United States Patent 11,421,016 (CANCER NEOEPITOPES) - sequence listing, part 20

SEQ ID NO: 879819 - protein, 9 aa, Homo Sapiens
KKEQEEEAL

SEQ ID NO: 879820 - protein, 9 aa, Homo Sapiens
PALSQPQKH

SEQ ID NO: 879821 - protein, 9 aa, Homo Sapiens
AGNAATVCK

SEQ ID NO: 879822 - protein, 9 aa, Homo Sapiens
PKKNAICEE

SEQ ID NO: 879823 - protein, 9 aa, Homo Sapiens
IINKSSEMG

SEQ ID NO: 879824 - protein, 9 aa, Homo Sapiens
LSETPPDGE

SEQ ID NO: 879825 - protein, 9 aa, Homo Sapiens
QNTLQTTIS

SEQ ID NO: 879826 - protein, 9 aa, Homo Sapiens
GKDSYWTLD

SEQ ID NO: 879827 - protein, 9 aa, Homo Sapiens
NSDHTEHQI

SEQ ID NO: 879828 - protein, 9 aa, Homo Sapiens
GKPILITGA

SEQ ID NO: 879829 - protein, 9 aa, Homo Sapiens
GVCNPQQHR

SEQ ID NO: 879830 - protein, 9 aa, Homo Sapiens
IEQPNVKWS

SEQ ID NO: 879831 - protein, 9 aa, Homo Sapiens
TQIISHVWE

SEQ ID NO: 879832 - protein, 9 aa, Homo Sapiens
NKVKDGLPN

SEQ ID NO: 879833 - protein, 9 aa, Homo Sapiens
YLNYGEEGV

SEQ ID NO: 879834 - protein, 9 aa, Homo Sapiens
GHKLPNELP

SEQ ID NO: 879835 - protein, 9 aa, Homo Sapiens
QFSGLERSI

SEQ ID NO: 879836 - protein, 9 aa, Homo Sapiens
QIDVHRLIK

SEQ ID NO: 879837 - protein, 9 aa, Homo Sapiens
KIRIEDPPH

SEQ ID NO: 879838 - protein, 9 aa, Homo Sapiens
RQIGIFSVR

SEQ ID NO: 879839 - protein, 9 aa, Homo Sapiens
VQNYKLIKS

SEQ ID NO: 879840 - protein, 9 aa, Homo Sapiens
LLVLTVYQD

SEQ ID NO: 879841 - protein, 9 aa, Homo Sapiens
ILHSKFIWQ

SEQ ID NO: 879842 - protein, 9 aa, Homo Sapiens
HGISSQISW

SEQ ID NO: 879843 - protein, 9 aa, Homo Sapiens
QSSKFQEGV

SEQ ID NO: 879844 - protein, 9 aa, Homo Sapiens
IQESRLFGA

SEQ ID NO: 879845 - protein, 9 aa, Homo Sapiens
RRPQNDRRN

SEQ ID NO: 879846 - protein, 9 aa, Homo Sapiens
LTEESTWCV

SEQ ID NO: 879847 - protein, 9 aa, Homo Sapiens
QKPRVNKSW

SEQ ID NO: 879848 - protein, 9 aa, Homo Sapiens
SDFTQEILP

SEQ ID NO: 879849 - protein, 9 aa, Homo Sapiens
AAKPAGPHL

SEQ ID NO: 879850 - protein, 9 aa, Homo Sapiens
VDLELSNLD

SEQ ID NO: 879851 - protein, 9 aa, Homo Sapiens
NPPAQTKNT

SEQ ID NO: 879852 - protein, 9 aa, Homo Sapiens
DRYVAVYQP

SEQ ID NO: 879853 - protein, 9 aa, Homo Sapiens
LCICCLLCE

SEQ ID NO: 879854 - protein, 9 aa, Homo Sapiens
ELQERNQIL

SEQ ID NO: 879855 - protein, 9 aa, Homo Sapiens
QIPILYRMC

SEQ ID NO: 879856 - protein, 9 aa, Homo Sapiens
WLTGEGMDE

SEQ ID NO: 879857 - protein, 9 aa, Homo Sapiens
LTLFRGAEY

SEQ ID NO: 879858 - protein, 9 aa, Homo Sapiens
KCPCSLCVS

SEQ ID NO: 879859 - protein, 9 aa, Homo Sapiens
ENMLLQQQL

SEQ ID NO: 879860 - protein, 9 aa, Homo Sapiens
YAWFWHPSY

SEQ ID NO: 879861 - protein, 9 aa, Homo Sapiens
VAHRNSLYV

SEQ ID NO: 879862 - protein, 9 aa, Homo Sapiens
SEQSLIKFF

SEQ ID NO: 879863 - protein, 9 aa, Homo Sapiens
LDGYYLVAC

SEQ ID NO: 879864 - protein, 9 aa, Homo Sapiens
NIEAPEGKL

SEQ ID NO: 879865 - protein, 9 aa, Homo Sapiens
NTSAEWLKV

SEQ ID NO: 879866 - protein, 9 aa, Homo Sapiens
YIDAGNFGS

SEQ ID NO: 879867 - protein, 9 aa, Homo Sapiens
AGNPGSLVS

SEQ ID NO: 879868 - protein, 9 aa, Homo Sapiens
MHTGEKSYK

SEQ ID NO: 879869 - protein, 9 aa, Homo Sapiens
NVREKRKSL

SEQ ID NO: 879870 - protein, 9 aa, Homo Sapiens
EPPQDMDEN

SEQ ID NO: 879871 - protein, 9 aa, Homo Sapiens
LNYVQERKN

SEQ ID NO: 879872 - protein, 9 aa, Homo Sapiens
PVARFGARR

SEQ ID NO: 879873 - protein, 9 aa, Homo Sapiens
FIAAFCFYF

SEQ ID NO: 879874 - protein, 9 aa, Homo Sapiens
LFDFDTFGG

SEQ ID NO: 879875 - protein, 9 aa, Homo Sapiens
QDSGLWSQA

SEQ ID NO: 879876 - protein, 9 aa, Homo Sapiens
HKCFVQVEN

SEQ ID NO: 879877 - protein, 9 aa, Homo Sapiens
TLETSLSKE

SEQ ID NO: 879878 - protein, 9 aa, Homo Sapiens
GTGSSNLWV

SEQ ID NO: 879879 - protein, 9 aa, Homo Sapiens
CTTDGRSNG

SEQ ID NO: 879880 - protein, 9 aa, Homo Sapiens
RHYDEYSAI

SEQ ID NO: 879881 - protein, 9 aa, Homo Sapiens
SWLEPVWFL

SEQ ID NO: 879882 - protein, 9 aa, Homo Sapiens
DQCEKQKLA

SEQ ID NO: 879883 - protein, 9 aa, Homo Sapiens
FQKSVDAGV

SEQ ID NO: 879884 - protein, 9 aa, Homo Sapiens
KLYLREKFE

SEQ ID NO: 879885 - protein, 9 aa, Homo Sapiens
QTLNINGQI

SEQ ID NO: 879886 - protein, 9 aa, Homo Sapiens
YKNIRIPER

SEQ ID NO: 879887 - protein, 9 aa, Homo Sapiens
LPGLLLGYH

SEQ ID NO: 879888 - protein, 9 aa, Homo Sapiens
RSRAPYPSA

SEQ ID NO: 879889 - protein, 9 aa, Homo Sapiens
VCILSSVDD

SEQ ID NO: 879890 - protein, 9 aa, Homo Sapiens
IYRYLKPEN

SEQ ID NO: 879891 - protein, 9 aa, Homo Sapiens
STQLPVAYQ

SEQ ID NO: 879892 - protein, 9 aa, Homo Sapiens
EAILTENQC

SEQ ID NO: 879893 - protein, 9 aa, Homo Sapiens
GKNCVIGCR

SEQ ID NO: 879894 - protein, 9 aa, Homo Sapiens
DALFFLKDL

SEQ ID NO: 879895 - protein, 9 aa, Homo Sapiens
WGPWGDCLR

SEQ ID NO: 879896 - protein, 9 aa, Homo Sapiens
QEWIKETFY

SEQ ID NO: 879897 - protein, 9 aa, Homo Sapiens
EKQDAWTII

SEQ ID NO: 879898 - protein, 9 aa, Homo Sapiens
DFFSGIVTA

SEQ ID NO: 879899 - protein, 9 aa, Homo Sapiens
FAFEKLIHF

SEQ ID NO: 879900 - protein, 9 aa, Homo Sapiens
DLPALNMQH

SEQ ID NO: 879901 - protein, 9 aa, Homo Sapiens
ATVINLSKK

SEQ ID NO: 879902 - protein, 9 aa, Homo Sapiens
PKLGNIANT

SEQ ID NO: 879903 - protein, 9 aa, Homo Sapiens
RLPGRPTQG

SEQ ID NO: 879904 - protein, 9 aa, Homo Sapiens
NVTSKEICN

SEQ ID NO: 879905 - protein, 9 aa, Homo Sapiens
YATQMNNAV

SEQ ID NO: 879906 - protein, 9 aa, Homo Sapiens
SRQCVGWRH

SEQ ID NO: 879907 - protein, 9 aa, Homo Sapiens
KLGTHLSKS

SEQ ID NO: 879908 - protein, 9 aa, Homo Sapiens
PWLLRLKSP

SEQ ID NO: 879909 - protein, 9 aa, Homo Sapiens
AVEKGTGAT

SEQ ID NO: 879910 - protein, 9 aa, Homo Sapiens
YHTNSCNRC

SEQ ID NO: 879911 - protein, 9 aa, Homo Sapiens
LAMGLICMI

SEQ ID NO: 879912 - protein, 9 aa, Homo Sapiens
LTDSCVQRR

SEQ ID NO: 879913 - protein, 9 aa, Homo Sapiens
IDEGNDGNN

SEQ ID NO: 879914 - protein, 9 aa, Homo Sapiens
RKCFSSRKK

SEQ ID NO: 879915 - protein, 9 aa, Homo Sapiens
QKGEIKPSL

SEQ ID NO: 879916 - protein, 9 aa, Homo Sapiens
ECDAAKHRL

SEQ ID NO: 879917 - protein, 9 aa, Homo Sapiens
GRAVCCVLE

SEQ ID NO: 879918 - protein, 9 aa, Homo Sapiens
SVNSNISKK

SEQ ID NO: 879919 - protein, 9 aa, Homo Sapiens
FDPSWRKCM

SEQ ID NO: 879920 - protein, 9 aa, Homo Sapiens
QGGSRMCCQ

SEQ ID NO: 879921 - protein, 9 aa, Homo Sapiens
HYRHRHCSR

SEQ ID NO: 879922 - protein, 9 aa, Homo Sapiens
VAGELKLWD

SEQ ID NO: 879923 - protein, 9 aa, Homo Sapiens
PDDVYAKHW

SEQ ID NO: 879924 - protein, 9 aa, Homo Sapiens
LDMMSVQAS

SEQ ID NO: 879925 - protein, 9 aa, Homo Sapiens
SLCILNINN

SEQ ID NO: 879926 - protein, 9 aa, Homo Sapiens
QHINLTTLS

SEQ ID NO: 879927 - protein, 9 aa, Homo Sapiens
ADKSVNYKT

SEQ ID NO: 879928 - protein, 9 aa, Homo Sapiens
QESEVFQVT

SEQ ID NO: 879929 - protein, 9 aa, Homo Sapiens
MVDALLFGN

SEQ ID NO: 879930 - protein, 9 aa, Homo Sapiens
ECRKTFICR

SEQ ID NO: 879931 - protein, 9 aa, Homo Sapiens
SRKKTPNLS

SEQ ID NO: 879932 - protein, 9 aa, Homo Sapiens
LDKRIEESS

SEQ ID NO: 879933 - protein, 9 aa, Homo Sapiens
VYRCVYKVQ

SEQ ID NO: 879934 - protein, 9 aa, Homo Sapiens
KAVFKHEGI

SEQ ID NO: 879935 - protein, 9 aa, Homo Sapiens
EYQIITDPG

SEQ ID NO: 879936 - protein, 9 aa, Homo Sapiens
QLIPQTTAR

SEQ ID NO: 879937 - protein, 9 aa, Homo Sapiens
SYLAVQSLS

SEQ ID NO: 879938 - protein, 9 aa, Homo Sapiens
LVHDIRQNE

SEQ ID NO: 879939 - protein, 9 aa, Homo Sapiens
TLGQIVFQR

SEQ ID NO: 879940 - protein, 9 aa, Homo Sapiens
DRVPAFRDK

SEQ ID NO: 879941 - protein, 9 aa, Homo Sapiens
EPTTNIQIW

SEQ ID NO: 879942 - protein, 9 aa, Homo Sapiens
EYLKSPLPD

SEQ ID NO: 879943 - protein, 9 aa, Homo Sapiens
RGCVRASYD

SEQ ID NO: 879944 - protein, 9 aa, Homo Sapiens
EAFYKINTL

SEQ ID NO: 879945 - protein, 9 aa, Homo Sapiens
RGSTLCFLC

SEQ ID NO: 879946 - protein, 9 aa, Homo Sapiens
VDTHAEMVH

SEQ ID NO: 879947 - protein, 9 aa, Homo Sapiens
FSPSLQNHY

SEQ ID NO: 879948 - protein, 9 aa, Homo Sapiens
GNPVYEQYY

SEQ ID NO: 879949 - protein, 9 aa, Homo Sapiens
SSRNFATMI

SEQ ID NO: 879950 - protein, 9 aa, Homo Sapiens
VDYLYQNAV

SEQ ID NO: 879951 - protein, 9 aa, Homo Sapiens
KQGFINLPE

SEQ ID NO: 879952 - protein, 9 aa, Homo Sapiens
ASHTMNKHS

SEQ ID NO: 879953 - protein, 9 aa, Homo Sapiens
LELFCCVLF

SEQ ID NO: 879954 - protein, 9 aa, Homo Sapiens
TGTGCPRPC

SEQ ID NO: 879955 - protein, 9 aa, Homo Sapiens
GVGFLMTFL

SEQ ID NO: 879956 - protein, 9 aa, Homo Sapiens
SQIQGGWTT

SEQ ID NO: 879957 - protein, 9 aa, Homo Sapiens
RKAFWLPDN

SEQ ID NO: 879958 - protein, 9 aa, Homo Sapiens
FLEIKEQIP

SEQ ID NO: 879959 - protein, 9 aa, Homo Sapiens
FSYSNLFQL

SEQ ID NO: 879960 - protein, 9 aa, Homo Sapiens
SKSQLQNRL

SEQ ID NO: 879961 - protein, 9 aa, Homo Sapiens
PDCIKQTLP

SEQ ID NO: 879962 - protein, 9 aa, Homo Sapiens
KHQKSSSDS

SEQ ID NO: 879963 - protein, 9 aa, Homo Sapiens
SFSVNFSLS

SEQ ID NO: 879964 - protein, 9 aa, Homo Sapiens
VVQIYHRKA

SEQ ID NO: 879965 - protein, 9 aa, Homo Sapiens
ECDKGRKGI

SEQ ID NO: 879966 - protein, 9 aa, Homo Sapiens
KTAQPYQPK

SEQ ID NO: 879967 - protein, 9 aa, Homo Sapiens
DKYHERPLP

SEQ ID NO: 879968 - protein, 9 aa, Homo Sapiens
ELFGKDAQQ

SEQ ID NO: 879969 - protein, 9 aa, Homo Sapiens
KGMGSGFAG

SEQ ID NO: 879970 - protein, 9 aa, Homo Sapiens
VILGQQLPK

SEQ ID NO: 879971 - protein, 9 aa, Homo Sapiens
MHDSSLVAS

SEQ ID NO: 879972 - protein, 9 aa, Homo Sapiens
GTLLMDVKV

SEQ ID NO: 879973 - protein, 9 aa, Homo Sapiens
VTVYVLVFT

SEQ ID NO: 879974 - protein, 9 aa, Homo Sapiens
TDDSKKSMI

SEQ ID NO: 879975 - protein, 9 aa, Homo Sapiens
LLMDVKVPM

SEQ ID NO: 879976 - protein, 9 aa, Homo Sapiens
ITNTFFGDD

SEQ ID NO: 879977 - protein, 9 aa, Homo Sapiens
AGRFGQDYS

SEQ ID NO: 879978 - protein, 9 aa, Homo Sapiens
SEDIFILLC

SEQ ID NO: 879979 - protein, 9 aa, Homo Sapiens
GSSDHPTLA

SEQ ID NO: 879980 - protein, 9 aa, Homo Sapiens
LVLRAGAGA

SEQ ID NO: 879981 - protein, 9 aa, Homo Sapiens
AQKKPPSSQ

SEQ ID NO: 879982 - protein, 9 aa, Homo Sapiens
LDRIEIIQV

SEQ ID NO: 879983 - protein, 9 aa, Homo Sapiens
KRELAKYSE

SEQ ID NO: 879984 - protein, 9 aa, Homo Sapiens
TRRQNPSCG

SEQ ID NO: 879985 - protein, 9 aa, Homo Sapiens
RETLELLYI

SEQ ID NO: 879986 - protein, 9 aa, Homo Sapiens
NSVLLIALE

SEQ ID NO: 879987 - protein, 9 aa, Homo Sapiens
PEIMESGYT

SEQ ID NO: 879988 - protein, 9 aa, Homo Sapiens
SSSMETSIK

SEQ ID NO: 879989 - protein, 9 aa, Homo Sapiens
MRTCECLVK

SEQ ID NO: 879990 - protein, 9 aa, Homo Sapiens
PCTLTARLS

SEQ ID NO: 879991 - protein, 9 aa, Homo Sapiens
LEQAGCLNW

SEQ ID NO: 879992 - protein, 9 aa, Homo Sapiens
QTPRIDPPL

SEQ ID NO: 879993 - protein, 9 aa, Homo Sapiens
PCDDIQKAR

SEQ ID NO: 879994 - protein, 9 aa, Homo Sapiens
KMIAKFQEE

SEQ ID NO: 879995 - protein, 9 aa, Homo Sapiens
EPLPGSLHE

SEQ ID NO: 879996 - protein, 9 aa, Homo Sapiens
ALNIINMAL

SEQ ID NO: 879997 - protein, 9 aa, Homo Sapiens
DEMIHKAQN

SEQ ID NO: 879998 - protein, 9 aa, Homo Sapiens
VALWECLVH

SEQ ID NO: 879999 - protein, 9 aa, Homo Sapiens
TRQHYYPMA

SEQ ID NO: 880000 - protein, 9 aa, Homo Sapiens
TLENVYTLL

SEQ ID NO: 880001 - protein, 9 aa, Homo Sapiens
YLDDRNTFQ

SEQ ID NO: 880002 - protein, 9 aa, Homo Sapiens
YKCNECGKL

SEQ ID NO: 880003 - protein, 9 aa, Homo Sapiens
EIWKVLTSQ

SEQ ID NO: 880004 - protein, 9 aa, Homo Sapiens
SGKGGPQGN

SEQ ID NO: 880005 - protein, 9 aa, Homo Sapiens
DSLTSQIST

SEQ ID NO: 880006 - protein, 9 aa, Homo Sapiens
LACLQCSQC

SEQ ID NO: 880007 - protein, 9 aa, Homo Sapiens
SKEFIETEL

SEQ ID NO: 880008 - protein, 9 aa, Homo Sapiens
CGETLSQIQ

SEQ ID NO: 880009 - protein, 9 aa, Homo Sapiens
ESQDNTPGQ

SEQ ID NO: 880010 - protein, 9 aa, Homo Sapiens
DKLTLELQD

SEQ ID NO: 880011 - protein, 9 aa, Homo Sapiens
STNVASTIS

SEQ ID NO: 880012 - protein, 9 aa, Homo Sapiens
FFMLLHLIQ

SEQ ID NO: 880013 - protein, 9 aa, Homo Sapiens
LDVFEVEKD

SEQ ID NO: 880014 - protein, 9 aa, Homo Sapiens
IRKNVENNC

SEQ ID NO: 880015 - protein, 9 aa, Homo Sapiens
HGEGVKQCG

SEQ ID NO: 880016 - protein, 9 aa, Homo Sapiens
SQSLVQEGT

SEQ ID NO: 880017 - protein, 9 aa, Homo Sapiens
FAQMVQLHK

SEQ ID NO: 880018 - protein, 9 aa, Homo Sapiens
LEKGSIKSL

SEQ ID NO: 880019 - protein, 9 aa, Homo Sapiens
DSYWTLDPR

SEQ ID NO: 880020 - protein, 9 aa, Homo Sapiens
HQIIHTMEK

SEQ ID NO: 880021 - protein, 9 aa, Homo Sapiens
LETGTPQPG

SEQ ID NO: 880022 - protein, 9 aa, Homo Sapiens
DKGLDSAEG

SEQ ID NO: 880023 - protein, 9 aa, Homo Sapiens
SSSSLSSHV

SEQ ID NO: 880024 - protein, 9 aa, Homo Sapiens
DVKINDEEI

SEQ ID NO: 880025 - protein, 9 aa, Homo Sapiens
GWQSPFLRI

SEQ ID NO: 880026 - protein, 9 aa, Homo Sapiens
ELFTTTMRL

SEQ ID NO: 880027 - protein, 9 aa, Homo Sapiens
MECLSVDYG

SEQ ID NO: 880028 - protein, 9 aa, Homo Sapiens
ADKLSWDLI

SEQ ID NO: 880029 - protein, 9 aa, Homo Sapiens
CLIFLWKKY

SEQ ID NO: 880030 - protein, 9 aa, Homo Sapiens
CCLFLEYVT

SEQ ID NO: 880031 - protein, 9 aa, Homo Sapiens
QFVSKKVSE

SEQ ID NO: 880032 - protein, 9 aa, Homo Sapiens
YLENDIKPA

SEQ ID NO: 880033 - protein, 9 aa, Homo Sapiens
KIPKGQTSV

SEQ ID NO: 880034 - protein, 9 aa, Homo Sapiens
TNMSSMNER

SEQ ID NO: 880035 - protein, 9 aa, Homo Sapiens
LTWEAMPRS

SEQ ID NO: 880036 - protein, 9 aa, Homo Sapiens
LFNTKEEIL

SEQ ID NO: 880037 - protein, 9 aa, Homo Sapiens
DYIQTQIIS

SEQ ID NO: 880038 - protein, 9 aa, Homo Sapiens
DKISKEFLT

SEQ ID NO: 880039 - protein, 9 aa, Homo Sapiens
QERNQILEN

SEQ ID NO: 880040 - protein, 9 aa, Homo Sapiens
AALVGRCLV

SEQ ID NO: 880041 - protein, 9 aa, Homo Sapiens
SDKITAVSL

SEQ ID NO: 880042 - protein, 9 aa, Homo Sapiens
QELFKHISE

SEQ ID NO: 880043 - protein, 9 aa, Homo Sapiens
PLLSNAKCK

SEQ ID NO: 880044 - protein, 9 aa, Homo Sapiens
DKPYECVEC

SEQ ID NO: 880045 - protein, 9 aa, Homo Sapiens
YINPAHAIY

SEQ ID NO: 880046 - protein, 9 aa, Homo Sapiens
IQLSLEEWQ

SEQ ID NO: 880047 - protein, 9 aa, Homo Sapiens
NIHTGGKPY

SEQ ID NO: 880048 - protein, 9 aa, Homo Sapiens
KGIGEVVAL

SEQ ID NO: 880049 - protein, 9 aa, Homo Sapiens
PLIPCNLMD

SEQ ID NO: 880050 - protein, 9 aa, Homo Sapiens
MCCQQEFFV

SEQ ID NO: 880051 - protein, 9 aa, Homo Sapiens
ESFAEHQSG

SEQ ID NO: 880052 - protein, 9 aa, Homo Sapiens
RQRTRPYLF

SEQ ID NO: 880053 - protein, 9 aa, Homo Sapiens
CNPQTGACF

SEQ ID NO: 880054 - protein, 9 aa, Homo Sapiens
VIKVSARVC

SEQ ID NO: 880055 - protein, 9 aa, Homo Sapiens
KEYPNTALK

SEQ ID NO: 880056 - protein, 9 aa, Homo Sapiens
DSENGGTEP

SEQ ID NO: 880057 - protein, 9 aa, Homo Sapiens
SEEKDPEKF

SEQ ID NO: 880058 - protein, 9 aa, Homo Sapiens
YLYYLSVNG

SEQ ID NO: 880059 - protein, 9 aa, Homo Sapiens
GAFQSSEEQ

SEQ ID NO: 880060 - protein, 9 aa, Homo Sapiens
KEAKECRLQ

SEQ ID NO: 880061 - protein, 9 aa, Homo Sapiens
RKSSVSGIC

SEQ ID NO: 880062 - protein, 9 aa, Homo Sapiens
LKSHLQIHT

SEQ ID NO: 880063 - protein, 9 aa, Homo Sapiens
EDDINASYV

SEQ ID NO: 880064 - protein, 9 aa, Homo Sapiens
ADNIISKTH

SEQ ID NO: 880065 - protein, 9 aa, Homo Sapiens
AIIASCLRK

SEQ ID NO: 880066 - protein, 9 aa, Homo Sapiens
FKYDMWDRL

SEQ ID NO: 880067 - protein, 9 aa, Homo Sapiens
DRNVYITID

SEQ ID NO: 880068 - protein, 9 aa, Homo Sapiens
SNQGEYICS

SEQ ID NO: 880069 - protein, 9 aa, Homo Sapiens
VQAVDKYLG

SEQ ID NO: 880070 - protein, 9 aa, Homo Sapiens
RPLGLKLCS

SEQ ID NO: 880071 - protein, 9 aa, Homo Sapiens
LENQAMDNH

SEQ ID NO: 880072 - protein, 9 aa, Homo Sapiens
SYVKLQTNL

SEQ ID NO: 880073 - protein, 9 aa, Homo Sapiens
DKAQPFPLP

SEQ ID NO: 880074 - protein, 9 aa, Homo Sapiens
PGRVMLQNL

SEQ ID NO: 880075 - protein, 9 aa, Homo Sapiens
IPKKGLIKK

SEQ ID NO: 880076 - protein, 9 aa, Homo Sapiens
VLSSLQGVT

SEQ ID NO: 880077 - protein, 9 aa, Homo Sapiens
YINNMNYKI

SEQ ID NO: 880078 - protein, 9 aa, Homo Sapiens
TQYLDKVMS

SEQ ID NO: 880079 - protein, 9 aa, Homo Sapiens
RSKKLIKKD

SEQ ID NO: 880080 - protein, 9 aa, Homo Sapiens
QVKIRNRTE

SEQ ID NO: 880081 - protein, 9 aa, Homo Sapiens
CIAIDNPVH

SEQ ID NO: 880082 - protein, 9 aa, Homo Sapiens
FGVTVIDNK

SEQ ID NO: 880083 - protein, 9 aa, Homo Sapiens
HLSLMMDKT

SEQ ID NO: 880084 - protein, 9 aa, Homo Sapiens
IITPFTDSL

SEQ ID NO: 880085 - protein, 9 aa, Homo Sapiens
SHELALAGQ

SEQ ID NO: 880086 - protein, 9 aa, Homo Sapiens
VDEIVMTLK

SEQ ID NO: 880087 - protein, 9 aa, Homo Sapiens
AIIFHNETS

SEQ ID NO: 880088 - protein, 9 aa, Homo Sapiens
CGKCFRHHT

SEQ ID NO: 880089 - protein, 9 aa, Homo Sapiens
CHIPIKINS

SEQ ID NO: 880090 - protein, 9 aa, Homo Sapiens
LGIIICSCI

SEQ ID NO: 880091 - protein, 9 aa, Homo Sapiens
AKMKMATNI

SEQ ID NO: 880092 - protein, 9 aa, Homo Sapiens
ICGQERFQV

SEQ ID NO: 880093 - protein, 9 aa, Homo Sapiens
NSLFKFKSS

SEQ ID NO: 880094 - protein, 9 aa, Homo Sapiens
NQRQKQKQM

SEQ ID NO: 880095 - protein, 9 aa, Homo Sapiens
EDEWESIFY

SEQ ID NO: 880096 - protein, 9 aa, Homo Sapiens
NKLFQPTEM

SEQ ID NO: 880097 - protein, 9 aa, Homo Sapiens
KIRYLPKGF

SEQ ID NO: 880098 - protein, 9 aa, Homo Sapiens
CFGLLAGRF

SEQ ID NO: 880099 - protein, 9 aa, Homo Sapiens
ACGLTTVSV

SEQ ID NO: 880100 - protein, 9 aa, Homo Sapiens
SEMQALAEL

SEQ ID NO: 880101 - protein, 9 aa, Homo Sapiens
WTLFSRGLS

SEQ ID NO: 880102 - protein, 9 aa, Homo Sapiens
QELPFRKNK

SEQ ID NO: 880103 - protein, 9 aa, Homo Sapiens
QDSAWKNMS

SEQ ID NO: 880104 - protein, 9 aa, Homo Sapiens
RHTAAAAAE

SEQ ID NO: 880105 - protein, 9 aa, Homo Sapiens
CFYFCTFAF

SEQ ID NO: 880106 - protein, 9 aa, Homo Sapiens
LISFQRHMR

SEQ ID NO: 880107 - protein, 9 aa, Homo Sapiens
AEKLLCMYQ

SEQ ID NO: 880108 - protein, 9 aa, Homo Sapiens
NDIILYCNS

SEQ ID NO: 880109 - protein, 9 aa, Homo Sapiens
HTAKKAPNG

SEQ ID NO: 880110 - protein, 9 aa, Homo Sapiens
IIFGDNLSN

SEQ ID NO: 880111 - protein, 9 aa, Homo Sapiens
EKKSQEEIE

SEQ ID NO: 880112 - protein, 9 aa, Homo Sapiens
QKLLGLEVT

SEQ ID NO: 880113 - protein, 9 aa, Homo Sapiens
RICVGENLS

SEQ ID NO: 880114 - protein, 9 aa, Homo Sapiens
WKPFNILIL

SEQ ID NO: 880115 - protein, 9 aa, Homo Sapiens
AADYDNFSC

SEQ ID NO: 880116 - protein, 9 aa, Homo Sapiens
SNPRGPSPA

SEQ ID NO: 880117 - protein, 9 aa, Homo Sapiens
TLGLLWQEA

SEQ ID NO: 880118 - protein, 9 aa, Homo Sapiens
NPLKLARYF

SEQ ID NO: 880119 - protein, 9 aa, Homo Sapiens
TVHPKEIWT

SEQ ID NO: 880120 - protein, 9 aa, Homo Sapiens
SKWLGPENI

SEQ ID NO: 880121 - protein, 9 aa, Homo Sapiens
QSAFKADEF

SEQ ID NO: 880122 - protein, 9 aa, Homo Sapiens
FKKQLALST

SEQ ID NO: 880123 - protein, 9 aa, Homo Sapiens
ENTSDLLRK

SEQ ID NO: 880124 - protein, 9 aa, Homo Sapiens
HGAPCNPQT

SEQ ID NO: 880125 - protein, 9 aa, Homo Sapiens
ALVWHQQDW

SEQ ID NO: 880126 - protein, 9 aa, Homo Sapiens
NYCQNPRGE

SEQ ID NO: 880127 - protein, 9 aa, Homo Sapiens
HHKLKTVEE

SEQ ID NO: 880128 - protein, 9 aa, Homo Sapiens
KVLRKIQKL

SEQ ID NO: 880129 - protein, 9 aa, Homo Sapiens
TTNKRRVIV

SEQ ID NO: 880130 - protein, 9 aa, Homo Sapiens
NGRILHMLN

SEQ ID NO: 880131 - protein, 9 aa, Homo Sapiens
GVQNGTDKD

SEQ ID NO: 880132 - protein, 9 aa, Homo Sapiens
HKNIHTGGK

SEQ ID NO: 880133 - protein, 9 aa, Homo Sapiens
HPNLIMGFN

SEQ ID NO: 880134 - protein, 9 aa, Homo Sapiens
AIQNFLALD

SEQ ID NO: 880135 - protein, 9 aa, Homo Sapiens
DRAWHVKCA

SEQ ID NO: 880136 - protein, 9 aa, Homo Sapiens
LPEQITKFM

SEQ ID NO: 880137 - protein, 9 aa, Homo Sapiens
KSLDWEKQH

SEQ ID NO: 880138 - protein, 9 aa, Homo Sapiens
VIGCRCVLK

SEQ ID NO: 880139 - protein, 9 aa, Homo Sapiens
EHFQSYYLD

SEQ ID NO: 880140 - protein, 9 aa, Homo Sapiens
ERTDAELFL

SEQ ID NO: 880141 - protein, 9 aa, Homo Sapiens
GYNVYGTKS

SEQ ID NO: 880142 - protein, 9 aa, Homo Sapiens
NTEPLQECI

SEQ ID NO: 880143 - protein, 9 aa, Homo Sapiens
CDSLLHHSD

SEQ ID NO: 880144 - protein, 9 aa, Homo Sapiens
FACHREPCL

SEQ ID NO: 880145 - protein, 9 aa, Homo Sapiens
CEKGSAKVA

SEQ ID NO: 880146 - protein, 9 aa, Homo Sapiens
NVEDIKRTP

SEQ ID NO: 880147 - protein, 9 aa, Homo Sapiens
DVNNNAPAF

SEQ ID NO: 880148 - protein, 9 aa, Homo Sapiens
MATNNPHLP

SEQ ID NO: 880149 - protein, 9 aa, Homo Sapiens
TYEKCFGLL

SEQ ID NO: 880150 - protein, 9 aa, Homo Sapiens
EPTCRNQTR

SEQ ID NO: 880151 - protein, 9 aa, Homo Sapiens
SALGKSVQQ

SEQ ID NO: 880152 - protein, 9 aa, Homo Sapiens
QINHIQNGI

SEQ ID NO: 880153 - protein, 9 aa, Homo Sapiens
LRSRTLPVG

SEQ ID NO: 880154 - protein, 9 aa, Homo Sapiens
LLEDNPSIC

SEQ ID NO: 880155 - protein, 9 aa, Homo Sapiens
KDSLYVPSL

SEQ ID NO: 880156 - protein, 9 aa, Homo Sapiens
NECMKIKIL

SEQ ID NO: 880157 - protein, 9 aa, Homo Sapiens
ELLLYPSQR

SEQ ID NO: 880158 - protein, 9 aa, Homo Sapiens
TLIGAGIQI

SEQ ID NO: 880159 - protein, 9 aa, Homo Sapiens
NASFNTFFC

SEQ ID NO: 880160 - protein, 9 aa, Homo Sapiens
EEENTCKTQ

SEQ ID NO: 880161 - protein, 9 aa, Homo Sapiens
KAVKKSLEG

SEQ ID NO: 880162 - protein, 9 aa, Homo Sapiens
SVEHEKPAQ

SEQ ID NO: 880163 - protein, 9 aa, Homo Sapiens
KASISSAEK

SEQ ID NO: 880164 - protein, 9 aa, Homo Sapiens
ICHEVSFKN

SEQ ID NO: 880165 - protein, 9 aa, Homo Sapiens
TVVYAQGLQ

SEQ ID NO: 880166 - protein, 9 aa, Homo Sapiens
INNQNKSVV

SEQ ID NO: 880167 - protein, 9 aa, Homo Sapiens
EQKTDNGKD

SEQ ID NO: 880168 - protein, 9 aa, Homo Sapiens
TLHSAPAFL

SEQ ID NO: 880169 - protein, 9 aa, Homo Sapiens
DISEMQALA

SEQ ID NO: 880170 - protein, 9 aa, Homo Sapiens
EGTEVSASK

SEQ ID NO: 880171 - protein, 9 aa, Homo Sapiens
HLKFKHEEI

SEQ ID NO: 880172 - protein, 9 aa, Homo Sapiens
QQLQTSFQD

SEQ ID NO: 880173 - protein, 9 aa, Homo Sapiens
AMDNHMELV

SEQ ID NO: 880174 - protein, 9 aa, Homo Sapiens
TPPQSETIS

SEQ ID NO: 880175 - protein, 9 aa, Homo Sapiens
PFLNIDKLQ

SEQ ID NO: 880176 - protein, 9 aa, Homo Sapiens
YQIFREKHG

SEQ ID NO: 880177 - protein, 9 aa, Homo Sapiens
NGDCPESLQ

SEQ ID NO: 880178 - protein, 9 aa, Homo Sapiens
KTALFPQYT

SEQ ID NO: 880179 - protein, 9 aa, Homo Sapiens
EKLRKRTKE

SEQ ID NO: 880180 - protein, 9 aa, Homo Sapiens
EYFTLDVKI

SEQ ID NO: 880181 - protein, 9 aa, Homo Sapiens
FQDLNKKAR

SEQ ID NO: 880182 - protein, 9 aa, Homo Sapiens
GNKQQDCEP

SEQ ID NO: 880183 - protein, 9 aa, Homo Sapiens
AIQILETIS

SEQ ID NO: 880184 - protein, 9 aa, Homo Sapiens
HHRLHGGDK

SEQ ID NO: 880185 - protein, 9 aa, Homo Sapiens
NLYATQMNN

SEQ ID NO: 880186 - protein, 9 aa, Homo Sapiens
TSDFLPSQP

SEQ ID NO: 880187 - protein, 9 aa, Homo Sapiens
EDDDDDKGY

SEQ ID NO: 880188 - protein, 9 aa, Homo Sapiens
LQDVWHIYS

SEQ ID NO: 880189 - protein, 9 aa, Homo Sapiens
RNLYMQIRD

SEQ ID NO: 880190 - protein, 9 aa, Homo Sapiens
FREARKITS

SEQ ID NO: 880191 - protein, 9 aa, Homo Sapiens
IFMILWLKG

SEQ ID NO: 880192 - protein, 9 aa, Homo Sapiens
SVRWATHIQ

SEQ ID NO: 880193 - protein, 9 aa, Homo Sapiens
EALEDKLEN

SEQ ID NO: 880194 - protein, 9 aa, Homo Sapiens
NYVSLAVLQ

SEQ ID NO: 880195 - protein, 9 aa, Homo Sapiens
SRPLSQRQL

SEQ ID NO: 880196 - protein, 9 aa, Homo Sapiens
DCRKTFCVK

SEQ ID NO: 880197 - protein, 9 aa, Homo Sapiens
SDVMSFNQT

SEQ ID NO: 880198 - protein, 9 aa, Homo Sapiens
ASTISMLLG

SEQ ID NO: 880199 - protein, 9 aa, Homo Sapiens
ALSPPTCRS

SEQ ID NO: 880200 - protein, 9 aa, Homo Sapiens
SKSPRWRRS

SEQ ID NO: 880201 - protein, 9 aa, Homo Sapiens
LSGGGGSQS

SEQ ID NO: 880202 - protein, 9 aa, Homo Sapiens
EQEHLRKYL

SEQ ID NO: 880203 - protein, 9 aa, Homo Sapiens
KWNKALQVR

SEQ ID NO: 880204 - protein, 9 aa, Homo Sapiens
NDFMGAMPF

SEQ ID NO: 880205 - protein, 9 aa, Homo Sapiens
DNKRQTLQR

SEQ ID NO: 880206 - protein, 9 aa, Homo Sapiens
IQILATLED

SEQ ID NO: 880207 - protein, 9 aa, Homo Sapiens
FLSHIQNIL

SEQ ID NO: 880208 - protein, 9 aa, Homo Sapiens
YDLAESYKV

SEQ ID NO: 880209 - protein, 9 aa, Homo Sapiens
HFFLQGDKQ

SEQ ID NO: 880210 - protein, 9 aa, Homo Sapiens
WKSFSFVCV

SEQ ID NO: 880211 - protein, 9 aa, Homo Sapiens
TDPWLLRLK

SEQ ID NO: 880212 - protein, 9 aa, Homo Sapiens
INTEERLKG

SEQ ID NO: 880213 - protein, 9 aa, Homo Sapiens
GIEYQDKPL

SEQ ID NO: 880214 - protein, 9 aa, Homo Sapiens
FQSLILVPN

SEQ ID NO: 880215 - protein, 9 aa, Homo Sapiens
GSDIGYGFG

SEQ ID NO: 880216 - protein, 9 aa, Homo Sapiens
LNKLFQPTE

SEQ ID NO: 880217 - protein, 9 aa, Homo Sapiens
LAKDIEEEL

SEQ ID NO: 880218 - protein, 9 aa, Homo Sapiens
DHRSQRRHA

SEQ ID NO: 880219 - protein, 9 aa, Homo Sapiens
SFLMPSDLQ

SEQ ID NO: 880220 - protein, 9 aa, Homo Sapiens
YTPPSVLPS

SEQ ID NO: 880221 - protein, 9 aa, Homo Sapiens
CHQISHTGE

SEQ ID NO: 880222 - protein, 9 aa, Homo Sapiens
STPRCTQQA

SEQ ID NO: 880223 - protein, 9 aa, Homo Sapiens
RWRIRQDEE

SEQ ID NO: 880224 - protein, 9 aa, Homo Sapiens
AFSLAEGLQ

SEQ ID NO: 880225 - protein, 9 aa, Homo Sapiens
PQLMGIIPQ

SEQ ID NO: 880226 - protein, 9 aa, Homo Sapiens
NFLEDKSIL

SEQ ID NO: 880227 - protein, 9 aa, Homo Sapiens
TMNKHSSRS

SEQ ID NO: 880228 - protein, 9 aa, Homo Sapiens
CQQGNFQYD

SEQ ID NO: 880229 - protein, 9 aa, Homo Sapiens
EAKGLLYET

SEQ ID NO: 880230 - protein, 9 aa, Homo Sapiens
TPKFSTFRA

SEQ ID NO: 880231 - protein, 9 aa, Homo Sapiens
VFDGDKHSI

SEQ ID NO: 880232 - protein, 9 aa, Homo Sapiens
HAAITADIQ

SEQ ID NO: 880233 - protein, 9 aa, Homo Sapiens
KYSKPPEKA

SEQ ID NO: 880234 - protein, 9 aa, Homo Sapiens
FLNNLNLGG

SEQ ID NO: 880235 - protein, 9 aa, Homo Sapiens
KEPEYVPWM

SEQ ID NO: 880236 - protein, 9 aa, Homo Sapiens
TMASKHSAW

SEQ ID NO: 880237 - protein, 9 aa, Homo Sapiens
KNDFEQGKL

SEQ ID NO: 880238 - protein, 9 aa, Homo Sapiens
ATLNNLMSR

SEQ ID NO: 880239 - protein, 9 aa, Homo Sapiens
GVQQIPIES

SEQ ID NO: 880240 - protein, 9 aa, Homo Sapiens
LFGLNNCSS

SEQ ID NO: 880241 - protein, 9 aa, Homo Sapiens
LQRTSTSNK

SEQ ID NO: 880242 - protein, 9 aa, Homo Sapiens
QGLVVGIYL

SEQ ID NO: 880243 - protein, 9 aa, Homo Sapiens
MREYECMKT

SEQ ID NO: 880244 - protein, 9 aa, Homo Sapiens
IDYLRLNKE

SEQ ID NO: 880245 - protein, 9 aa, Homo Sapiens
NNSPEDLGL

SEQ ID NO: 880246 - protein, 9 aa, Homo Sapiens
GGLAVSDAC

SEQ ID NO: 880247 - protein, 9 aa, Homo Sapiens
NVDRKEKST

SEQ ID NO: 880248 - protein, 9 aa, Homo Sapiens
SDIGYGFGG

SEQ ID NO: 880249 - protein, 9 aa, Homo Sapiens
LFLSHIQNI

SEQ ID NO: 880250 - protein, 9 aa, Homo Sapiens
QVRQEPVPE

SEQ ID NO: 880251 - protein, 9 aa, Homo Sapiens
VQTTTFQVF

SEQ ID NO: 880252 - protein, 9 aa, Homo Sapiens
KFYLFAERK

SEQ ID NO: 880253 - protein, 9 aa, Homo Sapiens
ISDDKVSTI

SEQ ID NO: 880254 - protein, 9 aa, Homo Sapiens
KTIGQVLAQ

SEQ ID NO: 880255 - protein, 9 aa, Homo Sapiens
ICVGENLSA

SEQ ID NO: 880256 - protein, 9 aa, Homo Sapiens
TCSATAHPA

SEQ ID NO: 880257 - protein, 9 aa, Homo Sapiens
KLATRALPE

SEQ ID NO: 880258 - protein, 9 aa, Homo Sapiens
NHFEGTRSE

SEQ ID NO: 880259 - protein, 9 aa, Homo Sapiens
SLHAKGAKI

SEQ ID NO: 880260 - protein, 9 aa, Homo Sapiens
QEQGKFIYL

SEQ ID NO: 880261 - protein, 9 aa, Homo Sapiens
DKQDETQTK

SEQ ID NO: 880262 - protein, 9 aa, Homo Sapiens
EVFILGVVY

SEQ ID NO: 880263 - protein, 9 aa, Homo Sapiens
DLAEYTFLF

SEQ ID NO: 880264 - protein, 9 aa, Homo Sapiens
PDHELFTAY

SEQ ID NO: 880265 - protein, 9 aa, Homo Sapiens
RSAPFIECN

SEQ ID NO: 880266 - protein, 9 aa, Homo Sapiens
RTLFLHTRN

SEQ ID NO: 880267 - protein, 9 aa, Homo Sapiens
NTTTAYVLQ

SEQ ID NO: 880268 - protein, 9 aa, Homo Sapiens
KNLMASELD

SEQ ID NO: 880269 - protein, 9 aa, Homo Sapiens
RVSGRKENR

SEQ ID NO: 880270 - protein, 9 aa, Homo Sapiens
NIELPTIIH

SEQ ID NO: 880271 - protein, 9 aa, Homo Sapiens
TGDKPFGCA

SEQ ID NO: 880272 - protein, 9 aa, Homo Sapiens
RNLILDSMK

SEQ ID NO: 880273 - protein, 9 aa, Homo Sapiens
TQPRDEDYK

SEQ ID NO: 880274 - protein, 9 aa, Homo Sapiens
CLKKAIDIT

SEQ ID NO: 880275 - protein, 9 aa, Homo Sapiens
PTLENVYTL

SEQ ID NO: 880276 - protein, 9 aa, Homo Sapiens
PVVGMWPDP

SEQ ID NO: 880277 - protein, 9 aa, Homo Sapiens
REFDQFGTI

SEQ ID NO: 880278 - protein, 9 aa, Homo Sapiens
GKAKWEALN

SEQ ID NO: 880279 - protein, 9 aa, Homo Sapiens
GGRDYAFAK

SEQ ID NO: 880280 - protein, 9 aa, Homo Sapiens
PVEDKRPEK

SEQ ID NO: 880281 - protein, 9 aa, Homo Sapiens
TALVKCLPV

SEQ ID NO: 880282 - protein, 9 aa, Homo Sapiens
PSPQHTNQT

SEQ ID NO: 880283 - protein, 9 aa, Homo Sapiens
GFYKVDYAS

SEQ ID NO: 880284 - protein, 9 aa, Homo Sapiens
QNILRALDV

SEQ ID NO: 880285 - protein, 9 aa, Homo Sapiens
ISGCCSGEK

SEQ ID NO: 880286 - protein, 9 aa, Homo Sapiens
NLSALQTFR

SEQ ID NO: 880287 - protein, 9 aa, Homo Sapiens
KKVMVMISS

SEQ ID NO: 880288 - protein, 9 aa, Homo Sapiens
ILFRGQQIQ

SEQ ID NO: 880289 - protein, 9 aa, Homo Sapiens
RNKSCEMSS

SEQ ID NO: 880290 - protein, 9 aa, Homo Sapiens
HSSLPIHKL

SEQ ID NO: 880291 - protein, 9 aa, Homo Sapiens
LANLMGLAE

SEQ ID NO: 880292 - protein, 9 aa, Homo Sapiens
QKRWFQFFC

SEQ ID NO: 880293 - protein, 9 aa, Homo Sapiens
WTVPSDNAV

SEQ ID NO: 880294 - protein, 9 aa, Homo Sapiens
CLETGTPQP

SEQ ID NO: 880295 - protein, 9 aa, Homo Sapiens
VFEVEKDGE

SEQ ID NO: 880296 - protein, 9 aa, Homo Sapiens
EMDIRNIFL

SEQ ID NO: 880297 - protein, 9 aa, Homo Sapiens
RVLHSRDAG

SEQ ID NO: 880298 - protein, 9 aa, Homo Sapiens
EFWQKVMLG

SEQ ID NO: 880299 - protein, 9 aa, Homo Sapiens
AEEYEHIAI

SEQ ID NO: 880300 - protein, 9 aa, Homo Sapiens
GPTLLQAEN

SEQ ID NO: 880301 - protein, 9 aa, Homo Sapiens
IEEDINKIY

SEQ ID NO: 880302 - protein, 9 aa, Homo Sapiens
LKTIKNKQK

SEQ ID NO: 880303 - protein, 9 aa, Homo Sapiens
SRVCIKGAE

SEQ ID NO: 880304 - protein, 9 aa, Homo Sapiens
IWLLVVIGV

SEQ ID NO: 880305 - protein, 9 aa, Homo Sapiens
KKPRRLCTL

SEQ ID NO: 880306 - protein, 9 aa, Homo Sapiens
CFLYANRTP

SEQ ID NO: 880307 - protein, 9 aa, Homo Sapiens
LKSQIKELV

SEQ ID NO: 880308 - protein, 9 aa, Homo Sapiens
LYQKVYVIG

SEQ ID NO: 880309 - protein, 9 aa, Homo Sapiens
GIDWDNIWN

SEQ ID NO: 880310 - protein, 9 aa, Homo Sapiens
WQKRFSSTD

SEQ ID NO: 880311 - protein, 9 aa, Homo Sapiens
IIHNREKAY

SEQ ID NO: 880312 - protein, 9 aa, Homo Sapiens
KTVSTMRCK

SEQ ID NO: 880313 - protein, 9 aa, Homo Sapiens
APHIHRWTI

SEQ ID NO: 880314 - protein, 9 aa, Homo Sapiens
WKYNGNVED

SEQ ID NO: 880315 - protein, 9 aa, Homo Sapiens
PRNNKRKTK

SEQ ID NO: 880316 - protein, 9 aa, Homo Sapiens
SVLGVCLGN

SEQ ID NO: 880317 - protein, 9 aa, Homo Sapiens
AGRDHLLTC

SEQ ID NO: 880318 - protein, 9 aa, Homo Sapiens
SVIYVIFGL

SEQ ID NO: 880319 - protein, 9 aa, Homo Sapiens
GLCALDYLY

SEQ ID NO: 880320 - protein, 9 aa, Homo Sapiens
KLTKLNVSK

SEQ ID NO: 880321 - protein, 9 aa, Homo Sapiens
HSILWDTIS

SEQ ID NO: 880322 - protein, 9 aa, Homo Sapiens
NSSLTEHQI

SEQ ID NO: 880323 - protein, 9 aa, Homo Sapiens
CMQKYHKSN

SEQ ID NO: 880324 - protein, 9 aa, Homo Sapiens
ITKKTFIGL

SEQ ID NO: 880325 - protein, 9 aa, Homo Sapiens
QNPYSIDNN

SEQ ID NO: 880326 - protein, 9 aa, Homo Sapiens
IIPIDDKLY

SEQ ID NO: 880327 - protein, 9 aa, Homo Sapiens
HQLQNMGKE

SEQ ID NO: 880328 - protein, 9 aa, Homo Sapiens
RGELQRFLS

SEQ ID NO: 880329 - protein, 9 aa, Homo Sapiens
VHDARRVYL

SEQ ID NO: 880330 - protein, 9 aa, Homo Sapiens
CPPGWKWED

SEQ ID NO: 880331 - protein, 9 aa, Homo Sapiens
NGFDDNNPP

SEQ ID NO: 880332 - protein, 9 aa, Homo Sapiens
SSDLEIDKL

SEQ ID NO: 880333 - protein, 9 aa, Homo Sapiens
VPPLDATWP

SEQ ID NO: 880334 - protein, 9 aa, Homo Sapiens
DFNWGKYLM

SEQ ID NO: 880335 - protein, 9 aa, Homo Sapiens
PLRELFVDD

SEQ ID NO: 880336 - protein, 9 aa, Homo Sapiens
YLNSFQTHE

SEQ ID NO: 880337 - protein, 9 aa, Homo Sapiens
IHMDCLRWL

SEQ ID NO: 880338 - protein, 9 aa, Homo Sapiens
YMQIYKKGD

SEQ ID NO: 880339 - protein, 9 aa, Homo Sapiens
GDNKYYDAY

SEQ ID NO: 880340 - protein, 9 aa, Homo Sapiens
AHYCSPTGT

SEQ ID NO: 880341 - protein, 9 aa, Homo Sapiens
IYLFYSIIT

SEQ ID NO: 880342 - protein, 9 aa, Homo Sapiens
NPPTTTEVT

SEQ ID NO: 880343 - protein, 9 aa, Homo Sapiens
HSIFTVEGA

SEQ ID NO: 880344 - protein, 9 aa, Homo Sapiens
AQDLPQNQK

SEQ ID NO: 880345 - protein, 9 aa, Homo Sapiens
TSKQIRKDI

SEQ ID NO: 880346 - protein, 9 aa, Homo Sapiens
KNPKEDKKP

SEQ ID NO: 880347 - protein, 9 aa, Homo Sapiens
IAWVSTLPF

SEQ ID NO: 880348 - protein, 9 aa, Homo Sapiens
TRTHQVVQQ

SEQ ID NO: 880349 - protein, 9 aa, Homo Sapiens
DSHSEHERQ

SEQ ID NO: 880350 - protein, 9 aa, Homo Sapiens
FQLAEFKAP

SEQ ID NO: 880351 - protein, 9 aa, Homo Sapiens
MLVHSRTPQ

SEQ ID NO: 880352 - protein, 9 aa, Homo Sapiens
PDLLRSGEY

SEQ ID NO: 880353 - protein, 9 aa, Homo Sapiens
LLLCLKHGA

SEQ ID NO: 880354 - protein, 9 aa, Homo Sapiens
FKVSVSSYE

SEQ ID NO: 880355 - protein, 9 aa, Homo Sapiens
PEPFILFQL

SEQ ID NO: 880356 - protein, 9 aa, Homo Sapiens
LTINLHVVI

SEQ ID NO: 880357 - protein, 9 aa, Homo Sapiens
SILYDHENA

SEQ ID NO: 880358 - protein, 9 aa, Homo Sapiens
IRQIECLPT

SEQ ID NO: 880359 - protein, 9 aa, Homo Sapiens
NSRTREQSR

SEQ ID NO: 880360 - protein, 9 aa, Homo Sapiens
MAFFGTSTG

SEQ ID NO: 880361 - protein, 9 aa, Homo Sapiens
AKCNGYCNK

SEQ ID NO: 880362 - protein, 9 aa, Homo Sapiens
NDNSTIVSV

SEQ ID NO: 880363 - protein, 9 aa, Homo Sapiens
HTSAKVFIL

SEQ ID NO: 880364 - protein, 9 aa, Homo Sapiens
NNLEAFRID

SEQ ID NO: 880365 - protein, 9 aa, Homo Sapiens
RIPVICQGD

SEQ ID NO: 880366 - protein, 9 aa, Homo Sapiens
IRRLLVKYP

SEQ ID NO: 880367 - protein, 9 aa, Homo Sapiens
KKNAICEES

SEQ ID NO: 880368 - protein, 9 aa, Homo Sapiens
VAPLVLTNC

SEQ ID NO: 880369 - protein, 9 aa, Homo Sapiens
TDTYKTIKQ

SEQ ID NO: 880370 - protein, 9 aa, Homo Sapiens
NMGHKENEK

SEQ ID NO: 880371 - protein, 9 aa, Homo Sapiens
VSGMSLSDT

SEQ ID NO: 880372 - protein, 9 aa, Homo Sapiens
NTITGEIRL

SEQ ID NO: 880373 - protein, 9 aa, Homo Sapiens
VGSSSPING

SEQ ID NO: 880374 - protein, 9 aa, Homo Sapiens
FGQMQQVQT

SEQ ID NO: 880375 - protein, 9 aa, Homo Sapiens
SHFDKLMDG

SEQ ID NO: 880376 - protein, 9 aa, Homo Sapiens
IFGDNLSNP

SEQ ID NO: 880377 - protein, 9 aa, Homo Sapiens
LPGLTSHAD

SEQ ID NO: 880378 - protein, 9 aa, Homo Sapiens
VRQFSGLER

SEQ ID NO: 880379 - protein, 9 aa, Homo Sapiens
GRILHMLNR

SEQ ID NO: 880380 - protein, 9 aa, Homo Sapiens
DHKPESKVE

SEQ ID NO: 880381 - protein, 9 aa, Homo Sapiens
MNYKIKKEE

SEQ ID NO: 880382 - protein, 9 aa, Homo Sapiens
WKEVNELYK

SEQ ID NO: 880383 - protein, 9 aa, Homo Sapiens
LVIMCSPVC

SEQ ID NO: 880384 - protein, 9 aa, Homo Sapiens
QLAFIKELF

SEQ ID NO: 880385 - protein, 9 aa, Homo Sapiens
DRYTYNNTV

SEQ ID NO: 880386 - protein, 9 aa, Homo Sapiens
EDAGCRPAD

SEQ ID NO: 880387 - protein, 9 aa, Homo Sapiens
VLKVDELVT

SEQ ID NO: 880388 - protein, 9 aa, Homo Sapiens
IQTETPALP

SEQ ID NO: 880389 - protein, 9 aa, Homo Sapiens
PPAQVQDNQ

SEQ ID NO: 880390 - protein, 9 aa, Homo Sapiens
TLVIHQQTH

SEQ ID NO: 880391 - protein, 9 aa, Homo Sapiens
PQKLMAMQR

SEQ ID NO: 880392 - protein, 9 aa, Homo Sapiens
PPGWKWEDD

SEQ ID NO: 880393 - protein, 9 aa, Homo Sapiens
QTNSSITLC

SEQ ID NO: 880394 - protein, 9 aa, Homo Sapiens
GKNYGGGKG

SEQ ID NO: 880395 - protein, 9 aa, Homo Sapiens
APLLFSWFA

SEQ ID NO: 880396 - protein, 9 aa, Homo Sapiens
APSHWVVQA

SEQ ID NO: 880397 - protein, 9 aa, Homo Sapiens
VGKRGVHEI

SEQ ID NO: 880398 - protein, 9 aa, Homo Sapiens
TKNWNHVVD

SEQ ID NO: 880399 - protein, 9 aa, Homo Sapiens
DSLEKEECN

SEQ ID NO: 880400 - protein, 9 aa, Homo Sapiens
RKGGMEVCN

SEQ ID NO: 880401 - protein, 9 aa, Homo Sapiens
VVQSCNVKA

SEQ ID NO: 880402 - protein, 9 aa, Homo Sapiens
SSYLAVQSL

SEQ ID NO: 880403 - protein, 9 aa, Homo Sapiens
DLGPNTQGF

SEQ ID NO: 880404 - protein, 9 aa, Homo Sapiens
WLGCTLQEF

SEQ ID NO: 880405 - protein, 9 aa, Homo Sapiens
NGRSLTTSP

SEQ ID NO: 880406 - protein, 9 aa, Homo Sapiens
CIEWCCSVC

SEQ ID NO: 880407 - protein, 9 aa, Homo Sapiens
AIYLLSALN

SEQ ID NO: 880408 - protein, 9 aa, Homo Sapiens
ERNNIDVNE

SEQ ID NO: 880409 - protein, 9 aa, Homo Sapiens
KYLEEAEKR

SEQ ID NO: 880410 - protein, 9 aa, Homo Sapiens
PNTKNHPVQ

SEQ ID NO: 880411 - protein, 9 aa, Homo Sapiens
DEIVMTLKQ

SEQ ID NO: 880412 - protein, 9 aa, Homo Sapiens
EEKYDYISQ

SEQ ID NO: 880413 - protein, 9 aa, Homo Sapiens
ECGKAFKLH

SEQ ID NO: 880414 - protein, 9 aa, Homo Sapiens
NCGHHKDAG

SEQ ID NO: 880415 - protein, 9 aa, Homo Sapiens
VLPQAQDSN

SEQ ID NO: 880416 - protein, 9 aa, Homo Sapiens
VENANPTAN

SEQ ID NO: 880417 - protein, 9 aa, Homo Sapiens
QTDSHLHTP

SEQ ID NO: 880418 - protein, 9 aa, Homo Sapiens
TGKIVGHGN

SEQ ID NO: 880419 - protein, 9 aa, Homo Sapiens
LNAQRAGFK

SEQ ID NO: 880420 - protein, 9 aa, Homo Sapiens
LYTDDEDKD

SEQ ID NO: 880421 - protein, 9 aa, Homo Sapiens
KELKVTMKK

SEQ ID NO: 880422 - protein, 9 aa, Homo Sapiens
LLASLQQGC

SEQ ID NO: 880423 - protein, 9 aa, Homo Sapiens
NKFLLKSIL

SEQ ID NO: 880424 - protein, 9 aa, Homo Sapiens
FVAELLMVF

SEQ ID NO: 880425 - protein, 9 aa, Homo Sapiens
LPTQPPVMP

SEQ ID NO: 880426 - protein, 9 aa, Homo Sapiens
QSDKKEDIK

SEQ ID NO: 880427 - protein, 9 aa, Homo Sapiens
CGVTVMMQS

SEQ ID NO: 880428 - protein, 9 aa, Homo Sapiens
KYRAAMLEE

SEQ ID NO: 880429 - protein, 9 aa, Homo Sapiens
ELWSKKRRH

SEQ ID NO: 880430 - protein, 9 aa, Homo Sapiens
TFTVCSNLT

SEQ ID NO: 880431 - protein, 9 aa, Homo Sapiens
PTVLPTNVL

SEQ ID NO: 880432 - protein, 9 aa, Homo Sapiens
VVNGKDVSQ

SEQ ID NO: 880433 - protein, 9 aa, Homo Sapiens
TSVSLLVVS

SEQ ID NO: 880434 - protein, 9 aa, Homo Sapiens
PSTPVTLFP

SEQ ID NO: 880435 - protein, 9 aa, Homo Sapiens
QDKYNSWHH

SEQ ID NO: 880436 - protein, 9 aa, Homo Sapiens
HILTRKQIR

SEQ ID NO: 880437 - protein, 9 aa, Homo Sapiens
ILRELDTDI

SEQ ID NO: 880438 - protein, 9 aa, Homo Sapiens
NYQTCFPQY

SEQ ID NO: 880439 - protein, 9 aa, Homo Sapiens
DTHPKYLEM

SEQ ID NO: 880440 - protein, 9 aa, Homo Sapiens
EKGRPGKDS

SEQ ID NO: 880441 - protein, 9 aa, Homo Sapiens
RLPVLPKKL

SEQ ID NO: 880442 - protein, 9 aa, Homo Sapiens
KDQGSTHSG

SEQ ID NO: 880443 - protein, 9 aa, Homo Sapiens
LERLTAKFK

SEQ ID NO: 880444 - protein, 9 aa, Homo Sapiens
PAEPWGHAR

SEQ ID NO: 880445 - protein, 9 aa, Homo Sapiens
LNPIIYGFL

SEQ ID NO: 880446 - protein, 9 aa, Homo Sapiens
LLLYPSQRF

SEQ ID NO: 880447 - protein, 9 aa, Homo Sapiens
TFSILNDND

SEQ ID NO: 880448 - protein, 9 aa, Homo Sapiens
GVPPLDATW

SEQ ID NO: 880449 - protein, 9 aa, Homo Sapiens
VHFAESLIA

SEQ ID NO: 880450 - protein, 9 aa, Homo Sapiens
ILLNNTGNL

SEQ ID NO: 880451 - protein, 9 aa, Homo Sapiens
PPRSTSQNF

SEQ ID NO: 880452 - protein, 9 aa, Homo Sapiens
YNDDRNLLQ

SEQ ID NO: 880453 - protein, 9 aa, Homo Sapiens
FLEPESVIK

SEQ ID NO: 880454 - protein, 9 aa, Homo Sapiens
TTDGAHNTF

SEQ ID NO: 880455 - protein, 9 aa, Homo Sapiens
PIIYVFMGR

SEQ ID NO: 880456 - protein, 9 aa, Homo Sapiens
DGGRETSGR

SEQ ID NO: 880457 - protein, 9 aa, Homo Sapiens
DNLSNPLNM

SEQ ID NO: 880458 - protein, 9 aa, Homo Sapiens
YDYISQGEN

SEQ ID NO: 880459 - protein, 9 aa, Homo Sapiens
GSGSENVPE

SEQ ID NO: 880460 - protein, 9 aa, Homo Sapiens
LLEDNDEKE

SEQ ID NO: 880461 - protein, 9 aa, Homo Sapiens
LTSKQGGCC

SEQ ID NO: 880462 - protein, 9 aa, Homo Sapiens
HNRFRLNKK

SEQ ID NO: 880463 - protein, 9 aa, Homo Sapiens
MERGISVLL

SEQ ID NO: 880464 - protein, 9 aa, Homo Sapiens
ARYGNSSGM

SEQ ID NO: 880465 - protein, 9 aa, Homo Sapiens
IPELLNKLC

SEQ ID NO: 880466 - protein, 9 aa, Homo Sapiens
KSGGDSNTN

SEQ ID NO: 880467 - protein, 9 aa, Homo Sapiens
NMFQTLPPS

SEQ ID NO: 880468 - protein, 9 aa, Homo Sapiens
VQASTGPPW

SEQ ID NO: 880469 - protein, 9 aa, Homo Sapiens
LKYSVGRPN

SEQ ID NO: 880470 - protein, 9 aa, Homo Sapiens
PGWPGPGQL

SEQ ID NO: 880471 - protein, 9 aa, Homo Sapiens
TRQYKLTVP

SEQ ID NO: 880472 - protein, 9 aa, Homo Sapiens
NRVCIAETW

SEQ ID NO: 880473 - protein, 9 aa, Homo Sapiens
NRELEKEAT

SEQ ID NO: 880474 - protein, 9 aa, Homo Sapiens
KGAFQSSEE

SEQ ID NO: 880475 - protein, 9 aa, Homo Sapiens
TQICNRALI

SEQ ID NO: 880476 - protein, 9 aa, Homo Sapiens
FEKLIHFKS

SEQ ID NO: 880477 - protein, 9 aa, Homo Sapiens
KFIPPVEGC

SEQ ID NO: 880478 - protein, 9 aa, Homo Sapiens
DLIQHQIIH

SEQ ID NO: 880479 - protein, 9 aa, Homo Sapiens
GDGHISQEA

SEQ ID NO: 880480 - protein, 9 aa, Homo Sapiens
YQLLSETPP

SEQ ID NO: 880481 - protein, 9 aa, Homo Sapiens
DEQMFPCQF

SEQ ID NO: 880482 - protein, 9 aa, Homo Sapiens
LRHNLDALL

SEQ ID NO: 880483 - protein, 9 aa, Homo Sapiens
VKRDLLIKV

SEQ ID NO: 880484 - protein, 9 aa, Homo Sapiens
DNTQSVGIL

SEQ ID NO: 880485 - protein, 9 aa, Homo Sapiens
RMKQKNEAP

SEQ ID NO: 880486 - protein, 9 aa, Homo Sapiens
YVDVAVGVF

SEQ ID NO: 880487 - protein, 9 aa, Homo Sapiens
IILIQGFFR

SEQ ID NO: 880488 - protein, 9 aa, Homo Sapiens
PIPMSIRSA

SEQ ID NO: 880489 - protein, 9 aa, Homo Sapiens
IEEKLLDDK

SEQ ID NO: 880490 - protein, 9 aa, Homo Sapiens
ASAAGSSSF

SEQ ID NO: 880491 - protein, 9 aa, Homo Sapiens
KELDVLQAR

SEQ ID NO: 880492 - protein, 9 aa, Homo Sapiens
KPPEQAPPY

SEQ ID NO: 880493 - protein, 9 aa, Homo Sapiens
YKYLFFHHS

SEQ ID NO: 880494 - protein, 9 aa, Homo Sapiens
MQHSRDHGL

SEQ ID NO: 880495 - protein, 9 aa, Homo Sapiens
KPDAKPDNF

SEQ ID NO: 880496 - protein, 9 aa, Homo Sapiens
FALQTLQPW

SEQ ID NO: 880497 - protein, 9 aa, Homo Sapiens
LFCNYEESR

SEQ ID NO: 880498 - protein, 9 aa, Homo Sapiens
VTTHKHHCR

SEQ ID NO: 880499 - protein, 9 aa, Homo Sapiens
KRFILTIYQ

SEQ ID NO: 880500 - protein, 9 aa, Homo Sapiens
TKALMHFGE

SEQ ID NO: 880501 - protein, 9 aa, Homo Sapiens
QIMSLFIVQ

SEQ ID NO: 880502 - protein, 9 aa, Homo Sapiens
QGKLYLREK

SEQ ID NO: 880503 - protein, 9 aa, Homo Sapiens
KSASRQNTS

SEQ ID NO: 880504 - protein, 9 aa, Homo Sapiens
KAFPVFLQT

SEQ ID NO: 880505 - protein, 9 aa, Homo Sapiens
ISDTLIQLS

SEQ ID NO: 880506 - protein, 9 aa, Homo Sapiens
SLCAKEDKC

SEQ ID NO: 880507 - protein, 9 aa, Homo Sapiens
NGEVPEDLR

SEQ ID NO: 880508 - protein, 9 aa, Homo Sapiens
ELFKHISEQ

SEQ ID NO: 880509 - protein, 9 aa, Homo Sapiens
CAPPAPCTP

SEQ ID NO: 880510 - protein, 9 aa, Homo Sapiens
DDGHLFCSS

SEQ ID NO: 880511 - protein, 9 aa, Homo Sapiens
WKTFEEENQ

SEQ ID NO: 880512 - protein, 9 aa, Homo Sapiens
WWKYMIVDE

SEQ ID NO: 880513 - protein, 9 aa, Homo Sapiens
NPAVTLKNF

SEQ ID NO: 880514 - protein, 9 aa, Homo Sapiens
GFHRVVKIL

SEQ ID NO: 880515 - protein, 9 aa, Homo Sapiens
EGNVVAAAG

SEQ ID NO: 880516 - protein, 9 aa, Homo Sapiens
QNYYAANSC

SEQ ID NO: 880517 - protein, 9 aa, Homo Sapiens
FLMPSDLQA

SEQ ID NO: 880518 - protein, 9 aa, Homo Sapiens
KKPRIKDTP

SEQ ID NO: 880519 - protein, 9 aa, Homo Sapiens
TVNLMQKHF

SEQ ID NO: 880520 - protein, 9 aa, Homo Sapiens
YSITGYPNP

SEQ ID NO: 880521 - protein, 9 aa, Homo Sapiens
DNFFQVSKN

SEQ ID NO: 880522 - protein, 9 aa, Homo Sapiens
GNGSNLIKG

SEQ ID NO: 880523 - protein, 9 aa, Homo Sapiens
SVLAWHSQY

SEQ ID NO: 880524 - protein, 9 aa, Homo Sapiens
KMETSPLRE

SEQ ID NO: 880525 - protein, 9 aa, Homo Sapiens
ENYGHIYNK

SEQ ID NO: 880526 - protein, 9 aa, Homo Sapiens
EVWEKYSKW

SEQ ID NO: 880527 - protein, 9 aa, Homo Sapiens
DGVPPLDAT

SEQ ID NO: 880528 - protein, 9 aa, Homo Sapiens
IPLPMLWAL

SEQ ID NO: 880529 - protein, 9 aa, Homo Sapiens
SIVGSLPRY

SEQ ID NO: 880530 - protein, 9 aa, Homo Sapiens
YQMDGDVAK

SEQ ID NO: 880531 - protein, 9 aa, Homo Sapiens
METKVQFLN

SEQ ID NO: 880532 - protein, 9 aa, Homo Sapiens
LGITYLPSV

SEQ ID NO: 880533 - protein, 9 aa, Homo Sapiens
TMIQLHSKR

SEQ ID NO: 880534 - protein, 9 aa, Homo Sapiens
CDTSEDLRL

SEQ ID NO: 880535 - protein, 9 aa, Homo Sapiens
TLMMTTALM

SEQ ID NO: 880536 - protein, 9 aa, Homo Sapiens
HNTFLKCGA

SEQ ID NO: 880537 - protein, 9 aa, Homo Sapiens
EYECMKTEA

SEQ ID NO: 880538 - protein, 9 aa, Homo Sapiens
LSLMMDKTK

SEQ ID NO: 880539 - protein, 9 aa, Homo Sapiens
DIYPNLLGL

SEQ ID NO: 880540 - protein, 9 aa, Homo Sapiens
YALQRTWNN

SEQ ID NO: 880541 - protein, 9 aa, Homo Sapiens
DEMAVQLDN

SEQ ID NO: 880542 - protein, 9 aa, Homo Sapiens
CHKPCRPLH

SEQ ID NO: 880543 - protein, 9 aa, Homo Sapiens
KQSPHSQIH

SEQ ID NO: 880544 - protein, 9 aa, Homo Sapiens
ITLFEQCVC

SEQ ID NO: 880545 - protein, 9 aa, Homo Sapiens
ESNLFLAEH

SEQ ID NO: 880546 - protein, 9 aa, Homo Sapiens
VVNKLFKFM

SEQ ID NO: 880547 - protein, 9 aa, Homo Sapiens
TYECRASNN

SEQ ID NO: 880548 - protein, 9 aa, Homo Sapiens
SSVLRVPCN

SEQ ID NO: 880549 - protein, 9 aa, Homo Sapiens
FGVERSVCP

SEQ ID NO: 880550 - protein, 9 aa, Homo Sapiens
PKYVYKNRS

SEQ ID NO: 880551 - protein, 9 aa, Homo Sapiens
DKSSGKQLR

SEQ ID NO: 880552 - protein, 9 aa, Homo Sapiens
SWWIPVVGP

SEQ ID NO: 880553 - protein, 9 aa, Homo Sapiens
QFGELREIS

SEQ ID NO: 880554 - protein, 9 aa, Homo Sapiens
ENLKLVRLM

SEQ ID NO: 880555 - protein, 9 aa, Homo Sapiens
NEEFGVKLG

SEQ ID NO: 880556 - protein, 9 aa, Homo Sapiens
VAHHIVETT

SEQ ID NO: 880557 - protein, 9 aa, Homo Sapiens
GQHLASGDQ

SEQ ID NO: 880558 - protein, 9 aa, Homo Sapiens
SATVDSETF

SEQ ID NO: 880559 - protein, 9 aa, Homo Sapiens
SLPATGWTK

SEQ ID NO: 880560 - protein, 9 aa, Homo Sapiens
SPVTVMESN

SEQ ID NO: 880561 - protein, 9 aa, Homo Sapiens
CIQNEWGTN

SEQ ID NO: 880562 - protein, 9 aa, Homo Sapiens
TDYFTGLVN

SEQ ID NO: 880563 - protein, 9 aa, Homo Sapiens
QMKEYRVQD

SEQ ID NO: 880564 - protein, 9 aa, Homo Sapiens
HGQQDLYQI

SEQ ID NO: 880565 - protein, 9 aa, Homo Sapiens
SLGTLTHGD

SEQ ID NO: 880566 - protein, 9 aa, Homo Sapiens
QLGAVFPGT

SEQ ID NO: 880567 - protein, 9 aa, Homo Sapiens
TKPGSLTQA

SEQ ID NO: 880568 - protein, 9 aa, Homo Sapiens
QTSVLLSLQ

SEQ ID NO: 880569 - protein, 9 aa, Homo Sapiens
RFHGDAQVV

SEQ ID NO: 880570 - protein, 9 aa, Homo Sapiens
IVKAAKSID

SEQ ID NO: 880571 - protein, 9 aa, Homo Sapiens
TQDFKTDLR

SEQ ID NO: 880572 - protein, 9 aa, Homo Sapiens
RDIKFELLA

SEQ ID NO: 880573 - protein, 9 aa, Homo Sapiens
FVLKTQNQP

SEQ ID NO: 880574 - protein, 9 aa, Homo Sapiens
MKDKRPRSK

SEQ ID NO: 880575 - protein, 9 aa, Homo Sapiens
PEKIIQILA

SEQ ID NO: 880576 - protein, 9 aa, Homo Sapiens
NKSKGEHVP

SEQ ID NO: 880577 - protein, 9 aa, Homo Sapiens
LRSLQELDL

SEQ ID NO: 880578 - protein, 9 aa, Homo Sapiens
GAHNRFRLN

SEQ ID NO: 880579 - protein, 9 aa, Homo Sapiens
WKALKKKQQ

SEQ ID NO: 880580 - protein, 9 aa, Homo Sapiens
LENTASTNC

SEQ ID NO: 880581 - protein, 9 aa, Homo Sapiens
PTGDGHNLF

SEQ ID NO: 880582 - protein, 9 aa, Homo Sapiens
HICGFLDIE

SEQ ID NO: 880583 - protein, 9 aa, Homo Sapiens
QLAKNLVEK

SEQ ID NO: 880584 - protein, 9 aa, Homo Sapiens
YLKNQMVLL

SEQ ID NO: 880585 - protein, 9 aa, Homo Sapiens
KCVLCTKSC

SEQ ID NO: 880586 - protein, 9 aa, Homo Sapiens
PVTLFPGIP

SEQ ID NO: 880587 - protein, 9 aa, Homo Sapiens
IEEINEQII

SEQ ID NO: 880588 - protein, 9 aa, Homo Sapiens
KHSINCARQ

SEQ ID NO: 880589 - protein, 9 aa, Homo Sapiens
GAITEHLRS

SEQ ID NO: 880590 - protein, 9 aa, Homo Sapiens
QDPQKKSDV

SEQ ID NO: 880591 - protein, 9 aa, Homo Sapiens
GGADQELFV

SEQ ID NO: 880592 - protein, 9 aa, Homo Sapiens
SHRGIQMYK

SEQ ID NO: 880593 - protein, 9 aa, Homo Sapiens
PVQIGDMRI

SEQ ID NO: 880594 - protein, 9 aa, Homo Sapiens
DKLPIQGHP

SEQ ID NO: 880595 - protein, 9 aa, Homo Sapiens
GAVVADVMC

SEQ ID NO: 880596 - protein, 9 aa, Homo Sapiens
QSYYLDHME

SEQ ID NO: 880597 - protein, 9 aa, Homo Sapiens
PGKPEIVDF

SEQ ID NO: 880598 - protein, 9 aa, Homo Sapiens
ENWPTRVCA

SEQ ID NO: 880599 - protein, 9 aa, Homo Sapiens
GIIICSCIC

SEQ ID NO: 880600 - protein, 9 aa, Homo Sapiens
QSCRCKGIV

SEQ ID NO: 880601 - protein, 9 aa, Homo Sapiens
QDNSVTSIS

SEQ ID NO: 880602 - protein, 9 aa, Homo Sapiens
FAKGFRDNF

SEQ ID NO: 880603 - protein, 9 aa, Homo Sapiens
ENDIGNRML

SEQ ID NO: 880604 - protein, 9 aa, Homo Sapiens
EKQHLIYQQ

SEQ ID NO: 880605 - protein, 9 aa, Homo Sapiens
AYPGGCGPR

SEQ ID NO: 880606 - protein, 9 aa, Homo Sapiens
NGNTDNNTQ

SEQ ID NO: 880607 - protein, 9 aa, Homo Sapiens
DPQAPYPCL

SEQ ID NO: 880608 - protein, 9 aa, Homo Sapiens
FYHTGRLHM

SEQ ID NO: 880609 - protein, 9 aa, Homo Sapiens
RKEAALSWL

SEQ ID NO: 880610 - protein, 9 aa, Homo Sapiens
GSYSPTRKA

SEQ ID NO: 880611 - protein, 9 aa, Homo Sapiens
DELVTGKKN

SEQ ID NO: 880612 - protein, 9 aa, Homo Sapiens
VVASQNAVL

SEQ ID NO: 880613 - protein, 9 aa, Homo Sapiens
IFKLEELCA

SEQ ID NO: 880614 - protein, 9 aa, Homo Sapiens
DISNNSFHS

SEQ ID NO: 880615 - protein, 9 aa, Homo Sapiens
SELTPKQAI

SEQ ID NO: 880616 - protein, 9 aa, Homo Sapiens
KAAKSIDQK

SEQ ID NO: 880617 - protein, 9 aa, Homo Sapiens
EVMVLLGFP

SEQ ID NO: 880618 - protein, 9 aa, Homo Sapiens
VIAGGCAGG

SEQ ID NO: 880619 - protein, 9 aa, Homo Sapiens
ESGTFHISP

SEQ ID NO: 880620 - protein, 9 aa, Homo Sapiens
LEDNDEKEN

SEQ ID NO: 880621 - protein, 9 aa, Homo Sapiens
SCLNPIIYV

SEQ ID NO: 880622 - protein, 9 aa, Homo Sapiens
AKECRLQTE

SEQ ID NO: 880623 - protein, 9 aa, Homo Sapiens
PESYYGERH

SEQ ID NO: 880624 - protein, 9 aa, Homo Sapiens
QTKLQDKYN

SEQ ID NO: 880625 - protein, 9 aa, Homo Sapiens
APSSQTKVL

SEQ ID NO: 880626 - protein, 9 aa, Homo Sapiens
NLYSTPRCT

SEQ ID NO: 880627 - protein, 9 aa, Homo Sapiens
LRLKSPVGN

SEQ ID NO: 880628 - protein, 9 aa, Homo Sapiens
FKAESNLFL

SEQ ID NO: 880629 - protein, 9 aa, Homo Sapiens
SNVFIVIAI

SEQ ID NO: 880630 - protein, 9 aa, Homo Sapiens
RLIMQQGQF

SEQ ID NO: 880631 - protein, 9 aa, Homo Sapiens
HHLTSRHQE

SEQ ID NO: 880632 - protein, 9 aa, Homo Sapiens
QEEEDKGLD

SEQ ID NO: 880633 - protein, 9 aa, Homo Sapiens
KHPHVANPQ

SEQ ID NO: 880634 - protein, 9 aa, Homo Sapiens
PDVLPQAQD

SEQ ID NO: 880635 - protein, 9 aa, Homo Sapiens
EDQVACNAS

SEQ ID NO: 880636 - protein, 9 aa, Homo Sapiens
HKRSHTRER

SEQ ID NO: 880637 - protein, 9 aa, Homo Sapiens
STSLLLSAD

SEQ ID NO: 880638 - protein, 9 aa, Homo Sapiens
IKEENYLRI

SEQ ID NO: 880639 - protein, 9 aa, Homo Sapiens
MQALAELLG

SEQ ID NO: 880640 - protein, 9 aa, Homo Sapiens
LHINMEAKH

SEQ ID NO: 880641 - protein, 9 aa, Homo Sapiens
CDGFNVRVP

SEQ ID NO: 880642 - protein, 9 aa, Homo Sapiens
QMDSNKGAS

SEQ ID NO: 880643 - protein, 9 aa, Homo Sapiens
HPLPNYRTF

SEQ ID NO: 880644 - protein, 9 aa, Homo Sapiens
SHFLFGLLN

SEQ ID NO: 880645 - protein, 9 aa, Homo Sapiens
DHQIFFNPQ

SEQ ID NO: 880646 - protein, 9 aa, Homo Sapiens
FAEHQSGLV

SEQ ID NO: 880647 - protein, 9 aa, Homo Sapiens
LLWQEAVSR

SEQ ID NO: 880648 - protein, 9 aa, Homo Sapiens
KDKRPRSKL

SEQ ID NO: 880649 - protein, 9 aa, Homo Sapiens
LTQIMSLFI

SEQ ID NO: 880650 - protein, 9 aa, Homo Sapiens
KRDSLQKRS

SEQ ID NO: 880651 - protein, 9 aa, Homo Sapiens
VKVTTERSQ

SEQ ID NO: 880652 - protein, 9 aa, Homo Sapiens
RQGLVVGIY

SEQ ID NO: 880653 - protein, 9 aa, Homo Sapiens
CHPWTSCEP

SEQ ID NO: 880654 - protein, 9 aa, Homo Sapiens
PHHPKWKNK

SEQ ID NO: 880655 - protein, 9 aa, Homo Sapiens
QRAMCISHK

SEQ ID NO: 880656 - protein, 9 aa, Homo Sapiens
MFGATSRMD

SEQ ID NO: 880657 - protein, 9 aa, Homo Sapiens
SPPKTFSPS

SEQ ID NO: 880658 - protein, 9 aa, Homo Sapiens
KITLETSLS

SEQ ID NO: 880659 - protein, 9 aa, Homo Sapiens
IINNFSFCR

SEQ ID NO: 880660 - protein, 9 aa, Homo Sapiens
IIGKMLNSD

SEQ ID NO: 880661 - protein, 9 aa, Homo Sapiens
KAEEEMARL

SEQ ID NO: 880662 - protein, 9 aa, Homo Sapiens
ELSLFAVHH

SEQ ID NO: 880663 - protein, 9 aa, Homo Sapiens
TCECLVKEG

SEQ ID NO: 880664 - protein, 9 aa, Homo Sapiens
TIRNTKAAK

SEQ ID NO: 880665 - protein, 9 aa, Homo Sapiens
AISVGSGLR

SEQ ID NO: 880666 - protein, 9 aa, Homo Sapiens
NFSPTSKQI

SEQ ID NO: 880667 - protein, 9 aa, Homo Sapiens
KGNLRKTGQ

SEQ ID NO: 880668 - protein, 9 aa, Homo Sapiens
IRLIGNKSK

SEQ ID NO: 880669 - protein, 9 aa, Homo Sapiens
NTTSIAQAR

SEQ ID NO: 880670 - protein, 9 aa, Homo Sapiens
NISDFTQEI

SEQ ID NO: 880671 - protein, 9 aa, Homo Sapiens
MSFVPNASH

SEQ ID NO: 880672 - protein, 9 aa, Homo Sapiens
ADSELVLKV

SEQ ID NO: 880673 - protein, 9 aa, Homo Sapiens
SKDKMSALS

SEQ ID NO: 880674 - protein, 9 aa, Homo Sapiens
EACAARLAN

SEQ ID NO: 880675 - protein, 9 aa, Homo Sapiens
QLLTLPVLP

SEQ ID NO: 880676 - protein, 9 aa, Homo Sapiens
QSSAFKSLE

SEQ ID NO: 880677 - protein, 9 aa, Homo Sapiens
SHTSIWLLQ

SEQ ID NO: 880678 - protein, 9 aa, Homo Sapiens
KMAFICAAC

SEQ ID NO: 880679 - protein, 9 aa, Homo Sapiens
APAFKPGRQ

SEQ ID NO: 880680 - protein, 9 aa, Homo Sapiens
LQNSFRDQV

SEQ ID NO: 880681 - protein, 9 aa, Homo Sapiens
PTNKQKEIY

SEQ ID NO: 880682 - protein, 9 aa, Homo Sapiens
PLAATSYFS

SEQ ID NO: 880683 - protein, 9 aa, Homo Sapiens
EEPCGVGTC

SEQ ID NO: 880684 - protein, 9 aa, Homo Sapiens
ICAQTFFKI

SEQ ID NO: 880685 - protein, 9 aa, Homo Sapiens
SLVALMVET

SEQ ID NO: 880686 - protein, 9 aa, Homo Sapiens
PLDHDDQCE

SEQ ID NO: 880687 - protein, 9 aa, Homo Sapiens
QFVRMIKRF

SEQ ID NO: 880688 - protein, 9 aa, Homo Sapiens
NPDSDNFLS

SEQ ID NO: 880689 - protein, 9 aa, Homo Sapiens
CKLSMKAST

SEQ ID NO: 880690 - protein, 9 aa, Homo Sapiens
RQAGFPRCP

SEQ ID NO: 880691 - protein, 9 aa, Homo Sapiens
FIDALEKIK

SEQ ID NO: 880692 - protein, 9 aa, Homo Sapiens
TPLMITCKT

SEQ ID NO: 880693 - protein, 9 aa, Homo Sapiens
ARYLVNRLE

SEQ ID NO: 880694 - protein, 9 aa, Homo Sapiens
GLLYLQLDI

SEQ ID NO: 880695 - protein, 9 aa, Homo Sapiens
RMTKVHRSA

SEQ ID NO: 880696 - protein, 9 aa, Homo Sapiens
VPIVLHICL

SEQ ID NO: 880697 - protein, 9 aa, Homo Sapiens
QTIKDNQAT

SEQ ID NO: 880698 - protein, 9 aa, Homo Sapiens
NPQIGTFDL

SEQ ID NO: 880699 - protein, 9 aa, Homo Sapiens
DVHFDLAVN

SEQ ID NO: 880700 - protein, 9 aa, Homo Sapiens
GVRICSVTC

SEQ ID NO: 880701 - protein, 9 aa, Homo Sapiens
ITSPPDSSV

SEQ ID NO: 880702 - protein, 9 aa, Homo Sapiens
RDLGPNTQG

SEQ ID NO: 880703 - protein, 9 aa, Homo Sapiens
LSFILRINC

SEQ ID NO: 880704 - protein, 9 aa, Homo Sapiens
ERWNGRILH

SEQ ID NO: 880705 - protein, 9 aa, Homo Sapiens
HFKNIPNSL

SEQ ID NO: 880706 - protein, 9 aa, Homo Sapiens
QFMWIIRKM

SEQ ID NO: 880707 - protein, 9 aa, Homo Sapiens
IVVKREVNK

SEQ ID NO: 880708 - protein, 9 aa, Homo Sapiens
KSFLSEELD

SEQ ID NO: 880709 - protein, 9 aa, Homo Sapiens
SFCDGDCSK

SEQ ID NO: 880710 - protein, 9 aa, Homo Sapiens
VGAIKQNAR

SEQ ID NO: 880711 - protein, 9 aa, Homo Sapiens
KNFEEYFMR

SEQ ID NO: 880712 - protein, 9 aa, Homo Sapiens
EKTEVKQKW

SEQ ID NO: 880713 - protein, 9 aa, Homo Sapiens
MTGFGLLLS

SEQ ID NO: 880714 - protein, 9 aa, Homo Sapiens
ETFAEMNRH

SEQ ID NO: 880715 - protein, 9 aa, Homo Sapiens
YVFDLIDTF

SEQ ID NO: 880716 - protein, 9 aa, Homo Sapiens
SNLLISNVA

SEQ ID NO: 880717 - protein, 9 aa, Homo Sapiens
QAILNQHFC

SEQ ID NO: 880718 - protein, 9 aa, Homo Sapiens
SGMIIDNMT

SEQ ID NO: 880719 - protein, 9 aa, Homo Sapiens
INGIDVDKW

SEQ ID NO: 880720 - protein, 9 aa, Homo Sapiens
QERIVTASS

SEQ ID NO: 880721 - protein, 9 aa, Homo Sapiens
AVETVKANV

SEQ ID NO: 880722 - protein, 9 aa, Homo Sapiens
VQLSRHKLE

SEQ ID NO: 880723 - protein, 9 aa, Homo Sapiens
TSPPCASPP

SEQ ID NO: 880724 - protein, 9 aa, Homo Sapiens
YKINLIVHQ

SEQ ID NO: 880725 - protein, 9 aa, Homo Sapiens
PKKKRLCLA

SEQ ID NO: 880726 - protein, 9 aa, Homo Sapiens
GLKVYLQRN

SEQ ID NO: 880727 - protein, 9 aa, Homo Sapiens
KQMHVQLST

SEQ ID NO: 880728 - protein, 9 aa, Homo Sapiens
NKWSGATYV

SEQ ID NO: 880729 - protein, 9 aa, Homo Sapiens
YKTSKRFSS

SEQ ID NO: 880730 - protein, 9 aa, Homo Sapiens
YKYAAGVCN

SEQ ID NO: 880731 - protein, 9 aa, Homo Sapiens
PELQVQHFG

SEQ ID NO: 880732 - protein, 9 aa, Homo Sapiens
AQTYLKVHS

SEQ ID NO: 880733 - protein, 9 aa, Homo Sapiens
KNDQLRIYF

SEQ ID NO: 880734 - protein, 9 aa, Homo Sapiens
PHRRWRTEY

SEQ ID NO: 880735 - protein, 9 aa, Homo Sapiens
AVNTRQHYY

SEQ ID NO: 880736 - protein, 9 aa, Homo Sapiens
DDCGWFVTP

SEQ ID NO: 880737 - protein, 9 aa, Homo Sapiens
SQAKYVKTA

SEQ ID NO: 880738 - protein, 9 aa, Homo Sapiens
YQSDPNLAR

SEQ ID NO: 880739 - protein, 9 aa, Homo Sapiens
LDWSVFHGA

SEQ ID NO: 880740 - protein, 9 aa, Homo Sapiens
IQIAAEGIN

SEQ ID NO: 880741 - protein, 9 aa, Homo Sapiens
WHVKCAQCC

SEQ ID NO: 880742 - protein, 9 aa, Homo Sapiens
GMDISNAPH

SEQ ID NO: 880743 - protein, 9 aa, Homo Sapiens
VQVPQTTTY

SEQ ID NO: 880744 - protein, 9 aa, Homo Sapiens
LLGLMLYLV

SEQ ID NO: 880745 - protein, 9 aa, Homo Sapiens
NIYLKQINY

SEQ ID NO: 880746 - protein, 9 aa, Homo Sapiens
IQIQWDKQS

SEQ ID NO: 880747 - protein, 9 aa, Homo Sapiens
LNKFMIRIG

SEQ ID NO: 880748 - protein, 9 aa, Homo Sapiens
NLPQDYAQI

SEQ ID NO: 880749 - protein, 9 aa, Homo Sapiens
QNGNTYKKP

SEQ ID NO: 880750 - protein, 9 aa, Homo Sapiens
AVQDLDSVP

SEQ ID NO: 880751 - protein, 9 aa, Homo Sapiens
GNLSGMLQE

SEQ ID NO: 880752 - protein, 9 aa, Homo Sapiens
VEYHGDLIK

SEQ ID NO: 880753 - protein, 9 aa, Homo Sapiens
AGPETPGKK

SEQ ID NO: 880754 - protein, 9 aa, Homo Sapiens
GDSAMHLVL

SEQ ID NO: 880755 - protein, 9 aa, Homo Sapiens
VLCKSGRCV

SEQ ID NO: 880756 - protein, 9 aa, Homo Sapiens
WLKSKWMKY

SEQ ID NO: 880757 - protein, 9 aa, Homo Sapiens
IDNEKRMKL

SEQ ID NO: 880758 - protein, 9 aa, Homo Sapiens
CQNHHNVGM

SEQ ID NO: 880759 - protein, 9 aa, Homo Sapiens
GIHGDMHVI

SEQ ID NO: 880760 - protein, 9 aa, Homo Sapiens
HRRGIVFLD

SEQ ID NO: 880761 - protein, 9 aa, Homo Sapiens
EKQRQNGSA

SEQ ID NO: 880762 - protein, 9 aa, Homo Sapiens
RLRSRTLPV

SEQ ID NO: 880763 - protein, 9 aa, Homo Sapiens
QSRSQRSDS

SEQ ID NO: 880764 - protein, 9 aa, Homo Sapiens
YLPSCAYYM

SEQ ID NO: 880765 - protein, 9 aa, Homo Sapiens
NKQSPHSQI

SEQ ID NO: 880766 - protein, 9 aa, Homo Sapiens
SNTSQHNSE

SEQ ID NO: 880767 - protein, 9 aa, Homo Sapiens
TNSTLATII

SEQ ID NO: 880768 - protein, 9 aa, Homo Sapiens
ELSEFIQAL

SEQ ID NO: 880769 - protein, 9 aa, Homo Sapiens
RSERNKWIH

SEQ ID NO: 880770 - protein, 9 aa, Homo Sapiens
VRLGDTMEA

SEQ ID NO: 880771 - protein, 9 aa, Homo Sapiens
DLQIIGFAA

SEQ ID NO: 880772 - protein, 9 aa, Homo Sapiens
ECASQTVED

SEQ ID NO: 880773 - protein, 9 aa, Homo Sapiens
QNMKLCQEN

SEQ ID NO: 880774 - protein, 9 aa, Homo Sapiens
SYLNIVLSI

SEQ ID NO: 880775 - protein, 9 aa, Homo Sapiens
NEKGSDQYR

SEQ ID NO: 880776 - protein, 9 aa, Homo Sapiens
PNLMSPTRK

SEQ ID NO: 880777 - protein, 9 aa, Homo Sapiens
SGETGAMVC

SEQ ID NO: 880778 - protein, 9 aa, Homo Sapiens
SVFEVNIQF

SEQ ID NO: 880779 - protein, 9 aa, Homo Sapiens
NQKESGLNK

SEQ ID NO: 880780 - protein, 9 aa, Homo Sapiens
TARLLSECD

SEQ ID NO: 880781 - protein, 9 aa, Homo Sapiens
TLAAKTLEV

SEQ ID NO: 880782 - protein, 9 aa, Homo Sapiens
MHKICFPIP

SEQ ID NO: 880783 - protein, 9 aa, Homo Sapiens
LLHLTSLGI

SEQ ID NO: 880784 - protein, 9 aa, Homo Sapiens
KEPSALGKS

SEQ ID NO: 880785 - protein, 9 aa, Homo Sapiens
TFCTCATVL

SEQ ID NO: 880786 - protein, 9 aa, Homo Sapiens
RQEPVPEAV

SEQ ID NO: 880787 - protein, 9 aa, Homo Sapiens
SSTRLKPHK

SEQ ID NO: 880788 - protein, 9 aa, Homo Sapiens
TIYVAHLLA

SEQ ID NO: 880789 - protein, 9 aa, Homo Sapiens
FCPDTCVWE

SEQ ID NO: 880790 - protein, 9 aa, Homo Sapiens
WTVTMRIWV

SEQ ID NO: 880791 - protein, 9 aa, Homo Sapiens
TPLWTLLQS

SEQ ID NO: 880792 - protein, 9 aa, Homo Sapiens
HLVPEPDHL

SEQ ID NO: 880793 - protein, 9 aa, Homo Sapiens
SPEQTKLWG

SEQ ID NO: 880794 - protein, 9 aa, Homo Sapiens
DHKASTQGR

SEQ ID NO: 880795 - protein, 9 aa, Homo Sapiens
EEMTLSHST

SEQ ID NO: 880796 - protein, 9 aa, Homo Sapiens
FMGDPSYKY

SEQ ID NO: 880797 - protein, 9 aa, Homo Sapiens
TFSPGRPRS

SEQ ID NO: 880798 - protein, 9 aa, Homo Sapiens
QLDIYQKAF

SEQ ID NO: 880799 - protein, 9 aa, Homo Sapiens
TTTAYVLQF

SEQ ID NO: 880800 - protein, 9 aa, Homo Sapiens
CFLKRRLEQ

SEQ ID NO: 880801 - protein, 9 aa, Homo Sapiens
WIFHLTIIP

SEQ ID NO: 880802 - protein, 9 aa, Homo Sapiens
GTAAHQTNK

SEQ ID NO: 880803 - protein, 9 aa, Homo Sapiens
LPITLNKLF

SEQ ID NO: 880804 - protein, 9 aa, Homo Sapiens
NPVRHLSTY

SEQ ID NO: 880805 - protein, 9 aa, Homo Sapiens
LKDNCRPDG

SEQ ID NO: 880806 - protein, 9 aa, Homo Sapiens
YPLQMHCIR

SEQ ID NO: 880807 - protein, 9 aa, Homo Sapiens
PVYPLVGSY

SEQ ID NO: 880808 - protein, 9 aa, Homo Sapiens
QSLARKYMC

SEQ ID NO: 880809 - protein, 9 aa, Homo Sapiens
ERQTDKTHS

SEQ ID NO: 880810 - protein, 9 aa, Homo Sapiens
FILCKEGKD

SEQ ID NO: 880811 - protein, 9 aa, Homo Sapiens
AKSKCPQLR

SEQ ID NO: 880812 - protein, 9 aa, Homo Sapiens
EEDNKEDPM

SEQ ID NO: 880813 - protein, 9 aa, Homo Sapiens
KTQGEGKEI

SEQ ID NO: 880814 - protein, 9 aa, Homo Sapiens
GEPGEDAGC

SEQ ID NO: 880815 - protein, 9 aa, Homo Sapiens
PSRQKWSVE

SEQ ID NO: 880816 - protein, 9 aa, Homo Sapiens
HKRMHADCI

SEQ ID NO: 880817 - protein, 9 aa, Homo Sapiens
GFKLNAQTG

SEQ ID NO: 880818 - protein, 9 aa, Homo Sapiens
CASTDVEMT

SEQ ID NO: 880819 - protein, 9 aa, Homo Sapiens
PEGPFSRHL

SEQ ID NO: 880820 - protein, 9 aa, Homo Sapiens
ATDLSAHSS

SEQ ID NO: 880821 - protein, 9 aa, Homo Sapiens
CECNVCGKP

SEQ ID NO: 880822 - protein, 9 aa, Homo Sapiens
AATNNPRFG

SEQ ID NO: 880823 - protein, 9 aa, Homo Sapiens
NTYKKPSKY

SEQ ID NO: 880824 - protein, 9 aa, Homo Sapiens
KLNVEIEEL

SEQ ID NO: 880825 - protein, 9 aa, Homo Sapiens
ECLQTKLRE

SEQ ID NO: 880826 - protein, 9 aa, Homo Sapiens
KLVRQTTEL

SEQ ID NO: 880827 - protein, 9 aa, Homo Sapiens
KDEKICQAF

SEQ ID NO: 880828 - protein, 9 aa, Homo Sapiens
LEQDLKVVK

SEQ ID NO: 880829 - protein, 9 aa, Homo Sapiens
NFEEYFMRQ

SEQ ID NO: 880830 - protein, 9 aa, Homo Sapiens
DSLYVPSLY

SEQ ID NO: 880831 - protein, 9 aa, Homo Sapiens
SDMESLSVR

SEQ ID NO: 880832 - protein, 9 aa, Homo Sapiens
VFKFQLAEF

SEQ ID NO: 880833 - protein, 9 aa, Homo Sapiens
YDKVKARLQ

SEQ ID NO: 880834 - protein, 9 aa, Homo Sapiens
PGKDSYWTL

SEQ ID NO: 880835 - protein, 9 aa, Homo Sapiens
ENLLGYYVD

SEQ ID NO: 880836 - protein, 9 aa, Homo Sapiens
LGVVKFPPD

SEQ ID NO: 880837 - protein, 9 aa, Homo Sapiens
LSALNHAVL

SEQ ID NO: 880838 - protein, 9 aa, Homo Sapiens
LTSNMYQVW

SEQ ID NO: 880839 - protein, 9 aa, Homo Sapiens
NAIAQRILK

SEQ ID NO: 880840 - protein, 9 aa, Homo Sapiens
RPSNQGEYI

SEQ ID NO: 880841 - protein, 9 aa, Homo Sapiens
LLESSKRSW

SEQ ID NO: 880842 - protein, 9 aa, Homo Sapiens
RQCALLQSQ

SEQ ID NO: 880843 - protein, 9 aa, Homo Sapiens
LSTFHLCLT

SEQ ID NO: 880844 - protein, 9 aa, Homo Sapiens
LALPERAKL

SEQ ID NO: 880845 - protein, 9 aa, Homo Sapiens
ILENDIGNR

SEQ ID NO: 880846 - protein, 9 aa, Homo Sapiens
YQPLHYATI

SEQ ID NO: 880847 - protein, 9 aa, Homo Sapiens
MEYTGRPGP

SEQ ID NO: 880848 - protein, 9 aa, Homo Sapiens
FKPPQQSID

SEQ ID NO: 880849 - protein, 9 aa, Homo Sapiens
EGHELDLTY

SEQ ID NO: 880850 - protein, 9 aa, Homo Sapiens
ENYNRVQRK

SEQ ID NO: 880851 - protein, 9 aa, Homo Sapiens
FAFLFSFQN

SEQ ID NO: 880852 - protein, 9 aa, Homo Sapiens
LQGIHGDMH

SEQ ID NO: 880853 - protein, 9 aa, Homo Sapiens
HFLPHNFRV

SEQ ID NO: 880854 - protein, 9 aa, Homo Sapiens
VEARGRRVW

SEQ ID NO: 880855 - protein, 9 aa, Homo Sapiens
NPCHNGSTC

SEQ ID NO: 880856 - protein, 9 aa, Homo Sapiens
KDYIRERFN

SEQ ID NO: 880857 - protein, 9 aa, Homo Sapiens
AKLNDFAVF

SEQ ID NO: 880858 - protein, 9 aa, Homo Sapiens
VADRILASY

SEQ ID NO: 880859 - protein, 9 aa, Homo Sapiens
IQGDLAGCA

SEQ ID NO: 880860 - protein, 9 aa, Homo Sapiens
VTKDNAMLL

SEQ ID NO: 880861 - protein, 9 aa, Homo Sapiens
KGKQMHVQL

SEQ ID NO: 880862 - protein, 9 aa, Homo Sapiens
TISQPVVVV

SEQ ID NO: 880863 - protein, 9 aa, Homo Sapiens
QPKIDTVME

SEQ ID NO: 880864 - protein, 9 aa, Homo Sapiens
EYANDKNLI

SEQ ID NO: 880865 - protein, 9 aa, Homo Sapiens
KEYPVAFEY

SEQ ID NO: 880866 - protein, 9 aa, Homo Sapiens
INELFRTEG

SEQ ID NO: 880867 - protein, 9 aa, Homo Sapiens
YNSDSYDSL

SEQ ID NO: 880868 - protein, 9 aa, Homo Sapiens
SLHKCFVQV

SEQ ID NO: 880869 - protein, 9 aa, Homo Sapiens
VQLHIMENY

SEQ ID NO: 880870 - protein, 9 aa, Homo Sapiens
SDEEKVICL

SEQ ID NO: 880871 - protein, 9 aa, Homo Sapiens
SSDLPALAS

SEQ ID NO: 880872 - protein, 9 aa, Homo Sapiens
HFGAGTRLT

SEQ ID NO: 880873 - protein, 9 aa, Homo Sapiens
HIVETTYFC

SEQ ID NO: 880874 - protein, 9 aa, Homo Sapiens
QLYQKPLSD

SEQ ID NO: 880875 - protein, 9 aa, Homo Sapiens
EKQTVKYHT

SEQ ID NO: 880876 - protein, 9 aa, Homo Sapiens
HYHRGYHHG

SEQ ID NO: 880877 - protein, 9 aa, Homo Sapiens
VDIGENIEN

SEQ ID NO: 880878 - protein, 9 aa, Homo Sapiens
ARGDMLEAE

SEQ ID NO: 880879 - protein, 9 aa, Homo Sapiens
SLNCHGSSV

SEQ ID NO: 880880 - protein, 9 aa, Homo Sapiens
KAQMELHHQ

SEQ ID NO: 880881 - protein, 9 aa, Homo Sapiens
HQPYWWVQE

SEQ ID NO: 880882 - protein, 9 aa, Homo Sapiens
NHICGFLDI

SEQ ID NO: 880883 - protein, 9 aa, Homo Sapiens
VLNNYILKE

SEQ ID NO: 880884 - protein, 9 aa, Homo Sapiens
LNGCGHTCQ

SEQ ID NO: 880885 - protein, 9 aa, Homo Sapiens
YNDSAFMEP

SEQ ID NO: 880886 - protein, 9 aa, Homo Sapiens
RQGGQMVDN

SEQ ID NO: 880887 - protein, 9 aa, Homo Sapiens
IFSTVLIIP

SEQ ID NO: 880888 - protein, 9 aa, Homo Sapiens
YEHIAIGVF

SEQ ID NO: 880889 - protein, 9 aa, Homo Sapiens
RGKVIILHR

SEQ ID NO: 880890 - protein, 9 aa, Homo Sapiens
CYKCCQCSF

SEQ ID NO: 880891 - protein, 9 aa, Homo Sapiens
YLDWSVFHG

SEQ ID NO: 880892 - protein, 9 aa, Homo Sapiens
RRYRAPNHD

SEQ ID NO: 880893 - protein, 9 aa, Homo Sapiens
LRNHCFLEE

SEQ ID NO: 880894 - protein, 9 aa, Homo Sapiens
KHQSHSSGN

SEQ ID NO: 880895 - protein, 9 aa, Homo Sapiens
TLAMVVASQ

SEQ ID NO: 880896 - protein, 9 aa, Homo Sapiens
GSTHSGDLE

SEQ ID NO: 880897 - protein, 9 aa, Homo Sapiens
LSHFLEEIN

SEQ ID NO: 880898 - protein, 9 aa, Homo Sapiens
TLKKYLEEA

SEQ ID NO: 880899 - protein, 9 aa, Homo Sapiens
GYSQNHLQQ

SEQ ID NO: 880900 - protein, 9 aa, Homo Sapiens
DITFKHIMA

SEQ ID NO: 880901 - protein, 9 aa, Homo Sapiens
VPVDQVNCK

SEQ ID NO: 880902 - protein, 9 aa, Homo Sapiens
FGICVLYQK

SEQ ID NO: 880903 - protein, 9 aa, Homo Sapiens
RQPFPAFKP

SEQ ID NO: 880904 - protein, 9 aa, Homo Sapiens
EIVDDAKVK

SEQ ID NO: 880905 - protein, 9 aa, Homo Sapiens
NIRIMEPDS

SEQ ID NO: 880906 - protein, 9 aa, Homo Sapiens
NKLTKLNVS

SEQ ID NO: 880907 - protein, 9 aa, Homo Sapiens
YRYPNWPMV

SEQ ID NO: 880908 - protein, 9 aa, Homo Sapiens
VMKINGSLH

SEQ ID NO: 880909 - protein, 9 aa, Homo Sapiens
TFCVKTSLT

SEQ ID NO: 880910 - protein, 9 aa, Homo Sapiens
VKHHSSTTG

SEQ ID NO: 880911 - protein, 9 aa, Homo Sapiens
RPLPAICKH

SEQ ID NO: 880912 - protein, 9 aa, Homo Sapiens
TLNVGRNPF

SEQ ID NO: 880913 - protein, 9 aa, Homo Sapiens
NVDLIQHQI

SEQ ID NO: 880914 - protein, 9 aa, Homo Sapiens
CVKTIVKAK

SEQ ID NO: 880915 - protein, 9 aa, Homo Sapiens
RSLFDPTSQ

SEQ ID NO: 880916 - protein, 9 aa, Homo Sapiens
AQLKAAVGE

SEQ ID NO: 880917 - protein, 9 aa, Homo Sapiens
TKTDTEGII

SEQ ID NO: 880918 - protein, 9 aa, Homo Sapiens
QTLLQDFFN

SEQ ID NO: 880919 - protein, 9 aa, Homo Sapiens
YVAHLLAAR

SEQ ID NO: 880920 - protein, 9 aa, Homo Sapiens
QALMLQRPQ

SEQ ID NO: 880921 - protein, 9 aa, Homo Sapiens
NNIVVDDIT

SEQ ID NO: 880922 - protein, 9 aa, Homo Sapiens
LFVLFTMYI

SEQ ID NO: 880923 - protein, 9 aa, Homo Sapiens
WNGNSCSDF

SEQ ID NO: 880924 - protein, 9 aa, Homo Sapiens
ATLGAADKQ

SEQ ID NO: 880925 - protein, 9 aa, Homo Sapiens
NRESMGLLS

SEQ ID NO: 880926 - protein, 9 aa, Homo Sapiens
LPFRKNKMK

SEQ ID NO: 880927 - protein, 9 aa, Homo Sapiens
WMNKFSESE

SEQ ID NO: 880928 - protein, 9 aa, Homo Sapiens
EGFGIQIQW

SEQ ID NO: 880929 - protein, 9 aa, Homo Sapiens
TEHGESTAN

SEQ ID NO: 880930 - protein, 9 aa, Homo Sapiens
VEQSHIFSS

SEQ ID NO: 880931 - protein, 9 aa, Homo Sapiens
GRNALQRVC

SEQ ID NO: 880932 - protein, 9 aa, Homo Sapiens
AESFKFVRP

SEQ ID NO: 880933 - protein, 9 aa, Homo Sapiens
IQPSLTKNG

SEQ ID NO: 880934 - protein, 9 aa, Homo Sapiens
EFVLKTQNQ

SEQ ID NO: 880935 - protein, 9 aa, Homo Sapiens
KNKIEDASE

SEQ ID NO: 880936 - protein, 9 aa, Homo Sapiens
GRPEWQFFV

SEQ ID NO: 880937 - protein, 9 aa, Homo Sapiens
AMVVASQNA

SEQ ID NO: 880938 - protein, 9 aa, Homo Sapiens
SELYEAVNN

SEQ ID NO: 880939 - protein, 9 aa, Homo Sapiens
KYLVDHKVH

SEQ ID NO: 880940 - protein, 9 aa, Homo Sapiens
VRSGKCFKT

SEQ ID NO: 880941 - protein, 9 aa, Homo Sapiens
NKLGQMRSQ

SEQ ID NO: 880942 - protein, 9 aa, Homo Sapiens
SPNYSPTFP

SEQ ID NO: 880943 - protein, 9 aa, Homo Sapiens
TSTSNKSGD

SEQ ID NO: 880944 - protein, 9 aa, Homo Sapiens
DKFTKALMH

SEQ ID NO: 880945 - protein, 9 aa, Homo Sapiens
PQQSIDKPF

SEQ ID NO: 880946 - protein, 9 aa, Homo Sapiens
RRSHSAGDR

SEQ ID NO: 880947 - protein, 9 aa, Homo Sapiens
VLLNLLESA

SEQ ID NO: 880948 - protein, 9 aa, Homo Sapiens
KPDSQMKQD

SEQ ID NO: 880949 - protein, 9 aa, Homo Sapiens
LQAENETGN

SEQ ID NO: 880950 - protein, 9 aa, Homo Sapiens
LNIVKNHIF

SEQ ID NO: 880951 - protein, 9 aa, Homo Sapiens
ERMAGNKAL

SEQ ID NO: 880952 - protein, 9 aa, Homo Sapiens
WSLHTPSLR

SEQ ID NO: 880953 - protein, 9 aa, Homo Sapiens
TGKSKYKFW

SEQ ID NO: 880954 - protein, 9 aa, Homo Sapiens
ILTSVAIST

SEQ ID NO: 880955 - protein, 9 aa, Homo Sapiens
IQIVSTTRK

SEQ ID NO: 880956 - protein, 9 aa, Homo Sapiens
LLSHNKFWK

SEQ ID NO: 880957 - protein, 9 aa, Homo Sapiens
KRKLSLIGI

SEQ ID NO: 880958 - protein, 9 aa, Homo Sapiens
NEITLDLIK

SEQ ID NO: 880959 - protein, 9 aa, Homo Sapiens
ELNPQIGTF

SEQ ID NO: 880960 - protein, 9 aa, Homo Sapiens
LICTLKNAQ

SEQ ID NO: 880961 - protein, 9 aa, Homo Sapiens
KLGYAEKQI

SEQ ID NO: 880962 - protein, 9 aa, Homo Sapiens
EKGKYPVPK

SEQ ID NO: 880963 - protein, 9 aa, Homo Sapiens
VCCPCCAWQ

SEQ ID NO: 880964 - protein, 9 aa, Homo Sapiens
YWTDDSKKS

SEQ ID NO: 880965 - protein, 9 aa, Homo Sapiens
SHSAEVQVC

SEQ ID NO: 880966 - protein, 9 aa, Homo Sapiens
SATHRIHEI

SEQ ID NO: 880967 - protein, 9 aa, Homo Sapiens
GSQTPHIPY

SEQ ID NO: 880968 - protein, 9 aa, Homo Sapiens
RHSISNGSA

SEQ ID NO: 880969 - protein, 9 aa, Homo Sapiens
PEITSPPDS

SEQ ID NO: 880970 - protein, 9 aa, Homo Sapiens
CAALKETLR

SEQ ID NO: 880971 - protein, 9 aa, Homo Sapiens
FRLQELFFN

SEQ ID NO: 880972 - protein, 9 aa, Homo Sapiens
AKLERLTAK

SEQ ID NO: 880973 - protein, 9 aa, Homo Sapiens
RNSKAERLR

SEQ ID NO: 880974 - protein, 9 aa, Homo Sapiens
DKFWDRSSA

SEQ ID NO: 880975 - protein, 9 aa, Homo Sapiens
KTPKLNLLL

SEQ ID NO: 880976 - protein, 9 aa, Homo Sapiens
NPQGDVALH

SEQ ID NO: 880977 - protein, 9 aa, Homo Sapiens
IKTLILEDS

SEQ ID NO: 880978 - protein, 9 aa, Homo Sapiens
SEDVFDIIL

SEQ ID NO: 880979 - protein, 9 aa, Homo Sapiens
SILRSNRFC

SEQ ID NO: 880980 - protein, 9 aa, Homo Sapiens
DKSLGSTQF

SEQ ID NO: 880981 - protein, 9 aa, Homo Sapiens
HKPPPYKHI

SEQ ID NO: 880982 - protein, 9 aa, Homo Sapiens
VCIYRGKEY

SEQ ID NO: 880983 - protein, 9 aa, Homo Sapiens
FQTRLRLLR

SEQ ID NO: 880984 - protein, 9 aa, Homo Sapiens
LNGFKSNGP

SEQ ID NO: 880985 - protein, 9 aa, Homo Sapiens
QNEKGEIEQ

SEQ ID NO: 880986 - protein, 9 aa, Homo Sapiens
SLGFKLTSV

SEQ ID NO: 880987 - protein, 9 aa, Homo Sapiens
GIQIDLRCP

SEQ ID NO: 880988 - protein, 9 aa, Homo Sapiens
WINPDDFPL

SEQ ID NO: 880989 - protein, 9 aa, Homo Sapiens
EGELPTHKQ

SEQ ID NO: 880990 - protein, 9 aa, Homo Sapiens
SKVKVQNLD

SEQ ID NO: 880991 - protein, 9 aa, Homo Sapiens
PDPFKFSSG

SEQ ID NO: 880992 - protein, 9 aa, Homo Sapiens
ALTFLPARL

SEQ ID NO: 880993 - protein, 9 aa, Homo Sapiens
PPPRSTSQN

SEQ ID NO: 880994 - protein, 9 aa, Homo Sapiens
IESLGITSR

SEQ ID NO: 880995 - protein, 9 aa, Homo Sapiens
MLDSVLYAN

SEQ ID NO: 880996 - protein, 9 aa, Homo Sapiens
SLFDPTSQH

SEQ ID NO: 880997 - protein, 9 aa, Homo Sapiens
KKEDVKVIF

SEQ ID NO: 880998 - protein, 9 aa, Homo Sapiens
KQRQKQARL

SEQ ID NO: 880999 - protein, 9 aa, Homo Sapiens
LKALFKHGL

SEQ ID NO: 881000 - protein, 9 aa, Homo Sapiens
FYKVDYASF

SEQ ID NO: 881001 - protein, 9 aa, Homo Sapiens
LGQQGLGAW

SEQ ID NO: 881002 - protein, 9 aa, Homo Sapiens
YCLQKVTEK

SEQ ID NO: 881003 - protein, 9 aa, Homo Sapiens
RRLQNHMAV

SEQ ID NO: 881004 - protein, 9 aa, Homo Sapiens
CRRQNGYRA

SEQ ID NO: 881005 - protein, 9 aa, Homo Sapiens
QSLDLCTQL

SEQ ID NO: 881006 - protein, 9 aa, Homo Sapiens
KLPASDQTS

SEQ ID NO: 881007 - protein, 9 aa, Homo Sapiens
VDEMIHKAQ

SEQ ID NO: 881008 - protein, 9 aa, Homo Sapiens
QFNSFDRSV

SEQ ID NO: 881009 - protein, 9 aa, Homo Sapiens
HSISNGSAL

SEQ ID NO: 881010 - protein, 9 aa, Homo Sapiens
GRWNNQSIN

SEQ ID NO: 881011 - protein, 9 aa, Homo Sapiens
AERWHYRPT

SEQ ID NO: 881012 - protein, 9 aa, Homo Sapiens
PNFNDNCPT

SEQ ID NO: 881013 - protein, 9 aa, Homo Sapiens
WPSLRSQAK

SEQ ID NO: 881014 - protein, 9 aa, Homo Sapiens
ILFDIPPQE

SEQ ID NO: 881015 - protein, 9 aa, Homo Sapiens
QNELAHCTV

SEQ ID NO: 881016 - protein, 9 aa, Homo Sapiens
SLIKFFNKM

SEQ ID NO: 881017 - protein, 9 aa, Homo Sapiens
NKITANLFQ

SEQ ID NO: 881018 - protein, 9 aa, Homo Sapiens
VVGAIKQNA

SEQ ID NO: 881019 - protein, 9 aa, Homo Sapiens
LRKILRRDI

SEQ ID NO: 881020 - protein, 9 aa, Homo Sapiens
PSADPGMPR

SEQ ID NO: 881021 - protein, 9 aa, Homo Sapiens
KVPKTAEHF

SEQ ID NO: 881022 - protein, 9 aa, Homo Sapiens
RSSVKRTHY

SEQ ID NO: 881023 - protein, 9 aa, Homo Sapiens
ERLFQCNIC

SEQ ID NO: 881024 - protein, 9 aa, Homo Sapiens
EKTANKGRP

SEQ ID NO: 881025 - protein, 9 aa, Homo Sapiens
GFGLARVAD

SEQ ID NO: 881026 - protein, 9 aa, Homo Sapiens
FKGITTLPN

SEQ ID NO: 881027 - protein, 9 aa, Homo Sapiens
LNSSGPSTS

SEQ ID NO: 881028 - protein, 9 aa, Homo Sapiens
RRKNRKTRR

SEQ ID NO: 881029 - protein, 9 aa, Homo Sapiens
VFLDKKILL

SEQ ID NO: 881030 - protein, 9 aa, Homo Sapiens
QYQSMRRDV

SEQ ID NO: 881031 - protein, 9 aa, Homo Sapiens
SMPCLGTEK

SEQ ID NO: 881032 - protein, 9 aa, Homo Sapiens
IKPSPLTPC

SEQ ID NO: 881033 - protein, 9 aa, Homo Sapiens
EELTQMLIQ

SEQ ID NO: 881034 - protein, 9 aa, Homo Sapiens
HRTLLESSK

SEQ ID NO: 881035 - protein, 9 aa, Homo Sapiens
TKSMAPRQL

SEQ ID NO: 881036 - protein, 9 aa, Homo Sapiens
GSFKTQKPY

SEQ ID NO: 881037 - protein, 9 aa, Homo Sapiens
KSLDFLYFT

SEQ ID NO: 881038 - protein, 9 aa, Homo Sapiens
VDELVTGKK

SEQ ID NO: 881039 - protein, 9 aa, Homo Sapiens
RSWSEAAPK

SEQ ID NO: 881040 - protein, 9 aa, Homo Sapiens
SQGLGLHFY

SEQ ID NO: 881041 - protein, 9 aa, Homo Sapiens
FLSEREASA

SEQ ID NO: 881042 - protein, 9 aa, Homo Sapiens
DDKLYTVHL

SEQ ID NO: 881043 - protein, 9 aa, Homo Sapiens
TVICDMDTD

SEQ ID NO: 881044 - protein, 9 aa, Homo Sapiens
HIFQDLQSS

SEQ ID NO: 881045 - protein, 9 aa, Homo Sapiens
KAHEITYVR

SEQ ID NO: 881046 - protein, 9 aa, Homo Sapiens
HHQQIHTGE

SEQ ID NO: 881047 - protein, 9 aa, Homo Sapiens
MLGLARRSP

SEQ ID NO: 881048 - protein, 9 aa, Homo Sapiens
YPQERMFTI

SEQ ID NO: 881049 - protein, 9 aa, Homo Sapiens
IPKGQTSVL

SEQ ID NO: 881050 - protein, 9 aa, Homo Sapiens
KKTNQCKEC

SEQ ID NO: 881051 - protein, 9 aa, Homo Sapiens
TLNSCINPF

SEQ ID NO: 881052 - protein, 9 aa, Homo Sapiens
LKNLEHHLN

SEQ ID NO: 881053 - protein, 9 aa, Homo Sapiens
KIWWKYMIV

SEQ ID NO: 881054 - protein, 9 aa, Homo Sapiens
ELADRSATK

SEQ ID NO: 881055 - protein, 9 aa, Homo Sapiens
CNFPSAKCV

SEQ ID NO: 881056 - protein, 9 aa, Homo Sapiens
FTSILNFYH

SEQ ID NO: 881057 - protein, 9 aa, Homo Sapiens
RAINKYPTK

SEQ ID NO: 881058 - protein, 9 aa, Homo Sapiens
KADILRSQS

SEQ ID NO: 881059 - protein, 9 aa, Homo Sapiens
KRVLKMDSL

SEQ ID NO: 881060 - protein, 9 aa, Homo Sapiens
AITLFEQCV

SEQ ID NO: 881061 - protein, 9 aa, Homo Sapiens
GKVLCTYMA

SEQ ID NO: 881062 - protein, 9 aa, Homo Sapiens
RKKNRELEK

SEQ ID NO: 881063 - protein, 9 aa, Homo Sapiens
LQARVAELE

SEQ ID NO: 881064 - protein, 9 aa, Homo Sapiens
SSQGASHFD

SEQ ID NO: 881065 - protein, 9 aa, Homo Sapiens
SDLTQHQII

SEQ ID NO: 881066 - protein, 9 aa, Homo Sapiens
PQECFQPVW

SEQ ID NO: 881067 - protein, 9 aa, Homo Sapiens
HQLGSKYIL

SEQ ID NO: 881068 - protein, 9 aa, Homo Sapiens
GGHCSIPSL

SEQ ID NO: 881069 - protein, 9 aa, Homo Sapiens
TKGFWRPLR

SEQ ID NO: 881070 - protein, 9 aa, Homo Sapiens
ETEEAWLRH

SEQ ID NO: 881071 - protein, 9 aa, Homo Sapiens
DIDKGQLPL

SEQ ID NO: 881072 - protein, 9 aa, Homo Sapiens
TQIMSLFIV

SEQ ID NO: 881073 - protein, 9 aa, Homo Sapiens
EVRIFKNAD

SEQ ID NO: 881074 - protein, 9 aa, Homo Sapiens
ELIRNTLYK

SEQ ID NO: 881075 - protein, 9 aa, Homo Sapiens
NENDLLQAQ

SEQ ID NO: 881076 - protein, 9 aa, Homo Sapiens
CGFGLARVA

SEQ ID NO: 881077 - protein, 9 aa, Homo Sapiens
LSEREQFCQ

SEQ ID NO: 881078 - protein, 9 aa, Homo Sapiens
PAQVQDNQQ

SEQ ID NO: 881079 - protein, 9 aa, Homo Sapiens
RLIFNHFAT

SEQ ID NO: 881080 - protein, 9 aa, Homo Sapiens
HIQDMFTGG

SEQ ID NO: 881081 - protein, 9 aa, Homo Sapiens
KDHSIFTVE

SEQ ID NO: 881082 - protein, 9 aa, Homo Sapiens
NGNVEDIKR

SEQ ID NO: 881083 - protein, 9 aa, Homo Sapiens
QTTVNPDCI

SEQ ID NO: 881084 - protein, 9 aa, Homo Sapiens
DMESLSVRE

SEQ ID NO: 881085 - protein, 9 aa, Homo Sapiens
GSKKTPAKS

SEQ ID NO: 881086 - protein, 9 aa, Homo Sapiens
DLYFNLQCC

SEQ ID NO: 881087 - protein, 9 aa, Homo Sapiens
MITCKTKHV

SEQ ID NO: 881088 - protein, 9 aa, Homo Sapiens
VPSNHQNNH

SEQ ID NO: 881089 - protein, 9 aa, Homo Sapiens
NRAAGKDYE

SEQ ID NO: 881090 - protein, 9 aa, Homo Sapiens
KDQMVYTVR

SEQ ID NO: 881091 - protein, 9 aa, Homo Sapiens
NNQLRHIHL

SEQ ID NO: 881092 - protein, 9 aa, Homo Sapiens
IIITVSTNG

SEQ ID NO: 881093 - protein, 9 aa, Homo Sapiens
SLEKQTVKY

SEQ ID NO: 881094 - protein, 9 aa, Homo Sapiens
TKMRSSGWK

SEQ ID NO: 881095 - protein, 9 aa, Homo Sapiens
GLDNKVKDG

SEQ ID NO: 881096 - protein, 9 aa, Homo Sapiens
KKAICKQDL

SEQ ID NO: 881097 - protein, 9 aa, Homo Sapiens
ATLLVPDTG

SEQ ID NO: 881098 - protein, 9 aa, Homo Sapiens
PPGILENTS

SEQ ID NO: 881099 - protein, 9 aa, Homo Sapiens
LNLKKGLST

SEQ ID NO: 881100 - protein, 9 aa, Homo Sapiens
FSQRIFMIL

SEQ ID NO: 881101 - protein, 9 aa, Homo Sapiens
KDRYTYNNT

SEQ ID NO: 881102 - protein, 9 aa, Homo Sapiens
GGIIVFQKD

SEQ ID NO: 881103 - protein, 9 aa, Homo Sapiens
LSSYFLNEI

SEQ ID NO: 881104 - protein, 9 aa, Homo Sapiens
SSQMETVSN

SEQ ID NO: 881105 - protein, 9 aa, Homo Sapiens
SPQMLTKEN

SEQ ID NO: 881106 - protein, 9 aa, Homo Sapiens
IISLSQNDF

SEQ ID NO: 881107 - protein, 9 aa, Homo Sapiens
KEQNLKAEI

SEQ ID NO: 881108 - protein, 9 aa, Homo Sapiens
VQIYHRKAK

SEQ ID NO: 881109 - protein, 9 aa, Homo Sapiens
AWHVKCAQC

SEQ ID NO: 881110 - protein, 9 aa, Homo Sapiens
NNLNLGGAM

SEQ ID NO: 881111 - protein, 9 aa, Homo Sapiens
DRSKSKSNR

SEQ ID NO: 881112 - protein, 9 aa, Homo Sapiens
GIKEVASII

SEQ ID NO: 881113 - protein, 9 aa, Homo Sapiens
QMDGDVAKT

SEQ ID NO: 881114 - protein, 9 aa, Homo Sapiens
QLLLLSIAV

SEQ ID NO: 881115 - protein, 9 aa, Homo Sapiens
TSCAPPAPC

SEQ ID NO: 881116 - protein, 9 aa, Homo Sapiens
AVVSETNQV

SEQ ID NO: 881117 - protein, 9 aa, Homo Sapiens
DPSISVSGM

SEQ ID NO: 881118 - protein, 9 aa, Homo Sapiens
VAVGVFRSD

SEQ ID NO: 881119 - protein, 9 aa, Homo Sapiens
PQTVISLPK

SEQ ID NO: 881120 - protein, 9 aa, Homo Sapiens
SLEAEPRSK

SEQ ID NO: 881121 - protein, 9 aa, Homo Sapiens
SPQNSLEVV

SEQ ID NO: 881122 - protein, 9 aa, Homo Sapiens
TDGGPFAKL

SEQ ID NO: 881123 - protein, 9 aa, Homo Sapiens
TSSRSLFDP

SEQ ID NO: 881124 - protein, 9 aa, Homo Sapiens
RNSVSPVLP

SEQ ID NO: 881125 - protein, 9 aa, Homo Sapiens
KLQQLFKGS

SEQ ID NO: 881126 - protein, 9 aa, Homo Sapiens
CHFSCGNGF

SEQ ID NO: 881127 - protein, 9 aa, Homo Sapiens
VTLLHSERP

SEQ ID NO: 881128 - protein, 9 aa, Homo Sapiens
QVLTFNLME

SEQ ID NO: 881129 - protein, 9 aa, Homo Sapiens
TLASRSQPK

SEQ ID NO: 881130 - protein, 9 aa, Homo Sapiens
WNEICYNIL

SEQ ID NO: 881131 - protein, 9 aa, Homo Sapiens
HQNRFSTFT

SEQ ID NO: 881132 - protein, 9 aa, Homo Sapiens
IKRGIKILE

SEQ ID NO: 881133 - protein, 9 aa, Homo Sapiens
GSTCRDLVN

SEQ ID NO: 881134 - protein, 9 aa, Homo Sapiens
ELRLTKNIH

SEQ ID NO: 881135 - protein, 9 aa, Homo Sapiens
EAIQNIAAI

SEQ ID NO: 881136 - protein, 9 aa, Homo Sapiens
SLDGYYLVA

SEQ ID NO: 881137 - protein, 9 aa, Homo Sapiens
TANYSKTFT

SEQ ID NO: 881138 - protein, 9 aa, Homo Sapiens
KPSLGDHSK

SEQ ID NO: 881139 - protein, 9 aa, Homo Sapiens
EEYQSRYQS

SEQ ID NO: 881140 - protein, 9 aa, Homo Sapiens
SFRTEQSTA

SEQ ID NO: 881141 - protein, 9 aa, Homo Sapiens
IRKMIQLPS

SEQ ID NO: 881142 - protein, 9 aa, Homo Sapiens
NLISSVAVD

SEQ ID NO: 881143 - protein, 9 aa, Homo Sapiens
LSRMCANER

SEQ ID NO: 881144 - protein, 9 aa, Homo Sapiens
RLLLDGDQL

SEQ ID NO: 881145 - protein, 9 aa, Homo Sapiens
YKKERICKL

SEQ ID NO: 881146 - protein, 9 aa, Homo Sapiens
AMEFIQGEV

SEQ ID NO: 881147 - protein, 9 aa, Homo Sapiens
RPFKCPCSL

SEQ ID NO: 881148 - protein, 9 aa, Homo Sapiens
VNLCDDLAP

SEQ ID NO: 881149 - protein, 9 aa, Homo Sapiens
SQSRLPGRP

SEQ ID NO: 881150 - protein, 9 aa, Homo Sapiens
FYTFSWAFL

SEQ ID NO: 881151 - protein, 9 aa, Homo Sapiens
QLHPASPAS

SEQ ID NO: 881152 - protein, 9 aa, Homo Sapiens
CGKTFKCFS

SEQ ID NO: 881153 - protein, 9 aa, Homo Sapiens
ADHKPESKV

SEQ ID NO: 881154 - protein, 9 aa, Homo Sapiens
PLTASAAGS

SEQ ID NO: 881155 - protein, 9 aa, Homo Sapiens
QHSVVVPYE

SEQ ID NO: 881156 - protein, 9 aa, Homo Sapiens
SASESGDQY

SEQ ID NO: 881157 - protein, 9 aa, Homo Sapiens
TRLIMQQGQ

SEQ ID NO: 881158 - protein, 9 aa, Homo Sapiens
EPNNSPEDL

SEQ ID NO: 881159 - protein, 9 aa, Homo Sapiens
YFRVLTRKH

SEQ ID NO: 881160 - protein, 9 aa, Homo Sapiens
IIYRYLKPE

SEQ ID NO: 881161 - protein, 9 aa, Homo Sapiens
KVKVQVNVH

SEQ ID NO: 881162 - protein, 9 aa, Homo Sapiens
GQTANKDPI

SEQ ID NO: 881163 - protein, 9 aa, Homo Sapiens
QPGRPLTQL

SEQ ID NO: 881164 - protein, 9 aa, Homo Sapiens
PQEWTLENN

SEQ ID NO: 881165 - protein, 9 aa, Homo Sapiens
RFCTKNREW

SEQ ID NO: 881166 - protein, 9 aa, Homo Sapiens
ICLYGRPIN

SEQ ID NO: 881167 - protein, 9 aa, Homo Sapiens
VRFETVNQN

SEQ ID NO: 881168 - protein, 9 aa, Homo Sapiens
NVLLTCSLD

SEQ ID NO: 881169 - protein, 9 aa, Homo Sapiens
LANMKVTLK

SEQ ID NO: 881170 - protein, 9 aa, Homo Sapiens
EKTSQMLSS

SEQ ID NO: 881171 - protein, 9 aa, Homo Sapiens
QPLHTKLNR

SEQ ID NO: 881172 - protein, 9 aa, Homo Sapiens
RLDFTEFFL

SEQ ID NO: 881173 - protein, 9 aa, Homo Sapiens
NWFKNRQQR

SEQ ID NO: 881174 - protein, 9 aa, Homo Sapiens
RLIGTTLGG

SEQ ID NO: 881175 - protein, 9 aa, Homo Sapiens
YANTINTFW

SEQ ID NO: 881176 - protein, 9 aa, Homo Sapiens
SRMESTGKL

SEQ ID NO: 881177 - protein, 9 aa, Homo Sapiens
LSVPAPPSQ

SEQ ID NO: 881178 - protein, 9 aa, Homo Sapiens
NIAKYQENL

SEQ ID NO: 881179 - protein, 9 aa, Homo Sapiens
NNSNNEVAC

SEQ ID NO: 881180 - protein, 9 aa, Homo Sapiens
YMGSNSQVQ

SEQ ID NO: 881181 - protein, 9 aa, Homo Sapiens
ISVGSGLRQ

SEQ ID NO: 881182 - protein, 9 aa, Homo Sapiens
DYNMVLAYV

SEQ ID NO: 881183 - protein, 9 aa, Homo Sapiens
EEDKHPYEL

SEQ ID NO: 881184 - protein, 9 aa, Homo Sapiens
IFWIQTETP

SEQ ID NO: 881185 - protein, 9 aa, Homo Sapiens
PISHICYWV

SEQ ID NO: 881186 - protein, 9 aa, Homo Sapiens
DVKNLNTTA

SEQ ID NO: 881187 - protein, 9 aa, Homo Sapiens
NVSLSAVRT

SEQ ID NO: 881188 - protein, 9 aa, Homo Sapiens
PHKPNTLTD

SEQ ID NO: 881189 - protein, 9 aa, Homo Sapiens
LVLANLTTC

SEQ ID NO: 881190 - protein, 9 aa, Homo Sapiens
ENIVRNIQA

SEQ ID NO: 881191 - protein, 9 aa, Homo Sapiens
RFLIKATTE

SEQ ID NO: 881192 - protein, 9 aa, Homo Sapiens
VAISTSTDK

SEQ ID NO: 881193 - protein, 9 aa, Homo Sapiens
HQIQHKGKD

SEQ ID NO: 881194 - protein, 9 aa, Homo Sapiens
QTSLMALAV

SEQ ID NO: 881195 - protein, 9 aa, Homo Sapiens
VWQNENEQI

SEQ ID NO: 881196 - protein, 9 aa, Homo Sapiens
RFPLTQKHG

SEQ ID NO: 881197 - protein, 9 aa, Homo Sapiens
NKKLAEWLE

SEQ ID NO: 881198 - protein, 9 aa, Homo Sapiens
HIQKQSICH

SEQ ID NO: 881199 - protein, 9 aa, Homo Sapiens
EEFQQTKLL

SEQ ID NO: 881200 - protein, 9 aa, Homo Sapiens
DVLPGLTSH

SEQ ID NO: 881201 - protein, 9 aa, Homo Sapiens
AVWSYYEVF

SEQ ID NO: 881202 - protein, 9 aa, Homo Sapiens
QIHVSKRGT

SEQ ID NO: 881203 - protein, 9 aa, Homo Sapiens
RKNKMKEQE

SEQ ID NO: 881204 - protein, 9 aa, Homo Sapiens
SGDLYRHIC

SEQ ID NO: 881205 - protein, 9 aa, Homo Sapiens
CKGFFRQSI

SEQ ID NO: 881206 - protein, 9 aa, Homo Sapiens
IDITECMEA

SEQ ID NO: 881207 - protein, 9 aa, Homo Sapiens
PCSSSPCCG

SEQ ID NO: 881208 - protein, 9 aa, Homo Sapiens
CIKQTLPSS

SEQ ID NO: 881209 - protein, 9 aa, Homo Sapiens
CHQQMQQQA

SEQ ID NO: 881210 - protein, 9 aa, Homo Sapiens
DGKICLWRN

SEQ ID NO: 881211 - protein, 9 aa, Homo Sapiens
NEILNLHGK

SEQ ID NO: 881212 - protein, 9 aa, Homo Sapiens
VSVESDNYV

SEQ ID NO: 881213 - protein, 9 aa, Homo Sapiens
VQQLELENL

SEQ ID NO: 881214 - protein, 9 aa, Homo Sapiens
VACAEEWQK

SEQ ID NO: 881215 - protein, 9 aa, Homo Sapiens
YHGDLIKIT

SEQ ID NO: 881216 - protein, 9 aa, Homo Sapiens
PLICTLKNA

SEQ ID NO: 881217 - protein, 9 aa, Homo Sapiens
NKSLVKQSP

SEQ ID NO: 881218 - protein, 9 aa, Homo Sapiens
EVANVNDNA

SEQ ID NO: 881219 - protein, 9 aa, Homo Sapiens
CKNHPGCIP

SEQ ID NO: 881220 - protein, 9 aa, Homo Sapiens
RGQYSDSVA

SEQ ID NO: 881221 - protein, 9 aa, Homo Sapiens
IQFEPPMLD

SEQ ID NO: 881222 - protein, 9 aa, Homo Sapiens
EVTECSNGL

SEQ ID NO: 881223 - protein, 9 aa, Homo Sapiens
IPLKTQNDL

SEQ ID NO: 881224 - protein, 9 aa, Homo Sapiens
SFACHREPC

SEQ ID NO: 881225 - protein, 9 aa, Homo Sapiens
TGGGLSPSD

SEQ ID NO: 881226 - protein, 9 aa, Homo Sapiens
NLFCFLTDT

SEQ ID NO: 881227 - protein, 9 aa, Homo Sapiens
KAKWEALNL

SEQ ID NO: 881228 - protein, 9 aa, Homo Sapiens
ITHKQTHIK

SEQ ID NO: 881229 - protein, 9 aa, Homo Sapiens
FGNDGVKVC

SEQ ID NO: 881230 - protein, 9 aa, Homo Sapiens
EIWNEICYN

SEQ ID NO: 881231 - protein, 9 aa, Homo Sapiens
YTVQQLELE

SEQ ID NO: 881232 - protein, 9 aa, Homo Sapiens
QILKAYTIY

SEQ ID NO: 881233 - protein, 9 aa, Homo Sapiens
SRAVETVKA

SEQ ID NO: 881234 - protein, 9 aa, Homo Sapiens
DTVLDILRY

SEQ ID NO: 881235 - protein, 9 aa, Homo Sapiens
TEEMAFFGT

SEQ ID NO: 881236 - protein, 9 aa, Homo Sapiens
KYTEEYEKN

SEQ ID NO: 881237 - protein, 9 aa, Homo Sapiens
DNGQEIKNP

SEQ ID NO: 881238 - protein, 9 aa, Homo Sapiens
KVLEKQTAI

SEQ ID NO: 881239 - protein, 9 aa, Homo Sapiens
EEAPIVKPH

SEQ ID NO: 881240 - protein, 9 aa, Homo Sapiens
SIDYLRLNK

SEQ ID NO: 881241 - protein, 9 aa, Homo Sapiens
LKKNEIQKL

SEQ ID NO: 881242 - protein, 9 aa, Homo Sapiens
QKPYKPFHR

SEQ ID NO: 881243 - protein, 9 aa, Homo Sapiens
ANIAEALYS

SEQ ID NO: 881244 - protein, 9 aa, Homo Sapiens
GTFISVCRH

SEQ ID NO: 881245 - protein, 9 aa, Homo Sapiens
SFQNTTASV

SEQ ID NO: 881246 - protein, 9 aa, Homo Sapiens
LNVGRNPFR

SEQ ID NO: 881247 - protein, 9 aa, Homo Sapiens
LPMQFNSFD

SEQ ID NO: 881248 - protein, 9 aa, Homo Sapiens
NVTLKTIKN

SEQ ID NO: 881249 - protein, 9 aa, Homo Sapiens
VEFCKRMEK

SEQ ID NO: 881250 - protein, 9 aa, Homo Sapiens
ACQTPVLAS

SEQ ID NO: 881251 - protein, 9 aa, Homo Sapiens
VQFQYVLIA

SEQ ID NO: 881252 - protein, 9 aa, Homo Sapiens
KLNKKSMYS

SEQ ID NO: 881253 - protein, 9 aa, Homo Sapiens
LVIHAPPPT

SEQ ID NO: 881254 - protein, 9 aa, Homo Sapiens
LHKLKKGLR

SEQ ID NO: 881255 - protein, 9 aa, Homo Sapiens
LLLGLQDKL

SEQ ID NO: 881256 - protein, 9 aa, Homo Sapiens
ENNLETERI

SEQ ID NO: 881257 - protein, 9 aa, Homo Sapiens
VVTTLHSAP

SEQ ID NO: 881258 - protein, 9 aa, Homo Sapiens
INRTSFTQE

SEQ ID NO: 881259 - protein, 9 aa, Homo Sapiens
HQCVKTIVK

SEQ ID NO: 881260 - protein, 9 aa, Homo Sapiens
SGRVQALRR

SEQ ID NO: 881261 - protein, 9 aa, Homo Sapiens
TVCLFVLDL

SEQ ID NO: 881262 - protein, 9 aa, Homo Sapiens
NVAYLDVCI

SEQ ID NO: 881263 - protein, 9 aa, Homo Sapiens
IKLTGKECE

SEQ ID NO: 881264 - protein, 9 aa, Homo Sapiens
SDWIINGSK

SEQ ID NO: 881265 - protein, 9 aa, Homo Sapiens
SFLAHPGPL

SEQ ID NO: 881266 - protein, 9 aa, Homo Sapiens
VNGVDYSDS

SEQ ID NO: 881267 - protein, 9 aa, Homo Sapiens
KECGMAFQY

SEQ ID NO: 881268 - protein, 9 aa, Homo Sapiens
KECRKTFIC

SEQ ID NO: 881269 - protein, 9 aa, Homo Sapiens
PGSPQMLTK

SEQ ID NO: 881270 - protein, 9 aa, Homo Sapiens
NPPASEVLQ

SEQ ID NO: 881271 - protein, 9 aa, Homo Sapiens
QTQGKGDAA

SEQ ID NO: 881272 - protein, 9 aa, Homo Sapiens
ECRGLRAIS

SEQ ID NO: 881273 - protein, 9 aa, Homo Sapiens
DKVNLPKYS

SEQ ID NO: 881274 - protein, 9 aa, Homo Sapiens
DRGPGGATG

SEQ ID NO: 881275 - protein, 9 aa, Homo Sapiens
KNYERVKTC

SEQ ID NO: 881276 - protein, 9 aa, Homo Sapiens
QNILILSHG

SEQ ID NO: 881277 - protein, 9 aa, Homo Sapiens
LNNGRWHCQ

SEQ ID NO: 881278 - protein, 9 aa, Homo Sapiens
SCHACRSGF

SEQ ID NO: 881279 - protein, 9 aa, Homo Sapiens
LGIICLLLM

SEQ ID NO: 881280 - protein, 9 aa, Homo Sapiens
EISKPGKFE

SEQ ID NO: 881281 - protein, 9 aa, Homo Sapiens
KKFNGEDIN

SEQ ID NO: 881282 - protein, 9 aa, Homo Sapiens
MCDIERHFG

SEQ ID NO: 881283 - protein, 9 aa, Homo Sapiens
EKMYGKQNI

SEQ ID NO: 881284 - protein, 9 aa, Homo Sapiens
KYEHTELQK

SEQ ID NO: 881285 - protein, 9 aa, Homo Sapiens
LIVQRWMRG

SEQ ID NO: 881286 - protein, 9 aa, Homo Sapiens
KHVFSGGRD

SEQ ID NO: 881287 - protein, 9 aa, Homo Sapiens
CVGWRHRLL

SEQ ID NO: 881288 - protein, 9 aa, Homo Sapiens
HYKDPSLCM

SEQ ID NO: 881289 - protein, 9 aa, Homo Sapiens
GYKVLIQPL

SEQ ID NO: 881290 - protein, 9 aa, Homo Sapiens
MWLDRRALC

SEQ ID NO: 881291 - protein, 9 aa, Homo Sapiens
KYSKWLGPE

SEQ ID NO: 881292 - protein, 9 aa, Homo Sapiens
NVELPPWAS

SEQ ID NO: 881293 - protein, 9 aa, Homo Sapiens
DEAQGVGLN

SEQ ID NO: 881294 - protein, 9 aa, Homo Sapiens
EMGNCIEDL

SEQ ID NO: 881295 - protein, 9 aa, Homo Sapiens
NYFTNSVLT

SEQ ID NO: 881296 - protein, 9 aa, Homo Sapiens
DKLTEKECI

SEQ ID NO: 881297 - protein, 9 aa, Homo Sapiens
EYKKILLLE

SEQ ID NO: 881298 - protein, 9 aa, Homo Sapiens
HKPYLWVRL

SEQ ID NO: 881299 - protein, 9 aa, Homo Sapiens
SLICHQISH

SEQ ID NO: 881300 - protein, 9 aa, Homo Sapiens
PRSLPSNPS

SEQ ID NO: 881301 - protein, 9 aa, Homo Sapiens
GFFRQSIQK

SEQ ID NO: 881302 - protein, 9 aa, Homo Sapiens
LRKGADSTG

SEQ ID NO: 881303 - protein, 9 aa, Homo Sapiens
RNPEEIEKE

SEQ ID NO: 881304 - protein, 9 aa, Homo Sapiens
CLGTEKQPP

SEQ ID NO: 881305 - protein, 9 aa, Homo Sapiens
GKNKAQYEE

SEQ ID NO: 881306 - protein, 9 aa, Homo Sapiens
SVSHAWDSE

SEQ ID NO: 881307 - protein, 9 aa, Homo Sapiens
HFCKNHPGC

SEQ ID NO: 881308 - protein, 9 aa, Homo Sapiens
TVWDSGVAV

SEQ ID NO: 881309 - protein, 9 aa, Homo Sapiens
PNTLTDTLI

SEQ ID NO: 881310 - protein, 9 aa, Homo Sapiens
HGDDGHLFC

SEQ ID NO: 881311 - protein, 9 aa, Homo Sapiens
PQYPGASCH

SEQ ID NO: 881312 - protein, 9 aa, Homo Sapiens
DDAGCLQGL

SEQ ID NO: 881313 - protein, 9 aa, Homo Sapiens
GFPKAIKTN

SEQ ID NO: 881314 - protein, 9 aa, Homo Sapiens
QTDFVLDYP

SEQ ID NO: 881315 - protein, 9 aa, Homo Sapiens
EKDTFKEKD

SEQ ID NO: 881316 - protein, 9 aa, Homo Sapiens
ILRLYNYVH

SEQ ID NO: 881317 - protein, 9 aa, Homo Sapiens
TWQKRFSST

SEQ ID NO: 881318 - protein, 9 aa, Homo Sapiens
QEQISYTPP

SEQ ID NO: 881319 - protein, 9 aa, Homo Sapiens
QACQKTFSR

SEQ ID NO: 881320 - protein, 9 aa, Homo Sapiens
KPKLALEDL

SEQ ID NO: 881321 - protein, 9 aa, Homo Sapiens
RECLKKVSE

SEQ ID NO: 881322 - protein, 9 aa, Homo Sapiens
MINDAVNEI

SEQ ID NO: 881323 - protein, 9 aa, Homo Sapiens
PHTNNWRPQ

SEQ ID NO: 881324 - protein, 9 aa, Homo Sapiens
AITEHLRSF

SEQ ID NO: 881325 - protein, 9 aa, Homo Sapiens
IMVVCMFSL

SEQ ID NO: 881326 - protein, 9 aa, Homo Sapiens
KINCNNFWL

SEQ ID NO: 881327 - protein, 9 aa, Homo Sapiens
KIHQYKVQA

SEQ ID NO: 881328 - protein, 9 aa, Homo Sapiens
EEEHCQHLQ

SEQ ID NO: 881329 - protein, 9 aa, Homo Sapiens
DVMSFNQTG

SEQ ID NO: 881330 - protein, 9 aa, Homo Sapiens
LMSSMAPTP

SEQ ID NO: 881331 - protein, 9 aa, Homo Sapiens
DKIERSKTV

SEQ ID NO: 881332 - protein, 9 aa, Homo Sapiens
HQQDWTILH

SEQ ID NO: 881333 - protein, 9 aa, Homo Sapiens
WIPVKWMAI

SEQ ID NO: 881334 - protein, 9 aa, Homo Sapiens
SDASVHEEM

SEQ ID NO: 881335 - protein, 9 aa, Homo Sapiens
WRDQVTDTC

SEQ ID NO: 881336 - protein, 9 aa, Homo Sapiens
TAGRDHLLT

SEQ ID NO: 881337 - protein, 9 aa, Homo Sapiens
GARYACQIH

SEQ ID NO: 881338 - protein, 9 aa, Homo Sapiens
TLTNAVAHV

SEQ ID NO: 881339 - protein, 9 aa, Homo Sapiens
RNIFLKQLD

SEQ ID NO: 881340 - protein, 9 aa, Homo Sapiens
VRIKTSILS

SEQ ID NO: 881341 - protein, 9 aa, Homo Sapiens
AVVLGAMAI

SEQ ID NO: 881342 - protein, 9 aa, Homo Sapiens
LSGRKASCS

SEQ ID NO: 881343 - protein, 9 aa, Homo Sapiens
TCLCCKRGN

SEQ ID NO: 881344 - protein, 9 aa, Homo Sapiens
IINLGEQQK

SEQ ID NO: 881345 - protein, 9 aa, Homo Sapiens
KKKRLCLAE

SEQ ID NO: 881346 - protein, 9 aa, Homo Sapiens
IVRAYNIPV

SEQ ID NO: 881347 - protein, 9 aa, Homo Sapiens
FTRTKGYST

SEQ ID NO: 881348 - protein, 9 aa, Homo Sapiens
MFLTGNTSP

SEQ ID NO: 881349 - protein, 9 aa, Homo Sapiens
GATGPKGDQ

SEQ ID NO: 881350 - protein, 9 aa, Homo Sapiens
HHSSLENPE

SEQ ID NO: 881351 - protein, 9 aa, Homo Sapiens
VTISYIDAE

SEQ ID NO: 881352 - protein, 9 aa, Homo Sapiens
FQHQRIHTG

SEQ ID NO: 881353 - protein, 9 aa, Homo Sapiens
GSQGFKQHR

SEQ ID NO: 881354 - protein, 9 aa, Homo Sapiens
LKNGAGSLV

SEQ ID NO: 881355 - protein, 9 aa, Homo Sapiens
KVYECKQCS

SEQ ID NO: 881356 - protein, 9 aa, Homo Sapiens
FVQLCADYR

SEQ ID NO: 881357 - protein, 9 aa, Homo Sapiens
KHINLFINP

SEQ ID NO: 881358 - protein, 9 aa, Homo Sapiens
EKLGTHLSK

SEQ ID NO: 881359 - protein, 9 aa, Homo Sapiens
VDIRLGLQL

SEQ ID NO: 881360 - protein, 9 aa, Homo Sapiens
FIQSCRCKG

SEQ ID NO: 881361 - protein, 9 aa, Homo Sapiens
QECISHSYA

SEQ ID NO: 881362 - protein, 9 aa, Homo Sapiens
PKNRAFSIC

SEQ ID NO: 881363 - protein, 9 aa, Homo Sapiens
QNFTVAFGT

SEQ ID NO: 881364 - protein, 9 aa, Homo Sapiens
EGNNTWITD

SEQ ID NO: 881365 - protein, 9 aa, Homo Sapiens
HPLLQDALH

SEQ ID NO: 881366 - protein, 9 aa, Homo Sapiens
TNIQIWLAD

SEQ ID NO: 881367 - protein, 9 aa, Homo Sapiens
VIKEENYLR

SEQ ID NO: 881368 - protein, 9 aa, Homo Sapiens
EDDPECMRL

SEQ ID NO: 881369 - protein, 9 aa, Homo Sapiens
FNTMPEIME

SEQ ID NO: 881370 - protein, 9 aa, Homo Sapiens
QNVLVDASA

SEQ ID NO: 881371 - protein, 9 aa, Homo Sapiens
KEERLSGRK

SEQ ID NO: 881372 - protein, 9 aa, Homo Sapiens
YSYRFVCDK

SEQ ID NO: 881373 - protein, 9 aa, Homo Sapiens
IINTGEKPY

SEQ ID NO: 881374 - protein, 9 aa, Homo Sapiens
SSHVSSEAG

SEQ ID NO: 881375 - protein, 9 aa, Homo Sapiens
RRLEITEGS

SEQ ID NO: 881376 - protein, 9 aa, Homo Sapiens
CCTVSGDLA

SEQ ID NO: 881377 - protein, 9 aa, Homo Sapiens
STSFSRDYI

SEQ ID NO: 881378 - protein, 9 aa, Homo Sapiens
RRDFFLDEA

SEQ ID NO: 881379 - protein, 9 aa, Homo Sapiens
NTICQQEMA

SEQ ID NO: 881380 - protein, 9 aa, Homo Sapiens
TKSSWFGLR

SEQ ID NO: 881381 - protein, 9 aa, Homo Sapiens
FWVILEELK

SEQ ID NO: 881382 - protein, 9 aa, Homo Sapiens
LLLGVVQIY

SEQ ID NO: 881383 - protein, 9 aa, Homo Sapiens
RDKSPAPED

SEQ ID NO: 881384 - protein, 9 aa, Homo Sapiens
KQIHVSKRG

SEQ ID NO: 881385 - protein, 9 aa, Homo Sapiens
YCLLPYCSL

SEQ ID NO: 881386 - protein, 9 aa, Homo Sapiens
IAFLYNLYR

SEQ ID NO: 881387 - protein, 9 aa, Homo Sapiens
RISQQTDIY

SEQ ID NO: 881388 - protein, 9 aa, Homo Sapiens
YRYFIPGVA

SEQ ID NO: 881389 - protein, 9 aa, Homo Sapiens
IRSKQKETL

SEQ ID NO: 881390 - protein, 9 aa, Homo Sapiens
FKFYHLLNY

SEQ ID NO: 881391 - protein, 9 aa, Homo Sapiens
TGWTKSMAP

SEQ ID NO: 881392 - protein, 9 aa, Homo Sapiens
ELYRGCVRA

SEQ ID NO: 881393 - protein, 9 aa, Homo Sapiens
VKRSQGWIP

SEQ ID NO: 881394 - protein, 9 aa, Homo Sapiens
VSKLKRHIH

SEQ ID NO: 881395 - protein, 9 aa, Homo Sapiens
LQAPHIHRW

SEQ ID NO: 881396 - protein, 9 aa, Homo Sapiens
LMSLLVDGN

SEQ ID NO: 881397 - protein, 9 aa, Homo Sapiens
MIRKQNSLI

SEQ ID NO: 881398 - protein, 9 aa, Homo Sapiens
LRTYLLTRN

SEQ ID NO: 881399 - protein, 9 aa, Homo Sapiens
QGDGVPPLD

SEQ ID NO: 881400 - protein, 9 aa, Homo Sapiens
SRRVEPQTP

SEQ ID NO: 881401 - protein, 9 aa, Homo Sapiens
YPNLLGLQW

SEQ ID NO: 881402 - protein, 9 aa, Homo Sapiens
APPLEQRSF

SEQ ID NO: 881403 - protein, 9 aa, Homo Sapiens
LKKQRTKNN

SEQ ID NO: 881404 - protein, 9 aa, Homo Sapiens
LIQPLNRRA

SEQ ID NO: 881405 - protein, 9 aa, Homo Sapiens
RKQRQKQAR

SEQ ID NO: 881406 - protein, 9 aa, Homo Sapiens
AQSVLRLEK

SEQ ID NO: 881407 - protein, 9 aa, Homo Sapiens
SLLGLLGHN

SEQ ID NO: 881408 - protein, 9 aa, Homo Sapiens
RLLFEVFDK

SEQ ID NO: 881409 - protein, 9 aa, Homo Sapiens
AITKRTFSP

SEQ ID NO: 881410 - protein, 9 aa, Homo Sapiens
LQIQNMVSS

SEQ ID NO: 881411 - protein, 9 aa, Homo Sapiens
LGRPLGLKL

SEQ ID NO: 881412 - protein, 9 aa, Homo Sapiens
EKDLRTQFR

SEQ ID NO: 881413 - protein, 9 aa, Homo Sapiens
KQDNCSWTS

SEQ ID NO: 881414 - protein, 9 aa, Homo Sapiens
VCYLRRKLV

SEQ ID NO: 881415 - protein, 9 aa, Homo Sapiens
PLLAAHQDL

SEQ ID NO: 881416 - protein, 9 aa, Homo Sapiens
WNDHFSDIY

SEQ ID NO: 881417 - protein, 9 aa, Homo Sapiens
TSTLANLTL

SEQ ID NO: 881418 - protein, 9 aa, Homo Sapiens
AHEITYVRL

SEQ ID NO: 881419 - protein, 9 aa, Homo Sapiens
EHPGGHNRD

SEQ ID NO: 881420 - protein, 9 aa, Homo Sapiens
SGLIKHQII

SEQ ID NO: 881421 - protein, 9 aa, Homo Sapiens
TYQTVANVT

SEQ ID NO: 881422 - protein, 9 aa, Homo Sapiens
RLQHISQSE

SEQ ID NO: 881423 - protein, 9 aa, Homo Sapiens
VPIKANYLD

SEQ ID NO: 881424 - protein, 9 aa, Homo Sapiens
CNVTFRLSK

SEQ ID NO: 881425 - protein, 9 aa, Homo Sapiens
LMPQPLGNG

SEQ ID NO: 881426 - protein, 9 aa, Homo Sapiens
WSSRPKNIP

SEQ ID NO: 881427 - protein, 9 aa, Homo Sapiens
KQWKTFEEE

SEQ ID NO: 881428 - protein, 9 aa, Homo Sapiens
PFSRHLVDL

SEQ ID NO: 881429 - protein, 9 aa, Homo Sapiens
HHTDMSSLS

SEQ ID NO: 881430 - protein, 9 aa, Homo Sapiens
LDILRYFFE

SEQ ID NO: 881431 - protein, 9 aa, Homo Sapiens
HWPADIPDR

SEQ ID NO: 881432 - protein, 9 aa, Homo Sapiens
SINKEIHTQ

SEQ ID NO: 881433 - protein, 9 aa, Homo Sapiens
PGSKLMSSF

SEQ ID NO: 881434 - protein, 9 aa, Homo Sapiens
VKNKISESF

SEQ ID NO: 881435 - protein, 9 aa, Homo Sapiens
DKTRYCVII

SEQ ID NO: 881436 - protein, 9 aa, Homo Sapiens
DKYVFCMQK

SEQ ID NO: 881437 - protein, 9 aa, Homo Sapiens
HHPQMLGFN

SEQ ID NO: 881438 - protein, 9 aa, Homo Sapiens
LYQKEVSHP

SEQ ID NO: 881439 - protein, 9 aa, Homo Sapiens
SVSGAGLQN

SEQ ID NO: 881440 - protein, 9 aa, Homo Sapiens
LKFKDGTDE

SEQ ID NO: 881441 - protein, 9 aa, Homo Sapiens
NMALSEYPE

SEQ ID NO: 881442 - protein, 9 aa, Homo Sapiens
RQMMGCFQN

SEQ ID NO: 881443 - protein, 9 aa, Homo Sapiens
QCNPRPKNI

SEQ ID NO: 881444 - protein, 9 aa, Homo Sapiens
QIWLADGGR

SEQ ID NO: 881445 - protein, 9 aa, Homo Sapiens
HGSGGGKNY

SEQ ID NO: 881446 - protein, 9 aa, Homo Sapiens
FAKLNTAPD

SEQ ID NO: 881447 - protein, 9 aa, Homo Sapiens
TAGTVFALC

SEQ ID NO: 881448 - protein, 9 aa, Homo Sapiens
GGGCSDVDP

SEQ ID NO: 881449 - protein, 9 aa, Homo Sapiens
QCSIKQEQI

SEQ ID NO: 881450 - protein, 9 aa, Homo Sapiens
PLAERAGDI

SEQ ID NO: 881451 - protein, 9 aa, Homo Sapiens
SMVLLGISC

SEQ ID NO: 881452 - protein, 9 aa, Homo Sapiens
AILDFNTMP

SEQ ID NO: 881453 - protein, 9 aa, Homo Sapiens
PNKPLPSAD

SEQ ID NO: 881454 - protein, 9 aa, Homo Sapiens
NMHDSSLVA

SEQ ID NO: 881455 - protein, 9 aa, Homo Sapiens
DSEYTDGST

SEQ ID NO: 881456 - protein, 9 aa, Homo Sapiens
LLTLQEAVN

SEQ ID NO: 881457 - protein, 9 aa, Homo Sapiens
KAICKQDLE

SEQ ID NO: 881458 - protein, 9 aa, Homo Sapiens
KKELNDIQF

SEQ ID NO: 881459 - protein, 9 aa, Homo Sapiens
DPEKGNWLQ

SEQ ID NO: 881460 - protein, 9 aa, Homo Sapiens
RTSKEQEGF

SEQ ID NO: 881461 - protein, 9 aa, Homo Sapiens
GSDIGGSIQ

SEQ ID NO: 881462 - protein, 9 aa, Homo Sapiens
NGAVPLGLN

SEQ ID NO: 881463 - protein, 9 aa, Homo Sapiens
TVVNKLFKF

SEQ ID NO: 881464 - protein, 9 aa, Homo Sapiens
QNHIRIHTG

SEQ ID NO: 881465 - protein, 9 aa, Homo Sapiens
HYIDSPPAS

SEQ ID NO: 881466 - protein, 9 aa, Homo Sapiens
NYKLIKSQN

SEQ ID NO: 881467 - protein, 9 aa, Homo Sapiens
QENDNSTIV

SEQ ID NO: 881468 - protein, 9 aa, Homo Sapiens
GFQTDLLSL

SEQ ID NO: 881469 - protein, 9 aa, Homo Sapiens
ALAKRSRSQ

SEQ ID NO: 881470 - protein, 9 aa, Homo Sapiens
KTPSPTAPD

SEQ ID NO: 881471 - protein, 9 aa, Homo Sapiens
KKYRGKCEP

SEQ ID NO: 881472 - protein, 9 aa, Homo Sapiens
NLLGYYVDC

SEQ ID NO: 881473 - protein, 9 aa, Homo Sapiens
SLQELDLTA

SEQ ID NO: 881474 - protein, 9 aa, Homo Sapiens
EAKANYCQC

SEQ ID NO: 881475 - protein, 9 aa, Homo Sapiens
EVKCTPSPR

SEQ ID NO: 881476 - protein, 9 aa, Homo Sapiens
SKEIISEVE

SEQ ID NO: 881477 - protein, 9 aa, Homo Sapiens
IGQRTPFQI

SEQ ID NO: 881478 - protein, 9 aa, Homo Sapiens
DLLYSKTAK

SEQ ID NO: 881479 - protein, 9 aa, Homo Sapiens
AKPKPANKT

SEQ ID NO: 881480 - protein, 9 aa, Homo Sapiens
SPQPSPKQS

SEQ ID NO: 881481 - protein, 9 aa, Homo Sapiens
AMAATTTTT

SEQ ID NO: 881482 - protein, 9 aa, Homo Sapiens
AFTSPDASY

SEQ ID NO: 881483 - protein, 9 aa, Homo Sapiens
MEFQRKGSQ

SEQ ID NO: 881484 - protein, 9 aa, Homo Sapiens
KDNFSLKLR

SEQ ID NO: 881485 - protein, 9 aa, Homo Sapiens
FRDKLYPIN

SEQ ID NO: 881486 - protein, 9 aa, Homo Sapiens
SVCSCFQQN

SEQ ID NO: 881487 - protein, 9 aa, Homo Sapiens
GKFHYKFFC

SEQ ID NO: 881488 - protein, 9 aa, Homo Sapiens
YPEGDDTQS

SEQ ID NO: 881489 - protein, 9 aa, Homo Sapiens
ELDTDISYL

SEQ ID NO: 881490 - protein, 9 aa, Homo Sapiens
FLPGYDKIV

SEQ ID NO: 881491 - protein, 9 aa, Homo Sapiens
DNYLSKMQQ

SEQ ID NO: 881492 - protein, 9 aa, Homo Sapiens
SSSSSSSSY

SEQ ID NO: 881493 - protein, 9 aa, Homo Sapiens
TQATHPCNL

SEQ ID NO: 881494 - protein, 9 aa, Homo Sapiens
KNKNRSYKS

SEQ ID NO: 881495 - protein, 9 aa, Homo Sapiens
CQSEYHAAF

SEQ ID NO: 881496 - protein, 9 aa, Homo Sapiens
NQTKLECES

SEQ ID NO: 881497 - protein, 9 aa, Homo Sapiens
EGCPAMGHF

SEQ ID NO: 881498 - protein, 9 aa, Homo Sapiens
YTSFYTFSW

SEQ ID NO: 881499 - protein, 9 aa, Homo Sapiens
TTKLNSINS

SEQ ID NO: 881500 - protein, 9 aa, Homo Sapiens
GLIKKMIAK

SEQ ID NO: 881501 - protein, 9 aa, Homo Sapiens
VKILHKNNA

SEQ ID NO: 881502 - protein, 9 aa, Homo Sapiens
GFLKNFLIK

SEQ ID NO: 881503 - protein, 9 aa, Homo Sapiens
ARLVPPQNL

SEQ ID NO: 881504 - protein, 9 aa, Homo Sapiens
VQEATFEEI

SEQ ID NO: 881505 - protein, 9 aa, Homo Sapiens
ELERIFELA

SEQ ID NO: 881506 - protein, 9 aa, Homo Sapiens
KYQENLAVI

SEQ ID NO: 881507 - protein, 9 aa, Homo Sapiens
NKPTHAGGG

SEQ ID NO: 881508 - protein, 9 aa, Homo Sapiens
RTDQLTNIL

SEQ ID NO: 881509 - protein, 9 aa, Homo Sapiens
FQKLTTADD

SEQ ID NO: 881510 - protein, 9 aa, Homo Sapiens
ISKSKLHKF

SEQ ID NO: 881511 - protein, 9 aa, Homo Sapiens
KEKSKRGFF

SEQ ID NO: 881512 - protein, 9 aa, Homo Sapiens
PKWKNKVAS

SEQ ID NO: 881513 - protein, 9 aa, Homo Sapiens
KLGTKIVFV

SEQ ID NO: 881514 - protein, 9 aa, Homo Sapiens
VLSVENSGR

SEQ ID NO: 881515 - protein, 9 aa, Homo Sapiens
PSLSAWPLS

SEQ ID NO: 881516 - protein, 9 aa, Homo Sapiens
DIEIATYRC

SEQ ID NO: 881517 - protein, 9 aa, Homo Sapiens
IISFNSLDV

SEQ ID NO: 881518 - protein, 9 aa, Homo Sapiens
LLSNITNHK

SEQ ID NO: 881519 - protein, 9 aa, Homo Sapiens
FGSKDKHFQ

SEQ ID NO: 881520 - protein, 9 aa, Homo Sapiens
LPLKNLESL

SEQ ID NO: 881521 - protein, 9 aa, Homo Sapiens
EQKKPRIKD

SEQ ID NO: 881522 - protein, 9 aa, Homo Sapiens
LHVLQVAMV

SEQ ID NO: 881523 - protein, 9 aa, Homo Sapiens
EDKCQGKGD

SEQ ID NO: 881524 - protein, 9 aa, Homo Sapiens
TALMHPRFC

SEQ ID NO: 881525 - protein, 9 aa, Homo Sapiens
NYEDKTRYC

SEQ ID NO: 881526 - protein, 9 aa, Homo Sapiens
CTPFRVLAC

SEQ ID NO: 881527 - protein, 9 aa, Homo Sapiens
ASDCFLYAN

SEQ ID NO: 881528 - protein, 9 aa, Homo Sapiens
NVQLYKMQN

SEQ ID NO: 881529 - protein, 9 aa, Homo Sapiens
NKYYDAYLS

SEQ ID NO: 881530 - protein, 9 aa, Homo Sapiens
PMSPRSLPS

SEQ ID NO: 881531 - protein, 9 aa, Homo Sapiens
NQLSTGLDS

SEQ ID NO: 881532 - protein, 9 aa, Homo Sapiens
NPSLYKAMV

SEQ ID NO: 881533 - protein, 9 aa, Homo Sapiens
GSSQSLYKI

SEQ ID NO: 881534 - protein, 9 aa, Homo Sapiens
SKTLIFIFM

SEQ ID NO: 881535 - protein, 9 aa, Homo Sapiens
FLICLSLVS

SEQ ID NO: 881536 - protein, 9 aa, Homo Sapiens
VQRRLEITE

SEQ ID NO: 881537 - protein, 9 aa, Homo Sapiens
THFIHNSAN

SEQ ID NO: 881538 - protein, 9 aa, Homo Sapiens
FEDIIRGID

SEQ ID NO: 881539 - protein, 9 aa, Homo Sapiens
NVLNMNKRL

SEQ ID NO: 881540 - protein, 9 aa, Homo Sapiens
IIHTMEKQY

SEQ ID NO: 881541 - protein, 9 aa, Homo Sapiens
LFAIEREFL

SEQ ID NO: 881542 - protein, 9 aa, Homo Sapiens
MQLPLVTDK

SEQ ID NO: 881543 - protein, 9 aa, Homo Sapiens
KYRNDYCEG

SEQ ID NO: 881544 - protein, 9 aa, Homo Sapiens
KNCMDCVLL

SEQ ID NO: 881545 - protein, 9 aa, Homo Sapiens
EDMTLCVAD

SEQ ID NO: 881546 - protein, 9 aa, Homo Sapiens
FWTLEFRDI

SEQ ID NO: 881547 - protein, 9 aa, Homo Sapiens
ITYQTVANV

SEQ ID NO: 881548 - protein, 9 aa, Homo Sapiens
FAVYRRVLC

SEQ ID NO: 881549 - protein, 9 aa, Homo Sapiens
AWTIITPFT

SEQ ID NO: 881550 - protein, 9 aa, Homo Sapiens
GEEEKVVKR

SEQ ID NO: 881551 - protein, 9 aa, Homo Sapiens
HSEEDNSDS

SEQ ID NO: 881552 - protein, 9 aa, Homo Sapiens
GGHNEVPPP

SEQ ID NO: 881553 - protein, 9 aa, Homo Sapiens
VYKTKMRSS

SEQ ID NO: 881554 - protein, 9 aa, Homo Sapiens
ETSVERVRS

SEQ ID NO: 881555 - protein, 9 aa, Homo Sapiens
PTNSSLNIS

SEQ ID NO: 881556 - protein, 9 aa, Homo Sapiens
HDSSGEGER

SEQ ID NO: 881557 - protein, 9 aa, Homo Sapiens
DASNSIDHQ

SEQ ID NO: 881558 - protein, 9 aa, Homo Sapiens
VWEGEGSFE

SEQ ID NO: 881559 - protein, 9 aa, Homo Sapiens
QQLTQIMSL

SEQ ID NO: 881560 - protein, 9 aa, Homo Sapiens
NMFGQIQLP

SEQ ID NO: 881561 - protein, 9 aa, Homo Sapiens
YVPRHEICL

SEQ ID NO: 881562 - protein, 9 aa, Homo Sapiens
NSGDMFMSM

SEQ ID NO: 881563 - protein, 9 aa, Homo Sapiens
FHPSDPTEK

SEQ ID NO: 881564 - protein, 9 aa, Homo Sapiens
NWGKYLMED

SEQ ID NO: 881565 - protein, 9 aa, Homo Sapiens
KGHCQDINK

SEQ ID NO: 881566 - protein, 9 aa, Homo Sapiens
ETEQRCASL

SEQ ID NO: 881567 - protein, 9 aa, Homo Sapiens
SLRVCTVDS

SEQ ID NO: 881568 - protein, 9 aa, Homo Sapiens
SVLDTSNER

SEQ ID NO: 881569 - protein, 9 aa, Homo Sapiens
QMPSSFACH

SEQ ID NO: 881570 - protein, 9 aa, Homo Sapiens
LHLQLDDSI

SEQ ID NO: 881571 - protein, 9 aa, Homo Sapiens
DYSYWALGY

SEQ ID NO: 881572 - protein, 9 aa, Homo Sapiens
VRTSKPDVF

SEQ ID NO: 881573 - protein, 9 aa, Homo Sapiens
ELQKDPGFS

SEQ ID NO: 881574 - protein, 9 aa, Homo Sapiens
AQEYAPCGN

SEQ ID NO: 881575 - protein, 9 aa, Homo Sapiens
VSLLNLFLS

SEQ ID NO: 881576 - protein, 9 aa, Homo Sapiens
NIINMALSE

SEQ ID NO: 881577 - protein, 9 aa, Homo Sapiens
DKWRKEFAV

SEQ ID NO: 881578 - protein, 9 aa, Homo Sapiens
LLKEYPVAF

SEQ ID NO: 881579 - protein, 9 aa, Homo Sapiens
LALFCHKPC

SEQ ID NO: 881580 - protein, 9 aa, Homo Sapiens
PEAYVNIHT

SEQ ID NO: 881581 - protein, 9 aa, Homo Sapiens
GHYGFLLPA

SEQ ID NO: 881582 - protein, 9 aa, Homo Sapiens
QTVRCCGRG

SEQ ID NO: 881583 - protein, 9 aa, Homo Sapiens
KDALIEILT

SEQ ID NO: 881584 - protein, 9 aa, Homo Sapiens
RSRSPNKER

SEQ ID NO: 881585 - protein, 9 aa, Homo Sapiens
VHGLYKDHY

SEQ ID NO: 881586 - protein, 9 aa, Homo Sapiens
QDNTWKIII

SEQ ID NO: 881587 - protein, 9 aa, Homo Sapiens
PIYSENSIE

SEQ ID NO: 881588 - protein, 9 aa, Homo Sapiens
IAIGVFTEC

SEQ ID NO: 881589 - protein, 9 aa, Homo Sapiens
GFFYPKQPD

SEQ ID NO: 881590 - protein, 9 aa, Homo Sapiens
GKVFICSSS

SEQ ID NO: 881591 - protein, 9 aa, Homo Sapiens
RNKHGHKHE

SEQ ID NO: 881592 - protein, 9 aa, Homo Sapiens
IHHFKNIPN

SEQ ID NO: 881593 - protein, 9 aa, Homo Sapiens
NEKSKAQME

SEQ ID NO: 881594 - protein, 9 aa, Homo Sapiens
PCNPQTGAC

SEQ ID NO: 881595 - protein, 9 aa, Homo Sapiens
ITHIGEKPY

SEQ ID NO: 881596 - protein, 9 aa, Homo Sapiens
LAKVDLPKL

SEQ ID NO: 881597 - protein, 9 aa, Homo Sapiens
KIICLGDST

SEQ ID NO: 881598 - protein, 9 aa, Homo Sapiens
YHNEIKSWE

SEQ ID NO: 881599 - protein, 9 aa, Homo Sapiens
QEVRCGIEK

SEQ ID NO: 881600 - protein, 9 aa, Homo Sapiens
NTSPAEDNR

SEQ ID NO: 881601 - protein, 9 aa, Homo Sapiens
QINIYEIIK

SEQ ID NO: 881602 - protein, 9 aa, Homo Sapiens
SLMPLTPLW

SEQ ID NO: 881603 - protein, 9 aa, Homo Sapiens
LGSLLFLVC

SEQ ID NO: 881604 - protein, 9 aa, Homo Sapiens
YKLQAPHIH

SEQ ID NO: 881605 - protein, 9 aa, Homo Sapiens
SDCRKTFCV

SEQ ID NO: 881606 - protein, 9 aa, Homo Sapiens
FRNHEITHS

SEQ ID NO: 881607 - protein, 9 aa, Homo Sapiens
STLPNDSDN

SEQ ID NO: 881608 - protein, 9 aa, Homo Sapiens
TVGIAYSNY

SEQ ID NO: 881609 - protein, 9 aa, Homo Sapiens
FELFDRTET

SEQ ID NO: 881610 - protein, 9 aa, Homo Sapiens
GMRTKQLQE

SEQ ID NO: 881611 - protein, 9 aa, Homo Sapiens
YEQILNPYN

SEQ ID NO: 881612 - protein, 9 aa, Homo Sapiens
EHGKAFNLL

SEQ ID NO: 881613 - protein, 9 aa, Homo Sapiens
VHHSSLENP

SEQ ID NO: 881614 - protein, 9 aa, Homo Sapiens
CETNAQMSR

SEQ ID NO: 881615 - protein, 9 aa, Homo Sapiens
LVIGIKQGE

SEQ ID NO: 881616 - protein, 9 aa, Homo Sapiens
VNKETQSPE

SEQ ID NO: 881617 - protein, 9 aa, Homo Sapiens
LDKFANQIL

SEQ ID NO: 881618 - protein, 9 aa, Homo Sapiens
VIHMWADEG

SEQ ID NO: 881619 - protein, 9 aa, Homo Sapiens
LLEEVKKKN

SEQ ID NO: 881620 - protein, 9 aa, Homo Sapiens
DRQLYQPEP

SEQ ID NO: 881621 - protein, 9 aa, Homo Sapiens
NKFQKSVDA

SEQ ID NO: 881622 - protein, 9 aa, Homo Sapiens
YSQGMKNQN

SEQ ID NO: 881623 - protein, 9 aa, Homo Sapiens
SFVNDIFKR

SEQ ID NO: 881624 - protein, 9 aa, Homo Sapiens
FIRLAIPSM

SEQ ID NO: 881625 - protein, 9 aa, Homo Sapiens
NIVPRHLFQ

SEQ ID NO: 881626 - protein, 9 aa, Homo Sapiens
SVTIIHVAI

SEQ ID NO: 881627 - protein, 9 aa, Homo Sapiens
AKVRAVNAD

SEQ ID NO: 881628 - protein, 9 aa, Homo Sapiens
DNSIPDIIP

SEQ ID NO: 881629 - protein, 9 aa, Homo Sapiens
PCNLKGIGL

SEQ ID NO: 881630 - protein, 9 aa, Homo Sapiens
DKERNSEDA

SEQ ID NO: 881631 - protein, 9 aa, Homo Sapiens
VGVFRSDSA

SEQ ID NO: 881632 - protein, 9 aa, Homo Sapiens
GWGQGAPFI

SEQ ID NO: 881633 - protein, 9 aa, Homo Sapiens
ELLYYKYPS

SEQ ID NO: 881634 - protein, 9 aa, Homo Sapiens
HEDKLELEV

SEQ ID NO: 881635 - protein, 9 aa, Homo Sapiens
VDALLFGNF

SEQ ID NO: 881636 - protein, 9 aa, Homo Sapiens
TVQYSDIGI

SEQ ID NO: 881637 - protein, 9 aa, Homo Sapiens
ACYALSLVM

SEQ ID NO: 881638 - protein, 9 aa, Homo Sapiens
QIECLPTSG

SEQ ID NO: 881639 - protein, 9 aa, Homo Sapiens
LWDTISTYD

SEQ ID NO: 881640 - protein, 9 aa, Homo Sapiens
DSTGSPIQL

SEQ ID NO: 881641 - protein, 9 aa, Homo Sapiens
IIDLILNNG

SEQ ID NO: 881642 - protein, 9 aa, Homo Sapiens
PFREPQNIL

SEQ ID NO: 881643 - protein, 9 aa, Homo Sapiens
VQLWAATEI

SEQ ID NO: 881644 - protein, 9 aa, Homo Sapiens
SKLGAKLND

SEQ ID NO: 881645 - protein, 9 aa, Homo Sapiens
SGSCPEDKV

SEQ ID NO: 881646 - protein, 9 aa, Homo Sapiens
QNFNLKYLI

SEQ ID NO: 881647 - protein, 9 aa, Homo Sapiens
EVSVESDNY

SEQ ID NO: 881648 - protein, 9 aa, Homo Sapiens
DPKTNSWLL

SEQ ID NO: 881649 - protein, 9 aa, Homo Sapiens
KSKLEYQNK

SEQ ID NO: 881650 - protein, 9 aa, Homo Sapiens
CLPWRSPIP

SEQ ID NO: 881651 - protein, 9 aa, Homo Sapiens
ATNMISIFE

SEQ ID NO: 881652 - protein, 9 aa, Homo Sapiens
SQIKELVNA

SEQ ID NO: 881653 - protein, 9 aa, Homo Sapiens
AQMHDEDLI

SEQ ID NO: 881654 - protein, 9 aa, Homo Sapiens
EALCSVLHT

SEQ ID NO: 881655 - protein, 9 aa, Homo Sapiens
VPEAYVNIH

SEQ ID NO: 881656 - protein, 9 aa, Homo Sapiens
IHPHMVKED

SEQ ID NO: 881657 - protein, 9 aa, Homo Sapiens
KAKNPKEDK

SEQ ID NO: 881658 - protein, 9 aa, Homo Sapiens
EEIGEWDCK

SEQ ID NO: 881659 - protein, 9 aa, Homo Sapiens
MWIIRKMIQ

SEQ ID NO: 881660 - protein, 9 aa, Homo Sapiens
TDDEDKDED

SEQ ID NO: 881661 - protein, 9 aa, Homo Sapiens
IHFKSVIHI

SEQ ID NO: 881662 - protein, 9 aa, Homo Sapiens
FSVKTHTFN

SEQ ID NO: 881663 - protein, 9 aa, Homo Sapiens
AKDEGPRSD

SEQ ID NO: 881664 - protein, 9 aa, Homo Sapiens
DDDKGYGFV

SEQ ID NO: 881665 - protein, 9 aa, Homo Sapiens
PNLTDIVIT

SEQ ID NO: 881666 - protein, 9 aa, Homo Sapiens
RSSDEEKVI

SEQ ID NO: 881667 - protein, 9 aa, Homo Sapiens
LIENCNLTQ

SEQ ID NO: 881668 - protein, 9 aa, Homo Sapiens
NWDGPGELE

SEQ ID NO: 881669 - protein, 9 aa, Homo Sapiens
SSTVTVCLF

SEQ ID NO: 881670 - protein, 9 aa, Homo Sapiens
LQAKEEGEG

SEQ ID NO: 881671 - protein, 9 aa, Homo Sapiens
IREIFGYDQ

SEQ ID NO: 881672 - protein, 9 aa, Homo Sapiens
WAIILKKNE

SEQ ID NO: 881673 - protein, 9 aa, Homo Sapiens
IHRDLDNKL

SEQ ID NO: 881674 - protein, 9 aa, Homo Sapiens
QITKFMVTQ

SEQ ID NO: 881675 - protein, 9 aa, Homo Sapiens
DHLEEQLPW

SEQ ID NO: 881676 - protein, 9 aa, Homo Sapiens
QIDAKEQGA

SEQ ID NO: 881677 - protein, 9 aa, Homo Sapiens
RCLIHSLLR

SEQ ID NO: 881678 - protein, 9 aa, Homo Sapiens
DKSVNYKTG

SEQ ID NO: 881679 - protein, 9 aa, Homo Sapiens
EDGFYKVDY

SEQ ID NO: 881680 - protein, 9 aa, Homo Sapiens
KWPMRSCLY

SEQ ID NO: 881681 - protein, 9 aa, Homo Sapiens
DALGHKLPV

SEQ ID NO: 881682 - protein, 9 aa, Homo Sapiens
MLSEEKQWI

SEQ ID NO: 881683 - protein, 9 aa, Homo Sapiens
HNEIKSWEE

SEQ ID NO: 881684 - protein, 9 aa, Homo Sapiens
GSNLIKGRD

SEQ ID NO: 881685 - protein, 9 aa, Homo Sapiens
RDCLKAEWD

SEQ ID NO: 881686 - protein, 9 aa, Homo Sapiens
SQSSRKSDA

SEQ ID NO: 881687 - protein, 9 aa, Homo Sapiens
TSIMSINNA

SEQ ID NO: 881688 - protein, 9 aa, Homo Sapiens
TKEKRPPQT

SEQ ID NO: 881689 - protein, 9 aa, Homo Sapiens
VWRQGFNIS

SEQ ID NO: 881690 - protein, 9 aa, Homo Sapiens
INKLCVSAL

SEQ ID NO: 881691 - protein, 9 aa, Homo Sapiens
VRLHPHTIT

SEQ ID NO: 881692 - protein, 9 aa, Homo Sapiens
RCCGRGMPQ

SEQ ID NO: 881693 - protein, 9 aa, Homo Sapiens
ALLLIIIVL

SEQ ID NO: 881694 - protein, 9 aa, Homo Sapiens
EQTKLWGGQ

SEQ ID NO: 881695 - protein, 9 aa, Homo Sapiens
NEQEVVDKV

SEQ ID NO: 881696 - protein, 9 aa, Homo Sapiens
LPPFKTFSQ

SEQ ID NO: 881697 - protein, 9 aa, Homo Sapiens
INGSKVFIS

SEQ ID NO: 881698 - protein, 9 aa, Homo Sapiens
DSGSNSSQP

SEQ ID NO: 881699 - protein, 9 aa, Homo Sapiens
DLYFYRNPE

SEQ ID NO: 881700 - protein, 9 aa, Homo Sapiens
QVFEGQNCI

SEQ ID NO: 881701 - protein, 9 aa, Homo Sapiens
SLDWEKQHL

SEQ ID NO: 881702 - protein, 9 aa, Homo Sapiens
ADLPVAQIS

SEQ ID NO: 881703 - protein, 9 aa, Homo Sapiens
EDKNALESI

SEQ ID NO: 881704 - protein, 9 aa, Homo Sapiens
MVPQLYFSS

SEQ ID NO: 881705 - protein, 9 aa, Homo Sapiens
GSHPDLSPS

SEQ ID NO: 881706 - protein, 9 aa, Homo Sapiens
IVMAYFFTI

SEQ ID NO: 881707 - protein, 9 aa, Homo Sapiens
LVFKQDNCS

SEQ ID NO: 881708 - protein, 9 aa, Homo Sapiens
PMEYTGRPG

SEQ ID NO: 881709 - protein, 9 aa, Homo Sapiens
EYRGRRQTP

SEQ ID NO: 881710 - protein, 9 aa, Homo Sapiens
FCFIEVNTI

SEQ ID NO: 881711 - protein, 9 aa, Homo Sapiens
HCKAGKGQT

SEQ ID NO: 881712 - protein, 9 aa, Homo Sapiens
PISVPLHRH

SEQ ID NO: 881713 - protein, 9 aa, Homo Sapiens
GGYIHLIQM

SEQ ID NO: 881714 - protein, 9 aa, Homo Sapiens
PAARRLLKQ

SEQ ID NO: 881715 - protein, 9 aa, Homo Sapiens
LRTIFIILF

SEQ ID NO: 881716 - protein, 9 aa, Homo Sapiens
WCKKRRLHP

SEQ ID NO: 881717 - protein, 9 aa, Homo Sapiens
PRASNNSMD

SEQ ID NO: 881718 - protein, 9 aa, Homo Sapiens
TSPLREEAK

SEQ ID NO: 881719 - protein, 9 aa, Homo Sapiens
EITHSGEKP

SEQ ID NO: 881720 - protein, 9 aa, Homo Sapiens
RAKTYFFSS

SEQ ID NO: 881721 - protein, 9 aa, Homo Sapiens
DMTLCVADF

SEQ ID NO: 881722 - protein, 9 aa, Homo Sapiens
ELGHLVYLL

SEQ ID NO: 881723 - protein, 9 aa, Homo Sapiens
SLYGLDLDC

SEQ ID NO: 881724 - protein, 9 aa, Homo Sapiens
EADEAYKLL

SEQ ID NO: 881725 - protein, 9 aa, Homo Sapiens
NNLLRVAGT

SEQ ID NO: 881726 - protein, 9 aa, Homo Sapiens
GGREGGGCS

SEQ ID NO: 881727 - protein, 9 aa, Homo Sapiens
AITFQYAVE

SEQ ID NO: 881728 - protein, 9 aa, Homo Sapiens
DKLELEVDD

SEQ ID NO: 881729 - protein, 9 aa, Homo Sapiens
AAEKKCILH

SEQ ID NO: 881730 - protein, 9 aa, Homo Sapiens
KFNHYDTAV

SEQ ID NO: 881731 - protein, 9 aa, Homo Sapiens
TFNNYRNDF

SEQ ID NO: 881732 - protein, 9 aa, Homo Sapiens
SGSHSQSRL

SEQ ID NO: 881733 - protein, 9 aa, Homo Sapiens
ELISQLRTL

SEQ ID NO: 881734 - protein, 9 aa, Homo Sapiens
CLIQLWHWL

SEQ ID NO: 881735 - protein, 9 aa, Homo Sapiens
MVTRKDTEE

SEQ ID NO: 881736 - protein, 9 aa, Homo Sapiens
QNLTLRNQI

SEQ ID NO: 881737 - protein, 9 aa, Homo Sapiens
DIGENIENR

SEQ ID NO: 881738 - protein, 9 aa, Homo Sapiens
KMLKEETRS

SEQ ID NO: 881739 - protein, 9 aa, Homo Sapiens
EHLSMIRAS

SEQ ID NO: 881740 - protein, 9 aa, Homo Sapiens
GKAGKEEWK

SEQ ID NO: 881741 - protein, 9 aa, Homo Sapiens
KSLRTFLLT

SEQ ID NO: 881742 - protein, 9 aa, Homo Sapiens
LAFLLGLPA

SEQ ID NO: 881743 - protein, 9 aa, Homo Sapiens
QNTSRLPLA

SEQ ID NO: 881744 - protein, 9 aa, Homo Sapiens
CIISPHPAL

SEQ ID NO: 881745 - protein, 9 aa, Homo Sapiens
SGNPVYEQY

SEQ ID NO: 881746 - protein, 9 aa, Homo Sapiens
AKNLMNVVV

SEQ ID NO: 881747 - protein, 9 aa, Homo Sapiens
RLRKLIKKC

SEQ ID NO: 881748 - protein, 9 aa, Homo Sapiens
ECKMTKSSP

SEQ ID NO: 881749 - protein, 9 aa, Homo Sapiens
LLHLPSERL

SEQ ID NO: 881750 - protein, 9 aa, Homo Sapiens
NRPSFAETH

SEQ ID NO: 881751 - protein, 9 aa, Homo Sapiens
SELIIKVQD

SEQ ID NO: 881752 - protein, 9 aa, Homo Sapiens
LAQLWDHST

SEQ ID NO: 881753 - protein, 9 aa, Homo Sapiens
QLPSICLSN

SEQ ID NO: 881754 - protein, 9 aa, Homo Sapiens
CALSPPTCR

SEQ ID NO: 881755 - protein, 9 aa, Homo Sapiens
FSLEISKPG

SEQ ID NO: 881756 - protein, 9 aa, Homo Sapiens
TSAFLPVFY

SEQ ID NO: 881757 - protein, 9 aa, Homo Sapiens
RLELAKMKE

SEQ ID NO: 881758 - protein, 9 aa, Homo Sapiens
DNSTIVSVV

SEQ ID NO: 881759 - protein, 9 aa, Homo Sapiens
KREGFGIQI

SEQ ID NO: 881760 - protein, 9 aa, Homo Sapiens
QLLSETPPD

SEQ ID NO: 881761 - protein, 9 aa, Homo Sapiens
FQQQPLPFG

SEQ ID NO: 881762 - protein, 9 aa, Homo Sapiens
RHDCNLLRE

SEQ ID NO: 881763 - protein, 9 aa, Homo Sapiens
DQNLDLQIR

SEQ ID NO: 881764 - protein, 9 aa, Homo Sapiens
KDKYNAIKK

SEQ ID NO: 881765 - protein, 9 aa, Homo Sapiens
GSEGPNLTD

SEQ ID NO: 881766 - protein, 9 aa, Homo Sapiens
VGTKSKPPR

SEQ ID NO: 881767 - protein, 9 aa, Homo Sapiens
IIQEVADEL

SEQ ID NO: 881768 - protein, 9 aa, Homo Sapiens
TQGFLYAGL

SEQ ID NO: 881769 - protein, 9 aa, Homo Sapiens
FQVTSTEFI

SEQ ID NO: 881770 - protein, 9 aa, Homo Sapiens
QQRIRSKQK

SEQ ID NO: 881771 - protein, 9 aa, Homo Sapiens
DMALCQNAR

SEQ ID NO: 881772 - protein, 9 aa, Homo Sapiens
TDNYGHDLT

SEQ ID NO: 881773 - protein, 9 aa, Homo Sapiens
CGHHKDAGV

SEQ ID NO: 881774 - protein, 9 aa, Homo Sapiens
NQHNSHDAL

SEQ ID NO: 881775 - protein, 9 aa, Homo Sapiens
SIIQHERPA

SEQ ID NO: 881776 - protein, 9 aa, Homo Sapiens
KKHQKSSSD

SEQ ID NO: 881777 - protein, 9 aa, Homo Sapiens
LPALASQSA

SEQ ID NO: 881778 - protein, 9 aa, Homo Sapiens
TKDDSKLIA

SEQ ID NO: 881779 - protein, 9 aa, Homo Sapiens
INLIAALPF

SEQ ID NO: 881780 - protein, 9 aa, Homo Sapiens
DCAYLVACT

SEQ ID NO: 881781 - protein, 9 aa, Homo Sapiens
VLRFPLTQK

SEQ ID NO: 881782 - protein, 9 aa, Homo Sapiens
AQYLGEVLF

SEQ ID NO: 881783 - protein, 9 aa, Homo Sapiens
CRLSGLSSV

SEQ ID NO: 881784 - protein, 9 aa, Homo Sapiens
HHCHKCGFV

SEQ ID NO: 881785 - protein, 9 aa, Homo Sapiens
TKLLQNIRQ

SEQ ID NO: 881786 - protein, 9 aa, Homo Sapiens
DLLNIIRKK

SEQ ID NO: 881787 - protein, 9 aa, Homo Sapiens
RHYDHNHQE

SEQ ID NO: 881788 - protein, 9 aa, Homo Sapiens
KRTKEPDRD

SEQ ID NO: 881789 - protein, 9 aa, Homo Sapiens
LDLAFTHLH

SEQ ID NO: 881790 - protein, 9 aa, Homo Sapiens
DSTLTLATE

SEQ ID NO: 881791 - protein, 9 aa, Homo Sapiens
EVSASKGLE

SEQ ID NO: 881792 - protein, 9 aa, Homo Sapiens
TRYTLVFNL

SEQ ID NO: 881793 - protein, 9 aa, Homo Sapiens
EVAPRSKRC

SEQ ID NO: 881794 - protein, 9 aa, Homo Sapiens
EIGEWDCKS

SEQ ID NO: 881795 - protein, 9 aa, Homo Sapiens
SFAEHQSGL

SEQ ID NO: 881796 - protein, 9 aa, Homo Sapiens
IPEDPTFNP

SEQ ID NO: 881797 - protein, 9 aa, Homo Sapiens
REFLFELGL

SEQ ID NO: 881798 - protein, 9 aa, Homo Sapiens
KKAIDITEC

SEQ ID NO: 881799 - protein, 9 aa, Homo Sapiens
SCSLSQSLV

SEQ ID NO: 881800 - protein, 9 aa, Homo Sapiens
VVLSFFRIA

SEQ ID NO: 881801 - protein, 9 aa, Homo Sapiens
KKFGADDTN

SEQ ID NO: 881802 - protein, 9 aa, Homo Sapiens
NFNLKYLID

SEQ ID NO: 881803 - protein, 9 aa, Homo Sapiens
NKQNLTLRN

SEQ ID NO: 881804 - protein, 9 aa, Homo Sapiens
HLFPVQIGD

SEQ ID NO: 881805 - protein, 9 aa, Homo Sapiens
LHSRDAGPS

SEQ ID NO: 881806 - protein, 9 aa, Homo Sapiens
LYPSQRFEE

SEQ ID NO: 881807 - protein, 9 aa, Homo Sapiens
HPEAYSHTE

SEQ ID NO: 881808 - protein, 9 aa, Homo Sapiens
QASCLTRHQ

SEQ ID NO: 881809 - protein, 9 aa, Homo Sapiens
LPISPFMDC

SEQ ID NO: 881810 - protein, 9 aa, Homo Sapiens
ATLQELLQF

SEQ ID NO: 881811 - protein, 9 aa, Homo Sapiens
LFASDNFLG

SEQ ID NO: 881812 - protein, 9 aa, Homo Sapiens
QSEYHAAFN

SEQ ID NO: 881813 - protein, 9 aa, Homo Sapiens
INERNSGLI

SEQ ID NO: 881814 - protein, 9 aa, Homo Sapiens
EIGQKNINR

SEQ ID NO: 881815 - protein, 9 aa, Homo Sapiens
RFGQMQQVQ

SEQ ID NO: 881816 - protein, 9 aa, Homo Sapiens
DSQKLLQCE

SEQ ID NO: 881817 - protein, 9 aa, Homo Sapiens
GPGSLFASD

SEQ ID NO: 881818 - protein, 9 aa, Homo Sapiens
WARNWKPKY

SEQ ID NO: 881819 - protein, 9 aa, Homo Sapiens
REHNFSTYS

SEQ ID NO: 881820 - protein, 9 aa, Homo Sapiens
QIGIFSVRE

SEQ ID NO: 881821 - protein, 9 aa, Homo Sapiens
LHISQNFLS

SEQ ID NO: 881822 - protein, 9 aa, Homo Sapiens
EKKSSCFIK

SEQ ID NO: 881823 - protein, 9 aa, Homo Sapiens
GKANPLGLE

SEQ ID NO: 881824 - protein, 9 aa, Homo Sapiens
QDEQLRSHE

SEQ ID NO: 881825 - protein, 9 aa, Homo Sapiens
KIVSSIKVL

SEQ ID NO: 881826 - protein, 9 aa, Homo Sapiens
CLSPRQIKL

SEQ ID NO: 881827 - protein, 9 aa, Homo Sapiens
YDNFFNYVT

SEQ ID NO: 881828 - protein, 9 aa, Homo Sapiens
MVQETQRLH

SEQ ID NO: 881829 - protein, 9 aa, Homo Sapiens
LVKVVEESL

SEQ ID NO: 881830 - protein, 9 aa, Homo Sapiens
LCVIYYFVM

SEQ ID NO: 881831 - protein, 9 aa, Homo Sapiens
NLFQILLEK

SEQ ID NO: 881832 - protein, 9 aa, Homo Sapiens
PVEDDANME

SEQ ID NO: 881833 - protein, 9 aa, Homo Sapiens
RRRSKSPRW

SEQ ID NO: 881834 - protein, 9 aa, Homo Sapiens
LALTSHFLF

SEQ ID NO: 881835 - protein, 9 aa, Homo Sapiens
IYISAEYIA

SEQ ID NO: 881836 - protein, 9 aa, Homo Sapiens
IITDPGDVP

SEQ ID NO: 881837 - protein, 9 aa, Homo Sapiens
RVKTCFEKA

SEQ ID NO: 881838 - protein, 9 aa, Homo Sapiens
SLDLAEYTF

SEQ ID NO: 881839 - protein, 9 aa, Homo Sapiens
GSDWIINGS

SEQ ID NO: 881840 - protein, 9 aa, Homo Sapiens
CGYSENNNF

SEQ ID NO: 881841 - protein, 9 aa, Homo Sapiens
GSDDAGCLQ

SEQ ID NO: 881842 - protein, 9 aa, Homo Sapiens
KHKHKCKCR

SEQ ID NO: 881843 - protein, 9 aa, Homo Sapiens
IQRRHNEFQ

SEQ ID NO: 881844 - protein, 9 aa, Homo Sapiens
VKKKKIKRG

SEQ ID NO: 881845 - protein, 9 aa, Homo Sapiens
FQAFILDEL

SEQ ID NO: 881846 - protein, 9 aa, Homo Sapiens
SKLGKQIHV

SEQ ID NO: 881847 - protein, 9 aa, Homo Sapiens
RQVGKAQMQ

SEQ ID NO: 881848 - protein, 9 aa, Homo Sapiens
KTKTPTLQP

SEQ ID NO: 881849 - protein, 9 aa, Homo Sapiens
FLDKKILLK

SEQ ID NO: 881850 - protein, 9 aa, Homo Sapiens
SGDQSGNLR

SEQ ID NO: 881851 - protein, 9 aa, Homo Sapiens
NQPFYILHS

SEQ ID NO: 881852 - protein, 9 aa, Homo Sapiens
QNSEWLFLD

SEQ ID NO: 881853 - protein, 9 aa, Homo Sapiens
QNDYFIRQQ

SEQ ID NO: 881854 - protein, 9 aa, Homo Sapiens
LGLELFCCV

SEQ ID NO: 881855 - protein, 9 aa, Homo Sapiens
SGEWANAPW

SEQ ID NO: 881856 - protein, 9 aa, Homo Sapiens
QNHHNVGMA

SEQ ID NO: 881857 - protein, 9 aa, Homo Sapiens
CINEKGSDQ

SEQ ID NO: 881858 - protein, 9 aa, Homo Sapiens
LQSSRHDCN

SEQ ID NO: 881859 - protein, 9 aa, Homo Sapiens
ITSKDQQNI

SEQ ID NO: 881860 - protein, 9 aa, Homo Sapiens
GTTAKTTSV

SEQ ID NO: 881861 - protein, 9 aa, Homo Sapiens
IGILCYEGK

SEQ ID NO: 881862 - protein, 9 aa, Homo Sapiens
TIKIQNISY

SEQ ID NO: 881863 - protein, 9 aa, Homo Sapiens
SELLEEVKC

SEQ ID NO: 881864 - protein, 9 aa, Homo Sapiens
IIYVFMGRN

SEQ ID NO: 881865 - protein, 9 aa, Homo Sapiens
QNRFSTFTR

SEQ ID NO: 881866 - protein, 9 aa, Homo Sapiens
PVLSVENSG

SEQ ID NO: 881867 - protein, 9 aa, Homo Sapiens
HPSTPLDPV

SEQ ID NO: 881868 - protein, 9 aa, Homo Sapiens
YLRNFLKLL

SEQ ID NO: 881869 - protein, 9 aa, Homo Sapiens
KQGGPGREL

SEQ ID NO: 881870 - protein, 9 aa, Homo Sapiens
FLTGNTSPA

SEQ ID NO: 881871 - protein, 9 aa, Homo Sapiens
KPQNHPYRY

SEQ ID NO: 881872 - protein, 9 aa, Homo Sapiens
IKATTEERM

SEQ ID NO: 881873 - protein, 9 aa, Homo Sapiens
GSRMCCQQE

SEQ ID NO: 881874 - protein, 9 aa, Homo Sapiens
GHSSIASGE

SEQ ID NO: 881875 - protein, 9 aa, Homo Sapiens
QNTICQQEM

SEQ ID NO: 881876 - protein, 9 aa, Homo Sapiens
LVRLCPPVS

SEQ ID NO: 881877 - protein, 9 aa, Homo Sapiens
EEHCQHLQA

SEQ ID NO: 881878 - protein, 9 aa, Homo Sapiens
ITNDESIPF

SEQ ID NO: 881879 - protein, 9 aa, Homo Sapiens
KEAELAAQI

SEQ ID NO: 881880 - protein, 9 aa, Homo Sapiens
REGYVSSNF

SEQ ID NO: 881881 - protein, 9 aa, Homo Sapiens
ERSYECSEC

SEQ ID NO: 881882 - protein, 9 aa, Homo Sapiens
VPRHLFQIK

SEQ ID NO: 881883 - protein, 9 aa, Homo Sapiens
ISQQTDIYK

SEQ ID NO: 881884 - protein, 9 aa, Homo Sapiens
TAAAAMATE

SEQ ID NO: 881885 - protein, 9 aa, Homo Sapiens
IIYIRKKKL

SEQ ID NO: 881886 - protein, 9 aa, Homo Sapiens
TVRDNQDNT

SEQ ID NO: 881887 - protein, 9 aa, Homo Sapiens
EKVFWWESL

SEQ ID NO: 881888 - protein, 9 aa, Homo Sapiens
ALKKLINRK

SEQ ID NO: 881889 - protein, 9 aa, Homo Sapiens
SHVSSEAGN

SEQ ID NO: 881890 - protein, 9 aa, Homo Sapiens
VRCGIEKQL

SEQ ID NO: 881891 - protein, 9 aa, Homo Sapiens
WVLTDHDEI

SEQ ID NO: 881892 - protein, 9 aa, Homo Sapiens
FFGTSTGDV

SEQ ID NO: 881893 - protein, 9 aa, Homo Sapiens
KAQMQSPTT

SEQ ID NO: 881894 - protein, 9 aa, Homo Sapiens
LYLPSCAYY

SEQ ID NO: 881895 - protein, 9 aa, Homo Sapiens
QLFPSWHRS

SEQ ID NO: 881896 - protein, 9 aa, Homo Sapiens
FLEELTQML

SEQ ID NO: 881897 - protein, 9 aa, Homo Sapiens
LSRLNDKLK

SEQ ID NO: 881898 - protein, 9 aa, Homo Sapiens
IKLGHTQTN

SEQ ID NO: 881899 - protein, 9 aa, Homo Sapiens
INTITGEIR

SEQ ID NO: 881900 - protein, 9 aa, Homo Sapiens
NNPSAGAFC

SEQ ID NO: 881901 - protein, 9 aa, Homo Sapiens
THIQDMFTG

SEQ ID NO: 881902 - protein, 9 aa, Homo Sapiens
GIPMKKAQN

SEQ ID NO: 881903 - protein, 9 aa, Homo Sapiens
WILRLKERH

SEQ ID NO: 881904 - protein, 9 aa, Homo Sapiens
RHNYQTCFP

SEQ ID NO: 881905 - protein, 9 aa, Homo Sapiens
RNVTDIKCV

SEQ ID NO: 881906 - protein, 9 aa, Homo Sapiens
GGATGPKGD

SEQ ID NO: 881907 - protein, 9 aa, Homo Sapiens
NPQTQTHAT

SEQ ID NO: 881908 - protein, 9 aa, Homo Sapiens
EMDATPGVD

SEQ ID NO: 881909 - protein, 9 aa, Homo Sapiens
TKKMMKDKR

SEQ ID NO: 881910 - protein, 9 aa, Homo Sapiens
DVPQKRKLV

SEQ ID NO: 881911 - protein, 9 aa, Homo Sapiens
LVGRCLVPE

SEQ ID NO: 881912 - protein, 9 aa, Homo Sapiens
ACVTVTCDP

SEQ ID NO: 881913 - protein, 9 aa, Homo Sapiens
ESSHSRGSI

SEQ ID NO: 881914 - protein, 9 aa, Homo Sapiens
TNEDNPEES

SEQ ID NO: 881915 - protein, 9 aa, Homo Sapiens
TCTCLEGFK

SEQ ID NO: 881916 - protein, 9 aa, Homo Sapiens
QYPGASCHP

SEQ ID NO: 881917 - protein, 9 aa, Homo Sapiens
SASRQNTSL

SEQ ID NO: 881918 - protein, 9 aa, Homo Sapiens
DSACDSLLH

SEQ ID NO: 881919 - protein, 9 aa, Homo Sapiens
CSVGKSLAG

SEQ ID NO: 881920 - protein, 9 aa, Homo Sapiens
VCIYYDYTD

SEQ ID NO: 881921 - protein, 9 aa, Homo Sapiens
TFPSYSPTS

SEQ ID NO: 881922 - protein, 9 aa, Homo Sapiens
KNYSASEDS

SEQ ID NO: 881923 - protein, 9 aa, Homo Sapiens
IPICPVLPH

SEQ ID NO: 881924 - protein, 9 aa, Homo Sapiens
GERQTDKTH

SEQ ID NO: 881925 - protein, 9 aa, Homo Sapiens
PGSLHEKGN

SEQ ID NO: 881926 - protein, 9 aa, Homo Sapiens
LEEDYKYIE

SEQ ID NO: 881927 - protein, 9 aa, Homo Sapiens
TEERMQAML

SEQ ID NO: 881928 - protein, 9 aa, Homo Sapiens
YKLPFLSTP

SEQ ID NO: 881929 - protein, 9 aa, Homo Sapiens
SLPYFKVIS

SEQ ID NO: 881930 - protein, 9 aa, Homo Sapiens
RTFSPGRPR

SEQ ID NO: 881931 - protein, 9 aa, Homo Sapiens
SRQSIWDVI

SEQ ID NO: 881932 - protein, 9 aa, Homo Sapiens
KNKVVKMIF

SEQ ID NO: 881933 - protein, 9 aa, Homo Sapiens
YTFRGFWST

SEQ ID NO: 881934 - protein, 9 aa, Homo Sapiens
TFQYDCFFE

SEQ ID NO: 881935 - protein, 9 aa, Homo Sapiens
QLPKMLEEL

SEQ ID NO: 881936 - protein, 9 aa, Homo Sapiens
SLAPEGLSN

SEQ ID NO: 881937 - protein, 9 aa, Homo Sapiens
LVALNLTGF

SEQ ID NO: 881938 - protein, 9 aa, Homo Sapiens
SQLIVHQII

SEQ ID NO: 881939 - protein, 9 aa, Homo Sapiens
RAPVTRASK

SEQ ID NO: 881940 - protein, 9 aa, Homo Sapiens
MLQSSLSTS

SEQ ID NO: 881941 - protein, 9 aa, Homo Sapiens
QLHVNISDL

SEQ ID NO: 881942 - protein, 9 aa, Homo Sapiens
HPQERPDWE

SEQ ID NO: 881943 - protein, 9 aa, Homo Sapiens
HPDVLVLQG

SEQ ID NO: 881944 - protein, 9 aa, Homo Sapiens
ASRRGDTGV

SEQ ID NO: 881945 - protein, 9 aa, Homo Sapiens
VIFGLCHQM

SEQ ID NO: 881946 - protein, 9 aa, Homo Sapiens
VVSETNQVL

SEQ ID NO: 881947 - protein, 9 aa, Homo Sapiens
HCKHGKVCK

SEQ ID NO: 881948 - protein, 9 aa, Homo Sapiens
ILNFISAQT

SEQ ID NO: 881949 - protein, 9 aa, Homo Sapiens
ICALHHLTS

SEQ ID NO: 881950 - protein, 9 aa, Homo Sapiens
YYLVACQPP

SEQ ID NO: 881951 - protein, 9 aa, Homo Sapiens
EDNYIRDRL

SEQ ID NO: 881952 - protein, 9 aa, Homo Sapiens
LNQIHQFDY

SEQ ID NO: 881953 - protein, 9 aa, Homo Sapiens
NIMCSTASI

SEQ ID NO: 881954 - protein, 9 aa, Homo Sapiens
RRTDQLTNI

SEQ ID NO: 881955 - protein, 9 aa, Homo Sapiens
SHKPIQSGN

SEQ ID NO: 881956 - protein, 9 aa, Homo Sapiens
NNYLSEATI

SEQ ID NO: 881957 - protein, 9 aa, Homo Sapiens
TGNTSFACT

SEQ ID NO: 881958 - protein, 9 aa, Homo Sapiens
QNHTGEKHY

SEQ ID NO: 881959 - protein, 9 aa, Homo Sapiens
SILRFLEIK

SEQ ID NO: 881960 - protein, 9 aa, Homo Sapiens
KRRFKTHNK

SEQ ID NO: 881961 - protein, 9 aa, Homo Sapiens
HIRGHYEQI

SEQ ID NO: 881962 - protein, 9 aa, Homo Sapiens
GLRDSHSEH

SEQ ID NO: 881963 - protein, 9 aa, Homo Sapiens
GDNLSNPLN

SEQ ID NO: 881964 - protein, 9 aa, Homo Sapiens
LPSNPSSRD

SEQ ID NO: 881965 - protein, 9 aa, Homo Sapiens
ENITPLIQA

SEQ ID NO: 881966 - protein, 9 aa, Homo Sapiens
CWCYLRLQH

SEQ ID NO: 881967 - protein, 9 aa, Homo Sapiens
RVIIYNRTR

SEQ ID NO: 881968 - protein, 9 aa, Homo Sapiens
IESWLEPVW

SEQ ID NO: 881969 - protein, 9 aa, Homo Sapiens
KILLLEGFE

SEQ ID NO: 881970 - protein, 9 aa, Homo Sapiens
FFNQEIRLC

SEQ ID NO: 881971 - protein, 9 aa, Homo Sapiens
RAAGKDYEN

SEQ ID NO: 881972 - protein, 9 aa, Homo Sapiens
EKEKAFQLQ

SEQ ID NO: 881973 - protein, 9 aa, Homo Sapiens
ETLTKAQIV

SEQ ID NO: 881974 - protein, 9 aa, Homo Sapiens
LKTSLLVAV

SEQ ID NO: 881975 - protein, 9 aa, Homo Sapiens
TIQELDKFA

SEQ ID NO: 881976 - protein, 9 aa, Homo Sapiens
LCNKEVRET

SEQ ID NO: 881977 - protein, 9 aa, Homo Sapiens
QIKMQLWIL

SEQ ID NO: 881978 - protein, 9 aa, Homo Sapiens
KLPSTSTLA

SEQ ID NO: 881979 - protein, 9 aa, Homo Sapiens
EKEGANFIL

SEQ ID NO: 881980 - protein, 9 aa, Homo Sapiens
LEKEECNGL

SEQ ID NO: 881981 - protein, 9 aa, Homo Sapiens
KIYTYQKKF

SEQ ID NO: 881982 - protein, 9 aa, Homo Sapiens
STSPPCASP

SEQ ID NO: 881983 - protein, 9 aa, Homo Sapiens
ALMLPSPRP

SEQ ID NO: 881984 - protein, 9 aa, Homo Sapiens
CSKCCDDLE

SEQ ID NO: 881985 - protein, 9 aa, Homo Sapiens
QFFTRHPPV

SEQ ID NO: 881986 - protein, 9 aa, Homo Sapiens
QCEKQKLAY

SEQ ID NO: 881987 - protein, 9 aa, Homo Sapiens
RKLETHKCA

SEQ ID NO: 881988 - protein, 9 aa, Homo Sapiens
TDPAERWHY

SEQ ID NO: 881989 - protein, 9 aa, Homo Sapiens
RSQSRSQRS

SEQ ID NO: 881990 - protein, 9 aa, Homo Sapiens
CFSIRADNI

SEQ ID NO: 881991 - protein, 9 aa, Homo Sapiens
SQLFKGHPN

SEQ ID NO: 881992 - protein, 9 aa, Homo Sapiens
GEVSTPSYP

SEQ ID NO: 881993 - protein, 9 aa, Homo Sapiens
RNQILENSK

SEQ ID NO: 881994 - protein, 9 aa, Homo Sapiens
VFCMQKYHK

SEQ ID NO: 881995 - protein, 9 aa, Homo Sapiens
CSGYQLTQH

SEQ ID NO: 881996 - protein, 9 aa, Homo Sapiens
PTRDDCGWF

SEQ ID NO: 881997 - protein, 9 aa, Homo Sapiens
QQDDLGTAF

SEQ ID NO: 881998 - protein, 9 aa, Homo Sapiens
LSLNYSNAE

SEQ ID NO: 881999 - protein, 9 aa, Homo Sapiens
AAAVGTKSK

SEQ ID NO: 882000 - protein, 9 aa, Homo Sapiens
LGHYTEEEQ

SEQ ID NO: 882001 - protein, 9 aa, Homo Sapiens
CLEVEMSKY

SEQ ID NO: 882002 - protein, 9 aa, Homo Sapiens
IAQGSDHEN

SEQ ID NO: 882003 - protein, 9 aa, Homo Sapiens
SGPYESDKD

SEQ ID NO: 882004 - protein, 9 aa, Homo Sapiens
NHNAMYWYR

SEQ ID NO: 882005 - protein, 9 aa, Homo Sapiens
MSFNQTGLK

SEQ ID NO: 882006 - protein, 9 aa, Homo Sapiens
CEQEKKEME

SEQ ID NO: 882007 - protein, 9 aa, Homo Sapiens
FILTIYQQF

SEQ ID NO: 882008 - protein, 9 aa, Homo Sapiens
DHYTIGKEI

SEQ ID NO: 882009 - protein, 9 aa, Homo Sapiens
ATTALAASP

SEQ ID NO: 882010 - protein, 9 aa, Homo Sapiens
LKVLKMFTN

SEQ ID NO: 882011 - protein, 9 aa, Homo Sapiens
MLSKTLGYL

SEQ ID NO: 882012 - protein, 9 aa, Homo Sapiens
CNKMPITAN

SEQ ID NO: 882013 - protein, 9 aa, Homo Sapiens
LGEGCKAMQ

SEQ ID NO: 882014 - protein, 9 aa, Homo Sapiens
KAIPIHLFL

SEQ ID NO: 882015 - protein, 9 aa, Homo Sapiens
GVVALAITS

SEQ ID NO: 882016 - protein, 9 aa, Homo Sapiens
SELERIFEL

SEQ ID NO: 882017 - protein, 9 aa, Homo Sapiens
DTSSPVACQ

SEQ ID NO: 882018 - protein, 9 aa, Homo Sapiens
LAVNKTPSF

SEQ ID NO: 882019 - protein, 9 aa, Homo Sapiens
SWQEDAYKC

SEQ ID NO: 882020 - protein, 9 aa, Homo Sapiens
VAASSRSDM

SEQ ID NO: 882021 - protein, 9 aa, Homo Sapiens
GTSFNLIGE

SEQ ID NO: 882022 - protein, 9 aa, Homo Sapiens
EVDSDGDGK

SEQ ID NO: 882023 - protein, 9 aa, Homo Sapiens
RDRVQWDLL

SEQ ID NO: 882024 - protein, 9 aa, Homo Sapiens
VQDNQQANG

SEQ ID NO: 882025 - protein, 9 aa, Homo Sapiens
IQQEERKVD

SEQ ID NO: 882026 - protein, 9 aa, Homo Sapiens
KPNNLEAFR

SEQ ID NO: 882027 - protein, 9 aa, Homo Sapiens
KMAFCAKSK

SEQ ID NO: 882028 - protein, 9 aa, Homo Sapiens
DALNIINMA

SEQ ID NO: 882029 - protein, 9 aa, Homo Sapiens
PPVSRRLLL

SEQ ID NO: 882030 - protein, 9 aa, Homo Sapiens
PGMHLPPPR

SEQ ID NO: 882031 - protein, 9 aa, Homo Sapiens
SESGDQYRT

SEQ ID NO: 882032 - protein, 9 aa, Homo Sapiens
KAVTAAETA

SEQ ID NO: 882033 - protein, 9 aa, Homo Sapiens
GSKDKHFQW

SEQ ID NO: 882034 - protein, 9 aa, Homo Sapiens
MWLGGFIHS

SEQ ID NO: 882035 - protein, 9 aa, Homo Sapiens
CYLRLQHIS

SEQ ID NO: 882036 - protein, 9 aa, Homo Sapiens
PVCITINTT

SEQ ID NO: 882037 - protein, 9 aa, Homo Sapiens
NNYILKENR

SEQ ID NO: 882038 - protein, 9 aa, Homo Sapiens
GIQILFSSC

SEQ ID NO: 882039 - protein, 9 aa, Homo Sapiens
LGFQTDLLS

SEQ ID NO: 882040 - protein, 9 aa, Homo Sapiens
KRHTAAAAA

SEQ ID NO: 882041 - protein, 9 aa, Homo Sapiens
EKRNFLGSP

SEQ ID NO: 882042 - protein, 9 aa, Homo Sapiens
PDMALCQNA

SEQ ID NO: 882043 - protein, 9 aa, Homo Sapiens
TAHLVLPTD

SEQ ID NO: 882044 - protein, 9 aa, Homo Sapiens
ITLNKLFQP

SEQ ID NO: 882045 - protein, 9 aa, Homo Sapiens
ILHMLNRLR

SEQ ID NO: 882046 - protein, 9 aa, Homo Sapiens
GRLRSRTLP

SEQ ID NO: 882047 - protein, 9 aa, Homo Sapiens
IRERFNNET

SEQ ID NO: 882048 - protein, 9 aa, Homo Sapiens
VCQLLHEKI

SEQ ID NO: 882049 - protein, 9 aa, Homo Sapiens
CNLMDGRDA

SEQ ID NO: 882050 - protein, 9 aa, Homo Sapiens
IMSINNADT

SEQ ID NO: 882051 - protein, 9 aa, Homo Sapiens
DLTSVQALQ

SEQ ID NO: 882052 - protein, 9 aa, Homo Sapiens
KELSWNQFS

SEQ ID NO: 882053 - protein, 9 aa, Homo Sapiens
YDPPQKLMA

SEQ ID NO: 882054 - protein, 9 aa, Homo Sapiens
YNQVYYVEE

SEQ ID NO: 882055 - protein, 9 aa, Homo Sapiens
ICHRWGLPQ

SEQ ID NO: 882056 - protein, 9 aa, Homo Sapiens
SLDGLDNKV

SEQ ID NO: 882057 - protein, 9 aa, Homo Sapiens
PFNLVYGAT

SEQ ID NO: 882058 - protein, 9 aa, Homo Sapiens
YNGNVEDIK

SEQ ID NO: 882059 - protein, 9 aa, Homo Sapiens
FHGDAQVVL

SEQ ID NO: 882060 - protein, 9 aa, Homo Sapiens
KRQTRKSIN

SEQ ID NO: 882061 - protein, 9 aa, Homo Sapiens
GKWHVSKVL

SEQ ID NO: 882062 - protein, 9 aa, Homo Sapiens
AMEPFKINV

SEQ ID NO: 882063 - protein, 9 aa, Homo Sapiens
HQNTLQSRQ

SEQ ID NO: 882064 - protein, 9 aa, Homo Sapiens
GVAKQLFPN

SEQ ID NO: 882065 - protein, 9 aa, Homo Sapiens
AVFEAGTLV

SEQ ID NO: 882066 - protein, 9 aa, Homo Sapiens
SAKIISLSF

SEQ ID NO: 882067 - protein, 9 aa, Homo Sapiens
KLLKQKENK

SEQ ID NO: 882068 - protein, 9 aa, Homo Sapiens
AAPAFLKAF

SEQ ID NO: 882069 - protein, 9 aa, Homo Sapiens
YARPIFLCL

SEQ ID NO: 882070 - protein, 9 aa, Homo Sapiens
KLIKCDKIQ

SEQ ID NO: 882071 - protein, 9 aa, Homo Sapiens
LFTTDGAHN

SEQ ID NO: 882072 - protein, 9 aa, Homo Sapiens
TLNGTDTIV

SEQ ID NO: 882073 - protein, 9 aa, Homo Sapiens
SILWINPDD

SEQ ID NO: 882074 - protein, 9 aa, Homo Sapiens
KNNYNPTAA

SEQ ID NO: 882075 - protein, 9 aa, Homo Sapiens
NKVEIEKIW

SEQ ID NO: 882076 - protein, 9 aa, Homo Sapiens
KNIDVGNKD

SEQ ID NO: 882077 - protein, 9 aa, Homo Sapiens
INLFINPGI

SEQ ID NO: 882078 - protein, 9 aa, Homo Sapiens
LYWQIWHMD

SEQ ID NO: 882079 - protein, 9 aa, Homo Sapiens
NHEPKKNAI

SEQ ID NO: 882080 - protein, 9 aa, Homo Sapiens
QDDLGTAFQ

SEQ ID NO: 882081 - protein, 9 aa, Homo Sapiens
SKITSKFVC

SEQ ID NO: 882082 - protein, 9 aa, Homo Sapiens
ASQAKYVKT

SEQ ID NO: 882083 - protein, 9 aa, Homo Sapiens
NISDLGLSR

SEQ ID NO: 882084 - protein, 9 aa, Homo Sapiens
IIYGFLNNG

SEQ ID NO: 882085 - protein, 9 aa, Homo Sapiens
QTCRYFHKV

SEQ ID NO: 882086 - protein, 9 aa, Homo Sapiens
EEVCKVNES

SEQ ID NO: 882087 - protein, 9 aa, Homo Sapiens
LLANSAHQV

SEQ ID NO: 882088 - protein, 9 aa, Homo Sapiens
VWVLTDHDE

SEQ ID NO: 882089 - protein, 9 aa, Homo Sapiens
GNYLFLVAV

SEQ ID NO: 882090 - protein, 9 aa, Homo Sapiens
GGSGDPFCS

SEQ ID NO: 882091 - protein, 9 aa, Homo Sapiens
GAGKYLAKW

SEQ ID NO: 882092 - protein, 9 aa, Homo Sapiens
IGAVVADVM

SEQ ID NO: 882093 - protein, 9 aa, Homo Sapiens
TGKNSNEVA

SEQ ID NO: 882094 - protein, 9 aa, Homo Sapiens
LKQKEYCGI

SEQ ID NO: 882095 - protein, 9 aa, Homo Sapiens
QSICHRWGL

SEQ ID NO: 882096 - protein, 9 aa, Homo Sapiens
NVREQLAKN

SEQ ID NO: 882097 - protein, 9 aa, Homo Sapiens
TNRKTCFII

SEQ ID NO: 882098 - protein, 9 aa, Homo Sapiens
LNHNAMYWY

SEQ ID NO: 882099 - protein, 9 aa, Homo Sapiens
ACPLPGSEF

SEQ ID NO: 882100 - protein, 9 aa, Homo Sapiens
QDYRRRHSH

SEQ ID NO: 882101 - protein, 9 aa, Homo Sapiens
CVISLGLVV

SEQ ID NO: 882102 - protein, 9 aa, Homo Sapiens
GFHGKIEDL

SEQ ID NO: 882103 - protein, 9 aa, Homo Sapiens
NMLKFGFGK

SEQ ID NO: 882104 - protein, 9 aa, Homo Sapiens
FTIYNNMLC

SEQ ID NO: 882105 - protein, 9 aa, Homo Sapiens
INLHNNRAG

SEQ ID NO: 882106 - protein, 9 aa, Homo Sapiens
VQSERSGGN

SEQ ID NO: 882107 - protein, 9 aa, Homo Sapiens
WDSGVAVAP

SEQ ID NO: 882108 - protein, 9 aa, Homo Sapiens
ITLFREAEE

SEQ ID NO: 882109 - protein, 9 aa, Homo Sapiens
QEFLYKTVG

SEQ ID NO: 882110 - protein, 9 aa, Homo Sapiens
DELQKRKSV

SEQ ID NO: 882111 - protein, 9 aa, Homo Sapiens
IPCENKSKA

SEQ ID NO: 882112 - protein, 9 aa, Homo Sapiens
DHDDQCEKQ

SEQ ID NO: 882113 - protein, 9 aa, Homo Sapiens
ETLTTQEPT

SEQ ID NO: 882114 - protein, 9 aa, Homo Sapiens
INFSRLRWL

SEQ ID NO: 882115 - protein, 9 aa, Homo Sapiens
TSPASSTSA

SEQ ID NO: 882116 - protein, 9 aa, Homo Sapiens
PFKINVPKP

SEQ ID NO: 882117 - protein, 9 aa, Homo Sapiens
SRHLVDLSG

SEQ ID NO: 882118 - protein, 9 aa, Homo Sapiens
PFVITLDSI

SEQ ID NO: 882119 - protein, 9 aa, Homo Sapiens
FNGSLRVCT

SEQ ID NO: 882120 - protein, 9 aa, Homo Sapiens
ADACNAKDP

SEQ ID NO: 882121 - protein, 9 aa, Homo Sapiens
TCHFHPDKD

SEQ ID NO: 882122 - protein, 9 aa, Homo Sapiens
QKMAKFISK

SEQ ID NO: 882123 - protein, 9 aa, Homo Sapiens
APDLLLAKV

SEQ ID NO: 882124 - protein, 9 aa, Homo Sapiens
LEVAGLSYF

SEQ ID NO: 882125 - protein, 9 aa, Homo Sapiens
IVNSASYRY

SEQ ID NO: 882126 - protein, 9 aa, Homo Sapiens
KSKYCEDID

SEQ ID NO: 882127 - protein, 9 aa, Homo Sapiens
DSIYLLANS

SEQ ID NO: 882128 - protein, 9 aa, Homo Sapiens
IWKVLTSQL

SEQ ID NO: 882129 - protein, 9 aa, Homo Sapiens
MADAQRQDC

SEQ ID NO: 882130 - protein, 9 aa, Homo Sapiens
LDGGDPIQK

SEQ ID NO: 882131 - protein, 9 aa, Homo Sapiens
RQQTYLSCQ

SEQ ID NO: 882132 - protein, 9 aa, Homo Sapiens
SGCCSGEKE

SEQ ID NO: 882133 - protein, 9 aa, Homo Sapiens
VESSPERPI

SEQ ID NO: 882134 - protein, 9 aa, Homo Sapiens
VMQISPDQG

SEQ ID NO: 882135 - protein, 9 aa, Homo Sapiens
MYKSNGYTM

SEQ ID NO: 882136 - protein, 9 aa, Homo Sapiens
IVKLFLSYD

SEQ ID NO: 882137 - protein, 9 aa, Homo Sapiens
GQMQQVQTH

SEQ ID NO: 882138 - protein, 9 aa, Homo Sapiens
RRTLPAWIC

SEQ ID NO: 882139 - protein, 9 aa, Homo Sapiens
AFGSKDKHF

SEQ ID NO: 882140 - protein, 9 aa, Homo Sapiens
YLAPQEGNV

SEQ ID NO: 882141 - protein, 9 aa, Homo Sapiens
IERLPLANE

SEQ ID NO: 882142 - protein, 9 aa, Homo Sapiens
NAEESEICY

SEQ ID NO: 882143 - protein, 9 aa, Homo Sapiens
FIQKVEGVE

SEQ ID NO: 882144 - protein, 9 aa, Homo Sapiens
HCHKCGFVV

SEQ ID NO: 882145 - protein, 9 aa, Homo Sapiens
PSERACPLP

SEQ ID NO: 882146 - protein, 9 aa, Homo Sapiens
KDLRTQFRT

SEQ ID NO: 882147 - protein, 9 aa, Homo Sapiens
IRLAIPSML

SEQ ID NO: 882148 - protein, 9 aa, Homo Sapiens
RQTDKTHSE

SEQ ID NO: 882149 - protein, 9 aa, Homo Sapiens
SVIGLSFDL

SEQ ID NO: 882150 - protein, 9 aa, Homo Sapiens
DASHVLEAA

SEQ ID NO: 882151 - protein, 9 aa, Homo Sapiens
YMERNNIDV

SEQ ID NO: 882152 - protein, 9 aa, Homo Sapiens
QKHFLPHNF

SEQ ID NO: 882153 - protein, 9 aa, Homo Sapiens
QKLDEYLKS

SEQ ID NO: 882154 - protein, 9 aa, Homo Sapiens
GAVYYCLHR

SEQ ID NO: 882155 - protein, 9 aa, Homo Sapiens
QNMGKEDAL

SEQ ID NO: 882156 - protein, 9 aa, Homo Sapiens
QKRSVRDLE

SEQ ID NO: 882157 - protein, 9 aa, Homo Sapiens
EGKVDPYHS

SEQ ID NO: 882158 - protein, 9 aa, Homo Sapiens
MIEAKANYC

SEQ ID NO: 882159 - protein, 9 aa, Homo Sapiens
DAEDYGHYK

SEQ ID NO: 882160 - protein, 9 aa, Homo Sapiens
KEVNYSPRA

SEQ ID NO: 882161 - protein, 9 aa, Homo Sapiens
QYHYQLIEH

SEQ ID NO: 882162 - protein, 9 aa, Homo Sapiens
CCGRGMPQP

SEQ ID NO: 882163 - protein, 9 aa, Homo Sapiens
NIYFADQDQ

SEQ ID NO: 882164 - protein, 9 aa, Homo Sapiens
DQVILQHMK

SEQ ID NO: 882165 - protein, 9 aa, Homo Sapiens
FSDLQVYLY

SEQ ID NO: 882166 - protein, 9 aa, Homo Sapiens
LMVFTIFFG

SEQ ID NO: 882167 - protein, 9 aa, Homo Sapiens
MGLLSFPVM

SEQ ID NO: 882168 - protein, 9 aa, Homo Sapiens
YRQHAARRL

SEQ ID NO: 882169 - protein, 9 aa, Homo Sapiens
SGGARQSVI

SEQ ID NO: 882170 - protein, 9 aa, Homo Sapiens
KWMLGPVVL

SEQ ID NO: 882171 - protein, 9 aa, Homo Sapiens
HPIHWAVVN

SEQ ID NO: 882172 - protein, 9 aa, Homo Sapiens
WCMERKRDK

SEQ ID NO: 882173 - protein, 9 aa, Homo Sapiens
IKYWLSENS

SEQ ID NO: 882174 - protein, 9 aa, Homo Sapiens
LDKKILLKI

SEQ ID NO: 882175 - protein, 9 aa, Homo Sapiens
LYTQICNRA

SEQ ID NO: 882176 - protein, 9 aa, Homo Sapiens
RQTYPKKPG

SEQ ID NO: 882177 - protein, 9 aa, Homo Sapiens
PDSDNFLSS

SEQ ID NO: 882178 - protein, 9 aa, Homo Sapiens
IWNQRHSGK

SEQ ID NO: 882179 - protein, 9 aa, Homo Sapiens
IGPGELGGS

SEQ ID NO: 882180 - protein, 9 aa, Homo Sapiens
NQCLDNMGH

SEQ ID NO: 882181 - protein, 9 aa, Homo Sapiens
NRVVWKQPR

SEQ ID NO: 882182 - protein, 9 aa, Homo Sapiens
WMRQKISFG

SEQ ID NO: 882183 - protein, 9 aa, Homo Sapiens
DNNTQNGDV

SEQ ID NO: 882184 - protein, 9 aa, Homo Sapiens
EDQEEDNNI

SEQ ID NO: 882185 - protein, 9 aa, Homo Sapiens
ARFYPLQMH

SEQ ID NO: 882186 - protein, 9 aa, Homo Sapiens
EGDENKPTH

SEQ ID NO: 882187 - protein, 9 aa, Homo Sapiens
WVAGVNQDC

SEQ ID NO: 882188 - protein, 9 aa, Homo Sapiens
YETAVKFSS

SEQ ID NO: 882189 - protein, 9 aa, Homo Sapiens
PNPAVTLKN

SEQ ID NO: 882190 - protein, 9 aa, Homo Sapiens
ESGSKIWAF

SEQ ID NO: 882191 - protein, 9 aa, Homo Sapiens
QKEFAKFEE

SEQ ID NO: 882192 - protein, 9 aa, Homo Sapiens
SVVFEDGTV

SEQ ID NO: 882193 - protein, 9 aa, Homo Sapiens
WCQNHHNVG

SEQ ID NO: 882194 - protein, 9 aa, Homo Sapiens
ALNMQHSRD

SEQ ID NO: 882195 - protein, 9 aa, Homo Sapiens
AMGNKMSAH

SEQ ID NO: 882196 - protein, 9 aa, Homo Sapiens
PHDQSPRRI

SEQ ID NO: 882197 - protein, 9 aa, Homo Sapiens
VIAIRLDSH

SEQ ID NO: 882198 - protein, 9 aa, Homo Sapiens
APVINLAES

SEQ ID NO: 882199 - protein, 9 aa, Homo Sapiens
VRWATHIQD

SEQ ID NO: 882200 - protein, 9 aa, Homo Sapiens
PSTSQLQQL

SEQ ID NO: 882201 - protein, 9 aa, Homo Sapiens
NQILENSKS

SEQ ID NO: 882202 - protein, 9 aa, Homo Sapiens
ICGLKRLHI

SEQ ID NO: 882203 - protein, 9 aa, Homo Sapiens
IDIYDKENI

SEQ ID NO: 882204 - protein, 9 aa, Homo Sapiens
FQKGKYVKK

SEQ ID NO: 882205 - protein, 9 aa, Homo Sapiens
ACAEEWQKS

SEQ ID NO: 882206 - protein, 9 aa, Homo Sapiens
GTTEGAVDA

SEQ ID NO: 882207 - protein, 9 aa, Homo Sapiens
GVNRVVWKQ

SEQ ID NO: 882208 - protein, 9 aa, Homo Sapiens
CCLNGCGHT

SEQ ID NO: 882209 - protein, 9 aa, Homo Sapiens
NAIKKYLCT

SEQ ID NO: 882210 - protein, 9 aa, Homo Sapiens
LCPQFPLIL

SEQ ID NO: 882211 - protein, 9 aa, Homo Sapiens
RKNLCCQSF

SEQ ID NO: 882212 - protein, 9 aa, Homo Sapiens
FLDTSERME

SEQ ID NO: 882213 - protein, 9 aa, Homo Sapiens
SGCDYSKLT

SEQ ID NO: 882214 - protein, 9 aa, Homo Sapiens
KIKDGDFKN

SEQ ID NO: 882215 - protein, 9 aa, Homo Sapiens
SGGCVPDVL

SEQ ID NO: 882216 - protein, 9 aa, Homo Sapiens
HPAKPISFV

SEQ ID NO: 882217 - protein, 9 aa, Homo Sapiens
NYVLDLVSD

SEQ ID NO: 882218 - protein, 9 aa, Homo Sapiens
PPGVMCLPV

SEQ ID NO: 882219 - protein, 9 aa, Homo Sapiens
NTSFACTEC

SEQ ID NO: 882220 - protein, 9 aa, Homo Sapiens
FFKFYHLLN

SEQ ID NO: 882221 - protein, 9 aa, Homo Sapiens
INLNHNFAD

SEQ ID NO: 882222 - protein, 9 aa, Homo Sapiens
ELKEIERLP

SEQ ID NO: 882223 - protein, 9 aa, Homo Sapiens
QDALHISQN

SEQ ID NO: 882224 - protein, 9 aa, Homo Sapiens
TRYHNEIKS

SEQ ID NO: 882225 - protein, 9 aa, Homo Sapiens
RRSRSPNKE

SEQ ID NO: 882226 - protein, 9 aa, Homo Sapiens
LQLEGLLCD

SEQ ID NO: 882227 - protein, 9 aa, Homo Sapiens
KDDHLLSPT

SEQ ID NO: 882228 - protein, 9 aa, Homo Sapiens
SNLSSTAKW

SEQ ID NO: 882229 - protein, 9 aa, Homo Sapiens
EVFQVTSTE

SEQ ID NO: 882230 - protein, 9 aa, Homo Sapiens
KNRSQMIEH

SEQ ID NO: 882231 - protein, 9 aa, Homo Sapiens
LKGKMPINL

SEQ ID NO: 882232 - protein, 9 aa, Homo Sapiens
VPGKWQQQG

SEQ ID NO: 882233 - protein, 9 aa, Homo Sapiens
GLLWQEAVS

SEQ ID NO: 882234 - protein, 9 aa, Homo Sapiens
KPFNILILL

SEQ ID NO: 882235 - protein, 9 aa, Homo Sapiens
IQIPAKPGK

SEQ ID NO: 882236 - protein, 9 aa, Homo Sapiens
ETKVQFLNN

SEQ ID NO: 882237 - protein, 9 aa, Homo Sapiens
KAQNYRKKA

SEQ ID NO: 882238 - protein, 9 aa, Homo Sapiens
CYRKQEWIK

SEQ ID NO: 882239 - protein, 9 aa, Homo Sapiens
RCPFREPQN

SEQ ID NO: 882240 - protein, 9 aa, Homo Sapiens
GRLLMRIGN

SEQ ID NO: 882241 - protein, 9 aa, Homo Sapiens
RPLSQRQLC

SEQ ID NO: 882242 - protein, 9 aa, Homo Sapiens
REEDKHPYE

SEQ ID NO: 882243 - protein, 9 aa, Homo Sapiens
FWQKVMLGT

SEQ ID NO: 882244 - protein, 9 aa, Homo Sapiens
EFSHAIAMQ

SEQ ID NO: 882245 - protein, 9 aa, Homo Sapiens
YPKFNSVGK

SEQ ID NO: 882246 - protein, 9 aa, Homo Sapiens
IYLKQINYS

SEQ ID NO: 882247 - protein, 9 aa, Homo Sapiens
LNMCVGEKR

SEQ ID NO: 882248 - protein, 9 aa, Homo Sapiens
KKQGVPENC

SEQ ID NO: 882249 - protein, 9 aa, Homo Sapiens
LRTGGDKLP

SEQ ID NO: 882250 - protein, 9 aa, Homo Sapiens
SVEYYNPAT

SEQ ID NO: 882251 - protein, 9 aa, Homo Sapiens
FNLMEDRMM

SEQ ID NO: 882252 - protein, 9 aa, Homo Sapiens
ILAKRTFRL

SEQ ID NO: 882253 - protein, 9 aa, Homo Sapiens
FLYKTVGGL

SEQ ID NO: 882254 - protein, 9 aa, Homo Sapiens
TQLPVAYQG

SEQ ID NO: 882255 - protein, 9 aa, Homo Sapiens
TLCVADFGL

SEQ ID NO: 882256 - protein, 9 aa, Homo Sapiens
QISHTGEEP

SEQ ID NO: 882257 - protein, 9 aa, Homo Sapiens
GSFSVILHY

SEQ ID NO: 882258 - protein, 9 aa, Homo Sapiens
CGGGVRICS

SEQ ID NO: 882259 - protein, 9 aa, Homo Sapiens
YYSRSRSQS

SEQ ID NO: 882260 - protein, 9 aa, Homo Sapiens
LQERIWSYL

SEQ ID NO: 882261 - protein, 9 aa, Homo Sapiens
FTALVKCLP

SEQ ID NO: 882262 - protein, 9 aa, Homo Sapiens
CLPVFNVLK

SEQ ID NO: 882263 - protein, 9 aa, Homo Sapiens
GGTSLSDKT

SEQ ID NO: 882264 - protein, 9 aa, Homo Sapiens
NITPLIQAV

SEQ ID NO: 882265 - protein, 9 aa, Homo Sapiens
EQFASMRNL

SEQ ID NO: 882266 - protein, 9 aa, Homo Sapiens
TEILAKRTF

SEQ ID NO: 882267 - protein, 9 aa, Homo Sapiens
QFGTIRTID

SEQ ID NO: 882268 - protein, 9 aa, Homo Sapiens
AYLQIFHKL

SEQ ID NO: 882269 - protein, 9 aa, Homo Sapiens
TRKLETHKC

SEQ ID NO: 882270 - protein, 9 aa, Homo Sapiens
IHKLGSTHE

SEQ ID NO: 882271 - protein, 9 aa, Homo Sapiens
HSDGRKYPE

SEQ ID NO: 882272 - protein, 9 aa, Homo Sapiens
RHFSIHTGD

SEQ ID NO: 882273 - protein, 9 aa, Homo Sapiens
PFLPIQALP

SEQ ID NO: 882274 - protein, 9 aa, Homo Sapiens
YLDGFAQNC

SEQ ID NO: 882275 - protein, 9 aa, Homo Sapiens
FCQTRQNAK

SEQ ID NO: 882276 - protein, 9 aa, Homo Sapiens
YEAFNPAAA

SEQ ID NO: 882277 - protein, 9 aa, Homo Sapiens
SRDVSPTSC

SEQ ID NO: 882278 - protein, 9 aa, Homo Sapiens
IFGYDQKKY

SEQ ID NO: 882279 - protein, 9 aa, Homo Sapiens
TAYPNAFCI

SEQ ID NO: 882280 - protein, 9 aa, Homo Sapiens
TIGQVLAQM

SEQ ID NO: 882281 - protein, 9 aa, Homo Sapiens
HQTHMSSCR

SEQ ID NO: 882282 - protein, 9 aa, Homo Sapiens
VSCQAADYD

SEQ ID NO: 882283 - protein, 9 aa, Homo Sapiens
DKHFQWANT

SEQ ID NO: 882284 - protein, 9 aa, Homo Sapiens
EWLKTSLLV

SEQ ID NO: 882285 - protein, 9 aa, Homo Sapiens
AYLDVCIPS

SEQ ID NO: 882286 - protein, 9 aa, Homo Sapiens
EDHSCTLAN

SEQ ID NO: 882287 - protein, 9 aa, Homo Sapiens
NDPSYKENA

SEQ ID NO: 882288 - protein, 9 aa, Homo Sapiens
GDWERLELK

SEQ ID NO: 882289 - protein, 9 aa, Homo Sapiens
LVPILELAC

SEQ ID NO: 882290 - protein, 9 aa, Homo Sapiens
ETSIKPKAT

SEQ ID NO: 882291 - protein, 9 aa, Homo Sapiens
TYMQIYKKG

SEQ ID NO: 882292 - protein, 9 aa, Homo Sapiens
LKATEVMMQ

SEQ ID NO: 882293 - protein, 9 aa, Homo Sapiens
FYILIVDPY

SEQ ID NO: 882294 - protein, 9 aa, Homo Sapiens
YLEIYQEDI

SEQ ID NO: 882295 - protein, 9 aa, Homo Sapiens
SIRSASACS

SEQ ID NO: 882296 - protein, 9 aa, Homo Sapiens
SCRQSTHLK

SEQ ID NO: 882297 - protein, 9 aa, Homo Sapiens
VSRCFHNGY

SEQ ID NO: 882298 - protein, 9 aa, Homo Sapiens
KLCSLENHG

SEQ ID NO: 882299 - protein, 9 aa, Homo Sapiens
LKFGFGKFV

SEQ ID NO: 882300 - protein, 9 aa, Homo Sapiens
VCNDIDEGN

SEQ ID NO: 882301 - protein, 9 aa, Homo Sapiens
LPQNQKEHR

SEQ ID NO: 882302 - protein, 9 aa, Homo Sapiens
EQQSTNGQT

SEQ ID NO: 882303 - protein, 9 aa, Homo Sapiens
SPAEIRRSW

SEQ ID NO: 882304 - protein, 9 aa, Homo Sapiens
DPVYCLLPY

SEQ ID NO: 882305 - protein, 9 aa, Homo Sapiens
GCFFRRKQH

SEQ ID NO: 882306 - protein, 9 aa, Homo Sapiens
EQIPILYRM

SEQ ID NO: 882307 - protein, 9 aa, Homo Sapiens
GLELEKKCK

SEQ ID NO: 882308 - protein, 9 aa, Homo Sapiens
VGTCKETEG

SEQ ID NO: 882309 - protein, 9 aa, Homo Sapiens
WWRHVAVRK

SEQ ID NO: 882310 - protein, 9 aa, Homo Sapiens
SVPYKQLMN

SEQ ID NO: 882311 - protein, 9 aa, Homo Sapiens
AHVAEQNST

SEQ ID NO: 882312 - protein, 9 aa, Homo Sapiens
GDQSGNLRI

SEQ ID NO: 882313 - protein, 9 aa, Homo Sapiens
HLRISPSLP

SEQ ID NO: 882314 - protein, 9 aa, Homo Sapiens
TLGMKLLHG

SEQ ID NO: 882315 - protein, 9 aa, Homo Sapiens
KSWAQGNLT

SEQ ID NO: 882316 - protein, 9 aa, Homo Sapiens
YYECYSDAS

SEQ ID NO: 882317 - protein, 9 aa, Homo Sapiens
SSCFIKWGL

SEQ ID NO: 882318 - protein, 9 aa, Homo Sapiens
KNVQKINEL

SEQ ID NO: 882319 - protein, 9 aa, Homo Sapiens
PKTTIKVWF

SEQ ID NO: 882320 - protein, 9 aa, Homo Sapiens
KRGFFWANI

SEQ ID NO: 882321 - protein, 9 aa, Homo Sapiens
LTLVFKQDN

SEQ ID NO: 882322 - protein, 9 aa, Homo Sapiens
ETEFRDKLY

SEQ ID NO: 882323 - protein, 9 aa, Homo Sapiens
VDHINQTPG

SEQ ID NO: 882324 - protein, 9 aa, Homo Sapiens
TRFKKTKID

SEQ ID NO: 882325 - protein, 9 aa, Homo Sapiens
KAENEDLNW

SEQ ID NO: 882326 - protein, 9 aa, Homo Sapiens
KFRGVELVC

SEQ ID NO: 882327 - protein, 9 aa, Homo Sapiens
KSHSDPHPD

SEQ ID NO: 882328 - protein, 9 aa, Homo Sapiens
ELSYEDIQN

SEQ ID NO: 882329 - protein, 9 aa, Homo Sapiens
LAQLKAAVG

SEQ ID NO: 882330 - protein, 9 aa, Homo Sapiens
LPENGYWVV

SEQ ID NO: 882331 - protein, 9 aa, Homo Sapiens
EYLHSSLYF

SEQ ID NO: 882332 - protein, 9 aa, Homo Sapiens
NGTDESPLW

SEQ ID NO: 882333 - protein, 9 aa, Homo Sapiens
NAADTWVDI

SEQ ID NO: 882334 - protein, 9 aa, Homo Sapiens
FTLCLHYQN

SEQ ID NO: 882335 - protein, 9 aa, Homo Sapiens
HEICLSDPG

SEQ ID NO: 882336 - protein, 9 aa, Homo Sapiens
SSRIQSIPS

SEQ ID NO: 882337 - protein, 9 aa, Homo Sapiens
PPGKVVFYT

SEQ ID NO: 882338 - protein, 9 aa, Homo Sapiens
GAQPSATLT

SEQ ID NO: 882339 - protein, 9 aa, Homo Sapiens
ENKDALEKA

SEQ ID NO: 882340 - protein, 9 aa, Homo Sapiens
VTGMGVQNG

SEQ ID NO: 882341 - protein, 9 aa, Homo Sapiens
IRTFAVGKR

SEQ ID NO: 882342 - protein, 9 aa, Homo Sapiens
LHVNISDLG

SEQ ID NO: 882343 - protein, 9 aa, Homo Sapiens
LSPKTTIYV

SEQ ID NO: 882344 - protein, 9 aa, Homo Sapiens
GTNVRRKPL

SEQ ID NO: 882345 - protein, 9 aa, Homo Sapiens
NQHNNILYR

SEQ ID NO: 882346 - protein, 9 aa, Homo Sapiens
FGEYANDKN

SEQ ID NO: 882347 - protein, 9 aa, Homo Sapiens
VPHKLPRVP

SEQ ID NO: 882348 - protein, 9 aa, Homo Sapiens
DERRLFCHL

SEQ ID NO: 882349 - protein, 9 aa, Homo Sapiens
DMRPLEALS

SEQ ID NO: 882350 - protein, 9 aa, Homo Sapiens
PNGILSVKH

SEQ ID NO: 882351 - protein, 9 aa, Homo Sapiens
KMSGRGSVL

SEQ ID NO: 882352 - protein, 9 aa, Homo Sapiens
EMGDLTHRV

SEQ ID NO: 882353 - protein, 9 aa, Homo Sapiens
MWTLFSRGL

SEQ ID NO: 882354 - protein, 9 aa, Homo Sapiens
HICYWVLQI

SEQ ID NO: 882355 - protein, 9 aa, Homo Sapiens
VWQRTLSYN

SEQ ID NO: 882356 - protein, 9 aa, Homo Sapiens
ADIQDIEAK

SEQ ID NO: 882357 - protein, 9 aa, Homo Sapiens
DMAFTHEGN

SEQ ID NO: 882358 - protein, 9 aa, Homo Sapiens
DVDTHAEMV

SEQ ID NO: 882359 - protein, 9 aa, Homo Sapiens
PDAAAKDSP

SEQ ID NO: 882360 - protein, 9 aa, Homo Sapiens
KWMVHGYPS

SEQ ID NO: 882361 - protein, 9 aa, Homo Sapiens
RLAEVGSVC

SEQ ID NO: 882362 - protein, 9 aa, Homo Sapiens
FKSLAKRRL

SEQ ID NO: 882363 - protein, 9 aa, Homo Sapiens
GDLDQDGRT

SEQ ID NO: 882364 - protein, 9 aa, Homo Sapiens
TKQGCTVAD

SEQ ID NO: 882365 - protein, 9 aa, Homo Sapiens
EEIQMTVVW

SEQ ID NO: 882366 - protein, 9 aa, Homo Sapiens
HRFLIKATT

SEQ ID NO: 882367 - protein, 9 aa, Homo Sapiens
IGELRTAHL

SEQ ID NO: 882368 - protein, 9 aa, Homo Sapiens
VENLFCFLT

SEQ ID NO: 882369 - protein, 9 aa, Homo Sapiens
PFNILILLT

SEQ ID NO: 882370 - protein, 9 aa, Homo Sapiens
AQVVLLGLA

SEQ ID NO: 882371 - protein, 9 aa, Homo Sapiens
YDIDDKNEI

SEQ ID NO: 882372 - protein, 9 aa, Homo Sapiens
LKADKPSSE

SEQ ID NO: 882373 - protein, 9 aa, Homo Sapiens
TVTQQRGNM

SEQ ID NO: 882374 - protein, 9 aa, Homo Sapiens
DCKLNNGRW

SEQ ID NO: 882375 - protein, 9 aa, Homo Sapiens
QKQEVWEAF

SEQ ID NO: 882376 - protein, 9 aa, Homo Sapiens
GNTSPAEDN

SEQ ID NO: 882377 - protein, 9 aa, Homo Sapiens
ILVATYIHL

SEQ ID NO: 882378 - protein, 9 aa, Homo Sapiens
LEKFTCSVG

SEQ ID NO: 882379 - protein, 9 aa, Homo Sapiens
NCHGSSVLS

SEQ ID NO: 882380 - protein, 9 aa, Homo Sapiens
RGPQKQLAA

SEQ ID NO: 882381 - protein, 9 aa, Homo Sapiens
APKVEANVS

SEQ ID NO: 882382 - protein, 9 aa, Homo Sapiens
SVLSLLRSE

SEQ ID NO: 882383 - protein, 9 aa, Homo Sapiens
SRKQKEKLW

SEQ ID NO: 882384 - protein, 9 aa, Homo Sapiens
TIQISCNSP

SEQ ID NO: 882385 - protein, 9 aa, Homo Sapiens
SKFLPMSYP

SEQ ID NO: 882386 - protein, 9 aa, Homo Sapiens
EYAPCGNLS

SEQ ID NO: 882387 - protein, 9 aa, Homo Sapiens
FLKQEGCAN

SEQ ID NO: 882388 - protein, 9 aa, Homo Sapiens
YPVAVLFAM

SEQ ID NO: 882389 - protein, 9 aa, Homo Sapiens
SAQYLGEVL

SEQ ID NO: 882390 - protein, 9 aa, Homo Sapiens
KKFPPHGPN

SEQ ID NO: 882391 - protein, 9 aa, Homo Sapiens
NHGKKLQNY

SEQ ID NO: 882392 - protein, 9 aa, Homo Sapiens
KLATCPLNA

SEQ ID NO: 882393 - protein, 9 aa, Homo Sapiens
NYGEEGVPG

SEQ ID NO: 882394 - protein, 9 aa, Homo Sapiens
SLKVEYKRG

SEQ ID NO: 882395 - protein, 9 aa, Homo Sapiens
KLGSGPFSK

SEQ ID NO: 882396 - protein, 9 aa, Homo Sapiens
PFDQLAFIK

SEQ ID NO: 882397 - protein, 9 aa, Homo Sapiens
KRVGPGFLL

SEQ ID NO: 882398 - protein, 9 aa, Homo Sapiens
ANLVAPILR

SEQ ID NO: 882399 - protein, 9 aa, Homo Sapiens
VPNPINLLE

SEQ ID NO: 882400 - protein, 9 aa, Homo Sapiens
WHKDILQLI

SEQ ID NO: 882401 - protein, 9 aa, Homo Sapiens
GCDYSKLTW

SEQ ID NO: 882402 - protein, 9 aa, Homo Sapiens
EIATYRCLL

SEQ ID NO: 882403 - protein, 9 aa, Homo Sapiens
SVDDVKNLN

SEQ ID NO: 882404 - protein, 9 aa, Homo Sapiens
FCAIFLHGR

SEQ ID NO: 882405 - protein, 9 aa, Homo Sapiens
SLLLSADWP

SEQ ID NO: 882406 - protein, 9 aa, Homo Sapiens
QINMLLKFK

SEQ ID NO: 882407 - protein, 9 aa, Homo Sapiens
KTQIGLAQY

SEQ ID NO: 882408 - protein, 9 aa, Homo Sapiens
SDMEKWVED

SEQ ID NO: 882409 - protein, 9 aa, Homo Sapiens
VTHLAEKNI

SEQ ID NO: 882410 - protein, 9 aa, Homo Sapiens
WGRLYPWGI

SEQ ID NO: 882411 - protein, 9 aa, Homo Sapiens
DPIQKGAVP

SEQ ID NO: 882412 - protein, 9 aa, Homo Sapiens
QPLGMEPKN

SEQ ID NO: 882413 - protein, 9 aa, Homo Sapiens
LISSAVYVN

SEQ ID NO: 882414 - protein, 9 aa, Homo Sapiens
TYPYVQHKI

SEQ ID NO: 882415 - protein, 9 aa, Homo Sapiens
FLLFVLLVW

SEQ ID NO: 882416 - protein, 9 aa, Homo Sapiens
RRLTWEAMP

SEQ ID NO: 882417 - protein, 9 aa, Homo Sapiens
LMLQRPQHY

SEQ ID NO: 882418 - protein, 9 aa, Homo Sapiens
HSKISKDVY

SEQ ID NO: 882419 - protein, 9 aa, Homo Sapiens
QAWALFPPR

SEQ ID NO: 882420 - protein, 9 aa, Homo Sapiens
NYLWNLAKS

SEQ ID NO: 882421 - protein, 9 aa, Homo Sapiens
ERNYPLAIK

SEQ ID NO: 882422 - protein, 9 aa, Homo Sapiens
KCMLLTLKS

SEQ ID NO: 882423 - protein, 9 aa, Homo Sapiens
QMICINQQT

SEQ ID NO: 882424 - protein, 9 aa, Homo Sapiens
IYVFMGRNF

SEQ ID NO: 882425 - protein, 9 aa, Homo Sapiens
LPGPYRLCQ

SEQ ID NO: 882426 - protein, 9 aa, Homo Sapiens
VAKVRAVNA

SEQ ID NO: 882427 - protein, 9 aa, Homo Sapiens
QVYQKVKTH

SEQ ID NO: 882428 - protein, 9 aa, Homo Sapiens
GHYLQQVTG

SEQ ID NO: 882429 - protein, 9 aa, Homo Sapiens
PLSQAKVIQ

SEQ ID NO: 882430 - protein, 9 aa, Homo Sapiens
KVVKRKAAV

SEQ ID NO: 882431 - protein, 9 aa, Homo Sapiens
AKYACNDIQ

SEQ ID NO: 882432 - protein, 9 aa, Homo Sapiens
SLDKDNQRT

SEQ ID NO: 882433 - protein, 9 aa, Homo Sapiens
KEEAEQLEK

SEQ ID NO: 882434 - protein, 9 aa, Homo Sapiens
QNQKEHRNL

SEQ ID NO: 882435 - protein, 9 aa, Homo Sapiens
QDCPFFLYY

SEQ ID NO: 882436 - protein, 9 aa, Homo Sapiens
SCNVKAYVL

SEQ ID NO: 882437 - protein, 9 aa, Homo Sapiens
RATWNDHFS

SEQ ID NO: 882438 - protein, 9 aa, Homo Sapiens
SIYNQVYYV

SEQ ID NO: 882439 - protein, 9 aa, Homo Sapiens
LLKEKQRHQ

SEQ ID NO: 882440 - protein, 9 aa, Homo Sapiens
DYKVNFHFI

SEQ ID NO: 882441 - protein, 9 aa, Homo Sapiens
FRRSLVLCT

SEQ ID NO: 882442 - protein, 9 aa, Homo Sapiens
AQFLVKDCD

SEQ ID NO: 882443 - protein, 9 aa, Homo Sapiens
LFLLDQNNN

SEQ ID NO: 882444 - protein, 9 aa, Homo Sapiens
LCPKDVVYP

SEQ ID NO: 882445 - protein, 9 aa, Homo Sapiens
PRFKIVEHF

SEQ ID NO: 882446 - protein, 9 aa, Homo Sapiens
LEIKEQIPL

SEQ ID NO: 882447 - protein, 9 aa, Homo Sapiens
AHCVTGLGK

SEQ ID NO: 882448 - protein, 9 aa, Homo Sapiens
KKLLERDSF

SEQ ID NO: 882449 - protein, 9 aa, Homo Sapiens
SITTPKMIC

SEQ ID NO: 882450 - protein, 9 aa, Homo Sapiens
HCHKPYLWV

SEQ ID NO: 882451 - protein, 9 aa, Homo Sapiens
WRRRPTPAT

SEQ ID NO: 882452 - protein, 9 aa, Homo Sapiens
LPNDSDNIK

SEQ ID NO: 882453 - protein, 9 aa, Homo Sapiens
GKAFLCSRT

SEQ ID NO: 882454 - protein, 9 aa, Homo Sapiens
DEQLFSVGQ

SEQ ID NO: 882455 - protein, 9 aa, Homo Sapiens
LDNQIATAT

SEQ ID NO: 882456 - protein, 9 aa, Homo Sapiens
AEEQARTEI

SEQ ID NO: 882457 - protein, 9 aa, Homo Sapiens
CHRWGLPQK

SEQ ID NO: 882458 - protein, 9 aa, Homo Sapiens
EQYITQFTS

SEQ ID NO: 882459 - protein, 9 aa, Homo Sapiens
FVNLPYYTV

SEQ ID NO: 882460 - protein, 9 aa, Homo Sapiens
NFLSFMVLF

SEQ ID NO: 882461 - protein, 9 aa, Homo Sapiens
ESTSFSRDY

SEQ ID NO: 882462 - protein, 9 aa, Homo Sapiens
LESPHMYVS

SEQ ID NO: 882463 - protein, 9 aa, Homo Sapiens
GLSSYNERV

SEQ ID NO: 882464 - protein, 9 aa, Homo Sapiens
KVSNQTLNL

SEQ ID NO: 882465 - protein, 9 aa, Homo Sapiens
IQKGEIKPS

SEQ ID NO: 882466 - protein, 9 aa, Homo Sapiens
TLCLPVVLT

SEQ ID NO: 882467 - protein, 9 aa, Homo Sapiens
SSKLEKVGS

SEQ ID NO: 882468 - protein, 9 aa, Homo Sapiens
ANNQRNVWF

SEQ ID NO: 882469 - protein, 9 aa, Homo Sapiens
RKTASFLSL

SEQ ID NO: 882470 - protein, 9 aa, Homo Sapiens
PHMYVSDTT

SEQ ID NO: 882471 - protein, 9 aa, Homo Sapiens
LGGLAVSDA

SEQ ID NO: 882472 - protein, 9 aa, Homo Sapiens
LCTLPNYTK

SEQ ID NO: 882473 - protein, 9 aa, Homo Sapiens
EAYKLLSQA

SEQ ID NO: 882474 - protein, 9 aa, Homo Sapiens
SAACCNYSL

SEQ ID NO: 882475 - protein, 9 aa, Homo Sapiens
VFWLHSSNK

SEQ ID NO: 882476 - protein, 9 aa, Homo Sapiens
KSCRQSTHL

SEQ ID NO: 882477 - protein, 9 aa, Homo Sapiens
CMFSLMCSN

SEQ ID NO: 882478 - protein, 9 aa, Homo Sapiens
MDQNQYALL

SEQ ID NO: 882479 - protein, 9 aa, Homo Sapiens
KHTAKKAPN

SEQ ID NO: 882480 - protein, 9 aa, Homo Sapiens
FCFHTDKTS

SEQ ID NO: 882481 - protein, 9 aa, Homo Sapiens
CLECSLSMW

SEQ ID NO: 882482 - protein, 9 aa, Homo Sapiens
EQQNVLKVL

SEQ ID NO: 882483 - protein, 9 aa, Homo Sapiens
TLDVKINDE

SEQ ID NO: 882484 - protein, 9 aa, Homo Sapiens
RDEKLHKLK

SEQ ID NO: 882485 - protein, 9 aa, Homo Sapiens
RNSRKMAFC

SEQ ID NO: 882486 - protein, 9 aa, Homo Sapiens
ELFCCVLFA

SEQ ID NO: 882487 - protein, 9 aa, Homo Sapiens
SALQTFRVL

SEQ ID NO: 882488 - protein, 9 aa, Homo Sapiens
IDLLIEEIE

SEQ ID NO: 882489 - protein, 9 aa, Homo Sapiens
QKNTSYYEN

SEQ ID NO: 882490 - protein, 9 aa, Homo Sapiens
TDQGPGHQN

SEQ ID NO: 882491 - protein, 9 aa, Homo Sapiens
NLKLFWTLE

SEQ ID NO: 882492 - protein, 9 aa, Homo Sapiens
ADLSGIALG

SEQ ID NO: 882493 - protein, 9 aa, Homo Sapiens
SSAPPLEQR

SEQ ID NO: 882494 - protein, 9 aa, Homo Sapiens
TKVQFLNNL

SEQ ID NO: 882495 - protein, 9 aa, Homo Sapiens
YVWNDLDKR

SEQ ID NO: 882496 - protein, 9 aa, Homo Sapiens
EEAVLELDK

SEQ ID NO: 882497 - protein, 9 aa, Homo Sapiens
LSCQNYSRG

SEQ ID NO: 882498 - protein, 9 aa, Homo Sapiens
NWSHANKPP

SEQ ID NO: 882499 - protein, 9 aa, Homo Sapiens
GIITVKQVY

SEQ ID NO: 882500 - protein, 9 aa, Homo Sapiens
SLLEESLCG

SEQ ID NO: 882501 - protein, 9 aa, Homo Sapiens
PGTLLETFN

SEQ ID NO: 882502 - protein, 9 aa, Homo Sapiens
LGLDFGDKL

SEQ ID NO: 882503 - protein, 9 aa, Homo Sapiens
GFWVILEEL

SEQ ID NO: 882504 - protein, 9 aa, Homo Sapiens
FLSKSQTNV

SEQ ID NO: 882505 - protein, 9 aa, Homo Sapiens
LAKYITSDT

SEQ ID NO: 882506 - protein, 9 aa, Homo Sapiens
KRTELTVGK

SEQ ID NO: 882507 - protein, 9 aa, Homo Sapiens
PPAQTKNTA

SEQ ID NO: 882508 - protein, 9 aa, Homo Sapiens
ASDCLHGNK

SEQ ID NO: 882509 - protein, 9 aa, Homo Sapiens
KDNAMLLKG

SEQ ID NO: 882510 - protein, 9 aa, Homo Sapiens
ITKPRGNEE

SEQ ID NO: 882511 - protein, 9 aa, Homo Sapiens
SCQNYSRGG

SEQ ID NO: 882512 - protein, 9 aa, Homo Sapiens
QKEAAAAEP

SEQ ID NO: 882513 - protein, 9 aa, Homo Sapiens
MVDNVELPP

SEQ ID NO: 882514 - protein, 9 aa, Homo Sapiens
MGVLAFLAP

SEQ ID NO: 882515 - protein, 9 aa, Homo Sapiens
KKSTTLSGP

SEQ ID NO: 882516 - protein, 9 aa, Homo Sapiens
EAENQHNNI

SEQ ID NO: 882517 - protein, 9 aa, Homo Sapiens
RWLKRDSYL

SEQ ID NO: 882518 - protein, 9 aa, Homo Sapiens
VDNVELPPW

SEQ ID NO: 882519 - protein, 9 aa, Homo Sapiens
ITETTVQVI

SEQ ID NO: 882520 - protein, 9 aa, Homo Sapiens
LTADYLAQI

SEQ ID NO: 882521 - protein, 9 aa, Homo Sapiens
RYRAPNHDK

SEQ ID NO: 882522 - protein, 9 aa, Homo Sapiens
LEKEKAFQL

SEQ ID NO: 882523 - protein, 9 aa, Homo Sapiens
WRDRVQWDL

SEQ ID NO: 882524 - protein, 9 aa, Homo Sapiens
GAVPLGLNA

SEQ ID NO: 882525 - protein, 9 aa, Homo Sapiens
DYFSQESSP

SEQ ID NO: 882526 - protein, 9 aa, Homo Sapiens
WLEQRQACE

SEQ ID NO: 882527 - protein, 9 aa, Homo Sapiens
QTHSGLTDG

SEQ ID NO: 882528 - protein, 9 aa, Homo Sapiens
KRDLLIKVG

SEQ ID NO: 882529 - protein, 9 aa, Homo Sapiens
SVSDNEYGQ

SEQ ID NO: 882530 - protein, 9 aa, Homo Sapiens
LEMDTNLQG

SEQ ID NO: 882531 - protein, 9 aa, Homo Sapiens
SLLVVSPIS

SEQ ID NO: 882532 - protein, 9 aa, Homo Sapiens
TAKTSVKPS

SEQ ID NO: 882533 - protein, 9 aa, Homo Sapiens
AAALVLANL

SEQ ID NO: 882534 - protein, 9 aa, Homo Sapiens
RAIKTILRL

SEQ ID NO: 882535 - protein, 9 aa, Homo Sapiens
TLQSRQTRI

SEQ ID NO: 882536 - protein, 9 aa, Homo Sapiens
TDLKEISVV

SEQ ID NO: 882537 - protein, 9 aa, Homo Sapiens
NVIHQLFCD

SEQ ID NO: 882538 - protein, 9 aa, Homo Sapiens
CDADVHLRA

SEQ ID NO: 882539 - protein, 9 aa, Homo Sapiens
EFLQKEQNL

SEQ ID NO: 882540 - protein, 9 aa, Homo Sapiens
CNKQGFINL

SEQ ID NO: 882541 - protein, 9 aa, Homo Sapiens
REITQDFKT

SEQ ID NO: 882542 - protein, 9 aa, Homo Sapiens
FWIQTETPA

SEQ ID NO: 882543 - protein, 9 aa, Homo Sapiens
PTVIQIPAK

SEQ ID NO: 882544 - protein, 9 aa, Homo Sapiens
HKIDLTGIF

SEQ ID NO: 882545 - protein, 9 aa, Homo Sapiens
AFLKAFAAN

SEQ ID NO: 882546 - protein, 9 aa, Homo Sapiens
LSLFRAPKL

SEQ ID NO: 882547 - protein, 9 aa, Homo Sapiens
QDPIISLDT

SEQ ID NO: 882548 - protein, 9 aa, Homo Sapiens
VCLSMRLAF

SEQ ID NO: 882549 - protein, 9 aa, Homo Sapiens
QCQYCRFQK

SEQ ID NO: 882550 - protein, 9 aa, Homo Sapiens
IKTAQPYQP

SEQ ID NO: 882551 - protein, 9 aa, Homo Sapiens
GPRTEPPAE

SEQ ID NO: 882552 - protein, 9 aa, Homo Sapiens
DVDIGENIE

SEQ ID NO: 882553 - protein, 9 aa, Homo Sapiens
SESHKQAQD

SEQ ID NO: 882554 - protein, 9 aa, Homo Sapiens
LGHNNTDVS

SEQ ID NO: 882555 - protein, 9 aa, Homo Sapiens
TVPVKAFPV

SEQ ID NO: 882556 - protein, 9 aa, Homo Sapiens
WNQFSTMSH

SEQ ID NO: 882557 - protein, 9 aa, Homo Sapiens
AFLPVFYTA

SEQ ID NO: 882558 - protein, 9 aa, Homo Sapiens
THLAEKNIP

SEQ ID NO: 882559 - protein, 9 aa, Homo Sapiens
LFQTFTVHQ

SEQ ID NO: 882560 - protein, 9 aa, Homo Sapiens
AVSQTQGKG

SEQ ID NO: 882561 - protein, 9 aa, Homo Sapiens
KVIQDEELY

SEQ ID NO: 882562 - protein, 9 aa, Homo Sapiens
KSKLHKFKI

SEQ ID NO: 882563 - protein, 9 aa, Homo Sapiens
GVKQCGLGA

SEQ ID NO: 882564 - protein, 9 aa, Homo Sapiens
KVAVSITIT

SEQ ID NO: 882565 - protein, 9 aa, Homo Sapiens
HTGRLHMME

SEQ ID NO: 882566 - protein, 9 aa, Homo Sapiens
VVALAITSF

SEQ ID NO: 882567 - protein, 9 aa, Homo Sapiens
WTCPAVGRA

SEQ ID NO: 882568 - protein, 9 aa, Homo Sapiens
TSSSPETPK

SEQ ID NO: 882569 - protein, 9 aa, Homo Sapiens
AIVLRLRRS

SEQ ID NO: 882570 - protein, 9 aa, Homo Sapiens
KPRVIKEAV

SEQ ID NO: 882571 - protein, 9 aa, Homo Sapiens
AMDNDTASE

SEQ ID NO: 882572 - protein, 9 aa, Homo Sapiens
TDFKDKTKS

SEQ ID NO: 882573 - protein, 9 aa, Homo Sapiens
KILYNKFNH

SEQ ID NO: 882574 - protein, 9 aa, Homo Sapiens
EAEEEVKNK

SEQ ID NO: 882575 - protein, 9 aa, Homo Sapiens
SNKWTGETG

SEQ ID NO: 882576 - protein, 9 aa, Homo Sapiens
RNRMHGLNN

SEQ ID NO: 882577 - protein, 9 aa, Homo Sapiens
FRDDNDHSL

SEQ ID NO: 882578 - protein, 9 aa, Homo Sapiens
GWVCQMPGK

SEQ ID NO: 882579 - protein, 9 aa, Homo Sapiens
SGMYTPLTT

SEQ ID NO: 882580 - protein, 9 aa, Homo Sapiens
RRRLNLTQH

SEQ ID NO: 882581 - protein, 9 aa, Homo Sapiens
HHNLHSWHA

SEQ ID NO: 882582 - protein, 9 aa, Homo Sapiens
LCIQNEWGT

SEQ ID NO: 882583 - protein, 9 aa, Homo Sapiens
NPAHAIYLL

SEQ ID NO: 882584 - protein, 9 aa, Homo Sapiens
NERVGNLNQ

SEQ ID NO: 882585 - protein, 9 aa, Homo Sapiens
IVNENLVEC

SEQ ID NO: 882586 - protein, 9 aa, Homo Sapiens
EQDISLQGN

SEQ ID NO: 882587 - protein, 9 aa, Homo Sapiens
GKRLPPFKT

SEQ ID NO: 882588 - protein, 9 aa, Homo Sapiens
QYYQCFDRI

SEQ ID NO: 882589 - protein, 9 aa, Homo Sapiens
NCLLLRFKV

SEQ ID NO: 882590 - protein, 9 aa, Homo Sapiens
VCKGSSTVC

SEQ ID NO: 882591 - protein, 9 aa, Homo Sapiens
HQAIHTGQK

SEQ ID NO: 882592 - protein, 9 aa, Homo Sapiens
KWSVENTGP

SEQ ID NO: 882593 - protein, 9 aa, Homo Sapiens
FEPVYPIKE

SEQ ID NO: 882594 - protein, 9 aa, Homo Sapiens
LPLPPKKTQ

SEQ ID NO: 882595 - protein, 9 aa, Homo Sapiens
HSVMSIQDL

SEQ ID NO: 882596 - protein, 9 aa, Homo Sapiens
HCCQCRPGF

SEQ ID NO: 882597 - protein, 9 aa, Homo Sapiens
SHLQTHGRT

SEQ ID NO: 882598 - protein, 9 aa, Homo Sapiens
QEVKTLNVG

SEQ ID NO: 882599 - protein, 9 aa, Homo Sapiens
TPEPQKKIS

SEQ ID NO: 882600 - protein, 9 aa, Homo Sapiens
QLQALMLQR

SEQ ID NO: 882601 - protein, 9 aa, Homo Sapiens
WLRHEVQDA

SEQ ID NO: 882602 - protein, 9 aa, Homo Sapiens
LTAKFKTPE

SEQ ID NO: 882603 - protein, 9 aa, Homo Sapiens
SLRGSNNVT

SEQ ID NO: 882604 - protein, 9 aa, Homo Sapiens
VLRVPCNVE

SEQ ID NO: 882605 - protein, 9 aa, Homo Sapiens
CNAQELEKC

SEQ ID NO: 882606 - protein, 9 aa, Homo Sapiens
NSHSRREHK

SEQ ID NO: 882607 - protein, 9 aa, Homo Sapiens
AHREALAKH

SEQ ID NO: 882608 - protein, 9 aa, Homo Sapiens
FTKAVVSDN

SEQ ID NO: 882609 - protein, 9 aa, Homo Sapiens
LKGFWVILE

SEQ ID NO: 882610 - protein, 9 aa, Homo Sapiens
HPLLQGWVM

SEQ ID NO: 882611 - protein, 9 aa, Homo Sapiens
LQRCIEKVA

SEQ ID NO: 882612 - protein, 9 aa, Homo Sapiens
LPGVYPLAL

SEQ ID NO: 882613 - protein, 9 aa, Homo Sapiens
ALRDQDKYC

SEQ ID NO: 882614 - protein, 9 aa, Homo Sapiens
KKAIEDRNI

SEQ ID NO: 882615 - protein, 9 aa, Homo Sapiens
QEKRMLKAT

SEQ ID NO: 882616 - protein, 9 aa, Homo Sapiens
SVRDSARPM

SEQ ID NO: 882617 - protein, 9 aa, Homo Sapiens
CLKVKEPIF

SEQ ID NO: 882618 - protein, 9 aa, Homo Sapiens
SWVISQPDQ

SEQ ID NO: 882619 - protein, 9 aa, Homo Sapiens
YRDRRYVDK

SEQ ID NO: 882620 - protein, 9 aa, Homo Sapiens
ALQGCGGDV

SEQ ID NO: 882621 - protein, 9 aa, Homo Sapiens
VILKYLDQR

SEQ ID NO: 882622 - protein, 9 aa, Homo Sapiens
EETGLKVYL

SEQ ID NO: 882623 - protein, 9 aa, Homo Sapiens
VRFLCPPGF

SEQ ID NO: 882624 - protein, 9 aa, Homo Sapiens
ILELACTDT

SEQ ID NO: 882625 - protein, 9 aa, Homo Sapiens
GSGPFSKIV

SEQ ID NO: 882626 - protein, 9 aa, Homo Sapiens
AKNKKEENA

SEQ ID NO: 882627 - protein, 9 aa, Homo Sapiens
KYGINDNDT

SEQ ID NO: 882628 - protein, 9 aa, Homo Sapiens
KEIIGYTHM

SEQ ID NO: 882629 - protein, 9 aa, Homo Sapiens
PPKNCPDDL

SEQ ID NO: 882630 - protein, 9 aa, Homo Sapiens
NLAESLVAD

SEQ ID NO: 882631 - protein, 9 aa, Homo Sapiens
ETEEDNKED

SEQ ID NO: 882632 - protein, 9 aa, Homo Sapiens
SSPCCGGAT

SEQ ID NO: 882633 - protein, 9 aa, Homo Sapiens
LCTLISAAS

SEQ ID NO: 882634 - protein, 9 aa, Homo Sapiens
GVSRCFHNG

SEQ ID NO: 882635 - protein, 9 aa, Homo Sapiens
LTDHDEIEN

SEQ ID NO: 882636 - protein, 9 aa, Homo Sapiens
ALLTDGIII

SEQ ID NO: 882637 - protein, 9 aa, Homo Sapiens
AKVIQEGSD

SEQ ID NO: 882638 - protein, 9 aa, Homo Sapiens
KIVFVERRE

SEQ ID NO: 882639 - protein, 9 aa, Homo Sapiens
SDIGGSIQM

SEQ ID NO: 882640 - protein, 9 aa, Homo Sapiens
LQNSEWLFL

SEQ ID NO: 882641 - protein, 9 aa, Homo Sapiens
NKVVDKSDR

SEQ ID NO: 882642 - protein, 9 aa, Homo Sapiens
DAKSKYVSL

SEQ ID NO: 882643 - protein, 9 aa, Homo Sapiens
VPEARYGNS

SEQ ID NO: 882644 - protein, 9 aa, Homo Sapiens
KFHYKFFCD

SEQ ID NO: 882645 - protein, 9 aa, Homo Sapiens
SKPPSRGGT

SEQ ID NO: 882646 - protein, 9 aa, Homo Sapiens
QEGNVVYKL

SEQ ID NO: 882647 - protein, 9 aa, Homo Sapiens
ALLDRIEII

SEQ ID NO: 882648 - protein, 9 aa, Homo Sapiens
EKLESKIQR

SEQ ID NO: 882649 - protein, 9 aa, Homo Sapiens
VLLSLQTLN

SEQ ID NO: 882650 - protein, 9 aa, Homo Sapiens
DCLCFAILY

SEQ ID NO: 882651 - protein, 9 aa, Homo Sapiens
TGAHWMRQK

SEQ ID NO: 882652 - protein, 9 aa, Homo Sapiens
KDVSQSMTP

SEQ ID NO: 882653 - protein, 9 aa, Homo Sapiens
IQFIGGLLA

SEQ ID NO: 882654 - protein, 9 aa, Homo Sapiens
ETVKKIHPC

SEQ ID NO: 882655 - protein, 9 aa, Homo Sapiens
VGGEVYVEC

SEQ ID NO: 882656 - protein, 9 aa, Homo Sapiens
IQDLQTLCC

SEQ ID NO: 882657 - protein, 9 aa, Homo Sapiens
NHSSHLVMH

SEQ ID NO: 882658 - protein, 9 aa, Homo Sapiens
AKGFRDNFE

SEQ ID NO: 882659 - protein, 9 aa, Homo Sapiens
QHHEIYLSA

SEQ ID NO: 882660 - protein, 9 aa, Homo Sapiens
IELPTIIHE

SEQ ID NO: 882661 - protein, 9 aa, Homo Sapiens
SPRISLSPR

SEQ ID NO: 882662 - protein, 9 aa, Homo Sapiens
GTVSSSDSL

SEQ ID NO: 882663 - protein, 9 aa, Homo Sapiens
VVFLEKAAD

SEQ ID NO: 882664 - protein, 9 aa, Homo Sapiens
LLGLLGHNN

SEQ ID NO: 882665 - protein, 9 aa, Homo Sapiens
SHWEQDISL

SEQ ID NO: 882666 - protein, 9 aa, Homo Sapiens
RHGEITRLT

SEQ ID NO: 882667 - protein, 9 aa, Homo Sapiens
NLKRIMAHK

SEQ ID NO: 882668 - protein, 9 aa, Homo Sapiens
QFLVKDCDA

SEQ ID NO: 882669 - protein, 9 aa, Homo Sapiens
LVDANQHCV

SEQ ID NO: 882670 - protein, 9 aa, Homo Sapiens
NMISIFEPP

SEQ ID NO: 882671 - protein, 9 aa, Homo Sapiens
KPAGPHLPV

SEQ ID NO: 882672 - protein, 9 aa, Homo Sapiens
KSQLQNRLL

SEQ ID NO: 882673 - protein, 9 aa, Homo Sapiens
GLDKIIILY

SEQ ID NO: 882674 - protein, 9 aa, Homo Sapiens
RVCFFFPSL

SEQ ID NO: 882675 - protein, 9 aa, Homo Sapiens
RNFIKNTAP

SEQ ID NO: 882676 - protein, 9 aa, Homo Sapiens
LSISPLLDA

SEQ ID NO: 882677 - protein, 9 aa, Homo Sapiens
VGHGNGTFS

SEQ ID NO: 882678 - protein, 9 aa, Homo Sapiens
RSLSDLASL

SEQ ID NO: 882679 - protein, 9 aa, Homo Sapiens
TYYNAWSLR

SEQ ID NO: 882680 - protein, 9 aa, Homo Sapiens
GGFHSRSSS

SEQ ID NO: 882681 - protein, 9 aa, Homo Sapiens
SFVGRMMQT

SEQ ID NO: 882682 - protein, 9 aa, Homo Sapiens
SGFIKAVFK

SEQ ID NO: 882683 - protein, 9 aa, Homo Sapiens
QNLDEDKQL

SEQ ID NO: 882684 - protein, 9 aa, Homo Sapiens
LPGGKGKCL

SEQ ID NO: 882685 - protein, 9 aa, Homo Sapiens
MNNKVVDKS

SEQ ID NO: 882686 - protein, 9 aa, Homo Sapiens
LPQAWALFP

SEQ ID NO: 882687 - protein, 9 aa, Homo Sapiens
QTLGKQLNV

SEQ ID NO: 882688 - protein, 9 aa, Homo Sapiens
RSLVLCTHK

SEQ ID NO: 882689 - protein, 9 aa, Homo Sapiens
TNVREKRKS

SEQ ID NO: 882690 - protein, 9 aa, Homo Sapiens
DGSTGKTCL

SEQ ID NO: 882691 - protein, 9 aa, Homo Sapiens
QTVKYHTET

SEQ ID NO: 882692 - protein, 9 aa, Homo Sapiens
RLLNRCRQA

SEQ ID NO: 882693 - protein, 9 aa, Homo Sapiens
RDEDYKGAP

SEQ ID NO: 882694 - protein, 9 aa, Homo Sapiens
NMDVLFSFC

SEQ ID NO: 882695 - protein, 9 aa, Homo Sapiens
INKTPKKVK

SEQ ID NO: 882696 - protein, 9 aa, Homo Sapiens
RWDISRTLG

SEQ ID NO: 882697 - protein, 9 aa, Homo Sapiens
SDPTVNAQL

SEQ ID NO: 882698 - protein, 9 aa, Homo Sapiens
FNGEDINTI

SEQ ID NO: 882699 - protein, 9 aa, Homo Sapiens
SPKVKEEQI

SEQ ID NO: 882700 - protein, 9 aa, Homo Sapiens
SSELSLAPE

SEQ ID NO: 882701 - protein, 9 aa, Homo Sapiens
NGSQIEINQ

SEQ ID NO: 882702 - protein, 9 aa, Homo Sapiens
FIFSSDHLI

SEQ ID NO: 882703 - protein, 9 aa, Homo Sapiens
VKPGFPKAI

SEQ ID NO: 882704 - protein, 9 aa, Homo Sapiens
EEAAQRGSE

SEQ ID NO: 882705 - protein, 9 aa, Homo Sapiens
LDKDNQRTF

SEQ ID NO: 882706 - protein, 9 aa, Homo Sapiens
LRLIYWLFI

SEQ ID NO: 882707 - protein, 9 aa, Homo Sapiens
SLQIRLIGT

SEQ ID NO: 882708 - protein, 9 aa, Homo Sapiens
KPEWFWGRD

SEQ ID NO: 882709 - protein, 9 aa, Homo Sapiens
MAFCSITTP

SEQ ID NO: 882710 - protein, 9 aa, Homo Sapiens
VKVKGNLRK

SEQ ID NO: 882711 - protein, 9 aa, Homo Sapiens
RILASYATG

SEQ ID NO: 882712 - protein, 9 aa, Homo Sapiens
MVFGLALAT

SEQ ID NO: 882713 - protein, 9 aa, Homo Sapiens
LRGLFPESY

SEQ ID NO: 882714 - protein, 9 aa, Homo Sapiens
RNCYPPLLE

SEQ ID NO: 882715 - protein, 9 aa, Homo Sapiens
KTHTFNNYR

SEQ ID NO: 882716 - protein, 9 aa, Homo Sapiens
AWVNEIWKV

SEQ ID NO: 882717 - protein, 9 aa, Homo Sapiens
WKYELKIRY

SEQ ID NO: 882718 - protein, 9 aa, Homo Sapiens
TLRLGKAHE

SEQ ID NO: 882719 - protein, 9 aa, Homo Sapiens
IVVCSVFLM

SEQ ID NO: 882720 - protein, 9 aa, Homo Sapiens
IRNIFLKQL

SEQ ID NO: 882721 - protein, 9 aa, Homo Sapiens
LISLVLRQS

SEQ ID NO: 882722 - protein, 9 aa, Homo Sapiens
EDNTQSVGI

SEQ ID NO: 882723 - protein, 9 aa, Homo Sapiens
RNKWIHCFE

SEQ ID NO: 882724 - protein, 9 aa, Homo Sapiens
EAAPEICCT

SEQ ID NO: 882725 - protein, 9 aa, Homo Sapiens
LPEEILELL

SEQ ID NO: 882726 - protein, 9 aa, Homo Sapiens
SERRIKRLC

SEQ ID NO: 882727 - protein, 9 aa, Homo Sapiens
NPSICAITL

SEQ ID NO: 882728 - protein, 9 aa, Homo Sapiens
QTFSEPGDH

SEQ ID NO: 882729 - protein, 9 aa, Homo Sapiens
SCKGMQCAA

SEQ ID NO: 882730 - protein, 9 aa, Homo Sapiens
KRLESLGTL

SEQ ID NO: 882731 - protein, 9 aa, Homo Sapiens
KPTVIQIPA

SEQ ID NO: 882732 - protein, 9 aa, Homo Sapiens
QARTEIEKM

SEQ ID NO: 882733 - protein, 9 aa, Homo Sapiens
LCQFHLHWG

SEQ ID NO: 882734 - protein, 9 aa, Homo Sapiens
ARVCKLQSG

SEQ ID NO: 882735 - protein, 9 aa, Homo Sapiens
ICLVRQRTG

SEQ ID NO: 882736 - protein, 9 aa, Homo Sapiens
ILSLFRAPK

SEQ ID NO: 882737 - protein, 9 aa, Homo Sapiens
AGTSDKREK

SEQ ID NO: 882738 - protein, 9 aa, Homo Sapiens
RPCNVTFRL

SEQ ID NO: 882739 - protein, 9 aa, Homo Sapiens
ASLPPTNKQ

SEQ ID NO: 882740 - protein, 9 aa, Homo Sapiens
KMRSSGWKS

SEQ ID NO: 882741 - protein, 9 aa, Homo Sapiens
KNIPPKEFH

SEQ ID NO: 882742 - protein, 9 aa, Homo Sapiens
MNIELIRNT

SEQ ID NO: 882743 - protein, 9 aa, Homo Sapiens
RAQELVAKL

SEQ ID NO: 882744 - protein, 9 aa, Homo Sapiens
EEEATAAAA

SEQ ID NO: 882745 - protein, 9 aa, Homo Sapiens
QKYDIDDKN

SEQ ID NO: 882746 - protein, 9 aa, Homo Sapiens
LANTQLVLE

SEQ ID NO: 882747 - protein, 9 aa, Homo Sapiens
PRNLKAYYA

SEQ ID NO: 882748 - protein, 9 aa, Homo Sapiens
GSITALGGA

SEQ ID NO: 882749 - protein, 9 aa, Homo Sapiens
LAVGDIADV

SEQ ID NO: 882750 - protein, 9 aa, Homo Sapiens
PKARCLIHS

SEQ ID NO: 882751 - protein, 9 aa, Homo Sapiens
CIHLEIKQL

SEQ ID NO: 882752 - protein, 9 aa, Homo Sapiens
HEPKKNAIC

SEQ ID NO: 882753 - protein, 9 aa, Homo Sapiens
LIKNGEQQD

SEQ ID NO: 882754 - protein, 9 aa, Homo Sapiens
ECQLAVVDG

SEQ ID NO: 882755 - protein, 9 aa, Homo Sapiens
LMRTCECLV

SEQ ID NO: 882756 - protein, 9 aa, Homo Sapiens
TSYYEISVD

SEQ ID NO: 882757 - protein, 9 aa, Homo Sapiens
DICENFQDL

SEQ ID NO: 882758 - protein, 9 aa, Homo Sapiens
ARRLQNHMA

SEQ ID NO: 882759 - protein, 9 aa, Homo Sapiens
FILALYDRQ

SEQ ID NO: 882760 - protein, 9 aa, Homo Sapiens
DIEALRPSN

SEQ ID NO: 882761 - protein, 9 aa, Homo Sapiens
HVSKRGTIY

SEQ ID NO: 882762 - protein, 9 aa, Homo Sapiens
VTHILSVRD

SEQ ID NO: 882763 - protein, 9 aa, Homo Sapiens
FSRHLVDLS

SEQ ID NO: 882764 - protein, 9 aa, Homo Sapiens
FDQFGTIRT

SEQ ID NO: 882765 - protein, 9 aa, Homo Sapiens
KATVYEVMY

SEQ ID NO: 882766 - protein, 9 aa, Homo Sapiens
KNKNDPEKK

SEQ ID NO: 882767 - protein, 9 aa, Homo Sapiens
DIAKYMPTE

SEQ ID NO: 882768 - protein, 9 aa, Homo Sapiens
EQKTLSPQT

SEQ ID NO: 882769 - protein, 9 aa, Homo Sapiens
RRLLETLNA

SEQ ID NO: 882770 - protein, 9 aa, Homo Sapiens
LPVWEPNDP

SEQ ID NO: 882771 - protein, 9 aa, Homo Sapiens
LTLLLGMGI

SEQ ID NO: 882772 - protein, 9 aa, Homo Sapiens
VHSRTPQEM

SEQ ID NO: 882773 - protein, 9 aa, Homo Sapiens
AKSKVSVDD

SEQ ID NO: 882774 - protein, 9 aa, Homo Sapiens
LDTSNVTYN

SEQ ID NO: 882775 - protein, 9 aa, Homo Sapiens
QRMMSSVAP

SEQ ID NO: 882776 - protein, 9 aa, Homo Sapiens
DNTSAEWLK

SEQ ID NO: 882777 - protein, 9 aa, Homo Sapiens
WGDGGRETS

SEQ ID NO: 882778 - protein, 9 aa, Homo Sapiens
VNKIWDLWR

SEQ ID NO: 882779 - protein, 9 aa, Homo Sapiens
KENSRDDSG

SEQ ID NO: 882780 - protein, 9 aa, Homo Sapiens
YPQPLNIIE

SEQ ID NO: 882781 - protein, 9 aa, Homo Sapiens
ASSAAPLLF

SEQ ID NO: 882782 - protein, 9 aa, Homo Sapiens
SLALPRRPH

SEQ ID NO: 882783 - protein, 9 aa, Homo Sapiens
NTQGFLYAG

SEQ ID NO: 882784 - protein, 9 aa, Homo Sapiens
MKMATNIYL

SEQ ID NO: 882785 - protein, 9 aa, Homo Sapiens
ALEKAQTYL

SEQ ID NO: 882786 - protein, 9 aa, Homo Sapiens
TIEFPNLDN

SEQ ID NO: 882787 - protein, 9 aa, Homo Sapiens
LRISPSLPP

SEQ ID NO: 882788 - protein, 9 aa, Homo Sapiens
ESPYMNGRY

SEQ ID NO: 882789 - protein, 9 aa, Homo Sapiens
GMKLLHGEF

SEQ ID NO: 882790 - protein, 9 aa, Homo Sapiens
QNTRNHFEG

SEQ ID NO: 882791 - protein, 9 aa, Homo Sapiens
ENEDLNWII

SEQ ID NO: 882792 - protein, 9 aa, Homo Sapiens
NLDNTSAEW

SEQ ID NO: 882793 - protein, 9 aa, Homo Sapiens
KVIDVKPFL

SEQ ID NO: 882794 - protein, 9 aa, Homo Sapiens
EREQRELEK

SEQ ID NO: 882795 - protein, 9 aa, Homo Sapiens
IRQDGNQFY

SEQ ID NO: 882796 - protein, 9 aa, Homo Sapiens
RFGKMEGNP

SEQ ID NO: 882797 - protein, 9 aa, Homo Sapiens
KSVNYKTGP

SEQ ID NO: 882798 - protein, 9 aa, Homo Sapiens
QCSWQEDAY

SEQ ID NO: 882799 - protein, 9 aa, Homo Sapiens
SQGENPKGK

SEQ ID NO: 882800 - protein, 9 aa, Homo Sapiens
SLIIHKIIH

SEQ ID NO: 882801 - protein, 9 aa, Homo Sapiens
KSQEENPEE

SEQ ID NO: 882802 - protein, 9 aa, Homo Sapiens
CQMICINQQ

SEQ ID NO: 882803 - protein, 9 aa, Homo Sapiens
IPMKKAQND

SEQ ID NO: 882804 - protein, 9 aa, Homo Sapiens
LKFAFADTP

SEQ ID NO: 882805 - protein, 9 aa, Homo Sapiens
TSGSSKLEK

SEQ ID NO: 882806 - protein, 9 aa, Homo Sapiens
TTVQVISSG

SEQ ID NO: 882807 - protein, 9 aa, Homo Sapiens
QSNSALILE

SEQ ID NO: 882808 - protein, 9 aa, Homo Sapiens
LGIHLIQRK

SEQ ID NO: 882809 - protein, 9 aa, Homo Sapiens
RPKRQTRKS

SEQ ID NO: 882810 - protein, 9 aa, Homo Sapiens
TWFFINLIA

SEQ ID NO: 882811 - protein, 9 aa, Homo Sapiens
LSISKDDLI

SEQ ID NO: 882812 - protein, 9 aa, Homo Sapiens
KQFLDTNET

SEQ ID NO: 882813 - protein, 9 aa, Homo Sapiens
TIPEELGHL

SEQ ID NO: 882814 - protein, 9 aa, Homo Sapiens
KCAASGDGN

SEQ ID NO: 882815 - protein, 9 aa, Homo Sapiens
KRSHTRERP

SEQ ID NO: 882816 - protein, 9 aa, Homo Sapiens
LGLLYLQLD

SEQ ID NO: 882817 - protein, 9 aa, Homo Sapiens
AFAKAIGDA

SEQ ID NO: 882818 - protein, 9 aa, Homo Sapiens
NRTGTEHLW

SEQ ID NO: 882819 - protein, 9 aa, Homo Sapiens
GNWLQYVNW

SEQ ID NO: 882820 - protein, 9 aa, Homo Sapiens
PNPEEVKMP

SEQ ID NO: 882821 - protein, 9 aa, Homo Sapiens
EKGSAKVAE

SEQ ID NO: 882822 - protein, 9 aa, Homo Sapiens
VALITAVAC

SEQ ID NO: 882823 - protein, 9 aa, Homo Sapiens
AIDCREPYV

SEQ ID NO: 882824 - protein, 9 aa, Homo Sapiens
AATEILLCS

SEQ ID NO: 882825 - protein, 9 aa, Homo Sapiens
GVQNYKLIK

SEQ ID NO: 882826 - protein, 9 aa, Homo Sapiens
WEQFLELVS

SEQ ID NO: 882827 - protein, 9 aa, Homo Sapiens
EGKEIHRAL

SEQ ID NO: 882828 - protein, 9 aa, Homo Sapiens
QTQEQRTQI

SEQ ID NO: 882829 - protein, 9 aa, Homo Sapiens
GILYIRLST

SEQ ID NO: 882830 - protein, 9 aa, Homo Sapiens
SVSGMSLSD

SEQ ID NO: 882831 - protein, 9 aa, Homo Sapiens
WSLKVEYKR

SEQ ID NO: 882832 - protein, 9 aa, Homo Sapiens
LLSALNTAG

SEQ ID NO: 882833 - protein, 9 aa, Homo Sapiens
DLDQDGRTS

SEQ ID NO: 882834 - protein, 9 aa, Homo Sapiens
PSVCSCFQQ

SEQ ID NO: 882835 - protein, 9 aa, Homo Sapiens
VFIYDEKVF

SEQ ID NO: 882836 - protein, 9 aa, Homo Sapiens
SGSNSSQPQ

SEQ ID NO: 882837 - protein, 9 aa, Homo Sapiens
EQTVRCCGR

SEQ ID NO: 882838 - protein, 9 aa, Homo Sapiens
CEGLEKMER

SEQ ID NO: 882839 - protein, 9 aa, Homo Sapiens
IFLKQLDQQ

SEQ ID NO: 882840 - protein, 9 aa, Homo Sapiens
KLTWYLTSV

SEQ ID NO: 882841 - protein, 9 aa, Homo Sapiens
MQELMLRHK

SEQ ID NO: 882842 - protein, 9 aa, Homo Sapiens
GKGFNLPNS

SEQ ID NO: 882843 - protein, 9 aa, Homo Sapiens
ELEKEATGY

SEQ ID NO: 882844 - protein, 9 aa, Homo Sapiens
YVQERKNLI

SEQ ID NO: 882845 - protein, 9 aa, Homo Sapiens
SFNHSSHLV

SEQ ID NO: 882846 - protein, 9 aa, Homo Sapiens
LLTDIFLCY

SEQ ID NO: 882847 - protein, 9 aa, Homo Sapiens
NMDDDHLSR

SEQ ID NO: 882848 - protein, 9 aa, Homo Sapiens
QYDIVQKNT

SEQ ID NO: 882849 - protein, 9 aa, Homo Sapiens
KDYFSQESS

SEQ ID NO: 882850 - protein, 9 aa, Homo Sapiens
VREQLAKNL

SEQ ID NO: 882851 - protein, 9 aa, Homo Sapiens
AQACLDETA

SEQ ID NO: 882852 - protein, 9 aa, Homo Sapiens
RSCNKEGSK

SEQ ID NO: 882853 - protein, 9 aa, Homo Sapiens
YSDSAVINC

SEQ ID NO: 882854 - protein, 9 aa, Homo Sapiens
VNLDSLGLS

SEQ ID NO: 882855 - protein, 9 aa, Homo Sapiens
NGIPMKKAQ

SEQ ID NO: 882856 - protein, 9 aa, Homo Sapiens
MIGHLPYKD

SEQ ID NO: 882857 - protein, 9 aa, Homo Sapiens
TQGAPHPPS

SEQ ID NO: 882858 - protein, 9 aa, Homo Sapiens
LGSTGEQIC

SEQ ID NO: 882859 - protein, 9 aa, Homo Sapiens
PVLPKKLKK

SEQ ID NO: 882860 - protein, 9 aa, Homo Sapiens
HYDINKSLV

SEQ ID NO: 882861 - protein, 9 aa, Homo Sapiens
LLQTLAYIP

SEQ ID NO: 882862 - protein, 9 aa, Homo Sapiens
QEKKSQEEI

SEQ ID NO: 882863 - protein, 9 aa, Homo Sapiens
IQSCRCKGI

SEQ ID NO: 882864 - protein, 9 aa, Homo Sapiens
QVKNFEEYF

SEQ ID NO: 882865 - protein, 9 aa, Homo Sapiens
RIGQNNFKK

SEQ ID NO: 882866 - protein, 9 aa, Homo Sapiens
GTIEEVCYF

SEQ ID NO: 882867 - protein, 9 aa, Homo Sapiens
EAHTAWCGF

SEQ ID NO: 882868 - protein, 9 aa, Homo Sapiens
EEACIISPH

SEQ ID NO: 882869 - protein, 9 aa, Homo Sapiens
ILRQKFLSE

SEQ ID NO: 882870 - protein, 9 aa, Homo Sapiens
FNEFVDMDF

SEQ ID NO: 882871 - protein, 9 aa, Homo Sapiens
GTGLVGVAC

SEQ ID NO: 882872 - protein, 9 aa, Homo Sapiens
VTESGTFHI

SEQ ID NO: 882873 - protein, 9 aa, Homo Sapiens
QLPVAYQGN

SEQ ID NO: 882874 - protein, 9 aa, Homo Sapiens
KPQNTSRLP

SEQ ID NO: 882875 - protein, 9 aa, Homo Sapiens
KHALPVSGR

SEQ ID NO: 882876 - protein, 9 aa, Homo Sapiens
REGCAAQGG

SEQ ID NO: 882877 - protein, 9 aa, Homo Sapiens
SSDCQDSRS

SEQ ID NO: 882878 - protein, 9 aa, Homo Sapiens
TAAAATKVS

SEQ ID NO: 882879 - protein, 9 aa, Homo Sapiens
TTTPGAQPE

SEQ ID NO: 882880 - protein, 9 aa, Homo Sapiens
DVLIVDLDE

SEQ ID NO: 882881 - protein, 9 aa, Homo Sapiens
HLNEMERTQ

SEQ ID NO: 882882 - protein, 9 aa, Homo Sapiens
CSLMESLPG

SEQ ID NO: 882883 - protein, 9 aa, Homo Sapiens
YRNHICNLF

SEQ ID NO: 882884 - protein, 9 aa, Homo Sapiens
AEESEICYS

SEQ ID NO: 882885 - protein, 9 aa, Homo Sapiens
CQNYSRGGV

SEQ ID NO: 882886 - protein, 9 aa, Homo Sapiens
DGSGLQMGL

SEQ ID NO: 882887 - protein, 9 aa, Homo Sapiens
YLVHGGPSP

SEQ ID NO: 882888 - protein, 9 aa, Homo Sapiens
WHQQDWTIL

SEQ ID NO: 882889 - protein, 9 aa, Homo Sapiens
TNASFNTFF

SEQ ID NO: 882890 - protein, 9 aa, Homo Sapiens
IGKMLNSDK

SEQ ID NO: 882891 - protein, 9 aa, Homo Sapiens
DQFGTIRTI

SEQ ID NO: 882892 - protein, 9 aa, Homo Sapiens
VQPITSSTL

SEQ ID NO: 882893 - protein, 9 aa, Homo Sapiens
SYYGERHLD

SEQ ID NO: 882894 - protein, 9 aa, Homo Sapiens
ETNQVLNSN

SEQ ID NO: 882895 - protein, 9 aa, Homo Sapiens
PILSSQLRY

SEQ ID NO: 882896 - protein, 9 aa, Homo Sapiens
KAKIMAKKI

SEQ ID NO: 882897 - protein, 9 aa, Homo Sapiens
AESSSKSDH

SEQ ID NO: 882898 - protein, 9 aa, Homo Sapiens
RSKIPLQEQ

SEQ ID NO: 882899 - protein, 9 aa, Homo Sapiens
MCKRNQVVF

SEQ ID NO: 882900 - protein, 9 aa, Homo Sapiens
CSKSFFMLL

SEQ ID NO: 882901 - protein, 9 aa, Homo Sapiens
LCAKEDKCQ

SEQ ID NO: 882902 - protein, 9 aa, Homo Sapiens
LVVHQQTHT

SEQ ID NO: 882903 - protein, 9 aa, Homo Sapiens
YNRVQRKQF

SEQ ID NO: 882904 - protein, 9 aa, Homo Sapiens
APQYQSMRR

SEQ ID NO: 882905 - protein, 9 aa, Homo Sapiens
DAKEQGAVA

SEQ ID NO: 882906 - protein, 9 aa, Homo Sapiens
KVVEESLPY

SEQ ID NO: 882907 - protein, 9 aa, Homo Sapiens
IFATAFNTN

SEQ ID NO: 882908 - protein, 9 aa, Homo Sapiens
TNGLCIWLL

SEQ ID NO: 882909 - protein, 9 aa, Homo Sapiens
LIDLCLTVE

SEQ ID NO: 882910 - protein, 9 aa, Homo Sapiens
SPLPKEVNY

SEQ ID NO: 882911 - protein, 9 aa, Homo Sapiens
FRAGNNSWW

SEQ ID NO: 882912 - protein, 9 aa, Homo Sapiens
DSEDVFDII

SEQ ID NO: 882913 - protein, 9 aa, Homo Sapiens
QHLQVHTGE

SEQ ID NO: 882914 - protein, 9 aa, Homo Sapiens
LHSERPPIF

SEQ ID NO: 882915 - protein, 9 aa, Homo Sapiens
KDHYAYRDS

SEQ ID NO: 882916 - protein, 9 aa, Homo Sapiens
CWPFSDECI

SEQ ID NO: 882917 - protein, 9 aa, Homo Sapiens
VLAKSKCPQ

SEQ ID NO: 882918 - protein, 9 aa, Homo Sapiens
FRRYSCSLH

SEQ ID NO: 882919 - protein, 9 aa, Homo Sapiens
LSWNQFSTM

SEQ ID NO: 882920 - protein, 9 aa, Homo Sapiens
EWQKSRTEG

SEQ ID NO: 882921 - protein, 9 aa, Homo Sapiens
CPLPGSEFF

SEQ ID NO: 882922 - protein, 9 aa, Homo Sapiens
RGINCNEKP

SEQ ID NO: 882923 - protein, 9 aa, Homo Sapiens
TRPSHLFQH

SEQ ID NO: 882924 - protein, 9 aa, Homo Sapiens
QPYWWVQET

SEQ ID NO: 882925 - protein, 9 aa, Homo Sapiens
RADSAACCN

SEQ ID NO: 882926 - protein, 9 aa, Homo Sapiens
LASSDLPAL

SEQ ID NO: 882927 - protein, 9 aa, Homo Sapiens
TENCVEFHK

SEQ ID NO: 882928 - protein, 9 aa, Homo Sapiens
EWLKPELFQ

SEQ ID NO: 882929 - protein, 9 aa, Homo Sapiens
TGLGVIHMW

SEQ ID NO: 882930 - protein, 9 aa, Homo Sapiens
ELDGDNKYY

SEQ ID NO: 882931 - protein, 9 aa, Homo Sapiens
LKRHTAAAA

SEQ ID NO: 882932 - protein, 9 aa, Homo Sapiens
SKYKFWNHI

SEQ ID NO: 882933 - protein, 9 aa, Homo Sapiens
NNKYLAKGG

SEQ ID NO: 882934 - protein, 9 aa, Homo Sapiens
RLCHNPKLQ

SEQ ID NO: 882935 - protein, 9 aa, Homo Sapiens
KDKMKPQEV

SEQ ID NO: 882936 - protein, 9 aa, Homo Sapiens
MTNLYHYIT

SEQ ID NO: 882937 - protein, 9 aa, Homo Sapiens
GETLSQIQN

SEQ ID NO: 882938 - protein, 9 aa, Homo Sapiens
LDASLDLQT

SEQ ID NO: 882939 - protein, 9 aa, Homo Sapiens
GDSENGGTE

SEQ ID NO: 882940 - protein, 9 aa, Homo Sapiens
ACHATHTRD

SEQ ID NO: 882941 - protein, 9 aa, Homo Sapiens
QELFVDIGP

SEQ ID NO: 882942 - protein, 9 aa, Homo Sapiens
FCTCATVLE

SEQ ID NO: 882943 - protein, 9 aa, Homo Sapiens
SIRADNIIS

SEQ ID NO: 882944 - protein, 9 aa, Homo Sapiens
QKKLQLALQ

SEQ ID NO: 882945 - protein, 9 aa, Homo Sapiens
LLYVNTDIL

SEQ ID NO: 882946 - protein, 9 aa, Homo Sapiens
TVSLNTRHM

SEQ ID NO: 882947 - protein, 9 aa, Homo Sapiens
SSSAPPLEQ

SEQ ID NO: 882948 - protein, 9 aa, Homo Sapiens
DLNTTSRQQ

SEQ ID NO: 882949 - protein, 9 aa, Homo Sapiens
LGRAVSPKF

SEQ ID NO: 882950 - protein, 9 aa, Homo Sapiens
TKSKITATT

SEQ ID NO: 882951 - protein, 9 aa, Homo Sapiens
LLQTFQAFI

SEQ ID NO: 882952 - protein, 9 aa, Homo Sapiens
TYWELQKDP

SEQ ID NO: 882953 - protein, 9 aa, Homo Sapiens
SCRQLPPVP

SEQ ID NO: 882954 - protein, 9 aa, Homo Sapiens
QSQTVGILI

SEQ ID NO: 882955 - protein, 9 aa, Homo Sapiens
SLSMINDAV

SEQ ID NO: 882956 - protein, 9 aa, Homo Sapiens
KKTPAKSVK

SEQ ID NO: 882957 - protein, 9 aa, Homo Sapiens
GIIKRNEKR

SEQ ID NO: 882958 - protein, 9 aa, Homo Sapiens
VIGVLLLLC

SEQ ID NO: 882959 - protein, 9 aa, Homo Sapiens
YRYNLKSKY

SEQ ID NO: 882960 - protein, 9 aa, Homo Sapiens
YKVSQKEKR

SEQ ID NO: 882961 - protein, 9 aa, Homo Sapiens
IHNYNITTV

SEQ ID NO: 882962 - protein, 9 aa, Homo Sapiens
KSKGEHVPG

SEQ ID NO: 882963 - protein, 9 aa, Homo Sapiens
EMIETKCFK

SEQ ID NO: 882964 - protein, 9 aa, Homo Sapiens
HFTPEDHWL

SEQ ID NO: 882965 - protein, 9 aa, Homo Sapiens
CVLNLWQKN

SEQ ID NO: 882966 - protein, 9 aa, Homo Sapiens
FIKAVFKHE

SEQ ID NO: 882967 - protein, 9 aa, Homo Sapiens
KKNGDRGEN

SEQ ID NO: 882968 - protein, 9 aa, Homo Sapiens
YKYFYICVN

SEQ ID NO: 882969 - protein, 9 aa, Homo Sapiens
LQVLHMMVG

SEQ ID NO: 882970 - protein, 9 aa, Homo Sapiens
ADFIHRVLS

SEQ ID NO: 882971 - protein, 9 aa, Homo Sapiens
KEQMETIQH

SEQ ID NO: 882972 - protein, 9 aa, Homo Sapiens
TVRMRRKNR

SEQ ID NO: 882973 - protein, 9 aa, Homo Sapiens
FKPSFIHPP

SEQ ID NO: 882974 - protein, 9 aa, Homo Sapiens
PRVPTCVLH

SEQ ID NO: 882975 - protein, 9 aa, Homo Sapiens
IQKVEGVEP

SEQ ID NO: 882976 - protein, 9 aa, Homo Sapiens
SFDSNYFGP

SEQ ID NO: 882977 - protein, 9 aa, Homo Sapiens
TESEPDDFN

SEQ ID NO: 882978 - protein, 9 aa, Homo Sapiens
LCEAREQNK

SEQ ID NO: 882979 - protein, 9 aa, Homo Sapiens
DLGAMPYVC

SEQ ID NO: 882980 - protein, 9 aa, Homo Sapiens
HRMTKVHRS

SEQ ID NO: 882981 - protein, 9 aa, Homo Sapiens
YTGMKEQKL

SEQ ID NO: 882982 - protein, 9 aa, Homo Sapiens
IISHYEGEK

SEQ ID NO: 882983 - protein, 9 aa, Homo Sapiens
ECISHSYAE

SEQ ID NO: 882984 - protein, 9 aa, Homo Sapiens
SSIFLPQMN

SEQ ID NO: 882985 - protein, 9 aa, Homo Sapiens
PEELNRVQL

SEQ ID NO: 882986 - protein, 9 aa, Homo Sapiens
EGEEEKVVK

SEQ ID NO: 882987 - protein, 9 aa, Homo Sapiens
KLFCWSTNL

SEQ ID NO: 882988 - protein, 9 aa, Homo Sapiens
PAIQHKRTV

SEQ ID NO: 882989 - protein, 9 aa, Homo Sapiens
VEAQERGLV

SEQ ID NO: 882990 - protein, 9 aa, Homo Sapiens
DPDNFLLLG

SEQ ID NO: 882991 - protein, 9 aa, Homo Sapiens
MLFDEPTSG

SEQ ID NO: 882992 - protein, 9 aa, Homo Sapiens
VPSDVMSFN

SEQ ID NO: 882993 - protein, 9 aa, Homo Sapiens
YARGIDPPP

SEQ ID NO: 882994 - protein, 9 aa, Homo Sapiens
TEDDSERDP

SEQ ID NO: 882995 - protein, 9 aa, Homo Sapiens
EEFFKLARQ

SEQ ID NO: 882996 - protein, 9 aa, Homo Sapiens
EKKWELICG

SEQ ID NO: 882997 - protein, 9 aa, Homo Sapiens
ISLALISNK

SEQ ID NO: 882998 - protein, 9 aa, Homo Sapiens
LQDKYNSWH

SEQ ID NO: 882999 - protein, 9 aa, Homo Sapiens
KYLATLDTL

SEQ ID NO: 883000 - protein, 9 aa, Homo Sapiens
EKQLMKEKK

SEQ ID NO: 883001 - protein, 9 aa, Homo Sapiens
GKGGPQGNS

SEQ ID NO: 883002 - protein, 9 aa, Homo Sapiens
FINLPEFPF

SEQ ID NO: 883003 - protein, 9 aa, Homo Sapiens
RSQSILDYL

SEQ ID NO: 883004 - protein, 9 aa, Homo Sapiens
IVLDDDDKD

SEQ ID NO: 883005 - protein, 9 aa, Homo Sapiens
VSRVVYSTR

SEQ ID NO: 883006 - protein, 9 aa, Homo Sapiens
KKCHQCVKT

SEQ ID NO: 883007 - protein, 9 aa, Homo Sapiens
PLTLFRGAE

SEQ ID NO: 883008 - protein, 9 aa, Homo Sapiens
AENQHFDGF

SEQ ID NO: 883009 - protein, 9 aa, Homo Sapiens
ADIAVKLLQ

SEQ ID NO: 883010 - protein, 9 aa, Homo Sapiens
SPSAWQMAY

SEQ ID NO: 883011 - protein, 9 aa, Homo Sapiens
IFSSREERL

SEQ ID NO: 883012 - protein, 9 aa, Homo Sapiens
QNQVRKELQ

SEQ ID NO: 883013 - protein, 9 aa, Homo Sapiens
VLALEAEIQ

SEQ ID NO: 883014 - protein, 9 aa, Homo Sapiens
QQEYETKLK

SEQ ID NO: 883015 - protein, 9 aa, Homo Sapiens
LCMYDDRNH

SEQ ID NO: 883016 - protein, 9 aa, Homo Sapiens
KKYLEEAEK

SEQ ID NO: 883017 - protein, 9 aa, Homo Sapiens
SSNLTTHKN

SEQ ID NO: 883018 - protein, 9 aa, Homo Sapiens
SKPSQQGQY

SEQ ID NO: 883019 - protein, 9 aa, Homo Sapiens
KSYNPDKLT

SEQ ID NO: 883020 - protein, 9 aa, Homo Sapiens
SRSDMEKWV

SEQ ID NO: 883021 - protein, 9 aa, Homo Sapiens
QQKPRVNKS

SEQ ID NO: 883022 - protein, 9 aa, Homo Sapiens
FLEDKSILG

SEQ ID NO: 883023 - protein, 9 aa, Homo Sapiens
LSRIKLTGK

SEQ ID NO: 883024 - protein, 9 aa, Homo Sapiens
TNIAKYQEN

SEQ ID NO: 883025 - protein, 9 aa, Homo Sapiens
AQLKDTKRN

SEQ ID NO: 883026 - protein, 9 aa, Homo Sapiens
SDKLSKSLW

SEQ ID NO: 883027 - protein, 9 aa, Homo Sapiens
ALLDNSCRK

SEQ ID NO: 883028 - protein, 9 aa, Homo Sapiens
LRPQNGNTY

SEQ ID NO: 883029 - protein, 9 aa, Homo Sapiens
FQPVWVTGE

SEQ ID NO: 883030 - protein, 9 aa, Homo Sapiens
PESLIPVQL

SEQ ID NO: 883031 - protein, 9 aa, Homo Sapiens
FTVRDNQDN

SEQ ID NO: 883032 - protein, 9 aa, Homo Sapiens
CATDMRPLE

SEQ ID NO: 883033 - protein, 9 aa, Homo Sapiens
HIDEPILLP

SEQ ID NO: 883034 - protein, 9 aa, Homo Sapiens
QMLGFNPRW

SEQ ID NO: 883035 - protein, 9 aa, Homo Sapiens
ALVDGPAEE

SEQ ID NO: 883036 - protein, 9 aa, Homo Sapiens
IVMGSGQVV

SEQ ID NO: 883037 - protein, 9 aa, Homo Sapiens
CNAVWSYYE

SEQ ID NO: 883038 - protein, 9 aa, Homo Sapiens
LFVDIQLPD

SEQ ID NO: 883039 - protein, 9 aa, Homo Sapiens
FCITNIEFL

SEQ ID NO: 883040 - protein, 9 aa, Homo Sapiens
RLNCNKYMV

SEQ ID NO: 883041 - protein, 9 aa, Homo Sapiens
LSDGVTKSH

SEQ ID NO: 883042 - protein, 9 aa, Homo Sapiens
ERICKLSMK

SEQ ID NO: 883043 - protein, 9 aa, Homo Sapiens
KILCTKTEN

SEQ ID NO: 883044 - protein, 9 aa, Homo Sapiens
HGHSFDSNY

SEQ ID NO: 883045 - protein, 9 aa, Homo Sapiens
LLIHTGFDW

SEQ ID NO: 883046 - protein, 9 aa, Homo Sapiens
SHLQIHTGE

SEQ ID NO: 883047 - protein, 9 aa, Homo Sapiens
EKDTMTTFE

SEQ ID NO: 883048 - protein, 9 aa, Homo Sapiens
AKADILRSQ

SEQ ID NO: 883049 - protein, 9 aa, Homo Sapiens
CRVSFADPI

SEQ ID NO: 883050 - protein, 9 aa, Homo Sapiens
HIVLDSVRQ

SEQ ID NO: 883051 - protein, 9 aa, Homo Sapiens
NQILIFGAH

SEQ ID NO: 883052 - protein, 9 aa, Homo Sapiens
VINTLKSTA

SEQ ID NO: 883053 - protein, 9 aa, Homo Sapiens
ASTGPPWES

SEQ ID NO: 883054 - protein, 9 aa, Homo Sapiens
EKNKNYLIE

SEQ ID NO: 883055 - protein, 9 aa, Homo Sapiens
FDVKYINKG

SEQ ID NO: 883056 - protein, 9 aa, Homo Sapiens
TPSYVKKKK

SEQ ID NO: 883057 - protein, 9 aa, Homo Sapiens
SKMSFKDIK

SEQ ID NO: 883058 - protein, 9 aa, Homo Sapiens
IMLALRMLQ

SEQ ID NO: 883059 - protein, 9 aa, Homo Sapiens
AMKMAHYPP

SEQ ID NO: 883060 - protein, 9 aa, Homo Sapiens
DCVFENEDN

SEQ ID NO: 883061 - protein, 9 aa, Homo Sapiens
APEICCTVS

SEQ ID NO: 883062 - protein, 9 aa, Homo Sapiens
CVCCPCCAW

SEQ ID NO: 883063 - protein, 9 aa, Homo Sapiens
ITALDGGNP

SEQ ID NO: 883064 - protein, 9 aa, Homo Sapiens
SLISKAVYT

SEQ ID NO: 883065 - protein, 9 aa, Homo Sapiens
KGLKKDYFS

SEQ ID NO: 883066 - protein, 9 aa, Homo Sapiens
MEPLGSEQL

SEQ ID NO: 883067 - protein, 9 aa, Homo Sapiens
HSELLEEVK

SEQ ID NO: 883068 - protein, 9 aa, Homo Sapiens
GPMSAAFPY

SEQ ID NO: 883069 - protein, 9 aa, Homo Sapiens
YRKQEWIKE

SEQ ID NO: 883070 - protein, 9 aa, Homo Sapiens
AIMTNSQGD

SEQ ID NO: 883071 - protein, 9 aa, Homo Sapiens
IHQFDYGEF

SEQ ID NO: 883072 - protein, 9 aa, Homo Sapiens
MEKIQQEER

SEQ ID NO: 883073 - protein, 9 aa, Homo Sapiens
ILALMPLFS

SEQ ID NO: 883074 - protein, 9 aa, Homo Sapiens
GYIKNKLFF

SEQ ID NO: 883075 - protein, 9 aa, Homo Sapiens
ESWVISQPD

SEQ ID NO: 883076 - protein, 9 aa, Homo Sapiens
LDDDDKDEA

SEQ ID NO: 883077 - protein, 9 aa, Homo Sapiens
FEEIEKLVK

SEQ ID NO: 883078 - protein, 9 aa, Homo Sapiens
QYIGELCCY

SEQ ID NO: 883079 - protein, 9 aa, Homo Sapiens
RKPSFLAHP

SEQ ID NO: 883080 - protein, 9 aa, Homo Sapiens
RAGSLELCG

SEQ ID NO: 883081 - protein, 9 aa, Homo Sapiens
RGAKCGACE

SEQ ID NO: 883082 - protein, 9 aa, Homo Sapiens
LINQLALPQ

SEQ ID NO: 883083 - protein, 9 aa, Homo Sapiens
KPCRCEECD

SEQ ID NO: 883084 - protein, 9 aa, Homo Sapiens
SQDTIQNQV

SEQ ID NO: 883085 - protein, 9 aa, Homo Sapiens
RCPPPRGTR

SEQ ID NO: 883086 - protein, 9 aa, Homo Sapiens
DEDKDEDED

SEQ ID NO: 883087 - protein, 9 aa, Homo Sapiens
IKSVFLSRS

SEQ ID NO: 883088 - protein, 9 aa, Homo Sapiens
AFNIMCSTA

SEQ ID NO: 883089 - protein, 9 aa, Homo Sapiens
TITKPRGNE

SEQ ID NO: 883090 - protein, 9 aa, Homo Sapiens
DFDCKELMN

SEQ ID NO: 883091 - protein, 9 aa, Homo Sapiens
LNTRESDRL

SEQ ID NO: 883092 - protein, 9 aa, Homo Sapiens
IRNVLLTCS

SEQ ID NO: 883093 - protein, 9 aa, Homo Sapiens
APVGNSLSK

SEQ ID NO: 883094 - protein, 9 aa, Homo Sapiens
LVFVAVKIL

SEQ ID NO: 883095 - protein, 9 aa, Homo Sapiens
ASEASDKVN

SEQ ID NO: 883096 - protein, 9 aa, Homo Sapiens
VKHWTNTYT

SEQ ID NO: 883097 - protein, 9 aa, Homo Sapiens
AAAATKVSL

SEQ ID NO: 883098 - protein, 9 aa, Homo Sapiens
LANYPDADR

SEQ ID NO: 883099 - protein, 9 aa, Homo Sapiens
VEMSKYANF

SEQ ID NO: 883100 - protein, 9 aa, Homo Sapiens
PAQGMIEFC

SEQ ID NO: 883101 - protein, 9 aa, Homo Sapiens
STLNKHKIV

SEQ ID NO: 883102 - protein, 9 aa, Homo Sapiens
LHLQDHQQV

SEQ ID NO: 883103 - protein, 9 aa, Homo Sapiens
AKEEAEQLE

SEQ ID NO: 883104 - protein, 9 aa, Homo Sapiens
STLNKHKII

SEQ ID NO: 883105 - protein, 9 aa, Homo Sapiens
DKKKILFSF

SEQ ID NO: 883106 - protein, 9 aa, Homo Sapiens
TKVNKHVFS

SEQ ID NO: 883107 - protein, 9 aa, Homo Sapiens
CKHYGEAVV

SEQ ID NO: 883108 - protein, 9 aa, Homo Sapiens
EANVSLSSM

SEQ ID NO: 883109 - protein, 9 aa, Homo Sapiens
YPGSNVRLH

SEQ ID NO: 883110 - protein, 9 aa, Homo Sapiens
NDTASEETG

SEQ ID NO: 883111 - protein, 9 aa, Homo Sapiens
VSINSASDS

SEQ ID NO: 883112 - protein, 9 aa, Homo Sapiens
RFRHRDKEY

SEQ ID NO: 883113 - protein, 9 aa, Homo Sapiens
EIFGYDQKK

SEQ ID NO: 883114 - protein, 9 aa, Homo Sapiens
AWQMAYEPQ

SEQ ID NO: 883115 - protein, 9 aa, Homo Sapiens
GSITRHYID

SEQ ID NO: 883116 - protein, 9 aa, Homo Sapiens
TAEHFRALS

SEQ ID NO: 883117 - protein, 9 aa, Homo Sapiens
DYAISVTII

SEQ ID NO: 883118 - protein, 9 aa, Homo Sapiens
PVMPQAPPP

SEQ ID NO: 883119 - protein, 9 aa, Homo Sapiens
KLESSASTG

SEQ ID NO: 883120 - protein, 9 aa, Homo Sapiens
SLEKNYSAS

SEQ ID NO: 883121 - protein, 9 aa, Homo Sapiens
GVQTGNDVL

SEQ ID NO: 883122 - protein, 9 aa, Homo Sapiens
LPLLSNAKC

SEQ ID NO: 883123 - protein, 9 aa, Homo Sapiens
VLKHKVIEK

SEQ ID NO: 883124 - protein, 9 aa, Homo Sapiens
DIPICPVLP

SEQ ID NO: 883125 - protein, 9 aa, Homo Sapiens
IAAFCFYFC

SEQ ID NO: 883126 - protein, 9 aa, Homo Sapiens
EVVKVTTER

SEQ ID NO: 883127 - protein, 9 aa, Homo Sapiens
KIQKELKIL

SEQ ID NO: 883128 - protein, 9 aa, Homo Sapiens
RRHFTPEDH

SEQ ID NO: 883129 - protein, 9 aa, Homo Sapiens
GSGKGGPQG

SEQ ID NO: 883130 - protein, 9 aa, Homo Sapiens
TIYQQFSEC

SEQ ID NO: 883131 - protein, 9 aa, Homo Sapiens
KINLESQIT

SEQ ID NO: 883132 - protein, 9 aa, Homo Sapiens
LEEVKCTPS

SEQ ID NO: 883133 - protein, 9 aa, Homo Sapiens
NSVKKYSRV

SEQ ID NO: 883134 - protein, 9 aa, Homo Sapiens
FVCVISLGL

SEQ ID NO: 883135 - protein, 9 aa, Homo Sapiens
RGPRLPQTV

SEQ ID NO: 883136 - protein, 9 aa, Homo Sapiens
IPIKINSIF

SEQ ID NO: 883137 - protein, 9 aa, Homo Sapiens
TFEEENQTI

SEQ ID NO: 883138 - protein, 9 aa, Homo Sapiens
SPVNKVCRV

SEQ ID NO: 883139 - protein, 9 aa, Homo Sapiens
ITCKTKHVD

SEQ ID NO: 883140 - protein, 9 aa, Homo Sapiens
YIMDYYQSN

SEQ ID NO: 883141 - protein, 9 aa, Homo Sapiens
VPINSVNLD

SEQ ID NO: 883142 - protein, 9 aa, Homo Sapiens
LVTMLGANG

SEQ ID NO: 883143 - protein, 9 aa, Homo Sapiens
DYIVLDLGF

SEQ ID NO: 883144 - protein, 9 aa, Homo Sapiens
KSKCPQLRE

SEQ ID NO: 883145 - protein, 9 aa, Homo Sapiens
ALLSALNTA

SEQ ID NO: 883146 - protein, 9 aa, Homo Sapiens
KPNVEFTFK

SEQ ID NO: 883147 - protein, 9 aa, Homo Sapiens
IIKRDSLQK

SEQ ID NO: 883148 - protein, 9 aa, Homo Sapiens
NAAGEVTAP

SEQ ID NO: 883149 - protein, 9 aa, Homo Sapiens
FSISFQHPV

SEQ ID NO: 883150 - protein, 9 aa, Homo Sapiens
ASVGSVLGV

SEQ ID NO: 883151 - protein, 9 aa, Homo Sapiens
FLGQMPIII

SEQ ID NO: 883152 - protein, 9 aa, Homo Sapiens
TYHRIYLPP

SEQ ID NO: 883153 - protein, 9 aa, Homo Sapiens
PKSLPVPTP

SEQ ID NO: 883154 - protein, 9 aa, Homo Sapiens
ALFCHKPCR

SEQ ID NO: 883155 - protein, 9 aa, Homo Sapiens
PIIILQRTA

SEQ ID NO: 883156 - protein, 9 aa, Homo Sapiens
SLEEDYKYI

SEQ ID NO: 883157 - protein, 9 aa, Homo Sapiens
EELKHLTET

SEQ ID NO: 883158 - protein, 9 aa, Homo Sapiens
ALKTIINKS

SEQ ID NO: 883159 - protein, 9 aa, Homo Sapiens
RYLVNRLEE

SEQ ID NO: 883160 - protein, 9 aa, Homo Sapiens
NGFYVFYIL

SEQ ID NO: 883161 - protein, 9 aa, Homo Sapiens
SQTDNLKKQ

SEQ ID NO: 883162 - protein, 9 aa, Homo Sapiens
WKSVCLDVT

SEQ ID NO: 883163 - protein, 9 aa, Homo Sapiens
LCKEGKDEH

SEQ ID NO: 883164 - protein, 9 aa, Homo Sapiens
CTCTSQKAV

SEQ ID NO: 883165 - protein, 9 aa, Homo Sapiens
DPQNLLLSG

SEQ ID NO: 883166 - protein, 9 aa, Homo Sapiens
LPLQDVWHI

SEQ ID NO: 883167 - protein, 9 aa, Homo Sapiens
SRTLNKHKT

SEQ ID NO: 883168 - protein, 9 aa, Homo Sapiens
GVDPCSRQS

SEQ ID NO: 883169 - protein, 9 aa, Homo Sapiens
VGEDCECGS

SEQ ID NO: 883170 - protein, 9 aa, Homo Sapiens
DLLLNTRES

SEQ ID NO: 883171 - protein, 9 aa, Homo Sapiens
AAEKKDSQG

SEQ ID NO: 883172 - protein, 9 aa, Homo Sapiens
ISVLHWLQQ

SEQ ID NO: 883173 - protein, 9 aa, Homo Sapiens
VGSVCSCVF

SEQ ID NO: 883174 - protein, 9 aa, Homo Sapiens
DNAYTGSGD

SEQ ID NO: 883175 - protein, 9 aa, Homo Sapiens
FQVSKNKIM

SEQ ID NO: 883176 - protein, 9 aa, Homo Sapiens
FVEGYYHTE

SEQ ID NO: 883177 - protein, 9 aa, Homo Sapiens
ENSDTEFGD

SEQ ID NO: 883178 - protein, 9 aa, Homo Sapiens
VLRAAWDTV

SEQ ID NO: 883179 - protein, 9 aa, Homo Sapiens
IVSLPLNVG

SEQ ID NO: 883180 - protein, 9 aa, Homo Sapiens
CLPEVYCIV

SEQ ID NO: 883181 - protein, 9 aa, Homo Sapiens
LTKNGVFSA

SEQ ID NO: 883182 - protein, 9 aa, Homo Sapiens
NTRMIRKQN

SEQ ID NO: 883183 - protein, 9 aa, Homo Sapiens
VWWITGTDG

SEQ ID NO: 883184 - protein, 9 aa, Homo Sapiens
GKVYGTSSH

SEQ ID NO: 883185 - protein, 9 aa, Homo Sapiens
GETGAMVCC

SEQ ID NO: 883186 - protein, 9 aa, Homo Sapiens
NQEKLNKFM

SEQ ID NO: 883187 - protein, 9 aa, Homo Sapiens
DSYTSNKIV

SEQ ID NO: 883188 - protein, 9 aa, Homo Sapiens
VRRIKLGHT

SEQ ID NO: 883189 - protein, 9 aa, Homo Sapiens
GMEPKNFIH

SEQ ID NO: 883190 - protein, 9 aa, Homo Sapiens
DEYSAIGPR

SEQ ID NO: 883191 - protein, 9 aa, Homo Sapiens
WKKLPAGST

SEQ ID NO: 883192 - protein, 9 aa, Homo Sapiens
EDRNVYITI

SEQ ID NO: 883193 - protein, 9 aa, Homo Sapiens
KVLRNNELS

SEQ ID NO: 883194 - protein, 9 aa, Homo Sapiens
DIRDLLSKE

SEQ ID NO: 883195 - protein, 9 aa, Homo Sapiens
NFSGLSLIK

SEQ ID NO: 883196 - protein, 9 aa, Homo Sapiens
EDTAVDFSQ

SEQ ID NO: 883197 - protein, 9 aa, Homo Sapiens
TADDKTAQV

SEQ ID NO: 883198 - protein, 9 aa, Homo Sapiens
PMLNPLICT

SEQ ID NO: 883199 - protein, 9 aa, Homo Sapiens
GHQLSTLDK

SEQ ID NO: 883200 - protein, 9 aa, Homo Sapiens
SKFQFIVSL

SEQ ID NO: 883201 - protein, 9 aa, Homo Sapiens
LNSLKEKQK

SEQ ID NO: 883202 - protein, 9 aa, Homo Sapiens
HLPPPRPAP

SEQ ID NO: 883203 - protein, 9 aa, Homo Sapiens
SDGDGKISF

SEQ ID NO: 883204 - protein, 9 aa, Homo Sapiens
FAKISVAIQ

SEQ ID NO: 883205 - protein, 9 aa, Homo Sapiens
PRRDIGNSI

SEQ ID NO: 883206 - protein, 9 aa, Homo Sapiens
PNTQGFLYA

SEQ ID NO: 883207 - protein, 9 aa, Homo Sapiens
HYSREELNL

SEQ ID NO: 883208 - protein, 9 aa, Homo Sapiens
NCNNFWLLQ

SEQ ID NO: 883209 - protein, 9 aa, Homo Sapiens
CKVICHSLW

SEQ ID NO: 883210 - protein, 9 aa, Homo Sapiens
RNFDRQKSC

SEQ ID NO: 883211 - protein, 9 aa, Homo Sapiens
KHYKICKLD

SEQ ID NO: 883212 - protein, 9 aa, Homo Sapiens
QCELESLKS

SEQ ID NO: 883213 - protein, 9 aa, Homo Sapiens
DKCQGKGDD

SEQ ID NO: 883214 - protein, 9 aa, Homo Sapiens
IFGAHNRFR

SEQ ID NO: 883215 - protein, 9 aa, Homo Sapiens
VTEETFTIL

SEQ ID NO: 883216 - protein, 9 aa, Homo Sapiens
GKQDPKHHL

SEQ ID NO: 883217 - protein, 9 aa, Homo Sapiens
KILHSLLNK

SEQ ID NO: 883218 - protein, 9 aa, Homo Sapiens
AKCKKSWGR

SEQ ID NO: 883219 - protein, 9 aa, Homo Sapiens
HEPTKPLVC

SEQ ID NO: 883220 - protein, 9 aa, Homo Sapiens
VVFMSLCKR

SEQ ID NO: 883221 - protein, 9 aa, Homo Sapiens
RPIFLCLLP

SEQ ID NO: 883222 - protein, 9 aa, Homo Sapiens
FQSYYLDHM

SEQ ID NO: 883223 - protein, 9 aa, Homo Sapiens
TALESPRKS

SEQ ID NO: 883224 - protein, 9 aa, Homo Sapiens
PPLSPLARS

SEQ ID NO: 883225 - protein, 9 aa, Homo Sapiens
KEKQRHQLH

SEQ ID NO: 883226 - protein, 9 aa, Homo Sapiens
PQLREICVG

SEQ ID NO: 883227 - protein, 9 aa, Homo Sapiens
SLLVDGNMN

SEQ ID NO: 883228 - protein, 9 aa, Homo Sapiens
CLMETNLSK

SEQ ID NO: 883229 - protein, 9 aa, Homo Sapiens
ICQSSRTSS

SEQ ID NO: 883230 - protein, 9 aa, Homo Sapiens
LNATIRQLE

SEQ ID NO: 883231 - protein, 9 aa, Homo Sapiens
KHNQLGSAG

SEQ ID NO: 883232 - protein, 9 aa, Homo Sapiens
KKATVYEVM

SEQ ID NO: 883233 - protein, 9 aa, Homo Sapiens
RQNQKTPTS

SEQ ID NO: 883234 - protein, 9 aa, Homo Sapiens
KTLYFPNPY

SEQ ID NO: 883235 - protein, 9 aa, Homo Sapiens
ILEWMFCGF

SEQ ID NO: 883236 - protein, 9 aa, Homo Sapiens
VWDSGVAVA

SEQ ID NO: 883237 - protein, 9 aa, Homo Sapiens
PDAMKEVVP

SEQ ID NO: 883238 - protein, 9 aa, Homo Sapiens
ILDSMKAKI

SEQ ID NO: 883239 - protein, 9 aa, Homo Sapiens
PYKQLMNEY

SEQ ID NO: 883240 - protein, 9 aa, Homo Sapiens
DRDTRLIMQ

SEQ ID NO: 883241 - protein, 9 aa, Homo Sapiens
LHHAKDSED

SEQ ID NO: 883242 - protein, 9 aa, Homo Sapiens
TQTFYGLHQ

SEQ ID NO: 883243 - protein, 9 aa, Homo Sapiens
NSIRHNLSF

SEQ ID NO: 883244 - protein, 9 aa, Homo Sapiens
LVCYLRRKL

SEQ ID NO: 883245 - protein, 9 aa, Homo Sapiens
NEMIETKCF

SEQ ID NO: 883246 - protein, 9 aa, Homo Sapiens
ITGKIVGHG

SEQ ID NO: 883247 - protein, 9 aa, Homo Sapiens
SQLWDTFSC

SEQ ID NO: 883248 - protein, 9 aa, Homo Sapiens
CFIEVNTII

SEQ ID NO: 883249 - protein, 9 aa, Homo Sapiens
SRSVQQLQT

SEQ ID NO: 883250 - protein, 9 aa, Homo Sapiens
HQNKINEVL

SEQ ID NO: 883251 - protein, 9 aa, Homo Sapiens
APDLTIKKR

SEQ ID NO: 883252 - protein, 9 aa, Homo Sapiens
CPDGSDDAG

SEQ ID NO: 883253 - protein, 9 aa, Homo Sapiens
SISSAEKTS

SEQ ID NO: 883254 - protein, 9 aa, Homo Sapiens
SGDMFMSMQ

SEQ ID NO: 883255 - protein, 9 aa, Homo Sapiens
TNPKSLITH

SEQ ID NO: 883256 - protein, 9 aa, Homo Sapiens
DRDYMERNN

SEQ ID NO: 883257 - protein, 9 aa, Homo Sapiens
GMEENNIGL

SEQ ID NO: 883258 - protein, 9 aa, Homo Sapiens
PKIAYSRKP

SEQ ID NO: 883259 - protein, 9 aa, Homo Sapiens
KECRDLDDL

SEQ ID NO: 883260 - protein, 9 aa, Homo Sapiens
LHLLVTIRN

SEQ ID NO: 883261 - protein, 9 aa, Homo Sapiens
LPFQGQLDY

SEQ ID NO: 883262 - protein, 9 aa, Homo Sapiens
NLYRDGRKG

SEQ ID NO: 883263 - protein, 9 aa, Homo Sapiens
SERACPLPG

SEQ ID NO: 883264 - protein, 9 aa, Homo Sapiens
LKIYQGNIS

SEQ ID NO: 883265 - protein, 9 aa, Homo Sapiens
FQNQKFRKG

SEQ ID NO: 883266 - protein, 9 aa, Homo Sapiens
QFIVSLPLN

SEQ ID NO: 883267 - protein, 9 aa, Homo Sapiens
SRSISMKPN

SEQ ID NO: 883268 - protein, 9 aa, Homo Sapiens
DGKQAVCLK

SEQ ID NO: 883269 - protein, 9 aa, Homo Sapiens
WFGLGQPGR

SEQ ID NO: 883270 - protein, 9 aa, Homo Sapiens
LFNKPVSPL

SEQ ID NO: 883271 - protein, 9 aa, Homo Sapiens
FQLGYHAIP

SEQ ID NO: 883272 - protein, 9 aa, Homo Sapiens
RKKNLAHPV

SEQ ID NO: 883273 - protein, 9 aa, Homo Sapiens
LLINSSAFS

SEQ ID NO: 883274 - protein, 9 aa, Homo Sapiens
ICKFQILND

SEQ ID NO: 883275 - protein, 9 aa, Homo Sapiens
PHIATTIIT

SEQ ID NO: 883276 - protein, 9 aa, Homo Sapiens
SQRIFMILW

SEQ ID NO: 883277 - protein, 9 aa, Homo Sapiens
RGTEEDPVL

SEQ ID NO: 883278 - protein, 9 aa, Homo Sapiens
STERVFRAG

SEQ ID NO: 883279 - protein, 9 aa, Homo Sapiens
HLPHLHINN

SEQ ID NO: 883280 - protein, 9 aa, Homo Sapiens
GNSSWHFDK

SEQ ID NO: 883281 - protein, 9 aa, Homo Sapiens
QTKNTASLQ

SEQ ID NO: 883282 - protein, 9 aa, Homo Sapiens
SEPDDFNSN

SEQ ID NO: 883283 - protein, 9 aa, Homo Sapiens
LQIFHKLWC

SEQ ID NO: 883284 - protein, 9 aa, Homo Sapiens
QPSATLTAP

SEQ ID NO: 883285 - protein, 9 aa, Homo Sapiens
PRPTRFLCS

SEQ ID NO: 883286 - protein, 9 aa, Homo Sapiens
ALDVGISLP

SEQ ID NO: 883287 - protein, 9 aa, Homo Sapiens
KHEEIILIP

SEQ ID NO: 883288 - protein, 9 aa, Homo Sapiens
ATFEEIEKL

SEQ ID NO: 883289 - protein, 9 aa, Homo Sapiens
GSKQAQKEN

SEQ ID NO: 883290 - protein, 9 aa, Homo Sapiens
QSYYRNSVG

SEQ ID NO: 883291 - protein, 9 aa, Homo Sapiens
ATTVPSNHQ

SEQ ID NO: 883292 - protein, 9 aa, Homo Sapiens
KHRWEYENE

SEQ ID NO: 883293 - protein, 9 aa, Homo Sapiens
NRLYINFML

SEQ ID NO: 883294 - protein, 9 aa, Homo Sapiens
RSGKTPSSI

SEQ ID NO: 883295 - protein, 9 aa, Homo Sapiens
DILKSPGFT

SEQ ID NO: 883296 - protein, 9 aa, Homo Sapiens
QTRHLPLQF

SEQ ID NO: 883297 - protein, 9 aa, Homo Sapiens
SVHCKKEHK

SEQ ID NO: 883298 - protein, 9 aa, Homo Sapiens
DGMNQTRII

SEQ ID NO: 883299 - protein, 9 aa, Homo Sapiens
KENKGETSR

SEQ ID NO: 883300 - protein, 9 aa, Homo Sapiens
AEKSQELLE

SEQ ID NO: 883301 - protein, 9 aa, Homo Sapiens
NAVVFQEAF

SEQ ID NO: 883302 - protein, 9 aa, Homo Sapiens
SFDLRPGVI

SEQ ID NO: 883303 - protein, 9 aa, Homo Sapiens
LFQLYKEFI

SEQ ID NO: 883304 - protein, 9 aa, Homo Sapiens
DLINQLALP

SEQ ID NO: 883305 - protein, 9 aa, Homo Sapiens
KQLMKEKKR

SEQ ID NO: 883306 - protein, 9 aa, Homo Sapiens
QQIHTGESS

SEQ ID NO: 883307 - protein, 9 aa, Homo Sapiens
RMEDTFQFC

SEQ ID NO: 883308 - protein, 9 aa, Homo Sapiens
LSRIESHEY

SEQ ID NO: 883309 - protein, 9 aa, Homo Sapiens
NEAIQNIAA

SEQ ID NO: 883310 - protein, 9 aa, Homo Sapiens
VIRFQKNNG

SEQ ID NO: 883311 - protein, 9 aa, Homo Sapiens
LQDYDIQTG

SEQ ID NO: 883312 - protein, 9 aa, Homo Sapiens
IKEAKGLLY

SEQ ID NO: 883313 - protein, 9 aa, Homo Sapiens
EAAQRGSES

SEQ ID NO: 883314 - protein, 9 aa, Homo Sapiens
GRLFFKFYH

SEQ ID NO: 883315 - protein, 9 aa, Homo Sapiens
IPSHKEERW

SEQ ID NO: 883316 - protein, 9 aa, Homo Sapiens
YYESGYFCI

SEQ ID NO: 883317 - protein, 9 aa, Homo Sapiens
KASTEATKL

SEQ ID NO: 883318 - protein, 9 aa, Homo Sapiens
AANTLTSLS

SEQ ID NO: 883319 - protein, 9 aa, Homo Sapiens
KVSVSSYEI

SEQ ID NO: 883320 - protein, 9 aa, Homo Sapiens
QTEDKKRQL

SEQ ID NO: 883321 - protein, 9 aa, Homo Sapiens
LSRSVQQLQ

SEQ ID NO: 883322 - protein, 9 aa, Homo Sapiens
VDYSDSAVI

SEQ ID NO: 883323 - protein, 9 aa, Homo Sapiens
EKLNKFMIR

SEQ ID NO: 883324 - protein, 9 aa, Homo Sapiens
FCVRDCRKL

SEQ ID NO: 883325 - protein, 9 aa, Homo Sapiens
LLVVSPISQ

SEQ ID NO: 883326 - protein, 9 aa, Homo Sapiens
ETGIEEANK

SEQ ID NO: 883327 - protein, 9 aa, Homo Sapiens
EQDTAEYIL

SEQ ID NO: 883328 - protein, 9 aa, Homo Sapiens
KEKKKRKKY

SEQ ID NO: 883329 - protein, 9 aa, Homo Sapiens
TIVLQTYFL

SEQ ID NO: 883330 - protein, 9 aa, Homo Sapiens
SSSPINGLQ

SEQ ID NO: 883331 - protein, 9 aa, Homo Sapiens
RRVRVWRRH

SEQ ID NO: 883332 - protein, 9 aa, Homo Sapiens
CNEVQLWAA

SEQ ID NO: 883333 - protein, 9 aa, Homo Sapiens
LKRKNKLPD

SEQ ID NO: 883334 - protein, 9 aa, Homo Sapiens
AYVLQFSIG

SEQ ID NO: 883335 - protein, 9 aa, Homo Sapiens
HPDLSPSYE

SEQ ID NO: 883336 - protein, 9 aa, Homo Sapiens
IIGVAKQLF

SEQ ID NO: 883337 - protein, 9 aa, Homo Sapiens
DLFMKRFSY

SEQ ID NO: 883338 - protein, 9 aa, Homo Sapiens
RVIGMPVAT

SEQ ID NO: 883339 - protein, 9 aa, Homo Sapiens
LYICPNIAQ

SEQ ID NO: 883340 - protein, 9 aa, Homo Sapiens
EKIQQEERK

SEQ ID NO: 883341 - protein, 9 aa, Homo Sapiens
QSLSPMSGL

SEQ ID NO: 883342 - protein, 9 aa, Homo Sapiens
DADSEFDVF

SEQ ID NO: 883343 - protein, 9 aa, Homo Sapiens
DTAEYILRA

SEQ ID NO: 883344 - protein, 9 aa, Homo Sapiens
QRLVFDNQL

SEQ ID NO: 883345 - protein, 9 aa, Homo Sapiens
RQTTELKVT

SEQ ID NO: 883346 - protein, 9 aa, Homo Sapiens
VFYILIVDP

SEQ ID NO: 883347 - protein, 9 aa, Homo Sapiens
YEQYYRQVD

SEQ ID NO: 883348 - protein, 9 aa, Homo Sapiens
QNSLEVVTP

SEQ ID NO: 883349 - protein, 9 aa, Homo Sapiens
RICKLSMKA

SEQ ID NO: 883350 - protein, 9 aa, Homo Sapiens
GLVSPSAET

SEQ ID NO: 883351 - protein, 9 aa, Homo Sapiens
STCTKGNSC

SEQ ID NO: 883352 - protein, 9 aa, Homo Sapiens
STVLIIPSG

SEQ ID NO: 883353 - protein, 9 aa, Homo Sapiens
LRHFSIYFL

SEQ ID NO: 883354 - protein, 9 aa, Homo Sapiens
ANISLSSSG

SEQ ID NO: 883355 - protein, 9 aa, Homo Sapiens
LVPPAGSPK

SEQ ID NO: 883356 - protein, 9 aa, Homo Sapiens
LYCPQQTIV

SEQ ID NO: 883357 - protein, 9 aa, Homo Sapiens
DKWRKVSGV

SEQ ID NO: 883358 - protein, 9 aa, Homo Sapiens
WRETGKIYT

SEQ ID NO: 883359 - protein, 9 aa, Homo Sapiens
KELTLELKE

SEQ ID NO: 883360 - protein, 9 aa, Homo Sapiens
GITYLPSVS

SEQ ID NO: 883361 - protein, 9 aa, Homo Sapiens
INCIQVHDQ

SEQ ID NO: 883362 - protein, 9 aa, Homo Sapiens
GPPHTNNWR

SEQ ID NO: 883363 - protein, 9 aa, Homo Sapiens
STSSDSGHS

SEQ ID NO: 883364 - protein, 9 aa, Homo Sapiens
VLFDISLFV

SEQ ID NO: 883365 - protein, 9 aa, Homo Sapiens
FNPPKSSNN

SEQ ID NO: 883366 - protein, 9 aa, Homo Sapiens
KMKEKYEAI

SEQ ID NO: 883367 - protein, 9 aa, Homo Sapiens
FCDGDCSKG

SEQ ID NO: 883368 - protein, 9 aa, Homo Sapiens
DNDTTEPRV

SEQ ID NO: 883369 - protein, 9 aa, Homo Sapiens
AAALFTSKL

SEQ ID NO: 883370 - protein, 9 aa, Homo Sapiens
PGQLRGEDP

SEQ ID NO: 883371 - protein, 9 aa, Homo Sapiens
GRRLQFGVT

SEQ ID NO: 883372 - protein, 9 aa, Homo Sapiens
FETKAQKGE

SEQ ID NO: 883373 - protein, 9 aa, Homo Sapiens
LELIANLPP

SEQ ID NO: 883374 - protein, 9 aa, Homo Sapiens
ILNIVKNHI

SEQ ID NO: 883375 - protein, 9 aa, Homo Sapiens
IIVEDIDKG

SEQ ID NO: 883376 - protein, 9 aa, Homo Sapiens
VPEPDHLEE

SEQ ID NO: 883377 - protein, 9 aa, Homo Sapiens
NKVCRVSFA

SEQ ID NO: 883378 - protein, 9 aa, Homo Sapiens
MNFHPESRS

SEQ ID NO: 883379 - protein, 9 aa, Homo Sapiens
LLNNTGNLA

SEQ ID NO: 883380 - protein, 9 aa, Homo Sapiens
DTDGLWLVA

SEQ ID NO: 883381 - protein, 9 aa, Homo Sapiens
GAKKEREML

SEQ ID NO: 883382 - protein, 9 aa, Homo Sapiens
PEWQFFVKW

SEQ ID NO: 883383 - protein, 9 aa, Homo Sapiens
AKIEVDENG

SEQ ID NO: 883384 - protein, 9 aa, Homo Sapiens
VTMRIWVLK

SEQ ID NO: 883385 - protein, 9 aa, Homo Sapiens
CTYQEGKES

SEQ ID NO: 883386 - protein, 9 aa, Homo Sapiens
VEPNRNKYL

SEQ ID NO: 883387 - protein, 9 aa, Homo Sapiens
SHFYRIDRA

SEQ ID NO: 883388 - protein, 9 aa, Homo Sapiens
AVKFSSNYR

SEQ ID NO: 883389 - protein, 9 aa, Homo Sapiens
KHSAWPAPF

SEQ ID NO: 883390 - protein, 9 aa, Homo Sapiens
CRQLPPVPP

SEQ ID NO: 883391 - protein, 9 aa, Homo Sapiens
QQNVLKVLT

SEQ ID NO: 883392 - protein, 9 aa, Homo Sapiens
YSAGRGLSG

SEQ ID NO: 883393 - protein, 9 aa, Homo Sapiens
IIRGIDIIK

SEQ ID NO: 883394 - protein, 9 aa, Homo Sapiens
SRAALVGRC

SEQ ID NO: 883395 - protein, 9 aa, Homo Sapiens
LKKEIVDDA

SEQ ID NO: 883396 - protein, 9 aa, Homo Sapiens
DVFEVEKDG

SEQ ID NO: 883397 - protein, 9 aa, Homo Sapiens
ISNTIEQLR

SEQ ID NO: 883398 - protein, 9 aa, Homo Sapiens
GPFGLSPLI

SEQ ID NO: 883399 - protein, 9 aa, Homo Sapiens
EDSGIPNPC

SEQ ID NO: 883400 - protein, 9 aa, Homo Sapiens
LSVQMEGEG

SEQ ID NO: 883401 - protein, 9 aa, Homo Sapiens
NEDNPEESE

SEQ ID NO: 883402 - protein, 9 aa, Homo Sapiens
KLRRNIIPE

SEQ ID NO: 883403 - protein, 9 aa, Homo Sapiens
QIIRDWLYE

SEQ ID NO: 883404 - protein, 9 aa, Homo Sapiens
SSSDSLQYV

SEQ ID NO: 883405 - protein, 9 aa, Homo Sapiens
GGIIQISLP

SEQ ID NO: 883406 - protein, 9 aa, Homo Sapiens
RRSEVCIYY

SEQ ID NO: 883407 - protein, 9 aa, Homo Sapiens
EASNNGSMC

SEQ ID NO: 883408 - protein, 9 aa, Homo Sapiens
KENNNSNKF

SEQ ID NO: 883409 - protein, 9 aa, Homo Sapiens
SREVKEIRR

SEQ ID NO: 883410 - protein, 9 aa, Homo Sapiens
EEIEKLVKD

SEQ ID NO: 883411 - protein, 9 aa, Homo Sapiens
VHLNKLSVN

SEQ ID NO: 883412 - protein, 9 aa, Homo Sapiens
LQTLAYIPT

SEQ ID NO: 883413 - protein, 9 aa, Homo Sapiens
YTSQEEIIC

SEQ ID NO: 883414 - protein, 9 aa, Homo Sapiens
IPDEVIAKV

SEQ ID NO: 883415 - protein, 9 aa, Homo Sapiens
DKENITPLI

SEQ ID NO: 883416 - protein, 9 aa, Homo Sapiens
LDEDQKVWP

SEQ ID NO: 883417 - protein, 9 aa, Homo Sapiens
SIQNTRNHF

SEQ ID NO: 883418 - protein, 9 aa, Homo Sapiens
SVTADRWKK

SEQ ID NO: 883419 - protein, 9 aa, Homo Sapiens
CVLLNLLES

SEQ ID NO: 883420 - protein, 9 aa, Homo Sapiens
ESIFYFHPI

SEQ ID NO: 883421 - protein, 9 aa, Homo Sapiens
LHVVILLPW

SEQ ID NO: 883422 - protein, 9 aa, Homo Sapiens
LLQDALHIS

SEQ ID NO: 883423 - protein, 9 aa, Homo Sapiens
AKNLAITLH

SEQ ID NO: 883424 - protein, 9 aa, Homo Sapiens
QARSKKLIK

SEQ ID NO: 883425 - protein, 9 aa, Homo Sapiens
LDDSIGSPG

SEQ ID NO: 883426 - protein, 9 aa, Homo Sapiens
PKYRLPINI

SEQ ID NO: 883427 - protein, 9 aa, Homo Sapiens
HFYRIDRAQ

SEQ ID NO: 883428 - protein, 9 aa, Homo Sapiens
IGEQLHVNI

SEQ ID NO: 883429 - protein, 9 aa, Homo Sapiens
CYLCKQSKR

SEQ ID NO: 883430 - protein, 9 aa, Homo Sapiens
VFRSDSAVL

SEQ ID NO: 883431 - protein, 9 aa, Homo Sapiens
LALKNGAGS

SEQ ID NO: 883432 - protein, 9 aa, Homo Sapiens
EQEERRKIK

SEQ ID NO: 883433 - protein, 9 aa, Homo Sapiens
TVTLLHSER

SEQ ID NO: 883434 - protein, 9 aa, Homo Sapiens
EIWNPVSAS

SEQ ID NO: 883435 - protein, 9 aa, Homo Sapiens
HMGNYRQIY

SEQ ID NO: 883436 - protein, 9 aa, Homo Sapiens
WDAFGRYIT

SEQ ID NO: 883437 - protein, 9 aa, Homo Sapiens
LRYFFELRL

SEQ ID NO: 883438 - protein, 9 aa, Homo Sapiens
QPLHTLYHI

SEQ ID NO: 883439 - protein, 9 aa, Homo Sapiens
WTKSMAPRQ

SEQ ID NO: 883440 - protein, 9 aa, Homo Sapiens
YQLTQHQVF

SEQ ID NO: 883441 - protein, 9 aa, Homo Sapiens
ALQSPKRPQ

SEQ ID NO: 883442 - protein, 9 aa, Homo Sapiens
IFEKRSTQT

SEQ ID NO: 883443 - protein, 9 aa, Homo Sapiens
YVKKEFVHV

SEQ ID NO: 883444 - protein, 9 aa, Homo Sapiens
VENQFCEFK

SEQ ID NO: 883445 - protein, 9 aa, Homo Sapiens
SQREGVSPQ

SEQ ID NO: 883446 - protein, 9 aa, Homo Sapiens
FQSVWVLTD

SEQ ID NO: 883447 - protein, 9 aa, Homo Sapiens
LFALQTLQP

SEQ ID NO: 883448 - protein, 9 aa, Homo Sapiens
CFLLVTMAY

SEQ ID NO: 883449 - protein, 9 aa, Homo Sapiens
KQTAEAVYS

SEQ ID NO: 883450 - protein, 9 aa, Homo Sapiens
YSRKTTPGK

SEQ ID NO: 883451 - protein, 9 aa, Homo Sapiens
KLLSGSVLS

SEQ ID NO: 883452 - protein, 9 aa, Homo Sapiens
ASRMESTGK

SEQ ID NO: 883453 - protein, 9 aa, Homo Sapiens
EVPGKVKAQ

SEQ ID NO: 883454 - protein, 9 aa, Homo Sapiens
LALFVDIQL

SEQ ID NO: 883455 - protein, 9 aa, Homo Sapiens
HEFNFIHDV

SEQ ID NO: 883456 - protein, 9 aa, Homo Sapiens
GVTKSHHLH

SEQ ID NO: 883457 - protein, 9 aa, Homo Sapiens
VLESGTVWI

SEQ ID NO: 883458 - protein, 9 aa, Homo Sapiens
CIHTDDKPY

SEQ ID NO: 883459 - protein, 9 aa, Homo Sapiens
THQDIDLLI

SEQ ID NO: 883460 - protein, 9 aa, Homo Sapiens
LQNMFGETL

SEQ ID NO: 883461 - protein, 9 aa, Homo Sapiens
LLDEDQKVW

SEQ ID NO: 883462 - protein, 9 aa, Homo Sapiens
NNILYRQFK

SEQ ID NO: 883463 - protein, 9 aa, Homo Sapiens
RTVRMRRKN

SEQ ID NO: 883464 - protein, 9 aa, Homo Sapiens
VVQDHSNNL

SEQ ID NO: 883465 - protein, 9 aa, Homo Sapiens
TLTSSAASP

SEQ ID NO: 883466 - protein, 9 aa, Homo Sapiens
VTKTLSDYE

SEQ ID NO: 883467 - protein, 9 aa, Homo Sapiens
CKRRETEAL

SEQ ID NO: 883468 - protein, 9 aa, Homo Sapiens
RAHSCYKCC

SEQ ID NO: 883469 - protein, 9 aa, Homo Sapiens
INKPEAEML

SEQ ID NO: 883470 - protein, 9 aa, Homo Sapiens
EHPLPNYRT

SEQ ID NO: 883471 - protein, 9 aa, Homo Sapiens
GKYSEIEEL

SEQ ID NO: 883472 - protein, 9 aa, Homo Sapiens
SLAISGLRH

SEQ ID NO: 883473 - protein, 9 aa, Homo Sapiens
LLKIKYRAA

SEQ ID NO: 883474 - protein, 9 aa, Homo Sapiens
HRSFTNMSS

SEQ ID NO: 883475 - protein, 9 aa, Homo Sapiens
INHIKQFLD

SEQ ID NO: 883476 - protein, 9 aa, Homo Sapiens
RVFRAGRQL

SEQ ID NO: 883477 - protein, 9 aa, Homo Sapiens
SQQGQYNMT

SEQ ID NO: 883478 - protein, 9 aa, Homo Sapiens
IKKLEEAEI

SEQ ID NO: 883479 - protein, 9 aa, Homo Sapiens
LPHETLLDI

SEQ ID NO: 883480 - protein, 9 aa, Homo Sapiens
LDSVLYANN

SEQ ID NO: 883481 - protein, 9 aa, Homo Sapiens
LCLHYRYFI

SEQ ID NO: 883482 - protein, 9 aa, Homo Sapiens
SEMGTERVM

SEQ ID NO: 883483 - protein, 9 aa, Homo Sapiens
EELYTLPFH

SEQ ID NO: 883484 - protein, 9 aa, Homo Sapiens
STVTVCLFV

SEQ ID NO: 883485 - protein, 9 aa, Homo Sapiens
LHKTDSAVA

SEQ ID NO: 883486 - protein, 9 aa, Homo Sapiens
QKLTNDHVQ

SEQ ID NO: 883487 - protein, 9 aa, Homo Sapiens
QRLQSQTDN

SEQ ID NO: 883488 - protein, 9 aa, Homo Sapiens
QFCAHCRAL

SEQ ID NO: 883489 - protein, 9 aa, Homo Sapiens
IYSHDGTNS

SEQ ID NO: 883490 - protein, 9 aa, Homo Sapiens
VKAQICESV

SEQ ID NO: 883491 - protein, 9 aa, Homo Sapiens
IPQSYPEGD

SEQ ID NO: 883492 - protein, 9 aa, Homo Sapiens
YNASLSLIF

SEQ ID NO: 883493 - protein, 9 aa, Homo Sapiens
RQCWKLKGR

SEQ ID NO: 883494 - protein, 9 aa, Homo Sapiens
VYSEMIYLA

SEQ ID NO: 883495 - protein, 9 aa, Homo Sapiens
LWVLLDGGL

SEQ ID NO: 883496 - protein, 9 aa, Homo Sapiens
QDLKVVKDV

SEQ ID NO: 883497 - protein, 9 aa, Homo Sapiens
IKFELLARL

SEQ ID NO: 883498 - protein, 9 aa, Homo Sapiens
YGTSSHLKA

SEQ ID NO: 883499 - protein, 9 aa, Homo Sapiens
TASSLLQKE

SEQ ID NO: 883500 - protein, 9 aa, Homo Sapiens
FKRYVTTAE

SEQ ID NO: 883501 - protein, 9 aa, Homo Sapiens
TRSTEDDSE

SEQ ID NO: 883502 - protein, 9 aa, Homo Sapiens
TTVSLNTRH

SEQ ID NO: 883503 - protein, 9 aa, Homo Sapiens
YLQRNMGNG

SEQ ID NO: 883504 - protein, 9 aa, Homo Sapiens
GQINKLCVS

SEQ ID NO: 883505 - protein, 9 aa, Homo Sapiens
YKHQSHSSG

SEQ ID NO: 883506 - protein, 9 aa, Homo Sapiens
NTWKIIIKN

SEQ ID NO: 883507 - protein, 9 aa, Homo Sapiens
QLHISQHEA

SEQ ID NO: 883508 - protein, 9 aa, Homo Sapiens
NKIGHLCKL

SEQ ID NO: 883509 - protein, 9 aa, Homo Sapiens
TQKGLCEAR

SEQ ID NO: 883510 - protein, 9 aa, Homo Sapiens
VFMWGVNHS

SEQ ID NO: 883511 - protein, 9 aa, Homo Sapiens
VNCKDARAC

SEQ ID NO: 883512 - protein, 9 aa, Homo Sapiens
HLNSVGNTC

SEQ ID NO: 883513 - protein, 9 aa, Homo Sapiens
SALNHAVLG

SEQ ID NO: 883514 - protein, 9 aa, Homo Sapiens
GEEKTKSSW

SEQ ID NO: 883515 - protein, 9 aa, Homo Sapiens
VEKGTGATV

SEQ ID NO: 883516 - protein, 9 aa, Homo Sapiens
TLYHILSQL

SEQ ID NO: 883517 - protein, 9 aa, Homo Sapiens
CCKRGNVGF

SEQ ID NO: 883518 - protein, 9 aa, Homo Sapiens
FSQGSGSHP

SEQ ID NO: 883519 - protein, 9 aa, Homo Sapiens
LICTTANTE

SEQ ID NO: 883520 - protein, 9 aa, Homo Sapiens
VFILSFILR

SEQ ID NO: 883521 - protein, 9 aa, Homo Sapiens
VRGMNLTVC

SEQ ID NO: 883522 - protein, 9 aa, Homo Sapiens
SQEEIEKKE

SEQ ID NO: 883523 - protein, 9 aa, Homo Sapiens
SWTVTMRIW

SEQ ID NO: 883524 - protein, 9 aa, Homo Sapiens
LLNLFLSAF

SEQ ID NO: 883525 - protein, 9 aa, Homo Sapiens
QVQHFGVFL

SEQ ID NO: 883526 - protein, 9 aa, Homo Sapiens
IQAFENTYK

SEQ ID NO: 883527 - protein, 9 aa, Homo Sapiens
KLQYGPMTG

SEQ ID NO: 883528 - protein, 9 aa, Homo Sapiens
PDCINQIAT

SEQ ID NO: 883529 - protein, 9 aa, Homo Sapiens
RNWKPKYVY

SEQ ID NO: 883530 - protein, 9 aa, Homo Sapiens
QFPYGARYD

SEQ ID NO: 883531 - protein, 9 aa, Homo Sapiens
YIHLGFMEK

SEQ ID NO: 883532 - protein, 9 aa, Homo Sapiens
LSSVDDIQA

SEQ ID NO: 883533 - protein, 9 aa, Homo Sapiens
ADTVPWLQG

SEQ ID NO: 883534 - protein, 9 aa, Homo Sapiens
ASGTTAKTT

SEQ ID NO: 883535 - protein, 9 aa, Homo Sapiens
FRSLVASSP

SEQ ID NO: 883536 - protein, 9 aa, Homo Sapiens
MEKMVDALL

SEQ ID NO: 883537 - protein, 9 aa, Homo Sapiens
MDKVVRLCH

SEQ ID NO: 883538 - protein, 9 aa, Homo Sapiens
VALDVGISL

SEQ ID NO: 883539 - protein, 9 aa, Homo Sapiens
LAENQLLTL

SEQ ID NO: 883540 - protein, 9 aa, Homo Sapiens
CFQIKYLIP

SEQ ID NO: 883541 - protein, 9 aa, Homo Sapiens
LQGAIVIEQ

SEQ ID NO: 883542 - protein, 9 aa, Homo Sapiens
YLQLDIYQK

SEQ ID NO: 883543 - protein, 9 aa, Homo Sapiens
NKLLAYTNS

SEQ ID NO: 883544 - protein, 9 aa, Homo Sapiens
PCFSCAQKM

SEQ ID NO: 883545 - protein, 9 aa, Homo Sapiens
TKDHSIFTV

SEQ ID NO: 883546 - protein, 9 aa, Homo Sapiens
SQQPHPRIK

SEQ ID NO: 883547 - protein, 9 aa, Homo Sapiens
FQNKCFRNM

SEQ ID NO: 883548 - protein, 9 aa, Homo Sapiens
NDLYFNLQC

SEQ ID NO: 883549 - protein, 9 aa, Homo Sapiens
SSLVASKVF

SEQ ID NO: 883550 - protein, 9 aa, Homo Sapiens
KIVEHFGIA

SEQ ID NO: 883551 - protein, 9 aa, Homo Sapiens
RFRKSFHLS

SEQ ID NO: 883552 - protein, 9 aa, Homo Sapiens
CNKLHVDPD

SEQ ID NO: 883553 - protein, 9 aa, Homo Sapiens
ASLYCPQQT

SEQ ID NO: 883554 - protein, 9 aa, Homo Sapiens
VLKMFTNFL

SEQ ID NO: 883555 - protein, 9 aa, Homo Sapiens
KYSRVMDLK

SEQ ID NO: 883556 - protein, 9 aa, Homo Sapiens
HWRIHSGEK

SEQ ID NO: 883557 - protein, 9 aa, Homo Sapiens
YHERPLPAL

SEQ ID NO: 883558 - protein, 9 aa, Homo Sapiens
LDGIFCAIF

SEQ ID NO: 883559 - protein, 9 aa, Homo Sapiens
MPLTPLWTL

SEQ ID NO: 883560 - protein, 9 aa, Homo Sapiens
QSSRHDCNL

SEQ ID NO: 883561 - protein, 9 aa, Homo Sapiens
DHTQYQFGI

SEQ ID NO: 883562 - protein, 9 aa, Homo Sapiens
LRKVKHMRN

SEQ ID NO: 883563 - protein, 9 aa, Homo Sapiens
VSYSFLFGF

SEQ ID NO: 883564 - protein, 9 aa, Homo Sapiens
TRAETEELI

SEQ ID NO: 883565 - protein, 9 aa, Homo Sapiens
LQSSLSTSI

SEQ ID NO: 883566 - protein, 9 aa, Homo Sapiens
GVSCEDQDK

SEQ ID NO: 883567 - protein, 9 aa, Homo Sapiens
PLPPWALIT

SEQ ID NO: 883568 - protein, 9 aa, Homo Sapiens
HVLCYVTFI

SEQ ID NO: 883569 - protein, 9 aa, Homo Sapiens
RLEPPKNCP

SEQ ID NO: 883570 - protein, 9 aa, Homo Sapiens
NAMLLKGKG

SEQ ID NO: 883571 - protein, 9 aa, Homo Sapiens
KNAICEESK

SEQ ID NO: 883572 - protein, 9 aa, Homo Sapiens
TLLCFDSRQ

SEQ ID NO: 883573 - protein, 9 aa, Homo Sapiens
ERVFLTHPA

SEQ ID NO: 883574 - protein, 9 aa, Homo Sapiens
PHETLLDIE

SEQ ID NO: 883575 - protein, 9 aa, Homo Sapiens
LKLARYFLW

SEQ ID NO: 883576 - protein, 9 aa, Homo Sapiens
HLQVHTGEK

SEQ ID NO: 883577 - protein, 9 aa, Homo Sapiens
PGDPDHKAS

SEQ ID NO: 883578 - protein, 9 aa, Homo Sapiens
KSKAQMELH

SEQ ID NO: 883579 - protein, 9 aa, Homo Sapiens
SLSQSLVQE

SEQ ID NO: 883580 - protein, 9 aa, Homo Sapiens
VPLATYMQI

SEQ ID NO: 883581 - protein, 9 aa, Homo Sapiens
QRGPAQKKP

SEQ ID NO: 883582 - protein, 9 aa, Homo Sapiens
LSQIQNSIV

SEQ ID NO: 883583 - protein, 9 aa, Homo Sapiens
RRCLKKAID

SEQ ID NO: 883584 - protein, 9 aa, Homo Sapiens
KGITTLPNI

SEQ ID NO: 883585 - protein, 9 aa, Homo Sapiens
AKVCLLREE

SEQ ID NO: 883586 - protein, 9 aa, Homo Sapiens
QSENMLLQQ

SEQ ID NO: 883587 - protein, 9 aa, Homo Sapiens
RGRPRVNKL

SEQ ID NO: 883588 - protein, 9 aa, Homo Sapiens
RRCRTAFTS

SEQ ID NO: 883589 - protein, 9 aa, Homo Sapiens
KTEDNYIRD

SEQ ID NO: 883590 - protein, 9 aa, Homo Sapiens
LSEAKHKQA

SEQ ID NO: 883591 - protein, 9 aa, Homo Sapiens
APRSKRCCV

SEQ ID NO: 883592 - protein, 9 aa, Homo Sapiens
AIQYLLYGE

SEQ ID NO: 883593 - protein, 9 aa, Homo Sapiens
FQRGQYSDS

SEQ ID NO: 883594 - protein, 9 aa, Homo Sapiens
FGLLLSLNL

SEQ ID NO: 883595 - protein, 9 aa, Homo Sapiens
VVFQEAFEI

SEQ ID NO: 883596 - protein, 9 aa, Homo Sapiens
VSESLGEQN

SEQ ID NO: 883597 - protein, 9 aa, Homo Sapiens
QSLVQEGTG

SEQ ID NO: 883598 - protein, 9 aa, Homo Sapiens
DWEKQHLIY

SEQ ID NO: 883599 - protein, 9 aa, Homo Sapiens
KFSYVELHQ

SEQ ID NO: 883600 - protein, 9 aa, Homo Sapiens
LLPKVSYVT

SEQ ID NO: 883601 - protein, 9 aa, Homo Sapiens
SQVDDIFID

SEQ ID NO: 883602 - protein, 9 aa, Homo Sapiens
QTALSNLVV

SEQ ID NO: 883603 - protein, 9 aa, Homo Sapiens
CRAVLCGVT

SEQ ID NO: 883604 - protein, 9 aa, Homo Sapiens
FNLPHNRPY

SEQ ID NO: 883605 - protein, 9 aa, Homo Sapiens
WPCCLVLVP

SEQ ID NO: 883606 - protein, 9 aa, Homo Sapiens
GRPYAGAVH

SEQ ID NO: 883607 - protein, 9 aa, Homo Sapiens
MIHKAQNFV

SEQ ID NO: 883608 - protein, 9 aa, Homo Sapiens
PLLDASLDL

SEQ ID NO: 883609 - protein, 9 aa, Homo Sapiens
HKCGFVVCG

SEQ ID NO: 883610 - protein, 9 aa, Homo Sapiens
VATHAPLAV

SEQ ID NO: 883611 - protein, 9 aa, Homo Sapiens
NNALDNLRK

SEQ ID NO: 883612 - protein, 9 aa, Homo Sapiens
SQLRTLETQ

SEQ ID NO: 883613 - protein, 9 aa, Homo Sapiens
YLICARRSM

SEQ ID NO: 883614 - protein, 9 aa, Homo Sapiens
SITQSYYRN

SEQ ID NO: 883615 - protein, 9 aa, Homo Sapiens
ILIVDPYYS

SEQ ID NO: 883616 - protein, 9 aa, Homo Sapiens
QLESMQLPL

SEQ ID NO: 883617 - protein, 9 aa, Homo Sapiens
KYSELRSQS

SEQ ID NO: 883618 - protein, 9 aa, Homo Sapiens
RRKSESQKK

SEQ ID NO: 883619 - protein, 9 aa, Homo Sapiens
FPASILRAV

SEQ ID NO: 883620 - protein, 9 aa, Homo Sapiens
CQQHDDFAD

SEQ ID NO: 883621 - protein, 9 aa, Homo Sapiens
ANVQVNKAF

SEQ ID NO: 883622 - protein, 9 aa, Homo Sapiens
ERPSYIMSG

SEQ ID NO: 883623 - protein, 9 aa, Homo Sapiens
GLFHGEGVK

SEQ ID NO: 883624 - protein, 9 aa, Homo Sapiens
FLPARLPPG

SEQ ID NO: 883625 - protein, 9 aa, Homo Sapiens
NKDPRDFKH

SEQ ID NO: 883626 - protein, 9 aa, Homo Sapiens
LWTLLQSNV

SEQ ID NO: 883627 - protein, 9 aa, Homo Sapiens
LKLDNILVW

SEQ ID NO: 883628 - protein, 9 aa, Homo Sapiens
TWEKDLRTQ

SEQ ID NO: 883629 - protein, 9 aa, Homo Sapiens
ELKEEFVLK

SEQ ID NO: 883630 - protein, 9 aa, Homo Sapiens
GSLHWRDRV

SEQ ID NO: 883631 - protein, 9 aa, Homo Sapiens
KQYRHIHNF

SEQ ID NO: 883632 - protein, 9 aa, Homo Sapiens
VCLSPRQIK

SEQ ID NO: 883633 - protein, 9 aa, Homo Sapiens
AKKHQRCYD

SEQ ID NO: 883634 - protein, 9 aa, Homo Sapiens
DCVKELCET

SEQ ID NO: 883635 - protein, 9 aa, Homo Sapiens
GSLLGSPDV

SEQ ID NO: 883636 - protein, 9 aa, Homo Sapiens
ASSGVNGVT

SEQ ID NO: 883637 - protein, 9 aa, Homo Sapiens
DLKSWAQGN

SEQ ID NO: 883638 - protein, 9 aa, Homo Sapiens
RNNPIKSIP

SEQ ID NO: 883639 - protein, 9 aa, Homo Sapiens
SREERLWFR

SEQ ID NO: 883640 - protein, 9 aa, Homo Sapiens
FNQEIRLCQ

SEQ ID NO: 883641 - protein, 9 aa, Homo Sapiens
QRHWSSKIN

SEQ ID NO: 883642 - protein, 9 aa, Homo Sapiens
QIYQHHEIY

SEQ ID NO: 883643 - protein, 9 aa, Homo Sapiens
PSTLCSLIS

SEQ ID NO: 883644 - protein, 9 aa, Homo Sapiens
FTSPDASYL

SEQ ID NO: 883645 - protein, 9 aa, Homo Sapiens
KYRNVSYLH

SEQ ID NO: 883646 - protein, 9 aa, Homo Sapiens
NLWTTLAAG

SEQ ID NO: 883647 - protein, 9 aa, Homo Sapiens
LHLLLFLHL

SEQ ID NO: 883648 - protein, 9 aa, Homo Sapiens
YSRVMDLKG

SEQ ID NO: 883649 - protein, 9 aa, Homo Sapiens
LNPQTQTHA

SEQ ID NO: 883650 - protein, 9 aa, Homo Sapiens
HHFKNIPNS

SEQ ID NO: 883651 - protein, 9 aa, Homo Sapiens
MYVSDTTSS

SEQ ID NO: 883652 - protein, 9 aa, Homo Sapiens
ILRSNRFCR

SEQ ID NO: 883653 - protein, 9 aa, Homo Sapiens
RGIQMYKSN

SEQ ID NO: 883654 - protein, 9 aa, Homo Sapiens
NSTLVKITW

SEQ ID NO: 883655 - protein, 9 aa, Homo Sapiens
KVDTLSKDK

SEQ ID NO: 883656 - protein, 9 aa, Homo Sapiens
KCIKDLFMK

SEQ ID NO: 883657 - protein, 9 aa, Homo Sapiens
YNNMLCAGF

SEQ ID NO: 883658 - protein, 9 aa, Homo Sapiens
IGNKSKGEH

SEQ ID NO: 883659 - protein, 9 aa, Homo Sapiens
TKTENSRLV

SEQ ID NO: 883660 - protein, 9 aa, Homo Sapiens
PKFPYTRRQ

SEQ ID NO: 883661 - protein, 9 aa, Homo Sapiens
PFKTFSQGP

SEQ ID NO: 883662 - protein, 9 aa, Homo Sapiens
SLHEKGNRI

SEQ ID NO: 883663 - protein, 9 aa, Homo Sapiens
WDSALHIAT

SEQ ID NO: 883664 - protein, 9 aa, Homo Sapiens
VQFGSDDEG

SEQ ID NO: 883665 - protein, 9 aa, Homo Sapiens
LAAKTLEVT

SEQ ID NO: 883666 - protein, 9 aa, Homo Sapiens
QTRIRGGCR

SEQ ID NO: 883667 - protein, 9 aa, Homo Sapiens
KDYKCIPQS

SEQ ID NO: 883668 - protein, 9 aa, Homo Sapiens
ASGDQSGNL

SEQ ID NO: 883669 - protein, 9 aa, Homo Sapiens
EEDKNALES

SEQ ID NO: 883670 - protein, 9 aa, Homo Sapiens
AVKNLMASE

SEQ ID NO: 883671 - protein, 9 aa, Homo Sapiens
SVLINILEV

SEQ ID NO: 883672 - protein, 9 aa, Homo Sapiens
VYLLHLLRQ

SEQ ID NO: 883673 - protein, 9 aa, Homo Sapiens
EKYDPGYES

SEQ ID NO: 883674 - protein, 9 aa, Homo Sapiens
DLVRSGPFG

SEQ ID NO: 883675 - protein, 9 aa, Homo Sapiens
ASMTKDDSK

SEQ ID NO: 883676 - protein, 9 aa, Homo Sapiens
YNSLDGYYL

SEQ ID NO: 883677 - protein, 9 aa, Homo Sapiens
VLRNEVIHI

SEQ ID NO: 883678 - protein, 9 aa, Homo Sapiens
NIPGKWTTN

SEQ ID NO: 883679 - protein, 9 aa, Homo Sapiens
VSTIGYLNY

SEQ ID NO: 883680 - protein, 9 aa, Homo Sapiens
YCLRLLKPQ

SEQ ID NO: 883681 - protein, 9 aa, Homo Sapiens
REEQDIKIM

SEQ ID NO: 883682 - protein, 9 aa, Homo Sapiens
EELDSEVLN

SEQ ID NO: 883683 - protein, 9 aa, Homo Sapiens
SDGEKVLVV

SEQ ID NO: 883684 - protein, 9 aa, Homo Sapiens
FLDEANGLL

SEQ ID NO: 883685 - protein, 9 aa, Homo Sapiens
LTLNKTSYP

SEQ ID NO: 883686 - protein, 9 aa, Homo Sapiens
TQLAITDYF

SEQ ID NO: 883687 - protein, 9 aa, Homo Sapiens
KITNGSQIE

SEQ ID NO: 883688 - protein, 9 aa, Homo Sapiens
QLHEGAKVL

SEQ ID NO: 883689 - protein, 9 aa, Homo Sapiens
PSAWKWMLG

SEQ ID NO: 883690 - protein, 9 aa, Homo Sapiens
RKDMTNEEK

SEQ ID NO: 883691 - protein, 9 aa, Homo Sapiens
KGKVLCTYM

SEQ ID NO: 883692 - protein, 9 aa, Homo Sapiens
LVSVISISA

SEQ ID NO: 883693 - protein, 9 aa, Homo Sapiens
GLCIWLLIL

SEQ ID NO: 883694 - protein, 9 aa, Homo Sapiens
LFPASILRA

SEQ ID NO: 883695 - protein, 9 aa, Homo Sapiens
KYPKRRMTI

SEQ ID NO: 883696 - protein, 9 aa, Homo Sapiens
SCASTDVEM

SEQ ID NO: 883697 - protein, 9 aa, Homo Sapiens
TCFIIHGFI

SEQ ID NO: 883698 - protein, 9 aa, Homo Sapiens
SLDTTAASA

SEQ ID NO: 883699 - protein, 9 aa, Homo Sapiens
WNVTGNSIR

SEQ ID NO: 883700 - protein, 9 aa, Homo Sapiens
CCLTINLHV

SEQ ID NO: 883701 - protein, 9 aa, Homo Sapiens
AANLQDCYQ

SEQ ID NO: 883702 - protein, 9 aa, Homo Sapiens
DGQAVVWEH

SEQ ID NO: 883703 - protein, 9 aa, Homo Sapiens
IPFYLHVAD

SEQ ID NO: 883704 - protein, 9 aa, Homo Sapiens
EEQARTEIE

SEQ ID NO: 883705 - protein, 9 aa, Homo Sapiens
DDSEELLVT

SEQ ID NO: 883706 - protein, 9 aa, Homo Sapiens
TEARHDHTV

SEQ ID NO: 883707 - protein, 9 aa, Homo Sapiens
DDPNDSGKL

SEQ ID NO: 883708 - protein, 9 aa, Homo Sapiens
MSYQYIRSE

SEQ ID NO: 883709 - protein, 9 aa, Homo Sapiens
MRIWVLKAL

SEQ ID NO: 883710 - protein, 9 aa, Homo Sapiens
KQIALLGLK

SEQ ID NO: 883711 - protein, 9 aa, Homo Sapiens
LCQQHDDFA

SEQ ID NO: 883712 - protein, 9 aa, Homo Sapiens
SLTYPLLFT

SEQ ID NO: 883713 - protein, 9 aa, Homo Sapiens
LKKNIHLWT

SEQ ID NO: 883714 - protein, 9 aa, Homo Sapiens
NKGKNAQPL

SEQ ID NO: 883715 - protein, 9 aa, Homo Sapiens
VTLFFGPCM

SEQ ID NO: 883716 - protein, 9 aa, Homo Sapiens
STVGKSKLM

SEQ ID NO: 883717 - protein, 9 aa, Homo Sapiens
SQEEIICRF

SEQ ID NO: 883718 - protein, 9 aa, Homo Sapiens
GYLNRIHKL

SEQ ID NO: 883719 - protein, 9 aa, Homo Sapiens
DTMNFSGLS

SEQ ID NO: 883720 - protein, 9 aa, Homo Sapiens
NSLYVVRNG

SEQ ID NO: 883721 - protein, 9 aa, Homo Sapiens
PQGIYAISA

SEQ ID NO: 883722 - protein, 9 aa, Homo Sapiens
QKPYKCNEC

SEQ ID NO: 883723 - protein, 9 aa, Homo Sapiens
LYSDRMSEL

SEQ ID NO: 883724 - protein, 9 aa, Homo Sapiens
SPPYLTSTQ

SEQ ID NO: 883725 - protein, 9 aa, Homo Sapiens
NVHPQERPD

SEQ ID NO: 883726 - protein, 9 aa, Homo Sapiens
IPVVIDTDG

SEQ ID NO: 883727 - protein, 9 aa, Homo Sapiens
YIRSEVMEE

SEQ ID NO: 883728 - protein, 9 aa, Homo Sapiens
ATEELLSFV

SEQ ID NO: 883729 - protein, 9 aa, Homo Sapiens
NHIFKHGTV

SEQ ID NO: 883730 - protein, 9 aa, Homo Sapiens
NQVARFNNL

SEQ ID NO: 883731 - protein, 9 aa, Homo Sapiens
NYPDADRLA

SEQ ID NO: 883732 - protein, 9 aa, Homo Sapiens
PTSCDNLVA

SEQ ID NO: 883733 - protein, 9 aa, Homo Sapiens
VSDPPVISE

SEQ ID NO: 883734 - protein, 9 aa, Homo Sapiens
MLLVKRRFA

SEQ ID NO: 883735 - protein, 9 aa, Homo Sapiens
CPKSLSENN

SEQ ID NO: 883736 - protein, 9 aa, Homo Sapiens
ALFFLKDLF

SEQ ID NO: 883737 - protein, 9 aa, Homo Sapiens
LALVIVISM

SEQ ID NO: 883738 - protein, 9 aa, Homo Sapiens
NCPFSQRIF

SEQ ID NO: 883739 - protein, 9 aa, Homo Sapiens
QIVGGKRAQ

SEQ ID NO: 883740 - protein, 9 aa, Homo Sapiens
RVQVVAGNK

SEQ ID NO: 883741 - protein, 9 aa, Homo Sapiens
REKLEKDIL

SEQ ID NO: 883742 - protein, 9 aa, Homo Sapiens
KDLDLENIV

SEQ ID NO: 883743 - protein, 9 aa, Homo Sapiens
RMSELSGCT

SEQ ID NO: 883744 - protein, 9 aa, Homo Sapiens
WVILEELKS

SEQ ID NO: 883745 - protein, 9 aa, Homo Sapiens
LLSSTEYQP

SEQ ID NO: 883746 - protein, 9 aa, Homo Sapiens
STTRKLYLE

SEQ ID NO: 883747 - protein, 9 aa, Homo Sapiens
QNPSCGSDN

SEQ ID NO: 883748 - protein, 9 aa, Homo Sapiens
QKSCILSLS

SEQ ID NO: 883749 - protein, 9 aa, Homo Sapiens
ACCYGFLGQ

SEQ ID NO: 883750 - protein, 9 aa, Homo Sapiens
FWLPDNRIG

SEQ ID NO: 883751 - protein, 9 aa, Homo Sapiens
GPSDLHHCF

SEQ ID NO: 883752 - protein, 9 aa, Homo Sapiens
EIEEIMQES

SEQ ID NO: 883753 - protein, 9 aa, Homo Sapiens
ERCCKLDVD

SEQ ID NO: 883754 - protein, 9 aa, Homo Sapiens
DPKHHLEEH

SEQ ID NO: 883755 - protein, 9 aa, Homo Sapiens
LFIYLPFSI

SEQ ID NO: 883756 - protein, 9 aa, Homo Sapiens
DERPLPAIC

SEQ ID NO: 883757 - protein, 9 aa, Homo Sapiens
DEHPGGHNR

SEQ ID NO: 883758 - protein, 9 aa, Homo Sapiens
LSSSSSSSD

SEQ ID NO: 883759 - protein, 9 aa, Homo Sapiens
AKITITVVY

SEQ ID NO: 883760 - protein, 9 aa, Homo Sapiens
GACHATHTR

SEQ ID NO: 883761 - protein, 9 aa, Homo Sapiens
FISHKLPNS

SEQ ID NO: 883762 - protein, 9 aa, Homo Sapiens
STTVPSVFK

SEQ ID NO: 883763 - protein, 9 aa, Homo Sapiens
CLHYRYFIP

SEQ ID NO: 883764 - protein, 9 aa, Homo Sapiens
VGGTASVCG

SEQ ID NO: 883765 - protein, 9 aa, Homo Sapiens
SPSERACPL

SEQ ID NO: 883766 - protein, 9 aa, Homo Sapiens
PYLSPETSP

SEQ ID NO: 883767 - protein, 9 aa, Homo Sapiens
ALVTYRSFN

SEQ ID NO: 883768 - protein, 9 aa, Homo Sapiens
NDHVQFLIY

SEQ ID NO: 883769 - protein, 9 aa, Homo Sapiens
DCNLLREQY

SEQ ID NO: 883770 - protein, 9 aa, Homo Sapiens
RRLYVPKGF

SEQ ID NO: 883771 - protein, 9 aa, Homo Sapiens
AFAQPKYTV

SEQ ID NO: 883772 - protein, 9 aa, Homo Sapiens
GVACMDVMK

SEQ ID NO: 883773 - protein, 9 aa, Homo Sapiens
THIVHPLLQ

SEQ ID NO: 883774 - protein, 9 aa, Homo Sapiens
SFETDQVIL

SEQ ID NO: 883775 - protein, 9 aa, Homo Sapiens
ALAITSFVA

SEQ ID NO: 883776 - protein, 9 aa, Homo Sapiens
TKLYCFYSE

SEQ ID NO: 883777 - protein, 9 aa, Homo Sapiens
WEKQHLIYQ

SEQ ID NO: 883778 - protein, 9 aa, Homo Sapiens
FAKEGHYSL

SEQ ID NO: 883779 - protein, 9 aa, Homo Sapiens
SHVLEAALE

SEQ ID NO: 883780 - protein, 9 aa, Homo Sapiens
MKSCGIHET

SEQ ID NO: 883781 - protein, 9 aa, Homo Sapiens
HGSDSFIAE

SEQ ID NO: 883782 - protein, 9 aa, Homo Sapiens
NLKLVRLMQ

SEQ ID NO: 883783 - protein, 9 aa, Homo Sapiens
DGDKHSINC

SEQ ID NO: 883784 - protein, 9 aa, Homo Sapiens
DKQLLYDFP

SEQ ID NO: 883785 - protein, 9 aa, Homo Sapiens
HPGGHNRDD

SEQ ID NO: 883786 - protein, 9 aa, Homo Sapiens
RQNGYRALM

SEQ ID NO: 883787 - protein, 9 aa, Homo Sapiens
AFCAKSKSC

SEQ ID NO: 883788 - protein, 9 aa, Homo Sapiens
ISVKNFFQM

SEQ ID NO: 883789 - protein, 9 aa, Homo Sapiens
NKGAGAGNP

SEQ ID NO: 883790 - protein, 9 aa, Homo Sapiens
TFSDLQVYL

SEQ ID NO: 883791 - protein, 9 aa, Homo Sapiens
ATLGKNEGK

SEQ ID NO: 883792 - protein, 9 aa, Homo Sapiens
NKMSAHQYL

SEQ ID NO: 883793 - protein, 9 aa, Homo Sapiens
FCKRMEKEV

SEQ ID NO: 883794 - protein, 9 aa, Homo Sapiens
ISFQHPVND

SEQ ID NO: 883795 - protein, 9 aa, Homo Sapiens
ISTLKSQIK

SEQ ID NO: 883796 - protein, 9 aa, Homo Sapiens
LMNMLWSQM

SEQ ID NO: 883797 - protein, 9 aa, Homo Sapiens
LYANNKYLA

SEQ ID NO: 883798 - protein, 9 aa, Homo Sapiens
RKGADSTGS

SEQ ID NO: 883799 - protein, 9 aa, Homo Sapiens
PQELKEIER

SEQ ID NO: 883800 - protein, 9 aa, Homo Sapiens
EPEKEISGC

SEQ ID NO: 883801 - protein, 9 aa, Homo Sapiens
ILLDIKTQL

SEQ ID NO: 883802 - protein, 9 aa, Homo Sapiens
ENEDVCMIF

SEQ ID NO: 883803 - protein, 9 aa, Homo Sapiens
AAGLHNVFK

SEQ ID NO: 883804 - protein, 9 aa, Homo Sapiens
TQQIRQLFP

SEQ ID NO: 883805 - protein, 9 aa, Homo Sapiens
RLISEDKKD

SEQ ID NO: 883806 - protein, 9 aa, Homo Sapiens
YAKKHQRCY

SEQ ID NO: 883807 - protein, 9 aa, Homo Sapiens
RIQNEKGEI

SEQ ID NO: 883808 - protein, 9 aa, Homo Sapiens
IPSNSTQLP

SEQ ID NO: 883809 - protein, 9 aa, Homo Sapiens
RGVELVCCP

SEQ ID NO: 883810 - protein, 9 aa, Homo Sapiens
LLVTMAYDR

SEQ ID NO: 883811 - protein, 9 aa, Homo Sapiens
CAQKMAKFI

SEQ ID NO: 883812 - protein, 9 aa, Homo Sapiens
LGFKLTSVE

SEQ ID NO: 883813 - protein, 9 aa, Homo Sapiens
IRGHYEQIL

SEQ ID NO: 883814 - protein, 9 aa, Homo Sapiens
MDVLFSFCD

SEQ ID NO: 883815 - protein, 9 aa, Homo Sapiens
QCWLFLVLQ

SEQ ID NO: 883816 - protein, 9 aa, Homo Sapiens
GLFPESYYG

SEQ ID NO: 883817 - protein, 9 aa, Homo Sapiens
EGCAAQGGL

SEQ ID NO: 883818 - protein, 9 aa, Homo Sapiens
GKDKYKVYE

SEQ ID NO: 883819 - protein, 9 aa, Homo Sapiens
ILSMHQKIH

SEQ ID NO: 883820 - protein, 9 aa, Homo Sapiens
KTFHLEFHY

SEQ ID NO: 883821 - protein, 9 aa, Homo Sapiens
GIFCAIFLH

SEQ ID NO: 883822 - protein, 9 aa, Homo Sapiens
IFLSKSQTN

SEQ ID NO: 883823 - protein, 9 aa, Homo Sapiens
RFRLGVVKF

SEQ ID NO: 883824 - protein, 9 aa, Homo Sapiens
VCITINTTI

SEQ ID NO: 883825 - protein, 9 aa, Homo Sapiens
KGASTKQAK

SEQ ID NO: 883826 - protein, 9 aa, Homo Sapiens
EWKYELKIR

SEQ ID NO: 883827 - protein, 9 aa, Homo Sapiens
SAASIGPNP

SEQ ID NO: 883828 - protein, 9 aa, Homo Sapiens
GTGCPRPCA

SEQ ID NO: 883829 - protein, 9 aa, Homo Sapiens
SPVVGMWPD

SEQ ID NO: 883830 - protein, 9 aa, Homo Sapiens
AKYFALPSV

SEQ ID NO: 883831 - protein, 9 aa, Homo Sapiens
QSGMEKICF

SEQ ID NO: 883832 - protein, 9 aa, Homo Sapiens
FTNFLSFMV

SEQ ID NO: 883833 - protein, 9 aa, Homo Sapiens
YTLGMKLLH

SEQ ID NO: 883834 - protein, 9 aa, Homo Sapiens
VRNEPWNIY

SEQ ID NO: 883835 - protein, 9 aa, Homo Sapiens
KVTGMGVQN

SEQ ID NO: 883836 - protein, 9 aa, Homo Sapiens
TDFQTRLRL

SEQ ID NO: 883837 - protein, 9 aa, Homo Sapiens
MACVGLFLL

SEQ ID NO: 883838 - protein, 9 aa, Homo Sapiens
VLIEFAAVN

SEQ ID NO: 883839 - protein, 9 aa, Homo Sapiens
RSHCLYAYG

SEQ ID NO: 883840 - protein, 9 aa, Homo Sapiens
FSVLLPALR

SEQ ID NO: 883841 - protein, 9 aa, Homo Sapiens
EYISLALIS

SEQ ID NO: 883842 - protein, 9 aa, Homo Sapiens
LQKEQNLKA

SEQ ID NO: 883843 - protein, 9 aa, Homo Sapiens
KHKIDLTGI

SEQ ID NO: 883844 - protein, 9 aa, Homo Sapiens
SIEQDKERN

SEQ ID NO: 883845 - protein, 9 aa, Homo Sapiens
WRKDMTNEE

SEQ ID NO: 883846 - protein, 9 aa, Homo Sapiens
RLLETLNAR

SEQ ID NO: 883847 - protein, 9 aa, Homo Sapiens
LIPTGDGHN

SEQ ID NO: 883848 - protein, 9 aa, Homo Sapiens
VKTMSEGSD

SEQ ID NO: 883849 - protein, 9 aa, Homo Sapiens
CYALSLVMW

SEQ ID NO: 883850 - protein, 9 aa, Homo Sapiens
LFSFTKYFI

SEQ ID NO: 883851 - protein, 9 aa, Homo Sapiens
YMAKARITS

SEQ ID NO: 883852 - protein, 9 aa, Homo Sapiens
HAVAIIFHN

SEQ ID NO: 883853 - protein, 9 aa, Homo Sapiens
PKSLSENNS

SEQ ID NO: 883854 - protein, 9 aa, Homo Sapiens
QKRKQSTQD

SEQ ID NO: 883855 - protein, 9 aa, Homo Sapiens
AGVNQDCHF

SEQ ID NO: 883856 - protein, 9 aa, Homo Sapiens
NKFTETKRT

SEQ ID NO: 883857 - protein, 9 aa, Homo Sapiens
PKGQPRTAP

SEQ ID NO: 883858 - protein, 9 aa, Homo Sapiens
QHLASGDQS

SEQ ID NO: 883859 - protein, 9 aa, Homo Sapiens
KCFRNMELK

SEQ ID NO: 883860 - protein, 9 aa, Homo Sapiens
PPQKLMAMQ

SEQ ID NO: 883861 - protein, 9 aa, Homo Sapiens
KIMMEGCEY

SEQ ID NO: 883862 - protein, 9 aa, Homo Sapiens
HIDLRRPHQ

SEQ ID NO: 883863 - protein, 9 aa, Homo Sapiens
HKPIQSGNV

SEQ ID NO: 883864 - protein, 9 aa, Homo Sapiens
SYPVKKTLI

SEQ ID NO: 883865 - protein, 9 aa, Homo Sapiens
TFKFKAESN

SEQ ID NO: 883866 - protein, 9 aa, Homo Sapiens
RVPRFNTIH

SEQ ID NO: 883867 - protein, 9 aa, Homo Sapiens
KQGVPENCN

SEQ ID NO: 883868 - protein, 9 aa, Homo Sapiens
KIKYISREC

SEQ ID NO: 883869 - protein, 9 aa, Homo Sapiens
VEADYSYWA

SEQ ID NO: 883870 - protein, 9 aa, Homo Sapiens
CQLIVNKWE

SEQ ID NO: 883871 - protein, 9 aa, Homo Sapiens
EQKELFAEL

SEQ ID NO: 883872 - protein, 9 aa, Homo Sapiens
QDTMQIIFR

SEQ ID NO: 883873 - protein, 9 aa, Homo Sapiens
CIMGMVEKT

SEQ ID NO: 883874 - protein, 9 aa, Homo Sapiens
QNYKLIKSQ

SEQ ID NO: 883875 - protein, 9 aa, Homo Sapiens
TIIHVAITS

SEQ ID NO: 883876 - protein, 9 aa, Homo Sapiens
LFTAYGPDY

SEQ ID NO: 883877 - protein, 9 aa, Homo Sapiens
ASGLSCHRR

SEQ ID NO: 883878 - protein, 9 aa, Homo Sapiens
SDIGILYIR

SEQ ID NO: 883879 - protein, 9 aa, Homo Sapiens
LFLKRNNLL

SEQ ID NO: 883880 - protein, 9 aa, Homo Sapiens
KADKEFWQK

SEQ ID NO: 883881 - protein, 9 aa, Homo Sapiens
KEEGEGLVP

SEQ ID NO: 883882 - protein, 9 aa, Homo Sapiens
IVQEKHLSR

SEQ ID NO: 883883 - protein, 9 aa, Homo Sapiens
ICCTVSGDL

SEQ ID NO: 883884 - protein, 9 aa, Homo Sapiens
TASVCGEWP

SEQ ID NO: 883885 - protein, 9 aa, Homo Sapiens
VCWHNKGKN

SEQ ID NO: 883886 - protein, 9 aa, Homo Sapiens
GSGYRMLLV

SEQ ID NO: 883887 - protein, 9 aa, Homo Sapiens
SRKSIPKSG

SEQ ID NO: 883888 - protein, 9 aa, Homo Sapiens
TMSFQGTWQ

SEQ ID NO: 883889 - protein, 9 aa, Homo Sapiens
NTLQTTISA

SEQ ID NO: 883890 - protein, 9 aa, Homo Sapiens
HLNYLWNLA

SEQ ID NO: 883891 - protein, 9 aa, Homo Sapiens
LKAMEKMVD

SEQ ID NO: 883892 - protein, 9 aa, Homo Sapiens
PERPINNSP

SEQ ID NO: 883893 - protein, 9 aa, Homo Sapiens
MKINGSLHQ

SEQ ID NO: 883894 - protein, 9 aa, Homo Sapiens
PPYPKNGSI

SEQ ID NO: 883895 - protein, 9 aa, Homo Sapiens
DTCVWEGEG

SEQ ID NO: 883896 - protein, 9 aa, Homo Sapiens
SQKLLQCEL

SEQ ID NO: 883897 - protein, 9 aa, Homo Sapiens
RAQSLSYAF

SEQ ID NO: 883898 - protein, 9 aa, Homo Sapiens
TLTHGDRRA

SEQ ID NO: 883899 - protein, 9 aa, Homo Sapiens
LYPHLYEDT

SEQ ID NO: 883900 - protein, 9 aa, Homo Sapiens
GQRSERNKW

SEQ ID NO: 883901 - protein, 9 aa, Homo Sapiens
GNSCPFRHC

SEQ ID NO: 883902 - protein, 9 aa, Homo Sapiens
TTIYVAHLL

SEQ ID NO: 883903 - protein, 9 aa, Homo Sapiens
QVEKAMGNK

SEQ ID NO: 883904 - protein, 9 aa, Homo Sapiens
KSIDQKNDS

SEQ ID NO: 883905 - protein, 9 aa, Homo Sapiens
DVDNKHCYL

SEQ ID NO: 883906 - protein, 9 aa, Homo Sapiens
DGYYLVACQ

SEQ ID NO: 883907 - protein, 9 aa, Homo Sapiens
KAEEVLLLH

SEQ ID NO: 883908 - protein, 9 aa, Homo Sapiens
NTEAFYKIN

SEQ ID NO: 883909 - protein, 9 aa, Homo Sapiens
KDSSTPYPN

SEQ ID NO: 883910 - protein, 9 aa, Homo Sapiens
QEIWRLHQY

SEQ ID NO: 883911 - protein, 9 aa, Homo Sapiens
SGGNKKISV

SEQ ID NO: 883912 - protein, 9 aa, Homo Sapiens
VAAFAVLAV

SEQ ID NO: 883913 - protein, 9 aa, Homo Sapiens
EEANKLTKL

SEQ ID NO: 883914 - protein, 9 aa, Homo Sapiens
DLFISQSFH

SEQ ID NO: 883915 - protein, 9 aa, Homo Sapiens
FYFNIHPTK

SEQ ID NO: 883916 - protein, 9 aa, Homo Sapiens
SPLLWIRIY

SEQ ID NO: 883917 - protein, 9 aa, Homo Sapiens
EWQDKDLPR

SEQ ID NO: 883918 - protein, 9 aa, Homo Sapiens
MEDVEADKL

SEQ ID NO: 883919 - protein, 9 aa, Homo Sapiens
GAEENGNSN

SEQ ID NO: 883920 - protein, 9 aa, Homo Sapiens
EGRPEWQFF

SEQ ID NO: 883921 - protein, 9 aa, Homo Sapiens
VHDQVLYTA

SEQ ID NO: 883922 - protein, 9 aa, Homo Sapiens
IKNALQLIK

SEQ ID NO: 883923 - protein, 9 aa, Homo Sapiens
PDEHPGGHN

SEQ ID NO: 883924 - protein, 9 aa, Homo Sapiens
YYEMIKNCS

SEQ ID NO: 883925 - protein, 9 aa, Homo Sapiens
CGIEKQLQE

SEQ ID NO: 883926 - protein, 9 aa, Homo Sapiens
DKALKLASV

SEQ ID NO: 883927 - protein, 9 aa, Homo Sapiens
ADDYTSSEL

SEQ ID NO: 883928 - protein, 9 aa, Homo Sapiens
ILYLRFGVQ

SEQ ID NO: 883929 - protein, 9 aa, Homo Sapiens
NTLQSRQTR

SEQ ID NO: 883930 - protein, 9 aa, Homo Sapiens
KATTEERMQ

SEQ ID NO: 883931 - protein, 9 aa, Homo Sapiens
CIFQIHTSR

SEQ ID NO: 883932 - protein, 9 aa, Homo Sapiens
YLVDHKVHF

SEQ ID NO: 883933 - protein, 9 aa, Homo Sapiens
PCMQDQETY

SEQ ID NO: 883934 - protein, 9 aa, Homo Sapiens
LSPYKSKKD

SEQ ID NO: 883935 - protein, 9 aa, Homo Sapiens
FIQEVHTHY

SEQ ID NO: 883936 - protein, 9 aa, Homo Sapiens
EEWKGAAQE

SEQ ID NO: 883937 - protein, 9 aa, Homo Sapiens
LAKNNVLNM

SEQ ID NO: 883938 - protein, 9 aa, Homo Sapiens
MYDLAESYK

SEQ ID NO: 883939 - protein, 9 aa, Homo Sapiens
QLQQEHCFL

SEQ ID NO: 883940 - protein, 9 aa, Homo Sapiens
QAPKGQPRT

SEQ ID NO: 883941 - protein, 9 aa, Homo Sapiens
DQILLHNLE

SEQ ID NO: 883942 - protein, 9 aa, Homo Sapiens
LYNLYRDGR

SEQ ID NO: 883943 - protein, 9 aa, Homo Sapiens
DKIVGLRDR

SEQ ID NO: 883944 - protein, 9 aa, Homo Sapiens
MSIQDLQTL

SEQ ID NO: 883945 - protein, 9 aa, Homo Sapiens
DEDSFRRQQ

SEQ ID NO: 883946 - protein, 9 aa, Homo Sapiens
FTVTDPQNL

SEQ ID NO: 883947 - protein, 9 aa, Homo Sapiens
YCSYVSWDL

SEQ ID NO: 883948 - protein, 9 aa, Homo Sapiens
NLALLTDGI

SEQ ID NO: 883949 - protein, 9 aa, Homo Sapiens
TYQIFREKH

SEQ ID NO: 883950 - protein, 9 aa, Homo Sapiens
HLVLPTDAV

SEQ ID NO: 883951 - protein, 9 aa, Homo Sapiens
VTTVCLKVK

SEQ ID NO: 883952 - protein, 9 aa, Homo Sapiens
ATPGVDLSC

SEQ ID NO: 883953 - protein, 9 aa, Homo Sapiens
RLFLKFFLK

SEQ ID NO: 883954 - protein, 9 aa, Homo Sapiens
GLLSVEEKN

SEQ ID NO: 883955 - protein, 9 aa, Homo Sapiens
DIKFTGDPH

SEQ ID NO: 883956 - protein, 9 aa, Homo Sapiens
LLTRNDHGL

SEQ ID NO: 883957 - protein, 9 aa, Homo Sapiens
ASIGPNPAL

SEQ ID NO: 883958 - protein, 9 aa, Homo Sapiens
CEAREQNKC

SEQ ID NO: 883959 - protein, 9 aa, Homo Sapiens
KQKETLRDF

SEQ ID NO: 883960 - protein, 9 aa, Homo Sapiens
QVDDIFIDS

SEQ ID NO: 883961 - protein, 9 aa, Homo Sapiens
ARSPVTVME

SEQ ID NO: 883962 - protein, 9 aa, Homo Sapiens
DKPRNNKRK

SEQ ID NO: 883963 - protein, 9 aa, Homo Sapiens
FAGKNCMDC

SEQ ID NO: 883964 - protein, 9 aa, Homo Sapiens
NPIIYGFLN

SEQ ID NO: 883965 - protein, 9 aa, Homo Sapiens
SNKSGDQLK

SEQ ID NO: 883966 - protein, 9 aa, Homo Sapiens
RGDSSKLRP

SEQ ID NO: 883967 - protein, 9 aa, Homo Sapiens
LFHGEGVKQ

SEQ ID NO: 883968 - protein, 9 aa, Homo Sapiens
DDDSESRWR

SEQ ID NO: 883969 - protein, 9 aa, Homo Sapiens
KATDVYIQP

SEQ ID NO: 883970 - protein, 9 aa, Homo Sapiens
LPVFPKGNK

SEQ ID NO: 883971 - protein, 9 aa, Homo Sapiens
EKFLFNTKE

SEQ ID NO: 883972 - protein, 9 aa, Homo Sapiens
TFVPINSVN

SEQ ID NO: 883973 - protein, 9 aa, Homo Sapiens
KARINAKAK

SEQ ID NO: 883974 - protein, 9 aa, Homo Sapiens
SYPAKAYAN

SEQ ID NO: 883975 - protein, 9 aa, Homo Sapiens
EESEICYST

SEQ ID NO: 883976 - protein, 9 aa, Homo Sapiens
HNAHRGFFF

SEQ ID NO: 883977 - protein, 9 aa, Homo Sapiens
FSIIELFIY

SEQ ID NO: 883978 - protein, 9 aa, Homo Sapiens
NKNPPARHT

SEQ ID NO: 883979 - protein, 9 aa, Homo Sapiens
VKRPGVTGK

SEQ ID NO: 883980 - protein, 9 aa, Homo Sapiens
LELAKMKEK

SEQ ID NO: 883981 - protein, 9 aa, Homo Sapiens
AIDTWSPSA

SEQ ID NO: 883982 - protein, 9 aa, Homo Sapiens
NAPTFTQIS

SEQ ID NO: 883983 - protein, 9 aa, Homo Sapiens
GGMEVCNLC

SEQ ID NO: 883984 - protein, 9 aa, Homo Sapiens
TDGLWLVAQ

SEQ ID NO: 883985 - protein, 9 aa, Homo Sapiens
TFHLCLTIS

SEQ ID NO: 883986 - protein, 9 aa, Homo Sapiens
VAHTLQNTL

SEQ ID NO: 883987 - protein, 9 aa, Homo Sapiens
WGDCLRTCG

SEQ ID NO: 883988 - protein, 9 aa, Homo Sapiens
KNRNAVPEV

SEQ ID NO: 883989 - protein, 9 aa, Homo Sapiens
SLMASLAAY

SEQ ID NO: 883990 - protein, 9 aa, Homo Sapiens
RMPGKVRRR

SEQ ID NO: 883991 - protein, 9 aa, Homo Sapiens
NESGLELEK

SEQ ID NO: 883992 - protein, 9 aa, Homo Sapiens
PQNILRALD

SEQ ID NO: 883993 - protein, 9 aa, Homo Sapiens
EVIRFQKNN

SEQ ID NO: 883994 - protein, 9 aa, Homo Sapiens
TNIDISNNS

SEQ ID NO: 883995 - protein, 9 aa, Homo Sapiens
VIQFFGVPY

SEQ ID NO: 883996 - protein, 9 aa, Homo Sapiens
VYLDITDCL

SEQ ID NO: 883997 - protein, 9 aa, Homo Sapiens
RLCQLIMAT

SEQ ID NO: 883998 - protein, 9 aa, Homo Sapiens
LLSILKMHF

SEQ ID NO: 883999 - protein, 9 aa, Homo Sapiens
LLIIGLVSV

SEQ ID NO: 884000 - protein, 9 aa, Homo Sapiens
LHWLTGEGM

SEQ ID NO: 884001 - protein, 9 aa, Homo Sapiens
VISMGFGHF

SEQ ID NO: 884002 - protein, 9 aa, Homo Sapiens
SLLKNHIVW

SEQ ID NO: 884003 - protein, 9 aa, Homo Sapiens
HSPSWTFKH

SEQ ID NO: 884004 - protein, 9 aa, Homo Sapiens
IRVVISLQL

SEQ ID NO: 884005 - protein, 9 aa, Homo Sapiens
ETHKCAALR

SEQ ID NO: 884006 - protein, 9 aa, Homo Sapiens
KNGVVKLMF

SEQ ID NO: 884007 - protein, 9 aa, Homo Sapiens
KRWFQFFCS

SEQ ID NO: 884008 - protein, 9 aa, Homo Sapiens
IIRKMIQLP

SEQ ID NO: 884009 - protein, 9 aa, Homo Sapiens
GCQHECVST

SEQ ID NO: 884010 - protein, 9 aa, Homo Sapiens
VERLGKKDT

SEQ ID NO: 884011 - protein, 9 aa, Homo Sapiens
RTNPKSLIT

SEQ ID NO: 884012 - protein, 9 aa, Homo Sapiens
VRILQRMMS

SEQ ID NO: 884013 - protein, 9 aa, Homo Sapiens
FPKKLLERD

SEQ ID NO: 884014 - protein, 9 aa, Homo Sapiens
RFRLWQCGQ

SEQ ID NO: 884015 - protein, 9 aa, Homo Sapiens
KAMTERQSK

SEQ ID NO: 884016 - protein, 9 aa, Homo Sapiens
GGRGTRFLR

SEQ ID NO: 884017 - protein, 9 aa, Homo Sapiens
SALIQTLGK

SEQ ID NO: 884018 - protein, 9 aa, Homo Sapiens
HCFRDDNDH

SEQ ID NO: 884019 - protein, 9 aa, Homo Sapiens
DTEFGDTDM

SEQ ID NO: 884020 - protein, 9 aa, Homo Sapiens
RNNLLIADI

SEQ ID NO: 884021 - protein, 9 aa, Homo Sapiens
MTKVHRSAC

SEQ ID NO: 884022 - protein, 9 aa, Homo Sapiens
DMTNEEKNI

SEQ ID NO: 884023 - protein, 9 aa, Homo Sapiens
NRAFSICFT

SEQ ID NO: 884024 - protein, 9 aa, Homo Sapiens
IYDSKLWEE

SEQ ID NO: 884025 - protein, 9 aa, Homo Sapiens
LGCVYCSYV

SEQ ID NO: 884026 - protein, 9 aa, Homo Sapiens
YCIIVVCSV

SEQ ID NO: 884027 - protein, 9 aa, Homo Sapiens
FMDQNQYAL

SEQ ID NO: 884028 - protein, 9 aa, Homo Sapiens
ATSRTFTTM

SEQ ID NO: 884029 - protein, 9 aa, Homo Sapiens
PKFSTFRAC

SEQ ID NO: 884030 - protein, 9 aa, Homo Sapiens
GVCYNAEKK

SEQ ID NO: 884031 - protein, 9 aa, Homo Sapiens
TNILWLSCF

SEQ ID NO: 884032 - protein, 9 aa, Homo Sapiens
HIHLENNDN

SEQ ID NO: 884033 - protein, 9 aa, Homo Sapiens
VATIANNRN

SEQ ID NO: 884034 - protein, 9 aa, Homo Sapiens
DDSKLIALI

SEQ ID NO: 884035 - protein, 9 aa, Homo Sapiens
EDIPFEQSF

SEQ ID NO: 884036 - protein, 9 aa, Homo Sapiens
HHLEEHVDV

SEQ ID NO: 884037 - protein, 9 aa, Homo Sapiens
NVRLHPHTI

SEQ ID NO: 884038 - protein, 9 aa, Homo Sapiens
YRNVSYLHC

SEQ ID NO: 884039 - protein, 9 aa, Homo Sapiens
CSSSFRLHE

SEQ ID NO: 884040 - protein, 9 aa, Homo Sapiens
NQQTGQRNQ

SEQ ID NO: 884041 - protein, 9 aa, Homo Sapiens
RGSLFSPRQ

SEQ ID NO: 884042 - protein, 9 aa, Homo Sapiens
DFLPQFLQY

SEQ ID NO: 884043 - protein, 9 aa, Homo Sapiens
VEAKDFGAK

SEQ ID NO: 884044 - protein, 9 aa, Homo Sapiens
LLNIFKLNG

SEQ ID NO: 884045 - protein, 9 aa, Homo Sapiens
DTVSNAEKR

SEQ ID NO: 884046 - protein, 9 aa, Homo Sapiens
QRTYEKCFG

SEQ ID NO: 884047 - protein, 9 aa, Homo Sapiens
WESIFYFHP

SEQ ID NO: 884048 - protein, 9 aa, Homo Sapiens
PCHNFAPAP

SEQ ID NO: 884049 - protein, 9 aa, Homo Sapiens
YHNLCIMIQ

SEQ ID NO: 884050 - protein, 9 aa, Homo Sapiens
HMDGKICLW

SEQ ID NO: 884051 - protein, 9 aa, Homo Sapiens
GQMVDNVEL

SEQ ID NO: 884052 - protein, 9 aa, Homo Sapiens
VNSRLALTQ

SEQ ID NO: 884053 - protein, 9 aa, Homo Sapiens
TLPVLPPKL

SEQ ID NO: 884054 - protein, 9 aa, Homo Sapiens
FTRPSHLFQ

SEQ ID NO: 884055 - protein, 9 aa, Homo Sapiens
ITQSYYRNS

SEQ ID NO: 884056 - protein, 9 aa, Homo Sapiens
PTVSRVVYS

SEQ ID NO: 884057 - protein, 9 aa, Homo Sapiens
YCRNLPMIS

SEQ ID NO: 884058 - protein, 9 aa, Homo Sapiens
AELFLADVN

SEQ ID NO: 884059 - protein, 9 aa, Homo Sapiens
RNALQRVCK

SEQ ID NO: 884060 - protein, 9 aa, Homo Sapiens
KVDIRLGLQ

SEQ ID NO: 884061 - protein, 9 aa, Homo Sapiens
SMLSTDTNK

SEQ ID NO: 884062 - protein, 9 aa, Homo Sapiens
THKCAALRI

SEQ ID NO: 884063 - protein, 9 aa, Homo Sapiens
LVLPEIAWV

SEQ ID NO: 884064 - protein, 9 aa, Homo Sapiens
RQPERNCSG

SEQ ID NO: 884065 - protein, 9 aa, Homo Sapiens
LCSLISSSS

SEQ ID NO: 884066 - protein, 9 aa, Homo Sapiens
GNKYFIDFV

SEQ ID NO: 884067 - protein, 9 aa, Homo Sapiens
IDEQMFPCQ

SEQ ID NO: 884068 - protein, 9 aa, Homo Sapiens
LVGLLLFYF

SEQ ID NO: 884069 - protein, 9 aa, Homo Sapiens
KEKPPKTTK

SEQ ID NO: 884070 - protein, 9 aa, Homo Sapiens
QNSTSSWFT

SEQ ID NO: 884071 - protein, 9 aa, Homo Sapiens
DCCKKDLCN

SEQ ID NO: 884072 - protein, 9 aa, Homo Sapiens
PVVIDTDGL

SEQ ID NO: 884073 - protein, 9 aa, Homo Sapiens
KRPPLRELF

SEQ ID NO: 884074 - protein, 9 aa, Homo Sapiens
VIERCCKLD

SEQ ID NO: 884075 - protein, 9 aa, Homo Sapiens
DQTSLLGDS

SEQ ID NO: 884076 - protein, 9 aa, Homo Sapiens
LYPGLSSYN

SEQ ID NO: 884077 - protein, 9 aa, Homo Sapiens
MGPAGVGGT

SEQ ID NO: 884078 - protein, 9 aa, Homo Sapiens
DLDEEDSSN

SEQ ID NO: 884079 - protein, 9 aa, Homo Sapiens
EQFYRKSVR

SEQ ID NO: 884080 - protein, 9 aa, Homo Sapiens
DAMEEVCKV

SEQ ID NO: 884081 - protein, 9 aa, Homo Sapiens
KVSARVCFF

SEQ ID NO: 884082 - protein, 9 aa, Homo Sapiens
RVDQITWIG

SEQ ID NO: 884083 - protein, 9 aa, Homo Sapiens
YHYKFENLN

SEQ ID NO: 884084 - protein, 9 aa, Homo Sapiens
PYTRRQNPS

SEQ ID NO: 884085 - protein, 9 aa, Homo Sapiens
CKLLAQPAD

SEQ ID NO: 884086 - protein, 9 aa, Homo Sapiens
CASWIYYSA

SEQ ID NO: 884087 - protein, 9 aa, Homo Sapiens
SSINKARIN

SEQ ID NO: 884088 - protein, 9 aa, Homo Sapiens
KIVGLRDRI

SEQ ID NO: 884089 - protein, 9 aa, Homo Sapiens
GSLSALNHA

SEQ ID NO: 884090 - protein, 9 aa, Homo Sapiens
GEWDCKSAE

SEQ ID NO: 884091 - protein, 9 aa, Homo Sapiens
ESSEIQEVM

SEQ ID NO: 884092 - protein, 9 aa, Homo Sapiens
MGMVEKTRR

SEQ ID NO: 884093 - protein, 9 aa, Homo Sapiens
HYDPPQKLM

SEQ ID NO: 884094 - protein, 9 aa, Homo Sapiens
QISWPLWTT

SEQ ID NO: 884095 - protein, 9 aa, Homo Sapiens
MSFQGTWQK

SEQ ID NO: 884096 - protein, 9 aa, Homo Sapiens
GGFLIEVNN

SEQ ID NO: 884097 - protein, 9 aa, Homo Sapiens
GSGKGVALI

SEQ ID NO: 884098 - protein, 9 aa, Homo Sapiens
SQIISHYEG

SEQ ID NO: 884099 - protein, 9 aa, Homo Sapiens
GTDTIVLQT

SEQ ID NO: 884100 - protein, 9 aa, Homo Sapiens
GKKNYFSLS

SEQ ID NO: 884101 - protein, 9 aa, Homo Sapiens
NILLYVVGL

SEQ ID NO: 884102 - protein, 9 aa, Homo Sapiens
CLRLLKPQP

SEQ ID NO: 884103 - protein, 9 aa, Homo Sapiens
HREPCLGSI

SEQ ID NO: 884104 - protein, 9 aa, Homo Sapiens
FLADVNNYC

SEQ ID NO: 884105 - protein, 9 aa, Homo Sapiens
LLGSDNPSK

SEQ ID NO: 884106 - protein, 9 aa, Homo Sapiens
QLREICVGI

SEQ ID NO: 884107 - protein, 9 aa, Homo Sapiens
LITLIEAIW

SEQ ID NO: 884108 - protein, 9 aa, Homo Sapiens
FKCPCSLCV

SEQ ID NO: 884109 - protein, 9 aa, Homo Sapiens
TAWREKQQL

SEQ ID NO: 884110 - protein, 9 aa, Homo Sapiens
NTVIFACMF

SEQ ID NO: 884111 - protein, 9 aa, Homo Sapiens
QFLLHLLLF

SEQ ID NO: 884112 - protein, 9 aa, Homo Sapiens
HDTNLTCQV

SEQ ID NO: 884113 - protein, 9 aa, Homo Sapiens
GSGSIISFN

SEQ ID NO: 884114 - protein, 9 aa, Homo Sapiens
VKQCSAGCA

SEQ ID NO: 884115 - protein, 9 aa, Homo Sapiens
SISVSGMSL

SEQ ID NO: 884116 - protein, 9 aa, Homo Sapiens
QNVVLQYGF

SEQ ID NO: 884117 - protein, 9 aa, Homo Sapiens
SKQVNRIDW

SEQ ID NO: 884118 - protein, 9 aa, Homo Sapiens
HVPTVWAIN

SEQ ID NO: 884119 - protein, 9 aa, Homo Sapiens
EVSLTADSQ

SEQ ID NO: 884120 - protein, 9 aa, Homo Sapiens
HSGDLESEA

SEQ ID NO: 884121 - protein, 9 aa, Homo Sapiens
SSIRKPPSS

SEQ ID NO: 884122 - protein, 9 aa, Homo Sapiens
RLTVHWRIH

SEQ ID NO: 884123 - protein, 9 aa, Homo Sapiens
SHTKPSKLP

SEQ ID NO: 884124 - protein, 9 aa, Homo Sapiens
GGQLESMQL

SEQ ID NO: 884125 - protein, 9 aa, Homo Sapiens
IVDDAKVKE

SEQ ID NO: 884126 - protein, 9 aa, Homo Sapiens
SRQLAGDSN

SEQ ID NO: 884127 - protein, 9 aa, Homo Sapiens
TMLGANGFG

SEQ ID NO: 884128 - protein, 9 aa, Homo Sapiens
IHMWADEGS

SEQ ID NO: 884129 - protein, 9 aa, Homo Sapiens
RANWSSICN

SEQ ID NO: 884130 - protein, 9 aa, Homo Sapiens
LYMVNSKYV

SEQ ID NO: 884131 - protein, 9 aa, Homo Sapiens
MFKDQMVYT

SEQ ID NO: 884132 - protein, 9 aa, Homo Sapiens
VKGYWSSLD

SEQ ID NO: 884133 - protein, 9 aa, Homo Sapiens
VTYNNWHGG

SEQ ID NO: 884134 - protein, 9 aa, Homo Sapiens
FGEGTKAVK

SEQ ID NO: 884135 - protein, 9 aa, Homo Sapiens
EELFDFLHV

SEQ ID NO: 884136 - protein, 9 aa, Homo Sapiens
LQQTLNYTV

SEQ ID NO: 884137 - protein, 9 aa, Homo Sapiens
INKGGVSGL

SEQ ID NO: 884138 - protein, 9 aa, Homo Sapiens
HAWDSEEEG

SEQ ID NO: 884139 - protein, 9 aa, Homo Sapiens
RDIPVVIDT

SEQ ID NO: 884140 - protein, 9 aa, Homo Sapiens
DCRLAEVGS

SEQ ID NO: 884141 - protein, 9 aa, Homo Sapiens
RIPHPHLGP

SEQ ID NO: 884142 - protein, 9 aa, Homo Sapiens
YCSPTGTGC

SEQ ID NO: 884143 - protein, 9 aa, Homo Sapiens
SGSKIWAFM

SEQ ID NO: 884144 - protein, 9 aa, Homo Sapiens
LQSENMLLQ

SEQ ID NO: 884145 - protein, 9 aa, Homo Sapiens
SDDRQPQWR

SEQ ID NO: 884146 - protein, 9 aa, Homo Sapiens
TSSHLKAHY

SEQ ID NO: 884147 - protein, 9 aa, Homo Sapiens
EFGVERSVC

SEQ ID NO: 884148 - protein, 9 aa, Homo Sapiens
GNSSGMYTP

SEQ ID NO: 884149 - protein, 9 aa, Homo Sapiens
SITGYPNPP

SEQ ID NO: 884150 - protein, 9 aa, Homo Sapiens
EEGKFILHV

SEQ ID NO: 884151 - protein, 9 aa, Homo Sapiens
LRNNFLNFL

SEQ ID NO: 884152 - protein, 9 aa, Homo Sapiens
GIFATAFNT

SEQ ID NO: 884153 - protein, 9 aa, Homo Sapiens
NETSKTFAC

SEQ ID NO: 884154 - protein, 9 aa, Homo Sapiens
FMGAMPFGV

SEQ ID NO: 884155 - protein, 9 aa, Homo Sapiens
LSWGYRRKA

SEQ ID NO: 884156 - protein, 9 aa, Homo Sapiens
EESVTFQIN

SEQ ID NO: 884157 - protein, 9 aa, Homo Sapiens
AGEVTAPVE

SEQ ID NO: 884158 - protein, 9 aa, Homo Sapiens
DIQKARQHM

SEQ ID NO: 884159 - protein, 9 aa, Homo Sapiens
SSGNIQEQV

SEQ ID NO: 884160 - protein, 9 aa, Homo Sapiens
EQEERLLKQ

SEQ ID NO: 884161 - protein, 9 aa, Homo Sapiens
GGCVPDVLP

SEQ ID NO: 884162 - protein, 9 aa, Homo Sapiens
TLKEHEKMC

SEQ ID NO: 884163 - protein, 9 aa, Homo Sapiens
INLREFFSV

SEQ ID NO: 884164 - protein, 9 aa, Homo Sapiens
FGIWDNHID

SEQ ID NO: 884165 - protein, 9 aa, Homo Sapiens
NIHLWTSYS

SEQ ID NO: 884166 - protein, 9 aa, Homo Sapiens
LFSSLICTT

SEQ ID NO: 884167 - protein, 9 aa, Homo Sapiens
FLDRQRTLV

SEQ ID NO: 884168 - protein, 9 aa, Homo Sapiens
FNVQELARK

SEQ ID NO: 884169 - protein, 9 aa, Homo Sapiens
SGKLTQEKE

SEQ ID NO: 884170 - protein, 9 aa, Homo Sapiens
ILQRCLMET

SEQ ID NO: 884171 - protein, 9 aa, Homo Sapiens
RHDSKRSTC

SEQ ID NO: 884172 - protein, 9 aa, Homo Sapiens
ASCALLCPM

SEQ ID NO: 884173 - protein, 9 aa, Homo Sapiens
VMCRNACRE

SEQ ID NO: 884174 - protein, 9 aa, Homo Sapiens
SNAQDLPQN

SEQ ID NO: 884175 - protein, 9 aa, Homo Sapiens
LARKYMCSS

SEQ ID NO: 884176 - protein, 9 aa, Homo Sapiens
GKPEIVDFA

SEQ ID NO: 884177 - protein, 9 aa, Homo Sapiens
TYRLCDNVW

SEQ ID NO: 884178 - protein, 9 aa, Homo Sapiens
DHSKISKDV

SEQ ID NO: 884179 - protein, 9 aa, Homo Sapiens
AYTGSGDED

SEQ ID NO: 884180 - protein, 9 aa, Homo Sapiens
YNLKSKYCE

SEQ ID NO: 884181 - protein, 9 aa, Homo Sapiens
RLLKIKYRA

SEQ ID NO: 884182 - protein, 9 aa, Homo Sapiens
GWFVPLFGE

SEQ ID NO: 884183 - protein, 9 aa, Homo Sapiens
WVALYNNNV

SEQ ID NO: 884184 - protein, 9 aa, Homo Sapiens
NGRMGVLAF

SEQ ID NO: 884185 - protein, 9 aa, Homo Sapiens
KHQNLAALV

SEQ ID NO: 884186 - protein, 9 aa, Homo Sapiens
ESRRIDVLL

SEQ ID NO: 884187 - protein, 9 aa, Homo Sapiens
DHFDKLPIN

SEQ ID NO: 884188 - protein, 9 aa, Homo Sapiens
ECRPQPRSI

SEQ ID NO: 884189 - protein, 9 aa, Homo Sapiens
RRLCTLPNY

SEQ ID NO: 884190 - protein, 9 aa, Homo Sapiens
AGDFYFGRR

SEQ ID NO: 884191 - protein, 9 aa, Homo Sapiens
SAGVANCSA

SEQ ID NO: 884192 - protein, 9 aa, Homo Sapiens
RTAHLVLPT

SEQ ID NO: 884193 - protein, 9 aa, Homo Sapiens
QSKCPAEGV

SEQ ID NO: 884194 - protein, 9 aa, Homo Sapiens
TQKPYKPFH

SEQ ID NO: 884195 - protein, 9 aa, Homo Sapiens
SPTTIATVI

SEQ ID NO: 884196 - protein, 9 aa, Homo Sapiens
VLSSYLRCC

SEQ ID NO: 884197 - protein, 9 aa, Homo Sapiens
KNNKEEAAE

SEQ ID NO: 884198 - protein, 9 aa, Homo Sapiens
EVDSLLYVN

SEQ ID NO: 884199 - protein, 9 aa, Homo Sapiens
YERECKLPK

SEQ ID NO: 884200 - protein, 9 aa, Homo Sapiens
TRVFERFCR

SEQ ID NO: 884201 - protein, 9 aa, Homo Sapiens
VSVFEVNIQ

SEQ ID NO: 884202 - protein, 9 aa, Homo Sapiens
VKLQTNLQH

SEQ ID NO: 884203 - protein, 9 aa, Homo Sapiens
LAQNISKLH

SEQ ID NO: 884204 - protein, 9 aa, Homo Sapiens
KKYPYFFWT

SEQ ID NO: 884205 - protein, 9 aa, Homo Sapiens
GANDFVVAF

SEQ ID NO: 884206 - protein, 9 aa, Homo Sapiens
TQKGLKVVF

SEQ ID NO: 884207 - protein, 9 aa, Homo Sapiens
LCAGFHEGG

SEQ ID NO: 884208 - protein, 9 aa, Homo Sapiens
HNFQLDMDL

SEQ ID NO: 884209 - protein, 9 aa, Homo Sapiens
GTFLCWIAY

SEQ ID NO: 884210 - protein, 9 aa, Homo Sapiens
RSQQMVTKV

SEQ ID NO: 884211 - protein, 9 aa, Homo Sapiens
LQTLKSHLQ

SEQ ID NO: 884212 - protein, 9 aa, Homo Sapiens
LDKAFEELR

SEQ ID NO: 884213 - protein, 9 aa, Homo Sapiens
FLNKWSGAT

SEQ ID NO: 884214 - protein, 9 aa, Homo Sapiens
HDTHAVATA

SEQ ID NO: 884215 - protein, 9 aa, Homo Sapiens
PYHSCGFSY

SEQ ID NO: 884216 - protein, 9 aa, Homo Sapiens
TTMGLEWED

SEQ ID NO: 884217 - protein, 9 aa, Homo Sapiens
VTVNEVIEE

SEQ ID NO: 884218 - protein, 9 aa, Homo Sapiens
NDGENSVSS

SEQ ID NO: 884219 - protein, 9 aa, Homo Sapiens
VLLIALEGN

SEQ ID NO: 884220 - protein, 9 aa, Homo Sapiens
DIEEELERT

SEQ ID NO: 884221 - protein, 9 aa, Homo Sapiens
IKEQIPLKP

SEQ ID NO: 884222 - protein, 9 aa, Homo Sapiens
DYFQKVILR

SEQ ID NO: 884223 - protein, 9 aa, Homo Sapiens
AKRSRSQTA

SEQ ID NO: 884224 - protein, 9 aa, Homo Sapiens
VTGIPREPS

SEQ ID NO: 884225 - protein, 9 aa, Homo Sapiens
PGSVAQKET

SEQ ID NO: 884226 - protein, 9 aa, Homo Sapiens
DVFDIILMT

SEQ ID NO: 884227 - protein, 9 aa, Homo Sapiens
LQVLLANSA

SEQ ID NO: 884228 - protein, 9 aa, Homo Sapiens
AAGKDGDKN

SEQ ID NO: 884229 - protein, 9 aa, Homo Sapiens
NPFVYYFVS

SEQ ID NO: 884230 - protein, 9 aa, Homo Sapiens
RSEEDHHWP

SEQ ID NO: 884231 - protein, 9 aa, Homo Sapiens
RITVNKETQ

SEQ ID NO: 884232 - protein, 9 aa, Homo Sapiens
KKHSVMSIQ

SEQ ID NO: 884233 - protein, 9 aa, Homo Sapiens
KNIFRICFH

SEQ ID NO: 884234 - protein, 9 aa, Homo Sapiens
IVRTILIDF

SEQ ID NO: 884235 - protein, 9 aa, Homo Sapiens
RNRCRGKIV

SEQ ID NO: 884236 - protein, 9 aa, Homo Sapiens
GVERSVCPT

SEQ ID NO: 884237 - protein, 9 aa, Homo Sapiens
LIHSLLRRE

SEQ ID NO: 884238 - protein, 9 aa, Homo Sapiens
TGIEEANKL

SEQ ID NO: 884239 - protein, 9 aa, Homo Sapiens
LQRPKMLKE

SEQ ID NO: 884240 - protein, 9 aa, Homo Sapiens
KVNKIWDLW

SEQ ID NO: 884241 - protein, 9 aa, Homo Sapiens
GKSIVLNCK

SEQ ID NO: 884242 - protein, 9 aa, Homo Sapiens
IAIVQKVIL

SEQ ID NO: 884243 - protein, 9 aa, Homo Sapiens
RHNEFQSLI

SEQ ID NO: 884244 - protein, 9 aa, Homo Sapiens
HTMNKHSSR

SEQ ID NO: 884245 - protein, 9 aa, Homo Sapiens
SEKITLETS

SEQ ID NO: 884246 - protein, 9 aa, Homo Sapiens
PILELACTD

SEQ ID NO: 884247 - protein, 9 aa, Homo Sapiens
VPEGYKVSQ

SEQ ID NO: 884248 - protein, 9 aa, Homo Sapiens
EKESIARTR

SEQ ID NO: 884249 - protein, 9 aa, Homo Sapiens
LLRHHIIHS

SEQ ID NO: 884250 - protein, 9 aa, Homo Sapiens
FYTMITYML

SEQ ID NO: 884251 - protein, 9 aa, Homo Sapiens
VDKVTGRCN

SEQ ID NO: 884252 - protein, 9 aa, Homo Sapiens
SGACHATHT

SEQ ID NO: 884253 - protein, 9 aa, Homo Sapiens
QSSEEQQQD

SEQ ID NO: 884254 - protein, 9 aa, Homo Sapiens
EAALSWLAN

SEQ ID NO: 884255 - protein, 9 aa, Homo Sapiens
GQRTPFQIG

SEQ ID NO: 884256 - protein, 9 aa, Homo Sapiens
LIQTLGKQL

SEQ ID NO: 884257 - protein, 9 aa, Homo Sapiens
GLIKHQIIH

SEQ ID NO: 884258 - protein, 9 aa, Homo Sapiens
DYSDSAVIN

SEQ ID NO: 884259 - protein, 9 aa, Homo Sapiens
IKPKATETS

SEQ ID NO: 884260 - protein, 9 aa, Homo Sapiens
RPIQFEPPM

SEQ ID NO: 884261 - protein, 9 aa, Homo Sapiens
EPLGSEQLF

SEQ ID NO: 884262 - protein, 9 aa, Homo Sapiens
WRPANVPID

SEQ ID NO: 884263 - protein, 9 aa, Homo Sapiens
FLIDINEES

SEQ ID NO: 884264 - protein, 9 aa, Homo Sapiens
WGRDVLDLG

SEQ ID NO: 884265 - protein, 9 aa, Homo Sapiens
SHTGDKPFG

SEQ ID NO: 884266 - protein, 9 aa, Homo Sapiens
KILEHLESQ

SEQ ID NO: 884267 - protein, 9 aa, Homo Sapiens
ASDKVNLPK

SEQ ID NO: 884268 - protein, 9 aa, Homo Sapiens
EPTKPLVCR

SEQ ID NO: 884269 - protein, 9 aa, Homo Sapiens
HLAEKNIPL

SEQ ID NO: 884270 - protein, 9 aa, Homo Sapiens
KKSMIGKIR

SEQ ID NO: 884271 - protein, 9 aa, Homo Sapiens
YQTAVYPVQ

SEQ ID NO: 884272 - protein, 9 aa, Homo Sapiens
LELDKRIEE

SEQ ID NO: 884273 - protein, 9 aa, Homo Sapiens
IEPMKVFDS

SEQ ID NO: 884274 - protein, 9 aa, Homo Sapiens
KVLAQLWDH

SEQ ID NO: 884275 - protein, 9 aa, Homo Sapiens
IQEQLCAQN

SEQ ID NO: 884276 - protein, 9 aa, Homo Sapiens
DGIPETCEQ

SEQ ID NO: 884277 - protein, 9 aa, Homo Sapiens
RVCIKGAES

SEQ ID NO: 884278 - protein, 9 aa, Homo Sapiens
VDSLLYVNT

SEQ ID NO: 884279 - protein, 9 aa, Homo Sapiens
PHRKHMVFL

SEQ ID NO: 884280 - protein, 9 aa, Homo Sapiens
SISMKPNVE

SEQ ID NO: 884281 - protein, 9 aa, Homo Sapiens
AREKKEESK

SEQ ID NO: 884282 - protein, 9 aa, Homo Sapiens
MDLVDILSF

SEQ ID NO: 884283 - protein, 9 aa, Homo Sapiens
KLWGGQGSS

SEQ ID NO: 884284 - protein, 9 aa, Homo Sapiens
TETPALPGC

SEQ ID NO: 884285 - protein, 9 aa, Homo Sapiens
TKDEPRKRE

SEQ ID NO: 884286 - protein, 9 aa, Homo Sapiens
THNQEKKSQ

SEQ ID NO: 884287 - protein, 9 aa, Homo Sapiens
CLYGRPINV

SEQ ID NO: 884288 - protein, 9 aa, Homo Sapiens
NLPNSIRYH

SEQ ID NO: 884289 - protein, 9 aa, Homo Sapiens
QIDTPPACT

SEQ ID NO: 884290 - protein, 9 aa, Homo Sapiens
RSINKEIHT

SEQ ID NO: 884291 - protein, 9 aa, Homo Sapiens
SQCKLHPDL

SEQ ID NO: 884292 - protein, 9 aa, Homo Sapiens
SEASDKVNL

SEQ ID NO: 884293 - protein, 9 aa, Homo Sapiens
TQYTLSVTA

SEQ ID NO: 884294 - protein, 9 aa, Homo Sapiens
KVAQAKHKP

SEQ ID NO: 884295 - protein, 9 aa, Homo Sapiens
SVESDNYVQ

SEQ ID NO: 884296 - protein, 9 aa, Homo Sapiens
PIKKEDSGI

SEQ ID NO: 884297 - protein, 9 aa, Homo Sapiens
PASPMNFHP

SEQ ID NO: 884298 - protein, 9 aa, Homo Sapiens
NPPGSCGPT

SEQ ID NO: 884299 - protein, 9 aa, Homo Sapiens
ASSDYDWNK

SEQ ID NO: 884300 - protein, 9 aa, Homo Sapiens
LDILTCIEC

SEQ ID NO: 884301 - protein, 9 aa, Homo Sapiens
SSGLQKGTK

SEQ ID NO: 884302 - protein, 9 aa, Homo Sapiens
PERVQPITS

SEQ ID NO: 884303 - protein, 9 aa, Homo Sapiens
LCSLNINVL

SEQ ID NO: 884304 - protein, 9 aa, Homo Sapiens
CAICFGRHY

SEQ ID NO: 884305 - protein, 9 aa, Homo Sapiens
IVPKMASDC

SEQ ID NO: 884306 - protein, 9 aa, Homo Sapiens
QTPGPPPSP

SEQ ID NO: 884307 - protein, 9 aa, Homo Sapiens
AWDTVSNAE

SEQ ID NO: 884308 - protein, 9 aa, Homo Sapiens
WGLLRPEDR

SEQ ID NO: 884309 - protein, 9 aa, Homo Sapiens
IYKQYCLQK

SEQ ID NO: 884310 - protein, 9 aa, Homo Sapiens
VISELLSHN

SEQ ID NO: 884311 - protein, 9 aa, Homo Sapiens
TMTTFECET

SEQ ID NO: 884312 - protein, 9 aa, Homo Sapiens
AFGTGSSNL

SEQ ID NO: 884313 - protein, 9 aa, Homo Sapiens
HRLLVGHAR

SEQ ID NO: 884314 - protein, 9 aa, Homo Sapiens
EVGDKIQIL

SEQ ID NO: 884315 - protein, 9 aa, Homo Sapiens
LHSLLNKEL

SEQ ID NO: 884316 - protein, 9 aa, Homo Sapiens
FGVIPPPPG

SEQ ID NO: 884317 - protein, 9 aa, Homo Sapiens
LLLGYHGLL

SEQ ID NO: 884318 - protein, 9 aa, Homo Sapiens
AEEVVKVTT

SEQ ID NO: 884319 - protein, 9 aa, Homo Sapiens
ILVILGEAT

SEQ ID NO: 884320 - protein, 9 aa, Homo Sapiens
PLKKMANRI

SEQ ID NO: 884321 - protein, 9 aa, Homo Sapiens
KEGMQKQGL

SEQ ID NO: 884322 - protein, 9 aa, Homo Sapiens
IWLLILSYV

SEQ ID NO: 884323 - protein, 9 aa, Homo Sapiens
SDNFLSSIL

SEQ ID NO: 884324 - protein, 9 aa, Homo Sapiens
CVPPLSPLA

SEQ ID NO: 884325 - protein, 9 aa, Homo Sapiens
LSGLQEGTG

SEQ ID NO: 884326 - protein, 9 aa, Homo Sapiens
RAVFPGAPG

SEQ ID NO: 884327 - protein, 9 aa, Homo Sapiens
KNHGKKLQN

SEQ ID NO: 884328 - protein, 9 aa, Homo Sapiens
QSKGESNQM

SEQ ID NO: 884329 - protein, 9 aa, Homo Sapiens
LMLYLVFFA

SEQ ID NO: 884330 - protein, 9 aa, Homo Sapiens
GRDDSENTF

SEQ ID NO: 884331 - protein, 9 aa, Homo Sapiens
QTATECDVR

SEQ ID NO: 884332 - protein, 9 aa, Homo Sapiens
DFGAKSKVS

SEQ ID NO: 884333 - protein, 9 aa, Homo Sapiens
LNKKENNNS

SEQ ID NO: 884334 - protein, 9 aa, Homo Sapiens
LNIVMFIVV

SEQ ID NO: 884335 - protein, 9 aa, Homo Sapiens
KQCGKVFIC

SEQ ID NO: 884336 - protein, 9 aa, Homo Sapiens
SSSSSYSSS

SEQ ID NO: 884337 - protein, 9 aa, Homo Sapiens
LKPHKAQNY

SEQ ID NO: 884338 - protein, 9 aa, Homo Sapiens
EASVQLIPQ

SEQ ID NO: 884339 - protein, 9 aa, Homo Sapiens
EHHLNEMER

SEQ ID NO: 884340 - protein, 9 aa, Homo Sapiens
MKQKYRVCN

SEQ ID NO: 884341 - protein, 9 aa, Homo Sapiens
YKQTFSEPG

SEQ ID NO: 884342 - protein, 9 aa, Homo Sapiens
GDTGVCRRQ

SEQ ID NO: 884343 - protein, 9 aa, Homo Sapiens
LLTDGIIIK

SEQ ID NO: 884344 - protein, 9 aa, Homo Sapiens
VCRDPSEGE

SEQ ID NO: 884345 - protein, 9 aa, Homo Sapiens
VEEISFADD

SEQ ID NO: 884346 - protein, 9 aa, Homo Sapiens
YYTVVKVDT

SEQ ID NO: 884347 - protein, 9 aa, Homo Sapiens
RIQSIPSLL

SEQ ID NO: 884348 - protein, 9 aa, Homo Sapiens
VYSDDLMET

SEQ ID NO: 884349 - protein, 9 aa, Homo Sapiens
NFLHSLRQQ

SEQ ID NO: 884350 - protein, 9 aa, Homo Sapiens
AWAVQNIQN

SEQ ID NO: 884351 - protein, 9 aa, Homo Sapiens
FIHPPTDQG

SEQ ID NO: 884352 - protein, 9 aa, Homo Sapiens
SPKTTIYVA

SEQ ID NO: 884353 - protein, 9 aa, Homo Sapiens
YQKVKTHLR

SEQ ID NO: 884354 - protein, 9 aa, Homo Sapiens
LYKMQNGYE

SEQ ID NO: 884355 - protein, 9 aa, Homo Sapiens
FGNVLSSLQ

SEQ ID NO: 884356 - protein, 9 aa, Homo Sapiens
ENIRYKYPN

SEQ ID NO: 884357 - protein, 9 aa, Homo Sapiens
RNQTRHLPL

SEQ ID NO: 884358 - protein, 9 aa, Homo Sapiens
ENAMKLSII

SEQ ID NO: 884359 - protein, 9 aa, Homo Sapiens
EPVYPIKEA

SEQ ID NO: 884360 - protein, 9 aa, Homo Sapiens
RDKEYPNTA

SEQ ID NO: 884361 - protein, 9 aa, Homo Sapiens
SDSHYHRGY

SEQ ID NO: 884362 - protein, 9 aa, Homo Sapiens
LLSTSVDTV

SEQ ID NO: 884363 - protein, 9 aa, Homo Sapiens
IRIMEPDSL

SEQ ID NO: 884364 - protein, 9 aa, Homo Sapiens
QSQTKSSQM

SEQ ID NO: 884365 - protein, 9 aa, Homo Sapiens
HHWPADIPD

SEQ ID NO: 884366 - protein, 9 aa, Homo Sapiens
SSPVACQTP

SEQ ID NO: 884367 - protein, 9 aa, Homo Sapiens
LVKYPKRRM

SEQ ID NO: 884368 - protein, 9 aa, Homo Sapiens
TSDKREKLE

SEQ ID NO: 884369 - protein, 9 aa, Homo Sapiens
DREKTPKLN

SEQ ID NO: 884370 - protein, 9 aa, Homo Sapiens
GMMAQTHSG

SEQ ID NO: 884371 - protein, 9 aa, Homo Sapiens
QMVQTNMQY

SEQ ID NO: 884372 - protein, 9 aa, Homo Sapiens
LHKHINLFI

SEQ ID NO: 884373 - protein, 9 aa, Homo Sapiens
KPLNGFKSN

SEQ ID NO: 884374 - protein, 9 aa, Homo Sapiens
CKQYRHIHN

SEQ ID NO: 884375 - protein, 9 aa, Homo Sapiens
LFCQAQKKC

SEQ ID NO: 884376 - protein, 9 aa, Homo Sapiens
PANGFLVCY

SEQ ID NO: 884377 - protein, 9 aa, Homo Sapiens
FQQTKLLNG

SEQ ID NO: 884378 - protein, 9 aa, Homo Sapiens
YVPHPSYLS

SEQ ID NO: 884379 - protein, 9 aa, Homo Sapiens
YSSPTPCTL

SEQ ID NO: 884380 - protein, 9 aa, Homo Sapiens
TNLQGRLFI

SEQ ID NO: 884381 - protein, 9 aa, Homo Sapiens
KEVNQARLE

SEQ ID NO: 884382 - protein, 9 aa, Homo Sapiens
NTAVLHQMW

SEQ ID NO: 884383 - protein, 9 aa, Homo Sapiens
TLRKKVNNI

SEQ ID NO: 884384 - protein, 9 aa, Homo Sapiens
SARPPRLIS

SEQ ID NO: 884385 - protein, 9 aa, Homo Sapiens
NAWSLRKAM

SEQ ID NO: 884386 - protein, 9 aa, Homo Sapiens
GNPIEASLY

SEQ ID NO: 884387 - protein, 9 aa, Homo Sapiens
AANQNSNTT

SEQ ID NO: 884388 - protein, 9 aa, Homo Sapiens
EGFDKNEIQ

SEQ ID NO: 884389 - protein, 9 aa, Homo Sapiens
FSFQNHIRI

SEQ ID NO: 884390 - protein, 9 aa, Homo Sapiens
QNRESMGLL

SEQ ID NO: 884391 - protein, 9 aa, Homo Sapiens
FNIMCSTAS

SEQ ID NO: 884392 - protein, 9 aa, Homo Sapiens
VSDWSSRPK

SEQ ID NO: 884393 - protein, 9 aa, Homo Sapiens
EPDHLEEQL

SEQ ID NO: 884394 - protein, 9 aa, Homo Sapiens
KTANKGRPM

SEQ ID NO: 884395 - protein, 9 aa, Homo Sapiens
IEAKANYCQ

SEQ ID NO: 884396 - protein, 9 aa, Homo Sapiens
GKKKAVVIC

SEQ ID NO: 884397 - protein, 9 aa, Homo Sapiens
PKKKIQTAL

SEQ ID NO: 884398 - protein, 9 aa, Homo Sapiens
HFQAGVSKL

SEQ ID NO: 884399 - protein, 9 aa, Homo Sapiens
NPPVMLFDE

SEQ ID NO: 884400 - protein, 9 aa, Homo Sapiens
DIKTQLEQE

SEQ ID NO: 884401 - protein, 9 aa, Homo Sapiens
MNQKNFLSL

SEQ ID NO: 884402 - protein, 9 aa, Homo Sapiens
DKVTGMGVQ

SEQ ID NO: 884403 - protein, 9 aa, Homo Sapiens
LTTVSLNTR

SEQ ID NO: 884404 - protein, 9 aa, Homo Sapiens
ELNAKVCLL

SEQ ID NO: 884405 - protein, 9 aa, Homo Sapiens
VGSNCLENI

SEQ ID NO: 884406 - protein, 9 aa, Homo Sapiens
VKLKTKDSG

SEQ ID NO: 884407 - protein, 9 aa, Homo Sapiens
FASMTKDDS

SEQ ID NO: 884408 - protein, 9 aa, Homo Sapiens
LAFTHLHIN

SEQ ID NO: 884409 - protein, 9 aa, Homo Sapiens
DTTFKNGLK

SEQ ID NO: 884410 - protein, 9 aa, Homo Sapiens
GGEENKSVQ

SEQ ID NO: 884411 - protein, 9 aa, Homo Sapiens
LGYLQARSC

SEQ ID NO: 884412 - protein, 9 aa, Homo Sapiens
HFILALYDR

SEQ ID NO: 884413 - protein, 9 aa, Homo Sapiens
GKTQTFYGL

SEQ ID NO: 884414 - protein, 9 aa, Homo Sapiens
RPGTLLETF

SEQ ID NO: 884415 - protein, 9 aa, Homo Sapiens
WTSSQENDN

SEQ ID NO: 884416 - protein, 9 aa, Homo Sapiens
IVKPHSFMF

SEQ ID NO: 884417 - protein, 9 aa, Homo Sapiens
NFIKNTAPV

SEQ ID NO: 884418 - protein, 9 aa, Homo Sapiens
SSFTKHQCI

SEQ ID NO: 884419 - protein, 9 aa, Homo Sapiens
TIRRTDQLT

SEQ ID NO: 884420 - protein, 9 aa, Homo Sapiens
TLNLDDLDA

SEQ ID NO: 884421 - protein, 9 aa, Homo Sapiens
CLDETAVMT

SEQ ID NO: 884422 - protein, 9 aa, Homo Sapiens
GTLTQNQMT

SEQ ID NO: 884423 - protein, 9 aa, Homo Sapiens
TGNSIRSYC

SEQ ID NO: 884424 - protein, 9 aa, Homo Sapiens
PLLQDALHI

SEQ ID NO: 884425 - protein, 9 aa, Homo Sapiens
RLLKQHVAP

SEQ ID NO: 884426 - protein, 9 aa, Homo Sapiens
DSILNIVKN

SEQ ID NO: 884427 - protein, 9 aa, Homo Sapiens
NSCNRCPKN

SEQ ID NO: 884428 - protein, 9 aa, Homo Sapiens
MMEKIQQEE

SEQ ID NO: 884429 - protein, 9 aa, Homo Sapiens
YNDCFEYFG

SEQ ID NO: 884430 - protein, 9 aa, Homo Sapiens
ATLPSLSAW

SEQ ID NO: 884431 - protein, 9 aa, Homo Sapiens
APMAQFLAQ

SEQ ID NO: 884432 - protein, 9 aa, Homo Sapiens
HLQQAQVTL

SEQ ID NO: 884433 - protein, 9 aa, Homo Sapiens
KELENNIWK

SEQ ID NO: 884434 - protein, 9 aa, Homo Sapiens
NIRAFLTAC

SEQ ID NO: 884435 - protein, 9 aa, Homo Sapiens
ICFHDPSPA

SEQ ID NO: 884436 - protein, 9 aa, Homo Sapiens
NFLSSILGS

SEQ ID NO: 884437 - protein, 9 aa, Homo Sapiens
ANFILLNFS

SEQ ID NO: 884438 - protein, 9 aa, Homo Sapiens
QTAETVPKL

SEQ ID NO: 884439 - protein, 9 aa, Homo Sapiens
QSPGSNSKV

SEQ ID NO: 884440 - protein, 9 aa, Homo Sapiens
QLAAEVTKL

SEQ ID NO: 884441 - protein, 9 aa, Homo Sapiens
RYFELSNYD

SEQ ID NO: 884442 - protein, 9 aa, Homo Sapiens
GVETDNWDG

SEQ ID NO: 884443 - protein, 9 aa, Homo Sapiens
ESKLGKQIH

SEQ ID NO: 884444 - protein, 9 aa, Homo Sapiens
SLLARACCY

SEQ ID NO: 884445 - protein, 9 aa, Homo Sapiens
TCLSNMLKF

SEQ ID NO: 884446 - protein, 9 aa, Homo Sapiens
EDVEADKLS

SEQ ID NO: 884447 - protein, 9 aa, Homo Sapiens
MKEDNVSFL

SEQ ID NO: 884448 - protein, 9 aa, Homo Sapiens
EYSMPCLGT

SEQ ID NO: 884449 - protein, 9 aa, Homo Sapiens
EGIIKAKEY

SEQ ID NO: 884450 - protein, 9 aa, Homo Sapiens
NEPSTRVRC

SEQ ID NO: 884451 - protein, 9 aa, Homo Sapiens
IETELQTEL

SEQ ID NO: 884452 - protein, 9 aa, Homo Sapiens
ALMVETQMK

SEQ ID NO: 884453 - protein, 9 aa, Homo Sapiens
YFMRQQRTI

SEQ ID NO: 884454 - protein, 9 aa, Homo Sapiens
RFKTHNKHL

SEQ ID NO: 884455 - protein, 9 aa, Homo Sapiens
IPQIAHDIF

SEQ ID NO: 884456 - protein, 9 aa, Homo Sapiens
GHGKKVADT

SEQ ID NO: 884457 - protein, 9 aa, Homo Sapiens
KIVVTLTEL

SEQ ID NO: 884458 - protein, 9 aa, Homo Sapiens
KQKEKLWQR

SEQ ID NO: 884459 - protein, 9 aa, Homo Sapiens
SHICYWVLQ

SEQ ID NO: 884460 - protein, 9 aa, Homo Sapiens
CTTKFLAMD

SEQ ID NO: 884461 - protein, 9 aa, Homo Sapiens
LITFNEADK

SEQ ID NO: 884462 - protein, 9 aa, Homo Sapiens
QKTMYLQQY

SEQ ID NO: 884463 - protein, 9 aa, Homo Sapiens
SGREHNFST

SEQ ID NO: 884464 - protein, 9 aa, Homo Sapiens
SEKIWIEII

SEQ ID NO: 884465 - protein, 9 aa, Homo Sapiens
ILIITLASR

SEQ ID NO: 884466 - protein, 9 aa, Homo Sapiens
NAKDPTDPF

SEQ ID NO: 884467 - protein, 9 aa, Homo Sapiens
EPYVFDTAL

SEQ ID NO: 884468 - protein, 9 aa, Homo Sapiens
AGGLVAHLL

SEQ ID NO: 884469 - protein, 9 aa, Homo Sapiens
YSKWLGPEN

SEQ ID NO: 884470 - protein, 9 aa, Homo Sapiens
PILITGATG

SEQ ID NO: 884471 - protein, 9 aa, Homo Sapiens
EEGDKTKTP

SEQ ID NO: 884472 - protein, 9 aa, Homo Sapiens
GCGSTFFRY

SEQ ID NO: 884473 - protein, 9 aa, Homo Sapiens
QFLAQFSMF

SEQ ID NO: 884474 - protein, 9 aa, Homo Sapiens
GRQCWKLKG

SEQ ID NO: 884475 - protein, 9 aa, Homo Sapiens
VSVCVYYKK

SEQ ID NO: 884476 - protein, 9 aa, Homo Sapiens
TAQVFARYL

SEQ ID NO: 884477 - protein, 9 aa, Homo Sapiens
EGCKGFFRQ

SEQ ID NO: 884478 - protein, 9 aa, Homo Sapiens
DTEGIIKAK

SEQ ID NO: 884479 - protein, 9 aa, Homo Sapiens
TLSTIARKL

SEQ ID NO: 884480 - protein, 9 aa, Homo Sapiens
LCKSGRCVN

SEQ ID NO: 884481 - protein, 9 aa, Homo Sapiens
EKLTNIRPI

SEQ ID NO: 884482 - protein, 9 aa, Homo Sapiens
LLLLQAVLW

SEQ ID NO: 884483 - protein, 9 aa, Homo Sapiens
KVKAQICES

SEQ ID NO: 884484 - protein, 9 aa, Homo Sapiens
LDTLGLLWQ

SEQ ID NO: 884485 - protein, 9 aa, Homo Sapiens
ATDKWTLLP

SEQ ID NO: 884486 - protein, 9 aa, Homo Sapiens
GQIVFQRKL

SEQ ID NO: 884487 - protein, 9 aa, Homo Sapiens
WTIITPFTD

SEQ ID NO: 884488 - protein, 9 aa, Homo Sapiens
AALSWLANC

SEQ ID NO: 884489 - protein, 9 aa, Homo Sapiens
DKNHTTIQS

SEQ ID NO: 884490 - protein, 9 aa, Homo Sapiens
MGKEDALIC

SEQ ID NO: 884491 - protein, 9 aa, Homo Sapiens
STIARKLLP

SEQ ID NO: 884492 - protein, 9 aa, Homo Sapiens
GILGQPPNH

SEQ ID NO: 884493 - protein, 9 aa, Homo Sapiens
HLLACLQCS

SEQ ID NO: 884494 - protein, 9 aa, Homo Sapiens
DGTNSPPDA

SEQ ID NO: 884495 - protein, 9 aa, Homo Sapiens
ERCLAALTK

SEQ ID NO: 884496 - protein, 9 aa, Homo Sapiens
TKMSGRGSV

SEQ ID NO: 884497 - protein, 9 aa, Homo Sapiens
SSKLRFQLG

SEQ ID NO: 884498 - protein, 9 aa, Homo Sapiens
TSLASTLVN

SEQ ID NO: 884499 - protein, 9 aa, Homo Sapiens
VYELDNNLK

SEQ ID NO: 884500 - protein, 9 aa, Homo Sapiens
DKISETAQQ

SEQ ID NO: 884501 - protein, 9 aa, Homo Sapiens
EEWQDKDLP

SEQ ID NO: 884502 - protein, 9 aa, Homo Sapiens
FNIHPTKRE

SEQ ID NO: 884503 - protein, 9 aa, Homo Sapiens
GKEIHRALH

SEQ ID NO: 884504 - protein, 9 aa, Homo Sapiens
FRLWQCGQW

SEQ ID NO: 884505 - protein, 9 aa, Homo Sapiens
SYYSRSRSQ

SEQ ID NO: 884506 - protein, 9 aa, Homo Sapiens
PSLQNHYLN

SEQ ID NO: 884507 - protein, 9 aa, Homo Sapiens
SWISSELSL

SEQ ID NO: 884508 - protein, 9 aa, Homo Sapiens
LDGEDGSLD

SEQ ID NO: 884509 - protein, 9 aa, Homo Sapiens
CWHFGDHFC

SEQ ID NO: 884510 - protein, 9 aa, Homo Sapiens
NSFQNTTAS

SEQ ID NO: 884511 - protein, 9 aa, Homo Sapiens
ELFDRTETR

SEQ ID NO: 884512 - protein, 9 aa, Homo Sapiens
CMDVMKDVM

SEQ ID NO: 884513 - protein, 9 aa, Homo Sapiens
VKNLNTTAV

SEQ ID NO: 884514 - protein, 9 aa, Homo Sapiens
RMSFCLANS

SEQ ID NO: 884515 - protein, 9 aa, Homo Sapiens
QREGVSPQN

SEQ ID NO: 884516 - protein, 9 aa, Homo Sapiens
LFCLLEKHQ

SEQ ID NO: 884517 - protein, 9 aa, Homo Sapiens
PEDLLDGCW

SEQ ID NO: 884518 - protein, 9 aa, Homo Sapiens
YWIWENPNL

SEQ ID NO: 884519 - protein, 9 aa, Homo Sapiens
LKAFAANVL

SEQ ID NO: 884520 - protein, 9 aa, Homo Sapiens
TYTLSGLQE

SEQ ID NO: 884521 - protein, 9 aa, Homo Sapiens
SGEEKTKSS

SEQ ID NO: 884522 - protein, 9 aa, Homo Sapiens
NLRLHQIQH

SEQ ID NO: 884523 - protein, 9 aa, Homo Sapiens
LMREITQDF

SEQ ID NO: 884524 - protein, 9 aa, Homo Sapiens
DSKLWEEAT

SEQ ID NO: 884525 - protein, 9 aa, Homo Sapiens
ERDSFLKEP

SEQ ID NO: 884526 - protein, 9 aa, Homo Sapiens
LSAFSFVAP

SEQ ID NO: 884527 - protein, 9 aa, Homo Sapiens
TPPDGERFS

SEQ ID NO: 884528 - protein, 9 aa, Homo Sapiens
WLDQSSRIQ

SEQ ID NO: 884529 - protein, 9 aa, Homo Sapiens
LRHNYQTCF

SEQ ID NO: 884530 - protein, 9 aa, Homo Sapiens
TLISAASKF

SEQ ID NO: 884531 - protein, 9 aa, Homo Sapiens
ELFPASILR

SEQ ID NO: 884532 - protein, 9 aa, Homo Sapiens
VLQIQNILT

SEQ ID NO: 884533 - protein, 9 aa, Homo Sapiens
RVLSQPGGK

SEQ ID NO: 884534 - protein, 9 aa, Homo Sapiens
MCFGGRDYA

SEQ ID NO: 884535 - protein, 9 aa, Homo Sapiens
RWILSVKNN

SEQ ID NO: 884536 - protein, 9 aa, Homo Sapiens
AAVEKGTGA

SEQ ID NO: 884537 - protein, 9 aa, Homo Sapiens
PQLYFSSSG

SEQ ID NO: 884538 - protein, 9 aa, Homo Sapiens
QQHPEAYSH

SEQ ID NO: 884539 - protein, 9 aa, Homo Sapiens
KGYSTSSYC

SEQ ID NO: 884540 - protein, 9 aa, Homo Sapiens
VISSVFSLG

SEQ ID NO: 884541 - protein, 9 aa, Homo Sapiens
IHGSKKTPA

SEQ ID NO: 884542 - protein, 9 aa, Homo Sapiens
ETDQVILQH

SEQ ID NO: 884543 - protein, 9 aa, Homo Sapiens
ATLMINFNG

SEQ ID NO: 884544 - protein, 9 aa, Homo Sapiens
GSAFKKLNN

SEQ ID NO: 884545 - protein, 9 aa, Homo Sapiens
MKIKILGDC

SEQ ID NO: 884546 - protein, 9 aa, Homo Sapiens
TIFTPSYVK

SEQ ID NO: 884547 - protein, 9 aa, Homo Sapiens
ETQTNSSIT

SEQ ID NO: 884548 - protein, 9 aa, Homo Sapiens
SRIESHEYC

SEQ ID NO: 884549 - protein, 9 aa, Homo Sapiens
GAQSQYVCR

SEQ ID NO: 884550 - protein, 9 aa, Homo Sapiens
GCWIYLCGF

SEQ ID NO: 884551 - protein, 9 aa, Homo Sapiens
NFRGQKRKQ

SEQ ID NO: 884552 - protein, 9 aa, Homo Sapiens
AVKLKTKDS

SEQ ID NO: 884553 - protein, 9 aa, Homo Sapiens
ETTYFCPVL

SEQ ID NO: 884554 - protein, 9 aa, Homo Sapiens
CSPCDTNWI

SEQ ID NO: 884555 - protein, 9 aa, Homo Sapiens
DWIINGSKV

SEQ ID NO: 884556 - protein, 9 aa, Homo Sapiens
RIKDTPALH

SEQ ID NO: 884557 - protein, 9 aa, Homo Sapiens
QEHCFLKRR

SEQ ID NO: 884558 - protein, 9 aa, Homo Sapiens
LFINPGILE

SEQ ID NO: 884559 - protein, 9 aa, Homo Sapiens
PLSFKWWNM

SEQ ID NO: 884560 - protein, 9 aa, Homo Sapiens
LTHMPKGMW

SEQ ID NO: 884561 - protein, 9 aa, Homo Sapiens
YVHDARRVY

SEQ ID NO: 884562 - protein, 9 aa, Homo Sapiens
LSVLYNETQ

SEQ ID NO: 884563 - protein, 9 aa, Homo Sapiens
RDDWDIAAA

SEQ ID NO: 884564 - protein, 9 aa, Homo Sapiens
STPMGKGVV

SEQ ID NO: 884565 - protein, 9 aa, Homo Sapiens
DDTNEVKNK

SEQ ID NO: 884566 - protein, 9 aa, Homo Sapiens
PISFVGRMM

SEQ ID NO: 884567 - protein, 9 aa, Homo Sapiens
IDFETSLQI

SEQ ID NO: 884568 - protein, 9 aa, Homo Sapiens
ELIANLPPE

SEQ ID NO: 884569 - protein, 9 aa, Homo Sapiens
LCSLPQAWA

SEQ ID NO: 884570 - protein, 9 aa, Homo Sapiens
AHLVPEPDH

SEQ ID NO: 884571 - protein, 9 aa, Homo Sapiens
LVNSRLALT

SEQ ID NO: 884572 - protein, 9 aa, Homo Sapiens
RSMLETINK

SEQ ID NO: 884573 - protein, 9 aa, Homo Sapiens
TEQEERRKI

SEQ ID NO: 884574 - protein, 9 aa, Homo Sapiens
ISSGNIQEQ

SEQ ID NO: 884575 - protein, 9 aa, Homo Sapiens
VFNNLFMRG

SEQ ID NO: 884576 - protein, 9 aa, Homo Sapiens
RTPQEMIDI

SEQ ID NO: 884577 - protein, 9 aa, Homo Sapiens
VDVQRVPRN

SEQ ID NO: 884578 - protein, 9 aa, Homo Sapiens
VKTHLRCQS

SEQ ID NO: 884579 - protein, 9 aa, Homo Sapiens
LPPWALITI

SEQ ID NO: 884580 - protein, 9 aa, Homo Sapiens
FLGGLAVSD

SEQ ID NO: 884581 - protein, 9 aa, Homo Sapiens
TKNIHPWVK

SEQ ID NO: 884582 - protein, 9 aa, Homo Sapiens
RSVQFLKST

SEQ ID NO: 884583 - protein, 9 aa, Homo Sapiens
QKFICGFCH

SEQ ID NO: 884584 - protein, 9 aa, Homo Sapiens
IDDNRKFYL

SEQ ID NO: 884585 - protein, 9 aa, Homo Sapiens
MESTGKLGK

SEQ ID NO: 884586 - protein, 9 aa, Homo Sapiens
VDVQFVRMI

SEQ ID NO: 884587 - protein, 9 aa, Homo Sapiens
INKTINTTL

SEQ ID NO: 884588 - protein, 9 aa, Homo Sapiens
LSEVKYQMD

SEQ ID NO: 884589 - protein, 9 aa, Homo Sapiens
KAIDITECM

SEQ ID NO: 884590 - protein, 9 aa, Homo Sapiens
PQPLNIIEG

SEQ ID NO: 884591 - protein, 9 aa, Homo Sapiens
NLCCQSFKW

SEQ ID NO: 884592 - protein, 9 aa, Homo Sapiens
QNQMTVAHM

SEQ ID NO: 884593 - protein, 9 aa, Homo Sapiens
ENGGTSLSD

SEQ ID NO: 884594 - protein, 9 aa, Homo Sapiens
YQLSSNEHL

SEQ ID NO: 884595 - protein, 9 aa, Homo Sapiens
GLVSVIIPT

SEQ ID NO: 884596 - protein, 9 aa, Homo Sapiens
DRILVVNND

SEQ ID NO: 884597 - protein, 9 aa, Homo Sapiens
SELWCMERK

SEQ ID NO: 884598 - protein, 9 aa, Homo Sapiens
VACMDVMKD

SEQ ID NO: 884599 - protein, 9 aa, Homo Sapiens
IYLLANSGL

SEQ ID NO: 884600 - protein, 9 aa, Homo Sapiens
LVAVYKTVP

SEQ ID NO: 884601 - protein, 9 aa, Homo Sapiens
NRWLRTIFI

SEQ ID NO: 884602 - protein, 9 aa, Homo Sapiens
LLVRLCPPV

SEQ ID NO: 884603 - protein, 9 aa, Homo Sapiens
PRVIKEAVS

SEQ ID NO: 884604 - protein, 9 aa, Homo Sapiens
QVGGKKRLC

SEQ ID NO: 884605 - protein, 9 aa, Homo Sapiens
ISVTIIHVA

SEQ ID NO: 884606 - protein, 9 aa, Homo Sapiens
ANLGYARGI

SEQ ID NO: 884607 - protein, 9 aa, Homo Sapiens
EDIQAFENT

SEQ ID NO: 884608 - protein, 9 aa, Homo Sapiens
KYLAKWMVH

SEQ ID NO: 884609 - protein, 9 aa, Homo Sapiens
NMTTNKRRV

SEQ ID NO: 884610 - protein, 9 aa, Homo Sapiens
EIEKIWQKV

SEQ ID NO: 884611 - protein, 9 aa, Homo Sapiens
QESEHKPPP

SEQ ID NO: 884612 - protein, 9 aa, Homo Sapiens
QVLAKNNVL

SEQ ID NO: 884613 - protein, 9 aa, Homo Sapiens
VTLITVCWH

SEQ ID NO: 884614 - protein, 9 aa, Homo Sapiens
WLATALAGL

SEQ ID NO: 884615 - protein, 9 aa, Homo Sapiens
TSEEKDPEK

SEQ ID NO: 884616 - protein, 9 aa, Homo Sapiens
TLRKGADST

SEQ ID NO: 884617 - protein, 9 aa, Homo Sapiens
DKLSQLQKT

SEQ ID NO: 884618 - protein, 9 aa, Homo Sapiens
PLWSQTPEL

SEQ ID NO: 884619 - protein, 9 aa, Homo Sapiens
DCPSSEKIT

SEQ ID NO: 884620 - protein, 9 aa, Homo Sapiens
PTQPPVMPQ

SEQ ID NO: 884621 - protein, 9 aa, Homo Sapiens
IKTLANMKV

SEQ ID NO: 884622 - protein, 9 aa, Homo Sapiens
NVFAIFIGS

SEQ ID NO: 884623 - protein, 9 aa, Homo Sapiens
NSFQQQPLP

SEQ ID NO: 884624 - protein, 9 aa, Homo Sapiens
TQEQRTQIN

SEQ ID NO: 884625 - protein, 9 aa, Homo Sapiens
ARVPRFNTI

SEQ ID NO: 884626 - protein, 9 aa, Homo Sapiens
QELARKNIH

SEQ ID NO: 884627 - protein, 9 aa, Homo Sapiens
KLSLIGIQE

SEQ ID NO: 884628 - protein, 9 aa, Homo Sapiens
QFESQIISH

SEQ ID NO: 884629 - protein, 9 aa, Homo Sapiens
HSGEISEIK

SEQ ID NO: 884630 - protein, 9 aa, Homo Sapiens
KIYNFWLPR

SEQ ID NO: 884631 - protein, 9 aa, Homo Sapiens
SAHHLLPLS

SEQ ID NO: 884632 - protein, 9 aa, Homo Sapiens
RQKWSVENT

SEQ ID NO: 884633 - protein, 9 aa, Homo Sapiens
IYALMPSFD

SEQ ID NO: 884634 - protein, 9 aa, Homo Sapiens
CSLGRAVRV

SEQ ID NO: 884635 - protein, 9 aa, Homo Sapiens
HKLNVEIEE

SEQ ID NO: 884636 - protein, 9 aa, Homo Sapiens
QPLGNGITI

SEQ ID NO: 884637 - protein, 9 aa, Homo Sapiens
KTTIYVAHL

SEQ ID NO: 884638 - protein, 9 aa, Homo Sapiens
QTANKDPIK

SEQ ID NO: 884639 - protein, 9 aa, Homo Sapiens
LHQLGSKYI

SEQ ID NO: 884640 - protein, 9 aa, Homo Sapiens
YNYVHDARR

SEQ ID NO: 884641 - protein, 9 aa, Homo Sapiens
VYGRCMWYC

SEQ ID NO: 884642 - protein, 9 aa, Homo Sapiens
TSTQSLSPM

SEQ ID NO: 884643 - protein, 9 aa, Homo Sapiens
DTWSPSAWQ

SEQ ID NO: 884644 - protein, 9 aa, Homo Sapiens
QLYASEHYS

SEQ ID NO: 884645 - protein, 9 aa, Homo Sapiens
NIRVILGQQ

SEQ ID NO: 884646 - protein, 9 aa, Homo Sapiens
FAKGRQKAF

SEQ ID NO: 884647 - protein, 9 aa, Homo Sapiens
MSKYANFGL

SEQ ID NO: 884648 - protein, 9 aa, Homo Sapiens
NFLLAVVCL

SEQ ID NO: 884649 - protein, 9 aa, Homo Sapiens
MGVQNGTDK

SEQ ID NO: 884650 - protein, 9 aa, Homo Sapiens
CSIECYSIN

SEQ ID NO: 884651 - protein, 9 aa, Homo Sapiens
TGDKPFECN

SEQ ID NO: 884652 - protein, 9 aa, Homo Sapiens
ATKDTYDTL

SEQ ID NO: 884653 - protein, 9 aa, Homo Sapiens
FVKFLEINE

SEQ ID NO: 884654 - protein, 9 aa, Homo Sapiens
QSHDYPVKA

SEQ ID NO: 884655 - protein, 9 aa, Homo Sapiens
EASLYGLDL

SEQ ID NO: 884656 - protein, 9 aa, Homo Sapiens
SRKKQELAF

SEQ ID NO: 884657 - protein, 9 aa, Homo Sapiens
AVVPSCIPL

SEQ ID NO: 884658 - protein, 9 aa, Homo Sapiens
RQAEFSGEC

SEQ ID NO: 884659 - protein, 9 aa, Homo Sapiens
LNCPRNADM

SEQ ID NO: 884660 - protein, 9 aa, Homo Sapiens
MYLGEIVRT

SEQ ID NO: 884661 - protein, 9 aa, Homo Sapiens
PQIQPFQNL

SEQ ID NO: 884662 - protein, 9 aa, Homo Sapiens
YSVGISVLH

SEQ ID NO: 884663 - protein, 9 aa, Homo Sapiens
QAKLYESIM

SEQ ID NO: 884664 - protein, 9 aa, Homo Sapiens
KMPITANLV

SEQ ID NO: 884665 - protein, 9 aa, Homo Sapiens
VNKRRQELE

SEQ ID NO: 884666 - protein, 9 aa, Homo Sapiens
KAADTVVFL

SEQ ID NO: 884667 - protein, 9 aa, Homo Sapiens
YASGTTAKT

SEQ ID NO: 884668 - protein, 9 aa, Homo Sapiens
RQDGNQFYI

SEQ ID NO: 884669 - protein, 9 aa, Homo Sapiens
SNLFLAEHH

SEQ ID NO: 884670 - protein, 9 aa, Homo Sapiens
SRVLSMYEE

SEQ ID NO: 884671 - protein, 9 aa, Homo Sapiens
MFKTFHLEF

SEQ ID NO: 884672 - protein, 9 aa, Homo Sapiens
EKDTMKFLN

SEQ ID NO: 884673 - protein, 9 aa, Homo Sapiens
IQNAVVFQE

SEQ ID NO: 884674 - protein, 9 aa, Homo Sapiens
VRVLHSRDA

SEQ ID NO: 884675 - protein, 9 aa, Homo Sapiens
HLTIIPPNK

SEQ ID NO: 884676 - protein, 9 aa, Homo Sapiens
DLTQADHLA

SEQ ID NO: 884677 - protein, 9 aa, Homo Sapiens
NLAVEKRNF

SEQ ID NO: 884678 - protein, 9 aa, Homo Sapiens
AVCATDMRP

SEQ ID NO: 884679 - protein, 9 aa, Homo Sapiens
VKQIALLGL

SEQ ID NO: 884680 - protein, 9 aa, Homo Sapiens
TVTVCLFVL

SEQ ID NO: 884681 - protein, 9 aa, Homo Sapiens
GAMPFGVSE

SEQ ID NO: 884682 - protein, 9 aa, Homo Sapiens
EIHNYNITT

SEQ ID NO: 884683 - protein, 9 aa, Homo Sapiens
WKTAEKWFI

SEQ ID NO: 884684 - protein, 9 aa, Homo Sapiens
EKKAVLAGY

SEQ ID NO: 884685 - protein, 9 aa, Homo Sapiens
AAVYSEMIY

SEQ ID NO: 884686 - protein, 9 aa, Homo Sapiens
PWRNMDDDH

SEQ ID NO: 884687 - protein, 9 aa, Homo Sapiens
PNELPYNDC

SEQ ID NO: 884688 - protein, 9 aa, Homo Sapiens
ILVIDKAKI

SEQ ID NO: 884689 - protein, 9 aa, Homo Sapiens
DLCLAAGSK

SEQ ID NO: 884690 - protein, 9 aa, Homo Sapiens
QIFFNPQGD

SEQ ID NO: 884691 - protein, 9 aa, Homo Sapiens
DEKLHKLKK

SEQ ID NO: 884692 - protein, 9 aa, Homo Sapiens
IHKIIHTER

SEQ ID NO: 884693 - protein, 9 aa, Homo Sapiens
SKRSTCSIL

SEQ ID NO: 884694 - protein, 9 aa, Homo Sapiens
QQMNQKNFL

SEQ ID NO: 884695 - protein, 9 aa, Homo Sapiens
QTVANVTGN

SEQ ID NO: 884696 - protein, 9 aa, Homo Sapiens
IRADNIISK

SEQ ID NO: 884697 - protein, 9 aa, Homo Sapiens
KDSGACKIH

SEQ ID NO: 884698 - protein, 9 aa, Homo Sapiens
GLKKDYFSQ

SEQ ID NO: 884699 - protein, 9 aa, Homo Sapiens
HRIQEQLCA

SEQ ID NO: 884700 - protein, 9 aa, Homo Sapiens
VTRKLETHK

SEQ ID NO: 884701 - protein, 9 aa, Homo Sapiens
TPWRQIPGG

SEQ ID NO: 884702 - protein, 9 aa, Homo Sapiens
YPPPVAPSR

SEQ ID NO: 884703 - protein, 9 aa, Homo Sapiens
MGSGFAGGE

SEQ ID NO: 884704 - protein, 9 aa, Homo Sapiens
EGVPIGAII

SEQ ID NO: 884705 - protein, 9 aa, Homo Sapiens
QGSDHENSL

SEQ ID NO: 884706 - protein, 9 aa, Homo Sapiens
NVALDVGIS

SEQ ID NO: 884707 - protein, 9 aa, Homo Sapiens
RFFLMLGGT

SEQ ID NO: 884708 - protein, 9 aa, Homo Sapiens
VPIGAIIFG

SEQ ID NO: 884709 - protein, 9 aa, Homo Sapiens
SLPQAWALF

SEQ ID NO: 884710 - protein, 9 aa, Homo Sapiens
LDHYTYSAN

SEQ ID NO: 884711 - protein, 9 aa, Homo Sapiens
KVKDEKICQ

SEQ ID NO: 884712 - protein, 9 aa, Homo Sapiens
TENSRLVSQ

SEQ ID NO: 884713 - protein, 9 aa, Homo Sapiens
GIKWDYIAT

SEQ ID NO: 884714 - protein, 9 aa, Homo Sapiens
ERPINNSPE

SEQ ID NO: 884715 - protein, 9 aa, Homo Sapiens
GWCECDDGF

SEQ ID NO: 884716 - protein, 9 aa, Homo Sapiens
TRKPTVIQI

SEQ ID NO: 884717 - protein, 9 aa, Homo Sapiens
SEFWLGNEH

SEQ ID NO: 884718 - protein, 9 aa, Homo Sapiens
VQICITVFQ

SEQ ID NO: 884719 - protein, 9 aa, Homo Sapiens
VGTMQWLIE

SEQ ID NO: 884720 - protein, 9 aa, Homo Sapiens
PELAEELCR

SEQ ID NO: 884721 - protein, 9 aa, Homo Sapiens
SYKENAMKL

SEQ ID NO: 884722 - protein, 9 aa, Homo Sapiens
ELALAGQTA

SEQ ID NO: 884723 - protein, 9 aa, Homo Sapiens
LARKNIHGV

SEQ ID NO: 884724 - protein, 9 aa, Homo Sapiens
PPNKSHGSC

SEQ ID NO: 884725 - protein, 9 aa, Homo Sapiens
DKITAVSLD

SEQ ID NO: 884726 - protein, 9 aa, Homo Sapiens
REQLAKNLV

SEQ ID NO: 884727 - protein, 9 aa, Homo Sapiens
SFNLIGEST

SEQ ID NO: 884728 - protein, 9 aa, Homo Sapiens
GEMDIRNIF

SEQ ID NO: 884729 - protein, 9 aa, Homo Sapiens
IIPASLLDR

SEQ ID NO: 884730 - protein, 9 aa, Homo Sapiens
HGESTANEN

SEQ ID NO: 884731 - protein, 9 aa, Homo Sapiens
SVAISTSTD

SEQ ID NO: 884732 - protein, 9 aa, Homo Sapiens
LDRLGRTAL

SEQ ID NO: 884733 - protein, 9 aa, Homo Sapiens
SVSFRRYSC

SEQ ID NO: 884734 - protein, 9 aa, Homo Sapiens
SKKAENDLT

SEQ ID NO: 884735 - protein, 9 aa, Homo Sapiens
LNCIMGMVE

SEQ ID NO: 884736 - protein, 9 aa, Homo Sapiens
LINILEVRG

SEQ ID NO: 884737 - protein, 9 aa, Homo Sapiens
YNIPVRKPA

SEQ ID NO: 884738 - protein, 9 aa, Homo Sapiens
HNLDALLNQ

SEQ ID NO: 884739 - protein, 9 aa, Homo Sapiens
TSGTVSSQK

SEQ ID NO: 884740 - protein, 9 aa, Homo Sapiens
LYWIFTVNH

SEQ ID NO: 884741 - protein, 9 aa, Homo Sapiens
CKHGKVCKL

SEQ ID NO: 884742 - protein, 9 aa, Homo Sapiens
LKRHFMFQN

SEQ ID NO: 884743 - protein, 9 aa, Homo Sapiens
SSILVMYYL

SEQ ID NO: 884744 - protein, 9 aa, Homo Sapiens
KVDPYHSCG

SEQ ID NO: 884745 - protein, 9 aa, Homo Sapiens
QAVCLKCVM

SEQ ID NO: 884746 - protein, 9 aa, Homo Sapiens
SVAQKETTE

SEQ ID NO: 884747 - protein, 9 aa, Homo Sapiens
LLQFSLEKY

SEQ ID NO: 884748 - protein, 9 aa, Homo Sapiens
NQVYYVEEG

SEQ ID NO: 884749 - protein, 9 aa, Homo Sapiens
NKKKKAKRD

SEQ ID NO: 884750 - protein, 9 aa, Homo Sapiens
ALEELVNAS

SEQ ID NO: 884751 - protein, 9 aa, Homo Sapiens
SGEERDIQY

SEQ ID NO: 884752 - protein, 9 aa, Homo Sapiens
ACTTDGRSN

SEQ ID NO: 884753 - protein, 9 aa, Homo Sapiens
DNLPLKLEK

SEQ ID NO: 884754 - protein, 9 aa, Homo Sapiens
TEISQRHRE

SEQ ID NO: 884755 - protein, 9 aa, Homo Sapiens
FEFTKPKRS

SEQ ID NO: 884756 - protein, 9 aa, Homo Sapiens
SLQNTFTTG

SEQ ID NO: 884757 - protein, 9 aa, Homo Sapiens
THGQSHYRH

SEQ ID NO: 884758 - protein, 9 aa, Homo Sapiens
SDSSLEKNY

SEQ ID NO: 884759 - protein, 9 aa, Homo Sapiens
EDIKTLILE

SEQ ID NO: 884760 - protein, 9 aa, Homo Sapiens
CSDNNLGSL

SEQ ID NO: 884761 - protein, 9 aa, Homo Sapiens
NVVVLTVKA

SEQ ID NO: 884762 - protein, 9 aa, Homo Sapiens
HGSKKTPAK

SEQ ID NO: 884763 - protein, 9 aa, Homo Sapiens
YLRIVPKKP

SEQ ID NO: 884764 - protein, 9 aa, Homo Sapiens
PINLVIDER

SEQ ID NO: 884765 - protein, 9 aa, Homo Sapiens
GGKPILITG

SEQ ID NO: 884766 - protein, 9 aa, Homo Sapiens
RKFYNKSKD

SEQ ID NO: 884767 - protein, 9 aa, Homo Sapiens
KRCCVLERK

SEQ ID NO: 884768 - protein, 9 aa, Homo Sapiens
ELAKYSELR

SEQ ID NO: 884769 - protein, 9 aa, Homo Sapiens
SQVFQAPHR

SEQ ID NO: 884770 - protein, 9 aa, Homo Sapiens
KKSINKTPK

SEQ ID NO: 884771 - protein, 9 aa, Homo Sapiens
TDVYIQPIT

SEQ ID NO: 884772 - protein, 9 aa, Homo Sapiens
KQAFCVLSE

SEQ ID NO: 884773 - protein, 9 aa, Homo Sapiens
SYFSSPNVS

SEQ ID NO: 884774 - protein, 9 aa, Homo Sapiens
LCHPVWSAV

SEQ ID NO: 884775 - protein, 9 aa, Homo Sapiens
HEIIITVST

SEQ ID NO: 884776 - protein, 9 aa, Homo Sapiens
RLAADFSVS

SEQ ID NO: 884777 - protein, 9 aa, Homo Sapiens
LVAMCRTAL

SEQ ID NO: 884778 - protein, 9 aa, Homo Sapiens
WEHNEQVKN

SEQ ID NO: 884779 - protein, 9 aa, Homo Sapiens
TFKHLVYQV

SEQ ID NO: 884780 - protein, 9 aa, Homo Sapiens
NTIINSGFQ

SEQ ID NO: 884781 - protein, 9 aa, Homo Sapiens
LAVVDGGQA

SEQ ID NO: 884782 - protein, 9 aa, Homo Sapiens
GASTIRTSS

SEQ ID NO: 884783 - protein, 9 aa, Homo Sapiens
FPSLLEDND

SEQ ID NO: 884784 - protein, 9 aa, Homo Sapiens
QATKLSGGQ

SEQ ID NO: 884785 - protein, 9 aa, Homo Sapiens
PAWICEGLE

SEQ ID NO: 884786 - protein, 9 aa, Homo Sapiens
DKKPKEKKK

SEQ ID NO: 884787 - protein, 9 aa, Homo Sapiens
CIAETWLGS

SEQ ID NO: 884788 - protein, 9 aa, Homo Sapiens
VDIENVVRK

SEQ ID NO: 884789 - protein, 9 aa, Homo Sapiens
LDYKKERIC

SEQ ID NO: 884790 - protein, 9 aa, Homo Sapiens
RGRAVEVWW

SEQ ID NO: 884791 - protein, 9 aa, Homo Sapiens
VDKYLGTNA

SEQ ID NO: 884792 - protein, 9 aa, Homo Sapiens
LVRGSGKGG

SEQ ID NO: 884793 - protein, 9 aa, Homo Sapiens
NVKAYVLPI

SEQ ID NO: 884794 - protein, 9 aa, Homo Sapiens
SRCFHNGYC

SEQ ID NO: 884795 - protein, 9 aa, Homo Sapiens
PQIPRRDIG

SEQ ID NO: 884796 - protein, 9 aa, Homo Sapiens
DKRRRNQCQ

SEQ ID NO: 884797 - protein, 9 aa, Homo Sapiens
NVLQPTPIA

SEQ ID NO: 884798 - protein, 9 aa, Homo Sapiens
PEAYVWVPI

SEQ ID NO: 884799 - protein, 9 aa, Homo Sapiens
SEAELTPKA

SEQ ID NO: 884800 - protein, 9 aa, Homo Sapiens
LNSFQTHEM

SEQ ID NO: 884801 - protein, 9 aa, Homo Sapiens
MTVVWCRSK

SEQ ID NO: 884802 - protein, 9 aa, Homo Sapiens
IKSYYTVQQ

SEQ ID NO: 884803 - protein, 9 aa, Homo Sapiens
RSYKQTFSE

SEQ ID NO: 884804 - protein, 9 aa, Homo Sapiens
KVQVNVHGI

SEQ ID NO: 884805 - protein, 9 aa, Homo Sapiens
KGGITFFRP

SEQ ID NO: 884806 - protein, 9 aa, Homo Sapiens
QIIFRHLRR

SEQ ID NO: 884807 - protein, 9 aa, Homo Sapiens
PKLKDLYIC

SEQ ID NO: 884808 - protein, 9 aa, Homo Sapiens
RLHTRQMKI

SEQ ID NO: 884809 - protein, 9 aa, Homo Sapiens
IHPTKREVI

SEQ ID NO: 884810 - protein, 9 aa, Homo Sapiens
NLEWLKNDR

SEQ ID NO: 884811 - protein, 9 aa, Homo Sapiens
IQTLGKQLN

SEQ ID NO: 884812 - protein, 9 aa, Homo Sapiens
ISFNSLDVY

SEQ ID NO: 884813 - protein, 9 aa, Homo Sapiens
TPEFCQLIV

SEQ ID NO: 884814 - protein, 9 aa, Homo Sapiens
DTLSKDKIS

SEQ ID NO: 884815 - protein, 9 aa, Homo Sapiens
APNGTVIPN

SEQ ID NO: 884816 - protein, 9 aa, Homo Sapiens
KRGNVGFKE

SEQ ID NO: 884817 - protein, 9 aa, Homo Sapiens
MAGGLVAHL

SEQ ID NO: 884818 - protein, 9 aa, Homo Sapiens
TTPGAQPEP

SEQ ID NO: 884819 - protein, 9 aa, Homo Sapiens
AHKVAQAKH

SEQ ID NO: 884820 - protein, 9 aa, Homo Sapiens
TKLSGGQKR

SEQ ID NO: 884821 - protein, 9 aa, Homo Sapiens
IYRLLLGLQ

SEQ ID NO: 884822 - protein, 9 aa, Homo Sapiens
KPIQSGNVS

SEQ ID NO: 884823 - protein, 9 aa, Homo Sapiens
SHVPYTSAF

SEQ ID NO: 884824 - protein, 9 aa, Homo Sapiens
QQSEQNMKL

SEQ ID NO: 884825 - protein, 9 aa, Homo Sapiens
VHQQTHTGE

SEQ ID NO: 884826 - protein, 9 aa, Homo Sapiens
LLFLVCHLV

SEQ ID NO: 884827 - protein, 9 aa, Homo Sapiens
YTLFNKTFW

SEQ ID NO: 884828 - protein, 9 aa, Homo Sapiens
PKKEGPVAS

SEQ ID NO: 884829 - protein, 9 aa, Homo Sapiens
EDEQDAHAA

SEQ ID NO: 884830 - protein, 9 aa, Homo Sapiens
VEANVSLSS

SEQ ID NO: 884831 - protein, 9 aa, Homo Sapiens
PGIICLSSG

SEQ ID NO: 884832 - protein, 9 aa, Homo Sapiens
KNQGKLIPP

SEQ ID NO: 884833 - protein, 9 aa, Homo Sapiens
QKHPSSPEC

SEQ ID NO: 884834 - protein, 9 aa, Homo Sapiens
RRKAGISDY

SEQ ID NO: 884835 - protein, 9 aa, Homo Sapiens
DLYRHICKF

SEQ ID NO: 884836 - protein, 9 aa, Homo Sapiens
AIVIEQPNV

SEQ ID NO: 884837 - protein, 9 aa, Homo Sapiens
LKVAAHAPL

SEQ ID NO: 884838 - protein, 9 aa, Homo Sapiens
SNCLGICSF

SEQ ID NO: 884839 - protein, 9 aa, Homo Sapiens
AECLQTKLR

SEQ ID NO: 884840 - protein, 9 aa, Homo Sapiens
GQSGSYLNS

SEQ ID NO: 884841 - protein, 9 aa, Homo Sapiens
ARKPPNYNV

SEQ ID NO: 884842 - protein, 9 aa, Homo Sapiens
EISFADDVE

SEQ ID NO: 884843 - protein, 9 aa, Homo Sapiens
IRKNLYVKI

SEQ ID NO: 884844 - protein, 9 aa, Homo Sapiens
NLPKTTIKV

SEQ ID NO: 884845 - protein, 9 aa, Homo Sapiens
GRHSSYCSN

SEQ ID NO: 884846 - protein, 9 aa, Homo Sapiens
LKMHFAKGR

SEQ ID NO: 884847 - protein, 9 aa, Homo Sapiens
DYKCIPQSL

SEQ ID NO: 884848 - protein, 9 aa, Homo Sapiens
STDDSYSCH

SEQ ID NO: 884849 - protein, 9 aa, Homo Sapiens
GEIKLPVEN

SEQ ID NO: 884850 - protein, 9 aa, Homo Sapiens
PLYWTMIQL

SEQ ID NO: 884851 - protein, 9 aa, Homo Sapiens
PEDMEIGPG

SEQ ID NO: 884852 - protein, 9 aa, Homo Sapiens
GLIDLCLTV

SEQ ID NO: 884853 - protein, 9 aa, Homo Sapiens
LYVVGLRNT

SEQ ID NO: 884854 - protein, 9 aa, Homo Sapiens
LDKYLYGPD

SEQ ID NO: 884855 - protein, 9 aa, Homo Sapiens
LQGDKQFLL

SEQ ID NO: 884856 - protein, 9 aa, Homo Sapiens
LALKEVFNN

SEQ ID NO: 884857 - protein, 9 aa, Homo Sapiens
PQIGTFDLK

SEQ ID NO: 884858 - protein, 9 aa, Homo Sapiens
YILCIHFIC

SEQ ID NO: 884859 - protein, 9 aa, Homo Sapiens
LGFNPRWMM

SEQ ID NO: 884860 - protein, 9 aa, Homo Sapiens
PTGRPKRQT

SEQ ID NO: 884861 - protein, 9 aa, Homo Sapiens
CTLACQQFC

SEQ ID NO: 884862 - protein, 9 aa, Homo Sapiens
ETVQKEGMQ

SEQ ID NO: 884863 - protein, 9 aa, Homo Sapiens
ARGRRVWGR

SEQ ID NO: 884864 - protein, 9 aa, Homo Sapiens
VTDPQNLLL

SEQ ID NO: 884865 - protein, 9 aa, Homo Sapiens
PEWNLISSV

SEQ ID NO: 884866 - protein, 9 aa, Homo Sapiens
GFLILLSFL

SEQ ID NO: 884867 - protein, 9 aa, Homo Sapiens
SLQSPTEDK

SEQ ID NO: 884868 - protein, 9 aa, Homo Sapiens
GILRTGGDK

SEQ ID NO: 884869 - protein, 9 aa, Homo Sapiens
GFKRYVTTA

SEQ ID NO: 884870 - protein, 9 aa, Homo Sapiens
RVALVGGTT

SEQ ID NO: 884871 - protein, 9 aa, Homo Sapiens
EQSRSRDRS

SEQ ID NO: 884872 - protein, 9 aa, Homo Sapiens
ASTGRKWFR

SEQ ID NO: 884873 - protein, 9 aa, Homo Sapiens
DSSGEGERR

SEQ ID NO: 884874 - protein, 9 aa, Homo Sapiens
ELDNAYTGS

SEQ ID NO: 884875 - protein, 9 aa, Homo Sapiens
NTLYYQLGD

SEQ ID NO: 884876 - protein, 9 aa, Homo Sapiens
NTSVKPSQP

SEQ ID NO: 884877 - protein, 9 aa, Homo Sapiens
SVSTFQYDC

SEQ ID NO: 884878 - protein, 9 aa, Homo Sapiens
VKKKKIQRE

SEQ ID NO: 884879 - protein, 9 aa, Homo Sapiens
RKSNFFHFI

SEQ ID NO: 884880 - protein, 9 aa, Homo Sapiens
TVNAQLDGI

SEQ ID NO: 884881 - protein, 9 aa, Homo Sapiens
FKSKFQFIV

SEQ ID NO: 884882 - protein, 9 aa, Homo Sapiens
SFNSLDVYG

SEQ ID NO: 884883 - protein, 9 aa, Homo Sapiens
TSEIEPNNS

SEQ ID NO: 884884 - protein, 9 aa, Homo Sapiens
PVIMSLAQN

SEQ ID NO: 884885 - protein, 9 aa, Homo Sapiens
MFFLNIVMF

SEQ ID NO: 884886 - protein, 9 aa, Homo Sapiens
NCLTYHRIY

SEQ ID NO: 884887 - protein, 9 aa, Homo Sapiens
GGLVNSRLA

SEQ ID NO: 884888 - protein, 9 aa, Homo Sapiens
STQRFKVNK

SEQ ID NO: 884889 - protein, 9 aa, Homo Sapiens
YCDASGLSC

SEQ ID NO: 884890 - protein, 9 aa, Homo Sapiens
MGHRPQTCI

SEQ ID NO: 884891 - protein, 9 aa, Homo Sapiens
QLCADYRSA

SEQ ID NO: 884892 - protein, 9 aa, Homo Sapiens
KLLDDKHLL

SEQ ID NO: 884893 - protein, 9 aa, Homo Sapiens
TNTNKLLAY

SEQ ID NO: 884894 - protein, 9 aa, Homo Sapiens
HRGFFFSHI

SEQ ID NO: 884895 - protein, 9 aa, Homo Sapiens
AQNCGKLEA

SEQ ID NO: 884896 - protein, 9 aa, Homo Sapiens
FCHQEHKQL

SEQ ID NO: 884897 - protein, 9 aa, Homo Sapiens
GLQTVLGLI

SEQ ID NO: 884898 - protein, 9 aa, Homo Sapiens
NKNRSYKSS

SEQ ID NO: 884899 - protein, 9 aa, Homo Sapiens
SWQEGACVT

SEQ ID NO: 884900 - protein, 9 aa, Homo Sapiens
TELSSSSSS

SEQ ID NO: 884901 - protein, 9 aa, Homo Sapiens
MDEFKRTQN

SEQ ID NO: 884902 - protein, 9 aa, Homo Sapiens
SPSLLKRHE

SEQ ID NO: 884903 - protein, 9 aa, Homo Sapiens
NIPFDELNN

SEQ ID NO: 884904 - protein, 9 aa, Homo Sapiens
TADYTTKKY

SEQ ID NO: 884905 - protein, 9 aa, Homo Sapiens
AGLIQKYNT

SEQ ID NO: 884906 - protein, 9 aa, Homo Sapiens
KTSLLVAVY

SEQ ID NO: 884907 - protein, 9 aa, Homo Sapiens
MHLPPPRPA

SEQ ID NO: 884908 - protein, 9 aa, Homo Sapiens
SKSKSNRVD

SEQ ID NO: 884909 - protein, 9 aa, Homo Sapiens
SEKTQIGLA

SEQ ID NO: 884910 - protein, 9 aa, Homo Sapiens
SVPLQVLLA

SEQ ID NO: 884911 - protein, 9 aa, Homo Sapiens
QPHPCILSA

SEQ ID NO: 884912 - protein, 9 aa, Homo Sapiens
KSSVLRVPC

SEQ ID NO: 884913 - protein, 9 aa, Homo Sapiens
KKVADTLTN

SEQ ID NO: 884914 - protein, 9 aa, Homo Sapiens
QHLKLNRNK

SEQ ID NO: 884915 - protein, 9 aa, Homo Sapiens
ARMREYECM

SEQ ID NO: 884916 - protein, 9 aa, Homo Sapiens
NNMNYKIKK

SEQ ID NO: 884917 - protein, 9 aa, Homo Sapiens
VYFSAADHK

SEQ ID NO: 884918 - protein, 9 aa, Homo Sapiens
SKLPASDQT

SEQ ID NO: 884919 - protein, 9 aa, Homo Sapiens
CHNFAPAPA

SEQ ID NO: 884920 - protein, 9 aa, Homo Sapiens
EAPIVKPHS

SEQ ID NO: 884921 - protein, 9 aa, Homo Sapiens
GAVCATDMR

SEQ ID NO: 884922 - protein, 9 aa, Homo Sapiens
PEPNLRLHQ

SEQ ID NO: 884923 - protein, 9 aa, Homo Sapiens
QTPHIPYKL

SEQ ID NO: 884924 - protein, 9 aa, Homo Sapiens
VNTIINSGF

SEQ ID NO: 884925 - protein, 9 aa, Homo Sapiens
FLPQMNPFV

SEQ ID NO: 884926 - protein, 9 aa, Homo Sapiens
YFIEKENYH

SEQ ID NO: 884927 - protein, 9 aa, Homo Sapiens
QLVKLLLVR

SEQ ID NO: 884928 - protein, 9 aa, Homo Sapiens
YHQLDANLN

SEQ ID NO: 884929 - protein, 9 aa, Homo Sapiens
DKDEEMDVG

SEQ ID NO: 884930 - protein, 9 aa, Homo Sapiens
VYPIKEAPG

SEQ ID NO: 884931 - protein, 9 aa, Homo Sapiens
IVMFIVVMV

SEQ ID NO: 884932 - protein, 9 aa, Homo Sapiens
YGPQWKHDF

SEQ ID NO: 884933 - protein, 9 aa, Homo Sapiens
DLRKNLCCQ

SEQ ID NO: 884934 - protein, 9 aa, Homo Sapiens
CELAGFAQT

SEQ ID NO: 884935 - protein, 9 aa, Homo Sapiens
KQLQERIWS

SEQ ID NO: 884936 - protein, 9 aa, Homo Sapiens
EYTDGSTGK

SEQ ID NO: 884937 - protein, 9 aa, Homo Sapiens
FQYDNFFNY

SEQ ID NO: 884938 - protein, 9 aa, Homo Sapiens
FDPDVGENF

SEQ ID NO: 884939 - protein, 9 aa, Homo Sapiens
IPFDELNNY

SEQ ID NO: 884940 - protein, 9 aa, Homo Sapiens
AARLANLMG

SEQ ID NO: 884941 - protein, 9 aa, Homo Sapiens
KYSKQVDNR

SEQ ID NO: 884942 - protein, 9 aa, Homo Sapiens
DKKLFLKRN

SEQ ID NO: 884943 - protein, 9 aa, Homo Sapiens
NALDRLGRT

SEQ ID NO: 884944 - protein, 9 aa, Homo Sapiens
TCLTLNYVQ

SEQ ID NO: 884945 - protein, 9 aa, Homo Sapiens
STPYPNFNF

SEQ ID NO: 884946 - protein, 9 aa, Homo Sapiens
KAIELEKMK

SEQ ID NO: 884947 - protein, 9 aa, Homo Sapiens
LKSWHRLKH

SEQ ID NO: 884948 - protein, 9 aa, Homo Sapiens
DIKCVKDAD

SEQ ID NO: 884949 - protein, 9 aa, Homo Sapiens
LLAQPADNH

SEQ ID NO: 884950 - protein, 9 aa, Homo Sapiens
YNNNVPATY

SEQ ID NO: 884951 - protein, 9 aa, Homo Sapiens
LETSDKITA

SEQ ID NO: 884952 - protein, 9 aa, Homo Sapiens
RTLVLLELF

SEQ ID NO: 884953 - protein, 9 aa, Homo Sapiens
LSPLARSSR

SEQ ID NO: 884954 - protein, 9 aa, Homo Sapiens
VHRHYKHFD

SEQ ID NO: 884955 - protein, 9 aa, Homo Sapiens
PLHKRIYCA

SEQ ID NO: 884956 - protein, 9 aa, Homo Sapiens
QTPVLASSL

SEQ ID NO: 884957 - protein, 9 aa, Homo Sapiens
DHVKHYKIC

SEQ ID NO: 884958 - protein, 9 aa, Homo Sapiens
VEGYYHTER

SEQ ID NO: 884959 - protein, 9 aa, Homo Sapiens
ITDTYKTIK

SEQ ID NO: 884960 - protein, 9 aa, Homo Sapiens
DDIFIDSAW

SEQ ID NO: 884961 - protein, 9 aa, Homo Sapiens
NGRSYKQTF

SEQ ID NO: 884962 - protein, 9 aa, Homo Sapiens
NIDISNNSF

SEQ ID NO: 884963 - protein, 9 aa, Homo Sapiens
QVFARYLVN

SEQ ID NO: 884964 - protein, 9 aa, Homo Sapiens
EDIPICPVL

SEQ ID NO: 884965 - protein, 9 aa, Homo Sapiens
GITSKDQQN

SEQ ID NO: 884966 - protein, 9 aa, Homo Sapiens
LSFLLVFWT

SEQ ID NO: 884967 - protein, 9 aa, Homo Sapiens
DGAAAVGTK

SEQ ID NO: 884968 - protein, 9 aa, Homo Sapiens
AGKEEWKGA

SEQ ID NO: 884969 - protein, 9 aa, Homo Sapiens
LHTLYHILS

SEQ ID NO: 884970 - protein, 9 aa, Homo Sapiens
EDKLENVKA

SEQ ID NO: 884971 - protein, 9 aa, Homo Sapiens
MLWSQMLKD

SEQ ID NO: 884972 - protein, 9 aa, Homo Sapiens
CRRGKLYLV

SEQ ID NO: 884973 - protein, 9 aa, Homo Sapiens
KRPQSPGSN

SEQ ID NO: 884974 - protein, 9 aa, Homo Sapiens
ALGKSVQQQ

SEQ ID NO: 884975 - protein, 9 aa, Homo Sapiens
YKVKVYKTD

SEQ ID NO: 884976 - protein, 9 aa, Homo Sapiens
FSEEGDKTK

SEQ ID NO: 884977 - protein, 9 aa, Homo Sapiens
REERLWFRE

SEQ ID NO: 884978 - protein, 9 aa, Homo Sapiens
STPVTLFPG

SEQ ID NO: 884979 - protein, 9 aa, Homo Sapiens
VALFISLPL

SEQ ID NO: 884980 - protein, 9 aa, Homo Sapiens
GGDHRSQRR

SEQ ID NO: 884981 - protein, 9 aa, Homo Sapiens
PIHNYQVFN

SEQ ID NO: 884982 - protein, 9 aa, Homo Sapiens
HTEHQIICP

SEQ ID NO: 884983 - protein, 9 aa, Homo Sapiens
CGFLFSGAN

SEQ ID NO: 884984 - protein, 9 aa, Homo Sapiens
RCQMICINQ

SEQ ID NO: 884985 - protein, 9 aa, Homo Sapiens
PDKPRNNKR

SEQ ID NO: 884986 - protein, 9 aa, Homo Sapiens
ILIESTAKF

SEQ ID NO: 884987 - protein, 9 aa, Homo Sapiens
IITDFKDKT

SEQ ID NO: 884988 - protein, 9 aa, Homo Sapiens
LGLPESLIP

SEQ ID NO: 884989 - protein, 9 aa, Homo Sapiens
WFLHLVIGI

SEQ ID NO: 884990 - protein, 9 aa, Homo Sapiens
SILVMYYLN

SEQ ID NO: 884991 - protein, 9 aa, Homo Sapiens
SISPLLDAS

SEQ ID NO: 884992 - protein, 9 aa, Homo Sapiens
FNTFFCETR

SEQ ID NO: 884993 - protein, 9 aa, Homo Sapiens
HVLEAALEQ

SEQ ID NO: 884994 - protein, 9 aa, Homo Sapiens
DIFIDSAWK

SEQ ID NO: 884995 - protein, 9 aa, Homo Sapiens
IAQVQTKAK

SEQ ID NO: 884996 - protein, 9 aa, Homo Sapiens
GCFQNQKFR

SEQ ID NO: 884997 - protein, 9 aa, Homo Sapiens
AIKVLENIK

SEQ ID NO: 884998 - protein, 9 aa, Homo Sapiens
QSVIGSGPQ

SEQ ID NO: 884999 - protein, 9 aa, Homo Sapiens
LVSPSAETQ

SEQ ID NO: 885000 - protein, 9 aa, Homo Sapiens
LHSLVLRVQ

SEQ ID NO: 885001 - protein, 9 aa, Homo Sapiens
RECDKGRKG

SEQ ID NO: 885002 - protein, 9 aa, Homo Sapiens
KLGNLSALQ

SEQ ID NO: 885003 - protein, 9 aa, Homo Sapiens
VLSVPDDVY

SEQ ID NO: 885004 - protein, 9 aa, Homo Sapiens
AITKEKRPP

SEQ ID NO: 885005 - protein, 9 aa, Homo Sapiens
TPQHLNQKG

SEQ ID NO: 885006 - protein, 9 aa, Homo Sapiens
RQQNIAIEV

SEQ ID NO: 885007 - protein, 9 aa, Homo Sapiens
YQNAVQQED

SEQ ID NO: 885008 - protein, 9 aa, Homo Sapiens
NGNTYKKPS

SEQ ID NO: 885009 - protein, 9 aa, Homo Sapiens
AMYCDNCNL

SEQ ID NO: 885010 - protein, 9 aa, Homo Sapiens
TAGCNYLLE

SEQ ID NO: 885011 - protein, 9 aa, Homo Sapiens
QELAQLKAA

SEQ ID NO: 885012 - protein, 9 aa, Homo Sapiens
NEQLNLEDK

SEQ ID NO: 885013 - protein, 9 aa, Homo Sapiens
DLQGQTANK

SEQ ID NO: 885014 - protein, 9 aa, Homo Sapiens
RKKVNNIET

SEQ ID NO: 885015 - protein, 9 aa, Homo Sapiens
SVNKFLAKA

SEQ ID NO: 885016 - protein, 9 aa, Homo Sapiens
NKLVLRKLR

SEQ ID NO: 885017 - protein, 9 aa, Homo Sapiens
TVGKSKLME

SEQ ID NO: 885018 - protein, 9 aa, Homo Sapiens
AFLFSFQNH

SEQ ID NO: 885019 - protein, 9 aa, Homo Sapiens
EFFEQGDWE

SEQ ID NO: 885020 - protein, 9 aa, Homo Sapiens
KKILKQASI

SEQ ID NO: 885021 - protein, 9 aa, Homo Sapiens
AISVTIIHV

SEQ ID NO: 885022 - protein, 9 aa, Homo Sapiens
FAVGKRGVH

SEQ ID NO: 885023 - protein, 9 aa, Homo Sapiens
TETTVQVIS

SEQ ID NO: 885024 - protein, 9 aa, Homo Sapiens
GKISVKNFF

SEQ ID NO: 885025 - protein, 9 aa, Homo Sapiens
HHTYPQDPA

SEQ ID NO: 885026 - protein, 9 aa, Homo Sapiens
TQLYQKPLS

SEQ ID NO: 885027 - protein, 9 aa, Homo Sapiens
SSSFNLDPD

SEQ ID NO: 885028 - protein, 9 aa, Homo Sapiens
RDYAFAKAI

SEQ ID NO: 885029 - protein, 9 aa, Homo Sapiens
YSAASIGPN

SEQ ID NO: 885030 - protein, 9 aa, Homo Sapiens
MQKLLGLEV

SEQ ID NO: 885031 - protein, 9 aa, Homo Sapiens
EAPEGVPIG

SEQ ID NO: 885032 - protein, 9 aa, Homo Sapiens
AFQIDAKEQ

SEQ ID NO: 885033 - protein, 9 aa, Homo Sapiens
SSELTPKQA

SEQ ID NO: 885034 - protein, 9 aa, Homo Sapiens
DIVQQMEQE

SEQ ID NO: 885035 - protein, 9 aa, Homo Sapiens
IMSPMLCLT

SEQ ID NO: 885036 - protein, 9 aa, Homo Sapiens
DQGPGHQNN

SEQ ID NO: 885037 - protein, 9 aa, Homo Sapiens
IFQNLDEDK

SEQ ID NO: 885038 - protein, 9 aa, Homo Sapiens
VAFNTSHLQ

SEQ ID NO: 885039 - protein, 9 aa, Homo Sapiens
KWSPANRPS

SEQ ID NO: 885040 - protein, 9 aa, Homo Sapiens
MVVASQNAV

SEQ ID NO: 885041 - protein, 9 aa, Homo Sapiens
HRYPQIQSI

SEQ ID NO: 885042 - protein, 9 aa, Homo Sapiens
MKHKIINTG

SEQ ID NO: 885043 - protein, 9 aa, Homo Sapiens
YESGYFCIP

SEQ ID NO: 885044 - protein, 9 aa, Homo Sapiens
IQFEFTPGR

SEQ ID NO: 885045 - protein, 9 aa, Homo Sapiens
RSHTGDKPF

SEQ ID NO: 885046 - protein, 9 aa, Homo Sapiens
IFNHFATEC

SEQ ID NO: 885047 - protein, 9 aa, Homo Sapiens
WGPRGDPGE

SEQ ID NO: 885048 - protein, 9 aa, Homo Sapiens
KRIKEGSAD

SEQ ID NO: 885049 - protein, 9 aa, Homo Sapiens
PCCGGATCV

SEQ ID NO: 885050 - protein, 9 aa, Homo Sapiens
GYSIWTNEH

SEQ ID NO: 885051 - protein, 9 aa, Homo Sapiens
CPRNADMKN

SEQ ID NO: 885052 - protein, 9 aa, Homo Sapiens
NKTNPFPLL

SEQ ID NO: 885053 - protein, 9 aa, Homo Sapiens
DADPHNAHR

SEQ ID NO: 885054 - protein, 9 aa, Homo Sapiens
MIHVNQNIM

SEQ ID NO: 885055 - protein, 9 aa, Homo Sapiens
HYAKKHQRC

SEQ ID NO: 885056 - protein, 9 aa, Homo Sapiens
SPKLSPPQP

SEQ ID NO: 885057 - protein, 9 aa, Homo Sapiens
SLQLGAVFP

SEQ ID NO: 885058 - protein, 9 aa, Homo Sapiens
TFISVCRHI

SEQ ID NO: 885059 - protein, 9 aa, Homo Sapiens
ISVPLHRHH

SEQ ID NO: 885060 - protein, 9 aa, Homo Sapiens
NDAISKKRD

SEQ ID NO: 885061 - protein, 9 aa, Homo Sapiens
KFLAKARGD

SEQ ID NO: 885062 - protein, 9 aa, Homo Sapiens
FRCDPNFHL

SEQ ID NO: 885063 - protein, 9 aa, Homo Sapiens
GRQAEFSGE

SEQ ID NO: 885064 - protein, 9 aa, Homo Sapiens
VKKKVVEYE

SEQ ID NO: 885065 - protein, 9 aa, Homo Sapiens
SPHLRLASL

SEQ ID NO: 885066 - protein, 9 aa, Homo Sapiens
CGTVWDSGV

SEQ ID NO: 885067 - protein, 9 aa, Homo Sapiens
KLFPPLFLE

SEQ ID NO: 885068 - protein, 9 aa, Homo Sapiens
KRGIKILEN

SEQ ID NO: 885069 - protein, 9 aa, Homo Sapiens
VKTCFEKAL

SEQ ID NO: 885070 - protein, 9 aa, Homo Sapiens
IIHTERETL

SEQ ID NO: 885071 - protein, 9 aa, Homo Sapiens
KLPFLSTPM

SEQ ID NO: 885072 - protein, 9 aa, Homo Sapiens
MNKFLISNS

SEQ ID NO: 885073 - protein, 9 aa, Homo Sapiens
DHLGNSVLH

SEQ ID NO: 885074 - protein, 9 aa, Homo Sapiens
LRGQLQALM

SEQ ID NO: 885075 - protein, 9 aa, Homo Sapiens
QEGVEMLLN

SEQ ID NO: 885076 - protein, 9 aa, Homo Sapiens
CFCNPEFES

SEQ ID NO: 885077 - protein, 9 aa, Homo Sapiens
HFSDIYALC

SEQ ID NO: 885078 - protein, 9 aa, Homo Sapiens
VLLANSAHQ

SEQ ID NO: 885079 - protein, 9 aa, Homo Sapiens
DKKEDIKTL

SEQ ID NO: 885080 - protein, 9 aa, Homo Sapiens
KISTIKTDL

SEQ ID NO: 885081 - protein, 9 aa, Homo Sapiens
GVTTHKHHC

SEQ ID NO: 885082 - protein, 9 aa, Homo Sapiens
AIEEDINKI

SEQ ID NO: 885083 - protein, 9 aa, Homo Sapiens
IDVKPFLDT

SEQ ID NO: 885084 - protein, 9 aa, Homo Sapiens
NTFDIATNK

SEQ ID NO: 885085 - protein, 9 aa, Homo Sapiens
RIMEPDSLF

SEQ ID NO: 885086 - protein, 9 aa, Homo Sapiens
ENRQKHFPE

SEQ ID NO: 885087 - protein, 9 aa, Homo Sapiens
PVIIDRLFL

SEQ ID NO: 885088 - protein, 9 aa, Homo Sapiens
FNSVGKLLG

SEQ ID NO: 885089 - protein, 9 aa, Homo Sapiens
WPNEENNKD

SEQ ID NO: 885090 - protein, 9 aa, Homo Sapiens
VDEDFNGKL

SEQ ID NO: 885091 - protein, 9 aa, Homo Sapiens
SAYGGAYGE

SEQ ID NO: 885092 - protein, 9 aa, Homo Sapiens
WNKSICKVF

SEQ ID NO: 885093 - protein, 9 aa, Homo Sapiens
DSHWEQDIS

SEQ ID NO: 885094 - protein, 9 aa, Homo Sapiens
NPLVFLLQF

SEQ ID NO: 885095 - protein, 9 aa, Homo Sapiens
NRRIQNEKG

SEQ ID NO: 885096 - protein, 9 aa, Homo Sapiens
AGKGQTGVM

SEQ ID NO: 885097 - protein, 9 aa, Homo Sapiens
KVPCSLEVQ

SEQ ID NO: 885098 - protein, 9 aa, Homo Sapiens
HRVLSQPGG

SEQ ID NO: 885099 - protein, 9 aa, Homo Sapiens
GADQELFVD

SEQ ID NO: 885100 - protein, 9 aa, Homo Sapiens
DRQPQWRRE

SEQ ID NO: 885101 - protein, 9 aa, Homo Sapiens
EDTEQDKDE

SEQ ID NO: 885102 - protein, 9 aa, Homo Sapiens
VDDIFIDSA

SEQ ID NO: 885103 - protein, 9 aa, Homo Sapiens
QTFVAPDYV

SEQ ID NO: 885104 - protein, 9 aa, Homo Sapiens
MPNWGRGAK

SEQ ID NO: 885105 - protein, 9 aa, Homo Sapiens
HKSVPLQVL

SEQ ID NO: 885106 - protein, 9 aa, Homo Sapiens
TCEQALRIQ

SEQ ID NO: 885107 - protein, 9 aa, Homo Sapiens
NPPKSSNNT

SEQ ID NO: 885108 - protein, 9 aa, Homo Sapiens
KQSLNENSA

SEQ ID NO: 885109 - protein, 9 aa, Homo Sapiens
SFFMLLHLI

SEQ ID NO: 885110 - protein, 9 aa, Homo Sapiens
MINFVRAVI

SEQ ID NO: 885111 - protein, 9 aa, Homo Sapiens
AFNLLSNIT

SEQ ID NO: 885112 - protein, 9 aa, Homo Sapiens
LQILLPLII

SEQ ID NO: 885113 - protein, 9 aa, Homo Sapiens
NNRNLHSPM

SEQ ID NO: 885114 - protein, 9 aa, Homo Sapiens
KVIQEGSDV

SEQ ID NO: 885115 - protein, 9 aa, Homo Sapiens
GEGCIEWCC

SEQ ID NO: 885116 - protein, 9 aa, Homo Sapiens
LSGSLSMIN

SEQ ID NO: 885117 - protein, 9 aa, Homo Sapiens
CHQLFELYH

SEQ ID NO: 885118 - protein, 9 aa, Homo Sapiens
YFFWTVPSD

SEQ ID NO: 885119 - protein, 9 aa, Homo Sapiens
ILGQQLPKV

SEQ ID NO: 885120 - protein, 9 aa, Homo Sapiens
FSAGVANCS

SEQ ID NO: 885121 - protein, 9 aa, Homo Sapiens
NVASTISML

SEQ ID NO: 885122 - protein, 9 aa, Homo Sapiens
AMEKMVDAL

SEQ ID NO: 885123 - protein, 9 aa, Homo Sapiens
DLYICPNIA

SEQ ID NO: 885124 - protein, 9 aa, Homo Sapiens
HTDPAERWH

SEQ ID NO: 885125 - protein, 9 aa, Homo Sapiens
SNAAGEVTA

SEQ ID NO: 885126 - protein, 9 aa, Homo Sapiens
VNIVRAYNI

SEQ ID NO: 885127 - protein, 9 aa, Homo Sapiens
TPGTWGPRG

SEQ ID NO: 885128 - protein, 9 aa, Homo Sapiens
KEICFMIST

SEQ ID NO: 885129 - protein, 9 aa, Homo Sapiens
ELHQFVSKK

SEQ ID NO: 885130 - protein, 9 aa, Homo Sapiens
DNKFTETKR

SEQ ID NO: 885131 - protein, 9 aa, Homo Sapiens
LDITDCLCF

SEQ ID NO: 885132 - protein, 9 aa, Homo Sapiens
RAFIIEETV

SEQ ID NO: 885133 - protein, 9 aa, Homo Sapiens
MDSNKGASQ

SEQ ID NO: 885134 - protein, 9 aa, Homo Sapiens
VSQANVQVN

SEQ ID NO: 885135 - protein, 9 aa, Homo Sapiens
SLKSNFTID

SEQ ID NO: 885136 - protein, 9 aa, Homo Sapiens
FKSLEEVRG

SEQ ID NO: 885137 - protein, 9 aa, Homo Sapiens
ARETQESEH

SEQ ID NO: 885138 - protein, 9 aa, Homo Sapiens
KEKLWQRLK

SEQ ID NO: 885139 - protein, 9 aa, Homo Sapiens
KSDQMESTD

SEQ ID NO: 885140 - protein, 9 aa, Homo Sapiens
GNGNFRRKR

SEQ ID NO: 885141 - protein, 9 aa, Homo Sapiens
ILYTDDEDK

SEQ ID NO: 885142 - protein, 9 aa, Homo Sapiens
AEHQSGLVP

SEQ ID NO: 885143 - protein, 9 aa, Homo Sapiens
LEGGLVLPS

SEQ ID NO: 885144 - protein, 9 aa, Homo Sapiens
IMDYYQSNE

SEQ ID NO: 885145 - protein, 9 aa, Homo Sapiens
IVGLIKKMI

SEQ ID NO: 885146 - protein, 9 aa, Homo Sapiens
LYNAMTNED

SEQ ID NO: 885147 - protein, 9 aa, Homo Sapiens
ELLSEKTEV

SEQ ID NO: 885148 - protein, 9 aa, Homo Sapiens
LLVVIGVLL

SEQ ID NO: 885149 - protein, 9 aa, Homo Sapiens
QNELIPLIY

SEQ ID NO: 885150 - protein, 9 aa, Homo Sapiens
SDELVEQSH

SEQ ID NO: 885151 - protein, 9 aa, Homo Sapiens
QGFCVDLPI

SEQ ID NO: 885152 - protein, 9 aa, Homo Sapiens
TVNISANGF

SEQ ID NO: 885153 - protein, 9 aa, Homo Sapiens
LTLEDGFYK

SEQ ID NO: 885154 - protein, 9 aa, Homo Sapiens
IHREAGGHN

SEQ ID NO: 885155 - protein, 9 aa, Homo Sapiens
STQSLSPMS

SEQ ID NO: 885156 - protein, 9 aa, Homo Sapiens
TGKIYTYQK

SEQ ID NO: 885157 - protein, 9 aa, Homo Sapiens
RHAASPARP

SEQ ID NO: 885158 - protein, 9 aa, Homo Sapiens
NDTTELQVW

SEQ ID NO: 885159 - protein, 9 aa, Homo Sapiens
WNLLHKTDS

SEQ ID NO: 885160 - protein, 9 aa, Homo Sapiens
SLYKAMVLA

SEQ ID NO: 885161 - protein, 9 aa, Homo Sapiens
VQDDSDLDC

SEQ ID NO: 885162 - protein, 9 aa, Homo Sapiens
YKFWNHIVA

SEQ ID NO: 885163 - protein, 9 aa, Homo Sapiens
CNGYCNKCF

SEQ ID NO: 885164 - protein, 9 aa, Homo Sapiens
SNPISVPLH

SEQ ID NO: 885165 - protein, 9 aa, Homo Sapiens
QTNLQHAIR

SEQ ID NO: 885166 - protein, 9 aa, Homo Sapiens
VFRAGNNSW

SEQ ID NO: 885167 - protein, 9 aa, Homo Sapiens
QWAAVATFI

SEQ ID NO: 885168 - protein, 9 aa, Homo Sapiens
PFHPSDPTE

SEQ ID NO: 885169 - protein, 9 aa, Homo Sapiens
TSAKVFILV

SEQ ID NO: 885170 - protein, 9 aa, Homo Sapiens
ACQSLDLCT

SEQ ID NO: 885171 - protein, 9 aa, Homo Sapiens
TQINVINVP

SEQ ID NO: 885172 - protein, 9 aa, Homo Sapiens
GKIQIAAEG

SEQ ID NO: 885173 - protein, 9 aa, Homo Sapiens
SPEKSQEEN

SEQ ID NO: 885174 - protein, 9 aa, Homo Sapiens
ALVDITKIL

SEQ ID NO: 885175 - protein, 9 aa, Homo Sapiens
LPEELNRVQ

SEQ ID NO: 885176 - protein, 9 aa, Homo Sapiens
FVPINSVNL

SEQ ID NO: 885177 - protein, 9 aa, Homo Sapiens
HVPYTSAFL

SEQ ID NO: 885178 - protein, 9 aa, Homo Sapiens
EVHTHYLHQ

SEQ ID NO: 885179 - protein, 9 aa, Homo Sapiens
RESMGLLSF

SEQ ID NO: 885180 - protein, 9 aa, Homo Sapiens
GFLRRDTER

SEQ ID NO: 885181 - protein, 9 aa, Homo Sapiens
LRKLIKKCS

SEQ ID NO: 885182 - protein, 9 aa, Homo Sapiens
RSVKLMPSK

SEQ ID NO: 885183 - protein, 9 aa, Homo Sapiens
AELAGHNYV

SEQ ID NO: 885184 - protein, 9 aa, Homo Sapiens
FHRYTVWAK

SEQ ID NO: 885185 - protein, 9 aa, Homo Sapiens
SLSSGLQKG

SEQ ID NO: 885186 - protein, 9 aa, Homo Sapiens
RGRVCMAGA

SEQ ID NO: 885187 - protein, 9 aa, Homo Sapiens
QSGEGRKKA

SEQ ID NO: 885188 - protein, 9 aa, Homo Sapiens
CTIEEIISF

SEQ ID NO: 885189 - protein, 9 aa, Homo Sapiens
YSLYLGTVN

SEQ ID NO: 885190 - protein, 9 aa, Homo Sapiens
LEKNYSASE

SEQ ID NO: 885191 - protein, 9 aa, Homo Sapiens
KPLVCRAGA

SEQ ID NO: 885192 - protein, 9 aa, Homo Sapiens
FWSTKSETN

SEQ ID NO: 885193 - protein, 9 aa, Homo Sapiens
KNINRTSFT

SEQ ID NO: 885194 - protein, 9 aa, Homo Sapiens
YRGNCRPIQ

SEQ ID NO: 885195 - protein, 9 aa, Homo Sapiens
NNYRKNVAY

SEQ ID NO: 885196 - protein, 9 aa, Homo Sapiens
RSIILLYFR

SEQ ID NO: 885197 - protein, 9 aa, Homo Sapiens
VLQNQDNKL

SEQ ID NO: 885198 - protein, 9 aa, Homo Sapiens
ESGQLLDQE

SEQ ID NO: 885199 - protein, 9 aa, Homo Sapiens
NNVLNMNKR

SEQ ID NO: 885200 - protein, 9 aa, Homo Sapiens
LAEDMTLCV

SEQ ID NO: 885201 - protein, 9 aa, Homo Sapiens
VKEQMETIQ

SEQ ID NO: 885202 - protein, 9 aa, Homo Sapiens
KTYSIVMGS

SEQ ID NO: 885203 - protein, 9 aa, Homo Sapiens
GNMTRVFER

SEQ ID NO: 885204 - protein, 9 aa, Homo Sapiens
KGFASDCFL

SEQ ID NO: 885205 - protein, 9 aa, Homo Sapiens
MLSTDTNKA

SEQ ID NO: 885206 - protein, 9 aa, Homo Sapiens
QLFELYHSS

SEQ ID NO: 885207 - protein, 9 aa, Homo Sapiens
LSSTAKWVL

SEQ ID NO: 885208 - protein, 9 aa, Homo Sapiens
YAISVTIIH

SEQ ID NO: 885209 - protein, 9 aa, Homo Sapiens
KMNVPEMMN

SEQ ID NO: 885210 - protein, 9 aa, Homo Sapiens
DKLQSAFKA

SEQ ID NO: 885211 - protein, 9 aa, Homo Sapiens
RYKYAAGVC

SEQ ID NO: 885212 - protein, 9 aa, Homo Sapiens
LKQEGCANL

SEQ ID NO: 885213 - protein, 9 aa, Homo Sapiens
QAPPYPPGV

SEQ ID NO: 885214 - protein, 9 aa, Homo Sapiens
KIVGHGNGT

SEQ ID NO: 885215 - protein, 9 aa, Homo Sapiens
GNTSFACTE

SEQ ID NO: 885216 - protein, 9 aa, Homo Sapiens
EGPFSRHLV

SEQ ID NO: 885217 - protein, 9 aa, Homo Sapiens
LAGDFYFGR

SEQ ID NO: 885218 - protein, 9 aa, Homo Sapiens
QRTHTGDKP

SEQ ID NO: 885219 - protein, 9 aa, Homo Sapiens
WCLSPPHPA

SEQ ID NO: 885220 - protein, 9 aa, Homo Sapiens
LEEVKKKNP

SEQ ID NO: 885221 - protein, 9 aa, Homo Sapiens
NMLWSQMLK

SEQ ID NO: 885222 - protein, 9 aa, Homo Sapiens
ESKIQRLSE

SEQ ID NO: 885223 - protein, 9 aa, Homo Sapiens
LENVYTLLT

SEQ ID NO: 885224 - protein, 9 aa, Homo Sapiens
HNRDDGSVY

SEQ ID NO: 885225 - protein, 9 aa, Homo Sapiens
KELWDAKNK

SEQ ID NO: 885226 - protein, 9 aa, Homo Sapiens
TNSSLNISV

SEQ ID NO: 885227 - protein, 9 aa, Homo Sapiens
SRVVYSTRL

SEQ ID NO: 885228 - protein, 9 aa, Homo Sapiens
HSSHLVMHQ

SEQ ID NO: 885229 - protein, 9 aa, Homo Sapiens
ICNFPSAKC

SEQ ID NO: 885230 - protein, 9 aa, Homo Sapiens
LEELVNASC

SEQ ID NO: 885231 - protein, 9 aa, Homo Sapiens
TFNQTAETV

SEQ ID NO: 885232 - protein, 9 aa, Homo Sapiens
NYTQYLDKV

SEQ ID NO: 885233 - protein, 9 aa, Homo Sapiens
EEILELLGS

SEQ ID NO: 885234 - protein, 9 aa, Homo Sapiens
TKNNYNPTA

SEQ ID NO: 885235 - protein, 9 aa, Homo Sapiens
IHLFLTNES

SEQ ID NO: 885236 - protein, 9 aa, Homo Sapiens
HKDAGVICS

SEQ ID NO: 885237 - protein, 9 aa, Homo Sapiens
LIKQYWKMH

SEQ ID NO: 885238 - protein, 9 aa, Homo Sapiens
VYNKRLKVL

SEQ ID NO: 885239 - protein, 9 aa, Homo Sapiens
FGDKLYSLK

SEQ ID NO: 885240 - protein, 9 aa, Homo Sapiens
KESLAISGL

SEQ ID NO: 885241 - protein, 9 aa, Homo Sapiens
FDRQKSCIL

SEQ ID NO: 885242 - protein, 9 aa, Homo Sapiens
FSLQIRLIG

SEQ ID NO: 885243 - protein, 9 aa, Homo Sapiens
QCKLHPDLV

SEQ ID NO: 885244 - protein, 9 aa, Homo Sapiens
CSSSPCCGG

SEQ ID NO: 885245 - protein, 9 aa, Homo Sapiens
ARYGNSINV

SEQ ID NO: 885246 - protein, 9 aa, Homo Sapiens
MNKNPPARH

SEQ ID NO: 885247 - protein, 9 aa, Homo Sapiens
YFFWLERGS

SEQ ID NO: 885248 - protein, 9 aa, Homo Sapiens
TLVFNLSSE

SEQ ID NO: 885249 - protein, 9 aa, Homo Sapiens
KDYENEDNY

SEQ ID NO: 885250 - protein, 9 aa, Homo Sapiens
IWCQNHHNV

SEQ ID NO: 885251 - protein, 9 aa, Homo Sapiens
LPLLMAPPL

SEQ ID NO: 885252 - protein, 9 aa, Homo Sapiens
QIEQQSEQN

SEQ ID NO: 885253 - protein, 9 aa, Homo Sapiens
KNPPAQTKN

SEQ ID NO: 885254 - protein, 9 aa, Homo Sapiens
PNLIMGFNT

SEQ ID NO: 885255 - protein, 9 aa, Homo Sapiens
LDSIHYITR

SEQ ID NO: 885256 - protein, 9 aa, Homo Sapiens
YGQGSQEGG

SEQ ID NO: 885257 - protein, 9 aa, Homo Sapiens
VCMFSLMCS

SEQ ID NO: 885258 - protein, 9 aa, Homo Sapiens
LIAALLFEA

SEQ ID NO: 885259 - protein, 9 aa, Homo Sapiens
KNLAAPSGQ

SEQ ID NO: 885260 - protein, 9 aa, Homo Sapiens
VFHPRSHCL

SEQ ID NO: 885261 - protein, 9 aa, Homo Sapiens
SRIKLTGKE

SEQ ID NO: 885262 - protein, 9 aa, Homo Sapiens
SVSGIKWDY

SEQ ID NO: 885263 - protein, 9 aa, Homo Sapiens
PDDFNSNTG

SEQ ID NO: 885264 - protein, 9 aa, Homo Sapiens
YLSAFSAVF

SEQ ID NO: 885265 - protein, 9 aa, Homo Sapiens
LDEFSKQVN

SEQ ID NO: 885266 - protein, 9 aa, Homo Sapiens
EQSTAARLP

SEQ ID NO: 885267 - protein, 9 aa, Homo Sapiens
GGEVYVECL

SEQ ID NO: 885268 - protein, 9 aa, Homo Sapiens
SPEALARDK

SEQ ID NO: 885269 - protein, 9 aa, Homo Sapiens
YQLRNVREQ

SEQ ID NO: 885270 - protein, 9 aa, Homo Sapiens
AAKSIDQKN

SEQ ID NO: 885271 - protein, 9 aa, Homo Sapiens
DCLKAEWDQ

SEQ ID NO: 885272 - protein, 9 aa, Homo Sapiens
CEGSSLYHQ

SEQ ID NO: 885273 - protein, 9 aa, Homo Sapiens
YGNSSGMYT

SEQ ID NO: 885274 - protein, 9 aa, Homo Sapiens
IDPPPCDAG

SEQ ID NO: 885275 - protein, 9 aa, Homo Sapiens
EYIKTLANM

SEQ ID NO: 885276 - protein, 9 aa, Homo Sapiens
RPYAGAVHK

SEQ ID NO: 885277 - protein, 9 aa, Homo Sapiens
RKKICEQEK

SEQ ID NO: 885278 - protein, 9 aa, Homo Sapiens
ATIRQLEDR

SEQ ID NO: 885279 - protein, 9 aa, Homo Sapiens
LGYGYGGFN

SEQ ID NO: 885280 - protein, 9 aa, Homo Sapiens
RSILRFLEI

SEQ ID NO: 885281 - protein, 9 aa, Homo Sapiens
ALNPQTQTH

SEQ ID NO: 885282 - protein, 9 aa, Homo Sapiens
SVIKEENYL

SEQ ID NO: 885283 - protein, 9 aa, Homo Sapiens
SDNFLGISS

SEQ ID NO: 885284 - protein, 9 aa, Homo Sapiens
ALTPDLCPL

SEQ ID NO: 885285 - protein, 9 aa, Homo Sapiens
FFLKDLFTS

SEQ ID NO: 885286 - protein, 9 aa, Homo Sapiens
LELKTINYA

SEQ ID NO: 885287 - protein, 9 aa, Homo Sapiens
GFTECKMTK

SEQ ID NO: 885288 - protein, 9 aa, Homo Sapiens
VFTIFFGSV

SEQ ID NO: 885289 - protein, 9 aa, Homo Sapiens
SSYSGMIID

SEQ ID NO: 885290 - protein, 9 aa, Homo Sapiens
KTIKQYQQD

SEQ ID NO: 885291 - protein, 9 aa, Homo Sapiens
LQECISHSY

SEQ ID NO: 885292 - protein, 9 aa, Homo Sapiens
IKEVDEDFN

SEQ ID NO: 885293 - protein, 9 aa, Homo Sapiens
YLKDMMLYC

SEQ ID NO: 885294 - protein, 9 aa, Homo Sapiens
MPVISELLS

SEQ ID NO: 885295 - protein, 9 aa, Homo Sapiens
SSERDCLKA

SEQ ID NO: 885296 - protein, 9 aa, Homo Sapiens
LTETLKEHE

SEQ ID NO: 885297 - protein, 9 aa, Homo Sapiens
QQWVAGVNQ

SEQ ID NO: 885298 - protein, 9 aa, Homo Sapiens
SSDQNPPID

SEQ ID NO: 885299 - protein, 9 aa, Homo Sapiens
HGSSVLSLL

SEQ ID NO: 885300 - protein, 9 aa, Homo Sapiens
VNKFQKSVD

SEQ ID NO: 885301 - protein, 9 aa, Homo Sapiens
NVPIKANYL

SEQ ID NO: 885302 - protein, 9 aa, Homo Sapiens
SADTVPWLQ

SEQ ID NO: 885303 - protein, 9 aa, Homo Sapiens
DPNCEKMFG

SEQ ID NO: 885304 - protein, 9 aa, Homo Sapiens
CTKSCRQST

SEQ ID NO: 885305 - protein, 9 aa, Homo Sapiens
HIHRWTILH

SEQ ID NO: 885306 - protein, 9 aa, Homo Sapiens
DNKEDPMMY

SEQ ID NO: 885307 - protein, 9 aa, Homo Sapiens
RQKQKQMKY

SEQ ID NO: 885308 - protein, 9 aa, Homo Sapiens
NDIGNRMLQ

SEQ ID NO: 885309 - protein, 9 aa, Homo Sapiens
GQLVKLLLV

SEQ ID NO: 885310 - protein, 9 aa, Homo Sapiens
AVATFIYAE

SEQ ID NO: 885311 - protein, 9 aa, Homo Sapiens
VDMRTILFD

SEQ ID NO: 885312 - protein, 9 aa, Homo Sapiens
VVPGPVQFQ

SEQ ID NO: 885313 - protein, 9 aa, Homo Sapiens
GIIVFLELT

SEQ ID NO: 885314 - protein, 9 aa, Homo Sapiens
CVRTTDEEL

SEQ ID NO: 885315 - protein, 9 aa, Homo Sapiens
SVPPAQVQD

SEQ ID NO: 885316 - protein, 9 aa, Homo Sapiens
AYQTEFQAL

SEQ ID NO: 885317 - protein, 9 aa, Homo Sapiens
PVSSRVKRP

SEQ ID NO: 885318 - protein, 9 aa, Homo Sapiens
ILTCRLGEQ

SEQ ID NO: 885319 - protein, 9 aa, Homo Sapiens
DDRTARVMI

SEQ ID NO: 885320 - protein, 9 aa, Homo Sapiens
MKMLSSVSK

SEQ ID NO: 885321 - protein, 9 aa, Homo Sapiens
IMTNGLCIW

SEQ ID NO: 885322 - protein, 9 aa, Homo Sapiens
LVHSRTPQE

SEQ ID NO: 885323 - protein, 9 aa, Homo Sapiens
HHTSLIQHQ

SEQ ID NO: 885324 - protein, 9 aa, Homo Sapiens
CLGLELFCC

SEQ ID NO: 885325 - protein, 9 aa, Homo Sapiens
GMEKICFKS

SEQ ID NO: 885326 - protein, 9 aa, Homo Sapiens
SECDAAKHR

SEQ ID NO: 885327 - protein, 9 aa, Homo Sapiens
ATYMQIYKK

SEQ ID NO: 885328 - protein, 9 aa, Homo Sapiens
ELSQRYQKQ

SEQ ID NO: 885329 - protein, 9 aa, Homo Sapiens
MEALCSVLH

SEQ ID NO: 885330 - protein, 9 aa, Homo Sapiens
VDIKTDLSF

SEQ ID NO: 885331 - protein, 9 aa, Homo Sapiens
SHRYPQIQS

SEQ ID NO: 885332 - protein, 9 aa, Homo Sapiens
QNAIMSYVL

SEQ ID NO: 885333 - protein, 9 aa, Homo Sapiens
TQESEHKPP

SEQ ID NO: 885334 - protein, 9 aa, Homo Sapiens
YLEWSNIKS

SEQ ID NO: 885335 - protein, 9 aa, Homo Sapiens
SREFRGKIY

SEQ ID NO: 885336 - protein, 9 aa, Homo Sapiens
TAAFKTYSN

SEQ ID NO: 885337 - protein, 9 aa, Homo Sapiens
GELQRFLSR

SEQ ID NO: 885338 - protein, 9 aa, Homo Sapiens
RNKWAQEPA

SEQ ID NO: 885339 - protein, 9 aa, Homo Sapiens
GTVYVRVPN

SEQ ID NO: 885340 - protein, 9 aa, Homo Sapiens
LFCTLLIHT

SEQ ID NO: 885341 - protein, 9 aa, Homo Sapiens
VWATLRLYA

SEQ ID NO: 885342 - protein, 9 aa, Homo Sapiens
EDKDEDEDG

SEQ ID NO: 885343 - protein, 9 aa, Homo Sapiens
QMTVAHMWF

SEQ ID NO: 885344 - protein, 9 aa, Homo Sapiens
YAGIFRFRL

SEQ ID NO: 885345 - protein, 9 aa, Homo Sapiens
FTTGIVSTT

SEQ ID NO: 885346 - protein, 9 aa, Homo Sapiens
NKDALIEIL

SEQ ID NO: 885347 - protein, 9 aa, Homo Sapiens
QSPKRPQSP

SEQ ID NO: 885348 - protein, 9 aa, Homo Sapiens
RKLIKKCSE

SEQ ID NO: 885349 - protein, 9 aa, Homo Sapiens
TFGSSKWVM

SEQ ID NO: 885350 - protein, 9 aa, Homo Sapiens
PAPFKSPEE

SEQ ID NO: 885351 - protein, 9 aa, Homo Sapiens
KAFNLLSNI

SEQ ID NO: 885352 - protein, 9 aa, Homo Sapiens
LLYRNNFLT

SEQ ID NO: 885353 - protein, 9 aa, Homo Sapiens
PPREEAAQR

SEQ ID NO: 885354 - protein, 9 aa, Homo Sapiens
KIGNAIAQR

SEQ ID NO: 885355 - protein, 9 aa, Homo Sapiens
AAIASERHS

SEQ ID NO: 885356 - protein, 9 aa, Homo Sapiens
LHFEEDKNA

SEQ ID NO: 885357 - protein, 9 aa, Homo Sapiens
VLPPVGSEN

SEQ ID NO: 885358 - protein, 9 aa, Homo Sapiens
VMALVDGPA

SEQ ID NO: 885359 - protein, 9 aa, Homo Sapiens
WCYLRLQHI

SEQ ID NO: 885360 - protein, 9 aa, Homo Sapiens
TKKTSSFNF

SEQ ID NO: 885361 - protein, 9 aa, Homo Sapiens
FDNKLKTLE

SEQ ID NO: 885362 - protein, 9 aa, Homo Sapiens
HIKHRTSDQ

SEQ ID NO: 885363 - protein, 9 aa, Homo Sapiens
KDDIIKRNP

SEQ ID NO: 885364 - protein, 9 aa, Homo Sapiens
ACTKKIGLE

SEQ ID NO: 885365 - protein, 9 aa, Homo Sapiens
GNGYRILSS

SEQ ID NO: 885366 - protein, 9 aa, Homo Sapiens
VEVADVNNN

SEQ ID NO: 885367 - protein, 9 aa, Homo Sapiens
EECVQKFIK

SEQ ID NO: 885368 - protein, 9 aa, Homo Sapiens
KFELLARLC

SEQ ID NO: 885369 - protein, 9 aa, Homo Sapiens
DSDLDCKRR

SEQ ID NO: 885370 - protein, 9 aa, Homo Sapiens
LVLTNCDFD

SEQ ID NO: 885371 - protein, 9 aa, Homo Sapiens
RLLIENCNL

SEQ ID NO: 885372 - protein, 9 aa, Homo Sapiens
SEYEVRIFK

SEQ ID NO: 885373 - protein, 9 aa, Homo Sapiens
KSKYVSLPV

SEQ ID NO: 885374 - protein, 9 aa, Homo Sapiens
DPQVNVFAI

SEQ ID NO: 885375 - protein, 9 aa, Homo Sapiens
SSYLRCCLM

SEQ ID NO: 885376 - protein, 9 aa, Homo Sapiens
SLAQNQFIA

SEQ ID NO: 885377 - protein, 9 aa, Homo Sapiens
LPVGRLCSL

SEQ ID NO: 885378 - protein, 9 aa, Homo Sapiens
RGFPPLDWF

SEQ ID NO: 885379 - protein, 9 aa, Homo Sapiens
PKDFMDQNQ

SEQ ID NO: 885380 - protein, 9 aa, Homo Sapiens
NTIHEEFPR

SEQ ID NO: 885381 - protein, 9 aa, Homo Sapiens
EFWRGFYKM

SEQ ID NO: 885382 - protein, 9 aa, Homo Sapiens
KSSSTDQKY

SEQ ID NO: 885383 - protein, 9 aa, Homo Sapiens
DEYLKSPLP

SEQ ID NO: 885384 - protein, 9 aa, Homo Sapiens
LASGDQSGN

SEQ ID NO: 885385 - protein, 9 aa, Homo Sapiens
QQVQTHFST

SEQ ID NO: 885386 - protein, 9 aa, Homo Sapiens
GLWSQAHFP

SEQ ID NO: 885387 - protein, 9 aa, Homo Sapiens
QCDVVDTTF

SEQ ID NO: 885388 - protein, 9 aa, Homo Sapiens
LHVADNNEK

SEQ ID NO: 885389 - protein, 9 aa, Homo Sapiens
YGFVEGLGT

SEQ ID NO: 885390 - protein, 9 aa, Homo Sapiens
QVSLKASND

SEQ ID NO: 885391 - protein, 9 aa, Homo Sapiens
FHPRSHCLY

SEQ ID NO: 885392 - protein, 9 aa, Homo Sapiens
LKVLTNKTL

SEQ ID NO: 885393 - protein, 9 aa, Homo Sapiens
CAEEPCGVG

SEQ ID NO: 885394 - protein, 9 aa, Homo Sapiens
SQAFGNVLS

SEQ ID NO: 885395 - protein, 9 aa, Homo Sapiens
RSGTFCTCA

SEQ ID NO: 885396 - protein, 9 aa, Homo Sapiens
VLAQLWDHS

SEQ ID NO: 885397 - protein, 9 aa, Homo Sapiens
VKEIRRKFE

SEQ ID NO: 885398 - protein, 9 aa, Homo Sapiens
LLGLEVTGK

SEQ ID NO: 885399 - protein, 9 aa, Homo Sapiens
IVAKYFALP

SEQ ID NO: 885400 - protein, 9 aa, Homo Sapiens
KKDNFSLKL

SEQ ID NO: 885401 - protein, 9 aa, Homo Sapiens
VPDDVYAKH

SEQ ID NO: 885402 - protein, 9 aa, Homo Sapiens
LWINPDDFP

SEQ ID NO: 885403 - protein, 9 aa, Homo Sapiens
QLTQIMSLF

SEQ ID NO: 885404 - protein, 9 aa, Homo Sapiens
LKNFLHWRR

SEQ ID NO: 885405 - protein, 9 aa, Homo Sapiens
KLTEICHEV

SEQ ID NO: 885406 - protein, 9 aa, Homo Sapiens
NYGHIYNKN

SEQ ID NO: 885407 - protein, 9 aa, Homo Sapiens
KRGQLYASE

SEQ ID NO: 885408 - protein, 9 aa, Homo Sapiens
YPNAFCIAK

SEQ ID NO: 885409 - protein, 9 aa, Homo Sapiens
CFHTDKTSF

SEQ ID NO: 885410 - protein, 9 aa, Homo Sapiens
NREEAILNM

SEQ ID NO: 885411 - protein, 9 aa, Homo Sapiens
AGGFHSRSS

SEQ ID NO: 885412 - protein, 9 aa, Homo Sapiens
FFHFILALY

SEQ ID NO: 885413 - protein, 9 aa, Homo Sapiens
YVIRTFAVG

SEQ ID NO: 885414 - protein, 9 aa, Homo Sapiens
NPLGLEAEK

SEQ ID NO: 885415 - protein, 9 aa, Homo Sapiens
GYKHFDKSP

SEQ ID NO: 885416 - protein, 9 aa, Homo Sapiens
SPSRPLSQR

SEQ ID NO: 885417 - protein, 9 aa, Homo Sapiens
KSFDLRPGV

SEQ ID NO: 885418 - protein, 9 aa, Homo Sapiens
LKKDYFSQE

SEQ ID NO: 885419 - protein, 9 aa, Homo Sapiens
YKLIKSQNI

SEQ ID NO: 885420 - protein, 9 aa, Homo Sapiens
QPLLGSCGT

SEQ ID NO: 885421 - protein, 9 aa, Homo Sapiens
HCSIPSLSS

SEQ ID NO: 885422 - protein, 9 aa, Homo Sapiens
WMATSGPGG

SEQ ID NO: 885423 - protein, 9 aa, Homo Sapiens
FCRDAKALE

SEQ ID NO: 885424 - protein, 9 aa, Homo Sapiens
CKVWRNPLT

SEQ ID NO: 885425 - protein, 9 aa, Homo Sapiens
NDFVEGYYH

SEQ ID NO: 885426 - protein, 9 aa, Homo Sapiens
TKEPDRDER

SEQ ID NO: 885427 - protein, 9 aa, Homo Sapiens
LGLLGHNNT

SEQ ID NO: 885428 - protein, 9 aa, Homo Sapiens
HTRNVHYCT

SEQ ID NO: 885429 - protein, 9 aa, Homo Sapiens
PLSSTVTVC

SEQ ID NO: 885430 - protein, 9 aa, Homo Sapiens
DRMSTKNAA

SEQ ID NO: 885431 - protein, 9 aa, Homo Sapiens
EPFILFQLY

SEQ ID NO: 885432 - protein, 9 aa, Homo Sapiens
VRPDNFELV

SEQ ID NO: 885433 - protein, 9 aa, Homo Sapiens
FLALLLIII

SEQ ID NO: 885434 - protein, 9 aa, Homo Sapiens
NEKKNKVVK

SEQ ID NO: 885435 - protein, 9 aa, Homo Sapiens
ERVCLSPRQ

SEQ ID NO: 885436 - protein, 9 aa, Homo Sapiens
FHSRSSSVG

SEQ ID NO: 885437 - protein, 9 aa, Homo Sapiens
TLSSYSGMI

SEQ ID NO: 885438 - protein, 9 aa, Homo Sapiens
MEIGPGELG

SEQ ID NO: 885439 - protein, 9 aa, Homo Sapiens
IWRQQGFLG

SEQ ID NO: 885440 - protein, 9 aa, Homo Sapiens
SYNPDKLTL

SEQ ID NO: 885441 - protein, 9 aa, Homo Sapiens
IKTQLEQEI

SEQ ID NO: 885442 - protein, 9 aa, Homo Sapiens
AFNTNDGRP

SEQ ID NO: 885443 - protein, 9 aa, Homo Sapiens
HRATLLVPD

SEQ ID NO: 885444 - protein, 9 aa, Homo Sapiens
RKLLSSDQN

SEQ ID NO: 885445 - protein, 9 aa, Homo Sapiens
FEEYFMRQQ

SEQ ID NO: 885446 - protein, 9 aa, Homo Sapiens
RMESTGKLG

SEQ ID NO: 885447 - protein, 9 aa, Homo Sapiens
KNLAITLHK

SEQ ID NO: 885448 - protein, 9 aa, Homo Sapiens
KEKLGTHLS

SEQ ID NO: 885449 - protein, 9 aa, Homo Sapiens
SVGKYINCD

SEQ ID NO: 885450 - protein, 9 aa, Homo Sapiens
SGISSLNEL

SEQ ID NO: 885451 - protein, 9 aa, Homo Sapiens
IASNAAGEV

SEQ ID NO: 885452 - protein, 9 aa, Homo Sapiens
SLLVVHQQT

SEQ ID NO: 885453 - protein, 9 aa, Homo Sapiens
DTMTTFECE

SEQ ID NO: 885454 - protein, 9 aa, Homo Sapiens
MIYLAPEVQ

SEQ ID NO: 885455 - protein, 9 aa, Homo Sapiens
GLADGEPDQ

SEQ ID NO: 885456 - protein, 9 aa, Homo Sapiens
IMAIDIFFH

SEQ ID NO: 885457 - protein, 9 aa, Homo Sapiens
NMNLSIIMT

SEQ ID NO: 885458 - protein, 9 aa, Homo Sapiens
LAEKNIPLI

SEQ ID NO: 885459 - protein, 9 aa, Homo Sapiens
VLDVGSGSG

SEQ ID NO: 885460 - protein, 9 aa, Homo Sapiens
DGAVLRMDA

SEQ ID NO: 885461 - protein, 9 aa, Homo Sapiens
PGEDAGCRP

SEQ ID NO: 885462 - protein, 9 aa, Homo Sapiens
FCDVSSDVF

SEQ ID NO: 885463 - protein, 9 aa, Homo Sapiens
ASERHSISN

SEQ ID NO: 885464 - protein, 9 aa, Homo Sapiens
IWQLQKNKY

SEQ ID NO: 885465 - protein, 9 aa, Homo Sapiens
LTQHQVFHT

SEQ ID NO: 885466 - protein, 9 aa, Homo Sapiens
ADILRSQSM

SEQ ID NO: 885467 - protein, 9 aa, Homo Sapiens
VVIIILLMF

SEQ ID NO: 885468 - protein, 9 aa, Homo Sapiens
HSLMLYHKH

SEQ ID NO: 885469 - protein, 9 aa, Homo Sapiens
LLKFCRERV

SEQ ID NO: 885470 - protein, 9 aa, Homo Sapiens
EEETKKKEG

SEQ ID NO: 885471 - protein, 9 aa, Homo Sapiens
IQHQIIHTK

SEQ ID NO: 885472 - protein, 9 aa, Homo Sapiens
IATELPLDN

SEQ ID NO: 885473 - protein, 9 aa, Homo Sapiens
PSSRTTKSP

SEQ ID NO: 885474 - protein, 9 aa, Homo Sapiens
AQRKCLSPG

SEQ ID NO: 885475 - protein, 9 aa, Homo Sapiens
AFLYNLYRD

SEQ ID NO: 885476 - protein, 9 aa, Homo Sapiens
YANFGLRLV

SEQ ID NO: 885477 - protein, 9 aa, Homo Sapiens
QDDDVPLSP

SEQ ID NO: 885478 - protein, 9 aa, Homo Sapiens
LSGNAGGFH

SEQ ID NO: 885479 - protein, 9 aa, Homo Sapiens
IEAPEGKLK

SEQ ID NO: 885480 - protein, 9 aa, Homo Sapiens
TEFFLMIFK

SEQ ID NO: 885481 - protein, 9 aa, Homo Sapiens
IQEQVFFLF

SEQ ID NO: 885482 - protein, 9 aa, Homo Sapiens
RQLVLNNYI

SEQ ID NO: 885483 - protein, 9 aa, Homo Sapiens
RAGFKAAIV

SEQ ID NO: 885484 - protein, 9 aa, Homo Sapiens
SYIMSGPNS

SEQ ID NO: 885485 - protein, 9 aa, Homo Sapiens
FDRQLYQPE

SEQ ID NO: 885486 - protein, 9 aa, Homo Sapiens
HMVKEDIDA

SEQ ID NO: 885487 - protein, 9 aa, Homo Sapiens
GSDISNFGA

SEQ ID NO: 885488 - protein, 9 aa, Homo Sapiens
IAVVLSFFR

SEQ ID NO: 885489 - protein, 9 aa, Homo Sapiens
LACTDMFVA

SEQ ID NO: 885490 - protein, 9 aa, Homo Sapiens
LLWASELAP

SEQ ID NO: 885491 - protein, 9 aa, Homo Sapiens
QGEVRLGDT

SEQ ID NO: 885492 - protein, 9 aa, Homo Sapiens
TRDNLPLKL

SEQ ID NO: 885493 - protein, 9 aa, Homo Sapiens
VIHQQTHTG

SEQ ID NO: 885494 - protein, 9 aa, Homo Sapiens
PFFPQEQKA

SEQ ID NO: 885495 - protein, 9 aa, Homo Sapiens
PVADIAVKL

SEQ ID NO: 885496 - protein, 9 aa, Homo Sapiens
GPVIQFFGV

SEQ ID NO: 885497 - protein, 9 aa, Homo Sapiens
KNQVARFNN

SEQ ID NO: 885498 - protein, 9 aa, Homo Sapiens
PVYPIKEAP

SEQ ID NO: 885499 - protein, 9 aa, Homo Sapiens
NTAGTVFAL

SEQ ID NO: 885500 - protein, 9 aa, Homo Sapiens
LISSVAVDA

SEQ ID NO: 885501 - protein, 9 aa, Homo Sapiens
INSDSDKLS

SEQ ID NO: 885502 - protein, 9 aa, Homo Sapiens
FGTGSSNLW

SEQ ID NO: 885503 - protein, 9 aa, Homo Sapiens
MRLGRQCWK

SEQ ID NO: 885504 - protein, 9 aa, Homo Sapiens
KQGGCCSPV

SEQ ID NO: 885505 - protein, 9 aa, Homo Sapiens
HLTSHGALR

SEQ ID NO: 885506 - protein, 9 aa, Homo Sapiens
SIFLPQMNP

SEQ ID NO: 885507 - protein, 9 aa, Homo Sapiens
FKLEELCAA

SEQ ID NO: 885508 - protein, 9 aa, Homo Sapiens
VEMLLNPEE

SEQ ID NO: 885509 - protein, 9 aa, Homo Sapiens
ATIRRTDQL

SEQ ID NO: 885510 - protein, 9 aa, Homo Sapiens
FYLHVADNN

SEQ ID NO: 885511 - protein, 9 aa, Homo Sapiens
DYKYFYICV

SEQ ID NO: 885512 - protein, 9 aa, Homo Sapiens
NKSKDDDEP

SEQ ID NO: 885513 - protein, 9 aa, Homo Sapiens
ATIIRQLSS

SEQ ID NO: 885514 - protein, 9 aa, Homo Sapiens
QNLDLQIRP

SEQ ID NO: 885515 - protein, 9 aa, Homo Sapiens
LIINLGEQQ

SEQ ID NO: 885516 - protein, 9 aa, Homo Sapiens
RQRFWGLLR

SEQ ID NO: 885517 - protein, 9 aa, Homo Sapiens
CILGTTGLF

SEQ ID NO: 885518 - protein, 9 aa, Homo Sapiens
FSQEEWILL

SEQ ID NO: 885519 - protein, 9 aa, Homo Sapiens
FNSLDVYGQ

SEQ ID NO: 885520 - protein, 9 aa, Homo Sapiens
LCKRVGPGF

SEQ ID NO: 885521 - protein, 9 aa, Homo Sapiens
VSGAGLQNG

SEQ ID NO: 885522 - protein, 9 aa, Homo Sapiens
VFKEIIGYT

SEQ ID NO: 885523 - protein, 9 aa, Homo Sapiens
SYTRKSQLQ

SEQ ID NO: 885524 - protein, 9 aa, Homo Sapiens
VLGVCLGNS

SEQ ID NO: 885525 - protein, 9 aa, Homo Sapiens
QIYHRKAKY

SEQ ID NO: 885526 - protein, 9 aa, Homo Sapiens
HCLVESTSL

SEQ ID NO: 885527 - protein, 9 aa, Homo Sapiens
FESQIISHY

SEQ ID NO: 885528 - protein, 9 aa, Homo Sapiens
LSSHVSSEA

SEQ ID NO: 885529 - protein, 9 aa, Homo Sapiens
FKKLNNLNT

SEQ ID NO: 885530 - protein, 9 aa, Homo Sapiens
SQTKSSQME

SEQ ID NO: 885531 - protein, 9 aa, Homo Sapiens
NDFVVAFNT

SEQ ID NO: 885532 - protein, 9 aa, Homo Sapiens
CLCYLFLAE

SEQ ID NO: 885533 - protein, 9 aa, Homo Sapiens
KIQNISYTP

SEQ ID NO: 885534 - protein, 9 aa, Homo Sapiens
FTAVSLLNL

SEQ ID NO: 885535 - protein, 9 aa, Homo Sapiens
AQQFKMQLL

SEQ ID NO: 885536 - protein, 9 aa, Homo Sapiens
KAGKTQTFY

SEQ ID NO: 885537 - protein, 9 aa, Homo Sapiens
APCNPQTGA

SEQ ID NO: 885538 - protein, 9 aa, Homo Sapiens
VYQPLHYAT

SEQ ID NO: 885539 - protein, 9 aa, Homo Sapiens
AEQIWRRRP

SEQ ID NO: 885540 - protein, 9 aa, Homo Sapiens
SNGRSYKQT

SEQ ID NO: 885541 - protein, 9 aa, Homo Sapiens
LSLVVHHCR

SEQ ID NO: 885542 - protein, 9 aa, Homo Sapiens
LMPHNYTRC

SEQ ID NO: 885543 - protein, 9 aa, Homo Sapiens
KHILAKIWW

SEQ ID NO: 885544 - protein, 9 aa, Homo Sapiens
SGDIVSVLC

SEQ ID NO: 885545 - protein, 9 aa, Homo Sapiens
HLAQNISKL

SEQ ID NO: 885546 - protein, 9 aa, Homo Sapiens
LKLVRLMQD

SEQ ID NO: 885547 - protein, 9 aa, Homo Sapiens
ESRFSISFQ

SEQ ID NO: 885548 - protein, 9 aa, Homo Sapiens
EHQSGLVPQ

SEQ ID NO: 885549 - protein, 9 aa, Homo Sapiens
TLMINFNGE

SEQ ID NO: 885550 - protein, 9 aa, Homo Sapiens
EKDQGSTHS

SEQ ID NO: 885551 - protein, 9 aa, Homo Sapiens
DNRKFYLFA

SEQ ID NO: 885552 - protein, 9 aa, Homo Sapiens
LLTTMLQNG

SEQ ID NO: 885553 - protein, 9 aa, Homo Sapiens
MHNLKTRTY

SEQ ID NO: 885554 - protein, 9 aa, Homo Sapiens
FGWCSSLQR

SEQ ID NO: 885555 - protein, 9 aa, Homo Sapiens
GILTPEFCQ

SEQ ID NO: 885556 - protein, 9 aa, Homo Sapiens
KRSELVSWY

SEQ ID NO: 885557 - protein, 9 aa, Homo Sapiens
PLGPEPLLA

SEQ ID NO: 885558 - protein, 9 aa, Homo Sapiens
TWAIILKKN

SEQ ID NO: 885559 - protein, 9 aa, Homo Sapiens
NTDILFLRP

SEQ ID NO: 885560 - protein, 9 aa, Homo Sapiens
KYVAVEEFP

SEQ ID NO: 885561 - protein, 9 aa, Homo Sapiens
KYNGNVEDI

SEQ ID NO: 885562 - protein, 9 aa, Homo Sapiens
KENAYNASL

SEQ ID NO: 885563 - protein, 9 aa, Homo Sapiens
RLRLLRSGL

SEQ ID NO: 885564 - protein, 9 aa, Homo Sapiens
DNQRTFRDV

SEQ ID NO: 885565 - protein, 9 aa, Homo Sapiens
IYLVHGGPS

SEQ ID NO: 885566 - protein, 9 aa, Homo Sapiens
RNIIPETLF

SEQ ID NO: 885567 - protein, 9 aa, Homo Sapiens
LEAALDSIH

SEQ ID NO: 885568 - protein, 9 aa, Homo Sapiens
PVWFLRSMF

SEQ ID NO: 885569 - protein, 9 aa, Homo Sapiens
DLSLLDHLG

SEQ ID NO: 885570 - protein, 9 aa, Homo Sapiens
CLFLEYVTL

SEQ ID NO: 885571 - protein, 9 aa, Homo Sapiens
DKIVVTLTE

SEQ ID NO: 885572 - protein, 9 aa, Homo Sapiens
HVKKDYLRE

SEQ ID NO: 885573 - protein, 9 aa, Homo Sapiens
KKRLPFSSL

SEQ ID NO: 885574 - protein, 9 aa, Homo Sapiens
PQSCLPHEV

SEQ ID NO: 885575 - protein, 9 aa, Homo Sapiens
EIRYTHEGV

SEQ ID NO: 885576 - protein, 9 aa, Homo Sapiens
EDGKFLFVE

SEQ ID NO: 885577 - protein, 9 aa, Homo Sapiens
CIALVSVCV

SEQ ID NO: 885578 - protein, 9 aa, Homo Sapiens
PLPGSLHEK

SEQ ID NO: 885579 - protein, 9 aa, Homo Sapiens
DNILLITED

SEQ ID NO: 885580 - protein, 9 aa, Homo Sapiens
LGRAVRVLH

SEQ ID NO: 885581 - protein, 9 aa, Homo Sapiens
TEHQIIHTG

SEQ ID NO: 885582 - protein, 9 aa, Homo Sapiens
ARTSKEQEG

SEQ ID NO: 885583 - protein, 9 aa, Homo Sapiens
QINIWYGFS

SEQ ID NO: 885584 - protein, 9 aa, Homo Sapiens
QRQKQQEEQ

SEQ ID NO: 885585 - protein, 9 aa, Homo Sapiens
WQIWHMDLI

SEQ ID NO: 885586 - protein, 9 aa, Homo Sapiens
KKILLKIPE

SEQ ID NO: 885587 - protein, 9 aa, Homo Sapiens
GVLSHTKPS

SEQ ID NO: 885588 - protein, 9 aa, Homo Sapiens
RQNESHLID

SEQ ID NO: 885589 - protein, 9 aa, Homo Sapiens
FLDKKHQNH

SEQ ID NO: 885590 - protein, 9 aa, Homo Sapiens
GAKKAAEDS

SEQ ID NO: 885591 - protein, 9 aa, Homo Sapiens
INPETKLII

SEQ ID NO: 885592 - protein, 9 aa, Homo Sapiens
MPDLYFYRN

SEQ ID NO: 885593 - protein, 9 aa, Homo Sapiens
VHVMIFVGV

SEQ ID NO: 885594 - protein, 9 aa, Homo Sapiens
HISEQFTAM

SEQ ID NO: 885595 - protein, 9 aa, Homo Sapiens
ASLNKSADD

SEQ ID NO: 885596 - protein, 9 aa, Homo Sapiens
GTSDFLPSQ

SEQ ID NO: 885597 - protein, 9 aa, Homo Sapiens
AAWVNEIWK

SEQ ID NO: 885598 - protein, 9 aa, Homo Sapiens
DSLYAVNSF

SEQ ID NO: 885599 - protein, 9 aa, Homo Sapiens
ECLVHELDT

SEQ ID NO: 885600 - protein, 9 aa, Homo Sapiens
DKVVRLCHN

SEQ ID NO: 885601 - protein, 9 aa, Homo Sapiens
KVGAWGDYN

SEQ ID NO: 885602 - protein, 9 aa, Homo Sapiens
NLVIHAPPP

SEQ ID NO: 885603 - protein, 9 aa, Homo Sapiens
LLWVGTFLC

SEQ ID NO: 885604 - protein, 9 aa, Homo Sapiens
DENLIQKHT

SEQ ID NO: 885605 - protein, 9 aa, Homo Sapiens
GTLGIICLL

SEQ ID NO: 885606 - protein, 9 aa, Homo Sapiens
KEGIAFLYN

SEQ ID NO: 885607 - protein, 9 aa, Homo Sapiens
TGAMVCCNN

SEQ ID NO: 885608 - protein, 9 aa, Homo Sapiens
NCNLKYLPF

SEQ ID NO: 885609 - protein, 9 aa, Homo Sapiens
MIQLHSKRD

SEQ ID NO: 885610 - protein, 9 aa, Homo Sapiens
RWKLVKDNS

SEQ ID NO: 885611 - protein, 9 aa, Homo Sapiens
RMIRKQNSL

SEQ ID NO: 885612 - protein, 9 aa, Homo Sapiens
HKDILQLIG

SEQ ID NO: 885613 - protein, 9 aa, Homo Sapiens
TAKQIIYNY

SEQ ID NO: 885614 - protein, 9 aa, Homo Sapiens
NLKRKNKLP

SEQ ID NO: 885615 - protein, 9 aa, Homo Sapiens
AVSPKFVCE

SEQ ID NO: 885616 - protein, 9 aa, Homo Sapiens
FSSRRPQND

SEQ ID NO: 885617 - protein, 9 aa, Homo Sapiens
HLITHKQTH

SEQ ID NO: 885618 - protein, 9 aa, Homo Sapiens
VLRLIFNHF

SEQ ID NO: 885619 - protein, 9 aa, Homo Sapiens
DCITQIKCK

SEQ ID NO: 885620 - protein, 9 aa, Homo Sapiens
KTYFFSSGG

SEQ ID NO: 885621 - protein, 9 aa, Homo Sapiens
LGENGIANL

SEQ ID NO: 885622 - protein, 9 aa, Homo Sapiens
LCEIKESHH

SEQ ID NO: 885623 - protein, 9 aa, Homo Sapiens
ASLTLKYGA

SEQ ID NO: 885624 - protein, 9 aa, Homo Sapiens
SLVMWLGGF

SEQ ID NO: 885625 - protein, 9 aa, Homo Sapiens
VTIRNVLLT

SEQ ID NO: 885626 - protein, 9 aa, Homo Sapiens
TKSPPSPGT

SEQ ID NO: 885627 - protein, 9 aa, Homo Sapiens
VCTVDSYDP

SEQ ID NO: 885628 - protein, 9 aa, Homo Sapiens
RSTQTRLST

SEQ ID NO: 885629 - protein, 9 aa, Homo Sapiens
AEECIRLCR

SEQ ID NO: 885630 - protein, 9 aa, Homo Sapiens
LPPKKTQII

SEQ ID NO: 885631 - protein, 9 aa, Homo Sapiens
QHAARRLDG

SEQ ID NO: 885632 - protein, 9 aa, Homo Sapiens
MPSDLQAFR

SEQ ID NO: 885633 - protein, 9 aa, Homo Sapiens
DVCMIFNAG

SEQ ID NO: 885634 - protein, 9 aa, Homo Sapiens
SLARKYMCS

SEQ ID NO: 885635 - protein, 9 aa, Homo Sapiens
KYISRECAL

SEQ ID NO: 885636 - protein, 9 aa, Homo Sapiens
CGKLEAQIE

SEQ ID NO: 885637 - protein, 9 aa, Homo Sapiens
NQFIANHPF

SEQ ID NO: 885638 - protein, 9 aa, Homo Sapiens
VINNPQFVF

SEQ ID NO: 885639 - protein, 9 aa, Homo Sapiens
SMCLIFLWK

SEQ ID NO: 885640 - protein, 9 aa, Homo Sapiens
NKSWRKIKN

SEQ ID NO: 885641 - protein, 9 aa, Homo Sapiens
FRVLTRKHS

SEQ ID NO: 885642 - protein, 9 aa, Homo Sapiens
QGEGKEIHR

SEQ ID NO: 885643 - protein, 9 aa, Homo Sapiens
LEYRISQQT

SEQ ID NO: 885644 - protein, 9 aa, Homo Sapiens
LSGNDIILY

SEQ ID NO: 885645 - protein, 9 aa, Homo Sapiens
NNPPVMLFD

SEQ ID NO: 885646 - protein, 9 aa, Homo Sapiens
EDINKIYDE

SEQ ID NO: 885647 - protein, 9 aa, Homo Sapiens
YPNAVLRLI

SEQ ID NO: 885648 - protein, 9 aa, Homo Sapiens
WKQPRLTHN

SEQ ID NO: 885649 - protein, 9 aa, Homo Sapiens
KVYKTDNNI

SEQ ID NO: 885650 - protein, 9 aa, Homo Sapiens
PPDQKARSS

SEQ ID NO: 885651 - protein, 9 aa, Homo Sapiens
NDTLVVLPP

SEQ ID NO: 885652 - protein, 9 aa, Homo Sapiens
QTLPPSSNP

SEQ ID NO: 885653 - protein, 9 aa, Homo Sapiens
FAFGSKDKH

SEQ ID NO: 885654 - protein, 9 aa, Homo Sapiens
PGSAFKKLN

SEQ ID NO: 885655 - protein, 9 aa, Homo Sapiens
SASTGRKWF

SEQ ID NO: 885656 - protein, 9 aa, Homo Sapiens
DSPFFPQEQ

SEQ ID NO: 885657 - protein, 9 aa, Homo Sapiens
QVSHRYPQI

SEQ ID NO: 885658 - protein, 9 aa, Homo Sapiens
KKDGIGLYL

SEQ ID NO: 885659 - protein, 9 aa, Homo Sapiens
QFVPEKMRH

SEQ ID NO: 885660 - protein, 9 aa, Homo Sapiens
LDREKTPKL

SEQ ID NO: 885661 - protein, 9 aa, Homo Sapiens
ALPLLSNAK

SEQ ID NO: 885662 - protein, 9 aa, Homo Sapiens
ILCSLFFAI

SEQ ID NO: 885663 - protein, 9 aa, Homo Sapiens
VSKTLIFIF

SEQ ID NO: 885664 - protein, 9 aa, Homo Sapiens
ALVGRCLVP

SEQ ID NO: 885665 - protein, 9 aa, Homo Sapiens
CLCFAILYS

SEQ ID NO: 885666 - protein, 9 aa, Homo Sapiens
GSGFAGGED

SEQ ID NO: 885667 - protein, 9 aa, Homo Sapiens
QARGALRFT

SEQ ID NO: 885668 - protein, 9 aa, Homo Sapiens
KKEVNQARL

SEQ ID NO: 885669 - protein, 9 aa, Homo Sapiens
ANKPPYPAL

SEQ ID NO: 885670 - protein, 9 aa, Homo Sapiens
YLNRIHKLL

SEQ ID NO: 885671 - protein, 9 aa, Homo Sapiens
RGTSFNLIG

SEQ ID NO: 885672 - protein, 9 aa, Homo Sapiens
EYKNIRIPE

SEQ ID NO: 885673 - protein, 9 aa, Homo Sapiens
SIITKKTSS

SEQ ID NO: 885674 - protein, 9 aa, Homo Sapiens
QTEECQLQL

SEQ ID NO: 885675 - protein, 9 aa, Homo Sapiens
QNRIIIVFH

SEQ ID NO: 885676 - protein, 9 aa, Homo Sapiens
VVERDAQPS

SEQ ID NO: 885677 - protein, 9 aa, Homo Sapiens
NAANESRKK

SEQ ID NO: 885678 - protein, 9 aa, Homo Sapiens
IPALKTIIN

SEQ ID NO: 885679 - protein, 9 aa, Homo Sapiens
GTFLEELTQ

SEQ ID NO: 885680 - protein, 9 aa, Homo Sapiens
HCKKEHKRE

SEQ ID NO: 885681 - protein, 9 aa, Homo Sapiens
DTAGNFSFS

SEQ ID NO: 885682 - protein, 9 aa, Homo Sapiens
EMINNQNKS

SEQ ID NO: 885683 - protein, 9 aa, Homo Sapiens
VKYALQRTW

SEQ ID NO: 885684 - protein, 9 aa, Homo Sapiens
QVLAQMHDE

SEQ ID NO: 885685 - protein, 9 aa, Homo Sapiens
ISPFMDCSA

SEQ ID NO: 885686 - protein, 9 aa, Homo Sapiens
IILLNNTGN

SEQ ID NO: 885687 - protein, 9 aa, Homo Sapiens
FLIKATTEE

SEQ ID NO: 885688 - protein, 9 aa, Homo Sapiens
EDELDMGQS

SEQ ID NO: 885689 - protein, 9 aa, Homo Sapiens
PEKEEQYIT

SEQ ID NO: 885690 - protein, 9 aa, Homo Sapiens
CLTRHQIIH

SEQ ID NO: 885691 - protein, 9 aa, Homo Sapiens
FAITFQYAV

SEQ ID NO: 885692 - protein, 9 aa, Homo Sapiens
PLVLTNCDF

SEQ ID NO: 885693 - protein, 9 aa, Homo Sapiens
ANLINAGKQ

SEQ ID NO: 885694 - protein, 9 aa, Homo Sapiens
HICKFHCEL

SEQ ID NO: 885695 - protein, 9 aa, Homo Sapiens
ALNSLKEKQ

SEQ ID NO: 885696 - protein, 9 aa, Homo Sapiens
RRRNQCQYC

SEQ ID NO: 885697 - protein, 9 aa, Homo Sapiens
LPQMNPFVL

SEQ ID NO: 885698 - protein, 9 aa, Homo Sapiens
PRAFKHVFE

SEQ ID NO: 885699 - protein, 9 aa, Homo Sapiens
MRRKNRKTR

SEQ ID NO: 885700 - protein, 9 aa, Homo Sapiens
KQRQKQQEE

SEQ ID NO: 885701 - protein, 9 aa, Homo Sapiens
TDMSSLSYL

SEQ ID NO: 885702 - protein, 9 aa, Homo Sapiens
EECGKTFKC

SEQ ID NO: 885703 - protein, 9 aa, Homo Sapiens
FILQPLGME

SEQ ID NO: 885704 - protein, 9 aa, Homo Sapiens
RSRAALVGR

SEQ ID NO: 885705 - protein, 9 aa, Homo Sapiens
PQNDRRNAP

SEQ ID NO: 885706 - protein, 9 aa, Homo Sapiens
KVDELVTGK

SEQ ID NO: 885707 - protein, 9 aa, Homo Sapiens
PHGPNLESH

SEQ ID NO: 885708 - protein, 9 aa, Homo Sapiens
YTVGRKIVM

SEQ ID NO: 885709 - protein, 9 aa, Homo Sapiens
IKKMIAKFQ

SEQ ID NO: 885710 - protein, 9 aa, Homo Sapiens
RIKLTGKEC

SEQ ID NO: 885711 - protein, 9 aa, Homo Sapiens
RGEKTTVAT

SEQ ID NO: 885712 - protein, 9 aa, Homo Sapiens
GTTKPGSLT

SEQ ID NO: 885713 - protein, 9 aa, Homo Sapiens
KKAADTVVF

SEQ ID NO: 885714 - protein, 9 aa, Homo Sapiens
GAAHTTPPV

SEQ ID NO: 885715 - protein, 9 aa, Homo Sapiens
CRPIQFEPP

SEQ ID NO: 885716 - protein, 9 aa, Homo Sapiens
GENGIANLI

SEQ ID NO: 885717 - protein, 9 aa, Homo Sapiens
MFAVNMFQT

SEQ ID NO: 885718 - protein, 9 aa, Homo Sapiens
TLHTSAKVF

SEQ ID NO: 885719 - protein, 9 aa, Homo Sapiens
NAGVKQIAL

SEQ ID NO: 885720 - protein, 9 aa, Homo Sapiens
PIKANYLDG

SEQ ID NO: 885721 - protein, 9 aa, Homo Sapiens
KNFVLGRDK

SEQ ID NO: 885722 - protein, 9 aa, Homo Sapiens
FKDVAIELS

SEQ ID NO: 885723 - protein, 9 aa, Homo Sapiens
GKECRDLDD

SEQ ID NO: 885724 - protein, 9 aa, Homo Sapiens
IKPRLSDYE

SEQ ID NO: 885725 - protein, 9 aa, Homo Sapiens
VRRLYVPKG

SEQ ID NO: 885726 - protein, 9 aa, Homo Sapiens
FQYPLTISQ

SEQ ID NO: 885727 - protein, 9 aa, Homo Sapiens
SEVCIYYDY

SEQ ID NO: 885728 - protein, 9 aa, Homo Sapiens
HDSSLVASK

SEQ ID NO: 885729 - protein, 9 aa, Homo Sapiens
RPDEIIEEI

SEQ ID NO: 885730 - protein, 9 aa, Homo Sapiens
PDELLNIIY

SEQ ID NO: 885731 - protein, 9 aa, Homo Sapiens
LSCQACAGI

SEQ ID NO: 885732 - protein, 9 aa, Homo Sapiens
LREFWLYDN

SEQ ID NO: 885733 - protein, 9 aa, Homo Sapiens
QLYDDRNEP

SEQ ID NO: 885734 - protein, 9 aa, Homo Sapiens
CTTANTEPR

SEQ ID NO: 885735 - protein, 9 aa, Homo Sapiens
RTPMLWSRI

SEQ ID NO: 885736 - protein, 9 aa, Homo Sapiens
DHVNLTTCP

SEQ ID NO: 885737 - protein, 9 aa, Homo Sapiens
FDLQIIGFA

SEQ ID NO: 885738 - protein, 9 aa, Homo Sapiens
NIQNVLVDA

SEQ ID NO: 885739 - protein, 9 aa, Homo Sapiens
YKTDNNIVV

SEQ ID NO: 885740 - protein, 9 aa, Homo Sapiens
EEQYITQFT

SEQ ID NO: 885741 - protein, 9 aa, Homo Sapiens
GSGDPFCSI

SEQ ID NO: 885742 - protein, 9 aa, Homo Sapiens
LRLNKELDS

SEQ ID NO: 885743 - protein, 9 aa, Homo Sapiens
KIINTGEKP

SEQ ID NO: 885744 - protein, 9 aa, Homo Sapiens
HLRKYLALQ

SEQ ID NO: 885745 - protein, 9 aa, Homo Sapiens
EPMKVFDSR

SEQ ID NO: 885746 - protein, 9 aa, Homo Sapiens
EPQRHRQKL

SEQ ID NO: 885747 - protein, 9 aa, Homo Sapiens
MVCCNNEAK

SEQ ID NO: 885748 - protein, 9 aa, Homo Sapiens
SENGGTEPP

SEQ ID NO: 885749 - protein, 9 aa, Homo Sapiens
TRLTLSGLF

SEQ ID NO: 885750 - protein, 9 aa, Homo Sapiens
TFNRLYPVA

SEQ ID NO: 885751 - protein, 9 aa, Homo Sapiens
DAGMKPRVI

SEQ ID NO: 885752 - protein, 9 aa, Homo Sapiens
CFVQVENVK

SEQ ID NO: 885753 - protein, 9 aa, Homo Sapiens
HTQYQFGIT

SEQ ID NO: 885754 - protein, 9 aa, Homo Sapiens
RQTPRIDPP

SEQ ID NO: 885755 - protein, 9 aa, Homo Sapiens
STRSAAENA

SEQ ID NO: 885756 - protein, 9 aa, Homo Sapiens
VGHYLKDMM

SEQ ID NO: 885757 - protein, 9 aa, Homo Sapiens
WEHFDCLTA

SEQ ID NO: 885758 - protein, 9 aa, Homo Sapiens
LETHKCAAL

SEQ ID NO: 885759 - protein, 9 aa, Homo Sapiens
IVKCQKLTN

SEQ ID NO: 885760 - protein, 9 aa, Homo Sapiens
MPITANLVA

SEQ ID NO: 885761 - protein, 9 aa, Homo Sapiens
SSMLSTDTN

SEQ ID NO: 885762 - protein, 9 aa, Homo Sapiens
APPYPPGVG

SEQ ID NO: 885763 - protein, 9 aa, Homo Sapiens
DWDNIWNCE

SEQ ID NO: 885764 - protein, 9 aa, Homo Sapiens
SRTLGVAKL

SEQ ID NO: 885765 - protein, 9 aa, Homo Sapiens
KSNGYTMVY

SEQ ID NO: 885766 - protein, 9 aa, Homo Sapiens
QLRTLETQP

SEQ ID NO: 885767 - protein, 9 aa, Homo Sapiens
EYKLNICPE

SEQ ID NO: 885768 - protein, 9 aa, Homo Sapiens
GEVIVTKDN

SEQ ID NO: 885769 - protein, 9 aa, Homo Sapiens
KLAKDIEEE

SEQ ID NO: 885770 - protein, 9 aa, Homo Sapiens
WELPKIAYS

SEQ ID NO: 885771 - protein, 9 aa, Homo Sapiens
WPGPGQLRG

SEQ ID NO: 885772 - protein, 9 aa, Homo Sapiens
KDCDADVHL

SEQ ID NO: 885773 - protein, 9 aa, Homo Sapiens
CSQQELEAK

SEQ ID NO: 885774 - protein, 9 aa, Homo Sapiens
EVFNNLFMR

SEQ ID NO: 885775 - protein, 9 aa, Homo Sapiens
KCNGYCNKC

SEQ ID NO: 885776 - protein, 9 aa, Homo Sapiens
HKTKEMATN

SEQ ID NO: 885777 - protein, 9 aa, Homo Sapiens
TTRQYKLTV

SEQ ID NO: 885778 - protein, 9 aa, Homo Sapiens
LGYARGIDP

SEQ ID NO: 885779 - protein, 9 aa, Homo Sapiens
SCKERNLRE

SEQ ID NO: 885780 - protein, 9 aa, Homo Sapiens
CILSSVDDI

SEQ ID NO: 885781 - protein, 9 aa, Homo Sapiens
LLLFYFIPS

SEQ ID NO: 885782 - protein, 9 aa, Homo Sapiens
QSRKRLIKQ

SEQ ID NO: 885783 - protein, 9 aa, Homo Sapiens
PFDELNNYL

SEQ ID NO: 885784 - protein, 9 aa, Homo Sapiens
VCFFFPSLR

SEQ ID NO: 885785 - protein, 9 aa, Homo Sapiens
ENLCYYKIS

SEQ ID NO: 885786 - protein, 9 aa, Homo Sapiens
TENDIANLF

SEQ ID NO: 885787 - protein, 9 aa, Homo Sapiens
PLATSLGLK

SEQ ID NO: 885788 - protein, 9 aa, Homo Sapiens
INLHQHQRI

SEQ ID NO: 885789 - protein, 9 aa, Homo Sapiens
LLLDGDQLT

SEQ ID NO: 885790 - protein, 9 aa, Homo Sapiens
DKVQSYDPK

SEQ ID NO: 885791 - protein, 9 aa, Homo Sapiens
AGPSDLHHC

SEQ ID NO: 885792 - protein, 9 aa, Homo Sapiens
NYDTPPILK

SEQ ID NO: 885793 - protein, 9 aa, Homo Sapiens
PQYQSMRRD

SEQ ID NO: 885794 - protein, 9 aa, Homo Sapiens
LVSQVDDIF

SEQ ID NO: 885795 - protein, 9 aa, Homo Sapiens
ARQTYPKKP

SEQ ID NO: 885796 - protein, 9 aa, Homo Sapiens
PNPPGTMEE

SEQ ID NO: 885797 - protein, 9 aa, Homo Sapiens
EAHRIQEQL

SEQ ID NO: 885798 - protein, 9 aa, Homo Sapiens
RGPAQKKPP

SEQ ID NO: 885799 - protein, 9 aa, Homo Sapiens
VFEFTKPKR

SEQ ID NO: 885800 - protein, 9 aa, Homo Sapiens
AYFFTIFNA

SEQ ID NO: 885801 - protein, 9 aa, Homo Sapiens
FTFASMTKD

SEQ ID NO: 885802 - protein, 9 aa, Homo Sapiens
SQNPCHNGS

SEQ ID NO: 885803 - protein, 9 aa, Homo Sapiens
YQLRHFSIY

SEQ ID NO: 885804 - protein, 9 aa, Homo Sapiens
FQLCLHYRY

SEQ ID NO: 885805 - protein, 9 aa, Homo Sapiens
PALVWHQQD

SEQ ID NO: 885806 - protein, 9 aa, Homo Sapiens
KSTSFMSVN

SEQ ID NO: 885807 - protein, 9 aa, Homo Sapiens
VKYPKRRMT

SEQ ID NO: 885808 - protein, 9 aa, Homo Sapiens
MQQVQTHFS

SEQ ID NO: 885809 - protein, 9 aa, Homo Sapiens
ELEKCDIFF

SEQ ID NO: 885810 - protein, 9 aa, Homo Sapiens
VRVETTKDH

SEQ ID NO: 885811 - protein, 9 aa, Homo Sapiens
QAEYKLNIC

SEQ ID NO: 885812 - protein, 9 aa, Homo Sapiens
ISNHQHSNR

SEQ ID NO: 885813 - protein, 9 aa, Homo Sapiens
LDGTAVENS

SEQ ID NO: 885814 - protein, 9 aa, Homo Sapiens
YYCLHRRRR

SEQ ID NO: 885815 - protein, 9 aa, Homo Sapiens
DRKTASFLS

SEQ ID NO: 885816 - protein, 9 aa, Homo Sapiens
AREEQDIKI

SEQ ID NO: 885817 - protein, 9 aa, Homo Sapiens
EENTCKTQK

SEQ ID NO: 885818 - protein, 9 aa, Homo Sapiens
KLMSDGSSN

SEQ ID NO: 885819 - protein, 9 aa, Homo Sapiens
RTFNQTAET

SEQ ID NO: 885820 - protein, 9 aa, Homo Sapiens
TVQVPQTTT

SEQ ID NO: 885821 - protein, 9 aa, Homo Sapiens
KPRLSDYET

SEQ ID NO: 885822 - protein, 9 aa, Homo Sapiens
GQESALPMR

SEQ ID NO: 885823 - protein, 9 aa, Homo Sapiens
FACATQMRF

SEQ ID NO: 885824 - protein, 9 aa, Homo Sapiens
ITALGGASS

SEQ ID NO: 885825 - protein, 9 aa, Homo Sapiens
VLHSRDAGP

SEQ ID NO: 885826 - protein, 9 aa, Homo Sapiens
TQQCIPVKR

SEQ ID NO: 885827 - protein, 9 aa, Homo Sapiens
GIDYYNTII

SEQ ID NO: 885828 - protein, 9 aa, Homo Sapiens
SRSGTDLEP

SEQ ID NO: 885829 - protein, 9 aa, Homo Sapiens
PEEPSYPQE

SEQ ID NO: 885830 - protein, 9 aa, Homo Sapiens
EISVVIFKN

SEQ ID NO: 885831 - protein, 9 aa, Homo Sapiens
ADKRIPQIR

SEQ ID NO: 885832 - protein, 9 aa, Homo Sapiens
RNHICNLFD

SEQ ID NO: 885833 - protein, 9 aa, Homo Sapiens
WENPNLNST

SEQ ID NO: 885834 - protein, 9 aa, Homo Sapiens
SDDSKMEDE

SEQ ID NO: 885835 - protein, 9 aa, Homo Sapiens
HGQSHYRHR

SEQ ID NO: 885836 - protein, 9 aa, Homo Sapiens
NDIDEGNDG

SEQ ID NO: 885837 - protein, 9 aa, Homo Sapiens
KITDAKKRE

SEQ ID NO: 885838 - protein, 9 aa, Homo Sapiens
INKEIHTQF

SEQ ID NO: 885839 - protein, 9 aa, Homo Sapiens
YSYLRLEKM

SEQ ID NO: 885840 - protein, 9 aa, Homo Sapiens
PGTMDLVRS

SEQ ID NO: 885841 - protein, 9 aa, Homo Sapiens
SLVLCTHKR

SEQ ID NO: 885842 - protein, 9 aa, Homo Sapiens
PSVPSVPHK

SEQ ID NO: 885843 - protein, 9 aa, Homo Sapiens
MIEYRGRRQ

SEQ ID NO: 885844 - protein, 9 aa, Homo Sapiens
PRCTQQAAL

SEQ ID NO: 885845 - protein, 9 aa, Homo Sapiens
IKEKEEAEA

SEQ ID NO: 885846 - protein, 9 aa, Homo Sapiens
KYNTGKGLF

SEQ ID NO: 885847 - protein, 9 aa, Homo Sapiens
LYTNHLTQE

SEQ ID NO: 885848 - protein, 9 aa, Homo Sapiens
QATLGAADK

SEQ ID NO: 885849 - protein, 9 aa, Homo Sapiens
NQDKIKDTE

SEQ ID NO: 885850 - protein, 9 aa, Homo Sapiens
KDEGPRSDM

SEQ ID NO: 885851 - protein, 9 aa, Homo Sapiens
AVLHQMWRD

SEQ ID NO: 885852 - protein, 9 aa, Homo Sapiens
SSGEERDIQ

SEQ ID NO: 885853 - protein, 9 aa, Homo Sapiens
GSCTGWQSY

SEQ ID NO: 885854 - protein, 9 aa, Homo Sapiens
AVVRIKCPL

SEQ ID NO: 885855 - protein, 9 aa, Homo Sapiens
VQMEGEGAI

SEQ ID NO: 885856 - protein, 9 aa, Homo Sapiens
STIGPPAVE

SEQ ID NO: 885857 - protein, 9 aa, Homo Sapiens
VAVYKTVPI

SEQ ID NO: 885858 - protein, 9 aa, Homo Sapiens
CEDEWESIF

SEQ ID NO: 885859 - protein, 9 aa, Homo Sapiens
NQAMDNHME

SEQ ID NO: 885860 - protein, 9 aa, Homo Sapiens
KKIHPCKKV

SEQ ID NO: 885861 - protein, 9 aa, Homo Sapiens
CSDCRKTFC

SEQ ID NO: 885862 - protein, 9 aa, Homo Sapiens
LFSFQNHIR

SEQ ID NO: 885863 - protein, 9 aa, Homo Sapiens
RCLPWRSPI

SEQ ID NO: 885864 - protein, 9 aa, Homo Sapiens
ASILRAVPS

SEQ ID NO: 885865 - protein, 9 aa, Homo Sapiens
KRLIKQSRE

SEQ ID NO: 885866 - protein, 9 aa, Homo Sapiens
ARRLDGEDG

SEQ ID NO: 885867 - protein, 9 aa, Homo Sapiens
RYFIPGVAI

SEQ ID NO: 885868 - protein, 9 aa, Homo Sapiens
LEKMCLKAS

SEQ ID NO: 885869 - protein, 9 aa, Homo Sapiens
NTARQGLKR

SEQ ID NO: 885870 - protein, 9 aa, Homo Sapiens
IYLACTKLT

SEQ ID NO: 885871 - protein, 9 aa, Homo Sapiens
SELNRAIQR

SEQ ID NO: 885872 - protein, 9 aa, Homo Sapiens
DLKVVKDVS

SEQ ID NO: 885873 - protein, 9 aa, Homo Sapiens
TSYSLYTDK

SEQ ID NO: 885874 - protein, 9 aa, Homo Sapiens
FGSKLVKHH

SEQ ID NO: 885875 - protein, 9 aa, Homo Sapiens
DEAYKLLSQ

SEQ ID NO: 885876 - protein, 9 aa, Homo Sapiens
EQFHYFIII

SEQ ID NO: 885877 - protein, 9 aa, Homo Sapiens
ETKKMMKDK

SEQ ID NO: 885878 - protein, 9 aa, Homo Sapiens
DCKELMNPL

SEQ ID NO: 885879 - protein, 9 aa, Homo Sapiens
RQLAGDSNI

SEQ ID NO: 885880 - protein, 9 aa, Homo Sapiens
SMDNYLSKM

SEQ ID NO: 885881 - protein, 9 aa, Homo Sapiens
RHGISSQIS

SEQ ID NO: 885882 - protein, 9 aa, Homo Sapiens
TVQQVEEAQ

SEQ ID NO: 885883 - protein, 9 aa, Homo Sapiens
PSDRINKFF

SEQ ID NO: 885884 - protein, 9 aa, Homo Sapiens
MAFTHEGNK

SEQ ID NO: 885885 - protein, 9 aa, Homo Sapiens
AQGVGLNST

SEQ ID NO: 885886 - protein, 9 aa, Homo Sapiens
YSRSNPVVS

SEQ ID NO: 885887 - protein, 9 aa, Homo Sapiens
AQQRTYEKC

SEQ ID NO: 885888 - protein, 9 aa, Homo Sapiens
VYVECLSDS

SEQ ID NO: 885889 - protein, 9 aa, Homo Sapiens
NSSCLNKYI

SEQ ID NO: 885890 - protein, 9 aa, Homo Sapiens
AAPLLFSWF

SEQ ID NO: 885891 - protein, 9 aa, Homo Sapiens
LLGISCFFL

SEQ ID NO: 885892 - protein, 9 aa, Homo Sapiens
QLKQWKTFE

SEQ ID NO: 885893 - protein, 9 aa, Homo Sapiens
ARLLSECDA

SEQ ID NO: 885894 - protein, 9 aa, Homo Sapiens
IYNYLKEGS

SEQ ID NO: 885895 - protein, 9 aa, Homo Sapiens
KRRLNTRFS

SEQ ID NO: 885896 - protein, 9 aa, Homo Sapiens
KIGKIRDEM

SEQ ID NO: 885897 - protein, 9 aa, Homo Sapiens
GDGVPPLDA

SEQ ID NO: 885898 - protein, 9 aa, Homo Sapiens
KISLSSHIL

SEQ ID NO: 885899 - protein, 9 aa, Homo Sapiens
VLKNSSSNK

SEQ ID NO: 885900 - protein, 9 aa, Homo Sapiens
ARRIEFQKK

SEQ ID NO: 885901 - protein, 9 aa, Homo Sapiens
VISSGEVHD

SEQ ID NO: 885902 - protein, 9 aa, Homo Sapiens
IANNRNLHS

SEQ ID NO: 885903 - protein, 9 aa, Homo Sapiens
DTFDLQIIG

SEQ ID NO: 885904 - protein, 9 aa, Homo Sapiens
KFKSLLSHN

SEQ ID NO: 885905 - protein, 9 aa, Homo Sapiens
AQRQDCPFF

SEQ ID NO: 885906 - protein, 9 aa, Homo Sapiens
DQYRNAYVW

SEQ ID NO: 885907 - protein, 9 aa, Homo Sapiens
MNIYDSKLW

SEQ ID NO: 885908 - protein, 9 aa, Homo Sapiens
PYECQACQK

SEQ ID NO: 885909 - protein, 9 aa, Homo Sapiens
ARHTLADII

SEQ ID NO: 885910 - protein, 9 aa, Homo Sapiens
NDLALFVDI

SEQ ID NO: 885911 - protein, 9 aa, Homo Sapiens
LNIFKLNGL

SEQ ID NO: 885912 - protein, 9 aa, Homo Sapiens
DIQYAPLSF

SEQ ID NO: 885913 - protein, 9 aa, Homo Sapiens
KTTVATEEL

SEQ ID NO: 885914 - protein, 9 aa, Homo Sapiens
RPASPTWQN

SEQ ID NO: 885915 - protein, 9 aa, Homo Sapiens
FTSPTNFQQ

SEQ ID NO: 885916 - protein, 9 aa, Homo Sapiens
IVELKEAFC

SEQ ID NO: 885917 - protein, 9 aa, Homo Sapiens
LFLLQGAWP

SEQ ID NO: 885918 - protein, 9 aa, Homo Sapiens
KVGSFKVAT

SEQ ID NO: 885919 - protein, 9 aa, Homo Sapiens
DIRNIFLKQ

SEQ ID NO: 885920 - protein, 9 aa, Homo Sapiens
WVRNINTLQ

SEQ ID NO: 885921 - protein, 9 aa, Homo Sapiens
PGLSSYNER

SEQ ID NO: 885922 - protein, 9 aa, Homo Sapiens
KGSIKSLRT

SEQ ID NO: 885923 - protein, 9 aa, Homo Sapiens
ASSLQLNQS

SEQ ID NO: 885924 - protein, 9 aa, Homo Sapiens
VMYIERYSR

SEQ ID NO: 885925 - protein, 9 aa, Homo Sapiens
AFTHEGNKT

SEQ ID NO: 885926 - protein, 9 aa, Homo Sapiens
QSGLVPQQI

SEQ ID NO: 885927 - protein, 9 aa, Homo Sapiens
VKCSLYRHF

SEQ ID NO: 885928 - protein, 9 aa, Homo Sapiens
GVVKLMFKI

SEQ ID NO: 885929 - protein, 9 aa, Homo Sapiens
KLTTADDKT

SEQ ID NO: 885930 - protein, 9 aa, Homo Sapiens
VFGLALATL

SEQ ID NO: 885931 - protein, 9 aa, Homo Sapiens
LSVSDNEYG

SEQ ID NO: 885932 - protein, 9 aa, Homo Sapiens
EYQSRYQSD

SEQ ID NO: 885933 - protein, 9 aa, Homo Sapiens
VNLMQKHFL

SEQ ID NO: 885934 - protein, 9 aa, Homo Sapiens
YEYKNIRIP

SEQ ID NO: 885935 - protein, 9 aa, Homo Sapiens
PKKLLERDS

SEQ ID NO: 885936 - protein, 9 aa, Homo Sapiens
FKLNFYSNG

SEQ ID NO: 885937 - protein, 9 aa, Homo Sapiens
IHEITHIGE

SEQ ID NO: 885938 - protein, 9 aa, Homo Sapiens
LLLAKVDLP

SEQ ID NO: 885939 - protein, 9 aa, Homo Sapiens
YHGDDGHLF

SEQ ID NO: 885940 - protein, 9 aa, Homo Sapiens
VEAAGEIDV

SEQ ID NO: 885941 - protein, 9 aa, Homo Sapiens
YVKTAVHMK

SEQ ID NO: 885942 - protein, 9 aa, Homo Sapiens
RTSTSNKSG

SEQ ID NO: 885943 - protein, 9 aa, Homo Sapiens
SCYKCCQCS

SEQ ID NO: 885944 - protein, 9 aa, Homo Sapiens
FWLSACQSL

SEQ ID NO: 885945 - protein, 9 aa, Homo Sapiens
VPRHEDKLE

SEQ ID NO: 885946 - protein, 9 aa, Homo Sapiens
QYAVEILTW

SEQ ID NO: 885947 - protein, 9 aa, Homo Sapiens
ERRKIKQRL

SEQ ID NO: 885948 - protein, 9 aa, Homo Sapiens
SDLLLNTRE

SEQ ID NO: 885949 - protein, 9 aa, Homo Sapiens
VTYRSFNTF

SEQ ID NO: 885950 - protein, 9 aa, Homo Sapiens
QVFGEGTKA

SEQ ID NO: 885951 - protein, 9 aa, Homo Sapiens
KLKDLYICP

SEQ ID NO: 885952 - protein, 9 aa, Homo Sapiens
DRLFLKFFL

SEQ ID NO: 885953 - protein, 9 aa, Homo Sapiens
PTIIHEEVY

SEQ ID NO: 885954 - protein, 9 aa, Homo Sapiens
VKIRNRTEA

SEQ ID NO: 885955 - protein, 9 aa, Homo Sapiens
VSGRRSPKS

SEQ ID NO: 885956 - protein, 9 aa, Homo Sapiens
PNRGWFVPL

SEQ ID NO: 885957 - protein, 9 aa, Homo Sapiens
YLTICYTLL

SEQ ID NO: 885958 - protein, 9 aa, Homo Sapiens
VNPNDQKKT

SEQ ID NO: 885959 - protein, 9 aa, Homo Sapiens
PASFVFNIP

SEQ ID NO: 885960 - protein, 9 aa, Homo Sapiens
CDVTAQACL

SEQ ID NO: 885961 - protein, 9 aa, Homo Sapiens
SKIVLSAPE

SEQ ID NO: 885962 - protein, 9 aa, Homo Sapiens
KSIIAIAFS

SEQ ID NO: 885963 - protein, 9 aa, Homo Sapiens
LALMPLFSE

SEQ ID NO: 885964 - protein, 9 aa, Homo Sapiens
IFGKGAQGV

SEQ ID NO: 885965 - protein, 9 aa, Homo Sapiens
DDVKNLNTT

SEQ ID NO: 885966 - protein, 9 aa, Homo Sapiens
GLVCMDLLV

SEQ ID NO: 885967 - protein, 9 aa, Homo Sapiens
HMKFDEIHW

SEQ ID NO: 885968 - protein, 9 aa, Homo Sapiens
IYLKNQMVL

SEQ ID NO: 885969 - protein, 9 aa, Homo Sapiens
TNGNTDNNT

SEQ ID NO: 885970 - protein, 9 aa, Homo Sapiens
FVGVGFLMT

SEQ ID NO: 885971 - protein, 9 aa, Homo Sapiens
HTTIQSVLM

SEQ ID NO: 885972 - protein, 9 aa, Homo Sapiens
GLASFLMPS

SEQ ID NO: 885973 - protein, 9 aa, Homo Sapiens
CKKEHKREE

SEQ ID NO: 885974 - protein, 9 aa, Homo Sapiens
TEKHNQLGS

SEQ ID NO: 885975 - protein, 9 aa, Homo Sapiens
LSFSETRTH

SEQ ID NO: 885976 - protein, 9 aa, Homo Sapiens
VQSVADGIK

SEQ ID NO: 885977 - protein, 9 aa, Homo Sapiens
QAAQNTICQ

SEQ ID NO: 885978 - protein, 9 aa, Homo Sapiens
EEVKKKNPK

SEQ ID NO: 885979 - protein, 9 aa, Homo Sapiens
FKYKHHLKK

SEQ ID NO: 885980 - protein, 9 aa, Homo Sapiens
AVADRILAS

SEQ ID NO: 885981 - protein, 9 aa, Homo Sapiens
LCLHYQNQR

SEQ ID NO: 885982 - protein, 9 aa, Homo Sapiens
QMVQNENYN

SEQ ID NO: 885983 - protein, 9 aa, Homo Sapiens
KRYLRNFLK

SEQ ID NO: 885984 - protein, 9 aa, Homo Sapiens
ERMKQKNEA

SEQ ID NO: 885985 - protein, 9 aa, Homo Sapiens
LEQFPLEED

SEQ ID NO: 885986 - protein, 9 aa, Homo Sapiens
NAICEESKA

SEQ ID NO: 885987 - protein, 9 aa, Homo Sapiens
PGRSQTPGL

SEQ ID NO: 885988 - protein, 9 aa, Homo Sapiens
DLQFRPHTG

SEQ ID NO: 885989 - protein, 9 aa, Homo Sapiens
VATARRSLL

SEQ ID NO: 885990 - protein, 9 aa, Homo Sapiens
LSVNSNISK

SEQ ID NO: 885991 - protein, 9 aa, Homo Sapiens
VSARPPRLI

SEQ ID NO: 885992 - protein, 9 aa, Homo Sapiens
KVECPTKLF

SEQ ID NO: 885993 - protein, 9 aa, Homo Sapiens
DIMISNHQH

SEQ ID NO: 885994 - protein, 9 aa, Homo Sapiens
QLDYIPVSN

SEQ ID NO: 885995 - protein, 9 aa, Homo Sapiens
GAQSVLRLE

SEQ ID NO: 885996 - protein, 9 aa, Homo Sapiens
PLSESRFSI

SEQ ID NO: 885997 - protein, 9 aa, Homo Sapiens
RLAYYSAGR

SEQ ID NO: 885998 - protein, 9 aa, Homo Sapiens
IEDYILPDT

SEQ ID NO: 885999 - protein, 9 aa, Homo Sapiens
ENKEKLAYT

SEQ ID NO: 886000 - protein, 9 aa, Homo Sapiens
NVTLGYDEG

SEQ ID NO: 886001 - protein, 9 aa, Homo Sapiens
LPDEKTKKC

SEQ ID NO: 886002 - protein, 9 aa, Homo Sapiens
AKKEREMLK

SEQ ID NO: 886003 - protein, 9 aa, Homo Sapiens
NGTANYSKT

SEQ ID NO: 886004 - protein, 9 aa, Homo Sapiens
KKAHTQNQE

SEQ ID NO: 886005 - protein, 9 aa, Homo Sapiens
VFPGTLTPT

SEQ ID NO: 886006 - protein, 9 aa, Homo Sapiens
CADYRSARL

SEQ ID NO: 886007 - protein, 9 aa, Homo Sapiens
WGTICDNRW

SEQ ID NO: 886008 - protein, 9 aa, Homo Sapiens
TYCYLTDIF

SEQ ID NO: 886009 - protein, 9 aa, Homo Sapiens
KPAITKRTF

SEQ ID NO: 886010 - protein, 9 aa, Homo Sapiens
RFKVSVSSY

SEQ ID NO: 886011 - protein, 9 aa, Homo Sapiens
AAMSYVKLQ

SEQ ID NO: 886012 - protein, 9 aa, Homo Sapiens
ETLKEHEKM

SEQ ID NO: 886013 - protein, 9 aa, Homo Sapiens
QMPDLLRSG

SEQ ID NO: 886014 - protein, 9 aa, Homo Sapiens
PVDKRRRNQ

SEQ ID NO: 886015 - protein, 9 aa, Homo Sapiens
QVPQTTTYV

SEQ ID NO: 886016 - protein, 9 aa, Homo Sapiens
SNISKKSKV

SEQ ID NO: 886017 - protein, 9 aa, Homo Sapiens
TWEAMPRSI

SEQ ID NO: 886018 - protein, 9 aa, Homo Sapiens
LGDHSKISK

SEQ ID NO: 886019 - protein, 9 aa, Homo Sapiens
DKFCDPQMC

SEQ ID NO: 886020 - protein, 9 aa, Homo Sapiens
KNNVLNMNK

SEQ ID NO: 886021 - protein, 9 aa, Homo Sapiens
QGKGDAADG

SEQ ID NO: 886022 - protein, 9 aa, Homo Sapiens
YLRPRSLQS

SEQ ID NO: 886023 - protein, 9 aa, Homo Sapiens
ATNNPHLPK

SEQ ID NO: 886024 - protein, 9 aa, Homo Sapiens
DGKQMRKAV

SEQ ID NO: 886025 - protein, 9 aa, Homo Sapiens
NSETKSQFD

SEQ ID NO: 886026 - protein, 9 aa, Homo Sapiens
SQKKSTTLS

SEQ ID NO: 886027 - protein, 9 aa, Homo Sapiens
EKYDYISQG

SEQ ID NO: 886028 - protein, 9 aa, Homo Sapiens
PLNPALFSM

SEQ ID NO: 886029 - protein, 9 aa, Homo Sapiens
LSYVLLTDI

SEQ ID NO: 886030 - protein, 9 aa, Homo Sapiens
HPAPMVFWK

SEQ ID NO: 886031 - protein, 9 aa, Homo Sapiens
AYYSAGRGL

SEQ ID NO: 886032 - protein, 9 aa, Homo Sapiens
ELKTINYAG

SEQ ID NO: 886033 - protein, 9 aa, Homo Sapiens
KLTQLKLSR

SEQ ID NO: 886034 - protein, 9 aa, Homo Sapiens
KLTEKECIE

SEQ ID NO: 886035 - protein, 9 aa, Homo Sapiens
QLSRHKLER

SEQ ID NO: 886036 - protein, 9 aa, Homo Sapiens
YRKLAKDIE

SEQ ID NO: 886037 - protein, 9 aa, Homo Sapiens
ADLSDGWLK

SEQ ID NO: 886038 - protein, 9 aa, Homo Sapiens
KTPAKSVKE

SEQ ID NO: 886039 - protein, 9 aa, Homo Sapiens
GLSFDLVAL

SEQ ID NO: 886040 - protein, 9 aa, Homo Sapiens
HWVVQAWTC

SEQ ID NO: 886041 - protein, 9 aa, Homo Sapiens
NIRIWFIRK

SEQ ID NO: 886042 - protein, 9 aa, Homo Sapiens
EVTAPVEVC

SEQ ID NO: 886043 - protein, 9 aa, Homo Sapiens
INYSKAIKF

SEQ ID NO: 886044 - protein, 9 aa, Homo Sapiens
DQKYSKPPE

SEQ ID NO: 886045 - protein, 9 aa, Homo Sapiens
YVDKYRNDY

SEQ ID NO: 886046 - protein, 9 aa, Homo Sapiens
EKSTKDEPR

SEQ ID NO: 886047 - protein, 9 aa, Homo Sapiens
RPPGILENT

SEQ ID NO: 886048 - protein, 9 aa, Homo Sapiens
KALKLASVL

SEQ ID NO: 886049 - protein, 9 aa, Homo Sapiens
EDKKDKMKP

SEQ ID NO: 886050 - protein, 9 aa, Homo Sapiens
QAVDKYLGT

SEQ ID NO: 886051 - protein, 9 aa, Homo Sapiens
PQKRKLVPL

SEQ ID NO: 886052 - protein, 9 aa, Homo Sapiens
TAKFTHYKP

SEQ ID NO: 886053 - protein, 9 aa, Homo Sapiens
LTTRQYKLT

SEQ ID NO: 886054 - protein, 9 aa, Homo Sapiens
LVENSVLLI

SEQ ID NO: 886055 - protein, 9 aa, Homo Sapiens
HEGVRYFVD

SEQ ID NO: 886056 - protein, 9 aa, Homo Sapiens
AKSKYVSLP

SEQ ID NO: 886057 - protein, 9 aa, Homo Sapiens
CNKAKTQDG

SEQ ID NO: 886058 - protein, 9 aa, Homo Sapiens
LVTKQAFNI

SEQ ID NO: 886059 - protein, 9 aa, Homo Sapiens
PDNFITQIE

SEQ ID NO: 886060 - protein, 9 aa, Homo Sapiens
ERVFRAGRQ

SEQ ID NO: 886061 - protein, 9 aa, Homo Sapiens
LRGASKEII

SEQ ID NO: 886062 - protein, 9 aa, Homo Sapiens
EEAKHRWEY

SEQ ID NO: 886063 - protein, 9 aa, Homo Sapiens
CKNHRSRLT

SEQ ID NO: 886064 - protein, 9 aa, Homo Sapiens
EVLQIQNIL

SEQ ID NO: 886065 - protein, 9 aa, Homo Sapiens
FVSHLNQIH

SEQ ID NO: 886066 - protein, 9 aa, Homo Sapiens
NKQKEIYST

SEQ ID NO: 886067 - protein, 9 aa, Homo Sapiens
ELLQSQVVA

SEQ ID NO: 886068 - protein, 9 aa, Homo Sapiens
QVPSDVMSF

SEQ ID NO: 886069 - protein, 9 aa, Homo Sapiens
IAPEILQLL

SEQ ID NO: 886070 - protein, 9 aa, Homo Sapiens
KDKHFQWAN

SEQ ID NO: 886071 - protein, 9 aa, Homo Sapiens
YTDGSTGKT

SEQ ID NO: 886072 - protein, 9 aa, Homo Sapiens
QQSAGGRGT

SEQ ID NO: 886073 - protein, 9 aa, Homo Sapiens
SYCQVWKIL

SEQ ID NO: 886074 - protein, 9 aa, Homo Sapiens
VFLFMQYCV

SEQ ID NO: 886075 - protein, 9 aa, Homo Sapiens
CTVADKSFA

SEQ ID NO: 886076 - protein, 9 aa, Homo Sapiens
IYDKENITP

SEQ ID NO: 886077 - protein, 9 aa, Homo Sapiens
FILENPDYP

SEQ ID NO: 886078 - protein, 9 aa, Homo Sapiens
PKNIPPKEF

SEQ ID NO: 886079 - protein, 9 aa, Homo Sapiens
TDTEGIIKA

SEQ ID NO: 886080 - protein, 9 aa, Homo Sapiens
KLIRHQIIH

SEQ ID NO: 886081 - protein, 9 aa, Homo Sapiens
EILSAAEHL

SEQ ID NO: 886082 - protein, 9 aa, Homo Sapiens
LNSTGYYDQ

SEQ ID NO: 886083 - protein, 9 aa, Homo Sapiens
AKPISFVGR

SEQ ID NO: 886084 - protein, 9 aa, Homo Sapiens
PDEKTKKCI

SEQ ID NO: 886085 - protein, 9 aa, Homo Sapiens
EKVGNCYFT

SEQ ID NO: 886086 - protein, 9 aa, Homo Sapiens
EKETSFEHH

SEQ ID NO: 886087 - protein, 9 aa, Homo Sapiens
KEKKRKKLE

SEQ ID NO: 886088 - protein, 9 aa, Homo Sapiens
PDNPQRFDL

SEQ ID NO: 886089 - protein, 9 aa, Homo Sapiens
TLVALSWVL

SEQ ID NO: 886090 - protein, 9 aa, Homo Sapiens
TICFQIKYL

SEQ ID NO: 886091 - protein, 9 aa, Homo Sapiens
VKILLTFKI

SEQ ID NO: 886092 - protein, 9 aa, Homo Sapiens
QNWQKSSSE

SEQ ID NO: 886093 - protein, 9 aa, Homo Sapiens
NTDSGCCLG

SEQ ID NO: 886094 - protein, 9 aa, Homo Sapiens
MDANICQVI

SEQ ID NO: 886095 - protein, 9 aa, Homo Sapiens
NIVKNHIFK

SEQ ID NO: 886096 - protein, 9 aa, Homo Sapiens
RCLAALTKC

SEQ ID NO: 886097 - protein, 9 aa, Homo Sapiens
KGTFISVCR

SEQ ID NO: 886098 - protein, 9 aa, Homo Sapiens
KHMKFDEIH

SEQ ID NO: 886099 - protein, 9 aa, Homo Sapiens
LMITCKTKH

SEQ ID NO: 886100 - protein, 9 aa, Homo Sapiens
IHKQDELII

SEQ ID NO: 886101 - protein, 9 aa, Homo Sapiens
SSTPYPNFN

SEQ ID NO: 886102 - protein, 9 aa, Homo Sapiens
QPFPAFKPW

SEQ ID NO: 886103 - protein, 9 aa, Homo Sapiens
YQRAMCISH

SEQ ID NO: 886104 - protein, 9 aa, Homo Sapiens
SRTLANNQR

SEQ ID NO: 886105 - protein, 9 aa, Homo Sapiens
ASGSLLGSP

SEQ ID NO: 886106 - protein, 9 aa, Homo Sapiens
INLSKKIKK

SEQ ID NO: 886107 - protein, 9 aa, Homo Sapiens
MLEELSLVV

SEQ ID NO: 886108 - protein, 9 aa, Homo Sapiens
LGMACGLTT

SEQ ID NO: 886109 - protein, 9 aa, Homo Sapiens
PMVMALVDG

SEQ ID NO: 886110 - protein, 9 aa, Homo Sapiens
CVSDPPVIS

SEQ ID NO: 886111 - protein, 9 aa, Homo Sapiens
FRTEQSTAA

SEQ ID NO: 886112 - protein, 9 aa, Homo Sapiens
VGVNLLQQY

SEQ ID NO: 886113 - protein, 9 aa, Homo Sapiens
DNQDNTAGV

SEQ ID NO: 886114 - protein, 9 aa, Homo Sapiens
GQLASTRSA

SEQ ID NO: 886115 - protein, 9 aa, Homo Sapiens
SDCQDSRSH

SEQ ID NO: 886116 - protein, 9 aa, Homo Sapiens
SQVAVPARV

SEQ ID NO: 886117 - protein, 9 aa, Homo Sapiens
KEGSADLRK

SEQ ID NO: 886118 - protein, 9 aa, Homo Sapiens
TSQEEIICR

SEQ ID NO: 886119 - protein, 9 aa, Homo Sapiens
ESLIPVQLL

SEQ ID NO: 886120 - protein, 9 aa, Homo Sapiens
NQTEAFQKG

SEQ ID NO: 886121 - protein, 9 aa, Homo Sapiens
HNEQVKNFV

SEQ ID NO: 886122 - protein, 9 aa, Homo Sapiens
TVKYHTETD

SEQ ID NO: 886123 - protein, 9 aa, Homo Sapiens
FDEKPAIIA

SEQ ID NO: 886124 - protein, 9 aa, Homo Sapiens
YKCIPQSLA

SEQ ID NO: 886125 - protein, 9 aa, Homo Sapiens
RTFTTMGLE

SEQ ID NO: 886126 - protein, 9 aa, Homo Sapiens
HKLFHVITS

SEQ ID NO: 886127 - protein, 9 aa, Homo Sapiens
NYFMYTMNK

SEQ ID NO: 886128 - protein, 9 aa, Homo Sapiens
TPSEVYHFG

SEQ ID NO: 886129 - protein, 9 aa, Homo Sapiens
YANDKNLIP

SEQ ID NO: 886130 - protein, 9 aa, Homo Sapiens
IRQPERNCS

SEQ ID NO: 886131 - protein, 9 aa, Homo Sapiens
NSQVQFTGE

SEQ ID NO: 886132 - protein, 9 aa, Homo Sapiens
GRGTRFLRN

SEQ ID NO: 886133 - protein, 9 aa, Homo Sapiens
NNQLSGTLQ

SEQ ID NO: 886134 - protein, 9 aa, Homo Sapiens
KIIQILAQS

SEQ ID NO: 886135 - protein, 9 aa, Homo Sapiens
AEMGMPNNK

SEQ ID NO: 886136 - protein, 9 aa, Homo Sapiens
PAPDAAAKD

SEQ ID NO: 886137 - protein, 9 aa, Homo Sapiens
SVKTHTFNN

SEQ ID NO: 886138 - protein, 9 aa, Homo Sapiens
STKDEPRKR

SEQ ID NO: 886139 - protein, 9 aa, Homo Sapiens
FQTYLHSSK

SEQ ID NO: 886140 - protein, 9 aa, Homo Sapiens
CQKLTNDHV

SEQ ID NO: 886141 - protein, 9 aa, Homo Sapiens
IRQNESHLI

SEQ ID NO: 886142 - protein, 9 aa, Homo Sapiens
GSEDGDNYD

SEQ ID NO: 886143 - protein, 9 aa, Homo Sapiens
ILRLLCTDT

SEQ ID NO: 886144 - protein, 9 aa, Homo Sapiens
GADSNNFPL

SEQ ID NO: 886145 - protein, 9 aa, Homo Sapiens
QDYAQIFQF

SEQ ID NO: 886146 - protein, 9 aa, Homo Sapiens
HIQNGIDIL

SEQ ID NO: 886147 - protein, 9 aa, Homo Sapiens
DEATSVLDT

SEQ ID NO: 886148 - protein, 9 aa, Homo Sapiens
VPLQILLPL

SEQ ID NO: 886149 - protein, 9 aa, Homo Sapiens
AAHCVTGLG

SEQ ID NO: 886150 - protein, 9 aa, Homo Sapiens
ETVLESLPI

SEQ ID NO: 886151 - protein, 9 aa, Homo Sapiens
FEEDKNALE

SEQ ID NO: 886152 - protein, 9 aa, Homo Sapiens
EKAMGNKMS

SEQ ID NO: 886153 - protein, 9 aa, Homo Sapiens
GKDEHPQCL

SEQ ID NO: 886154 - protein, 9 aa, Homo Sapiens
YVPFVITLD

SEQ ID NO: 886155 - protein, 9 aa, Homo Sapiens
AVPAPGKNK

SEQ ID NO: 886156 - protein, 9 aa, Homo Sapiens
VTTAEDKEL

SEQ ID NO: 886157 - protein, 9 aa, Homo Sapiens
IKAKQLLET

SEQ ID NO: 886158 - protein, 9 aa, Homo Sapiens
VGRLCSLGR

SEQ ID NO: 886159 - protein, 9 aa, Homo Sapiens
RYAKMKMAT

SEQ ID NO: 886160 - protein, 9 aa, Homo Sapiens
TEDNYIRDR

SEQ ID NO: 886161 - protein, 9 aa, Homo Sapiens
RPRVNKLHP

SEQ ID NO: 886162 - protein, 9 aa, Homo Sapiens
DICNTARQG

SEQ ID NO: 886163 - protein, 9 aa, Homo Sapiens
KLDAQRKCL

SEQ ID NO: 886164 - protein, 9 aa, Homo Sapiens
SPVALCGLP

SEQ ID NO: 886165 - protein, 9 aa, Homo Sapiens
KPQEWTLEN

SEQ ID NO: 886166 - protein, 9 aa, Homo Sapiens
LHQFVSKKV

SEQ ID NO: 886167 - protein, 9 aa, Homo Sapiens
VFKQDNCSW

SEQ ID NO: 886168 - protein, 9 aa, Homo Sapiens
FEAVLVIQT

SEQ ID NO: 886169 - protein, 9 aa, Homo Sapiens
QKYRVCNVT

SEQ ID NO: 886170 - protein, 9 aa, Homo Sapiens
QNPPIDDLI

SEQ ID NO: 886171 - protein, 9 aa, Homo Sapiens
ENANPTANT

SEQ ID NO: 886172 - protein, 9 aa, Homo Sapiens
EIERLPLAN

SEQ ID NO: 886173 - protein, 9 aa, Homo Sapiens
LYFNLQCCV

SEQ ID NO: 886174 - protein, 9 aa, Homo Sapiens
SDVDIGENI

SEQ ID NO: 886175 - protein, 9 aa, Homo Sapiens
GEGERRFIT

SEQ ID NO: 886176 - protein, 9 aa, Homo Sapiens
NGMDISNAP

SEQ ID NO: 886177 - protein, 9 aa, Homo Sapiens
LNARAVIIF

SEQ ID NO: 886178 - protein, 9 aa, Homo Sapiens
LRCQNEKKR

SEQ ID NO: 886179 - protein, 9 aa, Homo Sapiens
HMNIYDSKL

SEQ ID NO: 886180 - protein, 9 aa, Homo Sapiens
ELTSQCKLH

SEQ ID NO: 886181 - protein, 9 aa, Homo Sapiens
PNLRLHQIQ

SEQ ID NO: 886182 - protein, 9 aa, Homo Sapiens
AAHCFRDDN

SEQ ID NO: 886183 - protein, 9 aa, Homo Sapiens
THKRMHTGD

SEQ ID NO: 886184 - protein, 9 aa, Homo Sapiens
FAEMNRHSN

SEQ ID NO: 886185 - protein, 9 aa, Homo Sapiens
IQEQQNVLK

SEQ ID NO: 886186 - protein, 9 aa, Homo Sapiens
SEKMSTPLR

SEQ ID NO: 886187 - protein, 9 aa, Homo Sapiens
GYTVVDKKN

SEQ ID NO: 886188 - protein, 9 aa, Homo Sapiens
PVNTSKTHP

SEQ ID NO: 886189 - protein, 9 aa, Homo Sapiens
LLEESLCGT

SEQ ID NO: 886190 - protein, 9 aa, Homo Sapiens
GPWGDYDNS

SEQ ID NO: 886191 - protein, 9 aa, Homo Sapiens
DCSPMQDKL

SEQ ID NO: 886192 - protein, 9 aa, Homo Sapiens
TWAPDFLNK

SEQ ID NO: 886193 - protein, 9 aa, Homo Sapiens
EPIKQAFCV

SEQ ID NO: 886194 - protein, 9 aa, Homo Sapiens
NNLMSRAQE

SEQ ID NO: 886195 - protein, 9 aa, Homo Sapiens
LCQLPGRQP

SEQ ID NO: 886196 - protein, 9 aa, Homo Sapiens
YDADSEFDV

SEQ ID NO: 886197 - protein, 9 aa, Homo Sapiens
LDARSARMY

SEQ ID NO: 886198 - protein, 9 aa, Homo Sapiens
MDSTLTLAT

SEQ ID NO: 886199 - protein, 9 aa, Homo Sapiens
EAEGGQNSF

SEQ ID NO: 886200 - protein, 9 aa, Homo Sapiens
AKIWWKYMI

SEQ ID NO: 886201 - protein, 9 aa, Homo Sapiens
VIQDEELYT

SEQ ID NO: 886202 - protein, 9 aa, Homo Sapiens
RGPIPGPMS

SEQ ID NO: 886203 - protein, 9 aa, Homo Sapiens
DKYLYGPDN

SEQ ID NO: 886204 - protein, 9 aa, Homo Sapiens
DEGNDGNNG

SEQ ID NO: 886205 - protein, 9 aa, Homo Sapiens
TDTIVLQTY

SEQ ID NO: 886206 - protein, 9 aa, Homo Sapiens
VCPTDSNVS

SEQ ID NO: 886207 - protein, 9 aa, Homo Sapiens
KIERSKTVS

SEQ ID NO: 886208 - protein, 9 aa, Homo Sapiens
EIDKLETPS

SEQ ID NO: 886209 - protein, 9 aa, Homo Sapiens
QDGRTSFDE

SEQ ID NO: 886210 - protein, 9 aa, Homo Sapiens
VELYNKFPE

SEQ ID NO: 886211 - protein, 9 aa, Homo Sapiens
ELVLKVMAA

SEQ ID NO: 886212 - protein, 9 aa, Homo Sapiens
NSHSLDVAK

SEQ ID NO: 886213 - protein, 9 aa, Homo Sapiens
IQNHTGEKH

SEQ ID NO: 886214 - protein, 9 aa, Homo Sapiens
NRKKDENYR

SEQ ID NO: 886215 - protein, 9 aa, Homo Sapiens
TVKCSLYRH

SEQ ID NO: 886216 - protein, 9 aa, Homo Sapiens
LFVLLVWDP

SEQ ID NO: 886217 - protein, 9 aa, Homo Sapiens
SLDFLYFTD

SEQ ID NO: 886218 - protein, 9 aa, Homo Sapiens
SVNGAKITM

SEQ ID NO: 886219 - protein, 9 aa, Homo Sapiens
TDQLTNILA

SEQ ID NO: 886220 - protein, 9 aa, Homo Sapiens
ILYINCKVN

SEQ ID NO: 886221 - protein, 9 aa, Homo Sapiens
DIQDIEAKK

SEQ ID NO: 886222 - protein, 9 aa, Homo Sapiens
KDMTNEEKN

SEQ ID NO: 886223 - protein, 9 aa, Homo Sapiens
EINSDDRQP

SEQ ID NO: 886224 - protein, 9 aa, Homo Sapiens
FMSLCKRFW

SEQ ID NO: 886225 - protein, 9 aa, Homo Sapiens
RLVMYIERY

SEQ ID NO: 886226 - protein, 9 aa, Homo Sapiens
FKKEDVKVI

SEQ ID NO: 886227 - protein, 9 aa, Homo Sapiens
GDRILVVNN

SEQ ID NO: 886228 - protein, 9 aa, Homo Sapiens
LEGRPEWQF

SEQ ID NO: 886229 - protein, 9 aa, Homo Sapiens
PGSLHWRDR

SEQ ID NO: 886230 - protein, 9 aa, Homo Sapiens
AFGVACMDV

SEQ ID NO: 886231 - protein, 9 aa, Homo Sapiens
LGTTKPGSL

SEQ ID NO: 886232 - protein, 9 aa, Homo Sapiens
KRIWSTVDE

SEQ ID NO: 886233 - protein, 9 aa, Homo Sapiens
QIGTFDLKY

SEQ ID NO: 886234 - protein, 9 aa, Homo Sapiens
HTLCLPVVL

SEQ ID NO: 886235 - protein, 9 aa, Homo Sapiens
SEVFFPNNQ

SEQ ID NO: 886236 - protein, 9 aa, Homo Sapiens
GPSTSQLQQ

SEQ ID NO: 886237 - protein, 9 aa, Homo Sapiens
MWLHLQLDD

SEQ ID NO: 886238 - protein, 9 aa, Homo Sapiens
VCAFIILLF

SEQ ID NO: 886239 - protein, 9 aa, Homo Sapiens
NLTADYLAQ

SEQ ID NO: 886240 - protein, 9 aa, Homo Sapiens
GRRCREIKQ

SEQ ID NO: 886241 - protein, 9 aa, Homo Sapiens
FTVAMQNLN

SEQ ID NO: 886242 - protein, 9 aa, Homo Sapiens
CEIWNPVSA

SEQ ID NO: 886243 - protein, 9 aa, Homo Sapiens
IYWLFIILN

SEQ ID NO: 886244 - protein, 9 aa, Homo Sapiens
SESRFSISF

SEQ ID NO: 886245 - protein, 9 aa, Homo Sapiens
KRLPSLISK

SEQ ID NO: 886246 - protein, 9 aa, Homo Sapiens
GIICLLLMS

SEQ ID NO: 886247 - protein, 9 aa, Homo Sapiens
FKVDTLSKD

SEQ ID NO: 886248 - protein, 9 aa, Homo Sapiens
WRHRLLVGH

SEQ ID NO: 886249 - protein, 9 aa, Homo Sapiens
KQQKVEFCK

SEQ ID NO: 886250 - protein, 9 aa, Homo Sapiens
YRTFLGSIL

SEQ ID NO: 886251 - protein, 9 aa, Homo Sapiens
RMHGLNNAL

SEQ ID NO: 886252 - protein, 9 aa, Homo Sapiens
NKYFKLPHA

SEQ ID NO: 886253 - protein, 9 aa, Homo Sapiens
ARHDHTVSL

SEQ ID NO: 886254 - protein, 9 aa, Homo Sapiens
CGHRGSSGS

SEQ ID NO: 886255 - protein, 9 aa, Homo Sapiens
EEERQRLIQ

SEQ ID NO: 886256 - protein, 9 aa, Homo Sapiens
LDVLCKMTV

SEQ ID NO: 886257 - protein, 9 aa, Homo Sapiens
IFGLCHQMS

SEQ ID NO: 886258 - protein, 9 aa, Homo Sapiens
FQAPHRRWR

SEQ ID NO: 886259 - protein, 9 aa, Homo Sapiens
LGTIEEVCY

SEQ ID NO: 886260 - protein, 9 aa, Homo Sapiens
AFILDELTA

SEQ ID NO: 886261 - protein, 9 aa, Homo Sapiens
CQCHFCDKA

SEQ ID NO: 886262 - protein, 9 aa, Homo Sapiens
NIETQLPAL

SEQ ID NO: 886263 - protein, 9 aa, Homo Sapiens
RHYIDSPPA

SEQ ID NO: 886264 - protein, 9 aa, Homo Sapiens
ESVTEETFT

SEQ ID NO: 886265 - protein, 9 aa, Homo Sapiens
IFFNPQGDV

SEQ ID NO: 886266 - protein, 9 aa, Homo Sapiens
DYDKNKLVK

SEQ ID NO: 886267 - protein, 9 aa, Homo Sapiens
SKFVCRDPS

SEQ ID NO: 886268 - protein, 9 aa, Homo Sapiens
RVNKLHPQQ

SEQ ID NO: 886269 - protein, 9 aa, Homo Sapiens
EFDQFGTIR

SEQ ID NO: 886270 - protein, 9 aa, Homo Sapiens
GSVCQLLHE

SEQ ID NO: 886271 - protein, 9 aa, Homo Sapiens
QCSKEDQCK

SEQ ID NO: 886272 - protein, 9 aa, Homo Sapiens
KQSICHRWG

SEQ ID NO: 886273 - protein, 9 aa, Homo Sapiens
YLLPDKPRN

SEQ ID NO: 886274 - protein, 9 aa, Homo Sapiens
FQKRWFQFF

SEQ ID NO: 886275 - protein, 9 aa, Homo Sapiens
PNFFYRCFP

SEQ ID NO: 886276 - protein, 9 aa, Homo Sapiens
IYHLLKART

SEQ ID NO: 886277 - protein, 9 aa, Homo Sapiens
FPSWHRSSL

SEQ ID NO: 886278 - protein, 9 aa, Homo Sapiens
ETIWRQQGF

SEQ ID NO: 886279 - protein, 9 aa, Homo Sapiens
RTQNNLGNW

SEQ ID NO: 886280 - protein, 9 aa, Homo Sapiens
LHRHHLNNP

SEQ ID NO: 886281 - protein, 9 aa, Homo Sapiens
NLFLSAFWL

SEQ ID NO: 886282 - protein, 9 aa, Homo Sapiens
TILLCILRH

SEQ ID NO: 886283 - protein, 9 aa, Homo Sapiens
RLSTHSPFQ

SEQ ID NO: 886284 - protein, 9 aa, Homo Sapiens
ELYRKLLNY

SEQ ID NO: 886285 - protein, 9 aa, Homo Sapiens
PNCEKMFGN

SEQ ID NO: 886286 - protein, 9 aa, Homo Sapiens
GTEVSASKG

SEQ ID NO: 886287 - protein, 9 aa, Homo Sapiens
ILRLKLEQV

SEQ ID NO: 886288 - protein, 9 aa, Homo Sapiens
VGSYLSVKS

SEQ ID NO: 886289 - protein, 9 aa, Homo Sapiens
HDALNIINM

SEQ ID NO: 886290 - protein, 9 aa, Homo Sapiens
LKKHTNVIA

SEQ ID NO: 886291 - protein, 9 aa, Homo Sapiens
YDIVQKNTS

SEQ ID NO: 886292 - protein, 9 aa, Homo Sapiens
LNCHGSSVL

SEQ ID NO: 886293 - protein, 9 aa, Homo Sapiens
HPGRVMLQN

SEQ ID NO: 886294 - protein, 9 aa, Homo Sapiens
YCRGFNIFT

SEQ ID NO: 886295 - protein, 9 aa, Homo Sapiens
AWLRCALNK

SEQ ID NO: 886296 - protein, 9 aa, Homo Sapiens
SFEHHVNAV

SEQ ID NO: 886297 - protein, 9 aa, Homo Sapiens
IWQKVDDCE

SEQ ID NO: 886298 - protein, 9 aa, Homo Sapiens
HTDDCHPWV

SEQ ID NO: 886299 - protein, 9 aa, Homo Sapiens
IYFQFQNLH

SEQ ID NO: 886300 - protein, 9 aa, Homo Sapiens
IGAIIFGGR

SEQ ID NO: 886301 - protein, 9 aa, Homo Sapiens
RVLACMVDI

SEQ ID NO: 886302 - protein, 9 aa, Homo Sapiens
IKCDFKFKA

SEQ ID NO: 886303 - protein, 9 aa, Homo Sapiens
VRFRLGVVK

SEQ ID NO: 886304 - protein, 9 aa, Homo Sapiens
FTTPSAVCG

SEQ ID NO: 886305 - protein, 9 aa, Homo Sapiens
ACTDMFVAE

SEQ ID NO: 886306 - protein, 9 aa, Homo Sapiens
GFTSPKIDS

SEQ ID NO: 886307 - protein, 9 aa, Homo Sapiens
NQKNFLSLI

SEQ ID NO: 886308 - protein, 9 aa, Homo Sapiens
AANNYARDH

SEQ ID NO: 886309 - protein, 9 aa, Homo Sapiens
VTVQVPQTT

SEQ ID NO: 886310 - protein, 9 aa, Homo Sapiens
EKLHKLKKG

SEQ ID NO: 886311 - protein, 9 aa, Homo Sapiens
LLRLELAKM

SEQ ID NO: 886312 - protein, 9 aa, Homo Sapiens
TIHGSKKTP

SEQ ID NO: 886313 - protein, 9 aa, Homo Sapiens
PSCKGMQCA

SEQ ID NO: 886314 - protein, 9 aa, Homo Sapiens
ISYVFILSF

SEQ ID NO: 886315 - protein, 9 aa, Homo Sapiens
EKNKIGHLC

SEQ ID NO: 886316 - protein, 9 aa, Homo Sapiens
VVDSNDREI

SEQ ID NO: 886317 - protein, 9 aa, Homo Sapiens
YVLQFSIGS

SEQ ID NO: 886318 - protein, 9 aa, Homo Sapiens
QFSEEGDKT

SEQ ID NO: 886319 - protein, 9 aa, Homo Sapiens
NSNKESDFE

SEQ ID NO: 886320 - protein, 9 aa, Homo Sapiens
TNSYFQPNG

SEQ ID NO: 886321 - protein, 9 aa, Homo Sapiens
DIAAASLLQ

SEQ ID NO: 886322 - protein, 9 aa, Homo Sapiens
SEEGDKTKT

SEQ ID NO: 886323 - protein, 9 aa, Homo Sapiens
AQPLLGSCG

SEQ ID NO: 886324 - protein, 9 aa, Homo Sapiens
PSAVCGFQP

SEQ ID NO: 886325 - protein, 9 aa, Homo Sapiens
DYAITQFSY

SEQ ID NO: 886326 - protein, 9 aa, Homo Sapiens
KSQQLSDNS

SEQ ID NO: 886327 - protein, 9 aa, Homo Sapiens
GGQNSFEEN

SEQ ID NO: 886328 - protein, 9 aa, Homo Sapiens
QKVKTHLRC

SEQ ID NO: 886329 - protein, 9 aa, Homo Sapiens
GNVRETYCY

SEQ ID NO: 886330 - protein, 9 aa, Homo Sapiens
RRSKSPRWR

SEQ ID NO: 886331 - protein, 9 aa, Homo Sapiens
AGTNGRSLT

SEQ ID NO: 886332 - protein, 9 aa, Homo Sapiens
EKRMKLLQF

SEQ ID NO: 886333 - protein, 9 aa, Homo Sapiens
CPLPSQVNR

SEQ ID NO: 886334 - protein, 9 aa, Homo Sapiens
ANNKYLAKG

SEQ ID NO: 886335 - protein, 9 aa, Homo Sapiens
DKEEWPSLR

SEQ ID NO: 886336 - protein, 9 aa, Homo Sapiens
VNQPFEINT

SEQ ID NO: 886337 - protein, 9 aa, Homo Sapiens
PSKDSLYVP

SEQ ID NO: 886338 - protein, 9 aa, Homo Sapiens
SKTLGYLSS

SEQ ID NO: 886339 - protein, 9 aa, Homo Sapiens
NPINLLEST

SEQ ID NO: 886340 - protein, 9 aa, Homo Sapiens
FARYLVNRL

SEQ ID NO: 886341 - protein, 9 aa, Homo Sapiens
LYKDHYAYR

SEQ ID NO: 886342 - protein, 9 aa, Homo Sapiens
ICYTLLPFL

SEQ ID NO: 886343 - protein, 9 aa, Homo Sapiens
IQRLQSQTD

SEQ ID NO: 886344 - protein, 9 aa, Homo Sapiens
EIIELCRER

SEQ ID NO: 886345 - protein, 9 aa, Homo Sapiens
FLKSTDVGR

SEQ ID NO: 886346 - protein, 9 aa, Homo Sapiens
SLTSQISTS

SEQ ID NO: 886347 - protein, 9 aa, Homo Sapiens
QRGINCNEK

SEQ ID NO: 886348 - protein, 9 aa, Homo Sapiens
IFCVLLNLL

SEQ ID NO: 886349 - protein, 9 aa, Homo Sapiens
FIKIDQAWK

SEQ ID NO: 886350 - protein, 9 aa, Homo Sapiens
FILVLKRFS

SEQ ID NO: 886351 - protein, 9 aa, Homo Sapiens
QSQTDNLKK

SEQ ID NO: 886352 - protein, 9 aa, Homo Sapiens
NGAVADRIL

SEQ ID NO: 886353 - protein, 9 aa, Homo Sapiens
ELLIDKFCD

SEQ ID NO: 886354 - protein, 9 aa, Homo Sapiens
PAALLDRIE

SEQ ID NO: 886355 - protein, 9 aa, Homo Sapiens
MPCLGTEKQ

SEQ ID NO: 886356 - protein, 9 aa, Homo Sapiens
GAHIKKEQE

SEQ ID NO: 886357 - protein, 9 aa, Homo Sapiens
HVNQNIMDF

SEQ ID NO: 886358 - protein, 9 aa, Homo Sapiens
LYKVKVYKT

SEQ ID NO: 886359 - protein, 9 aa, Homo Sapiens
MNYSNENDL

SEQ ID NO: 886360 - protein, 9 aa, Homo Sapiens
EVETLVKYL

SEQ ID NO: 886361 - protein, 9 aa, Homo Sapiens
MDNDTASEE

SEQ ID NO: 886362 - protein, 9 aa, Homo Sapiens
QNNHIRRHS

SEQ ID NO: 886363 - protein, 9 aa, Homo Sapiens
LIKDMAFTH

SEQ ID NO: 886364 - protein, 9 aa, Homo Sapiens
KDGSDWIIN

SEQ ID NO: 886365 - protein, 9 aa, Homo Sapiens
KSYLLPDKP

SEQ ID NO: 886366 - protein, 9 aa, Homo Sapiens
LGGHFHIQL

SEQ ID NO: 886367 - protein, 9 aa, Homo Sapiens
IAKYQENLA

SEQ ID NO: 886368 - protein, 9 aa, Homo Sapiens
PNNCLIVLS

SEQ ID NO: 886369 - protein, 9 aa, Homo Sapiens
TGSRRNQKE

SEQ ID NO: 886370 - protein, 9 aa, Homo Sapiens
SEASNSVSS

SEQ ID NO: 886371 - protein, 9 aa, Homo Sapiens
HINNDALPL

SEQ ID NO: 886372 - protein, 9 aa, Homo Sapiens
TKAQKGEKP

SEQ ID NO: 886373 - protein, 9 aa, Homo Sapiens
KKRIQMDSY

SEQ ID NO: 886374 - protein, 9 aa, Homo Sapiens
ICPPYKENY

SEQ ID NO: 886375 - protein, 9 aa, Homo Sapiens
IKLDAQRKC

SEQ ID NO: 886376 - protein, 9 aa, Homo Sapiens
VAQKETTEQ

SEQ ID NO: 886377 - protein, 9 aa, Homo Sapiens
LAVVQPTTV

SEQ ID NO: 886378 - protein, 9 aa, Homo Sapiens
IKVSARVCF

SEQ ID NO: 886379 - protein, 9 aa, Homo Sapiens
KDVKYLKKE

SEQ ID NO: 886380 - protein, 9 aa, Homo Sapiens
KTVPSPEVV

SEQ ID NO: 886381 - protein, 9 aa, Homo Sapiens
SILKMHFAK

SEQ ID NO: 886382 - protein, 9 aa, Homo Sapiens
LVKCNDLYF

SEQ ID NO: 886383 - protein, 9 aa, Homo Sapiens
RRHQRQSGV

SEQ ID NO: 886384 - protein, 9 aa, Homo Sapiens
VSDCVKELC

SEQ ID NO: 886385 - protein, 9 aa, Homo Sapiens
DEKPAIIAS

SEQ ID NO: 886386 - protein, 9 aa, Homo Sapiens
VVFRRYTDL

SEQ ID NO: 886387 - protein, 9 aa, Homo Sapiens
GHISQEAFQ

SEQ ID NO: 886388 - protein, 9 aa, Homo Sapiens
CFFEKKIDE

SEQ ID NO: 886389 - protein, 9 aa, Homo Sapiens
EVWEAFDLF

SEQ ID NO: 886390 - protein, 9 aa, Homo Sapiens
RSHKLQGMG

SEQ ID NO: 886391 - protein, 9 aa, Homo Sapiens
MSIRSASAC

SEQ ID NO: 886392 - protein, 9 aa, Homo Sapiens
TLEDGFYKV

SEQ ID NO: 886393 - protein, 9 aa, Homo Sapiens
DDRNTFQHS

SEQ ID NO: 886394 - protein, 9 aa, Homo Sapiens
SHYRQCALL

SEQ ID NO: 886395 - protein, 9 aa, Homo Sapiens
YYQRHYDEY

SEQ ID NO: 886396 - protein, 9 aa, Homo Sapiens
LEDGFYKVD

SEQ ID NO: 886397 - protein, 9 aa, Homo Sapiens
EVRCTHVVI

SEQ ID NO: 886398 - protein, 9 aa, Homo Sapiens
GMWPDPQKA

SEQ ID NO: 886399 - protein, 9 aa, Homo Sapiens
SNLIKGRDG

SEQ ID NO: 886400 - protein, 9 aa, Homo Sapiens
FLEEINEQE

SEQ ID NO: 886401 - protein, 9 aa, Homo Sapiens
TFRRRLNLT

SEQ ID NO: 886402 - protein, 9 aa, Homo Sapiens
MQKLPQLWH

SEQ ID NO: 886403 - protein, 9 aa, Homo Sapiens
TSGLYGLSW

SEQ ID NO: 886404 - protein, 9 aa, Homo Sapiens
KKDYFSQES

SEQ ID NO: 886405 - protein, 9 aa, Homo Sapiens
DLEYRISQQ

SEQ ID NO: 886406 - protein, 9 aa, Homo Sapiens
NRIIIVFHC

SEQ ID NO: 886407 - protein, 9 aa, Homo Sapiens
LDGDNKYYD

SEQ ID NO: 886408 - protein, 9 aa, Homo Sapiens
VVADVMCRR

SEQ ID NO: 886409 - protein, 9 aa, Homo Sapiens
NLVECFSQE

SEQ ID NO: 886410 - protein, 9 aa, Homo Sapiens
GASTKQAKR

SEQ ID NO: 886411 - protein, 9 aa, Homo Sapiens
LRCPGRSQT

SEQ ID NO: 886412 - protein, 9 aa, Homo Sapiens
IIGYTHMLE

SEQ ID NO: 886413 - protein, 9 aa, Homo Sapiens
NNQEIEAEL

SEQ ID NO: 886414 - protein, 9 aa, Homo Sapiens
NQVYQKVKT

SEQ ID NO: 886415 - protein, 9 aa, Homo Sapiens
QNDFQSLLK

SEQ ID NO: 886416 - protein, 9 aa, Homo Sapiens
SLVSVISIS

SEQ ID NO: 886417 - protein, 9 aa, Homo Sapiens
KWKAIELEK

SEQ ID NO: 886418 - protein, 9 aa, Homo Sapiens
ETGKGASTK

SEQ ID NO: 886419 - protein, 9 aa, Homo Sapiens
GLCLSCRNN

SEQ ID NO: 886420 - protein, 9 aa, Homo Sapiens
PTFSSCVSD

SEQ ID NO: 886421 - protein, 9 aa, Homo Sapiens
NIQEQVFFL

SEQ ID NO: 886422 - protein, 9 aa, Homo Sapiens
SENSIEMYR

SEQ ID NO: 886423 - protein, 9 aa, Homo Sapiens
DPRDFKHTD

SEQ ID NO: 886424 - protein, 9 aa, Homo Sapiens
TAAHCHKPY

SEQ ID NO: 886425 - protein, 9 aa, Homo Sapiens
LRQRFWGLL

SEQ ID NO: 886426 - protein, 9 aa, Homo Sapiens
EEGVPDKEG

SEQ ID NO: 886427 - protein, 9 aa, Homo Sapiens
GRDHLLTCG

SEQ ID NO: 886428 - protein, 9 aa, Homo Sapiens
YLKSPLPDE

SEQ ID NO: 886429 - protein, 9 aa, Homo Sapiens
IEKKTNQCK

SEQ ID NO: 886430 - protein, 9 aa, Homo Sapiens
CPLWSQTPE

SEQ ID NO: 886431 - protein, 9 aa, Homo Sapiens
GTMALAFFS

SEQ ID NO: 886432 - protein, 9 aa, Homo Sapiens
YFSAADHKP

SEQ ID NO: 886433 - protein, 9 aa, Homo Sapiens
DDMGRINAG

SEQ ID NO: 886434 - protein, 9 aa, Homo Sapiens
VLLVWDPAR

SEQ ID NO: 886435 - protein, 9 aa, Homo Sapiens
FICGFCHLC

SEQ ID NO: 886436 - protein, 9 aa, Homo Sapiens
GHLPYKDCL

SEQ ID NO: 886437 - protein, 9 aa, Homo Sapiens
ELAACQLHI

SEQ ID NO: 886438 - protein, 9 aa, Homo Sapiens
EENVKVLLS

SEQ ID NO: 886439 - protein, 9 aa, Homo Sapiens
AEQLEKERR

SEQ ID NO: 886440 - protein, 9 aa, Homo Sapiens
EINTITGEI

SEQ ID NO: 886441 - protein, 9 aa, Homo Sapiens
DFDQADTFC

SEQ ID NO: 886442 - protein, 9 aa, Homo Sapiens
RILAGDVDT

SEQ ID NO: 886443 - protein, 9 aa, Homo Sapiens
FKVLGLHKL

SEQ ID NO: 886444 - protein, 9 aa, Homo Sapiens
HRNAYQTEF

SEQ ID NO: 886445 - protein, 9 aa, Homo Sapiens
GPGQCLSCQ

SEQ ID NO: 886446 - protein, 9 aa, Homo Sapiens
PTSQDTIQN

SEQ ID NO: 886447 - protein, 9 aa, Homo Sapiens
KIKVHSADN

SEQ ID NO: 886448 - protein, 9 aa, Homo Sapiens
YLETVAKTL

SEQ ID NO: 886449 - protein, 9 aa, Homo Sapiens
INNLYATQM

SEQ ID NO: 886450 - protein, 9 aa, Homo Sapiens
SLSQDSPWS

SEQ ID NO: 886451 - protein, 9 aa, Homo Sapiens
LQDCYQLYQ

SEQ ID NO: 886452 - protein, 9 aa, Homo Sapiens
DKVSNQTLN

SEQ ID NO: 886453 - protein, 9 aa, Homo Sapiens
SKQIRKDIS

SEQ ID NO: 886454 - protein, 9 aa, Homo Sapiens
APTFTQISY

SEQ ID NO: 886455 - protein, 9 aa, Homo Sapiens
THTRDCLQD

SEQ ID NO: 886456 - protein, 9 aa, Homo Sapiens
SPANRPSFA

SEQ ID NO: 886457 - protein, 9 aa, Homo Sapiens
VDKYRNDYC

SEQ ID NO: 886458 - protein, 9 aa, Homo Sapiens
RPKHEENLL

SEQ ID NO: 886459 - protein, 9 aa, Homo Sapiens
LRCALNKHS

SEQ ID NO: 886460 - protein, 9 aa, Homo Sapiens
NKLLRWLQN

SEQ ID NO: 886461 - protein, 9 aa, Homo Sapiens
KDSQGLGLH

SEQ ID NO: 886462 - protein, 9 aa, Homo Sapiens
HQLFELYHS

SEQ ID NO: 886463 - protein, 9 aa, Homo Sapiens
SFHGRHSSY

SEQ ID NO: 886464 - protein, 9 aa, Homo Sapiens
WAQGNLTAC

SEQ ID NO: 886465 - protein, 9 aa, Homo Sapiens
GSSKLEKVG

SEQ ID NO: 886466 - protein, 9 aa, Homo Sapiens
INKFFLHIF

SEQ ID NO: 886467 - protein, 9 aa, Homo Sapiens
AAAPAFLKA

SEQ ID NO: 886468 - protein, 9 aa, Homo Sapiens
TERIPSHKE

SEQ ID NO: 886469 - protein, 9 aa, Homo Sapiens
PPWALITIA

SEQ ID NO: 886470 - protein, 9 aa, Homo Sapiens
ALPHTPLTV

SEQ ID NO: 886471 - protein, 9 aa, Homo Sapiens
VIVGLIKKM

SEQ ID NO: 886472 - protein, 9 aa, Homo Sapiens
PSERTMMMG

SEQ ID NO: 886473 - protein, 9 aa, Homo Sapiens
SSLRQLVLN

SEQ ID NO: 886474 - protein, 9 aa, Homo Sapiens
RSYECSECG

SEQ ID NO: 886475 - protein, 9 aa, Homo Sapiens
PQIDVHRLI

SEQ ID NO: 886476 - protein, 9 aa, Homo Sapiens
RLCSLGRAV

SEQ ID NO: 886477 - protein, 9 aa, Homo Sapiens
FHTGNTSFA

SEQ ID NO: 886478 - protein, 9 aa, Homo Sapiens
EHKREEEED

SEQ ID NO: 886479 - protein, 9 aa, Homo Sapiens
PEIVDFASE

SEQ ID NO: 886480 - protein, 9 aa, Homo Sapiens
YLKDKNQGK

SEQ ID NO: 886481 - protein, 9 aa, Homo Sapiens
LKASNDGPT

SEQ ID NO: 886482 - protein, 9 aa, Homo Sapiens
SVCVYYKKC

SEQ ID NO: 886483 - protein, 9 aa, Homo Sapiens
HYKFFCDVS

SEQ ID NO: 886484 - protein, 9 aa, Homo Sapiens
WLSACQSLD

SEQ ID NO: 886485 - protein, 9 aa, Homo Sapiens
INQIATAFG

SEQ ID NO: 886486 - protein, 9 aa, Homo Sapiens
LWSKKRRHQ

SEQ ID NO: 886487 - protein, 9 aa, Homo Sapiens
FDLMRKIRT

SEQ ID NO: 886488 - protein, 9 aa, Homo Sapiens
SSRKKTPNL

SEQ ID NO: 886489 - protein, 9 aa, Homo Sapiens
DGIDLNQTK

SEQ ID NO: 886490 - protein, 9 aa, Homo Sapiens
LASEASDKV

SEQ ID NO: 886491 - protein, 9 aa, Homo Sapiens
ELMLRHKTY

SEQ ID NO: 886492 - protein, 9 aa, Homo Sapiens
PSIPLFAPP

SEQ ID NO: 886493 - protein, 9 aa, Homo Sapiens
LVEQSHIFS

SEQ ID NO: 886494 - protein, 9 aa, Homo Sapiens
CWDAEELGR

SEQ ID NO: 886495 - protein, 9 aa, Homo Sapiens
FKNIVYTYQ

SEQ ID NO: 886496 - protein, 9 aa, Homo Sapiens
QDLPQNQKE

SEQ ID NO: 886497 - protein, 9 aa, Homo Sapiens
DPNRQIKKW

SEQ ID NO: 886498 - protein, 9 aa, Homo Sapiens
NWFLHLVIG

SEQ ID NO: 886499 - protein, 9 aa, Homo Sapiens
IIQHERPAS

SEQ ID NO: 886500 - protein, 9 aa, Homo Sapiens
YCQCHFCDK

SEQ ID NO: 886501 - protein, 9 aa, Homo Sapiens
KRGSDKLLS

SEQ ID NO: 886502 - protein, 9 aa, Homo Sapiens
PDNLLYYSL

SEQ ID NO: 886503 - protein, 9 aa, Homo Sapiens
VKKDYLREL

SEQ ID NO: 886504 - protein, 9 aa, Homo Sapiens
EKKSHSDPH

SEQ ID NO: 886505 - protein, 9 aa, Homo Sapiens
YTQTPWRQI

SEQ ID NO: 886506 - protein, 9 aa, Homo Sapiens
QFLNNLNLG

SEQ ID NO: 886507 - protein, 9 aa, Homo Sapiens
AYANYSYAS

SEQ ID NO: 886508 - protein, 9 aa, Homo Sapiens
CSNLTIHQV

SEQ ID NO: 886509 - protein, 9 aa, Homo Sapiens
CNICGKRFM

SEQ ID NO: 886510 - protein, 9 aa, Homo Sapiens
KHVLLKNNL

SEQ ID NO: 886511 - protein, 9 aa, Homo Sapiens
GLIVAKYFA

SEQ ID NO: 886512 - protein, 9 aa, Homo Sapiens
LPIYSSMVP

SEQ ID NO: 886513 - protein, 9 aa, Homo Sapiens
DVGVNLLQQ

SEQ ID NO: 886514 - protein, 9 aa, Homo Sapiens
NVSYLHCKW

SEQ ID NO: 886515 - protein, 9 aa, Homo Sapiens
MKHLCPQFP

SEQ ID NO: 886516 - protein, 9 aa, Homo Sapiens
AKKISTIKT

SEQ ID NO: 886517 - protein, 9 aa, Homo Sapiens
WPNEITLDL

SEQ ID NO: 886518 - protein, 9 aa, Homo Sapiens
LQYVQCVAG

SEQ ID NO: 886519 - protein, 9 aa, Homo Sapiens
LLGSTGEQI

SEQ ID NO: 886520 - protein, 9 aa, Homo Sapiens
SDCGQFFTF

SEQ ID NO: 886521 - protein, 9 aa, Homo Sapiens
ESMKALPIL

SEQ ID NO: 886522 - protein, 9 aa, Homo Sapiens
NKEVEYNTN

SEQ ID NO: 886523 - protein, 9 aa, Homo Sapiens
TTCVVGRPG

SEQ ID NO: 886524 - protein, 9 aa, Homo Sapiens
GFYLRRSHK

SEQ ID NO: 886525 - protein, 9 aa, Homo Sapiens
LLYVVGLRN

SEQ ID NO: 886526 - protein, 9 aa, Homo Sapiens
SNMLKFGFG

SEQ ID NO: 886527 - protein, 9 aa, Homo Sapiens
GPNDSACAS

SEQ ID NO: 886528 - protein, 9 aa, Homo Sapiens
PPNHPNHSP

SEQ ID NO: 886529 - protein, 9 aa, Homo Sapiens
SNTIEQLRE

SEQ ID NO: 886530 - protein, 9 aa, Homo Sapiens
YPASFVFNI

SEQ ID NO: 886531 - protein, 9 aa, Homo Sapiens
ENNSNNEVA

SEQ ID NO: 886532 - protein, 9 aa, Homo Sapiens
PVNKVCRVS

SEQ ID NO: 886533 - protein, 9 aa, Homo Sapiens
EKYGFTHIS

SEQ ID NO: 886534 - protein, 9 aa, Homo Sapiens
DADAMDNDT

SEQ ID NO: 886535 - protein, 9 aa, Homo Sapiens
SNNPKRNDL

SEQ ID NO: 886536 - protein, 9 aa, Homo Sapiens
EALACKFIP

SEQ ID NO: 886537 - protein, 9 aa, Homo Sapiens
ALGYVISLE

SEQ ID NO: 886538 - protein, 9 aa, Homo Sapiens
FDSNYFGPV

SEQ ID NO: 886539 - protein, 9 aa, Homo Sapiens
KPRGNEEAQ

SEQ ID NO: 886540 - protein, 9 aa, Homo Sapiens
SVLHTLATD

SEQ ID NO: 886541 - protein, 9 aa, Homo Sapiens
YQSQINHIQ

SEQ ID NO: 886542 - protein, 9 aa, Homo Sapiens
VVIPLATSL

SEQ ID NO: 886543 - protein, 9 aa, Homo Sapiens
KMNEFLRLA

SEQ ID NO: 886544 - protein, 9 aa, Homo Sapiens
KQPGRSVQF

SEQ ID NO: 886545 - protein, 9 aa, Homo Sapiens
KQRQNGSAA

SEQ ID NO: 886546 - protein, 9 aa, Homo Sapiens
PSYPQERMF

SEQ ID NO: 886547 - protein, 9 aa, Homo Sapiens
SVTSRKKQE

SEQ ID NO: 886548 - protein, 9 aa, Homo Sapiens
TTTMRLPPY

SEQ ID NO: 886549 - protein, 9 aa, Homo Sapiens
PQPLGNGIT

SEQ ID NO: 886550 - protein, 9 aa, Homo Sapiens
YSSHIFQDL

SEQ ID NO: 886551 - protein, 9 aa, Homo Sapiens
FMLRRHIFF

SEQ ID NO: 886552 - protein, 9 aa, Homo Sapiens
YKFQKGKYV

SEQ ID NO: 886553 - protein, 9 aa, Homo Sapiens
GPVTTIPIV

SEQ ID NO: 886554 - protein, 9 aa, Homo Sapiens
PWVFAQMVQ

SEQ ID NO: 886555 - protein, 9 aa, Homo Sapiens
KYLKKEDAN

SEQ ID NO: 886556 - protein, 9 aa, Homo Sapiens
FRKEKDTFK

SEQ ID NO: 886557 - protein, 9 aa, Homo Sapiens
REFNLQRGD

SEQ ID NO: 886558 - protein, 9 aa, Homo Sapiens
CVTNSTLAT

SEQ ID NO: 886559 - protein, 9 aa, Homo Sapiens
ILWINPDDF

SEQ ID NO: 886560 - protein, 9 aa, Homo Sapiens
KEEEEEATA

SEQ ID NO: 886561 - protein, 9 aa, Homo Sapiens
KSSIIQHER

SEQ ID NO: 886562 - protein, 9 aa, Homo Sapiens
SPQHTNQTE

SEQ ID NO: 886563 - protein, 9 aa, Homo Sapiens
VGPWGDYDN

SEQ ID NO: 886564 - protein, 9 aa, Homo Sapiens
LSSTLNKHK

SEQ ID NO: 886565 - protein, 9 aa, Homo Sapiens
MCRGTHVYL

SEQ ID NO: 886566 - protein, 9 aa, Homo Sapiens
STLTQHQIT

SEQ ID NO: 886567 - protein, 9 aa, Homo Sapiens
KRIAGEASR

SEQ ID NO: 886568 - protein, 9 aa, Homo Sapiens
FSLQAIPHI

SEQ ID NO: 886569 - protein, 9 aa, Homo Sapiens
YLRRSHKLQ

SEQ ID NO: 886570 - protein, 9 aa, Homo Sapiens
QDFWDNSIP

SEQ ID NO: 886571 - protein, 9 aa, Homo Sapiens
DGNKQQDCE

SEQ ID NO: 886572 - protein, 9 aa, Homo Sapiens
SSNLLEKIQ

SEQ ID NO: 886573 - protein, 9 aa, Homo Sapiens
ETKAQKGEK

SEQ ID NO: 886574 - protein, 9 aa, Homo Sapiens
LVILGEATS

SEQ ID NO: 886575 - protein, 9 aa, Homo Sapiens
VEAALIINK

SEQ ID NO: 886576 - protein, 9 aa, Homo Sapiens
DELLNIIYF

SEQ ID NO: 886577 - protein, 9 aa, Homo Sapiens
KKKYPYFFW

SEQ ID NO: 886578 - protein, 9 aa, Homo Sapiens
IGLVSVIIP

SEQ ID NO: 886579 - protein, 9 aa, Homo Sapiens
NQRHSGKDW

SEQ ID NO: 886580 - protein, 9 aa, Homo Sapiens
TTANNKKVK

SEQ ID NO: 886581 - protein, 9 aa, Homo Sapiens
GLSVSDNEY

SEQ ID NO: 886582 - protein, 9 aa, Homo Sapiens
RKTGQEVAQ

SEQ ID NO: 886583 - protein, 9 aa, Homo Sapiens
NLVAPILRF

SEQ ID NO: 886584 - protein, 9 aa, Homo Sapiens
TVKQVYFHC

SEQ ID NO: 886585 - protein, 9 aa, Homo Sapiens
DIGILYIRL

SEQ ID NO: 886586 - protein, 9 aa, Homo Sapiens
CIQVHDQVL

SEQ ID NO: 886587 - protein, 9 aa, Homo Sapiens
WLSTNLDIL

SEQ ID NO: 886588 - protein, 9 aa, Homo Sapiens
LVECFSQEV

SEQ ID NO: 886589 - protein, 9 aa, Homo Sapiens
SYNSRTREQ

SEQ ID NO: 886590 - protein, 9 aa, Homo Sapiens
QNATLPSLS

SEQ ID NO: 886591 - protein, 9 aa, Homo Sapiens
AHKLFHVIT

SEQ ID NO: 886592 - protein, 9 aa, Homo Sapiens
VGKAGKEEW

SEQ ID NO: 886593 - protein, 9 aa, Homo Sapiens
RSDLWYLSL

SEQ ID NO: 886594 - protein, 9 aa, Homo Sapiens
KSDHFRCRD

SEQ ID NO: 886595 - protein, 9 aa, Homo Sapiens
SKEGCPAMG

SEQ ID NO: 886596 - protein, 9 aa, Homo Sapiens
EKGKRGPPG

SEQ ID NO: 886597 - protein, 9 aa, Homo Sapiens
LLNRTMATT

SEQ ID NO: 886598 - protein, 9 aa, Homo Sapiens
NENLVECFS

SEQ ID NO: 886599 - protein, 9 aa, Homo Sapiens
RDSHSEHER

SEQ ID NO: 886600 - protein, 9 aa, Homo Sapiens
CQMVQTNMQ

SEQ ID NO: 886601 - protein, 9 aa, Homo Sapiens
LSTGLDSIG

SEQ ID NO: 886602 - protein, 9 aa, Homo Sapiens
AVCLKCVMP

SEQ ID NO: 886603 - protein, 9 aa, Homo Sapiens
APPVVTTLH

SEQ ID NO: 886604 - protein, 9 aa, Homo Sapiens
DKLYTVHLK

SEQ ID NO: 886605 - protein, 9 aa, Homo Sapiens
GKAQMQSPT

SEQ ID NO: 886606 - protein, 9 aa, Homo Sapiens
YEPGKSSII

SEQ ID NO: 886607 - protein, 9 aa, Homo Sapiens
IAVTHFIHN

SEQ ID NO: 886608 - protein, 9 aa, Homo Sapiens
LLYIITNAQ

SEQ ID NO: 886609 - protein, 9 aa, Homo Sapiens
RMYYFDQGC

SEQ ID NO: 886610 - protein, 9 aa, Homo Sapiens
SLAEVQSEL

SEQ ID NO: 886611 - protein, 9 aa, Homo Sapiens
DHGIIQTLD

SEQ ID NO: 886612 - protein, 9 aa, Homo Sapiens
PVVLTLNDV

SEQ ID NO: 886613 - protein, 9 aa, Homo Sapiens
DVSFAYPNH

SEQ ID NO: 886614 - protein, 9 aa, Homo Sapiens
VLILIITLA

SEQ ID NO: 886615 - protein, 9 aa, Homo Sapiens
SFPENIISQ

SEQ ID NO: 886616 - protein, 9 aa, Homo Sapiens
QKLMAMQRP

SEQ ID NO: 886617 - protein, 9 aa, Homo Sapiens
LDFNTMPEI

SEQ ID NO: 886618 - protein, 9 aa, Homo Sapiens
SGHSMKWSA

SEQ ID NO: 886619 - protein, 9 aa, Homo Sapiens
LAYYSAGRG

SEQ ID NO: 886620 - protein, 9 aa, Homo Sapiens
CEKENYPKR

SEQ ID NO: 886621 - protein, 9 aa, Homo Sapiens
CNRIDASVL

SEQ ID NO: 886622 - protein, 9 aa, Homo Sapiens
YYKYPSDVI

SEQ ID NO: 886623 - protein, 9 aa, Homo Sapiens
PDKDGKANP

SEQ ID NO: 886624 - protein, 9 aa, Homo Sapiens
SHQAEYKLN

SEQ ID NO: 886625 - protein, 9 aa, Homo Sapiens
YSDIGILYI

SEQ ID NO: 886626 - protein, 9 aa, Homo Sapiens
AITSFVAAV

SEQ ID NO: 886627 - protein, 9 aa, Homo Sapiens
AGSLELCGF

SEQ ID NO: 886628 - protein, 9 aa, Homo Sapiens
TGYPNPPGT

SEQ ID NO: 886629 - protein, 9 aa, Homo Sapiens
GFNDLGYGY

SEQ ID NO: 886630 - protein, 9 aa, Homo Sapiens
FNEADKSVN

SEQ ID NO: 886631 - protein, 9 aa, Homo Sapiens
TPAKSVKER

SEQ ID NO: 886632 - protein, 9 aa, Homo Sapiens
YELDNNLKP

SEQ ID NO: 886633 - protein, 9 aa, Homo Sapiens
STLKSQIKE

SEQ ID NO: 886634 - protein, 9 aa, Homo Sapiens
IQVLHNMVH

SEQ ID NO: 886635 - protein, 9 aa, Homo Sapiens
SCFTQLINL

SEQ ID NO: 886636 - protein, 9 aa, Homo Sapiens
AMVRSIILL

SEQ ID NO: 886637 - protein, 9 aa, Homo Sapiens
VVATIANNR

SEQ ID NO: 886638 - protein, 9 aa, Homo Sapiens
QMYYEMIKN

SEQ ID NO: 886639 - protein, 9 aa, Homo Sapiens
KMTFDRDGE

SEQ ID NO: 886640 - protein, 9 aa, Homo Sapiens
KCDSKLPAS

SEQ ID NO: 886641 - protein, 9 aa, Homo Sapiens
YKMQNGYEL

SEQ ID NO: 886642 - protein, 9 aa, Homo Sapiens
GRLDKSNPR

SEQ ID NO: 886643 - protein, 9 aa, Homo Sapiens
GKYINCDVM

SEQ ID NO: 886644 - protein, 9 aa, Homo Sapiens
NQLPTPWKI

SEQ ID NO: 886645 - protein, 9 aa, Homo Sapiens
ARYACQIHH

SEQ ID NO: 886646 - protein, 9 aa, Homo Sapiens
ESLEEDYKY

SEQ ID NO: 886647 - protein, 9 aa, Homo Sapiens
ENPLWTSLA

SEQ ID NO: 886648 - protein, 9 aa, Homo Sapiens
SAKPKPANK

SEQ ID NO: 886649 - protein, 9 aa, Homo Sapiens
KSMIGKIRV

SEQ ID NO: 886650 - protein, 9 aa, Homo Sapiens
YKQVHILPV

SEQ ID NO: 886651 - protein, 9 aa, Homo Sapiens
VWKILAILY

SEQ ID NO: 886652 - protein, 9 aa, Homo Sapiens
FWLGNEHLH

SEQ ID NO: 886653 - protein, 9 aa, Homo Sapiens
VTDIKCVKD

SEQ ID NO: 886654 - protein, 9 aa, Homo Sapiens
VAATHIVHP

SEQ ID NO: 886655 - protein, 9 aa, Homo Sapiens
KALGTKTFQ

SEQ ID NO: 886656 - protein, 9 aa, Homo Sapiens
QDCYQLYQG

SEQ ID NO: 886657 - protein, 9 aa, Homo Sapiens
RMMSSVAPA

SEQ ID NO: 886658 - protein, 9 aa, Homo Sapiens
FCMQKYHKS

SEQ ID NO: 886659 - protein, 9 aa, Homo Sapiens
WPTRVCADV

SEQ ID NO: 886660 - protein, 9 aa, Homo Sapiens
NKFSESETK

SEQ ID NO: 886661 - protein, 9 aa, Homo Sapiens
MDLVRSGPF

SEQ ID NO: 886662 - protein, 9 aa, Homo Sapiens
FKIIIKIFF

SEQ ID NO: 886663 - protein, 9 aa, Homo Sapiens
MAHYPPGHH

SEQ ID NO: 886664 - protein, 9 aa, Homo Sapiens
LLLMSTLGI

SEQ ID NO: 886665 - protein, 9 aa, Homo Sapiens
TTAYVLQFS

SEQ ID NO: 886666 - protein, 9 aa, Homo Sapiens
QHIGEQFYR

SEQ ID NO: 886667 - protein, 9 aa, Homo Sapiens
ILKKNEIQK

SEQ ID NO: 886668 - protein, 9 aa, Homo Sapiens
ASDPLLSVF

SEQ ID NO: 886669 - protein, 9 aa, Homo Sapiens
QQWLHQNRF

SEQ ID NO: 886670 - protein, 9 aa, Homo Sapiens
LMGIIPQIA

SEQ ID NO: 886671 - protein, 9 aa, Homo Sapiens
IHVRFRLGV

SEQ ID NO: 886672 - protein, 9 aa, Homo Sapiens
VQRGPAQKK

SEQ ID NO: 886673 - protein, 9 aa, Homo Sapiens
ALEAEIQTL

SEQ ID NO: 886674 - protein, 9 aa, Homo Sapiens
FQDQTRIWF

SEQ ID NO: 886675 - protein, 9 aa, Homo Sapiens
TNGVLSRDG

SEQ ID NO: 886676 - protein, 9 aa, Homo Sapiens
MARSDLWYL

SEQ ID NO: 886677 - protein, 9 aa, Homo Sapiens
DNDPKPGEA

SEQ ID NO: 886678 - protein, 9 aa, Homo Sapiens
QDLYQILKA

SEQ ID NO: 886679 - protein, 9 aa, Homo Sapiens
NHIDEPILL

SEQ ID NO: 886680 - protein, 9 aa, Homo Sapiens
HHNVGMACS

SEQ ID NO: 886681 - protein, 9 aa, Homo Sapiens
EEEKVVKRK

SEQ ID NO: 886682 - protein, 9 aa, Homo Sapiens
KITWSTVPK

SEQ ID NO: 886683 - protein, 9 aa, Homo Sapiens
KREKLEKDI

SEQ ID NO: 886684 - protein, 9 aa, Homo Sapiens
SMVPQLYFS

SEQ ID NO: 886685 - protein, 9 aa, Homo Sapiens
MGQSGSYLN

SEQ ID NO: 886686 - protein, 9 aa, Homo Sapiens
NCIHLEIKQ

SEQ ID NO: 886687 - protein, 9 aa, Homo Sapiens
NDIQINIWY

SEQ ID NO: 886688 - protein, 9 aa, Homo Sapiens
PECMRLRNR

SEQ ID NO: 886689 - protein, 9 aa, Homo Sapiens
DHRMTKVHR

SEQ ID NO: 886690 - protein, 9 aa, Homo Sapiens
GRSLTTSPF

SEQ ID NO: 886691 - protein, 9 aa, Homo Sapiens
WQRTLSYNK

SEQ ID NO: 886692 - protein, 9 aa, Homo Sapiens
MQRNWSGRT

SEQ ID NO: 886693 - protein, 9 aa, Homo Sapiens
SLKYTFFEC

SEQ ID NO: 886694 - protein, 9 aa, Homo Sapiens
QISYTPPES

SEQ ID NO: 886695 - protein, 9 aa, Homo Sapiens
FFNPQGDVA

SEQ ID NO: 886696 - protein, 9 aa, Homo Sapiens
VQELFPASI

SEQ ID NO: 886697 - protein, 9 aa, Homo Sapiens
VLVIQTDEG

SEQ ID NO: 886698 - protein, 9 aa, Homo Sapiens
EGSSLYHQL

SEQ ID NO: 886699 - protein, 9 aa, Homo Sapiens
WAAAPSHWV

SEQ ID NO: 886700 - protein, 9 aa, Homo Sapiens
QTAEAVYSI

SEQ ID NO: 886701 - protein, 9 aa, Homo Sapiens
QSRLPGRPT

SEQ ID NO: 886702 - protein, 9 aa, Homo Sapiens
EFDVFDAYL

SEQ ID NO: 886703 - protein, 9 aa, Homo Sapiens
LGNEHLHQL

SEQ ID NO: 886704 - protein, 9 aa, Homo Sapiens
EYEVRCTHV

SEQ ID NO: 886705 - protein, 9 aa, Homo Sapiens
KKLRRNIIP

SEQ ID NO: 886706 - protein, 9 aa, Homo Sapiens
PFSSSKSRA

SEQ ID NO: 886707 - protein, 9 aa, Homo Sapiens
QVPVHRHYK

SEQ ID NO: 886708 - protein, 9 aa, Homo Sapiens
DQSPRRIPK

SEQ ID NO: 886709 - protein, 9 aa, Homo Sapiens
KFIRRDFFL

SEQ ID NO: 886710 - protein, 9 aa, Homo Sapiens
QGKPFKAKC

SEQ ID NO: 886711 - protein, 9 aa, Homo Sapiens
RYSRKTTPG

SEQ ID NO: 886712 - protein, 9 aa, Homo Sapiens
LQKNKYRVL

SEQ ID NO: 886713 - protein, 9 aa, Homo Sapiens
YKPFHRSSH

SEQ ID NO: 886714 - protein, 9 aa, Homo Sapiens
ETPPDGERF

SEQ ID NO: 886715 - protein, 9 aa, Homo Sapiens
LAVSDACTS

SEQ ID NO: 886716 - protein, 9 aa, Homo Sapiens
EAEIQTLKH

SEQ ID NO: 886717 - protein, 9 aa, Homo Sapiens
LNPMGDTLA

SEQ ID NO: 886718 - protein, 9 aa, Homo Sapiens
LHTRNVHYC

SEQ ID NO: 886719 - protein, 9 aa, Homo Sapiens
NSVLIQHQI

SEQ ID NO: 886720 - protein, 9 aa, Homo Sapiens
CATQMRFFL

SEQ ID NO: 886721 - protein, 9 aa, Homo Sapiens
LVLCTHKRI

SEQ ID NO: 886722 - protein, 9 aa, Homo Sapiens
IYQGNISKA

SEQ ID NO: 886723 - protein, 9 aa, Homo Sapiens
TNLKRKNKL

SEQ ID NO: 886724 - protein, 9 aa, Homo Sapiens
LGMEENNIG

SEQ ID NO: 886725 - protein, 9 aa, Homo Sapiens
STHSGDLES

SEQ ID NO: 886726 - protein, 9 aa, Homo Sapiens
SLKASNDGP

SEQ ID NO: 886727 - protein, 9 aa, Homo Sapiens
QPQWRREDR

SEQ ID NO: 886728 - protein, 9 aa, Homo Sapiens
NHLIHLMFK

SEQ ID NO: 886729 - protein, 9 aa, Homo Sapiens
NDIQFEFTP

SEQ ID NO: 886730 - protein, 9 aa, Homo Sapiens
KKTQIISHV

SEQ ID NO: 886731 - protein, 9 aa, Homo Sapiens
ELPKIAYSR

SEQ ID NO: 886732 - protein, 9 aa, Homo Sapiens
PLLMAPPLS

SEQ ID NO: 886733 - protein, 9 aa, Homo Sapiens
TFQHSVVVP

SEQ ID NO: 886734 - protein, 9 aa, Homo Sapiens
KHLSRGISH

SEQ ID NO: 886735 - protein, 9 aa, Homo Sapiens
YIERYSRKT

SEQ ID NO: 886736 - protein, 9 aa, Homo Sapiens
RALSISPLL

SEQ ID NO: 886737 - protein, 9 aa, Homo Sapiens
IPFLQNAIM

SEQ ID NO: 886738 - protein, 9 aa, Homo Sapiens
RVVYSTRLV

SEQ ID NO: 886739 - protein, 9 aa, Homo Sapiens
AQNLTKLMS

SEQ ID NO: 886740 - protein, 9 aa, Homo Sapiens
TVQGHVQLH

SEQ ID NO: 886741 - protein, 9 aa, Homo Sapiens
EYCGIWQLY

SEQ ID NO: 886742 - protein, 9 aa, Homo Sapiens
VLWASDECL

SEQ ID NO: 886743 - protein, 9 aa, Homo Sapiens
SKCSQKYIT

SEQ ID NO: 886744 - protein, 9 aa, Homo Sapiens
KIQIAAEGI

SEQ ID NO: 886745 - protein, 9 aa, Homo Sapiens
VGVLSHTKP

SEQ ID NO: 886746 - protein, 9 aa, Homo Sapiens
NLPEFPFGL

SEQ ID NO: 886747 - protein, 9 aa, Homo Sapiens
LSHTEYQII

SEQ ID NO: 886748 - protein, 9 aa, Homo Sapiens
HPLNINPDR

SEQ ID NO: 886749 - protein, 9 aa, Homo Sapiens
APLVLTNCD

SEQ ID NO: 886750 - protein, 9 aa, Homo Sapiens
INENCTLQF

SEQ ID NO: 886751 - protein, 9 aa, Homo Sapiens
TKKKEGKSR

SEQ ID NO: 886752 - protein, 9 aa, Homo Sapiens
SLPSNPSSR

SEQ ID NO: 886753 - protein, 9 aa, Homo Sapiens
SGAGFQSNP

SEQ ID NO: 886754 - protein, 9 aa, Homo Sapiens
ETFTILFES

SEQ ID NO: 886755 - protein, 9 aa, Homo Sapiens
CSSSWETSQ

SEQ ID NO: 886756 - protein, 9 aa, Homo Sapiens
VSSNFVARV

SEQ ID NO: 886757 - protein, 9 aa, Homo Sapiens
YPVAFEYLY

SEQ ID NO: 886758 - protein, 9 aa, Homo Sapiens
VDLIQHQII

SEQ ID NO: 886759 - protein, 9 aa, Homo Sapiens
LSGREHNFS

SEQ ID NO: 886760 - protein, 9 aa, Homo Sapiens
SARVCFFFP

SEQ ID NO: 886761 - protein, 9 aa, Homo Sapiens
RPAILHLLK

SEQ ID NO: 886762 - protein, 9 aa, Homo Sapiens
EQENNGDNA

SEQ ID NO: 886763 - protein, 9 aa, Homo Sapiens
LEGFELMDD

SEQ ID NO: 886764 - protein, 9 aa, Homo Sapiens
GDTPLNDAI

SEQ ID NO: 886765 - protein, 9 aa, Homo Sapiens
MLGFNPRWM

SEQ ID NO: 886766 - protein, 9 aa, Homo Sapiens
KELQEPQFR

SEQ ID NO: 886767 - protein, 9 aa, Homo Sapiens
TTIFTTLNE

SEQ ID NO: 886768 - protein, 9 aa, Homo Sapiens
LKLEKSIGN

SEQ ID NO: 886769 - protein, 9 aa, Homo Sapiens
RASRRGDTG

SEQ ID NO: 886770 - protein, 9 aa, Homo Sapiens
KILRELDTD

SEQ ID NO: 886771 - protein, 9 aa, Homo Sapiens
LLKQRNFLQ

SEQ ID NO: 886772 - protein, 9 aa, Homo Sapiens
GSITIPPCY

SEQ ID NO: 886773 - protein, 9 aa, Homo Sapiens
MAQLKIYQG

SEQ ID NO: 886774 - protein, 9 aa, Homo Sapiens
QVNVHGIFS

SEQ ID NO: 886775 - protein, 9 aa, Homo Sapiens
SPWSLHTPS

SEQ ID NO: 886776 - protein, 9 aa, Homo Sapiens
GGNMLGLAR

SEQ ID NO: 886777 - protein, 9 aa, Homo Sapiens
SPKARCLIH

SEQ ID NO: 886778 - protein, 9 aa, Homo Sapiens
CKEGKDEHP

SEQ ID NO: 886779 - protein, 9 aa, Homo Sapiens
QKKPMKKDM

SEQ ID NO: 886780 - protein, 9 aa, Homo Sapiens
SNVSLTGAS

SEQ ID NO: 886781 - protein, 9 aa, Homo Sapiens
EATSVLDTS

SEQ ID NO: 886782 - protein, 9 aa, Homo Sapiens
CVIYYFVMM

SEQ ID NO: 886783 - protein, 9 aa, Homo Sapiens
KILCMPHYD

SEQ ID NO: 886784 - protein, 9 aa, Homo Sapiens
TINKGGVSG

SEQ ID NO: 886785 - protein, 9 aa, Homo Sapiens
QKDSDDGPI

SEQ ID NO: 886786 - protein, 9 aa, Homo Sapiens
EEDKGLDSA

SEQ ID NO: 886787 - protein, 9 aa, Homo Sapiens
TLLINSSAF

SEQ ID NO: 886788 - protein, 9 aa, Homo Sapiens
KSLSSGLQK

SEQ ID NO: 886789 - protein, 9 aa, Homo Sapiens
IHTAEKSHK

SEQ ID NO: 886790 - protein, 9 aa, Homo Sapiens
NATLPSLSA

SEQ ID NO: 886791 - protein, 9 aa, Homo Sapiens
ESHSEEDNS

SEQ ID NO: 886792 - protein, 9 aa, Homo Sapiens
CMWYCLRLL

SEQ ID NO: 886793 - protein, 9 aa, Homo Sapiens
EDDKRLLLK

SEQ ID NO: 886794 - protein, 9 aa, Homo Sapiens
PGYDKIVGL

SEQ ID NO: 886795 - protein, 9 aa, Homo Sapiens
EPQKKISES

SEQ ID NO: 886796 - protein, 9 aa, Homo Sapiens
QGEEVETLV

SEQ ID NO: 886797 - protein, 9 aa, Homo Sapiens
NNTDFFIGK

SEQ ID NO: 886798 - protein, 9 aa, Homo Sapiens
NSVGKLLGP

SEQ ID NO: 886799 - protein, 9 aa, Homo Sapiens
LLDEATSVL

SEQ ID NO: 886800 - protein, 9 aa, Homo Sapiens
MNALNEKKQ

SEQ ID NO: 886801 - protein, 9 aa, Homo Sapiens
VSDAECKAH

SEQ ID NO: 886802 - protein, 9 aa, Homo Sapiens
GMKPRVIKE

SEQ ID NO: 886803 - protein, 9 aa, Homo Sapiens
MEEMGNCIE

SEQ ID NO: 886804 - protein, 9 aa, Homo Sapiens
SATASSKKA

SEQ ID NO: 886805 - protein, 9 aa, Homo Sapiens
GERLFQCNI

SEQ ID NO: 886806 - protein, 9 aa, Homo Sapiens
KYYDAYLSY

SEQ ID NO: 886807 - protein, 9 aa, Homo Sapiens
VLDSVRQFS

SEQ ID NO: 886808 - protein, 9 aa, Homo Sapiens
QVILQHMKD

SEQ ID NO: 886809 - protein, 9 aa, Homo Sapiens
DWPRRIRME

SEQ ID NO: 886810 - protein, 9 aa, Homo Sapiens
LGSIILIQG

SEQ ID NO: 886811 - protein, 9 aa, Homo Sapiens
WQEGACVTV

SEQ ID NO: 886812 - protein, 9 aa, Homo Sapiens
LQRMMSSVA

SEQ ID NO: 886813 - protein, 9 aa, Homo Sapiens
TGTQQQLFC

SEQ ID NO: 886814 - protein, 9 aa, Homo Sapiens
LRNVREQLA

SEQ ID NO: 886815 - protein, 9 aa, Homo Sapiens
FWWESLVLV

SEQ ID NO: 886816 - protein, 9 aa, Homo Sapiens
LHRRRRQEE

SEQ ID NO: 886817 - protein, 9 aa, Homo Sapiens
NTSYYENVN

SEQ ID NO: 886818 - protein, 9 aa, Homo Sapiens
KKEREMLKM

SEQ ID NO: 886819 - protein, 9 aa, Homo Sapiens
TAKFKTPEL

SEQ ID NO: 886820 - protein, 9 aa, Homo Sapiens
NAEAVHLFC

SEQ ID NO: 886821 - protein, 9 aa, Homo Sapiens
TDWLGCTLQ

SEQ ID NO: 886822 - protein, 9 aa, Homo Sapiens
ALINLHNNR

SEQ ID NO: 886823 - protein, 9 aa, Homo Sapiens
SNENDLLQA

SEQ ID NO: 886824 - protein, 9 aa, Homo Sapiens
KNIGKFCGK

SEQ ID NO: 886825 - protein, 9 aa, Homo Sapiens
DKEFWQKVM

SEQ ID NO: 886826 - protein, 9 aa, Homo Sapiens
VGYKRFLGP

SEQ ID NO: 886827 - protein, 9 aa, Homo Sapiens
NWMVQVSFS

SEQ ID NO: 886828 - protein, 9 aa, Homo Sapiens
GHMRSHTGD

SEQ ID NO: 886829 - protein, 9 aa, Homo Sapiens
SNKAEEEMA

SEQ ID NO: 886830 - protein, 9 aa, Homo Sapiens
EPNLRLHQI

SEQ ID NO: 886831 - protein, 9 aa, Homo Sapiens
TFDRDGEKA

SEQ ID NO: 886832 - protein, 9 aa, Homo Sapiens
EPSCKGMQC

SEQ ID NO: 886833 - protein, 9 aa, Homo Sapiens
QYKLPFLST

SEQ ID NO: 886834 - protein, 9 aa, Homo Sapiens
NKSCEMSSF

SEQ ID NO: 886835 - protein, 9 aa, Homo Sapiens
GFIAAFCFY

SEQ ID NO: 886836 - protein, 9 aa, Homo Sapiens
SPPLGGHFH

SEQ ID NO: 886837 - protein, 9 aa, Homo Sapiens
IEEIEEIMQ

SEQ ID NO: 886838 - protein, 9 aa, Homo Sapiens
SYSVGISVL

SEQ ID NO: 886839 - protein, 9 aa, Homo Sapiens
EGAEGRQVA

SEQ ID NO: 886840 - protein, 9 aa, Homo Sapiens
NLLLDARSA

SEQ ID NO: 886841 - protein, 9 aa, Homo Sapiens
IVHPLLQGW

SEQ ID NO: 886842 - protein, 9 aa, Homo Sapiens
GNFSPTSKQ

SEQ ID NO: 886843 - protein, 9 aa, Homo Sapiens
NIELIRNTL

SEQ ID NO: 886844 - protein, 9 aa, Homo Sapiens
KEKRRLNTR

SEQ ID NO: 886845 - protein, 9 aa, Homo Sapiens
IELDKYLYG

SEQ ID NO: 886846 - protein, 9 aa, Homo Sapiens
EVNQKEDTW

SEQ ID NO: 886847 - protein, 9 aa, Homo Sapiens
RDKLYPINI

SEQ ID NO: 886848 - protein, 9 aa, Homo Sapiens
STHSPFQTL

SEQ ID NO: 886849 - protein, 9 aa, Homo Sapiens
RVPTCVLHK

SEQ ID NO: 886850 - protein, 9 aa, Homo Sapiens
TGGFLIEVN

SEQ ID NO: 886851 - protein, 9 aa, Homo Sapiens
DPQKASGHF

SEQ ID NO: 886852 - protein, 9 aa, Homo Sapiens
NVRRKPLSF

SEQ ID NO: 886853 - protein, 9 aa, Homo Sapiens
DQETYSHCL

SEQ ID NO: 886854 - protein, 9 aa, Homo Sapiens
CSFLQKNQK

SEQ ID NO: 886855 - protein, 9 aa, Homo Sapiens
CGATSSSGT

SEQ ID NO: 886856 - protein, 9 aa, Homo Sapiens
NATASSNPL

SEQ ID NO: 886857 - protein, 9 aa, Homo Sapiens
GTLMRTCEC

SEQ ID NO: 886858 - protein, 9 aa, Homo Sapiens
FGVTSGSSK

SEQ ID NO: 886859 - protein, 9 aa, Homo Sapiens
QIRDNWNRP

SEQ ID NO: 886860 - protein, 9 aa, Homo Sapiens
LMEDRMMTK

SEQ ID NO: 886861 - protein, 9 aa, Homo Sapiens
ETKAVCEFE

SEQ ID NO: 886862 - protein, 9 aa, Homo Sapiens
LLYVQKESE

SEQ ID NO: 886863 - protein, 9 aa, Homo Sapiens
DHPTLASQS

SEQ ID NO: 886864 - protein, 9 aa, Homo Sapiens
NSSLNISVT

SEQ ID NO: 886865 - protein, 9 aa, Homo Sapiens
AEKLDWLAT

SEQ ID NO: 886866 - protein, 9 aa, Homo Sapiens
LDSRFWPRY

SEQ ID NO: 886867 - protein, 9 aa, Homo Sapiens
LPQDYAQIF

SEQ ID NO: 886868 - protein, 9 aa, Homo Sapiens
FQSSEEQQQ

SEQ ID NO: 886869 - protein, 9 aa, Homo Sapiens
RDRLLNRCR

SEQ ID NO: 886870 - protein, 9 aa, Homo Sapiens
KLQTNLQHA

SEQ ID NO: 886871 - protein, 9 aa, Homo Sapiens
YRHICKFHC

SEQ ID NO: 886872 - protein, 9 aa, Homo Sapiens
RFLDIPGQD

SEQ ID NO: 886873 - protein, 9 aa, Homo Sapiens
NIKNKIEDA

SEQ ID NO: 886874 - protein, 9 aa, Homo Sapiens
RTREQSRSR

SEQ ID NO: 886875 - protein, 9 aa, Homo Sapiens
TKLNRAMDN

SEQ ID NO: 886876 - protein, 9 aa, Homo Sapiens
VCVYYKKCP

SEQ ID NO: 886877 - protein, 9 aa, Homo Sapiens
KKQEGGAKK

SEQ ID NO: 886878 - protein, 9 aa, Homo Sapiens
LLRQRTRPY

SEQ ID NO: 886879 - protein, 9 aa, Homo Sapiens
GQAFGEYAN

SEQ ID NO: 886880 - protein, 9 aa, Homo Sapiens
LGGRLYISR

SEQ ID NO: 886881 - protein, 9 aa, Homo Sapiens
LASTRSAAE

SEQ ID NO: 886882 - protein, 9 aa, Homo Sapiens
SGQPYQPLW

SEQ ID NO: 886883 - protein, 9 aa, Homo Sapiens
GHLMVFTIF

SEQ ID NO: 886884 - protein, 9 aa, Homo Sapiens
KAEECIRLC

SEQ ID NO: 886885 - protein, 9 aa, Homo Sapiens
STVWGTEHT

SEQ ID NO: 886886 - protein, 9 aa, Homo Sapiens
VSDCGHRGS

SEQ ID NO: 886887 - protein, 9 aa, Homo Sapiens
IILHRRKQD

SEQ ID NO: 886888 - protein, 9 aa, Homo Sapiens
KQVFLQPPT

SEQ ID NO: 886889 - protein, 9 aa, Homo Sapiens
AALVLANLT

SEQ ID NO: 886890 - protein, 9 aa, Homo Sapiens
RIKPSPLTP

SEQ ID NO: 886891 - protein, 9 aa, Homo Sapiens
GWTEGSKMQ

SEQ ID NO: 886892 - protein, 9 aa, Homo Sapiens
EKAENEDLN

SEQ ID NO: 886893 - protein, 9 aa, Homo Sapiens
ENIPGKWTT

SEQ ID NO: 886894 - protein, 9 aa, Homo Sapiens
MLAIYLVHG

SEQ ID NO: 886895 - protein, 9 aa, Homo Sapiens
QYCLQKVTE

SEQ ID NO: 886896 - protein, 9 aa, Homo Sapiens
ENLKFQVWD

SEQ ID NO: 886897 - protein, 9 aa, Homo Sapiens
YGGNVVMLV

SEQ ID NO: 886898 - protein, 9 aa, Homo Sapiens
TSTDKSDQA

SEQ ID NO: 886899 - protein, 9 aa, Homo Sapiens
FGATSRMDT

SEQ ID NO: 886900 - protein, 9 aa, Homo Sapiens
LENNPSYTY

SEQ ID NO: 886901 - protein, 9 aa, Homo Sapiens
ICAITLGHG

SEQ ID NO: 886902 - protein, 9 aa, Homo Sapiens
IVHQIIHTG

SEQ ID NO: 886903 - protein, 9 aa, Homo Sapiens
YNTTADEIL

SEQ ID NO: 886904 - protein, 9 aa, Homo Sapiens
GSMVLLGIS

SEQ ID NO: 886905 - protein, 9 aa, Homo Sapiens
LLYFRMQDL

SEQ ID NO: 886906 - protein, 9 aa, Homo Sapiens
TVSVTSHRN

SEQ ID NO: 886907 - protein, 9 aa, Homo Sapiens
QGVGLNSTG

SEQ ID NO: 886908 - protein, 9 aa, Homo Sapiens
LDRICKLAD

SEQ ID NO: 886909 - protein, 9 aa, Homo Sapiens
IMQESPDPE

SEQ ID NO: 886910 - protein, 9 aa, Homo Sapiens
NKERQRRQS

SEQ ID NO: 886911 - protein, 9 aa, Homo Sapiens
PGTWGPRGD

SEQ ID NO: 886912 - protein, 9 aa, Homo Sapiens
MLSVFYFTI

SEQ ID NO: 886913 - protein, 9 aa, Homo Sapiens
GQQGLGAWP

SEQ ID NO: 886914 - protein, 9 aa, Homo Sapiens
GYYESGYFC

SEQ ID NO: 886915 - protein, 9 aa, Homo Sapiens
KSRSVKLMP

SEQ ID NO: 886916 - protein, 9 aa, Homo Sapiens
QEDKQIGKS

SEQ ID NO: 886917 - protein, 9 aa, Homo Sapiens
KVHPKYLSC

SEQ ID NO: 886918 - protein, 9 aa, Homo Sapiens
YLQIFHKLW

SEQ ID NO: 886919 - protein, 9 aa, Homo Sapiens
TVMVQETQR

SEQ ID NO: 886920 - protein, 9 aa, Homo Sapiens
EINKNRNAV

SEQ ID NO: 886921 - protein, 9 aa, Homo Sapiens
RKNVENNCY

SEQ ID NO: 886922 - protein, 9 aa, Homo Sapiens
RCQMVQTNM

SEQ ID NO: 886923 - protein, 9 aa, Homo Sapiens
LHKRIYCAL

SEQ ID NO: 886924 - protein, 9 aa, Homo Sapiens
PDLLEMDTN

SEQ ID NO: 886925 - protein, 9 aa, Homo Sapiens
IIGANQVSV

SEQ ID NO: 886926 - protein, 9 aa, Homo Sapiens
EVKMPEEGE

SEQ ID NO: 886927 - protein, 9 aa, Homo Sapiens
RFIQEVHTH

SEQ ID NO: 886928 - protein, 9 aa, Homo Sapiens
KFCCPAGGN

SEQ ID NO: 886929 - protein, 9 aa, Homo Sapiens
VLSLGRRVR

SEQ ID NO: 886930 - protein, 9 aa, Homo Sapiens
TSFYTFSWA

SEQ ID NO: 886931 - protein, 9 aa, Homo Sapiens
TQNNLGNWK

SEQ ID NO: 886932 - protein, 9 aa, Homo Sapiens
TAVQYIENS

SEQ ID NO: 886933 - protein, 9 aa, Homo Sapiens
QSHSSGNRN

SEQ ID NO: 886934 - protein, 9 aa, Homo Sapiens
SCRCKGIVT

SEQ ID NO: 886935 - protein, 9 aa, Homo Sapiens
NPCTSCAPP

SEQ ID NO: 886936 - protein, 9 aa, Homo Sapiens
QIMLLNHPD

SEQ ID NO: 886937 - protein, 9 aa, Homo Sapiens
YKGQMTNLY

SEQ ID NO: 886938 - protein, 9 aa, Homo Sapiens
LYKLFHDPS

SEQ ID NO: 886939 - protein, 9 aa, Homo Sapiens
KFANQILSY

SEQ ID NO: 886940 - protein, 9 aa, Homo Sapiens
YKQVIKYCT

SEQ ID NO: 886941 - protein, 9 aa, Homo Sapiens
NNKITKIKD

SEQ ID NO: 886942 - protein, 9 aa, Homo Sapiens
MRNLYQEWK

SEQ ID NO: 886943 - protein, 8 aa, Homo Sapiens
NTNSKEVL

SEQ ID NO: 886944 - protein, 9 aa, Homo Sapiens
ARAVVPSCI

SEQ ID NO: 886945 - protein, 9 aa, Homo Sapiens
KTVMYKHMD

SEQ ID NO: 886946 - protein, 9 aa, Homo Sapiens
LFLEYVTLS

SEQ ID NO: 886947 - protein, 9 aa, Homo Sapiens
TEKAINELF

SEQ ID NO: 886948 - protein, 9 aa, Homo Sapiens
DPYTLAINV

SEQ ID NO: 886949 - protein, 9 aa, Homo Sapiens
TEESPYMNG

SEQ ID NO: 886950 - protein, 9 aa, Homo Sapiens
TMSREVKEI

SEQ ID NO: 886951 - protein, 9 aa, Homo Sapiens
HFKSVIHIT

SEQ ID NO: 886952 - protein, 9 aa, Homo Sapiens
IDGMKMETS

SEQ ID NO: 886953 - protein, 9 aa, Homo Sapiens
TPGVDLSCI

SEQ ID NO: 886954 - protein, 9 aa, Homo Sapiens
RMIKRFIPL

SEQ ID NO: 886955 - protein, 9 aa, Homo Sapiens
WGEPSITLQ

SEQ ID NO: 886956 - protein, 9 aa, Homo Sapiens
FEGQNCIHL

SEQ ID NO: 886957 - protein, 9 aa, Homo Sapiens
APKRKLSLI

SEQ ID NO: 886958 - protein, 9 aa, Homo Sapiens
CCVLERGED

SEQ ID NO: 886959 - protein, 9 aa, Homo Sapiens
DYYKLQYGP

SEQ ID NO: 886960 - protein, 9 aa, Homo Sapiens
SFNTFFPLL

SEQ ID NO: 886961 - protein, 9 aa, Homo Sapiens
GSDYSQSSR

SEQ ID NO: 886962 - protein, 9 aa, Homo Sapiens
FIKNTAPVN

SEQ ID NO: 886963 - protein, 9 aa, Homo Sapiens
RWATHIQDM

SEQ ID NO: 886964 - protein, 9 aa, Homo Sapiens
RKENRVDAT

SEQ ID NO: 886965 - protein, 9 aa, Homo Sapiens
KQEGCANLL

SEQ ID NO: 886966 - protein, 9 aa, Homo Sapiens
LYFTDLKDG

SEQ ID NO: 886967 - protein, 9 aa, Homo Sapiens
EKIITEHRV

SEQ ID NO: 886968 - protein, 9 aa, Homo Sapiens
GCRICPGNT

SEQ ID NO: 886969 - protein, 9 aa, Homo Sapiens
ASQGLDFLS

SEQ ID NO: 886970 - protein, 9 aa, Homo Sapiens
ENKDGRIEL

SEQ ID NO: 886971 - protein, 9 aa, Homo Sapiens
NPIKSIPSY

SEQ ID NO: 886972 - protein, 9 aa, Homo Sapiens
AGGTSQNGA

SEQ ID NO: 886973 - protein, 9 aa, Homo Sapiens
LDLGLLNSL

SEQ ID NO: 886974 - protein, 9 aa, Homo Sapiens
PCELYQVMC

SEQ ID NO: 886975 - protein, 9 aa, Homo Sapiens
DDSSDNGFL

SEQ ID NO: 886976 - protein, 9 aa, Homo Sapiens
VREQQINIP

SEQ ID NO: 886977 - protein, 9 aa, Homo Sapiens
HNPKLQLKN

SEQ ID NO: 886978 - protein, 9 aa, Homo Sapiens
RRQRHIKHR

SEQ ID NO: 886979 - protein, 9 aa, Homo Sapiens
MALAFFSSS

SEQ ID NO: 886980 - protein, 9 aa, Homo Sapiens
EAIDGSGLQ

SEQ ID NO: 886981 - protein, 9 aa, Homo Sapiens
MREKLCEIK

SEQ ID NO: 886982 - protein, 9 aa, Homo Sapiens
VHFASVVNY

SEQ ID NO: 886983 - protein, 9 aa, Homo Sapiens
PHLHINNDA

SEQ ID NO: 886984 - protein, 9 aa, Homo Sapiens
QPEPLPEVA

SEQ ID NO: 886985 - protein, 9 aa, Homo Sapiens
KLGKQIHVS

SEQ ID NO: 886986 - protein, 9 aa, Homo Sapiens
LSECDAAKH

SEQ ID NO: 886987 - protein, 9 aa, Homo Sapiens
QPERNCSGN

SEQ ID NO: 886988 - protein, 9 aa, Homo Sapiens
KRMLKATEV

SEQ ID NO: 886989 - protein, 9 aa, Homo Sapiens
IQHKRTVAF

SEQ ID NO: 886990 - protein, 9 aa, Homo Sapiens
CDMDGMNQT

SEQ ID NO: 886991 - protein, 9 aa, Homo Sapiens
AAALALTFL

SEQ ID NO: 886992 - protein, 9 aa, Homo Sapiens
AKIMAKKIS

SEQ ID NO: 886993 - protein, 9 aa, Homo Sapiens
LPQELQLHY

SEQ ID NO: 886994 - protein, 9 aa, Homo Sapiens
SIQHCNICC

SEQ ID NO: 886995 - protein, 9 aa, Homo Sapiens
VERDIKFEL

SEQ ID NO: 886996 - protein, 9 aa, Homo Sapiens
FIRGSTLCF

SEQ ID NO: 886997 - protein, 9 aa, Homo Sapiens
QELDNFFDE

SEQ ID NO: 886998 - protein, 9 aa, Homo Sapiens
LSGFLKFCF

SEQ ID NO: 886999 - protein, 9 aa, Homo Sapiens
CDQPLDDIS

SEQ ID NO: 887000 - protein, 9 aa, Homo Sapiens
IQMPAFFNG

SEQ ID NO: 887001 - protein, 9 aa, Homo Sapiens
VQEESVTFQ

SEQ ID NO: 887002 - protein, 9 aa, Homo Sapiens
LQTPGPPPS

SEQ ID NO: 887003 - protein, 9 aa, Homo Sapiens
TAKEPSALG

SEQ ID NO: 887004 - protein, 9 aa, Homo Sapiens
LTGNTSPAE

SEQ ID NO: 887005 - protein, 9 aa, Homo Sapiens
FSSPEEGKF

SEQ ID NO: 887006 - protein, 9 aa, Homo Sapiens
HYYETLKFI

SEQ ID NO: 887007 - protein, 9 aa, Homo Sapiens
YTHHTDTNM

SEQ ID NO: 887008 - protein, 9 aa, Homo Sapiens
NSCPFRHCE

SEQ ID NO: 887009 - protein, 9 aa, Homo Sapiens
RVTGDHVNL

SEQ ID NO: 887010 - protein, 9 aa, Homo Sapiens
PDFLNKWSG

SEQ ID NO: 887011 - protein, 9 aa, Homo Sapiens
CLNENTDFP

SEQ ID NO: 887012 - protein, 9 aa, Homo Sapiens
TGMKEQKLE

SEQ ID NO: 887013 - protein, 9 aa, Homo Sapiens
IFQLELSRT

SEQ ID NO: 887014 - protein, 9 aa, Homo Sapiens
EAKHRWEYE

SEQ ID NO: 887015 - protein, 9 aa, Homo Sapiens
VKVIFKNSQ

SEQ ID NO: 887016 - protein, 9 aa, Homo Sapiens
RLIVGKYSI

SEQ ID NO: 887017 - protein, 9 aa, Homo Sapiens
ICKLSMKAS

SEQ ID NO: 887018 - protein, 9 aa, Homo Sapiens
DNQATKLSG

SEQ ID NO: 887019 - protein, 9 aa, Homo Sapiens
KERNLRENG

SEQ ID NO: 887020 - protein, 9 aa, Homo Sapiens
IDHTQYQFG

SEQ ID NO: 887021 - protein, 9 aa, Homo Sapiens
WHPKGGYIH

SEQ ID NO: 887022 - protein, 9 aa, Homo Sapiens
SQSRSQRSD

SEQ ID NO: 887023 - protein, 9 aa, Homo Sapiens
LTKENSRDD

SEQ ID NO: 887024 - protein, 9 aa, Homo Sapiens
FLFSFQNHI

SEQ ID NO: 887025 - protein, 9 aa, Homo Sapiens
SLPPTNKQK

SEQ ID NO: 887026 - protein, 9 aa, Homo Sapiens
KPHHPKWKN

SEQ ID NO: 887027 - protein, 9 aa, Homo Sapiens
LLEVAGLSY

SEQ ID NO: 887028 - protein, 9 aa, Homo Sapiens
ARNWKPKYV

SEQ ID NO: 887029 - protein, 9 aa, Homo Sapiens
TSQISTSLP

SEQ ID NO: 887030 - protein, 9 aa, Homo Sapiens
WSVENTGPL

SEQ ID NO: 887031 - protein, 9 aa, Homo Sapiens
LKDLFTSLS

SEQ ID NO: 887032 - protein, 9 aa, Homo Sapiens
VEIEKIWQK

SEQ ID NO: 887033 - protein, 9 aa, Homo Sapiens
IQFGSEAMK

SEQ ID NO: 887034 - protein, 9 aa, Homo Sapiens
EKNVKKKRP

SEQ ID NO: 887035 - protein, 9 aa, Homo Sapiens
NVNDNAPAF

SEQ ID NO: 887036 - protein, 9 aa, Homo Sapiens
KSNNICTIE

SEQ ID NO: 887037 - protein, 9 aa, Homo Sapiens
MNIKLTQLK

SEQ ID NO: 887038 - protein, 9 aa, Homo Sapiens
IHLRISPSL

SEQ ID NO: 887039 - protein, 9 aa, Homo Sapiens
PGHYDINKS

SEQ ID NO: 887040 - protein, 9 aa, Homo Sapiens
PGFTSPKID

SEQ ID NO: 887041 - protein, 9 aa, Homo Sapiens
ALEKDNQMR

SEQ ID NO: 887042 - protein, 9 aa, Homo Sapiens
SDYDWNKSI

SEQ ID NO: 887043 - protein, 9 aa, Homo Sapiens
VCVLNLWQK

SEQ ID NO: 887044 - protein, 9 aa, Homo Sapiens
RMHADCITQ

SEQ ID NO: 887045 - protein, 9 aa, Homo Sapiens
DIYQKAFEH

SEQ ID NO: 887046 - protein, 9 aa, Homo Sapiens
QKKVMVMIS

SEQ ID NO: 887047 - protein, 9 aa, Homo Sapiens
PFRVLACMV

SEQ ID NO: 887048 - protein, 9 aa, Homo Sapiens
LNISYEDFL

SEQ ID NO: 887049 - protein, 9 aa, Homo Sapiens
SDYAITQFS

SEQ ID NO: 887050 - protein, 9 aa, Homo Sapiens
LYVQKESEE

SEQ ID NO: 887051 - protein, 9 aa, Homo Sapiens
QFQYVLIAA

SEQ ID NO: 887052 - protein, 9 aa, Homo Sapiens
STIGYLNYH

SEQ ID NO: 887053 - protein, 9 aa, Homo Sapiens
RIVTASSTG

SEQ ID NO: 887054 - protein, 9 aa, Homo Sapiens
YNIFAITFQ

SEQ ID NO: 887055 - protein, 9 aa, Homo Sapiens
SLLHHSDRK

SEQ ID NO: 887056 - protein, 9 aa, Homo Sapiens
LVPDTGETT

SEQ ID NO: 887057 - protein, 9 aa, Homo Sapiens
YPDIAQQFK

SEQ ID NO: 887058 - protein, 9 aa, Homo Sapiens
HHQINIYEI

SEQ ID NO: 887059 - protein, 9 aa, Homo Sapiens
ASSIRIHEI

SEQ ID NO: 887060 - protein, 9 aa, Homo Sapiens
EGLCKNYVS

SEQ ID NO: 887061 - protein, 9 aa, Homo Sapiens
VQPTTVNIS

SEQ ID NO: 887062 - protein, 9 aa, Homo Sapiens
TVNKETQSP

SEQ ID NO: 887063 - protein, 9 aa, Homo Sapiens
YMWIINNFS

SEQ ID NO: 887064 - protein, 9 aa, Homo Sapiens
CKSGRCVNT

SEQ ID NO: 887065 - protein, 9 aa, Homo Sapiens
DSTVGKSKL

SEQ ID NO: 887066 - protein, 9 aa, Homo Sapiens
GPGHQNNVA

SEQ ID NO: 887067 - protein, 9 aa, Homo Sapiens
IMTNSQGDG

SEQ ID NO: 887068 - protein, 9 aa, Homo Sapiens
TKAVVSDNN

SEQ ID NO: 887069 - protein, 9 aa, Homo Sapiens
ACEKGSAKV

SEQ ID NO: 887070 - protein, 9 aa, Homo Sapiens
EYQNKVMQE

SEQ ID NO: 887071 - protein, 9 aa, Homo Sapiens
MAYFFTIFN

SEQ ID NO: 887072 - protein, 9 aa, Homo Sapiens
QMMGCFQNQ

SEQ ID NO: 887073 - protein, 9 aa, Homo Sapiens
VFLDTSERM

SEQ ID NO: 887074 - protein, 9 aa, Homo Sapiens
EWKPFNILI

SEQ ID NO: 887075 - protein, 9 aa, Homo Sapiens
QTTELKVTA

SEQ ID NO: 887076 - protein, 9 aa, Homo Sapiens
TSQNFPSSD

SEQ ID NO: 887077 - protein, 9 aa, Homo Sapiens
LLIKVGSFK

SEQ ID NO: 887078 - protein, 9 aa, Homo Sapiens
ACDSLLHHS

SEQ ID NO: 887079 - protein, 9 aa, Homo Sapiens
ELDNQIATA

SEQ ID NO: 887080 - protein, 9 aa, Homo Sapiens
TVAMQNLNE

SEQ ID NO: 887081 - protein, 9 aa, Homo Sapiens
EINENCTLQ

SEQ ID NO: 887082 - protein, 9 aa, Homo Sapiens
CGKEKVLFI

SEQ ID NO: 887083 - protein, 9 aa, Homo Sapiens
PRHEICLSD

SEQ ID NO: 887084 - protein, 9 aa, Homo Sapiens
IRLYLLQGI

SEQ ID NO: 887085 - protein, 9 aa, Homo Sapiens
MNEFLRLAM

SEQ ID NO: 887086 - protein, 9 aa, Homo Sapiens
QTDKTHSEK

SEQ ID NO: 887087 - protein, 9 aa, Homo Sapiens
KEICNELEK

SEQ ID NO: 887088 - protein, 9 aa, Homo Sapiens
CFQNQKFRK

SEQ ID NO: 887089 - protein, 9 aa, Homo Sapiens
ELSLICAKK

SEQ ID NO: 887090 - protein, 9 aa, Homo Sapiens
KDSGSKDKM

SEQ ID NO: 887091 - protein, 9 aa, Homo Sapiens
HRRGLGLCA

SEQ ID NO: 887092 - protein, 9 aa, Homo Sapiens
IINCIQVHD

SEQ ID NO: 887093 - protein, 9 aa, Homo Sapiens
EEQDIKIMM

SEQ ID NO: 887094 - protein, 9 aa, Homo Sapiens
SSPERPINN

SEQ ID NO: 887095 - protein, 9 aa, Homo Sapiens
NAATVCKGS

SEQ ID NO: 887096 - protein, 9 aa, Homo Sapiens
QCVKTIVKA

SEQ ID NO: 887097 - protein, 9 aa, Homo Sapiens
EAEIKSQHQ

SEQ ID NO: 887098 - protein, 9 aa, Homo Sapiens
SATHRIHKI

SEQ ID NO: 887099 - protein, 9 aa, Homo Sapiens
FQARSKKLI

SEQ ID NO: 887100 - protein, 9 aa, Homo Sapiens
STLSVAVVV

SEQ ID NO: 887101 - protein, 9 aa, Homo Sapiens
FKNSQGEEV

SEQ ID NO: 887102 - protein, 9 aa, Homo Sapiens
NALESILPT

SEQ ID NO: 887103 - protein, 9 aa, Homo Sapiens
KYEGKLVRQ

SEQ ID NO: 887104 - protein, 9 aa, Homo Sapiens
QVNRIDWPV

SEQ ID NO: 887105 - protein, 9 aa, Homo Sapiens
LLLTNGQWN

SEQ ID NO: 887106 - protein, 9 aa, Homo Sapiens
NAKVCLLRE

SEQ ID NO: 887107 - protein, 9 aa, Homo Sapiens
PTKAPDAMK

SEQ ID NO: 887108 - protein, 9 aa, Homo Sapiens
DAWTIITPF

SEQ ID NO: 887109 - protein, 9 aa, Homo Sapiens
KNEGKENLK

SEQ ID NO: 887110 - protein, 9 aa, Homo Sapiens
LPDGKQAVC

SEQ ID NO: 887111 - protein, 9 aa, Homo Sapiens
SSGCDYSKL

SEQ ID NO: 887112 - protein, 9 aa, Homo Sapiens
NTHNQEKKS

SEQ ID NO: 887113 - protein, 9 aa, Homo Sapiens
LAKRSRSQT

SEQ ID NO: 887114 - protein, 9 aa, Homo Sapiens
GRHYDHNHQ

SEQ ID NO: 887115 - protein, 9 aa, Homo Sapiens
GLLLFYFIP

SEQ ID NO: 887116 - protein, 9 aa, Homo Sapiens
TYPARCWCK

SEQ ID NO: 887117 - protein, 9 aa, Homo Sapiens
TVCDDGWNI

SEQ ID NO: 887118 - protein, 9 aa, Homo Sapiens
WVSTLPFCG

SEQ ID NO: 887119 - protein, 9 aa, Homo Sapiens
TATDLSAHS

SEQ ID NO: 887120 - protein, 9 aa, Homo Sapiens
NGYRWCATT

SEQ ID NO: 887121 - protein, 9 aa, Homo Sapiens
GKQIHVSKR

SEQ ID NO: 887122 - protein, 9 aa, Homo Sapiens
SSVLSLLRS

SEQ ID NO: 887123 - protein, 9 aa, Homo Sapiens
GGQMVDNVE

SEQ ID NO: 887124 - protein, 9 aa, Homo Sapiens
YFFELRLKY

SEQ ID NO: 887125 - protein, 9 aa, Homo Sapiens
IVTASSTGC

SEQ ID NO: 887126 - protein, 9 aa, Homo Sapiens
KLASVLESG

SEQ ID NO: 887127 - protein, 9 aa, Homo Sapiens
KNHKSKLEY

SEQ ID NO: 887128 - protein, 9 aa, Homo Sapiens
EKKDSQGLG

SEQ ID NO: 887129 - protein, 9 aa, Homo Sapiens
DVLEIFNVI

SEQ ID NO: 887130 - protein, 9 aa, Homo Sapiens
WTSCEPKDL

SEQ ID NO: 887131 - protein, 9 aa, Homo Sapiens
GKPDEEEGT

SEQ ID NO: 887132 - protein, 9 aa, Homo Sapiens
NRGRCVDGW

SEQ ID NO: 887133 - protein, 9 aa, Homo Sapiens
EREYGGIIQ

SEQ ID NO: 887134 - protein, 9 aa, Homo Sapiens
PWSLHTPSL

SEQ ID NO: 887135 - protein, 9 aa, Homo Sapiens
CQLPSICLS

SEQ ID NO: 887136 - protein, 9 aa, Homo Sapiens
IMWCRGHGP

SEQ ID NO: 887137 - protein, 9 aa, Homo Sapiens
KDWEQFLEL

SEQ ID NO: 887138 - protein, 9 aa, Homo Sapiens
ELVCCPLAE

SEQ ID NO: 887139 - protein, 9 aa, Homo Sapiens
VCKFCGKGF

SEQ ID NO: 887140 - protein, 9 aa, Homo Sapiens
QVVISTNGE

SEQ ID NO: 887141 - protein, 9 aa, Homo Sapiens
SGRDDSENT

SEQ ID NO: 887142 - protein, 9 aa, Homo Sapiens
DCLRWLKRD

SEQ ID NO: 887143 - protein, 9 aa, Homo Sapiens
NNPKRNDLR

SEQ ID NO: 887144 - protein, 9 aa, Homo Sapiens
SSGVWATLR

SEQ ID NO: 887145 - protein, 9 aa, Homo Sapiens
RMCCQQEFF

SEQ ID NO: 887146 - protein, 9 aa, Homo Sapiens
LLGLQDVVV

SEQ ID NO: 887147 - protein, 9 aa, Homo Sapiens
WSNIKSIIA

SEQ ID NO: 887148 - protein, 9 aa, Homo Sapiens
YPNWPMVLG

SEQ ID NO: 887149 - protein, 9 aa, Homo Sapiens
ELTPKQAIF

SEQ ID NO: 887150 - protein, 9 aa, Homo Sapiens
PPKKTQIIS

SEQ ID NO: 887151 - protein, 9 aa, Homo Sapiens
YCPQQTIVF

SEQ ID NO: 887152 - protein, 9 aa, Homo Sapiens
SPCDTNWIY

SEQ ID NO: 887153 - protein, 9 aa, Homo Sapiens
KLNAQTGLI

SEQ ID NO: 887154 - protein, 9 aa, Homo Sapiens
KCPLPSQVN

SEQ ID NO: 887155 - protein, 9 aa, Homo Sapiens
NSASDSLYA

SEQ ID NO: 887156 - protein, 9 aa, Homo Sapiens
LFIRLYLLQ

SEQ ID NO: 887157 - protein, 9 aa, Homo Sapiens
KKEDSGIPN

SEQ ID NO: 887158 - protein, 9 aa, Homo Sapiens
EPDQTSLLG

SEQ ID NO: 887159 - protein, 9 aa, Homo Sapiens
EGVKQCGLG

SEQ ID NO: 887160 - protein, 9 aa, Homo Sapiens
PMQFNSFDR

SEQ ID NO: 887161 - protein, 9 aa, Homo Sapiens
FVQVENVKG

SEQ ID NO: 887162 - protein, 9 aa, Homo Sapiens
QDKYCYRYP

SEQ ID NO: 887163 - protein, 9 aa, Homo Sapiens
RNQLIRVII

SEQ ID NO: 887164 - protein, 9 aa, Homo Sapiens
VDRKEKSTK

SEQ ID NO: 887165 - protein, 9 aa, Homo Sapiens
AAANQNSNT

SEQ ID NO: 887166 - protein, 9 aa, Homo Sapiens
HSLRQQNIA

SEQ ID NO: 887167 - protein, 9 aa, Homo Sapiens
IFYFHPISD

SEQ ID NO: 887168 - protein, 9 aa, Homo Sapiens
EREPDPFKF

SEQ ID NO: 887169 - protein, 9 aa, Homo Sapiens
STLRKKVNN

SEQ ID NO: 887170 - protein, 9 aa, Homo Sapiens
AVGDIADVQ

SEQ ID NO: 887171 - protein, 9 aa, Homo Sapiens
SQTFSPGAQ

SEQ ID NO: 887172 - protein, 9 aa, Homo Sapiens
EYCRNLPMI

SEQ ID NO: 887173 - protein, 9 aa, Homo Sapiens
DSDDVPQKR

SEQ ID NO: 887174 - protein, 9 aa, Homo Sapiens
DQEGGEENK

SEQ ID NO: 887175 - protein, 9 aa, Homo Sapiens
IKSQHQLEN

SEQ ID NO: 887176 - protein, 9 aa, Homo Sapiens
CIPDEVIAK

SEQ ID NO: 887177 - protein, 9 aa, Homo Sapiens
QSCLPHEVV

SEQ ID NO: 887178 - protein, 9 aa, Homo Sapiens
ATALCSLPQ

SEQ ID NO: 887179 - protein, 9 aa, Homo Sapiens
KMAKFISKN

SEQ ID NO: 887180 - protein, 9 aa, Homo Sapiens
QQRNSKAER

SEQ ID NO: 887181 - protein, 9 aa, Homo Sapiens
NKAYLDIFL

SEQ ID NO: 887182 - protein, 9 aa, Homo Sapiens
VRQLEQDNA

SEQ ID NO: 887183 - protein, 9 aa, Homo Sapiens
GKKRLCLPQ

SEQ ID NO: 887184 - protein, 9 aa, Homo Sapiens
PAIEEKLLD

SEQ ID NO: 887185 - protein, 9 aa, Homo Sapiens
SLNYSNAES

SEQ ID NO: 887186 - protein, 9 aa, Homo Sapiens
KEQKELFAE

SEQ ID NO: 887187 - protein, 9 aa, Homo Sapiens
RFGVQVLQD

SEQ ID NO: 887188 - protein, 9 aa, Homo Sapiens
EEARREYPF

SEQ ID NO: 887189 - protein, 9 aa, Homo Sapiens
NHDCSQGLR

SEQ ID NO: 887190 - protein, 9 aa, Homo Sapiens
KQHGSSRKS

SEQ ID NO: 887191 - protein, 9 aa, Homo Sapiens
ARRPPKGKH

SEQ ID NO: 887192 - protein, 9 aa, Homo Sapiens
NLTKLMSDG

SEQ ID NO: 887193 - protein, 9 aa, Homo Sapiens
ECVQKFIKI

SEQ ID NO: 887194 - protein, 9 aa, Homo Sapiens
FGAHNRFRL

SEQ ID NO: 887195 - protein, 9 aa, Homo Sapiens
NKWIHCFEG

SEQ ID NO: 887196 - protein, 9 aa, Homo Sapiens
QLTFDGKQM

SEQ ID NO: 887197 - protein, 9 aa, Homo Sapiens
QWDSALHIA

SEQ ID NO: 887198 - protein, 9 aa, Homo Sapiens
WQAGLRTGG

SEQ ID NO: 887199 - protein, 9 aa, Homo Sapiens
APGPRTEPP

SEQ ID NO: 887200 - protein, 9 aa, Homo Sapiens
DPDPLIPCN

SEQ ID NO: 887201 - protein, 9 aa, Homo Sapiens
WDNIWNCEA

SEQ ID NO: 887202 - protein, 9 aa, Homo Sapiens
KSSPGLGRG

SEQ ID NO: 887203 - protein, 9 aa, Homo Sapiens
IRALKDELQ

SEQ ID NO: 887204 - protein, 9 aa, Homo Sapiens
LGITGSERY

SEQ ID NO: 887205 - protein, 9 aa, Homo Sapiens
GVLAFLAPS

SEQ ID NO: 887206 - protein, 9 aa, Homo Sapiens
ELNRVQLSR

SEQ ID NO: 887207 - protein, 9 aa, Homo Sapiens
LLFLSHIQN

SEQ ID NO: 887208 - protein, 9 aa, Homo Sapiens
KLMFKIIGP

SEQ ID NO: 887209 - protein, 9 aa, Homo Sapiens
LTRNDHGLF

SEQ ID NO: 887210 - protein, 9 aa, Homo Sapiens
QVFCQMQKL

SEQ ID NO: 887211 - protein, 9 aa, Homo Sapiens
NRKTCFIIH

SEQ ID NO: 887212 - protein, 9 aa, Homo Sapiens
LISGFPRRA

SEQ ID NO: 887213 - protein, 9 aa, Homo Sapiens
EHSETRGGE

SEQ ID NO: 887214 - protein, 9 aa, Homo Sapiens
IIVFLELTA

SEQ ID NO: 887215 - protein, 9 aa, Homo Sapiens
PNDPSLGDK

SEQ ID NO: 887216 - protein, 9 aa, Homo Sapiens
HFSCGNGFK

SEQ ID NO: 887217 - protein, 9 aa, Homo Sapiens
KSFFMLLHL

SEQ ID NO: 887218 - protein, 9 aa, Homo Sapiens
AETTLLSTS

SEQ ID NO: 887219 - protein, 9 aa, Homo Sapiens
ARREGFDKN

SEQ ID NO: 887220 - protein, 9 aa, Homo Sapiens
AVRIKTSIL

SEQ ID NO: 887221 - protein, 9 aa, Homo Sapiens
DAANNYARD

SEQ ID NO: 887222 - protein, 9 aa, Homo Sapiens
YLEEAEKRE

SEQ ID NO: 887223 - protein, 9 aa, Homo Sapiens
IRIWFIRKN

SEQ ID NO: 887224 - protein, 9 aa, Homo Sapiens
VFLGIIVFL

SEQ ID NO: 887225 - protein, 9 aa, Homo Sapiens
EEATAAAAM

SEQ ID NO: 887226 - protein, 9 aa, Homo Sapiens
NCLENIAES

SEQ ID NO: 887227 - protein, 9 aa, Homo Sapiens
TDCLCFAIL

SEQ ID NO: 887228 - protein, 9 aa, Homo Sapiens
GPAQKKPPS

SEQ ID NO: 887229 - protein, 9 aa, Homo Sapiens
NNQVYQKVK

SEQ ID NO: 887230 - protein, 9 aa, Homo Sapiens
IMNLEQFPL

SEQ ID NO: 887231 - protein, 9 aa, Homo Sapiens
PKYTVFVKE

SEQ ID NO: 887232 - protein, 9 aa, Homo Sapiens
KQDGGLENL

SEQ ID NO: 887233 - protein, 9 aa, Homo Sapiens
DSKKSMIGK

SEQ ID NO: 887234 - protein, 9 aa, Homo Sapiens
PLLIKDMAF

SEQ ID NO: 887235 - protein, 9 aa, Homo Sapiens
NEDNTQSVG

SEQ ID NO: 887236 - protein, 9 aa, Homo Sapiens
IRPTSDCSP

SEQ ID NO: 887237 - protein, 9 aa, Homo Sapiens
RKSQQLSDN

SEQ ID NO: 887238 - protein, 9 aa, Homo Sapiens
RPSHLFQHQ

SEQ ID NO: 887239 - protein, 9 aa, Homo Sapiens
TLKNFLHWR

SEQ ID NO: 887240 - protein, 9 aa, Homo Sapiens
NRQIKKWNK

SEQ ID NO: 887241 - protein, 9 aa, Homo Sapiens
FSHRQLYDD

SEQ ID NO: 887242 - protein, 9 aa, Homo Sapiens
SLEKFTCSV

SEQ ID NO: 887243 - protein, 9 aa, Homo Sapiens
HIVWGSGIF

SEQ ID NO: 887244 - protein, 9 aa, Homo Sapiens
PADKRIPQI

SEQ ID NO: 887245 - protein, 9 aa, Homo Sapiens
FIAEHKLLG

SEQ ID NO: 887246 - protein, 9 aa, Homo Sapiens
EAKQKLQQL

SEQ ID NO: 887247 - protein, 9 aa, Homo Sapiens
DHQLQNMGK

SEQ ID NO: 887248 - protein, 9 aa, Homo Sapiens
YGYTSFYTF

SEQ ID NO: 887249 - protein, 9 aa, Homo Sapiens
RCRQAGSSG

SEQ ID NO: 887250 - protein, 9 aa, Homo Sapiens
PTTVNISAN

SEQ ID NO: 887251 - protein, 9 aa, Homo Sapiens
WERKYYILT

SEQ ID NO: 887252 - protein, 9 aa, Homo Sapiens
PSWRKCMLL

SEQ ID NO: 887253 - protein, 9 aa, Homo Sapiens
VYLDGGVQT

SEQ ID NO: 887254 - protein, 9 aa, Homo Sapiens
FKHTDDFEE

SEQ ID NO: 887255 - protein, 9 aa, Homo Sapiens
LTLGLIDLC

SEQ ID NO: 887256 - protein, 9 aa, Homo Sapiens
QEESVTFQI

SEQ ID NO: 887257 - protein, 9 aa, Homo Sapiens
LAGFAQTEV

SEQ ID NO: 887258 - protein, 9 aa, Homo Sapiens
GRLVDHINQ

SEQ ID NO: 887259 - protein, 9 aa, Homo Sapiens
VLRQRFWGL

SEQ ID NO: 887260 - protein, 9 aa, Homo Sapiens
NILQRCLME

SEQ ID NO: 887261 - protein, 9 aa, Homo Sapiens
PFLSTPMGK

SEQ ID NO: 887262 - protein, 9 aa, Homo Sapiens
HFMCDLVPI

SEQ ID NO: 887263 - protein, 9 aa, Homo Sapiens
HNEVPPPVF

SEQ ID NO: 887264 - protein, 9 aa, Homo Sapiens
FSYFLATNM

SEQ ID NO: 887265 - protein, 9 aa, Homo Sapiens
TSQHNSEKL

SEQ ID NO: 887266 - protein, 9 aa, Homo Sapiens
NPLLETFGN

SEQ ID NO: 887267 - protein, 9 aa, Homo Sapiens
PRRLCTLPN

SEQ ID NO: 887268 - protein, 9 aa, Homo Sapiens
YEKAENEDL

SEQ ID NO: 887269 - protein, 9 aa, Homo Sapiens
DYGRITLFR

SEQ ID NO: 887270 - protein, 9 aa, Homo Sapiens
KFKHEEIIL

SEQ ID NO: 887271 - protein, 9 aa, Homo Sapiens
TTVATEELL

SEQ ID NO: 887272 - protein, 9 aa, Homo Sapiens
DLTSPSMGI

SEQ ID NO: 887273 - protein, 9 aa, Homo Sapiens
KINVPKPKR

SEQ ID NO: 887274 - protein, 9 aa, Homo Sapiens
DCFLYANRT

SEQ ID NO: 887275 - protein, 9 aa, Homo Sapiens
GLFLLQGAW

SEQ ID NO: 887276 - protein, 9 aa, Homo Sapiens
LASLGKTNK

SEQ ID NO: 887277 - protein, 9 aa, Homo Sapiens
STLDKAFEE

SEQ ID NO: 887278 - protein, 9 aa, Homo Sapiens
SAPQSQSLA

SEQ ID NO: 887279 - protein, 9 aa, Homo Sapiens
QDPKHHLEE

SEQ ID NO: 887280 - protein, 9 aa, Homo Sapiens
PGKVRRRSS

SEQ ID NO: 887281 - protein, 9 aa, Homo Sapiens
GFLLEDQVA

SEQ ID NO: 887282 - protein, 9 aa, Homo Sapiens
MVNNNVRKK

SEQ ID NO: 887283 - protein, 9 aa, Homo Sapiens
GVNTKIGKI

SEQ ID NO: 887284 - protein, 9 aa, Homo Sapiens
WFQFFCSMS

SEQ ID NO: 887285 - protein, 9 aa, Homo Sapiens
NHDGNYLFL

SEQ ID NO: 887286 - protein, 9 aa, Homo Sapiens
LDVCIPSQL

SEQ ID NO: 887287 - protein, 9 aa, Homo Sapiens
MEDTFQFCA

SEQ ID NO: 887288 - protein, 9 aa, Homo Sapiens
TAVENSDNP

SEQ ID NO: 887289 - protein, 9 aa, Homo Sapiens
KSNFTIDLK

SEQ ID NO: 887290 - protein, 9 aa, Homo Sapiens
NAMTNEDNP

SEQ ID NO: 887291 - protein, 9 aa, Homo Sapiens
SLIGVCIAH

SEQ ID NO: 887292 - protein, 9 aa, Homo Sapiens
PETSPASST

SEQ ID NO: 887293 - protein, 9 aa, Homo Sapiens
GSKYLVDHK

SEQ ID NO: 887294 - protein, 9 aa, Homo Sapiens
EKKDDFNWG

SEQ ID NO: 887295 - protein, 9 aa, Homo Sapiens
IQNSIVNKN

SEQ ID NO: 887296 - protein, 9 aa, Homo Sapiens
LMVETQMKK

SEQ ID NO: 887297 - protein, 9 aa, Homo Sapiens
LREFFSVLL

SEQ ID NO: 887298 - protein, 9 aa, Homo Sapiens
TDPQNLLLS

SEQ ID NO: 887299 - protein, 9 aa, Homo Sapiens
PAPGKNKAQ

SEQ ID NO: 887300 - protein, 9 aa, Homo Sapiens
LDQPLHTLY

SEQ ID NO: 887301 - protein, 9 aa, Homo Sapiens
VPVKAFPVF

SEQ ID NO: 887302 - protein, 9 aa, Homo Sapiens
SVRLHHKLK

SEQ ID NO: 887303 - protein, 9 aa, Homo Sapiens
AHRGFFFSH

SEQ ID NO: 887304 - protein, 9 aa, Homo Sapiens
TIVFRGPNG

SEQ ID NO: 887305 - protein, 9 aa, Homo Sapiens
GHYLKDMML

SEQ ID NO: 887306 - protein, 9 aa, Homo Sapiens
KGFFRQSIQ

SEQ ID NO: 887307 - protein, 9 aa, Homo Sapiens
GKQMHVQLS

SEQ ID NO: 887308 - protein, 9 aa, Homo Sapiens
DQKEFAKFE

SEQ ID NO: 887309 - protein, 9 aa, Homo Sapiens
FMSVNPSKE

SEQ ID NO: 887310 - protein, 9 aa, Homo Sapiens
SLSDKTVLL

SEQ ID NO: 887311 - protein, 9 aa, Homo Sapiens
GVKQIALLG

SEQ ID NO: 887312 - protein, 9 aa, Homo Sapiens
QLAGDSNIF

SEQ ID NO: 887313 - protein, 9 aa, Homo Sapiens
NLCDDLAPV

SEQ ID NO: 887314 - protein, 9 aa, Homo Sapiens
NDFEQGKLY

SEQ ID NO: 887315 - protein, 9 aa, Homo Sapiens
YRLCDNVWT

SEQ ID NO: 887316 - protein, 9 aa, Homo Sapiens
DYGHYKELP

SEQ ID NO: 887317 - protein, 9 aa, Homo Sapiens
VNNNAPAFA

SEQ ID NO: 887318 - protein, 9 aa, Homo Sapiens
GKKPYKCDK

SEQ ID NO: 887319 - protein, 9 aa, Homo Sapiens
HQKFAITLF

SEQ ID NO: 887320 - protein, 9 aa, Homo Sapiens
VLRMDAKIN

SEQ ID NO: 887321 - protein, 9 aa, Homo Sapiens
TGNTSPAED

SEQ ID NO: 887322 - protein, 9 aa, Homo Sapiens
EEIMQESPD

SEQ ID NO: 887323 - protein, 9 aa, Homo Sapiens
TISYIDAED

SEQ ID NO: 887324 - protein, 9 aa, Homo Sapiens
VWYRQDLGH

SEQ ID NO: 887325 - protein, 9 aa, Homo Sapiens
QEIIGVAKQ

SEQ ID NO: 887326 - protein, 9 aa, Homo Sapiens
VTIRTVRAR

SEQ ID NO: 887327 - protein, 9 aa, Homo Sapiens
PGWKWEDDA

SEQ ID NO: 887328 - protein, 9 aa, Homo Sapiens
EFQDQTRIW

SEQ ID NO: 887329 - protein, 9 aa, Homo Sapiens
NSTLPNDSD

SEQ ID NO: 887330 - protein, 9 aa, Homo Sapiens
SGIKWDYIA

SEQ ID NO: 887331 - protein, 9 aa, Homo Sapiens
PAQPEGQKA

SEQ ID NO: 887332 - protein, 9 aa, Homo Sapiens
IDTPPQSET

SEQ ID NO: 887333 - protein, 9 aa, Homo Sapiens
TTALMSSMA

SEQ ID NO: 887334 - protein, 9 aa, Homo Sapiens
ASTERVFRA

SEQ ID NO: 887335 - protein, 9 aa, Homo Sapiens
DNYDTPPIL

SEQ ID NO: 887336 - protein, 9 aa, Homo Sapiens
QNESHLIDF

SEQ ID NO: 887337 - protein, 9 aa, Homo Sapiens
TETIFTPSY

SEQ ID NO: 887338 - protein, 9 aa, Homo Sapiens
KIKELSWNQ

SEQ ID NO: 887339 - protein, 9 aa, Homo Sapiens
SWFTALVKC

SEQ ID NO: 887340 - protein, 9 aa, Homo Sapiens
SHKRSHTRE

SEQ ID NO: 887341 - protein, 9 aa, Homo Sapiens
DHHYGARPP

SEQ ID NO: 887342 - protein, 9 aa, Homo Sapiens
KTTKKPPSG

SEQ ID NO: 887343 - protein, 9 aa, Homo Sapiens
PKTTIYVAH

SEQ ID NO: 887344 - protein, 9 aa, Homo Sapiens
VDSDGDGKI

SEQ ID NO: 887345 - protein, 9 aa, Homo Sapiens
IGRMFASLS

SEQ ID NO: 887346 - protein, 9 aa, Homo Sapiens
SDFDCKELM

SEQ ID NO: 887347 - protein, 9 aa, Homo Sapiens
NHQNNHIRR

SEQ ID NO: 887348 - protein, 9 aa, Homo Sapiens
QNLVDKISE

SEQ ID NO: 887349 - protein, 9 aa, Homo Sapiens
NLQDCYQLY

SEQ ID NO: 887350 - protein, 9 aa, Homo Sapiens
EVELYNKFP

SEQ ID NO: 887351 - protein, 9 aa, Homo Sapiens
HSNNLLRVA

SEQ ID NO: 887352 - protein, 9 aa, Homo Sapiens
HTEYQIITD

SEQ ID NO: 887353 - protein, 9 aa, Homo Sapiens
CGGTVTAFL

SEQ ID NO: 887354 - protein, 9 aa, Homo Sapiens
KLCEIKESH

SEQ ID NO: 887355 - protein, 9 aa, Homo Sapiens
VVDKKNLTA

SEQ ID NO: 887356 - protein, 9 aa, Homo Sapiens
STLANLTLG

SEQ ID NO: 887357 - protein, 9 aa, Homo Sapiens
SVNFSLSLL

SEQ ID NO: 887358 - protein, 9 aa, Homo Sapiens
KNFNDYMKS

SEQ ID NO: 887359 - protein, 9 aa, Homo Sapiens
PQTCILLRG

SEQ ID NO: 887360 - protein, 9 aa, Homo Sapiens
EASDKLSKS

SEQ ID NO: 887361 - protein, 9 aa, Homo Sapiens
PEPLLAAHQ

SEQ ID NO: 887362 - protein, 9 aa, Homo Sapiens
GCVPDVLPQ

SEQ ID NO: 887363 - protein, 9 aa, Homo Sapiens
GDIADVQKH

SEQ ID NO: 887364 - protein, 9 aa, Homo Sapiens
FNPSGPSVP

SEQ ID NO: 887365 - protein, 9 aa, Homo Sapiens
GHNLFTKDV

SEQ ID NO: 887366 - protein, 9 aa, Homo Sapiens
YNMVLAYVL

SEQ ID NO: 887367 - protein, 9 aa, Homo Sapiens
HNQEKKSQE

SEQ ID NO: 887368 - protein, 9 aa, Homo Sapiens
TTSNIRKEF

SEQ ID NO: 887369 - protein, 9 aa, Homo Sapiens
RDRRYVDKY

SEQ ID NO: 887370 - protein, 9 aa, Homo Sapiens
NLAITLHKA

SEQ ID NO: 887371 - protein, 9 aa, Homo Sapiens
PPCPSIPLF

SEQ ID NO: 887372 - protein, 9 aa, Homo Sapiens
WLSENSKEE

SEQ ID NO: 887373 - protein, 9 aa, Homo Sapiens
SRKSMLDAE

SEQ ID NO: 887374 - protein, 9 aa, Homo Sapiens
LQWKSVCLD

SEQ ID NO: 887375 - protein, 9 aa, Homo Sapiens
QNSIVNKNT

SEQ ID NO: 887376 - protein, 9 aa, Homo Sapiens
AETSVERVR

SEQ ID NO: 887377 - protein, 9 aa, Homo Sapiens
GERPSYIMS

SEQ ID NO: 887378 - protein, 9 aa, Homo Sapiens
CALHHLTSR

SEQ ID NO: 887379 - protein, 9 aa, Homo Sapiens
KISFVSAAE

SEQ ID NO: 887380 - protein, 9 aa, Homo Sapiens
FRHRDKEYP

SEQ ID NO: 887381 - protein, 9 aa, Homo Sapiens
CILGENGIA

SEQ ID NO: 887382 - protein, 9 aa, Homo Sapiens
GLYDADSEF

SEQ ID NO: 887383 - protein, 9 aa, Homo Sapiens
LASRSQPKV

SEQ ID NO: 887384 - protein, 9 aa, Homo Sapiens
TLSHSTLKQ

SEQ ID NO: 887385 - protein, 9 aa, Homo Sapiens
ILSSQLRYC

SEQ ID NO: 887386 - protein, 9 aa, Homo Sapiens
SLNKLVLRK

SEQ ID NO: 887387 - protein, 9 aa, Homo Sapiens
LGSSAANTL

SEQ ID NO: 887388 - protein, 9 aa, Homo Sapiens
YLKPENLIL

SEQ ID NO: 887389 - protein, 9 aa, Homo Sapiens
SQRVESMKA

SEQ ID NO: 887390 - protein, 9 aa, Homo Sapiens
TITGEIRLR

SEQ ID NO: 887391 - protein, 9 aa, Homo Sapiens
VDSLESPHM

SEQ ID NO: 887392 - protein, 9 aa, Homo Sapiens
LLLVTLVFL

SEQ ID NO: 887393 - protein, 9 aa, Homo Sapiens
LAGYLILSA

SEQ ID NO: 887394 - protein, 9 aa, Homo Sapiens
LVDEIVMTL

SEQ ID NO: 887395 - protein, 9 aa, Homo Sapiens
KGVPNPINL

SEQ ID NO: 887396 - protein, 9 aa, Homo Sapiens
SINKARINA

SEQ ID NO: 887397 - protein, 9 aa, Homo Sapiens
NYLDGFAQN

SEQ ID NO: 887398 - protein, 9 aa, Homo Sapiens
FETVNQNST

SEQ ID NO: 887399 - protein, 9 aa, Homo Sapiens
EIPVARFGA

SEQ ID NO: 887400 - protein, 9 aa, Homo Sapiens
IPIWLYWQI

SEQ ID NO: 887401 - protein, 9 aa, Homo Sapiens
DKKKARFEW

SEQ ID NO: 887402 - protein, 9 aa, Homo Sapiens
IARMFPSIT

SEQ ID NO: 887403 - protein, 9 aa, Homo Sapiens
LQICTSQLK

SEQ ID NO: 887404 - protein, 9 aa, Homo Sapiens
AAGEDQKPD

SEQ ID NO: 887405 - protein, 9 aa, Homo Sapiens
LWTSYSELV

SEQ ID NO: 887406 - protein, 9 aa, Homo Sapiens
HQYKVQAYI

SEQ ID NO: 887407 - protein, 9 aa, Homo Sapiens
KYVKTAVHM

SEQ ID NO: 887408 - protein, 9 aa, Homo Sapiens
GKVCIYRGK

SEQ ID NO: 887409 - protein, 9 aa, Homo Sapiens
VSGRLPPCA

SEQ ID NO: 887410 - protein, 9 aa, Homo Sapiens
THRIHEITH

SEQ ID NO: 887411 - protein, 9 aa, Homo Sapiens
KPFKAKCKL

SEQ ID NO: 887412 - protein, 9 aa, Homo Sapiens
KYELKIRYL

SEQ ID NO: 887413 - protein, 9 aa, Homo Sapiens
ASLNTRTVY

SEQ ID NO: 887414 - protein, 9 aa, Homo Sapiens
RSGACHATH

SEQ ID NO: 887415 - protein, 9 aa, Homo Sapiens
TGVNTKIGK

SEQ ID NO: 887416 - protein, 9 aa, Homo Sapiens
QDDSSDNGF

SEQ ID NO: 887417 - protein, 9 aa, Homo Sapiens
SMAKPHMVK

SEQ ID NO: 887418 - protein, 9 aa, Homo Sapiens
HRGIQMYKS

SEQ ID NO: 887419 - protein, 9 aa, Homo Sapiens
TQSYYRNSV

SEQ ID NO: 887420 - protein, 9 aa, Homo Sapiens
TLVILIQTD

SEQ ID NO: 887421 - protein, 9 aa, Homo Sapiens
AKRTFRLLD

SEQ ID NO: 887422 - protein, 9 aa, Homo Sapiens
FVTIGLDKI

SEQ ID NO: 887423 - protein, 9 aa, Homo Sapiens
LLDGCWIYL

SEQ ID NO: 887424 - protein, 9 aa, Homo Sapiens
GRRVWGRLY

SEQ ID NO: 887425 - protein, 9 aa, Homo Sapiens
IGVAKQLFP

SEQ ID NO: 887426 - protein, 9 aa, Homo Sapiens
DIKSYYTVQ

SEQ ID NO: 887427 - protein, 9 aa, Homo Sapiens
VGKTPIKTL

SEQ ID NO: 887428 - protein, 9 aa, Homo Sapiens
VSKNKIMNG

SEQ ID NO: 887429 - protein, 9 aa, Homo Sapiens
YGGIIQISL

SEQ ID NO: 887430 - protein, 9 aa, Homo Sapiens
SVIKSVFLS

SEQ ID NO: 887431 - protein, 9 aa, Homo Sapiens
LQEAVTKTL

SEQ ID NO: 887432 - protein, 9 aa, Homo Sapiens
SASHLQTHG

SEQ ID NO: 887433 - protein, 9 aa, Homo Sapiens
HTGKAASTP

SEQ ID NO: 887434 - protein, 9 aa, Homo Sapiens
PVVQVFIVV

SEQ ID NO: 887435 - protein, 9 aa, Homo Sapiens
PPTESQDNT

SEQ ID NO: 887436 - protein, 9 aa, Homo Sapiens
NPRWDISRT

SEQ ID NO: 887437 - protein, 9 aa, Homo Sapiens
LFTSFYLLD

SEQ ID NO: 887438 - protein, 9 aa, Homo Sapiens
FHQDSAWKN

SEQ ID NO: 887439 - protein, 9 aa, Homo Sapiens
HFGAIFSIF

SEQ ID NO: 887440 - protein, 9 aa, Homo Sapiens
FVCKFCGKG

SEQ ID NO: 887441 - protein, 9 aa, Homo Sapiens
CFFFPSLRE

SEQ ID NO: 887442 - protein, 9 aa, Homo Sapiens
LVASKVFRS

SEQ ID NO: 887443 - protein, 9 aa, Homo Sapiens
QLIVHQIIH

SEQ ID NO: 887444 - protein, 9 aa, Homo Sapiens
IFLLRNVMQ

SEQ ID NO: 887445 - protein, 9 aa, Homo Sapiens
VTQLSILSK

SEQ ID NO: 887446 - protein, 9 aa, Homo Sapiens
MINNQNKSV

SEQ ID NO: 887447 - protein, 9 aa, Homo Sapiens
QNHYLNVTP

SEQ ID NO: 887448 - protein, 9 aa, Homo Sapiens
SDNSGRDDS

SEQ ID NO: 887449 - protein, 9 aa, Homo Sapiens
ASSDLPALA

SEQ ID NO: 887450 - protein, 9 aa, Homo Sapiens
SGTFHISPE

SEQ ID NO: 887451 - protein, 9 aa, Homo Sapiens
QISPDQGQQ

SEQ ID NO: 887452 - protein, 9 aa, Homo Sapiens
LSLEEWQCL

SEQ ID NO: 887453 - protein, 9 aa, Homo Sapiens
TNVASTISM

SEQ ID NO: 887454 - protein, 9 aa, Homo Sapiens
SFTKHQCIH

SEQ ID NO: 887455 - protein, 9 aa, Homo Sapiens
DQMESTDTK

SEQ ID NO: 887456 - protein, 9 aa, Homo Sapiens
TSFYLLDFI

SEQ ID NO: 887457 - protein, 9 aa, Homo Sapiens
QLSLEEWQC

SEQ ID NO: 887458 - protein, 9 aa, Homo Sapiens
WHFDKVRNQ

SEQ ID NO: 887459 - protein, 9 aa, Homo Sapiens
NVFIVIAIR

SEQ ID NO: 887460 - protein, 9 aa, Homo Sapiens
ACATQMRFF

SEQ ID NO: 887461 - protein, 9 aa, Homo Sapiens
NNTVIFACM

SEQ ID NO: 887462 - protein, 9 aa, Homo Sapiens
IISMCLIFL

SEQ ID NO: 887463 - protein, 9 aa, Homo Sapiens
TYMLNPLIY

SEQ ID NO: 887464 - protein, 9 aa, Homo Sapiens
GQLRGEDPR

SEQ ID NO: 887465 - protein, 9 aa, Homo Sapiens
HSAKIISLS

SEQ ID NO: 887466 - protein, 9 aa, Homo Sapiens
FVCRDPSEG

SEQ ID NO: 887467 - protein, 9 aa, Homo Sapiens
LYSRSNPVV

SEQ ID NO: 887468 - protein, 9 aa, Homo Sapiens
YLDNDDLQT

SEQ ID NO: 887469 - protein, 9 aa, Homo Sapiens
GGETQGVAF

SEQ ID NO: 887470 - protein, 9 aa, Homo Sapiens
VRQEKRMLK

SEQ ID NO: 887471 - protein, 9 aa, Homo Sapiens
KKSHSDPHP

SEQ ID NO: 887472 - protein, 9 aa, Homo Sapiens
PEALAFTVA

SEQ ID NO: 887473 - protein, 9 aa, Homo Sapiens
VDKKNLTAR

SEQ ID NO: 887474 - protein, 9 aa, Homo Sapiens
CEEPTCRNQ

SEQ ID NO: 887475 - protein, 9 aa, Homo Sapiens
EDVCMIFNA

SEQ ID NO: 887476 - protein, 9 aa, Homo Sapiens
KLEELCAAL

SEQ ID NO: 887477 - protein, 9 aa, Homo Sapiens
NSALILESK

SEQ ID NO: 887478 - protein, 9 aa, Homo Sapiens
MFTSVTRCL

SEQ ID NO: 887479 - protein, 9 aa, Homo Sapiens
LAISGLRHF

SEQ ID NO: 887480 - protein, 9 aa, Homo Sapiens
IKSSERDCL

SEQ ID NO: 887481 - protein, 9 aa, Homo Sapiens
CVYYKKCPS

SEQ ID NO: 887482 - protein, 9 aa, Homo Sapiens
VYEQYYRQV

SEQ ID NO: 887483 - protein, 9 aa, Homo Sapiens
GPMEYTGRP

SEQ ID NO: 887484 - protein, 9 aa, Homo Sapiens
LPFGTVPPQ

SEQ ID NO: 887485 - protein, 9 aa, Homo Sapiens
ELSNTDSGC

SEQ ID NO: 887486 - protein, 9 aa, Homo Sapiens
MTTRTRNIF

SEQ ID NO: 887487 - protein, 9 aa, Homo Sapiens
KRDKQDETQ

SEQ ID NO: 887488 - protein, 9 aa, Homo Sapiens
CAGHLMVFT

SEQ ID NO: 887489 - protein, 9 aa, Homo Sapiens
WIANEKYLR

SEQ ID NO: 887490 - protein, 9 aa, Homo Sapiens
CYPQENKGT

SEQ ID NO: 887491 - protein, 9 aa, Homo Sapiens
ATAGPETFC

SEQ ID NO: 887492 - protein, 9 aa, Homo Sapiens
HWTNTYTGM

SEQ ID NO: 887493 - protein, 9 aa, Homo Sapiens
TDYFTEVKV

SEQ ID NO: 887494 - protein, 9 aa, Homo Sapiens
QPITSSTLI

SEQ ID NO: 887495 - protein, 9 aa, Homo Sapiens
KCSLYRHFK

SEQ ID NO: 887496 - protein, 9 aa, Homo Sapiens
NSHASQAKY

SEQ ID NO: 887497 - protein, 9 aa, Homo Sapiens
LDKITNGSQ

SEQ ID NO: 887498 - protein, 9 aa, Homo Sapiens
ILLYVVGLR

SEQ ID NO: 887499 - protein, 9 aa, Homo Sapiens
VVFQNALEI

SEQ ID NO: 887500 - protein, 9 aa, Homo Sapiens
DSSLEKNYS

SEQ ID NO: 887501 - protein, 9 aa, Homo Sapiens
PSPQHYLEE

SEQ ID NO: 887502 - protein, 9 aa, Homo Sapiens
DLMLVHSRT

SEQ ID NO: 887503 - protein, 9 aa, Homo Sapiens
YNQTFMKLG

SEQ ID NO: 887504 - protein, 9 aa, Homo Sapiens
ALAREFDQF

SEQ ID NO: 887505 - protein, 9 aa, Homo Sapiens
LCLKNIRAF

SEQ ID NO: 887506 - protein, 9 aa, Homo Sapiens
HREAGGHNE

SEQ ID NO: 887507 - protein, 9 aa, Homo Sapiens
NTIIDDLLK

SEQ ID NO: 887508 - protein, 9 aa, Homo Sapiens
MAVCKIKVH

SEQ ID NO: 887509 - protein, 9 aa, Homo Sapiens
ITVNKETQS

SEQ ID NO: 887510 - protein, 9 aa, Homo Sapiens
RIKEGSADL

SEQ ID NO: 887511 - protein, 9 aa, Homo Sapiens
EENMVSLLQ

SEQ ID NO: 887512 - protein, 9 aa, Homo Sapiens
QISQIYDKL

SEQ ID NO: 887513 - protein, 9 aa, Homo Sapiens
SVTVQVPQT

SEQ ID NO: 887514 - protein, 9 aa, Homo Sapiens
KNGQPVSTV

SEQ ID NO: 887515 - protein, 9 aa, Homo Sapiens
MPPLEDDNK

SEQ ID NO: 887516 - protein, 9 aa, Homo Sapiens
SASSINKAR

SEQ ID NO: 887517 - protein, 9 aa, Homo Sapiens
QPPVMPQAP

SEQ ID NO: 887518 - protein, 9 aa, Homo Sapiens
ALHLAVEAQ

SEQ ID NO: 887519 - protein, 9 aa, Homo Sapiens
ASVVNYFIE

SEQ ID NO: 887520 - protein, 9 aa, Homo Sapiens
AGKDYENED

SEQ ID NO: 887521 - protein, 9 aa, Homo Sapiens
GAHNTFLKC

SEQ ID NO: 887522 - protein, 9 aa, Homo Sapiens
FYVKYRNVS

SEQ ID NO: 887523 - protein, 9 aa, Homo Sapiens
EREFLFELG

SEQ ID NO: 887524 - protein, 9 aa, Homo Sapiens
EGCIEWCCS

SEQ ID NO: 887525 - protein, 9 aa, Homo Sapiens
MPDLLRSGE

SEQ ID NO: 887526 - protein, 9 aa, Homo Sapiens
PVFLDKKIL

SEQ ID NO: 887527 - protein, 9 aa, Homo Sapiens
TGNHRKPSF

SEQ ID NO: 887528 - protein, 9 aa, Homo Sapiens
TQFSYLEKL

SEQ ID NO: 887529 - protein, 9 aa, Homo Sapiens
SSPAIDTPP

SEQ ID NO: 887530 - protein, 9 aa, Homo Sapiens
TEICHEVSF

SEQ ID NO: 887531 - protein, 9 aa, Homo Sapiens
RVLARYIDA

SEQ ID NO: 887532 - protein, 9 aa, Homo Sapiens
DLKEISVVI

SEQ ID NO: 887533 - protein, 9 aa, Homo Sapiens
DMLEAELLI

SEQ ID NO: 887534 - protein, 9 aa, Homo Sapiens
SDSFIAEHK

SEQ ID NO: 887535 - protein, 9 aa, Homo Sapiens
ATTEERMQA

SEQ ID NO: 887536 - protein, 9 aa, Homo Sapiens
GLSLNYSNA

SEQ ID NO: 887537 - protein, 9 aa, Homo Sapiens
IEKAKTEDN

SEQ ID NO: 887538 - protein, 9 aa, Homo Sapiens
KDNQMRMAD

SEQ ID NO: 887539 - protein, 9 aa, Homo Sapiens
TMKDICENF

SEQ ID NO: 887540 - protein, 9 aa, Homo Sapiens
GSIQMPAFF

SEQ ID NO: 887541 - protein, 9 aa, Homo Sapiens
NISVTSFKK

SEQ ID NO: 887542 - protein, 9 aa, Homo Sapiens
LSVKNNYRK

SEQ ID NO: 887543 - protein, 9 aa, Homo Sapiens
NAYNASLSL

SEQ ID NO: 887544 - protein, 9 aa, Homo Sapiens
MMKDKRPRS

SEQ ID NO: 887545 - protein, 9 aa, Homo Sapiens
SVPLHRHHL

SEQ ID NO: 887546 - protein, 9 aa, Homo Sapiens
QYLLYGEKG

SEQ ID NO: 887547 - protein, 9 aa, Homo Sapiens
WSYYEVFLK

SEQ ID NO: 887548 - protein, 9 aa, Homo Sapiens
ITDPGDVPA

SEQ ID NO: 887549 - protein, 9 aa, Homo Sapiens
DKKHQNHYR

SEQ ID NO: 887550 - protein, 9 aa, Homo Sapiens
ESIPFWTFL

SEQ ID NO: 887551 - protein, 9 aa, Homo Sapiens
TKVPAIQHK

SEQ ID NO: 887552 - protein, 9 aa, Homo Sapiens
NKCRHPGTC

SEQ ID NO: 887553 - protein, 9 aa, Homo Sapiens
TALSNLVVK

SEQ ID NO: 887554 - protein, 9 aa, Homo Sapiens
TLLDVFEVE

SEQ ID NO: 887555 - protein, 9 aa, Homo Sapiens
KQESLEISL

SEQ ID NO: 887556 - protein, 9 aa, Homo Sapiens
KTFSPSPPP

SEQ ID NO: 887557 - protein, 9 aa, Homo Sapiens
VSDQPGEKG

SEQ ID NO: 887558 - protein, 9 aa, Homo Sapiens
EKELQEVRC

SEQ ID NO: 887559 - protein, 9 aa, Homo Sapiens
KLFWTLEFR

SEQ ID NO: 887560 - protein, 9 aa, Homo Sapiens
ALNEKKQHD

SEQ ID NO: 887561 - protein, 9 aa, Homo Sapiens
SGRKASCST

SEQ ID NO: 887562 - protein, 9 aa, Homo Sapiens
RDKSINSLN

SEQ ID NO: 887563 - protein, 9 aa, Homo Sapiens
HIIYQMDDV

SEQ ID NO: 887564 - protein, 9 aa, Homo Sapiens
KRDNNKDID

SEQ ID NO: 887565 - protein, 9 aa, Homo Sapiens
VWVALYNNN

SEQ ID NO: 887566 - protein, 9 aa, Homo Sapiens
KELFAELDK

SEQ ID NO: 887567 - protein, 9 aa, Homo Sapiens
SQFPKVWIL

SEQ ID NO: 887568 - protein, 9 aa, Homo Sapiens
SIHHFKNIP

SEQ ID NO: 887569 - protein, 9 aa, Homo Sapiens
ALMCELMDM

SEQ ID NO: 887570 - protein, 9 aa, Homo Sapiens
ILLAAALQI

SEQ ID NO: 887571 - protein, 9 aa, Homo Sapiens
RDTLITEET

SEQ ID NO: 887572 - protein, 9 aa, Homo Sapiens
TKTLSDYEV

SEQ ID NO: 887573 - protein, 9 aa, Homo Sapiens
SGYRMLLVK

SEQ ID NO: 887574 - protein, 9 aa, Homo Sapiens
CDVWVAFNI

SEQ ID NO: 887575 - protein, 9 aa, Homo Sapiens
LRQRTRPYL

SEQ ID NO: 887576 - protein, 9 aa, Homo Sapiens
LCHPSTPLD

SEQ ID NO: 887577 - protein, 9 aa, Homo Sapiens
QLSEAKHKQ

SEQ ID NO: 887578 - protein, 9 aa, Homo Sapiens
NFHLVGSSR

SEQ ID NO: 887579 - protein, 9 aa, Homo Sapiens
DKQGGPGRE

SEQ ID NO: 887580 - protein, 9 aa, Homo Sapiens
LQVWDLEPN

SEQ ID NO: 887581 - protein, 9 aa, Homo Sapiens
IYINNMNYK

SEQ ID NO: 887582 - protein, 9 aa, Homo Sapiens
EKCFGLLAG

SEQ ID NO: 887583 - protein, 9 aa, Homo Sapiens
PMQELMLRH

SEQ ID NO: 887584 - protein, 9 aa, Homo Sapiens
DKLGKEARS

SEQ ID NO: 887585 - protein, 9 aa, Homo Sapiens
MSLFIVQNK

SEQ ID NO: 887586 - protein, 9 aa, Homo Sapiens
YVDRQNHIC

SEQ ID NO: 887587 - protein, 9 aa, Homo Sapiens
EDAMEEVCK

SEQ ID NO: 887588 - protein, 9 aa, Homo Sapiens
RHHQIHTGE

SEQ ID NO: 887589 - protein, 9 aa, Homo Sapiens
TSNVTYNNW

SEQ ID NO: 887590 - protein, 9 aa, Homo Sapiens
RLDLRKNLC

SEQ ID NO: 887591 - protein, 9 aa, Homo Sapiens
MDDDHLSRR

SEQ ID NO: 887592 - protein, 9 aa, Homo Sapiens
KFVCRDPSE

SEQ ID NO: 887593 - protein, 9 aa, Homo Sapiens
ANLFSPLNP

SEQ ID NO: 887594 - protein, 9 aa, Homo Sapiens
LVKRRDNEE

SEQ ID NO: 887595 - protein, 9 aa, Homo Sapiens
SLLTLRSLQ

SEQ ID NO: 887596 - protein, 9 aa, Homo Sapiens
EHLFPVQIG

SEQ ID NO: 887597 - protein, 9 aa, Homo Sapiens
ISQIYDKLF

SEQ ID NO: 887598 - protein, 9 aa, Homo Sapiens
DLDEMNIEL

SEQ ID NO: 887599 - protein, 9 aa, Homo Sapiens
KHGRAVCCV

SEQ ID NO: 887600 - protein, 9 aa, Homo Sapiens
RRECDKGRK

SEQ ID NO: 887601 - protein, 9 aa, Homo Sapiens
YHKHLRKDL

SEQ ID NO: 887602 - protein, 9 aa, Homo Sapiens
NDTTEPRVL

SEQ ID NO: 887603 - protein, 9 aa, Homo Sapiens
KMQRVQEEY

SEQ ID NO: 887604 - protein, 9 aa, Homo Sapiens
LPKESVQII

SEQ ID NO: 887605 - protein, 9 aa, Homo Sapiens
GEQFYRKSV

SEQ ID NO: 887606 - protein, 9 aa, Homo Sapiens
KTAAATGGT

SEQ ID NO: 887607 - protein, 9 aa, Homo Sapiens
ASKEIISEV

SEQ ID NO: 887608 - protein, 9 aa, Homo Sapiens
CSIKQEQIS

SEQ ID NO: 887609 - protein, 9 aa, Homo Sapiens
VSLETLCTP

SEQ ID NO: 887610 - protein, 9 aa, Homo Sapiens
PAFDRQLYQ

SEQ ID NO: 887611 - protein, 9 aa, Homo Sapiens
TCKTKHVDH

SEQ ID NO: 887612 - protein, 9 aa, Homo Sapiens
ITGYPNPPG

SEQ ID NO: 887613 - protein, 9 aa, Homo Sapiens
GQPYQPLWE

SEQ ID NO: 887614 - protein, 9 aa, Homo Sapiens
EAELTPKAV

SEQ ID NO: 887615 - protein, 9 aa, Homo Sapiens
PIYSSMVPQ

SEQ ID NO: 887616 - protein, 9 aa, Homo Sapiens
NRQPFPAFK

SEQ ID NO: 887617 - protein, 9 aa, Homo Sapiens
RSGGNKKIS

SEQ ID NO: 887618 - protein, 9 aa, Homo Sapiens
RSGGNKKIR

SEQ ID NO: 887619 - protein, 9 aa, Homo Sapiens
PGAINSCQS

SEQ ID NO: 887620 - protein, 9 aa, Homo Sapiens
NHTISVGKY

SEQ ID NO: 887621 - protein, 9 aa, Homo Sapiens
VGRPNKEEL

SEQ ID NO: 887622 - protein, 9 aa, Homo Sapiens
AYNASLSLI

SEQ ID NO: 887623 - protein, 9 aa, Homo Sapiens
AKQLLETKP

SEQ ID NO: 887624 - protein, 9 aa, Homo Sapiens
PEAEMLPQE

SEQ ID NO: 887625 - protein, 9 aa, Homo Sapiens
FAYPNHPDV

SEQ ID NO: 887626 - protein, 9 aa, Homo Sapiens
CRNQTRHLP

SEQ ID NO: 887627 - protein, 9 aa, Homo Sapiens
TFQYAVEIL

SEQ ID NO: 887628 - protein, 9 aa, Homo Sapiens
ILLDEATSV

SEQ ID NO: 887629 - protein, 9 aa, Homo Sapiens
LWTSLAEGA

SEQ ID NO: 887630 - protein, 9 aa, Homo Sapiens
MRSCLYAGG

SEQ ID NO: 887631 - protein, 9 aa, Homo Sapiens
DNPSICAIT

SEQ ID NO: 887632 - protein, 9 aa, Homo Sapiens
VEEKNKIGH

SEQ ID NO: 887633 - protein, 9 aa, Homo Sapiens
SLSSHVSSE

SEQ ID NO: 887634 - protein, 9 aa, Homo Sapiens
CNVKAYVLP

SEQ ID NO: 887635 - protein, 9 aa, Homo Sapiens
KLNEKSKAQ

SEQ ID NO: 887636 - protein, 9 aa, Homo Sapiens
IEEVCYFFH

SEQ ID NO: 887637 - protein, 9 aa, Homo Sapiens
RALKDELQK

SEQ ID NO: 887638 - protein, 9 aa, Homo Sapiens
FNPAAAAFS

SEQ ID NO: 887639 - protein, 9 aa, Homo Sapiens
SPNPAVTLK

SEQ ID NO: 887640 - protein, 9 aa, Homo Sapiens
GEGTKAVKK

SEQ ID NO: 887641 - protein, 9 aa, Homo Sapiens
RYLRNFLKL

SEQ ID NO: 887642 - protein, 9 aa, Homo Sapiens
WGPFNLVYG

SEQ ID NO: 887643 - protein, 9 aa, Homo Sapiens
ELLYIITNA

SEQ ID NO: 887644 - protein, 9 aa, Homo Sapiens
FEAGTLVTY

SEQ ID NO: 887645 - protein, 9 aa, Homo Sapiens
PVLAKDSST

SEQ ID NO: 887646 - protein, 9 aa, Homo Sapiens
LKQQVQIYK

SEQ ID NO: 887647 - protein, 9 aa, Homo Sapiens
KCPQLREIC

SEQ ID NO: 887648 - protein, 9 aa, Homo Sapiens
PRQIKLYSS

SEQ ID NO: 887649 - protein, 9 aa, Homo Sapiens
RQTRIRGGC

SEQ ID NO: 887650 - protein, 9 aa, Homo Sapiens
QYPGSNVRL

SEQ ID NO: 887651 - protein, 9 aa, Homo Sapiens
GTRFLRNEI

SEQ ID NO: 887652 - protein, 9 aa, Homo Sapiens
DLNKKARAL

SEQ ID NO: 887653 - protein, 9 aa, Homo Sapiens
PTRGYGRDM

SEQ ID NO: 887654 - protein, 9 aa, Homo Sapiens
LGAKLNDFA

SEQ ID NO: 887655 - protein, 9 aa, Homo Sapiens
LFTSLIGVC

SEQ ID NO: 887656 - protein, 8 aa, Homo Sapiens
KDWPATRQ

SEQ ID NO: 887657 - protein, 9 aa, Homo Sapiens
PTFSPGPGI

SEQ ID NO: 887658 - protein, 9 aa, Homo Sapiens
KFPEPIKLD

SEQ ID NO: 887659 - protein, 9 aa, Homo Sapiens
KVVKDVSVR

SEQ ID NO: 887660 - protein, 9 aa, Homo Sapiens
HPDRGTSFN

SEQ ID NO: 887661 - protein, 9 aa, Homo Sapiens
ELDSEVLNL

SEQ ID NO: 887662 - protein, 9 aa, Homo Sapiens
ISHICYWVL

SEQ ID NO: 887663 - protein, 9 aa, Homo Sapiens
VVQVAENQH

SEQ ID NO: 887664 - protein, 9 aa, Homo Sapiens
AFPISHICY

SEQ ID NO: 887665 - protein, 9 aa, Homo Sapiens
MFRDVSIDL

SEQ ID NO: 887666 - protein, 9 aa, Homo Sapiens
QSLIKFFNK

SEQ ID NO: 887667 - protein, 9 aa, Homo Sapiens
IFYLQAKKI

SEQ ID NO: 887668 - protein, 9 aa, Homo Sapiens
PCECNVCGK

SEQ ID NO: 887669 - protein, 9 aa, Homo Sapiens
LKRDLAKYI

SEQ ID NO: 887670 - protein, 9 aa, Homo Sapiens
GYSTSSYCW

SEQ ID NO: 887671 - protein, 9 aa, Homo Sapiens
PGGLAGDFY

SEQ ID NO: 887672 - protein, 9 aa, Homo Sapiens
NLKSKYCED

SEQ ID NO: 887673 - protein, 9 aa, Homo Sapiens
LKILVILLV

SEQ ID NO: 887674 - protein, 9 aa, Homo Sapiens
KTVAMHKVF

SEQ ID NO: 887675 - protein, 9 aa, Homo Sapiens
HLEGWNMPF

SEQ ID NO: 887676 - protein, 9 aa, Homo Sapiens
KYSVGRPNK

SEQ ID NO: 887677 - protein, 9 aa, Homo Sapiens
LICMITEFA

SEQ ID NO: 887678 - protein, 9 aa, Homo Sapiens
VDDAKVKEE

SEQ ID NO: 887679 - protein, 9 aa, Homo Sapiens
VAENQHFDG

SEQ ID NO: 887680 - protein, 9 aa, Homo Sapiens
GCCSGEKEP

SEQ ID NO: 887681 - protein, 9 aa, Homo Sapiens
EVVDCIIFG

SEQ ID NO: 887682 - protein, 9 aa, Homo Sapiens
QEKHLSRGI

SEQ ID NO: 887683 - protein, 9 aa, Homo Sapiens
DNYGHDLTS

SEQ ID NO: 887684 - protein, 9 aa, Homo Sapiens
GERDLCQLP

SEQ ID NO: 887685 - protein, 9 aa, Homo Sapiens
PSLTKNGVF

SEQ ID NO: 887686 - protein, 9 aa, Homo Sapiens
DKDKSDYNL

SEQ ID NO: 887687 - protein, 9 aa, Homo Sapiens
KRTHYYETY

SEQ ID NO: 887688 - protein, 9 aa, Homo Sapiens
SGIVTASVG

SEQ ID NO: 887689 - protein, 9 aa, Homo Sapiens
AQPADNHEE

SEQ ID NO: 887690 - protein, 9 aa, Homo Sapiens
MCLKASLKG

SEQ ID NO: 887691 - protein, 9 aa, Homo Sapiens
QWPNEITLD

SEQ ID NO: 887692 - protein, 9 aa, Homo Sapiens
GYCNKCFQF

SEQ ID NO: 887693 - protein, 9 aa, Homo Sapiens
FQAEEEETK

SEQ ID NO: 887694 - protein, 9 aa, Homo Sapiens
RQNHICGFL

SEQ ID NO: 887695 - protein, 9 aa, Homo Sapiens
MCLPVLNIP

SEQ ID NO: 887696 - protein, 9 aa, Homo Sapiens
AFCFYFCTF

SEQ ID NO: 887697 - protein, 9 aa, Homo Sapiens
EFQRGQYSD

SEQ ID NO: 887698 - protein, 9 aa, Homo Sapiens
LSDYETLSF

SEQ ID NO: 887699 - protein, 9 aa, Homo Sapiens
AQFRKEKDT

SEQ ID NO: 887700 - protein, 9 aa, Homo Sapiens
NNPSYTYYA

SEQ ID NO: 887701 - protein, 9 aa, Homo Sapiens
PNPINLLES

SEQ ID NO: 887702 - protein, 9 aa, Homo Sapiens
SGINIKTVF

SEQ ID NO: 887703 - protein, 9 aa, Homo Sapiens
SHTEYQIIT

SEQ ID NO: 887704 - protein, 9 aa, Homo Sapiens
TICSICKAS

SEQ ID NO: 887705 - protein, 9 aa, Homo Sapiens
AAEHLSMIR

SEQ ID NO: 887706 - protein, 9 aa, Homo Sapiens
QLYKEFIDL

SEQ ID NO: 887707 - protein, 9 aa, Homo Sapiens
RDKQDETQT

SEQ ID NO: 887708 - protein, 9 aa, Homo Sapiens
SSKKNQCLL

SEQ ID NO: 887709 - protein, 9 aa, Homo Sapiens
PEEWKYELK

SEQ ID NO: 887710 - protein, 9 aa, Homo Sapiens
TTAEDKELE

SEQ ID NO: 887711 - protein, 9 aa, Homo Sapiens
LLTAAHCHK

SEQ ID NO: 887712 - protein, 9 aa, Homo Sapiens
QPERVQPIT

SEQ ID NO: 887713 - protein, 9 aa, Homo Sapiens
KPANKTNPF

SEQ ID NO: 887714 - protein, 9 aa, Homo Sapiens
TCVWEGEGS

SEQ ID NO: 887715 - protein, 9 aa, Homo Sapiens
FWISQVAVP

SEQ ID NO: 887716 - protein, 9 aa, Homo Sapiens
DMEIGPGEL

SEQ ID NO: 887717 - protein, 9 aa, Homo Sapiens
DNQTSLMAL

SEQ ID NO: 887718 - protein, 9 aa, Homo Sapiens
NLIAALPFD

SEQ ID NO: 887719 - protein, 9 aa, Homo Sapiens
QCVGWRHRL

SEQ ID NO: 887720 - protein, 9 aa, Homo Sapiens
KVPEWNLIS

SEQ ID NO: 887721 - protein, 9 aa, Homo Sapiens
KVFFDLMRK

SEQ ID NO: 887722 - protein, 9 aa, Homo Sapiens
SPGDPDHKA

SEQ ID NO: 887723 - protein, 9 aa, Homo Sapiens
QMVTKVPCS

SEQ ID NO: 887724 - protein, 9 aa, Homo Sapiens
TIANNRNLH

SEQ ID NO: 887725 - protein, 9 aa, Homo Sapiens
CLSCQNYSR

SEQ ID NO: 887726 - protein, 9 aa, Homo Sapiens
PHPSYLSGS

SEQ ID NO: 887727 - protein, 9 aa, Homo Sapiens
YPGGCGPRE

SEQ ID NO: 887728 - protein, 9 aa, Homo Sapiens
PSVFKLNFY

SEQ ID NO: 887729 - protein, 9 aa, Homo Sapiens
AAVVSETNQ

SEQ ID NO: 887730 - protein, 9 aa, Homo Sapiens
LPLDNICGL

SEQ ID NO: 887731 - protein, 9 aa, Homo Sapiens
FSAADHKPE

SEQ ID NO: 887732 - protein, 9 aa, Homo Sapiens
VFAIFIGSL

SEQ ID NO: 887733 - protein, 9 aa, Homo Sapiens
DEEADEAYK

SEQ ID NO: 887734 - protein, 9 aa, Homo Sapiens
YERVKTCFE

SEQ ID NO: 887735 - protein, 9 aa, Homo Sapiens
EQGKLYLRE

SEQ ID NO: 887736 - protein, 9 aa, Homo Sapiens
SSFAVLPWG

SEQ ID NO: 887737 - protein, 9 aa, Homo Sapiens
TKQAFNITI

SEQ ID NO: 887738 - protein, 9 aa, Homo Sapiens
AIPHIATTI

SEQ ID NO: 887739 - protein, 9 aa, Homo Sapiens
LSPPTCRSA

SEQ ID NO: 887740 - protein, 9 aa, Homo Sapiens
QETKRSINK

SEQ ID NO: 887741 - protein, 9 aa, Homo Sapiens
DKAFSWSSN

SEQ ID NO: 887742 - protein, 9 aa, Homo Sapiens
EKFTCSVGK

SEQ ID NO: 887743 - protein, 9 aa, Homo Sapiens
HRCQMICIN

SEQ ID NO: 887744 - protein, 9 aa, Homo Sapiens
CGKSFSYKI

SEQ ID NO: 887745 - protein, 9 aa, Homo Sapiens
NVTFRLSKC

SEQ ID NO: 887746 - protein, 9 aa, Homo Sapiens
MGTNVRFSA

SEQ ID NO: 887747 - protein, 9 aa, Homo Sapiens
VVAGNKYFI

SEQ ID NO: 887748 - protein, 9 aa, Homo Sapiens
SNHSGEKTS

SEQ ID NO: 887749 - protein, 9 aa, Homo Sapiens
YFRLQELFF

SEQ ID NO: 887750 - protein, 9 aa, Homo Sapiens
GSCHACRSG

SEQ ID NO: 887751 - protein, 9 aa, Homo Sapiens
SGKLCEQES

SEQ ID NO: 887752 - protein, 9 aa, Homo Sapiens
GVQIVERNY

SEQ ID NO: 887753 - protein, 9 aa, Homo Sapiens
ASPPKTFSP

SEQ ID NO: 887754 - protein, 9 aa, Homo Sapiens
VVNNIPFLQ

SEQ ID NO: 887755 - protein, 9 aa, Homo Sapiens
TKSHHLHLY

SEQ ID NO: 887756 - protein, 9 aa, Homo Sapiens
YGYCSYKTS

SEQ ID NO: 887757 - protein, 9 aa, Homo Sapiens
SKMEDEAEP

SEQ ID NO: 887758 - protein, 9 aa, Homo Sapiens
PDPMSSSFN

SEQ ID NO: 887759 - protein, 9 aa, Homo Sapiens
IVTTVCLKV

SEQ ID NO: 887760 - protein, 9 aa, Homo Sapiens
SAGAFCKTG

SEQ ID NO: 887761 - protein, 9 aa, Homo Sapiens
QVVLLGLAS

SEQ ID NO: 887762 - protein, 9 aa, Homo Sapiens
SAKVFILVL

SEQ ID NO: 887763 - protein, 9 aa, Homo Sapiens
LNNALDNLR

SEQ ID NO: 887764 - protein, 9 aa, Homo Sapiens
LPWEHNEQV

SEQ ID NO: 887765 - protein, 9 aa, Homo Sapiens
NSPPDADEV

SEQ ID NO: 887766 - protein, 9 aa, Homo Sapiens
SLIHSLNLW

SEQ ID NO: 887767 - protein, 9 aa, Homo Sapiens
WVISQPDQT

SEQ ID NO: 887768 - protein, 9 aa, Homo Sapiens
RKQGLVHQT

SEQ ID NO: 887769 - protein, 9 aa, Homo Sapiens
YRRFLKDNC

SEQ ID NO: 887770 - protein, 9 aa, Homo Sapiens
IQVHDQVLY

SEQ ID NO: 887771 - protein, 9 aa, Homo Sapiens
SLLRQRTRP

SEQ ID NO: 887772 - protein, 9 aa, Homo Sapiens
FYFIPSQLC

SEQ ID NO: 887773 - protein, 9 aa, Homo Sapiens
ECGKTFKCF

SEQ ID NO: 887774 - protein, 9 aa, Homo Sapiens
MSEMAPRNL

SEQ ID NO: 887775 - protein, 9 aa, Homo Sapiens
IYSENSIEM

SEQ ID NO: 887776 - protein, 9 aa, Homo Sapiens
GDKPYKCQE

SEQ ID NO: 887777 - protein, 9 aa, Homo Sapiens
KLQSAFKAD

SEQ ID NO: 887778 - protein, 9 aa, Homo Sapiens
KPYKPFHRS

SEQ ID NO: 887779 - protein, 9 aa, Homo Sapiens
MICRVNDEE

SEQ ID NO: 887780 - protein, 9 aa, Homo Sapiens
TTQATHPCN

SEQ ID NO: 887781 - protein, 9 aa, Homo Sapiens
FQQLYRHLA

SEQ ID NO: 887782 - protein, 9 aa, Homo Sapiens
HSQSRLPGR

SEQ ID NO: 887783 - protein, 9 aa, Homo Sapiens
MILRENPYF

SEQ ID NO: 887784 - protein, 9 aa, Homo Sapiens
ITDYFTGLV

SEQ ID NO: 887785 - protein, 9 aa, Homo Sapiens
HTDKTSFVL

SEQ ID NO: 887786 - protein, 9 aa, Homo Sapiens
TLGVAKLFH

SEQ ID NO: 887787 - protein, 9 aa, Homo Sapiens
ASPVDTTSV

SEQ ID NO: 887788 - protein, 9 aa, Homo Sapiens
SDDDSESRW

SEQ ID NO: 887789 - protein, 9 aa, Homo Sapiens
IVVERDAQP

SEQ ID NO: 887790 - protein, 9 aa, Homo Sapiens
DNFLGISSQ

SEQ ID NO: 887791 - protein, 9 aa, Homo Sapiens
WEAFDLFDV

SEQ ID NO: 887792 - protein, 9 aa, Homo Sapiens
PSQRVESMK

SEQ ID NO: 887793 - protein, 9 aa, Homo Sapiens
QLNALNSLK

SEQ ID NO: 887794 - protein, 9 aa, Homo Sapiens
TGELTSKIV

SEQ ID NO: 887795 - protein, 9 aa, Homo Sapiens
ELWDAKNKK

SEQ ID NO: 887796 - protein, 9 aa, Homo Sapiens
NEVHSTEVA

SEQ ID NO: 887797 - protein, 9 aa, Homo Sapiens
SERTMMMGI

SEQ ID NO: 887798 - protein, 9 aa, Homo Sapiens
IRKEKLGTH

SEQ ID NO: 887799 - protein, 9 aa, Homo Sapiens
SSQAFGNVL

SEQ ID NO: 887800 - protein, 9 aa, Homo Sapiens
ELFQIGAST

SEQ ID NO: 887801 - protein, 9 aa, Homo Sapiens
LTLLGSDNP

SEQ ID NO: 887802 - protein, 9 aa, Homo Sapiens
RLSDYETLS

SEQ ID NO: 887803 - protein, 9 aa, Homo Sapiens
VPSQLNALN

SEQ ID NO: 887804 - protein, 9 aa, Homo Sapiens
HQIAMEPFK

SEQ ID NO: 887805 - protein, 9 aa, Homo Sapiens
IERSKTVST

SEQ ID NO: 887806 - protein, 9 aa, Homo Sapiens
PIVFNEFVD

SEQ ID NO: 887807 - protein, 9 aa, Homo Sapiens
GEIVRTILI

SEQ ID NO: 887808 - protein, 9 aa, Homo Sapiens
TYSRLMGTN

SEQ ID NO: 887809 - protein, 9 aa, Homo Sapiens
YKYPSDVIR

SEQ ID NO: 887810 - protein, 9 aa, Homo Sapiens
PTGTGCPRP

SEQ ID NO: 887811 - protein, 9 aa, Homo Sapiens
LGEAGEKGK

SEQ ID NO: 887812 - protein, 9 aa, Homo Sapiens
INKARINAK

SEQ ID NO: 887813 - protein, 9 aa, Homo Sapiens
NIVRAYNIP

SEQ ID NO: 887814 - protein, 9 aa, Homo Sapiens
SLMRRLVNI

SEQ ID NO: 887815 - protein, 9 aa, Homo Sapiens
SKRGFFWAN

SEQ ID NO: 887816 - protein, 9 aa, Homo Sapiens
GWTEEMAFF

SEQ ID NO: 887817 - protein, 9 aa, Homo Sapiens
TQTRLSTET

SEQ ID NO: 887818 - protein, 9 aa, Homo Sapiens
QHPEAYSHT

SEQ ID NO: 887819 - protein, 9 aa, Homo Sapiens
ATDVYIQPI

SEQ ID NO: 887820 - protein, 9 aa, Homo Sapiens
PNAFCIAKL

SEQ ID NO: 887821 - protein, 9 aa, Homo Sapiens
GHSAKIISL

SEQ ID NO: 887822 - protein, 9 aa, Homo Sapiens
ENLFCFLTD

SEQ ID NO: 887823 - protein, 9 aa, Homo Sapiens
AVVKLVCGN

SEQ ID NO: 887824 - protein, 9 aa, Homo Sapiens
ERDSELSNT

SEQ ID NO: 887825 - protein, 9 aa, Homo Sapiens
EPQEPEEEE

SEQ ID NO: 887826 - protein, 9 aa, Homo Sapiens
QSPFLRITC

SEQ ID NO: 887827 - protein, 9 aa, Homo Sapiens
QRCEKTGNA

SEQ ID NO: 887828 - protein, 9 aa, Homo Sapiens
AIYLACTKL

SEQ ID NO: 887829 - protein, 9 aa, Homo Sapiens
AMQNKFLLK

SEQ ID NO: 887830 - protein, 9 aa, Homo Sapiens
EKVYECKQC

SEQ ID NO: 887831 - protein, 9 aa, Homo Sapiens
IPVNVTLRQ

SEQ ID NO: 887832 - protein, 9 aa, Homo Sapiens
AEDYGHYKE

SEQ ID NO: 887833 - protein, 9 aa, Homo Sapiens
RKNIHGVSR

SEQ ID NO: 887834 - protein, 9 aa, Homo Sapiens
QRKIVKPKH

SEQ ID NO: 887835 - protein, 9 aa, Homo Sapiens
VILHYLSFY

SEQ ID NO: 887836 - protein, 9 aa, Homo Sapiens
HLALYDFVV

SEQ ID NO: 887837 - protein, 9 aa, Homo Sapiens
FCVLSEPIG

SEQ ID NO: 887838 - protein, 9 aa, Homo Sapiens
ASNSVSSCG

SEQ ID NO: 887839 - protein, 9 aa, Homo Sapiens
IQNGVLCKS

SEQ ID NO: 887840 - protein, 9 aa, Homo Sapiens
PVLPQRPAS

SEQ ID NO: 887841 - protein, 9 aa, Homo Sapiens
RYLVIMCSP

SEQ ID NO: 887842 - protein, 9 aa, Homo Sapiens
HSSYCSNTF

SEQ ID NO: 887843 - protein, 9 aa, Homo Sapiens
LDGGLLTPL

SEQ ID NO: 887844 - protein, 9 aa, Homo Sapiens
FLLVTMAYD

SEQ ID NO: 887845 - protein, 9 aa, Homo Sapiens
FKDQMVYTV

SEQ ID NO: 887846 - protein, 9 aa, Homo Sapiens
LNQHNSHDA

SEQ ID NO: 887847 - protein, 9 aa, Homo Sapiens
NLAKHQRIH

SEQ ID NO: 887848 - protein, 9 aa, Homo Sapiens
SEEDHHWPA

SEQ ID NO: 887849 - protein, 9 aa, Homo Sapiens
SASSTGGGL

SEQ ID NO: 887850 - protein, 9 aa, Homo Sapiens
VLESLPILT

SEQ ID NO: 887851 - protein, 9 aa, Homo Sapiens
YPDMSVLRK

SEQ ID NO: 887852 - protein, 9 aa, Homo Sapiens
QVQTHFSTA

SEQ ID NO: 887853 - protein, 9 aa, Homo Sapiens
KFDEIHWLH

SEQ ID NO: 887854 - protein, 9 aa, Homo Sapiens
YDNSAFMEP

SEQ ID NO: 887855 - protein, 9 aa, Homo Sapiens
HLTGKIQIA

SEQ ID NO: 887856 - protein, 9 aa, Homo Sapiens
NGFKSNGPG

SEQ ID NO: 887857 - protein, 9 aa, Homo Sapiens
AARRLLKQH

SEQ ID NO: 887858 - protein, 9 aa, Homo Sapiens
QQIPIESIP

SEQ ID NO: 887859 - protein, 9 aa, Homo Sapiens
SGKGVALIT

SEQ ID NO: 887860 - protein, 9 aa, Homo Sapiens
HTDSLTSQI

SEQ ID NO: 887861 - protein, 9 aa, Homo Sapiens
PILSDEDFN

SEQ ID NO: 887862 - protein, 9 aa, Homo Sapiens
KNSSSNKWT

SEQ ID NO: 887863 - protein, 9 aa, Homo Sapiens
HPLCYPVLM

SEQ ID NO: 887864 - protein, 9 aa, Homo Sapiens
LFQIKHLPY

SEQ ID NO: 887865 - protein, 9 aa, Homo Sapiens
EGPNLTDIV

SEQ ID NO: 887866 - protein, 9 aa, Homo Sapiens
SLLGSPDVE

SEQ ID NO: 887867 - protein, 9 aa, Homo Sapiens
STLATIIRQ

SEQ ID NO: 887868 - protein, 9 aa, Homo Sapiens
RTSKPDVFI

SEQ ID NO: 887869 - protein, 9 aa, Homo Sapiens
TLNYTVGRK

SEQ ID NO: 887870 - protein, 9 aa, Homo Sapiens
TTELQVWDL

SEQ ID NO: 887871 - protein, 9 aa, Homo Sapiens
TKCFKELNV

SEQ ID NO: 887872 - protein, 9 aa, Homo Sapiens
FHYFIIINC

SEQ ID NO: 887873 - protein, 9 aa, Homo Sapiens
SSTSSDSGH

SEQ ID NO: 887874 - protein, 9 aa, Homo Sapiens
AICEESKAV

SEQ ID NO: 887875 - protein, 9 aa, Homo Sapiens
EEMGNCIED

SEQ ID NO: 887876 - protein, 9 aa, Homo Sapiens
HELFTAYGP

SEQ ID NO: 887877 - protein, 9 aa, Homo Sapiens
LQPWNVTGN

SEQ ID NO: 887878 - protein, 9 aa, Homo Sapiens
NPDDFPLLV

SEQ ID NO: 887879 - protein, 9 aa, Homo Sapiens
QPSEKIWIE

SEQ ID NO: 887880 - protein, 9 aa, Homo Sapiens
KMKEQEYWK

SEQ ID NO: 887881 - protein, 9 aa, Homo Sapiens
TFAEMNRHS

SEQ ID NO: 887882 - protein, 9 aa, Homo Sapiens
VIIYNRTRL

SEQ ID NO: 887883 - protein, 9 aa, Homo Sapiens
GSPSERACP

SEQ ID NO: 887884 - protein, 9 aa, Homo Sapiens
VEDIDKGQL

SEQ ID NO: 887885 - protein, 9 aa, Homo Sapiens
DRQKSCILS

SEQ ID NO: 887886 - protein, 9 aa, Homo Sapiens
KSCSKPEKI

SEQ ID NO: 887887 - protein, 9 aa, Homo Sapiens
SNLLEKIQK

SEQ ID NO: 887888 - protein, 9 aa, Homo Sapiens
ASPTWQNPM

SEQ ID NO: 887889 - protein, 9 aa, Homo Sapiens
RCGIEKQLQ

SEQ ID NO: 887890 - protein, 9 aa, Homo Sapiens
SGICIKIAD

SEQ ID NO: 887891 - protein, 9 aa, Homo Sapiens
SRHRHAMTR

SEQ ID NO: 887892 - protein, 9 aa, Homo Sapiens
GTDLEPLPG

SEQ ID NO: 887893 - protein, 9 aa, Homo Sapiens
AKYITSDTS

SEQ ID NO: 887894 - protein, 9 aa, Homo Sapiens
RSATKMSGR

SEQ ID NO: 887895 - protein, 9 aa, Homo Sapiens
SITIPPCYE

SEQ ID NO: 887896 - protein, 9 aa, Homo Sapiens
HGDMHVILW

SEQ ID NO: 887897 - protein, 9 aa, Homo Sapiens
QKRYHKDIF

SEQ ID NO: 887898 - protein, 9 aa, Homo Sapiens
MMGCFQNQK

SEQ ID NO: 887899 - protein, 9 aa, Homo Sapiens
NAQELEKCD

SEQ ID NO: 887900 - protein, 9 aa, Homo Sapiens
TSFNHEKSL

SEQ ID NO: 887901 - protein, 9 aa, Homo Sapiens
DFGDKLYSL

SEQ ID NO: 887902 - protein, 9 aa, Homo Sapiens
LDEFVTVNE

SEQ ID NO: 887903 - protein, 9 aa, Homo Sapiens
TLLTTMLQN

SEQ ID NO: 887904 - protein, 9 aa, Homo Sapiens
VLAVASQWE

SEQ ID NO: 887905 - protein, 9 aa, Homo Sapiens
GDLYRHICK

SEQ ID NO: 887906 - protein, 9 aa, Homo Sapiens
NLKAYYAFK

SEQ ID NO: 887907 - protein, 9 aa, Homo Sapiens
QDTAEYILR

SEQ ID NO: 887908 - protein, 9 aa, Homo Sapiens
ELAVVQPTT

SEQ ID NO: 887909 - protein, 9 aa, Homo Sapiens
YDGVSLCHP

SEQ ID NO: 887910 - protein, 9 aa, Homo Sapiens
LDSIGLAGE

SEQ ID NO: 887911 - protein, 9 aa, Homo Sapiens
AVCCVLERG

SEQ ID NO: 887912 - protein, 9 aa, Homo Sapiens
DFLIDINEE

SEQ ID NO: 887913 - protein, 9 aa, Homo Sapiens
RWAQGEQAR

SEQ ID NO: 887914 - protein, 9 aa, Homo Sapiens
SPTGTGCPR

SEQ ID NO: 887915 - protein, 9 aa, Homo Sapiens
GTLLINSSA

SEQ ID NO: 887916 - protein, 9 aa, Homo Sapiens
INVINVPGE

SEQ ID NO: 887917 - protein, 9 aa, Homo Sapiens
DYLWRGLAE

SEQ ID NO: 887918 - protein, 9 aa, Homo Sapiens
YLFLVAVHE

SEQ ID NO: 887919 - protein, 9 aa, Homo Sapiens
EDDANMEQM

SEQ ID NO: 887920 - protein, 9 aa, Homo Sapiens
RSKQKETLR

SEQ ID NO: 887921 - protein, 9 aa, Homo Sapiens
MIWQLQKNK

SEQ ID NO: 887922 - protein, 9 aa, Homo Sapiens
KFTHYKPPL

SEQ ID NO: 887923 - protein, 9 aa, Homo Sapiens
LLAAHQDLN

SEQ ID NO: 887924 - protein, 9 aa, Homo Sapiens
YLQARSCWV

SEQ ID NO: 887925 - protein, 9 aa, Homo Sapiens
PHEVVGSAS

SEQ ID NO: 887926 - protein, 9 aa, Homo Sapiens
GRAVSPKFV

SEQ ID NO: 887927 - protein, 9 aa, Homo Sapiens
DHENSLELD

SEQ ID NO: 887928 - protein, 9 aa, Homo Sapiens
HKLWCRQIP

SEQ ID NO: 887929 - protein, 9 aa, Homo Sapiens
LVPPQNLMG

SEQ ID NO: 887930 - protein, 9 aa, Homo Sapiens
SSLSSHVSS

SEQ ID NO: 887931 - protein, 9 aa, Homo Sapiens
KDIKHRLGF

SEQ ID NO: 887932 - protein, 9 aa, Homo Sapiens
IKQFLDTNE

SEQ ID NO: 887933 - protein, 9 aa, Homo Sapiens
GGPGRPRYP

SEQ ID NO: 887934 - protein, 9 aa, Homo Sapiens
SHRQLYDDR

SEQ ID NO: 887935 - protein, 9 aa, Homo Sapiens
STGSVCQLL

SEQ ID NO: 887936 - protein, 9 aa, Homo Sapiens
KAHKVAQAK

SEQ ID NO: 887937 - protein, 9 aa, Homo Sapiens
QLFKGHPNL

SEQ ID NO: 887938 - protein, 9 aa, Homo Sapiens
EGPTQKGLC

SEQ ID NO: 887939 - protein, 9 aa, Homo Sapiens
FSVSLIIDI

SEQ ID NO: 887940 - protein, 9 aa, Homo Sapiens
AQRGRPRVN

SEQ ID NO: 887941 - protein, 9 aa, Homo Sapiens
HKAQNFVEK

SEQ ID NO: 887942 - protein, 9 aa, Homo Sapiens
QPLPFGTVP

SEQ ID NO: 887943 - protein, 9 aa, Homo Sapiens
GKCLPEVYC

SEQ ID NO: 887944 - protein, 9 aa, Homo Sapiens
AICKQDLEC

SEQ ID NO: 887945 - protein, 9 aa, Homo Sapiens
NQDTMQIIF

SEQ ID NO: 887946 - protein, 9 aa, Homo Sapiens
FEKRSTQTR

SEQ ID NO: 887947 - protein, 9 aa, Homo Sapiens
QRQLCPLTP

SEQ ID NO: 887948 - protein, 9 aa, Homo Sapiens
RSYSQDYRR

SEQ ID NO: 887949 - protein, 9 aa, Homo Sapiens
QDEELYTLP

SEQ ID NO: 887950 - protein, 9 aa, Homo Sapiens
IAPSSQTKV

SEQ ID NO: 887951 - protein, 9 aa, Homo Sapiens
QGLVHQTHM

SEQ ID NO: 887952 - protein, 9 aa, Homo Sapiens
EGTRNFHKY

SEQ ID NO: 887953 - protein, 9 aa, Homo Sapiens
FLHVRDHCV

SEQ ID NO: 887954 - protein, 9 aa, Homo Sapiens
SHCLYAYGN

SEQ ID NO: 887955 - protein, 9 aa, Homo Sapiens
EICYSTWKK

SEQ ID NO: 887956 - protein, 9 aa, Homo Sapiens
CWKLKGRIE

SEQ ID NO: 887957 - protein, 9 aa, Homo Sapiens
AELNATIRQ

SEQ ID NO: 887958 - protein, 9 aa, Homo Sapiens
LKIFLNDSA

SEQ ID NO: 887959 - protein, 9 aa, Homo Sapiens
ERVKTCFEK

SEQ ID NO: 887960 - protein, 9 aa, Homo Sapiens
FTDFVHPLN

SEQ ID NO: 887961 - protein, 9 aa, Homo Sapiens
DRIEIIQVP

SEQ ID NO: 887962 - protein, 9 aa, Homo Sapiens
DLQNVSLSA

SEQ ID NO: 887963 - protein, 9 aa, Homo Sapiens
DFTQEILPL

SEQ ID NO: 887964 - protein, 9 aa, Homo Sapiens
CRDPSEGEA

SEQ ID NO: 887965 - protein, 9 aa, Homo Sapiens
LLEADNRQL

SEQ ID NO: 887966 - protein, 9 aa, Homo Sapiens
WNIKDVAVL

SEQ ID NO: 887967 - protein, 9 aa, Homo Sapiens
LADVNNYCC

SEQ ID NO: 887968 - protein, 9 aa, Homo Sapiens
MEEHFIQKV

SEQ ID NO: 887969 - protein, 9 aa, Homo Sapiens
EQARTEIEK

SEQ ID NO: 887970 - protein, 9 aa, Homo Sapiens
RDLAKYITS

SEQ ID NO: 887971 - protein, 9 aa, Homo Sapiens
YMIHVNQNI

SEQ ID NO: 887972 - protein, 9 aa, Homo Sapiens
NHSGEKTSK

SEQ ID NO: 887973 - protein, 9 aa, Homo Sapiens
AKEAELAAQ

SEQ ID NO: 887974 - protein, 9 aa, Homo Sapiens
DISLQVRQE

SEQ ID NO: 887975 - protein, 9 aa, Homo Sapiens
DDSKKSMIG

SEQ ID NO: 887976 - protein, 9 aa, Homo Sapiens
KVVRLCHNP

SEQ ID NO: 887977 - protein, 9 aa, Homo Sapiens
SQYKFCPTC

SEQ ID NO: 887978 - protein, 9 aa, Homo Sapiens
SLGAKKERE

SEQ ID NO: 887979 - protein, 9 aa, Homo Sapiens
LHAPQYQSM

SEQ ID NO: 887980 - protein, 9 aa, Homo Sapiens
LSLQGVTTV

SEQ ID NO: 887981 - protein, 9 aa, Homo Sapiens
TPQPGGASG

SEQ ID NO: 887982 - protein, 9 aa, Homo Sapiens
HSSSGEEKT

SEQ ID NO: 887983 - protein, 9 aa, Homo Sapiens
ATASSKKAI

SEQ ID NO: 887984 - protein, 9 aa, Homo Sapiens
QDLQSSDLK

SEQ ID NO: 887985 - protein, 9 aa, Homo Sapiens
KLNRAMDNC

SEQ ID NO: 887986 - protein, 9 aa, Homo Sapiens
PSQLNALNS

SEQ ID NO: 887987 - protein, 9 aa, Homo Sapiens
YRNELVAGS

SEQ ID NO: 887988 - protein, 9 aa, Homo Sapiens
KDLKSWAQG

SEQ ID NO: 887989 - protein, 9 aa, Homo Sapiens
RPEWQFFVK

SEQ ID NO: 887990 - protein, 9 aa, Homo Sapiens
ANLYLLDSP

SEQ ID NO: 887991 - protein, 9 aa, Homo Sapiens
RSCLYAGGL

SEQ ID NO: 887992 - protein, 9 aa, Homo Sapiens
DTPLNDAIS

SEQ ID NO: 887993 - protein, 9 aa, Homo Sapiens
GTMDLVRSG

SEQ ID NO: 887994 - protein, 9 aa, Homo Sapiens
ESVITATLA

SEQ ID NO: 887995 - protein, 9 aa, Homo Sapiens
VLIIPSGQS

SEQ ID NO: 887996 - protein, 9 aa, Homo Sapiens
LKEAFCRRG

SEQ ID NO: 887997 - protein, 9 aa, Homo Sapiens
CSQKYITEF

SEQ ID NO: 887998 - protein, 9 aa, Homo Sapiens
RPGVQWPCP

SEQ ID NO: 887999 - protein, 9 aa, Homo Sapiens
QDPVQLISG

SEQ ID NO: 888000 - protein, 9 aa, Homo Sapiens
LSFFRIAYI

SEQ ID NO: 888001 - protein, 9 aa, Homo Sapiens
KISFQEFLT

SEQ ID NO: 888002 - protein, 9 aa, Homo Sapiens
KQKNLFRLE

SEQ ID NO: 888003 - protein, 9 aa, Homo Sapiens
IATYRCLLE

SEQ ID NO: 888004 - protein, 9 aa, Homo Sapiens
ENIISQEEC

SEQ ID NO: 888005 - protein, 9 aa, Homo Sapiens
GRVEPGSLK

SEQ ID NO: 888006 - protein, 9 aa, Homo Sapiens
SSIRIHEIT

SEQ ID NO: 888007 - protein, 9 aa, Homo Sapiens
LQPLGMEPK

SEQ ID NO: 888008 - protein, 9 aa, Homo Sapiens
LVRQTTELK

SEQ ID NO: 888009 - protein, 9 aa, Homo Sapiens
ESPDIAKYM

SEQ ID NO: 888010 - protein, 9 aa, Homo Sapiens
SGYQLTQHQ

SEQ ID NO: 888011 - protein, 9 aa, Homo Sapiens
QTPRLQDPN

SEQ ID NO: 888012 - protein, 9 aa, Homo Sapiens
GLPESLIPV

SEQ ID NO: 888013 - protein, 9 aa, Homo Sapiens
LMFKTFHLE

SEQ ID NO: 888014 - protein, 9 aa, Homo Sapiens
HGGGQSQQT

SEQ ID NO: 888015 - protein, 9 aa, Homo Sapiens
DLGNIRIWF

SEQ ID NO: 888016 - protein, 9 aa, Homo Sapiens
LSSERNVSL

SEQ ID NO: 888017 - protein, 9 aa, Homo Sapiens
IIVLLRHTD

SEQ ID NO: 888018 - protein, 9 aa, Homo Sapiens
EEAEIKSQH

SEQ ID NO: 888019 - protein, 9 aa, Homo Sapiens
TYLLTRNDH

SEQ ID NO: 888020 - protein, 9 aa, Homo Sapiens
QQLITIRNT

SEQ ID NO: 888021 - protein, 9 aa, Homo Sapiens
PSEVYHFGA

SEQ ID NO: 888022 - protein, 9 aa, Homo Sapiens
EVDILVTVK

SEQ ID NO: 888023 - protein, 9 aa, Homo Sapiens
GGDKSYKCK

SEQ ID NO: 888024 - protein, 9 aa, Homo Sapiens
VMEEKTILL

SEQ ID NO: 888025 - protein, 9 aa, Homo Sapiens
FPYLEKTAN

SEQ ID NO: 888026 - protein, 9 aa, Homo Sapiens
GNIYLKQIN

SEQ ID NO: 888027 - protein, 9 aa, Homo Sapiens
HFPTLRHHN

SEQ ID NO: 888028 - protein, 9 aa, Homo Sapiens
ASEVLQIQN

SEQ ID NO: 888029 - protein, 9 aa, Homo Sapiens
EDIRDLLSK

SEQ ID NO: 888030 - protein, 9 aa, Homo Sapiens
TYDTLHMQA

SEQ ID NO: 888031 - protein, 9 aa, Homo Sapiens
MKLLQFVTG

SEQ ID NO: 888032 - protein, 9 aa, Homo Sapiens
PRDEDYKGA

SEQ ID NO: 888033 - protein, 9 aa, Homo Sapiens
AFIIEETVR

SEQ ID NO: 888034 - protein, 9 aa, Homo Sapiens
SSDFAKHKK

SEQ ID NO: 888035 - protein, 9 aa, Homo Sapiens
QRTGKPDEE

SEQ ID NO: 888036 - protein, 9 aa, Homo Sapiens
ADRSATKMS

SEQ ID NO: 888037 - protein, 9 aa, Homo Sapiens
VFIKLQVLE

SEQ ID NO: 888038 - protein, 9 aa, Homo Sapiens
FVCEGCQRV

SEQ ID NO: 888039 - protein, 9 aa, Homo Sapiens
KKRKMQRVQ

SEQ ID NO: 888040 - protein, 9 aa, Homo Sapiens
MAGQINKLC

SEQ ID NO: 888041 - protein, 9 aa, Homo Sapiens
LRKGGMEVC

SEQ ID NO: 888042 - protein, 9 aa, Homo Sapiens
RHKHLAFLL

SEQ ID NO: 888043 - protein, 9 aa, Homo Sapiens
FTTPGVPST

SEQ ID NO: 888044 - protein, 9 aa, Homo Sapiens
RKHSDGRKY

SEQ ID NO: 888045 - protein, 9 aa, Homo Sapiens
RETVLESLP

SEQ ID NO: 888046 - protein, 9 aa, Homo Sapiens
RKVKHMRNR

SEQ ID NO: 888047 - protein, 9 aa, Homo Sapiens
ISVNPNDQK

SEQ ID NO: 888048 - protein, 9 aa, Homo Sapiens
NCPRNADMK

SEQ ID NO: 888049 - protein, 9 aa, Homo Sapiens
SKSDHFRCR

SEQ ID NO: 888050 - protein, 9 aa, Homo Sapiens
SQGAITEHL

SEQ ID NO: 888051 - protein, 9 aa, Homo Sapiens
INTLRRTRK

SEQ ID NO: 888052 - protein, 9 aa, Homo Sapiens
NQNKSVVRS

SEQ ID NO: 888053 - protein, 9 aa, Homo Sapiens
KELLIDKFC

SEQ ID NO: 888054 - protein, 9 aa, Homo Sapiens
FGDNLSNPL

SEQ ID NO: 888055 - protein, 9 aa, Homo Sapiens
ALQIQNMVS

SEQ ID NO: 888056 - protein, 9 aa, Homo Sapiens
QILENSKSQ

SEQ ID NO: 888057 - protein, 9 aa, Homo Sapiens
FAYPAIQYL

SEQ ID NO: 888058 - protein, 9 aa, Homo Sapiens
AFGEYANDK

SEQ ID NO: 888059 - protein, 9 aa, Homo Sapiens
LKVLEKQTA

SEQ ID NO: 888060 - protein, 9 aa, Homo Sapiens
MPRMLPFLL

SEQ ID NO: 888061 - protein, 9 aa, Homo Sapiens
LIHIYKSFT

SEQ ID NO: 888062 - protein, 9 aa, Homo Sapiens
VSSEAGNMV

SEQ ID NO: 888063 - protein, 9 aa, Homo Sapiens
QCLKQLQLR

SEQ ID NO: 888064 - protein, 9 aa, Homo Sapiens
DNHEELSAR

SEQ ID NO: 888065 - protein, 9 aa, Homo Sapiens
VTGGREGGG

SEQ ID NO: 888066 - protein, 9 aa, Homo Sapiens
QWKSVCLDV

SEQ ID NO: 888067 - protein, 9 aa, Homo Sapiens
SIQDLQTLC

SEQ ID NO: 888068 - protein, 9 aa, Homo Sapiens
EEVPEAYVN

SEQ ID NO: 888069 - protein, 9 aa, Homo Sapiens
RIWSTVDEK

SEQ ID NO: 888070 - protein, 9 aa, Homo Sapiens
SGLSLNYSN

SEQ ID NO: 888071 - protein, 9 aa, Homo Sapiens
TKAVKKSLE

SEQ ID NO: 888072 - protein, 9 aa, Homo Sapiens
FDLQAKEEG

SEQ ID NO: 888073 - protein, 9 aa, Homo Sapiens
PLWNGNSCS

SEQ ID NO: 888074 - protein, 9 aa, Homo Sapiens
KGSYFFWLE

SEQ ID NO: 888075 - protein, 9 aa, Homo Sapiens
ICGAADGIW

SEQ ID NO: 888076 - protein, 9 aa, Homo Sapiens
AQNDEYENL

SEQ ID NO: 888077 - protein, 9 aa, Homo Sapiens
TPRRRKGRH

SEQ ID NO: 888078 - protein, 9 aa, Homo Sapiens
SFMSVNPSK

SEQ ID NO: 888079 - protein, 9 aa, Homo Sapiens
LQFNSQPYE

SEQ ID NO: 888080 - protein, 9 aa, Homo Sapiens
SDQPGEKGN

SEQ ID NO: 888081 - protein, 9 aa, Homo Sapiens
GTTTWEKTA

SEQ ID NO: 888082 - protein, 9 aa, Homo Sapiens
RCHYCRGFN

SEQ ID NO: 888083 - protein, 9 aa, Homo Sapiens
YVQICITVF

SEQ ID NO: 888084 - protein, 9 aa, Homo Sapiens
INLPEFPFG

SEQ ID NO: 888085 - protein, 9 aa, Homo Sapiens
EHGGECSQL

SEQ ID NO: 888086 - protein, 9 aa, Homo Sapiens
CLIHSLLRR

SEQ ID NO: 888087 - protein, 9 aa, Homo Sapiens
GVVKFPPDI

SEQ ID NO: 888088 - protein, 9 aa, Homo Sapiens
PYMNGRYYS

SEQ ID NO: 888089 - protein, 9 aa, Homo Sapiens
LSCRLVFLF

SEQ ID NO: 888090 - protein, 9 aa, Homo Sapiens
DTLTNAVAH

SEQ ID NO: 888091 - protein, 9 aa, Homo Sapiens
DYNHPGRVM

SEQ ID NO: 888092 - protein, 9 aa, Homo Sapiens
QAFCVLSEP

SEQ ID NO: 888093 - protein, 9 aa, Homo Sapiens
SGVWATLRL

SEQ ID NO: 888094 - protein, 9 aa, Homo Sapiens
NRDDGSVYG

SEQ ID NO: 888095 - protein, 9 aa, Homo Sapiens
YPVKAVAVD

SEQ ID NO: 888096 - protein, 9 aa, Homo Sapiens
ACKIHLQGQ

SEQ ID NO: 888097 - protein, 9 aa, Homo Sapiens
NDFTKVENG

SEQ ID NO: 888098 - protein, 9 aa, Homo Sapiens
ESLNFSVSN

SEQ ID NO: 888099 - protein, 9 aa, Homo Sapiens
ILDYLETVA

SEQ ID NO: 888100 - protein, 9 aa, Homo Sapiens
HQSGLVPQQ

SEQ ID NO: 888101 - protein, 9 aa, Homo Sapiens
LHCLVTISV

SEQ ID NO: 888102 - protein, 9 aa, Homo Sapiens
GICLYGRPI

SEQ ID NO: 888103 - protein, 9 aa, Homo Sapiens
ICSSSWETS

SEQ ID NO: 888104 - protein, 9 aa, Homo Sapiens
IQKENACDQ

SEQ ID NO: 888105 - protein, 9 aa, Homo Sapiens
IGCWYCRRQ

SEQ ID NO: 888106 - protein, 9 aa, Homo Sapiens
TGREGYVSS

SEQ ID NO: 888107 - protein, 9 aa, Homo Sapiens
RNLLQIREK

SEQ ID NO: 888108 - protein, 9 aa, Homo Sapiens
LAHCTVITI

SEQ ID NO: 888109 - protein, 9 aa, Homo Sapiens
PAKAYANYS

SEQ ID NO: 888110 - protein, 9 aa, Homo Sapiens
DTWALDDIL

SEQ ID NO: 888111 - protein, 9 aa, Homo Sapiens
IGTFLEELT

SEQ ID NO: 888112 - protein, 9 aa, Homo Sapiens
IFSPLAGLR

SEQ ID NO: 888113 - protein, 9 aa, Homo Sapiens
FLVKDCDAD

SEQ ID NO: 888114 - protein, 9 aa, Homo Sapiens
GLPYADHHY

SEQ ID NO: 888115 - protein, 9 aa, Homo Sapiens
KLIPPVLRF

SEQ ID NO: 888116 - protein, 9 aa, Homo Sapiens
STSTDKSDQ

SEQ ID NO: 888117 - protein, 9 aa, Homo Sapiens
RSLQELDLT

SEQ ID NO: 888118 - protein, 9 aa, Homo Sapiens
GIEFLKGFW

SEQ ID NO: 888119 - protein, 9 aa, Homo Sapiens
AMYSGSQTP

SEQ ID NO: 888120 - protein, 9 aa, Homo Sapiens
KGLDSAEGS

SEQ ID NO: 888121 - protein, 9 aa, Homo Sapiens
VALYNNNVP

SEQ ID NO: 888122 - protein, 9 aa, Homo Sapiens
QGQLDYIPV

SEQ ID NO: 888123 - protein, 9 aa, Homo Sapiens
VLDDKEEWP

SEQ ID NO: 888124 - protein, 9 aa, Homo Sapiens
IIQISLPED

SEQ ID NO: 888125 - protein, 9 aa, Homo Sapiens
VALMVETQM

SEQ ID NO: 888126 - protein, 9 aa, Homo Sapiens
NCTYQTSGL

SEQ ID NO: 888127 - protein, 9 aa, Homo Sapiens
AAREEDKHP

SEQ ID NO: 888128 - protein, 9 aa, Homo Sapiens
FYFTIPLGS

SEQ ID NO: 888129 - protein, 9 aa, Homo Sapiens
MIKRFIPLA

SEQ ID NO: 888130 - protein, 9 aa, Homo Sapiens
RVEKFLFNT

SEQ ID NO: 888131 - protein, 9 aa, Homo Sapiens
KTEDKITDP

SEQ ID NO: 888132 - protein, 9 aa, Homo Sapiens
ISVPKSSVL

SEQ ID NO: 888133 - protein, 9 aa, Homo Sapiens
QNSTAAELA

SEQ ID NO: 888134 - protein, 9 aa, Homo Sapiens
YNAIKKYLC

SEQ ID NO: 888135 - protein, 9 aa, Homo Sapiens
QRNFLQSHM

SEQ ID NO: 888136 - protein, 9 aa, Homo Sapiens
KLWDLSSSI

SEQ ID NO: 888137 - protein, 9 aa, Homo Sapiens
TEVDYYKLQ

SEQ ID NO: 888138 - protein, 9 aa, Homo Sapiens
YQPEPLPEV

SEQ ID NO: 888139 - protein, 9 aa, Homo Sapiens
EVNIICCKK

SEQ ID NO: 888140 - protein, 9 aa, Homo Sapiens
QNKINEVLA

SEQ ID NO: 888141 - protein, 9 aa, Homo Sapiens
DLDNKLRSV

SEQ ID NO: 888142 - protein, 9 aa, Homo Sapiens
LFDISLFVH

SEQ ID NO: 888143 - protein, 9 aa, Homo Sapiens
FIIFGDNLS

SEQ ID NO: 888144 - protein, 9 aa, Homo Sapiens
QRQNGSAAM

SEQ ID NO: 888145 - protein, 9 aa, Homo Sapiens
FNVETVTYE

SEQ ID NO: 888146 - protein, 9 aa, Homo Sapiens
PLTHMPKGM

SEQ ID NO: 888147 - protein, 9 aa, Homo Sapiens
KVVFDEAIL

SEQ ID NO: 888148 - protein, 9 aa, Homo Sapiens
NFMIDTYCL

SEQ ID NO: 888149 - protein, 9 aa, Homo Sapiens
ALTKCAASG

SEQ ID NO: 888150 - protein, 9 aa, Homo Sapiens
KQMLYTNHL

SEQ ID NO: 888151 - protein, 9 aa, Homo Sapiens
LPTAMQLLW

SEQ ID NO: 888152 - protein, 9 aa, Homo Sapiens
ERTMMMGII

SEQ ID NO: 888153 - protein, 9 aa, Homo Sapiens
SLHFTCDLN

SEQ ID NO: 888154 - protein, 9 aa, Homo Sapiens
GIIPRAFKH

SEQ ID NO: 888155 - protein, 9 aa, Homo Sapiens
GEKMKIAGG

SEQ ID NO: 888156 - protein, 9 aa, Homo Sapiens
LTEAGCEYI

SEQ ID NO: 888157 - protein, 9 aa, Homo Sapiens
QSIRPPYNQ

SEQ ID NO: 888158 - protein, 9 aa, Homo Sapiens
LDIIPASLL

SEQ ID NO: 888159 - protein, 9 aa, Homo Sapiens
KRVIGMPVA

SEQ ID NO: 888160 - protein, 9 aa, Homo Sapiens
PQNELIPLI

SEQ ID NO: 888161 - protein, 9 aa, Homo Sapiens
DKRPEKIIQ

SEQ ID NO: 888162 - protein, 9 aa, Homo Sapiens
SPPHPALSP

SEQ ID NO: 888163 - protein, 9 aa, Homo Sapiens
PPASEVLQI

SEQ ID NO: 888164 - protein, 9 aa, Homo Sapiens
DTLQKYFDV

SEQ ID NO: 888165 - protein, 9 aa, Homo Sapiens
KVHRSACGA

SEQ ID NO: 888166 - protein, 9 aa, Homo Sapiens
AGMKPRVIK

SEQ ID NO: 888167 - protein, 9 aa, Homo Sapiens
NPDCIKQTL

SEQ ID NO: 888168 - protein, 9 aa, Homo Sapiens
SSSVSHAWD

SEQ ID NO: 888169 - protein, 9 aa, Homo Sapiens
TLCWEVPDG

SEQ ID NO: 888170 - protein, 9 aa, Homo Sapiens
LYGLSWYQQ

SEQ ID NO: 888171 - protein, 9 aa, Homo Sapiens
LVQHLQVHT

SEQ ID NO: 888172 - protein, 9 aa, Homo Sapiens
RRKQIVGGK

SEQ ID NO: 888173 - protein, 9 aa, Homo Sapiens
EDCVLLLTN

SEQ ID NO: 888174 - protein, 9 aa, Homo Sapiens
VLQSQVKYT

SEQ ID NO: 888175 - protein, 9 aa, Homo Sapiens
ISVIKSVFL

SEQ ID NO: 888176 - protein, 9 aa, Homo Sapiens
PWRSPIPVS

SEQ ID NO: 888177 - protein, 9 aa, Homo Sapiens
KDDLIAYVS

SEQ ID NO: 888178 - protein, 9 aa, Homo Sapiens
TSSSGTSYH

SEQ ID NO: 888179 - protein, 9 aa, Homo Sapiens
ILSVRDSAR

SEQ ID NO: 888180 - protein, 9 aa, Homo Sapiens
DIQVHEWVP

SEQ ID NO: 888181 - protein, 9 aa, Homo Sapiens
QLSTGLDSI

SEQ ID NO: 888182 - protein, 9 aa, Homo Sapiens
AMTRKRGEG

SEQ ID NO: 888183 - protein, 9 aa, Homo Sapiens
QKRKLVPLD

SEQ ID NO: 888184 - protein, 9 aa, Homo Sapiens
FNQLCLSPY

SEQ ID NO: 888185 - protein, 9 aa, Homo Sapiens
AFNITIMIL

SEQ ID NO: 888186 - protein, 9 aa, Homo Sapiens
AHAPLNPAL

SEQ ID NO: 888187 - protein, 9 aa, Homo Sapiens
EHGSDSFIA

SEQ ID NO: 888188 - protein, 9 aa, Homo Sapiens
NYSPTFPSY

SEQ ID NO: 888189 - protein, 9 aa, Homo Sapiens
KDIKSLLRM

SEQ ID NO: 888190 - protein, 9 aa, Homo Sapiens
VLAYLQIFH

SEQ ID NO: 888191 - protein, 9 aa, Homo Sapiens
CGGKNYERV

SEQ ID NO: 888192 - protein, 9 aa, Homo Sapiens
YPQIQSIKV

SEQ ID NO: 888193 - protein, 9 aa, Homo Sapiens
SLYEHRRSH

SEQ ID NO: 888194 - protein, 9 aa, Homo Sapiens
YKCTFIVLD

SEQ ID NO: 888195 - protein, 9 aa, Homo Sapiens
ALTLATVTP

SEQ ID NO: 888196 - protein, 9 aa, Homo Sapiens
NFEKISELG

SEQ ID NO: 888197 - protein, 9 aa, Homo Sapiens
LQAVLWASD

SEQ ID NO: 888198 - protein, 9 aa, Homo Sapiens
RSGECQLAV

SEQ ID NO: 888199 - protein, 9 aa, Homo Sapiens
MAKPHMVKA

SEQ ID NO: 888200 - protein, 9 aa, Homo Sapiens
GFNLPNSIR

SEQ ID NO: 888201 - protein, 9 aa, Homo Sapiens
EECIRLCRA

SEQ ID NO: 888202 - protein, 9 aa, Homo Sapiens
KNIHTGGKP

SEQ ID NO: 888203 - protein, 9 aa, Homo Sapiens
KDFSAIYLA

SEQ ID NO: 888204 - protein, 9 aa, Homo Sapiens
SSYNERVGN

SEQ ID NO: 888205 - protein, 9 aa, Homo Sapiens
VMYRFCTKN

SEQ ID NO: 888206 - protein, 9 aa, Homo Sapiens
YLFYSIITP

SEQ ID NO: 888207 - protein, 9 aa, Homo Sapiens
QINYSKAIK

SEQ ID NO: 888208 - protein, 9 aa, Homo Sapiens
VDCCKKDLC

SEQ ID NO: 888209 - protein, 9 aa, Homo Sapiens
ILETISQPV

SEQ ID NO: 888210 - protein, 9 aa, Homo Sapiens
RRSRAALVG

SEQ ID NO: 888211 - protein, 9 aa, Homo Sapiens
RKGVPNPIN

SEQ ID NO: 888212 - protein, 9 aa, Homo Sapiens
RDSKEKRYL

SEQ ID NO: 888213 - protein, 9 aa, Homo Sapiens
NSDTEFGDT

SEQ ID NO: 888214 - protein, 9 aa, Homo Sapiens
KEDSGIPNP

SEQ ID NO: 888215 - protein, 9 aa, Homo Sapiens
LSQNDFQSL

SEQ ID NO: 888216 - protein, 9 aa, Homo Sapiens
RINHAPERL

SEQ ID NO: 888217 - protein, 9 aa, Homo Sapiens
PSNQGEYIC

SEQ ID NO: 888218 - protein, 9 aa, Homo Sapiens
SLTLAKHKK

SEQ ID NO: 888219 - protein, 9 aa, Homo Sapiens
RDYSQGMKN

SEQ ID NO: 888220 - protein, 9 aa, Homo Sapiens
RFVKFLEIN

SEQ ID NO: 888221 - protein, 9 aa, Homo Sapiens
QDNCSWTSF

SEQ ID NO: 888222 - protein, 9 aa, Homo Sapiens
AHPAPMVFW

SEQ ID NO: 888223 - protein, 9 aa, Homo Sapiens
TRVRCINLA

SEQ ID NO: 888224 - protein, 9 aa, Homo Sapiens
DKILYNKFN

SEQ ID NO: 888225 - protein, 9 aa, Homo Sapiens
SNKIVREYK

SEQ ID NO: 888226 - protein, 9 aa, Homo Sapiens
MGEQDGICS

SEQ ID NO: 888227 - protein, 9 aa, Homo Sapiens
HGDSAMHLV

SEQ ID NO: 888228 - protein, 9 aa, Homo Sapiens
IICCKKVEQ

SEQ ID NO: 888229 - protein, 9 aa, Homo Sapiens
RDCAYLVAC

SEQ ID NO: 888230 - protein, 9 aa, Homo Sapiens
AQMQSPTTT

SEQ ID NO: 888231 - protein, 9 aa, Homo Sapiens
FTPSYVKKK

SEQ ID NO: 888232 - protein, 9 aa, Homo Sapiens
DLTQHQIIH

SEQ ID NO: 888233 - protein, 9 aa, Homo Sapiens
DWSVFHGAI

SEQ ID NO: 888234 - protein, 9 aa, Homo Sapiens
RGSQPGIFS

SEQ ID NO: 888235 - protein, 9 aa, Homo Sapiens
YVAVLLRMY

SEQ ID NO: 888236 - protein, 9 aa, Homo Sapiens
KRQSHFQAG

SEQ ID NO: 888237 - protein, 9 aa, Homo Sapiens
GHELDLTYI

SEQ ID NO: 888238 - protein, 9 aa, Homo Sapiens
LEETEEDNK

SEQ ID NO: 888239 - protein, 9 aa, Homo Sapiens
LTQLSCQNL

SEQ ID NO: 888240 - protein, 9 aa, Homo Sapiens
RMREYECMK

SEQ ID NO: 888241 - protein, 9 aa, Homo Sapiens
DIPVTRTLI

SEQ ID NO: 888242 - protein, 9 aa, Homo Sapiens
NTLTDTLIP

SEQ ID NO: 888243 - protein, 9 aa, Homo Sapiens
YDAKSKYVS

SEQ ID NO: 888244 - protein, 9 aa, Homo Sapiens
YESAYGGAY

SEQ ID NO: 888245 - protein, 9 aa, Homo Sapiens
ETTDCFLLV

SEQ ID NO: 888246 - protein, 9 aa, Homo Sapiens
NICCMNGGS

SEQ ID NO: 888247 - protein, 9 aa, Homo Sapiens
SVEEISFAD

SEQ ID NO: 888248 - protein, 9 aa, Homo Sapiens
EHKDDKLQN

SEQ ID NO: 888249 - protein, 9 aa, Homo Sapiens
KRRRNQCQY

SEQ ID NO: 888250 - protein, 9 aa, Homo Sapiens
ARLANLMGL

SEQ ID NO: 888251 - protein, 9 aa, Homo Sapiens
VVTQQIRQL

SEQ ID NO: 888252 - protein, 9 aa, Homo Sapiens
LAEWLEQRQ

SEQ ID NO: 888253 - protein, 9 aa, Homo Sapiens
NYLIEMMGP

SEQ ID NO: 888254 - protein, 9 aa, Homo Sapiens
DITECMEAQ

SEQ ID NO: 888255 - protein, 9 aa, Homo Sapiens
KMAHYPPGH

SEQ ID NO: 888256 - protein, 9 aa, Homo Sapiens
AVTLITVCW

SEQ ID NO: 888257 - protein, 9 aa, Homo Sapiens
CIPVKRPIP

SEQ ID NO: 888258 - protein, 9 aa, Homo Sapiens
MQYLHHCEH

SEQ ID NO: 888259 - protein, 9 aa, Homo Sapiens
YSMMLILIG

SEQ ID NO: 888260 - protein, 9 aa, Homo Sapiens
MYTMNKFLI

SEQ ID NO: 888261 - protein, 9 aa, Homo Sapiens
KNSNEVAKL

SEQ ID NO: 888262 - protein, 9 aa, Homo Sapiens
NQTFMKLGP

SEQ ID NO: 888263 - protein, 9 aa, Homo Sapiens
QNCGKLEAQ

SEQ ID NO: 888264 - protein, 9 aa, Homo Sapiens
FDVENGPVE

SEQ ID NO: 888265 - protein, 9 aa, Homo Sapiens
DTSIMSINN

SEQ ID NO: 888266 - protein, 9 aa, Homo Sapiens
AADVLKYFS

SEQ ID NO: 888267 - protein, 9 aa, Homo Sapiens
KITDLVHFA

SEQ ID NO: 888268 - protein, 9 aa, Homo Sapiens
AVPASDSRP

SEQ ID NO: 888269 - protein, 9 aa, Homo Sapiens
VRTHYDPPQ

SEQ ID NO: 888270 - protein, 9 aa, Homo Sapiens
LYRHICKFH

SEQ ID NO: 888271 - protein, 9 aa, Homo Sapiens
NNRKEAALS

SEQ ID NO: 888272 - protein, 9 aa, Homo Sapiens
SSLNISVTS

SEQ ID NO: 888273 - protein, 9 aa, Homo Sapiens
YRSHMPYTD

SEQ ID NO: 888274 - protein, 9 aa, Homo Sapiens
SSIASGETH

SEQ ID NO: 888275 - protein, 9 aa, Homo Sapiens
GNDGVKVCT

SEQ ID NO: 888276 - protein, 9 aa, Homo Sapiens
FRGKIYNFW

SEQ ID NO: 888277 - protein, 9 aa, Homo Sapiens
VLGSFSVIL

SEQ ID NO: 888278 - protein, 9 aa, Homo Sapiens
RKYLALQQE

SEQ ID NO: 888279 - protein, 9 aa, Homo Sapiens
LFTSLSAEV

SEQ ID NO: 888280 - protein, 9 aa, Homo Sapiens
RRLNTRFSR

SEQ ID NO: 888281 - protein, 9 aa, Homo Sapiens
PSNPSSRDS

SEQ ID NO: 888282 - protein, 9 aa, Homo Sapiens
LIVAKYFAL

SEQ ID NO: 888283 - protein, 9 aa, Homo Sapiens
GQTCRYFHK

SEQ ID NO: 888284 - protein, 9 aa, Homo Sapiens
HVFRGQPGS

SEQ ID NO: 888285 - protein, 9 aa, Homo Sapiens
NCYFTSKCH

SEQ ID NO: 888286 - protein, 9 aa, Homo Sapiens
SLTGASTIR

SEQ ID NO: 888287 - protein, 9 aa, Homo Sapiens
QDIKIMMEG

SEQ ID NO: 888288 - protein, 9 aa, Homo Sapiens
ITTPKMICD

SEQ ID NO: 888289 - protein, 9 aa, Homo Sapiens
RNDFMGAMP

SEQ ID NO: 888290 - protein, 9 aa, Homo Sapiens
ACQLHISQH

SEQ ID NO: 888291 - protein, 9 aa, Homo Sapiens
VLLLVTLVF

SEQ ID NO: 888292 - protein, 9 aa, Homo Sapiens
TPKHALPVS

SEQ ID NO: 888293 - protein, 9 aa, Homo Sapiens
YRIILNGKD

SEQ ID NO: 888294 - protein, 9 aa, Homo Sapiens
DALYKLFHD

SEQ ID NO: 888295 - protein, 9 aa, Homo Sapiens
PNVEFTFKG

SEQ ID NO: 888296 - protein, 9 aa, Homo Sapiens
DIGGADQEL

SEQ ID NO: 888297 - protein, 9 aa, Homo Sapiens
NKALSPTSP

SEQ ID NO: 888298 - protein, 9 aa, Homo Sapiens
LEVGEDCEC

SEQ ID NO: 888299 - protein, 9 aa, Homo Sapiens
FSFTKYFIK

SEQ ID NO: 888300 - protein, 9 aa, Homo Sapiens
SDQTSVKQK

SEQ ID NO: 888301 - protein, 9 aa, Homo Sapiens
DKPFGCAHC

SEQ ID NO: 888302 - protein, 9 aa, Homo Sapiens
PIGAIIFGG

SEQ ID NO: 888303 - protein, 9 aa, Homo Sapiens
WYKPQNHPY

SEQ ID NO: 888304 - protein, 9 aa, Homo Sapiens
TVEKETSFE

SEQ ID NO: 888305 - protein, 9 aa, Homo Sapiens
VCDGMPLDY

SEQ ID NO: 888306 - protein, 9 aa, Homo Sapiens
SMINDAVNE

SEQ ID NO: 888307 - protein, 9 aa, Homo Sapiens
ELNNYLSEA

SEQ ID NO: 888308 - protein, 9 aa, Homo Sapiens
DKVSPPGVM

SEQ ID NO: 888309 - protein, 9 aa, Homo Sapiens
KFVRPFPLN

SEQ ID NO: 888310 - protein, 9 aa, Homo Sapiens
WDNHIDEPI

SEQ ID NO: 888311 - protein, 9 aa, Homo Sapiens
FRSQQMVTK

SEQ ID NO: 888312 - protein, 9 aa, Homo Sapiens
RDSARPMLE

SEQ ID NO: 888313 - protein, 9 aa, Homo Sapiens
DVSPTSCDN

SEQ ID NO: 888314 - protein, 9 aa, Homo Sapiens
HINMEAKHP

SEQ ID NO: 888315 - protein, 9 aa, Homo Sapiens
SPSSSVSHA

SEQ ID NO: 888316 - protein, 9 aa, Homo Sapiens
DCYQLYQGI

SEQ ID NO: 888317 - protein, 9 aa, Homo Sapiens
LLACLQCSQ

SEQ ID NO: 888318 - protein, 9 aa, Homo Sapiens
LIKFFNKMK

SEQ ID NO: 888319 - protein, 9 aa, Homo Sapiens
KMLAIYLVH

SEQ ID NO: 888320 - protein, 9 aa, Homo Sapiens
AYYMPEFST

SEQ ID NO: 888321 - protein, 9 aa, Homo Sapiens
AEPIKQAFC

SEQ ID NO: 888322 - protein, 9 aa, Homo Sapiens
YGINDNDTT

SEQ ID NO: 888323 - protein, 9 aa, Homo Sapiens
HNLEWLKND

SEQ ID NO: 888324 - protein, 9 aa, Homo Sapiens
KETLNLDDL

SEQ ID NO: 888325 - protein, 9 aa, Homo Sapiens
ATLDTLTKH

SEQ ID NO: 888326 - protein, 9 aa, Homo Sapiens
NIIYFKNMR

SEQ ID NO: 888327 - protein, 9 aa, Homo Sapiens
YEVRIFKNA

SEQ ID NO: 888328 - protein, 9 aa, Homo Sapiens
KKIQGMQKL

SEQ ID NO: 888329 - protein, 9 aa, Homo Sapiens
YYSAGRGLS

SEQ ID NO: 888330 - protein, 9 aa, Homo Sapiens
WKIIIKNFD

SEQ ID NO: 888331 - protein, 9 aa, Homo Sapiens
HLRVDQITW

SEQ ID NO: 888332 - protein, 9 aa, Homo Sapiens
MCLIFLWKK

SEQ ID NO: 888333 - protein, 9 aa, Homo Sapiens
RGGETICSI

SEQ ID NO: 888334 - protein, 9 aa, Homo Sapiens
IKEGSADLR

SEQ ID NO: 888335 - protein, 9 aa, Homo Sapiens
SIKQEQISY

SEQ ID NO: 888336 - protein, 9 aa, Homo Sapiens
VVIQNSNKN

SEQ ID NO: 888337 - protein, 9 aa, Homo Sapiens
DNYVQAVEE

SEQ ID NO: 888338 - protein, 9 aa, Homo Sapiens
ALRMLQSEN

SEQ ID NO: 888339 - protein, 9 aa, Homo Sapiens
SGACKIHLQ

SEQ ID NO: 888340 - protein, 9 aa, Homo Sapiens
AQELLQSNE

SEQ ID NO: 888341 - protein, 9 aa, Homo Sapiens
CCGLVHHRR

SEQ ID NO: 888342 - protein, 9 aa, Homo Sapiens
TTKYFKKQL

SEQ ID NO: 888343 - protein, 9 aa, Homo Sapiens
PVHKHLCIQ

SEQ ID NO: 888344 - protein, 9 aa, Homo Sapiens
LKNKLGQMR

SEQ ID NO: 888345 - protein, 9 aa, Homo Sapiens
YDIQTGNTR

SEQ ID NO: 888346 - protein, 9 aa, Homo Sapiens
PVGRLCSLG

SEQ ID NO: 888347 - protein, 9 aa, Homo Sapiens
ASDQTSVKQ

SEQ ID NO: 888348 - protein, 9 aa, Homo Sapiens
GYLNYHDAV

SEQ ID NO: 888349 - protein, 9 aa, Homo Sapiens
LLIKDMAFT

SEQ ID NO: 888350 - protein, 9 aa, Homo Sapiens
MAATTTTTI

SEQ ID NO: 888351 - protein, 9 aa, Homo Sapiens
VECPTKLFP

SEQ ID NO: 888352 - protein, 9 aa, Homo Sapiens
CEPKDLVVQ

SEQ ID NO: 888353 - protein, 9 aa, Homo Sapiens
LVCGNITVY

SEQ ID NO: 888354 - protein, 9 aa, Homo Sapiens
PLWTSLAEG

SEQ ID NO: 888355 - protein, 9 aa, Homo Sapiens
FLNEILNLH

SEQ ID NO: 888356 - protein, 9 aa, Homo Sapiens
LKLCSLENH

SEQ ID NO: 888357 - protein, 9 aa, Homo Sapiens
DSLQYVQCV

SEQ ID NO: 888358 - protein, 9 aa, Homo Sapiens
KTYLICYQR

SEQ ID NO: 888359 - protein, 9 aa, Homo Sapiens
GVAHTLQNT

SEQ ID NO: 888360 - protein, 9 aa, Homo Sapiens
HLAVEAQER

SEQ ID NO: 888361 - protein, 9 aa, Homo Sapiens
FCSLAVLVP

SEQ ID NO: 888362 - protein, 9 aa, Homo Sapiens
VELQNMFGE

SEQ ID NO: 888363 - protein, 9 aa, Homo Sapiens
SYSQNTLIA

SEQ ID NO: 888364 - protein, 9 aa, Homo Sapiens
EAAIMTNSQ

SEQ ID NO: 888365 - protein, 9 aa, Homo Sapiens
MPQDQESPR

SEQ ID NO: 888366 - protein, 9 aa, Homo Sapiens
LCTYQEGKE

SEQ ID NO: 888367 - protein, 9 aa, Homo Sapiens
ELNRAIQRL

SEQ ID NO: 888368 - protein, 9 aa, Homo Sapiens
LLQSQVVAV

SEQ ID NO: 888369 - protein, 9 aa, Homo Sapiens
SMSVERDIK

SEQ ID NO: 888370 - protein, 9 aa, Homo Sapiens
VGNTCGLEQ

SEQ ID NO: 888371 - protein, 9 aa, Homo Sapiens
ADVDIEGNV

SEQ ID NO: 888372 - protein, 9 aa, Homo Sapiens
SPRSLPSNP

SEQ ID NO: 888373 - protein, 9 aa, Homo Sapiens
KLTQEKEYN

SEQ ID NO: 888374 - protein, 9 aa, Homo Sapiens
HPVQFGSDD

SEQ ID NO: 888375 - protein, 9 aa, Homo Sapiens
LEQSLLNMC

SEQ ID NO: 888376 - protein, 9 aa, Homo Sapiens
LTFDGKQMR

SEQ ID NO: 888377 - protein, 9 aa, Homo Sapiens
RCFHNGYCL

SEQ ID NO: 888378 - protein, 9 aa, Homo Sapiens
RRIKLGHTQ

SEQ ID NO: 888379 - protein, 9 aa, Homo Sapiens
EGHHWHMKH

SEQ ID NO: 888380 - protein, 9 aa, Homo Sapiens
NNNVRKKDH

SEQ ID NO: 888381 - protein, 9 aa, Homo Sapiens
GRIGQNNFK

SEQ ID NO: 888382 - protein, 9 aa, Homo Sapiens
AVQYIENSD

SEQ ID NO: 888383 - protein, 9 aa, Homo Sapiens
TAEKSHKPI

SEQ ID NO: 888384 - protein, 9 aa, Homo Sapiens
QGAITEHLR

SEQ ID NO: 888385 - protein, 9 aa, Homo Sapiens
NVFRQLDKC

SEQ ID NO: 888386 - protein, 9 aa, Homo Sapiens
GQCRVDYKV

SEQ ID NO: 888387 - protein, 9 aa, Homo Sapiens
AELLMVFNS

SEQ ID NO: 888388 - protein, 9 aa, Homo Sapiens
KSAENGDIW

SEQ ID NO: 888389 - protein, 9 aa, Homo Sapiens
LAFIKELFS

SEQ ID NO: 888390 - protein, 9 aa, Homo Sapiens
NNLGSLQPP

SEQ ID NO: 888391 - protein, 9 aa, Homo Sapiens
WSSKINLES

SEQ ID NO: 888392 - protein, 8 aa, Homo Sapiens
LGMEENNI

SEQ ID NO: 888393 - protein, 9 aa, Homo Sapiens
MTNSQGDGE

SEQ ID NO: 888394 - protein, 9 aa, Homo Sapiens
STGTNTNKL

SEQ ID NO: 888395 - protein, 9 aa, Homo Sapiens
PFYSWERVF

SEQ ID NO: 888396 - protein, 9 aa, Homo Sapiens
IEFCDALVQ

SEQ ID NO: 888397 - protein, 9 aa, Homo Sapiens
HFLFGLLNE

SEQ ID NO: 888398 - protein, 9 aa, Homo Sapiens
GGVWRQGFN

SEQ ID NO: 888399 - protein, 9 aa, Homo Sapiens
RQTLMDNGN

SEQ ID NO: 888400 - protein, 9 aa, Homo Sapiens
AINSCQSEY

SEQ ID NO: 888401 - protein, 9 aa, Homo Sapiens
PFIYTLCNK

SEQ ID NO: 888402 - protein, 9 aa, Homo Sapiens
TLCPQSCKE

SEQ ID NO: 888403 - protein, 9 aa, Homo Sapiens
LSHNKFWKY

SEQ ID NO: 888404 - protein, 9 aa, Homo Sapiens
TPEGKWHVS

SEQ ID NO: 888405 - protein, 9 aa, Homo Sapiens
PFPTIHLRI

SEQ ID NO: 888406 - protein, 9 aa, Homo Sapiens
DVGSEKTQI

SEQ ID NO: 888407 - protein, 9 aa, Homo Sapiens
TSSAASPPA

SEQ ID NO: 888408 - protein, 9 aa, Homo Sapiens
NIKLFFSGS

SEQ ID NO: 888409 - protein, 9 aa, Homo Sapiens
DTVSQANVQ

SEQ ID NO: 888410 - protein, 9 aa, Homo Sapiens
QTHMSSCRV

SEQ ID NO: 888411 - protein, 9 aa, Homo Sapiens
YVRPRSLQS

SEQ ID NO: 888412 - protein, 9 aa, Homo Sapiens
KGDWYKPQN

SEQ ID NO: 888413 - protein, 9 aa, Homo Sapiens
FLQKEQNLK

SEQ ID NO: 888414 - protein, 9 aa, Homo Sapiens
YLSVHKIIH

SEQ ID NO: 888415 - protein, 9 aa, Homo Sapiens
HFEPNNYFT

SEQ ID NO: 888416 - protein, 9 aa, Homo Sapiens
HVILWPIQS

SEQ ID NO: 888417 - protein, 9 aa, Homo Sapiens
VNKLHCLVT

SEQ ID NO: 888418 - protein, 9 aa, Homo Sapiens
GQPGVETDN

SEQ ID NO: 888419 - protein, 9 aa, Homo Sapiens
EDCECGSPK

SEQ ID NO: 888420 - protein, 9 aa, Homo Sapiens
TEATGIARM

SEQ ID NO: 888421 - protein, 9 aa, Homo Sapiens
ASVCGEWPW

SEQ ID NO: 888422 - protein, 9 aa, Homo Sapiens
MQLWILQFN

SEQ ID NO: 888423 - protein, 9 aa, Homo Sapiens
IIMLELIAN

SEQ ID NO: 888424 - protein, 9 aa, Homo Sapiens
NALDNLRKV

SEQ ID NO: 888425 - protein, 9 aa, Homo Sapiens
IQNQVRKEL

SEQ ID NO: 888426 - protein, 9 aa, Homo Sapiens
YLGERPSYI

SEQ ID NO: 888427 - protein, 9 aa, Homo Sapiens
KNIVYTYQI

SEQ ID NO: 888428 - protein, 9 aa, Homo Sapiens
AFCKTGVHD

SEQ ID NO: 888429 - protein, 9 aa, Homo Sapiens
DLLEMDTNL

SEQ ID NO: 888430 - protein, 9 aa, Homo Sapiens
FDKFVRFCF

SEQ ID NO: 888431 - protein, 9 aa, Homo Sapiens
DYHILTRKQ

SEQ ID NO: 888432 - protein, 9 aa, Homo Sapiens
MVVCMFSLM

SEQ ID NO: 888433 - protein, 9 aa, Homo Sapiens
TAVFQTYGT

SEQ ID NO: 888434 - protein, 9 aa, Homo Sapiens
EGCPVCITI

SEQ ID NO: 888435 - protein, 9 aa, Homo Sapiens
ELLVTDNAI

SEQ ID NO: 888436 - protein, 9 aa, Homo Sapiens
TNLTAHKII

SEQ ID NO: 888437 - protein, 9 aa, Homo Sapiens
TSVLLSLQT

SEQ ID NO: 888438 - protein, 9 aa, Homo Sapiens
WGKYGPQWK

SEQ ID NO: 888439 - protein, 9 aa, Homo Sapiens
YEPQIKDSG

SEQ ID NO: 888440 - protein, 9 aa, Homo Sapiens
EEDNSDSQD

SEQ ID NO: 888441 - protein, 9 aa, Homo Sapiens
PPRALTLAT

SEQ ID NO: 888442 - protein, 9 aa, Homo Sapiens
RCEKTGNAY

SEQ ID NO: 888443 - protein, 9 aa, Homo Sapiens
QFDKFVRFC

SEQ ID NO: 888444 - protein, 9 aa, Homo Sapiens
KENITPLIQ

SEQ ID NO: 888445 - protein, 9 aa, Homo Sapiens
PVIQFFGVP

SEQ ID NO: 888446 - protein, 9 aa, Homo Sapiens
VDPCSRQSI

SEQ ID NO: 888447 - protein, 9 aa, Homo Sapiens
GDMLEAELL

SEQ ID NO: 888448 - protein, 9 aa, Homo Sapiens
YPLALHIKI

SEQ ID NO: 888449 - protein, 9 aa, Homo Sapiens
MRRGQNTLP

SEQ ID NO: 888450 - protein, 9 aa, Homo Sapiens
IQMTVVWCR

SEQ ID NO: 888451 - protein, 9 aa, Homo Sapiens
QKHTGSGIL

SEQ ID NO: 888452 - protein, 9 aa, Homo Sapiens
TLKSQIKEL

SEQ ID NO: 888453 - protein, 9 aa, Homo Sapiens
RVQEEYERD

SEQ ID NO: 888454 - protein, 9 aa, Homo Sapiens
RPQTCILLR

SEQ ID NO: 888455 - protein, 9 aa, Homo Sapiens
RSCRQLPPV

SEQ ID NO: 888456 - protein, 9 aa, Homo Sapiens
QIQGGWTTI

SEQ ID NO: 888457 - protein, 9 aa, Homo Sapiens
KYPSDVIRK

SEQ ID NO: 888458 - protein, 9 aa, Homo Sapiens
DGPPELLCI

SEQ ID NO: 888459 - protein, 9 aa, Homo Sapiens
REFFSVLLP

SEQ ID NO: 888460 - protein, 9 aa, Homo Sapiens
EILNLHGKI

SEQ ID NO: 888461 - protein, 9 aa, Homo Sapiens
KIQLSVPAP

SEQ ID NO: 888462 - protein, 9 aa, Homo Sapiens
KHTNVIAQA

SEQ ID NO: 888463 - protein, 9 aa, Homo Sapiens
RGLQRTIRL

SEQ ID NO: 888464 - protein, 9 aa, Homo Sapiens
EICCTVSGD

SEQ ID NO: 888465 - protein, 9 aa, Homo Sapiens
NSYLSVHKI

SEQ ID NO: 888466 - protein, 9 aa, Homo Sapiens
MRRKAFWLP

SEQ ID NO: 888467 - protein, 9 aa, Homo Sapiens
PLVCRAGAK

SEQ ID NO: 888468 - protein, 9 aa, Homo Sapiens
RVILKYLDQ

SEQ ID NO: 888469 - protein, 9 aa, Homo Sapiens
SLMWTLFSR

SEQ ID NO: 888470 - protein, 9 aa, Homo Sapiens
TEQEESVNK

SEQ ID NO: 888471 - protein, 9 aa, Homo Sapiens
VMVQETQRL

SEQ ID NO: 888472 - protein, 9 aa, Homo Sapiens
PSTTSSLVS

SEQ ID NO: 888473 - protein, 9 aa, Homo Sapiens
AVQSLSQKY

SEQ ID NO: 888474 - protein, 9 aa, Homo Sapiens
VEADKLSWD

SEQ ID NO: 888475 - protein, 9 aa, Homo Sapiens
LPAWICEGL

SEQ ID NO: 888476 - protein, 9 aa, Homo Sapiens
SLHWRDRVQ

SEQ ID NO: 888477 - protein, 9 aa, Homo Sapiens
SVKRIKEGS

SEQ ID NO: 888478 - protein, 9 aa, Homo Sapiens
VMCLPVLNI

SEQ ID NO: 888479 - protein, 9 aa, Homo Sapiens
MRFFLMLGG

SEQ ID NO: 888480 - protein, 9 aa, Homo Sapiens
SNETDFLID

SEQ ID NO: 888481 - protein, 9 aa, Homo Sapiens
YLRCCLMKI

SEQ ID NO: 888482 - protein, 9 aa, Homo Sapiens
LLSEREQFC

SEQ ID NO: 888483 - protein, 9 aa, Homo Sapiens
RAGTMALAF

SEQ ID NO: 888484 - protein, 9 aa, Homo Sapiens
KENEFFPTN

SEQ ID NO: 888485 - protein, 9 aa, Homo Sapiens
KLQGMGKPG

SEQ ID NO: 888486 - protein, 9 aa, Homo Sapiens
YEGLCKNYV

SEQ ID NO: 888487 - protein, 9 aa, Homo Sapiens
LVSLETLCT

SEQ ID NO: 888488 - protein, 9 aa, Homo Sapiens
EKRYLRNFL

SEQ ID NO: 888489 - protein, 9 aa, Homo Sapiens
YPGASCHPE

SEQ ID NO: 888490 - protein, 9 aa, Homo Sapiens
KLASLPPTN

SEQ ID NO: 888491 - protein, 9 aa, Homo Sapiens
NEVPPPVFS

SEQ ID NO: 888492 - protein, 9 aa, Homo Sapiens
CRLNWSDSD

SEQ ID NO: 888493 - protein, 9 aa, Homo Sapiens
RFIPCENKS

SEQ ID NO: 888494 - protein, 9 aa, Homo Sapiens
PYESDKDKS

SEQ ID NO: 888495 - protein, 9 aa, Homo Sapiens
ERLWPIHNY

SEQ ID NO: 888496 - protein, 9 aa, Homo Sapiens
VHKFLASVL

SEQ ID NO: 888497 - protein, 9 aa, Homo Sapiens
PAVPAPGKN

SEQ ID NO: 888498 - protein, 9 aa, Homo Sapiens
MDGMNQTRI

SEQ ID NO: 888499 - protein, 9 aa, Homo Sapiens
VLAEKQNYV

SEQ ID NO: 888500 - protein, 9 aa, Homo Sapiens
ISQVAVPAR

SEQ ID NO: 888501 - protein, 9 aa, Homo Sapiens
TEESTWCVL

SEQ ID NO: 888502 - protein, 9 aa, Homo Sapiens
QRTVGIAYS

SEQ ID NO: 888503 - protein, 9 aa, Homo Sapiens
GRTRAETEE

SEQ ID NO: 888504 - protein, 9 aa, Homo Sapiens
GKDGDKNPM

SEQ ID NO: 888505 - protein, 9 aa, Homo Sapiens
RRDNEEFGV

SEQ ID NO: 888506 - protein, 9 aa, Homo Sapiens
NFNDNCPTA

SEQ ID NO: 888507 - protein, 9 aa, Homo Sapiens
AGTLVTYMF

SEQ ID NO: 888508 - protein, 9 aa, Homo Sapiens
ECLSVDYGK

SEQ ID NO: 888509 - protein, 9 aa, Homo Sapiens
LSLVSPASF

SEQ ID NO: 888510 - protein, 9 aa, Homo Sapiens
LWALLDQQG

SEQ ID NO: 888511 - protein, 9 aa, Homo Sapiens
PGLLLGYHG

SEQ ID NO: 888512 - protein, 9 aa, Homo Sapiens
PAERWHYRP

SEQ ID NO: 888513 - protein, 9 aa, Homo Sapiens
GNSIMVMKI

SEQ ID NO: 888514 - protein, 9 aa, Homo Sapiens
DQYDEEARR

SEQ ID NO: 888515 - protein, 9 aa, Homo Sapiens
VPVEDDANM

SEQ ID NO: 888516 - protein, 9 aa, Homo Sapiens
TDIKCVKDA

SEQ ID NO: 888517 - protein, 9 aa, Homo Sapiens
ANYFSGFSS

SEQ ID NO: 888518 - protein, 9 aa, Homo Sapiens
GRGAKCGAC

SEQ ID NO: 888519 - protein, 9 aa, Homo Sapiens
PSSTTHITQ

SEQ ID NO: 888520 - protein, 9 aa, Homo Sapiens
NLYQEWKEC

SEQ ID NO: 888521 - protein, 9 aa, Homo Sapiens
HLNDLKKDN

SEQ ID NO: 888522 - protein, 9 aa, Homo Sapiens
HYRYFIPGV

SEQ ID NO: 888523 - protein, 9 aa, Homo Sapiens
SVRRSEVCI

SEQ ID NO: 888524 - protein, 9 aa, Homo Sapiens
PPTASISRV

SEQ ID NO: 888525 - protein, 9 aa, Homo Sapiens
QKELFAELD

SEQ ID NO: 888526 - protein, 9 aa, Homo Sapiens
YGGKPILIT

SEQ ID NO: 888527 - protein, 9 aa, Homo Sapiens
KKNKVVKMI

SEQ ID NO: 888528 - protein, 9 aa, Homo Sapiens
HRRVRVSYG

SEQ ID NO: 888529 - protein, 9 aa, Homo Sapiens
LKDYKCIPQ

SEQ ID NO: 888530 - protein, 9 aa, Homo Sapiens
LMLRHKTYN

SEQ ID NO: 888531 - protein, 9 aa, Homo Sapiens
NNICTIEEI

SEQ ID NO: 888532 - protein, 9 aa, Homo Sapiens
VFRPQTPPE

SEQ ID NO: 888533 - protein, 9 aa, Homo Sapiens
QQTGIFCVL

SEQ ID NO: 888534 - protein, 9 aa, Homo Sapiens
EPGEDAGCR

SEQ ID NO: 888535 - protein, 9 aa, Homo Sapiens
HLHKQPSHV

SEQ ID NO: 888536 - protein, 9 aa, Homo Sapiens
RWARLNLNG

SEQ ID NO: 888537 - protein, 9 aa, Homo Sapiens
QKVILVILG

SEQ ID NO: 888538 - protein, 9 aa, Homo Sapiens
AIDIFFHFF

SEQ ID NO: 888539 - protein, 9 aa, Homo Sapiens
HRIHEITHI

SEQ ID NO: 888540 - protein, 9 aa, Homo Sapiens
LTTADDKTA

SEQ ID NO: 888541 - protein, 9 aa, Homo Sapiens
PLGGHFHIQ

SEQ ID NO: 888542 - protein, 9 aa, Homo Sapiens
IKDMAFTHE

SEQ ID NO: 888543 - protein, 9 aa, Homo Sapiens
HQNLAALVS

SEQ ID NO: 888544 - protein, 9 aa, Homo Sapiens
SSNNTDFFI

SEQ ID NO: 888545 - protein, 9 aa, Homo Sapiens
EQHIKAHKV

SEQ ID NO: 888546 - protein, 9 aa, Homo Sapiens
LRLIFNHFA

SEQ ID NO: 888547 - protein, 9 aa, Homo Sapiens
CGWMKWPKN

SEQ ID NO: 888548 - protein, 9 aa, Homo Sapiens
MHFAKGRQK

SEQ ID NO: 888549 - protein, 9 aa, Homo Sapiens
NPPGTMEEE

SEQ ID NO: 888550 - protein, 9 aa, Homo Sapiens
RTAVKNLMA

SEQ ID NO: 888551 - protein, 9 aa, Homo Sapiens
DCRPLTVIC

SEQ ID NO: 888552 - protein, 9 aa, Homo Sapiens
VAWEYSMPC

SEQ ID NO: 888553 - protein, 9 aa, Homo Sapiens
LRVCTVDSY

SEQ ID NO: 888554 - protein, 9 aa, Homo Sapiens
WEINWEELE

SEQ ID NO: 888555 - protein, 9 aa, Homo Sapiens
NINNNNIDD

SEQ ID NO: 888556 - protein, 9 aa, Homo Sapiens
DFNGKLSFR

SEQ ID NO: 888557 - protein, 9 aa, Homo Sapiens
TLCLHYQNQ

SEQ ID NO: 888558 - protein, 9 aa, Homo Sapiens
PINVIYVGG

SEQ ID NO: 888559 - protein, 9 aa, Homo Sapiens
QTFTVHQSP

SEQ ID NO: 888560 - protein, 9 aa, Homo Sapiens
QSVRRSEVC

SEQ ID NO: 888561 - protein, 9 aa, Homo Sapiens
GDWGDTHGD

SEQ ID NO: 888562 - protein, 9 aa, Homo Sapiens
KEKAFQLQE

SEQ ID NO: 888563 - protein, 9 aa, Homo Sapiens
HQFVSKKVS

SEQ ID NO: 888564 - protein, 9 aa, Homo Sapiens
SKDSLYVPS

SEQ ID NO: 888565 - protein, 9 aa, Homo Sapiens
CREIKQVNE

SEQ ID NO: 888566 - protein, 9 aa, Homo Sapiens
EGTGRLFFK

SEQ ID NO: 888567 - protein, 9 aa, Homo Sapiens
EIVRTILID

SEQ ID NO: 888568 - protein, 9 aa, Homo Sapiens
IYSMMLILI

SEQ ID NO: 888569 - protein, 9 aa, Homo Sapiens
NKRLKVLRK

SEQ ID NO: 888570 - protein, 9 aa, Homo Sapiens
GDFIFSSDH

SEQ ID NO: 888571 - protein, 9 aa, Homo Sapiens
QQQPLPFGT

SEQ ID NO: 888572 - protein, 9 aa, Homo Sapiens
PAVKKQDNY

SEQ ID NO: 888573 - protein, 9 aa, Homo Sapiens
KTKIDYLMN

SEQ ID NO: 888574 - protein, 9 aa, Homo Sapiens
SLQWLTLET

SEQ ID NO: 888575 - protein, 9 aa, Homo Sapiens
SPASSTSAV

SEQ ID NO: 888576 - protein, 9 aa, Homo Sapiens
EQILNPYNL

SEQ ID NO: 888577 - protein, 9 aa, Homo Sapiens
FQLQEQSSN

SEQ ID NO: 888578 - protein, 9 aa, Homo Sapiens
GETICSICK

SEQ ID NO: 888579 - protein, 9 aa, Homo Sapiens
ASLGKTNKQ

SEQ ID NO: 888580 - protein, 9 aa, Homo Sapiens
FKNADNGTT

SEQ ID NO: 888581 - protein, 9 aa, Homo Sapiens
PFIECNGRG

SEQ ID NO: 888582 - protein, 9 aa, Homo Sapiens
WLGTTKPGS

SEQ ID NO: 888583 - protein, 9 aa, Homo Sapiens
QLVLNNYIL

SEQ ID NO: 888584 - protein, 9 aa, Homo Sapiens
SVQQLQTSF

SEQ ID NO: 888585 - protein, 9 aa, Homo Sapiens
GGQLASTRS

SEQ ID NO: 888586 - protein, 9 aa, Homo Sapiens
PLDYVPPTA

SEQ ID NO: 888587 - protein, 9 aa, Homo Sapiens
RHPCITNTF

SEQ ID NO: 888588 - protein, 9 aa, Homo Sapiens
KCSQKYITE

SEQ ID NO: 888589 - protein, 9 aa, Homo Sapiens
SHLIRHHQI

SEQ ID NO: 888590 - protein, 9 aa, Homo Sapiens
DGVIQIKAS

SEQ ID NO: 888591 - protein, 9 aa, Homo Sapiens
EYEVRIFKN

SEQ ID NO: 888592 - protein, 9 aa, Homo Sapiens
QIIRVILKY

SEQ ID NO: 888593 - protein, 9 aa, Homo Sapiens
QETYSHCLI

SEQ ID NO: 888594 - protein, 9 aa, Homo Sapiens
CQLHYFRNQ

SEQ ID NO: 888595 - protein, 9 aa, Homo Sapiens
ACVRTTDEE

SEQ ID NO: 888596 - protein, 9 aa, Homo Sapiens
PDQKARSSE

SEQ ID NO: 888597 - protein, 9 aa, Homo Sapiens
GFLVCYLRR

SEQ ID NO: 888598 - protein, 9 aa, Homo Sapiens
ETWAPDFLN

SEQ ID NO: 888599 - protein, 9 aa, Homo Sapiens
TNGRRTSST

SEQ ID NO: 888600 - protein, 9 aa, Homo Sapiens
VSARVCFFF

SEQ ID NO: 888601 - protein, 9 aa, Homo Sapiens
GPLFTDFVH

SEQ ID NO: 888602 - protein, 9 aa, Homo Sapiens
QSQVVAVTF

SEQ ID NO: 888603 - protein, 9 aa, Homo Sapiens
LLFVLLVWD

SEQ ID NO: 888604 - protein, 9 aa, Homo Sapiens
VQHFGVFLV

SEQ ID NO: 888605 - protein, 9 aa, Homo Sapiens
LNCNKYMVT

SEQ ID NO: 888606 - protein, 9 aa, Homo Sapiens
LPLICLHAA

SEQ ID NO: 888607 - protein, 9 aa, Homo Sapiens
FFWLERGSM

SEQ ID NO: 888608 - protein, 9 aa, Homo Sapiens
KLQAPHIHR

SEQ ID NO: 888609 - protein, 9 aa, Homo Sapiens
ALTLLGSDN

SEQ ID NO: 888610 - protein, 9 aa, Homo Sapiens
EWDCKSAEN

SEQ ID NO: 888611 - protein, 9 aa, Homo Sapiens
EETFTILFE

SEQ ID NO: 888612 - protein, 9 aa, Homo Sapiens
NQLCLSPYK

SEQ ID NO: 888613 - protein, 9 aa, Homo Sapiens
VRAYNIPVR

SEQ ID NO: 888614 - protein, 9 aa, Homo Sapiens
QMNQKNFLS

SEQ ID NO: 888615 - protein, 9 aa, Homo Sapiens
DELMDGGII

SEQ ID NO: 888616 - protein, 9 aa, Homo Sapiens
NKNVSESLG

SEQ ID NO: 888617 - protein, 9 aa, Homo Sapiens
QLAQTTCVV

SEQ ID NO: 888618 - protein, 9 aa, Homo Sapiens
GGECSQLWD

SEQ ID NO: 888619 - protein, 9 aa, Homo Sapiens
REVLWNLSS

SEQ ID NO: 888620 - protein, 9 aa, Homo Sapiens
EALARDKKL

SEQ ID NO: 888621 - protein, 9 aa, Homo Sapiens
PALKALFKH

SEQ ID NO: 888622 - protein, 9 aa, Homo Sapiens
DLLCPEAYV

SEQ ID NO: 888623 - protein, 9 aa, Homo Sapiens
FHSSIQRHM

SEQ ID NO: 888624 - protein, 9 aa, Homo Sapiens
FNQTAETVP

SEQ ID NO: 888625 - protein, 9 aa, Homo Sapiens
GCNYLLEQY

SEQ ID NO: 888626 - protein, 9 aa, Homo Sapiens
DYSQIQGGW

SEQ ID NO: 888627 - protein, 9 aa, Homo Sapiens
RNTKAAKLS

SEQ ID NO: 888628 - protein, 9 aa, Homo Sapiens
HLLKARTSK

SEQ ID NO: 888629 - protein, 9 aa, Homo Sapiens
CPQSCKERN

SEQ ID NO: 888630 - protein, 9 aa, Homo Sapiens
LPFREARKI

SEQ ID NO: 888631 - protein, 9 aa, Homo Sapiens
SLFASDNFL

SEQ ID NO: 888632 - protein, 9 aa, Homo Sapiens
MVQLHKKLG

SEQ ID NO: 888633 - protein, 9 aa, Homo Sapiens
FLQKNQKHP

SEQ ID NO: 888634 - protein, 9 aa, Homo Sapiens
FTVCSNLTI

SEQ ID NO: 888635 - protein, 9 aa, Homo Sapiens
RVQELVLQL

SEQ ID NO: 888636 - protein, 9 aa, Homo Sapiens
TTMLQNGAP

SEQ ID NO: 888637 - protein, 9 aa, Homo Sapiens
NAYQTEFQA

SEQ ID NO: 888638 - protein, 9 aa, Homo Sapiens
HAGLIELLA

SEQ ID NO: 888639 - protein, 9 aa, Homo Sapiens
NEVIEEVNP

SEQ ID NO: 888640 - protein, 9 aa, Homo Sapiens
DAGQITTIY

SEQ ID NO: 888641 - protein, 9 aa, Homo Sapiens
RLHGGDKSY

SEQ ID NO: 888642 - protein, 9 aa, Homo Sapiens
AEEVLLLHC

SEQ ID NO: 888643 - protein, 9 aa, Homo Sapiens
GNSINVVYS

SEQ ID NO: 888644 - protein, 9 aa, Homo Sapiens
KGDAADGEI

SEQ ID NO: 888645 - protein, 9 aa, Homo Sapiens
INIARPCSE

SEQ ID NO: 888646 - protein, 9 aa, Homo Sapiens
CNPQECFQP

SEQ ID NO: 888647 - protein, 9 aa, Homo Sapiens
HIHNFQLDM

SEQ ID NO: 888648 - protein, 9 aa, Homo Sapiens
SFGQVTILY

SEQ ID NO: 888649 - protein, 9 aa, Homo Sapiens
MEKGGNMTR

SEQ ID NO: 888650 - protein, 9 aa, Homo Sapiens
FCKNHPGCI

SEQ ID NO: 888651 - protein, 9 aa, Homo Sapiens
LESLGTLTH

SEQ ID NO: 888652 - protein, 9 aa, Homo Sapiens
QMIEHIDAC

SEQ ID NO: 888653 - protein, 9 aa, Homo Sapiens
EKTPKLNLL

SEQ ID NO: 888654 - protein, 9 aa, Homo Sapiens
ARKNIHGVS

SEQ ID NO: 888655 - protein, 9 aa, Homo Sapiens
SVTSHRNKS

SEQ ID NO: 888656 - protein, 9 aa, Homo Sapiens
ICSSSFRLH

SEQ ID NO: 888657 - protein, 9 aa, Homo Sapiens
PPLEDDNKF

SEQ ID NO: 888658 - protein, 9 aa, Homo Sapiens
WDTISTYDG

SEQ ID NO: 888659 - protein, 9 aa, Homo Sapiens
ARGFPPLDW

SEQ ID NO: 888660 - protein, 9 aa, Homo Sapiens
LGAVFPGTL

SEQ ID NO: 888661 - protein, 9 aa, Homo Sapiens
VKNNLNPVC

SEQ ID NO: 888662 - protein, 9 aa, Homo Sapiens
KQVIKYCTT

SEQ ID NO: 888663 - protein, 9 aa, Homo Sapiens
IHKLNVEIE

SEQ ID NO: 888664 - protein, 9 aa, Homo Sapiens
LLSVFMWGV

SEQ ID NO: 888665 - protein, 9 aa, Homo Sapiens
KAQNFVEKI

SEQ ID NO: 888666 - protein, 9 aa, Homo Sapiens
TTEERMQAM

SEQ ID NO: 888667 - protein, 9 aa, Homo Sapiens
SEKSRLPEQ

SEQ ID NO: 888668 - protein, 9 aa, Homo Sapiens
SFDVKYINK

SEQ ID NO: 888669 - protein, 9 aa, Homo Sapiens
GLHFEEDKN

SEQ ID NO: 888670 - protein, 9 aa, Homo Sapiens
REQRELEKL

SEQ ID NO: 888671 - protein, 9 aa, Homo Sapiens
PKTPQTPRL

SEQ ID NO: 888672 - protein, 9 aa, Homo Sapiens
GDPSYKYEH

SEQ ID NO: 888673 - protein, 9 aa, Homo Sapiens
KPISFVGRM

SEQ ID NO: 888674 - protein, 9 aa, Homo Sapiens
VENLCYYKI

SEQ ID NO: 888675 - protein, 9 aa, Homo Sapiens
KQLLETKPE

SEQ ID NO: 888676 - protein, 9 aa, Homo Sapiens
IADDYDKNK

SEQ ID NO: 888677 - protein, 9 aa, Homo Sapiens
DVKSYFSQK

SEQ ID NO: 888678 - protein, 9 aa, Homo Sapiens
LAGCAEILG

SEQ ID NO: 888679 - protein, 9 aa, Homo Sapiens
CPSIPLFAP

SEQ ID NO: 888680 - protein, 9 aa, Homo Sapiens
FRRQQKEKR

SEQ ID NO: 888681 - protein, 9 aa, Homo Sapiens
SRLNLLTPQ

SEQ ID NO: 888682 - protein, 9 aa, Homo Sapiens
FHGRHSSYC

SEQ ID NO: 888683 - protein, 9 aa, Homo Sapiens
EPNDLALFV

SEQ ID NO: 888684 - protein, 9 aa, Homo Sapiens
QAILPMQFN

SEQ ID NO: 888685 - protein, 9 aa, Homo Sapiens
PRLPQTVIS

SEQ ID NO: 888686 - protein, 9 aa, Homo Sapiens
PWMWSKCSQ

SEQ ID NO: 888687 - protein, 9 aa, Homo Sapiens
RCGAFMLKL

SEQ ID NO: 888688 - protein, 9 aa, Homo Sapiens
IKSQLKHKY

SEQ ID NO: 888689 - protein, 9 aa, Homo Sapiens
VCIPSQLNV

SEQ ID NO: 888690 - protein, 9 aa, Homo Sapiens
LLSIAVAAG

SEQ ID NO: 888691 - protein, 9 aa, Homo Sapiens
FDVFDAYLE

SEQ ID NO: 888692 - protein, 9 aa, Homo Sapiens
FFLMIFKLT

SEQ ID NO: 888693 - protein, 9 aa, Homo Sapiens
EAFFTVAGT

SEQ ID NO: 888694 - protein, 9 aa, Homo Sapiens
PSNHQNNHI

SEQ ID NO: 888695 - protein, 9 aa, Homo Sapiens
RFLATVKVH

SEQ ID NO: 888696 - protein, 9 aa, Homo Sapiens
RWKSFSFVC

SEQ ID NO: 888697 - protein, 9 aa, Homo Sapiens
GNLLFMSVW

SEQ ID NO: 888698 - protein, 9 aa, Homo Sapiens
ASSINKARI

SEQ ID NO: 888699 - protein, 9 aa, Homo Sapiens
ESLCGTSII

SEQ ID NO: 888700 - protein, 9 aa, Homo Sapiens
AKTEDNYIR

SEQ ID NO: 888701 - protein, 9 aa, Homo Sapiens
HAKDSEDID

SEQ ID NO: 888702 - protein, 9 aa, Homo Sapiens
CGVGTCKET

SEQ ID NO: 888703 - protein, 9 aa, Homo Sapiens
KILNRKIGF

SEQ ID NO: 888704 - protein, 9 aa, Homo Sapiens
QVSKNKIMN

SEQ ID NO: 888705 - protein, 9 aa, Homo Sapiens
KAKTEDNYI

SEQ ID NO: 888706 - protein, 9 aa, Homo Sapiens
KFCFYSEIM

SEQ ID NO: 888707 - protein, 9 aa, Homo Sapiens
EMATNNPHL

SEQ ID NO: 888708 - protein, 9 aa, Homo Sapiens
SLGRRVRVW

SEQ ID NO: 888709 - protein, 9 aa, Homo Sapiens
MLPQELQLH

SEQ ID NO: 888710 - protein, 9 aa, Homo Sapiens
ECLIQFLSE

SEQ ID NO: 888711 - protein, 9 aa, Homo Sapiens
MTRKRGEGG

SEQ ID NO: 888712 - protein, 9 aa, Homo Sapiens
KHLCPQFPL

SEQ ID NO: 888713 - protein, 9 aa, Homo Sapiens
RQQRDRAAA

SEQ ID NO: 888714 - protein, 9 aa, Homo Sapiens
PIPILSSQL

SEQ ID NO: 888715 - protein, 9 aa, Homo Sapiens
LRDSHSEHE

SEQ ID NO: 888716 - protein, 9 aa, Homo Sapiens
VDTLSKDKI

SEQ ID NO: 888717 - protein, 9 aa, Homo Sapiens
IVFGVIVYQ

SEQ ID NO: 888718 - protein, 9 aa, Homo Sapiens
RSDMESLSV

SEQ ID NO: 888719 - protein, 9 aa, Homo Sapiens
CKPLKKRSC

SEQ ID NO: 888720 - protein, 9 aa, Homo Sapiens
QTNMQYVFI

SEQ ID NO: 888721 - protein, 9 aa, Homo Sapiens
QLRGEDPRG

SEQ ID NO: 888722 - protein, 9 aa, Homo Sapiens
EVKLQNGEF

SEQ ID NO: 888723 - protein, 9 aa, Homo Sapiens
QVAMVFGLA

SEQ ID NO: 888724 - protein, 9 aa, Homo Sapiens
KIWAFMMCL

SEQ ID NO: 888725 - protein, 9 aa, Homo Sapiens
EVLQNSFRD

SEQ ID NO: 888726 - protein, 9 aa, Homo Sapiens
VEGQPLHTK

SEQ ID NO: 888727 - protein, 9 aa, Homo Sapiens
EIVMTLKQA

SEQ ID NO: 888728 - protein, 9 aa, Homo Sapiens
PPAARRLLK

SEQ ID NO: 888729 - protein, 9 aa, Homo Sapiens
INLHVVILL

SEQ ID NO: 888730 - protein, 9 aa, Homo Sapiens
AQKGEKPCA

SEQ ID NO: 888731 - protein, 9 aa, Homo Sapiens
CINLARTLQ

SEQ ID NO: 888732 - protein, 9 aa, Homo Sapiens
IFYLSKEEW

SEQ ID NO: 888733 - protein, 9 aa, Homo Sapiens
VKHYKICKL

SEQ ID NO: 888734 - protein, 9 aa, Homo Sapiens
SYSGMIIDN

SEQ ID NO: 888735 - protein, 9 aa, Homo Sapiens
EVNIQFIGG

SEQ ID NO: 888736 - protein, 9 aa, Homo Sapiens
VNSWKASLL

SEQ ID NO: 888737 - protein, 9 aa, Homo Sapiens
QMAAPAFKP

SEQ ID NO: 888738 - protein, 9 aa, Homo Sapiens
TSKFVCRDP

SEQ ID NO: 888739 - protein, 9 aa, Homo Sapiens
YRGCVRASY

SEQ ID NO: 888740 - protein, 9 aa, Homo Sapiens
LLSSDQNPP

SEQ ID NO: 888741 - protein, 9 aa, Homo Sapiens
TCATVLEMI

SEQ ID NO: 888742 - protein, 9 aa, Homo Sapiens
EAGGHNEVP

SEQ ID NO: 888743 - protein, 9 aa, Homo Sapiens
LTFSNLTLN

SEQ ID NO: 888744 - protein, 9 aa, Homo Sapiens
LGRTRAETE

SEQ ID NO: 888745 - protein, 9 aa, Homo Sapiens
LSPLIDRYC

SEQ ID NO: 888746 - protein, 9 aa, Homo Sapiens
AKKAAEDSG

SEQ ID NO: 888747 - protein, 9 aa, Homo Sapiens
ASDRFKGIT

SEQ ID NO: 888748 - protein, 9 aa, Homo Sapiens
LEPGTMDLV

SEQ ID NO: 888749 - protein, 9 aa, Homo Sapiens
LWSRIKKIL

SEQ ID NO: 888750 - protein, 9 aa, Homo Sapiens
YFELSNYDC

SEQ ID NO: 888751 - protein, 9 aa, Homo Sapiens
NASLSLIFS

SEQ ID NO: 888752 - protein, 9 aa, Homo Sapiens
PEDPTFNPS

SEQ ID NO: 888753 - protein, 9 aa, Homo Sapiens
FMAWELPKI

SEQ ID NO: 888754 - protein, 9 aa, Homo Sapiens
ELAAQILLD

SEQ ID NO: 888755 - protein, 9 aa, Homo Sapiens
QDKERNSED

SEQ ID NO: 888756 - protein, 9 aa, Homo Sapiens
NTENCVEFH

SEQ ID NO: 888757 - protein, 9 aa, Homo Sapiens
PWMATSGPG

SEQ ID NO: 888758 - protein, 9 aa, Homo Sapiens
TPGHYQRAK

SEQ ID NO: 888759 - protein, 9 aa, Homo Sapiens
GLMLYLVFF

SEQ ID NO: 888760 - protein, 9 aa, Homo Sapiens
MCELMDMNI

SEQ ID NO: 888761 - protein, 9 aa, Homo Sapiens
LKRHIHSHT

SEQ ID NO: 888762 - protein, 9 aa, Homo Sapiens
SRDKKPHDH

SEQ ID NO: 888763 - protein, 9 aa, Homo Sapiens
PEVKGYWSS

SEQ ID NO: 888764 - protein, 9 aa, Homo Sapiens
KFKIQTWIA

SEQ ID NO: 888765 - protein, 9 aa, Homo Sapiens
IKKTKLQQP

SEQ ID NO: 888766 - protein, 9 aa, Homo Sapiens
LFSPRQNSR

SEQ ID NO: 888767 - protein, 9 aa, Homo Sapiens
AEGLQTVLG

SEQ ID NO: 888768 - protein, 9 aa, Homo Sapiens
KPTRDDCGW

SEQ ID NO: 888769 - protein, 9 aa, Homo Sapiens
GQNCIHLEI

SEQ ID NO: 888770 - protein, 9 aa, Homo Sapiens
PLKLARYFL

SEQ ID NO: 888771 - protein, 9 aa, Homo Sapiens
KANYCQCHF

SEQ ID NO: 888772 - protein, 9 aa, Homo Sapiens
QLQNRLLFH

SEQ ID NO: 888773 - protein, 9 aa, Homo Sapiens
IREEDHSCT

SEQ ID NO: 888774 - protein, 9 aa, Homo Sapiens
DNEYGQGSQ

SEQ ID NO: 888775 - protein, 9 aa, Homo Sapiens
FSSCVSDPP

SEQ ID NO: 888776 - protein, 9 aa, Homo Sapiens
ETAKQIIYN

SEQ ID NO: 888777 - protein, 9 aa, Homo Sapiens
CMLLTLKSN

SEQ ID NO: 888778 - protein, 9 aa, Homo Sapiens
AWHKDILQL

SEQ ID NO: 888779 - protein, 9 aa, Homo Sapiens
CGYPPPVAP

SEQ ID NO: 888780 - protein, 9 aa, Homo Sapiens
STLKQKEPL

SEQ ID NO: 888781 - protein, 9 aa, Homo Sapiens
LCVYVWLER

SEQ ID NO: 888782 - protein, 9 aa, Homo Sapiens
MASLAAYDD

SEQ ID NO: 888783 - protein, 9 aa, Homo Sapiens
FQTLPPSSN

SEQ ID NO: 888784 - protein, 9 aa, Homo Sapiens
LLKPTLENV

SEQ ID NO: 888785 - protein, 9 aa, Homo Sapiens
AMAIWRSNS

SEQ ID NO: 888786 - protein, 9 aa, Homo Sapiens
KVFWWESLV

SEQ ID NO: 888787 - protein, 9 aa, Homo Sapiens
GYCNSLKYT

SEQ ID NO: 888788 - protein, 9 aa, Homo Sapiens
AAQTDSQPF

SEQ ID NO: 888789 - protein, 9 aa, Homo Sapiens
RVTIRTVRA

SEQ ID NO: 888790 - protein, 9 aa, Homo Sapiens
FKTYSNIKD

SEQ ID NO: 888791 - protein, 9 aa, Homo Sapiens
ESHPGTLLI

SEQ ID NO: 888792 - protein, 9 aa, Homo Sapiens
LVILLVLGI

SEQ ID NO: 888793 - protein, 9 aa, Homo Sapiens
DTHGDTCEC

SEQ ID NO: 888794 - protein, 9 aa, Homo Sapiens
RQYKLTVPR

SEQ ID NO: 888795 - protein, 9 aa, Homo Sapiens
QLSLLLGQQ

SEQ ID NO: 888796 - protein, 9 aa, Homo Sapiens
KVCTCTSQK

SEQ ID NO: 888797 - protein, 9 aa, Homo Sapiens
LFEVFDKNR

SEQ ID NO: 888798 - protein, 9 aa, Homo Sapiens
CIPLVKKHC

SEQ ID NO: 888799 - protein, 9 aa, Homo Sapiens
FPRLNCNKY

SEQ ID NO: 888800 - protein, 9 aa, Homo Sapiens
TDANILLYV

SEQ ID NO: 888801 - protein, 9 aa, Homo Sapiens
LHVLCYVTF

SEQ ID NO: 888802 - protein, 9 aa, Homo Sapiens
IKVKLEGHK

SEQ ID NO: 888803 - protein, 9 aa, Homo Sapiens
TVTDPQNLL

SEQ ID NO: 888804 - protein, 9 aa, Homo Sapiens
DYSKLTWYL

SEQ ID NO: 888805 - protein, 9 aa, Homo Sapiens
FLILLSFLL

SEQ ID NO: 888806 - protein, 9 aa, Homo Sapiens
LYHQLHIIE

SEQ ID NO: 888807 - protein, 9 aa, Homo Sapiens
INNFFCDLP

SEQ ID NO: 888808 - protein, 9 aa, Homo Sapiens
ARSDLWYLS

SEQ ID NO: 888809 - protein, 9 aa, Homo Sapiens
SPSPRNSPQ

SEQ ID NO: 888810 - protein, 9 aa, Homo Sapiens
PIHWAVVNK

SEQ ID NO: 888811 - protein, 9 aa, Homo Sapiens
IIMFCLILL

SEQ ID NO: 888812 - protein, 9 aa, Homo Sapiens
RPQNDRRNA

SEQ ID NO: 888813 - protein, 9 aa, Homo Sapiens
IAVVLGAMA

SEQ ID NO: 888814 - protein, 9 aa, Homo Sapiens
RQSIQKNMV

SEQ ID NO: 888815 - protein, 9 aa, Homo Sapiens
KNVKKKRPP

SEQ ID NO: 888816 - protein, 9 aa, Homo Sapiens
IDIFEDIIR

SEQ ID NO: 888817 - protein, 9 aa, Homo Sapiens
PAFAQPKYT

SEQ ID NO: 888818 - protein, 9 aa, Homo Sapiens
VFSLQAIPH

SEQ ID NO: 888819 - protein, 9 aa, Homo Sapiens
LCKQYRHIH

SEQ ID NO: 888820 - protein, 9 aa, Homo Sapiens
DINSDSDKL

SEQ ID NO: 888821 - protein, 9 aa, Homo Sapiens
NLTDIVITC

SEQ ID NO: 888822 - protein, 9 aa, Homo Sapiens
SFRRYSCSL

SEQ ID NO: 888823 - protein, 9 aa, Homo Sapiens
ANMLVMGEG

SEQ ID NO: 888824 - protein, 9 aa, Homo Sapiens
SLSYAFTSP

SEQ ID NO: 888825 - protein, 9 aa, Homo Sapiens
GQAARAGTM

SEQ ID NO: 888826 - protein, 9 aa, Homo Sapiens
LERDSFLKE

SEQ ID NO: 888827 - protein, 9 aa, Homo Sapiens
ELQRFLSRI

SEQ ID NO: 888828 - protein, 9 aa, Homo Sapiens
VDPYHSCGF

SEQ ID NO: 888829 - protein, 9 aa, Homo Sapiens
RLFQCNICG

SEQ ID NO: 888830 - protein, 9 aa, Homo Sapiens
SQKEVKILK

SEQ ID NO: 888831 - protein, 9 aa, Homo Sapiens
HQQIHTGES

SEQ ID NO: 888832 - protein, 9 aa, Homo Sapiens
INFDKWRKV

SEQ ID NO: 888833 - protein, 9 aa, Homo Sapiens
ENKELSLIC

SEQ ID NO: 888834 - protein, 9 aa, Homo Sapiens
SPIPVSPIP

SEQ ID NO: 888835 - protein, 9 aa, Homo Sapiens
ADEQLFSVG

SEQ ID NO: 888836 - protein, 9 aa, Homo Sapiens
LLDQNNNAP

SEQ ID NO: 888837 - protein, 9 aa, Homo Sapiens
INFDKWRKE

SEQ ID NO: 888838 - protein, 9 aa, Homo Sapiens
ILEGNQIEI

SEQ ID NO: 888839 - protein, 9 aa, Homo Sapiens
TIAVVAGLL

SEQ ID NO: 888840 - protein, 9 aa, Homo Sapiens
SSSSSSSYS

SEQ ID NO: 888841 - protein, 9 aa, Homo Sapiens
HPALSPILP

SEQ ID NO: 888842 - protein, 9 aa, Homo Sapiens
SGSLLGSPD

SEQ ID NO: 888843 - protein, 9 aa, Homo Sapiens
IEISELNRA

SEQ ID NO: 888844 - protein, 9 aa, Homo Sapiens
PNDTRLSPI

SEQ ID NO: 888845 - protein, 9 aa, Homo Sapiens
GEDPRFKIV

SEQ ID NO: 888846 - protein, 9 aa, Homo Sapiens
EDTFQFCAH

SEQ ID NO: 888847 - protein, 9 aa, Homo Sapiens
FFQVSKNKI

SEQ ID NO: 888848 - protein, 9 aa, Homo Sapiens
QAFILDELT

SEQ ID NO: 888849 - protein, 9 aa, Homo Sapiens
YVDPRKYSE

SEQ ID NO: 888850 - protein, 9 aa, Homo Sapiens
ADLQFRPHT

SEQ ID NO: 888851 - protein, 9 aa, Homo Sapiens
PSICLSNFL

SEQ ID NO: 888852 - protein, 9 aa, Homo Sapiens
KITSKFVCR

SEQ ID NO: 888853 - protein, 9 aa, Homo Sapiens
SPPAARRLL

SEQ ID NO: 888854 - protein, 9 aa, Homo Sapiens
NQSKGMGSG

SEQ ID NO: 888855 - protein, 9 aa, Homo Sapiens
NLGYLQARS

SEQ ID NO: 888856 - protein, 9 aa, Homo Sapiens
DPLDLLKEY

SEQ ID NO: 888857 - protein, 9 aa, Homo Sapiens
QINIPPQRG

SEQ ID NO: 888858 - protein, 9 aa, Homo Sapiens
GMGVQNGTD

SEQ ID NO: 888859 - protein, 9 aa, Homo Sapiens
YHFGAIFSI

SEQ ID NO: 888860 - protein, 9 aa, Homo Sapiens
KQAVCLKCV

SEQ ID NO: 888861 - protein, 9 aa, Homo Sapiens
DLIFQLELS

SEQ ID NO: 888862 - protein, 9 aa, Homo Sapiens
SVLYANNKY

SEQ ID NO: 888863 - protein, 9 aa, Homo Sapiens
NIKSIIAIA

SEQ ID NO: 888864 - protein, 9 aa, Homo Sapiens
WCPLWSQTP

SEQ ID NO: 888865 - protein, 9 aa, Homo Sapiens
QSSLSVNSN

SEQ ID NO: 888866 - protein, 9 aa, Homo Sapiens
RHELNKAYC

SEQ ID NO: 888867 - protein, 9 aa, Homo Sapiens
KLKNSLKEA

SEQ ID NO: 888868 - protein, 9 aa, Homo Sapiens
LRSVNGAKI

SEQ ID NO: 888869 - protein, 9 aa, Homo Sapiens
FEHIIYQMD

SEQ ID NO: 888870 - protein, 9 aa, Homo Sapiens
QTRIIDSKT

SEQ ID NO: 888871 - protein, 9 aa, Homo Sapiens
GERSYECSE

SEQ ID NO: 888872 - protein, 9 aa, Homo Sapiens
DKLETPSDS

SEQ ID NO: 888873 - protein, 9 aa, Homo Sapiens
ITKCADIDV

SEQ ID NO: 888874 - protein, 9 aa, Homo Sapiens
FATAFNTND

SEQ ID NO: 888875 - protein, 9 aa, Homo Sapiens
HTSIEQDKE

SEQ ID NO: 888876 - protein, 9 aa, Homo Sapiens
HVCSHGDKL

SEQ ID NO: 888877 - protein, 9 aa, Homo Sapiens
GKYGPQWKH

SEQ ID NO: 888878 - protein, 9 aa, Homo Sapiens
ILGTTGLFL

SEQ ID NO: 888879 - protein, 9 aa, Homo Sapiens
KDKISALEQ

SEQ ID NO: 888880 - protein, 9 aa, Homo Sapiens
KGAGAGNPG

SEQ ID NO: 888881 - protein, 9 aa, Homo Sapiens
VLSLEDDKR

SEQ ID NO: 888882 - protein, 9 aa, Homo Sapiens
RWRLDKDSG

SEQ ID NO: 888883 - protein, 9 aa, Homo Sapiens
HSCTLANNF

SEQ ID NO: 888884 - protein, 9 aa, Homo Sapiens
LVHQTHMSS

SEQ ID NO: 888885 - protein, 9 aa, Homo Sapiens
EVFRAGNNS

SEQ ID NO: 888886 - protein, 9 aa, Homo Sapiens
KLEKVGSIF

SEQ ID NO: 888887 - protein, 9 aa, Homo Sapiens
ACQKTFSRS

SEQ ID NO: 888888 - protein, 9 aa, Homo Sapiens
EAIAQILNF

SEQ ID NO: 888889 - protein, 9 aa, Homo Sapiens
DLYQILKAY

SEQ ID NO: 888890 - protein, 9 aa, Homo Sapiens
IHLMFKTFH

SEQ ID NO: 888891 - protein, 9 aa, Homo Sapiens
VECLSDSSI

SEQ ID NO: 888892 - protein, 9 aa, Homo Sapiens
DEMNIELIR

SEQ ID NO: 888893 - protein, 9 aa, Homo Sapiens
PYECEIWNP

SEQ ID NO: 888894 - protein, 9 aa, Homo Sapiens
QTRKSINYS

SEQ ID NO: 888895 - protein, 9 aa, Homo Sapiens
HFSIHTGDK

SEQ ID NO: 888896 - protein, 9 aa, Homo Sapiens
FNTFFPLLG

SEQ ID NO: 888897 - protein, 9 aa, Homo Sapiens
EAFCNAVWS

SEQ ID NO: 888898 - protein, 9 aa, Homo Sapiens
SSLMPLTPL

SEQ ID NO: 888899 - protein, 9 aa, Homo Sapiens
ETRGGETQG

SEQ ID NO: 888900 - protein, 9 aa, Homo Sapiens
AVTFSILND

SEQ ID NO: 888901 - protein, 9 aa, Homo Sapiens
LALQGCGGD

SEQ ID NO: 888902 - protein, 9 aa, Homo Sapiens
FAFADTPNH

SEQ ID NO: 888903 - protein, 9 aa, Homo Sapiens
FFSPSLLKR

SEQ ID NO: 888904 - protein, 9 aa, Homo Sapiens
AILYLRFGV

SEQ ID NO: 888905 - protein, 9 aa, Homo Sapiens
VEDNRIYGG

SEQ ID NO: 888906 - protein, 9 aa, Homo Sapiens
KNHIGMGVC

SEQ ID NO: 888907 - protein, 9 aa, Homo Sapiens
VETVKANVR

SEQ ID NO: 888908 - protein, 9 aa, Homo Sapiens
LMLYHKHLR

SEQ ID NO: 888909 - protein, 9 aa, Homo Sapiens
EESVNKFLA

SEQ ID NO: 888910 - protein, 9 aa, Homo Sapiens
KELCETNAQ

SEQ ID NO: 888911 - protein, 9 aa, Homo Sapiens
LRGSNNVTL

SEQ ID NO: 888912 - protein, 9 aa, Homo Sapiens
DWLDQSSRI

SEQ ID NO: 888913 - protein, 9 aa, Homo Sapiens
NILRLYNYV

SEQ ID NO: 888914 - protein, 9 aa, Homo Sapiens
QDDLEQAAK

SEQ ID NO: 888915 - protein, 9 aa, Homo Sapiens
LGKACGRKI

SEQ ID NO: 888916 - protein, 9 aa, Homo Sapiens
VCSHGDKLF

SEQ ID NO: 888917 - protein, 9 aa, Homo Sapiens
KLQNGEFMT

SEQ ID NO: 888918 - protein, 9 aa, Homo Sapiens
LSTDTNKAS

SEQ ID NO: 888919 - protein, 9 aa, Homo Sapiens
MEDRMMTKM

SEQ ID NO: 888920 - protein, 9 aa, Homo Sapiens
CNDLYFNLQ

SEQ ID NO: 888921 - protein, 9 aa, Homo Sapiens
REVPPRFCH

SEQ ID NO: 888922 - protein, 9 aa, Homo Sapiens
ITKEKRPPQ

SEQ ID NO: 888923 - protein, 9 aa, Homo Sapiens
QMNPFVLID

SEQ ID NO: 888924 - protein, 9 aa, Homo Sapiens
PTRTPKTPQ

SEQ ID NO: 888925 - protein, 9 aa, Homo Sapiens
YIMSGPNSS

SEQ ID NO: 888926 - protein, 9 aa, Homo Sapiens
NSDDRQPQW

SEQ ID NO: 888927 - protein, 9 aa, Homo Sapiens
KSTKNINFS

SEQ ID NO: 888928 - protein, 9 aa, Homo Sapiens
GADIKSKNK

SEQ ID NO: 888929 - protein, 9 aa, Homo Sapiens
LRENPYFCK

SEQ ID NO: 888930 - protein, 9 aa, Homo Sapiens
TNDESIPFW

SEQ ID NO: 888931 - protein, 9 aa, Homo Sapiens
MCTLENVKN

SEQ ID NO: 888932 - protein, 9 aa, Homo Sapiens
KVLFIRLYL

SEQ ID NO: 888933 - protein, 9 aa, Homo Sapiens
SQNTLIALV

SEQ ID NO: 888934 - protein, 9 aa, Homo Sapiens
EPYPVEYEV

SEQ ID NO: 888935 - protein, 9 aa, Homo Sapiens
QIGLAQYSG

SEQ ID NO: 888936 - protein, 9 aa, Homo Sapiens
AYYLSAFSA

SEQ ID NO: 888937 - protein, 9 aa, Homo Sapiens
ELLKRQSHF

SEQ ID NO: 888938 - protein, 9 aa, Homo Sapiens
GSDLTQHQI

SEQ ID NO: 888939 - protein, 9 aa, Homo Sapiens
GERRFITVS

SEQ ID NO: 888940 - protein, 9 aa, Homo Sapiens
RTFRRRLNL

SEQ ID NO: 888941 - protein, 9 aa, Homo Sapiens
ETVEKETSF

SEQ ID NO: 888942 - protein, 9 aa, Homo Sapiens
FQLKDTEDN

SEQ ID NO: 888943 - protein, 9 aa, Homo Sapiens
QRHQLHKFL

SEQ ID NO: 888944 - protein, 9 aa, Homo Sapiens
SHSEHERQY

SEQ ID NO: 888945 - protein, 9 aa, Homo Sapiens
NGICLYGRP

SEQ ID NO: 888946 - protein, 9 aa, Homo Sapiens
VWFLRSMFA

SEQ ID NO: 888947 - protein, 9 aa, Homo Sapiens
NKREGFGIQ

SEQ ID NO: 888948 - protein, 9 aa, Homo Sapiens
SESQKKSTT

SEQ ID NO: 888949 - protein, 9 aa, Homo Sapiens
FFLNIVMFI

SEQ ID NO: 888950 - protein, 9 aa, Homo Sapiens
KFLFVEPLP

SEQ ID NO: 888951 - protein, 9 aa, Homo Sapiens
IKSKNKHGL

SEQ ID NO: 888952 - protein, 9 aa, Homo Sapiens
FKFKAKHRI

SEQ ID NO: 888953 - protein, 9 aa, Homo Sapiens
PEGQKTMYL

SEQ ID NO: 888954 - protein, 9 aa, Homo Sapiens
ELQSKGESN

SEQ ID NO: 888955 - protein, 9 aa, Homo Sapiens
NSEWLFLDQ

SEQ ID NO: 888956 - protein, 9 aa, Homo Sapiens
INHAPERLG

SEQ ID NO: 888957 - protein, 9 aa, Homo Sapiens
AKYLCIAEY

SEQ ID NO: 888958 - protein, 9 aa, Homo Sapiens
KTNSWLLRA

SEQ ID NO: 888959 - protein, 9 aa, Homo Sapiens
RNQRPGASI

SEQ ID NO: 888960 - protein, 9 aa, Homo Sapiens
DLAHVAEQN

SEQ ID NO: 888961 - protein, 9 aa, Homo Sapiens
QLKRVPQTG

SEQ ID NO: 888962 - protein, 9 aa, Homo Sapiens
RIKWTKLTL

SEQ ID NO: 888963 - protein, 9 aa, Homo Sapiens
LLQAQLINM

SEQ ID NO: 888964 - protein, 9 aa, Homo Sapiens
QDDAKLATR

SEQ ID NO: 888965 - protein, 9 aa, Homo Sapiens
VVFDEAILT

SEQ ID NO: 888966 - protein, 9 aa, Homo Sapiens
TTKKPPSGK

SEQ ID NO: 888967 - protein, 9 aa, Homo Sapiens
KAVYEEFWR

SEQ ID NO: 888968 - protein, 9 aa, Homo Sapiens
VAKQLFPNT

SEQ ID NO: 888969 - protein, 9 aa, Homo Sapiens
NRMHGLNNA

SEQ ID NO: 888970 - protein, 9 aa, Homo Sapiens
TAMQLLWFN

SEQ ID NO: 888971 - protein, 9 aa, Homo Sapiens
SLNQTLKDK

SEQ ID NO: 888972 - protein, 9 aa, Homo Sapiens
IRLGLQLHP

SEQ ID NO: 888973 - protein, 9 aa, Homo Sapiens
ARVAELEHG

SEQ ID NO: 888974 - protein, 9 aa, Homo Sapiens
KKNLTARDM

SEQ ID NO: 888975 - protein, 9 aa, Homo Sapiens
EATGIARMF

SEQ ID NO: 888976 - protein, 9 aa, Homo Sapiens
WRLEEMMWE

SEQ ID NO: 888977 - protein, 9 aa, Homo Sapiens
RNVMQISPD

SEQ ID NO: 888978 - protein, 9 aa, Homo Sapiens
LHLITHKQT

SEQ ID NO: 888979 - protein, 9 aa, Homo Sapiens
DANICQVIQ

SEQ ID NO: 888980 - protein, 9 aa, Homo Sapiens
WEKDLRTQF

SEQ ID NO: 888981 - protein, 9 aa, Homo Sapiens
SICNFPSAK

SEQ ID NO: 888982 - protein, 9 aa, Homo Sapiens
PLGNGITIP

SEQ ID NO: 888983 - protein, 9 aa, Homo Sapiens
DFLNKWSGA

SEQ ID NO: 888984 - protein, 9 aa, Homo Sapiens
MYYFDQGCV

SEQ ID NO: 888985 - protein, 9 aa, Homo Sapiens
DNRWEVRVG

SEQ ID NO: 888986 - protein, 9 aa, Homo Sapiens
QLCLHYRYF

SEQ ID NO: 888987 - protein, 9 aa, Homo Sapiens
LSFVNFCYS

SEQ ID NO: 888988 - protein, 9 aa, Homo Sapiens
LQRTARIPQ

SEQ ID NO: 888989 - protein, 9 aa, Homo Sapiens
SLLEDNDEK

SEQ ID NO: 888990 - protein, 9 aa, Homo Sapiens
VERVRSTIS

SEQ ID NO: 888991 - protein, 9 aa, Homo Sapiens
ICINQQTGQ

SEQ ID NO: 888992 - protein, 9 aa, Homo Sapiens
VCDLTQADH

SEQ ID NO: 888993 - protein, 9 aa, Homo Sapiens
DSKNFNDYM

SEQ ID NO: 888994 - protein, 9 aa, Homo Sapiens
WKISLSSHI

SEQ ID NO: 888995 - protein, 9 aa, Homo Sapiens
IVLFQKRWF

SEQ ID NO: 888996 - protein, 9 aa, Homo Sapiens
ILVILLVLG

SEQ ID NO: 888997 - protein, 9 aa, Homo Sapiens
QIKLGFTQG

SEQ ID NO: 888998 - protein, 9 aa, Homo Sapiens
AEKKCILHC

SEQ ID NO: 888999 - protein, 9 aa, Homo Sapiens
IKLTDYFTE

SEQ ID NO: 889000 - protein, 9 aa, Homo Sapiens
HSRTPQEMI

SEQ ID NO: 889001 - protein, 9 aa, Homo Sapiens
CQQEFFVDF

SEQ ID NO: 889002 - protein, 9 aa, Homo Sapiens
LYCEKENYP

SEQ ID NO: 889003 - protein, 9 aa, Homo Sapiens
STPEPQKKI

SEQ ID NO: 889004 - protein, 9 aa, Homo Sapiens
ENFLHTYSL

SEQ ID NO: 889005 - protein, 9 aa, Homo Sapiens
VLHNMVHCA

SEQ ID NO: 889006 - protein, 9 aa, Homo Sapiens
PPHPALSPI

SEQ ID NO: 889007 - protein, 9 aa, Homo Sapiens
LEINENCTL

SEQ ID NO: 889008 - protein, 9 aa, Homo Sapiens
RLQFGVTVI

SEQ ID NO: 889009 - protein, 9 aa, Homo Sapiens
HIHSHTGER

SEQ ID NO: 889010 - protein, 9 aa, Homo Sapiens
SYVLLTDIF

SEQ ID NO: 889011 - protein, 9 aa, Homo Sapiens
EYPVAFEYL

SEQ ID NO: 889012 - protein, 9 aa, Homo Sapiens
KIYQQHPEA

SEQ ID NO: 889013 - protein, 9 aa, Homo Sapiens
ENISDNVIV

SEQ ID NO: 889014 - protein, 9 aa, Homo Sapiens
DIFEDIIRG

SEQ ID NO: 889015 - protein, 9 aa, Homo Sapiens
GIIGANQVS

SEQ ID NO: 889016 - protein, 9 aa, Homo Sapiens
ASCEEVDGC

SEQ ID NO: 889017 - protein, 9 aa, Homo Sapiens
INPFVYYFV

SEQ ID NO: 889018 - protein, 9 aa, Homo Sapiens
GALLHLPSE

SEQ ID NO: 889019 - protein, 9 aa, Homo Sapiens
SRQTLMDNG

SEQ ID NO: 889020 - protein, 9 aa, Homo Sapiens
NLIKGRDGK

SEQ ID NO: 889021 - protein, 9 aa, Homo Sapiens
NGFLVCYLR

SEQ ID NO: 889022 - protein, 9 aa, Homo Sapiens
VLGMMAQTH

SEQ ID NO: 889023 - protein, 9 aa, Homo Sapiens
PVQFGSDDE

SEQ ID NO: 889024 - protein, 9 aa, Homo Sapiens
RLVPPQNLM

SEQ ID NO: 889025 - protein, 9 aa, Homo Sapiens
VDTQLQVVR

SEQ ID NO: 889026 - protein, 9 aa, Homo Sapiens
QTDITFKHI

SEQ ID NO: 889027 - protein, 9 aa, Homo Sapiens
LSTQVKGSL

SEQ ID NO: 889028 - protein, 9 aa, Homo Sapiens
LDYLYYLSV

SEQ ID NO: 889029 - protein, 9 aa, Homo Sapiens
PAVTLKNFL

SEQ ID NO: 889030 - protein, 9 aa, Homo Sapiens
TIHLRISPS

SEQ ID NO: 889031 - protein, 9 aa, Homo Sapiens
AVNKFQKSV

SEQ ID NO: 889032 - protein, 9 aa, Homo Sapiens
VRQTTELKV

SEQ ID NO: 889033 - protein, 9 aa, Homo Sapiens
GVVQDHSNN

SEQ ID NO: 889034 - protein, 9 aa, Homo Sapiens
CLNKYIQIH

SEQ ID NO: 889035 - protein, 9 aa, Homo Sapiens
EHAAFLRTL

SEQ ID NO: 889036 - protein, 9 aa, Homo Sapiens
SNKNILQCP

SEQ ID NO: 889037 - protein, 9 aa, Homo Sapiens
KESRRIDVL

SEQ ID NO: 889038 - protein, 9 aa, Homo Sapiens
VQMYYEMIK

SEQ ID NO: 889039 - protein, 9 aa, Homo Sapiens
CDDIQKARQ

SEQ ID NO: 889040 - protein, 9 aa, Homo Sapiens
AELTPKAVT

SEQ ID NO: 889041 - protein, 9 aa, Homo Sapiens
NHTFPRLNC

SEQ ID NO: 889042 - protein, 9 aa, Homo Sapiens
KLDENNTPM

SEQ ID NO: 889043 - protein, 9 aa, Homo Sapiens
TSNMYQVWQ

SEQ ID NO: 889044 - protein, 9 aa, Homo Sapiens
NALQLIKQY

SEQ ID NO: 889045 - protein, 9 aa, Homo Sapiens
PGRLVDHIN

SEQ ID NO: 889046 - protein, 9 aa, Homo Sapiens
EKQIKNFQT

SEQ ID NO: 889047 - protein, 9 aa, Homo Sapiens
KLHKLKKGL

SEQ ID NO: 889048 - protein, 9 aa, Homo Sapiens
SDTLIQLSV

SEQ ID NO: 889049 - protein, 9 aa, Homo Sapiens
PLTVLMAAP

SEQ ID NO: 889050 - protein, 9 aa, Homo Sapiens
VMFIVVMVQ

SEQ ID NO: 889051 - protein, 9 aa, Homo Sapiens
DINKCRHPG

SEQ ID NO: 889052 - protein, 9 aa, Homo Sapiens
LPVVLTLND

SEQ ID NO: 889053 - protein, 9 aa, Homo Sapiens
EAEGHHWHM

SEQ ID NO: 889054 - protein, 9 aa, Homo Sapiens
LIRNTLYKA

SEQ ID NO: 889055 - protein, 9 aa, Homo Sapiens
GVTGKNSNE

SEQ ID NO: 889056 - protein, 9 aa, Homo Sapiens
MVRSIILLY

SEQ ID NO: 889057 - protein, 9 aa, Homo Sapiens
SAVFEAGTL

SEQ ID NO: 889058 - protein, 9 aa, Homo Sapiens
DNPVHLKCN

SEQ ID NO: 889059 - protein, 9 aa, Homo Sapiens
QSHFQAGVS

SEQ ID NO: 889060 - protein, 9 aa, Homo Sapiens
SFTSPTVKR

SEQ ID NO: 889061 - protein, 9 aa, Homo Sapiens
YWQIWHMDL

SEQ ID NO: 889062 - protein, 9 aa, Homo Sapiens
KGRHKEIQD

SEQ ID NO: 889063 - protein, 9 aa, Homo Sapiens
RRQNPSCGS

SEQ ID NO: 889064 - protein, 9 aa, Homo Sapiens
LQIQNILTE

SEQ ID NO: 889065 - protein, 9 aa, Homo Sapiens
TNHEIPHFF

SEQ ID NO: 889066 - protein, 9 aa, Homo Sapiens
DLLSLQGVT

SEQ ID NO: 889067 - protein, 9 aa, Homo Sapiens
SIILLYFRM

SEQ ID NO: 889068 - protein, 9 aa, Homo Sapiens
GFASDCFLY

SEQ ID NO: 889069 - protein, 9 aa, Homo Sapiens
ARTIKIQNI

SEQ ID NO: 889070 - protein, 9 aa, Homo Sapiens
SREELNLMT

SEQ ID NO: 889071 - protein, 9 aa, Homo Sapiens
RYVDKYRND

SEQ ID NO: 889072 - protein, 9 aa, Homo Sapiens
DKAFEELRS

SEQ ID NO: 889073 - protein, 9 aa, Homo Sapiens
KRPFQNKCF

SEQ ID NO: 889074 - protein, 9 aa, Homo Sapiens
KLHCLVTIS

SEQ ID NO: 889075 - protein, 9 aa, Homo Sapiens
GSLRVCTVD

SEQ ID NO: 889076 - protein, 9 aa, Homo Sapiens
DKEENSDTE

SEQ ID NO: 889077 - protein, 9 aa, Homo Sapiens
DQGSTHSGD

SEQ ID NO: 889078 - protein, 9 aa, Homo Sapiens
MSTKNAAIL

SEQ ID NO: 889079 - protein, 9 aa, Homo Sapiens
RKNLYVKID

SEQ ID NO: 889080 - protein, 9 aa, Homo Sapiens
TPRRSCRQL

SEQ ID NO: 889081 - protein, 9 aa, Homo Sapiens
FFIYKRCLN

SEQ ID NO: 889082 - protein, 9 aa, Homo Sapiens
ALLMNRTNP

SEQ ID NO: 889083 - protein, 9 aa, Homo Sapiens
QVQRYTNAI

SEQ ID NO: 889084 - protein, 9 aa, Homo Sapiens
VGITWILAY

SEQ ID NO: 889085 - protein, 9 aa, Homo Sapiens
VWAKRGTAQ

SEQ ID NO: 889086 - protein, 9 aa, Homo Sapiens
LLVSRKSIP

SEQ ID NO: 889087 - protein, 9 aa, Homo Sapiens
EEQIDTPPA

SEQ ID NO: 889088 - protein, 9 aa, Homo Sapiens
NKCFQFKQM

SEQ ID NO: 889089 - protein, 9 aa, Homo Sapiens
HPKQEKAFS

SEQ ID NO: 889090 - protein, 9 aa, Homo Sapiens
MLLKQRNFL

SEQ ID NO: 889091 - protein, 9 aa, Homo Sapiens
NTLQRCIEK

SEQ ID NO: 889092 - protein, 9 aa, Homo Sapiens
LAVTSQSDS

SEQ ID NO: 889093 - protein, 9 aa, Homo Sapiens
RCEECDKAF

SEQ ID NO: 889094 - protein, 9 aa, Homo Sapiens
VLAKNNVLN

SEQ ID NO: 889095 - protein, 9 aa, Homo Sapiens
NSFLQEKTA

SEQ ID NO: 889096 - protein, 9 aa, Homo Sapiens
KGQTSVLLS

SEQ ID NO: 889097 - protein, 9 aa, Homo Sapiens
AFKTYSNIK

SEQ ID NO: 889098 - protein, 9 aa, Homo Sapiens
YLQQVTGHD

SEQ ID NO: 889099 - protein, 9 aa, Homo Sapiens
ELLGLDFGD

SEQ ID NO: 889100 - protein, 9 aa, Homo Sapiens
TEAFYKINT

SEQ ID NO: 889101 - protein, 9 aa, Homo Sapiens
HCFLKRRLE

SEQ ID NO: 889102 - protein, 9 aa, Homo Sapiens
SWTFKHLVY

SEQ ID NO: 889103 - protein, 9 aa, Homo Sapiens
PSADTVPWL

SEQ ID NO: 889104 - protein, 9 aa, Homo Sapiens
RLTKNIHPW

SEQ ID NO: 889105 - protein, 9 aa, Homo Sapiens
GAIHVIERC

SEQ ID NO: 889106 - protein, 9 aa, Homo Sapiens
GSTGEQICL

SEQ ID NO: 889107 - protein, 9 aa, Homo Sapiens
FNLKSVDDV

SEQ ID NO: 889108 - protein, 9 aa, Homo Sapiens
GIADDYDKN

SEQ ID NO: 889109 - protein, 9 aa, Homo Sapiens
FLLRNVMQI

SEQ ID NO: 889110 - protein, 9 aa, Homo Sapiens
RIEDPPHRK

SEQ ID NO: 889111 - protein, 9 aa, Homo Sapiens
DPKKEGPVA

SEQ ID NO: 889112 - protein, 9 aa, Homo Sapiens
KGALKKLIN

SEQ ID NO: 889113 - protein, 9 aa, Homo Sapiens
VLINILEVR

SEQ ID NO: 889114 - protein, 9 aa, Homo Sapiens
DEKVFWWES

SEQ ID NO: 889115 - protein, 9 aa, Homo Sapiens
FSYPSQKEV

SEQ ID NO: 889116 - protein, 9 aa, Homo Sapiens
RKRLIKQSR

SEQ ID NO: 889117 - protein, 9 aa, Homo Sapiens
HVFSGGRDT

SEQ ID NO: 889118 - protein, 9 aa, Homo Sapiens
QYFLKSSKE

SEQ ID NO: 889119 - protein, 9 aa, Homo Sapiens
VVICHLYNE

SEQ ID NO: 889120 - protein, 9 aa, Homo Sapiens
FNQASCLTR

SEQ ID NO: 889121 - protein, 9 aa, Homo Sapiens
NLDNIKRII

SEQ ID NO: 889122 - protein, 9 aa, Homo Sapiens
PGECLIQFL

SEQ ID NO: 889123 - protein, 9 aa, Homo Sapiens
LLSEKTEVK

SEQ ID NO: 889124 - protein, 9 aa, Homo Sapiens
FRRFSLEIS

SEQ ID NO: 889125 - protein, 9 aa, Homo Sapiens
NYHDAVTKA

SEQ ID NO: 889126 - protein, 9 aa, Homo Sapiens
SHRNKSELD

SEQ ID NO: 889127 - protein, 9 aa, Homo Sapiens
NQGEYICSA

SEQ ID NO: 889128 - protein, 9 aa, Homo Sapiens
MISSEHTET

SEQ ID NO: 889129 - protein, 9 aa, Homo Sapiens
WMAGGLVAH

SEQ ID NO: 889130 - protein, 9 aa, Homo Sapiens
LDCKRRETE

SEQ ID NO: 889131 - protein, 9 aa, Homo Sapiens
NQEKKSQEE

SEQ ID NO: 889132 - protein, 9 aa, Homo Sapiens
AEKEWGNGI

SEQ ID NO: 889133 - protein, 9 aa, Homo Sapiens
SVLESGTVW

SEQ ID NO: 889134 - protein, 9 aa, Homo Sapiens
ISGKVQTTT

SEQ ID NO: 889135 - protein, 9 aa, Homo Sapiens
FTVHQSPVT

SEQ ID NO: 889136 - protein, 9 aa, Homo Sapiens
AEEPCGVGT

SEQ ID NO: 889137 - protein, 9 aa, Homo Sapiens
GKGFSQSLH

SEQ ID NO: 889138 - protein, 9 aa, Homo Sapiens
VYGGNVVML

SEQ ID NO: 889139 - protein, 9 aa, Homo Sapiens
LLLLSIAVA

SEQ ID NO: 889140 - protein, 9 aa, Homo Sapiens
PGQCLSCQN

SEQ ID NO: 889141 - protein, 9 aa, Homo Sapiens
QQSNHSGEK

SEQ ID NO: 889142 - protein, 9 aa, Homo Sapiens
ARDKFTKAL

SEQ ID NO: 889143 - protein, 9 aa, Homo Sapiens
REELFKVLG

SEQ ID NO: 889144 - protein, 9 aa, Homo Sapiens
SWHRSSLSE

SEQ ID NO: 889145 - protein, 9 aa, Homo Sapiens
RCLMETNLS

SEQ ID NO: 889146 - protein, 9 aa, Homo Sapiens
RNFDEIIRV

SEQ ID NO: 889147 - protein, 9 aa, Homo Sapiens
RFGARRLQE

SEQ ID NO: 889148 - protein, 9 aa, Homo Sapiens
YDEEARREM

SEQ ID NO: 889149 - protein, 9 aa, Homo Sapiens
NLRSVNGAK

SEQ ID NO: 889150 - protein, 9 aa, Homo Sapiens
TTSRQQIPE

SEQ ID NO: 889151 - protein, 9 aa, Homo Sapiens
LKNFLIKPF

SEQ ID NO: 889152 - protein, 9 aa, Homo Sapiens
KTAVQYIEN

SEQ ID NO: 889153 - protein, 9 aa, Homo Sapiens
QFISHKLPN

SEQ ID NO: 889154 - protein, 9 aa, Homo Sapiens
EIIQTKAFQ

SEQ ID NO: 889155 - protein, 9 aa, Homo Sapiens
KRLCLAEMA

SEQ ID NO: 889156 - protein, 9 aa, Homo Sapiens
PVTVYVLVF

SEQ ID NO: 889157 - protein, 9 aa, Homo Sapiens
KPDNQTSLM

SEQ ID NO: 889158 - protein, 9 aa, Homo Sapiens
ILQFNSQPY

SEQ ID NO: 889159 - protein, 9 aa, Homo Sapiens
DWSSRPKNI

SEQ ID NO: 889160 - protein, 9 aa, Homo Sapiens
NDLDKRFQK

SEQ ID NO: 889161 - protein, 9 aa, Homo Sapiens
VLSQPGGKI

SEQ ID NO: 889162 - protein, 9 aa, Homo Sapiens
AAVATFIYA

SEQ ID NO: 889163 - protein, 9 aa, Homo Sapiens
EHLHQLTLQ

SEQ ID NO: 889164 - protein, 9 aa, Homo Sapiens
QVVFQNALE

SEQ ID NO: 889165 - protein, 9 aa, Homo Sapiens
SQKEIPFYL

SEQ ID NO: 889166 - protein, 9 aa, Homo Sapiens
FLDATTASH

SEQ ID NO: 889167 - protein, 9 aa, Homo Sapiens
HKASTQGRT

SEQ ID NO: 889168 - protein, 9 aa, Homo Sapiens
LLQFHRPDF

SEQ ID NO: 889169 - protein, 9 aa, Homo Sapiens
VDFRCDPNF

SEQ ID NO: 889170 - protein, 9 aa, Homo Sapiens
AFLTYDKVK

SEQ ID NO: 889171 - protein, 9 aa, Homo Sapiens
HPKWKNKVA

SEQ ID NO: 889172 - protein, 9 aa, Homo Sapiens
LESKIQRLS

SEQ ID NO: 889173 - protein, 9 aa, Homo Sapiens
MGIIKRNEK

SEQ ID NO: 889174 - protein, 9 aa, Homo Sapiens
VDPRKYSEK

SEQ ID NO: 889175 - protein, 9 aa, Homo Sapiens
IKEAVSTPS

SEQ ID NO: 889176 - protein, 9 aa, Homo Sapiens
LIQLWHWLQ

SEQ ID NO: 889177 - protein, 9 aa, Homo Sapiens
CETFPSLLE

SEQ ID NO: 889178 - protein, 9 aa, Homo Sapiens
STFQYDCFF

SEQ ID NO: 889179 - protein, 9 aa, Homo Sapiens
IPQLKQWKT

SEQ ID NO: 889180 - protein, 9 aa, Homo Sapiens
HYLQQVTGH

SEQ ID NO: 889181 - protein, 9 aa, Homo Sapiens
TGIPREPSR

SEQ ID NO: 889182 - protein, 9 aa, Homo Sapiens
RSTRSALRD

SEQ ID NO: 889183 - protein, 9 aa, Homo Sapiens
AISGLRHFT

SEQ ID NO: 889184 - protein, 9 aa, Homo Sapiens
IMKILWDTG

SEQ ID NO: 889185 - protein, 9 aa, Homo Sapiens
NVLSSLQGV

SEQ ID NO: 889186 - protein, 9 aa, Homo Sapiens
TQPSEKIWI

SEQ ID NO: 889187 - protein, 9 aa, Homo Sapiens
QTWNHNNMV

SEQ ID NO: 889188 - protein, 9 aa, Homo Sapiens
PNALEERFS

SEQ ID NO: 889189 - protein, 9 aa, Homo Sapiens
ESKVVFTEN

SEQ ID NO: 889190 - protein, 9 aa, Homo Sapiens
HQLHIIETK

SEQ ID NO: 889191 - protein, 9 aa, Homo Sapiens
TGLDSIGLA

SEQ ID NO: 889192 - protein, 9 aa, Homo Sapiens
ELPTHKQVF

SEQ ID NO: 889193 - protein, 9 aa, Homo Sapiens
CQCSFTAAD

SEQ ID NO: 889194 - protein, 9 aa, Homo Sapiens
GDRGENRQK

SEQ ID NO: 889195 - protein, 9 aa, Homo Sapiens
HYNAGVKQI

SEQ ID NO: 889196 - protein, 9 aa, Homo Sapiens
QAGGQLAST

SEQ ID NO: 889197 - protein, 9 aa, Homo Sapiens
PRYFELSNY

SEQ ID NO: 889198 - protein, 9 aa, Homo Sapiens
KTKDKLTPL

SEQ ID NO: 889199 - protein, 9 aa, Homo Sapiens
RSNRFCRDA

SEQ ID NO: 889200 - protein, 9 aa, Homo Sapiens
LGTAEPITV

SEQ ID NO: 889201 - protein, 9 aa, Homo Sapiens
NAGGFHSRS

SEQ ID NO: 889202 - protein, 9 aa, Homo Sapiens
VTLKNFLHW

SEQ ID NO: 889203 - protein, 9 aa, Homo Sapiens
VVISTNGEL

SEQ ID NO: 889204 - protein, 9 aa, Homo Sapiens
SISEIPRWG

SEQ ID NO: 889205 - protein, 9 aa, Homo Sapiens
KQREWKSIL

SEQ ID NO: 889206 - protein, 9 aa, Homo Sapiens
AQQRISKDL

SEQ ID NO: 889207 - protein, 9 aa, Homo Sapiens
SKTSEIEPN

SEQ ID NO: 889208 - protein, 9 aa, Homo Sapiens
DPQGNGSNL

SEQ ID NO: 889209 - protein, 9 aa, Homo Sapiens
NKPLPSADT

SEQ ID NO: 889210 - protein, 9 aa, Homo Sapiens
SRSVKLMPS

SEQ ID NO: 889211 - protein, 9 aa, Homo Sapiens
CSLFFAILL

SEQ ID NO: 889212 - protein, 9 aa, Homo Sapiens
NYKEPTLAL

SEQ ID NO: 889213 - protein, 9 aa, Homo Sapiens
NQLINHIKQ

SEQ ID NO: 889214 - protein, 9 aa, Homo Sapiens
VQLHAPQYQ

SEQ ID NO: 889215 - protein, 9 aa, Homo Sapiens
TFKDVAIEL

SEQ ID NO: 889216 - protein, 9 aa, Homo Sapiens
HLHLTGKIQ

SEQ ID NO: 889217 - protein, 9 aa, Homo Sapiens
QFGVTVIDN

SEQ ID NO: 889218 - protein, 9 aa, Homo Sapiens
PSPEVVQIL

SEQ ID NO: 889219 - protein, 9 aa, Homo Sapiens
EEIINAAVK

SEQ ID NO: 889220 - protein, 9 aa, Homo Sapiens
LSLLLWVLL

SEQ ID NO: 889221 - protein, 9 aa, Homo Sapiens
QQTLNYTVG

SEQ ID NO: 889222 - protein, 9 aa, Homo Sapiens
RRKGRHKEI

SEQ ID NO: 889223 - protein, 9 aa, Homo Sapiens
CITINTTIC

SEQ ID NO: 889224 - protein, 9 aa, Homo Sapiens
SRMCANERT

SEQ ID NO: 889225 - protein, 9 aa, Homo Sapiens
ISNVADDDS

SEQ ID NO: 889226 - protein, 9 aa, Homo Sapiens
SATLTAPYR

SEQ ID NO: 889227 - protein, 9 aa, Homo Sapiens
ECPTKLFPP

SEQ ID NO: 889228 - protein, 9 aa, Homo Sapiens
CPPYKENYG

SEQ ID NO: 889229 - protein, 9 aa, Homo Sapiens
VVNNDVVEH

SEQ ID NO: 889230 - protein, 9 aa, Homo Sapiens
LCTDTSVNR

SEQ ID NO: 889231 - protein, 9 aa, Homo Sapiens
WIGQLMHYD

SEQ ID NO: 889232 - protein, 9 aa, Homo Sapiens
FGQDYSTGY

SEQ ID NO: 889233 - protein, 9 aa, Homo Sapiens
NTTSRQQIP

SEQ ID NO: 889234 - protein, 9 aa, Homo Sapiens
RPRRYRAPN

SEQ ID NO: 889235 - protein, 9 aa, Homo Sapiens
FQIHTPPAK

SEQ ID NO: 889236 - protein, 9 aa, Homo Sapiens
GRFGQDYST

SEQ ID NO: 889237 - protein, 9 aa, Homo Sapiens
SGGGKNYGG

SEQ ID NO: 889238 - protein, 9 aa, Homo Sapiens
HMKVECPTK

SEQ ID NO: 889239 - protein, 9 aa, Homo Sapiens
LRHHNLHSW

SEQ ID NO: 889240 - protein, 9 aa, Homo Sapiens
EAMPRSIHD

SEQ ID NO: 889241 - protein, 9 aa, Homo Sapiens
KEVDEDFNG

SEQ ID NO: 889242 - protein, 9 aa, Homo Sapiens
NLAIAITKE

SEQ ID NO: 889243 - protein, 9 aa, Homo Sapiens
VTADRWKKY

SEQ ID NO: 889244 - protein, 9 aa, Homo Sapiens
RVCKNHRSR

SEQ ID NO: 889245 - protein, 9 aa, Homo Sapiens
RPGMHLPPP

SEQ ID NO: 889246 - protein, 9 aa, Homo Sapiens
TLHMQALPP

SEQ ID NO: 889247 - protein, 9 aa, Homo Sapiens
DVEASDKLS

SEQ ID NO: 889248 - protein, 9 aa, Homo Sapiens
DNTWKIIIK

SEQ ID NO: 889249 - protein, 9 aa, Homo Sapiens
NNSPLMEDF

SEQ ID NO: 889250 - protein, 9 aa, Homo Sapiens
GSRVCIKGA

SEQ ID NO: 889251 - protein, 9 aa, Homo Sapiens
VQLCADYRS

SEQ ID NO: 889252 - protein, 9 aa, Homo Sapiens
QAIQILETI

SEQ ID NO: 889253 - protein, 9 aa, Homo Sapiens
WDTGVFEHT

SEQ ID NO: 889254 - protein, 9 aa, Homo Sapiens
SQMLKDNKK

SEQ ID NO: 889255 - protein, 9 aa, Homo Sapiens
TVTPRTVHL

SEQ ID NO: 889256 - protein, 9 aa, Homo Sapiens
CHKPYLWVR

SEQ ID NO: 889257 - protein, 9 aa, Homo Sapiens
TGRSRLIKG

SEQ ID NO: 889258 - protein, 9 aa, Homo Sapiens
RNNRCNNLG

SEQ ID NO: 889259 - protein, 9 aa, Homo Sapiens
GDENKPTHA

SEQ ID NO: 889260 - protein, 9 aa, Homo Sapiens
ALLCPMRWE

SEQ ID NO: 889261 - protein, 9 aa, Homo Sapiens
NTSKTHPKQ

SEQ ID NO: 889262 - protein, 9 aa, Homo Sapiens
DHLSRRADD

SEQ ID NO: 889263 - protein, 9 aa, Homo Sapiens
VPAPPCPSI

SEQ ID NO: 889264 - protein, 9 aa, Homo Sapiens
ETGWGEFKI

SEQ ID NO: 889265 - protein, 9 aa, Homo Sapiens
AADTWVDIS

SEQ ID NO: 889266 - protein, 9 aa, Homo Sapiens
WISASSINK

SEQ ID NO: 889267 - protein, 9 aa, Homo Sapiens
GQEVKLCLE

SEQ ID NO: 889268 - protein, 9 aa, Homo Sapiens
LKALMLPSP

SEQ ID NO: 889269 - protein, 9 aa, Homo Sapiens
PGPYRLCQF

SEQ ID NO: 889270 - protein, 9 aa, Homo Sapiens
LQKRSVRDL

SEQ ID NO: 889271 - protein, 9 aa, Homo Sapiens
WQKVMLGTP

SEQ ID NO: 889272 - protein, 9 aa, Homo Sapiens
IYVIFGLCH

SEQ ID NO: 889273 - protein, 9 aa, Homo Sapiens
KNALQLIKQ

SEQ ID NO: 889274 - protein, 9 aa, Homo Sapiens
REELNLMTL

SEQ ID NO: 889275 - protein, 9 aa, Homo Sapiens
VLDDDDKDE

SEQ ID NO: 889276 - protein, 9 aa, Homo Sapiens
IRRSWSEAA

SEQ ID NO: 889277 - protein, 9 aa, Homo Sapiens
VLCSLNINV

SEQ ID NO: 889278 - protein, 9 aa, Homo Sapiens
KSSVSGICI

SEQ ID NO: 889279 - protein, 9 aa, Homo Sapiens
AEFKAPLEA

SEQ ID NO: 889280 - protein, 9 aa, Homo Sapiens
NRLLDMRNL

SEQ ID NO: 889281 - protein, 9 aa, Homo Sapiens
GVCLGNSPS

SEQ ID NO: 889282 - protein, 9 aa, Homo Sapiens
PQNLMGSSI

SEQ ID NO: 889283 - protein, 9 aa, Homo Sapiens
AAGVCNPQQ

SEQ ID NO: 889284 - protein, 9 aa, Homo Sapiens
ESVIKEENY

SEQ ID NO: 889285 - protein, 9 aa, Homo Sapiens
GILTNGVLS

SEQ ID NO: 889286 - protein, 9 aa, Homo Sapiens
NKLVKAFKK

SEQ ID NO: 889287 - protein, 9 aa, Homo Sapiens
WAKRGTAQG

SEQ ID NO: 889288 - protein, 9 aa, Homo Sapiens
IQPLNRRAI

SEQ ID NO: 889289 - protein, 9 aa, Homo Sapiens
LRFPLTQKH

SEQ ID NO: 889290 - protein, 9 aa, Homo Sapiens
IKQSREFKK

SEQ ID NO: 889291 - protein, 9 aa, Homo Sapiens
VQEEEDKGL

SEQ ID NO: 889292 - protein, 9 aa, Homo Sapiens
PGFPKAIKT

SEQ ID NO: 889293 - protein, 9 aa, Homo Sapiens
FFSGIVTAS

SEQ ID NO: 889294 - protein, 9 aa, Homo Sapiens
QCRVDYKVN

SEQ ID NO: 889295 - protein, 9 aa, Homo Sapiens
SVQMEGEGA

SEQ ID NO: 889296 - protein, 9 aa, Homo Sapiens
KEASRQTLM

SEQ ID NO: 889297 - protein, 9 aa, Homo Sapiens
QDIDLLIEE

SEQ ID NO: 889298 - protein, 9 aa, Homo Sapiens
AARRLDGED

SEQ ID NO: 889299 - protein, 9 aa, Homo Sapiens
KIVLSAPEG

SEQ ID NO: 889300 - protein, 9 aa, Homo Sapiens
GILSVQMEG

SEQ ID NO: 889301 - protein, 9 aa, Homo Sapiens
YHRIYLPPS

SEQ ID NO: 889302 - protein, 9 aa, Homo Sapiens
LKHKYIITS

SEQ ID NO: 889303 - protein, 9 aa, Homo Sapiens
LDGIPETCE

SEQ ID NO: 889304 - protein, 9 aa, Homo Sapiens
TLVVLPPVG

SEQ ID NO: 889305 - protein, 9 aa, Homo Sapiens
KSHHLHLYM

SEQ ID NO: 889306 - protein, 9 aa, Homo Sapiens
DHQIPNSQR

SEQ ID NO: 889307 - protein, 9 aa, Homo Sapiens
KWEALNLKK

SEQ ID NO: 889308 - protein, 9 aa, Homo Sapiens
VFFFVPCMF

SEQ ID NO: 889309 - protein, 9 aa, Homo Sapiens
ADIQEEIIN

SEQ ID NO: 889310 - protein, 9 aa, Homo Sapiens
IKGKVLCTY

SEQ ID NO: 889311 - protein, 9 aa, Homo Sapiens
NGTDTIVLQ

SEQ ID NO: 889312 - protein, 9 aa, Homo Sapiens
NQMTVAHMW

SEQ ID NO: 889313 - protein, 9 aa, Homo Sapiens
EPVTINCGH

SEQ ID NO: 889314 - protein, 9 aa, Homo Sapiens
LAKNRINHA

SEQ ID NO: 889315 - protein, 9 aa, Homo Sapiens
IPQIRIETR

SEQ ID NO: 889316 - protein, 9 aa, Homo Sapiens
HWINLTFGY

SEQ ID NO: 889317 - protein, 9 aa, Homo Sapiens
SHLEGWNMP

SEQ ID NO: 889318 - protein, 9 aa, Homo Sapiens
EDSDGAVLR

SEQ ID NO: 889319 - protein, 9 aa, Homo Sapiens
SHSSGNRNE

SEQ ID NO: 889320 - protein, 9 aa, Homo Sapiens
RCKNRTGTE

SEQ ID NO: 889321 - protein, 9 aa, Homo Sapiens
IQQEYETKL

SEQ ID NO: 889322 - protein, 9 aa, Homo Sapiens
TVDGPREPQ

SEQ ID NO: 889323 - protein, 9 aa, Homo Sapiens
PLEIPVARF

SEQ ID NO: 889324 - protein, 9 aa, Homo Sapiens
FLAYLENDI

SEQ ID NO: 889325 - protein, 9 aa, Homo Sapiens
EASDKVNLP

SEQ ID NO: 889326 - protein, 9 aa, Homo Sapiens
RRHTRSTED

SEQ ID NO: 889327 - protein, 9 aa, Homo Sapiens
LPYNDCFEY

SEQ ID NO: 889328 - protein, 9 aa, Homo Sapiens
CVYKVQSRL

SEQ ID NO: 889329 - protein, 9 aa, Homo Sapiens
KEQLQQEHC

SEQ ID NO: 889330 - protein, 9 aa, Homo Sapiens
NSERITVNK

SEQ ID NO: 889331 - protein, 9 aa, Homo Sapiens
KALKKKQQF

SEQ ID NO: 889332 - protein, 9 aa, Homo Sapiens
CCNYSLHVD

SEQ ID NO: 889333 - protein, 9 aa, Homo Sapiens
EKKTNQCKE

SEQ ID NO: 889334 - protein, 9 aa, Homo Sapiens
GLVAHLLSK

SEQ ID NO: 889335 - protein, 9 aa, Homo Sapiens
GNVEDIKRT

SEQ ID NO: 889336 - protein, 9 aa, Homo Sapiens
EDFHRKFHS

SEQ ID NO: 889337 - protein, 9 aa, Homo Sapiens
LVLSLGRRV

SEQ ID NO: 889338 - protein, 9 aa, Homo Sapiens
VEEDLKADK

SEQ ID NO: 889339 - protein, 9 aa, Homo Sapiens
FQYIGELCC

SEQ ID NO: 889340 - protein, 9 aa, Homo Sapiens
YDPALSQPQ

SEQ ID NO: 889341 - protein, 9 aa, Homo Sapiens
KDGIGLYLE

SEQ ID NO: 889342 - protein, 9 aa, Homo Sapiens
QEEPPASAY

SEQ ID NO: 889343 - protein, 9 aa, Homo Sapiens
GRMLLHFGQ

SEQ ID NO: 889344 - protein, 9 aa, Homo Sapiens
YSTRLVNPP

SEQ ID NO: 889345 - protein, 9 aa, Homo Sapiens
NPEEVKMPE

SEQ ID NO: 889346 - protein, 9 aa, Homo Sapiens
MATSGPGGI

SEQ ID NO: 889347 - protein, 9 aa, Homo Sapiens
YRAAMLEED

SEQ ID NO: 889348 - protein, 9 aa, Homo Sapiens
LIIQNAVVF

SEQ ID NO: 889349 - protein, 9 aa, Homo Sapiens
ANDKNLIPT

SEQ ID NO: 889350 - protein, 9 aa, Homo Sapiens
ERSGGNKKI

SEQ ID NO: 889351 - protein, 9 aa, Homo Sapiens
EIYQEDIRD

SEQ ID NO: 889352 - protein, 9 aa, Homo Sapiens
ICNRALIQY

SEQ ID NO: 889353 - protein, 9 aa, Homo Sapiens
ARLECRGGV

SEQ ID NO: 889354 - protein, 9 aa, Homo Sapiens
SGAIEEDIN

SEQ ID NO: 889355 - protein, 9 aa, Homo Sapiens
IQVHEWVPL

SEQ ID NO: 889356 - protein, 9 aa, Homo Sapiens
GDYDNSAFM

SEQ ID NO: 889357 - protein, 9 aa, Homo Sapiens
ITNGSQIEI

SEQ ID NO: 889358 - protein, 9 aa, Homo Sapiens
SHSKTYLIC

SEQ ID NO: 889359 - protein, 9 aa, Homo Sapiens
SHHAGLIEL

SEQ ID NO: 889360 - protein, 9 aa, Homo Sapiens
ETKKKEGKS

SEQ ID NO: 889361 - protein, 9 aa, Homo Sapiens
AECKAHELI

SEQ ID NO: 889362 - protein, 9 aa, Homo Sapiens
QNILAALKE

SEQ ID NO: 889363 - protein, 9 aa, Homo Sapiens
SISSIDKDA

SEQ ID NO: 889364 - protein, 9 aa, Homo Sapiens
DLATLMINF

SEQ ID NO: 889365 - protein, 9 aa, Homo Sapiens
RFHTGNTSF

SEQ ID NO: 889366 - protein, 9 aa, Homo Sapiens
DFVVAFNTS

SEQ ID NO: 889367 - protein, 9 aa, Homo Sapiens
TIQSVLMEM

SEQ ID NO: 889368 - protein, 9 aa, Homo Sapiens
TGKAIPIHL

SEQ ID NO: 889369 - protein, 9 aa, Homo Sapiens
EDYGHYKEL

SEQ ID NO: 889370 - protein, 9 aa, Homo Sapiens
DAVNKFQKS

SEQ ID NO: 889371 - protein, 9 aa, Homo Sapiens
QEGACVTVT

SEQ ID NO: 889372 - protein, 9 aa, Homo Sapiens
HKVFLQRLA

SEQ ID NO: 889373 - protein, 9 aa, Homo Sapiens
RDIKSKHVL

SEQ ID NO: 889374 - protein, 9 aa, Homo Sapiens
PQNHPYRYR

SEQ ID NO: 889375 - protein, 9 aa, Homo Sapiens
LTFLPARLP

SEQ ID NO: 889376 - protein, 9 aa, Homo Sapiens
CEPVFSEEL

SEQ ID NO: 889377 - protein, 9 aa, Homo Sapiens
FGVIVYQIT

SEQ ID NO: 889378 - protein, 9 aa, Homo Sapiens
LKNIRAFLT

SEQ ID NO: 889379 - protein, 9 aa, Homo Sapiens
HTYPQDPAW

SEQ ID NO: 889380 - protein, 9 aa, Homo Sapiens
YQVVRFCLQ

SEQ ID NO: 889381 - protein, 9 aa, Homo Sapiens
AAGEVTAPV

SEQ ID NO: 889382 - protein, 9 aa, Homo Sapiens
LWEVLPGNR

SEQ ID NO: 889383 - protein, 9 aa, Homo Sapiens
EFFKLARQT

SEQ ID NO: 889384 - protein, 9 aa, Homo Sapiens
GFNPRWMMM

SEQ ID NO: 889385 - protein, 9 aa, Homo Sapiens
EKILNRKIG

SEQ ID NO: 889386 - protein, 9 aa, Homo Sapiens
GVSPQNSLE

SEQ ID NO: 889387 - protein, 9 aa, Homo Sapiens
NQRPGASIQ

SEQ ID NO: 889388 - protein, 9 aa, Homo Sapiens
EIKCDFKFK

SEQ ID NO: 889389 - protein, 9 aa, Homo Sapiens
LPDIYPNLL

SEQ ID NO: 889390 - protein, 9 aa, Homo Sapiens
LQTTALDLE

SEQ ID NO: 889391 - protein, 9 aa, Homo Sapiens
LNKYIQIHT

SEQ ID NO: 889392 - protein, 9 aa, Homo Sapiens
VQLALIISS

SEQ ID NO: 889393 - protein, 9 aa, Homo Sapiens
EETAWREKQ

SEQ ID NO: 889394 - protein, 9 aa, Homo Sapiens
SKWVMESTV

SEQ ID NO: 889395 - protein, 9 aa, Homo Sapiens
LPVSSRVKR

SEQ ID NO: 889396 - protein, 9 aa, Homo Sapiens
AGGQLASTR

SEQ ID NO: 889397 - protein, 9 aa, Homo Sapiens
LKELDNLEI

SEQ ID NO: 889398 - protein, 9 aa, Homo Sapiens
SDGVTKSHH

SEQ ID NO: 889399 - protein, 9 aa, Homo Sapiens
QRPGASIQE

SEQ ID NO: 889400 - protein, 9 aa, Homo Sapiens
RYETPKRVL

SEQ ID NO: 889401 - protein, 9 aa, Homo Sapiens
EPSAWKWML

SEQ ID NO: 889402 - protein, 9 aa, Homo Sapiens
MFIVNSASY

SEQ ID NO: 889403 - protein, 9 aa, Homo Sapiens
HGHADACNA

SEQ ID NO: 889404 - protein, 9 aa, Homo Sapiens
IPDSLLLSS

SEQ ID NO: 889405 - protein, 9 aa, Homo Sapiens
KFFNKMKKW

SEQ ID NO: 889406 - protein, 9 aa, Homo Sapiens
LQIIGFAAE

SEQ ID NO: 889407 - protein, 9 aa, Homo Sapiens
SMKPNVEFT

SEQ ID NO: 889408 - protein, 9 aa, Homo Sapiens
SMEFQRKGS

SEQ ID NO: 889409 - protein, 9 aa, Homo Sapiens
NICGLNASE

SEQ ID NO: 889410 - protein, 9 aa, Homo Sapiens
RRRRRTFNQ

SEQ ID NO: 889411 - protein, 9 aa, Homo Sapiens
QIQNMVSSG

SEQ ID NO: 889412 - protein, 9 aa, Homo Sapiens
VLDHYTYSA

SEQ ID NO: 889413 - protein, 9 aa, Homo Sapiens
QLFCDIPSL

SEQ ID NO: 889414 - protein, 9 aa, Homo Sapiens
HGKKLQNYY

SEQ ID NO: 889415 - protein, 9 aa, Homo Sapiens
SVLCTENEI

SEQ ID NO: 889416 - protein, 9 aa, Homo Sapiens
NKHCYLLVH

SEQ ID NO: 889417 - protein, 9 aa, Homo Sapiens
DGGVQTGND

SEQ ID NO: 889418 - protein, 9 aa, Homo Sapiens
LISHKRSHT

SEQ ID NO: 889419 - protein, 9 aa, Homo Sapiens
MVALEQAGC

SEQ ID NO: 889420 - protein, 9 aa, Homo Sapiens
AGPETFCGA

SEQ ID NO: 889421 - protein, 9 aa, Homo Sapiens
WSHANKPPY

SEQ ID NO: 889422 - protein, 9 aa, Homo Sapiens
KNVINNFFC

SEQ ID NO: 889423 - protein, 9 aa, Homo Sapiens
SPMNFHPES

SEQ ID NO: 889424 - protein, 9 aa, Homo Sapiens
SEVRRLYVP

SEQ ID NO: 889425 - protein, 9 aa, Homo Sapiens
ADEAYKLLS

SEQ ID NO: 889426 - protein, 9 aa, Homo Sapiens
GTMKDICEN

SEQ ID NO: 889427 - protein, 9 aa, Homo Sapiens
IYYGEQQST

SEQ ID NO: 889428 - protein, 9 aa, Homo Sapiens
KNKKLAEWL

SEQ ID NO: 889429 - protein, 9 aa, Homo Sapiens
RINAGIDFG

SEQ ID NO: 889430 - protein, 9 aa, Homo Sapiens
NDLGYGYGC

SEQ ID NO: 889431 - protein, 9 aa, Homo Sapiens
EAVLELDKR

SEQ ID NO: 889432 - protein, 9 aa, Homo Sapiens
FILGVVYTS

SEQ ID NO: 889433 - protein, 9 aa, Homo Sapiens
GWLKIIRVD

SEQ ID NO: 889434 - protein, 9 aa, Homo Sapiens
LLTNGQWND

SEQ ID NO: 889435 - protein, 9 aa, Homo Sapiens
TMQWLIERE

SEQ ID NO: 889436 - protein, 9 aa, Homo Sapiens
LSVCLGDLI

SEQ ID NO: 889437 - protein, 9 aa, Homo Sapiens
RSAWAMYFK

SEQ ID NO: 889438 - protein, 9 aa, Homo Sapiens
SSGSYWVSL

SEQ ID NO: 889439 - protein, 9 aa, Homo Sapiens
QPNVKWSDV

SEQ ID NO: 889440 - protein, 9 aa, Homo Sapiens
TGRPKRQTR

SEQ ID NO: 889441 - protein, 9 aa, Homo Sapiens
TVHEWKQKH

SEQ ID NO: 889442 - protein, 9 aa, Homo Sapiens
QQNILAALK

SEQ ID NO: 889443 - protein, 9 aa, Homo Sapiens
KHPYELLLT

SEQ ID NO: 889444 - protein, 9 aa, Homo Sapiens
HCPFYSWER

SEQ ID NO: 889445 - protein, 9 aa, Homo Sapiens
WQFKQREWK

SEQ ID NO: 889446 - protein, 9 aa, Homo Sapiens
LRQKFLSER

SEQ ID NO: 889447 - protein, 9 aa, Homo Sapiens
DLLIKVGSF

SEQ ID NO: 889448 - protein, 9 aa, Homo Sapiens
NNSFHSMPE

SEQ ID NO: 889449 - protein, 9 aa, Homo Sapiens
SSLNELNPM

SEQ ID NO: 889450 - protein, 9 aa, Homo Sapiens
FLFNTICMS

SEQ ID NO: 889451 - protein, 9 aa, Homo Sapiens
RRFKTHNKH

SEQ ID NO: 889452 - protein, 9 aa, Homo Sapiens
DSGACKIHL

SEQ ID NO: 889453 - protein, 9 aa, Homo Sapiens
EEHLGRAVF

SEQ ID NO: 889454 - protein, 9 aa, Homo Sapiens
AGKDGDKNP

SEQ ID NO: 889455 - protein, 9 aa, Homo Sapiens
PYAGAVHKF

SEQ ID NO: 889456 - protein, 9 aa, Homo Sapiens
RRHNEFQSL

SEQ ID NO: 889457 - protein, 9 aa, Homo Sapiens
HSLHQKKLQ

SEQ ID NO: 889458 - protein, 9 aa, Homo Sapiens
EHIIYQMDD

SEQ ID NO: 889459 - protein, 9 aa, Homo Sapiens
SCLIQLWHW

SEQ ID NO: 889460 - protein, 9 aa, Homo Sapiens
RHSNEWKTV

SEQ ID NO: 889461 - protein, 9 aa, Homo Sapiens
KMQQNIGKT

SEQ ID NO: 889462 - protein, 9 aa, Homo Sapiens
TSFVAAVKF

SEQ ID NO: 889463 - protein, 9 aa, Homo Sapiens
VMVMISSEH

SEQ ID NO: 889464 - protein, 9 aa, Homo Sapiens
SRIQSIPSL

SEQ ID NO: 889465 - protein, 9 aa, Homo Sapiens
RCLCQQHDD

SEQ ID NO: 889466 - protein, 9 aa, Homo Sapiens
RISPSLPPA

SEQ ID NO: 889467 - protein, 9 aa, Homo Sapiens
HEKSLGLEL

SEQ ID NO: 889468 - protein, 9 aa, Homo Sapiens
PQIRIETRQ

SEQ ID NO: 889469 - protein, 9 aa, Homo Sapiens
AGTGHYLQQ

SEQ ID NO: 889470 - protein, 9 aa, Homo Sapiens
APIVKPHSF

SEQ ID NO: 889471 - protein, 9 aa, Homo Sapiens
DQTRIWFML

SEQ ID NO: 889472 - protein, 9 aa, Homo Sapiens
RWLQNWQKS

SEQ ID NO: 889473 - protein, 9 aa, Homo Sapiens
AGLYSDRMS

SEQ ID NO: 889474 - protein, 9 aa, Homo Sapiens
IHTEDNKRQ

SEQ ID NO: 889475 - protein, 9 aa, Homo Sapiens
NMQFLLFVL

SEQ ID NO: 889476 - protein, 9 aa, Homo Sapiens
STEATKLLQ

SEQ ID NO: 889477 - protein, 9 aa, Homo Sapiens
KQIELKSRS

SEQ ID NO: 889478 - protein, 9 aa, Homo Sapiens
SELIEQNQR

SEQ ID NO: 889479 - protein, 9 aa, Homo Sapiens
PVNRRHHCH

SEQ ID NO: 889480 - protein, 9 aa, Homo Sapiens
YMSQFPKVW

SEQ ID NO: 889481 - protein, 9 aa, Homo Sapiens
ALWECLVHE

SEQ ID NO: 889482 - protein, 9 aa, Homo Sapiens
LSLFAVHHS

SEQ ID NO: 889483 - protein, 9 aa, Homo Sapiens
ILNMVVALK

SEQ ID NO: 889484 - protein, 9 aa, Homo Sapiens
SAAVEKGTG

SEQ ID NO: 889485 - protein, 9 aa, Homo Sapiens
QARREGFDK

SEQ ID NO: 889486 - protein, 9 aa, Homo Sapiens
PLQMHCIRA

SEQ ID NO: 889487 - protein, 9 aa, Homo Sapiens
VKCTPSPRL

SEQ ID NO: 889488 - protein, 9 aa, Homo Sapiens
AFSICFTDT

SEQ ID NO: 889489 - protein, 9 aa, Homo Sapiens
AGCAEILGK

SEQ ID NO: 889490 - protein, 9 aa, Homo Sapiens
LCIHFICIY

SEQ ID NO: 889491 - protein, 9 aa, Homo Sapiens
CVSTDDSYS

SEQ ID NO: 889492 - protein, 9 aa, Homo Sapiens
VLLGFPGLQ

SEQ ID NO: 889493 - protein, 9 aa, Homo Sapiens
YQEPSNSHS

SEQ ID NO: 889494 - protein, 9 aa, Homo Sapiens
YRRVLCMYD

SEQ ID NO: 889495 - protein, 9 aa, Homo Sapiens
NMQHSRDHG

SEQ ID NO: 889496 - protein, 9 aa, Homo Sapiens
RYHKDIFGA

SEQ ID NO: 889497 - protein, 9 aa, Homo Sapiens
VLASREWLP

SEQ ID NO: 889498 - protein, 9 aa, Homo Sapiens
DGSDDAGCL

SEQ ID NO: 889499 - protein, 9 aa, Homo Sapiens
GDCPESLQK

SEQ ID NO: 889500 - protein, 9 aa, Homo Sapiens
KTGYLVEIL

SEQ ID NO: 889501 - protein, 9 aa, Homo Sapiens
IKWDYIATQ

SEQ ID NO: 889502 - protein, 9 aa, Homo Sapiens
KINTLYYQL

SEQ ID NO: 889503 - protein, 9 aa, Homo Sapiens
VYLYRRLGE

SEQ ID NO: 889504 - protein, 9 aa, Homo Sapiens
LGAMPYVCD

SEQ ID NO: 889505 - protein, 9 aa, Homo Sapiens
LLCFDSRQR

SEQ ID NO: 889506 - protein, 9 aa, Homo Sapiens
YFVGKWMNK

SEQ ID NO: 889507 - protein, 9 aa, Homo Sapiens
FNTIHEEFP

SEQ ID NO: 889508 - protein, 9 aa, Homo Sapiens
IEQNQRYVE

SEQ ID NO: 889509 - protein, 9 aa, Homo Sapiens
PREPQRHRQ

SEQ ID NO: 889510 - protein, 9 aa, Homo Sapiens
IISQEECSS

SEQ ID NO: 889511 - protein, 9 aa, Homo Sapiens
TDSQPFHPS

SEQ ID NO: 889512 - protein, 9 aa, Homo Sapiens
PCRCEECDK

SEQ ID NO: 889513 - protein, 9 aa, Homo Sapiens
SLGYPTLWI

SEQ ID NO: 889514 - protein, 9 aa, Homo Sapiens
DKLPINGET

SEQ ID NO: 889515 - protein, 9 aa, Homo Sapiens
LLLPVLDIS

SEQ ID NO: 889516 - protein, 9 aa, Homo Sapiens
GKYSIDIDI

SEQ ID NO: 889517 - protein, 9 aa, Homo Sapiens
ENQGSYFGV

SEQ ID NO: 889518 - protein, 9 aa, Homo Sapiens
CLMNYFSLA

SEQ ID NO: 889519 - protein, 9 aa, Homo Sapiens
LEFHFEPNN

SEQ ID NO: 889520 - protein, 9 aa, Homo Sapiens
HYRQCALLQ

SEQ ID NO: 889521 - protein, 9 aa, Homo Sapiens
DMKGALKKL

SEQ ID NO: 889522 - protein, 9 aa, Homo Sapiens
MKMAHYPPG

SEQ ID NO: 889523 - protein, 9 aa, Homo Sapiens
KNHPVQFGS

SEQ ID NO: 889524 - protein, 9 aa, Homo Sapiens
QNPRGEEGG

SEQ ID NO: 889525 - protein, 9 aa, Homo Sapiens
HQNHYRVYN

SEQ ID NO: 889526 - protein, 9 aa, Homo Sapiens
TELQVWDLE

SEQ ID NO: 889527 - protein, 9 aa, Homo Sapiens
AIQHKRTVA

SEQ ID NO: 889528 - protein, 9 aa, Homo Sapiens
KTILLCILR

SEQ ID NO: 889529 - protein, 9 aa, Homo Sapiens
RTCHESYNQ

SEQ ID NO: 889530 - protein, 9 aa, Homo Sapiens
DRPKHEENL

SEQ ID NO: 889531 - protein, 9 aa, Homo Sapiens
LTGEGMDEM

SEQ ID NO: 889532 - protein, 9 aa, Homo Sapiens
NETDFLIDI

SEQ ID NO: 889533 - protein, 9 aa, Homo Sapiens
MMVDYLYQN

SEQ ID NO: 889534 - protein, 9 aa, Homo Sapiens
TEATKLLQN

SEQ ID NO: 889535 - protein, 9 aa, Homo Sapiens
ALKLGYAEK

SEQ ID NO: 889536 - protein, 9 aa, Homo Sapiens
LQSQVVAVT

SEQ ID NO: 889537 - protein, 9 aa, Homo Sapiens
VSNQTLNLF

SEQ ID NO: 889538 - protein, 9 aa, Homo Sapiens
HMLNRLRES

SEQ ID NO: 889539 - protein, 9 aa, Homo Sapiens
IWYKGQMTN

SEQ ID NO: 889540 - protein, 9 aa, Homo Sapiens
AFLLGLPAL

SEQ ID NO: 889541 - protein, 9 aa, Homo Sapiens
YGQIHMYKQ

SEQ ID NO: 889542 - protein, 9 aa, Homo Sapiens
SMGIKEVAS

SEQ ID NO: 889543 - protein, 9 aa, Homo Sapiens
IWTFFIHFQ

SEQ ID NO: 889544 - protein, 9 aa, Homo Sapiens
CPDTCVWEG

SEQ ID NO: 889545 - protein, 9 aa, Homo Sapiens
GVMFFLNIV

SEQ ID NO: 889546 - protein, 9 aa, Homo Sapiens
LLLYGADIK

SEQ ID NO: 889547 - protein, 9 aa, Homo Sapiens
SSKINLESQ

SEQ ID NO: 889548 - protein, 9 aa, Homo Sapiens
SDLLCPEAY

SEQ ID NO: 889549 - protein, 9 aa, Homo Sapiens
KQEKSPQDP

SEQ ID NO: 889550 - protein, 9 aa, Homo Sapiens
TSSTTGYKH

SEQ ID NO: 889551 - protein, 9 aa, Homo Sapiens
FVEPNRNKY

SEQ ID NO: 889552 - protein, 9 aa, Homo Sapiens
ASLINERNS

SEQ ID NO: 889553 - protein, 9 aa, Homo Sapiens
QPGVETDNW

SEQ ID NO: 889554 - protein, 9 aa, Homo Sapiens
SDDKVSTII

SEQ ID NO: 889555 - protein, 9 aa, Homo Sapiens
VLQPTPIAR

SEQ ID NO: 889556 - protein, 9 aa, Homo Sapiens
KEVFKEIIG

SEQ ID NO: 889557 - protein, 9 aa, Homo Sapiens
LNAQHINLT

SEQ ID NO: 889558 - protein, 9 aa, Homo Sapiens
LLNTRESDR

SEQ ID NO: 889559 - protein, 9 aa, Homo Sapiens
LSHTKPSKL

SEQ ID NO: 889560 - protein, 9 aa, Homo Sapiens
DTMKFLNDR

SEQ ID NO: 889561 - protein, 9 aa, Homo Sapiens
YLDVCIPSQ

SEQ ID NO: 889562 - protein, 9 aa, Homo Sapiens
DDIIKRNPD

SEQ ID NO: 889563 - protein, 9 aa, Homo Sapiens
RIQMDSYTS

SEQ ID NO: 889564 - protein, 9 aa, Homo Sapiens
DGIVKAAKS

SEQ ID NO: 889565 - protein, 9 aa, Homo Sapiens
VLFIRLYLL

SEQ ID NO: 889566 - protein, 9 aa, Homo Sapiens
HSAADDYTS

SEQ ID NO: 889567 - protein, 9 aa, Homo Sapiens
IIVDYILFK

SEQ ID NO: 889568 - protein, 9 aa, Homo Sapiens
TVVTSCQPN

SEQ ID NO: 889569 - protein, 9 aa, Homo Sapiens
RTVHEWKQK

SEQ ID NO: 889570 - protein, 9 aa, Homo Sapiens
IWNEICYNI

SEQ ID NO: 889571 - protein, 9 aa, Homo Sapiens
EIMQESPDP

SEQ ID NO: 889572 - protein, 9 aa, Homo Sapiens
NSNKKKKAK

SEQ ID NO: 889573 - protein, 9 aa, Homo Sapiens
TASSTGCVT

SEQ ID NO: 889574 - protein, 9 aa, Homo Sapiens
KPFKDALRV

SEQ ID NO: 889575 - protein, 9 aa, Homo Sapiens
ENTCKTQKT

SEQ ID NO: 889576 - protein, 9 aa, Homo Sapiens
SYEDIQNVV

SEQ ID NO: 889577 - protein, 9 aa, Homo Sapiens
SGETHSREM

SEQ ID NO: 889578 - protein, 9 aa, Homo Sapiens
EEMAFFGTS

SEQ ID NO: 889579 - protein, 9 aa, Homo Sapiens
RDDCGWFVT

SEQ ID NO: 889580 - protein, 9 aa, Homo Sapiens
LRFWVNVIN

SEQ ID NO: 889581 - protein, 9 aa, Homo Sapiens
VIQNSNKNI

SEQ ID NO: 889582 - protein, 9 aa, Homo Sapiens
LNEWSLKVE

SEQ ID NO: 889583 - protein, 9 aa, Homo Sapiens
TNNPRFGKM

SEQ ID NO: 889584 - protein, 9 aa, Homo Sapiens
PADNHEELS

SEQ ID NO: 889585 - protein, 9 aa, Homo Sapiens
EQHPGASTS

SEQ ID NO: 889586 - protein, 9 aa, Homo Sapiens
LRLLRSGLS

SEQ ID NO: 889587 - protein, 9 aa, Homo Sapiens
LARYFLWHT

SEQ ID NO: 889588 - protein, 9 aa, Homo Sapiens
WRLHQYVKF

SEQ ID NO: 889589 - protein, 9 aa, Homo Sapiens
FPKVWILRL

SEQ ID NO: 889590 - protein, 9 aa, Homo Sapiens
RNFMIDTYC

SEQ ID NO: 889591 - protein, 9 aa, Homo Sapiens
RTGGFLIEV

SEQ ID NO: 889592 - protein, 9 aa, Homo Sapiens
NSAFMEPRY

SEQ ID NO: 889593 - protein, 9 aa, Homo Sapiens
ELPLDNICG

SEQ ID NO: 889594 - protein, 9 aa, Homo Sapiens
LPTPWKISL

SEQ ID NO: 889595 - protein, 9 aa, Homo Sapiens
NKHSLERYL

SEQ ID NO: 889596 - protein, 9 aa, Homo Sapiens
DLSGIALGG

SEQ ID NO: 889597 - protein, 9 aa, Homo Sapiens
NFRPQNELI

SEQ ID NO: 889598 - protein, 9 aa, Homo Sapiens
TLIEAIWLY

SEQ ID NO: 889599 - protein, 9 aa, Homo Sapiens
QKLLQCELE

SEQ ID NO: 889600 - protein, 9 aa, Homo Sapiens
TKSSQMETV

SEQ ID NO: 889601 - protein, 9 aa, Homo Sapiens
RATALTPDL

SEQ ID NO: 889602 - protein, 9 aa, Homo Sapiens
DKKILLKIP

SEQ ID NO: 889603 - protein, 9 aa, Homo Sapiens
WRHVAVRKY

SEQ ID NO: 889604 - protein, 9 aa, Homo Sapiens
QRLVSLETL

SEQ ID NO: 889605 - protein, 9 aa, Homo Sapiens
PLPPKKTQI

SEQ ID NO: 889606 - protein, 9 aa, Homo Sapiens
KRIMAHKWM

SEQ ID NO: 889607 - protein, 9 aa, Homo Sapiens
KLTLDYLKE

SEQ ID NO: 889608 - protein, 9 aa, Homo Sapiens
VVCSVFLML

SEQ ID NO: 889609 - protein, 9 aa, Homo Sapiens
AGFPRCPPP

SEQ ID NO: 889610 - protein, 9 aa, Homo Sapiens
SSNKWTGET

SEQ ID NO: 889611 - protein, 9 aa, Homo Sapiens
PTKMDLLYS

SEQ ID NO: 889612 - protein, 9 aa, Homo Sapiens
TCNRKKDEN

SEQ ID NO: 889613 - protein, 9 aa, Homo Sapiens
VGSEKTQIG

SEQ ID NO: 889614 - protein, 9 aa, Homo Sapiens
GSPSRPLSQ

SEQ ID NO: 889615 - protein, 9 aa, Homo Sapiens
SDSGHSMKW

SEQ ID NO: 889616 - protein, 9 aa, Homo Sapiens
ERYETPKRV

SEQ ID NO: 889617 - protein, 9 aa, Homo Sapiens
LVTMAYDRY

SEQ ID NO: 889618 - protein, 9 aa, Homo Sapiens
RHNLDALLN

SEQ ID NO: 889619 - protein, 9 aa, Homo Sapiens
KHNSIDETL

SEQ ID NO: 889620 - protein, 9 aa, Homo Sapiens
YRFCTKNRE

SEQ ID NO: 889621 - protein, 9 aa, Homo Sapiens
LRNRVCIAE

SEQ ID NO: 889622 - protein, 9 aa, Homo Sapiens
CSFADAQGC

SEQ ID NO: 889623 - protein, 9 aa, Homo Sapiens
GWGEFKIII

SEQ ID NO: 889624 - protein, 9 aa, Homo Sapiens
DEGPRSDME

SEQ ID NO: 889625 - protein, 9 aa, Homo Sapiens
SVGSAIWNQ

SEQ ID NO: 889626 - protein, 9 aa, Homo Sapiens
NYRTFLGSI

SEQ ID NO: 889627 - protein, 9 aa, Homo Sapiens
NFFCDLPPL

SEQ ID NO: 889628 - protein, 9 aa, Homo Sapiens
MDTNLQGRL

SEQ ID NO: 889629 - protein, 9 aa, Homo Sapiens
TPCTLTARL

SEQ ID NO: 889630 - protein, 9 aa, Homo Sapiens
TEANSNKES

SEQ ID NO: 889631 - protein, 9 aa, Homo Sapiens
SIEVANVND

SEQ ID NO: 889632 - protein, 9 aa, Homo Sapiens
QMEGEGAIN

SEQ ID NO: 889633 - protein, 9 aa, Homo Sapiens
MAWELPKIA

SEQ ID NO: 889634 - protein, 9 aa, Homo Sapiens
LEDNPSICA

SEQ ID NO: 889635 - protein, 9 aa, Homo Sapiens
KEISGCCSG

SEQ ID NO: 889636 - protein, 9 aa, Homo Sapiens
VEDDANMEQ

SEQ ID NO: 889637 - protein, 9 aa, Homo Sapiens
ITANLVAPI

SEQ ID NO: 889638 - protein, 9 aa, Homo Sapiens
GTEHLWLTR

SEQ ID NO: 889639 - protein, 9 aa, Homo Sapiens
YFLSSLLGT

SEQ ID NO: 889640 - protein, 9 aa, Homo Sapiens
SPDIAKYMP

SEQ ID NO: 889641 - protein, 9 aa, Homo Sapiens
KSYEIIVED

SEQ ID NO: 889642 - protein, 9 aa, Homo Sapiens
SLPKDFMDQ

SEQ ID NO: 889643 - protein, 9 aa, Homo Sapiens
YTFSWAFLS

SEQ ID NO: 889644 - protein, 9 aa, Homo Sapiens
PQTPWVSSR

SEQ ID NO: 889645 - protein, 9 aa, Homo Sapiens
LPWRSPIPV

SEQ ID NO: 889646 - protein, 9 aa, Homo Sapiens
ITMKYVFDL

SEQ ID NO: 889647 - protein, 9 aa, Homo Sapiens
PNAVLRLIF

SEQ ID NO: 889648 - protein, 9 aa, Homo Sapiens
RITAFCCNG

SEQ ID NO: 889649 - protein, 9 aa, Homo Sapiens
NPEEDTERT

SEQ ID NO: 889650 - protein, 9 aa, Homo Sapiens
TPIKTLIRD

SEQ ID NO: 889651 - protein, 9 aa, Homo Sapiens
NKAVTFSIL

SEQ ID NO: 889652 - protein, 9 aa, Homo Sapiens
SLLIIGLVS

SEQ ID NO: 889653 - protein, 9 aa, Homo Sapiens
NFIHDVNKK

SEQ ID NO: 889654 - protein, 9 aa, Homo Sapiens
VNDIFKRIA

SEQ ID NO: 889655 - protein, 9 aa, Homo Sapiens
NKSVQKKKV

SEQ ID NO: 889656 - protein, 9 aa, Homo Sapiens
LSTLAAKTL

SEQ ID NO: 889657 - protein, 9 aa, Homo Sapiens
LVECGTVWD

SEQ ID NO: 889658 - protein, 9 aa, Homo Sapiens
NDVDNKHCY

SEQ ID NO: 889659 - protein, 9 aa, Homo Sapiens
WQNEMIETK

SEQ ID NO: 889660 - protein, 9 aa, Homo Sapiens
AANESRKKI

SEQ ID NO: 889661 - protein, 9 aa, Homo Sapiens
VLDTSNERA

SEQ ID NO: 889662 - protein, 9 aa, Homo Sapiens
GSMCNTSQD

SEQ ID NO: 889663 - protein, 9 aa, Homo Sapiens
KLCICCLLC

SEQ ID NO: 889664 - protein, 9 aa, Homo Sapiens
AQDNLHDQV

SEQ ID NO: 889665 - protein, 9 aa, Homo Sapiens
HSYRMGFTS

SEQ ID NO: 889666 - protein, 9 aa, Homo Sapiens
RLGIHLIQR

SEQ ID NO: 889667 - protein, 9 aa, Homo Sapiens
TLNKLFQPT

SEQ ID NO: 889668 - protein, 9 aa, Homo Sapiens
KHQNHYRVY

SEQ ID NO: 889669 - protein, 9 aa, Homo Sapiens
TLGYDEGSI

SEQ ID NO: 889670 - protein, 9 aa, Homo Sapiens
ELENFQGRQ

SEQ ID NO: 889671 - protein, 9 aa, Homo Sapiens
NSSGMYTPL

SEQ ID NO: 889672 - protein, 9 aa, Homo Sapiens
ENPASPPKT

SEQ ID NO: 889673 - protein, 9 aa, Homo Sapiens
EVKYQMDGD

SEQ ID NO: 889674 - protein, 9 aa, Homo Sapiens
SNAETSVER

SEQ ID NO: 889675 - protein, 9 aa, Homo Sapiens
SHRATLLVP

SEQ ID NO: 889676 - protein, 9 aa, Homo Sapiens
HYNTTADEI

SEQ ID NO: 889677 - protein, 9 aa, Homo Sapiens
AWLRHEVQD

SEQ ID NO: 889678 - protein, 9 aa, Homo Sapiens
FNTNDGRPP

SEQ ID NO: 889679 - protein, 9 aa, Homo Sapiens
QYKFCPTCG

SEQ ID NO: 889680 - protein, 9 aa, Homo Sapiens
QSVLMEMSY

SEQ ID NO: 889681 - protein, 9 aa, Homo Sapiens
FHYKFFCDV

SEQ ID NO: 889682 - protein, 9 aa, Homo Sapiens
FGVPYAAPP

SEQ ID NO: 889683 - protein, 9 aa, Homo Sapiens
SQNEVLQNS

SEQ ID NO: 889684 - protein, 9 aa, Homo Sapiens
GLELFCCVL

SEQ ID NO: 889685 - protein, 9 aa, Homo Sapiens
SSHELALAG

SEQ ID NO: 889686 - protein, 9 aa, Homo Sapiens
CQQEMAEKD

SEQ ID NO: 889687 - protein, 9 aa, Homo Sapiens
MVNKLHCLV

SEQ ID NO: 889688 - protein, 9 aa, Homo Sapiens
LCYRKQEWI

SEQ ID NO: 889689 - protein, 9 aa, Homo Sapiens
RRLQFGVTV

SEQ ID NO: 889690 - protein, 9 aa, Homo Sapiens
LRLIVGKYS

SEQ ID NO: 889691 - protein, 9 aa, Homo Sapiens
KKVLQADWH

SEQ ID NO: 889692 - protein, 9 aa, Homo Sapiens
LYFASLNKS

SEQ ID NO: 889693 - protein, 9 aa, Homo Sapiens
QDKDLPRPL

SEQ ID NO: 889694 - protein, 9 aa, Homo Sapiens
INTGEKPYK

SEQ ID NO: 889695 - protein, 9 aa, Homo Sapiens
YCKGGITFF

SEQ ID NO: 889696 - protein, 9 aa, Homo Sapiens
VSSLGDLSP

SEQ ID NO: 889697 - protein, 9 aa, Homo Sapiens
ESEPDDFNS

SEQ ID NO: 889698 - protein, 9 aa, Homo Sapiens
AINQYRVCQ

SEQ ID NO: 889699 - protein, 9 aa, Homo Sapiens
VQKNTSYYE

SEQ ID NO: 889700 - protein, 9 aa, Homo Sapiens
VLYAWNDLD

SEQ ID NO: 889701 - protein, 9 aa, Homo Sapiens
SEDDPECMR

SEQ ID NO: 889702 - protein, 9 aa, Homo Sapiens
PSSSVSHAW

SEQ ID NO: 889703 - protein, 9 aa, Homo Sapiens
LAKYSELRS

SEQ ID NO: 889704 - protein, 9 aa, Homo Sapiens
FTKKLQNPY

SEQ ID NO: 889705 - protein, 9 aa, Homo Sapiens
GKQMRKAVN

SEQ ID NO: 889706 - protein, 9 aa, Homo Sapiens
KEPDRDERL

SEQ ID NO: 889707 - protein, 9 aa, Homo Sapiens
ATHRIHEIT

SEQ ID NO: 889708 - protein, 9 aa, Homo Sapiens
ITLHKAGRS

SEQ ID NO: 889709 - protein, 9 aa, Homo Sapiens
KTKVNKHVF

SEQ ID NO: 889710 - protein, 9 aa, Homo Sapiens
AVSLLNLFL

SEQ ID NO: 889711 - protein, 9 aa, Homo Sapiens
LSALQTFRV

SEQ ID NO: 889712 - protein, 9 aa, Homo Sapiens
QKQSICHRW

SEQ ID NO: 889713 - protein, 9 aa, Homo Sapiens
IHIQNHTGE

SEQ ID NO: 889714 - protein, 9 aa, Homo Sapiens
DIILMTNNH

SEQ ID NO: 889715 - protein, 9 aa, Homo Sapiens
DKMNIKLTQ

SEQ ID NO: 889716 - protein, 9 aa, Homo Sapiens
VLTLNDVFL

SEQ ID NO: 889717 - protein, 9 aa, Homo Sapiens
SFSVILHYL

SEQ ID NO: 889718 - protein, 9 aa, Homo Sapiens
SRQNTSLGI

SEQ ID NO: 889719 - protein, 9 aa, Homo Sapiens
EGILTNGVL

SEQ ID NO: 889720 - protein, 9 aa, Homo Sapiens
NGKLSFREF

SEQ ID NO: 889721 - protein, 9 aa, Homo Sapiens
QDGNQFYIK

SEQ ID NO: 889722 - protein, 9 aa, Homo Sapiens
QPVTIVFRG

SEQ ID NO: 889723 - protein, 9 aa, Homo Sapiens
DNFFNYVTN

SEQ ID NO: 889724 - protein, 9 aa, Homo Sapiens
VAFWLSACQ

SEQ ID NO: 889725 - protein, 9 aa, Homo Sapiens
VDIHPHMVK

SEQ ID NO: 889726 - protein, 9 aa, Homo Sapiens
LLNRQVQME

SEQ ID NO: 889727 - protein, 9 aa, Homo Sapiens
PLLSVFMWG

SEQ ID NO: 889728 - protein, 9 aa, Homo Sapiens
HKENEKVGI

SEQ ID NO: 889729 - protein, 9 aa, Homo Sapiens
ESDKYHERP

SEQ ID NO: 889730 - protein, 9 aa, Homo Sapiens
PLSLQWLTL

SEQ ID NO: 889731 - protein, 9 aa, Homo Sapiens
ETKDLDLEN

SEQ ID NO: 889732 - protein, 9 aa, Homo Sapiens
IEYRGRRQT

SEQ ID NO: 889733 - protein, 9 aa, Homo Sapiens
FSNWMVQVS

SEQ ID NO: 889734 - protein, 9 aa, Homo Sapiens
QPNTRELWC

SEQ ID NO: 889735 - protein, 9 aa, Homo Sapiens
VLAQNLTKL

SEQ ID NO: 889736 - protein, 9 aa, Homo Sapiens
SKSNRVDAH

SEQ ID NO: 889737 - protein, 9 aa, Homo Sapiens
SCAQKMAKF

SEQ ID NO: 889738 - protein, 9 aa, Homo Sapiens
IIKRNPDLQ

SEQ ID NO: 889739 - protein, 9 aa, Homo Sapiens
GRNKHGHKH

SEQ ID NO: 889740 - protein, 9 aa, Homo Sapiens
IYGFLNNGI

SEQ ID NO: 889741 - protein, 9 aa, Homo Sapiens
ETSPASSTS

SEQ ID NO: 889742 - protein, 9 aa, Homo Sapiens
SYSNLFQLH

SEQ ID NO: 889743 - protein, 9 aa, Homo Sapiens
SDYETLSFK

SEQ ID NO: 889744 - protein, 9 aa, Homo Sapiens
DVMKMNEFL

SEQ ID NO: 889745 - protein, 9 aa, Homo Sapiens
CMRLRNRAA

SEQ ID NO: 889746 - protein, 9 aa, Homo Sapiens
LPVVKGTFI

SEQ ID NO: 889747 - protein, 9 aa, Homo Sapiens
KRLNIRVIL

SEQ ID NO: 889748 - protein, 9 aa, Homo Sapiens
GSASESGDQ

SEQ ID NO: 889749 - protein, 9 aa, Homo Sapiens
PSPTAPDAM

SEQ ID NO: 889750 - protein, 9 aa, Homo Sapiens
LSRKQKEKL

SEQ ID NO: 889751 - protein, 9 aa, Homo Sapiens
LKFSRLFEL

SEQ ID NO: 889752 - protein, 9 aa, Homo Sapiens
LKKMANRIR

SEQ ID NO: 889753 - protein, 9 aa, Homo Sapiens
NGFIAAFCF

SEQ ID NO: 889754 - protein, 9 aa, Homo Sapiens
DSLLYVNTD

SEQ ID NO: 889755 - protein, 9 aa, Homo Sapiens
RSTSQNFPS

SEQ ID NO: 889756 - protein, 9 aa, Homo Sapiens
HPWTSCEPK

SEQ ID NO: 889757 - protein, 9 aa, Homo Sapiens
GSIILIQGF

SEQ ID NO: 889758 - protein, 9 aa, Homo Sapiens
EVIAGGCAG

SEQ ID NO: 889759 - protein, 9 aa, Homo Sapiens
FGARRLQES

SEQ ID NO: 889760 - protein, 9 aa, Homo Sapiens
SEVYHFGAI

SEQ ID NO: 889761 - protein, 9 aa, Homo Sapiens
HKVGDTEGK

SEQ ID NO: 889762 - protein, 9 aa, Homo Sapiens
EAMQNKFLL

SEQ ID NO: 889763 - protein, 9 aa, Homo Sapiens
DMFVAELLM

SEQ ID NO: 889764 - protein, 9 aa, Homo Sapiens
CSEQSLIKF

SEQ ID NO: 889765 - protein, 9 aa, Homo Sapiens
YEKERSTRS

SEQ ID NO: 889766 - protein, 9 aa, Homo Sapiens
NNYWIWENP

SEQ ID NO: 889767 - protein, 9 aa, Homo Sapiens
VDILSFLFQ

SEQ ID NO: 889768 - protein, 9 aa, Homo Sapiens
FSPVPKETP

SEQ ID NO: 889769 - protein, 9 aa, Homo Sapiens
PLNARHQVP

SEQ ID NO: 889770 - protein, 9 aa, Homo Sapiens
LLRQHKHRP

SEQ ID NO: 889771 - protein, 9 aa, Homo Sapiens
LAVEKRNFL

SEQ ID NO: 889772 - protein, 9 aa, Homo Sapiens
KSKFQFIVS

SEQ ID NO: 889773 - protein, 9 aa, Homo Sapiens
IRQDEEGNE

SEQ ID NO: 889774 - protein, 9 aa, Homo Sapiens
LKLSPKNLA

SEQ ID NO: 889775 - protein, 9 aa, Homo Sapiens
LCIMIQYLL

SEQ ID NO: 889776 - protein, 9 aa, Homo Sapiens
QSYDPKTNS

SEQ ID NO: 889777 - protein, 9 aa, Homo Sapiens
PSSEKITLE

SEQ ID NO: 889778 - protein, 9 aa, Homo Sapiens
AFKSLEEVR

SEQ ID NO: 889779 - protein, 9 aa, Homo Sapiens
LACFRSLVA

SEQ ID NO: 889780 - protein, 9 aa, Homo Sapiens
EATKLLQNI

SEQ ID NO: 889781 - protein, 9 aa, Homo Sapiens
MAFCAKSKS

SEQ ID NO: 889782 - protein, 9 aa, Homo Sapiens
AIYLVHGGP

SEQ ID NO: 889783 - protein, 9 aa, Homo Sapiens
LPSLLKNHI

SEQ ID NO: 889784 - protein, 9 aa, Homo Sapiens
YEVRCTHVV

SEQ ID NO: 889785 - protein, 9 aa, Homo Sapiens
PLKTQNDLD

SEQ ID NO: 889786 - protein, 9 aa, Homo Sapiens
LCSQQELEA

SEQ ID NO: 889787 - protein, 9 aa, Homo Sapiens
TGLIEKNIK

SEQ ID NO: 889788 - protein, 9 aa, Homo Sapiens
GRLRNLILD

SEQ ID NO: 889789 - protein, 9 aa, Homo Sapiens
IGRGELQRF

SEQ ID NO: 889790 - protein, 9 aa, Homo Sapiens
EIRLIGNKS

SEQ ID NO: 889791 - protein, 9 aa, Homo Sapiens
TNSSITLCW

SEQ ID NO: 889792 - protein, 9 aa, Homo Sapiens
TLRCHYCRG

SEQ ID NO: 889793 - protein, 9 aa, Homo Sapiens
FVPLFGENP

SEQ ID NO: 889794 - protein, 9 aa, Homo Sapiens
FWLYDNHIS

SEQ ID NO: 889795 - protein, 9 aa, Homo Sapiens
VVVLTVKAS

SEQ ID NO: 889796 - protein, 9 aa, Homo Sapiens
YKDANLYLL

SEQ ID NO: 889797 - protein, 9 aa, Homo Sapiens
TPKRVLKMD

SEQ ID NO: 889798 - protein, 9 aa, Homo Sapiens
SNVYSKVAV

SEQ ID NO: 889799 - protein, 9 aa, Homo Sapiens
VMIFVGVGF

SEQ ID NO: 889800 - protein, 9 aa, Homo Sapiens
IETKTKDKL

SEQ ID NO: 889801 - protein, 9 aa, Homo Sapiens
VIQIKASSL

SEQ ID NO: 889802 - protein, 9 aa, Homo Sapiens
MQDQETYSH

SEQ ID NO: 889803 - protein, 9 aa, Homo Sapiens
VPTPPGEMG

SEQ ID NO: 889804 - protein, 9 aa, Homo Sapiens
LSQDSPWSL

SEQ ID NO: 889805 - protein, 9 aa, Homo Sapiens
HSRDHGLPG

SEQ ID NO: 889806 - protein, 9 aa, Homo Sapiens
YPTKDMKAT

SEQ ID NO: 889807 - protein, 9 aa, Homo Sapiens
RTELTVGKS

SEQ ID NO: 889808 - protein, 9 aa, Homo Sapiens
GTMQWLIER

SEQ ID NO: 889809 - protein, 9 aa, Homo Sapiens
LHIPLKTQN

SEQ ID NO: 889810 - protein, 9 aa, Homo Sapiens
CQFHLHWGS

SEQ ID NO: 889811 - protein, 9 aa, Homo Sapiens
GKSSIIQHE

SEQ ID NO: 889812 - protein, 9 aa, Homo Sapiens
PRTEPPAEP

SEQ ID NO: 889813 - protein, 9 aa, Homo Sapiens
KFGFGKFVE

SEQ ID NO: 889814 - protein, 9 aa, Homo Sapiens
CYRYPKGES

SEQ ID NO: 889815 - protein, 9 aa, Homo Sapiens
EIEAGRIPH

SEQ ID NO: 889816 - protein, 9 aa, Homo Sapiens
KSSNNTDFF

SEQ ID NO: 889817 - protein, 9 aa, Homo Sapiens
EQGKFIYLF

SEQ ID NO: 889818 - protein, 9 aa, Homo Sapiens
LEIDKLETP

SEQ ID NO: 889819 - protein, 9 aa, Homo Sapiens
LISQFRGPQ

SEQ ID NO: 889820 - protein, 9 aa, Homo Sapiens
ELKEERLSG

SEQ ID NO: 889821 - protein, 9 aa, Homo Sapiens
KRTVHEWKQ

SEQ ID NO: 889822 - protein, 9 aa, Homo Sapiens
KSFSYKINL

SEQ ID NO: 889823 - protein, 9 aa, Homo Sapiens
LRTAHLVLP

SEQ ID NO: 889824 - protein, 9 aa, Homo Sapiens
EETKKKEGK

SEQ ID NO: 889825 - protein, 9 aa, Homo Sapiens
LMPSDLQAF

SEQ ID NO: 889826 - protein, 9 aa, Homo Sapiens
WTNEHLACI

SEQ ID NO: 889827 - protein, 9 aa, Homo Sapiens
AFCNAVWSY

SEQ ID NO: 889828 - protein, 9 aa, Homo Sapiens
IVLGPYHYK

SEQ ID NO: 889829 - protein, 9 aa, Homo Sapiens
PVITGNCDG

SEQ ID NO: 889830 - protein, 9 aa, Homo Sapiens
LQQEHCFLK

SEQ ID NO: 889831 - protein, 9 aa, Homo Sapiens
IFLHVGSNC

SEQ ID NO: 889832 - protein, 9 aa, Homo Sapiens
QSLSQKYYL

SEQ ID NO: 889833 - protein, 9 aa, Homo Sapiens
GEGCKAMQR

SEQ ID NO: 889834 - protein, 9 aa, Homo Sapiens
PFGVSELLK

SEQ ID NO: 889835 - protein, 9 aa, Homo Sapiens
NKQQDCEPV

SEQ ID NO: 889836 - protein, 9 aa, Homo Sapiens
IKTLIRDML

SEQ ID NO: 889837 - protein, 9 aa, Homo Sapiens
EDSFRRQQK

SEQ ID NO: 889838 - protein, 9 aa, Homo Sapiens
HMYVSDTTS

SEQ ID NO: 889839 - protein, 9 aa, Homo Sapiens
TVSSSDSLQ

SEQ ID NO: 889840 - protein, 9 aa, Homo Sapiens
FFTVAGTLV

SEQ ID NO: 889841 - protein, 9 aa, Homo Sapiens
GKMLAIYLV

SEQ ID NO: 889842 - protein, 9 aa, Homo Sapiens
YNIPLSQAK

SEQ ID NO: 889843 - protein, 9 aa, Homo Sapiens
NQYRVCQEV

SEQ ID NO: 889844 - protein, 9 aa, Homo Sapiens
AELKEERLS

SEQ ID NO: 889845 - protein, 9 aa, Homo Sapiens
KALFKHGLK

SEQ ID NO: 889846 - protein, 9 aa, Homo Sapiens
PLKAGKTQT

SEQ ID NO: 889847 - protein, 9 aa, Homo Sapiens
QKEVSHPNA

SEQ ID NO: 889848 - protein, 9 aa, Homo Sapiens
DLPALASQS

SEQ ID NO: 889849 - protein, 9 aa, Homo Sapiens
IIHTKEEFF

SEQ ID NO: 889850 - protein, 9 aa, Homo Sapiens
IMANYFSGF

SEQ ID NO: 889851 - protein, 9 aa, Homo Sapiens
KKLAEWLEQ

SEQ ID NO: 889852 - protein, 9 aa, Homo Sapiens
NRFCRDAKA

SEQ ID NO: 889853 - protein, 9 aa, Homo Sapiens
DCLRTCGGG

SEQ ID NO: 889854 - protein, 9 aa, Homo Sapiens
DPDMALCQN

SEQ ID NO: 889855 - protein, 9 aa, Homo Sapiens
PIPGPMSGP

SEQ ID NO: 889856 - protein, 9 aa, Homo Sapiens
SLKSSPGLG

SEQ ID NO: 889857 - protein, 9 aa, Homo Sapiens
PPAEKNVKK

SEQ ID NO: 889858 - protein, 9 aa, Homo Sapiens
GTGATVLGT

SEQ ID NO: 889859 - protein, 9 aa, Homo Sapiens
CRPADTQSR

SEQ ID NO: 889860 - protein, 9 aa, Homo Sapiens
QNEVLQNSF

SEQ ID NO: 889861 - protein, 9 aa, Homo Sapiens
TTPKMICDI

SEQ ID NO: 889862 - protein, 9 aa, Homo Sapiens
SLLFLVCHL

SEQ ID NO: 889863 - protein, 9 aa, Homo Sapiens
ALKKIMRTK

SEQ ID NO: 889864 - protein, 9 aa, Homo Sapiens
QMGEENDSS

SEQ ID NO: 889865 - protein, 9 aa, Homo Sapiens
NPQECFQPV

SEQ ID NO: 889866 - protein, 9 aa, Homo Sapiens
LNLFLSAFW

SEQ ID NO: 889867 - protein, 9 aa, Homo Sapiens
TDKTVMYKH

SEQ ID NO: 889868 - protein, 9 aa, Homo Sapiens
LYHKHLRKD

SEQ ID NO: 889869 - protein, 9 aa, Homo Sapiens
MCVCCPCCA

SEQ ID NO: 889870 - protein, 9 aa, Homo Sapiens
LFSWFAFLI

SEQ ID NO: 889871 - protein, 9 aa, Homo Sapiens
NTSREFRGK

SEQ ID NO: 889872 - protein, 9 aa, Homo Sapiens
LSHYRQCAL

SEQ ID NO: 889873 - protein, 9 aa, Homo Sapiens
VQETQRLHG

SEQ ID NO: 889874 - protein, 9 aa, Homo Sapiens
LSDSPMVMA

SEQ ID NO: 889875 - protein, 9 aa, Homo Sapiens
LLRRQRHIK

SEQ ID NO: 889876 - protein, 9 aa, Homo Sapiens
FLTYDKVKA

SEQ ID NO: 889877 - protein, 9 aa, Homo Sapiens
DLENIVRNI

SEQ ID NO: 889878 - protein, 9 aa, Homo Sapiens
KKRNKSCEM

SEQ ID NO: 889879 - protein, 9 aa, Homo Sapiens
CFDECNRID

SEQ ID NO: 889880 - protein, 9 aa, Homo Sapiens
IITLASRSQ

SEQ ID NO: 889881 - protein, 9 aa, Homo Sapiens
PVEYEVINQ

SEQ ID NO: 889882 - protein, 9 aa, Homo Sapiens
NYARDHYTI

SEQ ID NO: 889883 - protein, 9 aa, Homo Sapiens
TLANLTLGS

SEQ ID NO: 889884 - protein, 9 aa, Homo Sapiens
IPCDDIQKA

SEQ ID NO: 889885 - protein, 9 aa, Homo Sapiens
AVKILLTFK

SEQ ID NO: 889886 - protein, 9 aa, Homo Sapiens
KKNLAHPVI

SEQ ID NO: 889887 - protein, 9 aa, Homo Sapiens
ERSVCPTDS

SEQ ID NO: 889888 - protein, 9 aa, Homo Sapiens
PANKTNPFP

SEQ ID NO: 889889 - protein, 9 aa, Homo Sapiens
VQNLDCYTT

SEQ ID NO: 889890 - protein, 9 aa, Homo Sapiens
QSRSRDRSR

SEQ ID NO: 889891 - protein, 9 aa, Homo Sapiens
ENIYSMMLI

SEQ ID NO: 889892 - protein, 9 aa, Homo Sapiens
GVSKRHLRV

SEQ ID NO: 889893 - protein, 9 aa, Homo Sapiens
RRIDVLLWA

SEQ ID NO: 889894 - protein, 9 aa, Homo Sapiens
KDLFMKRFS

SEQ ID NO: 889895 - protein, 9 aa, Homo Sapiens
TSLNYKSFS

SEQ ID NO: 889896 - protein, 9 aa, Homo Sapiens
RVETTKDHS

SEQ ID NO: 889897 - protein, 9 aa, Homo Sapiens
FKNKKLAEW

SEQ ID NO: 889898 - protein, 9 aa, Homo Sapiens
LLLDARSAR

SEQ ID NO: 889899 - protein, 9 aa, Homo Sapiens
RLYINFMLR

SEQ ID NO: 889900 - protein, 9 aa, Homo Sapiens
SKLRFQLGY

SEQ ID NO: 889901 - protein, 9 aa, Homo Sapiens
ACVGLFLLQ

SEQ ID NO: 889902 - protein, 9 aa, Homo Sapiens
QHIKAHKVA

SEQ ID NO: 889903 - protein, 9 aa, Homo Sapiens
MFGNGNFRR

SEQ ID NO: 889904 - protein, 9 aa, Homo Sapiens
FSIRADNII

SEQ ID NO: 889905 - protein, 9 aa, Homo Sapiens
SSHPQSRSA

SEQ ID NO: 889906 - protein, 9 aa, Homo Sapiens
GTKTFQIHT

SEQ ID NO: 889907 - protein, 9 aa, Homo Sapiens
TVWGTEHTQ

SEQ ID NO: 889908 - protein, 9 aa, Homo Sapiens
SLSFVNFCY

SEQ ID NO: 889909 - protein, 9 aa, Homo Sapiens
YCDKNVINN

SEQ ID NO: 889910 - protein, 9 aa, Homo Sapiens
DSKMSFKDI

SEQ ID NO: 889911 - protein, 9 aa, Homo Sapiens
ALIRHQIIH

SEQ ID NO: 889912 - protein, 9 aa, Homo Sapiens
KYKHQSHSS

SEQ ID NO: 889913 - protein, 9 aa, Homo Sapiens
SKPEELPEL

SEQ ID NO: 889914 - protein, 9 aa, Homo Sapiens
CDGDCSKGF

SEQ ID NO: 889915 - protein, 9 aa, Homo Sapiens
VSPVLPQRP

SEQ ID NO: 889916 - protein, 9 aa, Homo Sapiens
LWFREAEIY

SEQ ID NO: 889917 - protein, 9 aa, Homo Sapiens
GKEEWKGAA

SEQ ID NO: 889918 - protein, 9 aa, Homo Sapiens
EDCSVLCGG

SEQ ID NO: 889919 - protein, 9 aa, Homo Sapiens
AEARGDMLE

SEQ ID NO: 889920 - protein, 9 aa, Homo Sapiens
KFNPPKSSN

SEQ ID NO: 889921 - protein, 9 aa, Homo Sapiens
QEAIAQILN

SEQ ID NO: 889922 - protein, 9 aa, Homo Sapiens
VTETNNSPL

SEQ ID NO: 889923 - protein, 9 aa, Homo Sapiens
TTAKTTSVS

SEQ ID NO: 889924 - protein, 9 aa, Homo Sapiens
NLFLAEHHK

SEQ ID NO: 889925 - protein, 9 aa, Homo Sapiens
TSGVYAWFW

SEQ ID NO: 889926 - protein, 9 aa, Homo Sapiens
IYAISAPSI

SEQ ID NO: 889927 - protein, 9 aa, Homo Sapiens
TTTWERKYY

SEQ ID NO: 889928 - protein, 9 aa, Homo Sapiens
QMKITKCAD

SEQ ID NO: 889929 - protein, 9 aa, Homo Sapiens
AYEKNKNYL

SEQ ID NO: 889930 - protein, 9 aa, Homo Sapiens
LPSTTSSLV

SEQ ID NO: 889931 - protein, 9 aa, Homo Sapiens
IICSCICTV

SEQ ID NO: 889932 - protein, 9 aa, Homo Sapiens
PSHRSFTNM

SEQ ID NO: 889933 - protein, 9 aa, Homo Sapiens
KRRVIVPAD

SEQ ID NO: 889934 - protein, 9 aa, Homo Sapiens
KHFLPHNFR

SEQ ID NO: 889935 - protein, 9 aa, Homo Sapiens
QLEKERRAA

SEQ ID NO: 889936 - protein, 9 aa, Homo Sapiens
GSEASNSVS

SEQ ID NO: 889937 - protein, 9 aa, Homo Sapiens
WAAVATFIY

SEQ ID NO: 889938 - protein, 9 aa, Homo Sapiens
SQVVAVTFG

SEQ ID NO: 889939 - protein, 9 aa, Homo Sapiens
MHKVFLQRL

SEQ ID NO: 889940 - protein, 9 aa, Homo Sapiens
VRCTHVVIN

SEQ ID NO: 889941 - protein, 9 aa, Homo Sapiens
TRDPQVNVF

SEQ ID NO: 889942 - protein, 9 aa, Homo Sapiens
QKFIKIDQA

SEQ ID NO: 889943 - protein, 9 aa, Homo Sapiens
RSISMKPNV

SEQ ID NO: 889944 - protein, 9 aa, Homo Sapiens
GAIIFGGRR

SEQ ID NO: 889945 - protein, 9 aa, Homo Sapiens
AMKLSIIQH

SEQ ID NO: 889946 - protein, 9 aa, Homo Sapiens
FRDVAIQLS

SEQ ID NO: 889947 - protein, 9 aa, Homo Sapiens
MQWLIEREK

SEQ ID NO: 889948 - protein, 9 aa, Homo Sapiens
DQPLDDISK

SEQ ID NO: 889949 - protein, 9 aa, Homo Sapiens
SNTNGNTDN

SEQ ID NO: 889950 - protein, 9 aa, Homo Sapiens
EEVETLVKY

SEQ ID NO: 889951 - protein, 9 aa, Homo Sapiens
NSIDETLED

SEQ ID NO: 889952 - protein, 9 aa, Homo Sapiens
RLKLSPKNL

SEQ ID NO: 889953 - protein, 9 aa, Homo Sapiens
DRQNHICGF

SEQ ID NO: 889954 - protein, 9 aa, Homo Sapiens
TSGRFPSWR

SEQ ID NO: 889955 - protein, 9 aa, Homo Sapiens
PQNSLEVVT

SEQ ID NO: 889956 - protein, 9 aa, Homo Sapiens
VEKETSFEH

SEQ ID NO: 889957 - protein, 9 aa, Homo Sapiens
LYQNAVQQE

SEQ ID NO: 889958 - protein, 9 aa, Homo Sapiens
GSPEALARD

SEQ ID NO: 889959 - protein, 9 aa, Homo Sapiens
RTSLEKFTC

SEQ ID NO: 889960 - protein, 9 aa, Homo Sapiens
ICTIEEIIS

SEQ ID NO: 889961 - protein, 9 aa, Homo Sapiens
AVGSSSPIN

SEQ ID NO: 889962 - protein, 9 aa, Homo Sapiens
SDISNFGAV

SEQ ID NO: 889963 - protein, 9 aa, Homo Sapiens
ASKGDFIFS

SEQ ID NO: 889964 - protein, 9 aa, Homo Sapiens
LTSVQALQR

SEQ ID NO: 889965 - protein, 9 aa, Homo Sapiens
SQIYDKLFQ

SEQ ID NO: 889966 - protein, 9 aa, Homo Sapiens
KVLENIKLN

SEQ ID NO: 889967 - protein, 9 aa, Homo Sapiens
LKEEFVLKT

SEQ ID NO: 889968 - protein, 9 aa, Homo Sapiens
WFMLETMLA

SEQ ID NO: 889969 - protein, 9 aa, Homo Sapiens
ENSVLLIAL

SEQ ID NO: 889970 - protein, 9 aa, Homo Sapiens
IVLDSVRQF

SEQ ID NO: 889971 - protein, 9 aa, Homo Sapiens
EEVEAAGEI

SEQ ID NO: 889972 - protein, 9 aa, Homo Sapiens
AGGHNEVPP

SEQ ID NO: 889973 - protein, 9 aa, Homo Sapiens
IEDVKMTFD

SEQ ID NO: 889974 - protein, 9 aa, Homo Sapiens
SSLIIHKII

SEQ ID NO: 889975 - protein, 9 aa, Homo Sapiens
TALKRVIGM

SEQ ID NO: 889976 - protein, 9 aa, Homo Sapiens
CEGEGCIEW

SEQ ID NO: 889977 - protein, 9 aa, Homo Sapiens
GKVCKLDEN

SEQ ID NO: 889978 - protein, 9 aa, Homo Sapiens
SYKINLIVH

SEQ ID NO: 889979 - protein, 9 aa, Homo Sapiens
GDKLGKEAR

SEQ ID NO: 889980 - protein, 9 aa, Homo Sapiens
EKDNQMRMA

SEQ ID NO: 889981 - protein, 9 aa, Homo Sapiens
ASTFNLFNI

SEQ ID NO: 889982 - protein, 9 aa, Homo Sapiens
KDVVYPEIF

SEQ ID NO: 889983 - protein, 9 aa, Homo Sapiens
QDKHNSIDE

SEQ ID NO: 889984 - protein, 9 aa, Homo Sapiens
FQGTWQKRF

SEQ ID NO: 889985 - protein, 9 aa, Homo Sapiens
DRINKFFLH

SEQ ID NO: 889986 - protein, 9 aa, Homo Sapiens
EKPAQPEGQ

SEQ ID NO: 889987 - protein, 9 aa, Homo Sapiens
FSEYLHSSL

SEQ ID NO: 889988 - protein, 9 aa, Homo Sapiens
LKVDELVTG

SEQ ID NO: 889989 - protein, 9 aa, Homo Sapiens
ISASSINKA

SEQ ID NO: 889990 - protein, 9 aa, Homo Sapiens
AFELRDTGH

SEQ ID NO: 889991 - protein, 9 aa, Homo Sapiens
LKKKQQFGE

SEQ ID NO: 889992 - protein, 9 aa, Homo Sapiens
HCNICCMNG

SEQ ID NO: 889993 - protein, 9 aa, Homo Sapiens
TAEDIKQFL

SEQ ID NO: 889994 - protein, 9 aa, Homo Sapiens
YISLALISN

SEQ ID NO: 889995 - protein, 9 aa, Homo Sapiens
ICFMISTPE

SEQ ID NO: 889996 - protein, 9 aa, Homo Sapiens
AENFDQFFT

SEQ ID NO: 889997 - protein, 9 aa, Homo Sapiens
LQLDIYQKA

SEQ ID NO: 889998 - protein, 9 aa, Homo Sapiens
MVFNDLLQQ

SEQ ID NO: 889999 - protein, 9 aa, Homo Sapiens
QLFCQAQKK

SEQ ID NO: 890000 - protein, 9 aa, Homo Sapiens
MRNLYIKNG

SEQ ID NO: 890001 - protein, 9 aa, Homo Sapiens
GVKKCCLNG

SEQ ID NO: 890002 - protein, 9 aa, Homo Sapiens
KAGISDYLT

SEQ ID NO: 890003 - protein, 9 aa, Homo Sapiens
GMNCLIQFD

SEQ ID NO: 890004 - protein, 9 aa, Homo Sapiens
VKDYIQTQI

SEQ ID NO: 890005 - protein, 9 aa, Homo Sapiens
EGKWHVSKV

SEQ ID NO: 890006 - protein, 9 aa, Homo Sapiens
VYYILCIHF

SEQ ID NO: 890007 - protein, 9 aa, Homo Sapiens
LLYPSQRFE

SEQ ID NO: 890008 - protein, 9 aa, Homo Sapiens
KILLTFKIK

SEQ ID NO: 890009 - protein, 9 aa, Homo Sapiens
QDAWTIITP

SEQ ID NO: 890010 - protein, 9 aa, Homo Sapiens
PQSRSAAAQ

SEQ ID NO: 890011 - protein, 9 aa, Homo Sapiens
SIIMFCLIL

SEQ ID NO: 890012 - protein, 9 aa, Homo Sapiens
YTEEACIIS

SEQ ID NO: 890013 - protein, 9 aa, Homo Sapiens
TPMLWSRIK

SEQ ID NO: 890014 - protein, 9 aa, Homo Sapiens
CDPESENKR

SEQ ID NO: 890015 - protein, 9 aa, Homo Sapiens
PFPLNQQDV

SEQ ID NO: 890016 - protein, 9 aa, Homo Sapiens
CQDSRSHSS

SEQ ID NO: 890017 - protein, 9 aa, Homo Sapiens
RLFDDNGQE

SEQ ID NO: 890018 - protein, 9 aa, Homo Sapiens
SQDHVKKDY

SEQ ID NO: 890019 - protein, 9 aa, Homo Sapiens
AALALTFLP

SEQ ID NO: 890020 - protein, 9 aa, Homo Sapiens
ICLWRNFYD

SEQ ID NO: 890021 - protein, 9 aa, Homo Sapiens
VMKMNEFLR

SEQ ID NO: 890022 - protein, 9 aa, Homo Sapiens
DNFLLLGNV

SEQ ID NO: 890023 - protein, 9 aa, Homo Sapiens
QQLFCQAQK

SEQ ID NO: 890024 - protein, 9 aa, Homo Sapiens
FTHLHINAP

SEQ ID NO: 890025 - protein, 9 aa, Homo Sapiens
LSPPAARRL

SEQ ID NO: 890026 - protein, 9 aa, Homo Sapiens
SCRLVFLFM

SEQ ID NO: 890027 - protein, 9 aa, Homo Sapiens
LSLHKCFVQ

SEQ ID NO: 890028 - protein, 9 aa, Homo Sapiens
SVFLSRSLL

SEQ ID NO: 890029 - protein, 9 aa, Homo Sapiens
YGGLVCMDL

SEQ ID NO: 890030 - protein, 9 aa, Homo Sapiens
QIKHLPYTT

SEQ ID NO: 890031 - protein, 9 aa, Homo Sapiens
TLAKHKKIH

SEQ ID NO: 890032 - protein, 9 aa, Homo Sapiens
TFGNAKTVR

SEQ ID NO: 890033 - protein, 9 aa, Homo Sapiens
FSSREERLW

SEQ ID NO: 890034 - protein, 9 aa, Homo Sapiens
HRGYHHGRP

SEQ ID NO: 890035 - protein, 9 aa, Homo Sapiens
LRNNPIKSI

SEQ ID NO: 890036 - protein, 9 aa, Homo Sapiens
QELFFNLPQ

SEQ ID NO: 890037 - protein, 9 aa, Homo Sapiens
VCGFQPIEI

SEQ ID NO: 890038 - protein, 9 aa, Homo Sapiens
ATHTRDCLQ

SEQ ID NO: 890039 - protein, 9 aa, Homo Sapiens
DSDNIKHKN

SEQ ID NO: 890040 - protein, 9 aa, Homo Sapiens
ICMITEFAY

SEQ ID NO: 890041 - protein, 9 aa, Homo Sapiens
KKKIQREVK

SEQ ID NO: 890042 - protein, 9 aa, Homo Sapiens
EASTFNLFN

SEQ ID NO: 890043 - protein, 9 aa, Homo Sapiens
HKHELLTKA

SEQ ID NO: 890044 - protein, 9 aa, Homo Sapiens
QNYVAPLEL

SEQ ID NO: 890045 - protein, 9 aa, Homo Sapiens
MCDLVPILE

SEQ ID NO: 890046 - protein, 9 aa, Homo Sapiens
NEADKSVNY

SEQ ID NO: 890047 - protein, 9 aa, Homo Sapiens
KDFLEPESV

SEQ ID NO: 890048 - protein, 9 aa, Homo Sapiens
GDALYKLFH

SEQ ID NO: 890049 - protein, 9 aa, Homo Sapiens
KKLESSAST

SEQ ID NO: 890050 - protein, 9 aa, Homo Sapiens
IEDFHRKFH

SEQ ID NO: 890051 - protein, 9 aa, Homo Sapiens
TLMDNGNNL

SEQ ID NO: 890052 - protein, 9 aa, Homo Sapiens
EVLLLHCGP

SEQ ID NO: 890053 - protein, 9 aa, Homo Sapiens
IQDPQKKSD

SEQ ID NO: 890054 - protein, 9 aa, Homo Sapiens
IYLPFSILG

SEQ ID NO: 890055 - protein, 9 aa, Homo Sapiens
EEKLLDDKH

SEQ ID NO: 890056 - protein, 9 aa, Homo Sapiens
PLAHYNTTA

SEQ ID NO: 890057 - protein, 9 aa, Homo Sapiens
KGMQCAAGQ

SEQ ID NO: 890058 - protein, 9 aa, Homo Sapiens
NEIKSWEEQ

SEQ ID NO: 890059 - protein, 9 aa, Homo Sapiens
VKKQDNYIP

SEQ ID NO: 890060 - protein, 9 aa, Homo Sapiens
CINQQTGQR

SEQ ID NO: 890061 - protein, 9 aa, Homo Sapiens
THLVQHQII

SEQ ID NO: 890062 - protein, 9 aa, Homo Sapiens
FPSYSPTSP

SEQ ID NO: 890063 - protein, 9 aa, Homo Sapiens
PLRNQVVIS

SEQ ID NO: 890064 - protein, 9 aa, Homo Sapiens
GRPKRQTRK

SEQ ID NO: 890065 - protein, 9 aa, Homo Sapiens
KFAITLFEQ

SEQ ID NO: 890066 - protein, 9 aa, Homo Sapiens
CTLLIHTGF

SEQ ID NO: 890067 - protein, 9 aa, Homo Sapiens
QTHEMIHTG

SEQ ID NO: 890068 - protein, 9 aa, Homo Sapiens
YVTLSQRFI

SEQ ID NO: 890069 - protein, 9 aa, Homo Sapiens
DHYTYSAND

SEQ ID NO: 890070 - protein, 9 aa, Homo Sapiens
VVGSYLSVK

SEQ ID NO: 890071 - protein, 9 aa, Homo Sapiens
LLKAFQIDA

SEQ ID NO: 890072 - protein, 9 aa, Homo Sapiens
HTQNQEYLK

SEQ ID NO: 890073 - protein, 9 aa, Homo Sapiens
SSLGYPTLW

SEQ ID NO: 890074 - protein, 9 aa, Homo Sapiens
IKNKQKHRI

SEQ ID NO: 890075 - protein, 9 aa, Homo Sapiens
RQAKGFHGK

SEQ ID NO: 890076 - protein, 9 aa, Homo Sapiens
GIVFLDTSE

SEQ ID NO: 890077 - protein, 9 aa, Homo Sapiens
CNLLREQYE

SEQ ID NO: 890078 - protein, 9 aa, Homo Sapiens
KDCWKTFLN

SEQ ID NO: 890079 - protein, 9 aa, Homo Sapiens
KQKHHYDHQ

SEQ ID NO: 890080 - protein, 9 aa, Homo Sapiens
VGVGFLMTF

SEQ ID NO: 890081 - protein, 9 aa, Homo Sapiens
AAAVCLSMR

SEQ ID NO: 890082 - protein, 9 aa, Homo Sapiens
VVKGKQMHV

SEQ ID NO: 890083 - protein, 9 aa, Homo Sapiens
LNLPKTTIK

SEQ ID NO: 890084 - protein, 9 aa, Homo Sapiens
KAWHKDILQ

SEQ ID NO: 890085 - protein, 9 aa, Homo Sapiens
RTLVIHQQT

SEQ ID NO: 890086 - protein, 9 aa, Homo Sapiens
QYSDIGILY

SEQ ID NO: 890087 - protein, 9 aa, Homo Sapiens
KLLPKVSYV

SEQ ID NO: 890088 - protein, 9 aa, Homo Sapiens
MNRHSNEWK

SEQ ID NO: 890089 - protein, 9 aa, Homo Sapiens
LTQNQMTVA

SEQ ID NO: 890090 - protein, 9 aa, Homo Sapiens
CRCVLKDCC

SEQ ID NO: 890091 - protein, 9 aa, Homo Sapiens
NIKDVAVLC

SEQ ID NO: 890092 - protein, 9 aa, Homo Sapiens
CGKALTSKI

SEQ ID NO: 890093 - protein, 9 aa, Homo Sapiens
DSFSHRQLY

SEQ ID NO: 890094 - protein, 9 aa, Homo Sapiens
NVENNCYRR

SEQ ID NO: 890095 - protein, 9 aa, Homo Sapiens
MLPVVKGTF

SEQ ID NO: 890096 - protein, 9 aa, Homo Sapiens
DALGCRICP

SEQ ID NO: 890097 - protein, 9 aa, Homo Sapiens
IEDRDTMNF

SEQ ID NO: 890098 - protein, 9 aa, Homo Sapiens
VAFGTGSSN

SEQ ID NO: 890099 - protein, 9 aa, Homo Sapiens
HVKHYKICK

SEQ ID NO: 890100 - protein, 9 aa, Homo Sapiens
GHMDGKICL

SEQ ID NO: 890101 - protein, 9 aa, Homo Sapiens
IRIEDPPHR

SEQ ID NO: 890102 - protein, 9 aa, Homo Sapiens
TEENVKVLL

SEQ ID NO: 890103 - protein, 9 aa, Homo Sapiens
HLKKHLRIH

SEQ ID NO: 890104 - protein, 9 aa, Homo Sapiens
SYKQTFSEP

SEQ ID NO: 890105 - protein, 9 aa, Homo Sapiens
FLVLQDFIG

SEQ ID NO: 890106 - protein, 9 aa, Homo Sapiens
YRGQNNLTA

SEQ ID NO: 890107 - protein, 9 aa, Homo Sapiens
IAEHKLLGN

SEQ ID NO: 890108 - protein, 9 aa, Homo Sapiens
LVLLLGHYT

SEQ ID NO: 890109 - protein, 9 aa, Homo Sapiens
CTYQTSGLY

SEQ ID NO: 890110 - protein, 9 aa, Homo Sapiens
GIYAISAPS

SEQ ID NO: 890111 - protein, 9 aa, Homo Sapiens
DVEEWGPFN

SEQ ID NO: 890112 - protein, 9 aa, Homo Sapiens
KERDSELSN

SEQ ID NO: 890113 - protein, 9 aa, Homo Sapiens
AANIAEALY

SEQ ID NO: 890114 - protein, 9 aa, Homo Sapiens
SSLYHQLHI

SEQ ID NO: 890115 - protein, 9 aa, Homo Sapiens
LEDKDIESI

SEQ ID NO: 890116 - protein, 9 aa, Homo Sapiens
TSFSRDYIV

SEQ ID NO: 890117 - protein, 9 aa, Homo Sapiens
TSQDTIQNQ

SEQ ID NO: 890118 - protein, 9 aa, Homo Sapiens
YLYGPDNHL

SEQ ID NO: 890119 - protein, 9 aa, Homo Sapiens
KKQELAFHS

SEQ ID NO: 890120 - protein, 9 aa, Homo Sapiens
APPAPCTPC

SEQ ID NO: 890121 - protein, 9 aa, Homo Sapiens
VWYMDSYTS

SEQ ID NO: 890122 - protein, 9 aa, Homo Sapiens
HSSGEERDI

SEQ ID NO: 890123 - protein, 9 aa, Homo Sapiens
CARAVVPSC

SEQ ID NO: 890124 - protein, 9 aa, Homo Sapiens
VKPFLDTVI

SEQ ID NO: 890125 - protein, 9 aa, Homo Sapiens
ATTTTTIFT

SEQ ID NO: 890126 - protein, 9 aa, Homo Sapiens
LVMWLGGFI

SEQ ID NO: 890127 - protein, 9 aa, Homo Sapiens
RPRYPNTCF

SEQ ID NO: 890128 - protein, 9 aa, Homo Sapiens
CKRVGPGFL

SEQ ID NO: 890129 - protein, 9 aa, Homo Sapiens
QMEMKEDNV

SEQ ID NO: 890130 - protein, 9 aa, Homo Sapiens
SQGWIPVKW

SEQ ID NO: 890131 - protein, 9 aa, Homo Sapiens
STLTSSAAS

SEQ ID NO: 890132 - protein, 9 aa, Homo Sapiens
HPTARSPVT

SEQ ID NO: 890133 - protein, 9 aa, Homo Sapiens
AGKMLAIYL

SEQ ID NO: 890134 - protein, 9 aa, Homo Sapiens
NKWAQEPAL

SEQ ID NO: 890135 - protein, 9 aa, Homo Sapiens
DQRVREQQI

SEQ ID NO: 890136 - protein, 9 aa, Homo Sapiens
VSKRHLRVD

SEQ ID NO: 890137 - protein, 9 aa, Homo Sapiens
FRRYTDLSR

SEQ ID NO: 890138 - protein, 9 aa, Homo Sapiens
ILAIVLRLR

SEQ ID NO: 890139 - protein, 9 aa, Homo Sapiens
GMPLDYVPP

SEQ ID NO: 890140 - protein, 9 aa, Homo Sapiens
PGVPSTLTT

SEQ ID NO: 890141 - protein, 9 aa, Homo Sapiens
EPTLALKLR

SEQ ID NO: 890142 - protein, 9 aa, Homo Sapiens
GIPREPSRG

SEQ ID NO: 890143 - protein, 9 aa, Homo Sapiens
LVHNGRMLL

SEQ ID NO: 890144 - protein, 9 aa, Homo Sapiens
FNGMPVISE

SEQ ID NO: 890145 - protein, 9 aa, Homo Sapiens
KRTFRLLDD

SEQ ID NO: 890146 - protein, 9 aa, Homo Sapiens
RTEIEKMAE

SEQ ID NO: 890147 - protein, 9 aa, Homo Sapiens
KENRVDATR

SEQ ID NO: 890148 - protein, 9 aa, Homo Sapiens
DFQSDNLVI

SEQ ID NO: 890149 - protein, 9 aa, Homo Sapiens
TLTTPGLTT

SEQ ID NO: 890150 - protein, 9 aa, Homo Sapiens
VCEYYLLHL

SEQ ID NO: 890151 - protein, 9 aa, Homo Sapiens
DGRIELSEF

SEQ ID NO: 890152 - protein, 9 aa, Homo Sapiens
SITRHYIDS

SEQ ID NO: 890153 - protein, 9 aa, Homo Sapiens
FKQDNCSWT

SEQ ID NO: 890154 - protein, 9 aa, Homo Sapiens
AGHLMVFTI

SEQ ID NO: 890155 - protein, 9 aa, Homo Sapiens
GPNLTDIVI

SEQ ID NO: 890156 - protein, 9 aa, Homo Sapiens
DNSFQNTTA

SEQ ID NO: 890157 - protein, 9 aa, Homo Sapiens
GAWGDYNDS

SEQ ID NO: 890158 - protein, 9 aa, Homo Sapiens
MVTNSQRGI

SEQ ID NO: 890159 - protein, 9 aa, Homo Sapiens
NPETKLIIV

SEQ ID NO: 890160 - protein, 9 aa, Homo Sapiens
KFSYMWIIN

SEQ ID NO: 890161 - protein, 9 aa, Homo Sapiens
ATCSTIGPP

SEQ ID NO: 890162 - protein, 9 aa, Homo Sapiens
HLMFKTFHL

SEQ ID NO: 890163 - protein, 9 aa, Homo Sapiens
LDLFSSLIC

SEQ ID NO: 890164 - protein, 9 aa, Homo Sapiens
KPHKAQNYR

SEQ ID NO: 890165 - protein, 9 aa, Homo Sapiens
KSTGSVCQL

SEQ ID NO: 890166 - protein, 9 aa, Homo Sapiens
NLDLQIRPV

SEQ ID NO: 890167 - protein, 9 aa, Homo Sapiens
VKNFEEYFM

SEQ ID NO: 890168 - protein, 9 aa, Homo Sapiens
RKKFPPHGP

SEQ ID NO: 890169 - protein, 9 aa, Homo Sapiens
EGSEKIITE

SEQ ID NO: 890170 - protein, 9 aa, Homo Sapiens
TTEDTEQDK

SEQ ID NO: 890171 - protein, 9 aa, Homo Sapiens
NRHGEITRL

SEQ ID NO: 890172 - protein, 9 aa, Homo Sapiens
EEIILIPYP

SEQ ID NO: 890173 - protein, 9 aa, Homo Sapiens
ENEDNTQSV

SEQ ID NO: 890174 - protein, 9 aa, Homo Sapiens
EKEEKMWRL

SEQ ID NO: 890175 - protein, 9 aa, Homo Sapiens
FPPHGPNLE

SEQ ID NO: 890176 - protein, 9 aa, Homo Sapiens
LSSIFLPQM

SEQ ID NO: 890177 - protein, 9 aa, Homo Sapiens
AFQNIPGSK

SEQ ID NO: 890178 - protein, 9 aa, Homo Sapiens
LRPRSLQSP

SEQ ID NO: 890179 - protein, 9 aa, Homo Sapiens
KSPGFTSPK

SEQ ID NO: 890180 - protein, 9 aa, Homo Sapiens
INQREKDCP

SEQ ID NO: 890181 - protein, 9 aa, Homo Sapiens
YVWLERTMP

SEQ ID NO: 890182 - protein, 9 aa, Homo Sapiens
KQCDVVDTT

SEQ ID NO: 890183 - protein, 9 aa, Homo Sapiens
ENNIWKALS

SEQ ID NO: 890184 - protein, 9 aa, Homo Sapiens
DLQVYLYRR

SEQ ID NO: 890185 - protein, 9 aa, Homo Sapiens
KQIRYRFRR

SEQ ID NO: 890186 - protein, 9 aa, Homo Sapiens
SSSNKWTGE

SEQ ID NO: 890187 - protein, 9 aa, Homo Sapiens
YSQDSIYLL

SEQ ID NO: 890188 - protein, 9 aa, Homo Sapiens
ETFGNAKTV

SEQ ID NO: 890189 - protein, 9 aa, Homo Sapiens
PNKHSIYIQ

SEQ ID NO: 890190 - protein, 9 aa, Homo Sapiens
GSGGGKNYG

SEQ ID NO: 890191 - protein, 9 aa, Homo Sapiens
SNQLINHIK

SEQ ID NO: 890192 - protein, 9 aa, Homo Sapiens
NPISVPLHR

SEQ ID NO: 890193 - protein, 9 aa, Homo Sapiens
IIFCQTRQN

SEQ ID NO: 890194 - protein, 9 aa, Homo Sapiens
LFPSWHRSS

SEQ ID NO: 890195 - protein, 9 aa, Homo Sapiens
TKLNSINSS

SEQ ID NO: 890196 - protein, 9 aa, Homo Sapiens
SSDLLRHHI

SEQ ID NO: 890197 - protein, 9 aa, Homo Sapiens
KIMRTKGFW

SEQ ID NO: 890198 - protein, 9 aa, Homo Sapiens
LTNGQWNDV

SEQ ID NO: 890199 - protein, 9 aa, Homo Sapiens
HESRRVEPQ

SEQ ID NO: 890200 - protein, 9 aa, Homo Sapiens
SISRVLSMY

SEQ ID NO: 890201 - protein, 9 aa, Homo Sapiens
LQLDDSIGS

SEQ ID NO: 890202 - protein, 9 aa, Homo Sapiens
KAKCKLVNH

SEQ ID NO: 890203 - protein, 9 aa, Homo Sapiens
VEDKRPEKI

SEQ ID NO: 890204 - protein, 9 aa, Homo Sapiens
DIGFKGIGE

SEQ ID NO: 890205 - protein, 9 aa, Homo Sapiens
PKIQTLLQD

SEQ ID NO: 890206 - protein, 9 aa, Homo Sapiens
NNNAPEILY

SEQ ID NO: 890207 - protein, 9 aa, Homo Sapiens
QIGDMRIME

SEQ ID NO: 890208 - protein, 9 aa, Homo Sapiens
LAGHNYVLD

SEQ ID NO: 890209 - protein, 9 aa, Homo Sapiens
YSNENDLLQ

SEQ ID NO: 890210 - protein, 9 aa, Homo Sapiens
VMLVHDIRQ

SEQ ID NO: 890211 - protein, 9 aa, Homo Sapiens
FELVSDFDC

SEQ ID NO: 890212 - protein, 9 aa, Homo Sapiens
EDQKPDSQM

SEQ ID NO: 890213 - protein, 9 aa, Homo Sapiens
AQCIMFIVN

SEQ ID NO: 890214 - protein, 9 aa, Homo Sapiens
AFYGGKPIL

SEQ ID NO: 890215 - protein, 9 aa, Homo Sapiens
EENEPYPVE

SEQ ID NO: 890216 - protein, 9 aa, Homo Sapiens
FAQPKYTVF

SEQ ID NO: 890217 - protein, 9 aa, Homo Sapiens
GMQKLLGLE

SEQ ID NO: 890218 - protein, 9 aa, Homo Sapiens
GEQTVRCCG

SEQ ID NO: 890219 - protein, 9 aa, Homo Sapiens
YTLQICTSQ

SEQ ID NO: 890220 - protein, 9 aa, Homo Sapiens
NPVYEQYYR

SEQ ID NO: 890221 - protein, 9 aa, Homo Sapiens
ANCSASIRI

SEQ ID NO: 890222 - protein, 9 aa, Homo Sapiens
HTEILAKRT

SEQ ID NO: 890223 - protein, 9 aa, Homo Sapiens
LQQGCWDAE

SEQ ID NO: 890224 - protein, 9 aa, Homo Sapiens
LRAISVGSG

SEQ ID NO: 890225 - protein, 9 aa, Homo Sapiens
LWASDECLQ

SEQ ID NO: 890226 - protein, 9 aa, Homo Sapiens
QEVLEREQR

SEQ ID NO: 890227 - protein, 9 aa, Homo Sapiens
ADPGMPRML

SEQ ID NO: 890228 - protein, 9 aa, Homo Sapiens
DTGRNIRKN

SEQ ID NO: 890229 - protein, 9 aa, Homo Sapiens
EQSLLNMCV

SEQ ID NO: 890230 - protein, 9 aa, Homo Sapiens
EFEYEIQFG

SEQ ID NO: 890231 - protein, 9 aa, Homo Sapiens
NELFRTEGA

SEQ ID NO: 890232 - protein, 9 aa, Homo Sapiens
NYGYTSFYT

SEQ ID NO: 890233 - protein, 9 aa, Homo Sapiens
FPKGNKVQI

SEQ ID NO: 890234 - protein, 9 aa, Homo Sapiens
YTVWAKRGT

SEQ ID NO: 890235 - protein, 9 aa, Homo Sapiens
PELSSKKNQ

SEQ ID NO: 890236 - protein, 9 aa, Homo Sapiens
KDNCRPDGR

SEQ ID NO: 890237 - protein, 9 aa, Homo Sapiens
HCLVTISVD

SEQ ID NO: 890238 - protein, 9 aa, Homo Sapiens
SSAEKTSST

SEQ ID NO: 890239 - protein, 9 aa, Homo Sapiens
LSNLGYLQA

SEQ ID NO: 890240 - protein, 9 aa, Homo Sapiens
GGQSQQTLD

SEQ ID NO: 890241 - protein, 9 aa, Homo Sapiens
IFEDIIRGI

SEQ ID NO: 890242 - protein, 9 aa, Homo Sapiens
LYEYKNIRI

SEQ ID NO: 890243 - protein, 9 aa, Homo Sapiens
QNSNKNILQ

SEQ ID NO: 890244 - protein, 9 aa, Homo Sapiens
LIQKHTGSG

SEQ ID NO: 890245 - protein, 9 aa, Homo Sapiens
GPFSRHLVD

SEQ ID NO: 890246 - protein, 9 aa, Homo Sapiens
DQQKPRVNK

SEQ ID NO: 890247 - protein, 9 aa, Homo Sapiens
LRNEVIHIS

SEQ ID NO: 890248 - protein, 9 aa, Homo Sapiens
AKEQGAVAL

SEQ ID NO: 890249 - protein, 9 aa, Homo Sapiens
CKRFWDCGL

SEQ ID NO: 890250 - protein, 9 aa, Homo Sapiens
DKLYSLKSE

SEQ ID NO: 890251 - protein, 9 aa, Homo Sapiens
TMANNKGLF

SEQ ID NO: 890252 - protein, 9 aa, Homo Sapiens
CNNYWIWEN

SEQ ID NO: 890253 - protein, 9 aa, Homo Sapiens
IGQVLAQMH

SEQ ID NO: 890254 - protein, 9 aa, Homo Sapiens
LVPLPVPWT

SEQ ID NO: 890255 - protein, 9 aa, Homo Sapiens
NQNSTSSWF

SEQ ID NO: 890256 - protein, 9 aa, Homo Sapiens
KSLSENNSN

SEQ ID NO: 890257 - protein, 9 aa, Homo Sapiens
DHRRSRSPN

SEQ ID NO: 890258 - protein, 9 aa, Homo Sapiens
KNDTLDPKP

SEQ ID NO: 890259 - protein, 9 aa, Homo Sapiens
MDCVLLHVD

SEQ ID NO: 890260 - protein, 9 aa, Homo Sapiens
VPPAGSPKL

SEQ ID NO: 890261 - protein, 9 aa, Homo Sapiens
TVGKSIVLN

SEQ ID NO: 890262 - protein, 9 aa, Homo Sapiens
TLDPKPFVD

SEQ ID NO: 890263 - protein, 9 aa, Homo Sapiens
ESESGQLLD

SEQ ID NO: 890264 - protein, 9 aa, Homo Sapiens
CVECGKLFC

SEQ ID NO: 890265 - protein, 9 aa, Homo Sapiens
DVKCIKDLF

SEQ ID NO: 890266 - protein, 9 aa, Homo Sapiens
DVQRVPRNR

SEQ ID NO: 890267 - protein, 9 aa, Homo Sapiens
KFCGKGFHQ

SEQ ID NO: 890268 - protein, 9 aa, Homo Sapiens
NVWVALYNN

SEQ ID NO: 890269 - protein, 9 aa, Homo Sapiens
FWEINWEEL

SEQ ID NO: 890270 - protein, 9 aa, Homo Sapiens
VKKCCLNGC

SEQ ID NO: 890271 - protein, 9 aa, Homo Sapiens
SAWQMAYEP

SEQ ID NO: 890272 - protein, 9 aa, Homo Sapiens
TTTIFTTLN

SEQ ID NO: 890273 - protein, 9 aa, Homo Sapiens
EEVLTKFRE

SEQ ID NO: 890274 - protein, 9 aa, Homo Sapiens
LSVDEMIHK

SEQ ID NO: 890275 - protein, 9 aa, Homo Sapiens
LLLGHYTEE

SEQ ID NO: 890276 - protein, 9 aa, Homo Sapiens
IGNSIKHRF

SEQ ID NO: 890277 - protein, 9 aa, Homo Sapiens
PFQNKCFRN

SEQ ID NO: 890278 - protein, 9 aa, Homo Sapiens
ACKYTLQIC

SEQ ID NO: 890279 - protein, 9 aa, Homo Sapiens
WVGTFLCWI

SEQ ID NO: 890280 - protein, 9 aa, Homo Sapiens
YPSKGRWVE

SEQ ID NO: 890281 - protein, 9 aa, Homo Sapiens
GKVDPYHSC

SEQ ID NO: 890282 - protein, 9 aa, Homo Sapiens
LNIINMALS

SEQ ID NO: 890283 - protein, 9 aa, Homo Sapiens
MSCCLNPII

SEQ ID NO: 890284 - protein, 9 aa, Homo Sapiens
NKYLELKAK

SEQ ID NO: 890285 - protein, 9 aa, Homo Sapiens
HLCPQFPLI

SEQ ID NO: 890286 - protein, 9 aa, Homo Sapiens
CCYLCKQSK

SEQ ID NO: 890287 - protein, 9 aa, Homo Sapiens
KHQRTHTGD

SEQ ID NO: 890288 - protein, 9 aa, Homo Sapiens
EWQFFVKWQ

SEQ ID NO: 890289 - protein, 9 aa, Homo Sapiens
KYNAIKKYL

SEQ ID NO: 890290 - protein, 9 aa, Homo Sapiens
RTILFDIPP

SEQ ID NO: 890291 - protein, 9 aa, Homo Sapiens
TLGLIDLCL

SEQ ID NO: 890292 - protein, 9 aa, Homo Sapiens
VQEEYERDH

SEQ ID NO: 890293 - protein, 9 aa, Homo Sapiens
CFMISTPEK

SEQ ID NO: 890294 - protein, 9 aa, Homo Sapiens
GDMHVILWP

SEQ ID NO: 890295 - protein, 9 aa, Homo Sapiens
ILRSQSMND

SEQ ID NO: 890296 - protein, 9 aa, Homo Sapiens
RDKFTKALM

SEQ ID NO: 890297 - protein, 9 aa, Homo Sapiens
DLRRPHQQE

SEQ ID NO: 890298 - protein, 9 aa, Homo Sapiens
HSSRSHCIF

SEQ ID NO: 890299 - protein, 9 aa, Homo Sapiens
ITYLPSVSN

SEQ ID NO: 890300 - protein, 9 aa, Homo Sapiens
QRMHTGEKS

SEQ ID NO: 890301 - protein, 9 aa, Homo Sapiens
HTILQYYCC

SEQ ID NO: 890302 - protein, 9 aa, Homo Sapiens
GRKENRVDA

SEQ ID NO: 890303 - protein, 9 aa, Homo Sapiens
TKLIIVDYI

SEQ ID NO: 890304 - protein, 9 aa, Homo Sapiens
RVRCINLAR

SEQ ID NO: 890305 - protein, 9 aa, Homo Sapiens
SNSIDHQIP

SEQ ID NO: 890306 - protein, 9 aa, Homo Sapiens
EAVNNYIVN

SEQ ID NO: 890307 - protein, 9 aa, Homo Sapiens
RRIQNEKGE

SEQ ID NO: 890308 - protein, 9 aa, Homo Sapiens
HKLINKIKS

SEQ ID NO: 890309 - protein, 9 aa, Homo Sapiens
IGFHRVVKI

SEQ ID NO: 890310 - protein, 9 aa, Homo Sapiens
LCPQSCKER

SEQ ID NO: 890311 - protein, 9 aa, Homo Sapiens
LYYECYSDA

SEQ ID NO: 890312 - protein, 9 aa, Homo Sapiens
IFTSPTNFQ

SEQ ID NO: 890313 - protein, 9 aa, Homo Sapiens
KEEVPGKVK

SEQ ID NO: 890314 - protein, 9 aa, Homo Sapiens
VKYHTETDE

SEQ ID NO: 890315 - protein, 9 aa, Homo Sapiens
IQREVKILE

SEQ ID NO: 890316 - protein, 9 aa, Homo Sapiens
ADNHEELSA

SEQ ID NO: 890317 - protein, 9 aa, Homo Sapiens
INLTFGYKL

SEQ ID NO: 890318 - protein, 9 aa, Homo Sapiens
FLGLWQGVG

SEQ ID NO: 890319 - protein, 9 aa, Homo Sapiens
QAIPHIATT

SEQ ID NO: 890320 - protein, 9 aa, Homo Sapiens
ILQMSYQYI

SEQ ID NO: 890321 - protein, 9 aa, Homo Sapiens
SLPKVLNIN

SEQ ID NO: 890322 - protein, 9 aa, Homo Sapiens
CLRWLKRDS

SEQ ID NO: 890323 - protein, 9 aa, Homo Sapiens
KIDQAWKIL

SEQ ID NO: 890324 - protein, 9 aa, Homo Sapiens
FFRYLGDKG

SEQ ID NO: 890325 - protein, 9 aa, Homo Sapiens
YAFAKAIGD

SEQ ID NO: 890326 - protein, 9 aa, Homo Sapiens
VCSFLQKNQ

SEQ ID NO: 890327 - protein, 9 aa, Homo Sapiens
GFSSPEEGK

SEQ ID NO: 890328 - protein, 9 aa, Homo Sapiens
LFFAILLAF

SEQ ID NO: 890329 - protein, 9 aa, Homo Sapiens
TEHRVFFSD

SEQ ID NO: 890330 - protein, 9 aa, Homo Sapiens
MKFDEIHWL

SEQ ID NO: 890331 - protein, 9 aa, Homo Sapiens
HQIFFNPQG

SEQ ID NO: 890332 - protein, 9 aa, Homo Sapiens
NSDSYDSLS

SEQ ID NO: 890333 - protein, 9 aa, Homo Sapiens
LKYTFFECK

SEQ ID NO: 890334 - protein, 9 aa, Homo Sapiens
GLTSSIDYL

SEQ ID NO: 890335 - protein, 9 aa, Homo Sapiens
QRHIKHRTS

SEQ ID NO: 890336 - protein, 9 aa, Homo Sapiens
ILAGDVDTH

SEQ ID NO: 890337 - protein, 9 aa, Homo Sapiens
LEEAVSHNA

SEQ ID NO: 890338 - protein, 9 aa, Homo Sapiens
TYSHCLISG

SEQ ID NO: 890339 - protein, 9 aa, Homo Sapiens
RCIPDEVIA

SEQ ID NO: 890340 - protein, 9 aa, Homo Sapiens
KTMSEGSDC

SEQ ID NO: 890341 - protein, 9 aa, Homo Sapiens
GDFLAYLEN

SEQ ID NO: 890342 - protein, 9 aa, Homo Sapiens
PEKFLNILF

SEQ ID NO: 890343 - protein, 9 aa, Homo Sapiens
SGEGERRFI

SEQ ID NO: 890344 - protein, 9 aa, Homo Sapiens
DLEPKQSLI

SEQ ID NO: 890345 - protein, 9 aa, Homo Sapiens
HKRTVAFLN

SEQ ID NO: 890346 - protein, 9 aa, Homo Sapiens
VTFSILNDN

SEQ ID NO: 890347 - protein, 9 aa, Homo Sapiens
GFCFHTDKT

SEQ ID NO: 890348 - protein, 9 aa, Homo Sapiens
TVRARRPPK

SEQ ID NO: 890349 - protein, 9 aa, Homo Sapiens
KTHPKQEKA

SEQ ID NO: 890350 - protein, 9 aa, Homo Sapiens
QLWILQFNS

SEQ ID NO: 890351 - protein, 9 aa, Homo Sapiens
AQCCECKCN

SEQ ID NO: 890352 - protein, 9 aa, Homo Sapiens
CHLHKQPSH

SEQ ID NO: 890353 - protein, 9 aa, Homo Sapiens
FHSGINIKT

SEQ ID NO: 890354 - protein, 9 aa, Homo Sapiens
CLLREELQL

SEQ ID NO: 890355 - protein, 9 aa, Homo Sapiens
IVQILPWEH

SEQ ID NO: 890356 - protein, 9 aa, Homo Sapiens
SLRNLTADY

SEQ ID NO: 890357 - protein, 9 aa, Homo Sapiens
QMWLHLQLD

SEQ ID NO: 890358 - protein, 9 aa, Homo Sapiens
LHQKKLQLA

SEQ ID NO: 890359 - protein, 9 aa, Homo Sapiens
EKGQLPSPQ

SEQ ID NO: 890360 - protein, 9 aa, Homo Sapiens
KSQLIVHQI

SEQ ID NO: 890361 - protein, 9 aa, Homo Sapiens
FICAACGEI

SEQ ID NO: 890362 - protein, 9 aa, Homo Sapiens
KCFKTLKGH

SEQ ID NO: 890363 - protein, 9 aa, Homo Sapiens
LQDNGEVPE

SEQ ID NO: 890364 - protein, 9 aa, Homo Sapiens
GHLVYLLTD

SEQ ID NO: 890365 - protein, 9 aa, Homo Sapiens
VNEIWKVLT

SEQ ID NO: 890366 - protein, 9 aa, Homo Sapiens
RRPHQQELC

SEQ ID NO: 890367 - protein, 9 aa, Homo Sapiens
PSNSTQLPV

SEQ ID NO: 890368 - protein, 9 aa, Homo Sapiens
SNMYQVWQR

SEQ ID NO: 890369 - protein, 9 aa, Homo Sapiens
TSSTSCICQ

SEQ ID NO: 890370 - protein, 9 aa, Homo Sapiens
SLEEDLEWY

SEQ ID NO: 890371 - protein, 9 aa, Homo Sapiens
AGSLIINKM

SEQ ID NO: 890372 - protein, 9 aa, Homo Sapiens
QQDCEPVFS

SEQ ID NO: 890373 - protein, 9 aa, Homo Sapiens
RQLYQPEPL

SEQ ID NO: 890374 - protein, 9 aa, Homo Sapiens
PKGQTSVLL

SEQ ID NO: 890375 - protein, 9 aa, Homo Sapiens
TPSYPGYLR

SEQ ID NO: 890376 - protein, 9 aa, Homo Sapiens
EESTWCVLQ

SEQ ID NO: 890377 - protein, 9 aa, Homo Sapiens
AAFCFYFCT

SEQ ID NO: 890378 - protein, 9 aa, Homo Sapiens
MTLLDVFEV

SEQ ID NO: 890379 - protein, 9 aa, Homo Sapiens
LPSCAYYMP

SEQ ID NO: 890380 - protein, 9 aa, Homo Sapiens
SKVIDVKPF

SEQ ID NO: 890381 - protein, 9 aa, Homo Sapiens
GFKGKNCEL

SEQ ID NO: 890382 - protein, 9 aa, Homo Sapiens
TLLGSDNPS

SEQ ID NO: 890383 - protein, 9 aa, Homo Sapiens
GKVKAQICE

SEQ ID NO: 890384 - protein, 9 aa, Homo Sapiens
LEWMFCGFL

SEQ ID NO: 890385 - protein, 9 aa, Homo Sapiens
NNLKPIKPM

SEQ ID NO: 890386 - protein, 9 aa, Homo Sapiens
NDLKKDNFS

SEQ ID NO: 890387 - protein, 9 aa, Homo Sapiens
FLAQFSMFQ

SEQ ID NO: 890388 - protein, 9 aa, Homo Sapiens
CFQVGGKKR

SEQ ID NO: 890389 - protein, 9 aa, Homo Sapiens
ILKQKEISN

SEQ ID NO: 890390 - protein, 9 aa, Homo Sapiens
TNTEPLQEC

SEQ ID NO: 890391 - protein, 9 aa, Homo Sapiens
ERATWNDHF

SEQ ID NO: 890392 - protein, 9 aa, Homo Sapiens
KVCDGEGVW

SEQ ID NO: 890393 - protein, 9 aa, Homo Sapiens
EPTEHGEST

SEQ ID NO: 890394 - protein, 9 aa, Homo Sapiens
DCLRLYYFT

SEQ ID NO: 890395 - protein, 9 aa, Homo Sapiens
PMKKAQNDE

SEQ ID NO: 890396 - protein, 9 aa, Homo Sapiens
EEQDAHKLF

SEQ ID NO: 890397 - protein, 9 aa, Homo Sapiens
MMLILIGQK

SEQ ID NO: 890398 - protein, 9 aa, Homo Sapiens
DRIHKQDEL

SEQ ID NO: 890399 - protein, 9 aa, Homo Sapiens
KNIPNSLAF

SEQ ID NO: 890400 - protein, 9 aa, Homo Sapiens
SDNGFLADD

SEQ ID NO: 890401 - protein, 9 aa, Homo Sapiens
QEGQCRVDY

SEQ ID NO: 890402 - protein, 9 aa, Homo Sapiens
MTTFECETS

SEQ ID NO: 890403 - protein, 9 aa, Homo Sapiens
VGSGYRMLL

SEQ ID NO: 890404 - protein, 9 aa, Homo Sapiens
SCQACAGID

SEQ ID NO: 890405 - protein, 9 aa, Homo Sapiens
VVAFNTSHL

SEQ ID NO: 890406 - protein, 9 aa, Homo Sapiens
WNCEAPYIP

SEQ ID NO: 890407 - protein, 9 aa, Homo Sapiens
LAATSYFSS

SEQ ID NO: 890408 - protein, 9 aa, Homo Sapiens
TEPLQECIS

SEQ ID NO: 890409 - protein, 9 aa, Homo Sapiens
THKNIHTGG

SEQ ID NO: 890410 - protein, 9 aa, Homo Sapiens
LIQNDYFIR

SEQ ID NO: 890411 - protein, 9 aa, Homo Sapiens
HRGKVLSSR

SEQ ID NO: 890412 - protein, 9 aa, Homo Sapiens
NKSGDQLKR

SEQ ID NO: 890413 - protein, 9 aa, Homo Sapiens
GYRMLLVKR

SEQ ID NO: 890414 - protein, 9 aa, Homo Sapiens
NYQESNTSQ

SEQ ID NO: 890415 - protein, 9 aa, Homo Sapiens
MLRHKTYNL

SEQ ID NO: 890416 - protein, 9 aa, Homo Sapiens
PGKVVFYTW

SEQ ID NO: 890417 - protein, 9 aa, Homo Sapiens
NEVQLWAAT

SEQ ID NO: 890418 - protein, 9 aa, Homo Sapiens
EWPSLRSQA

SEQ ID NO: 890419 - protein, 9 aa, Homo Sapiens
RNVLLTCSL

SEQ ID NO: 890420 - protein, 9 aa, Homo Sapiens
SILNFYHTG

SEQ ID NO: 890421 - protein, 9 aa, Homo Sapiens
EDLNWIIPD

SEQ ID NO: 890422 - protein, 9 aa, Homo Sapiens
RKEKDTFKE

SEQ ID NO: 890423 - protein, 9 aa, Homo Sapiens
LDVEASDKL

SEQ ID NO: 890424 - protein, 9 aa, Homo Sapiens
GKKVKKKVV

SEQ ID NO: 890425 - protein, 9 aa, Homo Sapiens
ERDCRRHFT

SEQ ID NO: 890426 - protein, 9 aa, Homo Sapiens
PETNSYFQP

SEQ ID NO: 890427 - protein, 9 aa, Homo Sapiens
DIQINIWYG

SEQ ID NO: 890428 - protein, 9 aa, Homo Sapiens
VSVLCTENE

SEQ ID NO: 890429 - protein, 9 aa, Homo Sapiens
WLSVLFIFQ

SEQ ID NO: 890430 - protein, 9 aa, Homo Sapiens
KYLCIAEYA

SEQ ID NO: 890431 - protein, 9 aa, Homo Sapiens
IYAEIGLIL

SEQ ID NO: 890432 - protein, 9 aa, Homo Sapiens
TVTMRIWVL

SEQ ID NO: 890433 - protein, 9 aa, Homo Sapiens
LEYVTLSQR

SEQ ID NO: 890434 - protein, 9 aa, Homo Sapiens
RDGTLDGSQ

SEQ ID NO: 890435 - protein, 9 aa, Homo Sapiens
FPANEKKRD

SEQ ID NO: 890436 - protein, 9 aa, Homo Sapiens
HPAYLYSLE

SEQ ID NO: 890437 - protein, 9 aa, Homo Sapiens
ARDHYTIGK

SEQ ID NO: 890438 - protein, 9 aa, Homo Sapiens
RQPQWRRED

SEQ ID NO: 890439 - protein, 9 aa, Homo Sapiens
IDLCLTVEQ

SEQ ID NO: 890440 - protein, 9 aa, Homo Sapiens
RSGFYKAFA

SEQ ID NO: 890441 - protein, 9 aa, Homo Sapiens
LQPGRPLTQ

SEQ ID NO: 890442 - protein, 9 aa, Homo Sapiens
DQPLHTLYH

SEQ ID NO: 890443 - protein, 9 aa, Homo Sapiens
LASSGVNGV

SEQ ID NO: 890444 - protein, 9 aa, Homo Sapiens
PSALGKSVQ

SEQ ID NO: 890445 - protein, 9 aa, Homo Sapiens
SSAAPLLFS

SEQ ID NO: 890446 - protein, 9 aa, Homo Sapiens
GAGTNKDAL

SEQ ID NO: 890447 - protein, 9 aa, Homo Sapiens
EPPTESQDN

SEQ ID NO: 890448 - protein, 9 aa, Homo Sapiens
LLKVLAQLW

SEQ ID NO: 890449 - protein, 9 aa, Homo Sapiens
HLAFLLGLP

SEQ ID NO: 890450 - protein, 9 aa, Homo Sapiens
EDAVNKFQK

SEQ ID NO: 890451 - protein, 9 aa, Homo Sapiens
APGDLAPQS

SEQ ID NO: 890452 - protein, 9 aa, Homo Sapiens
PPLGGHFHI

SEQ ID NO: 890453 - protein, 9 aa, Homo Sapiens
NSSGSYWVS

SEQ ID NO: 890454 - protein, 9 aa, Homo Sapiens
HKSKLEYQN

SEQ ID NO: 890455 - protein, 9 aa, Homo Sapiens
THYYETYIR

SEQ ID NO: 890456 - protein, 9 aa, Homo Sapiens
QNASQKEIK

SEQ ID NO: 890457 - protein, 9 aa, Homo Sapiens
VPAIEEKLL

SEQ ID NO: 890458 - protein, 9 aa, Homo Sapiens
IFILLCLKV

SEQ ID NO: 890459 - protein, 9 aa, Homo Sapiens
SCGGGVRIC

SEQ ID NO: 890460 - protein, 9 aa, Homo Sapiens
ERNKWIHCF

SEQ ID NO: 890461 - protein, 9 aa, Homo Sapiens
VGVVQDHSN

SEQ ID NO: 890462 - protein, 9 aa, Homo Sapiens
MQRVQEEYE

SEQ ID NO: 890463 - protein, 9 aa, Homo Sapiens
LEESLCGTS

SEQ ID NO: 890464 - protein, 9 aa, Homo Sapiens
THQVVQQKS

SEQ ID NO: 890465 - protein, 9 aa, Homo Sapiens
AKNIFRICF

SEQ ID NO: 890466 - protein, 9 aa, Homo Sapiens
KIKILGDCY

SEQ ID NO: 890467 - protein, 9 aa, Homo Sapiens
KYMSERSKV

SEQ ID NO: 890468 - protein, 9 aa, Homo Sapiens
IEREKERDL

SEQ ID NO: 890469 - protein, 9 aa, Homo Sapiens
SKMQQNIGK

SEQ ID NO: 890470 - protein, 9 aa, Homo Sapiens
GSKRKSDQM

SEQ ID NO: 890471 - protein, 9 aa, Homo Sapiens
STSSDCQDS

SEQ ID NO: 890472 - protein, 9 aa, Homo Sapiens
IPGSKLMSS

SEQ ID NO: 890473 - protein, 9 aa, Homo Sapiens
VWEAFDLFD

SEQ ID NO: 890474 - protein, 9 aa, Homo Sapiens
LLQIREKER

SEQ ID NO: 890475 - protein, 9 aa, Homo Sapiens
LLRCPGRSQ

SEQ ID NO: 890476 - protein, 9 aa, Homo Sapiens
KFREDLELY

SEQ ID NO: 890477 - protein, 9 aa, Homo Sapiens
NNTWITDIT

SEQ ID NO: 890478 - protein, 9 aa, Homo Sapiens
LLYYKYPSD

SEQ ID NO: 890479 - protein, 9 aa, Homo Sapiens
NTFWIKSGN

SEQ ID NO: 890480 - protein, 9 aa, Homo Sapiens
YLFAERKYQ

SEQ ID NO: 890481 - protein, 9 aa, Homo Sapiens
VAIELSQEE

SEQ ID NO: 890482 - protein, 9 aa, Homo Sapiens
CLGSSAANT

SEQ ID NO: 890483 - protein, 9 aa, Homo Sapiens
PAFGVACMD

SEQ ID NO: 890484 - protein, 9 aa, Homo Sapiens
PRRIPKKGL

SEQ ID NO: 890485 - protein, 9 aa, Homo Sapiens
GGDKLPIQG

SEQ ID NO: 890486 - protein, 9 aa, Homo Sapiens
DNYIRDRLA

SEQ ID NO: 890487 - protein, 9 aa, Homo Sapiens
RNFHKYFLI

SEQ ID NO: 890488 - protein, 9 aa, Homo Sapiens
DKNRLTRDD

SEQ ID NO: 890489 - protein, 9 aa, Homo Sapiens
DHLLNCIMG

SEQ ID NO: 890490 - protein, 9 aa, Homo Sapiens
DEDCVLLLT

SEQ ID NO: 890491 - protein, 9 aa, Homo Sapiens
ITFNTSVYS

SEQ ID NO: 890492 - protein, 9 aa, Homo Sapiens
GKTPSSIRK

SEQ ID NO: 890493 - protein, 9 aa, Homo Sapiens
SARYGNSSG

SEQ ID NO: 890494 - protein, 9 aa, Homo Sapiens
SEAKHKQAE

SEQ ID NO: 890495 - protein, 9 aa, Homo Sapiens
ALPSVVFAR

SEQ ID NO: 890496 - protein, 9 aa, Homo Sapiens
MIILLNNTG

SEQ ID NO: 890497 - protein, 9 aa, Homo Sapiens
GWEIRYTHE

SEQ ID NO: 890498 - protein, 9 aa, Homo Sapiens
KGKYPVPKS

SEQ ID NO: 890499 - protein, 9 aa, Homo Sapiens
RLGIIYRYL

SEQ ID NO: 890500 - protein, 9 aa, Homo Sapiens
KSGRCVNTD

SEQ ID NO: 890501 - protein, 9 aa, Homo Sapiens
ECRLQTEEC

SEQ ID NO: 890502 - protein, 9 aa, Homo Sapiens
LYSITGYPN

SEQ ID NO: 890503 - protein, 9 aa, Homo Sapiens
AEHLSMIRA

SEQ ID NO: 890504 - protein, 9 aa, Homo Sapiens
KHILFQRRR

SEQ ID NO: 890505 - protein, 9 aa, Homo Sapiens
VNNSQNNTP

SEQ ID NO: 890506 - protein, 9 aa, Homo Sapiens
CLEKTSQML

SEQ ID NO: 890507 - protein, 9 aa, Homo Sapiens
LTGASTIRT

SEQ ID NO: 890508 - protein, 9 aa, Homo Sapiens
YPHLYEDTL

SEQ ID NO: 890509 - protein, 9 aa, Homo Sapiens
AFTHLHINA

SEQ ID NO: 890510 - protein, 9 aa, Homo Sapiens
DFRCDPNFH

SEQ ID NO: 890511 - protein, 9 aa, Homo Sapiens
LNRNVTDIK

SEQ ID NO: 890512 - protein, 9 aa, Homo Sapiens
NTMPEIMES

SEQ ID NO: 890513 - protein, 9 aa, Homo Sapiens
NLGVGAYHT

SEQ ID NO: 890514 - protein, 9 aa, Homo Sapiens
QLQELDNFF

SEQ ID NO: 890515 - protein, 9 aa, Homo Sapiens
YQTDLKEIS

SEQ ID NO: 890516 - protein, 9 aa, Homo Sapiens
KLLHGEFSA

SEQ ID NO: 890517 - protein, 9 aa, Homo Sapiens
GLVHQTHMS

SEQ ID NO: 890518 - protein, 9 aa, Homo Sapiens
AEKQNYVAP

SEQ ID NO: 890519 - protein, 9 aa, Homo Sapiens
SLKNLEHHL

SEQ ID NO: 890520 - protein, 9 aa, Homo Sapiens
QKDVLEIFN

SEQ ID NO: 890521 - protein, 9 aa, Homo Sapiens
TPKMLADVL

SEQ ID NO: 890522 - protein, 9 aa, Homo Sapiens
VKCAQCCEC

SEQ ID NO: 890523 - protein, 9 aa, Homo Sapiens
ICSKLGAKL

SEQ ID NO: 890524 - protein, 9 aa, Homo Sapiens
DKKLRKEAE

SEQ ID NO: 890525 - protein, 9 aa, Homo Sapiens
PIDDKLYTV

SEQ ID NO: 890526 - protein, 9 aa, Homo Sapiens
SGGNKKIRP

SEQ ID NO: 890527 - protein, 9 aa, Homo Sapiens
ATNKAYLDI

SEQ ID NO: 890528 - protein, 9 aa, Homo Sapiens
SLVLRQSFE

SEQ ID NO: 890529 - protein, 9 aa, Homo Sapiens
CVQRRLEIT

SEQ ID NO: 890530 - protein, 9 aa, Homo Sapiens
SIPLFAPPA

SEQ ID NO: 890531 - protein, 9 aa, Homo Sapiens
EFNLQRGDR

SEQ ID NO: 890532 - protein, 9 aa, Homo Sapiens
TWSLHPLAL

SEQ ID NO: 890533 - protein, 9 aa, Homo Sapiens
QMHVQLSTS

SEQ ID NO: 890534 - protein, 9 aa, Homo Sapiens
KTRYCVIIQ

SEQ ID NO: 890535 - protein, 9 aa, Homo Sapiens
SVGSVLGVC

SEQ ID NO: 890536 - protein, 9 aa, Homo Sapiens
SGEISEIKE

SEQ ID NO: 890537 - protein, 9 aa, Homo Sapiens
DCCNNMPVC

SEQ ID NO: 890538 - protein, 9 aa, Homo Sapiens
GMPNNKFLV

SEQ ID NO: 890539 - protein, 9 aa, Homo Sapiens
LSCIKAKQL

SEQ ID NO: 890540 - protein, 9 aa, Homo Sapiens
ANLIKIKLT

SEQ ID NO: 890541 - protein, 9 aa, Homo Sapiens
YVFCMQKYH

SEQ ID NO: 890542 - protein, 9 aa, Homo Sapiens
TTRLCQDEQ

SEQ ID NO: 890543 - protein, 9 aa, Homo Sapiens
EQDKERNSE

SEQ ID NO: 890544 - protein, 9 aa, Homo Sapiens
LSPKNLAAP

SEQ ID NO: 890545 - protein, 9 aa, Homo Sapiens
DGRTSFDEF

SEQ ID NO: 890546 - protein, 9 aa, Homo Sapiens
RIWVLKALQ

SEQ ID NO: 890547 - protein, 9 aa, Homo Sapiens
FINHCLVES

SEQ ID NO: 890548 - protein, 9 aa, Homo Sapiens
RNGQVDIKT

SEQ ID NO: 890549 - protein, 9 aa, Homo Sapiens
ILKSPGFTS

SEQ ID NO: 890550 - protein, 9 aa, Homo Sapiens
PGLTSHADY

SEQ ID NO: 890551 - protein, 9 aa, Homo Sapiens
NYFGPVSLG

SEQ ID NO: 890552 - protein, 9 aa, Homo Sapiens
EYTGRPGPL

SEQ ID NO: 890553 - protein, 9 aa, Homo Sapiens
LSSVSKTLI

SEQ ID NO: 890554 - protein, 9 aa, Homo Sapiens
YYRKQRQKQ

SEQ ID NO: 890555 - protein, 9 aa, Homo Sapiens
ILGPVIQFF

SEQ ID NO: 890556 - protein, 9 aa, Homo Sapiens
ELLNKLCQA

SEQ ID NO: 890557 - protein, 9 aa, Homo Sapiens
LLQSPVALC

SEQ ID NO: 890558 - protein, 9 aa, Homo Sapiens
WAELAGHNY

SEQ ID NO: 890559 - protein, 9 aa, Homo Sapiens
KSLEEVRGA

SEQ ID NO: 890560 - protein, 9 aa, Homo Sapiens
ARSSEVKTE

SEQ ID NO: 890561 - protein, 9 aa, Homo Sapiens
EDNKEDPMM

SEQ ID NO: 890562 - protein, 9 aa, Homo Sapiens
EDEAQSLKN

SEQ ID NO: 890563 - protein, 9 aa, Homo Sapiens
TIVMAYFFT

SEQ ID NO: 890564 - protein, 9 aa, Homo Sapiens
TPLLKEISD

SEQ ID NO: 890565 - protein, 9 aa, Homo Sapiens
PLEGRPEWQ

SEQ ID NO: 890566 - protein, 9 aa, Homo Sapiens
CCTQLYQKP

SEQ ID NO: 890567 - protein, 9 aa, Homo Sapiens
SRHVCSHGD

SEQ ID NO: 890568 - protein, 9 aa, Homo Sapiens
QGKKNYFSL

SEQ ID NO: 890569 - protein, 9 aa, Homo Sapiens
QELKEIERL

SEQ ID NO: 890570 - protein, 9 aa, Homo Sapiens
EGYRGKKCQ

SEQ ID NO: 890571 - protein, 9 aa, Homo Sapiens
AMEEVCKVN

SEQ ID NO: 890572 - protein, 9 aa, Homo Sapiens
DMFMSMQSL

SEQ ID NO: 890573 - protein, 9 aa, Homo Sapiens
KSMCPSLDK

SEQ ID NO: 890574 - protein, 9 aa, Homo Sapiens
FKFSSGSES

SEQ ID NO: 890575 - protein, 9 aa, Homo Sapiens
AEYILRAVR

SEQ ID NO: 890576 - protein, 9 aa, Homo Sapiens
VNKHVFSGG

SEQ ID NO: 890577 - protein, 9 aa, Homo Sapiens
SQPRYSWEW

SEQ ID NO: 890578 - protein, 9 aa, Homo Sapiens
DLVPILELA

SEQ ID NO: 890579 - protein, 9 aa, Homo Sapiens
QNQKTPTSL

SEQ ID NO: 890580 - protein, 9 aa, Homo Sapiens
QKQARLVLQ

SEQ ID NO: 890581 - protein, 9 aa, Homo Sapiens
NQMWLHLQL

SEQ ID NO: 890582 - protein, 9 aa, Homo Sapiens
SAAALFTSK

SEQ ID NO: 890583 - protein, 9 aa, Homo Sapiens
DHQNKINEV

SEQ ID NO: 890584 - protein, 9 aa, Homo Sapiens
ILCKEGKDE

SEQ ID NO: 890585 - protein, 9 aa, Homo Sapiens
PGVETDNWD

SEQ ID NO: 890586 - protein, 9 aa, Homo Sapiens
YYFVMMGIL

SEQ ID NO: 890587 - protein, 9 aa, Homo Sapiens
HGRAVCCVL

SEQ ID NO: 890588 - protein, 9 aa, Homo Sapiens
KFEAVLVIQ

SEQ ID NO: 890589 - protein, 9 aa, Homo Sapiens
TLDFPESWV

SEQ ID NO: 890590 - protein, 9 aa, Homo Sapiens
SMKPSCIWR

SEQ ID NO: 890591 - protein, 9 aa, Homo Sapiens
WEEVEAAGE

SEQ ID NO: 890592 - protein, 9 aa, Homo Sapiens
EVRDGPFGL

SEQ ID NO: 890593 - protein, 9 aa, Homo Sapiens
VVSPNDTRL

SEQ ID NO: 890594 - protein, 9 aa, Homo Sapiens
CLQLKETLT

SEQ ID NO: 890595 - protein, 9 aa, Homo Sapiens
KDKTKSPPA

SEQ ID NO: 890596 - protein, 9 aa, Homo Sapiens
DIKSLLRMV

SEQ ID NO: 890597 - protein, 9 aa, Homo Sapiens
QLSVGLEDE

SEQ ID NO: 890598 - protein, 9 aa, Homo Sapiens
LPSPQHYLE

SEQ ID NO: 890599 - protein, 9 aa, Homo Sapiens
LDSILLLGL

SEQ ID NO: 890600 - protein, 9 aa, Homo Sapiens
GRSMLETIN

SEQ ID NO: 890601 - protein, 9 aa, Homo Sapiens
EREQFCQEM

SEQ ID NO: 890602 - protein, 9 aa, Homo Sapiens
YWILNAQHI

SEQ ID NO: 890603 - protein, 9 aa, Homo Sapiens
PARCWCKKR

SEQ ID NO: 890604 - protein, 9 aa, Homo Sapiens
FKGIGEVVA

SEQ ID NO: 890605 - protein, 9 aa, Homo Sapiens
SNLNTHQII

SEQ ID NO: 890606 - protein, 9 aa, Homo Sapiens
MLALRMLQS

SEQ ID NO: 890607 - protein, 9 aa, Homo Sapiens
LVLNNYILK

SEQ ID NO: 890608 - protein, 9 aa, Homo Sapiens
QDTSIMSIN

SEQ ID NO: 890609 - protein, 9 aa, Homo Sapiens
LEPPKNCPD

SEQ ID NO: 890610 - protein, 9 aa, Homo Sapiens
ELRTAHLVL

SEQ ID NO: 890611 - protein, 9 aa, Homo Sapiens
DNCNLKYLP

SEQ ID NO: 890612 - protein, 9 aa, Homo Sapiens
GPSLIHSLN

SEQ ID NO: 890613 - protein, 9 aa, Homo Sapiens
NCYPPLLEN

SEQ ID NO: 890614 - protein, 9 aa, Homo Sapiens
QRTQINVIN

SEQ ID NO: 890615 - protein, 9 aa, Homo Sapiens
GQPPNHPNH

SEQ ID NO: 890616 - protein, 9 aa, Homo Sapiens
NFCYSSVIT

SEQ ID NO: 890617 - protein, 9 aa, Homo Sapiens
ATATQSNIC

SEQ ID NO: 890618 - protein, 9 aa, Homo Sapiens
SLLDHLGNS

SEQ ID NO: 890619 - protein, 9 aa, Homo Sapiens
LEENMVSLL

SEQ ID NO: 890620 - protein, 9 aa, Homo Sapiens
TADIQWPNE

SEQ ID NO: 890621 - protein, 9 aa, Homo Sapiens
LCLPVVLTL

SEQ ID NO: 890622 - protein, 9 aa, Homo Sapiens
DTIVLQTYF

SEQ ID NO: 890623 - protein, 9 aa, Homo Sapiens
FDLFRYFVN

SEQ ID NO: 890624 - protein, 9 aa, Homo Sapiens
ITFQYAVEI

SEQ ID NO: 890625 - protein, 9 aa, Homo Sapiens
GNCRPIQFE

SEQ ID NO: 890626 - protein, 9 aa, Homo Sapiens
NPYFCKGCK

SEQ ID NO: 890627 - protein, 9 aa, Homo Sapiens
CGKVFICSS

SEQ ID NO: 890628 - protein, 9 aa, Homo Sapiens
YKVQAYIQM

SEQ ID NO: 890629 - protein, 9 aa, Homo Sapiens
RGQKRKQST

SEQ ID NO: 890630 - protein, 9 aa, Homo Sapiens
GKIYNFWLP

SEQ ID NO: 890631 - protein, 9 aa, Homo Sapiens
RGMNLTVCG

SEQ ID NO: 890632 - protein, 9 aa, Homo Sapiens
CNTEGFVPP

SEQ ID NO: 890633 - protein, 9 aa, Homo Sapiens
SQPQKHREF

SEQ ID NO: 890634 - protein, 9 aa, Homo Sapiens
KHKQAEIEC

SEQ ID NO: 890635 - protein, 9 aa, Homo Sapiens
LLGLPALYY

SEQ ID NO: 890636 - protein, 9 aa, Homo Sapiens
LQMSYQYIR

SEQ ID NO: 890637 - protein, 9 aa, Homo Sapiens
LILIITLAS

SEQ ID NO: 890638 - protein, 9 aa, Homo Sapiens
LNYTVGRKI

SEQ ID NO: 890639 - protein, 9 aa, Homo Sapiens
GNDGNNGGC

SEQ ID NO: 890640 - protein, 9 aa, Homo Sapiens
QLCTYQEGK

SEQ ID NO: 890641 - protein, 9 aa, Homo Sapiens
IVVTLTELP

SEQ ID NO: 890642 - protein, 9 aa, Homo Sapiens
KIEDLQQWL

SEQ ID NO: 890643 - protein, 9 aa, Homo Sapiens
VARRIEFQK

SEQ ID NO: 890644 - protein, 9 aa, Homo Sapiens
MAQSQLTAT

SEQ ID NO: 890645 - protein, 9 aa, Homo Sapiens
GAVADRILA

SEQ ID NO: 890646 - protein, 9 aa, Homo Sapiens
LLFMSVWDQ

SEQ ID NO: 890647 - protein, 9 aa, Homo Sapiens
YFGPVSLGL

SEQ ID NO: 890648 - protein, 9 aa, Homo Sapiens
DLDLENIVR

SEQ ID NO: 890649 - protein, 9 aa, Homo Sapiens
FKDWEQFLE

SEQ ID NO: 890650 - protein, 9 aa, Homo Sapiens
GNTCGLEQI

SEQ ID NO: 890651 - protein, 9 aa, Homo Sapiens
ALDRLGRTA

SEQ ID NO: 890652 - protein, 9 aa, Homo Sapiens
IVTQMAGFL

SEQ ID NO: 890653 - protein, 9 aa, Homo Sapiens
TLTARLSPT

SEQ ID NO: 890654 - protein, 9 aa, Homo Sapiens
RSKFELDRI

SEQ ID NO: 890655 - protein, 9 aa, Homo Sapiens
GFEAFFTVA

SEQ ID NO: 890656 - protein, 9 aa, Homo Sapiens
QEYAPCGNL

SEQ ID NO: 890657 - protein, 9 aa, Homo Sapiens
SLALMCELM

SEQ ID NO: 890658 - protein, 9 aa, Homo Sapiens
ALAEEYEHI

SEQ ID NO: 890659 - protein, 9 aa, Homo Sapiens
LVVSILGSE

SEQ ID NO: 890660 - protein, 9 aa, Homo Sapiens
CIWRFAYLW

SEQ ID NO: 890661 - protein, 9 aa, Homo Sapiens
SSIITKKTS

SEQ ID NO: 890662 - protein, 9 aa, Homo Sapiens
NNCWCPGPV

SEQ ID NO: 890663 - protein, 9 aa, Homo Sapiens
FSFTSPTVK

SEQ ID NO: 890664 - protein, 9 aa, Homo Sapiens
TLRNRVCIA

SEQ ID NO: 890665 - protein, 9 aa, Homo Sapiens
KLSPKNLAA

SEQ ID NO: 890666 - protein, 9 aa, Homo Sapiens
YKQTAEAVY

SEQ ID NO: 890667 - protein, 9 aa, Homo Sapiens
REFRGKIYN

SEQ ID NO: 890668 - protein, 9 aa, Homo Sapiens
CIAGGTSQN

SEQ ID NO: 890669 - protein, 9 aa, Homo Sapiens
LATVKVHPK

SEQ ID NO: 890670 - protein, 9 aa, Homo Sapiens
DPHNAHRGF

SEQ ID NO: 890671 - protein, 9 aa, Homo Sapiens
CLYAYGNQI

SEQ ID NO: 890672 - protein, 9 aa, Homo Sapiens
VDTTSVSVY

SEQ ID NO: 890673 - protein, 9 aa, Homo Sapiens
SGIDWDNIW

SEQ ID NO: 890674 - protein, 9 aa, Homo Sapiens
TAFGHMPLL

SEQ ID NO: 890675 - protein, 9 aa, Homo Sapiens
VQVNVHGIF

SEQ ID NO: 890676 - protein, 9 aa, Homo Sapiens
CNKCFQFKQ

SEQ ID NO: 890677 - protein, 9 aa, Homo Sapiens
LRLGKAHEI

SEQ ID NO: 890678 - protein, 9 aa, Homo Sapiens
NIDVNEISR

SEQ ID NO: 890679 - protein, 9 aa, Homo Sapiens
GYHGLLGSP

SEQ ID NO: 890680 - protein, 9 aa, Homo Sapiens
GLSYFYGAF

SEQ ID NO: 890681 - protein, 9 aa, Homo Sapiens
ASVQLIPQT

SEQ ID NO: 890682 - protein, 9 aa, Homo Sapiens
ILHSFVQLC

SEQ ID NO: 890683 - protein, 9 aa, Homo Sapiens
GTGHYLQQV

SEQ ID NO: 890684 - protein, 9 aa, Homo Sapiens
SVQIDRRMP

SEQ ID NO: 890685 - protein, 9 aa, Homo Sapiens
NIPLSQAKV

SEQ ID NO: 890686 - protein, 9 aa, Homo Sapiens
MIFEKRSTQ

SEQ ID NO: 890687 - protein, 9 aa, Homo Sapiens
QSHYRHRHC

SEQ ID NO: 890688 - protein, 9 aa, Homo Sapiens
VEYEYEAEM

SEQ ID NO: 890689 - protein, 9 aa, Homo Sapiens
DEFKRTQNN

SEQ ID NO: 890690 - protein, 9 aa, Homo Sapiens
LHLVTMLGA

SEQ ID NO: 890691 - protein, 9 aa, Homo Sapiens
KSLQTLAMV

SEQ ID NO: 890692 - protein, 9 aa, Homo Sapiens
KAFQLQEQS

SEQ ID NO: 890693 - protein, 9 aa, Homo Sapiens
ELAQLKAAV

SEQ ID NO: 890694 - protein, 9 aa, Homo Sapiens
VGLNSTGYY

SEQ ID NO: 890695 - protein, 9 aa, Homo Sapiens
LFACATQMR

SEQ ID NO: 890696 - protein, 9 aa, Homo Sapiens
CPFYSWERV

SEQ ID NO: 890697 - protein, 9 aa, Homo Sapiens
DKKNLTARD

SEQ ID NO: 890698 - protein, 9 aa, Homo Sapiens
SQQLSDNSL

SEQ ID NO: 890699 - protein, 9 aa, Homo Sapiens
GECASQTVE

SEQ ID NO: 890700 - protein, 9 aa, Homo Sapiens
FNLPNSIRY

SEQ ID NO: 890701 - protein, 9 aa, Homo Sapiens
SPGAQSQYV

SEQ ID NO: 890702 - protein, 9 aa, Homo Sapiens
PETCEQALR

SEQ ID NO: 890703 - protein, 9 aa, Homo Sapiens
LYATQMNNA

SEQ ID NO: 890704 - protein, 9 aa, Homo Sapiens
FEQGDWERL

SEQ ID NO: 890705 - protein, 9 aa, Homo Sapiens
SHQSYSQNT

SEQ ID NO: 890706 - protein, 9 aa, Homo Sapiens
KELEENMVS

SEQ ID NO: 890707 - protein, 9 aa, Homo Sapiens
KKKPRRLCT

SEQ ID NO: 890708 - protein, 9 aa, Homo Sapiens
SVNLDSLGL

SEQ ID NO: 890709 - protein, 9 aa, Homo Sapiens
PHSFMFSPS

SEQ ID NO: 890710 - protein, 9 aa, Homo Sapiens
TSPTVKRLL

SEQ ID NO: 890711 - protein, 9 aa, Homo Sapiens
GEDQKPDSQ

SEQ ID NO: 890712 - protein, 9 aa, Homo Sapiens
LAASIAGSL

SEQ ID NO: 890713 - protein, 9 aa, Homo Sapiens
MPDMKAEDE

SEQ ID NO: 890714 - protein, 9 aa, Homo Sapiens
GNAATVCKG

SEQ ID NO: 890715 - protein, 9 aa, Homo Sapiens
DCKSAENGD

SEQ ID NO: 890716 - protein, 9 aa, Homo Sapiens
EPGSLKSSP

SEQ ID NO: 890717 - protein, 9 aa, Homo Sapiens
FQSNPVRHL

SEQ ID NO: 890718 - protein, 9 aa, Homo Sapiens
ISDFTQEIL

SEQ ID NO: 890719 - protein, 9 aa, Homo Sapiens
IHKLLNGTR

SEQ ID NO: 890720 - protein, 9 aa, Homo Sapiens
VNKFLAKAR

SEQ ID NO: 890721 - protein, 9 aa, Homo Sapiens
SAVCMHNLK

SEQ ID NO: 890722 - protein, 9 aa, Homo Sapiens
LCQNAREMT

SEQ ID NO: 890723 - protein, 9 aa, Homo Sapiens
QIKNFQTIL

SEQ ID NO: 890724 - protein, 9 aa, Homo Sapiens
LREHFQSYY

SEQ ID NO: 890725 - protein, 9 aa, Homo Sapiens
RLVSLETLC

SEQ ID NO: 890726 - protein, 9 aa, Homo Sapiens
GVMCLPVLN

SEQ ID NO: 890727 - protein, 9 aa, Homo Sapiens
ADSNNFPLR

SEQ ID NO: 890728 - protein, 9 aa, Homo Sapiens
SLDKAQPFP

SEQ ID NO: 890729 - protein, 9 aa, Homo Sapiens
SFTNMSSMN

SEQ ID NO: 890730 - protein, 9 aa, Homo Sapiens
SFQGTWQKR

SEQ ID NO: 890731 - protein, 9 aa, Homo Sapiens
NSGAIEEEF

SEQ ID NO: 890732 - protein, 9 aa, Homo Sapiens
YRKAKTINQ

SEQ ID NO: 890733 - protein, 9 aa, Homo Sapiens
ILVKCNDLY

SEQ ID NO: 890734 - protein, 9 aa, Homo Sapiens
HISTGELLR

SEQ ID NO: 890735 - protein, 9 aa, Homo Sapiens
KGVALITAV

SEQ ID NO: 890736 - protein, 9 aa, Homo Sapiens
AVATARRSL

SEQ ID NO: 890737 - protein, 9 aa, Homo Sapiens
SDHTEHQII

SEQ ID NO: 890738 - protein, 9 aa, Homo Sapiens
TANLVAPIL

SEQ ID NO: 890739 - protein, 9 aa, Homo Sapiens
GVTWILFQY

SEQ ID NO: 890740 - protein, 9 aa, Homo Sapiens
ILLVLGIVG

SEQ ID NO: 890741 - protein, 9 aa, Homo Sapiens
CRRPGVQWP

SEQ ID NO: 890742 - protein, 9 aa, Homo Sapiens
FSIYFLSSL

SEQ ID NO: 890743 - protein, 9 aa, Homo Sapiens
VDSETFSTY

SEQ ID NO: 890744 - protein, 9 aa, Homo Sapiens
WELICGQER

SEQ ID NO: 890745 - protein, 9 aa, Homo Sapiens
HQIICPGEE

SEQ ID NO: 890746 - protein, 9 aa, Homo Sapiens
KTFCVKTSL

SEQ ID NO: 890747 - protein, 9 aa, Homo Sapiens
LTYAETKAV

SEQ ID NO: 890748 - protein, 9 aa, Homo Sapiens
ITQGAPHPP

SEQ ID NO: 890749 - protein, 9 aa, Homo Sapiens
NYGRVVLNQ

SEQ ID NO: 890750 - protein, 9 aa, Homo Sapiens
VVAAHCVTG

SEQ ID NO: 890751 - protein, 9 aa, Homo Sapiens
WVRRECDKG

SEQ ID NO: 890752 - protein, 9 aa, Homo Sapiens
NGSLRVCTV

SEQ ID NO: 890753 - protein, 9 aa, Homo Sapiens
LKVVKDVSV

SEQ ID NO: 890754 - protein, 9 aa, Homo Sapiens
TCTDFEQMK

SEQ ID NO: 890755 - protein, 9 aa, Homo Sapiens
QGQPSRQKW

SEQ ID NO: 890756 - protein, 9 aa, Homo Sapiens
QNHLQQAQV

SEQ ID NO: 890757 - protein, 9 aa, Homo Sapiens
MTKKLLLCL

SEQ ID NO: 890758 - protein, 9 aa, Homo Sapiens
KVKVKVQVN

SEQ ID NO: 890759 - protein, 9 aa, Homo Sapiens
YKRCLNENT

SEQ ID NO: 890760 - protein, 9 aa, Homo Sapiens
EEEMARLEG

SEQ ID NO: 890761 - protein, 9 aa, Homo Sapiens
HKSFDLRPG

SEQ ID NO: 890762 - protein, 9 aa, Homo Sapiens
SGLEEKSSS

SEQ ID NO: 890763 - protein, 9 aa, Homo Sapiens
HKCQVTNFP

SEQ ID NO: 890764 - protein, 9 aa, Homo Sapiens
WIEEMINNQ

SEQ ID NO: 890765 - protein, 9 aa, Homo Sapiens
NAAYFFWLK

SEQ ID NO: 890766 - protein, 9 aa, Homo Sapiens
WKGAAQEKK

SEQ ID NO: 890767 - protein, 9 aa, Homo Sapiens
SKYANFGLR

SEQ ID NO: 890768 - protein, 9 aa, Homo Sapiens
GFWSTKSET

SEQ ID NO: 890769 - protein, 9 aa, Homo Sapiens
LLGQQGLGA

SEQ ID NO: 890770 - protein, 9 aa, Homo Sapiens
SCFQVGGKK

SEQ ID NO: 890771 - protein, 9 aa, Homo Sapiens
AHIKKEQEE

SEQ ID NO: 890772 - protein, 9 aa, Homo Sapiens
AELWRAMGP

SEQ ID NO: 890773 - protein, 9 aa, Homo Sapiens
RRSPKSCSK

SEQ ID NO: 890774 - protein, 9 aa, Homo Sapiens
DTDISYLKG

SEQ ID NO: 890775 - protein, 9 aa, Homo Sapiens
IIKLLDGKQ

SEQ ID NO: 890776 - protein, 9 aa, Homo Sapiens
GYAEKQIQS

SEQ ID NO: 890777 - protein, 9 aa, Homo Sapiens
GLEAVACNT

SEQ ID NO: 890778 - protein, 9 aa, Homo Sapiens
RHFSIYFLS

SEQ ID NO: 890779 - protein, 9 aa, Homo Sapiens
KINLHQHQR

SEQ ID NO: 890780 - protein, 9 aa, Homo Sapiens
LQSKGESNQ

SEQ ID NO: 890781 - protein, 9 aa, Homo Sapiens
TFFPPNKSH

SEQ ID NO: 890782 - protein, 9 aa, Homo Sapiens
SILRAVPSA

SEQ ID NO: 890783 - protein, 9 aa, Homo Sapiens
VPSCIPLVK

SEQ ID NO: 890784 - protein, 9 aa, Homo Sapiens
IQTLLQDFF

SEQ ID NO: 890785 - protein, 9 aa, Homo Sapiens
PTWQNPMST

SEQ ID NO: 890786 - protein, 9 aa, Homo Sapiens
QAFNITIMI

SEQ ID NO: 890787 - protein, 9 aa, Homo Sapiens
SHLNQIHQF

SEQ ID NO: 890788 - protein, 9 aa, Homo Sapiens
KNIHGVSRE

SEQ ID NO: 890789 - protein, 9 aa, Homo Sapiens
EHIDACLNF

SEQ ID NO: 890790 - protein, 9 aa, Homo Sapiens
ASTKQAKRN

SEQ ID NO: 890791 - protein, 9 aa, Homo Sapiens
AKNPKEDKK

SEQ ID NO: 890792 - protein, 9 aa, Homo Sapiens
GGITFFRPG

SEQ ID NO: 890793 - protein, 9 aa, Homo Sapiens
ASFVFNIPS

SEQ ID NO: 890794 - protein, 9 aa, Homo Sapiens
SQTPHIPYK

SEQ ID NO: 890795 - protein, 9 aa, Homo Sapiens
FDKVRNQCY

SEQ ID NO: 890796 - protein, 9 aa, Homo Sapiens
STTHITQGA

SEQ ID NO: 890797 - protein, 9 aa, Homo Sapiens
IQTDSHLHT

SEQ ID NO: 890798 - protein, 9 aa, Homo Sapiens
LKRHRRQRK

SEQ ID NO: 890799 - protein, 9 aa, Homo Sapiens
NCMDCVLLH

SEQ ID NO: 890800 - protein, 9 aa, Homo Sapiens
YKKDLKSWA

SEQ ID NO: 890801 - protein, 9 aa, Homo Sapiens
SSPTPCTLT

SEQ ID NO: 890802 - protein, 9 aa, Homo Sapiens
IHTDPAERW

SEQ ID NO: 890803 - protein, 9 aa, Homo Sapiens
ECGKLFCWS

SEQ ID NO: 890804 - protein, 9 aa, Homo Sapiens
ENLVSQVDD

SEQ ID NO: 890805 - protein, 9 aa, Homo Sapiens
FVPCMFMYA

SEQ ID NO: 890806 - protein, 9 aa, Homo Sapiens
NAFCIAKLM

SEQ ID NO: 890807 - protein, 9 aa, Homo Sapiens
RWRRSHSRE

SEQ ID NO: 890808 - protein, 9 aa, Homo Sapiens
QEGKITDLV

SEQ ID NO: 890809 - protein, 9 aa, Homo Sapiens
VARVSGRKE

SEQ ID NO: 890810 - protein, 9 aa, Homo Sapiens
FFDVCWHNK

SEQ ID NO: 890811 - protein, 9 aa, Homo Sapiens
TEVELYNKF

SEQ ID NO: 890812 - protein, 9 aa, Homo Sapiens
SQYLIRNVD

SEQ ID NO: 890813 - protein, 9 aa, Homo Sapiens
FHIQKQSIC

SEQ ID NO: 890814 - protein, 9 aa, Homo Sapiens
DPSEVVIPL

SEQ ID NO: 890815 - protein, 9 aa, Homo Sapiens
GKQLRIKHV

SEQ ID NO: 890816 - protein, 9 aa, Homo Sapiens
VGKAQMQSP

SEQ ID NO: 890817 - protein, 9 aa, Homo Sapiens
TPKAVTAAE

SEQ ID NO: 890818 - protein, 9 aa, Homo Sapiens
NGEQQDEES

SEQ ID NO: 890819 - protein, 9 aa, Homo Sapiens
DSPMVMALV

SEQ ID NO: 890820 - protein, 9 aa, Homo Sapiens
SDRINKFFL

SEQ ID NO: 890821 - protein, 9 aa, Homo Sapiens
LSVHKIIHN

SEQ ID NO: 890822 - protein, 9 aa, Homo Sapiens
LENNIWKAL

SEQ ID NO: 890823 - protein, 9 aa, Homo Sapiens
QTEFQALKS

SEQ ID NO: 890824 - protein, 9 aa, Homo Sapiens
TDCFLLVTM

SEQ ID NO: 890825 - protein, 9 aa, Homo Sapiens
LFRTEGAEK

SEQ ID NO: 890826 - protein, 9 aa, Homo Sapiens
HYKELPGEP

SEQ ID NO: 890827 - protein, 9 aa, Homo Sapiens
EKNQRLFVL

SEQ ID NO: 890828 - protein, 9 aa, Homo Sapiens
MKLEKLTNI

SEQ ID NO: 890829 - protein, 9 aa, Homo Sapiens
VEYEVINQF

SEQ ID NO: 890830 - protein, 9 aa, Homo Sapiens
GNVVAAAGA

SEQ ID NO: 890831 - protein, 9 aa, Homo Sapiens
DDINASYVN

SEQ ID NO: 890832 - protein, 9 aa, Homo Sapiens
KRHDSKRST

SEQ ID NO: 890833 - protein, 9 aa, Homo Sapiens
KIKYRAAML

SEQ ID NO: 890834 - protein, 9 aa, Homo Sapiens
LEAEPRSKI

SEQ ID NO: 890835 - protein, 9 aa, Homo Sapiens
ISHKKLEHR

SEQ ID NO: 890836 - protein, 9 aa, Homo Sapiens
HVNISDLGL

SEQ ID NO: 890837 - protein, 9 aa, Homo Sapiens
KYSEIEELP

SEQ ID NO: 890838 - protein, 9 aa, Homo Sapiens
EEYEHIAIG

SEQ ID NO: 890839 - protein, 9 aa, Homo Sapiens
GLNNALDNL

SEQ ID NO: 890840 - protein, 9 aa, Homo Sapiens
AVACNTEGF

SEQ ID NO: 890841 - protein, 9 aa, Homo Sapiens
PRPGMHLPP

SEQ ID NO: 890842 - protein, 9 aa, Homo Sapiens
SWRKCMLLT

SEQ ID NO: 890843 - protein, 9 aa, Homo Sapiens
ISTSTDKSD

SEQ ID NO: 890844 - protein, 9 aa, Homo Sapiens
LVCILGTTG

SEQ ID NO: 890845 - protein, 9 aa, Homo Sapiens
SLLKRHEKS

SEQ ID NO: 890846 - protein, 9 aa, Homo Sapiens
LMDGGIIVF

SEQ ID NO: 890847 - protein, 9 aa, Homo Sapiens
RQNAKWLTV

SEQ ID NO: 890848 - protein, 9 aa, Homo Sapiens
YLQAKKIMV

SEQ ID NO: 890849 - protein, 9 aa, Homo Sapiens
DLDKRFQKV

SEQ ID NO: 890850 - protein, 9 aa, Homo Sapiens
LFELFDRTE

SEQ ID NO: 890851 - protein, 9 aa, Homo Sapiens
KENYPKRRS

SEQ ID NO: 890852 - protein, 9 aa, Homo Sapiens
SYLNEVHST

SEQ ID NO: 890853 - protein, 9 aa, Homo Sapiens
LQDFIGVLN

SEQ ID NO: 890854 - protein, 9 aa, Homo Sapiens
VMLQNLTMS

SEQ ID NO: 890855 - protein, 9 aa, Homo Sapiens
AKYVKTAVH

SEQ ID NO: 890856 - protein, 9 aa, Homo Sapiens
ENYHTNSCN

SEQ ID NO: 890857 - protein, 9 aa, Homo Sapiens
GSSDLEIDK

SEQ ID NO: 890858 - protein, 9 aa, Homo Sapiens
MLCLTLVAL

SEQ ID NO: 890859 - protein, 9 aa, Homo Sapiens
KQAFNITIM

SEQ ID NO: 890860 - protein, 9 aa, Homo Sapiens
FASDNFLGI

SEQ ID NO: 890861 - protein, 9 aa, Homo Sapiens
GRKVADLYK

SEQ ID NO: 890862 - protein, 9 aa, Homo Sapiens
KLSKEAKQK

SEQ ID NO: 890863 - protein, 9 aa, Homo Sapiens
HIRRKQIVG

SEQ ID NO: 890864 - protein, 9 aa, Homo Sapiens
SEVLQIQNI

SEQ ID NO: 890865 - protein, 9 aa, Homo Sapiens
RRGVLELAL

SEQ ID NO: 890866 - protein, 9 aa, Homo Sapiens
TENTTDGQQ

SEQ ID NO: 890867 - protein, 9 aa, Homo Sapiens
VFTENTTDG

SEQ ID NO: 890868 - protein, 9 aa, Homo Sapiens
NHRKPSFLA

SEQ ID NO: 890869 - protein, 9 aa, Homo Sapiens
GSYWVSLPG

SEQ ID NO: 890870 - protein, 9 aa, Homo Sapiens
EVQEETAWR

SEQ ID NO: 890871 - protein, 9 aa, Homo Sapiens
IGGSIQMPA

SEQ ID NO: 890872 - protein, 9 aa, Homo Sapiens
RLLMRIGNK

SEQ ID NO: 890873 - protein, 9 aa, Homo Sapiens
DSSLGAKKE

SEQ ID NO: 890874 - protein, 9 aa, Homo Sapiens
VLLPALRKA

SEQ ID NO: 890875 - protein, 9 aa, Homo Sapiens
TDYLWRGLA

SEQ ID NO: 890876 - protein, 9 aa, Homo Sapiens
PPTCRSASC

SEQ ID NO: 890877 - protein, 9 aa, Homo Sapiens
NHEKSLGLE

SEQ ID NO: 890878 - protein, 9 aa, Homo Sapiens
GLGKVTMIK

SEQ ID NO: 890879 - protein, 9 aa, Homo Sapiens
HIGEQFYRK

SEQ ID NO: 890880 - protein, 9 aa, Homo Sapiens
GYSNVRGKQ

SEQ ID NO: 890881 - protein, 9 aa, Homo Sapiens
LATLDTLTK

SEQ ID NO: 890882 - protein, 9 aa, Homo Sapiens
KQIIYNYLK

SEQ ID NO: 890883 - protein, 9 aa, Homo Sapiens
VSLLVVSPI

SEQ ID NO: 890884 - protein, 9 aa, Homo Sapiens
ETAVKFSSN

SEQ ID NO: 890885 - protein, 9 aa, Homo Sapiens
FQYDCFFEK

SEQ ID NO: 890886 - protein, 9 aa, Homo Sapiens
LQQQLDDAH

SEQ ID NO: 890887 - protein, 9 aa, Homo Sapiens
ALKLRRGDP

SEQ ID NO: 890888 - protein, 9 aa, Homo Sapiens
ANLNALDRL

SEQ ID NO: 890889 - protein, 9 aa, Homo Sapiens
PLHCVPPLS

SEQ ID NO: 890890 - protein, 9 aa, Homo Sapiens
EGKDEHPQC

SEQ ID NO: 890891 - protein, 9 aa, Homo Sapiens
EQQDEESLG

SEQ ID NO: 890892 - protein, 9 aa, Homo Sapiens
EAFCRRGKL

SEQ ID NO: 890893 - protein, 9 aa, Homo Sapiens
SNAPHNYAV

SEQ ID NO: 890894 - protein, 9 aa, Homo Sapiens
VLLGLASVI

SEQ ID NO: 890895 - protein, 9 aa, Homo Sapiens
SDNNPCIKH

SEQ ID NO: 890896 - protein, 9 aa, Homo Sapiens
TEYQIITDP

SEQ ID NO: 890897 - protein, 9 aa, Homo Sapiens
YLLHLLRQH

SEQ ID NO: 890898 - protein, 9 aa, Homo Sapiens
NKEIHTQFL

SEQ ID NO: 890899 - protein, 9 aa, Homo Sapiens
GLDSIGLAG

SEQ ID NO: 890900 - protein, 9 aa, Homo Sapiens
SDLHHCFYR

SEQ ID NO: 890901 - protein, 9 aa, Homo Sapiens
VMTLKQAFT

SEQ ID NO: 890902 - protein, 9 aa, Homo Sapiens
LLDIKTQLE

SEQ ID NO: 890903 - protein, 9 aa, Homo Sapiens
LNIDKLQSA

SEQ ID NO: 890904 - protein, 9 aa, Homo Sapiens
LLHGEFSAS

SEQ ID NO: 890905 - protein, 9 aa, Homo Sapiens
VSELRQQLQ

SEQ ID NO: 890906 - protein, 9 aa, Homo Sapiens
WSQAHFPLS

SEQ ID NO: 890907 - protein, 9 aa, Homo Sapiens
YDWNKSICK

SEQ ID NO: 890908 - protein, 9 aa, Homo Sapiens
LCPLPGPGE

SEQ ID NO: 890909 - protein, 9 aa, Homo Sapiens
HIYKSFTNA

SEQ ID NO: 890910 - protein, 9 aa, Homo Sapiens
SKKSMIGKI

SEQ ID NO: 890911 - protein, 9 aa, Homo Sapiens
HTNVIAQAV

SEQ ID NO: 890912 - protein, 9 aa, Homo Sapiens
GQIEQQSEQ

SEQ ID NO: 890913 - protein, 9 aa, Homo Sapiens
KLNLLLTAT

SEQ ID NO: 890914 - protein, 9 aa, Homo Sapiens
RVEYVIGCY

SEQ ID NO: 890915 - protein, 9 aa, Homo Sapiens
MKGALKKLI

SEQ ID NO: 890916 - protein, 9 aa, Homo Sapiens
GEQQSTNGQ

SEQ ID NO: 890917 - protein, 9 aa, Homo Sapiens
WELQKDPGF

SEQ ID NO: 890918 - protein, 9 aa, Homo Sapiens
PSITLQPPN

SEQ ID NO: 890919 - protein, 9 aa, Homo Sapiens
CCSGEKEPV

SEQ ID NO: 890920 - protein, 9 aa, Homo Sapiens
ASLGFKLTS

SEQ ID NO: 890921 - protein, 9 aa, Homo Sapiens
NVRKKDHEP

SEQ ID NO: 890922 - protein, 9 aa, Homo Sapiens
NDSISSKTG

SEQ ID NO: 890923 - protein, 9 aa, Homo Sapiens
PTTSYSLYT

SEQ ID NO: 890924 - protein, 9 aa, Homo Sapiens
QRCLMETNL

SEQ ID NO: 890925 - protein, 9 aa, Homo Sapiens
NSQRGINCN

SEQ ID NO: 890926 - protein, 9 aa, Homo Sapiens
RQKQARLVL

SEQ ID NO: 890927 - protein, 9 aa, Homo Sapiens
SNGTANYSK

SEQ ID NO: 890928 - protein, 9 aa, Homo Sapiens
HGDLIKITD

SEQ ID NO: 890929 - protein, 9 aa, Homo Sapiens
KRICVGENL

SEQ ID NO: 890930 - protein, 9 aa, Homo Sapiens
PQKHREFLT

SEQ ID NO: 890931 - protein, 9 aa, Homo Sapiens
VWNDLDKRF

SEQ ID NO: 890932 - protein, 9 aa, Homo Sapiens
SKLRPDDTK

SEQ ID NO: 890933 - protein, 9 aa, Homo Sapiens
INKNVQKIN

SEQ ID NO: 890934 - protein, 9 aa, Homo Sapiens
QKKAADTVV

SEQ ID NO: 890935 - protein, 9 aa, Homo Sapiens
VPDVNIEAP

SEQ ID NO: 890936 - protein, 9 aa, Homo Sapiens
VNRVVWKQP

SEQ ID NO: 890937 - protein, 9 aa, Homo Sapiens
ALSRLISFQ

SEQ ID NO: 890938 - protein, 9 aa, Homo Sapiens
MPIPILSSQ

SEQ ID NO: 890939 - protein, 9 aa, Homo Sapiens
DKLQNRPRK

SEQ ID NO: 890940 - protein, 9 aa, Homo Sapiens
MYLQQYVEA

SEQ ID NO: 890941 - protein, 9 aa, Homo Sapiens
NLNALDRLG

SEQ ID NO: 890942 - protein, 9 aa, Homo Sapiens
QNQLSALPA

SEQ ID NO: 890943 - protein, 9 aa, Homo Sapiens
KIVFLATDM

SEQ ID NO: 890944 - protein, 9 aa, Homo Sapiens
VESVEEISF

SEQ ID NO: 890945 - protein, 9 aa, Homo Sapiens
SKNKIMNGH

SEQ ID NO: 890946 - protein, 9 aa, Homo Sapiens
KSKVSVDDL

SEQ ID NO: 890947 - protein, 9 aa, Homo Sapiens
QEPEEEENT

SEQ ID NO: 890948 - protein, 9 aa, Homo Sapiens
DVNSWKASL

SEQ ID NO: 890949 - protein, 9 aa, Homo Sapiens
RKEGEKMKI

SEQ ID NO: 890950 - protein, 9 aa, Homo Sapiens
KDTEKIREC

SEQ ID NO: 890951 - protein, 9 aa, Homo Sapiens
NTYTGMKEQ

SEQ ID NO: 890952 - protein, 9 aa, Homo Sapiens
VPFACFKEV

SEQ ID NO: 890953 - protein, 9 aa, Homo Sapiens
RREYPFSPD

SEQ ID NO: 890954 - protein, 9 aa, Homo Sapiens
VFAYVMCTV

SEQ ID NO: 890955 - protein, 9 aa, Homo Sapiens
EEISFADDV

SEQ ID NO: 890956 - protein, 9 aa, Homo Sapiens
LVERLGKKD

SEQ ID NO: 890957 - protein, 9 aa, Homo Sapiens
NSFQTHEMI

SEQ ID NO: 890958 - protein, 9 aa, Homo Sapiens
TQNQMTVAH

SEQ ID NO: 890959 - protein, 9 aa, Homo Sapiens
AACQLHISQ

SEQ ID NO: 890960 - protein, 9 aa, Homo Sapiens
FREPQNILR

SEQ ID NO: 890961 - protein, 9 aa, Homo Sapiens
LVVATIANN

SEQ ID NO: 890962 - protein, 9 aa, Homo Sapiens
RSLTTSPFV

SEQ ID NO: 890963 - protein, 9 aa, Homo Sapiens
KPKEKPPKT

SEQ ID NO: 890964 - protein, 9 aa, Homo Sapiens
RFGQDYSTG

SEQ ID NO: 890965 - protein, 9 aa, Homo Sapiens
RDLDNKLRS

SEQ ID NO: 890966 - protein, 9 aa, Homo Sapiens
LDNVFRQLD

SEQ ID NO: 890967 - protein, 9 aa, Homo Sapiens
GAGNPGSLV

SEQ ID NO: 890968 - protein, 9 aa, Homo Sapiens
TEHQIICPG

SEQ ID NO: 890969 - protein, 9 aa, Homo Sapiens
NLTFGYKLQ

SEQ ID NO: 890970 - protein, 9 aa, Homo Sapiens
FGYDQKKYK

SEQ ID NO: 890971 - protein, 9 aa, Homo Sapiens
GRNFDEIIR

SEQ ID NO: 890972 - protein, 9 aa, Homo Sapiens
QTLNYTVGR

SEQ ID NO: 890973 - protein, 9 aa, Homo Sapiens
EHIAIGVFT

SEQ ID NO: 890974 - protein, 9 aa, Homo Sapiens
GGVRTAAAP

SEQ ID NO: 890975 - protein, 9 aa, Homo Sapiens
PSFLAHPGP

SEQ ID NO: 890976 - protein, 9 aa, Homo Sapiens
TERVMGLSE

SEQ ID NO: 890977 - protein, 9 aa, Homo Sapiens
TQFFKVARA

SEQ ID NO: 890978 - protein, 9 aa, Homo Sapiens
QTKLWGGQG

SEQ ID NO: 890979 - protein, 9 aa, Homo Sapiens
NLMQKHFLP

SEQ ID NO: 890980 - protein, 9 aa, Homo Sapiens
SPTAPDAMK

SEQ ID NO: 890981 - protein, 9 aa, Homo Sapiens
PINNSPEAH

SEQ ID NO: 890982 - protein, 9 aa, Homo Sapiens
ETIFTPSYV

SEQ ID NO: 890983 - protein, 9 aa, Homo Sapiens
RSRSYSQDY

SEQ ID NO: 890984 - protein, 9 aa, Homo Sapiens
ADTFDLQII

SEQ ID NO: 890985 - protein, 9 aa, Homo Sapiens
EKLFKDWEQ

SEQ ID NO: 890986 - protein, 9 aa, Homo Sapiens
NLILDSMKA

SEQ ID NO: 890987 - protein, 9 aa, Homo Sapiens
DELNNYLSE

SEQ ID NO: 890988 - protein, 9 aa, Homo Sapiens
KNTSYYENV

SEQ ID NO: 890989 - protein, 9 aa, Homo Sapiens
KGLKVVFDE

SEQ ID NO: 890990 - protein, 9 aa, Homo Sapiens
QIQNSIVNK

SEQ ID NO: 890991 - protein, 9 aa, Homo Sapiens
EDVKMTFDR

SEQ ID NO: 890992 - protein, 9 aa, Homo Sapiens
ILVTVKNLL

SEQ ID NO: 890993 - protein, 9 aa, Homo Sapiens
FYLRRSHKL

SEQ ID NO: 890994 - protein, 9 aa, Homo Sapiens
ALPVSGRLP

SEQ ID NO: 890995 - protein, 9 aa, Homo Sapiens
GYLDWSVFH

SEQ ID NO: 890996 - protein, 9 aa, Homo Sapiens
AATPKKSIN

SEQ ID NO: 890997 - protein, 9 aa, Homo Sapiens
RNLKAYYAF

SEQ ID NO: 890998 - protein, 9 aa, Homo Sapiens
IPKIQTLLQ

SEQ ID NO: 890999 - protein, 9 aa, Homo Sapiens
VPSAPVINL

SEQ ID NO: 891000 - protein, 9 aa, Homo Sapiens
QYSDSVARG

SEQ ID NO: 891001 - protein, 9 aa, Homo Sapiens
YDDRTARVM

SEQ ID NO: 891002 - protein, 9 aa, Homo Sapiens
ASYIMDYYQ

SEQ ID NO: 891003 - protein, 9 aa, Homo Sapiens
YYMLISLVL

SEQ ID NO: 891004 - protein, 9 aa, Homo Sapiens
ISFADDVED

SEQ ID NO: 891005 - protein, 9 aa, Homo Sapiens
FHFILALYD

SEQ ID NO: 891006 - protein, 9 aa, Homo Sapiens
ILRENPYFC

SEQ ID NO: 891007 - protein, 9 aa, Homo Sapiens
RTTDEELCN

SEQ ID NO: 891008 - protein, 9 aa, Homo Sapiens
IIYNYLKEG

SEQ ID NO: 891009 - protein, 9 aa, Homo Sapiens
CCMASELVR

SEQ ID NO: 891010 - protein, 9 aa, Homo Sapiens
QSVAAFAVL

SEQ ID NO: 891011 - protein, 9 aa, Homo Sapiens
SLELCGFKN

SEQ ID NO: 891012 - protein, 9 aa, Homo Sapiens
SLEISLSVG

SEQ ID NO: 891013 - protein, 9 aa, Homo Sapiens
GDSNIFPVR

SEQ ID NO: 891014 - protein, 9 aa, Homo Sapiens
SIQESRLFG

SEQ ID NO: 891015 - protein, 9 aa, Homo Sapiens
GGQRSERNK

SEQ ID NO: 891016 - protein, 9 aa, Homo Sapiens
KKARFEWEQ

SEQ ID NO: 891017 - protein, 9 aa, Homo Sapiens
PPFEINKNR

SEQ ID NO: 891018 - protein, 9 aa, Homo Sapiens
CDAAKHRLV

SEQ ID NO: 891019 - protein, 9 aa, Homo Sapiens
LCYPVLMNH

SEQ ID NO: 891020 - protein, 9 aa, Homo Sapiens
GANFILLNF

SEQ ID NO: 891021 - protein, 9 aa, Homo Sapiens
KTAEKWFID

SEQ ID NO: 891022 - protein, 9 aa, Homo Sapiens
SIFYFHPIS

SEQ ID NO: 891023 - protein, 9 aa, Homo Sapiens
EGKYSEIEE

SEQ ID NO: 891024 - protein, 9 aa, Homo Sapiens
ICDNRWEVR

SEQ ID NO: 891025 - protein, 9 aa, Homo Sapiens
GRSNGYRWC

SEQ ID NO: 891026 - protein, 9 aa, Homo Sapiens
TQEHPLPNY

SEQ ID NO: 891027 - protein, 9 aa, Homo Sapiens
QQGNFQYDN

SEQ ID NO: 891028 - protein, 9 aa, Homo Sapiens
ELAGHNYVL

SEQ ID NO: 891029 - protein, 9 aa, Homo Sapiens
RKELEENMV

SEQ ID NO: 891030 - protein, 9 aa, Homo Sapiens
KASDELVEQ

SEQ ID NO: 891031 - protein, 9 aa, Homo Sapiens
EEDLKADKP

SEQ ID NO: 891032 - protein, 9 aa, Homo Sapiens
NARYMHKIC

SEQ ID NO: 891033 - protein, 9 aa, Homo Sapiens
IDINEESVE

SEQ ID NO: 891034 - protein, 9 aa, Homo Sapiens
AWREKQQLL

SEQ ID NO: 891035 - protein, 9 aa, Homo Sapiens
KKTVAMHKV

SEQ ID NO: 891036 - protein, 9 aa, Homo Sapiens
EHPAYLYSL

SEQ ID NO: 891037 - protein, 9 aa, Homo Sapiens
EPSVCSCFQ

SEQ ID NO: 891038 - protein, 9 aa, Homo Sapiens
REPYVFDTA

SEQ ID NO: 891039 - protein, 9 aa, Homo Sapiens
NTDPWLLRL

SEQ ID NO: 891040 - protein, 9 aa, Homo Sapiens
VTNSTLATI

SEQ ID NO: 891041 - protein, 9 aa, Homo Sapiens
TEEKVYEII

SEQ ID NO: 891042 - protein, 9 aa, Homo Sapiens
CFSSRKKTP

SEQ ID NO: 891043 - protein, 9 aa, Homo Sapiens
SACDSLLHH

SEQ ID NO: 891044 - protein, 9 aa, Homo Sapiens
YLVEILNGE

SEQ ID NO: 891045 - protein, 9 aa, Homo Sapiens
APSADPGMP

SEQ ID NO: 891046 - protein, 9 aa, Homo Sapiens
LKTLLRCQN

SEQ ID NO: 891047 - protein, 9 aa, Homo Sapiens
ASTRSAAEN

SEQ ID NO: 891048 - protein, 9 aa, Homo Sapiens
FWLHSSNKS

SEQ ID NO: 891049 - protein, 9 aa, Homo Sapiens
PEKHLNYLW

SEQ ID NO: 891050 - protein, 9 aa, Homo Sapiens
GGESESGQL

SEQ ID NO: 891051 - protein, 9 aa, Homo Sapiens
HFPANEKKR

SEQ ID NO: 891052 - protein, 9 aa, Homo Sapiens
VLARYIDAG

SEQ ID NO: 891053 - protein, 9 aa, Homo Sapiens
WIQTETPAL

SEQ ID NO: 891054 - protein, 9 aa, Homo Sapiens
EGKITDLVH

SEQ ID NO: 891055 - protein, 9 aa, Homo Sapiens
CECKDCWKT

SEQ ID NO: 891056 - protein, 9 aa, Homo Sapiens
TLSIQESRL

SEQ ID NO: 891057 - protein, 9 aa, Homo Sapiens
FVLLGITYL

SEQ ID NO: 891058 - protein, 9 aa, Homo Sapiens
LAQTTCVVG

SEQ ID NO: 891059 - protein, 9 aa, Homo Sapiens
FLRTLGRPP

SEQ ID NO: 891060 - protein, 9 aa, Homo Sapiens
LTLQEAVNK

SEQ ID NO: 891061 - protein, 9 aa, Homo Sapiens
AVGQLGRTR

SEQ ID NO: 891062 - protein, 9 aa, Homo Sapiens
DPGYESAYG

SEQ ID NO: 891063 - protein, 9 aa, Homo Sapiens
SRTEKHNQL

SEQ ID NO: 891064 - protein, 9 aa, Homo Sapiens
SRWRLDKDS

SEQ ID NO: 891065 - protein, 9 aa, Homo Sapiens
NLKDYKCIP

SEQ ID NO: 891066 - protein, 9 aa, Homo Sapiens
SINKTPKKV

SEQ ID NO: 891067 - protein, 9 aa, Homo Sapiens
FTSPTVKRL

SEQ ID NO: 891068 - protein, 9 aa, Homo Sapiens
LSYEDIQNV

SEQ ID NO: 891069 - protein, 9 aa, Homo Sapiens
TVHWRIHSG

SEQ ID NO: 891070 - protein, 9 aa, Homo Sapiens
SALEELVNA

SEQ ID NO: 891071 - protein, 9 aa, Homo Sapiens
FQRTVGIAY

SEQ ID NO: 891072 - protein, 9 aa, Homo Sapiens
WLKRDSYLP

SEQ ID NO: 891073 - protein, 9 aa, Homo Sapiens
CTCATVLEM

SEQ ID NO: 891074 - protein, 9 aa, Homo Sapiens
KAFAANVLE

SEQ ID NO: 891075 - protein, 9 aa, Homo Sapiens
FLSALRQYA

SEQ ID NO: 891076 - protein, 9 aa, Homo Sapiens
DLAFTHLHI

SEQ ID NO: 891077 - protein, 9 aa, Homo Sapiens
NMYQVWQRT

SEQ ID NO: 891078 - protein, 9 aa, Homo Sapiens
AGSTKNWNH

SEQ ID NO: 891079 - protein, 9 aa, Homo Sapiens
KICQAFYFA

SEQ ID NO: 891080 - protein, 9 aa, Homo Sapiens
TCTKGNSCP

SEQ ID NO: 891081 - protein, 9 aa, Homo Sapiens
PVISELLSH

SEQ ID NO: 891082 - protein, 9 aa, Homo Sapiens
CDLTQADHL

SEQ ID NO: 891083 - protein, 9 aa, Homo Sapiens
LNTFQELFG

SEQ ID NO: 891084 - protein, 9 aa, Homo Sapiens
KFYNKSKDD

SEQ ID NO: 891085 - protein, 9 aa, Homo Sapiens
VTASVGHCH

SEQ ID NO: 891086 - protein, 9 aa, Homo Sapiens
FLGIIVFLE

SEQ ID NO: 891087 - protein, 9 aa, Homo Sapiens
CRDAKALEE

SEQ ID NO: 891088 - protein, 9 aa, Homo Sapiens
QRRHAASPA

SEQ ID NO: 891089 - protein, 9 aa, Homo Sapiens
IPQTTARRA

SEQ ID NO: 891090 - protein, 9 aa, Homo Sapiens
QWAELAGHN

SEQ ID NO: 891091 - protein, 9 aa, Homo Sapiens
CCKVICHSL

SEQ ID NO: 891092 - protein, 9 aa, Homo Sapiens
LRLTKNIHP

SEQ ID NO: 891093 - protein, 9 aa, Homo Sapiens
RGDMLEAEL

SEQ ID NO: 891094 - protein, 9 aa, Homo Sapiens
QNLLLSGAQ

SEQ ID NO: 891095 - protein, 9 aa, Homo Sapiens
NGGTEPPGS

SEQ ID NO: 891096 - protein, 9 aa, Homo Sapiens
WQEDAYKCT

SEQ ID NO: 891097 - protein, 9 aa, Homo Sapiens
FENEDVCMI

SEQ ID NO: 891098 - protein, 9 aa, Homo Sapiens
DNIWNCEAP

SEQ ID NO: 891099 - protein, 9 aa, Homo Sapiens
LVFWTPSCT

SEQ ID NO: 891100 - protein, 9 aa, Homo Sapiens
LMSYLNEVH

SEQ ID NO: 891101 - protein, 9 aa, Homo Sapiens
VLQADWHGR

SEQ ID NO: 891102 - protein, 9 aa, Homo Sapiens
IIQKGEIKP

SEQ ID NO: 891103 - protein, 9 aa, Homo Sapiens
PLPNYRTFL

SEQ ID NO: 891104 - protein, 9 aa, Homo Sapiens
TICDNRWEV

SEQ ID NO: 891105 - protein, 9 aa, Homo Sapiens
SLNISVTSF

SEQ ID NO: 891106 - protein, 9 aa, Homo Sapiens
DKLLSGSVL

SEQ ID NO: 891107 - protein, 9 aa, Homo Sapiens
PRQNSRTSL

SEQ ID NO: 891108 - protein, 9 aa, Homo Sapiens
GGADSNNFP

SEQ ID NO: 891109 - protein, 9 aa, Homo Sapiens
TTDGRSNGY

SEQ ID NO: 891110 - protein, 9 aa, Homo Sapiens
FKSSSHAIS

SEQ ID NO: 891111 - protein, 9 aa, Homo Sapiens
LNDLKKDNF

SEQ ID NO: 891112 - protein, 9 aa, Homo Sapiens
PNYSPTFPS

SEQ ID NO: 891113 - protein, 9 aa, Homo Sapiens
VCILGTTGL

SEQ ID NO: 891114 - protein, 9 aa, Homo Sapiens
TNKQKEIYS

SEQ ID NO: 891115 - protein, 9 aa, Homo Sapiens
RHHCHKCGF

SEQ ID NO: 891116 - protein, 9 aa, Homo Sapiens
PKTTKKPPS

SEQ ID NO: 891117 - protein, 9 aa, Homo Sapiens
ITLQPPNEA

SEQ ID NO: 891118 - protein, 9 aa, Homo Sapiens
LYFPNPYNQ

SEQ ID NO: 891119 - protein, 9 aa, Homo Sapiens
TTLLSTSVD

SEQ ID NO: 891120 - protein, 9 aa, Homo Sapiens
SPHRNAYQT

SEQ ID NO: 891121 - protein, 9 aa, Homo Sapiens
TVWAINQYR

SEQ ID NO: 891122 - protein, 9 aa, Homo Sapiens
DDLYKYLFF

SEQ ID NO: 891123 - protein, 9 aa, Homo Sapiens
NIIFCDLKL

SEQ ID NO: 891124 - protein, 9 aa, Homo Sapiens
DNVFRQLDK

SEQ ID NO: 891125 - protein, 9 aa, Homo Sapiens
RYDNLVSRL

SEQ ID NO: 891126 - protein, 9 aa, Homo Sapiens
YDLLNIFKL

SEQ ID NO: 891127 - protein, 9 aa, Homo Sapiens
KEDNVSFLM

SEQ ID NO: 891128 - protein, 9 aa, Homo Sapiens
VNNYIVNKC

SEQ ID NO: 891129 - protein, 9 aa, Homo Sapiens
ERAKRMSFC

SEQ ID NO: 891130 - protein, 9 aa, Homo Sapiens
NEKQRQNGS

SEQ ID NO: 891131 - protein, 9 aa, Homo Sapiens
GDDGHLFCS

SEQ ID NO: 891132 - protein, 9 aa, Homo Sapiens
FENTYKGSE

SEQ ID NO: 891133 - protein, 9 aa, Homo Sapiens
WAVVNKDSG

SEQ ID NO: 891134 - protein, 9 aa, Homo Sapiens
QDQQSNHSG

SEQ ID NO: 891135 - protein, 9 aa, Homo Sapiens
IQIDLRCPL

SEQ ID NO: 891136 - protein, 9 aa, Homo Sapiens
ICLSNFLKD

SEQ ID NO: 891137 - protein, 9 aa, Homo Sapiens
IVLVSYLNI

SEQ ID NO: 891138 - protein, 9 aa, Homo Sapiens
NADEGFGLA

SEQ ID NO: 891139 - protein, 9 aa, Homo Sapiens
KLFHDPSEG

SEQ ID NO: 891140 - protein, 9 aa, Homo Sapiens
LGMQFVLLQ

SEQ ID NO: 891141 - protein, 9 aa, Homo Sapiens
QLPDIYPNL

SEQ ID NO: 891142 - protein, 9 aa, Homo Sapiens
DLAFQGDGV

SEQ ID NO: 891143 - protein, 9 aa, Homo Sapiens
KQHLIYQQQ

SEQ ID NO: 891144 - protein, 9 aa, Homo Sapiens
HIEDVKMTF

SEQ ID NO: 891145 - protein, 9 aa, Homo Sapiens
NKSHGSCAP

SEQ ID NO: 891146 - protein, 9 aa, Homo Sapiens
FLKNFLIKP

SEQ ID NO: 891147 - protein, 9 aa, Homo Sapiens
HLPKLGQSI

SEQ ID NO: 891148 - protein, 9 aa, Homo Sapiens
LGHTQTNVG

SEQ ID NO: 891149 - protein, 9 aa, Homo Sapiens
HLKRHTAAA

SEQ ID NO: 891150 - protein, 9 aa, Homo Sapiens
GFTHISTGE

SEQ ID NO: 891151 - protein, 9 aa, Homo Sapiens
GIQMYKSNG

SEQ ID NO: 891152 - protein, 9 aa, Homo Sapiens
YRKLLNYQV

SEQ ID NO: 891153 - protein, 9 aa, Homo Sapiens
CCQCSFTAA

SEQ ID NO: 891154 - protein, 9 aa, Homo Sapiens
INGVQNYKL

SEQ ID NO: 891155 - protein, 9 aa, Homo Sapiens
KSFSYSNLF

SEQ ID NO: 891156 - protein, 9 aa, Homo Sapiens
VMFFLNIVM

SEQ ID NO: 891157 - protein, 9 aa, Homo Sapiens
EADKLSWDL

SEQ ID NO: 891158 - protein, 9 aa, Homo Sapiens
LFLVLQDFI

SEQ ID NO: 891159 - protein, 9 aa, Homo Sapiens
SGRCVNTDG

SEQ ID NO: 891160 - protein, 9 aa, Homo Sapiens
SDCFLYANR

SEQ ID NO: 891161 - protein, 9 aa, Homo Sapiens
EFTKPKRSQ

SEQ ID NO: 891162 - protein, 9 aa, Homo Sapiens
LILIGQKLK

SEQ ID NO: 891163 - protein, 9 aa, Homo Sapiens
VLCTYMASE

SEQ ID NO: 891164 - protein, 9 aa, Homo Sapiens
DQREKIKYI

SEQ ID NO: 891165 - protein, 9 aa, Homo Sapiens
ENAYNASLS

SEQ ID NO: 891166 - protein, 9 aa, Homo Sapiens
ICEGLEKME

SEQ ID NO: 891167 - protein, 9 aa, Homo Sapiens
RLHPHTITG

SEQ ID NO: 891168 - protein, 9 aa, Homo Sapiens
SHDYPVKAV

SEQ ID NO: 891169 - protein, 9 aa, Homo Sapiens
HIKAHKVAQ

SEQ ID NO: 891170 - protein, 9 aa, Homo Sapiens
LNSEGKISV

SEQ ID NO: 891171 - protein, 9 aa, Homo Sapiens
EPRTAVKNL

SEQ ID NO: 891172 - protein, 9 aa, Homo Sapiens
NDPSLGDKA

SEQ ID NO: 891173 - protein, 9 aa, Homo Sapiens
KNRLTRDDF

SEQ ID NO: 891174 - protein, 9 aa, Homo Sapiens
ASHFYRIDR

SEQ ID NO: 891175 - protein, 9 aa, Homo Sapiens
IHPCKKVSS

SEQ ID NO: 891176 - protein, 9 aa, Homo Sapiens
FKTNRKTCF

SEQ ID NO: 891177 - protein, 9 aa, Homo Sapiens
TQRLHGMDM

SEQ ID NO: 891178 - protein, 9 aa, Homo Sapiens
NQLRHIHLE

SEQ ID NO: 891179 - protein, 9 aa, Homo Sapiens
KKENNNSNK

SEQ ID NO: 891180 - protein, 9 aa, Homo Sapiens
NTFQHSVVV

SEQ ID NO: 891181 - protein, 9 aa, Homo Sapiens
LALEELQSK

SEQ ID NO: 891182 - protein, 9 aa, Homo Sapiens
LLHANVVPN

SEQ ID NO: 891183 - protein, 9 aa, Homo Sapiens
DKYLGTNAQ

SEQ ID NO: 891184 - protein, 9 aa, Homo Sapiens
LNIRVILGQ

SEQ ID NO: 891185 - protein, 9 aa, Homo Sapiens
PDGKQAVCL

SEQ ID NO: 891186 - protein, 9 aa, Homo Sapiens
HLFQIKHLP

SEQ ID NO: 891187 - protein, 9 aa, Homo Sapiens
FYLFAERKY

SEQ ID NO: 891188 - protein, 9 aa, Homo Sapiens
EVIVTKDNA

SEQ ID NO: 891189 - protein, 9 aa, Homo Sapiens
EVAGLSYFY

SEQ ID NO: 891190 - protein, 9 aa, Homo Sapiens
VFQTKQKNL

SEQ ID NO: 891191 - protein, 9 aa, Homo Sapiens
CINQIATAF

SEQ ID NO: 891192 - protein, 9 aa, Homo Sapiens
RADTFDLQI

SEQ ID NO: 891193 - protein, 9 aa, Homo Sapiens
MEAVLSVPD

SEQ ID NO: 891194 - protein, 9 aa, Homo Sapiens
NLMTLGEVE

SEQ ID NO: 891195 - protein, 9 aa, Homo Sapiens
ESSPERPIN

SEQ ID NO: 891196 - protein, 9 aa, Homo Sapiens
FVGRMMQTF

SEQ ID NO: 891197 - protein, 9 aa, Homo Sapiens
ERKRHDSKR

SEQ ID NO: 891198 - protein, 9 aa, Homo Sapiens
FGKDAQQRI

SEQ ID NO: 891199 - protein, 9 aa, Homo Sapiens
QQQLDDAHK

SEQ ID NO: 891200 - protein, 9 aa, Homo Sapiens
KQMKYSAVH

SEQ ID NO: 891201 - protein, 9 aa, Homo Sapiens
KSLGLELIH

SEQ ID NO: 891202 - protein, 9 aa, Homo Sapiens
GTRNFHKYF

SEQ ID NO: 891203 - protein, 9 aa, Homo Sapiens
HWAVVNKDS

SEQ ID NO: 891204 - protein, 9 aa, Homo Sapiens
NQVWGKVFP

SEQ ID NO: 891205 - protein, 9 aa, Homo Sapiens
DTEANSNKE

SEQ ID NO: 891206 - protein, 9 aa, Homo Sapiens
TANNKKVKE

SEQ ID NO: 891207 - protein, 9 aa, Homo Sapiens
ADYTTKKYR

SEQ ID NO: 891208 - protein, 9 aa, Homo Sapiens
RLPINIARP

SEQ ID NO: 891209 - protein, 9 aa, Homo Sapiens
NFFQVSKNK

SEQ ID NO: 891210 - protein, 9 aa, Homo Sapiens
LAFLAPSVS

SEQ ID NO: 891211 - protein, 9 aa, Homo Sapiens
HYFIIINCG

SEQ ID NO: 891212 - protein, 9 aa, Homo Sapiens
IASLINERN

SEQ ID NO: 891213 - protein, 9 aa, Homo Sapiens
MTERQSKFT

SEQ ID NO: 891214 - protein, 9 aa, Homo Sapiens
FIIINCGAN

SEQ ID NO: 891215 - protein, 9 aa, Homo Sapiens
RICKFQILN

SEQ ID NO: 891216 - protein, 9 aa, Homo Sapiens
PLFWEINWE

SEQ ID NO: 891217 - protein, 9 aa, Homo Sapiens
NGHGGGQSQ

SEQ ID NO: 891218 - protein, 9 aa, Homo Sapiens
QILLDQGQT

SEQ ID NO: 891219 - protein, 9 aa, Homo Sapiens
YSDASVHEE

SEQ ID NO: 891220 - protein, 9 aa, Homo Sapiens
LDYLKEVDV

SEQ ID NO: 891221 - protein, 9 aa, Homo Sapiens
SCVSDPPVI

SEQ ID NO: 891222 - protein, 9 aa, Homo Sapiens
VYCHSVELQ

SEQ ID NO: 891223 - protein, 9 aa, Homo Sapiens
EETEEDNKE

SEQ ID NO: 891224 - protein, 9 aa, Homo Sapiens
EGYNVYGTK

SEQ ID NO: 891225 - protein, 9 aa, Homo Sapiens
HAFDFGPHD

SEQ ID NO: 891226 - protein, 9 aa, Homo Sapiens
YSWERVFLT

SEQ ID NO: 891227 - protein, 9 aa, Homo Sapiens
GAMVCCNNE

SEQ ID NO: 891228 - protein, 9 aa, Homo Sapiens
SCINPFVYY

SEQ ID NO: 891229 - protein, 9 aa, Homo Sapiens
EPCVREGCA

SEQ ID NO: 891230 - protein, 9 aa, Homo Sapiens
PAADGVAAS

SEQ ID NO: 891231 - protein, 9 aa, Homo Sapiens
NHPGRVMLQ

SEQ ID NO: 891232 - protein, 9 aa, Homo Sapiens
GIRLLPRGN

SEQ ID NO: 891233 - protein, 9 aa, Homo Sapiens
VELHQFVSK

SEQ ID NO: 891234 - protein, 9 aa, Homo Sapiens
CNPPPAEKN

SEQ ID NO: 891235 - protein, 9 aa, Homo Sapiens
RDELLQVLH

SEQ ID NO: 891236 - protein, 9 aa, Homo Sapiens
HDSKRSTCS

SEQ ID NO: 891237 - protein, 9 aa, Homo Sapiens
VLLLSPDVT

SEQ ID NO: 891238 - protein, 9 aa, Homo Sapiens
DTNKASILL

SEQ ID NO: 891239 - protein, 9 aa, Homo Sapiens
QILFSSCQE

SEQ ID NO: 891240 - protein, 9 aa, Homo Sapiens
NVIAQAVPH

SEQ ID NO: 891241 - protein, 9 aa, Homo Sapiens
EAQLQEIWR

SEQ ID NO: 891242 - protein, 9 aa, Homo Sapiens
VDYKVNFHF

SEQ ID NO: 891243 - protein, 9 aa, Homo Sapiens
CIKAKQLLE

SEQ ID NO: 891244 - protein, 9 aa, Homo Sapiens
RKIGFAIGM

SEQ ID NO: 891245 - protein, 9 aa, Homo Sapiens
TGRCNGQFK

SEQ ID NO: 891246 - protein, 9 aa, Homo Sapiens
INTFWIKSG

SEQ ID NO: 891247 - protein, 9 aa, Homo Sapiens
NLTNIDISN

SEQ ID NO: 891248 - protein, 9 aa, Homo Sapiens
LLVWDPARL

SEQ ID NO: 891249 - protein, 9 aa, Homo Sapiens
YTDLSRLND

SEQ ID NO: 891250 - protein, 9 aa, Homo Sapiens
ALKDELQKR

SEQ ID NO: 891251 - protein, 9 aa, Homo Sapiens
FPYTRRQNP

SEQ ID NO: 891252 - protein, 9 aa, Homo Sapiens
QWLHQNRFS

SEQ ID NO: 891253 - protein, 9 aa, Homo Sapiens
EALVDEIVM

SEQ ID NO: 891254 - protein, 9 aa, Homo Sapiens
RWMRGFLVR

SEQ ID NO: 891255 - protein, 9 aa, Homo Sapiens
AQTGLITTT

SEQ ID NO: 891256 - protein, 9 aa, Homo Sapiens
SSSLIIHKI

SEQ ID NO: 891257 - protein, 9 aa, Homo Sapiens
EREEAVCLL

SEQ ID NO: 891258 - protein, 9 aa, Homo Sapiens
ILKEKEGAN

SEQ ID NO: 891259 - protein, 9 aa, Homo Sapiens
VDANLINAG

SEQ ID NO: 891260 - protein, 9 aa, Homo Sapiens
KDGVSRCFH

SEQ ID NO: 891261 - protein, 9 aa, Homo Sapiens
ASNAAGEVT

SEQ ID NO: 891262 - protein, 9 aa, Homo Sapiens
PKMLEELSL

SEQ ID NO: 891263 - protein, 9 aa, Homo Sapiens
ENDGENSVS

SEQ ID NO: 891264 - protein, 9 aa, Homo Sapiens
KCCLNGCGH

SEQ ID NO: 891265 - protein, 9 aa, Homo Sapiens
LLSETPPDG

SEQ ID NO: 891266 - protein, 9 aa, Homo Sapiens
VPTVWAINQ

SEQ ID NO: 891267 - protein, 9 aa, Homo Sapiens
CRANCLCYL

SEQ ID NO: 891268 - protein, 9 aa, Homo Sapiens
GAIEEDINK

SEQ ID NO: 891269 - protein, 9 aa, Homo Sapiens
GKGASTKQA

SEQ ID NO: 891270 - protein, 9 aa, Homo Sapiens
KDFMDQNQY

SEQ ID NO: 891271 - protein, 9 aa, Homo Sapiens
CMSELWCME

SEQ ID NO: 891272 - protein, 9 aa, Homo Sapiens
EKTGNAYED

SEQ ID NO: 891273 - protein, 9 aa, Homo Sapiens
RKCLSPGSK

SEQ ID NO: 891274 - protein, 9 aa, Homo Sapiens
TQYYQCFDR

SEQ ID NO: 891275 - protein, 9 aa, Homo Sapiens
GVQVTESGT

SEQ ID NO: 891276 - protein, 9 aa, Homo Sapiens
VCGGTVTAF

SEQ ID NO: 891277 - protein, 9 aa, Homo Sapiens
DIIPASLLD

SEQ ID NO: 891278 - protein, 9 aa, Homo Sapiens
NLNHNAMYW

SEQ ID NO: 891279 - protein, 9 aa, Homo Sapiens
GDPIQKGAV

SEQ ID NO: 891280 - protein, 9 aa, Homo Sapiens
ILLCLKVDN

SEQ ID NO: 891281 - protein, 9 aa, Homo Sapiens
RFEERDFVP

SEQ ID NO: 891282 - protein, 9 aa, Homo Sapiens
YTDDEDKDE

SEQ ID NO: 891283 - protein, 9 aa, Homo Sapiens
ENACDQPLD

SEQ ID NO: 891284 - protein, 9 aa, Homo Sapiens
QNIPGSKLM

SEQ ID NO: 891285 - protein, 9 aa, Homo Sapiens
AEARINMVV

SEQ ID NO: 891286 - protein, 9 aa, Homo Sapiens
NVTLRQIAH

SEQ ID NO: 891287 - protein, 9 aa, Homo Sapiens
GHNRDDGSV

SEQ ID NO: 891288 - protein, 9 aa, Homo Sapiens
CYWVLQIIF

SEQ ID NO: 891289 - protein, 9 aa, Homo Sapiens
VVAIMAIDI

SEQ ID NO: 891290 - protein, 9 aa, Homo Sapiens
EFEHSETRG

SEQ ID NO: 891291 - protein, 9 aa, Homo Sapiens
GSQIEINQT

SEQ ID NO: 891292 - protein, 9 aa, Homo Sapiens
PDKLTLELQ

SEQ ID NO: 891293 - protein, 9 aa, Homo Sapiens
QKDPGFSKV

SEQ ID NO: 891294 - protein, 9 aa, Homo Sapiens
EPQNILRAL

SEQ ID NO: 891295 - protein, 9 aa, Homo Sapiens
RTHTGDKPF

SEQ ID NO: 891296 - protein, 9 aa, Homo Sapiens
AFLRTLGRP

SEQ ID NO: 891297 - protein, 9 aa, Homo Sapiens
LIISMCLIF

SEQ ID NO: 891298 - protein, 9 aa, Homo Sapiens
EKIIQILAQ

SEQ ID NO: 891299 - protein, 9 aa, Homo Sapiens
LWAGLLRNH

SEQ ID NO: 891300 - protein, 9 aa, Homo Sapiens
GKPAITKRT

SEQ ID NO: 891301 - protein, 9 aa, Homo Sapiens
SPSLQNHYL

SEQ ID NO: 891302 - protein, 9 aa, Homo Sapiens
ATSVLDTSN

SEQ ID NO: 891303 - protein, 9 aa, Homo Sapiens
TLREPVTIN

SEQ ID NO: 891304 - protein, 9 aa, Homo Sapiens
ETGRSRLIK

SEQ ID NO: 891305 - protein, 9 aa, Homo Sapiens
NLFDFDTFG

SEQ ID NO: 891306 - protein, 9 aa, Homo Sapiens
HFDKLPING

SEQ ID NO: 891307 - protein, 9 aa, Homo Sapiens
RRRNFDNSF

SEQ ID NO: 891308 - protein, 9 aa, Homo Sapiens
QLSKDKKKI

SEQ ID NO: 891309 - protein, 9 aa, Homo Sapiens
ISPQSWPPP

SEQ ID NO: 891310 - protein, 9 aa, Homo Sapiens
ELTCPPGWK

SEQ ID NO: 891311 - protein, 9 aa, Homo Sapiens
DDFNWGKYL

SEQ ID NO: 891312 - protein, 9 aa, Homo Sapiens
CAKEDKCQG

SEQ ID NO: 891313 - protein, 9 aa, Homo Sapiens
EFFPTNSTS

SEQ ID NO: 891314 - protein, 9 aa, Homo Sapiens
VYPLVGSYS

SEQ ID NO: 891315 - protein, 9 aa, Homo Sapiens
ADRFYQIDR

SEQ ID NO: 891316 - protein, 9 aa, Homo Sapiens
EDRIHKQDE

SEQ ID NO: 891317 - protein, 9 aa, Homo Sapiens
TVKFCCPAG

SEQ ID NO: 891318 - protein, 9 aa, Homo Sapiens
LTIYQQFSE

SEQ ID NO: 891319 - protein, 9 aa, Homo Sapiens
PNRQIKKWN

SEQ ID NO: 891320 - protein, 9 aa, Homo Sapiens
RLYETAVKF

SEQ ID NO: 891321 - protein, 9 aa, Homo Sapiens
AEVQSELER

SEQ ID NO: 891322 - protein, 9 aa, Homo Sapiens
GKLFCWSTN

SEQ ID NO: 891323 - protein, 9 aa, Homo Sapiens
GIDPPPCDA

SEQ ID NO: 891324 - protein, 9 aa, Homo Sapiens
YDEKVFWWE

SEQ ID NO: 891325 - protein, 9 aa, Homo Sapiens
HSQIKHQNL

SEQ ID NO: 891326 - protein, 9 aa, Homo Sapiens
LFSNWMVQV

SEQ ID NO: 891327 - protein, 9 aa, Homo Sapiens
ETDIVQQME

SEQ ID NO: 891328 - protein, 9 aa, Homo Sapiens
CCGGATCVL

SEQ ID NO: 891329 - protein, 9 aa, Homo Sapiens
YWTMIQLHS

SEQ ID NO: 891330 - protein, 9 aa, Homo Sapiens
CKMTVNTEL

SEQ ID NO: 891331 - protein, 9 aa, Homo Sapiens
NSLNKLVLR

SEQ ID NO: 891332 - protein, 9 aa, Homo Sapiens
QMPAFFNGI

SEQ ID NO: 891333 - protein, 9 aa, Homo Sapiens
VTLGYDEGS

SEQ ID NO: 891334 - protein, 9 aa, Homo Sapiens
LKKEDANRK

SEQ ID NO: 891335 - protein, 9 aa, Homo Sapiens
SNLAKHQRI

SEQ ID NO: 891336 - protein, 9 aa, Homo Sapiens
DDNGQEIKN

SEQ ID NO: 891337 - protein, 9 aa, Homo Sapiens
YVKYRNVSY

SEQ ID NO: 891338 - protein, 9 aa, Homo Sapiens
AGKTQTFYG

SEQ ID NO: 891339 - protein, 9 aa, Homo Sapiens
SPSPIKKED

SEQ ID NO: 891340 - protein, 9 aa, Homo Sapiens
KCSEQSLIK

SEQ ID NO: 891341 - protein, 9 aa, Homo Sapiens
GIHLIQRKI

SEQ ID NO: 891342 - protein, 9 aa, Homo Sapiens
TLANMKVTL

SEQ ID NO: 891343 - protein, 9 aa, Homo Sapiens
PRSLQSPTE

SEQ ID NO: 891344 - protein, 9 aa, Homo Sapiens
FFPNNQEIE

SEQ ID NO: 891345 - protein, 9 aa, Homo Sapiens
LEDLENTAS

SEQ ID NO: 891346 - protein, 9 aa, Homo Sapiens
YPPGVGSRQ

SEQ ID NO: 891347 - protein, 9 aa, Homo Sapiens
HPKEIWTFF

SEQ ID NO: 891348 - protein, 9 aa, Homo Sapiens
PRTAVKNLM

SEQ ID NO: 891349 - protein, 9 aa, Homo Sapiens
DSLLLSSTE

SEQ ID NO: 891350 - protein, 9 aa, Homo Sapiens
MEQLCTYQE

SEQ ID NO: 891351 - protein, 9 aa, Homo Sapiens
RDKHLQGLT

SEQ ID NO: 891352 - protein, 9 aa, Homo Sapiens
YIPEDPTFN

SEQ ID NO: 891353 - protein, 9 aa, Homo Sapiens
QEHPLPNYR

SEQ ID NO: 891354 - protein, 9 aa, Homo Sapiens
IIKEKEEAE

SEQ ID NO: 891355 - protein, 9 aa, Homo Sapiens
DLLKGAFQS

SEQ ID NO: 891356 - protein, 9 aa, Homo Sapiens
FLGMKSCGI

SEQ ID NO: 891357 - protein, 9 aa, Homo Sapiens
KNKLPDSFS

SEQ ID NO: 891358 - protein, 9 aa, Homo Sapiens
DLAKYITSD

SEQ ID NO: 891359 - protein, 9 aa, Homo Sapiens
HHAKDSEDI

SEQ ID NO: 891360 - protein, 9 aa, Homo Sapiens
ALLHLPSER

SEQ ID NO: 891361 - protein, 9 aa, Homo Sapiens
SRSTSSDCQ

SEQ ID NO: 891362 - protein, 9 aa, Homo Sapiens
ELRQQLQIR

SEQ ID NO: 891363 - protein, 9 aa, Homo Sapiens
FSRAVETVK

SEQ ID NO: 891364 - protein, 9 aa, Homo Sapiens
LNLDDLDAT

SEQ ID NO: 891365 - protein, 9 aa, Homo Sapiens
LPPTNKQKE

SEQ ID NO: 891366 - protein, 9 aa, Homo Sapiens
LDIENAVES

SEQ ID NO: 891367 - protein, 9 aa, Homo Sapiens
DDIQAILDD

SEQ ID NO: 891368 - protein, 9 aa, Homo Sapiens
HSIYIQSIG

SEQ ID NO: 891369 - protein, 9 aa, Homo Sapiens
KYDMWDRLS

SEQ ID NO: 891370 - protein, 9 aa, Homo Sapiens
EIFNVISGA

SEQ ID NO: 891371 - protein, 9 aa, Homo Sapiens
TLKSTASSL

SEQ ID NO: 891372 - protein, 9 aa, Homo Sapiens
LQPPNEATA

SEQ ID NO: 891373 - protein, 9 aa, Homo Sapiens
KHLNYLWNL

SEQ ID NO: 891374 - protein, 9 aa, Homo Sapiens
DNIAQGSDH

SEQ ID NO: 891375 - protein, 9 aa, Homo Sapiens
TQVKGSLNI

SEQ ID NO: 891376 - protein, 9 aa, Homo Sapiens
SGQRHWSSK

SEQ ID NO: 891377 - protein, 9 aa, Homo Sapiens
TLKQKEPLH

SEQ ID NO: 891378 - protein, 9 aa, Homo Sapiens
NAREEQDIK

SEQ ID NO: 891379 - protein, 9 aa, Homo Sapiens
SSKSDHFRC

SEQ ID NO: 891380 - protein, 9 aa, Homo Sapiens
GDKPYECVE

SEQ ID NO: 891381 - protein, 9 aa, Homo Sapiens
NPATDKWTL

SEQ ID NO: 891382 - protein, 9 aa, Homo Sapiens
DHFLFNKPV

SEQ ID NO: 891383 - protein, 9 aa, Homo Sapiens
LLYSKTAKQ

SEQ ID NO: 891384 - protein, 9 aa, Homo Sapiens
CRICPGNTY

SEQ ID NO: 891385 - protein, 9 aa, Homo Sapiens
AFAVLAVAS

SEQ ID NO: 891386 - protein, 9 aa, Homo Sapiens
SPSAETQSS

SEQ ID NO: 891387 - protein, 9 aa, Homo Sapiens
DRKTPSKSN

SEQ ID NO: 891388 - protein, 9 aa, Homo Sapiens
VIILHRRKQ

SEQ ID NO: 891389 - protein, 9 aa, Homo Sapiens
LLIIIVLLR

SEQ ID NO: 891390 - protein, 9 aa, Homo Sapiens
AKDIKHRLG

SEQ ID NO: 891391 - protein, 9 aa, Homo Sapiens
MLTKENSRD

SEQ ID NO: 891392 - protein, 9 aa, Homo Sapiens
FPQYTPPSV

SEQ ID NO: 891393 - protein, 9 aa, Homo Sapiens
NRIYGGSSR

SEQ ID NO: 891394 - protein, 9 aa, Homo Sapiens
RRLDFTEFF

SEQ ID NO: 891395 - protein, 9 aa, Homo Sapiens
ESKKAENDL

SEQ ID NO: 891396 - protein, 9 aa, Homo Sapiens
NEQEALEDK

SEQ ID NO: 891397 - protein, 9 aa, Homo Sapiens
FNKPVSPLL

SEQ ID NO: 891398 - protein, 9 aa, Homo Sapiens
AQGMIEFCD

SEQ ID NO: 891399 - protein, 9 aa, Homo Sapiens
LALLLIIIV

SEQ ID NO: 891400 - protein, 9 aa, Homo Sapiens
ESIPDIQVH

SEQ ID NO: 891401 - protein, 9 aa, Homo Sapiens
SPVLPQRPA

SEQ ID NO: 891402 - protein, 9 aa, Homo Sapiens
DNPQRFDLV

SEQ ID NO: 891403 - protein, 9 aa, Homo Sapiens
IKDLFMKRF

SEQ ID NO: 891404 - protein, 9 aa, Homo Sapiens
YEDKTRYCV

SEQ ID NO: 891405 - protein, 9 aa, Homo Sapiens
VVLTLNDVF

SEQ ID NO: 891406 - protein, 9 aa, Homo Sapiens
VALAITSFV

SEQ ID NO: 891407 - protein, 9 aa, Homo Sapiens
IDVHRLIKG

SEQ ID NO: 891408 - protein, 9 aa, Homo Sapiens
KLTNIRPIP

SEQ ID NO: 891409 - protein, 9 aa, Homo Sapiens
QIIHIGKKQ

SEQ ID NO: 891410 - protein, 9 aa, Homo Sapiens
LLHHSDRKP

SEQ ID NO: 891411 - protein, 9 aa, Homo Sapiens
AGKYLAKWM

SEQ ID NO: 891412 - protein, 9 aa, Homo Sapiens
SFVQLCADY

SEQ ID NO: 891413 - protein, 9 aa, Homo Sapiens
RTARLLSEC

SEQ ID NO: 891414 - protein, 9 aa, Homo Sapiens
DYSQSSRKS

SEQ ID NO: 891415 - protein, 9 aa, Homo Sapiens
GGGHCSIPS

SEQ ID NO: 891416 - protein, 9 aa, Homo Sapiens
NLLQIREKE

SEQ ID NO: 891417 - protein, 9 aa, Homo Sapiens
LLLEGFELM

SEQ ID NO: 891418 - protein, 9 aa, Homo Sapiens
ICEQEKKEM

SEQ ID NO: 891419 - protein, 9 aa, Homo Sapiens
LRQCHQQMQ

SEQ ID NO: 891420 - protein, 9 aa, Homo Sapiens
RKKRRIIKL

SEQ ID NO: 891421 - protein, 9 aa, Homo Sapiens
IWLYWQIWH

SEQ ID NO: 891422 - protein, 9 aa, Homo Sapiens
YQNATGESC

SEQ ID NO: 891423 - protein, 9 aa, Homo Sapiens
LNGTDTIVL

SEQ ID NO: 891424 - protein, 9 aa, Homo Sapiens
LDIKRICVG

SEQ ID NO: 891425 - protein, 9 aa, Homo Sapiens
NVPLKKMAN

SEQ ID NO: 891426 - protein, 9 aa, Homo Sapiens
RNELVAGSQ

SEQ ID NO: 891427 - protein, 9 aa, Homo Sapiens
VVNNSQNNT

SEQ ID NO: 891428 - protein, 9 aa, Homo Sapiens
CQIHHPSLP

SEQ ID NO: 891429 - protein, 9 aa, Homo Sapiens
KRKMQRVQE

SEQ ID NO: 891430 - protein, 9 aa, Homo Sapiens
KHQKEICFM

SEQ ID NO: 891431 - protein, 9 aa, Homo Sapiens
RDNFESMYT

SEQ ID NO: 891432 - protein, 9 aa, Homo Sapiens
NVETVTYEN

SEQ ID NO: 891433 - protein, 9 aa, Homo Sapiens
QVWDLEPNT

SEQ ID NO: 891434 - protein, 9 aa, Homo Sapiens
GLSQEIWNE

SEQ ID NO: 891435 - protein, 9 aa, Homo Sapiens
INECYKPTG

SEQ ID NO: 891436 - protein, 9 aa, Homo Sapiens
ESLCAKEDK

SEQ ID NO: 891437 - protein, 9 aa, Homo Sapiens
EEDYKYIEH

SEQ ID NO: 891438 - protein, 9 aa, Homo Sapiens
IVFLELTAG

SEQ ID NO: 891439 - protein, 9 aa, Homo Sapiens
SKTMASKHS

SEQ ID NO: 891440 - protein, 9 aa, Homo Sapiens
RCPGRSQTP

SEQ ID NO: 891441 - protein, 9 aa, Homo Sapiens
NVNYYNHLY

SEQ ID NO: 891442 - protein, 9 aa, Homo Sapiens
ACLGSSAAN

SEQ ID NO: 891443 - protein, 9 aa, Homo Sapiens
GAGALLHLP

SEQ ID NO: 891444 - protein, 9 aa, Homo Sapiens
MVMISSEHT

SEQ ID NO: 891445 - protein, 9 aa, Homo Sapiens
RKNRKTRRY

SEQ ID NO: 891446 - protein, 9 aa, Homo Sapiens
TTGVSADPT

SEQ ID NO: 891447 - protein, 9 aa, Homo Sapiens
EVNELYKEK

SEQ ID NO: 891448 - protein, 9 aa, Homo Sapiens
QVWQRTLSY

SEQ ID NO: 891449 - protein, 9 aa, Homo Sapiens
TTSVENLFC

SEQ ID NO: 891450 - protein, 9 aa, Homo Sapiens
INKSLVKQS

SEQ ID NO: 891451 - protein, 9 aa, Homo Sapiens
PKKNKGKEC

SEQ ID NO: 891452 - protein, 9 aa, Homo Sapiens
INSSAFSYQ

SEQ ID NO: 891453 - protein, 9 aa, Homo Sapiens
LSRKKFPPH

SEQ ID NO: 891454 - protein, 9 aa, Homo Sapiens
ELFKVLGLH

SEQ ID NO: 891455 - protein, 9 aa, Homo Sapiens
GVVQIYHRK

SEQ ID NO: 891456 - protein, 9 aa, Homo Sapiens
MNLEQFPLE

SEQ ID NO: 891457 - protein, 9 aa, Homo Sapiens
LEGHKLPNE

SEQ ID NO: 891458 - protein, 9 aa, Homo Sapiens
SHPNALEER

SEQ ID NO: 891459 - protein, 9 aa, Homo Sapiens
EYKLQAPHI

SEQ ID NO: 891460 - protein, 9 aa, Homo Sapiens
SRDYIVLDL

SEQ ID NO: 891461 - protein, 9 aa, Homo Sapiens
HAAECLQTK

SEQ ID NO: 891462 - protein, 9 aa, Homo Sapiens
VFRGQPGSG

SEQ ID NO: 891463 - protein, 9 aa, Homo Sapiens
TLKLQKKDF

SEQ ID NO: 891464 - protein, 9 aa, Homo Sapiens
TDKTSFVLP

SEQ ID NO: 891465 - protein, 9 aa, Homo Sapiens
VDGWCECDD

SEQ ID NO: 891466 - protein, 9 aa, Homo Sapiens
DKLFQIHLK

SEQ ID NO: 891467 - protein, 9 aa, Homo Sapiens
KKKDVKSYF

SEQ ID NO: 891468 - protein, 9 aa, Homo Sapiens
SQSILDYLE

SEQ ID NO: 891469 - protein, 9 aa, Homo Sapiens
TSYWIGWVC

SEQ ID NO: 891470 - protein, 9 aa, Homo Sapiens
LVILTTRQY

SEQ ID NO: 891471 - protein, 9 aa, Homo Sapiens
QVYFHCLHL

SEQ ID NO: 891472 - protein, 9 aa, Homo Sapiens
LVLSQDYSQ

SEQ ID NO: 891473 - protein, 9 aa, Homo Sapiens
ECFSQEVQV

SEQ ID NO: 891474 - protein, 9 aa, Homo Sapiens
TTSVSVYGR

SEQ ID NO: 891475 - protein, 9 aa, Homo Sapiens
SFSHRQLYD

SEQ ID NO: 891476 - protein, 9 aa, Homo Sapiens
AFQIIRGNF

SEQ ID NO: 891477 - protein, 9 aa, Homo Sapiens
TPGAQPEPT

SEQ ID NO: 891478 - protein, 9 aa, Homo Sapiens
AGLHNVFKL

SEQ ID NO: 891479 - protein, 9 aa, Homo Sapiens
LRKFKIQTW

SEQ ID NO: 891480 - protein, 9 aa, Homo Sapiens
TIVVGMPNG

SEQ ID NO: 891481 - protein, 9 aa, Homo Sapiens
SGSSKLEKV

SEQ ID NO: 891482 - protein, 9 aa, Homo Sapiens
ALMPSFDFL

SEQ ID NO: 891483 - protein, 9 aa, Homo Sapiens
NCSGNQRQS

SEQ ID NO: 891484 - protein, 9 aa, Homo Sapiens
SIRPPYNQA

SEQ ID NO: 891485 - protein, 9 aa, Homo Sapiens
VSIIMFCLI

SEQ ID NO: 891486 - protein, 9 aa, Homo Sapiens
FGSRVCIKG

SEQ ID NO: 891487 - protein, 9 aa, Homo Sapiens
YTSAFLPVF

SEQ ID NO: 891488 - protein, 9 aa, Homo Sapiens
WTEGSKMQQ

SEQ ID NO: 891489 - protein, 9 aa, Homo Sapiens
WIEIIALSL

SEQ ID NO: 891490 - protein, 9 aa, Homo Sapiens
SWAQGNLTA

SEQ ID NO: 891491 - protein, 9 aa, Homo Sapiens
SVENLFCFL

SEQ ID NO: 891492 - protein, 9 aa, Homo Sapiens
EIAQVQTKA

SEQ ID NO: 891493 - protein, 9 aa, Homo Sapiens
LAEYTFLFA

SEQ ID NO: 891494 - protein, 9 aa, Homo Sapiens
PICYERECK

SEQ ID NO: 891495 - protein, 9 aa, Homo Sapiens
AQMELHHQN

SEQ ID NO: 891496 - protein, 9 aa, Homo Sapiens
LCECKDCWK

SEQ ID NO: 891497 - protein, 9 aa, Homo Sapiens
AQMVQLHKK

SEQ ID NO: 891498 - protein, 9 aa, Homo Sapiens
LCLTVEQAV

SEQ ID NO: 891499 - protein, 9 aa, Homo Sapiens
NPALSQAMV

SEQ ID NO: 891500 - protein, 9 aa, Homo Sapiens
TLSFPVDTS

SEQ ID NO: 891501 - protein, 9 aa, Homo Sapiens
YFRNQRPGA

SEQ ID NO: 891502 - protein, 9 aa, Homo Sapiens
DWLATALAG

SEQ ID NO: 891503 - protein, 9 aa, Homo Sapiens
LQFGVTVID

SEQ ID NO: 891504 - protein, 9 aa, Homo Sapiens
TDCCNNMPV

SEQ ID NO: 891505 - protein, 9 aa, Homo Sapiens
TLNARAVII

SEQ ID NO: 891506 - protein, 9 aa, Homo Sapiens
TRGGETQGV

SEQ ID NO: 891507 - protein, 9 aa, Homo Sapiens
QRQKQARLV

SEQ ID NO: 891508 - protein, 9 aa, Homo Sapiens
RYSCSLHAR

SEQ ID NO: 891509 - protein, 9 aa, Homo Sapiens
FSPLAGLRA

SEQ ID NO: 891510 - protein, 9 aa, Homo Sapiens
GRPGKDSYW

SEQ ID NO: 891511 - protein, 9 aa, Homo Sapiens
GTFHISPEG

SEQ ID NO: 891512 - protein, 9 aa, Homo Sapiens
PVDQVNCKD

SEQ ID NO: 891513 - protein, 9 aa, Homo Sapiens
SYLSGSLPG

SEQ ID NO: 891514 - protein, 9 aa, Homo Sapiens
PKEEKVATH

SEQ ID NO: 891515 - protein, 9 aa, Homo Sapiens
QWCCLRCLC

SEQ ID NO: 891516 - protein, 9 aa, Homo Sapiens
YKNRKSKEP

SEQ ID NO: 891517 - protein, 9 aa, Homo Sapiens
EHFRALSTG

SEQ ID NO: 891518 - protein, 9 aa, Homo Sapiens
GYWSSLDAS

SEQ ID NO: 891519 - protein, 9 aa, Homo Sapiens
NSPSQGAVS

SEQ ID NO: 891520 - protein, 9 aa, Homo Sapiens
LFDSSLGAK

SEQ ID NO: 891521 - protein, 9 aa, Homo Sapiens
LLHLLLFLH

SEQ ID NO: 891522 - protein, 9 aa, Homo Sapiens
CLSSSHPQS

SEQ ID NO: 891523 - protein, 9 aa, Homo Sapiens
GAINSCQSE

SEQ ID NO: 891524 - protein, 9 aa, Homo Sapiens
EFLKGFWVI

SEQ ID NO: 891525 - protein, 9 aa, Homo Sapiens
FISLPLICL

SEQ ID NO: 891526 - protein, 9 aa, Homo Sapiens
ITITVVYAQ

SEQ ID NO: 891527 - protein, 9 aa, Homo Sapiens
SQKRYHKDI

SEQ ID NO: 891528 - protein, 9 aa, Homo Sapiens
NKFLVKQNP

SEQ ID NO: 891529 - protein, 9 aa, Homo Sapiens
VKEEWQDKD

SEQ ID NO: 891530 - protein, 9 aa, Homo Sapiens
QDISLQGNY

SEQ ID NO: 891531 - protein, 9 aa, Homo Sapiens
PPRSGKTPS

SEQ ID NO: 891532 - protein, 9 aa, Homo Sapiens
VLACMVDIL

SEQ ID NO: 891533 - protein, 9 aa, Homo Sapiens
EDQKVWPNE

SEQ ID NO: 891534 - protein, 9 aa, Homo Sapiens
RKSDQMEST

SEQ ID NO: 891535 - protein, 9 aa, Homo Sapiens
NLTLNKTSY

SEQ ID NO: 891536 - protein, 9 aa, Homo Sapiens
VVKLMFKII

SEQ ID NO: 891537 - protein, 9 aa, Homo Sapiens
SIQRHMVMH

SEQ ID NO: 891538 - protein, 9 aa, Homo Sapiens
GNCYFTSKC

SEQ ID NO: 891539 - protein, 9 aa, Homo Sapiens
LCAALVLVV

SEQ ID NO: 891540 - protein, 9 aa, Homo Sapiens
CMLAEDMTL

SEQ ID NO: 891541 - protein, 9 aa, Homo Sapiens
CQEVKTLNV

SEQ ID NO: 891542 - protein, 9 aa, Homo Sapiens
ALCSLPQAW

SEQ ID NO: 891543 - protein, 9 aa, Homo Sapiens
EDQKQEVWE

SEQ ID NO: 891544 - protein, 9 aa, Homo Sapiens
VWGKVFPPA

SEQ ID NO: 891545 - protein, 9 aa, Homo Sapiens
QIEDRDTMN

SEQ ID NO: 891546 - protein, 9 aa, Homo Sapiens
VDNRFGAYV

SEQ ID NO: 891547 - protein, 9 aa, Homo Sapiens
IEASLYGLD

SEQ ID NO: 891548 - protein, 9 aa, Homo Sapiens
DNHIDEPIL

SEQ ID NO: 891549 - protein, 9 aa, Homo Sapiens
KCAQCCECK

SEQ ID NO: 891550 - protein, 9 aa, Homo Sapiens
HDQSPRRIP

SEQ ID NO: 891551 - protein, 9 aa, Homo Sapiens
DCEPVFSEE

SEQ ID NO: 891552 - protein, 9 aa, Homo Sapiens
GKQNIYFAD

SEQ ID NO: 891553 - protein, 9 aa, Homo Sapiens
FPRCPPPRG

SEQ ID NO: 891554 - protein, 9 aa, Homo Sapiens
ESHKQAQDN

SEQ ID NO: 891555 - protein, 9 aa, Homo Sapiens
GIEEANKLT

SEQ ID NO: 891556 - protein, 9 aa, Homo Sapiens
LRLEKMCLK

SEQ ID NO: 891557 - protein, 9 aa, Homo Sapiens
DNFLHSLRQ

SEQ ID NO: 891558 - protein, 9 aa, Homo Sapiens
NNKFLVKQN

SEQ ID NO: 891559 - protein, 9 aa, Homo Sapiens
CTTRLCQDE

SEQ ID NO: 891560 - protein, 9 aa, Homo Sapiens
GKFLFVEPL

SEQ ID NO: 891561 - protein, 9 aa, Homo Sapiens
HKWMPDQIS

SEQ ID NO: 891562 - protein, 9 aa, Homo Sapiens
ASVPAISDL

SEQ ID NO: 891563 - protein, 9 aa, Homo Sapiens
QAENETGNM

SEQ ID NO: 891564 - protein, 9 aa, Homo Sapiens
QEVWEAFDL

SEQ ID NO: 891565 - protein, 9 aa, Homo Sapiens
GWKWEDDAW

SEQ ID NO: 891566 - protein, 9 aa, Homo Sapiens
VFDTALLEQ

SEQ ID NO: 891567 - protein, 9 aa, Homo Sapiens
CNSLKYTFF

SEQ ID NO: 891568 - protein, 9 aa, Homo Sapiens
KFLEINENC

SEQ ID NO: 891569 - protein, 9 aa, Homo Sapiens
KHKMNVPEM

SEQ ID NO: 891570 - protein, 9 aa, Homo Sapiens
RPLHCVPPL

SEQ ID NO: 891571 - protein, 9 aa, Homo Sapiens
KKWNKALQV

SEQ ID NO: 891572 - protein, 9 aa, Homo Sapiens
RMGFTSRKS

SEQ ID NO: 891573 - protein, 9 aa, Homo Sapiens
VGMWPDPQK

SEQ ID NO: 891574 - protein, 9 aa, Homo Sapiens
AILALMPLF

SEQ ID NO: 891575 - protein, 9 aa, Homo Sapiens
DCPFFLYYA

SEQ ID NO: 891576 - protein, 9 aa, Homo Sapiens
AVVLSFFRI

SEQ ID NO: 891577 - protein, 9 aa, Homo Sapiens
ELRFLDIPG

SEQ ID NO: 891578 - protein, 9 aa, Homo Sapiens
WIFTVNHKL

SEQ ID NO: 891579 - protein, 9 aa, Homo Sapiens
QEQQNVLKV

SEQ ID NO: 891580 - protein, 9 aa, Homo Sapiens
DVQGKKNYF

SEQ ID NO: 891581 - protein, 9 aa, Homo Sapiens
KFYHLLNYS

SEQ ID NO: 891582 - protein, 9 aa, Homo Sapiens
NAHRGFFFS

SEQ ID NO: 891583 - protein, 9 aa, Homo Sapiens
QEDAYKCTF

SEQ ID NO: 891584 - protein, 9 aa, Homo Sapiens
TSRKKQELA

SEQ ID NO: 891585 - protein, 9 aa, Homo Sapiens
DAKVKEEPP

SEQ ID NO: 891586 - protein, 9 aa, Homo Sapiens
GEPDQTSLL

SEQ ID NO: 891587 - protein, 9 aa, Homo Sapiens
DTLDPKPFV

SEQ ID NO: 891588 - protein, 9 aa, Homo Sapiens
RTVPPGECL

SEQ ID NO: 891589 - protein, 9 aa, Homo Sapiens
RFLDKKHQN

SEQ ID NO: 891590 - protein, 9 aa, Homo Sapiens
QQTYLSCQA

SEQ ID NO: 891591 - protein, 9 aa, Homo Sapiens
FSGKLCEQE

SEQ ID NO: 891592 - protein, 9 aa, Homo Sapiens
NNPIKSIPS

SEQ ID NO: 891593 - protein, 9 aa, Homo Sapiens
DNEEFGVKL

SEQ ID NO: 891594 - protein, 9 aa, Homo Sapiens
HVRFRLGVV

SEQ ID NO: 891595 - protein, 9 aa, Homo Sapiens
ESLPYFKVI

SEQ ID NO: 891596 - protein, 9 aa, Homo Sapiens
PMKVFDSRF

SEQ ID NO: 891597 - protein, 9 aa, Homo Sapiens
VDSKNFNDY

SEQ ID NO: 891598 - protein, 9 aa, Homo Sapiens
LKSWAQGNL

SEQ ID NO: 891599 - protein, 9 aa, Homo Sapiens
GSDQYRNAY

SEQ ID NO: 891600 - protein, 9 aa, Homo Sapiens
AVMVFQTKQ

SEQ ID NO: 891601 - protein, 9 aa, Homo Sapiens
LPVITGNCD

SEQ ID NO: 891602 - protein, 9 aa, Homo Sapiens
RNAYQTEFQ

SEQ ID NO: 891603 - protein, 9 aa, Homo Sapiens
QPWNVTGNS

SEQ ID NO: 891604 - protein, 9 aa, Homo Sapiens
PGGKSRRCR

SEQ ID NO: 891605 - protein, 9 aa, Homo Sapiens
LNKKARALK

SEQ ID NO: 891606 - protein, 9 aa, Homo Sapiens
RHQEYYRGQ

SEQ ID NO: 891607 - protein, 9 aa, Homo Sapiens
YFSLAPFNQ

SEQ ID NO: 891608 - protein, 9 aa, Homo Sapiens
IRAFLTACC

SEQ ID NO: 891609 - protein, 9 aa, Homo Sapiens
STQFFKVAR

SEQ ID NO: 891610 - protein, 9 aa, Homo Sapiens
IYDEKVFWW

SEQ ID NO: 891611 - protein, 9 aa, Homo Sapiens
HEQNDSISS

SEQ ID NO: 891612 - protein, 9 aa, Homo Sapiens
NFLPEEMES

SEQ ID NO: 891613 - protein, 9 aa, Homo Sapiens
LLVAIFLMF

SEQ ID NO: 891614 - protein, 9 aa, Homo Sapiens
PHMVKEDID

SEQ ID NO: 891615 - protein, 9 aa, Homo Sapiens
RITLFREAE

SEQ ID NO: 891616 - protein, 9 aa, Homo Sapiens
YVIFGLCHQ

SEQ ID NO: 891617 - protein, 9 aa, Homo Sapiens
CLIQFLSEP

SEQ ID NO: 891618 - protein, 9 aa, Homo Sapiens
RKIAPEILQ

SEQ ID NO: 891619 - protein, 9 aa, Homo Sapiens
LPLSRIKLT

SEQ ID NO: 891620 - protein, 9 aa, Homo Sapiens
QKLQQLFKG

SEQ ID NO: 891621 - protein, 9 aa, Homo Sapiens
LTHRVANVF

SEQ ID NO: 891622 - protein, 9 aa, Homo Sapiens
ADAMDNDTA

SEQ ID NO: 891623 - protein, 9 aa, Homo Sapiens
ANQNSNTTS

SEQ ID NO: 891624 - protein, 9 aa, Homo Sapiens
CDVSSDVFY

SEQ ID NO: 891625 - protein, 9 aa, Homo Sapiens
GPPELLCIH

SEQ ID NO: 891626 - protein, 9 aa, Homo Sapiens
ILRYFFELR

SEQ ID NO: 891627 - protein, 9 aa, Homo Sapiens
RTLPAWICE

SEQ ID NO: 891628 - protein, 9 aa, Homo Sapiens
KGKMPINLV

SEQ ID NO: 891629 - protein, 9 aa, Homo Sapiens
VEKLIKCDK

SEQ ID NO: 891630 - protein, 9 aa, Homo Sapiens
VLPNPDSDN

SEQ ID NO: 891631 - protein, 9 aa, Homo Sapiens
RYLEEQKTD

SEQ ID NO: 891632 - protein, 9 aa, Homo Sapiens
DQLQLEGLL

SEQ ID NO: 891633 - protein, 9 aa, Homo Sapiens
NTRFSRPSP

SEQ ID NO: 891634 - protein, 9 aa, Homo Sapiens
GKRRKKNKN

SEQ ID NO: 891635 - protein, 9 aa, Homo Sapiens
PAPMAQFLA

SEQ ID NO: 891636 - protein, 9 aa, Homo Sapiens
LLLRRQRHI

SEQ ID NO: 891637 - protein, 9 aa, Homo Sapiens
VDITKILAE

SEQ ID NO: 891638 - protein, 9 aa, Homo Sapiens
VAELLMVFN

SEQ ID NO: 891639 - protein, 9 aa, Homo Sapiens
PSSIRKPPS

SEQ ID NO: 891640 - protein, 9 aa, Homo Sapiens
ASVHEEMIA

SEQ ID NO: 891641 - protein, 9 aa, Homo Sapiens
VNVPIKANY

SEQ ID NO: 891642 - protein, 9 aa, Homo Sapiens
CEIKESHHC

SEQ ID NO: 891643 - protein, 9 aa, Homo Sapiens
PIAVTHFIH

SEQ ID NO: 891644 - protein, 9 aa, Homo Sapiens
EPFKINVPK

SEQ ID NO: 891645 - protein, 9 aa, Homo Sapiens
ILCYRKQEW

SEQ ID NO: 891646 - protein, 9 aa, Homo Sapiens
ARFGVTTHK

SEQ ID NO: 891647 - protein, 9 aa, Homo Sapiens
SWHFDKVRN

SEQ ID NO: 891648 - protein, 9 aa, Homo Sapiens
QRHEMTHTG

SEQ ID NO: 891649 - protein, 9 aa, Homo Sapiens
TPQTPRLQD

SEQ ID NO: 891650 - protein, 9 aa, Homo Sapiens
CFNQLCLSP

SEQ ID NO: 891651 - protein, 9 aa, Homo Sapiens
EVYLDGGVQ

SEQ ID NO: 891652 - protein, 9 aa, Homo Sapiens
DKFANQILS

SEQ ID NO: 891653 - protein, 9 aa, Homo Sapiens
TKKTFIGLE

SEQ ID NO: 891654 - protein, 9 aa, Homo Sapiens
NITIMILIC

SEQ ID NO: 891655 - protein, 9 aa, Homo Sapiens
DIRQNESHL

SEQ ID NO: 891656 - protein, 9 aa, Homo Sapiens
RGRRQTPRI

SEQ ID NO: 891657 - protein, 9 aa, Homo Sapiens
HISQSEDEE

SEQ ID NO: 891658 - protein, 9 aa, Homo Sapiens
RVEEEEEHC

SEQ ID NO: 891659 - protein, 9 aa, Homo Sapiens
YVKLQTNLQ

SEQ ID NO: 891660 - protein, 9 aa, Homo Sapiens
VPYTSAFLP

SEQ ID NO: 891661 - protein, 9 aa, Homo Sapiens
TRTKGYSTS

SEQ ID NO: 891662 - protein, 9 aa, Homo Sapiens
LQCSQCYHP

SEQ ID NO: 891663 - protein, 9 aa, Homo Sapiens
LMASLAAYD

SEQ ID NO: 891664 - protein, 9 aa, Homo Sapiens
GEVLCHPST

SEQ ID NO: 891665 - protein, 9 aa, Homo Sapiens
SLMALAVSF

SEQ ID NO: 891666 - protein, 9 aa, Homo Sapiens
STSCICQSS

SEQ ID NO: 891667 - protein, 9 aa, Homo Sapiens
LTVQQVEEA

SEQ ID NO: 891668 - protein, 9 aa, Homo Sapiens
SSSTDQKYS

SEQ ID NO: 891669 - protein, 9 aa, Homo Sapiens
RLSSSSGVW

SEQ ID NO: 891670 - protein, 9 aa, Homo Sapiens
VKEEQIDTP

SEQ ID NO: 891671 - protein, 9 aa, Homo Sapiens
CEPQDGVIQ

SEQ ID NO: 891672 - protein, 9 aa, Homo Sapiens
YPAKAYANY

SEQ ID NO: 891673 - protein, 9 aa, Homo Sapiens
SFIAEHKLL

SEQ ID NO: 891674 - protein, 9 aa, Homo Sapiens
VWGTEHTQA

SEQ ID NO: 891675 - protein, 9 aa, Homo Sapiens
TEKTTKSKI

SEQ ID NO: 891676 - protein, 9 aa, Homo Sapiens
GTDESPLWN

SEQ ID NO: 891677 - protein, 9 aa, Homo Sapiens
VVQILYQRM

SEQ ID NO: 891678 - protein, 9 aa, Homo Sapiens
YILRAVRAS

SEQ ID NO: 891679 - protein, 9 aa, Homo Sapiens
HLYKGEFKQ

SEQ ID NO: 891680 - protein, 9 aa, Homo Sapiens
NKTFWDAFG

SEQ ID NO: 891681 - protein, 9 aa, Homo Sapiens
GSHLEGWNM

SEQ ID NO: 891682 - protein, 9 aa, Homo Sapiens
QHKHRPAPR

SEQ ID NO: 891683 - protein, 9 aa, Homo Sapiens
VKASTEATK

SEQ ID NO: 891684 - protein, 9 aa, Homo Sapiens
EKGTGATVL

SEQ ID NO: 891685 - protein, 9 aa, Homo Sapiens
SDSDKLSQL

SEQ ID NO: 891686 - protein, 9 aa, Homo Sapiens
TQNQEYLKR

SEQ ID NO: 891687 - protein, 9 aa, Homo Sapiens
KNGRMGVLA

SEQ ID NO: 891688 - protein, 9 aa, Homo Sapiens
TGRLFFKFY

SEQ ID NO: 891689 - protein, 9 aa, Homo Sapiens
VVQDRNELK

SEQ ID NO: 891690 - protein, 9 aa, Homo Sapiens
KITDPKKEG

SEQ ID NO: 891691 - protein, 9 aa, Homo Sapiens
FQTHEMIHT

SEQ ID NO: 891692 - protein, 9 aa, Homo Sapiens
RRSLVLCTH

SEQ ID NO: 891693 - protein, 9 aa, Homo Sapiens
VKNNYRKNV

SEQ ID NO: 891694 - protein, 9 aa, Homo Sapiens
KPLEGRPEW

SEQ ID NO: 891695 - protein, 9 aa, Homo Sapiens
LMREKLCEI

SEQ ID NO: 891696 - protein, 9 aa, Homo Sapiens
GKAFFSPSL

SEQ ID NO: 891697 - protein, 9 aa, Homo Sapiens
MTNGLCIWL

SEQ ID NO: 891698 - protein, 9 aa, Homo Sapiens
NSRLALTQP

SEQ ID NO: 891699 - protein, 9 aa, Homo Sapiens
IKKWNKALQ

SEQ ID NO: 891700 - protein, 9 aa, Homo Sapiens
GTNVRFSAE

SEQ ID NO: 891701 - protein, 9 aa, Homo Sapiens
PEDKVLRNN

SEQ ID NO: 891702 - protein, 9 aa, Homo Sapiens
YKDHYAYRD

SEQ ID NO: 891703 - protein, 9 aa, Homo Sapiens
VAFNIMCST

SEQ ID NO: 891704 - protein, 9 aa, Homo Sapiens
RVCLSPRQI

SEQ ID NO: 891705 - protein, 9 aa, Homo Sapiens
QCQLNVLDN

SEQ ID NO: 891706 - protein, 9 aa, Homo Sapiens
NTLKSTASS

SEQ ID NO: 891707 - protein, 9 aa, Homo Sapiens
AEESVLINI

SEQ ID NO: 891708 - protein, 9 aa, Homo Sapiens
LRRPHQQEL

SEQ ID NO: 891709 - protein, 9 aa, Homo Sapiens
IKCVKDADY

SEQ ID NO: 891710 - protein, 9 aa, Homo Sapiens
SPTKMDLLY

SEQ ID NO: 891711 - protein, 9 aa, Homo Sapiens
FINLIAALP

SEQ ID NO: 891712 - protein, 9 aa, Homo Sapiens
NNVRKKDHE

SEQ ID NO: 891713 - protein, 9 aa, Homo Sapiens
VNMFQTLPP

SEQ ID NO: 891714 - protein, 9 aa, Homo Sapiens
AEWLEQRQA

SEQ ID NO: 891715 - protein, 9 aa, Homo Sapiens
KEFWQKVML

SEQ ID NO: 891716 - protein, 9 aa, Homo Sapiens
QARPEYEVR

SEQ ID NO: 891717 - protein, 9 aa, Homo Sapiens
HTLATDSNK

SEQ ID NO: 891718 - protein, 9 aa, Homo Sapiens
WLHSSNKSS

SEQ ID NO: 891719 - protein, 9 aa, Homo Sapiens
KECGKAFKL

SEQ ID NO: 891720 - protein, 9 aa, Homo Sapiens
VLPQRPASA

SEQ ID NO: 891721 - protein, 9 aa, Homo Sapiens
QRHRQKLDD

SEQ ID NO: 891722 - protein, 9 aa, Homo Sapiens
QIPAKPGKC

SEQ ID NO: 891723 - protein, 9 aa, Homo Sapiens
ISLVLRQSF

SEQ ID NO: 891724 - protein, 9 aa, Homo Sapiens
PENCNKAKT

SEQ ID NO: 891725 - protein, 9 aa, Homo Sapiens
LSRHVCSHG

SEQ ID NO: 891726 - protein, 9 aa, Homo Sapiens
HDYPVKAVA

SEQ ID NO: 891727 - protein, 9 aa, Homo Sapiens
AEAAGLHNV

SEQ ID NO: 891728 - protein, 9 aa, Homo Sapiens
VLDGIFCAI

SEQ ID NO: 891729 - protein, 9 aa, Homo Sapiens
DKGTTEGAV

SEQ ID NO: 891730 - protein, 9 aa, Homo Sapiens
LPSQPRYSW

SEQ ID NO: 891731 - protein, 9 aa, Homo Sapiens
GMYTPLTTR

SEQ ID NO: 891732 - protein, 9 aa, Homo Sapiens
IQTTIQNEL

SEQ ID NO: 891733 - protein, 9 aa, Homo Sapiens
TEHLRSFSM

SEQ ID NO: 891734 - protein, 9 aa, Homo Sapiens
TRNFHKYFL

SEQ ID NO: 891735 - protein, 9 aa, Homo Sapiens
PCVREGCAA

SEQ ID NO: 891736 - protein, 9 aa, Homo Sapiens
KEKDTMTTF

SEQ ID NO: 891737 - protein, 9 aa, Homo Sapiens
AATSYFSSP

SEQ ID NO: 891738 - protein, 9 aa, Homo Sapiens
SLLEVAGLS

SEQ ID NO: 891739 - protein, 9 aa, Homo Sapiens
GIALGGRLY

SEQ ID NO: 891740 - protein, 9 aa, Homo Sapiens
FSISCSLSQ

SEQ ID NO: 891741 - protein, 9 aa, Homo Sapiens
LFQIGASTL

SEQ ID NO: 891742 - protein, 9 aa, Homo Sapiens
DCIIFGTVI

SEQ ID NO: 891743 - protein, 9 aa, Homo Sapiens
GIVFWLHSS

SEQ ID NO: 891744 - protein, 9 aa, Homo Sapiens
QIITDPGDV

SEQ ID NO: 891745 - protein, 9 aa, Homo Sapiens
AWWRHVAVR

SEQ ID NO: 891746 - protein, 9 aa, Homo Sapiens
DPEAAEQIW

SEQ ID NO: 891747 - protein, 9 aa, Homo Sapiens
QKRFSSTDT

SEQ ID NO: 891748 - protein, 9 aa, Homo Sapiens
GAFMLKLIN

SEQ ID NO: 891749 - protein, 9 aa, Homo Sapiens
EIKSQHQLE

SEQ ID NO: 891750 - protein, 9 aa, Homo Sapiens
SPKNLAAPS

SEQ ID NO: 891751 - protein, 9 aa, Homo Sapiens
HELDLTYIT

SEQ ID NO: 891752 - protein, 9 aa, Homo Sapiens
SNSESRTEK

SEQ ID NO: 891753 - protein, 9 aa, Homo Sapiens
DIENVVRKQ

SEQ ID NO: 891754 - protein, 9 aa, Homo Sapiens
ATYRCLLEG

SEQ ID NO: 891755 - protein, 9 aa, Homo Sapiens
HDHTVSLLT

SEQ ID NO: 891756 - protein, 9 aa, Homo Sapiens
IQNFLALDP

SEQ ID NO: 891757 - protein, 9 aa, Homo Sapiens
RYVWNDLDK

SEQ ID NO: 891758 - protein, 9 aa, Homo Sapiens
KMSALSLSN

SEQ ID NO: 891759 - protein, 9 aa, Homo Sapiens
KEFIETELS

SEQ ID NO: 891760 - protein, 9 aa, Homo Sapiens
SLQAIPHIA

SEQ ID NO: 891761 - protein, 9 aa, Homo Sapiens
TESKEGTEV

SEQ ID NO: 891762 - protein, 9 aa, Homo Sapiens
CGFKNKLYV

SEQ ID NO: 891763 - protein, 9 aa, Homo Sapiens
YLAVQSLSQ

SEQ ID NO: 891764 - protein, 9 aa, Homo Sapiens
KMATNIYLL

SEQ ID NO: 891765 - protein, 9 aa, Homo Sapiens
NQHFCKNHP

SEQ ID NO: 891766 - protein, 9 aa, Homo Sapiens
QLCAQNSEL

SEQ ID NO: 891767 - protein, 9 aa, Homo Sapiens
KKTSSFNFC

SEQ ID NO: 891768 - protein, 9 aa, Homo Sapiens
QSPTEDKVL

SEQ ID NO: 891769 - protein, 9 aa, Homo Sapiens
STLRSRSGT

SEQ ID NO: 891770 - protein, 9 aa, Homo Sapiens
EEEEHCQHL

SEQ ID NO: 891771 - protein, 9 aa, Homo Sapiens
SKKRIQMDS

SEQ ID NO: 891772 - protein, 9 aa, Homo Sapiens
YEIIVEDID

SEQ ID NO: 891773 - protein, 9 aa, Homo Sapiens
VISTNGELN

SEQ ID NO: 891774 - protein, 9 aa, Homo Sapiens
GGFGSDYSQ

SEQ ID NO: 891775 - protein, 9 aa, Homo Sapiens
GGCCSPVPG

SEQ ID NO: 891776 - protein, 9 aa, Homo Sapiens
YFCIPLCTE

SEQ ID NO: 891777 - protein, 9 aa, Homo Sapiens
PIDGMKMET

SEQ ID NO: 891778 - protein, 9 aa, Homo Sapiens
KVQIKVLNI

SEQ ID NO: 891779 - protein, 9 aa, Homo Sapiens
DKDGKANPL

SEQ ID NO: 891780 - protein, 9 aa, Homo Sapiens
FLCLKNIRA

SEQ ID NO: 891781 - protein, 9 aa, Homo Sapiens
LKRLHINME

SEQ ID NO: 891782 - protein, 9 aa, Homo Sapiens
YLIEMMGPR

SEQ ID NO: 891783 - protein, 9 aa, Homo Sapiens
RQHPLFWEI

SEQ ID NO: 891784 - protein, 9 aa, Homo Sapiens
LEKLTNIRP

SEQ ID NO: 891785 - protein, 9 aa, Homo Sapiens
GEQLQMDGA

SEQ ID NO: 891786 - protein, 9 aa, Homo Sapiens
TMATTALAA

SEQ ID NO: 891787 - protein, 9 aa, Homo Sapiens
VWDQDREGA

SEQ ID NO: 891788 - protein, 9 aa, Homo Sapiens
QPLNIIEGP

SEQ ID NO: 891789 - protein, 9 aa, Homo Sapiens
MPNNKFLVK

SEQ ID NO: 891790 - protein, 9 aa, Homo Sapiens
VVQVFIVVE

SEQ ID NO: 891791 - protein, 9 aa, Homo Sapiens
PYPPGVGSR

SEQ ID NO: 891792 - protein, 9 aa, Homo Sapiens
DLKPANMLV

SEQ ID NO: 891793 - protein, 9 aa, Homo Sapiens
TPWKISLSS

SEQ ID NO: 891794 - protein, 9 aa, Homo Sapiens
KSFSYNSNL

SEQ ID NO: 891795 - protein, 9 aa, Homo Sapiens
FQNTTASVS

SEQ ID NO: 891796 - protein, 9 aa, Homo Sapiens
YKGAPWNCD

SEQ ID NO: 891797 - protein, 9 aa, Homo Sapiens
CMFMYARPA

SEQ ID NO: 891798 - protein, 9 aa, Homo Sapiens
LPKEICAQT

SEQ ID NO: 891799 - protein, 9 aa, Homo Sapiens
LITIRNTKA

SEQ ID NO: 891800 - protein, 9 aa, Homo Sapiens
NYSYASSYH

SEQ ID NO: 891801 - protein, 9 aa, Homo Sapiens
NTEERLKGV

SEQ ID NO: 891802 - protein, 9 aa, Homo Sapiens
ALKEVFNNL

SEQ ID NO: 891803 - protein, 9 aa, Homo Sapiens
TLYTQICNR

SEQ ID NO: 891804 - protein, 9 aa, Homo Sapiens
KNPPARHTL

SEQ ID NO: 891805 - protein, 9 aa, Homo Sapiens
YLVACQPPS

SEQ ID NO: 891806 - protein, 9 aa, Homo Sapiens
VVGMPNGIL

SEQ ID NO: 891807 - protein, 9 aa, Homo Sapiens
ESTWCVLQG

SEQ ID NO: 891808 - protein, 9 aa, Homo Sapiens
TSPTNFQQL

SEQ ID NO: 891809 - protein, 9 aa, Homo Sapiens
FGVACMDVM

SEQ ID NO: 891810 - protein, 9 aa, Homo Sapiens
VEIRQDGNQ

SEQ ID NO: 891811 - protein, 9 aa, Homo Sapiens
QEAVNKYFK

SEQ ID NO: 891812 - protein, 9 aa, Homo Sapiens
ITPRPQDHD

SEQ ID NO: 891813 - protein, 9 aa, Homo Sapiens
FQAGVSKLN

SEQ ID NO: 891814 - protein, 9 aa, Homo Sapiens
LCGFKNKLY

SEQ ID NO: 891815 - protein, 9 aa, Homo Sapiens
CPALKALFK

SEQ ID NO: 891816 - protein, 9 aa, Homo Sapiens
WYCLRLLKP

SEQ ID NO: 891817 - protein, 9 aa, Homo Sapiens
CSTIGPPAV

SEQ ID NO: 891818 - protein, 9 aa, Homo Sapiens
QKAVSDAEC

SEQ ID NO: 891819 - protein, 9 aa, Homo Sapiens
KIYQGNISK

SEQ ID NO: 891820 - protein, 9 aa, Homo Sapiens
QLISHKRSH

SEQ ID NO: 891821 - protein, 9 aa, Homo Sapiens
DHFSDIYAL

SEQ ID NO: 891822 - protein, 9 aa, Homo Sapiens
SLSENNSNN

SEQ ID NO: 891823 - protein, 9 aa, Homo Sapiens
GFNISYDPH

SEQ ID NO: 891824 - protein, 9 aa, Homo Sapiens
SKRPFQNKC

SEQ ID NO: 891825 - protein, 9 aa, Homo Sapiens
SRGMDLVDI

SEQ ID NO: 891826 - protein, 9 aa, Homo Sapiens
KGYWSSLDA

SEQ ID NO: 891827 - protein, 9 aa, Homo Sapiens
QDSPWSLHT

SEQ ID NO: 891828 - protein, 9 aa, Homo Sapiens
RGYGRDMGN

SEQ ID NO: 891829 - protein, 9 aa, Homo Sapiens
RNNFLNFLP

SEQ ID NO: 891830 - protein, 9 aa, Homo Sapiens
ENSDSEEIE

SEQ ID NO: 891831 - protein, 9 aa, Homo Sapiens
QLQERIWSY

SEQ ID NO: 891832 - protein, 9 aa, Homo Sapiens
TLPAQPAGL

SEQ ID NO: 891833 - protein, 9 aa, Homo Sapiens
QPFEINTIT

SEQ ID NO: 891834 - protein, 9 aa, Homo Sapiens
NQTPGFSLQ

SEQ ID NO: 891835 - protein, 9 aa, Homo Sapiens
KSVDDVKNL

SEQ ID NO: 891836 - protein, 9 aa, Homo Sapiens
RLVDHINQT

SEQ ID NO: 891837 - protein, 9 aa, Homo Sapiens
AEPDSWGSD

SEQ ID NO: 891838 - protein, 9 aa, Homo Sapiens
SKNFNDYMK

SEQ ID NO: 891839 - protein, 9 aa, Homo Sapiens
KAVVICHLY

SEQ ID NO: 891840 - protein, 9 aa, Homo Sapiens
GKTPIKTLI

SEQ ID NO: 891841 - protein, 9 aa, Homo Sapiens
YAEKQIQSV

SEQ ID NO: 891842 - protein, 9 aa, Homo Sapiens
IFVGVGFLM

SEQ ID NO: 891843 - protein, 9 aa, Homo Sapiens
AGNKYFIDF

SEQ ID NO: 891844 - protein, 9 aa, Homo Sapiens
HQINIYEII

SEQ ID NO: 891845 - protein, 9 aa, Homo Sapiens
ETEANSINT

SEQ ID NO: 891846 - protein, 9 aa, Homo Sapiens
EDKGRVARG

SEQ ID NO: 891847 - protein, 9 aa, Homo Sapiens
AQPEGQKAM

SEQ ID NO: 891848 - protein, 9 aa, Homo Sapiens
SESGQLLDQ

SEQ ID NO: 891849 - protein, 9 aa, Homo Sapiens
VWVAFNIMC

SEQ ID NO: 891850 - protein, 9 aa, Homo Sapiens
LQYYCCMAS

SEQ ID NO: 891851 - protein, 9 aa, Homo Sapiens
GNANISLSS

SEQ ID NO: 891852 - protein, 9 aa, Homo Sapiens
TLVLLELFY

SEQ ID NO: 891853 - protein, 9 aa, Homo Sapiens
ELLDLAFTH

SEQ ID NO: 891854 - protein, 9 aa, Homo Sapiens
HNVGMACSI

SEQ ID NO: 891855 - protein, 9 aa, Homo Sapiens
LRSNRFCRD

SEQ ID NO: 891856 - protein, 9 aa, Homo Sapiens
LENIKLNKK

SEQ ID NO: 891857 - protein, 9 aa, Homo Sapiens
VEPSCKGMQ

SEQ ID NO: 891858 - protein, 9 aa, Homo Sapiens
GGQVSLKAS

SEQ ID NO: 891859 - protein, 9 aa, Homo Sapiens
DMKRGLHKL

SEQ ID NO: 891860 - protein, 9 aa, Homo Sapiens
NIKLNKKSM

SEQ ID NO: 891861 - protein, 9 aa, Homo Sapiens
VEKKDDFNW

SEQ ID NO: 891862 - protein, 9 aa, Homo Sapiens
YIIPIDDKL

SEQ ID NO: 891863 - protein, 9 aa, Homo Sapiens
WFLNPLKLA

SEQ ID NO: 891864 - protein, 9 aa, Homo Sapiens
HLWTSYSEL

SEQ ID NO: 891865 - protein, 9 aa, Homo Sapiens
PRSKRCCVL

SEQ ID NO: 891866 - protein, 9 aa, Homo Sapiens
KHYYGEGCS

SEQ ID NO: 891867 - protein, 9 aa, Homo Sapiens
KKCQEAPPH

SEQ ID NO: 891868 - protein, 9 aa, Homo Sapiens
SPINGLQDK

SEQ ID NO: 891869 - protein, 9 aa, Homo Sapiens
SGALEKDNQ

SEQ ID NO: 891870 - protein, 9 aa, Homo Sapiens
PDPAFGVAC

SEQ ID NO: 891871 - protein, 9 aa, Homo Sapiens
NVVYKLFSL

SEQ ID NO: 891872 - protein, 9 aa, Homo Sapiens
DGCWIYLCG

SEQ ID NO: 891873 - protein, 9 aa, Homo Sapiens
SSQENDNST

SEQ ID NO: 891874 - protein, 9 aa, Homo Sapiens
SVKRTHYYE

SEQ ID NO: 891875 - protein, 9 aa, Homo Sapiens
AVKLLQKAA

SEQ ID NO: 891876 - protein, 9 aa, Homo Sapiens
MDCSAPQLA

SEQ ID NO: 891877 - protein, 9 aa, Homo Sapiens
GVNLLQQYY

SEQ ID NO: 891878 - protein, 9 aa, Homo Sapiens
TTADDKTAQ

SEQ ID NO: 891879 - protein, 9 aa, Homo Sapiens
HRYTVWAKR

SEQ ID NO: 891880 - protein, 9 aa, Homo Sapiens
PFYILHSKF

SEQ ID NO: 891881 - protein, 9 aa, Homo Sapiens
AVLAGYLIL

SEQ ID NO: 891882 - protein, 9 aa, Homo Sapiens
VTILYINCK

SEQ ID NO: 891883 - protein, 9 aa, Homo Sapiens
TAVSLLNLF

SEQ ID NO: 891884 - protein, 9 aa, Homo Sapiens
EKIQKELKI

SEQ ID NO: 891885 - protein, 9 aa, Homo Sapiens
NYGGGKGSG

SEQ ID NO: 891886 - protein, 9 aa, Homo Sapiens
RVLKPEWFW

SEQ ID NO: 891887 - protein, 9 aa, Homo Sapiens
AVFPGTLTP

SEQ ID NO: 891888 - protein, 9 aa, Homo Sapiens
IKNGEQQDE

SEQ ID NO: 891889 - protein, 9 aa, Homo Sapiens
AAVGTKSKP

SEQ ID NO: 891890 - protein, 9 aa, Homo Sapiens
QTQIISKKI

SEQ ID NO: 891891 - protein, 9 aa, Homo Sapiens
WKAIIDFQN

SEQ ID NO: 891892 - protein, 9 aa, Homo Sapiens
VFDLRQCHQ

SEQ ID NO: 891893 - protein, 9 aa, Homo Sapiens
IQEEIINAA

SEQ ID NO: 891894 - protein, 9 aa, Homo Sapiens
LDNKVKDGL

SEQ ID NO: 891895 - protein, 9 aa, Homo Sapiens
TLFPGIPDT

SEQ ID NO: 891896 - protein, 9 aa, Homo Sapiens
DVLFSFCDG

SEQ ID NO: 891897 - protein, 9 aa, Homo Sapiens
SCEPKDLVV

SEQ ID NO: 891898 - protein, 9 aa, Homo Sapiens
HALPVSGRL

SEQ ID NO: 891899 - protein, 9 aa, Homo Sapiens
HSKFIWQLW

SEQ ID NO: 891900 - protein, 9 aa, Homo Sapiens
HQQMQQQAA

SEQ ID NO: 891901 - protein, 9 aa, Homo Sapiens
EAKHKQAEI

SEQ ID NO: 891902 - protein, 9 aa, Homo Sapiens
LRNQVVIST

SEQ ID NO: 891903 - protein, 9 aa, Homo Sapiens
LGHKLPVLA

SEQ ID NO: 891904 - protein, 9 aa, Homo Sapiens
LLKQEERIQ

SEQ ID NO: 891905 - protein, 9 aa, Homo Sapiens
SYLHNCETC

SEQ ID NO: 891906 - protein, 9 aa, Homo Sapiens
SRKKFPPHG

SEQ ID NO: 891907 - protein, 9 aa, Homo Sapiens
SYQEPSNSH

SEQ ID NO: 891908 - protein, 9 aa, Homo Sapiens
HKHLRKDLP

SEQ ID NO: 891909 - protein, 9 aa, Homo Sapiens
AKCKLVNHI

SEQ ID NO: 891910 - protein, 9 aa, Homo Sapiens
SRYQSDPNL

SEQ ID NO: 891911 - protein, 9 aa, Homo Sapiens
YGADIKSKN

SEQ ID NO: 891912 - protein, 9 aa, Homo Sapiens
VKYTEEYEK

SEQ ID NO: 891913 - protein, 9 aa, Homo Sapiens
ECSQLWDTF

SEQ ID NO: 891914 - protein, 9 aa, Homo Sapiens
ITKRTFSPG

SEQ ID NO: 891915 - protein, 9 aa, Homo Sapiens
LHLAVEAQE

SEQ ID NO: 891916 - protein, 9 aa, Homo Sapiens
DLHHWINLT

SEQ ID NO: 891917 - protein, 9 aa, Homo Sapiens
VEKFLFNTK

SEQ ID NO: 891918 - protein, 9 aa, Homo Sapiens
PEKEISGCC

SEQ ID NO: 891919 - protein, 9 aa, Homo Sapiens
LHTRQMKIT

SEQ ID NO: 891920 - protein, 9 aa, Homo Sapiens
YVLRNEVIH

SEQ ID NO: 891921 - protein, 9 aa, Homo Sapiens
LFISQSFHS

SEQ ID NO: 891922 - protein, 9 aa, Homo Sapiens
FKPWLDIQH

SEQ ID NO: 891923 - protein, 9 aa, Homo Sapiens
KVICLVRQR

SEQ ID NO: 891924 - protein, 9 aa, Homo Sapiens
NYFSLSSFL

SEQ ID NO: 891925 - protein, 9 aa, Homo Sapiens
QLDANLNML

SEQ ID NO: 891926 - protein, 9 aa, Homo Sapiens
NMQYVFIYQ

SEQ ID NO: 891927 - protein, 9 aa, Homo Sapiens
CLQDQQSNH

SEQ ID NO: 891928 - protein, 9 aa, Homo Sapiens
SEYTDGSTG

SEQ ID NO: 891929 - protein, 9 aa, Homo Sapiens
SVGRPNKEE

SEQ ID NO: 891930 - protein, 9 aa, Homo Sapiens
NKCGKVFSY

SEQ ID NO: 891931 - protein, 9 aa, Homo Sapiens
INFNGEEKA

SEQ ID NO: 891932 - protein, 9 aa, Homo Sapiens
YGQCWVFAY

SEQ ID NO: 891933 - protein, 9 aa, Homo Sapiens
LSQRQLCPL

SEQ ID NO: 891934 - protein, 9 aa, Homo Sapiens
ELAAEKKCI

SEQ ID NO: 891935 - protein, 9 aa, Homo Sapiens
IDGSGLQMG

SEQ ID NO: 891936 - protein, 9 aa, Homo Sapiens
EDRLALYPG

SEQ ID NO: 891937 - protein, 9 aa, Homo Sapiens
GLHTGDKPY

SEQ ID NO: 891938 - protein, 9 aa, Homo Sapiens
AKDFSAIYL

SEQ ID NO: 891939 - protein, 9 aa, Homo Sapiens
ERMCDIERH

SEQ ID NO: 891940 - protein, 9 aa, Homo Sapiens
ETQESEHKP

SEQ ID NO: 891941 - protein, 9 aa, Homo Sapiens
ICYQRKHDY

SEQ ID NO: 891942 - protein, 9 aa, Homo Sapiens
DPESENKRK

SEQ ID NO: 891943 - protein, 9 aa, Homo Sapiens
TIFTTLNEP

SEQ ID NO: 891944 - protein, 9 aa, Homo Sapiens
VLTKATDVY

SEQ ID NO: 891945 - protein, 9 aa, Homo Sapiens
HLPGLLLGY

SEQ ID NO: 891946 - protein, 9 aa, Homo Sapiens
SDNNLGSLQ

SEQ ID NO: 891947 - protein, 9 aa, Homo Sapiens
EEVVKVTTE

SEQ ID NO: 891948 - protein, 9 aa, Homo Sapiens
MSINNADTG

SEQ ID NO: 891949 - protein, 9 aa, Homo Sapiens
QTFMKLGPE

SEQ ID NO: 891950 - protein, 9 aa, Homo Sapiens
KLSLICHQI

SEQ ID NO: 891951 - protein, 9 aa, Homo Sapiens
KSCWPFSDE

SEQ ID NO: 891952 - protein, 9 aa, Homo Sapiens
SYSFLFGFH

SEQ ID NO: 891953 - protein, 9 aa, Homo Sapiens
FSSLICTTA

SEQ ID NO: 891954 - protein, 9 aa, Homo Sapiens
RTLPVGRLC

SEQ ID NO: 891955 - protein, 9 aa, Homo Sapiens
HDDQCEKQK

SEQ ID NO: 891956 - protein, 9 aa, Homo Sapiens
FANVFSEYL

SEQ ID NO: 891957 - protein, 9 aa, Homo Sapiens
NNQNKSVVR

SEQ ID NO: 891958 - protein, 9 aa, Homo Sapiens
LTTAKTSVK

SEQ ID NO: 891959 - protein, 9 aa, Homo Sapiens
VICLVRQRT

SEQ ID NO: 891960 - protein, 9 aa, Homo Sapiens
KLPQLQHLK

SEQ ID NO: 891961 - protein, 9 aa, Homo Sapiens
EVADVNNNA

SEQ ID NO: 891962 - protein, 9 aa, Homo Sapiens
PEICCTVSG

SEQ ID NO: 891963 - protein, 9 aa, Homo Sapiens
VHKHLCIQN

SEQ ID NO: 891964 - protein, 9 aa, Homo Sapiens
CSRQSIWDV

SEQ ID NO: 891965 - protein, 9 aa, Homo Sapiens
GNWFKNRQQ

SEQ ID NO: 891966 - protein, 9 aa, Homo Sapiens
LNYHDAVTK

SEQ ID NO: 891967 - protein, 9 aa, Homo Sapiens
LKLASVLES

SEQ ID NO: 891968 - protein, 9 aa, Homo Sapiens
ASSPAIDTP

SEQ ID NO: 891969 - protein, 9 aa, Homo Sapiens
VETVTYENL

SEQ ID NO: 891970 - protein, 9 aa, Homo Sapiens
VLRAGAGAP

SEQ ID NO: 891971 - protein, 9 aa, Homo Sapiens
AGELKLWDL

SEQ ID NO: 891972 - protein, 9 aa, Homo Sapiens
ADGEPDQTS

SEQ ID NO: 891973 - protein, 9 aa, Homo Sapiens
DLGLLNSLG

SEQ ID NO: 891974 - protein, 9 aa, Homo Sapiens
QRYTNAIQW

SEQ ID NO: 891975 - protein, 9 aa, Homo Sapiens
ELKHLTETL

SEQ ID NO: 891976 - protein, 9 aa, Homo Sapiens
PDVGENFLH

SEQ ID NO: 891977 - protein, 9 aa, Homo Sapiens
ALKLASVLE

SEQ ID NO: 891978 - protein, 9 aa, Homo Sapiens
NLFFTVLQD

SEQ ID NO: 891979 - protein, 9 aa, Homo Sapiens
QWIMLLERT

SEQ ID NO: 891980 - protein, 9 aa, Homo Sapiens
KEAENQHNN

SEQ ID NO: 891981 - protein, 9 aa, Homo Sapiens
PRVNKSWRK

SEQ ID NO: 891982 - protein, 9 aa, Homo Sapiens
VAQISAGTY

SEQ ID NO: 891983 - protein, 9 aa, Homo Sapiens
PPGFLRRDT

SEQ ID NO: 891984 - protein, 9 aa, Homo Sapiens
EFFLMIFKL

SEQ ID NO: 891985 - protein, 9 aa, Homo Sapiens
ESPLWNGNS

SEQ ID NO: 891986 - protein, 9 aa, Homo Sapiens
TSDLLRKMC

SEQ ID NO: 891987 - protein, 9 aa, Homo Sapiens
IANDVDNKH

SEQ ID NO: 891988 - protein, 9 aa, Homo Sapiens
SGTTAKTTS

SEQ ID NO: 891989 - protein, 9 aa, Homo Sapiens
MWGPWGDCL

SEQ ID NO: 891990 - protein, 9 aa, Homo Sapiens
SQIQNSIVN

SEQ ID NO: 891991 - protein, 9 aa, Homo Sapiens
SYLEIYQED

SEQ ID NO: 891992 - protein, 9 aa, Homo Sapiens
DSPWSLHTP

SEQ ID NO: 891993 - protein, 9 aa, Homo Sapiens
KVFICSSSF

SEQ ID NO: 891994 - protein, 9 aa, Homo Sapiens
ELHRNVHPQ

SEQ ID NO: 891995 - protein, 9 aa, Homo Sapiens
CETRVNLCD

SEQ ID NO: 891996 - protein, 9 aa, Homo Sapiens
IQILETISQ

SEQ ID NO: 891997 - protein, 9 aa, Homo Sapiens
LPSTSTLAN

SEQ ID NO: 891998 - protein, 9 aa, Homo Sapiens
LGRAVFPGA

SEQ ID NO: 891999 - protein, 9 aa, Homo Sapiens
CRCEECDKA

SEQ ID NO: 892000 - protein, 9 aa, Homo Sapiens
IKDVKYLKK

SEQ ID NO: 892001 - protein, 9 aa, Homo Sapiens
MCNTSQDRE

SEQ ID NO: 892002 - protein, 9 aa, Homo Sapiens
ALLAAIWFQ

SEQ ID NO: 892003 - protein, 9 aa, Homo Sapiens
QAVSLDSPV

SEQ ID NO: 892004 - protein, 9 aa, Homo Sapiens
WVIHKLNVE

SEQ ID NO: 892005 - protein, 9 aa, Homo Sapiens
SFKDIKSLL

SEQ ID NO: 892006 - protein, 9 aa, Homo Sapiens
VIVLGSLLF

SEQ ID NO: 892007 - protein, 9 aa, Homo Sapiens
LILHQIIHS

SEQ ID NO: 892008 - protein, 9 aa, Homo Sapiens
YDGSITIPP

SEQ ID NO: 892009 - protein, 9 aa, Homo Sapiens
ARIWQFKQR

SEQ ID NO: 892010 - protein, 9 aa, Homo Sapiens
LLPTQPPVM

SEQ ID NO: 892011 - protein, 9 aa, Homo Sapiens
KAIKTNDPG

SEQ ID NO: 892012 - protein, 9 aa, Homo Sapiens
CTQLYQKPL

SEQ ID NO: 892013 - protein, 9 aa, Homo Sapiens
ATGQEVKLC

SEQ ID NO: 892014 - protein, 9 aa, Homo Sapiens
LAIAITKEK

SEQ ID NO: 892015 - protein, 9 aa, Homo Sapiens
ESFKFVRPF

SEQ ID NO: 892016 - protein, 9 aa, Homo Sapiens
SKFQEGVEM

SEQ ID NO: 892017 - protein, 9 aa, Homo Sapiens
KMLADVLSE

SEQ ID NO: 892018 - protein, 9 aa, Homo Sapiens
NQDCHFNLG

SEQ ID NO: 892019 - protein, 9 aa, Homo Sapiens
CTKTENSRL

SEQ ID NO: 892020 - protein, 9 aa, Homo Sapiens
CYTRDNLPL

SEQ ID NO: 892021 - protein, 9 aa, Homo Sapiens
QKYSKPPEK

SEQ ID NO: 892022 - protein, 9 aa, Homo Sapiens
LAVQSLSQK

SEQ ID NO: 892023 - protein, 9 aa, Homo Sapiens
TLETQPTRK

SEQ ID NO: 892024 - protein, 9 aa, Homo Sapiens
MKAEDEVDF

SEQ ID NO: 892025 - protein, 9 aa, Homo Sapiens
TREQSRSRD

SEQ ID NO: 892026 - protein, 9 aa, Homo Sapiens
LEPPSELII

SEQ ID NO: 892027 - protein, 9 aa, Homo Sapiens
VHWRIHSGE

SEQ ID NO: 892028 - protein, 9 aa, Homo Sapiens
KQDELIIKA

SEQ ID NO: 892029 - protein, 9 aa, Homo Sapiens
LKKLINRKI

SEQ ID NO: 892030 - protein, 9 aa, Homo Sapiens
YPLLFTASG

SEQ ID NO: 892031 - protein, 9 aa, Homo Sapiens
ADRWKKYLI

SEQ ID NO: 892032 - protein, 9 aa, Homo Sapiens
LDLENIVRN

SEQ ID NO: 892033 - protein, 9 aa, Homo Sapiens
PTDGGPFAK

SEQ ID NO: 892034 - protein, 9 aa, Homo Sapiens
HLKLNRNKI

SEQ ID NO: 892035 - protein, 9 aa, Homo Sapiens
QGRQAEFSG

SEQ ID NO: 892036 - protein, 9 aa, Homo Sapiens
WLFLVLQDF

SEQ ID NO: 892037 - protein, 9 aa, Homo Sapiens
EDIWQVNIQ

SEQ ID NO: 892038 - protein, 9 aa, Homo Sapiens
VFNDLLQQV

SEQ ID NO: 892039 - protein, 9 aa, Homo Sapiens
DKDEAAAQP

SEQ ID NO: 892040 - protein, 9 aa, Homo Sapiens
DGEKVLVVF

SEQ ID NO: 892041 - protein, 9 aa, Homo Sapiens
GEKVYECKQ

SEQ ID NO: 892042 - protein, 9 aa, Homo Sapiens
LIDINEESV

SEQ ID NO: 892043 - protein, 9 aa, Homo Sapiens
QSKGMGSGF

SEQ ID NO: 892044 - protein, 9 aa, Homo Sapiens
QRTLVLLEL

SEQ ID NO: 892045 - protein, 9 aa, Homo Sapiens
KDAKEAITA

SEQ ID NO: 892046 - protein, 9 aa, Homo Sapiens
IAITKEKRP

SEQ ID NO: 892047 - protein, 9 aa, Homo Sapiens
FLCLLPQVD

SEQ ID NO: 892048 - protein, 9 aa, Homo Sapiens
QSAGGRGTR

SEQ ID NO: 892049 - protein, 9 aa, Homo Sapiens
VPAPGKNKA

SEQ ID NO: 892050 - protein, 9 aa, Homo Sapiens
SRTPQEMID

SEQ ID NO: 892051 - protein, 9 aa, Homo Sapiens
ISEMQALAE

SEQ ID NO: 892052 - protein, 9 aa, Homo Sapiens
QGFLYAGLS

SEQ ID NO: 892053 - protein, 9 aa, Homo Sapiens
QNEKKRHRA

SEQ ID NO: 892054 - protein, 9 aa, Homo Sapiens
TLFNKTFWD

SEQ ID NO: 892055 - protein, 9 aa, Homo Sapiens
RGGSGDPFC

SEQ ID NO: 892056 - protein, 9 aa, Homo Sapiens
PKVKEEQID

SEQ ID NO: 892057 - protein, 9 aa, Homo Sapiens
FSVFLGIIV

SEQ ID NO: 892058 - protein, 9 aa, Homo Sapiens
DNCLTYHRI

SEQ ID NO: 892059 - protein, 9 aa, Homo Sapiens
GDGGRETSG

SEQ ID NO: 892060 - protein, 9 aa, Homo Sapiens
DPSWRKCML

SEQ ID NO: 892061 - protein, 9 aa, Homo Sapiens
IVQKNTSYY

SEQ ID NO: 892062 - protein, 9 aa, Homo Sapiens
KTCFIIHGF

SEQ ID NO: 892063 - protein, 9 aa, Homo Sapiens
TSHADYAGG

SEQ ID NO: 892064 - protein, 9 aa, Homo Sapiens
PRDFKHTDD

SEQ ID NO: 892065 - protein, 9 aa, Homo Sapiens
LMNRTNPKS

SEQ ID NO: 892066 - protein, 9 aa, Homo Sapiens
CTKMAFICA

SEQ ID NO: 892067 - protein, 9 aa, Homo Sapiens
KRMHTGDKP

SEQ ID NO: 892068 - protein, 9 aa, Homo Sapiens
SVLCGGGEQ

SEQ ID NO: 892069 - protein, 9 aa, Homo Sapiens
FEQLCSLME

SEQ ID NO: 892070 - protein, 9 aa, Homo Sapiens
EQGDWERLE

SEQ ID NO: 892071 - protein, 9 aa, Homo Sapiens
HTFPRLNCN

SEQ ID NO: 892072 - protein, 9 aa, Homo Sapiens
SYRYPNWPM

SEQ ID NO: 892073 - protein, 9 aa, Homo Sapiens
QESALPMRE

SEQ ID NO: 892074 - protein, 9 aa, Homo Sapiens
VCLFVLDLN

SEQ ID NO: 892075 - protein, 9 aa, Homo Sapiens
TGEDVKVIF

SEQ ID NO: 892076 - protein, 9 aa, Homo Sapiens
APYPCLMAR

SEQ ID NO: 892077 - protein, 9 aa, Homo Sapiens
CCNNMPVCL

SEQ ID NO: 892078 - protein, 9 aa, Homo Sapiens
MDCLRWLKR

SEQ ID NO: 892079 - protein, 9 aa, Homo Sapiens
CKNYVSLAV

SEQ ID NO: 892080 - protein, 9 aa, Homo Sapiens
QTDSQPFHP

SEQ ID NO: 892081 - protein, 9 aa, Homo Sapiens
KEGANFILL

SEQ ID NO: 892082 - protein, 9 aa, Homo Sapiens
GNKGAGAGN

SEQ ID NO: 892083 - protein, 9 aa, Homo Sapiens
IEKNIKLFF

SEQ ID NO: 892084 - protein, 9 aa, Homo Sapiens
GVYAWFWHP

SEQ ID NO: 892085 - protein, 9 aa, Homo Sapiens
LASTLVNAS

SEQ ID NO: 892086 - protein, 9 aa, Homo Sapiens
ETFPSLLED

SEQ ID NO: 892087 - protein, 9 aa, Homo Sapiens
FWLERGSMK

SEQ ID NO: 892088 - protein, 9 aa, Homo Sapiens
HTISVGKYI

SEQ ID NO: 892089 - protein, 9 aa, Homo Sapiens
LRNLILDSM

SEQ ID NO: 892090 - protein, 9 aa, Homo Sapiens
DCGYPPPVA

SEQ ID NO: 892091 - protein, 9 aa, Homo Sapiens
EEDADAMDN

SEQ ID NO: 892092 - protein, 9 aa, Homo Sapiens
MGNIYLKQI

SEQ ID NO: 892093 - protein, 9 aa, Homo Sapiens
TNSLMWTLF

SEQ ID NO: 892094 - protein, 9 aa, Homo Sapiens
GQRLVFDNQ

SEQ ID NO: 892095 - protein, 9 aa, Homo Sapiens
QKETLRDFI

SEQ ID NO: 892096 - protein, 9 aa, Homo Sapiens
TYQKKPMKK

SEQ ID NO: 892097 - protein, 9 aa, Homo Sapiens
TRFLCSQQE

SEQ ID NO: 892098 - protein, 9 aa, Homo Sapiens
FIEWMAGGL

SEQ ID NO: 892099 - protein, 9 aa, Homo Sapiens
FFWANIRAA

SEQ ID NO: 892100 - protein, 9 aa, Homo Sapiens
KASKSQLQN

SEQ ID NO: 892101 - protein, 9 aa, Homo Sapiens
TGQEVKLCL

SEQ ID NO: 892102 - protein, 9 aa, Homo Sapiens
EQNQRYVEQ

SEQ ID NO: 892103 - protein, 9 aa, Homo Sapiens
MNGAVADRI

SEQ ID NO: 892104 - protein, 9 aa, Homo Sapiens
PCHNGSTCR

SEQ ID NO: 892105 - protein, 9 aa, Homo Sapiens
TVENYHTNS

SEQ ID NO: 892106 - protein, 9 aa, Homo Sapiens
RPDQNLDLQ

SEQ ID NO: 892107 - protein, 9 aa, Homo Sapiens
PPLTHMPKG

SEQ ID NO: 892108 - protein, 9 aa, Homo Sapiens
IAVAAGYHV

SEQ ID NO: 892109 - protein, 9 aa, Homo Sapiens
DCLHGNKSI

SEQ ID NO: 892110 - protein, 9 aa, Homo Sapiens
ASEKMSTPL

SEQ ID NO: 892111 - protein, 9 aa, Homo Sapiens
HHIVETTYF

SEQ ID NO: 892112 - protein, 9 aa, Homo Sapiens
VFSFDLQAK

SEQ ID NO: 892113 - protein, 9 aa, Homo Sapiens
DEPSQKTGY

SEQ ID NO: 892114 - protein, 9 aa, Homo Sapiens
PKMASDCLH

SEQ ID NO: 892115 - protein, 9 aa, Homo Sapiens
FVESVEEIS

SEQ ID NO: 892116 - protein, 9 aa, Homo Sapiens
KKYPSKGRW

SEQ ID NO: 892117 - protein, 9 aa, Homo Sapiens
FFINLIAAL

SEQ ID NO: 892118 - protein, 9 aa, Homo Sapiens
LGVPQNASQ

SEQ ID NO: 892119 - protein, 9 aa, Homo Sapiens
MIKRELAKY

SEQ ID NO: 892120 - protein, 9 aa, Homo Sapiens
YNSRTREQS

SEQ ID NO: 892121 - protein, 9 aa, Homo Sapiens
GGGQSQQTL

SEQ ID NO: 892122 - protein, 9 aa, Homo Sapiens
LYINFMLRR

SEQ ID NO: 892123 - protein, 9 aa, Homo Sapiens
YTYNNTVIF

SEQ ID NO: 892124 - protein, 9 aa, Homo Sapiens
EFQDLNKKA

SEQ ID NO: 892125 - protein, 9 aa, Homo Sapiens
VFQAPHRRW

SEQ ID NO: 892126 - protein, 9 aa, Homo Sapiens
HVISVWDWQ

SEQ ID NO: 892127 - protein, 9 aa, Homo Sapiens
SMKALPILS

SEQ ID NO: 892128 - protein, 9 aa, Homo Sapiens
IQKARQHME

SEQ ID NO: 892129 - protein, 9 aa, Homo Sapiens
TPYPNFNFN

SEQ ID NO: 892130 - protein, 9 aa, Homo Sapiens
EEFVLKTQN

SEQ ID NO: 892131 - protein, 9 aa, Homo Sapiens
KYINCDVMI

SEQ ID NO: 892132 - protein, 9 aa, Homo Sapiens
AAPSHWVVQ

SEQ ID NO: 892133 - protein, 9 aa, Homo Sapiens
PWTSCEPKD

SEQ ID NO: 892134 - protein, 9 aa, Homo Sapiens
WNDLDSRFW

SEQ ID NO: 892135 - protein, 9 aa, Homo Sapiens
TALTPDLCP

SEQ ID NO: 892136 - protein, 9 aa, Homo Sapiens
MVFQTKQKN

SEQ ID NO: 892137 - protein, 9 aa, Homo Sapiens
EVAQSNSAL

SEQ ID NO: 892138 - protein, 9 aa, Homo Sapiens
ALQRTWNNL

SEQ ID NO: 892139 - protein, 9 aa, Homo Sapiens
NKESLAISG

SEQ ID NO: 892140 - protein, 9 aa, Homo Sapiens
KNGVFSALK

SEQ ID NO: 892141 - protein, 9 aa, Homo Sapiens
STCHFSCGN

SEQ ID NO: 892142 - protein, 9 aa, Homo Sapiens
GKNHGKKLQ

SEQ ID NO: 892143 - protein, 9 aa, Homo Sapiens
GARVPRFNT

SEQ ID NO: 892144 - protein, 9 aa, Homo Sapiens
RWNGRILHM

SEQ ID NO: 892145 - protein, 9 aa, Homo Sapiens
AVLPWGCLC

SEQ ID NO: 892146 - protein, 9 aa, Homo Sapiens
VLCKMTVNT

SEQ ID NO: 892147 - protein, 9 aa, Homo Sapiens
RKRDNNKDI

SEQ ID NO: 892148 - protein, 9 aa, Homo Sapiens
SDKLLSGSV

SEQ ID NO: 892149 - protein, 9 aa, Homo Sapiens
PESSYPVKK

SEQ ID NO: 892150 - protein, 9 aa, Homo Sapiens
IKIEKNGKV

SEQ ID NO: 892151 - protein, 9 aa, Homo Sapiens
KVISSPHLR

SEQ ID NO: 892152 - protein, 9 aa, Homo Sapiens
CFLTDTSHL

SEQ ID NO: 892153 - protein, 9 aa, Homo Sapiens
QTFFKITAP

SEQ ID NO: 892154 - protein, 9 aa, Homo Sapiens
ICYWVLQII

SEQ ID NO: 892155 - protein, 9 aa, Homo Sapiens
QMDSYTSYC

SEQ ID NO: 892156 - protein, 9 aa, Homo Sapiens
CSYKTSKRF

SEQ ID NO: 892157 - protein, 9 aa, Homo Sapiens
SSASKFLPM

SEQ ID NO: 892158 - protein, 9 aa, Homo Sapiens
EKICFKSLA

SEQ ID NO: 892159 - protein, 9 aa, Homo Sapiens
VKKIIGKML

SEQ ID NO: 892160 - protein, 9 aa, Homo Sapiens
CDKIQVDSE

SEQ ID NO: 892161 - protein, 9 aa, Homo Sapiens
VSVAEITFN

SEQ ID NO: 892162 - protein, 9 aa, Homo Sapiens
YETPKRVLK

SEQ ID NO: 892163 - protein, 9 aa, Homo Sapiens
EVEMSKYAN

SEQ ID NO: 892164 - protein, 9 aa, Homo Sapiens
EKDDIIKRN

SEQ ID NO: 892165 - protein, 9 aa, Homo Sapiens
YRNPEEIEK

SEQ ID NO: 892166 - protein, 9 aa, Homo Sapiens
TGGNFLEDK

SEQ ID NO: 892167 - protein, 9 aa, Homo Sapiens
VKAFPVFLQ

SEQ ID NO: 892168 - protein, 9 aa, Homo Sapiens
DSHYHRGYH

SEQ ID NO: 892169 - protein, 9 aa, Homo Sapiens
IRDAHRQIM

SEQ ID NO: 892170 - protein, 9 aa, Homo Sapiens
KIRDAHRQI

SEQ ID NO: 892171 - protein, 9 aa, Homo Sapiens
TLSKDKISA

SEQ ID NO: 892172 - protein, 9 aa, Homo Sapiens
HLNQIHQFD

SEQ ID NO: 892173 - protein, 9 aa, Homo Sapiens
CYVAVLLRM

SEQ ID NO: 892174 - protein, 9 aa, Homo Sapiens
QGMIEFCDA

SEQ ID NO: 892175 - protein, 9 aa, Homo Sapiens
GDLAPQSDS

SEQ ID NO: 892176 - protein, 9 aa, Homo Sapiens
EVGEDCECG

SEQ ID NO: 892177 - protein, 9 aa, Homo Sapiens
QIISHVWEN

SEQ ID NO: 892178 - protein, 9 aa, Homo Sapiens
ESVNKFLAK

SEQ ID NO: 892179 - protein, 9 aa, Homo Sapiens
CIHGGHTAK

SEQ ID NO: 892180 - protein, 9 aa, Homo Sapiens
SKRCCVLER

SEQ ID NO: 892181 - protein, 9 aa, Homo Sapiens
QAFGNVLSS

SEQ ID NO: 892182 - protein, 9 aa, Homo Sapiens
HTGNTSFAC

SEQ ID NO: 892183 - protein, 9 aa, Homo Sapiens
RSHSAGDRW

SEQ ID NO: 892184 - protein, 9 aa, Homo Sapiens
ESLGTLTHG

SEQ ID NO: 892185 - protein, 9 aa, Homo Sapiens
FRDKHLQGL

SEQ ID NO: 892186 - protein, 9 aa, Homo Sapiens
NSDSDKLSQ

SEQ ID NO: 892187 - protein, 9 aa, Homo Sapiens
NIPSTAYVV

SEQ ID NO: 892188 - protein, 9 aa, Homo Sapiens
LILLQRCEK

SEQ ID NO: 892189 - protein, 9 aa, Homo Sapiens
TKKYREKSL

SEQ ID NO: 892190 - protein, 9 aa, Homo Sapiens
YGEQQSTNG

SEQ ID NO: 892191 - protein, 9 aa, Homo Sapiens
CHPVWSAVV

SEQ ID NO: 892192 - protein, 9 aa, Homo Sapiens
RGPGGATGP

SEQ ID NO: 892193 - protein, 9 aa, Homo Sapiens
KLAYTLPLE

SEQ ID NO: 892194 - protein, 9 aa, Homo Sapiens
KLNSINSSS

SEQ ID NO: 892195 - protein, 9 aa, Homo Sapiens
HKFLASVLP

SEQ ID NO: 892196 - protein, 9 aa, Homo Sapiens
RLMEDVEAD

SEQ ID NO: 892197 - protein, 9 aa, Homo Sapiens
IHMYKQDGG

SEQ ID NO: 892198 - protein, 9 aa, Homo Sapiens
SFLDIKRIC

SEQ ID NO: 892199 - protein, 9 aa, Homo Sapiens
RGSGKGGPQ

SEQ ID NO: 892200 - protein, 9 aa, Homo Sapiens
PAEDRLALY

SEQ ID NO: 892201 - protein, 9 aa, Homo Sapiens
HTGLHTGDK

SEQ ID NO: 892202 - protein, 9 aa, Homo Sapiens
PKRVLKMDS

SEQ ID NO: 892203 - protein, 9 aa, Homo Sapiens
KAMEKMVDA

SEQ ID NO: 892204 - protein, 9 aa, Homo Sapiens
GFTSLLMEC

SEQ ID NO: 892205 - protein, 9 aa, Homo Sapiens
KKAPNGTVI

SEQ ID NO: 892206 - protein, 9 aa, Homo Sapiens
LLSVEEKNK

SEQ ID NO: 892207 - protein, 9 aa, Homo Sapiens
NCGKLEAQI

SEQ ID NO: 892208 - protein, 9 aa, Homo Sapiens
VNYTQYLDK

SEQ ID NO: 892209 - protein, 9 aa, Homo Sapiens
LIINKTINT

SEQ ID NO: 892210 - protein, 9 aa, Homo Sapiens
WFDPSWRKC

SEQ ID NO: 892211 - protein, 9 aa, Homo Sapiens
QAARAGTMA

SEQ ID NO: 892212 - protein, 9 aa, Homo Sapiens
GLTSHADYA

SEQ ID NO: 892213 - protein, 9 aa, Homo Sapiens
QNQYALLLI

SEQ ID NO: 892214 - protein, 9 aa, Homo Sapiens
LSGRGGGHC

SEQ ID NO: 892215 - protein, 9 aa, Homo Sapiens
PATDKWTLL

SEQ ID NO: 892216 - protein, 9 aa, Homo Sapiens
SLPVPTPPG

SEQ ID NO: 892217 - protein, 9 aa, Homo Sapiens
YNETQEELS

SEQ ID NO: 892218 - protein, 9 aa, Homo Sapiens
DLEQKKPRI

SEQ ID NO: 892219 - protein, 9 aa, Homo Sapiens
PFKDALRVP

SEQ ID NO: 892220 - protein, 9 aa, Homo Sapiens
FITCICYVA

SEQ ID NO: 892221 - protein, 9 aa, Homo Sapiens
LPIYSENSI

SEQ ID NO: 892222 - protein, 9 aa, Homo Sapiens
CKDCWKTFL

SEQ ID NO: 892223 - protein, 9 aa, Homo Sapiens
CAWQRCCPQ

SEQ ID NO: 892224 - protein, 9 aa, Homo Sapiens
CVKTSLTRH

SEQ ID NO: 892225 - protein, 9 aa, Homo Sapiens
LIRNVDTTV

SEQ ID NO: 892226 - protein, 9 aa, Homo Sapiens
SQDYSQIQG

SEQ ID NO: 892227 - protein, 9 aa, Homo Sapiens
DFNRRIQNE

SEQ ID NO: 892228 - protein, 9 aa, Homo Sapiens
VCIAETWLG

SEQ ID NO: 892229 - protein, 9 aa, Homo Sapiens
NLGYARGID

SEQ ID NO: 892230 - protein, 9 aa, Homo Sapiens
PQRYLVIMC

SEQ ID NO: 892231 - protein, 9 aa, Homo Sapiens
ESILALNPQ

SEQ ID NO: 892232 - protein, 9 aa, Homo Sapiens
FLSPEQTKL

SEQ ID NO: 892233 - protein, 9 aa, Homo Sapiens
ELEENMVSL

SEQ ID NO: 892234 - protein, 9 aa, Homo Sapiens
GAPCNPQTG

SEQ ID NO: 892235 - protein, 9 aa, Homo Sapiens
KIQREVKIL

SEQ ID NO: 892236 - protein, 9 aa, Homo Sapiens
PGPMEYTGR

SEQ ID NO: 892237 - protein, 9 aa, Homo Sapiens
TVYVRVPNF

SEQ ID NO: 892238 - protein, 9 aa, Homo Sapiens
GQCLSCQNY

SEQ ID NO: 892239 - protein, 9 aa, Homo Sapiens
ISDNVIVGR

SEQ ID NO: 892240 - protein, 9 aa, Homo Sapiens
RSPRISLSP

SEQ ID NO: 892241 - protein, 9 aa, Homo Sapiens
QGSITRHYI

SEQ ID NO: 892242 - protein, 9 aa, Homo Sapiens
DGPREPQRH

SEQ ID NO: 892243 - protein, 9 aa, Homo Sapiens
VVRLCHNPK

SEQ ID NO: 892244 - protein, 9 aa, Homo Sapiens
TTKDHSIFT

SEQ ID NO: 892245 - protein, 9 aa, Homo Sapiens
SISTLKSQI

SEQ ID NO: 892246 - protein, 9 aa, Homo Sapiens
NRCRGKIVR

SEQ ID NO: 892247 - protein, 9 aa, Homo Sapiens
TKGILPGVY

SEQ ID NO: 892248 - protein, 9 aa, Homo Sapiens
GFVLPSGEV

SEQ ID NO: 892249 - protein, 9 aa, Homo Sapiens
YLIDPKDLD

SEQ ID NO: 892250 - protein, 9 aa, Homo Sapiens
EFSDISEMQ

SEQ ID NO: 892251 - protein, 9 aa, Homo Sapiens
EIDNEKRMK

SEQ ID NO: 892252 - protein, 9 aa, Homo Sapiens
WQLQKNKYR

SEQ ID NO: 892253 - protein, 9 aa, Homo Sapiens
QGLKRKSLQ

SEQ ID NO: 892254 - protein, 9 aa, Homo Sapiens
SAWKWMLGP

SEQ ID NO: 892255 - protein, 9 aa, Homo Sapiens
RKIRTKKMS

SEQ ID NO: 892256 - protein, 9 aa, Homo Sapiens
NVQELARKN

SEQ ID NO: 892257 - protein, 9 aa, Homo Sapiens
AHTTPPVLT

SEQ ID NO: 892258 - protein, 9 aa, Homo Sapiens
EIILKRAAN

SEQ ID NO: 892259 - protein, 9 aa, Homo Sapiens
SSEAAIMTN

SEQ ID NO: 892260 - protein, 9 aa, Homo Sapiens
QPGSGFSST

SEQ ID NO: 892261 - protein, 9 aa, Homo Sapiens
DGMKMETSP

SEQ ID NO: 892262 - protein, 9 aa, Homo Sapiens
PDPQKASGH

SEQ ID NO: 892263 - protein, 9 aa, Homo Sapiens
GYHHGRPQY

SEQ ID NO: 892264 - protein, 9 aa, Homo Sapiens
PRGTPGTWG

SEQ ID NO: 892265 - protein, 9 aa, Homo Sapiens
GVTSGSSKL

SEQ ID NO: 892266 - protein, 9 aa, Homo Sapiens
TNTYTGMKE

SEQ ID NO: 892267 - protein, 9 aa, Homo Sapiens
KLITKKEVN

SEQ ID NO: 892268 - protein, 9 aa, Homo Sapiens
AFDFGPHDN

SEQ ID NO: 892269 - protein, 9 aa, Homo Sapiens
AGCRPADTQ

SEQ ID NO: 892270 - protein, 9 aa, Homo Sapiens
TAYVLQFSI

SEQ ID NO: 892271 - protein, 9 aa, Homo Sapiens
LDDRNTFQH

SEQ ID NO: 892272 - protein, 9 aa, Homo Sapiens
LSENNSNNE

SEQ ID NO: 892273 - protein, 9 aa, Homo Sapiens
ACHREPCLG

SEQ ID NO: 892274 - protein, 9 aa, Homo Sapiens
HANVVPNAT

SEQ ID NO: 892275 - protein, 9 aa, Homo Sapiens
CIPQSLAYT

SEQ ID NO: 892276 - protein, 9 aa, Homo Sapiens
TKPLVCRAG

SEQ ID NO: 892277 - protein, 9 aa, Homo Sapiens
ENPYFCKGC

SEQ ID NO: 892278 - protein, 9 aa, Homo Sapiens
TVQKEGMQK

SEQ ID NO: 892279 - protein, 9 aa, Homo Sapiens
PFFDVCWHN

SEQ ID NO: 892280 - protein, 9 aa, Homo Sapiens
PARHTLADI

SEQ ID NO: 892281 - protein, 9 aa, Homo Sapiens
AQGVPFACF

SEQ ID NO: 892282 - protein, 9 aa, Homo Sapiens
NQCQYCRFQ

SEQ ID NO: 892283 - protein, 9 aa, Homo Sapiens
ALDGGNPPR

SEQ ID NO: 892284 - protein, 9 aa, Homo Sapiens
VKCNDLYFN

SEQ ID NO: 892285 - protein, 9 aa, Homo Sapiens
SPDLFISQS

SEQ ID NO: 892286 - protein, 9 aa, Homo Sapiens
QSQYVCRLY

SEQ ID NO: 892287 - protein, 9 aa, Homo Sapiens
SVVIFKNLH

SEQ ID NO: 892288 - protein, 9 aa, Homo Sapiens
ETSGRFPSW

SEQ ID NO: 892289 - protein, 9 aa, Homo Sapiens
EALNLKKGL

SEQ ID NO: 892290 - protein, 9 aa, Homo Sapiens
RLLLGLQDV

SEQ ID NO: 892291 - protein, 9 aa, Homo Sapiens
LQMEMKEDN

SEQ ID NO: 892292 - protein, 9 aa, Homo Sapiens
LNQTKLECE

SEQ ID NO: 892293 - protein, 9 aa, Homo Sapiens
INNDALPLL

SEQ ID NO: 892294 - protein, 9 aa, Homo Sapiens
RLLLGLQDK

SEQ ID NO: 892295 - protein, 9 aa, Homo Sapiens
DILTCIECS

SEQ ID NO: 892296 - protein, 9 aa, Homo Sapiens
TLLRCQNEK

SEQ ID NO: 892297 - protein, 9 aa, Homo Sapiens
KRSTCSILE

SEQ ID NO: 892298 - protein, 9 aa, Homo Sapiens
QFPKVWILR

SEQ ID NO: 892299 - protein, 9 aa, Homo Sapiens
LLSECDAAK

SEQ ID NO: 892300 - protein, 9 aa, Homo Sapiens
KICVCPDGK

SEQ ID NO: 892301 - protein, 9 aa, Homo Sapiens
GMPNGILSV

SEQ ID NO: 892302 - protein, 9 aa, Homo Sapiens
CNDIQINIW

SEQ ID NO: 892303 - protein, 9 aa, Homo Sapiens
SIPEKNRHL

SEQ ID NO: 892304 - protein, 9 aa, Homo Sapiens
TIKKRLPFS

SEQ ID NO: 892305 - protein, 9 aa, Homo Sapiens
LTVLMAAPV

SEQ ID NO: 892306 - protein, 9 aa, Homo Sapiens
HLIQRKIVK

SEQ ID NO: 892307 - protein, 9 aa, Homo Sapiens
LISAASKFA

SEQ ID NO: 892308 - protein, 9 aa, Homo Sapiens
TLWIEKNDL

SEQ ID NO: 892309 - protein, 9 aa, Homo Sapiens
ALNHAVLGL

SEQ ID NO: 892310 - protein, 9 aa, Homo Sapiens
ELMDANICQ

SEQ ID NO: 892311 - protein, 9 aa, Homo Sapiens
AVRVLHSRD

SEQ ID NO: 892312 - protein, 9 aa, Homo Sapiens
YKFENLNTV

SEQ ID NO: 892313 - protein, 9 aa, Homo Sapiens
ILVVQDRNE

SEQ ID NO: 892314 - protein, 9 aa, Homo Sapiens
YPSDVIRKP

SEQ ID NO: 892315 - protein, 9 aa, Homo Sapiens
VYDVIWRFQ

SEQ ID NO: 892316 - protein, 9 aa, Homo Sapiens
CLSCRNNRC

SEQ ID NO: 892317 - protein, 9 aa, Homo Sapiens
DLVVSILGS

SEQ ID NO: 892318 - protein, 9 aa, Homo Sapiens
QPQETVKKI

SEQ ID NO: 892319 - protein, 9 aa, Homo Sapiens
PTLLQAENE

SEQ ID NO: 892320 - protein, 9 aa, Homo Sapiens
TMRIWVLKA

SEQ ID NO: 892321 - protein, 9 aa, Homo Sapiens
DGKISFQEF

SEQ ID NO: 892322 - protein, 9 aa, Homo Sapiens
FKAAIVHNV

SEQ ID NO: 892323 - protein, 9 aa, Homo Sapiens
LQNNKITKI

SEQ ID NO: 892324 - protein, 9 aa, Homo Sapiens
MSFCLANSI

SEQ ID NO: 892325 - protein, 9 aa, Homo Sapiens
TTRKLYLED

SEQ ID NO: 892326 - protein, 9 aa, Homo Sapiens
NFDNSFQNT

SEQ ID NO: 892327 - protein, 9 aa, Homo Sapiens
FFQGTRVAL

SEQ ID NO: 892328 - protein, 9 aa, Homo Sapiens
LFEIHNYNI

SEQ ID NO: 892329 - protein, 9 aa, Homo Sapiens
DIKSKNKHG

SEQ ID NO: 892330 - protein, 9 aa, Homo Sapiens
SQELLEADN

SEQ ID NO: 892331 - protein, 9 aa, Homo Sapiens
GRRSPKSCS

SEQ ID NO: 892332 - protein, 9 aa, Homo Sapiens
DFVNAANES

SEQ ID NO: 892333 - protein, 9 aa, Homo Sapiens
IAVELYRGC

SEQ ID NO: 892334 - protein, 9 aa, Homo Sapiens
PLPGPYRLC

SEQ ID NO: 892335 - protein, 9 aa, Homo Sapiens
GKFEAVLVI

SEQ ID NO: 892336 - protein, 9 aa, Homo Sapiens
IYLAPEVQS

SEQ ID NO: 892337 - protein, 9 aa, Homo Sapiens
NITVYETTV

SEQ ID NO: 892338 - protein, 9 aa, Homo Sapiens
YQDDAKLAT

SEQ ID NO: 892339 - protein, 9 aa, Homo Sapiens
NFWNPPTTT

SEQ ID NO: 892340 - protein, 9 aa, Homo Sapiens
ISGFPRRAF

SEQ ID NO: 892341 - protein, 9 aa, Homo Sapiens
SVKNNYRKN

SEQ ID NO: 892342 - protein, 9 aa, Homo Sapiens
QLVHKGYKF

SEQ ID NO: 892343 - protein, 9 aa, Homo Sapiens
KLSTQVKGS

SEQ ID NO: 892344 - protein, 9 aa, Homo Sapiens
QDEEGNEIK

SEQ ID NO: 892345 - protein, 9 aa, Homo Sapiens
TRDDCGWFV

SEQ ID NO: 892346 - protein, 9 aa, Homo Sapiens
AWLLLYRNN

SEQ ID NO: 892347 - protein, 9 aa, Homo Sapiens
KKTKIDYLM

SEQ ID NO: 892348 - protein, 9 aa, Homo Sapiens
QTVLGLIQQ

SEQ ID NO: 892349 - protein, 9 aa, Homo Sapiens
DGDNYDTPP

SEQ ID NO: 892350 - protein, 9 aa, Homo Sapiens
LCQLIMATP

SEQ ID NO: 892351 - protein, 9 aa, Homo Sapiens
QQGFLGLWQ

SEQ ID NO: 892352 - protein, 9 aa, Homo Sapiens
IKELSWNQF

SEQ ID NO: 892353 - protein, 9 aa, Homo Sapiens
LEDDKRLLL

SEQ ID NO: 892354 - protein, 9 aa, Homo Sapiens
HTQTNVGEA

SEQ ID NO: 892355 - protein, 9 aa, Homo Sapiens
KLEYQNKVM

SEQ ID NO: 892356 - protein, 9 aa, Homo Sapiens
IDDHFLFNK

SEQ ID NO: 892357 - protein, 9 aa, Homo Sapiens
HRDLKPANM

SEQ ID NO: 892358 - protein, 9 aa, Homo Sapiens
RDFFLDEAN

SEQ ID NO: 892359 - protein, 9 aa, Homo Sapiens
WISSELSLA

SEQ ID NO: 892360 - protein, 9 aa, Homo Sapiens
NLEAFRIDG

SEQ ID NO: 892361 - protein, 9 aa, Homo Sapiens
GECLIQFLS

SEQ ID NO: 892362 - protein, 9 aa, Homo Sapiens
KAVVSDNNP

SEQ ID NO: 892363 - protein, 9 aa, Homo Sapiens
CVDGWCECD

SEQ ID NO: 892364 - protein, 9 aa, Homo Sapiens
DSGSKDKMS

SEQ ID NO: 892365 - protein, 9 aa, Homo Sapiens
LELLGSRLE

SEQ ID NO: 892366 - protein, 9 aa, Homo Sapiens
QESFAEHQS

SEQ ID NO: 892367 - protein, 9 aa, Homo Sapiens
PHSAADDYT

SEQ ID NO: 892368 - protein, 9 aa, Homo Sapiens
VQIIRVILK

SEQ ID NO: 892369 - protein, 8 aa, Homo Sapiens
DLGMEENN

SEQ ID NO: 892370 - protein, 9 aa, Homo Sapiens
SISSKTGET

SEQ ID NO: 892371 - protein, 9 aa, Homo Sapiens
GPNPALSQA

SEQ ID NO: 892372 - protein, 9 aa, Homo Sapiens
RVLSMYEEA

SEQ ID NO: 892373 - protein, 9 aa, Homo Sapiens
QECFQPVWV

SEQ ID NO: 892374 - protein, 9 aa, Homo Sapiens
KQIIDEFES

SEQ ID NO: 892375 - protein, 9 aa, Homo Sapiens
HIDACLNFL

SEQ ID NO: 892376 - protein, 9 aa, Homo Sapiens
HKVIEKVQH

SEQ ID NO: 892377 - protein, 9 aa, Homo Sapiens
EERLSGRKA

SEQ ID NO: 892378 - protein, 9 aa, Homo Sapiens
SQGAVSSLG

SEQ ID NO: 892379 - protein, 9 aa, Homo Sapiens
PRPNFFYRC

SEQ ID NO: 892380 - protein, 9 aa, Homo Sapiens
LYNKFPEPI

SEQ ID NO: 892381 - protein, 9 aa, Homo Sapiens
RLQTEECQL

SEQ ID NO: 892382 - protein, 9 aa, Homo Sapiens
SYTSNKIVR

SEQ ID NO: 892383 - protein, 9 aa, Homo Sapiens
QVYLYRRLG

SEQ ID NO: 892384 - protein, 9 aa, Homo Sapiens
KLGHTQTNV

SEQ ID NO: 892385 - protein, 9 aa, Homo Sapiens
NGEDINTIS

SEQ ID NO: 892386 - protein, 9 aa, Homo Sapiens
MLGPVVLYA

SEQ ID NO: 892387 - protein, 9 aa, Homo Sapiens
NIQFIGGLL

SEQ ID NO: 892388 - protein, 9 aa, Homo Sapiens
AVDKYLGTN

SEQ ID NO: 892389 - protein, 9 aa, Homo Sapiens
KHKRDLNSI

SEQ ID NO: 892390 - protein, 9 aa, Homo Sapiens
LQRHLLIHT

SEQ ID NO: 892391 - protein, 9 aa, Homo Sapiens
ANVVPNATI

SEQ ID NO: 892392 - protein, 9 aa, Homo Sapiens
LAKDFLDLI

SEQ ID NO: 892393 - protein, 9 aa, Homo Sapiens
GYYLVACQP

SEQ ID NO: 892394 - protein, 9 aa, Homo Sapiens
ASCLTRHQI

SEQ ID NO: 892395 - protein, 9 aa, Homo Sapiens
LKLEQVQQQ

SEQ ID NO: 892396 - protein, 9 aa, Homo Sapiens
EDKSKIVCV

SEQ ID NO: 892397 - protein, 9 aa, Homo Sapiens
CQLPGRQPQ

SEQ ID NO: 892398 - protein, 9 aa, Homo Sapiens
GVPSTLTTP

SEQ ID NO: 892399 - protein, 9 aa, Homo Sapiens
DGHISQEAF

SEQ ID NO: 892400 - protein, 9 aa, Homo Sapiens
QLAINTEER

SEQ ID NO: 892401 - protein, 9 aa, Homo Sapiens
LPHNRPYFK

SEQ ID NO: 892402 - protein, 9 aa, Homo Sapiens
RYIDAGNFG

SEQ ID NO: 892403 - protein, 9 aa, Homo Sapiens
EKPPKTTKK

SEQ ID NO: 892404 - protein, 9 aa, Homo Sapiens
LDELMDGGI

SEQ ID NO: 892405 - protein, 9 aa, Homo Sapiens
QGGRIMCRG

SEQ ID NO: 892406 - protein, 9 aa, Homo Sapiens
LLCVYVWLE

SEQ ID NO: 892407 - protein, 9 aa, Homo Sapiens
AFNPAAAAF

SEQ ID NO: 892408 - protein, 9 aa, Homo Sapiens
PLATYMQIY

SEQ ID NO: 892409 - protein, 9 aa, Homo Sapiens
LYNKFNHYD

SEQ ID NO: 892410 - protein, 9 aa, Homo Sapiens
YVSSNFVAR

SEQ ID NO: 892411 - protein, 9 aa, Homo Sapiens
GLDFGDKLY

SEQ ID NO: 892412 - protein, 9 aa, Homo Sapiens
YMAFLTYDK

SEQ ID NO: 892413 - protein, 9 aa, Homo Sapiens
KKYLIKICQ

SEQ ID NO: 892414 - protein, 9 aa, Homo Sapiens
PSEVVIPLA

SEQ ID NO: 892415 - protein, 9 aa, Homo Sapiens
AVLWASDEC

SEQ ID NO: 892416 - protein, 9 aa, Homo Sapiens
NLMEDRMMT

SEQ ID NO: 892417 - protein, 9 aa, Homo Sapiens
GTLLETFNA

SEQ ID NO: 892418 - protein, 9 aa, Homo Sapiens
DTYKTIKQY

SEQ ID NO: 892419 - protein, 9 aa, Homo Sapiens
CNKEVRETL

SEQ ID NO: 892420 - protein, 9 aa, Homo Sapiens
HHYGARPPP

SEQ ID NO: 892421 - protein, 9 aa, Homo Sapiens
YTCPVCIQK

SEQ ID NO: 892422 - protein, 9 aa, Homo Sapiens
EEEEEHCQH

SEQ ID NO: 892423 - protein, 9 aa, Homo Sapiens
TFKNGLKDT

SEQ ID NO: 892424 - protein, 9 aa, Homo Sapiens
NYPLAIKNA

SEQ ID NO: 892425 - protein, 9 aa, Homo Sapiens
CLRSAKDIK

SEQ ID NO: 892426 - protein, 9 aa, Homo Sapiens
DQQSNHSGE

SEQ ID NO: 892427 - protein, 9 aa, Homo Sapiens
LKRVIGMPV

SEQ ID NO: 892428 - protein, 9 aa, Homo Sapiens
VAGNKYFID

SEQ ID NO: 892429 - protein, 9 aa, Homo Sapiens
QRELEKLYQ

SEQ ID NO: 892430 - protein, 9 aa, Homo Sapiens
GEFKIIIKI

SEQ ID NO: 892431 - protein, 9 aa, Homo Sapiens
VTVMESNPQ

SEQ ID NO: 892432 - protein, 9 aa, Homo Sapiens
QELLQFHRP

SEQ ID NO: 892433 - protein, 9 aa, Homo Sapiens
KLTSVEKSL

SEQ ID NO: 892434 - protein, 9 aa, Homo Sapiens
RTIQISCNS

SEQ ID NO: 892435 - protein, 9 aa, Homo Sapiens
DEDSDDVPQ

SEQ ID NO: 892436 - protein, 9 aa, Homo Sapiens
PFMDCSAPQ

SEQ ID NO: 892437 - protein, 9 aa, Homo Sapiens
TVEYWGKYG

SEQ ID NO: 892438 - protein, 9 aa, Homo Sapiens
VFVDIKFTG

SEQ ID NO: 892439 - protein, 9 aa, Homo Sapiens
IKLFFSGSA

SEQ ID NO: 892440 - protein, 9 aa, Homo Sapiens
DAHKLFHVI

SEQ ID NO: 892441 - protein, 9 aa, Homo Sapiens
QGTRVALVG

SEQ ID NO: 892442 - protein, 9 aa, Homo Sapiens
VSVIIPTIG

SEQ ID NO: 892443 - protein, 9 aa, Homo Sapiens
DKFVRFCFI

SEQ ID NO: 892444 - protein, 9 aa, Homo Sapiens
AEIKSQHQL

SEQ ID NO: 892445 - protein, 9 aa, Homo Sapiens
AHSSDENIP

SEQ ID NO: 892446 - protein, 9 aa, Homo Sapiens
CSLYRHFKN

SEQ ID NO: 892447 - protein, 9 aa, Homo Sapiens
VPPAQVQDN

SEQ ID NO: 892448 - protein, 9 aa, Homo Sapiens
FGNGNFRRK

SEQ ID NO: 892449 - protein, 9 aa, Homo Sapiens
IHVAITSTV

SEQ ID NO: 892450 - protein, 9 aa, Homo Sapiens
HVIERCCKL

SEQ ID NO: 892451 - protein, 9 aa, Homo Sapiens
LSPETSPAS

SEQ ID NO: 892452 - protein, 9 aa, Homo Sapiens
WHGMEDEDI

SEQ ID NO: 892453 - protein, 9 aa, Homo Sapiens
KDTKRNSRL

SEQ ID NO: 892454 - protein, 9 aa, Homo Sapiens
KDSYWTLDP

SEQ ID NO: 892455 - protein, 9 aa, Homo Sapiens
DNDHSLWRV

SEQ ID NO: 892456 - protein, 9 aa, Homo Sapiens
KIWQKVDDC

SEQ ID NO: 892457 - protein, 9 aa, Homo Sapiens
RPHTGKAAS

SEQ ID NO: 892458 - protein, 9 aa, Homo Sapiens
SNKESDFEE

SEQ ID NO: 892459 - protein, 9 aa, Homo Sapiens
GNLSALQTF

SEQ ID NO: 892460 - protein, 9 aa, Homo Sapiens
EPEFQDLNK

SEQ ID NO: 892461 - protein, 9 aa, Homo Sapiens
FDKWRKEFA

SEQ ID NO: 892462 - protein, 9 aa, Homo Sapiens
LKKAIDITE

SEQ ID NO: 892463 - protein, 9 aa, Homo Sapiens
STGEQICLA

SEQ ID NO: 892464 - protein, 9 aa, Homo Sapiens
ETKCFKELN

SEQ ID NO: 892465 - protein, 9 aa, Homo Sapiens
CYYKISANL

SEQ ID NO: 892466 - protein, 9 aa, Homo Sapiens
TVCKGSSTV

SEQ ID NO: 892467 - protein, 9 aa, Homo Sapiens
KFIEDYILP

SEQ ID NO: 892468 - protein, 9 aa, Homo Sapiens
FYNSHSLDV

SEQ ID NO: 892469 - protein, 9 aa, Homo Sapiens
ESMGLLSFP

SEQ ID NO: 892470 - protein, 9 aa, Homo Sapiens
FSKQVNRID

SEQ ID NO: 892471 - protein, 9 aa, Homo Sapiens
FDELNNYLS

SEQ ID NO: 892472 - protein, 9 aa, Homo Sapiens
KEAENVWWI

SEQ ID NO: 892473 - protein, 9 aa, Homo Sapiens
GGHFHIQLP

SEQ ID NO: 892474 - protein, 9 aa, Homo Sapiens
WTALLGLML

SEQ ID NO: 892475 - protein, 9 aa, Homo Sapiens
TNGLPVQES

SEQ ID NO: 892476 - protein, 9 aa, Homo Sapiens
LSEKNNLTL

SEQ ID NO: 892477 - protein, 9 aa, Homo Sapiens
MKEKKRKKL

SEQ ID NO: 892478 - protein, 9 aa, Homo Sapiens
VLTKFREDL

SEQ ID NO: 892479 - protein, 9 aa, Homo Sapiens
SADRFYQID

SEQ ID NO: 892480 - protein, 9 aa, Homo Sapiens
ERLWFREAE

SEQ ID NO: 892481 - protein, 9 aa, Homo Sapiens
VMPQAPPPP

SEQ ID NO: 892482 - protein, 9 aa, Homo Sapiens
QVVAGNKYF

SEQ ID NO: 892483 - protein, 9 aa, Homo Sapiens
FIYAEIGLI

SEQ ID NO: 892484 - protein, 9 aa, Homo Sapiens
KLSVLYNET

SEQ ID NO: 892485 - protein, 9 aa, Homo Sapiens
LEKEATGYK

SEQ ID NO: 892486 - protein, 9 aa, Homo Sapiens
IIFHNETSK

SEQ ID NO: 892487 - protein, 9 aa, Homo Sapiens
IIHIGKKQY

SEQ ID NO: 892488 - protein, 9 aa, Homo Sapiens
TGLGKVTMI

SEQ ID NO: 892489 - protein, 9 aa, Homo Sapiens
ITEGYLDWS

SEQ ID NO: 892490 - protein, 9 aa, Homo Sapiens
APCGNLSGM

SEQ ID NO: 892491 - protein, 9 aa, Homo Sapiens
ALPRRPHNR

SEQ ID NO: 892492 - protein, 9 aa, Homo Sapiens
GEISEIKEI

SEQ ID NO: 892493 - protein, 9 aa, Homo Sapiens
ARPPRLISI

SEQ ID NO: 892494 - protein, 9 aa, Homo Sapiens
LFRYFVNRE

SEQ ID NO: 892495 - protein, 9 aa, Homo Sapiens
KEIHTQFLD

SEQ ID NO: 892496 - protein, 9 aa, Homo Sapiens
KTDSFSHRQ

SEQ ID NO: 892497 - protein, 9 aa, Homo Sapiens
GLHKLINKI

SEQ ID NO: 892498 - protein, 9 aa, Homo Sapiens
ASKSQLQNR

SEQ ID NO: 892499 - protein, 9 aa, Homo Sapiens
KHGKVCKLD

SEQ ID NO: 892500 - protein, 9 aa, Homo Sapiens
RACPLPGSE

SEQ ID NO: 892501 - protein, 9 aa, Homo Sapiens
HFHIQLPNT

SEQ ID NO: 892502 - protein, 9 aa, Homo Sapiens
PRIKDTPAL

SEQ ID NO: 892503 - protein, 9 aa, Homo Sapiens
IGCYPQENK

SEQ ID NO: 892504 - protein, 9 aa, Homo Sapiens
NLDEFVTVN

SEQ ID NO: 892505 - protein, 9 aa, Homo Sapiens
HSQRQYIFK

SEQ ID NO: 892506 - protein, 9 aa, Homo Sapiens
REIFGYDQK

SEQ ID NO: 892507 - protein, 9 aa, Homo Sapiens
HEKPAQPEG

SEQ ID NO: 892508 - protein, 9 aa, Homo Sapiens
QRFVKFLEI

SEQ ID NO: 892509 - protein, 9 aa, Homo Sapiens
NKQKHRIWG

SEQ ID NO: 892510 - protein, 9 aa, Homo Sapiens
CSQGLRIFC

SEQ ID NO: 892511 - protein, 9 aa, Homo Sapiens
QNNFKKIMH

SEQ ID NO: 892512 - protein, 9 aa, Homo Sapiens
RKRHDSKRS

SEQ ID NO: 892513 - protein, 9 aa, Homo Sapiens
PTTTEVTIE

SEQ ID NO: 892514 - protein, 9 aa, Homo Sapiens
QPYQPLWEV

SEQ ID NO: 892515 - protein, 9 aa, Homo Sapiens
GPPGPMEYT

SEQ ID NO: 892516 - protein, 9 aa, Homo Sapiens
WLTLLLGMG

SEQ ID NO: 892517 - protein, 9 aa, Homo Sapiens
PVDFVNAAN

SEQ ID NO: 892518 - protein, 9 aa, Homo Sapiens
ADAQRQDCP

SEQ ID NO: 892519 - protein, 9 aa, Homo Sapiens
TDESPLWNG

SEQ ID NO: 892520 - protein, 9 aa, Homo Sapiens
VLTDHDEIE

SEQ ID NO: 892521 - protein, 9 aa, Homo Sapiens
AVLLRMYYF

SEQ ID NO: 892522 - protein, 9 aa, Homo Sapiens
PNLLGLQWR

SEQ ID NO: 892523 - protein, 9 aa, Homo Sapiens
FFRIAYILP

SEQ ID NO: 892524 - protein, 9 aa, Homo Sapiens
MSFSLAPFI

SEQ ID NO: 892525 - protein, 9 aa, Homo Sapiens
ERRGPQKQL

SEQ ID NO: 892526 - protein, 9 aa, Homo Sapiens
DYTMTLLDV

SEQ ID NO: 892527 - protein, 9 aa, Homo Sapiens
HKAGRSAEE

SEQ ID NO: 892528 - protein, 9 aa, Homo Sapiens
EKPCECNVC

SEQ ID NO: 892529 - protein, 9 aa, Homo Sapiens
VLGPYHYKF

SEQ ID NO: 892530 - protein, 9 aa, Homo Sapiens
KSCILSLSW

SEQ ID NO: 892531 - protein, 9 aa, Homo Sapiens
IPTGDGHNL

SEQ ID NO: 892532 - protein, 9 aa, Homo Sapiens
LFYVKYRNV

SEQ ID NO: 892533 - protein, 9 aa, Homo Sapiens
KNSVWIGQL

SEQ ID NO: 892534 - protein, 9 aa, Homo Sapiens
VIDKAKIES

SEQ ID NO: 892535 - protein, 9 aa, Homo Sapiens
RHVCSHGDK

SEQ ID NO: 892536 - protein, 9 aa, Homo Sapiens
IMGMVEKTR

SEQ ID NO: 892537 - protein, 9 aa, Homo Sapiens
RGQNNLTAP

SEQ ID NO: 892538 - protein, 9 aa, Homo Sapiens
AKYSELRSQ

SEQ ID NO: 892539 - protein, 9 aa, Homo Sapiens
SPKSCSKPE

SEQ ID NO: 892540 - protein, 9 aa, Homo Sapiens
SATKMSGRG

SEQ ID NO: 892541 - protein, 9 aa, Homo Sapiens
LTLDYLKEV

SEQ ID NO: 892542 - protein, 9 aa, Homo Sapiens
CNGQFKTYA

SEQ ID NO: 892543 - protein, 9 aa, Homo Sapiens
SYRFVCDKH

SEQ ID NO: 892544 - protein, 9 aa, Homo Sapiens
QAADYDNFS

SEQ ID NO: 892545 - protein, 9 aa, Homo Sapiens
LVFTLTTIA

SEQ ID NO: 892546 - protein, 9 aa, Homo Sapiens
KLARQTYPK

SEQ ID NO: 892547 - protein, 9 aa, Homo Sapiens
IFKLNGLPS

SEQ ID NO: 892548 - protein, 9 aa, Homo Sapiens
ECYSDASVH

SEQ ID NO: 892549 - protein, 9 aa, Homo Sapiens
LIQRKIVKP

SEQ ID NO: 892550 - protein, 9 aa, Homo Sapiens
DTNMHSHTH

SEQ ID NO: 892551 - protein, 9 aa, Homo Sapiens
QFLQYYDME

SEQ ID NO: 892552 - protein, 9 aa, Homo Sapiens
SYEGHGSHK

SEQ ID NO: 892553 - protein, 9 aa, Homo Sapiens
SVKNFFQMF

SEQ ID NO: 892554 - protein, 9 aa, Homo Sapiens
ICKLADQCT

SEQ ID NO: 892555 - protein, 9 aa, Homo Sapiens
TDAELFLAD

SEQ ID NO: 892556 - protein, 9 aa, Homo Sapiens
CINPFVYYF

SEQ ID NO: 892557 - protein, 9 aa, Homo Sapiens
NLKKNIHLW

SEQ ID NO: 892558 - protein, 9 aa, Homo Sapiens
LLAAALQIQ

SEQ ID NO: 892559 - protein, 9 aa, Homo Sapiens
ENSGAIEEE

SEQ ID NO: 892560 - protein, 9 aa, Homo Sapiens
YIKYWLSEN

SEQ ID NO: 892561 - protein, 9 aa, Homo Sapiens
VYKVQSRLL

SEQ ID NO: 892562 - protein, 9 aa, Homo Sapiens
INSIFNRSI

SEQ ID NO: 892563 - protein, 9 aa, Homo Sapiens
CALLQSQPV

SEQ ID NO: 892564 - protein, 9 aa, Homo Sapiens
GAYKQVIKY

SEQ ID NO: 892565 - protein, 9 aa, Homo Sapiens
HKLPNELPA

SEQ ID NO: 892566 - protein, 9 aa, Homo Sapiens
EQVLAKNNV

SEQ ID NO: 892567 - protein, 9 aa, Homo Sapiens
PNLDNTSAE

SEQ ID NO: 892568 - protein, 9 aa, Homo Sapiens
VCKNHRSRL

SEQ ID NO: 892569 - protein, 9 aa, Homo Sapiens
TVHQSPVTK

SEQ ID NO: 892570 - protein, 9 aa, Homo Sapiens
IVPHKPNTL

SEQ ID NO: 892571 - protein, 9 aa, Homo Sapiens
NLIQKHTGS

SEQ ID NO: 892572 - protein, 9 aa, Homo Sapiens
EPPVSRRLL

SEQ ID NO: 892573 - protein, 9 aa, Homo Sapiens
DNSVTSISE

SEQ ID NO: 892574 - protein, 9 aa, Homo Sapiens
SQEIWNEIC

SEQ ID NO: 892575 - protein, 9 aa, Homo Sapiens
CRGHGPQSF

SEQ ID NO: 892576 - protein, 9 aa, Homo Sapiens
EGVEMLLNP

SEQ ID NO: 892577 - protein, 9 aa, Homo Sapiens
GKYPVPKSP

SEQ ID NO: 892578 - protein, 9 aa, Homo Sapiens
HIQNILILS

SEQ ID NO: 892579 - protein, 9 aa, Homo Sapiens
CLKNIRAFL

SEQ ID NO: 892580 - protein, 9 aa, Homo Sapiens
EPDCGYPPP

SEQ ID NO: 892581 - protein, 9 aa, Homo Sapiens
WRKCMLLTL

SEQ ID NO: 892582 - protein, 9 aa, Homo Sapiens
VCRVSFADP

SEQ ID NO: 892583 - protein, 9 aa, Homo Sapiens
KNKIGHLCK

SEQ ID NO: 892584 - protein, 9 aa, Homo Sapiens
QFETDIVQQ

SEQ ID NO: 892585 - protein, 9 aa, Homo Sapiens
PPKKKRLCL

SEQ ID NO: 892586 - protein, 9 aa, Homo Sapiens
FQNHLCLVF

SEQ ID NO: 892587 - protein, 9 aa, Homo Sapiens
AHTQNQEYL

SEQ ID NO: 892588 - protein, 9 aa, Homo Sapiens
SSSFTKHQC

SEQ ID NO: 892589 - protein, 9 aa, Homo Sapiens
PLNDAISKK

SEQ ID NO: 892590 - protein, 9 aa, Homo Sapiens
PKDRKKIQL

SEQ ID NO: 892591 - protein, 9 aa, Homo Sapiens
SGSQTPHIP

SEQ ID NO: 892592 - protein, 9 aa, Homo Sapiens
KQINYSKAI

SEQ ID NO: 892593 - protein, 9 aa, Homo Sapiens
INEQEVVDK

SEQ ID NO: 892594 - protein, 9 aa, Homo Sapiens
INQYRVCQE

SEQ ID NO: 892595 - protein, 9 aa, Homo Sapiens
IPSTAQATV

SEQ ID NO: 892596 - protein, 9 aa, Homo Sapiens
EQEESVNKF

SEQ ID NO: 892597 - protein, 9 aa, Homo Sapiens
GSYFFWLER

SEQ ID NO: 892598 - protein, 9 aa, Homo Sapiens
EIVDFASEL

SEQ ID NO: 892599 - protein, 9 aa, Homo Sapiens
EWYEPQIKD

SEQ ID NO: 892600 - protein, 9 aa, Homo Sapiens
KDVAIELSQ

SEQ ID NO: 892601 - protein, 9 aa, Homo Sapiens
YFALPSVVF

SEQ ID NO: 892602 - protein, 9 aa, Homo Sapiens
DLGCCKVIC

SEQ ID NO: 892603 - protein, 9 aa, Homo Sapiens
PMKPLYWTM

SEQ ID NO: 892604 - protein, 9 aa, Homo Sapiens
ECLPCLQRL

SEQ ID NO: 892605 - protein, 9 aa, Homo Sapiens
QLIRVIIYN

SEQ ID NO: 892606 - protein, 9 aa, Homo Sapiens
KGSKYMSER

SEQ ID NO: 892607 - protein, 9 aa, Homo Sapiens
HQKEICFMI

SEQ ID NO: 892608 - protein, 9 aa, Homo Sapiens
DMKAEDEVD

SEQ ID NO: 892609 - protein, 9 aa, Homo Sapiens
STQVKGSLN

SEQ ID NO: 892610 - protein, 9 aa, Homo Sapiens
PLLGRLCGD

SEQ ID NO: 892611 - protein, 9 aa, Homo Sapiens
EEMLLKQRN

SEQ ID NO: 892612 - protein, 9 aa, Homo Sapiens
MRQKISFGK

SEQ ID NO: 892613 - protein, 9 aa, Homo Sapiens
LVWHQQDWT

SEQ ID NO: 892614 - protein, 9 aa, Homo Sapiens
NLLESTLYE

SEQ ID NO: 892615 - protein, 9 aa, Homo Sapiens
EQEALEDKL

SEQ ID NO: 892616 - protein, 9 aa, Homo Sapiens
KAFEELRSK

SEQ ID NO: 892617 - protein, 9 aa, Homo Sapiens
RDSELSNTD

SEQ ID NO: 892618 - protein, 9 aa, Homo Sapiens
MQFNSFDRS

SEQ ID NO: 892619 - protein, 9 aa, Homo Sapiens
TFIFHSSIQ

SEQ ID NO: 892620 - protein, 9 aa, Homo Sapiens
EGHLLACLQ

SEQ ID NO: 892621 - protein, 9 aa, Homo Sapiens
WECLVHELD

SEQ ID NO: 892622 - protein, 9 aa, Homo Sapiens
VSFSFDVEN

SEQ ID NO: 892623 - protein, 9 aa, Homo Sapiens
QSNHSGEKT

SEQ ID NO: 892624 - protein, 9 aa, Homo Sapiens
RVNKSWRKI

SEQ ID NO: 892625 - protein, 9 aa, Homo Sapiens
WDRPKHEEN

SEQ ID NO: 892626 - protein, 9 aa, Homo Sapiens
GGLVLPSRV

SEQ ID NO: 892627 - protein, 9 aa, Homo Sapiens
KVVTQQIRQ

SEQ ID NO: 892628 - protein, 9 aa, Homo Sapiens
DPSIAPSSQ

SEQ ID NO: 892629 - protein, 9 aa, Homo Sapiens
NYTRCYTCQ

SEQ ID NO: 892630 - protein, 9 aa, Homo Sapiens
NLVCAFIIL

SEQ ID NO: 892631 - protein, 9 aa, Homo Sapiens
IFQIINNTE

SEQ ID NO: 892632 - protein, 9 aa, Homo Sapiens
RKENAYNAS

SEQ ID NO: 892633 - protein, 9 aa, Homo Sapiens
AASLYCPQQ

SEQ ID NO: 892634 - protein, 9 aa, Homo Sapiens
NENPASPPK

SEQ ID NO: 892635 - protein, 9 aa, Homo Sapiens
LHANVVPNA

SEQ ID NO: 892636 - protein, 9 aa, Homo Sapiens
NLKYLIDPK

SEQ ID NO: 892637 - protein, 9 aa, Homo Sapiens
QLRHFSIYF

SEQ ID NO: 892638 - protein, 9 aa, Homo Sapiens
YFQPNGIHV

SEQ ID NO: 892639 - protein, 9 aa, Homo Sapiens
QSRQTRIRG

SEQ ID NO: 892640 - protein, 9 aa, Homo Sapiens
CLVHELDTT

SEQ ID NO: 892641 - protein, 9 aa, Homo Sapiens
LPSICLSNF

SEQ ID NO: 892642 - protein, 9 aa, Homo Sapiens
RLIYWLFII

SEQ ID NO: 892643 - protein, 9 aa, Homo Sapiens
LKTQNDLDI

SEQ ID NO: 892644 - protein, 9 aa, Homo Sapiens
IQKQSICHR

SEQ ID NO: 892645 - protein, 9 aa, Homo Sapiens
QQLELENLT

SEQ ID NO: 892646 - protein, 9 aa, Homo Sapiens
LTVALGFYC

SEQ ID NO: 892647 - protein, 9 aa, Homo Sapiens
VNRIDWPVG

SEQ ID NO: 892648 - protein, 9 aa, Homo Sapiens
CQQFCVRDC

SEQ ID NO: 892649 - protein, 9 aa, Homo Sapiens
SVPLPAEVI

SEQ ID NO: 892650 - protein, 9 aa, Homo Sapiens
RPNKEELDE

SEQ ID NO: 892651 - protein, 9 aa, Homo Sapiens
VSNKINGID

SEQ ID NO: 892652 - protein, 9 aa, Homo Sapiens
PLPAEVIAG

SEQ ID NO: 892653 - protein, 9 aa, Homo Sapiens
SNLVCAFII

SEQ ID NO: 892654 - protein, 9 aa, Homo Sapiens
IQGMQKLLG

SEQ ID NO: 892655 - protein, 9 aa, Homo Sapiens
QLYQPEPLP

SEQ ID NO: 892656 - protein, 9 aa, Homo Sapiens
PYTSAFLPV

SEQ ID NO: 892657 - protein, 9 aa, Homo Sapiens
EKVLFIRLY

SEQ ID NO: 892658 - protein, 9 aa, Homo Sapiens
NIRKNLYVK

SEQ ID NO: 892659 - protein, 9 aa, Homo Sapiens
KLPINGETQ

SEQ ID NO: 892660 - protein, 9 aa, Homo Sapiens
KHSDGRKYP

SEQ ID NO: 892661 - protein, 9 aa, Homo Sapiens
HRRSRSPNK

SEQ ID NO: 892662 - protein, 9 aa, Homo Sapiens
GTSLSDKTV

SEQ ID NO: 892663 - protein, 9 aa, Homo Sapiens
LFDRTETRT

SEQ ID NO: 892664 - protein, 9 aa, Homo Sapiens
DYETLSFKD

SEQ ID NO: 892665 - protein, 9 aa, Homo Sapiens
FTSLLMECL

SEQ ID NO: 892666 - protein, 9 aa, Homo Sapiens
LSVLFIFQI

SEQ ID NO: 892667 - protein, 9 aa, Homo Sapiens
LINERNSGL

SEQ ID NO: 892668 - protein, 9 aa, Homo Sapiens
YNTGKGLFI

SEQ ID NO: 892669 - protein, 9 aa, Homo Sapiens
YFNLQCCVA

SEQ ID NO: 892670 - protein, 9 aa, Homo Sapiens
YFFENEDVC

SEQ ID NO: 892671 - protein, 9 aa, Homo Sapiens
KKKFGADDT

SEQ ID NO: 892672 - protein, 9 aa, Homo Sapiens
TFLSIYNQV

SEQ ID NO: 892673 - protein, 9 aa, Homo Sapiens
VNLLQQYYL

SEQ ID NO: 892674 - protein, 9 aa, Homo Sapiens
PSCAYYMPE

SEQ ID NO: 892675 - protein, 9 aa, Homo Sapiens
RLHQIQHKG

SEQ ID NO: 892676 - protein, 9 aa, Homo Sapiens
KCDPESENK

SEQ ID NO: 892677 - protein, 9 aa, Homo Sapiens
NGYRILSSG

SEQ ID NO: 892678 - protein, 9 aa, Homo Sapiens
KEMATNNPH

SEQ ID NO: 892679 - protein, 9 aa, Homo Sapiens
FDSLEKEEC

SEQ ID NO: 892680 - protein, 9 aa, Homo Sapiens
FKFKAESNL

SEQ ID NO: 892681 - protein, 9 aa, Homo Sapiens
DDIKNALQL

SEQ ID NO: 892682 - protein, 9 aa, Homo Sapiens
GYIGMVVLV

SEQ ID NO: 892683 - protein, 9 aa, Homo Sapiens
GTKIVFVER

SEQ ID NO: 892684 - protein, 9 aa, Homo Sapiens
LCYYKISAN

SEQ ID NO: 892685 - protein, 9 aa, Homo Sapiens
LLDGGLLTP

SEQ ID NO: 892686 - protein, 9 aa, Homo Sapiens
QKQGLFQWL

SEQ ID NO: 892687 - protein, 9 aa, Homo Sapiens
CKLNNGRWH

SEQ ID NO: 892688 - protein, 9 aa, Homo Sapiens
FDQERIVTA

SEQ ID NO: 892689 - protein, 9 aa, Homo Sapiens
DKMKPQEVA

SEQ ID NO: 892690 - protein, 9 aa, Homo Sapiens
VRARRPPKG

SEQ ID NO: 892691 - protein, 9 aa, Homo Sapiens
WKWMLGPVV

SEQ ID NO: 892692 - protein, 9 aa, Homo Sapiens
NTVKCSLYR

SEQ ID NO: 892693 - protein, 9 aa, Homo Sapiens
NNQSINLNH

SEQ ID NO: 892694 - protein, 9 aa, Homo Sapiens
FLFNTKEEI

SEQ ID NO: 892695 - protein, 9 aa, Homo Sapiens
RMRDEKLHK

SEQ ID NO: 892696 - protein, 9 aa, Homo Sapiens
DTLIDEVER

SEQ ID NO: 892697 - protein, 9 aa, Homo Sapiens
DLFDMKPFK

SEQ ID NO: 892698 - protein, 9 aa, Homo Sapiens
LIMKILWDT

SEQ ID NO: 892699 - protein, 9 aa, Homo Sapiens
WPMVLGWLM

SEQ ID NO: 892700 - protein, 9 aa, Homo Sapiens
DIQTGNTRE

SEQ ID NO: 892701 - protein, 9 aa, Homo Sapiens
VIAVVLGAM

SEQ ID NO: 892702 - protein, 9 aa, Homo Sapiens
SQANVQVNK

SEQ ID NO: 892703 - protein, 9 aa, Homo Sapiens
VICDMDTDG

SEQ ID NO: 892704 - protein, 9 aa, Homo Sapiens
ALVIVISMG

SEQ ID NO: 892705 - protein, 9 aa, Homo Sapiens
DQKKYKDES

SEQ ID NO: 892706 - protein, 9 aa, Homo Sapiens
KLLNYQVVR

SEQ ID NO: 892707 - protein, 9 aa, Homo Sapiens
RANCLCYLF

SEQ ID NO: 892708 - protein, 9 aa, Homo Sapiens
VDSNDREII

SEQ ID NO: 892709 - protein, 9 aa, Homo Sapiens
PREVPPRFC

SEQ ID NO: 892710 - protein, 9 aa, Homo Sapiens
TTEGAVDAM

SEQ ID NO: 892711 - protein, 9 aa, Homo Sapiens
PLLKEISDD

SEQ ID NO: 892712 - protein, 9 aa, Homo Sapiens
QEESVNKFL

SEQ ID NO: 892713 - protein, 9 aa, Homo Sapiens
LTEISQRHR

SEQ ID NO: 892714 - protein, 9 aa, Homo Sapiens
VVKVTTERS

SEQ ID NO: 892715 - protein, 9 aa, Homo Sapiens
EINEQEVVD

SEQ ID NO: 892716 - protein, 9 aa, Homo Sapiens
FPELQVQHF

SEQ ID NO: 892717 - protein, 9 aa, Homo Sapiens
HANDLCLAA

SEQ ID NO: 892718 - protein, 9 aa, Homo Sapiens
PDSMFKDQM

SEQ ID NO: 892719 - protein, 9 aa, Homo Sapiens
DQKPDSQMK

SEQ ID NO: 892720 - protein, 9 aa, Homo Sapiens
FNRLYPVAV

SEQ ID NO: 892721 - protein, 9 aa, Homo Sapiens
VCNLCILGE

SEQ ID NO: 892722 - protein, 9 aa, Homo Sapiens
QKDRYTYNN

SEQ ID NO: 892723 - protein, 9 aa, Homo Sapiens
LSQPQKHRE

SEQ ID NO: 892724 - protein, 9 aa, Homo Sapiens
ITYDGSITI

SEQ ID NO: 892725 - protein, 9 aa, Homo Sapiens
HPSYLSGSL

SEQ ID NO: 892726 - protein, 9 aa, Homo Sapiens
LWSQMLKDN

SEQ ID NO: 892727 - protein, 9 aa, Homo Sapiens
QKLTTADDK

SEQ ID NO: 892728 - protein, 9 aa, Homo Sapiens
REFWLYDNH

SEQ ID NO: 892729 - protein, 9 aa, Homo Sapiens
SSSHPQSRS

SEQ ID NO: 892730 - protein, 9 aa, Homo Sapiens
AADFSVSLI

SEQ ID NO: 892731 - protein, 9 aa, Homo Sapiens
DDLEQAAKP

SEQ ID NO: 892732 - protein, 9 aa, Homo Sapiens
TCGQNATKL

SEQ ID NO: 892733 - protein, 9 aa, Homo Sapiens
PGEKGNCSQ

SEQ ID NO: 892734 - protein, 9 aa, Homo Sapiens
YFQFQNLHQ

SEQ ID NO: 892735 - protein, 9 aa, Homo Sapiens
NTLPAQPAG

SEQ ID NO: 892736 - protein, 9 aa, Homo Sapiens
ISFVSAAER

SEQ ID NO: 892737 - protein, 9 aa, Homo Sapiens
HQLVHKGYK

SEQ ID NO: 892738 - protein, 9 aa, Homo Sapiens
QRPKMLKEE

SEQ ID NO: 892739 - protein, 9 aa, Homo Sapiens
GKDAQQRIS

SEQ ID NO: 892740 - protein, 9 aa, Homo Sapiens
LQVRQEPVP

SEQ ID NO: 892741 - protein, 9 aa, Homo Sapiens
SGHMDGKIC

SEQ ID NO: 892742 - protein, 9 aa, Homo Sapiens
PVFPKGNKV

SEQ ID NO: 892743 - protein, 9 aa, Homo Sapiens
QQKAVKLKT

SEQ ID NO: 892744 - protein, 9 aa, Homo Sapiens
FEHSETRGG

SEQ ID NO: 892745 - protein, 9 aa, Homo Sapiens
TRSALRDSA

SEQ ID NO: 892746 - protein, 9 aa, Homo Sapiens
SNVKSFYQT

SEQ ID NO: 892747 - protein, 9 aa, Homo Sapiens
WLEPVWFLR

SEQ ID NO: 892748 - protein, 9 aa, Homo Sapiens
SSNLAIAIT

SEQ ID NO: 892749 - protein, 9 aa, Homo Sapiens
VLSMYEEAF

SEQ ID NO: 892750 - protein, 9 aa, Homo Sapiens
LKEGTQYTL

SEQ ID NO: 892751 - protein, 9 aa, Homo Sapiens
SRKMAFCAK

SEQ ID NO: 892752 - protein, 9 aa, Homo Sapiens
LPQTVISLP

SEQ ID NO: 892753 - protein, 9 aa, Homo Sapiens
SSARNTLMR

SEQ ID NO: 892754 - protein, 9 aa, Homo Sapiens
LSLICAKKR

SEQ ID NO: 892755 - protein, 9 aa, Homo Sapiens
FLLDQNNNA

SEQ ID NO: 892756 - protein, 9 aa, Homo Sapiens
LHVDPDNFL

SEQ ID NO: 892757 - protein, 9 aa, Homo Sapiens
LLIDKFCDP

SEQ ID NO: 892758 - protein, 9 aa, Homo Sapiens
KMASDCLHG

SEQ ID NO: 892759 - protein, 9 aa, Homo Sapiens
NHTTIQSVL

SEQ ID NO: 892760 - protein, 9 aa, Homo Sapiens
TTIQNELAH

SEQ ID NO: 892761 - protein, 9 aa, Homo Sapiens
ILGENGIAN

SEQ ID NO: 892762 - protein, 9 aa, Homo Sapiens
LSMWSVAHA

SEQ ID NO: 892763 - protein, 9 aa, Homo Sapiens
TSSFNFCRE

SEQ ID NO: 892764 - protein, 9 aa, Homo Sapiens
YSNYNWFYG

SEQ ID NO: 892765 - protein, 9 aa, Homo Sapiens
TMINFVRAV

SEQ ID NO: 892766 - protein, 9 aa, Homo Sapiens
LLHKTDSAV

SEQ ID NO: 892767 - protein, 9 aa, Homo Sapiens
VVRFETVNQ

SEQ ID NO: 892768 - protein, 9 aa, Homo Sapiens
KLHPDLVSQ

SEQ ID NO: 892769 - protein, 9 aa, Homo Sapiens
GHTQTNVGE

SEQ ID NO: 892770 - protein, 9 aa, Homo Sapiens
STMANNKGL

SEQ ID NO: 892771 - protein, 9 aa, Homo Sapiens
KLTYAETKA

SEQ ID NO: 892772 - protein, 9 aa, Homo Sapiens
PGNTYHLGL

SEQ ID NO: 892773 - protein, 9 aa, Homo Sapiens
LTQEQWVRL

SEQ ID NO: 892774 - protein, 9 aa, Homo Sapiens
VECGTVWDS

SEQ ID NO: 892775 - protein, 9 aa, Homo Sapiens
EMAFFGTST

SEQ ID NO: 892776 - protein, 9 aa, Homo Sapiens
WALITIAVV

SEQ ID NO: 892777 - protein, 9 aa, Homo Sapiens
RKQKEKLWQ

SEQ ID NO: 892778 - protein, 9 aa, Homo Sapiens
DSGEEECRP

SEQ ID NO: 892779 - protein, 9 aa, Homo Sapiens
SQLQNRLLF

SEQ ID NO: 892780 - protein, 9 aa, Homo Sapiens
RDLCQLPGR

SEQ ID NO: 892781 - protein, 9 aa, Homo Sapiens
SKIWAFMMC

SEQ ID NO: 892782 - protein, 9 aa, Homo Sapiens
VFNLSSERN

SEQ ID NO: 892783 - protein, 9 aa, Homo Sapiens
ASHFDKLMD

SEQ ID NO: 892784 - protein, 9 aa, Homo Sapiens
FCSIECYSI

SEQ ID NO: 892785 - protein, 9 aa, Homo Sapiens
NCIQVHDQV

SEQ ID NO: 892786 - protein, 9 aa, Homo Sapiens
IGRELNPQI

SEQ ID NO: 892787 - protein, 9 aa, Homo Sapiens
HLASGDQSG

SEQ ID NO: 892788 - protein, 9 aa, Homo Sapiens
PHPRIKPSP

SEQ ID NO: 892789 - protein, 9 aa, Homo Sapiens
IRVIIYNRT

SEQ ID NO: 892790 - protein, 9 aa, Homo Sapiens
KGKQAPKGQ

SEQ ID NO: 892791 - protein, 9 aa, Homo Sapiens
STASSLLQK

SEQ ID NO: 892792 - protein, 9 aa, Homo Sapiens
PVLIVQRWM

SEQ ID NO: 892793 - protein, 9 aa, Homo Sapiens
NDQLRIYFP

SEQ ID NO: 892794 - protein, 9 aa, Homo Sapiens
CFGRHYDHN

SEQ ID NO: 892795 - protein, 9 aa, Homo Sapiens
ETGTPQPGG

SEQ ID NO: 892796 - protein, 9 aa, Homo Sapiens
CNFILENPD

SEQ ID NO: 892797 - protein, 9 aa, Homo Sapiens
AFLGSIILI

SEQ ID NO: 892798 - protein, 9 aa, Homo Sapiens
HRRVYTGEK

SEQ ID NO: 892799 - protein, 9 aa, Homo Sapiens
CQTPVLASS

SEQ ID NO: 892800 - protein, 9 aa, Homo Sapiens
DRNLLQIRE

SEQ ID NO: 892801 - protein, 9 aa, Homo Sapiens
TIHRRVYTG

SEQ ID NO: 892802 - protein, 9 aa, Homo Sapiens
CKEKCEGFK

SEQ ID NO: 892803 - protein, 9 aa, Homo Sapiens
TKATDVYIQ

SEQ ID NO: 892804 - protein, 9 aa, Homo Sapiens
LKGTTTWEK

SEQ ID NO: 892805 - protein, 9 aa, Homo Sapiens
FNQSSNLIH

SEQ ID NO: 892806 - protein, 9 aa, Homo Sapiens
KGFTEVKLQ

SEQ ID NO: 892807 - protein, 9 aa, Homo Sapiens
NFYVQTYQK

SEQ ID NO: 892808 - protein, 9 aa, Homo Sapiens
ELYHSSEVR

SEQ ID NO: 892809 - protein, 9 aa, Homo Sapiens
PKRQTRKSI

SEQ ID NO: 892810 - protein, 9 aa, Homo Sapiens
HETLLDIEN

SEQ ID NO: 892811 - protein, 9 aa, Homo Sapiens
PCSTLTSSA

SEQ ID NO: 892812 - protein, 9 aa, Homo Sapiens
FCGFLFSGA

SEQ ID NO: 892813 - protein, 9 aa, Homo Sapiens
SWYLKEIES

SEQ ID NO: 892814 - protein, 9 aa, Homo Sapiens
YSSTMANNK

SEQ ID NO: 892815 - protein, 9 aa, Homo Sapiens
DVTETNNSP

SEQ ID NO: 892816 - protein, 9 aa, Homo Sapiens
LHLIQHKRI

SEQ ID NO: 892817 - protein, 9 aa, Homo Sapiens
MLLHFGQMP

SEQ ID NO: 892818 - protein, 9 aa, Homo Sapiens
KSIVLNCKA

SEQ ID NO: 892819 - protein, 9 aa, Homo Sapiens
VSPQNSLEV

SEQ ID NO: 892820 - protein, 9 aa, Homo Sapiens
LLPHETLLD

SEQ ID NO: 892821 - protein, 9 aa, Homo Sapiens
KIGFAIGMP

SEQ ID NO: 892822 - protein, 9 aa, Homo Sapiens
FKLTSVEKS

SEQ ID NO: 892823 - protein, 9 aa, Homo Sapiens
EEAEEEVKN

SEQ ID NO: 892824 - protein, 9 aa, Homo Sapiens
QIHHPSLPA

SEQ ID NO: 892825 - protein, 9 aa, Homo Sapiens
RDAVEDNRI

SEQ ID NO: 892826 - protein, 9 aa, Homo Sapiens
NTDNNTQNG

SEQ ID NO: 892827 - protein, 9 aa, Homo Sapiens
LMQKHFLPH

SEQ ID NO: 892828 - protein, 9 aa, Homo Sapiens
KHLAFLLGL

SEQ ID NO: 892829 - protein, 9 aa, Homo Sapiens
KDIEEELER

SEQ ID NO: 892830 - protein, 9 aa, Homo Sapiens
LCALDYLYY

SEQ ID NO: 892831 - protein, 9 aa, Homo Sapiens
GLAEMAGQI

SEQ ID NO: 892832 - protein, 9 aa, Homo Sapiens
PDLLVLTVY

SEQ ID NO: 892833 - protein, 9 aa, Homo Sapiens
WLYLGYVGN

SEQ ID NO: 892834 - protein, 9 aa, Homo Sapiens
SFTNAIQDK

SEQ ID NO: 892835 - protein, 9 aa, Homo Sapiens
EPEEEENTC

SEQ ID NO: 892836 - protein, 9 aa, Homo Sapiens
GAQGVPFAC

SEQ ID NO: 892837 - protein, 9 aa, Homo Sapiens
KTSKRFSSL

SEQ ID NO: 892838 - protein, 9 aa, Homo Sapiens
GNKSKGEHV

SEQ ID NO: 892839 - protein, 9 aa, Homo Sapiens
FLSTPMGKG

SEQ ID NO: 892840 - protein, 9 aa, Homo Sapiens
GAAAVGTKS

SEQ ID NO: 892841 - protein, 9 aa, Homo Sapiens
HIKSTKNIN

SEQ ID NO: 892842 - protein, 9 aa, Homo Sapiens
DFLPSQPRY

SEQ ID NO: 892843 - protein, 9 aa, Homo Sapiens
AVKRIWSTV

SEQ ID NO: 892844 - protein, 9 aa, Homo Sapiens
GASCHPEGI

SEQ ID NO: 892845 - protein, 9 aa, Homo Sapiens
LEQEKVVTQ

SEQ ID NO: 892846 - protein, 9 aa, Homo Sapiens
PVFLQTVSL

SEQ ID NO: 892847 - protein, 9 aa, Homo Sapiens
GFLIEVNNE

SEQ ID NO: 892848 - protein, 9 aa, Homo Sapiens
FKTFSQGPT

SEQ ID NO: 892849 - protein, 9 aa, Homo Sapiens
LETLCTPST

SEQ ID NO: 892850 - protein, 9 aa, Homo Sapiens
DLEPGTMDL

SEQ ID NO: 892851 - protein, 9 aa, Homo Sapiens
IKRNPDLQK

SEQ ID NO: 892852 - protein, 9 aa, Homo Sapiens
QFFKVARAK

SEQ ID NO: 892853 - protein, 9 aa, Homo Sapiens
ANLTFEQLC

SEQ ID NO: 892854 - protein, 9 aa, Homo Sapiens
SEKNNLTLS

SEQ ID NO: 892855 - protein, 9 aa, Homo Sapiens
KCKLCCWTF

SEQ ID NO: 892856 - protein, 9 aa, Homo Sapiens
TRKHSDGRK

SEQ ID NO: 892857 - protein, 9 aa, Homo Sapiens
MDLLSGKYV

SEQ ID NO: 892858 - protein, 9 aa, Homo Sapiens
WSSLDASTQ

SEQ ID NO: 892859 - protein, 9 aa, Homo Sapiens
EDYKGAPWN

SEQ ID NO: 892860 - protein, 9 aa, Homo Sapiens
TINLHVVIL

SEQ ID NO: 892861 - protein, 9 aa, Homo Sapiens
CLHYQNQRF

SEQ ID NO: 892862 - protein, 9 aa, Homo Sapiens
VTMAYDRYV

SEQ ID NO: 892863 - protein, 9 aa, Homo Sapiens
NKLLKQKEN

SEQ ID NO: 892864 - protein, 9 aa, Homo Sapiens
EQIDTPPAC

SEQ ID NO: 892865 - protein, 9 aa, Homo Sapiens
QILETISQP

SEQ ID NO: 892866 - protein, 9 aa, Homo Sapiens
KTKEMATNN

SEQ ID NO: 892867 - protein, 9 aa, Homo Sapiens
LHLPSERLD

SEQ ID NO: 892868 - protein, 9 aa, Homo Sapiens
SVWDQDREG

SEQ ID NO: 892869 - protein, 9 aa, Homo Sapiens
KKWPMRSCL

SEQ ID NO: 892870 - protein, 9 aa, Homo Sapiens
QNGSAAMYS

SEQ ID NO: 892871 - protein, 9 aa, Homo Sapiens
RHGCLGLEL

SEQ ID NO: 892872 - protein, 9 aa, Homo Sapiens
EQYKLPFLS

SEQ ID NO: 892873 - protein, 9 aa, Homo Sapiens
LASFLMPSD

SEQ ID NO: 892874 - protein, 9 aa, Homo Sapiens
KAQNDEYEN

SEQ ID NO: 892875 - protein, 9 aa, Homo Sapiens
GHPNLIMGF

SEQ ID NO: 892876 - protein, 9 aa, Homo Sapiens
EVVGSYLSV

SEQ ID NO: 892877 - protein, 9 aa, Homo Sapiens
KRIQMDSYT

SEQ ID NO: 892878 - protein, 9 aa, Homo Sapiens
WEQDISLQG

SEQ ID NO: 892879 - protein, 9 aa, Homo Sapiens
EAVTKTLSD

SEQ ID NO: 892880 - protein, 9 aa, Homo Sapiens
SCLTRHQII

SEQ ID NO: 892881 - protein, 9 aa, Homo Sapiens
GISDTLIQL

SEQ ID NO: 892882 - protein, 9 aa, Homo Sapiens
VMSLYMVNS

SEQ ID NO: 892883 - protein, 9 aa, Homo Sapiens
QTRELRLTK

SEQ ID NO: 892884 - protein, 9 aa, Homo Sapiens
VRKKDHEPL

SEQ ID NO: 892885 - protein, 9 aa, Homo Sapiens
EDKQLLYDF

SEQ ID NO: 892886 - protein, 9 aa, Homo Sapiens
KGFNLPNSI

SEQ ID NO: 892887 - protein, 9 aa, Homo Sapiens
QAKKIMVES

SEQ ID NO: 892888 - protein, 9 aa, Homo Sapiens
AARLVPPQN

SEQ ID NO: 892889 - protein, 9 aa, Homo Sapiens
DIHPHMVKE

SEQ ID NO: 892890 - protein, 9 aa, Homo Sapiens
LGVVQIYHR

SEQ ID NO: 892891 - protein, 9 aa, Homo Sapiens
VAGTLVVAV

SEQ ID NO: 892892 - protein, 9 aa, Homo Sapiens
RLNLTQHIR

SEQ ID NO: 892893 - protein, 9 aa, Homo Sapiens
VIGMPVATK

SEQ ID NO: 892894 - protein, 9 aa, Homo Sapiens
VLQARVAEL

SEQ ID NO: 892895 - protein, 9 aa, Homo Sapiens
CFAFVFSVL

SEQ ID NO: 892896 - protein, 9 aa, Homo Sapiens
RLTVQQVEE

SEQ ID NO: 892897 - protein, 9 aa, Homo Sapiens
MKFCSLAVL

SEQ ID NO: 892898 - protein, 9 aa, Homo Sapiens
LKRIMAHKW

SEQ ID NO: 892899 - protein, 9 aa, Homo Sapiens
VKVQNLDCY

SEQ ID NO: 892900 - protein, 9 aa, Homo Sapiens
FILSFILRI

SEQ ID NO: 892901 - protein, 9 aa, Homo Sapiens
TRPYLFSNS

SEQ ID NO: 892902 - protein, 9 aa, Homo Sapiens
SCEQNLNHN

SEQ ID NO: 892903 - protein, 9 aa, Homo Sapiens
DMEKWVEDI

SEQ ID NO: 892904 - protein, 9 aa, Homo Sapiens
CTNHEIPHF

SEQ ID NO: 892905 - protein, 9 aa, Homo Sapiens
VQTYQKKPM

SEQ ID NO: 892906 - protein, 9 aa, Homo Sapiens
AKDFLDLIF

SEQ ID NO: 892907 - protein, 9 aa, Homo Sapiens
AVAELRAHR

SEQ ID NO: 892908 - protein, 9 aa, Homo Sapiens
LNRVQLSRH

SEQ ID NO: 892909 - protein, 9 aa, Homo Sapiens
DELDNAYTG

SEQ ID NO: 892910 - protein, 9 aa, Homo Sapiens
NKTCQLPSI

SEQ ID NO: 892911 - protein, 9 aa, Homo Sapiens
QGKFIYLFY

SEQ ID NO: 892912 - protein, 9 aa, Homo Sapiens
CGKTFTVCS

SEQ ID NO: 892913 - protein, 9 aa, Homo Sapiens
QRLIQNAND

SEQ ID NO: 892914 - protein, 9 aa, Homo Sapiens
PELLCIHGG

SEQ ID NO: 892915 - protein, 9 aa, Homo Sapiens
SSFHHQINI

SEQ ID NO: 892916 - protein, 9 aa, Homo Sapiens
AIKTNDPGV

SEQ ID NO: 892917 - protein, 9 aa, Homo Sapiens
CNGLEEEEE

SEQ ID NO: 892918 - protein, 9 aa, Homo Sapiens
ANQHCVCRE

SEQ ID NO: 892919 - protein, 9 aa, Homo Sapiens
INKNRNAVP

SEQ ID NO: 892920 - protein, 9 aa, Homo Sapiens
TKLCKFFHP

SEQ ID NO: 892921 - protein, 9 aa, Homo Sapiens
AMHKVFLQR

SEQ ID NO: 892922 - protein, 9 aa, Homo Sapiens
LRLPCHNFA

SEQ ID NO: 892923 - protein, 9 aa, Homo Sapiens
IKQFLLNYL

SEQ ID NO: 892924 - protein, 9 aa, Homo Sapiens
GNSLSKLSE

SEQ ID NO: 892925 - protein, 9 aa, Homo Sapiens
VEVTECSNG

SEQ ID NO: 892926 - protein, 9 aa, Homo Sapiens
YFHKVCDGE

SEQ ID NO: 892927 - protein, 9 aa, Homo Sapiens
LPRRPHNRD

SEQ ID NO: 892928 - protein, 9 aa, Homo Sapiens
KDPSLCMFF

SEQ ID NO: 892929 - protein, 9 aa, Homo Sapiens
EKKCILHCL

SEQ ID NO: 892930 - protein, 9 aa, Homo Sapiens
KKRLCLAEM

SEQ ID NO: 892931 - protein, 9 aa, Homo Sapiens
MSELWCMER

SEQ ID NO: 892932 - protein, 9 aa, Homo Sapiens
GAAPVATGS

SEQ ID NO: 892933 - protein, 9 aa, Homo Sapiens
TTYFCPVLA

SEQ ID NO: 892934 - protein, 9 aa, Homo Sapiens
MMGIIKRNE

SEQ ID NO: 892935 - protein, 9 aa, Homo Sapiens
EVVQILYQR

SEQ ID NO: 892936 - protein, 9 aa, Homo Sapiens
PYNQAVSLD

SEQ ID NO: 892937 - protein, 9 aa, Homo Sapiens
IWQFKQREW

SEQ ID NO: 892938 - protein, 9 aa, Homo Sapiens
CLLEGEEQR

SEQ ID NO: 892939 - protein, 9 aa, Homo Sapiens
TKPRGNEEA

SEQ ID NO: 892940 - protein, 9 aa, Homo Sapiens
FTESQPIDL

SEQ ID NO: 892941 - protein, 9 aa, Homo Sapiens
DHSILWDTI

SEQ ID NO: 892942 - protein, 9 aa, Homo Sapiens
KNKLGQMRS

SEQ ID NO: 892943 - protein, 9 aa, Homo Sapiens
RGIVFLDTS

SEQ ID NO: 892944 - protein, 9 aa, Homo Sapiens
NIFYLSKEE

SEQ ID NO: 892945 - protein, 9 aa, Homo Sapiens
SHWVVQAWT

SEQ ID NO: 892946 - protein, 9 aa, Homo Sapiens
QKARQHMEV

SEQ ID NO: 892947 - protein, 9 aa, Homo Sapiens
LACMVDILA

SEQ ID NO: 892948 - protein, 9 aa, Homo Sapiens
DKPFECNEC

SEQ ID NO: 892949 - protein, 9 aa, Homo Sapiens
NMLVMGEGP

SEQ ID NO: 892950 - protein, 9 aa, Homo Sapiens
LSKDKISAL

SEQ ID NO: 892951 - protein, 9 aa, Homo Sapiens
RQCQLNVLD

SEQ ID NO: 892952 - protein, 9 aa, Homo Sapiens
EQLHVNISD

SEQ ID NO: 892953 - protein, 9 aa, Homo Sapiens
KEAKGLLYE

SEQ ID NO: 892954 - protein, 9 aa, Homo Sapiens
AINKYPTKD

SEQ ID NO: 892955 - protein, 9 aa, Homo Sapiens
DINTISPTL

SEQ ID NO: 892956 - protein, 9 aa, Homo Sapiens
TFNLMEDRM

SEQ ID NO: 892957 - protein, 9 aa, Homo Sapiens
SAASPPASS

SEQ ID NO: 892958 - protein, 9 aa, Homo Sapiens
AVGVFRSDS

SEQ ID NO: 892959 - protein, 9 aa, Homo Sapiens
FTEVKLQNG

SEQ ID NO: 892960 - protein, 9 aa, Homo Sapiens
RNPINVIYV

SEQ ID NO: 892961 - protein, 9 aa, Homo Sapiens
VATFIYAEI

SEQ ID NO: 892962 - protein, 9 aa, Homo Sapiens
EKVLVVFLE

SEQ ID NO: 892963 - protein, 9 aa, Homo Sapiens
RLRNLILDS

SEQ ID NO: 892964 - protein, 9 aa, Homo Sapiens
QELLQSNEQ

SEQ ID NO: 892965 - protein, 9 aa, Homo Sapiens
LKRAANIAE

SEQ ID NO: 892966 - protein, 9 aa, Homo Sapiens
DLKKRRWAQ

SEQ ID NO: 892967 - protein, 9 aa, Homo Sapiens
AEPTEHGES

SEQ ID NO: 892968 - protein, 9 aa, Homo Sapiens
AGVKQIALL

SEQ ID NO: 892969 - protein, 9 aa, Homo Sapiens
SDPLLSVFM

SEQ ID NO: 892970 - protein, 9 aa, Homo Sapiens
QVLHNMVHC

SEQ ID NO: 892971 - protein, 9 aa, Homo Sapiens
YSYLWTCPA

SEQ ID NO: 892972 - protein, 9 aa, Homo Sapiens
KKEKRRLNT

SEQ ID NO: 892973 - protein, 9 aa, Homo Sapiens
LNSSKPVSY

SEQ ID NO: 892974 - protein, 9 aa, Homo Sapiens
DINKIYDEA

SEQ ID NO: 892975 - protein, 9 aa, Homo Sapiens
RKGNMTLLP

SEQ ID NO: 892976 - protein, 9 aa, Homo Sapiens
KAKYLCIAE

SEQ ID NO: 892977 - protein, 9 aa, Homo Sapiens
LKIRYLPKG

SEQ ID NO: 892978 - protein, 9 aa, Homo Sapiens
HVDPDNFLL

SEQ ID NO: 892979 - protein, 9 aa, Homo Sapiens
HLFLTNESG

SEQ ID NO: 892980 - protein, 9 aa, Homo Sapiens
SLMTHMIIH

SEQ ID NO: 892981 - protein, 9 aa, Homo Sapiens
KSIPKSGGS

SEQ ID NO: 892982 - protein, 9 aa, Homo Sapiens
GTICDNRWE

SEQ ID NO: 892983 - protein, 9 aa, Homo Sapiens
RSVLAWHSQ

SEQ ID NO: 892984 - protein, 9 aa, Homo Sapiens
FRGQPGSGF

SEQ ID NO: 892985 - protein, 9 aa, Homo Sapiens
FRPQNELIP

SEQ ID NO: 892986 - protein, 9 aa, Homo Sapiens
LIVGRPRPN

SEQ ID NO: 892987 - protein, 9 aa, Homo Sapiens
IQWPNEITL

SEQ ID NO: 892988 - protein, 9 aa, Homo Sapiens
FHSLMLYHK

SEQ ID NO: 892989 - protein, 9 aa, Homo Sapiens
ADVLSEKKT

SEQ ID NO: 892990 - protein, 9 aa, Homo Sapiens
YAWAVQNIQ

SEQ ID NO: 892991 - protein, 9 aa, Homo Sapiens
VLVSYLNIV

SEQ ID NO: 892992 - protein, 9 aa, Homo Sapiens
CVPDVLPQA

SEQ ID NO: 892993 - protein, 9 aa, Homo Sapiens
SAGGRGTRF

SEQ ID NO: 892994 - protein, 9 aa, Homo Sapiens
WFQTYLHSS

SEQ ID NO: 892995 - protein, 9 aa, Homo Sapiens
SVQASTGPP

SEQ ID NO: 892996 - protein, 9 aa, Homo Sapiens
VPNWIFHLT

SEQ ID NO: 892997 - protein, 9 aa, Homo Sapiens
AITNIAKYQ

SEQ ID NO: 892998 - protein, 9 aa, Homo Sapiens
GSNSQVQFT

SEQ ID NO: 892999 - protein, 9 aa, Homo Sapiens
YWGKYGPQW

SEQ ID NO: 893000 - protein, 9 aa, Homo Sapiens
YQGNISKAC

SEQ ID NO: 893001 - protein, 9 aa, Homo Sapiens
KSLLVVHQQ

SEQ ID NO: 893002 - protein, 9 aa, Homo Sapiens
REEAILNMV

SEQ ID NO: 893003 - protein, 9 aa, Homo Sapiens
LQTLQPWSD

SEQ ID NO: 893004 - protein, 9 aa, Homo Sapiens
QRLQNLVDK

SEQ ID NO: 893005 - protein, 9 aa, Homo Sapiens
LYLQQTLNY

SEQ ID NO: 893006 - protein, 9 aa, Homo Sapiens
EKMCLKASL

SEQ ID NO: 893007 - protein, 9 aa, Homo Sapiens
GTAEPITVK

SEQ ID NO: 893008 - protein, 9 aa, Homo Sapiens
ALEDLENTA

SEQ ID NO: 893009 - protein, 9 aa, Homo Sapiens
ISERRIKRL

SEQ ID NO: 893010 - protein, 9 aa, Homo Sapiens
KHQRCYDEL

SEQ ID NO: 893011 - protein, 9 aa, Homo Sapiens
LISEDKKDK

SEQ ID NO: 893012 - protein, 9 aa, Homo Sapiens
KCQKLTNDH

SEQ ID NO: 893013 - protein, 9 aa, Homo Sapiens
YLATWFFIN

SEQ ID NO: 893014 - protein, 9 aa, Homo Sapiens
IDNGFFYPK

SEQ ID NO: 893015 - protein, 9 aa, Homo Sapiens
TSFDEFIKI

SEQ ID NO: 893016 - protein, 9 aa, Homo Sapiens
GSASSTGGG

SEQ ID NO: 893017 - protein, 9 aa, Homo Sapiens
KKPQELKEI

SEQ ID NO: 893018 - protein, 9 aa, Homo Sapiens
VDENFRPQN

SEQ ID NO: 893019 - protein, 9 aa, Homo Sapiens
PLNGFKSNG

SEQ ID NO: 893020 - protein, 9 aa, Homo Sapiens
SKDQQNILA

SEQ ID NO: 893021 - protein, 9 aa, Homo Sapiens
NNRCNNLGY

SEQ ID NO: 893022 - protein, 9 aa, Homo Sapiens
KEVVDCIIF

SEQ ID NO: 893023 - protein, 9 aa, Homo Sapiens
QENLGAHIK

SEQ ID NO: 893024 - protein, 9 aa, Homo Sapiens
PSWTFKHLV

SEQ ID NO: 893025 - protein, 9 aa, Homo Sapiens
IGLDKIIIL

SEQ ID NO: 893026 - protein, 9 aa, Homo Sapiens
PIDLGAMPY

SEQ ID NO: 893027 - protein, 9 aa, Homo Sapiens
RQIKLYSSI

SEQ ID NO: 893028 - protein, 9 aa, Homo Sapiens
GRKSQQLSD

SEQ ID NO: 893029 - protein, 9 aa, Homo Sapiens
SLTKNSVWI

SEQ ID NO: 893030 - protein, 9 aa, Homo Sapiens
NDIANLFSP

SEQ ID NO: 893031 - protein, 9 aa, Homo Sapiens
FRDNFESMY

SEQ ID NO: 893032 - protein, 9 aa, Homo Sapiens
DNCRPDGRE

SEQ ID NO: 893033 - protein, 9 aa, Homo Sapiens
RGDPVYCLL

SEQ ID NO: 893034 - protein, 9 aa, Homo Sapiens
IRIHEITHT

SEQ ID NO: 893035 - protein, 9 aa, Homo Sapiens
IIRVILKYL

SEQ ID NO: 893036 - protein, 9 aa, Homo Sapiens
KMIKNFDRD

SEQ ID NO: 893037 - protein, 9 aa, Homo Sapiens
DAWMDTHPK

SEQ ID NO: 893038 - protein, 9 aa, Homo Sapiens
ECIRLCRAL

SEQ ID NO: 893039 - protein, 9 aa, Homo Sapiens
YIDAEDVLD

SEQ ID NO: 893040 - protein, 9 aa, Homo Sapiens
DYLKVLEKQ

SEQ ID NO: 893041 - protein, 9 aa, Homo Sapiens
HPLFWEINW

SEQ ID NO: 893042 - protein, 9 aa, Homo Sapiens
DAEEVVKVT

SEQ ID NO: 893043 - protein, 9 aa, Homo Sapiens
KEDKKPKEK

SEQ ID NO: 893044 - protein, 9 aa, Homo Sapiens
NSTGYYDQE

SEQ ID NO: 893045 - protein, 9 aa, Homo Sapiens
KWVLLDQTR

SEQ ID NO: 893046 - protein, 9 aa, Homo Sapiens
YSAIGPRSP

SEQ ID NO: 893047 - protein, 9 aa, Homo Sapiens
YEGINSPSV

SEQ ID NO: 893048 - protein, 9 aa, Homo Sapiens
SKLHKFKIK

SEQ ID NO: 893049 - protein, 9 aa, Homo Sapiens
KKDEEFQQT

SEQ ID NO: 893050 - protein, 9 aa, Homo Sapiens
IVGSLPRYF

SEQ ID NO: 893051 - protein, 9 aa, Homo Sapiens
AAKTLEVTV

SEQ ID NO: 893052 - protein, 9 aa, Homo Sapiens
TCRLGEQLQ

SEQ ID NO: 893053 - protein, 9 aa, Homo Sapiens
LITIHDQKE

SEQ ID NO: 893054 - protein, 9 aa, Homo Sapiens
ACAARLANL

SEQ ID NO: 893055 - protein, 9 aa, Homo Sapiens
MVQNENYNR

SEQ ID NO: 893056 - protein, 9 aa, Homo Sapiens
IWRRRPTPA

SEQ ID NO: 893057 - protein, 9 aa, Homo Sapiens
KFMHETHDG

SEQ ID NO: 893058 - protein, 9 aa, Homo Sapiens
TGLHTGDKP

SEQ ID NO: 893059 - protein, 9 aa, Homo Sapiens
PLLWIRIYP

SEQ ID NO: 893060 - protein, 9 aa, Homo Sapiens
YGQAFGEYA

SEQ ID NO: 893061 - protein, 9 aa, Homo Sapiens
EILQLLTEW

SEQ ID NO: 893062 - protein, 9 aa, Homo Sapiens
YQTEFQALK

SEQ ID NO: 893063 - protein, 9 aa, Homo Sapiens
QKSVDAGVS

SEQ ID NO: 893064 - protein, 9 aa, Homo Sapiens
FNRRIQNEK

SEQ ID NO: 893065 - protein, 9 aa, Homo Sapiens
RFSADEQLF

SEQ ID NO: 893066 - protein, 9 aa, Homo Sapiens
TMEAVLSVP

SEQ ID NO: 893067 - protein, 9 aa, Homo Sapiens
DVKYALQRT

SEQ ID NO: 893068 - protein, 9 aa, Homo Sapiens
IFCFIEVNT

SEQ ID NO: 893069 - protein, 9 aa, Homo Sapiens
LKNEQFLLH

SEQ ID NO: 893070 - protein, 9 aa, Homo Sapiens
NPTAAGTER

SEQ ID NO: 893071 - protein, 9 aa, Homo Sapiens
AKHIKGEQE

SEQ ID NO: 893072 - protein, 9 aa, Homo Sapiens
EIPDHELFT

SEQ ID NO: 893073 - protein, 9 aa, Homo Sapiens
KDKLTPLHC

SEQ ID NO: 893074 - protein, 9 aa, Homo Sapiens
NGFFYPKQP

SEQ ID NO: 893075 - protein, 9 aa, Homo Sapiens
KIHLQGQTL

SEQ ID NO: 893076 - protein, 9 aa, Homo Sapiens
TPSAVCGFQ

SEQ ID NO: 893077 - protein, 9 aa, Homo Sapiens
KGFSQSLHL

SEQ ID NO: 893078 - protein, 9 aa, Homo Sapiens
ILENPDYPK

SEQ ID NO: 893079 - protein, 9 aa, Homo Sapiens
KSSCFIKWG

SEQ ID NO: 893080 - protein, 9 aa, Homo Sapiens
LWHWLQETH

SEQ ID NO: 893081 - protein, 9 aa, Homo Sapiens
LEKQTVKYH

SEQ ID NO: 893082 - protein, 9 aa, Homo Sapiens
EIIGYTHML

SEQ ID NO: 893083 - protein, 9 aa, Homo Sapiens
RGIIPRAFK

SEQ ID NO: 893084 - protein, 9 aa, Homo Sapiens
IKRICVGEN

SEQ ID NO: 893085 - protein, 9 aa, Homo Sapiens
YLVACTWAG

SEQ ID NO: 893086 - protein, 9 aa, Homo Sapiens
VQDPQHEII

SEQ ID NO: 893087 - protein, 9 aa, Homo Sapiens
ITCSATAHP

SEQ ID NO: 893088 - protein, 9 aa, Homo Sapiens
FAIEREFLF

SEQ ID NO: 893089 - protein, 9 aa, Homo Sapiens
NMKVTLKEL

SEQ ID NO: 893090 - protein, 9 aa, Homo Sapiens
FLATNMISI

SEQ ID NO: 893091 - protein, 9 aa, Homo Sapiens
QDCPDGSDD

SEQ ID NO: 893092 - protein, 9 aa, Homo Sapiens
QYQFGITKV

SEQ ID NO: 893093 - protein, 9 aa, Homo Sapiens
LTLPVLPPK

SEQ ID NO: 893094 - protein, 9 aa, Homo Sapiens
FAEARINMV

SEQ ID NO: 893095 - protein, 9 aa, Homo Sapiens
QPLRNQVVI

SEQ ID NO: 893096 - protein, 9 aa, Homo Sapiens
LGYAEKQIQ

SEQ ID NO: 893097 - protein, 9 aa, Homo Sapiens
PWKISLSSH

SEQ ID NO: 893098 - protein, 9 aa, Homo Sapiens
GAHPKGYVG

SEQ ID NO: 893099 - protein, 9 aa, Homo Sapiens
MLNEFSHAI

SEQ ID NO: 893100 - protein, 9 aa, Homo Sapiens
IMNGHGGGQ

SEQ ID NO: 893101 - protein, 9 aa, Homo Sapiens
PPLLENPMV

SEQ ID NO: 893102 - protein, 9 aa, Homo Sapiens
RLCTLPNYT

SEQ ID NO: 893103 - protein, 9 aa, Homo Sapiens
QSSNLIHHQ

SEQ ID NO: 893104 - protein, 9 aa, Homo Sapiens
ADYSYWALG

SEQ ID NO: 893105 - protein, 9 aa, Homo Sapiens
PSYIMSGPN

SEQ ID NO: 893106 - protein, 9 aa, Homo Sapiens
IFCQTRQNA

SEQ ID NO: 893107 - protein, 9 aa, Homo Sapiens
KETAGDKLG

SEQ ID NO: 893108 - protein, 9 aa, Homo Sapiens
AQQWLHQNR

SEQ ID NO: 893109 - protein, 9 aa, Homo Sapiens
PCYEGTDWL

SEQ ID NO: 893110 - protein, 9 aa, Homo Sapiens
TLLIHTGFD

SEQ ID NO: 893111 - protein, 9 aa, Homo Sapiens
YLYQNAVQQ

SEQ ID NO: 893112 - protein, 9 aa, Homo Sapiens
LITGKIVGH

SEQ ID NO: 893113 - protein, 9 aa, Homo Sapiens
CRGQVLLWS

SEQ ID NO: 893114 - protein, 9 aa, Homo Sapiens
RVSVHCKKE

SEQ ID NO: 893115 - protein, 9 aa, Homo Sapiens
SGLWSQAHF

SEQ ID NO: 893116 - protein, 9 aa, Homo Sapiens
DMDENIRYK

SEQ ID NO: 893117 - protein, 9 aa, Homo Sapiens
CKRGNVGFK

SEQ ID NO: 893118 - protein, 9 aa, Homo Sapiens
TTTTIFTTL

SEQ ID NO: 893119 - protein, 9 aa, Homo Sapiens
QDLGDVMKM

SEQ ID NO: 893120 - protein, 9 aa, Homo Sapiens
YTMTLLDVF

SEQ ID NO: 893121 - protein, 9 aa, Homo Sapiens
VSDACTSTS

SEQ ID NO: 893122 - protein, 9 aa, Homo Sapiens
DNHDCSQGL

SEQ ID NO: 893123 - protein, 9 aa, Homo Sapiens
SESLKSNFT

SEQ ID NO: 893124 - protein, 9 aa, Homo Sapiens
KDLFTSLSA

SEQ ID NO: 893125 - protein, 9 aa, Homo Sapiens
PPEQAPPYP

SEQ ID NO: 893126 - protein, 9 aa, Homo Sapiens
SWHRLKHKR

SEQ ID NO: 893127 - protein, 9 aa, Homo Sapiens
LDPDMALCQ

SEQ ID NO: 893128 - protein, 9 aa, Homo Sapiens
RKTKQVITF

SEQ ID NO: 893129 - protein, 9 aa, Homo Sapiens
MLCAGFHEG

SEQ ID NO: 893130 - protein, 9 aa, Homo Sapiens
HLPSERLDF

SEQ ID NO: 893131 - protein, 9 aa, Homo Sapiens
IIHFKKELQ

SEQ ID NO: 893132 - protein, 9 aa, Homo Sapiens
LTYHRIYLP

SEQ ID NO: 893133 - protein, 9 aa, Homo Sapiens
IEHIDACLN

SEQ ID NO: 893134 - protein, 9 aa, Homo Sapiens
AAECLQTKL

SEQ ID NO: 893135 - protein, 9 aa, Homo Sapiens
WHWLQETHK

SEQ ID NO: 893136 - protein, 9 aa, Homo Sapiens
GHGNGTFSV

SEQ ID NO: 893137 - protein, 9 aa, Homo Sapiens
YRQAGPVIT

SEQ ID NO: 893138 - protein, 9 aa, Homo Sapiens
QNGVLCKSG

SEQ ID NO: 893139 - protein, 9 aa, Homo Sapiens
LRTCGGGVQ

SEQ ID NO: 893140 - protein, 9 aa, Homo Sapiens
YNKRLKVLR

SEQ ID NO: 893141 - protein, 9 aa, Homo Sapiens
HNLCIMIQY

SEQ ID NO: 893142 - protein, 9 aa, Homo Sapiens
GLVNSRLAL

SEQ ID NO: 893143 - protein, 9 aa, Homo Sapiens
EPWNIYISA

SEQ ID NO: 893144 - protein, 9 aa, Homo Sapiens
QISAGTYFT

SEQ ID NO: 893145 - protein, 9 aa, Homo Sapiens
TVINLSKKI

SEQ ID NO: 893146 - protein, 9 aa, Homo Sapiens
AAEGDENKP

SEQ ID NO: 893147 - protein, 9 aa, Homo Sapiens
VMGSGQVVL

SEQ ID NO: 893148 - protein, 9 aa, Homo Sapiens
GKDVSQSMT

SEQ ID NO: 893149 - protein, 9 aa, Homo Sapiens
ISRTLGVAK

SEQ ID NO: 893150 - protein, 9 aa, Homo Sapiens
DNLKKQNAS

SEQ ID NO: 893151 - protein, 9 aa, Homo Sapiens
SQVKNFEEY

SEQ ID NO: 893152 - protein, 9 aa, Homo Sapiens
VPTCVLHKC

SEQ ID NO: 893153 - protein, 9 aa, Homo Sapiens
HKLLNGTRG

SEQ ID NO: 893154 - protein, 9 aa, Homo Sapiens
SNHQHSNRY

SEQ ID NO: 893155 - protein, 9 aa, Homo Sapiens
IAEKAPEPN

SEQ ID NO: 893156 - protein, 9 aa, Homo Sapiens
ISTGELLRE

SEQ ID NO: 893157 - protein, 9 aa, Homo Sapiens
KIHPCKKVS

SEQ ID NO: 893158 - protein, 9 aa, Homo Sapiens
DIKIMMEGC

SEQ ID NO: 893159 - protein, 9 aa, Homo Sapiens
ITCICYVAS

SEQ ID NO: 893160 - protein, 9 aa, Homo Sapiens
DDDDKGYGF

SEQ ID NO: 893161 - protein, 9 aa, Homo Sapiens
VLLQGNEDD

SEQ ID NO: 893162 - protein, 9 aa, Homo Sapiens
PGSEGPNLT

SEQ ID NO: 893163 - protein, 9 aa, Homo Sapiens
FYPKQPDLF

SEQ ID NO: 893164 - protein, 9 aa, Homo Sapiens
LSSGLQKGT

SEQ ID NO: 893165 - protein, 9 aa, Homo Sapiens
PTPWKISLS

SEQ ID NO: 893166 - protein, 9 aa, Homo Sapiens
IPTDKTVMY

SEQ ID NO: 893167 - protein, 9 aa, Homo Sapiens
KKAQNDEYE

SEQ ID NO: 893168 - protein, 9 aa, Homo Sapiens
SFQRHMRMH

SEQ ID NO: 893169 - protein, 9 aa, Homo Sapiens
RLFCHLQLA

SEQ ID NO: 893170 - protein, 9 aa, Homo Sapiens
EDSTNVAST

SEQ ID NO: 893171 - protein, 9 aa, Homo Sapiens
IAFFIYKRC

SEQ ID NO: 893172 - protein, 9 aa, Homo Sapiens
YTVVDKKNL

SEQ ID NO: 893173 - protein, 9 aa, Homo Sapiens
AICGLKRLH

SEQ ID NO: 893174 - protein, 9 aa, Homo Sapiens
YQTVANVTG

SEQ ID NO: 893175 - protein, 9 aa, Homo Sapiens
NIAEALYSV

SEQ ID NO: 893176 - protein, 9 aa, Homo Sapiens
TGTEHLWLT

SEQ ID NO: 893177 - protein, 9 aa, Homo Sapiens
KRTQNNLGN

SEQ ID NO: 893178 - protein, 9 aa, Homo Sapiens
CDLNTSPYC

SEQ ID NO: 893179 - protein, 9 aa, Homo Sapiens
TQNDLDISR

SEQ ID NO: 893180 - protein, 9 aa, Homo Sapiens
HKQTHIKNT

SEQ ID NO: 893181 - protein, 9 aa, Homo Sapiens
KPIWCQNHH

SEQ ID NO: 893182 - protein, 9 aa, Homo Sapiens
ANDFVVAFN

SEQ ID NO: 893183 - protein, 9 aa, Homo Sapiens
PIIYGFLNN

SEQ ID NO: 893184 - protein, 9 aa, Homo Sapiens
KRSLRNLTA

SEQ ID NO: 893185 - protein, 9 aa, Homo Sapiens
DEGSEDGDN

SEQ ID NO: 893186 - protein, 9 aa, Homo Sapiens
MGAMPFGVS

SEQ ID NO: 893187 - protein, 9 aa, Homo Sapiens
FGVTTHKHH

SEQ ID NO: 893188 - protein, 9 aa, Homo Sapiens
DNGFFYPKQ

SEQ ID NO: 893189 - protein, 9 aa, Homo Sapiens
TRYCVIIQA

SEQ ID NO: 893190 - protein, 9 aa, Homo Sapiens
DGYSQNHLQ

SEQ ID NO: 893191 - protein, 9 aa, Homo Sapiens
DTRLIMQQG

SEQ ID NO: 893192 - protein, 9 aa, Homo Sapiens
LCSQTVSTR

SEQ ID NO: 893193 - protein, 9 aa, Homo Sapiens
CAEILGKTS

SEQ ID NO: 893194 - protein, 9 aa, Homo Sapiens
NMGKEDALI

SEQ ID NO: 893195 - protein, 9 aa, Homo Sapiens
AEEWQKSRT

SEQ ID NO: 893196 - protein, 9 aa, Homo Sapiens
SRKGNMTLL

SEQ ID NO: 893197 - protein, 9 aa, Homo Sapiens
WKWEDDAWS

SEQ ID NO: 893198 - protein, 9 aa, Homo Sapiens
ILFQYPLTI

SEQ ID NO: 893199 - protein, 9 aa, Homo Sapiens
LKEAKQQER

SEQ ID NO: 893200 - protein, 9 aa, Homo Sapiens
HIKQFLDTN

SEQ ID NO: 893201 - protein, 9 aa, Homo Sapiens
IRKGNTKQI

SEQ ID NO: 893202 - protein, 9 aa, Homo Sapiens
VQFLKSTDV

SEQ ID NO: 893203 - protein, 9 aa, Homo Sapiens
TLELKENFI

SEQ ID NO: 893204 - protein, 9 aa, Homo Sapiens
DRLALYPGP

SEQ ID NO: 893205 - protein, 9 aa, Homo Sapiens
QIFREKHGY

SEQ ID NO: 893206 - protein, 9 aa, Homo Sapiens
LCRRSRAAL

SEQ ID NO: 893207 - protein, 9 aa, Homo Sapiens
LTVCGGTVT

SEQ ID NO: 893208 - protein, 9 aa, Homo Sapiens
DVNIEAPEG

SEQ ID NO: 893209 - protein, 9 aa, Homo Sapiens
MIIHTGEKP

SEQ ID NO: 893210 - protein, 9 aa, Homo Sapiens
QIDDNRKFY

SEQ ID NO: 893211 - protein, 9 aa, Homo Sapiens
LWKKKDVKS

SEQ ID NO: 893212 - protein, 9 aa, Homo Sapiens
AGPVITVQV

SEQ ID NO: 893213 - protein, 9 aa, Homo Sapiens
YNHLYKGEF

SEQ ID NO: 893214 - protein, 9 aa, Homo Sapiens
TAEEQARTE

SEQ ID NO: 893215 - protein, 9 aa, Homo Sapiens
RKILRRDIP

SEQ ID NO: 893216 - protein, 9 aa, Homo Sapiens
AAEMPDMKA

SEQ ID NO: 893217 - protein, 9 aa, Homo Sapiens
QQIGNANIS

SEQ ID NO: 893218 - protein, 9 aa, Homo Sapiens
QPFYILHSK

SEQ ID NO: 893219 - protein, 9 aa, Homo Sapiens
IENIKNKIE

SEQ ID NO: 893220 - protein, 9 aa, Homo Sapiens
AGYKPFVCK

SEQ ID NO: 893221 - protein, 9 aa, Homo Sapiens
TLVTYMFQE

SEQ ID NO: 893222 - protein, 9 aa, Homo Sapiens
RIQEQLCAQ

SEQ ID NO: 893223 - protein, 9 aa, Homo Sapiens
NPGSRYDNL

SEQ ID NO: 893224 - protein, 9 aa, Homo Sapiens
EEDHSCTLA

SEQ ID NO: 893225 - protein, 9 aa, Homo Sapiens
LALEDLENT

SEQ ID NO: 893226 - protein, 9 aa, Homo Sapiens
AQLERLLIE

SEQ ID NO: 893227 - protein, 9 aa, Homo Sapiens
SLSAVRTVR

SEQ ID NO: 893228 - protein, 9 aa, Homo Sapiens
YWSSLDAST

SEQ ID NO: 893229 - protein, 9 aa, Homo Sapiens
NSSPSRDKK

SEQ ID NO: 893230 - protein, 9 aa, Homo Sapiens
CLNGCGHTC

SEQ ID NO: 893231 - protein, 9 aa, Homo Sapiens
LIQQAKLYE

SEQ ID NO: 893232 - protein, 9 aa, Homo Sapiens
ERIHTGEKV

SEQ ID NO: 893233 - protein, 9 aa, Homo Sapiens
KNGDRGENR

SEQ ID NO: 893234 - protein, 9 aa, Homo Sapiens
GADSELVLK

SEQ ID NO: 893235 - protein, 9 aa, Homo Sapiens
YTVVKVDTE

SEQ ID NO: 893236 - protein, 9 aa, Homo Sapiens
QKIMKYSAG

SEQ ID NO: 893237 - protein, 9 aa, Homo Sapiens
LFLGGLAVS

SEQ ID NO: 893238 - protein, 9 aa, Homo Sapiens
QDKQRQKQQ

SEQ ID NO: 893239 - protein, 9 aa, Homo Sapiens
EELLVTDNA

SEQ ID NO: 893240 - protein, 9 aa, Homo Sapiens
QLPGYPDSY

SEQ ID NO: 893241 - protein, 9 aa, Homo Sapiens
DPWLLRLKS

SEQ ID NO: 893242 - protein, 9 aa, Homo Sapiens
IVFNEFVDM

SEQ ID NO: 893243 - protein, 9 aa, Homo Sapiens
QFEPPMLDF

SEQ ID NO: 893244 - protein, 9 aa, Homo Sapiens
LYVENQFCE

SEQ ID NO: 893245 - protein, 9 aa, Homo Sapiens
HADYAGGDL

SEQ ID NO: 893246 - protein, 9 aa, Homo Sapiens
IIHPGSVAQ

SEQ ID NO: 893247 - protein, 9 aa, Homo Sapiens
HNFSTYSDD

SEQ ID NO: 893248 - protein, 9 aa, Homo Sapiens
SSGVNGVTQ

SEQ ID NO: 893249 - protein, 9 aa, Homo Sapiens
KESIARTRA

SEQ ID NO: 893250 - protein, 9 aa, Homo Sapiens
TSILSLFRA

SEQ ID NO: 893251 - protein, 9 aa, Homo Sapiens
QTEVMQKSC

SEQ ID NO: 893252 - protein, 9 aa, Homo Sapiens
YAGLGPSPC

SEQ ID NO: 893253 - protein, 9 aa, Homo Sapiens
SFILCKEGK

SEQ ID NO: 893254 - protein, 9 aa, Homo Sapiens
YTFFPPNKS

SEQ ID NO: 893255 - protein, 9 aa, Homo Sapiens
VREELFKVL

SEQ ID NO: 893256 - protein, 9 aa, Homo Sapiens
LYYFGERQT

SEQ ID NO: 893257 - protein, 9 aa, Homo Sapiens
GIQIQWDKQ

SEQ ID NO: 893258 - protein, 9 aa, Homo Sapiens
GNKEVEYNT

SEQ ID NO: 893259 - protein, 9 aa, Homo Sapiens
INPGILEAV

SEQ ID NO: 893260 - protein, 9 aa, Homo Sapiens
GQEFSWEEV

SEQ ID NO: 893261 - protein, 9 aa, Homo Sapiens
TFTLCLHYQ

SEQ ID NO: 893262 - protein, 9 aa, Homo Sapiens
HGCLGLELF

SEQ ID NO: 893263 - protein, 9 aa, Homo Sapiens
ITSSTTGYK

SEQ ID NO: 893264 - protein, 9 aa, Homo Sapiens
AQKMAKFIS

SEQ ID NO: 893265 - protein, 9 aa, Homo Sapiens
ERKYYILTD

SEQ ID NO: 893266 - protein, 9 aa, Homo Sapiens
LNPVCEAFK

SEQ ID NO: 893267 - protein, 9 aa, Homo Sapiens
HVLQVAMVF

SEQ ID NO: 893268 - protein, 9 aa, Homo Sapiens
NFLNFLPEE

SEQ ID NO: 893269 - protein, 9 aa, Homo Sapiens
RVIKEAVST

SEQ ID NO: 893270 - protein, 9 aa, Homo Sapiens
RSVKRIKEG

SEQ ID NO: 893271 - protein, 9 aa, Homo Sapiens
DNIISKTHQ

SEQ ID NO: 893272 - protein, 9 aa, Homo Sapiens
LSAAEHLSM

SEQ ID NO: 893273 - protein, 9 aa, Homo Sapiens
MVVKQCSAG

SEQ ID NO: 893274 - protein, 9 aa, Homo Sapiens
DSNYFGPVS

SEQ ID NO: 893275 - protein, 9 aa, Homo Sapiens
ILCCWVLPD

SEQ ID NO: 893276 - protein, 9 aa, Homo Sapiens
SFDLVALNL

SEQ ID NO: 893277 - protein, 9 aa, Homo Sapiens
SNRLVSLDL

SEQ ID NO: 893278 - protein, 9 aa, Homo Sapiens
SKKRRHQRQ

SEQ ID NO: 893279 - protein, 9 aa, Homo Sapiens
ELQTELVRM

SEQ ID NO: 893280 - protein, 9 aa, Homo Sapiens
LTLELKENF

SEQ ID NO: 893281 - protein, 9 aa, Homo Sapiens
DGICSSSWE

SEQ ID NO: 893282 - protein, 9 aa, Homo Sapiens
RNELKNMWK

SEQ ID NO: 893283 - protein, 9 aa, Homo Sapiens
SFKTQKPYK

SEQ ID NO: 893284 - protein, 9 aa, Homo Sapiens
CNLKYLPFV

SEQ ID NO: 893285 - protein, 9 aa, Homo Sapiens
SEIPRWGSQ

SEQ ID NO: 893286 - protein, 9 aa, Homo Sapiens
TFIGLESLE

SEQ ID NO: 893287 - protein, 9 aa, Homo Sapiens
TDNWDGPGE

SEQ ID NO: 893288 - protein, 9 aa, Homo Sapiens
AQNTICQQE

SEQ ID NO: 893289 - protein, 9 aa, Homo Sapiens
QIEINQTGT

SEQ ID NO: 893290 - protein, 9 aa, Homo Sapiens
VLRIINEGA

SEQ ID NO: 893291 - protein, 9 aa, Homo Sapiens
SKEKRYLRN

SEQ ID NO: 893292 - protein, 9 aa, Homo Sapiens
EHIEDVKMT

SEQ ID NO: 893293 - protein, 9 aa, Homo Sapiens
RRRTFNQTA

SEQ ID NO: 893294 - protein, 9 aa, Homo Sapiens
ATQKKAADT

SEQ ID NO: 893295 - protein, 9 aa, Homo Sapiens
STYSDDISD

SEQ ID NO: 893296 - protein, 9 aa, Homo Sapiens
EESLPYFKV

SEQ ID NO: 893297 - protein, 9 aa, Homo Sapiens
REPQNILRA

SEQ ID NO: 893298 - protein, 9 aa, Homo Sapiens
KNEIDENDV

SEQ ID NO: 893299 - protein, 9 aa, Homo Sapiens
RFCHQEHKQ

SEQ ID NO: 893300 - protein, 9 aa, Homo Sapiens
LPKIAYSRK

SEQ ID NO: 893301 - protein, 9 aa, Homo Sapiens
ANDLCLAAG

SEQ ID NO: 893302 - protein, 9 aa, Homo Sapiens
VHEWKQKHH

SEQ ID NO: 893303 - protein, 9 aa, Homo Sapiens
DQNPPIDDL

SEQ ID NO: 893304 - protein, 9 aa, Homo Sapiens
DGFYNSHSL

SEQ ID NO: 893305 - protein, 9 aa, Homo Sapiens
QSVADGIKY

SEQ ID NO: 893306 - protein, 9 aa, Homo Sapiens
LDEHLFPVQ

SEQ ID NO: 893307 - protein, 9 aa, Homo Sapiens
EWANAPWDP

SEQ ID NO: 893308 - protein, 9 aa, Homo Sapiens
LNEKKQHDT

SEQ ID NO: 893309 - protein, 9 aa, Homo Sapiens
LSDLASLSA

SEQ ID NO: 893310 - protein, 9 aa, Homo Sapiens
RVESQVLKI

SEQ ID NO: 893311 - protein, 9 aa, Homo Sapiens
VENYHTNSC

SEQ ID NO: 893312 - protein, 9 aa, Homo Sapiens
VATGVNTKI

SEQ ID NO: 893313 - protein, 9 aa, Homo Sapiens
IDLKDVDNI

SEQ ID NO: 893314 - protein, 9 aa, Homo Sapiens
FCTKNREWM

SEQ ID NO: 893315 - protein, 9 aa, Homo Sapiens
LQMHCIRAL

SEQ ID NO: 893316 - protein, 9 aa, Homo Sapiens
LAAQILLDQ

SEQ ID NO: 893317 - protein, 9 aa, Homo Sapiens
HHAVHTGKK

SEQ ID NO: 893318 - protein, 9 aa, Homo Sapiens
TKYTFFPPN

SEQ ID NO: 893319 - protein, 9 aa, Homo Sapiens
ARPEYEVRC

SEQ ID NO: 893320 - protein, 9 aa, Homo Sapiens
SGSPSERAC

SEQ ID NO: 893321 - protein, 9 aa, Homo Sapiens
EIKEQIPLK

SEQ ID NO: 893322 - protein, 9 aa, Homo Sapiens
VLSILCSLF

SEQ ID NO: 893323 - protein, 9 aa, Homo Sapiens
TSYFSSPNV

SEQ ID NO: 893324 - protein, 9 aa, Homo Sapiens
ILHPGVIGY

SEQ ID NO: 893325 - protein, 9 aa, Homo Sapiens
RLNIRVILG

SEQ ID NO: 893326 - protein, 9 aa, Homo Sapiens
HCQDINKCR

SEQ ID NO: 893327 - protein, 9 aa, Homo Sapiens
AYVNIHTGL

SEQ ID NO: 893328 - protein, 9 aa, Homo Sapiens
KQTVKYHTE

SEQ ID NO: 893329 - protein, 9 aa, Homo Sapiens
PGAQSQYVC

SEQ ID NO: 893330 - protein, 9 aa, Homo Sapiens
EDEDIPFEQ

SEQ ID NO: 893331 - protein, 9 aa, Homo Sapiens
NMNKTNIRI

SEQ ID NO: 893332 - protein, 9 aa, Homo Sapiens
KSQLQVEEE

SEQ ID NO: 893333 - protein, 9 aa, Homo Sapiens
SSIHHFKNI

SEQ ID NO: 893334 - protein, 9 aa, Homo Sapiens
ILAILYLCY

SEQ ID NO: 893335 - protein, 9 aa, Homo Sapiens
VTSHRNKSE

SEQ ID NO: 893336 - protein, 9 aa, Homo Sapiens
SYVFILSFI

SEQ ID NO: 893337 - protein, 9 aa, Homo Sapiens
YKRFLGPEI

SEQ ID NO: 893338 - protein, 9 aa, Homo Sapiens
SLEAIDGSG

SEQ ID NO: 893339 - protein, 9 aa, Homo Sapiens
NEHLSLMMD

SEQ ID NO: 893340 - protein, 9 aa, Homo Sapiens
NRSQMIEHI

SEQ ID NO: 893341 - protein, 9 aa, Homo Sapiens
TIGLDKIII

SEQ ID NO: 893342 - protein, 9 aa, Homo Sapiens
AEKWFIDAL

SEQ ID NO: 893343 - protein, 9 aa, Homo Sapiens
SNLAIAITK

SEQ ID NO: 893344 - protein, 9 aa, Homo Sapiens
SKLSEENFD

SEQ ID NO: 893345 - protein, 9 aa, Homo Sapiens
FGSSKWVME

SEQ ID NO: 893346 - protein, 9 aa, Homo Sapiens
FLKFCFYSE

SEQ ID NO: 893347 - protein, 9 aa, Homo Sapiens
CSYVSWDLF

SEQ ID NO: 893348 - protein, 9 aa, Homo Sapiens
EATLRNRVC

SEQ ID NO: 893349 - protein, 9 aa, Homo Sapiens
IKVSVSGIK

SEQ ID NO: 893350 - protein, 9 aa, Homo Sapiens
QKEYCGIWQ

SEQ ID NO: 893351 - protein, 9 aa, Homo Sapiens
SGNIQEQVF

SEQ ID NO: 893352 - protein, 9 aa, Homo Sapiens
LQKRKSVVN

SEQ ID NO: 893353 - protein, 9 aa, Homo Sapiens
VADGIKYPE

SEQ ID NO: 893354 - protein, 9 aa, Homo Sapiens
LAPQEGNVV

SEQ ID NO: 893355 - protein, 9 aa, Homo Sapiens
TSFNLIGES

SEQ ID NO: 893356 - protein, 9 aa, Homo Sapiens
LRITAFCCN

SEQ ID NO: 893357 - protein, 9 aa, Homo Sapiens
ENTYKGSEE

SEQ ID NO: 893358 - protein, 9 aa, Homo Sapiens
QGQYNMTYE

SEQ ID NO: 893359 - protein, 9 aa, Homo Sapiens
FEHHVNAVF

SEQ ID NO: 893360 - protein, 9 aa, Homo Sapiens
VFSLGSGSE

SEQ ID NO: 893361 - protein, 9 aa, Homo Sapiens
ICKHYGEAV

SEQ ID NO: 893362 - protein, 9 aa, Homo Sapiens
DRRALCALV

SEQ ID NO: 893363 - protein, 9 aa, Homo Sapiens
KVSLFNRLC

SEQ ID NO: 893364 - protein, 9 aa, Homo Sapiens
VQQIPIESI

SEQ ID NO: 893365 - protein, 9 aa, Homo Sapiens
TFRGFWSTK

SEQ ID NO: 893366 - protein, 9 aa, Homo Sapiens
YLRLQHISQ

SEQ ID NO: 893367 - protein, 9 aa, Homo Sapiens
SSLAQNCGK

SEQ ID NO: 893368 - protein, 9 aa, Homo Sapiens
GGGSQSISA

SEQ ID NO: 893369 - protein, 9 aa, Homo Sapiens
LPVLDISLI

SEQ ID NO: 893370 - protein, 9 aa, Homo Sapiens
VGNSLSKLS

SEQ ID NO: 893371 - protein, 9 aa, Homo Sapiens
RLMREITQD

SEQ ID NO: 893372 - protein, 9 aa, Homo Sapiens
YMKESVQLL

SEQ ID NO: 893373 - protein, 9 aa, Homo Sapiens
SINLNHNFA

SEQ ID NO: 893374 - protein, 9 aa, Homo Sapiens
EHYKDPSLC

SEQ ID NO: 893375 - protein, 9 aa, Homo Sapiens
MHYPGPMSA

SEQ ID NO: 893376 - protein, 9 aa, Homo Sapiens
KETSFEHHV

SEQ ID NO: 893377 - protein, 9 aa, Homo Sapiens
RRWAQGEQA

SEQ ID NO: 893378 - protein, 9 aa, Homo Sapiens
NEFFPTNST

SEQ ID NO: 893379 - protein, 9 aa, Homo Sapiens
ACWKWSPAN

SEQ ID NO: 893380 - protein, 9 aa, Homo Sapiens
TSKEICNEL

SEQ ID NO: 893381 - protein, 9 aa, Homo Sapiens
GVNGVTQLS

SEQ ID NO: 893382 - protein, 9 aa, Homo Sapiens
LKPANMLVM

SEQ ID NO: 893383 - protein, 9 aa, Homo Sapiens
VMLQFESQI

SEQ ID NO: 893384 - protein, 9 aa, Homo Sapiens
REQARVCKL

SEQ ID NO: 893385 - protein, 9 aa, Homo Sapiens
PNGFDDNNP

SEQ ID NO: 893386 - protein, 9 aa, Homo Sapiens
EHLGRAVFP

SEQ ID NO: 893387 - protein, 9 aa, Homo Sapiens
AAFLRTLGR

SEQ ID NO: 893388 - protein, 9 aa, Homo Sapiens
WLLTAAHCH

SEQ ID NO: 893389 - protein, 9 aa, Homo Sapiens
HYYGLRDSH

SEQ ID NO: 893390 - protein, 9 aa, Homo Sapiens
RVQWDLLTQ

SEQ ID NO: 893391 - protein, 9 aa, Homo Sapiens
ICLLLMSTL

SEQ ID NO: 893392 - protein, 9 aa, Homo Sapiens
EMKEDNVSF

SEQ ID NO: 893393 - protein, 9 aa, Homo Sapiens
CRKTFCVKT

SEQ ID NO: 893394 - protein, 9 aa, Homo Sapiens
GAKVLDVGS

SEQ ID NO: 893395 - protein, 9 aa, Homo Sapiens
SILCSLFFA

SEQ ID NO: 893396 - protein, 9 aa, Homo Sapiens
YEKCFGLLA

SEQ ID NO: 893397 - protein, 9 aa, Homo Sapiens
NINFSRLRW

SEQ ID NO: 893398 - protein, 9 aa, Homo Sapiens
YTRRQNPSC

SEQ ID NO: 893399 - protein, 9 aa, Homo Sapiens
SQTQGKGDA

SEQ ID NO: 893400 - protein, 9 aa, Homo Sapiens
RSRSPRISL

SEQ ID NO: 893401 - protein, 9 aa, Homo Sapiens
GASHFDKLM

SEQ ID NO: 893402 - protein, 9 aa, Homo Sapiens
CILHCLGLA

SEQ ID NO: 893403 - protein, 9 aa, Homo Sapiens
KFGPIYRLL

SEQ ID NO: 893404 - protein, 9 aa, Homo Sapiens
QAEFSGECS

SEQ ID NO: 893405 - protein, 9 aa, Homo Sapiens
CDFKFKAKH

SEQ ID NO: 893406 - protein, 9 aa, Homo Sapiens
ASGLWGGPP

SEQ ID NO: 893407 - protein, 9 aa, Homo Sapiens
KILAETKLT

SEQ ID NO: 893408 - protein, 9 aa, Homo Sapiens
ISVTSFKKI

SEQ ID NO: 893409 - protein, 9 aa, Homo Sapiens
DNCSAASTF

SEQ ID NO: 893410 - protein, 9 aa, Homo Sapiens
FYIIQVVFQ

SEQ ID NO: 893411 - protein, 9 aa, Homo Sapiens
RLCQFHLHW

SEQ ID NO: 893412 - protein, 9 aa, Homo Sapiens
VGIYLKNQM

SEQ ID NO: 893413 - protein, 9 aa, Homo Sapiens
WRAMGPAGV

SEQ ID NO: 893414 - protein, 9 aa, Homo Sapiens
TTAASAVWV

SEQ ID NO: 893415 - protein, 9 aa, Homo Sapiens
EKAKTEDNY

SEQ ID NO: 893416 - protein, 9 aa, Homo Sapiens
ISKAVYTSF

SEQ ID NO: 893417 - protein, 9 aa, Homo Sapiens
HRVVKILHK

SEQ ID NO: 893418 - protein, 9 aa, Homo Sapiens
TRNHFEGTR

SEQ ID NO: 893419 - protein, 9 aa, Homo Sapiens
PTCVLHKCQ

SEQ ID NO: 893420 - protein, 9 aa, Homo Sapiens
NTNDGRPPP

SEQ ID NO: 893421 - protein, 9 aa, Homo Sapiens
KINGSLHQE

SEQ ID NO: 893422 - protein, 9 aa, Homo Sapiens
EEEAEEEDG

SEQ ID NO: 893423 - protein, 9 aa, Homo Sapiens
RTKNNKEEA

SEQ ID NO: 893424 - protein, 9 aa, Homo Sapiens
AEKQIQSVL

SEQ ID NO: 893425 - protein, 9 aa, Homo Sapiens
GHYKELPGE

SEQ ID NO: 893426 - protein, 9 aa, Homo Sapiens
FGVQVLQDN

SEQ ID NO: 893427 - protein, 9 aa, Homo Sapiens
NDSAFMEPR

SEQ ID NO: 893428 - protein, 9 aa, Homo Sapiens
NELPYNDCF

SEQ ID NO: 893429 - protein, 9 aa, Homo Sapiens
QLWAATEIL

SEQ ID NO: 893430 - protein, 9 aa, Homo Sapiens
FKSLLSHNK

SEQ ID NO: 893431 - protein, 9 aa, Homo Sapiens
EICFMISTP

SEQ ID NO: 893432 - protein, 9 aa, Homo Sapiens
SRLPGRPTQ

SEQ ID NO: 893433 - protein, 9 aa, Homo Sapiens
DDSDLDCKR

SEQ ID NO: 893434 - protein, 9 aa, Homo Sapiens
GINGVQNYK

SEQ ID NO: 893435 - protein, 9 aa, Homo Sapiens
YWVSLPGKM

SEQ ID NO: 893436 - protein, 9 aa, Homo Sapiens
RDLLIKVGS

SEQ ID NO: 893437 - protein, 9 aa, Homo Sapiens
STTTAEDIK

SEQ ID NO: 893438 - protein, 9 aa, Homo Sapiens
SEVVIPLAT

SEQ ID NO: 893439 - protein, 9 aa, Homo Sapiens
QIQWDKQSR

SEQ ID NO: 893440 - protein, 9 aa, Homo Sapiens
SRIEVLKHK

SEQ ID NO: 893441 - protein, 9 aa, Homo Sapiens
CRKQGLVHQ

SEQ ID NO: 893442 - protein, 9 aa, Homo Sapiens
KSILSMHQK

SEQ ID NO: 893443 - protein, 9 aa, Homo Sapiens
DLYEYKNIR

SEQ ID NO: 893444 - protein, 9 aa, Homo Sapiens
RNSLYVVRN

SEQ ID NO: 893445 - protein, 9 aa, Homo Sapiens
FKKELQEPQ

SEQ ID NO: 893446 - protein, 9 aa, Homo Sapiens
QQINIPPQR

SEQ ID NO: 893447 - protein, 9 aa, Homo Sapiens
DELLQVLHM

SEQ ID NO: 893448 - protein, 9 aa, Homo Sapiens
DISYLKGRI

SEQ ID NO: 893449 - protein, 9 aa, Homo Sapiens
MWEKEEKMW

SEQ ID NO: 893450 - protein, 9 aa, Homo Sapiens
IVERNYPLA

SEQ ID NO: 893451 - protein, 9 aa, Homo Sapiens
ECRDLDDLK

SEQ ID NO: 893452 - protein, 9 aa, Homo Sapiens
CASLNTRTV

SEQ ID NO: 893453 - protein, 9 aa, Homo Sapiens
IFHNETSKT

SEQ ID NO: 893454 - protein, 9 aa, Homo Sapiens
TYDKVKARL

SEQ ID NO: 893455 - protein, 9 aa, Homo Sapiens
QIWRRRPTP

SEQ ID NO: 893456 - protein, 9 aa, Homo Sapiens
TWIANEKYL

SEQ ID NO: 893457 - protein, 9 aa, Homo Sapiens
VGLIKKMIA

SEQ ID NO: 893458 - protein, 9 aa, Homo Sapiens
DVDNILLIT

SEQ ID NO: 893459 - protein, 9 aa, Homo Sapiens
KNEKKNKVV

SEQ ID NO: 893460 - protein, 9 aa, Homo Sapiens
PVNWSHANK

SEQ ID NO: 893461 - protein, 9 aa, Homo Sapiens
VCCKCGRQF

SEQ ID NO: 893462 - protein, 9 aa, Homo Sapiens
AREFDQFGT

SEQ ID NO: 893463 - protein, 9 aa, Homo Sapiens
QVISSGEVH

SEQ ID NO: 893464 - protein, 9 aa, Homo Sapiens
LWECLVHEL

SEQ ID NO: 893465 - protein, 9 aa, Homo Sapiens
KKTKLQQPV

SEQ ID NO: 893466 - protein, 9 aa, Homo Sapiens
RYACQIHHP

SEQ ID NO: 893467 - protein, 9 aa, Homo Sapiens
KVYGTSSHL

SEQ ID NO: 893468 - protein, 9 aa, Homo Sapiens
YCQNPRGEE

SEQ ID NO: 893469 - protein, 9 aa, Homo Sapiens
VQVVAGNKY

SEQ ID NO: 893470 - protein, 9 aa, Homo Sapiens
CEQALRIQT

SEQ ID NO: 893471 - protein, 9 aa, Homo Sapiens
MFQNHLCLV

SEQ ID NO: 893472 - protein, 9 aa, Homo Sapiens
PGPNDSACA

SEQ ID NO: 893473 - protein, 9 aa, Homo Sapiens
ILKTLLRCQ

SEQ ID NO: 893474 - protein, 9 aa, Homo Sapiens
NEETAKQII

SEQ ID NO: 893475 - protein, 9 aa, Homo Sapiens
DGEPDQTSL

SEQ ID NO: 893476 - protein, 9 aa, Homo Sapiens
HHTDTNMHS

SEQ ID NO: 893477 - protein, 9 aa, Homo Sapiens
MKGAGTNKD

SEQ ID NO: 893478 - protein, 9 aa, Homo Sapiens
VKSYFSQKW

SEQ ID NO: 893479 - protein, 9 aa, Homo Sapiens
LNEAIQNIA

SEQ ID NO: 893480 - protein, 9 aa, Homo Sapiens
EQEKVVTQQ

SEQ ID NO: 893481 - protein, 9 aa, Homo Sapiens
SELVLKVMA

SEQ ID NO: 893482 - protein, 9 aa, Homo Sapiens
AWKYNGNVE

SEQ ID NO: 893483 - protein, 9 aa, Homo Sapiens
MSFKDIKSL

SEQ ID NO: 893484 - protein, 9 aa, Homo Sapiens
SPFMDCSAP

SEQ ID NO: 893485 - protein, 9 aa, Homo Sapiens
SAAREEDKH

SEQ ID NO: 893486 - protein, 9 aa, Homo Sapiens
LSLICHQIS

SEQ ID NO: 893487 - protein, 9 aa, Homo Sapiens
RNLTADYLA

SEQ ID NO: 893488 - protein, 9 aa, Homo Sapiens
VGSAIWNQR

SEQ ID NO: 893489 - protein, 9 aa, Homo Sapiens
RTYLLTRND

SEQ ID NO: 893490 - protein, 9 aa, Homo Sapiens
AKPHMVKAV

SEQ ID NO: 893491 - protein, 9 aa, Homo Sapiens
PIVKPHSFM

SEQ ID NO: 893492 - protein, 9 aa, Homo Sapiens
NRHSNEWKT

SEQ ID NO: 893493 - protein, 9 aa, Homo Sapiens
PWRQIPGGY

SEQ ID NO: 893494 - protein, 9 aa, Homo Sapiens
QVIEEIEEI

SEQ ID NO: 893495 - protein, 9 aa, Homo Sapiens
RHRHAMTRK

SEQ ID NO: 893496 - protein, 9 aa, Homo Sapiens
IALGGRLYI

SEQ ID NO: 893497 - protein, 9 aa, Homo Sapiens
SHIQNILIL

SEQ ID NO: 893498 - protein, 9 aa, Homo Sapiens
SENEKQRQN

SEQ ID NO: 893499 - protein, 9 aa, Homo Sapiens
VDKISETAQ

SEQ ID NO: 893500 - protein, 9 aa, Homo Sapiens
SDNVIVGRC

SEQ ID NO: 893501 - protein, 9 aa, Homo Sapiens
KPSFLAHPG

SEQ ID NO: 893502 - protein, 9 aa, Homo Sapiens
RRQRKQRPP

SEQ ID NO: 893503 - protein, 9 aa, Homo Sapiens
LSGKYVAVE

SEQ ID NO: 893504 - protein, 9 aa, Homo Sapiens
KVRAVNADS

SEQ ID NO: 893505 - protein, 9 aa, Homo Sapiens
HPRIKPSPL

SEQ ID NO: 893506 - protein, 9 aa, Homo Sapiens
TPQEMIDIW

SEQ ID NO: 893507 - protein, 9 aa, Homo Sapiens
QLLLDRQCQ

SEQ ID NO: 893508 - protein, 9 aa, Homo Sapiens
FDGDKHSIN

SEQ ID NO: 893509 - protein, 9 aa, Homo Sapiens
GMARSDLWY

SEQ ID NO: 893510 - protein, 9 aa, Homo Sapiens
FDDNNPPGS

SEQ ID NO: 893511 - protein, 9 aa, Homo Sapiens
PPARHTLAD

SEQ ID NO: 893512 - protein, 9 aa, Homo Sapiens
VQVISSGEV

SEQ ID NO: 893513 - protein, 9 aa, Homo Sapiens
GSYRYPNWP

SEQ ID NO: 893514 - protein, 9 aa, Homo Sapiens
GTSVSLLVV

SEQ ID NO: 893515 - protein, 9 aa, Homo Sapiens
QHCVCREEF

SEQ ID NO: 893516 - protein, 9 aa, Homo Sapiens
APDAMKEVV

SEQ ID NO: 893517 - protein, 9 aa, Homo Sapiens
ILRRDIPVT

SEQ ID NO: 893518 - protein, 9 aa, Homo Sapiens
FNHSSHLVM

SEQ ID NO: 893519 - protein, 9 aa, Homo Sapiens
TVLDILRYF

SEQ ID NO: 893520 - protein, 9 aa, Homo Sapiens
QICLAGDSA

SEQ ID NO: 893521 - protein, 9 aa, Homo Sapiens
KFKDGTDEE

SEQ ID NO: 893522 - protein, 9 aa, Homo Sapiens
DGVTKSHHL

SEQ ID NO: 893523 - protein, 9 aa, Homo Sapiens
QCHQQMQQQ

SEQ ID NO: 893524 - protein, 9 aa, Homo Sapiens
SPHMYVSDT

SEQ ID NO: 893525 - protein, 9 aa, Homo Sapiens
ATITKPRGN

SEQ ID NO: 893526 - protein, 9 aa, Homo Sapiens
FLYSLNQTL

SEQ ID NO: 893527 - protein, 9 aa, Homo Sapiens
EPAICALHH

SEQ ID NO: 893528 - protein, 9 aa, Homo Sapiens
IGNAIAQRI

SEQ ID NO: 893529 - protein, 9 aa, Homo Sapiens
EEKVICLVR

SEQ ID NO: 893530 - protein, 9 aa, Homo Sapiens
LEQQRLTVQ

SEQ ID NO: 893531 - protein, 9 aa, Homo Sapiens
IIICSCICT

SEQ ID NO: 893532 - protein, 9 aa, Homo Sapiens
QCGKVFICS

SEQ ID NO: 893533 - protein, 9 aa, Homo Sapiens
PPGPMEYTG

SEQ ID NO: 893534 - protein, 9 aa, Homo Sapiens
SILSLFRAP

SEQ ID NO: 893535 - protein, 9 aa, Homo Sapiens
ANKLLRWLQ

SEQ ID NO: 893536 - protein, 9 aa, Homo Sapiens
HPEGIINIV

SEQ ID NO: 893537 - protein, 9 aa, Homo Sapiens
ARQSVIGSG

SEQ ID NO: 893538 - protein, 9 aa, Homo Sapiens
LLMSTLGIL

SEQ ID NO: 893539 - protein, 9 aa, Homo Sapiens
HIATTIITI

SEQ ID NO: 893540 - protein, 9 aa, Homo Sapiens
SGGKIWRPA

SEQ ID NO: 893541 - protein, 9 aa, Homo Sapiens
SRPKNIPPK

SEQ ID NO: 893542 - protein, 9 aa, Homo Sapiens
ILWDTGVFE

SEQ ID NO: 893543 - protein, 9 aa, Homo Sapiens
WTSYSELVG

SEQ ID NO: 893544 - protein, 9 aa, Homo Sapiens
RDAILALMP

SEQ ID NO: 893545 - protein, 9 aa, Homo Sapiens
TAVDFSQEE

SEQ ID NO: 893546 - protein, 9 aa, Homo Sapiens
DNGFLADDN

SEQ ID NO: 893547 - protein, 9 aa, Homo Sapiens
LYGADIKSK

SEQ ID NO: 893548 - protein, 9 aa, Homo Sapiens
ARCWCKKRR

SEQ ID NO: 893549 - protein, 9 aa, Homo Sapiens
LQEAVNKYF

SEQ ID NO: 893550 - protein, 9 aa, Homo Sapiens
LLSRMCANE

SEQ ID NO: 893551 - protein, 9 aa, Homo Sapiens
HTGEKPFWC

SEQ ID NO: 893552 - protein, 9 aa, Homo Sapiens
CAARLANLM

SEQ ID NO: 893553 - protein, 9 aa, Homo Sapiens
CLSVDYGKK

SEQ ID NO: 893554 - protein, 9 aa, Homo Sapiens
LKDKNQGKL

SEQ ID NO: 893555 - protein, 9 aa, Homo Sapiens
KDALEKAQT

SEQ ID NO: 893556 - protein, 9 aa, Homo Sapiens
IRQAGFPRC

SEQ ID NO: 893557 - protein, 9 aa, Homo Sapiens
ILENTSDLL

SEQ ID NO: 893558 - protein, 9 aa, Homo Sapiens
VAVLLRMYY

SEQ ID NO: 893559 - protein, 9 aa, Homo Sapiens
IFHSSIQRH

SEQ ID NO: 893560 - protein, 9 aa, Homo Sapiens
NFSRLRWLV

SEQ ID NO: 893561 - protein, 9 aa, Homo Sapiens
SRTSSTSCI

SEQ ID NO: 893562 - protein, 9 aa, Homo Sapiens
PRYPNTCFF

SEQ ID NO: 893563 - protein, 9 aa, Homo Sapiens
SSGEEKTKS

SEQ ID NO: 893564 - protein, 9 aa, Homo Sapiens
PRFFMVVKQ

SEQ ID NO: 893565 - protein, 9 aa, Homo Sapiens
TGTNTNKLL

SEQ ID NO: 893566 - protein, 9 aa, Homo Sapiens
VINYYADTI

SEQ ID NO: 893567 - protein, 9 aa, Homo Sapiens
FDSSLGAKK

SEQ ID NO: 893568 - protein, 9 aa, Homo Sapiens
QSLHAKGAK

SEQ ID NO: 893569 - protein, 9 aa, Homo Sapiens
KQLEGGLVL

SEQ ID NO: 893570 - protein, 9 aa, Homo Sapiens
PITMKYVFD

SEQ ID NO: 893571 - protein, 9 aa, Homo Sapiens
QNATGESCN

SEQ ID NO: 893572 - protein, 9 aa, Homo Sapiens
PNPDSDNFL

SEQ ID NO: 893573 - protein, 9 aa, Homo Sapiens
IEEIIQTKA

SEQ ID NO: 893574 - protein, 9 aa, Homo Sapiens
ITIRNTKAA

SEQ ID NO: 893575 - protein, 9 aa, Homo Sapiens
NQLIRVIIY

SEQ ID NO: 893576 - protein, 9 aa, Homo Sapiens
VQTHFSTAY

SEQ ID NO: 893577 - protein, 9 aa, Homo Sapiens
GILCYEGKA

SEQ ID NO: 893578 - protein, 9 aa, Homo Sapiens
YISRECALK

SEQ ID NO: 893579 - protein, 9 aa, Homo Sapiens
ANYSYASSY

SEQ ID NO: 893580 - protein, 9 aa, Homo Sapiens
GTSSHLKAH

SEQ ID NO: 893581 - protein, 9 aa, Homo Sapiens
SQKYITEFL

SEQ ID NO: 893582 - protein, 9 aa, Homo Sapiens
AQTKNTASL

SEQ ID NO: 893583 - protein, 9 aa, Homo Sapiens
FSADEQLFS

SEQ ID NO: 893584 - protein, 9 aa, Homo Sapiens
AHLVQHLQV

SEQ ID NO: 893585 - protein, 9 aa, Homo Sapiens
RELQERNQI

SEQ ID NO: 893586 - protein, 9 aa, Homo Sapiens
PAASALIQT

SEQ ID NO: 893587 - protein, 9 aa, Homo Sapiens
EVTVLTSLA

SEQ ID NO: 893588 - protein, 9 aa, Homo Sapiens
QASSAVSDC

SEQ ID NO: 893589 - protein, 9 aa, Homo Sapiens
NQIATAFGH

SEQ ID NO: 893590 - protein, 9 aa, Homo Sapiens
QLWHWLQET

SEQ ID NO: 893591 - protein, 9 aa, Homo Sapiens
WLHQNRFST

SEQ ID NO: 893592 - protein, 9 aa, Homo Sapiens
QYLGEVLFD

SEQ ID NO: 893593 - protein, 9 aa, Homo Sapiens
YRLLLGLQD

SEQ ID NO: 893594 - protein, 9 aa, Homo Sapiens
LVGKTPIKT

SEQ ID NO: 893595 - protein, 9 aa, Homo Sapiens
VIEEIEEIM

SEQ ID NO: 893596 - protein, 9 aa, Homo Sapiens
ASNNPKRND

SEQ ID NO: 893597 - protein, 9 aa, Homo Sapiens
NIVVGAIKQ

SEQ ID NO: 893598 - protein, 9 aa, Homo Sapiens
EVKEIRRKF

SEQ ID NO: 893599 - protein, 9 aa, Homo Sapiens
KFLNILFHH

SEQ ID NO: 893600 - protein, 9 aa, Homo Sapiens
CRASFRGPR

SEQ ID NO: 893601 - protein, 9 aa, Homo Sapiens
SVITKLCKF

SEQ ID NO: 893602 - protein, 9 aa, Homo Sapiens
FENEDNTQS

SEQ ID NO: 893603 - protein, 9 aa, Homo Sapiens
TISVGKYIN

SEQ ID NO: 893604 - protein, 9 aa, Homo Sapiens
HLSMIRASR

SEQ ID NO: 893605 - protein, 9 aa, Homo Sapiens
VQLTITRHC

SEQ ID NO: 893606 - protein, 9 aa, Homo Sapiens
VIMCSPVCG

SEQ ID NO: 893607 - protein, 9 aa, Homo Sapiens
RQGFNISYD

SEQ ID NO: 893608 - protein, 9 aa, Homo Sapiens
NLLSNITNH

SEQ ID NO: 893609 - protein, 9 aa, Homo Sapiens
SQMLSSTYN

SEQ ID NO: 893610 - protein, 9 aa, Homo Sapiens
VRIFKNADN

SEQ ID NO: 893611 - protein, 9 aa, Homo Sapiens
ILVVNNDVV

SEQ ID NO: 893612 - protein, 9 aa, Homo Sapiens
IKTILRLKL

SEQ ID NO: 893613 - protein, 9 aa, Homo Sapiens
LPQFLQYYD

SEQ ID NO: 893614 - protein, 9 aa, Homo Sapiens
LFELGLYDP

SEQ ID NO: 893615 - protein, 9 aa, Homo Sapiens
SPRWRRSHS

SEQ ID NO: 893616 - protein, 9 aa, Homo Sapiens
DDFAKEGHY

SEQ ID NO: 893617 - protein, 9 aa, Homo Sapiens
ETKRSINKE

SEQ ID NO: 893618 - protein, 9 aa, Homo Sapiens
MCISHKKLE

SEQ ID NO: 893619 - protein, 9 aa, Homo Sapiens
DIVSVLCTE

SEQ ID NO: 893620 - protein, 9 aa, Homo Sapiens
CRSNVIHQL

SEQ ID NO: 893621 - protein, 9 aa, Homo Sapiens
EIDHRGKVL

SEQ ID NO: 893622 - protein, 9 aa, Homo Sapiens
IRLSTSLLL

SEQ ID NO: 893623 - protein, 9 aa, Homo Sapiens
FCLANSISQ

SEQ ID NO: 893624 - protein, 9 aa, Homo Sapiens
LRNKELKVT

SEQ ID NO: 893625 - protein, 9 aa, Homo Sapiens
VGWRHRLLV

SEQ ID NO: 893626 - protein, 9 aa, Homo Sapiens
EVHSTEVAN

SEQ ID NO: 893627 - protein, 9 aa, Homo Sapiens
DSKRSTCSI

SEQ ID NO: 893628 - protein, 9 aa, Homo Sapiens
KICKLDNGG

SEQ ID NO: 893629 - protein, 9 aa, Homo Sapiens
KMCLKASLK

SEQ ID NO: 893630 - protein, 9 aa, Homo Sapiens
DELIIKAKE

SEQ ID NO: 893631 - protein, 9 aa, Homo Sapiens
DKVEPGIIC

SEQ ID NO: 893632 - protein, 9 aa, Homo Sapiens
YLSVKSLFW

SEQ ID NO: 893633 - protein, 9 aa, Homo Sapiens
DLTIKKRLP

SEQ ID NO: 893634 - protein, 9 aa, Homo Sapiens
LQSHGETKV

SEQ ID NO: 893635 - protein, 9 aa, Homo Sapiens
YQLYQGINQ

SEQ ID NO: 893636 - protein, 9 aa, Homo Sapiens
NSCRKYLFI

SEQ ID NO: 893637 - protein, 9 aa, Homo Sapiens
DSSSPEITS

SEQ ID NO: 893638 - protein, 9 aa, Homo Sapiens
ENFQGRQAE

SEQ ID NO: 893639 - protein, 9 aa, Homo Sapiens
NLFNICQRR

SEQ ID NO: 893640 - protein, 9 aa, Homo Sapiens
TGPKGDQGI

SEQ ID NO: 893641 - protein, 9 aa, Homo Sapiens
VQNGTDKDA

SEQ ID NO: 893642 - protein, 9 aa, Homo Sapiens
LIKCDKIQV

SEQ ID NO: 893643 - protein, 9 aa, Homo Sapiens
TKQAKRNAA

SEQ ID NO: 893644 - protein, 9 aa, Homo Sapiens
VEKVGNCYF

SEQ ID NO: 893645 - protein, 9 aa, Homo Sapiens
RNHCFLEEN

SEQ ID NO: 893646 - protein, 9 aa, Homo Sapiens
DTGKENKGE

SEQ ID NO: 893647 - protein, 9 aa, Homo Sapiens
KERICKLSM

SEQ ID NO: 893648 - protein, 9 aa, Homo Sapiens
LESSKRSWL

SEQ ID NO: 893649 - protein, 9 aa, Homo Sapiens
FCGAELVDA

SEQ ID NO: 893650 - protein, 9 aa, Homo Sapiens
VAIMAIDIF

SEQ ID NO: 893651 - protein, 9 aa, Homo Sapiens
YLVNRLEEK

SEQ ID NO: 893652 - protein, 9 aa, Homo Sapiens
MIDTYCLNP

SEQ ID NO: 893653 - protein, 9 aa, Homo Sapiens
VPSVPHKLP

SEQ ID NO: 893654 - protein, 9 aa, Homo Sapiens
RDQDKYCYR

SEQ ID NO: 893655 - protein, 9 aa, Homo Sapiens
VLTVYQDIK

SEQ ID NO: 893656 - protein, 9 aa, Homo Sapiens
DLCLTVEQA

SEQ ID NO: 893657 - protein, 9 aa, Homo Sapiens
NFDQFFTRH

SEQ ID NO: 893658 - protein, 9 aa, Homo Sapiens
IASSPAIDT

SEQ ID NO: 893659 - protein, 9 aa, Homo Sapiens
IRYVWNDLD

SEQ ID NO: 893660 - protein, 9 aa, Homo Sapiens
HILSVRDSA

SEQ ID NO: 893661 - protein, 9 aa, Homo Sapiens
HSKTYLICY

SEQ ID NO: 893662 - protein, 9 aa, Homo Sapiens
DTPFWLLSE

SEQ ID NO: 893663 - protein, 9 aa, Homo Sapiens
RLDKSNPRG

SEQ ID NO: 893664 - protein, 9 aa, Homo Sapiens
NALNEKKQH

SEQ ID NO: 893665 - protein, 9 aa, Homo Sapiens
RPTSDCSPM

SEQ ID NO: 893666 - protein, 9 aa, Homo Sapiens
LHCVPPLSP

SEQ ID NO: 893667 - protein, 9 aa, Homo Sapiens
KLNRNKIKN

SEQ ID NO: 893668 - protein, 9 aa, Homo Sapiens
QLDDSIGSP

SEQ ID NO: 893669 - protein, 9 aa, Homo Sapiens
AEELCRLSG

SEQ ID NO: 893670 - protein, 9 aa, Homo Sapiens
QESRLFGAV

SEQ ID NO: 893671 - protein, 9 aa, Homo Sapiens
INCNNFWLL

SEQ ID NO: 893672 - protein, 9 aa, Homo Sapiens
AKQKLQQLF

SEQ ID NO: 893673 - protein, 9 aa, Homo Sapiens
SRSQTATEC

SEQ ID NO: 893674 - protein, 9 aa, Homo Sapiens
DAGCLQGLN

SEQ ID NO: 893675 - protein, 9 aa, Homo Sapiens
SLDLQNVSL

SEQ ID NO: 893676 - protein, 9 aa, Homo Sapiens
CLVLVPDRH

SEQ ID NO: 893677 - protein, 9 aa, Homo Sapiens
PDNQTSLMA

SEQ ID NO: 893678 - protein, 9 aa, Homo Sapiens
LDTLTKHYG

SEQ ID NO: 893679 - protein, 9 aa, Homo Sapiens
FIGRELNPQ

SEQ ID NO: 893680 - protein, 9 aa, Homo Sapiens
TDITFKHIM

SEQ ID NO: 893681 - protein, 9 aa, Homo Sapiens
VGAYHTDDC

SEQ ID NO: 893682 - protein, 9 aa, Homo Sapiens
IKVFVDIKF

SEQ ID NO: 893683 - protein, 9 aa, Homo Sapiens
LHNVFKLQT

SEQ ID NO: 893684 - protein, 9 aa, Homo Sapiens
TTCLSNMLK

SEQ ID NO: 893685 - protein, 9 aa, Homo Sapiens
KCFQFKQMY

SEQ ID NO: 893686 - protein, 9 aa, Homo Sapiens
FNYMIHVNQ

SEQ ID NO: 893687 - protein, 9 aa, Homo Sapiens
LHAAECLQT

SEQ ID NO: 893688 - protein, 9 aa, Homo Sapiens
SLLLGQQGL

SEQ ID NO: 893689 - protein, 9 aa, Homo Sapiens
IGIFSVREK

SEQ ID NO: 893690 - protein, 9 aa, Homo Sapiens
SVTFQINLT

SEQ ID NO: 893691 - protein, 9 aa, Homo Sapiens
QFGSEAMKS

SEQ ID NO: 893692 - protein, 9 aa, Homo Sapiens
QTRQNAKWL

SEQ ID NO: 893693 - protein, 9 aa, Homo Sapiens
SELSNTDSG

SEQ ID NO: 893694 - protein, 9 aa, Homo Sapiens
NATIRRTDQ

SEQ ID NO: 893695 - protein, 9 aa, Homo Sapiens
VSLAVLQRD

SEQ ID NO: 893696 - protein, 9 aa, Homo Sapiens
WILFQYPLT

SEQ ID NO: 893697 - protein, 9 aa, Homo Sapiens
VCLGNSPSS

SEQ ID NO: 893698 - protein, 9 aa, Homo Sapiens
TGYKHFDKS

SEQ ID NO: 893699 - protein, 9 aa, Homo Sapiens
TLMRVCVAQ

SEQ ID NO: 893700 - protein, 9 aa, Homo Sapiens
KQNYVAPLE

SEQ ID NO: 893701 - protein, 9 aa, Homo Sapiens
AKHRWEYEN

SEQ ID NO: 893702 - protein, 9 aa, Homo Sapiens
RITALDGGN

SEQ ID NO: 893703 - protein, 9 aa, Homo Sapiens
FQVGGKKRL

SEQ ID NO: 893704 - protein, 9 aa, Homo Sapiens
FRPHTGKAA

SEQ ID NO: 893705 - protein, 9 aa, Homo Sapiens
IELCRERED

SEQ ID NO: 893706 - protein, 9 aa, Homo Sapiens
VTGRCNGQF

SEQ ID NO: 893707 - protein, 9 aa, Homo Sapiens
FKSPEEMRK

SEQ ID NO: 893708 - protein, 9 aa, Homo Sapiens
GDNIAQGSD

SEQ ID NO: 893709 - protein, 9 aa, Homo Sapiens
DEEKVICLV

SEQ ID NO: 893710 - protein, 9 aa, Homo Sapiens
TSSPVACQT

SEQ ID NO: 893711 - protein, 9 aa, Homo Sapiens
EAYVNIHTG

SEQ ID NO: 893712 - protein, 9 aa, Homo Sapiens
VFWTPSCTI

SEQ ID NO: 893713 - protein, 9 aa, Homo Sapiens
RQRKQRPPR

SEQ ID NO: 893714 - protein, 9 aa, Homo Sapiens
AAKEVFKEI

SEQ ID NO: 893715 - protein, 9 aa, Homo Sapiens
ELYQVMCRN

SEQ ID NO: 893716 - protein, 9 aa, Homo Sapiens
EEEDKGLDS

SEQ ID NO: 893717 - protein, 9 aa, Homo Sapiens
RWKKYLIKI

SEQ ID NO: 893718 - protein, 9 aa, Homo Sapiens
PREEAAQRG

SEQ ID NO: 893719 - protein, 9 aa, Homo Sapiens
DPDVGVNLL

SEQ ID NO: 893720 - protein, 9 aa, Homo Sapiens
APFKSYNPD

SEQ ID NO: 893721 - protein, 9 aa, Homo Sapiens
PFISPQSWP

SEQ ID NO: 893722 - protein, 9 aa, Homo Sapiens
EFVTVNEVI

SEQ ID NO: 893723 - protein, 9 aa, Homo Sapiens
FSNLTLNKT

SEQ ID NO: 893724 - protein, 9 aa, Homo Sapiens
NLYHYITSY

SEQ ID NO: 893725 - protein, 9 aa, Homo Sapiens
GRNIRKNLY

SEQ ID NO: 893726 - protein, 9 aa, Homo Sapiens
QLKDTEDNL

SEQ ID NO: 893727 - protein, 9 aa, Homo Sapiens
SQLISHKRS

SEQ ID NO: 893728 - protein, 9 aa, Homo Sapiens
HTLADIIME

SEQ ID NO: 893729 - protein, 9 aa, Homo Sapiens
LKQQKAVKL

SEQ ID NO: 893730 - protein, 9 aa, Homo Sapiens
FHTDKTSFV

SEQ ID NO: 893731 - protein, 9 aa, Homo Sapiens
RSKSKSNRV

SEQ ID NO: 893732 - protein, 9 aa, Homo Sapiens
PVLTTAKTS

SEQ ID NO: 893733 - protein, 9 aa, Homo Sapiens
YESDKDKSD

SEQ ID NO: 893734 - protein, 9 aa, Homo Sapiens
WVVSIIMFC

SEQ ID NO: 893735 - protein, 9 aa, Homo Sapiens
EQQRLTVQQ

SEQ ID NO: 893736 - protein, 9 aa, Homo Sapiens
VVPLATYMQ

SEQ ID NO: 893737 - protein, 9 aa, Homo Sapiens
FEWEQNDTF

SEQ ID NO: 893738 - protein, 9 aa, Homo Sapiens
AKEDKCQGK

SEQ ID NO: 893739 - protein, 9 aa, Homo Sapiens
LQRTIRLAP

SEQ ID NO: 893740 - protein, 9 aa, Homo Sapiens
KAFLHWLTG

SEQ ID NO: 893741 - protein, 9 aa, Homo Sapiens
PRTPMLWSR

SEQ ID NO: 893742 - protein, 9 aa, Homo Sapiens
YRRKAGISD

SEQ ID NO: 893743 - protein, 9 aa, Homo Sapiens
NIYSMMLIL

SEQ ID NO: 893744 - protein, 9 aa, Homo Sapiens
LAYLENDIK

SEQ ID NO: 893745 - protein, 9 aa, Homo Sapiens
EWSLKVEYK

SEQ ID NO: 893746 - protein, 9 aa, Homo Sapiens
SQDSPWSLH

SEQ ID NO: 893747 - protein, 9 aa, Homo Sapiens
AEFQEEAKH

SEQ ID NO: 893748 - protein, 9 aa, Homo Sapiens
KSTLTQHQI

SEQ ID NO: 893749 - protein, 9 aa, Homo Sapiens
IQTQIISKK

SEQ ID NO: 893750 - protein, 9 aa, Homo Sapiens
ELKRDLAKY

SEQ ID NO: 893751 - protein, 9 aa, Homo Sapiens
MQNNKIIKP

SEQ ID NO: 893752 - protein, 9 aa, Homo Sapiens
SPSMGIKEV

SEQ ID NO: 893753 - protein, 9 aa, Homo Sapiens
PCNLMDGRD

SEQ ID NO: 893754 - protein, 9 aa, Homo Sapiens
AWVSTLPFC

SEQ ID NO: 893755 - protein, 9 aa, Homo Sapiens
PNMTTNKRR

SEQ ID NO: 893756 - protein, 9 aa, Homo Sapiens
SEVKYQMDG

SEQ ID NO: 893757 - protein, 9 aa, Homo Sapiens
QPYQPKIDT

SEQ ID NO: 893758 - protein, 9 aa, Homo Sapiens
MATNIYLLN

SEQ ID NO: 893759 - protein, 9 aa, Homo Sapiens
HLGNSVLHL

SEQ ID NO: 893760 - protein, 9 aa, Homo Sapiens
YYVGGEVYV

SEQ ID NO: 893761 - protein, 9 aa, Homo Sapiens
LCDNVWTFV

SEQ ID NO: 893762 - protein, 9 aa, Homo Sapiens
LCKRRDTLI

SEQ ID NO: 893763 - protein, 9 aa, Homo Sapiens
QINVINVPG

SEQ ID NO: 893764 - protein, 9 aa, Homo Sapiens
LQTVLGLIQ

SEQ ID NO: 893765 - protein, 9 aa, Homo Sapiens
LAKMKEKYE

SEQ ID NO: 893766 - protein, 9 aa, Homo Sapiens
NSCQSEYHA

SEQ ID NO: 893767 - protein, 9 aa, Homo Sapiens
GPETFCGAE

SEQ ID NO: 893768 - protein, 9 aa, Homo Sapiens
EGMARSDLW

SEQ ID NO: 893769 - protein, 9 aa, Homo Sapiens
LIARKTKQV

SEQ ID NO: 893770 - protein, 9 aa, Homo Sapiens
CSCFQQNNN

SEQ ID NO: 893771 - protein, 9 aa, Homo Sapiens
DITDCLCFA

SEQ ID NO: 893772 - protein, 9 aa, Homo Sapiens
SIYCIIVVC

SEQ ID NO: 893773 - protein, 9 aa, Homo Sapiens
DANLYLLDS

SEQ ID NO: 893774 - protein, 9 aa, Homo Sapiens
TARSPVTVM

SEQ ID NO: 893775 - protein, 9 aa, Homo Sapiens
AKEGHYSLY

SEQ ID NO: 893776 - protein, 9 aa, Homo Sapiens
GYYHTERDK

SEQ ID NO: 893777 - protein, 9 aa, Homo Sapiens
PTAQPLLGS

SEQ ID NO: 893778 - protein, 9 aa, Homo Sapiens
SHLKFKHEE

SEQ ID NO: 893779 - protein, 9 aa, Homo Sapiens
GFKSNGPGL

SEQ ID NO: 893780 - protein, 9 aa, Homo Sapiens
DDWDIAAAS

SEQ ID NO: 893781 - protein, 9 aa, Homo Sapiens
LINYQDDAK

SEQ ID NO: 893782 - protein, 9 aa, Homo Sapiens
PWEDCSVLC

SEQ ID NO: 893783 - protein, 9 aa, Homo Sapiens
YEGTDWLGC

SEQ ID NO: 893784 - protein, 9 aa, Homo Sapiens
LRVQELVLQ

SEQ ID NO: 893785 - protein, 9 aa, Homo Sapiens
LGRRVRVWR

SEQ ID NO: 893786 - protein, 9 aa, Homo Sapiens
RDLKPANML

SEQ ID NO: 893787 - protein, 9 aa, Homo Sapiens
HLVQHQIIH

SEQ ID NO: 893788 - protein, 9 aa, Homo Sapiens
LQRRPCNVT

SEQ ID NO: 893789 - protein, 9 aa, Homo Sapiens
SKIHQYKVQ

SEQ ID NO: 893790 - protein, 9 aa, Homo Sapiens
LQKGTKKYP

SEQ ID NO: 893791 - protein, 9 aa, Homo Sapiens
SIISFNSLD

SEQ ID NO: 893792 - protein, 9 aa, Homo Sapiens
DNIKRIIKA

SEQ ID NO: 893793 - protein, 9 aa, Homo Sapiens
RLLKQEERI

SEQ ID NO: 893794 - protein, 9 aa, Homo Sapiens
NRGWFVPLF

SEQ ID NO: 893795 - protein, 9 aa, Homo Sapiens
EGSKQAQKE

SEQ ID NO: 893796 - protein, 9 aa, Homo Sapiens
FCVDLPIKS

SEQ ID NO: 893797 - protein, 9 aa, Homo Sapiens
GNTKQIIDE

SEQ ID NO: 893798 - protein, 9 aa, Homo Sapiens
LNLLTPQHL

SEQ ID NO: 893799 - protein, 9 aa, Homo Sapiens
HRHHLNNPP

SEQ ID NO: 893800 - protein, 9 aa, Homo Sapiens
ACASWIYYS

SEQ ID NO: 893801 - protein, 9 aa, Homo Sapiens
IWFLNPLKL

SEQ ID NO: 893802 - protein, 9 aa, Homo Sapiens
SSAFKSLEE

SEQ ID NO: 893803 - protein, 9 aa, Homo Sapiens
ISKDDLIAY

SEQ ID NO: 893804 - protein, 9 aa, Homo Sapiens
ENMVSLLQE

SEQ ID NO: 893805 - protein, 9 aa, Homo Sapiens
NMLGLARRS

SEQ ID NO: 893806 - protein, 9 aa, Homo Sapiens
APEPDCGYP

SEQ ID NO: 893807 - protein, 9 aa, Homo Sapiens
VIIDRLFLK

SEQ ID NO: 893808 - protein, 9 aa, Homo Sapiens
QIKKWNKAL

SEQ ID NO: 893809 - protein, 9 aa, Homo Sapiens
VHTHYLHQR

SEQ ID NO: 893810 - protein, 9 aa, Homo Sapiens
DWGDTHGDT

SEQ ID NO: 893811 - protein, 9 aa, Homo Sapiens
KTLIRDMLL

SEQ ID NO: 893812 - protein, 9 aa, Homo Sapiens
EGVPDKEGW

SEQ ID NO: 893813 - protein, 9 aa, Homo Sapiens
QEGGAKKAA

SEQ ID NO: 893814 - protein, 9 aa, Homo Sapiens
KTENSRLVS

SEQ ID NO: 893815 - protein, 9 aa, Homo Sapiens
PSAYPVRPE

SEQ ID NO: 893816 - protein, 9 aa, Homo Sapiens
MYKQDGGLE

SEQ ID NO: 893817 - protein, 9 aa, Homo Sapiens
TQPHPCILS

SEQ ID NO: 893818 - protein, 9 aa, Homo Sapiens
QVGKAQMQS

SEQ ID NO: 893819 - protein, 9 aa, Homo Sapiens
PFSELSDSG

SEQ ID NO: 893820 - protein, 9 aa, Homo Sapiens
CKFHCELVN

SEQ ID NO: 893821 - protein, 9 aa, Homo Sapiens
SLGSGSENV

SEQ ID NO: 893822 - protein, 9 aa, Homo Sapiens
ESQLRALGL

SEQ ID NO: 893823 - protein, 9 aa, Homo Sapiens
TGLKVYLQR

SEQ ID NO: 893824 - protein, 9 aa, Homo Sapiens
TSISEIPRW

SEQ ID NO: 893825 - protein, 9 aa, Homo Sapiens
PAIIASCLR

SEQ ID NO: 893826 - protein, 9 aa, Homo Sapiens
GLVGVACAI

SEQ ID NO: 893827 - protein, 9 aa, Homo Sapiens
QMETIQHGV

SEQ ID NO: 893828 - protein, 9 aa, Homo Sapiens
GPWEDCSVL

SEQ ID NO: 893829 - protein, 9 aa, Homo Sapiens
YEHRRSHTG

SEQ ID NO: 893830 - protein, 9 aa, Homo Sapiens
SNVRGKQHG

SEQ ID NO: 893831 - protein, 9 aa, Homo Sapiens
DANILLYVV

SEQ ID NO: 893832 - protein, 9 aa, Homo Sapiens
RRKAFWLPD

SEQ ID NO: 893833 - protein, 9 aa, Homo Sapiens
DLDERRLFC

SEQ ID NO: 893834 - protein, 9 aa, Homo Sapiens
VDPETGRSR

SEQ ID NO: 893835 - protein, 9 aa, Homo Sapiens
KDPRDFKHT

SEQ ID NO: 893836 - protein, 9 aa, Homo Sapiens
SEIEPNNSP

SEQ ID NO: 893837 - protein, 9 aa, Homo Sapiens
KQYCLQKVT

SEQ ID NO: 893838 - protein, 9 aa, Homo Sapiens
LTAQLKDTK

SEQ ID NO: 893839 - protein, 9 aa, Homo Sapiens
VKLLLVRLC

SEQ ID NO: 893840 - protein, 9 aa, Homo Sapiens
LSILWINPD

SEQ ID NO: 893841 - protein, 9 aa, Homo Sapiens
CQACQKTFS

SEQ ID NO: 893842 - protein, 9 aa, Homo Sapiens
TAVNTRQHY

SEQ ID NO: 893843 - protein, 9 aa, Homo Sapiens
TNFQQLYRH

SEQ ID NO: 893844 - protein, 9 aa, Homo Sapiens
TLQNTLQTT

SEQ ID NO: 893845 - protein, 9 aa, Homo Sapiens
HKHINLFIN

SEQ ID NO: 893846 - protein, 9 aa, Homo Sapiens
AVELYRGCV

SEQ ID NO: 893847 - protein, 9 aa, Homo Sapiens
VSLFNRLCS

SEQ ID NO: 893848 - protein, 9 aa, Homo Sapiens
NPIEASLYG

SEQ ID NO: 893849 - protein, 9 aa, Homo Sapiens
IARKTKQVI

SEQ ID NO: 893850 - protein, 9 aa, Homo Sapiens
QYEKERSTR

SEQ ID NO: 893851 - protein, 9 aa, Homo Sapiens
DSILLLGLL

SEQ ID NO: 893852 - protein, 9 aa, Homo Sapiens
GKGCRYLRY

SEQ ID NO: 893853 - protein, 9 aa, Homo Sapiens
RLDGEDGSL

SEQ ID NO: 893854 - protein, 9 aa, Homo Sapiens
KYLELKAKL

SEQ ID NO: 893855 - protein, 9 aa, Homo Sapiens
DFKFKAKHR

SEQ ID NO: 893856 - protein, 9 aa, Homo Sapiens
PAKPISFVG

SEQ ID NO: 893857 - protein, 9 aa, Homo Sapiens
WDNSVKKYS

SEQ ID NO: 893858 - protein, 9 aa, Homo Sapiens
SATAGPETF

SEQ ID NO: 893859 - protein, 9 aa, Homo Sapiens
RGLLARRLQ

SEQ ID NO: 893860 - protein, 9 aa, Homo Sapiens
LNAKVCLLR

SEQ ID NO: 893861 - protein, 9 aa, Homo Sapiens
PLLETFGNA

SEQ ID NO: 893862 - protein, 9 aa, Homo Sapiens
TLDPQAPYP

SEQ ID NO: 893863 - protein, 9 aa, Homo Sapiens
IYNNMLCAG

SEQ ID NO: 893864 - protein, 9 aa, Homo Sapiens
LMRLGRQCW

SEQ ID NO: 893865 - protein, 9 aa, Homo Sapiens
SVCMTLYTL

SEQ ID NO: 893866 - protein, 9 aa, Homo Sapiens
GKFIYLFYS

SEQ ID NO: 893867 - protein, 9 aa, Homo Sapiens
SLDGFYNSH

SEQ ID NO: 893868 - protein, 9 aa, Homo Sapiens
RCKGIVTPE

SEQ ID NO: 893869 - protein, 9 aa, Homo Sapiens
EEGKYSEIE

SEQ ID NO: 893870 - protein, 9 aa, Homo Sapiens
VKAEFRVFC

SEQ ID NO: 893871 - protein, 9 aa, Homo Sapiens
KKRQLQERL

SEQ ID NO: 893872 - protein, 9 aa, Homo Sapiens
DITKILAET

SEQ ID NO: 893873 - protein, 9 aa, Homo Sapiens
TCCLLRITA

SEQ ID NO: 893874 - protein, 9 aa, Homo Sapiens
VQSCNVKAY

SEQ ID NO: 893875 - protein, 9 aa, Homo Sapiens
KLHVDPDNF

SEQ ID NO: 893876 - protein, 9 aa, Homo Sapiens
LNAADTWVD

SEQ ID NO: 893877 - protein, 9 aa, Homo Sapiens
NQMGEENDS

SEQ ID NO: 893878 - protein, 9 aa, Homo Sapiens
LKSNFTIDL

SEQ ID NO: 893879 - protein, 9 aa, Homo Sapiens
LCQLFPSWH

SEQ ID NO: 893880 - protein, 9 aa, Homo Sapiens
AHAASLASV

SEQ ID NO: 893881 - protein, 9 aa, Homo Sapiens
RSNLNTHQI

SEQ ID NO: 893882 - protein, 9 aa, Homo Sapiens
GTDWLGCTL

SEQ ID NO: 893883 - protein, 9 aa, Homo Sapiens
VLVILTTRQ

SEQ ID NO: 893884 - protein, 9 aa, Homo Sapiens
PQRDLEPKQ

SEQ ID NO: 893885 - protein, 9 aa, Homo Sapiens
KYGFTHIST

SEQ ID NO: 893886 - protein, 9 aa, Homo Sapiens
EDNVSFLMK

SEQ ID NO: 893887 - protein, 9 aa, Homo Sapiens
IYQHHEIYL

SEQ ID NO: 893888 - protein, 9 aa, Homo Sapiens
DLRCPLSRN

SEQ ID NO: 893889 - protein, 9 aa, Homo Sapiens
RPKNIPPKE

SEQ ID NO: 893890 - protein, 9 aa, Homo Sapiens
ERGISVLLL

SEQ ID NO: 893891 - protein, 9 aa, Homo Sapiens
GEQQDEESL

SEQ ID NO: 893892 - protein, 9 aa, Homo Sapiens
SVPKSSVLR

SEQ ID NO: 893893 - protein, 9 aa, Homo Sapiens
LRKYLALQQ

SEQ ID NO: 893894 - protein, 9 aa, Homo Sapiens
CNNFWLLQN

SEQ ID NO: 893895 - protein, 9 aa, Homo Sapiens
FLLGLPALY

SEQ ID NO: 893896 - protein, 9 aa, Homo Sapiens
RATASEKMS

SEQ ID NO: 893897 - protein, 9 aa, Homo Sapiens
EDDNKFTET

SEQ ID NO: 893898 - protein, 9 aa, Homo Sapiens
VLAFLAPSV

SEQ ID NO: 893899 - protein, 9 aa, Homo Sapiens
ATKVSLSTF

SEQ ID NO: 893900 - protein, 9 aa, Homo Sapiens
SEQENNGDN

SEQ ID NO: 893901 - protein, 9 aa, Homo Sapiens
REARKITSF

SEQ ID NO: 893902 - protein, 9 aa, Homo Sapiens
LSPVEPSCK

SEQ ID NO: 893903 - protein, 9 aa, Homo Sapiens
MTLVILIQT

SEQ ID NO: 893904 - protein, 9 aa, Homo Sapiens
TMRLPPYAT

SEQ ID NO: 893905 - protein, 9 aa, Homo Sapiens
NVLKVLTNK

SEQ ID NO: 893906 - protein, 9 aa, Homo Sapiens
VRRKPLSFK

SEQ ID NO: 893907 - protein, 9 aa, Homo Sapiens
LHDTHAVAT

SEQ ID NO: 893908 - protein, 9 aa, Homo Sapiens
CCWTFVSKH

SEQ ID NO: 893909 - protein, 9 aa, Homo Sapiens
SHPQSRSAA

SEQ ID NO: 893910 - protein, 9 aa, Homo Sapiens
SQHNSEKLR

SEQ ID NO: 893911 - protein, 9 aa, Homo Sapiens
FNDLGYGYG

SEQ ID NO: 893912 - protein, 9 aa, Homo Sapiens
LLFEVFDKN

SEQ ID NO: 893913 - protein, 9 aa, Homo Sapiens
ISPLRLAYY

SEQ ID NO: 893914 - protein, 9 aa, Homo Sapiens
YHRGYHHGR

SEQ ID NO: 893915 - protein, 9 aa, Homo Sapiens
PYPVEYEVI

SEQ ID NO: 893916 - protein, 9 aa, Homo Sapiens
TDLRGDPVY

SEQ ID NO: 893917 - protein, 9 aa, Homo Sapiens
DDFFQGTRV

SEQ ID NO: 893918 - protein, 9 aa, Homo Sapiens
DLELSNLDI

SEQ ID NO: 893919 - protein, 9 aa, Homo Sapiens
FQWDFLPQF

SEQ ID NO: 893920 - protein, 9 aa, Homo Sapiens
SGSYWVSLP

SEQ ID NO: 893921 - protein, 9 aa, Homo Sapiens
DNQDDSSDN

SEQ ID NO: 893922 - protein, 9 aa, Homo Sapiens
ELSNLDIIK

SEQ ID NO: 893923 - protein, 9 aa, Homo Sapiens
KILQDKHNS

SEQ ID NO: 893924 - protein, 9 aa, Homo Sapiens
EDSLPPGKV

SEQ ID NO: 893925 - protein, 9 aa, Homo Sapiens
DPFKFSSGS

SEQ ID NO: 893926 - protein, 9 aa, Homo Sapiens
RLKLEQVQQ

SEQ ID NO: 893927 - protein, 9 aa, Homo Sapiens
LPALVWHQQ

SEQ ID NO: 893928 - protein, 9 aa, Homo Sapiens
KWHVSKVLR

SEQ ID NO: 893929 - protein, 9 aa, Homo Sapiens
SPAPEDKGR

SEQ ID NO: 893930 - protein, 9 aa, Homo Sapiens
NKGGVSGLT

SEQ ID NO: 893931 - protein, 9 aa, Homo Sapiens
ISFQRHMRM

SEQ ID NO: 893932 - protein, 9 aa, Homo Sapiens
VGRPRPNFF

SEQ ID NO: 893933 - protein, 9 aa, Homo Sapiens
ASFNTFFCE

SEQ ID NO: 893934 - protein, 9 aa, Homo Sapiens
WKNKVASAL

SEQ ID NO: 893935 - protein, 9 aa, Homo Sapiens
KNCVIGCRC

SEQ ID NO: 893936 - protein, 9 aa, Homo Sapiens
VPPRFCHQE

SEQ ID NO: 893937 - protein, 9 aa, Homo Sapiens
LEIPVARFG

SEQ ID NO: 893938 - protein, 9 aa, Homo Sapiens
QNQRYVEQS

SEQ ID NO: 893939 - protein, 9 aa, Homo Sapiens
FKRIAGEAS

SEQ ID NO: 893940 - protein, 9 aa, Homo Sapiens
LNLTQHIRT

SEQ ID NO: 893941 - protein, 9 aa, Homo Sapiens
KQEWIKETF

SEQ ID NO: 893942 - protein, 9 aa, Homo Sapiens
DVEKVGNCY

SEQ ID NO: 893943 - protein, 9 aa, Homo Sapiens
ITDNHDCSQ

SEQ ID NO: 893944 - protein, 9 aa, Homo Sapiens
AMGPAGVGG

SEQ ID NO: 893945 - protein, 9 aa, Homo Sapiens
DSGIPNPCL

SEQ ID NO: 893946 - protein, 9 aa, Homo Sapiens
RKTCFIIHG

SEQ ID NO: 893947 - protein, 9 aa, Homo Sapiens
FDKWRKVSG

SEQ ID NO: 893948 - protein, 9 aa, Homo Sapiens
YPNHPDVLV

SEQ ID NO: 893949 - protein, 9 aa, Homo Sapiens
HPQRYLVIM

SEQ ID NO: 893950 - protein, 9 aa, Homo Sapiens
DVKYLKKED

SEQ ID NO: 893951 - protein, 9 aa, Homo Sapiens
QLITIRNTK

SEQ ID NO: 893952 - protein, 9 aa, Homo Sapiens
KALSPTSPF

SEQ ID NO: 893953 - protein, 9 aa, Homo Sapiens
YCYLTDIFT

SEQ ID NO: 893954 - protein, 9 aa, Homo Sapiens
TTTEKTTKS

SEQ ID NO: 893955 - protein, 9 aa, Homo Sapiens
IGYEGINSP

SEQ ID NO: 893956 - protein, 9 aa, Homo Sapiens
PELLLYPSQ

SEQ ID NO: 893957 - protein, 9 aa, Homo Sapiens
DDKSSGKQL

SEQ ID NO: 893958 - protein, 9 aa, Homo Sapiens
IFKNSQGEE

SEQ ID NO: 893959 - protein, 9 aa, Homo Sapiens
HQQELCGRC

SEQ ID NO: 893960 - protein, 9 aa, Homo Sapiens
VHNGRMLLH

SEQ ID NO: 893961 - protein, 9 aa, Homo Sapiens
LKKKPRRLC

SEQ ID NO: 893962 - protein, 9 aa, Homo Sapiens
VVWKQPRLT

SEQ ID NO: 893963 - protein, 9 aa, Homo Sapiens
SETPPDGER

SEQ ID NO: 893964 - protein, 9 aa, Homo Sapiens
KLLDGKQSQ

SEQ ID NO: 893965 - protein, 9 aa, Homo Sapiens
ESSELRFLD

SEQ ID NO: 893966 - protein, 9 aa, Homo Sapiens
LQNGAPLTR

SEQ ID NO: 893967 - protein, 9 aa, Homo Sapiens
RGKIYNFWL

SEQ ID NO: 893968 - protein, 9 aa, Homo Sapiens
LNAQTGLIT

SEQ ID NO: 893969 - protein, 9 aa, Homo Sapiens
NSIDHQIPN

SEQ ID NO: 893970 - protein, 9 aa, Homo Sapiens
NPKSLITHV

SEQ ID NO: 893971 - protein, 9 aa, Homo Sapiens
HKRDLNSIL

SEQ ID NO: 893972 - protein, 9 aa, Homo Sapiens
FCRAVLCGV

SEQ ID NO: 893973 - protein, 9 aa, Homo Sapiens
VPILELACT

SEQ ID NO: 893974 - protein, 9 aa, Homo Sapiens
LNGICLYGR

SEQ ID NO: 893975 - protein, 9 aa, Homo Sapiens
REPVTINCG

SEQ ID NO: 893976 - protein, 9 aa, Homo Sapiens
VQMEYKKWF

SEQ ID NO: 893977 - protein, 9 aa, Homo Sapiens
EDCKLNNGR

SEQ ID NO: 893978 - protein, 9 aa, Homo Sapiens
EEDINKIYD

SEQ ID NO: 893979 - protein, 9 aa, Homo Sapiens
PASDSRPTK

SEQ ID NO: 893980 - protein, 9 aa, Homo Sapiens
GRMFASLSS

SEQ ID NO: 893981 - protein, 9 aa, Homo Sapiens
AVVFQEAFE

SEQ ID NO: 893982 - protein, 9 aa, Homo Sapiens
KIMTKAKYL

SEQ ID NO: 893983 - protein, 9 aa, Homo Sapiens
TPMLNPLIC

SEQ ID NO: 893984 - protein, 9 aa, Homo Sapiens
CRQSTHLKI

SEQ ID NO: 893985 - protein, 9 aa, Homo Sapiens
IMVMKINGS

SEQ ID NO: 893986 - protein, 9 aa, Homo Sapiens
EDPNNCLIV

SEQ ID NO: 893987 - protein, 9 aa, Homo Sapiens
HRNSLYVVR

SEQ ID NO: 893988 - protein, 9 aa, Homo Sapiens
LGKTNKQSP

SEQ ID NO: 893989 - protein, 9 aa, Homo Sapiens
ANKLTKLNV

SEQ ID NO: 893990 - protein, 9 aa, Homo Sapiens
AYNIPVRKP

SEQ ID NO: 893991 - protein, 9 aa, Homo Sapiens
MGNYRQIYP

SEQ ID NO: 893992 - protein, 9 aa, Homo Sapiens
PRSTSQNFP

SEQ ID NO: 893993 - protein, 9 aa, Homo Sapiens
KSVFLSRSL

SEQ ID NO: 893994 - protein, 9 aa, Homo Sapiens
RNYPLAIKN

SEQ ID NO: 893995 - protein, 9 aa, Homo Sapiens
ELSLSEKNN

SEQ ID NO: 893996 - protein, 9 aa, Homo Sapiens
KRHFMFQNH

SEQ ID NO: 893997 - protein, 9 aa, Homo Sapiens
LFGHQPYWW

SEQ ID NO: 893998 - protein, 9 aa, Homo Sapiens
DPPHRKHMV

SEQ ID NO: 893999 - protein, 9 aa, Homo Sapiens
GKGKCLPEV

SEQ ID NO: 894000 - protein, 9 aa, Homo Sapiens
LMFTSVTRC

SEQ ID NO: 894001 - protein, 9 aa, Homo Sapiens
KSSGKQLRI

SEQ ID NO: 894002 - protein, 9 aa, Homo Sapiens
PVQLISGFP

SEQ ID NO: 894003 - protein, 9 aa, Homo Sapiens
LYYKYPSDV

SEQ ID NO: 894004 - protein, 9 aa, Homo Sapiens
ALGHKLPVL

SEQ ID NO: 894005 - protein, 9 aa, Homo Sapiens
VNPDCIKQT

SEQ ID NO: 894006 - protein, 9 aa, Homo Sapiens
EGYYHTERD

SEQ ID NO: 894007 - protein, 9 aa, Homo Sapiens
ASWIYYSAV

SEQ ID NO: 894008 - protein, 9 aa, Homo Sapiens
SPVPKETPA

SEQ ID NO: 894009 - protein, 9 aa, Homo Sapiens
VIGCYPQEN

SEQ ID NO: 894010 - protein, 9 aa, Homo Sapiens
SGFKRYVTT

SEQ ID NO: 894011 - protein, 9 aa, Homo Sapiens
AYKLLSQAE

SEQ ID NO: 894012 - protein, 9 aa, Homo Sapiens
PCGATSSSG

SEQ ID NO: 894013 - protein, 9 aa, Homo Sapiens
PGPMSAAFP

SEQ ID NO: 894014 - protein, 9 aa, Homo Sapiens
PVKAFPVFL

SEQ ID NO: 894015 - protein, 9 aa, Homo Sapiens
VVKREVNKR

SEQ ID NO: 894016 - protein, 9 aa, Homo Sapiens
VDEEIVLRI

SEQ ID NO: 894017 - protein, 9 aa, Homo Sapiens
YEAVNNYIV

SEQ ID NO: 894018 - protein, 9 aa, Homo Sapiens
LMDANICQV

SEQ ID NO: 894019 - protein, 9 aa, Homo Sapiens
QGPGHQNNV

SEQ ID NO: 894020 - protein, 9 aa, Homo Sapiens
EQIWRRRPT

SEQ ID NO: 894021 - protein, 9 aa, Homo Sapiens
VFKPTRDDC

SEQ ID NO: 894022 - protein, 9 aa, Homo Sapiens
FFDQERIVT

SEQ ID NO: 894023 - protein, 9 aa, Homo Sapiens
ERQENLKLV

SEQ ID NO: 894024 - protein, 9 aa, Homo Sapiens
EIDHTQYQF

SEQ ID NO: 894025 - protein, 9 aa, Homo Sapiens
SDSLQYVQC

SEQ ID NO: 894026 - protein, 9 aa, Homo Sapiens
SVGNTCGLE

SEQ ID NO: 894027 - protein, 9 aa, Homo Sapiens
LQITASPDS

SEQ ID NO: 894028 - protein, 9 aa, Homo Sapiens
SGSHLEGWN

SEQ ID NO: 894029 - protein, 9 aa, Homo Sapiens
NLGPAEWQG

SEQ ID NO: 894030 - protein, 9 aa, Homo Sapiens
CSLNINVLH

SEQ ID NO: 894031 - protein, 9 aa, Homo Sapiens
EERMKQKNE

SEQ ID NO: 894032 - protein, 9 aa, Homo Sapiens
QKTLYFPNP

SEQ ID NO: 894033 - protein, 9 aa, Homo Sapiens
EIWTFFIHF

SEQ ID NO: 894034 - protein, 9 aa, Homo Sapiens
LGSPDVEEC

SEQ ID NO: 894035 - protein, 9 aa, Homo Sapiens
FIETELSSS

SEQ ID NO: 894036 - protein, 9 aa, Homo Sapiens
EPANGFLVC

SEQ ID NO: 894037 - protein, 9 aa, Homo Sapiens
DHTVSLLTA

SEQ ID NO: 894038 - protein, 9 aa, Homo Sapiens
IQDEELYTL

SEQ ID NO: 894039 - protein, 9 aa, Homo Sapiens
KIQILATLE

SEQ ID NO: 894040 - protein, 9 aa, Homo Sapiens
YKRATASEK

SEQ ID NO: 894041 - protein, 9 aa, Homo Sapiens
KPPKTTKKP

SEQ ID NO: 894042 - protein, 9 aa, Homo Sapiens
YLYMAKARI

SEQ ID NO: 894043 - protein, 9 aa, Homo Sapiens
EPSITLQPP

SEQ ID NO: 894044 - protein, 9 aa, Homo Sapiens
CGKGFNLPN

SEQ ID NO: 894045 - protein, 9 aa, Homo Sapiens
ISSQISWPL

SEQ ID NO: 894046 - protein, 9 aa, Homo Sapiens
ANQVSVEGL

SEQ ID NO: 894047 - protein, 9 aa, Homo Sapiens
NLIQQAKLY

SEQ ID NO: 894048 - protein, 9 aa, Homo Sapiens
VARFGARRL

SEQ ID NO: 894049 - protein, 9 aa, Homo Sapiens
LSILKMHFA

SEQ ID NO: 894050 - protein, 9 aa, Homo Sapiens
QRNVWFAEF

SEQ ID NO: 894051 - protein, 9 aa, Homo Sapiens
IYNKCKIKN

SEQ ID NO: 894052 - protein, 9 aa, Homo Sapiens
EAVACNTEG

SEQ ID NO: 894053 - protein, 9 aa, Homo Sapiens
FRIAYILPA

SEQ ID NO: 894054 - protein, 9 aa, Homo Sapiens
RQNPSCGSD

SEQ ID NO: 894055 - protein, 9 aa, Homo Sapiens
QGNFQYDNF

SEQ ID NO: 894056 - protein, 9 aa, Homo Sapiens
DLVLDRICK

SEQ ID NO: 894057 - protein, 9 aa, Homo Sapiens
ERICKFQIL

SEQ ID NO: 894058 - protein, 9 aa, Homo Sapiens
VSLCHPVWS

SEQ ID NO: 894059 - protein, 9 aa, Homo Sapiens
RMHIRRKQI

SEQ ID NO: 894060 - protein, 9 aa, Homo Sapiens
CPTKLFPPL

SEQ ID NO: 894061 - protein, 9 aa, Homo Sapiens
LCVFDGDKH

SEQ ID NO: 894062 - protein, 9 aa, Homo Sapiens
MAPRNLKAY

SEQ ID NO: 894063 - protein, 9 aa, Homo Sapiens
EITRLTLSG

SEQ ID NO: 894064 - protein, 9 aa, Homo Sapiens
LEDQVACNA

SEQ ID NO: 894065 - protein, 9 aa, Homo Sapiens
VQIGDMRIM

SEQ ID NO: 894066 - protein, 9 aa, Homo Sapiens
NAPHNYAVR

SEQ ID NO: 894067 - protein, 9 aa, Homo Sapiens
NIYDSKLWE

SEQ ID NO: 894068 - protein, 9 aa, Homo Sapiens
FKWILFGHQ

SEQ ID NO: 894069 - protein, 9 aa, Homo Sapiens
PQMLTKENS

SEQ ID NO: 894070 - protein, 9 aa, Homo Sapiens
QRWMRGFLV

SEQ ID NO: 894071 - protein, 9 aa, Homo Sapiens
TPKLNLLLT

SEQ ID NO: 894072 - protein, 9 aa, Homo Sapiens
ASCHPEGII

SEQ ID NO: 894073 - protein, 9 aa, Homo Sapiens
RFSLEISKP

SEQ ID NO: 894074 - protein, 9 aa, Homo Sapiens
EPLQRPKML

SEQ ID NO: 894075 - protein, 9 aa, Homo Sapiens
SEICYSTWK

SEQ ID NO: 894076 - protein, 9 aa, Homo Sapiens
VGKQDPKHH

SEQ ID NO: 894077 - protein, 9 aa, Homo Sapiens
SYVKKKKRR

SEQ ID NO: 894078 - protein, 9 aa, Homo Sapiens
GMPRMLPFL

SEQ ID NO: 894079 - protein, 9 aa, Homo Sapiens
KFTKKLQNP

SEQ ID NO: 894080 - protein, 9 aa, Homo Sapiens
HFIHNSANV

SEQ ID NO: 894081 - protein, 9 aa, Homo Sapiens
QNQFIANHP

SEQ ID NO: 894082 - protein, 9 aa, Homo Sapiens
SNNTTSIAQ

SEQ ID NO: 894083 - protein, 9 aa, Homo Sapiens
KHKYIITSL

SEQ ID NO: 894084 - protein, 9 aa, Homo Sapiens
QITTAAALS

SEQ ID NO: 894085 - protein, 9 aa, Homo Sapiens
PMPNLREFW

SEQ ID NO: 894086 - protein, 9 aa, Homo Sapiens
SHTMNKHSS

SEQ ID NO: 894087 - protein, 9 aa, Homo Sapiens
AATCSTIGP

SEQ ID NO: 894088 - protein, 9 aa, Homo Sapiens
IFRFRLWQC

SEQ ID NO: 894089 - protein, 9 aa, Homo Sapiens
KTFHRYTVW

SEQ ID NO: 894090 - protein, 9 aa, Homo Sapiens
VVKLVCGNI

SEQ ID NO: 894091 - protein, 9 aa, Homo Sapiens
EPQDGVIQI

SEQ ID NO: 894092 - protein, 9 aa, Homo Sapiens
NMPVCLCGT

SEQ ID NO: 894093 - protein, 9 aa, Homo Sapiens
HRQTEDKKR

SEQ ID NO: 894094 - protein, 9 aa, Homo Sapiens
MEPKNFIHG

SEQ ID NO: 894095 - protein, 9 aa, Homo Sapiens
RDAHRQIML

SEQ ID NO: 894096 - protein, 9 aa, Homo Sapiens
ISSAEKTSS

SEQ ID NO: 894097 - protein, 9 aa, Homo Sapiens
LNGKDKYKV

SEQ ID NO: 894098 - protein, 9 aa, Homo Sapiens
RIFYYLHVL

SEQ ID NO: 894099 - protein, 9 aa, Homo Sapiens
RRNIIPETL

SEQ ID NO: 894100 - protein, 9 aa, Homo Sapiens
ILPKEICAQ

SEQ ID NO: 894101 - protein, 9 aa, Homo Sapiens
ENQAMDNHM

SEQ ID NO: 894102 - protein, 9 aa, Homo Sapiens
DFFQGTRVA

SEQ ID NO: 894103 - protein, 9 aa, Homo Sapiens
CCWVLPDTP

SEQ ID NO: 894104 - protein, 9 aa, Homo Sapiens
ECDVVKGKQ

SEQ ID NO: 894105 - protein, 9 aa, Homo Sapiens
LLLLFSNWM

SEQ ID NO: 894106 - protein, 9 aa, Homo Sapiens
WLKIIRVDA

SEQ ID NO: 894107 - protein, 9 aa, Homo Sapiens
KLTGSRRNQ

SEQ ID NO: 894108 - protein, 9 aa, Homo Sapiens
IQHCNICCM

SEQ ID NO: 894109 - protein, 9 aa, Homo Sapiens
KNFDRDNVR

SEQ ID NO: 894110 - protein, 9 aa, Homo Sapiens
MVLAYVLAS

SEQ ID NO: 894111 - protein, 9 aa, Homo Sapiens
IRVILGQQL

SEQ ID NO: 894112 - protein, 9 aa, Homo Sapiens
FSVLIEFAA

SEQ ID NO: 894113 - protein, 9 aa, Homo Sapiens
ICKLDNGGY

SEQ ID NO: 894114 - protein, 9 aa, Homo Sapiens
PKAWNFRGQ

SEQ ID NO: 894115 - protein, 9 aa, Homo Sapiens
CGLDIVLWN

SEQ ID NO: 894116 - protein, 9 aa, Homo Sapiens
ARRLLKQHV

SEQ ID NO: 894117 - protein, 9 aa, Homo Sapiens
RQFSGLERS

SEQ ID NO: 894118 - protein, 9 aa, Homo Sapiens
CKKVEQDAA

SEQ ID NO: 894119 - protein, 9 aa, Homo Sapiens
SHSLDVAKA

SEQ ID NO: 894120 - protein, 9 aa, Homo Sapiens
TNDHVQFLI

SEQ ID NO: 894121 - protein, 9 aa, Homo Sapiens
LGLQLHPAS

SEQ ID NO: 894122 - protein, 9 aa, Homo Sapiens
NAENFDQFF

SEQ ID NO: 894123 - protein, 9 aa, Homo Sapiens
GYPPPVAPS

SEQ ID NO: 894124 - protein, 9 aa, Homo Sapiens
LMINFNGEE

SEQ ID NO: 894125 - protein, 9 aa, Homo Sapiens
NLEHHLNEM

SEQ ID NO: 894126 - protein, 9 aa, Homo Sapiens
TTLPTAMQL

SEQ ID NO: 894127 - protein, 9 aa, Homo Sapiens
CMKIKILGD

SEQ ID NO: 894128 - protein, 9 aa, Homo Sapiens
TLMRTCECL

SEQ ID NO: 894129 - protein, 9 aa, Homo Sapiens
VCFITLSFP

SEQ ID NO: 894130 - protein, 9 aa, Homo Sapiens
MKQKFIVTQ

SEQ ID NO: 894131 - protein, 9 aa, Homo Sapiens
PAEVKILAV

SEQ ID NO: 894132 - protein, 9 aa, Homo Sapiens
VMSIQDLQT

SEQ ID NO: 894133 - protein, 9 aa, Homo Sapiens
MTPEGKWHV

SEQ ID NO: 894134 - protein, 9 aa, Homo Sapiens
YFHCLHLFI

SEQ ID NO: 894135 - protein, 9 aa, Homo Sapiens
LRSAKDIKH

SEQ ID NO: 894136 - protein, 9 aa, Homo Sapiens
LPALNMQHS

SEQ ID NO: 894137 - protein, 9 aa, Homo Sapiens
FLGMACGLT

SEQ ID NO: 894138 - protein, 9 aa, Homo Sapiens
KIIGKMLNS

SEQ ID NO: 894139 - protein, 9 aa, Homo Sapiens
VSLQMDSNK

SEQ ID NO: 894140 - protein, 9 aa, Homo Sapiens
CSKLGAKLN

SEQ ID NO: 894141 - protein, 9 aa, Homo Sapiens
NGNSNKKKK

SEQ ID NO: 894142 - protein, 9 aa, Homo Sapiens
NFVLGRDKV

SEQ ID NO: 894143 - protein, 9 aa, Homo Sapiens
INCNEKPTN

SEQ ID NO: 894144 - protein, 9 aa, Homo Sapiens
TARVMIGHI

SEQ ID NO: 894145 - protein, 9 aa, Homo Sapiens
QMKQKYRVC

SEQ ID NO: 894146 - protein, 9 aa, Homo Sapiens
LRKNTVKCS

SEQ ID NO: 894147 - protein, 9 aa, Homo Sapiens
GDKLYSLKS

SEQ ID NO: 894148 - protein, 9 aa, Homo Sapiens
LSDNSGRDD

SEQ ID NO: 894149 - protein, 9 aa, Homo Sapiens
HVCFITLSF

SEQ ID NO: 894150 - protein, 9 aa, Homo Sapiens
DEVDANLIN

SEQ ID NO: 894151 - protein, 9 aa, Homo Sapiens
EPGKSSIIQ

SEQ ID NO: 894152 - protein, 9 aa, Homo Sapiens
YLQQYVEAG

SEQ ID NO: 894153 - protein, 9 aa, Homo Sapiens
YFFHRSPQL

SEQ ID NO: 894154 - protein, 9 aa, Homo Sapiens
LLRFKVSVS

SEQ ID NO: 894155 - protein, 9 aa, Homo Sapiens
HQLSTLDKA

SEQ ID NO: 894156 - protein, 9 aa, Homo Sapiens
KYYILTDSQ

SEQ ID NO: 894157 - protein, 9 aa, Homo Sapiens
KPGRQSDLL

SEQ ID NO: 894158 - protein, 9 aa, Homo Sapiens
LPSFPENII

SEQ ID NO: 894159 - protein, 9 aa, Homo Sapiens
PRFGKMEGN

SEQ ID NO: 894160 - protein, 9 aa, Homo Sapiens
DLQSSDLKT

SEQ ID NO: 894161 - protein, 9 aa, Homo Sapiens
PEYVPWMAT

SEQ ID NO: 894162 - protein, 9 aa, Homo Sapiens
SRTREQSRS

SEQ ID NO: 894163 - protein, 9 aa, Homo Sapiens
ICGKRFMQL

SEQ ID NO: 894164 - protein, 9 aa, Homo Sapiens
RNRSPCMQY

SEQ ID NO: 894165 - protein, 9 aa, Homo Sapiens
MFPCQFIKI

SEQ ID NO: 894166 - protein, 9 aa, Homo Sapiens
PDHLEEQLP

SEQ ID NO: 894167 - protein, 9 aa, Homo Sapiens
WKPKYVYKN

SEQ ID NO: 894168 - protein, 9 aa, Homo Sapiens
PKQAIFKGS

SEQ ID NO: 894169 - protein, 9 aa, Homo Sapiens
HSRSSSVGS

SEQ ID NO: 894170 - protein, 9 aa, Homo Sapiens
DFEQMKEYR

SEQ ID NO: 894171 - protein, 9 aa, Homo Sapiens
SFSFVCVIS

SEQ ID NO: 894172 - protein, 9 aa, Homo Sapiens
ITPKMLADV

SEQ ID NO: 894173 - protein, 9 aa, Homo Sapiens
TRGDFLAYL

SEQ ID NO: 894174 - protein, 9 aa, Homo Sapiens
WEPNDPSLG

SEQ ID NO: 894175 - protein, 9 aa, Homo Sapiens
KEDPMMYPE

SEQ ID NO: 894176 - protein, 9 aa, Homo Sapiens
KNNLNPVCE

SEQ ID NO: 894177 - protein, 9 aa, Homo Sapiens
FKCKLCCWT

SEQ ID NO: 894178 - protein, 9 aa, Homo Sapiens
CHYCRGFNI

SEQ ID NO: 894179 - protein, 9 aa, Homo Sapiens
YCSYKTSKR

SEQ ID NO: 894180 - protein, 9 aa, Homo Sapiens
YSFDVKYIN

SEQ ID NO: 894181 - protein, 9 aa, Homo Sapiens
TFLCWIAYG

SEQ ID NO: 894182 - protein, 9 aa, Homo Sapiens
QFRTQNDFA

SEQ ID NO: 894183 - protein, 9 aa, Homo Sapiens
NGVTQLSIL

SEQ ID NO: 894184 - protein, 9 aa, Homo Sapiens
TKFLAMDKV

SEQ ID NO: 894185 - protein, 9 aa, Homo Sapiens
CGQERFQVK

SEQ ID NO: 894186 - protein, 9 aa, Homo Sapiens
SLPIVFNEF

SEQ ID NO: 894187 - protein, 9 aa, Homo Sapiens
LRGPPGPME

SEQ ID NO: 894188 - protein, 9 aa, Homo Sapiens
SYSQDYRRR

SEQ ID NO: 894189 - protein, 9 aa, Homo Sapiens
ELVSWYLKE

SEQ ID NO: 894190 - protein, 9 aa, Homo Sapiens
EVPPRFCHQ

SEQ ID NO: 894191 - protein, 9 aa, Homo Sapiens
SSSPETPKF

SEQ ID NO: 894192 - protein, 9 aa, Homo Sapiens
STFFRYLGD

SEQ ID NO: 894193 - protein, 9 aa, Homo Sapiens
LKKMVERIC

SEQ ID NO: 894194 - protein, 9 aa, Homo Sapiens
NNKGLFSLV

SEQ ID NO: 894195 - protein, 9 aa, Homo Sapiens
RELAKYSEL

SEQ ID NO: 894196 - protein, 9 aa, Homo Sapiens
TAKTTSVST

SEQ ID NO: 894197 - protein, 9 aa, Homo Sapiens
DYAQIFQFQ

SEQ ID NO: 894198 - protein, 9 aa, Homo Sapiens
KNVENNCYR

SEQ ID NO: 894199 - protein, 9 aa, Homo Sapiens
RSQMIEHID

SEQ ID NO: 894200 - protein, 9 aa, Homo Sapiens
RIKTSILSL

SEQ ID NO: 894201 - protein, 9 aa, Homo Sapiens
PCMQYRSHM

SEQ ID NO: 894202 - protein, 9 aa, Homo Sapiens
EKKEESKLK

SEQ ID NO: 894203 - protein, 9 aa, Homo Sapiens
TKPKRSQSP

SEQ ID NO: 894204 - protein, 9 aa, Homo Sapiens
TTLMMTTAL

SEQ ID NO: 894205 - protein, 9 aa, Homo Sapiens
VLLQTLAYI

SEQ ID NO: 894206 - protein, 9 aa, Homo Sapiens
VCCNNEAKD

SEQ ID NO: 894207 - protein, 9 aa, Homo Sapiens
GGRLEPPKN

SEQ ID NO: 894208 - protein, 9 aa, Homo Sapiens
DVCWHNKGK

SEQ ID NO: 894209 - protein, 9 aa, Homo Sapiens
YPSQRFEEY

SEQ ID NO: 894210 - protein, 9 aa, Homo Sapiens
SICAITLGH

SEQ ID NO: 894211 - protein, 9 aa, Homo Sapiens
DKNQGKLIP

SEQ ID NO: 894212 - protein, 9 aa, Homo Sapiens
RLIKQSREF

SEQ ID NO: 894213 - protein, 9 aa, Homo Sapiens
KPSCIWRFA

SEQ ID NO: 894214 - protein, 9 aa, Homo Sapiens
EFTETSVVF

SEQ ID NO: 894215 - protein, 9 aa, Homo Sapiens
GCPAMGHFA

SEQ ID NO: 894216 - protein, 9 aa, Homo Sapiens
KTGNAYEDL

SEQ ID NO: 894217 - protein, 9 aa, Homo Sapiens
QIRGLPVSG

SEQ ID NO: 894218 - protein, 9 aa, Homo Sapiens
FGKGAQGVP

SEQ ID NO: 894219 - protein, 9 aa, Homo Sapiens
SFLSEELDS

SEQ ID NO: 894220 - protein, 9 aa, Homo Sapiens
SISKDDLIA

SEQ ID NO: 894221 - protein, 9 aa, Homo Sapiens
SSKTGETVV

SEQ ID NO: 894222 - protein, 9 aa, Homo Sapiens
LVIAVVLGA

SEQ ID NO: 894223 - protein, 9 aa, Homo Sapiens
CWVLPDTPF

SEQ ID NO: 894224 - protein, 9 aa, Homo Sapiens
KFSSNYRAW

SEQ ID NO: 894225 - protein, 9 aa, Homo Sapiens
EFKRTQNNL

SEQ ID NO: 894226 - protein, 9 aa, Homo Sapiens
EPRSKIPLQ

SEQ ID NO: 894227 - protein, 9 aa, Homo Sapiens
AMQNLNEDD

SEQ ID NO: 894228 - protein, 9 aa, Homo Sapiens
EVFFPNNQE

SEQ ID NO: 894229 - protein, 9 aa, Homo Sapiens
NDIFKRIAG

SEQ ID NO: 894230 - protein, 9 aa, Homo Sapiens
EEKMWRLEE

SEQ ID NO: 894231 - protein, 9 aa, Homo Sapiens
QRYQKQMEE

SEQ ID NO: 894232 - protein, 9 aa, Homo Sapiens
PIVKKIIGK

SEQ ID NO: 894233 - protein, 9 aa, Homo Sapiens
TSLQITASP

SEQ ID NO: 894234 - protein, 9 aa, Homo Sapiens
TFQELFGLN

SEQ ID NO: 894235 - protein, 9 aa, Homo Sapiens
GKGAQGVPF

SEQ ID NO: 894236 - protein, 9 aa, Homo Sapiens
PDRGTSFNL

SEQ ID NO: 894237 - protein, 9 aa, Homo Sapiens
QRFLSRIKF

SEQ ID NO: 894238 - protein, 9 aa, Homo Sapiens
LDGKQSQTV

SEQ ID NO: 894239 - protein, 9 aa, Homo Sapiens
MDTHPKYLE

SEQ ID NO: 894240 - protein, 9 aa, Homo Sapiens
QTLNLFFTV

SEQ ID NO: 894241 - protein, 9 aa, Homo Sapiens
HTGFDWLLS

SEQ ID NO: 894242 - protein, 9 aa, Homo Sapiens
WTSLAEGAP

SEQ ID NO: 894243 - protein, 9 aa, Homo Sapiens
EVKILAVFY

SEQ ID NO: 894244 - protein, 9 aa, Homo Sapiens
EIIEEIIQT

SEQ ID NO: 894245 - protein, 9 aa, Homo Sapiens
IDKLETPSD

SEQ ID NO: 894246 - protein, 9 aa, Homo Sapiens
KFLAMDKVA

SEQ ID NO: 894247 - protein, 9 aa, Homo Sapiens
TPPKAWHKD

SEQ ID NO: 894248 - protein, 9 aa, Homo Sapiens
KVEIEKIWQ

SEQ ID NO: 894249 - protein, 9 aa, Homo Sapiens
LYKICVCPD

SEQ ID NO: 894250 - protein, 9 aa, Homo Sapiens
PAICALHHL

SEQ ID NO: 894251 - protein, 9 aa, Homo Sapiens
ADMKNQGEE

SEQ ID NO: 894252 - protein, 9 aa, Homo Sapiens
DTHAEMVHS

SEQ ID NO: 894253 - protein, 9 aa, Homo Sapiens
GRTSFDEFI

SEQ ID NO: 894254 - protein, 9 aa, Homo Sapiens
YDKLFQIHL

SEQ ID NO: 894255 - protein, 9 aa, Homo Sapiens
VQVLQDNFV

SEQ ID NO: 894256 - protein, 9 aa, Homo Sapiens
RSELVSWYL

SEQ ID NO: 894257 - protein, 9 aa, Homo Sapiens
ALCGLPDGQ

SEQ ID NO: 894258 - protein, 9 aa, Homo Sapiens
RTTKSPPSP

SEQ ID NO: 894259 - protein, 9 aa, Homo Sapiens
DANLNMLRA

SEQ ID NO: 894260 - protein, 9 aa, Homo Sapiens
YHTGRLHMM

SEQ ID NO: 894261 - protein, 9 aa, Homo Sapiens
SKQAQKENE

SEQ ID NO: 894262 - protein, 9 aa, Homo Sapiens
LFIFQILLL

SEQ ID NO: 894263 - protein, 9 aa, Homo Sapiens
YSNLFQLHE

SEQ ID NO: 894264 - protein, 9 aa, Homo Sapiens
DVFLICLSL

SEQ ID NO: 894265 - protein, 9 aa, Homo Sapiens
AYLVACTWA

SEQ ID NO: 894266 - protein, 9 aa, Homo Sapiens
LNRCRQAGS

SEQ ID NO: 894267 - protein, 9 aa, Homo Sapiens
ITKKTSSFN

SEQ ID NO: 894268 - protein, 9 aa, Homo Sapiens
KREVNKRRQ

SEQ ID NO: 894269 - protein, 9 aa, Homo Sapiens
TQLQVVRKL

SEQ ID NO: 894270 - protein, 9 aa, Homo Sapiens
EQQINIPPQ

SEQ ID NO: 894271 - protein, 9 aa, Homo Sapiens
CMKTEAESN

SEQ ID NO: 894272 - protein, 9 aa, Homo Sapiens
SSIDYLRLN

SEQ ID NO: 894273 - protein, 9 aa, Homo Sapiens
EKWFIDALE

SEQ ID NO: 894274 - protein, 9 aa, Homo Sapiens
DNCSWTSFR

SEQ ID NO: 894275 - protein, 9 aa, Homo Sapiens
QFRKEKDTF

SEQ ID NO: 894276 - protein, 9 aa, Homo Sapiens
LNGCRVTNE

SEQ ID NO: 894277 - protein, 9 aa, Homo Sapiens
HQKSSSDSD

SEQ ID NO: 894278 - protein, 9 aa, Homo Sapiens
EDIQNVVLQ

SEQ ID NO: 894279 - protein, 9 aa, Homo Sapiens
IAAIKSFKV

SEQ ID NO: 894280 - protein, 9 aa, Homo Sapiens
AWELPKIAY

SEQ ID NO: 894281 - protein, 9 aa, Homo Sapiens
RGWFVPLFG

SEQ ID NO: 894282 - protein, 9 aa, Homo Sapiens
LGEIVRTIL

SEQ ID NO: 894283 - protein, 9 aa, Homo Sapiens
LTQHQITHT

SEQ ID NO: 894284 - protein, 9 aa, Homo Sapiens
AGALLHLPS

SEQ ID NO: 894285 - protein, 9 aa, Homo Sapiens
GTWQKRFSS

SEQ ID NO: 894286 - protein, 9 aa, Homo Sapiens
HSFVQLCAD

SEQ ID NO: 894287 - protein, 9 aa, Homo Sapiens
GTPSEVYHF

SEQ ID NO: 894288 - protein, 9 aa, Homo Sapiens
DIGNSIKHR

SEQ ID NO: 894289 - protein, 9 aa, Homo Sapiens
NQCGKAFNQ

SEQ ID NO: 894290 - protein, 9 aa, Homo Sapiens
SIVEWKPFN

SEQ ID NO: 894291 - protein, 9 aa, Homo Sapiens
SSDNGFLAD

SEQ ID NO: 894292 - protein, 9 aa, Homo Sapiens
NSLYEHRRS

SEQ ID NO: 894293 - protein, 9 aa, Homo Sapiens
LELTSQCKL

SEQ ID NO: 894294 - protein, 9 aa, Homo Sapiens
SVFYFTIPL

SEQ ID NO: 894295 - protein, 9 aa, Homo Sapiens
KLPQLWHIS

SEQ ID NO: 894296 - protein, 9 aa, Homo Sapiens
TSLLMECLS

SEQ ID NO: 894297 - protein, 9 aa, Homo Sapiens
MTKAKYLCI

SEQ ID NO: 894298 - protein, 9 aa, Homo Sapiens
PKGNKVQIK

SEQ ID NO: 894299 - protein, 9 aa, Homo Sapiens
DQVNCKDAR

SEQ ID NO: 894300 - protein, 9 aa, Homo Sapiens
TGEKPFWCT

SEQ ID NO: 894301 - protein, 9 aa, Homo Sapiens
SLVIELDKY

SEQ ID NO: 894302 - protein, 9 aa, Homo Sapiens
TLATIIRQL

SEQ ID NO: 894303 - protein, 9 aa, Homo Sapiens
FNLLSNITN

SEQ ID NO: 894304 - protein, 9 aa, Homo Sapiens
LASSAAPLL

SEQ ID NO: 894305 - protein, 9 aa, Homo Sapiens
LGAVYYCLH

SEQ ID NO: 894306 - protein, 9 aa, Homo Sapiens
SVERVRSTI

SEQ ID NO: 894307 - protein, 9 aa, Homo Sapiens
FRFRLWQCG

SEQ ID NO: 894308 - protein, 9 aa, Homo Sapiens
KDKNQGKLI

SEQ ID NO: 894309 - protein, 9 aa, Homo Sapiens
IRNRTEARG

SEQ ID NO: 894310 - protein, 9 aa, Homo Sapiens
KLAEWLEQR

SEQ ID NO: 894311 - protein, 9 aa, Homo Sapiens
MGTYVTSVL

SEQ ID NO: 894312 - protein, 9 aa, Homo Sapiens
CHGSSVLSL

SEQ ID NO: 894313 - protein, 9 aa, Homo Sapiens
GDLAGCAEI

SEQ ID NO: 894314 - protein, 9 aa, Homo Sapiens
DDERVCEYY

SEQ ID NO: 894315 - protein, 9 aa, Homo Sapiens
FCSGYQLTQ

SEQ ID NO: 894316 - protein, 9 aa, Homo Sapiens
VLWEGAEGR

SEQ ID NO: 894317 - protein, 9 aa, Homo Sapiens
VAAGYHVIN

SEQ ID NO: 894318 - protein, 9 aa, Homo Sapiens
AVVSDNNPC

SEQ ID NO: 894319 - protein, 9 aa, Homo Sapiens
GNCSQHMGT

SEQ ID NO: 894320 - protein, 9 aa, Homo Sapiens
RNAENFDQF

SEQ ID NO: 894321 - protein, 9 aa, Homo Sapiens
GIGLYLENS

SEQ ID NO: 894322 - protein, 9 aa, Homo Sapiens
TIYINNMNY

SEQ ID NO: 894323 - protein, 9 aa, Homo Sapiens
GANQVSVEG

SEQ ID NO: 894324 - protein, 9 aa, Homo Sapiens
ELLRLELAK

SEQ ID NO: 894325 - protein, 9 aa, Homo Sapiens
HKIIHNREK

SEQ ID NO: 894326 - protein, 9 aa, Homo Sapiens
PYKDCLRLY

SEQ ID NO: 894327 - protein, 9 aa, Homo Sapiens
LFFHHSHGD

SEQ ID NO: 894328 - protein, 9 aa, Homo Sapiens
ILDLEVFIL

SEQ ID NO: 894329 - protein, 9 aa, Homo Sapiens
EFYFNIHPT

SEQ ID NO: 894330 - protein, 9 aa, Homo Sapiens
SRTLPVGRL

SEQ ID NO: 894331 - protein, 9 aa, Homo Sapiens
YIRPTSDCS

SEQ ID NO: 894332 - protein, 9 aa, Homo Sapiens
KNRELEKEA

SEQ ID NO: 894333 - protein, 9 aa, Homo Sapiens
PLRLAYYSA

SEQ ID NO: 894334 - protein, 9 aa, Homo Sapiens
LCLSCRNNR

SEQ ID NO: 894335 - protein, 9 aa, Homo Sapiens
QTYGTWWDQ

SEQ ID NO: 894336 - protein, 9 aa, Homo Sapiens
AKTINQREK

SEQ ID NO: 894337 - protein, 9 aa, Homo Sapiens
IDKLQSAFK

SEQ ID NO: 894338 - protein, 9 aa, Homo Sapiens
RETSGRFPS

SEQ ID NO: 894339 - protein, 9 aa, Homo Sapiens
RRVYTGEKP

SEQ ID NO: 894340 - protein, 9 aa, Homo Sapiens
GACVRTTDE

SEQ ID NO: 894341 - protein, 9 aa, Homo Sapiens
SPPREEAAQ

SEQ ID NO: 894342 - protein, 9 aa, Homo Sapiens
NQVVISTNG

SEQ ID NO: 894343 - protein, 9 aa, Homo Sapiens
VCADAVSKD

SEQ ID NO: 894344 - protein, 9 aa, Homo Sapiens
IGVFSPSLQ

SEQ ID NO: 894345 - protein, 9 aa, Homo Sapiens
YGYGGFNDL

SEQ ID NO: 894346 - protein, 9 aa, Homo Sapiens
PYFCKGCKI

SEQ ID NO: 894347 - protein, 9 aa, Homo Sapiens
GPGRPRYPN

SEQ ID NO: 894348 - protein, 9 aa, Homo Sapiens
GHCSIPSLS

SEQ ID NO: 894349 - protein, 9 aa, Homo Sapiens
LLPVLDISL

SEQ ID NO: 894350 - protein, 9 aa, Homo Sapiens
EGIAFLYNL

SEQ ID NO: 894351 - protein, 9 aa, Homo Sapiens
GYPNPPGTM

SEQ ID NO: 894352 - protein, 9 aa, Homo Sapiens
ALPTAQPLL

SEQ ID NO: 894353 - protein, 9 aa, Homo Sapiens
AGEDQKPDS

SEQ ID NO: 894354 - protein, 9 aa, Homo Sapiens
DIFKRIAGE

SEQ ID NO: 894355 - protein, 9 aa, Homo Sapiens
KETLTTQEP

SEQ ID NO: 894356 - protein, 9 aa, Homo Sapiens
EDKDIESID

SEQ ID NO: 894357 - protein, 9 aa, Homo Sapiens
AFVFSVLIE

SEQ ID NO: 894358 - protein, 9 aa, Homo Sapiens
GQFFTFNSN

SEQ ID NO: 894359 - protein, 9 aa, Homo Sapiens
NVHFSYPSQ

SEQ ID NO: 894360 - protein, 9 aa, Homo Sapiens
FPPNKSHGS

SEQ ID NO: 894361 - protein, 9 aa, Homo Sapiens
NLLREQYEE

SEQ ID NO: 894362 - protein, 9 aa, Homo Sapiens
AVYQPLHYA

SEQ ID NO: 894363 - protein, 9 aa, Homo Sapiens
GVWATLRLY

SEQ ID NO: 894364 - protein, 9 aa, Homo Sapiens
KMANRIRKY

SEQ ID NO: 894365 - protein, 9 aa, Homo Sapiens
PKGFNKNDA

SEQ ID NO: 894366 - protein, 9 aa, Homo Sapiens
KKMANRIRK

SEQ ID NO: 894367 - protein, 9 aa, Homo Sapiens
LNGHEFNFI

SEQ ID NO: 894368 - protein, 9 aa, Homo Sapiens
DLMRKIRTK

SEQ ID NO: 894369 - protein, 9 aa, Homo Sapiens
CLWRNFYDD

SEQ ID NO: 894370 - protein, 9 aa, Homo Sapiens
IEEEEAEEE

SEQ ID NO: 894371 - protein, 9 aa, Homo Sapiens
YQQFSECMD

SEQ ID NO: 894372 - protein, 9 aa, Homo Sapiens
RTMMMGIIK

SEQ ID NO: 894373 - protein, 9 aa, Homo Sapiens
SHDGTNSPP

SEQ ID NO: 894374 - protein, 9 aa, Homo Sapiens
HAVQDLDSV

SEQ ID NO: 894375 - protein, 9 aa, Homo Sapiens
LHTSAKVFI

SEQ ID NO: 894376 - protein, 9 aa, Homo Sapiens
NSWWIPVVG

SEQ ID NO: 894377 - protein, 9 aa, Homo Sapiens
TVWAKRGTA

SEQ ID NO: 894378 - protein, 9 aa, Homo Sapiens
CYPLCPKDV

SEQ ID NO: 894379 - protein, 9 aa, Homo Sapiens
LASEEPECL

SEQ ID NO: 894380 - protein, 9 aa, Homo Sapiens
VVYSTRLVN

SEQ ID NO: 894381 - protein, 9 aa, Homo Sapiens
LDRRALCAL

SEQ ID NO: 894382 - protein, 9 aa, Homo Sapiens
CLVKEGRFV

SEQ ID NO: 894383 - protein, 9 aa, Homo Sapiens
RHRHCSRRR

SEQ ID NO: 894384 - protein, 9 aa, Homo Sapiens
QDHSNNLLR

SEQ ID NO: 894385 - protein, 9 aa, Homo Sapiens
SMMLILIGQ

SEQ ID NO: 894386 - protein, 9 aa, Homo Sapiens
GKAKDAGQI

SEQ ID NO: 894387 - protein, 9 aa, Homo Sapiens
AFRDKHLQG

SEQ ID NO: 894388 - protein, 9 aa, Homo Sapiens
KSVTADRWK

SEQ ID NO: 894389 - protein, 9 aa, Homo Sapiens
NMKQKFIVT

SEQ ID NO: 894390 - protein, 9 aa, Homo Sapiens
SKAQMELHH

SEQ ID NO: 894391 - protein, 9 aa, Homo Sapiens
EAAALVLAN

SEQ ID NO: 894392 - protein, 9 aa, Homo Sapiens
GSKYMSERS

SEQ ID NO: 894393 - protein, 9 aa, Homo Sapiens
FKPTRDDCG

SEQ ID NO: 894394 - protein, 9 aa, Homo Sapiens
QMLKDNKKN

SEQ ID NO: 894395 - protein, 9 aa, Homo Sapiens
NVYSDDLME

SEQ ID NO: 894396 - protein, 9 aa, Homo Sapiens
LKMFTNFLS

SEQ ID NO: 894397 - protein, 9 aa, Homo Sapiens
ARVSGRKEN

SEQ ID NO: 894398 - protein, 9 aa, Homo Sapiens
YNTIIDDLL

SEQ ID NO: 894399 - protein, 9 aa, Homo Sapiens
NSVSSCGQA

SEQ ID NO: 894400 - protein, 9 aa, Homo Sapiens
EAEEEDGEK

SEQ ID NO: 894401 - protein, 9 aa, Homo Sapiens
FWLLQNSET

SEQ ID NO: 894402 - protein, 9 aa, Homo Sapiens
IFLCLLPQV

SEQ ID NO: 894403 - protein, 9 aa, Homo Sapiens
VLRVQELVL

SEQ ID NO: 894404 - protein, 9 aa, Homo Sapiens
CLANSISQV

SEQ ID NO: 894405 - protein, 9 aa, Homo Sapiens
ITICFQIKY

SEQ ID NO: 894406 - protein, 9 aa, Homo Sapiens
QIDRRMPGK

SEQ ID NO: 894407 - protein, 9 aa, Homo Sapiens
TSLEKFTCS

SEQ ID NO: 894408 - protein, 9 aa, Homo Sapiens
ECQACQKTF

SEQ ID NO: 894409 - protein, 9 aa, Homo Sapiens
INLSTTLSD

SEQ ID NO: 894410 - protein, 9 aa, Homo Sapiens
ELDLTYITE

SEQ ID NO: 894411 - protein, 9 aa, Homo Sapiens
NKEKLAYTL

SEQ ID NO: 894412 - protein, 9 aa, Homo Sapiens
FIYLPFSIL

SEQ ID NO: 894413 - protein, 9 aa, Homo Sapiens
LARQTYPKK

SEQ ID NO: 894414 - protein, 9 aa, Homo Sapiens
SGSCTGWQS

SEQ ID NO: 894415 - protein, 9 aa, Homo Sapiens
HLVLRAGAG

SEQ ID NO: 894416 - protein, 9 aa, Homo Sapiens
FCTLLIHTG

SEQ ID NO: 894417 - protein, 9 aa, Homo Sapiens
KGCRYLRYI

SEQ ID NO: 894418 - protein, 9 aa, Homo Sapiens
LCTHKRIHT

SEQ ID NO: 894419 - protein, 9 aa, Homo Sapiens
MVSKVKVQN

SEQ ID NO: 894420 - protein, 9 aa, Homo Sapiens
KLPKIDVHL

SEQ ID NO: 894421 - protein, 9 aa, Homo Sapiens
KSITKKTFI

SEQ ID NO: 894422 - protein, 9 aa, Homo Sapiens
ESENKRKME

SEQ ID NO: 894423 - protein, 9 aa, Homo Sapiens
CGNLSGMLQ

SEQ ID NO: 894424 - protein, 9 aa, Homo Sapiens
LCKNYVSLA

SEQ ID NO: 894425 - protein, 9 aa, Homo Sapiens
GADLSLLDH

SEQ ID NO: 894426 - protein, 9 aa, Homo Sapiens
GCRVTNEIL

SEQ ID NO: 894427 - protein, 9 aa, Homo Sapiens
REEEERMKQ

SEQ ID NO: 894428 - protein, 9 aa, Homo Sapiens
RLGKAHEIT

SEQ ID NO: 894429 - protein, 9 aa, Homo Sapiens
QDDKSSGKQ

SEQ ID NO: 894430 - protein, 9 aa, Homo Sapiens
QKFKRKEMF

SEQ ID NO: 894431 - protein, 9 aa, Homo Sapiens
RLWFREAEI

SEQ ID NO: 894432 - protein, 9 aa, Homo Sapiens
DAGPSDLHH

SEQ ID NO: 894433 - protein, 9 aa, Homo Sapiens
TGCPRPCAD

SEQ ID NO: 894434 - protein, 9 aa, Homo Sapiens
QIELKSRSV

SEQ ID NO: 894435 - protein, 9 aa, Homo Sapiens
SSGMYTPLT

SEQ ID NO: 894436 - protein, 9 aa, Homo Sapiens
IQTLDLPIY

SEQ ID NO: 894437 - protein, 9 aa, Homo Sapiens
VEPQTPWVS

SEQ ID NO: 894438 - protein, 9 aa, Homo Sapiens
VPHKPNTLT

SEQ ID NO: 894439 - protein, 9 aa, Homo Sapiens
GHNNTDVSI

SEQ ID NO: 894440 - protein, 9 aa, Homo Sapiens
LVTGGREGG

SEQ ID NO: 894441 - protein, 9 aa, Homo Sapiens
KTALKRVIG

SEQ ID NO: 894442 - protein, 9 aa, Homo Sapiens
KFCSLAVLV

SEQ ID NO: 894443 - protein, 9 aa, Homo Sapiens
VCATDMRPL

SEQ ID NO: 894444 - protein, 9 aa, Homo Sapiens
TFFRPGAAG

SEQ ID NO: 894445 - protein, 9 aa, Homo Sapiens
MNEAGGRGC

SEQ ID NO: 894446 - protein, 9 aa, Homo Sapiens
SHRDIKSKH

SEQ ID NO: 894447 - protein, 9 aa, Homo Sapiens
EKMKIAGGN

SEQ ID NO: 894448 - protein, 9 aa, Homo Sapiens
TDEELCNGH

SEQ ID NO: 894449 - protein, 9 aa, Homo Sapiens
KNAAILTHC

SEQ ID NO: 894450 - protein, 9 aa, Homo Sapiens
APWLQIARR

SEQ ID NO: 894451 - protein, 9 aa, Homo Sapiens
IWWKYMIVD

SEQ ID NO: 894452 - protein, 9 aa, Homo Sapiens
SPMSPRSLP

SEQ ID NO: 894453 - protein, 9 aa, Homo Sapiens
CMITEFAYG

SEQ ID NO: 894454 - protein, 9 aa, Homo Sapiens
CILNINNNN

SEQ ID NO: 894455 - protein, 9 aa, Homo Sapiens
KDCLRLYYF

SEQ ID NO: 894456 - protein, 9 aa, Homo Sapiens
ASLAAYDDS

SEQ ID NO: 894457 - protein, 9 aa, Homo Sapiens
THPKQEKAF

SEQ ID NO: 894458 - protein, 9 aa, Homo Sapiens
RSRTLPVGR

SEQ ID NO: 894459 - protein, 9 aa, Homo Sapiens
AEDRLALYP

SEQ ID NO: 894460 - protein, 9 aa, Homo Sapiens
CNYSLHVDI

SEQ ID NO: 894461 - protein, 9 aa, Homo Sapiens
CWLFLVLQD

SEQ ID NO: 894462 - protein, 9 aa, Homo Sapiens
TSRTFTTMG

SEQ ID NO: 894463 - protein, 9 aa, Homo Sapiens
KIIILYDTS

SEQ ID NO: 894464 - protein, 9 aa, Homo Sapiens
WGYRRKAGI

SEQ ID NO: 894465 - protein, 9 aa, Homo Sapiens
NPSKEIKIV

SEQ ID NO: 894466 - protein, 9 aa, Homo Sapiens
SGVNGVTQL

SEQ ID NO: 894467 - protein, 9 aa, Homo Sapiens
YILIVDPYY

SEQ ID NO: 894468 - protein, 9 aa, Homo Sapiens
TFLEELTQM

SEQ ID NO: 894469 - protein, 9 aa, Homo Sapiens
VKVCTCTSQ

SEQ ID NO: 894470 - protein, 9 aa, Homo Sapiens
NIENRTERS

SEQ ID NO: 894471 - protein, 9 aa, Homo Sapiens
TSPTKMDLL

SEQ ID NO: 894472 - protein, 9 aa, Homo Sapiens
HPKGYVGSE

SEQ ID NO: 894473 - protein, 9 aa, Homo Sapiens
YFCRWYKNR

SEQ ID NO: 894474 - protein, 9 aa, Homo Sapiens
ADSEFDVFD

SEQ ID NO: 894475 - protein, 9 aa, Homo Sapiens
DIRLGLQLH

SEQ ID NO: 894476 - protein, 9 aa, Homo Sapiens
YTFCRAVLC

SEQ ID NO: 894477 - protein, 9 aa, Homo Sapiens
EIVLRIINE

SEQ ID NO: 894478 - protein, 9 aa, Homo Sapiens
QANGNMQLC

SEQ ID NO: 894479 - protein, 9 aa, Homo Sapiens
DILIESTAK

SEQ ID NO: 894480 - protein, 9 aa, Homo Sapiens
TTPSAVCGF

SEQ ID NO: 894481 - protein, 9 aa, Homo Sapiens
DLVTKQAFN

SEQ ID NO: 894482 - protein, 9 aa, Homo Sapiens
SKLLRQEQA

SEQ ID NO: 894483 - protein, 9 aa, Homo Sapiens
TGWGEFKII

SEQ ID NO: 894484 - protein, 9 aa, Homo Sapiens
LESLPILTL

SEQ ID NO: 894485 - protein, 9 aa, Homo Sapiens
DLLVAMCRT

SEQ ID NO: 894486 - protein, 9 aa, Homo Sapiens
PLDLLKEYP

SEQ ID NO: 894487 - protein, 9 aa, Homo Sapiens
GRELNPQIG

SEQ ID NO: 894488 - protein, 9 aa, Homo Sapiens
CLNPIIYGF

SEQ ID NO: 894489 - protein, 9 aa, Homo Sapiens
SVCLGDLIN

SEQ ID NO: 894490 - protein, 9 aa, Homo Sapiens
NKHSIYIQS

SEQ ID NO: 894491 - protein, 9 aa, Homo Sapiens
IAIDNPVHL

SEQ ID NO: 894492 - protein, 9 aa, Homo Sapiens
DLASLSANT

SEQ ID NO: 894493 - protein, 9 aa, Homo Sapiens
PCGNLSGML

SEQ ID NO: 894494 - protein, 9 aa, Homo Sapiens
IGWVCQMPG

SEQ ID NO: 894495 - protein, 9 aa, Homo Sapiens
RFMGDPSYK

SEQ ID NO: 894496 - protein, 9 aa, Homo Sapiens
TSQCKLHPD

SEQ ID NO: 894497 - protein, 9 aa, Homo Sapiens
CRGFNIFTL

SEQ ID NO: 894498 - protein, 9 aa, Homo Sapiens
SPPTCRSAS

SEQ ID NO: 894499 - protein, 9 aa, Homo Sapiens
ADDYDKNKL

SEQ ID NO: 894500 - protein, 9 aa, Homo Sapiens
HLLRQHKHR

SEQ ID NO: 894501 - protein, 9 aa, Homo Sapiens
QHQVFHTGE

SEQ ID NO: 894502 - protein, 9 aa, Homo Sapiens
NAVWSYYEV

SEQ ID NO: 894503 - protein, 9 aa, Homo Sapiens
NGNSKVIDV

SEQ ID NO: 894504 - protein, 9 aa, Homo Sapiens
SPVEEKGKY

SEQ ID NO: 894505 - protein, 9 aa, Homo Sapiens
KINGIDVDK

SEQ ID NO: 894506 - protein, 9 aa, Homo Sapiens
KIRTKKMSE

SEQ ID NO: 894507 - protein, 9 aa, Homo Sapiens
PDKDDHLLS

SEQ ID NO: 894508 - protein, 9 aa, Homo Sapiens
NGSMCNTSQ

SEQ ID NO: 894509 - protein, 9 aa, Homo Sapiens
QPRDEDYKG

SEQ ID NO: 894510 - protein, 9 aa, Homo Sapiens
FIEVNTIIN

SEQ ID NO: 894511 - protein, 9 aa, Homo Sapiens
FPPLDWFGL

SEQ ID NO: 894512 - protein, 9 aa, Homo Sapiens
LLNCIMGMV

SEQ ID NO: 894513 - protein, 9 aa, Homo Sapiens
EQQSEQNMK

SEQ ID NO: 894514 - protein, 9 aa, Homo Sapiens
PILYRMCTL

SEQ ID NO: 894515 - protein, 9 aa, Homo Sapiens
SSYTRKSQL

SEQ ID NO: 894516 - protein, 9 aa, Homo Sapiens
EGKISVKNF

SEQ ID NO: 894517 - protein, 9 aa, Homo Sapiens
RTQINVINV

SEQ ID NO: 894518 - protein, 9 aa, Homo Sapiens
LGKTYSIVM

SEQ ID NO: 894519 - protein, 9 aa, Homo Sapiens
MASDASHVL

SEQ ID NO: 894520 - protein, 9 aa, Homo Sapiens
DRFLATVKV

SEQ ID NO: 894521 - protein, 9 aa, Homo Sapiens
SEYLHSSLY

SEQ ID NO: 894522 - protein, 9 aa, Homo Sapiens
PFLQNAIMS

SEQ ID NO: 894523 - protein, 9 aa, Homo Sapiens
PSRSTSSDC

SEQ ID NO: 894524 - protein, 9 aa, Homo Sapiens
PEGVPIGAI

SEQ ID NO: 894525 - protein, 9 aa, Homo Sapiens
TGVCRRQEM

SEQ ID NO: 894526 - protein, 9 aa, Homo Sapiens
DRKKIQLSV

SEQ ID NO: 894527 - protein, 9 aa, Homo Sapiens
EKGNWLQYV

SEQ ID NO: 894528 - protein, 9 aa, Homo Sapiens
NQLQPKEFE

SEQ ID NO: 894529 - protein, 9 aa, Homo Sapiens
KPLKKRSCA

SEQ ID NO: 894530 - protein, 9 aa, Homo Sapiens
QSCNVKAYV

SEQ ID NO: 894531 - protein, 9 aa, Homo Sapiens
SKILQDKHN

SEQ ID NO: 894532 - protein, 9 aa, Homo Sapiens
FPYGARYDR

SEQ ID NO: 894533 - protein, 9 aa, Homo Sapiens
DSSTPYPNF

SEQ ID NO: 894534 - protein, 9 aa, Homo Sapiens
VECGKLFCW

SEQ ID NO: 894535 - protein, 9 aa, Homo Sapiens
PQSQSLAPS

SEQ ID NO: 894536 - protein, 9 aa, Homo Sapiens
TEGKYHRAS

SEQ ID NO: 894537 - protein, 9 aa, Homo Sapiens
QDVWHIYSG

SEQ ID NO: 894538 - protein, 9 aa, Homo Sapiens
HYEKAENED

SEQ ID NO: 894539 - protein, 9 aa, Homo Sapiens
LWCPLWSQT

SEQ ID NO: 894540 - protein, 9 aa, Homo Sapiens
HKAQNYRKK

SEQ ID NO: 894541 - protein, 9 aa, Homo Sapiens
AADHKPESK

SEQ ID NO: 894542 - protein, 9 aa, Homo Sapiens
EIEPNNSPE

SEQ ID NO: 894543 - protein, 9 aa, Homo Sapiens
QEAVTKTLS

SEQ ID NO: 894544 - protein, 9 aa, Homo Sapiens
CWKTFLNQS

SEQ ID NO: 894545 - protein, 9 aa, Homo Sapiens
PNRNKYLEL

SEQ ID NO: 894546 - protein, 9 aa, Homo Sapiens
LSTSVDTVT

SEQ ID NO: 894547 - protein, 9 aa, Homo Sapiens
DDEDSFRRQ

SEQ ID NO: 894548 - protein, 9 aa, Homo Sapiens
RYGLEDWRN

SEQ ID NO: 894549 - protein, 9 aa, Homo Sapiens
KKIMVESPL

SEQ ID NO: 894550 - protein, 9 aa, Homo Sapiens
FLFPFHHTT

SEQ ID NO: 894551 - protein, 9 aa, Homo Sapiens
RHRLLVGHA

SEQ ID NO: 894552 - protein, 9 aa, Homo Sapiens
SQVQFTGEL

SEQ ID NO: 894553 - protein, 9 aa, Homo Sapiens
QDDIVQEKH

SEQ ID NO: 894554 - protein, 9 aa, Homo Sapiens
PVIDKMNIK

SEQ ID NO: 894555 - protein, 9 aa, Homo Sapiens
LAKSKCPQL

SEQ ID NO: 894556 - protein, 9 aa, Homo Sapiens
NSEDIFILL

SEQ ID NO: 894557 - protein, 9 aa, Homo Sapiens
FGPTLLQAE

SEQ ID NO: 894558 - protein, 9 aa, Homo Sapiens
LLEKGSIKS

SEQ ID NO: 894559 - protein, 9 aa, Homo Sapiens
AFKLHYQLT

SEQ ID NO: 894560 - protein, 9 aa, Homo Sapiens
AAQRGSESK

SEQ ID NO: 894561 - protein, 9 aa, Homo Sapiens
TVALGFYCL

SEQ ID NO: 894562 - protein, 9 aa, Homo Sapiens
VNKLFKFMH

SEQ ID NO: 894563 - protein, 9 aa, Homo Sapiens
SIMSINNAD

SEQ ID NO: 894564 - protein, 9 aa, Homo Sapiens
VEGVEPRLK

SEQ ID NO: 894565 - protein, 9 aa, Homo Sapiens
QTAVFQTYG

SEQ ID NO: 894566 - protein, 9 aa, Homo Sapiens
VLCMYDDRN

SEQ ID NO: 894567 - protein, 9 aa, Homo Sapiens
RIWQFKQRE

SEQ ID NO: 894568 - protein, 9 aa, Homo Sapiens
GAHWMRQKI

SEQ ID NO: 894569 - protein, 9 aa, Homo Sapiens
ECGKTFTVC

SEQ ID NO: 894570 - protein, 9 aa, Homo Sapiens
QTELVRMEQ

SEQ ID NO: 894571 - protein, 9 aa, Homo Sapiens
CMHNLKTRT

SEQ ID NO: 894572 - protein, 9 aa, Homo Sapiens
DGGIIVFQK

SEQ ID NO: 894573 - protein, 9 aa, Homo Sapiens
KTLLRCQNE

SEQ ID NO: 894574 - protein, 9 aa, Homo Sapiens
RPLTVICDM

SEQ ID NO: 894575 - protein, 9 aa, Homo Sapiens
LPFLSTPMG

SEQ ID NO: 894576 - protein, 9 aa, Homo Sapiens
PNLREFWLY

SEQ ID NO: 894577 - protein, 9 aa, Homo Sapiens
HAPQYQSMR

SEQ ID NO: 894578 - protein, 9 aa, Homo Sapiens
ELYEAVNNY

SEQ ID NO: 894579 - protein, 9 aa, Homo Sapiens
EESLCGTSI

SEQ ID NO: 894580 - protein, 9 aa, Homo Sapiens
HSQYKFCPT

SEQ ID NO: 894581 - protein, 9 aa, Homo Sapiens
CNTSQDRER

SEQ ID NO: 894582 - protein, 9 aa, Homo Sapiens
LLEMDTNLQ

SEQ ID NO: 894583 - protein, 9 aa, Homo Sapiens
DRFYQIDRS

SEQ ID NO: 894584 - protein, 9 aa, Homo Sapiens
VANPQLQMA

SEQ ID NO: 894585 - protein, 9 aa, Homo Sapiens
QNKCFRNME

SEQ ID NO: 894586 - protein, 9 aa, Homo Sapiens
IHEITHTGE

SEQ ID NO: 894587 - protein, 9 aa, Homo Sapiens
NVVRKQEKE

SEQ ID NO: 894588 - protein, 9 aa, Homo Sapiens
QMIPSNSTQ

SEQ ID NO: 894589 - protein, 9 aa, Homo Sapiens
IHSHTGERP

SEQ ID NO: 894590 - protein, 9 aa, Homo Sapiens
ALMSSMAPT

SEQ ID NO: 894591 - protein, 9 aa, Homo Sapiens
SSLTEHQII

SEQ ID NO: 894592 - protein, 9 aa, Homo Sapiens
ASMEFQRKG

SEQ ID NO: 894593 - protein, 9 aa, Homo Sapiens
PSRDKKPHD

SEQ ID NO: 894594 - protein, 9 aa, Homo Sapiens
RRGQNTLPA

SEQ ID NO: 894595 - protein, 9 aa, Homo Sapiens
EKSHKPIQS

SEQ ID NO: 894596 - protein, 9 aa, Homo Sapiens
EENKSVQKK

SEQ ID NO: 894597 - protein, 9 aa, Homo Sapiens
CHPLCYPVL

SEQ ID NO: 894598 - protein, 9 aa, Homo Sapiens
RQSIWDVIS

SEQ ID NO: 894599 - protein, 9 aa, Homo Sapiens
EVVGSASNL

SEQ ID NO: 894600 - protein, 9 aa, Homo Sapiens
KDELLSEKT

SEQ ID NO: 894601 - protein, 9 aa, Homo Sapiens
CKAHELITT

SEQ ID NO: 894602 - protein, 9 aa, Homo Sapiens
WLQNWQKSS

SEQ ID NO: 894603 - protein, 9 aa, Homo Sapiens
RTKEPDRDE

SEQ ID NO: 894604 - protein, 9 aa, Homo Sapiens
CTLISAASK

SEQ ID NO: 894605 - protein, 9 aa, Homo Sapiens
TLLFLSHIQ

SEQ ID NO: 894606 - protein, 9 aa, Homo Sapiens
QKKSDVTSI

SEQ ID NO: 894607 - protein, 9 aa, Homo Sapiens
VFSPSLQNH

SEQ ID NO: 894608 - protein, 9 aa, Homo Sapiens
LELLYIITN

SEQ ID NO: 894609 - protein, 9 aa, Homo Sapiens
KGDFIFSSD

SEQ ID NO: 894610 - protein, 9 aa, Homo Sapiens
GVIVPHKPN

SEQ ID NO: 894611 - protein, 9 aa, Homo Sapiens
SMCNTSQDR

SEQ ID NO: 894612 - protein, 9 aa, Homo Sapiens
LGRLCGDKL

SEQ ID NO: 894613 - protein, 9 aa, Homo Sapiens
NRPHAFDFG

SEQ ID NO: 894614 - protein, 9 aa, Homo Sapiens
KNSGALEKD

SEQ ID NO: 894615 - protein, 9 aa, Homo Sapiens
VPPLSPLAR

SEQ ID NO: 894616 - protein, 9 aa, Homo Sapiens
AIPIWLYWQ

SEQ ID NO: 894617 - protein, 9 aa, Homo Sapiens
LDNFFDESQ

SEQ ID NO: 894618 - protein, 9 aa, Homo Sapiens
SKKNQCLLY

SEQ ID NO: 894619 - protein, 9 aa, Homo Sapiens
YFLIGEGEI

SEQ ID NO: 894620 - protein, 9 aa, Homo Sapiens
IQNDYFIRQ

SEQ ID NO: 894621 - protein, 9 aa, Homo Sapiens
NGQSLPVSS

SEQ ID NO: 894622 - protein, 9 aa, Homo Sapiens
DFAKHKKIH

SEQ ID NO: 894623 - protein, 9 aa, Homo Sapiens
PSIAPSSQT

SEQ ID NO: 894624 - protein, 9 aa, Homo Sapiens
PQTPRLQDP

SEQ ID NO: 894625 - protein, 9 aa, Homo Sapiens
TTTKNNYNP

SEQ ID NO: 894626 - protein, 9 aa, Homo Sapiens
GEQLHVNIS

SEQ ID NO: 894627 - protein, 9 aa, Homo Sapiens
IWLADGGRL

SEQ ID NO: 894628 - protein, 9 aa, Homo Sapiens
MMNEVLDMS

SEQ ID NO: 894629 - protein, 9 aa, Homo Sapiens
RQLSLLLGQ

SEQ ID NO: 894630 - protein, 9 aa, Homo Sapiens
SKINLESQI

SEQ ID NO: 894631 - protein, 9 aa, Homo Sapiens
ANRPSFAET

SEQ ID NO: 894632 - protein, 9 aa, Homo Sapiens
SSKWVMEST

SEQ ID NO: 894633 - protein, 9 aa, Homo Sapiens
LQELDNFFD

SEQ ID NO: 894634 - protein, 9 aa, Homo Sapiens
ILLWVGTFL

SEQ ID NO: 894635 - protein, 9 aa, Homo Sapiens
QYGPMTGQE

SEQ ID NO: 894636 - protein, 9 aa, Homo Sapiens
HWRDRVQWD

SEQ ID NO: 894637 - protein, 9 aa, Homo Sapiens
LKKLESSAS

SEQ ID NO: 894638 - protein, 9 aa, Homo Sapiens
AFQGDGVPP

SEQ ID NO: 894639 - protein, 9 aa, Homo Sapiens
EFESSSGHL

SEQ ID NO: 894640 - protein, 9 aa, Homo Sapiens
GAKSKVSVD

SEQ ID NO: 894641 - protein, 9 aa, Homo Sapiens
KENECMKIK

SEQ ID NO: 894642 - protein, 9 aa, Homo Sapiens
QAQQMNQKN

SEQ ID NO: 894643 - protein, 9 aa, Homo Sapiens
FQGKQMHVQ

SEQ ID NO: 894644 - protein, 9 aa, Homo Sapiens
IKDGVSRCF

SEQ ID NO: 894645 - protein, 9 aa, Homo Sapiens
TAGGADSNN

SEQ ID NO: 894646 - protein, 9 aa, Homo Sapiens
CWKWSPANR

SEQ ID NO: 894647 - protein, 9 aa, Homo Sapiens
NQNSNTTSN

SEQ ID NO: 894648 - protein, 9 aa, Homo Sapiens
ILQRTARIP

SEQ ID NO: 894649 - protein, 9 aa, Homo Sapiens
WQKVDDCER

SEQ ID NO: 894650 - protein, 9 aa, Homo Sapiens
NIISQEECS

SEQ ID NO: 894651 - protein, 9 aa, Homo Sapiens
NTWITDITL

SEQ ID NO: 894652 - protein, 9 aa, Homo Sapiens
KVAELLLSH

SEQ ID NO: 894653 - protein, 9 aa, Homo Sapiens
IVGHLKTIA

SEQ ID NO: 894654 - protein, 9 aa, Homo Sapiens
VQVFIVVER

SEQ ID NO: 894655 - protein, 9 aa, Homo Sapiens
QLSWFTALV

SEQ ID NO: 894656 - protein, 9 aa, Homo Sapiens
SLCLEGIQC

SEQ ID NO: 894657 - protein, 9 aa, Homo Sapiens
YKQYCLQKV

SEQ ID NO: 894658 - protein, 9 aa, Homo Sapiens
PLKNLESLN

SEQ ID NO: 894659 - protein, 9 aa, Homo Sapiens
TGLFLQPLM

SEQ ID NO: 894660 - protein, 9 aa, Homo Sapiens
TTKSPPSPG

SEQ ID NO: 894661 - protein, 9 aa, Homo Sapiens
NGSTCRDLV

SEQ ID NO: 894662 - protein, 9 aa, Homo Sapiens
VEIEELTAS

SEQ ID NO: 894663 - protein, 9 aa, Homo Sapiens
YYDAYLSYT

SEQ ID NO: 894664 - protein, 9 aa, Homo Sapiens
RLFWKSKDW

SEQ ID NO: 894665 - protein, 9 aa, Homo Sapiens
EARDKFTKA

SEQ ID NO: 894666 - protein, 9 aa, Homo Sapiens
EELSLVVHH

SEQ ID NO: 894667 - protein, 9 aa, Homo Sapiens
SGFEAFFTV

SEQ ID NO: 894668 - protein, 9 aa, Homo Sapiens
KVDMRTILF

SEQ ID NO: 894669 - protein, 9 aa, Homo Sapiens
VIGAVVADV

SEQ ID NO: 894670 - protein, 9 aa, Homo Sapiens
LDLIFQLEL

SEQ ID NO: 894671 - protein, 9 aa, Homo Sapiens
EGDKTKTPT

SEQ ID NO: 894672 - protein, 9 aa, Homo Sapiens
GKNYERVKT

SEQ ID NO: 894673 - protein, 9 aa, Homo Sapiens
QVCNDIDEG

SEQ ID NO: 894674 - protein, 9 aa, Homo Sapiens
SRSPNKERQ

SEQ ID NO: 894675 - protein, 9 aa, Homo Sapiens
LVVFLEKAA

SEQ ID NO: 894676 - protein, 9 aa, Homo Sapiens
EQHHIGDRS

SEQ ID NO: 894677 - protein, 9 aa, Homo Sapiens
HKHHCRHCG

SEQ ID NO: 894678 - protein, 9 aa, Homo Sapiens
DIGGATIPE

SEQ ID NO: 894679 - protein, 9 aa, Homo Sapiens
KKNKGKECR

SEQ ID NO: 894680 - protein, 9 aa, Homo Sapiens
DNQIATATQ

SEQ ID NO: 894681 - protein, 9 aa, Homo Sapiens
VLYKVKVYK

SEQ ID NO: 894682 - protein, 9 aa, Homo Sapiens
FRCIPDEVI

SEQ ID NO: 894683 - protein, 9 aa, Homo Sapiens
PHNYTRCYT

SEQ ID NO: 894684 - protein, 9 aa, Homo Sapiens
DLLDHRMTK

SEQ ID NO: 894685 - protein, 9 aa, Homo Sapiens
EDNRIYGGS

SEQ ID NO: 894686 - protein, 9 aa, Homo Sapiens
AHSCYKCCQ

SEQ ID NO: 894687 - protein, 9 aa, Homo Sapiens
QASTERVFR

SEQ ID NO: 894688 - protein, 9 aa, Homo Sapiens
QQYEKERST

SEQ ID NO: 894689 - protein, 9 aa, Homo Sapiens
DQKKVMVMI

SEQ ID NO: 894690 - protein, 9 aa, Homo Sapiens
LPEIAWVST

SEQ ID NO: 894691 - protein, 9 aa, Homo Sapiens
ESYYGERHL

SEQ ID NO: 894692 - protein, 9 aa, Homo Sapiens
LMRVCVAQG

SEQ ID NO: 894693 - protein, 9 aa, Homo Sapiens
WDISRTLGV

SEQ ID NO: 894694 - protein, 9 aa, Homo Sapiens
ATVTNILLS

SEQ ID NO: 894695 - protein, 9 aa, Homo Sapiens
EDKTRYCVI

SEQ ID NO: 894696 - protein, 9 aa, Homo Sapiens
LQTFRVLRA

SEQ ID NO: 894697 - protein, 9 aa, Homo Sapiens
AEVGSVCSC

SEQ ID NO: 894698 - protein, 9 aa, Homo Sapiens
SGNDIILYC

SEQ ID NO: 894699 - protein, 9 aa, Homo Sapiens
RSRSQTATE

SEQ ID NO: 894700 - protein, 9 aa, Homo Sapiens
IHHAVHTGK

SEQ ID NO: 894701 - protein, 9 aa, Homo Sapiens
TNSCNRCPK

SEQ ID NO: 894702 - protein, 9 aa, Homo Sapiens
YQKNGTAEE

SEQ ID NO: 894703 - protein, 9 aa, Homo Sapiens
YDKENITPL

SEQ ID NO: 894704 - protein, 9 aa, Homo Sapiens
NLAAPSGQR

SEQ ID NO: 894705 - protein, 9 aa, Homo Sapiens
PEKNRHLKN

SEQ ID NO: 894706 - protein, 9 aa, Homo Sapiens
HVPNWIFHL

SEQ ID NO: 894707 - protein, 9 aa, Homo Sapiens
SRPIPMSIR

SEQ ID NO: 894708 - protein, 9 aa, Homo Sapiens
SIQMPAFFN

SEQ ID NO: 894709 - protein, 9 aa, Homo Sapiens
NKTPSFPHC

SEQ ID NO: 894710 - protein, 9 aa, Homo Sapiens
QSTAARLPP

SEQ ID NO: 894711 - protein, 9 aa, Homo Sapiens
HLTIQDPQK

SEQ ID NO: 894712 - protein, 9 aa, Homo Sapiens
DAPEPDCGY

SEQ ID NO: 894713 - protein, 9 aa, Homo Sapiens
QYLTICYTL

SEQ ID NO: 894714 - protein, 9 aa, Homo Sapiens
SVPHKLPRV

SEQ ID NO: 894715 - protein, 9 aa, Homo Sapiens
VGSLPRYFE

SEQ ID NO: 894716 - protein, 9 aa, Homo Sapiens
YRKYKHQSH

SEQ ID NO: 894717 - protein, 9 aa, Homo Sapiens
GRRKSESQK

SEQ ID NO: 894718 - protein, 9 aa, Homo Sapiens
SSQSLYKIC

SEQ ID NO: 894719 - protein, 9 aa, Homo Sapiens
NMVWYRQDL

SEQ ID NO: 894720 - protein, 9 aa, Homo Sapiens
EDKRPEKII

SEQ ID NO: 894721 - protein, 9 aa, Homo Sapiens
NQKKYPQPL

SEQ ID NO: 894722 - protein, 9 aa, Homo Sapiens
YFKKQLALS

SEQ ID NO: 894723 - protein, 9 aa, Homo Sapiens
TKDTYDTLH

SEQ ID NO: 894724 - protein, 9 aa, Homo Sapiens
KVLRAAWDT

SEQ ID NO: 894725 - protein, 9 aa, Homo Sapiens
YEGILTNGV

SEQ ID NO: 894726 - protein, 9 aa, Homo Sapiens
FKHVFESVQ

SEQ ID NO: 894727 - protein, 9 aa, Homo Sapiens
NILILLTIF

SEQ ID NO: 894728 - protein, 9 aa, Homo Sapiens
FHIQLPNTV

SEQ ID NO: 894729 - protein, 9 aa, Homo Sapiens
NKGLFSLVA

SEQ ID NO: 894730 - protein, 9 aa, Homo Sapiens
KVQSRLLAC

SEQ ID NO: 894731 - protein, 9 aa, Homo Sapiens
RSRLIKGDG

SEQ ID NO: 894732 - protein, 9 aa, Homo Sapiens
AVVNKDSGA

SEQ ID NO: 894733 - protein, 9 aa, Homo Sapiens
LQCELESLK

SEQ ID NO: 894734 - protein, 9 aa, Homo Sapiens
AVAAGYHVI

SEQ ID NO: 894735 - protein, 9 aa, Homo Sapiens
RDFKHTDDF

SEQ ID NO: 894736 - protein, 9 aa, Homo Sapiens
KELNDIQFE

SEQ ID NO: 894737 - protein, 9 aa, Homo Sapiens
YTRCYTCQV

SEQ ID NO: 894738 - protein, 9 aa, Homo Sapiens
GWEPNDLAL

SEQ ID NO: 894739 - protein, 9 aa, Homo Sapiens
LYWTMIQLH

SEQ ID NO: 894740 - protein, 9 aa, Homo Sapiens
NTKAAKLSR

SEQ ID NO: 894741 - protein, 9 aa, Homo Sapiens
PECLPCLQR

SEQ ID NO: 894742 - protein, 9 aa, Homo Sapiens
MTLSHSTLK

SEQ ID NO: 894743 - protein, 9 aa, Homo Sapiens
FRQMMGCFQ

SEQ ID NO: 894744 - protein, 9 aa, Homo Sapiens
MEEGHELDL

SEQ ID NO: 894745 - protein, 9 aa, Homo Sapiens
KQEQISYTP

SEQ ID NO: 894746 - protein, 9 aa, Homo Sapiens
ICFKSLAKR

SEQ ID NO: 894747 - protein, 9 aa, Homo Sapiens
AEKKDSQGL

SEQ ID NO: 894748 - protein, 9 aa, Homo Sapiens
INDAVNEIV

SEQ ID NO: 894749 - protein, 9 aa, Homo Sapiens
YSIDIDISS

SEQ ID NO: 894750 - protein, 9 aa, Homo Sapiens
KLLLCLKHG

SEQ ID NO: 894751 - protein, 9 aa, Homo Sapiens
YVVPGPVQF

SEQ ID NO: 894752 - protein, 9 aa, Homo Sapiens
LYQKPLSDK

SEQ ID NO: 894753 - protein, 9 aa, Homo Sapiens
GKMLNSDKS

SEQ ID NO: 894754 - protein, 9 aa, Homo Sapiens
KKTVPSPEV

SEQ ID NO: 894755 - protein, 9 aa, Homo Sapiens
NVNYTQYLD

SEQ ID NO: 894756 - protein, 9 aa, Homo Sapiens
FSELSDSGL

SEQ ID NO: 894757 - protein, 9 aa, Homo Sapiens
DWEQFLELV

SEQ ID NO: 894758 - protein, 9 aa, Homo Sapiens
CNRALIQYF

SEQ ID NO: 894759 - protein, 9 aa, Homo Sapiens
WKDRTIQIS

SEQ ID NO: 894760 - protein, 9 aa, Homo Sapiens
PSHWVVQAW

SEQ ID NO: 894761 - protein, 9 aa, Homo Sapiens
CDTNWIYYG

SEQ ID NO: 894762 - protein, 9 aa, Homo Sapiens
KEIPFYLHV

SEQ ID NO: 894763 - protein, 9 aa, Homo Sapiens
NSPQPSPKQ

SEQ ID NO: 894764 - protein, 9 aa, Homo Sapiens
PAQKKPPSS

SEQ ID NO: 894765 - protein, 9 aa, Homo Sapiens
PNNSPEDLG

SEQ ID NO: 894766 - protein, 9 aa, Homo Sapiens
TVPDELLNI

SEQ ID NO: 894767 - protein, 9 aa, Homo Sapiens
LYVNTDILF

SEQ ID NO: 894768 - protein, 9 aa, Homo Sapiens
KCILHCLGL

SEQ ID NO: 894769 - protein, 9 aa, Homo Sapiens
KYFDVCADA

SEQ ID NO: 894770 - protein, 9 aa, Homo Sapiens
RVLTRKHSD

SEQ ID NO: 894771 - protein, 9 aa, Homo Sapiens
GYMGSNSQV

SEQ ID NO: 894772 - protein, 9 aa, Homo Sapiens
CPVCITINT

SEQ ID NO: 894773 - protein, 9 aa, Homo Sapiens
FLNEWSLKV

SEQ ID NO: 894774 - protein, 9 aa, Homo Sapiens
LRVPCNVEG

SEQ ID NO: 894775 - protein, 9 aa, Homo Sapiens
FFENEDVCM

SEQ ID NO: 894776 - protein, 9 aa, Homo Sapiens
YTLCNKEVR

SEQ ID NO: 894777 - protein, 9 aa, Homo Sapiens
RTALESPRK

SEQ ID NO: 894778 - protein, 9 aa, Homo Sapiens
VLHQMWRDQ

SEQ ID NO: 894779 - protein, 9 aa, Homo Sapiens
GQTGVMICA

SEQ ID NO: 894780 - protein, 9 aa, Homo Sapiens
RSLEAIDGS

SEQ ID NO: 894781 - protein, 9 aa, Homo Sapiens
TTALAASPA

SEQ ID NO: 894782 - protein, 9 aa, Homo Sapiens
NCIMGMVEK

SEQ ID NO: 894783 - protein, 9 aa, Homo Sapiens
LPRGNGYRI

SEQ ID NO: 894784 - protein, 9 aa, Homo Sapiens
CEKTGNAYE

SEQ ID NO: 894785 - protein, 9 aa, Homo Sapiens
VADIQEEII

SEQ ID NO: 894786 - protein, 9 aa, Homo Sapiens
PGPMSGPAP

SEQ ID NO: 894787 - protein, 9 aa, Homo Sapiens
IIILLMFTS

SEQ ID NO: 894788 - protein, 9 aa, Homo Sapiens
GRLCGDKLP

SEQ ID NO: 894789 - protein, 9 aa, Homo Sapiens
SDQYRNAYV

SEQ ID NO: 894790 - protein, 9 aa, Homo Sapiens
LNVSLQMDS

SEQ ID NO: 894791 - protein, 9 aa, Homo Sapiens
SRSQSILDY

SEQ ID NO: 894792 - protein, 9 aa, Homo Sapiens
FDKILYNKF

SEQ ID NO: 894793 - protein, 9 aa, Homo Sapiens
RSRSLSDLA

SEQ ID NO: 894794 - protein, 9 aa, Homo Sapiens
GYLILSAAS

SEQ ID NO: 894795 - protein, 9 aa, Homo Sapiens
PGYLNRIHK

SEQ ID NO: 894796 - protein, 9 aa, Homo Sapiens
IVIFRGPVT

SEQ ID NO: 894797 - protein, 9 aa, Homo Sapiens
FMYTMNKFL

SEQ ID NO: 894798 - protein, 9 aa, Homo Sapiens
ELICGQERF

SEQ ID NO: 894799 - protein, 9 aa, Homo Sapiens
KAKKRKRDN

SEQ ID NO: 894800 - protein, 9 aa, Homo Sapiens
LIIIVLLRH

SEQ ID NO: 894801 - protein, 9 aa, Homo Sapiens
DVPLSPMLY

SEQ ID NO: 894802 - protein, 9 aa, Homo Sapiens
LHMMVGVNI

SEQ ID NO: 894803 - protein, 9 aa, Homo Sapiens
HTRQMKITK

SEQ ID NO: 894804 - protein, 9 aa, Homo Sapiens
NYCQCHFCD

SEQ ID NO: 894805 - protein, 9 aa, Homo Sapiens
FYFGRRPPT

SEQ ID NO: 894806 - protein, 9 aa, Homo Sapiens
AFIILLFIT

SEQ ID NO: 894807 - protein, 9 aa, Homo Sapiens
LSVVAIMAI

SEQ ID NO: 894808 - protein, 9 aa, Homo Sapiens
KRLCNPSLS

SEQ ID NO: 894809 - protein, 9 aa, Homo Sapiens
CVARNYLEE

SEQ ID NO: 894810 - protein, 9 aa, Homo Sapiens
RKSFHLSKH

SEQ ID NO: 894811 - protein, 9 aa, Homo Sapiens
TTTWEKTAP

SEQ ID NO: 894812 - protein, 9 aa, Homo Sapiens
QNLNHNAMY

SEQ ID NO: 894813 - protein, 9 aa, Homo Sapiens
RKQEWIKET

SEQ ID NO: 894814 - protein, 9 aa, Homo Sapiens
RMRRKNRKT

SEQ ID NO: 894815 - protein, 9 aa, Homo Sapiens
EEQHHIGDR

SEQ ID NO: 894816 - protein, 9 aa, Homo Sapiens
ENQFCEFKL

SEQ ID NO: 894817 - protein, 9 aa, Homo Sapiens
QNTFTTGIV

SEQ ID NO: 894818 - protein, 9 aa, Homo Sapiens
EMAVQLDNV

SEQ ID NO: 894819 - protein, 9 aa, Homo Sapiens
DLVHFAESL

SEQ ID NO: 894820 - protein, 9 aa, Homo Sapiens
TFQIHTPPA

SEQ ID NO: 894821 - protein, 9 aa, Homo Sapiens
FSLSSTLNK

SEQ ID NO: 894822 - protein, 9 aa, Homo Sapiens
LECSDNNLG

SEQ ID NO: 894823 - protein, 9 aa, Homo Sapiens
ILPMQFNSF

SEQ ID NO: 894824 - protein, 9 aa, Homo Sapiens
CEYYLLHLQ

SEQ ID NO: 894825 - protein, 9 aa, Homo Sapiens
KPLVKRDKQ

SEQ ID NO: 894826 - protein, 9 aa, Homo Sapiens
HSHTLKGQR

SEQ ID NO: 894827 - protein, 9 aa, Homo Sapiens
GVIHMWADE

SEQ ID NO: 894828 - protein, 9 aa, Homo Sapiens
SKTYLICYQ

SEQ ID NO: 894829 - protein, 9 aa, Homo Sapiens
SVNPSKEIK

SEQ ID NO: 894830 - protein, 9 aa, Homo Sapiens
DKHLQGLTR

SEQ ID NO: 894831 - protein, 9 aa, Homo Sapiens
FQYHYQLIE

SEQ ID NO: 894832 - protein, 9 aa, Homo Sapiens
HSSEAAIMT

SEQ ID NO: 894833 - protein, 9 aa, Homo Sapiens
LENDIGNRM

SEQ ID NO: 894834 - protein, 9 aa, Homo Sapiens
FKHGLKKPS

SEQ ID NO: 894835 - protein, 9 aa, Homo Sapiens
FNDYMKSLG

SEQ ID NO: 894836 - protein, 9 aa, Homo Sapiens
QKLPQLWHI

SEQ ID NO: 894837 - protein, 9 aa, Homo Sapiens
FQGTRVALV

SEQ ID NO: 894838 - protein, 9 aa, Homo Sapiens
PSYKENAMK

SEQ ID NO: 894839 - protein, 9 aa, Homo Sapiens
LFCSSGTGQ

SEQ ID NO: 894840 - protein, 9 aa, Homo Sapiens
TLAKNRINH

SEQ ID NO: 894841 - protein, 9 aa, Homo Sapiens
PSFIHPPTD

SEQ ID NO: 894842 - protein, 9 aa, Homo Sapiens
EKHNHQSLV

SEQ ID NO: 894843 - protein, 9 aa, Homo Sapiens
TPVYYILCI

SEQ ID NO: 894844 - protein, 9 aa, Homo Sapiens
QSVLRLEKI

SEQ ID NO: 894845 - protein, 9 aa, Homo Sapiens
VDVAVGVFR

SEQ ID NO: 894846 - protein, 9 aa, Homo Sapiens
PLSQRQLCP

SEQ ID NO: 894847 - protein, 9 aa, Homo Sapiens
SHASQAKYV

SEQ ID NO: 894848 - protein, 9 aa, Homo Sapiens
HHQIHTGEK

SEQ ID NO: 894849 - protein, 9 aa, Homo Sapiens
RGETPLMIT

SEQ ID NO: 894850 - protein, 9 aa, Homo Sapiens
APEGVPIGA

SEQ ID NO: 894851 - protein, 9 aa, Homo Sapiens
RPINNSPEA

SEQ ID NO: 894852 - protein, 9 aa, Homo Sapiens
KLKISSSPP

SEQ ID NO: 894853 - protein, 9 aa, Homo Sapiens
EVQVCLQFL

SEQ ID NO: 894854 - protein, 9 aa, Homo Sapiens
IASHTMNKH

SEQ ID NO: 894855 - protein, 9 aa, Homo Sapiens
LDLQIRPVD

SEQ ID NO: 894856 - protein, 9 aa, Homo Sapiens
NSKAERLRW

SEQ ID NO: 894857 - protein, 9 aa, Homo Sapiens
LFSVGQAAS

SEQ ID NO: 894858 - protein, 9 aa, Homo Sapiens
SPLRQNQKT

SEQ ID NO: 894859 - protein, 9 aa, Homo Sapiens
TFCGAELVD

SEQ ID NO: 894860 - protein, 9 aa, Homo Sapiens
PNNQEIEAE

SEQ ID NO: 894861 - protein, 9 aa, Homo Sapiens
KAYVLPIGL

SEQ ID NO: 894862 - protein, 9 aa, Homo Sapiens
GTKAVKKSL

SEQ ID NO: 894863 - protein, 9 aa, Homo Sapiens
IIPRAFKHV

SEQ ID NO: 894864 - protein, 9 aa, Homo Sapiens
CHFHPDKDP

SEQ ID NO: 894865 - protein, 9 aa, Homo Sapiens
AFADTPNHY

SEQ ID NO: 894866 - protein, 9 aa, Homo Sapiens
WVNVINNPQ

SEQ ID NO: 894867 - protein, 9 aa, Homo Sapiens
LTRHQIIHI

SEQ ID NO: 894868 - protein, 9 aa, Homo Sapiens
QIVFQRKLS

SEQ ID NO: 894869 - protein, 9 aa, Homo Sapiens
HPNALEERF

SEQ ID NO: 894870 - protein, 9 aa, Homo Sapiens
PSDRMSTKN

SEQ ID NO: 894871 - protein, 9 aa, Homo Sapiens
VQEKHLSRG

SEQ ID NO: 894872 - protein, 9 aa, Homo Sapiens
LLNIIYFKN

SEQ ID NO: 894873 - protein, 9 aa, Homo Sapiens
SKLVKHHSS

SEQ ID NO: 894874 - protein, 9 aa, Homo Sapiens
EEWPSLRSQ

SEQ ID NO: 894875 - protein, 9 aa, Homo Sapiens
DSAMHLVLR

SEQ ID NO: 894876 - protein, 9 aa, Homo Sapiens
ERLSGRKAS

SEQ ID NO: 894877 - protein, 9 aa, Homo Sapiens
ITLETSLSK

SEQ ID NO: 894878 - protein, 9 aa, Homo Sapiens
IYFLSSLLG

SEQ ID NO: 894879 - protein, 9 aa, Homo Sapiens
NHLNSVGNT

SEQ ID NO: 894880 - protein, 9 aa, Homo Sapiens
FTLERNPIN

SEQ ID NO: 894881 - protein, 9 aa, Homo Sapiens
LSIYNQVYY

SEQ ID NO: 894882 - protein, 9 aa, Homo Sapiens
ESHEYCRNL

SEQ ID NO: 894883 - protein, 9 aa, Homo Sapiens
IVSNKINGI

SEQ ID NO: 894884 - protein, 9 aa, Homo Sapiens
GKTFKCFSY

SEQ ID NO: 894885 - protein, 9 aa, Homo Sapiens
SRDLHHWIN

SEQ ID NO: 894886 - protein, 9 aa, Homo Sapiens
IDLNQTKLE

SEQ ID NO: 894887 - protein, 9 aa, Homo Sapiens
RTLGRPPAP

SEQ ID NO: 894888 - protein, 9 aa, Homo Sapiens
WCPGPVRGG

SEQ ID NO: 894889 - protein, 9 aa, Homo Sapiens
SLQITASPD

SEQ ID NO: 894890 - protein, 9 aa, Homo Sapiens
ATFIYAEIG

SEQ ID NO: 894891 - protein, 9 aa, Homo Sapiens
MNTRMIRKQ

SEQ ID NO: 894892 - protein, 9 aa, Homo Sapiens
EGTKAVKKS

SEQ ID NO: 894893 - protein, 9 aa, Homo Sapiens
TCPAVGRAQ

SEQ ID NO: 894894 - protein, 9 aa, Homo Sapiens
EDKHPYELL

SEQ ID NO: 894895 - protein, 9 aa, Homo Sapiens
CIRLCRALL

SEQ ID NO: 894896 - protein, 9 aa, Homo Sapiens
DFMDQNQYA

SEQ ID NO: 894897 - protein, 9 aa, Homo Sapiens
LHHWINLTF

SEQ ID NO: 894898 - protein, 9 aa, Homo Sapiens
ILNRKIGFA

SEQ ID NO: 894899 - protein, 9 aa, Homo Sapiens
SLFFAILLA

SEQ ID NO: 894900 - protein, 9 aa, Homo Sapiens
KETLRKGAD

SEQ ID NO: 894901 - protein, 9 aa, Homo Sapiens
LICLSLVSP

SEQ ID NO: 894902 - protein, 9 aa, Homo Sapiens
ETGLKVYLQ

SEQ ID NO: 894903 - protein, 9 aa, Homo Sapiens
EVCIYYDYT

SEQ ID NO: 894904 - protein, 9 aa, Homo Sapiens
LRFIQEVHT

SEQ ID NO: 894905 - protein, 9 aa, Homo Sapiens
CKNRTGTEH

SEQ ID NO: 894906 - protein, 9 aa, Homo Sapiens
GSEKIITEH

SEQ ID NO: 894907 - protein, 9 aa, Homo Sapiens
YTSNKIVRE

SEQ ID NO: 894908 - protein, 9 aa, Homo Sapiens
FMQYCVAAN

SEQ ID NO: 894909 - protein, 9 aa, Homo Sapiens
VRLHHKLKT

SEQ ID NO: 894910 - protein, 9 aa, Homo Sapiens
HRNVHPQER

SEQ ID NO: 894911 - protein, 9 aa, Homo Sapiens
DILVTVKNL

SEQ ID NO: 894912 - protein, 9 aa, Homo Sapiens
GNGFKLEGP

SEQ ID NO: 894913 - protein, 9 aa, Homo Sapiens
KKDGSDWII

SEQ ID NO: 894914 - protein, 9 aa, Homo Sapiens
ENNCWCPGP

SEQ ID NO: 894915 - protein, 9 aa, Homo Sapiens
VTVCLFVLD

SEQ ID NO: 894916 - protein, 9 aa, Homo Sapiens
CFSYLTKHK

SEQ ID NO: 894917 - protein, 9 aa, Homo Sapiens
KVKVQNLDC

SEQ ID NO: 894918 - protein, 9 aa, Homo Sapiens
QEENPEEDT

SEQ ID NO: 894919 - protein, 9 aa, Homo Sapiens
VASTISMLL

SEQ ID NO: 894920 - protein, 9 aa, Homo Sapiens
PLGGLVNSR

SEQ ID NO: 894921 - protein, 9 aa, Homo Sapiens
KNLMNVVVL

SEQ ID NO: 894922 - protein, 9 aa, Homo Sapiens
GGKNYERVK

SEQ ID NO: 894923 - protein, 9 aa, Homo Sapiens
GWIPVKWMA

SEQ ID NO: 894924 - protein, 9 aa, Homo Sapiens
NATAAFKTY

SEQ ID NO: 894925 - protein, 9 aa, Homo Sapiens
PPLLSTTNI

SEQ ID NO: 894926 - protein, 9 aa, Homo Sapiens
LSDEDFNWT

SEQ ID NO: 894927 - protein, 9 aa, Homo Sapiens
RTEPPAEPW

SEQ ID NO: 894928 - protein, 9 aa, Homo Sapiens
VVYKLFSLQ

SEQ ID NO: 894929 - protein, 9 aa, Homo Sapiens
KHHLKKHLR

SEQ ID NO: 894930 - protein, 9 aa, Homo Sapiens
NEDVCMIFN

SEQ ID NO: 894931 - protein, 9 aa, Homo Sapiens
IFSSDHLIE

SEQ ID NO: 894932 - protein, 9 aa, Homo Sapiens
HFIQKVEGV

SEQ ID NO: 894933 - protein, 9 aa, Homo Sapiens
TAQPYQPKI

SEQ ID NO: 894934 - protein, 9 aa, Homo Sapiens
SNLTLNKTS

SEQ ID NO: 894935 - protein, 9 aa, Homo Sapiens
TSRMDTTAV

SEQ ID NO: 894936 - protein, 9 aa, Homo Sapiens
KFQLKDTED

SEQ ID NO: 894937 - protein, 9 aa, Homo Sapiens
ENNPSYTYY

SEQ ID NO: 894938 - protein, 9 aa, Homo Sapiens
NLVSQVDDI

SEQ ID NO: 894939 - protein, 9 aa, Homo Sapiens
EEEEAEEED

SEQ ID NO: 894940 - protein, 9 aa, Homo Sapiens
SLYCPQQTI

SEQ ID NO: 894941 - protein, 9 aa, Homo Sapiens
GAGLQNGPR

SEQ ID NO: 894942 - protein, 9 aa, Homo Sapiens
TFWDAFGRY

SEQ ID NO: 894943 - protein, 9 aa, Homo Sapiens
GKAEECIRL

SEQ ID NO: 894944 - protein, 9 aa, Homo Sapiens
AHAIYLLSA

SEQ ID NO: 894945 - protein, 9 aa, Homo Sapiens
TFHCIFQFV

SEQ ID NO: 894946 - protein, 9 aa, Homo Sapiens
RKPDAKPDN

SEQ ID NO: 894947 - protein, 9 aa, Homo Sapiens
KDLQENYCQ

SEQ ID NO: 894948 - protein, 9 aa, Homo Sapiens
SNLTTHKNI

SEQ ID NO: 894949 - protein, 9 aa, Homo Sapiens
SQLKHKYII

SEQ ID NO: 894950 - protein, 9 aa, Homo Sapiens
IQSGEGRKK

SEQ ID NO: 894951 - protein, 9 aa, Homo Sapiens
WLGNEHLHQ

SEQ ID NO: 894952 - protein, 9 aa, Homo Sapiens
SGEQTVRCC

SEQ ID NO: 894953 - protein, 9 aa, Homo Sapiens
VEKYGFTHI

SEQ ID NO: 894954 - protein, 9 aa, Homo Sapiens
AHRNSLYVV

SEQ ID NO: 894955 - protein, 9 aa, Homo Sapiens
HYYETYIRS

SEQ ID NO: 894956 - protein, 9 aa, Homo Sapiens
RCINLARTL

SEQ ID NO: 894957 - protein, 9 aa, Homo Sapiens
QYPKFNSVG

SEQ ID NO: 894958 - protein, 9 aa, Homo Sapiens
LPTIIHEEV

SEQ ID NO: 894959 - protein, 9 aa, Homo Sapiens
LIKVFVDIK

SEQ ID NO: 894960 - protein, 9 aa, Homo Sapiens
FSPSLLKRH

SEQ ID NO: 894961 - protein, 9 aa, Homo Sapiens
ISKEFLTKQ

SEQ ID NO: 894962 - protein, 9 aa, Homo Sapiens
VQILPWEHN

SEQ ID NO: 894963 - protein, 9 aa, Homo Sapiens
CLACSYEGH

SEQ ID NO: 894964 - protein, 9 aa, Homo Sapiens
QEEIINAAV

SEQ ID NO: 894965 - protein, 9 aa, Homo Sapiens
FGQIQLPGY

SEQ ID NO: 894966 - protein, 9 aa, Homo Sapiens
TFGSTLLCF

SEQ ID NO: 894967 - protein, 9 aa, Homo Sapiens
WNQSFQGVT

SEQ ID NO: 894968 - protein, 9 aa, Homo Sapiens
ANCLCYLFL

SEQ ID NO: 894969 - protein, 9 aa, Homo Sapiens
EIKEIEELS

SEQ ID NO: 894970 - protein, 9 aa, Homo Sapiens
IMLELIANL

SEQ ID NO: 894971 - protein, 9 aa, Homo Sapiens
GSSLYHQLH

SEQ ID NO: 894972 - protein, 9 aa, Homo Sapiens
PGTGTQQQL

SEQ ID NO: 894973 - protein, 9 aa, Homo Sapiens
KEAFCRRGK

SEQ ID NO: 894974 - protein, 9 aa, Homo Sapiens
TIRWRIRQD

SEQ ID NO: 894975 - protein, 9 aa, Homo Sapiens
AGENKAVTF

SEQ ID NO: 894976 - protein, 9 aa, Homo Sapiens
LTLNDVFLG

SEQ ID NO: 894977 - protein, 9 aa, Homo Sapiens
VLEKEKAFQ

SEQ ID NO: 894978 - protein, 9 aa, Homo Sapiens
IICLGDSTV

SEQ ID NO: 894979 - protein, 9 aa, Homo Sapiens
EGSDSPDLF

SEQ ID NO: 894980 - protein, 9 aa, Homo Sapiens
SLICTTANT

SEQ ID NO: 894981 - protein, 9 aa, Homo Sapiens
KAHTQNQEY

SEQ ID NO: 894982 - protein, 9 aa, Homo Sapiens
AQFLAQFSM

SEQ ID NO: 894983 - protein, 9 aa, Homo Sapiens
LSSKKNQCL

SEQ ID NO: 894984 - protein, 9 aa, Homo Sapiens
SCGYSENNN

SEQ ID NO: 894985 - protein, 9 aa, Homo Sapiens
QLIKQYWKM

SEQ ID NO: 894986 - protein, 9 aa, Homo Sapiens
AEMLPQELQ

SEQ ID NO: 894987 - protein, 9 aa, Homo Sapiens
DIGYGFGGP

SEQ ID NO: 894988 - protein, 9 aa, Homo Sapiens
SVRQFSGLE

SEQ ID NO: 894989 - protein, 9 aa, Homo Sapiens
PLEPPSELI

SEQ ID NO: 894990 - protein, 9 aa, Homo Sapiens
YKYEHTELQ

SEQ ID NO: 894991 - protein, 9 aa, Homo Sapiens
RIVLANYPD

SEQ ID NO: 894992 - protein, 9 aa, Homo Sapiens
KVPAIEEKL

SEQ ID NO: 894993 - protein, 9 aa, Homo Sapiens
LTDGIIIKG

SEQ ID NO: 894994 - protein, 9 aa, Homo Sapiens
NMNATIRRT

SEQ ID NO: 894995 - protein, 9 aa, Homo Sapiens
QTVISLPKH

SEQ ID NO: 894996 - protein, 9 aa, Homo Sapiens
YCRRQNGYR

SEQ ID NO: 894997 - protein, 9 aa, Homo Sapiens
NLRKTGQEV

SEQ ID NO: 894998 - protein, 9 aa, Homo Sapiens
LGQIVFQRK

SEQ ID NO: 894999 - protein, 9 aa, Homo Sapiens
LVVNNDVVE

SEQ ID NO: 895000 - protein, 9 aa, Homo Sapiens
PEQAPPYPP

SEQ ID NO: 895001 - protein, 9 aa, Homo Sapiens
DEDIPFEQS

SEQ ID NO: 895002 - protein, 9 aa, Homo Sapiens
GQPSRQKWS

SEQ ID NO: 895003 - protein, 9 aa, Homo Sapiens
LNLFFTVLQ

SEQ ID NO: 895004 - protein, 9 aa, Homo Sapiens
SSNGTANYS

SEQ ID NO: 895005 - protein, 9 aa, Homo Sapiens
GNMLGLARR

SEQ ID NO: 895006 - protein, 9 aa, Homo Sapiens
ACDSQEDVN

SEQ ID NO: 895007 - protein, 9 aa, Homo Sapiens
SFYTFSWAF

SEQ ID NO: 895008 - protein, 9 aa, Homo Sapiens
CVGLFLLQG

SEQ ID NO: 895009 - protein, 9 aa, Homo Sapiens
MLNINLWLT

SEQ ID NO: 895010 - protein, 9 aa, Homo Sapiens
LLRWLQNWQ

SEQ ID NO: 895011 - protein, 9 aa, Homo Sapiens
SILEWMFCG

SEQ ID NO: 895012 - protein, 9 aa, Homo Sapiens
PMSAAFPYS

SEQ ID NO: 895013 - protein, 9 aa, Homo Sapiens
EGGQNSFEE

SEQ ID NO: 895014 - protein, 9 aa, Homo Sapiens
RLWPIHNYQ

SEQ ID NO: 895015 - protein, 9 aa, Homo Sapiens
QCNKCGKVF

SEQ ID NO: 895016 - protein, 9 aa, Homo Sapiens
YVLASREWL

SEQ ID NO: 895017 - protein, 9 aa, Homo Sapiens
KVQTTTFQV

SEQ ID NO: 895018 - protein, 9 aa, Homo Sapiens
VTYTFRGFW

SEQ ID NO: 895019 - protein, 9 aa, Homo Sapiens
TCRGQVLLW

SEQ ID NO: 895020 - protein, 9 aa, Homo Sapiens
KKDKMKPQE

SEQ ID NO: 895021 - protein, 9 aa, Homo Sapiens
PRVNKLHPQ

SEQ ID NO: 895022 - protein, 9 aa, Homo Sapiens
ERTQQCIPV

SEQ ID NO: 895023 - protein, 9 aa, Homo Sapiens
VTKVPCSLE

SEQ ID NO: 895024 - protein, 9 aa, Homo Sapiens
EDLQGQTAN

SEQ ID NO: 895025 - protein, 9 aa, Homo Sapiens
LFLDQHMLK

SEQ ID NO: 895026 - protein, 9 aa, Homo Sapiens
DLRQCHQQM

SEQ ID NO: 895027 - protein, 9 aa, Homo Sapiens
DFEQGKLYL

SEQ ID NO: 895028 - protein, 9 aa, Homo Sapiens
FNNLRFVGR

SEQ ID NO: 895029 - protein, 9 aa, Homo Sapiens
NKFLISNSS

SEQ ID NO: 895030 - protein, 9 aa, Homo Sapiens
LTSHADYAG

SEQ ID NO: 895031 - protein, 9 aa, Homo Sapiens
VIKEAVSTP

SEQ ID NO: 895032 - protein, 9 aa, Homo Sapiens
GRVCMAGAL

SEQ ID NO: 895033 - protein, 9 aa, Homo Sapiens
FSPRQNSRT

SEQ ID NO: 895034 - protein, 9 aa, Homo Sapiens
MPNLREFWL

SEQ ID NO: 895035 - protein, 9 aa, Homo Sapiens
SDDAGCLQG

SEQ ID NO: 895036 - protein, 9 aa, Homo Sapiens
LQHLLLIQN

SEQ ID NO: 895037 - protein, 9 aa, Homo Sapiens
ILQHLLLIQ

SEQ ID NO: 895038 - protein, 9 aa, Homo Sapiens
VWLERTMPR

SEQ ID NO: 895039 - protein, 9 aa, Homo Sapiens
GLQKGTKKY

SEQ ID NO: 895040 - protein, 9 aa, Homo Sapiens
DKHYYGEGC

SEQ ID NO: 895041 - protein, 9 aa, Homo Sapiens
AVILAIVLR

SEQ ID NO: 895042 - protein, 9 aa, Homo Sapiens
LRLKHMKFD

SEQ ID NO: 895043 - protein, 9 aa, Homo Sapiens
QRAGFKAAI

SEQ ID NO: 895044 - protein, 9 aa, Homo Sapiens
SGFLKFCFY

SEQ ID NO: 895045 - protein, 9 aa, Homo Sapiens
GYPTLWIEK

SEQ ID NO: 895046 - protein, 9 aa, Homo Sapiens
LTLSLDKDN

SEQ ID NO: 895047 - protein, 9 aa, Homo Sapiens
SMPLQRCRA

SEQ ID NO: 895048 - protein, 9 aa, Homo Sapiens
ANWSSICNF

SEQ ID NO: 895049 - protein, 9 aa, Homo Sapiens
KYITSDTSG

SEQ ID NO: 895050 - protein, 9 aa, Homo Sapiens
MAFQYHYQL

SEQ ID NO: 895051 - protein, 9 aa, Homo Sapiens
ANKGRPMVI

SEQ ID NO: 895052 - protein, 9 aa, Homo Sapiens
GDKNPMSSL

SEQ ID NO: 895053 - protein, 9 aa, Homo Sapiens
VHQTHMSSC

SEQ ID NO: 895054 - protein, 9 aa, Homo Sapiens
YKVNFHFIL

SEQ ID NO: 895055 - protein, 9 aa, Homo Sapiens
IILNGKDKY

SEQ ID NO: 895056 - protein, 9 aa, Homo Sapiens
ASSAVSDCG

SEQ ID NO: 895057 - protein, 9 aa, Homo Sapiens
SRSLPIVFN

SEQ ID NO: 895058 - protein, 9 aa, Homo Sapiens
LKRLPSLIS

SEQ ID NO: 895059 - protein, 9 aa, Homo Sapiens
WNLAKSLDA

SEQ ID NO: 895060 - protein, 9 aa, Homo Sapiens
TYRSFNTFF

SEQ ID NO: 895061 - protein, 9 aa, Homo Sapiens
IVLANYPDA

SEQ ID NO: 895062 - protein, 9 aa, Homo Sapiens
RECKLPKID

SEQ ID NO: 895063 - protein, 9 aa, Homo Sapiens
LIDDHFLFN

SEQ ID NO: 895064 - protein, 9 aa, Homo Sapiens
FLKRNNLLI

SEQ ID NO: 895065 - protein, 9 aa, Homo Sapiens
YFTLDVKIN

SEQ ID NO: 895066 - protein, 9 aa, Homo Sapiens
CEYISLALI

SEQ ID NO: 895067 - protein, 9 aa, Homo Sapiens
TPGSTVLYW

SEQ ID NO: 895068 - protein, 9 aa, Homo Sapiens
LSIQESRLF

SEQ ID NO: 895069 - protein, 9 aa, Homo Sapiens
NDSACASWI

SEQ ID NO: 895070 - protein, 9 aa, Homo Sapiens
RTIQELDKF

SEQ ID NO: 895071 - protein, 9 aa, Homo Sapiens
VVYPEIFPA

SEQ ID NO: 895072 - protein, 9 aa, Homo Sapiens
ELSLVVHHC

SEQ ID NO: 895073 - protein, 9 aa, Homo Sapiens
CSWQEDAYK

SEQ ID NO: 895074 - protein, 9 aa, Homo Sapiens
FYQIDRSQE

SEQ ID NO: 895075 - protein, 9 aa, Homo Sapiens
GVYPLALHI

SEQ ID NO: 895076 - protein, 9 aa, Homo Sapiens
VLRKIQKLI

SEQ ID NO: 895077 - protein, 9 aa, Homo Sapiens
EELDGDNKY

SEQ ID NO: 895078 - protein, 9 aa, Homo Sapiens
KSQGAITEH

SEQ ID NO: 895079 - protein, 9 aa, Homo Sapiens
PAPPCPSIP

SEQ ID NO: 895080 - protein, 9 aa, Homo Sapiens
WLERGSMKW

SEQ ID NO: 895081 - protein, 9 aa, Homo Sapiens
PRISLSPRR

SEQ ID NO: 895082 - protein, 9 aa, Homo Sapiens
SHPDLSPSY

SEQ ID NO: 895083 - protein, 9 aa, Homo Sapiens
TNQVLNSNG

SEQ ID NO: 895084 - protein, 9 aa, Homo Sapiens
STSQLQQLQ

SEQ ID NO: 895085 - protein, 9 aa, Homo Sapiens
KSKRGFFWA

SEQ ID NO: 895086 - protein, 9 aa, Homo Sapiens
MLKFGFGKF

SEQ ID NO: 895087 - protein, 9 aa, Homo Sapiens
EDKLELEVD

SEQ ID NO: 895088 - protein, 9 aa, Homo Sapiens
LHLLRQHKH

SEQ ID NO: 895089 - protein, 9 aa, Homo Sapiens
LPFSPVPKE

SEQ ID NO: 895090 - protein, 9 aa, Homo Sapiens
IQTALSNLV

SEQ ID NO: 895091 - protein, 9 aa, Homo Sapiens
KKDLCNGAA

SEQ ID NO: 895092 - protein, 9 aa, Homo Sapiens
DGGPFAKLN

SEQ ID NO: 895093 - protein, 9 aa, Homo Sapiens
KIEGAQSVL

SEQ ID NO: 895094 - protein, 9 aa, Homo Sapiens
HKIIHTERE

SEQ ID NO: 895095 - protein, 9 aa, Homo Sapiens
LDQNNNAPE

SEQ ID NO: 895096 - protein, 9 aa, Homo Sapiens
QTDLLSLQG

SEQ ID NO: 895097 - protein, 9 aa, Homo Sapiens
PSLGDHSKI

SEQ ID NO: 895098 - protein, 9 aa, Homo Sapiens
QTLDLPIYV

SEQ ID NO: 895099 - protein, 9 aa, Homo Sapiens
QDNASLESR

SEQ ID NO: 895100 - protein, 9 aa, Homo Sapiens
NVTDIKCVK

SEQ ID NO: 895101 - protein, 9 aa, Homo Sapiens
EQLEQQRLT

SEQ ID NO: 895102 - protein, 9 aa, Homo Sapiens
CILDLEVFI

SEQ ID NO: 895103 - protein, 9 aa, Homo Sapiens
EQMETIQHG

SEQ ID NO: 895104 - protein, 9 aa, Homo Sapiens
PLQQGGRIM

SEQ ID NO: 895105 - protein, 9 aa, Homo Sapiens
FFTVTDPQN

SEQ ID NO: 895106 - protein, 9 aa, Homo Sapiens
ENSIEMYRG

SEQ ID NO: 895107 - protein, 9 aa, Homo Sapiens
VKCIKDLFM

SEQ ID NO: 895108 - protein, 9 aa, Homo Sapiens
PDHKASTQG

SEQ ID NO: 895109 - protein, 9 aa, Homo Sapiens
MLTYLNLSQ

SEQ ID NO: 895110 - protein, 9 aa, Homo Sapiens
DASVHEEMI

SEQ ID NO: 895111 - protein, 9 aa, Homo Sapiens
DTFQFCAHC

SEQ ID NO: 895112 - protein, 9 aa, Homo Sapiens
VQLISGFPR

SEQ ID NO: 895113 - protein, 9 aa, Homo Sapiens
PTARFYPLQ

SEQ ID NO: 895114 - protein, 9 aa, Homo Sapiens
INSVNLDSL

SEQ ID NO: 895115 - protein, 9 aa, Homo Sapiens
QNEWGTNQG

SEQ ID NO: 895116 - protein, 9 aa, Homo Sapiens
TTELPLLCA

SEQ ID NO: 895117 - protein, 9 aa, Homo Sapiens
NPFSGSHLE

SEQ ID NO: 895118 - protein, 9 aa, Homo Sapiens
LAPFISPQS

SEQ ID NO: 895119 - protein, 9 aa, Homo Sapiens
SNFTIDLKH

SEQ ID NO: 895120 - protein, 9 aa, Homo Sapiens
QPGRSVQFL

SEQ ID NO: 895121 - protein, 9 aa, Homo Sapiens
QLKHKYIIT

SEQ ID NO: 895122 - protein, 9 aa, Homo Sapiens
FTKPKRSQS

SEQ ID NO: 895123 - protein, 9 aa, Homo Sapiens
KVAAHAPLN

SEQ ID NO: 895124 - protein, 9 aa, Homo Sapiens
SIWTNEHLA

SEQ ID NO: 895125 - protein, 9 aa, Homo Sapiens
KQIRKDISA

SEQ ID NO: 895126 - protein, 9 aa, Homo Sapiens
FHCIFQFVC

SEQ ID NO: 895127 - protein, 9 aa, Homo Sapiens
VNQNSTSSW

SEQ ID NO: 895128 - protein, 9 aa, Homo Sapiens
PSVPHKLPR

SEQ ID NO: 895129 - protein, 9 aa, Homo Sapiens
SNNLLRVAG

SEQ ID NO: 895130 - protein, 9 aa, Homo Sapiens
LELALQGCG

SEQ ID NO: 895131 - protein, 9 aa, Homo Sapiens
IELLALSNS

SEQ ID NO: 895132 - protein, 9 aa, Homo Sapiens
EEKVVKRKA

SEQ ID NO: 895133 - protein, 9 aa, Homo Sapiens
LGGLVNSRL

SEQ ID NO: 895134 - protein, 9 aa, Homo Sapiens
PGASCHPEG

SEQ ID NO: 895135 - protein, 9 aa, Homo Sapiens
FPAFKPWLD

SEQ ID NO: 895136 - protein, 9 aa, Homo Sapiens
EKFKSLLSH

SEQ ID NO: 895137 - protein, 9 aa, Homo Sapiens
NRLVSLDLG

SEQ ID NO: 895138 - protein, 9 aa, Homo Sapiens
TDGRSNGYR

SEQ ID NO: 895139 - protein, 9 aa, Homo Sapiens
LDIIKKGSS

SEQ ID NO: 895140 - protein, 9 aa, Homo Sapiens
LEVDERDQY

SEQ ID NO: 895141 - protein, 9 aa, Homo Sapiens
HNYQTCFPQ

SEQ ID NO: 895142 - protein, 9 aa, Homo Sapiens
LQIARRALR

SEQ ID NO: 895143 - protein, 9 aa, Homo Sapiens
FYILHSKFI

SEQ ID NO: 895144 - protein, 9 aa, Homo Sapiens
DKHNSIDET

SEQ ID NO: 895145 - protein, 9 aa, Homo Sapiens
PETPGKKKT

SEQ ID NO: 895146 - protein, 9 aa, Homo Sapiens
TEDTEQDKD

SEQ ID NO: 895147 - protein, 9 aa, Homo Sapiens
GEDVKVIFK

SEQ ID NO: 895148 - protein, 9 aa, Homo Sapiens
CDPPLTHMP

SEQ ID NO: 895149 - protein, 9 aa, Homo Sapiens
RCDMDGMNQ

SEQ ID NO: 895150 - protein, 9 aa, Homo Sapiens
LYQVMCRNA

SEQ ID NO: 895151 - protein, 9 aa, Homo Sapiens
SLSGGGGSQ

SEQ ID NO: 895152 - protein, 9 aa, Homo Sapiens
TFIYAEIGL

SEQ ID NO: 895153 - protein, 9 aa, Homo Sapiens
LCGTSIIVP

SEQ ID NO: 895154 - protein, 9 aa, Homo Sapiens
GEVLFDISL

SEQ ID NO: 895155 - protein, 9 aa, Homo Sapiens
VHPQERPDW

SEQ ID NO: 895156 - protein, 9 aa, Homo Sapiens
KTQTFYGLH

SEQ ID NO: 895157 - protein, 9 aa, Homo Sapiens
FNDTLVVLP

SEQ ID NO: 895158 - protein, 9 aa, Homo Sapiens
IFTFLSIYN

SEQ ID NO: 895159 - protein, 9 aa, Homo Sapiens
EEEDQEEDN

SEQ ID NO: 895160 - protein, 9 aa, Homo Sapiens
LPAEVIAGG

SEQ ID NO: 895161 - protein, 9 aa, Homo Sapiens
QESNTSQHN

SEQ ID NO: 895162 - protein, 9 aa, Homo Sapiens
QLINHIKQF

SEQ ID NO: 895163 - protein, 9 aa, Homo Sapiens
AKHKQAEIE

SEQ ID NO: 895164 - protein, 9 aa, Homo Sapiens
THAVATARR

SEQ ID NO: 895165 - protein, 9 aa, Homo Sapiens
EEPSYPQER

SEQ ID NO: 895166 - protein, 9 aa, Homo Sapiens
ESSYPVKKT

SEQ ID NO: 895167 - protein, 9 aa, Homo Sapiens
FGPIYRLLL

SEQ ID NO: 895168 - protein, 9 aa, Homo Sapiens
SNLDIIKKG

SEQ ID NO: 895169 - protein, 9 aa, Homo Sapiens
KLLEEVKKK

SEQ ID NO: 895170 - protein, 9 aa, Homo Sapiens
PRRRKGRHK

SEQ ID NO: 895171 - protein, 9 aa, Homo Sapiens
GWCSSLQRH

SEQ ID NO: 895172 - protein, 9 aa, Homo Sapiens
GVFSPSLQN

SEQ ID NO: 895173 - protein, 9 aa, Homo Sapiens
NTTSNIRKE

SEQ ID NO: 895174 - protein, 9 aa, Homo Sapiens
GTRVALVGG

SEQ ID NO: 895175 - protein, 9 aa, Homo Sapiens
ETGTLLMDV

SEQ ID NO: 895176 - protein, 9 aa, Homo Sapiens
SAAGSSSFS

SEQ ID NO: 895177 - protein, 9 aa, Homo Sapiens
DERVCEYYL

SEQ ID NO: 895178 - protein, 9 aa, Homo Sapiens
HRLKHKRDL

SEQ ID NO: 895179 - protein, 9 aa, Homo Sapiens
GQVDIKTDL

SEQ ID NO: 895180 - protein, 9 aa, Homo Sapiens
EVLFDISLF

SEQ ID NO: 895181 - protein, 9 aa, Homo Sapiens
NRAIQRLQG

SEQ ID NO: 895182 - protein, 9 aa, Homo Sapiens
ASNDGPTLI

SEQ ID NO: 895183 - protein, 9 aa, Homo Sapiens
LLGKGCRYL

SEQ ID NO: 895184 - protein, 9 aa, Homo Sapiens
RFIFPAPDL

SEQ ID NO: 895185 - protein, 9 aa, Homo Sapiens
LSSLSFVNF

SEQ ID NO: 895186 - protein, 9 aa, Homo Sapiens
KEEQYITQF

SEQ ID NO: 895187 - protein, 9 aa, Homo Sapiens
NFWLLQNSE

SEQ ID NO: 895188 - protein, 9 aa, Homo Sapiens
GDKHSINCA

SEQ ID NO: 895189 - protein, 9 aa, Homo Sapiens
AARTIKIQN

SEQ ID NO: 895190 - protein, 9 aa, Homo Sapiens
EKLAYTLPL

SEQ ID NO: 895191 - protein, 9 aa, Homo Sapiens
GGKSRRCRT

SEQ ID NO: 895192 - protein, 9 aa, Homo Sapiens
AENNCWCPG

SEQ ID NO: 895193 - protein, 9 aa, Homo Sapiens
SDLASLSAN

SEQ ID NO: 895194 - protein, 9 aa, Homo Sapiens
NIPVRKPAV

SEQ ID NO: 895195 - protein, 9 aa, Homo Sapiens
PQRHRQKLD

SEQ ID NO: 895196 - protein, 9 aa, Homo Sapiens
PLSCETRVN

SEQ ID NO: 895197 - protein, 9 aa, Homo Sapiens
GDRGPGGAT

SEQ ID NO: 895198 - protein, 9 aa, Homo Sapiens
LDFPESWVI

SEQ ID NO: 895199 - protein, 9 aa, Homo Sapiens
PDAKPDNFI

SEQ ID NO: 895200 - protein, 9 aa, Homo Sapiens
IKSKHVLLK

SEQ ID NO: 895201 - protein, 9 aa, Homo Sapiens
FIAGIVFWL

SEQ ID NO: 895202 - protein, 9 aa, Homo Sapiens
ALCSVLHTL

SEQ ID NO: 895203 - protein, 9 aa, Homo Sapiens
LRQQNIAIE

SEQ ID NO: 895204 - protein, 9 aa, Homo Sapiens
TNSQRGINC

SEQ ID NO: 895205 - protein, 9 aa, Homo Sapiens
DRQCQLNVL

SEQ ID NO: 895206 - protein, 9 aa, Homo Sapiens
HINLFINPG

SEQ ID NO: 895207 - protein, 9 aa, Homo Sapiens
QFCQEMIAT

SEQ ID NO: 895208 - protein, 9 aa, Homo Sapiens
GMPVISELL

SEQ ID NO: 895209 - protein, 9 aa, Homo Sapiens
KKQLEGGLV

SEQ ID NO: 895210 - protein, 9 aa, Homo Sapiens
MEHTNASFN

SEQ ID NO: 895211 - protein, 9 aa, Homo Sapiens
TKGNSCPFR

SEQ ID NO: 895212 - protein, 9 aa, Homo Sapiens
LEELCAALV

SEQ ID NO: 895213 - protein, 9 aa, Homo Sapiens
EKNYSASED

SEQ ID NO: 895214 - protein, 9 aa, Homo Sapiens
ITSSTLIHS

SEQ ID NO: 895215 - protein, 9 aa, Homo Sapiens
HTELFTTTM

SEQ ID NO: 895216 - protein, 9 aa, Homo Sapiens
LCLLPQVDT

SEQ ID NO: 895217 - protein, 9 aa, Homo Sapiens
MKGAYKQVI

SEQ ID NO: 895218 - protein, 9 aa, Homo Sapiens
VEFHKLNVS

SEQ ID NO: 895219 - protein, 9 aa, Homo Sapiens
KLWLGTTKP

SEQ ID NO: 895220 - protein, 9 aa, Homo Sapiens
IQVVFQNAL

SEQ ID NO: 895221 - protein, 9 aa, Homo Sapiens
GQVTILYIN

SEQ ID NO: 895222 - protein, 9 aa, Homo Sapiens
LLTLRSLQE

SEQ ID NO: 895223 - protein, 9 aa, Homo Sapiens
VNISDLGLS

SEQ ID NO: 895224 - protein, 9 aa, Homo Sapiens
FLPMSYPQM

SEQ ID NO: 895225 - protein, 9 aa, Homo Sapiens
TCSTIGPPA

SEQ ID NO: 895226 - protein, 9 aa, Homo Sapiens
GILSDGVTK

SEQ ID NO: 895227 - protein, 9 aa, Homo Sapiens
EEDLEWYEP

SEQ ID NO: 895228 - protein, 9 aa, Homo Sapiens
ECMKIKILG

SEQ ID NO: 895229 - protein, 9 aa, Homo Sapiens
LNKHSLERY

SEQ ID NO: 895230 - protein, 9 aa, Homo Sapiens
YQIDRSQEH

SEQ ID NO: 895231 - protein, 9 aa, Homo Sapiens
TSQMLSSTY

SEQ ID NO: 895232 - protein, 9 aa, Homo Sapiens
LSVFYFTIP

SEQ ID NO: 895233 - protein, 9 aa, Homo Sapiens
EAGRIPHPH

SEQ ID NO: 895234 - protein, 9 aa, Homo Sapiens
WMEAMQNKF

SEQ ID NO: 895235 - protein, 9 aa, Homo Sapiens
LIFNHFATE

SEQ ID NO: 895236 - protein, 9 aa, Homo Sapiens
MKPNVEFTF

SEQ ID NO: 895237 - protein, 9 aa, Homo Sapiens
SISGKVQTT

SEQ ID NO: 895238 - protein, 9 aa, Homo Sapiens
IGNKEVEYN

SEQ ID NO: 895239 - protein, 9 aa, Homo Sapiens
LAKDSSTPY

SEQ ID NO: 895240 - protein, 9 aa, Homo Sapiens
NCDGFNVRV

SEQ ID NO: 895241 - protein, 9 aa, Homo Sapiens
LIAENNCWC

SEQ ID NO: 895242 - protein, 9 aa, Homo Sapiens
KNFLIKPFV

SEQ ID NO: 895243 - protein, 9 aa, Homo Sapiens
VLDRICKLA

SEQ ID NO: 895244 - protein, 9 aa, Homo Sapiens
SVRPDNFEL

SEQ ID NO: 895245 - protein, 9 aa, Homo Sapiens
SLYYFGERQ

SEQ ID NO: 895246 - protein, 9 aa, Homo Sapiens
GFKGIGEVV

SEQ ID NO: 895247 - protein, 9 aa, Homo Sapiens
AGAGNPGSL

SEQ ID NO: 895248 - protein, 9 aa, Homo Sapiens
QSLTLAKHK

SEQ ID NO: 895249 - protein, 9 aa, Homo Sapiens
RIIKLPESD

SEQ ID NO: 895250 - protein, 9 aa, Homo Sapiens
GVVQSCNVK

SEQ ID NO: 895251 - protein, 9 aa, Homo Sapiens
FLVCYLRRK

SEQ ID NO: 895252 - protein, 9 aa, Homo Sapiens
AGDKLGKEA

SEQ ID NO: 895253 - protein, 9 aa, Homo Sapiens
DRNELKNMW

SEQ ID NO: 895254 - protein, 9 aa, Homo Sapiens
YGARYDRRH

SEQ ID NO: 895255 - protein, 9 aa, Homo Sapiens
VFKLNFYSN

SEQ ID NO: 895256 - protein, 9 aa, Homo Sapiens
WNDLDKRFQ

SEQ ID NO: 895257 - protein, 9 aa, Homo Sapiens
GDTHGDTCE

SEQ ID NO: 895258 - protein, 9 aa, Homo Sapiens
FTNMSSMNE

SEQ ID NO: 895259 - protein, 9 aa, Homo Sapiens
ETLSSYSGM

SEQ ID NO: 895260 - protein, 9 aa, Homo Sapiens
LPPPRPAPS

SEQ ID NO: 895261 - protein, 9 aa, Homo Sapiens
KLCCWTFVS

SEQ ID NO: 895262 - protein, 9 aa, Homo Sapiens
TVSRVVYST

SEQ ID NO: 895263 - protein, 9 aa, Homo Sapiens
LALRMLQSE

SEQ ID NO: 895264 - protein, 9 aa, Homo Sapiens
GEAGEKGKR

SEQ ID NO: 895265 - protein, 9 aa, Homo Sapiens
LPAADGVAA

SEQ ID NO: 895266 - protein, 9 aa, Homo Sapiens
NKELVPLAT

SEQ ID NO: 895267 - protein, 9 aa, Homo Sapiens
FFAILLAFL

SEQ ID NO: 895268 - protein, 9 aa, Homo Sapiens
QKHGKNVPK

SEQ ID NO: 895269 - protein, 9 aa, Homo Sapiens
EKLLDDKHL

SEQ ID NO: 895270 - protein, 9 aa, Homo Sapiens
HLLKFCRER

SEQ ID NO: 895271 - protein, 9 aa, Homo Sapiens
KSFHLSKHH

SEQ ID NO: 895272 - protein, 9 aa, Homo Sapiens
VPRHEICLS

SEQ ID NO: 895273 - protein, 9 aa, Homo Sapiens
LPLGPEPLL

SEQ ID NO: 895274 - protein, 9 aa, Homo Sapiens
HRSSLSESE

SEQ ID NO: 895275 - protein, 9 aa, Homo Sapiens
CKINCNNFW

SEQ ID NO: 895276 - protein, 9 aa, Homo Sapiens
SPGFTSPKI

SEQ ID NO: 895277 - protein, 9 aa, Homo Sapiens
SVFLGIIVF

SEQ ID NO: 895278 - protein, 9 aa, Homo Sapiens
EVQDDDVPL

SEQ ID NO: 895279 - protein, 9 aa, Homo Sapiens
NGIANLIKI

SEQ ID NO: 895280 - protein, 9 aa, Homo Sapiens
RKPLSFKWW

SEQ ID NO: 895281 - protein, 9 aa, Homo Sapiens
NFSTYSDDI

SEQ ID NO: 895282 - protein, 9 aa, Homo Sapiens
VERATWNDH

SEQ ID NO: 895283 - protein, 9 aa, Homo Sapiens
TLNKHKIVH

SEQ ID NO: 895284 - protein, 9 aa, Homo Sapiens
IKHRLGFLL

SEQ ID NO: 895285 - protein, 9 aa, Homo Sapiens
MATTALAAS

SEQ ID NO: 895286 - protein, 9 aa, Homo Sapiens
FDKNEIQNA

SEQ ID NO: 895287 - protein, 9 aa, Homo Sapiens
LSLDKDNQR

SEQ ID NO: 895288 - protein, 9 aa, Homo Sapiens
EEEEEATAA

SEQ ID NO: 895289 - protein, 9 aa, Homo Sapiens
RKTPSKSNS

SEQ ID NO: 895290 - protein, 9 aa, Homo Sapiens
NKNKNDPEK

SEQ ID NO: 895291 - protein, 9 aa, Homo Sapiens
DKGRKGIYE

SEQ ID NO: 895292 - protein, 9 aa, Homo Sapiens
PTGDWGDTH

SEQ ID NO: 895293 - protein, 9 aa, Homo Sapiens
LRFLEIKEQ

SEQ ID NO: 895294 - protein, 9 aa, Homo Sapiens
VREGCAAQG

SEQ ID NO: 895295 - protein, 9 aa, Homo Sapiens
KSVLKQKEY

SEQ ID NO: 895296 - protein, 9 aa, Homo Sapiens
SIARTRAGS

SEQ ID NO: 895297 - protein, 9 aa, Homo Sapiens
EMTLSHSTL

SEQ ID NO: 895298 - protein, 9 aa, Homo Sapiens
EDPVLSVEN

SEQ ID NO: 895299 - protein, 9 aa, Homo Sapiens
TCLPFSPVP

SEQ ID NO: 895300 - protein, 9 aa, Homo Sapiens
GFGAWLLLY

SEQ ID NO: 895301 - protein, 9 aa, Homo Sapiens
MLWSRIKKI

SEQ ID NO: 895302 - protein, 9 aa, Homo Sapiens
RTSYYEISV

SEQ ID NO: 895303 - protein, 9 aa, Homo Sapiens
LQTEECQLQ

SEQ ID NO: 895304 - protein, 9 aa, Homo Sapiens
SYKYEHTEL

SEQ ID NO: 895305 - protein, 9 aa, Homo Sapiens
SRILAGDVD

SEQ ID NO: 895306 - protein, 9 aa, Homo Sapiens
QREWKSILL

SEQ ID NO: 895307 - protein, 9 aa, Homo Sapiens
SFITCICYV

SEQ ID NO: 895308 - protein, 9 aa, Homo Sapiens
ILTIYQQFS

SEQ ID NO: 895309 - protein, 9 aa, Homo Sapiens
VCVARNYLE

SEQ ID NO: 895310 - protein, 9 aa, Homo Sapiens
LNTAGTVFA

SEQ ID NO: 895311 - protein, 9 aa, Homo Sapiens
SLSEKNNLT

SEQ ID NO: 895312 - protein, 9 aa, Homo Sapiens
NYNRVQRKQ

SEQ ID NO: 895313 - protein, 9 aa, Homo Sapiens
NDRGLQRTI

SEQ ID NO: 895314 - protein, 9 aa, Homo Sapiens
SVMSIQDLQ

SEQ ID NO: 895315 - protein, 9 aa, Homo Sapiens
GQSQQTLDT

SEQ ID NO: 895316 - protein, 9 aa, Homo Sapiens
CGNGFKLEG

SEQ ID NO: 895317 - protein, 9 aa, Homo Sapiens
KGFHGKIED

SEQ ID NO: 895318 - protein, 9 aa, Homo Sapiens
TTTTTIFTT

SEQ ID NO: 895319 - protein, 9 aa, Homo Sapiens
VVNKDSGAV

SEQ ID NO: 895320 - protein, 9 aa, Homo Sapiens
PHAFDFGPH

SEQ ID NO: 895321 - protein, 9 aa, Homo Sapiens
LVHFAESLI

SEQ ID NO: 895322 - protein, 9 aa, Homo Sapiens
TIPLGSGLG

SEQ ID NO: 895323 - protein, 9 aa, Homo Sapiens
AKQLFPNTD

SEQ ID NO: 895324 - protein, 9 aa, Homo Sapiens
DQERIVTAS

SEQ ID NO: 895325 - protein, 9 aa, Homo Sapiens
LLETFNAMD

SEQ ID NO: 895326 - protein, 9 aa, Homo Sapiens
FLYNLYRDG

SEQ ID NO: 895327 - protein, 9 aa, Homo Sapiens
ADDTNEVKN

SEQ ID NO: 895328 - protein, 9 aa, Homo Sapiens
TEANSINTL

SEQ ID NO: 895329 - protein, 9 aa, Homo Sapiens
YIEKKTNQC

SEQ ID NO: 895330 - protein, 9 aa, Homo Sapiens
FWLKSKWMK

SEQ ID NO: 895331 - protein, 9 aa, Homo Sapiens
RELNPQIGT

SEQ ID NO: 895332 - protein, 9 aa, Homo Sapiens
WLKPELFQI

SEQ ID NO: 895333 - protein, 9 aa, Homo Sapiens
EVIHISRGE

SEQ ID NO: 895334 - protein, 9 aa, Homo Sapiens
EAPDLLLAK

SEQ ID NO: 895335 - protein, 9 aa, Homo Sapiens
RVHTGEKPC

SEQ ID NO: 895336 - protein, 9 aa, Homo Sapiens
VGMPNGILS

SEQ ID NO: 895337 - protein, 9 aa, Homo Sapiens
EEINEQEVV

SEQ ID NO: 895338 - protein, 9 aa, Homo Sapiens
EDTWALDDI

SEQ ID NO: 895339 - protein, 9 aa, Homo Sapiens
IKFTGDPHQ

SEQ ID NO: 895340 - protein, 9 aa, Homo Sapiens
RNVDTTVDE

SEQ ID NO: 895341 - protein, 9 aa, Homo Sapiens
QSQKDSDDG

SEQ ID NO: 895342 - protein, 9 aa, Homo Sapiens
RTQQCIPVK

SEQ ID NO: 895343 - protein, 9 aa, Homo Sapiens
EFRVFCLQN

SEQ ID NO: 895344 - protein, 9 aa, Homo Sapiens
DKWKAIELE

SEQ ID NO: 895345 - protein, 9 aa, Homo Sapiens
RLLKRHRRQ

SEQ ID NO: 895346 - protein, 9 aa, Homo Sapiens
KKKKKHQKS

SEQ ID NO: 895347 - protein, 9 aa, Homo Sapiens
IWLYLGYVG

SEQ ID NO: 895348 - protein, 9 aa, Homo Sapiens
HNMVHCADL

SEQ ID NO: 895349 - protein, 9 aa, Homo Sapiens
EKKLRRNII

SEQ ID NO: 895350 - protein, 9 aa, Homo Sapiens
WANAPWDPC

SEQ ID NO: 895351 - protein, 9 aa, Homo Sapiens
VPNFNDNCP

SEQ ID NO: 895352 - protein, 9 aa, Homo Sapiens
TKTKDKLTP

SEQ ID NO: 895353 - protein, 9 aa, Homo Sapiens
EDIIRGIDI

SEQ ID NO: 895354 - protein, 9 aa, Homo Sapiens
TLELQQRNS

SEQ ID NO: 895355 - protein, 9 aa, Homo Sapiens
QAEAAGLHN

SEQ ID NO: 895356 - protein, 9 aa, Homo Sapiens
FCQMQKLPQ

SEQ ID NO: 895357 - protein, 9 aa, Homo Sapiens
CDICNTARQ

SEQ ID NO: 895358 - protein, 9 aa, Homo Sapiens
PPLDWFGLG

SEQ ID NO: 895359 - protein, 9 aa, Homo Sapiens
KKKRKKYPS

SEQ ID NO: 895360 - protein, 9 aa, Homo Sapiens
NNGDNATAS

SEQ ID NO: 895361 - protein, 9 aa, Homo Sapiens
PTCRSASCR

SEQ ID NO: 895362 - protein, 9 aa, Homo Sapiens
KVNLPKYSH

SEQ ID NO: 895363 - protein, 9 aa, Homo Sapiens
IKMQLWILQ

SEQ ID NO: 895364 - protein, 9 aa, Homo Sapiens
SQCWLFLVL

SEQ ID NO: 895365 - protein, 9 aa, Homo Sapiens
KKISTIKTD

SEQ ID NO: 895366 - protein, 9 aa, Homo Sapiens
VNREIYPGS

SEQ ID NO: 895367 - protein, 9 aa, Homo Sapiens
SLEKEECNG

SEQ ID NO: 895368 - protein, 9 aa, Homo Sapiens
LQNFNLKYL

SEQ ID NO: 895369 - protein, 9 aa, Homo Sapiens
EKCMSELWC

SEQ ID NO: 895370 - protein, 9 aa, Homo Sapiens
NDLCLAAGS

SEQ ID NO: 895371 - protein, 9 aa, Homo Sapiens
AGFAQTEVM

SEQ ID NO: 895372 - protein, 9 aa, Homo Sapiens
TPGVPSTLT

SEQ ID NO: 895373 - protein, 9 aa, Homo Sapiens
FEDTAVDFS

SEQ ID NO: 895374 - protein, 9 aa, Homo Sapiens
EEVNIICCK

SEQ ID NO: 895375 - protein, 9 aa, Homo Sapiens
NPVPASPMN

SEQ ID NO: 895376 - protein, 9 aa, Homo Sapiens
GDIVSVLCT

SEQ ID NO: 895377 - protein, 9 aa, Homo Sapiens
MPLQRCRAS

SEQ ID NO: 895378 - protein, 9 aa, Homo Sapiens
QAKVIQEGS

SEQ ID NO: 895379 - protein, 9 aa, Homo Sapiens
TNVRRKPLS

SEQ ID NO: 895380 - protein, 9 aa, Homo Sapiens
YQDLPVRSK

SEQ ID NO: 895381 - protein, 9 aa, Homo Sapiens
GFKLHFWRK

SEQ ID NO: 895382 - protein, 9 aa, Homo Sapiens
DWLGCTLQE

SEQ ID NO: 895383 - protein, 9 aa, Homo Sapiens
YPSAYPVRP

SEQ ID NO: 895384 - protein, 9 aa, Homo Sapiens
LNDAISKKR

SEQ ID NO: 895385 - protein, 9 aa, Homo Sapiens
PAGSPKLSP

SEQ ID NO: 895386 - protein, 9 aa, Homo Sapiens
DCLETGTPQ

SEQ ID NO: 895387 - protein, 9 aa, Homo Sapiens
KDVKYALQR

SEQ ID NO: 895388 - protein, 9 aa, Homo Sapiens
SYEDFLSAL

SEQ ID NO: 895389 - protein, 9 aa, Homo Sapiens
TQLAINTEE

SEQ ID NO: 895390 - protein, 9 aa, Homo Sapiens
PFQIGIKES

SEQ ID NO: 895391 - protein, 9 aa, Homo Sapiens
DAQRKCLSP

SEQ ID NO: 895392 - protein, 9 aa, Homo Sapiens
NQSFQGVTG

SEQ ID NO: 895393 - protein, 9 aa, Homo Sapiens
NNIETQLPA

SEQ ID NO: 895394 - protein, 9 aa, Homo Sapiens
ADDERVCEY

SEQ ID NO: 895395 - protein, 9 aa, Homo Sapiens
EHGESTANE

SEQ ID NO: 895396 - protein, 9 aa, Homo Sapiens
HLVYLLTDK

SEQ ID NO: 895397 - protein, 9 aa, Homo Sapiens
VCLQFLTCV

SEQ ID NO: 895398 - protein, 9 aa, Homo Sapiens
KVDVDCCKK

SEQ ID NO: 895399 - protein, 9 aa, Homo Sapiens
QKQMEEMQK

SEQ ID NO: 895400 - protein, 9 aa, Homo Sapiens
SEELDSEVL

SEQ ID NO: 895401 - protein, 9 aa, Homo Sapiens
KHWTNTYTG

SEQ ID NO: 895402 - protein, 9 aa, Homo Sapiens
VGVKRGSDK

SEQ ID NO: 895403 - protein, 9 aa, Homo Sapiens
EITDNHDCS

SEQ ID NO: 895404 - protein, 9 aa, Homo Sapiens
RPRPNFFYR

SEQ ID NO: 895405 - protein, 9 aa, Homo Sapiens
LATIIRQLS

SEQ ID NO: 895406 - protein, 9 aa, Homo Sapiens
SGPSTSQLQ

SEQ ID NO: 895407 - protein, 9 aa, Homo Sapiens
LLCPEAYVW

SEQ ID NO: 895408 - protein, 9 aa, Homo Sapiens
LRLYETAVK

SEQ ID NO: 895409 - protein, 9 aa, Homo Sapiens
SFNTFFCET

SEQ ID NO: 895410 - protein, 9 aa, Homo Sapiens
QTSGLYGLS

SEQ ID NO: 895411 - protein, 9 aa, Homo Sapiens
INNSPEAHT

SEQ ID NO: 895412 - protein, 9 aa, Homo Sapiens
GNDIILYCN

SEQ ID NO: 895413 - protein, 9 aa, Homo Sapiens
QSSENDGEN

SEQ ID NO: 895414 - protein, 9 aa, Homo Sapiens
KIIIKIFFI

SEQ ID NO: 895415 - protein, 9 aa, Homo Sapiens
EADRLDVLK

SEQ ID NO: 895416 - protein, 9 aa, Homo Sapiens
HNETSKTFA

SEQ ID NO: 895417 - protein, 9 aa, Homo Sapiens
KLKTVEEKR

SEQ ID NO: 895418 - protein, 9 aa, Homo Sapiens
FSGIVTASV

SEQ ID NO: 895419 - protein, 9 aa, Homo Sapiens
DDAWKYNGN

SEQ ID NO: 895420 - protein, 9 aa, Homo Sapiens
KTIKNKQKH

SEQ ID NO: 895421 - protein, 9 aa, Homo Sapiens
NIYISAEYI

SEQ ID NO: 895422 - protein, 9 aa, Homo Sapiens
SYNERVGNL

SEQ ID NO: 895423 - protein, 9 aa, Homo Sapiens
LSLEPQDQE

SEQ ID NO: 895424 - protein, 9 aa, Homo Sapiens
HEENLLGYY

SEQ ID NO: 895425 - protein, 9 aa, Homo Sapiens
PGKVKAQIC

SEQ ID NO: 895426 - protein, 9 aa, Homo Sapiens
EYYRGQNNL

SEQ ID NO: 895427 - protein, 9 aa, Homo Sapiens
GNFLEDKSI

SEQ ID NO: 895428 - protein, 9 aa, Homo Sapiens
EELFKVLGL

SEQ ID NO: 895429 - protein, 9 aa, Homo Sapiens
NNVTLGYDE

SEQ ID NO: 895430 - protein, 9 aa, Homo Sapiens
SKHVLLKNN

SEQ ID NO: 895431 - protein, 9 aa, Homo Sapiens
GLTEESTWC

SEQ ID NO: 895432 - protein, 9 aa, Homo Sapiens
SLLVAVYKT

SEQ ID NO: 895433 - protein, 9 aa, Homo Sapiens
DCQDSRSHS

SEQ ID NO: 895434 - protein, 9 aa, Homo Sapiens
TITRHCCQC

SEQ ID NO: 895435 - protein, 9 aa, Homo Sapiens
SVLLLSPDV

SEQ ID NO: 895436 - protein, 9 aa, Homo Sapiens
NKMKEQEYW

SEQ ID NO: 895437 - protein, 9 aa, Homo Sapiens
HRKFHSIRG

SEQ ID NO: 895438 - protein, 9 aa, Homo Sapiens
VITKLCKFF

SEQ ID NO: 895439 - protein, 9 aa, Homo Sapiens
RDIPVTRTL

SEQ ID NO: 895440 - protein, 9 aa, Homo Sapiens
LVDSKNFND

SEQ ID NO: 895441 - protein, 9 aa, Homo Sapiens
GTESEPDDF

SEQ ID NO: 895442 - protein, 9 aa, Homo Sapiens
AYVLASREW

SEQ ID NO: 895443 - protein, 9 aa, Homo Sapiens
GVNEKQIKN

SEQ ID NO: 895444 - protein, 9 aa, Homo Sapiens
TLQPPNEAT

SEQ ID NO: 895445 - protein, 9 aa, Homo Sapiens
KSDDKNKNK

SEQ ID NO: 895446 - protein, 9 aa, Homo Sapiens
PSSIHHFKN

SEQ ID NO: 895447 - protein, 9 aa, Homo Sapiens
LLDIENAVE

SEQ ID NO: 895448 - protein, 9 aa, Homo Sapiens
WCVLQGHDL

SEQ ID NO: 895449 - protein, 9 aa, Homo Sapiens
PNDSDNIKH

SEQ ID NO: 895450 - protein, 9 aa, Homo Sapiens
KTVVNKLFK

SEQ ID NO: 895451 - protein, 9 aa, Homo Sapiens
EYFMRQQRT

SEQ ID NO: 895452 - protein, 9 aa, Homo Sapiens
ASEMGTERV

SEQ ID NO: 895453 - protein, 9 aa, Homo Sapiens
TASISRVLS

SEQ ID NO: 895454 - protein, 9 aa, Homo Sapiens
AQPKYTVFV

SEQ ID NO: 895455 - protein, 9 aa, Homo Sapiens
HHWINLTFG

SEQ ID NO: 895456 - protein, 9 aa, Homo Sapiens
FIFPAPDLP

SEQ ID NO: 895457 - protein, 9 aa, Homo Sapiens
INKIYDEAT

SEQ ID NO: 895458 - protein, 9 aa, Homo Sapiens
FQPCFLGMK

SEQ ID NO: 895459 - protein, 9 aa, Homo Sapiens
LSGINVINY

SEQ ID NO: 895460 - protein, 9 aa, Homo Sapiens
SKQKETLRD

SEQ ID NO: 895461 - protein, 9 aa, Homo Sapiens
CKYTLQICT

SEQ ID NO: 895462 - protein, 9 aa, Homo Sapiens
PQHTNQTEA

SEQ ID NO: 895463 - protein, 9 aa, Homo Sapiens
LLNMCVGEK

SEQ ID NO: 895464 - protein, 9 aa, Homo Sapiens
EQISYTPPE

SEQ ID NO: 895465 - protein, 9 aa, Homo Sapiens
LGPNTQGFL

SEQ ID NO: 895466 - protein, 9 aa, Homo Sapiens
CPQQTIVFA

SEQ ID NO: 895467 - protein, 9 aa, Homo Sapiens
ISLLCVYVW

SEQ ID NO: 895468 - protein, 9 aa, Homo Sapiens
AESVTEETF

SEQ ID NO: 895469 - protein, 9 aa, Homo Sapiens
KSLVALMVE

SEQ ID NO: 895470 - protein, 9 aa, Homo Sapiens
ILLKELDNL

SEQ ID NO: 895471 - protein, 9 aa, Homo Sapiens
LTNGVLSRD

SEQ ID NO: 895472 - protein, 9 aa, Homo Sapiens
RCRTAFTSE

SEQ ID NO: 895473 - protein, 9 aa, Homo Sapiens
FKFKSSSHA

SEQ ID NO: 895474 - protein, 9 aa, Homo Sapiens
RNLYQEWKE

SEQ ID NO: 895475 - protein, 9 aa, Homo Sapiens
FIHNSANVP

SEQ ID NO: 895476 - protein, 9 aa, Homo Sapiens
LEKTANKGR

SEQ ID NO: 895477 - protein, 9 aa, Homo Sapiens
KYDYISQGE

SEQ ID NO: 895478 - protein, 9 aa, Homo Sapiens
VDDIQAILD

SEQ ID NO: 895479 - protein, 9 aa, Homo Sapiens
LIVTTVCLK

SEQ ID NO: 895480 - protein, 9 aa, Homo Sapiens
KMAVCKIKV

SEQ ID NO: 895481 - protein, 9 aa, Homo Sapiens
MSPMLCLTL

SEQ ID NO: 895482 - protein, 9 aa, Homo Sapiens
SCAEEPCGV

SEQ ID NO: 895483 - protein, 9 aa, Homo Sapiens
SICHRWGLP

SEQ ID NO: 895484 - protein, 9 aa, Homo Sapiens
GKNVPKYQC

SEQ ID NO: 895485 - protein, 9 aa, Homo Sapiens
ICFPIPTEM

SEQ ID NO: 895486 - protein, 9 aa, Homo Sapiens
ELSHYRQCA

SEQ ID NO: 895487 - protein, 9 aa, Homo Sapiens
VADTLTNAV

SEQ ID NO: 895488 - protein, 9 aa, Homo Sapiens
DFQKLTTAD

SEQ ID NO: 895489 - protein, 9 aa, Homo Sapiens
KDRTIQISC

SEQ ID NO: 895490 - protein, 9 aa, Homo Sapiens
ERSKVIHLT

SEQ ID NO: 895491 - protein, 9 aa, Homo Sapiens
EKVVTQQIR

SEQ ID NO: 895492 - protein, 9 aa, Homo Sapiens
MSREVKEIR

SEQ ID NO: 895493 - protein, 9 aa, Homo Sapiens
KTQCSKEDQ

SEQ ID NO: 895494 - protein, 9 aa, Homo Sapiens
SNNTDFFIG

SEQ ID NO: 895495 - protein, 9 aa, Homo Sapiens
DIILYCNSS

SEQ ID NO: 895496 - protein, 9 aa, Homo Sapiens
SRNFATMIN

SEQ ID NO: 895497 - protein, 9 aa, Homo Sapiens
ATARRSLLS

SEQ ID NO: 895498 - protein, 9 aa, Homo Sapiens
PVVSPNDTR

SEQ ID NO: 895499 - protein, 9 aa, Homo Sapiens
QARVCKLQS

SEQ ID NO: 895500 - protein, 9 aa, Homo Sapiens
DEALVDITK

SEQ ID NO: 895501 - protein, 9 aa, Homo Sapiens
LWPIHNYQV

SEQ ID NO: 895502 - protein, 9 aa, Homo Sapiens
RPEKIIQIL

SEQ ID NO: 895503 - protein, 9 aa, Homo Sapiens
EEGVPGKWQ

SEQ ID NO: 895504 - protein, 9 aa, Homo Sapiens
IIEEIIQTK

SEQ ID NO: 895505 - protein, 9 aa, Homo Sapiens
QNAEAVHLF

SEQ ID NO: 895506 - protein, 9 aa, Homo Sapiens
IICRFETRI

SEQ ID NO: 895507 - protein, 9 aa, Homo Sapiens
FMWIIRKMI

SEQ ID NO: 895508 - protein, 9 aa, Homo Sapiens
PTLRHHNLH

SEQ ID NO: 895509 - protein, 9 aa, Homo Sapiens
KEGEEEKVV

SEQ ID NO: 895510 - protein, 9 aa, Homo Sapiens
KEETGLKVY

SEQ ID NO: 895511 - protein, 9 aa, Homo Sapiens
YKFFCDVSS

SEQ ID NO: 895512 - protein, 9 aa, Homo Sapiens
PAISDLGGS

SEQ ID NO: 895513 - protein, 9 aa, Homo Sapiens
TVGGLIYWI

SEQ ID NO: 895514 - protein, 9 aa, Homo Sapiens
SSDTSSRSL

SEQ ID NO: 895515 - protein, 9 aa, Homo Sapiens
REEDHSCTL

SEQ ID NO: 895516 - protein, 9 aa, Homo Sapiens
MIPSNSTQL

SEQ ID NO: 895517 - protein, 9 aa, Homo Sapiens
GLGVIHMWA

SEQ ID NO: 895518 - protein, 9 aa, Homo Sapiens
GPYRLCQFH

SEQ ID NO: 895519 - protein, 9 aa, Homo Sapiens
EEKTKSSWF

SEQ ID NO: 895520 - protein, 9 aa, Homo Sapiens
ECGKCFRHH

SEQ ID NO: 895521 - protein, 9 aa, Homo Sapiens
ITADIQDIE

SEQ ID NO: 895522 - protein, 9 aa, Homo Sapiens
VQTKAKAES

SEQ ID NO: 895523 - protein, 9 aa, Homo Sapiens
YSYWALGYV

SEQ ID NO: 895524 - protein, 9 aa, Homo Sapiens
PYGARYDRR

SEQ ID NO: 895525 - protein, 9 aa, Homo Sapiens
VNTKIGKIR

SEQ ID NO: 895526 - protein, 9 aa, Homo Sapiens
IHDQKEFAK

SEQ ID NO: 895527 - protein, 9 aa, Homo Sapiens
DSKEKRYLR

SEQ ID NO: 895528 - protein, 9 aa, Homo Sapiens
RRFSADEQL

SEQ ID NO: 895529 - protein, 9 aa, Homo Sapiens
HTFNNYRND

SEQ ID NO: 895530 - protein, 9 aa, Homo Sapiens
NFVSHLNQI

SEQ ID NO: 895531 - protein, 9 aa, Homo Sapiens
HIKGEQEKE

SEQ ID NO: 895532 - protein, 9 aa, Homo Sapiens
DLQENYCQN

SEQ ID NO: 895533 - protein, 9 aa, Homo Sapiens
RNMKQKFIV

SEQ ID NO: 895534 - protein, 9 aa, Homo Sapiens
QIDNGFFYP

SEQ ID NO: 895535 - protein, 9 aa, Homo Sapiens
QTHFSTAYE

SEQ ID NO: 895536 - protein, 9 aa, Homo Sapiens
RGASKEIIS

SEQ ID NO: 895537 - protein, 9 aa, Homo Sapiens
RCWCKKRRL

SEQ ID NO: 895538 - protein, 9 aa, Homo Sapiens
EQNSTAAEL

SEQ ID NO: 895539 - protein, 9 aa, Homo Sapiens
ADIKSKNKH

SEQ ID NO: 895540 - protein, 9 aa, Homo Sapiens
PPAPFKSPE

SEQ ID NO: 895541 - protein, 9 aa, Homo Sapiens
FLGSIILIQ

SEQ ID NO: 895542 - protein, 9 aa, Homo Sapiens
SSTDQKYSK

SEQ ID NO: 895543 - protein, 9 aa, Homo Sapiens
VTLKTIKNK

SEQ ID NO: 895544 - protein, 9 aa, Homo Sapiens
EQLNLEDKD

SEQ ID NO: 895545 - protein, 9 aa, Homo Sapiens
EEAEQLEKE

SEQ ID NO: 895546 - protein, 9 aa, Homo Sapiens
CFKSLAKRR

SEQ ID NO: 895547 - protein, 9 aa, Homo Sapiens
DLFSSLICT

SEQ ID NO: 895548 - protein, 9 aa, Homo Sapiens
DGNQFYIKT

SEQ ID NO: 895549 - protein, 9 aa, Homo Sapiens
LTLKTQVDT

SEQ ID NO: 895550 - protein, 9 aa, Homo Sapiens
YKELPGEPG

SEQ ID NO: 895551 - protein, 9 aa, Homo Sapiens
FSILLWVGT

SEQ ID NO: 895552 - protein, 9 aa, Homo Sapiens
DIFLCYIIT

SEQ ID NO: 895553 - protein, 9 aa, Homo Sapiens
NLDPDVIGP

SEQ ID NO: 895554 - protein, 9 aa, Homo Sapiens
QRLTVQQVE

SEQ ID NO: 895555 - protein, 9 aa, Homo Sapiens
VFQVTSTEF

SEQ ID NO: 895556 - protein, 9 aa, Homo Sapiens
ELYTLPFHL

SEQ ID NO: 895557 - protein, 9 aa, Homo Sapiens
FGTSTGDVC

SEQ ID NO: 895558 - protein, 9 aa, Homo Sapiens
NDTYWELQK

SEQ ID NO: 895559 - protein, 9 aa, Homo Sapiens
LMSDGSSNT

SEQ ID NO: 895560 - protein, 9 aa, Homo Sapiens
VPDVLPQAQ

SEQ ID NO: 895561 - protein, 9 aa, Homo Sapiens
EFWLYDNHI

SEQ ID NO: 895562 - protein, 9 aa, Homo Sapiens
AQNQFIANH

SEQ ID NO: 895563 - protein, 9 aa, Homo Sapiens
DIDDKNEID

SEQ ID NO: 895564 - protein, 9 aa, Homo Sapiens
GEGKEIHRA

SEQ ID NO: 895565 - protein, 9 aa, Homo Sapiens
HLHINAPQS

SEQ ID NO: 895566 - protein, 9 aa, Homo Sapiens
VQNRESMGL

SEQ ID NO: 895567 - protein, 9 aa, Homo Sapiens
KCMSELWCM

SEQ ID NO: 895568 - protein, 9 aa, Homo Sapiens
SSGEGERRF

SEQ ID NO: 895569 - protein, 9 aa, Homo Sapiens
PSNSHSRRE

SEQ ID NO: 895570 - protein, 9 aa, Homo Sapiens
PVALCGLPD

SEQ ID NO: 895571 - protein, 9 aa, Homo Sapiens
GQQDLYQIL

SEQ ID NO: 895572 - protein, 9 aa, Homo Sapiens
KSVDAGVSQ

SEQ ID NO: 895573 - protein, 9 aa, Homo Sapiens
MELMDANIC

SEQ ID NO: 895574 - protein, 9 aa, Homo Sapiens
FSCAQKMAK

SEQ ID NO: 895575 - protein, 9 aa, Homo Sapiens
RAGNNSWWI

SEQ ID NO: 895576 - protein, 9 aa, Homo Sapiens
PLCPKDVVY

SEQ ID NO: 895577 - protein, 9 aa, Homo Sapiens
PYEAFNPAA

SEQ ID NO: 895578 - protein, 9 aa, Homo Sapiens
KLSWGYRRK

SEQ ID NO: 895579 - protein, 9 aa, Homo Sapiens
IKELENNIW

SEQ ID NO: 895580 - protein, 9 aa, Homo Sapiens
IDQREKIKY

SEQ ID NO: 895581 - protein, 9 aa, Homo Sapiens
VAVLFAMVL

SEQ ID NO: 895582 - protein, 9 aa, Homo Sapiens
WIYLCGFSG

SEQ ID NO: 895583 - protein, 9 aa, Homo Sapiens
ALLGLMLYL

SEQ ID NO: 895584 - protein, 9 aa, Homo Sapiens
QQRGNMVTT

SEQ ID NO: 895585 - protein, 9 aa, Homo Sapiens
EVREAAALV

SEQ ID NO: 895586 - protein, 9 aa, Homo Sapiens
RLQELFFNL

SEQ ID NO: 895587 - protein, 9 aa, Homo Sapiens
GRPLGLKLC

SEQ ID NO: 895588 - protein, 9 aa, Homo Sapiens
SQLQVEEED

SEQ ID NO: 895589 - protein, 9 aa, Homo Sapiens
DQNNNAPEI

SEQ ID NO: 895590 - protein, 9 aa, Homo Sapiens
GKWMNKFSE

SEQ ID NO: 895591 - protein, 9 aa, Homo Sapiens
CSVTCAKNH

SEQ ID NO: 895592 - protein, 9 aa, Homo Sapiens
QLGPVLRFP

SEQ ID NO: 895593 - protein, 9 aa, Homo Sapiens
NCVIGCRCV

SEQ ID NO: 895594 - protein, 9 aa, Homo Sapiens
DFVEGYYHT

SEQ ID NO: 895595 - protein, 9 aa, Homo Sapiens
FSMKPSCIW

SEQ ID NO: 895596 - protein, 9 aa, Homo Sapiens
AGLSYFYGA

SEQ ID NO: 895597 - protein, 9 aa, Homo Sapiens
HCRTVTQQR

SEQ ID NO: 895598 - protein, 9 aa, Homo Sapiens
LPRYFELSN

SEQ ID NO: 895599 - protein, 9 aa, Homo Sapiens
MIETKCFKE

SEQ ID NO: 895600 - protein, 9 aa, Homo Sapiens
SSHLTRHQI

SEQ ID NO: 895601 - protein, 9 aa, Homo Sapiens
VINLSKKIK

SEQ ID NO: 895602 - protein, 9 aa, Homo Sapiens
CENFQDLMQ

SEQ ID NO: 895603 - protein, 9 aa, Homo Sapiens
SRPASPTWQ

SEQ ID NO: 895604 - protein, 9 aa, Homo Sapiens
GNQFYIKTS

SEQ ID NO: 895605 - protein, 9 aa, Homo Sapiens
ILGVVYTSH

SEQ ID NO: 895606 - protein, 9 aa, Homo Sapiens
YFSQESSPS

SEQ ID NO: 895607 - protein, 9 aa, Homo Sapiens
LLQGNEDDI

SEQ ID NO: 895608 - protein, 9 aa, Homo Sapiens
NEDRIHKQD

SEQ ID NO: 895609 - protein, 9 aa, Homo Sapiens
GEKPYECQA

SEQ ID NO: 895610 - protein, 9 aa, Homo Sapiens
TLSNAETSV

SEQ ID NO: 895611 - protein, 9 aa, Homo Sapiens
KYFFENEDV

SEQ ID NO: 895612 - protein, 9 aa, Homo Sapiens
SSRTSYYEI

SEQ ID NO: 895613 - protein, 9 aa, Homo Sapiens
QDHQLQNMG

SEQ ID NO: 895614 - protein, 9 aa, Homo Sapiens
IILLFITAI

SEQ ID NO: 895615 - protein, 9 aa, Homo Sapiens
GICIKIADF

SEQ ID NO: 895616 - protein, 9 aa, Homo Sapiens
KISFGKLKL

SEQ ID NO: 895617 - protein, 9 aa, Homo Sapiens
DFEVGDKIQ

SEQ ID NO: 895618 - protein, 9 aa, Homo Sapiens
EDIKQFLLN

SEQ ID NO: 895619 - protein, 9 aa, Homo Sapiens
VNKTPSFPH

SEQ ID NO: 895620 - protein, 9 aa, Homo Sapiens
KYDIDDKNE

SEQ ID NO: 895621 - protein, 9 aa, Homo Sapiens
AAEQIWRRR

SEQ ID NO: 895622 - protein, 9 aa, Homo Sapiens
LLVTIRNVL

SEQ ID NO: 895623 - protein, 9 aa, Homo Sapiens
KMFGNGNFR

SEQ ID NO: 895624 - protein, 9 aa, Homo Sapiens
SDPHPDRTH

SEQ ID NO: 895625 - protein, 9 aa, Homo Sapiens
RRCHRFIPC

SEQ ID NO: 895626 - protein, 9 aa, Homo Sapiens
ASDNFLGIS

SEQ ID NO: 895627 - protein, 9 aa, Homo Sapiens
LGLARRSPR

SEQ ID NO: 895628 - protein, 9 aa, Homo Sapiens
SKVKVKVQV

SEQ ID NO: 895629 - protein, 9 aa, Homo Sapiens
SSASTGRKW

SEQ ID NO: 895630 - protein, 9 aa, Homo Sapiens
LETERIPSH

SEQ ID NO: 895631 - protein, 9 aa, Homo Sapiens
VQEIIGVAK

SEQ ID NO: 895632 - protein, 9 aa, Homo Sapiens
AIYTSQEEI

SEQ ID NO: 895633 - protein, 9 aa, Homo Sapiens
RQKFLSERE

SEQ ID NO: 895634 - protein, 9 aa, Homo Sapiens
NPTKDLYEY

SEQ ID NO: 895635 - protein, 9 aa, Homo Sapiens
ILLPHRRGL

SEQ ID NO: 895636 - protein, 9 aa, Homo Sapiens
LSAVRTVRV

SEQ ID NO: 895637 - protein, 9 aa, Homo Sapiens
EIVSNKING

SEQ ID NO: 895638 - protein, 9 aa, Homo Sapiens
YHDAVTKAI

SEQ ID NO: 895639 - protein, 9 aa, Homo Sapiens
RKSQLQVEE

SEQ ID NO: 895640 - protein, 9 aa, Homo Sapiens
ETICSICKA

SEQ ID NO: 895641 - protein, 9 aa, Homo Sapiens
FVSVIPESY

SEQ ID NO: 895642 - protein, 9 aa, Homo Sapiens
QLKIYQGNI

SEQ ID NO: 895643 - protein, 9 aa, Homo Sapiens
HRIYLPPSR

SEQ ID NO: 895644 - protein, 9 aa, Homo Sapiens
NRKENAYNA

SEQ ID NO: 895645 - protein, 9 aa, Homo Sapiens
YYKISANLY

SEQ ID NO: 895646 - protein, 9 aa, Homo Sapiens
KFTIYNNML

SEQ ID NO: 895647 - protein, 9 aa, Homo Sapiens
KAAWVNEIW

SEQ ID NO: 895648 - protein, 9 aa, Homo Sapiens
LGTKTFQIH

SEQ ID NO: 895649 - protein, 9 aa, Homo Sapiens
ARDMKTCHF

SEQ ID NO: 895650 - protein, 9 aa, Homo Sapiens
PQLQMASPE

SEQ ID NO: 895651 - protein, 9 aa, Homo Sapiens
EITHTGEKP

SEQ ID NO: 895652 - protein, 9 aa, Homo Sapiens
QVNIQRKRR

SEQ ID NO: 895653 - protein, 9 aa, Homo Sapiens
MLADVLSEK

SEQ ID NO: 895654 - protein, 9 aa, Homo Sapiens
FDNSFQNTT

SEQ ID NO: 895655 - protein, 9 aa, Homo Sapiens
SAKADILRS

SEQ ID NO: 895656 - protein, 9 aa, Homo Sapiens
IPASLLDRE

SEQ ID NO: 895657 - protein, 9 aa, Homo Sapiens
ITKIKDGDF

SEQ ID NO: 895658 - protein, 9 aa, Homo Sapiens
CIPSDRINK

SEQ ID NO: 895659 - protein, 9 aa, Homo Sapiens
HTLYHILSQ

SEQ ID NO: 895660 - protein, 9 aa, Homo Sapiens
VVFEDGTVE

SEQ ID NO: 895661 - protein, 9 aa, Homo Sapiens
FLAMDKVAH

SEQ ID NO: 895662 - protein, 9 aa, Homo Sapiens
GQGEEVETL

SEQ ID NO: 895663 - protein, 9 aa, Homo Sapiens
VLLRMYYFD

SEQ ID NO: 895664 - protein, 9 aa, Homo Sapiens
FNQQQRTGK

SEQ ID NO: 895665 - protein, 9 aa, Homo Sapiens
RVDILQGAK

SEQ ID NO: 895666 - protein, 9 aa, Homo Sapiens
ESQVLKINE

SEQ ID NO: 895667 - protein, 9 aa, Homo Sapiens
TTGYKHFDK

SEQ ID NO: 895668 - protein, 9 aa, Homo Sapiens
SCHRRVHLG

SEQ ID NO: 895669 - protein, 9 aa, Homo Sapiens
AIEGNFLGQ

SEQ ID NO: 895670 - protein, 9 aa, Homo Sapiens
CSIDEDCKL

SEQ ID NO: 895671 - protein, 9 aa, Homo Sapiens
TTSSLVSVI

SEQ ID NO: 895672 - protein, 9 aa, Homo Sapiens
AAHCHKPYL

SEQ ID NO: 895673 - protein, 9 aa, Homo Sapiens
IMSLFIVQN

SEQ ID NO: 895674 - protein, 9 aa, Homo Sapiens
MHDLDHFDK

SEQ ID NO: 895675 - protein, 9 aa, Homo Sapiens
HHKDAGVIC

SEQ ID NO: 895676 - protein, 9 aa, Homo Sapiens
KCNDLYFNL

SEQ ID NO: 895677 - protein, 9 aa, Homo Sapiens
TFNEADKSV

SEQ ID NO: 895678 - protein, 9 aa, Homo Sapiens
WWITGTDGV

SEQ ID NO: 895679 - protein, 9 aa, Homo Sapiens
SAMHLVLRA

SEQ ID NO: 895680 - protein, 9 aa, Homo Sapiens
KKVEQDAAR

SEQ ID NO: 895681 - protein, 9 aa, Homo Sapiens
KMSFKDIKS

SEQ ID NO: 895682 - protein, 9 aa, Homo Sapiens
EMPDMKAED

SEQ ID NO: 895683 - protein, 9 aa, Homo Sapiens
SYSPTRKAK

SEQ ID NO: 895684 - protein, 9 aa, Homo Sapiens
QTLQRNDIA

SEQ ID NO: 895685 - protein, 9 aa, Homo Sapiens
ARFEWEQND

SEQ ID NO: 895686 - protein, 9 aa, Homo Sapiens
LACSYEGHG

SEQ ID NO: 895687 - protein, 9 aa, Homo Sapiens
IKMEGMARS

SEQ ID NO: 895688 - protein, 9 aa, Homo Sapiens
LSAERMCDI

SEQ ID NO: 895689 - protein, 9 aa, Homo Sapiens
ELLGSRLEQ

SEQ ID NO: 895690 - protein, 9 aa, Homo Sapiens
VERNYPLAI

SEQ ID NO: 895691 - protein, 9 aa, Homo Sapiens
CLSLVSPAS

SEQ ID NO: 895692 - protein, 9 aa, Homo Sapiens
LVAHLLSKY

SEQ ID NO: 895693 - protein, 9 aa, Homo Sapiens
MDGGIIVFQ

SEQ ID NO: 895694 - protein, 9 aa, Homo Sapiens
SQQTDIYKQ

SEQ ID NO: 895695 - protein, 9 aa, Homo Sapiens
QYKRATASE

SEQ ID NO: 895696 - protein, 9 aa, Homo Sapiens
DNFFDESQY

SEQ ID NO: 895697 - protein, 9 aa, Homo Sapiens
TKCAASGDG

SEQ ID NO: 895698 - protein, 9 aa, Homo Sapiens
KKKAVVICH

SEQ ID NO: 895699 - protein, 9 aa, Homo Sapiens
QVARFNNLR

SEQ ID NO: 895700 - protein, 9 aa, Homo Sapiens
NQEIEAELR

SEQ ID NO: 895701 - protein, 9 aa, Homo Sapiens
GRNQEKLNK

SEQ ID NO: 895702 - protein, 9 aa, Homo Sapiens
PTTIATVIN

SEQ ID NO: 895703 - protein, 9 aa, Homo Sapiens
TCHESYNQT

SEQ ID NO: 895704 - protein, 9 aa, Homo Sapiens
GPIYRLLLG

SEQ ID NO: 895705 - protein, 9 aa, Homo Sapiens
TKQKNLFRL

SEQ ID NO: 895706 - protein, 9 aa, Homo Sapiens
WSPANRPSF

SEQ ID NO: 895707 - protein, 9 aa, Homo Sapiens
QTYPKKPGV

SEQ ID NO: 895708 - protein, 9 aa, Homo Sapiens
KNALESILP

SEQ ID NO: 895709 - protein, 9 aa, Homo Sapiens
PGIFSPLAG

SEQ ID NO: 895710 - protein, 9 aa, Homo Sapiens
QVHEWVPLW

SEQ ID NO: 895711 - protein, 9 aa, Homo Sapiens
RRLLVKYPK

SEQ ID NO: 895712 - protein, 9 aa, Homo Sapiens
TVYVLVFTL

SEQ ID NO: 895713 - protein, 9 aa, Homo Sapiens
TWCVLQGHD

SEQ ID NO: 895714 - protein, 9 aa, Homo Sapiens
DKTKTPTLQ

SEQ ID NO: 895715 - protein, 9 aa, Homo Sapiens
LTQKGLKVV

SEQ ID NO: 895716 - protein, 9 aa, Homo Sapiens
PVFKFQLAE

SEQ ID NO: 895717 - protein, 9 aa, Homo Sapiens
MHFGAGTRL

SEQ ID NO: 895718 - protein, 9 aa, Homo Sapiens
ADKPSSEES

SEQ ID NO: 895719 - protein, 9 aa, Homo Sapiens
KRHIHSHTG

SEQ ID NO: 895720 - protein, 9 aa, Homo Sapiens
LPTHKQVFL

SEQ ID NO: 895721 - protein, 9 aa, Homo Sapiens
LGLMLYLVF

SEQ ID NO: 895722 - protein, 9 aa, Homo Sapiens
DWRKDMTNE

SEQ ID NO: 895723 - protein, 9 aa, Homo Sapiens
RDDSENTFS

SEQ ID NO: 895724 - protein, 9 aa, Homo Sapiens
DDKRLLLKE

SEQ ID NO: 895725 - protein, 9 aa, Homo Sapiens
NMNYKIKKE

SEQ ID NO: 895726 - protein, 9 aa, Homo Sapiens
VLELDKRIE

SEQ ID NO: 895727 - protein, 9 aa, Homo Sapiens
GPGWPGPGQ

SEQ ID NO: 895728 - protein, 9 aa, Homo Sapiens
IMFCLILLI

SEQ ID NO: 895729 - protein, 9 aa, Homo Sapiens
DQADTFCPA

SEQ ID NO: 895730 - protein, 9 aa, Homo Sapiens
HDCSQGLRI

SEQ ID NO: 895731 - protein, 9 aa, Homo Sapiens
GNKVQIKVL

SEQ ID NO: 895732 - protein, 9 aa, Homo Sapiens
PVINLAESL

SEQ ID NO: 895733 - protein, 9 aa, Homo Sapiens
VIVISMGFG

SEQ ID NO: 895734 - protein, 9 aa, Homo Sapiens
KLTDYFTEV

SEQ ID NO: 895735 - protein, 9 aa, Homo Sapiens
DMRNLYQEW

SEQ ID NO: 895736 - protein, 9 aa, Homo Sapiens
QWGTICDNR

SEQ ID NO: 895737 - protein, 9 aa, Homo Sapiens
DEASVQLIP

SEQ ID NO: 895738 - protein, 9 aa, Homo Sapiens
RVDFRCDPN

SEQ ID NO: 895739 - protein, 9 aa, Homo Sapiens
IELSEFIQA

SEQ ID NO: 895740 - protein, 9 aa, Homo Sapiens
SIHYITRHI

SEQ ID NO: 895741 - protein, 9 aa, Homo Sapiens
VGSYSPTRK

SEQ ID NO: 895742 - protein, 9 aa, Homo Sapiens
VFMSLCKRF

SEQ ID NO: 895743 - protein, 9 aa, Homo Sapiens
FTKHQCIHT

SEQ ID NO: 895744 - protein, 9 aa, Homo Sapiens
GGKNYGGGK

SEQ ID NO: 895745 - protein, 9 aa, Homo Sapiens
LKSLDFLYF

SEQ ID NO: 895746 - protein, 9 aa, Homo Sapiens
LGVGAYHTD

SEQ ID NO: 895747 - protein, 9 aa, Homo Sapiens
WSNPLEKHN

SEQ ID NO: 895748 - protein, 9 aa, Homo Sapiens
RMSTKNAAI

SEQ ID NO: 895749 - protein, 9 aa, Homo Sapiens
YCNSLKYTF

SEQ ID NO: 895750 - protein, 9 aa, Homo Sapiens
WFLCKRRDT

SEQ ID NO: 895751 - protein, 9 aa, Homo Sapiens
QLQPKEFED

SEQ ID NO: 895752 - protein, 9 aa, Homo Sapiens
VTNILLSGV

SEQ ID NO: 895753 - protein, 9 aa, Homo Sapiens
IEQDKERNS

SEQ ID NO: 895754 - protein, 9 aa, Homo Sapiens
LTSSIDYLR

SEQ ID NO: 895755 - protein, 9 aa, Homo Sapiens
LKMYPSMPT

SEQ ID NO: 895756 - protein, 9 aa, Homo Sapiens
MDSYTSNKI

SEQ ID NO: 895757 - protein, 9 aa, Homo Sapiens
LPTNVLQPT

SEQ ID NO: 895758 - protein, 9 aa, Homo Sapiens
VNSASYRYG

SEQ ID NO: 895759 - protein, 9 aa, Homo Sapiens
TESQSSEND

SEQ ID NO: 895760 - protein, 9 aa, Homo Sapiens
KVYEIIELC

SEQ ID NO: 895761 - protein, 9 aa, Homo Sapiens
AKAYANYSY

SEQ ID NO: 895762 - protein, 9 aa, Homo Sapiens
DKNEIQNAE

SEQ ID NO: 895763 - protein, 9 aa, Homo Sapiens
LKVVFDEAI

SEQ ID NO: 895764 - protein, 9 aa, Homo Sapiens
RKNTVKCSL

SEQ ID NO: 895765 - protein, 9 aa, Homo Sapiens
YYILCIHFI

SEQ ID NO: 895766 - protein, 9 aa, Homo Sapiens
KLVDSKNFN

SEQ ID NO: 895767 - protein, 9 aa, Homo Sapiens
KEWGNGIRG

SEQ ID NO: 895768 - protein, 9 aa, Homo Sapiens
IHNYQVFNG

SEQ ID NO: 895769 - protein, 9 aa, Homo Sapiens
PCILSAFSF

SEQ ID NO: 895770 - protein, 9 aa, Homo Sapiens
DSNDREIIQ

SEQ ID NO: 895771 - protein, 9 aa, Homo Sapiens
VELDNQIAT

SEQ ID NO: 895772 - protein, 9 aa, Homo Sapiens
ANKAQDNTW

SEQ ID NO: 895773 - protein, 9 aa, Homo Sapiens
FQHSVVVPY

SEQ ID NO: 895774 - protein, 9 aa, Homo Sapiens
KAFLCSRTL

SEQ ID NO: 895775 - protein, 9 aa, Homo Sapiens
IGLYLENSF

SEQ ID NO: 895776 - protein, 9 aa, Homo Sapiens
GQLKRVPQT

SEQ ID NO: 895777 - protein, 9 aa, Homo Sapiens
SPTSCDNLV

SEQ ID NO: 895778 - protein, 9 aa, Homo Sapiens
ILYRMCTLE

SEQ ID NO: 895779 - protein, 9 aa, Homo Sapiens
MWCRGHGPQ

SEQ ID NO: 895780 - protein, 9 aa, Homo Sapiens
ADGVAASNA

SEQ ID NO: 895781 - protein, 9 aa, Homo Sapiens
LVDGNMNLS

SEQ ID NO: 895782 - protein, 9 aa, Homo Sapiens
WSVAHAAIF

SEQ ID NO: 895783 - protein, 9 aa, Homo Sapiens
PDYLKVLEK

SEQ ID NO: 895784 - protein, 9 aa, Homo Sapiens
VPDELLNII

SEQ ID NO: 895785 - protein, 9 aa, Homo Sapiens
VKRKAAVLS

SEQ ID NO: 895786 - protein, 9 aa, Homo Sapiens
HSIYCIIVV

SEQ ID NO: 895787 - protein, 9 aa, Homo Sapiens
SYRMGFTSR

SEQ ID NO: 895788 - protein, 9 aa, Homo Sapiens
RSHTRERPF

SEQ ID NO: 895789 - protein, 9 aa, Homo Sapiens
VRAVNADSG

SEQ ID NO: 895790 - protein, 9 aa, Homo Sapiens
MFIYVWPFS

SEQ ID NO: 895791 - protein, 9 aa, Homo Sapiens
VEMDATPGV

SEQ ID NO: 895792 - protein, 9 aa, Homo Sapiens
SQTATECDV

SEQ ID NO: 895793 - protein, 9 aa, Homo Sapiens
TLCFLCKLK

SEQ ID NO: 895794 - protein, 9 aa, Homo Sapiens
RRKIKQRLT

SEQ ID NO: 895795 - protein, 9 aa, Homo Sapiens
GCLGLELFC

SEQ ID NO: 895796 - protein, 9 aa, Homo Sapiens
CLEGIQCAI

SEQ ID NO: 895797 - protein, 9 aa, Homo Sapiens
ADVQKHASL

SEQ ID NO: 895798 - protein, 9 aa, Homo Sapiens
PKRPPLREL

SEQ ID NO: 895799 - protein, 9 aa, Homo Sapiens
EDEVDANLI

SEQ ID NO: 895800 - protein, 9 aa, Homo Sapiens
LPMSYPQMK

SEQ ID NO: 895801 - protein, 9 aa, Homo Sapiens
RLKSPVGNP

SEQ ID NO: 895802 - protein, 9 aa, Homo Sapiens
ITASPDSKE

SEQ ID NO: 895803 - protein, 9 aa, Homo Sapiens
PPGHYIEKK

SEQ ID NO: 895804 - protein, 9 aa, Homo Sapiens
KLFKDWEQF

SEQ ID NO: 895805 - protein, 9 aa, Homo Sapiens
PTFTQISYT

SEQ ID NO: 895806 - protein, 9 aa, Homo Sapiens
ERVCEYYLL

SEQ ID NO: 895807 - protein, 9 aa, Homo Sapiens
EEEEATAAA

SEQ ID NO: 895808 - protein, 9 aa, Homo Sapiens
KSSSHAISM

SEQ ID NO: 895809 - protein, 9 aa, Homo Sapiens
LHHKLKTVE

SEQ ID NO: 895810 - protein, 9 aa, Homo Sapiens
SYNQTFMKL

SEQ ID NO: 895811 - protein, 9 aa, Homo Sapiens
WEKYSKWLG

SEQ ID NO: 895812 - protein, 9 aa, Homo Sapiens
LGSLSALNH

SEQ ID NO: 895813 - protein, 9 aa, Homo Sapiens
QKNEAPLIL

SEQ ID NO: 895814 - protein, 9 aa, Homo Sapiens
LFCWSTNLI

SEQ ID NO: 895815 - protein, 9 aa, Homo Sapiens
LFFNLPQLL

SEQ ID NO: 895816 - protein, 9 aa, Homo Sapiens
ALLETSDKI

SEQ ID NO: 895817 - protein, 9 aa, Homo Sapiens
YFLNEILNL

SEQ ID NO: 895818 - protein, 9 aa, Homo Sapiens
SKLHLETCQ

SEQ ID NO: 895819 - protein, 9 aa, Homo Sapiens
PIKQAFCVL

SEQ ID NO: 895820 - protein, 9 aa, Homo Sapiens
YPNTCFFEG

SEQ ID NO: 895821 - protein, 9 aa, Homo Sapiens
ANAPWDPCP

SEQ ID NO: 895822 - protein, 9 aa, Homo Sapiens
EKELDVLQA

SEQ ID NO: 895823 - protein, 9 aa, Homo Sapiens
CQAPDFYVE

SEQ ID NO: 895824 - protein, 9 aa, Homo Sapiens
YIAATYTLS

SEQ ID NO: 895825 - protein, 9 aa, Homo Sapiens
LLAKVDLPK

SEQ ID NO: 895826 - protein, 9 aa, Homo Sapiens
IQQVYKTKM

SEQ ID NO: 895827 - protein, 9 aa, Homo Sapiens
AIGRDACTK

SEQ ID NO: 895828 - protein, 9 aa, Homo Sapiens
IDEDCKLNN

SEQ ID NO: 895829 - protein, 9 aa, Homo Sapiens
PNWIFHLTI

SEQ ID NO: 895830 - protein, 9 aa, Homo Sapiens
VIKGKVLCT

SEQ ID NO: 895831 - protein, 9 aa, Homo Sapiens
NFLIKPFVP

SEQ ID NO: 895832 - protein, 9 aa, Homo Sapiens
GTDFIDCLK

SEQ ID NO: 895833 - protein, 9 aa, Homo Sapiens
GWKEVNELY

SEQ ID NO: 895834 - protein, 9 aa, Homo Sapiens
DSELVLKVM

SEQ ID NO: 895835 - protein, 9 aa, Homo Sapiens
GNFSFSVNF

SEQ ID NO: 895836 - protein, 9 aa, Homo Sapiens
MDKWKAIEL

SEQ ID NO: 895837 - protein, 9 aa, Homo Sapiens
LNSSGSYWV

SEQ ID NO: 895838 - protein, 9 aa, Homo Sapiens
PSLLEVAGL

SEQ ID NO: 895839 - protein, 9 aa, Homo Sapiens
GLAGDFYFG

SEQ ID NO: 895840 - protein, 9 aa, Homo Sapiens
ITATLANTQ

SEQ ID NO: 895841 - protein, 9 aa, Homo Sapiens
GYQLTQHQV

SEQ ID NO: 895842 - protein, 9 aa, Homo Sapiens
AGAVHKFLA

SEQ ID NO: 895843 - protein, 9 aa, Homo Sapiens
RNTLMRVCV

SEQ ID NO: 895844 - protein, 9 aa, Homo Sapiens
IPKSGGSGH

SEQ ID NO: 895845 - protein, 9 aa, Homo Sapiens
LMRKIRTKK

SEQ ID NO: 895846 - protein, 9 aa, Homo Sapiens
ALKRVIGMP

SEQ ID NO: 895847 - protein, 9 aa, Homo Sapiens
LLDMRNLYQ

SEQ ID NO: 895848 - protein, 9 aa, Homo Sapiens
CLGICSFAD

SEQ ID NO: 895849 - protein, 9 aa, Homo Sapiens
QKLWLGTTK

SEQ ID NO: 895850 - protein, 9 aa, Homo Sapiens
LLKFKDGTD

SEQ ID NO: 895851 - protein, 9 aa, Homo Sapiens
HQKQHIGEQ

SEQ ID NO: 895852 - protein, 9 aa, Homo Sapiens
DFNTMPEIM

SEQ ID NO: 895853 - protein, 9 aa, Homo Sapiens
FLPQFLQYY

SEQ ID NO: 895854 - protein, 9 aa, Homo Sapiens
VSSSDSLQY

SEQ ID NO: 895855 - protein, 9 aa, Homo Sapiens
YLEEQKTDN

SEQ ID NO: 895856 - protein, 9 aa, Homo Sapiens
AFFSPSLLK

SEQ ID NO: 895857 - protein, 9 aa, Homo Sapiens
SLDLGLLNS

SEQ ID NO: 895858 - protein, 9 aa, Homo Sapiens
KVFILVLKR

SEQ ID NO: 895859 - protein, 9 aa, Homo Sapiens
CMERKRDKN

SEQ ID NO: 895860 - protein, 9 aa, Homo Sapiens
RLQSQTDNL

SEQ ID NO: 895861 - protein, 9 aa, Homo Sapiens
TLNNLMSRA

SEQ ID NO: 895862 - protein, 9 aa, Homo Sapiens
RRLVNISVY

SEQ ID NO: 895863 - protein, 9 aa, Homo Sapiens
CGFCHLCDG

SEQ ID NO: 895864 - protein, 9 aa, Homo Sapiens
AAALNLPKT

SEQ ID NO: 895865 - protein, 9 aa, Homo Sapiens
MGTERVMGL

SEQ ID NO: 895866 - protein, 9 aa, Homo Sapiens
SGFMEQLCT

SEQ ID NO: 895867 - protein, 9 aa, Homo Sapiens
GVQVLQDNF

SEQ ID NO: 895868 - protein, 9 aa, Homo Sapiens
ADKQGGPGR

SEQ ID NO: 895869 - protein, 9 aa, Homo Sapiens
ALGFYCLWI

SEQ ID NO: 895870 - protein, 9 aa, Homo Sapiens
YQKEVSHPN

SEQ ID NO: 895871 - protein, 9 aa, Homo Sapiens
IKPFVPHSQ

SEQ ID NO: 895872 - protein, 9 aa, Homo Sapiens
IPQIDVHRL

SEQ ID NO: 895873 - protein, 9 aa, Homo Sapiens
SYIIPIDDK

SEQ ID NO: 895874 - protein, 9 aa, Homo Sapiens
VRDSARPML

SEQ ID NO: 895875 - protein, 9 aa, Homo Sapiens
QRSERNKWI

SEQ ID NO: 895876 - protein, 9 aa, Homo Sapiens
NRRHHCHKC

SEQ ID NO: 895877 - protein, 9 aa, Homo Sapiens
FQCNICGKR

SEQ ID NO: 895878 - protein, 9 aa, Homo Sapiens
DIQAFENTY

SEQ ID NO: 895879 - protein, 9 aa, Homo Sapiens
SKIEPMKVF

SEQ ID NO: 895880 - protein, 9 aa, Homo Sapiens
FYQKKKSCW

SEQ ID NO: 895881 - protein, 9 aa, Homo Sapiens
ECSNGLFCK

SEQ ID NO: 895882 - protein, 9 aa, Homo Sapiens
QDMDENIRY

SEQ ID NO: 895883 - protein, 9 aa, Homo Sapiens
KSESLKSNF

SEQ ID NO: 895884 - protein, 9 aa, Homo Sapiens
AATVCKGSS

SEQ ID NO: 895885 - protein, 9 aa, Homo Sapiens
EIPFYLHVA

SEQ ID NO: 895886 - protein, 9 aa, Homo Sapiens
AKVDLPKLD

SEQ ID NO: 895887 - protein, 9 aa, Homo Sapiens
HDGNYLFLV

SEQ ID NO: 895888 - protein, 9 aa, Homo Sapiens
GPGSASSTG

SEQ ID NO: 895889 - protein, 9 aa, Homo Sapiens
ALFPQYTPP

SEQ ID NO: 895890 - protein, 9 aa, Homo Sapiens
YINKGEISD

SEQ ID NO: 895891 - protein, 9 aa, Homo Sapiens
SFINQDKIK

SEQ ID NO: 895892 - protein, 9 aa, Homo Sapiens
LFQRRRRGF

SEQ ID NO: 895893 - protein, 9 aa, Homo Sapiens
HTLQNTLQT

SEQ ID NO: 895894 - protein, 9 aa, Homo Sapiens
PRLNCNKYM

SEQ ID NO: 895895 - protein, 9 aa, Homo Sapiens
VLSHTKPSK

SEQ ID NO: 895896 - protein, 9 aa, Homo Sapiens
PFYLHVADN

SEQ ID NO: 895897 - protein, 9 aa, Homo Sapiens
FCDVWVAFN

SEQ ID NO: 895898 - protein, 9 aa, Homo Sapiens
AKHQRIHSG

SEQ ID NO: 895899 - protein, 9 aa, Homo Sapiens
CYLTDIFTT

SEQ ID NO: 895900 - protein, 9 aa, Homo Sapiens
LHPLALIVD

SEQ ID NO: 895901 - protein, 9 aa, Homo Sapiens
VCNPQQHRN

SEQ ID NO: 895902 - protein, 9 aa, Homo Sapiens
VIDVGYKRF

SEQ ID NO: 895903 - protein, 9 aa, Homo Sapiens
DIWQVNIQR

SEQ ID NO: 895904 - protein, 9 aa, Homo Sapiens
QQAIQILET

SEQ ID NO: 895905 - protein, 9 aa, Homo Sapiens
KFCGKQRPP

SEQ ID NO: 895906 - protein, 9 aa, Homo Sapiens
LVLTVYQDI

SEQ ID NO: 895907 - protein, 9 aa, Homo Sapiens
QGHVQLHIM

SEQ ID NO: 895908 - protein, 9 aa, Homo Sapiens
YYNPATDKW

SEQ ID NO: 895909 - protein, 9 aa, Homo Sapiens
KFTKALMHF

SEQ ID NO: 895910 - protein, 9 aa, Homo Sapiens
LDKFIEDYI

SEQ ID NO: 895911 - protein, 9 aa, Homo Sapiens
ALQTLQPWS

SEQ ID NO: 895912 - protein, 9 aa, Homo Sapiens
PASLLDREV

SEQ ID NO: 895913 - protein, 9 aa, Homo Sapiens
NSSKPVSYS

SEQ ID NO: 895914 - protein, 9 aa, Homo Sapiens
HLCIQNEWG

SEQ ID NO: 895915 - protein, 9 aa, Homo Sapiens
DTQLQVVRK

SEQ ID NO: 895916 - protein, 9 aa, Homo Sapiens
NCLGICSFA

SEQ ID NO: 895917 - protein, 9 aa, Homo Sapiens
ARPGTLLET

SEQ ID NO: 895918 - protein, 9 aa, Homo Sapiens
NSYFQPNGI

SEQ ID NO: 895919 - protein, 9 aa, Homo Sapiens
FETDQVILQ

SEQ ID NO: 895920 - protein, 9 aa, Homo Sapiens
RPFPLNQQD

SEQ ID NO: 895921 - protein, 9 aa, Homo Sapiens
LPIHKLGST

SEQ ID NO: 895922 - protein, 9 aa, Homo Sapiens
LLGSPDVEE

SEQ ID NO: 895923 - protein, 9 aa, Homo Sapiens
KRQLQERLE

SEQ ID NO: 895924 - protein, 9 aa, Homo Sapiens
ISIQNTRNH

SEQ ID NO: 895925 - protein, 9 aa, Homo Sapiens
DIAVKLLQK

SEQ ID NO: 895926 - protein, 9 aa, Homo Sapiens
LEEDLEWYE

SEQ ID NO: 895927 - protein, 9 aa, Homo Sapiens
STPRRSCRQ

SEQ ID NO: 895928 - protein, 9 aa, Homo Sapiens
EVRLGDTME

SEQ ID NO: 895929 - protein, 9 aa, Homo Sapiens
DIDEGNDGN

SEQ ID NO: 895930 - protein, 9 aa, Homo Sapiens
KENAMKLSI

SEQ ID NO: 895931 - protein, 9 aa, Homo Sapiens
LAEVGSVCS

SEQ ID NO: 895932 - protein, 9 aa, Homo Sapiens
QLMGIIPQI

SEQ ID NO: 895933 - protein, 9 aa, Homo Sapiens
QSSLSTSIV

SEQ ID NO: 895934 - protein, 9 aa, Homo Sapiens
ARNCYPPLL

SEQ ID NO: 895935 - protein, 9 aa, Homo Sapiens
AYVMCTVMR

SEQ ID NO: 895936 - protein, 9 aa, Homo Sapiens
VQFVRMIKR

SEQ ID NO: 895937 - protein, 9 aa, Homo Sapiens
QTCFPQYLN

SEQ ID NO: 895938 - protein, 9 aa, Homo Sapiens
EAQGVGLNS

SEQ ID NO: 895939 - protein, 9 aa, Homo Sapiens
NQTRHLPLQ

SEQ ID NO: 895940 - protein, 9 aa, Homo Sapiens
YFTGLVNIL

SEQ ID NO: 895941 - protein, 9 aa, Homo Sapiens
DLAPQSDSF

SEQ ID NO: 895942 - protein, 9 aa, Homo Sapiens
PAVGVLSHT

SEQ ID NO: 895943 - protein, 9 aa, Homo Sapiens
CSGVKKCCL

SEQ ID NO: 895944 - protein, 9 aa, Homo Sapiens
QAIHTGQKP

SEQ ID NO: 895945 - protein, 9 aa, Homo Sapiens
TKDLYEYKN

SEQ ID NO: 895946 - protein, 9 aa, Homo Sapiens
ISVWDWQKE

SEQ ID NO: 895947 - protein, 9 aa, Homo Sapiens
PEELGHLVY

SEQ ID NO: 895948 - protein, 9 aa, Homo Sapiens
YICPNIAQK

SEQ ID NO: 895949 - protein, 9 aa, Homo Sapiens
HDIRQNESH

SEQ ID NO: 895950 - protein, 9 aa, Homo Sapiens
FLKDLFTSL

SEQ ID NO: 895951 - protein, 9 aa, Homo Sapiens
TKAQIVKLF

SEQ ID NO: 895952 - protein, 9 aa, Homo Sapiens
RDDRGRVCM

SEQ ID NO: 895953 - protein, 9 aa, Homo Sapiens
SFITYDGSI

SEQ ID NO: 895954 - protein, 9 aa, Homo Sapiens
LNYGEEGVP

SEQ ID NO: 895955 - protein, 9 aa, Homo Sapiens
LYNETQEEL

SEQ ID NO: 895956 - protein, 9 aa, Homo Sapiens
DGKANPLGL

SEQ ID NO: 895957 - protein, 9 aa, Homo Sapiens
LWIRIYPDM

SEQ ID NO: 895958 - protein, 9 aa, Homo Sapiens
TVVKVDTEV

SEQ ID NO: 895959 - protein, 9 aa, Homo Sapiens
QPGEKGNCS

SEQ ID NO: 895960 - protein, 9 aa, Homo Sapiens
VSHPNALEE

SEQ ID NO: 895961 - protein, 9 aa, Homo Sapiens
IIRDWLYEH

SEQ ID NO: 895962 - protein, 9 aa, Homo Sapiens
SILSMHQKI

SEQ ID NO: 895963 - protein, 9 aa, Homo Sapiens
DMKPFKDAL

SEQ ID NO: 895964 - protein, 9 aa, Homo Sapiens
KESLCAKED

SEQ ID NO: 895965 - protein, 9 aa, Homo Sapiens
SMGLLSFPV

SEQ ID NO: 895966 - protein, 9 aa, Homo Sapiens
KDANLYLLD

SEQ ID NO: 895967 - protein, 9 aa, Homo Sapiens
MLVMGEGPE

SEQ ID NO: 895968 - protein, 9 aa, Homo Sapiens
LKINECYKP

SEQ ID NO: 895969 - protein, 9 aa, Homo Sapiens
KVEYKRGGQ

SEQ ID NO: 895970 - protein, 9 aa, Homo Sapiens
KILRQKFLS

SEQ ID NO: 895971 - protein, 9 aa, Homo Sapiens
DKQFLLFTE

SEQ ID NO: 895972 - protein, 9 aa, Homo Sapiens
TDRIQVLHN

SEQ ID NO: 895973 - protein, 9 aa, Homo Sapiens
FFSPCLPVF

SEQ ID NO: 895974 - protein, 9 aa, Homo Sapiens
GSTQFFKVA

SEQ ID NO: 895975 - protein, 9 aa, Homo Sapiens
LAGDVDTHA

SEQ ID NO: 895976 - protein, 9 aa, Homo Sapiens
LQGAKIVFL

SEQ ID NO: 895977 - protein, 9 aa, Homo Sapiens
PDVLFEIHN

SEQ ID NO: 895978 - protein, 9 aa, Homo Sapiens
PCTSCAPPA

SEQ ID NO: 895979 - protein, 9 aa, Homo Sapiens
LNQSVHTGE

SEQ ID NO: 895980 - protein, 9 aa, Homo Sapiens
TGIARMFPS

SEQ ID NO: 895981 - protein, 9 aa, Homo Sapiens
LYPVAVLFA

SEQ ID NO: 895982 - protein, 9 aa, Homo Sapiens
ADTFCPAEF

SEQ ID NO: 895983 - protein, 9 aa, Homo Sapiens
QFVLLQTLA

SEQ ID NO: 895984 - protein, 9 aa, Homo Sapiens
TIHDQKEFA

SEQ ID NO: 895985 - protein, 9 aa, Homo Sapiens
CLSPGSKEY

SEQ ID NO: 895986 - protein, 9 aa, Homo Sapiens
EGNQIEIID

SEQ ID NO: 895987 - protein, 9 aa, Homo Sapiens
LNALDRLGR

SEQ ID NO: 895988 - protein, 9 aa, Homo Sapiens
LQVYLYRRL

SEQ ID NO: 895989 - protein, 9 aa, Homo Sapiens
IEEIMQESP

SEQ ID NO: 895990 - protein, 9 aa, Homo Sapiens
FQRKGSQMS

SEQ ID NO: 895991 - protein, 9 aa, Homo Sapiens
ENDNSTIVS

SEQ ID NO: 895992 - protein, 9 aa, Homo Sapiens
NDESIPFWT

SEQ ID NO: 895993 - protein, 9 aa, Homo Sapiens
CGRGMPQPN

SEQ ID NO: 895994 - protein, 9 aa, Homo Sapiens
VLCGVTVMM

SEQ ID NO: 895995 - protein, 9 aa, Homo Sapiens
EKTKSSWFG

SEQ ID NO: 895996 - protein, 9 aa, Homo Sapiens
ARKITSFQP

SEQ ID NO: 895997 - protein, 9 aa, Homo Sapiens
TLNCPRNAD

SEQ ID NO: 895998 - protein, 9 aa, Homo Sapiens
VLAWHSQYK

SEQ ID NO: 895999 - protein, 9 aa, Homo Sapiens
CGNITVYET

SEQ ID NO: 896000 - protein, 9 aa, Homo Sapiens
GRNAENFDQ

SEQ ID NO: 896001 - protein, 9 aa, Homo Sapiens
GSVLGVCLG

SEQ ID NO: 896002 - protein, 9 aa, Homo Sapiens
KTAEHFRAL

SEQ ID NO: 896003 - protein, 9 aa, Homo Sapiens
INSLNKLVL

SEQ ID NO: 896004 - protein, 9 aa, Homo Sapiens
LRGHSAKII

SEQ ID NO: 896005 - protein, 9 aa, Homo Sapiens
FFLDEANGL

SEQ ID NO: 896006 - protein, 9 aa, Homo Sapiens
LQVEEEDIE

SEQ ID NO: 896007 - protein, 9 aa, Homo Sapiens
LSSYLRCCL

SEQ ID NO: 896008 - protein, 9 aa, Homo Sapiens
ISSLTYPLL

SEQ ID NO: 896009 - protein, 9 aa, Homo Sapiens
EDIHIPQID

SEQ ID NO: 896010 - protein, 9 aa, Homo Sapiens
GMNALNEKK

SEQ ID NO: 896011 - protein, 9 aa, Homo Sapiens
EFRDKLYPI

SEQ ID NO: 896012 - protein, 9 aa, Homo Sapiens
AGNKALSPT

SEQ ID NO: 896013 - protein, 9 aa, Homo Sapiens
YKLTYAETK

SEQ ID NO: 896014 - protein, 9 aa, Homo Sapiens
FARPDSMFK

SEQ ID NO: 896015 - protein, 9 aa, Homo Sapiens
LAEELCRLS

SEQ ID NO: 896016 - protein, 9 aa, Homo Sapiens
CCAWQRCCP

SEQ ID NO: 896017 - protein, 9 aa, Homo Sapiens
MMVLKVDEL

SEQ ID NO: 896018 - protein, 9 aa, Homo Sapiens
RHVDKGTTE

SEQ ID NO: 896019 - protein, 9 aa, Homo Sapiens
GMSRGKVII

SEQ ID NO: 896020 - protein, 9 aa, Homo Sapiens
KADTISKSK

SEQ ID NO: 896021 - protein, 9 aa, Homo Sapiens
LEELTQMLI

SEQ ID NO: 896022 - protein, 9 aa, Homo Sapiens
DNEKRMKLL

SEQ ID NO: 896023 - protein, 9 aa, Homo Sapiens
KQEVWEAFD

SEQ ID NO: 896024 - protein, 9 aa, Homo Sapiens
QKGLKVVFD

SEQ ID NO: 896025 - protein, 9 aa, Homo Sapiens
DNMGHKENE

SEQ ID NO: 896026 - protein, 9 aa, Homo Sapiens
DDLIAYVSN

SEQ ID NO: 896027 - protein, 9 aa, Homo Sapiens
SMKGAGTNK

SEQ ID NO: 896028 - protein, 9 aa, Homo Sapiens
RDYIVLDLG

SEQ ID NO: 896029 - protein, 9 aa, Homo Sapiens
VKPHSFMFS

SEQ ID NO: 896030 - protein, 9 aa, Homo Sapiens
NQSVHTGEK

SEQ ID NO: 896031 - protein, 9 aa, Homo Sapiens
LLHFGQMPA

SEQ ID NO: 896032 - protein, 9 aa, Homo Sapiens
NKSICKVFV

SEQ ID NO: 896033 - protein, 9 aa, Homo Sapiens
RSPKSCSKP

SEQ ID NO: 896034 - protein, 9 aa, Homo Sapiens
AQVPSDVMS

SEQ ID NO: 896035 - protein, 9 aa, Homo Sapiens
QRVRKPNNL

SEQ ID NO: 896036 - protein, 9 aa, Homo Sapiens
NCGHNFCRA

SEQ ID NO: 896037 - protein, 9 aa, Homo Sapiens
EDKVLRNNE

SEQ ID NO: 896038 - protein, 9 aa, Homo Sapiens
TQHQITHTG

SEQ ID NO: 896039 - protein, 9 aa, Homo Sapiens
PEAAEQIWR

SEQ ID NO: 896040 - protein, 9 aa, Homo Sapiens
KGTTTWEKT

SEQ ID NO: 896041 - protein, 9 aa, Homo Sapiens
YNNTVIFAC

SEQ ID NO: 896042 - protein, 9 aa, Homo Sapiens
EGSCHACRS

SEQ ID NO: 896043 - protein, 9 aa, Homo Sapiens
TKLFPPLFL

SEQ ID NO: 896044 - protein, 9 aa, Homo Sapiens
DQFSEEGDK

SEQ ID NO: 896045 - protein, 9 aa, Homo Sapiens
QEGGEENKS

SEQ ID NO: 896046 - protein, 9 aa, Homo Sapiens
QPEASGLWG

SEQ ID NO: 896047 - protein, 9 aa, Homo Sapiens
ILCIHFICI

SEQ ID NO: 896048 - protein, 9 aa, Homo Sapiens
SDDPNDSGK

SEQ ID NO: 896049 - protein, 9 aa, Homo Sapiens
KKCSELYEA

SEQ ID NO: 896050 - protein, 9 aa, Homo Sapiens
EAVGSSSPI

SEQ ID NO: 896051 - protein, 9 aa, Homo Sapiens
RSALKTLSF

SEQ ID NO: 896052 - protein, 9 aa, Homo Sapiens
RLNLNGAPL

SEQ ID NO: 896053 - protein, 9 aa, Homo Sapiens
RKKTPNLSK

SEQ ID NO: 896054 - protein, 9 aa, Homo Sapiens
RGPPGPMEY

SEQ ID NO: 896055 - protein, 9 aa, Homo Sapiens
AKLYESIMK

SEQ ID NO: 896056 - protein, 9 aa, Homo Sapiens
RIFMILWLK

SEQ ID NO: 896057 - protein, 9 aa, Homo Sapiens
CFEYFGPDF

SEQ ID NO: 896058 - protein, 9 aa, Homo Sapiens
FILRINCAE

SEQ ID NO: 896059 - protein, 9 aa, Homo Sapiens
DSNKGASQR

SEQ ID NO: 896060 - protein, 9 aa, Homo Sapiens
VGELKDDNF

SEQ ID NO: 896061 - protein, 9 aa, Homo Sapiens
ENDIANLFS

SEQ ID NO: 896062 - protein, 9 aa, Homo Sapiens
LDTSERMEP

SEQ ID NO: 896063 - protein, 9 aa, Homo Sapiens
HVSKVLRIE

SEQ ID NO: 896064 - protein, 9 aa, Homo Sapiens
QDGVIQIKA

SEQ ID NO: 896065 - protein, 9 aa, Homo Sapiens
HCVPPLSPL

SEQ ID NO: 896066 - protein, 9 aa, Homo Sapiens
KLHLETCQY

SEQ ID NO: 896067 - protein, 9 aa, Homo Sapiens
LKPELFQIG

SEQ ID NO: 896068 - protein, 9 aa, Homo Sapiens
MSVNPSKEI

SEQ ID NO: 896069 - protein, 9 aa, Homo Sapiens
LKPTLENVY

SEQ ID NO: 896070 - protein, 9 aa, Homo Sapiens
SDSRPTKQE

SEQ ID NO: 896071 - protein, 9 aa, Homo Sapiens
PGFLRRDTE

SEQ ID NO: 896072 - protein, 9 aa, Homo Sapiens
SEPLPGSLH

SEQ ID NO: 896073 - protein, 9 aa, Homo Sapiens
CIEGTLANK

SEQ ID NO: 896074 - protein, 9 aa, Homo Sapiens
HRIHKITHT

SEQ ID NO: 896075 - protein, 9 aa, Homo Sapiens
CGKGFSQSL

SEQ ID NO: 896076 - protein, 9 aa, Homo Sapiens
TKENSRDDS

SEQ ID NO: 896077 - protein, 9 aa, Homo Sapiens
LQQAQVTLI

SEQ ID NO: 896078 - protein, 9 aa, Homo Sapiens
GMKMETSPL

SEQ ID NO: 896079 - protein, 9 aa, Homo Sapiens
KQIKNFQTI

SEQ ID NO: 896080 - protein, 9 aa, Homo Sapiens
KWTTNGLPV

SEQ ID NO: 896081 - protein, 9 aa, Homo Sapiens
LLDRQCQLN

SEQ ID NO: 896082 - protein, 9 aa, Homo Sapiens
AAQILLDQG

SEQ ID NO: 896083 - protein, 9 aa, Homo Sapiens
HRRRRQEEK

SEQ ID NO: 896084 - protein, 9 aa, Homo Sapiens
HTPLTVLMA

SEQ ID NO: 896085 - protein, 9 aa, Homo Sapiens
ADKKILKQA

SEQ ID NO: 896086 - protein, 9 aa, Homo Sapiens
LLPGGKGKC

SEQ ID NO: 896087 - protein, 9 aa, Homo Sapiens
GEKTTVATE

SEQ ID NO: 896088 - protein, 9 aa, Homo Sapiens
WLLQTDFVL

SEQ ID NO: 896089 - protein, 9 aa, Homo Sapiens
CLTLVALSW

SEQ ID NO: 896090 - protein, 9 aa, Homo Sapiens
PSTSTLANL

SEQ ID NO: 896091 - protein, 9 aa, Homo Sapiens
GGNVVMLVP

SEQ ID NO: 896092 - protein, 9 aa, Homo Sapiens
IRWRIRQDE

SEQ ID NO: 896093 - protein, 9 aa, Homo Sapiens
KVNKHVFSG

SEQ ID NO: 896094 - protein, 9 aa, Homo Sapiens
IKNILEWAK

SEQ ID NO: 896095 - protein, 9 aa, Homo Sapiens
YACNDIQIN

SEQ ID NO: 896096 - protein, 9 aa, Homo Sapiens
GNHRKPSFL

SEQ ID NO: 896097 - protein, 9 aa, Homo Sapiens
SIDKFWDRS

SEQ ID NO: 896098 - protein, 9 aa, Homo Sapiens
RFLCPPGFL

SEQ ID NO: 896099 - protein, 9 aa, Homo Sapiens
EKMRHELNK

SEQ ID NO: 896100 - protein, 9 aa, Homo Sapiens
VVNYFIEKE

SEQ ID NO: 896101 - protein, 9 aa, Homo Sapiens
RATLQELLQ

SEQ ID NO: 896102 - protein, 9 aa, Homo Sapiens
DQDKCLMGA

SEQ ID NO: 896103 - protein, 9 aa, Homo Sapiens
NTAEEQART

SEQ ID NO: 896104 - protein, 9 aa, Homo Sapiens
GWLWKKKDV

SEQ ID NO: 896105 - protein, 9 aa, Homo Sapiens
VPQKRKLVP

SEQ ID NO: 896106 - protein, 9 aa, Homo Sapiens
LTEHQIIHT

SEQ ID NO: 896107 - protein, 9 aa, Homo Sapiens
GYCSYKTSK

SEQ ID NO: 896108 - protein, 9 aa, Homo Sapiens
QRCQMVQTN

SEQ ID NO: 896109 - protein, 9 aa, Homo Sapiens
DKSILGNKK

SEQ ID NO: 896110 - protein, 9 aa, Homo Sapiens
SYYLDHMEK

SEQ ID NO: 896111 - protein, 9 aa, Homo Sapiens
TLQELLQFH

SEQ ID NO: 896112 - protein, 9 aa, Homo Sapiens
AIALLNGIC

SEQ ID NO: 896113 - protein, 9 aa, Homo Sapiens
IRQHPLFWE

SEQ ID NO: 896114 - protein, 9 aa, Homo Sapiens
SSVKRTHYY

SEQ ID NO: 896115 - protein, 9 aa, Homo Sapiens
HASCALLCP

SEQ ID NO: 896116 - protein, 9 aa, Homo Sapiens
LFSLQIRLI

SEQ ID NO: 896117 - protein, 9 aa, Homo Sapiens
EANSNKESD

SEQ ID NO: 896118 - protein, 9 aa, Homo Sapiens
VTMLGANGF

SEQ ID NO: 896119 - protein, 9 aa, Homo Sapiens
MKIAGGNTD

SEQ ID NO: 896120 - protein, 9 aa, Homo Sapiens
CCLLCEAYL

SEQ ID NO: 896121 - protein, 9 aa, Homo Sapiens
GKGQTGVMI

SEQ ID NO: 896122 - protein, 9 aa, Homo Sapiens
VKLLQKAAP

SEQ ID NO: 896123 - protein, 9 aa, Homo Sapiens
YLPSVSNAV

SEQ ID NO: 896124 - protein, 9 aa, Homo Sapiens
DTGRIGQNN

SEQ ID NO: 896125 - protein, 9 aa, Homo Sapiens
TWILFQYPL

SEQ ID NO: 896126 - protein, 9 aa, Homo Sapiens
DKILRQKFL

SEQ ID NO: 896127 - protein, 9 aa, Homo Sapiens
QFHYFIIIN

SEQ ID NO: 896128 - protein, 9 aa, Homo Sapiens
NKVVKMIFA

SEQ ID NO: 896129 - protein, 9 aa, Homo Sapiens
EYVTLSQRF

SEQ ID NO: 896130 - protein, 9 aa, Homo Sapiens
NKIKELSWN

SEQ ID NO: 896131 - protein, 9 aa, Homo Sapiens
YMSERSKVI

SEQ ID NO: 896132 - protein, 9 aa, Homo Sapiens
FNRLCSQTV

SEQ ID NO: 896133 - protein, 9 aa, Homo Sapiens
GPETPGKKK

SEQ ID NO: 896134 - protein, 9 aa, Homo Sapiens
SCEDQDKCL

SEQ ID NO: 896135 - protein, 9 aa, Homo Sapiens
NELNAKVCL

SEQ ID NO: 896136 - protein, 9 aa, Homo Sapiens
IQQAKLYES

SEQ ID NO: 896137 - protein, 9 aa, Homo Sapiens
PDKNHTTIQ

SEQ ID NO: 896138 - protein, 9 aa, Homo Sapiens
LQPKEFEDV

SEQ ID NO: 896139 - protein, 9 aa, Homo Sapiens
LKEVFNNLF

SEQ ID NO: 896140 - protein, 9 aa, Homo Sapiens
QNATKLYCF

SEQ ID NO: 896141 - protein, 9 aa, Homo Sapiens
LSFDLVALN

SEQ ID NO: 896142 - protein, 9 aa, Homo Sapiens
FPESYYGER

SEQ ID NO: 896143 - protein, 9 aa, Homo Sapiens
MLSSVSKTL

SEQ ID NO: 896144 - protein, 9 aa, Homo Sapiens
DAQRQDCPF

SEQ ID NO: 896145 - protein, 9 aa, Homo Sapiens
LPPLLSTTN

SEQ ID NO: 896146 - protein, 9 aa, Homo Sapiens
PSLCMFFEP

SEQ ID NO: 896147 - protein, 9 aa, Homo Sapiens
TTKFLAMDK

SEQ ID NO: 896148 - protein, 9 aa, Homo Sapiens
WLYNSLKSR

SEQ ID NO: 896149 - protein, 9 aa, Homo Sapiens
NEPYPVEYE

SEQ ID NO: 896150 - protein, 9 aa, Homo Sapiens
ELKPDNQTS

SEQ ID NO: 896151 - protein, 9 aa, Homo Sapiens
LNKLVLRKL

SEQ ID NO: 896152 - protein, 9 aa, Homo Sapiens
KSMAPRQLQ

SEQ ID NO: 896153 - protein, 9 aa, Homo Sapiens
PERRGPQKQ

SEQ ID NO: 896154 - protein, 9 aa, Homo Sapiens
TRMIRKQNS

SEQ ID NO: 896155 - protein, 9 aa, Homo Sapiens
NLNIKQNNS

SEQ ID NO: 896156 - protein, 9 aa, Homo Sapiens
GCKAMQRNW

SEQ ID NO: 896157 - protein, 9 aa, Homo Sapiens
TSVQALQRK

SEQ ID NO: 896158 - protein, 9 aa, Homo Sapiens
ICLSDPGLE

SEQ ID NO: 896159 - protein, 9 aa, Homo Sapiens
IGQKNINRT

SEQ ID NO: 896160 - protein, 9 aa, Homo Sapiens
STSLNYKSF

SEQ ID NO: 896161 - protein, 9 aa, Homo Sapiens
THDYGRITL

SEQ ID NO: 896162 - protein, 9 aa, Homo Sapiens
ESEICYSTW

SEQ ID NO: 896163 - protein, 9 aa, Homo Sapiens
HKQVFLQPP

SEQ ID NO: 896164 - protein, 9 aa, Homo Sapiens
WNLSSPGWE

SEQ ID NO: 896165 - protein, 9 aa, Homo Sapiens
TEDQKQEVW

SEQ ID NO: 896166 - protein, 9 aa, Homo Sapiens
EVLWNLSSP

SEQ ID NO: 896167 - protein, 9 aa, Homo Sapiens
GALMGTYVT

SEQ ID NO: 896168 - protein, 9 aa, Homo Sapiens
SAEVQVCLQ

SEQ ID NO: 896169 - protein, 9 aa, Homo Sapiens
TIPTDKTVM

SEQ ID NO: 896170 - protein, 9 aa, Homo Sapiens
PVAVLFAMV

SEQ ID NO: 896171 - protein, 9 aa, Homo Sapiens
KGFRDNFES

SEQ ID NO: 896172 - protein, 9 aa, Homo Sapiens
GCFDECNRI

SEQ ID NO: 896173 - protein, 9 aa, Homo Sapiens
FKIQTWIAN

SEQ ID NO: 896174 - protein, 9 aa, Homo Sapiens
LKLWDLSSS

SEQ ID NO: 896175 - protein, 9 aa, Homo Sapiens
MPEEGEGQS

SEQ ID NO: 896176 - protein, 9 aa, Homo Sapiens
KQEGGAKKA

SEQ ID NO: 896177 - protein, 9 aa, Homo Sapiens
ECGSPKECT

SEQ ID NO: 896178 - protein, 9 aa, Homo Sapiens
NTFQELFGL

SEQ ID NO: 896179 - protein, 9 aa, Homo Sapiens
ILNGKDKYK

SEQ ID NO: 896180 - protein, 9 aa, Homo Sapiens
ICSCICTVL

SEQ ID NO: 896181 - protein, 9 aa, Homo Sapiens
NFDRQKSCI

SEQ ID NO: 896182 - protein, 9 aa, Homo Sapiens
GYDQKKYKD

SEQ ID NO: 896183 - protein, 9 aa, Homo Sapiens
IKLTQLKLS

SEQ ID NO: 896184 - protein, 9 aa, Homo Sapiens
YNPTAAGTE

SEQ ID NO: 896185 - protein, 9 aa, Homo Sapiens
LNTHQIIHT

SEQ ID NO: 896186 - protein, 9 aa, Homo Sapiens
KTCEGEGCI

SEQ ID NO: 896187 - protein, 9 aa, Homo Sapiens
TDFIDCLKI

SEQ ID NO: 896188 - protein, 9 aa, Homo Sapiens
SQISTSLPQ

SEQ ID NO: 896189 - protein, 9 aa, Homo Sapiens
SGSIISFNS

SEQ ID NO: 896190 - protein, 9 aa, Homo Sapiens
SDPVIIDRL

SEQ ID NO: 896191 - protein, 9 aa, Homo Sapiens
DPSLCMFFE

SEQ ID NO: 896192 - protein, 9 aa, Homo Sapiens
QFPLEEDMS

SEQ ID NO: 896193 - protein, 9 aa, Homo Sapiens
GKAFNLLSN

SEQ ID NO: 896194 - protein, 9 aa, Homo Sapiens
NGHEFNFIH

SEQ ID NO: 896195 - protein, 9 aa, Homo Sapiens
GNTDNNTQN

SEQ ID NO: 896196 - protein, 9 aa, Homo Sapiens
IIVLDDDDK

SEQ ID NO: 896197 - protein, 9 aa, Homo Sapiens
SLYHQLHII

SEQ ID NO: 896198 - protein, 9 aa, Homo Sapiens
RCMWYCLRL

SEQ ID NO: 896199 - protein, 9 aa, Homo Sapiens
ALLGHAVQD

SEQ ID NO: 896200 - protein, 9 aa, Homo Sapiens
NKDGRIELS

SEQ ID NO: 896201 - protein, 9 aa, Homo Sapiens
PLHTKLNRA

SEQ ID NO: 896202 - protein, 9 aa, Homo Sapiens
VNADSGYNA

SEQ ID NO: 896203 - protein, 9 aa, Homo Sapiens
VSKVKVQNL

SEQ ID NO: 896204 - protein, 9 aa, Homo Sapiens
LGPVLRFPL

SEQ ID NO: 896205 - protein, 9 aa, Homo Sapiens
TLKTIKNKQ

SEQ ID NO: 896206 - protein, 9 aa, Homo Sapiens
SPCLPVFNV

SEQ ID NO: 896207 - protein, 9 aa, Homo Sapiens
NNSMDNYLS

SEQ ID NO: 896208 - protein, 9 aa, Homo Sapiens
NKLLKQHEY

SEQ ID NO: 896209 - protein, 9 aa, Homo Sapiens
QHNNILYRQ

SEQ ID NO: 896210 - protein, 9 aa, Homo Sapiens
KAHSGEKPH

SEQ ID NO: 896211 - protein, 9 aa, Homo Sapiens
TLRNQIQQV

SEQ ID NO: 896212 - protein, 9 aa, Homo Sapiens
QLGRTRAET

SEQ ID NO: 896213 - protein, 9 aa, Homo Sapiens
VFFDLMRKI

SEQ ID NO: 896214 - protein, 9 aa, Homo Sapiens
SIIELFIYL

SEQ ID NO: 896215 - protein, 9 aa, Homo Sapiens
KGNKVQIKV

SEQ ID NO: 896216 - protein, 9 aa, Homo Sapiens
IVVGAIKQN

SEQ ID NO: 896217 - protein, 9 aa, Homo Sapiens
KSRTEGEHS

SEQ ID NO: 896218 - protein, 9 aa, Homo Sapiens
MLYLVFFAP

SEQ ID NO: 896219 - protein, 9 aa, Homo Sapiens
HHQSLKALM

SEQ ID NO: 896220 - protein, 9 aa, Homo Sapiens
FRLGVVKFP

SEQ ID NO: 896221 - protein, 9 aa, Homo Sapiens
LQLIKQYWK

SEQ ID NO: 896222 - protein, 9 aa, Homo Sapiens
QIFQNLDED

SEQ ID NO: 896223 - protein, 9 aa, Homo Sapiens
REKGRPGKD

SEQ ID NO: 896224 - protein, 9 aa, Homo Sapiens
AFVSVIPES

SEQ ID NO: 896225 - protein, 9 aa, Homo Sapiens
HFQSYYLDH

SEQ ID NO: 896226 - protein, 9 aa, Homo Sapiens
MQFLLFVLL

SEQ ID NO: 896227 - protein, 9 aa, Homo Sapiens
LSYFYGAFL

SEQ ID NO: 896228 - protein, 9 aa, Homo Sapiens
LAEGLQTVL

SEQ ID NO: 896229 - protein, 9 aa, Homo Sapiens
NVTTDMLKM

SEQ ID NO: 896230 - protein, 9 aa, Homo Sapiens
NKLCQAPDF

SEQ ID NO: 896231 - protein, 9 aa, Homo Sapiens
RPEFYFNIH

SEQ ID NO: 896232 - protein, 9 aa, Homo Sapiens
SNSHSRREH

SEQ ID NO: 896233 - protein, 9 aa, Homo Sapiens
VLRHNYQTC

SEQ ID NO: 896234 - protein, 9 aa, Homo Sapiens
INKNVSESL

SEQ ID NO: 896235 - protein, 9 aa, Homo Sapiens
EGGAKKAAE

SEQ ID NO: 896236 - protein, 9 aa, Homo Sapiens
THRQGLQTP

SEQ ID NO: 896237 - protein, 9 aa, Homo Sapiens
LVRSGPFGQ

SEQ ID NO: 896238 - protein, 9 aa, Homo Sapiens
KEHKREEEE

SEQ ID NO: 896239 - protein, 9 aa, Homo Sapiens
PYQPKIDTV

SEQ ID NO: 896240 - protein, 9 aa, Homo Sapiens
PGHQNNVAK

SEQ ID NO: 896241 - protein, 9 aa, Homo Sapiens
HGCQHECVS

SEQ ID NO: 896242 - protein, 9 aa, Homo Sapiens
PPKSSNNTD

SEQ ID NO: 896243 - protein, 9 aa, Homo Sapiens
KKIKRGIKI

SEQ ID NO: 896244 - protein, 9 aa, Homo Sapiens
ALGGRLYIS

SEQ ID NO: 896245 - protein, 9 aa, Homo Sapiens
HLYEDTLID

SEQ ID NO: 896246 - protein, 9 aa, Homo Sapiens
SRSQSRSQR

SEQ ID NO: 896247 - protein, 9 aa, Homo Sapiens
AHHQQIHTG

SEQ ID NO: 896248 - protein, 9 aa, Homo Sapiens
VLTFNLMED

SEQ ID NO: 896249 - protein, 9 aa, Homo Sapiens
VDGNMNLSI

SEQ ID NO: 896250 - protein, 9 aa, Homo Sapiens
SCFCNPEFE

SEQ ID NO: 896251 - protein, 9 aa, Homo Sapiens
NTHQIIHTG

SEQ ID NO: 896252 - protein, 9 aa, Homo Sapiens
SEVFQVTST

SEQ ID NO: 896253 - protein, 9 aa, Homo Sapiens
MSRAQELVA

SEQ ID NO: 896254 - protein, 9 aa, Homo Sapiens
PAICKHYGE

SEQ ID NO: 896255 - protein, 9 aa, Homo Sapiens
DLDSRFWPR

SEQ ID NO: 896256 - protein, 9 aa, Homo Sapiens
TPILRLLCT

SEQ ID NO: 896257 - protein, 9 aa, Homo Sapiens
QEKVVTQQI

SEQ ID NO: 896258 - protein, 9 aa, Homo Sapiens
FRGQKRKQS

SEQ ID NO: 896259 - protein, 9 aa, Homo Sapiens
NGRMLLHFG

SEQ ID NO: 896260 - protein, 9 aa, Homo Sapiens
LATVTPRTV

SEQ ID NO: 896261 - protein, 9 aa, Homo Sapiens
LYLRFGVQV

SEQ ID NO: 896262 - protein, 9 aa, Homo Sapiens
NKYRVLGIN

SEQ ID NO: 896263 - protein, 9 aa, Homo Sapiens
VTIIHVAIT

SEQ ID NO: 896264 - protein, 9 aa, Homo Sapiens
NYFSLAPFN

SEQ ID NO: 896265 - protein, 9 aa, Homo Sapiens
LLGVVQIYH

SEQ ID NO: 896266 - protein, 9 aa, Homo Sapiens
FLYFTDLKD

SEQ ID NO: 896267 - protein, 9 aa, Homo Sapiens
QSLILVPNM

SEQ ID NO: 896268 - protein, 9 aa, Homo Sapiens
DSFRRQQKE

SEQ ID NO: 896269 - protein, 9 aa, Homo Sapiens
PPASAYPGG

SEQ ID NO: 896270 - protein, 9 aa, Homo Sapiens
CQHECVSTD

SEQ ID NO: 896271 - protein, 9 aa, Homo Sapiens
DNAPTFTQI

SEQ ID NO: 896272 - protein, 9 aa, Homo Sapiens
KALMLPSPR

SEQ ID NO: 896273 - protein, 9 aa, Homo Sapiens
MHRQTEDKK

SEQ ID NO: 896274 - protein, 9 aa, Homo Sapiens
SACQSLDLC

SEQ ID NO: 896275 - protein, 9 aa, Homo Sapiens
FKDWRKDMT

SEQ ID NO: 896276 - protein, 9 aa, Homo Sapiens
VFIVVERDA

SEQ ID NO: 896277 - protein, 9 aa, Homo Sapiens
TACCTQLYQ

SEQ ID NO: 896278 - protein, 9 aa, Homo Sapiens
IEPNNSPED

SEQ ID NO: 896279 - protein, 9 aa, Homo Sapiens
AVKKQDNYI

SEQ ID NO: 896280 - protein, 9 aa, Homo Sapiens
DCKRRETEA

SEQ ID NO: 896281 - protein, 9 aa, Homo Sapiens
YSNAESLEL

SEQ ID NO: 896282 - protein, 9 aa, Homo Sapiens
NAAGEDQKP

SEQ ID NO: 896283 - protein, 9 aa, Homo Sapiens
GMNLTVCGG

SEQ ID NO: 896284 - protein, 9 aa, Homo Sapiens
MEPFKINVP

SEQ ID NO: 896285 - protein, 9 aa, Homo Sapiens
ASNKAEEEM

SEQ ID NO: 896286 - protein, 9 aa, Homo Sapiens
SPEVVQILY

SEQ ID NO: 896287 - protein, 9 aa, Homo Sapiens
DASGLSCHR

SEQ ID NO: 896288 - protein, 9 aa, Homo Sapiens
TSQLQQLQM

SEQ ID NO: 896289 - protein, 9 aa, Homo Sapiens
KYLDQRLKA

SEQ ID NO: 896290 - protein, 9 aa, Homo Sapiens
KTFIGLESL

SEQ ID NO: 896291 - protein, 9 aa, Homo Sapiens
DDHFLFNKP

SEQ ID NO: 896292 - protein, 9 aa, Homo Sapiens
FCKTGVHDA

SEQ ID NO: 896293 - protein, 9 aa, Homo Sapiens
LTISSDTFV

SEQ ID NO: 896294 - protein, 9 aa, Homo Sapiens
GIPETCEQA

SEQ ID NO: 896295 - protein, 9 aa, Homo Sapiens
EPPSELIIK

SEQ ID NO: 896296 - protein, 9 aa, Homo Sapiens
GAFQSVWVL

SEQ ID NO: 896297 - protein, 9 aa, Homo Sapiens
KRNNLLIAD

SEQ ID NO: 896298 - protein, 9 aa, Homo Sapiens
KYPQPLNII

SEQ ID NO: 896299 - protein, 9 aa, Homo Sapiens
VFLQLALSP

SEQ ID NO: 896300 - protein, 9 aa, Homo Sapiens
CKLPKIDVH

SEQ ID NO: 896301 - protein, 9 aa, Homo Sapiens
ESRRVEPQT

SEQ ID NO: 896302 - protein, 9 aa, Homo Sapiens
GPSGRVQAL

SEQ ID NO: 896303 - protein, 9 aa, Homo Sapiens
AAHAPLNPA

SEQ ID NO: 896304 - protein, 9 aa, Homo Sapiens
LRYILKQDH

SEQ ID NO: 896305 - protein, 9 aa, Homo Sapiens
KQPRLTHNG

SEQ ID NO: 896306 - protein, 9 aa, Homo Sapiens
AIYKQYCLQ

SEQ ID NO: 896307 - protein, 9 aa, Homo Sapiens
HLVIGIKQG

SEQ ID NO: 896308 - protein, 9 aa, Homo Sapiens
PDCGYPPPV

SEQ ID NO: 896309 - protein, 9 aa, Homo Sapiens
CTCLEGFKG

SEQ ID NO: 896310 - protein, 9 aa, Homo Sapiens
VDKRRRNQC

SEQ ID NO: 896311 - protein, 9 aa, Homo Sapiens
ELFTAYGPD

SEQ ID NO: 896312 - protein, 9 aa, Homo Sapiens
MAVQLDNVF

SEQ ID NO: 896313 - protein, 9 aa, Homo Sapiens
YFSGFSSPP

SEQ ID NO: 896314 - protein, 9 aa, Homo Sapiens
LGCTLQEFM

SEQ ID NO: 896315 - protein, 9 aa, Homo Sapiens
AIHIQNHTG

SEQ ID NO: 896316 - protein, 9 aa, Homo Sapiens
SLSMWSVAH

SEQ ID NO: 896317 - protein, 9 aa, Homo Sapiens
ARLNLNGAP

SEQ ID NO: 896318 - protein, 9 aa, Homo Sapiens
RGDFLAYLE

SEQ ID NO: 896319 - protein, 9 aa, Homo Sapiens
FAITLFEQC

SEQ ID NO: 896320 - protein, 9 aa, Homo Sapiens
SDSLYAVNS

SEQ ID NO: 896321 - protein, 9 aa, Homo Sapiens
STRIPKIQT

SEQ ID NO: 896322 - protein, 9 aa, Homo Sapiens
TWLSTNLDI

SEQ ID NO: 896323 - protein, 9 aa, Homo Sapiens
KRRWAQGEQ

SEQ ID NO: 896324 - protein, 9 aa, Homo Sapiens
CRNHDYLSY

SEQ ID NO: 896325 - protein, 9 aa, Homo Sapiens
GWRHRLLVG

SEQ ID NO: 896326 - protein, 9 aa, Homo Sapiens
KTPPFEINK

SEQ ID NO: 896327 - protein, 9 aa, Homo Sapiens
EKAINELFR

SEQ ID NO: 896328 - protein, 9 aa, Homo Sapiens
YSLNGHEFN

SEQ ID NO: 896329 - protein, 9 aa, Homo Sapiens
NVYITIDHN

SEQ ID NO: 896330 - protein, 9 aa, Homo Sapiens
KDKYKVYEE

SEQ ID NO: 896331 - protein, 9 aa, Homo Sapiens
SYLWTCPAV

SEQ ID NO: 896332 - protein, 9 aa, Homo Sapiens
NFNGEEKAW

SEQ ID NO: 896333 - protein, 9 aa, Homo Sapiens
EEIEEIMQE

SEQ ID NO: 896334 - protein, 9 aa, Homo Sapiens
DGHLFCSSG

SEQ ID NO: 896335 - protein, 9 aa, Homo Sapiens
PHRNAYQTE

SEQ ID NO: 896336 - protein, 9 aa, Homo Sapiens
EYGQGSQEG

SEQ ID NO: 896337 - protein, 9 aa, Homo Sapiens
FITYDGSIT

SEQ ID NO: 896338 - protein, 9 aa, Homo Sapiens
GMIEFCDAL

SEQ ID NO: 896339 - protein, 9 aa, Homo Sapiens
VVGIYLKNQ

SEQ ID NO: 896340 - protein, 9 aa, Homo Sapiens
GRSYKQTFS

SEQ ID NO: 896341 - protein, 9 aa, Homo Sapiens
DVGTMQWLI

SEQ ID NO: 896342 - protein, 9 aa, Homo Sapiens
SHSQIKHQN

SEQ ID NO: 896343 - protein, 9 aa, Homo Sapiens
VSTLPFCGS

SEQ ID NO: 896344 - protein, 9 aa, Homo Sapiens
LSLEDDKRL

SEQ ID NO: 896345 - protein, 9 aa, Homo Sapiens
RYEGILTNG

SEQ ID NO: 896346 - protein, 9 aa, Homo Sapiens
NGQVDIKTD

SEQ ID NO: 896347 - protein, 9 aa, Homo Sapiens
ITQFSYLEK

SEQ ID NO: 896348 - protein, 9 aa, Homo Sapiens
VDGPREPQR

SEQ ID NO: 896349 - protein, 9 aa, Homo Sapiens
LDVGISLPK

SEQ ID NO: 896350 - protein, 9 aa, Homo Sapiens
PYPKNGSIQ

SEQ ID NO: 896351 - protein, 9 aa, Homo Sapiens
QDGICSSSW

SEQ ID NO: 896352 - protein, 9 aa, Homo Sapiens
AGSPKTCNR

SEQ ID NO: 896353 - protein, 9 aa, Homo Sapiens
GFRDNFESM

SEQ ID NO: 896354 - protein, 9 aa, Homo Sapiens
KKHQNHYRV

SEQ ID NO: 896355 - protein, 9 aa, Homo Sapiens
VSLNTRHMV

SEQ ID NO: 896356 - protein, 9 aa, Homo Sapiens
LPQLQHLKL

SEQ ID NO: 896357 - protein, 9 aa, Homo Sapiens
HSAGDRWVD

SEQ ID NO: 896358 - protein, 9 aa, Homo Sapiens
IVGRPRPNF

SEQ ID NO: 896359 - protein, 9 aa, Homo Sapiens
IQNAEAVHL

SEQ ID NO: 896360 - protein, 9 aa, Homo Sapiens
KSKSDDKNK

SEQ ID NO: 896361 - protein, 9 aa, Homo Sapiens
AGCNYLLEQ

SEQ ID NO: 896362 - protein, 9 aa, Homo Sapiens
KKAAEDSGG

SEQ ID NO: 896363 - protein, 9 aa, Homo Sapiens
DSMFKDQMV

SEQ ID NO: 896364 - protein, 9 aa, Homo Sapiens
LEAEIQTLK

SEQ ID NO: 896365 - protein, 9 aa, Homo Sapiens
WEDIWQVNI

SEQ ID NO: 896366 - protein, 9 aa, Homo Sapiens
SQQMVTKVP

SEQ ID NO: 896367 - protein, 9 aa, Homo Sapiens
LTLRSLQEL

SEQ ID NO: 896368 - protein, 9 aa, Homo Sapiens
DYILPDTCF

SEQ ID NO: 896369 - protein, 9 aa, Homo Sapiens
IMSLAQNQF

SEQ ID NO: 896370 - protein, 9 aa, Homo Sapiens
ALTQKGLKV

SEQ ID NO: 896371 - protein, 9 aa, Homo Sapiens
YSPTRKAKS

SEQ ID NO: 896372 - protein, 9 aa, Homo Sapiens
NCNFRCIPD

SEQ ID NO: 896373 - protein, 9 aa, Homo Sapiens
MWNLLHKTD

SEQ ID NO: 896374 - protein, 9 aa, Homo Sapiens
HMIIHTGEK

SEQ ID NO: 896375 - protein, 9 aa, Homo Sapiens
KLFFKKGKK

SEQ ID NO: 896376 - protein, 9 aa, Homo Sapiens
AENQHNNIL

SEQ ID NO: 896377 - protein, 9 aa, Homo Sapiens
NRKEAALSW

SEQ ID NO: 896378 - protein, 9 aa, Homo Sapiens
LTQMLIQMK

SEQ ID NO: 896379 - protein, 9 aa, Homo Sapiens
CFLGMKSCG

SEQ ID NO: 896380 - protein, 9 aa, Homo Sapiens
WTMIQLHSK

SEQ ID NO: 896381 - protein, 9 aa, Homo Sapiens
RMLNEFSHA

SEQ ID NO: 896382 - protein, 9 aa, Homo Sapiens
MSLAQNQFI

SEQ ID NO: 896383 - protein, 9 aa, Homo Sapiens
NLPIYSENS

SEQ ID NO: 896384 - protein, 9 aa, Homo Sapiens
KPPVVSPND

SEQ ID NO: 896385 - protein, 9 aa, Homo Sapiens
RDMKTCHFH

SEQ ID NO: 896386 - protein, 9 aa, Homo Sapiens
PLDNICGLN

SEQ ID NO: 896387 - protein, 9 aa, Homo Sapiens
DLNKKENNN

SEQ ID NO: 896388 - protein, 9 aa, Homo Sapiens
NIWNCEAPY

SEQ ID NO: 896389 - protein, 9 aa, Homo Sapiens
PSHVIYTDY

SEQ ID NO: 896390 - protein, 9 aa, Homo Sapiens
SGVRVFRPQ

SEQ ID NO: 896391 - protein, 9 aa, Homo Sapiens
VRVWRRHRE

SEQ ID NO: 896392 - protein, 9 aa, Homo Sapiens
PWNVTGNSI

SEQ ID NO: 896393 - protein, 9 aa, Homo Sapiens
KLSEENFDG

SEQ ID NO: 896394 - protein, 9 aa, Homo Sapiens
LQRVCKNHR

SEQ ID NO: 896395 - protein, 9 aa, Homo Sapiens
GTASYLICA

SEQ ID NO: 896396 - protein, 9 aa, Homo Sapiens
NFFIQSCRC

SEQ ID NO: 896397 - protein, 9 aa, Homo Sapiens
YCYRYPKGE

SEQ ID NO: 896398 - protein, 9 aa, Homo Sapiens
VVDPETGRS

SEQ ID NO: 896399 - protein, 9 aa, Homo Sapiens
QNRPRKHRS

SEQ ID NO: 896400 - protein, 9 aa, Homo Sapiens
RIWFIRKNK

SEQ ID NO: 896401 - protein, 9 aa, Homo Sapiens
LCRHKKAHS

SEQ ID NO: 896402 - protein, 9 aa, Homo Sapiens
STEDDSERD

SEQ ID NO: 896403 - protein, 9 aa, Homo Sapiens
QSRLLACKN

SEQ ID NO: 896404 - protein, 9 aa, Homo Sapiens
DKAKIESLG

SEQ ID NO: 896405 - protein, 9 aa, Homo Sapiens
HQHSNRYLY

SEQ ID NO: 896406 - protein, 9 aa, Homo Sapiens
VVHKSFDLR

SEQ ID NO: 896407 - protein, 9 aa, Homo Sapiens
GCWDAEELG

SEQ ID NO: 896408 - protein, 9 aa, Homo Sapiens
PCNVTFRLS

SEQ ID NO: 896409 - protein, 9 aa, Homo Sapiens
QFLSLVHHT

SEQ ID NO: 896410 - protein, 9 aa, Homo Sapiens
WDQDREGAG

SEQ ID NO: 896411 - protein, 9 aa, Homo Sapiens
HQSLKALML

SEQ ID NO: 896412 - protein, 9 aa, Homo Sapiens
VCGNITVYE

SEQ ID NO: 896413 - protein, 9 aa, Homo Sapiens
LLKNHIVWG

SEQ ID NO: 896414 - protein, 9 aa, Homo Sapiens
WCCLRCLCQ

SEQ ID NO: 896415 - protein, 9 aa, Homo Sapiens
PGSGAPWLQ

SEQ ID NO: 896416 - protein, 9 aa, Homo Sapiens
ASALIQTLG

SEQ ID NO: 896417 - protein, 9 aa, Homo Sapiens
NFLGQMPII

SEQ ID NO: 896418 - protein, 9 aa, Homo Sapiens
KLRKRTKEP

SEQ ID NO: 896419 - protein, 9 aa, Homo Sapiens
GKKCQEAPP

SEQ ID NO: 896420 - protein, 9 aa, Homo Sapiens
KRLPPFKTF

SEQ ID NO: 896421 - protein, 9 aa, Homo Sapiens
TKQLQERIW

SEQ ID NO: 896422 - protein, 9 aa, Homo Sapiens
LDERRLFCH

SEQ ID NO: 896423 - protein, 9 aa, Homo Sapiens
LDWEKQHLI

SEQ ID NO: 896424 - protein, 9 aa, Homo Sapiens
CPAVGRAQL

SEQ ID NO: 896425 - protein, 9 aa, Homo Sapiens
YIVLDLGFI

SEQ ID NO: 896426 - protein, 9 aa, Homo Sapiens
TEFRDKLYP

SEQ ID NO: 896427 - protein, 9 aa, Homo Sapiens
LKKIMRTKG

SEQ ID NO: 896428 - protein, 9 aa, Homo Sapiens
LEELSQRYQ

SEQ ID NO: 896429 - protein, 9 aa, Homo Sapiens
KFAFADTPN

SEQ ID NO: 896430 - protein, 9 aa, Homo Sapiens
LTIHRRVYT

SEQ ID NO: 896431 - protein, 9 aa, Homo Sapiens
QSIDKPFRL

SEQ ID NO: 896432 - protein, 9 aa, Homo Sapiens
KVKLEGHKL

SEQ ID NO: 896433 - protein, 9 aa, Homo Sapiens
SVMYRFCTK

SEQ ID NO: 896434 - protein, 9 aa, Homo Sapiens
QKWSVENTG

SEQ ID NO: 896435 - protein, 9 aa, Homo Sapiens
SINSASDSL

SEQ ID NO: 896436 - protein, 9 aa, Homo Sapiens
QITYIQQEY

SEQ ID NO: 896437 - protein, 9 aa, Homo Sapiens
PALNMQHSR

SEQ ID NO: 896438 - protein, 9 aa, Homo Sapiens
MQISPDQGQ

SEQ ID NO: 896439 - protein, 9 aa, Homo Sapiens
TDSLTSQIS

SEQ ID NO: 896440 - protein, 9 aa, Homo Sapiens
QRQKQKQMK

SEQ ID NO: 896441 - protein, 9 aa, Homo Sapiens
TIIIMLELI

SEQ ID NO: 896442 - protein, 9 aa, Homo Sapiens
KIAYSRKPW

SEQ ID NO: 896443 - protein, 9 aa, Homo Sapiens
RKLSLIGIQ

SEQ ID NO: 896444 - protein, 9 aa, Homo Sapiens
TESQPIDLG

SEQ ID NO: 896445 - protein, 9 aa, Homo Sapiens
ESVQLLSEK

SEQ ID NO: 896446 - protein, 9 aa, Homo Sapiens
ESALPMREI

SEQ ID NO: 896447 - protein, 9 aa, Homo Sapiens
LTKNIHPWV

SEQ ID NO: 896448 - protein, 9 aa, Homo Sapiens
MKDICENFQ

SEQ ID NO: 896449 - protein, 9 aa, Homo Sapiens
FYTRNLYMQ

SEQ ID NO: 896450 - protein, 9 aa, Homo Sapiens
QTGVMICAY

SEQ ID NO: 896451 - protein, 9 aa, Homo Sapiens
SNLTRHQII

SEQ ID NO: 896452 - protein, 9 aa, Homo Sapiens
NGQKPLGTA

SEQ ID NO: 896453 - protein, 9 aa, Homo Sapiens
SNTNGRRTS

SEQ ID NO: 896454 - protein, 9 aa, Homo Sapiens
GNVVALWEC

SEQ ID NO: 896455 - protein, 9 aa, Homo Sapiens
LNSVGNTCG

SEQ ID NO: 896456 - protein, 9 aa, Homo Sapiens
VLVPDRHPS

SEQ ID NO: 896457 - protein, 9 aa, Homo Sapiens
DGWCECDDG

SEQ ID NO: 896458 - protein, 9 aa, Homo Sapiens
KNYFSLSSF

SEQ ID NO: 896459 - protein, 9 aa, Homo Sapiens
NYSIYKQTA

SEQ ID NO: 896460 - protein, 9 aa, Homo Sapiens
DYDNSAFME

SEQ ID NO: 896461 - protein, 9 aa, Homo Sapiens
VSWYLKEIE

SEQ ID NO: 896462 - protein, 9 aa, Homo Sapiens
FSYMWIINN

SEQ ID NO: 896463 - protein, 9 aa, Homo Sapiens
DLAMNLCTL

SEQ ID NO: 896464 - protein, 9 aa, Homo Sapiens
TSPNYSPTF

SEQ ID NO: 896465 - protein, 9 aa, Homo Sapiens
DKSINSLNK

SEQ ID NO: 896466 - protein, 9 aa, Homo Sapiens
FIVSLPLNV

SEQ ID NO: 896467 - protein, 9 aa, Homo Sapiens
QSDLLNKKA

SEQ ID NO: 896468 - protein, 9 aa, Homo Sapiens
NWIYYGDSC

SEQ ID NO: 896469 - protein, 9 aa, Homo Sapiens
SINNADTGR

SEQ ID NO: 896470 - protein, 9 aa, Homo Sapiens
LNLWTTLAA

SEQ ID NO: 896471 - protein, 9 aa, Homo Sapiens
IKIQNISYT

SEQ ID NO: 896472 - protein, 9 aa, Homo Sapiens
QQCIPVKRP

SEQ ID NO: 896473 - protein, 9 aa, Homo Sapiens
KCPAEGVDS

SEQ ID NO: 896474 - protein, 9 aa, Homo Sapiens
NHEITHSGE

SEQ ID NO: 896475 - protein, 9 aa, Homo Sapiens
PGHYQRAKT

SEQ ID NO: 896476 - protein, 9 aa, Homo Sapiens
RETGKIYTY

SEQ ID NO: 896477 - protein, 9 aa, Homo Sapiens
KVKGNLRKT

SEQ ID NO: 896478 - protein, 9 aa, Homo Sapiens
IQNVLVDAS

SEQ ID NO: 896479 - protein, 9 aa, Homo Sapiens
PPHGPNLES

SEQ ID NO: 896480 - protein, 9 aa, Homo Sapiens
VVKMIFAVV

SEQ ID NO: 896481 - protein, 9 aa, Homo Sapiens
LQDQQSNHS

SEQ ID NO: 896482 - protein, 9 aa, Homo Sapiens
ALIINKTIN

SEQ ID NO: 896483 - protein, 9 aa, Homo Sapiens
GYGYGGFND

SEQ ID NO: 896484 - protein, 9 aa, Homo Sapiens
SRTFTTMGL

SEQ ID NO: 896485 - protein, 9 aa, Homo Sapiens
EVYVECLSD

SEQ ID NO: 896486 - protein, 9 aa, Homo Sapiens
QLTTVSLNT

SEQ ID NO: 896487 - protein, 9 aa, Homo Sapiens
CDIERHFGC

SEQ ID NO: 896488 - protein, 9 aa, Homo Sapiens
PDIQVHEWV

SEQ ID NO: 896489 - protein, 9 aa, Homo Sapiens
NNSQNNTPE

SEQ ID NO: 896490 - protein, 9 aa, Homo Sapiens
FKTQKPYKP

SEQ ID NO: 896491 - protein, 9 aa, Homo Sapiens
VERICKFQI

SEQ ID NO: 896492 - protein, 9 aa, Homo Sapiens
RYLRYILKQ

SEQ ID NO: 896493 - protein, 9 aa, Homo Sapiens
VKAVYEEFW

SEQ ID NO: 896494 - protein, 9 aa, Homo Sapiens
GYESAYGGA

SEQ ID NO: 896495 - protein, 9 aa, Homo Sapiens
RGHSAKIIS

SEQ ID NO: 896496 - protein, 9 aa, Homo Sapiens
AGSDDSKME

SEQ ID NO: 896497 - protein, 9 aa, Homo Sapiens
KRLCKRVGP

SEQ ID NO: 896498 - protein, 9 aa, Homo Sapiens
IRTVRARRP

SEQ ID NO: 896499 - protein, 9 aa, Homo Sapiens
FAKTFKQRQ

SEQ ID NO: 896500 - protein, 9 aa, Homo Sapiens
PLFGENPWW

SEQ ID NO: 896501 - protein, 9 aa, Homo Sapiens
SNLKRIMAH

SEQ ID NO: 896502 - protein, 9 aa, Homo Sapiens
EITLDLIKS

SEQ ID NO: 896503 - protein, 9 aa, Homo Sapiens
AVQAVDKYL

SEQ ID NO: 896504 - protein, 9 aa, Homo Sapiens
CNQRQKQKQ

SEQ ID NO: 896505 - protein, 9 aa, Homo Sapiens
LTSPSMGIK

SEQ ID NO: 896506 - protein, 9 aa, Homo Sapiens
MGIKEVASI

SEQ ID NO: 896507 - protein, 9 aa, Homo Sapiens
AAVGQLGRT

SEQ ID NO: 896508 - protein, 9 aa, Homo Sapiens
DLLNIFKLN

SEQ ID NO: 896509 - protein, 9 aa, Homo Sapiens
QNSFEENPD

SEQ ID NO: 896510 - protein, 9 aa, Homo Sapiens
DKYCYRYPK

SEQ ID NO: 896511 - protein, 9 aa, Homo Sapiens
ALYVENQFC

SEQ ID NO: 896512 - protein, 9 aa, Homo Sapiens
LQNVSLSAV

SEQ ID NO: 896513 - protein, 9 aa, Homo Sapiens
SNWMVQVSF

SEQ ID NO: 896514 - protein, 9 aa, Homo Sapiens
AIQRLQGEI

SEQ ID NO: 896515 - protein, 9 aa, Homo Sapiens
LDWFGLGQP

SEQ ID NO: 896516 - protein, 9 aa, Homo Sapiens
FNPQGDVAL

SEQ ID NO: 896517 - protein, 9 aa, Homo Sapiens
TFNTSVYSQ

SEQ ID NO: 896518 - protein, 9 aa, Homo Sapiens
PKPFVDCKE

SEQ ID NO: 896519 - protein, 9 aa, Homo Sapiens
RLECSDNNL

SEQ ID NO: 896520 - protein, 9 aa, Homo Sapiens
ELNATIRQL

SEQ ID NO: 896521 - protein, 9 aa, Homo Sapiens
LFAPWCPPC

SEQ ID NO: 896522 - protein, 9 aa, Homo Sapiens
VVIDTDGLW

SEQ ID NO: 896523 - protein, 9 aa, Homo Sapiens
KKDFLEPES

SEQ ID NO: 896524 - protein, 9 aa, Homo Sapiens
IRDWLYEHR

SEQ ID NO: 896525 - protein, 9 aa, Homo Sapiens
YQQHPEAYS

SEQ ID NO: 896526 - protein, 9 aa, Homo Sapiens
NLEQFPLEE

SEQ ID NO: 896527 - protein, 9 aa, Homo Sapiens
KNNYRKNVA

SEQ ID NO: 896528 - protein, 9 aa, Homo Sapiens
LTLTTLPTA

SEQ ID NO: 896529 - protein, 9 aa, Homo Sapiens
DEVQDDDVP

SEQ ID NO: 896530 - protein, 9 aa, Homo Sapiens
HPNHSPPPS

SEQ ID NO: 896531 - protein, 9 aa, Homo Sapiens
YSHDGTNSP

SEQ ID NO: 896532 - protein, 9 aa, Homo Sapiens
KHLRKDLPS

SEQ ID NO: 896533 - protein, 9 aa, Homo Sapiens
NSNLAKHQR

SEQ ID NO: 896534 - protein, 9 aa, Homo Sapiens
KEKSTKDEP

SEQ ID NO: 896535 - protein, 9 aa, Homo Sapiens
QRGNMVTTY

SEQ ID NO: 896536 - protein, 9 aa, Homo Sapiens
PPAADVLKY

SEQ ID NO: 896537 - protein, 9 aa, Homo Sapiens
AFCIAKLML

SEQ ID NO: 896538 - protein, 9 aa, Homo Sapiens
LDSMVNNNV

SEQ ID NO: 896539 - protein, 9 aa, Homo Sapiens
QPRLTHNGP

SEQ ID NO: 896540 - protein, 9 aa, Homo Sapiens
DSSDNGFLA

SEQ ID NO: 896541 - protein, 9 aa, Homo Sapiens
VTMDKWKAI

SEQ ID NO: 896542 - protein, 9 aa, Homo Sapiens
IHVSKRGTI

SEQ ID NO: 896543 - protein, 9 aa, Homo Sapiens
QELEKCDIF

SEQ ID NO: 896544 - protein, 9 aa, Homo Sapiens
HPCILSAFS

SEQ ID NO: 896545 - protein, 9 aa, Homo Sapiens
SGECQLAVV

SEQ ID NO: 896546 - protein, 9 aa, Homo Sapiens
QVQAPCGAT

SEQ ID NO: 896547 - protein, 9 aa, Homo Sapiens
GFIKAVFKH

SEQ ID NO: 896548 - protein, 9 aa, Homo Sapiens
LHKCFVQVE

SEQ ID NO: 896549 - protein, 9 aa, Homo Sapiens
GDKIQILAT

SEQ ID NO: 896550 - protein, 9 aa, Homo Sapiens
LISQLRTLE

SEQ ID NO: 896551 - protein, 9 aa, Homo Sapiens
YISAEYIAQ

SEQ ID NO: 896552 - protein, 9 aa, Homo Sapiens
PMLKKHTNV

SEQ ID NO: 896553 - protein, 9 aa, Homo Sapiens
AVVWEHFDC

SEQ ID NO: 896554 - protein, 9 aa, Homo Sapiens
KGIENIKNK

SEQ ID NO: 896555 - protein, 9 aa, Homo Sapiens
TKNTASLQR

SEQ ID NO: 896556 - protein, 9 aa, Homo Sapiens
TFLPARLPP

SEQ ID NO: 896557 - protein, 9 aa, Homo Sapiens
ALLSGNDII

SEQ ID NO: 896558 - protein, 9 aa, Homo Sapiens
YFGVIPPPP

SEQ ID NO: 896559 - protein, 9 aa, Homo Sapiens
LSKDKKKIL

SEQ ID NO: 896560 - protein, 9 aa, Homo Sapiens
DIGGSIQMP

SEQ ID NO: 896561 - protein, 9 aa, Homo Sapiens
TEKIRECLK

SEQ ID NO: 896562 - protein, 9 aa, Homo Sapiens
TIYYGEQQS

SEQ ID NO: 896563 - protein, 9 aa, Homo Sapiens
TGASTIRTS

SEQ ID NO: 896564 - protein, 9 aa, Homo Sapiens
PKRKLSLIG

SEQ ID NO: 896565 - protein, 9 aa, Homo Sapiens
NLEDKDIES

SEQ ID NO: 896566 - protein, 9 aa, Homo Sapiens
CEKGDKLQL

SEQ ID NO: 896567 - protein, 9 aa, Homo Sapiens
LDGGVQTGN

SEQ ID NO: 896568 - protein, 9 aa, Homo Sapiens
KRQTLQRND

SEQ ID NO: 896569 - protein, 9 aa, Homo Sapiens
IFNVISGAR

SEQ ID NO: 896570 - protein, 9 aa, Homo Sapiens
DGWLKIIRV

SEQ ID NO: 896571 - protein, 9 aa, Homo Sapiens
KLIHFKSVI

SEQ ID NO: 896572 - protein, 9 aa, Homo Sapiens
YYCCMASEL

SEQ ID NO: 896573 - protein, 9 aa, Homo Sapiens
SSRSLFDPT

SEQ ID NO: 896574 - protein, 9 aa, Homo Sapiens
YSEMIYLAP

SEQ ID NO: 896575 - protein, 9 aa, Homo Sapiens
VSLLRQRTR

SEQ ID NO: 896576 - protein, 9 aa, Homo Sapiens
YKLNICPET

SEQ ID NO: 896577 - protein, 9 aa, Homo Sapiens
VQEETAWRE

SEQ ID NO: 896578 - protein, 9 aa, Homo Sapiens
VEASDKLSK

SEQ ID NO: 896579 - protein, 9 aa, Homo Sapiens
FEYEIQFGS

SEQ ID NO: 896580 - protein, 9 aa, Homo Sapiens
VKLFLSYDY

SEQ ID NO: 896581 - protein, 9 aa, Homo Sapiens
VMISSEHTE

SEQ ID NO: 896582 - protein, 9 aa, Homo Sapiens
SFLFNTICM

SEQ ID NO: 896583 - protein, 9 aa, Homo Sapiens
SFADDVEDT

SEQ ID NO: 896584 - protein, 9 aa, Homo Sapiens
FGSEAMKSK

SEQ ID NO: 896585 - protein, 9 aa, Homo Sapiens
CPFSQRIFM

SEQ ID NO: 896586 - protein, 9 aa, Homo Sapiens
AEIQTLKHK

SEQ ID NO: 896587 - protein, 9 aa, Homo Sapiens
LTDSEYTDG

SEQ ID NO: 896588 - protein, 9 aa, Homo Sapiens
FYLQAKKIM

SEQ ID NO: 896589 - protein, 9 aa, Homo Sapiens
IEKLVKDMV

SEQ ID NO: 896590 - protein, 9 aa, Homo Sapiens
STLVKITWS

SEQ ID NO: 896591 - protein, 9 aa, Homo Sapiens
NSSLFALQT

SEQ ID NO: 896592 - protein, 9 aa, Homo Sapiens
ETRTHQVVQ

SEQ ID NO: 896593 - protein, 9 aa, Homo Sapiens
REMGDLTHR

SEQ ID NO: 896594 - protein, 9 aa, Homo Sapiens
GVCIAHSNV

SEQ ID NO: 896595 - protein, 9 aa, Homo Sapiens
SHFLEEINE

SEQ ID NO: 896596 - protein, 9 aa, Homo Sapiens
HLHINNDAL

SEQ ID NO: 896597 - protein, 9 aa, Homo Sapiens
IQNILILSH

SEQ ID NO: 896598 - protein, 9 aa, Homo Sapiens
IDNPVHLKC

SEQ ID NO: 896599 - protein, 9 aa, Homo Sapiens
GENRQKHFP

SEQ ID NO: 896600 - protein, 9 aa, Homo Sapiens
GSAKVAELL

SEQ ID NO: 896601 - protein, 9 aa, Homo Sapiens
SFNMHDSSL

SEQ ID NO: 896602 - protein, 9 aa, Homo Sapiens
HMRSHTGDK

SEQ ID NO: 896603 - protein, 9 aa, Homo Sapiens
QKSSSDSDD

SEQ ID NO: 896604 - protein, 9 aa, Homo Sapiens
MSVERDIKF

SEQ ID NO: 896605 - protein, 9 aa, Homo Sapiens
KRVLLYVQK

SEQ ID NO: 896606 - protein, 9 aa, Homo Sapiens
AIFKGSESS

SEQ ID NO: 896607 - protein, 9 aa, Homo Sapiens
EAAEGDENK

SEQ ID NO: 896608 - protein, 9 aa, Homo Sapiens
VNIICCKKV

SEQ ID NO: 896609 - protein, 9 aa, Homo Sapiens
MPPTYYNAW

SEQ ID NO: 896610 - protein, 9 aa, Homo Sapiens
QGCTVADKS

SEQ ID NO: 896611 - protein, 9 aa, Homo Sapiens
RFCRDAKAL

SEQ ID NO: 896612 - protein, 9 aa, Homo Sapiens
QAKYVKTAV

SEQ ID NO: 896613 - protein, 9 aa, Homo Sapiens
AQVFARYLV

SEQ ID NO: 896614 - protein, 9 aa, Homo Sapiens
APCGATSSS

SEQ ID NO: 896615 - protein, 9 aa, Homo Sapiens
LKGLKKDYF

SEQ ID NO: 896616 - protein, 9 aa, Homo Sapiens
KISIVGTGL

SEQ ID NO: 896617 - protein, 9 aa, Homo Sapiens
QKPLSDKLL

SEQ ID NO: 896618 - protein, 9 aa, Homo Sapiens
DQDGRTSFD

SEQ ID NO: 896619 - protein, 9 aa, Homo Sapiens
KNKMKEQEY

SEQ ID NO: 896620 - protein, 9 aa, Homo Sapiens
EVPITMKYV

SEQ ID NO: 896621 - protein, 9 aa, Homo Sapiens
WLYWQIWHM

SEQ ID NO: 896622 - protein, 9 aa, Homo Sapiens
RTSFDEFIK

SEQ ID NO: 896623 - protein, 9 aa, Homo Sapiens
YKKILLLEG

SEQ ID NO: 896624 - protein, 9 aa, Homo Sapiens
VPQTGWVYR

SEQ ID NO: 896625 - protein, 9 aa, Homo Sapiens
DTLIQLSVG

SEQ ID NO: 896626 - protein, 9 aa, Homo Sapiens
FLSSLSFVN

SEQ ID NO: 896627 - protein, 9 aa, Homo Sapiens
VFLQTVSLE

SEQ ID NO: 896628 - protein, 9 aa, Homo Sapiens
KIQGMQKLL

SEQ ID NO: 896629 - protein, 9 aa, Homo Sapiens
GACKIHLQG

SEQ ID NO: 896630 - protein, 9 aa, Homo Sapiens
PDSQKLLQC

SEQ ID NO: 896631 - protein, 9 aa, Homo Sapiens
QNHPYRYRK

SEQ ID NO: 896632 - protein, 9 aa, Homo Sapiens
NADSKKRIQ

SEQ ID NO: 896633 - protein, 9 aa, Homo Sapiens
EKGNCSQHM

SEQ ID NO: 896634 - protein, 9 aa, Homo Sapiens
CCLLRITAF

SEQ ID NO: 896635 - protein, 9 aa, Homo Sapiens
LLQQYYLSP

SEQ ID NO: 896636 - protein, 9 aa, Homo Sapiens
LAKHQRIHS

SEQ ID NO: 896637 - protein, 9 aa, Homo Sapiens
SVLHWLQQH

SEQ ID NO: 896638 - protein, 9 aa, Homo Sapiens
FLSRSLLYV

SEQ ID NO: 896639 - protein, 9 aa, Homo Sapiens
RQNSRTSLF

SEQ ID NO: 896640 - protein, 9 aa, Homo Sapiens
LEAELLILD

SEQ ID NO: 896641 - protein, 9 aa, Homo Sapiens
SFRNHEITH

SEQ ID NO: 896642 - protein, 9 aa, Homo Sapiens
ITEHLRSFS

SEQ ID NO: 896643 - protein, 9 aa, Homo Sapiens
VIHAPPPTK

SEQ ID NO: 896644 - protein, 9 aa, Homo Sapiens
RMHYPGPMS

SEQ ID NO: 896645 - protein, 9 aa, Homo Sapiens
EEEVKNKIS

SEQ ID NO: 896646 - protein, 9 aa, Homo Sapiens
ILHSLLNKE

SEQ ID NO: 896647 - protein, 9 aa, Homo Sapiens
LNIIRKKNL

SEQ ID NO: 896648 - protein, 9 aa, Homo Sapiens
RGNCRPIQF

SEQ ID NO: 896649 - protein, 9 aa, Homo Sapiens
QKKKSCWPF

SEQ ID NO: 896650 - protein, 9 aa, Homo Sapiens
YECMKTEAE

SEQ ID NO: 896651 - protein, 9 aa, Homo Sapiens
MTLCVADFG

SEQ ID NO: 896652 - protein, 9 aa, Homo Sapiens
GWGQPQIQP

SEQ ID NO: 896653 - protein, 9 aa, Homo Sapiens
SRRLLLDGD

SEQ ID NO: 896654 - protein, 9 aa, Homo Sapiens
EGGGCSDVD

SEQ ID NO: 896655 - protein, 9 aa, Homo Sapiens
VSAPKVEAN

SEQ ID NO: 896656 - protein, 9 aa, Homo Sapiens
NFILLNFSF

SEQ ID NO: 896657 - protein, 9 aa, Homo Sapiens
FSLDVQSVA

SEQ ID NO: 896658 - protein, 9 aa, Homo Sapiens
LLPSTTSSL

SEQ ID NO: 896659 - protein, 9 aa, Homo Sapiens
IFSIEARDY

SEQ ID NO: 896660 - protein, 9 aa, Homo Sapiens
LYIPLPMLW

SEQ ID NO: 896661 - protein, 9 aa, Homo Sapiens
KWTGETGKG

SEQ ID NO: 896662 - protein, 9 aa, Homo Sapiens
PEPNLMSPT

SEQ ID NO: 896663 - protein, 9 aa, Homo Sapiens
LGDYDKVKT

SEQ ID NO: 896664 - protein, 9 aa, Homo Sapiens
PTAPDAMKE

SEQ ID NO: 896665 - protein, 9 aa, Homo Sapiens
SDNIKHKNN

SEQ ID NO: 896666 - protein, 9 aa, Homo Sapiens
NLLTPQHLN

SEQ ID NO: 896667 - protein, 9 aa, Homo Sapiens
GRLEPPKNC

SEQ ID NO: 896668 - protein, 9 aa, Homo Sapiens
TNMQYVFIY

SEQ ID NO: 896669 - protein, 9 aa, Homo Sapiens
RRDIPVTRT

SEQ ID NO: 896670 - protein, 9 aa, Homo Sapiens
SSVVNNSQN

SEQ ID NO: 896671 - protein, 9 aa, Homo Sapiens
KNRTGTEHL

SEQ ID NO: 896672 - protein, 9 aa, Homo Sapiens
ISMKPNVEF

SEQ ID NO: 896673 - protein, 9 aa, Homo Sapiens
DVLQARVAE

SEQ ID NO: 896674 - protein, 9 aa, Homo Sapiens
PNHPNHSPP

SEQ ID NO: 896675 - protein, 9 aa, Homo Sapiens
TPKQAIFKG

SEQ ID NO: 896676 - protein, 9 aa, Homo Sapiens
KCDIFFEES

SEQ ID NO: 896677 - protein, 9 aa, Homo Sapiens
WNNMIILLN

SEQ ID NO: 896678 - protein, 9 aa, Homo Sapiens
GAPWLQIAR

SEQ ID NO: 896679 - protein, 9 aa, Homo Sapiens
EETIVMAYF

SEQ ID NO: 896680 - protein, 9 aa, Homo Sapiens
VILTLVPVE

SEQ ID NO: 896681 - protein, 9 aa, Homo Sapiens
FCHLQLAQD

SEQ ID NO: 896682 - protein, 9 aa, Homo Sapiens
EDGDNYDTP

SEQ ID NO: 896683 - protein, 9 aa, Homo Sapiens
VLMRLGRQC

SEQ ID NO: 896684 - protein, 9 aa, Homo Sapiens
YPKQPDLFK

SEQ ID NO: 896685 - protein, 9 aa, Homo Sapiens
VAPRSKRCC

SEQ ID NO: 896686 - protein, 9 aa, Homo Sapiens
YVNTDILFL

SEQ ID NO: 896687 - protein, 9 aa, Homo Sapiens
HKGYKFMFD

SEQ ID NO: 896688 - protein, 9 aa, Homo Sapiens
QQFPYGARY

SEQ ID NO: 896689 - protein, 9 aa, Homo Sapiens
FEAFFTVAG

SEQ ID NO: 896690 - protein, 9 aa, Homo Sapiens
NRETGTLLM

SEQ ID NO: 896691 - protein, 9 aa, Homo Sapiens
KHGKNVPKY

SEQ ID NO: 896692 - protein, 9 aa, Homo Sapiens
TIQNELAHC

SEQ ID NO: 896693 - protein, 9 aa, Homo Sapiens
SDRMSELSG

SEQ ID NO: 896694 - protein, 9 aa, Homo Sapiens
RGSNNVTLG

SEQ ID NO: 896695 - protein, 9 aa, Homo Sapiens
LKSTASSLL

SEQ ID NO: 896696 - protein, 9 aa, Homo Sapiens
FPTNSTSQT

SEQ ID NO: 896697 - protein, 9 aa, Homo Sapiens
TQGEGKEIH

SEQ ID NO: 896698 - protein, 9 aa, Homo Sapiens
DIQNVVLQY

SEQ ID NO: 896699 - protein, 9 aa, Homo Sapiens
VGFLMTFLK

SEQ ID NO: 896700 - protein, 9 aa, Homo Sapiens
LKQEERIQE

SEQ ID NO: 896701 - protein, 9 aa, Homo Sapiens
KQQFGELRE

SEQ ID NO: 896702 - protein, 9 aa, Homo Sapiens
MNHLNSVGN

SEQ ID NO: 896703 - protein, 9 aa, Homo Sapiens
FVNREIYPG

SEQ ID NO: 896704 - protein, 9 aa, Homo Sapiens
EEKVYEIIE

SEQ ID NO: 896705 - protein, 9 aa, Homo Sapiens
EIQFGSEAM

SEQ ID NO: 896706 - protein, 9 aa, Homo Sapiens
ASMRNLYIK

SEQ ID NO: 896707 - protein, 9 aa, Homo Sapiens
LFMKRFSYE

SEQ ID NO: 896708 - protein, 9 aa, Homo Sapiens
IQRKIVKPK

SEQ ID NO: 896709 - protein, 9 aa, Homo Sapiens
SRYDPSISV

SEQ ID NO: 896710 - protein, 9 aa, Homo Sapiens
KEEAVLELD

SEQ ID NO: 896711 - protein, 9 aa, Homo Sapiens
DIKTLILED

SEQ ID NO: 896712 - protein, 9 aa, Homo Sapiens
ETLNARAVI

SEQ ID NO: 896713 - protein, 9 aa, Homo Sapiens
ALQLIKQYW

SEQ ID NO: 896714 - protein, 9 aa, Homo Sapiens
REQSRSRDR

SEQ ID NO: 896715 - protein, 9 aa, Homo Sapiens
RKCMLLTLK

SEQ ID NO: 896716 - protein, 9 aa, Homo Sapiens
PTDKTVMYK

SEQ ID NO: 896717 - protein, 9 aa, Homo Sapiens
VYFHCLHLF

SEQ ID NO: 896718 - protein, 9 aa, Homo Sapiens
DGKQSQTVG

SEQ ID NO: 896719 - protein, 9 aa, Homo Sapiens
QQLTFDGKQ

SEQ ID NO: 896720 - protein, 9 aa, Homo Sapiens
QCFDRINWP

SEQ ID NO: 896721 - protein, 9 aa, Homo Sapiens
FKQRQIKLG

SEQ ID NO: 896722 - protein, 9 aa, Homo Sapiens
QIQPFQNLT

SEQ ID NO: 896723 - protein, 9 aa, Homo Sapiens
SEEDNSDSQ

SEQ ID NO: 896724 - protein, 9 aa, Homo Sapiens
THTFNNYRN

SEQ ID NO: 896725 - protein, 9 aa, Homo Sapiens
STTSSLVSV

SEQ ID NO: 896726 - protein, 9 aa, Homo Sapiens
KCHQCVKTI

SEQ ID NO: 896727 - protein, 9 aa, Homo Sapiens
LAACQLHIS

SEQ ID NO: 896728 - protein, 9 aa, Homo Sapiens
RPKMLKEET

SEQ ID NO: 896729 - protein, 9 aa, Homo Sapiens
PTVKRLLGW

SEQ ID NO: 896730 - protein, 9 aa, Homo Sapiens
VLCTHKRIH

SEQ ID NO: 896731 - protein, 9 aa, Homo Sapiens
DETIVVGMP

SEQ ID NO: 896732 - protein, 9 aa, Homo Sapiens
RSPIPVSPI

SEQ ID NO: 896733 - protein, 9 aa, Homo Sapiens
VTESEVARG

SEQ ID NO: 896734 - protein, 9 aa, Homo Sapiens
CQACAGIDK

SEQ ID NO: 896735 - protein, 9 aa, Homo Sapiens
KNYVSLAVL

SEQ ID NO: 896736 - protein, 9 aa, Homo Sapiens
SKKHSVMSI

SEQ ID NO: 896737 - protein, 9 aa, Homo Sapiens
LLMECLSVD

SEQ ID NO: 896738 - protein, 9 aa, Homo Sapiens
LNTYRLCDN

SEQ ID NO: 896739 - protein, 9 aa, Homo Sapiens
MKTLKKYLE

SEQ ID NO: 896740 - protein, 9 aa, Homo Sapiens
KARFEWEQN

SEQ ID NO: 896741 - protein, 9 aa, Homo Sapiens
MWRLEEMMW

SEQ ID NO: 896742 - protein, 9 aa, Homo Sapiens
YIQQEYETK

SEQ ID NO: 896743 - protein, 9 aa, Homo Sapiens
VADVMCRRK

SEQ ID NO: 896744 - protein, 9 aa, Homo Sapiens
YVSINSASD

SEQ ID NO: 896745 - protein, 9 aa, Homo Sapiens
PSAPVINLA

SEQ ID NO: 896746 - protein, 9 aa, Homo Sapiens
NSTAAELAH

SEQ ID NO: 896747 - protein, 9 aa, Homo Sapiens
PARKPPNYN

SEQ ID NO: 896748 - protein, 9 aa, Homo Sapiens
ILIFGAHNR

SEQ ID NO: 896749 - protein, 9 aa, Homo Sapiens
ATHAPLAVS

SEQ ID NO: 896750 - protein, 9 aa, Homo Sapiens
VQSAYPQQS

SEQ ID NO: 896751 - protein, 9 aa, Homo Sapiens
RGNVGFKEF

SEQ ID NO: 896752 - protein, 9 aa, Homo Sapiens
DFSVSLIID

SEQ ID NO: 896753 - protein, 9 aa, Homo Sapiens
GNCPFSQRI

SEQ ID NO: 896754 - protein, 9 aa, Homo Sapiens
PEDAWMDTH

SEQ ID NO: 896755 - protein, 9 aa, Homo Sapiens
GSKIWAFMM

SEQ ID NO: 896756 - protein, 9 aa, Homo Sapiens
LDHRMTKVH

SEQ ID NO: 896757 - protein, 9 aa, Homo Sapiens
DKNPMSSLQ

SEQ ID NO: 896758 - protein, 9 aa, Homo Sapiens
PDWCLSPPH

SEQ ID NO: 896759 - protein, 9 aa, Homo Sapiens
KSLGSTQFF

SEQ ID NO: 896760 - protein, 9 aa, Homo Sapiens
HTERDKGTQ

SEQ ID NO: 896761 - protein, 9 aa, Homo Sapiens
EQMKEYRVQ

SEQ ID NO: 896762 - protein, 9 aa, Homo Sapiens
WSEVDKIVV

SEQ ID NO: 896763 - protein, 9 aa, Homo Sapiens
QSEPDYLKV

SEQ ID NO: 896764 - protein, 9 aa, Homo Sapiens
ARTRAGSRL

SEQ ID NO: 896765 - protein, 9 aa, Homo Sapiens
TLVFKQDNC

SEQ ID NO: 896766 - protein, 9 aa, Homo Sapiens
TETLKEHEK

SEQ ID NO: 896767 - protein, 9 aa, Homo Sapiens
DNNIVVDDI

SEQ ID NO: 896768 - protein, 9 aa, Homo Sapiens
TDGVLFCRS

SEQ ID NO: 896769 - protein, 9 aa, Homo Sapiens
KNCSSTTAK

SEQ ID NO: 896770 - protein, 9 aa, Homo Sapiens
DRGENRQKH

SEQ ID NO: 896771 - protein, 9 aa, Homo Sapiens
YLKQINYSK

SEQ ID NO: 896772 - protein, 9 aa, Homo Sapiens
LIGVCIAHS

SEQ ID NO: 896773 - protein, 9 aa, Homo Sapiens
VTKSHHLHL

SEQ ID NO: 896774 - protein, 9 aa, Homo Sapiens
GSTCHFSCG

SEQ ID NO: 896775 - protein, 9 aa, Homo Sapiens
RLYVPKGFN

SEQ ID NO: 896776 - protein, 9 aa, Homo Sapiens
QQTKLLNGP

SEQ ID NO: 896777 - protein, 9 aa, Homo Sapiens
QMQSPTTTN

SEQ ID NO: 896778 - protein, 9 aa, Homo Sapiens
LLDRIEIIQ

SEQ ID NO: 896779 - protein, 9 aa, Homo Sapiens
RKNKLPDSF

SEQ ID NO: 896780 - protein, 9 aa, Homo Sapiens
SQPESDKYH

SEQ ID NO: 896781 - protein, 9 aa, Homo Sapiens
GIANLIKIK

SEQ ID NO: 896782 - protein, 9 aa, Homo Sapiens
PISPFMDCS

SEQ ID NO: 896783 - protein, 9 aa, Homo Sapiens
FTLDVKIND

SEQ ID NO: 896784 - protein, 9 aa, Homo Sapiens
ETAGDKLGK

SEQ ID NO: 896785 - protein, 9 aa, Homo Sapiens
HREALAKHC

SEQ ID NO: 896786 - protein, 9 aa, Homo Sapiens
CLLTKQVVD

SEQ ID NO: 896787 - protein, 9 aa, Homo Sapiens
RSQRRHAAS

SEQ ID NO: 896788 - protein, 9 aa, Homo Sapiens
SSEIPDHEL

SEQ ID NO: 896789 - protein, 9 aa, Homo Sapiens
RLCSQTVST

SEQ ID NO: 896790 - protein, 9 aa, Homo Sapiens
GFFWANIRA

SEQ ID NO: 896791 - protein, 9 aa, Homo Sapiens
TYPLLFTAS

SEQ ID NO: 896792 - protein, 9 aa, Homo Sapiens
RGRCVDGWC

SEQ ID NO: 896793 - protein, 9 aa, Homo Sapiens
DRQRTLVLL

SEQ ID NO: 896794 - protein, 9 aa, Homo Sapiens
VALLMNRTN

SEQ ID NO: 896795 - protein, 9 aa, Homo Sapiens
HLSRGISHA

SEQ ID NO: 896796 - protein, 9 aa, Homo Sapiens
LYFYRNPEE

SEQ ID NO: 896797 - protein, 9 aa, Homo Sapiens
SRLFELFDR

SEQ ID NO: 896798 - protein, 9 aa, Homo Sapiens
AAAAVCLSM

SEQ ID NO: 896799 - protein, 9 aa, Homo Sapiens
ELQVQHFGV

SEQ ID NO: 896800 - protein, 9 aa, Homo Sapiens
ELKIRYLPK

SEQ ID NO: 896801 - protein, 9 aa, Homo Sapiens
FAVLAVASQ

SEQ ID NO: 896802 - protein, 9 aa, Homo Sapiens
GKSFSYSNL

SEQ ID NO: 896803 - protein, 9 aa, Homo Sapiens
TLCNKEVRE

SEQ ID NO: 896804 - protein, 9 aa, Homo Sapiens
LTKLMSDGS

SEQ ID NO: 896805 - protein, 9 aa, Homo Sapiens
NLTTCPLAA

SEQ ID NO: 896806 - protein, 9 aa, Homo Sapiens
YVNIHTGLS

SEQ ID NO: 896807 - protein, 9 aa, Homo Sapiens
LGKNGVVKL

SEQ ID NO: 896808 - protein, 9 aa, Homo Sapiens
SNPLAHYNT

SEQ ID NO: 896809 - protein, 9 aa, Homo Sapiens
LPHEVVGSA

SEQ ID NO: 896810 - protein, 9 aa, Homo Sapiens
YRYLKPENL

SEQ ID NO: 896811 - protein, 9 aa, Homo Sapiens
PKPIFWIQT

SEQ ID NO: 896812 - protein, 9 aa, Homo Sapiens
NELVAGSQE

SEQ ID NO: 896813 - protein, 9 aa, Homo Sapiens
WCRGHGPQS

SEQ ID NO: 896814 - protein, 9 aa, Homo Sapiens
YFTDLKDGN

SEQ ID NO: 896815 - protein, 9 aa, Homo Sapiens
RDNVRIPGM

SEQ ID NO: 896816 - protein, 9 aa, Homo Sapiens
LHINNDALP

SEQ ID NO: 896817 - protein, 9 aa, Homo Sapiens
ISLSQNDFQ

SEQ ID NO: 896818 - protein, 9 aa, Homo Sapiens
ATTELPLLC

SEQ ID NO: 896819 - protein, 9 aa, Homo Sapiens
TMSEGSDCQ

SEQ ID NO: 896820 - protein, 9 aa, Homo Sapiens
SQMLLGIII

SEQ ID NO: 896821 - protein, 9 aa, Homo Sapiens
VRTILIDFT

SEQ ID NO: 896822 - protein, 9 aa, Homo Sapiens
GHLLLGVVQ

SEQ ID NO: 896823 - protein, 9 aa, Homo Sapiens
DDSDLLLNT

SEQ ID NO: 896824 - protein, 9 aa, Homo Sapiens
VGISVLHWL

SEQ ID NO: 896825 - protein, 9 aa, Homo Sapiens
HADSMCKRN

SEQ ID NO: 896826 - protein, 9 aa, Homo Sapiens
YCHSVELQN

SEQ ID NO: 896827 - protein, 9 aa, Homo Sapiens
AEENGNSNK

SEQ ID NO: 896828 - protein, 9 aa, Homo Sapiens
KSNSPSSSS

SEQ ID NO: 896829 - protein, 9 aa, Homo Sapiens
YQKKKSCWP

SEQ ID NO: 896830 - protein, 9 aa, Homo Sapiens
CITVFQLPQ

SEQ ID NO: 896831 - protein, 9 aa, Homo Sapiens
LKHLTETLK

SEQ ID NO: 896832 - protein, 9 aa, Homo Sapiens
RPRSLQSPT

SEQ ID NO: 896833 - protein, 9 aa, Homo Sapiens
TPFQIGIKE

SEQ ID NO: 896834 - protein, 9 aa, Homo Sapiens
DKSNPRGPS

SEQ ID NO: 896835 - protein, 9 aa, Homo Sapiens
QRFDLVVSI

SEQ ID NO: 896836 - protein, 9 aa, Homo Sapiens
TTRTRNIFY

SEQ ID NO: 896837 - protein, 9 aa, Homo Sapiens
AQTTCVVGR

SEQ ID NO: 896838 - protein, 9 aa, Homo Sapiens
VHLFCNYEE

SEQ ID NO: 896839 - protein, 9 aa, Homo Sapiens
EADVDIEGN

SEQ ID NO: 896840 - protein, 9 aa, Homo Sapiens
NGVFSALKM

SEQ ID NO: 896841 - protein, 9 aa, Homo Sapiens
YFSLAGNFS

SEQ ID NO: 896842 - protein, 9 aa, Homo Sapiens
ILRYAKMKM

SEQ ID NO: 896843 - protein, 9 aa, Homo Sapiens
IKHQNLAAL

SEQ ID NO: 896844 - protein, 9 aa, Homo Sapiens
KLMSSFAKT

SEQ ID NO: 896845 - protein, 9 aa, Homo Sapiens
FYLSKEEWR

SEQ ID NO: 896846 - protein, 9 aa, Homo Sapiens
QNLDCYTTV

SEQ ID NO: 896847 - protein, 9 aa, Homo Sapiens
GYLQARSCW

SEQ ID NO: 896848 - protein, 9 aa, Homo Sapiens
HVDKGTTEG

SEQ ID NO: 896849 - protein, 9 aa, Homo Sapiens
TQIGLAQYS

SEQ ID NO: 896850 - protein, 9 aa, Homo Sapiens
STKCFDNKL

SEQ ID NO: 896851 - protein, 9 aa, Homo Sapiens
TLLETFNAM

SEQ ID NO: 896852 - protein, 9 aa, Homo Sapiens
VVATGVNTK

SEQ ID NO: 896853 - protein, 9 aa, Homo Sapiens
YCFSIRADN

SEQ ID NO: 896854 - protein, 9 aa, Homo Sapiens
ELSRKQKEK

SEQ ID NO: 896855 - protein, 9 aa, Homo Sapiens
YRKQRQKQA

SEQ ID NO: 896856 - protein, 9 aa, Homo Sapiens
WALGYVISL

SEQ ID NO: 896857 - protein, 9 aa, Homo Sapiens
SQSSAFKSL

SEQ ID NO: 896858 - protein, 9 aa, Homo Sapiens
IRQLEDRNT

SEQ ID NO: 896859 - protein, 9 aa, Homo Sapiens
TTNILWLSC

SEQ ID NO: 896860 - protein, 9 aa, Homo Sapiens
DKSKIVCVL

SEQ ID NO: 896861 - protein, 9 aa, Homo Sapiens
CYSDASVHE

SEQ ID NO: 896862 - protein, 9 aa, Homo Sapiens
FDKNRLTRD

SEQ ID NO: 896863 - protein, 9 aa, Homo Sapiens
GKKLQNYYA

SEQ ID NO: 896864 - protein, 9 aa, Homo Sapiens
GMEDEDIPF

SEQ ID NO: 896865 - protein, 9 aa, Homo Sapiens
LSKTLGYLS

SEQ ID NO: 896866 - protein, 9 aa, Homo Sapiens
GISSLNELN

SEQ ID NO: 896867 - protein, 9 aa, Homo Sapiens
DHSIFTVEG

SEQ ID NO: 896868 - protein, 9 aa, Homo Sapiens
CADVTINLN

SEQ ID NO: 896869 - protein, 9 aa, Homo Sapiens
EKKKRKKYP

SEQ ID NO: 896870 - protein, 9 aa, Homo Sapiens
CFKDGVQQI

SEQ ID NO: 896871 - protein, 9 aa, Homo Sapiens
IDLNKKENN

SEQ ID NO: 896872 - protein, 9 aa, Homo Sapiens
QIKASSLST

SEQ ID NO: 896873 - protein, 9 aa, Homo Sapiens
APRNLKAYY

SEQ ID NO: 896874 - protein, 9 aa, Homo Sapiens
FLKDNCRPD

SEQ ID NO: 896875 - protein, 9 aa, Homo Sapiens
NNAPEILYP

SEQ ID NO: 896876 - protein, 9 aa, Homo Sapiens
VLSFSETRT

SEQ ID NO: 896877 - protein, 9 aa, Homo Sapiens
IMEPDSLFC

SEQ ID NO: 896878 - protein, 9 aa, Homo Sapiens
FLDIKRICV

SEQ ID NO: 896879 - protein, 9 aa, Homo Sapiens
VLCNFILEN

SEQ ID NO: 896880 - protein, 9 aa, Homo Sapiens
YLSGSLPGM

SEQ ID NO: 896881 - protein, 9 aa, Homo Sapiens
KIQESEVFQ

SEQ ID NO: 896882 - protein, 9 aa, Homo Sapiens
ETTLLSTSV

SEQ ID NO: 896883 - protein, 9 aa, Homo Sapiens
ELQVWDLEP

SEQ ID NO: 896884 - protein, 9 aa, Homo Sapiens
KSKIVCVLN

SEQ ID NO: 896885 - protein, 9 aa, Homo Sapiens
SPYKSKKDL

SEQ ID NO: 896886 - protein, 9 aa, Homo Sapiens
KQWIMLLER

SEQ ID NO: 896887 - protein, 9 aa, Homo Sapiens
GFTEVKLQN

SEQ ID NO: 896888 - protein, 9 aa, Homo Sapiens
VIDTDGLWL

SEQ ID NO: 896889 - protein, 9 aa, Homo Sapiens
SHIFQDLQS

SEQ ID NO: 896890 - protein, 9 aa, Homo Sapiens
LGLLNSLGA

SEQ ID NO: 896891 - protein, 9 aa, Homo Sapiens
NLIMGFNTF

SEQ ID NO: 896892 - protein, 9 aa, Homo Sapiens
INSDDRQPQ

SEQ ID NO: 896893 - protein, 9 aa, Homo Sapiens
LETINKGGV

SEQ ID NO: 896894 - protein, 9 aa, Homo Sapiens
QELMLRHKT

SEQ ID NO: 896895 - protein, 9 aa, Homo Sapiens
KTQKPYKPF

SEQ ID NO: 896896 - protein, 9 aa, Homo Sapiens
LFPESYYGE

SEQ ID NO: 896897 - protein, 9 aa, Homo Sapiens
AKHKKIHTE

SEQ ID NO: 896898 - protein, 9 aa, Homo Sapiens
VDNILLITE

SEQ ID NO: 896899 - protein, 9 aa, Homo Sapiens
SDHENSLEL

SEQ ID NO: 896900 - protein, 9 aa, Homo Sapiens
LDAQRKCLS

SEQ ID NO: 896901 - protein, 9 aa, Homo Sapiens
GDLIKITDA

SEQ ID NO: 896902 - protein, 9 aa, Homo Sapiens
DVEDGKFLF

SEQ ID NO: 896903 - protein, 9 aa, Homo Sapiens
KTFTVCSNL

SEQ ID NO: 896904 - protein, 9 aa, Homo Sapiens
KEDIKTLIL

SEQ ID NO: 896905 - protein, 9 aa, Homo Sapiens
FQKNNGTVW

SEQ ID NO: 896906 - protein, 9 aa, Homo Sapiens
YQRHYDEYS

SEQ ID NO: 896907 - protein, 9 aa, Homo Sapiens
MPRSIHDGV

SEQ ID NO: 896908 - protein, 9 aa, Homo Sapiens
KKCCLNGCG

SEQ ID NO: 896909 - protein, 9 aa, Homo Sapiens
VPYKQLMNE

SEQ ID NO: 896910 - protein, 9 aa, Homo Sapiens
YRDILPYDA

SEQ ID NO: 896911 - protein, 9 aa, Homo Sapiens
LYLQLDIYQ

SEQ ID NO: 896912 - protein, 9 aa, Homo Sapiens
KGNMTLLPE

SEQ ID NO: 896913 - protein, 9 aa, Homo Sapiens
QMVQLHKKL

SEQ ID NO: 896914 - protein, 9 aa, Homo Sapiens
DDKNEIDEN

SEQ ID NO: 896915 - protein, 9 aa, Homo Sapiens
RSASCRNTL

SEQ ID NO: 896916 - protein, 9 aa, Homo Sapiens
LKKYLEEAE

SEQ ID NO: 896917 - protein, 9 aa, Homo Sapiens
FSFDVENGP

SEQ ID NO: 896918 - protein, 9 aa, Homo Sapiens
IRHHQIHTG

SEQ ID NO: 896919 - protein, 9 aa, Homo Sapiens
KQLKEQAAT

SEQ ID NO: 896920 - protein, 9 aa, Homo Sapiens
MLVHDIRQN

SEQ ID NO: 896921 - protein, 9 aa, Homo Sapiens
GGLTEESTW

SEQ ID NO: 896922 - protein, 9 aa, Homo Sapiens
AGKNCMDCV

SEQ ID NO: 896923 - protein, 9 aa, Homo Sapiens
REEIKCDFK

SEQ ID NO: 896924 - protein, 9 aa, Homo Sapiens
GSRHPCITN

SEQ ID NO: 896925 - protein, 9 aa, Homo Sapiens
KTSSFNFCR

SEQ ID NO: 896926 - protein, 9 aa, Homo Sapiens
SVHKIIHNR

SEQ ID NO: 896927 - protein, 9 aa, Homo Sapiens
IITVKQVYF

SEQ ID NO: 896928 - protein, 9 aa, Homo Sapiens
KLCKFFHPF

SEQ ID NO: 896929 - protein, 9 aa, Homo Sapiens
QKELWDAKN

SEQ ID NO: 896930 - protein, 9 aa, Homo Sapiens
QLHKKLGTE

SEQ ID NO: 896931 - protein, 9 aa, Homo Sapiens
KAWWRHVAV

SEQ ID NO: 896932 - protein, 9 aa, Homo Sapiens
IEFPNLDNT

SEQ ID NO: 896933 - protein, 9 aa, Homo Sapiens
DTMQIIFRH

SEQ ID NO: 896934 - protein, 9 aa, Homo Sapiens
KVILVILGE

SEQ ID NO: 896935 - protein, 9 aa, Homo Sapiens
YQPLWEVLP

SEQ ID NO: 896936 - protein, 9 aa, Homo Sapiens
RKLAKDIEE

SEQ ID NO: 896937 - protein, 9 aa, Homo Sapiens
KVTHILSVR

SEQ ID NO: 896938 - protein, 9 aa, Homo Sapiens
YYLDHMEKK

SEQ ID NO: 896939 - protein, 9 aa, Homo Sapiens
NRWEVRVGQ

SEQ ID NO: 896940 - protein, 9 aa, Homo Sapiens
LTYLNLSQN

SEQ ID NO: 896941 - protein, 9 aa, Homo Sapiens
LQVSHRYPQ

SEQ ID NO: 896942 - protein, 9 aa, Homo Sapiens
PSDLHHCFY

SEQ ID NO: 896943 - protein, 9 aa, Homo Sapiens
VNPSKEIKI

SEQ ID NO: 896944 - protein, 9 aa, Homo Sapiens
QESCLIQLW

SEQ ID NO: 896945 - protein, 9 aa, Homo Sapiens
ELPLGPEPL

SEQ ID NO: 896946 - protein, 9 aa, Homo Sapiens
KDEEFQQTK

SEQ ID NO: 896947 - protein, 9 aa, Homo Sapiens
WFIRKNKPF

SEQ ID NO: 896948 - protein, 9 aa, Homo Sapiens
NIAAIKSFK

SEQ ID NO: 896949 - protein, 9 aa, Homo Sapiens
KLHYQLTEH

SEQ ID NO: 896950 - protein, 9 aa, Homo Sapiens
MENISDNVI

SEQ ID NO: 896951 - protein, 9 aa, Homo Sapiens
EIAWVSTLP

SEQ ID NO: 896952 - protein, 9 aa, Homo Sapiens
TFQFCAHCR

SEQ ID NO: 896953 - protein, 9 aa, Homo Sapiens
EEKTILLCI

SEQ ID NO: 896954 - protein, 9 aa, Homo Sapiens
GTPGTWGPR

SEQ ID NO: 896955 - protein, 9 aa, Homo Sapiens
GCPAVKKQD

SEQ ID NO: 896956 - protein, 9 aa, Homo Sapiens
HRPQTCILL

SEQ ID NO: 896957 - protein, 9 aa, Homo Sapiens
QPVSTVWGT

SEQ ID NO: 896958 - protein, 9 aa, Homo Sapiens
KRRHQRQSG

SEQ ID NO: 896959 - protein, 9 aa, Homo Sapiens
HEITYVRLK

SEQ ID NO: 896960 - protein, 9 aa, Homo Sapiens
VHFSYPSQK

SEQ ID NO: 896961 - protein, 9 aa, Homo Sapiens
CRYLRYILK

SEQ ID NO: 896962 - protein, 9 aa, Homo Sapiens
QQLSDNSLD

SEQ ID NO: 896963 - protein, 9 aa, Homo Sapiens
RCREIKQVN

SEQ ID NO: 896964 - protein, 9 aa, Homo Sapiens
RRFLKDNCR

SEQ ID NO: 896965 - protein, 9 aa, Homo Sapiens
DTGVCRRQE

SEQ ID NO: 896966 - protein, 9 aa, Homo Sapiens
DVLLWASEL

SEQ ID NO: 896967 - protein, 9 aa, Homo Sapiens
GGETICSIC

SEQ ID NO: 896968 - protein, 9 aa, Homo Sapiens
CIYGLVIYC

SEQ ID NO: 896969 - protein, 9 aa, Homo Sapiens
NKIEDASEP

SEQ ID NO: 896970 - protein, 9 aa, Homo Sapiens
PGEDPRFKI

SEQ ID NO: 896971 - protein, 9 aa, Homo Sapiens
AVTDFQTRL

SEQ ID NO: 896972 - protein, 9 aa, Homo Sapiens
TGNCDGFNV

SEQ ID NO: 896973 - protein, 9 aa, Homo Sapiens
SNNICTIEE

SEQ ID NO: 896974 - protein, 9 aa, Homo Sapiens
PLHYTALMH

SEQ ID NO: 896975 - protein, 9 aa, Homo Sapiens
ATAAAAMAT

SEQ ID NO: 896976 - protein, 9 aa, Homo Sapiens
PSAETQSSS

SEQ ID NO: 896977 - protein, 9 aa, Homo Sapiens
ETIVMAYFF

SEQ ID NO: 896978 - protein, 9 aa, Homo Sapiens
YSVGRPNKE

SEQ ID NO: 896979 - protein, 9 aa, Homo Sapiens
QKGIDYYNT

SEQ ID NO: 896980 - protein, 9 aa, Homo Sapiens
NKLHPQQVL

SEQ ID NO: 896981 - protein, 9 aa, Homo Sapiens
YLDGGVQTG

SEQ ID NO: 896982 - protein, 9 aa, Homo Sapiens
LRELFGKDA

SEQ ID NO: 896983 - protein, 9 aa, Homo Sapiens
YLWNLAKSL

SEQ ID NO: 896984 - protein, 9 aa, Homo Sapiens
KYTQTPWRQ

SEQ ID NO: 896985 - protein, 9 aa, Homo Sapiens
TNNWRPQLL

SEQ ID NO: 896986 - protein, 9 aa, Homo Sapiens
ACCNYSLHV

SEQ ID NO: 896987 - protein, 9 aa, Homo Sapiens
KGLLYETAE

SEQ ID NO: 896988 - protein, 9 aa, Homo Sapiens
CLLPQVDTT

SEQ ID NO: 896989 - protein, 9 aa, Homo Sapiens
FKKTKIDYL

SEQ ID NO: 896990 - protein, 9 aa, Homo Sapiens
IGMPVATKM

SEQ ID NO: 896991 - protein, 9 aa, Homo Sapiens
TNMISIFEP

SEQ ID NO: 896992 - protein, 9 aa, Homo Sapiens
GQLQALMLQ

SEQ ID NO: 896993 - protein, 9 aa, Homo Sapiens
IEREFLFEL

SEQ ID NO: 896994 - protein, 9 aa, Homo Sapiens
TSDIHRDLD

SEQ ID NO: 896995 - protein, 9 aa, Homo Sapiens
GTNPLVFLL

SEQ ID NO: 896996 - protein, 9 aa, Homo Sapiens
AEEEVKNKI

SEQ ID NO: 896997 - protein, 9 aa, Homo Sapiens
EILELLGSR

SEQ ID NO: 896998 - protein, 9 aa, Homo Sapiens
KTPSKSNSP

SEQ ID NO: 896999 - protein, 9 aa, Homo Sapiens
KKQDNYIPD

SEQ ID NO: 897000 - protein, 9 aa, Homo Sapiens
CLHGNKSIS

SEQ ID NO: 897001 - protein, 9 aa, Homo Sapiens
DHLALYDFV

SEQ ID NO: 897002 - protein, 9 aa, Homo Sapiens
HGHKHELLT

SEQ ID NO: 897003 - protein, 9 aa, Homo Sapiens
LYGLDLDCG

SEQ ID NO: 897004 - protein, 9 aa, Homo Sapiens
GPRGTPGTW

SEQ ID NO: 897005 - protein, 9 aa, Homo Sapiens
NPQTGACFC

SEQ ID NO: 897006 - protein, 9 aa, Homo Sapiens
SCNKEGSKQ

SEQ ID NO: 897007 - protein, 9 aa, Homo Sapiens
TEFEILLPH

SEQ ID NO: 897008 - protein, 9 aa, Homo Sapiens
KVEANVSLS

SEQ ID NO: 897009 - protein, 9 aa, Homo Sapiens
HLLLIQNDY

SEQ ID NO: 897010 - protein, 9 aa, Homo Sapiens
LNGQKPLGT

SEQ ID NO: 897011 - protein, 9 aa, Homo Sapiens
SPLWNGNSC

SEQ ID NO: 897012 - protein, 9 aa, Homo Sapiens
YVECLSDSS

SEQ ID NO: 897013 - protein, 9 aa, Homo Sapiens
RSFTNMSSM

SEQ ID NO: 897014 - protein, 9 aa, Homo Sapiens
QIICPGEES

SEQ ID NO: 897015 - protein, 9 aa, Homo Sapiens
YCCMASELV

SEQ ID NO: 897016 - protein, 9 aa, Homo Sapiens
SFSTLIMWC

SEQ ID NO: 897017 - protein, 9 aa, Homo Sapiens
KGSAKVAEL

SEQ ID NO: 897018 - protein, 9 aa, Homo Sapiens
LFISLPLIC

SEQ ID NO: 897019 - protein, 9 aa, Homo Sapiens
FYGGKPILI

SEQ ID NO: 897020 - protein, 9 aa, Homo Sapiens
NRNKYLELK

SEQ ID NO: 897021 - protein, 9 aa, Homo Sapiens
IPETCEQAL

SEQ ID NO: 897022 - protein, 9 aa, Homo Sapiens
LQKYFDVCA

SEQ ID NO: 897023 - protein, 9 aa, Homo Sapiens
LYVPKGFNK

SEQ ID NO: 897024 - protein, 9 aa, Homo Sapiens
ILNQHFCKN

SEQ ID NO: 897025 - protein, 9 aa, Homo Sapiens
RQIKKWNKA

SEQ ID NO: 897026 - protein, 9 aa, Homo Sapiens
QHFCKNHPG

SEQ ID NO: 897027 - protein, 9 aa, Homo Sapiens
SELSDSGLE

SEQ ID NO: 897028 - protein, 9 aa, Homo Sapiens
KFLFNTKEE

SEQ ID NO: 897029 - protein, 9 aa, Homo Sapiens
LCRLSGLSS

SEQ ID NO: 897030 - protein, 9 aa, Homo Sapiens
CQMPGKGLE

SEQ ID NO: 897031 - protein, 9 aa, Homo Sapiens
METGKGAST

SEQ ID NO: 897032 - protein, 9 aa, Homo Sapiens
EQDIKIMME

SEQ ID NO: 897033 - protein, 9 aa, Homo Sapiens
EEDHHWPAD

SEQ ID NO: 897034 - protein, 9 aa, Homo Sapiens
QQMEQETQR

SEQ ID NO: 897035 - protein, 9 aa, Homo Sapiens
DDLGTAFQT

SEQ ID NO: 897036 - protein, 9 aa, Homo Sapiens
EGCKAMQRN

SEQ ID NO: 897037 - protein, 9 aa, Homo Sapiens
ETRYHNEIK

SEQ ID NO: 897038 - protein, 9 aa, Homo Sapiens
PRRSCRQLP

SEQ ID NO: 897039 - protein, 9 aa, Homo Sapiens
LVGVACAIS

SEQ ID NO: 897040 - protein, 9 aa, Homo Sapiens
KNIKLFFSG

SEQ ID NO: 897041 - protein, 9 aa, Homo Sapiens
RYLEWSNIK

SEQ ID NO: 897042 - protein, 9 aa, Homo Sapiens
VYSYLWTCP

SEQ ID NO: 897043 - protein, 9 aa, Homo Sapiens
YRLPINIAR

SEQ ID NO: 897044 - protein, 9 aa, Homo Sapiens
EGFKLHFWR

SEQ ID NO: 897045 - protein, 9 aa, Homo Sapiens
EGQNCIHLE

SEQ ID NO: 897046 - protein, 9 aa, Homo Sapiens
KCFDNKLKT

SEQ ID NO: 897047 - protein, 9 aa, Homo Sapiens
LGDTGRIGQ

SEQ ID NO: 897048 - protein, 9 aa, Homo Sapiens
NIAGTSDKR

SEQ ID NO: 897049 - protein, 9 aa, Homo Sapiens
RNPDLQKKI

SEQ ID NO: 897050 - protein, 9 aa, Homo Sapiens
FFCDVSSDV

SEQ ID NO: 897051 - protein, 9 aa, Homo Sapiens
LKRQSHFQA

SEQ ID NO: 897052 - protein, 9 aa, Homo Sapiens
RMLLHFGQM

SEQ ID NO: 897053 - protein, 9 aa, Homo Sapiens
MIQKENACD

SEQ ID NO: 897054 - protein, 9 aa, Homo Sapiens
SLYVPSLYF

SEQ ID NO: 897055 - protein, 9 aa, Homo Sapiens
STAKFTHYK

SEQ ID NO: 897056 - protein, 9 aa, Homo Sapiens
RGGTLLFCT

SEQ ID NO: 897057 - protein, 9 aa, Homo Sapiens
DQVACNASI

SEQ ID NO: 897058 - protein, 9 aa, Homo Sapiens
LTTAAAATK

SEQ ID NO: 897059 - protein, 9 aa, Homo Sapiens
IIYQMDDVY

SEQ ID NO: 897060 - protein, 9 aa, Homo Sapiens
NVINNPQFV

SEQ ID NO: 897061 - protein, 9 aa, Homo Sapiens
VFSGGRDTI

SEQ ID NO: 897062 - protein, 9 aa, Homo Sapiens
IRLIGTTLG

SEQ ID NO: 897063 - protein, 9 aa, Homo Sapiens
YIQIHTGIK

SEQ ID NO: 897064 - protein, 9 aa, Homo Sapiens
LKDSGACKI

SEQ ID NO: 897065 - protein, 9 aa, Homo Sapiens
KDDKLQNRP

SEQ ID NO: 897066 - protein, 9 aa, Homo Sapiens
DYYQSNEFI

SEQ ID NO: 897067 - protein, 9 aa, Homo Sapiens
ELCETNAQM

SEQ ID NO: 897068 - protein, 9 aa, Homo Sapiens
NKAQDNTWK

SEQ ID NO: 897069 - protein, 9 aa, Homo Sapiens
APVTRASKG

SEQ ID NO: 897070 - protein, 9 aa, Homo Sapiens
TTLHSAPAF

SEQ ID NO: 897071 - protein, 9 aa, Homo Sapiens
LNVAYLDVC

SEQ ID NO: 897072 - protein, 9 aa, Homo Sapiens
RTVGIAYSN

SEQ ID NO: 897073 - protein, 9 aa, Homo Sapiens
IANLIKIKL

SEQ ID NO: 897074 - protein, 9 aa, Homo Sapiens
LENVYSDDL

SEQ ID NO: 897075 - protein, 9 aa, Homo Sapiens
VNVINNPQF

SEQ ID NO: 897076 - protein, 9 aa, Homo Sapiens
TNIRIMEPD

SEQ ID NO: 897077 - protein, 9 aa, Homo Sapiens
PTRFLCSQQ

SEQ ID NO: 897078 - protein, 9 aa, Homo Sapiens
YPKRRSCQT

SEQ ID NO: 897079 - protein, 9 aa, Homo Sapiens
WNFLLAVVC

SEQ ID NO: 897080 - protein, 9 aa, Homo Sapiens
KGQMTNLYH

SEQ ID NO: 897081 - protein, 9 aa, Homo Sapiens
SDAGPSDLH

SEQ ID NO: 897082 - protein, 9 aa, Homo Sapiens
QKLTEISQR

SEQ ID NO: 897083 - protein, 9 aa, Homo Sapiens
ADRLDVLKK

SEQ ID NO: 897084 - protein, 9 aa, Homo Sapiens
IVYQITTAA

SEQ ID NO: 897085 - protein, 9 aa, Homo Sapiens
VETTKDHSI

SEQ ID NO: 897086 - protein, 9 aa, Homo Sapiens
MMSFVPNAS

SEQ ID NO: 897087 - protein, 9 aa, Homo Sapiens
YGHDLTSVQ

SEQ ID NO: 897088 - protein, 9 aa, Homo Sapiens
LQKLDEYLK

SEQ ID NO: 897089 - protein, 9 aa, Homo Sapiens
AVTLKNFLH

SEQ ID NO: 897090 - protein, 9 aa, Homo Sapiens
MNKTNIRIM

SEQ ID NO: 897091 - protein, 9 aa, Homo Sapiens
DIIKKGSSS

SEQ ID NO: 897092 - protein, 9 aa, Homo Sapiens
KVFDSRFTE

SEQ ID NO: 897093 - protein, 9 aa, Homo Sapiens
WRIHSGEKP

SEQ ID NO: 897094 - protein, 9 aa, Homo Sapiens
KWRKVSGVS

SEQ ID NO: 897095 - protein, 9 aa, Homo Sapiens
RDDNDHSLW

SEQ ID NO: 897096 - protein, 9 aa, Homo Sapiens
EEWGPFNLV

SEQ ID NO: 897097 - protein, 9 aa, Homo Sapiens
RSNVIHQLF

SEQ ID NO: 897098 - protein, 9 aa, Homo Sapiens
LINLSTTLS

SEQ ID NO: 897099 - protein, 9 aa, Homo Sapiens
NGVDYSDSA

SEQ ID NO: 897100 - protein, 9 aa, Homo Sapiens
VRERQENLK

SEQ ID NO: 897101 - protein, 9 aa, Homo Sapiens
PRALTLATV

SEQ ID NO: 897102 - protein, 9 aa, Homo Sapiens
KIVVKREVN

SEQ ID NO: 897103 - protein, 9 aa, Homo Sapiens
ANYCQCHFC

SEQ ID NO: 897104 - protein, 9 aa, Homo Sapiens
HIPLKTQND

SEQ ID NO: 897105 - protein, 9 aa, Homo Sapiens
SCVQRRLEI

SEQ ID NO: 897106 - protein, 9 aa, Homo Sapiens
DTLVVLPPV

SEQ ID NO: 897107 - protein, 9 aa, Homo Sapiens
LHSGEWANA

SEQ ID NO: 897108 - protein, 9 aa, Homo Sapiens
ENLGAHIKK

SEQ ID NO: 897109 - protein, 9 aa, Homo Sapiens
AHHIVETTY

SEQ ID NO: 897110 - protein, 9 aa, Homo Sapiens
FCDPQMCFD

SEQ ID NO: 897111 - protein, 9 aa, Homo Sapiens
KLKKGLRKY

SEQ ID NO: 897112 - protein, 9 aa, Homo Sapiens
TKEMATNNP

SEQ ID NO: 897113 - protein, 9 aa, Homo Sapiens
SVQFLKSTD

SEQ ID NO: 897114 - protein, 9 aa, Homo Sapiens
ACIALVSVC

SEQ ID NO: 897115 - protein, 9 aa, Homo Sapiens
PQDHDTNLT

SEQ ID NO: 897116 - protein, 9 aa, Homo Sapiens
KEKRYLRNF

SEQ ID NO: 897117 - protein, 9 aa, Homo Sapiens
LCFLCKLKE

SEQ ID NO: 897118 - protein, 9 aa, Homo Sapiens
KFTGDPHQF

SEQ ID NO: 897119 - protein, 9 aa, Homo Sapiens
LGHLVYLLT

SEQ ID NO: 897120 - protein, 9 aa, Homo Sapiens
INAAVKDTQ

SEQ ID NO: 897121 - protein, 9 aa, Homo Sapiens
YILHSKFIW

SEQ ID NO: 897122 - protein, 9 aa, Homo Sapiens
EVKNKISES

SEQ ID NO: 897123 - protein, 9 aa, Homo Sapiens
AIDGSGLQM

SEQ ID NO: 897124 - protein, 9 aa, Homo Sapiens
GGVQTGNDV

SEQ ID NO: 897125 - protein, 9 aa, Homo Sapiens
NKNRNAVPE

SEQ ID NO: 897126 - protein, 9 aa, Homo Sapiens
LTSLGILFR

SEQ ID NO: 897127 - protein, 9 aa, Homo Sapiens
AVQLDNVFR

SEQ ID NO: 897128 - protein, 9 aa, Homo Sapiens
PSSHELALA

SEQ ID NO: 897129 - protein, 9 aa, Homo Sapiens
VGLFLLQGA

SEQ ID NO: 897130 - protein, 9 aa, Homo Sapiens
CPGRSQTPG

SEQ ID NO: 897131 - protein, 9 aa, Homo Sapiens
CFRNMELKL

SEQ ID NO: 897132 - protein, 9 aa, Homo Sapiens
KEDQCKINK

SEQ ID NO: 897133 - protein, 9 aa, Homo Sapiens
FQSDNLVIH

SEQ ID NO: 897134 - protein, 9 aa, Homo Sapiens
DDKEEWPSL

SEQ ID NO: 897135 - protein, 9 aa, Homo Sapiens
KWRKEFAVL

SEQ ID NO: 897136 - protein, 9 aa, Homo Sapiens
NLREFWLYD

SEQ ID NO: 897137 - protein, 9 aa, Homo Sapiens
LTNIDISNN

SEQ ID NO: 897138 - protein, 9 aa, Homo Sapiens
LKYLDQRLK

SEQ ID NO: 897139 - protein, 9 aa, Homo Sapiens
GQVSLKASN

SEQ ID NO: 897140 - protein, 9 aa, Homo Sapiens
PSYVKKKKR

SEQ ID NO: 897141 - protein, 9 aa, Homo Sapiens
GIAFLYNLY

SEQ ID NO: 897142 - protein, 9 aa, Homo Sapiens
YHILSQLQA

SEQ ID NO: 897143 - protein, 9 aa, Homo Sapiens
ERSTRSALR

SEQ ID NO: 897144 - protein, 9 aa, Homo Sapiens
EQDNASLES

SEQ ID NO: 897145 - protein, 9 aa, Homo Sapiens
TDADPHNAH

SEQ ID NO: 897146 - protein, 9 aa, Homo Sapiens
GEQDGICSS

SEQ ID NO: 897147 - protein, 9 aa, Homo Sapiens
RSGKCFKTL

SEQ ID NO: 897148 - protein, 9 aa, Homo Sapiens
LQNHMAVAF

SEQ ID NO: 897149 - protein, 9 aa, Homo Sapiens
SESLLARAC

SEQ ID NO: 897150 - protein, 9 aa, Homo Sapiens
DGWMEAMQN

SEQ ID NO: 897151 - protein, 9 aa, Homo Sapiens
DYPVKAVAV

SEQ ID NO: 897152 - protein, 9 aa, Homo Sapiens
QGSYFGVIP

SEQ ID NO: 897153 - protein, 9 aa, Homo Sapiens
VCIAHSNVG

SEQ ID NO: 897154 - protein, 9 aa, Homo Sapiens
KNEQFLLHL

SEQ ID NO: 897155 - protein, 9 aa, Homo Sapiens
FPNNQEIEA

SEQ ID NO: 897156 - protein, 9 aa, Homo Sapiens
AALAREFDQ

SEQ ID NO: 897157 - protein, 9 aa, Homo Sapiens
LDIKTQLEQ

SEQ ID NO: 897158 - protein, 9 aa, Homo Sapiens
SVSGICIKI

SEQ ID NO: 897159 - protein, 9 aa, Homo Sapiens
MITYMLNPL

SEQ ID NO: 897160 - protein, 9 aa, Homo Sapiens
PSSAVCMHN

SEQ ID NO: 897161 - protein, 9 aa, Homo Sapiens
SSDSLQYVQ

SEQ ID NO: 897162 - protein, 9 aa, Homo Sapiens
PNNYFTNSV

SEQ ID NO: 897163 - protein, 9 aa, Homo Sapiens
KARCLIHSL

SEQ ID NO: 897164 - protein, 9 aa, Homo Sapiens
VLANLTTCN

SEQ ID NO: 897165 - protein, 9 aa, Homo Sapiens
NKWTGETGK

SEQ ID NO: 897166 - protein, 9 aa, Homo Sapiens
GHLPKYKQV

SEQ ID NO: 897167 - protein, 9 aa, Homo Sapiens
PLGLCALDY

SEQ ID NO: 897168 - protein, 9 aa, Homo Sapiens
TVATEELLS

SEQ ID NO: 897169 - protein, 9 aa, Homo Sapiens
LCCQSFKWY

SEQ ID NO: 897170 - protein, 9 aa, Homo Sapiens
AVGVLSHTK

SEQ ID NO: 897171 - protein, 9 aa, Homo Sapiens
KLLGHLTSH

SEQ ID NO: 897172 - protein, 9 aa, Homo Sapiens
VAIQNFLAL

SEQ ID NO: 897173 - protein, 9 aa, Homo Sapiens
QENMNLLLD

SEQ ID NO: 897174 - protein, 9 aa, Homo Sapiens
AISAPSIYA

SEQ ID NO: 897175 - protein, 9 aa, Homo Sapiens
GHADACNAK

SEQ ID NO: 897176 - protein, 9 aa, Homo Sapiens
PYARPIFLC

SEQ ID NO: 897177 - protein, 9 aa, Homo Sapiens
YLNSSGSYW

SEQ ID NO: 897178 - protein, 9 aa, Homo Sapiens
TDPKKEGPV

SEQ ID NO: 897179 - protein, 9 aa, Homo Sapiens
AEGDENKPT

SEQ ID NO: 897180 - protein, 9 aa, Homo Sapiens
VSDLEYRIS

SEQ ID NO: 897181 - protein, 9 aa, Homo Sapiens
GDAQVVLLG

SEQ ID NO: 897182 - protein, 9 aa, Homo Sapiens
QTTAGCNYL

SEQ ID NO: 897183 - protein, 9 aa, Homo Sapiens
GDVDTHAEM

SEQ ID NO: 897184 - protein, 9 aa, Homo Sapiens
KPKYVYKNR

SEQ ID NO: 897185 - protein, 9 aa, Homo Sapiens
VEYKRGGQR

SEQ ID NO: 897186 - protein, 9 aa, Homo Sapiens
EEMARLEGE

SEQ ID NO: 897187 - protein, 9 aa, Homo Sapiens
LCTKTENSR

SEQ ID NO: 897188 - protein, 9 aa, Homo Sapiens
VSLSAVRTV

SEQ ID NO: 897189 - protein, 9 aa, Homo Sapiens
LRLQHISQS

SEQ ID NO: 897190 - protein, 9 aa, Homo Sapiens
LEQKTLSPQ

SEQ ID NO: 897191 - protein, 9 aa, Homo Sapiens
ETELSSSSS

SEQ ID NO: 897192 - protein, 9 aa, Homo Sapiens
FGSTLLCFD

SEQ ID NO: 897193 - protein, 9 aa, Homo Sapiens
LVHKGYKFM

SEQ ID NO: 897194 - protein, 9 aa, Homo Sapiens
HVAEQNSTA

SEQ ID NO: 897195 - protein, 9 aa, Homo Sapiens
AANTVKFCC

SEQ ID NO: 897196 - protein, 9 aa, Homo Sapiens
DVQKHASLK

SEQ ID NO: 897197 - protein, 9 aa, Homo Sapiens
DCVLLHVDV

SEQ ID NO: 897198 - protein, 9 aa, Homo Sapiens
ATVKVHPKY

SEQ ID NO: 897199 - protein, 9 aa, Homo Sapiens
FLPIQALPF

SEQ ID NO: 897200 - protein, 9 aa, Homo Sapiens
KYWLSENSK

SEQ ID NO: 897201 - protein, 9 aa, Homo Sapiens
NLKAMEKMV

SEQ ID NO: 897202 - protein, 9 aa, Homo Sapiens
RLSFHGRHS

SEQ ID NO: 897203 - protein, 9 aa, Homo Sapiens
NRFNLRFEE

SEQ ID NO: 897204 - protein, 9 aa, Homo Sapiens
PSLYKAMVL

SEQ ID NO: 897205 - protein, 9 aa, Homo Sapiens
RICPGNTYH

SEQ ID NO: 897206 - protein, 9 aa, Homo Sapiens
GLIQKYNTG

SEQ ID NO: 897207 - protein, 9 aa, Homo Sapiens
AGSVKLSVC

SEQ ID NO: 897208 - protein, 9 aa, Homo Sapiens
NYQDDAKLA

SEQ ID NO: 897209 - protein, 9 aa, Homo Sapiens
HNKHLAGVL

SEQ ID NO: 897210 - protein, 9 aa, Homo Sapiens
QTDLKEISV

SEQ ID NO: 897211 - protein, 9 aa, Homo Sapiens
RIELSEFIQ

SEQ ID NO: 897212 - protein, 9 aa, Homo Sapiens
LRQNQKTPT

SEQ ID NO: 897213 - protein, 9 aa, Homo Sapiens
KEESKLKIS

SEQ ID NO: 897214 - protein, 9 aa, Homo Sapiens
EMLPQELQL

SEQ ID NO: 897215 - protein, 9 aa, Homo Sapiens
LSALRQYAA

SEQ ID NO: 897216 - protein, 9 aa, Homo Sapiens
KLVKHHSST

SEQ ID NO: 897217 - protein, 9 aa, Homo Sapiens
HSLLRREPS

SEQ ID NO: 897218 - protein, 9 aa, Homo Sapiens
MSERSKVIH

SEQ ID NO: 897219 - protein, 9 aa, Homo Sapiens
ELLQVLHMM

SEQ ID NO: 897220 - protein, 9 aa, Homo Sapiens
VICQGDTSK

SEQ ID NO: 897221 - protein, 9 aa, Homo Sapiens
CDPGFSGKL

SEQ ID NO: 897222 - protein, 9 aa, Homo Sapiens
INSTLVKIT

SEQ ID NO: 897223 - protein, 9 aa, Homo Sapiens
DSIHYITRH

SEQ ID NO: 897224 - protein, 9 aa, Homo Sapiens
MASDCLHGN

SEQ ID NO: 897225 - protein, 9 aa, Homo Sapiens
QMEQETQRK

SEQ ID NO: 897226 - protein, 9 aa, Homo Sapiens
EQSIKDYFQ

SEQ ID NO: 897227 - protein, 9 aa, Homo Sapiens
TAKWVLLDQ

SEQ ID NO: 897228 - protein, 9 aa, Homo Sapiens
PEPDHLEEQ

SEQ ID NO: 897229 - protein, 9 aa, Homo Sapiens
NKKEENARL

SEQ ID NO: 897230 - protein, 9 aa, Homo Sapiens
SLNELNPMG

SEQ ID NO: 897231 - protein, 9 aa, Homo Sapiens
RRNQCQYCR

SEQ ID NO: 897232 - protein, 9 aa, Homo Sapiens
LFYFIPSQL

SEQ ID NO: 897233 - protein, 9 aa, Homo Sapiens
NSSSNKWTG

SEQ ID NO: 897234 - protein, 9 aa, Homo Sapiens
CLQFLTCVF

SEQ ID NO: 897235 - protein, 9 aa, Homo Sapiens
TDNHDCSQG

SEQ ID NO: 897236 - protein, 9 aa, Homo Sapiens
VFPKGNKVQ

SEQ ID NO: 897237 - protein, 9 aa, Homo Sapiens
VCIQKFKRK

SEQ ID NO: 897238 - protein, 9 aa, Homo Sapiens
LNGHEKDTM

SEQ ID NO: 897239 - protein, 9 aa, Homo Sapiens
GDNYDTPPI

SEQ ID NO: 897240 - protein, 9 aa, Homo Sapiens
IKWGLPGTK

SEQ ID NO: 897241 - protein, 9 aa, Homo Sapiens
GDAKLERLT

SEQ ID NO: 897242 - protein, 9 aa, Homo Sapiens
TDSFSHRQL

SEQ ID NO: 897243 - protein, 9 aa, Homo Sapiens
ANLMGLAEE

SEQ ID NO: 897244 - protein, 9 aa, Homo Sapiens
SQEEWILLD

SEQ ID NO: 897245 - protein, 9 aa, Homo Sapiens
LDNLEIYTF

SEQ ID NO: 897246 - protein, 9 aa, Homo Sapiens
LWILQFNSQ

SEQ ID NO: 897247 - protein, 9 aa, Homo Sapiens
KITANLFQI

SEQ ID NO: 897248 - protein, 9 aa, Homo Sapiens
TRSAAENAA

SEQ ID NO: 897249 - protein, 9 aa, Homo Sapiens
ANRIRKYQI

SEQ ID NO: 897250 - protein, 9 aa, Homo Sapiens
LYVPSLYFT

SEQ ID NO: 897251 - protein, 9 aa, Homo Sapiens
GGAKKAAED

SEQ ID NO: 897252 - protein, 9 aa, Homo Sapiens
LLPIREEDH

SEQ ID NO: 897253 - protein, 9 aa, Homo Sapiens
LYEAVNNYI

SEQ ID NO: 897254 - protein, 9 aa, Homo Sapiens
VVKDVSVRL

SEQ ID NO: 897255 - protein, 9 aa, Homo Sapiens
SFAFEKLIH

SEQ ID NO: 897256 - protein, 9 aa, Homo Sapiens
GDYDKVKTM

SEQ ID NO: 897257 - protein, 9 aa, Homo Sapiens
TESQDNTPG

SEQ ID NO: 897258 - protein, 9 aa, Homo Sapiens
ISELIEQNQ

SEQ ID NO: 897259 - protein, 9 aa, Homo Sapiens
EDKKRQLQE

SEQ ID NO: 897260 - protein, 9 aa, Homo Sapiens
GNPNHDGNY

SEQ ID NO: 897261 - protein, 9 aa, Homo Sapiens
QMETVSNAS

SEQ ID NO: 897262 - protein, 9 aa, Homo Sapiens
HTSIWLLQT

SEQ ID NO: 897263 - protein, 9 aa, Homo Sapiens
NYWIWENPN

SEQ ID NO: 897264 - protein, 9 aa, Homo Sapiens
QLNSEGKIS

SEQ ID NO: 897265 - protein, 9 aa, Homo Sapiens
TTVNPDCIK

SEQ ID NO: 897266 - protein, 9 aa, Homo Sapiens
KVTGRCNGQ

SEQ ID NO: 897267 - protein, 9 aa, Homo Sapiens
YKSFTNAIQ

SEQ ID NO: 897268 - protein, 9 aa, Homo Sapiens
DSCVQRRLE

SEQ ID NO: 897269 - protein, 9 aa, Homo Sapiens
LPHLHINND

SEQ ID NO: 897270 - protein, 9 aa, Homo Sapiens
PIYRLLLGL

SEQ ID NO: 897271 - protein, 9 aa, Homo Sapiens
MKRGLHKLI

SEQ ID NO: 897272 - protein, 9 aa, Homo Sapiens
PTESQDNTP

SEQ ID NO: 897273 - protein, 9 aa, Homo Sapiens
LHLLKFCRE

SEQ ID NO: 897274 - protein, 9 aa, Homo Sapiens
RQLFQSHDY

SEQ ID NO: 897275 - protein, 9 aa, Homo Sapiens
EPEYVPWMA

SEQ ID NO: 897276 - protein, 9 aa, Homo Sapiens
QTAIEGNFL

SEQ ID NO: 897277 - protein, 9 aa, Homo Sapiens
CGKAFKLHY

SEQ ID NO: 897278 - protein, 9 aa, Homo Sapiens
LSVEEKNKI

SEQ ID NO: 897279 - protein, 9 aa, Homo Sapiens
SAFLPVFYT

SEQ ID NO: 897280 - protein, 9 aa, Homo Sapiens
AKPDNFITQ

SEQ ID NO: 897281 - protein, 9 aa, Homo Sapiens
IEALRPSNQ

SEQ ID NO: 897282 - protein, 9 aa, Homo Sapiens
ISMCLIFLW

SEQ ID NO: 897283 - protein, 9 aa, Homo Sapiens
MSELSGCTP

SEQ ID NO: 897284 - protein, 9 aa, Homo Sapiens
DRLGRTALI

SEQ ID NO: 897285 - protein, 9 aa, Homo Sapiens
LLAVILAIV

SEQ ID NO: 897286 - protein, 9 aa, Homo Sapiens
LSTHSPFQT

SEQ ID NO: 897287 - protein, 9 aa, Homo Sapiens
VATYIHLGF

SEQ ID NO: 897288 - protein, 9 aa, Homo Sapiens
SNQTLNLFF

SEQ ID NO: 897289 - protein, 9 aa, Homo Sapiens
KSKITATTT

SEQ ID NO: 897290 - protein, 9 aa, Homo Sapiens
TSIEQDKER

SEQ ID NO: 897291 - protein, 9 aa, Homo Sapiens
SVPEGPFSR

SEQ ID NO: 897292 - protein, 9 aa, Homo Sapiens
KLNNGRWHC

SEQ ID NO: 897293 - protein, 9 aa, Homo Sapiens
WLFLDQHML

SEQ ID NO: 897294 - protein, 9 aa, Homo Sapiens
LVNIVRAYN

SEQ ID NO: 897295 - protein, 9 aa, Homo Sapiens
PKIYALMPS

SEQ ID NO: 897296 - protein, 9 aa, Homo Sapiens
QHHIGDRSL

SEQ ID NO: 897297 - protein, 9 aa, Homo Sapiens
TDLLSLQGV

SEQ ID NO: 897298 - protein, 9 aa, Homo Sapiens
DFASELTAG

SEQ ID NO: 897299 - protein, 9 aa, Homo Sapiens
KEGEKMKIA

SEQ ID NO: 897300 - protein, 9 aa, Homo Sapiens
AVNKYFKLP

SEQ ID NO: 897301 - protein, 9 aa, Homo Sapiens
LDWLATALA

SEQ ID NO: 897302 - protein, 9 aa, Homo Sapiens
LTRKHSDGR

SEQ ID NO: 897303 - protein, 9 aa, Homo Sapiens
LLIALEGNI

SEQ ID NO: 897304 - protein, 9 aa, Homo Sapiens
NSIMVMKIN

SEQ ID NO: 897305 - protein, 9 aa, Homo Sapiens
ISTIKTDLD

SEQ ID NO: 897306 - protein, 9 aa, Homo Sapiens
TDTGKENKG

SEQ ID NO: 897307 - protein, 9 aa, Homo Sapiens
DKDDHLLSP

SEQ ID NO: 897308 - protein, 9 aa, Homo Sapiens
NEHLHQLTL

SEQ ID NO: 897309 - protein, 9 aa, Homo Sapiens
PDAKPVCCK

SEQ ID NO: 897310 - protein, 9 aa, Homo Sapiens
ASGAGFQSN

SEQ ID NO: 897311 - protein, 9 aa, Homo Sapiens
VETLVKYLD

SEQ ID NO: 897312 - protein, 9 aa, Homo Sapiens
RLKHKRDLN

SEQ ID NO: 897313 - protein, 9 aa, Homo Sapiens
SRQTRIRGG

SEQ ID NO: 897314 - protein, 9 aa, Homo Sapiens
YKLVQYAGN

SEQ ID NO: 897315 - protein, 9 aa, Homo Sapiens
EMNIELIRN

SEQ ID NO: 897316 - protein, 9 aa, Homo Sapiens
PPELLCIHG

SEQ ID NO: 897317 - protein, 9 aa, Homo Sapiens
RQLPDIYPN

SEQ ID NO: 897318 - protein, 9 aa, Homo Sapiens
LAMNLCTLI

SEQ ID NO: 897319 - protein, 9 aa, Homo Sapiens
INKQNLTLR

SEQ ID NO: 897320 - protein, 9 aa, Homo Sapiens
LMASELDDN

SEQ ID NO: 897321 - protein, 9 aa, Homo Sapiens
IYYSFDVKY

SEQ ID NO: 897322 - protein, 9 aa, Homo Sapiens
FLNIDKLQS

SEQ ID NO: 897323 - protein, 9 aa, Homo Sapiens
YLHHCEHLL

SEQ ID NO: 897324 - protein, 9 aa, Homo Sapiens
VKVKVQVNV

SEQ ID NO: 897325 - protein, 9 aa, Homo Sapiens
VIQIPAKPG

SEQ ID NO: 897326 - protein, 9 aa, Homo Sapiens
LTTHKNIHT

SEQ ID NO: 897327 - protein, 9 aa, Homo Sapiens
VPWMATSGP

SEQ ID NO: 897328 - protein, 9 aa, Homo Sapiens
KEECNGLEE

SEQ ID NO: 897329 - protein, 9 aa, Homo Sapiens
MRHELNKAY

SEQ ID NO: 897330 - protein, 9 aa, Homo Sapiens
CNMESIRRI

SEQ ID NO: 897331 - protein, 9 aa, Homo Sapiens
EENDSSCHG

SEQ ID NO: 897332 - protein, 9 aa, Homo Sapiens
LLDVFEVEK

SEQ ID NO: 897333 - protein, 9 aa, Homo Sapiens
LTLRNQIQQ

SEQ ID NO: 897334 - protein, 9 aa, Homo Sapiens
TAMYCDNCN

SEQ ID NO: 897335 - protein, 9 aa, Homo Sapiens
PTTTKNNYN

SEQ ID NO: 897336 - protein, 9 aa, Homo Sapiens
VAVVVGITW

SEQ ID NO: 897337 - protein, 9 aa, Homo Sapiens
VGQLGRTRA

SEQ ID NO: 897338 - protein, 9 aa, Homo Sapiens
LFINHCLVE

SEQ ID NO: 897339 - protein, 9 aa, Homo Sapiens
KRIPQIRIE

SEQ ID NO: 897340 - protein, 9 aa, Homo Sapiens
IHTGFDWLL

SEQ ID NO: 897341 - protein, 9 aa, Homo Sapiens
QAFENTYKG

SEQ ID NO: 897342 - protein, 9 aa, Homo Sapiens
RPFQNKCFR

SEQ ID NO: 897343 - protein, 9 aa, Homo Sapiens
HPHLGPVEE

SEQ ID NO: 897344 - protein, 9 aa, Homo Sapiens
DPPLTHMPK

SEQ ID NO: 897345 - protein, 9 aa, Homo Sapiens
KEDTWALDD

SEQ ID NO: 897346 - protein, 9 aa, Homo Sapiens
HKLNVSNYS

SEQ ID NO: 897347 - protein, 9 aa, Homo Sapiens
YFTIPLGSG

SEQ ID NO: 897348 - protein, 9 aa, Homo Sapiens
AAWDTVSNA

SEQ ID NO: 897349 - protein, 9 aa, Homo Sapiens
ERAGDIGGA

SEQ ID NO: 897350 - protein, 9 aa, Homo Sapiens
ERLLKQEER

SEQ ID NO: 897351 - protein, 9 aa, Homo Sapiens
PCEDEWESI

SEQ ID NO: 897352 - protein, 9 aa, Homo Sapiens
ALITDTYKT

SEQ ID NO: 897353 - protein, 9 aa, Homo Sapiens
YQILKAYTI

SEQ ID NO: 897354 - protein, 9 aa, Homo Sapiens
TILIDFTKK

SEQ ID NO: 897355 - protein, 9 aa, Homo Sapiens
RLPCHNFAP

SEQ ID NO: 897356 - protein, 9 aa, Homo Sapiens
GNGFIAAFC

SEQ ID NO: 897357 - protein, 9 aa, Homo Sapiens
PKVEANVSL

SEQ ID NO: 897358 - protein, 9 aa, Homo Sapiens
NTLMRVCVA

SEQ ID NO: 897359 - protein, 9 aa, Homo Sapiens
FSQSLHLQD

SEQ ID NO: 897360 - protein, 9 aa, Homo Sapiens
GCVYCSYVS

SEQ ID NO: 897361 - protein, 9 aa, Homo Sapiens
MCPSLDKAQ

SEQ ID NO: 897362 - protein, 9 aa, Homo Sapiens
LLWVLLDGG

SEQ ID NO: 897363 - protein, 9 aa, Homo Sapiens
QEDEQDAHA

SEQ ID NO: 897364 - protein, 9 aa, Homo Sapiens
DLRGDPVYC

SEQ ID NO: 897365 - protein, 9 aa, Homo Sapiens
AKDFGAKSK

SEQ ID NO: 897366 - protein, 9 aa, Homo Sapiens
HTEDNKRQT

SEQ ID NO: 897367 - protein, 9 aa, Homo Sapiens
DIDLKDVDN

SEQ ID NO: 897368 - protein, 9 aa, Homo Sapiens
ENKRKMEFN

SEQ ID NO: 897369 - protein, 9 aa, Homo Sapiens
VISVWDWQK

SEQ ID NO: 897370 - protein, 9 aa, Homo Sapiens
CMYDDRNHV

SEQ ID NO: 897371 - protein, 9 aa, Homo Sapiens
TLTQNQMTV

SEQ ID NO: 897372 - protein, 9 aa, Homo Sapiens
PCDTNWIYY

SEQ ID NO: 897373 - protein, 9 aa, Homo Sapiens
CHLYNEDNV

SEQ ID NO: 897374 - protein, 9 aa, Homo Sapiens
LTICYTLLP

SEQ ID NO: 897375 - protein, 9 aa, Homo Sapiens
RQQKEKRKR

SEQ ID NO: 897376 - protein, 9 aa, Homo Sapiens
LLSNAKCKK

SEQ ID NO: 897377 - protein, 9 aa, Homo Sapiens
HGKVCKLDE

SEQ ID NO: 897378 - protein, 9 aa, Homo Sapiens
EQDAHKLFH

SEQ ID NO: 897379 - protein, 9 aa, Homo Sapiens
DVDCCKKDL

SEQ ID NO: 897380 - protein, 9 aa, Homo Sapiens
ELAKMKEKY

SEQ ID NO: 897381 - protein, 9 aa, Homo Sapiens
TTFECETSE

SEQ ID NO: 897382 - protein, 9 aa, Homo Sapiens
GPVQFQYVL

SEQ ID NO: 897383 - protein, 9 aa, Homo Sapiens
HRDIKSKHV

SEQ ID NO: 897384 - protein, 9 aa, Homo Sapiens
LQRCRASFR

SEQ ID NO: 897385 - protein, 9 aa, Homo Sapiens
KNGPNSRIL

SEQ ID NO: 897386 - protein, 9 aa, Homo Sapiens
GKKEISGNS

SEQ ID NO: 897387 - protein, 9 aa, Homo Sapiens
RKMCLVNWS

SEQ ID NO: 897388 - protein, 9 aa, Homo Sapiens
VVKGLVKEG

SEQ ID NO: 897389 - protein, 9 aa, Homo Sapiens
RIGLEWLWK

SEQ ID NO: 897390 - protein, 9 aa, Homo Sapiens
GPNSRILNN

SEQ ID NO: 897391 - protein, 9 aa, Homo Sapiens
STGNRGFED

SEQ ID NO: 897392 - protein, 9 aa, Homo Sapiens
GTAHCRKKC

SEQ ID NO: 897393 - protein, 9 aa, Homo Sapiens
DDTKIPMFI

SEQ ID NO: 897394 - protein, 9 aa, Homo Sapiens
KGLVKEGAN

SEQ ID NO: 897395 - protein, 9 aa, Homo Sapiens
TLWSAGATS

SEQ ID NO: 897396 - protein, 9 aa, Homo Sapiens
SCDKWIRAY

SEQ ID NO: 897397 - protein, 9 aa, Homo Sapiens
QDLYNPSPE

SEQ ID NO: 897398 - protein, 9 aa, Homo Sapiens
QLLLGSHYN

SEQ ID NO: 897399 - protein, 9 aa, Homo Sapiens
LSKENSLII

SEQ ID NO: 897400 - protein, 9 aa, Homo Sapiens
CDCQGGPNT

SEQ ID NO: 897401 - protein, 9 aa, Homo Sapiens
TTTLGGCHS

SEQ ID NO: 897402 - protein, 9 aa, Homo Sapiens
QSQRSFLRN

SEQ ID NO: 897403 - protein, 9 aa, Homo Sapiens
FVFCLKRRF

SEQ ID NO: 897404 - protein, 9 aa, Homo Sapiens
VKGNSGSHG

SEQ ID NO: 897405 - protein, 9 aa, Homo Sapiens
FNNTIKEHF

SEQ ID NO: 897406 - protein, 9 aa, Homo Sapiens
QHMQSTFNN

SEQ ID NO: 897407 - protein, 9 aa, Homo Sapiens
AEVVKGLVK

SEQ ID NO: 897408 - protein, 9 aa, Homo Sapiens
TSRLRVSSS

SEQ ID NO: 897409 - protein, 9 aa, Homo Sapiens
NDRNHYSFN

SEQ ID NO: 897410 - protein, 9 aa, Homo Sapiens
GYGTAHCRK

SEQ ID NO: 897411 - protein, 9 aa, Homo Sapiens
SGNSEEMNI

SEQ ID NO: 897412 - protein, 9 aa, Homo Sapiens
SPMRVLGDV

SEQ ID NO: 897413 - protein, 9 aa, Homo Sapiens
QGQPVLTPP

SEQ ID NO: 897414 - protein, 9 aa, Homo Sapiens
ICGYGTAHC

SEQ ID NO: 897415 - protein, 9 aa, Homo Sapiens
IVLNKNRTV

SEQ ID NO: 897416 - protein, 9 aa, Homo Sapiens
DKVIWLWHP

SEQ ID NO: 897417 - protein, 9 aa, Homo Sapiens
LGSHYNVLE

SEQ ID NO: 897418 - protein, 9 aa, Homo Sapiens
KEDSLSSRH

SEQ ID NO: 897419 - protein, 9 aa, Homo Sapiens
MQSTFNNTI

SEQ ID NO: 897420 - protein, 9 aa, Homo Sapiens
RFFVLFCFG

SEQ ID NO: 897421 - protein, 9 aa, Homo Sapiens
GQSQRSFLR

SEQ ID NO: 897422 - protein, 9 aa, Homo Sapiens
LLKKVRLLK

SEQ ID NO: 897423 - protein, 9 aa, Homo Sapiens
YEHKAMWGK

SEQ ID NO: 897424 - protein, 9 aa, Homo Sapiens
PPSMRGKAL

SEQ ID NO: 897425 - protein, 9 aa, Homo Sapiens
NHYSFNPVI

SEQ ID NO: 897426 - protein, 9 aa, Homo Sapiens
FKRVRNRFL

SEQ ID NO: 897427 - protein, 9 aa, Homo Sapiens
SKNIKSSDE

SEQ ID NO: 897428 - protein, 9 aa, Homo Sapiens
IFYPSKDDT

SEQ ID NO: 897429 - protein, 9 aa, Homo Sapiens
RPQIQYFFA

SEQ ID NO: 897430 - protein, 9 aa, Homo Sapiens
NAMQPSVKG

SEQ ID NO: 897431 - protein, 9 aa, Homo Sapiens
HMQSTFNNT

SEQ ID NO: 897432 - protein, 9 aa, Homo Sapiens
CCVQYDGRR

SEQ ID NO: 897433 - protein, 9 aa, Homo Sapiens
QENNTIDSR

SEQ ID NO: 897434 - protein, 9 aa, Homo Sapiens
SRHRIERFS

SEQ ID NO: 897435 - protein, 9 aa, Homo Sapiens
RAVDNTLHK

SEQ ID NO: 897436 - protein, 9 aa, Homo Sapiens
LEKDRTSKE

SEQ ID NO: 897437 - protein, 9 aa, Homo Sapiens
AAVCCVQYD

SEQ ID NO: 897438 - protein, 9 aa, Homo Sapiens
ERDKDAHYP

SEQ ID NO: 897439 - protein, 9 aa, Homo Sapiens
RTVFRFNAA

SEQ ID NO: 897440 - protein, 9 aa, Homo Sapiens
LMGHVAAVC

SEQ ID NO: 897441 - protein, 9 aa, Homo Sapiens
LMATIWKNL

SEQ ID NO: 897442 - protein, 9 aa, Homo Sapiens
HCRKKCRSQ

SEQ ID NO: 897443 - protein, 9 aa, Homo Sapiens
AEMNHRSPM

SEQ ID NO: 897444 - protein, 9 aa, Homo Sapiens
ISGNSEEMN

SEQ ID NO: 897445 - protein, 9 aa, Homo Sapiens
ANPETTTLG

SEQ ID NO: 897446 - protein, 9 aa, Homo Sapiens
HMRAVDNTL

SEQ ID NO: 897447 - protein, 9 aa, Homo Sapiens
NGPNSRILN

SEQ ID NO: 897448 - protein, 9 aa, Homo Sapiens
SSLGFEVSM

SEQ ID NO: 897449 - protein, 9 aa, Homo Sapiens
SAQVTRSSA

SEQ ID NO: 897450 - protein, 9 aa, Homo Sapiens
KAMWGKALV

SEQ ID NO: 897451 - protein, 9 aa, Homo Sapiens
STFNNTIKE

SEQ ID NO: 897452 - protein, 9 aa, Homo Sapiens
ALSQTGFSY

SEQ ID NO: 897453 - protein, 9 aa, Homo Sapiens
KFFTQGQPV

SEQ ID NO: 897454 - protein, 9 aa, Homo Sapiens
LRKVRIGLE

SEQ ID NO: 897455 - protein, 9 aa, Homo Sapiens
EDSLSSRHR

SEQ ID NO: 897456 - protein, 9 aa, Homo Sapiens
AAAEAALSQ

SEQ ID NO: 897457 - protein, 9 aa, Homo Sapiens
SHYNVLEAH

SEQ ID NO: 897458 - protein, 9 aa, Homo Sapiens
TLEDSSVNL

SEQ ID NO: 897459 - protein, 9 aa, Homo Sapiens
KLMATIWKN

SEQ ID NO: 897460 - protein, 9 aa, Homo Sapiens
DGTSRRSAQ

SEQ ID NO: 897461 - protein, 9 aa, Homo Sapiens
RLLKEYQKE

SEQ ID NO: 897462 - protein, 9 aa, Homo Sapiens
ASIFFIERC

SEQ ID NO: 897463 - protein, 9 aa, Homo Sapiens
MTALAQAFA

SEQ ID NO: 897464 - protein, 9 aa, Homo Sapiens
AVTPGFMQS

SEQ ID NO: 897465 - protein, 9 aa, Homo Sapiens
SLSSRHRIE

SEQ ID NO: 897466 - protein, 9 aa, Homo Sapiens
EKDRTSKES

SEQ ID NO: 897467 - protein, 9 aa, Homo Sapiens
PLRKVRIGL

SEQ ID NO: 897468 - protein, 9 aa, Homo Sapiens
AKFARIMTL

SEQ ID NO: 897469 - protein, 9 aa, Homo Sapiens
NNCDLPSRT

SEQ ID NO: 897470 - protein, 9 aa, Homo Sapiens
TRLRTYEHK

SEQ ID NO: 897471 - protein, 9 aa, Homo Sapiens
GFMQSEKTT

SEQ ID NO: 897472 - protein, 9 aa, Homo Sapiens
LCASCDKWI

SEQ ID NO: 897473 - protein, 9 aa, Homo Sapiens
FQLLLGSHY

SEQ ID NO: 897474 - protein, 9 aa, Homo Sapiens
NRTVFRFNA

SEQ ID NO: 897475 - protein, 9 aa, Homo Sapiens
ETTTLGGCH

SEQ ID NO: 897476 - protein, 9 aa, Homo Sapiens
FYPSKDDTK

SEQ ID NO: 897477 - protein, 9 aa, Homo Sapiens
NGGQSQRSF

SEQ ID NO: 897478 - protein, 9 aa, Homo Sapiens
DDKVIWLWH

SEQ ID NO: 897479 - protein, 9 aa, Homo Sapiens
PSKDDTKIP

SEQ ID NO: 897480 - protein, 9 aa, Homo Sapiens
GNSEEMNIN

SEQ ID NO: 897481 - protein, 9 aa, Homo Sapiens
LIIQFTSFV

SEQ ID NO: 897482 - protein, 9 aa, Homo Sapiens
RGKALRYIN

SEQ ID NO: 897483 - protein, 9 aa, Homo Sapiens
SSRHRIERF

SEQ ID NO: 897484 - protein, 9 aa, Homo Sapiens
QKPLRKVRI

SEQ ID NO: 897485 - protein, 9 aa, Homo Sapiens
DLYNPSPEP

SEQ ID NO: 897486 - protein, 9 aa, Homo Sapiens
GPNTLWSAG

SEQ ID NO: 897487 - protein, 9 aa, Homo Sapiens
GYDLGEAKF

SEQ ID NO: 897488 - protein, 9 aa, Homo Sapiens
EIWENICQV

SEQ ID NO: 897489 - protein, 9 aa, Homo Sapiens
GANPETTTL

SEQ ID NO: 897490 - protein, 9 aa, Homo Sapiens
QRSFLRNVM

SEQ ID NO: 897491 - protein, 9 aa, Homo Sapiens
AFLIDKESK

SEQ ID NO: 897492 - protein, 9 aa, Homo Sapiens
EKLMATIWK

SEQ ID NO: 897493 - protein, 9 aa, Homo Sapiens
MNHRSPMRV

SEQ ID NO: 897494 - protein, 9 aa, Homo Sapiens
MATIWKNLS

SEQ ID NO: 897495 - protein, 9 aa, Homo Sapiens
GNRGFEDGD

SEQ ID NO: 897496 - protein, 9 aa, Homo Sapiens
PPLNGGQSQ

SEQ ID NO: 897497 - protein, 9 aa, Homo Sapiens
TSRRSAQVT

SEQ ID NO: 897498 - protein, 9 aa, Homo Sapiens
SRELDIGRR

SEQ ID NO: 897499 - protein, 9 aa, Homo Sapiens
ENSLIIQFT

SEQ ID NO: 897500 - protein, 9 aa, Homo Sapiens
RLSSLGFEV

SEQ ID NO: 897501 - protein, 9 aa, Homo Sapiens
CQGGPNTLW

SEQ ID NO: 897502 - protein, 9 aa, Homo Sapiens
VCCVQYDGR

SEQ ID NO: 897503 - protein, 9 aa, Homo Sapiens
VTPGFMQSE

SEQ ID NO: 897504 - protein, 9 aa, Homo Sapiens
IDFRLPNST

SEQ ID NO: 897505 - protein, 9 aa, Homo Sapiens
LRTYEHKAM

SEQ ID NO: 897506 - protein, 9 aa, Homo Sapiens
SIFFIERCP

SEQ ID NO: 897507 - protein, 9 aa, Homo Sapiens
DVFFHQSWK

SEQ ID NO: 897508 - protein, 9 aa, Homo Sapiens
LKKVRLLKE

SEQ ID NO: 897509 - protein, 9 aa, Homo Sapiens
SKDDTKIPM

SEQ ID NO: 897510 - protein, 9 aa, Homo Sapiens
ENFDKFFTQ

SEQ ID NO: 897511 - protein, 9 aa, Homo Sapiens
VCNDRNHYS

SEQ ID NO: 897512 - protein, 9 aa, Homo Sapiens
IDFCSSTPH

SEQ ID NO: 897513 - protein, 9 aa, Homo Sapiens
SKENSLIIQ

SEQ ID NO: 897514 - protein, 9 aa, Homo Sapiens
PAPEYWCYC

SEQ ID NO: 897515 - protein, 9 aa, Homo Sapiens
KWIRAYEMT

SEQ ID NO: 897516 - protein, 9 aa, Homo Sapiens
ENICQVQGK

SEQ ID NO: 897517 - protein, 9 aa, Homo Sapiens
YDLGEAKFA

SEQ ID NO: 897518 - protein, 9 aa, Homo Sapiens
CPSRWPAMK

SEQ ID NO: 897519 - protein, 9 aa, Homo Sapiens
LEDSSVNLL

SEQ ID NO: 897520 - protein, 9 aa, Homo Sapiens
IITLEDSSV

SEQ ID NO: 897521 - protein, 9 aa, Homo Sapiens
AVDNTLHKV

SEQ ID NO: 897522 - protein, 9 aa, Homo Sapiens
SSVNLLGRN

SEQ ID NO: 897523 - protein, 9 aa, Homo Sapiens
YTIDVFFHQ

SEQ ID NO: 897524 - protein, 9 aa, Homo Sapiens
LNKNRTVFR

SEQ ID NO: 897525 - protein, 9 aa, Homo Sapiens
IWLWHPNIS

SEQ ID NO: 897526 - protein, 9 aa, Homo Sapiens
NRKMCLVNW

SEQ ID NO: 897527 - protein, 9 aa, Homo Sapiens
ANHMRAVDN

SEQ ID NO: 897528 - protein, 9 aa, Homo Sapiens
DKESKNIKS

SEQ ID NO: 897529 - protein, 9 aa, Homo Sapiens
LEPSGVLLK

SEQ ID NO: 897530 - protein, 9 aa, Homo Sapiens
YPFIDFRLP

SEQ ID NO: 897531 - protein, 9 aa, Homo Sapiens
EISGNSEEM

SEQ ID NO: 897532 - protein, 9 aa, Homo Sapiens
RELDIGRRA

SEQ ID NO: 897533 - protein, 9 aa, Homo Sapiens
KSTGNRGFE

SEQ ID NO: 897534 - protein, 9 aa, Homo Sapiens
RLRTYEHKA

SEQ ID NO: 897535 - protein, 9 aa, Homo Sapiens
HQSWKDERL

SEQ ID NO: 897536 - protein, 9 aa, Homo Sapiens
PEYWCYCLL

SEQ ID NO: 897537 - protein, 9 aa, Homo Sapiens
RTYEHKAMW

SEQ ID NO: 897538 - protein, 9 aa, Homo Sapiens
SRLRVSSSP

SEQ ID NO: 897539 - protein, 9 aa, Homo Sapiens
RLRVSSSPG

SEQ ID NO: 897540 - protein, 9 aa, Homo Sapiens
FIERCPSRW

SEQ ID NO: 897541 - protein, 9 aa, Homo Sapiens
DLGEAKFAR

SEQ ID NO: 897542 - protein, 9 aa, Homo Sapiens
VNLLGRNSF

SEQ ID NO: 897543 - protein, 9 aa, Homo Sapiens
AMQPSVKGN

SEQ ID NO: 897544 - protein, 9 aa, Homo Sapiens
LSSRHRIER

SEQ ID NO: 897545 - protein, 9 aa, Homo Sapiens
RDKDAHYPV

SEQ ID NO: 897546 - protein, 9 aa, Homo Sapiens
HYNVLEAHC

SEQ ID NO: 897547 - protein, 9 aa, Homo Sapiens
PNSTTYSGE

SEQ ID NO: 897548 - protein, 9 aa, Homo Sapiens
RSAQVTRSS

SEQ ID NO: 897549 - protein, 9 aa, Homo Sapiens
TFKRVRNRF

SEQ ID NO: 897550 - protein, 9 aa, Homo Sapiens
NFDKFFTQG

SEQ ID NO: 897551 - protein, 9 aa, Homo Sapiens
MGYDLGEAK

SEQ ID NO: 897552 - protein, 9 aa, Homo Sapiens
QTSRLRVSS

SEQ ID NO: 897553 - protein, 9 aa, Homo Sapiens
GTSRRSAQV

SEQ ID NO: 897554 - protein, 9 aa, Homo Sapiens
FFHQSWKDE

SEQ ID NO: 897555 - protein, 9 aa, Homo Sapiens
VLLKSGNYS

SEQ ID NO: 897556 - protein, 9 aa, Homo Sapiens
KFARIMTLV

SEQ ID NO: 897557 - protein, 9 aa, Homo Sapiens
MRGKALRYI

SEQ ID NO: 897558 - protein, 9 aa, Homo Sapiens
IHEEKDFID

SEQ ID NO: 897559 - protein, 9 aa, Homo Sapiens
CLVNWSDPE

SEQ ID NO: 897560 - protein, 9 aa, Homo Sapiens
LIDKESKNI

SEQ ID NO: 897561 - protein, 9 aa, Homo Sapiens
AVCCVQYDG

SEQ ID NO: 897562 - protein, 9 aa, Homo Sapiens
NPPSMRGKA

SEQ ID NO: 897563 - protein, 9 aa, Homo Sapiens
NRGFEDGDD

SEQ ID NO: 897564 - protein, 9 aa, Homo Sapiens
VDNTLHKVR

SEQ ID NO: 897565 - protein, 9 aa, Homo Sapiens
LVGNNCDLP

SEQ ID NO: 897566 - protein, 9 aa, Homo Sapiens
GLCASCDKW

SEQ ID NO: 897567 - protein, 9 aa, Homo Sapiens
FNLEKDRTS

SEQ ID NO: 897568 - protein, 9 aa, Homo Sapiens
ASCDKWIRA

SEQ ID NO: 897569 - protein, 9 aa, Homo Sapiens
WIRAYEMTM

SEQ ID NO: 897570 - protein, 9 aa, Homo Sapiens
KVRLLKEYQ

SEQ ID NO: 897571 - protein, 9 aa, Homo Sapiens
VFRFNAASI

SEQ ID NO: 897572 - protein, 9 aa, Homo Sapiens
HPAPEYWCY

SEQ ID NO: 897573 - protein, 9 aa, Homo Sapiens
VTNRKMCLV

SEQ ID NO: 897574 - protein, 9 aa, Homo Sapiens
MRAVDNTLH

SEQ ID NO: 897575 - protein, 9 aa, Homo Sapiens
FDKFFTQGQ

SEQ ID NO: 897576 - protein, 9 aa, Homo Sapiens
LKEYQKEAP

SEQ ID NO: 897577 - protein, 9 aa, Homo Sapiens
PSVKGNSGS

SEQ ID NO: 897578 - protein, 9 aa, Homo Sapiens
FLIDKESKN

SEQ ID NO: 897579 - protein, 9 aa, Homo Sapiens
TGNRGFEDG

SEQ ID NO: 897580 - protein, 9 aa, Homo Sapiens
SRSLEPSGV

SEQ ID NO: 897581 - protein, 9 aa, Homo Sapiens
DRNHYSFNP

SEQ ID NO: 897582 - protein, 9 aa, Homo Sapiens
AFAVGLGPR

SEQ ID NO: 897583 - protein, 9 aa, Homo Sapiens
TGGDDKVIW

SEQ ID NO: 897584 - protein, 9 aa, Homo Sapiens
NTLWSAGAT

SEQ ID NO: 897585 - protein, 9 aa, Homo Sapiens
WLWHPNIST

SEQ ID NO: 897586 - protein, 9 aa, Homo Sapiens
AQKPLRKVR

SEQ ID NO: 897587 - protein, 9 aa, Homo Sapiens
QIFYPSKDD

SEQ ID NO: 897588 - protein, 9 aa, Homo Sapiens
AFWWAVISM

SEQ ID NO: 897589 - protein, 9 aa, Homo Sapiens
FRLPNSTTY

SEQ ID NO: 897590 - protein, 9 aa, Homo Sapiens
KEYQKEAPS

SEQ ID NO: 897591 - protein, 9 aa, Homo Sapiens
GNSGSHGSP

SEQ ID NO: 897592 - protein, 9 aa, Homo Sapiens
QNPPSMRGK

SEQ ID NO: 897593 - protein, 9 aa, Homo Sapiens
RVRNRFLMR

SEQ ID NO: 897594 - protein, 9 aa, Homo Sapiens
KDRTSKESG

SEQ ID NO: 897595 - protein, 9 aa, Homo Sapiens
FCLKRRFFV

SEQ ID NO: 897596 - protein, 9 aa, Homo Sapiens
KKVRLLKEY

SEQ ID NO: 897597 - protein, 9 aa, Homo Sapiens
FWWAVISMT

SEQ ID NO: 897598 - protein, 9 aa, Homo Sapiens
AAEAALSQT

SEQ ID NO: 897599 - protein, 9 aa, Homo Sapiens
RKVRIGLEW

SEQ ID NO: 897600 - protein, 9 aa, Homo Sapiens
PQIQYFFAA

SEQ ID NO: 897601 - protein, 9 aa, Homo Sapiens
CDKWIRAYE

SEQ ID NO: 897602 - protein, 9 aa, Homo Sapiens
DFCSSTPHN

SEQ ID NO: 897603 - protein, 9 aa, Homo Sapiens
ETPLAVTPG

SEQ ID NO: 897604 - protein, 9 aa, Homo Sapiens
KQYFIEKLM

SEQ ID NO: 897605 - protein, 9 aa, Homo Sapiens
DAEMNHRSP

SEQ ID NO: 897606 - protein, 9 aa, Homo Sapiens
AEAALSQTG

SEQ ID NO: 897607 - protein, 9 aa, Homo Sapiens
SFQLLLGSH

SEQ ID NO: 897608 - protein, 9 aa, Homo Sapiens
IRPQIQYFF

SEQ ID NO: 897609 - protein, 9 aa, Homo Sapiens
RICGYGTAH

SEQ ID NO: 897610 - protein, 9 aa, Homo Sapiens
AQAFAVGLG

SEQ ID NO: 897611 - protein, 9 aa, Homo Sapiens
EEKDFIDFC

SEQ ID NO: 897612 - protein, 9 aa, Homo Sapiens
KERDKDAHY

SEQ ID NO: 897613 - protein, 9 aa, Homo Sapiens
RSLEPSGVL

SEQ ID NO: 897614 - protein, 9 aa, Homo Sapiens
SLEPSGVLL

SEQ ID NO: 897615 - protein, 9 aa, Homo Sapiens
KRRFFVLFC

SEQ ID NO: 897616 - protein, 9 aa, Homo Sapiens
NTKPIRPQI

SEQ ID NO: 897617 - protein, 9 aa, Homo Sapiens
EHKAMWGKA

SEQ ID NO: 897618 - protein, 9 aa, Homo Sapiens
LVNWSDPED

SEQ ID NO: 897619 - protein, 9 aa, Homo Sapiens
KRMTALAQA

SEQ ID NO: 897620 - protein, 9 aa, Homo Sapiens
HRIERFSIA

SEQ ID NO: 897621 - protein, 9 aa, Homo Sapiens
NTFKRVRNR

SEQ ID NO: 897622 - protein, 9 aa, Homo Sapiens
FIDFRLPNS

SEQ ID NO: 897623 - protein, 9 aa, Homo Sapiens
PIRPQIQYF

SEQ ID NO: 897624 - protein, 9 aa, Homo Sapiens
NTIDSRELD

SEQ ID NO: 897625 - protein, 9 aa, Homo Sapiens
FIDFCSSTP

SEQ ID NO: 897626 - protein, 9 aa, Homo Sapiens
LKRRFFVLF

SEQ ID NO: 897627 - protein, 9 aa, Homo Sapiens
DKWIRAYEM

SEQ ID NO: 897628 - protein, 9 aa, Homo Sapiens
GHVAAVCCV

SEQ ID NO: 897629 - protein, 9 aa, Homo Sapiens
TLGGCHSPE

SEQ ID NO: 897630 - protein, 9 aa, Homo Sapiens
QQHMQSTFN

SEQ ID NO: 897631 - protein, 9 aa, Homo Sapiens
RHRIERFSI

SEQ ID NO: 897632 - protein, 9 aa, Homo Sapiens
RSPMRVLGD

SEQ ID NO: 897633 - protein, 9 aa, Homo Sapiens
YSFNPVIGM

SEQ ID NO: 897634 - protein, 9 aa, Homo Sapiens
QSTFNNTIK

SEQ ID NO: 897635 - protein, 9 aa, Homo Sapiens
LPNSTTYSG

SEQ ID NO: 897636 - protein, 9 aa, Homo Sapiens
KVRIGLEWL

SEQ ID NO: 897637 - protein, 9 aa, Homo Sapiens
IWENICQVQ

SEQ ID NO: 897638 - protein, 9 aa, Homo Sapiens
PSMRGKALR

SEQ ID NO: 897639 - protein, 9 aa, Homo Sapiens
EMNHRSPMR

SEQ ID NO: 897640 - protein, 9 aa, Homo Sapiens
VKGLVKEGA

SEQ ID NO: 897641 - protein, 9 aa, Homo Sapiens
VLNKNRTVF

SEQ ID NO: 897642 - protein, 9 aa, Homo Sapiens
CASCDKWIR

SEQ ID NO: 897643 - protein, 9 aa, Homo Sapiens
KPIRPQIQY

SEQ ID NO: 897644 - protein, 9 aa, Homo Sapiens
PMVLVGNNC

SEQ ID NO: 897645 - protein, 9 aa, Homo Sapiens
ESKNIKSSD

SEQ ID NO: 897646 - protein, 9 aa, Homo Sapiens
RLPNSTTYS

SEQ ID NO: 897647 - protein, 9 aa, Homo Sapiens
FIEKLMATI

SEQ ID NO: 897648 - protein, 9 aa, Homo Sapiens
EDSQDLYNP

SEQ ID NO: 897649 - protein, 9 aa, Homo Sapiens
MFVFCLKRR

SEQ ID NO: 897650 - protein, 9 aa, Homo Sapiens
DEIWENICQ

SEQ ID NO: 897651 - protein, 9 aa, Homo Sapiens
KENSLIIQF

SEQ ID NO: 897652 - protein, 9 aa, Homo Sapiens
HRSPMRVLG

SEQ ID NO: 897653 - protein, 9 aa, Homo Sapiens
RFLMRKVAV

SEQ ID NO: 897654 - protein, 9 aa, Homo Sapiens
YGTAHCRKK

SEQ ID NO: 897655 - protein, 9 aa, Homo Sapiens
NCDLPSRTV

SEQ ID NO: 897656 - protein, 9 aa, Homo Sapiens
TVFRFNAAS

SEQ ID NO: 897657 - protein, 9 aa, Homo Sapiens
KDFIDFCSS

SEQ ID NO: 897658 - protein, 9 aa, Homo Sapiens
GGQSQRSFL

SEQ ID NO: 897659 - protein, 9 aa, Homo Sapiens
TIDVFFHQS

SEQ ID NO: 897660 - protein, 9 aa, Homo Sapiens
TNRKMCLVN

SEQ ID NO: 897661 - protein, 9 aa, Homo Sapiens
YNPSPEPKT

SEQ ID NO: 897662 - protein, 9 aa, Homo Sapiens
DKFFTQGQP

SEQ ID NO: 897663 - protein, 9 aa, Homo Sapiens
VIWLWHPNI

SEQ ID NO: 897664 - protein, 9 aa, Homo Sapiens
HKAMWGKAL

SEQ ID NO: 897665 - protein, 9 aa, Homo Sapiens
PMRVLGDVV

SEQ ID NO: 897666 - protein, 9 aa, Homo Sapiens
IDVFFHQSW

SEQ ID NO: 897667 - protein, 9 aa, Homo Sapiens
DFRLPNSTT

SEQ ID NO: 897668 - protein, 9 aa, Homo Sapiens
KALRYINIT

SEQ ID NO: 897669 - protein, 9 aa, Homo Sapiens
GKALRYINI

SEQ ID NO: 897670 - protein, 9 aa, Homo Sapiens
KDAHYPVVV

SEQ ID NO: 897671 - protein, 9 aa, Homo Sapiens
EPSGVLLKS

SEQ ID NO: 897672 - protein, 9 aa, Homo Sapiens
NPETTTLGG

SEQ ID NO: 897673 - protein, 9 aa, Homo Sapiens
RMTALAQAF

SEQ ID NO: 897674 - protein, 9 aa, Homo Sapiens
QTFTPPPQP

SEQ ID NO: 897675 - protein, 9 aa, Homo Sapiens
LLILKERDK

SEQ ID NO: 897676 - protein, 9 aa, Homo Sapiens
TFNNTIKEH

SEQ ID NO: 897677 - protein, 9 aa, Homo Sapiens
IEKLMATIW

SEQ ID NO: 897678 - protein, 9 aa, Homo Sapiens
NHMRAVDNT

SEQ ID NO: 897679 - protein, 9 aa, Homo Sapiens
MVLVGNNCD

SEQ ID NO: 897680 - protein, 9 aa, Homo Sapiens
MQPSVKGNS

SEQ ID NO: 897681 - protein, 9 aa, Homo Sapiens
AGQAEVVKG

SEQ ID NO: 897682 - protein, 9 aa, Homo Sapiens
KDDTKIPMF

SEQ ID NO: 897683 - protein, 9 aa, Homo Sapiens
DTKIPMFIV

SEQ ID NO: 897684 - protein, 9 aa, Homo Sapiens
QPSVKGNSG

SEQ ID NO: 897685 - protein, 9 aa, Homo Sapiens
YPSKDDTKI

SEQ ID NO: 897686 - protein, 9 aa, Homo Sapiens
RRSAQVTRS

SEQ ID NO: 897687 - protein, 9 aa, Homo Sapiens
PSPEPKTLF

SEQ ID NO: 897688 - protein, 9 aa, Homo Sapiens
AHCRKKCRS

SEQ ID NO: 897689 - protein, 9 aa, Homo Sapiens
NRFLMRKVA

SEQ ID NO: 897690 - protein, 9 aa, Homo Sapiens
IYPKSTGNR

SEQ ID NO: 897691 - protein, 9 aa, Homo Sapiens
YFIEKLMAT

SEQ ID NO: 897692 - protein, 9 aa, Homo Sapiens
MCLVNWSDP

SEQ ID NO: 897693 - protein, 9 aa, Homo Sapiens
ILKERDKDA

SEQ ID NO: 897694 - protein, 9 aa, Homo Sapiens
SQDLYNPSP

SEQ ID NO: 897695 - protein, 9 aa, Homo Sapiens
RTSKESGKV

SEQ ID NO: 897696 - protein, 9 aa, Homo Sapiens
TFTPPPQPQ

SEQ ID NO: 897697 - protein, 9 aa, Homo Sapiens
NFNLEKDRT

SEQ ID NO: 897698 - protein, 9 aa, Homo Sapiens
SVNLLGRNS

SEQ ID NO: 897699 - protein, 9 aa, Homo Sapiens
DCQGGPNTL

SEQ ID NO: 897700 - protein, 9 aa, Homo Sapiens
LGEAKFARI

SEQ ID NO: 897701 - protein, 9 aa, Homo Sapiens
QIQYFFAAS

SEQ ID NO: 897702 - protein, 9 aa, Homo Sapiens
NLEKDRTSK

SEQ ID NO: 897703 - protein, 9 aa, Homo Sapiens
ERCPSRWPA

SEQ ID NO: 897704 - protein, 9 aa, Homo Sapiens
TAHCRKKCR

SEQ ID NO: 897705 - protein, 9 aa, Homo Sapiens
RCPSRWPAM

SEQ ID NO: 897706 - protein, 9 aa, Homo Sapiens
RNHYSFNPV

SEQ ID NO: 897707 - protein, 9 aa, Homo Sapiens
GCDEIWENI

SEQ ID NO: 897708 - protein, 9 aa, Homo Sapiens
GQAEVVKGL

SEQ ID NO: 897709 - protein, 9 aa, Homo Sapiens
DNTLHKVRD

SEQ ID NO: 897710 - protein, 9 aa, Homo Sapiens
FHQSWKDER

SEQ ID NO: 897711 - protein, 9 aa, Homo Sapiens
PSGVLLKSG

SEQ ID NO: 897712 - protein, 9 aa, Homo Sapiens
KNIKSSDEI

SEQ ID NO: 897713 - protein, 9 aa, Homo Sapiens
TYEHKAMWG

SEQ ID NO: 897714 - protein, 9 aa, Homo Sapiens
VFCLKRRFF

SEQ ID NO: 897715 - protein, 9 aa, Homo Sapiens
LAQAFAVGL

SEQ ID NO: 897716 - protein, 9 aa, Homo Sapiens
RRFFVLFCF

SEQ ID NO: 897717 - protein, 9 aa, Homo Sapiens
SMRGKALRY

SEQ ID NO: 897718 - protein, 9 aa, Homo Sapiens
RAAAEAALS

SEQ ID NO: 897719 - protein, 9 aa, Homo Sapiens
PGFMQSEKT

SEQ ID NO: 897720 - protein, 9 aa, Homo Sapiens
TKPIRPQIQ

SEQ ID NO: 897721 - protein, 9 aa, Homo Sapiens
VFFHQSWKD

SEQ ID NO: 897722 - protein, 9 aa, Homo Sapiens
PETTTLGGC

SEQ ID NO: 897723 - protein, 9 aa, Homo Sapiens
LGGCHSPED

SEQ ID NO: 897724 - protein, 9 aa, Homo Sapiens
FTQGQPVLT

SEQ ID NO: 897725 - protein, 9 aa, Homo Sapiens
RNRFLMRKV

SEQ ID NO: 897726 - protein, 9 aa, Homo Sapiens
ANTKPIRPQ

SEQ ID NO: 897727 - protein, 9 aa, Homo Sapiens
GDDKVIWLW

SEQ ID NO: 897728 - protein, 9 aa, Homo Sapiens
EKDFIDFCS

SEQ ID NO: 897729 - protein, 9 aa, Homo Sapiens
VGNNCDLPS

SEQ ID NO: 897730 - protein, 9 aa, Homo Sapiens
EYTIDVFFH

SEQ ID NO: 897731 - protein, 9 aa, Homo Sapiens
TPLAVTPGF

SEQ ID NO: 897732 - protein, 9 aa, Homo Sapiens
ITLEDSSVN

SEQ ID NO: 897733 - protein, 9 aa, Homo Sapiens
PLAVTPGFM

SEQ ID NO: 897734 - protein, 9 aa, Homo Sapiens
GLVKEGANI

SEQ ID NO: 897735 - protein, 9 aa, Homo Sapiens
TPGFMQSEK

SEQ ID NO: 897736 - protein, 9 aa, Homo Sapiens
VRLLKEYQK

SEQ ID NO: 897737 - protein, 9 aa, Homo Sapiens
SVKGNSGSH

SEQ ID NO: 897738 - protein, 9 aa, Homo Sapiens
GEAKFARIM

SEQ ID NO: 897739 - protein, 9 aa, Homo Sapiens
VPMVLVGNN

SEQ ID NO: 897740 - protein, 9 aa, Homo Sapiens
AQVTRSSAR

SEQ ID NO: 897741 - protein, 9 aa, Homo Sapiens
NNTIDSREL

SEQ ID NO: 897742 - protein, 9 aa, Homo Sapiens
GGPNTLWSA

SEQ ID NO: 897743 - protein, 9 aa, Homo Sapiens
PFIDFRLPN

SEQ ID NO: 897744 - protein, 9 aa, Homo Sapiens
DFIDFCSST

SEQ ID NO: 897745 - protein, 9 aa, Homo Sapiens
CNDRNHYSF

SEQ ID NO: 897746 - protein, 9 aa, Homo Sapiens
EDSSVNLLG

SEQ ID NO: 897747 - protein, 9 aa, Homo Sapiens
CGYGTAHCR

SEQ ID NO: 897748 - protein, 9 aa, Homo Sapiens
DSRELDIGR

SEQ ID NO: 897749 - protein, 9 aa, Homo Sapiens
NKNRTVFRF

SEQ ID NO: 897750 - protein, 9 aa, Homo Sapiens
FFIERCPSR

SEQ ID NO: 897751 - protein, 9 aa, Homo Sapiens
LRAAAEAAL

SEQ ID NO: 897752 - protein, 9 aa, Homo Sapiens
EVVKGLVKE

SEQ ID NO: 897753 - protein, 9 aa, Homo Sapiens
KGNSGSHGS

SEQ ID NO: 897754 - protein, 9 aa, Homo Sapiens
ENNTIDSRE

SEQ ID NO: 897755 - protein, 9 aa, Homo Sapiens
LSSLGFEVS

SEQ ID NO: 897756 - protein, 9 aa, Homo Sapiens
NSLIIQFTS

SEQ ID NO: 897757 - protein, 9 aa, Homo Sapiens
CLKRRFFVL

SEQ ID NO: 897758 - protein, 9 aa, Homo Sapiens
LAVTPGFMQ

SEQ ID NO: 897759 - protein, 9 aa, Homo Sapiens
TSKESGKVF

SEQ ID NO: 897760 - protein, 9 aa, Homo Sapiens
DSQDLYNPS

SEQ ID NO: 897761 - protein, 9 aa, Homo Sapiens
TQGQPVLTP

SEQ ID NO: 897762 - protein, 9 aa, Homo Sapiens
NSEEMNINS

SEQ ID NO: 897763 - protein, 9 aa, Homo Sapiens
NQTSRLRVS

SEQ ID NO: 897764 - protein, 9 aa, Homo Sapiens
TIDSRELDI

SEQ ID NO: 897765 - protein, 9 aa, Homo Sapiens
LNGGQSQRS

SEQ ID NO: 897766 - protein, 9 aa, Homo Sapiens
YGKKEISGN

SEQ ID NO: 897767 - protein, 9 aa, Homo Sapiens
SQRSFLRNV

SEQ ID NO: 897768 - protein, 9 aa, Homo Sapiens
KVIWLWHPN

SEQ ID NO: 897769 - protein, 9 aa, Homo Sapiens
MGHVAAVCC

SEQ ID NO: 897770 - protein, 9 aa, Homo Sapiens
GSHYNVLEA

SEQ ID NO: 897771 - protein, 9 aa, Homo Sapiens
PKSTGNRGF

SEQ ID NO: 897772 - protein, 9 aa, Homo Sapiens
VNWSDPEDD

SEQ ID NO: 897773 - protein, 9 aa, Homo Sapiens
DKDAHYPVV

SEQ ID NO: 897774 - protein, 9 aa, Homo Sapiens
KKEISGNSE

SEQ ID NO: 897775 - protein, 9 aa, Homo Sapiens
RGFEDGDDA

SEQ ID NO: 897776 - protein, 9 aa, Homo Sapiens
EAALSQTGF

SEQ ID NO: 897777 - protein, 9 aa, Homo Sapiens
HVAAVCCVQ

SEQ ID NO: 897778 - protein, 9 aa, Homo Sapiens
DAFWWAVIS

SEQ ID NO: 897779 - protein, 9 aa, Homo Sapiens
QYFIEKLMA

SEQ ID NO: 897780 - protein, 9 aa, Homo Sapiens
LLKEYQKEA

SEQ ID NO: 897781 - protein, 9 aa, Homo Sapiens
GNNCDLPSR

SEQ ID NO: 897782 - protein, 9 aa, Homo Sapiens
IQFTSFVAV

SEQ ID NO: 897783 - protein, 9 aa, Homo Sapiens
IDSRELDIG

SEQ ID NO: 897784 - protein, 9 aa, Homo Sapiens
IIQFTSFVA

SEQ ID NO: 897785 - protein, 9 aa, Homo Sapiens
CDEIWENIC

SEQ ID NO: 897786 - protein, 9 aa, Homo Sapiens
NRNQTSRLR

SEQ ID NO: 897787 - protein, 9 aa, Homo Sapiens
IERCPSRWP

SEQ ID NO: 897788 - protein, 9 aa, Homo Sapiens
LSQTGFSYD

SEQ ID NO: 897789 - protein, 9 aa, Homo Sapiens
VAAVCCVQY

SEQ ID NO: 897790 - protein, 9 aa, Homo Sapiens
KEISGNSEE

SEQ ID NO: 897791 - protein, 9 aa, Homo Sapiens
NPSPEPKTL

SEQ ID NO: 897792 - protein, 9 aa, Homo Sapiens
VRNRFLMRK

SEQ ID NO: 897793 - protein, 9 aa, Homo Sapiens
VLVGNNCDL

SEQ ID NO: 897794 - protein, 9 aa, Homo Sapiens
LILKERDKD

SEQ ID NO: 897795 - protein, 9 aa, Homo Sapiens
SLGFEVSMC

SEQ ID NO: 897796 - protein, 9 aa, Homo Sapiens
NNTIKEHFT

SEQ ID NO: 897797 - protein, 9 aa, Homo Sapiens
KRVRNRFLM

SEQ ID NO: 897798 - protein, 9 aa, Homo Sapiens
DSSVNLLGR

SEQ ID NO: 897799 - protein, 9 aa, Homo Sapiens
EAKFARIMT

SEQ ID NO: 897800 - protein, 9 aa, Homo Sapiens
SFNPVIGMN

SEQ ID NO: 897801 - protein, 9 aa, Homo Sapiens
NICQVQGKD

SEQ ID NO: 897802 - protein, 9 aa, Homo Sapiens
RNQTSRLRV

SEQ ID NO: 897803 - protein, 9 aa, Homo Sapiens
LLGSHYNVL

SEQ ID NO: 897804 - protein, 9 aa, Homo Sapiens
AGCDEIWEN

SEQ ID NO: 897805 - protein, 9 aa, Homo Sapiens
IDKESKNIK

SEQ ID NO: 897806 - protein, 9 aa, Homo Sapiens
KPLRKVRIG

SEQ ID NO: 897807 - protein, 9 aa, Homo Sapiens
KMCLVNWSD

SEQ ID NO: 897808 - protein, 9 aa, Homo Sapiens
LLLGSHYNV

SEQ ID NO: 897809 - protein, 9 aa, Homo Sapiens
KESKNIKSS

SEQ ID NO: 897810 - protein, 9 aa, Homo Sapiens
AALSQTGFS

SEQ ID NO: 897811 - protein, 9 aa, Homo Sapiens
GVLLKSGNY

SEQ ID NO: 897812 - protein, 9 aa, Homo Sapiens
QAFAVGLGP

SEQ ID NO: 897813 - protein, 9 aa, Homo Sapiens
PDAFWWAVI

SEQ ID NO: 897814 - protein, 9 aa, Homo Sapiens
PLNGGQSQR

SEQ ID NO: 897815 - protein, 9 aa, Homo Sapiens
LYNPSPEPK

SEQ ID NO: 897816 - protein, 9 aa, Homo Sapiens
SRRSAQVTR

SEQ ID NO: 897817 - protein, 9 aa, Homo Sapiens
ALAQAFAVG

SEQ ID NO: 897818 - protein, 9 aa, Homo Sapiens
FFTQGQPVL

SEQ ID NO: 897819 - protein, 9 aa, Homo Sapiens
SNRNQTSRL

SEQ ID NO: 897820 - protein, 9 aa, Homo Sapiens
APEYWCYCL

SEQ ID NO: 897821 - protein, 9 aa, Homo Sapiens
QVTRSSARL

SEQ ID NO: 897822 - protein, 9 aa, Homo Sapiens
QAEVVKGLV

SEQ ID NO: 897823 - protein, 9 aa, Homo Sapiens
PNTLWSAGA

SEQ ID NO: 897824 - protein, 9 aa, Homo Sapiens
LKERDKDAH

SEQ ID NO: 897825 - protein, 9 aa, Homo Sapiens
HYSFNPVIG

SEQ ID NO: 897826 - protein, 9 aa, Homo Sapiens
YPKSTGNRG

SEQ ID NO: 897827 - protein, 9 aa, Homo Sapiens
SLIIQFTSF

SEQ ID NO: 897828 - protein, 9 aa, Homo Sapiens
GGDDKVIWL

SEQ ID NO: 897829 - protein, 9 aa, Homo Sapiens
LRVSSSPGV

SEQ ID NO: 897830 - protein, 9 aa, Homo Sapiens
TTLGGCHSP

SEQ ID NO: 897831 - protein, 9 aa, Homo Sapiens
WENICQVQG

SEQ ID NO: 897832 - protein, 9 aa, Homo Sapiens
DRTSKESGK

SEQ ID NO: 897833 - protein, 9 aa, Homo Sapiens
IFFIERCPS

SEQ ID NO: 897834 - protein, 9 aa, Homo Sapiens
QGGPNTLWS

SEQ ID NO: 897835 - protein, 9 aa, Homo Sapiens
NHRSPMRVL

SEQ ID NO: 897836 - protein, 9 aa, Homo Sapiens
HEEKDFIDF

SEQ ID NO: 897837 - protein, 9 aa, Homo Sapiens
SGVLLKSGN

SEQ ID NO: 897838 - protein, 9 aa, Homo Sapiens
VANHMRAVD

SEQ ID NO: 897839 - protein, 9 aa, Homo Sapiens
KNRTVFRFN

SEQ ID NO: 897840 - protein, 9 aa, Homo Sapiens
VRIGLEWLW

SEQ ID NO: 897841 - protein, 9 aa, Homo Sapiens
DSLSSRHRI

SEQ ID NO: 897842 - protein, 9 aa, Homo Sapiens
KGSYCHFVL

SEQ ID NO: 897843 - protein, 9 aa, Homo Sapiens
VEVGPQDGL

SEQ ID NO: 897844 - protein, 9 aa, Homo Sapiens
HRHTGIHTD

SEQ ID NO: 897845 - protein, 9 aa, Homo Sapiens
QHQCVQYAL

SEQ ID NO: 897846 - protein, 9 aa, Homo Sapiens
SNYMSVHAE

SEQ ID NO: 897847 - protein, 9 aa, Homo Sapiens
DTHRNTQAH

SEQ ID NO: 897848 - protein, 9 aa, Homo Sapiens
DNGYLLEKK

SEQ ID NO: 897849 - protein, 9 aa, Homo Sapiens
SSTLVGHKR

SEQ ID NO: 897850 - protein, 9 aa, Homo Sapiens
GGRWQESAG

SEQ ID NO: 897851 - protein, 9 aa, Homo Sapiens
RSSRMRFTD

SEQ ID NO: 897852 - protein, 9 aa, Homo Sapiens
WALDQAGFA

SEQ ID NO: 897853 - protein, 9 aa, Homo Sapiens
PYRCEKCGK

SEQ ID NO: 897854 - protein, 9 aa, Homo Sapiens
PELFSNTPT

SEQ ID NO: 897855 - protein, 9 aa, Homo Sapiens
GHHKMVLYT

SEQ ID NO: 897856 - protein, 9 aa, Homo Sapiens
MSDDFGQTW

SEQ ID NO: 897857 - protein, 9 aa, Homo Sapiens
VRVMAIYKQ

SEQ ID NO: 897858 - protein, 9 aa, Homo Sapiens
VGTLDCKFR

SEQ ID NO: 897859 - protein, 9 aa, Homo Sapiens
CRRFAQAPS

SEQ ID NO: 897860 - protein, 9 aa, Homo Sapiens
STHNSVSSG

SEQ ID NO: 897861 - protein, 9 aa, Homo Sapiens
RVPHQPPSP

SEQ ID NO: 897862 - protein, 9 aa, Homo Sapiens
DDDKACIII

SEQ ID NO: 897863 - protein, 9 aa, Homo Sapiens
KSPTGLVRA

SEQ ID NO: 897864 - protein, 9 aa, Homo Sapiens
TLEEIKSNK

SEQ ID NO: 897865 - protein, 9 aa, Homo Sapiens
LGKELFQCL

SEQ ID NO: 897866 - protein, 9 aa, Homo Sapiens
IKSNKMKEK

SEQ ID NO: 897867 - protein, 9 aa, Homo Sapiens
AEGSRVERV

SEQ ID NO: 897868 - protein, 9 aa, Homo Sapiens
NKRDCLMRR

SEQ ID NO: 897869 - protein, 9 aa, Homo Sapiens
LMDRTPDGW

SEQ ID NO: 897870 - protein, 9 aa, Homo Sapiens
APGGLLGRF

SEQ ID NO: 897871 - protein, 9 aa, Homo Sapiens
QLWMSDDFG

SEQ ID NO: 897872 - protein, 9 aa, Homo Sapiens
WGFSANSAR

SEQ ID NO: 897873 - protein, 9 aa, Homo Sapiens
QRAQKGRKK

SEQ ID NO: 897874 - protein, 9 aa, Homo Sapiens
TLVGHKRIH

SEQ ID NO: 897875 - protein, 9 aa, Homo Sapiens
RLSITLRIQ

SEQ ID NO: 897876 - protein, 9 aa, Homo Sapiens
NEDVEKEEE

SEQ ID NO: 897877 - protein, 9 aa, Homo Sapiens
EERLGDLAS

SEQ ID NO: 897878 - protein, 9 aa, Homo Sapiens
QSLGQGAAA

SEQ ID NO: 897879 - protein, 9 aa, Homo Sapiens
TADLLKQGV

SEQ ID NO: 897880 - protein, 9 aa, Homo Sapiens
AFKSQAPGY

SEQ ID NO: 897881 - protein, 9 aa, Homo Sapiens
QAPLPMHSD

SEQ ID NO: 897882 - protein, 9 aa, Homo Sapiens
IKEGKPHLI

SEQ ID NO: 897883 - protein, 9 aa, Homo Sapiens
PEPSEEGTR

SEQ ID NO: 897884 - protein, 9 aa, Homo Sapiens
LMLVFLALV

SEQ ID NO: 897885 - protein, 9 aa, Homo Sapiens
GTHTVVVMG

SEQ ID NO: 897886 - protein, 9 aa, Homo Sapiens
SISHSRSER

SEQ ID NO: 897887 - protein, 9 aa, Homo Sapiens
LSWPSPEES

SEQ ID NO: 897888 - protein, 9 aa, Homo Sapiens
EFSDLNAVS

SEQ ID NO: 897889 - protein, 9 aa, Homo Sapiens
REYFLGLSW

SEQ ID NO: 897890 - protein, 9 aa, Homo Sapiens
TGIHTDTHR

SEQ ID NO: 897891 - protein, 9 aa, Homo Sapiens
VTLSLRDFL

SEQ ID NO: 897892 - protein, 9 aa, Homo Sapiens
VQTGANTNR

SEQ ID NO: 897893 - protein, 9 aa, Homo Sapiens
HTQAYTLTY

SEQ ID NO: 897894 - protein, 9 aa, Homo Sapiens
ITDLRNQPH

SEQ ID NO: 897895 - protein, 9 aa, Homo Sapiens
VGACGVGKS

SEQ ID NO: 897896 - protein, 9 aa, Homo Sapiens
ILGDVFLGM

SEQ ID NO: 897897 - protein, 9 aa, Homo Sapiens
CETSPPPPT

SEQ ID NO: 897898 - protein, 9 aa, Homo Sapiens
IHGFQLQKH

SEQ ID NO: 897899 - protein, 9 aa, Homo Sapiens
IPEDKGNVK

SEQ ID NO: 897900 - protein, 9 aa, Homo Sapiens
GRWQESAGC

SEQ ID NO: 897901 - protein, 9 aa, Homo Sapiens
AFWCSISCY

SEQ ID NO: 897902 - protein, 9 aa, Homo Sapiens
TGTHRHIHS

SEQ ID NO: 897903 - protein, 9 aa, Homo Sapiens
RHTHTQAYT

SEQ ID NO: 897904 - protein, 9 aa, Homo Sapiens
NTPTSVIIS

SEQ ID NO: 897905 - protein, 9 aa, Homo Sapiens
LLADVCLNY

SEQ ID NO: 897906 - protein, 9 aa, Homo Sapiens
AYTLTYTGT

SEQ ID NO: 897907 - protein, 9 aa, Homo Sapiens
LTIMWALDQ

SEQ ID NO: 897908 - protein, 9 aa, Homo Sapiens
QTHIQAQTG

SEQ ID NO: 897909 - protein, 9 aa, Homo Sapiens
KELFQCLEL

SEQ ID NO: 897910 - protein, 9 aa, Homo Sapiens
GANTNRTSS

SEQ ID NO: 897911 - protein, 9 aa, Homo Sapiens
QTGANTNRT

SEQ ID NO: 897912 - protein, 9 aa, Homo Sapiens
RLGLSFWSL

SEQ ID NO: 897913 - protein, 9 aa, Homo Sapiens
HFSSKKSLA

SEQ ID NO: 897914 - protein, 9 aa, Homo Sapiens
FSNTPTSVI

SEQ ID NO: 897915 - protein, 9 aa, Homo Sapiens
RECLGTHTV

SEQ ID NO: 897916 - protein, 9 aa, Homo Sapiens
HCILHREVQ

SEQ ID NO: 897917 - protein, 9 aa, Homo Sapiens
ERNCKLWET

SEQ ID NO: 897918 - protein, 9 aa, Homo Sapiens
RHTGIHTDT

SEQ ID NO: 897919 - protein, 9 aa, Homo Sapiens
VSTPMPPKR

SEQ ID NO: 897920 - protein, 9 aa, Homo Sapiens
TFKNEKYSK

SEQ ID NO: 897921 - protein, 9 aa, Homo Sapiens
HKMVLYTLR

SEQ ID NO: 897922 - protein, 9 aa, Homo Sapiens
CLELLFNPP

SEQ ID NO: 897923 - protein, 9 aa, Homo Sapiens
LQLLDPTSS

SEQ ID NO: 897924 - protein, 9 aa, Homo Sapiens
MSPWGCACL

SEQ ID NO: 897925 - protein, 9 aa, Homo Sapiens
TGGVDSDLS

SEQ ID NO: 897926 - protein, 9 aa, Homo Sapiens
RITPSTHNS

SEQ ID NO: 897927 - protein, 9 aa, Homo Sapiens
IDELIIEEP

SEQ ID NO: 897928 - protein, 9 aa, Homo Sapiens
EDMEKLQQV

SEQ ID NO: 897929 - protein, 9 aa, Homo Sapiens
AAPGGLLGR

SEQ ID NO: 897930 - protein, 9 aa, Homo Sapiens
MPVRCNRKS

SEQ ID NO: 897931 - protein, 9 aa, Homo Sapiens
QAYTLTYTG

SEQ ID NO: 897932 - protein, 9 aa, Homo Sapiens
VMLPEDMEK

SEQ ID NO: 897933 - protein, 9 aa, Homo Sapiens
PSEEGTRLT

SEQ ID NO: 897934 - protein, 9 aa, Homo Sapiens
GTLDCKFRR

SEQ ID NO: 897935 - protein, 9 aa, Homo Sapiens
HTGIHTDTD

SEQ ID NO: 897936 - protein, 9 aa, Homo Sapiens
KKEDGINDI

SEQ ID NO: 897937 - protein, 9 aa, Homo Sapiens
PSLPDSLPW

SEQ ID NO: 897938 - protein, 9 aa, Homo Sapiens
DVCLNYLGG

SEQ ID NO: 897939 - protein, 9 aa, Homo Sapiens
EDGDIHPEI

SEQ ID NO: 897940 - protein, 9 aa, Homo Sapiens
HRYTHRHTQ

SEQ ID NO: 897941 - protein, 9 aa, Homo Sapiens
RWGFSANSA

SEQ ID NO: 897942 - protein, 9 aa, Homo Sapiens
SCLRRFSTI

SEQ ID NO: 897943 - protein, 9 aa, Homo Sapiens
GIPFRMTYA

SEQ ID NO: 897944 - protein, 9 aa, Homo Sapiens
SHSSSRWGF

SEQ ID NO: 897945 - protein, 9 aa, Homo Sapiens
IMWALDQAG

SEQ ID NO: 897946 - protein, 9 aa, Homo Sapiens
TPPWQKSPS

SEQ ID NO: 897947 - protein, 9 aa, Homo Sapiens
LLGRFNSDL

SEQ ID NO: 897948 - protein, 9 aa, Homo Sapiens
THRHTHTHR

SEQ ID NO: 897949 - protein, 9 aa, Homo Sapiens
SPPERLVKS

SEQ ID NO: 897950 - protein, 9 aa, Homo Sapiens
FNRKKTSKN

SEQ ID NO: 897951 - protein, 9 aa, Homo Sapiens
NGYLLEKKI

SEQ ID NO: 897952 - protein, 9 aa, Homo Sapiens
DSDLSEAMS

SEQ ID NO: 897953 - protein, 9 aa, Homo Sapiens
VTTEVLYAG

SEQ ID NO: 897954 - protein, 9 aa, Homo Sapiens
CLTIMWALD

SEQ ID NO: 897955 - protein, 9 aa, Homo Sapiens
EVGPQDGLQ

SEQ ID NO: 897956 - protein, 9 aa, Homo Sapiens
DNINKLLLL

SEQ ID NO: 897957 - protein, 9 aa, Homo Sapiens
EKCGKAFRW

SEQ ID NO: 897958 - protein, 9 aa, Homo Sapiens
RWQESAGCA

SEQ ID NO: 897959 - protein, 9 aa, Homo Sapiens
HPNKQLWMS

SEQ ID NO: 897960 - protein, 9 aa, Homo Sapiens
AVPLALAFI

SEQ ID NO: 897961 - protein, 9 aa, Homo Sapiens
NLSTHCREA

SEQ ID NO: 897962 - protein, 9 aa, Homo Sapiens
PISKAPTMD

SEQ ID NO: 897963 - protein, 9 aa, Homo Sapiens
GTTPPWQKS

SEQ ID NO: 897964 - protein, 9 aa, Homo Sapiens
KRRTRSKSQ

SEQ ID NO: 897965 - protein, 9 aa, Homo Sapiens
TVVAKVTNV

SEQ ID NO: 897966 - protein, 9 aa, Homo Sapiens
NDEHVISPK

SEQ ID NO: 897967 - protein, 9 aa, Homo Sapiens
LDKNQHQCV

SEQ ID NO: 897968 - protein, 9 aa, Homo Sapiens
NCISDSLSL

SEQ ID NO: 897969 - protein, 9 aa, Homo Sapiens
SELFWGDIQ

SEQ ID NO: 897970 - protein, 9 aa, Homo Sapiens
CELDKNQHQ

SEQ ID NO: 897971 - protein, 9 aa, Homo Sapiens
HFRWVHLRW

SEQ ID NO: 897972 - protein, 9 aa, Homo Sapiens
RYTHRHTQA

SEQ ID NO: 897973 - protein, 9 aa, Homo Sapiens
LRLEEDDIP

SEQ ID NO: 897974 - protein, 9 aa, Homo Sapiens
LLKQGVACN

SEQ ID NO: 897975 - protein, 9 aa, Homo Sapiens
HTGIHTDTH

SEQ ID NO: 897976 - protein, 9 aa, Homo Sapiens
RSISHSRSE

SEQ ID NO: 897977 - protein, 9 aa, Homo Sapiens
ADVCLNYLG

SEQ ID NO: 897978 - protein, 9 aa, Homo Sapiens
KAVERRSIN

SEQ ID NO: 897979 - protein, 9 aa, Homo Sapiens
QAQTGTHRH

SEQ ID NO: 897980 - protein, 9 aa, Homo Sapiens
SKRSSRMRF

SEQ ID NO: 897981 - protein, 9 aa, Homo Sapiens
KCVQNDEHV

SEQ ID NO: 897982 - protein, 9 aa, Homo Sapiens
EAGPCRVLY

SEQ ID NO: 897983 - protein, 9 aa, Homo Sapiens
VHLRWDGEP

SEQ ID NO: 897984 - protein, 9 aa, Homo Sapiens
DQETLALLA

SEQ ID NO: 897985 - protein, 9 aa, Homo Sapiens
LGDVFLGMY

SEQ ID NO: 897986 - protein, 9 aa, Homo Sapiens
LDCKFRRDS

SEQ ID NO: 897987 - protein, 9 aa, Homo Sapiens
PYHPGSTCL

SEQ ID NO: 897988 - protein, 9 aa, Homo Sapiens
FVEGQTVVA

SEQ ID NO: 897989 - protein, 9 aa, Homo Sapiens
SRPDPEPSE

SEQ ID NO: 897990 - protein, 9 aa, Homo Sapiens
HSDPQPPGL

SEQ ID NO: 897991 - protein, 9 aa, Homo Sapiens
WPQEVGRVY

SEQ ID NO: 897992 - protein, 9 aa, Homo Sapiens
PTAPRLGSR

SEQ ID NO: 897993 - protein, 9 aa, Homo Sapiens
RSINKEHNS

SEQ ID NO: 897994 - protein, 9 aa, Homo Sapiens
GEIGFPGWP

SEQ ID NO: 897995 - protein, 9 aa, Homo Sapiens
FKSQAPGYA

SEQ ID NO: 897996 - protein, 9 aa, Homo Sapiens
PPGVSVDLL

SEQ ID NO: 897997 - protein, 9 aa, Homo Sapiens
HTDTDTHSH

SEQ ID NO: 897998 - protein, 9 aa, Homo Sapiens
TQAYTQTHI

SEQ ID NO: 897999 - protein, 9 aa, Homo Sapiens
SLPDSLPWG

SEQ ID NO: 898000 - protein, 9 aa, Homo Sapiens
KACIIIRSL

SEQ ID NO: 898001 - protein, 9 aa, Homo Sapiens
GRFNSDLVT

SEQ ID NO: 898002 - protein, 9 aa, Homo Sapiens
NRTSSGQGT

SEQ ID NO: 898003 - protein, 9 aa, Homo Sapiens
WAQSQDCMA

SEQ ID NO: 898004 - protein, 9 aa, Homo Sapiens
SFSKRSSRM

SEQ ID NO: 898005 - protein, 9 aa, Homo Sapiens
ASGGPPISK

SEQ ID NO: 898006 - protein, 9 aa, Homo Sapiens
KLVVVGACG

SEQ ID NO: 898007 - protein, 9 aa, Homo Sapiens
KSNKMKEKS

SEQ ID NO: 898008 - protein, 9 aa, Homo Sapiens
DSAHSETEL

SEQ ID NO: 898009 - protein, 9 aa, Homo Sapiens
HSVTLSLRD

SEQ ID NO: 898010 - protein, 9 aa, Homo Sapiens
RLGDLASDL

SEQ ID NO: 898011 - protein, 9 aa, Homo Sapiens
ETFKNEKYS

SEQ ID NO: 898012 - protein, 9 aa, Homo Sapiens
TLDCKFRRD

SEQ ID NO: 898013 - protein, 9 aa, Homo Sapiens
GDLASDLLL

SEQ ID NO: 898014 - protein, 9 aa, Homo Sapiens
AGQTAFKSQ

SEQ ID NO: 898015 - protein, 9 aa, Homo Sapiens
LKNQKFLDE

SEQ ID NO: 898016 - protein, 9 aa, Homo Sapiens
PGVYSNVLY

SEQ ID NO: 898017 - protein, 9 aa, Homo Sapiens
AQEERLGDL

SEQ ID NO: 898018 - protein, 9 aa, Homo Sapiens
HSQIAVFKE

SEQ ID NO: 898019 - protein, 9 aa, Homo Sapiens
RFSTIPFMF

SEQ ID NO: 898020 - protein, 9 aa, Homo Sapiens
DCLMRRCSQ

SEQ ID NO: 898021 - protein, 9 aa, Homo Sapiens
ISKAPTMDA

SEQ ID NO: 898022 - protein, 9 aa, Homo Sapiens
HMFPYHSQI

SEQ ID NO: 898023 - protein, 9 aa, Homo Sapiens
GACGVGKSA

SEQ ID NO: 898024 - protein, 9 aa, Homo Sapiens
SCRTGLGRE

SEQ ID NO: 898025 - protein, 9 aa, Homo Sapiens
GIKEGKPHL

SEQ ID NO: 898026 - protein, 9 aa, Homo Sapiens
KLWETFKNE

SEQ ID NO: 898027 - protein, 9 aa, Homo Sapiens
PLALAFISV

SEQ ID NO: 898028 - protein, 9 aa, Homo Sapiens
LNLSTHCRE

SEQ ID NO: 898029 - protein, 9 aa, Homo Sapiens
QNDEHVISP

SEQ ID NO: 898030 - protein, 9 aa, Homo Sapiens
AQRLGLSFW

SEQ ID NO: 898031 - protein, 9 aa, Homo Sapiens
SELRITVYL

SEQ ID NO: 898032 - protein, 9 aa, Homo Sapiens
FQCLELLFN

SEQ ID NO: 898033 - protein, 9 aa, Homo Sapiens
STGLHSLGA

SEQ ID NO: 898034 - protein, 9 aa, Homo Sapiens
SEEGTRLTP

SEQ ID NO: 898035 - protein, 9 aa, Homo Sapiens
ITVYLCTDD

SEQ ID NO: 898036 - protein, 9 aa, Homo Sapiens
IFNFETFGN

SEQ ID NO: 898037 - protein, 9 aa, Homo Sapiens
YTGTHRHTH

SEQ ID NO: 898038 - protein, 9 aa, Homo Sapiens
TGLHSLGAT

SEQ ID NO: 898039 - protein, 9 aa, Homo Sapiens
LMPVSTPMP

SEQ ID NO: 898040 - protein, 9 aa, Homo Sapiens
HTVVVMGGK

SEQ ID NO: 898041 - protein, 9 aa, Homo Sapiens
TQAHTGIHT

SEQ ID NO: 898042 - protein, 9 aa, Homo Sapiens
RTHAYTREC

SEQ ID NO: 898043 - protein, 9 aa, Homo Sapiens
HRNTQAHTG

SEQ ID NO: 898044 - protein, 9 aa, Homo Sapiens
GSTDNINKL

SEQ ID NO: 898045 - protein, 9 aa, Homo Sapiens
YKFNECGKT

SEQ ID NO: 898046 - protein, 9 aa, Homo Sapiens
QTGTHRHIH

SEQ ID NO: 898047 - protein, 9 aa, Homo Sapiens
SITLRIQPN

SEQ ID NO: 898048 - protein, 9 aa, Homo Sapiens
ISHSRSERG

SEQ ID NO: 898049 - protein, 9 aa, Homo Sapiens
ELFWGDIQW

SEQ ID NO: 898050 - protein, 9 aa, Homo Sapiens
IEDQETLAL

SEQ ID NO: 898051 - protein, 9 aa, Homo Sapiens
MVHCILHRE

SEQ ID NO: 898052 - protein, 9 aa, Homo Sapiens
SWPKSKGSY

SEQ ID NO: 898053 - protein, 9 aa, Homo Sapiens
HNSVSSGLL

SEQ ID NO: 898054 - protein, 9 aa, Homo Sapiens
FWGDIQWRS

SEQ ID NO: 898055 - protein, 9 aa, Homo Sapiens
GVYSNVLYF

SEQ ID NO: 898056 - protein, 9 aa, Homo Sapiens
PWQKSPSGP

SEQ ID NO: 898057 - protein, 9 aa, Homo Sapiens
TQTHIQAQT

SEQ ID NO: 898058 - protein, 9 aa, Homo Sapiens
DGDIHPEIC

SEQ ID NO: 898059 - protein, 9 aa, Homo Sapiens
VVAKVTNVD

SEQ ID NO: 898060 - protein, 9 aa, Homo Sapiens
FFPCLCELD

SEQ ID NO: 898061 - protein, 9 aa, Homo Sapiens
KEDNGYLLE

SEQ ID NO: 898062 - protein, 9 aa, Homo Sapiens
SEAMSDCDP

SEQ ID NO: 898063 - protein, 9 aa, Homo Sapiens
SSFHMFPYH

SEQ ID NO: 898064 - protein, 9 aa, Homo Sapiens
VPHQPPSPQ

SEQ ID NO: 898065 - protein, 9 aa, Homo Sapiens
GLVRLSITL

SEQ ID NO: 898066 - protein, 9 aa, Homo Sapiens
VMAIYKQSQ

SEQ ID NO: 898067 - protein, 9 aa, Homo Sapiens
GPCRVLYLD

SEQ ID NO: 898068 - protein, 9 aa, Homo Sapiens
NRSSTLVGH

SEQ ID NO: 898069 - protein, 9 aa, Homo Sapiens
LKQGVACNV

SEQ ID NO: 898070 - protein, 9 aa, Homo Sapiens
PGSQRAQKG

SEQ ID NO: 898071 - protein, 9 aa, Homo Sapiens
PTGLVRAKE

SEQ ID NO: 898072 - protein, 9 aa, Homo Sapiens
ETELLRSQM

SEQ ID NO: 898073 - protein, 9 aa, Homo Sapiens
KKKDDIPED

SEQ ID NO: 898074 - protein, 9 aa, Homo Sapiens
VLMSPWGCA

SEQ ID NO: 898075 - protein, 9 aa, Homo Sapiens
GWPGRPGMN

SEQ ID NO: 898076 - protein, 9 aa, Homo Sapiens
LELLFNPPE

SEQ ID NO: 898077 - protein, 9 aa, Homo Sapiens
GVSVDLLPT

SEQ ID NO: 898078 - protein, 9 aa, Homo Sapiens
LGLSFWSLG

SEQ ID NO: 898079 - protein, 9 aa, Homo Sapiens
ENSELRITV

SEQ ID NO: 898080 - protein, 9 aa, Homo Sapiens
MAAALACSK

SEQ ID NO: 898081 - protein, 9 aa, Homo Sapiens
ERERRRSIS

SEQ ID NO: 898082 - protein, 9 aa, Homo Sapiens
VDLLPTSIL

SEQ ID NO: 898083 - protein, 9 aa, Homo Sapiens
NIFSKTKTH

SEQ ID NO: 898084 - protein, 9 aa, Homo Sapiens
IGFPGWPGR

SEQ ID NO: 898085 - protein, 9 aa, Homo Sapiens
VYSNVLYFV

SEQ ID NO: 898086 - protein, 9 aa, Homo Sapiens
IRGHHKMVL

SEQ ID NO: 898087 - protein, 9 aa, Homo Sapiens
YTRECLGTH

SEQ ID NO: 898088 - protein, 9 aa, Homo Sapiens
DGINDIFNF

SEQ ID NO: 898089 - protein, 9 aa, Homo Sapiens
VVVHSVTLS

SEQ ID NO: 898090 - protein, 9 aa, Homo Sapiens
GIHTDTDTH

SEQ ID NO: 898091 - protein, 9 aa, Homo Sapiens
CNRKSSSSL

SEQ ID NO: 898092 - protein, 9 aa, Homo Sapiens
DQAGFANLT

SEQ ID NO: 898093 - protein, 9 aa, Homo Sapiens
TDTDTHSHR

SEQ ID NO: 898094 - protein, 9 aa, Homo Sapiens
ETSPPPPTP

SEQ ID NO: 898095 - protein, 9 aa, Homo Sapiens
LIIEEPSRL

SEQ ID NO: 898096 - protein, 9 aa, Homo Sapiens
EEAPNCISD

SEQ ID NO: 898097 - protein, 9 aa, Homo Sapiens
AFNRSSTLV

SEQ ID NO: 898098 - protein, 9 aa, Homo Sapiens
PQLPKSPTG

SEQ ID NO: 898099 - protein, 9 aa, Homo Sapiens
NGRLLVATF

SEQ ID NO: 898100 - protein, 9 aa, Homo Sapiens
VKIVEVGPQ

SEQ ID NO: 898101 - protein, 9 aa, Homo Sapiens
GDLRQALPC

SEQ ID NO: 898102 - protein, 9 aa, Homo Sapiens
LGMYVAVFD

SEQ ID NO: 898103 - protein, 9 aa, Homo Sapiens
AHSETELLR

SEQ ID NO: 898104 - protein, 9 aa, Homo Sapiens
SSSRWGFSA

SEQ ID NO: 898105 - protein, 9 aa, Homo Sapiens
LYAGCTKTV

SEQ ID NO: 898106 - protein, 9 aa, Homo Sapiens
VLMPVSTPM

SEQ ID NO: 898107 - protein, 9 aa, Homo Sapiens
SKSQEKRHR

SEQ ID NO: 898108 - protein, 9 aa, Homo Sapiens
PSTHNSVSS

SEQ ID NO: 898109 - protein, 9 aa, Homo Sapiens
RSHSSSRWG

SEQ ID NO: 898110 - protein, 9 aa, Homo Sapiens
SNTPTSVII

SEQ ID NO: 898111 - protein, 9 aa, Homo Sapiens
AQSLGQGAA

SEQ ID NO: 898112 - protein, 9 aa, Homo Sapiens
AFIHGFQLQ

SEQ ID NO: 898113 - protein, 9 aa, Homo Sapiens
HRHTHTHRY

SEQ ID NO: 898114 - protein, 9 aa, Homo Sapiens
LRRFSTIPF

SEQ ID NO: 898115 - protein, 9 aa, Homo Sapiens
KEEADSCRT

SEQ ID NO: 898116 - protein, 9 aa, Homo Sapiens
HGLGSTDNI

SEQ ID NO: 898117 - protein, 9 aa, Homo Sapiens
CELDFWQEG

SEQ ID NO: 898118 - protein, 9 aa, Homo Sapiens
QKFLDELRM

SEQ ID NO: 898119 - protein, 9 aa, Homo Sapiens
CIIIRSLLD

SEQ ID NO: 898120 - protein, 9 aa, Homo Sapiens
GLKNQKFLD

SEQ ID NO: 898121 - protein, 9 aa, Homo Sapiens
QGVACNVLF

SEQ ID NO: 898122 - protein, 9 aa, Homo Sapiens
LWETFKNEK

SEQ ID NO: 898123 - protein, 9 aa, Homo Sapiens
CLRRFSTIP

SEQ ID NO: 898124 - protein, 9 aa, Homo Sapiens
TEEIEDQET

SEQ ID NO: 898125 - protein, 9 aa, Homo Sapiens
SFWSLGTLR

SEQ ID NO: 898126 - protein, 9 aa, Homo Sapiens
KSLAWFYEY

SEQ ID NO: 898127 - protein, 9 aa, Homo Sapiens
QAHTGIHTD

SEQ ID NO: 898128 - protein, 9 aa, Homo Sapiens
REVWRRAAD

SEQ ID NO: 898129 - protein, 9 aa, Homo Sapiens
CKFRRDSLF

SEQ ID NO: 898130 - protein, 9 aa, Homo Sapiens
LGNRLPAVG

SEQ ID NO: 898131 - protein, 9 aa, Homo Sapiens
IQAQTGTHR

SEQ ID NO: 898132 - protein, 9 aa, Homo Sapiens
WHVACTFLL

SEQ ID NO: 898133 - protein, 9 aa, Homo Sapiens
HSRTHAYTR

SEQ ID NO: 898134 - protein, 9 aa, Homo Sapiens
LSTHCREAT

SEQ ID NO: 898135 - protein, 9 aa, Homo Sapiens
IHTDTHRNT

SEQ ID NO: 898136 - protein, 9 aa, Homo Sapiens
DLRQALPCV

SEQ ID NO: 898137 - protein, 9 aa, Homo Sapiens
AQAPSLSSG

SEQ ID NO: 898138 - protein, 9 aa, Homo Sapiens
EKAVERRSI

SEQ ID NO: 898139 - protein, 9 aa, Homo Sapiens
QQHFRWVHL

SEQ ID NO: 898140 - protein, 9 aa, Homo Sapiens
LRPSLPDSL

SEQ ID NO: 898141 - protein, 9 aa, Homo Sapiens
FPCLCELDF

SEQ ID NO: 898142 - protein, 9 aa, Homo Sapiens
TRECLGTHT

SEQ ID NO: 898143 - protein, 9 aa, Homo Sapiens
SMPLLADVC

SEQ ID NO: 898144 - protein, 9 aa, Homo Sapiens
PEDKGNVKQ

SEQ ID NO: 898145 - protein, 9 aa, Homo Sapiens
VEGQTVVAK

SEQ ID NO: 898146 - protein, 9 aa, Homo Sapiens
EGFYNFEEQ

SEQ ID NO: 898147 - protein, 9 aa, Homo Sapiens
RVMAIYKQS

SEQ ID NO: 898148 - protein, 9 aa, Homo Sapiens
PPISKAPTM

SEQ ID NO: 898149 - protein, 9 aa, Homo Sapiens
IKSMNLRLE

SEQ ID NO: 898150 - protein, 9 aa, Homo Sapiens
RTPDGWPQE

SEQ ID NO: 898151 - protein, 9 aa, Homo Sapiens
LVATFTLIG

SEQ ID NO: 898152 - protein, 9 aa, Homo Sapiens
APAPYLGNR

SEQ ID NO: 898153 - protein, 9 aa, Homo Sapiens
THRTSMPTS

SEQ ID NO: 898154 - protein, 9 aa, Homo Sapiens
SKGSYCHFV

SEQ ID NO: 898155 - protein, 9 aa, Homo Sapiens
NSELRITVY

SEQ ID NO: 898156 - protein, 9 aa, Homo Sapiens
RMRFTDYQL

SEQ ID NO: 898157 - protein, 9 aa, Homo Sapiens
AQTGTHRHI

SEQ ID NO: 898158 - protein, 9 aa, Homo Sapiens
GPQDGLQNE

SEQ ID NO: 898159 - protein, 9 aa, Homo Sapiens
MWALDQAGF

SEQ ID NO: 898160 - protein, 9 aa, Homo Sapiens
FNRSSTLVG

SEQ ID NO: 898161 - protein, 9 aa, Homo Sapiens
GMHRHTHTQ

SEQ ID NO: 898162 - protein, 9 aa, Homo Sapiens
YRCEKCGKA

SEQ ID NO: 898163 - protein, 9 aa, Homo Sapiens
NFEEQNRAE

SEQ ID NO: 898164 - protein, 9 aa, Homo Sapiens
VCSTWHVAC

SEQ ID NO: 898165 - protein, 9 aa, Homo Sapiens
SETELLRSQ

SEQ ID NO: 898166 - protein, 9 aa, Homo Sapiens
ISGPEDGDI

SEQ ID NO: 898167 - protein, 9 aa, Homo Sapiens
DPASPPERL

SEQ ID NO: 898168 - protein, 9 aa, Homo Sapiens
HRHTHTQAY

SEQ ID NO: 898169 - protein, 9 aa, Homo Sapiens
MGEFSDLNA

SEQ ID NO: 898170 - protein, 9 aa, Homo Sapiens
NCELDKNQH

SEQ ID NO: 898171 - protein, 9 aa, Homo Sapiens
SSKKSLAWF

SEQ ID NO: 898172 - protein, 9 aa, Homo Sapiens
HSTGLHSLG

SEQ ID NO: 898173 - protein, 9 aa, Homo Sapiens
TGTHRHTHT

SEQ ID NO: 898174 - protein, 9 aa, Homo Sapiens
TGASGGPPI

SEQ ID NO: 898175 - protein, 9 aa, Homo Sapiens
ACTFLLMPR

SEQ ID NO: 898176 - protein, 9 aa, Homo Sapiens
NCEKEGFYN

SEQ ID NO: 898177 - protein, 9 aa, Homo Sapiens
LPDSLPWGA

SEQ ID NO: 898178 - protein, 9 aa, Homo Sapiens
TLSLRDFLV

SEQ ID NO: 898179 - protein, 9 aa, Homo Sapiens
VYEAGPCRV

SEQ ID NO: 898180 - protein, 9 aa, Homo Sapiens
SNVLYFVEW

SEQ ID NO: 898181 - protein, 9 aa, Homo Sapiens
KDDIPEDKG

SEQ ID NO: 898182 - protein, 9 aa, Homo Sapiens
LFQCLELLF

SEQ ID NO: 898183 - protein, 9 aa, Homo Sapiens
RNKRDCLMR

SEQ ID NO: 898184 - protein, 9 aa, Homo Sapiens
ATFFPCLCE

SEQ ID NO: 898185 - protein, 9 aa, Homo Sapiens
NINKLLLLD

SEQ ID NO: 898186 - protein, 9 aa, Homo Sapiens
SGRALKDVW

SEQ ID NO: 898187 - protein, 9 aa, Homo Sapiens
TDTHRNTQA

SEQ ID NO: 898188 - protein, 9 aa, Homo Sapiens
VVVGACGVG

SEQ ID NO: 898189 - protein, 9 aa, Homo Sapiens
KRDCLMRRC

SEQ ID NO: 898190 - protein, 9 aa, Homo Sapiens
SKVDDDKAC

SEQ ID NO: 898191 - protein, 9 aa, Homo Sapiens
EHFSSKKSL

SEQ ID NO: 898192 - protein, 9 aa, Homo Sapiens
LSEAMSDCD

SEQ ID NO: 898193 - protein, 9 aa, Homo Sapiens
SGGPPISKA

SEQ ID NO: 898194 - protein, 9 aa, Homo Sapiens
INKEHNSNF

SEQ ID NO: 898195 - protein, 9 aa, Homo Sapiens
PVVVHSVTL

SEQ ID NO: 898196 - protein, 9 aa, Homo Sapiens
TVFATQELQ

SEQ ID NO: 898197 - protein, 9 aa, Homo Sapiens
CVQNDEHVI

SEQ ID NO: 898198 - protein, 9 aa, Homo Sapiens
TDTHSHRHT

SEQ ID NO: 898199 - protein, 9 aa, Homo Sapiens
HRHTGMHRH

SEQ ID NO: 898200 - protein, 9 aa, Homo Sapiens
KCGRAFIHG

SEQ ID NO: 898201 - protein, 9 aa, Homo Sapiens
KREYFLGLS

SEQ ID NO: 898202 - protein, 9 aa, Homo Sapiens
THRHTGIHT

SEQ ID NO: 898203 - protein, 9 aa, Homo Sapiens
VRCNRKSSS

SEQ ID NO: 898204 - protein, 9 aa, Homo Sapiens
FLGMYVAVF

SEQ ID NO: 898205 - protein, 9 aa, Homo Sapiens
YHPGSTCLD

SEQ ID NO: 898206 - protein, 9 aa, Homo Sapiens
PVTTEVLYA

SEQ ID NO: 898207 - protein, 9 aa, Homo Sapiens
YSNVLYFVE

SEQ ID NO: 898208 - protein, 9 aa, Homo Sapiens
STHCREATD

SEQ ID NO: 898209 - protein, 9 aa, Homo Sapiens
HCREATDIL

SEQ ID NO: 898210 - protein, 9 aa, Homo Sapiens
QKKREYFLG

SEQ ID NO: 898211 - protein, 9 aa, Homo Sapiens
NRKKTSKNI

SEQ ID NO: 898212 - protein, 9 aa, Homo Sapiens
VVGACGVGK

SEQ ID NO: 898213 - protein, 9 aa, Homo Sapiens
RAVPLALAF

SEQ ID NO: 898214 - protein, 9 aa, Homo Sapiens
RHIHSRTHA

SEQ ID NO: 898215 - protein, 9 aa, Homo Sapiens
TPSTHNSVS

SEQ ID NO: 898216 - protein, 9 aa, Homo Sapiens
SRVERVPSR

SEQ ID NO: 898217 - protein, 9 aa, Homo Sapiens
QQRDVIDEL

SEQ ID NO: 898218 - protein, 9 aa, Homo Sapiens
VFLGMYVAV

SEQ ID NO: 898219 - protein, 9 aa, Homo Sapiens
SAQRLGLSF

SEQ ID NO: 898220 - protein, 9 aa, Homo Sapiens
SQDPREVWR

SEQ ID NO: 898221 - protein, 9 aa, Homo Sapiens
TELEMLAEK

SEQ ID NO: 898222 - protein, 9 aa, Homo Sapiens
EGKPHLIPA

SEQ ID NO: 898223 - protein, 9 aa, Homo Sapiens
ISDSLSLDN

SEQ ID NO: 898224 - protein, 9 aa, Homo Sapiens
RLLVATFTL

SEQ ID NO: 898225 - protein, 9 aa, Homo Sapiens
IPFMFCNIN

SEQ ID NO: 898226 - protein, 9 aa, Homo Sapiens
VIDELIIEE

SEQ ID NO: 898227 - protein, 9 aa, Homo Sapiens
WVHLRWDGE

SEQ ID NO: 898228 - protein, 9 aa, Homo Sapiens
SSLPEGGRW

SEQ ID NO: 898229 - protein, 9 aa, Homo Sapiens
FSKRSSRMR

SEQ ID NO: 898230 - protein, 9 aa, Homo Sapiens
VSVDLLPTS

SEQ ID NO: 898231 - protein, 9 aa, Homo Sapiens
KNQKFLDEL

SEQ ID NO: 898232 - protein, 9 aa, Homo Sapiens
PNKQLWMSD

SEQ ID NO: 898233 - protein, 9 aa, Homo Sapiens
PQDGLQNEK

SEQ ID NO: 898234 - protein, 9 aa, Homo Sapiens
PGGLLGRFN

SEQ ID NO: 898235 - protein, 9 aa, Homo Sapiens
FNECGKTFG

SEQ ID NO: 898236 - protein, 9 aa, Homo Sapiens
RTRSKSQEK

SEQ ID NO: 898237 - protein, 9 aa, Homo Sapiens
DPEPSEEGT

SEQ ID NO: 898238 - protein, 9 aa, Homo Sapiens
VLYFVEWIK

SEQ ID NO: 898239 - protein, 9 aa, Homo Sapiens
HTHTQAYTL

SEQ ID NO: 898240 - protein, 9 aa, Homo Sapiens
FTSTSTVPL

SEQ ID NO: 898241 - protein, 9 aa, Homo Sapiens
PNCISDSLS

SEQ ID NO: 898242 - protein, 9 aa, Homo Sapiens
AVGDLRQAL

SEQ ID NO: 898243 - protein, 9 aa, Homo Sapiens
LDSAHSETE

SEQ ID NO: 898244 - protein, 9 aa, Homo Sapiens
GNRLPAVGG

SEQ ID NO: 898245 - protein, 9 aa, Homo Sapiens
SRMRFTDYQ

SEQ ID NO: 898246 - protein, 9 aa, Homo Sapiens
LAKISRLKK

SEQ ID NO: 898247 - protein, 9 aa, Homo Sapiens
LPKSPTGLV

SEQ ID NO: 898248 - protein, 9 aa, Homo Sapiens
STWHVACTF

SEQ ID NO: 898249 - protein, 9 aa, Homo Sapiens
ACRRFAQAP

SEQ ID NO: 898250 - protein, 9 aa, Homo Sapiens
AKISRLKKR

SEQ ID NO: 898251 - protein, 9 aa, Homo Sapiens
THTMPVRCN

SEQ ID NO: 898252 - protein, 9 aa, Homo Sapiens
CLSQPYHPG

SEQ ID NO: 898253 - protein, 9 aa, Homo Sapiens
CVMLPEDME

SEQ ID NO: 898254 - protein, 9 aa, Homo Sapiens
GFQLQKHQI

SEQ ID NO: 898255 - protein, 9 aa, Homo Sapiens
ECLSQPYHP

SEQ ID NO: 898256 - protein, 9 aa, Homo Sapiens
VSAQRLGLS

SEQ ID NO: 898257 - protein, 9 aa, Homo Sapiens
SDLNAVSPG

SEQ ID NO: 898258 - protein, 9 aa, Homo Sapiens
PVSTPMPPK

SEQ ID NO: 898259 - protein, 9 aa, Homo Sapiens
WQESAGCAC

SEQ ID NO: 898260 - protein, 9 aa, Homo Sapiens
RYEGGPTAP

SEQ ID NO: 898261 - protein, 9 aa, Homo Sapiens
GKELFQCLE

SEQ ID NO: 898262 - protein, 9 aa, Homo Sapiens
QELQVPSEQ

SEQ ID NO: 898263 - protein, 9 aa, Homo Sapiens
DIPEDKGNV

SEQ ID NO: 898264 - protein, 9 aa, Homo Sapiens
CSISCYELN

SEQ ID NO: 898265 - protein, 9 aa, Homo Sapiens
FISVSNPRL

SEQ ID NO: 898266 - protein, 9 aa, Homo Sapiens
ITLRIQPND

SEQ ID NO: 898267 - protein, 9 aa, Homo Sapiens
QLPKSPTGL

SEQ ID NO: 898268 - protein, 9 aa, Homo Sapiens
RVRVMAIYK

SEQ ID NO: 898269 - protein, 9 aa, Homo Sapiens
VHCILHREV

SEQ ID NO: 898270 - protein, 9 aa, Homo Sapiens
RHTHTHRYT

SEQ ID NO: 898271 - protein, 9 aa, Homo Sapiens
THRNTQAHT

SEQ ID NO: 898272 - protein, 9 aa, Homo Sapiens
TPMPPKRPR

SEQ ID NO: 898273 - protein, 9 aa, Homo Sapiens
LQKKREYFL

SEQ ID NO: 898274 - protein, 9 aa, Homo Sapiens
KNQHQCVQY

SEQ ID NO: 898275 - protein, 9 aa, Homo Sapiens
TQAYTLTYT

SEQ ID NO: 898276 - protein, 9 aa, Homo Sapiens
HSHRHTHTH

SEQ ID NO: 898277 - protein, 9 aa, Homo Sapiens
PCRVLYLDP

SEQ ID NO: 898278 - protein, 9 aa, Homo Sapiens
STHTMPVRC

SEQ ID NO: 898279 - protein, 9 aa, Homo Sapiens
SVYEAGPCR

SEQ ID NO: 898280 - protein, 9 aa, Homo Sapiens
ERRSINKEH

SEQ ID NO: 898281 - protein, 9 aa, Homo Sapiens
RPSLPDSLP

SEQ ID NO: 898282 - protein, 9 aa, Homo Sapiens
APYLGNRLP

SEQ ID NO: 898283 - protein, 9 aa, Homo Sapiens
MLKEEADSC

SEQ ID NO: 898284 - protein, 9 aa, Homo Sapiens
RRFSTIPFM

SEQ ID NO: 898285 - protein, 9 aa, Homo Sapiens
WQKSPSGPF

SEQ ID NO: 898286 - protein, 9 aa, Homo Sapiens
PLLADVCLN

SEQ ID NO: 898287 - protein, 9 aa, Homo Sapiens
GRAFIHGFQ

SEQ ID NO: 898288 - protein, 9 aa, Homo Sapiens
ISRLKKRAK

SEQ ID NO: 898289 - protein, 9 aa, Homo Sapiens
KKDDIPEDK

SEQ ID NO: 898290 - protein, 9 aa, Homo Sapiens
ATEEIEDQE

SEQ ID NO: 898291 - protein, 9 aa, Homo Sapiens
QRLGLSFWS

SEQ ID NO: 898292 - protein, 9 aa, Homo Sapiens
STIPFMFCN

SEQ ID NO: 898293 - protein, 9 aa, Homo Sapiens
THTQAYTLT

SEQ ID NO: 898294 - protein, 9 aa, Homo Sapiens
NTQAHTGIH

SEQ ID NO: 898295 - protein, 9 aa, Homo Sapiens
KQLWMSDDF

SEQ ID NO: 898296 - protein, 9 aa, Homo Sapiens
EEIEDQETL

SEQ ID NO: 898297 - protein, 9 aa, Homo Sapiens
RAFIHGFQL

SEQ ID NO: 898298 - protein, 9 aa, Homo Sapiens
THNSVSSGL

SEQ ID NO: 898299 - protein, 9 aa, Homo Sapiens
RRSISHSRS

SEQ ID NO: 898300 - protein, 9 aa, Homo Sapiens
VGPQDGLQN

SEQ ID NO: 898301 - protein, 9 aa, Homo Sapiens
CKLWETFKN

SEQ ID NO: 898302 - protein, 9 aa, Homo Sapiens
FSTIPFMFC

SEQ ID NO: 898303 - protein, 9 aa, Homo Sapiens
PFRMTYAAS

SEQ ID NO: 898304 - protein, 9 aa, Homo Sapiens
ELDKNQHQC

SEQ ID NO: 898305 - protein, 9 aa, Homo Sapiens
LTELEMLAE

SEQ ID NO: 898306 - protein, 9 aa, Homo Sapiens
CLGTHTVVV

SEQ ID NO: 898307 - protein, 9 aa, Homo Sapiens
SVPFTSTST

SEQ ID NO: 898308 - protein, 9 aa, Homo Sapiens
FPYHSQIAV

SEQ ID NO: 898309 - protein, 9 aa, Homo Sapiens
GTHRHIHSR

SEQ ID NO: 898310 - protein, 9 aa, Homo Sapiens
DGLKNQKFL

SEQ ID NO: 898311 - protein, 9 aa, Homo Sapiens
VCLNYLGGL

SEQ ID NO: 898312 - protein, 9 aa, Homo Sapiens
GPGVYSNVL

SEQ ID NO: 898313 - protein, 9 aa, Homo Sapiens
NVKCVQNDE

SEQ ID NO: 898314 - protein, 9 aa, Homo Sapiens
HVACTFLLM

SEQ ID NO: 898315 - protein, 9 aa, Homo Sapiens
RGHHKMVLY

SEQ ID NO: 898316 - protein, 9 aa, Homo Sapiens
RVLYLDPTL

SEQ ID NO: 898317 - protein, 9 aa, Homo Sapiens
MPLLADVCL

SEQ ID NO: 898318 - protein, 9 aa, Homo Sapiens
HTQAYTQTH

SEQ ID NO: 898319 - protein, 9 aa, Homo Sapiens
PASPPERLV

SEQ ID NO: 898320 - protein, 9 aa, Homo Sapiens
NKQLWMSDD

SEQ ID NO: 898321 - protein, 9 aa, Homo Sapiens
VDDDKACII

SEQ ID NO: 898322 - protein, 9 aa, Homo Sapiens
LSNYMSVHA

SEQ ID NO: 898323 - protein, 9 aa, Homo Sapiens
PSPELFSNT

SEQ ID NO: 898324 - protein, 9 aa, Homo Sapiens
VFATQELQV

SEQ ID NO: 898325 - protein, 9 aa, Homo Sapiens
IWAQSQDCM

SEQ ID NO: 898326 - protein, 9 aa, Homo Sapiens
KCGKAFRWP

SEQ ID NO: 898327 - protein, 9 aa, Homo Sapiens
FRWVHLRWD

SEQ ID NO: 898328 - protein, 9 aa, Homo Sapiens
LDELRMNYI

SEQ ID NO: 898329 - protein, 9 aa, Homo Sapiens
MRRCSQPVF

SEQ ID NO: 898330 - protein, 9 aa, Homo Sapiens
PKSKGSYCH

SEQ ID NO: 898331 - protein, 9 aa, Homo Sapiens
NKMKEKSEE

SEQ ID NO: 898332 - protein, 9 aa, Homo Sapiens
FAQAPSLSS

SEQ ID NO: 898333 - protein, 9 aa, Homo Sapiens
QSELFWGDI

SEQ ID NO: 898334 - protein, 9 aa, Homo Sapiens
VLQKKREYF

SEQ ID NO: 898335 - protein, 9 aa, Homo Sapiens
TTPPWQKSP

SEQ ID NO: 898336 - protein, 9 aa, Homo Sapiens
NECLSQPYH

SEQ ID NO: 898337 - protein, 9 aa, Homo Sapiens
CLMRRCSQP

SEQ ID NO: 898338 - protein, 9 aa, Homo Sapiens
GPEDGDIHP

SEQ ID NO: 898339 - protein, 9 aa, Homo Sapiens
GVDSDLSEA

SEQ ID NO: 898340 - protein, 9 aa, Homo Sapiens
ACIIIRSLL

SEQ ID NO: 898341 - protein, 9 aa, Homo Sapiens
RHTQAYTQT

SEQ ID NO: 898342 - protein, 9 aa, Homo Sapiens
YNFEEQNRA

SEQ ID NO: 898343 - protein, 9 aa, Homo Sapiens
VVHSVTLSL

SEQ ID NO: 898344 - protein, 9 aa, Homo Sapiens
ELDSAHSET

SEQ ID NO: 898345 - protein, 9 aa, Homo Sapiens
AQSQDCMAA

SEQ ID NO: 898346 - protein, 9 aa, Homo Sapiens
SFHMFPYHS

SEQ ID NO: 898347 - protein, 9 aa, Homo Sapiens
SRWGFSANS

SEQ ID NO: 898348 - protein, 9 aa, Homo Sapiens
ERVPSRSAS

SEQ ID NO: 898349 - protein, 9 aa, Homo Sapiens
PCLCELDFW

SEQ ID NO: 898350 - protein, 9 aa, Homo Sapiens
QRNKRDCLM

SEQ ID NO: 898351 - protein, 9 aa, Homo Sapiens
LMRRCSQPV

SEQ ID NO: 898352 - protein, 9 aa, Homo Sapiens
AISGPEDGD

SEQ ID NO: 898353 - protein, 9 aa, Homo Sapiens
VWRRAADWA

SEQ ID NO: 898354 - protein, 9 aa, Homo Sapiens
MHSDPQPPG

SEQ ID NO: 898355 - protein, 9 aa, Homo Sapiens
SVDLLPTSI

SEQ ID NO: 898356 - protein, 9 aa, Homo Sapiens
LGRFNSDLV

SEQ ID NO: 898357 - protein, 9 aa, Homo Sapiens
ASPPERLVK

SEQ ID NO: 898358 - protein, 9 aa, Homo Sapiens
LADVCLNYL

SEQ ID NO: 898359 - protein, 9 aa, Homo Sapiens
NLRLEEDDI

SEQ ID NO: 898360 - protein, 9 aa, Homo Sapiens
AVMGEFSDL

SEQ ID NO: 898361 - protein, 9 aa, Homo Sapiens
VMGEFSDLN

SEQ ID NO: 898362 - protein, 9 aa, Homo Sapiens
AFISVSNPR

SEQ ID NO: 898363 - protein, 9 aa, Homo Sapiens
LLVATFTLI

SEQ ID NO: 898364 - protein, 9 aa, Homo Sapiens
ILNLSTHCR

SEQ ID NO: 898365 - protein, 9 aa, Homo Sapiens
PPGTTPPWQ

SEQ ID NO: 898366 - protein, 9 aa, Homo Sapiens
MNSVPFTST

SEQ ID NO: 898367 - protein, 9 aa, Homo Sapiens
LSITLRIQP

SEQ ID NO: 898368 - protein, 9 aa, Homo Sapiens
QDPREVWRR

SEQ ID NO: 898369 - protein, 9 aa, Homo Sapiens
EDQETLALL

SEQ ID NO: 898370 - protein, 9 aa, Homo Sapiens
GFPGWPGRP

SEQ ID NO: 898371 - protein, 9 aa, Homo Sapiens
DIHPEICRL

SEQ ID NO: 898372 - protein, 9 aa, Homo Sapiens
PDPEPSEEG

SEQ ID NO: 898373 - protein, 9 aa, Homo Sapiens
EIEDQETLA

SEQ ID NO: 898374 - protein, 9 aa, Homo Sapiens
DKACIIIRS

SEQ ID NO: 898375 - protein, 9 aa, Homo Sapiens
RLEEDDIPW

SEQ ID NO: 898376 - protein, 9 aa, Homo Sapiens
INDIFNFET

SEQ ID NO: 898377 - protein, 9 aa, Homo Sapiens
CEKEGFYNF

SEQ ID NO: 898378 - protein, 9 aa, Homo Sapiens
KISRLKKRA

SEQ ID NO: 898379 - protein, 9 aa, Homo Sapiens
LEEDDIPWE

SEQ ID NO: 898380 - protein, 9 aa, Homo Sapiens
TAPRLGSRT

SEQ ID NO: 898381 - protein, 9 aa, Homo Sapiens
SLPWGAAPG

SEQ ID NO: 898382 - protein, 9 aa, Homo Sapiens
CSTWHVACT

SEQ ID NO: 898383 - protein, 9 aa, Homo Sapiens
SVTLSLRDF

SEQ ID NO: 898384 - protein, 9 aa, Homo Sapiens
TMNSVPFTS

SEQ ID NO: 898385 - protein, 9 aa, Homo Sapiens
CLNYLGGLV

SEQ ID NO: 898386 - protein, 9 aa, Homo Sapiens
LACRRFAQA

SEQ ID NO: 898387 - protein, 9 aa, Homo Sapiens
HREVQDAVK

SEQ ID NO: 898388 - protein, 9 aa, Homo Sapiens
MSVHAESGK

SEQ ID NO: 898389 - protein, 9 aa, Homo Sapiens
RALKDVWDR

SEQ ID NO: 898390 - protein, 9 aa, Homo Sapiens
HQCVQYALK

SEQ ID NO: 898391 - protein, 9 aa, Homo Sapiens
QETLALLAA

SEQ ID NO: 898392 - protein, 9 aa, Homo Sapiens
NDIFNFETF

SEQ ID NO: 898393 - protein, 9 aa, Homo Sapiens
IEIVLQKKR

SEQ ID NO: 898394 - protein, 9 aa, Homo Sapiens
STLVGHKRI

SEQ ID NO: 898395 - protein, 9 aa, Homo Sapiens
QLLDPTSSR

SEQ ID NO: 898396 - protein, 9 aa, Homo Sapiens
LLLQLLDPT

SEQ ID NO: 898397 - protein, 9 aa, Homo Sapiens
DSLPWGAAP

SEQ ID NO: 898398 - protein, 9 aa, Homo Sapiens
RNCKLWETF

SEQ ID NO: 898399 - protein, 9 aa, Homo Sapiens
ISCYELNQR

SEQ ID NO: 898400 - protein, 9 aa, Homo Sapiens
SLAWFYEYA

SEQ ID NO: 898401 - protein, 9 aa, Homo Sapiens
NSVPFTSTS

SEQ ID NO: 898402 - protein, 9 aa, Homo Sapiens
SGPEDGDIH

SEQ ID NO: 898403 - protein, 9 aa, Homo Sapiens
LMSPWGCAC

SEQ ID NO: 898404 - protein, 9 aa, Homo Sapiens
GGPTAPRLG

SEQ ID NO: 898405 - protein, 9 aa, Homo Sapiens
GMYVAVFDR

SEQ ID NO: 898406 - protein, 9 aa, Homo Sapiens
THRHIHSRT

SEQ ID NO: 898407 - protein, 9 aa, Homo Sapiens
ERLVKSGSL

SEQ ID NO: 898408 - protein, 9 aa, Homo Sapiens
FATQELQVP

SEQ ID NO: 898409 - protein, 9 aa, Homo Sapiens
KEDGINDIF

SEQ ID NO: 898410 - protein, 9 aa, Homo Sapiens
CGVGKSALT

SEQ ID NO: 898411 - protein, 9 aa, Homo Sapiens
CLCELDFWQ

SEQ ID NO: 898412 - protein, 9 aa, Homo Sapiens
PQAPLPMHS

SEQ ID NO: 898413 - protein, 9 aa, Homo Sapiens
APNCISDSL

SEQ ID NO: 898414 - protein, 9 aa, Homo Sapiens
KSQAPGYAA

SEQ ID NO: 898415 - protein, 9 aa, Homo Sapiens
THTVVVMGG

SEQ ID NO: 898416 - protein, 9 aa, Homo Sapiens
GLVRAKEGK

SEQ ID NO: 898417 - protein, 9 aa, Homo Sapiens
VERVPSRSA

SEQ ID NO: 898418 - protein, 9 aa, Homo Sapiens
GEKPYRCEK

SEQ ID NO: 898419 - protein, 9 aa, Homo Sapiens
EIGFPGWPG

SEQ ID NO: 898420 - protein, 9 aa, Homo Sapiens
SQRAQKGRK

SEQ ID NO: 898421 - protein, 9 aa, Homo Sapiens
NSVSSGLLR

SEQ ID NO: 898422 - protein, 9 aa, Homo Sapiens
GSRVERVPS

SEQ ID NO: 898423 - protein, 9 aa, Homo Sapiens
LGTHTVVVM

SEQ ID NO: 898424 - protein, 9 aa, Homo Sapiens
IAVMGEFSD

SEQ ID NO: 898425 - protein, 9 aa, Homo Sapiens
NVLMSPWGC

SEQ ID NO: 898426 - protein, 9 aa, Homo Sapiens
THRHTQAYT

SEQ ID NO: 898427 - protein, 9 aa, Homo Sapiens
HTHTHRYTH

SEQ ID NO: 898428 - protein, 9 aa, Homo Sapiens
RQALPCVAE

SEQ ID NO: 898429 - protein, 9 aa, Homo Sapiens
PGVSVDLLP

SEQ ID NO: 898430 - protein, 9 aa, Homo Sapiens
SLGQGAAAS

SEQ ID NO: 898431 - protein, 9 aa, Homo Sapiens
VACTFLLMP

SEQ ID NO: 898432 - protein, 9 aa, Homo Sapiens
SNKMKEKSE

SEQ ID NO: 898433 - protein, 9 aa, Homo Sapiens
GPTAPRLGS

SEQ ID NO: 898434 - protein, 9 aa, Homo Sapiens
ALAFISVSN

SEQ ID NO: 898435 - protein, 9 aa, Homo Sapiens
HRRADAVRR

SEQ ID NO: 898436 - protein, 9 aa, Homo Sapiens
LGQGAAASG

SEQ ID NO: 898437 - protein, 9 aa, Homo Sapiens
NVLYFVEWI

SEQ ID NO: 898438 - protein, 9 aa, Homo Sapiens
KNIFSKTKT

SEQ ID NO: 898439 - protein, 9 aa, Homo Sapiens
QDGLQNEKN

SEQ ID NO: 898440 - protein, 9 aa, Homo Sapiens
ERLGDLASD

SEQ ID NO: 898441 - protein, 9 aa, Homo Sapiens
HRHTQAYTQ

SEQ ID NO: 898442 - protein, 9 aa, Homo Sapiens
AAQEERLGD

SEQ ID NO: 898443 - protein, 9 aa, Homo Sapiens
CRVLYLDPT

SEQ ID NO: 898444 - protein, 9 aa, Homo Sapiens
EDNGYLLEK

SEQ ID NO: 898445 - protein, 9 aa, Homo Sapiens
KFNECGKTF

SEQ ID NO: 898446 - protein, 9 aa, Homo Sapiens
FLDELRMNY

SEQ ID NO: 898447 - protein, 9 aa, Homo Sapiens
MDEAVGDLR

SEQ ID NO: 898448 - protein, 9 aa, Homo Sapiens
MDRTPDGWP

SEQ ID NO: 898449 - protein, 9 aa, Homo Sapiens
EEIKSNKMK

SEQ ID NO: 898450 - protein, 9 aa, Homo Sapiens
LKEEADSCR

SEQ ID NO: 898451 - protein, 9 aa, Homo Sapiens
LGLSWPSPE

SEQ ID NO: 898452 - protein, 9 aa, Homo Sapiens
HHKMVLYTL

SEQ ID NO: 898453 - protein, 9 aa, Homo Sapiens
LPTSILLVS

SEQ ID NO: 898454 - protein, 9 aa, Homo Sapiens
TSKNIFSKT

SEQ ID NO: 898455 - protein, 9 aa, Homo Sapiens
MLPEDMEKL

SEQ ID NO: 898456 - protein, 9 aa, Homo Sapiens
AAAQEERLG

SEQ ID NO: 898457 - protein, 9 aa, Homo Sapiens
DATFFPCLC

SEQ ID NO: 898458 - protein, 9 aa, Homo Sapiens
PEDMEKLQQ

SEQ ID NO: 898459 - protein, 9 aa, Homo Sapiens
MRFTDYQLR

SEQ ID NO: 898460 - protein, 9 aa, Homo Sapiens
SLPEGGRWQ

SEQ ID NO: 898461 - protein, 9 aa, Homo Sapiens
HAYTRECLG

SEQ ID NO: 898462 - protein, 9 aa, Homo Sapiens
GLHSLGATL

SEQ ID NO: 898463 - protein, 9 aa, Homo Sapiens
SHPNKQLWM

SEQ ID NO: 898464 - protein, 9 aa, Homo Sapiens
ELRITVYLC

SEQ ID NO: 898465 - protein, 9 aa, Homo Sapiens
TSPPPPTPR

SEQ ID NO: 898466 - protein, 9 aa, Homo Sapiens
TWHVACTFL

SEQ ID NO: 898467 - protein, 9 aa, Homo Sapiens
YTQTHIQAQ

SEQ ID NO: 898468 - protein, 9 aa, Homo Sapiens
RHSTGLHSL

SEQ ID NO: 898469 - protein, 9 aa, Homo Sapiens
WRRAADWAE

SEQ ID NO: 898470 - protein, 9 aa, Homo Sapiens
DCKFRRDSL

SEQ ID NO: 898471 - protein, 9 aa, Homo Sapiens
VPLALAFIS

SEQ ID NO: 898472 - protein, 9 aa, Homo Sapiens
KEGFYNFEE

SEQ ID NO: 898473 - protein, 9 aa, Homo Sapiens
YFLGLSWPS

SEQ ID NO: 898474 - protein, 9 aa, Homo Sapiens
AAILNLSTH

SEQ ID NO: 898475 - protein, 9 aa, Homo Sapiens
HSWPKSKGS

SEQ ID NO: 898476 - protein, 9 aa, Homo Sapiens
LAFISVSNP

SEQ ID NO: 898477 - protein, 9 aa, Homo Sapiens
ELFQCLELL

SEQ ID NO: 898478 - protein, 9 aa, Homo Sapiens
KGEIGFPGW

SEQ ID NO: 898479 - protein, 9 aa, Homo Sapiens
LSSVGTLDC

SEQ ID NO: 898480 - protein, 9 aa, Homo Sapiens
GQGAAASGP

SEQ ID NO: 898481 - protein, 9 aa, Homo Sapiens
AILNLSTHC

SEQ ID NO: 898482 - protein, 9 aa, Homo Sapiens
KHSWPKSKG

SEQ ID NO: 898483 - protein, 9 aa, Homo Sapiens
TFFPCLCEL

SEQ ID NO: 898484 - protein, 9 aa, Homo Sapiens
THTHRHTGI

SEQ ID NO: 898485 - protein, 9 aa, Homo Sapiens
EMLAEKLNE

SEQ ID NO: 898486 - protein, 9 aa, Homo Sapiens
AYTRECLGT

SEQ ID NO: 898487 - protein, 9 aa, Homo Sapiens
EGQTVVAKV

SEQ ID NO: 898488 - protein, 9 aa, Homo Sapiens
AQSELFWGD

SEQ ID NO: 898489 - protein, 9 aa, Homo Sapiens
KKSLAWFYE

SEQ ID NO: 898490 - protein, 9 aa, Homo Sapiens
TGANTNRTS

SEQ ID NO: 898491 - protein, 9 aa, Homo Sapiens
TIPFMFCNI

SEQ ID NO: 898492 - protein, 9 aa, Homo Sapiens
GEFSDLNAV

SEQ ID NO: 898493 - protein, 9 aa, Homo Sapiens
LTYTGTHRH

SEQ ID NO: 898494 - protein, 9 aa, Homo Sapiens
DVIDELIIE

SEQ ID NO: 898495 - protein, 9 aa, Homo Sapiens
RWVHLRWDG

SEQ ID NO: 898496 - protein, 9 aa, Homo Sapiens
SQEKRHRHR

SEQ ID NO: 898497 - protein, 9 aa, Homo Sapiens
DLRNQPHRR

SEQ ID NO: 898498 - protein, 9 aa, Homo Sapiens
GIHTDTHRN

SEQ ID NO: 898499 - protein, 9 aa, Homo Sapiens
RFAQAPSLS

SEQ ID NO: 898500 - protein, 9 aa, Homo Sapiens
DRTPDGWPQ

SEQ ID NO: 898501 - protein, 9 aa, Homo Sapiens
NQHQCVQYA

SEQ ID NO: 898502 - protein, 9 aa, Homo Sapiens
SSRMRFTDY

SEQ ID NO: 898503 - protein, 9 aa, Homo Sapiens
EGGRWQESA

SEQ ID NO: 898504 - protein, 9 aa, Homo Sapiens
IHSRTHAYT

SEQ ID NO: 898505 - protein, 9 aa, Homo Sapiens
HTHTHRHTG

SEQ ID NO: 898506 - protein, 9 aa, Homo Sapiens
RALSNYMSV

SEQ ID NO: 898507 - protein, 9 aa, Homo Sapiens
PFTSTSTVP

SEQ ID NO: 898508 - protein, 9 aa, Homo Sapiens
THTHRYTHR

SEQ ID NO: 898509 - protein, 9 aa, Homo Sapiens
THCREATDI

SEQ ID NO: 898510 - protein, 9 aa, Homo Sapiens
HGFQLQKHQ

SEQ ID NO: 898511 - protein, 9 aa, Homo Sapiens
GFTHRTSMP

SEQ ID NO: 898512 - protein, 9 aa, Homo Sapiens
HTHRHTGIH

SEQ ID NO: 898513 - protein, 9 aa, Homo Sapiens
GQNEDVEKE

SEQ ID NO: 898514 - protein, 9 aa, Homo Sapiens
TTEVLYAGC

SEQ ID NO: 898515 - protein, 9 aa, Homo Sapiens
RHTHTHRHT

SEQ ID NO: 898516 - protein, 9 aa, Homo Sapiens
RDVIDELII

SEQ ID NO: 898517 - protein, 9 aa, Homo Sapiens
HNECLSQPY

SEQ ID NO: 898518 - protein, 9 aa, Homo Sapiens
NGFTHRTSM

SEQ ID NO: 898519 - protein, 9 aa, Homo Sapiens
LEMLAEKLN

SEQ ID NO: 898520 - protein, 9 aa, Homo Sapiens
SSVGTLDCK

SEQ ID NO: 898521 - protein, 9 aa, Homo Sapiens
LIVKHIRKN

SEQ ID NO: 898522 - protein, 9 aa, Homo Sapiens
LVRLSITLR

SEQ ID NO: 898523 - protein, 9 aa, Homo Sapiens
LWMSDDFGQ

SEQ ID NO: 898524 - protein, 9 aa, Homo Sapiens
RMTYAASKH

SEQ ID NO: 898525 - protein, 9 aa, Homo Sapiens
GTRVRVMAI

SEQ ID NO: 898526 - protein, 9 aa, Homo Sapiens
PHLIPAGPI

SEQ ID NO: 898527 - protein, 9 aa, Homo Sapiens
EEADSCRTG

SEQ ID NO: 898528 - protein, 9 aa, Homo Sapiens
FHMFPYHSQ

SEQ ID NO: 898529 - protein, 9 aa, Homo Sapiens
LRITVYLCT

SEQ ID NO: 898530 - protein, 9 aa, Homo Sapiens
GDIHPEICR

SEQ ID NO: 898531 - protein, 9 aa, Homo Sapiens
LALAFISVS

SEQ ID NO: 898532 - protein, 9 aa, Homo Sapiens
GLSWPSPEE

SEQ ID NO: 898533 - protein, 9 aa, Homo Sapiens
GKPHLIPAG

SEQ ID NO: 898534 - protein, 9 aa, Homo Sapiens
EGIRGHHKM

SEQ ID NO: 898535 - protein, 9 aa, Homo Sapiens
KQGVACNVL

SEQ ID NO: 898536 - protein, 9 aa, Homo Sapiens
YMSVHAESG

SEQ ID NO: 898537 - protein, 9 aa, Homo Sapiens
LFSNTPTSV

SEQ ID NO: 898538 - protein, 9 aa, Homo Sapiens
PYHSQIAVF

SEQ ID NO: 898539 - protein, 9 aa, Homo Sapiens
EIVLQKKRE

SEQ ID NO: 898540 - protein, 9 aa, Homo Sapiens
RHTGMHRHT

SEQ ID NO: 898541 - protein, 9 aa, Homo Sapiens
GPPGTTPPW

SEQ ID NO: 898542 - protein, 9 aa, Homo Sapiens
PEGGRWQES

SEQ ID NO: 898543 - protein, 9 aa, Homo Sapiens
IPSPELFSN

SEQ ID NO: 898544 - protein, 9 aa, Homo Sapiens
DGWPQEVGR

SEQ ID NO: 898545 - protein, 9 aa, Homo Sapiens
QAPSLSSGH

SEQ ID NO: 898546 - protein, 9 aa, Homo Sapiens
DTDTHSHRH

SEQ ID NO: 898547 - protein, 9 aa, Homo Sapiens
NYMSVHAES

SEQ ID NO: 898548 - protein, 9 aa, Homo Sapiens
RTSMPTSST

SEQ ID NO: 898549 - protein, 9 aa, Homo Sapiens
TEGIRGHHK

SEQ ID NO: 898550 - protein, 9 aa, Homo Sapiens
LDQAGFANL

SEQ ID NO: 898551 - protein, 9 aa, Homo Sapiens
HTHRYTHRH

SEQ ID NO: 898552 - protein, 9 aa, Homo Sapiens
MLAEKLNEQ

SEQ ID NO: 898553 - protein, 9 aa, Homo Sapiens
AGPCRVLYL

SEQ ID NO: 898554 - protein, 9 aa, Homo Sapiens
PYLGNRLPA

SEQ ID NO: 898555 - protein, 9 aa, Homo Sapiens
SPWGCACLV

SEQ ID NO: 898556 - protein, 9 aa, Homo Sapiens
EPSEEGTRL

SEQ ID NO: 898557 - protein, 9 aa, Homo Sapiens
QRDVIDELI

SEQ ID NO: 898558 - protein, 9 aa, Homo Sapiens
VACNVLFVN

SEQ ID NO: 898559 - protein, 9 aa, Homo Sapiens
EKPYRCEKC

SEQ ID NO: 898560 - protein, 9 aa, Homo Sapiens
LSLRDFLVI

SEQ ID NO: 898561 - protein, 9 aa, Homo Sapiens
IVEVGPQDG

SEQ ID NO: 898562 - protein, 9 aa, Homo Sapiens
TGIHTDTDT

SEQ ID NO: 898563 - protein, 9 aa, Homo Sapiens
FGIPFRMTY

SEQ ID NO: 898564 - protein, 9 aa, Homo Sapiens
GTHRHTHTH

SEQ ID NO: 898565 - protein, 9 aa, Homo Sapiens
RNQPHRRAD

SEQ ID NO: 898566 - protein, 9 aa, Homo Sapiens
EGQNEDVEK

SEQ ID NO: 898567 - protein, 9 aa, Homo Sapiens
VDSDLSEAM

SEQ ID NO: 898568 - protein, 9 aa, Homo Sapiens
ASRVPHQPP

SEQ ID NO: 898569 - protein, 9 aa, Homo Sapiens
VQNDEHVIS

SEQ ID NO: 898570 - protein, 9 aa, Homo Sapiens
VPFTSTSTV

SEQ ID NO: 898571 - protein, 9 aa, Homo Sapiens
DEAVGDLRQ

SEQ ID NO: 898572 - protein, 9 aa, Homo Sapiens
SKKSLAWFY

SEQ ID NO: 898573 - protein, 9 aa, Homo Sapiens
TLTYTGTHR

SEQ ID NO: 898574 - protein, 9 aa, Homo Sapiens
LPMHSDPQP

SEQ ID NO: 898575 - protein, 9 aa, Homo Sapiens
KTSKNIFSK

SEQ ID NO: 898576 - protein, 9 aa, Homo Sapiens
IVLQKKREY

SEQ ID NO: 898577 - protein, 9 aa, Homo Sapiens
RKNQAKKAA

SEQ ID NO: 898578 - protein, 9 aa, Homo Sapiens
YEAGPCRVL

SEQ ID NO: 898579 - protein, 9 aa, Homo Sapiens
RITVYLCTD

SEQ ID NO: 898580 - protein, 9 aa, Homo Sapiens
GGKEDNGYL

SEQ ID NO: 898581 - protein, 9 aa, Homo Sapiens
QDCMAAALA

SEQ ID NO: 898582 - protein, 9 aa, Homo Sapiens
PPPPTPRAL

SEQ ID NO: 898583 - protein, 9 aa, Homo Sapiens
DMEKLQQVD

SEQ ID NO: 898584 - protein, 9 aa, Homo Sapiens
LVVVGACGV

SEQ ID NO: 898585 - protein, 9 aa, Homo Sapiens
LARHSTGLH

SEQ ID NO: 898586 - protein, 9 aa, Homo Sapiens
LFWGDIQWR

SEQ ID NO: 898587 - protein, 9 aa, Homo Sapiens
YTLTYTGTH

SEQ ID NO: 898588 - protein, 9 aa, Homo Sapiens
VLYAGCTKT

SEQ ID NO: 898589 - protein, 9 aa, Homo Sapiens
TVVVMGGKE

SEQ ID NO: 898590 - protein, 9 aa, Homo Sapiens
CAQSLGQGA

SEQ ID NO: 898591 - protein, 9 aa, Homo Sapiens
RKHSWPKSK

SEQ ID NO: 898592 - protein, 9 aa, Homo Sapiens
IPFRMTYAA

SEQ ID NO: 898593 - protein, 9 aa, Homo Sapiens
HLIPAGPIT

SEQ ID NO: 898594 - protein, 9 aa, Homo Sapiens
PDSLPWGAA

SEQ ID NO: 898595 - protein, 9 aa, Homo Sapiens
RSKSQEKRH

SEQ ID NO: 898596 - protein, 9 aa, Homo Sapiens
HTMNSVPFT

SEQ ID NO: 898597 - protein, 9 aa, Homo Sapiens
VMVHCILHR

SEQ ID NO: 898598 - protein, 9 aa, Homo Sapiens
HDEGQNEDV

SEQ ID NO: 898599 - protein, 9 aa, Homo Sapiens
PKSPTGLVR

SEQ ID NO: 898600 - protein, 9 aa, Homo Sapiens
LRQALPCVA

SEQ ID NO: 898601 - protein, 9 aa, Homo Sapiens
TPDGWPQEV

SEQ ID NO: 898602 - protein, 9 aa, Homo Sapiens
LYFVEWIKR

SEQ ID NO: 898603 - protein, 9 aa, Homo Sapiens
TGMHRHTHT

SEQ ID NO: 898604 - protein, 9 aa, Homo Sapiens
RAQKGRKKK

SEQ ID NO: 898605 - protein, 9 aa, Homo Sapiens
KKREYFLGL

SEQ ID NO: 898606 - protein, 9 aa, Homo Sapiens
KPYRCEKCG

SEQ ID NO: 898607 - protein, 9 aa, Homo Sapiens
IRKNQAKKA

SEQ ID NO: 898608 - protein, 9 aa, Homo Sapiens
QSQDCMAAA

SEQ ID NO: 898609 - protein, 9 aa, Homo Sapiens
SPELFSNTP

SEQ ID NO: 898610 - protein, 9 aa, Homo Sapiens
GLGSTDNIN

SEQ ID NO: 898611 - protein, 9 aa, Homo Sapiens
ADGTVFATQ

SEQ ID NO: 898612 - protein, 9 aa, Homo Sapiens
RNTQAHTGI

SEQ ID NO: 898613 - protein, 9 aa, Homo Sapiens
NRLPAVGGQ

SEQ ID NO: 898614 - protein, 9 aa, Homo Sapiens
EGGPTAPRL

SEQ ID NO: 898615 - protein, 9 aa, Homo Sapiens
SAHSETELL

SEQ ID NO: 898616 - protein, 9 aa, Homo Sapiens
SVGTLDCKF

SEQ ID NO: 898617 - protein, 9 aa, Homo Sapiens
LGSTDNINK

SEQ ID NO: 898618 - protein, 9 aa, Homo Sapiens
TNRTSSGQG

SEQ ID NO: 898619 - protein, 9 aa, Homo Sapiens
KSQEKRHRH

SEQ ID NO: 898620 - protein, 9 aa, Homo Sapiens
RSSTLVGHK

SEQ ID NO: 898621 - protein, 9 aa, Homo Sapiens
PEDGDIHPE

SEQ ID NO: 898622 - protein, 9 aa, Homo Sapiens
GLLGRFNSD

SEQ ID NO: 898623 - protein, 9 aa, Homo Sapiens
EKEGFYNFE

SEQ ID NO: 898624 - protein, 9 aa, Homo Sapiens
SERERRRSI

SEQ ID NO: 898625 - protein, 9 aa, Homo Sapiens
MLVFLALVF

SEQ ID NO: 898626 - protein, 9 aa, Homo Sapiens
QHFRWVHLR

SEQ ID NO: 898627 - protein, 9 aa, Homo Sapiens
GYLLEKKIY

SEQ ID NO: 898628 - protein, 9 aa, Homo Sapiens
RLKKRAKTI

SEQ ID NO: 898629 - protein, 9 aa, Homo Sapiens
GLSFWSLGT

SEQ ID NO: 898630 - protein, 9 aa, Homo Sapiens
KKTSKNIFS

SEQ ID NO: 898631 - protein, 9 aa, Homo Sapiens
MTYAASKHA

SEQ ID NO: 898632 - protein, 9 aa, Homo Sapiens
YLGNRLPAV

SEQ ID NO: 898633 - protein, 9 aa, Homo Sapiens
AQKGRKKKS

SEQ ID NO: 898634 - protein, 9 aa, Homo Sapiens
DELIIEEPS

SEQ ID NO: 898635 - protein, 9 aa, Homo Sapiens
PIAVMGEFS

SEQ ID NO: 898636 - protein, 9 aa, Homo Sapiens
CYELNQRVG

SEQ ID NO: 898637 - protein, 9 aa, Homo Sapiens
DVFLGMYVA

SEQ ID NO: 898638 - protein, 9 aa, Homo Sapiens
LHDEGQNED

SEQ ID NO: 898639 - protein, 9 aa, Homo Sapiens
HLRWDGEPM

SEQ ID NO: 898640 - protein, 9 aa, Homo Sapiens
GASGGPPIS

SEQ ID NO: 898641 - protein, 9 aa, Homo Sapiens
CILHREVQD

SEQ ID NO: 898642 - protein, 9 aa, Homo Sapiens
VVMGGKEDN

SEQ ID NO: 898643 - protein, 9 aa, Homo Sapiens
AHTGIHTDT

SEQ ID NO: 898644 - protein, 9 aa, Homo Sapiens
VRLSITLRI

SEQ ID NO: 898645 - protein, 9 aa, Homo Sapiens
EADSCRTGL

SEQ ID NO: 898646 - protein, 9 aa, Homo Sapiens
EPCAQSLGQ

SEQ ID NO: 898647 - protein, 9 aa, Homo Sapiens
KTLEEIKSN

SEQ ID NO: 898648 - protein, 9 aa, Homo Sapiens
PAFWCSISC

SEQ ID NO: 898649 - protein, 9 aa, Homo Sapiens
RHRYEGGPT

SEQ ID NO: 898650 - protein, 9 aa, Homo Sapiens
LDSGRALKD

SEQ ID NO: 898651 - protein, 9 aa, Homo Sapiens
SSQDPREVW

SEQ ID NO: 898652 - protein, 9 aa, Homo Sapiens
NQKFLDELR

SEQ ID NO: 898653 - protein, 9 aa, Homo Sapiens
KNQAKKAAA

SEQ ID NO: 898654 - protein, 9 aa, Homo Sapiens
AVERRSINK

SEQ ID NO: 898655 - protein, 9 aa, Homo Sapiens
GTVFATQEL

SEQ ID NO: 898656 - protein, 9 aa, Homo Sapiens
YEGGPTAPR

SEQ ID NO: 898657 - protein, 9 aa, Homo Sapiens
ARHSTGLHS

SEQ ID NO: 898658 - protein, 9 aa, Homo Sapiens
EEHFSSKKS

SEQ ID NO: 898659 - protein, 9 aa, Homo Sapiens
VKCVQNDEH

SEQ ID NO: 898660 - protein, 9 aa, Homo Sapiens
LEEIKSNKM

SEQ ID NO: 898661 - protein, 9 aa, Homo Sapiens
GINVKCVQN

SEQ ID NO: 898662 - protein, 9 aa, Homo Sapiens
SHRHTHTHR

SEQ ID NO: 898663 - protein, 9 aa, Homo Sapiens
ELIIEEPSR

SEQ ID NO: 898664 - protein, 9 aa, Homo Sapiens
YHSQIAVFK

SEQ ID NO: 898665 - protein, 9 aa, Homo Sapiens
LKKRAKTIT

SEQ ID NO: 898666 - protein, 9 aa, Homo Sapiens
PGTTPPWQK

SEQ ID NO: 898667 - protein, 9 aa, Homo Sapiens
IRSHSSSRW

SEQ ID NO: 898668 - protein, 9 aa, Homo Sapiens
QTWNGRLLV

SEQ ID NO: 898669 - protein, 9 aa, Homo Sapiens
PVRCNRKSS

SEQ ID NO: 898670 - protein, 9 aa, Homo Sapiens
PPERLVKSG

SEQ ID NO: 898671 - protein, 9 aa, Homo Sapiens
VKHIRKNQA

SEQ ID NO: 898672 - protein, 9 aa, Homo Sapiens
SQDCMAAAL

SEQ ID NO: 898673 - protein, 9 aa, Homo Sapiens
WPKSKGSYC

SEQ ID NO: 898674 - protein, 9 aa, Homo Sapiens
RVERVPSRS

SEQ ID NO: 898675 - protein, 9 aa, Homo Sapiens
HRHIHSRTH

SEQ ID NO: 898676 - protein, 9 aa, Homo Sapiens
HRTSMPTSS

SEQ ID NO: 898677 - protein, 9 aa, Homo Sapiens
DKNQHQCVQ

SEQ ID NO: 898678 - protein, 9 aa, Homo Sapiens
FYNFEEQNR

SEQ ID NO: 898679 - protein, 9 aa, Homo Sapiens
PHQPPSPQL

SEQ ID NO: 898680 - protein, 9 aa, Homo Sapiens
IAQSELFWG

SEQ ID NO: 898681 - protein, 9 aa, Homo Sapiens
TEVLYAGCT

SEQ ID NO: 898682 - protein, 9 aa, Homo Sapiens
AYTQTHIQA

SEQ ID NO: 898683 - protein, 9 aa, Homo Sapiens
ECLGTHTVV

SEQ ID NO: 898684 - protein, 9 aa, Homo Sapiens
THRYTHRHT

SEQ ID NO: 898685 - protein, 9 aa, Homo Sapiens
LKVLDSGRA

SEQ ID NO: 898686 - protein, 9 aa, Homo Sapiens
APLPMHSDP

SEQ ID NO: 898687 - protein, 9 aa, Homo Sapiens
SLFPLLLQL

SEQ ID NO: 898688 - protein, 9 aa, Homo Sapiens
TMPVRCNRK

SEQ ID NO: 898689 - protein, 9 aa, Homo Sapiens
AAPGSQRAQ

SEQ ID NO: 898690 - protein, 9 aa, Homo Sapiens
PGWPGRPGM

SEQ ID NO: 898691 - protein, 9 aa, Homo Sapiens
PERLVKSGS

SEQ ID NO: 898692 - protein, 9 aa, Homo Sapiens
HSLGATLKY

SEQ ID NO: 898693 - protein, 9 aa, Homo Sapiens
HSSSRWGFS

SEQ ID NO: 898694 - protein, 9 aa, Homo Sapiens
LVFLALVFL

SEQ ID NO: 898695 - protein, 9 aa, Homo Sapiens
HSETELLRS

SEQ ID NO: 898696 - protein, 9 aa, Homo Sapiens
TLRIQPNDG

SEQ ID NO: 898697 - protein, 9 aa, Homo Sapiens
PWGCACLVG

SEQ ID NO: 898698 - protein, 9 aa, Homo Sapiens
TYTGTHRHT

SEQ ID NO: 898699 - protein, 9 aa, Homo Sapiens
ALDQAGFAN

SEQ ID NO: 898700 - protein, 9 aa, Homo Sapiens
RRFAQAPSL

SEQ ID NO: 898701 - protein, 9 aa, Homo Sapiens
SQPYHPGST

SEQ ID NO: 898702 - protein, 9 aa, Homo Sapiens
INKLLLLDY

SEQ ID NO: 898703 - protein, 9 aa, Homo Sapiens
GQTVVAKVT

SEQ ID NO: 898704 - protein, 9 aa, Homo Sapiens
GINDIFNFE

SEQ ID NO: 898705 - protein, 9 aa, Homo Sapiens
ACGVGKSAL

SEQ ID NO: 898706 - protein, 9 aa, Homo Sapiens
CLRPSLPDS

SEQ ID NO: 898707 - protein, 9 aa, Homo Sapiens
RCEKCGKAF

SEQ ID NO: 898708 - protein, 9 aa, Homo Sapiens
RDCLMRRCS

SEQ ID NO: 898709 - protein, 9 aa, Homo Sapiens
MHRHTHTQA

SEQ ID NO: 898710 - protein, 9 aa, Homo Sapiens
SPPPPTPRA

SEQ ID NO: 898711 - protein, 9 aa, Homo Sapiens
YHTMNSVPF

SEQ ID NO: 898712 - protein, 9 aa, Homo Sapiens
NCKLWETFK

SEQ ID NO: 898713 - protein, 9 aa, Homo Sapiens
IEEAPNCIS

SEQ ID NO: 898714 - protein, 9 aa, Homo Sapiens
PLLLQLLDP

SEQ ID NO: 898715 - protein, 9 aa, Homo Sapiens
PMPPKRPRL

SEQ ID NO: 898716 - protein, 9 aa, Homo Sapiens
GRALKDVWD

SEQ ID NO: 898717 - protein, 9 aa, Homo Sapiens
QCLELLFNP

SEQ ID NO: 898718 - protein, 9 aa, Homo Sapiens
WCSISCYEL

SEQ ID NO: 898719 - protein, 9 aa, Homo Sapiens
FPGWPGRPG

SEQ ID NO: 898720 - protein, 9 aa, Homo Sapiens
EVWRRAADW

SEQ ID NO: 898721 - protein, 9 aa, Homo Sapiens
LSFWSLGTL

SEQ ID NO: 898722 - protein, 9 aa, Homo Sapiens
LRDPASPPE

SEQ ID NO: 898723 - protein, 9 aa, Homo Sapiens
VHSVTLSLR

SEQ ID NO: 898724 - protein, 9 aa, Homo Sapiens
MPPKRPRLQ

SEQ ID NO: 898725 - protein, 9 aa, Homo Sapiens
QGAAASGPG

SEQ ID NO: 898726 - protein, 9 aa, Homo Sapiens
GVACNVLFV

SEQ ID NO: 898727 - protein, 9 aa, Homo Sapiens
RLPAVGGQL

SEQ ID NO: 898728 - protein, 9 aa, Homo Sapiens
TDNINKLLL

SEQ ID NO: 898729 - protein, 9 aa, Homo Sapiens
EGSRVERVP

SEQ ID NO: 898730 - protein, 9 aa, Homo Sapiens
SCYELNQRV

SEQ ID NO: 898731 - protein, 9 aa, Homo Sapiens
VMGGKEDNG

SEQ ID NO: 898732 - protein, 9 aa, Homo Sapiens
PPWQKSPSG

SEQ ID NO: 898733 - protein, 9 aa, Homo Sapiens
QNEDVEKEE

SEQ ID NO: 898734 - protein, 9 aa, Homo Sapiens
WGDIQWRSF

SEQ ID NO: 898735 - protein, 9 aa, Homo Sapiens
KFGIPFRMT

SEQ ID NO: 898736 - protein, 9 aa, Homo Sapiens
RKKTSKNIF

SEQ ID NO: 898737 - protein, 9 aa, Homo Sapiens
FWCSISCYE

SEQ ID NO: 898738 - protein, 9 aa, Homo Sapiens
TRSKSQEKR

SEQ ID NO: 898739 - protein, 9 aa, Homo Sapiens
ALTELEMLA

SEQ ID NO: 898740 - protein, 9 aa, Homo Sapiens
ADLLKQGVA

SEQ ID NO: 898741 - protein, 9 aa, Homo Sapiens
FIHGFQLQK

SEQ ID NO: 898742 - protein, 9 aa, Homo Sapiens
CGRAFIHGF

SEQ ID NO: 898743 - protein, 9 aa, Homo Sapiens
ALKDVWDRC

SEQ ID NO: 898744 - protein, 9 aa, Homo Sapiens
EAVGDLRQA

SEQ ID NO: 898745 - protein, 9 aa, Homo Sapiens
EYFLGLSWP

SEQ ID NO: 898746 - protein, 9 aa, Homo Sapiens
TSMPTSSTP

SEQ ID NO: 898747 - protein, 9 aa, Homo Sapiens
NQPHRRADA

SEQ ID NO: 898748 - protein, 9 aa, Homo Sapiens
TWNGRLLVA

SEQ ID NO: 898749 - protein, 9 aa, Homo Sapiens
DPREVWRRA

SEQ ID NO: 898750 - protein, 9 aa, Homo Sapiens
PPGTRVRVM

SEQ ID NO: 898751 - protein, 9 aa, Homo Sapiens
KVDDDKACI

SEQ ID NO: 898752 - protein, 9 aa, Homo Sapiens
QLALTELEM

SEQ ID NO: 898753 - protein, 9 aa, Homo Sapiens
HIQAQTGTH

SEQ ID NO: 898754 - protein, 9 aa, Homo Sapiens
VLDSGRALK

SEQ ID NO: 898755 - protein, 9 aa, Homo Sapiens
FSSKKSLAW

SEQ ID NO: 898756 - protein, 9 aa, Homo Sapiens
GGPPISKAP

SEQ ID NO: 898757 - protein, 9 aa, Homo Sapiens
PGIKEGKPH

SEQ ID NO: 898758 - protein, 9 aa, Homo Sapiens
LLQLLDPTS

SEQ ID NO: 898759 - protein, 9 aa, Homo Sapiens
LGDLASDLL

SEQ ID NO: 898760 - protein, 9 aa, Homo Sapiens
HQPPSPQLS

SEQ ID NO: 898761 - protein, 9 aa, Homo Sapiens
PGLVRLSIT

SEQ ID NO: 898762 - protein, 9 aa, Homo Sapiens
KSMNLRLEE

SEQ ID NO: 898763 - protein, 9 aa, Homo Sapiens
WNGRLLVAT

SEQ ID NO: 898764 - protein, 9 aa, Homo Sapiens
RRSINKEHN

SEQ ID NO: 898765 - protein, 9 aa, Homo Sapiens
SMPTSSTPG

SEQ ID NO: 898766 - protein, 9 aa, Homo Sapiens
RYNVLMSPW

SEQ ID NO: 898767 - protein, 9 aa, Homo Sapiens
DTHSHRHTH

SEQ ID NO: 898768 - protein, 9 aa, Homo Sapiens
DSCRTGLGR

SEQ ID NO: 898769 - protein, 9 aa, Homo Sapiens
GSQRAQKGR

SEQ ID NO: 898770 - protein, 9 aa, Homo Sapiens
EDGINDIFN

SEQ ID NO: 898771 - protein, 9 aa, Homo Sapiens
QKGRKKKSK

SEQ ID NO: 898772 - protein, 9 aa, Homo Sapiens
EVLYAGCTK

SEQ ID NO: 898773 - protein, 9 aa, Homo Sapiens
GFYNFEEQN

SEQ ID NO: 898774 - protein, 9 aa, Homo Sapiens
FRMTYAASK

SEQ ID NO: 898775 - protein, 9 aa, Homo Sapiens
VAKVTNVDE

SEQ ID NO: 898776 - protein, 9 aa, Homo Sapiens
CMAAALACS

SEQ ID NO: 898777 - protein, 9 aa, Homo Sapiens
TVPVTTEVL

SEQ ID NO: 898778 - protein, 9 aa, Homo Sapiens
TIMWALDQA

SEQ ID NO: 898779 - protein, 9 aa, Homo Sapiens
FLGLSWPSP

SEQ ID NO: 898780 - protein, 9 aa, Homo Sapiens
ALSNYMSVH

SEQ ID NO: 898781 - protein, 9 aa, Homo Sapiens
RPDPEPSEE

SEQ ID NO: 898782 - protein, 9 aa, Homo Sapiens
HRYEGGPTA

SEQ ID NO: 898783 - protein, 9 aa, Homo Sapiens
PAPYLGNRL

SEQ ID NO: 898784 - protein, 9 aa, Homo Sapiens
TAFKSQAPG

SEQ ID NO: 898785 - protein, 9 aa, Homo Sapiens
ADSCRTGLG

SEQ ID NO: 898786 - protein, 9 aa, Homo Sapiens
GQTAFKSQA

SEQ ID NO: 898787 - protein, 9 aa, Homo Sapiens
GERALSNYM

SEQ ID NO: 898788 - protein, 9 aa, Homo Sapiens
SPTGLVRAK

SEQ ID NO: 898789 - protein, 9 aa, Homo Sapiens
RRRSISHSR

SEQ ID NO: 898790 - protein, 9 aa, Homo Sapiens
HIRKNQAKK

SEQ ID NO: 898791 - protein, 9 aa, Homo Sapiens
PDGWPQEVG

SEQ ID NO: 898792 - protein, 9 aa, Homo Sapiens
VERRSINKE

SEQ ID NO: 898793 - protein, 9 aa, Homo Sapiens
SDPQPPGLA

SEQ ID NO: 898794 - protein, 9 aa, Homo Sapiens
KHIRKNQAK

SEQ ID NO: 898795 - protein, 9 aa, Homo Sapiens
KATEEIEDQ

SEQ ID NO: 898796 - protein, 9 aa, Homo Sapiens
RTSSGQGTV

SEQ ID NO: 898797 - protein, 9 aa, Homo Sapiens
RQYASRVPH

SEQ ID NO: 898798 - protein, 9 aa, Homo Sapiens
SKNIFSKTK

SEQ ID NO: 898799 - protein, 9 aa, Homo Sapiens
APGSQRAQK

SEQ ID NO: 898800 - protein, 9 aa, Homo Sapiens
VMLKEEADS

SEQ ID NO: 898801 - protein, 9 aa, Homo Sapiens
SSRWGFSAN

SEQ ID NO: 898802 - protein, 9 aa, Homo Sapiens
DIFNFETFG

SEQ ID NO: 898803 - protein, 9 aa, Homo Sapiens
VGDLRQALP

SEQ ID NO: 898804 - protein, 9 aa, Homo Sapiens
SSRPDPEPS

SEQ ID NO: 898805 - protein, 9 aa, Homo Sapiens
MFPYHSQIA

SEQ ID NO: 898806 - protein, 9 aa, Homo Sapiens
SIKSMNLRL

SEQ ID NO: 898807 - protein, 9 aa, Homo Sapiens
SINKEHNSN

SEQ ID NO: 898808 - protein, 9 aa, Homo Sapiens
MNLRLEEDD

SEQ ID NO: 898809 - protein, 9 aa, Homo Sapiens
ILHREVQDA

SEQ ID NO: 898810 - protein, 9 aa, Homo Sapiens
WMSDDFGQT

SEQ ID NO: 898811 - protein, 9 aa, Homo Sapiens
QAYTQTHIQ

SEQ ID NO: 898812 - protein, 9 aa, Homo Sapiens
CTFLLMPRG

SEQ ID NO: 898813 - protein, 9 aa, Homo Sapiens
MEKLQQVDS

SEQ ID NO: 898814 - protein, 9 aa, Homo Sapiens
FSDLNAVSP

SEQ ID NO: 898815 - protein, 9 aa, Homo Sapiens
KCETSPPPP

SEQ ID NO: 898816 - protein, 9 aa, Homo Sapiens
WPGRPGMNG

SEQ ID NO: 898817 - protein, 9 aa, Homo Sapiens
VLACRRFAQ

SEQ ID NO: 898818 - protein, 9 aa, Homo Sapiens
DEGQNEDVE

SEQ ID NO: 898819 - protein, 9 aa, Homo Sapiens
QTAFKSQAP

SEQ ID NO: 898820 - protein, 9 aa, Homo Sapiens
DDIPEDKGN

SEQ ID NO: 898821 - protein, 9 aa, Homo Sapiens
LALTELEML

SEQ ID NO: 898822 - protein, 9 aa, Homo Sapiens
GGLLGRFNS

SEQ ID NO: 898823 - protein, 9 aa, Homo Sapiens
QTVVAKVTN

SEQ ID NO: 898824 - protein, 9 aa, Homo Sapiens
FTHRTSMPT

SEQ ID NO: 898825 - protein, 9 aa, Homo Sapiens
TELLRSQMA

SEQ ID NO: 898826 - protein, 9 aa, Homo Sapiens
TRVRVMAIY

SEQ ID NO: 898827 - protein, 9 aa, Homo Sapiens
VSLFPLLLQ

SEQ ID NO: 898828 - protein, 9 aa, Homo Sapiens
KENSELRIT

SEQ ID NO: 898829 - protein, 9 aa, Homo Sapiens
MPVSTPMPP

SEQ ID NO: 898830 - protein, 9 aa, Homo Sapiens
SRVPHQPPS

SEQ ID NO: 898831 - protein, 9 aa, Homo Sapiens
LRNQPHRRA

SEQ ID NO: 898832 - protein, 9 aa, Homo Sapiens
DSGRALKDV

SEQ ID NO: 898833 - protein, 9 aa, Homo Sapiens
HFVEGQTVV

SEQ ID NO: 898834 - protein, 9 aa, Homo Sapiens
SDSLSLDNG

SEQ ID NO: 898835 - protein, 9 aa, Homo Sapiens
FPLLLQLLD

SEQ ID NO: 898836 - protein, 9 aa, Homo Sapiens
ELEMLAEKL

SEQ ID NO: 898837 - protein, 9 aa, Homo Sapiens
KRSSRMRFT

SEQ ID NO: 898838 - protein, 9 aa, Homo Sapiens
IVMVHCILH

SEQ ID NO: 898839 - protein, 9 aa, Homo Sapiens
ERALSNYMS

SEQ ID NO: 898840 - protein, 9 aa, Homo Sapiens
STPMPPKRP

SEQ ID NO: 898841 - protein, 9 aa, Homo Sapiens
THAYTRECL

SEQ ID NO: 898842 - protein, 9 aa, Homo Sapiens
QYASRVPHQ

SEQ ID NO: 898843 - protein, 9 aa, Homo Sapiens
VPSRSASPS

SEQ ID NO: 898844 - protein, 9 aa, Homo Sapiens
KVLDSGRAL

SEQ ID NO: 898845 - protein, 9 aa, Homo Sapiens
SRLKKRAKT

SEQ ID NO: 898846 - protein, 9 aa, Homo Sapiens
LHSLGATLK

SEQ ID NO: 898847 - protein, 9 aa, Homo Sapiens
LPEGGRWQE

SEQ ID NO: 898848 - protein, 9 aa, Homo Sapiens
LCELDFWQE

SEQ ID NO: 898849 - protein, 9 aa, Homo Sapiens
AILAKISRL

SEQ ID NO: 898850 - protein, 9 aa, Homo Sapiens
VQQHFRWVH

SEQ ID NO: 898851 - protein, 9 aa, Homo Sapiens
SDLSEAMSD

SEQ ID NO: 898852 - protein, 9 aa, Homo Sapiens
RERRRSISH

SEQ ID NO: 898853 - protein, 9 aa, Homo Sapiens
QEERLGDLA

SEQ ID NO: 898854 - protein, 9 aa, Homo Sapiens
NQAKKAAAI

SEQ ID NO: 898855 - protein, 9 aa, Homo Sapiens
YNVLMSPWG

SEQ ID NO: 898856 - protein, 9 aa, Homo Sapiens
RFNSDLVTL

SEQ ID NO: 898857 - protein, 9 aa, Homo Sapiens
SMNLRLEED

SEQ ID NO: 898858 - protein, 9 aa, Homo Sapiens
DLSEAMSDC

SEQ ID NO: 898859 - protein, 9 aa, Homo Sapiens
ITPSTHNSV

SEQ ID NO: 898860 - protein, 9 aa, Homo Sapiens
RDPASPPER

SEQ ID NO: 898861 - protein, 9 aa, Homo Sapiens
WETFKNEKY

SEQ ID NO: 898862 - protein, 9 aa, Homo Sapiens
EIKSNKMKE

SEQ ID NO: 898863 - protein, 9 aa, Homo Sapiens
GGVDSDLSE

SEQ ID NO: 898864 - protein, 9 aa, Homo Sapiens
VCVMLPEDM

SEQ ID NO: 898865 - protein, 9 aa, Homo Sapiens
PREVWRRAA

SEQ ID NO: 898866 - protein, 9 aa, Homo Sapiens
LLPTSILLV

SEQ ID NO: 898867 - protein, 9 aa, Homo Sapiens
PCAQSLGQG

SEQ ID NO: 898868 - protein, 9 aa, Homo Sapiens
ILAKISRLK

SEQ ID NO: 898869 - protein, 9 aa, Homo Sapiens
RVPSRSASP

SEQ ID NO: 898870 - protein, 9 aa, Homo Sapiens
GWPQEVGRV

SEQ ID NO: 898871 - protein, 9 aa, Homo Sapiens
ERRRSISHS

SEQ ID NO: 898872 - protein, 9 aa, Homo Sapiens
INVKCVQND

SEQ ID NO: 898873 - protein, 9 aa, Homo Sapiens
IVKHIRKNQ

SEQ ID NO: 898874 - protein, 9 aa, Homo Sapiens
SAGQTAFKS

SEQ ID NO: 898875 - protein, 9 aa, Homo Sapiens
GKFGIPFRM

SEQ ID NO: 898876 - protein, 9 aa, Homo Sapiens
MPTSSTPGT

SEQ ID NO: 898877 - protein, 9 aa, Homo Sapiens
KSKGSYCHF

SEQ ID NO: 898878 - protein, 9 aa, Homo Sapiens
KPHLIPAGP

SEQ ID NO: 898879 - protein, 9 aa, Homo Sapiens
ATQELQVPS

SEQ ID NO: 898880 - protein, 9 aa, Homo Sapiens
QEKRHRHRS

SEQ ID NO: 898881 - protein, 9 aa, Homo Sapiens
EAPNCISDS

SEQ ID NO: 898882 - protein, 9 aa, Homo Sapiens
IHTDTDTHS

SEQ ID NO: 898883 - protein, 9 aa, Homo Sapiens
YASRVPHQP

SEQ ID NO: 898884 - protein, 9 aa, Homo Sapiens
TQELQVPSE

SEQ ID NO: 898885 - protein, 9 aa, Homo Sapiens
SISCYELNQ

SEQ ID NO: 898886 - protein, 9 aa, Homo Sapiens
YTHRHTQAY

SEQ ID NO: 898887 - protein, 9 aa, Homo Sapiens
HRHTHTHRH

SEQ ID NO: 898888 - protein, 9 aa, Homo Sapiens
CISDSLSLD

SEQ ID NO: 898889 - protein, 9 aa, Homo Sapiens
DCMAAALAC

SEQ ID NO: 898890 - protein, 9 aa, Homo Sapiens
DDKACIIIR

SEQ ID NO: 898891 - protein, 9 aa, Homo Sapiens
KIVEVGPQD

SEQ ID NO: 898892 - protein, 9 aa, Homo Sapiens
GRLLVATFT

SEQ ID NO: 898893 - protein, 9 aa, Homo Sapiens
THIQAQTGT

SEQ ID NO: 898894 - protein, 9 aa, Homo Sapiens
QPHRRADAV

SEQ ID NO: 898895 - protein, 9 aa, Homo Sapiens
ELFSNTPTS

SEQ ID NO: 898896 - protein, 9 aa, Homo Sapiens
RCNRKSSSS

SEQ ID NO: 898897 - protein, 9 aa, Homo Sapiens
QPYHPGSTC

SEQ ID NO: 898898 - protein, 9 aa, Homo Sapiens
LPEDMEKLQ

SEQ ID NO: 898899 - protein, 9 aa, Homo Sapiens
LFPLLLQLL

SEQ ID NO: 898900 - protein, 9 aa, Homo Sapiens
HIHSRTHAY

SEQ ID NO: 898901 - protein, 9 aa, Homo Sapiens
THSHRHTHT

SEQ ID NO: 898902 - protein, 9 aa, Homo Sapiens
MGGKEDNGY

SEQ ID NO: 898903 - protein, 9 aa, Homo Sapiens
LRITPSTHN

SEQ ID NO: 898904 - protein, 9 aa, Homo Sapiens
ASAGQTAFK

SEQ ID NO: 898905 - protein, 9 aa, Homo Sapiens
DIAQSELFW

SEQ ID NO: 898906 - protein, 9 aa, Homo Sapiens
PLPMHSDPQ

SEQ ID NO: 898907 - protein, 9 aa, Homo Sapiens
STDNINKLL

SEQ ID NO: 898908 - protein, 9 aa, Homo Sapiens
HTMPVRCNR

SEQ ID NO: 898909 - protein, 9 aa, Homo Sapiens
WGCACLVGC

SEQ ID NO: 898910 - protein, 9 aa, Homo Sapiens
PPPGTRVRV

SEQ ID NO: 898911 - protein, 9 aa, Homo Sapiens
ANTNRTSSG

SEQ ID NO: 898912 - protein, 9 aa, Homo Sapiens
KKENSELRI

SEQ ID NO: 898913 - protein, 9 aa, Homo Sapiens
TGLVRAKEG

SEQ ID NO: 898914 - protein, 9 aa, Homo Sapiens
ATEGIRGHH

SEQ ID NO: 898915 - protein, 9 aa, Homo Sapiens
LSQPYHPGS

SEQ ID NO: 898916 - protein, 9 aa, Homo Sapiens
GIRGHHKMV

SEQ ID NO: 898917 - protein, 9 aa, Homo Sapiens
TDLRNQPHR

SEQ ID NO: 898918 - protein, 9 aa, Homo Sapiens
PMHSDPQPP

SEQ ID NO: 898919 - protein, 9 aa, Homo Sapiens
NTNRTSSGQ

SEQ ID NO: 898920 - protein, 9 aa, Homo Sapiens
YKLVVVGAC

SEQ ID NO: 898921 - protein, 9 aa, Homo Sapiens
HTDTHRNTQ

SEQ ID NO: 898922 - protein, 9 aa, Homo Sapiens
GDVFLGMYV

SEQ ID NO: 898923 - protein, 9 aa, Homo Sapiens
GPPISKAPT

SEQ ID NO: 898924 - protein, 9 aa, Homo Sapiens
PHRRADAVR

SEQ ID NO: 898925 - protein, 9 aa, Homo Sapiens
HTGMHRHTH

SEQ ID NO: 898926 - protein, 9 aa, Homo Sapiens
RRTRSKSQE

SEQ ID NO: 898927 - protein, 9 aa, Homo Sapiens
KFLDELRMN

SEQ ID NO: 898928 - protein, 9 aa, Homo Sapiens
DLLKQGVAC

SEQ ID NO: 898929 - protein, 9 aa, Homo Sapiens
LHREVQDAV

SEQ ID NO: 898930 - protein, 9 aa, Homo Sapiens
GKEDNGYLL

SEQ ID NO: 898931 - protein, 9 aa, Homo Sapiens
PGTRVRVMA

SEQ ID NO: 898932 - protein, 9 aa, Homo Sapiens
DGTVFATQE

SEQ ID NO: 898933 - protein, 9 aa, Homo Sapiens
VATFTLIGV

SEQ ID NO: 898934 - protein, 9 aa, Homo Sapiens
MYVAVFDRG

SEQ ID NO: 898935 - protein, 9 aa, Homo Sapiens
KEGKPHLIP

SEQ ID NO: 898936 - protein, 9 aa, Homo Sapiens
VPVTTEVLY

SEQ ID NO: 898937 - protein, 9 aa, Homo Sapiens
VVVMGGKED

SEQ ID NO: 898938 - protein, 9 aa, Homo Sapiens
SRTHAYTRE

SEQ ID NO: 898939 - protein, 9 aa, Homo Sapiens
NCLWAEDST

SEQ ID NO: 898940 - protein, 9 aa, Homo Sapiens
GIVIVLLFL

SEQ ID NO: 898941 - protein, 9 aa, Homo Sapiens
TSNCLWAED

SEQ ID NO: 898942 - protein, 9 aa, Homo Sapiens
QKRKMLCLS

SEQ ID NO: 898943 - protein, 9 aa, Homo Sapiens
LLYHQYCSN

SEQ ID NO: 898944 - protein, 9 aa, Homo Sapiens
SSSTAPDQL

SEQ ID NO: 898945 - protein, 9 aa, Homo Sapiens
PVNFLIFSL

SEQ ID NO: 898946 - protein, 9 aa, Homo Sapiens
RGYAIQRLP

SEQ ID NO: 898947 - protein, 9 aa, Homo Sapiens
RSGVKCDFR

SEQ ID NO: 898948 - protein, 9 aa, Homo Sapiens
IGHKITHGF

SEQ ID NO: 898949 - protein, 9 aa, Homo Sapiens
QATVICDGD

SEQ ID NO: 898950 - protein, 9 aa, Homo Sapiens
TGTLQFCQA

SEQ ID NO: 898951 - protein, 9 aa, Homo Sapiens
SPDNMLQGR

SEQ ID NO: 898952 - protein, 9 aa, Homo Sapiens
SVSVSLGDA

SEQ ID NO: 898953 - protein, 9 aa, Homo Sapiens
ASVTQAGVQ

SEQ ID NO: 898954 - protein, 9 aa, Homo Sapiens
SQEEACIMG

SEQ ID NO: 898955 - protein, 9 aa, Homo Sapiens
EVLEELAKK

SEQ ID NO: 898956 - protein, 9 aa, Homo Sapiens
NFLIFSLRG

SEQ ID NO: 898957 - protein, 9 aa, Homo Sapiens
IHMSIPNRI

SEQ ID NO: 898958 - protein, 9 aa, Homo Sapiens
LVGIDNKIK

SEQ ID NO: 898959 - protein, 9 aa, Homo Sapiens
EGSFINLTR

SEQ ID NO: 898960 - protein, 9 aa, Homo Sapiens
PWQLHSQEE

SEQ ID NO: 898961 - protein, 9 aa, Homo Sapiens
PQQATVICD

SEQ ID NO: 898962 - protein, 9 aa, Homo Sapiens
AKGTLANSS

SEQ ID NO: 898963 - protein, 9 aa, Homo Sapiens
FWIVFLLVG

SEQ ID NO: 898964 - protein, 9 aa, Homo Sapiens
ASDPYQIHV

SEQ ID NO: 898965 - protein, 9 aa, Homo Sapiens
KVTPRMIGL

SEQ ID NO: 898966 - protein, 9 aa, Homo Sapiens
LNGKVGMDY

SEQ ID NO: 898967 - protein, 9 aa, Homo Sapiens
DNKDQAWVD

SEQ ID NO: 898968 - protein, 9 aa, Homo Sapiens
CYLQASTGE

SEQ ID NO: 898969 - protein, 9 aa, Homo Sapiens
FKYRGKDGT

SEQ ID NO: 898970 - protein, 9 aa, Homo Sapiens
NIECLQICA

SEQ ID NO: 898971 - protein, 9 aa, Homo Sapiens
YSTHLVDMA

SEQ ID NO: 898972 - protein, 9 aa, Homo Sapiens
VGGFDSPSG

SEQ ID NO: 898973 - protein, 9 aa, Homo Sapiens
YLQDFAPLG

SEQ ID NO: 898974 - protein, 9 aa, Homo Sapiens
QLTAELAKH

SEQ ID NO: 898975 - protein, 9 aa, Homo Sapiens
LDLVSLNHS

SEQ ID NO: 898976 - protein, 9 aa, Homo Sapiens
PVDYCDNTL

SEQ ID NO: 898977 - protein, 9 aa, Homo Sapiens
EWEVVQYST

SEQ ID NO: 898978 - protein, 9 aa, Homo Sapiens
WDNWYPRSW

SEQ ID NO: 898979 - protein, 9 aa, Homo Sapiens
FFRMLRIFK

SEQ ID NO: 898980 - protein, 9 aa, Homo Sapiens
MRMLALFVT

SEQ ID NO: 898981 - protein, 9 aa, Homo Sapiens
LSTAATVRE

SEQ ID NO: 898982 - protein, 9 aa, Homo Sapiens
PEKDNKDQA

SEQ ID NO: 898983 - protein, 9 aa, Homo Sapiens
DFRQNPLDV

SEQ ID NO: 898984 - protein, 9 aa, Homo Sapiens
IKQAMDLVK

SEQ ID NO: 898985 - protein, 9 aa, Homo Sapiens
KQPVDYCDN

SEQ ID NO: 898986 - protein, 9 aa, Homo Sapiens
LPTGQSITS

SEQ ID NO: 898987 - protein, 9 aa, Homo Sapiens
QICAVGRLE

SEQ ID NO: 898988 - protein, 9 aa, Homo Sapiens
FSTTPALYL

SEQ ID NO: 898989 - protein, 9 aa, Homo Sapiens
RYLQDFAPL

SEQ ID NO: 898990 - protein, 9 aa, Homo Sapiens
KYDMSGAHL

SEQ ID NO: 898991 - protein, 9 aa, Homo Sapiens
WYPRSWDNW

SEQ ID NO: 898992 - protein, 9 aa, Homo Sapiens
WQLHSQEEA

SEQ ID NO: 898993 - protein, 9 aa, Homo Sapiens
NLPLDSHYV

SEQ ID NO: 898994 - protein, 9 aa, Homo Sapiens
ARAEAAGVQ

SEQ ID NO: 898995 - protein, 9 aa, Homo Sapiens
ALAAETADG

SEQ ID NO: 898996 - protein, 9 aa, Homo Sapiens
KGTLANSSS

SEQ ID NO: 898997 - protein, 9 aa, Homo Sapiens
SVAGRGVEV

SEQ ID NO: 898998 - protein, 9 aa, Homo Sapiens
GKAIFRFST

SEQ ID NO: 898999 - protein, 9 aa, Homo Sapiens
QPPLSATIT

SEQ ID NO: 899000 - protein, 9 aa, Homo Sapiens
SGNQKGHFY

SEQ ID NO: 899001 - protein, 9 aa, Homo Sapiens
KDLLLTKTP

SEQ ID NO: 899002 - protein, 9 aa, Homo Sapiens
PTMSTVFSS

SEQ ID NO: 899003 - protein, 9 aa, Homo Sapiens
VFKCDMSAL

SEQ ID NO: 899004 - protein, 9 aa, Homo Sapiens
TRRFTDVEM

SEQ ID NO: 899005 - protein, 9 aa, Homo Sapiens
SSAEQSFLS

SEQ ID NO: 899006 - protein, 9 aa, Homo Sapiens
TFWIVGGFD

SEQ ID NO: 899007 - protein, 9 aa, Homo Sapiens
ILLIFLQKK

SEQ ID NO: 899008 - protein, 9 aa, Homo Sapiens
EEEFLLLED

SEQ ID NO: 899009 - protein, 9 aa, Homo Sapiens
QQATVICDG

SEQ ID NO: 899010 - protein, 9 aa, Homo Sapiens
ICDGDKFQI

SEQ ID NO: 899011 - protein, 9 aa, Homo Sapiens
LHSQEEACI

SEQ ID NO: 899012 - protein, 9 aa, Homo Sapiens
FWQFTTEHT

SEQ ID NO: 899013 - protein, 9 aa, Homo Sapiens
GVAQLACDD

SEQ ID NO: 899014 - protein, 9 aa, Homo Sapiens
RGQSAGVTP

SEQ ID NO: 899015 - protein, 9 aa, Homo Sapiens
VTFAINFIL

SEQ ID NO: 899016 - protein, 9 aa, Homo Sapiens
SLRGGSVAG

SEQ ID NO: 899017 - protein, 9 aa, Homo Sapiens
KRPHVKKVT

SEQ ID NO: 899018 - protein, 9 aa, Homo Sapiens
YAIQRLPEL

SEQ ID NO: 899019 - protein, 9 aa, Homo Sapiens
TKGDNIYEW

SEQ ID NO: 899020 - protein, 9 aa, Homo Sapiens
TFSVRLCPF

SEQ ID NO: 899021 - protein, 9 aa, Homo Sapiens
MTIQYDNMG

SEQ ID NO: 899022 - protein, 9 aa, Homo Sapiens
TWFPFRTTV

SEQ ID NO: 899023 - protein, 9 aa, Homo Sapiens
GQLLSPLQD

SEQ ID NO: 899024 - protein, 9 aa, Homo Sapiens
VNFLIFSLR

SEQ ID NO: 899025 - protein, 9 aa, Homo Sapiens
RAALAAETA

SEQ ID NO: 899026 - protein, 9 aa, Homo Sapiens
DVATWCWAL

SEQ ID NO: 899027 - protein, 9 aa, Homo Sapiens
KDNKDQAWV

SEQ ID NO: 899028 - protein, 9 aa, Homo Sapiens
ANTQKKCRA

SEQ ID NO: 899029 - protein, 9 aa, Homo Sapiens
FQCAPPLPY

SEQ ID NO: 899030 - protein, 9 aa, Homo Sapiens
PWFCLSTAR

SEQ ID NO: 899031 - protein, 9 aa, Homo Sapiens
PFPSVSVSL

SEQ ID NO: 899032 - protein, 9 aa, Homo Sapiens
RCYLQASTG

SEQ ID NO: 899033 - protein, 9 aa, Homo Sapiens
GGPTGLANV

SEQ ID NO: 899034 - protein, 9 aa, Homo Sapiens
CYNVCWDTG

SEQ ID NO: 899035 - protein, 9 aa, Homo Sapiens
GEARRAALP

SEQ ID NO: 899036 - protein, 9 aa, Homo Sapiens
NLPVRYLQD

SEQ ID NO: 899037 - protein, 9 aa, Homo Sapiens
GKVGMDYRS

SEQ ID NO: 899038 - protein, 9 aa, Homo Sapiens
FQDTNDESS

SEQ ID NO: 899039 - protein, 9 aa, Homo Sapiens
EVHIIWSEH

SEQ ID NO: 899040 - protein, 9 aa, Homo Sapiens
CLAPDPDRE

SEQ ID NO: 899041 - protein, 9 aa, Homo Sapiens
QTLCSFFFF

SEQ ID NO: 899042 - protein, 9 aa, Homo Sapiens
IRVYLLPER

SEQ ID NO: 899043 - protein, 9 aa, Homo Sapiens
SVRLCPFLQ

SEQ ID NO: 899044 - protein, 9 aa, Homo Sapiens
KKLHKEAEI

SEQ ID NO: 899045 - protein, 9 aa, Homo Sapiens
ISPVGTVTG

SEQ ID NO: 899046 - protein, 9 aa, Homo Sapiens
ANVPLIEVG

SEQ ID NO: 899047 - protein, 9 aa, Homo Sapiens
IISGNQKGH

SEQ ID NO: 899048 - protein, 9 aa, Homo Sapiens
RHREKLYVS

SEQ ID NO: 899049 - protein, 9 aa, Homo Sapiens
FFETESASV

SEQ ID NO: 899050 - protein, 9 aa, Homo Sapiens
KLHKEAEIE

SEQ ID NO: 899051 - protein, 9 aa, Homo Sapiens
CGFQGRPVQ

SEQ ID NO: 899052 - protein, 9 aa, Homo Sapiens
YIRVYLLPE

SEQ ID NO: 899053 - protein, 9 aa, Homo Sapiens
RAALPLVRR

SEQ ID NO: 899054 - protein, 9 aa, Homo Sapiens
VCLIQGTAE

SEQ ID NO: 899055 - protein, 9 aa, Homo Sapiens
FINLTRLQK

SEQ ID NO: 899056 - protein, 9 aa, Homo Sapiens
YVCNPSPEL

SEQ ID NO: 899057 - protein, 9 aa, Homo Sapiens
WNLPLDSHY

SEQ ID NO: 899058 - protein, 9 aa, Homo Sapiens
MQAIPMERW

SEQ ID NO: 899059 - protein, 9 aa, Homo Sapiens
NTGTLQFCQ

SEQ ID NO: 899060 - protein, 9 aa, Homo Sapiens
SLGGKPQIL

SEQ ID NO: 899061 - protein, 9 aa, Homo Sapiens
CSNCAFSQR

SEQ ID NO: 899062 - protein, 9 aa, Homo Sapiens
LGALYSSMK

SEQ ID NO: 899063 - protein, 9 aa, Homo Sapiens
HLTLQLDLV

SEQ ID NO: 899064 - protein, 9 aa, Homo Sapiens
LIQGTAEAL

SEQ ID NO: 899065 - protein, 9 aa, Homo Sapiens
PGLVFSCLS

SEQ ID NO: 899066 - protein, 9 aa, Homo Sapiens
WCWALAEYA

SEQ ID NO: 899067 - protein, 9 aa, Homo Sapiens
FCQASDTEE

SEQ ID NO: 899068 - protein, 9 aa, Homo Sapiens
AHRARHRLV

SEQ ID NO: 899069 - protein, 9 aa, Homo Sapiens
YDCVCIMFA

SEQ ID NO: 899070 - protein, 9 aa, Homo Sapiens
NFQDTNDES

SEQ ID NO: 899071 - protein, 9 aa, Homo Sapiens
ETETTALTP

SEQ ID NO: 899072 - protein, 9 aa, Homo Sapiens
APPLPYDTD

SEQ ID NO: 899073 - protein, 9 aa, Homo Sapiens
VVRYRRNLK

SEQ ID NO: 899074 - protein, 9 aa, Homo Sapiens
VRYLQDFAP

SEQ ID NO: 899075 - protein, 9 aa, Homo Sapiens
SSTSNCLWA

SEQ ID NO: 899076 - protein, 9 aa, Homo Sapiens
KDLEDVLRN

SEQ ID NO: 899077 - protein, 9 aa, Homo Sapiens
GWTELRRDK

SEQ ID NO: 899078 - protein, 9 aa, Homo Sapiens
YCDNTLMFE

SEQ ID NO: 899079 - protein, 9 aa, Homo Sapiens
SKLLWPEWM

SEQ ID NO: 899080 - protein, 9 aa, Homo Sapiens
GGTKPKLST

SEQ ID NO: 899081 - protein, 9 aa, Homo Sapiens
DPYQIHVCN

SEQ ID NO: 899082 - protein, 9 aa, Homo Sapiens
TGLKIHMSI

SEQ ID NO: 899083 - protein, 9 aa, Homo Sapiens
LLGEATEGC

SEQ ID NO: 899084 - protein, 9 aa, Homo Sapiens
DDFRQNPLD

SEQ ID NO: 899085 - protein, 9 aa, Homo Sapiens
HYGKQLERE

SEQ ID NO: 899086 - protein, 9 aa, Homo Sapiens
TGDTEKMSP

SEQ ID NO: 899087 - protein, 9 aa, Homo Sapiens
PSVSVSLGD

SEQ ID NO: 899088 - protein, 9 aa, Homo Sapiens
ALTPPAPEP

SEQ ID NO: 899089 - protein, 9 aa, Homo Sapiens
GLDQMAKMM

SEQ ID NO: 899090 - protein, 9 aa, Homo Sapiens
VAYCLAPDP

SEQ ID NO: 899091 - protein, 9 aa, Homo Sapiens
HRGQGGAHW

SEQ ID NO: 899092 - protein, 9 aa, Homo Sapiens
PKKKMKLMM

SEQ ID NO: 899093 - protein, 9 aa, Homo Sapiens
PKKKMKLMI

SEQ ID NO: 899094 - protein, 9 aa, Homo Sapiens
KTCKCPENF

SEQ ID NO: 899095 - protein, 9 aa, Homo Sapiens
SAGVTPGWV

SEQ ID NO: 899096 - protein, 9 aa, Homo Sapiens
KKKMKLMIG

SEQ ID NO: 899097 - protein, 9 aa, Homo Sapiens
QFQEVLEEL

SEQ ID NO: 899098 - protein, 9 aa, Homo Sapiens
AGLFWQFTT

SEQ ID NO: 899099 - protein, 9 aa, Homo Sapiens
VEQAMQAIP

SEQ ID NO: 899100 - protein, 9 aa, Homo Sapiens
AIDLSQEEW

SEQ ID NO: 899101 - protein, 9 aa, Homo Sapiens
SMRQGALSE

SEQ ID NO: 899102 - protein, 9 aa, Homo Sapiens
IVIVLLFLC

SEQ ID NO: 899103 - protein, 9 aa, Homo Sapiens
TKEQPYKCY

SEQ ID NO: 899104 - protein, 9 aa, Homo Sapiens
KMEEEFLLL

SEQ ID NO: 899105 - protein, 9 aa, Homo Sapiens
VGIDNKIKQ

SEQ ID NO: 899106 - protein, 9 aa, Homo Sapiens
DAHRARHRL

SEQ ID NO: 899107 - protein, 9 aa, Homo Sapiens
DLPVVAQTR

SEQ ID NO: 899108 - protein, 9 aa, Homo Sapiens
APTMSTVFS

SEQ ID NO: 899109 - protein, 9 aa, Homo Sapiens
EEGSFINLT

SEQ ID NO: 899110 - protein, 9 aa, Homo Sapiens
INSPRSWDN

SEQ ID NO: 899111 - protein, 9 aa, Homo Sapiens
LQLDLVSLN

SEQ ID NO: 899112 - protein, 9 aa, Homo Sapiens
LLLLRVSLG

SEQ ID NO: 899113 - protein, 9 aa, Homo Sapiens
MAPGEKEIG

SEQ ID NO: 899114 - protein, 9 aa, Homo Sapiens
IGFVSMRQG

SEQ ID NO: 899115 - protein, 9 aa, Homo Sapiens
FVMREAVTI

SEQ ID NO: 899116 - protein, 9 aa, Homo Sapiens
VLEELAKKR

SEQ ID NO: 899117 - protein, 9 aa, Homo Sapiens
AGRGVEVAG

SEQ ID NO: 899118 - protein, 9 aa, Homo Sapiens
LETFSVRLC

SEQ ID NO: 899119 - protein, 9 aa, Homo Sapiens
EVVQYSTHL

SEQ ID NO: 899120 - protein, 9 aa, Homo Sapiens
SLPTGQSIT

SEQ ID NO: 899121 - protein, 9 aa, Homo Sapiens
RNICCLTPT

SEQ ID NO: 899122 - protein, 9 aa, Homo Sapiens
VLKQQQELL

SEQ ID NO: 899123 - protein, 9 aa, Homo Sapiens
LYDPEKDNK

SEQ ID NO: 899124 - protein, 9 aa, Homo Sapiens
MWNLPLDSH

SEQ ID NO: 899125 - protein, 9 aa, Homo Sapiens
AKDSQHYKV

SEQ ID NO: 899126 - protein, 9 aa, Homo Sapiens
TTQALVSVA

SEQ ID NO: 899127 - protein, 9 aa, Homo Sapiens
IVISSLKIF

SEQ ID NO: 899128 - protein, 9 aa, Homo Sapiens
GQGGAHWSP

SEQ ID NO: 899129 - protein, 9 aa, Homo Sapiens
SIVISSLKI

SEQ ID NO: 899130 - protein, 9 aa, Homo Sapiens
TGQRVICCQ

SEQ ID NO: 899131 - protein, 9 aa, Homo Sapiens
GGFDSPSGR

SEQ ID NO: 899132 - protein, 9 aa, Homo Sapiens
GEKEIGEGP

SEQ ID NO: 899133 - protein, 9 aa, Homo Sapiens
SVSLGDAKR

SEQ ID NO: 899134 - protein, 9 aa, Homo Sapiens
AVTIEIEFC

SEQ ID NO: 899135 - protein, 9 aa, Homo Sapiens
DNMLQGRLF

SEQ ID NO: 899136 - protein, 9 aa, Homo Sapiens
NGILKGYRV

SEQ ID NO: 899137 - protein, 9 aa, Homo Sapiens
IFLQKKDLL

SEQ ID NO: 899138 - protein, 9 aa, Homo Sapiens
RLMDEVLKQ

SEQ ID NO: 899139 - protein, 9 aa, Homo Sapiens
EGVLNGKVG

SEQ ID NO: 899140 - protein, 9 aa, Homo Sapiens
QGRPVQVNS

SEQ ID NO: 899141 - protein, 9 aa, Homo Sapiens
QSQPPRSGV

SEQ ID NO: 899142 - protein, 9 aa, Homo Sapiens
LAKHRCHPV

SEQ ID NO: 899143 - protein, 9 aa, Homo Sapiens
CDDITVNIW

SEQ ID NO: 899144 - protein, 9 aa, Homo Sapiens
GYAIQRLPE

SEQ ID NO: 899145 - protein, 9 aa, Homo Sapiens
SEGNAKCRG

SEQ ID NO: 899146 - protein, 9 aa, Homo Sapiens
SGGTKPKLS

SEQ ID NO: 899147 - protein, 9 aa, Homo Sapiens
ELAKHRCHP

SEQ ID NO: 899148 - protein, 9 aa, Homo Sapiens
ECLQICAVG

SEQ ID NO: 899149 - protein, 9 aa, Homo Sapiens
NFRVPVNFL

SEQ ID NO: 899150 - protein, 9 aa, Homo Sapiens
EILRNADSG

SEQ ID NO: 899151 - protein, 9 aa, Homo Sapiens
AKLYLEQLH

SEQ ID NO: 899152 - protein, 9 aa, Homo Sapiens
LGAPAEARL

SEQ ID NO: 899153 - protein, 9 aa, Homo Sapiens
GILKGYRVI

SEQ ID NO: 899154 - protein, 9 aa, Homo Sapiens
GFPHGYPYY

SEQ ID NO: 899155 - protein, 9 aa, Homo Sapiens
RLANEGQLL

SEQ ID NO: 899156 - protein, 9 aa, Homo Sapiens
KDVAIDLSQ

SEQ ID NO: 899157 - protein, 9 aa, Homo Sapiens
LIHAVKGYW

SEQ ID NO: 899158 - protein, 9 aa, Homo Sapiens
MPDCGFQGR

SEQ ID NO: 899159 - protein, 9 aa, Homo Sapiens
LVFSCLSPE

SEQ ID NO: 899160 - protein, 9 aa, Homo Sapiens
FLQKKDLLL

SEQ ID NO: 899161 - protein, 9 aa, Homo Sapiens
ATITLTVAV

SEQ ID NO: 899162 - protein, 9 aa, Homo Sapiens
HAVKGYWLT

SEQ ID NO: 899163 - protein, 9 aa, Homo Sapiens
AMQAIPMER

SEQ ID NO: 899164 - protein, 9 aa, Homo Sapiens
EASDPYQIH

SEQ ID NO: 899165 - protein, 9 aa, Homo Sapiens
ACDDITVNI

SEQ ID NO: 899166 - protein, 9 aa, Homo Sapiens
HQYCSNCAF

SEQ ID NO: 899167 - protein, 9 aa, Homo Sapiens
KEIGEGPAK

SEQ ID NO: 899168 - protein, 9 aa, Homo Sapiens
SSTAPDQLG

SEQ ID NO: 899169 - protein, 9 aa, Homo Sapiens
FPFRTTVFS

SEQ ID NO: 899170 - protein, 9 aa, Homo Sapiens
CDNTLMFEA

SEQ ID NO: 899171 - protein, 9 aa, Homo Sapiens
IWVLVTLQL

SEQ ID NO: 899172 - protein, 9 aa, Homo Sapiens
EGCISAIES

SEQ ID NO: 899173 - protein, 9 aa, Homo Sapiens
PGWVQHRGQ

SEQ ID NO: 899174 - protein, 9 aa, Homo Sapiens
FQKRKMLCL

SEQ ID NO: 899175 - protein, 9 aa, Homo Sapiens
AFTTQALVS

SEQ ID NO: 899176 - protein, 9 aa, Homo Sapiens
GGSVAGRGV

SEQ ID NO: 899177 - protein, 9 aa, Homo Sapiens
TFKDVAIDL

SEQ ID NO: 899178 - protein, 9 aa, Homo Sapiens
GLANVPLIE

SEQ ID NO: 899179 - protein, 9 aa, Homo Sapiens
SQRVTEINS

SEQ ID NO: 899180 - protein, 9 aa, Homo Sapiens
ILPTWFPFR

SEQ ID NO: 899181 - protein, 9 aa, Homo Sapiens
RKMLCLSQD

SEQ ID NO: 899182 - protein, 9 aa, Homo Sapiens
SHNSWEKFR

SEQ ID NO: 899183 - protein, 9 aa, Homo Sapiens
MASPFRQPP

SEQ ID NO: 899184 - protein, 9 aa, Homo Sapiens
NTFKYRGKD

SEQ ID NO: 899185 - protein, 9 aa, Homo Sapiens
VYSVTSWLV

SEQ ID NO: 899186 - protein, 9 aa, Homo Sapiens
NPSPELLPN

SEQ ID NO: 899187 - protein, 9 aa, Homo Sapiens
SFLSSREEA

SEQ ID NO: 899188 - protein, 9 aa, Homo Sapiens
GPWGRVGVP

SEQ ID NO: 899189 - protein, 9 aa, Homo Sapiens
SSLDVHLTI

SEQ ID NO: 899190 - protein, 9 aa, Homo Sapiens
DENVFTGED

SEQ ID NO: 899191 - protein, 9 aa, Homo Sapiens
SELGAPLHD

SEQ ID NO: 899192 - protein, 9 aa, Homo Sapiens
QHRGQGGAH

SEQ ID NO: 899193 - protein, 9 aa, Homo Sapiens
AFKTCKCPE

SEQ ID NO: 899194 - protein, 9 aa, Homo Sapiens
MYRPHNFRV

SEQ ID NO: 899195 - protein, 9 aa, Homo Sapiens
LKQPVDYCD

SEQ ID NO: 899196 - protein, 9 aa, Homo Sapiens
MNLFAGKFG

SEQ ID NO: 899197 - protein, 9 aa, Homo Sapiens
FCKHAHNEV

SEQ ID NO: 899198 - protein, 9 aa, Homo Sapiens
FTASSEGNA

SEQ ID NO: 899199 - protein, 9 aa, Homo Sapiens
FVSMRQGAL

SEQ ID NO: 899200 - protein, 9 aa, Homo Sapiens
NWYPRSWDN

SEQ ID NO: 899201 - protein, 9 aa, Homo Sapiens
AIYAGIVIV

SEQ ID NO: 899202 - protein, 9 aa, Homo Sapiens
ICCLTPTRS

SEQ ID NO: 899203 - protein, 9 aa, Homo Sapiens
STLSFLLGL

SEQ ID NO: 899204 - protein, 9 aa, Homo Sapiens
KLGLMTKLY

SEQ ID NO: 899205 - protein, 9 aa, Homo Sapiens
DLEDVLRNN

SEQ ID NO: 899206 - protein, 9 aa, Homo Sapiens
TREQEDLPL

SEQ ID NO: 899207 - protein, 9 aa, Homo Sapiens
GMALLRFFR

SEQ ID NO: 899208 - protein, 9 aa, Homo Sapiens
PHNFRVPVN

SEQ ID NO: 899209 - protein, 9 aa, Homo Sapiens
VTTGLKIHM

SEQ ID NO: 899210 - protein, 9 aa, Homo Sapiens
ENIKLYHSW

SEQ ID NO: 899211 - protein, 9 aa, Homo Sapiens
HVLDSHLRF

SEQ ID NO: 899212 - protein, 9 aa, Homo Sapiens
YDTDQPQET

SEQ ID NO: 899213 - protein, 9 aa, Homo Sapiens
LRNADSGAI

SEQ ID NO: 899214 - protein, 9 aa, Homo Sapiens
HVIFCPNKV

SEQ ID NO: 899215 - protein, 9 aa, Homo Sapiens
RVSGAVVTA

SEQ ID NO: 899216 - protein, 9 aa, Homo Sapiens
QEGVLNGKV

SEQ ID NO: 899217 - protein, 9 aa, Homo Sapiens
PHGYPYYAN

SEQ ID NO: 899218 - protein, 9 aa, Homo Sapiens
SQAILPTWF

SEQ ID NO: 899219 - protein, 9 aa, Homo Sapiens
EQPYKCYVC

SEQ ID NO: 899220 - protein, 9 aa, Homo Sapiens
LSQEEWQWM

SEQ ID NO: 899221 - protein, 9 aa, Homo Sapiens
TLQLLPILP

SEQ ID NO: 899222 - protein, 9 aa, Homo Sapiens
FGSAPTMST

SEQ ID NO: 899223 - protein, 9 aa, Homo Sapiens
PDTELEMQQ

SEQ ID NO: 899224 - protein, 9 aa, Homo Sapiens
LMYWMTIQY

SEQ ID NO: 899225 - protein, 9 aa, Homo Sapiens
SHLTLQLDL

SEQ ID NO: 899226 - protein, 9 aa, Homo Sapiens
CISAIESLF

SEQ ID NO: 899227 - protein, 9 aa, Homo Sapiens
GRLPVQMGM

SEQ ID NO: 899228 - protein, 9 aa, Homo Sapiens
AREKKLHKE

SEQ ID NO: 899229 - protein, 9 aa, Homo Sapiens
FWIVGGFDS

SEQ ID NO: 899230 - protein, 9 aa, Homo Sapiens
VRLCPFLQV

SEQ ID NO: 899231 - protein, 9 aa, Homo Sapiens
GFDSPSGRQ

SEQ ID NO: 899232 - protein, 9 aa, Homo Sapiens
QPFWIVFLL

SEQ ID NO: 899233 - protein, 9 aa, Homo Sapiens
EPPEVPSEV

SEQ ID NO: 899234 - protein, 9 aa, Homo Sapiens
QPYKCYVCS

SEQ ID NO: 899235 - protein, 9 aa, Homo Sapiens
SGAHLALIL

SEQ ID NO: 899236 - protein, 9 aa, Homo Sapiens
RLLTVLGVG

SEQ ID NO: 899237 - protein, 9 aa, Homo Sapiens
TQSSTSNCL

SEQ ID NO: 899238 - protein, 9 aa, Homo Sapiens
EVGHLRGQS

SEQ ID NO: 899239 - protein, 9 aa, Homo Sapiens
SRAYTAPAP

SEQ ID NO: 899240 - protein, 9 aa, Homo Sapiens
TFEQFQEVL

SEQ ID NO: 899241 - protein, 9 aa, Homo Sapiens
QYCSNCAFS

SEQ ID NO: 899242 - protein, 9 aa, Homo Sapiens
FVTFAINFI

SEQ ID NO: 899243 - protein, 9 aa, Homo Sapiens
YRGKDGTHA

SEQ ID NO: 899244 - protein, 9 aa, Homo Sapiens
NSPRSWDNW

SEQ ID NO: 899245 - protein, 9 aa, Homo Sapiens
KLMMSEGPD

SEQ ID NO: 899246 - protein, 9 aa, Homo Sapiens
YDMSGAHLA

SEQ ID NO: 899247 - protein, 9 aa, Homo Sapiens
FPHGYPYYA

SEQ ID NO: 899248 - protein, 9 aa, Homo Sapiens
YLEQLHQQE

SEQ ID NO: 899249 - protein, 9 aa, Homo Sapiens
LEASISPVG

SEQ ID NO: 899250 - protein, 9 aa, Homo Sapiens
QPVENIKLY

SEQ ID NO: 899251 - protein, 9 aa, Homo Sapiens
LYHQYCSNC

SEQ ID NO: 899252 - protein, 9 aa, Homo Sapiens
LGAVLSTAA

SEQ ID NO: 899253 - protein, 9 aa, Homo Sapiens
LVYSCGRKG

SEQ ID NO: 899254 - protein, 9 aa, Homo Sapiens
SRLMDEVLK

SEQ ID NO: 899255 - protein, 9 aa, Homo Sapiens
CLEASISPV

SEQ ID NO: 899256 - protein, 9 aa, Homo Sapiens
VPSISPFRF

SEQ ID NO: 899257 - protein, 9 aa, Homo Sapiens
WWHHTNPVG

SEQ ID NO: 899258 - protein, 9 aa, Homo Sapiens
IFSIMGMNL

SEQ ID NO: 899259 - protein, 9 aa, Homo Sapiens
RQGEWSEWS

SEQ ID NO: 899260 - protein, 9 aa, Homo Sapiens
PTGQSITSR

SEQ ID NO: 899261 - protein, 9 aa, Homo Sapiens
DSEEVRNIC

SEQ ID NO: 899262 - protein, 9 aa, Homo Sapiens
SSKLLWPEW

SEQ ID NO: 899263 - protein, 9 aa, Homo Sapiens
YSSMKDTEK

SEQ ID NO: 899264 - protein, 9 aa, Homo Sapiens
MYVQPFWIV

SEQ ID NO: 899265 - protein, 9 aa, Homo Sapiens
SAEQSFLSS

SEQ ID NO: 899266 - protein, 9 aa, Homo Sapiens
DMSGAHLAL

SEQ ID NO: 899267 - protein, 9 aa, Homo Sapiens
GETNDANTQ

SEQ ID NO: 899268 - protein, 9 aa, Homo Sapiens
ETESASVTQ

SEQ ID NO: 899269 - protein, 9 aa, Homo Sapiens
SPFRQPPPG

SEQ ID NO: 899270 - protein, 9 aa, Homo Sapiens
VFTGEDLDE

SEQ ID NO: 899271 - protein, 9 aa, Homo Sapiens
TCLEASISP

SEQ ID NO: 899272 - protein, 9 aa, Homo Sapiens
RPVRHNFYD

SEQ ID NO: 899273 - protein, 9 aa, Homo Sapiens
TWQDFGPSG

SEQ ID NO: 899274 - protein, 9 aa, Homo Sapiens
KAIFRFSTT

SEQ ID NO: 899275 - protein, 9 aa, Homo Sapiens
PQPVENIKL

SEQ ID NO: 899276 - protein, 9 aa, Homo Sapiens
QASTGENET

SEQ ID NO: 899277 - protein, 9 aa, Homo Sapiens
ESASVTQAG

SEQ ID NO: 899278 - protein, 9 aa, Homo Sapiens
AALPLVRRR

SEQ ID NO: 899279 - protein, 9 aa, Homo Sapiens
DCGFQGRPV

SEQ ID NO: 899280 - protein, 9 aa, Homo Sapiens
QPGQDRWRE

SEQ ID NO: 899281 - protein, 9 aa, Homo Sapiens
PTLSHFQQS

SEQ ID NO: 899282 - protein, 9 aa, Homo Sapiens
ASPDNMLQG

SEQ ID NO: 899283 - protein, 9 aa, Homo Sapiens
TAGLFWQFT

SEQ ID NO: 899284 - protein, 9 aa, Homo Sapiens
VAGRGVEVA

SEQ ID NO: 899285 - protein, 9 aa, Homo Sapiens
EARRAALPL

SEQ ID NO: 899286 - protein, 9 aa, Homo Sapiens
ADSGAIDVK

SEQ ID NO: 899287 - protein, 9 aa, Homo Sapiens
SFFFFETES

SEQ ID NO: 899288 - protein, 9 aa, Homo Sapiens
PHLRPLLQR

SEQ ID NO: 899289 - protein, 9 aa, Homo Sapiens
KQGHSIVIS

SEQ ID NO: 899290 - protein, 9 aa, Homo Sapiens
LYSSMKDTE

SEQ ID NO: 899291 - protein, 9 aa, Homo Sapiens
QLETFSVRL

SEQ ID NO: 899292 - protein, 9 aa, Homo Sapiens
HRARHRLVR

SEQ ID NO: 899293 - protein, 9 aa, Homo Sapiens
LTLQLDLVS

SEQ ID NO: 899294 - protein, 9 aa, Homo Sapiens
ILRNADSGA

SEQ ID NO: 899295 - protein, 9 aa, Homo Sapiens
LFLWAVSTL

SEQ ID NO: 899296 - protein, 9 aa, Homo Sapiens
GLKIHMSIP

SEQ ID NO: 899297 - protein, 9 aa, Homo Sapiens
VHYGVAYCL

SEQ ID NO: 899298 - protein, 9 aa, Homo Sapiens
AHLALILCV

SEQ ID NO: 899299 - protein, 9 aa, Homo Sapiens
EVLEEGSFI

SEQ ID NO: 899300 - protein, 9 aa, Homo Sapiens
NDANTQKKC

SEQ ID NO: 899301 - protein, 9 aa, Homo Sapiens
EREQALKAR

SEQ ID NO: 899302 - protein, 9 aa, Homo Sapiens
PRSTLNGIL

SEQ ID NO: 899303 - protein, 9 aa, Homo Sapiens
SHYVTLTGT

SEQ ID NO: 899304 - protein, 9 aa, Homo Sapiens
TELCENIDP

SEQ ID NO: 899305 - protein, 9 aa, Homo Sapiens
GNAKCRGHI

SEQ ID NO: 899306 - protein, 9 aa, Homo Sapiens
SQLETFSVR

SEQ ID NO: 899307 - protein, 9 aa, Homo Sapiens
QEREQALKA

SEQ ID NO: 899308 - protein, 9 aa, Homo Sapiens
SIGFVSMRQ

SEQ ID NO: 899309 - protein, 9 aa, Homo Sapiens
EEVRNICCL

SEQ ID NO: 899310 - protein, 9 aa, Homo Sapiens
FKQEGVLNG

SEQ ID NO: 899311 - protein, 9 aa, Homo Sapiens
LRGYAIQRL

SEQ ID NO: 899312 - protein, 9 aa, Homo Sapiens
IIWSEHTRD

SEQ ID NO: 899313 - protein, 9 aa, Homo Sapiens
TLQFCQASD

SEQ ID NO: 899314 - protein, 9 aa, Homo Sapiens
CALGAPAEA

SEQ ID NO: 899315 - protein, 9 aa, Homo Sapiens
TDRQGQNSH

SEQ ID NO: 899316 - protein, 9 aa, Homo Sapiens
PDNMLQGRL

SEQ ID NO: 899317 - protein, 9 aa, Homo Sapiens
VPVNFLIFS

SEQ ID NO: 899318 - protein, 9 aa, Homo Sapiens
CLPKFCGYP

SEQ ID NO: 899319 - protein, 9 aa, Homo Sapiens
VQYSTHLVD

SEQ ID NO: 899320 - protein, 9 aa, Homo Sapiens
DNWYPRSWD

SEQ ID NO: 899321 - protein, 9 aa, Homo Sapiens
VIVLLFLCL

SEQ ID NO: 899322 - protein, 9 aa, Homo Sapiens
REQALKARE

SEQ ID NO: 899323 - protein, 9 aa, Homo Sapiens
WSLGGKPQI

SEQ ID NO: 899324 - protein, 9 aa, Homo Sapiens
TALTPPAPE

SEQ ID NO: 899325 - protein, 9 aa, Homo Sapiens
IGVAQLACD

SEQ ID NO: 899326 - protein, 9 aa, Homo Sapiens
RARSELGAP

SEQ ID NO: 899327 - protein, 9 aa, Homo Sapiens
STGENETFV

SEQ ID NO: 899328 - protein, 9 aa, Homo Sapiens
YPRSWNNWY

SEQ ID NO: 899329 - protein, 9 aa, Homo Sapiens
GTKGDNIYE

SEQ ID NO: 899330 - protein, 9 aa, Homo Sapiens
VGVPSISPF

SEQ ID NO: 899331 - protein, 9 aa, Homo Sapiens
VSTLSFLLG

SEQ ID NO: 899332 - protein, 9 aa, Homo Sapiens
SFGSAPTMS

SEQ ID NO: 899333 - protein, 9 aa, Homo Sapiens
EKEIGEGPA

SEQ ID NO: 899334 - protein, 9 aa, Homo Sapiens
VDYCDNTLM

SEQ ID NO: 899335 - protein, 9 aa, Homo Sapiens
TLCSFFFFE

SEQ ID NO: 899336 - protein, 9 aa, Homo Sapiens
VICCQANGK

SEQ ID NO: 899337 - protein, 9 aa, Homo Sapiens
ICAVGRLEG

SEQ ID NO: 899338 - protein, 9 aa, Homo Sapiens
LLLLLLRVS

SEQ ID NO: 899339 - protein, 9 aa, Homo Sapiens
LAAETADGE

SEQ ID NO: 899340 - protein, 9 aa, Homo Sapiens
EASPDNMLQ

SEQ ID NO: 899341 - protein, 9 aa, Homo Sapiens
LPPEPPEVP

SEQ ID NO: 899342 - protein, 9 aa, Homo Sapiens
YYANCTWII

SEQ ID NO: 899343 - protein, 9 aa, Homo Sapiens
EPAMERPLP

SEQ ID NO: 899344 - protein, 9 aa, Homo Sapiens
IGMVIGHKI

SEQ ID NO: 899345 - protein, 9 aa, Homo Sapiens
WYPRSWNNW

SEQ ID NO: 899346 - protein, 9 aa, Homo Sapiens
LQLLPILPL

SEQ ID NO: 899347 - protein, 9 aa, Homo Sapiens
QEVLEELAK

SEQ ID NO: 899348 - protein, 9 aa, Homo Sapiens
WLVGCGTEL

SEQ ID NO: 899349 - protein, 9 aa, Homo Sapiens
GAHLALILC

SEQ ID NO: 899350 - protein, 9 aa, Homo Sapiens
TLQLDLVSL

SEQ ID NO: 899351 - protein, 9 aa, Homo Sapiens
TMRPVRHNF

SEQ ID NO: 899352 - protein, 9 aa, Homo Sapiens
QKKDLLLTK

SEQ ID NO: 899353 - protein, 9 aa, Homo Sapiens
WLIFSIMGM

SEQ ID NO: 899354 - protein, 9 aa, Homo Sapiens
KMLCLSQDV

SEQ ID NO: 899355 - protein, 9 aa, Homo Sapiens
NVCWDTGDT

SEQ ID NO: 899356 - protein, 9 aa, Homo Sapiens
LEQLHQQEE

SEQ ID NO: 899357 - protein, 9 aa, Homo Sapiens
HRSSKLLWP

SEQ ID NO: 899358 - protein, 9 aa, Homo Sapiens
NEVEKNPKP

SEQ ID NO: 899359 - protein, 9 aa, Homo Sapiens
VKKVTPRMI

SEQ ID NO: 899360 - protein, 9 aa, Homo Sapiens
QALVSVAYQ

SEQ ID NO: 899361 - protein, 9 aa, Homo Sapiens
QLACDDITV

SEQ ID NO: 899362 - protein, 9 aa, Homo Sapiens
QPPRSGVKC

SEQ ID NO: 899363 - protein, 9 aa, Homo Sapiens
HRYREGWTE

SEQ ID NO: 899364 - protein, 9 aa, Homo Sapiens
VRYRRNLKR

SEQ ID NO: 899365 - protein, 9 aa, Homo Sapiens
CTGRHQWHP

SEQ ID NO: 899366 - protein, 9 aa, Homo Sapiens
MREAVTIEI

SEQ ID NO: 899367 - protein, 9 aa, Homo Sapiens
YPRSWDNWY

SEQ ID NO: 899368 - protein, 9 aa, Homo Sapiens
FRQGEWSEW

SEQ ID NO: 899369 - protein, 9 aa, Homo Sapiens
GLLVYSCGR

SEQ ID NO: 899370 - protein, 9 aa, Homo Sapiens
LIFSIMGMN

SEQ ID NO: 899371 - protein, 9 aa, Homo Sapiens
CWDTGDTEK

SEQ ID NO: 899372 - protein, 9 aa, Homo Sapiens
QCYNVCWDT

SEQ ID NO: 899373 - protein, 9 aa, Homo Sapiens
WKTAGLFWQ

SEQ ID NO: 899374 - protein, 9 aa, Homo Sapiens
AQTKLGLMT

SEQ ID NO: 899375 - protein, 9 aa, Homo Sapiens
YVQPFWIVF

SEQ ID NO: 899376 - protein, 9 aa, Homo Sapiens
LLVLRLLTV

SEQ ID NO: 899377 - protein, 9 aa, Homo Sapiens
VGHLRGQSA

SEQ ID NO: 899378 - protein, 9 aa, Homo Sapiens
VTAVLWVLA

SEQ ID NO: 899379 - protein, 9 aa, Homo Sapiens
NPGLVFSCL

SEQ ID NO: 899380 - protein, 9 aa, Homo Sapiens
LLLLLRVSL

SEQ ID NO: 899381 - protein, 9 aa, Homo Sapiens
SQPPRSGVK

SEQ ID NO: 899382 - protein, 9 aa, Homo Sapiens
LLVGLLVYS

SEQ ID NO: 899383 - protein, 9 aa, Homo Sapiens
KMKLMMSEG

SEQ ID NO: 899384 - protein, 9 aa, Homo Sapiens
TVLGVGDAN

SEQ ID NO: 899385 - protein, 9 aa, Homo Sapiens
LIFSLRGGS

SEQ ID NO: 899386 - protein, 9 aa, Homo Sapiens
ARSELGAPL

SEQ ID NO: 899387 - protein, 9 aa, Homo Sapiens
FEHRSSKLL

SEQ ID NO: 899388 - protein, 9 aa, Homo Sapiens
MAFTTQALV

SEQ ID NO: 899389 - protein, 9 aa, Homo Sapiens
HFQQSFCYL

SEQ ID NO: 899390 - protein, 9 aa, Homo Sapiens
HNFYDPSSA

SEQ ID NO: 899391 - protein, 9 aa, Homo Sapiens
FQGRPVQVN

SEQ ID NO: 899392 - protein, 9 aa, Homo Sapiens
RRNLKRTSP

SEQ ID NO: 899393 - protein, 9 aa, Homo Sapiens
HAHNEVEKN

SEQ ID NO: 899394 - protein, 9 aa, Homo Sapiens
TETETTALT

SEQ ID NO: 899395 - protein, 9 aa, Homo Sapiens
SIMGMNLFA

SEQ ID NO: 899396 - protein, 9 aa, Homo Sapiens
DTNDESSGS

SEQ ID NO: 899397 - protein, 9 aa, Homo Sapiens
EAVTIEIEF

SEQ ID NO: 899398 - protein, 9 aa, Homo Sapiens
KSVTCTYPP

SEQ ID NO: 899399 - protein, 9 aa, Homo Sapiens
TSFGSAPTM

SEQ ID NO: 899400 - protein, 9 aa, Homo Sapiens
TTPMETCDN

SEQ ID NO: 899401 - protein, 9 aa, Homo Sapiens
QLLPILPLI

SEQ ID NO: 899402 - protein, 9 aa, Homo Sapiens
RAEAAGVQP

SEQ ID NO: 899403 - protein, 9 aa, Homo Sapiens
KIKQAMDLV

SEQ ID NO: 899404 - protein, 9 aa, Homo Sapiens
TGRLPVQMG

SEQ ID NO: 899405 - protein, 9 aa, Homo Sapiens
YPPALNKMF

SEQ ID NO: 899406 - protein, 9 aa, Homo Sapiens
AIQRLPELL

SEQ ID NO: 899407 - protein, 9 aa, Homo Sapiens
GRVGVPSIS

SEQ ID NO: 899408 - protein, 9 aa, Homo Sapiens
TMSTVFSSA

SEQ ID NO: 899409 - protein, 9 aa, Homo Sapiens
LFVTFAINF

SEQ ID NO: 899410 - protein, 9 aa, Homo Sapiens
RQNPLDVMV

SEQ ID NO: 899411 - protein, 9 aa, Homo Sapiens
WEVVQYSTH

SEQ ID NO: 899412 - protein, 9 aa, Homo Sapiens
LQKKDLLLT

SEQ ID NO: 899413 - protein, 9 aa, Homo Sapiens
FQQSFCYLM

SEQ ID NO: 899414 - protein, 9 aa, Homo Sapiens
RPHNFRVPV

SEQ ID NO: 899415 - protein, 9 aa, Homo Sapiens
QLQEREQAL

SEQ ID NO: 899416 - protein, 9 aa, Homo Sapiens
PELLPNVVV

SEQ ID NO: 899417 - protein, 9 aa, Homo Sapiens
LPLVRRRLV

SEQ ID NO: 899418 - protein, 9 aa, Homo Sapiens
GNQKGHFYL

SEQ ID NO: 899419 - protein, 9 aa, Homo Sapiens
PVDENVFTG

SEQ ID NO: 899420 - protein, 9 aa, Homo Sapiens
LVVRYRRNL

SEQ ID NO: 899421 - protein, 9 aa, Homo Sapiens
KSHNSWEKF

SEQ ID NO: 899422 - protein, 9 aa, Homo Sapiens
LVGLLVYSC

SEQ ID NO: 899423 - protein, 9 aa, Homo Sapiens
STAATVREA

SEQ ID NO: 899424 - protein, 9 aa, Homo Sapiens
FLWAVSTLS

SEQ ID NO: 899425 - protein, 9 aa, Homo Sapiens
CAFSQRVTE

SEQ ID NO: 899426 - protein, 9 aa, Homo Sapiens
TLANSSSKD

SEQ ID NO: 899427 - protein, 9 aa, Homo Sapiens
PLSATITLT

SEQ ID NO: 899428 - protein, 9 aa, Homo Sapiens
YGVAYCLAP

SEQ ID NO: 899429 - protein, 9 aa, Homo Sapiens
QEEFRQGEW

SEQ ID NO: 899430 - protein, 9 aa, Homo Sapiens
EGQLLSPLQ

SEQ ID NO: 899431 - protein, 9 aa, Homo Sapiens
LYLEQLHQQ

SEQ ID NO: 899432 - protein, 9 aa, Homo Sapiens
PVRYLQDFA

SEQ ID NO: 899433 - protein, 9 aa, Homo Sapiens
IAAKETIKN

SEQ ID NO: 899434 - protein, 9 aa, Homo Sapiens
MSIPNRIPK

SEQ ID NO: 899435 - protein, 9 aa, Homo Sapiens
WMTIQYDNM

SEQ ID NO: 899436 - protein, 9 aa, Homo Sapiens
LRLANEGQL

SEQ ID NO: 899437 - protein, 9 aa, Homo Sapiens
VLLLVLLYH

SEQ ID NO: 899438 - protein, 9 aa, Homo Sapiens
YLGSLQPLP

SEQ ID NO: 899439 - protein, 9 aa, Homo Sapiens
AGGPTGLAN

SEQ ID NO: 899440 - protein, 9 aa, Homo Sapiens
TDVEMQFGA

SEQ ID NO: 899441 - protein, 9 aa, Homo Sapiens
GSAPTMSTV

SEQ ID NO: 899442 - protein, 9 aa, Homo Sapiens
YPGIPAQGK

SEQ ID NO: 899443 - protein, 9 aa, Homo Sapiens
GMNLFAGKF

SEQ ID NO: 899444 - protein, 9 aa, Homo Sapiens
CENIDPNNC

SEQ ID NO: 899445 - protein, 9 aa, Homo Sapiens
HIIWSEHTR

SEQ ID NO: 899446 - protein, 9 aa, Homo Sapiens
DNINECATL

SEQ ID NO: 899447 - protein, 9 aa, Homo Sapiens
YREGWTELR

SEQ ID NO: 899448 - protein, 9 aa, Homo Sapiens
LRLIHAVKG

SEQ ID NO: 899449 - protein, 9 aa, Homo Sapiens
RSLMYWMTI

SEQ ID NO: 899450 - protein, 9 aa, Homo Sapiens
HREKLYVSP

SEQ ID NO: 899451 - protein, 9 aa, Homo Sapiens
GADPYIRVY

SEQ ID NO: 899452 - protein, 9 aa, Homo Sapiens
VDENVFTGE

SEQ ID NO: 899453 - protein, 9 aa, Homo Sapiens
RLSACLVLA

SEQ ID NO: 899454 - protein, 9 aa, Homo Sapiens
HYVTLTGTI

SEQ ID NO: 899455 - protein, 9 aa, Homo Sapiens
PSPELLPNV

SEQ ID NO: 899456 - protein, 9 aa, Homo Sapiens
KRKMLCLSQ

SEQ ID NO: 899457 - protein, 9 aa, Homo Sapiens
HSIVISSLK

SEQ ID NO: 899458 - protein, 9 aa, Homo Sapiens
LKIHMSIPN

SEQ ID NO: 899459 - protein, 9 aa, Homo Sapiens
VLDSHLRFD

SEQ ID NO: 899460 - protein, 9 aa, Homo Sapiens
WFTFEFLMH

SEQ ID NO: 899461 - protein, 9 aa, Homo Sapiens
GMVIGHKIT

SEQ ID NO: 899462 - protein, 9 aa, Homo Sapiens
HRLVREPVE

SEQ ID NO: 899463 - protein, 9 aa, Homo Sapiens
PGEARRAAL

SEQ ID NO: 899464 - protein, 9 aa, Homo Sapiens
TPMETCDNI

SEQ ID NO: 899465 - protein, 9 aa, Homo Sapiens
LTGRLPVQM

SEQ ID NO: 899466 - protein, 9 aa, Homo Sapiens
IARVEQAMQ

SEQ ID NO: 899467 - protein, 9 aa, Homo Sapiens
DLGALYSSM

SEQ ID NO: 899468 - protein, 9 aa, Homo Sapiens
KEQPYKCYV

SEQ ID NO: 899469 - protein, 9 aa, Homo Sapiens
LNGILKGYR

SEQ ID NO: 899470 - protein, 9 aa, Homo Sapiens
FWSLGGKPQ

SEQ ID NO: 899471 - protein, 9 aa, Homo Sapiens
SNCAFSQRV

SEQ ID NO: 899472 - protein, 9 aa, Homo Sapiens
VTSWLVGCG

SEQ ID NO: 899473 - protein, 9 aa, Homo Sapiens
TAPDQLGKK

SEQ ID NO: 899474 - protein, 9 aa, Homo Sapiens
AELAKHRCH

SEQ ID NO: 899475 - protein, 9 aa, Homo Sapiens
YHQYCSNCA

SEQ ID NO: 899476 - protein, 9 aa, Homo Sapiens
FFFFETESA

SEQ ID NO: 899477 - protein, 9 aa, Homo Sapiens
SGINCLLDH

SEQ ID NO: 899478 - protein, 9 aa, Homo Sapiens
HSDTDGNVS

SEQ ID NO: 899479 - protein, 9 aa, Homo Sapiens
DEVLKQQQE

SEQ ID NO: 899480 - protein, 9 aa, Homo Sapiens
DIQAFIRAH

SEQ ID NO: 899481 - protein, 9 aa, Homo Sapiens
DLVSLNHSG

SEQ ID NO: 899482 - protein, 9 aa, Homo Sapiens
ITSRLSPSL

SEQ ID NO: 899483 - protein, 9 aa, Homo Sapiens
DKRPHVKKV

SEQ ID NO: 899484 - protein, 9 aa, Homo Sapiens
GQRVICCQA

SEQ ID NO: 899485 - protein, 9 aa, Homo Sapiens
PGPWGRVGV

SEQ ID NO: 899486 - protein, 9 aa, Homo Sapiens
YRPHNFRVP

SEQ ID NO: 899487 - protein, 9 aa, Homo Sapiens
VTFWIVGGF

SEQ ID NO: 899488 - protein, 9 aa, Homo Sapiens
RLLLLLLLR

SEQ ID NO: 899489 - protein, 9 aa, Homo Sapiens
VSVSLGDAK

SEQ ID NO: 899490 - protein, 9 aa, Homo Sapiens
ERAALAAET

SEQ ID NO: 899491 - protein, 9 aa, Homo Sapiens
EVPSEVELQ

SEQ ID NO: 899492 - protein, 9 aa, Homo Sapiens
LANEGQLLS

SEQ ID NO: 899493 - protein, 9 aa, Homo Sapiens
DHAIFLTWQ

SEQ ID NO: 899494 - protein, 9 aa, Homo Sapiens
ANEGQLLSP

SEQ ID NO: 899495 - protein, 9 aa, Homo Sapiens
QAQTKLGLM

SEQ ID NO: 899496 - protein, 9 aa, Homo Sapiens
VYSCGRKGT

SEQ ID NO: 899497 - protein, 9 aa, Homo Sapiens
EKRHREKLY

SEQ ID NO: 899498 - protein, 9 aa, Homo Sapiens
LFWQFTTEH

SEQ ID NO: 899499 - protein, 9 aa, Homo Sapiens
DPYIRVYLL

SEQ ID NO: 899500 - protein, 9 aa, Homo Sapiens
DVLRNNRRP

SEQ ID NO: 899501 - protein, 9 aa, Homo Sapiens
EHRSSKLLW

SEQ ID NO: 899502 - protein, 9 aa, Homo Sapiens
LLTVLGVGD

SEQ ID NO: 899503 - protein, 9 aa, Homo Sapiens
AILPTWFPF

SEQ ID NO: 899504 - protein, 9 aa, Homo Sapiens
AVLSTAATV

SEQ ID NO: 899505 - protein, 9 aa, Homo Sapiens
WTELRRDKS

SEQ ID NO: 899506 - protein, 9 aa, Homo Sapiens
LMDEVLKQQ

SEQ ID NO: 899507 - protein, 9 aa, Homo Sapiens
ETETETTAL

SEQ ID NO: 899508 - protein, 9 aa, Homo Sapiens
TESASVTQA

SEQ ID NO: 899509 - protein, 9 aa, Homo Sapiens
ARPCALGAP

SEQ ID NO: 899510 - protein, 9 aa, Homo Sapiens
IECLQICAV

SEQ ID NO: 899511 - protein, 9 aa, Homo Sapiens
YGKQLERER

SEQ ID NO: 899512 - protein, 9 aa, Homo Sapiens
GLFWQFTTE

SEQ ID NO: 899513 - protein, 9 aa, Homo Sapiens
IFLTWQDFG

SEQ ID NO: 899514 - protein, 9 aa, Homo Sapiens
PVENIKLYH

SEQ ID NO: 899515 - protein, 9 aa, Homo Sapiens
TGCPRLSAC

SEQ ID NO: 899516 - protein, 9 aa, Homo Sapiens
LPECGQPSC

SEQ ID NO: 899517 - protein, 9 aa, Homo Sapiens
VQHRGQGGA

SEQ ID NO: 899518 - protein, 9 aa, Homo Sapiens
CNPSPELLP

SEQ ID NO: 899519 - protein, 9 aa, Homo Sapiens
VENIKLYHS

SEQ ID NO: 899520 - protein, 9 aa, Homo Sapiens
ATEGCISAI

SEQ ID NO: 899521 - protein, 9 aa, Homo Sapiens
GELRGYAIQ

SEQ ID NO: 899522 - protein, 9 aa, Homo Sapiens
LVTLQLLPI

SEQ ID NO: 899523 - protein, 9 aa, Homo Sapiens
SASVTQAGV

SEQ ID NO: 899524 - protein, 9 aa, Homo Sapiens
QKGHFYLEE

SEQ ID NO: 899525 - protein, 9 aa, Homo Sapiens
CCQANGKWS

SEQ ID NO: 899526 - protein, 9 aa, Homo Sapiens
QMAKMMESS

SEQ ID NO: 899527 - protein, 9 aa, Homo Sapiens
QTKLGLMTK

SEQ ID NO: 899528 - protein, 9 aa, Homo Sapiens
REAVTIEIE

SEQ ID NO: 899529 - protein, 9 aa, Homo Sapiens
LANSSSKDY

SEQ ID NO: 899530 - protein, 9 aa, Homo Sapiens
WGRVGVPSI

SEQ ID NO: 899531 - protein, 9 aa, Homo Sapiens
AYCLAPDPD

SEQ ID NO: 899532 - protein, 9 aa, Homo Sapiens
RNADSGAID

SEQ ID NO: 899533 - protein, 9 aa, Homo Sapiens
LLDHSDTDG

SEQ ID NO: 899534 - protein, 9 aa, Homo Sapiens
QSYDCVCIM

SEQ ID NO: 899535 - protein, 9 aa, Homo Sapiens
LGGKPQILT

SEQ ID NO: 899536 - protein, 9 aa, Homo Sapiens
RAYTAPAPG

SEQ ID NO: 899537 - protein, 9 aa, Homo Sapiens
IHVCNLCGI

SEQ ID NO: 899538 - protein, 9 aa, Homo Sapiens
TETTALTPP

SEQ ID NO: 899539 - protein, 9 aa, Homo Sapiens
IDPNNCIPP

SEQ ID NO: 899540 - protein, 9 aa, Homo Sapiens
SNCLWAEDS

SEQ ID NO: 899541 - protein, 9 aa, Homo Sapiens
CYVCSNSFS

SEQ ID NO: 899542 - protein, 9 aa, Homo Sapiens
HKITHGFDD

SEQ ID NO: 899543 - protein, 9 aa, Homo Sapiens
YRRNLKRTS

SEQ ID NO: 899544 - protein, 9 aa, Homo Sapiens
VSMRQGALS

SEQ ID NO: 899545 - protein, 9 aa, Homo Sapiens
PTGLANVPL

SEQ ID NO: 899546 - protein, 9 aa, Homo Sapiens
VKGYWLTNK

SEQ ID NO: 899547 - protein, 9 aa, Homo Sapiens
PKLSTALAL

SEQ ID NO: 899548 - protein, 9 aa, Homo Sapiens
TFEFLMHVI

SEQ ID NO: 899549 - protein, 9 aa, Homo Sapiens
TTCLEASIS

SEQ ID NO: 899550 - protein, 9 aa, Homo Sapiens
EPQPVENIK

SEQ ID NO: 899551 - protein, 9 aa, Homo Sapiens
PRLSACLVL

SEQ ID NO: 899552 - protein, 9 aa, Homo Sapiens
VCWDTGDTE

SEQ ID NO: 899553 - protein, 9 aa, Homo Sapiens
LSSREEADT

SEQ ID NO: 899554 - protein, 9 aa, Homo Sapiens
PLIEVGHLR

SEQ ID NO: 899555 - protein, 9 aa, Homo Sapiens
SLRLIHAVK

SEQ ID NO: 899556 - protein, 9 aa, Homo Sapiens
RDDFRQNPL

SEQ ID NO: 899557 - protein, 9 aa, Homo Sapiens
VTIEIEFCV

SEQ ID NO: 899558 - protein, 9 aa, Homo Sapiens
KQAMDLVKS

SEQ ID NO: 899559 - protein, 9 aa, Homo Sapiens
MSGAHLALI

SEQ ID NO: 899560 - protein, 9 aa, Homo Sapiens
GVEVAGGPT

SEQ ID NO: 899561 - protein, 9 aa, Homo Sapiens
AIWVLVTLQ

SEQ ID NO: 899562 - protein, 9 aa, Homo Sapiens
RLPVQMGMY

SEQ ID NO: 899563 - protein, 9 aa, Homo Sapiens
VCIMFASIP

SEQ ID NO: 899564 - protein, 9 aa, Homo Sapiens
PRSWDNWYP

SEQ ID NO: 899565 - protein, 9 aa, Homo Sapiens
DYCDNTLMF

SEQ ID NO: 899566 - protein, 9 aa, Homo Sapiens
LDQMAKMME

SEQ ID NO: 899567 - protein, 9 aa, Homo Sapiens
TSWLVGCGT

SEQ ID NO: 899568 - protein, 9 aa, Homo Sapiens
HLRGQSAGV

SEQ ID NO: 899569 - protein, 9 aa, Homo Sapiens
SPSTLEPHL

SEQ ID NO: 899570 - protein, 9 aa, Homo Sapiens
PKFCGYPGI

SEQ ID NO: 899571 - protein, 9 aa, Homo Sapiens
KLLWPEWMG

SEQ ID NO: 899572 - protein, 9 aa, Homo Sapiens
FKCDMSALQ

SEQ ID NO: 899573 - protein, 9 aa, Homo Sapiens
VGCGTELPL

SEQ ID NO: 899574 - protein, 9 aa, Homo Sapiens
RARHRLVRE

SEQ ID NO: 899575 - protein, 9 aa, Homo Sapiens
PRSGVKCDF

SEQ ID NO: 899576 - protein, 9 aa, Homo Sapiens
PCALGAPAE

SEQ ID NO: 899577 - protein, 9 aa, Homo Sapiens
LCLSQDVKG

SEQ ID NO: 899578 - protein, 9 aa, Homo Sapiens
IIYYLTFGD

SEQ ID NO: 899579 - protein, 9 aa, Homo Sapiens
SIIYYLTFG

SEQ ID NO: 899580 - protein, 9 aa, Homo Sapiens
LALFVTFAI

SEQ ID NO: 899581 - protein, 9 aa, Homo Sapiens
LVGCGTELP

SEQ ID NO: 899582 - protein, 9 aa, Homo Sapiens
TPHRYREGW

SEQ ID NO: 899583 - protein, 9 aa, Homo Sapiens
KGYWLTNKV

SEQ ID NO: 899584 - protein, 9 aa, Homo Sapiens
EINSPRSWD

SEQ ID NO: 899585 - protein, 9 aa, Homo Sapiens
PLIIAAKET

SEQ ID NO: 899586 - protein, 9 aa, Homo Sapiens
VICDGDKFQ

SEQ ID NO: 899587 - protein, 9 aa, Homo Sapiens
GVAYCLAPD

SEQ ID NO: 899588 - protein, 9 aa, Homo Sapiens
DNKIKQAMD

SEQ ID NO: 899589 - protein, 9 aa, Homo Sapiens
PSCSLPSLV

SEQ ID NO: 899590 - protein, 9 aa, Homo Sapiens
RFTDVEMQF

SEQ ID NO: 899591 - protein, 9 aa, Homo Sapiens
EKSHNSWEK

SEQ ID NO: 899592 - protein, 9 aa, Homo Sapiens
FIRAHRIGQ

SEQ ID NO: 899593 - protein, 9 aa, Homo Sapiens
VCTGRHQWH

SEQ ID NO: 899594 - protein, 9 aa, Homo Sapiens
TEGCISAIE

SEQ ID NO: 899595 - protein, 9 aa, Homo Sapiens
LGLMTKLYI

SEQ ID NO: 899596 - protein, 9 aa, Homo Sapiens
CKCPENFNE

SEQ ID NO: 899597 - protein, 9 aa, Homo Sapiens
CLLDHSDTD

SEQ ID NO: 899598 - protein, 9 aa, Homo Sapiens
AVPVDENVF

SEQ ID NO: 899599 - protein, 9 aa, Homo Sapiens
PLPPEPPEV

SEQ ID NO: 899600 - protein, 9 aa, Homo Sapiens
LDVHLTIQE

SEQ ID NO: 899601 - protein, 9 aa, Homo Sapiens
CVCIMFASI

SEQ ID NO: 899602 - protein, 9 aa, Homo Sapiens
HQWHPDPVL

SEQ ID NO: 899603 - protein, 9 aa, Homo Sapiens
ASRAYTAPA

SEQ ID NO: 899604 - protein, 9 aa, Homo Sapiens
TFKYRGKDG

SEQ ID NO: 899605 - protein, 9 aa, Homo Sapiens
GTKPKLSTA

SEQ ID NO: 899606 - protein, 9 aa, Homo Sapiens
ITLTVAVAD

SEQ ID NO: 899607 - protein, 9 aa, Homo Sapiens
KMMESSLPS

SEQ ID NO: 899608 - protein, 9 aa, Homo Sapiens
NLKRTSPEE

SEQ ID NO: 899609 - protein, 9 aa, Homo Sapiens
AQLACDDIT

SEQ ID NO: 899610 - protein, 9 aa, Homo Sapiens
IVLLFLCLL

SEQ ID NO: 899611 - protein, 9 aa, Homo Sapiens
AVSTLSFLL

SEQ ID NO: 899612 - protein, 9 aa, Homo Sapiens
FCLSTARAE

SEQ ID NO: 899613 - protein, 9 aa, Homo Sapiens
AFSQRVTEI

SEQ ID NO: 899614 - protein, 9 aa, Homo Sapiens
QNPLDVMVA

SEQ ID NO: 899615 - protein, 9 aa, Homo Sapiens
RGQGGAHWS

SEQ ID NO: 899616 - protein, 9 aa, Homo Sapiens
SGVKCDFRS

SEQ ID NO: 899617 - protein, 9 aa, Homo Sapiens
KNTFKYRGK

SEQ ID NO: 899618 - protein, 9 aa, Homo Sapiens
LWAVSTLSF

SEQ ID NO: 899619 - protein, 9 aa, Homo Sapiens
IKLYHSWLL

SEQ ID NO: 899620 - protein, 9 aa, Homo Sapiens
KKMEEEFLL

SEQ ID NO: 899621 - protein, 9 aa, Homo Sapiens
EQAMQAIPM

SEQ ID NO: 899622 - protein, 9 aa, Homo Sapiens
KKMKLMMSE

SEQ ID NO: 899623 - protein, 9 aa, Homo Sapiens
FETESASVT

SEQ ID NO: 899624 - protein, 9 aa, Homo Sapiens
RLRVSGAVV

SEQ ID NO: 899625 - protein, 9 aa, Homo Sapiens
RYREGWTEL

SEQ ID NO: 899626 - protein, 9 aa, Homo Sapiens
LLLRVSLGG

SEQ ID NO: 899627 - protein, 9 aa, Homo Sapiens
LYAFKTCKC

SEQ ID NO: 899628 - protein, 9 aa, Homo Sapiens
GAVLSTAAT

SEQ ID NO: 899629 - protein, 9 aa, Homo Sapiens
ASPFRQPPP

SEQ ID NO: 899630 - protein, 9 aa, Homo Sapiens
IMFASIPDF

SEQ ID NO: 899631 - protein, 9 aa, Homo Sapiens
LSHFQQSFC

SEQ ID NO: 899632 - protein, 9 aa, Homo Sapiens
NEWEVVQYS

SEQ ID NO: 899633 - protein, 9 aa, Homo Sapiens
YLQASTGEN

SEQ ID NO: 899634 - protein, 9 aa, Homo Sapiens
NDVNFQDTN

SEQ ID NO: 899635 - protein, 9 aa, Homo Sapiens
WVQHRGQGG

SEQ ID NO: 899636 - protein, 9 aa, Homo Sapiens
EEFLLLEDQ

SEQ ID NO: 899637 - protein, 9 aa, Homo Sapiens
LARPCALGA

SEQ ID NO: 899638 - protein, 9 aa, Homo Sapiens
GGKPQILTK

SEQ ID NO: 899639 - protein, 9 aa, Homo Sapiens
AEQSFLSSR

SEQ ID NO: 899640 - protein, 9 aa, Homo Sapiens
GVTPGWVQH

SEQ ID NO: 899641 - protein, 9 aa, Homo Sapiens
FFFETESAS

SEQ ID NO: 899642 - protein, 9 aa, Homo Sapiens
PPPNCSAGT

SEQ ID NO: 899643 - protein, 9 aa, Homo Sapiens
KQEGVLNGK

SEQ ID NO: 899644 - protein, 9 aa, Homo Sapiens
RVCLIQGTA

SEQ ID NO: 899645 - protein, 9 aa, Homo Sapiens
CQASDTEED

SEQ ID NO: 899646 - protein, 9 aa, Homo Sapiens
ADPYIRVYL

SEQ ID NO: 899647 - protein, 9 aa, Homo Sapiens
AQEEFRQGE

SEQ ID NO: 899648 - protein, 9 aa, Homo Sapiens
LSTARAEAA

SEQ ID NO: 899649 - protein, 9 aa, Homo Sapiens
ETCDNINEC

SEQ ID NO: 899650 - protein, 9 aa, Homo Sapiens
GTLANSSSK

SEQ ID NO: 899651 - protein, 9 aa, Homo Sapiens
LWPEWMGVM

SEQ ID NO: 899652 - protein, 9 aa, Homo Sapiens
IEIEFCVWD

SEQ ID NO: 899653 - protein, 9 aa, Homo Sapiens
EEFRQGEWS

SEQ ID NO: 899654 - protein, 9 aa, Homo Sapiens
YRCYLQAST

SEQ ID NO: 899655 - protein, 9 aa, Homo Sapiens
GTLQFCQAS

SEQ ID NO: 899656 - protein, 9 aa, Homo Sapiens
AFIRAHRIG

SEQ ID NO: 899657 - protein, 9 aa, Homo Sapiens
GRTRRFTDV

SEQ ID NO: 899658 - protein, 9 aa, Homo Sapiens
TNDANTQKK

SEQ ID NO: 899659 - protein, 9 aa, Homo Sapiens
EQLHQQEEE

SEQ ID NO: 899660 - protein, 9 aa, Homo Sapiens
LLTGRLPVQ

SEQ ID NO: 899661 - protein, 9 aa, Homo Sapiens
WFPFRTTVF

SEQ ID NO: 899662 - protein, 9 aa, Homo Sapiens
FRQNPLDVM

SEQ ID NO: 899663 - protein, 9 aa, Homo Sapiens
VRNICCLTP

SEQ ID NO: 899664 - protein, 9 aa, Homo Sapiens
PLDVMVAVG

SEQ ID NO: 899665 - protein, 9 aa, Homo Sapiens
CDGDKFQIN

SEQ ID NO: 899666 - protein, 9 aa, Homo Sapiens
STLEPHLRP

SEQ ID NO: 899667 - protein, 9 aa, Homo Sapiens
VFSCLSPEY

SEQ ID NO: 899668 - protein, 9 aa, Homo Sapiens
PHNDIQAFI

SEQ ID NO: 899669 - protein, 9 aa, Homo Sapiens
PPLSATITL

SEQ ID NO: 899670 - protein, 9 aa, Homo Sapiens
CCLTPTRSF

SEQ ID NO: 899671 - protein, 9 aa, Homo Sapiens
HNDIQAFIR

SEQ ID NO: 899672 - protein, 9 aa, Homo Sapiens
RNLKRTSPE

SEQ ID NO: 899673 - protein, 9 aa, Homo Sapiens
PLDSHYVTL

SEQ ID NO: 899674 - protein, 9 aa, Homo Sapiens
SCKDLEDVL

SEQ ID NO: 899675 - protein, 9 aa, Homo Sapiens
GQPSCSLPS

SEQ ID NO: 899676 - protein, 9 aa, Homo Sapiens
SYDCVCIMF

SEQ ID NO: 899677 - protein, 9 aa, Homo Sapiens
EQFQEVLEE

SEQ ID NO: 899678 - protein, 9 aa, Homo Sapiens
HSQEEACIM

SEQ ID NO: 899679 - protein, 9 aa, Homo Sapiens
EKDNKDQAW

SEQ ID NO: 899680 - protein, 9 aa, Homo Sapiens
LIFLQKKDL

SEQ ID NO: 899681 - protein, 9 aa, Homo Sapiens
KKDLLLTKT

SEQ ID NO: 899682 - protein, 9 aa, Homo Sapiens
RRFTDVEMQ

SEQ ID NO: 899683 - protein, 9 aa, Homo Sapiens
LLPNVVVNG

SEQ ID NO: 899684 - protein, 9 aa, Homo Sapiens
YYLTFGDKI

SEQ ID NO: 899685 - protein, 9 aa, Homo Sapiens
PPLPYDTDQ

SEQ ID NO: 899686 - protein, 9 aa, Homo Sapiens
WQDFGPSGM

SEQ ID NO: 899687 - protein, 9 aa, Homo Sapiens
TCSIIYYLT

SEQ ID NO: 899688 - protein, 9 aa, Homo Sapiens
KFCGYPGIP

SEQ ID NO: 899689 - protein, 9 aa, Homo Sapiens
RRAALPLVR

SEQ ID NO: 899690 - protein, 9 aa, Homo Sapiens
AAKETIKNS

SEQ ID NO: 899691 - protein, 9 aa, Homo Sapiens
GTMRPVRHN

SEQ ID NO: 899692 - protein, 9 aa, Homo Sapiens
NPLDVMVAV

SEQ ID NO: 899693 - protein, 9 aa, Homo Sapiens
VLEEGSFIN

SEQ ID NO: 899694 - protein, 9 aa, Homo Sapiens
TAILTGCPR

SEQ ID NO: 899695 - protein, 9 aa, Homo Sapiens
TQAGVQWRY

SEQ ID NO: 899696 - protein, 9 aa, Homo Sapiens
LASRAYTAP

SEQ ID NO: 899697 - protein, 9 aa, Homo Sapiens
YYTGQRVIC

SEQ ID NO: 899698 - protein, 9 aa, Homo Sapiens
FTDVEMQFG

SEQ ID NO: 899699 - protein, 9 aa, Homo Sapiens
TGQSITSRL

SEQ ID NO: 899700 - protein, 9 aa, Homo Sapiens
QRVTEINSP

SEQ ID NO: 899701 - protein, 9 aa, Homo Sapiens
LTVLGVGDA

SEQ ID NO: 899702 - protein, 9 aa, Homo Sapiens
VLLYHQYCS

SEQ ID NO: 899703 - protein, 9 aa, Homo Sapiens
LPEKVEYVF

SEQ ID NO: 899704 - protein, 9 aa, Homo Sapiens
INLTRLQKL

SEQ ID NO: 899705 - protein, 9 aa, Homo Sapiens
CLWAEDSTE

SEQ ID NO: 899706 - protein, 9 aa, Homo Sapiens
MEEEFLLLE

SEQ ID NO: 899707 - protein, 9 aa, Homo Sapiens
LLTCSIIYY

SEQ ID NO: 899708 - protein, 9 aa, Homo Sapiens
PPRSTLNGI

SEQ ID NO: 899709 - protein, 9 aa, Homo Sapiens
ILKGYRVIF

SEQ ID NO: 899710 - protein, 9 aa, Homo Sapiens
RFSTTPALY

SEQ ID NO: 899711 - protein, 9 aa, Homo Sapiens
NSRLMDEVL

SEQ ID NO: 899712 - protein, 9 aa, Homo Sapiens
QSFLSSREE

SEQ ID NO: 899713 - protein, 9 aa, Homo Sapiens
APGEKEIGE

SEQ ID NO: 899714 - protein, 9 aa, Homo Sapiens
KLYLEQLHQ

SEQ ID NO: 899715 - protein, 9 aa, Homo Sapiens
GEDAHRARH

SEQ ID NO: 899716 - protein, 9 aa, Homo Sapiens
SGADPYIRV

SEQ ID NO: 899717 - protein, 9 aa, Homo Sapiens
RLIHAVKGY

SEQ ID NO: 899718 - protein, 9 aa, Homo Sapiens
APSIGFVSM

SEQ ID NO: 899719 - protein, 9 aa, Homo Sapiens
LPVVAQTRE

SEQ ID NO: 899720 - protein, 9 aa, Homo Sapiens
FPSVSVSLG

SEQ ID NO: 899721 - protein, 9 aa, Homo Sapiens
VIGHKITHG

SEQ ID NO: 899722 - protein, 9 aa, Homo Sapiens
TNIECLQIC

SEQ ID NO: 899723 - protein, 9 aa, Homo Sapiens
EEACIMGAK

SEQ ID NO: 899724 - protein, 9 aa, Homo Sapiens
YSVTSWLVG

SEQ ID NO: 899725 - protein, 9 aa, Homo Sapiens
WIVFLLVGH

SEQ ID NO: 899726 - protein, 9 aa, Homo Sapiens
RAQEEFRQG

SEQ ID NO: 899727 - protein, 9 aa, Homo Sapiens
QAHYGKQLE

SEQ ID NO: 899728 - protein, 9 aa, Homo Sapiens
PSTLEPHLR

SEQ ID NO: 899729 - protein, 9 aa, Homo Sapiens
PLPYDTDQP

SEQ ID NO: 899730 - protein, 9 aa, Homo Sapiens
NGEILRNAD

SEQ ID NO: 899731 - protein, 9 aa, Homo Sapiens
GHKITHGFD

SEQ ID NO: 899732 - protein, 9 aa, Homo Sapiens
NDEVHIIWS

SEQ ID NO: 899733 - protein, 9 aa, Homo Sapiens
KHRCHPVER

SEQ ID NO: 899734 - protein, 9 aa, Homo Sapiens
GQSAGVTPG

SEQ ID NO: 899735 - protein, 9 aa, Homo Sapiens
GALYSSMKD

SEQ ID NO: 899736 - protein, 9 aa, Homo Sapiens
LVSLNHSGA

SEQ ID NO: 899737 - protein, 9 aa, Homo Sapiens
RTRRFTDVE

SEQ ID NO: 899738 - protein, 9 aa, Homo Sapiens
RPCALGAPA

SEQ ID NO: 899739 - protein, 9 aa, Homo Sapiens
CPRLSACLV

SEQ ID NO: 899740 - protein, 9 aa, Homo Sapiens
LVSVAYQVG

SEQ ID NO: 899741 - protein, 9 aa, Homo Sapiens
GLMTKLYIL

SEQ ID NO: 899742 - protein, 9 aa, Homo Sapiens
TARAEAAGV

SEQ ID NO: 899743 - protein, 9 aa, Homo Sapiens
NGRTRRFTD

SEQ ID NO: 899744 - protein, 9 aa, Homo Sapiens
EFRQGEWSE

SEQ ID NO: 899745 - protein, 9 aa, Homo Sapiens
FSIMGMNLF

SEQ ID NO: 899746 - protein, 9 aa, Homo Sapiens
NIDPNNCIP

SEQ ID NO: 899747 - protein, 9 aa, Homo Sapiens
GQSITSRLS

SEQ ID NO: 899748 - protein, 9 aa, Homo Sapiens
DVAIDLSQE

SEQ ID NO: 899749 - protein, 9 aa, Homo Sapiens
IDLGALYSS

SEQ ID NO: 899750 - protein, 9 aa, Homo Sapiens
STLNGILKG

SEQ ID NO: 899751 - protein, 9 aa, Homo Sapiens
QAFIRAHRI

SEQ ID NO: 899752 - protein, 9 aa, Homo Sapiens
KITHGFDDN

SEQ ID NO: 899753 - protein, 9 aa, Homo Sapiens
NICCLTPTR

SEQ ID NO: 899754 - protein, 9 aa, Homo Sapiens
NDIQAFIRA

SEQ ID NO: 899755 - protein, 9 aa, Homo Sapiens
QDRWREPAM

SEQ ID NO: 899756 - protein, 9 aa, Homo Sapiens
DSHYVTLTG

SEQ ID NO: 899757 - protein, 9 aa, Homo Sapiens
TKLGLMTKL

SEQ ID NO: 899758 - protein, 9 aa, Homo Sapiens
MRQGALSEA

SEQ ID NO: 899759 - protein, 9 aa, Homo Sapiens
GVLNGKVGM

SEQ ID NO: 899760 - protein, 9 aa, Homo Sapiens
AGMALLRFF

SEQ ID NO: 899761 - protein, 9 aa, Homo Sapiens
PWGRVGVPS

SEQ ID NO: 899762 - protein, 9 aa, Homo Sapiens
AHYGKQLER

SEQ ID NO: 899763 - protein, 9 aa, Homo Sapiens
PDCGFQGRP

SEQ ID NO: 899764 - protein, 9 aa, Homo Sapiens
RVICCQANG

SEQ ID NO: 899765 - protein, 9 aa, Homo Sapiens
KRHREKLYV

SEQ ID NO: 899766 - protein, 9 aa, Homo Sapiens
QFTTEHTPP

SEQ ID NO: 899767 - protein, 9 aa, Homo Sapiens
SAPTMSTVF

SEQ ID NO: 899768 - protein, 9 aa, Homo Sapiens
YAGIVIVLL

SEQ ID NO: 899769 - protein, 9 aa, Homo Sapiens
QDTNDESSG

SEQ ID NO: 899770 - protein, 9 aa, Homo Sapiens
GVKCDFRSE

SEQ ID NO: 899771 - protein, 9 aa, Homo Sapiens
WVLVTLQLL

SEQ ID NO: 899772 - protein, 9 aa, Homo Sapiens
QFCQASDTE

SEQ ID NO: 899773 - protein, 9 aa, Homo Sapiens
VGLLVYSCG

SEQ ID NO: 899774 - protein, 9 aa, Homo Sapiens
YPYYANCTW

SEQ ID NO: 899775 - protein, 9 aa, Homo Sapiens
AVVTAVLWV

SEQ ID NO: 899776 - protein, 9 aa, Homo Sapiens
HKEAEIEYR

SEQ ID NO: 899777 - protein, 9 aa, Homo Sapiens
QLHQQEEEK

SEQ ID NO: 899778 - protein, 9 aa, Homo Sapiens
YAFKTCKCP

SEQ ID NO: 899779 - protein, 9 aa, Homo Sapiens
ENVFTGEDL

SEQ ID NO: 899780 - protein, 9 aa, Homo Sapiens
QGGAHWSPH

SEQ ID NO: 899781 - protein, 9 aa, Homo Sapiens
AALAAETAD

SEQ ID NO: 899782 - protein, 9 aa, Homo Sapiens
SSSKDYTLH

SEQ ID NO: 899783 - protein, 9 aa, Homo Sapiens
VMREAVTIE

SEQ ID NO: 899784 - protein, 9 aa, Homo Sapiens
MAKMMESSL

SEQ ID NO: 899785 - protein, 9 aa, Homo Sapiens
TTPALYLLS

SEQ ID NO: 899786 - protein, 9 aa, Homo Sapiens
MQQKCGFSE

SEQ ID NO: 899787 - protein, 9 aa, Homo Sapiens
ETTALTPPA

SEQ ID NO: 899788 - protein, 9 aa, Homo Sapiens
IHAVKGYWL

SEQ ID NO: 899789 - protein, 9 aa, Homo Sapiens
LTCSIIYYL

SEQ ID NO: 899790 - protein, 9 aa, Homo Sapiens
SDPYQIHVC

SEQ ID NO: 899791 - protein, 9 aa, Homo Sapiens
AYGRARSEL

SEQ ID NO: 899792 - protein, 9 aa, Homo Sapiens
FRFSTTPAL

SEQ ID NO: 899793 - protein, 9 aa, Homo Sapiens
CKDLEDVLR

SEQ ID NO: 899794 - protein, 9 aa, Homo Sapiens
INTGTLQFC

SEQ ID NO: 899795 - protein, 9 aa, Homo Sapiens
QTDRQGQNS

SEQ ID NO: 899796 - protein, 9 aa, Homo Sapiens
LLVYSCGRK

SEQ ID NO: 899797 - protein, 9 aa, Homo Sapiens
TELEMQQKC

SEQ ID NO: 899798 - protein, 9 aa, Homo Sapiens
CGQPSCSLP

SEQ ID NO: 899799 - protein, 9 aa, Homo Sapiens
RSWNNWYHT

SEQ ID NO: 899800 - protein, 9 aa, Homo Sapiens
LRVSGAVVT

SEQ ID NO: 899801 - protein, 9 aa, Homo Sapiens
SHFQQSFCY

SEQ ID NO: 899802 - protein, 9 aa, Homo Sapiens
LQFCQASDT

SEQ ID NO: 899803 - protein, 9 aa, Homo Sapiens
AKHRCHPVE

SEQ ID NO: 899804 - protein, 9 aa, Homo Sapiens
FQEVLEELA

SEQ ID NO: 899805 - protein, 9 aa, Homo Sapiens
YQAHYGKQL

SEQ ID NO: 899806 - protein, 9 aa, Homo Sapiens
IWSEHTRDY

SEQ ID NO: 899807 - protein, 9 aa, Homo Sapiens
GHSIVISSL

SEQ ID NO: 899808 - protein, 9 aa, Homo Sapiens
DSHLRFDRA

SEQ ID NO: 899809 - protein, 9 aa, Homo Sapiens
ALVSVAYQV

SEQ ID NO: 899810 - protein, 9 aa, Homo Sapiens
TYSGGTKPK

SEQ ID NO: 899811 - protein, 9 aa, Homo Sapiens
SVTCTYPPA

SEQ ID NO: 899812 - protein, 9 aa, Homo Sapiens
LPYDTDQPQ

SEQ ID NO: 899813 - protein, 9 aa, Homo Sapiens
PVTFWIVGG

SEQ ID NO: 899814 - protein, 9 aa, Homo Sapiens
CSIIYYLTF

SEQ ID NO: 899815 - protein, 9 aa, Homo Sapiens
MHVIFCPNK

SEQ ID NO: 899816 - protein, 9 aa, Homo Sapiens
ESLARPCAL

SEQ ID NO: 899817 - protein, 9 aa, Homo Sapiens
GQPPLSATI

SEQ ID NO: 899818 - protein, 9 aa, Homo Sapiens
ASISPVGTV

SEQ ID NO: 899819 - protein, 9 aa, Homo Sapiens
SLARPCALG

SEQ ID NO: 899820 - protein, 9 aa, Homo Sapiens
FLMHVIFCP

SEQ ID NO: 899821 - protein, 9 aa, Homo Sapiens
RVGVPSISP

SEQ ID NO: 899822 - protein, 9 aa, Homo Sapiens
HLALILCVT

SEQ ID NO: 899823 - protein, 9 aa, Homo Sapiens
KCYVCSNSF

SEQ ID NO: 899824 - protein, 9 aa, Homo Sapiens
VISSLKIFY

SEQ ID NO: 899825 - protein, 9 aa, Homo Sapiens
EMPDCGFQG

SEQ ID NO: 899826 - protein, 9 aa, Homo Sapiens
CLIQGTAEA

SEQ ID NO: 899827 - protein, 9 aa, Homo Sapiens
SWDNWYPRS

SEQ ID NO: 899828 - protein, 9 aa, Homo Sapiens
TCKCPENFN

SEQ ID NO: 899829 - protein, 9 aa, Homo Sapiens
TYPPALNKM

SEQ ID NO: 899830 - protein, 9 aa, Homo Sapiens
AGIVIVLLF

SEQ ID NO: 899831 - protein, 9 aa, Homo Sapiens
QYSTHLVDM

SEQ ID NO: 899832 - protein, 9 aa, Homo Sapiens
WDTGDTEKM

SEQ ID NO: 899833 - protein, 9 aa, Homo Sapiens
GHLRGQSAG

SEQ ID NO: 899834 - protein, 9 aa, Homo Sapiens
PNCSAGTKG

SEQ ID NO: 899835 - protein, 9 aa, Homo Sapiens
KQLERERRL

SEQ ID NO: 899836 - protein, 9 aa, Homo Sapiens
VVTAVLWVL

SEQ ID NO: 899837 - protein, 9 aa, Homo Sapiens
IRAHRIGQN

SEQ ID NO: 899838 - protein, 9 aa, Homo Sapiens
WQFTTEHTP

SEQ ID NO: 899839 - protein, 9 aa, Homo Sapiens
VVAQTREQE

SEQ ID NO: 899840 - protein, 9 aa, Homo Sapiens
LLLVLLYHQ

SEQ ID NO: 899841 - protein, 9 aa, Homo Sapiens
VAGMALLRF

SEQ ID NO: 899842 - protein, 9 aa, Homo Sapiens
TLSFLLGLA

SEQ ID NO: 899843 - protein, 9 aa, Homo Sapiens
SLMYWMTIQ

SEQ ID NO: 899844 - protein, 9 aa, Homo Sapiens
AFYQAHYGK

SEQ ID NO: 899845 - protein, 9 aa, Homo Sapiens
SSMKDTEKG

SEQ ID NO: 899846 - protein, 9 aa, Homo Sapiens
DTELEMQQK

SEQ ID NO: 899847 - protein, 9 aa, Homo Sapiens
GWVQHRGQG

SEQ ID NO: 899848 - protein, 9 aa, Homo Sapiens
FSCLSPEYY

SEQ ID NO: 899849 - protein, 9 aa, Homo Sapiens
NWYPRSWNN

SEQ ID NO: 899850 - protein, 9 aa, Homo Sapiens
IQRLPELLT

SEQ ID NO: 899851 - protein, 9 aa, Homo Sapiens
KYRGKDGTH

SEQ ID NO: 899852 - protein, 9 aa, Homo Sapiens
IQAFIRAHR

SEQ ID NO: 899853 - protein, 9 aa, Homo Sapiens
AILTGCPRL

SEQ ID NO: 899854 - protein, 9 aa, Homo Sapiens
ECGQPSCSL

SEQ ID NO: 899855 - protein, 9 aa, Homo Sapiens
GAVVTAVLW

SEQ ID NO: 899856 - protein, 9 aa, Homo Sapiens
TEINSPRSW

SEQ ID NO: 899857 - protein, 9 aa, Homo Sapiens
ARHRLVREP

SEQ ID NO: 899858 - protein, 9 aa, Homo Sapiens
IVCTGRHQW

SEQ ID NO: 899859 - protein, 9 aa, Homo Sapiens
LLIFLQKKD

SEQ ID NO: 899860 - protein, 9 aa, Homo Sapiens
VAQTREQED

SEQ ID NO: 899861 - protein, 9 aa, Homo Sapiens
ATWCWALAE

SEQ ID NO: 899862 - protein, 9 aa, Homo Sapiens
PVLASRAYT

SEQ ID NO: 899863 - protein, 9 aa, Homo Sapiens
GHAKDSQHY

SEQ ID NO: 899864 - protein, 9 aa, Homo Sapiens
SQHYKVDYE

SEQ ID NO: 899865 - protein, 9 aa, Homo Sapiens
GIDNKIKQA

SEQ ID NO: 899866 - protein, 9 aa, Homo Sapiens
FKQGHSIVI

SEQ ID NO: 899867 - protein, 9 aa, Homo Sapiens
PECGQPSCS

SEQ ID NO: 899868 - protein, 9 aa, Homo Sapiens
QQSFCYLMH

SEQ ID NO: 899869 - protein, 9 aa, Homo Sapiens
KIKKMEEEF

SEQ ID NO: 899870 - protein, 9 aa, Homo Sapiens
SWLVGCGTE

SEQ ID NO: 899871 - protein, 9 aa, Homo Sapiens
LANVPLIEV

SEQ ID NO: 899872 - protein, 9 aa, Homo Sapiens
QAMQAIPME

SEQ ID NO: 899873 - protein, 9 aa, Homo Sapiens
PVQMGMYPG

SEQ ID NO: 899874 - protein, 9 aa, Homo Sapiens
VSLGDAKRA

SEQ ID NO: 899875 - protein, 9 aa, Homo Sapiens
TASSEGNAK

SEQ ID NO: 899876 - protein, 9 aa, Homo Sapiens
ASSEGNAKC

SEQ ID NO: 899877 - protein, 9 aa, Homo Sapiens
CSLPSLVKR

SEQ ID NO: 899878 - protein, 9 aa, Homo Sapiens
NKDQAWVDA

SEQ ID NO: 899879 - protein, 9 aa, Homo Sapiens
NCSAGTKGD

SEQ ID NO: 899880 - protein, 9 aa, Homo Sapiens
NAKCRGHIV

SEQ ID NO: 899881 - protein, 9 aa, Homo Sapiens
LRGGSVAGR

SEQ ID NO: 899882 - protein, 9 aa, Homo Sapiens
FTFEFLMHV

SEQ ID NO: 899883 - protein, 9 aa, Homo Sapiens
SEEVRNICC

SEQ ID NO: 899884 - protein, 9 aa, Homo Sapiens
DVNFQDTND

SEQ ID NO: 899885 - protein, 9 aa, Homo Sapiens
LTPPAPEPH

SEQ ID NO: 899886 - protein, 9 aa, Homo Sapiens
STARAEAAG

SEQ ID NO: 899887 - protein, 9 aa, Homo Sapiens
SFINLTRLQ

SEQ ID NO: 899888 - protein, 9 aa, Homo Sapiens
APDQLGKKG

SEQ ID NO: 899889 - protein, 9 aa, Homo Sapiens
AIFRFSTTP

SEQ ID NO: 899890 - protein, 9 aa, Homo Sapiens
PPEPPEVPS

SEQ ID NO: 899891 - protein, 9 aa, Homo Sapiens
QSIVCTGRH

SEQ ID NO: 899892 - protein, 9 aa, Homo Sapiens
VLSTAATVR

SEQ ID NO: 899893 - protein, 9 aa, Homo Sapiens
RVSLGGAKE

SEQ ID NO: 899894 - protein, 9 aa, Homo Sapiens
FCGYPGIPA

SEQ ID NO: 899895 - protein, 9 aa, Homo Sapiens
YSCGRKGTL

SEQ ID NO: 899896 - protein, 9 aa, Homo Sapiens
FEASDPYQI

SEQ ID NO: 899897 - protein, 9 aa, Homo Sapiens
DEVHIIWSE

SEQ ID NO: 899898 - protein, 9 aa, Homo Sapiens
TITLTVAVA

SEQ ID NO: 899899 - protein, 9 aa, Homo Sapiens
SCLSPEYYD

SEQ ID NO: 899900 - protein, 9 aa, Homo Sapiens
FEQFQEVLE

SEQ ID NO: 899901 - protein, 9 aa, Homo Sapiens
WHHTNPVGT

SEQ ID NO: 899902 - protein, 9 aa, Homo Sapiens
NINECATLS

SEQ ID NO: 899903 - protein, 9 aa, Homo Sapiens
ETFSVRLCP

SEQ ID NO: 899904 - protein, 9 aa, Homo Sapiens
SAGTKGDNI

SEQ ID NO: 899905 - protein, 9 aa, Homo Sapiens
KDSQHYKVD

SEQ ID NO: 899906 - protein, 9 aa, Homo Sapiens
ENIDPNNCI

SEQ ID NO: 899907 - protein, 9 aa, Homo Sapiens
PYDTDQPQE

SEQ ID NO: 899908 - protein, 9 aa, Homo Sapiens
CLSPEYYDL

SEQ ID NO: 899909 - protein, 9 aa, Homo Sapiens
LEPHLRPLL

SEQ ID NO: 899910 - protein, 9 aa, Homo Sapiens
VAIDLSQEE

SEQ ID NO: 899911 - protein, 9 aa, Homo Sapiens
QSSTSNCLW

SEQ ID NO: 899912 - protein, 9 aa, Homo Sapiens
NADSGAIDV

SEQ ID NO: 899913 - protein, 9 aa, Homo Sapiens
GNDEVHIIW

SEQ ID NO: 899914 - protein, 9 aa, Homo Sapiens
VPVDENVFT

SEQ ID NO: 899915 - protein, 9 aa, Homo Sapiens
FLTWQDFGP

SEQ ID NO: 899916 - protein, 9 aa, Homo Sapiens
FRQPPPGGS

SEQ ID NO: 899917 - protein, 9 aa, Homo Sapiens
CGYPGIPAQ

SEQ ID NO: 899918 - protein, 9 aa, Homo Sapiens
DQMAKMMES

SEQ ID NO: 899919 - protein, 9 aa, Homo Sapiens
SESSSLDVH

SEQ ID NO: 899920 - protein, 9 aa, Homo Sapiens
KDGTHASPK

SEQ ID NO: 899921 - protein, 9 aa, Homo Sapiens
AEAAGVQPV

SEQ ID NO: 899922 - protein, 9 aa, Homo Sapiens
PPEVPSEVE

SEQ ID NO: 899923 - protein, 9 aa, Homo Sapiens
WREPAMERP

SEQ ID NO: 899924 - protein, 9 aa, Homo Sapiens
VVQYSTHLV

SEQ ID NO: 899925 - protein, 9 aa, Homo Sapiens
FEFLMHVIF

SEQ ID NO: 899926 - protein, 9 aa, Homo Sapiens
PTWFPFRTT

SEQ ID NO: 899927 - protein, 9 aa, Homo Sapiens
EDAHRARHR

SEQ ID NO: 899928 - protein, 9 aa, Homo Sapiens
SFCYLMHEF

SEQ ID NO: 899929 - protein, 9 aa, Homo Sapiens
NKIKQAMDL

SEQ ID NO: 899930 - protein, 9 aa, Homo Sapiens
FSVRLCPFL

SEQ ID NO: 899931 - protein, 9 aa, Homo Sapiens
GKQLERERR

SEQ ID NO: 899932 - protein, 9 aa, Homo Sapiens
LKRTSPEEL

SEQ ID NO: 899933 - protein, 9 aa, Homo Sapiens
GINCLLDHS

SEQ ID NO: 899934 - protein, 9 aa, Homo Sapiens
RVPVNFLIF

SEQ ID NO: 899935 - protein, 9 aa, Homo Sapiens
HNFRVPVNF

SEQ ID NO: 899936 - protein, 9 aa, Homo Sapiens
ESSSLDVHL

SEQ ID NO: 899937 - protein, 9 aa, Homo Sapiens
LDSHYVTLT

SEQ ID NO: 899938 - protein, 9 aa, Homo Sapiens
GFCKHAHNE

SEQ ID NO: 899939 - protein, 9 aa, Homo Sapiens
QKKCRALFG

SEQ ID NO: 899940 - protein, 9 aa, Homo Sapiens
GIGMVIGHK

SEQ ID NO: 899941 - protein, 9 aa, Homo Sapiens
NTQKKCRAL

SEQ ID NO: 899942 - protein, 9 aa, Homo Sapiens
PGFPHGYPY

SEQ ID NO: 899943 - protein, 9 aa, Homo Sapiens
EFLMHVIFC

SEQ ID NO: 899944 - protein, 9 aa, Homo Sapiens
SVTSWLVGC

SEQ ID NO: 899945 - protein, 9 aa, Homo Sapiens
PGQDRWREP

SEQ ID NO: 899946 - protein, 9 aa, Homo Sapiens
PPHVLDSHL

SEQ ID NO: 899947 - protein, 9 aa, Homo Sapiens
TNDESSGSG

SEQ ID NO: 899948 - protein, 9 aa, Homo Sapiens
SSGADPYIR

SEQ ID NO: 899949 - protein, 9 aa, Homo Sapiens
CTYPPALNK

SEQ ID NO: 899950 - protein, 9 aa, Homo Sapiens
GEATEGCIS

SEQ ID NO: 899951 - protein, 9 aa, Homo Sapiens
RFFRMLRIF

SEQ ID NO: 899952 - protein, 9 aa, Homo Sapiens
CLSTARAEA

SEQ ID NO: 899953 - protein, 9 aa, Homo Sapiens
DCVCIMFAS

SEQ ID NO: 899954 - protein, 9 aa, Homo Sapiens
LHKEAEIEY

SEQ ID NO: 899955 - protein, 9 aa, Homo Sapiens
AAETADGEP

SEQ ID NO: 899956 - protein, 9 aa, Homo Sapiens
PDQLGKKGK

SEQ ID NO: 899957 - protein, 9 aa, Homo Sapiens
SGAVVTAVL

SEQ ID NO: 899958 - protein, 9 aa, Homo Sapiens
LRGQSAGVT

SEQ ID NO: 899959 - protein, 9 aa, Homo Sapiens
VQPFWIVFL

SEQ ID NO: 899960 - protein, 9 aa, Homo Sapiens
IDLPVVAQT

SEQ ID NO: 899961 - protein, 9 aa, Homo Sapiens
QCAPPLPYD

SEQ ID NO: 899962 - protein, 9 aa, Homo Sapiens
MMESSLPSA

SEQ ID NO: 899963 - protein, 9 aa, Homo Sapiens
YSGGTKPKL

SEQ ID NO: 899964 - protein, 9 aa, Homo Sapiens
TGLANVPLI

SEQ ID NO: 899965 - protein, 9 aa, Homo Sapiens
CIMFASIPD

SEQ ID NO: 899966 - protein, 9 aa, Homo Sapiens
PRSWNNWYH

SEQ ID NO: 899967 - protein, 9 aa, Homo Sapiens
GRHQWHPDP

SEQ ID NO: 899968 - protein, 9 aa, Homo Sapiens
ELLPNVVVN

SEQ ID NO: 899969 - protein, 9 aa, Homo Sapiens
PGEKEIGEG

SEQ ID NO: 899970 - protein, 9 aa, Homo Sapiens
FLIFSLRGG

SEQ ID NO: 899971 - protein, 9 aa, Homo Sapiens
PYIRVYLLP

SEQ ID NO: 899972 - protein, 9 aa, Homo Sapiens
AGTKGDNIY

SEQ ID NO: 899973 - protein, 9 aa, Homo Sapiens
HVKKVTPRM

SEQ ID NO: 899974 - protein, 9 aa, Homo Sapiens
IYAGIVIVL

SEQ ID NO: 899975 - protein, 9 aa, Homo Sapiens
FCWWHHTNP

SEQ ID NO: 899976 - protein, 9 aa, Homo Sapiens
VAGGPTGLA

SEQ ID NO: 899977 - protein, 9 aa, Homo Sapiens
GDVATWCWA

SEQ ID NO: 899978 - protein, 9 aa, Homo Sapiens
VTCTYPPAL

SEQ ID NO: 899979 - protein, 9 aa, Homo Sapiens
VLLFLCLLP

SEQ ID NO: 899980 - protein, 9 aa, Homo Sapiens
LAREKKLHK

SEQ ID NO: 899981 - protein, 9 aa, Homo Sapiens
RHQWHPDPV

SEQ ID NO: 899982 - protein, 9 aa, Homo Sapiens
EPLPPEPPE

SEQ ID NO: 899983 - protein, 9 aa, Homo Sapiens
TLSHFQQSF

SEQ ID NO: 899984 - protein, 9 aa, Homo Sapiens
GKPQILTKS

SEQ ID NO: 899985 - protein, 9 aa, Homo Sapiens
MLCLSQDVK

SEQ ID NO: 899986 - protein, 9 aa, Homo Sapiens
PLKQPVDYC

SEQ ID NO: 899987 - protein, 9 aa, Homo Sapiens
DFAPLGTGG

SEQ ID NO: 899988 - protein, 9 aa, Homo Sapiens
VEYVFKCDM

SEQ ID NO: 899989 - protein, 9 aa, Homo Sapiens
QTREQEDLP

SEQ ID NO: 899990 - protein, 9 aa, Homo Sapiens
NIKLYHSWL

SEQ ID NO: 899991 - protein, 9 aa, Homo Sapiens
MALLRFFRM

SEQ ID NO: 899992 - protein, 9 aa, Homo Sapiens
LTAELAKHR

SEQ ID NO: 899993 - protein, 9 aa, Homo Sapiens
LMYRPHNFR

SEQ ID NO: 899994 - protein, 9 aa, Homo Sapiens
LGEATEGCI

SEQ ID NO: 899995 - protein, 9 aa, Homo Sapiens
METCDNINE

SEQ ID NO: 899996 - protein, 9 aa, Homo Sapiens
EIQLQEREQ

SEQ ID NO: 899997 - protein, 9 aa, Homo Sapiens
GKDGTHASP

SEQ ID NO: 899998 - protein, 9 aa, Homo Sapiens
REKRHREKL

SEQ ID NO: 899999 - protein, 9 aa, Homo Sapiens
GIEASPDNM

SEQ ID NO: 900000 - protein, 9 aa, Homo Sapiens
ATRPPHVLD

SEQ ID NO: 900001 - protein, 9 aa, Homo Sapiens
LLRFFRMLR

SEQ ID NO: 900002 - protein, 9 aa, Homo Sapiens
MLALFVTFA

SEQ ID NO: 900003 - protein, 9 aa, Homo Sapiens
TRPPHVLDS

SEQ ID NO: 900004 - protein, 9 aa, Homo Sapiens
PEVPSEVEL

SEQ ID NO: 900005 - protein, 9 aa, Homo Sapiens
EKLYVSPGT

SEQ ID NO: 900006 - protein, 9 aa, Homo Sapiens
VLRLLTVLG

SEQ ID NO: 900007 - protein, 9 aa, Homo Sapiens
LPTWFPFRT

SEQ ID NO: 900008 - protein, 9 aa, Homo Sapiens
EYVFKCDMS

SEQ ID NO: 900009 - protein, 9 aa, Homo Sapiens
WIVGGFDSP

SEQ ID NO: 900010 - protein, 9 aa, Homo Sapiens
IEASPDNML

SEQ ID NO: 900011 - protein, 9 aa, Homo Sapiens
VHIIWSEHT

SEQ ID NO: 900012 - protein, 9 aa, Homo Sapiens
MDEVLKQQQ

SEQ ID NO: 900013 - protein, 9 aa, Homo Sapiens
SITSRLSPS

SEQ ID NO: 900014 - protein, 9 aa, Homo Sapiens
KHAHNEVEK

SEQ ID NO: 900015 - protein, 9 aa, Homo Sapiens
RHNFYDPSS

SEQ ID NO: 900016 - protein, 9 aa, Homo Sapiens
QIARVEQAM

SEQ ID NO: 900017 - protein, 9 aa, Homo Sapiens
QSFCYLMHE

SEQ ID NO: 900018 - protein, 9 aa, Homo Sapiens
VKCDFRSEE

SEQ ID NO: 900019 - protein, 9 aa, Homo Sapiens
SLLVGLLVY

SEQ ID NO: 900020 - protein, 9 aa, Homo Sapiens
CVFCWWHHT

SEQ ID NO: 900021 - protein, 9 aa, Homo Sapiens
LRPLLQREL

SEQ ID NO: 900022 - protein, 9 aa, Homo Sapiens
TLEPHLRPL

SEQ ID NO: 900023 - protein, 9 aa, Homo Sapiens
QLPWFCLST

SEQ ID NO: 900024 - protein, 9 aa, Homo Sapiens
ANSSSKDYT

SEQ ID NO: 900025 - protein, 9 aa, Homo Sapiens
IVGGFDSPS

SEQ ID NO: 900026 - protein, 9 aa, Homo Sapiens
LTWQDFGPS

SEQ ID NO: 900027 - protein, 9 aa, Homo Sapiens
NEGQLLSPL

SEQ ID NO: 900028 - protein, 9 aa, Homo Sapiens
GCPRLSACL

SEQ ID NO: 900029 - protein, 9 aa, Homo Sapiens
PYYANCTWI

SEQ ID NO: 900030 - protein, 9 aa, Homo Sapiens
FRVPVNFLI

SEQ ID NO: 900031 - protein, 9 aa, Homo Sapiens
GFVSMRQGA

SEQ ID NO: 900032 - protein, 9 aa, Homo Sapiens
LPVQMGMYP

SEQ ID NO: 900033 - protein, 9 aa, Homo Sapiens
VNFQDTNDE

SEQ ID NO: 900034 - protein, 9 aa, Homo Sapiens
AKMYVQPFW

SEQ ID NO: 900035 - protein, 9 aa, Homo Sapiens
NDESSGSGS

SEQ ID NO: 900036 - protein, 9 aa, Homo Sapiens
SLDVHLTIQ

SEQ ID NO: 900037 - protein, 9 aa, Homo Sapiens
STSNCLWAE

SEQ ID NO: 900038 - protein, 9 aa, Homo Sapiens
GYPGIPAQG

SEQ ID NO: 900039 - protein, 9 aa, Homo Sapiens
CAPPLPYDT

SEQ ID NO: 900040 - protein, 9 aa, Homo Sapiens
EGREKRHRE

SEQ ID NO: 900041 - protein, 9 aa, Homo Sapiens
LLVLLYHQY

SEQ ID NO: 900042 - protein, 9 aa, Homo Sapiens
GPTGLANVP

SEQ ID NO: 900043 - protein, 9 aa, Homo Sapiens
GVPSISPFR

SEQ ID NO: 900044 - protein, 9 aa, Homo Sapiens
KVEYVFKCD

SEQ ID NO: 900045 - protein, 9 aa, Homo Sapiens
KGFCKHAHN

SEQ ID NO: 900046 - protein, 9 aa, Homo Sapiens
LLRVSLGGA

SEQ ID NO: 900047 - protein, 9 aa, Homo Sapiens
ATVICDGDK

SEQ ID NO: 900048 - protein, 9 aa, Homo Sapiens
AKETIKNSS

SEQ ID NO: 900049 - protein, 9 aa, Homo Sapiens
LPLDSHYVT

SEQ ID NO: 900050 - protein, 9 aa, Homo Sapiens
LRFFRMLRI

SEQ ID NO: 900051 - protein, 9 aa, Homo Sapiens
YNVCWDTGD

SEQ ID NO: 900052 - protein, 9 aa, Homo Sapiens
TTALTPPAP

SEQ ID NO: 900053 - protein, 9 aa, Homo Sapiens
MSEGPDVSV

SEQ ID NO: 900054 - protein, 9 aa, Homo Sapiens
ELCENIDPN

SEQ ID NO: 900055 - protein, 9 aa, Homo Sapiens
DHSDTDGNV

SEQ ID NO: 900056 - protein, 9 aa, Homo Sapiens
REKLYVSPG

SEQ ID NO: 900057 - protein, 9 aa, Homo Sapiens
PPRSGVKCD

SEQ ID NO: 900058 - protein, 9 aa, Homo Sapiens
FYQAHYGKQ

SEQ ID NO: 900059 - protein, 9 aa, Homo Sapiens
ALAREKKLH

SEQ ID NO: 900060 - protein, 9 aa, Homo Sapiens
AKSVTCTYP

SEQ ID NO: 900061 - protein, 9 aa, Homo Sapiens
TFTASSEGN

SEQ ID NO: 900062 - protein, 9 aa, Homo Sapiens
QPVDYCDNT

SEQ ID NO: 900063 - protein, 9 aa, Homo Sapiens
LPVRYLQDF

SEQ ID NO: 900064 - protein, 9 aa, Homo Sapiens
GQTDRQGQN

SEQ ID NO: 900065 - protein, 9 aa, Homo Sapiens
QSAGVTPGW

SEQ ID NO: 900066 - protein, 9 aa, Homo Sapiens
SSESSSLDV

SEQ ID NO: 900067 - protein, 9 aa, Homo Sapiens
RLCPFLQVP

SEQ ID NO: 900068 - protein, 9 aa, Homo Sapiens
LDSHLRFDR

SEQ ID NO: 900069 - protein, 9 aa, Homo Sapiens
VPQQATVIC

SEQ ID NO: 900070 - protein, 9 aa, Homo Sapiens
IYYLTFGDK

SEQ ID NO: 900071 - protein, 9 aa, Homo Sapiens
EKYDMSGAH

SEQ ID NO: 900072 - protein, 9 aa, Homo Sapiens
AGVTPGWVQ

SEQ ID NO: 900073 - protein, 9 aa, Homo Sapiens
SPELLPNVV

SEQ ID NO: 900074 - protein, 9 aa, Homo Sapiens
VEVAGGPTG

SEQ ID NO: 900075 - protein, 9 aa, Homo Sapiens
RYRRNLKRT

SEQ ID NO: 900076 - protein, 9 aa, Homo Sapiens
LMHVIFCPN

SEQ ID NO: 900077 - protein, 9 aa, Homo Sapiens
ALLRFFRML

SEQ ID NO: 900078 - protein, 9 aa, Homo Sapiens
TLYAFKTCK

SEQ ID NO: 900079 - protein, 9 aa, Homo Sapiens
IDLSQEEWQ

SEQ ID NO: 900080 - protein, 9 aa, Homo Sapiens
ARRAALPLV

SEQ ID NO: 900081 - protein, 9 aa, Homo Sapiens
GFQGRPVQV

SEQ ID NO: 900082 - protein, 9 aa, Homo Sapiens
DAVPVDENV

SEQ ID NO: 900083 - protein, 9 aa, Homo Sapiens
NCLLDHSDT

SEQ ID NO: 900084 - protein, 9 aa, Homo Sapiens
INCLLDHSD

SEQ ID NO: 900085 - protein, 9 aa, Homo Sapiens
KPKLSTALA

SEQ ID NO: 900086 - protein, 9 aa, Homo Sapiens
LPWFCLSTA

SEQ ID NO: 900087 - protein, 9 aa, Homo Sapiens
ALGAPAEAR

SEQ ID NO: 900088 - protein, 9 aa, Homo Sapiens
TCTYPPALN

SEQ ID NO: 900089 - protein, 9 aa, Homo Sapiens
VTPGWVQHR

SEQ ID NO: 900090 - protein, 9 aa, Homo Sapiens
YDPEKDNKD

SEQ ID NO: 900091 - protein, 9 aa, Homo Sapiens
KFWSLGGKP

SEQ ID NO: 900092 - protein, 9 aa, Homo Sapiens
QGHSIVISS

SEQ ID NO: 900093 - protein, 9 aa, Homo Sapiens
ALYSSMKDT

SEQ ID NO: 900094 - protein, 9 aa, Homo Sapiens
TGRHQWHPD

SEQ ID NO: 900095 - protein, 9 aa, Homo Sapiens
SPRSWDNWY

SEQ ID NO: 900096 - protein, 9 aa, Homo Sapiens
LPKFCGYPG

SEQ ID NO: 900097 - protein, 9 aa, Homo Sapiens
NIISGNQKG

SEQ ID NO: 900098 - protein, 9 aa, Homo Sapiens
SAYGRARSE

SEQ ID NO: 900099 - protein, 9 aa, Homo Sapiens
RGVEVAGGP

SEQ ID NO: 900100 - protein, 9 aa, Homo Sapiens
WAVSTLSFL

SEQ ID NO: 900101 - protein, 9 aa, Homo Sapiens
YQIHVCNLC

SEQ ID NO: 900102 - protein, 9 aa, Homo Sapiens
IKKMEEEFL

SEQ ID NO: 900103 - protein, 9 aa, Homo Sapiens
LRVSLGGAK

SEQ ID NO: 900104 - protein, 9 aa, Homo Sapiens
QDFAPLGTG

SEQ ID NO: 900105 - protein, 9 aa, Homo Sapiens
STAPDQLGK

SEQ ID NO: 900106 - protein, 9 aa, Homo Sapiens
AHNEVEKNP

SEQ ID NO: 900107 - protein, 9 aa, Homo Sapiens
SKFWSLGGK

SEQ ID NO: 900108 - protein, 9 aa, Homo Sapiens
DSQHYKVDY

SEQ ID NO: 900109 - protein, 9 aa, Homo Sapiens
ILTGCPRLS

SEQ ID NO: 900110 - protein, 9 aa, Homo Sapiens
ITFEQFQEV

SEQ ID NO: 900111 - protein, 9 aa, Homo Sapiens
LLWPEWMGV

SEQ ID NO: 900112 - protein, 9 aa, Homo Sapiens
LDSSSTAPD

SEQ ID NO: 900113 - protein, 9 aa, Homo Sapiens
DTGDTEKMS

SEQ ID NO: 900114 - protein, 9 aa, Homo Sapiens
EGELRGYAI

SEQ ID NO: 900115 - protein, 9 aa, Homo Sapiens
ISSLKIFYK

SEQ ID NO: 900116 - protein, 9 aa, Homo Sapiens
TGTMRPVRH

SEQ ID NO: 900117 - protein, 9 aa, Homo Sapiens
TVICDGDKF

SEQ ID NO: 900118 - protein, 9 aa, Homo Sapiens
MYWMTIQYD

SEQ ID NO: 900119 - protein, 9 aa, Homo Sapiens
LQDFAPLGT

SEQ ID NO: 900120 - protein, 9 aa, Homo Sapiens
LCENIDPNN

SEQ ID NO: 900121 - protein, 9 aa, Homo Sapiens
CWWHHTNPV

SEQ ID NO: 900122 - protein, 9 aa, Homo Sapiens
ETADGEPGA

SEQ ID NO: 900123 - protein, 9 aa, Homo Sapiens
TQALVSVAY

SEQ ID NO: 900124 - protein, 9 aa, Homo Sapiens
KKVTPRMIG

SEQ ID NO: 900125 - protein, 9 aa, Homo Sapiens
FSQRVTEIN

SEQ ID NO: 900126 - protein, 9 aa, Homo Sapiens
YNIISGNQK

SEQ ID NO: 900127 - protein, 9 aa, Homo Sapiens
RPPHVLDSH

SEQ ID NO: 900128 - protein, 9 aa, Homo Sapiens
QAILPTWFP

SEQ ID NO: 900129 - protein, 9 aa, Homo Sapiens
TADGEPGAD

SEQ ID NO: 900130 - protein, 9 aa, Homo Sapiens
YKCYVCSNS

SEQ ID NO: 900131 - protein, 9 aa, Homo Sapiens
LQASTGENE

SEQ ID NO: 900132 - protein, 9 aa, Homo Sapiens
ARVEQAMQA

SEQ ID NO: 900133 - protein, 9 aa, Homo Sapiens
QPSCSLPSL

SEQ ID NO: 900134 - protein, 9 aa, Homo Sapiens
TKPKLSTAL

SEQ ID NO: 900135 - protein, 9 aa, Homo Sapiens
YTGQRVICC

SEQ ID NO: 900136 - protein, 9 aa, Homo Sapiens
REPAMERPL

SEQ ID NO: 900137 - protein, 9 aa, Homo Sapiens
PHRYREGWT

SEQ ID NO: 900138 - protein, 9 aa, Homo Sapiens
VLVTLQLLP

SEQ ID NO: 900139 - protein, 9 aa, Homo Sapiens
DPEKDNKDQ

SEQ ID NO: 900140 - protein, 9 aa, Homo Sapiens
IDNKIKQAM

SEQ ID NO: 900141 - protein, 9 aa, Homo Sapiens
HYGVAYCLA

SEQ ID NO: 900142 - protein, 9 aa, Homo Sapiens
EASISPVGT

SEQ ID NO: 900143 - protein, 9 aa, Homo Sapiens
TLGAVLSTA

SEQ ID NO: 900144 - protein, 9 aa, Homo Sapiens
VTEINSPRS

SEQ ID NO: 900145 - protein, 9 aa, Homo Sapiens
PGIEASPDN

SEQ ID NO: 900146 - protein, 9 aa, Homo Sapiens
VTPRMIGLT

SEQ ID NO: 900147 - protein, 9 aa, Homo Sapiens
PEPQPVENI

SEQ ID NO: 900148 - protein, 9 aa, Homo Sapiens
CLSQDVKGY

SEQ ID NO: 900149 - protein, 9 aa, Homo Sapiens
EDVLRNNRR

SEQ ID NO: 900150 - protein, 9 aa, Homo Sapiens
FKDVAIDLS

SEQ ID NO: 900151 - protein, 9 aa, Homo Sapiens
TAPAPGQAL

SEQ ID NO: 900152 - protein, 9 aa, Homo Sapiens
HNEWEVVQY

SEQ ID NO: 900153 - protein, 9 aa, Homo Sapiens
RMLALFVTF

SEQ ID NO: 900154 - protein, 9 aa, Homo Sapiens
WFCLSTARA

SEQ ID NO: 900155 - protein, 9 aa, Homo Sapiens
TIDLGALYS

SEQ ID NO: 900156 - protein, 9 aa, Homo Sapiens
PYKCYVCSN

SEQ ID NO: 900157 - protein, 9 aa, Homo Sapiens
MTKLYILNP

SEQ ID NO: 900158 - protein, 9 aa, Homo Sapiens
VATWCWALA

SEQ ID NO: 900159 - protein, 9 aa, Homo Sapiens
KMYVQPFWI

SEQ ID NO: 900160 - protein, 9 aa, Homo Sapiens
AYTAPAPGQ

SEQ ID NO: 900161 - protein, 9 aa, Homo Sapiens
KDQAWVDAQ

SEQ ID NO: 900162 - protein, 9 aa, Homo Sapiens
EIGEGPAKS

SEQ ID NO: 900163 - protein, 9 aa, Homo Sapiens
LCSFFFFET

SEQ ID NO: 900164 - protein, 9 aa, Homo Sapiens
HDHAIFLTW

SEQ ID NO: 900165 - protein, 9 aa, Homo Sapiens
EQSFLSSRE

SEQ ID NO: 900166 - protein, 9 aa, Homo Sapiens
MSTVFSSAL

SEQ ID NO: 900167 - protein, 9 aa, Homo Sapiens
LTLGAVLST

SEQ ID NO: 900168 - protein, 9 aa, Homo Sapiens
QSITSRLSP

SEQ ID NO: 900169 - protein, 9 aa, Homo Sapiens
EVLKQQQEL

SEQ ID NO: 900170 - protein, 9 aa, Homo Sapiens
ASKFWSLGG

SEQ ID NO: 900171 - protein, 9 aa, Homo Sapiens
REKKLHKEA

SEQ ID NO: 900172 - protein, 9 aa, Homo Sapiens
HLRPLLQRE

SEQ ID NO: 900173 - protein, 9 aa, Homo Sapiens
PHVKKVTPR

SEQ ID NO: 900174 - protein, 9 aa, Homo Sapiens
SSEGNAKCR

SEQ ID NO: 900175 - protein, 9 aa, Homo Sapiens
ELEMQQKCG

SEQ ID NO: 900176 - protein, 9 aa, Homo Sapiens
FSLRGGSVA

SEQ ID NO: 900177 - protein, 9 aa, Homo Sapiens
RHRLVREPV

SEQ ID NO: 900178 - protein, 9 aa, Homo Sapiens
RVEQAMQAI

SEQ ID NO: 900179 - protein, 9 aa, Homo Sapiens
PMETCDNIN

SEQ ID NO: 900180 - protein, 9 aa, Homo Sapiens
NQKGHFYLE

SEQ ID NO: 900181 - protein, 9 aa, Homo Sapiens
LSATITLTV

SEQ ID NO: 900182 - protein, 9 aa, Homo Sapiens
ELGAPLHDK

SEQ ID NO: 900183 - protein, 9 aa, Homo Sapiens
SIVCTGRHQ

SEQ ID NO: 900184 - protein, 9 aa, Homo Sapiens
GQDRWREPA

SEQ ID NO: 900185 - protein, 9 aa, Homo Sapiens
MVIGHKITH

SEQ ID NO: 900186 - protein, 9 aa, Homo Sapiens
QMGMYPGVL

SEQ ID NO: 900187 - protein, 9 aa, Homo Sapiens
DSSSTAPDQ

SEQ ID NO: 900188 - protein, 9 aa, Homo Sapiens
GRGVEVAGG

SEQ ID NO: 900189 - protein, 9 aa, Homo Sapiens
DLSQEEWQW

SEQ ID NO: 900190 - protein, 9 aa, Homo Sapiens
NGKVGMDYR

SEQ ID NO: 900191 - protein, 9 aa, Homo Sapiens
PSIGFVSMR

SEQ ID NO: 900192 - protein, 9 aa, Homo Sapiens
GREKRHREK

SEQ ID NO: 900193 - protein, 9 aa, Homo Sapiens
AETADGEPG

SEQ ID NO: 900194 - protein, 9 aa, Homo Sapiens
IEVGHLRGQ

SEQ ID NO: 900195 - protein, 9 aa, Homo Sapiens
PVRHNFYDP

SEQ ID NO: 900196 - protein, 9 aa, Homo Sapiens
VRHNFYDPS

SEQ ID NO: 900197 - protein, 9 aa, Homo Sapiens
TSRLSPSLR

SEQ ID NO: 900198 - protein, 9 aa, Homo Sapiens
DNWYPRSWN

SEQ ID NO: 900199 - protein, 9 aa, Homo Sapiens
RSWDNWYPR

SEQ ID NO: 900200 - protein, 9 aa, Homo Sapiens
LDHSDTDGN

SEQ ID NO: 900201 - protein, 9 aa, Homo Sapiens
LVLRLLTVL

SEQ ID NO: 900202 - protein, 9 aa, Homo Sapiens
RWREPAMER

SEQ ID NO: 900203 - protein, 9 aa, Homo Sapiens
ISGNQKGHF

SEQ ID NO: 900204 - protein, 9 aa, Homo Sapiens
STTPALYLL

SEQ ID NO: 900205 - protein, 9 aa, Homo Sapiens
ASTGENETF

SEQ ID NO: 900206 - protein, 9 aa, Homo Sapiens
RYLGSLQPL

SEQ ID NO: 900207 - protein, 9 aa, Homo Sapiens
VEMPDCGFQ

SEQ ID NO: 900208 - protein, 9 aa, Homo Sapiens
QIHVCNLCG

SEQ ID NO: 900209 - protein, 9 aa, Homo Sapiens
VAQLACDDI

SEQ ID NO: 900210 - protein, 9 aa, Homo Sapiens
RGGSVAGRG

SEQ ID NO: 900211 - protein, 9 aa, Homo Sapiens
SLRLANEGQ

SEQ ID NO: 900212 - protein, 9 aa, Homo Sapiens
HYKVDYESQ

SEQ ID NO: 900213 - protein, 9 aa, Homo Sapiens
GCISAIESL

SEQ ID NO: 900214 - protein, 9 aa, Homo Sapiens
EVAGGPTGL

SEQ ID NO: 900215 - protein, 9 aa, Homo Sapiens
PFRQPPPGG

SEQ ID NO: 900216 - protein, 9 aa, Homo Sapiens
AVHYGVAYC

SEQ ID NO: 900217 - protein, 9 aa, Homo Sapiens
LQICAVGRL

SEQ ID NO: 900218 - protein, 9 aa, Homo Sapiens
LMTKLYILN

SEQ ID NO: 900219 - protein, 9 aa, Homo Sapiens
SWNNWYHTC

SEQ ID NO: 900220 - protein, 9 aa, Homo Sapiens
YTAPAPGQA

SEQ ID NO: 900221 - protein, 9 aa, Homo Sapiens
ETNDANTQK

SEQ ID NO: 900222 - protein, 9 aa, Homo Sapiens
FLSSREEAD

SEQ ID NO: 900223 - protein, 9 aa, Homo Sapiens
IYNIISGNQ

SEQ ID NO: 900224 - protein, 9 aa, Homo Sapiens
VLRNNRRPK

SEQ ID NO: 900225 - protein, 9 aa, Homo Sapiens
CKHAHNEVE

SEQ ID NO: 900226 - protein, 9 aa, Homo Sapiens
NVFTGEDLD

SEQ ID NO: 900227 - protein, 9 aa, Homo Sapiens
QLRAQEEFR

SEQ ID NO: 900228 - protein, 9 aa, Homo Sapiens
KKKMKLMMS

SEQ ID NO: 900229 - protein, 9 aa, Homo Sapiens
TCDNINECA

SEQ ID NO: 900230 - protein, 9 aa, Homo Sapiens
VTLQLLPIL

SEQ ID NO: 900231 - protein, 9 aa, Homo Sapiens
QSCKDLEDV

SEQ ID NO: 900232 - protein, 9 aa, Homo Sapiens
HAIFLTWQD

SEQ ID NO: 900233 - protein, 9 aa, Homo Sapiens
NVPLIEVGH

SEQ ID NO: 900234 - protein, 9 aa, Homo Sapiens
REGWTELRR

SEQ ID NO: 900235 - protein, 9 aa, Homo Sapiens
GNPGLVFSC

SEQ ID NO: 900236 - protein, 9 aa, Homo Sapiens
DANTQKKCR

SEQ ID NO: 900237 - protein, 9 aa, Homo Sapiens
CDNINECAT

SEQ ID NO: 900238 - protein, 9 aa, Homo Sapiens
CSAGTKGDN

SEQ ID NO: 900239 - protein, 9 aa, Homo Sapiens
QLHSQEEAC

SEQ ID NO: 900240 - protein, 9 aa, Homo Sapiens
LRAQEEFRQ

SEQ ID NO: 900241 - protein, 9 aa, Homo Sapiens
SSSLDVHLT

SEQ ID NO: 900242 - protein, 9 aa, Homo Sapiens
HMSIPNRIP

SEQ ID NO: 900243 - protein, 9 aa, Homo Sapiens
VLNGKVGMD

SEQ ID NO: 900244 - protein, 9 aa, Homo Sapiens
TPGWVQHRG

SEQ ID NO: 900245 - protein, 9 aa, Homo Sapiens
IQGTAEALN

SEQ ID NO: 900246 - protein, 9 aa, Homo Sapiens
TLNGILKGY

SEQ ID NO: 900247 - protein, 9 aa, Homo Sapiens
EKKLHKEAE

SEQ ID NO: 900248 - protein, 9 aa, Homo Sapiens
QALKAREER

SEQ ID NO: 900249 - protein, 9 aa, Homo Sapiens
QLLSPLQDV

SEQ ID NO: 900250 - protein, 9 aa, Homo Sapiens
GSVAGRGVE

SEQ ID NO: 900251 - protein, 9 aa, Homo Sapiens
PEKVEYVFK

SEQ ID NO: 900252 - protein, 9 aa, Homo Sapiens
AQTREQEDL

SEQ ID NO: 900253 - protein, 9 aa, Homo Sapiens
CSFFFFETE

SEQ ID NO: 900254 - protein, 9 aa, Homo Sapiens
ELRGYAIQR

SEQ ID NO: 900255 - protein, 9 aa, Homo Sapiens
HGYPYYANC

SEQ ID NO: 900256 - protein, 9 aa, Homo Sapiens
MMSEGPDVS

SEQ ID NO: 900257 - protein, 9 aa, Homo Sapiens
GSFINLTRL

SEQ ID NO: 900258 - protein, 9 aa, Homo Sapiens
PPALNKMFC

SEQ ID NO: 900259 - protein, 9 aa, Homo Sapiens
IQLQEREQA

SEQ ID NO: 900260 - protein, 9 aa, Homo Sapiens
LTGCPRLSA

SEQ ID NO: 900261 - protein, 9 aa, Homo Sapiens
DQLGKKGKE

SEQ ID NO: 900262 - protein, 9 aa, Homo Sapiens
FKTCKCPEN

SEQ ID NO: 900263 - protein, 9 aa, Homo Sapiens
HNEVEKNPK

SEQ ID NO: 900264 - protein, 9 aa, Homo Sapiens
LRLLTVLGV

SEQ ID NO: 900265 - protein, 9 aa, Homo Sapiens
IFSLRGGSV

SEQ ID NO: 900266 - protein, 9 aa, Homo Sapiens
LMMSEGPDV

SEQ ID NO: 900267 - protein, 9 aa, Homo Sapiens
FTTQALVSV

SEQ ID NO: 900268 - protein, 9 aa, Homo Sapiens
EGNAKCRGH

SEQ ID NO: 900269 - protein, 9 aa, Homo Sapiens
TWCWALAEY

SEQ ID NO: 900270 - protein, 9 aa, Homo Sapiens
TQKKCRALF

SEQ ID NO: 900271 - protein, 9 aa, Homo Sapiens
IGEGPAKSA

SEQ ID NO: 900272 - protein, 9 aa, Homo Sapiens
GEILRNADS

SEQ ID NO: 900273 - protein, 9 aa, Homo Sapiens
DDITVNIWY

SEQ ID NO: 900274 - protein, 9 aa, Homo Sapiens
VPLIEVGHL

SEQ ID NO: 900275 - protein, 9 aa, Homo Sapiens
QPDTELEMQ

SEQ ID NO: 900276 - protein, 9 aa, Homo Sapiens
PPNCSAGTK

SEQ ID NO: 900277 - protein, 9 aa, Homo Sapiens
SSKDYTLHL

SEQ ID NO: 900278 - protein, 9 aa, Homo Sapiens
KETIKNSSR

SEQ ID NO: 900279 - protein, 9 aa, Homo Sapiens
KIHMSIPNR

SEQ ID NO: 900280 - protein, 9 aa, Homo Sapiens
VLGVGDANR

SEQ ID NO: 900281 - protein, 9 aa, Homo Sapiens
RSSKLLWPE

SEQ ID NO: 900282 - protein, 9 aa, Homo Sapiens
KGHAKDSQH

SEQ ID NO: 900283 - protein, 9 aa, Homo Sapiens
YCLAPDPDR

SEQ ID NO: 900284 - protein, 9 aa, Homo Sapiens
FLLLEDQNS

SEQ ID NO: 900285 - protein, 9 aa, Homo Sapiens
QCLPKFCGY

SEQ ID NO: 900286 - protein, 9 aa, Homo Sapiens
ALPLVRRRL

SEQ ID NO: 900287 - protein, 9 aa, Homo Sapiens
YVFKCDMSA

SEQ ID NO: 900288 - protein, 9 aa, Homo Sapiens
VQMGMYPGV

SEQ ID NO: 900289 - protein, 9 aa, Homo Sapiens
SSREEADTL

SEQ ID NO: 900290 - protein, 9 aa, Homo Sapiens
DSGAIDVKF

SEQ ID NO: 900291 - protein, 9 aa, Homo Sapiens
QRVICCQAN

SEQ ID NO: 900292 - protein, 9 aa, Homo Sapiens
LIEVGHLRG

SEQ ID NO: 900293 - protein, 9 aa, Homo Sapiens
RSELGAPLH

SEQ ID NO: 900294 - protein, 9 aa, Homo Sapiens
TSSGADPYI

SEQ ID NO: 900295 - protein, 9 aa, Homo Sapiens
VLASRAYTA

SEQ ID NO: 900296 - protein, 9 aa, Homo Sapiens
PEPPEVPSE

SEQ ID NO: 900297 - protein, 9 aa, Homo Sapiens
KFQKRKMLC

SEQ ID NO: 900298 - protein, 9 aa, Homo Sapiens
EGWTELRRD

SEQ ID NO: 900299 - protein, 9 aa, Homo Sapiens
PHVLDSHLR

SEQ ID NO: 900300 - protein, 9 aa, Homo Sapiens
ALFVTFAIN

SEQ ID NO: 900301 - protein, 9 aa, Homo Sapiens
LGNDEVHII

SEQ ID NO: 900302 - protein, 9 aa, Homo Sapiens
TFAINFILL

SEQ ID NO: 900303 - protein, 9 aa, Homo Sapiens
SCSLPSLVK

SEQ ID NO: 900304 - protein, 9 aa, Homo Sapiens
PVVAQTREQ

SEQ ID NO: 900305 - protein, 9 aa, Homo Sapiens
VFCWWHHTN

SEQ ID NO: 900306 - protein, 9 aa, Homo Sapiens
RPWQLHSQE

SEQ ID NO: 900307 - protein, 9 aa, Homo Sapiens
LDVMVAVGE

SEQ ID NO: 900308 - protein, 9 aa, Homo Sapiens
RPHVKKVTP

SEQ ID NO: 900309 - protein, 9 aa, Homo Sapiens
RQLTAELAK

SEQ ID NO: 900310 - protein, 9 aa, Homo Sapiens
CLQICAVGR

SEQ ID NO: 900311 - protein, 9 aa, Homo Sapiens
SVLLLVLLY

SEQ ID NO: 900312 - protein, 9 aa, Homo Sapiens
TTGLKIHMS

SEQ ID NO: 900313 - protein, 9 aa, Homo Sapiens
LIIAAKETI

SEQ ID NO: 900314 - protein, 9 aa, Homo Sapiens
AIFLTWQDF

SEQ ID NO: 900315 - protein, 9 aa, Homo Sapiens
LEDVLRNNR

SEQ ID NO: 900316 - protein, 9 aa, Homo Sapiens
VSSESSSLD

SEQ ID NO: 900317 - protein, 9 aa, Homo Sapiens
AKMMESSLP

SEQ ID NO: 900318 - protein, 9 aa, Homo Sapiens
CTLYAFKTC

SEQ ID NO: 900319 - protein, 9 aa, Homo Sapiens
TAATVREAQ

SEQ ID NO: 900320 - protein, 9 aa, Homo Sapiens
RSTLNGILK

SEQ ID NO: 900321 - protein, 9 aa, Homo Sapiens
TIEIEFCVW

SEQ ID NO: 900322 - protein, 9 aa, Homo Sapiens
EQALKAREE

SEQ ID NO: 900323 - protein, 9 aa, Homo Sapiens
LEEGSFINL

SEQ ID NO: 900324 - protein, 9 aa, Homo Sapiens
NCAFSQRVT

SEQ ID NO: 900325 - protein, 9 aa, Homo Sapiens
GLVFSCLSP

SEQ ID NO: 900326 - protein, 9 aa, Homo Sapiens
PYQIHVCNL

SEQ ID NO: 900327 - protein, 9 aa, Homo Sapiens
KTELCENID

SEQ ID NO: 900328 - protein, 9 aa, Homo Sapiens
NNSRLMDEV

SEQ ID NO: 900329 - protein, 9 aa, Homo Sapiens
QLDLVSLNH

SEQ ID NO: 900330 - protein, 9 aa, Homo Sapiens
KTAGLFWQF

SEQ ID NO: 900331 - protein, 9 aa, Homo Sapiens
ATYSGGTKP

SEQ ID NO: 900332 - protein, 9 aa, Homo Sapiens
LPFPSVSVS

SEQ ID NO: 900333 - protein, 9 aa, Homo Sapiens
IIAAKETIK

SEQ ID NO: 900334 - protein, 9 aa, Homo Sapiens
GTQSSTSNC

SEQ ID NO: 900335 - protein, 9 aa, Homo Sapiens
EMQQKCGFS

SEQ ID NO: 900336 - protein, 9 aa, Homo Sapiens
HAKDSQHYK

SEQ ID NO: 900337 - protein, 9 aa, Homo Sapiens
DRWREPAME

SEQ ID NO: 900338 - protein, 9 aa, Homo Sapiens
NMLQGRLFA

SEQ ID NO: 900339 - protein, 9 aa, Homo Sapiens
EATEGCISA

SEQ ID NO: 900340 - protein, 9 aa, Homo Sapiens
MLFLWAVST

SEQ ID NO: 900341 - protein, 9 aa, Homo Sapiens
LQEREQALK

SEQ ID NO: 900342 - protein, 9 aa, Homo Sapiens
QHYKVDYES

SEQ ID NO: 900343 - protein, 9 aa, Homo Sapiens
EKVEYVFKC

SEQ ID NO: 900344 - protein, 9 aa, Homo Sapiens
TAELAKHRC

SEQ ID NO: 900345 - protein, 9 aa, Homo Sapiens
VCNPSPELL

SEQ ID NO: 900346 - protein, 9 aa, Homo Sapiens
IFRFSTTPA

SEQ ID NO: 900347 - protein, 9 aa, Homo Sapiens
SLLTCSIIY

SEQ ID NO: 900348 - protein, 9 aa, Homo Sapiens
MGDVATWCW

SEQ ID NO: 900349 - protein, 9 aa, Homo Sapiens
WALAEYARA

SEQ ID NO: 900350 - protein, 9 aa, Homo Sapiens
SVSSESSSL

SEQ ID NO: 900351 - protein, 9 aa, Homo Sapiens
NSSSKDYTL

SEQ ID NO: 900352 - protein, 9 aa, Homo Sapiens
HQQEEEKAE

SEQ ID NO: 900353 - protein, 9 aa, Homo Sapiens
LVLLYHQYC

SEQ ID NO: 900354 - protein, 9 aa, Homo Sapiens
HQSYDCVCI

SEQ ID NO: 900355 - protein, 9 aa, Homo Sapiens
STTCLEASI

SEQ ID NO: 900356 - protein, 9 aa, Homo Sapiens
AKTELCENI

SEQ ID NO: 900357 - protein, 9 aa, Homo Sapiens
YCSNCAFSQ

SEQ ID NO: 900358 - protein, 9 aa, Homo Sapiens
MRPVRHNFY

SEQ ID NO: 900359 - protein, 9 aa, Homo Sapiens
MESSLPSAS

SEQ ID NO: 900360 - protein, 9 aa, Homo Sapiens
TGENETFVM

SEQ ID NO: 900361 - protein, 9 aa, Homo Sapiens
GYPYYANCT

SEQ ID NO: 900362 - protein, 9 aa, Homo Sapiens
LSVLLLVLL

SEQ ID NO: 900363 - protein, 9 aa, Homo Sapiens
PFWIVFLLV

SEQ ID NO: 900364 - protein, 9 aa, Homo Sapiens
AVKGYWLTN

SEQ ID NO: 900365 - protein, 9 aa, Homo Sapiens
EPHLRPLLQ

SEQ ID NO: 900366 - protein, 9 aa, Homo Sapiens
RGKDGTHAS

SEQ ID NO: 900367 - protein, 9 aa, Homo Sapiens
QEEACIMGA

SEQ ID NO: 900368 - protein, 9 aa, Homo Sapiens
LHQQEEEKA

SEQ ID NO: 900369 - protein, 9 aa, Homo Sapiens
RVTEINSPR

SEQ ID NO: 900370 - protein, 9 aa, Homo Sapiens
LEMQQKCGF

SEQ ID NO: 900371 - protein, 9 aa, Homo Sapiens
ICCQANGKW

SEQ ID NO: 900372 - protein, 9 aa, Homo Sapiens
EFLLLEDQN

SEQ ID NO: 900373 - protein, 9 aa, Homo Sapiens
MKLMMSEGP

SEQ ID NO: 900374 - protein, 9 aa, Homo Sapiens
MGMNLFAGK

SEQ ID NO: 900375 - protein, 9 aa, Homo Sapiens
VSVAYQVGN

SEQ ID NO: 900376 - protein, 9 aa, Homo Sapiens
SISPVGTVT

SEQ ID NO: 900377 - protein, 9 aa, Homo Sapiens
SATITLTVA

SEQ ID NO: 900378 - protein, 9 aa, Homo Sapiens
QQPDTELEM

SEQ ID NO: 900379 - protein, 9 aa, Homo Sapiens
IMGMNLFAG

SEQ ID NO: 900380 - protein, 9 aa, Homo Sapiens
EVRNICCLT

SEQ ID NO: 900381 - protein, 9 aa, Homo Sapiens
GRARSELGA

SEQ ID NO: 900382 - protein, 9 aa, Homo Sapiens
YGRARSELG

SEQ ID NO: 900383 - protein, 9 aa, Homo Sapiens
CWALAEYAR

SEQ ID NO: 900384 - protein, 9 aa, Homo Sapiens
LLPFPSVSV

SEQ ID NO: 900385 - protein, 9 aa, Homo Sapiens
VHYAYAIVP

SEQ ID NO: 900386 - protein, 9 aa, Homo Sapiens
FGIDYLSET

SEQ ID NO: 900387 - protein, 9 aa, Homo Sapiens
QATLHITVT

SEQ ID NO: 900388 - protein, 9 aa, Homo Sapiens
HTEDAWQPN

SEQ ID NO: 900389 - protein, 9 aa, Homo Sapiens
SSDDDLSHD

SEQ ID NO: 900390 - protein, 9 aa, Homo Sapiens
CYIDDFAKE

SEQ ID NO: 900391 - protein, 9 aa, Homo Sapiens
LKWCLYELD

SEQ ID NO: 900392 - protein, 9 aa, Homo Sapiens
PDLIALNLK

SEQ ID NO: 900393 - protein, 9 aa, Homo Sapiens
DLIALNLKA

SEQ ID NO: 900394 - protein, 9 aa, Homo Sapiens
VNKARGAIP

SEQ ID NO: 900395 - protein, 9 aa, Homo Sapiens
IPPPPLVQS

SEQ ID NO: 900396 - protein, 9 aa, Homo Sapiens
TPIDSLDTL

SEQ ID NO: 900397 - protein, 9 aa, Homo Sapiens
LPSKRVSVS

SEQ ID NO: 900398 - protein, 9 aa, Homo Sapiens
EKALIRSTH

SEQ ID NO: 900399 - protein, 9 aa, Homo Sapiens
SACKDSKKV

SEQ ID NO: 900400 - protein, 9 aa, Homo Sapiens
LSETSSSES

SEQ ID NO: 900401 - protein, 9 aa, Homo Sapiens
SQQENGHFM

SEQ ID NO: 900402 - protein, 9 aa, Homo Sapiens
LQPNYQTII

SEQ ID NO: 900403 - protein, 9 aa, Homo Sapiens
QHVSGEEIV

SEQ ID NO: 900404 - protein, 9 aa, Homo Sapiens
LGPSPIPVL

SEQ ID NO: 900405 - protein, 9 aa, Homo Sapiens
EILANVFTC

SEQ ID NO: 900406 - protein, 9 aa, Homo Sapiens
GQGKEKAVS

SEQ ID NO: 900407 - protein, 9 aa, Homo Sapiens
NKARGAIPS

SEQ ID NO: 900408 - protein, 9 aa, Homo Sapiens
LETNKLQNV

SEQ ID NO: 900409 - protein, 9 aa, Homo Sapiens
GIMKDMLRD

SEQ ID NO: 900410 - protein, 9 aa, Homo Sapiens
CQYVMLIAV

SEQ ID NO: 900411 - protein, 9 aa, Homo Sapiens
QEMRCQEPL

SEQ ID NO: 900412 - protein, 9 aa, Homo Sapiens
MAEEERNPN

SEQ ID NO: 900413 - protein, 9 aa, Homo Sapiens
YGLKWCLYE

SEQ ID NO: 900414 - protein, 9 aa, Homo Sapiens
DFFCQYVML

SEQ ID NO: 900415 - protein, 9 aa, Homo Sapiens
SVEKPYECK

SEQ ID NO: 900416 - protein, 9 aa, Homo Sapiens
VRQEMRCQE

SEQ ID NO: 900417 - protein, 9 aa, Homo Sapiens
GLCYIDDFA

SEQ ID NO: 900418 - protein, 9 aa, Homo Sapiens
NGESPRHSL

SEQ ID NO: 900419 - protein, 9 aa, Homo Sapiens
AKPQNDEKN

SEQ ID NO: 900420 - protein, 9 aa, Homo Sapiens
QLQRGDRSR

SEQ ID NO: 900421 - protein, 9 aa, Homo Sapiens
YERGGIGEG

SEQ ID NO: 900422 - protein, 9 aa, Homo Sapiens
WETGDDQFS

SEQ ID NO: 900423 - protein, 9 aa, Homo Sapiens
TTTGLLIYK

SEQ ID NO: 900424 - protein, 9 aa, Homo Sapiens
TLHITVTEE

SEQ ID NO: 900425 - protein, 9 aa, Homo Sapiens
TCGASWQRR

SEQ ID NO: 900426 - protein, 9 aa, Homo Sapiens
KEAGNVPEP

SEQ ID NO: 900427 - protein, 9 aa, Homo Sapiens
GPLFACVIG

SEQ ID NO: 900428 - protein, 9 aa, Homo Sapiens
IVTKWDLVF

SEQ ID NO: 900429 - protein, 9 aa, Homo Sapiens
FPHWNVVVD

SEQ ID NO: 900430 - protein, 9 aa, Homo Sapiens
EECREELLK

SEQ ID NO: 900431 - protein, 9 aa, Homo Sapiens
FIEAKYIAF

SEQ ID NO: 900432 - protein, 9 aa, Homo Sapiens
LLMAEEERN

SEQ ID NO: 900433 - protein, 9 aa, Homo Sapiens
LFVIIFAAV

SEQ ID NO: 900434 - protein, 9 aa, Homo Sapiens
SPIPVLLIT

SEQ ID NO: 900435 - protein, 9 aa, Homo Sapiens
EEGECYIQF

SEQ ID NO: 900436 - protein, 9 aa, Homo Sapiens
FMDTNECIQ

SEQ ID NO: 900437 - protein, 9 aa, Homo Sapiens
KNLEEQKIS

SEQ ID NO: 900438 - protein, 9 aa, Homo Sapiens
NVTHRLVTQ

SEQ ID NO: 900439 - protein, 9 aa, Homo Sapiens
IIRKAAKAS

SEQ ID NO: 900440 - protein, 9 aa, Homo Sapiens
FGKYGQETE

SEQ ID NO: 900441 - protein, 9 aa, Homo Sapiens
VRPWRAFFK

SEQ ID NO: 900442 - protein, 9 aa, Homo Sapiens
MNLEIQELR

SEQ ID NO: 900443 - protein, 9 aa, Homo Sapiens
ETQALLMAE

SEQ ID NO: 900444 - protein, 9 aa, Homo Sapiens
QPLIPPPPL

SEQ ID NO: 900445 - protein, 9 aa, Homo Sapiens
AKASGIVVP

SEQ ID NO: 900446 - protein, 9 aa, Homo Sapiens
THLSGGKKV

SEQ ID NO: 900447 - protein, 9 aa, Homo Sapiens
DDLSHDEEA

SEQ ID NO: 900448 - protein, 9 aa, Homo Sapiens
VVELFGKLA

SEQ ID NO: 900449 - protein, 9 aa, Homo Sapiens
AHWLRHGGE

SEQ ID NO: 900450 - protein, 9 aa, Homo Sapiens
SYLCRSRLQ

SEQ ID NO: 900451 - protein, 9 aa, Homo Sapiens
QQGFTLQPN

SEQ ID NO: 900452 - protein, 9 aa, Homo Sapiens
PAGAAQECH

SEQ ID NO: 900453 - protein, 9 aa, Homo Sapiens
MKLTLLQKI

SEQ ID NO: 900454 - protein, 9 aa, Homo Sapiens
WDLVFESQP

SEQ ID NO: 900455 - protein, 9 aa, Homo Sapiens
LQKIDNISL

SEQ ID NO: 900456 - protein, 9 aa, Homo Sapiens
CGINLSSLR

SEQ ID NO: 900457 - protein, 9 aa, Homo Sapiens
LEIQELRRQ

SEQ ID NO: 900458 - protein, 9 aa, Homo Sapiens
TVTQKMDPK

SEQ ID NO: 900459 - protein, 9 aa, Homo Sapiens
MDPKMLSKK

SEQ ID NO: 900460 - protein, 9 aa, Homo Sapiens
RQRVLLCPT

SEQ ID NO: 900461 - protein, 9 aa, Homo Sapiens
LTLLQKIDN

SEQ ID NO: 900462 - protein, 9 aa, Homo Sapiens
ELRDHEGST

SEQ ID NO: 900463 - protein, 9 aa, Homo Sapiens
VLQTIHGKE

SEQ ID NO: 900464 - protein, 9 aa, Homo Sapiens
IHTVTKLFE

SEQ ID NO: 900465 - protein, 9 aa, Homo Sapiens
GQSVSLMDL

SEQ ID NO: 900466 - protein, 9 aa, Homo Sapiens
GKSTTTGLL

SEQ ID NO: 900467 - protein, 9 aa, Homo Sapiens
TMKIERAHM

SEQ ID NO: 900468 - protein, 9 aa, Homo Sapiens
QTIHGKEMS

SEQ ID NO: 900469 - protein, 9 aa, Homo Sapiens
DMLRDCTHD

SEQ ID NO: 900470 - protein, 9 aa, Homo Sapiens
LSACKDSKK

SEQ ID NO: 900471 - protein, 9 aa, Homo Sapiens
DTEVRHSNF

SEQ ID NO: 900472 - protein, 9 aa, Homo Sapiens
VPLHPYATG

SEQ ID NO: 900473 - protein, 9 aa, Homo Sapiens
NTLLTEFII

SEQ ID NO: 900474 - protein, 9 aa, Homo Sapiens
EDRKKVIWF

SEQ ID NO: 900475 - protein, 9 aa, Homo Sapiens
TPSTDLKMW

SEQ ID NO: 900476 - protein, 9 aa, Homo Sapiens
ILANVFTCS

SEQ ID NO: 900477 - protein, 9 aa, Homo Sapiens
ASPILHGQG

SEQ ID NO: 900478 - protein, 9 aa, Homo Sapiens
GTGSEMESP

SEQ ID NO: 900479 - protein, 9 aa, Homo Sapiens
QRASTVSTT

SEQ ID NO: 900480 - protein, 9 aa, Homo Sapiens
EESLYLQLY

SEQ ID NO: 900481 - protein, 9 aa, Homo Sapiens
LFQTTESGA

SEQ ID NO: 900482 - protein, 9 aa, Homo Sapiens
FVIIFAAVV

SEQ ID NO: 900483 - protein, 9 aa, Homo Sapiens
NLEIQELRR

SEQ ID NO: 900484 - protein, 9 aa, Homo Sapiens
VITSSEVSS

SEQ ID NO: 900485 - protein, 9 aa, Homo Sapiens
FTESKRYEK

SEQ ID NO: 900486 - protein, 9 aa, Homo Sapiens
VLLAVFKDK

SEQ ID NO: 900487 - protein, 9 aa, Homo Sapiens
LIPPPPLVQ

SEQ ID NO: 900488 - protein, 9 aa, Homo Sapiens
ECHESHNGE

SEQ ID NO: 900489 - protein, 9 aa, Homo Sapiens
SNSTLKEAI

SEQ ID NO: 900490 - protein, 9 aa, Homo Sapiens
VVGMIILIP

SEQ ID NO: 900491 - protein, 9 aa, Homo Sapiens
ESMLRAHWL

SEQ ID NO: 900492 - protein, 9 aa, Homo Sapiens
MIILIPYCI

SEQ ID NO: 900493 - protein, 9 aa, Homo Sapiens
GKYGQETEE

SEQ ID NO: 900494 - protein, 9 aa, Homo Sapiens
TTESGAIEM

SEQ ID NO: 900495 - protein, 9 aa, Homo Sapiens
FGDMPRKLK

SEQ ID NO: 900496 - protein, 9 aa, Homo Sapiens
KVVNAQCGY

SEQ ID NO: 900497 - protein, 9 aa, Homo Sapiens
ILHGQGKEK

SEQ ID NO: 900498 - protein, 9 aa, Homo Sapiens
SSRFTESKR

SEQ ID NO: 900499 - protein, 9 aa, Homo Sapiens
INGHVAGPV

SEQ ID NO: 900500 - protein, 9 aa, Homo Sapiens
RTGPLFACV

SEQ ID NO: 900501 - protein, 9 aa, Homo Sapiens
FESQPLNSV

SEQ ID NO: 900502 - protein, 9 aa, Homo Sapiens
PRHSLQCPR

SEQ ID NO: 900503 - protein, 9 aa, Homo Sapiens
YLSETSSSE

SEQ ID NO: 900504 - protein, 9 aa, Homo Sapiens
TTGLLIYKC

SEQ ID NO: 900505 - protein, 9 aa, Homo Sapiens
LIALNLKAH

SEQ ID NO: 900506 - protein, 9 aa, Homo Sapiens
HVLSSSTGN

SEQ ID NO: 900507 - protein, 9 aa, Homo Sapiens
LSSLRKMAV

SEQ ID NO: 900508 - protein, 9 aa, Homo Sapiens
TGWSAVARS

SEQ ID NO: 900509 - protein, 9 aa, Homo Sapiens
NGHFMDTNE

SEQ ID NO: 900510 - protein, 9 aa, Homo Sapiens
DVLGRLQHV

SEQ ID NO: 900511 - protein, 9 aa, Homo Sapiens
SKRVSVSRS

SEQ ID NO: 900512 - protein, 9 aa, Homo Sapiens
RCGHHHRQQ

SEQ ID NO: 900513 - protein, 9 aa, Homo Sapiens
WLRHGGERP

SEQ ID NO: 900514 - protein, 9 aa, Homo Sapiens
LSSQATLHI

SEQ ID NO: 900515 - protein, 9 aa, Homo Sapiens
LLTEFIIFL

SEQ ID NO: 900516 - protein, 9 aa, Homo Sapiens
YNWETGDDQ

SEQ ID NO: 900517 - protein, 9 aa, Homo Sapiens
TTVNVTHRL

SEQ ID NO: 900518 - protein, 9 aa, Homo Sapiens
LYPAIPGVY

SEQ ID NO: 900519 - protein, 9 aa, Homo Sapiens
STLKEAILK

SEQ ID NO: 900520 - protein, 9 aa, Homo Sapiens
SLTPIDSLD

SEQ ID NO: 900521 - protein, 9 aa, Homo Sapiens
MESPRNPSS

SEQ ID NO: 900522 - protein, 9 aa, Homo Sapiens
DYLSETSSS

SEQ ID NO: 900523 - protein, 9 aa, Homo Sapiens
RARAVHYAY

SEQ ID NO: 900524 - protein, 9 aa, Homo Sapiens
CKQLDLELR

SEQ ID NO: 900525 - protein, 9 aa, Homo Sapiens
GYLGLFVII

SEQ ID NO: 900526 - protein, 9 aa, Homo Sapiens
LLIYKCGGI

SEQ ID NO: 900527 - protein, 9 aa, Homo Sapiens
MQLLPPAIR

SEQ ID NO: 900528 - protein, 9 aa, Homo Sapiens
EWQLLAAFE

SEQ ID NO: 900529 - protein, 9 aa, Homo Sapiens
PEALLRHQE

SEQ ID NO: 900530 - protein, 9 aa, Homo Sapiens
QYVAVCQPL

SEQ ID NO: 900531 - protein, 9 aa, Homo Sapiens
EYPPEGCLA

SEQ ID NO: 900532 - protein, 9 aa, Homo Sapiens
ESPRHSLQC

SEQ ID NO: 900533 - protein, 9 aa, Homo Sapiens
PFGDMPRKL

SEQ ID NO: 900534 - protein, 9 aa, Homo Sapiens
RPGLQGPRG

SEQ ID NO: 900535 - protein, 9 aa, Homo Sapiens
TNQVNKARG

SEQ ID NO: 900536 - protein, 9 aa, Homo Sapiens
VSVKMHSVE

SEQ ID NO: 900537 - protein, 9 aa, Homo Sapiens
RTLEGFQAF

SEQ ID NO: 900538 - protein, 9 aa, Homo Sapiens
LESMLRAHW

SEQ ID NO: 900539 - protein, 9 aa, Homo Sapiens
SVGNRTLEG

SEQ ID NO: 900540 - protein, 9 aa, Homo Sapiens
RNVPANFIE

SEQ ID NO: 900541 - protein, 9 aa, Homo Sapiens
VHMKFLVEQ

SEQ ID NO: 900542 - protein, 9 aa, Homo Sapiens
GPVTSHGFT

SEQ ID NO: 900543 - protein, 9 aa, Homo Sapiens
FLTDSLKTP

SEQ ID NO: 900544 - protein, 9 aa, Homo Sapiens
LQKNLEEQK

SEQ ID NO: 900545 - protein, 9 aa, Homo Sapiens
VSRSQHDIL

SEQ ID NO: 900546 - protein, 9 aa, Homo Sapiens
FEKRAKMFC

SEQ ID NO: 900547 - protein, 9 aa, Homo Sapiens
KLQNVAKMF

SEQ ID NO: 900548 - protein, 9 aa, Homo Sapiens
SCCKPSCCM

SEQ ID NO: 900549 - protein, 9 aa, Homo Sapiens
ETMKIERAH

SEQ ID NO: 900550 - protein, 9 aa, Homo Sapiens
KQLKETMKI

SEQ ID NO: 900551 - protein, 9 aa, Homo Sapiens
RCQEPLPPP

SEQ ID NO: 900552 - protein, 9 aa, Homo Sapiens
AAQECHESH

SEQ ID NO: 900553 - protein, 9 aa, Homo Sapiens
KSTTTGLLI

SEQ ID NO: 900554 - protein, 9 aa, Homo Sapiens
VADLITEWQ

SEQ ID NO: 900555 - protein, 9 aa, Homo Sapiens
YLGNTGMHR

SEQ ID NO: 900556 - protein, 9 aa, Homo Sapiens
NEASTRVRF

SEQ ID NO: 900557 - protein, 9 aa, Homo Sapiens
FILESNSTL

SEQ ID NO: 900558 - protein, 9 aa, Homo Sapiens
SVADLITEW

SEQ ID NO: 900559 - protein, 9 aa, Homo Sapiens
WQPNFLHPV

SEQ ID NO: 900560 - protein, 9 aa, Homo Sapiens
SKCGINLSS

SEQ ID NO: 900561 - protein, 9 aa, Homo Sapiens
MGEILANVF

SEQ ID NO: 900562 - protein, 9 aa, Homo Sapiens
GGTNQVNKA

SEQ ID NO: 900563 - protein, 9 aa, Homo Sapiens
GVRTVEEGE

SEQ ID NO: 900564 - protein, 9 aa, Homo Sapiens
VEEGECYIQ

SEQ ID NO: 900565 - protein, 9 aa, Homo Sapiens
KDMLRDCTH

SEQ ID NO: 900566 - protein, 9 aa, Homo Sapiens
VSVSRSQHD

SEQ ID NO: 900567 - protein, 9 aa, Homo Sapiens
VRTVEEGEC

SEQ ID NO: 900568 - protein, 9 aa, Homo Sapiens
HNGESPRHS

SEQ ID NO: 900569 - protein, 9 aa, Homo Sapiens
GNTNEASTR

SEQ ID NO: 900570 - protein, 9 aa, Homo Sapiens
SDDNFGKYG

SEQ ID NO: 900571 - protein, 9 aa, Homo Sapiens
WSHSIFLPV

SEQ ID NO: 900572 - protein, 9 aa, Homo Sapiens
TEFIIFLMA

SEQ ID NO: 900573 - protein, 9 aa, Homo Sapiens
AEYPPEGCL

SEQ ID NO: 900574 - protein, 9 aa, Homo Sapiens
WGKLGVSPR

SEQ ID NO: 900575 - protein, 9 aa, Homo Sapiens
YMTVTQKMD

SEQ ID NO: 900576 - protein, 9 aa, Homo Sapiens
FHDYERGGI

SEQ ID NO: 900577 - protein, 9 aa, Homo Sapiens
LVRPWRAFF

SEQ ID NO: 900578 - protein, 9 aa, Homo Sapiens
ALNLKAHVV

SEQ ID NO: 900579 - protein, 9 aa, Homo Sapiens
TGPLFACVI

SEQ ID NO: 900580 - protein, 9 aa, Homo Sapiens
TLLTEFIIF

SEQ ID NO: 900581 - protein, 9 aa, Homo Sapiens
LELRDHEGS

SEQ ID NO: 900582 - protein, 9 aa, Homo Sapiens
ADLITEWQL

SEQ ID NO: 900583 - protein, 9 aa, Homo Sapiens
HGGYLGLFV

SEQ ID NO: 900584 - protein, 9 aa, Homo Sapiens
HPAGAAQEC

SEQ ID NO: 900585 - protein, 9 aa, Homo Sapiens
IHGGTNQVN

SEQ ID NO: 900586 - protein, 9 aa, Homo Sapiens
SEVSSSPTP

SEQ ID NO: 900587 - protein, 9 aa, Homo Sapiens
LYLGNTGMH

SEQ ID NO: 900588 - protein, 9 aa, Homo Sapiens
LYLQLYPAI

SEQ ID NO: 900589 - protein, 9 aa, Homo Sapiens
SGCQKLNCA

SEQ ID NO: 900590 - protein, 9 aa, Homo Sapiens
YPAIPGVYF

SEQ ID NO: 900591 - protein, 9 aa, Homo Sapiens
LQCPRCGHH

SEQ ID NO: 900592 - protein, 9 aa, Homo Sapiens
PLGLCYIDD

SEQ ID NO: 900593 - protein, 9 aa, Homo Sapiens
ETNKLQNVA

SEQ ID NO: 900594 - protein, 9 aa, Homo Sapiens
YFKEAGNVP

SEQ ID NO: 900595 - protein, 9 aa, Homo Sapiens
KSSSSRFTE

SEQ ID NO: 900596 - protein, 9 aa, Homo Sapiens
SLGISLMEL

SEQ ID NO: 900597 - protein, 9 aa, Homo Sapiens
QNDEKNNTK

SEQ ID NO: 900598 - protein, 9 aa, Homo Sapiens
FMGEILANV

SEQ ID NO: 900599 - protein, 9 aa, Homo Sapiens
MPRKLKIQV

SEQ ID NO: 900600 - protein, 9 aa, Homo Sapiens
KMFCARQNC

SEQ ID NO: 900601 - protein, 9 aa, Homo Sapiens
QQEEMMRRH

SEQ ID NO: 900602 - protein, 9 aa, Homo Sapiens
FACVIGKQM

SEQ ID NO: 900603 - protein, 9 aa, Homo Sapiens
GEGGRPGLQ

SEQ ID NO: 900604 - protein, 9 aa, Homo Sapiens
QRMECTDKQ

SEQ ID NO: 900605 - protein, 9 aa, Homo Sapiens
CEKALIRST

SEQ ID NO: 900606 - protein, 9 aa, Homo Sapiens
DLELRDHEG

SEQ ID NO: 900607 - protein, 9 aa, Homo Sapiens
INLSSLRKM

SEQ ID NO: 900608 - protein, 9 aa, Homo Sapiens
IVPEALLRH

SEQ ID NO: 900609 - protein, 9 aa, Homo Sapiens
IALNLKAHV

SEQ ID NO: 900610 - protein, 9 aa, Homo Sapiens
YEDRKKVIW

SEQ ID NO: 900611 - protein, 9 aa, Homo Sapiens
HVRSYLCRS

SEQ ID NO: 900612 - protein, 9 aa, Homo Sapiens
EEPSQRAST

SEQ ID NO: 900613 - protein, 9 aa, Homo Sapiens
AAEECREEL

SEQ ID NO: 900614 - protein, 9 aa, Homo Sapiens
HSVEKPYEC

SEQ ID NO: 900615 - protein, 9 aa, Homo Sapiens
KLRRWKGCV

SEQ ID NO: 900616 - protein, 9 aa, Homo Sapiens
GRLQHVSGE

SEQ ID NO: 900617 - protein, 9 aa, Homo Sapiens
AIVGTLKFN

SEQ ID NO: 900618 - protein, 9 aa, Homo Sapiens
RFTESKRYE

SEQ ID NO: 900619 - protein, 9 aa, Homo Sapiens
GLHPAGAAQ

SEQ ID NO: 900620 - protein, 9 aa, Homo Sapiens
EALLRHQES

SEQ ID NO: 900621 - protein, 9 aa, Homo Sapiens
MLRAHWLRH

SEQ ID NO: 900622 - protein, 9 aa, Homo Sapiens
DKQIRQVNE

SEQ ID NO: 900623 - protein, 9 aa, Homo Sapiens
QQTLPTPTP

SEQ ID NO: 900624 - protein, 9 aa, Homo Sapiens
LDGIVDFFC

SEQ ID NO: 900625 - protein, 9 aa, Homo Sapiens
ESLYLQLYP

SEQ ID NO: 900626 - protein, 9 aa, Homo Sapiens
QPNFLHPVI

SEQ ID NO: 900627 - protein, 9 aa, Homo Sapiens
RARPALMAS

SEQ ID NO: 900628 - protein, 9 aa, Homo Sapiens
VGDGSVLQT

SEQ ID NO: 900629 - protein, 9 aa, Homo Sapiens
RKMNLEIQE

SEQ ID NO: 900630 - protein, 9 aa, Homo Sapiens
SACKDSKKK

SEQ ID NO: 900631 - protein, 9 aa, Homo Sapiens
RGILREDAV

SEQ ID NO: 900632 - protein, 9 aa, Homo Sapiens
KNIHTVTKL

SEQ ID NO: 900633 - protein, 9 aa, Homo Sapiens
DDQFSFRSF

SEQ ID NO: 900634 - protein, 9 aa, Homo Sapiens
PIPVLLITE

SEQ ID NO: 900635 - protein, 9 aa, Homo Sapiens
NSPVITSSE

SEQ ID NO: 900636 - protein, 9 aa, Homo Sapiens
DAWQPNFLH

SEQ ID NO: 900637 - protein, 9 aa, Homo Sapiens
KPPLPPTME

SEQ ID NO: 900638 - protein, 9 aa, Homo Sapiens
GLHVHFWIV

SEQ ID NO: 900639 - protein, 9 aa, Homo Sapiens
FIIFLMAVF

SEQ ID NO: 900640 - protein, 9 aa, Homo Sapiens
SLMELALGR

SEQ ID NO: 900641 - protein, 9 aa, Homo Sapiens
FQTTESGAI

SEQ ID NO: 900642 - protein, 9 aa, Homo Sapiens
NVVELFGKL

SEQ ID NO: 900643 - protein, 9 aa, Homo Sapiens
YGTGSEMES

SEQ ID NO: 900644 - protein, 9 aa, Homo Sapiens
GESPRHSLQ

SEQ ID NO: 900645 - protein, 9 aa, Homo Sapiens
PNFLHPVIY

SEQ ID NO: 900646 - protein, 9 aa, Homo Sapiens
VKMHSVEKP

SEQ ID NO: 900647 - protein, 9 aa, Homo Sapiens
PNYQTIINP

SEQ ID NO: 900648 - protein, 9 aa, Homo Sapiens
ACVDMTFNE

SEQ ID NO: 900649 - protein, 9 aa, Homo Sapiens
SVLQTIHGK

SEQ ID NO: 900650 - protein, 9 aa, Homo Sapiens
PANFIEAKY

SEQ ID NO: 900651 - protein, 9 aa, Homo Sapiens
QVNKARGAI

SEQ ID NO: 900652 - protein, 9 aa, Homo Sapiens
GHFMDTNEC

SEQ ID NO: 900653 - protein, 9 aa, Homo Sapiens
DPAQKVVNA

SEQ ID NO: 900654 - protein, 9 aa, Homo Sapiens
TGDDQFSFR

SEQ ID NO: 900655 - protein, 9 aa, Homo Sapiens
LVSKCGINL

SEQ ID NO: 900656 - protein, 9 aa, Homo Sapiens
NNKGGLHVH

SEQ ID NO: 900657 - protein, 9 aa, Homo Sapiens
ANVFTCSLM

SEQ ID NO: 900658 - protein, 9 aa, Homo Sapiens
TGSDKCDFL

SEQ ID NO: 900659 - protein, 9 aa, Homo Sapiens
WDSVGNRTL

SEQ ID NO: 900660 - protein, 9 aa, Homo Sapiens
SSSPEKIQS

SEQ ID NO: 900661 - protein, 9 aa, Homo Sapiens
VPEALLRHQ

SEQ ID NO: 900662 - protein, 9 aa, Homo Sapiens
SFEKRAKMF

SEQ ID NO: 900663 - protein, 9 aa, Homo Sapiens
WSLGISLME

SEQ ID NO: 900664 - protein, 9 aa, Homo Sapiens
RWKGCVSPS

SEQ ID NO: 900665 - protein, 9 aa, Homo Sapiens
VLGRLQHVS

SEQ ID NO: 900666 - protein, 9 aa, Homo Sapiens
LHITVTEEN

SEQ ID NO: 900667 - protein, 9 aa, Homo Sapiens
RAVHYAYAI

SEQ ID NO: 900668 - protein, 9 aa, Homo Sapiens
PFLMAKPQN

SEQ ID NO: 900669 - protein, 9 aa, Homo Sapiens
RVSVSRSQH

SEQ ID NO: 900670 - protein, 9 aa, Homo Sapiens
FFCQYVMLI

SEQ ID NO: 900671 - protein, 9 aa, Homo Sapiens
PTMERHERS

SEQ ID NO: 900672 - protein, 9 aa, Homo Sapiens
SHAIAPTLS

SEQ ID NO: 900673 - protein, 9 aa, Homo Sapiens
TLEGFQAFS

SEQ ID NO: 900674 - protein, 9 aa, Homo Sapiens
RTVEEGECY

SEQ ID NO: 900675 - protein, 9 aa, Homo Sapiens
LGNTGMHRL

SEQ ID NO: 900676 - protein, 9 aa, Homo Sapiens
NRTLEGFQA

SEQ ID NO: 900677 - protein, 9 aa, Homo Sapiens
LVTQVTTRL

SEQ ID NO: 900678 - protein, 9 aa, Homo Sapiens
VIIFAAVVC

SEQ ID NO: 900679 - protein, 9 aa, Homo Sapiens
PVITSSEVS

SEQ ID NO: 900680 - protein, 9 aa, Homo Sapiens
PPLFQTTES

SEQ ID NO: 900681 - protein, 9 aa, Homo Sapiens
PALMASHAI

SEQ ID NO: 900682 - protein, 9 aa, Homo Sapiens
PIEWAAEEC

SEQ ID NO: 900683 - protein, 9 aa, Homo Sapiens
TSSEVSSSP

SEQ ID NO: 900684 - protein, 9 aa, Homo Sapiens
EIVTALAIV

SEQ ID NO: 900685 - protein, 9 aa, Homo Sapiens
EFIIFLMAV

SEQ ID NO: 900686 - protein, 9 aa, Homo Sapiens
VTGSDKCDF

SEQ ID NO: 900687 - protein, 9 aa, Homo Sapiens
ANFIEAKYI

SEQ ID NO: 900688 - protein, 9 aa, Homo Sapiens
PLSSQATLH

SEQ ID NO: 900689 - protein, 9 aa, Homo Sapiens
HGFTVKWDP

SEQ ID NO: 900690 - protein, 9 aa, Homo Sapiens
AEPPLFQTT

SEQ ID NO: 900691 - protein, 9 aa, Homo Sapiens
NVTGSDKCD

SEQ ID NO: 900692 - protein, 9 aa, Homo Sapiens
GINLSSLRK

SEQ ID NO: 900693 - protein, 9 aa, Homo Sapiens
LNLKAHVVA

SEQ ID NO: 900694 - protein, 9 aa, Homo Sapiens
SSYGLKWCL

SEQ ID NO: 900695 - protein, 9 aa, Homo Sapiens
EWAAEECRE

SEQ ID NO: 900696 - protein, 9 aa, Homo Sapiens
SSTGNSAPN

SEQ ID NO: 900697 - protein, 9 aa, Homo Sapiens
GRPGLQGPR

SEQ ID NO: 900698 - protein, 9 aa, Homo Sapiens
TVEEGECYI

SEQ ID NO: 900699 - protein, 9 aa, Homo Sapiens
KMWGKLGVS

SEQ ID NO: 900700 - protein, 9 aa, Homo Sapiens
GEILANVFT

SEQ ID NO: 900701 - protein, 9 aa, Homo Sapiens
LCPTGWSAV

SEQ ID NO: 900702 - protein, 9 aa, Homo Sapiens
KNVVELFGK

SEQ ID NO: 900703 - protein, 9 aa, Homo Sapiens
LGKFSLTPI

SEQ ID NO: 900704 - protein, 9 aa, Homo Sapiens
LSSSTGNSA

SEQ ID NO: 900705 - protein, 9 aa, Homo Sapiens
KKVLPMQVT

SEQ ID NO: 900706 - protein, 9 aa, Homo Sapiens
VRHSNFDNF

SEQ ID NO: 900707 - protein, 9 aa, Homo Sapiens
TDLKMWGKL

SEQ ID NO: 900708 - protein, 9 aa, Homo Sapiens
RRARAVHYA

SEQ ID NO: 900709 - protein, 9 aa, Homo Sapiens
QPSGCQKLN

SEQ ID NO: 900710 - protein, 9 aa, Homo Sapiens
MKDMLRDCT

SEQ ID NO: 900711 - protein, 9 aa, Homo Sapiens
ATLHITVTE

SEQ ID NO: 900712 - protein, 9 aa, Homo Sapiens
KIVPEALLR

SEQ ID NO: 900713 - protein, 9 aa, Homo Sapiens
LRAHWLRHG

SEQ ID NO: 900714 - protein, 9 aa, Homo Sapiens
PAIRTGTKT

SEQ ID NO: 900715 - protein, 9 aa, Homo Sapiens
SDDDLSHDE

SEQ ID NO: 900716 - protein, 9 aa, Homo Sapiens
TINFLTDSL

SEQ ID NO: 900717 - protein, 9 aa, Homo Sapiens
GGYLGLFVI

SEQ ID NO: 900718 - protein, 9 aa, Homo Sapiens
LKMWGKLGV

SEQ ID NO: 900719 - protein, 9 aa, Homo Sapiens
SRFTESKRY

SEQ ID NO: 900720 - protein, 9 aa, Homo Sapiens
EVIKQLKET

SEQ ID NO: 900721 - protein, 9 aa, Homo Sapiens
LGLCYIDDF

SEQ ID NO: 900722 - protein, 9 aa, Homo Sapiens
RRRARAVHY

SEQ ID NO: 900723 - protein, 9 aa, Homo Sapiens
DGIVDFFCQ

SEQ ID NO: 900724 - protein, 9 aa, Homo Sapiens
NKGGLHVHF

SEQ ID NO: 900725 - protein, 9 aa, Homo Sapiens
PLFACVIGK

SEQ ID NO: 900726 - protein, 9 aa, Homo Sapiens
RLFPYANGT

SEQ ID NO: 900727 - protein, 9 aa, Homo Sapiens
AFDQYVAVC

SEQ ID NO: 900728 - protein, 9 aa, Homo Sapiens
LFACVIGKQ

SEQ ID NO: 900729 - protein, 9 aa, Homo Sapiens
NWETGDDQF

SEQ ID NO: 900730 - protein, 9 aa, Homo Sapiens
VLLITEIFL

SEQ ID NO: 900731 - protein, 9 aa, Homo Sapiens
DKNLQAPMY

SEQ ID NO: 900732 - protein, 9 aa, Homo Sapiens
FLPVDTVVE

SEQ ID NO: 900733 - protein, 9 aa, Homo Sapiens
KCKICEKAL

SEQ ID NO: 900734 - protein, 9 aa, Homo Sapiens
VTSHGFTVK

SEQ ID NO: 900735 - protein, 9 aa, Homo Sapiens
GIDYLSETS

SEQ ID NO: 900736 - protein, 9 aa, Homo Sapiens
KICEKALIR

SEQ ID NO: 900737 - protein, 9 aa, Homo Sapiens
QQPQPLIPP

SEQ ID NO: 900738 - protein, 9 aa, Homo Sapiens
ASTRVRFIN

SEQ ID NO: 900739 - protein, 9 aa, Homo Sapiens
CKTHHEMKE

SEQ ID NO: 900740 - protein, 9 aa, Homo Sapiens
EPPLFQTTE

SEQ ID NO: 900741 - protein, 9 aa, Homo Sapiens
VSNNKGGLH

SEQ ID NO: 900742 - protein, 9 aa, Homo Sapiens
RQEMRCQEP

SEQ ID NO: 900743 - protein, 9 aa, Homo Sapiens
KWCLYELDK

SEQ ID NO: 900744 - protein, 9 aa, Homo Sapiens
SWQILVRPW

SEQ ID NO: 900745 - protein, 9 aa, Homo Sapiens
ESNSTLKEA

SEQ ID NO: 900746 - protein, 9 aa, Homo Sapiens
ASGIVVPST

SEQ ID NO: 900747 - protein, 9 aa, Homo Sapiens
MPFAEYPPE

SEQ ID NO: 900748 - protein, 9 aa, Homo Sapiens
SRTSNLVRH

SEQ ID NO: 900749 - protein, 9 aa, Homo Sapiens
QLLPPAIRT

SEQ ID NO: 900750 - protein, 9 aa, Homo Sapiens
PVPLHPYAT

SEQ ID NO: 900751 - protein, 9 aa, Homo Sapiens
GNVPEPEEK

SEQ ID NO: 900752 - protein, 9 aa, Homo Sapiens
QPQPLIPPP

SEQ ID NO: 900753 - protein, 9 aa, Homo Sapiens
EHRGILRED

SEQ ID NO: 900754 - protein, 9 aa, Homo Sapiens
SNSPVITSS

SEQ ID NO: 900755 - protein, 9 aa, Homo Sapiens
IEAKYIAFT

SEQ ID NO: 900756 - protein, 9 aa, Homo Sapiens
TRNVPANFI

SEQ ID NO: 900757 - protein, 9 aa, Homo Sapiens
PPTMERHER

SEQ ID NO: 900758 - protein, 9 aa, Homo Sapiens
MHRLRGSFR

SEQ ID NO: 900759 - protein, 9 aa, Homo Sapiens
LIKLACVDM

SEQ ID NO: 900760 - protein, 9 aa, Homo Sapiens
TGLLIYKCG

SEQ ID NO: 900761 - protein, 9 aa, Homo Sapiens
KPSCCMTTC

SEQ ID NO: 900762 - protein, 9 aa, Homo Sapiens
LQLYPAIPG

SEQ ID NO: 900763 - protein, 9 aa, Homo Sapiens
VAGPVPLHP

SEQ ID NO: 900764 - protein, 9 aa, Homo Sapiens
DYERGGIGE

SEQ ID NO: 900765 - protein, 9 aa, Homo Sapiens
WNGIMKDML

SEQ ID NO: 900766 - protein, 9 aa, Homo Sapiens
VLSSSTGNS

SEQ ID NO: 900767 - protein, 9 aa, Homo Sapiens
PCYWENQPS

SEQ ID NO: 900768 - protein, 9 aa, Homo Sapiens
HRGILREDA

SEQ ID NO: 900769 - protein, 9 aa, Homo Sapiens
ILVRPWRAF

SEQ ID NO: 900770 - protein, 9 aa, Homo Sapiens
CKICEKALI

SEQ ID NO: 900771 - protein, 9 aa, Homo Sapiens
NGIMKDMLR

SEQ ID NO: 900772 - protein, 9 aa, Homo Sapiens
LHGQGKEKA

SEQ ID NO: 900773 - protein, 9 aa, Homo Sapiens
GLQGPRGDP

SEQ ID NO: 900774 - protein, 9 aa, Homo Sapiens
ENQPSGCQK

SEQ ID NO: 900775 - protein, 9 aa, Homo Sapiens
TTKRKMNLE

SEQ ID NO: 900776 - protein, 9 aa, Homo Sapiens
RHKNIHTVT

SEQ ID NO: 900777 - protein, 9 aa, Homo Sapiens
DDNFGKYGQ

SEQ ID NO: 900778 - protein, 9 aa, Homo Sapiens
LHPYATGLH

SEQ ID NO: 900779 - protein, 9 aa, Homo Sapiens
EEHRGILRE

SEQ ID NO: 900780 - protein, 9 aa, Homo Sapiens
TSNLVRHQR

SEQ ID NO: 900781 - protein, 9 aa, Homo Sapiens
VMPPKNVVE

SEQ ID NO: 900782 - protein, 9 aa, Homo Sapiens
NFGKYGQET

SEQ ID NO: 900783 - protein, 9 aa, Homo Sapiens
LGISLMELA

SEQ ID NO: 900784 - protein, 9 aa, Homo Sapiens
TVTKLFECK

SEQ ID NO: 900785 - protein, 9 aa, Homo Sapiens
PPKNVVELF

SEQ ID NO: 900786 - protein, 9 aa, Homo Sapiens
AQKVVNAQC

SEQ ID NO: 900787 - protein, 9 aa, Homo Sapiens
YRNLEFPQK

SEQ ID NO: 900788 - protein, 9 aa, Homo Sapiens
PSCCMTTCC

SEQ ID NO: 900789 - protein, 9 aa, Homo Sapiens
HPYATGLHP

SEQ ID NO: 900790 - protein, 9 aa, Homo Sapiens
PPLSSQATL

SEQ ID NO: 900791 - protein, 9 aa, Homo Sapiens
GKFSLTPID

SEQ ID NO: 900792 - protein, 9 aa, Homo Sapiens
QRVLLCPTG

SEQ ID NO: 900793 - protein, 9 aa, Homo Sapiens
AVFKDKNLQ

SEQ ID NO: 900794 - protein, 9 aa, Homo Sapiens
MECTDKQIR

SEQ ID NO: 900795 - protein, 9 aa, Homo Sapiens
SHSIFLPVD

SEQ ID NO: 900796 - protein, 9 aa, Homo Sapiens
IAFYEDRKK

SEQ ID NO: 900797 - protein, 9 aa, Homo Sapiens
IFLPVDTVV

SEQ ID NO: 900798 - protein, 9 aa, Homo Sapiens
ADLEKRCEH

SEQ ID NO: 900799 - protein, 9 aa, Homo Sapiens
GDMPRKLKI

SEQ ID NO: 900800 - protein, 9 aa, Homo Sapiens
SEINQQTLP

SEQ ID NO: 900801 - protein, 9 aa, Homo Sapiens
WITINFLTD

SEQ ID NO: 900802 - protein, 9 aa, Homo Sapiens
RAKMFCARQ

SEQ ID NO: 900803 - protein, 9 aa, Homo Sapiens
GKKVLPMQV

SEQ ID NO: 900804 - protein, 9 aa, Homo Sapiens
VWSLGISLM

SEQ ID NO: 900805 - protein, 9 aa, Homo Sapiens
LQTIHGKEM

SEQ ID NO: 900806 - protein, 9 aa, Homo Sapiens
TEDAWQPNF

SEQ ID NO: 900807 - protein, 9 aa, Homo Sapiens
CYWENQPSG

SEQ ID NO: 900808 - protein, 9 aa, Homo Sapiens
YAYAIVPSP

SEQ ID NO: 900809 - protein, 9 aa, Homo Sapiens
HQRMECTDK

SEQ ID NO: 900810 - protein, 9 aa, Homo Sapiens
ALGKFSLTP

SEQ ID NO: 900811 - protein, 9 aa, Homo Sapiens
SYGTGSEME

SEQ ID NO: 900812 - protein, 9 aa, Homo Sapiens
VWHEEHRGI

SEQ ID NO: 900813 - protein, 9 aa, Homo Sapiens
IVTALAIVG

SEQ ID NO: 900814 - protein, 9 aa, Homo Sapiens
FCQYVMLIA

SEQ ID NO: 900815 - protein, 9 aa, Homo Sapiens
LACVDMTFN

SEQ ID NO: 900816 - protein, 9 aa, Homo Sapiens
SSEVSSSPT

SEQ ID NO: 900817 - protein, 9 aa, Homo Sapiens
SSLPNGQSV

SEQ ID NO: 900818 - protein, 9 aa, Homo Sapiens
STHLSGGKK

SEQ ID NO: 900819 - protein, 9 aa, Homo Sapiens
SSFEKRAKM

SEQ ID NO: 900820 - protein, 9 aa, Homo Sapiens
IILIPYCIR

SEQ ID NO: 900821 - protein, 9 aa, Homo Sapiens
QTTESGAIE

SEQ ID NO: 900822 - protein, 9 aa, Homo Sapiens
DSFPHWNVV

SEQ ID NO: 900823 - protein, 9 aa, Homo Sapiens
NYSDDNFGK

SEQ ID NO: 900824 - protein, 9 aa, Homo Sapiens
ENGHFMDTN

SEQ ID NO: 900825 - protein, 9 aa, Homo Sapiens
AGGVDFNET

SEQ ID NO: 900826 - protein, 9 aa, Homo Sapiens
LMELALGRF

SEQ ID NO: 900827 - protein, 9 aa, Homo Sapiens
GFSRTSNLV

SEQ ID NO: 900828 - protein, 9 aa, Homo Sapiens
AKMFCARQN

SEQ ID NO: 900829 - protein, 9 aa, Homo Sapiens
PSGCQKLNC

SEQ ID NO: 900830 - protein, 9 aa, Homo Sapiens
GSVLQTIHG

SEQ ID NO: 900831 - protein, 9 aa, Homo Sapiens
LTPIDSLDT

SEQ ID NO: 900832 - protein, 9 aa, Homo Sapiens
SLYLQLYPA

SEQ ID NO: 900833 - protein, 9 aa, Homo Sapiens
QGPRGDPGP

SEQ ID NO: 900834 - protein, 9 aa, Homo Sapiens
EMRCQEPLP

SEQ ID NO: 900835 - protein, 9 aa, Homo Sapiens
LLCPTGWSA

SEQ ID NO: 900836 - protein, 9 aa, Homo Sapiens
WENQPSGCQ

SEQ ID NO: 900837 - protein, 9 aa, Homo Sapiens
TDSLKTPGG

SEQ ID NO: 900838 - protein, 9 aa, Homo Sapiens
LQNVAKMFA

SEQ ID NO: 900839 - protein, 9 aa, Homo Sapiens
LRDHEGSTA

SEQ ID NO: 900840 - protein, 9 aa, Homo Sapiens
VMAFDQYVA

SEQ ID NO: 900841 - protein, 9 aa, Homo Sapiens
SIVMPPKNV

SEQ ID NO: 900842 - protein, 9 aa, Homo Sapiens
LWYPYFCRM

SEQ ID NO: 900843 - protein, 9 aa, Homo Sapiens
LLPPAIRTG

SEQ ID NO: 900844 - protein, 9 aa, Homo Sapiens
AGHVLSSST

SEQ ID NO: 900845 - protein, 9 aa, Homo Sapiens
MAFDQYVAV

SEQ ID NO: 900846 - protein, 9 aa, Homo Sapiens
IIFLMAVFI

SEQ ID NO: 900847 - protein, 9 aa, Homo Sapiens
PSKRVSVSR

SEQ ID NO: 900848 - protein, 9 aa, Homo Sapiens
YSSSPEKIQ

SEQ ID NO: 900849 - protein, 9 aa, Homo Sapiens
GFTVKWDPP

SEQ ID NO: 900850 - protein, 9 aa, Homo Sapiens
PDSFPHWNV

SEQ ID NO: 900851 - protein, 9 aa, Homo Sapiens
VTKLFECKE

SEQ ID NO: 900852 - protein, 9 aa, Homo Sapiens
QKPPLPPTM

SEQ ID NO: 900853 - protein, 9 aa, Homo Sapiens
LHVHFWIVF

SEQ ID NO: 900854 - protein, 9 aa, Homo Sapiens
ECGKGFSRT

SEQ ID NO: 900855 - protein, 9 aa, Homo Sapiens
LIRSTHLTQ

SEQ ID NO: 900856 - protein, 9 aa, Homo Sapiens
LSHDEEALE

SEQ ID NO: 900857 - protein, 9 aa, Homo Sapiens
SSSRFTESK

SEQ ID NO: 900858 - protein, 9 aa, Homo Sapiens
PIVPLGLCY

SEQ ID NO: 900859 - protein, 9 aa, Homo Sapiens
AAVYLSACK

SEQ ID NO: 900860 - protein, 9 aa, Homo Sapiens
DLEKRCEHR

SEQ ID NO: 900861 - protein, 9 aa, Homo Sapiens
VTHRLVTQV

SEQ ID NO: 900862 - protein, 9 aa, Homo Sapiens
FSLTPIDSL

SEQ ID NO: 900863 - protein, 9 aa, Homo Sapiens
QTTYTMSGR

SEQ ID NO: 900864 - protein, 9 aa, Homo Sapiens
LPVDTVVEW

SEQ ID NO: 900865 - protein, 9 aa, Homo Sapiens
INQQTLPTP

SEQ ID NO: 900866 - protein, 9 aa, Homo Sapiens
EVRHSNFDN

SEQ ID NO: 900867 - protein, 9 aa, Homo Sapiens
GCVSPSASS

SEQ ID NO: 900868 - protein, 9 aa, Homo Sapiens
HGGTNQVNK

SEQ ID NO: 900869 - protein, 9 aa, Homo Sapiens
TSYGTGSEM

SEQ ID NO: 900870 - protein, 9 aa, Homo Sapiens
VYLSACKDS

SEQ ID NO: 900871 - protein, 9 aa, Homo Sapiens
LRHQESSHY

SEQ ID NO: 900872 - protein, 9 aa, Homo Sapiens
SGIVVPSTI

SEQ ID NO: 900873 - protein, 9 aa, Homo Sapiens
MAKPQNDEK

SEQ ID NO: 900874 - protein, 9 aa, Homo Sapiens
GMIILIPYC

SEQ ID NO: 900875 - protein, 9 aa, Homo Sapiens
VGMIILIPY

SEQ ID NO: 900876 - protein, 9 aa, Homo Sapiens
LTDSLKTPG

SEQ ID NO: 900877 - protein, 9 aa, Homo Sapiens
ALIRSTHLT

SEQ ID NO: 900878 - protein, 9 aa, Homo Sapiens
TVNVTHRLV

SEQ ID NO: 900879 - protein, 9 aa, Homo Sapiens
SVSRSQHDI

SEQ ID NO: 900880 - protein, 9 aa, Homo Sapiens
QNVAKMFAH

SEQ ID NO: 900881 - protein, 9 aa, Homo Sapiens
DLKMWGKLG

SEQ ID NO: 900882 - protein, 9 aa, Homo Sapiens
LPPTMERHE

SEQ ID NO: 900883 - protein, 9 aa, Homo Sapiens
NGHVAGPVP

SEQ ID NO: 900884 - protein, 9 aa, Homo Sapiens
TMSGRMATA

SEQ ID NO: 900885 - protein, 9 aa, Homo Sapiens
LMAEEERNP

SEQ ID NO: 900886 - protein, 9 aa, Homo Sapiens
LQGPRGDPG

SEQ ID NO: 900887 - protein, 9 aa, Homo Sapiens
QKIDNISLT

SEQ ID NO: 900888 - protein, 9 aa, Homo Sapiens
GFGIDYLSE

SEQ ID NO: 900889 - protein, 9 aa, Homo Sapiens
KWDLVFESQ

SEQ ID NO: 900890 - protein, 9 aa, Homo Sapiens
YATGLHPAG

SEQ ID NO: 900891 - protein, 9 aa, Homo Sapiens
VNVTHRLVT

SEQ ID NO: 900892 - protein, 9 aa, Homo Sapiens
DGSVLQTIH

SEQ ID NO: 900893 - protein, 9 aa, Homo Sapiens
GSDKCDFLK

SEQ ID NO: 900894 - protein, 9 aa, Homo Sapiens
SSPEKIQSP

SEQ ID NO: 900895 - protein, 9 aa, Homo Sapiens
KKLRRWKGC

SEQ ID NO: 900896 - protein, 9 aa, Homo Sapiens
CREELLKKM

SEQ ID NO: 900897 - protein, 9 aa, Homo Sapiens
VIKQLKETM

SEQ ID NO: 900898 - protein, 9 aa, Homo Sapiens
RESSLPNGQ

SEQ ID NO: 900899 - protein, 9 aa, Homo Sapiens
RTSNLVRHQ

SEQ ID NO: 900900 - protein, 9 aa, Homo Sapiens
FIAFYEDRK

SEQ ID NO: 900901 - protein, 9 aa, Homo Sapiens
EEECKTHHE

SEQ ID NO: 900902 - protein, 9 aa, Homo Sapiens
ALLRHQESS

SEQ ID NO: 900903 - protein, 9 aa, Homo Sapiens
PVDTVVEWK

SEQ ID NO: 900904 - protein, 9 aa, Homo Sapiens
DQYVAVCQP

SEQ ID NO: 900905 - protein, 9 aa, Homo Sapiens
PIDSLDTLV

SEQ ID NO: 900906 - protein, 9 aa, Homo Sapiens
NWNGIMKDM

SEQ ID NO: 900907 - protein, 9 aa, Homo Sapiens
NIHTVTKLF

SEQ ID NO: 900908 - protein, 9 aa, Homo Sapiens
KRAKMFCAR

SEQ ID NO: 900909 - protein, 9 aa, Homo Sapiens
SSSTGNSAP

SEQ ID NO: 900910 - protein, 9 aa, Homo Sapiens
PAQKVVNAQ

SEQ ID NO: 900911 - protein, 9 aa, Homo Sapiens
HLSGGKKVL

SEQ ID NO: 900912 - protein, 9 aa, Homo Sapiens
THLHERPAL

SEQ ID NO: 900913 - protein, 9 aa, Homo Sapiens
PQPLIPPPP

SEQ ID NO: 900914 - protein, 9 aa, Homo Sapiens
LRRWKGCVS

SEQ ID NO: 900915 - protein, 9 aa, Homo Sapiens
STVSTTMAT

SEQ ID NO: 900916 - protein, 9 aa, Homo Sapiens
NFIEAKYIA

SEQ ID NO: 900917 - protein, 9 aa, Homo Sapiens
QKISSKRLE

SEQ ID NO: 900918 - protein, 9 aa, Homo Sapiens
CMTTCCRPS

SEQ ID NO: 900919 - protein, 9 aa, Homo Sapiens
RRHQEGFKG

SEQ ID NO: 900920 - protein, 9 aa, Homo Sapiens
GSGLVTHLH

SEQ ID NO: 900921 - protein, 9 aa, Homo Sapiens
MHSVEKPYE

SEQ ID NO: 900922 - protein, 9 aa, Homo Sapiens
ETQKVHMKF

SEQ ID NO: 900923 - protein, 9 aa, Homo Sapiens
LKETMKIER

SEQ ID NO: 900924 - protein, 9 aa, Homo Sapiens
QALLMAEEE

SEQ ID NO: 900925 - protein, 9 aa, Homo Sapiens
DNFGKYGQE

SEQ ID NO: 900926 - protein, 9 aa, Homo Sapiens
YSDDNFGKY

SEQ ID NO: 900927 - protein, 9 aa, Homo Sapiens
ETSSSESSW

SEQ ID NO: 900928 - protein, 9 aa, Homo Sapiens
HVHFWIVFV

SEQ ID NO: 900929 - protein, 9 aa, Homo Sapiens
PSQRASTVS

SEQ ID NO: 900930 - protein, 9 aa, Homo Sapiens
ASWQRRTVE

SEQ ID NO: 900931 - protein, 9 aa, Homo Sapiens
GGLHVHFWI

SEQ ID NO: 900932 - protein, 9 aa, Homo Sapiens
QAHVRSYLC

SEQ ID NO: 900933 - protein, 9 aa, Homo Sapiens
VAIFIAFYE

SEQ ID NO: 900934 - protein, 9 aa, Homo Sapiens
PEKIQSPFS

SEQ ID NO: 900935 - protein, 9 aa, Homo Sapiens
WAAVYLSAC

SEQ ID NO: 900936 - protein, 9 aa, Homo Sapiens
MFCARQNCS

SEQ ID NO: 900937 - protein, 9 aa, Homo Sapiens
QQENGHFMD

SEQ ID NO: 900938 - protein, 9 aa, Homo Sapiens
KDETQKVHM

SEQ ID NO: 900939 - protein, 9 aa, Homo Sapiens
WYPYFCRMY

SEQ ID NO: 900940 - protein, 9 aa, Homo Sapiens
GHVLSSSTG

SEQ ID NO: 900941 - protein, 9 aa, Homo Sapiens
GGKKVLPMQ

SEQ ID NO: 900942 - protein, 9 aa, Homo Sapiens
HKNIHTVTK

SEQ ID NO: 900943 - protein, 9 aa, Homo Sapiens
SGLVTHLHE

SEQ ID NO: 900944 - protein, 9 aa, Homo Sapiens
LAIVGTLKF

SEQ ID NO: 900945 - protein, 9 aa, Homo Sapiens
GAAQECHES

SEQ ID NO: 900946 - protein, 9 aa, Homo Sapiens
RSEINQQTL

SEQ ID NO: 900947 - protein, 9 aa, Homo Sapiens
NDEKNNTKC

SEQ ID NO: 900948 - protein, 9 aa, Homo Sapiens
PVTSHGFTV

SEQ ID NO: 900949 - protein, 9 aa, Homo Sapiens
EDAWQPNFL

SEQ ID NO: 900950 - protein, 9 aa, Homo Sapiens
TEWQLLAAF

SEQ ID NO: 900951 - protein, 9 aa, Homo Sapiens
KLTLLQKID

SEQ ID NO: 900952 - protein, 9 aa, Homo Sapiens
HAVSVKMHS

SEQ ID NO: 900953 - protein, 9 aa, Homo Sapiens
HLHERPALL

SEQ ID NO: 900954 - protein, 9 aa, Homo Sapiens
SMLRAHWLR

SEQ ID NO: 900955 - protein, 9 aa, Homo Sapiens
AEECREELL

SEQ ID NO: 900956 - protein, 9 aa, Homo Sapiens
FTVKWDPPK

SEQ ID NO: 900957 - protein, 9 aa, Homo Sapiens
VRINGHVAG

SEQ ID NO: 900958 - protein, 9 aa, Homo Sapiens
PNGQSVSLM

SEQ ID NO: 900959 - protein, 9 aa, Homo Sapiens
YWENQPSGC

SEQ ID NO: 900960 - protein, 9 aa, Homo Sapiens
PPPPLVQSQ

SEQ ID NO: 900961 - protein, 9 aa, Homo Sapiens
DSLKTPGGS

SEQ ID NO: 900962 - protein, 9 aa, Homo Sapiens
CGASWQRRT

SEQ ID NO: 900963 - protein, 9 aa, Homo Sapiens
ILESNSTLK

SEQ ID NO: 900964 - protein, 9 aa, Homo Sapiens
AIRTGTKTQ

SEQ ID NO: 900965 - protein, 9 aa, Homo Sapiens
MLWYPYFCR

SEQ ID NO: 900966 - protein, 9 aa, Homo Sapiens
EASTRVRFI

SEQ ID NO: 900967 - protein, 9 aa, Homo Sapiens
TMDPDSFPH

SEQ ID NO: 900968 - protein, 9 aa, Homo Sapiens
IDYLSETSS

SEQ ID NO: 900969 - protein, 9 aa, Homo Sapiens
PAGGVDFNE

SEQ ID NO: 900970 - protein, 9 aa, Homo Sapiens
LVTHLHERP

SEQ ID NO: 900971 - protein, 9 aa, Homo Sapiens
GLKWCLYEL

SEQ ID NO: 900972 - protein, 9 aa, Homo Sapiens
GASWQRRTV

SEQ ID NO: 900973 - protein, 9 aa, Homo Sapiens
LDLELRDHE

SEQ ID NO: 900974 - protein, 9 aa, Homo Sapiens
SHDEEALED

SEQ ID NO: 900975 - protein, 9 aa, Homo Sapiens
FEDTEVRHS

SEQ ID NO: 900976 - protein, 9 aa, Homo Sapiens
LEGFQAFSK

SEQ ID NO: 900977 - protein, 9 aa, Homo Sapiens
TGLHPAGAA

SEQ ID NO: 900978 - protein, 9 aa, Homo Sapiens
YFILESNST

SEQ ID NO: 900979 - protein, 9 aa, Homo Sapiens
DDDLSHDEE

SEQ ID NO: 900980 - protein, 9 aa, Homo Sapiens
LMASHAIAP

SEQ ID NO: 900981 - protein, 9 aa, Homo Sapiens
KIQSPFSQK

SEQ ID NO: 900982 - protein, 9 aa, Homo Sapiens
IFIAFYEDR

SEQ ID NO: 900983 - protein, 9 aa, Homo Sapiens
MWGKLGVSP

SEQ ID NO: 900984 - protein, 9 aa, Homo Sapiens
HVAGPVPLH

SEQ ID NO: 900985 - protein, 9 aa, Homo Sapiens
RGGIGEGEG

SEQ ID NO: 900986 - protein, 9 aa, Homo Sapiens
NAQCGYDVR

SEQ ID NO: 900987 - protein, 9 aa, Homo Sapiens
QLYPAIPGV

SEQ ID NO: 900988 - protein, 9 aa, Homo Sapiens
ERLFPYANG

SEQ ID NO: 900989 - protein, 9 aa, Homo Sapiens
KETMKIERA

SEQ ID NO: 900990 - protein, 9 aa, Homo Sapiens
SNNKGGLHV

SEQ ID NO: 900991 - protein, 9 aa, Homo Sapiens
TGNSAPNSP

SEQ ID NO: 900992 - protein, 9 aa, Homo Sapiens
TESKRYEKD

SEQ ID NO: 900993 - protein, 9 aa, Homo Sapiens
VTKWDLVFE

SEQ ID NO: 900994 - protein, 9 aa, Homo Sapiens
QECHESHNG

SEQ ID NO: 900995 - protein, 9 aa, Homo Sapiens
TMERHERSS

SEQ ID NO: 900996 - protein, 9 aa, Homo Sapiens
EEMMRRHQE

SEQ ID NO: 900997 - protein, 9 aa, Homo Sapiens
RLVTQVTTR

SEQ ID NO: 900998 - protein, 9 aa, Homo Sapiens
RRWKGCVSP

SEQ ID NO: 900999 - protein, 9 aa, Homo Sapiens
HYAYAIVPS

SEQ ID NO: 901000 - protein, 9 aa, Homo Sapiens
SSSSRFTES

SEQ ID NO: 901001 - protein, 9 aa, Homo Sapiens
KVHMKFLVE

SEQ ID NO: 901002 - protein, 9 aa, Homo Sapiens
EKIQSPFSQ

SEQ ID NO: 901003 - protein, 9 aa, Homo Sapiens
IVDFFCQYV

SEQ ID NO: 901004 - protein, 9 aa, Homo Sapiens
FTLQPNYQT

SEQ ID NO: 901005 - protein, 9 aa, Homo Sapiens
MERHERSSP

SEQ ID NO: 901006 - protein, 9 aa, Homo Sapiens
MMRRHQEGF

SEQ ID NO: 901007 - protein, 9 aa, Homo Sapiens
PSPIPVLLI

SEQ ID NO: 901008 - protein, 9 aa, Homo Sapiens
PEEPSQRAS

SEQ ID NO: 901009 - protein, 9 aa, Homo Sapiens
VNAQCGYDV

SEQ ID NO: 901010 - protein, 9 aa, Homo Sapiens
IFLMAVFIL

SEQ ID NO: 901011 - protein, 9 aa, Homo Sapiens
TVMAFDQYV

SEQ ID NO: 901012 - protein, 9 aa, Homo Sapiens
SLPNGQSVS

SEQ ID NO: 901013 - protein, 9 aa, Homo Sapiens
LGRLQHVSG

SEQ ID NO: 901014 - protein, 9 aa, Homo Sapiens
QKMDPKMLS

SEQ ID NO: 901015 - protein, 9 aa, Homo Sapiens
KLACVDMTF

SEQ ID NO: 901016 - protein, 9 aa, Homo Sapiens
ASHAIAPTL

SEQ ID NO: 901017 - protein, 9 aa, Homo Sapiens
DQFSFRSFR

SEQ ID NO: 901018 - protein, 9 aa, Homo Sapiens
VDMTFNEAE

SEQ ID NO: 901019 - protein, 9 aa, Homo Sapiens
ARPALMASH

SEQ ID NO: 901020 - protein, 9 aa, Homo Sapiens
RVGDGSVLQ

SEQ ID NO: 901021 - protein, 9 aa, Homo Sapiens
MPPKNVVEL

SEQ ID NO: 901022 - protein, 9 aa, Homo Sapiens
ESKRYEKDF

SEQ ID NO: 901023 - protein, 9 aa, Homo Sapiens
RHSNFDNFP

SEQ ID NO: 901024 - protein, 9 aa, Homo Sapiens
YLQLYPAIP

SEQ ID NO: 901025 - protein, 9 aa, Homo Sapiens
VTQKMDPKM

SEQ ID NO: 901026 - protein, 9 aa, Homo Sapiens
LSGGKKVLP

SEQ ID NO: 901027 - protein, 9 aa, Homo Sapiens
ITSSEVSSS

SEQ ID NO: 901028 - protein, 9 aa, Homo Sapiens
CVSPSASSP

SEQ ID NO: 901029 - protein, 9 aa, Homo Sapiens
WKGCVSPSA

SEQ ID NO: 901030 - protein, 9 aa, Homo Sapiens
WHEEHRGIL

SEQ ID NO: 901031 - protein, 9 aa, Homo Sapiens
IVMPPKNVV

SEQ ID NO: 901032 - protein, 9 aa, Homo Sapiens
PSTDLKMWG

SEQ ID NO: 901033 - protein, 9 aa, Homo Sapiens
RHQEGFKGT

SEQ ID NO: 901034 - protein, 9 aa, Homo Sapiens
ITINFLTDS

SEQ ID NO: 901035 - protein, 9 aa, Homo Sapiens
AIFIAFYED

SEQ ID NO: 901036 - protein, 9 aa, Homo Sapiens
QSVSLMDLQ

SEQ ID NO: 901037 - protein, 9 aa, Homo Sapiens
ISLMELALG

SEQ ID NO: 901038 - protein, 9 aa, Homo Sapiens
ATEFHDYER

SEQ ID NO: 901039 - protein, 9 aa, Homo Sapiens
HDYERGGIG

SEQ ID NO: 901040 - protein, 9 aa, Homo Sapiens
FAEYPPEGC

SEQ ID NO: 901041 - protein, 9 aa, Homo Sapiens
GDGSVLQTI

SEQ ID NO: 901042 - protein, 9 aa, Homo Sapiens
ACKDSKKKA

SEQ ID NO: 901043 - protein, 9 aa, Homo Sapiens
YLSACKDSK

SEQ ID NO: 901044 - protein, 9 aa, Homo Sapiens
QPNYQTIIN

SEQ ID NO: 901045 - protein, 9 aa, Homo Sapiens
SKKEREEEC

SEQ ID NO: 901046 - protein, 9 aa, Homo Sapiens
GDDQFSFRS

SEQ ID NO: 901047 - protein, 9 aa, Homo Sapiens
PVLLITEIF

SEQ ID NO: 901048 - protein, 9 aa, Homo Sapiens
KAAKASGIV

SEQ ID NO: 901049 - protein, 9 aa, Homo Sapiens
NLPSKRVSV

SEQ ID NO: 901050 - protein, 9 aa, Homo Sapiens
KPAGGVDFN

SEQ ID NO: 901051 - protein, 9 aa, Homo Sapiens
VFESQPLNS

SEQ ID NO: 901052 - protein, 9 aa, Homo Sapiens
PLHPYATGL

SEQ ID NO: 901053 - protein, 9 aa, Homo Sapiens
IEWAAEECR

SEQ ID NO: 901054 - protein, 9 aa, Homo Sapiens
RLQHVSGEE

SEQ ID NO: 901055 - protein, 9 aa, Homo Sapiens
LKPFGDMPR

SEQ ID NO: 901056 - protein, 9 aa, Homo Sapiens
ESSLPNGQS

SEQ ID NO: 901057 - protein, 9 aa, Homo Sapiens
MDVLGRLQH

SEQ ID NO: 901058 - protein, 9 aa, Homo Sapiens
WQILVRPWR

SEQ ID NO: 901059 - protein, 9 aa, Homo Sapiens
FQSWQILVR

SEQ ID NO: 901060 - protein, 9 aa, Homo Sapiens
DERLFPYAN

SEQ ID NO: 901061 - protein, 9 aa, Homo Sapiens
KPFGDMPRK

SEQ ID NO: 901062 - protein, 9 aa, Homo Sapiens
HSIFLPVDT

SEQ ID NO: 901063 - protein, 9 aa, Homo Sapiens
FSQQENGHF

SEQ ID NO: 901064 - protein, 9 aa, Homo Sapiens
GSEMESPRN

SEQ ID NO: 901065 - protein, 9 aa, Homo Sapiens
STGNSAPNS

SEQ ID NO: 901066 - protein, 9 aa, Homo Sapiens
QFSFRSFRS

SEQ ID NO: 901067 - protein, 9 aa, Homo Sapiens
PILHGQGKE

SEQ ID NO: 901068 - protein, 9 aa, Homo Sapiens
MGNTNEAST

SEQ ID NO: 901069 - protein, 9 aa, Homo Sapiens
LEKRCEHRL

SEQ ID NO: 901070 - protein, 9 aa, Homo Sapiens
VPDLIALNL

SEQ ID NO: 901071 - protein, 9 aa, Homo Sapiens
RKYFKEAGN

SEQ ID NO: 901072 - protein, 9 aa, Homo Sapiens
CCMTTCCRP

SEQ ID NO: 901073 - protein, 9 aa, Homo Sapiens
LITEWQLLA

SEQ ID NO: 901074 - protein, 9 aa, Homo Sapiens
HSNFDNFPQ

SEQ ID NO: 901075 - protein, 9 aa, Homo Sapiens
QEEMMRRHQ

SEQ ID NO: 901076 - protein, 9 aa, Homo Sapiens
SIFLPVDTV

SEQ ID NO: 901077 - protein, 9 aa, Homo Sapiens
AVHYAYAIV

SEQ ID NO: 901078 - protein, 9 aa, Homo Sapiens
FLMAKPQND

SEQ ID NO: 901079 - protein, 9 aa, Homo Sapiens
QLKPFGDMP

SEQ ID NO: 901080 - protein, 9 aa, Homo Sapiens
KVLPMQVTQ

SEQ ID NO: 901081 - protein, 9 aa, Homo Sapiens
GIVDFFCQY

SEQ ID NO: 901082 - protein, 9 aa, Homo Sapiens
TKWDLVFES

SEQ ID NO: 901083 - protein, 9 aa, Homo Sapiens
CSSTCGASW

SEQ ID NO: 901084 - protein, 9 aa, Homo Sapiens
KCDFLKNTE

SEQ ID NO: 901085 - protein, 9 aa, Homo Sapiens
AVSVKMHSV

SEQ ID NO: 901086 - protein, 9 aa, Homo Sapiens
HGQGKEKAV

SEQ ID NO: 901087 - protein, 9 aa, Homo Sapiens
GHTEDAWQP

SEQ ID NO: 901088 - protein, 9 aa, Homo Sapiens
WFMGEILAN

SEQ ID NO: 901089 - protein, 9 aa, Homo Sapiens
QGFTLQPNY

SEQ ID NO: 901090 - protein, 9 aa, Homo Sapiens
TGSEMESPR

SEQ ID NO: 901091 - protein, 9 aa, Homo Sapiens
EGECYIQFF

SEQ ID NO: 901092 - protein, 9 aa, Homo Sapiens
KYFKEAGNV

SEQ ID NO: 901093 - protein, 9 aa, Homo Sapiens
CTDKQIRQV

SEQ ID NO: 901094 - protein, 9 aa, Homo Sapiens
HRLETNKLQ

SEQ ID NO: 901095 - protein, 9 aa, Homo Sapiens
KALIRSTHL

SEQ ID NO: 901096 - protein, 9 aa, Homo Sapiens
FKEAGNVPE

SEQ ID NO: 901097 - protein, 9 aa, Homo Sapiens
KRCEHRLQD

SEQ ID NO: 901098 - protein, 9 aa, Homo Sapiens
PTGWSAVAR

SEQ ID NO: 901099 - protein, 9 aa, Homo Sapiens
HQEGFKGTF

SEQ ID NO: 901100 - protein, 9 aa, Homo Sapiens
EETQALLMA

SEQ ID NO: 901101 - protein, 9 aa, Homo Sapiens
ALAIVGTLK

SEQ ID NO: 901102 - protein, 9 aa, Homo Sapiens
GNTGMHRLR

SEQ ID NO: 901103 - protein, 9 aa, Homo Sapiens
EECKTHHEM

SEQ ID NO: 901104 - protein, 9 aa, Homo Sapiens
AGNVPEPEE

SEQ ID NO: 901105 - protein, 9 aa, Homo Sapiens
ERGGIGEGE

SEQ ID NO: 901106 - protein, 9 aa, Homo Sapiens
WYMTVTQKM

SEQ ID NO: 901107 - protein, 9 aa, Homo Sapiens
ACVIGKQMK

SEQ ID NO: 901108 - protein, 9 aa, Homo Sapiens
AGPVPLHPY

SEQ ID NO: 901109 - protein, 9 aa, Homo Sapiens
PRCGHHHRQ

SEQ ID NO: 901110 - protein, 9 aa, Homo Sapiens
LFQSWQILV

SEQ ID NO: 901111 - protein, 9 aa, Homo Sapiens
HSLQCPRCG

SEQ ID NO: 901112 - protein, 9 aa, Homo Sapiens
DQLKPFGDM

SEQ ID NO: 901113 - protein, 9 aa, Homo Sapiens
NKLQNVAKM

SEQ ID NO: 901114 - protein, 9 aa, Homo Sapiens
HTVTKLFEC

SEQ ID NO: 901115 - protein, 9 aa, Homo Sapiens
FKDKNLQAP

SEQ ID NO: 901116 - protein, 9 aa, Homo Sapiens
PKNVVELFG

SEQ ID NO: 901117 - protein, 9 aa, Homo Sapiens
PSASPILHG

SEQ ID NO: 901118 - protein, 9 aa, Homo Sapiens
HWLRHGGER

SEQ ID NO: 901119 - protein, 9 aa, Homo Sapiens
TVLQDERLF

SEQ ID NO: 901120 - protein, 9 aa, Homo Sapiens
NTGMHRLRG

SEQ ID NO: 901121 - protein, 9 aa, Homo Sapiens
KGCVSPSAS

SEQ ID NO: 901122 - protein, 9 aa, Homo Sapiens
PPLPPTMER

SEQ ID NO: 901123 - protein, 9 aa, Homo Sapiens
DLSSDDDLS

SEQ ID NO: 901124 - protein, 9 aa, Homo Sapiens
MTTCCRPSC

SEQ ID NO: 901125 - protein, 9 aa, Homo Sapiens
DFLKNTEVS

SEQ ID NO: 901126 - protein, 9 aa, Homo Sapiens
NQLQRGDRS

SEQ ID NO: 901127 - protein, 9 aa, Homo Sapiens
AGAAQECHE

SEQ ID NO: 901128 - protein, 9 aa, Homo Sapiens
SLQCPRCGH

SEQ ID NO: 901129 - protein, 9 aa, Homo Sapiens
EFHDYERGG

SEQ ID NO: 901130 - protein, 9 aa, Homo Sapiens
SGGKKVLPM

SEQ ID NO: 901131 - protein, 9 aa, Homo Sapiens
EINQQTLPT

SEQ ID NO: 901132 - protein, 9 aa, Homo Sapiens
SPILHGQGK

SEQ ID NO: 901133 - protein, 9 aa, Homo Sapiens
SPVITSSEV

SEQ ID NO: 901134 - protein, 9 aa, Homo Sapiens
TESGAIEMT

SEQ ID NO: 901135 - protein, 9 aa, Homo Sapiens
LPPAIRTGT

SEQ ID NO: 901136 - protein, 9 aa, Homo Sapiens
SSMPFAEYP

SEQ ID NO: 901137 - protein, 9 aa, Homo Sapiens
CVDMTFNEA

SEQ ID NO: 901138 - protein, 9 aa, Homo Sapiens
LESNSTLKE

SEQ ID NO: 901139 - protein, 9 aa, Homo Sapiens
DSVGNRTLE

SEQ ID NO: 901140 - protein, 9 aa, Homo Sapiens
SHGFTVKWD

SEQ ID NO: 901141 - protein, 9 aa, Homo Sapiens
MLRDCTHDE

SEQ ID NO: 901142 - protein, 9 aa, Homo Sapiens
VGNRTLEGF

SEQ ID NO: 901143 - protein, 9 aa, Homo Sapiens
AVRQEMRCQ

SEQ ID NO: 901144 - protein, 9 aa, Homo Sapiens
TLQKNLEEQ

SEQ ID NO: 901145 - protein, 9 aa, Homo Sapiens
SGSGLVTHL

SEQ ID NO: 901146 - protein, 9 aa, Homo Sapiens
ACKDSKKVQ

SEQ ID NO: 901147 - protein, 9 aa, Homo Sapiens
MTFNEAELF

SEQ ID NO: 901148 - protein, 9 aa, Homo Sapiens
TQKVHMKFL

SEQ ID NO: 901149 - protein, 9 aa, Homo Sapiens
GISLMELAL

SEQ ID NO: 901150 - protein, 9 aa, Homo Sapiens
TLLQKIDNI

SEQ ID NO: 901151 - protein, 9 aa, Homo Sapiens
TLPTPTPRP

SEQ ID NO: 901152 - protein, 9 aa, Homo Sapiens
ANQLQRGDR

SEQ ID NO: 901153 - protein, 9 aa, Homo Sapiens
QLKETMKIE

SEQ ID NO: 901154 - protein, 9 aa, Homo Sapiens
LEEQKISSK

SEQ ID NO: 901155 - protein, 9 aa, Homo Sapiens
TTVLQDERL

SEQ ID NO: 901156 - protein, 9 aa, Homo Sapiens
DMMGNTNEA

SEQ ID NO: 901157 - protein, 9 aa, Homo Sapiens
CVIGKQMKA

SEQ ID NO: 901158 - protein, 9 aa, Homo Sapiens
TEVRHSNFD

SEQ ID NO: 901159 - protein, 9 aa, Homo Sapiens
NLSSLRKMA

SEQ ID NO: 901160 - protein, 9 aa, Homo Sapiens
VGTLKFNPE

SEQ ID NO: 901161 - protein, 9 aa, Homo Sapiens
LAVFKDKNL

SEQ ID NO: 901162 - protein, 9 aa, Homo Sapiens
YLCRSRLQR

SEQ ID NO: 901163 - protein, 9 aa, Homo Sapiens
LQDERLFPY

SEQ ID NO: 901164 - protein, 9 aa, Homo Sapiens
SHNGESPRH

SEQ ID NO: 901165 - protein, 9 aa, Homo Sapiens
ICEKALIRS

SEQ ID NO: 901166 - protein, 9 aa, Homo Sapiens
QENGHFMDT

SEQ ID NO: 901167 - protein, 9 aa, Homo Sapiens
DLSHDEEAL

SEQ ID NO: 901168 - protein, 9 aa, Homo Sapiens
IVPLGLCYI

SEQ ID NO: 901169 - protein, 9 aa, Homo Sapiens
KMDPKMLSK

SEQ ID NO: 901170 - protein, 9 aa, Homo Sapiens
AAKASGIVV

SEQ ID NO: 901171 - protein, 9 aa, Homo Sapiens
RAHWLRHGG

SEQ ID NO: 901172 - protein, 9 aa, Homo Sapiens
FRKYFKEAG

SEQ ID NO: 901173 - protein, 9 aa, Homo Sapiens
TNEASTRVR

SEQ ID NO: 901174 - protein, 9 aa, Homo Sapiens
ECTDKQIRQ

SEQ ID NO: 901175 - protein, 9 aa, Homo Sapiens
IQQPQPLIP

SEQ ID NO: 901176 - protein, 9 aa, Homo Sapiens
LPNGQSVSL

SEQ ID NO: 901177 - protein, 9 aa, Homo Sapiens
GGRPGLQGP

SEQ ID NO: 901178 - protein, 9 aa, Homo Sapiens
EKRCEHRLQ

SEQ ID NO: 901179 - protein, 9 aa, Homo Sapiens
TTYTMSGRM

SEQ ID NO: 901180 - protein, 9 aa, Homo Sapiens
LLYLGNTGM

SEQ ID NO: 901181 - protein, 9 aa, Homo Sapiens
NQVNKARGA

SEQ ID NO: 901182 - protein, 9 aa, Homo Sapiens
MASHAIAPT

SEQ ID NO: 901183 - protein, 9 aa, Homo Sapiens
TDKQIRQVN

SEQ ID NO: 901184 - protein, 9 aa, Homo Sapiens
DMPRKLKIQ

SEQ ID NO: 901185 - protein, 9 aa, Homo Sapiens
HFMDTNECI

SEQ ID NO: 901186 - protein, 9 aa, Homo Sapiens
TVKWDPPKD

SEQ ID NO: 901187 - protein, 9 aa, Homo Sapiens
GKGFSRTSN

SEQ ID NO: 901188 - protein, 9 aa, Homo Sapiens
IMDVLGRLQ

SEQ ID NO: 901189 - protein, 9 aa, Homo Sapiens
VPLGLCYID

SEQ ID NO: 901190 - protein, 9 aa, Homo Sapiens
RPALMASHA

SEQ ID NO: 901191 - protein, 9 aa, Homo Sapiens
LTFSSYGLK

SEQ ID NO: 901192 - protein, 9 aa, Homo Sapiens
TQALLMAEE

SEQ ID NO: 901193 - protein, 9 aa, Homo Sapiens
LLQKIDNIS

SEQ ID NO: 901194 - protein, 9 aa, Homo Sapiens
KQLDLELRD

SEQ ID NO: 901195 - protein, 9 aa, Homo Sapiens
CDFLKNTEV

SEQ ID NO: 901196 - protein, 9 aa, Homo Sapiens
QKVHMKFLV

SEQ ID NO: 901197 - protein, 9 aa, Homo Sapiens
DLVFESQPL

SEQ ID NO: 901198 - protein, 9 aa, Homo Sapiens
SCCMTTCCR

SEQ ID NO: 901199 - protein, 9 aa, Homo Sapiens
THRLVTQVT

SEQ ID NO: 901200 - protein, 9 aa, Homo Sapiens
VLLCPTGWS

SEQ ID NO: 901201 - protein, 9 aa, Homo Sapiens
CQEPLPPPP

SEQ ID NO: 901202 - protein, 9 aa, Homo Sapiens
GMHRLRGSF

SEQ ID NO: 901203 - protein, 9 aa, Homo Sapiens
TQKMDPKML

SEQ ID NO: 901204 - protein, 9 aa, Homo Sapiens
SMPFAEYPP

SEQ ID NO: 901205 - protein, 9 aa, Homo Sapiens
NLEEQKISS

SEQ ID NO: 901206 - protein, 9 aa, Homo Sapiens
KKDETQKVH

SEQ ID NO: 901207 - protein, 9 aa, Homo Sapiens
GFTLQPNYQ

SEQ ID NO: 901208 - protein, 9 aa, Homo Sapiens
QSPFSQKYQ

SEQ ID NO: 901209 - protein, 9 aa, Homo Sapiens
HEEHRGILR

SEQ ID NO: 901210 - protein, 9 aa, Homo Sapiens
EDTEVRHSN

SEQ ID NO: 901211 - protein, 9 aa, Homo Sapiens
SLSQTTYTM

SEQ ID NO: 901212 - protein, 9 aa, Homo Sapiens
PQNDEKNNT

SEQ ID NO: 901213 - protein, 9 aa, Homo Sapiens
SSQATLHIT

SEQ ID NO: 901214 - protein, 9 aa, Homo Sapiens
CHESHNGES

SEQ ID NO: 901215 - protein, 9 aa, Homo Sapiens
DEETQALLM

SEQ ID NO: 901216 - protein, 9 aa, Homo Sapiens
KDKNLQAPM

SEQ ID NO: 901217 - protein, 9 aa, Homo Sapiens
NQPSGCQKL

SEQ ID NO: 901218 - protein, 9 aa, Homo Sapiens
AWQPNFLHP

SEQ ID NO: 901219 - protein, 9 aa, Homo Sapiens
KEREEECKT

SEQ ID NO: 901220 - protein, 9 aa, Homo Sapiens
PHWNVVVDG

SEQ ID NO: 901221 - protein, 9 aa, Homo Sapiens
CKPSCCMTT

SEQ ID NO: 901222 - protein, 9 aa, Homo Sapiens
FSRTSNLVR

SEQ ID NO: 901223 - protein, 9 aa, Homo Sapiens
GHVAGPVPL

SEQ ID NO: 901224 - protein, 9 aa, Homo Sapiens
LVFESQPLN

SEQ ID NO: 901225 - protein, 9 aa, Homo Sapiens
PGLQGPRGD

SEQ ID NO: 901226 - protein, 9 aa, Homo Sapiens
LQHVSGEEI

SEQ ID NO: 901227 - protein, 9 aa, Homo Sapiens
RDHEGSTAL

SEQ ID NO: 901228 - protein, 9 aa, Homo Sapiens
EQKISSKRL

SEQ ID NO: 901229 - protein, 9 aa, Homo Sapiens
SSTCGASWQ

SEQ ID NO: 901230 - protein, 9 aa, Homo Sapiens
GPVPLHPYA

SEQ ID NO: 901231 - protein, 9 aa, Homo Sapiens
NSTLKEAIL

SEQ ID NO: 901232 - protein, 9 aa, Homo Sapiens
LSQTTYTMS

SEQ ID NO: 901233 - protein, 9 aa, Homo Sapiens
KRKMNLEIQ

SEQ ID NO: 901234 - protein, 9 aa, Homo Sapiens
EREEECKTH

SEQ ID NO: 901235 - protein, 9 aa, Homo Sapiens
EPSQRASTV

SEQ ID NO: 901236 - protein, 9 aa, Homo Sapiens
ECREELLKK

SEQ ID NO: 901237 - protein, 9 aa, Homo Sapiens
HWNVVVDGC

SEQ ID NO: 901238 - protein, 9 aa, Homo Sapiens
AHVRSYLCR

SEQ ID NO: 901239 - protein, 9 aa, Homo Sapiens
HRLVTQVTT

SEQ ID NO: 901240 - protein, 9 aa, Homo Sapiens
SEMESPRNP

SEQ ID NO: 901241 - protein, 9 aa, Homo Sapiens
VIQAHVRSY

SEQ ID NO: 901242 - protein, 9 aa, Homo Sapiens
NVFTCSLMI

SEQ ID NO: 901243 - protein, 9 aa, Homo Sapiens
PFAEYPPEG

SEQ ID NO: 901244 - protein, 9 aa, Homo Sapiens
VDFFCQYVM

SEQ ID NO: 901245 - protein, 9 aa, Homo Sapiens
NVPANFIEA

SEQ ID NO: 901246 - protein, 9 aa, Homo Sapiens
IVGTLKFNP

SEQ ID NO: 901247 - protein, 9 aa, Homo Sapiens
DPDSFPHWN

SEQ ID NO: 901248 - protein, 9 aa, Homo Sapiens
KRVSVSRSQ

SEQ ID NO: 901249 - protein, 9 aa, Homo Sapiens
LVPDLIALN

SEQ ID NO: 901250 - protein, 9 aa, Homo Sapiens
RLETNKLQN

SEQ ID NO: 901251 - protein, 9 aa, Homo Sapiens
RKAAKASGI

SEQ ID NO: 901252 - protein, 9 aa, Homo Sapiens
YPPEGCLAS

SEQ ID NO: 901253 - protein, 9 aa, Homo Sapiens
TSHGFTVKW

SEQ ID NO: 901254 - protein, 9 aa, Homo Sapiens
IQAHVRSYL

SEQ ID NO: 901255 - protein, 9 aa, Homo Sapiens
TGMHRLRGS

SEQ ID NO: 901256 - protein, 9 aa, Homo Sapiens
ILVPDLIAL

SEQ ID NO: 901257 - protein, 9 aa, Homo Sapiens
SYGLKWCLY

SEQ ID NO: 901258 - protein, 9 aa, Homo Sapiens
KGFSRTSNL

SEQ ID NO: 901259 - protein, 9 aa, Homo Sapiens
FSSYGLKWC

SEQ ID NO: 901260 - protein, 9 aa, Homo Sapiens
FYEDRKKVI

SEQ ID NO: 901261 - protein, 9 aa, Homo Sapiens
TPIVPLGLC

SEQ ID NO: 901262 - protein, 9 aa, Homo Sapiens
LPTPTPRPP

SEQ ID NO: 901263 - protein, 9 aa, Homo Sapiens
SQRASTVST

SEQ ID NO: 901264 - protein, 9 aa, Homo Sapiens
EAVRQEMRC

SEQ ID NO: 901265 - protein, 9 aa, Homo Sapiens
SPRHSLQCP

SEQ ID NO: 901266 - protein, 9 aa, Homo Sapiens
MTVTQKMDP

SEQ ID NO: 901267 - protein, 9 aa, Homo Sapiens
EGGRPGLQG

SEQ ID NO: 901268 - protein, 9 aa, Homo Sapiens
LCYIDDFAK

SEQ ID NO: 901269 - protein, 9 aa, Homo Sapiens
KQIRQVNEI

SEQ ID NO: 901270 - protein, 9 aa, Homo Sapiens
DMTFNEAEL

SEQ ID NO: 901271 - protein, 9 aa, Homo Sapiens
VFKDKNLQA

SEQ ID NO: 901272 - protein, 9 aa, Homo Sapiens
QDERLFPYA

SEQ ID NO: 901273 - protein, 9 aa, Homo Sapiens
EKRAKMFCA

SEQ ID NO: 901274 - protein, 9 aa, Homo Sapiens
QILVRPWRA

SEQ ID NO: 901275 - protein, 9 aa, Homo Sapiens
DLITEWQLL

SEQ ID NO: 901276 - protein, 9 aa, Homo Sapiens
SFPHWNVVV

SEQ ID NO: 901277 - protein, 9 aa, Homo Sapiens
ALGPSPIPV

SEQ ID NO: 901278 - protein, 9 aa, Homo Sapiens
VRSYLCRSR

SEQ ID NO: 901279 - protein, 9 aa, Homo Sapiens
QTLPTPTPR

SEQ ID NO: 901280 - protein, 9 aa, Homo Sapiens
VSKCGINLS

SEQ ID NO: 901281 - protein, 9 aa, Homo Sapiens
TNKLQNVAK

SEQ ID NO: 901282 - protein, 9 aa, Homo Sapiens
LANVFTCSL

SEQ ID NO: 901283 - protein, 9 aa, Homo Sapiens
SWQRRTVEC

SEQ ID NO: 901284 - protein, 9 aa, Homo Sapiens
MMGNTNEAS

SEQ ID NO: 901285 - protein, 9 aa, Homo Sapiens
NGQSVSLMD

SEQ ID NO: 901286 - protein, 9 aa, Homo Sapiens
CGKGFSRTS

SEQ ID NO: 901287 - protein, 9 aa, Homo Sapiens
QSWQILVRP

SEQ ID NO: 901288 - protein, 9 aa, Homo Sapiens
GLVTHLHER

SEQ ID NO: 901289 - protein, 9 aa, Homo Sapiens
CPRCGHHHR

SEQ ID NO: 901290 - protein, 9 aa, Homo Sapiens
IVGVRTVEE

SEQ ID NO: 901291 - protein, 9 aa, Homo Sapiens
HMKFLVEQM

SEQ ID NO: 901292 - protein, 9 aa, Homo Sapiens
VTALAIVGT

SEQ ID NO: 901293 - protein, 9 aa, Homo Sapiens
KPQNDEKNN

SEQ ID NO: 901294 - protein, 9 aa, Homo Sapiens
TKRKMNLEI

SEQ ID NO: 901295 - protein, 9 aa, Homo Sapiens
PLFQTTESG

SEQ ID NO: 901296 - protein, 9 aa, Homo Sapiens
IKQLKETMK

SEQ ID NO: 901297 - protein, 9 aa, Homo Sapiens
LSSDDDLSH

SEQ ID NO: 901298 - protein, 9 aa, Homo Sapiens
RHQESSHYI

SEQ ID NO: 901299 - protein, 9 aa, Homo Sapiens
NTNEASTRV

SEQ ID NO: 901300 - protein, 9 aa, Homo Sapiens
RINGHVAGP

SEQ ID NO: 901301 - protein, 9 aa, Homo Sapiens
DETQKVHMK

SEQ ID NO: 901302 - protein, 9 aa, Homo Sapiens
GLFVIIFAA

SEQ ID NO: 901303 - protein, 9 aa, Homo Sapiens
LMAKPQNDE

SEQ ID NO: 901304 - protein, 9 aa, Homo Sapiens
WQLLAAFEQ

SEQ ID NO: 901305 - protein, 9 aa, Homo Sapiens
STCGASWQR

SEQ ID NO: 901306 - protein, 9 aa, Homo Sapiens
SQATLHITV

SEQ ID NO: 901307 - protein, 9 aa, Homo Sapiens
SDKCDFLKN

SEQ ID NO: 901308 - protein, 9 aa, Homo Sapiens
MRRHQEGFK

SEQ ID NO: 901309 - protein, 9 aa, Homo Sapiens
LLAVFKDKN

SEQ ID NO: 901310 - protein, 9 aa, Homo Sapiens
KMNLEIQEL

SEQ ID NO: 901311 - protein, 9 aa, Homo Sapiens
PYATGLHPA

SEQ ID NO: 901312 - protein, 9 aa, Homo Sapiens
SSSMPFAEY

SEQ ID NO: 901313 - protein, 9 aa, Homo Sapiens
WAAEECREE

SEQ ID NO: 901314 - protein, 9 aa, Homo Sapiens
KCGINLSSL

SEQ ID NO: 901315 - protein, 9 aa, Homo Sapiens
PPAIRTGTK

SEQ ID NO: 901316 - protein, 9 aa, Homo Sapiens
IVLLAVFKD

SEQ ID NO: 901317 - protein, 9 aa, Homo Sapiens
VIGKQMKAL

SEQ ID NO: 901318 - protein, 9 aa, Homo Sapiens
VPANFIEAK

SEQ ID NO: 901319 - protein, 9 aa, Homo Sapiens
DFEDTEVRH

SEQ ID NO: 901320 - protein, 9 aa, Homo Sapiens
NQQTLPTPT

SEQ ID NO: 901321 - protein, 9 aa, Homo Sapiens
RVLLCPTGW

SEQ ID NO: 901322 - protein, 9 aa, Homo Sapiens
AQECHESHN

SEQ ID NO: 901323 - protein, 9 aa, Homo Sapiens
HESHNGESP

SEQ ID NO: 901324 - protein, 9 aa, Homo Sapiens
RSYLCRSRL

SEQ ID NO: 901325 - protein, 9 aa, Homo Sapiens
LLRHQESSH

SEQ ID NO: 901326 - protein, 9 aa, Homo Sapiens
ECKTHHEMK

SEQ ID NO: 901327 - protein, 9 aa, Homo Sapiens
QKVVNAQCG

SEQ ID NO: 901328 - protein, 9 aa, Homo Sapiens
MSGRMATAP

SEQ ID NO: 901329 - protein, 9 aa, Homo Sapiens
IMKDMLRDC

SEQ ID NO: 901330 - protein, 9 aa, Homo Sapiens
AVYLSACKD

SEQ ID NO: 901331 - protein, 9 aa, Homo Sapiens
EEQKISSKR

SEQ ID NO: 901332 - protein, 9 aa, Homo Sapiens
SGKSTTTGL

SEQ ID NO: 901333 - protein, 9 aa, Homo Sapiens
MDPDSFPHW

SEQ ID NO: 901334 - protein, 9 aa, Homo Sapiens
TLQPNYQTI

SEQ ID NO: 901335 - protein, 9 aa, Homo Sapiens
IQSPFSQKY

SEQ ID NO: 901336 - protein, 9 aa, Homo Sapiens
VLQDERLFP

SEQ ID NO: 901337 - protein, 9 aa, Homo Sapiens
YTMSGRMAT

SEQ ID NO: 901338 - protein, 9 aa, Homo Sapiens
YLGLFVIIF

SEQ ID NO: 901339 - protein, 9 aa, Homo Sapiens
RMECTDKQI

SEQ ID NO: 901340 - protein, 9 aa, Homo Sapiens
ESHNGESPR

SEQ ID NO: 901341 - protein, 9 aa, Homo Sapiens
GNRTLEGFQ

SEQ ID NO: 901342 - protein, 9 aa, Homo Sapiens
RHSLQCPRC

SEQ ID NO: 901343 - protein, 9 aa, Homo Sapiens
TKLFECKEC

SEQ ID NO: 901344 - protein, 9 aa, Homo Sapiens
SETSSSESS

SEQ ID NO: 901345 - protein, 9 aa, Homo Sapiens
QLDLELRDH

SEQ ID NO: 901346 - protein, 9 aa, Homo Sapiens
ETGDDQFSF

SEQ ID NO: 901347 - protein, 9 aa, Homo Sapiens
AFYEDRKKV

SEQ ID NO: 901348 - protein, 9 aa, Homo Sapiens
VVNAQCGYD

SEQ ID NO: 901349 - protein, 9 aa, Homo Sapiens
MRCQEPLPP

SEQ ID NO: 901350 - protein, 9 aa, Homo Sapiens
TFSSYGLKW

SEQ ID NO: 901351 - protein, 9 aa, Homo Sapiens
KFSLTPIDS

SEQ ID NO: 901352 - protein, 9 aa, Homo Sapiens
ILREDAVLE

SEQ ID NO: 901353 - protein, 9 aa, Homo Sapiens
LTEFIIFLM

SEQ ID NO: 901354 - protein, 9 aa, Homo Sapiens
REEECKTHH

SEQ ID NO: 901355 - protein, 9 aa, Homo Sapiens
ARAVHYAYA

SEQ ID NO: 901356 - protein, 9 aa, Homo Sapiens
DSGSGLVTH

SEQ ID NO: 901357 - protein, 9 aa, Homo Sapiens
KASGIVVPS

SEQ ID NO: 901358 - protein, 9 aa, Homo Sapiens
QCPRCGHHH

SEQ ID NO: 901359 - protein, 9 aa, Homo Sapiens
IRKAAKASG

SEQ ID NO: 901360 - protein, 9 aa, Homo Sapiens
QKNLEEQKI

SEQ ID NO: 901361 - protein, 9 aa, Homo Sapiens
AQCGYDVRI

SEQ ID NO: 901362 - protein, 9 aa, Homo Sapiens
NYQTIINPT

SEQ ID NO: 901363 - protein, 9 aa, Homo Sapiens
EMESPRNPS

SEQ ID NO: 901364 - protein, 9 aa, Homo Sapiens
RASTVSTTM

SEQ ID NO: 901365 - protein, 9 aa, Homo Sapiens
ITEWQLLAA

SEQ ID NO: 901366 - protein, 9 aa, Homo Sapiens
KKEREEECK

SEQ ID NO: 901367 - protein, 9 aa, Homo Sapiens
VDTVVEWKF

SEQ ID NO: 901368 - protein, 9 aa, Homo Sapiens
ATGLHPAGA

SEQ ID NO: 901369 - protein, 9 aa, Homo Sapiens
KMHSVEKPY

SEQ ID NO: 901370 - protein, 9 aa, Homo Sapiens
GLLIYKCGG

SEQ ID NO: 901371 - protein, 9 aa, Homo Sapiens
TLKEAILKK

SEQ ID NO: 901372 - protein, 9 aa, Homo Sapiens
EIQELRRQL

SEQ ID NO: 901373 - protein, 9 aa, Homo Sapiens
IPVLLITEI

SEQ ID NO: 901374 - protein, 9 aa, Homo Sapiens
PLPPTMERH

SEQ ID NO: 901375 - protein, 9 aa, Homo Sapiens
ALMASHAIA

SEQ ID NO: 901376 - protein, 9 aa, Homo Sapiens
TEFHDYERG

SEQ ID NO: 901377 - protein, 9 aa, Homo Sapiens
DKCDFLKNT

SEQ ID NO: 901378 - protein, 9 aa, Homo Sapiens
GPSPIPVLL

SEQ ID NO: 901379 - protein, 9 aa, Homo Sapiens
STTTGLLIY

SEQ ID NO: 901380 - protein, 9 aa, Homo Sapiens
NFLTDSLKT

SEQ ID NO: 901381 - protein, 9 aa, Homo Sapiens
LGLFVIIFA

SEQ ID NO: 901382 - protein, 9 aa, Homo Sapiens
SPEKIQSPF

SEQ ID NO: 901383 - protein, 9 aa, Homo Sapiens
INFLTDSLK

SEQ ID NO: 901384 - protein, 9 aa, Homo Sapiens
TYTMSGRMA

SEQ ID NO: 901385 - protein, 9 aa, Homo Sapiens
LFPYANGTL

SEQ ID NO: 901386 - protein, 9 aa, Homo Sapiens
CCKPSCCMT

SEQ ID NO: 901387 - protein, 9 aa, Homo Sapiens
SASPILHGQ

SEQ ID NO: 901388 - protein, 9 aa, Homo Sapiens
GTNQVNKAR

SEQ ID NO: 901389 - protein, 9 aa, Homo Sapiens
SVKMHSVEK

SEQ ID NO: 901390 - protein, 9 aa, Homo Sapiens
EAGNVPEPE

SEQ ID NO: 901391 - protein, 9 aa, Homo Sapiens
ECSSTCGAS

SEQ ID NO: 901392 - protein, 9 aa, Homo Sapiens
VTHLHERPA

SEQ ID NO: 901393 - protein, 9 aa, Homo Sapiens
GWAAVYLSA

SEQ ID NO: 901394 - protein, 9 aa, Homo Sapiens
ALLMAEEER

SEQ ID NO: 901395 - protein, 9 aa, Homo Sapiens
FDQYVAVCQ

SEQ ID NO: 901396 - protein, 9 aa, Homo Sapiens
KYGQETEED

SEQ ID NO: 901397 - protein, 9 aa, Homo Sapiens
ASTVSTTMA

SEQ ID NO: 901398 - protein, 9 aa, Homo Sapiens
GILREDAVL

SEQ ID NO: 901399 - protein, 9 aa, Homo Sapiens
LHPAGAAQE

SEQ ID NO: 901400 - protein, 9 aa, Homo Sapiens
CPTGWSAVA

SEQ ID NO: 901401 - protein, 9 aa, Homo Sapiens
SQTTYTMSG

SEQ ID NO: 901402 - protein, 9 aa, Homo Sapiens
STDLKMWGK

SEQ ID NO: 901403 - protein, 9 aa, Homo Sapiens
VGVRTVEEG

SEQ ID NO: 901404 - protein, 9 aa, Homo Sapiens
MANQLQRGD

SEQ ID NO: 901405 - protein, 9 aa, Homo Sapiens
TALAIVGTL

SEQ ID NO: 901406 - protein, 9 aa, Homo Sapiens
IKLACVDMT

SEQ ID NO: 901407 - protein, 9 aa, Homo Sapiens
KGGLHVHFW

SEQ ID NO: 901408 - protein, 9 aa, Homo Sapiens
PLIPPPPLV

SEQ ID NO: 901409 - protein, 9 aa, Homo Sapiens
EMMRRHQEG

SEQ ID NO: 901410 - protein, 9 aa, Homo Sapiens
AFKYSSNLN

SEQ ID NO: 901411 - protein, 9 aa, Homo Sapiens
VRKILLRWK

SEQ ID NO: 901412 - protein, 9 aa, Homo Sapiens
EILRQEEKG

SEQ ID NO: 901413 - protein, 9 aa, Homo Sapiens
PEGSYRSKN

SEQ ID NO: 901414 - protein, 9 aa, Homo Sapiens
SIFCAQSGA

SEQ ID NO: 901415 - protein, 9 aa, Homo Sapiens
SSNLNTHKK

SEQ ID NO: 901416 - protein, 9 aa, Homo Sapiens
PKITAIASM

SEQ ID NO: 901417 - protein, 9 aa, Homo Sapiens
GRCTLDQNC

SEQ ID NO: 901418 - protein, 9 aa, Homo Sapiens
SAVVELMRH

SEQ ID NO: 901419 - protein, 9 aa, Homo Sapiens
FLQKVVQMP

SEQ ID NO: 901420 - protein, 9 aa, Homo Sapiens
LQKVVQMPQ

SEQ ID NO: 901421 - protein, 9 aa, Homo Sapiens
NPKNADTYI

SEQ ID NO: 901422 - protein, 9 aa, Homo Sapiens
QRASDLAKQ

SEQ ID NO: 901423 - protein, 9 aa, Homo Sapiens
KLVVVGAGD

SEQ ID NO: 901424 - protein, 9 aa, Homo Sapiens
PKPKITAIA

SEQ ID NO: 901425 - protein, 9 aa, Homo Sapiens
GRDFPTETI

SEQ ID NO: 901426 - protein, 9 aa, Homo Sapiens
SMVLDLCSI

SEQ ID NO: 901427 - protein, 9 aa, Homo Sapiens
SSSLRPRLS

SEQ ID NO: 901428 - protein, 9 aa, Homo Sapiens
TLRWPHPLT

SEQ ID NO: 901429 - protein, 9 aa, Homo Sapiens
YAGFRLMPE

SEQ ID NO: 901430 - protein, 9 aa, Homo Sapiens
QAKKAYKLQ

SEQ ID NO: 901431 - protein, 9 aa, Homo Sapiens
KLLFEGWSH

SEQ ID NO: 901432 - protein, 9 aa, Homo Sapiens
RPCRAKGGL

SEQ ID NO: 901433 - protein, 9 aa, Homo Sapiens
SGLRARLCP

SEQ ID NO: 901434 - protein, 9 aa, Homo Sapiens
ASLKSAKVE

SEQ ID NO: 901435 - protein, 9 aa, Homo Sapiens
NPPGACHLW

SEQ ID NO: 901436 - protein, 9 aa, Homo Sapiens
FSAQIASYQ

SEQ ID NO: 901437 - protein, 9 aa, Homo Sapiens
TPALNIAVM

SEQ ID NO: 901438 - protein, 9 aa, Homo Sapiens
CCVLSVTLA

SEQ ID NO: 901439 - protein, 9 aa, Homo Sapiens
MSSYWCSGE

SEQ ID NO: 901440 - protein, 9 aa, Homo Sapiens
LMPEPVPTC

SEQ ID NO: 901441 - protein, 9 aa, Homo Sapiens
KGKGTLEQE

SEQ ID NO: 901442 - protein, 9 aa, Homo Sapiens
NAQPRCSED

SEQ ID NO: 901443 - protein, 9 aa, Homo Sapiens
LIHNTVVYT

SEQ ID NO: 901444 - protein, 9 aa, Homo Sapiens
GQKREDDQR

SEQ ID NO: 901445 - protein, 9 aa, Homo Sapiens
HLYRDGHEA

SEQ ID NO: 901446 - protein, 9 aa, Homo Sapiens
GDRPCRAKG

SEQ ID NO: 901447 - protein, 9 aa, Homo Sapiens
NKAAFSVAV

SEQ ID NO: 901448 - protein, 9 aa, Homo Sapiens
NTHKKIHTG

SEQ ID NO: 901449 - protein, 9 aa, Homo Sapiens
GCEHTCYCR

SEQ ID NO: 901450 - protein, 9 aa, Homo Sapiens
LKIPDIALD

SEQ ID NO: 901451 - protein, 9 aa, Homo Sapiens
KIHVICCVL

SEQ ID NO: 901452 - protein, 9 aa, Homo Sapiens
RCWRPSAVQ

SEQ ID NO: 901453 - protein, 9 aa, Homo Sapiens
TAHFEITSD

SEQ ID NO: 901454 - protein, 9 aa, Homo Sapiens
LSIFCAQSG

SEQ ID NO: 901455 - protein, 9 aa, Homo Sapiens
PGNSPCSMR

SEQ ID NO: 901456 - protein, 9 aa, Homo Sapiens
NFENPKNAD

SEQ ID NO: 901457 - protein, 9 aa, Homo Sapiens
AVVELMRHQ

SEQ ID NO: 901458 - protein, 9 aa, Homo Sapiens
SLRPRLSDR

SEQ ID NO: 901459 - protein, 9 aa, Homo Sapiens
LKSAKVEAH

SEQ ID NO: 901460 - protein, 9 aa, Homo Sapiens
TASPRRGPS

SEQ ID NO: 901461 - protein, 9 aa, Homo Sapiens
QAEATRSTT

SEQ ID NO: 901462 - protein, 9 aa, Homo Sapiens
PLQYASVIS

SEQ ID NO: 901463 - protein, 9 aa, Homo Sapiens
AKQINHPEL

SEQ ID NO: 901464 - protein, 9 aa, Homo Sapiens
YRDGHEAAL

SEQ ID NO: 901465 - protein, 9 aa, Homo Sapiens
SCECQKGHN

SEQ ID NO: 901466 - protein, 9 aa, Homo Sapiens
AVEGRDFPT

SEQ ID NO: 901467 - protein, 9 aa, Homo Sapiens
VENGNQARS

SEQ ID NO: 901468 - protein, 9 aa, Homo Sapiens
HSHPNPDSQ

SEQ ID NO: 901469 - protein, 9 aa, Homo Sapiens
YDPGSGSFG

SEQ ID NO: 901470 - protein, 9 aa, Homo Sapiens
SILWVQAAT

SEQ ID NO: 901471 - protein, 9 aa, Homo Sapiens
NEAILLPSG

SEQ ID NO: 901472 - protein, 9 aa, Homo Sapiens
RVYNGRNQG

SEQ ID NO: 901473 - protein, 9 aa, Homo Sapiens
VIGSCINPI

SEQ ID NO: 901474 - protein, 9 aa, Homo Sapiens
TNPPGACHL

SEQ ID NO: 901475 - protein, 9 aa, Homo Sapiens
WSPAKRLQL

SEQ ID NO: 901476 - protein, 9 aa, Homo Sapiens
SSLRPRLSD

SEQ ID NO: 901477 - protein, 9 aa, Homo Sapiens
ISYPDQRSI

SEQ ID NO: 901478 - protein, 9 aa, Homo Sapiens
DIKDGGLFL

SEQ ID NO: 901479 - protein, 9 aa, Homo Sapiens
QLGIKAGNS

SEQ ID NO: 901480 - protein, 9 aa, Homo Sapiens
GVSLLAGFT

SEQ ID NO: 901481 - protein, 9 aa, Homo Sapiens
AEATRSTTG

SEQ ID NO: 901482 - protein, 9 aa, Homo Sapiens
HVICCVLSV

SEQ ID NO: 901483 - protein, 9 aa, Homo Sapiens
SLSLYSGKD

SEQ ID NO: 901484 - protein, 9 aa, Homo Sapiens
GFRLMPEPV

SEQ ID NO: 901485 - protein, 9 aa, Homo Sapiens
QDVDECQQS

SEQ ID NO: 901486 - protein, 9 aa, Homo Sapiens
VEGRDFPTE

SEQ ID NO: 901487 - protein, 9 aa, Homo Sapiens
ETGDSFSDV

SEQ ID NO: 901488 - protein, 9 aa, Homo Sapiens
KLIHNTVVY

SEQ ID NO: 901489 - protein, 9 aa, Homo Sapiens
LHHERWMRT

SEQ ID NO: 901490 - protein, 9 aa, Homo Sapiens
DGDGTAHFE

SEQ ID NO: 901491 - protein, 9 aa, Homo Sapiens
DSCKGDTGG

SEQ ID NO: 901492 - protein, 9 aa, Homo Sapiens
SQAEATRST

SEQ ID NO: 901493 - protein, 9 aa, Homo Sapiens
LQLRAAPTL

SEQ ID NO: 901494 - protein, 9 aa, Homo Sapiens
IIDGDGTAH

SEQ ID NO: 901495 - protein, 9 aa, Homo Sapiens
SGEWGLAGP

SEQ ID NO: 901496 - protein, 9 aa, Homo Sapiens
PSMVHLKPK

SEQ ID NO: 901497 - protein, 9 aa, Homo Sapiens
HEAALSKFT

SEQ ID NO: 901498 - protein, 9 aa, Homo Sapiens
VIPEMQKSN

SEQ ID NO: 901499 - protein, 9 aa, Homo Sapiens
EEKGKGTLE

SEQ ID NO: 901500 - protein, 9 aa, Homo Sapiens
AQLKFCGPN

SEQ ID NO: 901501 - protein, 9 aa, Homo Sapiens
SNLNTHKKI

SEQ ID NO: 901502 - protein, 9 aa, Homo Sapiens
ENEAILLPS

SEQ ID NO: 901503 - protein, 9 aa, Homo Sapiens
LAYAGFRLM

SEQ ID NO: 901504 - protein, 9 aa, Homo Sapiens
AICTHCLDP

SEQ ID NO: 901505 - protein, 9 aa, Homo Sapiens
VQRPSARLL

SEQ ID NO: 901506 - protein, 9 aa, Homo Sapiens
VLSVTLAVD

SEQ ID NO: 901507 - protein, 9 aa, Homo Sapiens
REVNGRVEN

SEQ ID NO: 901508 - protein, 9 aa, Homo Sapiens
QIVRKITMV

SEQ ID NO: 901509 - protein, 9 aa, Homo Sapiens
KMYLGLSKM

SEQ ID NO: 901510 - protein, 9 aa, Homo Sapiens
GHLKESEAD

SEQ ID NO: 901511 - protein, 9 aa, Homo Sapiens
VMIVRCQPQ

SEQ ID NO: 901512 - protein, 9 aa, Homo Sapiens
VVGAGDVGK

SEQ ID NO: 901513 - protein, 9 aa, Homo Sapiens
TGVDTAKMV

SEQ ID NO: 901514 - protein, 9 aa, Homo Sapiens
NCWHCVCQV

SEQ ID NO: 901515 - protein, 9 aa, Homo Sapiens
KGCYACSVA

SEQ ID NO: 901516 - protein, 9 aa, Homo Sapiens
EKTTKKMKK

SEQ ID NO: 901517 - protein, 9 aa, Homo Sapiens
GEWGLAGPP

SEQ ID NO: 901518 - protein, 9 aa, Homo Sapiens
KIPDIALDV

SEQ ID NO: 901519 - protein, 9 aa, Homo Sapiens
EETLQLRAA

SEQ ID NO: 901520 - protein, 9 aa, Homo Sapiens
CPTDKPLRL

SEQ ID NO: 901521 - protein, 9 aa, Homo Sapiens
MRINTGEKP

SEQ ID NO: 901522 - protein, 9 aa, Homo Sapiens
YFFLSNISF

SEQ ID NO: 901523 - protein, 9 aa, Homo Sapiens
GHNLSGTSC

SEQ ID NO: 901524 - protein, 9 aa, Homo Sapiens
LVQLEQNKA

SEQ ID NO: 901525 - protein, 9 aa, Homo Sapiens
VYNGRNQGG

SEQ ID NO: 901526 - protein, 9 aa, Homo Sapiens
TRKIFAMKV

SEQ ID NO: 901527 - protein, 9 aa, Homo Sapiens
HYEQLVLHH

SEQ ID NO: 901528 - protein, 9 aa, Homo Sapiens
LHVVKIVAN

SEQ ID NO: 901529 - protein, 9 aa, Homo Sapiens
SGEGDVIDD

SEQ ID NO: 901530 - protein, 9 aa, Homo Sapiens
FATFKQEME

SEQ ID NO: 901531 - protein, 9 aa, Homo Sapiens
GVDTAKMVL

SEQ ID NO: 901532 - protein, 9 aa, Homo Sapiens
VGCEHTCYC

SEQ ID NO: 901533 - protein, 9 aa, Homo Sapiens
NKYRNYDIP

SEQ ID NO: 901534 - protein, 9 aa, Homo Sapiens
ELIAGFTGP

SEQ ID NO: 901535 - protein, 9 aa, Homo Sapiens
HHERWMRTL

SEQ ID NO: 901536 - protein, 9 aa, Homo Sapiens
HPLTTLATA

SEQ ID NO: 901537 - protein, 9 aa, Homo Sapiens
VVYTAVLFP

SEQ ID NO: 901538 - protein, 9 aa, Homo Sapiens
LKPKSRHVS

SEQ ID NO: 901539 - protein, 9 aa, Homo Sapiens
QLSAKLVGF

SEQ ID NO: 901540 - protein, 9 aa, Homo Sapiens
SQEKPERPS

SEQ ID NO: 901541 - protein, 9 aa, Homo Sapiens
DVVLWLVEE

SEQ ID NO: 901542 - protein, 9 aa, Homo Sapiens
GKAFSVPSS

SEQ ID NO: 901543 - protein, 9 aa, Homo Sapiens
DLQTRVKQL

SEQ ID NO: 901544 - protein, 9 aa, Homo Sapiens
DSLSLYSGK

SEQ ID NO: 901545 - protein, 9 aa, Homo Sapiens
AENEAILLP

SEQ ID NO: 901546 - protein, 9 aa, Homo Sapiens
YNGQASVPI

SEQ ID NO: 901547 - protein, 9 aa, Homo Sapiens
RKIFAMKVL

SEQ ID NO: 901548 - protein, 9 aa, Homo Sapiens
KGDTGGPLI

SEQ ID NO: 901549 - protein, 9 aa, Homo Sapiens
TMRIWLGLP

SEQ ID NO: 901550 - protein, 9 aa, Homo Sapiens
THMRINTGE

SEQ ID NO: 901551 - protein, 9 aa, Homo Sapiens
GACHLWELD

SEQ ID NO: 901552 - protein, 9 aa, Homo Sapiens
RDGHEAALS

SEQ ID NO: 901553 - protein, 9 aa, Homo Sapiens
GFLYNGQAS

SEQ ID NO: 901554 - protein, 9 aa, Homo Sapiens
EAKQIVRKI

SEQ ID NO: 901555 - protein, 9 aa, Homo Sapiens
SYWCSGEGD

SEQ ID NO: 901556 - protein, 9 aa, Homo Sapiens
PKGSQGSLG

SEQ ID NO: 901557 - protein, 9 aa, Homo Sapiens
ICCVLSVTL

SEQ ID NO: 901558 - protein, 9 aa, Homo Sapiens
AIQPRVNRC

SEQ ID NO: 901559 - protein, 9 aa, Homo Sapiens
PLDSAYDPG

SEQ ID NO: 901560 - protein, 9 aa, Homo Sapiens
ACHLWELDG

SEQ ID NO: 901561 - protein, 9 aa, Homo Sapiens
VKQLESCEC

SEQ ID NO: 901562 - protein, 9 aa, Homo Sapiens
LTLRWPHPL

SEQ ID NO: 901563 - protein, 9 aa, Homo Sapiens
KPKSRHVSA

SEQ ID NO: 901564 - protein, 9 aa, Homo Sapiens
CQQSPRLCK

SEQ ID NO: 901565 - protein, 9 aa, Homo Sapiens
QSPRLCKSY

SEQ ID NO: 901566 - protein, 9 aa, Homo Sapiens
GFTGPWESP

SEQ ID NO: 901567 - protein, 9 aa, Homo Sapiens
VMNVRKILL

SEQ ID NO: 901568 - protein, 9 aa, Homo Sapiens
HCKAGTQTL

SEQ ID NO: 901569 - protein, 9 aa, Homo Sapiens
FFLSNISFI

SEQ ID NO: 901570 - protein, 9 aa, Homo Sapiens
LGDRPCRAK

SEQ ID NO: 901571 - protein, 9 aa, Homo Sapiens
VVVGAGDVG

SEQ ID NO: 901572 - protein, 9 aa, Homo Sapiens
LAQITGTGH

SEQ ID NO: 901573 - protein, 9 aa, Homo Sapiens
QLSVPFDES

SEQ ID NO: 901574 - protein, 9 aa, Homo Sapiens
ICTHCLDPK

SEQ ID NO: 901575 - protein, 9 aa, Homo Sapiens
CKAGTQTLE

SEQ ID NO: 901576 - protein, 9 aa, Homo Sapiens
VCASEKLPK

SEQ ID NO: 901577 - protein, 9 aa, Homo Sapiens
ASVPIQQCG

SEQ ID NO: 901578 - protein, 9 aa, Homo Sapiens
SPCSMRESG

SEQ ID NO: 901579 - protein, 9 aa, Homo Sapiens
ISRRLPEVG

SEQ ID NO: 901580 - protein, 9 aa, Homo Sapiens
ECQKGHNLS

SEQ ID NO: 901581 - protein, 9 aa, Homo Sapiens
LQKNFIESH

SEQ ID NO: 901582 - protein, 9 aa, Homo Sapiens
KIWCLGNES

SEQ ID NO: 901583 - protein, 9 aa, Homo Sapiens
EVLKIPDIA

SEQ ID NO: 901584 - protein, 9 aa, Homo Sapiens
KKAYKLQSD

SEQ ID NO: 901585 - protein, 9 aa, Homo Sapiens
GTPALNIAV

SEQ ID NO: 901586 - protein, 9 aa, Homo Sapiens
PGPKGSQGS

SEQ ID NO: 901587 - protein, 9 aa, Homo Sapiens
AQWLHCKAG

SEQ ID NO: 901588 - protein, 9 aa, Homo Sapiens
DDLKAIQDM

SEQ ID NO: 901589 - protein, 9 aa, Homo Sapiens
AAENEAILL

SEQ ID NO: 901590 - protein, 9 aa, Homo Sapiens
HQNRVSVII

SEQ ID NO: 901591 - protein, 9 aa, Homo Sapiens
LGIKAGNSD

SEQ ID NO: 901592 - protein, 9 aa, Homo Sapiens
SSRNLQESL

SEQ ID NO: 901593 - protein, 9 aa, Homo Sapiens
SAFEQLGIK

SEQ ID NO: 901594 - protein, 9 aa, Homo Sapiens
SCKGDTGGP

SEQ ID NO: 901595 - protein, 9 aa, Homo Sapiens
SLLSQLSAK

SEQ ID NO: 901596 - protein, 9 aa, Homo Sapiens
NPDSQEKPE

SEQ ID NO: 901597 - protein, 9 aa, Homo Sapiens
LNTHKKIHT

SEQ ID NO: 901598 - protein, 9 aa, Homo Sapiens
LMTHMRINT

SEQ ID NO: 901599 - protein, 9 aa, Homo Sapiens
SVPFDESCP

SEQ ID NO: 901600 - protein, 9 aa, Homo Sapiens
QPRVNRCKL

SEQ ID NO: 901601 - protein, 9 aa, Homo Sapiens
EKGKGTLEQ

SEQ ID NO: 901602 - protein, 9 aa, Homo Sapiens
LKKRPQRML

SEQ ID NO: 901603 - protein, 9 aa, Homo Sapiens
RARLCPVRQ

SEQ ID NO: 901604 - protein, 9 aa, Homo Sapiens
NGGQCLGST

SEQ ID NO: 901605 - protein, 9 aa, Homo Sapiens
MVLDLCSIN

SEQ ID NO: 901606 - protein, 9 aa, Homo Sapiens
SHKLMYDNT

SEQ ID NO: 901607 - protein, 9 aa, Homo Sapiens
FLSNISFID

SEQ ID NO: 901608 - protein, 9 aa, Homo Sapiens
MIKRACEQF

SEQ ID NO: 901609 - protein, 9 aa, Homo Sapiens
SEDDLKAIQ

SEQ ID NO: 901610 - protein, 9 aa, Homo Sapiens
HPPWSPAKR

SEQ ID NO: 901611 - protein, 9 aa, Homo Sapiens
LPPLSVGKS

SEQ ID NO: 901612 - protein, 9 aa, Homo Sapiens
KAFSVPSSL

SEQ ID NO: 901613 - protein, 9 aa, Homo Sapiens
VPSSLTTHQ

SEQ ID NO: 901614 - protein, 9 aa, Homo Sapiens
SAAAEKGTP

SEQ ID NO: 901615 - protein, 9 aa, Homo Sapiens
NGRVENGNQ

SEQ ID NO: 901616 - protein, 9 aa, Homo Sapiens
ETLQLRAAP

SEQ ID NO: 901617 - protein, 9 aa, Homo Sapiens
PRLSDRGTC

SEQ ID NO: 901618 - protein, 9 aa, Homo Sapiens
RAKGGLARW

SEQ ID NO: 901619 - protein, 9 aa, Homo Sapiens
FLPPLSVGK

SEQ ID NO: 901620 - protein, 9 aa, Homo Sapiens
MKISRRLPE

SEQ ID NO: 901621 - protein, 9 aa, Homo Sapiens
RAAEIQVPN

SEQ ID NO: 901622 - protein, 9 aa, Homo Sapiens
SVPSSLTTH

SEQ ID NO: 901623 - protein, 9 aa, Homo Sapiens
SPNTQLSVP

SEQ ID NO: 901624 - protein, 9 aa, Homo Sapiens
ALVAQLKFC

SEQ ID NO: 901625 - protein, 9 aa, Homo Sapiens
RLPPSDEFV

SEQ ID NO: 901626 - protein, 9 aa, Homo Sapiens
RISYPDQRS

SEQ ID NO: 901627 - protein, 9 aa, Homo Sapiens
KITAIASMK

SEQ ID NO: 901628 - protein, 9 aa, Homo Sapiens
KIFLQKVVQ

SEQ ID NO: 901629 - protein, 9 aa, Homo Sapiens
VEETLQLRA

SEQ ID NO: 901630 - protein, 9 aa, Homo Sapiens
ITGTGHLKE

SEQ ID NO: 901631 - protein, 9 aa, Homo Sapiens
FNVPFPAEE

SEQ ID NO: 901632 - protein, 9 aa, Homo Sapiens
KFCGPNHID

SEQ ID NO: 901633 - protein, 9 aa, Homo Sapiens
ECQQSPRLC

SEQ ID NO: 901634 - protein, 9 aa, Homo Sapiens
NADTYIPTI

SEQ ID NO: 901635 - protein, 9 aa, Homo Sapiens
PHSHSTSRV

SEQ ID NO: 901636 - protein, 9 aa, Homo Sapiens
FSVPSSLTT

SEQ ID NO: 901637 - protein, 9 aa, Homo Sapiens
VICCVLSVT

SEQ ID NO: 901638 - protein, 9 aa, Homo Sapiens
LFLPPLSVG

SEQ ID NO: 901639 - protein, 9 aa, Homo Sapiens
KKEIKMYLG

SEQ ID NO: 901640 - protein, 9 aa, Homo Sapiens
CHPPWSPAK

SEQ ID NO: 901641 - protein, 9 aa, Homo Sapiens
DGTAHFEIT

SEQ ID NO: 901642 - protein, 9 aa, Homo Sapiens
VELMRHQPT

SEQ ID NO: 901643 - protein, 9 aa, Homo Sapiens
QGSLGPTGA

SEQ ID NO: 901644 - protein, 9 aa, Homo Sapiens
CVLSVTLAV

SEQ ID NO: 901645 - protein, 9 aa, Homo Sapiens
KISRRLPEV

SEQ ID NO: 901646 - protein, 9 aa, Homo Sapiens
GTAHFEITS

SEQ ID NO: 901647 - protein, 9 aa, Homo Sapiens
SQGSLGPTG

SEQ ID NO: 901648 - protein, 9 aa, Homo Sapiens
DPWYHSNVN

SEQ ID NO: 901649 - protein, 9 aa, Homo Sapiens
VPFPAEESL

SEQ ID NO: 901650 - protein, 9 aa, Homo Sapiens
SRNLQESLR

SEQ ID NO: 901651 - protein, 9 aa, Homo Sapiens
VIYENFSKS

SEQ ID NO: 901652 - protein, 9 aa, Homo Sapiens
LSNISFIDI

SEQ ID NO: 901653 - protein, 9 aa, Homo Sapiens
PLPEGSYRS

SEQ ID NO: 901654 - protein, 9 aa, Homo Sapiens
LDSAYDPGS

SEQ ID NO: 901655 - protein, 9 aa, Homo Sapiens
QEMEKTTKK

SEQ ID NO: 901656 - protein, 9 aa, Homo Sapiens
VVSKLLFEG

SEQ ID NO: 901657 - protein, 9 aa, Homo Sapiens
EPVMIVRCQ

SEQ ID NO: 901658 - protein, 9 aa, Homo Sapiens
CTLDQNCWH

SEQ ID NO: 901659 - protein, 9 aa, Homo Sapiens
TGDSFSDVA

SEQ ID NO: 901660 - protein, 9 aa, Homo Sapiens
AAAEKGTPA

SEQ ID NO: 901661 - protein, 9 aa, Homo Sapiens
QTRVKQLES

SEQ ID NO: 901662 - protein, 9 aa, Homo Sapiens
HNLSGTSCV

SEQ ID NO: 901663 - protein, 9 aa, Homo Sapiens
DRPCRAKGG

SEQ ID NO: 901664 - protein, 9 aa, Homo Sapiens
PHPLTTLAT

SEQ ID NO: 901665 - protein, 9 aa, Homo Sapiens
PPKPKITAI

SEQ ID NO: 901666 - protein, 9 aa, Homo Sapiens
GRVENGNQA

SEQ ID NO: 901667 - protein, 9 aa, Homo Sapiens
GDVGKSALT

SEQ ID NO: 901668 - protein, 9 aa, Homo Sapiens
SAVQRPSAR

SEQ ID NO: 901669 - protein, 9 aa, Homo Sapiens
DPGSGSFGV

SEQ ID NO: 901670 - protein, 9 aa, Homo Sapiens
EAAAENEAI

SEQ ID NO: 901671 - protein, 9 aa, Homo Sapiens
TFKQEMEKT

SEQ ID NO: 901672 - protein, 9 aa, Homo Sapiens
YYTMRIWLG

SEQ ID NO: 901673 - protein, 9 aa, Homo Sapiens
HPHSHSTSR

SEQ ID NO: 901674 - protein, 9 aa, Homo Sapiens
PRRGPSSLG

SEQ ID NO: 901675 - protein, 9 aa, Homo Sapiens
HSVETPLVI

SEQ ID NO: 901676 - protein, 9 aa, Homo Sapiens
DDQRAAEIQ

SEQ ID NO: 901677 - protein, 9 aa, Homo Sapiens
GGDGYLADE

SEQ ID NO: 901678 - protein, 9 aa, Homo Sapiens
KREDDQRAA

SEQ ID NO: 901679 - protein, 9 aa, Homo Sapiens
SCHPPWSPA

SEQ ID NO: 901680 - protein, 9 aa, Homo Sapiens
VGAGDVGKS

SEQ ID NO: 901681 - protein, 9 aa, Homo Sapiens
LPSMVHLKP

SEQ ID NO: 901682 - protein, 9 aa, Homo Sapiens
ETRISYPDQ

SEQ ID NO: 901683 - protein, 9 aa, Homo Sapiens
IKMYLGLSK

SEQ ID NO: 901684 - protein, 9 aa, Homo Sapiens
IRFMLEAML

SEQ ID NO: 901685 - protein, 9 aa, Homo Sapiens
LPEGSYRSK

SEQ ID NO: 901686 - protein, 9 aa, Homo Sapiens
NKDLQTRVK

SEQ ID NO: 901687 - protein, 9 aa, Homo Sapiens
VREVLKIPD

SEQ ID NO: 901688 - protein, 9 aa, Homo Sapiens
SQLSAKLVG

SEQ ID NO: 901689 - protein, 9 aa, Homo Sapiens
KEEYENGGQ

SEQ ID NO: 901690 - protein, 9 aa, Homo Sapiens
RFMLEAMLA

SEQ ID NO: 901691 - protein, 9 aa, Homo Sapiens
MELANRRLF

SEQ ID NO: 901692 - protein, 9 aa, Homo Sapiens
TQRNNGILE

SEQ ID NO: 901693 - protein, 9 aa, Homo Sapiens
CSMRESGLE

SEQ ID NO: 901694 - protein, 9 aa, Homo Sapiens
HVVKIVANK

SEQ ID NO: 901695 - protein, 9 aa, Homo Sapiens
PILIVGDTV

SEQ ID NO: 901696 - protein, 9 aa, Homo Sapiens
GGLFLPPLS

SEQ ID NO: 901697 - protein, 9 aa, Homo Sapiens
VLRAVEGRD

SEQ ID NO: 901698 - protein, 9 aa, Homo Sapiens
AAEKGTPAL

SEQ ID NO: 901699 - protein, 9 aa, Homo Sapiens
FKIHVICCV

SEQ ID NO: 901700 - protein, 9 aa, Homo Sapiens
VVLWLVEES

SEQ ID NO: 901701 - protein, 9 aa, Homo Sapiens
ASNLGSAVV

SEQ ID NO: 901702 - protein, 9 aa, Homo Sapiens
EKIFLQKVV

SEQ ID NO: 901703 - protein, 9 aa, Homo Sapiens
SHEKGLKTR

SEQ ID NO: 901704 - protein, 9 aa, Homo Sapiens
GFPFPPYLS

SEQ ID NO: 901705 - protein, 9 aa, Homo Sapiens
CHLWELDGR

SEQ ID NO: 901706 - protein, 9 aa, Homo Sapiens
YNPKSMVLD

SEQ ID NO: 901707 - protein, 9 aa, Homo Sapiens
CEHTCYCRN

SEQ ID NO: 901708 - protein, 9 aa, Homo Sapiens
WPHPLTTLA

SEQ ID NO: 901709 - protein, 9 aa, Homo Sapiens
ITAIASMKS

SEQ ID NO: 901710 - protein, 9 aa, Homo Sapiens
QLRAAPTLL

SEQ ID NO: 901711 - protein, 9 aa, Homo Sapiens
SMRESGLET

SEQ ID NO: 901712 - protein, 9 aa, Homo Sapiens
NESRFHINK

SEQ ID NO: 901713 - protein, 9 aa, Homo Sapiens
KDCTLRIRD

SEQ ID NO: 901714 - protein, 9 aa, Homo Sapiens
PHPHSHSTS

SEQ ID NO: 901715 - protein, 9 aa, Homo Sapiens
KYSSNLNTH

SEQ ID NO: 901716 - protein, 9 aa, Homo Sapiens
IYNPKSMVL

SEQ ID NO: 901717 - protein, 9 aa, Homo Sapiens
SMVHLKPKS

SEQ ID NO: 901718 - protein, 9 aa, Homo Sapiens
RVVVSKLLF

SEQ ID NO: 901719 - protein, 9 aa, Homo Sapiens
TGANTRKIF

SEQ ID NO: 901720 - protein, 9 aa, Homo Sapiens
VVELMRHQP

SEQ ID NO: 901721 - protein, 9 aa, Homo Sapiens
EDNLDSLSL

SEQ ID NO: 901722 - protein, 9 aa, Homo Sapiens
PFDESCPPG

SEQ ID NO: 901723 - protein, 9 aa, Homo Sapiens
REDDQRAAE

SEQ ID NO: 901724 - protein, 9 aa, Homo Sapiens
PKNADTYIP

SEQ ID NO: 901725 - protein, 9 aa, Homo Sapiens
GLRARLCPV

SEQ ID NO: 901726 - protein, 9 aa, Homo Sapiens
TAIASMKSP

SEQ ID NO: 901727 - protein, 9 aa, Homo Sapiens
VVEETLQLR

SEQ ID NO: 901728 - protein, 9 aa, Homo Sapiens
AGFRLMPEP

SEQ ID NO: 901729 - protein, 9 aa, Homo Sapiens
YGRSRVYNG

SEQ ID NO: 901730 - protein, 9 aa, Homo Sapiens
RLSDRGTCP

SEQ ID NO: 901731 - protein, 9 aa, Homo Sapiens
SRFHINKTV

SEQ ID NO: 901732 - protein, 9 aa, Homo Sapiens
PASSSLRPR

SEQ ID NO: 901733 - protein, 9 aa, Homo Sapiens
IAICKPLQY

SEQ ID NO: 901734 - protein, 9 aa, Homo Sapiens
AVQRPSARL

SEQ ID NO: 901735 - protein, 9 aa, Homo Sapiens
WLGLPGKMD

SEQ ID NO: 901736 - protein, 9 aa, Homo Sapiens
SVETPLVIA

SEQ ID NO: 901737 - protein, 9 aa, Homo Sapiens
NKDCTLRIR

SEQ ID NO: 901738 - protein, 9 aa, Homo Sapiens
EAAFPLPEG

SEQ ID NO: 901739 - protein, 9 aa, Homo Sapiens
CSEDDLKAI

SEQ ID NO: 901740 - protein, 9 aa, Homo Sapiens
IFLQKVVQM

SEQ ID NO: 901741 - protein, 9 aa, Homo Sapiens
CTLRIRDTR

SEQ ID NO: 901742 - protein, 9 aa, Homo Sapiens
AKLVGFYLT

SEQ ID NO: 901743 - protein, 9 aa, Homo Sapiens
VIQAKKAYK

SEQ ID NO: 901744 - protein, 9 aa, Homo Sapiens
DSQEKPERP

SEQ ID NO: 901745 - protein, 9 aa, Homo Sapiens
MNVRKILLR

SEQ ID NO: 901746 - protein, 9 aa, Homo Sapiens
PGQMDFFYP

SEQ ID NO: 901747 - protein, 9 aa, Homo Sapiens
PSAAAEKGT

SEQ ID NO: 901748 - protein, 9 aa, Homo Sapiens
INTGEKPYK

SEQ ID NO: 901749 - protein, 9 aa, Homo Sapiens
PGPSGEWGL

SEQ ID NO: 901750 - protein, 9 aa, Homo Sapiens
KKQEDVVLW

SEQ ID NO: 901751 - protein, 9 aa, Homo Sapiens
PPWSPAKRL

SEQ ID NO: 901752 - protein, 9 aa, Homo Sapiens
LVLHHERWM

SEQ ID NO: 901753 - protein, 9 aa, Homo Sapiens
VTGANTRKI

SEQ ID NO: 901754 - protein, 9 aa, Homo Sapiens
FLYNGQASV

SEQ ID NO: 901755 - protein, 9 aa, Homo Sapiens
NNFENPKNA

SEQ ID NO: 901756 - protein, 9 aa, Homo Sapiens
KQINHPELH

SEQ ID NO: 901757 - protein, 9 aa, Homo Sapiens
LFSAQIASY

SEQ ID NO: 901758 - protein, 9 aa, Homo Sapiens
HNTVVYTAV

SEQ ID NO: 901759 - protein, 9 aa, Homo Sapiens
IPDIALDVF

SEQ ID NO: 901760 - protein, 9 aa, Homo Sapiens
PTASPRRGP

SEQ ID NO: 901761 - protein, 9 aa, Homo Sapiens
FENPKNADT

SEQ ID NO: 901762 - protein, 9 aa, Homo Sapiens
YVIGSCINP

SEQ ID NO: 901763 - protein, 9 aa, Homo Sapiens
WRRLPPSDE

SEQ ID NO: 901764 - protein, 9 aa, Homo Sapiens
EKGTPALNI

SEQ ID NO: 901765 - protein, 9 aa, Homo Sapiens
PWSPAKRLQ

SEQ ID NO: 901766 - protein, 9 aa, Homo Sapiens
SSQAEATRS

SEQ ID NO: 901767 - protein, 9 aa, Homo Sapiens
AKMVLSGAK

SEQ ID NO: 901768 - protein, 9 aa, Homo Sapiens
NSKKQEDVV

SEQ ID NO: 901769 - protein, 9 aa, Homo Sapiens
RACEQFSSR

SEQ ID NO: 901770 - protein, 9 aa, Homo Sapiens
IVANKYRNY

SEQ ID NO: 901771 - protein, 9 aa, Homo Sapiens
RIWLGLPGK

SEQ ID NO: 901772 - protein, 9 aa, Homo Sapiens
KVTGANTRK

SEQ ID NO: 901773 - protein, 9 aa, Homo Sapiens
PGVSLLAGF

SEQ ID NO: 901774 - protein, 9 aa, Homo Sapiens
PFPPYLSSS

SEQ ID NO: 901775 - protein, 9 aa, Homo Sapiens
MLEAMLALK

SEQ ID NO: 901776 - protein, 9 aa, Homo Sapiens
SSYWCSGEG

SEQ ID NO: 901777 - protein, 9 aa, Homo Sapiens
PMYFFLSNI

SEQ ID NO: 901778 - protein, 9 aa, Homo Sapiens
IFCAQSGAR

SEQ ID NO: 901779 - protein, 9 aa, Homo Sapiens
SPRLCKSYG

SEQ ID NO: 901780 - protein, 9 aa, Homo Sapiens
CAQSGARRV

SEQ ID NO: 901781 - protein, 9 aa, Homo Sapiens
ICKPLQYAS

SEQ ID NO: 901782 - protein, 9 aa, Homo Sapiens
CASEKLPKD

SEQ ID NO: 901783 - protein, 9 aa, Homo Sapiens
ETPLVIADP

SEQ ID NO: 901784 - protein, 9 aa, Homo Sapiens
IAGFTGPWE

SEQ ID NO: 901785 - protein, 9 aa, Homo Sapiens
WEDSRTRSI

SEQ ID NO: 901786 - protein, 9 aa, Homo Sapiens
PEGGDGYLA

SEQ ID NO: 901787 - protein, 9 aa, Homo Sapiens
AEKGTPALN

SEQ ID NO: 901788 - protein, 9 aa, Homo Sapiens
KPKITAIAS

SEQ ID NO: 901789 - protein, 9 aa, Homo Sapiens
ELANRRLFS

SEQ ID NO: 901790 - protein, 9 aa, Homo Sapiens
FIESHKLMY

SEQ ID NO: 901791 - protein, 9 aa, Homo Sapiens
SSSRNLQES

SEQ ID NO: 901792 - protein, 9 aa, Homo Sapiens
LEQNKAAFS

SEQ ID NO: 901793 - protein, 9 aa, Homo Sapiens
MEKTTKKMK

SEQ ID NO: 901794 - protein, 9 aa, Homo Sapiens
DSAYDPGSG

SEQ ID NO: 901795 - protein, 9 aa, Homo Sapiens
VYSCHPPWS

SEQ ID NO: 901796 - protein, 9 aa, Homo Sapiens
DDLETRISY

SEQ ID NO: 901797 - protein, 9 aa, Homo Sapiens
RDVLRAVEG

SEQ ID NO: 901798 - protein, 9 aa, Homo Sapiens
CAVREVLKI

SEQ ID NO: 901799 - protein, 9 aa, Homo Sapiens
YACSVAADG

SEQ ID NO: 901800 - protein, 9 aa, Homo Sapiens
ILLPSGELL

SEQ ID NO: 901801 - protein, 9 aa, Homo Sapiens
NVRKILLRW

SEQ ID NO: 901802 - protein, 9 aa, Homo Sapiens
TRIRFMLEA

SEQ ID NO: 901803 - protein, 9 aa, Homo Sapiens
SRTRSILWV

SEQ ID NO: 901804 - protein, 9 aa, Homo Sapiens
FKQEMEKTT

SEQ ID NO: 901805 - protein, 9 aa, Homo Sapiens
QNKDCTLRI

SEQ ID NO: 901806 - protein, 9 aa, Homo Sapiens
QPRCSEDDL

SEQ ID NO: 901807 - protein, 9 aa, Homo Sapiens
LVAQLKFCG

SEQ ID NO: 901808 - protein, 9 aa, Homo Sapiens
DKKRVVVSK

SEQ ID NO: 901809 - protein, 9 aa, Homo Sapiens
YHSNVNTLC

SEQ ID NO: 901810 - protein, 9 aa, Homo Sapiens
FPLPEGSYR

SEQ ID NO: 901811 - protein, 9 aa, Homo Sapiens
GNSPCSMRE

SEQ ID NO: 901812 - protein, 9 aa, Homo Sapiens
TGHLKESEA

SEQ ID NO: 901813 - protein, 9 aa, Homo Sapiens
KEIKMYLGL

SEQ ID NO: 901814 - protein, 9 aa, Homo Sapiens
ASSSLRPRL

SEQ ID NO: 901815 - protein, 9 aa, Homo Sapiens
VMVEVIPEM

SEQ ID NO: 901816 - protein, 9 aa, Homo Sapiens
KGGLARWPT

SEQ ID NO: 901817 - protein, 9 aa, Homo Sapiens
PAEESLHLI

SEQ ID NO: 901818 - protein, 9 aa, Homo Sapiens
KRVVVSKLL

SEQ ID NO: 901819 - protein, 9 aa, Homo Sapiens
NSPCSMRES

SEQ ID NO: 901820 - protein, 9 aa, Homo Sapiens
DVIYENFSK

SEQ ID NO: 901821 - protein, 9 aa, Homo Sapiens
SKKQEDVVL

SEQ ID NO: 901822 - protein, 9 aa, Homo Sapiens
AICKPLQYA

SEQ ID NO: 901823 - protein, 9 aa, Homo Sapiens
ILAQITGTG

SEQ ID NO: 901824 - protein, 9 aa, Homo Sapiens
GDTGGPLIC

SEQ ID NO: 901825 - protein, 9 aa, Homo Sapiens
VFNVPFPAE

SEQ ID NO: 901826 - protein, 9 aa, Homo Sapiens
LPPKPKITA

SEQ ID NO: 901827 - protein, 9 aa, Homo Sapiens
RAVEGRDFP

SEQ ID NO: 901828 - protein, 9 aa, Homo Sapiens
CECQKGHNL

SEQ ID NO: 901829 - protein, 9 aa, Homo Sapiens
MVEVIPEMQ

SEQ ID NO: 901830 - protein, 9 aa, Homo Sapiens
LRWPHPLTT

SEQ ID NO: 901831 - protein, 9 aa, Homo Sapiens
KRPQRMLTS

SEQ ID NO: 901832 - protein, 9 aa, Homo Sapiens
HTCYCRNGG

SEQ ID NO: 901833 - protein, 9 aa, Homo Sapiens
AHFEITSDA

SEQ ID NO: 901834 - protein, 9 aa, Homo Sapiens
KPLQYASVI

SEQ ID NO: 901835 - protein, 9 aa, Homo Sapiens
DECQQSPRL

SEQ ID NO: 901836 - protein, 9 aa, Homo Sapiens
SLIAHQKFH

SEQ ID NO: 901837 - protein, 9 aa, Homo Sapiens
VVQMPQEEV

SEQ ID NO: 901838 - protein, 9 aa, Homo Sapiens
QPGPSGEWG

SEQ ID NO: 901839 - protein, 9 aa, Homo Sapiens
QFSSRYLEV

SEQ ID NO: 901840 - protein, 9 aa, Homo Sapiens
DVLRAVEGR

SEQ ID NO: 901841 - protein, 9 aa, Homo Sapiens
EGGDGYLAD

SEQ ID NO: 901842 - protein, 9 aa, Homo Sapiens
NPILIVGDT

SEQ ID NO: 901843 - protein, 9 aa, Homo Sapiens
RVKQLESCE

SEQ ID NO: 901844 - protein, 9 aa, Homo Sapiens
YSSNLNTHK

SEQ ID NO: 901845 - protein, 9 aa, Homo Sapiens
LQTRVKQLE

SEQ ID NO: 901846 - protein, 9 aa, Homo Sapiens
QMDFFYPTF

SEQ ID NO: 901847 - protein, 9 aa, Homo Sapiens
IWLGLPGKM

SEQ ID NO: 901848 - protein, 9 aa, Homo Sapiens
KGHNLSGTS

SEQ ID NO: 901849 - protein, 9 aa, Homo Sapiens
YSDFPGVSL

SEQ ID NO: 901850 - protein, 9 aa, Homo Sapiens
RGLGAIQPR

SEQ ID NO: 901851 - protein, 9 aa, Homo Sapiens
TLQLRAAPT

SEQ ID NO: 901852 - protein, 9 aa, Homo Sapiens
GTGHLKESE

SEQ ID NO: 901853 - protein, 9 aa, Homo Sapiens
CINPILIVG

SEQ ID NO: 901854 - protein, 9 aa, Homo Sapiens
AHQNRVSVI

SEQ ID NO: 901855 - protein, 9 aa, Homo Sapiens
VSKLLFEGW

SEQ ID NO: 901856 - protein, 9 aa, Homo Sapiens
EDSRTRSIL

SEQ ID NO: 901857 - protein, 9 aa, Homo Sapiens
EIKMYLGLS

SEQ ID NO: 901858 - protein, 9 aa, Homo Sapiens
ISDVIYENF

SEQ ID NO: 901859 - protein, 9 aa, Homo Sapiens
RTRSILWVQ

SEQ ID NO: 901860 - protein, 9 aa, Homo Sapiens
NKMNQYLGT

SEQ ID NO: 901861 - protein, 9 aa, Homo Sapiens
VLWLVEESN

SEQ ID NO: 901862 - protein, 9 aa, Homo Sapiens
GSVGIIKKK

SEQ ID NO: 901863 - protein, 9 aa, Homo Sapiens
EQLGIKAGN

SEQ ID NO: 901864 - protein, 9 aa, Homo Sapiens
LRARLCPVR

SEQ ID NO: 901865 - protein, 9 aa, Homo Sapiens
SAYDPGSGS

SEQ ID NO: 901866 - protein, 9 aa, Homo Sapiens
PHSHPNPDS

SEQ ID NO: 901867 - protein, 9 aa, Homo Sapiens
RLMPEPVPT

SEQ ID NO: 901868 - protein, 9 aa, Homo Sapiens
RLFSAQIAS

SEQ ID NO: 901869 - protein, 9 aa, Homo Sapiens
AYAGFRLMP

SEQ ID NO: 901870 - protein, 9 aa, Homo Sapiens
HMRINTGEK

SEQ ID NO: 901871 - protein, 9 aa, Homo Sapiens
DKQMSYGFP

SEQ ID NO: 901872 - protein, 9 aa, Homo Sapiens
IKRACEQFS

SEQ ID NO: 901873 - protein, 9 aa, Homo Sapiens
VVMVEVIPE

SEQ ID NO: 901874 - protein, 9 aa, Homo Sapiens
LGNESRFHI

SEQ ID NO: 901875 - protein, 9 aa, Homo Sapiens
LSSQAEATR

SEQ ID NO: 901876 - protein, 9 aa, Homo Sapiens
EKLPKDLGY

SEQ ID NO: 901877 - protein, 9 aa, Homo Sapiens
GQCLGSTAL

SEQ ID NO: 901878 - protein, 9 aa, Homo Sapiens
AAAENEAIL

SEQ ID NO: 901879 - protein, 9 aa, Homo Sapiens
AYDPGSGSF

SEQ ID NO: 901880 - protein, 9 aa, Homo Sapiens
RCQPQDLLL

SEQ ID NO: 901881 - protein, 9 aa, Homo Sapiens
PRCSEDDLK

SEQ ID NO: 901882 - protein, 9 aa, Homo Sapiens
FPFPPYLSS

SEQ ID NO: 901883 - protein, 9 aa, Homo Sapiens
RSRVYNGRN

SEQ ID NO: 901884 - protein, 9 aa, Homo Sapiens
RKVTGANTR

SEQ ID NO: 901885 - protein, 9 aa, Homo Sapiens
CEQFSSRYL

SEQ ID NO: 901886 - protein, 9 aa, Homo Sapiens
VEVIPEMQK

SEQ ID NO: 901887 - protein, 9 aa, Homo Sapiens
PTCPTDKPL

SEQ ID NO: 901888 - protein, 9 aa, Homo Sapiens
LSVPFDESC

SEQ ID NO: 901889 - protein, 9 aa, Homo Sapiens
PTNPPGACH

SEQ ID NO: 901890 - protein, 9 aa, Homo Sapiens
SVFNVPFPA

SEQ ID NO: 901891 - protein, 9 aa, Homo Sapiens
ESHKLMYDN

SEQ ID NO: 901892 - protein, 9 aa, Homo Sapiens
ECGKAFSVP

SEQ ID NO: 901893 - protein, 9 aa, Homo Sapiens
QKVVQMPQE

SEQ ID NO: 901894 - protein, 9 aa, Homo Sapiens
PRVNRCKLI

SEQ ID NO: 901895 - protein, 9 aa, Homo Sapiens
HLWELDGRQ

SEQ ID NO: 901896 - protein, 9 aa, Homo Sapiens
KKRVVVSKL

SEQ ID NO: 901897 - protein, 9 aa, Homo Sapiens
KKRPQRMLT

SEQ ID NO: 901898 - protein, 9 aa, Homo Sapiens
YEQLVLHHE

SEQ ID NO: 901899 - protein, 9 aa, Homo Sapiens
CYCRNGGLC

SEQ ID NO: 901900 - protein, 9 aa, Homo Sapiens
QKVCASEKL

SEQ ID NO: 901901 - protein, 9 aa, Homo Sapiens
LVIADPFQD

SEQ ID NO: 901902 - protein, 9 aa, Homo Sapiens
SRVYNGRNQ

SEQ ID NO: 901903 - protein, 9 aa, Homo Sapiens
QITGTGHLK

SEQ ID NO: 901904 - protein, 9 aa, Homo Sapiens
IVRKITMVV

SEQ ID NO: 901905 - protein, 9 aa, Homo Sapiens
IAHQKFHTG

SEQ ID NO: 901906 - protein, 9 aa, Homo Sapiens
IADPFQDLR

SEQ ID NO: 901907 - protein, 9 aa, Homo Sapiens
KKIHFRTLP

SEQ ID NO: 901908 - protein, 9 aa, Homo Sapiens
QTGVDTAKM

SEQ ID NO: 901909 - protein, 9 aa, Homo Sapiens
CAQWLHCKA

SEQ ID NO: 901910 - protein, 9 aa, Homo Sapiens
RVENGNQAR

SEQ ID NO: 901911 - protein, 9 aa, Homo Sapiens
FSSRYLEVL

SEQ ID NO: 901912 - protein, 9 aa, Homo Sapiens
EVYSCHPPW

SEQ ID NO: 901913 - protein, 9 aa, Homo Sapiens
TRISYPDQR

SEQ ID NO: 901914 - protein, 9 aa, Homo Sapiens
DQNCWHCVC

SEQ ID NO: 901915 - protein, 9 aa, Homo Sapiens
RVSVIIFSL

SEQ ID NO: 901916 - protein, 9 aa, Homo Sapiens
LDSAFEQLG

SEQ ID NO: 901917 - protein, 9 aa, Homo Sapiens
ETQRNNGIL

SEQ ID NO: 901918 - protein, 9 aa, Homo Sapiens
GTPGPKGSQ

SEQ ID NO: 901919 - protein, 9 aa, Homo Sapiens
NRRLFSAQI

SEQ ID NO: 901920 - protein, 9 aa, Homo Sapiens
WRPSAVQRP

SEQ ID NO: 901921 - protein, 9 aa, Homo Sapiens
PHGCQSSHE

SEQ ID NO: 901922 - protein, 9 aa, Homo Sapiens
WGLAGPPGR

SEQ ID NO: 901923 - protein, 9 aa, Homo Sapiens
QRAAEIQVP

SEQ ID NO: 901924 - protein, 9 aa, Homo Sapiens
TGTGHLKES

SEQ ID NO: 901925 - protein, 9 aa, Homo Sapiens
CQKGHNLSG

SEQ ID NO: 901926 - protein, 9 aa, Homo Sapiens
KMVLSGAKD

SEQ ID NO: 901927 - protein, 9 aa, Homo Sapiens
LVVVGAGDV

SEQ ID NO: 901928 - protein, 9 aa, Homo Sapiens
FPGVSLLAG

SEQ ID NO: 901929 - protein, 9 aa, Homo Sapiens
VDECQQSPR

SEQ ID NO: 901930 - protein, 9 aa, Homo Sapiens
EVIPEMQKS

SEQ ID NO: 901931 - protein, 9 aa, Homo Sapiens
QASGLRARL

SEQ ID NO: 901932 - protein, 9 aa, Homo Sapiens
AKGGLARWP

SEQ ID NO: 901933 - protein, 9 aa, Homo Sapiens
LRPRLSDRG

SEQ ID NO: 901934 - protein, 9 aa, Homo Sapiens
ASGLRARLC

SEQ ID NO: 901935 - protein, 9 aa, Homo Sapiens
YGYGRSRVY

SEQ ID NO: 901936 - protein, 9 aa, Homo Sapiens
ATFKQEMEK

SEQ ID NO: 901937 - protein, 9 aa, Homo Sapiens
QMSSFETQR

SEQ ID NO: 901938 - protein, 9 aa, Homo Sapiens
TRSILWVQA

SEQ ID NO: 901939 - protein, 9 aa, Homo Sapiens
GKGTLEQEV

SEQ ID NO: 901940 - protein, 9 aa, Homo Sapiens
ALLTLRWPH

SEQ ID NO: 901941 - protein, 9 aa, Homo Sapiens
EDDQRAAEI

SEQ ID NO: 901942 - protein, 9 aa, Homo Sapiens
LEAMLALKN

SEQ ID NO: 901943 - protein, 9 aa, Homo Sapiens
QKDSCKGDT

SEQ ID NO: 901944 - protein, 9 aa, Homo Sapiens
LETRISYPD

SEQ ID NO: 901945 - protein, 9 aa, Homo Sapiens
KDGGLFLPP

SEQ ID NO: 901946 - protein, 9 aa, Homo Sapiens
VLEDNLDSL

SEQ ID NO: 901947 - protein, 9 aa, Homo Sapiens
HERWMRTLL

SEQ ID NO: 901948 - protein, 9 aa, Homo Sapiens
HSNVNTLCP

SEQ ID NO: 901949 - protein, 9 aa, Homo Sapiens
RRLFSAQIA

SEQ ID NO: 901950 - protein, 9 aa, Homo Sapiens
YPTFDYEMI

SEQ ID NO: 901951 - protein, 9 aa, Homo Sapiens
SPRRGPSSL

SEQ ID NO: 901952 - protein, 9 aa, Homo Sapiens
VNGRVENGN

SEQ ID NO: 901953 - protein, 9 aa, Homo Sapiens
DTAKMVLSG

SEQ ID NO: 901954 - protein, 9 aa, Homo Sapiens
HRWRRLPPS

SEQ ID NO: 901955 - protein, 9 aa, Homo Sapiens
DVGKSALTI

SEQ ID NO: 901956 - protein, 9 aa, Homo Sapiens
LQYASVISP

SEQ ID NO: 901957 - protein, 9 aa, Homo Sapiens
EATRSTTGE

SEQ ID NO: 901958 - protein, 9 aa, Homo Sapiens
GVGCEHTCY

SEQ ID NO: 901959 - protein, 9 aa, Homo Sapiens
LPKDLGYIY

SEQ ID NO: 901960 - protein, 9 aa, Homo Sapiens
LYRDGHEAA

SEQ ID NO: 901961 - protein, 9 aa, Homo Sapiens
RETGDSFSD

SEQ ID NO: 901962 - protein, 9 aa, Homo Sapiens
KDLQTRVKQ

SEQ ID NO: 901963 - protein, 9 aa, Homo Sapiens
SVPIQQCGC

SEQ ID NO: 901964 - protein, 9 aa, Homo Sapiens
ILSIFCAQS

SEQ ID NO: 901965 - protein, 9 aa, Homo Sapiens
EGDVIDDWC

SEQ ID NO: 901966 - protein, 9 aa, Homo Sapiens
MVHLKPKSR

SEQ ID NO: 901967 - protein, 9 aa, Homo Sapiens
GHEAALSKF

SEQ ID NO: 901968 - protein, 9 aa, Homo Sapiens
DLVQLEQNK

SEQ ID NO: 901969 - protein, 9 aa, Homo Sapiens
NREVNGRVE

SEQ ID NO: 901970 - protein, 9 aa, Homo Sapiens
SLKSAKVEA

SEQ ID NO: 901971 - protein, 9 aa, Homo Sapiens
DCTLRIRDT

SEQ ID NO: 901972 - protein, 9 aa, Homo Sapiens
WLHCKAGTQ

SEQ ID NO: 901973 - protein, 9 aa, Homo Sapiens
QWLHCKAGT

SEQ ID NO: 901974 - protein, 9 aa, Homo Sapiens
DQRAAEIQV

SEQ ID NO: 901975 - protein, 9 aa, Homo Sapiens
VAADGEVKH

SEQ ID NO: 901976 - protein, 9 aa, Homo Sapiens
EEYENGGQC

SEQ ID NO: 901977 - protein, 9 aa, Homo Sapiens
PCSMRESGL

SEQ ID NO: 901978 - protein, 9 aa, Homo Sapiens
QRMKISRRL

SEQ ID NO: 901979 - protein, 9 aa, Homo Sapiens
SPHGCQSSH

SEQ ID NO: 901980 - protein, 9 aa, Homo Sapiens
YNREVNGRV

SEQ ID NO: 901981 - protein, 9 aa, Homo Sapiens
CLDPKSPGV

SEQ ID NO: 901982 - protein, 9 aa, Homo Sapiens
SNLGSAVVE

SEQ ID NO: 901983 - protein, 9 aa, Homo Sapiens
DFFYPTFDY

SEQ ID NO: 901984 - protein, 9 aa, Homo Sapiens
CKPLQYASV

SEQ ID NO: 901985 - protein, 9 aa, Homo Sapiens
GSGSFGVQT

SEQ ID NO: 901986 - protein, 9 aa, Homo Sapiens
NLQESLRRK

SEQ ID NO: 901987 - protein, 9 aa, Homo Sapiens
ASPRRGPSS

SEQ ID NO: 901988 - protein, 9 aa, Homo Sapiens
NLDSLSLYS

SEQ ID NO: 901989 - protein, 9 aa, Homo Sapiens
HLKPKSRHV

SEQ ID NO: 901990 - protein, 9 aa, Homo Sapiens
VIADPFQDL

SEQ ID NO: 901991 - protein, 9 aa, Homo Sapiens
FCAQSGARR

SEQ ID NO: 901992 - protein, 9 aa, Homo Sapiens
FKYSSNLNT

SEQ ID NO: 901993 - protein, 9 aa, Homo Sapiens
LEASLKSAK

SEQ ID NO: 901994 - protein, 9 aa, Homo Sapiens
RLPEVGKYT

SEQ ID NO: 901995 - protein, 9 aa, Homo Sapiens
LGSAVVELM

SEQ ID NO: 901996 - protein, 9 aa, Homo Sapiens
AQITGTGHL

SEQ ID NO: 901997 - protein, 9 aa, Homo Sapiens
GYLADEEEG

SEQ ID NO: 901998 - protein, 9 aa, Homo Sapiens
VHLKPKSRH

SEQ ID NO: 901999 - protein, 9 aa, Homo Sapiens
CTHCLDPKS

SEQ ID NO: 902000 - protein, 9 aa, Homo Sapiens
MYLGLSKMQ

SEQ ID NO: 902001 - protein, 9 aa, Homo Sapiens
GDGYLADEE

SEQ ID NO: 902002 - protein, 9 aa, Homo Sapiens
ISFIDICYS

SEQ ID NO: 902003 - protein, 9 aa, Homo Sapiens
CWRPSAVQR

SEQ ID NO: 902004 - protein, 9 aa, Homo Sapiens
GCYACSVAA

SEQ ID NO: 902005 - protein, 9 aa, Homo Sapiens
YKLQSDNVY

SEQ ID NO: 902006 - protein, 9 aa, Homo Sapiens
CKGDTGGPL

SEQ ID NO: 902007 - protein, 9 aa, Homo Sapiens
GRSRVYNGR

SEQ ID NO: 902008 - protein, 9 aa, Homo Sapiens
LGRVDPWYH

SEQ ID NO: 902009 - protein, 9 aa, Homo Sapiens
TLKKRPQRM

SEQ ID NO: 902010 - protein, 9 aa, Homo Sapiens
RSTTGEGPE

SEQ ID NO: 902011 - protein, 9 aa, Homo Sapiens
DNLDSLSLY

SEQ ID NO: 902012 - protein, 9 aa, Homo Sapiens
VYTAVLFPH

SEQ ID NO: 902013 - protein, 9 aa, Homo Sapiens
ACEQFSSRY

SEQ ID NO: 902014 - protein, 9 aa, Homo Sapiens
KSAKVEAHQ

SEQ ID NO: 902015 - protein, 9 aa, Homo Sapiens
DAICTHCLD

SEQ ID NO: 902016 - protein, 9 aa, Homo Sapiens
LDQNCWHCV

SEQ ID NO: 902017 - protein, 9 aa, Homo Sapiens
QLEQNKAAF

SEQ ID NO: 902018 - protein, 9 aa, Homo Sapiens
HPNPDSQEK

SEQ ID NO: 902019 - protein, 9 aa, Homo Sapiens
QRCWRPSAV

SEQ ID NO: 902020 - protein, 9 aa, Homo Sapiens
GAGDVGKSA

SEQ ID NO: 902021 - protein, 9 aa, Homo Sapiens
SRRLPEVGK

SEQ ID NO: 902022 - protein, 9 aa, Homo Sapiens
FEQLGIKAG

SEQ ID NO: 902023 - protein, 9 aa, Homo Sapiens
NTGEKPYKC

SEQ ID NO: 902024 - protein, 9 aa, Homo Sapiens
KQEDVVLWL

SEQ ID NO: 902025 - protein, 9 aa, Homo Sapiens
SDFPGVSLL

SEQ ID NO: 902026 - protein, 9 aa, Homo Sapiens
CCAQWLHCK

SEQ ID NO: 902027 - protein, 9 aa, Homo Sapiens
ADTYIPTII

SEQ ID NO: 902028 - protein, 9 aa, Homo Sapiens
PVMIVRCQP

SEQ ID NO: 902029 - protein, 9 aa, Homo Sapiens
PFPAEESLH

SEQ ID NO: 902030 - protein, 9 aa, Homo Sapiens
YENGGQCLG

SEQ ID NO: 902031 - protein, 9 aa, Homo Sapiens
RCTLDQNCW

SEQ ID NO: 902032 - protein, 9 aa, Homo Sapiens
VLKIPDIAL

SEQ ID NO: 902033 - protein, 9 aa, Homo Sapiens
TQLSVPFDE

SEQ ID NO: 902034 - protein, 9 aa, Homo Sapiens
DPGNSPCSM

SEQ ID NO: 902035 - protein, 9 aa, Homo Sapiens
IKDGGLFLP

SEQ ID NO: 902036 - protein, 9 aa, Homo Sapiens
ATEELIAGF

SEQ ID NO: 902037 - protein, 9 aa, Homo Sapiens
QASVPIQQC

SEQ ID NO: 902038 - protein, 9 aa, Homo Sapiens
EVNGRVENG

SEQ ID NO: 902039 - protein, 9 aa, Homo Sapiens
VDPWYHSNV

SEQ ID NO: 902040 - protein, 9 aa, Homo Sapiens
NTQLSVPFD

SEQ ID NO: 902041 - protein, 9 aa, Homo Sapiens
RNLQESLRR

SEQ ID NO: 902042 - protein, 9 aa, Homo Sapiens
GDSFSDVAI

SEQ ID NO: 902043 - protein, 9 aa, Homo Sapiens
ENGGQCLGS

SEQ ID NO: 902044 - protein, 9 aa, Homo Sapiens
SLMTHMRIN

SEQ ID NO: 902045 - protein, 9 aa, Homo Sapiens
EELIAGFTG

SEQ ID NO: 902046 - protein, 9 aa, Homo Sapiens
DGHEAALSK

SEQ ID NO: 902047 - protein, 9 aa, Homo Sapiens
SAKLVGFYL

SEQ ID NO: 902048 - protein, 9 aa, Homo Sapiens
RRLPPSDEF

SEQ ID NO: 902049 - protein, 9 aa, Homo Sapiens
NPKSMVLDL

SEQ ID NO: 902050 - protein, 9 aa, Homo Sapiens
PQRMLTSAP

SEQ ID NO: 902051 - protein, 9 aa, Homo Sapiens
GLGAIQPRV

SEQ ID NO: 902052 - protein, 9 aa, Homo Sapiens
IVRCQPQDL

SEQ ID NO: 902053 - protein, 9 aa, Homo Sapiens
SFETQRNNG

SEQ ID NO: 902054 - protein, 9 aa, Homo Sapiens
GAIQPRVNR

SEQ ID NO: 902055 - protein, 9 aa, Homo Sapiens
ESRFHINKT

SEQ ID NO: 902056 - protein, 9 aa, Homo Sapiens
REIYNPKSM

SEQ ID NO: 902057 - protein, 9 aa, Homo Sapiens
QSSHEKGLK

SEQ ID NO: 902058 - protein, 9 aa, Homo Sapiens
ADDLETRIS

SEQ ID NO: 902059 - protein, 9 aa, Homo Sapiens
CGKAFSVPS

SEQ ID NO: 902060 - protein, 9 aa, Homo Sapiens
LLTLRWPHP

SEQ ID NO: 902061 - protein, 9 aa, Homo Sapiens
EASLKSAKV

SEQ ID NO: 902062 - protein, 9 aa, Homo Sapiens
YWCSGEGDV

SEQ ID NO: 902063 - protein, 9 aa, Homo Sapiens
NVPFPAEES

SEQ ID NO: 902064 - protein, 9 aa, Homo Sapiens
TLDQNCWHC

SEQ ID NO: 902065 - protein, 9 aa, Homo Sapiens
YCRNGGLCH

SEQ ID NO: 902066 - protein, 9 aa, Homo Sapiens
PGSGSFGVQ

SEQ ID NO: 902067 - protein, 9 aa, Homo Sapiens
KQLESCECH

SEQ ID NO: 902068 - protein, 9 aa, Homo Sapiens
RASDLAKQI

SEQ ID NO: 902069 - protein, 9 aa, Homo Sapiens
PSAVQRPSA

SEQ ID NO: 902070 - protein, 9 aa, Homo Sapiens
VANKYRNYD

SEQ ID NO: 902071 - protein, 9 aa, Homo Sapiens
SCINPILIV

SEQ ID NO: 902072 - protein, 9 aa, Homo Sapiens
VVALVAQLK

SEQ ID NO: 902073 - protein, 9 aa, Homo Sapiens
TRSTTGEGP

SEQ ID NO: 902074 - protein, 9 aa, Homo Sapiens
RQEEKGKGT

SEQ ID NO: 902075 - protein, 9 aa, Homo Sapiens
KAYKLQSDN

SEQ ID NO: 902076 - protein, 9 aa, Homo Sapiens
MRESGLETV

SEQ ID NO: 902077 - protein, 9 aa, Homo Sapiens
QYASVISPQ

SEQ ID NO: 902078 - protein, 9 aa, Homo Sapiens
QCLGSTALT

SEQ ID NO: 902079 - protein, 9 aa, Homo Sapiens
DFPGVSLLA

SEQ ID NO: 902080 - protein, 9 aa, Homo Sapiens
HYYTMRIWL

SEQ ID NO: 902081 - protein, 9 aa, Homo Sapiens
MIVRCQPQD

SEQ ID NO: 902082 - protein, 9 aa, Homo Sapiens
NLSGTSCVP

SEQ ID NO: 902083 - protein, 9 aa, Homo Sapiens
DGYLADEEE

SEQ ID NO: 902084 - protein, 9 aa, Homo Sapiens
NTVVYTAVL

SEQ ID NO: 902085 - protein, 9 aa, Homo Sapiens
IGSCINPIL

SEQ ID NO: 902086 - protein, 9 aa, Homo Sapiens
ILPPTCPTD

SEQ ID NO: 902087 - protein, 9 aa, Homo Sapiens
VAQLKFCGP

SEQ ID NO: 902088 - protein, 9 aa, Homo Sapiens
FMLEAMLAL

SEQ ID NO: 902089 - protein, 9 aa, Homo Sapiens
TVVYTAVLF

SEQ ID NO: 902090 - protein, 9 aa, Homo Sapiens
SVIIFSLAT

SEQ ID NO: 902091 - protein, 9 aa, Homo Sapiens
LEDNLDSLS

SEQ ID NO: 902092 - protein, 9 aa, Homo Sapiens
DSVVEETLQ

SEQ ID NO: 902093 - protein, 9 aa, Homo Sapiens
AKKIHFRTL

SEQ ID NO: 902094 - protein, 9 aa, Homo Sapiens
LIAGFTGPW

SEQ ID NO: 902095 - protein, 9 aa, Homo Sapiens
DTGGPLICK

SEQ ID NO: 902096 - protein, 9 aa, Homo Sapiens
GQPGPSGEW

SEQ ID NO: 902097 - protein, 9 aa, Homo Sapiens
YLADEEEGT

SEQ ID NO: 902098 - protein, 9 aa, Homo Sapiens
DTILPPTCP

SEQ ID NO: 902099 - protein, 9 aa, Homo Sapiens
KDSCKGDTG

SEQ ID NO: 902100 - protein, 9 aa, Homo Sapiens
EHTCYCRNG

SEQ ID NO: 902101 - protein, 9 aa, Homo Sapiens
QKNFIESHK

SEQ ID NO: 902102 - protein, 9 aa, Homo Sapiens
CSGEGDVID

SEQ ID NO: 902103 - protein, 9 aa, Homo Sapiens
LRAVEGRDF

SEQ ID NO: 902104 - protein, 9 aa, Homo Sapiens
VRCQPQDLL

SEQ ID NO: 902105 - protein, 9 aa, Homo Sapiens
YTMRIWLGL

SEQ ID NO: 902106 - protein, 9 aa, Homo Sapiens
MQRASDLAK

SEQ ID NO: 902107 - protein, 9 aa, Homo Sapiens
FTGPWESPQ

SEQ ID NO: 902108 - protein, 9 aa, Homo Sapiens
QKREDDQRA

SEQ ID NO: 902109 - protein, 9 aa, Homo Sapiens
DLETRISYP

SEQ ID NO: 902110 - protein, 9 aa, Homo Sapiens
GGQCLGSTA

SEQ ID NO: 902111 - protein, 9 aa, Homo Sapiens
EAALSKFTL

SEQ ID NO: 902112 - protein, 9 aa, Homo Sapiens
PNPDSQEKP

SEQ ID NO: 902113 - protein, 9 aa, Homo Sapiens
VVKIVANKY

SEQ ID NO: 902114 - protein, 9 aa, Homo Sapiens
AILLPSGEL

SEQ ID NO: 902115 - protein, 9 aa, Homo Sapiens
AFEQLGIKA

SEQ ID NO: 902116 - protein, 9 aa, Homo Sapiens
GPSGEWGLA

SEQ ID NO: 902117 - protein, 9 aa, Homo Sapiens
KNADTYIPT

SEQ ID NO: 902118 - protein, 9 aa, Homo Sapiens
AIQMSSFET

SEQ ID NO: 902119 - protein, 9 aa, Homo Sapiens
LSQLSAKLV

SEQ ID NO: 902120 - protein, 9 aa, Homo Sapiens
QSGARRVYA

SEQ ID NO: 902121 - protein, 9 aa, Homo Sapiens
MVLSGAKDA

SEQ ID NO: 902122 - protein, 9 aa, Homo Sapiens
QMSYGFPFP

SEQ ID NO: 902123 - protein, 9 aa, Homo Sapiens
VPFDESCPP

SEQ ID NO: 902124 - protein, 9 aa, Homo Sapiens
GLFLPPLSV

SEQ ID NO: 902125 - protein, 9 aa, Homo Sapiens
DGGLFLPPL

SEQ ID NO: 902126 - protein, 9 aa, Homo Sapiens
WCSGEGDVI

SEQ ID NO: 902127 - protein, 9 aa, Homo Sapiens
QNCWHCVCQ

SEQ ID NO: 902128 - protein, 9 aa, Homo Sapiens
GRVDPWYHS

SEQ ID NO: 902129 - protein, 9 aa, Homo Sapiens
SKLLFEGWS

SEQ ID NO: 902130 - protein, 9 aa, Homo Sapiens
RGPSSLGPG

SEQ ID NO: 902131 - protein, 9 aa, Homo Sapiens
HGCQSSHEK

SEQ ID NO: 902132 - protein, 9 aa, Homo Sapiens
CQSSHEKGL

SEQ ID NO: 902133 - protein, 9 aa, Homo Sapiens
RSILWVQAA

SEQ ID NO: 902134 - protein, 9 aa, Homo Sapiens
DVLEASLKS

SEQ ID NO: 902135 - protein, 9 aa, Homo Sapiens
PNTQLSVPF

SEQ ID NO: 902136 - protein, 9 aa, Homo Sapiens
EAILLPSGE

SEQ ID NO: 902137 - protein, 9 aa, Homo Sapiens
QEDVVLWLV

SEQ ID NO: 902138 - protein, 9 aa, Homo Sapiens
SDEFVGARR

SEQ ID NO: 902139 - protein, 9 aa, Homo Sapiens
RCSEDDLKA

SEQ ID NO: 902140 - protein, 9 aa, Homo Sapiens
EIYNPKSMV

SEQ ID NO: 902141 - protein, 9 aa, Homo Sapiens
QSLIAHQKF

SEQ ID NO: 902142 - protein, 9 aa, Homo Sapiens
KGSQGSLGP

SEQ ID NO: 902143 - protein, 9 aa, Homo Sapiens
RKILLRWKY

SEQ ID NO: 902144 - protein, 9 aa, Homo Sapiens
EQLVLHHER

SEQ ID NO: 902145 - protein, 9 aa, Homo Sapiens
RVDPWYHSN

SEQ ID NO: 902146 - protein, 9 aa, Homo Sapiens
PPSDEFVGA

SEQ ID NO: 902147 - protein, 9 aa, Homo Sapiens
MDFFYPTFD

SEQ ID NO: 902148 - protein, 9 aa, Homo Sapiens
KNFIESHKL

SEQ ID NO: 902149 - protein, 9 aa, Homo Sapiens
ITMVVLSSE

SEQ ID NO: 902150 - protein, 9 aa, Homo Sapiens
CRAKGGLAR

SEQ ID NO: 902151 - protein, 9 aa, Homo Sapiens
PAHQNRVSV

SEQ ID NO: 902152 - protein, 9 aa, Homo Sapiens
PHYYTMRIW

SEQ ID NO: 902153 - protein, 9 aa, Homo Sapiens
PSDEFVGAR

SEQ ID NO: 902154 - protein, 9 aa, Homo Sapiens
PPKKEIKMY

SEQ ID NO: 902155 - protein, 9 aa, Homo Sapiens
ASEKLPKDL

SEQ ID NO: 902156 - protein, 9 aa, Homo Sapiens
DSAFEQLGI

SEQ ID NO: 902157 - protein, 9 aa, Homo Sapiens
TCYCRNGGL

SEQ ID NO: 902158 - protein, 9 aa, Homo Sapiens
KIVANKYRN

SEQ ID NO: 902159 - protein, 9 aa, Homo Sapiens
VALVAQLKF

SEQ ID NO: 902160 - protein, 9 aa, Homo Sapiens
ANTRKIFAM

SEQ ID NO: 902161 - protein, 9 aa, Homo Sapiens
IFRETGDSF

SEQ ID NO: 902162 - protein, 9 aa, Homo Sapiens
RPRLSDRGT

SEQ ID NO: 902163 - protein, 9 aa, Homo Sapiens
MPEPVPTCS

SEQ ID NO: 902164 - protein, 9 aa, Homo Sapiens
QKGHNLSGT

SEQ ID NO: 902165 - protein, 9 aa, Homo Sapiens
RMLTSAPAL

SEQ ID NO: 902166 - protein, 9 aa, Homo Sapiens
GANTRKIFA

SEQ ID NO: 902167 - protein, 9 aa, Homo Sapiens
IHVICCVLS

SEQ ID NO: 902168 - protein, 9 aa, Homo Sapiens
NLGSAVVEL

SEQ ID NO: 902169 - protein, 9 aa, Homo Sapiens
EWGLAGPPG

SEQ ID NO: 902170 - protein, 9 aa, Homo Sapiens
PKSMVLDLC

SEQ ID NO: 902171 - protein, 9 aa, Homo Sapiens
PLPPKPKIT

SEQ ID NO: 902172 - protein, 9 aa, Homo Sapiens
IDGDGTAHF

SEQ ID NO: 902173 - protein, 9 aa, Homo Sapiens
LRQEEKGKG

SEQ ID NO: 902174 - protein, 9 aa, Homo Sapiens
ACSVAADGE

SEQ ID NO: 902175 - protein, 9 aa, Homo Sapiens
TPLVIADPF

SEQ ID NO: 902176 - protein, 9 aa, Homo Sapiens
AMLALKNND

SEQ ID NO: 902177 - protein, 9 aa, Homo Sapiens
VRKITMVVL

SEQ ID NO: 902178 - protein, 9 aa, Homo Sapiens
AQSGARRVY

SEQ ID NO: 902179 - protein, 9 aa, Homo Sapiens
FYPTFDYEM

SEQ ID NO: 902180 - protein, 9 aa, Homo Sapiens
RRLPEVGKY

SEQ ID NO: 902181 - protein, 9 aa, Homo Sapiens
NLNTHKKIH

SEQ ID NO: 902182 - protein, 9 aa, Homo Sapiens
KLPKDLGYI

SEQ ID NO: 902183 - protein, 9 aa, Homo Sapiens
RKITMVVLS

SEQ ID NO: 902184 - protein, 9 aa, Homo Sapiens
LQRMKISRR

SEQ ID NO: 902185 - protein, 9 aa, Homo Sapiens
RIRDTRESD

SEQ ID NO: 902186 - protein, 9 aa, Homo Sapiens
IESHKLMYD

SEQ ID NO: 902187 - protein, 9 aa, Homo Sapiens
KQIVRKITM

SEQ ID NO: 902188 - protein, 9 aa, Homo Sapiens
TVMNVRKIL

SEQ ID NO: 902189 - protein, 9 aa, Homo Sapiens
AQPRCSEDD

SEQ ID NO: 902190 - protein, 9 aa, Homo Sapiens
SVVEETLQL

SEQ ID NO: 902191 - protein, 9 aa, Homo Sapiens
TPGPKGSQG

SEQ ID NO: 902192 - protein, 9 aa, Homo Sapiens
WYHSNVNTL

SEQ ID NO: 902193 - protein, 9 aa, Homo Sapiens
FFYPTFDYE

SEQ ID NO: 902194 - protein, 9 aa, Homo Sapiens
VQLEQNKAA

SEQ ID NO: 902195 - protein, 9 aa, Homo Sapiens
ILRQEEKGK

SEQ ID NO: 902196 - protein, 9 aa, Homo Sapiens
ATRSTTGEG

SEQ ID NO: 902197 - protein, 9 aa, Homo Sapiens
VDTAKMVLS

SEQ ID NO: 902198 - protein, 9 aa, Homo Sapiens
TGGPLICKG

SEQ ID NO: 902199 - protein, 9 aa, Homo Sapiens
EQFSSRYLE

SEQ ID NO: 902200 - protein, 9 aa, Homo Sapiens
LPPTCPTDK

SEQ ID NO: 902201 - protein, 9 aa, Homo Sapiens
GEGDVIDDW

SEQ ID NO: 902202 - protein, 9 aa, Homo Sapiens
AADGEVKHC

SEQ ID NO: 902203 - protein, 9 aa, Homo Sapiens
ANKYRNYDI

SEQ ID NO: 902204 - protein, 9 aa, Homo Sapiens
AGFTGPWES

SEQ ID NO: 902205 - protein, 9 aa, Homo Sapiens
PSGEWGLAG

SEQ ID NO: 902206 - protein, 9 aa, Homo Sapiens
KAAFSVAVC

SEQ ID NO: 902207 - protein, 9 aa, Homo Sapiens
EVLEDNLDS

SEQ ID NO: 902208 - protein, 9 aa, Homo Sapiens
VKIVANKYR

SEQ ID NO: 902209 - protein, 9 aa, Homo Sapiens
HFEITSDAQ

SEQ ID NO: 902210 - protein, 9 aa, Homo Sapiens
KQEMEKTTK

SEQ ID NO: 902211 - protein, 9 aa, Homo Sapiens
LQASGLRAR

SEQ ID NO: 902212 - protein, 9 aa, Homo Sapiens
MRIWLGLPG

SEQ ID NO: 902213 - protein, 9 aa, Homo Sapiens
IQPRVNRCK

SEQ ID NO: 902214 - protein, 9 aa, Homo Sapiens
YIAICKPLQ

SEQ ID NO: 902215 - protein, 9 aa, Homo Sapiens
KVVQMPQEE

SEQ ID NO: 902216 - protein, 9 aa, Homo Sapiens
ACCAQWLHC

SEQ ID NO: 902217 - protein, 9 aa, Homo Sapiens
VLEASLKSA

SEQ ID NO: 902218 - protein, 9 aa, Homo Sapiens
LQESLRRKE

SEQ ID NO: 902219 - protein, 9 aa, Homo Sapiens
ASDLAKQIN

SEQ ID NO: 902220 - protein, 9 aa, Homo Sapiens
AVREVLKIP

SEQ ID NO: 902221 - protein, 9 aa, Homo Sapiens
RIRFMLEAM

SEQ ID NO: 902222 - protein, 9 aa, Homo Sapiens
NSPHGCQSS

SEQ ID NO: 902223 - protein, 9 aa, Homo Sapiens
LTLKKRPQR

SEQ ID NO: 902224 - protein, 9 aa, Homo Sapiens
PKSRHVSAQ

SEQ ID NO: 902225 - protein, 9 aa, Homo Sapiens
MSSFETQRN

SEQ ID NO: 902226 - protein, 9 aa, Homo Sapiens
AKKAYKLQS

SEQ ID NO: 902227 - protein, 9 aa, Homo Sapiens
SNISFIDIC

SEQ ID NO: 902228 - protein, 9 aa, Homo Sapiens
GVDAICTHC

SEQ ID NO: 902229 - protein, 9 aa, Homo Sapiens
SGARRVYAV

SEQ ID NO: 902230 - protein, 9 aa, Homo Sapiens
PCRAKGGLA

SEQ ID NO: 902231 - protein, 9 aa, Homo Sapiens
CYACSVAAD

SEQ ID NO: 902232 - protein, 9 aa, Homo Sapiens
DIFRETGDS

SEQ ID NO: 902233 - protein, 9 aa, Homo Sapiens
TLRIRDTRE

SEQ ID NO: 902234 - protein, 9 aa, Homo Sapiens
DSFSDVAIQ

SEQ ID NO: 902235 - protein, 9 aa, Homo Sapiens
SSFETQRNN

SEQ ID NO: 902236 - protein, 9 aa, Homo Sapiens
PGACHLWEL

SEQ ID NO: 902237 - protein, 9 aa, Homo Sapiens
DVDECQQSP

SEQ ID NO: 902238 - protein, 9 aa, Homo Sapiens
MYFFLSNIS

SEQ ID NO: 902239 - protein, 9 aa, Homo Sapiens
YSCHPPWSP

SEQ ID NO: 902240 - protein, 9 aa, Homo Sapiens
NISFIDICY

SEQ ID NO: 902241 - protein, 9 aa, Homo Sapiens
TRVKQLESC

SEQ ID NO: 902242 - protein, 9 aa, Homo Sapiens
PPGACHLWE

SEQ ID NO: 902243 - protein, 9 aa, Homo Sapiens
GIKAGNSDS

SEQ ID NO: 902244 - protein, 9 aa, Homo Sapiens
AGDVGKSAL

SEQ ID NO: 902245 - protein, 9 aa, Homo Sapiens
IHNTVVYTA

SEQ ID NO: 902246 - protein, 9 aa, Homo Sapiens
GYGYGRSRV

SEQ ID NO: 902247 - protein, 9 aa, Homo Sapiens
RRGPSSLGP

SEQ ID NO: 902248 - protein, 9 aa, Homo Sapiens
FHTGEKPYA

SEQ ID NO: 902249 - protein, 9 aa, Homo Sapiens
RPSAVQRPS

SEQ ID NO: 902250 - protein, 9 aa, Homo Sapiens
QLVLHHERW

SEQ ID NO: 902251 - protein, 9 aa, Homo Sapiens
TCPTDKPLR

SEQ ID NO: 902252 - protein, 9 aa, Homo Sapiens
LANRRLFSA

SEQ ID NO: 902253 - protein, 9 aa, Homo Sapiens
QNRVSVIIF

SEQ ID NO: 902254 - protein, 9 aa, Homo Sapiens
QNKAAFSVA

SEQ ID NO: 902255 - protein, 9 aa, Homo Sapiens
PADDLETRI

SEQ ID NO: 902256 - protein, 9 aa, Homo Sapiens
TAKMVLSGA

SEQ ID NO: 902257 - protein, 9 aa, Homo Sapiens
GCQSSHEKG

SEQ ID NO: 902258 - protein, 9 aa, Homo Sapiens
SHPNPDSQE

SEQ ID NO: 902259 - protein, 9 aa, Homo Sapiens
FETQRNNGI

SEQ ID NO: 902260 - protein, 9 aa, Homo Sapiens
GSQGSLGPT

SEQ ID NO: 902261 - protein, 9 aa, Homo Sapiens
MSYGFPFPP

SEQ ID NO: 902262 - protein, 9 aa, Homo Sapiens
LSAKLVGFY

SEQ ID NO: 902263 - protein, 9 aa, Homo Sapiens
NTRKIFAMK

SEQ ID NO: 902264 - protein, 9 aa, Homo Sapiens
AHQKFHTGE

SEQ ID NO: 902265 - protein, 9 aa, Homo Sapiens
KRACEQFSS

SEQ ID NO: 902266 - protein, 9 aa, Homo Sapiens
NGQASVPIQ

SEQ ID NO: 902267 - protein, 9 aa, Homo Sapiens
YGFPFPPYL

SEQ ID NO: 902268 - protein, 9 aa, Homo Sapiens
AFPLPEGSY

SEQ ID NO: 902269 - protein, 9 aa, Homo Sapiens
KVCASEKLP

SEQ ID NO: 902270 - protein, 9 aa, Homo Sapiens
ANRRLFSAQ

SEQ ID NO: 902271 - protein, 9 aa, Homo Sapiens
REVLKIPDI

SEQ ID NO: 902272 - protein, 9 aa, Homo Sapiens
LHCKAGTQT

SEQ ID NO: 902273 - protein, 9 aa, Homo Sapiens
SFSDVAIQG

SEQ ID NO: 902274 - protein, 9 aa, Homo Sapiens
NRVSVIIFS

SEQ ID NO: 902275 - protein, 9 aa, Homo Sapiens
TILPPTCPT

SEQ ID NO: 902276 - protein, 9 aa, Homo Sapiens
VETPLVIAD

SEQ ID NO: 902277 - protein, 9 aa, Homo Sapiens
PAPTASPRR

SEQ ID NO: 902278 - protein, 9 aa, Homo Sapiens
QQSPRLCKS

SEQ ID NO: 902279 - protein, 9 aa, Homo Sapiens
QPQDLLLVE

SEQ ID NO: 902280 - protein, 9 aa, Homo Sapiens
SYEAAFPLP

SEQ ID NO: 902281 - protein, 9 aa, Homo Sapiens
ALQKNFIES

SEQ ID NO: 902282 - protein, 9 aa, Homo Sapiens
AEESLHLIY

SEQ ID NO: 902283 - protein, 9 aa, Homo Sapiens
VSVIIFSLA

SEQ ID NO: 902284 - protein, 9 aa, Homo Sapiens
GDGTAHFEI

SEQ ID NO: 902285 - protein, 9 aa, Homo Sapiens
PDSQEKPER

SEQ ID NO: 902286 - protein, 9 aa, Homo Sapiens
IQMSSFETQ

SEQ ID NO: 902287 - protein, 9 aa, Homo Sapiens
SDLAKQINH

SEQ ID NO: 902288 - protein, 9 aa, Homo Sapiens
RWRRLPPSD

SEQ ID NO: 902289 - protein, 9 aa, Homo Sapiens
VLHHERWMR

SEQ ID NO: 902290 - protein, 9 aa, Homo Sapiens
KFHTGEKPY

SEQ ID NO: 902291 - protein, 9 aa, Homo Sapiens
KDVLEASLK

SEQ ID NO: 902292 - protein, 9 aa, Homo Sapiens
AKQIVRKIT

SEQ ID NO: 902293 - protein, 9 aa, Homo Sapiens
EAMLALKNN

SEQ ID NO: 902294 - protein, 9 aa, Homo Sapiens
GSAVVELMR

SEQ ID NO: 902295 - protein, 9 aa, Homo Sapiens
PPTCPTDKP

SEQ ID NO: 902296 - protein, 9 aa, Homo Sapiens
LPPSDEFVG

SEQ ID NO: 902297 - protein, 9 aa, Homo Sapiens
THCLDPKSP

SEQ ID NO: 902298 - protein, 9 aa, Homo Sapiens
LDTILPPTC

SEQ ID NO: 902299 - protein, 9 aa, Homo Sapiens
PSSLTTHQA

SEQ ID NO: 902300 - protein, 9 aa, Homo Sapiens
PLVIADPFQ

SEQ ID NO: 902301 - protein, 9 aa, Homo Sapiens
CQPQDLLLV

SEQ ID NO: 902302 - protein, 9 aa, Homo Sapiens
FRLMPEPVP

SEQ ID NO: 902303 - protein, 9 aa, Homo Sapiens
AFSVPSSLT

SEQ ID NO: 902304 - protein, 9 aa, Homo Sapiens
RVNRCKLIT

SEQ ID NO: 902305 - protein, 9 aa, Homo Sapiens
RPQRMLTSA

SEQ ID NO: 902306 - protein, 9 aa, Homo Sapiens
GQMDFFYPT

SEQ ID NO: 902307 - protein, 9 aa, Homo Sapiens
GPKGSQGSL

SEQ ID NO: 902308 - protein, 9 aa, Homo Sapiens
INPILIVGD

SEQ ID NO: 902309 - protein, 9 aa, Homo Sapiens
AAFPLPEGS

SEQ ID NO: 902310 - protein, 9 aa, Homo Sapiens
EQNKAAFSV

SEQ ID NO: 902311 - protein, 9 aa, Homo Sapiens
SSHEKGLKT

SEQ ID NO: 902312 - protein, 9 aa, Homo Sapiens
LGAIQPRVN

SEQ ID NO: 902313 - protein, 9 aa, Homo Sapiens
NFIESHKLM

SEQ ID NO: 902314 - protein, 9 aa, Homo Sapiens
FRETGDSFS

SEQ ID NO: 902315 - protein, 9 aa, Homo Sapiens
KSMVLDLCS

SEQ ID NO: 902316 - protein, 9 aa, Homo Sapiens
PQNKDCTLR

SEQ ID NO: 902317 - protein, 9 aa, Homo Sapiens
KIHFRTLPL

SEQ ID NO: 902318 - protein, 9 aa, Homo Sapiens
KQMSYGFPF

SEQ ID NO: 902319 - protein, 9 aa, Homo Sapiens
VVVSKLLFE

SEQ ID NO: 902320 - protein, 9 aa, Homo Sapiens
AALSKFTLK

SEQ ID NO: 902321 - protein, 9 aa, Homo Sapiens
QRMLTSAPA

SEQ ID NO: 902322 - protein, 9 aa, Homo Sapiens
PAPEGGDGY

SEQ ID NO: 902323 - protein, 9 aa, Homo Sapiens
AYKLQSDNV

SEQ ID NO: 902324 - protein, 9 aa, Homo Sapiens
SDVIYENFS

SEQ ID NO: 902325 - protein, 9 aa, Homo Sapiens
VDAICTHCL

SEQ ID NO: 902326 - protein, 9 aa, Homo Sapiens
YTAVLFPHY

SEQ ID NO: 902327 - protein, 9 aa, Homo Sapiens
LIAHQKFHT

SEQ ID NO: 902328 - protein, 9 aa, Homo Sapiens
KLQSDNVYK

SEQ ID NO: 902329 - protein, 9 aa, Homo Sapiens
VIIFSLATE

SEQ ID NO: 902330 - protein, 9 aa, Homo Sapiens
CWHCVCQVG

SEQ ID NO: 902331 - protein, 9 aa, Homo Sapiens
IQAKKAYKL

SEQ ID NO: 902332 - protein, 9 aa, Homo Sapiens
SWEDSRTRS

SEQ ID NO: 902333 - protein, 9 aa, Homo Sapiens
EDDLKAIQD

SEQ ID NO: 902334 - protein, 9 aa, Homo Sapiens
FPAEESLHL

SEQ ID NO: 902335 - protein, 9 aa, Homo Sapiens
YEAAFPLPE

SEQ ID NO: 902336 - protein, 9 aa, Homo Sapiens
RWPHPLTTL

SEQ ID NO: 902337 - protein, 9 aa, Homo Sapiens
QLKFCGPNH

SEQ ID NO: 902338 - protein, 9 aa, Homo Sapiens
APEGGDGYL

SEQ ID NO: 902339 - protein, 9 aa, Homo Sapiens
KITMVVLSS

SEQ ID NO: 902340 - protein, 9 aa, Homo Sapiens
PKKEIKMYL

SEQ ID NO: 902341 - protein, 9 aa, Homo Sapiens
CSVAADGEV

SEQ ID NO: 902342 - protein, 9 aa, Homo Sapiens
DLAKQINHP

SEQ ID NO: 902343 - protein, 9 aa, Homo Sapiens
PWYHSNVNT

SEQ ID NO: 902344 - protein, 9 aa, Homo Sapiens
LLSQLSAKL

SEQ ID NO: 902345 - protein, 9 aa, Homo Sapiens
GNESRFHIN

SEQ ID NO: 902346 - protein, 9 aa, Homo Sapiens
HCLDPKSPG

SEQ ID NO: 902347 - protein, 9 aa, Homo Sapiens
LRIRDTRES

SEQ ID NO: 902348 - protein, 9 aa, Homo Sapiens
MTHMRINTG

SEQ ID NO: 902349 - protein, 9 aa, Homo Sapiens
LAKQINHPE

SEQ ID NO: 902350 - protein, 9 aa, Homo Sapiens
LPPKKEIKM

SEQ ID NO: 902351 - protein, 9 aa, Homo Sapiens
ENPKNADTY

SEQ ID NO: 902352 - protein, 9 aa, Homo Sapiens
EYENGGQCL

SEQ ID NO: 902353 - protein, 9 aa, Homo Sapiens
EDVVLWLVE

SEQ ID NO: 902354 - protein, 9 aa, Homo Sapiens
DSRTRSILW

SEQ ID NO: 902355 - protein, 9 aa, Homo Sapiens
RMKISRRLP

SEQ ID NO: 902356 - protein, 9 aa, Homo Sapiens
LYNGQASVP

SEQ ID NO: 902357 - protein, 9 aa, Homo Sapiens
SYGFPFPPY

SEQ ID NO: 902358 - protein, 9 aa, Homo Sapiens
EMEKTTKKM

SEQ ID NO: 902359 - protein, 9 aa, Homo Sapiens
SEKLPKDLG

SEQ ID NO: 902360 - protein, 9 aa, Homo Sapiens
QEEKGKGTL

SEQ ID NO: 902361 - protein, 9 aa, Homo Sapiens
APTASPRRG

SEQ ID NO: 902362 - protein, 9 aa, Homo Sapiens
VQMPQEEVE

SEQ ID NO: 902363 - protein, 9 aa, Homo Sapiens
LKFCGPNHI

SEQ ID NO: 902364 - protein, 9 aa, Homo Sapiens
GYGRSRVYN

SEQ ID NO: 902365 - protein, 9 aa, Homo Sapiens
GQASVPIQQ

SEQ ID NO: 902366 - protein, 9 aa, Homo Sapiens
TEELIAGFT

SEQ ID NO: 902367 - protein, 9 aa, Homo Sapiens
EGRDFPTET

SEQ ID NO: 902368 - protein, 9 aa, Homo Sapiens
FPGQMDFFY

SEQ ID NO: 902369 - protein, 9 aa, Homo Sapiens
KGTPALNIA

SEQ ID NO: 902370 - protein, 9 aa, Homo Sapiens
SVAADGEVK

SEQ ID NO: 902371 - protein, 9 aa, Homo Sapiens
KLVGFYLTY

SEQ ID NO: 902372 - protein, 9 aa, Homo Sapiens
LDSLSLYSG

SEQ ID NO: 902373 - protein, 9 aa, Homo Sapiens
GSCINPILI

SEQ ID NO: 902374 - protein, 9 aa, Homo Sapiens
ELSDEETSI

SEQ ID NO: 902375 - protein, 9 aa, Homo Sapiens
ETRSQHLSP

SEQ ID NO: 902376 - protein, 9 aa, Homo Sapiens
AAVKDICGK

SEQ ID NO: 902377 - protein, 9 aa, Homo Sapiens
LELQKEQRW

SEQ ID NO: 902378 - protein, 9 aa, Homo Sapiens
PVHRPGKIP

SEQ ID NO: 902379 - protein, 9 aa, Homo Sapiens
LFLVPNGIY

SEQ ID NO: 902380 - protein, 9 aa, Homo Sapiens
FSSHGCKEV

SEQ ID NO: 902381 - protein, 9 aa, Homo Sapiens
PACSPSKAA

SEQ ID NO: 902382 - protein, 9 aa, Homo Sapiens
VSVETVLRV

SEQ ID NO: 902383 - protein, 9 aa, Homo Sapiens
GEPGPPGPD

SEQ ID NO: 902384 - protein, 9 aa, Homo Sapiens
LREENKILR

SEQ ID NO: 902385 - protein, 9 aa, Homo Sapiens
AVEILIWEK

SEQ ID NO: 902386 - protein, 9 aa, Homo Sapiens
LEWDMKINC

SEQ ID NO: 902387 - protein, 9 aa, Homo Sapiens
DASLAPPNI

SEQ ID NO: 902388 - protein, 9 aa, Homo Sapiens
QLLQEYYKI

SEQ ID NO: 902389 - protein, 9 aa, Homo Sapiens
AKNQDGMST

SEQ ID NO: 902390 - protein, 9 aa, Homo Sapiens
MAIFPRFSK

SEQ ID NO: 902391 - protein, 9 aa, Homo Sapiens
EGIWESQRQ

SEQ ID NO: 902392 - protein, 9 aa, Homo Sapiens
ERLQTPVPE

SEQ ID NO: 902393 - protein, 9 aa, Homo Sapiens
KYVASSYLS

SEQ ID NO: 902394 - protein, 9 aa, Homo Sapiens
HRQFGVNCD

SEQ ID NO: 902395 - protein, 9 aa, Homo Sapiens
LFYHAKTGR

SEQ ID NO: 902396 - protein, 9 aa, Homo Sapiens
EEFRRLAAI

SEQ ID NO: 902397 - protein, 9 aa, Homo Sapiens
FWDSQRPRL

SEQ ID NO: 902398 - protein, 9 aa, Homo Sapiens
PTPGKAPGV

SEQ ID NO: 902399 - protein, 9 aa, Homo Sapiens
NDVMLLDAW

SEQ ID NO: 902400 - protein, 9 aa, Homo Sapiens
GVRAPGGPG

SEQ ID NO: 902401 - protein, 9 aa, Homo Sapiens
YPTPGKAPG

SEQ ID NO: 902402 - protein, 9 aa, Homo Sapiens
SREFVQRVK

SEQ ID NO: 902403 - protein, 9 aa, Homo Sapiens
NGIYDPADI

SEQ ID NO: 902404 - protein, 9 aa, Homo Sapiens
LTLGTTIAV

SEQ ID NO: 902405 - protein, 9 aa, Homo Sapiens
SQYIDKITH

SEQ ID NO: 902406 - protein, 9 aa, Homo Sapiens
PGKAPGVVG

SEQ ID NO: 902407 - protein, 9 aa, Homo Sapiens
SSIPITPPG

SEQ ID NO: 902408 - protein, 9 aa, Homo Sapiens
ELKSICSYR

SEQ ID NO: 902409 - protein, 9 aa, Homo Sapiens
QCDVDTIYH

SEQ ID NO: 902410 - protein, 9 aa, Homo Sapiens
EDIKERMKE

SEQ ID NO: 902411 - protein, 9 aa, Homo Sapiens
TFEPYLLDD

SEQ ID NO: 902412 - protein, 9 aa, Homo Sapiens
LSDGANVTG

SEQ ID NO: 902413 - protein, 9 aa, Homo Sapiens
VVSPKKHST

SEQ ID NO: 902414 - protein, 9 aa, Homo Sapiens
PILTPSPTS

SEQ ID NO: 902415 - protein, 9 aa, Homo Sapiens
GRSGRSASF

SEQ ID NO: 902416 - protein, 9 aa, Homo Sapiens
GFESASLGA

SEQ ID NO: 902417 - protein, 9 aa, Homo Sapiens
EFVQRVKDL

SEQ ID NO: 902418 - protein, 9 aa, Homo Sapiens
EGLDPEEHM

SEQ ID NO: 902419 - protein, 9 aa, Homo Sapiens
LPRVVSPKK

SEQ ID NO: 902420 - protein, 9 aa, Homo Sapiens
IAVTYTVIT

SEQ ID NO: 902421 - protein, 9 aa, Homo Sapiens
VKPFLFYHA

SEQ ID NO: 902422 - protein, 9 aa, Homo Sapiens
PKSRAQLRQ

SEQ ID NO: 902423 - protein, 9 aa, Homo Sapiens
EHRQFGVNC

SEQ ID NO: 902424 - protein, 9 aa, Homo Sapiens
YDNSRFTDL

SEQ ID NO: 902425 - protein, 9 aa, Homo Sapiens
DNLAFWDFL

SEQ ID NO: 902426 - protein, 9 aa, Homo Sapiens
TTVVTTSTN

SEQ ID NO: 902427 - protein, 9 aa, Homo Sapiens
ISREEYLYT

SEQ ID NO: 902428 - protein, 9 aa, Homo Sapiens
YVEGQCISE

SEQ ID NO: 902429 - protein, 9 aa, Homo Sapiens
ELSRAPRWA

SEQ ID NO: 902430 - protein, 9 aa, Homo Sapiens
TLGTTIAVG

SEQ ID NO: 902431 - protein, 9 aa, Homo Sapiens
SQPPKMRNR

SEQ ID NO: 902432 - protein, 9 aa, Homo Sapiens
ASRPPVTQR

SEQ ID NO: 902433 - protein, 9 aa, Homo Sapiens
QVDEGIPLK

SEQ ID NO: 902434 - protein, 9 aa, Homo Sapiens
PRQQLEFAH

SEQ ID NO: 902435 - protein, 9 aa, Homo Sapiens
KLVVVGACG

SEQ ID NO: 902436 - protein, 9 aa, Homo Sapiens
SKQSNNKYV

SEQ ID NO: 902437 - protein, 9 aa, Homo Sapiens
IRPKETRSQ

SEQ ID NO: 902438 - protein, 9 aa, Homo Sapiens
HRERERERE

SEQ ID NO: 902439 - protein, 9 aa, Homo Sapiens
APRPCVVAQ

SEQ ID NO: 902440 - protein, 9 aa, Homo Sapiens
DGMSTLHFA

SEQ ID NO: 902441 - protein, 9 aa, Homo Sapiens
SSHGCKEVE

SEQ ID NO: 902442 - protein, 9 aa, Homo Sapiens
DFICMAQIS

SEQ ID NO: 902443 - protein, 9 aa, Homo Sapiens
SQGRPPYTT

SEQ ID NO: 902444 - protein, 9 aa, Homo Sapiens
PRPQDHDTD

SEQ ID NO: 902445 - protein, 9 aa, Homo Sapiens
GGVRAPGGP

SEQ ID NO: 902446 - protein, 9 aa, Homo Sapiens
FVACLQPLP

SEQ ID NO: 902447 - protein, 9 aa, Homo Sapiens
SLEDIKERM

SEQ ID NO: 902448 - protein, 9 aa, Homo Sapiens
NRACFTMDP

SEQ ID NO: 902449 - protein, 9 aa, Homo Sapiens
GDQAIAGAL

SEQ ID NO: 902450 - protein, 9 aa, Homo Sapiens
KIQVSFTNL

SEQ ID NO: 902451 - protein, 9 aa, Homo Sapiens
SRAPRWASA

SEQ ID NO: 902452 - protein, 9 aa, Homo Sapiens
SLCLFTLAR

SEQ ID NO: 902453 - protein, 9 aa, Homo Sapiens
DEERTQVKL

SEQ ID NO: 902454 - protein, 9 aa, Homo Sapiens
LTPTGLSDG

SEQ ID NO: 902455 - protein, 9 aa, Homo Sapiens
TNGLCIWLL

SEQ ID NO: 902456 - protein, 9 aa, Homo Sapiens
HAKVNGRIY

SEQ ID NO: 902457 - protein, 9 aa, Homo Sapiens
PTLCCYTCR

SEQ ID NO: 902458 - protein, 9 aa, Homo Sapiens
TLCCYTCRQ

SEQ ID NO: 902459 - protein, 9 aa, Homo Sapiens
QRWQEENDK

SEQ ID NO: 902460 - protein, 9 aa, Homo Sapiens
KEIIAIKEV

SEQ ID NO: 902461 - protein, 9 aa, Homo Sapiens
QFWDSQRPR

SEQ ID NO: 902462 - protein, 9 aa, Homo Sapiens
CPPTLSPPP

SEQ ID NO: 902463 - protein, 9 aa, Homo Sapiens
DADESQNAD

SEQ ID NO: 902464 - protein, 9 aa, Homo Sapiens
RVAGCPNPR

SEQ ID NO: 902465 - protein, 9 aa, Homo Sapiens
QCDQAQRSC

SEQ ID NO: 902466 - protein, 9 aa, Homo Sapiens
DGMDVNVHG

SEQ ID NO: 902467 - protein, 9 aa, Homo Sapiens
CINTVGSFH

SEQ ID NO: 902468 - protein, 9 aa, Homo Sapiens
RKSQRNLLR

SEQ ID NO: 902469 - protein, 9 aa, Homo Sapiens
VPRDVRVRK

SEQ ID NO: 902470 - protein, 9 aa, Homo Sapiens
DMKLLSMEI

SEQ ID NO: 902471 - protein, 9 aa, Homo Sapiens
LCIWLLILS

SEQ ID NO: 902472 - protein, 9 aa, Homo Sapiens
AQVDEGIPL

SEQ ID NO: 902473 - protein, 9 aa, Homo Sapiens
KIDAMGTYH

SEQ ID NO: 902474 - protein, 9 aa, Homo Sapiens
GGPGSAVCV

SEQ ID NO: 902475 - protein, 9 aa, Homo Sapiens
IYLIINSIK

SEQ ID NO: 902476 - protein, 9 aa, Homo Sapiens
LLIAGHLHI

SEQ ID NO: 902477 - protein, 9 aa, Homo Sapiens
LIRHKACAL

SEQ ID NO: 902478 - protein, 9 aa, Homo Sapiens
AVTYTVITP

SEQ ID NO: 902479 - protein, 9 aa, Homo Sapiens
TELYTFEPY

SEQ ID NO: 902480 - protein, 9 aa, Homo Sapiens
SPELPFDDI

SEQ ID NO: 902481 - protein, 9 aa, Homo Sapiens
VLLHMTFLE

SEQ ID NO: 902482 - protein, 9 aa, Homo Sapiens
VFVDCCKTL

SEQ ID NO: 902483 - protein, 9 aa, Homo Sapiens
PTLSPPPST

SEQ ID NO: 902484 - protein, 9 aa, Homo Sapiens
THRVPVSWL

SEQ ID NO: 902485 - protein, 9 aa, Homo Sapiens
NLIYDNSRF

SEQ ID NO: 902486 - protein, 9 aa, Homo Sapiens
MLTLEEQLL

SEQ ID NO: 902487 - protein, 9 aa, Homo Sapiens
PNHSRGNPS

SEQ ID NO: 902488 - protein, 9 aa, Homo Sapiens
VGLFLVPNG

SEQ ID NO: 902489 - protein, 9 aa, Homo Sapiens
PEEHMADGE

SEQ ID NO: 902490 - protein, 9 aa, Homo Sapiens
DDLAENDVM

SEQ ID NO: 902491 - protein, 9 aa, Homo Sapiens
QISLNLGVI

SEQ ID NO: 902492 - protein, 9 aa, Homo Sapiens
KCYGRCKRD

SEQ ID NO: 902493 - protein, 9 aa, Homo Sapiens
IIECHNNSR

SEQ ID NO: 902494 - protein, 9 aa, Homo Sapiens
AILVLLCVR

SEQ ID NO: 902495 - protein, 9 aa, Homo Sapiens
CLSDLQKGY

SEQ ID NO: 902496 - protein, 9 aa, Homo Sapiens
MNFVSKKSI

SEQ ID NO: 902497 - protein, 9 aa, Homo Sapiens
LGSHERPVK

SEQ ID NO: 902498 - protein, 9 aa, Homo Sapiens
LVGLFLVPN

SEQ ID NO: 902499 - protein, 9 aa, Homo Sapiens
SINEEGQKR

SEQ ID NO: 902500 - protein, 9 aa, Homo Sapiens
DTVILLTRQ

SEQ ID NO: 902501 - protein, 9 aa, Homo Sapiens
DPTILLTKP

SEQ ID NO: 902502 - protein, 9 aa, Homo Sapiens
QTAHSILKG

SEQ ID NO: 902503 - protein, 9 aa, Homo Sapiens
TSAMVYPPR

SEQ ID NO: 902504 - protein, 9 aa, Homo Sapiens
VLLCVRQCL

SEQ ID NO: 902505 - protein, 9 aa, Homo Sapiens
QFGVNCDVD

SEQ ID NO: 902506 - protein, 9 aa, Homo Sapiens
WAYDSGKEE

SEQ ID NO: 902507 - protein, 9 aa, Homo Sapiens
ATQVATVVD

SEQ ID NO: 902508 - protein, 9 aa, Homo Sapiens
ACSPSKAAV

SEQ ID NO: 902509 - protein, 9 aa, Homo Sapiens
ISLNLGVIF

SEQ ID NO: 902510 - protein, 9 aa, Homo Sapiens
KASQPPKMR

SEQ ID NO: 902511 - protein, 9 aa, Homo Sapiens
RSWSRSRER

SEQ ID NO: 902512 - protein, 9 aa, Homo Sapiens
GGGRRRSGE

SEQ ID NO: 902513 - protein, 9 aa, Homo Sapiens
GAELQKSDI

SEQ ID NO: 902514 - protein, 9 aa, Homo Sapiens
VAAGSAGSD

SEQ ID NO: 902515 - protein, 9 aa, Homo Sapiens
ANSQDEAVV

SEQ ID NO: 902516 - protein, 9 aa, Homo Sapiens
KLSFFIHNL

SEQ ID NO: 902517 - protein, 9 aa, Homo Sapiens
MAQLKIQQR

SEQ ID NO: 902518 - protein, 9 aa, Homo Sapiens
LHMTFLEVI

SEQ ID NO: 902519 - protein, 9 aa, Homo Sapiens
HTIAPIGTR

SEQ ID NO: 902520 - protein, 9 aa, Homo Sapiens
IQVQSQLPP

SEQ ID NO: 902521 - protein, 9 aa, Homo Sapiens
ALAQKYWLT

SEQ ID NO: 902522 - protein, 9 aa, Homo Sapiens
FPTVLLHMT

SEQ ID NO: 902523 - protein, 9 aa, Homo Sapiens
QRAQEEYEL

SEQ ID NO: 902524 - protein, 9 aa, Homo Sapiens
FQRRWRRQV

SEQ ID NO: 902525 - protein, 9 aa, Homo Sapiens
MDVNVHGPD

SEQ ID NO: 902526 - protein, 9 aa, Homo Sapiens
SDGANVTGY

SEQ ID NO: 902527 - protein, 9 aa, Homo Sapiens
RLTIPSYTG

SEQ ID NO: 902528 - protein, 9 aa, Homo Sapiens
LKSICSYRA

SEQ ID NO: 902529 - protein, 9 aa, Homo Sapiens
FCASRKLDV

SEQ ID NO: 902530 - protein, 9 aa, Homo Sapiens
MSNASAEEN

SEQ ID NO: 902531 - protein, 9 aa, Homo Sapiens
NVHGPDGFT

SEQ ID NO: 902532 - protein, 9 aa, Homo Sapiens
LRSKSIELE

SEQ ID NO: 902533 - protein, 9 aa, Homo Sapiens
PDGRPHTAV

SEQ ID NO: 902534 - protein, 9 aa, Homo Sapiens
VCVHQLPPG

SEQ ID NO: 902535 - protein, 9 aa, Homo Sapiens
IPLKICLSQ

SEQ ID NO: 902536 - protein, 9 aa, Homo Sapiens
WSPELPFDD

SEQ ID NO: 902537 - protein, 9 aa, Homo Sapiens
LTAVPAVPL

SEQ ID NO: 902538 - protein, 9 aa, Homo Sapiens
GMNRRPFLT

SEQ ID NO: 902539 - protein, 9 aa, Homo Sapiens
IRQEFDKLC

SEQ ID NO: 902540 - protein, 9 aa, Homo Sapiens
ELLSQELWQ

SEQ ID NO: 902541 - protein, 9 aa, Homo Sapiens
IGTRRKHLG

SEQ ID NO: 902542 - protein, 9 aa, Homo Sapiens
VENALKAAS

SEQ ID NO: 902543 - protein, 9 aa, Homo Sapiens
YFYDSVSRD

SEQ ID NO: 902544 - protein, 9 aa, Homo Sapiens
PQACRRAHG

SEQ ID NO: 902545 - protein, 9 aa, Homo Sapiens
LILKAEMAQ

SEQ ID NO: 902546 - protein, 9 aa, Homo Sapiens
CDVDTIYHR

SEQ ID NO: 902547 - protein, 9 aa, Homo Sapiens
DSFSQPRGW

SEQ ID NO: 902548 - protein, 9 aa, Homo Sapiens
THTHTHRER

SEQ ID NO: 902549 - protein, 9 aa, Homo Sapiens
QLCLLPNKD

SEQ ID NO: 902550 - protein, 9 aa, Homo Sapiens
HSQDSRLNQ

SEQ ID NO: 902551 - protein, 9 aa, Homo Sapiens
WLPPVYEDS

SEQ ID NO: 902552 - protein, 9 aa, Homo Sapiens
LLLAGSGGV

SEQ ID NO: 902553 - protein, 9 aa, Homo Sapiens
RWASAPPQD

SEQ ID NO: 902554 - protein, 9 aa, Homo Sapiens
IALEHGIPT

SEQ ID NO: 902555 - protein, 9 aa, Homo Sapiens
CFLKAIKNT

SEQ ID NO: 902556 - protein, 9 aa, Homo Sapiens
SLAANSQDE

SEQ ID NO: 902557 - protein, 9 aa, Homo Sapiens
GSKAVVTLE

SEQ ID NO: 902558 - protein, 9 aa, Homo Sapiens
RLSPCPPTL

SEQ ID NO: 902559 - protein, 9 aa, Homo Sapiens
FTPRPQDHD

SEQ ID NO: 902560 - protein, 9 aa, Homo Sapiens
TGLSDGANV

SEQ ID NO: 902561 - protein, 9 aa, Homo Sapiens
WEDPLPPGL

SEQ ID NO: 902562 - protein, 9 aa, Homo Sapiens
LKLFPLRET

SEQ ID NO: 902563 - protein, 9 aa, Homo Sapiens
ESASLGAEL

SEQ ID NO: 902564 - protein, 9 aa, Homo Sapiens
SRRPVFLAL

SEQ ID NO: 902565 - protein, 9 aa, Homo Sapiens
SASFLYQVS

SEQ ID NO: 902566 - protein, 9 aa, Homo Sapiens
LRDASLAPP

SEQ ID NO: 902567 - protein, 9 aa, Homo Sapiens
GNPSHVTQP

SEQ ID NO: 902568 - protein, 9 aa, Homo Sapiens
SMAPRPCVV

SEQ ID NO: 902569 - protein, 9 aa, Homo Sapiens
KTFIETAYL

SEQ ID NO: 902570 - protein, 9 aa, Homo Sapiens
RPPVTQRLV

SEQ ID NO: 902571 - protein, 9 aa, Homo Sapiens
NDTPIVRTS

SEQ ID NO: 902572 - protein, 9 aa, Homo Sapiens
DSRGGSKAV

SEQ ID NO: 902573 - protein, 9 aa, Homo Sapiens
RIMAGSNRS

SEQ ID NO: 902574 - protein, 9 aa, Homo Sapiens
TGDVVGRGT

SEQ ID NO: 902575 - protein, 9 aa, Homo Sapiens
SNSLLDNLA

SEQ ID NO: 902576 - protein, 9 aa, Homo Sapiens
NSDPVLEAS

SEQ ID NO: 902577 - protein, 9 aa, Homo Sapiens
RHVLSINEE

SEQ ID NO: 902578 - protein, 9 aa, Homo Sapiens
THRERERER

SEQ ID NO: 902579 - protein, 9 aa, Homo Sapiens
KAWSEAQFV

SEQ ID NO: 902580 - protein, 9 aa, Homo Sapiens
TAFDVGSDK

SEQ ID NO: 902581 - protein, 9 aa, Homo Sapiens
LMNFVSKKS

SEQ ID NO: 902582 - protein, 9 aa, Homo Sapiens
ILNKKIALE

SEQ ID NO: 902583 - protein, 9 aa, Homo Sapiens
IPITPPGQD

SEQ ID NO: 902584 - protein, 9 aa, Homo Sapiens
PVTQRLVVP

SEQ ID NO: 902585 - protein, 9 aa, Homo Sapiens
IIFEGDTAS

SEQ ID NO: 902586 - protein, 9 aa, Homo Sapiens
NPSHVTQPP

SEQ ID NO: 902587 - protein, 9 aa, Homo Sapiens
WVHWSRRPV

SEQ ID NO: 902588 - protein, 9 aa, Homo Sapiens
QNKYQELKS

SEQ ID NO: 902589 - protein, 9 aa, Homo Sapiens
CISETTMLQ

SEQ ID NO: 902590 - protein, 9 aa, Homo Sapiens
AYDADESQN

SEQ ID NO: 902591 - protein, 9 aa, Homo Sapiens
ADGVGKSAL

SEQ ID NO: 902592 - protein, 9 aa, Homo Sapiens
PQIPRLSLT

SEQ ID NO: 902593 - protein, 9 aa, Homo Sapiens
KSQYIDKIT

SEQ ID NO: 902594 - protein, 9 aa, Homo Sapiens
GRPRGQADP

SEQ ID NO: 902595 - protein, 9 aa, Homo Sapiens
TVGSFHCQR

SEQ ID NO: 902596 - protein, 9 aa, Homo Sapiens
LVRLFRELF

SEQ ID NO: 902597 - protein, 9 aa, Homo Sapiens
YYGYRQSVT

SEQ ID NO: 902598 - protein, 9 aa, Homo Sapiens
SEGIWESQR

SEQ ID NO: 902599 - protein, 9 aa, Homo Sapiens
PDGQPGVDG

SEQ ID NO: 902600 - protein, 9 aa, Homo Sapiens
ILIWEKESE

SEQ ID NO: 902601 - protein, 9 aa, Homo Sapiens
GCPNPRGKG

SEQ ID NO: 902602 - protein, 9 aa, Homo Sapiens
PGGPGSAVC

SEQ ID NO: 902603 - protein, 9 aa, Homo Sapiens
IKNTAVTGG

SEQ ID NO: 902604 - protein, 9 aa, Homo Sapiens
FDDIVGKQN

SEQ ID NO: 902605 - protein, 9 aa, Homo Sapiens
RHPEHYDTV

SEQ ID NO: 902606 - protein, 9 aa, Homo Sapiens
FVRQKFIIH

SEQ ID NO: 902607 - protein, 9 aa, Homo Sapiens
PFREEIQCD

SEQ ID NO: 902608 - protein, 9 aa, Homo Sapiens
LVLLCVRQC

SEQ ID NO: 902609 - protein, 9 aa, Homo Sapiens
FRYPTPGKA

SEQ ID NO: 902610 - protein, 9 aa, Homo Sapiens
CLFTLARGR

SEQ ID NO: 902611 - protein, 9 aa, Homo Sapiens
SFQRRWRRQ

SEQ ID NO: 902612 - protein, 9 aa, Homo Sapiens
WLLILSYVG

SEQ ID NO: 902613 - protein, 9 aa, Homo Sapiens
DDSKGLAAH

SEQ ID NO: 902614 - protein, 9 aa, Homo Sapiens
DVLQFVGLS

SEQ ID NO: 902615 - protein, 9 aa, Homo Sapiens
RRWSYQLSL

SEQ ID NO: 902616 - protein, 9 aa, Homo Sapiens
LQQQIQVQS

SEQ ID NO: 902617 - protein, 9 aa, Homo Sapiens
VEILIWEKE

SEQ ID NO: 902618 - protein, 9 aa, Homo Sapiens
AIKEVYQRL

SEQ ID NO: 902619 - protein, 9 aa, Homo Sapiens
RSDSRGGSK

SEQ ID NO: 902620 - protein, 9 aa, Homo Sapiens
VVQKVKSLL

SEQ ID NO: 902621 - protein, 9 aa, Homo Sapiens
CIWLLILSY

SEQ ID NO: 902622 - protein, 9 aa, Homo Sapiens
QATEGHCPW

SEQ ID NO: 902623 - protein, 9 aa, Homo Sapiens
RVKDLVTAS

SEQ ID NO: 902624 - protein, 9 aa, Homo Sapiens
EQCTVEPDL

SEQ ID NO: 902625 - protein, 9 aa, Homo Sapiens
GRRLLTVSV

SEQ ID NO: 902626 - protein, 9 aa, Homo Sapiens
QGSPQYLYV

SEQ ID NO: 902627 - protein, 9 aa, Homo Sapiens
ESQNADVTY

SEQ ID NO: 902628 - protein, 9 aa, Homo Sapiens
AILEGEYAA

SEQ ID NO: 902629 - protein, 9 aa, Homo Sapiens
GQGNGEAKL

SEQ ID NO: 902630 - protein, 9 aa, Homo Sapiens
RRKWMEKMA

SEQ ID NO: 902631 - protein, 9 aa, Homo Sapiens
VSFTNLEEL

SEQ ID NO: 902632 - protein, 9 aa, Homo Sapiens
WQRLLPGCR

SEQ ID NO: 902633 - protein, 9 aa, Homo Sapiens
HLPRVVSPK

SEQ ID NO: 902634 - protein, 9 aa, Homo Sapiens
KYEVCKGAL

SEQ ID NO: 902635 - protein, 9 aa, Homo Sapiens
TVLLHMTFL

SEQ ID NO: 902636 - protein, 9 aa, Homo Sapiens
LLKLKRNSN

SEQ ID NO: 902637 - protein, 9 aa, Homo Sapiens
VVGADGVGK

SEQ ID NO: 902638 - protein, 9 aa, Homo Sapiens
TPKSQYIDK

SEQ ID NO: 902639 - protein, 9 aa, Homo Sapiens
QPPKMRNRP

SEQ ID NO: 902640 - protein, 9 aa, Homo Sapiens
LTPSPTSAF

SEQ ID NO: 902641 - protein, 9 aa, Homo Sapiens
INTVGSFHC

SEQ ID NO: 902642 - protein, 9 aa, Homo Sapiens
LSHRIKPRV

SEQ ID NO: 902643 - protein, 9 aa, Homo Sapiens
CASRKLDVV

SEQ ID NO: 902644 - protein, 9 aa, Homo Sapiens
CLLVARACL

SEQ ID NO: 902645 - protein, 9 aa, Homo Sapiens
TTNSFHIKT

SEQ ID NO: 902646 - protein, 9 aa, Homo Sapiens
VQKAKWRSA

SEQ ID NO: 902647 - protein, 9 aa, Homo Sapiens
LCCYTCRQL

SEQ ID NO: 902648 - protein, 9 aa, Homo Sapiens
KQAQVDEGI

SEQ ID NO: 902649 - protein, 9 aa, Homo Sapiens
VARACLSDL

SEQ ID NO: 902650 - protein, 9 aa, Homo Sapiens
SEPVHRPGK

SEQ ID NO: 902651 - protein, 9 aa, Homo Sapiens
EYELDHCSG

SEQ ID NO: 902652 - protein, 9 aa, Homo Sapiens
GDPACSPSK

SEQ ID NO: 902653 - protein, 9 aa, Homo Sapiens
GLDPEEHMA

SEQ ID NO: 902654 - protein, 9 aa, Homo Sapiens
CVHQLPPGQ

SEQ ID NO: 902655 - protein, 9 aa, Homo Sapiens
ADLPDTTVV

SEQ ID NO: 902656 - protein, 9 aa, Homo Sapiens
KVNGRIYLI

SEQ ID NO: 902657 - protein, 9 aa, Homo Sapiens
LGQGNGEAK

SEQ ID NO: 902658 - protein, 9 aa, Homo Sapiens
EGDTASLVC

SEQ ID NO: 902659 - protein, 9 aa, Homo Sapiens
GIPLKICLS

SEQ ID NO: 902660 - protein, 9 aa, Homo Sapiens
FTIVYLKLF

SEQ ID NO: 902661 - protein, 9 aa, Homo Sapiens
LHIPAHRLV

SEQ ID NO: 902662 - protein, 9 aa, Homo Sapiens
SLRSKPSPG

SEQ ID NO: 902663 - protein, 9 aa, Homo Sapiens
VELVFPNSD

SEQ ID NO: 902664 - protein, 9 aa, Homo Sapiens
PPVTQRLVV

SEQ ID NO: 902665 - protein, 9 aa, Homo Sapiens
ENKILRAHF

SEQ ID NO: 902666 - protein, 9 aa, Homo Sapiens
QELKSICSY

SEQ ID NO: 902667 - protein, 9 aa, Homo Sapiens
AVDWAYDSG

SEQ ID NO: 902668 - protein, 9 aa, Homo Sapiens
VALNVQYVP

SEQ ID NO: 902669 - protein, 9 aa, Homo Sapiens
SINQENFQL

SEQ ID NO: 902670 - protein, 9 aa, Homo Sapiens
SPQKQLCLL

SEQ ID NO: 902671 - protein, 9 aa, Homo Sapiens
TLEMLSLDT

SEQ ID NO: 902672 - protein, 9 aa, Homo Sapiens
HGMGYFESS

SEQ ID NO: 902673 - protein, 9 aa, Homo Sapiens
ELYTFEPYL

SEQ ID NO: 902674 - protein, 9 aa, Homo Sapiens
PEHYDTVIL

SEQ ID NO: 902675 - protein, 9 aa, Homo Sapiens
PKETRSQHL

SEQ ID NO: 902676 - protein, 9 aa, Homo Sapiens
PRGKGSAGF

SEQ ID NO: 902677 - protein, 9 aa, Homo Sapiens
QYLYVCHYC

SEQ ID NO: 902678 - protein, 9 aa, Homo Sapiens
LTDLTRETT

SEQ ID NO: 902679 - protein, 9 aa, Homo Sapiens
CARTGGRIA

SEQ ID NO: 902680 - protein, 9 aa, Homo Sapiens
GYRTQDRYE

SEQ ID NO: 902681 - protein, 9 aa, Homo Sapiens
DWHTYHNEM

SEQ ID NO: 902682 - protein, 9 aa, Homo Sapiens
RIYLIINSI

SEQ ID NO: 902683 - protein, 9 aa, Homo Sapiens
GDWTPLEEP

SEQ ID NO: 902684 - protein, 9 aa, Homo Sapiens
IDWADWRPV

SEQ ID NO: 902685 - protein, 9 aa, Homo Sapiens
MFTIVYLKL

SEQ ID NO: 902686 - protein, 9 aa, Homo Sapiens
SDRVNGRAW

SEQ ID NO: 902687 - protein, 9 aa, Homo Sapiens
AGALAAPSR

SEQ ID NO: 902688 - protein, 9 aa, Homo Sapiens
KTKSECAIV

SEQ ID NO: 902689 - protein, 9 aa, Homo Sapiens
EQRDELSER

SEQ ID NO: 902690 - protein, 9 aa, Homo Sapiens
DIVGKQNTL

SEQ ID NO: 902691 - protein, 9 aa, Homo Sapiens
TGLVDGKMK

SEQ ID NO: 902692 - protein, 9 aa, Homo Sapiens
LKECHKCHG

SEQ ID NO: 902693 - protein, 9 aa, Homo Sapiens
RRKSQRNLL

SEQ ID NO: 902694 - protein, 9 aa, Homo Sapiens
HASIEEEAW

SEQ ID NO: 902695 - protein, 9 aa, Homo Sapiens
LSINEEGQK

SEQ ID NO: 902696 - protein, 9 aa, Homo Sapiens
QLRQRHLLL

SEQ ID NO: 902697 - protein, 9 aa, Homo Sapiens
PGCGPPRLD

SEQ ID NO: 902698 - protein, 9 aa, Homo Sapiens
NGKFQLSRQ

SEQ ID NO: 902699 - protein, 9 aa, Homo Sapiens
HRVPVSWLH

SEQ ID NO: 902700 - protein, 9 aa, Homo Sapiens
RLQTPVPEV

SEQ ID NO: 902701 - protein, 9 aa, Homo Sapiens
VTTREPTPL

SEQ ID NO: 902702 - protein, 9 aa, Homo Sapiens
PSSIPITPP

SEQ ID NO: 902703 - protein, 9 aa, Homo Sapiens
GSHERPVKM

SEQ ID NO: 902704 - protein, 9 aa, Homo Sapiens
LMWLHLERL

SEQ ID NO: 902705 - protein, 9 aa, Homo Sapiens
LLGAMTVDR

SEQ ID NO: 902706 - protein, 9 aa, Homo Sapiens
TLRSGEQCT

SEQ ID NO: 902707 - protein, 9 aa, Homo Sapiens
VDWAYDSGK

SEQ ID NO: 902708 - protein, 9 aa, Homo Sapiens
SPSSIPITP

SEQ ID NO: 902709 - protein, 9 aa, Homo Sapiens
ITPPGQDHV

SEQ ID NO: 902710 - protein, 9 aa, Homo Sapiens
LRQRHLLLC

SEQ ID NO: 902711 - protein, 9 aa, Homo Sapiens
FKLEWDMKI

SEQ ID NO: 902712 - protein, 9 aa, Homo Sapiens
EEEAWEDPL

SEQ ID NO: 902713 - protein, 9 aa, Homo Sapiens
FESSNIHRN

SEQ ID NO: 902714 - protein, 9 aa, Homo Sapiens
GLTLGTTIA

SEQ ID NO: 902715 - protein, 9 aa, Homo Sapiens
SGGVRAPGG

SEQ ID NO: 902716 - protein, 9 aa, Homo Sapiens
CGYRTQDRY

SEQ ID NO: 902717 - protein, 9 aa, Homo Sapiens
TSVYFCPSS

SEQ ID NO: 902718 - protein, 9 aa, Homo Sapiens
QRHLLLCQS

SEQ ID NO: 902719 - protein, 9 aa, Homo Sapiens
RLCFLKAIK

SEQ ID NO: 902720 - protein, 9 aa, Homo Sapiens
SSPPQACRR

SEQ ID NO: 902721 - protein, 9 aa, Homo Sapiens
AFFMFCFLS

SEQ ID NO: 902722 - protein, 9 aa, Homo Sapiens
LVSYLRNNC

SEQ ID NO: 902723 - protein, 9 aa, Homo Sapiens
ASFDDVFVA

SEQ ID NO: 902724 - protein, 9 aa, Homo Sapiens
FRRLAAIPN

SEQ ID NO: 902725 - protein, 9 aa, Homo Sapiens
DVVNPLHEN

SEQ ID NO: 902726 - protein, 9 aa, Homo Sapiens
QEEYELDHC

SEQ ID NO: 902727 - protein, 9 aa, Homo Sapiens
RVRTVAGRT

SEQ ID NO: 902728 - protein, 9 aa, Homo Sapiens
VQSEGIWES

SEQ ID NO: 902729 - protein, 9 aa, Homo Sapiens
SLDWNRACF

SEQ ID NO: 902730 - protein, 9 aa, Homo Sapiens
QQLEFAHQQ

SEQ ID NO: 902731 - protein, 9 aa, Homo Sapiens
PEGMSNASA

SEQ ID NO: 902732 - protein, 9 aa, Homo Sapiens
ACGVGKSAL

SEQ ID NO: 902733 - protein, 9 aa, Homo Sapiens
IDAMGTYHG

SEQ ID NO: 902734 - protein, 9 aa, Homo Sapiens
ASLAPPNIV

SEQ ID NO: 902735 - protein, 9 aa, Homo Sapiens
ELPFDDIVG

SEQ ID NO: 902736 - protein, 9 aa, Homo Sapiens
GGAEQPNGD

SEQ ID NO: 902737 - protein, 9 aa, Homo Sapiens
AHQQFWDSQ

SEQ ID NO: 902738 - protein, 9 aa, Homo Sapiens
IEEHRQFGV

SEQ ID NO: 902739 - protein, 9 aa, Homo Sapiens
ILTDLTRET

SEQ ID NO: 902740 - protein, 9 aa, Homo Sapiens
SRPPVTQRL

SEQ ID NO: 902741 - protein, 9 aa, Homo Sapiens
LTLEEQLLR

SEQ ID NO: 902742 - protein, 9 aa, Homo Sapiens
IRHKACALR

SEQ ID NO: 902743 - protein, 9 aa, Homo Sapiens
PVESMQTEL

SEQ ID NO: 902744 - protein, 9 aa, Homo Sapiens
EGMSNASAE

SEQ ID NO: 902745 - protein, 9 aa, Homo Sapiens
EEQRDELSE

SEQ ID NO: 902746 - protein, 9 aa, Homo Sapiens
ELVFPNSDP

SEQ ID NO: 902747 - protein, 9 aa, Homo Sapiens
DTDMKLLSM

SEQ ID NO: 902748 - protein, 9 aa, Homo Sapiens
GPGSAVCVH

SEQ ID NO: 902749 - protein, 9 aa, Homo Sapiens
FICMAQISF

SEQ ID NO: 902750 - protein, 9 aa, Homo Sapiens
KEQRWQEEN

SEQ ID NO: 902751 - protein, 9 aa, Homo Sapiens
ASAEENYHR

SEQ ID NO: 902752 - protein, 9 aa, Homo Sapiens
NASAEENYH

SEQ ID NO: 902753 - protein, 9 aa, Homo Sapiens
GMGYFESSN

SEQ ID NO: 902754 - protein, 9 aa, Homo Sapiens
VDGDWTPLE

SEQ ID NO: 902755 - protein, 9 aa, Homo Sapiens
RYPTPGKAP

SEQ ID NO: 902756 - protein, 9 aa, Homo Sapiens
LGSVATKLS

SEQ ID NO: 902757 - protein, 9 aa, Homo Sapiens
ACLQPLPSS

SEQ ID NO: 902758 - protein, 9 aa, Homo Sapiens
EGSLFEVQW

SEQ ID NO: 902759 - protein, 9 aa, Homo Sapiens
TQDDLAEND

SEQ ID NO: 902760 - protein, 9 aa, Homo Sapiens
QAQRSCWCV

SEQ ID NO: 902761 - protein, 9 aa, Homo Sapiens
ASALMMAIF

SEQ ID NO: 902762 - protein, 9 aa, Homo Sapiens
KWRSAAPLH

SEQ ID NO: 902763 - protein, 9 aa, Homo Sapiens
AMTVDRYVA

SEQ ID NO: 902764 - protein, 9 aa, Homo Sapiens
RDDSKGLAA

SEQ ID NO: 902765 - protein, 9 aa, Homo Sapiens
CNSPSSIPI

SEQ ID NO: 902766 - protein, 9 aa, Homo Sapiens
LDNLAFWDF

SEQ ID NO: 902767 - protein, 9 aa, Homo Sapiens
CLSPSSSSD

SEQ ID NO: 902768 - protein, 9 aa, Homo Sapiens
PLLQEGSLS

SEQ ID NO: 902769 - protein, 9 aa, Homo Sapiens
APRWASAPP

SEQ ID NO: 902770 - protein, 9 aa, Homo Sapiens
LFYWKLCFC

SEQ ID NO: 902771 - protein, 9 aa, Homo Sapiens
FHIKTKSEC

SEQ ID NO: 902772 - protein, 9 aa, Homo Sapiens
CGKTFIETA

SEQ ID NO: 902773 - protein, 9 aa, Homo Sapiens
HCPWQQWAL

SEQ ID NO: 902774 - protein, 9 aa, Homo Sapiens
TLFALGLTL

SEQ ID NO: 902775 - protein, 9 aa, Homo Sapiens
VHGPDGFTP

SEQ ID NO: 902776 - protein, 9 aa, Homo Sapiens
HPEHYDTVI

SEQ ID NO: 902777 - protein, 9 aa, Homo Sapiens
RQFGVNCDV

SEQ ID NO: 902778 - protein, 9 aa, Homo Sapiens
RGNPSHVTQ

SEQ ID NO: 902779 - protein, 9 aa, Homo Sapiens
SIEEEAWED

SEQ ID NO: 902780 - protein, 9 aa, Homo Sapiens
SIISNVGCM

SEQ ID NO: 902781 - protein, 9 aa, Homo Sapiens
GKHSEQHPA

SEQ ID NO: 902782 - protein, 9 aa, Homo Sapiens
PRVVSPKKH

SEQ ID NO: 902783 - protein, 9 aa, Homo Sapiens
WMEKMAEQQ

SEQ ID NO: 902784 - protein, 9 aa, Homo Sapiens
WQEENDKLR

SEQ ID NO: 902785 - protein, 9 aa, Homo Sapiens
VTRIMAGSN

SEQ ID NO: 902786 - protein, 9 aa, Homo Sapiens
FQMGVIFQQ

SEQ ID NO: 902787 - protein, 9 aa, Homo Sapiens
HTENFLQQF

SEQ ID NO: 902788 - protein, 9 aa, Homo Sapiens
GGMNRRPFL

SEQ ID NO: 902789 - protein, 9 aa, Homo Sapiens
ACGGYCPVL

SEQ ID NO: 902790 - protein, 9 aa, Homo Sapiens
PPYTTGPGA

SEQ ID NO: 902791 - protein, 9 aa, Homo Sapiens
IWEKESELP

SEQ ID NO: 902792 - protein, 9 aa, Homo Sapiens
QAILEGEYA

SEQ ID NO: 902793 - protein, 9 aa, Homo Sapiens
VLTPTGLSD

SEQ ID NO: 902794 - protein, 9 aa, Homo Sapiens
RSGEAEAEA

SEQ ID NO: 902795 - protein, 9 aa, Homo Sapiens
ITTKLPNRA

SEQ ID NO: 902796 - protein, 9 aa, Homo Sapiens
LDHCSGSRG

SEQ ID NO: 902797 - protein, 9 aa, Homo Sapiens
IAPIGTRRK

SEQ ID NO: 902798 - protein, 9 aa, Homo Sapiens
RVSSLRQEP

SEQ ID NO: 902799 - protein, 9 aa, Homo Sapiens
MQTELNYLR

SEQ ID NO: 902800 - protein, 9 aa, Homo Sapiens
CMAQISFYA

SEQ ID NO: 902801 - protein, 9 aa, Homo Sapiens
DEIKDPAGD

SEQ ID NO: 902802 - protein, 9 aa, Homo Sapiens
NVVCFIVAR

SEQ ID NO: 902803 - protein, 9 aa, Homo Sapiens
LSRVLGDDP

SEQ ID NO: 902804 - protein, 9 aa, Homo Sapiens
TDLTRETTR

SEQ ID NO: 902805 - protein, 9 aa, Homo Sapiens
PPQACRRAH

SEQ ID NO: 902806 - protein, 9 aa, Homo Sapiens
FSDTGLVDG

SEQ ID NO: 902807 - protein, 9 aa, Homo Sapiens
IRSLVVGPS

SEQ ID NO: 902808 - protein, 9 aa, Homo Sapiens
DSRRWSYQL

SEQ ID NO: 902809 - protein, 9 aa, Homo Sapiens
ASLVCEKEV

SEQ ID NO: 902810 - protein, 9 aa, Homo Sapiens
QADPTILLT

SEQ ID NO: 902811 - protein, 9 aa, Homo Sapiens
FMFCFLSGR

SEQ ID NO: 902812 - protein, 9 aa, Homo Sapiens
PFHTENFLQ

SEQ ID NO: 902813 - protein, 9 aa, Homo Sapiens
EWAHCERCQ

SEQ ID NO: 902814 - protein, 9 aa, Homo Sapiens
QLVVQKVKS

SEQ ID NO: 902815 - protein, 9 aa, Homo Sapiens
QQIQVQSQL

SEQ ID NO: 902816 - protein, 9 aa, Homo Sapiens
QSEGIWESQ

SEQ ID NO: 902817 - protein, 9 aa, Homo Sapiens
WHTYHNEMC

SEQ ID NO: 902818 - protein, 9 aa, Homo Sapiens
TGGRIAVPR

SEQ ID NO: 902819 - protein, 9 aa, Homo Sapiens
LCLFTLARG

SEQ ID NO: 902820 - protein, 9 aa, Homo Sapiens
QKQLCLLPN

SEQ ID NO: 902821 - protein, 9 aa, Homo Sapiens
LCQSGLPRQ

SEQ ID NO: 902822 - protein, 9 aa, Homo Sapiens
MYFYDSVSR

SEQ ID NO: 902823 - protein, 9 aa, Homo Sapiens
YQELKSICS

SEQ ID NO: 902824 - protein, 9 aa, Homo Sapiens
SVETVLRVL

SEQ ID NO: 902825 - protein, 9 aa, Homo Sapiens
VTQRLVVPA

SEQ ID NO: 902826 - protein, 9 aa, Homo Sapiens
RPRGQADPT

SEQ ID NO: 902827 - protein, 9 aa, Homo Sapiens
QCTVEPDLI

SEQ ID NO: 902828 - protein, 9 aa, Homo Sapiens
SFFIHNLAQ

SEQ ID NO: 902829 - protein, 9 aa, Homo Sapiens
QSQLPPLMI

SEQ ID NO: 902830 - protein, 9 aa, Homo Sapiens
GQCISETTM

SEQ ID NO: 902831 - protein, 9 aa, Homo Sapiens
DVVAIEAKF

SEQ ID NO: 902832 - protein, 9 aa, Homo Sapiens
SGSRDDSKG

SEQ ID NO: 902833 - protein, 9 aa, Homo Sapiens
GSDRVNGRA

SEQ ID NO: 902834 - protein, 9 aa, Homo Sapiens
VGSDKTRIG

SEQ ID NO: 902835 - protein, 9 aa, Homo Sapiens
LTDDALAQK

SEQ ID NO: 902836 - protein, 9 aa, Homo Sapiens
RSKPSPGPG

SEQ ID NO: 902837 - protein, 9 aa, Homo Sapiens
ASIEEEAWE

SEQ ID NO: 902838 - protein, 9 aa, Homo Sapiens
DDTLIAVTY

SEQ ID NO: 902839 - protein, 9 aa, Homo Sapiens
PNGIYDPAD

SEQ ID NO: 902840 - protein, 9 aa, Homo Sapiens
QHQHQHQQQ

SEQ ID NO: 902841 - protein, 9 aa, Homo Sapiens
VTPKSQYID

SEQ ID NO: 902842 - protein, 9 aa, Homo Sapiens
FTDFICMAQ

SEQ ID NO: 902843 - protein, 9 aa, Homo Sapiens
TRVSSLRQE

SEQ ID NO: 902844 - protein, 9 aa, Homo Sapiens
SQCLLQAQD

SEQ ID NO: 902845 - protein, 9 aa, Homo Sapiens
TLEEQLLRE

SEQ ID NO: 902846 - protein, 9 aa, Homo Sapiens
GACGGYCPV

SEQ ID NO: 902847 - protein, 9 aa, Homo Sapiens
SSLRQEPPK

SEQ ID NO: 902848 - protein, 9 aa, Homo Sapiens
HTHRERERE

SEQ ID NO: 902849 - protein, 9 aa, Homo Sapiens
KRVLNETQQ

SEQ ID NO: 902850 - protein, 9 aa, Homo Sapiens
HSSLLKECH

SEQ ID NO: 902851 - protein, 9 aa, Homo Sapiens
QKEQRWQEE

SEQ ID NO: 902852 - protein, 9 aa, Homo Sapiens
TDMKLLSME

SEQ ID NO: 902853 - protein, 9 aa, Homo Sapiens
DQFQTAIRV

SEQ ID NO: 902854 - protein, 9 aa, Homo Sapiens
KAPGVVGNF

SEQ ID NO: 902855 - protein, 9 aa, Homo Sapiens
ALDDVVNPL

SEQ ID NO: 902856 - protein, 9 aa, Homo Sapiens
ETAYLIRHQ

SEQ ID NO: 902857 - protein, 9 aa, Homo Sapiens
KASIKCKPP

SEQ ID NO: 902858 - protein, 9 aa, Homo Sapiens
HQQFWDSQR

SEQ ID NO: 902859 - protein, 9 aa, Homo Sapiens
STLHFATQS

SEQ ID NO: 902860 - protein, 9 aa, Homo Sapiens
FEGDTASLV

SEQ ID NO: 902861 - protein, 9 aa, Homo Sapiens
RWQEENDKL

SEQ ID NO: 902862 - protein, 9 aa, Homo Sapiens
QFQTAIRVA

SEQ ID NO: 902863 - protein, 9 aa, Homo Sapiens
ERLREENKI

SEQ ID NO: 902864 - protein, 9 aa, Homo Sapiens
TKCYGRCKR

SEQ ID NO: 902865 - protein, 9 aa, Homo Sapiens
LGLTLGTTI

SEQ ID NO: 902866 - protein, 9 aa, Homo Sapiens
SPKYEVCKG

SEQ ID NO: 902867 - protein, 9 aa, Homo Sapiens
HLFYWKLCF

SEQ ID NO: 902868 - protein, 9 aa, Homo Sapiens
GEAGQPNGG

SEQ ID NO: 902869 - protein, 9 aa, Homo Sapiens
TVDRYVAVC

SEQ ID NO: 902870 - protein, 9 aa, Homo Sapiens
YDTVILLTR

SEQ ID NO: 902871 - protein, 9 aa, Homo Sapiens
PLVSYLRNN

SEQ ID NO: 902872 - protein, 9 aa, Homo Sapiens
DFKDTDMKL

SEQ ID NO: 902873 - protein, 9 aa, Homo Sapiens
SAGRSGRSA

SEQ ID NO: 902874 - protein, 9 aa, Homo Sapiens
HYDTVILLT

SEQ ID NO: 902875 - protein, 9 aa, Homo Sapiens
EIQCDVDTI

SEQ ID NO: 902876 - protein, 9 aa, Homo Sapiens
EEQLLRELQ

SEQ ID NO: 902877 - protein, 9 aa, Homo Sapiens
GKTFIETAY

SEQ ID NO: 902878 - protein, 9 aa, Homo Sapiens
QEFDKLCEF

SEQ ID NO: 902879 - protein, 9 aa, Homo Sapiens
RLMWLHLER

SEQ ID NO: 902880 - protein, 9 aa, Homo Sapiens
IWESQRQDS

SEQ ID NO: 902881 - protein, 9 aa, Homo Sapiens
TLKKQLRDV

SEQ ID NO: 902882 - protein, 9 aa, Homo Sapiens
QENFQLLQE

SEQ ID NO: 902883 - protein, 9 aa, Homo Sapiens
SRRWSYQLS

SEQ ID NO: 902884 - protein, 9 aa, Homo Sapiens
RDYYGYRQS

SEQ ID NO: 902885 - protein, 9 aa, Homo Sapiens
SKKSIISNV

SEQ ID NO: 902886 - protein, 9 aa, Homo Sapiens
DGANVTGYG

SEQ ID NO: 902887 - protein, 9 aa, Homo Sapiens
DKLETETHR

SEQ ID NO: 902888 - protein, 9 aa, Homo Sapiens
SHGCKEVEN

SEQ ID NO: 902889 - protein, 9 aa, Homo Sapiens
SDSRGGSKA

SEQ ID NO: 902890 - protein, 9 aa, Homo Sapiens
AFLRDLRDA

SEQ ID NO: 902891 - protein, 9 aa, Homo Sapiens
FLKAIKNTA

SEQ ID NO: 902892 - protein, 9 aa, Homo Sapiens
PFLFYHAKT

SEQ ID NO: 902893 - protein, 9 aa, Homo Sapiens
VYQRLFDRS

SEQ ID NO: 902894 - protein, 9 aa, Homo Sapiens
DDALAQKYW

SEQ ID NO: 902895 - protein, 9 aa, Homo Sapiens
KEVENALKA

SEQ ID NO: 902896 - protein, 9 aa, Homo Sapiens
DDVVNPLHE

SEQ ID NO: 902897 - protein, 9 aa, Homo Sapiens
GAEQPNGDA

SEQ ID NO: 902898 - protein, 9 aa, Homo Sapiens
KNQDGMSTL

SEQ ID NO: 902899 - protein, 9 aa, Homo Sapiens
DYYGYRQSV

SEQ ID NO: 902900 - protein, 9 aa, Homo Sapiens
YFPSVTRIM

SEQ ID NO: 902901 - protein, 9 aa, Homo Sapiens
AGSGGVRAP

SEQ ID NO: 902902 - protein, 9 aa, Homo Sapiens
PTVLLHMTF

SEQ ID NO: 902903 - protein, 9 aa, Homo Sapiens
VRTSGRELS

SEQ ID NO: 902904 - protein, 9 aa, Homo Sapiens
RPFLTIITL

SEQ ID NO: 902905 - protein, 9 aa, Homo Sapiens
DLAENDVML

SEQ ID NO: 902906 - protein, 9 aa, Homo Sapiens
VIHAGNKSP

SEQ ID NO: 902907 - protein, 9 aa, Homo Sapiens
TTSILLKLK

SEQ ID NO: 902908 - protein, 9 aa, Homo Sapiens
FGLSRVLGD

SEQ ID NO: 902909 - protein, 9 aa, Homo Sapiens
ATKLSFFIH

SEQ ID NO: 902910 - protein, 9 aa, Homo Sapiens
CYTCRQLHA

SEQ ID NO: 902911 - protein, 9 aa, Homo Sapiens
LEEQLLREL

SEQ ID NO: 902912 - protein, 9 aa, Homo Sapiens
DSLEDIKER

SEQ ID NO: 902913 - protein, 9 aa, Homo Sapiens
TTGPGANVA

SEQ ID NO: 902914 - protein, 9 aa, Homo Sapiens
SDTGLVDGK

SEQ ID NO: 902915 - protein, 9 aa, Homo Sapiens
ANKPDGRPH

SEQ ID NO: 902916 - protein, 9 aa, Homo Sapiens
EPGPPGPDG

SEQ ID NO: 902917 - protein, 9 aa, Homo Sapiens
GFLSASVAN

SEQ ID NO: 902918 - protein, 9 aa, Homo Sapiens
VLGDDPEAT

SEQ ID NO: 902919 - protein, 9 aa, Homo Sapiens
EVCKGALKE

SEQ ID NO: 902920 - protein, 9 aa, Homo Sapiens
FKIDAMGTY

SEQ ID NO: 902921 - protein, 9 aa, Homo Sapiens
PVTLNVLYD

SEQ ID NO: 902922 - protein, 9 aa, Homo Sapiens
IKDPAGDEY

SEQ ID NO: 902923 - protein, 9 aa, Homo Sapiens
AEYRRQLRS

SEQ ID NO: 902924 - protein, 9 aa, Homo Sapiens
KSRAQLRQR

SEQ ID NO: 902925 - protein, 9 aa, Homo Sapiens
EPMFTIVYL

SEQ ID NO: 902926 - protein, 9 aa, Homo Sapiens
VRLFRELFT

SEQ ID NO: 902927 - protein, 9 aa, Homo Sapiens
MDILGSVSE

SEQ ID NO: 902928 - protein, 9 aa, Homo Sapiens
SAEENYHRN

SEQ ID NO: 902929 - protein, 9 aa, Homo Sapiens
PPVYEDSFS

SEQ ID NO: 902930 - protein, 9 aa, Homo Sapiens
TDDALAQKY

SEQ ID NO: 902931 - protein, 9 aa, Homo Sapiens
VQSQLPPLM

SEQ ID NO: 902932 - protein, 9 aa, Homo Sapiens
GLSRVLGDD

SEQ ID NO: 902933 - protein, 9 aa, Homo Sapiens
GMFYRTICM

SEQ ID NO: 902934 - protein, 9 aa, Homo Sapiens
TENFLQQFF

SEQ ID NO: 902935 - protein, 9 aa, Homo Sapiens
LSLDTSAMV

SEQ ID NO: 902936 - protein, 9 aa, Homo Sapiens
MTFLEVIDV

SEQ ID NO: 902937 - protein, 9 aa, Homo Sapiens
PMFTIVYLK

SEQ ID NO: 902938 - protein, 9 aa, Homo Sapiens
CNICGYRTQ

SEQ ID NO: 902939 - protein, 9 aa, Homo Sapiens
IFRLTIPSY

SEQ ID NO: 902940 - protein, 9 aa, Homo Sapiens
PRDQFQTAI

SEQ ID NO: 902941 - protein, 9 aa, Homo Sapiens
LDDVVNPLH

SEQ ID NO: 902942 - protein, 9 aa, Homo Sapiens
DFSLAANSQ

SEQ ID NO: 902943 - protein, 9 aa, Homo Sapiens
PPILTPSPT

SEQ ID NO: 902944 - protein, 9 aa, Homo Sapiens
SPQYLYVCH

SEQ ID NO: 902945 - protein, 9 aa, Homo Sapiens
GACGVGKSA

SEQ ID NO: 902946 - protein, 9 aa, Homo Sapiens
SKLETEIQK

SEQ ID NO: 902947 - protein, 9 aa, Homo Sapiens
IYDNSRFTD

SEQ ID NO: 902948 - protein, 9 aa, Homo Sapiens
QHSQDSRLN

SEQ ID NO: 902949 - protein, 9 aa, Homo Sapiens
MGGMNRRPF

SEQ ID NO: 902950 - protein, 9 aa, Homo Sapiens
ALLRHVLSI

SEQ ID NO: 902951 - protein, 9 aa, Homo Sapiens
QIPRLSLTI

SEQ ID NO: 902952 - protein, 9 aa, Homo Sapiens
GSFHCQRDS

SEQ ID NO: 902953 - protein, 9 aa, Homo Sapiens
LPFHTENFL

SEQ ID NO: 902954 - protein, 9 aa, Homo Sapiens
CLLPNKDLF

SEQ ID NO: 902955 - protein, 9 aa, Homo Sapiens
GQADPTILL

SEQ ID NO: 902956 - protein, 9 aa, Homo Sapiens
WVLILERQG

SEQ ID NO: 902957 - protein, 9 aa, Homo Sapiens
RRPVFLALA

SEQ ID NO: 902958 - protein, 9 aa, Homo Sapiens
GMDVNVHGP

SEQ ID NO: 902959 - protein, 9 aa, Homo Sapiens
HSKIITYIR

SEQ ID NO: 902960 - protein, 9 aa, Homo Sapiens
RVPVSWLHS

SEQ ID NO: 902961 - protein, 9 aa, Homo Sapiens
EFRRLAAIP

SEQ ID NO: 902962 - protein, 9 aa, Homo Sapiens
RIWASEDGC

SEQ ID NO: 902963 - protein, 9 aa, Homo Sapiens
DQAIAGALA

SEQ ID NO: 902964 - protein, 9 aa, Homo Sapiens
EYRRQLRSK

SEQ ID NO: 902965 - protein, 9 aa, Homo Sapiens
GPDGQPGVD

SEQ ID NO: 902966 - protein, 9 aa, Homo Sapiens
MMAIFPRFS

SEQ ID NO: 902967 - protein, 9 aa, Homo Sapiens
RAPGGPGSA

SEQ ID NO: 902968 - protein, 9 aa, Homo Sapiens
GNKSPTEPM

SEQ ID NO: 902969 - protein, 9 aa, Homo Sapiens
EAQLGQGNG

SEQ ID NO: 902970 - protein, 9 aa, Homo Sapiens
STPRHPLKT

SEQ ID NO: 902971 - protein, 9 aa, Homo Sapiens
EIKDPAGDE

SEQ ID NO: 902972 - protein, 9 aa, Homo Sapiens
KSQRNLLRN

SEQ ID NO: 902973 - protein, 9 aa, Homo Sapiens
GSAGSDRVN

SEQ ID NO: 902974 - protein, 9 aa, Homo Sapiens
QVQGQQVQT

SEQ ID NO: 902975 - protein, 9 aa, Homo Sapiens
LFRELFTAE

SEQ ID NO: 902976 - protein, 9 aa, Homo Sapiens
MTNGLCIWL

SEQ ID NO: 902977 - protein, 9 aa, Homo Sapiens
AQEEYELDH

SEQ ID NO: 902978 - protein, 9 aa, Homo Sapiens
RPCVVAQLP

SEQ ID NO: 902979 - protein, 9 aa, Homo Sapiens
SNNKYVASS

SEQ ID NO: 902980 - protein, 9 aa, Homo Sapiens
PELPFDDIV

SEQ ID NO: 902981 - protein, 9 aa, Homo Sapiens
LKKQLRDVL

SEQ ID NO: 902982 - protein, 9 aa, Homo Sapiens
ATMVQKAKW

SEQ ID NO: 902983 - protein, 9 aa, Homo Sapiens
MAFVATQVA

SEQ ID NO: 902984 - protein, 9 aa, Homo Sapiens
KQLCLLPNK

SEQ ID NO: 902985 - protein, 9 aa, Homo Sapiens
AANNVVCFI

SEQ ID NO: 902986 - protein, 9 aa, Homo Sapiens
GDTASLVCE

SEQ ID NO: 902987 - protein, 9 aa, Homo Sapiens
GDVVGRGTD

SEQ ID NO: 902988 - protein, 9 aa, Homo Sapiens
GCSFQRRWR

SEQ ID NO: 902989 - protein, 9 aa, Homo Sapiens
FVDCCKTLD

SEQ ID NO: 902990 - protein, 9 aa, Homo Sapiens
RWSYQLSLD

SEQ ID NO: 902991 - protein, 9 aa, Homo Sapiens
LLDNLAFWD

SEQ ID NO: 902992 - protein, 9 aa, Homo Sapiens
DPVLEASSL

SEQ ID NO: 902993 - protein, 9 aa, Homo Sapiens
RNRRRRKSQ

SEQ ID NO: 902994 - protein, 9 aa, Homo Sapiens
TLIAVTYTV

SEQ ID NO: 902995 - protein, 9 aa, Homo Sapiens
GDRLIRHKA

SEQ ID NO: 902996 - protein, 9 aa, Homo Sapiens
DLTDDALAQ

SEQ ID NO: 902997 - protein, 9 aa, Homo Sapiens
KQWLRRKWM

SEQ ID NO: 902998 - protein, 9 aa, Homo Sapiens
DDSRRWSYQ

SEQ ID NO: 902999 - protein, 9 aa, Homo Sapiens
SLVVGPSAE

SEQ ID NO: 903000 - protein, 9 aa, Homo Sapiens
FKQWLRRKW

SEQ ID NO: 903001 - protein, 9 aa, Homo Sapiens
TIADLPDTT

SEQ ID NO: 903002 - protein, 9 aa, Homo Sapiens
GQQVQTQQI

SEQ ID NO: 903003 - protein, 9 aa, Homo Sapiens
HTYHNEMCN

SEQ ID NO: 903004 - protein, 9 aa, Homo Sapiens
YPRDQFQTA

SEQ ID NO: 903005 - protein, 9 aa, Homo Sapiens
FIKQISLNL

SEQ ID NO: 903006 - protein, 9 aa, Homo Sapiens
KYIFRLTIP

SEQ ID NO: 903007 - protein, 9 aa, Homo Sapiens
LAQHPDGCA

SEQ ID NO: 903008 - protein, 9 aa, Homo Sapiens
NKSPTEPMP

SEQ ID NO: 903009 - protein, 9 aa, Homo Sapiens
PGDRVELVF

SEQ ID NO: 903010 - protein, 9 aa, Homo Sapiens
QKAKWRSAA

SEQ ID NO: 903011 - protein, 9 aa, Homo Sapiens
DSSYSMAPR

SEQ ID NO: 903012 - protein, 9 aa, Homo Sapiens
KLETEIQKD

SEQ ID NO: 903013 - protein, 9 aa, Homo Sapiens
LAYDADESQ

SEQ ID NO: 903014 - protein, 9 aa, Homo Sapiens
ADPTILLTK

SEQ ID NO: 903015 - protein, 9 aa, Homo Sapiens
QANLIYDNS

SEQ ID NO: 903016 - protein, 9 aa, Homo Sapiens
KDTDMKLLS

SEQ ID NO: 903017 - protein, 9 aa, Homo Sapiens
FPILTDLTR

SEQ ID NO: 903018 - protein, 9 aa, Homo Sapiens
FSREFVQRV

SEQ ID NO: 903019 - protein, 9 aa, Homo Sapiens
VVVGACGVG

SEQ ID NO: 903020 - protein, 9 aa, Homo Sapiens
ENDVMLLDA

SEQ ID NO: 903021 - protein, 9 aa, Homo Sapiens
AQKYWLTCF

SEQ ID NO: 903022 - protein, 9 aa, Homo Sapiens
NPFPEISRE

SEQ ID NO: 903023 - protein, 9 aa, Homo Sapiens
EACARTGGR

SEQ ID NO: 903024 - protein, 9 aa, Homo Sapiens
RKIQVSFTN

SEQ ID NO: 903025 - protein, 9 aa, Homo Sapiens
YTTGPGANV

SEQ ID NO: 903026 - protein, 9 aa, Homo Sapiens
TFLEVIDVD

SEQ ID NO: 903027 - protein, 9 aa, Homo Sapiens
LEGSGGLPL

SEQ ID NO: 903028 - protein, 9 aa, Homo Sapiens
TMVQKAKWR

SEQ ID NO: 903029 - protein, 9 aa, Homo Sapiens
GNKAWSEAQ

SEQ ID NO: 903030 - protein, 9 aa, Homo Sapiens
FIIHSKIIT

SEQ ID NO: 903031 - protein, 9 aa, Homo Sapiens
VVRGCSFQR

SEQ ID NO: 903032 - protein, 9 aa, Homo Sapiens
LLAGSGGVR

SEQ ID NO: 903033 - protein, 9 aa, Homo Sapiens
PTPLLQEGS

SEQ ID NO: 903034 - protein, 9 aa, Homo Sapiens
MFYRTICMM

SEQ ID NO: 903035 - protein, 9 aa, Homo Sapiens
IECHNNSRC

SEQ ID NO: 903036 - protein, 9 aa, Homo Sapiens
GRTYYCRTG

SEQ ID NO: 903037 - protein, 9 aa, Homo Sapiens
DGCAKMSDH

SEQ ID NO: 903038 - protein, 9 aa, Homo Sapiens
RAGTPTRTA

SEQ ID NO: 903039 - protein, 9 aa, Homo Sapiens
GYASALMMA

SEQ ID NO: 903040 - protein, 9 aa, Homo Sapiens
TPTGLSDGA

SEQ ID NO: 903041 - protein, 9 aa, Homo Sapiens
NSQDEAVVS

SEQ ID NO: 903042 - protein, 9 aa, Homo Sapiens
CTKCYGRCK

SEQ ID NO: 903043 - protein, 9 aa, Homo Sapiens
YELDHCSGS

SEQ ID NO: 903044 - protein, 9 aa, Homo Sapiens
DTGLVDGKM

SEQ ID NO: 903045 - protein, 9 aa, Homo Sapiens
SFSQPRGWN

SEQ ID NO: 903046 - protein, 9 aa, Homo Sapiens
TLSPPPSTL

SEQ ID NO: 903047 - protein, 9 aa, Homo Sapiens
RAPKASQPP

SEQ ID NO: 903048 - protein, 9 aa, Homo Sapiens
SKPSPGPGP

SEQ ID NO: 903049 - protein, 9 aa, Homo Sapiens
YAVEILIWE

SEQ ID NO: 903050 - protein, 9 aa, Homo Sapiens
NFVSKKSII

SEQ ID NO: 903051 - protein, 9 aa, Homo Sapiens
ASLGAELQK

SEQ ID NO: 903052 - protein, 9 aa, Homo Sapiens
QDSRLNQVP

SEQ ID NO: 903053 - protein, 9 aa, Homo Sapiens
EKQWHSQCL

SEQ ID NO: 903054 - protein, 9 aa, Homo Sapiens
SDKTRIGLA

SEQ ID NO: 903055 - protein, 9 aa, Homo Sapiens
FQLSRQKLF

SEQ ID NO: 903056 - protein, 9 aa, Homo Sapiens
SRAQLRQRH

SEQ ID NO: 903057 - protein, 9 aa, Homo Sapiens
SASVANTIP

SEQ ID NO: 903058 - protein, 9 aa, Homo Sapiens
ELWQRLLPG

SEQ ID NO: 903059 - protein, 9 aa, Homo Sapiens
PWQQWALVE

SEQ ID NO: 903060 - protein, 9 aa, Homo Sapiens
EEQANLIYD

SEQ ID NO: 903061 - protein, 9 aa, Homo Sapiens
QVSFTNLEE

SEQ ID NO: 903062 - protein, 9 aa, Homo Sapiens
GSSAGTTPK

SEQ ID NO: 903063 - protein, 9 aa, Homo Sapiens
AIAGALAAP

SEQ ID NO: 903064 - protein, 9 aa, Homo Sapiens
NRWHTIAPI

SEQ ID NO: 903065 - protein, 9 aa, Homo Sapiens
AAIPNVYEV

SEQ ID NO: 903066 - protein, 9 aa, Homo Sapiens
AQLGQGNGE

SEQ ID NO: 903067 - protein, 9 aa, Homo Sapiens
SHAKVNGRI

SEQ ID NO: 903068 - protein, 9 aa, Homo Sapiens
FGVNCDVDV

SEQ ID NO: 903069 - protein, 9 aa, Homo Sapiens
FAHQQFWDS

SEQ ID NO: 903070 - protein, 9 aa, Homo Sapiens
ETYVEGQCI

SEQ ID NO: 903071 - protein, 9 aa, Homo Sapiens
AHHLGFLSA

SEQ ID NO: 903072 - protein, 9 aa, Homo Sapiens
LMMAIFPRF

SEQ ID NO: 903073 - protein, 9 aa, Homo Sapiens
IAGHLHIPA

SEQ ID NO: 903074 - protein, 9 aa, Homo Sapiens
RSISNSLLD

SEQ ID NO: 903075 - protein, 9 aa, Homo Sapiens
FPSVTRIMA

SEQ ID NO: 903076 - protein, 9 aa, Homo Sapiens
RLIRHKACA

SEQ ID NO: 903077 - protein, 9 aa, Homo Sapiens
ECNICGYRT

SEQ ID NO: 903078 - protein, 9 aa, Homo Sapiens
LEFAHQQFW

SEQ ID NO: 903079 - protein, 9 aa, Homo Sapiens
SFDDVFVAC

SEQ ID NO: 903080 - protein, 9 aa, Homo Sapiens
LIAVTYTVI

SEQ ID NO: 903081 - protein, 9 aa, Homo Sapiens
RLPFHTENF

SEQ ID NO: 903082 - protein, 9 aa, Homo Sapiens
WDMKINCSG

SEQ ID NO: 903083 - protein, 9 aa, Homo Sapiens
NRAYTPEIS

SEQ ID NO: 903084 - protein, 9 aa, Homo Sapiens
RACLSDLQK

SEQ ID NO: 903085 - protein, 9 aa, Homo Sapiens
LRNNCLTLF

SEQ ID NO: 903086 - protein, 9 aa, Homo Sapiens
VPSGLTAVP

SEQ ID NO: 903087 - protein, 9 aa, Homo Sapiens
LSFFIHNLA

SEQ ID NO: 903088 - protein, 9 aa, Homo Sapiens
GHLHIPAHR

SEQ ID NO: 903089 - protein, 9 aa, Homo Sapiens
GDNSDPVLE

SEQ ID NO: 903090 - protein, 9 aa, Homo Sapiens
PDGCAKMSD

SEQ ID NO: 903091 - protein, 9 aa, Homo Sapiens
CGPPRLDGF

SEQ ID NO: 903092 - protein, 9 aa, Homo Sapiens
LQKEQRWQE

SEQ ID NO: 903093 - protein, 9 aa, Homo Sapiens
AVIDWADWR

SEQ ID NO: 903094 - protein, 9 aa, Homo Sapiens
LSPPPSTLH

SEQ ID NO: 903095 - protein, 9 aa, Homo Sapiens
TSILESGGF

SEQ ID NO: 903096 - protein, 9 aa, Homo Sapiens
KLEWDMKIN

SEQ ID NO: 903097 - protein, 9 aa, Homo Sapiens
QCISETTML

SEQ ID NO: 903098 - protein, 9 aa, Homo Sapiens
TRAPKASQP

SEQ ID NO: 903099 - protein, 9 aa, Homo Sapiens
TEDFFKLEW

SEQ ID NO: 903100 - protein, 9 aa, Homo Sapiens
ADWRPVWVR

SEQ ID NO: 903101 - protein, 9 aa, Homo Sapiens
HLHIPAHRL

SEQ ID NO: 903102 - protein, 9 aa, Homo Sapiens
YDADESQNA

SEQ ID NO: 903103 - protein, 9 aa, Homo Sapiens
AFDVGSDKT

SEQ ID NO: 903104 - protein, 9 aa, Homo Sapiens
KAIKASIKC

SEQ ID NO: 903105 - protein, 9 aa, Homo Sapiens
LPNRAYTPE

SEQ ID NO: 903106 - protein, 9 aa, Homo Sapiens
VGVFVDCCK

SEQ ID NO: 903107 - protein, 9 aa, Homo Sapiens
RAPRWASAP

SEQ ID NO: 903108 - protein, 9 aa, Homo Sapiens
ETETHRVPV

SEQ ID NO: 903109 - protein, 9 aa, Homo Sapiens
LFLSSSSLC

SEQ ID NO: 903110 - protein, 9 aa, Homo Sapiens
EETSILESG

SEQ ID NO: 903111 - protein, 9 aa, Homo Sapiens
CQSGLPRQQ

SEQ ID NO: 903112 - protein, 9 aa, Homo Sapiens
PKASQPPKM

SEQ ID NO: 903113 - protein, 9 aa, Homo Sapiens
FIETAYLIR

SEQ ID NO: 903114 - protein, 9 aa, Homo Sapiens
SQRNLLRNF

SEQ ID NO: 903115 - protein, 9 aa, Homo Sapiens
ISGDTAFDM

SEQ ID NO: 903116 - protein, 9 aa, Homo Sapiens
NAANNVVCF

SEQ ID NO: 903117 - protein, 9 aa, Homo Sapiens
IKTKSECAI

SEQ ID NO: 903118 - protein, 9 aa, Homo Sapiens
LPDTTVVTT

SEQ ID NO: 903119 - protein, 9 aa, Homo Sapiens
AAAGANKPD

SEQ ID NO: 903120 - protein, 9 aa, Homo Sapiens
YLTHTHTHR

SEQ ID NO: 903121 - protein, 9 aa, Homo Sapiens
IQVSFTNLE

SEQ ID NO: 903122 - protein, 9 aa, Homo Sapiens
ERTQVKLES

SEQ ID NO: 903123 - protein, 9 aa, Homo Sapiens
HYRVAGCPN

SEQ ID NO: 903124 - protein, 9 aa, Homo Sapiens
VKDICGKGE

SEQ ID NO: 903125 - protein, 9 aa, Homo Sapiens
HTHTHRERE

SEQ ID NO: 903126 - protein, 9 aa, Homo Sapiens
FRELFTAEN

SEQ ID NO: 903127 - protein, 9 aa, Homo Sapiens
LPPVYEDSF

SEQ ID NO: 903128 - protein, 9 aa, Homo Sapiens
EEYELDHCS

SEQ ID NO: 903129 - protein, 9 aa, Homo Sapiens
LWQRLLPGC

SEQ ID NO: 903130 - protein, 9 aa, Homo Sapiens
QLRSKSIEL

SEQ ID NO: 903131 - protein, 9 aa, Homo Sapiens
LIRSLVVGP

SEQ ID NO: 903132 - protein, 9 aa, Homo Sapiens
ELSHRIKPR

SEQ ID NO: 903133 - protein, 9 aa, Homo Sapiens
KLETETHRV

SEQ ID NO: 903134 - protein, 9 aa, Homo Sapiens
DSVSRDAAS

SEQ ID NO: 903135 - protein, 9 aa, Homo Sapiens
EELQDWVLI

SEQ ID NO: 903136 - protein, 9 aa, Homo Sapiens
RSGRSASFL

SEQ ID NO: 903137 - protein, 9 aa, Homo Sapiens
ESREAVVID

SEQ ID NO: 903138 - protein, 9 aa, Homo Sapiens
QDGMSTLHF

SEQ ID NO: 903139 - protein, 9 aa, Homo Sapiens
VASSYLSLT

SEQ ID NO: 903140 - protein, 9 aa, Homo Sapiens
RQQGSPQYL

SEQ ID NO: 903141 - protein, 9 aa, Homo Sapiens
FDDVFVACL

SEQ ID NO: 903142 - protein, 9 aa, Homo Sapiens
QGAAFAFFM

SEQ ID NO: 903143 - protein, 9 aa, Homo Sapiens
TPSPTSAFP

SEQ ID NO: 903144 - protein, 9 aa, Homo Sapiens
PSPGPGPEI

SEQ ID NO: 903145 - protein, 9 aa, Homo Sapiens
WADWRPVWV

SEQ ID NO: 903146 - protein, 9 aa, Homo Sapiens
RSLVVGPSA

SEQ ID NO: 903147 - protein, 9 aa, Homo Sapiens
GIWESQRQD

SEQ ID NO: 903148 - protein, 9 aa, Homo Sapiens
GDDTLIAVT

SEQ ID NO: 903149 - protein, 9 aa, Homo Sapiens
PFDDIVGKQ

SEQ ID NO: 903150 - protein, 9 aa, Homo Sapiens
LVVQKVKSL

SEQ ID NO: 903151 - protein, 9 aa, Homo Sapiens
ELDSSDDWH

SEQ ID NO: 903152 - protein, 9 aa, Homo Sapiens
RPNHSRGNP

SEQ ID NO: 903153 - protein, 9 aa, Homo Sapiens
TARSPLRSP

SEQ ID NO: 903154 - protein, 9 aa, Homo Sapiens
FYRTICMME

SEQ ID NO: 903155 - protein, 9 aa, Homo Sapiens
EMAQLKIQQ

SEQ ID NO: 903156 - protein, 9 aa, Homo Sapiens
SRVLGDDPE

SEQ ID NO: 903157 - protein, 9 aa, Homo Sapiens
SKAVVTLEP

SEQ ID NO: 903158 - protein, 9 aa, Homo Sapiens
HQHQHQQQQ

SEQ ID NO: 903159 - protein, 9 aa, Homo Sapiens
NVLYDPDLP

SEQ ID NO: 903160 - protein, 9 aa, Homo Sapiens
LCLLPNKDL

SEQ ID NO: 903161 - protein, 9 aa, Homo Sapiens
HSQCLLQAQ

SEQ ID NO: 903162 - protein, 9 aa, Homo Sapiens
DICGKGEMA

SEQ ID NO: 903163 - protein, 9 aa, Homo Sapiens
RCTKCYGRC

SEQ ID NO: 903164 - protein, 9 aa, Homo Sapiens
AAGSAGSDR

SEQ ID NO: 903165 - protein, 9 aa, Homo Sapiens
FKDTDMKLL

SEQ ID NO: 903166 - protein, 9 aa, Homo Sapiens
EEGDQAIAG

SEQ ID NO: 903167 - protein, 9 aa, Homo Sapiens
WHTIAPIGT

SEQ ID NO: 903168 - protein, 9 aa, Homo Sapiens
EEKRVLNET

SEQ ID NO: 903169 - protein, 9 aa, Homo Sapiens
VKDLVTASL

SEQ ID NO: 903170 - protein, 9 aa, Homo Sapiens
RKLILKAEM

SEQ ID NO: 903171 - protein, 9 aa, Homo Sapiens
TSILLKLKR

SEQ ID NO: 903172 - protein, 9 aa, Homo Sapiens
HLHSEPVHR

SEQ ID NO: 903173 - protein, 9 aa, Homo Sapiens
EYFIKQISL

SEQ ID NO: 903174 - protein, 9 aa, Homo Sapiens
HVLSINEEG

SEQ ID NO: 903175 - protein, 9 aa, Homo Sapiens
SAGSDRVNG

SEQ ID NO: 903176 - protein, 9 aa, Homo Sapiens
HLLLCQSGL

SEQ ID NO: 903177 - protein, 9 aa, Homo Sapiens
RETTRRWKL

SEQ ID NO: 903178 - protein, 9 aa, Homo Sapiens
TVILLTRQN

SEQ ID NO: 903179 - protein, 9 aa, Homo Sapiens
QISFYALSA

SEQ ID NO: 903180 - protein, 9 aa, Homo Sapiens
YFESSNIHR

SEQ ID NO: 903181 - protein, 9 aa, Homo Sapiens
TVSVETVLR

SEQ ID NO: 903182 - protein, 9 aa, Homo Sapiens
QSGLPRQQL

SEQ ID NO: 903183 - protein, 9 aa, Homo Sapiens
DTPIVRTSG

SEQ ID NO: 903184 - protein, 9 aa, Homo Sapiens
DPACSPSKA

SEQ ID NO: 903185 - protein, 9 aa, Homo Sapiens
IPNVYEVIS

SEQ ID NO: 903186 - protein, 9 aa, Homo Sapiens
RSGEQCTVE

SEQ ID NO: 903187 - protein, 9 aa, Homo Sapiens
CVRQCLSLR

SEQ ID NO: 903188 - protein, 9 aa, Homo Sapiens
PVGVFVDCC

SEQ ID NO: 903189 - protein, 9 aa, Homo Sapiens
IKQISLNLG

SEQ ID NO: 903190 - protein, 9 aa, Homo Sapiens
VFVACLQPL

SEQ ID NO: 903191 - protein, 9 aa, Homo Sapiens
DWVLILERQ

SEQ ID NO: 903192 - protein, 9 aa, Homo Sapiens
LSDLQKGYY

SEQ ID NO: 903193 - protein, 9 aa, Homo Sapiens
RVELVFPNS

SEQ ID NO: 903194 - protein, 9 aa, Homo Sapiens
CTVEPDLIS

SEQ ID NO: 903195 - protein, 9 aa, Homo Sapiens
VRGCSFQRR

SEQ ID NO: 903196 - protein, 9 aa, Homo Sapiens
SRGNPSHVT

SEQ ID NO: 903197 - protein, 9 aa, Homo Sapiens
LLHMTFLEV

SEQ ID NO: 903198 - protein, 9 aa, Homo Sapiens
FPKSRAQLR

SEQ ID NO: 903199 - protein, 9 aa, Homo Sapiens
TREPTPLLQ

SEQ ID NO: 903200 - protein, 9 aa, Homo Sapiens
RTVAGRTYY

SEQ ID NO: 903201 - protein, 9 aa, Homo Sapiens
QLEFAHQQF

SEQ ID NO: 903202 - protein, 9 aa, Homo Sapiens
RLREENKIL

SEQ ID NO: 903203 - protein, 9 aa, Homo Sapiens
ISVLKYIFR

SEQ ID NO: 903204 - protein, 9 aa, Homo Sapiens
RICFEEQRD

SEQ ID NO: 903205 - protein, 9 aa, Homo Sapiens
SISNSLLDN

SEQ ID NO: 903206 - protein, 9 aa, Homo Sapiens
NHSRGNPSH

SEQ ID NO: 903207 - protein, 9 aa, Homo Sapiens
DVGSDKTRI

SEQ ID NO: 903208 - protein, 9 aa, Homo Sapiens
ERPNHSRGN

SEQ ID NO: 903209 - protein, 9 aa, Homo Sapiens
SYRSRSWSR

SEQ ID NO: 903210 - protein, 9 aa, Homo Sapiens
DMDILGSVS

SEQ ID NO: 903211 - protein, 9 aa, Homo Sapiens
TTLKKQLRD

SEQ ID NO: 903212 - protein, 9 aa, Homo Sapiens
RHNQSCVVE

SEQ ID NO: 903213 - protein, 9 aa, Homo Sapiens
AGTTPKQGG

SEQ ID NO: 903214 - protein, 9 aa, Homo Sapiens
LRCVQTAHS

SEQ ID NO: 903215 - protein, 9 aa, Homo Sapiens
VDCQHNTEW

SEQ ID NO: 903216 - protein, 9 aa, Homo Sapiens
SRLNQVPPN

SEQ ID NO: 903217 - protein, 9 aa, Homo Sapiens
FRYAVEILI

SEQ ID NO: 903218 - protein, 9 aa, Homo Sapiens
FLSASVANT

SEQ ID NO: 903219 - protein, 9 aa, Homo Sapiens
VILLTRQNF

SEQ ID NO: 903220 - protein, 9 aa, Homo Sapiens
LHLERLQTP

SEQ ID NO: 903221 - protein, 9 aa, Homo Sapiens
PCPPTLSPP

SEQ ID NO: 903222 - protein, 9 aa, Homo Sapiens
MFPKSRAQL

SEQ ID NO: 903223 - protein, 9 aa, Homo Sapiens
APHSHLPRV

SEQ ID NO: 903224 - protein, 9 aa, Homo Sapiens
QQQIQVQSQ

SEQ ID NO: 903225 - protein, 9 aa, Homo Sapiens
DTSAMVYPP

SEQ ID NO: 903226 - protein, 9 aa, Homo Sapiens
SHERPVKML

SEQ ID NO: 903227 - protein, 9 aa, Homo Sapiens
PVYEDSFSQ

SEQ ID NO: 903228 - protein, 9 aa, Homo Sapiens
SDDSRRWSY

SEQ ID NO: 903229 - protein, 9 aa, Homo Sapiens
PASSNSSGC

SEQ ID NO: 903230 - protein, 9 aa, Homo Sapiens
HSRGNPSHV

SEQ ID NO: 903231 - protein, 9 aa, Homo Sapiens
IYFPSVTRI

SEQ ID NO: 903232 - protein, 9 aa, Homo Sapiens
SRDDSKGLA

SEQ ID NO: 903233 - protein, 9 aa, Homo Sapiens
WTGDVVGRG

SEQ ID NO: 903234 - protein, 9 aa, Homo Sapiens
AGCPNPRGK

SEQ ID NO: 903235 - protein, 9 aa, Homo Sapiens
TTKLPNRAY

SEQ ID NO: 903236 - protein, 9 aa, Homo Sapiens
DLRDASLAP

SEQ ID NO: 903237 - protein, 9 aa, Homo Sapiens
GLCIWLLIL

SEQ ID NO: 903238 - protein, 9 aa, Homo Sapiens
GYFESSNIH

SEQ ID NO: 903239 - protein, 9 aa, Homo Sapiens
FTQDDLAEN

SEQ ID NO: 903240 - protein, 9 aa, Homo Sapiens
TEQAILEGE

SEQ ID NO: 903241 - protein, 9 aa, Homo Sapiens
RLEEKRVLN

SEQ ID NO: 903242 - protein, 9 aa, Homo Sapiens
FREEIQCDV

SEQ ID NO: 903243 - protein, 9 aa, Homo Sapiens
PKSQYIDKI

SEQ ID NO: 903244 - protein, 9 aa, Homo Sapiens
RRQLRSKSI

SEQ ID NO: 903245 - protein, 9 aa, Homo Sapiens
NVDGDWTPL

SEQ ID NO: 903246 - protein, 9 aa, Homo Sapiens
LSLRSKPSP

SEQ ID NO: 903247 - protein, 9 aa, Homo Sapiens
WNRACFTMD

SEQ ID NO: 903248 - protein, 9 aa, Homo Sapiens
QVKLESLED

SEQ ID NO: 903249 - protein, 9 aa, Homo Sapiens
MRLCFLKAI

SEQ ID NO: 903250 - protein, 9 aa, Homo Sapiens
RQKFIIHSK

SEQ ID NO: 903251 - protein, 9 aa, Homo Sapiens
NNVVCFIVA

SEQ ID NO: 903252 - protein, 9 aa, Homo Sapiens
GEYAALEGS

SEQ ID NO: 903253 - protein, 9 aa, Homo Sapiens
ALPCQLVVQ

SEQ ID NO: 903254 - protein, 9 aa, Homo Sapiens
ASQPPKMRN

SEQ ID NO: 903255 - protein, 9 aa, Homo Sapiens
RGTDSNIFM

SEQ ID NO: 903256 - protein, 9 aa, Homo Sapiens
LTVSVETVL

SEQ ID NO: 903257 - protein, 9 aa, Homo Sapiens
SIRPKETRS

SEQ ID NO: 903258 - protein, 9 aa, Homo Sapiens
QIQVQSQLP

SEQ ID NO: 903259 - protein, 9 aa, Homo Sapiens
GIIQGERDY

SEQ ID NO: 903260 - protein, 9 aa, Homo Sapiens
EGIPLKICL

SEQ ID NO: 903261 - protein, 9 aa, Homo Sapiens
TEGFKIDAM

SEQ ID NO: 903262 - protein, 9 aa, Homo Sapiens
CFRYPTPGK

SEQ ID NO: 903263 - protein, 9 aa, Homo Sapiens
APIGTRRKH

SEQ ID NO: 903264 - protein, 9 aa, Homo Sapiens
SREEYLYTY

SEQ ID NO: 903265 - protein, 9 aa, Homo Sapiens
ANLIYDNSR

SEQ ID NO: 903266 - protein, 9 aa, Homo Sapiens
NGRIYLIIN

SEQ ID NO: 903267 - protein, 9 aa, Homo Sapiens
HNTEWAHCE

SEQ ID NO: 903268 - protein, 9 aa, Homo Sapiens
AGNKSPTEP

SEQ ID NO: 903269 - protein, 9 aa, Homo Sapiens
GFKIDAMGT

SEQ ID NO: 903270 - protein, 9 aa, Homo Sapiens
AGPGCGPPR

SEQ ID NO: 903271 - protein, 9 aa, Homo Sapiens
TRGSALDDV

SEQ ID NO: 903272 - protein, 9 aa, Homo Sapiens
LAGSGGVRA

SEQ ID NO: 903273 - protein, 9 aa, Homo Sapiens
VNRLEEKRV

SEQ ID NO: 903274 - protein, 9 aa, Homo Sapiens
SELSDEETS

SEQ ID NO: 903275 - protein, 9 aa, Homo Sapiens
INQENFQLL

SEQ ID NO: 903276 - protein, 9 aa, Homo Sapiens
CPNPRGKGS

SEQ ID NO: 903277 - protein, 9 aa, Homo Sapiens
SQLPPLMIP

SEQ ID NO: 903278 - protein, 9 aa, Homo Sapiens
HAGNKSPTE

SEQ ID NO: 903279 - protein, 9 aa, Homo Sapiens
VLKYIFRLT

SEQ ID NO: 903280 - protein, 9 aa, Homo Sapiens
TRIMAGSNR

SEQ ID NO: 903281 - protein, 9 aa, Homo Sapiens
KAVVTLEPC

SEQ ID NO: 903282 - protein, 9 aa, Homo Sapiens
AETYVEGQC

SEQ ID NO: 903283 - protein, 9 aa, Homo Sapiens
TASLVCEKE

SEQ ID NO: 903284 - protein, 9 aa, Homo Sapiens
KKSIISNVG

SEQ ID NO: 903285 - protein, 9 aa, Homo Sapiens
EGEYAALEG

SEQ ID NO: 903286 - protein, 9 aa, Homo Sapiens
KDEERTQVK

SEQ ID NO: 903287 - protein, 9 aa, Homo Sapiens
EGHCPWQQW

SEQ ID NO: 903288 - protein, 9 aa, Homo Sapiens
EDTTSILLK

SEQ ID NO: 903289 - protein, 9 aa, Homo Sapiens
LLTVSVETV

SEQ ID NO: 903290 - protein, 9 aa, Homo Sapiens
QEMYFYDSV

SEQ ID NO: 903291 - protein, 9 aa, Homo Sapiens
FYWKLCFCF

SEQ ID NO: 903292 - protein, 9 aa, Homo Sapiens
DGRPHTAVP

SEQ ID NO: 903293 - protein, 9 aa, Homo Sapiens
RGSALDDVV

SEQ ID NO: 903294 - protein, 9 aa, Homo Sapiens
MAQISFYAL

SEQ ID NO: 903295 - protein, 9 aa, Homo Sapiens
SQDSRLNQV

SEQ ID NO: 903296 - protein, 9 aa, Homo Sapiens
SQELWQRLL

SEQ ID NO: 903297 - protein, 9 aa, Homo Sapiens
QDTQPVGVF

SEQ ID NO: 903298 - protein, 9 aa, Homo Sapiens
FRLTIPSYT

SEQ ID NO: 903299 - protein, 9 aa, Homo Sapiens
DALAQKYWL

SEQ ID NO: 903300 - protein, 9 aa, Homo Sapiens
FPEISREEY

SEQ ID NO: 903301 - protein, 9 aa, Homo Sapiens
ENFQLLQEY

SEQ ID NO: 903302 - protein, 9 aa, Homo Sapiens
EVYQRLFDR

SEQ ID NO: 903303 - protein, 9 aa, Homo Sapiens
DTASLVCEK

SEQ ID NO: 903304 - protein, 9 aa, Homo Sapiens
PRPCVVAQL

SEQ ID NO: 903305 - protein, 9 aa, Homo Sapiens
EFALLGAMT

SEQ ID NO: 903306 - protein, 9 aa, Homo Sapiens
EHYDTVILL

SEQ ID NO: 903307 - protein, 9 aa, Homo Sapiens
AANSQDEAV

SEQ ID NO: 903308 - protein, 9 aa, Homo Sapiens
RRSGEAEAE

SEQ ID NO: 903309 - protein, 9 aa, Homo Sapiens
PSSPPQACR

SEQ ID NO: 903310 - protein, 9 aa, Homo Sapiens
SNASAEENY

SEQ ID NO: 903311 - protein, 9 aa, Homo Sapiens
SDEETSILE

SEQ ID NO: 903312 - protein, 9 aa, Homo Sapiens
YTCRQLHAA

SEQ ID NO: 903313 - protein, 9 aa, Homo Sapiens
VDGKMKSDS

SEQ ID NO: 903314 - protein, 9 aa, Homo Sapiens
QAAENSKLE

SEQ ID NO: 903315 - protein, 9 aa, Homo Sapiens
DCQHNTEWA

SEQ ID NO: 903316 - protein, 9 aa, Homo Sapiens
NPRGKGSAG

SEQ ID NO: 903317 - protein, 9 aa, Homo Sapiens
WSRRPVFLA

SEQ ID NO: 903318 - protein, 9 aa, Homo Sapiens
ILLKLKRNS

SEQ ID NO: 903319 - protein, 9 aa, Homo Sapiens
VVGRGTDSN

SEQ ID NO: 903320 - protein, 9 aa, Homo Sapiens
ELDHCSGSR

SEQ ID NO: 903321 - protein, 9 aa, Homo Sapiens
TYVEGQCIS

SEQ ID NO: 903322 - protein, 9 aa, Homo Sapiens
IIHSKIITY

SEQ ID NO: 903323 - protein, 9 aa, Homo Sapiens
FQLLQEYYK

SEQ ID NO: 903324 - protein, 9 aa, Homo Sapiens
LYDPDLPRI

SEQ ID NO: 903325 - protein, 9 aa, Homo Sapiens
FVSKKSIIS

SEQ ID NO: 903326 - protein, 9 aa, Homo Sapiens
NADRCTKCY

SEQ ID NO: 903327 - protein, 9 aa, Homo Sapiens
SVTNAANNV

SEQ ID NO: 903328 - protein, 9 aa, Homo Sapiens
QGQQVQTQQ

SEQ ID NO: 903329 - protein, 9 aa, Homo Sapiens
VATVVDQTT

SEQ ID NO: 903330 - protein, 9 aa, Homo Sapiens
VGPSAELLL

SEQ ID NO: 903331 - protein, 9 aa, Homo Sapiens
RDQFQTAIR

SEQ ID NO: 903332 - protein, 9 aa, Homo Sapiens
VHQLPPGQL

SEQ ID NO: 903333 - protein, 9 aa, Homo Sapiens
AQHPDGCAK

SEQ ID NO: 903334 - protein, 9 aa, Homo Sapiens
YTFEPYLLD

SEQ ID NO: 903335 - protein, 9 aa, Homo Sapiens
EYAALEGSQ

SEQ ID NO: 903336 - protein, 9 aa, Homo Sapiens
CRICFEEQR

SEQ ID NO: 903337 - protein, 9 aa, Homo Sapiens
RLAAIPNVY

SEQ ID NO: 903338 - protein, 9 aa, Homo Sapiens
KQISLNLGV

SEQ ID NO: 903339 - protein, 9 aa, Homo Sapiens
HMTFLEVID

SEQ ID NO: 903340 - protein, 9 aa, Homo Sapiens
KLILKAEMA

SEQ ID NO: 903341 - protein, 9 aa, Homo Sapiens
ADRCTKCYG

SEQ ID NO: 903342 - protein, 9 aa, Homo Sapiens
NKKIALEHG

SEQ ID NO: 903343 - protein, 9 aa, Homo Sapiens
LAAILVLLC

SEQ ID NO: 903344 - protein, 9 aa, Homo Sapiens
ENSKLETEI

SEQ ID NO: 903345 - protein, 9 aa, Homo Sapiens
GRIYLIINS

SEQ ID NO: 903346 - protein, 9 aa, Homo Sapiens
LDVVAIEAK

SEQ ID NO: 903347 - protein, 9 aa, Homo Sapiens
LLCVRQCLS

SEQ ID NO: 903348 - protein, 9 aa, Homo Sapiens
ARACLSDLQ

SEQ ID NO: 903349 - protein, 9 aa, Homo Sapiens
LDVRLPFHT

SEQ ID NO: 903350 - protein, 9 aa, Homo Sapiens
DGDWTPLEE

SEQ ID NO: 903351 - protein, 9 aa, Homo Sapiens
AFAFFMFCF

SEQ ID NO: 903352 - protein, 9 aa, Homo Sapiens
SILKGLQQE

SEQ ID NO: 903353 - protein, 9 aa, Homo Sapiens
VQYVPRDVR

SEQ ID NO: 903354 - protein, 9 aa, Homo Sapiens
WASEDGCCI

SEQ ID NO: 903355 - protein, 9 aa, Homo Sapiens
CQHNTEWAH

SEQ ID NO: 903356 - protein, 9 aa, Homo Sapiens
IADLPDTTV

SEQ ID NO: 903357 - protein, 9 aa, Homo Sapiens
SAVCVHQLP

SEQ ID NO: 903358 - protein, 9 aa, Homo Sapiens
FLRDLRDAS

SEQ ID NO: 903359 - protein, 9 aa, Homo Sapiens
KYQELKSIC

SEQ ID NO: 903360 - protein, 9 aa, Homo Sapiens
WQQWALVEF

SEQ ID NO: 903361 - protein, 9 aa, Homo Sapiens
WDSQRPRLP

SEQ ID NO: 903362 - protein, 9 aa, Homo Sapiens
DLTRETTRR

SEQ ID NO: 903363 - protein, 9 aa, Homo Sapiens
YRSRSWSRS

SEQ ID NO: 903364 - protein, 9 aa, Homo Sapiens
SQNADVTYS

SEQ ID NO: 903365 - protein, 9 aa, Homo Sapiens
VGACGVGKS

SEQ ID NO: 903366 - protein, 9 aa, Homo Sapiens
NQENFQLLQ

SEQ ID NO: 903367 - protein, 9 aa, Homo Sapiens
CPWQQWALV

SEQ ID NO: 903368 - protein, 9 aa, Homo Sapiens
QHPALAAPL

SEQ ID NO: 903369 - protein, 9 aa, Homo Sapiens
GTPTRTARS

SEQ ID NO: 903370 - protein, 9 aa, Homo Sapiens
EGRPRGQAD

SEQ ID NO: 903371 - protein, 9 aa, Homo Sapiens
VTAFDVGSD

SEQ ID NO: 903372 - protein, 9 aa, Homo Sapiens
ICMAQISFY

SEQ ID NO: 903373 - protein, 9 aa, Homo Sapiens
GQPNGGAEQ

SEQ ID NO: 903374 - protein, 9 aa, Homo Sapiens
WASAPPQDP

SEQ ID NO: 903375 - protein, 9 aa, Homo Sapiens
GCLSPSSSS

SEQ ID NO: 903376 - protein, 9 aa, Homo Sapiens
ICMMENGIK

SEQ ID NO: 903377 - protein, 9 aa, Homo Sapiens
GSALDDVVN

SEQ ID NO: 903378 - protein, 9 aa, Homo Sapiens
LLGGLEGSG

SEQ ID NO: 903379 - protein, 9 aa, Homo Sapiens
TYTVITPFL

SEQ ID NO: 903380 - protein, 9 aa, Homo Sapiens
LLYKAIKAS

SEQ ID NO: 903381 - protein, 9 aa, Homo Sapiens
RYAVEILIW

SEQ ID NO: 903382 - protein, 9 aa, Homo Sapiens
IPQIPRLSL

SEQ ID NO: 903383 - protein, 9 aa, Homo Sapiens
GCKEVENAL

SEQ ID NO: 903384 - protein, 9 aa, Homo Sapiens
SVTRIMAGS

SEQ ID NO: 903385 - protein, 9 aa, Homo Sapiens
YRWVIHAGN

SEQ ID NO: 903386 - protein, 9 aa, Homo Sapiens
NVQYVPRDV

SEQ ID NO: 903387 - protein, 9 aa, Homo Sapiens
DVNVHGPDG

SEQ ID NO: 903388 - protein, 9 aa, Homo Sapiens
NNCLTLFRY

SEQ ID NO: 903389 - protein, 9 aa, Homo Sapiens
VPHSSLLKE

SEQ ID NO: 903390 - protein, 9 aa, Homo Sapiens
DTIADLPDT

SEQ ID NO: 903391 - protein, 9 aa, Homo Sapiens
CHNNSRCVN

SEQ ID NO: 903392 - protein, 9 aa, Homo Sapiens
GSPQYLYVC

SEQ ID NO: 903393 - protein, 9 aa, Homo Sapiens
RTSGRELSY

SEQ ID NO: 903394 - protein, 9 aa, Homo Sapiens
HWSRRPVFL

SEQ ID NO: 903395 - protein, 9 aa, Homo Sapiens
YLLDDPNSE

SEQ ID NO: 903396 - protein, 9 aa, Homo Sapiens
QKFIIHSKI

SEQ ID NO: 903397 - protein, 9 aa, Homo Sapiens
CDQAQRSCW

SEQ ID NO: 903398 - protein, 9 aa, Homo Sapiens
LLQEGSLSS

SEQ ID NO: 903399 - protein, 9 aa, Homo Sapiens
GIGDEIKDP

SEQ ID NO: 903400 - protein, 9 aa, Homo Sapiens
AKWRSAAPL

SEQ ID NO: 903401 - protein, 9 aa, Homo Sapiens
PIVRTSGRE

SEQ ID NO: 903402 - protein, 9 aa, Homo Sapiens
LRDLRDASL

SEQ ID NO: 903403 - protein, 9 aa, Homo Sapiens
CRQQGSPQY

SEQ ID NO: 903404 - protein, 9 aa, Homo Sapiens
MILNKKIAL

SEQ ID NO: 903405 - protein, 9 aa, Homo Sapiens
EFDKLCEFL

SEQ ID NO: 903406 - protein, 9 aa, Homo Sapiens
GSFSDTGLV

SEQ ID NO: 903407 - protein, 9 aa, Homo Sapiens
AGHLHIPAH

SEQ ID NO: 903408 - protein, 9 aa, Homo Sapiens
EKRVLNETQ

SEQ ID NO: 903409 - protein, 9 aa, Homo Sapiens
GLFLVPNGI

SEQ ID NO: 903410 - protein, 9 aa, Homo Sapiens
YEDSFSQPR

SEQ ID NO: 903411 - protein, 9 aa, Homo Sapiens
GGGIGDEIK

SEQ ID NO: 903412 - protein, 9 aa, Homo Sapiens
PRWASAPPQ

SEQ ID NO: 903413 - protein, 9 aa, Homo Sapiens
GLTAVPAVP

SEQ ID NO: 903414 - protein, 9 aa, Homo Sapiens
FYHAKTGRT

SEQ ID NO: 903415 - protein, 9 aa, Homo Sapiens
EMLSLDTSA

SEQ ID NO: 903416 - protein, 9 aa, Homo Sapiens
PTSAFPTVT

SEQ ID NO: 903417 - protein, 9 aa, Homo Sapiens
KQWHSQCLL

SEQ ID NO: 903418 - protein, 9 aa, Homo Sapiens
RLFRELFTA

SEQ ID NO: 903419 - protein, 9 aa, Homo Sapiens
SLLKECHKC

SEQ ID NO: 903420 - protein, 9 aa, Homo Sapiens
TPRHPLKTP

SEQ ID NO: 903421 - protein, 9 aa, Homo Sapiens
SSQGRPPYT

SEQ ID NO: 903422 - protein, 9 aa, Homo Sapiens
SICSYRAQA

SEQ ID NO: 903423 - protein, 9 aa, Homo Sapiens
EPTPLLQEG

SEQ ID NO: 903424 - protein, 9 aa, Homo Sapiens
PTGLSDGAN

SEQ ID NO: 903425 - protein, 9 aa, Homo Sapiens
PPGPDGQPG

SEQ ID NO: 903426 - protein, 9 aa, Homo Sapiens
SGLTAVPAV

SEQ ID NO: 903427 - protein, 9 aa, Homo Sapiens
AENSKLETE

SEQ ID NO: 903428 - protein, 9 aa, Homo Sapiens
LVDGKMKSD

SEQ ID NO: 903429 - protein, 9 aa, Homo Sapiens
RSASFLYQV

SEQ ID NO: 903430 - protein, 9 aa, Homo Sapiens
LTRETTRRW

SEQ ID NO: 903431 - protein, 9 aa, Homo Sapiens
KSICSYRAQ

SEQ ID NO: 903432 - protein, 9 aa, Homo Sapiens
CLLQAQDPL

SEQ ID NO: 903433 - protein, 9 aa, Homo Sapiens
NSFHIKTKS

SEQ ID NO: 903434 - protein, 9 aa, Homo Sapiens
PYLLDDPNS

SEQ ID NO: 903435 - protein, 9 aa, Homo Sapiens
QQVQTQQII

SEQ ID NO: 903436 - protein, 9 aa, Homo Sapiens
RQQLEFAHQ

SEQ ID NO: 903437 - protein, 9 aa, Homo Sapiens
TDFICMAQI

SEQ ID NO: 903438 - protein, 9 aa, Homo Sapiens
LVARACLSD

SEQ ID NO: 903439 - protein, 9 aa, Homo Sapiens
VACLQPLPS

SEQ ID NO: 903440 - protein, 9 aa, Homo Sapiens
AIQEACART

SEQ ID NO: 903441 - protein, 9 aa, Homo Sapiens
WHSQCLLQA

SEQ ID NO: 903442 - protein, 9 aa, Homo Sapiens
DRVELVFPN

SEQ ID NO: 903443 - protein, 9 aa, Homo Sapiens
KAEMAQLKI

SEQ ID NO: 903444 - protein, 9 aa, Homo Sapiens
KPSPGPGPE

SEQ ID NO: 903445 - protein, 9 aa, Homo Sapiens
GRSASFLYQ

SEQ ID NO: 903446 - protein, 9 aa, Homo Sapiens
GGACGGYCP

SEQ ID NO: 903447 - protein, 9 aa, Homo Sapiens
TPRPQDHDT

SEQ ID NO: 903448 - protein, 9 aa, Homo Sapiens
SIPITPPGQ

SEQ ID NO: 903449 - protein, 9 aa, Homo Sapiens
RESREAVVI

SEQ ID NO: 903450 - protein, 9 aa, Homo Sapiens
YKAIKASIK

SEQ ID NO: 903451 - protein, 9 aa, Homo Sapiens
LLVRLFREL

SEQ ID NO: 903452 - protein, 9 aa, Homo Sapiens
QVATVVDQT

SEQ ID NO: 903453 - protein, 9 aa, Homo Sapiens
PEKQWHSQC

SEQ ID NO: 903454 - protein, 9 aa, Homo Sapiens
GGKHSEQHP

SEQ ID NO: 903455 - protein, 9 aa, Homo Sapiens
GVNCDVDVS

SEQ ID NO: 903456 - protein, 9 aa, Homo Sapiens
RVLNETQQS

SEQ ID NO: 903457 - protein, 9 aa, Homo Sapiens
KPGDRVELV

SEQ ID NO: 903458 - protein, 9 aa, Homo Sapiens
ILKAEMAQL

SEQ ID NO: 903459 - protein, 9 aa, Homo Sapiens
RTGGRIAVP

SEQ ID NO: 903460 - protein, 9 aa, Homo Sapiens
CEFLRVEEQ

SEQ ID NO: 903461 - protein, 9 aa, Homo Sapiens
EPEGMSNAS

SEQ ID NO: 903462 - protein, 9 aa, Homo Sapiens
LYKAIKASI

SEQ ID NO: 903463 - protein, 9 aa, Homo Sapiens
VAEAIPQIP

SEQ ID NO: 903464 - protein, 9 aa, Homo Sapiens
AKVNGRIYL

SEQ ID NO: 903465 - protein, 9 aa, Homo Sapiens
NQDGMSTLH

SEQ ID NO: 903466 - protein, 9 aa, Homo Sapiens
HAKTGRTST

SEQ ID NO: 903467 - protein, 9 aa, Homo Sapiens
GSSLDWNRA

SEQ ID NO: 903468 - protein, 9 aa, Homo Sapiens
LFELSHRIK

SEQ ID NO: 903469 - protein, 9 aa, Homo Sapiens
PQKQLCLLP

SEQ ID NO: 903470 - protein, 9 aa, Homo Sapiens
QACRRAHGE

SEQ ID NO: 903471 - protein, 9 aa, Homo Sapiens
SHLPRVVSP

SEQ ID NO: 903472 - protein, 9 aa, Homo Sapiens
KLLSMEIEK

SEQ ID NO: 903473 - protein, 9 aa, Homo Sapiens
VHWSRRPVF

SEQ ID NO: 903474 - protein, 9 aa, Homo Sapiens
QGNGEAKLD

SEQ ID NO: 903475 - protein, 9 aa, Homo Sapiens
HHLGFLSAS

SEQ ID NO: 903476 - protein, 9 aa, Homo Sapiens
LLVARACLS

SEQ ID NO: 903477 - protein, 9 aa, Homo Sapiens
DTTVVTTST

SEQ ID NO: 903478 - protein, 9 aa, Homo Sapiens
NIIVTPKSQ

SEQ ID NO: 903479 - protein, 9 aa, Homo Sapiens
LAENDVMLL

SEQ ID NO: 903480 - protein, 9 aa, Homo Sapiens
ASRKLDVVA

SEQ ID NO: 903481 - protein, 9 aa, Homo Sapiens
ASEDGCCIR

SEQ ID NO: 903482 - protein, 9 aa, Homo Sapiens
NNKYVASSY

SEQ ID NO: 903483 - protein, 9 aa, Homo Sapiens
MADGEPSAK

SEQ ID NO: 903484 - protein, 9 aa, Homo Sapiens
HVAEAIPQI

SEQ ID NO: 903485 - protein, 9 aa, Homo Sapiens
LSDEETSIL

SEQ ID NO: 903486 - protein, 9 aa, Homo Sapiens
PGPPGPDGQ

SEQ ID NO: 903487 - protein, 9 aa, Homo Sapiens
PIGTRRKHL

SEQ ID NO: 903488 - protein, 9 aa, Homo Sapiens
DRLIRHKAC

SEQ ID NO: 903489 - protein, 9 aa, Homo Sapiens
CKGALKEVS

SEQ ID NO: 903490 - protein, 9 aa, Homo Sapiens
YRTQDRYEF

SEQ ID NO: 903491 - protein, 9 aa, Homo Sapiens
ILTPSPTSA

SEQ ID NO: 903492 - protein, 9 aa, Homo Sapiens
WLRRKWMEK

SEQ ID NO: 903493 - protein, 9 aa, Homo Sapiens
SVLKYIFRL

SEQ ID NO: 903494 - protein, 9 aa, Homo Sapiens
TEWAHCERC

SEQ ID NO: 903495 - protein, 9 aa, Homo Sapiens
SDPVLEASS

SEQ ID NO: 903496 - protein, 9 aa, Homo Sapiens
PVKMLGPEH

SEQ ID NO: 903497 - protein, 9 aa, Homo Sapiens
RNNCLTLFR

SEQ ID NO: 903498 - protein, 9 aa, Homo Sapiens
EHMADGEPS

SEQ ID NO: 903499 - protein, 9 aa, Homo Sapiens
DIKERMKEK

SEQ ID NO: 903500 - protein, 9 aa, Homo Sapiens
ESGNKAWSE

SEQ ID NO: 903501 - protein, 9 aa, Homo Sapiens
GGIGDEIKD

SEQ ID NO: 903502 - protein, 9 aa, Homo Sapiens
PGSAVCVHQ

SEQ ID NO: 903503 - protein, 9 aa, Homo Sapiens
EGIIECHNN

SEQ ID NO: 903504 - protein, 9 aa, Homo Sapiens
KLPNRAYTP

SEQ ID NO: 903505 - protein, 9 aa, Homo Sapiens
AAENSKLET

SEQ ID NO: 903506 - protein, 9 aa, Homo Sapiens
RRNRRRRKS

SEQ ID NO: 903507 - protein, 9 aa, Homo Sapiens
ILVLLCVRQ

SEQ ID NO: 903508 - protein, 9 aa, Homo Sapiens
LNVLYDPDL

SEQ ID NO: 903509 - protein, 9 aa, Homo Sapiens
TLHFATQSN

SEQ ID NO: 903510 - protein, 9 aa, Homo Sapiens
GSDKTRIGL

SEQ ID NO: 903511 - protein, 9 aa, Homo Sapiens
SNSSGCLSP

SEQ ID NO: 903512 - protein, 9 aa, Homo Sapiens
AGRSGRSAS

SEQ ID NO: 903513 - protein, 9 aa, Homo Sapiens
VQVQGQQVQ

SEQ ID NO: 903514 - protein, 9 aa, Homo Sapiens
FLSSSSLCL

SEQ ID NO: 903515 - protein, 9 aa, Homo Sapiens
GMSNASAEE

SEQ ID NO: 903516 - protein, 9 aa, Homo Sapiens
SSGCLSPSS

SEQ ID NO: 903517 - protein, 9 aa, Homo Sapiens
SGCLSPSSS

SEQ ID NO: 903518 - protein, 9 aa, Homo Sapiens
PRGQADPTI

SEQ ID NO: 903519 - protein, 9 aa, Homo Sapiens
HCQRDSSCG

SEQ ID NO: 903520 - protein, 9 aa, Homo Sapiens
TNSFHIKTK

SEQ ID NO: 903521 - protein, 9 aa, Homo Sapiens
CGVGKSALT

SEQ ID NO: 903522 - protein, 9 aa, Homo Sapiens
TQVKLESLE

SEQ ID NO: 903523 - protein, 9 aa, Homo Sapiens
ACLSDLQKG

SEQ ID NO: 903524 - protein, 9 aa, Homo Sapiens
LFEVQWQLA

SEQ ID NO: 903525 - protein, 9 aa, Homo Sapiens
KLGSSLDWN

SEQ ID NO: 903526 - protein, 9 aa, Homo Sapiens
RTARSPLRS

SEQ ID NO: 903527 - protein, 9 aa, Homo Sapiens
SYSMAPRPC

SEQ ID NO: 903528 - protein, 9 aa, Homo Sapiens
EIIAIKEVY

SEQ ID NO: 903529 - protein, 9 aa, Homo Sapiens
MVQKAKWRS

SEQ ID NO: 903530 - protein, 9 aa, Homo Sapiens
SNIHRNRIA

SEQ ID NO: 903531 - protein, 9 aa, Homo Sapiens
VVCFIVARK

SEQ ID NO: 903532 - protein, 9 aa, Homo Sapiens
YRVAGCPNP

SEQ ID NO: 903533 - protein, 9 aa, Homo Sapiens
IAIKEVYQR

SEQ ID NO: 903534 - protein, 9 aa, Homo Sapiens
KIALEHGIP

SEQ ID NO: 903535 - protein, 9 aa, Homo Sapiens
NNSRCVNLP

SEQ ID NO: 903536 - protein, 9 aa, Homo Sapiens
NICGYRTQD

SEQ ID NO: 903537 - protein, 9 aa, Homo Sapiens
MNRRPFLTI

SEQ ID NO: 903538 - protein, 9 aa, Homo Sapiens
VNADRCTKC

SEQ ID NO: 903539 - protein, 9 aa, Homo Sapiens
SDDWHTYHN

SEQ ID NO: 903540 - protein, 9 aa, Homo Sapiens
VATQVATVV

SEQ ID NO: 903541 - protein, 9 aa, Homo Sapiens
LRDVLQFVG

SEQ ID NO: 903542 - protein, 9 aa, Homo Sapiens
RRRRKSQRN

SEQ ID NO: 903543 - protein, 9 aa, Homo Sapiens
SSDDWHTYH

SEQ ID NO: 903544 - protein, 9 aa, Homo Sapiens
EGFESASLG

SEQ ID NO: 903545 - protein, 9 aa, Homo Sapiens
NSKLETEIQ

SEQ ID NO: 903546 - protein, 9 aa, Homo Sapiens
TETHRVPVS

SEQ ID NO: 903547 - protein, 9 aa, Homo Sapiens
EDGCCIREI

SEQ ID NO: 903548 - protein, 9 aa, Homo Sapiens
GALPCQLVV

SEQ ID NO: 903549 - protein, 9 aa, Homo Sapiens
ASIKCKPPL

SEQ ID NO: 903550 - protein, 9 aa, Homo Sapiens
SALMMAIFP

SEQ ID NO: 903551 - protein, 9 aa, Homo Sapiens
SPCPPTLSP

SEQ ID NO: 903552 - protein, 9 aa, Homo Sapiens
IVYLKLFPL

SEQ ID NO: 903553 - protein, 9 aa, Homo Sapiens
DDHYRVAGC

SEQ ID NO: 903554 - protein, 9 aa, Homo Sapiens
GVFVDCCKT

SEQ ID NO: 903555 - protein, 9 aa, Homo Sapiens
TQDRYEFSS

SEQ ID NO: 903556 - protein, 9 aa, Homo Sapiens
VFQMGVIFQ

SEQ ID NO: 903557 - protein, 9 aa, Homo Sapiens
LPTLCCYTC

SEQ ID NO: 903558 - protein, 9 aa, Homo Sapiens
AVQVQGQQV

SEQ ID NO: 903559 - protein, 9 aa, Homo Sapiens
LVPNGIYDP

SEQ ID NO: 903560 - protein, 9 aa, Homo Sapiens
IWASEDGCC

SEQ ID NO: 903561 - protein, 9 aa, Homo Sapiens
KLCFCFTGV

SEQ ID NO: 903562 - protein, 9 aa, Homo Sapiens
RQEFDKLCE

SEQ ID NO: 903563 - protein, 9 aa, Homo Sapiens
QAIAGALAA

SEQ ID NO: 903564 - protein, 9 aa, Homo Sapiens
RRAHGEGLP

SEQ ID NO: 903565 - protein, 9 aa, Homo Sapiens
RVVSPKKHS

SEQ ID NO: 903566 - protein, 9 aa, Homo Sapiens
FFMFCFLSG

SEQ ID NO: 903567 - protein, 9 aa, Homo Sapiens
GRPNSGSRD

SEQ ID NO: 903568 - protein, 9 aa, Homo Sapiens
IAGALAAPS

SEQ ID NO: 903569 - protein, 9 aa, Homo Sapiens
TAFDMDILG

SEQ ID NO: 903570 - protein, 9 aa, Homo Sapiens
LAANSQDEA

SEQ ID NO: 903571 - protein, 9 aa, Homo Sapiens
YVASSYLSL

SEQ ID NO: 903572 - protein, 9 aa, Homo Sapiens
PGDRLIRHK

SEQ ID NO: 903573 - protein, 9 aa, Homo Sapiens
HSILKGLQQ

SEQ ID NO: 903574 - protein, 9 aa, Homo Sapiens
FESASLGAE

SEQ ID NO: 903575 - protein, 9 aa, Homo Sapiens
GLLGGLEGS

SEQ ID NO: 903576 - protein, 9 aa, Homo Sapiens
FEEQRDELS

SEQ ID NO: 903577 - protein, 9 aa, Homo Sapiens
FHCQRDSSC

SEQ ID NO: 903578 - protein, 9 aa, Homo Sapiens
VFLALAVLV

SEQ ID NO: 903579 - protein, 9 aa, Homo Sapiens
MAGPGCGPP

SEQ ID NO: 903580 - protein, 9 aa, Homo Sapiens
SREAVVIDP

SEQ ID NO: 903581 - protein, 9 aa, Homo Sapiens
HIPAHRLVL

SEQ ID NO: 903582 - protein, 9 aa, Homo Sapiens
VESMQTELN

SEQ ID NO: 903583 - protein, 9 aa, Homo Sapiens
YDSGKEELF

SEQ ID NO: 903584 - protein, 9 aa, Homo Sapiens
QELWQRLLP

SEQ ID NO: 903585 - protein, 9 aa, Homo Sapiens
QCLLQAQDP

SEQ ID NO: 903586 - protein, 9 aa, Homo Sapiens
PGPDGQPGV

SEQ ID NO: 903587 - protein, 9 aa, Homo Sapiens
VGRGTDSNI

SEQ ID NO: 903588 - protein, 9 aa, Homo Sapiens
FSLAANSQD

SEQ ID NO: 903589 - protein, 9 aa, Homo Sapiens
LEEKRVLNE

SEQ ID NO: 903590 - protein, 9 aa, Homo Sapiens
MSTLHFATQ

SEQ ID NO: 903591 - protein, 9 aa, Homo Sapiens
INEEGQKRC

SEQ ID NO: 903592 - protein, 9 aa, Homo Sapiens
FKDEERTQV

SEQ ID NO: 903593 - protein, 9 aa, Homo Sapiens
DEETSILES

SEQ ID NO: 903594 - protein, 9 aa, Homo Sapiens
HGPDGFTPL

SEQ ID NO: 903595 - protein, 9 aa, Homo Sapiens
AAFAFFMFC

SEQ ID NO: 903596 - protein, 9 aa, Homo Sapiens
HPDGCAKMS

SEQ ID NO: 903597 - protein, 9 aa, Homo Sapiens
SSLCLFTLA

SEQ ID NO: 903598 - protein, 9 aa, Homo Sapiens
LLRHVLSIN

SEQ ID NO: 903599 - protein, 9 aa, Homo Sapiens
TKDFSLAAN

SEQ ID NO: 903600 - protein, 9 aa, Homo Sapiens
GSAVCVHQL

SEQ ID NO: 903601 - protein, 9 aa, Homo Sapiens
CAKMSDHRE

SEQ ID NO: 903602 - protein, 9 aa, Homo Sapiens
NKYQELKSI

SEQ ID NO: 903603 - protein, 9 aa, Homo Sapiens
EWDMKINCS

SEQ ID NO: 903604 - protein, 9 aa, Homo Sapiens
FALLGAMTV

SEQ ID NO: 903605 - protein, 9 aa, Homo Sapiens
DWNRACFTM

SEQ ID NO: 903606 - protein, 9 aa, Homo Sapiens
ASSNSSGCL

SEQ ID NO: 903607 - protein, 9 aa, Homo Sapiens
MNVDGDWTP

SEQ ID NO: 903608 - protein, 9 aa, Homo Sapiens
VNVHGPDGF

SEQ ID NO: 903609 - protein, 9 aa, Homo Sapiens
HSHLPRVVS

SEQ ID NO: 903610 - protein, 9 aa, Homo Sapiens
RTYYCRTGK

SEQ ID NO: 903611 - protein, 9 aa, Homo Sapiens
EGSGGLPLN

SEQ ID NO: 903612 - protein, 9 aa, Homo Sapiens
IQCDVDTIY

SEQ ID NO: 903613 - protein, 9 aa, Homo Sapiens
HLGFLSASV

SEQ ID NO: 903614 - protein, 9 aa, Homo Sapiens
VEELQDWVL

SEQ ID NO: 903615 - protein, 9 aa, Homo Sapiens
LSASVANTI

SEQ ID NO: 903616 - protein, 9 aa, Homo Sapiens
GIYFPSVTR

SEQ ID NO: 903617 - protein, 9 aa, Homo Sapiens
FELSHRIKP

SEQ ID NO: 903618 - protein, 9 aa, Homo Sapiens
VQWQLAQLE

SEQ ID NO: 903619 - protein, 9 aa, Homo Sapiens
IFKDEERTQ

SEQ ID NO: 903620 - protein, 9 aa, Homo Sapiens
RSCWCVMDS

SEQ ID NO: 903621 - protein, 9 aa, Homo Sapiens
IQGERDYYG

SEQ ID NO: 903622 - protein, 9 aa, Homo Sapiens
QVPHSSLLK

SEQ ID NO: 903623 - protein, 9 aa, Homo Sapiens
DGQPGVDGA

SEQ ID NO: 903624 - protein, 9 aa, Homo Sapiens
DTQPVGVFV

SEQ ID NO: 903625 - protein, 9 aa, Homo Sapiens
VRLPFHTEN

SEQ ID NO: 903626 - protein, 9 aa, Homo Sapiens
DVFVACLQP

SEQ ID NO: 903627 - protein, 9 aa, Homo Sapiens
LFALGLTLG

SEQ ID NO: 903628 - protein, 9 aa, Homo Sapiens
SGEQCTVEP

SEQ ID NO: 903629 - protein, 9 aa, Homo Sapiens
FALGLTLGT

SEQ ID NO: 903630 - protein, 9 aa, Homo Sapiens
PSVTRIMAG

SEQ ID NO: 903631 - protein, 9 aa, Homo Sapiens
LRQEPPKTR

SEQ ID NO: 903632 - protein, 9 aa, Homo Sapiens
QTSVYFCPS

SEQ ID NO: 903633 - protein, 9 aa, Homo Sapiens
RQKLFIPQI

SEQ ID NO: 903634 - protein, 9 aa, Homo Sapiens
LLSQELWQR

SEQ ID NO: 903635 - protein, 9 aa, Homo Sapiens
AAILVLLCV

SEQ ID NO: 903636 - protein, 9 aa, Homo Sapiens
GAMTVDRYV

SEQ ID NO: 903637 - protein, 9 aa, Homo Sapiens
KGALKEVSK

SEQ ID NO: 903638 - protein, 9 aa, Homo Sapiens
VKMLGPEHG

SEQ ID NO: 903639 - protein, 9 aa, Homo Sapiens
RAYTPEISA

SEQ ID NO: 903640 - protein, 9 aa, Homo Sapiens
SILLKLKRN

SEQ ID NO: 903641 - protein, 9 aa, Homo Sapiens
AYDSGKEEL

SEQ ID NO: 903642 - protein, 9 aa, Homo Sapiens
LSPQKQLCL

SEQ ID NO: 903643 - protein, 9 aa, Homo Sapiens
GKAPGVVGN

SEQ ID NO: 903644 - protein, 9 aa, Homo Sapiens
SEQHPALAA

SEQ ID NO: 903645 - protein, 9 aa, Homo Sapiens
VTLNVLYDP

SEQ ID NO: 903646 - protein, 9 aa, Homo Sapiens
VGSFHCQRD

SEQ ID NO: 903647 - protein, 9 aa, Homo Sapiens
APKASQPPK

SEQ ID NO: 903648 - protein, 9 aa, Homo Sapiens
ESMQTELNY

SEQ ID NO: 903649 - protein, 9 aa, Homo Sapiens
SLSPQKQLC

SEQ ID NO: 903650 - protein, 9 aa, Homo Sapiens
ERPVKMLGP

SEQ ID NO: 903651 - protein, 9 aa, Homo Sapiens
TVEPDLISK

SEQ ID NO: 903652 - protein, 9 aa, Homo Sapiens
NGLCIWLLI

SEQ ID NO: 903653 - protein, 9 aa, Homo Sapiens
AEAIPQIPR

SEQ ID NO: 903654 - protein, 9 aa, Homo Sapiens
GPGCGPPRL

SEQ ID NO: 903655 - protein, 9 aa, Homo Sapiens
GLVDGKMKS

SEQ ID NO: 903656 - protein, 9 aa, Homo Sapiens
GCCIREIPD

SEQ ID NO: 903657 - protein, 9 aa, Homo Sapiens
SCRQQGSPQ

SEQ ID NO: 903658 - protein, 9 aa, Homo Sapiens
GTTPKQGGS

SEQ ID NO: 903659 - protein, 9 aa, Homo Sapiens
QWQLAQLEA

SEQ ID NO: 903660 - protein, 9 aa, Homo Sapiens
PMLTLEEQL

SEQ ID NO: 903661 - protein, 9 aa, Homo Sapiens
PNPRGKGSA

SEQ ID NO: 903662 - protein, 9 aa, Homo Sapiens
CSFQRRWRR

SEQ ID NO: 903663 - protein, 9 aa, Homo Sapiens
WAHCERCQA

SEQ ID NO: 903664 - protein, 9 aa, Homo Sapiens
HRPGKIPHQ

SEQ ID NO: 903665 - protein, 9 aa, Homo Sapiens
PITPPGQDH

SEQ ID NO: 903666 - protein, 9 aa, Homo Sapiens
WQLAQLEAR

SEQ ID NO: 903667 - protein, 9 aa, Homo Sapiens
AVCVHQLPP

SEQ ID NO: 903668 - protein, 9 aa, Homo Sapiens
RQRHLLLCQ

SEQ ID NO: 903669 - protein, 9 aa, Homo Sapiens
AFVATQVAT

SEQ ID NO: 903670 - protein, 9 aa, Homo Sapiens
TRETTRRWK

SEQ ID NO: 903671 - protein, 9 aa, Homo Sapiens
NSLLDNLAF

SEQ ID NO: 903672 - protein, 9 aa, Homo Sapiens
NSPSSIPIT

SEQ ID NO: 903673 - protein, 9 aa, Homo Sapiens
AGLAVIDWA

SEQ ID NO: 903674 - protein, 9 aa, Homo Sapiens
LPFDDIVGK

SEQ ID NO: 903675 - protein, 9 aa, Homo Sapiens
TRSQHLSPA

SEQ ID NO: 903676 - protein, 9 aa, Homo Sapiens
LCEFLRVEE

SEQ ID NO: 903677 - protein, 9 aa, Homo Sapiens
ANNVVCFIV

SEQ ID NO: 903678 - protein, 9 aa, Homo Sapiens
SYQLSLDEK

SEQ ID NO: 903679 - protein, 9 aa, Homo Sapiens
AIKASIKCK

SEQ ID NO: 903680 - protein, 9 aa, Homo Sapiens
RAQLRQRHL

SEQ ID NO: 903681 - protein, 9 aa, Homo Sapiens
AQLRQRHLL

SEQ ID NO: 903682 - protein, 9 aa, Homo Sapiens
CVQTAHSIL

SEQ ID NO: 903683 - protein, 9 aa, Homo Sapiens
NSSGCLSPS

SEQ ID NO: 903684 - protein, 9 aa, Homo Sapiens
ICFEEQRDE

SEQ ID NO: 903685 - protein, 9 aa, Homo Sapiens
YWKLCFCFT

SEQ ID NO: 903686 - protein, 9 aa, Homo Sapiens
GLEGSGGLP

SEQ ID NO: 903687 - protein, 9 aa, Homo Sapiens
IKERMKEKR

SEQ ID NO: 903688 - protein, 9 aa, Homo Sapiens
KKIALEHGI

SEQ ID NO: 903689 - protein, 9 aa, Homo Sapiens
DESQNADVT

SEQ ID NO: 903690 - protein, 9 aa, Homo Sapiens
TKLPNRAYT

SEQ ID NO: 903691 - protein, 9 aa, Homo Sapiens
ELNYLRRNL

SEQ ID NO: 903692 - protein, 9 aa, Homo Sapiens
LLKPGDRVE

SEQ ID NO: 903693 - protein, 9 aa, Homo Sapiens
RRWRRQVSG

SEQ ID NO: 903694 - protein, 9 aa, Homo Sapiens
PVLEASSLP

SEQ ID NO: 903695 - protein, 9 aa, Homo Sapiens
ALMMAIFPR

SEQ ID NO: 903696 - protein, 9 aa, Homo Sapiens
MKRHNQSCV

SEQ ID NO: 903697 - protein, 9 aa, Homo Sapiens
MTVDRYVAV

SEQ ID NO: 903698 - protein, 9 aa, Homo Sapiens
ETEGFKIDA

SEQ ID NO: 903699 - protein, 9 aa, Homo Sapiens
GVQSEGIWE

SEQ ID NO: 903700 - protein, 9 aa, Homo Sapiens
YEVCKGALK

SEQ ID NO: 903701 - protein, 9 aa, Homo Sapiens
PPTLSPPPS

SEQ ID NO: 903702 - protein, 9 aa, Homo Sapiens
VNGRIYLII

SEQ ID NO: 903703 - protein, 9 aa, Homo Sapiens
LKYIFRLTI

SEQ ID NO: 903704 - protein, 9 aa, Homo Sapiens
KQLRDVLQF

SEQ ID NO: 903705 - protein, 9 aa, Homo Sapiens
AMGTYHGMT

SEQ ID NO: 903706 - protein, 9 aa, Homo Sapiens
QLGQGNGEA

SEQ ID NO: 903707 - protein, 9 aa, Homo Sapiens
TPTRTARSP

SEQ ID NO: 903708 - protein, 9 aa, Homo Sapiens
AFDMDILGS

SEQ ID NO: 903709 - protein, 9 aa, Homo Sapiens
LLIRSLVVG

SEQ ID NO: 903710 - protein, 9 aa, Homo Sapiens
GRGTDSNIF

SEQ ID NO: 903711 - protein, 9 aa, Homo Sapiens
LLSMEIEKE

SEQ ID NO: 903712 - protein, 9 aa, Homo Sapiens
CCRICFEEQ

SEQ ID NO: 903713 - protein, 9 aa, Homo Sapiens
EEHMADGEP

SEQ ID NO: 903714 - protein, 9 aa, Homo Sapiens
AGSAGSDRV

SEQ ID NO: 903715 - protein, 9 aa, Homo Sapiens
IGDEIKDPA

SEQ ID NO: 903716 - protein, 9 aa, Homo Sapiens
RKWMEKMAE

SEQ ID NO: 903717 - protein, 9 aa, Homo Sapiens
ESSNIHRNR

SEQ ID NO: 903718 - protein, 9 aa, Homo Sapiens
QSYRSRSWS

SEQ ID NO: 903719 - protein, 9 aa, Homo Sapiens
GSGGVRAPG

SEQ ID NO: 903720 - protein, 9 aa, Homo Sapiens
RWVIHAGNK

SEQ ID NO: 903721 - protein, 9 aa, Homo Sapiens
DAMGTYHGM

SEQ ID NO: 903722 - protein, 9 aa, Homo Sapiens
GRRRSGEAE

SEQ ID NO: 903723 - protein, 9 aa, Homo Sapiens
RRPFLTIIT

SEQ ID NO: 903724 - protein, 9 aa, Homo Sapiens
LETETHRVP

SEQ ID NO: 903725 - protein, 9 aa, Homo Sapiens
EQMILNKKI

SEQ ID NO: 903726 - protein, 9 aa, Homo Sapiens
RHLLLCQSG

SEQ ID NO: 903727 - protein, 9 aa, Homo Sapiens
PRHPLKTPA

SEQ ID NO: 903728 - protein, 9 aa, Homo Sapiens
REEIQCDVD

SEQ ID NO: 903729 - protein, 9 aa, Homo Sapiens
PVALNVQYV

SEQ ID NO: 903730 - protein, 9 aa, Homo Sapiens
LEMLSLDTS

SEQ ID NO: 903731 - protein, 9 aa, Homo Sapiens
HLGSHERPV

SEQ ID NO: 903732 - protein, 9 aa, Homo Sapiens
PKYEVCKGA

SEQ ID NO: 903733 - protein, 9 aa, Homo Sapiens
AHSILKGLQ

SEQ ID NO: 903734 - protein, 9 aa, Homo Sapiens
MWLHLERLQ

SEQ ID NO: 903735 - protein, 9 aa, Homo Sapiens
ALNVQYVPR

SEQ ID NO: 903736 - protein, 9 aa, Homo Sapiens
VNCDVDVSF

SEQ ID NO: 903737 - protein, 9 aa, Homo Sapiens
RTQVKLESL

SEQ ID NO: 903738 - protein, 9 aa, Homo Sapiens
EGFKIDAMG

SEQ ID NO: 903739 - protein, 9 aa, Homo Sapiens
PYTTGPGAN

SEQ ID NO: 903740 - protein, 9 aa, Homo Sapiens
REFVQRVKD

SEQ ID NO: 903741 - protein, 9 aa, Homo Sapiens
PILTDLTRE

SEQ ID NO: 903742 - protein, 9 aa, Homo Sapiens
SGRSASFLY

SEQ ID NO: 903743 - protein, 9 aa, Homo Sapiens
VVIDPVLET

SEQ ID NO: 903744 - protein, 9 aa, Homo Sapiens
YITTKLPNR

SEQ ID NO: 903745 - protein, 9 aa, Homo Sapiens
ETHRVPVSW

SEQ ID NO: 903746 - protein, 9 aa, Homo Sapiens
DQAQRSCWC

SEQ ID NO: 903747 - protein, 9 aa, Homo Sapiens
AVKDICGKG

SEQ ID NO: 903748 - protein, 9 aa, Homo Sapiens
VLEASSLPP

SEQ ID NO: 903749 - protein, 9 aa, Homo Sapiens
EEAWEDPLP

SEQ ID NO: 903750 - protein, 9 aa, Homo Sapiens
AIPNVYEVI

SEQ ID NO: 903751 - protein, 9 aa, Homo Sapiens
EQHPALAAP

SEQ ID NO: 903752 - protein, 9 aa, Homo Sapiens
LCVRQCLSL

SEQ ID NO: 903753 - protein, 9 aa, Homo Sapiens
VPQAAENSK

SEQ ID NO: 903754 - protein, 9 aa, Homo Sapiens
YQLSLDEKD

SEQ ID NO: 903755 - protein, 9 aa, Homo Sapiens
SWSRSRERP

SEQ ID NO: 903756 - protein, 9 aa, Homo Sapiens
CQLVVQKVK

SEQ ID NO: 903757 - protein, 9 aa, Homo Sapiens
RDLRDASLA

SEQ ID NO: 903758 - protein, 9 aa, Homo Sapiens
EQLLRELQR

SEQ ID NO: 903759 - protein, 9 aa, Homo Sapiens
EDFFKLEWD

SEQ ID NO: 903760 - protein, 9 aa, Homo Sapiens
NSGSRDDSK

SEQ ID NO: 903761 - protein, 9 aa, Homo Sapiens
FLTIITLED

SEQ ID NO: 903762 - protein, 9 aa, Homo Sapiens
AASRPPVTQ

SEQ ID NO: 903763 - protein, 9 aa, Homo Sapiens
ECGKTFIET

SEQ ID NO: 903764 - protein, 9 aa, Homo Sapiens
HKACALRDT

SEQ ID NO: 903765 - protein, 9 aa, Homo Sapiens
SLFEVQWQL

SEQ ID NO: 903766 - protein, 9 aa, Homo Sapiens
QYVPRDVRV

SEQ ID NO: 903767 - protein, 9 aa, Homo Sapiens
VRQKFIIHS

SEQ ID NO: 903768 - protein, 9 aa, Homo Sapiens
LLRELQRHG

SEQ ID NO: 903769 - protein, 9 aa, Homo Sapiens
NSRCVNLPG

SEQ ID NO: 903770 - protein, 9 aa, Homo Sapiens
RVLGDDPEA

SEQ ID NO: 903771 - protein, 9 aa, Homo Sapiens
DHYRVAGCP

SEQ ID NO: 903772 - protein, 9 aa, Homo Sapiens
NFQLLQEYY

SEQ ID NO: 903773 - protein, 9 aa, Homo Sapiens
SIKCKPPLC

SEQ ID NO: 903774 - protein, 9 aa, Homo Sapiens
PNGGAEQPN

SEQ ID NO: 903775 - protein, 9 aa, Homo Sapiens
FVATQVATV

SEQ ID NO: 903776 - protein, 9 aa, Homo Sapiens
LYTFEPYLL

SEQ ID NO: 903777 - protein, 9 aa, Homo Sapiens
LGDDPEATY

SEQ ID NO: 903778 - protein, 9 aa, Homo Sapiens
QRLLPGCRR

SEQ ID NO: 903779 - protein, 9 aa, Homo Sapiens
DLAQHPDGC

SEQ ID NO: 903780 - protein, 9 aa, Homo Sapiens
DQGGGRRRS

SEQ ID NO: 903781 - protein, 9 aa, Homo Sapiens
RPGKIPHQG

SEQ ID NO: 903782 - protein, 9 aa, Homo Sapiens
APGGPGSAV

SEQ ID NO: 903783 - protein, 9 aa, Homo Sapiens
QVQTQQIII

SEQ ID NO: 903784 - protein, 9 aa, Homo Sapiens
ADGMDVNVH

SEQ ID NO: 903785 - protein, 9 aa, Homo Sapiens
QLRDVLQFV

SEQ ID NO: 903786 - protein, 9 aa, Homo Sapiens
QTELNYLRR

SEQ ID NO: 903787 - protein, 9 aa, Homo Sapiens
ICGKGEMAT

SEQ ID NO: 903788 - protein, 9 aa, Homo Sapiens
RVAAGSAGS

SEQ ID NO: 903789 - protein, 9 aa, Homo Sapiens
QGERDYYGY

SEQ ID NO: 903790 - protein, 9 aa, Homo Sapiens
FQMFPKSRA

SEQ ID NO: 903791 - protein, 9 aa, Homo Sapiens
CKEVENALK

SEQ ID NO: 903792 - protein, 9 aa, Homo Sapiens
ARLLVRLFR

SEQ ID NO: 903793 - protein, 9 aa, Homo Sapiens
TFIETAYLI

SEQ ID NO: 903794 - protein, 9 aa, Homo Sapiens
SFHCQRDSS

SEQ ID NO: 903795 - protein, 9 aa, Homo Sapiens
QEPPKTRVS

SEQ ID NO: 903796 - protein, 9 aa, Homo Sapiens
YRRQLRSKS

SEQ ID NO: 903797 - protein, 9 aa, Homo Sapiens
KHSEQHPAL

SEQ ID NO: 903798 - protein, 9 aa, Homo Sapiens
LVVVGADGV

SEQ ID NO: 903799 - protein, 9 aa, Homo Sapiens
TVEELQDWV

SEQ ID NO: 903800 - protein, 9 aa, Homo Sapiens
PQYLYVCHY

SEQ ID NO: 903801 - protein, 9 aa, Homo Sapiens
IKRKIQVSF

SEQ ID NO: 903802 - protein, 9 aa, Homo Sapiens
AGSDRVNGR

SEQ ID NO: 903803 - protein, 9 aa, Homo Sapiens
DSELSDEET

SEQ ID NO: 903804 - protein, 9 aa, Homo Sapiens
GCAKMSDHR

SEQ ID NO: 903805 - protein, 9 aa, Homo Sapiens
DDVFVACLQ

SEQ ID NO: 903806 - protein, 9 aa, Homo Sapiens
ISNSLLDNL

SEQ ID NO: 903807 - protein, 9 aa, Homo Sapiens
LLLCQSGLP

SEQ ID NO: 903808 - protein, 9 aa, Homo Sapiens
EVENALKAA

SEQ ID NO: 903809 - protein, 9 aa, Homo Sapiens
GSVATKLSF

SEQ ID NO: 903810 - protein, 9 aa, Homo Sapiens
LDPEEHMAD

SEQ ID NO: 903811 - protein, 9 aa, Homo Sapiens
RGQADPTIL

SEQ ID NO: 903812 - protein, 9 aa, Homo Sapiens
IQEACARTG

SEQ ID NO: 903813 - protein, 9 aa, Homo Sapiens
DRCTKCYGR

SEQ ID NO: 903814 - protein, 9 aa, Homo Sapiens
VATKLSFFI

SEQ ID NO: 903815 - protein, 9 aa, Homo Sapiens
IWLLILSYV

SEQ ID NO: 903816 - protein, 9 aa, Homo Sapiens
GEQCTVEPD

SEQ ID NO: 903817 - protein, 9 aa, Homo Sapiens
AQISFYALS

SEQ ID NO: 903818 - protein, 9 aa, Homo Sapiens
LLKECHKCH

SEQ ID NO: 903819 - protein, 9 aa, Homo Sapiens
GAHHLGFLS

SEQ ID NO: 903820 - protein, 9 aa, Homo Sapiens
ASFLYQVST

SEQ ID NO: 903821 - protein, 9 aa, Homo Sapiens
GIIECHNNS

SEQ ID NO: 903822 - protein, 9 aa, Homo Sapiens
EGLLGGLEG

SEQ ID NO: 903823 - protein, 9 aa, Homo Sapiens
KDICGKGEM

SEQ ID NO: 903824 - protein, 9 aa, Homo Sapiens
KLDVVAIEA

SEQ ID NO: 903825 - protein, 9 aa, Homo Sapiens
TQVATVVDQ

SEQ ID NO: 903826 - protein, 9 aa, Homo Sapiens
LNVQYVPRD

SEQ ID NO: 903827 - protein, 9 aa, Homo Sapiens
KETRSQHLS

SEQ ID NO: 903828 - protein, 9 aa, Homo Sapiens
KDFSLAANS

SEQ ID NO: 903829 - protein, 9 aa, Homo Sapiens
NKYVASSYL

SEQ ID NO: 903830 - protein, 9 aa, Homo Sapiens
SLNLGVIFF

SEQ ID NO: 903831 - protein, 9 aa, Homo Sapiens
QMILNKKIA

SEQ ID NO: 903832 - protein, 9 aa, Homo Sapiens
DFFKLEWDM

SEQ ID NO: 903833 - protein, 9 aa, Homo Sapiens
GADGVGKSA

SEQ ID NO: 903834 - protein, 9 aa, Homo Sapiens
QQHQHQHQQ

SEQ ID NO: 903835 - protein, 9 aa, Homo Sapiens
SYPRDQFQT

SEQ ID NO: 903836 - protein, 9 aa, Homo Sapiens
PSKAAVETQ

SEQ ID NO: 903837 - protein, 9 aa, Homo Sapiens
ERMKEKRNK

SEQ ID NO: 903838 - protein, 9 aa, Homo Sapiens
PCQLVVQKV

SEQ ID NO: 903839 - protein, 9 aa, Homo Sapiens
HNNSRCVNL

SEQ ID NO: 903840 - protein, 9 aa, Homo Sapiens
SMQTELNYL

SEQ ID NO: 903841 - protein, 9 aa, Homo Sapiens
RSQHLSPAP

SEQ ID NO: 903842 - protein, 9 aa, Homo Sapiens
VLSINEEGQ

SEQ ID NO: 903843 - protein, 9 aa, Homo Sapiens
SSSLCLFTL

SEQ ID NO: 903844 - protein, 9 aa, Homo Sapiens
MAPRPCVVA

SEQ ID NO: 903845 - protein, 9 aa, Homo Sapiens
QQQHQHQHQ

SEQ ID NO: 903846 - protein, 9 aa, Homo Sapiens
YVPRDVRVR

SEQ ID NO: 903847 - protein, 9 aa, Homo Sapiens
DWADWRPVW

SEQ ID NO: 903848 - protein, 9 aa, Homo Sapiens
GALAAPSRF

SEQ ID NO: 903849 - protein, 9 aa, Homo Sapiens
GLPRQQLEF

SEQ ID NO: 903850 - protein, 9 aa, Homo Sapiens
TPKQGGSAP

SEQ ID NO: 903851 - protein, 9 aa, Homo Sapiens
QDSLEDIKE

SEQ ID NO: 903852 - protein, 9 aa, Homo Sapiens
PDTTVVTTS

SEQ ID NO: 903853 - protein, 9 aa, Homo Sapiens
DPEEHMADG

SEQ ID NO: 903854 - protein, 9 aa, Homo Sapiens
QPVGVFVDC

SEQ ID NO: 903855 - protein, 9 aa, Homo Sapiens
LQDWVLILE

SEQ ID NO: 903856 - protein, 9 aa, Homo Sapiens
SQTSVYFCP

SEQ ID NO: 903857 - protein, 9 aa, Homo Sapiens
SRSWSRSRE

SEQ ID NO: 903858 - protein, 9 aa, Homo Sapiens
GGGSSAGTT

SEQ ID NO: 903859 - protein, 9 aa, Homo Sapiens
QHPDGCAKM

SEQ ID NO: 903860 - protein, 9 aa, Homo Sapiens
VIDWADWRP

SEQ ID NO: 903861 - protein, 9 aa, Homo Sapiens
GTGVQSEGI

SEQ ID NO: 903862 - protein, 9 aa, Homo Sapiens
QRDELSERL

SEQ ID NO: 903863 - protein, 9 aa, Homo Sapiens
DFGLSRVLG

SEQ ID NO: 903864 - protein, 9 aa, Homo Sapiens
RQEPPKTRV

SEQ ID NO: 903865 - protein, 9 aa, Homo Sapiens
DSSDDWHTY

SEQ ID NO: 903866 - protein, 9 aa, Homo Sapiens
KRHNQSCVV

SEQ ID NO: 903867 - protein, 9 aa, Homo Sapiens
AAGANKPDG

SEQ ID NO: 903868 - protein, 9 aa, Homo Sapiens
WSRSRERPS

SEQ ID NO: 903869 - protein, 9 aa, Homo Sapiens
ESINQENFQ

SEQ ID NO: 903870 - protein, 9 aa, Homo Sapiens
DNSDPVLEA

SEQ ID NO: 903871 - protein, 9 aa, Homo Sapiens
NKAWSEAQF

SEQ ID NO: 903872 - protein, 9 aa, Homo Sapiens
VRTVAGRTY

SEQ ID NO: 903873 - protein, 9 aa, Homo Sapiens
SSNSSGCLS

SEQ ID NO: 903874 - protein, 9 aa, Homo Sapiens
KAIKNTAVT

SEQ ID NO: 903875 - protein, 9 aa, Homo Sapiens
VVVGADGVG

SEQ ID NO: 903876 - protein, 9 aa, Homo Sapiens
MGMFYRTIC

SEQ ID NO: 903877 - protein, 9 aa, Homo Sapiens
KFQLSRQKL

SEQ ID NO: 903878 - protein, 9 aa, Homo Sapiens
MGYFESSNI

SEQ ID NO: 903879 - protein, 9 aa, Homo Sapiens
DSGKEELFV

SEQ ID NO: 903880 - protein, 9 aa, Homo Sapiens
VQGQQVQTQ

SEQ ID NO: 903881 - protein, 9 aa, Homo Sapiens
FLVPNGIYD

SEQ ID NO: 903882 - protein, 9 aa, Homo Sapiens
DKTRIGLAQ

SEQ ID NO: 903883 - protein, 9 aa, Homo Sapiens
TPGKAPGVV

SEQ ID NO: 903884 - protein, 9 aa, Homo Sapiens
PHSSLLKEC

SEQ ID NO: 903885 - protein, 9 aa, Homo Sapiens
HGGKHSEQH

SEQ ID NO: 903886 - protein, 9 aa, Homo Sapiens
VYEDSFSQP

SEQ ID NO: 903887 - protein, 9 aa, Homo Sapiens
KDPAGDEYE

SEQ ID NO: 903888 - protein, 9 aa, Homo Sapiens
RAQEEYELD

SEQ ID NO: 903889 - protein, 9 aa, Homo Sapiens
ELQKEQRWQ

SEQ ID NO: 903890 - protein, 9 aa, Homo Sapiens
PFLTIITLE

SEQ ID NO: 903891 - protein, 9 aa, Homo Sapiens
GGRRRSGEA

SEQ ID NO: 903892 - protein, 9 aa, Homo Sapiens
LGAMTVDRY

SEQ ID NO: 903893 - protein, 9 aa, Homo Sapiens
HSEQHPALA

SEQ ID NO: 903894 - protein, 9 aa, Homo Sapiens
LDTSAMVYP

SEQ ID NO: 903895 - protein, 9 aa, Homo Sapiens
FDKLCEFLR

SEQ ID NO: 903896 - protein, 9 aa, Homo Sapiens
PNRAYTPEI

SEQ ID NO: 903897 - protein, 9 aa, Homo Sapiens
SGKEELFVA

SEQ ID NO: 903898 - protein, 9 aa, Homo Sapiens
ITGQFYDRV

SEQ ID NO: 903899 - protein, 9 aa, Homo Sapiens
VHRPGKIPH

SEQ ID NO: 903900 - protein, 9 aa, Homo Sapiens
ETSILESGG

SEQ ID NO: 903901 - protein, 9 aa, Homo Sapiens
EAWEDPLPP

SEQ ID NO: 903902 - protein, 9 aa, Homo Sapiens
CCYTCRQLH

SEQ ID NO: 903903 - protein, 9 aa, Homo Sapiens
IMTNGLCIW

SEQ ID NO: 903904 - protein, 9 aa, Homo Sapiens
SFSDTGLVD

SEQ ID NO: 903905 - protein, 9 aa, Homo Sapiens
QMFPKSRAQ

SEQ ID NO: 903906 - protein, 9 aa, Homo Sapiens
EGQCISETT

SEQ ID NO: 903907 - protein, 9 aa, Homo Sapiens
VTYTVITPF

SEQ ID NO: 903908 - protein, 9 aa, Homo Sapiens
NTVGSFHCQ

SEQ ID NO: 903909 - protein, 9 aa, Homo Sapiens
QHNTEWAHC

SEQ ID NO: 903910 - protein, 9 aa, Homo Sapiens
LDWNRACFT

SEQ ID NO: 903911 - protein, 9 aa, Homo Sapiens
GDDPEATYT

SEQ ID NO: 903912 - protein, 9 aa, Homo Sapiens
REAVVIDPV

SEQ ID NO: 903913 - protein, 9 aa, Homo Sapiens
QDDLAENDV

SEQ ID NO: 903914 - protein, 9 aa, Homo Sapiens
GDEIKDPAG

SEQ ID NO: 903915 - protein, 9 aa, Homo Sapiens
LHSEPVHRP

SEQ ID NO: 903916 - protein, 9 aa, Homo Sapiens
KWMEKMAEQ

SEQ ID NO: 903917 - protein, 9 aa, Homo Sapiens
TELNYLRRN

SEQ ID NO: 903918 - protein, 9 aa, Homo Sapiens
EPYLLDDPN

SEQ ID NO: 903919 - protein, 9 aa, Homo Sapiens
RPVKMLGPE

SEQ ID NO: 903920 - protein, 9 aa, Homo Sapiens
TIVYLKLFP

SEQ ID NO: 903921 - protein, 9 aa, Homo Sapiens
KPDGRPHTA

SEQ ID NO: 903922 - protein, 9 aa, Homo Sapiens
EQAILEGEY

SEQ ID NO: 903923 - protein, 9 aa, Homo Sapiens
KEVYQRLFD

SEQ ID NO: 903924 - protein, 9 aa, Homo Sapiens
QQFWDSQRP

SEQ ID NO: 903925 - protein, 9 aa, Homo Sapiens
IKASIKCKP

SEQ ID NO: 903926 - protein, 9 aa, Homo Sapiens
YIFRLTIPS

SEQ ID NO: 903927 - protein, 9 aa, Homo Sapiens
LEGEYAALE

SEQ ID NO: 903928 - protein, 9 aa, Homo Sapiens
LSPCPPTLS

SEQ ID NO: 903929 - protein, 9 aa, Homo Sapiens
EEIQCDVDT

SEQ ID NO: 903930 - protein, 9 aa, Homo Sapiens
AQRSCWCVM

SEQ ID NO: 903931 - protein, 9 aa, Homo Sapiens
ICGYRTQDR

SEQ ID NO: 903932 - protein, 9 aa, Homo Sapiens
LKAEMAQLK

SEQ ID NO: 903933 - protein, 9 aa, Homo Sapiens
NGEAKLDLK

SEQ ID NO: 903934 - protein, 9 aa, Homo Sapiens
RGCSFQRRW

SEQ ID NO: 903935 - protein, 9 aa, Homo Sapiens
RTQDRYEFS

SEQ ID NO: 903936 - protein, 9 aa, Homo Sapiens
PGYASALMM

SEQ ID NO: 903937 - protein, 9 aa, Homo Sapiens
AVVIDPVLE

SEQ ID NO: 903938 - protein, 9 aa, Homo Sapiens
SFHIKTKSE

SEQ ID NO: 903939 - protein, 9 aa, Homo Sapiens
PSPTSAFPT

SEQ ID NO: 903940 - protein, 9 aa, Homo Sapiens
QRSCWCVMD

SEQ ID NO: 903941 - protein, 9 aa, Homo Sapiens
YHAKTGRTS

SEQ ID NO: 903942 - protein, 9 aa, Homo Sapiens
AWEDPLPPG

SEQ ID NO: 903943 - protein, 9 aa, Homo Sapiens
TTLFALGLT

SEQ ID NO: 903944 - protein, 9 aa, Homo Sapiens
LQHSQDSRL

SEQ ID NO: 903945 - protein, 9 aa, Homo Sapiens
QPNGGAEQP

SEQ ID NO: 903946 - protein, 9 aa, Homo Sapiens
SRKLDVVAI

SEQ ID NO: 903947 - protein, 9 aa, Homo Sapiens
LGFLSASVA

SEQ ID NO: 903948 - protein, 9 aa, Homo Sapiens
MEDTTSILL

SEQ ID NO: 903949 - protein, 9 aa, Homo Sapiens
SVATKLSFF

SEQ ID NO: 903950 - protein, 9 aa, Homo Sapiens
YSMAPRPCV

SEQ ID NO: 903951 - protein, 9 aa, Homo Sapiens
QRLVVPATQ

SEQ ID NO: 903952 - protein, 9 aa, Homo Sapiens
VSSLRQEPP

SEQ ID NO: 903953 - protein, 9 aa, Homo Sapiens
LKLKRNSNA

SEQ ID NO: 903954 - protein, 9 aa, Homo Sapiens
FQVPHSSLL

SEQ ID NO: 903955 - protein, 9 aa, Homo Sapiens
PVFLALAVL

SEQ ID NO: 903956 - protein, 9 aa, Homo Sapiens
DTAFDMDIL

SEQ ID NO: 903957 - protein, 9 aa, Homo Sapiens
SYGDNSDPV

SEQ ID NO: 903958 - protein, 9 aa, Homo Sapiens
WKLCFCFTG

SEQ ID NO: 903959 - protein, 9 aa, Homo Sapiens
VVNPLHENG

SEQ ID NO: 903960 - protein, 9 aa, Homo Sapiens
LIWEKESEL

SEQ ID NO: 903961 - protein, 9 aa, Homo Sapiens
FFKLEWDMK

SEQ ID NO: 903962 - protein, 9 aa, Homo Sapiens
FTNLEELNV

SEQ ID NO: 903963 - protein, 9 aa, Homo Sapiens
FVQRVKDLV

SEQ ID NO: 903964 - protein, 9 aa, Homo Sapiens
KPFLFYHAK

SEQ ID NO: 903965 - protein, 9 aa, Homo Sapiens
TAYLIRHQR

SEQ ID NO: 903966 - protein, 9 aa, Homo Sapiens
DWAYDSGKE

SEQ ID NO: 903967 - protein, 9 aa, Homo Sapiens
IAEYRRQLR

SEQ ID NO: 903968 - protein, 9 aa, Homo Sapiens
VVAIEAKFK

SEQ ID NO: 903969 - protein, 9 aa, Homo Sapiens
AEMAQLKIQ

SEQ ID NO: 903970 - protein, 9 aa, Homo Sapiens
QDWVLILER

SEQ ID NO: 903971 - protein, 9 aa, Homo Sapiens
SPSKAAVET

SEQ ID NO: 903972 - protein, 9 aa, Homo Sapiens
EERTQVKLE

SEQ ID NO: 903973 - protein, 9 aa, Homo Sapiens
VGADGVGKS

SEQ ID NO: 903974 - protein, 9 aa, Homo Sapiens
LSQELWQRL

SEQ ID NO: 903975 - protein, 9 aa, Homo Sapiens
QVQSQLPPL

SEQ ID NO: 903976 - protein, 9 aa, Homo Sapiens
WRSAAPLHS

SEQ ID NO: 903977 - protein, 9 aa, Homo Sapiens
VVGACGVGK

SEQ ID NO: 903978 - protein, 9 aa, Homo Sapiens
LIYDNSRFT

SEQ ID NO: 903979 - protein, 9 aa, Homo Sapiens
GKFQLSRQK

SEQ ID NO: 903980 - protein, 9 aa, Homo Sapiens
LSRAPRWAS

SEQ ID NO: 903981 - protein, 9 aa, Homo Sapiens
SASLGAELQ

SEQ ID NO: 903982 - protein, 9 aa, Homo Sapiens
IKEVYQRLF

SEQ ID NO: 903983 - protein, 9 aa, Homo Sapiens
VQKVKSLLW

SEQ ID NO: 903984 - protein, 9 aa, Homo Sapiens
TGQFYDRVS

SEQ ID NO: 903985 - protein, 9 aa, Homo Sapiens
VIDPVLETA

SEQ ID NO: 903986 - protein, 9 aa, Homo Sapiens
FDVGSDKTR

SEQ ID NO: 903987 - protein, 9 aa, Homo Sapiens
LVVGPSAEL

SEQ ID NO: 903988 - protein, 9 aa, Homo Sapiens
DGVGKSALT

SEQ ID NO: 903989 - protein, 9 aa, Homo Sapiens
VTNAANNVV

SEQ ID NO: 903990 - protein, 9 aa, Homo Sapiens
AIKNTAVTG

SEQ ID NO: 903991 - protein, 9 aa, Homo Sapiens
SEDGCCIRE

SEQ ID NO: 903992 - protein, 9 aa, Homo Sapiens
RQLRSKSIE

SEQ ID NO: 903993 - protein, 9 aa, Homo Sapiens
TKLSFFIHN

SEQ ID NO: 903994 - protein, 9 aa, Homo Sapiens
TTREPTPLL

SEQ ID NO: 903995 - protein, 9 aa, Homo Sapiens
TNAANNVVC

SEQ ID NO: 903996 - protein, 9 aa, Homo Sapiens
NQSYRSRSW

SEQ ID NO: 903997 - protein, 9 aa, Homo Sapiens
HIKTKSECA

SEQ ID NO: 903998 - protein, 9 aa, Homo Sapiens
RCVQTAHSI

SEQ ID NO: 903999 - protein, 9 aa, Homo Sapiens
VVGPSAELL

SEQ ID NO: 904000 - protein, 9 aa, Homo Sapiens
REENKILRA

SEQ ID NO: 904001 - protein, 9 aa, Homo Sapiens
RPVFLALAV

SEQ ID NO: 904002 - protein, 9 aa, Homo Sapiens
SSSSLCLFT

SEQ ID NO: 904003 - protein, 9 aa, Homo Sapiens
ERDYYGYRQ

SEQ ID NO: 904004 - protein, 9 aa, Homo Sapiens
GTTNSFHIK

SEQ ID NO: 904005 - protein, 9 aa, Homo Sapiens
AGTPTRTAR

SEQ ID NO: 904006 - protein, 9 aa, Homo Sapiens
LRHVLSINE

SEQ ID NO: 904007 - protein, 9 aa, Homo Sapiens
YLRNNCLTL

SEQ ID NO: 904008 - protein, 9 aa, Homo Sapiens
TAIRVADLL

SEQ ID NO: 904009 - protein, 9 aa, Homo Sapiens
PTRTARSPL

SEQ ID NO: 904010 - protein, 9 aa, Homo Sapiens
EHLFYWKLC

SEQ ID NO: 904011 - protein, 9 aa, Homo Sapiens
SVSRDAASA

SEQ ID NO: 904012 - protein, 9 aa, Homo Sapiens
CFCFTGVCS

SEQ ID NO: 904013 - protein, 9 aa, Homo Sapiens
RDVLQFVGL

SEQ ID NO: 904014 - protein, 9 aa, Homo Sapiens
LCFCFTGVC

SEQ ID NO: 904015 - protein, 9 aa, Homo Sapiens
VLAYDADES

SEQ ID NO: 904016 - protein, 9 aa, Homo Sapiens
HERPVKMLG

SEQ ID NO: 904017 - protein, 9 aa, Homo Sapiens
SSAGTTPKQ

SEQ ID NO: 904018 - protein, 9 aa, Homo Sapiens
AGRTYYCRT

SEQ ID NO: 904019 - protein, 9 aa, Homo Sapiens
LRRKWMEKM

SEQ ID NO: 904020 - protein, 9 aa, Homo Sapiens
VAGRTYYCR

SEQ ID NO: 904021 - protein, 9 aa, Homo Sapiens
TPLEEPSPA

SEQ ID NO: 904022 - protein, 9 aa, Homo Sapiens
DDIVGKQNT

SEQ ID NO: 904023 - protein, 9 aa, Homo Sapiens
QGGGRRRSG

SEQ ID NO: 904024 - protein, 9 aa, Homo Sapiens
LCFLKAIKN

SEQ ID NO: 904025 - protein, 9 aa, Homo Sapiens
QGRPPYTTG

SEQ ID NO: 904026 - protein, 9 aa, Homo Sapiens
GTVEELQDW

SEQ ID NO: 904027 - protein, 9 aa, Homo Sapiens
GSRDDSKGL

SEQ ID NO: 904028 - protein, 9 aa, Homo Sapiens
EIIFEGDTA

SEQ ID NO: 904029 - protein, 9 aa, Homo Sapiens
TPIVRTSGR

SEQ ID NO: 904030 - protein, 9 aa, Homo Sapiens
NRLEEKRVL

SEQ ID NO: 904031 - protein, 9 aa, Homo Sapiens
GDRVELVFP

SEQ ID NO: 904032 - protein, 9 aa, Homo Sapiens
SGDTAFDMD

SEQ ID NO: 904033 - protein, 9 aa, Homo Sapiens
RLLVRLFRE

SEQ ID NO: 904034 - protein, 9 aa, Homo Sapiens
LRVRTVAGR

SEQ ID NO: 904035 - protein, 9 aa, Homo Sapiens
IHSKIITYI

SEQ ID NO: 904036 - protein, 9 aa, Homo Sapiens
SQHLSPAPG

SEQ ID NO: 904037 - protein, 9 aa, Homo Sapiens
AWSEAQFVL

SEQ ID NO: 904038 - protein, 9 aa, Homo Sapiens
NCLTLFRYI

SEQ ID NO: 904039 - protein, 9 aa, Homo Sapiens
HLERLQTPV

SEQ ID NO: 904040 - protein, 9 aa, Homo Sapiens
NGGAEQPNG

SEQ ID NO: 904041 - protein, 9 aa, Homo Sapiens
YLKLFPLRE

SEQ ID NO: 904042 - protein, 9 aa, Homo Sapiens
LPRQQLEFA

SEQ ID NO: 904043 - protein, 9 aa, Homo Sapiens
CMMENGIKP

SEQ ID NO: 904044 - protein, 9 aa, Homo Sapiens
HHVAEAIPQ

SEQ ID NO: 904045 - protein, 9 aa, Homo Sapiens
KACALRDTA

SEQ ID NO: 904046 - protein, 9 aa, Homo Sapiens
WSEAQFVLE

SEQ ID NO: 904047 - protein, 9 aa, Homo Sapiens
LIAGHLHIP

SEQ ID NO: 904048 - protein, 9 aa, Homo Sapiens
SYLRNNCLT

SEQ ID NO: 904049 - protein, 9 aa, Homo Sapiens
VDEGIPLKI

SEQ ID NO: 904050 - protein, 9 aa, Homo Sapiens
CRRAHGEGL

SEQ ID NO: 904051 - protein, 9 aa, Homo Sapiens
DTLIAVTYT

SEQ ID NO: 904052 - protein, 9 aa, Homo Sapiens
VLLIAGHLH

SEQ ID NO: 904053 - protein, 9 aa, Homo Sapiens
TSGRELSYV

SEQ ID NO: 904054 - protein, 9 aa, Homo Sapiens
CYGRCKRDC

SEQ ID NO: 904055 - protein, 9 aa, Homo Sapiens
ILEGEYAAL

SEQ ID NO: 904056 - protein, 9 aa, Homo Sapiens
WTPLEEPSP

SEQ ID NO: 904057 - protein, 9 aa, Homo Sapiens
INGKFQLSR

SEQ ID NO: 904058 - protein, 9 aa, Homo Sapiens
GHCPWQQWA

SEQ ID NO: 904059 - protein, 9 aa, Homo Sapiens
RRRSGEAEA

SEQ ID NO: 904060 - protein, 9 aa, Homo Sapiens
DSRLNQVPP

SEQ ID NO: 904061 - protein, 9 aa, Homo Sapiens
VQTQQIIIQ

SEQ ID NO: 904062 - protein, 9 aa, Homo Sapiens
GSLFEVQWQ

SEQ ID NO: 904063 - protein, 9 aa, Homo Sapiens
LDSSDDWHT

SEQ ID NO: 904064 - protein, 9 aa, Homo Sapiens
QWLRRKWME

SEQ ID NO: 904065 - protein, 9 aa, Homo Sapiens
NRRRRKSQR

SEQ ID NO: 904066 - protein, 9 aa, Homo Sapiens
WSYQLSLDE

SEQ ID NO: 904067 - protein, 9 aa, Homo Sapiens
EGDQAIAGA

SEQ ID NO: 904068 - protein, 9 aa, Homo Sapiens
CCIREIPDP

SEQ ID NO: 904069 - protein, 9 aa, Homo Sapiens
LAQKYWLTC

SEQ ID NO: 904070 - protein, 9 aa, Homo Sapiens
RRRKSQRNL

SEQ ID NO: 904071 - protein, 9 aa, Homo Sapiens
KSIISNVGC

SEQ ID NO: 904072 - protein, 9 aa, Homo Sapiens
THTHRERER

SEQ ID NO: 904073 - protein, 9 aa, Homo Sapiens
MAAVKDICG

SEQ ID NO: 904074 - protein, 9 aa, Homo Sapiens
ECHNNSRCV

SEQ ID NO: 904075 - protein, 9 aa, Homo Sapiens
AEGLLGGLE

SEQ ID NO: 904076 - protein, 9 aa, Homo Sapiens
WLHLERLQT

SEQ ID NO: 904077 - protein, 9 aa, Homo Sapiens
RPPYTTGPG

SEQ ID NO: 904078 - protein, 9 aa, Homo Sapiens
SKAAVETQL

SEQ ID NO: 904079 - protein, 9 aa, Homo Sapiens
ALPTLCCYT

SEQ ID NO: 904080 - protein, 9 aa, Homo Sapiens
MFCFLSGRA

SEQ ID NO: 904081 - protein, 9 aa, Homo Sapiens
RHKACALRD

SEQ ID NO: 904082 - protein, 9 aa, Homo Sapiens
SLRQEPPKT

SEQ ID NO: 904083 - protein, 9 aa, Homo Sapiens
GLAVIDWAD

SEQ ID NO: 904084 - protein, 9 aa, Homo Sapiens
FQTAIRVAD

SEQ ID NO: 904085 - protein, 9 aa, Homo Sapiens
HMADGEPSA

SEQ ID NO: 904086 - protein, 9 aa, Homo Sapiens
QPLVPSGLT

SEQ ID NO: 904087 - protein, 9 aa, Homo Sapiens
RELFTAENL

SEQ ID NO: 904088 - protein, 9 aa, Homo Sapiens
LSRQKLFIP

SEQ ID NO: 904089 - protein, 9 aa, Homo Sapiens
PLVPSGLTA

SEQ ID NO: 904090 - protein, 9 aa, Homo Sapiens
SFTNLEELN

SEQ ID NO: 904091 - protein, 9 aa, Homo Sapiens
PNSGSRDDS

SEQ ID NO: 904092 - protein, 9 aa, Homo Sapiens
VAGCPNPRG

SEQ ID NO: 904093 - protein, 9 aa, Homo Sapiens
LKAIKNTAV

SEQ ID NO: 904094 - protein, 9 aa, Homo Sapiens
LSSSSLCLF

SEQ ID NO: 904095 - protein, 9 aa, Homo Sapiens
LEDIKERMK

SEQ ID NO: 904096 - protein, 9 aa, Homo Sapiens
GGRRLLTVS

SEQ ID NO: 904097 - protein, 9 aa, Homo Sapiens
PEISREEYL

SEQ ID NO: 904098 - protein, 9 aa, Homo Sapiens
GDTAFDMDI

SEQ ID NO: 904099 - protein, 9 aa, Homo Sapiens
GCGPPRLDG

SEQ ID NO: 904100 - protein, 9 aa, Homo Sapiens
AIPQIPRLS

SEQ ID NO: 904101 - protein, 9 aa, Homo Sapiens
CFEEQRDEL

SEQ ID NO: 904102 - protein, 9 aa, Homo Sapiens
TSAFPTVTT

SEQ ID NO: 904103 - protein, 9 aa, Homo Sapiens
QYIDKITHY

SEQ ID NO: 904104 - protein, 9 aa, Homo Sapiens
DEGIPLKIC

SEQ ID NO: 904105 - protein, 9 aa, Homo Sapiens
TGVQSEGIW

SEQ ID NO: 904106 - protein, 9 aa, Homo Sapiens
LNKKIALEH

SEQ ID NO: 904107 - protein, 9 aa, Homo Sapiens
RTICMMENG

SEQ ID NO: 904108 - protein, 9 aa, Homo Sapiens
LERLQTPVP

SEQ ID NO: 904109 - protein, 9 aa, Homo Sapiens
TVAGRTYYC

SEQ ID NO: 904110 - protein, 9 aa, Homo Sapiens
DLPDTTVVT

SEQ ID NO: 904111 - protein, 9 aa, Homo Sapiens
KFIIHSKII

SEQ ID NO: 904112 - protein, 9 aa, Homo Sapiens
GRPPYTTGP

SEQ ID NO: 904113 - protein, 9 aa, Homo Sapiens
GGLEGSGGL

SEQ ID NO: 904114 - protein, 9 aa, Homo Sapiens
TICMMENGI

SEQ ID NO: 904115 - protein, 9 aa, Homo Sapiens
GMSTLHFAT

SEQ ID NO: 904116 - protein, 9 aa, Homo Sapiens
WVIHAGNKS

SEQ ID NO: 904117 - protein, 9 aa, Homo Sapiens
HGCKEVENA

SEQ ID NO: 904118 - protein, 9 aa, Homo Sapiens
EISREEYLY

SEQ ID NO: 904119 - protein, 9 aa, Homo Sapiens
EEHRQFGVN

SEQ ID NO: 904120 - protein, 9 aa, Homo Sapiens
AENDVMLLD

SEQ ID NO: 904121 - protein, 9 aa, Homo Sapiens
SEYFIKQIS

SEQ ID NO: 904122 - protein, 9 aa, Homo Sapiens
MLSLDTSAM

SEQ ID NO: 904123 - protein, 9 aa, Homo Sapiens
YKLVVVGAD

SEQ ID NO: 904124 - protein, 9 aa, Homo Sapiens
QLLRELQRH

SEQ ID NO: 904125 - protein, 9 aa, Homo Sapiens
DPDLPRIYP

SEQ ID NO: 904126 - protein, 9 aa, Homo Sapiens
SEAQFVLER

SEQ ID NO: 904127 - protein, 9 aa, Homo Sapiens
MKLLSMEIE

SEQ ID NO: 904128 - protein, 9 aa, Homo Sapiens
ATEGHCPWQ

SEQ ID NO: 904129 - protein, 9 aa, Homo Sapiens
GAAFAFFMF

SEQ ID NO: 904130 - protein, 9 aa, Homo Sapiens
NKPDGRPHT

SEQ ID NO: 904131 - protein, 9 aa, Homo Sapiens
KRKIQVSFT

SEQ ID NO: 904132 - protein, 9 aa, Homo Sapiens
YRTICMMEN

SEQ ID NO: 904133 - protein, 9 aa, Homo Sapiens
TIAPIGTRR

SEQ ID NO: 904134 - protein, 9 aa, Homo Sapiens
LGAELQKSD

SEQ ID NO: 904135 - protein, 9 aa, Homo Sapiens
LEAQLGQGN

SEQ ID NO: 904136 - protein, 9 aa, Homo Sapiens
NRRPFLTII

SEQ ID NO: 904137 - protein, 9 aa, Homo Sapiens
DRESREAVV

SEQ ID NO: 904138 - protein, 9 aa, Homo Sapiens
SPPQACRRA

SEQ ID NO: 904139 - protein, 9 aa, Homo Sapiens
SGLPRQQLE

SEQ ID NO: 904140 - protein, 9 aa, Homo Sapiens
FPFREEIQC

SEQ ID NO: 904141 - protein, 9 aa, Homo Sapiens
SSLLKECHK

SEQ ID NO: 904142 - protein, 9 aa, Homo Sapiens
FYDSVSRDA

SEQ ID NO: 904143 - protein, 9 aa, Homo Sapiens
ACARTGGRI

SEQ ID NO: 904144 - protein, 9 aa, Homo Sapiens
VPNGIYDPA

SEQ ID NO: 904145 - protein, 9 aa, Homo Sapiens
TQEMYFYDS

SEQ ID NO: 904146 - protein, 9 aa, Homo Sapiens
PFPEISREE

SEQ ID NO: 904147 - protein, 9 aa, Homo Sapiens
TPLLQEGSL

SEQ ID NO: 904148 - protein, 9 aa, Homo Sapiens
LAAIPNVYE

SEQ ID NO: 904149 - protein, 9 aa, Homo Sapiens
ELQDWVLIL

SEQ ID NO: 904150 - protein, 9 aa, Homo Sapiens
ACRRAHGEG

SEQ ID NO: 904151 - protein, 9 aa, Homo Sapiens
SRQKLFIPQ

SEQ ID NO: 904152 - protein, 9 aa, Homo Sapiens
SALDDVVNP

SEQ ID NO: 904153 - protein, 9 aa, Homo Sapiens
SGNKAWSEA

SEQ ID NO: 904154 - protein, 9 aa, Homo Sapiens
EPVHRPGKI

SEQ ID NO: 904155 - protein, 9 aa, Homo Sapiens
SLGAELQKS

SEQ ID NO: 904156 - protein, 9 aa, Homo Sapiens
RPQDHDTDL

SEQ ID NO: 904157 - protein, 9 aa, Homo Sapiens
EENKILRAH

SEQ ID NO: 904158 - protein, 9 aa, Homo Sapiens
ARTGGRIAV

SEQ ID NO: 904159 - protein, 9 aa, Homo Sapiens
SSYSMAPRP

SEQ ID NO: 904160 - protein, 9 aa, Homo Sapiens
TAHSILKGL

SEQ ID NO: 904161 - protein, 9 aa, Homo Sapiens
YGDNSDPVL

SEQ ID NO: 904162 - protein, 9 aa, Homo Sapiens
RKLDVVAIE

SEQ ID NO: 904163 - protein, 9 aa, Homo Sapiens
QQGSPQYLY

SEQ ID NO: 904164 - protein, 9 aa, Homo Sapiens
SLLDNLAFW

SEQ ID NO: 904165 - protein, 9 aa, Homo Sapiens
DKLCEFLRV

SEQ ID NO: 904166 - protein, 9 aa, Homo Sapiens
RRLLTVSVE

SEQ ID NO: 904167 - protein, 9 aa, Homo Sapiens
LRSKPSPGP

SEQ ID NO: 904168 - protein, 9 aa, Homo Sapiens
KAAVETQLA

SEQ ID NO: 904169 - protein, 9 aa, Homo Sapiens
TLNVLYDPD

SEQ ID NO: 904170 - protein, 9 aa, Homo Sapiens
EQANLIYDN

SEQ ID NO: 904171 - protein, 9 aa, Homo Sapiens
LGGLEGSGG

SEQ ID NO: 904172 - protein, 9 aa, Homo Sapiens
QLSRQKLFI

SEQ ID NO: 904173 - protein, 9 aa, Homo Sapiens
KAKWRSAAP

SEQ ID NO: 904174 - protein, 9 aa, Homo Sapiens
RLNQVPPNK

SEQ ID NO: 904175 - protein, 9 aa, Homo Sapiens
VQCDQAQRS

SEQ ID NO: 904176 - protein, 9 aa, Homo Sapiens
EILIWEKES

SEQ ID NO: 904177 - protein, 9 aa, Homo Sapiens
YASALMMAI

SEQ ID NO: 904178 - protein, 9 aa, Homo Sapiens
RLLTVSVET

SEQ ID NO: 904179 - protein, 9 aa, Homo Sapiens
PVKPFLFYH

SEQ ID NO: 904180 - protein, 9 aa, Homo Sapiens
LPCQLVVQK

SEQ ID NO: 904181 - protein, 9 aa, Homo Sapiens
IIQGERDYY

SEQ ID NO: 904182 - protein, 9 aa, Homo Sapiens
FHTENFLQQ

SEQ ID NO: 904183 - protein, 9 aa, Homo Sapiens
GALKEVSKL

SEQ ID NO: 904184 - protein, 9 aa, Homo Sapiens
QLPPGQLHV

SEQ ID NO: 904185 - protein, 9 aa, Homo Sapiens
EEYLYTYDS

SEQ ID NO: 904186 - protein, 9 aa, Homo Sapiens
EQRWQEEND

SEQ ID NO: 904187 - protein, 9 aa, Homo Sapiens
REEYLYTYD

SEQ ID NO: 904188 - protein, 9 aa, Homo Sapiens
DGCCIREIP

SEQ ID NO: 904189 - protein, 9 aa, Homo Sapiens
FAFFMFCFL

SEQ ID NO: 904190 - protein, 9 aa, Homo Sapiens
EAIPQIPRL

SEQ ID NO: 904191 - protein, 9 aa, Homo Sapiens
RPNSGSRDD

SEQ ID NO: 904192 - protein, 9 aa, Homo Sapiens
QQQQHQHQH

SEQ ID NO: 904193 - protein, 9 aa, Homo Sapiens
VCKGALKEV

SEQ ID NO: 904194 - protein, 9 aa, Homo Sapiens
REPTPLLQE

SEQ ID NO: 904195 - protein, 9 aa, Homo Sapiens
VEGQCISET

SEQ ID NO: 904196 - protein, 9 aa, Homo Sapiens
AELSRAPRW

SEQ ID NO: 904197 - protein, 9 aa, Homo Sapiens
LAVIDWADW

SEQ ID NO: 904198 - protein, 9 aa, Homo Sapiens
IFEGDTASL

SEQ ID NO: 904199 - protein, 9 aa, Homo Sapiens
RGGSKAVVT

SEQ ID NO: 904200 - protein, 9 aa, Homo Sapiens
YDPDLPRIY

SEQ ID NO: 904201 - protein, 9 aa, Homo Sapiens
IHAGNKSPT

SEQ ID NO: 904202 - protein, 9 aa, Homo Sapiens
LKPGDRVEL

SEQ ID NO: 904203 - protein, 9 aa, Homo Sapiens
QAVDWAYDS

SEQ ID NO: 904204 - protein, 9 aa, Homo Sapiens
VRAPGGPGS

SEQ ID NO: 904205 - protein, 9 aa, Homo Sapiens
LRSGEQCTV

SEQ ID NO: 904206 - protein, 9 aa, Homo Sapiens
NTEWAHCER

SEQ ID NO: 904207 - protein, 9 aa, Homo Sapiens
VWTGDVVGR

SEQ ID NO: 904208 - protein, 9 aa, Homo Sapiens
VSKKSIISN

SEQ ID NO: 904209 - protein, 9 aa, Homo Sapiens
TEGHCPWQQ

SEQ ID NO: 904210 - protein, 9 aa, Homo Sapiens
ARAGTPTRT

SEQ ID NO: 904211 - protein, 9 aa, Homo Sapiens
VYLKLFPLR

SEQ ID NO: 904212 - protein, 9 aa, Homo Sapiens
GALPTLCCY

SEQ ID NO: 904213 - protein, 9 aa, Homo Sapiens
GLSDGANVT

SEQ ID NO: 904214 - protein, 9 aa, Homo Sapiens
GERDYYGYR

SEQ ID NO: 904215 - protein, 9 aa, Homo Sapiens
QSNNKYVAS

SEQ ID NO: 904216 - protein, 9 aa, Homo Sapiens
DVVGRGTDS

SEQ ID NO: 904217 - protein, 9 aa, Homo Sapiens
DNSRFTDLH

SEQ ID NO: 904218 - protein, 9 aa, Homo Sapiens
IIVTPKSQY

SEQ ID NO: 904219 - protein, 9 aa, Homo Sapiens
PVQCDQAQR

SEQ ID NO: 904220 - protein, 9 aa, Homo Sapiens
PQAAENSKL

SEQ ID NO: 904221 - protein, 9 aa, Homo Sapiens
GNGEAKLDL

SEQ ID NO: 904222 - protein, 9 aa, Homo Sapiens
GGSSAGTTP

SEQ ID NO: 904223 - protein, 9 aa, Homo Sapiens
KTRVSSLRQ

SEQ ID NO: 904224 - protein, 9 aa, Homo Sapiens
VQTAHSILK

SEQ ID NO: 904225 - protein, 9 aa, Homo Sapiens
FDMDILGSV

SEQ ID NO: 904226 - protein, 9 aa, Homo Sapiens
IVRTSGREL

SEQ ID NO: 904227 - protein, 9 aa, Homo Sapiens
EAGQPNGGA

SEQ ID NO: 904228 - protein, 9 aa, Homo Sapiens
LGSSLDWNR

SEQ ID NO: 904229 - protein, 9 aa, Homo Sapiens
EDSFSQPRG

SEQ ID NO: 904230 - protein, 9 aa, Homo Sapiens
HQLPPGQLH

SEQ ID NO: 904231 - protein, 9 aa, Homo Sapiens
KKQLRDVLQ

SEQ ID NO: 904232 - protein, 9 aa, Homo Sapiens
LVPSGLTAV

SEQ ID NO: 904233 - protein, 9 aa, Homo Sapiens
IEEEAWEDP

SEQ ID NO: 904234 - protein, 9 aa, Homo Sapiens
SSNIHRNRI

SEQ ID NO: 904235 - protein, 9 aa, Homo Sapiens
TAVPAVPLG

SEQ ID NO: 904236 - protein, 9 aa, Homo Sapiens
TQRLVVPAT

SEQ ID NO: 904237 - protein, 9 aa, Homo Sapiens
VSYLRNNCL

SEQ ID NO: 904238 - protein, 9 aa, Homo Sapiens
IETAYLIRH

SEQ ID NO: 904239 - protein, 9 aa, Homo Sapiens
ADESQNADV

SEQ ID NO: 904240 - protein, 9 aa, Homo Sapiens
SPTSAFPTV

SEQ ID NO: 904241 - protein, 9 aa, Homo Sapiens
YNDTPIVRT

SEQ ID NO: 904242 - protein, 9 aa, Homo Sapiens
RSKSIELES

SEQ ID NO: 904243 - protein, 9 aa, Homo Sapiens
RDASLAPPN

SEQ ID NO: 904244 - protein, 9 aa, Homo Sapiens
IHGGKHSEQ

SEQ ID NO: 904245 - protein, 9 aa, Homo Sapiens
GGSKAVVTL

SEQ ID NO: 904246 - protein, 9 aa, Homo Sapiens
FEPYLLDDP

SEQ ID NO: 904247 - protein, 9 aa, Homo Sapiens
PHSHLPRVV

SEQ ID NO: 904248 - protein, 9 aa, Homo Sapiens
QRRWRRQVS

SEQ ID NO: 904249 - protein, 9 aa, Homo Sapiens
HNQSCVVEF

SEQ ID NO: 904250 - protein, 9 aa, Homo Sapiens
GPPGPDGQP

SEQ ID NO: 904251 - protein, 9 aa, Homo Sapiens
ELLIRSLVV

SEQ ID NO: 904252 - protein, 9 aa, Homo Sapiens
QWHSQCLLQ

SEQ ID NO: 904253 - protein, 9 aa, Homo Sapiens
RPKETRSQH

SEQ ID NO: 904254 - protein, 9 aa, Homo Sapiens
EMYFYDSVS

SEQ ID NO: 904255 - protein, 9 aa, Homo Sapiens
GLQHSQDSR

SEQ ID NO: 904256 - protein, 9 aa, Homo Sapiens
DDWHTYHNE

SEQ ID NO: 904257 - protein, 9 aa, Homo Sapiens
VLYDPDLPR

SEQ ID NO: 904258 - protein, 9 aa, Homo Sapiens
TTPKQGGSA

SEQ ID NO: 904259 - protein, 9 aa, Homo Sapiens
EAVVIDPVL

SEQ ID NO: 904260 - protein, 9 aa, Homo Sapiens
SLDTSAMVY

SEQ ID NO: 904261 - protein, 9 aa, Homo Sapiens
EMNVDGDWT

SEQ ID NO: 904262 - protein, 9 aa, Homo Sapiens
RWHTIAPIG

SEQ ID NO: 904263 - protein, 9 aa, Homo Sapiens
KERMKEKRN

SEQ ID NO: 904264 - protein, 9 aa, Homo Sapiens
LLCQSGLPR

SEQ ID NO: 904265 - protein, 9 aa, Homo Sapiens
KLVVVGADG

SEQ ID NO: 904266 - protein, 9 aa, Homo Sapiens
SSLDWNRAC

SEQ ID NO: 904267 - protein, 9 aa, Homo Sapiens
QTAIRVADL

SEQ ID NO: 904268 - protein, 9 aa, Homo Sapiens
DWTPLEEPS

SEQ ID NO: 904269 - protein, 9 aa, Homo Sapiens
FLFYHAKTG

SEQ ID NO: 904270 - protein, 9 aa, Homo Sapiens
HSEPVHRPG

SEQ ID NO: 904271 - protein, 9 aa, Homo Sapiens
VQRVKDLVT

SEQ ID NO: 904272 - protein, 9 aa, Homo Sapiens
LTHTHTHRE

SEQ ID NO: 904273 - protein, 9 aa, Homo Sapiens
IVTPKSQYI

SEQ ID NO: 904274 - protein, 9 aa, Homo Sapiens
YFIKQISLN

SEQ ID NO: 904275 - protein, 9 aa, Homo Sapiens
TRTARSPLR

SEQ ID NO: 904276 - protein, 9 aa, Homo Sapiens
DVRLPFHTE

SEQ ID NO: 904277 - protein, 9 aa, Homo Sapiens
IIAIKEVYQ

SEQ ID NO: 904278 - protein, 9 aa, Homo Sapiens
QRVKDLVTA

SEQ ID NO: 904279 - protein, 9 aa, Homo Sapiens
EAQFVLERS

SEQ ID NO: 904280 - protein, 9 aa, Homo Sapiens
KQSNNKYVA

SEQ ID NO: 904281 - protein, 9 aa, Homo Sapiens
GANKPDGRP

SEQ ID NO: 904282 - protein, 9 aa, Homo Sapiens
AGANKPDGR

SEQ ID NO: 904283 - protein, 9 aa, Homo Sapiens
FEVQWQLAQ

SEQ ID NO: 904284 - protein, 9 aa, Homo Sapiens
ALLGAMTVD

SEQ ID NO: 904285 - protein, 9 aa, Homo Sapiens
KPVESMQTE

SEQ ID NO: 904286 - protein, 9 aa, Homo Sapiens
EVQWQLAQL

SEQ ID NO: 904287 - protein, 9 aa, Homo Sapiens
DTTSILLKL

SEQ ID NO: 904288 - protein, 9 aa, Homo Sapiens
KLCEFLRVE

SEQ ID NO: 904289 - protein, 9 aa, Homo Sapiens
RRLAAIPNV

SEQ ID NO: 904290 - protein, 9 aa, Homo Sapiens
YDSVSRDAA

SEQ ID NO: 904291 - protein, 9 aa, Homo Sapiens
LVNRLEEKR

SEQ ID NO: 904292 - protein, 9 aa, Homo Sapiens
PSGLTAVPA

SEQ ID NO: 904293 - protein, 9 aa, Homo Sapiens
YKLVVVGAC

SEQ ID NO: 904294 - protein, 9 aa, Homo Sapiens
AGQPNGGAE

SEQ ID NO: 904295 - protein, 9 aa, Homo Sapiens
QAQVDEGIP

SEQ ID NO: 904296 - protein, 9 aa, Homo Sapiens
SRGGSKAVV

SEQ ID NO: 904297 - protein, 9 aa, Homo Sapiens
QEACARTGG

SEQ ID NO: 904298 - protein, 9 aa, Homo Sapiens
LVVVGACGV

SEQ ID NO: 904299 - protein, 9 aa, Homo Sapiens
CSPSKAAVE

SEQ ID NO: 904300 - protein, 9 aa, Homo Sapiens
TQPVGVFVD

SEQ ID NO: 904301 - protein, 9 aa, Homo Sapiens
PTRAPKASQ

SEQ ID NO: 904302 - protein, 9 aa, Homo Sapiens
SAGTTPKQG

SEQ ID NO: 904303 - protein, 9 aa, Homo Sapiens
EFAHQQFWD

SEQ ID NO: 904304 - protein, 9 aa, Homo Sapiens
QKYWLTCFE

SEQ ID NO: 904305 - protein, 9 aa, Homo Sapiens
ELKLNICPL

SEQ ID NO: 904306 - protein, 9 aa, Homo Sapiens
WHQSEKANL

SEQ ID NO: 904307 - protein, 9 aa, Homo Sapiens
HGLEIFQHC

SEQ ID NO: 904308 - protein, 9 aa, Homo Sapiens
RNDYIVKHA

SEQ ID NO: 904309 - protein, 9 aa, Homo Sapiens
FTADSPNVM

SEQ ID NO: 904310 - protein, 9 aa, Homo Sapiens
EKLRKFRFL

SEQ ID NO: 904311 - protein, 9 aa, Homo Sapiens
CPMGTGSDS

SEQ ID NO: 904312 - protein, 9 aa, Homo Sapiens
TLSHSVGGP

SEQ ID NO: 904313 - protein, 9 aa, Homo Sapiens
IDRRWHQSE

SEQ ID NO: 904314 - protein, 9 aa, Homo Sapiens
EGLNKLTLS

SEQ ID NO: 904315 - protein, 9 aa, Homo Sapiens
ISTRGDFNL

SEQ ID NO: 904316 - protein, 9 aa, Homo Sapiens
TGSSPEKAT

SEQ ID NO: 904317 - protein, 9 aa, Homo Sapiens
LSPENLLSP

SEQ ID NO: 904318 - protein, 9 aa, Homo Sapiens
ENPYIPYIQ

SEQ ID NO: 904319 - protein, 9 aa, Homo Sapiens
GDSLETKEY

SEQ ID NO: 904320 - protein, 9 aa, Homo Sapiens
GSGQGPVME

SEQ ID NO: 904321 - protein, 9 aa, Homo Sapiens
YQKMSPKAT

SEQ ID NO: 904322 - protein, 9 aa, Homo Sapiens
MKKVAGERY

SEQ ID NO: 904323 - protein, 9 aa, Homo Sapiens
ERCEVDLAY

SEQ ID NO: 904324 - protein, 9 aa, Homo Sapiens
DLAYDLISD

SEQ ID NO: 904325 - protein, 9 aa, Homo Sapiens
IYFTADSPN

SEQ ID NO: 904326 - protein, 9 aa, Homo Sapiens
GSSPEKATF

SEQ ID NO: 904327 - protein, 9 aa, Homo Sapiens
EIFQHCDCA

SEQ ID NO: 904328 - protein, 9 aa, Homo Sapiens
LLTECVLTG

SEQ ID NO: 904329 - protein, 9 aa, Homo Sapiens
SPENLLSPS

SEQ ID NO: 904330 - protein, 9 aa, Homo Sapiens
KKKLLSGNK

SEQ ID NO: 904331 - protein, 9 aa, Homo Sapiens
TVYTACHHG

SEQ ID NO: 904332 - protein, 9 aa, Homo Sapiens
NHPFLFFIM

SEQ ID NO: 904333 - protein, 9 aa, Homo Sapiens
SIIYFTADS

SEQ ID NO: 904334 - protein, 9 aa, Homo Sapiens
RWHQSEKAN

SEQ ID NO: 904335 - protein, 9 aa, Homo Sapiens
YYEKGIMKK

SEQ ID NO: 904336 - protein, 9 aa, Homo Sapiens
SHGLEIFQH

SEQ ID NO: 904337 - protein, 9 aa, Homo Sapiens
VYTACHHGS

SEQ ID NO: 904338 - protein, 9 aa, Homo Sapiens
DSDVRILPP

SEQ ID NO: 904339 - protein, 9 aa, Homo Sapiens
KLNICPLLR

SEQ ID NO: 904340 - protein, 9 aa, Homo Sapiens
AFTQRSQLI

SEQ ID NO: 904341 - protein, 9 aa, Homo Sapiens
SLETKEYQK

SEQ ID NO: 904342 - protein, 9 aa, Homo Sapiens
SWIDRRWHQ

SEQ ID NO: 904343 - protein, 9 aa, Homo Sapiens
LKITDFGLV

SEQ ID NO: 904344 - protein, 9 aa, Homo Sapiens
RSQLILHHR

SEQ ID NO: 904345 - protein, 9 aa, Homo Sapiens
LTLSHSVGG

SEQ ID NO: 904346 - protein, 9 aa, Homo Sapiens
KKLLSGNKL

SEQ ID NO: 904347 - protein, 9 aa, Homo Sapiens
HPFLFFIMH

SEQ ID NO: 904348 - protein, 9 aa, Homo Sapiens
PLNLIPKSA

SEQ ID NO: 904349 - protein, 9 aa, Homo Sapiens
TDFGLVREW

SEQ ID NO: 904350 - protein, 9 aa, Homo Sapiens
RRWHQSEKA

SEQ ID NO: 904351 - protein, 9 aa, Homo Sapiens
GDFNLLGYE

SEQ ID NO: 904352 - protein, 9 aa, Homo Sapiens
LQEQKPLNL

SEQ ID NO: 904353 - protein, 9 aa, Homo Sapiens
IKPCFKGIL

SEQ ID NO: 904354 - protein, 9 aa, Homo Sapiens
RNVSLTLSH

SEQ ID NO: 904355 - protein, 9 aa, Homo Sapiens
NPYIPYIQD

SEQ ID NO: 904356 - protein, 9 aa, Homo Sapiens
KPCFKGILV

SEQ ID NO: 904357 - protein, 9 aa, Homo Sapiens
NKLTLSHCA

SEQ ID NO: 904358 - protein, 9 aa, Homo Sapiens
KGLRTLYSI

SEQ ID NO: 904359 - protein, 9 aa, Homo Sapiens
MHNESNSIL

SEQ ID NO: 904360 - protein, 9 aa, Homo Sapiens
KNTGSSPEK

SEQ ID NO: 904361 - protein, 9 aa, Homo Sapiens
AKRVHERAG

SEQ ID NO: 904362 - protein, 9 aa, Homo Sapiens
SLTLSHSVG

SEQ ID NO: 904363 - protein, 9 aa, Homo Sapiens
LETKEYQKM

SEQ ID NO: 904364 - protein, 9 aa, Homo Sapiens
ASWIDRRWH

SEQ ID NO: 904365 - protein, 9 aa, Homo Sapiens
IIYFTADSP

SEQ ID NO: 904366 - protein, 9 aa, Homo Sapiens
KDSIIYFTA

SEQ ID NO: 904367 - protein, 9 aa, Homo Sapiens
IVKHAKRVH

SEQ ID NO: 904368 - protein, 9 aa, Homo Sapiens
YIKPCFKGI

SEQ ID NO: 904369 - protein, 9 aa, Homo Sapiens
ENKSLKKKL

SEQ ID NO: 904370 - protein, 9 aa, Homo Sapiens
LAYDLISDI

SEQ ID NO: 904371 - protein, 9 aa, Homo Sapiens
PEDKKKHLF

SEQ ID NO: 904372 - protein, 9 aa, Homo Sapiens
ADSANSRNK

SEQ ID NO: 904373 - protein, 9 aa, Homo Sapiens
FIMHNESNS

SEQ ID NO: 904374 - protein, 9 aa, Homo Sapiens
TLLTECVLT

SEQ ID NO: 904375 - protein, 9 aa, Homo Sapiens
SLKKKLLSG

SEQ ID NO: 904376 - protein, 9 aa, Homo Sapiens
LKETNNAAI

SEQ ID NO: 904377 - protein, 9 aa, Homo Sapiens
MLGSGQGPV

SEQ ID NO: 904378 - protein, 9 aa, Homo Sapiens
QHCDCAKGL

SEQ ID NO: 904379 - protein, 9 aa, Homo Sapiens
VSLTLSHSV

SEQ ID NO: 904380 - protein, 9 aa, Homo Sapiens
TQEADSANS

SEQ ID NO: 904381 - protein, 9 aa, Homo Sapiens
MHGEGLNKL

SEQ ID NO: 904382 - protein, 9 aa, Homo Sapiens
EYHEKRMLG

SEQ ID NO: 904383 - protein, 9 aa, Homo Sapiens
LRKFRFLKE

SEQ ID NO: 904384 - protein, 9 aa, Homo Sapiens
REIKRRTLF

SEQ ID NO: 904385 - protein, 9 aa, Homo Sapiens
RMHGEGLNK

SEQ ID NO: 904386 - protein, 9 aa, Homo Sapiens
FRREIKRRT

SEQ ID NO: 904387 - protein, 9 aa, Homo Sapiens
CEHCDHRFY

SEQ ID NO: 904388 - protein, 9 aa, Homo Sapiens
DSLETKEYQ

SEQ ID NO: 904389 - protein, 9 aa, Homo Sapiens
FTQRSQLIL

SEQ ID NO: 904390 - protein, 9 aa, Homo Sapiens
EGTVYTACH

SEQ ID NO: 904391 - protein, 9 aa, Homo Sapiens
PYIPYIQDL

SEQ ID NO: 904392 - protein, 9 aa, Homo Sapiens
NTGSSPEKA

SEQ ID NO: 904393 - protein, 9 aa, Homo Sapiens
SLVADCHSV

SEQ ID NO: 904394 - protein, 9 aa, Homo Sapiens
TECVLTGFL

SEQ ID NO: 904395 - protein, 9 aa, Homo Sapiens
TAELSPENL

SEQ ID NO: 904396 - protein, 9 aa, Homo Sapiens
PKDSIIYFT

SEQ ID NO: 904397 - protein, 9 aa, Homo Sapiens
FGLVREWHR

SEQ ID NO: 904398 - protein, 9 aa, Homo Sapiens
IMKKVAGER

SEQ ID NO: 904399 - protein, 9 aa, Homo Sapiens
EKATFGGCH

SEQ ID NO: 904400 - protein, 9 aa, Homo Sapiens
CHSVINQAL

SEQ ID NO: 904401 - protein, 9 aa, Homo Sapiens
GIMKKVAGE

SEQ ID NO: 904402 - protein, 9 aa, Homo Sapiens
FEIENPYIP

SEQ ID NO: 904403 - protein, 9 aa, Homo Sapiens
IPYIQDLVT

SEQ ID NO: 904404 - protein, 9 aa, Homo Sapiens
EHCDHRFYT

SEQ ID NO: 904405 - protein, 9 aa, Homo Sapiens
IENPYIPYI

SEQ ID NO: 904406 - protein, 9 aa, Homo Sapiens
RTLFRSCFI

SEQ ID NO: 904407 - protein, 9 aa, Homo Sapiens
LSHSVGGPL

SEQ ID NO: 904408 - protein, 9 aa, Homo Sapiens
ADCHSVINQ

SEQ ID NO: 904409 - protein, 9 aa, Homo Sapiens
LEIFQHCDC

SEQ ID NO: 904410 - protein, 9 aa, Homo Sapiens
ATLLTECVL

SEQ ID NO: 904411 - protein, 9 aa, Homo Sapiens
NSRNKRKDW

SEQ ID NO: 904412 - protein, 9 aa, Homo Sapiens
FISTRGDFN

SEQ ID NO: 904413 - protein, 9 aa, Homo Sapiens
QKPLNLIPK

SEQ ID NO: 904414 - protein, 9 aa, Homo Sapiens
KEYQKMSPK

SEQ ID NO: 904415 - protein, 9 aa, Homo Sapiens
LNKLTLSHC

SEQ ID NO: 904416 - protein, 9 aa, Homo Sapiens
NICPLLRLV

SEQ ID NO: 904417 - protein, 9 aa, Homo Sapiens
DSIIYFTAD

SEQ ID NO: 904418 - protein, 9 aa, Homo Sapiens
LKKKLLSGN

SEQ ID NO: 904419 - protein, 9 aa, Homo Sapiens
SSPEKATFG

SEQ ID NO: 904420 - protein, 9 aa, Homo Sapiens
IKRRTLFRS

SEQ ID NO: 904421 - protein, 9 aa, Homo Sapiens
EIENPYIPY

SEQ ID NO: 904422 - protein, 9 aa, Homo Sapiens
DYIVKHAKR

SEQ ID NO: 904423 - protein, 9 aa, Homo Sapiens
QEADSANSR

SEQ ID NO: 904424 - protein, 9 aa, Homo Sapiens
SKRNVSLTL

SEQ ID NO: 904425 - protein, 9 aa, Homo Sapiens
DHRFYTRKD

SEQ ID NO: 904426 - protein, 9 aa, Homo Sapiens
VHYIKPCFK

SEQ ID NO: 904427 - protein, 9 aa, Homo Sapiens
HQCEHCDHR

SEQ ID NO: 904428 - protein, 9 aa, Homo Sapiens
FLKETNNAA

SEQ ID NO: 904429 - protein, 9 aa, Homo Sapiens
DKKKHLFIG

SEQ ID NO: 904430 - protein, 9 aa, Homo Sapiens
DFGLVREWH

SEQ ID NO: 904431 - protein, 9 aa, Homo Sapiens
TKEYQKMSP

SEQ ID NO: 904432 - protein, 9 aa, Homo Sapiens
HRFYTRKDV

SEQ ID NO: 904433 - protein, 9 aa, Homo Sapiens
GLNKLTLSH

SEQ ID NO: 904434 - protein, 9 aa, Homo Sapiens
LNICPLLRL

SEQ ID NO: 904435 - protein, 9 aa, Homo Sapiens
HQKFTHFFT

SEQ ID NO: 904436 - protein, 9 aa, Homo Sapiens
RREIKRRTL

SEQ ID NO: 904437 - protein, 9 aa, Homo Sapiens
GTGSDSDVR

SEQ ID NO: 904438 - protein, 9 aa, Homo Sapiens
KSLKKKLLS

SEQ ID NO: 904439 - protein, 9 aa, Homo Sapiens
KKHLFIGVS

SEQ ID NO: 904440 - protein, 9 aa, Homo Sapiens
EKRMLGSGQ

SEQ ID NO: 904441 - protein, 9 aa, Homo Sapiens
YRMHGEGLN

SEQ ID NO: 904442 - protein, 9 aa, Homo Sapiens
HCDHRFYTR

SEQ ID NO: 904443 - protein, 9 aa, Homo Sapiens
HHGSKAGIG

SEQ ID NO: 904444 - protein, 9 aa, Homo Sapiens
EIKRRTLFR

SEQ ID NO: 904445 - protein, 9 aa, Homo Sapiens
RCEVDLAYD

SEQ ID NO: 904446 - protein, 9 aa, Homo Sapiens
GLVREWHRT

SEQ ID NO: 904447 - protein, 9 aa, Homo Sapiens
RRTLFRSCF

SEQ ID NO: 904448 - protein, 9 aa, Homo Sapiens
LVREWHRTT

SEQ ID NO: 904449 - protein, 9 aa, Homo Sapiens
KAFTQRSQL

SEQ ID NO: 904450 - protein, 9 aa, Homo Sapiens
ICPLLRLVC

SEQ ID NO: 904451 - protein, 9 aa, Homo Sapiens
ELSPENLLS

SEQ ID NO: 904452 - protein, 9 aa, Homo Sapiens
LTECVLTGF

SEQ ID NO: 904453 - protein, 9 aa, Homo Sapiens
LVADCHSVI

SEQ ID NO: 904454 - protein, 9 aa, Homo Sapiens
AYDLISDIF

SEQ ID NO: 904455 - protein, 9 aa, Homo Sapiens
LGSGQGPVM

SEQ ID NO: 904456 - protein, 9 aa, Homo Sapiens
IMHNESNSI

SEQ ID NO: 904457 - protein, 9 aa, Homo Sapiens
KLRKFRFLK

SEQ ID NO: 904458 - protein, 9 aa, Homo Sapiens
ESLVADCHS

SEQ ID NO: 904459 - protein, 9 aa, Homo Sapiens
KEELKLNIC

SEQ ID NO: 904460 - protein, 9 aa, Homo Sapiens
KRMLGSGQG

SEQ ID NO: 904461 - protein, 9 aa, Homo Sapiens
ENLLSPSSF

SEQ ID NO: 904462 - protein, 9 aa, Homo Sapiens
KHLFIGVSS

SEQ ID NO: 904463 - protein, 9 aa, Homo Sapiens
WEESLVADC

SEQ ID NO: 904464 - protein, 9 aa, Homo Sapiens
ANSRNKRKD

SEQ ID NO: 904465 - protein, 9 aa, Homo Sapiens
YIVKHAKRV

SEQ ID NO: 904466 - protein, 9 aa, Homo Sapiens
VKHAKRVHE

SEQ ID NO: 904467 - protein, 9 aa, Homo Sapiens
YIPYIQDLV

SEQ ID NO: 904468 - protein, 9 aa, Homo Sapiens
GSDSDVRIL

SEQ ID NO: 904469 - protein, 9 aa, Homo Sapiens
GKAFTQRSQ

SEQ ID NO: 904470 - protein, 9 aa, Homo Sapiens
YEKGIMKKV

SEQ ID NO: 904471 - protein, 9 aa, Homo Sapiens
DSANSRNKR

SEQ ID NO: 904472 - protein, 9 aa, Homo Sapiens
CHHGSKAGI

SEQ ID NO: 904473 - protein, 9 aa, Homo Sapiens
LKGLRTLYS

SEQ ID NO: 904474 - protein, 9 aa, Homo Sapiens
GLEIFQHCD

SEQ ID NO: 904475 - protein, 9 aa, Homo Sapiens
YVHYIKPCF

SEQ ID NO: 904476 - protein, 9 aa, Homo Sapiens
PENLLSPSS

SEQ ID NO: 904477 - protein, 9 aa, Homo Sapiens
GEGLNKLTL

SEQ ID NO: 904478 - protein, 9 aa, Homo Sapiens
FFIMHNESN

SEQ ID NO: 904479 - protein, 9 aa, Homo Sapiens
KRRTLFRSC

SEQ ID NO: 904480 - protein, 9 aa, Homo Sapiens
EKGIMKKVA

SEQ ID NO: 904481 - protein, 9 aa, Homo Sapiens
FQHCDCAKG

SEQ ID NO: 904482 - protein, 9 aa, Homo Sapiens
WIDRRWHQS

SEQ ID NO: 904483 - protein, 9 aa, Homo Sapiens
EQKPLNLIP

SEQ ID NO: 904484 - protein, 9 aa, Homo Sapiens
FIGVSSDRG

SEQ ID NO: 904485 - protein, 9 aa, Homo Sapiens
KGIMKKVAG

SEQ ID NO: 904486 - protein, 9 aa, Homo Sapiens
PFLFFIMHN

SEQ ID NO: 904487 - protein, 9 aa, Homo Sapiens
PMGTGSDSD

SEQ ID NO: 904488 - protein, 9 aa, Homo Sapiens
HYIKPCFKG

SEQ ID NO: 904489 - protein, 9 aa, Homo Sapiens
LFFIMHNES

SEQ ID NO: 904490 - protein, 9 aa, Homo Sapiens
TLFRSCFIL

SEQ ID NO: 904491 - protein, 9 aa, Homo Sapiens
NDYVHYIKP

SEQ ID NO: 904492 - protein, 9 aa, Homo Sapiens
EVDLAYDLI

SEQ ID NO: 904493 - protein, 9 aa, Homo Sapiens
YFTADSPNV

SEQ ID NO: 904494 - protein, 9 aa, Homo Sapiens
MGTGSDSDV

SEQ ID NO: 904495 - protein, 9 aa, Homo Sapiens
ITDFGLVRE

SEQ ID NO: 904496 - protein, 9 aa, Homo Sapiens
NKSLKKKLL

SEQ ID NO: 904497 - protein, 9 aa, Homo Sapiens
EYQKMSPKA

SEQ ID NO: 904498 - protein, 9 aa, Homo Sapiens
VADCHSVIN

SEQ ID NO: 904499 - protein, 9 aa, Homo Sapiens
KTAELSPEN

SEQ ID NO: 904500 - protein, 9 aa, Homo Sapiens
NLLGYEVVE

SEQ ID NO: 904501 - protein, 9 aa, Homo Sapiens
SPEKATFGG

SEQ ID NO: 904502 - protein, 9 aa, Homo Sapiens
LIPKSAETL

SEQ ID NO: 904503 - protein, 9 aa, Homo Sapiens
DCHSVINQA

SEQ ID NO: 904504 - protein, 9 aa, Homo Sapiens
PEKATFGGC

SEQ ID NO: 904505 - protein, 9 aa, Homo Sapiens
NVSLTLSHS

SEQ ID NO: 904506 - protein, 9 aa, Homo Sapiens
YHEKRMLGS

SEQ ID NO: 904507 - protein, 9 aa, Homo Sapiens
VREWHRTTK

SEQ ID NO: 904508 - protein, 9 aa, Homo Sapiens
KKKHLFIGV

SEQ ID NO: 904509 - protein, 9 aa, Homo Sapiens
QCEHCDHRF

SEQ ID NO: 904510 - protein, 9 aa, Homo Sapiens
KPLNLIPKS

SEQ ID NO: 904511 - protein, 9 aa, Homo Sapiens
EESLVADCH

SEQ ID NO: 904512 - protein, 9 aa, Homo Sapiens
NLIPKSAET

SEQ ID NO: 904513 - protein, 9 aa, Homo Sapiens
GTVYTACHH

SEQ ID NO: 904514 - protein, 9 aa, Homo Sapiens
VASWIDRRW

SEQ ID NO: 904515 - protein, 9 aa, Homo Sapiens
KHAKRVHER

SEQ ID NO: 904516 - protein, 9 aa, Homo Sapiens
KRNVSLTLS

SEQ ID NO: 904517 - protein, 9 aa, Homo Sapiens
KFRFLKETN

SEQ ID NO: 904518 - protein, 9 aa, Homo Sapiens
KHQCEHCDH

SEQ ID NO: 904519 - protein, 9 aa, Homo Sapiens
SFEIENPYI

SEQ ID NO: 904520 - protein, 9 aa, Homo Sapiens
CDHRFYTRK

SEQ ID NO: 904521 - protein, 9 aa, Homo Sapiens
KKVAGERYV

SEQ ID NO: 904522 - protein, 9 aa, Homo Sapiens
HEKRMLGSG

SEQ ID NO: 904523 - protein, 9 aa, Homo Sapiens
QNENKSLKK

SEQ ID NO: 904524 - protein, 9 aa, Homo Sapiens
ECVLTGFLH

SEQ ID NO: 904525 - protein, 9 aa, Homo Sapiens
ETKEYQKMS

SEQ ID NO: 904526 - protein, 9 aa, Homo Sapiens
SDVRILPPS

SEQ ID NO: 904527 - protein, 9 aa, Homo Sapiens
LFIGVSSDR

SEQ ID NO: 904528 - protein, 9 aa, Homo Sapiens
VDLAYDLIS

SEQ ID NO: 904529 - protein, 9 aa, Homo Sapiens
QEQKPLNLI

SEQ ID NO: 904530 - protein, 9 aa, Homo Sapiens
HLFIGVSSD

SEQ ID NO: 904531 - protein, 9 aa, Homo Sapiens
SDSDVRILP

SEQ ID NO: 904532 - protein, 9 aa, Homo Sapiens
NENKSLKKK

SEQ ID NO: 904533 - protein, 9 aa, Homo Sapiens
KITDFGLVR

SEQ ID NO: 904534 - protein, 9 aa, Homo Sapiens
TRGDFNLLG

SEQ ID NO: 904535 - protein, 9 aa, Homo Sapiens
STRGDFNLL

SEQ ID NO: 904536 - protein, 9 aa, Homo Sapiens
AELSPENLL

SEQ ID NO: 904537 - protein, 9 aa, Homo Sapiens
YYYEKGIMK

SEQ ID NO: 904538 - protein, 9 aa, Homo Sapiens
IFQHCDCAK

SEQ ID NO: 904539 - protein, 9 aa, Homo Sapiens
LNLIPKSAE

SEQ ID NO: 904540 - protein, 9 aa, Homo Sapiens
LKLNICPLL

SEQ ID NO: 904541 - protein, 9 aa, Homo Sapiens
FRFLKETNN

SEQ ID NO: 904542 - protein, 9 aa, Homo Sapiens
EELKLNICP

SEQ ID NO: 904543 - protein, 9 aa, Homo Sapiens
FNLLGYEVV

SEQ ID NO: 904544 - protein, 9 aa, Homo Sapiens
FPKDSIIYF

SEQ ID NO: 904545 - protein, 9 aa, Homo Sapiens
ALKGLRTLY

SEQ ID NO: 904546 - protein, 9 aa, Homo Sapiens
SRNKRKDWN

SEQ ID NO: 904547 - protein, 9 aa, Homo Sapiens
HCDCAKGLS

SEQ ID NO: 904548 - protein, 9 aa, Homo Sapiens
RKFRFLKET

SEQ ID NO: 904549 - protein, 9 aa, Homo Sapiens
QRSQLILHH

SEQ ID NO: 904550 - protein, 9 aa, Homo Sapiens
NDYIVKHAK

SEQ ID NO: 904551 - protein, 9 aa, Homo Sapiens
YDLISDIFT

SEQ ID NO: 904552 - protein, 9 aa, Homo Sapiens
CPLLRLVCK

SEQ ID NO: 904553 - protein, 9 aa, Homo Sapiens
ECGKAFTQR

SEQ ID NO: 904554 - protein, 9 aa, Homo Sapiens
FLFFIMHNE

SEQ ID NO: 904555 - protein, 9 aa, Homo Sapiens
ACHHGSKAG

SEQ ID NO: 904556 - protein, 9 aa, Homo Sapiens
SANSRNKRK

SEQ ID NO: 904557 - protein, 9 aa, Homo Sapiens
EDKKKHLFI

SEQ ID NO: 904558 - protein, 9 aa, Homo Sapiens
RMLGSGQGP

SEQ ID NO: 904559 - protein, 9 aa, Homo Sapiens
RFLKETNNA

SEQ ID NO: 904560 - protein, 9 aa, Homo Sapiens
YTACHHGSK

SEQ ID NO: 904561 - protein, 9 aa, Homo Sapiens
RGDFNLLGY

SEQ ID NO: 904562 - protein, 9 aa, Homo Sapiens
SKTAELSPE

SEQ ID NO: 904563 - protein, 9 aa, Homo Sapiens
DYVHYIKPC

SEQ ID NO: 904564 - protein, 9 aa, Homo Sapiens
HAKRVHERA

SEQ ID NO: 904565 - protein, 9 aa, Homo Sapiens
CVLTGFLHQ

SEQ ID NO: 904566 - protein, 9 aa, Homo Sapiens
CEVDLAYDL

SEQ ID NO: 904567 - protein, 9 aa, Homo Sapiens
YNDYVHYIK

SEQ ID NO: 904568 - protein, 9 aa, Homo Sapiens
TACHHGSKA

SEQ ID NO: 904569 - protein, 9 aa, Homo Sapiens
NATLLTECV

SEQ ID NO: 904570 - protein, 9 aa, Homo Sapiens
ENATLLTEC

SEQ ID NO: 904571 - protein, 9 aa, Homo Sapiens
DFNLLGYEV

SEQ ID NO: 904572 - protein, 9 aa, Homo Sapiens
TQRSQLILH

SEQ ID NO: 904573 - protein, 9 aa, Homo Sapiens
EADSANSRN

SEQ ID NO: 904574 - protein, 9 aa, Homo Sapiens
DRRWHQSEK

SEQ ID NO: 904575 - protein, 9 aa, Homo Sapiens
RHQKFTHFF

SEQ ID NO: 904576 - protein, 9 aa, Homo Sapiens
HGEGLNKLT

SEQ ID NO: 904577 - protein, 9 aa, Homo Sapiens
KATFGGCHS

SEQ ID NO: 904578 - protein, 9 aa, Homo Sapiens
TGSDSDVRI

SEQ ID NO: 904579 - protein, 9 aa, Homo Sapiens
APPGLNRKN

SEQ ID NO: 904580 - protein, 9 aa, Homo Sapiens
LLCNFAPGV

SEQ ID NO: 904581 - protein, 9 aa, Homo Sapiens
AEKITLLWQ

SEQ ID NO: 904582 - protein, 9 aa, Homo Sapiens
LFLSFLFFS

SEQ ID NO: 904583 - protein, 9 aa, Homo Sapiens
GMLYHYKVQ

SEQ ID NO: 904584 - protein, 9 aa, Homo Sapiens
PRSWDYRYA

SEQ ID NO: 904585 - protein, 9 aa, Homo Sapiens
HIKQDERVM

SEQ ID NO: 904586 - protein, 9 aa, Homo Sapiens
YILDRRWMP

SEQ ID NO: 904587 - protein, 9 aa, Homo Sapiens
ECNDSGDDC

SEQ ID NO: 904588 - protein, 9 aa, Homo Sapiens
ISPEGTAKI

SEQ ID NO: 904589 - protein, 9 aa, Homo Sapiens
EMMLLSIGA

SEQ ID NO: 904590 - protein, 9 aa, Homo Sapiens
SPHGHPKSH

SEQ ID NO: 904591 - protein, 9 aa, Homo Sapiens
CQKISPEGT

SEQ ID NO: 904592 - protein, 9 aa, Homo Sapiens
KIIKYIWRI

SEQ ID NO: 904593 - protein, 9 aa, Homo Sapiens
GPGGPVGEP

SEQ ID NO: 904594 - protein, 9 aa, Homo Sapiens
EERAAATQP

SEQ ID NO: 904595 - protein, 9 aa, Homo Sapiens
FFSETCYTL

SEQ ID NO: 904596 - protein, 9 aa, Homo Sapiens
HSVEKQDIA

SEQ ID NO: 904597 - protein, 9 aa, Homo Sapiens
YQKIIKYIW

SEQ ID NO: 904598 - protein, 9 aa, Homo Sapiens
RKIQIGHVL

SEQ ID NO: 904599 - protein, 9 aa, Homo Sapiens
VRPFTMFFS

SEQ ID NO: 904600 - protein, 9 aa, Homo Sapiens
VMMGQNGNL

SEQ ID NO: 904601 - protein, 9 aa, Homo Sapiens
YHEVMNLKP

SEQ ID NO: 904602 - protein, 9 aa, Homo Sapiens
RLDRMFNKM

SEQ ID NO: 904603 - protein, 9 aa, Homo Sapiens
LVDLRSKCT

SEQ ID NO: 904604 - protein, 9 aa, Homo Sapiens
VDIRGYGGT

SEQ ID NO: 904605 - protein, 9 aa, Homo Sapiens
PIPLQFYLL

SEQ ID NO: 904606 - protein, 9 aa, Homo Sapiens
GRRAWPHAW

SEQ ID NO: 904607 - protein, 9 aa, Homo Sapiens
ISLSRKIQI

SEQ ID NO: 904608 - protein, 9 aa, Homo Sapiens
SRKIQIGHV

SEQ ID NO: 904609 - protein, 9 aa, Homo Sapiens
IKLFELSLQ

SEQ ID NO: 904610 - protein, 9 aa, Homo Sapiens
SHAASQPPL

SEQ ID NO: 904611 - protein, 9 aa, Homo Sapiens
SSNEEYVRM

SEQ ID NO: 904612 - protein, 9 aa, Homo Sapiens
SPEGTAKIQ

SEQ ID NO: 904613 - protein, 9 aa, Homo Sapiens
VGGRRAWPH

SEQ ID NO: 904614 - protein, 9 aa, Homo Sapiens
EVMNLKPEN

SEQ ID NO: 904615 - protein, 9 aa, Homo Sapiens
CPDTRGHAH

SEQ ID NO: 904616 - protein, 9 aa, Homo Sapiens
EEEEASQQF

SEQ ID NO: 904617 - protein, 9 aa, Homo Sapiens
REHKRMHDL

SEQ ID NO: 904618 - protein, 9 aa, Homo Sapiens
NEEYVRMLL

SEQ ID NO: 904619 - protein, 9 aa, Homo Sapiens
PWQMRDVSC

SEQ ID NO: 904620 - protein, 9 aa, Homo Sapiens
EEASQQFLE

SEQ ID NO: 904621 - protein, 9 aa, Homo Sapiens
SIFCCKTPS

SEQ ID NO: 904622 - protein, 9 aa, Homo Sapiens
GFKHERLVW

SEQ ID NO: 904623 - protein, 9 aa, Homo Sapiens
DEEEEASQQ

SEQ ID NO: 904624 - protein, 9 aa, Homo Sapiens
TESSNEEYV

SEQ ID NO: 904625 - protein, 9 aa, Homo Sapiens
QPILLKLEA

SEQ ID NO: 904626 - protein, 9 aa, Homo Sapiens
PLAFKHTVV

SEQ ID NO: 904627 - protein, 9 aa, Homo Sapiens
RKGAQLGGG

SEQ ID NO: 904628 - protein, 9 aa, Homo Sapiens
VFLMGATTQ

SEQ ID NO: 904629 - protein, 9 aa, Homo Sapiens
RRTKTEKKI

SEQ ID NO: 904630 - protein, 9 aa, Homo Sapiens
LMGATTQDT

SEQ ID NO: 904631 - protein, 9 aa, Homo Sapiens
KEDQEALCL

SEQ ID NO: 904632 - protein, 9 aa, Homo Sapiens
MMLLSIGAP

SEQ ID NO: 904633 - protein, 9 aa, Homo Sapiens
NRVYFARVH

SEQ ID NO: 904634 - protein, 9 aa, Homo Sapiens
ERVMMGQNG

SEQ ID NO: 904635 - protein, 9 aa, Homo Sapiens
ICEEMYPDI

SEQ ID NO: 904636 - protein, 9 aa, Homo Sapiens
VKVMHKLSN

SEQ ID NO: 904637 - protein, 9 aa, Homo Sapiens
GPNEIDHFF

SEQ ID NO: 904638 - protein, 9 aa, Homo Sapiens
ANELASQDG

SEQ ID NO: 904639 - protein, 9 aa, Homo Sapiens
CSRIFTSDC

SEQ ID NO: 904640 - protein, 9 aa, Homo Sapiens
MSREGAGAV

SEQ ID NO: 904641 - protein, 9 aa, Homo Sapiens
RKNSRSTLS

SEQ ID NO: 904642 - protein, 9 aa, Homo Sapiens
TKTEKKILE

SEQ ID NO: 904643 - protein, 9 aa, Homo Sapiens
FHNVLKEDQ

SEQ ID NO: 904644 - protein, 9 aa, Homo Sapiens
PINCPGDKI

SEQ ID NO: 904645 - protein, 9 aa, Homo Sapiens
DQEALCLDL

SEQ ID NO: 904646 - protein, 9 aa, Homo Sapiens
EEHTKFLNS

SEQ ID NO: 904647 - protein, 9 aa, Homo Sapiens
PPPSHAASQ

SEQ ID NO: 904648 - protein, 9 aa, Homo Sapiens
AAHTHSNTT

SEQ ID NO: 904649 - protein, 9 aa, Homo Sapiens
TLLWQPPAD

SEQ ID NO: 904650 - protein, 9 aa, Homo Sapiens
WMPYGGRGD

SEQ ID NO: 904651 - protein, 9 aa, Homo Sapiens
SSGFKHERL

SEQ ID NO: 904652 - protein, 9 aa, Homo Sapiens
HKLSNSNRH

SEQ ID NO: 904653 - protein, 9 aa, Homo Sapiens
YHYKVQVEG

SEQ ID NO: 904654 - protein, 9 aa, Homo Sapiens
NRKNSRSTL

SEQ ID NO: 904655 - protein, 9 aa, Homo Sapiens
AAATQPRQK

SEQ ID NO: 904656 - protein, 9 aa, Homo Sapiens
GPRGDIGSP

SEQ ID NO: 904657 - protein, 9 aa, Homo Sapiens
QKISPEGTA

SEQ ID NO: 904658 - protein, 9 aa, Homo Sapiens
NSRSTLSLP

SEQ ID NO: 904659 - protein, 9 aa, Homo Sapiens
RNPKLVVTQ

SEQ ID NO: 904660 - protein, 9 aa, Homo Sapiens
HNGHRCFYE

SEQ ID NO: 904661 - protein, 9 aa, Homo Sapiens
NSLKRIGTE

SEQ ID NO: 904662 - protein, 9 aa, Homo Sapiens
LLWQPPADD

SEQ ID NO: 904663 - protein, 9 aa, Homo Sapiens
NVLKEDQEA

SEQ ID NO: 904664 - protein, 9 aa, Homo Sapiens
RYNGLNQCL

SEQ ID NO: 904665 - protein, 9 aa, Homo Sapiens
EEEASQQFL

SEQ ID NO: 904666 - protein, 9 aa, Homo Sapiens
RAVEEAFAR

SEQ ID NO: 904667 - protein, 9 aa, Homo Sapiens
KEWLLAIRR

SEQ ID NO: 904668 - protein, 9 aa, Homo Sapiens
IGWQRRRQS

SEQ ID NO: 904669 - protein, 9 aa, Homo Sapiens
ELSLQPPVM

SEQ ID NO: 904670 - protein, 9 aa, Homo Sapiens
AISFLSVKR

SEQ ID NO: 904671 - protein, 9 aa, Homo Sapiens
KIQIGHVLC

SEQ ID NO: 904672 - protein, 9 aa, Homo Sapiens
DERVMMGQN

SEQ ID NO: 904673 - protein, 9 aa, Homo Sapiens
LTIHSVEKQ

SEQ ID NO: 904674 - protein, 9 aa, Homo Sapiens
QRRRQSIRC

SEQ ID NO: 904675 - protein, 9 aa, Homo Sapiens
PDTRGHAHR

SEQ ID NO: 904676 - protein, 9 aa, Homo Sapiens
TSTLTIHSV

SEQ ID NO: 904677 - protein, 9 aa, Homo Sapiens
SFCGPNEID

SEQ ID NO: 904678 - protein, 9 aa, Homo Sapiens
SRIFTSDCL

SEQ ID NO: 904679 - protein, 9 aa, Homo Sapiens
GDDCTHSST

SEQ ID NO: 904680 - protein, 9 aa, Homo Sapiens
TISEAIVAK

SEQ ID NO: 904681 - protein, 9 aa, Homo Sapiens
TAKIQLQLV

SEQ ID NO: 904682 - protein, 9 aa, Homo Sapiens
HKRMHDLNL

SEQ ID NO: 904683 - protein, 9 aa, Homo Sapiens
LFYQKIIKY

SEQ ID NO: 904684 - protein, 9 aa, Homo Sapiens
PLLCNFAPG

SEQ ID NO: 904685 - protein, 9 aa, Homo Sapiens
NEELWPIPL

SEQ ID NO: 904686 - protein, 9 aa, Homo Sapiens
TSDCLLVHQ

SEQ ID NO: 904687 - protein, 9 aa, Homo Sapiens
YRTQSPHGH

SEQ ID NO: 904688 - protein, 9 aa, Homo Sapiens
LCNFAPGVS

SEQ ID NO: 904689 - protein, 9 aa, Homo Sapiens
EADVKKLAE

SEQ ID NO: 904690 - protein, 9 aa, Homo Sapiens
RVYFARVHG

SEQ ID NO: 904691 - protein, 9 aa, Homo Sapiens
HRLLTVAIG

SEQ ID NO: 904692 - protein, 9 aa, Homo Sapiens
SKSADNCFQ

SEQ ID NO: 904693 - protein, 9 aa, Homo Sapiens
CFQRTNSED

SEQ ID NO: 904694 - protein, 9 aa, Homo Sapiens
PILLKLEAP

SEQ ID NO: 904695 - protein, 9 aa, Homo Sapiens
KPENTLDQH

SEQ ID NO: 904696 - protein, 9 aa, Homo Sapiens
HPVASTLGA

SEQ ID NO: 904697 - protein, 9 aa, Homo Sapiens
TIQPVLWSC

SEQ ID NO: 904698 - protein, 9 aa, Homo Sapiens
APAFTQTTY

SEQ ID NO: 904699 - protein, 9 aa, Homo Sapiens
WQRRRQSIR

SEQ ID NO: 904700 - protein, 9 aa, Homo Sapiens
SRTFPVPVT

SEQ ID NO: 904701 - protein, 9 aa, Homo Sapiens
EGTAKIQLQ

SEQ ID NO: 904702 - protein, 9 aa, Homo Sapiens
SGDDCTHSS

SEQ ID NO: 904703 - protein, 9 aa, Homo Sapiens
SADNCFQRT

SEQ ID NO: 904704 - protein, 9 aa, Homo Sapiens
VGEPGKGGA

SEQ ID NO: 904705 - protein, 9 aa, Homo Sapiens
RSKSADNCF

SEQ ID NO: 904706 - protein, 9 aa, Homo Sapiens
KQKLKKRRG

SEQ ID NO: 904707 - protein, 9 aa, Homo Sapiens
VQPWQMRDV

SEQ ID NO: 904708 - protein, 9 aa, Homo Sapiens
ASLNYPSHC

SEQ ID NO: 904709 - protein, 9 aa, Homo Sapiens
DFHNVLKED

SEQ ID NO: 904710 - protein, 9 aa, Homo Sapiens
CEEMYPDIL

SEQ ID NO: 904711 - protein, 9 aa, Homo Sapiens
NFAPGVSLG

SEQ ID NO: 904712 - protein, 9 aa, Homo Sapiens
DRRWMPYGG

SEQ ID NO: 904713 - protein, 9 aa, Homo Sapiens
LINPLIYSL

SEQ ID NO: 904714 - protein, 9 aa, Homo Sapiens
INGREHKRM

SEQ ID NO: 904715 - protein, 9 aa, Homo Sapiens
SKGCTVVGG

SEQ ID NO: 904716 - protein, 9 aa, Homo Sapiens
ISEAIVAKE

SEQ ID NO: 904717 - protein, 9 aa, Homo Sapiens
FLMGATTQD

SEQ ID NO: 904718 - protein, 9 aa, Homo Sapiens
RAWPHAWPF

SEQ ID NO: 904719 - protein, 9 aa, Homo Sapiens
VMNLKPENT

SEQ ID NO: 904720 - protein, 9 aa, Homo Sapiens
HSVSRTFPV

SEQ ID NO: 904721 - protein, 9 aa, Homo Sapiens
QIGHVLCLM

SEQ ID NO: 904722 - protein, 9 aa, Homo Sapiens
VMHKLSNSN

SEQ ID NO: 904723 - protein, 9 aa, Homo Sapiens
RQSIRCPCT

SEQ ID NO: 904724 - protein, 9 aa, Homo Sapiens
FTQTTYTLF

SEQ ID NO: 904725 - protein, 9 aa, Homo Sapiens
HYKVQVEGG

SEQ ID NO: 904726 - protein, 9 aa, Homo Sapiens
AHTHSNTTI

SEQ ID NO: 904727 - protein, 9 aa, Homo Sapiens
YTLLTPLIN

SEQ ID NO: 904728 - protein, 9 aa, Homo Sapiens
KLFELSLQP

SEQ ID NO: 904729 - protein, 9 aa, Homo Sapiens
LLKLEAPLK

SEQ ID NO: 904730 - protein, 9 aa, Homo Sapiens
EKKILEPKW

SEQ ID NO: 904731 - protein, 9 aa, Homo Sapiens
SLKRIGTES

SEQ ID NO: 904732 - protein, 9 aa, Homo Sapiens
THSNTTISL

SEQ ID NO: 904733 - protein, 9 aa, Homo Sapiens
RYGVSLAWY

SEQ ID NO: 904734 - protein, 9 aa, Homo Sapiens
VLWSCMPNS

SEQ ID NO: 904735 - protein, 9 aa, Homo Sapiens
IINEELWPI

SEQ ID NO: 904736 - protein, 9 aa, Homo Sapiens
LLPRGEEHT

SEQ ID NO: 904737 - protein, 9 aa, Homo Sapiens
SEYLKTKKQ

SEQ ID NO: 904738 - protein, 9 aa, Homo Sapiens
LYWTLNRRR

SEQ ID NO: 904739 - protein, 9 aa, Homo Sapiens
SPITTPTIV

SEQ ID NO: 904740 - protein, 9 aa, Homo Sapiens
LKTKKQTPN

SEQ ID NO: 904741 - protein, 9 aa, Homo Sapiens
RGYGGTDVD

SEQ ID NO: 904742 - protein, 9 aa, Homo Sapiens
FHNGHRCFY

SEQ ID NO: 904743 - protein, 9 aa, Homo Sapiens
KMHKMPTLR

SEQ ID NO: 904744 - protein, 9 aa, Homo Sapiens
GLYWTLNRR

SEQ ID NO: 904745 - protein, 9 aa, Homo Sapiens
SGFKHERLV

SEQ ID NO: 904746 - protein, 9 aa, Homo Sapiens
SVDDQKHPV

SEQ ID NO: 904747 - protein, 9 aa, Homo Sapiens
HCRANELAS

SEQ ID NO: 904748 - protein, 9 aa, Homo Sapiens
YGVSLAWYP

SEQ ID NO: 904749 - protein, 9 aa, Homo Sapiens
FQCFRATED

SEQ ID NO: 904750 - protein, 9 aa, Homo Sapiens
WVRPFTMFF

SEQ ID NO: 904751 - protein, 9 aa, Homo Sapiens
NDSGDDCTH

SEQ ID NO: 904752 - protein, 9 aa, Homo Sapiens
LPRSWDYRY

SEQ ID NO: 904753 - protein, 9 aa, Homo Sapiens
LPGLFSRHC

SEQ ID NO: 904754 - protein, 9 aa, Homo Sapiens
PNSLKRIGT

SEQ ID NO: 904755 - protein, 9 aa, Homo Sapiens
RSWDYRYAS

SEQ ID NO: 904756 - protein, 9 aa, Homo Sapiens
RPLLCNFAP

SEQ ID NO: 904757 - protein, 9 aa, Homo Sapiens
HVHSQTMDK

SEQ ID NO: 904758 - protein, 9 aa, Homo Sapiens
NCFQRTNSE

SEQ ID NO: 904759 - protein, 9 aa, Homo Sapiens
VDLRSKCTD

SEQ ID NO: 904760 - protein, 9 aa, Homo Sapiens
HTFCQLDRL

SEQ ID NO: 904761 - protein, 9 aa, Homo Sapiens
FSGLSLPRS

SEQ ID NO: 904762 - protein, 9 aa, Homo Sapiens
LFELSLQPP

SEQ ID NO: 904763 - protein, 9 aa, Homo Sapiens
DIRGYGGTD

SEQ ID NO: 904764 - protein, 9 aa, Homo Sapiens
STSTLTIHS

SEQ ID NO: 904765 - protein, 9 aa, Homo Sapiens
SNEEYVRML

SEQ ID NO: 904766 - protein, 9 aa, Homo Sapiens
FVPALIMLI

SEQ ID NO: 904767 - protein, 9 aa, Homo Sapiens
AVPLWVRPF

SEQ ID NO: 904768 - protein, 9 aa, Homo Sapiens
PFECNDSGD

SEQ ID NO: 904769 - protein, 9 aa, Homo Sapiens
FHTFCQLDR

SEQ ID NO: 904770 - protein, 9 aa, Homo Sapiens
ALPSRDTAV

SEQ ID NO: 904771 - protein, 9 aa, Homo Sapiens
MGMLYHYKV

SEQ ID NO: 904772 - protein, 9 aa, Homo Sapiens
SPRRPLLCN

SEQ ID NO: 904773 - protein, 9 aa, Homo Sapiens
LMEASLNYP

SEQ ID NO: 904774 - protein, 9 aa, Homo Sapiens
TISLSRKIQ

SEQ ID NO: 904775 - protein, 9 aa, Homo Sapiens
MDDKQLQIS

SEQ ID NO: 904776 - protein, 9 aa, Homo Sapiens
DPIKLFELS

SEQ ID NO: 904777 - protein, 9 aa, Homo Sapiens
IGHVLCLMP

SEQ ID NO: 904778 - protein, 9 aa, Homo Sapiens
DCLLVHQRS

SEQ ID NO: 904779 - protein, 9 aa, Homo Sapiens
KEVRVDYVG

SEQ ID NO: 904780 - protein, 9 aa, Homo Sapiens
EWLLAIRRI

SEQ ID NO: 904781 - protein, 9 aa, Homo Sapiens
RIFTSDCLL

SEQ ID NO: 904782 - protein, 9 aa, Homo Sapiens
AFTQTTYTL

SEQ ID NO: 904783 - protein, 9 aa, Homo Sapiens
GHRCFYEMD

SEQ ID NO: 904784 - protein, 9 aa, Homo Sapiens
ILVDLRSKC

SEQ ID NO: 904785 - protein, 9 aa, Homo Sapiens
VCRYGVSLA

SEQ ID NO: 904786 - protein, 9 aa, Homo Sapiens
VHSQTMDKS

SEQ ID NO: 904787 - protein, 9 aa, Homo Sapiens
PPINCPGDK

SEQ ID NO: 904788 - protein, 9 aa, Homo Sapiens
KQLQISSSS

SEQ ID NO: 904789 - protein, 9 aa, Homo Sapiens
TPLINPLIY

SEQ ID NO: 904790 - protein, 9 aa, Homo Sapiens
KGAQLGGGQ

SEQ ID NO: 904791 - protein, 9 aa, Homo Sapiens
GGPVGEPGK

SEQ ID NO: 904792 - protein, 9 aa, Homo Sapiens
LECYRQISG

SEQ ID NO: 904793 - protein, 9 aa, Homo Sapiens
FLVEICEEM

SEQ ID NO: 904794 - protein, 9 aa, Homo Sapiens
DNCFQRTNS

SEQ ID NO: 904795 - protein, 9 aa, Homo Sapiens
MLPGLFSRH

SEQ ID NO: 904796 - protein, 9 aa, Homo Sapiens
GYPVFIFLD

SEQ ID NO: 904797 - protein, 9 aa, Homo Sapiens
LWPIPLQFY

SEQ ID NO: 904798 - protein, 9 aa, Homo Sapiens
SLKEWLLAI

SEQ ID NO: 904799 - protein, 9 aa, Homo Sapiens
NPKLVVTQK

SEQ ID NO: 904800 - protein, 9 aa, Homo Sapiens
TQKTIRLAY

SEQ ID NO: 904801 - protein, 9 aa, Homo Sapiens
LWVRPFTMF

SEQ ID NO: 904802 - protein, 9 aa, Homo Sapiens
SFVPALIML

SEQ ID NO: 904803 - protein, 9 aa, Homo Sapiens
EKITLLWQP

SEQ ID NO: 904804 - protein, 9 aa, Homo Sapiens
VAKEDEEGR

SEQ ID NO: 904805 - protein, 9 aa, Homo Sapiens
DTRGHAHRL

SEQ ID NO: 904806 - protein, 9 aa, Homo Sapiens
LLTVAIGAD

SEQ ID NO: 904807 - protein, 9 aa, Homo Sapiens
MLLSIGAPQ

SEQ ID NO: 904808 - protein, 9 aa, Homo Sapiens
CYRQISGDW

SEQ ID NO: 904809 - protein, 9 aa, Homo Sapiens
PCVCRYGVS

SEQ ID NO: 904810 - protein, 9 aa, Homo Sapiens
STLTIHSVE

SEQ ID NO: 904811 - protein, 9 aa, Homo Sapiens
FWTVDDKEF

SEQ ID NO: 904812 - protein, 9 aa, Homo Sapiens
DLRSKCTDG

SEQ ID NO: 904813 - protein, 9 aa, Homo Sapiens
IMLILLRKC

SEQ ID NO: 904814 - protein, 9 aa, Homo Sapiens
ADVFHTFCQ

SEQ ID NO: 904815 - protein, 9 aa, Homo Sapiens
PMTHSPITT

SEQ ID NO: 904816 - protein, 9 aa, Homo Sapiens
PLWVRPFTM

SEQ ID NO: 904817 - protein, 9 aa, Homo Sapiens
NNALRVLWK

SEQ ID NO: 904818 - protein, 9 aa, Homo Sapiens
IIKYIWRIG

SEQ ID NO: 904819 - protein, 9 aa, Homo Sapiens
QMSSGFKHE

SEQ ID NO: 904820 - protein, 9 aa, Homo Sapiens
QTMDKSRNT

SEQ ID NO: 904821 - protein, 9 aa, Homo Sapiens
FLSFLFFSE

SEQ ID NO: 904822 - protein, 9 aa, Homo Sapiens
SIGAPQFLG

SEQ ID NO: 904823 - protein, 9 aa, Homo Sapiens
PCAVPLWVR

SEQ ID NO: 904824 - protein, 9 aa, Homo Sapiens
INCPGDKIL

SEQ ID NO: 904825 - protein, 9 aa, Homo Sapiens
ATTQDTKNS

SEQ ID NO: 904826 - protein, 9 aa, Homo Sapiens
PEINRVYFA

SEQ ID NO: 904827 - protein, 9 aa, Homo Sapiens
ALIGYPVFI

SEQ ID NO: 904828 - protein, 9 aa, Homo Sapiens
SREGAGAVL

SEQ ID NO: 904829 - protein, 9 aa, Homo Sapiens
PCPDTRGHA

SEQ ID NO: 904830 - protein, 9 aa, Homo Sapiens
ILATESSNE

SEQ ID NO: 904831 - protein, 9 aa, Homo Sapiens
SRDTAVPQE

SEQ ID NO: 904832 - protein, 9 aa, Homo Sapiens
YLFLSFLFF

SEQ ID NO: 904833 - protein, 9 aa, Homo Sapiens
WQMRDVSCS

SEQ ID NO: 904834 - protein, 9 aa, Homo Sapiens
LGGGQGGQD

SEQ ID NO: 904835 - protein, 9 aa, Homo Sapiens
MRDVSCSDR

SEQ ID NO: 904836 - protein, 9 aa, Homo Sapiens
YLKTKKQTP

SEQ ID NO: 904837 - protein, 9 aa, Homo Sapiens
LTVDGFTDL

SEQ ID NO: 904838 - protein, 9 aa, Homo Sapiens
INDGFQCFR

SEQ ID NO: 904839 - protein, 9 aa, Homo Sapiens
HSQTMDKSR

SEQ ID NO: 904840 - protein, 9 aa, Homo Sapiens
LINDGFQCF

SEQ ID NO: 904841 - protein, 9 aa, Homo Sapiens
IGTESSRPN

SEQ ID NO: 904842 - protein, 9 aa, Homo Sapiens
RFSGLSLPR

SEQ ID NO: 904843 - protein, 9 aa, Homo Sapiens
AKEDEEGRL

SEQ ID NO: 904844 - protein, 9 aa, Homo Sapiens
DKNRAVEEA

SEQ ID NO: 904845 - protein, 9 aa, Homo Sapiens
PIKLFELSL

SEQ ID NO: 904846 - protein, 9 aa, Homo Sapiens
KISPEGTAK

SEQ ID NO: 904847 - protein, 9 aa, Homo Sapiens
KGCTVVGGG

SEQ ID NO: 904848 - protein, 9 aa, Homo Sapiens
GTAKIQLQL

SEQ ID NO: 904849 - protein, 9 aa, Homo Sapiens
FREGVESEL

SEQ ID NO: 904850 - protein, 9 aa, Homo Sapiens
GFTDLSNSE

SEQ ID NO: 904851 - protein, 9 aa, Homo Sapiens
EELWPIPLQ

SEQ ID NO: 904852 - protein, 9 aa, Homo Sapiens
ALRVLWKSR

SEQ ID NO: 904853 - protein, 9 aa, Homo Sapiens
QHPILLPPI

SEQ ID NO: 904854 - protein, 9 aa, Homo Sapiens
VKRLTLSLD

SEQ ID NO: 904855 - protein, 9 aa, Homo Sapiens
PPSHAASQP

SEQ ID NO: 904856 - protein, 9 aa, Homo Sapiens
INRVYFARV

SEQ ID NO: 904857 - protein, 9 aa, Homo Sapiens
NPNSLKRIG

SEQ ID NO: 904858 - protein, 9 aa, Homo Sapiens
VSRTFPVPV

SEQ ID NO: 904859 - protein, 9 aa, Homo Sapiens
ITTPTIVWT

SEQ ID NO: 904860 - protein, 9 aa, Homo Sapiens
FTSDCLLVH

SEQ ID NO: 904861 - protein, 9 aa, Homo Sapiens
DSHTLMTYS

SEQ ID NO: 904862 - protein, 9 aa, Homo Sapiens
RSKCTDGGR

SEQ ID NO: 904863 - protein, 9 aa, Homo Sapiens
KVHKRRYNG

SEQ ID NO: 904864 - protein, 9 aa, Homo Sapiens
SFLFFSETC

SEQ ID NO: 904865 - protein, 9 aa, Homo Sapiens
HHPMGMLYH

SEQ ID NO: 904866 - protein, 9 aa, Homo Sapiens
LNRRRLPPE

SEQ ID NO: 904867 - protein, 9 aa, Homo Sapiens
LNYPSHCCA

SEQ ID NO: 904868 - protein, 9 aa, Homo Sapiens
KNSRSTLSL

SEQ ID NO: 904869 - protein, 9 aa, Homo Sapiens
CMPNSFLKV

SEQ ID NO: 904870 - protein, 9 aa, Homo Sapiens
ISFLSVKRL

SEQ ID NO: 904871 - protein, 9 aa, Homo Sapiens
TTQDTKNSR

SEQ ID NO: 904872 - protein, 9 aa, Homo Sapiens
HPILLPPIN

SEQ ID NO: 904873 - protein, 9 aa, Homo Sapiens
DDKEFKRGR

SEQ ID NO: 904874 - protein, 9 aa, Homo Sapiens
MDKSRNTSW

SEQ ID NO: 904875 - protein, 9 aa, Homo Sapiens
QDPIKLFEL

SEQ ID NO: 904876 - protein, 9 aa, Homo Sapiens
LVEICEEMY

SEQ ID NO: 904877 - protein, 9 aa, Homo Sapiens
CRANELASQ

SEQ ID NO: 904878 - protein, 9 aa, Homo Sapiens
LATESSNEE

SEQ ID NO: 904879 - protein, 9 aa, Homo Sapiens
VPQERNKKL

SEQ ID NO: 904880 - protein, 9 aa, Homo Sapiens
KSADNCFQR

SEQ ID NO: 904881 - protein, 9 aa, Homo Sapiens
HSNTTISLS

SEQ ID NO: 904882 - protein, 9 aa, Homo Sapiens
AVSSRLECY

SEQ ID NO: 904883 - protein, 9 aa, Homo Sapiens
NELASQDGR

SEQ ID NO: 904884 - protein, 9 aa, Homo Sapiens
AIVAKEDEE

SEQ ID NO: 904885 - protein, 9 aa, Homo Sapiens
NDGFQCFRA

SEQ ID NO: 904886 - protein, 9 aa, Homo Sapiens
AAGPGGPVG

SEQ ID NO: 904887 - protein, 9 aa, Homo Sapiens
QTPNLQHFV

SEQ ID NO: 904888 - protein, 9 aa, Homo Sapiens
LSVKRLTLS

SEQ ID NO: 904889 - protein, 9 aa, Homo Sapiens
KLEAPLKIC

SEQ ID NO: 904890 - protein, 9 aa, Homo Sapiens
RGDIGSPGP

SEQ ID NO: 904891 - protein, 9 aa, Homo Sapiens
MFNKMHKMP

SEQ ID NO: 904892 - protein, 9 aa, Homo Sapiens
ADNCFQRTN

SEQ ID NO: 904893 - protein, 9 aa, Homo Sapiens
PLINPLIYS

SEQ ID NO: 904894 - protein, 9 aa, Homo Sapiens
MGATTQDTK

SEQ ID NO: 904895 - protein, 9 aa, Homo Sapiens
LRSKSADNC

SEQ ID NO: 904896 - protein, 9 aa, Homo Sapiens
RPFTMFFSV

SEQ ID NO: 904897 - protein, 9 aa, Homo Sapiens
NRRRLPPEL

SEQ ID NO: 904898 - protein, 9 aa, Homo Sapiens
SRLECYRQI

SEQ ID NO: 904899 - protein, 9 aa, Homo Sapiens
RTKTEKKIL

SEQ ID NO: 904900 - protein, 9 aa, Homo Sapiens
LQISSSSAS

SEQ ID NO: 904901 - protein, 9 aa, Homo Sapiens
PAFTQTTYT

SEQ ID NO: 904902 - protein, 9 aa, Homo Sapiens
CNDSGDDCT

SEQ ID NO: 904903 - protein, 9 aa, Homo Sapiens
QISSSSASN

SEQ ID NO: 904904 - protein, 9 aa, Homo Sapiens
QPRQKSWLV

SEQ ID NO: 904905 - protein, 9 aa, Homo Sapiens
SSMDDKQLQ

SEQ ID NO: 904906 - protein, 9 aa, Homo Sapiens
SLNYPSHCC

SEQ ID NO: 904907 - protein, 9 aa, Homo Sapiens
GFREGVESE

SEQ ID NO: 904908 - protein, 9 aa, Homo Sapiens
NYPSHCCAF

SEQ ID NO: 904909 - protein, 9 aa, Homo Sapiens
GAGAVLVAE

SEQ ID NO: 904910 - protein, 9 aa, Homo Sapiens
EINRVYFAR

SEQ ID NO: 904911 - protein, 9 aa, Homo Sapiens
VSSRLECYR

SEQ ID NO: 904912 - protein, 9 aa, Homo Sapiens
FLFFSETCY

SEQ ID NO: 904913 - protein, 9 aa, Homo Sapiens
LSFCGPNEI

SEQ ID NO: 904914 - protein, 9 aa, Homo Sapiens
MEASLNYPS

SEQ ID NO: 904915 - protein, 9 aa, Homo Sapiens
GHAHRLLHY

SEQ ID NO: 904916 - protein, 9 aa, Homo Sapiens
SLSFCGPNE

SEQ ID NO: 904917 - protein, 9 aa, Homo Sapiens
RVDYVGELG

SEQ ID NO: 904918 - protein, 9 aa, Homo Sapiens
PRRPLLCNF

SEQ ID NO: 904919 - protein, 9 aa, Homo Sapiens
SSFVPALIM

SEQ ID NO: 904920 - protein, 9 aa, Homo Sapiens
IIMVADEGW

SEQ ID NO: 904921 - protein, 9 aa, Homo Sapiens
SVEKQDIAT

SEQ ID NO: 904922 - protein, 9 aa, Homo Sapiens
RNPNSLKRI

SEQ ID NO: 904923 - protein, 9 aa, Homo Sapiens
TAVPQERNK

SEQ ID NO: 904924 - protein, 9 aa, Homo Sapiens
RLLTVAIGA

SEQ ID NO: 904925 - protein, 9 aa, Homo Sapiens
EICEEMYPD

SEQ ID NO: 904926 - protein, 9 aa, Homo Sapiens
PNEIDHFFC

SEQ ID NO: 904927 - protein, 9 aa, Homo Sapiens
TDLSNSERF

SEQ ID NO: 904928 - protein, 9 aa, Homo Sapiens
LLPPINCPG

SEQ ID NO: 904929 - protein, 9 aa, Homo Sapiens
LSDGFREGV

SEQ ID NO: 904930 - protein, 9 aa, Homo Sapiens
TPSAEYLDR

SEQ ID NO: 904931 - protein, 9 aa, Homo Sapiens
IALIGYPVF

SEQ ID NO: 904932 - protein, 9 aa, Homo Sapiens
ESSNEEYVR

SEQ ID NO: 904933 - protein, 9 aa, Homo Sapiens
EEMMLLSIG

SEQ ID NO: 904934 - protein, 9 aa, Homo Sapiens
EGAGAVLVA

SEQ ID NO: 904935 - protein, 9 aa, Homo Sapiens
LSFLFFSET

SEQ ID NO: 904936 - protein, 9 aa, Homo Sapiens
DQKHPVAST

SEQ ID NO: 904937 - protein, 9 aa, Homo Sapiens
LSVDDQKHP

SEQ ID NO: 904938 - protein, 9 aa, Homo Sapiens
TMDKSRNTS

SEQ ID NO: 904939 - protein, 9 aa, Homo Sapiens
KAPEINRVY

SEQ ID NO: 904940 - protein, 9 aa, Homo Sapiens
GAAGPGGPV

SEQ ID NO: 904941 - protein, 9 aa, Homo Sapiens
LLSIGAPQF

SEQ ID NO: 904942 - protein, 9 aa, Homo Sapiens
KINGREHKR

SEQ ID NO: 904943 - protein, 9 aa, Homo Sapiens
AATQPRQKS

SEQ ID NO: 904944 - protein, 9 aa, Homo Sapiens
QLQISSSSA

SEQ ID NO: 904945 - protein, 9 aa, Homo Sapiens
FCQLDRLLP

SEQ ID NO: 904946 - protein, 9 aa, Homo Sapiens
PVGEPGKGG

SEQ ID NO: 904947 - protein, 9 aa, Homo Sapiens
ILDRRWMPY

SEQ ID NO: 904948 - protein, 9 aa, Homo Sapiens
HTHSNTTIS

SEQ ID NO: 904949 - protein, 9 aa, Homo Sapiens
WQPPADDGG

SEQ ID NO: 904950 - protein, 9 aa, Homo Sapiens
NEIDHFFCD

SEQ ID NO: 904951 - protein, 9 aa, Homo Sapiens
THSPITTPT

SEQ ID NO: 904952 - protein, 9 aa, Homo Sapiens
ECYRQISGD

SEQ ID NO: 904953 - protein, 9 aa, Homo Sapiens
FCCKTPSAE

SEQ ID NO: 904954 - protein, 9 aa, Homo Sapiens
EASQQFLEQ

SEQ ID NO: 904955 - protein, 9 aa, Homo Sapiens
CTDGGRAEK

SEQ ID NO: 904956 - protein, 9 aa, Homo Sapiens
NRAVEEAFA

SEQ ID NO: 904957 - protein, 9 aa, Homo Sapiens
GLNRKNSRS

SEQ ID NO: 904958 - protein, 9 aa, Homo Sapiens
IVAKEDEEG

SEQ ID NO: 904959 - protein, 9 aa, Homo Sapiens
SFWTVDDKE

SEQ ID NO: 904960 - protein, 9 aa, Homo Sapiens
TIHSVEKQD

SEQ ID NO: 904961 - protein, 9 aa, Homo Sapiens
NKMHKMPTL

SEQ ID NO: 904962 - protein, 9 aa, Homo Sapiens
GCVDIRGYG

SEQ ID NO: 904963 - protein, 9 aa, Homo Sapiens
TQSPHGHPK

SEQ ID NO: 904964 - protein, 9 aa, Homo Sapiens
SEVEEADVK

SEQ ID NO: 904965 - protein, 9 aa, Homo Sapiens
RTFPVPVTM

SEQ ID NO: 904966 - protein, 9 aa, Homo Sapiens
LPRGEEHTK

SEQ ID NO: 904967 - protein, 9 aa, Homo Sapiens
LFFSETCYT

SEQ ID NO: 904968 - protein, 9 aa, Homo Sapiens
AGAVLVAEV

SEQ ID NO: 904969 - protein, 9 aa, Homo Sapiens
QPIIMVADE

SEQ ID NO: 904970 - protein, 9 aa, Homo Sapiens
LKEVRVDYV

SEQ ID NO: 904971 - protein, 9 aa, Homo Sapiens
TFCQLDRLL

SEQ ID NO: 904972 - protein, 9 aa, Homo Sapiens
QSPHGHPKS

SEQ ID NO: 904973 - protein, 9 aa, Homo Sapiens
KRRYNGLNQ

SEQ ID NO: 904974 - protein, 9 aa, Homo Sapiens
AASQPPLPA

SEQ ID NO: 904975 - protein, 9 aa, Homo Sapiens
EDQEALCLD

SEQ ID NO: 904976 - protein, 9 aa, Homo Sapiens
EAHCRANEL

SEQ ID NO: 904977 - protein, 9 aa, Homo Sapiens
GWQRRRQSI

SEQ ID NO: 904978 - protein, 9 aa, Homo Sapiens
VDDQKHPVA

SEQ ID NO: 904979 - protein, 9 aa, Homo Sapiens
ATQPRQKSW

SEQ ID NO: 904980 - protein, 9 aa, Homo Sapiens
SDGFREGVE

SEQ ID NO: 904981 - protein, 9 aa, Homo Sapiens
LLTPLINPL

SEQ ID NO: 904982 - protein, 9 aa, Homo Sapiens
REGVESELM

SEQ ID NO: 904983 - protein, 9 aa, Homo Sapiens
SLDSHTLMT

SEQ ID NO: 904984 - protein, 9 aa, Homo Sapiens
CCKTPSAEY

SEQ ID NO: 904985 - protein, 9 aa, Homo Sapiens
IFCCKTPSA

SEQ ID NO: 904986 - protein, 9 aa, Homo Sapiens
QLGGGQGGQ

SEQ ID NO: 904987 - protein, 9 aa, Homo Sapiens
AEERAAATQ

SEQ ID NO: 904988 - protein, 9 aa, Homo Sapiens
SFDLHSVSR

SEQ ID NO: 904989 - protein, 9 aa, Homo Sapiens
PPPPPSHAA

SEQ ID NO: 904990 - protein, 9 aa, Homo Sapiens
CGPNEIDHF

SEQ ID NO: 904991 - protein, 9 aa, Homo Sapiens
DKEFKRGRH

SEQ ID NO: 904992 - protein, 9 aa, Homo Sapiens
LWQPPADDG

SEQ ID NO: 904993 - protein, 9 aa, Homo Sapiens
DKQLQISSS

SEQ ID NO: 904994 - protein, 9 aa, Homo Sapiens
LKINGREHK

SEQ ID NO: 904995 - protein, 9 aa, Homo Sapiens
RGCVDIRGY

SEQ ID NO: 904996 - protein, 9 aa, Homo Sapiens
PPPPSHAAS

SEQ ID NO: 904997 - protein, 9 aa, Homo Sapiens
KKDASKGCT

SEQ ID NO: 904998 - protein, 9 aa, Homo Sapiens
VHRLLTVAI

SEQ ID NO: 904999 - protein, 9 aa, Homo Sapiens
TQTTYTLFV

SEQ ID NO: 905000 - protein, 9 aa, Homo Sapiens
KPCVCRYGV

SEQ ID NO: 905001 - protein, 9 aa, Homo Sapiens
CFYEMDEVE

SEQ ID NO: 905002 - protein, 9 aa, Homo Sapiens
AVEEAFARA

SEQ ID NO: 905003 - protein, 9 aa, Homo Sapiens
WLLAIRRIL

SEQ ID NO: 905004 - protein, 9 aa, Homo Sapiens
EEDKNRAVE

SEQ ID NO: 905005 - protein, 9 aa, Homo Sapiens
LSRKIQIGH

SEQ ID NO: 905006 - protein, 9 aa, Homo Sapiens
MNLKPENTL

SEQ ID NO: 905007 - protein, 9 aa, Homo Sapiens
EMYPDILNF

SEQ ID NO: 905008 - protein, 9 aa, Homo Sapiens
VLWKSREWN

SEQ ID NO: 905009 - protein, 9 aa, Homo Sapiens
SNTTISLSR

SEQ ID NO: 905010 - protein, 9 aa, Homo Sapiens
DVKKLAEIL

SEQ ID NO: 905011 - protein, 9 aa, Homo Sapiens
VLVAEVIKD

SEQ ID NO: 905012 - protein, 9 aa, Homo Sapiens
RCFYEMDEV

SEQ ID NO: 905013 - protein, 9 aa, Homo Sapiens
IQIGHVLCL

SEQ ID NO: 905014 - protein, 9 aa, Homo Sapiens
VFHTFCQLD

SEQ ID NO: 905015 - protein, 9 aa, Homo Sapiens
TVDDKEFKR

SEQ ID NO: 905016 - protein, 9 aa, Homo Sapiens
RAAATQPRQ

SEQ ID NO: 905017 - protein, 9 aa, Homo Sapiens
EDKNRAVEE

SEQ ID NO: 905018 - protein, 9 aa, Homo Sapiens
IGYPVFIFL

SEQ ID NO: 905019 - protein, 9 aa, Homo Sapiens
RANELASQD

SEQ ID NO: 905020 - protein, 9 aa, Homo Sapiens
TLLTPLINP

SEQ ID NO: 905021 - protein, 9 aa, Homo Sapiens
LIILFYQKI

SEQ ID NO: 905022 - protein, 9 aa, Homo Sapiens
IGAPQFLGA

SEQ ID NO: 905023 - protein, 9 aa, Homo Sapiens
LYHYKVQVE

SEQ ID NO: 905024 - protein, 9 aa, Homo Sapiens
WSEVEEADV

SEQ ID NO: 905025 - protein, 9 aa, Homo Sapiens
QKHPVASTL

SEQ ID NO: 905026 - protein, 9 aa, Homo Sapiens
HAHRLLHYC

SEQ ID NO: 905027 - protein, 9 aa, Homo Sapiens
AIALIGYPV

SEQ ID NO: 905028 - protein, 9 aa, Homo Sapiens
LPSRDTAVP

SEQ ID NO: 905029 - protein, 9 aa, Homo Sapiens
ALMEASLNY

SEQ ID NO: 905030 - protein, 9 aa, Homo Sapiens
DLHSVSRTF

SEQ ID NO: 905031 - protein, 9 aa, Homo Sapiens
FKHTVVHII

SEQ ID NO: 905032 - protein, 8 aa, Homo Sapiens
IPGKYRSV

SEQ ID NO: 905033 - protein, 9 aa, Homo Sapiens
TLNRRRLPP

SEQ ID NO: 905034 - protein, 9 aa, Homo Sapiens
GLSLDSHTL

SEQ ID NO: 905035 - protein, 9 aa, Homo Sapiens
RMFNKMHKM

SEQ ID NO: 905036 - protein, 9 aa, Homo Sapiens
PKLVVTQKT

SEQ ID NO: 905037 - protein, 9 aa, Homo Sapiens
STNNALRVL

SEQ ID NO: 905038 - protein, 9 aa, Homo Sapiens
WSCMPNSFL

SEQ ID NO: 905039 - protein, 9 aa, Homo Sapiens
PILLPPINC

SEQ ID NO: 905040 - protein, 9 aa, Homo Sapiens
VFIFLDEPT

SEQ ID NO: 905041 - protein, 9 aa, Homo Sapiens
KDASKGCTV

SEQ ID NO: 905042 - protein, 9 aa, Homo Sapiens
DRMFNKMHK

SEQ ID NO: 905043 - protein, 9 aa, Homo Sapiens
QLINDGFQC

SEQ ID NO: 905044 - protein, 9 aa, Homo Sapiens
MLYHYKVQV

SEQ ID NO: 905045 - protein, 9 aa, Homo Sapiens
PGLNRKNSR

SEQ ID NO: 905046 - protein, 9 aa, Homo Sapiens
VVHIILSEH

SEQ ID NO: 905047 - protein, 9 aa, Homo Sapiens
KQTPNLQHF

SEQ ID NO: 905048 - protein, 9 aa, Homo Sapiens
DGFREGVES

SEQ ID NO: 905049 - protein, 9 aa, Homo Sapiens
KRRTKTEKK

SEQ ID NO: 905050 - protein, 9 aa, Homo Sapiens
IVGGRRAWP

SEQ ID NO: 905051 - protein, 9 aa, Homo Sapiens
KITLLWQPP

SEQ ID NO: 905052 - protein, 9 aa, Homo Sapiens
SLPRSWDYR

SEQ ID NO: 905053 - protein, 9 aa, Homo Sapiens
VRVDYVGEL

SEQ ID NO: 905054 - protein, 9 aa, Homo Sapiens
FLSVKRLTL

SEQ ID NO: 905055 - protein, 9 aa, Homo Sapiens
EEYVRMLLD

SEQ ID NO: 905056 - protein, 9 aa, Homo Sapiens
INEELWPIP

SEQ ID NO: 905057 - protein, 9 aa, Homo Sapiens
EAIVAKEDE

SEQ ID NO: 905058 - protein, 9 aa, Homo Sapiens
QKIIKYIWR

SEQ ID NO: 905059 - protein, 9 aa, Homo Sapiens
IMVADEGWT

SEQ ID NO: 905060 - protein, 9 aa, Homo Sapiens
PEGTAKIQL

SEQ ID NO: 905061 - protein, 9 aa, Homo Sapiens
LSIGAPQFL

SEQ ID NO: 905062 - protein, 9 aa, Homo Sapiens
KNRAVEEAF

SEQ ID NO: 905063 - protein, 9 aa, Homo Sapiens
IILFYQKII

SEQ ID NO: 905064 - protein, 9 aa, Homo Sapiens
KVMHKLSNS

SEQ ID NO: 905065 - protein, 9 aa, Homo Sapiens
VPALIMLIL

SEQ ID NO: 905066 - protein, 9 aa, Homo Sapiens
IKQDERVMM

SEQ ID NO: 905067 - protein, 9 aa, Homo Sapiens
RVLWKSREW

SEQ ID NO: 905068 - protein, 9 aa, Homo Sapiens
GLKEVRVDY

SEQ ID NO: 905069 - protein, 9 aa, Homo Sapiens
TVVHIILSE

SEQ ID NO: 905070 - protein, 9 aa, Homo Sapiens
SSRLECYRQ

SEQ ID NO: 905071 - protein, 9 aa, Homo Sapiens
HDQMSSGFK

SEQ ID NO: 905072 - protein, 9 aa, Homo Sapiens
PGGPVGEPG

SEQ ID NO: 905073 - protein, 9 aa, Homo Sapiens
PMGMLYHYK

SEQ ID NO: 905074 - protein, 9 aa, Homo Sapiens
VLKEDQEAL

SEQ ID NO: 905075 - protein, 9 aa, Homo Sapiens
TTYTLFVRE

SEQ ID NO: 905076 - protein, 9 aa, Homo Sapiens
HKRRYNGLN

SEQ ID NO: 905077 - protein, 9 aa, Homo Sapiens
EASLNYPSH

SEQ ID NO: 905078 - protein, 9 aa, Homo Sapiens
FDLHSVSRT

SEQ ID NO: 905079 - protein, 9 aa, Homo Sapiens
GAQLGGGQG

SEQ ID NO: 905080 - protein, 9 aa, Homo Sapiens
LTPLINPLI

SEQ ID NO: 905081 - protein, 9 aa, Homo Sapiens
GAVLVAEVI

SEQ ID NO: 905082 - protein, 9 aa, Homo Sapiens
QSIRCPCTT

SEQ ID NO: 905083 - protein, 9 aa, Homo Sapiens
PSRDTAVPQ

SEQ ID NO: 905084 - protein, 9 aa, Homo Sapiens
AWPHAWPFM

SEQ ID NO: 905085 - protein, 9 aa, Homo Sapiens
QTTYTLFVR

SEQ ID NO: 905086 - protein, 9 aa, Homo Sapiens
LDRMFNKMH

SEQ ID NO: 905087 - protein, 9 aa, Homo Sapiens
SLSVDDQKH

SEQ ID NO: 905088 - protein, 9 aa, Homo Sapiens
MHKMPTLRR

SEQ ID NO: 905089 - protein, 9 aa, Homo Sapiens
LSQPILLKL

SEQ ID NO: 905090 - protein, 9 aa, Homo Sapiens
GGQGGQDGH

SEQ ID NO: 905091 - protein, 9 aa, Homo Sapiens
VDDKEFKRG

SEQ ID NO: 905092 - protein, 9 aa, Homo Sapiens
PRGDIGSPG

SEQ ID NO: 905093 - protein, 9 aa, Homo Sapiens
LRSKCTDGG

SEQ ID NO: 905094 - protein, 9 aa, Homo Sapiens
LSNSERFCL

SEQ ID NO: 905095 - protein, 9 aa, Homo Sapiens
LSLDSHTLM

SEQ ID NO: 905096 - protein, 9 aa, Homo Sapiens
LSNSNRHKI

SEQ ID NO: 905097 - protein, 9 aa, Homo Sapiens
KCTDGGRAE

SEQ ID NO: 905098 - protein, 9 aa, Homo Sapiens
GLSLPRSWD

SEQ ID NO: 905099 - protein, 9 aa, Homo Sapiens
AYTLLTPLI

SEQ ID NO: 905100 - protein, 9 aa, Homo Sapiens
CVDIRGYGG

SEQ ID NO: 905101 - protein, 9 aa, Homo Sapiens
VDGFTDLSN

SEQ ID NO: 905102 - protein, 9 aa, Homo Sapiens
GYGGTDVDQ

SEQ ID NO: 905103 - protein, 9 aa, Homo Sapiens
AHCRANELA

SEQ ID NO: 905104 - protein, 9 aa, Homo Sapiens
HEVMNLKPE

SEQ ID NO: 905105 - protein, 9 aa, Homo Sapiens
GGRRAWPHA

SEQ ID NO: 905106 - protein, 9 aa, Homo Sapiens
DDQKHPVAS

SEQ ID NO: 905107 - protein, 9 aa, Homo Sapiens
DDCTHSSTI

SEQ ID NO: 905108 - protein, 9 aa, Homo Sapiens
TNNALRVLW

SEQ ID NO: 905109 - protein, 9 aa, Homo Sapiens
EGKVHKRRY

SEQ ID NO: 905110 - protein, 9 aa, Homo Sapiens
SDCLLVHQR

SEQ ID NO: 905111 - protein, 9 aa, Homo Sapiens
ILFYQKIIK

SEQ ID NO: 905112 - protein, 9 aa, Homo Sapiens
NGHRCFYEM

SEQ ID NO: 905113 - protein, 9 aa, Homo Sapiens
LVVTQKTIR

SEQ ID NO: 905114 - protein, 9 aa, Homo Sapiens
PRGEEHTKF

SEQ ID NO: 905115 - protein, 9 aa, Homo Sapiens
DQMSSGFKH

SEQ ID NO: 905116 - protein, 9 aa, Homo Sapiens
PVFIFLDEP

SEQ ID NO: 905117 - protein, 9 aa, Homo Sapiens
DEGKVHKRR

SEQ ID NO: 905118 - protein, 9 aa, Homo Sapiens
APEINRVYF

SEQ ID NO: 905119 - protein, 9 aa, Homo Sapiens
EVRVDYVGE

SEQ ID NO: 905120 - protein, 9 aa, Homo Sapiens
LPPPPPSHA

SEQ ID NO: 905121 - protein, 9 aa, Homo Sapiens
DSGDDCTHS

SEQ ID NO: 905122 - protein, 9 aa, Homo Sapiens
YRQISGDWQ

SEQ ID NO: 905123 - protein, 9 aa, Homo Sapiens
RIGTESSRP

SEQ ID NO: 905124 - protein, 9 aa, Homo Sapiens
LWKSREWNM

SEQ ID NO: 905125 - protein, 9 aa, Homo Sapiens
CRYGVSLAW

SEQ ID NO: 905126 - protein, 9 aa, Homo Sapiens
TEFHNGHRC

SEQ ID NO: 905127 - protein, 9 aa, Homo Sapiens
QKTIRLAYR

SEQ ID NO: 905128 - protein, 9 aa, Homo Sapiens
RIQPIIMVA

SEQ ID NO: 905129 - protein, 9 aa, Homo Sapiens
KRIGTESSR

SEQ ID NO: 905130 - protein, 9 aa, Homo Sapiens
KHTVVHIIL

SEQ ID NO: 905131 - protein, 9 aa, Homo Sapiens
RWMPYGGRG

SEQ ID NO: 905132 - protein, 9 aa, Homo Sapiens
KLVVTQKTI

SEQ ID NO: 905133 - protein, 9 aa, Homo Sapiens
VALMEASLN

SEQ ID NO: 905134 - protein, 9 aa, Homo Sapiens
IHSVEKQDI

SEQ ID NO: 905135 - protein, 9 aa, Homo Sapiens
KTPSAEYLD

SEQ ID NO: 905136 - protein, 9 aa, Homo Sapiens
SVSRTFPVP

SEQ ID NO: 905137 - protein, 9 aa, Homo Sapiens
KTKKQTPNL

SEQ ID NO: 905138 - protein, 9 aa, Homo Sapiens
LKLEAPLKI

SEQ ID NO: 905139 - protein, 9 aa, Homo Sapiens
HPKSHSTSP

SEQ ID NO: 905140 - protein, 9 aa, Homo Sapiens
GMTSLKEWL

SEQ ID NO: 905141 - protein, 9 aa, Homo Sapiens
VSLAWYPCM

SEQ ID NO: 905142 - protein, 9 aa, Homo Sapiens
CQLDRLLPK

SEQ ID NO: 905143 - protein, 9 aa, Homo Sapiens
CVCRYGVSL

SEQ ID NO: 905144 - protein, 9 aa, Homo Sapiens
AQLGGGQGG

SEQ ID NO: 905145 - protein, 9 aa, Homo Sapiens
WTVDDKEFK

SEQ ID NO: 905146 - protein, 9 aa, Homo Sapiens
GVESELMRD

SEQ ID NO: 905147 - protein, 9 aa, Homo Sapiens
LKEDQEALC

SEQ ID NO: 905148 - protein, 9 aa, Homo Sapiens
SFLSVKRLT

SEQ ID NO: 905149 - protein, 9 aa, Homo Sapiens
GFQCFRATE

SEQ ID NO: 905150 - protein, 9 aa, Homo Sapiens
SLSRKIQIG

SEQ ID NO: 905151 - protein, 9 aa, Homo Sapiens
LKEWLLAIR

SEQ ID NO: 905152 - protein, 9 aa, Homo Sapiens
LKRIGTESS

SEQ ID NO: 905153 - protein, 9 aa, Homo Sapiens
VIVHRLLTV

SEQ ID NO: 905154 - protein, 9 aa, Homo Sapiens
GDIGSPGPQ

SEQ ID NO: 905155 - protein, 9 aa, Homo Sapiens
EHTKFLNSL

SEQ ID NO: 905156 - protein, 9 aa, Homo Sapiens
EGVESELMR

SEQ ID NO: 905157 - protein, 9 aa, Homo Sapiens
MMGQNGNLY

SEQ ID NO: 905158 - protein, 9 aa, Homo Sapiens
LNRKNSRST

SEQ ID NO: 905159 - protein, 9 aa, Homo Sapiens
FECNDSGDD

SEQ ID NO: 905160 - protein, 9 aa, Homo Sapiens
SKQKLKKRR

SEQ ID NO: 905161 - protein, 9 aa, Homo Sapiens
GVQPWQMRD

SEQ ID NO: 905162 - protein, 9 aa, Homo Sapiens
LRVLWKSRE

SEQ ID NO: 905163 - protein, 9 aa, Homo Sapiens
TLMTYSTAR

SEQ ID NO: 905164 - protein, 9 aa, Homo Sapiens
RDTAVPQER

SEQ ID NO: 905165 - protein, 9 aa, Homo Sapiens
ALIMLILLR

SEQ ID NO: 905166 - protein, 9 aa, Homo Sapiens
YPVFIFLDE

SEQ ID NO: 905167 - protein, 9 aa, Homo Sapiens
SPVFLMGAT

SEQ ID NO: 905168 - protein, 9 aa, Homo Sapiens
YGVQPWQMR

SEQ ID NO: 905169 - protein, 9 aa, Homo Sapiens
DASKGCTVV

SEQ ID NO: 905170 - protein, 9 aa, Homo Sapiens
DDKQLQISS

SEQ ID NO: 905171 - protein, 9 aa, Homo Sapiens
TTPTIVWTS

SEQ ID NO: 905172 - protein, 9 aa, Homo Sapiens
DLSNSERFC

SEQ ID NO: 905173 - protein, 9 aa, Homo Sapiens
VKKLAEILV

SEQ ID NO: 905174 - protein, 9 aa, Homo Sapiens
EFHNGHRCF

SEQ ID NO: 905175 - protein, 9 aa, Homo Sapiens
DRIQPIIMV

SEQ ID NO: 905176 - protein, 9 aa, Homo Sapiens
CLYILDRRW

SEQ ID NO: 905177 - protein, 9 aa, Homo Sapiens
RGLKEVRVD

SEQ ID NO: 905178 - protein, 9 aa, Homo Sapiens
PIIMVADEG

SEQ ID NO: 905179 - protein, 9 aa, Homo Sapiens
HRCFYEMDE

SEQ ID NO: 905180 - protein, 9 aa, Homo Sapiens
LIGYPVFIF

SEQ ID NO: 905181 - protein, 9 aa, Homo Sapiens
MYPDILNFV

SEQ ID NO: 905182 - protein, 9 aa, Homo Sapiens
KYVKVMHKL

SEQ ID NO: 905183 - protein, 9 aa, Homo Sapiens
DGFTDLSNS

SEQ ID NO: 905184 - protein, 9 aa, Homo Sapiens
GATTQDTKN

SEQ ID NO: 905185 - protein, 9 aa, Homo Sapiens
RLECYRQIS

SEQ ID NO: 905186 - protein, 9 aa, Homo Sapiens
CFRATEDCG

SEQ ID NO: 905187 - protein, 9 aa, Homo Sapiens
TEKKILEPK

SEQ ID NO: 905188 - protein, 9 aa, Homo Sapiens
YWTLNRRRL

SEQ ID NO: 905189 - protein, 9 aa, Homo Sapiens
ERAAATQPR

SEQ ID NO: 905190 - protein, 9 aa, Homo Sapiens
WPHAWPFMV

SEQ ID NO: 905191 - protein, 9 aa, Homo Sapiens
KSKRRTKTE

SEQ ID NO: 905192 - protein, 9 aa, Homo Sapiens
EEMYPDILN

SEQ ID NO: 905193 - protein, 9 aa, Homo Sapiens
INPLIYSLR

SEQ ID NO: 905194 - protein, 9 aa, Homo Sapiens
LWSCMPNSF

SEQ ID NO: 905195 - protein, 9 aa, Homo Sapiens
SMDDKQLQI

SEQ ID NO: 905196 - protein, 9 aa, Homo Sapiens
TKKQTPNLQ

SEQ ID NO: 905197 - protein, 9 aa, Homo Sapiens
SHTLMTYST

SEQ ID NO: 905198 - protein, 9 aa, Homo Sapiens
LSLQPPVMQ

SEQ ID NO: 905199 - protein, 9 aa, Homo Sapiens
CAVPLWVRP

SEQ ID NO: 905200 - protein, 9 aa, Homo Sapiens
IVHRLLTVA

SEQ ID NO: 905201 - protein, 9 aa, Homo Sapiens
PALIMLILL

SEQ ID NO: 905202 - protein, 9 aa, Homo Sapiens
QCFRATEDC

SEQ ID NO: 905203 - protein, 9 aa, Homo Sapiens
EVEEADVKK

SEQ ID NO: 905204 - protein, 9 aa, Homo Sapiens
QMRDVSCSD

SEQ ID NO: 905205 - protein, 9 aa, Homo Sapiens
IQPIIMVAD

SEQ ID NO: 905206 - protein, 9 aa, Homo Sapiens
AVLVAEVIK

SEQ ID NO: 905207 - protein, 9 aa, Homo Sapiens
EEADVKKLA

SEQ ID NO: 905208 - protein, 9 aa, Homo Sapiens
CRGLKEVRV

SEQ ID NO: 905209 - protein, 9 aa, Homo Sapiens
HTLMTYSTA

SEQ ID NO: 905210 - protein, 9 aa, Homo Sapiens
FNKMHKMPT

SEQ ID NO: 905211 - protein, 9 aa, Homo Sapiens
HSPITTPTI

SEQ ID NO: 905212 - protein, 9 aa, Homo Sapiens
LTVAIGADC

SEQ ID NO: 905213 - protein, 9 aa, Homo Sapiens
EIDHFFCDF

SEQ ID NO: 905214 - protein, 9 aa, Homo Sapiens
QDERVMMGQ

SEQ ID NO: 905215 - protein, 9 aa, Homo Sapiens
QPWQMRDVS

SEQ ID NO: 905216 - protein, 9 aa, Homo Sapiens
MLILLRKCH

SEQ ID NO: 905217 - protein, 9 aa, Homo Sapiens
RRAWPHAWP

SEQ ID NO: 905218 - protein, 9 aa, Homo Sapiens
HTKFLNSLK

SEQ ID NO: 905219 - protein, 9 aa, Homo Sapiens
GEEHTKFLN

SEQ ID NO: 905220 - protein, 9 aa, Homo Sapiens
CNFAPGVSL

SEQ ID NO: 905221 - protein, 9 aa, Homo Sapiens
VHIILSEHK

SEQ ID NO: 905222 - protein, 9 aa, Homo Sapiens
VVTQKTIRL

SEQ ID NO: 905223 - protein, 9 aa, Homo Sapiens
SKEKRKSKQ

SEQ ID NO: 905224 - protein, 9 aa, Homo Sapiens
SQPILLKLE

SEQ ID NO: 905225 - protein, 9 aa, Homo Sapiens
KEFKRGRHI

SEQ ID NO: 905226 - protein, 9 aa, Homo Sapiens
WTLNRRRLP

SEQ ID NO: 905227 - protein, 9 aa, Homo Sapiens
NTTISLSRK

SEQ ID NO: 905228 - protein, 9 aa, Homo Sapiens
FELSLQPPV

SEQ ID NO: 905229 - protein, 9 aa, Homo Sapiens
SQTMDKSRN

SEQ ID NO: 905230 - protein, 9 aa, Homo Sapiens
RRPLLCNFA

SEQ ID NO: 905231 - protein, 9 aa, Homo Sapiens
KKQTPNLQH

SEQ ID NO: 905232 - protein, 9 aa, Homo Sapiens
PVFLMGATT

SEQ ID NO: 905233 - protein, 9 aa, Homo Sapiens
GSFWTVDDK

SEQ ID NO: 905234 - protein, 9 aa, Homo Sapiens
YEPKKDASK

SEQ ID NO: 905235 - protein, 9 aa, Homo Sapiens
VPLWVRPFT

SEQ ID NO: 905236 - protein, 9 aa, Homo Sapiens
GVSLAWYPC

SEQ ID NO: 905237 - protein, 9 aa, Homo Sapiens
NLKPENTLD

SEQ ID NO: 905238 - protein, 9 aa, Homo Sapiens
PPGLNRKNS

SEQ ID NO: 905239 - protein, 9 aa, Homo Sapiens
VDYVGELGG

SEQ ID NO: 905240 - protein, 9 aa, Homo Sapiens
GREHKRMHD

SEQ ID NO: 905241 - protein, 9 aa, Homo Sapiens
MYLFLSFLF

SEQ ID NO: 905242 - protein, 9 aa, Homo Sapiens
EHKRMHDLN

SEQ ID NO: 905243 - protein, 9 aa, Homo Sapiens
TVAIGADCT

SEQ ID NO: 905244 - protein, 9 aa, Homo Sapiens
GPVGEPGKG

SEQ ID NO: 905245 - protein, 9 aa, Homo Sapiens
HAASQPPLP

SEQ ID NO: 905246 - protein, 9 aa, Homo Sapiens
VEICEEMYP

SEQ ID NO: 905247 - protein, 9 aa, Homo Sapiens
VEEAFARAQ

SEQ ID NO: 905248 - protein, 9 aa, Homo Sapiens
TTISLSRKI

SEQ ID NO: 905249 - protein, 9 aa, Homo Sapiens
RRYNGLNQC

SEQ ID NO: 905250 - protein, 9 aa, Homo Sapiens
DTAVPQERN

SEQ ID NO: 905251 - protein, 9 aa, Homo Sapiens
IGSPGPQGP

SEQ ID NO: 905252 - protein, 9 aa, Homo Sapiens
ADVKKLAEI

SEQ ID NO: 905253 - protein, 9 aa, Homo Sapiens
LEEMMLLSI

SEQ ID NO: 905254 - protein, 9 aa, Homo Sapiens
VEEADVKKL

SEQ ID NO: 905255 - protein, 9 aa, Homo Sapiens
EPKKDASKG

SEQ ID NO: 905256 - protein, 9 aa, Homo Sapiens
DGFQCFRAT

SEQ ID NO: 905257 - protein, 9 aa, Homo Sapiens
QPVLWSCMP

SEQ ID NO: 905258 - protein, 9 aa, Homo Sapiens
WPIPLQFYL

SEQ ID NO: 905259 - protein, 9 aa, Homo Sapiens
SKRRTKTEK

SEQ ID NO: 905260 - protein, 9 aa, Homo Sapiens
HNVLKEDQE

SEQ ID NO: 905261 - protein, 9 aa, Homo Sapiens
GIGWQRRRQ

SEQ ID NO: 905262 - protein, 9 aa, Homo Sapiens
EGLYWTLNR

SEQ ID NO: 905263 - protein, 9 aa, Homo Sapiens
KRKSKQKLK

SEQ ID NO: 905264 - protein, 9 aa, Homo Sapiens
EYLKTKKQT

SEQ ID NO: 905265 - protein, 9 aa, Homo Sapiens
ITLLWQPPA

SEQ ID NO: 905266 - protein, 9 aa, Homo Sapiens
RRQSIRCPC

SEQ ID NO: 905267 - protein, 9 aa, Homo Sapiens
KTEKKILEP

SEQ ID NO: 905268 - protein, 9 aa, Homo Sapiens
NGREHKRMH

SEQ ID NO: 905269 - protein, 9 aa, Homo Sapiens
PGLFSRHCL

SEQ ID NO: 905270 - protein, 9 aa, Homo Sapiens
ATESSNEEY

SEQ ID NO: 905271 - protein, 9 aa, Homo Sapiens
LHSVSRTFP

SEQ ID NO: 905272 - protein, 9 aa, Homo Sapiens
DAISFLSVK

SEQ ID NO: 905273 - protein, 9 aa, Homo Sapiens
PHGHPKSHS

SEQ ID NO: 905274 - protein, 9 aa, Homo Sapiens
RKAPEINRV

SEQ ID NO: 905275 - protein, 9 aa, Homo Sapiens
IFTSDCLLV

SEQ ID NO: 905276 - protein, 9 aa, Homo Sapiens
REGAGAVLV

SEQ ID NO: 905277 - protein, 9 aa, Homo Sapiens
KHPVASTLG

SEQ ID NO: 905278 - protein, 9 aa, Homo Sapiens
QPPADDGGA

SEQ ID NO: 905279 - protein, 9 aa, Homo Sapiens
MTHSPITTP

SEQ ID NO: 905280 - protein, 9 aa, Homo Sapiens
YVKVMHKLS

SEQ ID NO: 905281 - protein, 9 aa, Homo Sapiens
NALRVLWKS

SEQ ID NO: 905282 - protein, 9 aa, Homo Sapiens
LHVHSQTMD

SEQ ID NO: 905283 - protein, 9 aa, Homo Sapiens
IQPVLWSCM

SEQ ID NO: 905284 - protein, 9 aa, Homo Sapiens
TLTIHSVEK

SEQ ID NO: 905285 - protein, 9 aa, Homo Sapiens
TRGHAHRLL

SEQ ID NO: 905286 - protein, 9 aa, Homo Sapiens
LKPENTLDQ

SEQ ID NO: 905287 - protein, 9 aa, Homo Sapiens
SEAIVAKED

SEQ ID NO: 905288 - protein, 9 aa, Homo Sapiens
MHKLSNSNR

SEQ ID NO: 905289 - protein, 9 aa, Homo Sapiens
VTQKTIRLA

SEQ ID NO: 905290 - protein, 9 aa, Homo Sapiens
PPCPDTRGH

SEQ ID NO: 905291 - protein, 9 aa, Homo Sapiens
KYGVQPWQM

SEQ ID NO: 905292 - protein, 9 aa, Homo Sapiens
IRGYGGTDV

SEQ ID NO: 905293 - protein, 9 aa, Homo Sapiens
TSLKEWLLA

SEQ ID NO: 905294 - protein, 9 aa, Homo Sapiens
DVFHTFCQL

SEQ ID NO: 905295 - protein, 9 aa, Homo Sapiens
MVADEGWTI

SEQ ID NO: 905296 - protein, 9 aa, Homo Sapiens
SADVFHTFC

SEQ ID NO: 905297 - protein, 9 aa, Homo Sapiens
RGHAHRLLH

SEQ ID NO: 905298 - protein, 9 aa, Homo Sapiens
LYILDRRWM

SEQ ID NO: 905299 - protein, 9 aa, Homo Sapiens
ALEAHCRAN

SEQ ID NO: 905300 - protein, 9 aa, Homo Sapiens
HGHPKSHST

SEQ ID NO: 905301 - protein, 9 aa, Homo Sapiens
LGMTSLKEW

SEQ ID NO: 905302 - protein, 9 aa, Homo Sapiens
ILLPPINCP

SEQ ID NO: 905303 - protein, 9 aa, Homo Sapiens
RVMMGQNGN

SEQ ID NO: 905304 - protein, 9 aa, Homo Sapiens
DVIVHRLLT

SEQ ID NO: 905305 - protein, 9 aa, Homo Sapiens
HPMGMLYHY

SEQ ID NO: 905306 - protein, 9 aa, Homo Sapiens
EIVGGRRAW

SEQ ID NO: 905307 - protein, 9 aa, Homo Sapiens
VHKRRYNGL

SEQ ID NO: 905308 - protein, 9 aa, Homo Sapiens
LDSHTLMTY

SEQ ID NO: 905309 - protein, 9 aa, Homo Sapiens
AVPQERNKK

SEQ ID NO: 905310 - protein, 9 aa, Homo Sapiens
KQDERVMMG

SEQ ID NO: 905311 - protein, 9 aa, Homo Sapiens
QYHEVMNLK

SEQ ID NO: 905312 - protein, 9 aa, Homo Sapiens
FLSQPILLK

SEQ ID NO: 905313 - protein, 9 aa, Homo Sapiens
NDRIQPIIM

SEQ ID NO: 905314 - protein, 9 aa, Homo Sapiens
IDAISFLSV

SEQ ID NO: 905315 - protein, 9 aa, Homo Sapiens
AGPGGPVGE

SEQ ID NO: 905316 - protein, 9 aa, Homo Sapiens
KLSNSNRHK

SEQ ID NO: 905317 - protein, 9 aa, Homo Sapiens
NAPAFTQTT

SEQ ID NO: 905318 - protein, 9 aa, Homo Sapiens
YGGTDVDQA

SEQ ID NO: 905319 - protein, 9 aa, Homo Sapiens
SGLSLPRSW

SEQ ID NO: 905320 - protein, 9 aa, Homo Sapiens
HTVVHIILS

SEQ ID NO: 905321 - protein, 9 aa, Homo Sapiens
ASKGCTVVG

SEQ ID NO: 905322 - protein, 9 aa, Homo Sapiens
KEKRKSKQK

SEQ ID NO: 905323 - protein, 9 aa, Homo Sapiens
GHPKSHSTS

SEQ ID NO: 905324 - protein, 9 aa, Homo Sapiens
RTQSPHGHP

SEQ ID NO: 905325 - protein, 9 aa, Homo Sapiens
FTDLSNSER

SEQ ID NO: 905326 - protein, 9 aa, Homo Sapiens
FKHERLVWK

SEQ ID NO: 905327 - protein, 9 aa, Homo Sapiens
SCMPNSFLK

SEQ ID NO: 905328 - protein, 9 aa, Homo Sapiens
LEEDKNRAV

SEQ ID NO: 905329 - protein, 9 aa, Homo Sapiens
CKTPSAEYL

SEQ ID NO: 905330 - protein, 9 aa, Homo Sapiens
VYFARVHGV

SEQ ID NO: 905331 - protein, 9 aa, Homo Sapiens
TQPRQKSWL

SEQ ID NO: 905332 - protein, 9 aa, Homo Sapiens
CLLVHQRSC

SEQ ID NO: 905333 - protein, 9 aa, Homo Sapiens
DKSRNTSWS

SEQ ID NO: 905334 - protein, 9 aa, Homo Sapiens
LPPINCPGD

SEQ ID NO: 905335 - protein, 9 aa, Homo Sapiens
TPTIVWTST

SEQ ID NO: 905336 - protein, 9 aa, Homo Sapiens
DEDEEEEAS

SEQ ID NO: 905337 - protein, 9 aa, Homo Sapiens
ELWPIPLQF

SEQ ID NO: 905338 - protein, 9 aa, Homo Sapiens
IPLQFYLLS

SEQ ID NO: 905339 - protein, 9 aa, Homo Sapiens
TYTLFVREN

SEQ ID NO: 905340 - protein, 9 aa, Homo Sapiens
MTSLKEWLL

SEQ ID NO: 905341 - protein, 9 aa, Homo Sapiens
LDRRWMPYG

SEQ ID NO: 905342 - protein, 9 aa, Homo Sapiens
PSHAASQPP

SEQ ID NO: 905343 - protein, 9 aa, Homo Sapiens
RRRQSIRCP

SEQ ID NO: 905344 - protein, 9 aa, Homo Sapiens
YHSIFCCKT

SEQ ID NO: 905345 - protein, 9 aa, Homo Sapiens
GKVHKRRYN

SEQ ID NO: 905346 - protein, 9 aa, Homo Sapiens
KEDEEGRLD

SEQ ID NO: 905347 - protein, 9 aa, Homo Sapiens
RRRLPPELS

SEQ ID NO: 905348 - protein, 9 aa, Homo Sapiens
PITTPTIVW

SEQ ID NO: 905349 - protein, 9 aa, Homo Sapiens
FYQKIIKYI

SEQ ID NO: 905350 - protein, 9 aa, Homo Sapiens
AFKHTVVHI

SEQ ID NO: 905351 - protein, 9 aa, Homo Sapiens
RGEEHTKFL

SEQ ID NO: 905352 - protein, 9 aa, Homo Sapiens
PKKDASKGC

SEQ ID NO: 905353 - protein, 9 aa, Homo Sapiens
GGGQGGQDG

SEQ ID NO: 905354 - protein, 9 aa, Homo Sapiens
LEAHCRANE

SEQ ID NO: 905355 - protein, 9 aa, Homo Sapiens
RKSKQKLKK

SEQ ID NO: 905356 - protein, 9 aa, Homo Sapiens
SVKRLTLSL

SEQ ID NO: 905357 - protein, 9 aa, Homo Sapiens
VESELMRDA

SEQ ID NO: 905358 - protein, 9 aa, Homo Sapiens
SKCTDGGRA

SEQ ID NO: 905359 - protein, 9 aa, Homo Sapiens
GHVLCLMPN

SEQ ID NO: 905360 - protein, 9 aa, Homo Sapiens
PGPRGDIGS

SEQ ID NO: 905361 - protein, 9 aa, Homo Sapiens
LAFKHTVVH

SEQ ID NO: 905362 - protein, 9 aa, Homo Sapiens
QGLSLDSHT

SEQ ID NO: 905363 - protein, 9 aa, Homo Sapiens
KSKQKLKKR

SEQ ID NO: 905364 - protein, 9 aa, Homo Sapiens
MSSGFKHER

SEQ ID NO: 905365 - protein, 9 aa, Homo Sapiens
PVLWSCMPN

SEQ ID NO: 905366 - protein, 9 aa, Homo Sapiens
RLKINGREH

SEQ ID NO: 905367 - protein, 9 aa, Homo Sapiens
LIMLILLRK

SEQ ID NO: 905368 - protein, 9 aa, Homo Sapiens
DIGSPGPQG

SEQ ID NO: 905369 - protein, 9 aa, Homo Sapiens
QKLKKRRGH

SEQ ID NO: 905370 - protein, 9 aa, Homo Sapiens
HSIFCCKTP

SEQ ID NO: 905371 - protein, 9 aa, Homo Sapiens
RRWMPYGGR

SEQ ID NO: 905372 - protein, 9 aa, Homo Sapiens
ILLKLEAPL

SEQ ID NO: 905373 - protein, 9 aa, Homo Sapiens
TVDGFTDLS

SEQ ID NO: 905374 - protein, 9 aa, Homo Sapiens
DVQYYPTAR

SEQ ID NO: 905375 - protein, 9 aa, Homo Sapiens
GSRIGFNFE

SEQ ID NO: 905376 - protein, 9 aa, Homo Sapiens
LDVQYYPTA

SEQ ID NO: 905377 - protein, 9 aa, Homo Sapiens
VVQLAKKIE

SEQ ID NO: 905378 - protein, 9 aa, Homo Sapiens
KEKDVVQLA

SEQ ID NO: 905379 - protein, 9 aa, Homo Sapiens
RHYLEYREV

SEQ ID NO: 905380 - protein, 9 aa, Homo Sapiens
GEEKPPLYA

SEQ ID NO: 905381 - protein, 9 aa, Homo Sapiens
ILTVLLKGT

SEQ ID NO: 905382 - protein, 9 aa, Homo Sapiens
LYLATISLT

SEQ ID NO: 905383 - protein, 9 aa, Homo Sapiens
RYGKMDMTI

SEQ ID NO: 905384 - protein, 9 aa, Homo Sapiens
WRIFTNSRE

SEQ ID NO: 905385 - protein, 9 aa, Homo Sapiens
KPALYLYQL

SEQ ID NO: 905386 - protein, 9 aa, Homo Sapiens
GQTSEGTLA

SEQ ID NO: 905387 - protein, 9 aa, Homo Sapiens
ETPCALDQT

SEQ ID NO: 905388 - protein, 9 aa, Homo Sapiens
KEHTGFSIR

SEQ ID NO: 905389 - protein, 9 aa, Homo Sapiens
QEMFDPHKR

SEQ ID NO: 905390 - protein, 9 aa, Homo Sapiens
PELDFQFKD

SEQ ID NO: 905391 - protein, 9 aa, Homo Sapiens
SGGGDSAAT

SEQ ID NO: 905392 - protein, 9 aa, Homo Sapiens
TLPKGAQLA

SEQ ID NO: 905393 - protein, 9 aa, Homo Sapiens
HAQKLLEFH

SEQ ID NO: 905394 - protein, 9 aa, Homo Sapiens
ESCVRSFAC

SEQ ID NO: 905395 - protein, 9 aa, Homo Sapiens
LATLPKGAQ

SEQ ID NO: 905396 - protein, 9 aa, Homo Sapiens
EEKGKKGVI

SEQ ID NO: 905397 - protein, 9 aa, Homo Sapiens
VSPNTLSQV

SEQ ID NO: 905398 - protein, 9 aa, Homo Sapiens
RILGVCFVD

SEQ ID NO: 905399 - protein, 9 aa, Homo Sapiens
KKAQEEALQ

SEQ ID NO: 905400 - protein, 9 aa, Homo Sapiens
TSASWCRAQ

SEQ ID NO: 905401 - protein, 9 aa, Homo Sapiens
PRRYGKMDM

SEQ ID NO: 905402 - protein, 9 aa, Homo Sapiens
PSQCKEWNL

SEQ ID NO: 905403 - protein, 9 aa, Homo Sapiens
VRKIYATVK

SEQ ID NO: 905404 - protein, 9 aa, Homo Sapiens
RMKWFKLLF

SEQ ID NO: 905405 - protein, 9 aa, Homo Sapiens
QQQIQANTE

SEQ ID NO: 905406 - protein, 9 aa, Homo Sapiens
QTFLLTKDG

SEQ ID NO: 905407 - protein, 9 aa, Homo Sapiens
LLTKDGAAD

SEQ ID NO: 905408 - protein, 9 aa, Homo Sapiens
QVLKKMNEN

SEQ ID NO: 905409 - protein, 9 aa, Homo Sapiens
LASAIDVDH

SEQ ID NO: 905410 - protein, 9 aa, Homo Sapiens
NRWRLREPE

SEQ ID NO: 905411 - protein, 9 aa, Homo Sapiens
HPGVTNEQL

SEQ ID NO: 905412 - protein, 9 aa, Homo Sapiens
VVLSSGLRQ

SEQ ID NO: 905413 - protein, 9 aa, Homo Sapiens
SQCKEWNLQ

SEQ ID NO: 905414 - protein, 9 aa, Homo Sapiens
HISEHVLWD

SEQ ID NO: 905415 - protein, 9 aa, Homo Sapiens
PLDIAIMTK

SEQ ID NO: 905416 - protein, 9 aa, Homo Sapiens
QFSSCKSLL

SEQ ID NO: 905417 - protein, 9 aa, Homo Sapiens
FLKEHTGFS

SEQ ID NO: 905418 - protein, 9 aa, Homo Sapiens
IDPNALLDL

SEQ ID NO: 905419 - protein, 9 aa, Homo Sapiens
GIDPNALLD

SEQ ID NO: 905420 - protein, 9 aa, Homo Sapiens
DGRIEVKWQ

SEQ ID NO: 905421 - protein, 9 aa, Homo Sapiens
TANRLQIHS

SEQ ID NO: 905422 - protein, 9 aa, Homo Sapiens
ELTVFENWL

SEQ ID NO: 905423 - protein, 9 aa, Homo Sapiens
GTLHPGVTN

SEQ ID NO: 905424 - protein, 9 aa, Homo Sapiens
QVQEPFTHP

SEQ ID NO: 905425 - protein, 9 aa, Homo Sapiens
PTCGCIFRN

SEQ ID NO: 905426 - protein, 9 aa, Homo Sapiens
GRSCQQKGV

SEQ ID NO: 905427 - protein, 9 aa, Homo Sapiens
KCIEVAKLD

SEQ ID NO: 905428 - protein, 9 aa, Homo Sapiens
IQVQEPFTH

SEQ ID NO: 905429 - protein, 9 aa, Homo Sapiens
EIGDTLTFS

SEQ ID NO: 905430 - protein, 9 aa, Homo Sapiens
ECGECLVPV

SEQ ID NO: 905431 - protein, 9 aa, Homo Sapiens
YPTARIHAS

SEQ ID NO: 905432 - protein, 9 aa, Homo Sapiens
MRRSSLLSQ

SEQ ID NO: 905433 - protein, 9 aa, Homo Sapiens
AAANPETTT

SEQ ID NO: 905434 - protein, 9 aa, Homo Sapiens
CIEVAKLDG

SEQ ID NO: 905435 - protein, 9 aa, Homo Sapiens
GTIIGTVTA

SEQ ID NO: 905436 - protein, 9 aa, Homo Sapiens
LLHKDQRQW

SEQ ID NO: 905437 - protein, 9 aa, Homo Sapiens
AANPETTTV

SEQ ID NO: 905438 - protein, 9 aa, Homo Sapiens
DAEEKGKKG

SEQ ID NO: 905439 - protein, 9 aa, Homo Sapiens
DPNALLDLV

SEQ ID NO: 905440 - protein, 9 aa, Homo Sapiens
GGDKPALYL

SEQ ID NO: 905441 - protein, 9 aa, Homo Sapiens
PHTIVAVEV

SEQ ID NO: 905442 - protein, 9 aa, Homo Sapiens
VEGSCFWPA

SEQ ID NO: 905443 - protein, 9 aa, Homo Sapiens
GECLVPVPT

SEQ ID NO: 905444 - protein, 9 aa, Homo Sapiens
ILEETPCAL

SEQ ID NO: 905445 - protein, 9 aa, Homo Sapiens
EFLEEEQQL

SEQ ID NO: 905446 - protein, 9 aa, Homo Sapiens
LTQSKFVHS

SEQ ID NO: 905447 - protein, 9 aa, Homo Sapiens
YNKTDVATP

SEQ ID NO: 905448 - protein, 9 aa, Homo Sapiens
SLTIVAFVK

SEQ ID NO: 905449 - protein, 9 aa, Homo Sapiens
MTGVNDLGE

SEQ ID NO: 905450 - protein, 9 aa, Homo Sapiens
CHAFFLRVS

SEQ ID NO: 905451 - protein, 9 aa, Homo Sapiens
EEEPERKEV

SEQ ID NO: 905452 - protein, 9 aa, Homo Sapiens
VLDENDNTP

SEQ ID NO: 905453 - protein, 9 aa, Homo Sapiens
VLSVRTGYD

SEQ ID NO: 905454 - protein, 9 aa, Homo Sapiens
VWRIFTNSR

SEQ ID NO: 905455 - protein, 9 aa, Homo Sapiens
RQERDREFL

SEQ ID NO: 905456 - protein, 9 aa, Homo Sapiens
PTQYSTVRT

SEQ ID NO: 905457 - protein, 9 aa, Homo Sapiens
GESLVRLLT

SEQ ID NO: 905458 - protein, 9 aa, Homo Sapiens
ATISLTIVA

SEQ ID NO: 905459 - protein, 9 aa, Homo Sapiens
ADEEKSKKE

SEQ ID NO: 905460 - protein, 9 aa, Homo Sapiens
EELATLPKG

SEQ ID NO: 905461 - protein, 9 aa, Homo Sapiens
SHIAKQVSS

SEQ ID NO: 905462 - protein, 9 aa, Homo Sapiens
CVEGSCFWP

SEQ ID NO: 905463 - protein, 9 aa, Homo Sapiens
RIEVKWQHG

SEQ ID NO: 905464 - protein, 9 aa, Homo Sapiens
NTPALLATP

SEQ ID NO: 905465 - protein, 9 aa, Homo Sapiens
RDTANRLQI

SEQ ID NO: 905466 - protein, 9 aa, Homo Sapiens
VPVSEVMGA

SEQ ID NO: 905467 - protein, 9 aa, Homo Sapiens
KWFKLLFYV

SEQ ID NO: 905468 - protein, 9 aa, Homo Sapiens
LQPVELTVF

SEQ ID NO: 905469 - protein, 9 aa, Homo Sapiens
GLPLINGQN

SEQ ID NO: 905470 - protein, 9 aa, Homo Sapiens
PLPGSVETP

SEQ ID NO: 905471 - protein, 9 aa, Homo Sapiens
VKKAQEEAL

SEQ ID NO: 905472 - protein, 9 aa, Homo Sapiens
GATLAEMST

SEQ ID NO: 905473 - protein, 9 aa, Homo Sapiens
LKEKDVVQL

SEQ ID NO: 905474 - protein, 9 aa, Homo Sapiens
IIGTVTAQD

SEQ ID NO: 905475 - protein, 9 aa, Homo Sapiens
PLINGQNCD

SEQ ID NO: 905476 - protein, 9 aa, Homo Sapiens
WVDAEEKGK

SEQ ID NO: 905477 - protein, 9 aa, Homo Sapiens
PVKEPHGLS

SEQ ID NO: 905478 - protein, 9 aa, Homo Sapiens
RGGDKPALY

SEQ ID NO: 905479 - protein, 9 aa, Homo Sapiens
ATLPKGAQL

SEQ ID NO: 905480 - protein, 9 aa, Homo Sapiens
RETRPFPHT

SEQ ID NO: 905481 - protein, 9 aa, Homo Sapiens
AQEEMTGVN

SEQ ID NO: 905482 - protein, 9 aa, Homo Sapiens
LTSASWCRA

SEQ ID NO: 905483 - protein, 9 aa, Homo Sapiens
LTIVAFVKY

SEQ ID NO: 905484 - protein, 9 aa, Homo Sapiens
INGQNCDPY

SEQ ID NO: 905485 - protein, 9 aa, Homo Sapiens
TVAGVQVSG

SEQ ID NO: 905486 - protein, 9 aa, Homo Sapiens
KVVWRIFTN

SEQ ID NO: 905487 - protein, 9 aa, Homo Sapiens
CALDQTTEW

SEQ ID NO: 905488 - protein, 9 aa, Homo Sapiens
GSCFWPAGH

SEQ ID NO: 905489 - protein, 9 aa, Homo Sapiens
KEPHGLSAA

SEQ ID NO: 905490 - protein, 9 aa, Homo Sapiens
HTGFSIRPV

SEQ ID NO: 905491 - protein, 9 aa, Homo Sapiens
VHECGECLV

SEQ ID NO: 905492 - protein, 9 aa, Homo Sapiens
TISLTIVAF

SEQ ID NO: 905493 - protein, 9 aa, Homo Sapiens
PALYLYQLS

SEQ ID NO: 905494 - protein, 9 aa, Homo Sapiens
RKIYATVKI

SEQ ID NO: 905495 - protein, 9 aa, Homo Sapiens
SKKEECNLW

SEQ ID NO: 905496 - protein, 9 aa, Homo Sapiens
DFQFKDAGL

SEQ ID NO: 905497 - protein, 9 aa, Homo Sapiens
CGCIFRNFN

SEQ ID NO: 905498 - protein, 9 aa, Homo Sapiens
EETPCALDQ

SEQ ID NO: 905499 - protein, 9 aa, Homo Sapiens
VELTVFENW

SEQ ID NO: 905500 - protein, 9 aa, Homo Sapiens
LRQHISEHV

SEQ ID NO: 905501 - protein, 9 aa, Homo Sapiens
QKGCPLTSA

SEQ ID NO: 905502 - protein, 9 aa, Homo Sapiens
QHISEHVLW

SEQ ID NO: 905503 - protein, 9 aa, Homo Sapiens
GVSLCHPVW

SEQ ID NO: 905504 - protein, 9 aa, Homo Sapiens
LAGDKASGG

SEQ ID NO: 905505 - protein, 9 aa, Homo Sapiens
DGVSLCHPV

SEQ ID NO: 905506 - protein, 9 aa, Homo Sapiens
RSSLLSQSS

SEQ ID NO: 905507 - protein, 9 aa, Homo Sapiens
IAKQVSSLS

SEQ ID NO: 905508 - protein, 9 aa, Homo Sapiens
WNLQDPVPK

SEQ ID NO: 905509 - protein, 9 aa, Homo Sapiens
QKLLEFHIQ

SEQ ID NO: 905510 - protein, 9 aa, Homo Sapiens
EEKSKKEEC

SEQ ID NO: 905511 - protein, 9 aa, Homo Sapiens
VDAEEKGKK

SEQ ID NO: 905512 - protein, 9 aa, Homo Sapiens
IEEWLLMYS

SEQ ID NO: 905513 - protein, 9 aa, Homo Sapiens
GTVTAQDLD

SEQ ID NO: 905514 - protein, 9 aa, Homo Sapiens
NFLKEHTGF

SEQ ID NO: 905515 - protein, 9 aa, Homo Sapiens
KRILGVCFV

SEQ ID NO: 905516 - protein, 9 aa, Homo Sapiens
LINGQNCDP

SEQ ID NO: 905517 - protein, 9 aa, Homo Sapiens
PEHAQKLLE

SEQ ID NO: 905518 - protein, 9 aa, Homo Sapiens
LGVCFVDQG

SEQ ID NO: 905519 - protein, 9 aa, Homo Sapiens
KTQFSSCKS

SEQ ID NO: 905520 - protein, 9 aa, Homo Sapiens
KRRRTIIEC

SEQ ID NO: 905521 - protein, 9 aa, Homo Sapiens
WRLREPELG

SEQ ID NO: 905522 - protein, 9 aa, Homo Sapiens
QCKEWNLQD

SEQ ID NO: 905523 - protein, 9 aa, Homo Sapiens
VLDVQYYPT

SEQ ID NO: 905524 - protein, 9 aa, Homo Sapiens
GNHAMRLPL

SEQ ID NO: 905525 - protein, 9 aa, Homo Sapiens
NKTDVATPF

SEQ ID NO: 905526 - protein, 9 aa, Homo Sapiens
IAIMTKNVP

SEQ ID NO: 905527 - protein, 9 aa, Homo Sapiens
QEEMTGVND

SEQ ID NO: 905528 - protein, 9 aa, Homo Sapiens
ALQQPEAAA

SEQ ID NO: 905529 - protein, 9 aa, Homo Sapiens
LTVLLKGTN

SEQ ID NO: 905530 - protein, 9 aa, Homo Sapiens
TDVATPFGG

SEQ ID NO: 905531 - protein, 9 aa, Homo Sapiens
VRSFACSDE

SEQ ID NO: 905532 - protein, 9 aa, Homo Sapiens
YYPELDFQF

SEQ ID NO: 905533 - protein, 9 aa, Homo Sapiens
PHGLSAASP

SEQ ID NO: 905534 - protein, 9 aa, Homo Sapiens
HSSDSVKVS

SEQ ID NO: 905535 - protein, 9 aa, Homo Sapiens
KVSQSPPIE

SEQ ID NO: 905536 - protein, 9 aa, Homo Sapiens
VWVQRHYLE

SEQ ID NO: 905537 - protein, 9 aa, Homo Sapiens
KKRRRTIIE

SEQ ID NO: 905538 - protein, 9 aa, Homo Sapiens
FQALNPLWQ

SEQ ID NO: 905539 - protein, 9 aa, Homo Sapiens
QSINMLPLK

SEQ ID NO: 905540 - protein, 9 aa, Homo Sapiens
MRLPLMECV

SEQ ID NO: 905541 - protein, 9 aa, Homo Sapiens
YLYQLSPSE

SEQ ID NO: 905542 - protein, 9 aa, Homo Sapiens
ANPETTTVS

SEQ ID NO: 905543 - protein, 9 aa, Homo Sapiens
SSCKSLLES

SEQ ID NO: 905544 - protein, 9 aa, Homo Sapiens
IMTKNVPIA

SEQ ID NO: 905545 - protein, 9 aa, Homo Sapiens
PLYAETQWK

SEQ ID NO: 905546 - protein, 9 aa, Homo Sapiens
GTLAGDKAS

SEQ ID NO: 905547 - protein, 9 aa, Homo Sapiens
ASWCRAQIS

SEQ ID NO: 905548 - protein, 9 aa, Homo Sapiens
PLSGGGDSA

SEQ ID NO: 905549 - protein, 9 aa, Homo Sapiens
CQQKGVPIQ

SEQ ID NO: 905550 - protein, 9 aa, Homo Sapiens
FNFEIGDTL

SEQ ID NO: 905551 - protein, 9 aa, Homo Sapiens
EITKQEKDF

SEQ ID NO: 905552 - protein, 9 aa, Homo Sapiens
FSSCKSLLE

SEQ ID NO: 905553 - protein, 9 aa, Homo Sapiens
VIPRRYGKM

SEQ ID NO: 905554 - protein, 9 aa, Homo Sapiens
TAQEEMTGV

SEQ ID NO: 905555 - protein, 9 aa, Homo Sapiens
EWLLMYSFV

SEQ ID NO: 905556 - protein, 9 aa, Homo Sapiens
KKEECNLWT

SEQ ID NO: 905557 - protein, 9 aa, Homo Sapiens
HISHIAKQV

SEQ ID NO: 905558 - protein, 9 aa, Homo Sapiens
WLGSKADFL

SEQ ID NO: 905559 - protein, 9 aa, Homo Sapiens
SSGSEVKQP

SEQ ID NO: 905560 - protein, 9 aa, Homo Sapiens
KQEKDFLWS

SEQ ID NO: 905561 - protein, 9 aa, Homo Sapiens
FWPAGHQTG

SEQ ID NO: 905562 - protein, 9 aa, Homo Sapiens
IFRNFNLFL

SEQ ID NO: 905563 - protein, 9 aa, Homo Sapiens
AIDVDHFFL

SEQ ID NO: 905564 - protein, 9 aa, Homo Sapiens
LDFQFKDAG

SEQ ID NO: 905565 - protein, 9 aa, Homo Sapiens
LSQVEGDQI

SEQ ID NO: 905566 - protein, 9 aa, Homo Sapiens
DTKKLEQAG

SEQ ID NO: 905567 - protein, 9 aa, Homo Sapiens
QKSMGLPTL

SEQ ID NO: 905568 - protein, 9 aa, Homo Sapiens
CFWPAGHQT

SEQ ID NO: 905569 - protein, 9 aa, Homo Sapiens
VSLNGNHAM

SEQ ID NO: 905570 - protein, 9 aa, Homo Sapiens
CVRSFACSD

SEQ ID NO: 905571 - protein, 9 aa, Homo Sapiens
QQKGVPIQT

SEQ ID NO: 905572 - protein, 9 aa, Homo Sapiens
EVKWQHGSS

SEQ ID NO: 905573 - protein, 9 aa, Homo Sapiens
THPVLRASS

SEQ ID NO: 905574 - protein, 9 aa, Homo Sapiens
FVHSFAADS

SEQ ID NO: 905575 - protein, 9 aa, Homo Sapiens
VLERPEPHW

SEQ ID NO: 905576 - protein, 9 aa, Homo Sapiens
DPHKRKFSE

SEQ ID NO: 905577 - protein, 9 aa, Homo Sapiens
NGNHAMRLP

SEQ ID NO: 905578 - protein, 9 aa, Homo Sapiens
ATLAEMSTP

SEQ ID NO: 905579 - protein, 9 aa, Homo Sapiens
KSMGLPTLD

SEQ ID NO: 905580 - protein, 9 aa, Homo Sapiens
QKGVPIQTP

SEQ ID NO: 905581 - protein, 9 aa, Homo Sapiens
IEVKWQHGS

SEQ ID NO: 905582 - protein, 9 aa, Homo Sapiens
RQERQSINM

SEQ ID NO: 905583 - protein, 9 aa, Homo Sapiens
LPLSGGGDS

SEQ ID NO: 905584 - protein, 9 aa, Homo Sapiens
SDTKKLEQA

SEQ ID NO: 905585 - protein, 9 aa, Homo Sapiens
LRDTANRLQ

SEQ ID NO: 905586 - protein, 9 aa, Homo Sapiens
EEALQQPEA

SEQ ID NO: 905587 - protein, 9 aa, Homo Sapiens
QHMQQLLQQ

SEQ ID NO: 905588 - protein, 9 aa, Homo Sapiens
LPKGAQLAA

SEQ ID NO: 905589 - protein, 9 aa, Homo Sapiens
LQQQIQANT

SEQ ID NO: 905590 - protein, 9 aa, Homo Sapiens
CSVHECGEC

SEQ ID NO: 905591 - protein, 9 aa, Homo Sapiens
TPFGGFKQS

SEQ ID NO: 905592 - protein, 9 aa, Homo Sapiens
LTKVWVQRH

SEQ ID NO: 905593 - protein, 9 aa, Homo Sapiens
VRTGYDKGE

SEQ ID NO: 905594 - protein, 9 aa, Homo Sapiens
IADEEKSKK

SEQ ID NO: 905595 - protein, 9 aa, Homo Sapiens
QPFQVLKKM

SEQ ID NO: 905596 - protein, 9 aa, Homo Sapiens
VKVSQSPPI

SEQ ID NO: 905597 - protein, 9 aa, Homo Sapiens
AEAGRSCQQ

SEQ ID NO: 905598 - protein, 9 aa, Homo Sapiens
NLLVYEQQD

SEQ ID NO: 905599 - protein, 9 aa, Homo Sapiens
TPTQYSTVR

SEQ ID NO: 905600 - protein, 9 aa, Homo Sapiens
PSTPTQYST

SEQ ID NO: 905601 - protein, 9 aa, Homo Sapiens
PLTSASWCR

SEQ ID NO: 905602 - protein, 9 aa, Homo Sapiens
VSGVTHIWA

SEQ ID NO: 905603 - protein, 9 aa, Homo Sapiens
TQSKFVHSF

SEQ ID NO: 905604 - protein, 9 aa, Homo Sapiens
GGGDSAATA

SEQ ID NO: 905605 - protein, 9 aa, Homo Sapiens
TLAGDKASG

SEQ ID NO: 905606 - protein, 9 aa, Homo Sapiens
GGDSAATAC

SEQ ID NO: 905607 - protein, 9 aa, Homo Sapiens
GGQTSEGTL

SEQ ID NO: 905608 - protein, 9 aa, Homo Sapiens
VNTILEIMR

SEQ ID NO: 905609 - protein, 9 aa, Homo Sapiens
DLDLAILTV

SEQ ID NO: 905610 - protein, 9 aa, Homo Sapiens
RPFPHTIVA

SEQ ID NO: 905611 - protein, 9 aa, Homo Sapiens
GQKNNIKGQ

SEQ ID NO: 905612 - protein, 9 aa, Homo Sapiens
EEKPPLYAE

SEQ ID NO: 905613 - protein, 9 aa, Homo Sapiens
EWKRFIEEW

SEQ ID NO: 905614 - protein, 9 aa, Homo Sapiens
MGLPTLDEQ

SEQ ID NO: 905615 - protein, 9 aa, Homo Sapiens
GAHISHIAK

SEQ ID NO: 905616 - protein, 9 aa, Homo Sapiens
HTIVAVEVQ

SEQ ID NO: 905617 - protein, 9 aa, Homo Sapiens
ALLDLVQFA

SEQ ID NO: 905618 - protein, 9 aa, Homo Sapiens
KLLFYVGAQ

SEQ ID NO: 905619 - protein, 9 aa, Homo Sapiens
DGPHTKVVW

SEQ ID NO: 905620 - protein, 9 aa, Homo Sapiens
PFQKGCPLT

SEQ ID NO: 905621 - protein, 9 aa, Homo Sapiens
PVSEVMGAT

SEQ ID NO: 905622 - protein, 9 aa, Homo Sapiens
ITPSQCKEW

SEQ ID NO: 905623 - protein, 9 aa, Homo Sapiens
DSVKVSQSP

SEQ ID NO: 905624 - protein, 9 aa, Homo Sapiens
RRYGKMDMT

SEQ ID NO: 905625 - protein, 9 aa, Homo Sapiens
SEGTLAGDK

SEQ ID NO: 905626 - protein, 9 aa, Homo Sapiens
RRRTIIECG

SEQ ID NO: 905627 - protein, 9 aa, Homo Sapiens
TCGCIFRNF

SEQ ID NO: 905628 - protein, 9 aa, Homo Sapiens
FIEEWLLMY

SEQ ID NO: 905629 - protein, 9 aa, Homo Sapiens
SFACSDELN

SEQ ID NO: 905630 - protein, 9 aa, Homo Sapiens
SKTQFSSCK

SEQ ID NO: 905631 - protein, 9 aa, Homo Sapiens
CGECLVPVP

SEQ ID NO: 905632 - protein, 9 aa, Homo Sapiens
FDPHKRKFS

SEQ ID NO: 905633 - protein, 9 aa, Homo Sapiens
VLGGESLVR

SEQ ID NO: 905634 - protein, 9 aa, Homo Sapiens
RSFACSDEL

SEQ ID NO: 905635 - protein, 9 aa, Homo Sapiens
MVCLVHLSI

SEQ ID NO: 905636 - protein, 9 aa, Homo Sapiens
GCIFRNFNL

SEQ ID NO: 905637 - protein, 9 aa, Homo Sapiens
TLSQVEGDQ

SEQ ID NO: 905638 - protein, 9 aa, Homo Sapiens
DVVQLAKKI

SEQ ID NO: 905639 - protein, 9 aa, Homo Sapiens
VETPTVDTI

SEQ ID NO: 905640 - protein, 9 aa, Homo Sapiens
ERPEPHWWR

SEQ ID NO: 905641 - protein, 9 aa, Homo Sapiens
GDSAATACL

SEQ ID NO: 905642 - protein, 9 aa, Homo Sapiens
KAQEEALQQ

SEQ ID NO: 905643 - protein, 9 aa, Homo Sapiens
AKQVSSLSE

SEQ ID NO: 905644 - protein, 9 aa, Homo Sapiens
GAQLAAAFI

SEQ ID NO: 905645 - protein, 9 aa, Homo Sapiens
MPFQKGCPL

SEQ ID NO: 905646 - protein, 9 aa, Homo Sapiens
SNILQPVEL

SEQ ID NO: 905647 - protein, 9 aa, Homo Sapiens
AQKLLEFHI

SEQ ID NO: 905648 - protein, 9 aa, Homo Sapiens
SEVMGATLA

SEQ ID NO: 905649 - protein, 9 aa, Homo Sapiens
QERDREFLE

SEQ ID NO: 905650 - protein, 9 aa, Homo Sapiens
QWYYPELDF

SEQ ID NO: 905651 - protein, 9 aa, Homo Sapiens
EMFDPHKRK

SEQ ID NO: 905652 - protein, 9 aa, Homo Sapiens
LVHLSILEP

SEQ ID NO: 905653 - protein, 9 aa, Homo Sapiens
LAKKIEALQ

SEQ ID NO: 905654 - protein, 9 aa, Homo Sapiens
QYVLDVQYY

SEQ ID NO: 905655 - protein, 9 aa, Homo Sapiens
SRIGFNFEI

SEQ ID NO: 905656 - protein, 9 aa, Homo Sapiens
MGATLAEMS

SEQ ID NO: 905657 - protein, 9 aa, Homo Sapiens
FLASAIDVD

SEQ ID NO: 905658 - protein, 9 aa, Homo Sapiens
PHKRKFSEE

SEQ ID NO: 905659 - protein, 9 aa, Homo Sapiens
ACHAFFLRV

SEQ ID NO: 905660 - protein, 9 aa, Homo Sapiens
DAQLITQSI

SEQ ID NO: 905661 - protein, 9 aa, Homo Sapiens
EMTGVNDLG

SEQ ID NO: 905662 - protein, 9 aa, Homo Sapiens
HPVLRASSF

SEQ ID NO: 905663 - protein, 9 aa, Homo Sapiens
DGAADDPWR

SEQ ID NO: 905664 - protein, 9 aa, Homo Sapiens
VKQPVRKDN

SEQ ID NO: 905665 - protein, 9 aa, Homo Sapiens
AVNTILEIM

SEQ ID NO: 905666 - protein, 9 aa, Homo Sapiens
TGVNDLGER

SEQ ID NO: 905667 - protein, 9 aa, Homo Sapiens
YLATISLTI

SEQ ID NO: 905668 - protein, 9 aa, Homo Sapiens
SHMLSAKLK

SEQ ID NO: 905669 - protein, 9 aa, Homo Sapiens
TYNKTDVAT

SEQ ID NO: 905670 - protein, 9 aa, Homo Sapiens
LFFPEHAQK

SEQ ID NO: 905671 - protein, 9 aa, Homo Sapiens
GTVQAAVNT

SEQ ID NO: 905672 - protein, 9 aa, Homo Sapiens
ASAIDVDHF

SEQ ID NO: 905673 - protein, 9 aa, Homo Sapiens
QQDGSKSLK

SEQ ID NO: 905674 - protein, 9 aa, Homo Sapiens
QEEALQQPE

SEQ ID NO: 905675 - protein, 9 aa, Homo Sapiens
WLLMYSFVN

SEQ ID NO: 905676 - protein, 9 aa, Homo Sapiens
EHVLWDLGR

SEQ ID NO: 905677 - protein, 9 aa, Homo Sapiens
LCHPVWSAV

SEQ ID NO: 905678 - protein, 9 aa, Homo Sapiens
SNFLKEHTG

SEQ ID NO: 905679 - protein, 9 aa, Homo Sapiens
ERDREFLEE

SEQ ID NO: 905680 - protein, 9 aa, Homo Sapiens
MFVRKIYAT

SEQ ID NO: 905681 - protein, 9 aa, Homo Sapiens
EVMGATLAE

SEQ ID NO: 905682 - protein, 9 aa, Homo Sapiens
GDKPALYLY

SEQ ID NO: 905683 - protein, 9 aa, Homo Sapiens
ALNPLWQSR

SEQ ID NO: 905684 - protein, 9 aa, Homo Sapiens
ESEDAQLIT

SEQ ID NO: 905685 - protein, 9 aa, Homo Sapiens
VQRHYLEYR

SEQ ID NO: 905686 - protein, 9 aa, Homo Sapiens
THMPFQKGC

SEQ ID NO: 905687 - protein, 9 aa, Homo Sapiens
SVKVSQSPP

SEQ ID NO: 905688 - protein, 9 aa, Homo Sapiens
CSDELNRHL

SEQ ID NO: 905689 - protein, 9 aa, Homo Sapiens
TKKLEQAGS

SEQ ID NO: 905690 - protein, 9 aa, Homo Sapiens
EKPPLYAET

SEQ ID NO: 905691 - protein, 9 aa, Homo Sapiens
LAGFLASAI

SEQ ID NO: 905692 - protein, 9 aa, Homo Sapiens
SAIDVDHFF

SEQ ID NO: 905693 - protein, 9 aa, Homo Sapiens
GSEVKQPVR

SEQ ID NO: 905694 - protein, 9 aa, Homo Sapiens
VLLKGTNLS

SEQ ID NO: 905695 - protein, 9 aa, Homo Sapiens
CHPVWSAVV

SEQ ID NO: 905696 - protein, 9 aa, Homo Sapiens
VFQALNPLW

SEQ ID NO: 905697 - protein, 9 aa, Homo Sapiens
PGQKNNIKG

SEQ ID NO: 905698 - protein, 9 aa, Homo Sapiens
NEEEEPERK

SEQ ID NO: 905699 - protein, 9 aa, Homo Sapiens
GLPTLDEQK

SEQ ID NO: 905700 - protein, 9 aa, Homo Sapiens
QSKFVHSFA

SEQ ID NO: 905701 - protein, 9 aa, Homo Sapiens
PFPHTIVAV

SEQ ID NO: 905702 - protein, 9 aa, Homo Sapiens
SQSSSGYFS

SEQ ID NO: 905703 - protein, 9 aa, Homo Sapiens
SCQQKGVPI

SEQ ID NO: 905704 - protein, 9 aa, Homo Sapiens
EGEEKPPLY

SEQ ID NO: 905705 - protein, 9 aa, Homo Sapiens
DYKHGTLHP

SEQ ID NO: 905706 - protein, 9 aa, Homo Sapiens
PFQVLKKMN

SEQ ID NO: 905707 - protein, 9 aa, Homo Sapiens
VLSSGLRQR

SEQ ID NO: 905708 - protein, 9 aa, Homo Sapiens
SKFVHSFAA

SEQ ID NO: 905709 - protein, 9 aa, Homo Sapiens
AVLPPSFRP

SEQ ID NO: 905710 - protein, 9 aa, Homo Sapiens
LLSQSSSGY

SEQ ID NO: 905711 - protein, 9 aa, Homo Sapiens
SGLRQRSKK

SEQ ID NO: 905712 - protein, 9 aa, Homo Sapiens
SLLSQSSSG

SEQ ID NO: 905713 - protein, 9 aa, Homo Sapiens
PGSVETPTV

SEQ ID NO: 905714 - protein, 9 aa, Homo Sapiens
RTIIECGCD

SEQ ID NO: 905715 - protein, 9 aa, Homo Sapiens
KVWVQRHYL

SEQ ID NO: 905716 - protein, 9 aa, Homo Sapiens
DVSNFLKEH

SEQ ID NO: 905717 - protein, 9 aa, Homo Sapiens
DLAILTVLL

SEQ ID NO: 905718 - protein, 9 aa, Homo Sapiens
SWCRAQISR

SEQ ID NO: 905719 - protein, 9 aa, Homo Sapiens
IISSGSEVK

SEQ ID NO: 905720 - protein, 9 aa, Homo Sapiens
RIGFNFEIG

SEQ ID NO: 905721 - protein, 9 aa, Homo Sapiens
FVLSVRTGY

SEQ ID NO: 905722 - protein, 9 aa, Homo Sapiens
VCFVDQGSL

SEQ ID NO: 905723 - protein, 9 aa, Homo Sapiens
KDVVQLAKK

SEQ ID NO: 905724 - protein, 9 aa, Homo Sapiens
LVYEQQDGS

SEQ ID NO: 905725 - protein, 9 aa, Homo Sapiens
YDKGESNDG

SEQ ID NO: 905726 - protein, 9 aa, Homo Sapiens
GVCFVDQGS

SEQ ID NO: 905727 - protein, 9 aa, Homo Sapiens
YEQQDGSKS

SEQ ID NO: 905728 - protein, 9 aa, Homo Sapiens
ITKQEKDFL

SEQ ID NO: 905729 - protein, 9 aa, Homo Sapiens
PSFRPHFEV

SEQ ID NO: 905730 - protein, 9 aa, Homo Sapiens
QPVELTVFE

SEQ ID NO: 905731 - protein, 9 aa, Homo Sapiens
ARPVKEPHG

SEQ ID NO: 905732 - protein, 9 aa, Homo Sapiens
LSAKLKEEK

SEQ ID NO: 905733 - protein, 9 aa, Homo Sapiens
RTGYDKGES

SEQ ID NO: 905734 - protein, 9 aa, Homo Sapiens
AGRSCQQKG

SEQ ID NO: 905735 - protein, 9 aa, Homo Sapiens
VNDLGERQS

SEQ ID NO: 905736 - protein, 9 aa, Homo Sapiens
KTDVATPFG

SEQ ID NO: 905737 - protein, 9 aa, Homo Sapiens
VRMKGLNPL

SEQ ID NO: 905738 - protein, 9 aa, Homo Sapiens
YWSDVKNKC

SEQ ID NO: 905739 - protein, 9 aa, Homo Sapiens
EPHWWRGRS

SEQ ID NO: 905740 - protein, 9 aa, Homo Sapiens
PGNPGQKNN

SEQ ID NO: 905741 - protein, 9 aa, Homo Sapiens
HVLWDLGRD

SEQ ID NO: 905742 - protein, 9 aa, Homo Sapiens
KEWNLQDPV

SEQ ID NO: 905743 - protein, 9 aa, Homo Sapiens
ILQPVELTV

SEQ ID NO: 905744 - protein, 9 aa, Homo Sapiens
EEMTGVNDL

SEQ ID NO: 905745 - protein, 9 aa, Homo Sapiens
QWLGSKADF

SEQ ID NO: 905746 - protein, 9 aa, Homo Sapiens
QERQSINML

SEQ ID NO: 905747 - protein, 9 aa, Homo Sapiens
WPAGHQTGI

SEQ ID NO: 905748 - protein, 9 aa, Homo Sapiens
WSDVKNKCI

SEQ ID NO: 905749 - protein, 9 aa, Homo Sapiens
VQAAVNTIL

SEQ ID NO: 905750 - protein, 9 aa, Homo Sapiens
DIAIMTKNV

SEQ ID NO: 905751 - protein, 9 aa, Homo Sapiens
NTILEIMRK

SEQ ID NO: 905752 - protein, 9 aa, Homo Sapiens
SSDSVKVSQ

SEQ ID NO: 905753 - protein, 9 aa, Homo Sapiens
YGKMDMTIY

SEQ ID NO: 905754 - protein, 9 aa, Homo Sapiens
HPTCGCIFR

SEQ ID NO: 905755 - protein, 9 aa, Homo Sapiens
KWQHGSSSL

SEQ ID NO: 905756 - protein, 9 aa, Homo Sapiens
TVTAQDLDV

SEQ ID NO: 905757 - protein, 9 aa, Homo Sapiens
LLPLSGGGD

SEQ ID NO: 905758 - protein, 9 aa, Homo Sapiens
AEEKGKKGV

SEQ ID NO: 905759 - protein, 9 aa, Homo Sapiens
YKHGTLHPG

SEQ ID NO: 905760 - protein, 9 aa, Homo Sapiens
WVQRHYLEY

SEQ ID NO: 905761 - protein, 9 aa, Homo Sapiens
LSGGGDSAA

SEQ ID NO: 905762 - protein, 9 aa, Homo Sapiens
FACSDELNR

SEQ ID NO: 905763 - protein, 9 aa, Homo Sapiens
VEGDQICLY

SEQ ID NO: 905764 - protein, 9 aa, Homo Sapiens
ASMPLPGSV

SEQ ID NO: 905765 - protein, 9 aa, Homo Sapiens
LPGSVETPT

SEQ ID NO: 905766 - protein, 9 aa, Homo Sapiens
HTKVVWRIF

SEQ ID NO: 905767 - protein, 9 aa, Homo Sapiens
NPLERDSMY

SEQ ID NO: 905768 - protein, 9 aa, Homo Sapiens
WKRFIEEWL

SEQ ID NO: 905769 - protein, 9 aa, Homo Sapiens
EALQQPEAA

SEQ ID NO: 905770 - protein, 9 aa, Homo Sapiens
ANEEEEPER

SEQ ID NO: 905771 - protein, 9 aa, Homo Sapiens
EKSKKEECN

SEQ ID NO: 905772 - protein, 9 aa, Homo Sapiens
SASWCRAQI

SEQ ID NO: 905773 - protein, 9 aa, Homo Sapiens
PCALDQTTE

SEQ ID NO: 905774 - protein, 9 aa, Homo Sapiens
GRMKWFKLL

SEQ ID NO: 905775 - protein, 9 aa, Homo Sapiens
MTKNVPIAR

SEQ ID NO: 905776 - protein, 9 aa, Homo Sapiens
GSGEAAANP

SEQ ID NO: 905777 - protein, 9 aa, Homo Sapiens
VLPPSFRPH

SEQ ID NO: 905778 - protein, 9 aa, Homo Sapiens
FQHMQQLLQ

SEQ ID NO: 905779 - protein, 9 aa, Homo Sapiens
GKMDMTIYK

SEQ ID NO: 905780 - protein, 9 aa, Homo Sapiens
LNPLWQSRG

SEQ ID NO: 905781 - protein, 9 aa, Homo Sapiens
GKKRRRTII

SEQ ID NO: 905782 - protein, 9 aa, Homo Sapiens
VATPFGGFK

SEQ ID NO: 905783 - protein, 9 aa, Homo Sapiens
TQSIGQAFS

SEQ ID NO: 905784 - protein, 9 aa, Homo Sapiens
EAGRSCQQK

SEQ ID NO: 905785 - protein, 9 aa, Homo Sapiens
EWNLQDPVP

SEQ ID NO: 905786 - protein, 9 aa, Homo Sapiens
QKNNIKGQK

SEQ ID NO: 905787 - protein, 9 aa, Homo Sapiens
LLFYVGAQF

SEQ ID NO: 905788 - protein, 9 aa, Homo Sapiens
FKLTQSKFV

SEQ ID NO: 905789 - protein, 9 aa, Homo Sapiens
EGTLAGDKA

SEQ ID NO: 905790 - protein, 9 aa, Homo Sapiens
LREPELGRG

SEQ ID NO: 905791 - protein, 9 aa, Homo Sapiens
LDLVQFAYT

SEQ ID NO: 905792 - protein, 9 aa, Homo Sapiens
EEPERKEVS

SEQ ID NO: 905793 - protein, 9 aa, Homo Sapiens
RRTIIECGC

SEQ ID NO: 905794 - protein, 9 aa, Homo Sapiens
VQLAKKIEA

SEQ ID NO: 905795 - protein, 9 aa, Homo Sapiens
DQRQWLGSK

SEQ ID NO: 905796 - protein, 9 aa, Homo Sapiens
MFDPHKRKF

SEQ ID NO: 905797 - protein, 9 aa, Homo Sapiens
PVELTVFEN

SEQ ID NO: 905798 - protein, 9 aa, Homo Sapiens
NRLQIHSIR

SEQ ID NO: 905799 - protein, 9 aa, Homo Sapiens
CKEWNLQDP

SEQ ID NO: 905800 - protein, 9 aa, Homo Sapiens
EIADEEKSK

SEQ ID NO: 905801 - protein, 9 aa, Homo Sapiens
ILAGFLASA

SEQ ID NO: 905802 - protein, 9 aa, Homo Sapiens
LDGRIEVKW

SEQ ID NO: 905803 - protein, 9 aa, Homo Sapiens
KRFIEEWLL

SEQ ID NO: 905804 - protein, 9 aa, Homo Sapiens
LSILEPLNP

SEQ ID NO: 905805 - protein, 9 aa, Homo Sapiens
SLNGNHAMR

SEQ ID NO: 905806 - protein, 9 aa, Homo Sapiens
EDDACHAFF

SEQ ID NO: 905807 - protein, 9 aa, Homo Sapiens
LYAETQWKD

SEQ ID NO: 905808 - protein, 9 aa, Homo Sapiens
NDVFQALNP

SEQ ID NO: 905809 - protein, 9 aa, Homo Sapiens
EEEEPERKE

SEQ ID NO: 905810 - protein, 9 aa, Homo Sapiens
FMPSLFFSQ

SEQ ID NO: 905811 - protein, 9 aa, Homo Sapiens
DPLSEITKQ

SEQ ID NO: 905812 - protein, 9 aa, Homo Sapiens
LSVRTGYDK

SEQ ID NO: 905813 - protein, 9 aa, Homo Sapiens
IIEVLERPE

SEQ ID NO: 905814 - protein, 9 aa, Homo Sapiens
KLKEEKLSQ

SEQ ID NO: 905815 - protein, 9 aa, Homo Sapiens
HMLSAKLKE

SEQ ID NO: 905816 - protein, 9 aa, Homo Sapiens
GSVETPTVD

SEQ ID NO: 905817 - protein, 9 aa, Homo Sapiens
SDSVKVSQS

SEQ ID NO: 905818 - protein, 9 aa, Homo Sapiens
HLSILEPLN

SEQ ID NO: 905819 - protein, 9 aa, Homo Sapiens
KIYATVKID

SEQ ID NO: 905820 - protein, 9 aa, Homo Sapiens
KQVSSLSES

SEQ ID NO: 905821 - protein, 9 aa, Homo Sapiens
QVSGVTHIW

SEQ ID NO: 905822 - protein, 9 aa, Homo Sapiens
LERDSMYSQ

SEQ ID NO: 905823 - protein, 9 aa, Homo Sapiens
VSQSPPIET

SEQ ID NO: 905824 - protein, 9 aa, Homo Sapiens
KSKKEECNL

SEQ ID NO: 905825 - protein, 9 aa, Homo Sapiens
KGKKGVISS

SEQ ID NO: 905826 - protein, 9 aa, Homo Sapiens
EHAQKLLEF

SEQ ID NO: 905827 - protein, 9 aa, Homo Sapiens
PEPHWWRGR

SEQ ID NO: 905828 - protein, 9 aa, Homo Sapiens
GVNDLGERQ

SEQ ID NO: 905829 - protein, 9 aa, Homo Sapiens
DENDNTPAL

SEQ ID NO: 905830 - protein, 9 aa, Homo Sapiens
WYYPELDFQ

SEQ ID NO: 905831 - protein, 9 aa, Homo Sapiens
DVFQALNPL

SEQ ID NO: 905832 - protein, 9 aa, Homo Sapiens
IVSGKKRRR

SEQ ID NO: 905833 - protein, 9 aa, Homo Sapiens
SVETPTVDT

SEQ ID NO: 905834 - protein, 9 aa, Homo Sapiens
AFFLRVSKM

SEQ ID NO: 905835 - protein, 9 aa, Homo Sapiens
HRQERDREF

SEQ ID NO: 905836 - protein, 9 aa, Homo Sapiens
LYLYQLSPS

SEQ ID NO: 905837 - protein, 9 aa, Homo Sapiens
TQFSSCKSL

SEQ ID NO: 905838 - protein, 9 aa, Homo Sapiens
QLLQQQIQA

SEQ ID NO: 905839 - protein, 9 aa, Homo Sapiens
QEPFTHPVL

SEQ ID NO: 905840 - protein, 9 aa, Homo Sapiens
MLSAKLKEE

SEQ ID NO: 905841 - protein, 9 aa, Homo Sapiens
SCVEGSCFW

SEQ ID NO: 905842 - protein, 9 aa, Homo Sapiens
PVGTIIGTV

SEQ ID NO: 905843 - protein, 9 aa, Homo Sapiens
KNNIKGQKG

SEQ ID NO: 905844 - protein, 9 aa, Homo Sapiens
GFLASAIDV

SEQ ID NO: 905845 - protein, 9 aa, Homo Sapiens
EDYKHGTLH

SEQ ID NO: 905846 - protein, 9 aa, Homo Sapiens
TRPFPHTIV

SEQ ID NO: 905847 - protein, 9 aa, Homo Sapiens
TKQEKDFLW

SEQ ID NO: 905848 - protein, 9 aa, Homo Sapiens
ACSDELNRH

SEQ ID NO: 905849 - protein, 9 aa, Homo Sapiens
SPNTLSQVE

SEQ ID NO: 905850 - protein, 9 aa, Homo Sapiens
PPLYAETQW

SEQ ID NO: 905851 - protein, 9 aa, Homo Sapiens
QQLLQQQIQ

SEQ ID NO: 905852 - protein, 9 aa, Homo Sapiens
SINMLPLKF

SEQ ID NO: 905853 - protein, 9 aa, Homo Sapiens
ITQSIGQAF

SEQ ID NO: 905854 - protein, 9 aa, Homo Sapiens
RDPLSEITK

SEQ ID NO: 905855 - protein, 9 aa, Homo Sapiens
GKKGVISSV

SEQ ID NO: 905856 - protein, 9 aa, Homo Sapiens
IGFNFEIGD

SEQ ID NO: 905857 - protein, 9 aa, Homo Sapiens
FFPEHAQKL

SEQ ID NO: 905858 - protein, 9 aa, Homo Sapiens
EPFTHPVLR

SEQ ID NO: 905859 - protein, 9 aa, Homo Sapiens
TPVGTIIGT

SEQ ID NO: 905860 - protein, 9 aa, Homo Sapiens
KKGVISSVD

SEQ ID NO: 905861 - protein, 9 aa, Homo Sapiens
RNFNLFLAL

SEQ ID NO: 905862 - protein, 9 aa, Homo Sapiens
QNCDPYATV

SEQ ID NO: 905863 - protein, 9 aa, Homo Sapiens
KDQRQWLGS

SEQ ID NO: 905864 - protein, 9 aa, Homo Sapiens
YAETQWKDR

SEQ ID NO: 905865 - protein, 9 aa, Homo Sapiens
DEEKSKKEE

SEQ ID NO: 905866 - protein, 9 aa, Homo Sapiens
MQQLLQQQI

SEQ ID NO: 905867 - protein, 9 aa, Homo Sapiens
RQHISEHVL

SEQ ID NO: 905868 - protein, 9 aa, Homo Sapiens
QLAKKIEAL

SEQ ID NO: 905869 - protein, 9 aa, Homo Sapiens
LQIHSIRAT

SEQ ID NO: 905870 - protein, 9 aa, Homo Sapiens
AQLITQSIG

SEQ ID NO: 905871 - protein, 9 aa, Homo Sapiens
DPGNPGQKN

SEQ ID NO: 905872 - protein, 9 aa, Homo Sapiens
LLDLVQFAY

SEQ ID NO: 905873 - protein, 9 aa, Homo Sapiens
AMRLPLMEC

SEQ ID NO: 905874 - protein, 9 aa, Homo Sapiens
REPELGRGC

SEQ ID NO: 905875 - protein, 9 aa, Homo Sapiens
HAMRLPLME

SEQ ID NO: 905876 - protein, 9 aa, Homo Sapiens
GEAAANPET

SEQ ID NO: 905877 - protein, 9 aa, Homo Sapiens
GNPGQKNNI

SEQ ID NO: 905878 - protein, 9 aa, Homo Sapiens
VHLSILEPL

SEQ ID NO: 905879 - protein, 9 aa, Homo Sapiens
RRSSLLSQS

SEQ ID NO: 905880 - protein, 9 aa, Homo Sapiens
LLQQQIQAN

SEQ ID NO: 905881 - protein, 9 aa, Homo Sapiens
KPPLYAETQ

SEQ ID NO: 905882 - protein, 9 aa, Homo Sapiens
EEWLLMYSF

SEQ ID NO: 905883 - protein, 9 aa, Homo Sapiens
SEITKQEKD

SEQ ID NO: 905884 - protein, 9 aa, Homo Sapiens
PENLLVYEQ

SEQ ID NO: 905885 - protein, 9 aa, Homo Sapiens
LLFFPEHAQ

SEQ ID NO: 905886 - protein, 9 aa, Homo Sapiens
SAENRWRLR

SEQ ID NO: 905887 - protein, 9 aa, Homo Sapiens
LKEHTGFSI

SEQ ID NO: 905888 - protein, 9 aa, Homo Sapiens
INMLPLKFC

SEQ ID NO: 905889 - protein, 9 aa, Homo Sapiens
VKWQHGSSS

SEQ ID NO: 905890 - protein, 9 aa, Homo Sapiens
EQQDGSKSL

SEQ ID NO: 905891 - protein, 9 aa, Homo Sapiens
SVHECGECL

SEQ ID NO: 905892 - protein, 9 aa, Homo Sapiens
GYDKGESND

SEQ ID NO: 905893 - protein, 9 aa, Homo Sapiens
HMQQLLQQQ

SEQ ID NO: 905894 - protein, 9 aa, Homo Sapiens
DVATPFGGF

SEQ ID NO: 905895 - protein, 9 aa, Homo Sapiens
TKVWVQRHY

SEQ ID NO: 905896 - protein, 9 aa, Homo Sapiens
TGYDKGESN

SEQ ID NO: 905897 - protein, 9 aa, Homo Sapiens
YPELDFQFK

SEQ ID NO: 905898 - protein, 9 aa, Homo Sapiens
HPVWSAVVR

SEQ ID NO: 905899 - protein, 9 aa, Homo Sapiens
ERQSINMLP

SEQ ID NO: 905900 - protein, 9 aa, Homo Sapiens
TPALLATPA

SEQ ID NO: 905901 - protein, 9 aa, Homo Sapiens
MQTFLLTKD

SEQ ID NO: 905902 - protein, 9 aa, Homo Sapiens
ATPFGGFKQ

SEQ ID NO: 905903 - protein, 9 aa, Homo Sapiens
TVQAAVNTI

SEQ ID NO: 905904 - protein, 9 aa, Homo Sapiens
NTLSQVEGD

SEQ ID NO: 905905 - protein, 9 aa, Homo Sapiens
STVRTVRTQ

SEQ ID NO: 905906 - protein, 9 aa, Homo Sapiens
LLTKVWVQR

SEQ ID NO: 905907 - protein, 9 aa, Homo Sapiens
QAAVNTILE

SEQ ID NO: 905908 - protein, 9 aa, Homo Sapiens
FLLPLSGGG

SEQ ID NO: 905909 - protein, 9 aa, Homo Sapiens
LPPSFRPHF

SEQ ID NO: 905910 - protein, 9 aa, Homo Sapiens
IPRRYGKMD

SEQ ID NO: 905911 - protein, 9 aa, Homo Sapiens
QGSGEAAAN

SEQ ID NO: 905912 - protein, 9 aa, Homo Sapiens
DACHAFFLR

SEQ ID NO: 905913 - protein, 9 aa, Homo Sapiens
CFVDQGSLL

SEQ ID NO: 905914 - protein, 9 aa, Homo Sapiens
PLERDSMYS

SEQ ID NO: 905915 - protein, 9 aa, Homo Sapiens
SMPLPGSVE

SEQ ID NO: 905916 - protein, 9 aa, Homo Sapiens
LPTLDEQKK

SEQ ID NO: 905917 - protein, 9 aa, Homo Sapiens
KLTQSKFVH

SEQ ID NO: 905918 - protein, 9 aa, Homo Sapiens
PFTHPVLRA

SEQ ID NO: 905919 - protein, 9 aa, Homo Sapiens
FTHPVLRAS

SEQ ID NO: 905920 - protein, 9 aa, Homo Sapiens
NFEIGDTLT

SEQ ID NO: 905921 - protein, 9 aa, Homo Sapiens
QRQWLGSKA

SEQ ID NO: 905922 - protein, 9 aa, Homo Sapiens
LGGESLVRL

SEQ ID NO: 905923 - protein, 9 aa, Homo Sapiens
IEVLERPEP

SEQ ID NO: 905924 - protein, 9 aa, Homo Sapiens
LVVLSSGLR

SEQ ID NO: 905925 - protein, 9 aa, Homo Sapiens
MPLPGSVET

SEQ ID NO: 905926 - protein, 9 aa, Homo Sapiens
TIVAFVKYS

SEQ ID NO: 905927 - protein, 9 aa, Homo Sapiens
FPEHAQKLL

SEQ ID NO: 905928 - protein, 9 aa, Homo Sapiens
QVEGDQICL

SEQ ID NO: 905929 - protein, 9 aa, Homo Sapiens
TLDEQKKQE

SEQ ID NO: 905930 - protein, 9 aa, Homo Sapiens
QYSTVRTVR

SEQ ID NO: 905931 - protein, 9 aa, Homo Sapiens
LFYVGAQFL

SEQ ID NO: 905932 - protein, 9 aa, Homo Sapiens
GGESLVRLL

SEQ ID NO: 905933 - protein, 9 aa, Homo Sapiens
VYEQQDGSK

SEQ ID NO: 905934 - protein, 9 aa, Homo Sapiens
VQYYPTARI

SEQ ID NO: 905935 - protein, 9 aa, Homo Sapiens
NKCIEVAKL

SEQ ID NO: 905936 - protein, 9 aa, Homo Sapiens
FVRKIYATV

SEQ ID NO: 905937 - protein, 9 aa, Homo Sapiens
MKRILGVCF

SEQ ID NO: 905938 - protein, 9 aa, Homo Sapiens
KNKCIEVAK

SEQ ID NO: 905939 - protein, 9 aa, Homo Sapiens
CPLTSASWC

SEQ ID NO: 905940 - protein, 9 aa, Homo Sapiens
NCDPYATVS

SEQ ID NO: 905941 - protein, 9 aa, Homo Sapiens
YSTVRTVRT

SEQ ID NO: 905942 - protein, 9 aa, Homo Sapiens
QIHSIRATC

SEQ ID NO: 905943 - protein, 9 aa, Homo Sapiens
NILQPVELT

SEQ ID NO: 905944 - protein, 9 aa, Homo Sapiens
LHPGVTNEQ

SEQ ID NO: 905945 - protein, 9 aa, Homo Sapiens
ERKEVSELR

SEQ ID NO: 905946 - protein, 9 aa, Homo Sapiens
TPSQCKEWN

SEQ ID NO: 905947 - protein, 9 aa, Homo Sapiens
MKGLNPLER

SEQ ID NO: 905948 - protein, 9 aa, Homo Sapiens
QALNPLWQS

SEQ ID NO: 905949 - protein, 9 aa, Homo Sapiens
LTKDGAADD

SEQ ID NO: 905950 - protein, 9 aa, Homo Sapiens
RQWLGSKAD

SEQ ID NO: 905951 - protein, 9 aa, Homo Sapiens
NGQNCDPYA

SEQ ID NO: 905952 - protein, 9 aa, Homo Sapiens
EKDVVQLAK

SEQ ID NO: 905953 - protein, 9 aa, Homo Sapiens
SYGAVLPPS

SEQ ID NO: 905954 - protein, 9 aa, Homo Sapiens
PPSFRPHFE

SEQ ID NO: 905955 - protein, 9 aa, Homo Sapiens
PNALLDLVQ

SEQ ID NO: 905956 - protein, 9 aa, Homo Sapiens
CANDVFQAL

SEQ ID NO: 905957 - protein, 9 aa, Homo Sapiens
EPHGLSAAS

SEQ ID NO: 905958 - protein, 9 aa, Homo Sapiens
HQFMPSLFF

SEQ ID NO: 905959 - protein, 9 aa, Homo Sapiens
LSSGLRQRS

SEQ ID NO: 905960 - protein, 9 aa, Homo Sapiens
LKEEKLSQK

SEQ ID NO: 905961 - protein, 9 aa, Homo Sapiens
HKDQRQWLG

SEQ ID NO: 905962 - protein, 9 aa, Homo Sapiens
LVRLLTPGL

SEQ ID NO: 905963 - protein, 9 aa, Homo Sapiens
SGKKRRRTI

SEQ ID NO: 905964 - protein, 9 aa, Homo Sapiens
IHQLLHQFM

SEQ ID NO: 905965 - protein, 9 aa, Homo Sapiens
EGSCFWPAG

SEQ ID NO: 905966 - protein, 9 aa, Homo Sapiens
KSLLESRPS

SEQ ID NO: 905967 - protein, 9 aa, Homo Sapiens
ELDFQFKDA

SEQ ID NO: 905968 - protein, 9 aa, Homo Sapiens
FRNFNLFLA

SEQ ID NO: 905969 - protein, 9 aa, Homo Sapiens
RLLTPGLQN

SEQ ID NO: 905970 - protein, 9 aa, Homo Sapiens
EDAQLITQS

SEQ ID NO: 905971 - protein, 9 aa, Homo Sapiens
NCSVHECGE

SEQ ID NO: 905972 - protein, 9 aa, Homo Sapiens
KNVPIARIL

SEQ ID NO: 905973 - protein, 9 aa, Homo Sapiens
TSEGTLAGD

SEQ ID NO: 905974 - protein, 9 aa, Homo Sapiens
EPERKEVSE

SEQ ID NO: 905975 - protein, 9 aa, Homo Sapiens
EVLERPEPH

SEQ ID NO: 905976 - protein, 9 aa, Homo Sapiens
SDVKNKCIE

SEQ ID NO: 905977 - protein, 9 aa, Homo Sapiens
RMKGLNPLE

SEQ ID NO: 905978 - protein, 9 aa, Homo Sapiens
SGSEVKQPV

SEQ ID NO: 905979 - protein, 9 aa, Homo Sapiens
SLRQHISEH

SEQ ID NO: 905980 - protein, 9 aa, Homo Sapiens
LDENDNTPA

SEQ ID NO: 905981 - protein, 9 aa, Homo Sapiens
NEDDACHAF

SEQ ID NO: 905982 - protein, 9 aa, Homo Sapiens
VKNKCIEVA

SEQ ID NO: 905983 - protein, 9 aa, Homo Sapiens
GQNCDPYAT

SEQ ID NO: 905984 - protein, 9 aa, Homo Sapiens
YGAVLPPSF

SEQ ID NO: 905985 - protein, 9 aa, Homo Sapiens
QSSSGYFSF

SEQ ID NO: 905986 - protein, 9 aa, Homo Sapiens
PNTLSQVEG

SEQ ID NO: 905987 - protein, 9 aa, Homo Sapiens
SEDAQLITQ

SEQ ID NO: 905988 - protein, 9 aa, Homo Sapiens
EFMSDTKKL

SEQ ID NO: 905989 - protein, 9 aa, Homo Sapiens
GCPLTSASW

SEQ ID NO: 905990 - protein, 9 aa, Homo Sapiens
ELATLPKGA

SEQ ID NO: 905991 - protein, 9 aa, Homo Sapiens
TKVVWRIFT

SEQ ID NO: 905992 - protein, 9 aa, Homo Sapiens
MGIEFMSDT

SEQ ID NO: 905993 - protein, 9 aa, Homo Sapiens
RLREPELGR

SEQ ID NO: 905994 - protein, 9 aa, Homo Sapiens
KGAQLAAAF

SEQ ID NO: 905995 - protein, 9 aa, Homo Sapiens
VSGKKRRRT

SEQ ID NO: 905996 - protein, 9 aa, Homo Sapiens
SSLLSQSSS

SEQ ID NO: 905997 - protein, 9 aa, Homo Sapiens
RDREFLEEE

SEQ ID NO: 905998 - protein, 9 aa, Homo Sapiens
QYYPTARIH

SEQ ID NO: 905999 - protein, 9 aa, Homo Sapiens
SVRTGYDKG

SEQ ID NO: 906000 - protein, 9 aa, Homo Sapiens
RKEVSELRS

SEQ ID NO: 906001 - protein, 9 aa, Homo Sapiens
CARPVKEPH

SEQ ID NO: 906002 - protein, 9 aa, Homo Sapiens
KDGAADDPW

SEQ ID NO: 906003 - protein, 9 aa, Homo Sapiens
LDIAIMTKN

SEQ ID NO: 906004 - protein, 9 aa, Homo Sapiens
LRQRSKKAK

SEQ ID NO: 906005 - protein, 9 aa, Homo Sapiens
SCFWPAGHQ

SEQ ID NO: 906006 - protein, 9 aa, Homo Sapiens
HTVAGVQVS

SEQ ID NO: 906007 - protein, 9 aa, Homo Sapiens
PERKEVSEL

SEQ ID NO: 906008 - protein, 9 aa, Homo Sapiens
AYDGVSLCH

SEQ ID NO: 906009 - protein, 9 aa, Homo Sapiens
LMVCLVHLS

SEQ ID NO: 906010 - protein, 9 aa, Homo Sapiens
TFLLTKDGA

SEQ ID NO: 906011 - protein, 9 aa, Homo Sapiens
VSLCHPVWS

SEQ ID NO: 906012 - protein, 9 aa, Homo Sapiens
WQHGSSSLH

SEQ ID NO: 906013 - protein, 9 aa, Homo Sapiens
LAILTVLLK

SEQ ID NO: 906014 - protein, 9 aa, Homo Sapiens
DNTPALLAT

SEQ ID NO: 906015 - protein, 9 aa, Homo Sapiens
SQVEGDQIC

SEQ ID NO: 906016 - protein, 9 aa, Homo Sapiens
YYPTARIHA

SEQ ID NO: 906017 - protein, 9 aa, Homo Sapiens
HMPFQKGCP

SEQ ID NO: 906018 - protein, 9 aa, Homo Sapiens
REFLEEEQQ

SEQ ID NO: 906019 - protein, 9 aa, Homo Sapiens
CLVHLSILE

SEQ ID NO: 906020 - protein, 9 aa, Homo Sapiens
AAVNTILEI

SEQ ID NO: 906021 - protein, 9 aa, Homo Sapiens
LERPEPHWW

SEQ ID NO: 906022 - protein, 9 aa, Homo Sapiens
ESLVRLLTP

SEQ ID NO: 906023 - protein, 9 aa, Homo Sapiens
GAVLPPSFR

SEQ ID NO: 906024 - protein, 9 aa, Homo Sapiens
EKGKKGVIS

SEQ ID NO: 906025 - protein, 9 aa, Homo Sapiens
EGTVQAAVN

SEQ ID NO: 906026 - protein, 9 aa, Homo Sapiens
GLNPLERDS

SEQ ID NO: 906027 - protein, 9 aa, Homo Sapiens
WFKLLFYVG

SEQ ID NO: 906028 - protein, 9 aa, Homo Sapiens
LDEQKKQEI

SEQ ID NO: 906029 - protein, 9 aa, Homo Sapiens
ISSGSEVKQ

SEQ ID NO: 906030 - protein, 9 aa, Homo Sapiens
HIAKQVSSL

SEQ ID NO: 906031 - protein, 9 aa, Homo Sapiens
GSRQERQSI

SEQ ID NO: 906032 - protein, 9 aa, Homo Sapiens
LLHQFMPSL

SEQ ID NO: 906033 - protein, 9 aa, Homo Sapiens
ILGVCFVDQ

SEQ ID NO: 906034 - protein, 9 aa, Homo Sapiens
DVKNKCIEV

SEQ ID NO: 906035 - protein, 9 aa, Homo Sapiens
GDPGNPGQK

SEQ ID NO: 906036 - protein, 9 aa, Homo Sapiens
VVWRIFTNS

SEQ ID NO: 906037 - protein, 9 aa, Homo Sapiens
VLKKMNENL

SEQ ID NO: 906038 - protein, 9 aa, Homo Sapiens
AQEEALQQP

SEQ ID NO: 906039 - protein, 9 aa, Homo Sapiens
VRLLTPGLQ

SEQ ID NO: 906040 - protein, 9 aa, Homo Sapiens
QLITQSIGQ

SEQ ID NO: 906041 - protein, 9 aa, Homo Sapiens
SCVRSFACS

SEQ ID NO: 906042 - protein, 9 aa, Homo Sapiens
ANDVFQALN

SEQ ID NO: 906043 - protein, 9 aa, Homo Sapiens
NPETTTVSS

SEQ ID NO: 906044 - protein, 9 aa, Homo Sapiens
NHAMRLPLM

SEQ ID NO: 906045 - protein, 9 aa, Homo Sapiens
ENDNTPALL

SEQ ID NO: 906046 - protein, 9 aa, Homo Sapiens
NDNTPALLA

SEQ ID NO: 906047 - protein, 9 aa, Homo Sapiens
KHGTLHPGV

SEQ ID NO: 906048 - protein, 9 aa, Homo Sapiens
HAFFLRVSK

SEQ ID NO: 906049 - protein, 9 aa, Homo Sapiens
SFKLTQSKF

SEQ ID NO: 906050 - protein, 9 aa, Homo Sapiens
FFLRVSKMR

SEQ ID NO: 906051 - protein, 9 aa, Homo Sapiens
EILEETPCA

SEQ ID NO: 906052 - protein, 9 aa, Homo Sapiens
FVLDENDNT

SEQ ID NO: 906053 - protein, 9 aa, Homo Sapiens
FQWYYPELD

SEQ ID NO: 906054 - protein, 9 aa, Homo Sapiens
FQVLKKMNE

SEQ ID NO: 906055 - protein, 9 aa, Homo Sapiens
LSEITKQEK

SEQ ID NO: 906056 - protein, 9 aa, Homo Sapiens
HKRKFSEEE

SEQ ID NO: 906057 - protein, 9 aa, Homo Sapiens
DRETRPFPH

SEQ ID NO: 906058 - protein, 9 aa, Homo Sapiens
GIEFMSDTK

SEQ ID NO: 906059 - protein, 9 aa, Homo Sapiens
QRHYLEYRE

SEQ ID NO: 906060 - protein, 9 aa, Homo Sapiens
GPHTKVVWR

SEQ ID NO: 906061 - protein, 9 aa, Homo Sapiens
CNCSVHECG

SEQ ID NO: 906062 - protein, 9 aa, Homo Sapiens
NPGQKNNIK

SEQ ID NO: 906063 - protein, 9 aa, Homo Sapiens
FPHTIVAVE

SEQ ID NO: 906064 - protein, 9 aa, Homo Sapiens
TVLLKGTNL

SEQ ID NO: 906065 - protein, 9 aa, Homo Sapiens
LHKDQRQWL

SEQ ID NO: 906066 - protein, 9 aa, Homo Sapiens
ALYLYQLSP

SEQ ID NO: 906067 - protein, 9 aa, Homo Sapiens
AILTVLLKG

SEQ ID NO: 906068 - protein, 9 aa, Homo Sapiens
LSQSSSGYF

SEQ ID NO: 906069 - protein, 9 aa, Homo Sapiens
PHTKVVWRI

SEQ ID NO: 906070 - protein, 9 aa, Homo Sapiens
DTANRLQIH

SEQ ID NO: 906071 - protein, 9 aa, Homo Sapiens
DREFLEEEQ

SEQ ID NO: 906072 - protein, 9 aa, Homo Sapiens
LQQPEAAAA

SEQ ID NO: 906073 - protein, 9 aa, Homo Sapiens
AGFLASAID

SEQ ID NO: 906074 - protein, 9 aa, Homo Sapiens
MSDTKKLEQ

SEQ ID NO: 906075 - protein, 9 aa, Homo Sapiens
KEEKLSQKK

SEQ ID NO: 906076 - protein, 9 aa, Homo Sapiens
ISEHVLWDL

SEQ ID NO: 906077 - protein, 9 aa, Homo Sapiens
PKGAQLAAA

SEQ ID NO: 906078 - protein, 9 aa, Homo Sapiens
SEHVLWDLG

SEQ ID NO: 906079 - protein, 9 aa, Homo Sapiens
TIIGTVTAQ

SEQ ID NO: 906080 - protein, 9 aa, Homo Sapiens
TPCALDQTT

SEQ ID NO: 906081 - protein, 9 aa, Homo Sapiens
ENRWRLREP

SEQ ID NO: 906082 - protein, 9 aa, Homo Sapiens
NALLDLVQF

SEQ ID NO: 906083 - protein, 9 aa, Homo Sapiens
DDACHAFFL

SEQ ID NO: 906084 - protein, 9 aa, Homo Sapiens
QFMPSLFFS

SEQ ID NO: 906085 - protein, 9 aa, Homo Sapiens
LDLAILTVL

SEQ ID NO: 906086 - protein, 9 aa, Homo Sapiens
GQEMFDPHK

SEQ ID NO: 906087 - protein, 9 aa, Homo Sapiens
LNGNHAMRL

SEQ ID NO: 906088 - protein, 9 aa, Homo Sapiens
VQEPFTHPV

SEQ ID NO: 906089 - protein, 9 aa, Homo Sapiens
SLVRLLTPG

SEQ ID NO: 906090 - protein, 9 aa, Homo Sapiens
AKLKEEKLS

SEQ ID NO: 906091 - protein, 9 aa, Homo Sapiens
LPLINGQNC

SEQ ID NO: 906092 - protein, 9 aa, Homo Sapiens
HGTLHPGVT

SEQ ID NO: 906093 - protein, 9 aa, Homo Sapiens
SLCHPVWSA

SEQ ID NO: 906094 - protein, 9 aa, Homo Sapiens
FEIGDTLTF

SEQ ID NO: 906095 - protein, 9 aa, Homo Sapiens
ANRLQIHSI

SEQ ID NO: 906096 - protein, 9 aa, Homo Sapiens
SGEAAANPE

SEQ ID NO: 906097 - protein, 9 aa, Homo Sapiens
EGIDPNALL

SEQ ID NO: 906098 - protein, 9 aa, Homo Sapiens
AHISHIAKQ

SEQ ID NO: 906099 - protein, 9 aa, Homo Sapiens
IEFMSDTKK

SEQ ID NO: 906100 - protein, 9 aa, Homo Sapiens
QEILEETPC

SEQ ID NO: 906101 - protein, 9 aa, Homo Sapiens
RPVKEPHGL

SEQ ID NO: 906102 - protein, 9 aa, Homo Sapiens
RFIEEWLLM

SEQ ID NO: 906103 - protein, 9 aa, Homo Sapiens
ISLTIVAFV

SEQ ID NO: 906104 - protein, 9 aa, Homo Sapiens
RPEPHWWRG

SEQ ID NO: 906105 - protein, 9 aa, Homo Sapiens
KGLNPLERD

SEQ ID NO: 906106 - protein, 9 aa, Homo Sapiens
QTSEGTLAG

SEQ ID NO: 906107 - protein, 9 aa, Homo Sapiens
TVRTVRTQG

SEQ ID NO: 906108 - protein, 9 aa, Homo Sapiens
VQVSGVTHI

SEQ ID NO: 906109 - protein, 9 aa, Homo Sapiens
LITQSIGQA

SEQ ID NO: 906110 - protein, 9 aa, Homo Sapiens
ISHIAKQVS

SEQ ID NO: 906111 - protein, 9 aa, Homo Sapiens
TLHPGVTNE

SEQ ID NO: 906112 - protein, 9 aa, Homo Sapiens
SFRPHFEVG

SEQ ID NO: 906113 - protein, 9 aa, Homo Sapiens
TKNVPIARI

SEQ ID NO: 906114 - protein, 9 aa, Homo Sapiens
MPSLFFSQQ

SEQ ID NO: 906115 - protein, 9 aa, Homo Sapiens
LLVYEQQDG

SEQ ID NO: 906116 - protein, 9 aa, Homo Sapiens
PLSEITKQE

SEQ ID NO: 906117 - protein, 9 aa, Homo Sapiens
HECGECLVP

SEQ ID NO: 906118 - protein, 9 aa, Homo Sapiens
AIMTKNVPI

SEQ ID NO: 906119 - protein, 9 aa, Homo Sapiens
ETRPFPHTI

SEQ ID NO: 906120 - protein, 9 aa, Homo Sapiens
GLRQRSKKA

SEQ ID NO: 906121 - protein, 9 aa, Homo Sapiens
KFVHSFAAD

SEQ ID NO: 906122 - protein, 9 aa, Homo Sapiens
FKLLFYVGA

SEQ ID NO: 906123 - protein, 9 aa, Homo Sapiens
SAKLKEEKL

SEQ ID NO: 906124 - protein, 9 aa, Homo Sapiens
VKEPHGLSA

SEQ ID NO: 906125 - protein, 9 aa, Homo Sapiens
HGLSAASPP

SEQ ID NO: 906126 - protein, 9 aa, Homo Sapiens
SGVTHIWAV

SEQ ID NO: 906127 - protein, 9 aa, Homo Sapiens
RSCQQKGVP

SEQ ID NO: 906128 - protein, 9 aa, Homo Sapiens
EHTGFSIRP

SEQ ID NO: 906129 - protein, 9 aa, Homo Sapiens
RLQIHSIRA

SEQ ID NO: 906130 - protein, 9 aa, Homo Sapiens
SEVKQPVRK

SEQ ID NO: 906131 - protein, 9 aa, Homo Sapiens
LHRQERDRE

SEQ ID NO: 906132 - protein, 9 aa, Homo Sapiens
LEETPCALD

SEQ ID NO: 906133 - protein, 9 aa, Homo Sapiens
FMSDTKKLE

SEQ ID NO: 906134 - protein, 9 aa, Homo Sapiens
GRIEVKWQH

SEQ ID NO: 906135 - protein, 9 aa, Homo Sapiens
SCKSLLESR

SEQ ID NO: 906136 - protein, 9 aa, Homo Sapiens
PTLDEQKKQ

SEQ ID NO: 906137 - protein, 9 aa, Homo Sapiens
PGQEMFDPH

SEQ ID NO: 906138 - protein, 9 aa, Homo Sapiens
LKKMNENLE

SEQ ID NO: 906139 - protein, 9 aa, Homo Sapiens
MKWFKLLFY

SEQ ID NO: 906140 - protein, 9 aa, Homo Sapiens
VCLVHLSIL

SEQ ID NO: 906141 - protein, 9 aa, Homo Sapiens
YDGVSLCHP

SEQ ID NO: 906142 - protein, 9 aa, Homo Sapiens
CKSLLESRP

SEQ ID NO: 906143 - protein, 9 aa, Homo Sapiens
SRQERQSIN

SEQ ID NO: 906144 - protein, 9 aa, Homo Sapiens
CIFRNFNLF

SEQ ID NO: 906145 - protein, 9 aa, Homo Sapiens
FQKGCPLTS

SEQ ID NO: 906146 - protein, 9 aa, Homo Sapiens
HQLLHQFMP

SEQ ID NO: 906147 - protein, 9 aa, Homo Sapiens
VMGATLAEM

SEQ ID NO: 906148 - protein, 9 aa, Homo Sapiens
AENRWRLRE

SEQ ID NO: 906149 - protein, 9 aa, Homo Sapiens
STPTQYSTV

SEQ ID NO: 906150 - protein, 9 aa, Homo Sapiens
VGTIIGTVT

SEQ ID NO: 906151 - protein, 9 aa, Homo Sapiens
RQSINMLPL

SEQ ID NO: 906152 - protein, 9 aa, Homo Sapiens
VSNFLKEHT

SEQ ID NO: 906153 - protein, 9 aa, Homo Sapiens
TKDGAADDP

SEQ ID NO: 906154 - protein, 9 aa, Homo Sapiens
VSEVMGATL

SEQ ID NO: 906155 - protein, 9 aa, Homo Sapiens
DKPALYLYQ

SEQ ID NO: 906156 - protein, 9 aa, Homo Sapiens
IHSSDSVKV

SEQ ID NO: 906157 - protein, 9 aa, Homo Sapiens
KGCPLTSAS

SEQ ID NO: 906158 - protein, 9 aa, Homo Sapiens
SILEPLNPL

SEQ ID NO: 906159 - protein, 9 aa, Homo Sapiens
YVLDVQYYP

SEQ ID NO: 906160 - protein, 9 aa, Homo Sapiens
EVKQPVRKD

SEQ ID NO: 906161 - protein, 9 aa, Homo Sapiens
IGTVTAQDL

SEQ ID NO: 906162 - protein, 9 aa, Homo Sapiens
EAAANPETT

SEQ ID NO: 906163 - protein, 9 aa, Homo Sapiens
ENLLVYEQQ

SEQ ID NO: 906164 - protein, 9 aa, Homo Sapiens
FLLTKDGAA

SEQ ID NO: 906165 - protein, 9 aa, Homo Sapiens
TQYSTVRTV

SEQ ID NO: 906166 - protein, 9 aa, Homo Sapiens
DSNILQPVE

SEQ ID NO: 906167 - protein, 9 aa, Homo Sapiens
GFNFEIGDT

SEQ ID NO: 906168 - protein, 9 aa, Homo Sapiens
LNPLERDSM

SEQ ID NO: 906169 - protein, 9 aa, Homo Sapiens
LHQFMPSLF

SEQ ID NO: 906170 - protein, 9 aa, Homo Sapiens
SMGLPTLDE

SEQ ID NO: 906171 - protein, 9 aa, Homo Sapiens
SSGLRQRSK

SEQ ID NO: 906172 - protein, 9 aa, Homo Sapiens
LATISLTIV

SEQ ID NO: 906173 - protein, 9 aa, Homo Sapiens
QLLHQFMPS

SEQ ID NO: 906174 - protein, 9 aa, Homo Sapiens
RWRLREPEL

SEQ ID NO: 906175 - protein, 9 aa, Homo Sapiens
TQVRDCHLV

SEQ ID NO: 906176 - protein, 9 aa, Homo Sapiens
ESVKQMLKS

SEQ ID NO: 906177 - protein, 9 aa, Homo Sapiens
KEYLDVLSH

SEQ ID NO: 906178 - protein, 9 aa, Homo Sapiens
RDCHLVGLL

SEQ ID NO: 906179 - protein, 9 aa, Homo Sapiens
VSLPELEDR

SEQ ID NO: 906180 - protein, 9 aa, Homo Sapiens
KKVEKIKQN

SEQ ID NO: 906181 - protein, 9 aa, Homo Sapiens
QVRDCHLVG

SEQ ID NO: 906182 - protein, 9 aa, Homo Sapiens
KCVTVLSDI

SEQ ID NO: 906183 - protein, 9 aa, Homo Sapiens
QWPSVSDDS

SEQ ID NO: 906184 - protein, 9 aa, Homo Sapiens
VQSGADETA

SEQ ID NO: 906185 - protein, 9 aa, Homo Sapiens
PLVVWALEL

SEQ ID NO: 906186 - protein, 9 aa, Homo Sapiens
HVTGPQVSC

SEQ ID NO: 906187 - protein, 9 aa, Homo Sapiens
SFSVSAHKL

SEQ ID NO: 906188 - protein, 9 aa, Homo Sapiens
LVPLVVWAL

SEQ ID NO: 906189 - protein, 9 aa, Homo Sapiens
KSVKCVTVL

SEQ ID NO: 906190 - protein, 9 aa, Homo Sapiens
ELQHTELAC

SEQ ID NO: 906191 - protein, 9 aa, Homo Sapiens
SVTMPSMQC

SEQ ID NO: 906192 - protein, 9 aa, Homo Sapiens
QVQSGADET

SEQ ID NO: 906193 - protein, 9 aa, Homo Sapiens
GRRGCWPLR

SEQ ID NO: 906194 - protein, 9 aa, Homo Sapiens
KLTTLTISR

SEQ ID NO: 906195 - protein, 9 aa, Homo Sapiens
GPPGNLGPS

SEQ ID NO: 906196 - protein, 9 aa, Homo Sapiens
PPIPHLRVL

SEQ ID NO: 906197 - protein, 9 aa, Homo Sapiens
LAKMWVRYA

SEQ ID NO: 906198 - protein, 9 aa, Homo Sapiens
APFAGCCTR

SEQ ID NO: 906199 - protein, 9 aa, Homo Sapiens
AKSKPQRSA

SEQ ID NO: 906200 - protein, 9 aa, Homo Sapiens
EWDWLLAKM

SEQ ID NO: 906201 - protein, 9 aa, Homo Sapiens
VIKHTKLTT

SEQ ID NO: 906202 - protein, 9 aa, Homo Sapiens
VYKSTHSAK

SEQ ID NO: 906203 - protein, 9 aa, Homo Sapiens
NEEGVSWWW

SEQ ID NO: 906204 - protein, 9 aa, Homo Sapiens
IGKPGHLNQ

SEQ ID NO: 906205 - protein, 9 aa, Homo Sapiens
SLELGCKYS

SEQ ID NO: 906206 - protein, 9 aa, Homo Sapiens
TAYDPMLKV

SEQ ID NO: 906207 - protein, 9 aa, Homo Sapiens
TIMPQLLAI

SEQ ID NO: 906208 - protein, 9 aa, Homo Sapiens
VKCVTVLSD

SEQ ID NO: 906209 - protein, 9 aa, Homo Sapiens
PNENRMVET

SEQ ID NO: 906210 - protein, 9 aa, Homo Sapiens
SVKQMLKSV

SEQ ID NO: 906211 - protein, 9 aa, Homo Sapiens
GKLGPPGNL

SEQ ID NO: 906212 - protein, 9 aa, Homo Sapiens
GEGVWTRVP

SEQ ID NO: 906213 - protein, 9 aa, Homo Sapiens
LSHVTGPQV

SEQ ID NO: 906214 - protein, 9 aa, Homo Sapiens
ILAKDNGVL

SEQ ID NO: 906215 - protein, 9 aa, Homo Sapiens
MDKFKILLE

SEQ ID NO: 906216 - protein, 9 aa, Homo Sapiens
HQNQVLQTK

SEQ ID NO: 906217 - protein, 9 aa, Homo Sapiens
QVSLPELED

SEQ ID NO: 906218 - protein, 9 aa, Homo Sapiens
DKFKILLEK

SEQ ID NO: 906219 - protein, 9 aa, Homo Sapiens
ESEEPQDSD

SEQ ID NO: 906220 - protein, 9 aa, Homo Sapiens
SEKHQLMYR

SEQ ID NO: 906221 - protein, 9 aa, Homo Sapiens
DVLSHVTGP

SEQ ID NO: 906222 - protein, 9 aa, Homo Sapiens
IDYSRKQIS

SEQ ID NO: 906223 - protein, 9 aa, Homo Sapiens
DDSRGLVIT

SEQ ID NO: 906224 - protein, 9 aa, Homo Sapiens
LEHQNQVLQ

SEQ ID NO: 906225 - protein, 9 aa, Homo Sapiens
AASEPMSVE

SEQ ID NO: 906226 - protein, 9 aa, Homo Sapiens
SVLGQLRLS

SEQ ID NO: 906227 - protein, 9 aa, Homo Sapiens
HNMASRPLI

SEQ ID NO: 906228 - protein, 9 aa, Homo Sapiens
WAPFAGCCT

SEQ ID NO: 906229 - protein, 9 aa, Homo Sapiens
KVRFLEHQN

SEQ ID NO: 906230 - protein, 9 aa, Homo Sapiens
VLGQLRLSR

SEQ ID NO: 906231 - protein, 9 aa, Homo Sapiens
LPLPLSSSV

SEQ ID NO: 906232 - protein, 9 aa, Homo Sapiens
CNYHNEEGV

SEQ ID NO: 906233 - protein, 9 aa, Homo Sapiens
CCTRDGDGD

SEQ ID NO: 906234 - protein, 9 aa, Homo Sapiens
LVVKSVKCV

SEQ ID NO: 906235 - protein, 9 aa, Homo Sapiens
MPQLLAIIS

SEQ ID NO: 906236 - protein, 9 aa, Homo Sapiens
SQWPSVSDD

SEQ ID NO: 906237 - protein, 9 aa, Homo Sapiens
VSHSSFPVG

SEQ ID NO: 906238 - protein, 9 aa, Homo Sapiens
NGVLPLTSN

SEQ ID NO: 906239 - protein, 9 aa, Homo Sapiens
LLAKMWVRY

SEQ ID NO: 906240 - protein, 9 aa, Homo Sapiens
RGCWPLRKT

SEQ ID NO: 906241 - protein, 9 aa, Homo Sapiens
VTMPSMQCK

SEQ ID NO: 906242 - protein, 9 aa, Homo Sapiens
YLVDGSPCA

SEQ ID NO: 906243 - protein, 9 aa, Homo Sapiens
DKAFHFKSN

SEQ ID NO: 906244 - protein, 9 aa, Homo Sapiens
ARVVSHSSF

SEQ ID NO: 906245 - protein, 9 aa, Homo Sapiens
VPLVVWALE

SEQ ID NO: 906246 - protein, 9 aa, Homo Sapiens
AKMWVRYAE

SEQ ID NO: 906247 - protein, 9 aa, Homo Sapiens
VSAHKLCED

SEQ ID NO: 906248 - protein, 9 aa, Homo Sapiens
WQVSLPELE

SEQ ID NO: 906249 - protein, 9 aa, Homo Sapiens
KMWVRYAEF

SEQ ID NO: 906250 - protein, 9 aa, Homo Sapiens
EEPQDSDFL

SEQ ID NO: 906251 - protein, 9 aa, Homo Sapiens
KHTKLTTLT

SEQ ID NO: 906252 - protein, 9 aa, Homo Sapiens
KPQRSASGN

SEQ ID NO: 906253 - protein, 9 aa, Homo Sapiens
MGVNNISAP

SEQ ID NO: 906254 - protein, 9 aa, Homo Sapiens
ASLELGCKY

SEQ ID NO: 906255 - protein, 9 aa, Homo Sapiens
NENRMVETK

SEQ ID NO: 906256 - protein, 9 aa, Homo Sapiens
GCCTRDGDG

SEQ ID NO: 906257 - protein, 9 aa, Homo Sapiens
KRHIDYSRK

SEQ ID NO: 906258 - protein, 9 aa, Homo Sapiens
AGLVPLVVW

SEQ ID NO: 906259 - protein, 9 aa, Homo Sapiens
AIGKPGHLN

SEQ ID NO: 906260 - protein, 9 aa, Homo Sapiens
VESEEPQDS

SEQ ID NO: 906261 - protein, 9 aa, Homo Sapiens
ALDKIFKKV

SEQ ID NO: 906262 - protein, 9 aa, Homo Sapiens
EQPDSWQPY

SEQ ID NO: 906263 - protein, 9 aa, Homo Sapiens
AHKLCEDVK

SEQ ID NO: 906264 - protein, 9 aa, Homo Sapiens
LTTLTISRR

SEQ ID NO: 906265 - protein, 9 aa, Homo Sapiens
GVWTRVPSL

SEQ ID NO: 906266 - protein, 9 aa, Homo Sapiens
KSKPQRSAS

SEQ ID NO: 906267 - protein, 9 aa, Homo Sapiens
QAASEPMSV

SEQ ID NO: 906268 - protein, 9 aa, Homo Sapiens
PELEDRLQC

SEQ ID NO: 906269 - protein, 9 aa, Homo Sapiens
SPPIPHLRV

SEQ ID NO: 906270 - protein, 9 aa, Homo Sapiens
KQMLKSVMQ

SEQ ID NO: 906271 - protein, 9 aa, Homo Sapiens
KAFHFKSNL

SEQ ID NO: 906272 - protein, 9 aa, Homo Sapiens
VKSVKCVTV

SEQ ID NO: 906273 - protein, 9 aa, Homo Sapiens
TKLTTLTIS

SEQ ID NO: 906274 - protein, 9 aa, Homo Sapiens
PQRSASGNN

SEQ ID NO: 906275 - protein, 9 aa, Homo Sapiens
VVWALELLE

SEQ ID NO: 906276 - protein, 9 aa, Homo Sapiens
EYLDVLSHV

SEQ ID NO: 906277 - protein, 9 aa, Homo Sapiens
WALELLEQA

SEQ ID NO: 906278 - protein, 9 aa, Homo Sapiens
TVIKHTKLT

SEQ ID NO: 906279 - protein, 9 aa, Homo Sapiens
LMDKFKILL

SEQ ID NO: 906280 - protein, 9 aa, Homo Sapiens
RVVSHSSFP

SEQ ID NO: 906281 - protein, 9 aa, Homo Sapiens
RLSRTGDRP

SEQ ID NO: 906282 - protein, 9 aa, Homo Sapiens
QDSDFLSCM

SEQ ID NO: 906283 - protein, 9 aa, Homo Sapiens
PQLLAIISK

SEQ ID NO: 906284 - protein, 9 aa, Homo Sapiens
PPDVYLVDG

SEQ ID NO: 906285 - protein, 9 aa, Homo Sapiens
LVDGSPCAR

SEQ ID NO: 906286 - protein, 9 aa, Homo Sapiens
APTAYDPML

SEQ ID NO: 906287 - protein, 9 aa, Homo Sapiens
SFPVGGPEG

SEQ ID NO: 906288 - protein, 9 aa, Homo Sapiens
LSRTGDRPR

SEQ ID NO: 906289 - protein, 9 aa, Homo Sapiens
QRSASGNNE

SEQ ID NO: 906290 - protein, 9 aa, Homo Sapiens
LPLTSNVTV

SEQ ID NO: 906291 - protein, 9 aa, Homo Sapiens
AKDNGVLPL

SEQ ID NO: 906292 - protein, 9 aa, Homo Sapiens
LGPPGNLGP

SEQ ID NO: 906293 - protein, 9 aa, Homo Sapiens
CKYSYGGTV

SEQ ID NO: 906294 - protein, 9 aa, Homo Sapiens
YSRKQISLF

SEQ ID NO: 906295 - protein, 9 aa, Homo Sapiens
VDPQVQSGA

SEQ ID NO: 906296 - protein, 9 aa, Homo Sapiens
PTAYDPMLK

SEQ ID NO: 906297 - protein, 9 aa, Homo Sapiens
PDVYLVDGS

SEQ ID NO: 906298 - protein, 9 aa, Homo Sapiens
WTRVPSLDW

SEQ ID NO: 906299 - protein, 9 aa, Homo Sapiens
LTPLMDKFK

SEQ ID NO: 906300 - protein, 9 aa, Homo Sapiens
AYDPMLKVD

SEQ ID NO: 906301 - protein, 9 aa, Homo Sapiens
LACSVEEAM

SEQ ID NO: 906302 - protein, 9 aa, Homo Sapiens
HSAKPVGPE

SEQ ID NO: 906303 - protein, 9 aa, Homo Sapiens
NRMVETKSS

SEQ ID NO: 906304 - protein, 9 aa, Homo Sapiens
VDGSPCARG

SEQ ID NO: 906305 - protein, 9 aa, Homo Sapiens
QMLKSVMQE

SEQ ID NO: 906306 - protein, 9 aa, Homo Sapiens
GWAPFAGCC

SEQ ID NO: 906307 - protein, 9 aa, Homo Sapiens
SYAIGKPGH

SEQ ID NO: 906308 - protein, 9 aa, Homo Sapiens
LITIMPQLL

SEQ ID NO: 906309 - protein, 9 aa, Homo Sapiens
FLEHQNQVL

SEQ ID NO: 906310 - protein, 9 aa, Homo Sapiens
VWALELLEQ

SEQ ID NO: 906311 - protein, 9 aa, Homo Sapiens
ASRPLILHL

SEQ ID NO: 906312 - protein, 9 aa, Homo Sapiens
RPLILHLNH

SEQ ID NO: 906313 - protein, 9 aa, Homo Sapiens
QVMGVNNIS

SEQ ID NO: 906314 - protein, 9 aa, Homo Sapiens
SEPMSVEDL

SEQ ID NO: 906315 - protein, 9 aa, Homo Sapiens
LWQAASEPM

SEQ ID NO: 906316 - protein, 9 aa, Homo Sapiens
PIPHLRVLL

SEQ ID NO: 906317 - protein, 9 aa, Homo Sapiens
MVETKSSEN

SEQ ID NO: 906318 - protein, 9 aa, Homo Sapiens
AWQVSLPEL

SEQ ID NO: 906319 - protein, 9 aa, Homo Sapiens
SSSVTMPSM

SEQ ID NO: 906320 - protein, 9 aa, Homo Sapiens
DWLLAKMWV

SEQ ID NO: 906321 - protein, 9 aa, Homo Sapiens
LVVWALELL

SEQ ID NO: 906322 - protein, 9 aa, Homo Sapiens
WPSVSDDSR

SEQ ID NO: 906323 - protein, 9 aa, Homo Sapiens
LDQVMGVNN

SEQ ID NO: 906324 - protein, 9 aa, Homo Sapiens
FPVGGPEGE

SEQ ID NO: 906325 - protein, 9 aa, Homo Sapiens
DPQVQSGAD

SEQ ID NO: 906326 - protein, 9 aa, Homo Sapiens
DKVRFLEHQ

SEQ ID NO: 906327 - protein, 9 aa, Homo Sapiens
HLRVLLSSS

SEQ ID NO: 906328 - protein, 9 aa, Homo Sapiens
DCHLVGLLD

SEQ ID NO: 906329 - protein, 9 aa, Homo Sapiens
HKLCEDVKI

SEQ ID NO: 906330 - protein, 9 aa, Homo Sapiens
DATQVRDCH

SEQ ID NO: 906331 - protein, 9 aa, Homo Sapiens
HNEEGVSWW

SEQ ID NO: 906332 - protein, 9 aa, Homo Sapiens
DSWQPYGSS

SEQ ID NO: 906333 - protein, 9 aa, Homo Sapiens
LESVKQMLK

SEQ ID NO: 906334 - protein, 9 aa, Homo Sapiens
RMVETKSSE

SEQ ID NO: 906335 - protein, 9 aa, Homo Sapiens
MWVRYAEFY

SEQ ID NO: 906336 - protein, 9 aa, Homo Sapiens
PGEGVWTRV

SEQ ID NO: 906337 - protein, 9 aa, Homo Sapiens
HSSFPVGGP

SEQ ID NO: 906338 - protein, 9 aa, Homo Sapiens
VLPLTSNVT

SEQ ID NO: 906339 - protein, 9 aa, Homo Sapiens
MAPTAYDPM

SEQ ID NO: 906340 - protein, 9 aa, Homo Sapiens
WQPYGSSFY

SEQ ID NO: 906341 - protein, 9 aa, Homo Sapiens
GVLPLTSNV

SEQ ID NO: 906342 - protein, 9 aa, Homo Sapiens
VSDDSRGLV

SEQ ID NO: 906343 - protein, 9 aa, Homo Sapiens
NNISAPECG

SEQ ID NO: 906344 - protein, 9 aa, Homo Sapiens
ELACSVEEA

SEQ ID NO: 906345 - protein, 9 aa, Homo Sapiens
SDFLSCMSR

SEQ ID NO: 906346 - protein, 9 aa, Homo Sapiens
AAKSKPQRS

SEQ ID NO: 906347 - protein, 9 aa, Homo Sapiens
RFLEHQNQV

SEQ ID NO: 906348 - protein, 9 aa, Homo Sapiens
WLLAKMWVR

SEQ ID NO: 906349 - protein, 9 aa, Homo Sapiens
VVSHSSFPV

SEQ ID NO: 906350 - protein, 9 aa, Homo Sapiens
LPELEDRLQ

SEQ ID NO: 906351 - protein, 9 aa, Homo Sapiens
ASEKHQLMY

SEQ ID NO: 906352 - protein, 9 aa, Homo Sapiens
PPGNLGPSG

SEQ ID NO: 906353 - protein, 9 aa, Homo Sapiens
IMPQLLAII

SEQ ID NO: 906354 - protein, 9 aa, Homo Sapiens
GNLGPSGSP

SEQ ID NO: 906355 - protein, 9 aa, Homo Sapiens
IPHLRVLLS

SEQ ID NO: 906356 - protein, 9 aa, Homo Sapiens
KDNGVLPLT

SEQ ID NO: 906357 - protein, 9 aa, Homo Sapiens
SEEPQDSDF

SEQ ID NO: 906358 - protein, 9 aa, Homo Sapiens
KSTHSAKPV

SEQ ID NO: 906359 - protein, 9 aa, Homo Sapiens
AGCCTRDGD

SEQ ID NO: 906360 - protein, 9 aa, Homo Sapiens
CPPDVYLVD

SEQ ID NO: 906361 - protein, 9 aa, Homo Sapiens
VIALDKIFK

SEQ ID NO: 906362 - protein, 9 aa, Homo Sapiens
RAPGEGVWT

SEQ ID NO: 906363 - protein, 9 aa, Homo Sapiens
AAAKSKPQR

SEQ ID NO: 906364 - protein, 9 aa, Homo Sapiens
VVYKSTHSA

SEQ ID NO: 906365 - protein, 9 aa, Homo Sapiens
ITIMPQLLA

SEQ ID NO: 906366 - protein, 9 aa, Homo Sapiens
NLSFSVSAH

SEQ ID NO: 906367 - protein, 9 aa, Homo Sapiens
EPMSVEDLL

SEQ ID NO: 906368 - protein, 9 aa, Homo Sapiens
APGEGVWTR

SEQ ID NO: 906369 - protein, 9 aa, Homo Sapiens
PQVQSGADE

SEQ ID NO: 906370 - protein, 9 aa, Homo Sapiens
LEQPDSWQP

SEQ ID NO: 906371 - protein, 9 aa, Homo Sapiens
RRGCWPLRK

SEQ ID NO: 906372 - protein, 9 aa, Homo Sapiens
PSCNNRHFW

SEQ ID NO: 906373 - protein, 9 aa, Homo Sapiens
SSVTMPSMQ

SEQ ID NO: 906374 - protein, 9 aa, Homo Sapiens
VWTRVPSLD

SEQ ID NO: 906375 - protein, 9 aa, Homo Sapiens
PLPLSSSVT

SEQ ID NO: 906376 - protein, 9 aa, Homo Sapiens
DVYLVDGSP

SEQ ID NO: 906377 - protein, 9 aa, Homo Sapiens
HLNQPYEII

SEQ ID NO: 906378 - protein, 9 aa, Homo Sapiens
PLSSSVTMP

SEQ ID NO: 906379 - protein, 9 aa, Homo Sapiens
HTELACSVE

SEQ ID NO: 906380 - protein, 9 aa, Homo Sapiens
LMYRLAMTG

SEQ ID NO: 906381 - protein, 9 aa, Homo Sapiens
DNGVLPLTS

SEQ ID NO: 906382 - protein, 9 aa, Homo Sapiens
DQVMGVNNI

SEQ ID NO: 906383 - protein, 9 aa, Homo Sapiens
PGNLGPSGS

SEQ ID NO: 906384 - protein, 9 aa, Homo Sapiens
SVKCVTVLS

SEQ ID NO: 906385 - protein, 9 aa, Homo Sapiens
ASEPMSVED

SEQ ID NO: 906386 - protein, 9 aa, Homo Sapiens
SVSAHKLCE

SEQ ID NO: 906387 - protein, 9 aa, Homo Sapiens
YHNEEGVSW

SEQ ID NO: 906388 - protein, 9 aa, Homo Sapiens
STHSAKPVG

SEQ ID NO: 906389 - protein, 9 aa, Homo Sapiens
QSGADETAV

SEQ ID NO: 906390 - protein, 9 aa, Homo Sapiens
CVTVLSDIL

SEQ ID NO: 906391 - protein, 9 aa, Homo Sapiens
CSVEEAMES

SEQ ID NO: 906392 - protein, 9 aa, Homo Sapiens
TLWQAASEP

SEQ ID NO: 906393 - protein, 9 aa, Homo Sapiens
YLDVLSHVT

SEQ ID NO: 906394 - protein, 9 aa, Homo Sapiens
IDKVRFLEH

SEQ ID NO: 906395 - protein, 9 aa, Homo Sapiens
LASEKHQLM

SEQ ID NO: 906396 - protein, 9 aa, Homo Sapiens
HTKLTTLTI

SEQ ID NO: 906397 - protein, 9 aa, Homo Sapiens
LQHTELACS

SEQ ID NO: 906398 - protein, 9 aa, Homo Sapiens
CWPLRKTAP

SEQ ID NO: 906399 - protein, 9 aa, Homo Sapiens
HIDYSRKQI

SEQ ID NO: 906400 - protein, 9 aa, Homo Sapiens
FTVIKHTKL

SEQ ID NO: 906401 - protein, 9 aa, Homo Sapiens
YAIGKPGHL

SEQ ID NO: 906402 - protein, 9 aa, Homo Sapiens
LGPSGSPGP

SEQ ID NO: 906403 - protein, 9 aa, Homo Sapiens
SKPQRSASG

SEQ ID NO: 906404 - protein, 9 aa, Homo Sapiens
SRPLILHLN

SEQ ID NO: 906405 - protein, 9 aa, Homo Sapiens
SWQPYGSSF

SEQ ID NO: 906406 - protein, 9 aa, Homo Sapiens
SRTGDRPRT

SEQ ID NO: 906407 - protein, 9 aa, Homo Sapiens
GLVPLVVWA

SEQ ID NO: 906408 - protein, 9 aa, Homo Sapiens
KQISLFWKN

SEQ ID NO: 906409 - protein, 9 aa, Homo Sapiens
SKPNENRMV

SEQ ID NO: 906410 - protein, 9 aa, Homo Sapiens
FKKVEKIKQ

SEQ ID NO: 906411 - protein, 9 aa, Homo Sapiens
LGVVYKSTH

SEQ ID NO: 906412 - protein, 9 aa, Homo Sapiens
VVKSVKCVT

SEQ ID NO: 906413 - protein, 9 aa, Homo Sapiens
TELACSVEE

SEQ ID NO: 906414 - protein, 9 aa, Homo Sapiens
CLPSCNNRH

SEQ ID NO: 906415 - protein, 9 aa, Homo Sapiens
KPGHLNQPY

SEQ ID NO: 906416 - protein, 9 aa, Homo Sapiens
SDDSRGLVI

SEQ ID NO: 906417 - protein, 9 aa, Homo Sapiens
MLITIMPQL

SEQ ID NO: 906418 - protein, 9 aa, Homo Sapiens
IFKKVEKIK

SEQ ID NO: 906419 - protein, 9 aa, Homo Sapiens
IKHTKLTTL

SEQ ID NO: 906420 - protein, 9 aa, Homo Sapiens
MAWQVSLPE

SEQ ID NO: 906421 - protein, 9 aa, Homo Sapiens
GCKYSYGGT

SEQ ID NO: 906422 - protein, 9 aa, Homo Sapiens
TRVPSLDWE

SEQ ID NO: 906423 - protein, 9 aa, Homo Sapiens
LGQLRLSRT

SEQ ID NO: 906424 - protein, 9 aa, Homo Sapiens
FHFKSNLER

SEQ ID NO: 906425 - protein, 9 aa, Homo Sapiens
SGADETAVQ

SEQ ID NO: 906426 - protein, 9 aa, Homo Sapiens
TDLGRRGCW

SEQ ID NO: 906427 - protein, 9 aa, Homo Sapiens
CLEQPDSWQ

SEQ ID NO: 906428 - protein, 9 aa, Homo Sapiens
PDSWQPYGS

SEQ ID NO: 906429 - protein, 9 aa, Homo Sapiens
SVSDDSRGL

SEQ ID NO: 906430 - protein, 9 aa, Homo Sapiens
SHSSFPVGG

SEQ ID NO: 906431 - protein, 9 aa, Homo Sapiens
LSSSVTMPS

SEQ ID NO: 906432 - protein, 9 aa, Homo Sapiens
PHLRVLLSS

SEQ ID NO: 906433 - protein, 9 aa, Homo Sapiens
IALDKIFKK

SEQ ID NO: 906434 - protein, 9 aa, Homo Sapiens
DSRGLVITA

SEQ ID NO: 906435 - protein, 9 aa, Homo Sapiens
WDWLLAKMW

SEQ ID NO: 906436 - protein, 9 aa, Homo Sapiens
SHVTGPQVS

SEQ ID NO: 906437 - protein, 9 aa, Homo Sapiens
VYLVDGSPC

SEQ ID NO: 906438 - protein, 9 aa, Homo Sapiens
RHIDYSRKQ

SEQ ID NO: 906439 - protein, 9 aa, Homo Sapiens
QLRLSRTGD

SEQ ID NO: 906440 - protein, 9 aa, Homo Sapiens
WPLRKTAPK

SEQ ID NO: 906441 - protein, 9 aa, Homo Sapiens
CTRDGDGDE

SEQ ID NO: 906442 - protein, 9 aa, Homo Sapiens
PTSPMAPTA

SEQ ID NO: 906443 - protein, 9 aa, Homo Sapiens
LGCKYSYGG

SEQ ID NO: 906444 - protein, 9 aa, Homo Sapiens
PFAGCCTRD

SEQ ID NO: 906445 - protein, 9 aa, Homo Sapiens
EPQDSDFLS

SEQ ID NO: 906446 - protein, 9 aa, Homo Sapiens
QHTELACSV

SEQ ID NO: 906447 - protein, 9 aa, Homo Sapiens
KIFKKVEKI

SEQ ID NO: 906448 - protein, 9 aa, Homo Sapiens
TMLITIMPQ

SEQ ID NO: 906449 - protein, 9 aa, Homo Sapiens
FSVSAHKLC

SEQ ID NO: 906450 - protein, 9 aa, Homo Sapiens
SPMAPTAYD

SEQ ID NO: 906451 - protein, 9 aa, Homo Sapiens
RNLLTPLMD

SEQ ID NO: 906452 - protein, 9 aa, Homo Sapiens
PQDSDFLSC

SEQ ID NO: 906453 - protein, 9 aa, Homo Sapiens
LGRRGCWPL

SEQ ID NO: 906454 - protein, 9 aa, Homo Sapiens
FAGCCTRDG

SEQ ID NO: 906455 - protein, 9 aa, Homo Sapiens
GHLNQPYEI

SEQ ID NO: 906456 - protein, 9 aa, Homo Sapiens
RSASGNNES

SEQ ID NO: 906457 - protein, 9 aa, Homo Sapiens
HCPPDVYLV

SEQ ID NO: 906458 - protein, 9 aa, Homo Sapiens
GCWPLRKTA

SEQ ID NO: 906459 - protein, 9 aa, Homo Sapiens
PLMDKFKIL

SEQ ID NO: 906460 - protein, 9 aa, Homo Sapiens
CHLVGLLDL

SEQ ID NO: 906461 - protein, 9 aa, Homo Sapiens
HLVGLLDLA

SEQ ID NO: 906462 - protein, 9 aa, Homo Sapiens
NISAPECGM

SEQ ID NO: 906463 - protein, 9 aa, Homo Sapiens
KLASEKHQL

SEQ ID NO: 906464 - protein, 9 aa, Homo Sapiens
ACSVEEAME

SEQ ID NO: 906465 - protein, 9 aa, Homo Sapiens
QPDSWQPYG

SEQ ID NO: 906466 - protein, 9 aa, Homo Sapiens
DSDFLSCMS

SEQ ID NO: 906467 - protein, 9 aa, Homo Sapiens
ESKPNENRM

SEQ ID NO: 906468 - protein, 9 aa, Homo Sapiens
GKPGHLNQP

SEQ ID NO: 906469 - protein, 9 aa, Homo Sapiens
EGVWTRVPS

SEQ ID NO: 906470 - protein, 9 aa, Homo Sapiens
VNNISAPEC

SEQ ID NO: 906471 - protein, 9 aa, Homo Sapiens
VRFLEHQNQ

SEQ ID NO: 906472 - protein, 9 aa, Homo Sapiens
LLTPLMDKF

SEQ ID NO: 906473 - protein, 9 aa, Homo Sapiens
SCLEQPDSW

SEQ ID NO: 906474 - protein, 9 aa, Homo Sapiens
PVDPQVQSG

SEQ ID NO: 906475 - protein, 9 aa, Homo Sapiens
ENRMVETKS

SEQ ID NO: 906476 - protein, 9 aa, Homo Sapiens
PGHLNQPYE

SEQ ID NO: 906477 - protein, 9 aa, Homo Sapiens
QLLAIISKA

SEQ ID NO: 906478 - protein, 9 aa, Homo Sapiens
KHQLMYRLA

SEQ ID NO: 906479 - protein, 9 aa, Homo Sapiens
LRLSRTGDR

SEQ ID NO: 906480 - protein, 9 aa, Homo Sapiens
SCLPSCNNR

SEQ ID NO: 906481 - protein, 9 aa, Homo Sapiens
LAKDNGVLP

SEQ ID NO: 906482 - protein, 9 aa, Homo Sapiens
SSFPVGGPE

SEQ ID NO: 906483 - protein, 9 aa, Homo Sapiens
LPSCNNRHF

SEQ ID NO: 906484 - protein, 9 aa, Homo Sapiens
VKQMLKSVM

SEQ ID NO: 906485 - protein, 9 aa, Homo Sapiens
LTLWQAASE

SEQ ID NO: 906486 - protein, 9 aa, Homo Sapiens
QLMYRLAMT

SEQ ID NO: 906487 - protein, 9 aa, Homo Sapiens
SRKQISLFW

SEQ ID NO: 906488 - protein, 9 aa, Homo Sapiens
EGVSWWWCF

SEQ ID NO: 906489 - protein, 9 aa, Homo Sapiens
TSPMAPTAY

SEQ ID NO: 906490 - protein, 9 aa, Homo Sapiens
GVNNISAPE

SEQ ID NO: 906491 - protein, 9 aa, Homo Sapiens
LRVLLSSSD

SEQ ID NO: 906492 - protein, 9 aa, Homo Sapiens
PLILHLNHM

SEQ ID NO: 906493 - protein, 9 aa, Homo Sapiens
PMAPTAYDP

SEQ ID NO: 906494 - protein, 9 aa, Homo Sapiens
NLGPSGSPG

SEQ ID NO: 906495 - protein, 9 aa, Homo Sapiens
VRDCHLVGL

SEQ ID NO: 906496 - protein, 9 aa, Homo Sapiens
GQLRLSRTG

SEQ ID NO: 906497 - protein, 9 aa, Homo Sapiens
GADETAVQL

SEQ ID NO: 906498 - protein, 9 aa, Homo Sapiens
EEGVSWWWC

SEQ ID NO: 906499 - protein, 9 aa, Homo Sapiens
ATQVRDCHL

SEQ ID NO: 906500 - protein, 9 aa, Homo Sapiens
DYSRKQISL

SEQ ID NO: 906501 - protein, 9 aa, Homo Sapiens
AASLELGCK

SEQ ID NO: 906502 - protein, 9 aa, Homo Sapiens
DCNYHNEEG

SEQ ID NO: 906503 - protein, 9 aa, Homo Sapiens
KLGPPGNLG

SEQ ID NO: 906504 - protein, 9 aa, Homo Sapiens
MASRPLILH

SEQ ID NO: 906505 - protein, 9 aa, Homo Sapiens
NYHNEEGVS

SEQ ID NO: 906506 - protein, 9 aa, Homo Sapiens
LPLSSSVTM

SEQ ID NO: 906507 - protein, 9 aa, Homo Sapiens
RVLLSSSDD

SEQ ID NO: 906508 - protein, 9 aa, Homo Sapiens
KYSYGGTVN

SEQ ID NO: 906509 - protein, 9 aa, Homo Sapiens
VLLSSSDDP

SEQ ID NO: 906510 - protein, 9 aa, Homo Sapiens
THSAKPVGP

SEQ ID NO: 906511 - protein, 9 aa, Homo Sapiens
LDKIFKKVE

SEQ ID NO: 906512 - protein, 9 aa, Homo Sapiens
EHQNQVLQT

SEQ ID NO: 906513 - protein, 9 aa, Homo Sapiens
SLPELEDRL

SEQ ID NO: 906514 - protein, 9 aa, Homo Sapiens
WQAASEPMS

SEQ ID NO: 906515 - protein, 9 aa, Homo Sapiens
HFKSNLERH

SEQ ID NO: 906516 - protein, 9 aa, Homo Sapiens
PSVSDDSRG

SEQ ID NO: 906517 - protein, 9 aa, Homo Sapiens
LSFSVSAHK

SEQ ID NO: 906518 - protein, 9 aa, Homo Sapiens
LELGCKYSY

SEQ ID NO: 906519 - protein, 9 aa, Homo Sapiens
VMGVNNISA

SEQ ID NO: 906520 - protein, 9 aa, Homo Sapiens
LDVLSHVTG

SEQ ID NO: 906521 - protein, 9 aa, Homo Sapiens
NLLTPLMDK

SEQ ID NO: 906522 - protein, 9 aa, Homo Sapiens
KPNENRMVE

SEQ ID NO: 906523 - protein, 9 aa, Homo Sapiens
NMASRPLIL

SEQ ID NO: 906524 - protein, 9 aa, Homo Sapiens
DLGRRGCWP

SEQ ID NO: 906525 - protein, 9 aa, Homo Sapiens
AFHFKSNLE

SEQ ID NO: 906526 - protein, 9 aa, Homo Sapiens
VTVLSDILR

SEQ ID NO: 906527 - protein, 9 aa, Homo Sapiens
ELGCKYSYG

SEQ ID NO: 906528 - protein, 9 aa, Homo Sapiens
GVVYKSTHS

SEQ ID NO: 906529 - protein, 9 aa, Homo Sapiens
TPLMDKFKI

SEQ ID NO: 906530 - protein, 9 aa, Homo Sapiens
EKHQLMYRL

SEQ ID NO: 906531 - protein, 9 aa, Homo Sapiens
SAHKLCEDV

SEQ ID NO: 906532 - protein, 9 aa, Homo Sapiens
DKIFKKVEK

SEQ ID NO: 906533 - protein, 9 aa, Homo Sapiens
HQLMYRLAM

SEQ ID NO: 906534 - protein, 9 aa, Homo Sapiens
VLSHVTGPQ

SEQ ID NO: 906535 - protein, 9 aa, Homo Sapiens
YKSTHSAKP

SEQ ID NO: 906536 - protein, 9 aa, Homo Sapiens
RKQISLFWK

SEQ ID NO: 906537 - protein, 9 aa, Homo Sapiens
GAGCVKRGW

SEQ ID NO: 906538 - protein, 9 aa, Homo Sapiens
IPKLRILIL

SEQ ID NO: 906539 - protein, 9 aa, Homo Sapiens
DRYFLSGEN

SEQ ID NO: 906540 - protein, 9 aa, Homo Sapiens
SASGFPDTL

SEQ ID NO: 906541 - protein, 9 aa, Homo Sapiens
PAVQSFRRT

SEQ ID NO: 906542 - protein, 9 aa, Homo Sapiens
VYRYVSPEQ

SEQ ID NO: 906543 - protein, 9 aa, Homo Sapiens
RFLHGSPRL

SEQ ID NO: 906544 - protein, 9 aa, Homo Sapiens
LCFVAYSIH

SEQ ID NO: 906545 - protein, 9 aa, Homo Sapiens
VAYSIHIYF

SEQ ID NO: 906546 - protein, 9 aa, Homo Sapiens
QDGALGAGC

SEQ ID NO: 906547 - protein, 9 aa, Homo Sapiens
FHEDWEVIT

SEQ ID NO: 906548 - protein, 9 aa, Homo Sapiens
PGPIFKPEN

SEQ ID NO: 906549 - protein, 9 aa, Homo Sapiens
GELWDPKAV

SEQ ID NO: 906550 - protein, 9 aa, Homo Sapiens
CGELWDPKA

SEQ ID NO: 906551 - protein, 9 aa, Homo Sapiens
YRYVSPEQK

SEQ ID NO: 906552 - protein, 9 aa, Homo Sapiens
PSNPLDIVV

SEQ ID NO: 906553 - protein, 9 aa, Homo Sapiens
AALVTPLSL

SEQ ID NO: 906554 - protein, 9 aa, Homo Sapiens
PIDIVQLSG

SEQ ID NO: 906555 - protein, 9 aa, Homo Sapiens
VEERGEEYL

SEQ ID NO: 906556 - protein, 9 aa, Homo Sapiens
AQAGSGYNL

SEQ ID NO: 906557 - protein, 9 aa, Homo Sapiens
FKNLFAVSS

SEQ ID NO: 906558 - protein, 9 aa, Homo Sapiens
VGMISLEKE

SEQ ID NO: 906559 - protein, 9 aa, Homo Sapiens
KPPGTGSRK

SEQ ID NO: 906560 - protein, 9 aa, Homo Sapiens
FKLFPGNDN

SEQ ID NO: 906561 - protein, 9 aa, Homo Sapiens
SDIPDRVQR

SEQ ID NO: 906562 - protein, 9 aa, Homo Sapiens
AGQTVFHIL

SEQ ID NO: 906563 - protein, 9 aa, Homo Sapiens
PTPNGHCTN

SEQ ID NO: 906564 - protein, 9 aa, Homo Sapiens
RTSNVGYFD

SEQ ID NO: 906565 - protein, 9 aa, Homo Sapiens
FYGPKIHIK

SEQ ID NO: 906566 - protein, 9 aa, Homo Sapiens
PDRYFLSGE

SEQ ID NO: 906567 - protein, 9 aa, Homo Sapiens
KKLSHAKGG

SEQ ID NO: 906568 - protein, 9 aa, Homo Sapiens
TEKEKVWSH

SEQ ID NO: 906569 - protein, 9 aa, Homo Sapiens
WEVITVLIG

SEQ ID NO: 906570 - protein, 9 aa, Homo Sapiens
FLIFWIIYL

SEQ ID NO: 906571 - protein, 9 aa, Homo Sapiens
YSIHIYFNE

SEQ ID NO: 906572 - protein, 9 aa, Homo Sapiens
ITQNVLQKL

SEQ ID NO: 906573 - protein, 9 aa, Homo Sapiens
HGGDFGITS

SEQ ID NO: 906574 - protein, 9 aa, Homo Sapiens
LVAALVTPL

SEQ ID NO: 906575 - protein, 9 aa, Homo Sapiens
NLRTSNVGY

SEQ ID NO: 906576 - protein, 9 aa, Homo Sapiens
ATMAYDRYI

SEQ ID NO: 906577 - protein, 9 aa, Homo Sapiens
WKSPVGKVK

SEQ ID NO: 906578 - protein, 9 aa, Homo Sapiens
QPSESAAPA

SEQ ID NO: 906579 - protein, 9 aa, Homo Sapiens
NWNPGQPDR

SEQ ID NO: 906580 - protein, 9 aa, Homo Sapiens
WFTPRSIYV

SEQ ID NO: 906581 - protein, 9 aa, Homo Sapiens
DWEVITVLI

SEQ ID NO: 906582 - protein, 9 aa, Homo Sapiens
GKENCSENM

SEQ ID NO: 906583 - protein, 9 aa, Homo Sapiens
NVLQKLDVF

SEQ ID NO: 906584 - protein, 9 aa, Homo Sapiens
GVSAQRDLV

SEQ ID NO: 906585 - protein, 9 aa, Homo Sapiens
HTRSCGELW

SEQ ID NO: 906586 - protein, 9 aa, Homo Sapiens
LKKEAQRAL

SEQ ID NO: 906587 - protein, 9 aa, Homo Sapiens
NKPGPIFKP

SEQ ID NO: 906588 - protein, 9 aa, Homo Sapiens
ATEKEKVWS

SEQ ID NO: 906589 - protein, 9 aa, Homo Sapiens
LGTWKSPVG

SEQ ID NO: 906590 - protein, 9 aa, Homo Sapiens
AQRDLVEER

SEQ ID NO: 906591 - protein, 9 aa, Homo Sapiens
QKLLGASKR

SEQ ID NO: 906592 - protein, 9 aa, Homo Sapiens
DPLDRCYST

SEQ ID NO: 906593 - protein, 9 aa, Homo Sapiens
SRTVIGVVI

SEQ ID NO: 906594 - protein, 9 aa, Homo Sapiens
PLDRCYSTP

SEQ ID NO: 906595 - protein, 9 aa, Homo Sapiens
NMLDSMPDI

SEQ ID NO: 906596 - protein, 9 aa, Homo Sapiens
VQRTLAAKK

SEQ ID NO: 906597 - protein, 9 aa, Homo Sapiens
GNDNSNKFS

SEQ ID NO: 906598 - protein, 9 aa, Homo Sapiens
FPGNDNSNK

SEQ ID NO: 906599 - protein, 9 aa, Homo Sapiens
LPGTFNAIP

SEQ ID NO: 906600 - protein, 9 aa, Homo Sapiens
SDYSHSDAS

SEQ ID NO: 906601 - protein, 9 aa, Homo Sapiens
ITSTVTFSC

SEQ ID NO: 906602 - protein, 9 aa, Homo Sapiens
RTVIGVVIY

SEQ ID NO: 906603 - protein, 9 aa, Homo Sapiens
HSDASSPTI

SEQ ID NO: 906604 - protein, 9 aa, Homo Sapiens
NPGQPDRYF

SEQ ID NO: 906605 - protein, 9 aa, Homo Sapiens
SRKRGQLYK

SEQ ID NO: 906606 - protein, 9 aa, Homo Sapiens
GADMVINTS

SEQ ID NO: 906607 - protein, 9 aa, Homo Sapiens
KAAAVLENL

SEQ ID NO: 906608 - protein, 9 aa, Homo Sapiens
EVLQDPLDR

SEQ ID NO: 906609 - protein, 9 aa, Homo Sapiens
GFKLFPGND

SEQ ID NO: 906610 - protein, 9 aa, Homo Sapiens
GSTHTIAFP

SEQ ID NO: 906611 - protein, 9 aa, Homo Sapiens
KRTEGRERA

SEQ ID NO: 906612 - protein, 9 aa, Homo Sapiens
FLKRTEGRE

SEQ ID NO: 906613 - protein, 9 aa, Homo Sapiens
TQNVLQKLD

SEQ ID NO: 906614 - protein, 9 aa, Homo Sapiens
DSQNKLGAD

SEQ ID NO: 906615 - protein, 9 aa, Homo Sapiens
LATPQPSES

SEQ ID NO: 906616 - protein, 9 aa, Homo Sapiens
TVFHILPGG

SEQ ID NO: 906617 - protein, 9 aa, Homo Sapiens
GQTVFHILP

SEQ ID NO: 906618 - protein, 9 aa, Homo Sapiens
YHQNGCISI

SEQ ID NO: 906619 - protein, 9 aa, Homo Sapiens
NPLDIVVTG

SEQ ID NO: 906620 - protein, 9 aa, Homo Sapiens
RTTSHIAKE

SEQ ID NO: 906621 - protein, 9 aa, Homo Sapiens
TIVASRTVI

SEQ ID NO: 906622 - protein, 9 aa, Homo Sapiens
CVAPEHEGH

SEQ ID NO: 906623 - protein, 9 aa, Homo Sapiens
EKVWSHVCS

SEQ ID NO: 906624 - protein, 9 aa, Homo Sapiens
GFRKPSQAY

SEQ ID NO: 906625 - protein, 9 aa, Homo Sapiens
RMQLSSLCV

SEQ ID NO: 906626 - protein, 9 aa, Homo Sapiens
SPVGKVKEA

SEQ ID NO: 906627 - protein, 9 aa, Homo Sapiens
VFVVALVAI

SEQ ID NO: 906628 - protein, 9 aa, Homo Sapiens
VLENLIFGS

SEQ ID NO: 906629 - protein, 9 aa, Homo Sapiens
LSHMDVYRY

SEQ ID NO: 906630 - protein, 9 aa, Homo Sapiens
RGFKLFPGN

SEQ ID NO: 906631 - protein, 9 aa, Homo Sapiens
PRSIYVEAS

SEQ ID NO: 906632 - protein, 9 aa, Homo Sapiens
TPNGHCTNG

SEQ ID NO: 906633 - protein, 9 aa, Homo Sapiens
EHPSQGMKT

SEQ ID NO: 906634 - protein, 9 aa, Homo Sapiens
YVEASTVDC

SEQ ID NO: 906635 - protein, 9 aa, Homo Sapiens
AYMLHSKHD

SEQ ID NO: 906636 - protein, 9 aa, Homo Sapiens
AVQSFRRTV

SEQ ID NO: 906637 - protein, 9 aa, Homo Sapiens
NARTTSHIA

SEQ ID NO: 906638 - protein, 9 aa, Homo Sapiens
QQGYQSLSD

SEQ ID NO: 906639 - protein, 9 aa, Homo Sapiens
RTLAAKKLS

SEQ ID NO: 906640 - protein, 9 aa, Homo Sapiens
SLSDYSHSD

SEQ ID NO: 906641 - protein, 9 aa, Homo Sapiens
KQCGYKLLI

SEQ ID NO: 906642 - protein, 9 aa, Homo Sapiens
QVLKKEAQR

SEQ ID NO: 906643 - protein, 9 aa, Homo Sapiens
LLSLRWCLF

SEQ ID NO: 906644 - protein, 9 aa, Homo Sapiens
TPLSLVHEL

SEQ ID NO: 906645 - protein, 9 aa, Homo Sapiens
TIAFPGSTT

SEQ ID NO: 906646 - protein, 9 aa, Homo Sapiens
QNGCISIWR

SEQ ID NO: 906647 - protein, 9 aa, Homo Sapiens
LHGSPRLEG

SEQ ID NO: 906648 - protein, 9 aa, Homo Sapiens
ASTIVASRT

SEQ ID NO: 906649 - protein, 9 aa, Homo Sapiens
EIVGMISLE

SEQ ID NO: 906650 - protein, 9 aa, Homo Sapiens
DQNQMGSTK

SEQ ID NO: 906651 - protein, 9 aa, Homo Sapiens
TTAQQTLSF

SEQ ID NO: 906652 - protein, 9 aa, Homo Sapiens
IHIKIKDAI

SEQ ID NO: 906653 - protein, 9 aa, Homo Sapiens
ITSGILLSQ

SEQ ID NO: 906654 - protein, 9 aa, Homo Sapiens
ILSHMDVYR

SEQ ID NO: 906655 - protein, 9 aa, Homo Sapiens
LCDLYLLLK

SEQ ID NO: 906656 - protein, 9 aa, Homo Sapiens
SCGELWDPK

SEQ ID NO: 906657 - protein, 9 aa, Homo Sapiens
FFLKRTEGR

SEQ ID NO: 906658 - protein, 9 aa, Homo Sapiens
LLMLTFFLI

SEQ ID NO: 906659 - protein, 9 aa, Homo Sapiens
RVNFHEDWE

SEQ ID NO: 906660 - protein, 9 aa, Homo Sapiens
EECLFFLKR

SEQ ID NO: 906661 - protein, 9 aa, Homo Sapiens
GPIFKPENG

SEQ ID NO: 906662 - protein, 9 aa, Homo Sapiens
GALGAGCVK

SEQ ID NO: 906663 - protein, 9 aa, Homo Sapiens
KSPVGKVKE

SEQ ID NO: 906664 - protein, 9 aa, Homo Sapiens
GAFYGPKIH

SEQ ID NO: 906665 - protein, 9 aa, Homo Sapiens
QNKLGADMV

SEQ ID NO: 906666 - protein, 9 aa, Homo Sapiens
PGNDNSNKF

SEQ ID NO: 906667 - protein, 9 aa, Homo Sapiens
IVNILEEEV

SEQ ID NO: 906668 - protein, 9 aa, Homo Sapiens
IFKPENGLL

SEQ ID NO: 906669 - protein, 9 aa, Homo Sapiens
CGYKLLIYG

SEQ ID NO: 906670 - protein, 9 aa, Homo Sapiens
QYHQNGCIS

SEQ ID NO: 906671 - protein, 9 aa, Homo Sapiens
IADLLVKPQ

SEQ ID NO: 906672 - protein, 9 aa, Homo Sapiens
PSQKLLGAS

SEQ ID NO: 906673 - protein, 9 aa, Homo Sapiens
SHMDVYRYV

SEQ ID NO: 906674 - protein, 9 aa, Homo Sapiens
VTSAATRTS

SEQ ID NO: 906675 - protein, 9 aa, Homo Sapiens
VNMEPDQNQ

SEQ ID NO: 906676 - protein, 9 aa, Homo Sapiens
EAQRALKLP

SEQ ID NO: 906677 - protein, 9 aa, Homo Sapiens
KEAQRALKL

SEQ ID NO: 906678 - protein, 9 aa, Homo Sapiens
VAALVTPLS

SEQ ID NO: 906679 - protein, 9 aa, Homo Sapiens
TPQPSESAA

SEQ ID NO: 906680 - protein, 9 aa, Homo Sapiens
GKCSGHCSF

SEQ ID NO: 906681 - protein, 9 aa, Homo Sapiens
SAAPAVLGE

SEQ ID NO: 906682 - protein, 9 aa, Homo Sapiens
HIKIKDAIG

SEQ ID NO: 906683 - protein, 9 aa, Homo Sapiens
QGMKTTYLD

SEQ ID NO: 906684 - protein, 9 aa, Homo Sapiens
SCTRLSGVT

SEQ ID NO: 906685 - protein, 9 aa, Homo Sapiens
SNVGYFDIG

SEQ ID NO: 906686 - protein, 9 aa, Homo Sapiens
SIHIYFNEE

SEQ ID NO: 906687 - protein, 9 aa, Homo Sapiens
AANARERCR

SEQ ID NO: 906688 - protein, 9 aa, Homo Sapiens
VNILEEEVV

SEQ ID NO: 906689 - protein, 9 aa, Homo Sapiens
NFLCDLYLL

SEQ ID NO: 906690 - protein, 9 aa, Homo Sapiens
KLQDNYCEI

SEQ ID NO: 906691 - protein, 9 aa, Homo Sapiens
APSNPLDIV

SEQ ID NO: 906692 - protein, 9 aa, Homo Sapiens
AVKRTITQN

SEQ ID NO: 906693 - protein, 9 aa, Homo Sapiens
RYFLSGENC

SEQ ID NO: 906694 - protein, 9 aa, Homo Sapiens
KSVTRKDTG

SEQ ID NO: 906695 - protein, 9 aa, Homo Sapiens
ISLEKETVP

SEQ ID NO: 906696 - protein, 9 aa, Homo Sapiens
KLLLMLTFF

SEQ ID NO: 906697 - protein, 9 aa, Homo Sapiens
SLEKETVPF

SEQ ID NO: 906698 - protein, 9 aa, Homo Sapiens
RYEGHLQIA

SEQ ID NO: 906699 - protein, 9 aa, Homo Sapiens
RKRGQLYKH

SEQ ID NO: 906700 - protein, 9 aa, Homo Sapiens
CTRLSGVTS

SEQ ID NO: 906701 - protein, 9 aa, Homo Sapiens
FHILPGGLD

SEQ ID NO: 906702 - protein, 9 aa, Homo Sapiens
ILLSQREAR

SEQ ID NO: 906703 - protein, 9 aa, Homo Sapiens
HVGIVRYEG

SEQ ID NO: 906704 - protein, 9 aa, Homo Sapiens
SINARTTSH

SEQ ID NO: 906705 - protein, 9 aa, Homo Sapiens
ENMLDSMPD

SEQ ID NO: 906706 - protein, 9 aa, Homo Sapiens
VWSHVCSSR

SEQ ID NO: 906707 - protein, 9 aa, Homo Sapiens
TAGQTVFHI

SEQ ID NO: 906708 - protein, 9 aa, Homo Sapiens
PEVLQDPLD

SEQ ID NO: 906709 - protein, 9 aa, Homo Sapiens
VRQRFLHGS

SEQ ID NO: 906710 - protein, 9 aa, Homo Sapiens
HTILATTTA

SEQ ID NO: 906711 - protein, 9 aa, Homo Sapiens
RSIYVEAST

SEQ ID NO: 906712 - protein, 9 aa, Homo Sapiens
SIKIVNILE

SEQ ID NO: 906713 - protein, 9 aa, Homo Sapiens
QLSSLCVCN

SEQ ID NO: 906714 - protein, 9 aa, Homo Sapiens
GYFDIGLME

SEQ ID NO: 906715 - protein, 9 aa, Homo Sapiens
VALVAISIV

SEQ ID NO: 906716 - protein, 9 aa, Homo Sapiens
RSCGELWDP

SEQ ID NO: 906717 - protein, 9 aa, Homo Sapiens
VTSEIADLL

SEQ ID NO: 906718 - protein, 9 aa, Homo Sapiens
AVRQRFLHG

SEQ ID NO: 906719 - protein, 9 aa, Homo Sapiens
LSLSIPCVA

SEQ ID NO: 906720 - protein, 9 aa, Homo Sapiens
SGGQVLKKE

SEQ ID NO: 906721 - protein, 9 aa, Homo Sapiens
IHIYFNEEP

SEQ ID NO: 906722 - protein, 9 aa, Homo Sapiens
TSEIADLLV

SEQ ID NO: 906723 - protein, 9 aa, Homo Sapiens
GQVLKKEAQ

SEQ ID NO: 906724 - protein, 9 aa, Homo Sapiens
VGIVRYEGH

SEQ ID NO: 906725 - protein, 9 aa, Homo Sapiens
QLSAPSNPL

SEQ ID NO: 906726 - protein, 9 aa, Homo Sapiens
SSAVRLVTI

SEQ ID NO: 906727 - protein, 9 aa, Homo Sapiens
ILATTTAQQ

SEQ ID NO: 906728 - protein, 9 aa, Homo Sapiens
KLSHAKGGA

SEQ ID NO: 906729 - protein, 9 aa, Homo Sapiens
ERCRMHGLN

SEQ ID NO: 906730 - protein, 9 aa, Homo Sapiens
LFFLKRTEG

SEQ ID NO: 906731 - protein, 9 aa, Homo Sapiens
GLGTWKSPV

SEQ ID NO: 906732 - protein, 9 aa, Homo Sapiens
FRKPSQAYM

SEQ ID NO: 906733 - protein, 9 aa, Homo Sapiens
LYLLLKLAC

SEQ ID NO: 906734 - protein, 9 aa, Homo Sapiens
IYVEASTVD

SEQ ID NO: 906735 - protein, 9 aa, Homo Sapiens
IVRYEGHLQ

SEQ ID NO: 906736 - protein, 9 aa, Homo Sapiens
PGTGSRKRG

SEQ ID NO: 906737 - protein, 9 aa, Homo Sapiens
VQIAMEAGF

SEQ ID NO: 906738 - protein, 9 aa, Homo Sapiens
LANETQPGE

SEQ ID NO: 906739 - protein, 9 aa, Homo Sapiens
CTNGEAGRS

SEQ ID NO: 906740 - protein, 9 aa, Homo Sapiens
SQNKLGADM

SEQ ID NO: 906741 - protein, 9 aa, Homo Sapiens
QIAMEAGFR

SEQ ID NO: 906742 - protein, 9 aa, Homo Sapiens
HPSQGMKTT

SEQ ID NO: 906743 - protein, 9 aa, Homo Sapiens
EDWEVITVL

SEQ ID NO: 906744 - protein, 9 aa, Homo Sapiens
VGKCSGHCS

SEQ ID NO: 906745 - protein, 9 aa, Homo Sapiens
SLCVCNSHC

SEQ ID NO: 906746 - protein, 9 aa, Homo Sapiens
FVVALVAIS

SEQ ID NO: 906747 - protein, 9 aa, Homo Sapiens
PSQGMKTTY

SEQ ID NO: 906748 - protein, 9 aa, Homo Sapiens
VLKKEAQRA

SEQ ID NO: 906749 - protein, 9 aa, Homo Sapiens
VVFVVALVA

SEQ ID NO: 906750 - protein, 9 aa, Homo Sapiens
PNGHCTNGE

SEQ ID NO: 906751 - protein, 9 aa, Homo Sapiens
TRKDTGTYT

SEQ ID NO: 906752 - protein, 9 aa, Homo Sapiens
PYQLSAPSN

SEQ ID NO: 906753 - protein, 9 aa, Homo Sapiens
ELALGQYHQ

SEQ ID NO: 906754 - protein, 9 aa, Homo Sapiens
CRMHGLNHA

SEQ ID NO: 906755 - protein, 9 aa, Homo Sapiens
ETSASGFPD

SEQ ID NO: 906756 - protein, 9 aa, Homo Sapiens
STIVASRTV

SEQ ID NO: 906757 - protein, 9 aa, Homo Sapiens
GITSTVTFS

SEQ ID NO: 906758 - protein, 9 aa, Homo Sapiens
YKLLIYGRD

SEQ ID NO: 906759 - protein, 9 aa, Homo Sapiens
VSVTYLANE

SEQ ID NO: 906760 - protein, 9 aa, Homo Sapiens
QAYMLHSKH

SEQ ID NO: 906761 - protein, 9 aa, Homo Sapiens
RLSGVTSAA

SEQ ID NO: 906762 - protein, 9 aa, Homo Sapiens
ENQVSVTYL

SEQ ID NO: 906763 - protein, 9 aa, Homo Sapiens
NGHCTNGEA

SEQ ID NO: 906764 - protein, 9 aa, Homo Sapiens
FGITSTVTF

SEQ ID NO: 906765 - protein, 9 aa, Homo Sapiens
ATLSLSIPC

SEQ ID NO: 906766 - protein, 9 aa, Homo Sapiens
TAQQTLSFL

SEQ ID NO: 906767 - protein, 9 aa, Homo Sapiens
TSTVTFSCD

SEQ ID NO: 906768 - protein, 9 aa, Homo Sapiens
LVTPLSLVH

SEQ ID NO: 906769 - protein, 9 aa, Homo Sapiens
KPHVGIVRY

SEQ ID NO: 906770 - protein, 9 aa, Homo Sapiens
PRVITSGIL

SEQ ID NO: 906771 - protein, 9 aa, Homo Sapiens
GTFNAIPKL

SEQ ID NO: 906772 - protein, 9 aa, Homo Sapiens
PVGKVKEAV

SEQ ID NO: 906773 - protein, 9 aa, Homo Sapiens
NLLSLRWCL

SEQ ID NO: 906774 - protein, 9 aa, Homo Sapiens
FLCDLYLLL

SEQ ID NO: 906775 - protein, 9 aa, Homo Sapiens
CLLLATMAY

SEQ ID NO: 906776 - protein, 9 aa, Homo Sapiens
SLSIPCVAP

SEQ ID NO: 906777 - protein, 9 aa, Homo Sapiens
CVKRGWVWN

SEQ ID NO: 906778 - protein, 9 aa, Homo Sapiens
PDQNQMGST

SEQ ID NO: 906779 - protein, 9 aa, Homo Sapiens
ECLFFLKRT

SEQ ID NO: 906780 - protein, 9 aa, Homo Sapiens
PSQAYMLHS

SEQ ID NO: 906781 - protein, 9 aa, Homo Sapiens
CLFFLKRTE

SEQ ID NO: 906782 - protein, 9 aa, Homo Sapiens
VSAQRDLVE

SEQ ID NO: 906783 - protein, 9 aa, Homo Sapiens
ADMVINTSG

SEQ ID NO: 906784 - protein, 9 aa, Homo Sapiens
CSGHCSFIT

SEQ ID NO: 906785 - protein, 9 aa, Homo Sapiens
GFPDTLLPS

SEQ ID NO: 906786 - protein, 9 aa, Homo Sapiens
TPRSIYVEA

SEQ ID NO: 906787 - protein, 9 aa, Homo Sapiens
RLVTIVECG

SEQ ID NO: 906788 - protein, 9 aa, Homo Sapiens
YPTPNGHCT

SEQ ID NO: 906789 - protein, 9 aa, Homo Sapiens
INARTTSHI

SEQ ID NO: 906790 - protein, 9 aa, Homo Sapiens
RQRFLHGSP

SEQ ID NO: 906791 - protein, 9 aa, Homo Sapiens
LENLIFGSL

SEQ ID NO: 906792 - protein, 9 aa, Homo Sapiens
EKEKVWSHV

SEQ ID NO: 906793 - protein, 9 aa, Homo Sapiens
AAKKLSHAK

SEQ ID NO: 906794 - protein, 9 aa, Homo Sapiens
FPDTLLPSA

SEQ ID NO: 906795 - protein, 9 aa, Homo Sapiens
SQGMKTTYL

SEQ ID NO: 906796 - protein, 9 aa, Homo Sapiens
PSESAAPAV

SEQ ID NO: 906797 - protein, 9 aa, Homo Sapiens
HSFKNLFAV

SEQ ID NO: 906798 - protein, 9 aa, Homo Sapiens
GSGYNLLSL

SEQ ID NO: 906799 - protein, 9 aa, Homo Sapiens
DKDGKPRLS

SEQ ID NO: 906800 - protein, 9 aa, Homo Sapiens
IDIVQLSGR

SEQ ID NO: 906801 - protein, 9 aa, Homo Sapiens
TGSRKRGQL

SEQ ID NO: 906802 - protein, 9 aa, Homo Sapiens
VITSGILLS

SEQ ID NO: 906803 - protein, 9 aa, Homo Sapiens
VTAGQTVFH

SEQ ID NO: 906804 - protein, 9 aa, Homo Sapiens
QVSVTYLAN

SEQ ID NO: 906805 - protein, 9 aa, Homo Sapiens
NKLGADMVI

SEQ ID NO: 906806 - protein, 9 aa, Homo Sapiens
DLYLLLKLA

SEQ ID NO: 906807 - protein, 9 aa, Homo Sapiens
LEIVGMISL

SEQ ID NO: 906808 - protein, 9 aa, Homo Sapiens
LQDPLDRCY

SEQ ID NO: 906809 - protein, 9 aa, Homo Sapiens
GVVFVVALV

SEQ ID NO: 906810 - protein, 9 aa, Homo Sapiens
LLIQNKKLQ

SEQ ID NO: 906811 - protein, 9 aa, Homo Sapiens
GYNLLSLRW

SEQ ID NO: 906812 - protein, 9 aa, Homo Sapiens
RDLVEERGE

SEQ ID NO: 906813 - protein, 9 aa, Homo Sapiens
IQNKKLQDN

SEQ ID NO: 906814 - protein, 9 aa, Homo Sapiens
GIVRYEGHL

SEQ ID NO: 906815 - protein, 9 aa, Homo Sapiens
MEPDQNQMG

SEQ ID NO: 906816 - protein, 9 aa, Homo Sapiens
KIVNILEEE

SEQ ID NO: 906817 - protein, 9 aa, Homo Sapiens
AGCVKRGWV

SEQ ID NO: 906818 - protein, 9 aa, Homo Sapiens
SHTILATTT

SEQ ID NO: 906819 - protein, 9 aa, Homo Sapiens
NVGYFDIGL

SEQ ID NO: 906820 - protein, 9 aa, Homo Sapiens
HCTNGEAGR

SEQ ID NO: 906821 - protein, 9 aa, Homo Sapiens
YLLLKLACT

SEQ ID NO: 906822 - protein, 9 aa, Homo Sapiens
SLSDIPDRV

SEQ ID NO: 906823 - protein, 9 aa, Homo Sapiens
PRFSSAVRL

SEQ ID NO: 906824 - protein, 9 aa, Homo Sapiens
NAETSASGF

SEQ ID NO: 906825 - protein, 9 aa, Homo Sapiens
DIVQLSGRD

SEQ ID NO: 906826 - protein, 9 aa, Homo Sapiens
MLTFFLIFW

SEQ ID NO: 906827 - protein, 9 aa, Homo Sapiens
CFVAYSIHI

SEQ ID NO: 906828 - protein, 9 aa, Homo Sapiens
LIQNKKLQD

SEQ ID NO: 906829 - protein, 9 aa, Homo Sapiens
SAPSNPLDI

SEQ ID NO: 906830 - protein, 9 aa, Homo Sapiens
LSSLCVCNS

SEQ ID NO: 906831 - protein, 9 aa, Homo Sapiens
KNLFAVSSF

SEQ ID NO: 906832 - protein, 9 aa, Homo Sapiens
AVRLVTIVE

SEQ ID NO: 906833 - protein, 9 aa, Homo Sapiens
LGQYHQNGC

SEQ ID NO: 906834 - protein, 9 aa, Homo Sapiens
LQDNYCEIT

SEQ ID NO: 906835 - protein, 9 aa, Homo Sapiens
TNGEAGRSK

SEQ ID NO: 906836 - protein, 9 aa, Homo Sapiens
HIAKELEEQ

SEQ ID NO: 906837 - protein, 9 aa, Homo Sapiens
GTWKSPVGK

SEQ ID NO: 906838 - protein, 9 aa, Homo Sapiens
ILPGTFNAI

SEQ ID NO: 906839 - protein, 9 aa, Homo Sapiens
LAANARERC

SEQ ID NO: 906840 - protein, 9 aa, Homo Sapiens
KTTYLDPDT

SEQ ID NO: 906841 - protein, 9 aa, Homo Sapiens
VRLVTIVEC

SEQ ID NO: 906842 - protein, 9 aa, Homo Sapiens
LKPHVGIVR

SEQ ID NO: 906843 - protein, 9 aa, Homo Sapiens
GQYHQNGCI

SEQ ID NO: 906844 - protein, 9 aa, Homo Sapiens
NFHEDWEVI

SEQ ID NO: 906845 - protein, 9 aa, Homo Sapiens
VLQDPLDRC

SEQ ID NO: 906846 - protein, 9 aa, Homo Sapiens
LLIYGRDDY

SEQ ID NO: 906847 - protein, 9 aa, Homo Sapiens
LAAKKLSHA

SEQ ID NO: 906848 - protein, 9 aa, Homo Sapiens
RHGGDFGIT

SEQ ID NO: 906849 - protein, 9 aa, Homo Sapiens
HIYFNEEPT

SEQ ID NO: 906850 - protein, 9 aa, Homo Sapiens
QRTLAAKKL

SEQ ID NO: 906851 - protein, 9 aa, Homo Sapiens
KLLGASKRA

SEQ ID NO: 906852 - protein, 9 aa, Homo Sapiens
ASGFPDTLL

SEQ ID NO: 906853 - protein, 9 aa, Homo Sapiens
LLLKLACTN

SEQ ID NO: 906854 - protein, 9 aa, Homo Sapiens
LCVCNSHCV

SEQ ID NO: 906855 - protein, 9 aa, Homo Sapiens
SENMLDSMP

SEQ ID NO: 906856 - protein, 9 aa, Homo Sapiens
SECLLLATM

SEQ ID NO: 906857 - protein, 9 aa, Homo Sapiens
LVEERGEEY

SEQ ID NO: 906858 - protein, 9 aa, Homo Sapiens
LLLATMAYD

SEQ ID NO: 906859 - protein, 9 aa, Homo Sapiens
EKQCGYKLL

SEQ ID NO: 906860 - protein, 9 aa, Homo Sapiens
LSIPCVAPE

SEQ ID NO: 906861 - protein, 9 aa, Homo Sapiens
QDNYCEITG

SEQ ID NO: 906862 - protein, 9 aa, Homo Sapiens
LSAPSNPLD

SEQ ID NO: 906863 - protein, 9 aa, Homo Sapiens
KENCSENML

SEQ ID NO: 906864 - protein, 9 aa, Homo Sapiens
PGQPDRYFL

SEQ ID NO: 906865 - protein, 9 aa, Homo Sapiens
QNKKLQDNY

SEQ ID NO: 906866 - protein, 9 aa, Homo Sapiens
IKIVNILEE

SEQ ID NO: 906867 - protein, 9 aa, Homo Sapiens
ARERCRMHG

SEQ ID NO: 906868 - protein, 9 aa, Homo Sapiens
VVTSEIADL

SEQ ID NO: 906869 - protein, 9 aa, Homo Sapiens
AIPKLRILI

SEQ ID NO: 906870 - protein, 9 aa, Homo Sapiens
GFRIAPDQW

SEQ ID NO: 906871 - protein, 9 aa, Homo Sapiens
TSASGFPDT

SEQ ID NO: 906872 - protein, 9 aa, Homo Sapiens
SAQRDLVEE

SEQ ID NO: 906873 - protein, 9 aa, Homo Sapiens
HCSFITHLD

SEQ ID NO: 906874 - protein, 9 aa, Homo Sapiens
QPDRYFLSG

SEQ ID NO: 906875 - protein, 9 aa, Homo Sapiens
SGHCSFITH

SEQ ID NO: 906876 - protein, 9 aa, Homo Sapiens
GMPSQKLLG

SEQ ID NO: 906877 - protein, 9 aa, Homo Sapiens
RFSSAVRLV

SEQ ID NO: 906878 - protein, 9 aa, Homo Sapiens
RTITQNVLQ

SEQ ID NO: 906879 - protein, 9 aa, Homo Sapiens
AETSASGFP

SEQ ID NO: 906880 - protein, 9 aa, Homo Sapiens
DVLVAALVT

SEQ ID NO: 906881 - protein, 9 aa, Homo Sapiens
KVWSHVCSS

SEQ ID NO: 906882 - protein, 9 aa, Homo Sapiens
KPSQAYMLH

SEQ ID NO: 906883 - protein, 9 aa, Homo Sapiens
QDPLDRCYS

SEQ ID NO: 906884 - protein, 9 aa, Homo Sapiens
QRDLVEERG

SEQ ID NO: 906885 - protein, 9 aa, Homo Sapiens
TLAAKKLSH

SEQ ID NO: 906886 - protein, 9 aa, Homo Sapiens
STHTIAFPG

SEQ ID NO: 906887 - protein, 9 aa, Homo Sapiens
LLGASKRAK

SEQ ID NO: 906888 - protein, 9 aa, Homo Sapiens
RKDTGTYTC

SEQ ID NO: 906889 - protein, 9 aa, Homo Sapiens
LKRTEGRER

SEQ ID NO: 906890 - protein, 9 aa, Homo Sapiens
PQPSESAAP

SEQ ID NO: 906891 - protein, 9 aa, Homo Sapiens
SGFPDTLLP

SEQ ID NO: 906892 - protein, 9 aa, Homo Sapiens
ATTTAQQTL

SEQ ID NO: 906893 - protein, 9 aa, Homo Sapiens
SNPLDIVVT

SEQ ID NO: 906894 - protein, 9 aa, Homo Sapiens
VASRTVIGV

SEQ ID NO: 906895 - protein, 9 aa, Homo Sapiens
ALGAGCVKR

SEQ ID NO: 906896 - protein, 9 aa, Homo Sapiens
ESLPIDIVQ

SEQ ID NO: 906897 - protein, 9 aa, Homo Sapiens
MKTTYLDPD

SEQ ID NO: 906898 - protein, 9 aa, Homo Sapiens
AGSGYNLLS

SEQ ID NO: 906899 - protein, 9 aa, Homo Sapiens
TTYLDPDTD

SEQ ID NO: 906900 - protein, 9 aa, Homo Sapiens
KLGADMVIN

SEQ ID NO: 906901 - protein, 9 aa, Homo Sapiens
NVVTSEIAD

SEQ ID NO: 906902 - protein, 9 aa, Homo Sapiens
WASTIVASR

SEQ ID NO: 906903 - protein, 9 aa, Homo Sapiens
KDGKPRLSN

SEQ ID NO: 906904 - protein, 9 aa, Homo Sapiens
QCGYKLLIY

SEQ ID NO: 906905 - protein, 9 aa, Homo Sapiens
LSDYSHSDA

SEQ ID NO: 906906 - protein, 9 aa, Homo Sapiens
NAIPKLRIL

SEQ ID NO: 906907 - protein, 9 aa, Homo Sapiens
KCSGHCSFI

SEQ ID NO: 906908 - protein, 9 aa, Homo Sapiens
ASRTVIGVV

SEQ ID NO: 906909 - protein, 9 aa, Homo Sapiens
QRFLHGSPR

SEQ ID NO: 906910 - protein, 9 aa, Homo Sapiens
PHVGIVRYE

SEQ ID NO: 906911 - protein, 9 aa, Homo Sapiens
RPGSTHTIA

SEQ ID NO: 906912 - protein, 9 aa, Homo Sapiens
GPKIHIKIK

SEQ ID NO: 906913 - protein, 9 aa, Homo Sapiens
QYCSIKIVN

SEQ ID NO: 906914 - protein, 9 aa, Homo Sapiens
SIYVEASTV

SEQ ID NO: 906915 - protein, 9 aa, Homo Sapiens
VQSFRRTVE

SEQ ID NO: 906916 - protein, 9 aa, Homo Sapiens
TGSLSDYSH

SEQ ID NO: 906917 - protein, 9 aa, Homo Sapiens
GHCTNGEAG

SEQ ID NO: 906918 - protein, 9 aa, Homo Sapiens
VGYFDIGLM

SEQ ID NO: 906919 - protein, 9 aa, Homo Sapiens
SRPGSTHTI

SEQ ID NO: 906920 - protein, 9 aa, Homo Sapiens
ADLLVKPQK

SEQ ID NO: 906921 - protein, 9 aa, Homo Sapiens
VTYLANETQ

SEQ ID NO: 906922 - protein, 9 aa, Homo Sapiens
KDTGTYTCM

SEQ ID NO: 906923 - protein, 9 aa, Homo Sapiens
ELWDPKAVL

SEQ ID NO: 906924 - protein, 9 aa, Homo Sapiens
YQLSAPSNP

SEQ ID NO: 906925 - protein, 9 aa, Homo Sapiens
LFAVSSFLP

SEQ ID NO: 906926 - protein, 9 aa, Homo Sapiens
CSIKIVNIL

SEQ ID NO: 906927 - protein, 9 aa, Homo Sapiens
HTIAFPGST

SEQ ID NO: 906928 - protein, 9 aa, Homo Sapiens
RTEGRERAF

SEQ ID NO: 906929 - protein, 9 aa, Homo Sapiens
FFLIFWIIY

SEQ ID NO: 906930 - protein, 9 aa, Homo Sapiens
AAGVVFVVA

SEQ ID NO: 906931 - protein, 9 aa, Homo Sapiens
PGSTHTIAF

SEQ ID NO: 906932 - protein, 9 aa, Homo Sapiens
GSECLLLAT

SEQ ID NO: 906933 - protein, 9 aa, Homo Sapiens
VFHILPGGL

SEQ ID NO: 906934 - protein, 9 aa, Homo Sapiens
NLFAVSSFL

SEQ ID NO: 906935 - protein, 9 aa, Homo Sapiens
EIADLLVKP

SEQ ID NO: 906936 - protein, 9 aa, Homo Sapiens
AGFRIAPDQ

SEQ ID NO: 906937 - protein, 9 aa, Homo Sapiens
SESAAPAVL

SEQ ID NO: 906938 - protein, 9 aa, Homo Sapiens
IVQLSGRDF

SEQ ID NO: 906939 - protein, 9 aa, Homo Sapiens
KPRLSNLRQ

SEQ ID NO: 906940 - protein, 9 aa, Homo Sapiens
LTFFLIFWI

SEQ ID NO: 906941 - protein, 9 aa, Homo Sapiens
YNLLSLRWC

SEQ ID NO: 906942 - protein, 9 aa, Homo Sapiens
ARTTSHIAK

SEQ ID NO: 906943 - protein, 9 aa, Homo Sapiens
GASKRAKNF

SEQ ID NO: 906944 - protein, 9 aa, Homo Sapiens
KKLQDNYCE

SEQ ID NO: 906945 - protein, 9 aa, Homo Sapiens
YFDIGLMEV

SEQ ID NO: 906946 - protein, 9 aa, Homo Sapiens
LSGVTSAAT

SEQ ID NO: 906947 - protein, 9 aa, Homo Sapiens
LALGQYHQN

SEQ ID NO: 906948 - protein, 9 aa, Homo Sapiens
EPDQNQMGS

SEQ ID NO: 906949 - protein, 9 aa, Homo Sapiens
THTIAFPGS

SEQ ID NO: 906950 - protein, 9 aa, Homo Sapiens
VKRTITQNV

SEQ ID NO: 906951 - protein, 9 aa, Homo Sapiens
FLHGSPRLE

SEQ ID NO: 906952 - protein, 9 aa, Homo Sapiens
AAAVLENLI

SEQ ID NO: 906953 - protein, 9 aa, Homo Sapiens
QNVLQKLDV

SEQ ID NO: 906954 - protein, 9 aa, Homo Sapiens
AFYGPKIHI

SEQ ID NO: 906955 - protein, 9 aa, Homo Sapiens
LPIDIVQLS

SEQ ID NO: 906956 - protein, 9 aa, Homo Sapiens
LGADMVINT

SEQ ID NO: 906957 - protein, 9 aa, Homo Sapiens
LEKETVPFI

SEQ ID NO: 906958 - protein, 9 aa, Homo Sapiens
YGPKIHIKI

SEQ ID NO: 906959 - protein, 9 aa, Homo Sapiens
DINKPGPIF

SEQ ID NO: 906960 - protein, 9 aa, Homo Sapiens
MISLEKETV

SEQ ID NO: 906961 - protein, 9 aa, Homo Sapiens
TWKSPVGKV

SEQ ID NO: 906962 - protein, 9 aa, Homo Sapiens
IVGMISLEK

SEQ ID NO: 906963 - protein, 9 aa, Homo Sapiens
GYKLLIYGR

SEQ ID NO: 906964 - protein, 9 aa, Homo Sapiens
HEDWEVITV

SEQ ID NO: 906965 - protein, 9 aa, Homo Sapiens
TRSCGELWD

SEQ ID NO: 906966 - protein, 9 aa, Homo Sapiens
SEIADLLVK

SEQ ID NO: 906967 - protein, 9 aa, Homo Sapiens
TRLSGVTSA

SEQ ID NO: 906968 - protein, 9 aa, Homo Sapiens
ENCSENMLD

SEQ ID NO: 906969 - protein, 9 aa, Homo Sapiens
TSNVGYFDI

SEQ ID NO: 906970 - protein, 9 aa, Homo Sapiens
DFGITSTVT

SEQ ID NO: 906971 - protein, 9 aa, Homo Sapiens
ESAAPAVLG

SEQ ID NO: 906972 - protein, 9 aa, Homo Sapiens
DMVINTSGK

SEQ ID NO: 906973 - protein, 9 aa, Homo Sapiens
KPGPIFKPE

SEQ ID NO: 906974 - protein, 9 aa, Homo Sapiens
KLLIYGRDD

SEQ ID NO: 906975 - protein, 9 aa, Homo Sapiens
GGDFGITST

SEQ ID NO: 906976 - protein, 9 aa, Homo Sapiens
YQSLSDIPD

SEQ ID NO: 906977 - protein, 9 aa, Homo Sapiens
VTPLSLVHE

SEQ ID NO: 906978 - protein, 9 aa, Homo Sapiens
MDINKPGPI

SEQ ID NO: 906979 - protein, 9 aa, Homo Sapiens
HAVRQRFLH

SEQ ID NO: 906980 - protein, 9 aa, Homo Sapiens
FNAIPKLRI

SEQ ID NO: 906981 - protein, 9 aa, Homo Sapiens
VRYEGHLQI

SEQ ID NO: 906982 - protein, 9 aa, Homo Sapiens
FTPRSIYVE

SEQ ID NO: 906983 - protein, 9 aa, Homo Sapiens
PKIHIKIKD

SEQ ID NO: 906984 - protein, 9 aa, Homo Sapiens
NKKLQDNYC

SEQ ID NO: 906985 - protein, 9 aa, Homo Sapiens
KESLPIDIV

SEQ ID NO: 906986 - protein, 9 aa, Homo Sapiens
MDVYRYVSP

SEQ ID NO: 906987 - protein, 9 aa, Homo Sapiens
KRTITQNVL

SEQ ID NO: 906988 - protein, 9 aa, Homo Sapiens
SVTYLANET

SEQ ID NO: 906989 - protein, 9 aa, Homo Sapiens
CSENMLDSM

SEQ ID NO: 906990 - protein, 9 aa, Homo Sapiens
NCSENMLDS

SEQ ID NO: 906991 - protein, 9 aa, Homo Sapiens
LSDIPDRVQ

SEQ ID NO: 906992 - protein, 9 aa, Homo Sapiens
VEASTVDCN

SEQ ID NO: 906993 - protein, 9 aa, Homo Sapiens
EVITVLIGG

SEQ ID NO: 906994 - protein, 9 aa, Homo Sapiens
LFHTRSCGE

SEQ ID NO: 906995 - protein, 9 aa, Homo Sapiens
AGVVFVVAL

SEQ ID NO: 906996 - protein, 9 aa, Homo Sapiens
SGILLSQRE

SEQ ID NO: 906997 - protein, 9 aa, Homo Sapiens
PRLSNLRQG

SEQ ID NO: 906998 - protein, 9 aa, Homo Sapiens
ALVAISIVC

SEQ ID NO: 906999 - protein, 9 aa, Homo Sapiens
AYSIHIYFN

SEQ ID NO: 907000 - protein, 9 aa, Homo Sapiens
GMISLEKET

SEQ ID NO: 907001 - protein, 9 aa, Homo Sapiens
MQLSSLCVC

SEQ ID NO: 907002 - protein, 9 aa, Homo Sapiens
LIYGRDDYV

SEQ ID NO: 907003 - protein, 9 aa, Homo Sapiens
LATTTAQQT

SEQ ID NO: 907004 - protein, 9 aa, Homo Sapiens
RVITSGILL

SEQ ID NO: 907005 - protein, 9 aa, Homo Sapiens
KLFPGNDNS

SEQ ID NO: 907006 - protein, 9 aa, Homo Sapiens
WSHVCSSRG

SEQ ID NO: 907007 - protein, 9 aa, Homo Sapiens
GYQSLSDIP

SEQ ID NO: 907008 - protein, 9 aa, Homo Sapiens
TYLANETQP

SEQ ID NO: 907009 - protein, 9 aa, Homo Sapiens
GCVKRGWVW

SEQ ID NO: 907010 - protein, 9 aa, Homo Sapiens
TSHIAKELE

SEQ ID NO: 907011 - protein, 9 aa, Homo Sapiens
EAGFRIAPD

SEQ ID NO: 907012 - protein, 9 aa, Homo Sapiens
LILSHMDVY

SEQ ID NO: 907013 - protein, 9 aa, Homo Sapiens
SSCTRLSGV

SEQ ID NO: 907014 - protein, 9 aa, Homo Sapiens
VLVAALVTP

SEQ ID NO: 907015 - protein, 9 aa, Homo Sapiens
INKPGPIFK

SEQ ID NO: 907016 - protein, 9 aa, Homo Sapiens
TMAYDRYIA

SEQ ID NO: 907017 - protein, 9 aa, Homo Sapiens
ATPQPSESA

SEQ ID NO: 907018 - protein, 9 aa, Homo Sapiens
HILPGGLDL

SEQ ID NO: 907019 - protein, 9 aa, Homo Sapiens
AVNMEPDQN

SEQ ID NO: 907020 - protein, 9 aa, Homo Sapiens
ENLIFGSLV

SEQ ID NO: 907021 - protein, 9 aa, Homo Sapiens
GKPRLSNLR

SEQ ID NO: 907022 - protein, 9 aa, Homo Sapiens
MLDSMPDIR

SEQ ID NO: 907023 - protein, 9 aa, Homo Sapiens
CKAAAVLEN

SEQ ID NO: 907024 - protein, 9 aa, Homo Sapiens
DVYRYVSPE

SEQ ID NO: 907025 - protein, 9 aa, Homo Sapiens
VVALVAISI

SEQ ID NO: 907026 - protein, 9 aa, Homo Sapiens
DGALGAGCV

SEQ ID NO: 907027 - protein, 9 aa, Homo Sapiens
FSSAVRLVT

SEQ ID NO: 907028 - protein, 9 aa, Homo Sapiens
KKEAQRALK

SEQ ID NO: 907029 - protein, 9 aa, Homo Sapiens
IAFPGSTTM

SEQ ID NO: 907030 - protein, 9 aa, Homo Sapiens
QTVFHILPG

SEQ ID NO: 907031 - protein, 9 aa, Homo Sapiens
SIPCVAPEH

SEQ ID NO: 907032 - protein, 9 aa, Homo Sapiens
SLPIDIVQL

SEQ ID NO: 907033 - protein, 9 aa, Homo Sapiens
GSLSDYSHS

SEQ ID NO: 907034 - protein, 9 aa, Homo Sapiens
SGVTSAATR

SEQ ID NO: 907035 - protein, 9 aa, Homo Sapiens
QNQMGSTKV

SEQ ID NO: 907036 - protein, 9 aa, Homo Sapiens
KEKVWSHVC

SEQ ID NO: 907037 - protein, 9 aa, Homo Sapiens
LSNLRQGGI

SEQ ID NO: 907038 - protein, 9 aa, Homo Sapiens
VQLSGRDFC

SEQ ID NO: 907039 - protein, 9 aa, Homo Sapiens
MPSQKLLGA

SEQ ID NO: 907040 - protein, 9 aa, Homo Sapiens
PCVAPEHEG

SEQ ID NO: 907041 - protein, 9 aa, Homo Sapiens
TILATTTAQ

SEQ ID NO: 907042 - protein, 9 aa, Homo Sapiens
QSLSDIPDR

SEQ ID NO: 907043 - protein, 9 aa, Homo Sapiens
QGYQSLSDI

SEQ ID NO: 907044 - protein, 9 aa, Homo Sapiens
LRMQLSSLC

SEQ ID NO: 907045 - protein, 9 aa, Homo Sapiens
SQKLLGASK

SEQ ID NO: 907046 - protein, 9 aa, Homo Sapiens
PIFKPENGL

SEQ ID NO: 907047 - protein, 9 aa, Homo Sapiens
PGTFNAIPK

SEQ ID NO: 907048 - protein, 9 aa, Homo Sapiens
SGYNLLSLR

SEQ ID NO: 907049 - protein, 9 aa, Homo Sapiens
FVAYSIHIY

SEQ ID NO: 907050 - protein, 9 aa, Homo Sapiens
APRFSSAVR

SEQ ID NO: 907051 - protein, 9 aa, Homo Sapiens
QAGSGYNLL

SEQ ID NO: 907052 - protein, 9 aa, Homo Sapiens
RCRMHGLNH

SEQ ID NO: 907053 - protein, 9 aa, Homo Sapiens
FRIAPDQWS

SEQ ID NO: 907054 - protein, 9 aa, Homo Sapiens
YMLHSKHDE

SEQ ID NO: 907055 - protein, 9 aa, Homo Sapiens
LPRVITSGI

SEQ ID NO: 907056 - protein, 9 aa, Homo Sapiens
GILLSQREA

SEQ ID NO: 907057 - protein, 9 aa, Homo Sapiens
HMDVYRYVS

SEQ ID NO: 907058 - protein, 9 aa, Homo Sapiens
MEAGFRIAP

SEQ ID NO: 907059 - protein, 9 aa, Homo Sapiens
WNPGQPDRY

SEQ ID NO: 907060 - protein, 9 aa, Homo Sapiens
TFKSVTRKD

SEQ ID NO: 907061 - protein, 9 aa, Homo Sapiens
SAVRLVTIV

SEQ ID NO: 907062 - protein, 9 aa, Homo Sapiens
RLSNLRQGG

SEQ ID NO: 907063 - protein, 9 aa, Homo Sapiens
GHCSFITHL

SEQ ID NO: 907064 - protein, 9 aa, Homo Sapiens
LMLTFFLIF

SEQ ID NO: 907065 - protein, 9 aa, Homo Sapiens
LCKAAAVLE

SEQ ID NO: 907066 - protein, 9 aa, Homo Sapiens
GQPDRYFLS

SEQ ID NO: 907067 - protein, 9 aa, Homo Sapiens
KEPEVLQDP

SEQ ID NO: 907068 - protein, 9 aa, Homo Sapiens
TTSHIAKEL

SEQ ID NO: 907069 - protein, 9 aa, Homo Sapiens
YCSIKIVNI

SEQ ID NO: 907070 - protein, 9 aa, Homo Sapiens
TFNAIPKLR

SEQ ID NO: 907071 - protein, 9 aa, Homo Sapiens
YLANETQPG

SEQ ID NO: 907072 - protein, 9 aa, Homo Sapiens
DGKPRLSNL

SEQ ID NO: 907073 - protein, 9 aa, Homo Sapiens
DLVEERGEE

SEQ ID NO: 907074 - protein, 9 aa, Homo Sapiens
ECLLLATMA

SEQ ID NO: 907075 - protein, 9 aa, Homo Sapiens
HGSPRLEGH

SEQ ID NO: 907076 - protein, 9 aa, Homo Sapiens
NARERCRMH

SEQ ID NO: 907077 - protein, 9 aa, Homo Sapiens
AAVLENLIF

SEQ ID NO: 907078 - protein, 9 aa, Homo Sapiens
CDLYLLLKL

SEQ ID NO: 907079 - protein, 9 aa, Homo Sapiens
DNFLCDLYL

SEQ ID NO: 907080 - protein, 9 aa, Homo Sapiens
NILEEEVVT

SEQ ID NO: 907081 - protein, 9 aa, Homo Sapiens
KIHIKIKDA

SEQ ID NO: 907082 - protein, 9 aa, Homo Sapiens
LLLMLTFFL

SEQ ID NO: 907083 - protein, 9 aa, Homo Sapiens
GDFGITSTV

SEQ ID NO: 907084 - protein, 9 aa, Homo Sapiens
VGKVKEAVK

SEQ ID NO: 907085 - protein, 9 aa, Homo Sapiens
HQNGCISIW

SEQ ID NO: 907086 - protein, 9 aa, Homo Sapiens
RERCRMHGL

SEQ ID NO: 907087 - protein, 9 aa, Homo Sapiens
SQAYMLHSK

SEQ ID NO: 907088 - protein, 9 aa, Homo Sapiens
NDNSNKFSI

SEQ ID NO: 907089 - protein, 9 aa, Homo Sapiens
SHSDASSPT

SEQ ID NO: 907090 - protein, 9 aa, Homo Sapiens
GTGSRKRGQ

SEQ ID NO: 907091 - protein, 9 aa, Homo Sapiens
ANARERCRM

SEQ ID NO: 907092 - protein, 9 aa, Homo Sapiens
SHIAKELEE

SEQ ID NO: 907093 - protein, 9 aa, Homo Sapiens
IAMEAGFRI

SEQ ID NO: 907094 - protein, 9 aa, Homo Sapiens
NQMGSTKVF

SEQ ID NO: 907095 - protein, 9 aa, Homo Sapiens
ALVTPLSLV

SEQ ID NO: 907096 - protein, 9 aa, Homo Sapiens
AKKLSHAKG

SEQ ID NO: 907097 - protein, 9 aa, Homo Sapiens
DYSHSDASS

SEQ ID NO: 907098 - protein, 9 aa, Homo Sapiens
SHVCSSRGK

SEQ ID NO: 907099 - protein, 9 aa, Homo Sapiens
NQVSVTYLA

SEQ ID NO: 907100 - protein, 9 aa, Homo Sapiens
GSRKRGQLY

SEQ ID NO: 907101 - protein, 9 aa, Homo Sapiens
GGQVLKKEA

SEQ ID NO: 907102 - protein, 9 aa, Homo Sapiens
DLLVKPQKE

SEQ ID NO: 907103 - protein, 9 aa, Homo Sapiens
RKPSQAYML

SEQ ID NO: 907104 - protein, 9 aa, Homo Sapiens
TTTAQQTLS

SEQ ID NO: 907105 - protein, 9 aa, Homo Sapiens
EPEVLQDPL

SEQ ID NO: 907106 - protein, 9 aa, Homo Sapiens
SSLCVCNSH

SEQ ID NO: 907107 - protein, 9 aa, Homo Sapiens
LGAGCVKRG

SEQ ID NO: 907108 - protein, 9 aa, Homo Sapiens
TFFLIFWII

SEQ ID NO: 907109 - protein, 9 aa, Homo Sapiens
KRGQLYKHG

SEQ ID NO: 907110 - protein, 9 aa, Homo Sapiens
CSFITHLDW

SEQ ID NO: 907111 - protein, 9 aa, Homo Sapiens
NMEPDQNQM

SEQ ID NO: 907112 - protein, 9 aa, Homo Sapiens
AVLENLIFG

SEQ ID NO: 907113 - protein, 9 aa, Homo Sapiens
ITFKSVTRK

SEQ ID NO: 907114 - protein, 9 aa, Homo Sapiens
FKSVTRKDT

SEQ ID NO: 907115 - protein, 9 aa, Homo Sapiens
TLSLSIPCV

SEQ ID NO: 907116 - protein, 9 aa, Homo Sapiens
LGASKRAKN

SEQ ID NO: 907117 - protein, 9 aa, Homo Sapiens
LRTSNVGYF

SEQ ID NO: 907118 - protein, 9 aa, Homo Sapiens
AMEAGFRIA

SEQ ID NO: 907119 - protein, 9 aa, Homo Sapiens
ALGQYHQNG

SEQ ID NO: 907120 - protein, 9 aa, Homo Sapiens
PPGTGSRKR

SEQ ID NO: 907121 - protein, 9 aa, Homo Sapiens
ALRMQLSSL

SEQ ID NO: 907122 - protein, 9 aa, Homo Sapiens
RVGKCSGHC

SEQ ID NO: 907123 - protein, 9 aa, Homo Sapiens
LFPGNDNSN

SEQ ID NO: 907124 - protein, 9 aa, Homo Sapiens
GMKTTYLDP

SEQ ID NO: 907125 - protein, 9 aa, Homo Sapiens
VTRKDTGTY

SEQ ID NO: 907126 - protein, 9 aa, Homo Sapiens
IVASRTVIG

SEQ ID NO: 907127 - protein, 9 aa, Homo Sapiens
SFKNLFAVS

SEQ ID NO: 907128 - protein, 9 aa, Homo Sapiens
YSHSDASSP

SEQ ID NO: 907129 - protein, 9 aa, Homo Sapiens
FHTRSCGEL

SEQ ID NO: 907130 - protein, 9 aa, Homo Sapiens
VNFHEDWEV

SEQ ID NO: 907131 - protein, 9 aa, Homo Sapiens
TSGILLSQR

SEQ ID NO: 907132 - protein, 9 aa, Homo Sapiens
IPCVAPEHE

SEQ ID NO: 907133 - protein, 9 aa, Homo Sapiens
IDKDGKPRL

SEQ ID NO: 907134 - protein, 9 aa, Homo Sapiens
GVTSAATRT

SEQ ID NO: 907135 - protein, 9 aa, Homo Sapiens
SVTRKDTGT

SEQ ID NO: 907136 - protein, 9 aa, Homo Sapiens
TITQNVLQK

SEQ ID NO: 907137 - protein, 9 aa, Homo Sapiens
VQQGYQSLS

SEQ ID NO: 907138 - protein, 9 aa, Homo Sapiens
VKRMYDMIV

SEQ ID NO: 907139 - protein, 9 aa, Homo Sapiens
SCCTPQCCQ

SEQ ID NO: 907140 - protein, 9 aa, Homo Sapiens
AQTIAQLIV

SEQ ID NO: 907141 - protein, 9 aa, Homo Sapiens
FLTVNLAFG

SEQ ID NO: 907142 - protein, 9 aa, Homo Sapiens
RIIALINDQ

SEQ ID NO: 907143 - protein, 9 aa, Homo Sapiens
LSRGKEGAS

SEQ ID NO: 907144 - protein, 9 aa, Homo Sapiens
PSATPRGGH

SEQ ID NO: 907145 - protein, 9 aa, Homo Sapiens
ARRSRSRTR

SEQ ID NO: 907146 - protein, 9 aa, Homo Sapiens
FHSSLGDKD

SEQ ID NO: 907147 - protein, 9 aa, Homo Sapiens
FPRSQLFMQ

SEQ ID NO: 907148 - protein, 9 aa, Homo Sapiens
FPRSQLFMS

SEQ ID NO: 907149 - protein, 9 aa, Homo Sapiens
IFVIMSPEV

SEQ ID NO: 907150 - protein, 9 aa, Homo Sapiens
AECRNTDIE

SEQ ID NO: 907151 - protein, 9 aa, Homo Sapiens
LQKVLAKNR

SEQ ID NO: 907152 - protein, 9 aa, Homo Sapiens
PVMAKVLQP

SEQ ID NO: 907153 - protein, 9 aa, Homo Sapiens
TPRGGHRPW

SEQ ID NO: 907154 - protein, 9 aa, Homo Sapiens
SARRSRSRT

SEQ ID NO: 907155 - protein, 9 aa, Homo Sapiens
LPGNRAKAL

SEQ ID NO: 907156 - protein, 9 aa, Homo Sapiens
LGGPGCPQE

SEQ ID NO: 907157 - protein, 9 aa, Homo Sapiens
PDVSVSWDG

SEQ ID NO: 907158 - protein, 9 aa, Homo Sapiens
APNVLHILD

SEQ ID NO: 907159 - protein, 9 aa, Homo Sapiens
SPHSCPPPL

SEQ ID NO: 907160 - protein, 9 aa, Homo Sapiens
RKNEDIEDV

SEQ ID NO: 907161 - protein, 9 aa, Homo Sapiens
LLKESAERF

SEQ ID NO: 907162 - protein, 9 aa, Homo Sapiens
CPCPPVNTI

SEQ ID NO: 907163 - protein, 9 aa, Homo Sapiens
PSFFFFSRP

SEQ ID NO: 907164 - protein, 9 aa, Homo Sapiens
DSKLTSEEE

SEQ ID NO: 907165 - protein, 9 aa, Homo Sapiens
CPPPLPAKA

SEQ ID NO: 907166 - protein, 9 aa, Homo Sapiens
HTCRGHIPG

SEQ ID NO: 907167 - protein, 9 aa, Homo Sapiens
RRSRSRTRS

SEQ ID NO: 907168 - protein, 9 aa, Homo Sapiens
EIHKLILRR

SEQ ID NO: 907169 - protein, 9 aa, Homo Sapiens
GEKKSSPSG

SEQ ID NO: 907170 - protein, 9 aa, Homo Sapiens
KQMPDVSVS

SEQ ID NO: 907171 - protein, 9 aa, Homo Sapiens
IRESSPPHS

SEQ ID NO: 907172 - protein, 9 aa, Homo Sapiens
LQVFEFRVG

SEQ ID NO: 907173 - protein, 9 aa, Homo Sapiens
VGAAAYSAR

SEQ ID NO: 907174 - protein, 9 aa, Homo Sapiens
MPDVSVSWD

SEQ ID NO: 907175 - protein, 9 aa, Homo Sapiens
PTKRRPPHP

SEQ ID NO: 907176 - protein, 9 aa, Homo Sapiens
CPPVNTISK

SEQ ID NO: 907177 - protein, 9 aa, Homo Sapiens
RMYDMIVLR

SEQ ID NO: 907178 - protein, 9 aa, Homo Sapiens
ASPSPARQV

SEQ ID NO: 907179 - protein, 9 aa, Homo Sapiens
AASPHSCPP

SEQ ID NO: 907180 - protein, 9 aa, Homo Sapiens
EAECRNTDI

SEQ ID NO: 907181 - protein, 9 aa, Homo Sapiens
KGLGGPGCP

SEQ ID NO: 907182 - protein, 9 aa, Homo Sapiens
TIFNYHKTR

SEQ ID NO: 907183 - protein, 9 aa, Homo Sapiens
SKYYTPVSC

SEQ ID NO: 907184 - protein, 9 aa, Homo Sapiens
KETIVSQLS

SEQ ID NO: 907185 - protein, 9 aa, Homo Sapiens
SECTGTPSN

SEQ ID NO: 907186 - protein, 9 aa, Homo Sapiens
ILTNYVFMT

SEQ ID NO: 907187 - protein, 9 aa, Homo Sapiens
PPGSAQPVM

SEQ ID NO: 907188 - protein, 9 aa, Homo Sapiens
IAQLIVPKP

SEQ ID NO: 907189 - protein, 9 aa, Homo Sapiens
LYKFVVSKP

SEQ ID NO: 907190 - protein, 9 aa, Homo Sapiens
LMEKLLFMK

SEQ ID NO: 907191 - protein, 9 aa, Homo Sapiens
LLPDAPNVL

SEQ ID NO: 907192 - protein, 9 aa, Homo Sapiens
TPKSTIFNY

SEQ ID NO: 907193 - protein, 9 aa, Homo Sapiens
SCCVSSCCT

SEQ ID NO: 907194 - protein, 9 aa, Homo Sapiens
CERSSSSEC

SEQ ID NO: 907195 - protein, 9 aa, Homo Sapiens
YNQPKRNMI

SEQ ID NO: 907196 - protein, 9 aa, Homo Sapiens
VENSFPRSQ

SEQ ID NO: 907197 - protein, 9 aa, Homo Sapiens
LTICCCCCW

SEQ ID NO: 907198 - protein, 9 aa, Homo Sapiens
IKLSSERKN

SEQ ID NO: 907199 - protein, 9 aa, Homo Sapiens
TVNLAFGFA

SEQ ID NO: 907200 - protein, 9 aa, Homo Sapiens
YSARSPGGS

SEQ ID NO: 907201 - protein, 9 aa, Homo Sapiens
LITPKSTIF

SEQ ID NO: 907202 - protein, 9 aa, Homo Sapiens
AAPPDKPKE

SEQ ID NO: 907203 - protein, 9 aa, Homo Sapiens
DLKSIKQYK

SEQ ID NO: 907204 - protein, 9 aa, Homo Sapiens
ALQVFEFRV

SEQ ID NO: 907205 - protein, 9 aa, Homo Sapiens
EQYRFGPNK

SEQ ID NO: 907206 - protein, 9 aa, Homo Sapiens
YHKTRITLR

SEQ ID NO: 907207 - protein, 9 aa, Homo Sapiens
VSCESATAK

SEQ ID NO: 907208 - protein, 9 aa, Homo Sapiens
NALVGAILS

SEQ ID NO: 907209 - protein, 9 aa, Homo Sapiens
SERKNEDIE

SEQ ID NO: 907210 - protein, 9 aa, Homo Sapiens
EQDSKLTSE

SEQ ID NO: 907211 - protein, 9 aa, Homo Sapiens
LAKNRDPVS

SEQ ID NO: 907212 - protein, 9 aa, Homo Sapiens
GKGLGGPGC

SEQ ID NO: 907213 - protein, 9 aa, Homo Sapiens
KQYKEGMGW

SEQ ID NO: 907214 - protein, 9 aa, Homo Sapiens
KTQDHLRQQ

SEQ ID NO: 907215 - protein, 9 aa, Homo Sapiens
NRMVENSFP

SEQ ID NO: 907216 - protein, 9 aa, Homo Sapiens
SDDDMTRNI

SEQ ID NO: 907217 - protein, 9 aa, Homo Sapiens
VVSKPRSEC

SEQ ID NO: 907218 - protein, 9 aa, Homo Sapiens
DAPNVLHIL

SEQ ID NO: 907219 - protein, 9 aa, Homo Sapiens
EAEIKALME

SEQ ID NO: 907220 - protein, 9 aa, Homo Sapiens
PPSGTPPSP

SEQ ID NO: 907221 - protein, 9 aa, Homo Sapiens
WPSLRVWGS

SEQ ID NO: 907222 - protein, 9 aa, Homo Sapiens
DMTRNIRES

SEQ ID NO: 907223 - protein, 9 aa, Homo Sapiens
SRNSRSARR

SEQ ID NO: 907224 - protein, 9 aa, Homo Sapiens
ASPHSCPPP

SEQ ID NO: 907225 - protein, 9 aa, Homo Sapiens
PQKEWYRLM

SEQ ID NO: 907226 - protein, 9 aa, Homo Sapiens
PDAPNVLHI

SEQ ID NO: 907227 - protein, 9 aa, Homo Sapiens
GSLLSRGKE

SEQ ID NO: 907228 - protein, 9 aa, Homo Sapiens
DYEALQVFE

SEQ ID NO: 907229 - protein, 9 aa, Homo Sapiens
LVGAILSIM

SEQ ID NO: 907230 - protein, 9 aa, Homo Sapiens
LMEEESAPI

SEQ ID NO: 907231 - protein, 9 aa, Homo Sapiens
HKTRITLRI

SEQ ID NO: 907232 - protein, 9 aa, Homo Sapiens
PKTQDHLRQ

SEQ ID NO: 907233 - protein, 9 aa, Homo Sapiens
LHAAPPDKP

SEQ ID NO: 907234 - protein, 9 aa, Homo Sapiens
HWPSLRVWG

SEQ ID NO: 907235 - protein, 9 aa, Homo Sapiens
SRAYLLLNT

SEQ ID NO: 907236 - protein, 9 aa, Homo Sapiens
FCPCPPVNT

SEQ ID NO: 907237 - protein, 9 aa, Homo Sapiens
PEQDSKLTS

SEQ ID NO: 907238 - protein, 9 aa, Homo Sapiens
SSSSECTGT

SEQ ID NO: 907239 - protein, 9 aa, Homo Sapiens
FVVSKPRSE

SEQ ID NO: 907240 - protein, 9 aa, Homo Sapiens
PNVLHILDG

SEQ ID NO: 907241 - protein, 9 aa, Homo Sapiens
QRNCLIDKT

SEQ ID NO: 907242 - protein, 9 aa, Homo Sapiens
MEKLLFMKK

SEQ ID NO: 907243 - protein, 9 aa, Homo Sapiens
NRAKALDIM

SEQ ID NO: 907244 - protein, 9 aa, Homo Sapiens
QKPSFFFFS

SEQ ID NO: 907245 - protein, 9 aa, Homo Sapiens
PPVNTISKE

SEQ ID NO: 907246 - protein, 9 aa, Homo Sapiens
YEALQVFEF

SEQ ID NO: 907247 - protein, 9 aa, Homo Sapiens
ERKNEDIED

SEQ ID NO: 907248 - protein, 9 aa, Homo Sapiens
KDYCKEFFH

SEQ ID NO: 907249 - protein, 9 aa, Homo Sapiens
TAFMQPDHV

SEQ ID NO: 907250 - protein, 9 aa, Homo Sapiens
NYVFMTMSN

SEQ ID NO: 907251 - protein, 9 aa, Homo Sapiens
QLGALFLLK

SEQ ID NO: 907252 - protein, 9 aa, Homo Sapiens
VCSTGCGIF

SEQ ID NO: 907253 - protein, 9 aa, Homo Sapiens
PKRNMIQFT

SEQ ID NO: 907254 - protein, 9 aa, Homo Sapiens
KFVVSKPRS

SEQ ID NO: 907255 - protein, 9 aa, Homo Sapiens
CVLSLPHHR

SEQ ID NO: 907256 - protein, 9 aa, Homo Sapiens
YDEIHKLIL

SEQ ID NO: 907257 - protein, 9 aa, Homo Sapiens
RAGSLLSRG

SEQ ID NO: 907258 - protein, 9 aa, Homo Sapiens
HAAPPDKPK

SEQ ID NO: 907259 - protein, 9 aa, Homo Sapiens
VFEFRVGAT

SEQ ID NO: 907260 - protein, 9 aa, Homo Sapiens
SPWSVYEQG

SEQ ID NO: 907261 - protein, 9 aa, Homo Sapiens
GNRAKALDI

SEQ ID NO: 907262 - protein, 9 aa, Homo Sapiens
EAGNAQTIA

SEQ ID NO: 907263 - protein, 9 aa, Homo Sapiens
IDKTNRNRC

SEQ ID NO: 907264 - protein, 9 aa, Homo Sapiens
QVFEFRVGA

SEQ ID NO: 907265 - protein, 9 aa, Homo Sapiens
PAAASPHSC

SEQ ID NO: 907266 - protein, 9 aa, Homo Sapiens
LPDAPNVLH

SEQ ID NO: 907267 - protein, 9 aa, Homo Sapiens
KRRPPHPLH

SEQ ID NO: 907268 - protein, 9 aa, Homo Sapiens
KDWGCGYRN

SEQ ID NO: 907269 - protein, 9 aa, Homo Sapiens
GCGIFKPLP

SEQ ID NO: 907270 - protein, 9 aa, Homo Sapiens
LSIMNVLLV

SEQ ID NO: 907271 - protein, 9 aa, Homo Sapiens
KLEQYRFGP

SEQ ID NO: 907272 - protein, 9 aa, Homo Sapiens
KTRITLRIH

SEQ ID NO: 907273 - protein, 9 aa, Homo Sapiens
HQLHAAPPD

SEQ ID NO: 907274 - protein, 9 aa, Homo Sapiens
MYDMIVLRS

SEQ ID NO: 907275 - protein, 9 aa, Homo Sapiens
RVWGSPYSP

SEQ ID NO: 907276 - protein, 9 aa, Homo Sapiens
GIFKPLPSV

SEQ ID NO: 907277 - protein, 9 aa, Homo Sapiens
ATRIIALIN

SEQ ID NO: 907278 - protein, 9 aa, Homo Sapiens
KSIKQYKEG

SEQ ID NO: 907279 - protein, 9 aa, Homo Sapiens
PSKVELAII

SEQ ID NO: 907280 - protein, 9 aa, Homo Sapiens
TNYVFMTMS

SEQ ID NO: 907281 - protein, 9 aa, Homo Sapiens
TSQKVGEKK

SEQ ID NO: 907282 - protein, 9 aa, Homo Sapiens
FMQPDHVGI

SEQ ID NO: 907283 - protein, 9 aa, Homo Sapiens
PWSVYEQGV

SEQ ID NO: 907284 - protein, 9 aa, Homo Sapiens
CCTPQCCQP

SEQ ID NO: 907285 - protein, 9 aa, Homo Sapiens
DWGCGYRNF

SEQ ID NO: 907286 - protein, 9 aa, Homo Sapiens
HSCPPPLPA

SEQ ID NO: 907287 - protein, 9 aa, Homo Sapiens
EGLNVLVTV

SEQ ID NO: 907288 - protein, 9 aa, Homo Sapiens
NLPGNRAKA

SEQ ID NO: 907289 - protein, 9 aa, Homo Sapiens
SKPRSECSK

SEQ ID NO: 907290 - protein, 9 aa, Homo Sapiens
NSRSARRSR

SEQ ID NO: 907291 - protein, 9 aa, Homo Sapiens
VGAILSIMN

SEQ ID NO: 907292 - protein, 9 aa, Homo Sapiens
TIAQLIVPK

SEQ ID NO: 907293 - protein, 9 aa, Homo Sapiens
DVSVSWDGE

SEQ ID NO: 907294 - protein, 9 aa, Homo Sapiens
SPSPARQVP

SEQ ID NO: 907295 - protein, 9 aa, Homo Sapiens
LDYEALQVF

SEQ ID NO: 907296 - protein, 9 aa, Homo Sapiens
DGSVITGTL

SEQ ID NO: 907297 - protein, 9 aa, Homo Sapiens
VMAKVLQPR

SEQ ID NO: 907298 - protein, 9 aa, Homo Sapiens
IFVYDEIHK

SEQ ID NO: 907299 - protein, 9 aa, Homo Sapiens
DPPSGTPPS

SEQ ID NO: 907300 - protein, 9 aa, Homo Sapiens
GSLGKGLGG

SEQ ID NO: 907301 - protein, 9 aa, Homo Sapiens
LRIHQKNHP

SEQ ID NO: 907302 - protein, 9 aa, Homo Sapiens
CILTWSVLC

SEQ ID NO: 907303 - protein, 9 aa, Homo Sapiens
LCAHVECPP

SEQ ID NO: 907304 - protein, 9 aa, Homo Sapiens
AAAYSARSP

SEQ ID NO: 907305 - protein, 9 aa, Homo Sapiens
RNLPGNRAK

SEQ ID NO: 907306 - protein, 9 aa, Homo Sapiens
RSARRSRSR

SEQ ID NO: 907307 - protein, 9 aa, Homo Sapiens
YKFVVSKPR

SEQ ID NO: 907308 - protein, 9 aa, Homo Sapiens
EFFHTCRGH

SEQ ID NO: 907309 - protein, 9 aa, Homo Sapiens
PHHRLVCYC

SEQ ID NO: 907310 - protein, 9 aa, Homo Sapiens
QPKRNMIQF

SEQ ID NO: 907311 - protein, 9 aa, Homo Sapiens
DHLRQQRAS

SEQ ID NO: 907312 - protein, 9 aa, Homo Sapiens
IMSPEVPSF

SEQ ID NO: 907313 - protein, 9 aa, Homo Sapiens
SLDYEALQV

SEQ ID NO: 907314 - protein, 9 aa, Homo Sapiens
RFARLCILT

SEQ ID NO: 907315 - protein, 9 aa, Homo Sapiens
RRPPHPLHQ

SEQ ID NO: 907316 - protein, 9 aa, Homo Sapiens
SARSPGGSP

SEQ ID NO: 907317 - protein, 9 aa, Homo Sapiens
KSTIFNYHK

SEQ ID NO: 907318 - protein, 9 aa, Homo Sapiens
ALMEKLLFM

SEQ ID NO: 907319 - protein, 9 aa, Homo Sapiens
ACAKEQLES

SEQ ID NO: 907320 - protein, 9 aa, Homo Sapiens
QYRFGPNKM

SEQ ID NO: 907321 - protein, 9 aa, Homo Sapiens
YDMIVLRSG

SEQ ID NO: 907322 - protein, 9 aa, Homo Sapiens
LVTVSGKKD

SEQ ID NO: 907323 - protein, 9 aa, Homo Sapiens
LEEKETIVS

SEQ ID NO: 907324 - protein, 9 aa, Homo Sapiens
AAAAAASRP

SEQ ID NO: 907325 - protein, 9 aa, Homo Sapiens
AIKEMQKDS

SEQ ID NO: 907326 - protein, 9 aa, Homo Sapiens
IKEAECRNT

SEQ ID NO: 907327 - protein, 9 aa, Homo Sapiens
RNCLIDKTN

SEQ ID NO: 907328 - protein, 9 aa, Homo Sapiens
SLGDKDWGC

SEQ ID NO: 907329 - protein, 9 aa, Homo Sapiens
CVSSCCTPQ

SEQ ID NO: 907330 - protein, 9 aa, Homo Sapiens
KEMQKDSDV

SEQ ID NO: 907331 - protein, 9 aa, Homo Sapiens
YDSFDNTYL

SEQ ID NO: 907332 - protein, 9 aa, Homo Sapiens
DNRACAKEQ

SEQ ID NO: 907333 - protein, 9 aa, Homo Sapiens
PSLCAHVEC

SEQ ID NO: 907334 - protein, 9 aa, Homo Sapiens
ICCCCCWAP

SEQ ID NO: 907335 - protein, 9 aa, Homo Sapiens
IFKPLPSVF

SEQ ID NO: 907336 - protein, 9 aa, Homo Sapiens
SLPHHRLVC

SEQ ID NO: 907337 - protein, 9 aa, Homo Sapiens
SPEVPSFRQ

SEQ ID NO: 907338 - protein, 9 aa, Homo Sapiens
STEVSCGGH

SEQ ID NO: 907339 - protein, 9 aa, Homo Sapiens
FNYHKTRIT

SEQ ID NO: 907340 - protein, 9 aa, Homo Sapiens
PREPAPRLL

SEQ ID NO: 907341 - protein, 9 aa, Homo Sapiens
CTPQCCQPA

SEQ ID NO: 907342 - protein, 9 aa, Homo Sapiens
QKVGEKKSS

SEQ ID NO: 907343 - protein, 9 aa, Homo Sapiens
TKRRPPHPL

SEQ ID NO: 907344 - protein, 9 aa, Homo Sapiens
HATRIIALI

SEQ ID NO: 907345 - protein, 9 aa, Homo Sapiens
KEFFHTCRG

SEQ ID NO: 907346 - protein, 9 aa, Homo Sapiens
IFNYHKTRI

SEQ ID NO: 907347 - protein, 9 aa, Homo Sapiens
SNPEQDSKL

SEQ ID NO: 907348 - protein, 9 aa, Homo Sapiens
TQDHLRQQR

SEQ ID NO: 907349 - protein, 9 aa, Homo Sapiens
YRLMEEESA

SEQ ID NO: 907350 - protein, 9 aa, Homo Sapiens
PGNRAKALD

SEQ ID NO: 907351 - protein, 9 aa, Homo Sapiens
IDVCDCQYH

SEQ ID NO: 907352 - protein, 9 aa, Homo Sapiens
SKVELAIIM

SEQ ID NO: 907353 - protein, 9 aa, Homo Sapiens
QTIAQLIVP

SEQ ID NO: 907354 - protein, 9 aa, Homo Sapiens
PGSAQPVMA

SEQ ID NO: 907355 - protein, 9 aa, Homo Sapiens
TILTNYVFM

SEQ ID NO: 907356 - protein, 9 aa, Homo Sapiens
EEKETIVSQ

SEQ ID NO: 907357 - protein, 9 aa, Homo Sapiens
EKETIVSQL

SEQ ID NO: 907358 - protein, 9 aa, Homo Sapiens
LAQLGALFL

SEQ ID NO: 907359 - protein, 9 aa, Homo Sapiens
ITLRIHQKN

SEQ ID NO: 907360 - protein, 9 aa, Homo Sapiens
LTNYVFMTM

SEQ ID NO: 907361 - protein, 9 aa, Homo Sapiens
TLKQMPDVS

SEQ ID NO: 907362 - protein, 9 aa, Homo Sapiens
GGHICLPSS

SEQ ID NO: 907363 - protein, 9 aa, Homo Sapiens
QDHLRQQRA

SEQ ID NO: 907364 - protein, 9 aa, Homo Sapiens
IGKRKLEQY

SEQ ID NO: 907365 - protein, 9 aa, Homo Sapiens
ATPRGGHRP

SEQ ID NO: 907366 - protein, 9 aa, Homo Sapiens
EQQPGGVGG

SEQ ID NO: 907367 - protein, 9 aa, Homo Sapiens
SSERKNEDI

SEQ ID NO: 907368 - protein, 9 aa, Homo Sapiens
LIDVCDCQY

SEQ ID NO: 907369 - protein, 9 aa, Homo Sapiens
LATIGIDFL

SEQ ID NO: 907370 - protein, 9 aa, Homo Sapiens
SSECTGTPS

SEQ ID NO: 907371 - protein, 9 aa, Homo Sapiens
LGYMPSKVE

SEQ ID NO: 907372 - protein, 9 aa, Homo Sapiens
CTILTNYVF

SEQ ID NO: 907373 - protein, 9 aa, Homo Sapiens
MTRNIRESS

SEQ ID NO: 907374 - protein, 9 aa, Homo Sapiens
KEQLESLYR

SEQ ID NO: 907375 - protein, 9 aa, Homo Sapiens
RNSRSARRS

SEQ ID NO: 907376 - protein, 9 aa, Homo Sapiens
ILSIMNVLL

SEQ ID NO: 907377 - protein, 9 aa, Homo Sapiens
QPVMAKVLQ

SEQ ID NO: 907378 - protein, 9 aa, Homo Sapiens
QLHAAPPDK

SEQ ID NO: 907379 - protein, 9 aa, Homo Sapiens
TISKELPFL

SEQ ID NO: 907380 - protein, 9 aa, Homo Sapiens
TYLATIGID

SEQ ID NO: 907381 - protein, 9 aa, Homo Sapiens
LLSRGKEGA

SEQ ID NO: 907382 - protein, 9 aa, Homo Sapiens
RNIRESSPP

SEQ ID NO: 907383 - protein, 9 aa, Homo Sapiens
DEIHKLILR

SEQ ID NO: 907384 - protein, 9 aa, Homo Sapiens
KEAECRNTD

SEQ ID NO: 907385 - protein, 9 aa, Homo Sapiens
KVGEKKSSP

SEQ ID NO: 907386 - protein, 9 aa, Homo Sapiens
RITLRIHQK

SEQ ID NO: 907387 - protein, 9 aa, Homo Sapiens
VNTISKELP

SEQ ID NO: 907388 - protein, 9 aa, Homo Sapiens
DNIKSSQPS

SEQ ID NO: 907389 - protein, 9 aa, Homo Sapiens
SVSWDGEGP

SEQ ID NO: 907390 - protein, 9 aa, Homo Sapiens
GSVITGTLS

SEQ ID NO: 907391 - protein, 9 aa, Homo Sapiens
QKVLAKNRD

SEQ ID NO: 907392 - protein, 9 aa, Homo Sapiens
SQKVGEKKS

SEQ ID NO: 907393 - protein, 9 aa, Homo Sapiens
CLIDKTNRN

SEQ ID NO: 907394 - protein, 9 aa, Homo Sapiens
DLIDVCDCQ

SEQ ID NO: 907395 - protein, 9 aa, Homo Sapiens
HPLHQVHRV

SEQ ID NO: 907396 - protein, 9 aa, Homo Sapiens
SLGYMPSKV

SEQ ID NO: 907397 - protein, 9 aa, Homo Sapiens
HHRLVCYCR

SEQ ID NO: 907398 - protein, 9 aa, Homo Sapiens
LKSIKQYKE

SEQ ID NO: 907399 - protein, 9 aa, Homo Sapiens
DDMTRNIRE

SEQ ID NO: 907400 - protein, 9 aa, Homo Sapiens
PVNTISKEL

SEQ ID NO: 907401 - protein, 9 aa, Homo Sapiens
EWYRLMEEE

SEQ ID NO: 907402 - protein, 9 aa, Homo Sapiens
LLNTSVIIK

SEQ ID NO: 907403 - protein, 9 aa, Homo Sapiens
RNMIQFTHT

SEQ ID NO: 907404 - protein, 9 aa, Homo Sapiens
SCPPPLPAK

SEQ ID NO: 907405 - protein, 9 aa, Homo Sapiens
GLNVLVTVS

SEQ ID NO: 907406 - protein, 9 aa, Homo Sapiens
MCTILTNYV

SEQ ID NO: 907407 - protein, 9 aa, Homo Sapiens
PSLRVWGSP

SEQ ID NO: 907408 - protein, 9 aa, Homo Sapiens
LEAEIKALM

SEQ ID NO: 907409 - protein, 9 aa, Homo Sapiens
VPSFRQNCR

SEQ ID NO: 907410 - protein, 9 aa, Homo Sapiens
VGEKKSSPS

SEQ ID NO: 907411 - protein, 9 aa, Homo Sapiens
VNLAFGFAV

SEQ ID NO: 907412 - protein, 9 aa, Homo Sapiens
PSGTPPSPV

SEQ ID NO: 907413 - protein, 9 aa, Homo Sapiens
MSPEVPSFR

SEQ ID NO: 907414 - protein, 9 aa, Homo Sapiens
PGGVGGGQN

SEQ ID NO: 907415 - protein, 9 aa, Homo Sapiens
DNTYLATIG

SEQ ID NO: 907416 - protein, 9 aa, Homo Sapiens
HGGFLTVNL

SEQ ID NO: 907417 - protein, 9 aa, Homo Sapiens
MIQFTHTQI

SEQ ID NO: 907418 - protein, 9 aa, Homo Sapiens
QRCKDLIDV

SEQ ID NO: 907419 - protein, 9 aa, Homo Sapiens
EIKALMEKL

SEQ ID NO: 907420 - protein, 9 aa, Homo Sapiens
FHTCRGHIP

SEQ ID NO: 907421 - protein, 9 aa, Homo Sapiens
ALVGAILSI

SEQ ID NO: 907422 - protein, 9 aa, Homo Sapiens
ALLTESTTI

SEQ ID NO: 907423 - protein, 9 aa, Homo Sapiens
QPDHVGIFR

SEQ ID NO: 907424 - protein, 9 aa, Homo Sapiens
MQPDHVGIF

SEQ ID NO: 907425 - protein, 9 aa, Homo Sapiens
GDKDWGCGY

SEQ ID NO: 907426 - protein, 9 aa, Homo Sapiens
HKLILRRNP

SEQ ID NO: 907427 - protein, 9 aa, Homo Sapiens
EQGVGPGRQ

SEQ ID NO: 907428 - protein, 9 aa, Homo Sapiens
LRQQRASAR

SEQ ID NO: 907429 - protein, 9 aa, Homo Sapiens
QLEEKETIV

SEQ ID NO: 907430 - protein, 9 aa, Homo Sapiens
NEDIEDVTP

SEQ ID NO: 907431 - protein, 9 aa, Homo Sapiens
ARQVPATRR

SEQ ID NO: 907432 - protein, 9 aa, Homo Sapiens
LGKGLGGPG

SEQ ID NO: 907433 - protein, 9 aa, Homo Sapiens
LGDKDWGCG

SEQ ID NO: 907434 - protein, 9 aa, Homo Sapiens
PEEPREPAP

SEQ ID NO: 907435 - protein, 9 aa, Homo Sapiens
LVETHATRI

SEQ ID NO: 907436 - protein, 9 aa, Homo Sapiens
SLITPKSTI

SEQ ID NO: 907437 - protein, 9 aa, Homo Sapiens
RACAKEQLE

SEQ ID NO: 907438 - protein, 9 aa, Homo Sapiens
QKEWYRLME

SEQ ID NO: 907439 - protein, 9 aa, Homo Sapiens
VGGGQNGQQ

SEQ ID NO: 907440 - protein, 9 aa, Homo Sapiens
MGPPSATPR

SEQ ID NO: 907441 - protein, 9 aa, Homo Sapiens
NTYLATIGI

SEQ ID NO: 907442 - protein, 9 aa, Homo Sapiens
ETRFARLCI

SEQ ID NO: 907443 - protein, 9 aa, Homo Sapiens
SPKTQDHLR

SEQ ID NO: 907444 - protein, 9 aa, Homo Sapiens
SCSPWSVYE

SEQ ID NO: 907445 - protein, 9 aa, Homo Sapiens
VITGTLSPA

SEQ ID NO: 907446 - protein, 9 aa, Homo Sapiens
SPARQVPAT

SEQ ID NO: 907447 - protein, 9 aa, Homo Sapiens
SKLTSEEES

SEQ ID NO: 907448 - protein, 9 aa, Homo Sapiens
EEPREPAPR

SEQ ID NO: 907449 - protein, 9 aa, Homo Sapiens
NSFPRSQLF

SEQ ID NO: 907450 - protein, 9 aa, Homo Sapiens
WSVYEQGVG

SEQ ID NO: 907451 - protein, 9 aa, Homo Sapiens
YKEGMGWSY

SEQ ID NO: 907452 - protein, 9 aa, Homo Sapiens
KRNMIQFTH

SEQ ID NO: 907453 - protein, 9 aa, Homo Sapiens
DSDVKGGET

SEQ ID NO: 907454 - protein, 9 aa, Homo Sapiens
ASHQLHAAP

SEQ ID NO: 907455 - protein, 9 aa, Homo Sapiens
SSSECTGTP

SEQ ID NO: 907456 - protein, 9 aa, Homo Sapiens
AILSIMNVL

SEQ ID NO: 907457 - protein, 9 aa, Homo Sapiens
FARLCILTW

SEQ ID NO: 907458 - protein, 9 aa, Homo Sapiens
CTGTPSNPD

SEQ ID NO: 907459 - protein, 9 aa, Homo Sapiens
VIMSPEVPS

SEQ ID NO: 907460 - protein, 9 aa, Homo Sapiens
KRKLEQYRF

SEQ ID NO: 907461 - protein, 9 aa, Homo Sapiens
AQLGALFLL

SEQ ID NO: 907462 - protein, 9 aa, Homo Sapiens
YCKEFFHTC

SEQ ID NO: 907463 - protein, 9 aa, Homo Sapiens
LFLLKESAE

SEQ ID NO: 907464 - protein, 9 aa, Homo Sapiens
KNRDPVSHI

SEQ ID NO: 907465 - protein, 9 aa, Homo Sapiens
ALFLLKESA

SEQ ID NO: 907466 - protein, 9 aa, Homo Sapiens
GLGGPGCPQ

SEQ ID NO: 907467 - protein, 9 aa, Homo Sapiens
RQVPATRRS

SEQ ID NO: 907468 - protein, 9 aa, Homo Sapiens
PHPLHQVHR

SEQ ID NO: 907469 - protein, 9 aa, Homo Sapiens
SAQPVMAKV

SEQ ID NO: 907470 - protein, 9 aa, Homo Sapiens
RPTKRRPPH

SEQ ID NO: 907471 - protein, 9 aa, Homo Sapiens
DDDMTRNIR

SEQ ID NO: 907472 - protein, 9 aa, Homo Sapiens
RNTDIELEH

SEQ ID NO: 907473 - protein, 9 aa, Homo Sapiens
GSDGSVITG

SEQ ID NO: 907474 - protein, 9 aa, Homo Sapiens
LKQMPDVSV

SEQ ID NO: 907475 - protein, 9 aa, Homo Sapiens
TIVSQLSRS

SEQ ID NO: 907476 - protein, 9 aa, Homo Sapiens
SVITGTLSP

SEQ ID NO: 907477 - protein, 9 aa, Homo Sapiens
AEIKALMEK

SEQ ID NO: 907478 - protein, 9 aa, Homo Sapiens
HLQKVLAKN

SEQ ID NO: 907479 - protein, 9 aa, Homo Sapiens
THGGFLTVN

SEQ ID NO: 907480 - protein, 9 aa, Homo Sapiens
RSSSSECTG

SEQ ID NO: 907481 - protein, 9 aa, Homo Sapiens
GFLTVNLAF

SEQ ID NO: 907482 - protein, 9 aa, Homo Sapiens
THATRIIAL

SEQ ID NO: 907483 - protein, 9 aa, Homo Sapiens
WYRLMEEES

SEQ ID NO: 907484 - protein, 9 aa, Homo Sapiens
ERSSSSECT

SEQ ID NO: 907485 - protein, 9 aa, Homo Sapiens
GVGGGQNGQ

SEQ ID NO: 907486 - protein, 9 aa, Homo Sapiens
RCKDLIDVC

SEQ ID NO: 907487 - protein, 9 aa, Homo Sapiens
FFSRPSPKT

SEQ ID NO: 907488 - protein, 9 aa, Homo Sapiens
GPPSATPRG

SEQ ID NO: 907489 - protein, 9 aa, Homo Sapiens
LRVWGSPYS

SEQ ID NO: 907490 - protein, 9 aa, Homo Sapiens
TDIELEHHR

SEQ ID NO: 907491 - protein, 9 aa, Homo Sapiens
YMPSKVELA

SEQ ID NO: 907492 - protein, 9 aa, Homo Sapiens
DSFDNTYLA

SEQ ID NO: 907493 - protein, 9 aa, Homo Sapiens
AAAAASRPS

SEQ ID NO: 907494 - protein, 9 aa, Homo Sapiens
CSPWSVYEQ

SEQ ID NO: 907495 - protein, 9 aa, Homo Sapiens
TRIIALIND

SEQ ID NO: 907496 - protein, 9 aa, Homo Sapiens
KEWYRLMEE

SEQ ID NO: 907497 - protein, 9 aa, Homo Sapiens
AASPSPARQ

SEQ ID NO: 907498 - protein, 9 aa, Homo Sapiens
LNRRNLPGN

SEQ ID NO: 907499 - protein, 9 aa, Homo Sapiens
GSAQPVMAK

SEQ ID NO: 907500 - protein, 9 aa, Homo Sapiens
SHQLHAAPP

SEQ ID NO: 907501 - protein, 9 aa, Homo Sapiens
LCILTWSVL

SEQ ID NO: 907502 - protein, 9 aa, Homo Sapiens
QLESLYRKI

SEQ ID NO: 907503 - protein, 9 aa, Homo Sapiens
SRGKEGASG

SEQ ID NO: 907504 - protein, 9 aa, Homo Sapiens
GALFLLKES

SEQ ID NO: 907505 - protein, 9 aa, Homo Sapiens
CKEFFHTCR

SEQ ID NO: 907506 - protein, 9 aa, Homo Sapiens
TRFARLCIL

SEQ ID NO: 907507 - protein, 9 aa, Homo Sapiens
SIKQYKEGM

SEQ ID NO: 907508 - protein, 9 aa, Homo Sapiens
RLMEEESAP

SEQ ID NO: 907509 - protein, 9 aa, Homo Sapiens
ETHATRIIA

SEQ ID NO: 907510 - protein, 9 aa, Homo Sapiens
IGSRAYLLL

SEQ ID NO: 907511 - protein, 9 aa, Homo Sapiens
PARQVPATR

SEQ ID NO: 907512 - protein, 9 aa, Homo Sapiens
RRNLPGNRA

SEQ ID NO: 907513 - protein, 9 aa, Homo Sapiens
RKLEQYRFG

SEQ ID NO: 907514 - protein, 9 aa, Homo Sapiens
AQPVMAKVL

SEQ ID NO: 907515 - protein, 9 aa, Homo Sapiens
CCVSSCCTP

SEQ ID NO: 907516 - protein, 9 aa, Homo Sapiens
SGTPPSPVS

SEQ ID NO: 907517 - protein, 9 aa, Homo Sapiens
YRFGPNKMM

SEQ ID NO: 907518 - protein, 9 aa, Homo Sapiens
LSSERKNED

SEQ ID NO: 907519 - protein, 9 aa, Homo Sapiens
VTVSGKKDK

SEQ ID NO: 907520 - protein, 9 aa, Homo Sapiens
YVFMTMSNP

SEQ ID NO: 907521 - protein, 9 aa, Homo Sapiens
LAEQQPGGV

SEQ ID NO: 907522 - protein, 9 aa, Homo Sapiens
KDLIDVCDC

SEQ ID NO: 907523 - protein, 9 aa, Homo Sapiens
AGSLLSRGK

SEQ ID NO: 907524 - protein, 9 aa, Homo Sapiens
GTHGGFLTV

SEQ ID NO: 907525 - protein, 9 aa, Homo Sapiens
MPSKVELAI

SEQ ID NO: 907526 - protein, 9 aa, Homo Sapiens
EETRFARLC

SEQ ID NO: 907527 - protein, 9 aa, Homo Sapiens
PSPKTQDHL

SEQ ID NO: 907528 - protein, 9 aa, Homo Sapiens
RLCILTWSV

SEQ ID NO: 907529 - protein, 9 aa, Homo Sapiens
FVIMSPEVP

SEQ ID NO: 907530 - protein, 9 aa, Homo Sapiens
KRMYDMIVL

SEQ ID NO: 907531 - protein, 9 aa, Homo Sapiens
GNAQTIAQL

SEQ ID NO: 907532 - protein, 9 aa, Homo Sapiens
SCESATAKA

SEQ ID NO: 907533 - protein, 9 aa, Homo Sapiens
PGSLGKGLG

SEQ ID NO: 907534 - protein, 9 aa, Homo Sapiens
NQPKRNMIQ

SEQ ID NO: 907535 - protein, 9 aa, Homo Sapiens
NIRESSPPH

SEQ ID NO: 907536 - protein, 9 aa, Homo Sapiens
SLLSRGKEG

SEQ ID NO: 907537 - protein, 9 aa, Homo Sapiens
REPAPRLLQ

SEQ ID NO: 907538 - protein, 9 aa, Homo Sapiens
DKDWGCGYR

SEQ ID NO: 907539 - protein, 9 aa, Homo Sapiens
TICCCCCWA

SEQ ID NO: 907540 - protein, 9 aa, Homo Sapiens
RPSPKTQDH

SEQ ID NO: 907541 - protein, 9 aa, Homo Sapiens
LIDKTNRNR

SEQ ID NO: 907542 - protein, 9 aa, Homo Sapiens
PSQNQGLGR

SEQ ID NO: 907543 - protein, 9 aa, Homo Sapiens
LEQYRFGPN

SEQ ID NO: 907544 - protein, 9 aa, Homo Sapiens
AYLLLNTSV

SEQ ID NO: 907545 - protein, 9 aa, Homo Sapiens
EPREPAPRL

SEQ ID NO: 907546 - protein, 9 aa, Homo Sapiens
TDLKSIKQY

SEQ ID NO: 907547 - protein, 9 aa, Homo Sapiens
RPPHPLHQV

SEQ ID NO: 907548 - protein, 9 aa, Homo Sapiens
GAAAYSARS

SEQ ID NO: 907549 - protein, 9 aa, Homo Sapiens
MVENSFPRS

SEQ ID NO: 907550 - protein, 9 aa, Homo Sapiens
PHSCPPPLP

SEQ ID NO: 907551 - protein, 9 aa, Homo Sapiens
NVLVTVSGK

SEQ ID NO: 907552 - protein, 9 aa, Homo Sapiens
VSGKKDKLR

SEQ ID NO: 907553 - protein, 9 aa, Homo Sapiens
PCPPVNTIS

SEQ ID NO: 907554 - protein, 9 aa, Homo Sapiens
QPGGVGGGQ

SEQ ID NO: 907555 - protein, 9 aa, Homo Sapiens
IKQYKEGMG

SEQ ID NO: 907556 - protein, 9 aa, Homo Sapiens
NYHKTRITL

SEQ ID NO: 907557 - protein, 9 aa, Homo Sapiens
LTADYALLT

SEQ ID NO: 907558 - protein, 9 aa, Homo Sapiens
DPHWPSLRV

SEQ ID NO: 907559 - protein, 9 aa, Homo Sapiens
VNALVGAIL

SEQ ID NO: 907560 - protein, 9 aa, Homo Sapiens
FFFSRPSPK

SEQ ID NO: 907561 - protein, 9 aa, Homo Sapiens
GTLSPASSP

SEQ ID NO: 907562 - protein, 9 aa, Homo Sapiens
SLGKGLGGP

SEQ ID NO: 907563 - protein, 9 aa, Homo Sapiens
MEEESAPIG

SEQ ID NO: 907564 - protein, 9 aa, Homo Sapiens
VSSCCTPQC

SEQ ID NO: 907565 - protein, 9 aa, Homo Sapiens
KVLAKNRDP

SEQ ID NO: 907566 - protein, 9 aa, Homo Sapiens
AKEQLESLY

SEQ ID NO: 907567 - protein, 9 aa, Homo Sapiens
NPEQDSKLT

SEQ ID NO: 907568 - protein, 9 aa, Homo Sapiens
TADYALLTE

SEQ ID NO: 907569 - protein, 9 aa, Homo Sapiens
VLSLPHHRL

SEQ ID NO: 907570 - protein, 9 aa, Homo Sapiens
LTESTTIEY

SEQ ID NO: 907571 - protein, 9 aa, Homo Sapiens
PYNQPKRNM

SEQ ID NO: 907572 - protein, 9 aa, Homo Sapiens
AAAASRPSP

SEQ ID NO: 907573 - protein, 9 aa, Homo Sapiens
ECTGTPSNP

SEQ ID NO: 907574 - protein, 9 aa, Homo Sapiens
FLLKESAER

SEQ ID NO: 907575 - protein, 9 aa, Homo Sapiens
IHKLILRRN

SEQ ID NO: 907576 - protein, 9 aa, Homo Sapiens
VYEQGVGPG

SEQ ID NO: 907577 - protein, 9 aa, Homo Sapiens
TPVSCESAT

SEQ ID NO: 907578 - protein, 9 aa, Homo Sapiens
YEQGVGPGR

SEQ ID NO: 907579 - protein, 9 aa, Homo Sapiens
SVYEQGVGP

SEQ ID NO: 907580 - protein, 9 aa, Homo Sapiens
YLATIGIDF

SEQ ID NO: 907581 - protein, 9 aa, Homo Sapiens
AAASPHSCP

SEQ ID NO: 907582 - protein, 9 aa, Homo Sapiens
TPQCCQPAC

SEQ ID NO: 907583 - protein, 9 aa, Homo Sapiens
GGFLTVNLA

SEQ ID NO: 907584 - protein, 9 aa, Homo Sapiens
EQLESLYRK

SEQ ID NO: 907585 - protein, 9 aa, Homo Sapiens
FFHTCRGHI

SEQ ID NO: 907586 - protein, 9 aa, Homo Sapiens
ENSNPEQDS

SEQ ID NO: 907587 - protein, 9 aa, Homo Sapiens
GYMPSKVEL

SEQ ID NO: 907588 - protein, 9 aa, Homo Sapiens
TGPEEPREP

SEQ ID NO: 907589 - protein, 9 aa, Homo Sapiens
QPSQNQGLG

SEQ ID NO: 907590 - protein, 9 aa, Homo Sapiens
VLHILDGPE

SEQ ID NO: 907591 - protein, 9 aa, Homo Sapiens
DHVGIFRVF

SEQ ID NO: 907592 - protein, 9 aa, Homo Sapiens
VNRMVENSF

SEQ ID NO: 907593 - protein, 9 aa, Homo Sapiens
QVPATRRSP

SEQ ID NO: 907594 - protein, 9 aa, Homo Sapiens
KALMEKLLF

SEQ ID NO: 907595 - protein, 9 aa, Homo Sapiens
SFDNTYLAT

SEQ ID NO: 907596 - protein, 9 aa, Homo Sapiens
NAQTIAQLI

SEQ ID NO: 907597 - protein, 9 aa, Homo Sapiens
AKNRDPVSH

SEQ ID NO: 907598 - protein, 9 aa, Homo Sapiens
VDNIKSSQP

SEQ ID NO: 907599 - protein, 9 aa, Homo Sapiens
KTNRNRCQH

SEQ ID NO: 907600 - protein, 9 aa, Homo Sapiens
NSNPEQDSK

SEQ ID NO: 907601 - protein, 9 aa, Homo Sapiens
PPSATPRGG

SEQ ID NO: 907602 - protein, 9 aa, Homo Sapiens
HEPSLCAHV

SEQ ID NO: 907603 - protein, 9 aa, Homo Sapiens
VLRSGNWEL

SEQ ID NO: 907604 - protein, 9 aa, Homo Sapiens
SASHQLHAA

SEQ ID NO: 907605 - protein, 9 aa, Homo Sapiens
TRNIRESSP

SEQ ID NO: 907606 - protein, 9 aa, Homo Sapiens
LNVLVTVSG

SEQ ID NO: 907607 - protein, 9 aa, Homo Sapiens
FDNTYLATI

SEQ ID NO: 907608 - protein, 9 aa, Homo Sapiens
PPHPLHQVH

SEQ ID NO: 907609 - protein, 9 aa, Homo Sapiens
HPGSLGKGL

SEQ ID NO: 907610 - protein, 9 aa, Homo Sapiens
NVLHILDGP

SEQ ID NO: 907611 - protein, 9 aa, Homo Sapiens
YYTPVSCES

SEQ ID NO: 907612 - protein, 9 aa, Homo Sapiens
RSRNSRSAR

SEQ ID NO: 907613 - protein, 9 aa, Homo Sapiens
VSCGGHICL

SEQ ID NO: 907614 - protein, 9 aa, Homo Sapiens
IIALINDQR

SEQ ID NO: 907615 - protein, 9 aa, Homo Sapiens
STIFNYHKT

SEQ ID NO: 907616 - protein, 9 aa, Homo Sapiens
AYSARSPGG

SEQ ID NO: 907617 - protein, 9 aa, Homo Sapiens
HSSLGDKDW

SEQ ID NO: 907618 - protein, 9 aa, Homo Sapiens
PKSTIFNYH

SEQ ID NO: 907619 - protein, 9 aa, Homo Sapiens
SATPRGGHR

SEQ ID NO: 907620 - protein, 9 aa, Homo Sapiens
VGIFRVFCA

SEQ ID NO: 907621 - protein, 9 aa, Homo Sapiens
DYCKEFFHT

SEQ ID NO: 907622 - protein, 9 aa, Homo Sapiens
KPSFFFFSR

SEQ ID NO: 907623 - protein, 9 aa, Homo Sapiens
NRACAKEQL

SEQ ID NO: 907624 - protein, 9 aa, Homo Sapiens
ENSFPRSQL

SEQ ID NO: 907625 - protein, 9 aa, Homo Sapiens
HICLPSSCQ

SEQ ID NO: 907626 - protein, 9 aa, Homo Sapiens
VSKPRSECS

SEQ ID NO: 907627 - protein, 9 aa, Homo Sapiens
VLVTVSGKK

SEQ ID NO: 907628 - protein, 9 aa, Homo Sapiens
PVSCESATA

SEQ ID NO: 907629 - protein, 9 aa, Homo Sapiens
QTGPEEPRE

SEQ ID NO: 907630 - protein, 9 aa, Homo Sapiens
QMPDVSVSW

SEQ ID NO: 907631 - protein, 9 aa, Homo Sapiens
YTPVSCESA

SEQ ID NO: 907632 - protein, 9 aa, Homo Sapiens
CGIFKPLPS

SEQ ID NO: 907633 - protein, 9 aa, Homo Sapiens
DKTNRNRCQ

SEQ ID NO: 907634 - protein, 9 aa, Homo Sapiens
GAILSIMNV

SEQ ID NO: 907635 - protein, 9 aa, Homo Sapiens
SSQPSQNQG

SEQ ID NO: 907636 - protein, 9 aa, Homo Sapiens
QDSKLTSEE

SEQ ID NO: 907637 - protein, 9 aa, Homo Sapiens
EPSLCAHVE

SEQ ID NO: 907638 - protein, 9 aa, Homo Sapiens
LLLNTSVII

SEQ ID NO: 907639 - protein, 9 aa, Homo Sapiens
AEQQPGGVG

SEQ ID NO: 907640 - protein, 9 aa, Homo Sapiens
PPPGSAQPV

SEQ ID NO: 907641 - protein, 9 aa, Homo Sapiens
LPHHRLVCY

SEQ ID NO: 907642 - protein, 9 aa, Homo Sapiens
KLSSERKNE

SEQ ID NO: 907643 - protein, 9 aa, Homo Sapiens
SDGSVITGT

SEQ ID NO: 907644 - protein, 9 aa, Homo Sapiens
PEVPSFRQN

SEQ ID NO: 907645 - protein, 9 aa, Homo Sapiens
CGGHICLPS

SEQ ID NO: 907646 - protein, 9 aa, Homo Sapiens
KDSDVKGGE

SEQ ID NO: 907647 - protein, 9 aa, Homo Sapiens
MHEPSLCAH

SEQ ID NO: 907648 - protein, 9 aa, Homo Sapiens
VYDEIHKLI

SEQ ID NO: 907649 - protein, 9 aa, Homo Sapiens
HLRQQRASA

SEQ ID NO: 907650 - protein, 9 aa, Homo Sapiens
EVSCGGHIC

SEQ ID NO: 907651 - protein, 9 aa, Homo Sapiens
LGALFLLKE

SEQ ID NO: 907652 - protein, 9 aa, Homo Sapiens
SSLGDKDWG

SEQ ID NO: 907653 - protein, 9 aa, Homo Sapiens
MDPHWPSLR

SEQ ID NO: 907654 - protein, 9 aa, Homo Sapiens
TGTLSPASS

SEQ ID NO: 907655 - protein, 9 aa, Homo Sapiens
VQRCKDLID

SEQ ID NO: 907656 - protein, 9 aa, Homo Sapiens
IKSSQPSQN

SEQ ID NO: 907657 - protein, 9 aa, Homo Sapiens
AAYSARSPG

SEQ ID NO: 907658 - protein, 9 aa, Homo Sapiens
AVGAAAYSA

SEQ ID NO: 907659 - protein, 9 aa, Homo Sapiens
SRQLEEKET

SEQ ID NO: 907660 - protein, 9 aa, Homo Sapiens
ITGTLSPAS

SEQ ID NO: 907661 - protein, 9 aa, Homo Sapiens
DVCDCQYHF

SEQ ID NO: 907662 - protein, 9 aa, Homo Sapiens
ALYKFVVSK

SEQ ID NO: 907663 - protein, 9 aa, Homo Sapiens
YSKYYTPVS

SEQ ID NO: 907664 - protein, 9 aa, Homo Sapiens
GPEEPREPA

SEQ ID NO: 907665 - protein, 9 aa, Homo Sapiens
FFFFSRPSP

SEQ ID NO: 907666 - protein, 9 aa, Homo Sapiens
IVLRSGNWE

SEQ ID NO: 907667 - protein, 9 aa, Homo Sapiens
RSLGYMPSK

SEQ ID NO: 907668 - protein, 9 aa, Homo Sapiens
NCLIDKTNR

SEQ ID NO: 907669 - protein, 9 aa, Homo Sapiens
LNTSVIIKC

SEQ ID NO: 907670 - protein, 9 aa, Homo Sapiens
LIFVYDEIH

SEQ ID NO: 907671 - protein, 9 aa, Homo Sapiens
LSLPHHRLV

SEQ ID NO: 907672 - protein, 9 aa, Homo Sapiens
AFMQPDHVG

SEQ ID NO: 907673 - protein, 9 aa, Homo Sapiens
SLRVWGSPY

SEQ ID NO: 907674 - protein, 9 aa, Homo Sapiens
FKPLPSVFS

SEQ ID NO: 907675 - protein, 9 aa, Homo Sapiens
ADYALLTES

SEQ ID NO: 907676 - protein, 9 aa, Homo Sapiens
SRSARRSRS

SEQ ID NO: 907677 - protein, 9 aa, Homo Sapiens
KVELAIIMQ

SEQ ID NO: 907678 - protein, 9 aa, Homo Sapiens
SSCCTPQCC

SEQ ID NO: 907679 - protein, 9 aa, Homo Sapiens
PRAGSLLSR

SEQ ID NO: 907680 - protein, 9 aa, Homo Sapiens
GKRKLEQYR

SEQ ID NO: 907681 - protein, 9 aa, Homo Sapiens
LLTESTTIE

SEQ ID NO: 907682 - protein, 9 aa, Homo Sapiens
SLCAHVECP

SEQ ID NO: 907683 - protein, 9 aa, Homo Sapiens
TGCGIFKPL

SEQ ID NO: 907684 - protein, 9 aa, Homo Sapiens
DMIVLRSGN

SEQ ID NO: 907685 - protein, 9 aa, Homo Sapiens
NRRNLPGNR

SEQ ID NO: 907686 - protein, 9 aa, Homo Sapiens
GSRAYLLLN

SEQ ID NO: 907687 - protein, 9 aa, Homo Sapiens
KSSQPSQNQ

SEQ ID NO: 907688 - protein, 9 aa, Homo Sapiens
NTISKELPF

SEQ ID NO: 907689 - protein, 9 aa, Homo Sapiens
EMQKDSDVK

SEQ ID NO: 907690 - protein, 9 aa, Homo Sapiens
GGVGGGQNG

SEQ ID NO: 907691 - protein, 9 aa, Homo Sapiens
TEVSCGGHI

SEQ ID NO: 907692 - protein, 9 aa, Homo Sapiens
RAYLLLNTS

SEQ ID NO: 907693 - protein, 9 aa, Homo Sapiens
VSVSWDGEG

SEQ ID NO: 907694 - protein, 9 aa, Homo Sapiens
YLLLNTSVI

SEQ ID NO: 907695 - protein, 9 aa, Homo Sapiens
PSPARQVPA

SEQ ID NO: 907696 - protein, 9 aa, Homo Sapiens
STGCGIFKP

SEQ ID NO: 907697 - protein, 9 aa, Homo Sapiens
IMCTILTNY

SEQ ID NO: 907698 - protein, 9 aa, Homo Sapiens
FVYDEIHKL

SEQ ID NO: 907699 - protein, 9 aa, Homo Sapiens
CRNTDIELE

SEQ ID NO: 907700 - protein, 9 aa, Homo Sapiens
ESASHQLHA

SEQ ID NO: 907701 - protein, 9 aa, Homo Sapiens
AGNAQTIAQ

SEQ ID NO: 907702 - protein, 9 aa, Homo Sapiens
GHICLPSSC

SEQ ID NO: 907703 - protein, 9 aa, Homo Sapiens
HVGIFRVFC

SEQ ID NO: 907704 - protein, 9 aa, Homo Sapiens
NRDPVSHIC

SEQ ID NO: 907705 - protein, 9 aa, Homo Sapiens
SCGGHICLP

SEQ ID NO: 907706 - protein, 9 aa, Homo Sapiens
ECRNTDIEL

SEQ ID NO: 907707 - protein, 9 aa, Homo Sapiens
KYYTPVSCE

SEQ ID NO: 907708 - protein, 9 aa, Homo Sapiens
GCVLSLPHH

SEQ ID NO: 907709 - protein, 9 aa, Homo Sapiens
CSTGCGIFK

SEQ ID NO: 907710 - protein, 9 aa, Homo Sapiens
EALQVFEFR

SEQ ID NO: 907711 - protein, 9 aa, Homo Sapiens
TRITLRIHQ

SEQ ID NO: 907712 - protein, 9 aa, Homo Sapiens
EALYKFVVS

SEQ ID NO: 907713 - protein, 9 aa, Homo Sapiens
HRLVCYCRL

SEQ ID NO: 907714 - protein, 9 aa, Homo Sapiens
SQPSQNQGL

SEQ ID NO: 907715 - protein, 9 aa, Homo Sapiens
IPRAGSLLS

SEQ ID NO: 907716 - protein, 9 aa, Homo Sapiens
RQLEEKETI

SEQ ID NO: 907717 - protein, 9 aa, Homo Sapiens
IKALMEKLL

SEQ ID NO: 907718 - protein, 9 aa, Homo Sapiens
ARLCILTWS

SEQ ID NO: 907719 - protein, 9 aa, Homo Sapiens
NEAGNAQTI

SEQ ID NO: 907720 - protein, 9 aa, Homo Sapiens
KNEDIEDVT

SEQ ID NO: 907721 - protein, 9 aa, Homo Sapiens
QKDSDVKGG

SEQ ID NO: 907722 - protein, 9 aa, Homo Sapiens
RQRNCLIDK

SEQ ID NO: 907723 - protein, 9 aa, Homo Sapiens
QQPGGVGGG

SEQ ID NO: 907724 - protein, 9 aa, Homo Sapiens
KAVGAAAYS

SEQ ID NO: 907725 - protein, 9 aa, Homo Sapiens
MQKDSDVKG

SEQ ID NO: 907726 - protein, 9 aa, Homo Sapiens
SFFFFSRPS

SEQ ID NO: 907727 - protein, 9 aa, Homo Sapiens
PDHVGIFRV

SEQ ID NO: 907728 - protein, 9 aa, Homo Sapiens
CKDLIDVCD

SEQ ID NO: 907729 - protein, 9 aa, Homo Sapiens
CAKEQLESL

SEQ ID NO: 907730 - protein, 9 aa, Homo Sapiens
RLLPDAPNV

SEQ ID NO: 907731 - protein, 9 aa, Homo Sapiens
IKEMQKDSD

SEQ ID NO: 907732 - protein, 9 aa, Homo Sapiens
NMIQFTHTQ

SEQ ID NO: 907733 - protein, 9 aa, Homo Sapiens
DYALLTEST

SEQ ID NO: 907734 - protein, 9 aa, Homo Sapiens
FSRPSPKTQ

SEQ ID NO: 907735 - protein, 9 aa, Homo Sapiens
RMVENSFPR

SEQ ID NO: 907736 - protein, 9 aa, Homo Sapiens
QYKEGMGWS

SEQ ID NO: 907737 - protein, 9 aa, Homo Sapiens
TLRIHQKNH

SEQ ID NO: 907738 - protein, 9 aa, Homo Sapiens
SRPSPKTQD

SEQ ID NO: 907739 - protein, 9 aa, Homo Sapiens
SFPRSQLFM

SEQ ID NO: 907740 - protein, 9 aa, Homo Sapiens
NTDIELEHH

SEQ ID NO: 907741 - protein, 9 aa, Homo Sapiens
SQTGPEEPR

SEQ ID NO: 907742 - protein, 9 aa, Homo Sapiens
NIKSSQPSQ

SEQ ID NO: 907743 - protein, 9 aa, Homo Sapiens
YALLTESTT

SEQ ID NO: 907744 - protein, 9 aa, Homo Sapiens
MIVLRSGNW

SEQ ID NO: 907745 - protein, 9 aa, Homo Sapiens
SDVKGGETS

SEQ ID NO: 907746 - protein, 9 aa, Homo Sapiens
TVSGKKDKL

SEQ ID NO: 907747 - protein, 9 aa, Homo Sapiens
PHWPSLRVW

SEQ ID NO: 907748 - protein, 9 aa, Homo Sapiens
ITPKSTIFN

SEQ ID NO: 907749 - protein, 9 aa, Homo Sapiens
LTVNLAFGF

SEQ ID NO: 907750 - protein, 9 aa, Homo Sapiens
ETIVSQLSR

SEQ ID NO: 907751 - protein, 9 aa, Homo Sapiens
TESTTIEYV

SEQ ID NO: 907752 - protein, 9 aa, Homo Sapiens
VETHATRII

SEQ ID NO: 907753 - protein, 9 aa, Homo Sapiens
EVPSFRQNC

SEQ ID NO: 907754 - protein, 9 aa, Homo Sapiens
VLAKNRDPV

SEQ ID NO: 907755 - protein, 9 aa, Homo Sapiens
ADRPGNLFI

SEQ ID NO: 907756 - protein, 9 aa, Homo Sapiens
LPPRPPQPG

SEQ ID NO: 907757 - protein, 9 aa, Homo Sapiens
TSYKELSRG

SEQ ID NO: 907758 - protein, 9 aa, Homo Sapiens
NDPFAQWST

SEQ ID NO: 907759 - protein, 9 aa, Homo Sapiens
AWLSNASLQ

SEQ ID NO: 907760 - protein, 9 aa, Homo Sapiens
IHVEVKAKS

SEQ ID NO: 907761 - protein, 9 aa, Homo Sapiens
QLWRGMRGA

SEQ ID NO: 907762 - protein, 9 aa, Homo Sapiens
EFTTSYKEL

SEQ ID NO: 907763 - protein, 9 aa, Homo Sapiens
LQRLPTPPQ

SEQ ID NO: 907764 - protein, 9 aa, Homo Sapiens
WLDLTLPNS

SEQ ID NO: 907765 - protein, 9 aa, Homo Sapiens
LAEADHAAH

SEQ ID NO: 907766 - protein, 9 aa, Homo Sapiens
KDRCIRKSC

SEQ ID NO: 907767 - protein, 9 aa, Homo Sapiens
IRKSCRNPP

SEQ ID NO: 907768 - protein, 9 aa, Homo Sapiens
VRNDEEVNK

SEQ ID NO: 907769 - protein, 9 aa, Homo Sapiens
GILSFNAPS

SEQ ID NO: 907770 - protein, 9 aa, Homo Sapiens
LVEHWSIHT

SEQ ID NO: 907771 - protein, 9 aa, Homo Sapiens
ACCRQLIPG

SEQ ID NO: 907772 - protein, 9 aa, Homo Sapiens
QLTLPKCRL

SEQ ID NO: 907773 - protein, 9 aa, Homo Sapiens
CRQLIPGDE

SEQ ID NO: 907774 - protein, 9 aa, Homo Sapiens
GVETKLNRI

SEQ ID NO: 907775 - protein, 9 aa, Homo Sapiens
PPLQRLPTP

SEQ ID NO: 907776 - protein, 9 aa, Homo Sapiens
PEIQKEHRD

SEQ ID NO: 907777 - protein, 9 aa, Homo Sapiens
VIAGLVDSG

SEQ ID NO: 907778 - protein, 9 aa, Homo Sapiens
PQLGQRTHA

SEQ ID NO: 907779 - protein, 9 aa, Homo Sapiens
PSEISDNVV

SEQ ID NO: 907780 - protein, 9 aa, Homo Sapiens
TGAKDRCIR

SEQ ID NO: 907781 - protein, 9 aa, Homo Sapiens
VETKLNRIP

SEQ ID NO: 907782 - protein, 9 aa, Homo Sapiens
AKVSLDWIQ

SEQ ID NO: 907783 - protein, 9 aa, Homo Sapiens
QPHPPPLQR

SEQ ID NO: 907784 - protein, 9 aa, Homo Sapiens
LEAKVSLDW

SEQ ID NO: 907785 - protein, 9 aa, Homo Sapiens
EADRPGNLF

SEQ ID NO: 907786 - protein, 9 aa, Homo Sapiens
YKELSRGQS

SEQ ID NO: 907787 - protein, 9 aa, Homo Sapiens
VKAKSLVIS

SEQ ID NO: 907788 - protein, 9 aa, Homo Sapiens
DLTLPNSTP

SEQ ID NO: 907789 - protein, 9 aa, Homo Sapiens
PPRPPQPGP

SEQ ID NO: 907790 - protein, 9 aa, Homo Sapiens
VVDYGPKAH

SEQ ID NO: 907791 - protein, 9 aa, Homo Sapiens
WLGSKEGLH

SEQ ID NO: 907792 - protein, 9 aa, Homo Sapiens
DDVIEQQLW

SEQ ID NO: 907793 - protein, 9 aa, Homo Sapiens
LLAGPLGFN

SEQ ID NO: 907794 - protein, 9 aa, Homo Sapiens
IARYRNQTI

SEQ ID NO: 907795 - protein, 9 aa, Homo Sapiens
TIQAESYYR

SEQ ID NO: 907796 - protein, 9 aa, Homo Sapiens
IPAKDAPPV

SEQ ID NO: 907797 - protein, 9 aa, Homo Sapiens
LGSKEGLHW

SEQ ID NO: 907798 - protein, 9 aa, Homo Sapiens
TYAFGLVQL

SEQ ID NO: 907799 - protein, 9 aa, Homo Sapiens
PGPPALWPP

SEQ ID NO: 907800 - protein, 9 aa, Homo Sapiens
WEVVRAEIV

SEQ ID NO: 907801 - protein, 9 aa, Homo Sapiens
EDWPPRVVD

SEQ ID NO: 907802 - protein, 9 aa, Homo Sapiens
PSWKFSDQL

SEQ ID NO: 907803 - protein, 9 aa, Homo Sapiens
PPLPPQEQL

SEQ ID NO: 907804 - protein, 9 aa, Homo Sapiens
ANDPFAQWS

SEQ ID NO: 907805 - protein, 9 aa, Homo Sapiens
GVIAGLVDS

SEQ ID NO: 907806 - protein, 9 aa, Homo Sapiens
ISSPQLGQR

SEQ ID NO: 907807 - protein, 9 aa, Homo Sapiens
VDYGPKAHP

SEQ ID NO: 907808 - protein, 9 aa, Homo Sapiens
QRKLQPAAV

SEQ ID NO: 907809 - protein, 9 aa, Homo Sapiens
PPTQVVHRA

SEQ ID NO: 907810 - protein, 9 aa, Homo Sapiens
AKLILGGGG

SEQ ID NO: 907811 - protein, 9 aa, Homo Sapiens
EQLTLPKCR

SEQ ID NO: 907812 - protein, 9 aa, Homo Sapiens
WPPRVVDYG

SEQ ID NO: 907813 - protein, 9 aa, Homo Sapiens
PCFHRGTCQ

SEQ ID NO: 907814 - protein, 9 aa, Homo Sapiens
EFNDSGEDC

SEQ ID NO: 907815 - protein, 9 aa, Homo Sapiens
CGPNILDTF

SEQ ID NO: 907816 - protein, 9 aa, Homo Sapiens
LQTAIRKAQ

SEQ ID NO: 907817 - protein, 9 aa, Homo Sapiens
EAWLSNASL

SEQ ID NO: 907818 - protein, 9 aa, Homo Sapiens
TTTSIGVET

SEQ ID NO: 907819 - protein, 9 aa, Homo Sapiens
QTIQAESYY

SEQ ID NO: 907820 - protein, 9 aa, Homo Sapiens
CVACCRQLI

SEQ ID NO: 907821 - protein, 9 aa, Homo Sapiens
SAQPPHPQP

SEQ ID NO: 907822 - protein, 9 aa, Homo Sapiens
HPPPLQRLP

SEQ ID NO: 907823 - protein, 9 aa, Homo Sapiens
GFNDRRIVP

SEQ ID NO: 907824 - protein, 9 aa, Homo Sapiens
FEVYIYVTI

SEQ ID NO: 907825 - protein, 9 aa, Homo Sapiens
TEEFKIVLA

SEQ ID NO: 907826 - protein, 9 aa, Homo Sapiens
SDNVVAKDP

SEQ ID NO: 907827 - protein, 9 aa, Homo Sapiens
EQQLWRGMR

SEQ ID NO: 907828 - protein, 9 aa, Homo Sapiens
LGFNDRRIV

SEQ ID NO: 907829 - protein, 9 aa, Homo Sapiens
QSPPPPAQG

SEQ ID NO: 907830 - protein, 9 aa, Homo Sapiens
SLDWIQLFL

SEQ ID NO: 907831 - protein, 9 aa, Homo Sapiens
LQCGSAQPP

SEQ ID NO: 907832 - protein, 9 aa, Homo Sapiens
LAGPLGFND

SEQ ID NO: 907833 - protein, 9 aa, Homo Sapiens
QQEAWLSNA

SEQ ID NO: 907834 - protein, 9 aa, Homo Sapiens
KAKSLVISP

SEQ ID NO: 907835 - protein, 9 aa, Homo Sapiens
AKRLLFGKS

SEQ ID NO: 907836 - protein, 9 aa, Homo Sapiens
NLFIGGLNT

SEQ ID NO: 907837 - protein, 9 aa, Homo Sapiens
QEQLTLPKC

SEQ ID NO: 907838 - protein, 9 aa, Homo Sapiens
KVSLDWIQL

SEQ ID NO: 907839 - protein, 9 aa, Homo Sapiens
RLPQPRASQ

SEQ ID NO: 907840 - protein, 9 aa, Homo Sapiens
SEISDNVVA

SEQ ID NO: 907841 - protein, 9 aa, Homo Sapiens
VDSGETLQC

SEQ ID NO: 907842 - protein, 9 aa, Homo Sapiens
PLPPQEQLT

SEQ ID NO: 907843 - protein, 9 aa, Homo Sapiens
DTYAFGLVQ

SEQ ID NO: 907844 - protein, 9 aa, Homo Sapiens
EIQKEHRDL

SEQ ID NO: 907845 - protein, 9 aa, Homo Sapiens
DTFEVYIYV

SEQ ID NO: 907846 - protein, 9 aa, Homo Sapiens
ECFRCVACC

SEQ ID NO: 907847 - protein, 9 aa, Homo Sapiens
GQKSDANDP

SEQ ID NO: 907848 - protein, 9 aa, Homo Sapiens
KPHAKLILG

SEQ ID NO: 907849 - protein, 9 aa, Homo Sapiens
VHRAQDFVY

SEQ ID NO: 907850 - protein, 9 aa, Homo Sapiens
PHAIDTYAF

SEQ ID NO: 907851 - protein, 9 aa, Homo Sapiens
LTLPNSTPG

SEQ ID NO: 907852 - protein, 9 aa, Homo Sapiens
RPPQPGPPA

SEQ ID NO: 907853 - protein, 9 aa, Homo Sapiens
QLGQRTHAT

SEQ ID NO: 907854 - protein, 9 aa, Homo Sapiens
AIDTYAFGL

SEQ ID NO: 907855 - protein, 9 aa, Homo Sapiens
QPRASQSPP

SEQ ID NO: 907856 - protein, 9 aa, Homo Sapiens
GNLFIGGLN

SEQ ID NO: 907857 - protein, 9 aa, Homo Sapiens
NGLPSWKFS

SEQ ID NO: 907858 - protein, 9 aa, Homo Sapiens
PPAQGRHAR

SEQ ID NO: 907859 - protein, 9 aa, Homo Sapiens
AGQKKHALC

SEQ ID NO: 907860 - protein, 9 aa, Homo Sapiens
QTAIRKAQY

SEQ ID NO: 907861 - protein, 9 aa, Homo Sapiens
SQPPHPRPP

SEQ ID NO: 907862 - protein, 9 aa, Homo Sapiens
KEHRDLLQE

SEQ ID NO: 907863 - protein, 9 aa, Homo Sapiens
HLVEHWSIH

SEQ ID NO: 907864 - protein, 9 aa, Homo Sapiens
SEPSEISDN

SEQ ID NO: 907865 - protein, 9 aa, Homo Sapiens
QRAGFETAI

SEQ ID NO: 907866 - protein, 9 aa, Homo Sapiens
PAKDAPPVE

SEQ ID NO: 907867 - protein, 9 aa, Homo Sapiens
RPGNLFIGG

SEQ ID NO: 907868 - protein, 9 aa, Homo Sapiens
DLAKRLLFG

SEQ ID NO: 907869 - protein, 9 aa, Homo Sapiens
WTRLSQPPH

SEQ ID NO: 907870 - protein, 9 aa, Homo Sapiens
TTWTRLSQP

SEQ ID NO: 907871 - protein, 9 aa, Homo Sapiens
HAKLILGGG

SEQ ID NO: 907872 - protein, 9 aa, Homo Sapiens
SISSPQLGQ

SEQ ID NO: 907873 - protein, 9 aa, Homo Sapiens
MKKKREQHE

SEQ ID NO: 907874 - protein, 9 aa, Homo Sapiens
DNVVAKDPD

SEQ ID NO: 907875 - protein, 9 aa, Homo Sapiens
PMTEEFKIV

SEQ ID NO: 907876 - protein, 9 aa, Homo Sapiens
VRAEIVRSL

SEQ ID NO: 907877 - protein, 9 aa, Homo Sapiens
VLLNYNPDN

SEQ ID NO: 907878 - protein, 9 aa, Homo Sapiens
MEWLDLTLP

SEQ ID NO: 907879 - protein, 9 aa, Homo Sapiens
FNDSGEDCT

SEQ ID NO: 907880 - protein, 9 aa, Homo Sapiens
LVDSGETLQ

SEQ ID NO: 907881 - protein, 9 aa, Homo Sapiens
PTPPQCLPP

SEQ ID NO: 907882 - protein, 9 aa, Homo Sapiens
PPHPRPPCP

SEQ ID NO: 907883 - protein, 9 aa, Homo Sapiens
LAKRLLFGK

SEQ ID NO: 907884 - protein, 9 aa, Homo Sapiens
GSKEGLHWK

SEQ ID NO: 907885 - protein, 9 aa, Homo Sapiens
SVAVMHHPL

SEQ ID NO: 907886 - protein, 9 aa, Homo Sapiens
VVHRAQDFV

SEQ ID NO: 907887 - protein, 9 aa, Homo Sapiens
AEIVRSLSF

SEQ ID NO: 907888 - protein, 9 aa, Homo Sapiens
IVLAIGNLV

SEQ ID NO: 907889 - protein, 9 aa, Homo Sapiens
HAAHEEMEA

SEQ ID NO: 907890 - protein, 9 aa, Homo Sapiens
LMGGIIVGF

SEQ ID NO: 907891 - protein, 9 aa, Homo Sapiens
NASLQTAFQ

SEQ ID NO: 907892 - protein, 9 aa, Homo Sapiens
SHLVEHWSI

SEQ ID NO: 907893 - protein, 9 aa, Homo Sapiens
PRASQSPPP

SEQ ID NO: 907894 - protein, 9 aa, Homo Sapiens
EAKVSLDWI

SEQ ID NO: 907895 - protein, 9 aa, Homo Sapiens
VNKLLGGVT

SEQ ID NO: 907896 - protein, 9 aa, Homo Sapiens
WTGAKDRCI

SEQ ID NO: 907897 - protein, 9 aa, Homo Sapiens
VIEQQLWRG

SEQ ID NO: 907898 - protein, 9 aa, Homo Sapiens
RSISSPQLG

SEQ ID NO: 907899 - protein, 9 aa, Homo Sapiens
AGFETAIVH

SEQ ID NO: 907900 - protein, 9 aa, Homo Sapiens
VAVMHHPLY

SEQ ID NO: 907901 - protein, 9 aa, Homo Sapiens
DEEVNKLLG

SEQ ID NO: 907902 - protein, 9 aa, Homo Sapiens
TWTRLSQPP

SEQ ID NO: 907903 - protein, 9 aa, Homo Sapiens
HWSIHTGQK

SEQ ID NO: 907904 - protein, 9 aa, Homo Sapiens
IPPTQVVHR

SEQ ID NO: 907905 - protein, 9 aa, Homo Sapiens
FEFNDSGED

SEQ ID NO: 907906 - protein, 9 aa, Homo Sapiens
LEDPFEFND

SEQ ID NO: 907907 - protein, 9 aa, Homo Sapiens
TFEVYIYVT

SEQ ID NO: 907908 - protein, 9 aa, Homo Sapiens
PPRVVDYGP

SEQ ID NO: 907909 - protein, 9 aa, Homo Sapiens
RVVDYGPKA

SEQ ID NO: 907910 - protein, 9 aa, Homo Sapiens
LDWIQLFLD

SEQ ID NO: 907911 - protein, 9 aa, Homo Sapiens
FGKSASVDA

SEQ ID NO: 907912 - protein, 9 aa, Homo Sapiens
EEFKIVLAI

SEQ ID NO: 907913 - protein, 9 aa, Homo Sapiens
EFKIVLAIG

SEQ ID NO: 907914 - protein, 9 aa, Homo Sapiens
TMEWLDLTL

SEQ ID NO: 907915 - protein, 9 aa, Homo Sapiens
QPPHPQPVA

SEQ ID NO: 907916 - protein, 9 aa, Homo Sapiens
TTQTTSTSL

SEQ ID NO: 907917 - protein, 9 aa, Homo Sapiens
KEGLHWKEA

SEQ ID NO: 907918 - protein, 9 aa, Homo Sapiens
ILEDPFEFN

SEQ ID NO: 907919 - protein, 9 aa, Homo Sapiens
QVVLLNYNP

SEQ ID NO: 907920 - protein, 9 aa, Homo Sapiens
VVLLNYNPD

SEQ ID NO: 907921 - protein, 9 aa, Homo Sapiens
PQPHPPPLQ

SEQ ID NO: 907922 - protein, 9 aa, Homo Sapiens
WPPPLPPQE

SEQ ID NO: 907923 - protein, 9 aa, Homo Sapiens
EADHAAHEE

SEQ ID NO: 907924 - protein, 9 aa, Homo Sapiens
IVRSLSFST

SEQ ID NO: 907925 - protein, 9 aa, Homo Sapiens
KDAPPVEKI

SEQ ID NO: 907926 - protein, 9 aa, Homo Sapiens
EGLHWKEAM

SEQ ID NO: 907927 - protein, 9 aa, Homo Sapiens
ILKVLGILS

SEQ ID NO: 907928 - protein, 9 aa, Homo Sapiens
ELLAGPLGF

SEQ ID NO: 907929 - protein, 9 aa, Homo Sapiens
PNILDTFYC

SEQ ID NO: 907930 - protein, 9 aa, Homo Sapiens
QPAAVYEIK

SEQ ID NO: 907931 - protein, 9 aa, Homo Sapiens
DLDPHAIDT

SEQ ID NO: 907932 - protein, 9 aa, Homo Sapiens
DRSISSPQL

SEQ ID NO: 907933 - protein, 9 aa, Homo Sapiens
AVYEIKVRS

SEQ ID NO: 907934 - protein, 9 aa, Homo Sapiens
DRCIRKSCR

SEQ ID NO: 907935 - protein, 9 aa, Homo Sapiens
KNRWGKMMK

SEQ ID NO: 907936 - protein, 9 aa, Homo Sapiens
EVVRAEIVR

SEQ ID NO: 907937 - protein, 9 aa, Homo Sapiens
NAQRAGFET

SEQ ID NO: 907938 - protein, 9 aa, Homo Sapiens
PVSVAVMHH

SEQ ID NO: 907939 - protein, 9 aa, Homo Sapiens
KCRLPQPRA

SEQ ID NO: 907940 - protein, 9 aa, Homo Sapiens
LPQPRASQS

SEQ ID NO: 907941 - protein, 9 aa, Homo Sapiens
LPPQEQLTL

SEQ ID NO: 907942 - protein, 9 aa, Homo Sapiens
STTQTTSTS

SEQ ID NO: 907943 - protein, 9 aa, Homo Sapiens
RCIRKSCRN

SEQ ID NO: 907944 - protein, 9 aa, Homo Sapiens
IGEFTTSYK

SEQ ID NO: 907945 - protein, 9 aa, Homo Sapiens
GIIVGFILR

SEQ ID NO: 907946 - protein, 9 aa, Homo Sapiens
PAQGRHARL

SEQ ID NO: 907947 - protein, 9 aa, Homo Sapiens
LAVRNDEEV

SEQ ID NO: 907948 - protein, 9 aa, Homo Sapiens
PHAKLILGG

SEQ ID NO: 907949 - protein, 9 aa, Homo Sapiens
IAGLVDSGE

SEQ ID NO: 907950 - protein, 9 aa, Homo Sapiens
RDLLQELKV

SEQ ID NO: 907951 - protein, 9 aa, Homo Sapiens
NDEEVNKLL

SEQ ID NO: 907952 - protein, 9 aa, Homo Sapiens
FRCVACCRQ

SEQ ID NO: 907953 - protein, 9 aa, Homo Sapiens
TTSYKELSR

SEQ ID NO: 907954 - protein, 9 aa, Homo Sapiens
AIRKAQYSQ

SEQ ID NO: 907955 - protein, 9 aa, Homo Sapiens
RASQSPPPP

SEQ ID NO: 907956 - protein, 9 aa, Homo Sapiens
KHALCCYCQ

SEQ ID NO: 907957 - protein, 9 aa, Homo Sapiens
IQKEHRDLL

SEQ ID NO: 907958 - protein, 9 aa, Homo Sapiens
QKSDANDPF

SEQ ID NO: 907959 - protein, 9 aa, Homo Sapiens
HAIDTYAFG

SEQ ID NO: 907960 - protein, 9 aa, Homo Sapiens
SNASLQTAF

SEQ ID NO: 907961 - protein, 9 aa, Homo Sapiens
IQAESYYRH

SEQ ID NO: 907962 - protein, 9 aa, Homo Sapiens
FETAIVHNV

SEQ ID NO: 907963 - protein, 9 aa, Homo Sapiens
VYEIKVRSI

SEQ ID NO: 907964 - protein, 9 aa, Homo Sapiens
RPVSVAVMH

SEQ ID NO: 907965 - protein, 9 aa, Homo Sapiens
LCCYCQAMQ

SEQ ID NO: 907966 - protein, 9 aa, Homo Sapiens
SLSSPLGTS

SEQ ID NO: 907967 - protein, 9 aa, Homo Sapiens
VEHWSIHTG

SEQ ID NO: 907968 - protein, 9 aa, Homo Sapiens
DRPGNLFIG

SEQ ID NO: 907969 - protein, 9 aa, Homo Sapiens
EWLDLTLPN

SEQ ID NO: 907970 - protein, 9 aa, Homo Sapiens
ETKLNRIPS

SEQ ID NO: 907971 - protein, 9 aa, Homo Sapiens
GLHWKEAML

SEQ ID NO: 907972 - protein, 9 aa, Homo Sapiens
FTTSYKELS

SEQ ID NO: 907973 - protein, 9 aa, Homo Sapiens
EDDVIEQQL

SEQ ID NO: 907974 - protein, 9 aa, Homo Sapiens
QYSQGKSSL

SEQ ID NO: 907975 - protein, 9 aa, Homo Sapiens
VVRAEIVRS

SEQ ID NO: 907976 - protein, 9 aa, Homo Sapiens
PRVVDYGPK

SEQ ID NO: 907977 - protein, 9 aa, Homo Sapiens
AAVYEIKVR

SEQ ID NO: 907978 - protein, 9 aa, Homo Sapiens
PPPPAQGRH

SEQ ID NO: 907979 - protein, 9 aa, Homo Sapiens
GLPSWKFSD

SEQ ID NO: 907980 - protein, 9 aa, Homo Sapiens
RWGKMMKKK

SEQ ID NO: 907981 - protein, 9 aa, Homo Sapiens
QKKHALCCY

SEQ ID NO: 907982 - protein, 9 aa, Homo Sapiens
RAGFETAIV

SEQ ID NO: 907983 - protein, 9 aa, Homo Sapiens
PPHPQPVAP

SEQ ID NO: 907984 - protein, 9 aa, Homo Sapiens
CCRQLIPGD

SEQ ID NO: 907985 - protein, 9 aa, Homo Sapiens
PAAVYEIKV

SEQ ID NO: 907986 - protein, 9 aa, Homo Sapiens
LSQPPHPRP

SEQ ID NO: 907987 - protein, 9 aa, Homo Sapiens
LEVGQVVLL

SEQ ID NO: 907988 - protein, 9 aa, Homo Sapiens
RYRNQTIQA

SEQ ID NO: 907989 - protein, 9 aa, Homo Sapiens
ETAIVHNVH

SEQ ID NO: 907990 - protein, 9 aa, Homo Sapiens
KDLAKRLLF

SEQ ID NO: 907991 - protein, 9 aa, Homo Sapiens
PFEFNDSGE

SEQ ID NO: 907992 - protein, 9 aa, Homo Sapiens
QRLPTPPQC

SEQ ID NO: 907993 - protein, 9 aa, Homo Sapiens
EPSEISDNV

SEQ ID NO: 907994 - protein, 9 aa, Homo Sapiens
FILRLPFWG

SEQ ID NO: 907995 - protein, 9 aa, Homo Sapiens
ALWPPPLPP

SEQ ID NO: 907996 - protein, 9 aa, Homo Sapiens
KLILGGGGG

SEQ ID NO: 907997 - protein, 9 aa, Homo Sapiens
VGFILRLPF

SEQ ID NO: 907998 - protein, 9 aa, Homo Sapiens
IYVTIKDEK

SEQ ID NO: 907999 - protein, 9 aa, Homo Sapiens
EVYIYVTIK

SEQ ID NO: 908000 - protein, 9 aa, Homo Sapiens
LKVLGILSF

SEQ ID NO: 908001 - protein, 9 aa, Homo Sapiens
RAEIVRSLS

SEQ ID NO: 908002 - protein, 9 aa, Homo Sapiens
SDQLFPCDV

SEQ ID NO: 908003 - protein, 9 aa, Homo Sapiens
FNDRRIVPE

SEQ ID NO: 908004 - protein, 9 aa, Homo Sapiens
TKLNRIPSP

SEQ ID NO: 908005 - protein, 9 aa, Homo Sapiens
AQPPHPQPV

SEQ ID NO: 908006 - protein, 9 aa, Homo Sapiens
VRSLSFSTN

SEQ ID NO: 908007 - protein, 9 aa, Homo Sapiens
LGGGGGGKA

SEQ ID NO: 908008 - protein, 9 aa, Homo Sapiens
RNDEEVNKL

SEQ ID NO: 908009 - protein, 9 aa, Homo Sapiens
KIVLAIGNL

SEQ ID NO: 908010 - protein, 9 aa, Homo Sapiens
CCYCQAMQV

SEQ ID NO: 908011 - protein, 9 aa, Homo Sapiens
RGTCQDWAL

SEQ ID NO: 908012 - protein, 9 aa, Homo Sapiens
CFRCVACCR

SEQ ID NO: 908013 - protein, 9 aa, Homo Sapiens
AQYSQGKSS

SEQ ID NO: 908014 - protein, 9 aa, Homo Sapiens
VSLDWIQLF

SEQ ID NO: 908015 - protein, 9 aa, Homo Sapiens
VACCRQLIP

SEQ ID NO: 908016 - protein, 9 aa, Homo Sapiens
NIPAKDAPP

SEQ ID NO: 908017 - protein, 9 aa, Homo Sapiens
IDTYAFGLV

SEQ ID NO: 908018 - protein, 9 aa, Homo Sapiens
ARYRNQTIQ

SEQ ID NO: 908019 - protein, 9 aa, Homo Sapiens
SWKFSDQLF

SEQ ID NO: 908020 - protein, 9 aa, Homo Sapiens
SGETLQCPE

SEQ ID NO: 908021 - protein, 9 aa, Homo Sapiens
PPVEKIDTM

SEQ ID NO: 908022 - protein, 9 aa, Homo Sapiens
GGIIVGFIL

SEQ ID NO: 908023 - protein, 9 aa, Homo Sapiens
AEDWPPRVV

SEQ ID NO: 908024 - protein, 9 aa, Homo Sapiens
YRPVSVAVM

SEQ ID NO: 908025 - protein, 9 aa, Homo Sapiens
WGKMMKKKR

SEQ ID NO: 908026 - protein, 9 aa, Homo Sapiens
SKEGLHWKE

SEQ ID NO: 908027 - protein, 9 aa, Homo Sapiens
WSIHTGQKP

SEQ ID NO: 908028 - protein, 9 aa, Homo Sapiens
PPQEQLTLP

SEQ ID NO: 908029 - protein, 9 aa, Homo Sapiens
VLGILSFNA

SEQ ID NO: 908030 - protein, 9 aa, Homo Sapiens
LILGGGGGG

SEQ ID NO: 908031 - protein, 9 aa, Homo Sapiens
LLFGKSASV

SEQ ID NO: 908032 - protein, 9 aa, Homo Sapiens
MTEEFKIVL

SEQ ID NO: 908033 - protein, 9 aa, Homo Sapiens
PQPRASQSP

SEQ ID NO: 908034 - protein, 9 aa, Homo Sapiens
LPKCRLPQP

SEQ ID NO: 908035 - protein, 9 aa, Homo Sapiens
GKMMKKKRE

SEQ ID NO: 908036 - protein, 9 aa, Homo Sapiens
DSQPCFHRG

SEQ ID NO: 908037 - protein, 9 aa, Homo Sapiens
ILDTFYCDV

SEQ ID NO: 908038 - protein, 9 aa, Homo Sapiens
PPCPQPHPP

SEQ ID NO: 908039 - protein, 9 aa, Homo Sapiens
STSLSSPLG

SEQ ID NO: 908040 - protein, 9 aa, Homo Sapiens
HPMTEEFKI

SEQ ID NO: 908041 - protein, 9 aa, Homo Sapiens
SFNAPSCGL

SEQ ID NO: 908042 - protein, 9 aa, Homo Sapiens
ASQSPPPPA

SEQ ID NO: 908043 - protein, 9 aa, Homo Sapiens
HRAQDFVYH

SEQ ID NO: 908044 - protein, 9 aa, Homo Sapiens
HRGTCQDWA

SEQ ID NO: 908045 - protein, 9 aa, Homo Sapiens
EDPFEFNDS

SEQ ID NO: 908046 - protein, 9 aa, Homo Sapiens
PHPRPPCPQ

SEQ ID NO: 908047 - protein, 9 aa, Homo Sapiens
SDANDPFAQ

SEQ ID NO: 908048 - protein, 9 aa, Homo Sapiens
TPPQCLPPR

SEQ ID NO: 908049 - protein, 9 aa, Homo Sapiens
LWPPPLPPQ

SEQ ID NO: 908050 - protein, 9 aa, Homo Sapiens
PGNLFIGGL

SEQ ID NO: 908051 - protein, 9 aa, Homo Sapiens
AEADHAAHE

SEQ ID NO: 908052 - protein, 9 aa, Homo Sapiens
HWKEAMLTH

SEQ ID NO: 908053 - protein, 9 aa, Homo Sapiens
EEDTFEVYI

SEQ ID NO: 908054 - protein, 9 aa, Homo Sapiens
DVIEQQLWR

SEQ ID NO: 908055 - protein, 9 aa, Homo Sapiens
PTQVVHRAQ

SEQ ID NO: 908056 - protein, 9 aa, Homo Sapiens
LDPHAIDTY

SEQ ID NO: 908057 - protein, 9 aa, Homo Sapiens
NRWGKMMKK

SEQ ID NO: 908058 - protein, 9 aa, Homo Sapiens
ILSFNAPSC

SEQ ID NO: 908059 - protein, 9 aa, Homo Sapiens
LGILSFNAP

SEQ ID NO: 908060 - protein, 9 aa, Homo Sapiens
GAKDRCIRK

SEQ ID NO: 908061 - protein, 9 aa, Homo Sapiens
HALCCYCQA

SEQ ID NO: 908062 - protein, 9 aa, Homo Sapiens
AKSLVISPP

SEQ ID NO: 908063 - protein, 9 aa, Homo Sapiens
NQTIQAESY

SEQ ID NO: 908064 - protein, 9 aa, Homo Sapiens
LDLTLPNST

SEQ ID NO: 908065 - protein, 9 aa, Homo Sapiens
SIHTGQKPY

SEQ ID NO: 908066 - protein, 9 aa, Homo Sapiens
VGQVVLLNY

SEQ ID NO: 908067 - protein, 9 aa, Homo Sapiens
LLNYNPDNP

SEQ ID NO: 908068 - protein, 9 aa, Homo Sapiens
HARLQCGSA

SEQ ID NO: 908069 - protein, 9 aa, Homo Sapiens
AQGRHARLQ

SEQ ID NO: 908070 - protein, 9 aa, Homo Sapiens
GQVVLLNYN

SEQ ID NO: 908071 - protein, 9 aa, Homo Sapiens
FCGPNILDT

SEQ ID NO: 908072 - protein, 9 aa, Homo Sapiens
DSGETLQCP

SEQ ID NO: 908073 - protein, 9 aa, Homo Sapiens
LHWKEAMLT

SEQ ID NO: 908074 - protein, 9 aa, Homo Sapiens
KMMKKKREQ

SEQ ID NO: 908075 - protein, 9 aa, Homo Sapiens
PQPGPPALW

SEQ ID NO: 908076 - protein, 9 aa, Homo Sapiens
AQRAGFETA

SEQ ID NO: 908077 - protein, 9 aa, Homo Sapiens
FSDQLFPCD

SEQ ID NO: 908078 - protein, 9 aa, Homo Sapiens
TAIVHNVHS

SEQ ID NO: 908079 - protein, 9 aa, Homo Sapiens
FKIVLAIGN

SEQ ID NO: 908080 - protein, 9 aa, Homo Sapiens
IGVETKLNR

SEQ ID NO: 908081 - protein, 9 aa, Homo Sapiens
GFILRLPFW

SEQ ID NO: 908082 - protein, 9 aa, Homo Sapiens
GSAQPPHPQ

SEQ ID NO: 908083 - protein, 9 aa, Homo Sapiens
QPGPPALWP

SEQ ID NO: 908084 - protein, 9 aa, Homo Sapiens
EEVNKLLGG

SEQ ID NO: 908085 - protein, 9 aa, Homo Sapiens
EISDNVVAK

SEQ ID NO: 908086 - protein, 9 aa, Homo Sapiens
QPPHPRPPC

SEQ ID NO: 908087 - protein, 9 aa, Homo Sapiens
CLPPRPPQP

SEQ ID NO: 908088 - protein, 9 aa, Homo Sapiens
SQPCFHRGT

SEQ ID NO: 908089 - protein, 9 aa, Homo Sapiens
KAQYSQGKS

SEQ ID NO: 908090 - protein, 9 aa, Homo Sapiens
TLPKCRLPQ

SEQ ID NO: 908091 - protein, 9 aa, Homo Sapiens
PALWPPPLP

SEQ ID NO: 908092 - protein, 9 aa, Homo Sapiens
LGQRTHATP

SEQ ID NO: 908093 - protein, 9 aa, Homo Sapiens
RKAQYSQGK

SEQ ID NO: 908094 - protein, 9 aa, Homo Sapiens
EHWSIHTGQ

SEQ ID NO: 908095 - protein, 9 aa, Homo Sapiens
SQSPPPPAQ

SEQ ID NO: 908096 - protein, 9 aa, Homo Sapiens
VSEPSEISD

SEQ ID NO: 908097 - protein, 9 aa, Homo Sapiens
RLSQPPHPR

SEQ ID NO: 908098 - protein, 9 aa, Homo Sapiens
ARLQCGSAQ

SEQ ID NO: 908099 - protein, 9 aa, Homo Sapiens
EVNKLLGGV

SEQ ID NO: 908100 - protein, 9 aa, Homo Sapiens
WLSNASLQT

SEQ ID NO: 908101 - protein, 9 aa, Homo Sapiens
DANDPFAQW

SEQ ID NO: 908102 - protein, 9 aa, Homo Sapiens
AGPLGFNDR

SEQ ID NO: 908103 - protein, 9 aa, Homo Sapiens
WKFSDQLFP

SEQ ID NO: 908104 - protein, 9 aa, Homo Sapiens
HVEVKAKSL

SEQ ID NO: 908105 - protein, 9 aa, Homo Sapiens
AKDRCIRKS

SEQ ID NO: 908106 - protein, 9 aa, Homo Sapiens
PHPPPLQRL

SEQ ID NO: 908107 - protein, 9 aa, Homo Sapiens
CDSQPCFHR

SEQ ID NO: 908108 - protein, 9 aa, Homo Sapiens
TAIRKAQYS

SEQ ID NO: 908109 - protein, 9 aa, Homo Sapiens
NILDTFYCD

SEQ ID NO: 908110 - protein, 9 aa, Homo Sapiens
PLGFNDRRI

SEQ ID NO: 908111 - protein, 9 aa, Homo Sapiens
MVEADRPGN

SEQ ID NO: 908112 - protein, 9 aa, Homo Sapiens
GPPALWPPP

SEQ ID NO: 908113 - protein, 9 aa, Homo Sapiens
PHPQPVAPR

SEQ ID NO: 908114 - protein, 9 aa, Homo Sapiens
WIQLFLDLP

SEQ ID NO: 908115 - protein, 9 aa, Homo Sapiens
KKKREQHEI

SEQ ID NO: 908116 - protein, 9 aa, Homo Sapiens
ADHAAHEEM

SEQ ID NO: 908117 - protein, 9 aa, Homo Sapiens
CGSAQPPHP

SEQ ID NO: 908118 - protein, 9 aa, Homo Sapiens
AVRNDEEVN

SEQ ID NO: 908119 - protein, 9 aa, Homo Sapiens
KKHALCCYC

SEQ ID NO: 908120 - protein, 9 aa, Homo Sapiens
KSLVISPPA

SEQ ID NO: 908121 - protein, 9 aa, Homo Sapiens
VSVAVMHHP

SEQ ID NO: 908122 - protein, 9 aa, Homo Sapiens
RLQCGSAQP

SEQ ID NO: 908123 - protein, 9 aa, Homo Sapiens
GLVDSGETL

SEQ ID NO: 908124 - protein, 9 aa, Homo Sapiens
QGRHARLQC

SEQ ID NO: 908125 - protein, 9 aa, Homo Sapiens
CPQPHPPPL

SEQ ID NO: 908126 - protein, 9 aa, Homo Sapiens
TQVVHRAQD

SEQ ID NO: 908127 - protein, 9 aa, Homo Sapiens
EVKAKSLVI

SEQ ID NO: 908128 - protein, 9 aa, Homo Sapiens
MHHPLYHEC

SEQ ID NO: 908129 - protein, 9 aa, Homo Sapiens
RCVACCRQL

SEQ ID NO: 908130 - protein, 9 aa, Homo Sapiens
PPPLPPQEQ

SEQ ID NO: 908131 - protein, 9 aa, Homo Sapiens
TTSTSLSSP

SEQ ID NO: 908132 - protein, 9 aa, Homo Sapiens
DLLQELKVI

SEQ ID NO: 908133 - protein, 9 aa, Homo Sapiens
DWIQLFLDL

SEQ ID NO: 908134 - protein, 9 aa, Homo Sapiens
LPTPPQCLP

SEQ ID NO: 908135 - protein, 9 aa, Homo Sapiens
EIVRSLSFS

SEQ ID NO: 908136 - protein, 9 aa, Homo Sapiens
PPPAQGRHA

SEQ ID NO: 908137 - protein, 9 aa, Homo Sapiens
GPNILDTFY

SEQ ID NO: 908138 - protein, 9 aa, Homo Sapiens
DLEVGQVVL

SEQ ID NO: 908139 - protein, 9 aa, Homo Sapiens
LPSWKFSDQ

SEQ ID NO: 908140 - protein, 9 aa, Homo Sapiens
SLAEADHAA

SEQ ID NO: 908141 - protein, 9 aa, Homo Sapiens
RLLFGKSAS

SEQ ID NO: 908142 - protein, 9 aa, Homo Sapiens
YRNQTIQAE

SEQ ID NO: 908143 - protein, 9 aa, Homo Sapiens
CFHRGTCQD

SEQ ID NO: 908144 - protein, 9 aa, Homo Sapiens
EDTFEVYIY

SEQ ID NO: 908145 - protein, 9 aa, Homo Sapiens
TNIPAKDAP

SEQ ID NO: 908146 - protein, 9 aa, Homo Sapiens
IRKAQYSQG

SEQ ID NO: 908147 - protein, 9 aa, Homo Sapiens
RPPCPQPHP

SEQ ID NO: 908148 - protein, 9 aa, Homo Sapiens
GRHARLQCG

SEQ ID NO: 908149 - protein, 9 aa, Homo Sapiens
EHRDLLQEL

SEQ ID NO: 908150 - protein, 9 aa, Homo Sapiens
SSPQLGQRT

SEQ ID NO: 908151 - protein, 9 aa, Homo Sapiens
GPLGFNDRR

SEQ ID NO: 908152 - protein, 9 aa, Homo Sapiens
MMKKKREQH

SEQ ID NO: 908153 - protein, 9 aa, Homo Sapiens
EIHVEVKAK

SEQ ID NO: 908154 - protein, 9 aa, Homo Sapiens
HRDLLQELK

SEQ ID NO: 908155 - protein, 9 aa, Homo Sapiens
CIRKSCRNP

SEQ ID NO: 908156 - protein, 9 aa, Homo Sapiens
DPFEFNDSG

SEQ ID NO: 908157 - protein, 9 aa, Homo Sapiens
IEQQLWRGM

SEQ ID NO: 908158 - protein, 9 aa, Homo Sapiens
LTLPKCRLP

SEQ ID NO: 908159 - protein, 9 aa, Homo Sapiens
GEFTTSYKE

SEQ ID NO: 908160 - protein, 9 aa, Homo Sapiens
QCGSAQPPH

SEQ ID NO: 908161 - protein, 9 aa, Homo Sapiens
GSLAEADHA

SEQ ID NO: 908162 - protein, 9 aa, Homo Sapiens
ISDNVVAKD

SEQ ID NO: 908163 - protein, 9 aa, Homo Sapiens
AGLVDSGET

SEQ ID NO: 908164 - protein, 9 aa, Homo Sapiens
PRPPCPQPH

SEQ ID NO: 908165 - protein, 9 aa, Homo Sapiens
LQPAAVYEI

SEQ ID NO: 908166 - protein, 9 aa, Homo Sapiens
VEVKAKSLV

SEQ ID NO: 908167 - protein, 9 aa, Homo Sapiens
VYIYVTIKD

SEQ ID NO: 908168 - protein, 9 aa, Homo Sapiens
TSTSLSSPL

SEQ ID NO: 908169 - protein, 9 aa, Homo Sapiens
LSNASLQTA

SEQ ID NO: 908170 - protein, 9 aa, Homo Sapiens
KELSRGQSQ

SEQ ID NO: 908171 - protein, 9 aa, Homo Sapiens
NSHLVEHWS

SEQ ID NO: 908172 - protein, 9 aa, Homo Sapiens
KFSDQLFPC

SEQ ID NO: 908173 - protein, 9 aa, Homo Sapiens
QPCFHRGTC

SEQ ID NO: 908174 - protein, 9 aa, Homo Sapiens
VMHHPLYHE

SEQ ID NO: 908175 - protein, 9 aa, Homo Sapiens
SYKELSRGQ

SEQ ID NO: 908176 - protein, 9 aa, Homo Sapiens
TSLSSPLGT

SEQ ID NO: 908177 - protein, 9 aa, Homo Sapiens
PCPQPHPPP

SEQ ID NO: 908178 - protein, 9 aa, Homo Sapiens
ALCCYCQAM

SEQ ID NO: 908179 - protein, 9 aa, Homo Sapiens
KRLLFGKSA

SEQ ID NO: 908180 - protein, 9 aa, Homo Sapiens
LPNSTPGFS

SEQ ID NO: 908181 - protein, 9 aa, Homo Sapiens
QQLWRGMRG

SEQ ID NO: 908182 - protein, 9 aa, Homo Sapiens
FHRGTCQDW

SEQ ID NO: 908183 - protein, 9 aa, Homo Sapiens
GIPPTQVVH

SEQ ID NO: 908184 - protein, 9 aa, Homo Sapiens
DHAAHEEME

SEQ ID NO: 908185 - protein, 9 aa, Homo Sapiens
QTTSTSLSS

SEQ ID NO: 908186 - protein, 9 aa, Homo Sapiens
DPFAQWSTE

SEQ ID NO: 908187 - protein, 9 aa, Homo Sapiens
TSIGVETKL

SEQ ID NO: 908188 - protein, 9 aa, Homo Sapiens
PKCRLPQPR

SEQ ID NO: 908189 - protein, 9 aa, Homo Sapiens
YIYVTIKDE

SEQ ID NO: 908190 - protein, 9 aa, Homo Sapiens
DAPPVEKID

SEQ ID NO: 908191 - protein, 9 aa, Homo Sapiens
SPQLGQRTH

SEQ ID NO: 908192 - protein, 9 aa, Homo Sapiens
PPPLQRLPT

SEQ ID NO: 908193 - protein, 9 aa, Homo Sapiens
EVGQVVLLN

SEQ ID NO: 908194 - protein, 9 aa, Homo Sapiens
AVMHHPLYH

SEQ ID NO: 908195 - protein, 9 aa, Homo Sapiens
KLQPAAVYE

SEQ ID NO: 908196 - protein, 9 aa, Homo Sapiens
TTSIGVETK

SEQ ID NO: 908197 - protein, 9 aa, Homo Sapiens
PPQCLPPRP

SEQ ID NO: 908198 - protein, 9 aa, Homo Sapiens
QQQEAWLSN

SEQ ID NO: 908199 - protein, 9 aa, Homo Sapiens
PQCLPPRPP

SEQ ID NO: 908200 - protein, 9 aa, Homo Sapiens
APPVEKIDT

SEQ ID NO: 908201 - protein, 9 aa, Homo Sapiens
TQTTSTSLS

SEQ ID NO: 908202 - protein, 9 aa, Homo Sapiens
LFGKSASVD

SEQ ID NO: 908203 - protein, 9 aa, Homo Sapiens
PRPPQPGPP

SEQ ID NO: 908204 - protein, 9 aa, Homo Sapiens
TLPNSTPGF

SEQ ID NO: 908205 - protein, 9 aa, Homo Sapiens
AKDAPPVEK

SEQ ID NO: 908206 - protein, 9 aa, Homo Sapiens
TRLSQPPHP

SEQ ID NO: 908207 - protein, 9 aa, Homo Sapiens
VEADRPGNL

SEQ ID NO: 908208 - protein, 9 aa, Homo Sapiens
QEAWLSNAS

SEQ ID NO: 908209 - protein, 9 aa, Homo Sapiens
QVVHRAQDF

SEQ ID NO: 908210 - protein, 9 aa, Homo Sapiens
PPALWPPPL

SEQ ID NO: 908211 - protein, 9 aa, Homo Sapiens
SIGVETKLN

SEQ ID NO: 908212 - protein, 9 aa, Homo Sapiens
HPRPPCPQP

SEQ ID NO: 908213 - protein, 9 aa, Homo Sapiens
DWPPRVVDY

SEQ ID NO: 908214 - protein, 9 aa, Homo Sapiens
TEDDVIEQQ

SEQ ID NO: 908215 - protein, 9 aa, Homo Sapiens
ILGGGGGGK

SEQ ID NO: 908216 - protein, 9 aa, Homo Sapiens
IIVGFILRL

SEQ ID NO: 908217 - protein, 9 aa, Homo Sapiens
PQEQLTLPK

SEQ ID NO: 908218 - protein, 9 aa, Homo Sapiens
LSFNAPSCG

SEQ ID NO: 908219 - protein, 9 aa, Homo Sapiens
MGGIIVGFI

SEQ ID NO: 908220 - protein, 9 aa, Homo Sapiens
RNQTIQAES

SEQ ID NO: 908221 - protein, 9 aa, Homo Sapiens
PLQRLPTPP

SEQ ID NO: 908222 - protein, 9 aa, Homo Sapiens
DPHAIDTYA

SEQ ID NO: 908223 - protein, 9 aa, Homo Sapiens
AAHEEMEAH

SEQ ID NO: 908224 - protein, 9 aa, Homo Sapiens
RKLQPAAVY

SEQ ID NO: 908225 - protein, 9 aa, Homo Sapiens
KSDANDPFA

SEQ ID NO: 908226 - protein, 9 aa, Homo Sapiens
QCLPPRPPQ

SEQ ID NO: 908227 - protein, 9 aa, Homo Sapiens
GFETAIVHN

SEQ ID NO: 908228 - protein, 9 aa, Homo Sapiens
RHARLQCGS

SEQ ID NO: 908229 - protein, 9 aa, Homo Sapiens
GQKKHALCC

SEQ ID NO: 908230 - protein, 9 aa, Homo Sapiens
RLPTPPQCL

SEQ ID NO: 908231 - protein, 9 aa, Homo Sapiens
KVLGILSFN

SEQ ID NO: 908232 - protein, 9 aa, Homo Sapiens
CRLPQPRAS

SEQ ID NO: 908233 - protein, 9 aa, Homo Sapiens
SPPPPAQGR

SEQ ID NO: 908234 - protein, 9 aa, Homo Sapiens
IVGFILRLP

SEQ ID NO: 908235 - protein, 9 aa, Homo Sapiens
LILEDPFEF

SEQ ID NO: 908236 - protein, 9 aa, Homo Sapiens
QKEHRDLLQ

SEQ ID NO: 908237 - protein, 9 aa, Homo Sapiens
PPQPGPPAL

SEQ ID NO: 908238 - protein, 9 aa, Homo Sapiens
KGQKSDAND

SEQ ID NO: 908239 - protein, 9 aa, Homo Sapiens
REALEEAIA

SEQ ID NO: 908240 - protein, 9 aa, Homo Sapiens
RFGSFLTPL

SEQ ID NO: 908241 - protein, 9 aa, Homo Sapiens
GDWILKGNL

SEQ ID NO: 908242 - protein, 9 aa, Homo Sapiens
QQCGPGPYP

SEQ ID NO: 908243 - protein, 9 aa, Homo Sapiens
LRVPETRPS

SEQ ID NO: 908244 - protein, 9 aa, Homo Sapiens
NNLATSEAT

SEQ ID NO: 908245 - protein, 9 aa, Homo Sapiens
VGSSAMITN

SEQ ID NO: 908246 - protein, 9 aa, Homo Sapiens
VMLGYTQGF

SEQ ID NO: 908247 - protein, 9 aa, Homo Sapiens
KLFREQRPQ

SEQ ID NO: 908248 - protein, 9 aa, Homo Sapiens
PHDPHLPLA

SEQ ID NO: 908249 - protein, 9 aa, Homo Sapiens
LHSKLKEIN

SEQ ID NO: 908250 - protein, 9 aa, Homo Sapiens
CSCQALDDI

SEQ ID NO: 908251 - protein, 9 aa, Homo Sapiens
KLWMESHLR

SEQ ID NO: 908252 - protein, 9 aa, Homo Sapiens
RAFHKLFRE

SEQ ID NO: 908253 - protein, 9 aa, Homo Sapiens
SCQALDDIF

SEQ ID NO: 908254 - protein, 9 aa, Homo Sapiens
PVSRHPGSA

SEQ ID NO: 908255 - protein, 9 aa, Homo Sapiens
YREALEEAI

SEQ ID NO: 908256 - protein, 9 aa, Homo Sapiens
EELSAKRGL

SEQ ID NO: 908257 - protein, 9 aa, Homo Sapiens
SAVDLGSDE

SEQ ID NO: 908258 - protein, 9 aa, Homo Sapiens
SSQNMNHEY

SEQ ID NO: 908259 - protein, 9 aa, Homo Sapiens
SAMITNSGA

SEQ ID NO: 908260 - protein, 9 aa, Homo Sapiens
HWDPKIFTA

SEQ ID NO: 908261 - protein, 9 aa, Homo Sapiens
RVPETRPSP

SEQ ID NO: 908262 - protein, 9 aa, Homo Sapiens
LEYHHLEVV

SEQ ID NO: 908263 - protein, 9 aa, Homo Sapiens
MLGYTQGFF

SEQ ID NO: 908264 - protein, 9 aa, Homo Sapiens
QELILHCVP

SEQ ID NO: 908265 - protein, 9 aa, Homo Sapiens
MDPEGDWIL

SEQ ID NO: 908266 - protein, 9 aa, Homo Sapiens
TSSQNMNHE

SEQ ID NO: 908267 - protein, 9 aa, Homo Sapiens
GPGLPRLPL

SEQ ID NO: 908268 - protein, 9 aa, Homo Sapiens
YSLLPPHDP

SEQ ID NO: 908269 - protein, 9 aa, Homo Sapiens
EDIRFPASA

SEQ ID NO: 908270 - protein, 9 aa, Homo Sapiens
HDPHLPLAS

SEQ ID NO: 908271 - protein, 9 aa, Homo Sapiens
QGRLALAAM

SEQ ID NO: 908272 - protein, 9 aa, Homo Sapiens
AVDLGSDEV

SEQ ID NO: 908273 - protein, 9 aa, Homo Sapiens
ALPLPGEGF

SEQ ID NO: 908274 - protein, 9 aa, Homo Sapiens
ISLLGFAIF

SEQ ID NO: 908275 - protein, 9 aa, Homo Sapiens
EDLEELSAK

SEQ ID NO: 908276 - protein, 9 aa, Homo Sapiens
PGEGFGPSP

SEQ ID NO: 908277 - protein, 9 aa, Homo Sapiens
HSKLKEINQ

SEQ ID NO: 908278 - protein, 9 aa, Homo Sapiens
LTVTSSQNM

SEQ ID NO: 908279 - protein, 9 aa, Homo Sapiens
TGINVQQGR

SEQ ID NO: 908280 - protein, 9 aa, Homo Sapiens
AFHKLFREQ

SEQ ID NO: 908281 - protein, 9 aa, Homo Sapiens
AAFKCSCQA

SEQ ID NO: 908282 - protein, 9 aa, Homo Sapiens
TQKEFDRVM

SEQ ID NO: 908283 - protein, 9 aa, Homo Sapiens
GPGPYPQWN

SEQ ID NO: 908284 - protein, 9 aa, Homo Sapiens
LEDWLHSKL

SEQ ID NO: 908285 - protein, 9 aa, Homo Sapiens
KKLTVTSSQ

SEQ ID NO: 908286 - protein, 9 aa, Homo Sapiens
DRVMLGYTQ

SEQ ID NO: 908287 - protein, 9 aa, Homo Sapiens
WMESHLRVP

SEQ ID NO: 908288 - protein, 9 aa, Homo Sapiens
DLEELSAKR

SEQ ID NO: 908289 - protein, 9 aa, Homo Sapiens
AIALREANP

SEQ ID NO: 908290 - protein, 9 aa, Homo Sapiens
LWMESHLRV

SEQ ID NO: 908291 - protein, 9 aa, Homo Sapiens
KLKEINQTR

SEQ ID NO: 908292 - protein, 9 aa, Homo Sapiens
LLSSAVDLG

SEQ ID NO: 908293 - protein, 9 aa, Homo Sapiens
IIVFQEDFK

SEQ ID NO: 908294 - protein, 9 aa, Homo Sapiens
TNSGATITS

SEQ ID NO: 908295 - protein, 9 aa, Homo Sapiens
SLLPPHDPH

SEQ ID NO: 908296 - protein, 9 aa, Homo Sapiens
QSYSRDMVC

SEQ ID NO: 908297 - protein, 9 aa, Homo Sapiens
LKEINQTRD

SEQ ID NO: 908298 - protein, 9 aa, Homo Sapiens
LSAKRGLEG

SEQ ID NO: 908299 - protein, 9 aa, Homo Sapiens
SEGTNPLAS

SEQ ID NO: 908300 - protein, 9 aa, Homo Sapiens
FEDIRFPAS

SEQ ID NO: 908301 - protein, 9 aa, Homo Sapiens
ILKGNLLII

SEQ ID NO: 908302 - protein, 9 aa, Homo Sapiens
QCPAPLFYV

SEQ ID NO: 908303 - protein, 9 aa, Homo Sapiens
EALEEAIAL

SEQ ID NO: 908304 - protein, 9 aa, Homo Sapiens
AKRGLEGES

SEQ ID NO: 908305 - protein, 9 aa, Homo Sapiens
QNLRNNLAT

SEQ ID NO: 908306 - protein, 9 aa, Homo Sapiens
LIGCTKTSL

SEQ ID NO: 908307 - protein, 9 aa, Homo Sapiens
NVQQGRLAL

SEQ ID NO: 908308 - protein, 9 aa, Homo Sapiens
KEFDRVMLG

SEQ ID NO: 908309 - protein, 9 aa, Homo Sapiens
RSPQNLRNN

SEQ ID NO: 908310 - protein, 9 aa, Homo Sapiens
NLATSEATT

SEQ ID NO: 908311 - protein, 9 aa, Homo Sapiens
EFGRFGSFL

SEQ ID NO: 908312 - protein, 9 aa, Homo Sapiens
AFKCSCQAL

SEQ ID NO: 908313 - protein, 9 aa, Homo Sapiens
SLLGFAIFL

SEQ ID NO: 908314 - protein, 9 aa, Homo Sapiens
PKIFTAYDV

SEQ ID NO: 908315 - protein, 9 aa, Homo Sapiens
VSRHPGSAA

SEQ ID NO: 908316 - protein, 9 aa, Homo Sapiens
PQNLRNNLA

SEQ ID NO: 908317 - protein, 9 aa, Homo Sapiens
CPAPLFYVP

SEQ ID NO: 908318 - protein, 9 aa, Homo Sapiens
LFYVPRILL

SEQ ID NO: 908319 - protein, 9 aa, Homo Sapiens
LRYVLEQSY

SEQ ID NO: 908320 - protein, 9 aa, Homo Sapiens
AHWDPKIFT

SEQ ID NO: 908321 - protein, 9 aa, Homo Sapiens
RYVLEQSYS

SEQ ID NO: 908322 - protein, 9 aa, Homo Sapiens
NLRNNLATS

SEQ ID NO: 908323 - protein, 9 aa, Homo Sapiens
TYSLLPPHD

SEQ ID NO: 908324 - protein, 9 aa, Homo Sapiens
PPPPGPGLP

SEQ ID NO: 908325 - protein, 9 aa, Homo Sapiens
FLTPLGDLD

SEQ ID NO: 908326 - protein, 9 aa, Homo Sapiens
ELSAKRGLE

SEQ ID NO: 908327 - protein, 9 aa, Homo Sapiens
GCTKTSLAK

SEQ ID NO: 908328 - protein, 9 aa, Homo Sapiens
EYHHLEVVA

SEQ ID NO: 908329 - protein, 9 aa, Homo Sapiens
SSAMITNSG

SEQ ID NO: 908330 - protein, 9 aa, Homo Sapiens
TKTSLAKYC

SEQ ID NO: 908331 - protein, 9 aa, Homo Sapiens
PEGDWILKG

SEQ ID NO: 908332 - protein, 9 aa, Homo Sapiens
DWLHSKLKE

SEQ ID NO: 908333 - protein, 9 aa, Homo Sapiens
KIFTAYDVF

SEQ ID NO: 908334 - protein, 9 aa, Homo Sapiens
PGLPRLPLP

SEQ ID NO: 908335 - protein, 9 aa, Homo Sapiens
PAPLFYVPR

SEQ ID NO: 908336 - protein, 9 aa, Homo Sapiens
ALEEAIALR

SEQ ID NO: 908337 - protein, 9 aa, Homo Sapiens
QSLEYHHLE

SEQ ID NO: 908338 - protein, 9 aa, Homo Sapiens
GSSAMITNS

SEQ ID NO: 908339 - protein, 9 aa, Homo Sapiens
DIRFPASAL

SEQ ID NO: 908340 - protein, 9 aa, Homo Sapiens
APLFYVPRI

SEQ ID NO: 908341 - protein, 9 aa, Homo Sapiens
KRAAFKCSC

SEQ ID NO: 908342 - protein, 9 aa, Homo Sapiens
QKEFDRVML

SEQ ID NO: 908343 - protein, 9 aa, Homo Sapiens
GEGFGPSPV

SEQ ID NO: 908344 - protein, 9 aa, Homo Sapiens
PLFYVPRIL

SEQ ID NO: 908345 - protein, 9 aa, Homo Sapiens
EDFKCCGLV

SEQ ID NO: 908346 - protein, 9 aa, Homo Sapiens
SFLTPLGDL

SEQ ID NO: 908347 - protein, 9 aa, Homo Sapiens
KKRAAFKCS

SEQ ID NO: 908348 - protein, 9 aa, Homo Sapiens
PGPYPQWNY

SEQ ID NO: 908349 - protein, 9 aa, Homo Sapiens
WILKGNLLI

SEQ ID NO: 908350 - protein, 9 aa, Homo Sapiens
CGPGPYPQW

SEQ ID NO: 908351 - protein, 9 aa, Homo Sapiens
GKKLTVTSS

SEQ ID NO: 908352 - protein, 9 aa, Homo Sapiens
MITNSGATI

SEQ ID NO: 908353 - protein, 9 aa, Homo Sapiens
LPPPVSRHP

SEQ ID NO: 908354 - protein, 9 aa, Homo Sapiens
HPGSAATTK

SEQ ID NO: 908355 - protein, 9 aa, Homo Sapiens
GSFLTPLGD

SEQ ID NO: 908356 - protein, 9 aa, Homo Sapiens
KVKKRRQVY

SEQ ID NO: 908357 - protein, 9 aa, Homo Sapiens
VTYSLLPPH

SEQ ID NO: 908358 - protein, 9 aa, Homo Sapiens
LRNNLATSE

SEQ ID NO: 908359 - protein, 9 aa, Homo Sapiens
PPPVSRHPG

SEQ ID NO: 908360 - protein, 9 aa, Homo Sapiens
TQMGQELIL

SEQ ID NO: 908361 - protein, 9 aa, Homo Sapiens
FHKLFREQR

SEQ ID NO: 908362 - protein, 9 aa, Homo Sapiens
DPKIFTAYD

SEQ ID NO: 908363 - protein, 9 aa, Homo Sapiens
QQGRLALAA

SEQ ID NO: 908364 - protein, 9 aa, Homo Sapiens
IFTAYDVFR

SEQ ID NO: 908365 - protein, 9 aa, Homo Sapiens
MESHLRVPE

SEQ ID NO: 908366 - protein, 9 aa, Homo Sapiens
GRLALAAMR

SEQ ID NO: 908367 - protein, 9 aa, Homo Sapiens
AMITNSGAT

SEQ ID NO: 908368 - protein, 9 aa, Homo Sapiens
PYPQWNYGN

SEQ ID NO: 908369 - protein, 9 aa, Homo Sapiens
ERAFHKLFR

SEQ ID NO: 908370 - protein, 9 aa, Homo Sapiens
MGQELILHC

SEQ ID NO: 908371 - protein, 9 aa, Homo Sapiens
VDLGSDEVK

SEQ ID NO: 908372 - protein, 9 aa, Homo Sapiens
LPRLPLPLL

SEQ ID NO: 908373 - protein, 9 aa, Homo Sapiens
FGRFGSFLT

SEQ ID NO: 908374 - protein, 9 aa, Homo Sapiens
LLRYVLEQS

SEQ ID NO: 908375 - protein, 9 aa, Homo Sapiens
TNPLASMPV

SEQ ID NO: 908376 - protein, 9 aa, Homo Sapiens
FKCSCQALD

SEQ ID NO: 908377 - protein, 9 aa, Homo Sapiens
PGPGLPRLP

SEQ ID NO: 908378 - protein, 9 aa, Homo Sapiens
PPHDPHLPL

SEQ ID NO: 908379 - protein, 9 aa, Homo Sapiens
YPQWNYGNW

SEQ ID NO: 908380 - protein, 9 aa, Homo Sapiens
QEDFKCCGL

SEQ ID NO: 908381 - protein, 9 aa, Homo Sapiens
RAAFKCSCQ

SEQ ID NO: 908382 - protein, 9 aa, Homo Sapiens
NSGATITSG

SEQ ID NO: 908383 - protein, 9 aa, Homo Sapiens
EFDRVMLGY

SEQ ID NO: 908384 - protein, 9 aa, Homo Sapiens
GINVQQGRL

SEQ ID NO: 908385 - protein, 9 aa, Homo Sapiens
HKLFREQRP

SEQ ID NO: 908386 - protein, 9 aa, Homo Sapiens
PPSEGTNPL

SEQ ID NO: 908387 - protein, 9 aa, Homo Sapiens
SSAVDLGSD

SEQ ID NO: 908388 - protein, 9 aa, Homo Sapiens
DWILKGNLL

SEQ ID NO: 908389 - protein, 9 aa, Homo Sapiens
ELFFEDIRF

SEQ ID NO: 908390 - protein, 9 aa, Homo Sapiens
YVLEQSYSR

SEQ ID NO: 908391 - protein, 9 aa, Homo Sapiens
INVQQGRLA

SEQ ID NO: 908392 - protein, 9 aa, Homo Sapiens
LEQSYSRDM

SEQ ID NO: 908393 - protein, 9 aa, Homo Sapiens
SPPSEGTNP

SEQ ID NO: 908394 - protein, 9 aa, Homo Sapiens
GTNPLASMP

SEQ ID NO: 908395 - protein, 9 aa, Homo Sapiens
WDPKIFTAY

SEQ ID NO: 908396 - protein, 9 aa, Homo Sapiens
ALLSSAVDL

SEQ ID NO: 908397 - protein, 9 aa, Homo Sapiens
RFPASALLG

SEQ ID NO: 908398 - protein, 9 aa, Homo Sapiens
TGKKLTVTS

SEQ ID NO: 908399 - protein, 9 aa, Homo Sapiens
VTSSQNMNH

SEQ ID NO: 908400 - protein, 9 aa, Homo Sapiens
IVFQEDFKC

SEQ ID NO: 908401 - protein, 9 aa, Homo Sapiens
TVTSSQNMN

SEQ ID NO: 908402 - protein, 9 aa, Homo Sapiens
VTQMGQELI

SEQ ID NO: 908403 - protein, 9 aa, Homo Sapiens
EEAIALREA

SEQ ID NO: 908404 - protein, 9 aa, Homo Sapiens
PPPGPGLPR

SEQ ID NO: 908405 - protein, 9 aa, Homo Sapiens
CCLIGCTKT

SEQ ID NO: 908406 - protein, 9 aa, Homo Sapiens
GAQCPAPLF

SEQ ID NO: 908407 - protein, 9 aa, Homo Sapiens
SKLKEINQT

SEQ ID NO: 908408 - protein, 9 aa, Homo Sapiens
NPLASMPVS

SEQ ID NO: 908409 - protein, 9 aa, Homo Sapiens
QCGPGPYPQ

SEQ ID NO: 908410 - protein, 9 aa, Homo Sapiens
EQSYSRDMV

SEQ ID NO: 908411 - protein, 9 aa, Homo Sapiens
TPALPLPGE

SEQ ID NO: 908412 - protein, 9 aa, Homo Sapiens
QMGQELILH

SEQ ID NO: 908413 - protein, 9 aa, Homo Sapiens
VFQEDFKCC

SEQ ID NO: 908414 - protein, 9 aa, Homo Sapiens
IALREANPT

SEQ ID NO: 908415 - protein, 9 aa, Homo Sapiens
LEEAIALRE

SEQ ID NO: 908416 - protein, 9 aa, Homo Sapiens
FFEDIRFPA

SEQ ID NO: 908417 - protein, 9 aa, Homo Sapiens
LQQCGPGPY

SEQ ID NO: 908418 - protein, 9 aa, Homo Sapiens
FQSLEYHHL

SEQ ID NO: 908419 - protein, 9 aa, Homo Sapiens
GQELILHCV

SEQ ID NO: 908420 - protein, 9 aa, Homo Sapiens
GRFGSFLTP

SEQ ID NO: 908421 - protein, 9 aa, Homo Sapiens
VLEQSYSRD

SEQ ID NO: 908422 - protein, 9 aa, Homo Sapiens
SHLRVPETR

SEQ ID NO: 908423 - protein, 9 aa, Homo Sapiens
RIAHWDPKI

SEQ ID NO: 908424 - protein, 9 aa, Homo Sapiens
IGCTKTSLA

SEQ ID NO: 908425 - protein, 9 aa, Homo Sapiens
GLPRLPLPL

SEQ ID NO: 908426 - protein, 9 aa, Homo Sapiens
DPEGDWILK

SEQ ID NO: 908427 - protein, 9 aa, Homo Sapiens
TSPPSEGTN

SEQ ID NO: 908428 - protein, 9 aa, Homo Sapiens
RHPGSAATT

SEQ ID NO: 908429 - protein, 9 aa, Homo Sapiens
LEELSAKRG

SEQ ID NO: 908430 - protein, 9 aa, Homo Sapiens
ESHLRVPET

SEQ ID NO: 908431 - protein, 9 aa, Homo Sapiens
DFKCCGLVN

SEQ ID NO: 908432 - protein, 9 aa, Homo Sapiens
FGSFLTPLG

SEQ ID NO: 908433 - protein, 9 aa, Homo Sapiens
SYSRDMVCN

SEQ ID NO: 908434 - protein, 9 aa, Homo Sapiens
ITNSGATIT

SEQ ID NO: 908435 - protein, 9 aa, Homo Sapiens
KLTVTSSQN

SEQ ID NO: 908436 - protein, 9 aa, Homo Sapiens
SPQNLRNNL

SEQ ID NO: 908437 - protein, 9 aa, Homo Sapiens
PLPGEGFGP

SEQ ID NO: 908438 - protein, 9 aa, Homo Sapiens
VKKRRQVYF

SEQ ID NO: 908439 - protein, 9 aa, Homo Sapiens
FYVPRILLG

SEQ ID NO: 908440 - protein, 9 aa, Homo Sapiens
IAHWDPKIF

SEQ ID NO: 908441 - protein, 9 aa, Homo Sapiens
GLPPPVSRH

SEQ ID NO: 908442 - protein, 9 aa, Homo Sapiens
AIIVFQEDF

SEQ ID NO: 908443 - protein, 9 aa, Homo Sapiens
KCSCQALDD

SEQ ID NO: 908444 - protein, 9 aa, Homo Sapiens
PSEGTNPLA

SEQ ID NO: 908445 - protein, 9 aa, Homo Sapiens
YHHLEVVAF

SEQ ID NO: 908446 - protein, 9 aa, Homo Sapiens
RNNLATSEA

SEQ ID NO: 908447 - protein, 9 aa, Homo Sapiens
PPVSRHPGS

SEQ ID NO: 908448 - protein, 9 aa, Homo Sapiens
QVTQMGQEL

SEQ ID NO: 908449 - protein, 9 aa, Homo Sapiens
LPLPGEGFG

SEQ ID NO: 908450 - protein, 9 aa, Homo Sapiens
KVFQSLEYH

SEQ ID NO: 908451 - protein, 9 aa, Homo Sapiens
IRFPASALL

SEQ ID NO: 908452 - protein, 9 aa, Homo Sapiens
EDWLHSKLK

SEQ ID NO: 908453 - protein, 9 aa, Homo Sapiens
PRLPLPLLL

SEQ ID NO: 908454 - protein, 9 aa, Homo Sapiens
VKVFQSLEY

SEQ ID NO: 908455 - protein, 9 aa, Homo Sapiens
LPPHDPHLP

SEQ ID NO: 908456 - protein, 9 aa, Homo Sapiens
SCVERAFHK

SEQ ID NO: 908457 - protein, 9 aa, Homo Sapiens
DLGSDEVKF

SEQ ID NO: 908458 - protein, 9 aa, Homo Sapiens
LPGEGFGPS

SEQ ID NO: 908459 - protein, 9 aa, Homo Sapiens
SAKRGLEGE

SEQ ID NO: 908460 - protein, 9 aa, Homo Sapiens
VFQSLEYHH

SEQ ID NO: 908461 - protein, 9 aa, Homo Sapiens
LSSAVDLGS

SEQ ID NO: 908462 - protein, 9 aa, Homo Sapiens
EGFGPSPVG

SEQ ID NO: 908463 - protein, 9 aa, Homo Sapiens
LGSDEVKFR

SEQ ID NO: 908464 - protein, 9 aa, Homo Sapiens
ELILHCVPI

SEQ ID NO: 908465 - protein, 9 aa, Homo Sapiens
RVMLGYTQG

SEQ ID NO: 908466 - protein, 9 aa, Homo Sapiens
PALPLPGEG

SEQ ID NO: 908467 - protein, 9 aa, Homo Sapiens
LLPPHDPHL

SEQ ID NO: 908468 - protein, 9 aa, Homo Sapiens
LTGINVQQG

SEQ ID NO: 908469 - protein, 9 aa, Homo Sapiens
TISLLGFAI

SEQ ID NO: 908470 - protein, 9 aa, Homo Sapiens
SLEYHHLEV

SEQ ID NO: 908471 - protein, 9 aa, Homo Sapiens
LFFEDIRFP

SEQ ID NO: 908472 - protein, 9 aa, Homo Sapiens
AQCPAPLFY

SEQ ID NO: 908473 - protein, 9 aa, Homo Sapiens
EAIALREAN

SEQ ID NO: 908474 - protein, 9 aa, Homo Sapiens
VQQGRLALA

SEQ ID NO: 908475 - protein, 9 aa, Homo Sapiens
VERAFHKLF

SEQ ID NO: 908476 - protein, 9 aa, Homo Sapiens
EGDWILKGN

SEQ ID NO: 908477 - protein, 9 aa, Homo Sapiens
EAIIVFQED

SEQ ID NO: 908478 - protein, 9 aa, Homo Sapiens
GPYPQWNYG

SEQ ID NO: 908479 - protein, 9 aa, Homo Sapiens
KYKVKKRRQ

SEQ ID NO: 908480 - protein, 9 aa, Homo Sapiens
HLRVPETRP

SEQ ID NO: 908481 - protein, 9 aa, Homo Sapiens
CLIGCTKTS

SEQ ID NO: 908482 - protein, 9 aa, Homo Sapiens
PPGPGLPRL

SEQ ID NO: 908483 - protein, 9 aa, Homo Sapiens
SRHPGSAAT

SEQ ID NO: 908484 - protein, 9 aa, Homo Sapiens
YMDPEGDWI

SEQ ID NO: 908485 - protein, 9 aa, Homo Sapiens
MTISLLGFA

SEQ ID NO: 908486 - protein, 9 aa, Homo Sapiens
CTKTSLAKY

SEQ ID NO: 908487 - protein, 9 aa, Homo Sapiens
FDRVMLGYT

SEQ ID NO: 908488 - protein, 9 aa, Homo Sapiens
KRGLEGESD

SEQ ID NO: 908489 - protein, 9 aa, Homo Sapiens
LKYKVKKRR

SEQ ID NO: 908490 - protein, 9 aa, Homo Sapiens
CVERAFHKL

SEQ ID NO: 908491 - protein, 9 aa, Homo Sapiens
FPASALLGE

SEQ ID NO: 908492 - protein, 9 aa, Homo Sapiens
YKVKKRRQV

SEQ ID NO: 908493 - protein, 9 aa, Homo Sapiens
WLHSKLKEI

SEQ ID NO: 908494 - protein, 9 aa, Homo Sapiens
EGTNPLASM

SEQ ID NO: 908495 - protein, 9 aa, Homo Sapiens
LILHCVPIS

SEQ ID NO: 908496 - protein, 9 aa, Homo Sapiens
DEFGRFGSF

SEQ ID NO: 908497 - protein, 9 aa, Homo Sapiens
FQEDFKCCG

SEQ ID NO: 908498 - protein, 9 aa, Homo Sapiens
QWKWHGGNC

SEQ ID NO: 908499 - protein, 9 aa, Homo Sapiens
RTEVREESE

SEQ ID NO: 908500 - protein, 9 aa, Homo Sapiens
AIETMSMAN

SEQ ID NO: 908501 - protein, 9 aa, Homo Sapiens
SAEKPHACQ

SEQ ID NO: 908502 - protein, 9 aa, Homo Sapiens
TRRRASSVS

SEQ ID NO: 908503 - protein, 9 aa, Homo Sapiens
SVASNCSSE

SEQ ID NO: 908504 - protein, 9 aa, Homo Sapiens
LQTLTRRRA

SEQ ID NO: 908505 - protein, 9 aa, Homo Sapiens
DHEFGALGL

SEQ ID NO: 908506 - protein, 9 aa, Homo Sapiens
SESESVFPG

SEQ ID NO: 908507 - protein, 9 aa, Homo Sapiens
LSREKWNPD

SEQ ID NO: 908508 - protein, 9 aa, Homo Sapiens
CPEQEQQLQ

SEQ ID NO: 908509 - protein, 9 aa, Homo Sapiens
VCRAAVVIQ

SEQ ID NO: 908510 - protein, 9 aa, Homo Sapiens
QEQQLQRLE

SEQ ID NO: 908511 - protein, 9 aa, Homo Sapiens
GTKPDECNE

SEQ ID NO: 908512 - protein, 9 aa, Homo Sapiens
SWQWSDCTP

SEQ ID NO: 908513 - protein, 9 aa, Homo Sapiens
AVHHMCSPA

SEQ ID NO: 908514 - protein, 9 aa, Homo Sapiens
NDHEFGALG

SEQ ID NO: 908515 - protein, 9 aa, Homo Sapiens
QTLTRRRAS

SEQ ID NO: 908516 - protein, 9 aa, Homo Sapiens
SVFPGGRSG

SEQ ID NO: 908517 - protein, 9 aa, Homo Sapiens
NFGFQPDTV

SEQ ID NO: 908518 - protein, 9 aa, Homo Sapiens
AKCQGARYV

SEQ ID NO: 908519 - protein, 9 aa, Homo Sapiens
VPRSPNTGP

SEQ ID NO: 908520 - protein, 9 aa, Homo Sapiens
GRSGSLQTL

SEQ ID NO: 908521 - protein, 9 aa, Homo Sapiens
EWLAKCQGA

SEQ ID NO: 908522 - protein, 9 aa, Homo Sapiens
QLQRLERLP

SEQ ID NO: 908523 - protein, 9 aa, Homo Sapiens
ESELAKPVV

SEQ ID NO: 908524 - protein, 9 aa, Homo Sapiens
KAVHHMCSP

SEQ ID NO: 908525 - protein, 9 aa, Homo Sapiens
GPPPCPGKP

SEQ ID NO: 908526 - protein, 9 aa, Homo Sapiens
VHHMCSPAI

SEQ ID NO: 908527 - protein, 9 aa, Homo Sapiens
QGFGSRQTS

SEQ ID NO: 908528 - protein, 9 aa, Homo Sapiens
VALWKIQLG

SEQ ID NO: 908529 - protein, 9 aa, Homo Sapiens
SNCSSEGSM

SEQ ID NO: 908530 - protein, 9 aa, Homo Sapiens
IMISSRIHH

SEQ ID NO: 908531 - protein, 9 aa, Homo Sapiens
VREESEPEV

SEQ ID NO: 908532 - protein, 9 aa, Homo Sapiens
GSRQTSRHL

SEQ ID NO: 908533 - protein, 9 aa, Homo Sapiens
WLAKCQGAR

SEQ ID NO: 908534 - protein, 9 aa, Homo Sapiens
QLGTPEAPE

SEQ ID NO: 908535 - protein, 9 aa, Homo Sapiens
PHACQQCGK

SEQ ID NO: 908536 - protein, 9 aa, Homo Sapiens
NCSSEGSMS

SEQ ID NO: 908537 - protein, 9 aa, Homo Sapiens
AKPVVYDSC

SEQ ID NO: 908538 - protein, 9 aa, Homo Sapiens
ETSRYSFHY

SEQ ID NO: 908539 - protein, 9 aa, Homo Sapiens
LGTPEAPEF

SEQ ID NO: 908540 - protein, 9 aa, Homo Sapiens
GAAAATAID

SEQ ID NO: 908541 - protein, 9 aa, Homo Sapiens
IQLGTPEAP

SEQ ID NO: 908542 - protein, 9 aa, Homo Sapiens
SRHLVDETM

SEQ ID NO: 908543 - protein, 9 aa, Homo Sapiens
CRAAVVIQA

SEQ ID NO: 908544 - protein, 9 aa, Homo Sapiens
FERLSREKW

SEQ ID NO: 908545 - protein, 9 aa, Homo Sapiens
AATAIDGGG

SEQ ID NO: 908546 - protein, 9 aa, Homo Sapiens
YKENIMISS

SEQ ID NO: 908547 - protein, 9 aa, Homo Sapiens
LVQEWLAKC

SEQ ID NO: 908548 - protein, 9 aa, Homo Sapiens
NARLLIHAV

SEQ ID NO: 908549 - protein, 9 aa, Homo Sapiens
LGKELIEPL

SEQ ID NO: 908550 - protein, 9 aa, Homo Sapiens
RLSREKWNP

SEQ ID NO: 908551 - protein, 9 aa, Homo Sapiens
QRVCRAAVV

SEQ ID NO: 908552 - protein, 9 aa, Homo Sapiens
RQAYQRVCR

SEQ ID NO: 908553 - protein, 9 aa, Homo Sapiens
EFGALGLQQ

SEQ ID NO: 908554 - protein, 9 aa, Homo Sapiens
ERLSREKWN

SEQ ID NO: 908555 - protein, 9 aa, Homo Sapiens
MGITDIAEL

SEQ ID NO: 908556 - protein, 9 aa, Homo Sapiens
LLIHAVPGL

SEQ ID NO: 908557 - protein, 9 aa, Homo Sapiens
TSRHLVDET

SEQ ID NO: 908558 - protein, 9 aa, Homo Sapiens
RVCRAAVVI

SEQ ID NO: 908559 - protein, 9 aa, Homo Sapiens
WQWSDCTPV

SEQ ID NO: 908560 - protein, 9 aa, Homo Sapiens
SFHYLKSGS

SEQ ID NO: 908561 - protein, 9 aa, Homo Sapiens
KCQGARYVW

SEQ ID NO: 908562 - protein, 9 aa, Homo Sapiens
HEFGALGLQ

SEQ ID NO: 908563 - protein, 9 aa, Homo Sapiens
SESVFPGGR

SEQ ID NO: 908564 - protein, 9 aa, Homo Sapiens
TMSMANEKI

SEQ ID NO: 908565 - protein, 9 aa, Homo Sapiens
NAIETMSMA

SEQ ID NO: 908566 - protein, 9 aa, Homo Sapiens
ARLLIHAVP

SEQ ID NO: 908567 - protein, 9 aa, Homo Sapiens
EQEQQLQRL

SEQ ID NO: 908568 - protein, 9 aa, Homo Sapiens
SDCTPVSTI

SEQ ID NO: 908569 - protein, 9 aa, Homo Sapiens
NMFGSFQCE

SEQ ID NO: 908570 - protein, 9 aa, Homo Sapiens
SYAGTKPDE

SEQ ID NO: 908571 - protein, 9 aa, Homo Sapiens
QTSRHLVDE

SEQ ID NO: 908572 - protein, 9 aa, Homo Sapiens
QEWLAKCQG

SEQ ID NO: 908573 - protein, 9 aa, Homo Sapiens
TEPCWQYSV

SEQ ID NO: 908574 - protein, 9 aa, Homo Sapiens
KELIEPLTN

SEQ ID NO: 908575 - protein, 9 aa, Homo Sapiens
VFPGGRSGS

SEQ ID NO: 908576 - protein, 9 aa, Homo Sapiens
RRMMRQRSK

SEQ ID NO: 908577 - protein, 9 aa, Homo Sapiens
ASNCSSEGS

SEQ ID NO: 908578 - protein, 9 aa, Homo Sapiens
ERLPDRTEV

SEQ ID NO: 908579 - protein, 9 aa, Homo Sapiens
EKWNPDCLM

SEQ ID NO: 908580 - protein, 9 aa, Homo Sapiens
AGDFSALES

SEQ ID NO: 908581 - protein, 9 aa, Homo Sapiens
TVPRSPNTG

SEQ ID NO: 908582 - protein, 9 aa, Homo Sapiens
VQEWLAKCQ

SEQ ID NO: 908583 - protein, 9 aa, Homo Sapiens
PVVYDSCNS

SEQ ID NO: 908584 - protein, 9 aa, Homo Sapiens
FQPDTVPRS

SEQ ID NO: 908585 - protein, 9 aa, Homo Sapiens
GTVGDKARV

SEQ ID NO: 908586 - protein, 9 aa, Homo Sapiens
RRLKRKRRM

SEQ ID NO: 908587 - protein, 9 aa, Homo Sapiens
FGALGLQQG

SEQ ID NO: 908588 - protein, 9 aa, Homo Sapiens
MSMANEKIL

SEQ ID NO: 908589 - protein, 9 aa, Homo Sapiens
SGSLQTLTR

SEQ ID NO: 908590 - protein, 9 aa, Homo Sapiens
RLPDRTEVR

SEQ ID NO: 908591 - protein, 9 aa, Homo Sapiens
PCWQYSVHH

SEQ ID NO: 908592 - protein, 9 aa, Homo Sapiens
FWLFIRSFY

SEQ ID NO: 908593 - protein, 9 aa, Homo Sapiens
ENAIETMSM

SEQ ID NO: 908594 - protein, 9 aa, Homo Sapiens
TPTSAEKVD

SEQ ID NO: 908595 - protein, 9 aa, Homo Sapiens
DNDHEFGAL

SEQ ID NO: 908596 - protein, 9 aa, Homo Sapiens
SSEKVTPTS

SEQ ID NO: 908597 - protein, 9 aa, Homo Sapiens
DTVPRSPNT

SEQ ID NO: 908598 - protein, 9 aa, Homo Sapiens
AYQRVCRAA

SEQ ID NO: 908599 - protein, 9 aa, Homo Sapiens
TAIDGGGKE

SEQ ID NO: 908600 - protein, 9 aa, Homo Sapiens
PSYKENIMI

SEQ ID NO: 908601 - protein, 9 aa, Homo Sapiens
CQGGDCVNM

SEQ ID NO: 908602 - protein, 9 aa, Homo Sapiens
GSYAGTKPD

SEQ ID NO: 908603 - protein, 9 aa, Homo Sapiens
VTPTSAEKV

SEQ ID NO: 908604 - protein, 9 aa, Homo Sapiens
VASNCSSEG

SEQ ID NO: 908605 - protein, 9 aa, Homo Sapiens
DRTEVREES

SEQ ID NO: 908606 - protein, 9 aa, Homo Sapiens
ALFGLLAGD

SEQ ID NO: 908607 - protein, 9 aa, Homo Sapiens
SFYDSFRYQ

SEQ ID NO: 908608 - protein, 9 aa, Homo Sapiens
KRRMMRQRS

SEQ ID NO: 908609 - protein, 9 aa, Homo Sapiens
VQMGHSLVG

SEQ ID NO: 908610 - protein, 9 aa, Homo Sapiens
PPPCPGKPE

SEQ ID NO: 908611 - protein, 9 aa, Homo Sapiens
WKWHGGNCY

SEQ ID NO: 908612 - protein, 9 aa, Homo Sapiens
WKIQLGTPE

SEQ ID NO: 908613 - protein, 9 aa, Homo Sapiens
SLKAVHHMC

SEQ ID NO: 908614 - protein, 9 aa, Homo Sapiens
QSQGPPPCP

SEQ ID NO: 908615 - protein, 9 aa, Homo Sapiens
FGSRQTSRH

SEQ ID NO: 908616 - protein, 9 aa, Homo Sapiens
KFERLSREK

SEQ ID NO: 908617 - protein, 9 aa, Homo Sapiens
QPDTVPRSP

SEQ ID NO: 908618 - protein, 9 aa, Homo Sapiens
WQYSVHHEN

SEQ ID NO: 908619 - protein, 9 aa, Homo Sapiens
KIQLGTPEA

SEQ ID NO: 908620 - protein, 9 aa, Homo Sapiens
CPGKPEGPP

SEQ ID NO: 908621 - protein, 9 aa, Homo Sapiens
HMCSPAIPS

SEQ ID NO: 908622 - protein, 9 aa, Homo Sapiens
SMANEKILM

SEQ ID NO: 908623 - protein, 9 aa, Homo Sapiens
RVFPSNYVR

SEQ ID NO: 908624 - protein, 9 aa, Homo Sapiens
HSAEKPHAC

SEQ ID NO: 908625 - protein, 9 aa, Homo Sapiens
ASSVSVGMC

SEQ ID NO: 908626 - protein, 9 aa, Homo Sapiens
ESESVFPGG

SEQ ID NO: 908627 - protein, 9 aa, Homo Sapiens
SLQTLTRRR

SEQ ID NO: 908628 - protein, 9 aa, Homo Sapiens
GNCYQFYKD

SEQ ID NO: 908629 - protein, 9 aa, Homo Sapiens
SQGPPPCPG

SEQ ID NO: 908630 - protein, 9 aa, Homo Sapiens
KPVVYDSCN

SEQ ID NO: 908631 - protein, 9 aa, Homo Sapiens
KVTPTSAEK

SEQ ID NO: 908632 - protein, 9 aa, Homo Sapiens
YRISSVASN

SEQ ID NO: 908633 - protein, 9 aa, Homo Sapiens
VNEFILMGI

SEQ ID NO: 908634 - protein, 9 aa, Homo Sapiens
LPDRTEVRE

SEQ ID NO: 908635 - protein, 9 aa, Homo Sapiens
LTWVQMGHS

SEQ ID NO: 908636 - protein, 9 aa, Homo Sapiens
ARGAAAATA

SEQ ID NO: 908637 - protein, 9 aa, Homo Sapiens
GFGSRQTSR

SEQ ID NO: 908638 - protein, 9 aa, Homo Sapiens
PPCPGKPEG

SEQ ID NO: 908639 - protein, 9 aa, Homo Sapiens
DCTPVSTII

SEQ ID NO: 908640 - protein, 9 aa, Homo Sapiens
MAAAAAAGD

SEQ ID NO: 908641 - protein, 9 aa, Homo Sapiens
QGSWQWSDC

SEQ ID NO: 908642 - protein, 9 aa, Homo Sapiens
PGGRSGSLQ

SEQ ID NO: 908643 - protein, 9 aa, Homo Sapiens
AAATAIDGG

SEQ ID NO: 908644 - protein, 9 aa, Homo Sapiens
WHGGNCYQF

SEQ ID NO: 908645 - protein, 9 aa, Homo Sapiens
GGRSGSLQT

SEQ ID NO: 908646 - protein, 9 aa, Homo Sapiens
LAKCQGARY

SEQ ID NO: 908647 - protein, 9 aa, Homo Sapiens
HGGNCYQFY

SEQ ID NO: 908648 - protein, 9 aa, Homo Sapiens
CVNMFGSFQ

SEQ ID NO: 908649 - protein, 9 aa, Homo Sapiens
GDFSALESC

SEQ ID NO: 908650 - protein, 9 aa, Homo Sapiens
FGLLAGDFS

SEQ ID NO: 908651 - protein, 9 aa, Homo Sapiens
WLFIRSFYD

SEQ ID NO: 908652 - protein, 9 aa, Homo Sapiens
TVGDKARVF

SEQ ID NO: 908653 - protein, 9 aa, Homo Sapiens
MAYKLTWVQ

SEQ ID NO: 908654 - protein, 9 aa, Homo Sapiens
LAKPVVYDS

SEQ ID NO: 908655 - protein, 9 aa, Homo Sapiens
LMGITDIAE

SEQ ID NO: 908656 - protein, 9 aa, Homo Sapiens
PRLGKELIE

SEQ ID NO: 908657 - protein, 9 aa, Homo Sapiens
HHMCSPAIP

SEQ ID NO: 908658 - protein, 9 aa, Homo Sapiens
EPCWQYSVH

SEQ ID NO: 908659 - protein, 9 aa, Homo Sapiens
LLAGDFSAL

SEQ ID NO: 908660 - protein, 9 aa, Homo Sapiens
ISSVASNCS

SEQ ID NO: 908661 - protein, 9 aa, Homo Sapiens
QAYQRVCRA

SEQ ID NO: 908662 - protein, 9 aa, Homo Sapiens
SRQTSRHLV

SEQ ID NO: 908663 - protein, 9 aa, Homo Sapiens
LFGLLAGDF

SEQ ID NO: 908664 - protein, 9 aa, Homo Sapiens
GGDCVNMFG

SEQ ID NO: 908665 - protein, 9 aa, Homo Sapiens
QQLQRLERL

SEQ ID NO: 908666 - protein, 9 aa, Homo Sapiens
SDDNDHEFG

SEQ ID NO: 908667 - protein, 9 aa, Homo Sapiens
NEFILMGIT

SEQ ID NO: 908668 - protein, 9 aa, Homo Sapiens
LFIRSFYDS

SEQ ID NO: 908669 - protein, 9 aa, Homo Sapiens
MANEKILMM

SEQ ID NO: 908670 - protein, 9 aa, Homo Sapiens
RLGKELIEP

SEQ ID NO: 908671 - protein, 9 aa, Homo Sapiens
TWVQMGHSL

SEQ ID NO: 908672 - protein, 9 aa, Homo Sapiens
LEPRLGKEL

SEQ ID NO: 908673 - protein, 9 aa, Homo Sapiens
CSPAIPSAS

SEQ ID NO: 908674 - protein, 9 aa, Homo Sapiens
RASSVSVGM

SEQ ID NO: 908675 - protein, 9 aa, Homo Sapiens
VVYDSCNSE

SEQ ID NO: 908676 - protein, 9 aa, Homo Sapiens
QENARLLIH

SEQ ID NO: 908677 - protein, 9 aa, Homo Sapiens
IHAVPGLLS

SEQ ID NO: 908678 - protein, 9 aa, Homo Sapiens
TSRYSFHYL

SEQ ID NO: 908679 - protein, 9 aa, Homo Sapiens
ELIEPLTNL

SEQ ID NO: 908680 - protein, 9 aa, Homo Sapiens
NIMISSRIH

SEQ ID NO: 908681 - protein, 9 aa, Homo Sapiens
TLTRRRASS

SEQ ID NO: 908682 - protein, 9 aa, Homo Sapiens
SDGSYAGTK

SEQ ID NO: 908683 - protein, 9 aa, Homo Sapiens
AEKPHACQQ

SEQ ID NO: 908684 - protein, 9 aa, Homo Sapiens
RRASSVSVG

SEQ ID NO: 908685 - protein, 9 aa, Homo Sapiens
ILMGITDIA

SEQ ID NO: 908686 - protein, 9 aa, Homo Sapiens
WVQMGHSLV

SEQ ID NO: 908687 - protein, 9 aa, Homo Sapiens
LQENARLLI

SEQ ID NO: 908688 - protein, 9 aa, Homo Sapiens
RLKRKRRMM

SEQ ID NO: 908689 - protein, 9 aa, Homo Sapiens
RYSFHYLKS

SEQ ID NO: 908690 - protein, 9 aa, Homo Sapiens
ESVFPGGRS

SEQ ID NO: 908691 - protein, 9 aa, Homo Sapiens
RQTSRHLVD

SEQ ID NO: 908692 - protein, 9 aa, Homo Sapiens
EQQLQRLER

SEQ ID NO: 908693 - protein, 9 aa, Homo Sapiens
IETMSMANE

SEQ ID NO: 908694 - protein, 9 aa, Homo Sapiens
RGAAAATAI

SEQ ID NO: 908695 - protein, 9 aa, Homo Sapiens
FGFQPDTVP

SEQ ID NO: 908696 - protein, 9 aa, Homo Sapiens
GLLAGDFSA

SEQ ID NO: 908697 - protein, 9 aa, Homo Sapiens
EPRLGKELI

SEQ ID NO: 908698 - protein, 9 aa, Homo Sapiens
ISSDGSYAG

SEQ ID NO: 908699 - protein, 9 aa, Homo Sapiens
QGPPPCPGK

SEQ ID NO: 908700 - protein, 9 aa, Homo Sapiens
TVNEFILMG

SEQ ID NO: 908701 - protein, 9 aa, Homo Sapiens
NQSQGPPPC

SEQ ID NO: 908702 - protein, 9 aa, Homo Sapiens
QWSDCTPVS

SEQ ID NO: 908703 - protein, 9 aa, Homo Sapiens
SSVASNCSS

SEQ ID NO: 908704 - protein, 9 aa, Homo Sapiens
DCVNMFGSF

SEQ ID NO: 908705 - protein, 9 aa, Homo Sapiens
VGDKARVFP

SEQ ID NO: 908706 - protein, 9 aa, Homo Sapiens
PCPGKPEGP

SEQ ID NO: 908707 - protein, 9 aa, Homo Sapiens
SREKWNPDC

SEQ ID NO: 908708 - protein, 9 aa, Homo Sapiens
VHHENKYCD

SEQ ID NO: 908709 - protein, 9 aa, Homo Sapiens
SRYSFHYLK

SEQ ID NO: 908710 - protein, 9 aa, Homo Sapiens
QGGDCVNMF

SEQ ID NO: 908711 - protein, 9 aa, Homo Sapiens
RLLIHAVPG

SEQ ID NO: 908712 - protein, 9 aa, Homo Sapiens
GFQPDTVPR

SEQ ID NO: 908713 - protein, 9 aa, Homo Sapiens
YSVHHENKY

SEQ ID NO: 908714 - protein, 9 aa, Homo Sapiens
FILMGITDI

SEQ ID NO: 908715 - protein, 9 aa, Homo Sapiens
VSSEKVTPT

SEQ ID NO: 908716 - protein, 9 aa, Homo Sapiens
PDTVPRSPN

SEQ ID NO: 908717 - protein, 9 aa, Homo Sapiens
SELAKPVVY

SEQ ID NO: 908718 - protein, 9 aa, Homo Sapiens
AVALWKIQL

SEQ ID NO: 908719 - protein, 9 aa, Homo Sapiens
EKVTPTSAE

SEQ ID NO: 908720 - protein, 9 aa, Homo Sapiens
YAGTKPDEC

SEQ ID NO: 908721 - protein, 9 aa, Homo Sapiens
AIDGGGKED

SEQ ID NO: 908722 - protein, 9 aa, Homo Sapiens
RCPEQEQQL

SEQ ID NO: 908723 - protein, 9 aa, Homo Sapiens
EQWKWHGGN

SEQ ID NO: 908724 - protein, 9 aa, Homo Sapiens
THSAEKPHA

SEQ ID NO: 908725 - protein, 9 aa, Homo Sapiens
HACQQCGKA

SEQ ID NO: 908726 - protein, 9 aa, Homo Sapiens
RKRRMMRQR

SEQ ID NO: 908727 - protein, 9 aa, Homo Sapiens
LKRKRRMMR

SEQ ID NO: 908728 - protein, 9 aa, Homo Sapiens
CQGARYVWN

SEQ ID NO: 908729 - protein, 9 aa, Homo Sapiens
LWKIQLGTP

SEQ ID NO: 908730 - protein, 9 aa, Homo Sapiens
REKWNPDCL

SEQ ID NO: 908731 - protein, 9 aa, Homo Sapiens
KPHACQQCG

SEQ ID NO: 908732 - protein, 9 aa, Homo Sapiens
RRRASSVSV

SEQ ID NO: 908733 - protein, 9 aa, Homo Sapiens
IESELAKPV

SEQ ID NO: 908734 - protein, 9 aa, Homo Sapiens
LKAVHHMCS

SEQ ID NO: 908735 - protein, 9 aa, Homo Sapiens
KLTWVQMGH

SEQ ID NO: 908736 - protein, 9 aa, Homo Sapiens
TEQWKWHGG

SEQ ID NO: 908737 - protein, 9 aa, Homo Sapiens
TGTVGDKAR

SEQ ID NO: 908738 - protein, 9 aa, Homo Sapiens
CTPVSTIIM

SEQ ID NO: 908739 - protein, 9 aa, Homo Sapiens
KRKRRMMRQ

SEQ ID NO: 908740 - protein, 9 aa, Homo Sapiens
SVHHENKYC

SEQ ID NO: 908741 - protein, 9 aa, Homo Sapiens
ENARLLIHA

SEQ ID NO: 908742 - protein, 9 aa, Homo Sapiens
YQRVCRAAV

SEQ ID NO: 908743 - protein, 9 aa, Homo Sapiens
RSGSLQTLT

SEQ ID NO: 908744 - protein, 9 aa, Homo Sapiens
FALFGLLAG

SEQ ID NO: 908745 - protein, 9 aa, Homo Sapiens
PDRTEVREE

SEQ ID NO: 908746 - protein, 9 aa, Homo Sapiens
DDNDHEFGA

SEQ ID NO: 908747 - protein, 9 aa, Homo Sapiens
YSFHYLKSG

SEQ ID NO: 908748 - protein, 9 aa, Homo Sapiens
QYSVHHENK

SEQ ID NO: 908749 - protein, 9 aa, Homo Sapiens
SYKENIMIS

SEQ ID NO: 908750 - protein, 9 aa, Homo Sapiens
RSFYDSFRY

SEQ ID NO: 908751 - protein, 9 aa, Homo Sapiens
GSLQTLTRR

SEQ ID NO: 908752 - protein, 9 aa, Homo Sapiens
KARVFPSNY

SEQ ID NO: 908753 - protein, 9 aa, Homo Sapiens
CWQYSVHHE

SEQ ID NO: 908754 - protein, 9 aa, Homo Sapiens
TRCPEQEQQ

SEQ ID NO: 908755 - protein, 9 aa, Homo Sapiens
QKFERLSRE

SEQ ID NO: 908756 - protein, 9 aa, Homo Sapiens
YLKSGSLYS

SEQ ID NO: 908757 - protein, 9 aa, Homo Sapiens
TEVREESEP

SEQ ID NO: 908758 - protein, 9 aa, Homo Sapiens
KWHGGNCYQ

SEQ ID NO: 908759 - protein, 9 aa, Homo Sapiens
ELAKPVVYD

SEQ ID NO: 908760 - protein, 9 aa, Homo Sapiens
ISSRIHHDQ

SEQ ID NO: 908761 - protein, 9 aa, Homo Sapiens
WSDCTPVST

SEQ ID NO: 908762 - protein, 9 aa, Homo Sapiens
MFGSFQCEC

SEQ ID NO: 908763 - protein, 9 aa, Homo Sapiens
MCSPAIPSA

SEQ ID NO: 908764 - protein, 9 aa, Homo Sapiens
GDCVNMFGS

SEQ ID NO: 908765 - protein, 9 aa, Homo Sapiens
LIHAVPGLL

SEQ ID NO: 908766 - protein, 9 aa, Homo Sapiens
PLEPRLGKE

SEQ ID NO: 908767 - protein, 9 aa, Homo Sapiens
LAGDFSALE

SEQ ID NO: 908768 - protein, 9 aa, Homo Sapiens
SEKVTPTSA

SEQ ID NO: 908769 - protein, 9 aa, Homo Sapiens
YKLTWVQMG

SEQ ID NO: 908770 - protein, 9 aa, Homo Sapiens
HYLKSGSLY

SEQ ID NO: 908771 - protein, 9 aa, Homo Sapiens
FYDSFRYQG

SEQ ID NO: 908772 - protein, 9 aa, Homo Sapiens
TTVNEFILM

SEQ ID NO: 908773 - protein, 9 aa, Homo Sapiens
PVSSEKVTP

SEQ ID NO: 908774 - protein, 9 aa, Homo Sapiens
ARVFPSNYV

SEQ ID NO: 908775 - protein, 9 aa, Homo Sapiens
ATAIDGGGK

SEQ ID NO: 908776 - protein, 9 aa, Homo Sapiens
HPVSSEKVT

SEQ ID NO: 908777 - protein, 9 aa, Homo Sapiens
DGSYAGTKP

SEQ ID NO: 908778 - protein, 9 aa, Homo Sapiens
FPGGRSGSL

SEQ ID NO: 908779 - protein, 9 aa, Homo Sapiens
MISSRIHHD

SEQ ID NO: 908780 - protein, 9 aa, Homo Sapiens
GDKARVFPS

SEQ ID NO: 908781 - protein, 9 aa, Homo Sapiens
ENIMISSRI

SEQ ID NO: 908782 - protein, 9 aa, Homo Sapiens
FHYLKSGSL

SEQ ID NO: 908783 - protein, 9 aa, Homo Sapiens
RSDDNDHEF

SEQ ID NO: 908784 - protein, 9 aa, Homo Sapiens
QMGHSLVGG

SEQ ID NO: 908785 - protein, 9 aa, Homo Sapiens
DKARVFPSN

SEQ ID NO: 908786 - protein, 9 aa, Homo Sapiens
GKELIEPLT

SEQ ID NO: 908787 - protein, 9 aa, Homo Sapiens
FIRSFYDSF

SEQ ID NO: 908788 - protein, 9 aa, Homo Sapiens
LTRRRASSV

SEQ ID NO: 908789 - protein, 9 aa, Homo Sapiens
PFWLFIRSF

SEQ ID NO: 908790 - protein, 9 aa, Homo Sapiens
ALWKIQLGT

SEQ ID NO: 908791 - protein, 9 aa, Homo Sapiens
AAAATAIDG

SEQ ID NO: 908792 - protein, 9 aa, Homo Sapiens
EVREESEPE

SEQ ID NO: 908793 - protein, 9 aa, Homo Sapiens
ETMSMANEK

SEQ ID NO: 908794 - protein, 9 aa, Homo Sapiens
AYKLTWVQM

SEQ ID NO: 908795 - protein, 9 aa, Homo Sapiens
EKPHACQQC

SEQ ID NO: 908796 - protein, 9 aa, Homo Sapiens
PEQEQQLQR

SEQ ID NO: 908797 - protein, 9 aa, Homo Sapiens
VNMFGSFQC

SEQ ID NO: 908798 - protein, 9 aa, Homo Sapiens
AGTKPDECN

SEQ ID NO: 908799 - protein, 9 aa, Homo Sapiens
GGNCYQFYK

SEQ ID NO: 908800 - protein, 9 aa, Homo Sapiens
ARQAYQRVC

SEQ ID NO: 908801 - protein, 9 aa, Homo Sapiens
KENIMISSR

SEQ ID NO: 908802 - protein, 9 aa, Homo Sapiens
GSWQWSDCT

SEQ ID NO: 908803 - protein, 9 aa, Homo Sapiens
RISSVASNC

SEQ ID NO: 908804 - protein, 9 aa, Homo Sapiens
SSDGSYAGT

SEQ ID NO: 908805 - protein, 9 aa, Homo Sapiens
IRSFYDSFR

SEQ ID NO: 908806 - protein, 9 aa, Homo Sapiens
HCLLLPAHT

SEQ ID NO: 908807 - protein, 9 aa, Homo Sapiens
NLLCRDLGL

SEQ ID NO: 908808 - protein, 9 aa, Homo Sapiens
PTCHFHVLA

SEQ ID NO: 908809 - protein, 9 aa, Homo Sapiens
LDFVPAFSL

SEQ ID NO: 908810 - protein, 9 aa, Homo Sapiens
KPTMIWRPP

SEQ ID NO: 908811 - protein, 9 aa, Homo Sapiens
FILNLLCRD

SEQ ID NO: 908812 - protein, 9 aa, Homo Sapiens
WCHLKTQRA

SEQ ID NO: 908813 - protein, 9 aa, Homo Sapiens
IWRPPAVVC

SEQ ID NO: 908814 - protein, 9 aa, Homo Sapiens
KQIMHNEEK

SEQ ID NO: 908815 - protein, 9 aa, Homo Sapiens
ILQTAAVTR

SEQ ID NO: 908816 - protein, 9 aa, Homo Sapiens
TVEWSARSE

SEQ ID NO: 908817 - protein, 9 aa, Homo Sapiens
NLRKQIMHN

SEQ ID NO: 908818 - protein, 9 aa, Homo Sapiens
LCRDLGLKD

SEQ ID NO: 908819 - protein, 9 aa, Homo Sapiens
ATRWCHLKT

SEQ ID NO: 908820 - protein, 9 aa, Homo Sapiens
AEEEEEEDD

SEQ ID NO: 908821 - protein, 9 aa, Homo Sapiens
QEKAEQQKK

SEQ ID NO: 908822 - protein, 9 aa, Homo Sapiens
GPPPTCHFH

SEQ ID NO: 908823 - protein, 9 aa, Homo Sapiens
PLTVEWSAR

SEQ ID NO: 908824 - protein, 9 aa, Homo Sapiens
GATRWCHLK

SEQ ID NO: 908825 - protein, 9 aa, Homo Sapiens
FPQVVKECR

SEQ ID NO: 908826 - protein, 9 aa, Homo Sapiens
NFRVMSCNS

SEQ ID NO: 908827 - protein, 9 aa, Homo Sapiens
TGNANTASA

SEQ ID NO: 908828 - protein, 9 aa, Homo Sapiens
LLLPAHTLQ

SEQ ID NO: 908829 - protein, 9 aa, Homo Sapiens
LRKQIMHNE

SEQ ID NO: 908830 - protein, 9 aa, Homo Sapiens
ISEIFVSQT

SEQ ID NO: 908831 - protein, 9 aa, Homo Sapiens
GNANTASAT

SEQ ID NO: 908832 - protein, 9 aa, Homo Sapiens
LNLLCRDLG

SEQ ID NO: 908833 - protein, 9 aa, Homo Sapiens
PQVVKECRA

SEQ ID NO: 908834 - protein, 9 aa, Homo Sapiens
LQTAAVTRL

SEQ ID NO: 908835 - protein, 9 aa, Homo Sapiens
GATRFALQK

SEQ ID NO: 908836 - protein, 9 aa, Homo Sapiens
LLNPAVHFP

SEQ ID NO: 908837 - protein, 9 aa, Homo Sapiens
PAVHFPQVV

SEQ ID NO: 908838 - protein, 9 aa, Homo Sapiens
QIMHNEEKP

SEQ ID NO: 908839 - protein, 9 aa, Homo Sapiens
YSKRFKGHK

SEQ ID NO: 908840 - protein, 9 aa, Homo Sapiens
PTVVIHPLE

SEQ ID NO: 908841 - protein, 9 aa, Homo Sapiens
DSMSELVIS

SEQ ID NO: 908842 - protein, 9 aa, Homo Sapiens
TVVIHPLEE

SEQ ID NO: 908843 - protein, 9 aa, Homo Sapiens
PPTCHFHVL

SEQ ID NO: 908844 - protein, 9 aa, Homo Sapiens
PTMIWRPPA

SEQ ID NO: 908845 - protein, 9 aa, Homo Sapiens
QGLLQQLDF

SEQ ID NO: 908846 - protein, 9 aa, Homo Sapiens
ELVISEIFV

SEQ ID NO: 908847 - protein, 9 aa, Homo Sapiens
PPPTCHFHV

SEQ ID NO: 908848 - protein, 9 aa, Homo Sapiens
LEEDLEAAL

SEQ ID NO: 908849 - protein, 9 aa, Homo Sapiens
NSFPIRRLS

SEQ ID NO: 908850 - protein, 9 aa, Homo Sapiens
VMSCNSFPI

SEQ ID NO: 908851 - protein, 9 aa, Homo Sapiens
NANTASATL

SEQ ID NO: 908852 - protein, 9 aa, Homo Sapiens
WRPPAVVCY

SEQ ID NO: 908853 - protein, 9 aa, Homo Sapiens
EWSARSESA

SEQ ID NO: 908854 - protein, 9 aa, Homo Sapiens
DPHCLLLPA

SEQ ID NO: 908855 - protein, 9 aa, Homo Sapiens
MIWRPPAVV

SEQ ID NO: 908856 - protein, 9 aa, Homo Sapiens
WSARSESAQ

SEQ ID NO: 908857 - protein, 9 aa, Homo Sapiens
YSRRGATRF

SEQ ID NO: 908858 - protein, 9 aa, Homo Sapiens
HLKTQRADP

SEQ ID NO: 908859 - protein, 9 aa, Homo Sapiens
TPMGPPPTC

SEQ ID NO: 908860 - protein, 9 aa, Homo Sapiens
QILQTAAVT

SEQ ID NO: 908861 - protein, 9 aa, Homo Sapiens
ATRFALQKL

SEQ ID NO: 908862 - protein, 9 aa, Homo Sapiens
KEKAEQQEK

SEQ ID NO: 908863 - protein, 9 aa, Homo Sapiens
RKQIMHNEE

SEQ ID NO: 908864 - protein, 9 aa, Homo Sapiens
VFILNLLCR

SEQ ID NO: 908865 - protein, 9 aa, Homo Sapiens
NTKPTMIWR

SEQ ID NO: 908866 - protein, 9 aa, Homo Sapiens
PMGPPPTCH

SEQ ID NO: 908867 - protein, 9 aa, Homo Sapiens
LNPAVHFPQ

SEQ ID NO: 908868 - protein, 9 aa, Homo Sapiens
KRFKGHKNN

SEQ ID NO: 908869 - protein, 9 aa, Homo Sapiens
TNTGNANTA

SEQ ID NO: 908870 - protein, 9 aa, Homo Sapiens
RRGATRFAL

SEQ ID NO: 908871 - protein, 9 aa, Homo Sapiens
TAAVTRLRN

SEQ ID NO: 908872 - protein, 9 aa, Homo Sapiens
INFRVMSCN

SEQ ID NO: 908873 - protein, 9 aa, Homo Sapiens
QQEKAEQQK

SEQ ID NO: 908874 - protein, 9 aa, Homo Sapiens
HFPQVVKEC

SEQ ID NO: 908875 - protein, 9 aa, Homo Sapiens
AVHFPQVVK

SEQ ID NO: 908876 - protein, 9 aa, Homo Sapiens
CNSFPIRRL

SEQ ID NO: 908877 - protein, 9 aa, Homo Sapiens
NTGNANTAS

SEQ ID NO: 908878 - protein, 9 aa, Homo Sapiens
MGPPPTCHF

SEQ ID NO: 908879 - protein, 9 aa, Homo Sapiens
LVISEIFVS

SEQ ID NO: 908880 - protein, 9 aa, Homo Sapiens
NPAVHFPQV

SEQ ID NO: 908881 - protein, 9 aa, Homo Sapiens
SELVISEIF

SEQ ID NO: 908882 - protein, 9 aa, Homo Sapiens
QTAAVTRLR

SEQ ID NO: 908883 - protein, 9 aa, Homo Sapiens
HPLEEDLEA

SEQ ID NO: 908884 - protein, 9 aa, Homo Sapiens
SSNLRKQIM

SEQ ID NO: 908885 - protein, 9 aa, Homo Sapiens
LTVEWSARS

SEQ ID NO: 908886 - protein, 9 aa, Homo Sapiens
SCNSFPIRR

SEQ ID NO: 908887 - protein, 9 aa, Homo Sapiens
EQQEKAEQQ

SEQ ID NO: 908888 - protein, 9 aa, Homo Sapiens
KGHKNNTTV

SEQ ID NO: 908889 - protein, 9 aa, Homo Sapiens
TMIWRPPAV

SEQ ID NO: 908890 - protein, 9 aa, Homo Sapiens
TAAAGGGGS

SEQ ID NO: 908891 - protein, 9 aa, Homo Sapiens
MHNEEKPYK

SEQ ID NO: 908892 - protein, 9 aa, Homo Sapiens
AYSRRGATR

SEQ ID NO: 908893 - protein, 9 aa, Homo Sapiens
SRRGATRFA

SEQ ID NO: 908894 - protein, 9 aa, Homo Sapiens
HKNNTTVKG

SEQ ID NO: 908895 - protein, 9 aa, Homo Sapiens
FVPAFSLFR

SEQ ID NO: 908896 - protein, 9 aa, Homo Sapiens
GAGATRWCH

SEQ ID NO: 908897 - protein, 9 aa, Homo Sapiens
CHLKTQRAD

SEQ ID NO: 908898 - protein, 9 aa, Homo Sapiens
TASATLASA

SEQ ID NO: 908899 - protein, 9 aa, Homo Sapiens
LQQLDFVPA

SEQ ID NO: 908900 - protein, 9 aa, Homo Sapiens
GVFILNLLC

SEQ ID NO: 908901 - protein, 9 aa, Homo Sapiens
MSCNSFPIR

SEQ ID NO: 908902 - protein, 9 aa, Homo Sapiens
ASATLASAA

SEQ ID NO: 908903 - protein, 9 aa, Homo Sapiens
RFKGHKNNT

SEQ ID NO: 908904 - protein, 9 aa, Homo Sapiens
NTASATLAS

SEQ ID NO: 908905 - protein, 9 aa, Homo Sapiens
VIHPLEEDL

SEQ ID NO: 908906 - protein, 9 aa, Homo Sapiens
CLLLPAHTL

SEQ ID NO: 908907 - protein, 9 aa, Homo Sapiens
SKRFKGHKN

SEQ ID NO: 908908 - protein, 9 aa, Homo Sapiens
IPTVVIHPL

SEQ ID NO: 908909 - protein, 9 aa, Homo Sapiens
EKAEQQEKA

SEQ ID NO: 908910 - protein, 9 aa, Homo Sapiens
LLQQLDFVP

SEQ ID NO: 908911 - protein, 9 aa, Homo Sapiens
ATAAAGGGG

SEQ ID NO: 908912 - protein, 9 aa, Homo Sapiens
VHFPQVVKE

SEQ ID NO: 908913 - protein, 9 aa, Homo Sapiens
CHFHVLADT

SEQ ID NO: 908914 - protein, 9 aa, Homo Sapiens
QLDFVPAFS

SEQ ID NO: 908915 - protein, 9 aa, Homo Sapiens
SAAATAAAG

SEQ ID NO: 908916 - protein, 9 aa, Homo Sapiens
QQLDFVPAF

SEQ ID NO: 908917 - protein, 9 aa, Homo Sapiens
HNTKPTMIW

SEQ ID NO: 908918 - protein, 9 aa, Homo Sapiens
ANTASATLA

SEQ ID NO: 908919 - protein, 9 aa, Homo Sapiens
PHCLLLPAH

SEQ ID NO: 908920 - protein, 9 aa, Homo Sapiens
KAEQQEKAE

SEQ ID NO: 908921 - protein, 9 aa, Homo Sapiens
GLLQQLDFV

SEQ ID NO: 908922 - protein, 9 aa, Homo Sapiens
EKAEQQKKV

SEQ ID NO: 908923 - protein, 9 aa, Homo Sapiens
RGATRFALQ

SEQ ID NO: 908924 - protein, 9 aa, Homo Sapiens
RWCHLKTQR

SEQ ID NO: 908925 - protein, 9 aa, Homo Sapiens
VISEIFVSQ

SEQ ID NO: 908926 - protein, 9 aa, Homo Sapiens
IHPLEEDLE

SEQ ID NO: 908927 - protein, 9 aa, Homo Sapiens
AGATRWCHL

SEQ ID NO: 908928 - protein, 9 aa, Homo Sapiens
AEQQEKAEQ

SEQ ID NO: 908929 - protein, 9 aa, Homo Sapiens
IMHNEEKPY

SEQ ID NO: 908930 - protein, 9 aa, Homo Sapiens
SPLTVEWSA

SEQ ID NO: 908931 - protein, 9 aa, Homo Sapiens
RVMSCNSFP

SEQ ID NO: 908932 - protein, 9 aa, Homo Sapiens
KAYSRRGAT

SEQ ID NO: 908933 - protein, 9 aa, Homo Sapiens
VEWSARSES

SEQ ID NO: 908934 - protein, 9 aa, Homo Sapiens
AATAAAGGG

SEQ ID NO: 908935 - protein, 9 aa, Homo Sapiens
DQILQTAAV

SEQ ID NO: 908936 - protein, 9 aa, Homo Sapiens
TSPLTVEWS

SEQ ID NO: 908937 - protein, 9 aa, Homo Sapiens
PSLDQILQT

SEQ ID NO: 908938 - protein, 9 aa, Homo Sapiens
TRWCHLKTQ

SEQ ID NO: 908939 - protein, 9 aa, Homo Sapiens
LLCRDLGLK

SEQ ID NO: 908940 - protein, 9 aa, Homo Sapiens
FRVMSCNSF

SEQ ID NO: 908941 - protein, 9 aa, Homo Sapiens
FKGHKNNTT

SEQ ID NO: 908942 - protein, 9 aa, Homo Sapiens
AAATAAAGG

SEQ ID NO: 908943 - protein, 9 aa, Homo Sapiens
EDSMSELVI

SEQ ID NO: 908944 - protein, 9 aa, Homo Sapiens
ILNLLCRDL

SEQ ID NO: 908945 - protein, 9 aa, Homo Sapiens
SMSELVISE

SEQ ID NO: 908946 - protein, 9 aa, Homo Sapiens
KNNTTVKGV

SEQ ID NO: 908947 - protein, 9 aa, Homo Sapiens
GHKNNTTVK

SEQ ID NO: 908948 - protein, 9 aa, Homo Sapiens
TCHFHVLAD

SEQ ID NO: 908949 - protein, 9 aa, Homo Sapiens
PLEEDLEAA

SEQ ID NO: 908950 - protein, 9 aa, Homo Sapiens
LDQILQTAA

SEQ ID NO: 908951 - protein, 9 aa, Homo Sapiens
TKPTMIWRP

SEQ ID NO: 908952 - protein, 9 aa, Homo Sapiens
TRFALQKLE

SEQ ID NO: 908953 - protein, 9 aa, Homo Sapiens
DFVPAFSLF

SEQ ID NO: 908954 - protein, 9 aa, Homo Sapiens
EGVFILNLL

SEQ ID NO: 908955 - protein, 9 aa, Homo Sapiens
SARSESAQS

SEQ ID NO: 908956 - protein, 9 aa, Homo Sapiens
LLPAHTLQG

SEQ ID NO: 908957 - protein, 9 aa, Homo Sapiens
LPAHTLQGE

SEQ ID NO: 908958 - protein, 9 aa, Homo Sapiens
SLDQILQTA

SEQ ID NO: 908959 - protein, 9 aa, Homo Sapiens
MSELVISEI

SEQ ID NO: 908960 - protein, 9 aa, Homo Sapiens
VKEKAEQQE

SEQ ID NO: 908961 - protein, 9 aa, Homo Sapiens
SNLRKQIMH

SEQ ID NO: 908962 - protein, 9 aa, Homo Sapiens
VVIHPLEED

SEQ ID NO: 908963 - protein, 9 aa, Homo Sapiens
LMVKMKTSY

SEQ ID NO: 908964 - protein, 9 aa, Homo Sapiens
SRVIVMTMK

SEQ ID NO: 908965 - protein, 9 aa, Homo Sapiens
PIQNPCPRR

SEQ ID NO: 908966 - protein, 9 aa, Homo Sapiens
KPPPGEKPP

SEQ ID NO: 908967 - protein, 9 aa, Homo Sapiens
RDASLKDKW

SEQ ID NO: 908968 - protein, 9 aa, Homo Sapiens
NKEKSPNLT

SEQ ID NO: 908969 - protein, 9 aa, Homo Sapiens
HMVTLQCTA

SEQ ID NO: 908970 - protein, 9 aa, Homo Sapiens
PRHCPPWGC

SEQ ID NO: 908971 - protein, 9 aa, Homo Sapiens
SHNLTVREL

SEQ ID NO: 908972 - protein, 9 aa, Homo Sapiens
VIQCKVRLP

SEQ ID NO: 908973 - protein, 9 aa, Homo Sapiens
REGCASGHM

SEQ ID NO: 908974 - protein, 9 aa, Homo Sapiens
LGTLRPLFS

SEQ ID NO: 908975 - protein, 9 aa, Homo Sapiens
FSLSWSTTF

SEQ ID NO: 908976 - protein, 9 aa, Homo Sapiens
AEGRLRGRG

SEQ ID NO: 908977 - protein, 9 aa, Homo Sapiens
FRNHLRKFP

SEQ ID NO: 908978 - protein, 9 aa, Homo Sapiens
AWHQSVVEA

SEQ ID NO: 908979 - protein, 9 aa, Homo Sapiens
ENLWTGGPM

SEQ ID NO: 908980 - protein, 9 aa, Homo Sapiens
MKCLPGSLH

SEQ ID NO: 908981 - protein, 9 aa, Homo Sapiens
IPFLGTLRP

SEQ ID NO: 908982 - protein, 9 aa, Homo Sapiens
RHCPPWGCL

SEQ ID NO: 908983 - protein, 9 aa, Homo Sapiens
SLIHRVQAK

SEQ ID NO: 908984 - protein, 9 aa, Homo Sapiens
KEKSPNLTQ

SEQ ID NO: 908985 - protein, 9 aa, Homo Sapiens
PPWGCLHSQ

SEQ ID NO: 908986 - protein, 9 aa, Homo Sapiens
TSYFSLSWS

SEQ ID NO: 908987 - protein, 9 aa, Homo Sapiens
QHFFCDAPP

SEQ ID NO: 908988 - protein, 9 aa, Homo Sapiens
NHLRKFPAL

SEQ ID NO: 908989 - protein, 9 aa, Homo Sapiens
IAAAFLFKW

SEQ ID NO: 908990 - protein, 9 aa, Homo Sapiens
AFRNHLRKF

SEQ ID NO: 908991 - protein, 9 aa, Homo Sapiens
LPGSLHLMV

SEQ ID NO: 908992 - protein, 9 aa, Homo Sapiens
DFFSLIHRV

SEQ ID NO: 908993 - protein, 9 aa, Homo Sapiens
WTGGPMASC

SEQ ID NO: 908994 - protein, 9 aa, Homo Sapiens
VIVMTMKEV

SEQ ID NO: 908995 - protein, 9 aa, Homo Sapiens
IVMTMKEVE

SEQ ID NO: 908996 - protein, 9 aa, Homo Sapiens
LVVWRVHSE

SEQ ID NO: 908997 - protein, 9 aa, Homo Sapiens
WRVHSEDQS

SEQ ID NO: 908998 - protein, 9 aa, Homo Sapiens
YFSLSWSTT

SEQ ID NO: 908999 - protein, 9 aa, Homo Sapiens
GAEGRLRGR

SEQ ID NO: 909000 - protein, 9 aa, Homo Sapiens
CQGAEGRLR

SEQ ID NO: 909001 - protein, 9 aa, Homo Sapiens
PAERSGSAH

SEQ ID NO: 909002 - protein, 9 aa, Homo Sapiens
SRMENLWTG

SEQ ID NO: 909003 - protein, 9 aa, Homo Sapiens
SLHLMVKMK

SEQ ID NO: 909004 - protein, 9 aa, Homo Sapiens
TKKLKQCPS

SEQ ID NO: 909005 - protein, 9 aa, Homo Sapiens
KMKTSYFSL

SEQ ID NO: 909006 - protein, 9 aa, Homo Sapiens
EEHRPLAWG

SEQ ID NO: 909007 - protein, 9 aa, Homo Sapiens
TNARVAVLE

SEQ ID NO: 909008 - protein, 9 aa, Homo Sapiens
NHQWNDALP

SEQ ID NO: 909009 - protein, 9 aa, Homo Sapiens
REEVLQLSS

SEQ ID NO: 909010 - protein, 9 aa, Homo Sapiens
NALQFFRFE

SEQ ID NO: 909011 - protein, 9 aa, Homo Sapiens
LIHRVQAKR

SEQ ID NO: 909012 - protein, 9 aa, Homo Sapiens
LKQCPSAVV

SEQ ID NO: 909013 - protein, 9 aa, Homo Sapiens
LKLAGWQCP

SEQ ID NO: 909014 - protein, 9 aa, Homo Sapiens
RNHLRKFPA

SEQ ID NO: 909015 - protein, 9 aa, Homo Sapiens
SSHSDEGSE

SEQ ID NO: 909016 - protein, 9 aa, Homo Sapiens
LAEPGEEKI

SEQ ID NO: 909017 - protein, 9 aa, Homo Sapiens
MKTSYFSLS

SEQ ID NO: 909018 - protein, 9 aa, Homo Sapiens
FFSLIHRVQ

SEQ ID NO: 909019 - protein, 9 aa, Homo Sapiens
MKEVERGKS

SEQ ID NO: 909020 - protein, 9 aa, Homo Sapiens
MSKLRHGQI

SEQ ID NO: 909021 - protein, 9 aa, Homo Sapiens
VLLKTREEV

SEQ ID NO: 909022 - protein, 9 aa, Homo Sapiens
PWFKIIAAA

SEQ ID NO: 909023 - protein, 9 aa, Homo Sapiens
RRSSMRDAS

SEQ ID NO: 909024 - protein, 9 aa, Homo Sapiens
RSGSAHGEQ

SEQ ID NO: 909025 - protein, 9 aa, Homo Sapiens
ILKHWTGGC

SEQ ID NO: 909026 - protein, 9 aa, Homo Sapiens
PDIDLPKDV

SEQ ID NO: 909027 - protein, 9 aa, Homo Sapiens
NQIQHFFCD

SEQ ID NO: 909028 - protein, 9 aa, Homo Sapiens
IQNPCPRRL

SEQ ID NO: 909029 - protein, 9 aa, Homo Sapiens
VLASHNLTV

SEQ ID NO: 909030 - protein, 9 aa, Homo Sapiens
IHRVQAKRM

SEQ ID NO: 909031 - protein, 9 aa, Homo Sapiens
EHRPLAWGN

SEQ ID NO: 909032 - protein, 9 aa, Homo Sapiens
KLRRSSMRD

SEQ ID NO: 909033 - protein, 9 aa, Homo Sapiens
FIFPEIPFL

SEQ ID NO: 909034 - protein, 9 aa, Homo Sapiens
LHLMVKMKT

SEQ ID NO: 909035 - protein, 9 aa, Homo Sapiens
CCMKCLPGS

SEQ ID NO: 909036 - protein, 9 aa, Homo Sapiens
RVIQCKVRL

SEQ ID NO: 909037 - protein, 9 aa, Homo Sapiens
KMSKLRHGQ

SEQ ID NO: 909038 - protein, 9 aa, Homo Sapiens
QNKEKSPNL

SEQ ID NO: 909039 - protein, 9 aa, Homo Sapiens
WTGGCPFRE

SEQ ID NO: 909040 - protein, 9 aa, Homo Sapiens
ERSGSAHGE

SEQ ID NO: 909041 - protein, 9 aa, Homo Sapiens
EQNKEKSPN

SEQ ID NO: 909042 - protein, 9 aa, Homo Sapiens
WNDALPSCD

SEQ ID NO: 909043 - protein, 9 aa, Homo Sapiens
MRDASLKDK

SEQ ID NO: 909044 - protein, 9 aa, Homo Sapiens
MTMKEVERG

SEQ ID NO: 909045 - protein, 9 aa, Homo Sapiens
MVKMKTSYF

SEQ ID NO: 909046 - protein, 9 aa, Homo Sapiens
LASHNLTVR

SEQ ID NO: 909047 - protein, 9 aa, Homo Sapiens
PRRLFLSAK

SEQ ID NO: 909048 - protein, 9 aa, Homo Sapiens
TKMSKLRHG

SEQ ID NO: 909049 - protein, 9 aa, Homo Sapiens
NSRVIVMTM

SEQ ID NO: 909050 - protein, 9 aa, Homo Sapiens
QNPCPRRLF

SEQ ID NO: 909051 - protein, 9 aa, Homo Sapiens
LRHGQIIFP

SEQ ID NO: 909052 - protein, 9 aa, Homo Sapiens
ASCCMKCLP

SEQ ID NO: 909053 - protein, 9 aa, Homo Sapiens
LEHLVVWRV

SEQ ID NO: 909054 - protein, 9 aa, Homo Sapiens
NPCPRRLFL

SEQ ID NO: 909055 - protein, 9 aa, Homo Sapiens
VKMKTSYFS

SEQ ID NO: 909056 - protein, 9 aa, Homo Sapiens
SGSAHGEQN

SEQ ID NO: 909057 - protein, 9 aa, Homo Sapiens
EAQAWHQSV

SEQ ID NO: 909058 - protein, 9 aa, Homo Sapiens
IEGYSEKAQ

SEQ ID NO: 909059 - protein, 9 aa, Homo Sapiens
TMKEVERGK

SEQ ID NO: 909060 - protein, 9 aa, Homo Sapiens
EKPPVFHTL

SEQ ID NO: 909061 - protein, 9 aa, Homo Sapiens
ALEHLVVWR

SEQ ID NO: 909062 - protein, 9 aa, Homo Sapiens
TGGCPFREG

SEQ ID NO: 909063 - protein, 9 aa, Homo Sapiens
APATGGVMK

SEQ ID NO: 909064 - protein, 9 aa, Homo Sapiens
AFLFKWWDN

SEQ ID NO: 909065 - protein, 9 aa, Homo Sapiens
RNHQWNDAL

SEQ ID NO: 909066 - protein, 9 aa, Homo Sapiens
IPDAVTYTE

SEQ ID NO: 909067 - protein, 9 aa, Homo Sapiens
PWGCLHSQN

SEQ ID NO: 909068 - protein, 9 aa, Homo Sapiens
QCKVRLPLK

SEQ ID NO: 909069 - protein, 9 aa, Homo Sapiens
SSMRDASLK

SEQ ID NO: 909070 - protein, 9 aa, Homo Sapiens
RRLFLSAKD

SEQ ID NO: 909071 - protein, 9 aa, Homo Sapiens
GCLHSQNVL

SEQ ID NO: 909072 - protein, 9 aa, Homo Sapiens
MENLWTGGP

SEQ ID NO: 909073 - protein, 9 aa, Homo Sapiens
AAFLFKWWD

SEQ ID NO: 909074 - protein, 9 aa, Homo Sapiens
CPPWGCLHS

SEQ ID NO: 909075 - protein, 9 aa, Homo Sapiens
EKIEGYSEK

SEQ ID NO: 909076 - protein, 9 aa, Homo Sapiens
PKDVFAALG

SEQ ID NO: 909077 - protein, 9 aa, Homo Sapiens
HSDEGSEED

SEQ ID NO: 909078 - protein, 9 aa, Homo Sapiens
SWSTTFPIQ

SEQ ID NO: 909079 - protein, 9 aa, Homo Sapiens
RARIYSSHS

SEQ ID NO: 909080 - protein, 9 aa, Homo Sapiens
KQCPSAVVL

SEQ ID NO: 909081 - protein, 9 aa, Homo Sapiens
KPPVFHTLS

SEQ ID NO: 909082 - protein, 9 aa, Homo Sapiens
PGEKPPVFH

SEQ ID NO: 909083 - protein, 9 aa, Homo Sapiens
LKHWTGGCP

SEQ ID NO: 909084 - protein, 9 aa, Homo Sapiens
IYSSHSDEG

SEQ ID NO: 909085 - protein, 9 aa, Homo Sapiens
TTPTNQSAE

SEQ ID NO: 909086 - protein, 9 aa, Homo Sapiens
DLVLLKTRE

SEQ ID NO: 909087 - protein, 9 aa, Homo Sapiens
MVTLQCTAC

SEQ ID NO: 909088 - protein, 9 aa, Homo Sapiens
AISRMENLW

SEQ ID NO: 909089 - protein, 9 aa, Homo Sapiens
SAHGEQNLC

SEQ ID NO: 909090 - protein, 9 aa, Homo Sapiens
VLENALQFF

SEQ ID NO: 909091 - protein, 9 aa, Homo Sapiens
RLRGRGAEL

SEQ ID NO: 909092 - protein, 9 aa, Homo Sapiens
TPLKLAGWQ

SEQ ID NO: 909093 - protein, 9 aa, Homo Sapiens
GSAHGEQNL

SEQ ID NO: 909094 - protein, 9 aa, Homo Sapiens
KKLKQCPSA

SEQ ID NO: 909095 - protein, 9 aa, Homo Sapiens
KLRHGQIIF

SEQ ID NO: 909096 - protein, 9 aa, Homo Sapiens
FPIQNPCPR

SEQ ID NO: 909097 - protein, 9 aa, Homo Sapiens
HLMVKMKTS

SEQ ID NO: 909098 - protein, 9 aa, Homo Sapiens
IQCKVRLPL

SEQ ID NO: 909099 - protein, 9 aa, Homo Sapiens
KGAKEEHRP

SEQ ID NO: 909100 - protein, 9 aa, Homo Sapiens
AKEQNKEKS

SEQ ID NO: 909101 - protein, 9 aa, Homo Sapiens
IPRVIQCKV

SEQ ID NO: 909102 - protein, 9 aa, Homo Sapiens
KHWTGGCPF

SEQ ID NO: 909103 - protein, 9 aa, Homo Sapiens
TGGPMASCC

SEQ ID NO: 909104 - protein, 9 aa, Homo Sapiens
HFFCDAPPI

SEQ ID NO: 909105 - protein, 9 aa, Homo Sapiens
PEIIAISRM

SEQ ID NO: 909106 - protein, 9 aa, Homo Sapiens
PDAVTYTEH

SEQ ID NO: 909107 - protein, 9 aa, Homo Sapiens
QVVLENALQ

SEQ ID NO: 909108 - protein, 9 aa, Homo Sapiens
YIAPEIIAI

SEQ ID NO: 909109 - protein, 9 aa, Homo Sapiens
KIEGYSEKA

SEQ ID NO: 909110 - protein, 9 aa, Homo Sapiens
RMENLWTGG

SEQ ID NO: 909111 - protein, 9 aa, Homo Sapiens
HQSVVEARD

SEQ ID NO: 909112 - protein, 9 aa, Homo Sapiens
STTFPIQNP

SEQ ID NO: 909113 - protein, 9 aa, Homo Sapiens
PAVTTPTNQ

SEQ ID NO: 909114 - protein, 9 aa, Homo Sapiens
TPDIDLPKD

SEQ ID NO: 909115 - protein, 9 aa, Homo Sapiens
HGEQNLCLS

SEQ ID NO: 909116 - protein, 9 aa, Homo Sapiens
QAWHQSVVE

SEQ ID NO: 909117 - protein, 9 aa, Homo Sapiens
IFPEIPFLG

SEQ ID NO: 909118 - protein, 9 aa, Homo Sapiens
WFKIIAAAF

SEQ ID NO: 909119 - protein, 9 aa, Homo Sapiens
KTPDIDLPK

SEQ ID NO: 909120 - protein, 9 aa, Homo Sapiens
FLGTLRPLF

SEQ ID NO: 909121 - protein, 9 aa, Homo Sapiens
IIAISRMEN

SEQ ID NO: 909122 - protein, 9 aa, Homo Sapiens
ENALQFFRF

SEQ ID NO: 909123 - protein, 9 aa, Homo Sapiens
SVVEARDGG

SEQ ID NO: 909124 - protein, 9 aa, Homo Sapiens
RSSMRDASL

SEQ ID NO: 909125 - protein, 9 aa, Homo Sapiens
MASCCMKCL

SEQ ID NO: 909126 - protein, 9 aa, Homo Sapiens
DEDFFSLIH

SEQ ID NO: 909127 - protein, 9 aa, Homo Sapiens
SSHCTNARV

SEQ ID NO: 909128 - protein, 9 aa, Homo Sapiens
MKPHRYRPG

SEQ ID NO: 909129 - protein, 9 aa, Homo Sapiens
EHLVVWRVH

SEQ ID NO: 909130 - protein, 9 aa, Homo Sapiens
CLHSQNVLG

SEQ ID NO: 909131 - protein, 9 aa, Homo Sapiens
ENVIPDAVT

SEQ ID NO: 909132 - protein, 9 aa, Homo Sapiens
PSAVVLFDE

SEQ ID NO: 909133 - protein, 9 aa, Homo Sapiens
ERARIYSSH

SEQ ID NO: 909134 - protein, 9 aa, Homo Sapiens
NLWTGGPMA

SEQ ID NO: 909135 - protein, 9 aa, Homo Sapiens
PLKLAGWQC

SEQ ID NO: 909136 - protein, 9 aa, Homo Sapiens
KEQNKEKSP

SEQ ID NO: 909137 - protein, 9 aa, Homo Sapiens
SCCMKCLPG

SEQ ID NO: 909138 - protein, 9 aa, Homo Sapiens
QWNDALPSC

SEQ ID NO: 909139 - protein, 9 aa, Homo Sapiens
RKGAKEEHR

SEQ ID NO: 909140 - protein, 9 aa, Homo Sapiens
EEKIEGYSE

SEQ ID NO: 909141 - protein, 9 aa, Homo Sapiens
RIYSSHSDE

SEQ ID NO: 909142 - protein, 9 aa, Homo Sapiens
HRVQAKRMD

SEQ ID NO: 909143 - protein, 9 aa, Homo Sapiens
DASLKDKWG

SEQ ID NO: 909144 - protein, 9 aa, Homo Sapiens
PTNQSAEAS

SEQ ID NO: 909145 - protein, 9 aa, Homo Sapiens
WHQSVVEAR

SEQ ID NO: 909146 - protein, 9 aa, Homo Sapiens
AQAWHQSVV

SEQ ID NO: 909147 - protein, 9 aa, Homo Sapiens
RVAVLEVPK

SEQ ID NO: 909148 - protein, 9 aa, Homo Sapiens
VTPLKLAGW

SEQ ID NO: 909149 - protein, 9 aa, Homo Sapiens
LWTGGPMAS

SEQ ID NO: 909150 - protein, 9 aa, Homo Sapiens
QIQHFFCDA

SEQ ID NO: 909151 - protein, 9 aa, Homo Sapiens
VMKPHRYRP

SEQ ID NO: 909152 - protein, 9 aa, Homo Sapiens
SAVVLFDEV

SEQ ID NO: 909153 - protein, 9 aa, Homo Sapiens
FQVVLENAL

SEQ ID NO: 909154 - protein, 9 aa, Homo Sapiens
FFCDAPPIL

SEQ ID NO: 909155 - protein, 9 aa, Homo Sapiens
AKEEHRPLA

SEQ ID NO: 909156 - protein, 9 aa, Homo Sapiens
NDALPSCDA

SEQ ID NO: 909157 - protein, 9 aa, Homo Sapiens
ASHNLTVRE

SEQ ID NO: 909158 - protein, 9 aa, Homo Sapiens
GAKEEHRPL

SEQ ID NO: 909159 - protein, 9 aa, Homo Sapiens
PRVIQCKVR

SEQ ID NO: 909160 - protein, 9 aa, Homo Sapiens
QSVVEARDG

SEQ ID NO: 909161 - protein, 9 aa, Homo Sapiens
FSLIHRVQA

SEQ ID NO: 909162 - protein, 9 aa, Homo Sapiens
LPKDVFAAL

SEQ ID NO: 909163 - protein, 9 aa, Homo Sapiens
SYFSLSWST

SEQ ID NO: 909164 - protein, 9 aa, Homo Sapiens
GRLRGRGAE

SEQ ID NO: 909165 - protein, 9 aa, Homo Sapiens
IAVTPLKLA

SEQ ID NO: 909166 - protein, 9 aa, Homo Sapiens
RHGQIIFPT

SEQ ID NO: 909167 - protein, 9 aa, Homo Sapiens
RVHSEDQSF

SEQ ID NO: 909168 - protein, 9 aa, Homo Sapiens
HRPLAWGNI

SEQ ID NO: 909169 - protein, 9 aa, Homo Sapiens
FPEIPFLGT

SEQ ID NO: 909170 - protein, 9 aa, Homo Sapiens
IAPEIIAIS

SEQ ID NO: 909171 - protein, 9 aa, Homo Sapiens
LAGWQCPEC

SEQ ID NO: 909172 - protein, 9 aa, Homo Sapiens
AVTPLKLAG

SEQ ID NO: 909173 - protein, 9 aa, Homo Sapiens
SGHMVTLQC

SEQ ID NO: 909174 - protein, 9 aa, Homo Sapiens
VRLPLKLIC

SEQ ID NO: 909175 - protein, 9 aa, Homo Sapiens
PEIPFLGTL

SEQ ID NO: 909176 - protein, 9 aa, Homo Sapiens
TFPIQNPCP

SEQ ID NO: 909177 - protein, 9 aa, Homo Sapiens
GCQGAEGRL

SEQ ID NO: 909178 - protein, 9 aa, Homo Sapiens
GDAFRNHLR

SEQ ID NO: 909179 - protein, 9 aa, Homo Sapiens
DALPSCDAL

SEQ ID NO: 909180 - protein, 9 aa, Homo Sapiens
GGVMKPHRY

SEQ ID NO: 909181 - protein, 9 aa, Homo Sapiens
GEEKIEGYS

SEQ ID NO: 909182 - protein, 9 aa, Homo Sapiens
DIDLPKDVF

SEQ ID NO: 909183 - protein, 9 aa, Homo Sapiens
MLGVLASHN

SEQ ID NO: 909184 - protein, 9 aa, Homo Sapiens
IQHFFCDAP

SEQ ID NO: 909185 - protein, 9 aa, Homo Sapiens
LGVLASHNL

SEQ ID NO: 909186 - protein, 9 aa, Homo Sapiens
TGGVMKPHR

SEQ ID NO: 909187 - protein, 9 aa, Homo Sapiens
SMRDASLKD

SEQ ID NO: 909188 - protein, 9 aa, Homo Sapiens
GGCPFREGV

SEQ ID NO: 909189 - protein, 9 aa, Homo Sapiens
ISRMENLWT

SEQ ID NO: 909190 - protein, 9 aa, Homo Sapiens
CLPGSLHLM

SEQ ID NO: 909191 - protein, 9 aa, Homo Sapiens
KIIAAAFLF

SEQ ID NO: 909192 - protein, 9 aa, Homo Sapiens
AAAFLFKWW

SEQ ID NO: 909193 - protein, 9 aa, Homo Sapiens
HCTNARVAV

SEQ ID NO: 909194 - protein, 9 aa, Homo Sapiens
AERSGSAHG

SEQ ID NO: 909195 - protein, 9 aa, Homo Sapiens
CPRRLFLSA

SEQ ID NO: 909196 - protein, 9 aa, Homo Sapiens
PMASCCMKC

SEQ ID NO: 909197 - protein, 9 aa, Homo Sapiens
LRRSSMRDA

SEQ ID NO: 909198 - protein, 9 aa, Homo Sapiens
TTFPIQNPC

SEQ ID NO: 909199 - protein, 9 aa, Homo Sapiens
FKTPDIDLP

SEQ ID NO: 909200 - protein, 9 aa, Homo Sapiens
IAISRMENL

SEQ ID NO: 909201 - protein, 9 aa, Homo Sapiens
KVFLENVIP

SEQ ID NO: 909202 - protein, 9 aa, Homo Sapiens
NVIPDAVTY

SEQ ID NO: 909203 - protein, 9 aa, Homo Sapiens
VKILKHWTG

SEQ ID NO: 909204 - protein, 9 aa, Homo Sapiens
RVIVMTMKE

SEQ ID NO: 909205 - protein, 9 aa, Homo Sapiens
GGCQGAEGR

SEQ ID NO: 909206 - protein, 9 aa, Homo Sapiens
LVLLKTREE

SEQ ID NO: 909207 - protein, 9 aa, Homo Sapiens
LWAKEQNKE

SEQ ID NO: 909208 - protein, 9 aa, Homo Sapiens
EIPFLGTLR

SEQ ID NO: 909209 - protein, 9 aa, Homo Sapiens
CGPNQIQHF

SEQ ID NO: 909210 - protein, 9 aa, Homo Sapiens
YSSHSDEGS

SEQ ID NO: 909211 - protein, 9 aa, Homo Sapiens
IGDAFRNHL

SEQ ID NO: 909212 - protein, 9 aa, Homo Sapiens
PATGGVMKP

SEQ ID NO: 909213 - protein, 9 aa, Homo Sapiens
KLKQCPSAV

SEQ ID NO: 909214 - protein, 9 aa, Homo Sapiens
KTREEVLQL

SEQ ID NO: 909215 - protein, 9 aa, Homo Sapiens
DMLGVLASH

SEQ ID NO: 909216 - protein, 9 aa, Homo Sapiens
KILKHWTGG

SEQ ID NO: 909217 - protein, 9 aa, Homo Sapiens
GVMKPHRYR

SEQ ID NO: 909218 - protein, 9 aa, Homo Sapiens
QCPSAVVLF

SEQ ID NO: 909219 - protein, 9 aa, Homo Sapiens
CKVRLPLKL

SEQ ID NO: 909220 - protein, 9 aa, Homo Sapiens
PGSLHLMVK

SEQ ID NO: 909221 - protein, 9 aa, Homo Sapiens
HWTGGCPFR

SEQ ID NO: 909222 - protein, 9 aa, Homo Sapiens
REAQAWHQS

SEQ ID NO: 909223 - protein, 9 aa, Homo Sapiens
GSLHLMVKM

SEQ ID NO: 909224 - protein, 9 aa, Homo Sapiens
VMTMKEVER

SEQ ID NO: 909225 - protein, 9 aa, Homo Sapiens
RPLAWGNIN

SEQ ID NO: 909226 - protein, 9 aa, Homo Sapiens
TREEVLQLS

SEQ ID NO: 909227 - protein, 9 aa, Homo Sapiens
QGAEGRLRG

SEQ ID NO: 909228 - protein, 9 aa, Homo Sapiens
GVLASHNLT

SEQ ID NO: 909229 - protein, 9 aa, Homo Sapiens
SHSDEGSEE

SEQ ID NO: 909230 - protein, 9 aa, Homo Sapiens
LLWAKEQNK

SEQ ID NO: 909231 - protein, 9 aa, Homo Sapiens
NARVAVLEV

SEQ ID NO: 909232 - protein, 9 aa, Homo Sapiens
FKIIAAAFL

SEQ ID NO: 909233 - protein, 9 aa, Homo Sapiens
PPGEKPPVF

SEQ ID NO: 909234 - protein, 9 aa, Homo Sapiens
RDLVLLKTR

SEQ ID NO: 909235 - protein, 9 aa, Homo Sapiens
ARVAVLEVP

SEQ ID NO: 909236 - protein, 9 aa, Homo Sapiens
SLSWSTTFP

SEQ ID NO: 909237 - protein, 9 aa, Homo Sapiens
ATGGVMKPH

SEQ ID NO: 909238 - protein, 9 aa, Homo Sapiens
WSTTFPIQN

SEQ ID NO: 909239 - protein, 9 aa, Homo Sapiens
HLRKFPALV

SEQ ID NO: 909240 - protein, 9 aa, Homo Sapiens
HGQIIFPTT

SEQ ID NO: 909241 - protein, 9 aa, Homo Sapiens
WAKEQNKEK

SEQ ID NO: 909242 - protein, 9 aa, Homo Sapiens
PNQIQHFFC

SEQ ID NO: 909243 - protein, 9 aa, Homo Sapiens
AEPGEEKIE

SEQ ID NO: 909244 - protein, 9 aa, Homo Sapiens
KCLPGSLHL

SEQ ID NO: 909245 - protein, 9 aa, Homo Sapiens
EGRLRGRGA

SEQ ID NO: 909246 - protein, 9 aa, Homo Sapiens
EGCASGHMV

SEQ ID NO: 909247 - protein, 9 aa, Homo Sapiens
IIAAAFLFK

SEQ ID NO: 909248 - protein, 9 aa, Homo Sapiens
GHMVTLQCT

SEQ ID NO: 909249 - protein, 9 aa, Homo Sapiens
IDLPKDVFA

SEQ ID NO: 909250 - protein, 9 aa, Homo Sapiens
VIPDAVTYT

SEQ ID NO: 909251 - protein, 9 aa, Homo Sapiens
VWRVHSEDQ

SEQ ID NO: 909252 - protein, 9 aa, Homo Sapiens
DAFRNHLRK

SEQ ID NO: 909253 - protein, 9 aa, Homo Sapiens
TPTNQSAEA

SEQ ID NO: 909254 - protein, 9 aa, Homo Sapiens
GPNQIQHFF

SEQ ID NO: 909255 - protein, 9 aa, Homo Sapiens
LENVIPDAV

SEQ ID NO: 909256 - protein, 9 aa, Homo Sapiens
GQIIFPTTQ

SEQ ID NO: 909257 - protein, 9 aa, Homo Sapiens
PFLGTLRPL

SEQ ID NO: 909258 - protein, 9 aa, Homo Sapiens
DLPKDVFAA

SEQ ID NO: 909259 - protein, 9 aa, Homo Sapiens
ARIYSSHSD

SEQ ID NO: 909260 - protein, 9 aa, Homo Sapiens
DIAVTPLKL

SEQ ID NO: 909261 - protein, 9 aa, Homo Sapiens
HQWNDALPS

SEQ ID NO: 909262 - protein, 9 aa, Homo Sapiens
GPMASCCMK

SEQ ID NO: 909263 - protein, 9 aa, Homo Sapiens
ASGHMVTLQ

SEQ ID NO: 909264 - protein, 9 aa, Homo Sapiens
KLAGWQCPE

SEQ ID NO: 909265 - protein, 9 aa, Homo Sapiens
EIIAISRME

SEQ ID NO: 909266 - protein, 9 aa, Homo Sapiens
HFQVVLENA

SEQ ID NO: 909267 - protein, 9 aa, Homo Sapiens
AVTTPTNQS

SEQ ID NO: 909268 - protein, 9 aa, Homo Sapiens
AHGEQNLCL

SEQ ID NO: 909269 - protein, 9 aa, Homo Sapiens
LSSHCTNAR

SEQ ID NO: 909270 - protein, 9 aa, Homo Sapiens
CERNHQWND

SEQ ID NO: 909271 - protein, 9 aa, Homo Sapiens
SKLRHGQII

SEQ ID NO: 909272 - protein, 9 aa, Homo Sapiens
KVRLPLKLI

SEQ ID NO: 909273 - protein, 9 aa, Homo Sapiens
CPSAVVLFD

SEQ ID NO: 909274 - protein, 9 aa, Homo Sapiens
LLKTREEVL

SEQ ID NO: 909275 - protein, 9 aa, Homo Sapiens
TNQSAEASA

SEQ ID NO: 909276 - protein, 9 aa, Homo Sapiens
PGEEKIEGY

SEQ ID NO: 909277 - protein, 9 aa, Homo Sapiens
ERNHQWNDA

SEQ ID NO: 909278 - protein, 9 aa, Homo Sapiens
KEEHRPLAW

SEQ ID NO: 909279 - protein, 9 aa, Homo Sapiens
PCPRRLFLS

SEQ ID NO: 909280 - protein, 9 aa, Homo Sapiens
PPPGEKPPV

SEQ ID NO: 909281 - protein, 9 aa, Homo Sapiens
SHCTNARVA

SEQ ID NO: 909282 - protein, 9 aa, Homo Sapiens
PVFHTLSRV

SEQ ID NO: 909283 - protein, 9 aa, Homo Sapiens
VVLENALQF

SEQ ID NO: 909284 - protein, 9 aa, Homo Sapiens
CMKCLPGSL

SEQ ID NO: 909285 - protein, 9 aa, Homo Sapiens
EDFFSLIHR

SEQ ID NO: 909286 - protein, 9 aa, Homo Sapiens
HNLTVRELK

SEQ ID NO: 909287 - protein, 9 aa, Homo Sapiens
PIGDAFRNH

SEQ ID NO: 909288 - protein, 9 aa, Homo Sapiens
LPPAVTTPT

SEQ ID NO: 909289 - protein, 9 aa, Homo Sapiens
EPGEEKIEG

SEQ ID NO: 909290 - protein, 9 aa, Homo Sapiens
LSWSTTFPI

SEQ ID NO: 909291 - protein, 9 aa, Homo Sapiens
PPVFHTLSR

SEQ ID NO: 909292 - protein, 9 aa, Homo Sapiens
GGPMASCCM

SEQ ID NO: 909293 - protein, 9 aa, Homo Sapiens
APEIIAISR

SEQ ID NO: 909294 - protein, 9 aa, Homo Sapiens
KTSYFSLSW

SEQ ID NO: 909295 - protein, 9 aa, Homo Sapiens
VVWRVHSED

SEQ ID NO: 909296 - protein, 9 aa, Homo Sapiens
LENALQFFR

SEQ ID NO: 909297 - protein, 9 aa, Homo Sapiens
GCASGHMVT

SEQ ID NO: 909298 - protein, 9 aa, Homo Sapiens
GEKPPVFHT

SEQ ID NO: 909299 - protein, 9 aa, Homo Sapiens
HCPPWGCLH

SEQ ID NO: 909300 - protein, 9 aa, Homo Sapiens
SAPATGGVM

SEQ ID NO: 909301 - protein, 9 aa, Homo Sapiens
WGCLHSQNV

SEQ ID NO: 909302 - protein, 9 aa, Homo Sapiens
VFLENVIPD

SEQ ID NO: 909303 - protein, 9 aa, Homo Sapiens
HLVVWRVHS

SEQ ID NO: 909304 - protein, 9 aa, Homo Sapiens
ALQFFRFEL

SEQ ID NO: 909305 - protein, 9 aa, Homo Sapiens
PPAVTTPTN

SEQ ID NO: 909306 - protein, 9 aa, Homo Sapiens
LKTREEVLQ

SEQ ID NO: 909307 - protein, 9 aa, Homo Sapiens
VTTPTNQSA

SEQ ID NO: 909308 - protein, 9 aa, Homo Sapiens
FLENVIPDA

SEQ ID NO: 909309 - protein, 9 aa, Homo Sapiens
CTNARVAVL

SEQ ID NO: 909310 - protein, 9 aa, Homo Sapiens
CASGHMVTL

SEQ ID NO: 909311 - protein, 9 aa, Homo Sapiens
IICVLILIY

SEQ ID NO: 909312 - protein, 9 aa, Homo Sapiens
LMLSALQTI

SEQ ID NO: 909313 - protein, 9 aa, Homo Sapiens
QGYDWSQPF

SEQ ID NO: 909314 - protein, 9 aa, Homo Sapiens
EDRDNMSDS

SEQ ID NO: 909315 - protein, 9 aa, Homo Sapiens
DGFFARYYL

SEQ ID NO: 909316 - protein, 9 aa, Homo Sapiens
NRRRGRLCW

SEQ ID NO: 909317 - protein, 9 aa, Homo Sapiens
AQGAPSDAA

SEQ ID NO: 909318 - protein, 9 aa, Homo Sapiens
HLRRCGAPE

SEQ ID NO: 909319 - protein, 9 aa, Homo Sapiens
PEEMDSFSG

SEQ ID NO: 909320 - protein, 9 aa, Homo Sapiens
SVFKKKKVK

SEQ ID NO: 909321 - protein, 9 aa, Homo Sapiens
SATLLKDYI

SEQ ID NO: 909322 - protein, 9 aa, Homo Sapiens
SSENITMAS

SEQ ID NO: 909323 - protein, 9 aa, Homo Sapiens
QGLWEVVVT

SEQ ID NO: 909324 - protein, 9 aa, Homo Sapiens
KHTGNECVT

SEQ ID NO: 909325 - protein, 9 aa, Homo Sapiens
TMIGELRSD

SEQ ID NO: 909326 - protein, 9 aa, Homo Sapiens
RVTVMLGGC

SEQ ID NO: 909327 - protein, 9 aa, Homo Sapiens
DRIRKLVDL

SEQ ID NO: 909328 - protein, 9 aa, Homo Sapiens
KAPLASGPE

SEQ ID NO: 909329 - protein, 9 aa, Homo Sapiens
IQSLKAECD

SEQ ID NO: 909330 - protein, 9 aa, Homo Sapiens
ENITMASLS

SEQ ID NO: 909331 - protein, 9 aa, Homo Sapiens
LHETAAPSD

SEQ ID NO: 909332 - protein, 9 aa, Homo Sapiens
SVCESGARL

SEQ ID NO: 909333 - protein, 9 aa, Homo Sapiens
LIHTQVAAQ

SEQ ID NO: 909334 - protein, 9 aa, Homo Sapiens
SRKAPLASG

SEQ ID NO: 909335 - protein, 9 aa, Homo Sapiens
EEVENEALW

SEQ ID NO: 909336 - protein, 9 aa, Homo Sapiens
NKRSSVFKK

SEQ ID NO: 909337 - protein, 9 aa, Homo Sapiens
FIGCPTPPK

SEQ ID NO: 909338 - protein, 9 aa, Homo Sapiens
GSSENITMA

SEQ ID NO: 909339 - protein, 9 aa, Homo Sapiens
PSKLQNCAR

SEQ ID NO: 909340 - protein, 9 aa, Homo Sapiens
KTLNFNSVD

SEQ ID NO: 909341 - protein, 9 aa, Homo Sapiens
CVAPWIMTP

SEQ ID NO: 909342 - protein, 9 aa, Homo Sapiens
SFQLIINLD

SEQ ID NO: 909343 - protein, 9 aa, Homo Sapiens
LPQLLGPPC

SEQ ID NO: 909344 - protein, 9 aa, Homo Sapiens
TPPLPSNWT

SEQ ID NO: 909345 - protein, 9 aa, Homo Sapiens
ANVVVWLLI

SEQ ID NO: 909346 - protein, 9 aa, Homo Sapiens
ATKRSGAGL

SEQ ID NO: 909347 - protein, 9 aa, Homo Sapiens
PAYGNEQTA

SEQ ID NO: 909348 - protein, 9 aa, Homo Sapiens
TFRTSHYPY

SEQ ID NO: 909349 - protein, 9 aa, Homo Sapiens
HINISALWA

SEQ ID NO: 909350 - protein, 9 aa, Homo Sapiens
EGATLLPAE

SEQ ID NO: 909351 - protein, 9 aa, Homo Sapiens
SGETFRRAK

SEQ ID NO: 909352 - protein, 9 aa, Homo Sapiens
HMESTLNYE

SEQ ID NO: 909353 - protein, 9 aa, Homo Sapiens
ASLSKVTTF

SEQ ID NO: 909354 - protein, 9 aa, Homo Sapiens
LCDRSGVWG

SEQ ID NO: 909355 - protein, 9 aa, Homo Sapiens
VASFTPPLT

SEQ ID NO: 909356 - protein, 9 aa, Homo Sapiens
KISPLLKLT

SEQ ID NO: 909357 - protein, 9 aa, Homo Sapiens
PKVRMTSLK

SEQ ID NO: 909358 - protein, 9 aa, Homo Sapiens
ELSSRQLLI

SEQ ID NO: 909359 - protein, 9 aa, Homo Sapiens
MASLSKVTT

SEQ ID NO: 909360 - protein, 9 aa, Homo Sapiens
EQAVVRAFD

SEQ ID NO: 909361 - protein, 9 aa, Homo Sapiens
TKLLGCHSI

SEQ ID NO: 909362 - protein, 9 aa, Homo Sapiens
ACQGDSRGP

SEQ ID NO: 909363 - protein, 9 aa, Homo Sapiens
YTSSPVPLI

SEQ ID NO: 909364 - protein, 9 aa, Homo Sapiens
SQGYDWSQP

SEQ ID NO: 909365 - protein, 9 aa, Homo Sapiens
TCIIICVLI

SEQ ID NO: 909366 - protein, 9 aa, Homo Sapiens
GVWGIVLEA

SEQ ID NO: 909367 - protein, 9 aa, Homo Sapiens
VWGIVLEAV

SEQ ID NO: 909368 - protein, 9 aa, Homo Sapiens
NEALWAWPS

SEQ ID NO: 909369 - protein, 9 aa, Homo Sapiens
GCHSIEKFR

SEQ ID NO: 909370 - protein, 9 aa, Homo Sapiens
AGLALLNDH

SEQ ID NO: 909371 - protein, 9 aa, Homo Sapiens
GSLLTEHQV

SEQ ID NO: 909372 - protein, 9 aa, Homo Sapiens
RSGAGLALL

SEQ ID NO: 909373 - protein, 9 aa, Homo Sapiens
CPQGRFSPN

SEQ ID NO: 909374 - protein, 9 aa, Homo Sapiens
MPILYGHSA

SEQ ID NO: 909375 - protein, 9 aa, Homo Sapiens
GGRGGGGGS

SEQ ID NO: 909376 - protein, 9 aa, Homo Sapiens
QGEKIHDDI

SEQ ID NO: 909377 - protein, 9 aa, Homo Sapiens
AQESKTEPF

SEQ ID NO: 909378 - protein, 9 aa, Homo Sapiens
QYATKLNNV

SEQ ID NO: 909379 - protein, 9 aa, Homo Sapiens
IINLDKWSA

SEQ ID NO: 909380 - protein, 9 aa, Homo Sapiens
EQEANDLRA

SEQ ID NO: 909381 - protein, 9 aa, Homo Sapiens
ECDEADECF

SEQ ID NO: 909382 - protein, 9 aa, Homo Sapiens
VTVMLGGCW

SEQ ID NO: 909383 - protein, 9 aa, Homo Sapiens
MLHETAAPS

SEQ ID NO: 909384 - protein, 9 aa, Homo Sapiens
QNYTTTTFF

SEQ ID NO: 909385 - protein, 9 aa, Homo Sapiens
KQPLPPAHR

SEQ ID NO: 909386 - protein, 9 aa, Homo Sapiens
VDAQESKTE

SEQ ID NO: 909387 - protein, 9 aa, Homo Sapiens
KKAFIGCPT

SEQ ID NO: 909388 - protein, 9 aa, Homo Sapiens
DSRGPLVCP

SEQ ID NO: 909389 - protein, 9 aa, Homo Sapiens
QGVAEDRDN

SEQ ID NO: 909390 - protein, 9 aa, Homo Sapiens
QAAGSRKAP

SEQ ID NO: 909391 - protein, 9 aa, Homo Sapiens
DGFKISPLL

SEQ ID NO: 909392 - protein, 9 aa, Homo Sapiens
ALWASYKVA

SEQ ID NO: 909393 - protein, 9 aa, Homo Sapiens
RTETPCAKS

SEQ ID NO: 909394 - protein, 9 aa, Homo Sapiens
IKQMATISE

SEQ ID NO: 909395 - protein, 9 aa, Homo Sapiens
ITMASLSKV

SEQ ID NO: 909396 - protein, 9 aa, Homo Sapiens
TDKLHERDE

SEQ ID NO: 909397 - protein, 9 aa, Homo Sapiens
DSIPEFRLS

SEQ ID NO: 909398 - protein, 9 aa, Homo Sapiens
YGRDLIWDM

SEQ ID NO: 909399 - protein, 9 aa, Homo Sapiens
THPSTLASS

SEQ ID NO: 909400 - protein, 9 aa, Homo Sapiens
IRLFQRDFQ

SEQ ID NO: 909401 - protein, 9 aa, Homo Sapiens
SKTEPFTQG

SEQ ID NO: 909402 - protein, 9 aa, Homo Sapiens
LFLCYLLRF

SEQ ID NO: 909403 - protein, 9 aa, Homo Sapiens
NNLTDKLHE

SEQ ID NO: 909404 - protein, 9 aa, Homo Sapiens
MYRGDVVPK

SEQ ID NO: 909405 - protein, 9 aa, Homo Sapiens
VLHTFSSQQ

SEQ ID NO: 909406 - protein, 9 aa, Homo Sapiens
LLKWVVYGF

SEQ ID NO: 909407 - protein, 9 aa, Homo Sapiens
MFLHWLVEM

SEQ ID NO: 909408 - protein, 9 aa, Homo Sapiens
FQLIINLDK

SEQ ID NO: 909409 - protein, 9 aa, Homo Sapiens
RRVPDSLFH

SEQ ID NO: 909410 - protein, 9 aa, Homo Sapiens
ARLTPSKLQ

SEQ ID NO: 909411 - protein, 9 aa, Homo Sapiens
LLPAEDITT

SEQ ID NO: 909412 - protein, 9 aa, Homo Sapiens
IPEFRLSGW

SEQ ID NO: 909413 - protein, 9 aa, Homo Sapiens
SPLLKLTET

SEQ ID NO: 909414 - protein, 9 aa, Homo Sapiens
NKCLTMLHL

SEQ ID NO: 909415 - protein, 9 aa, Homo Sapiens
TTTTFFHSD

SEQ ID NO: 909416 - protein, 9 aa, Homo Sapiens
LPAEDITTV

SEQ ID NO: 909417 - protein, 9 aa, Homo Sapiens
CGPQTCDTL

SEQ ID NO: 909418 - protein, 9 aa, Homo Sapiens
PCAKSETKL

SEQ ID NO: 909419 - protein, 9 aa, Homo Sapiens
VDSDSRLLN

SEQ ID NO: 909420 - protein, 9 aa, Homo Sapiens
AAFVALAMA

SEQ ID NO: 909421 - protein, 9 aa, Homo Sapiens
AGNTLYVLH

SEQ ID NO: 909422 - protein, 9 aa, Homo Sapiens
SALDSIPEF

SEQ ID NO: 909423 - protein, 9 aa, Homo Sapiens
PARLTPSKL

SEQ ID NO: 909424 - protein, 9 aa, Homo Sapiens
TTSGIRLFQ

SEQ ID NO: 909425 - protein, 9 aa, Homo Sapiens
KAECDEADE

SEQ ID NO: 909426 - protein, 9 aa, Homo Sapiens
LLGCHSIEK

SEQ ID NO: 909427 - protein, 9 aa, Homo Sapiens
GRGGGGGSS

SEQ ID NO: 909428 - protein, 9 aa, Homo Sapiens
FLHWLVEMV

SEQ ID NO: 909429 - protein, 9 aa, Homo Sapiens
CHSIEKFRS

SEQ ID NO: 909430 - protein, 9 aa, Homo Sapiens
MRVDSDSRL

SEQ ID NO: 909431 - protein, 9 aa, Homo Sapiens
LDKWSAPNL

SEQ ID NO: 909432 - protein, 9 aa, Homo Sapiens
FTCGRTLLQ

SEQ ID NO: 909433 - protein, 9 aa, Homo Sapiens
ATESVCESG

SEQ ID NO: 909434 - protein, 9 aa, Homo Sapiens
LHEPDSDLC

SEQ ID NO: 909435 - protein, 9 aa, Homo Sapiens
VEMVYVFYF

SEQ ID NO: 909436 - protein, 9 aa, Homo Sapiens
CPEDLLYVL

SEQ ID NO: 909437 - protein, 9 aa, Homo Sapiens
GATDEGLPP

SEQ ID NO: 909438 - protein, 9 aa, Homo Sapiens
ASGETFRRA

SEQ ID NO: 909439 - protein, 9 aa, Homo Sapiens
KIYNNPFAK

SEQ ID NO: 909440 - protein, 9 aa, Homo Sapiens
LTDKLHERD

SEQ ID NO: 909441 - protein, 9 aa, Homo Sapiens
VFCVAPWIM

SEQ ID NO: 909442 - protein, 9 aa, Homo Sapiens
GDSRGPLVC

SEQ ID NO: 909443 - protein, 9 aa, Homo Sapiens
FHSDHSAPS

SEQ ID NO: 909444 - protein, 9 aa, Homo Sapiens
VEALKNSSG

SEQ ID NO: 909445 - protein, 9 aa, Homo Sapiens
MEAENMYYE

SEQ ID NO: 909446 - protein, 9 aa, Homo Sapiens
SSRVVESSP

SEQ ID NO: 909447 - protein, 9 aa, Homo Sapiens
QDSVVFCVA

SEQ ID NO: 909448 - protein, 9 aa, Homo Sapiens
SSRKQLPTL

SEQ ID NO: 909449 - protein, 9 aa, Homo Sapiens
TVMLGGCWL

SEQ ID NO: 909450 - protein, 9 aa, Homo Sapiens
FVSSRKQLP

SEQ ID NO: 909451 - protein, 9 aa, Homo Sapiens
MEMLLKWVV

SEQ ID NO: 909452 - protein, 9 aa, Homo Sapiens
SQGEKIHDD

SEQ ID NO: 909453 - protein, 9 aa, Homo Sapiens
SRVVESSPT

SEQ ID NO: 909454 - protein, 9 aa, Homo Sapiens
PYPPQHPAY

SEQ ID NO: 909455 - protein, 9 aa, Homo Sapiens
IQIVTKHTG

SEQ ID NO: 909456 - protein, 9 aa, Homo Sapiens
QSLKAECDE

SEQ ID NO: 909457 - protein, 9 aa, Homo Sapiens
CESWAPQCS

SEQ ID NO: 909458 - protein, 9 aa, Homo Sapiens
VRMTSLKCG

SEQ ID NO: 909459 - protein, 9 aa, Homo Sapiens
LGEAKERAD

SEQ ID NO: 909460 - protein, 9 aa, Homo Sapiens
LIPRTWDLR

SEQ ID NO: 909461 - protein, 9 aa, Homo Sapiens
TSGIRLFQR

SEQ ID NO: 909462 - protein, 9 aa, Homo Sapiens
GGLHEPDSD

SEQ ID NO: 909463 - protein, 9 aa, Homo Sapiens
ESKTEPFTQ

SEQ ID NO: 909464 - protein, 9 aa, Homo Sapiens
HTFSSQQLY

SEQ ID NO: 909465 - protein, 9 aa, Homo Sapiens
SHRERDHME

SEQ ID NO: 909466 - protein, 9 aa, Homo Sapiens
EPIQQASKV

SEQ ID NO: 909467 - protein, 9 aa, Homo Sapiens
DAENMVEAL

SEQ ID NO: 909468 - protein, 9 aa, Homo Sapiens
DFKITTVEL

SEQ ID NO: 909469 - protein, 9 aa, Homo Sapiens
LKKGCKSVD

SEQ ID NO: 909470 - protein, 9 aa, Homo Sapiens
RGPLVCPDG

SEQ ID NO: 909471 - protein, 9 aa, Homo Sapiens
SAVSKNSRI

SEQ ID NO: 909472 - protein, 9 aa, Homo Sapiens
IPDQDELDQ

SEQ ID NO: 909473 - protein, 9 aa, Homo Sapiens
FDVCKERAK

SEQ ID NO: 909474 - protein, 9 aa, Homo Sapiens
CAKSETKLM

SEQ ID NO: 909475 - protein, 9 aa, Homo Sapiens
HTHPSTLAS

SEQ ID NO: 909476 - protein, 9 aa, Homo Sapiens
ITQLKIYNN

SEQ ID NO: 909477 - protein, 9 aa, Homo Sapiens
ENLQLKKGC

SEQ ID NO: 909478 - protein, 9 aa, Homo Sapiens
KVDAQESKT

SEQ ID NO: 909479 - protein, 9 aa, Homo Sapiens
VPDSLFHSL

SEQ ID NO: 909480 - protein, 9 aa, Homo Sapiens
PQLLGPPCS

SEQ ID NO: 909481 - protein, 9 aa, Homo Sapiens
LGVSLGALT

SEQ ID NO: 909482 - protein, 9 aa, Homo Sapiens
ILYGHSATL

SEQ ID NO: 909483 - protein, 9 aa, Homo Sapiens
CYGADHHLG

SEQ ID NO: 909484 - protein, 9 aa, Homo Sapiens
FARYYLVHQ

SEQ ID NO: 909485 - protein, 9 aa, Homo Sapiens
EMLLKWVVY

SEQ ID NO: 909486 - protein, 9 aa, Homo Sapiens
ENEALWAWP

SEQ ID NO: 909487 - protein, 9 aa, Homo Sapiens
VSKNSRISP

SEQ ID NO: 909488 - protein, 9 aa, Homo Sapiens
RVPDSLFHS

SEQ ID NO: 909489 - protein, 9 aa, Homo Sapiens
TFFHSDHSA

SEQ ID NO: 909490 - protein, 9 aa, Homo Sapiens
PIPDQDELD

SEQ ID NO: 909491 - protein, 9 aa, Homo Sapiens
AFCILSVEP

SEQ ID NO: 909492 - protein, 9 aa, Homo Sapiens
FRKLQHELG

SEQ ID NO: 909493 - protein, 9 aa, Homo Sapiens
RDNMSDSEV

SEQ ID NO: 909494 - protein, 9 aa, Homo Sapiens
NWLQLDHRI

SEQ ID NO: 909495 - protein, 9 aa, Homo Sapiens
VCYTSSPVP

SEQ ID NO: 909496 - protein, 9 aa, Homo Sapiens
KEKQPLPPA

SEQ ID NO: 909497 - protein, 9 aa, Homo Sapiens
PQTCDTLGM

SEQ ID NO: 909498 - protein, 9 aa, Homo Sapiens
SKLQNCARR

SEQ ID NO: 909499 - protein, 9 aa, Homo Sapiens
IYNNPFAKG

SEQ ID NO: 909500 - protein, 9 aa, Homo Sapiens
YVLHTFSSQ

SEQ ID NO: 909501 - protein, 9 aa, Homo Sapiens
NLMLSALQT

SEQ ID NO: 909502 - protein, 9 aa, Homo Sapiens
GAPSDAAGT

SEQ ID NO: 909503 - protein, 9 aa, Homo Sapiens
LLRWLGANT

SEQ ID NO: 909504 - protein, 9 aa, Homo Sapiens
SALWASYKV

SEQ ID NO: 909505 - protein, 9 aa, Homo Sapiens
FHRQLLMHL

SEQ ID NO: 909506 - protein, 9 aa, Homo Sapiens
DSVVFCVAP

SEQ ID NO: 909507 - protein, 9 aa, Homo Sapiens
VLDRIRKLV

SEQ ID NO: 909508 - protein, 9 aa, Homo Sapiens
CQGDSRGPL

SEQ ID NO: 909509 - protein, 9 aa, Homo Sapiens
ASFTPPLTP

SEQ ID NO: 909510 - protein, 9 aa, Homo Sapiens
SGKTDMEAE

SEQ ID NO: 909511 - protein, 9 aa, Homo Sapiens
LKVDAQESK

SEQ ID NO: 909512 - protein, 9 aa, Homo Sapiens
LHERDEKMQ

SEQ ID NO: 909513 - protein, 9 aa, Homo Sapiens
AAAKEKQPL

SEQ ID NO: 909514 - protein, 9 aa, Homo Sapiens
YDWSQPFSP

SEQ ID NO: 909515 - protein, 9 aa, Homo Sapiens
GSSHLRRCG

SEQ ID NO: 909516 - protein, 9 aa, Homo Sapiens
LRFTCSGVE

SEQ ID NO: 909517 - protein, 9 aa, Homo Sapiens
APQCSLVAQ

SEQ ID NO: 909518 - protein, 9 aa, Homo Sapiens
AKTQEEISA

SEQ ID NO: 909519 - protein, 9 aa, Homo Sapiens
ESSRVVESS

SEQ ID NO: 909520 - protein, 9 aa, Homo Sapiens
LSHRERDHM

SEQ ID NO: 909521 - protein, 9 aa, Homo Sapiens
ARLSPDGVS

SEQ ID NO: 909522 - protein, 9 aa, Homo Sapiens
QESKTEPFT

SEQ ID NO: 909523 - protein, 9 aa, Homo Sapiens
KSETKLMTP

SEQ ID NO: 909524 - protein, 9 aa, Homo Sapiens
SDAAGTDRC

SEQ ID NO: 909525 - protein, 9 aa, Homo Sapiens
TGRELSSRQ

SEQ ID NO: 909526 - protein, 9 aa, Homo Sapiens
HSRLIPRTW

SEQ ID NO: 909527 - protein, 9 aa, Homo Sapiens
SFTPPLTPP

SEQ ID NO: 909528 - protein, 9 aa, Homo Sapiens
YLLRFTCSG

SEQ ID NO: 909529 - protein, 9 aa, Homo Sapiens
KLHERDEKM

SEQ ID NO: 909530 - protein, 9 aa, Homo Sapiens
RKQLPTLPT

SEQ ID NO: 909531 - protein, 9 aa, Homo Sapiens
AKKRLAKTQ

SEQ ID NO: 909532 - protein, 9 aa, Homo Sapiens
ISALWASYK

SEQ ID NO: 909533 - protein, 9 aa, Homo Sapiens
RKLVDLCTG

SEQ ID NO: 909534 - protein, 9 aa, Homo Sapiens
KQEKARASG

SEQ ID NO: 909535 - protein, 9 aa, Homo Sapiens
NANVVVWLL

SEQ ID NO: 909536 - protein, 9 aa, Homo Sapiens
PSVLTHAPS

SEQ ID NO: 909537 - protein, 9 aa, Homo Sapiens
QMATISEDV

SEQ ID NO: 909538 - protein, 9 aa, Homo Sapiens
WGLVGAFMI

SEQ ID NO: 909539 - protein, 9 aa, Homo Sapiens
LLTEHQVAE

SEQ ID NO: 909540 - protein, 9 aa, Homo Sapiens
EGLPPHGAP

SEQ ID NO: 909541 - protein, 9 aa, Homo Sapiens
QVEVPNTTQ

SEQ ID NO: 909542 - protein, 9 aa, Homo Sapiens
HLIHTQVAA

SEQ ID NO: 909543 - protein, 9 aa, Homo Sapiens
VCESGARLL

SEQ ID NO: 909544 - protein, 9 aa, Homo Sapiens
RHSNPKVRM

SEQ ID NO: 909545 - protein, 9 aa, Homo Sapiens
RVVESSPTQ

SEQ ID NO: 909546 - protein, 9 aa, Homo Sapiens
YMLHETAAP

SEQ ID NO: 909547 - protein, 9 aa, Homo Sapiens
LGGCWLQTL

SEQ ID NO: 909548 - protein, 9 aa, Homo Sapiens
TLDQYATKL

SEQ ID NO: 909549 - protein, 9 aa, Homo Sapiens
SHINISALW

SEQ ID NO: 909550 - protein, 9 aa, Homo Sapiens
VVYGFKVYF

SEQ ID NO: 909551 - protein, 9 aa, Homo Sapiens
AENMYYEAL

SEQ ID NO: 909552 - protein, 9 aa, Homo Sapiens
RQDLCGPQT

SEQ ID NO: 909553 - protein, 9 aa, Homo Sapiens
QLKIYNNPF

SEQ ID NO: 909554 - protein, 9 aa, Homo Sapiens
ESWAPQCSL

SEQ ID NO: 909555 - protein, 9 aa, Homo Sapiens
AKDGFFARY

SEQ ID NO: 909556 - protein, 9 aa, Homo Sapiens
THAPSPSPS

SEQ ID NO: 909557 - protein, 9 aa, Homo Sapiens
TPPLTPPLP

SEQ ID NO: 909558 - protein, 9 aa, Homo Sapiens
GLVGAFMIN

SEQ ID NO: 909559 - protein, 9 aa, Homo Sapiens
KLVDLCTGL

SEQ ID NO: 909560 - protein, 9 aa, Homo Sapiens
QYYMLHETA

SEQ ID NO: 909561 - protein, 9 aa, Homo Sapiens
YNNPFAKGF

SEQ ID NO: 909562 - protein, 9 aa, Homo Sapiens
FFARYYLVH

SEQ ID NO: 909563 - protein, 9 aa, Homo Sapiens
QPFSPGEDE

SEQ ID NO: 909564 - protein, 9 aa, Homo Sapiens
KLQNCARRG

SEQ ID NO: 909565 - protein, 9 aa, Homo Sapiens
GIALTCIII

SEQ ID NO: 909566 - protein, 9 aa, Homo Sapiens
LDQYATKLN

SEQ ID NO: 909567 - protein, 9 aa, Homo Sapiens
IDFKITTVE

SEQ ID NO: 909568 - protein, 9 aa, Homo Sapiens
AAKEKQPLP

SEQ ID NO: 909569 - protein, 9 aa, Homo Sapiens
NQVEVPNTT

SEQ ID NO: 909570 - protein, 9 aa, Homo Sapiens
QPSESSRVV

SEQ ID NO: 909571 - protein, 9 aa, Homo Sapiens
KSQGYDWSQ

SEQ ID NO: 909572 - protein, 9 aa, Homo Sapiens
MPPTRSVTS

SEQ ID NO: 909573 - protein, 9 aa, Homo Sapiens
SNTKLLGCH

SEQ ID NO: 909574 - protein, 9 aa, Homo Sapiens
TMLHLGGNE

SEQ ID NO: 909575 - protein, 9 aa, Homo Sapiens
AMGSLLTEH

SEQ ID NO: 909576 - protein, 9 aa, Homo Sapiens
RDLIWDMRE

SEQ ID NO: 909577 - protein, 9 aa, Homo Sapiens
NMSDSEVSS

SEQ ID NO: 909578 - protein, 9 aa, Homo Sapiens
LCYLLRFTC

SEQ ID NO: 909579 - protein, 9 aa, Homo Sapiens
EPIPDQDEL

SEQ ID NO: 909580 - protein, 9 aa, Homo Sapiens
NVKMPPTRS

SEQ ID NO: 909581 - protein, 9 aa, Homo Sapiens
GLESNPYRR

SEQ ID NO: 909582 - protein, 9 aa, Homo Sapiens
LSSRQLLIS

SEQ ID NO: 909583 - protein, 9 aa, Homo Sapiens
LYGHSATLL

SEQ ID NO: 909584 - protein, 9 aa, Homo Sapiens
HERDEKMQH

SEQ ID NO: 909585 - protein, 9 aa, Homo Sapiens
QLLMHLGRY

SEQ ID NO: 909586 - protein, 9 aa, Homo Sapiens
TNKCLTMLH

SEQ ID NO: 909587 - protein, 9 aa, Homo Sapiens
TMFLHWLVE

SEQ ID NO: 909588 - protein, 9 aa, Homo Sapiens
NLTDKLHER

SEQ ID NO: 909589 - protein, 9 aa, Homo Sapiens
LLLGATDEG

SEQ ID NO: 909590 - protein, 9 aa, Homo Sapiens
SPTCPLCGK

SEQ ID NO: 909591 - protein, 9 aa, Homo Sapiens
KRSSVFKKK

SEQ ID NO: 909592 - protein, 9 aa, Homo Sapiens
LPEEMDSFS

SEQ ID NO: 909593 - protein, 9 aa, Homo Sapiens
RRCGAPEGF

SEQ ID NO: 909594 - protein, 9 aa, Homo Sapiens
QNLMLSALQ

SEQ ID NO: 909595 - protein, 9 aa, Homo Sapiens
GCWLQTLEA

SEQ ID NO: 909596 - protein, 9 aa, Homo Sapiens
RTCESWAPQ

SEQ ID NO: 909597 - protein, 9 aa, Homo Sapiens
VQPSESSRV

SEQ ID NO: 909598 - protein, 9 aa, Homo Sapiens
PPLTPPLPS

SEQ ID NO: 909599 - protein, 9 aa, Homo Sapiens
QDLCGPQTC

SEQ ID NO: 909600 - protein, 9 aa, Homo Sapiens
GEAKERADI

SEQ ID NO: 909601 - protein, 9 aa, Homo Sapiens
EANDLRAQV

SEQ ID NO: 909602 - protein, 9 aa, Homo Sapiens
LELQNLMLS

SEQ ID NO: 909603 - protein, 9 aa, Homo Sapiens
DRSGVWGIV

SEQ ID NO: 909604 - protein, 9 aa, Homo Sapiens
FEELQGGLH

SEQ ID NO: 909605 - protein, 9 aa, Homo Sapiens
LHWLVEMVY

SEQ ID NO: 909606 - protein, 9 aa, Homo Sapiens
KTQEEISAE

SEQ ID NO: 909607 - protein, 9 aa, Homo Sapiens
LLRFTCSGV

SEQ ID NO: 909608 - protein, 9 aa, Homo Sapiens
KTEPIPDQD

SEQ ID NO: 909609 - protein, 9 aa, Homo Sapiens
VSPTCPLCG

SEQ ID NO: 909610 - protein, 9 aa, Homo Sapiens
DMEAENMYY

SEQ ID NO: 909611 - protein, 9 aa, Homo Sapiens
LRHFFHRQL

SEQ ID NO: 909612 - protein, 9 aa, Homo Sapiens
SPTMIGELR

SEQ ID NO: 909613 - protein, 9 aa, Homo Sapiens
VSLGALTSL

SEQ ID NO: 909614 - protein, 9 aa, Homo Sapiens
YGYKTEPIP

SEQ ID NO: 909615 - protein, 9 aa, Homo Sapiens
SLFLCYLLR

SEQ ID NO: 909616 - protein, 9 aa, Homo Sapiens
VLPFFLCWG

SEQ ID NO: 909617 - protein, 9 aa, Homo Sapiens
KYMACCMMY

SEQ ID NO: 909618 - protein, 9 aa, Homo Sapiens
RLSNLTGAS

SEQ ID NO: 909619 - protein, 9 aa, Homo Sapiens
RLSPDGVSP

SEQ ID NO: 909620 - protein, 9 aa, Homo Sapiens
KLLGCHSIE

SEQ ID NO: 909621 - protein, 9 aa, Homo Sapiens
SKNSRISPP

SEQ ID NO: 909622 - protein, 9 aa, Homo Sapiens
PEFRLSGWL

SEQ ID NO: 909623 - protein, 9 aa, Homo Sapiens
DLCGPQTCD

SEQ ID NO: 909624 - protein, 9 aa, Homo Sapiens
MACCMMYRG

SEQ ID NO: 909625 - protein, 9 aa, Homo Sapiens
TESVCESGA

SEQ ID NO: 909626 - protein, 9 aa, Homo Sapiens
RKAPLASGP

SEQ ID NO: 909627 - protein, 9 aa, Homo Sapiens
RLFQRDFQF

SEQ ID NO: 909628 - protein, 9 aa, Homo Sapiens
PSDAAGTDR

SEQ ID NO: 909629 - protein, 9 aa, Homo Sapiens
VMRVDSDSR

SEQ ID NO: 909630 - protein, 9 aa, Homo Sapiens
RMCYLTIKQ

SEQ ID NO: 909631 - protein, 9 aa, Homo Sapiens
DLIWDMREQ

SEQ ID NO: 909632 - protein, 9 aa, Homo Sapiens
DSDSRLLNA

SEQ ID NO: 909633 - protein, 9 aa, Homo Sapiens
NSVDYMGQN

SEQ ID NO: 909634 - protein, 9 aa, Homo Sapiens
LAMALLFLL

SEQ ID NO: 909635 - protein, 9 aa, Homo Sapiens
ERDHMESTL

SEQ ID NO: 909636 - protein, 9 aa, Homo Sapiens
ALDSIPEFR

SEQ ID NO: 909637 - protein, 9 aa, Homo Sapiens
RILDHDLPK

SEQ ID NO: 909638 - protein, 9 aa, Homo Sapiens
AFDVCKERA

SEQ ID NO: 909639 - protein, 9 aa, Homo Sapiens
CCMMYRGDV

SEQ ID NO: 909640 - protein, 9 aa, Homo Sapiens
NFNSVDYMG

SEQ ID NO: 909641 - protein, 9 aa, Homo Sapiens
VKMPPTRSV

SEQ ID NO: 909642 - protein, 9 aa, Homo Sapiens
DSITNLLKE

SEQ ID NO: 909643 - protein, 9 aa, Homo Sapiens
INNLTDKLH

SEQ ID NO: 909644 - protein, 9 aa, Homo Sapiens
LKEQAVVRA

SEQ ID NO: 909645 - protein, 9 aa, Homo Sapiens
TQVAAQACA

SEQ ID NO: 909646 - protein, 9 aa, Homo Sapiens
SSVFKKKKV

SEQ ID NO: 909647 - protein, 9 aa, Homo Sapiens
TSSPVPLIL

SEQ ID NO: 909648 - protein, 9 aa, Homo Sapiens
LNFNSVDYM

SEQ ID NO: 909649 - protein, 9 aa, Homo Sapiens
VDAENMVEA

SEQ ID NO: 909650 - protein, 9 aa, Homo Sapiens
NITMASLSK

SEQ ID NO: 909651 - protein, 9 aa, Homo Sapiens
QGSESPTMI

SEQ ID NO: 909652 - protein, 9 aa, Homo Sapiens
LLYVLEHNL

SEQ ID NO: 909653 - protein, 9 aa, Homo Sapiens
YRHSNPKVR

SEQ ID NO: 909654 - protein, 9 aa, Homo Sapiens
LKIYNNPFA

SEQ ID NO: 909655 - protein, 9 aa, Homo Sapiens
RSGVWGIVL

SEQ ID NO: 909656 - protein, 9 aa, Homo Sapiens
INLDKWSAP

SEQ ID NO: 909657 - protein, 9 aa, Homo Sapiens
RRGRLCWFS

SEQ ID NO: 909658 - protein, 9 aa, Homo Sapiens
NTLYVLHTF

SEQ ID NO: 909659 - protein, 9 aa, Homo Sapiens
KRSGAGLAL

SEQ ID NO: 909660 - protein, 9 aa, Homo Sapiens
CHSRLIPRT

SEQ ID NO: 909661 - protein, 9 aa, Homo Sapiens
DVCKERAKA

SEQ ID NO: 909662 - protein, 9 aa, Homo Sapiens
VDLCTGLQG

SEQ ID NO: 909663 - protein, 9 aa, Homo Sapiens
ENMYYEALE

SEQ ID NO: 909664 - protein, 9 aa, Homo Sapiens
RHFFHRQLL

SEQ ID NO: 909665 - protein, 9 aa, Homo Sapiens
LAKKRLAKT

SEQ ID NO: 909666 - protein, 9 aa, Homo Sapiens
AFIGCPTPP

SEQ ID NO: 909667 - protein, 9 aa, Homo Sapiens
TAAPSDIVG

SEQ ID NO: 909668 - protein, 9 aa, Homo Sapiens
ADGFKISPL

SEQ ID NO: 909669 - protein, 9 aa, Homo Sapiens
VTKHTGNEC

SEQ ID NO: 909670 - protein, 9 aa, Homo Sapiens
RLTPSKLQN

SEQ ID NO: 909671 - protein, 9 aa, Homo Sapiens
NLRLSNLTG

SEQ ID NO: 909672 - protein, 9 aa, Homo Sapiens
AMALLFLLR

SEQ ID NO: 909673 - protein, 9 aa, Homo Sapiens
LQLDHRILD

SEQ ID NO: 909674 - protein, 9 aa, Homo Sapiens
VAKDGFFAR

SEQ ID NO: 909675 - protein, 9 aa, Homo Sapiens
ELGEAKERA

SEQ ID NO: 909676 - protein, 9 aa, Homo Sapiens
AECDEADEC

SEQ ID NO: 909677 - protein, 9 aa, Homo Sapiens
PQHPAYGNE

SEQ ID NO: 909678 - protein, 9 aa, Homo Sapiens
DNKRSSVFK

SEQ ID NO: 909679 - protein, 9 aa, Homo Sapiens
ATDEGLPPH

SEQ ID NO: 909680 - protein, 9 aa, Homo Sapiens
CIIICVLIL

SEQ ID NO: 909681 - protein, 9 aa, Homo Sapiens
VVTLSERAR

SEQ ID NO: 909682 - protein, 9 aa, Homo Sapiens
TNRRRGRLC

SEQ ID NO: 909683 - protein, 9 aa, Homo Sapiens
ADHHLGRLH

SEQ ID NO: 909684 - protein, 9 aa, Homo Sapiens
LDSIPEFRL

SEQ ID NO: 909685 - protein, 9 aa, Homo Sapiens
TMASLSKVT

SEQ ID NO: 909686 - protein, 9 aa, Homo Sapiens
LQNCARRGH

SEQ ID NO: 909687 - protein, 9 aa, Homo Sapiens
SFTCGRTLL

SEQ ID NO: 909688 - protein, 9 aa, Homo Sapiens
PNTTQSSPV

SEQ ID NO: 909689 - protein, 9 aa, Homo Sapiens
GKTDMEAEN

SEQ ID NO: 909690 - protein, 9 aa, Homo Sapiens
LKWVVYGFK

SEQ ID NO: 909691 - protein, 9 aa, Homo Sapiens
QLLPSVLTH

SEQ ID NO: 909692 - protein, 9 aa, Homo Sapiens
KKRLAKTQE

SEQ ID NO: 909693 - protein, 9 aa, Homo Sapiens
AGSRKAPLA

SEQ ID NO: 909694 - protein, 9 aa, Homo Sapiens
NYTTTTFFH

SEQ ID NO: 909695 - protein, 9 aa, Homo Sapiens
LTGASFVSH

SEQ ID NO: 909696 - protein, 9 aa, Homo Sapiens
TCESWAPQC

SEQ ID NO: 909697 - protein, 9 aa, Homo Sapiens
RCGAPEGFE

SEQ ID NO: 909698 - protein, 9 aa, Homo Sapiens
SSPQNQEPI

SEQ ID NO: 909699 - protein, 9 aa, Homo Sapiens
QMPILYGHS

SEQ ID NO: 909700 - protein, 9 aa, Homo Sapiens
QEANDLRAQ

SEQ ID NO: 909701 - protein, 9 aa, Homo Sapiens
LSSFTCGRT

SEQ ID NO: 909702 - protein, 9 aa, Homo Sapiens
GSRKAPLAS

SEQ ID NO: 909703 - protein, 9 aa, Homo Sapiens
AEITQLKIY

SEQ ID NO: 909704 - protein, 9 aa, Homo Sapiens
TEPIPDQDE

SEQ ID NO: 909705 - protein, 9 aa, Homo Sapiens
VLKVDAQES

SEQ ID NO: 909706 - protein, 9 aa, Homo Sapiens
GASALDSIP

SEQ ID NO: 909707 - protein, 9 aa, Homo Sapiens
AEQEANDLR

SEQ ID NO: 909708 - protein, 9 aa, Homo Sapiens
PIQQASKVE

SEQ ID NO: 909709 - protein, 9 aa, Homo Sapiens
VTGRELSSR

SEQ ID NO: 909710 - protein, 9 aa, Homo Sapiens
PTRSVTSCF

SEQ ID NO: 909711 - protein, 9 aa, Homo Sapiens
KVRMTSLKC

SEQ ID NO: 909712 - protein, 9 aa, Homo Sapiens
DSRLLNARH

SEQ ID NO: 909713 - protein, 9 aa, Homo Sapiens
FCVAPWIMT

SEQ ID NO: 909714 - protein, 9 aa, Homo Sapiens
LLKEQAVVR

SEQ ID NO: 909715 - protein, 9 aa, Homo Sapiens
TPCAKSETK

SEQ ID NO: 909716 - protein, 9 aa, Homo Sapiens
KQLPTLPTL

SEQ ID NO: 909717 - protein, 9 aa, Homo Sapiens
NIHTHPSTL

SEQ ID NO: 909718 - protein, 9 aa, Homo Sapiens
LQTLDQYAT

SEQ ID NO: 909719 - protein, 9 aa, Homo Sapiens
GADHHLGRL

SEQ ID NO: 909720 - protein, 9 aa, Homo Sapiens
LQHELGEAK

SEQ ID NO: 909721 - protein, 9 aa, Homo Sapiens
FTPPLTPPL

SEQ ID NO: 909722 - protein, 9 aa, Homo Sapiens
WLGANTFRT

SEQ ID NO: 909723 - protein, 9 aa, Homo Sapiens
NLDKWSAPN

SEQ ID NO: 909724 - protein, 9 aa, Homo Sapiens
QLLGPPCSW

SEQ ID NO: 909725 - protein, 9 aa, Homo Sapiens
PILYGHSAT

SEQ ID NO: 909726 - protein, 9 aa, Homo Sapiens
ETAAPSDIV

SEQ ID NO: 909727 - protein, 9 aa, Homo Sapiens
YKTEPIPDQ

SEQ ID NO: 909728 - protein, 9 aa, Homo Sapiens
IPRTWDLRQ

SEQ ID NO: 909729 - protein, 9 aa, Homo Sapiens
PLPPAHRGP

SEQ ID NO: 909730 - protein, 9 aa, Homo Sapiens
GALTSLPLE

SEQ ID NO: 909731 - protein, 9 aa, Homo Sapiens
FKITTVELQ

SEQ ID NO: 909732 - protein, 9 aa, Homo Sapiens
ESKTLNFNS

SEQ ID NO: 909733 - protein, 9 aa, Homo Sapiens
SNPYRRRKQ

SEQ ID NO: 909734 - protein, 9 aa, Homo Sapiens
SPDGVSPTC

SEQ ID NO: 909735 - protein, 9 aa, Homo Sapiens
DAQESKTEP

SEQ ID NO: 909736 - protein, 9 aa, Homo Sapiens
SENITMASL

SEQ ID NO: 909737 - protein, 9 aa, Homo Sapiens
IVTKHTGNE

SEQ ID NO: 909738 - protein, 9 aa, Homo Sapiens
QQGSESPTM

SEQ ID NO: 909739 - protein, 9 aa, Homo Sapiens
LPSVLTHAP

SEQ ID NO: 909740 - protein, 9 aa, Homo Sapiens
LGALTSLPL

SEQ ID NO: 909741 - protein, 9 aa, Homo Sapiens
ENANVVVWL

SEQ ID NO: 909742 - protein, 9 aa, Homo Sapiens
EKQPLPPAH

SEQ ID NO: 909743 - protein, 9 aa, Homo Sapiens
MALLFLLRC

SEQ ID NO: 909744 - protein, 9 aa, Homo Sapiens
LDRIRKLVD

SEQ ID NO: 909745 - protein, 9 aa, Homo Sapiens
CDEADECFL

SEQ ID NO: 909746 - protein, 9 aa, Homo Sapiens
AAFDVCKER

SEQ ID NO: 909747 - protein, 9 aa, Homo Sapiens
FLCYLLRFT

SEQ ID NO: 909748 - protein, 9 aa, Homo Sapiens
SKIQIVTKH

SEQ ID NO: 909749 - protein, 9 aa, Homo Sapiens
FQRDFQFQQ

SEQ ID NO: 909750 - protein, 9 aa, Homo Sapiens
RRKQRQEWE

SEQ ID NO: 909751 - protein, 9 aa, Homo Sapiens
KNSRISPPV

SEQ ID NO: 909752 - protein, 9 aa, Homo Sapiens
ITNLLKEQA

SEQ ID NO: 909753 - protein, 9 aa, Homo Sapiens
RGRLCWFSH

SEQ ID NO: 909754 - protein, 9 aa, Homo Sapiens
DNMSDSEVS

SEQ ID NO: 909755 - protein, 9 aa, Homo Sapiens
NTKLLGCHS

SEQ ID NO: 909756 - protein, 9 aa, Homo Sapiens
ESPTMIGEL

SEQ ID NO: 909757 - protein, 9 aa, Homo Sapiens
QCSLVAQIT

SEQ ID NO: 909758 - protein, 9 aa, Homo Sapiens
RRRGRLCWF

SEQ ID NO: 909759 - protein, 9 aa, Homo Sapiens
FFHRQLLMH

SEQ ID NO: 909760 - protein, 9 aa, Homo Sapiens
CGAPEGFEE

SEQ ID NO: 909761 - protein, 9 aa, Homo Sapiens
LLQTLDQYA

SEQ ID NO: 909762 - protein, 9 aa, Homo Sapiens
GHSATLLKD

SEQ ID NO: 909763 - protein, 9 aa, Homo Sapiens
STNQVEVPN

SEQ ID NO: 909764 - protein, 9 aa, Homo Sapiens
KCLTMLHLG

SEQ ID NO: 909765 - protein, 9 aa, Homo Sapiens
SSPVPLILA

SEQ ID NO: 909766 - protein, 9 aa, Homo Sapiens
FFLCWGLVG

SEQ ID NO: 909767 - protein, 9 aa, Homo Sapiens
FFHSDHSAP

SEQ ID NO: 909768 - protein, 9 aa, Homo Sapiens
KMPPTRSVT

SEQ ID NO: 909769 - protein, 9 aa, Homo Sapiens
GVAEDRDNM

SEQ ID NO: 909770 - protein, 9 aa, Homo Sapiens
SDNKRSSVF

SEQ ID NO: 909771 - protein, 9 aa, Homo Sapiens
CYTSSPVPL

SEQ ID NO: 909772 - protein, 9 aa, Homo Sapiens
RIRKLVDLC

SEQ ID NO: 909773 - protein, 9 aa, Homo Sapiens
GRVSSAVSK

SEQ ID NO: 909774 - protein, 9 aa, Homo Sapiens
EELQGGLHE

SEQ ID NO: 909775 - protein, 9 aa, Homo Sapiens
RELSSRQLL

SEQ ID NO: 909776 - protein, 9 aa, Homo Sapiens
SWAPQCSLV

SEQ ID NO: 909777 - protein, 9 aa, Homo Sapiens
KIQIVTKHT

SEQ ID NO: 909778 - protein, 9 aa, Homo Sapiens
CWLQTLEAS

SEQ ID NO: 909779 - protein, 9 aa, Homo Sapiens
SRKQLPTLP

SEQ ID NO: 909780 - protein, 9 aa, Homo Sapiens
WASYKVALP

SEQ ID NO: 909781 - protein, 9 aa, Homo Sapiens
EEEEVENEA

SEQ ID NO: 909782 - protein, 9 aa, Homo Sapiens
DKLHERDEK

SEQ ID NO: 909783 - protein, 9 aa, Homo Sapiens
CWGLVGAFM

SEQ ID NO: 909784 - protein, 9 aa, Homo Sapiens
VFQDSVVFC

SEQ ID NO: 909785 - protein, 9 aa, Homo Sapiens
LTIKQMATI

SEQ ID NO: 909786 - protein, 9 aa, Homo Sapiens
LAKTQEEIS

SEQ ID NO: 909787 - protein, 9 aa, Homo Sapiens
QLDHRILDH

SEQ ID NO: 909788 - protein, 9 aa, Homo Sapiens
PQCSLVAQI

SEQ ID NO: 909789 - protein, 9 aa, Homo Sapiens
VYGFKVYFT

SEQ ID NO: 909790 - protein, 9 aa, Homo Sapiens
TIGIDFKIT

SEQ ID NO: 909791 - protein, 9 aa, Homo Sapiens
PQNQEPIQQ

SEQ ID NO: 909792 - protein, 9 aa, Homo Sapiens
LTPPLPSNW

SEQ ID NO: 909793 - protein, 9 aa, Homo Sapiens
PYGYKTEPI

SEQ ID NO: 909794 - protein, 9 aa, Homo Sapiens
CYLLRFTCS

SEQ ID NO: 909795 - protein, 9 aa, Homo Sapiens
SESSRVVES

SEQ ID NO: 909796 - protein, 9 aa, Homo Sapiens
SLKAECDEA

SEQ ID NO: 909797 - protein, 9 aa, Homo Sapiens
HDDIFDIID

SEQ ID NO: 909798 - protein, 9 aa, Homo Sapiens
TCGRTLLQE

SEQ ID NO: 909799 - protein, 9 aa, Homo Sapiens
DGVSPTCPL

SEQ ID NO: 909800 - protein, 9 aa, Homo Sapiens
LQNLMLSAL

SEQ ID NO: 909801 - protein, 9 aa, Homo Sapiens
VFKKKKVKE

SEQ ID NO: 909802 - protein, 9 aa, Homo Sapiens
KDGFFARYY

SEQ ID NO: 909803 - protein, 9 aa, Homo Sapiens
GPYPPQHPA

SEQ ID NO: 909804 - protein, 9 aa, Homo Sapiens
LSETSPAFC

SEQ ID NO: 909805 - protein, 9 aa, Homo Sapiens
LSALQTIYG

SEQ ID NO: 909806 - protein, 9 aa, Homo Sapiens
TPSKLQNCA

SEQ ID NO: 909807 - protein, 9 aa, Homo Sapiens
LFQRDFQFQ

SEQ ID NO: 909808 - protein, 9 aa, Homo Sapiens
HRQLLMHLG

SEQ ID NO: 909809 - protein, 9 aa, Homo Sapiens
LGPPCSWEA

SEQ ID NO: 909810 - protein, 9 aa, Homo Sapiens
EEEVENEAL

SEQ ID NO: 909811 - protein, 9 aa, Homo Sapiens
QTNKCLTML

SEQ ID NO: 909812 - protein, 9 aa, Homo Sapiens
LQQGSESPT

SEQ ID NO: 909813 - protein, 9 aa, Homo Sapiens
TKRSGAGLA

SEQ ID NO: 909814 - protein, 9 aa, Homo Sapiens
ILFVSSRKQ

SEQ ID NO: 909815 - protein, 9 aa, Homo Sapiens
AENMVEALK

SEQ ID NO: 909816 - protein, 9 aa, Homo Sapiens
TSPAFCILS

SEQ ID NO: 909817 - protein, 9 aa, Homo Sapiens
LRRCGAPEG

SEQ ID NO: 909818 - protein, 9 aa, Homo Sapiens
MLSALQTIY

SEQ ID NO: 909819 - protein, 9 aa, Homo Sapiens
ELAKKRLAK

SEQ ID NO: 909820 - protein, 9 aa, Homo Sapiens
NTTQSSPVS

SEQ ID NO: 909821 - protein, 9 aa, Homo Sapiens
VVESSPTQQ

SEQ ID NO: 909822 - protein, 9 aa, Homo Sapiens
VEGATLLPA

SEQ ID NO: 909823 - protein, 9 aa, Homo Sapiens
CAAFVALAM

SEQ ID NO: 909824 - protein, 9 aa, Homo Sapiens
LSPDGVSPT

SEQ ID NO: 909825 - protein, 9 aa, Homo Sapiens
ACQGLWEVV

SEQ ID NO: 909826 - protein, 9 aa, Homo Sapiens
LTCIIICVL

SEQ ID NO: 909827 - protein, 9 aa, Homo Sapiens
VVFCVAPWI

SEQ ID NO: 909828 - protein, 9 aa, Homo Sapiens
YYMLHETAA

SEQ ID NO: 909829 - protein, 9 aa, Homo Sapiens
LYVLHTFSS

SEQ ID NO: 909830 - protein, 9 aa, Homo Sapiens
CPTPPKTPN

SEQ ID NO: 909831 - protein, 9 aa, Homo Sapiens
LTHAPSPSP

SEQ ID NO: 909832 - protein, 9 aa, Homo Sapiens
TLYVLHTFS

SEQ ID NO: 909833 - protein, 9 aa, Homo Sapiens
CRCHSRLIP

SEQ ID NO: 909834 - protein, 9 aa, Homo Sapiens
LWEVVVTLS

SEQ ID NO: 909835 - protein, 9 aa, Homo Sapiens
LGANTFRTS

SEQ ID NO: 909836 - protein, 9 aa, Homo Sapiens
VMLGGCWLQ

SEQ ID NO: 909837 - protein, 9 aa, Homo Sapiens
ASDNKRSSV

SEQ ID NO: 909838 - protein, 9 aa, Homo Sapiens
ADACQGDSR

SEQ ID NO: 909839 - protein, 9 aa, Homo Sapiens
LVEMVYVFY

SEQ ID NO: 909840 - protein, 9 aa, Homo Sapiens
ISFQLIINL

SEQ ID NO: 909841 - protein, 9 aa, Homo Sapiens
IHDDIFDII

SEQ ID NO: 909842 - protein, 9 aa, Homo Sapiens
LRWLGANTF

SEQ ID NO: 909843 - protein, 9 aa, Homo Sapiens
DLLYVLEHN

SEQ ID NO: 909844 - protein, 9 aa, Homo Sapiens
QGDSRGPLV

SEQ ID NO: 909845 - protein, 9 aa, Homo Sapiens
IGCPTPPKT

SEQ ID NO: 909846 - protein, 9 aa, Homo Sapiens
GATLLPAED

SEQ ID NO: 909847 - protein, 9 aa, Homo Sapiens
PQLLPSVLT

SEQ ID NO: 909848 - protein, 9 aa, Homo Sapiens
WVVYGFKVY

SEQ ID NO: 909849 - protein, 9 aa, Homo Sapiens
GAKTSLPEE

SEQ ID NO: 909850 - protein, 9 aa, Homo Sapiens
RSVTSCFQS

SEQ ID NO: 909851 - protein, 9 aa, Homo Sapiens
TNQVEVPNT

SEQ ID NO: 909852 - protein, 9 aa, Homo Sapiens
TDEGLPPHG

SEQ ID NO: 909853 - protein, 9 aa, Homo Sapiens
SPVPLILAS

SEQ ID NO: 909854 - protein, 9 aa, Homo Sapiens
ACRVAEQEA

SEQ ID NO: 909855 - protein, 9 aa, Homo Sapiens
SRGPLVCPD

SEQ ID NO: 909856 - protein, 9 aa, Homo Sapiens
RWLGANTFR

SEQ ID NO: 909857 - protein, 9 aa, Homo Sapiens
MCYLTIKQM

SEQ ID NO: 909858 - protein, 9 aa, Homo Sapiens
NLTGASFVS

SEQ ID NO: 909859 - protein, 9 aa, Homo Sapiens
YRRRKQRQE

SEQ ID NO: 909860 - protein, 9 aa, Homo Sapiens
CGRTLLQED

SEQ ID NO: 909861 - protein, 9 aa, Homo Sapiens
HSIEKFRSH

SEQ ID NO: 909862 - protein, 9 aa, Homo Sapiens
TSLPLEELP

SEQ ID NO: 909863 - protein, 9 aa, Homo Sapiens
QGAKTSLPE

SEQ ID NO: 909864 - protein, 9 aa, Homo Sapiens
LHTFSSQQL

SEQ ID NO: 909865 - protein, 9 aa, Homo Sapiens
HEPDSDLCG

SEQ ID NO: 909866 - protein, 9 aa, Homo Sapiens
TTVELQGKK

SEQ ID NO: 909867 - protein, 9 aa, Homo Sapiens
PPTRSVTSC

SEQ ID NO: 909868 - protein, 9 aa, Homo Sapiens
ESGARLLFM

SEQ ID NO: 909869 - protein, 9 aa, Homo Sapiens
EKARASGET

SEQ ID NO: 909870 - protein, 9 aa, Homo Sapiens
SLGALTSLP

SEQ ID NO: 909871 - protein, 9 aa, Homo Sapiens
EVPNTTQSS

SEQ ID NO: 909872 - protein, 9 aa, Homo Sapiens
ETPCAKSET

SEQ ID NO: 909873 - protein, 9 aa, Homo Sapiens
KQMATISED

SEQ ID NO: 909874 - protein, 9 aa, Homo Sapiens
RASGETFRR

SEQ ID NO: 909875 - protein, 9 aa, Homo Sapiens
APSDAAGTD

SEQ ID NO: 909876 - protein, 9 aa, Homo Sapiens
MMYRGDVVP

SEQ ID NO: 909877 - protein, 9 aa, Homo Sapiens
AEDITTVGS

SEQ ID NO: 909878 - protein, 9 aa, Homo Sapiens
VAEDRDNMS

SEQ ID NO: 909879 - protein, 9 aa, Homo Sapiens
TSLPEEMDS

SEQ ID NO: 909880 - protein, 9 aa, Homo Sapiens
HTGNECVTA

SEQ ID NO: 909881 - protein, 9 aa, Homo Sapiens
GVSLGALTS

SEQ ID NO: 909882 - protein, 9 aa, Homo Sapiens
YMACCMMYR

SEQ ID NO: 909883 - protein, 9 aa, Homo Sapiens
SQPFSPGED

SEQ ID NO: 909884 - protein, 9 aa, Homo Sapiens
DGDAAMGSL

SEQ ID NO: 909885 - protein, 9 aa, Homo Sapiens
GACYGADHH

SEQ ID NO: 909886 - protein, 9 aa, Homo Sapiens
RVAEQEAND

SEQ ID NO: 909887 - protein, 9 aa, Homo Sapiens
QQGAKTSLP

SEQ ID NO: 909888 - protein, 9 aa, Homo Sapiens
GFFARYYLV

SEQ ID NO: 909889 - protein, 9 aa, Homo Sapiens
NQEPIQQAS

SEQ ID NO: 909890 - protein, 9 aa, Homo Sapiens
GSESPTMIG

SEQ ID NO: 909891 - protein, 9 aa, Homo Sapiens
TQLKIYNNP

SEQ ID NO: 909892 - protein, 9 aa, Homo Sapiens
KKGCKSVDE

SEQ ID NO: 909893 - protein, 9 aa, Homo Sapiens
GAGLALLND

SEQ ID NO: 909894 - protein, 9 aa, Homo Sapiens
MYGRDLIWD

SEQ ID NO: 909895 - protein, 9 aa, Homo Sapiens
PAEDITTVG

SEQ ID NO: 909896 - protein, 9 aa, Homo Sapiens
TLLPAEDIT

SEQ ID NO: 909897 - protein, 9 aa, Homo Sapiens
RLAKTQEEI

SEQ ID NO: 909898 - protein, 9 aa, Homo Sapiens
LGATDEGLP

SEQ ID NO: 909899 - protein, 9 aa, Homo Sapiens
PYRRRKQRQ

SEQ ID NO: 909900 - protein, 9 aa, Homo Sapiens
LPFFLCWGL

SEQ ID NO: 909901 - protein, 9 aa, Homo Sapiens
SGVWGIVLE

SEQ ID NO: 909902 - protein, 9 aa, Homo Sapiens
AKEKQPLPP

SEQ ID NO: 909903 - protein, 9 aa, Homo Sapiens
PCSWEAEGL

SEQ ID NO: 909904 - protein, 9 aa, Homo Sapiens
RNIHTHPST

SEQ ID NO: 909905 - protein, 9 aa, Homo Sapiens
CESGARLLF

SEQ ID NO: 909906 - protein, 9 aa, Homo Sapiens
HSATLLKDY

SEQ ID NO: 909907 - protein, 9 aa, Homo Sapiens
GFKISPLLK

SEQ ID NO: 909908 - protein, 9 aa, Homo Sapiens
DQYATKLNN

SEQ ID NO: 909909 - protein, 9 aa, Homo Sapiens
PDSLFHSLL

SEQ ID NO: 909910 - protein, 9 aa, Homo Sapiens
YGHSATLLK

SEQ ID NO: 909911 - protein, 9 aa, Homo Sapiens
EITQLKIYN

SEQ ID NO: 909912 - protein, 9 aa, Homo Sapiens
TVDAENMVE

SEQ ID NO: 909913 - protein, 9 aa, Homo Sapiens
ALTSLPLEE

SEQ ID NO: 909914 - protein, 9 aa, Homo Sapiens
PTMIGELRS

SEQ ID NO: 909915 - protein, 9 aa, Homo Sapiens
GASFVSHYI

SEQ ID NO: 909916 - protein, 9 aa, Homo Sapiens
MGSLLTEHQ

SEQ ID NO: 909917 - protein, 9 aa, Homo Sapiens
WEVVVTLSE

SEQ ID NO: 909918 - protein, 9 aa, Homo Sapiens
HTQVAAQAC

SEQ ID NO: 909919 - protein, 9 aa, Homo Sapiens
AVAKDGFFA

SEQ ID NO: 909920 - protein, 9 aa, Homo Sapiens
SNLTGASFV

SEQ ID NO: 909921 - protein, 9 aa, Homo Sapiens
FHSLLERYL

SEQ ID NO: 909922 - protein, 9 aa, Homo Sapiens
CILSVEPRL

SEQ ID NO: 909923 - protein, 9 aa, Homo Sapiens
KEQAVVRAF

SEQ ID NO: 909924 - protein, 9 aa, Homo Sapiens
ANTFRTSHY

SEQ ID NO: 909925 - protein, 9 aa, Homo Sapiens
IHTHPSTLA

SEQ ID NO: 909926 - protein, 9 aa, Homo Sapiens
LCGPQTCDT

SEQ ID NO: 909927 - protein, 9 aa, Homo Sapiens
MLGGCWLQT

SEQ ID NO: 909928 - protein, 9 aa, Homo Sapiens
ENPRNIHTH

SEQ ID NO: 909929 - protein, 9 aa, Homo Sapiens
AFVALAMAL

SEQ ID NO: 909930 - protein, 9 aa, Homo Sapiens
LTCPQGRFS

SEQ ID NO: 909931 - protein, 9 aa, Homo Sapiens
QLPTLPTLL

SEQ ID NO: 909932 - protein, 9 aa, Homo Sapiens
LTPSKLQNC

SEQ ID NO: 909933 - protein, 9 aa, Homo Sapiens
QHELGEAKE

SEQ ID NO: 909934 - protein, 9 aa, Homo Sapiens
WLQLDHRIL

SEQ ID NO: 909935 - protein, 9 aa, Homo Sapiens
IWDMREQLS

SEQ ID NO: 909936 - protein, 9 aa, Homo Sapiens
RFTCSGVEA

SEQ ID NO: 909937 - protein, 9 aa, Homo Sapiens
LIINLDKWS

SEQ ID NO: 909938 - protein, 9 aa, Homo Sapiens
SLLTEHQVA

SEQ ID NO: 909939 - protein, 9 aa, Homo Sapiens
RLIPRTWDL

SEQ ID NO: 909940 - protein, 9 aa, Homo Sapiens
QLIINLDKW

SEQ ID NO: 909941 - protein, 9 aa, Homo Sapiens
ISPLLKLTE

SEQ ID NO: 909942 - protein, 9 aa, Homo Sapiens
GARLLFMSI

SEQ ID NO: 909943 - protein, 9 aa, Homo Sapiens
PPQHPAYGN

SEQ ID NO: 909944 - protein, 9 aa, Homo Sapiens
GCPTPPKTP

SEQ ID NO: 909945 - protein, 9 aa, Homo Sapiens
KARASGETF

SEQ ID NO: 909946 - protein, 9 aa, Homo Sapiens
KWVVYGFKV

SEQ ID NO: 909947 - protein, 9 aa, Homo Sapiens
CQGLWEVVV

SEQ ID NO: 909948 - protein, 9 aa, Homo Sapiens
GIQSLKAEC

SEQ ID NO: 909949 - protein, 9 aa, Homo Sapiens
IHLIHTQVA

SEQ ID NO: 909950 - protein, 9 aa, Homo Sapiens
LWASYKVAL

SEQ ID NO: 909951 - protein, 9 aa, Homo Sapiens
SVVFCVAPW

SEQ ID NO: 909952 - protein, 9 aa, Homo Sapiens
YATKLNNVI

SEQ ID NO: 909953 - protein, 9 aa, Homo Sapiens
RDHMESTLN

SEQ ID NO: 909954 - protein, 9 aa, Homo Sapiens
AKSETKLMT

SEQ ID NO: 909955 - protein, 9 aa, Homo Sapiens
SSHLRRCGA

SEQ ID NO: 909956 - protein, 9 aa, Homo Sapiens
SLPQLLGPP

SEQ ID NO: 909957 - protein, 9 aa, Homo Sapiens
QVAAQACAV

SEQ ID NO: 909958 - protein, 9 aa, Homo Sapiens
AVSKNSRIS

SEQ ID NO: 909959 - protein, 9 aa, Homo Sapiens
RGGGGGSSA

SEQ ID NO: 909960 - protein, 9 aa, Homo Sapiens
HPAYGNEQT

SEQ ID NO: 909961 - protein, 9 aa, Homo Sapiens
MSIHLIHTQ

SEQ ID NO: 909962 - protein, 9 aa, Homo Sapiens
PEDLLYVLE

SEQ ID NO: 909963 - protein, 9 aa, Homo Sapiens
GIRLFQRDF

SEQ ID NO: 909964 - protein, 9 aa, Homo Sapiens
FSQGEKIHD

SEQ ID NO: 909965 - protein, 9 aa, Homo Sapiens
LQGGLHEPD

SEQ ID NO: 909966 - protein, 9 aa, Homo Sapiens
ESNPYRRRK

SEQ ID NO: 909967 - protein, 9 aa, Homo Sapiens
YTTTTFFHS

SEQ ID NO: 909968 - protein, 9 aa, Homo Sapiens
IIICVLILI

SEQ ID NO: 909969 - protein, 9 aa, Homo Sapiens
KTSLPEEMD

SEQ ID NO: 909970 - protein, 9 aa, Homo Sapiens
GTVDAENMV

SEQ ID NO: 909971 - protein, 9 aa, Homo Sapiens
LCWFSHSTR

SEQ ID NO: 909972 - protein, 9 aa, Homo Sapiens
SLPEEMDSF

SEQ ID NO: 909973 - protein, 9 aa, Homo Sapiens
LIWDMREQL

SEQ ID NO: 909974 - protein, 9 aa, Homo Sapiens
ETSPAFCIL

SEQ ID NO: 909975 - protein, 9 aa, Homo Sapiens
DDIFDIIDR

SEQ ID NO: 909976 - protein, 9 aa, Homo Sapiens
ELQNLMLSA

SEQ ID NO: 909977 - protein, 9 aa, Homo Sapiens
DRDNMSDSE

SEQ ID NO: 909978 - protein, 9 aa, Homo Sapiens
RQLLMHLGR

SEQ ID NO: 909979 - protein, 9 aa, Homo Sapiens
WSQPFSPGE

SEQ ID NO: 909980 - protein, 9 aa, Homo Sapiens
SGARLLFMS

SEQ ID NO: 909981 - protein, 9 aa, Homo Sapiens
SESPTMIGE

SEQ ID NO: 909982 - protein, 9 aa, Homo Sapiens
PSESSRVVE

SEQ ID NO: 909983 - protein, 9 aa, Homo Sapiens
IRKLVDLCT

SEQ ID NO: 909984 - protein, 9 aa, Homo Sapiens
SPAFCILSV

SEQ ID NO: 909985 - protein, 9 aa, Homo Sapiens
RVDSDSRLL

SEQ ID NO: 909986 - protein, 9 aa, Homo Sapiens
SVLTHAPSP

SEQ ID NO: 909987 - protein, 9 aa, Homo Sapiens
LLPSVLTHA

SEQ ID NO: 909988 - protein, 9 aa, Homo Sapiens
KIHDDIFDI

SEQ ID NO: 909989 - protein, 9 aa, Homo Sapiens
ATLLPAEDI

SEQ ID NO: 909990 - protein, 9 aa, Homo Sapiens
QGRFSPNCT

SEQ ID NO: 909991 - protein, 9 aa, Homo Sapiens
HWLVEMVYV

SEQ ID NO: 909992 - protein, 9 aa, Homo Sapiens
KITTVELQG

SEQ ID NO: 909993 - protein, 9 aa, Homo Sapiens
QIVTKHTGN

SEQ ID NO: 909994 - protein, 9 aa, Homo Sapiens
ARASGETFR

SEQ ID NO: 909995 - protein, 9 aa, Homo Sapiens
LSNLTGASF

SEQ ID NO: 909996 - protein, 9 aa, Homo Sapiens
TRQDLCGPQ

SEQ ID NO: 909997 - protein, 9 aa, Homo Sapiens
NPRNIHTHP

SEQ ID NO: 909998 - protein, 9 aa, Homo Sapiens
TRSVTSCFQ

SEQ ID NO: 909999 - protein, 9 aa, Homo Sapiens
SPNCTHVCG

SEQ ID NO: 910000 - protein, 9 aa, Homo Sapiens
AKTSLPEEM

SEQ ID NO: 910001 - protein, 9 aa, Homo Sapiens
LCWGLVGAF

SEQ ID NO: 910002 - protein, 9 aa, Homo Sapiens
SALQTIYGA

SEQ ID NO: 910003 - protein, 9 aa, Homo Sapiens
GNTLYVLHT

SEQ ID NO: 910004 - protein, 9 aa, Homo Sapiens
GYKTEPIPD

SEQ ID NO: 910005 - protein, 9 aa, Homo Sapiens
SITNLLKEQ

SEQ ID NO: 910006 - protein, 9 aa, Homo Sapiens
IHTQVAAQA

SEQ ID NO: 910007 - protein, 9 aa, Homo Sapiens
HRERDHMES

SEQ ID NO: 910008 - protein, 9 aa, Homo Sapiens
DVCYTSSPV

SEQ ID NO: 910009 - protein, 9 aa, Homo Sapiens
FLCWGLVGA

SEQ ID NO: 910010 - protein, 9 aa, Homo Sapiens
DEGLPPHGA

SEQ ID NO: 910011 - protein, 9 aa, Homo Sapiens
GRLCWFSHS

SEQ ID NO: 910012 - protein, 9 aa, Homo Sapiens
YPPQHPAYG

SEQ ID NO: 910013 - protein, 9 aa, Homo Sapiens
SHLRRCGAP

SEQ ID NO: 910014 - protein, 9 aa, Homo Sapiens
NLLKEQAVV

SEQ ID NO: 910015 - protein, 9 aa, Homo Sapiens
CLTMLHLGG

SEQ ID NO: 910016 - protein, 9 aa, Homo Sapiens
DAAMGSLLT

SEQ ID NO: 910017 - protein, 9 aa, Homo Sapiens
CDRSGVWGI

SEQ ID NO: 910018 - protein, 9 aa, Homo Sapiens
HHLGRLHPC

SEQ ID NO: 910019 - protein, 9 aa, Homo Sapiens
HSLLERYLT

SEQ ID NO: 910020 - protein, 9 aa, Homo Sapiens
SSAVSKNSR

SEQ ID NO: 910021 - protein, 9 aa, Homo Sapiens
PPCSWEAEG

SEQ ID NO: 910022 - protein, 9 aa, Homo Sapiens
LRLSNLTGA

SEQ ID NO: 910023 - protein, 9 aa, Homo Sapiens
LVDLCTGLQ

SEQ ID NO: 910024 - protein, 9 aa, Homo Sapiens
SSQAAGSRK

SEQ ID NO: 910025 - protein, 9 aa, Homo Sapiens
GRFSPNCTH

SEQ ID NO: 910026 - protein, 9 aa, Homo Sapiens
DSLFHSLLE

SEQ ID NO: 910027 - protein, 9 aa, Homo Sapiens
SRQLLISQH

SEQ ID NO: 910028 - protein, 9 aa, Homo Sapiens
FCILSVEPR

SEQ ID NO: 910029 - protein, 9 aa, Homo Sapiens
KAAFDVCKE

SEQ ID NO: 910030 - protein, 9 aa, Homo Sapiens
SRLIPRTWD

SEQ ID NO: 910031 - protein, 9 aa, Homo Sapiens
ALAMALLFL

SEQ ID NO: 910032 - protein, 9 aa, Homo Sapiens
GYDWSQPFS

SEQ ID NO: 910033 - protein, 9 aa, Homo Sapiens
VVVWLLIRK

SEQ ID NO: 910034 - protein, 9 aa, Homo Sapiens
RVSSAVSKN

SEQ ID NO: 910035 - protein, 9 aa, Homo Sapiens
GGCWLQTLE

SEQ ID NO: 910036 - protein, 9 aa, Homo Sapiens
HRILDHDLP

SEQ ID NO: 910037 - protein, 9 aa, Homo Sapiens
RLLNARHDW

SEQ ID NO: 910038 - protein, 9 aa, Homo Sapiens
SKTLNFNSV

SEQ ID NO: 910039 - protein, 9 aa, Homo Sapiens
PLLKLTETK

SEQ ID NO: 910040 - protein, 9 aa, Homo Sapiens
FSPNCTHVC

SEQ ID NO: 910041 - protein, 9 aa, Homo Sapiens
LKAECDEAD

SEQ ID NO: 910042 - protein, 9 aa, Homo Sapiens
SQAAGSRKA

SEQ ID NO: 910043 - protein, 9 aa, Homo Sapiens
ENMVEALKN

SEQ ID NO: 910044 - protein, 9 aa, Homo Sapiens
YNLCDRSGV

SEQ ID NO: 910045 - protein, 9 aa, Homo Sapiens
TIKQMATIS

SEQ ID NO: 910046 - protein, 9 aa, Homo Sapiens
SLSHRERDH

SEQ ID NO: 910047 - protein, 9 aa, Homo Sapiens
QTLDQYATK

SEQ ID NO: 910048 - protein, 9 aa, Homo Sapiens
LGCHSIEKF

SEQ ID NO: 910049 - protein, 9 aa, Homo Sapiens
AYGNEQTAS

SEQ ID NO: 910050 - protein, 9 aa, Homo Sapiens
GDAAMGSLL

SEQ ID NO: 910051 - protein, 9 aa, Homo Sapiens
SVDYMGQNA

SEQ ID NO: 910052 - protein, 9 aa, Homo Sapiens
VAEQEANDL

SEQ ID NO: 910053 - protein, 9 aa, Homo Sapiens
TPPKTPNGN

SEQ ID NO: 910054 - protein, 9 aa, Homo Sapiens
GKYMACCMM

SEQ ID NO: 910055 - protein, 9 aa, Homo Sapiens
PDGVSPTCP

SEQ ID NO: 910056 - protein, 9 aa, Homo Sapiens
NPYRRRKQR

SEQ ID NO: 910057 - protein, 9 aa, Homo Sapiens
ITTVELQGK

SEQ ID NO: 910058 - protein, 9 aa, Homo Sapiens
HFFHRQLLM

SEQ ID NO: 910059 - protein, 9 aa, Homo Sapiens
NVVVWLLIR

SEQ ID NO: 910060 - protein, 9 aa, Homo Sapiens
QRDFQFQQI

SEQ ID NO: 910061 - protein, 9 aa, Homo Sapiens
NTFRTSHYP

SEQ ID NO: 910062 - protein, 9 aa, Homo Sapiens
NLCDRSGVW

SEQ ID NO: 910063 - protein, 9 aa, Homo Sapiens
QGAPSDAAG

SEQ ID NO: 910064 - protein, 9 aa, Homo Sapiens
QEPIQQASK

SEQ ID NO: 910065 - protein, 9 aa, Homo Sapiens
FQDSVVFCV

SEQ ID NO: 910066 - protein, 9 aa, Homo Sapiens
ALTCIIICV

SEQ ID NO: 910067 - protein, 9 aa, Homo Sapiens
TSSPQNQEP

SEQ ID NO: 910068 - protein, 9 aa, Homo Sapiens
SETSPAFCI

SEQ ID NO: 910069 - protein, 9 aa, Homo Sapiens
QEKARASGE

SEQ ID NO: 910070 - protein, 9 aa, Homo Sapiens
NPKVRMTSL

SEQ ID NO: 910071 - protein, 9 aa, Homo Sapiens
VGIALTCII

SEQ ID NO: 910072 - protein, 9 aa, Homo Sapiens
QCPEDLLYV

SEQ ID NO: 910073 - protein, 9 aa, Homo Sapiens
TDMEAENMY

SEQ ID NO: 910074 - protein, 9 aa, Homo Sapiens
PFFLCWGLV

SEQ ID NO: 910075 - protein, 9 aa, Homo Sapiens
WLLIRKPEC

SEQ ID NO: 910076 - protein, 9 aa, Homo Sapiens
MLLKWVVYG

SEQ ID NO: 910077 - protein, 9 aa, Homo Sapiens
RACRVAEQE

SEQ ID NO: 910078 - protein, 9 aa, Homo Sapiens
EDLLYVLEH

SEQ ID NO: 910079 - protein, 9 aa, Homo Sapiens
LTMLHLGGN

SEQ ID NO: 910080 - protein, 9 aa, Homo Sapiens
GLHEPDSDL

SEQ ID NO: 910081 - protein, 9 aa, Homo Sapiens
HELGEAKER

SEQ ID NO: 910082 - protein, 9 aa, Homo Sapiens
RSSVFKKKK

SEQ ID NO: 910083 - protein, 9 aa, Homo Sapiens
FNSVDYMGQ

SEQ ID NO: 910084 - protein, 9 aa, Homo Sapiens
ASALDSIPE

SEQ ID NO: 910085 - protein, 9 aa, Homo Sapiens
SDSRLLNAR

SEQ ID NO: 910086 - protein, 9 aa, Homo Sapiens
GPQTCDTLG

SEQ ID NO: 910087 - protein, 9 aa, Homo Sapiens
RQLLISQHE

SEQ ID NO: 910088 - protein, 9 aa, Homo Sapiens
EKIHDDIFD

SEQ ID NO: 910089 - protein, 9 aa, Homo Sapiens
SIPEFRLSG

SEQ ID NO: 910090 - protein, 9 aa, Homo Sapiens
EKQCPEDLL

SEQ ID NO: 910091 - protein, 9 aa, Homo Sapiens
VWLLIRKPE

SEQ ID NO: 910092 - protein, 9 aa, Homo Sapiens
TTFFHSDHS

SEQ ID NO: 910093 - protein, 9 aa, Homo Sapiens
RCHSRLIPR

SEQ ID NO: 910094 - protein, 9 aa, Homo Sapiens
GRELSSRQL

SEQ ID NO: 910095 - protein, 9 aa, Homo Sapiens
RFSPNCTHV

SEQ ID NO: 910096 - protein, 9 aa, Homo Sapiens
RRRKQRQEW

SEQ ID NO: 910097 - protein, 9 aa, Homo Sapiens
TGASFVSHY

SEQ ID NO: 910098 - protein, 9 aa, Homo Sapiens
AAPSDIVGA

SEQ ID NO: 910099 - protein, 9 aa, Homo Sapiens
SRLLNARHD

SEQ ID NO: 910100 - protein, 9 aa, Homo Sapiens
TLNFNSVDY

SEQ ID NO: 910101 - protein, 9 aa, Homo Sapiens
RERDHMEST

SEQ ID NO: 910102 - protein, 9 aa, Homo Sapiens
ILDHDLPKK

SEQ ID NO: 910103 - protein, 9 aa, Homo Sapiens
RLCWFSHST

SEQ ID NO: 910104 - protein, 9 aa, Homo Sapiens
QNQEPIQQA

SEQ ID NO: 910105 - protein, 9 aa, Homo Sapiens
VVWLLIRKP

SEQ ID NO: 910106 - protein, 9 aa, Homo Sapiens
PQGRFSPNC

SEQ ID NO: 910107 - protein, 9 aa, Homo Sapiens
LALLNDHIY

SEQ ID NO: 910108 - protein, 9 aa, Homo Sapiens
YLTIKQMAT

SEQ ID NO: 910109 - protein, 9 aa, Homo Sapiens
GLWEVVVTL

SEQ ID NO: 910110 - protein, 9 aa, Homo Sapiens
HENLQLKKG

SEQ ID NO: 910111 - protein, 9 aa, Homo Sapiens
NYRHSNPKV

SEQ ID NO: 910112 - protein, 9 aa, Homo Sapiens
AAMGSLLTE

SEQ ID NO: 910113 - protein, 9 aa, Homo Sapiens
QGGLHEPDS

SEQ ID NO: 910114 - protein, 9 aa, Homo Sapiens
LFVSSRKQL

SEQ ID NO: 910115 - protein, 9 aa, Homo Sapiens
VEVPNTTQS

SEQ ID NO: 910116 - protein, 9 aa, Homo Sapiens
AAGSRKAPL

SEQ ID NO: 910117 - protein, 9 aa, Homo Sapiens
ELQGGLHEP

SEQ ID NO: 910118 - protein, 9 aa, Homo Sapiens
CRVAEQEAN

SEQ ID NO: 910119 - protein, 9 aa, Homo Sapiens
FFLSSFTCG

SEQ ID NO: 910120 - protein, 9 aa, Homo Sapiens
SLFHSLLER

SEQ ID NO: 910121 - protein, 9 aa, Homo Sapiens
SSRQLLISQ

SEQ ID NO: 910122 - protein, 9 aa, Homo Sapiens
HSNPKVRMT

SEQ ID NO: 910123 - protein, 9 aa, Homo Sapiens
ESVCESGAR

SEQ ID NO: 910124 - protein, 9 aa, Homo Sapiens
LDHRILDHD

SEQ ID NO: 910125 - protein, 9 aa, Homo Sapiens
DACQGDSRG

SEQ ID NO: 910126 - protein, 9 aa, Homo Sapiens
GLPPHGAPF

SEQ ID NO: 910127 - protein, 9 aa, Homo Sapiens
PRNIHTHPS

SEQ ID NO: 910128 - protein, 9 aa, Homo Sapiens
MAVAKDGFF

SEQ ID NO: 910129 - protein, 9 aa, Homo Sapiens
EVVVTLSER

SEQ ID NO: 910130 - protein, 9 aa, Homo Sapiens
KQCPEDLLY

SEQ ID NO: 910131 - protein, 9 aa, Homo Sapiens
EVENEALWA

SEQ ID NO: 910132 - protein, 9 aa, Homo Sapiens
YLRHFFHRQ

SEQ ID NO: 910133 - protein, 9 aa, Homo Sapiens
KRLAKTQEE

SEQ ID NO: 910134 - protein, 9 aa, Homo Sapiens
SLLQTLDQY

SEQ ID NO: 910135 - protein, 9 aa, Homo Sapiens
VPNTTQSSP

SEQ ID NO: 910136 - protein, 9 aa, Homo Sapiens
VALAMALLF

SEQ ID NO: 910137 - protein, 9 aa, Homo Sapiens
IGIDFKITT

SEQ ID NO: 910138 - protein, 9 aa, Homo Sapiens
MLHLGGNEL

SEQ ID NO: 910139 - protein, 9 aa, Homo Sapiens
MVEALKNSS

SEQ ID NO: 910140 - protein, 9 aa, Homo Sapiens
VLTHAPSPS

SEQ ID NO: 910141 - protein, 9 aa, Homo Sapiens
GRTLLQEDY

SEQ ID NO: 910142 - protein, 9 aa, Homo Sapiens
GIDFKITTV

SEQ ID NO: 910143 - protein, 9 aa, Homo Sapiens
AEDRDNMSD

SEQ ID NO: 910144 - protein, 9 aa, Homo Sapiens
VVVTLSERA

SEQ ID NO: 910145 - protein, 9 aa, Homo Sapiens
GVSPTCPLC

SEQ ID NO: 910146 - protein, 9 aa, Homo Sapiens
RKLQHELGE

SEQ ID NO: 910147 - protein, 9 aa, Homo Sapiens
LLGPPCSWE

SEQ ID NO: 910148 - protein, 9 aa, Homo Sapiens
DHRILDHDL

SEQ ID NO: 910149 - protein, 9 aa, Homo Sapiens
IALTCIIIC

SEQ ID NO: 910150 - protein, 9 aa, Homo Sapiens
SPQNQEPIQ

SEQ ID NO: 910151 - protein, 9 aa, Homo Sapiens
TCPQGRFSP

SEQ ID NO: 910152 - protein, 9 aa, Homo Sapiens
LQTNKCLTM

SEQ ID NO: 910153 - protein, 9 aa, Homo Sapiens
ACYGADHHL

SEQ ID NO: 910154 - protein, 9 aa, Homo Sapiens
GRDLIWDMR

SEQ ID NO: 910155 - protein, 9 aa, Homo Sapiens
FVALAMALL

SEQ ID NO: 910156 - protein, 9 aa, Homo Sapiens
SIHLIHTQV

SEQ ID NO: 910157 - protein, 9 aa, Homo Sapiens
TEKQCPEDL

SEQ ID NO: 910158 - protein, 9 aa, Homo Sapiens
GETFRRAKY

SEQ ID NO: 910159 - protein, 9 aa, Homo Sapiens
HETAAPSDI

SEQ ID NO: 910160 - protein, 9 aa, Homo Sapiens
TKHTGNECV

SEQ ID NO: 910161 - protein, 9 aa, Homo Sapiens
WLVEMVYVF

SEQ ID NO: 910162 - protein, 9 aa, Homo Sapiens
PTPPKTPNG

SEQ ID NO: 910163 - protein, 9 aa, Homo Sapiens
EAENMYYEA

SEQ ID NO: 910164 - protein, 9 aa, Homo Sapiens
DHHLGRLHP

SEQ ID NO: 910165 - protein, 9 aa, Homo Sapiens
DCRCHSRLI

SEQ ID NO: 910166 - protein, 9 aa, Homo Sapiens
YGADHHLGR

SEQ ID NO: 910167 - protein, 9 aa, Homo Sapiens
FTRQDLCGP

SEQ ID NO: 910168 - protein, 9 aa, Homo Sapiens
QPLPPAHRG

SEQ ID NO: 910169 - protein, 9 aa, Homo Sapiens
HLGRLHPCV

SEQ ID NO: 910170 - protein, 9 aa, Homo Sapiens
PAFCILSVE

SEQ ID NO: 910171 - protein, 9 aa, Homo Sapiens
GANTFRTSH

SEQ ID NO: 910172 - protein, 9 aa, Homo Sapiens
CYLTIKQMA

SEQ ID NO: 910173 - protein, 9 aa, Homo Sapiens
INISALWAS

SEQ ID NO: 910174 - protein, 9 aa, Homo Sapiens
SGAGLALLN

SEQ ID NO: 910175 - protein, 9 aa, Homo Sapiens
GAPEGFEED

SEQ ID NO: 910176 - protein, 9 aa, Homo Sapiens
QHPAYGNEQ

SEQ ID NO: 910177 - protein, 9 aa, Homo Sapiens
GPPCSWEAE

SEQ ID NO: 910178 - protein, 9 aa, Homo Sapiens
GEKIHDDIF

SEQ ID NO: 910179 - protein, 9 aa, Homo Sapiens
HPSTLASSA

SEQ ID NO: 910180 - protein, 9 aa, Homo Sapiens
FLSSFTCGR

SEQ ID NO: 910181 - protein, 9 aa, Homo Sapiens
LTSLPLEEL

SEQ ID NO: 910182 - protein, 9 aa, Homo Sapiens
TNLLKEQAV

SEQ ID NO: 910183 - protein, 9 aa, Homo Sapiens
EMVYVFYFA

SEQ ID NO: 910184 - protein, 9 aa, Homo Sapiens
LDVCYTSSP

SEQ ID NO: 910185 - protein, 9 aa, Homo Sapiens
FKISPLLKL

SEQ ID NO: 910186 - protein, 9 aa, Homo Sapiens
PVPLILASF

SEQ ID NO: 910187 - protein, 9 aa, Homo Sapiens
NISALWASY

SEQ ID NO: 910188 - protein, 9 aa, Homo Sapiens
YNVKMPPTR

SEQ ID NO: 910189 - protein, 9 aa, Homo Sapiens
NMVEALKNS

SEQ ID NO: 910190 - protein, 9 aa, Homo Sapiens
VSSRKQLPT

SEQ ID NO: 910191 - protein, 9 aa, Homo Sapiens
DADGFKISP

SEQ ID NO: 910192 - protein, 9 aa, Homo Sapiens
VENEALWAW

SEQ ID NO: 910193 - protein, 9 aa, Homo Sapiens
TETPCAKSE

SEQ ID NO: 910194 - protein, 9 aa, Homo Sapiens
LESNPYRRR

SEQ ID NO: 910195 - protein, 9 aa, Homo Sapiens
WAPQCSLVA

SEQ ID NO: 910196 - protein, 9 aa, Homo Sapiens
VSSAVSKNS

SEQ ID NO: 910197 - protein, 9 aa, Homo Sapiens
CWFSHSTRS

SEQ ID NO: 910198 - protein, 9 aa, Homo Sapiens
KLQHELGEA

SEQ ID NO: 910199 - protein, 9 aa, Homo Sapiens
LPPAHRGPA

SEQ ID NO: 910200 - protein, 9 aa, Homo Sapiens
SETKLMTPL

SEQ ID NO: 910201 - protein, 9 aa, Homo Sapiens
SSFTCGRTL

SEQ ID NO: 910202 - protein, 9 aa, Homo Sapiens
SGIRLFQRD

SEQ ID NO: 910203 - protein, 9 aa, Homo Sapiens
KTDMEAENM

SEQ ID NO: 910204 - protein, 9 aa, Homo Sapiens
EENANVVVW

SEQ ID NO: 910205 - protein, 9 aa, Homo Sapiens
DWSQPFSPG

SEQ ID NO: 910206 - protein, 9 aa, Homo Sapiens
WDMREQLSD

SEQ ID NO: 910207 - protein, 9 aa, Homo Sapiens
PLTPPLPSN

SEQ ID NO: 910208 - protein, 9 aa, Homo Sapiens
GLALLNDHI

SEQ ID NO: 910209 - protein, 9 aa, Homo Sapiens
TTTFFHSDH

SEQ ID NO: 910210 - protein, 9 aa, Homo Sapiens
DHMESTLNY

SEQ ID NO: 910211 - protein, 9 aa, Homo Sapiens
LLGATDEGL

SEQ ID NO: 910212 - protein, 9 aa, Homo Sapiens
SMYGRDLIW

SEQ ID NO: 910213 - protein, 9 aa, Homo Sapiens
ACCMMYRGD

SEQ ID NO: 910214 - protein, 9 aa, Homo Sapiens
SNPKVRMTS

SEQ ID NO: 910215 - protein, 9 aa, Homo Sapiens
LFHSLLERY

SEQ ID NO: 910216 - protein, 9 aa, Homo Sapiens
CMMYRGDVV

SEQ ID NO: 910217 - protein, 9 aa, Homo Sapiens
KAFIGCPTP

SEQ ID NO: 910218 - protein, 9 aa, Homo Sapiens
STKGSLKQK

SEQ ID NO: 910219 - protein, 9 aa, Homo Sapiens
PEHPVVNAN

SEQ ID NO: 910220 - protein, 9 aa, Homo Sapiens
DAMCKYCTK

SEQ ID NO: 910221 - protein, 9 aa, Homo Sapiens
KQKRSSAAS

SEQ ID NO: 910222 - protein, 9 aa, Homo Sapiens
TEVVQEIKN

SEQ ID NO: 910223 - protein, 9 aa, Homo Sapiens
RRVQATAQD

SEQ ID NO: 910224 - protein, 9 aa, Homo Sapiens
RVQATAQDP

SEQ ID NO: 910225 - protein, 9 aa, Homo Sapiens
QLQCCQRLE

SEQ ID NO: 910226 - protein, 9 aa, Homo Sapiens
KKRSAFPSR

SEQ ID NO: 910227 - protein, 9 aa, Homo Sapiens
QCCQRLEEL

SEQ ID NO: 910228 - protein, 9 aa, Homo Sapiens
KKKRSAFPS

SEQ ID NO: 910229 - protein, 9 aa, Homo Sapiens
PSSSLHSVE

SEQ ID NO: 910230 - protein, 9 aa, Homo Sapiens
TTATTFRAC

SEQ ID NO: 910231 - protein, 9 aa, Homo Sapiens
EAGASIMGS

SEQ ID NO: 910232 - protein, 9 aa, Homo Sapiens
FLRAIDVCV

SEQ ID NO: 910233 - protein, 9 aa, Homo Sapiens
QVLQTLKFL

SEQ ID NO: 910234 - protein, 9 aa, Homo Sapiens
DQGDPGVPG

SEQ ID NO: 910235 - protein, 9 aa, Homo Sapiens
KHLPNFFHK

SEQ ID NO: 910236 - protein, 9 aa, Homo Sapiens
KHIKVQVQV

SEQ ID NO: 910237 - protein, 9 aa, Homo Sapiens
GLSRHRCVH

SEQ ID NO: 910238 - protein, 9 aa, Homo Sapiens
DFSQERQVL

SEQ ID NO: 910239 - protein, 9 aa, Homo Sapiens
TPSNPDFDA

SEQ ID NO: 910240 - protein, 9 aa, Homo Sapiens
KRSAFPSRS

SEQ ID NO: 910241 - protein, 9 aa, Homo Sapiens
SQGGNQSQG

SEQ ID NO: 910242 - protein, 9 aa, Homo Sapiens
SNLEQDLKL

SEQ ID NO: 910243 - protein, 9 aa, Homo Sapiens
EGPPSQGGN

SEQ ID NO: 910244 - protein, 9 aa, Homo Sapiens
EENFYKLVS

SEQ ID NO: 910245 - protein, 9 aa, Homo Sapiens
FDAGVSEHS

SEQ ID NO: 910246 - protein, 9 aa, Homo Sapiens
KGDQGDPGV

SEQ ID NO: 910247 - protein, 9 aa, Homo Sapiens
KFTDRKMTL

SEQ ID NO: 910248 - protein, 9 aa, Homo Sapiens
PDFDAGVSE

SEQ ID NO: 910249 - protein, 8 aa, Homo Sapiens
VANLSRGP

SEQ ID NO: 910250 - protein, 9 aa, Homo Sapiens
CKPLVLNDL

SEQ ID NO: 910251 - protein, 9 aa, Homo Sapiens
ERQVLQTLK

SEQ ID NO: 910252 - protein, 9 aa, Homo Sapiens
DPTAFLVPR

SEQ ID NO: 910253 - protein, 9 aa, Homo Sapiens
TLCKPLVLN

SEQ ID NO: 910254 - protein, 9 aa, Homo Sapiens
RIGLKNSPS

SEQ ID NO: 910255 - protein, 9 aa, Homo Sapiens
SLKQKRSSA

SEQ ID NO: 910256 - protein, 9 aa, Homo Sapiens
FLVLATLVL

SEQ ID NO: 910257 - protein, 9 aa, Homo Sapiens
LRRSAGGWI

SEQ ID NO: 910258 - protein, 9 aa, Homo Sapiens
PPCCESVPG

SEQ ID NO: 910259 - protein, 9 aa, Homo Sapiens
SSKGGRIGL

SEQ ID NO: 910260 - protein, 9 aa, Homo Sapiens
ATTFRACSR

SEQ ID NO: 910261 - protein, 9 aa, Homo Sapiens
VTEENFYKL

SEQ ID NO: 910262 - protein, 9 aa, Homo Sapiens
LHSVESGGA

SEQ ID NO: 910263 - protein, 9 aa, Homo Sapiens
RTLGLQTKD

SEQ ID NO: 910264 - protein, 9 aa, Homo Sapiens
TTFRACSRA

SEQ ID NO: 910265 - protein, 9 aa, Homo Sapiens
VQVKLLEKR

SEQ ID NO: 910266 - protein, 9 aa, Homo Sapiens
LNDCFKKLP

SEQ ID NO: 910267 - protein, 9 aa, Homo Sapiens
RIILLYMFL

SEQ ID NO: 910268 - protein, 9 aa, Homo Sapiens
AEAGASIMG

SEQ ID NO: 910269 - protein, 9 aa, Homo Sapiens
TSLLGADTP

SEQ ID NO: 910270 - protein, 9 aa, Homo Sapiens
VQVQVKLLE

SEQ ID NO: 910271 - protein, 9 aa, Homo Sapiens
QRLEELCKQ

SEQ ID NO: 910272 - protein, 9 aa, Homo Sapiens
CCESVPGLS

SEQ ID NO: 910273 - protein, 9 aa, Homo Sapiens
AFPSRSLSS

SEQ ID NO: 910274 - protein, 9 aa, Homo Sapiens
DPGVPGFMG

SEQ ID NO: 910275 - protein, 9 aa, Homo Sapiens
TFRACSRAP

SEQ ID NO: 910276 - protein, 9 aa, Homo Sapiens
KMYFNAVQA

SEQ ID NO: 910277 - protein, 9 aa, Homo Sapiens
LDLLLDTKF

SEQ ID NO: 910278 - protein, 9 aa, Homo Sapiens
ASESLARRV

SEQ ID NO: 910279 - protein, 9 aa, Homo Sapiens
TGTPSNPDF

SEQ ID NO: 910280 - protein, 9 aa, Homo Sapiens
PFLVLATLV

SEQ ID NO: 910281 - protein, 9 aa, Homo Sapiens
ATLVLLDGA

SEQ ID NO: 910282 - protein, 9 aa, Homo Sapiens
SAFPSRSLS

SEQ ID NO: 910283 - protein, 9 aa, Homo Sapiens
SGRATSLLG

SEQ ID NO: 910284 - protein, 9 aa, Homo Sapiens
GSEPSSSLH

SEQ ID NO: 910285 - protein, 9 aa, Homo Sapiens
SPARATLCK

SEQ ID NO: 910286 - protein, 9 aa, Homo Sapiens
VQATAQDPV

SEQ ID NO: 910287 - protein, 9 aa, Homo Sapiens
NLEQDLKLT

SEQ ID NO: 910288 - protein, 9 aa, Homo Sapiens
PTAFLVPRD

SEQ ID NO: 910289 - protein, 9 aa, Homo Sapiens
FDPTAFLVP

SEQ ID NO: 910290 - protein, 9 aa, Homo Sapiens
PPSQGGNQS

SEQ ID NO: 910291 - protein, 9 aa, Homo Sapiens
KIRIILLYM

SEQ ID NO: 910292 - protein, 9 aa, Homo Sapiens
SIMGSVQVQ

SEQ ID NO: 910293 - protein, 9 aa, Homo Sapiens
LGLQTKDEV

SEQ ID NO: 910294 - protein, 9 aa, Homo Sapiens
VQVGVSVMA

SEQ ID NO: 910295 - protein, 9 aa, Homo Sapiens
IKVQVQVKL

SEQ ID NO: 910296 - protein, 9 aa, Homo Sapiens
TEPLSGRAT

SEQ ID NO: 910297 - protein, 9 aa, Homo Sapiens
LRAIDVCVM

SEQ ID NO: 910298 - protein, 9 aa, Homo Sapiens
FTDRKMTLL

SEQ ID NO: 910299 - protein, 9 aa, Homo Sapiens
SLHSVESGG

SEQ ID NO: 910300 - protein, 9 aa, Homo Sapiens
KNKQKVGPS

SEQ ID NO: 910301 - protein, 9 aa, Homo Sapiens
EIKNKQKVG

SEQ ID NO: 910302 - protein, 9 aa, Homo Sapiens
LPRDEDDPG

SEQ ID NO: 910303 - protein, 9 aa, Homo Sapiens
HRCVHLGYR

SEQ ID NO: 910304 - protein, 9 aa, Homo Sapiens
EAKKMYFNA

SEQ ID NO: 910305 - protein, 9 aa, Homo Sapiens
SCGIKSCRV

SEQ ID NO: 910306 - protein, 9 aa, Homo Sapiens
KKVTEENFY

SEQ ID NO: 910307 - protein, 9 aa, Homo Sapiens
VGQKGDQGD

SEQ ID NO: 910308 - protein, 9 aa, Homo Sapiens
LEQDLKLTS

SEQ ID NO: 910309 - protein, 9 aa, Homo Sapiens
KAEAGASIM

SEQ ID NO: 910310 - protein, 9 aa, Homo Sapiens
HKGQLTKMF

SEQ ID NO: 910311 - protein, 9 aa, Homo Sapiens
SGNSNLEQD

SEQ ID NO: 910312 - protein, 9 aa, Homo Sapiens
AMCKYCTKV

SEQ ID NO: 910313 - protein, 9 aa, Homo Sapiens
EVVQEIKNK

SEQ ID NO: 910314 - protein, 9 aa, Homo Sapiens
CGIKSCRVA

SEQ ID NO: 910315 - protein, 9 aa, Homo Sapiens
ATLCKPLVL

SEQ ID NO: 910316 - protein, 9 aa, Homo Sapiens
SSSSSSCQT

SEQ ID NO: 910317 - protein, 9 aa, Homo Sapiens
KVTEENFYK

SEQ ID NO: 910318 - protein, 9 aa, Homo Sapiens
LRESFDPTA

SEQ ID NO: 910319 - protein, 9 aa, Homo Sapiens
GSLKQKRSS

SEQ ID NO: 910320 - protein, 9 aa, Homo Sapiens
RVMDSPEHP

SEQ ID NO: 910321 - protein, 9 aa, Homo Sapiens
IILLYMFLK

SEQ ID NO: 910322 - protein, 9 aa, Homo Sapiens
GKPEGPPSQ

SEQ ID NO: 910323 - protein, 9 aa, Homo Sapiens
IGLKNSPSI

SEQ ID NO: 910324 - protein, 9 aa, Homo Sapiens
SSPARATLC

SEQ ID NO: 910325 - protein, 9 aa, Homo Sapiens
KKLPRDEDD

SEQ ID NO: 910326 - protein, 9 aa, Homo Sapiens
NFYKLVSEF

SEQ ID NO: 910327 - protein, 9 aa, Homo Sapiens
RRHEHYYVH

SEQ ID NO: 910328 - protein, 9 aa, Homo Sapiens
GGWIEAENG

SEQ ID NO: 910329 - protein, 9 aa, Homo Sapiens
AGGWIEAEN

SEQ ID NO: 910330 - protein, 9 aa, Homo Sapiens
KKMYFNAVQ

SEQ ID NO: 910331 - protein, 9 aa, Homo Sapiens
STLEEKETN

SEQ ID NO: 910332 - protein, 9 aa, Homo Sapiens
LKQKRSSAA

SEQ ID NO: 910333 - protein, 9 aa, Homo Sapiens
ENFYKLVSE

SEQ ID NO: 910334 - protein, 9 aa, Homo Sapiens
AKHIKVQVQ

SEQ ID NO: 910335 - protein, 9 aa, Homo Sapiens
RAIDVCVMV

SEQ ID NO: 910336 - protein, 9 aa, Homo Sapiens
QPEYHVSVH

SEQ ID NO: 910337 - protein, 9 aa, Homo Sapiens
GVSVMAIRN

SEQ ID NO: 910338 - protein, 9 aa, Homo Sapiens
DVCVMVGGS

SEQ ID NO: 910339 - protein, 9 aa, Homo Sapiens
CSRAPFSRS

SEQ ID NO: 910340 - protein, 9 aa, Homo Sapiens
KGSLKQKRS

SEQ ID NO: 910341 - protein, 9 aa, Homo Sapiens
FFHKGQLTK

SEQ ID NO: 910342 - protein, 9 aa, Homo Sapiens
GASIMGSVQ

SEQ ID NO: 910343 - protein, 9 aa, Homo Sapiens
GTEVVQEIK

SEQ ID NO: 910344 - protein, 9 aa, Homo Sapiens
DFDAGVSEH

SEQ ID NO: 910345 - protein, 9 aa, Homo Sapiens
WIEAENGKE

SEQ ID NO: 910346 - protein, 9 aa, Homo Sapiens
GNKKVTEEN

SEQ ID NO: 910347 - protein, 9 aa, Homo Sapiens
ARRVQATAQ

SEQ ID NO: 910348 - protein, 9 aa, Homo Sapiens
SLNDCFKKL

SEQ ID NO: 910349 - protein, 9 aa, Homo Sapiens
SSSSSCQTR

SEQ ID NO: 910350 - protein, 9 aa, Homo Sapiens
SSSSCQTRP

SEQ ID NO: 910351 - protein, 9 aa, Homo Sapiens
HPVVNANVS

SEQ ID NO: 910352 - protein, 9 aa, Homo Sapiens
IEAENGKEG

SEQ ID NO: 910353 - protein, 9 aa, Homo Sapiens
CFKKLPRDE

SEQ ID NO: 910354 - protein, 9 aa, Homo Sapiens
KPEGPPSQG

SEQ ID NO: 910355 - protein, 9 aa, Homo Sapiens
EVLPPCCES

SEQ ID NO: 910356 - protein, 9 aa, Homo Sapiens
LYMFLKNGI

SEQ ID NO: 910357 - protein, 9 aa, Homo Sapiens
ASIMGSVQV

SEQ ID NO: 910358 - protein, 9 aa, Homo Sapiens
GQKGDQGDP

SEQ ID NO: 910359 - protein, 9 aa, Homo Sapiens
VGVSVMAIR

SEQ ID NO: 910360 - protein, 9 aa, Homo Sapiens
SVMAIRNKM

SEQ ID NO: 910361 - protein, 9 aa, Homo Sapiens
AKKMYFNAV

SEQ ID NO: 910362 - protein, 9 aa, Homo Sapiens
CKYCTKVMD

SEQ ID NO: 910363 - protein, 9 aa, Homo Sapiens
HIKVQVQVK

SEQ ID NO: 910364 - protein, 9 aa, Homo Sapiens
PARATLCKP

SEQ ID NO: 910365 - protein, 9 aa, Homo Sapiens
MFLKNGITE

SEQ ID NO: 910366 - protein, 9 aa, Homo Sapiens
RESFDPTAF

SEQ ID NO: 910367 - protein, 9 aa, Homo Sapiens
RSAFPSRSL

SEQ ID NO: 910368 - protein, 9 aa, Homo Sapiens
ESVPGLSLR

SEQ ID NO: 910369 - protein, 9 aa, Homo Sapiens
HEHYYVHNS

SEQ ID NO: 910370 - protein, 9 aa, Homo Sapiens
QGDPGVPGF

SEQ ID NO: 910371 - protein, 9 aa, Homo Sapiens
SSSCQTRPI

SEQ ID NO: 910372 - protein, 9 aa, Homo Sapiens
TKVMDTHLV

SEQ ID NO: 910373 - protein, 9 aa, Homo Sapiens
PSQGGNQSQ

SEQ ID NO: 910374 - protein, 9 aa, Homo Sapiens
CVMVGGSTL

SEQ ID NO: 910375 - protein, 9 aa, Homo Sapiens
SLARRVQAT

SEQ ID NO: 910376 - protein, 9 aa, Homo Sapiens
GIKSCRVAA

SEQ ID NO: 910377 - protein, 9 aa, Homo Sapiens
SKAEAGASI

SEQ ID NO: 910378 - protein, 9 aa, Homo Sapiens
TLEEKETNG

SEQ ID NO: 910379 - protein, 9 aa, Homo Sapiens
EELCKQCLL

SEQ ID NO: 910380 - protein, 9 aa, Homo Sapiens
ILLYMFLKN

SEQ ID NO: 910381 - protein, 9 aa, Homo Sapiens
DQQEMQPEL

SEQ ID NO: 910382 - protein, 9 aa, Homo Sapiens
AGASIMGSV

SEQ ID NO: 910383 - protein, 9 aa, Homo Sapiens
NETPKKKRS

SEQ ID NO: 910384 - protein, 9 aa, Homo Sapiens
LSGRATSLL

SEQ ID NO: 910385 - protein, 9 aa, Homo Sapiens
RQVLQTLKF

SEQ ID NO: 910386 - protein, 9 aa, Homo Sapiens
VHENVPVGT

SEQ ID NO: 910387 - protein, 9 aa, Homo Sapiens
SFLRAIDVC

SEQ ID NO: 910388 - protein, 9 aa, Homo Sapiens
TKDEVSIEV

SEQ ID NO: 910389 - protein, 9 aa, Homo Sapiens
KETNGEQGP

SEQ ID NO: 910390 - protein, 9 aa, Homo Sapiens
ASGLSRHRC

SEQ ID NO: 910391 - protein, 9 aa, Homo Sapiens
QERQVLQTL

SEQ ID NO: 910392 - protein, 9 aa, Homo Sapiens
ETNGEQGPT

SEQ ID NO: 910393 - protein, 9 aa, Homo Sapiens
FAKHIKVQV

SEQ ID NO: 910394 - protein, 9 aa, Homo Sapiens
DEVSIEVLK

SEQ ID NO: 910395 - protein, 9 aa, Homo Sapiens
VCVMVGGST

SEQ ID NO: 910396 - protein, 9 aa, Homo Sapiens
LEELCKQCL

SEQ ID NO: 910397 - protein, 9 aa, Homo Sapiens
VSVMAIRNK

SEQ ID NO: 910398 - protein, 9 aa, Homo Sapiens
EKETNGEQG

SEQ ID NO: 910399 - protein, 9 aa, Homo Sapiens
GGRIGLKNS

SEQ ID NO: 910400 - protein, 9 aa, Homo Sapiens
KRSSAASVV

SEQ ID NO: 910401 - protein, 9 aa, Homo Sapiens
SSLHSVESG

SEQ ID NO: 910402 - protein, 9 aa, Homo Sapiens
NKKVTEENF

SEQ ID NO: 910403 - protein, 9 aa, Homo Sapiens
FKKLPRDED

SEQ ID NO: 910404 - protein, 9 aa, Homo Sapiens
MQPELPEQQ

SEQ ID NO: 910405 - protein, 9 aa, Homo Sapiens
LVLATLVLL

SEQ ID NO: 910406 - protein, 9 aa, Homo Sapiens
YCTKVMDTH

SEQ ID NO: 910407 - protein, 9 aa, Homo Sapiens
YHVSVHENV

SEQ ID NO: 910408 - protein, 9 aa, Homo Sapiens
SCQTRPILK

SEQ ID NO: 910409 - protein, 9 aa, Homo Sapiens
CCQRLEELC

SEQ ID NO: 910410 - protein, 9 aa, Homo Sapiens
CVHLGYRPH

SEQ ID NO: 910411 - protein, 9 aa, Homo Sapiens
SQERQVLQT

SEQ ID NO: 910412 - protein, 9 aa, Homo Sapiens
YMFLKNGIT

SEQ ID NO: 910413 - protein, 9 aa, Homo Sapiens
SSCQTRPIL

SEQ ID NO: 910414 - protein, 9 aa, Homo Sapiens
GDQGDPGVP

SEQ ID NO: 910415 - protein, 9 aa, Homo Sapiens
PLSGRATSL

SEQ ID NO: 910416 - protein, 9 aa, Homo Sapiens
TEENFYKLV

SEQ ID NO: 910417 - protein, 9 aa, Homo Sapiens
SRHRCVHLG

SEQ ID NO: 910418 - protein, 9 aa, Homo Sapiens
SESLARRVQ

SEQ ID NO: 910419 - protein, 9 aa, Homo Sapiens
FHKGQLTKM

SEQ ID NO: 910420 - protein, 9 aa, Homo Sapiens
GDPGVPGFM

SEQ ID NO: 910421 - protein, 9 aa, Homo Sapiens
LCKPLVLND

SEQ ID NO: 910422 - protein, 9 aa, Homo Sapiens
ESFDPTAFL

SEQ ID NO: 910423 - protein, 9 aa, Homo Sapiens
VSVHENVPV

SEQ ID NO: 910424 - protein, 9 aa, Homo Sapiens
KMVQVGVSV

SEQ ID NO: 910425 - protein, 9 aa, Homo Sapiens
EMQPELPEQ

SEQ ID NO: 910426 - protein, 9 aa, Homo Sapiens
QVQVKLLEK

SEQ ID NO: 910427 - protein, 9 aa, Homo Sapiens
LATLVLLDG

SEQ ID NO: 910428 - protein, 9 aa, Homo Sapiens
SVHENVPVG

SEQ ID NO: 910429 - protein, 9 aa, Homo Sapiens
EPSSSLHSV

SEQ ID NO: 910430 - protein, 9 aa, Homo Sapiens
RRSAGGWIE

SEQ ID NO: 910431 - protein, 9 aa, Homo Sapiens
SFDPTAFLV

SEQ ID NO: 910432 - protein, 9 aa, Homo Sapiens
GPPSQGGNQ

SEQ ID NO: 910433 - protein, 9 aa, Homo Sapiens
TLGLQTKDE

SEQ ID NO: 910434 - protein, 9 aa, Homo Sapiens
FSQERQVLQ

SEQ ID NO: 910435 - protein, 9 aa, Homo Sapiens
YNRRHEHYY

SEQ ID NO: 910436 - protein, 9 aa, Homo Sapiens
APFLVLATL

SEQ ID NO: 910437 - protein, 9 aa, Homo Sapiens
DLLLDTKFT

SEQ ID NO: 910438 - protein, 9 aa, Homo Sapiens
SEPSSSLHS

SEQ ID NO: 910439 - protein, 9 aa, Homo Sapiens
PCCESVPGL

SEQ ID NO: 910440 - protein, 9 aa, Homo Sapiens
IKNKQKVGP

SEQ ID NO: 910441 - protein, 9 aa, Homo Sapiens
RHRCVHLGY

SEQ ID NO: 910442 - protein, 9 aa, Homo Sapiens
RCVHLGYRP

SEQ ID NO: 910443 - protein, 9 aa, Homo Sapiens
SAGGWIEAE

SEQ ID NO: 910444 - protein, 9 aa, Homo Sapiens
TKFTDRKMT

SEQ ID NO: 910445 - protein, 9 aa, Homo Sapiens
QKRSSAASV

SEQ ID NO: 910446 - protein, 9 aa, Homo Sapiens
DSPEHPVVN

SEQ ID NO: 910447 - protein, 9 aa, Homo Sapiens
EHYYVHNSP

SEQ ID NO: 910448 - protein, 9 aa, Homo Sapiens
NGEQGPTVS

SEQ ID NO: 910449 - protein, 9 aa, Homo Sapiens
MDSPEHPVV

SEQ ID NO: 910450 - protein, 9 aa, Homo Sapiens
NDCFKKLPR

SEQ ID NO: 910451 - protein, 9 aa, Homo Sapiens
HYYVHNSPA

SEQ ID NO: 910452 - protein, 9 aa, Homo Sapiens
FRACSRAPF

SEQ ID NO: 910453 - protein, 9 aa, Homo Sapiens
LKMVQVGVS

SEQ ID NO: 910454 - protein, 9 aa, Homo Sapiens
DTKFTDRKM

SEQ ID NO: 910455 - protein, 9 aa, Homo Sapiens
ACSRAPFSR

SEQ ID NO: 910456 - protein, 9 aa, Homo Sapiens
VDFSQERQV

SEQ ID NO: 910457 - protein, 9 aa, Homo Sapiens
RSAGGWIEA

SEQ ID NO: 910458 - protein, 9 aa, Homo Sapiens
DCFKKLPRD

SEQ ID NO: 910459 - protein, 9 aa, Homo Sapiens
LDQQEMQPE

SEQ ID NO: 910460 - protein, 9 aa, Homo Sapiens
VLQTLKFLP

SEQ ID NO: 910461 - protein, 9 aa, Homo Sapiens
SSGNSNLEQ

SEQ ID NO: 910462 - protein, 9 aa, Homo Sapiens
LPPCCESVP

SEQ ID NO: 910463 - protein, 9 aa, Homo Sapiens
TNGEQGPTV

SEQ ID NO: 910464 - protein, 9 aa, Homo Sapiens
LQTKDEVSI

SEQ ID NO: 910465 - protein, 9 aa, Homo Sapiens
LARRVQATA

SEQ ID NO: 910466 - protein, 9 aa, Homo Sapiens
TSSSSSSSC

SEQ ID NO: 910467 - protein, 9 aa, Homo Sapiens
EEKETNGEQ

SEQ ID NO: 910468 - protein, 9 aa, Homo Sapiens
AYNRRHEHY

SEQ ID NO: 910469 - protein, 9 aa, Homo Sapiens
QQEMQPELP

SEQ ID NO: 910470 - protein, 9 aa, Homo Sapiens
NRRHEHYYV

SEQ ID NO: 910471 - protein, 9 aa, Homo Sapiens
QEIKNKQKV

SEQ ID NO: 910472 - protein, 9 aa, Homo Sapiens
PNFFHKGQL

SEQ ID NO: 910473 - protein, 9 aa, Homo Sapiens
GWIEAENGK

SEQ ID NO: 910474 - protein, 9 aa, Homo Sapiens
ESLARRVQA

SEQ ID NO: 910475 - protein, 9 aa, Homo Sapiens
TPPPPGKPQ

SEQ ID NO: 910476 - protein, 9 aa, Homo Sapiens
TAPFLVLAT

SEQ ID NO: 910477 - protein, 9 aa, Homo Sapiens
QKGDQGDPG

SEQ ID NO: 910478 - protein, 9 aa, Homo Sapiens
NAVQAIETH

SEQ ID NO: 910479 - protein, 9 aa, Homo Sapiens
TKGSLKQKR

SEQ ID NO: 910480 - protein, 9 aa, Homo Sapiens
KLPRDEDDP

SEQ ID NO: 910481 - protein, 9 aa, Homo Sapiens
LLDTKFTDR

SEQ ID NO: 910482 - protein, 9 aa, Homo Sapiens
SKGGRIGLK

SEQ ID NO: 910483 - protein, 9 aa, Homo Sapiens
GRIGLKNSP

SEQ ID NO: 910484 - protein, 9 aa, Homo Sapiens
MVQVGVSVM

SEQ ID NO: 910485 - protein, 9 aa, Homo Sapiens
QVGVSVMAI

SEQ ID NO: 910486 - protein, 9 aa, Homo Sapiens
RATLCKPLV

SEQ ID NO: 910487 - protein, 9 aa, Homo Sapiens
LDAMCKYCT

SEQ ID NO: 910488 - protein, 9 aa, Homo Sapiens
LEEKETNGE

SEQ ID NO: 910489 - protein, 9 aa, Homo Sapiens
MYFNAVQAI

SEQ ID NO: 910490 - protein, 9 aa, Homo Sapiens
ARATLCKPL

SEQ ID NO: 910491 - protein, 9 aa, Homo Sapiens
IRIILLYMF

SEQ ID NO: 910492 - protein, 9 aa, Homo Sapiens
IDVCVMVGG

SEQ ID NO: 910493 - protein, 9 aa, Homo Sapiens
PSNPDFDAG

SEQ ID NO: 910494 - protein, 9 aa, Homo Sapiens
SVPGLSLRR

SEQ ID NO: 910495 - protein, 9 aa, Homo Sapiens
PEGPPSQGG

SEQ ID NO: 910496 - protein, 9 aa, Homo Sapiens
KYCTKVMDT

SEQ ID NO: 910497 - protein, 9 aa, Homo Sapiens
NFFHKGQLT

SEQ ID NO: 910498 - protein, 9 aa, Homo Sapiens
CTKVMDTHL

SEQ ID NO: 910499 - protein, 9 aa, Homo Sapiens
EHPVVNANV

SEQ ID NO: 910500 - protein, 9 aa, Homo Sapiens
QEMQPELPE

SEQ ID NO: 910501 - protein, 9 aa, Homo Sapiens
VQEIKNKQK

SEQ ID NO: 910502 - protein, 9 aa, Homo Sapiens
MKHLPNFFH

SEQ ID NO: 910503 - protein, 9 aa, Homo Sapiens
AIDVCVMVG

SEQ ID NO: 910504 - protein, 9 aa, Homo Sapiens
RACSRAPFS

SEQ ID NO: 910505 - protein, 9 aa, Homo Sapiens
YYVHNSPAV

SEQ ID NO: 910506 - protein, 9 aa, Homo Sapiens
MCKYCTKVM

SEQ ID NO: 910507 - protein, 9 aa, Homo Sapiens
HENVPVGTR

SEQ ID NO: 910508 - protein, 9 aa, Homo Sapiens
LEAKKMYFN

SEQ ID NO: 910509 - protein, 9 aa, Homo Sapiens
NSSGNSNLE

SEQ ID NO: 910510 - protein, 9 aa, Homo Sapiens
GLQTKDEVS

SEQ ID NO: 910511 - protein, 9 aa, Homo Sapiens
NSNLEQDLK

SEQ ID NO: 910512 - protein, 9 aa, Homo Sapiens
EYHVSVHEN

SEQ ID NO: 910513 - protein, 9 aa, Homo Sapiens
RRVMDSPEH

SEQ ID NO: 910514 - protein, 9 aa, Homo Sapiens
HLDQQEMQP

SEQ ID NO: 910515 - protein, 9 aa, Homo Sapiens
HLPNFFHKG

SEQ ID NO: 910516 - protein, 9 aa, Homo Sapiens
LLYMFLKNG

SEQ ID NO: 910517 - protein, 9 aa, Homo Sapiens
TATTFRACS

SEQ ID NO: 910518 - protein, 9 aa, Homo Sapiens
VMDSPEHPV

SEQ ID NO: 910519 - protein, 9 aa, Homo Sapiens
SNPDFDAGV

SEQ ID NO: 910520 - protein, 9 aa, Homo Sapiens
KVQVQVKLL

SEQ ID NO: 910521 - protein, 9 aa, Homo Sapiens
VVQEIKNKQ

SEQ ID NO: 910522 - protein, 9 aa, Homo Sapiens
VLPPCCESV

SEQ ID NO: 910523 - protein, 9 aa, Homo Sapiens
CQTRPILKE

SEQ ID NO: 910524 - protein, 9 aa, Homo Sapiens
PGKPEGPPS

SEQ ID NO: 910525 - protein, 9 aa, Homo Sapiens
TLVLLDGAI

SEQ ID NO: 910526 - protein, 9 aa, Homo Sapiens
GNSNLEQDL

SEQ ID NO: 910527 - protein, 9 aa, Homo Sapiens
LDTKFTDRK

SEQ ID NO: 910528 - protein, 9 aa, Homo Sapiens
SPEHPVVNA

SEQ ID NO: 910529 - protein, 9 aa, Homo Sapiens
TAFLVPRDP

SEQ ID NO: 910530 - protein, 9 aa, Homo Sapiens
RLEELCKQC

SEQ ID NO: 910531 - protein, 9 aa, Homo Sapiens
LKHLDQQEM

SEQ ID NO: 910532 - protein, 9 aa, Homo Sapiens
SGLSRHRCV

SEQ ID NO: 910533 - protein, 9 aa, Homo Sapiens
GTPSNPDFD

SEQ ID NO: 910534 - protein, 9 aa, Homo Sapiens
KGGRIGLKN

SEQ ID NO: 910535 - protein, 9 aa, Homo Sapiens
NNSSGNSNL

SEQ ID NO: 910536 - protein, 9 aa, Homo Sapiens
YFNAVQAIE

SEQ ID NO: 910537 - protein, 9 aa, Homo Sapiens
KHLDQQEMQ

SEQ ID NO: 910538 - protein, 9 aa, Homo Sapiens
NPDFDAGVS

SEQ ID NO: 910539 - protein, 9 aa, Homo Sapiens
QTKDEVSIE

SEQ ID NO: 910540 - protein, 9 aa, Homo Sapiens
CQRLEELCK

SEQ ID NO: 910541 - protein, 9 aa, Homo Sapiens
SSSLHSVES

SEQ ID NO: 910542 - protein, 9 aa, Homo Sapiens
ETPKKKRSA

SEQ ID NO: 910543 - protein, 9 aa, Homo Sapiens
RHEHYYVHN

SEQ ID NO: 910544 - protein, 9 aa, Homo Sapiens
EPLSGRATS

SEQ ID NO: 910545 - protein, 9 aa, Homo Sapiens
KDEVSIEVL

SEQ ID NO: 910546 - protein, 9 aa, Homo Sapiens
FLRESFDPT

SEQ ID NO: 910547 - protein, 9 aa, Homo Sapiens
LSRHRCVHL

SEQ ID NO: 910548 - protein, 9 aa, Homo Sapiens
PKKKRSAFP

SEQ ID NO: 910549 - protein, 9 aa, Homo Sapiens
ATSLLGADT

SEQ ID NO: 910550 - protein, 9 aa, Homo Sapiens
HVSVHENVP

SEQ ID NO: 910551 - protein, 9 aa, Homo Sapiens
VLATLVLLD

SEQ ID NO: 910552 - protein, 9 aa, Homo Sapiens
LLLDTKFTD

SEQ ID NO: 910553 - protein, 9 aa, Homo Sapiens
LQCCQRLEE

SEQ ID NO: 910554 - protein, 9 aa, Homo Sapiens
HSVESGGAA

SEQ ID NO: 910555 - protein, 9 aa, Homo Sapiens
SNETPKKKR

SEQ ID NO: 910556 - protein, 9 aa, Homo Sapiens
CESVPGLSL

SEQ ID NO: 910557 - protein, 9 aa, Homo Sapiens
FNAVQAIET

SEQ ID NO: 910558 - protein, 9 aa, Homo Sapiens
GRATSLLGA

SEQ ID NO: 910559 - protein, 9 aa, Homo Sapiens
PEYHVSVHE

SEQ ID NO: 910560 - protein, 9 aa, Homo Sapiens
ISKAEAGAS

SEQ ID NO: 910561 - protein, 9 aa, Homo Sapiens
LPNFFHKGQ

SEQ ID NO: 910562 - protein, 9 aa, Homo Sapiens
TPKKKRSAF

SEQ ID NO: 910563 - protein, 9 aa, Homo Sapiens
RATSLLGAD

SEQ ID NO: 910564 - protein, 9 aa, Homo Sapiens
GKAESAVIS

SEQ ID NO: 910565 - protein, 9 aa, Homo Sapiens
PSSVYASAQ

SEQ ID NO: 910566 - protein, 9 aa, Homo Sapiens
SSTFTPQAD

SEQ ID NO: 910567 - protein, 9 aa, Homo Sapiens
GDDLREEVV

SEQ ID NO: 910568 - protein, 9 aa, Homo Sapiens
RNNSSPNTR

SEQ ID NO: 910569 - protein, 9 aa, Homo Sapiens
ENLNQVLLE

SEQ ID NO: 910570 - protein, 9 aa, Homo Sapiens
AFRARYNLV

SEQ ID NO: 910571 - protein, 9 aa, Homo Sapiens
RELIQEEKI

SEQ ID NO: 910572 - protein, 9 aa, Homo Sapiens
AIEQVCFRI

SEQ ID NO: 910573 - protein, 9 aa, Homo Sapiens
SQQAVKSSP

SEQ ID NO: 910574 - protein, 9 aa, Homo Sapiens
LMISACWPM

SEQ ID NO: 910575 - protein, 9 aa, Homo Sapiens
VYASAQGTS

SEQ ID NO: 910576 - protein, 9 aa, Homo Sapiens
SSSSSTFTP

SEQ ID NO: 910577 - protein, 9 aa, Homo Sapiens
LRRFGSGMP

SEQ ID NO: 910578 - protein, 9 aa, Homo Sapiens
SSPRTFFMW

SEQ ID NO: 910579 - protein, 9 aa, Homo Sapiens
KNIQQVFAD

SEQ ID NO: 910580 - protein, 9 aa, Homo Sapiens
PAPYKMMYG

SEQ ID NO: 910581 - protein, 9 aa, Homo Sapiens
SIKTAEIPG

SEQ ID NO: 910582 - protein, 9 aa, Homo Sapiens
ASATGPSQA

SEQ ID NO: 910583 - protein, 9 aa, Homo Sapiens
STITSYLRR

SEQ ID NO: 910584 - protein, 9 aa, Homo Sapiens
SPRTFFMWT

SEQ ID NO: 910585 - protein, 9 aa, Homo Sapiens
LVERENLNQ

SEQ ID NO: 910586 - protein, 9 aa, Homo Sapiens
RWCSPLMIS

SEQ ID NO: 910587 - protein, 9 aa, Homo Sapiens
SEGDDLREE

SEQ ID NO: 910588 - protein, 9 aa, Homo Sapiens
YLRRFGSGM

SEQ ID NO: 910589 - protein, 9 aa, Homo Sapiens
IHVNTFLSC

SEQ ID NO: 910590 - protein, 9 aa, Homo Sapiens
AQGSEVLMC

SEQ ID NO: 910591 - protein, 9 aa, Homo Sapiens
PMYFFLHNF

SEQ ID NO: 910592 - protein, 9 aa, Homo Sapiens
VLMCRHNVG

SEQ ID NO: 910593 - protein, 9 aa, Homo Sapiens
TCKRDSVKW

SEQ ID NO: 910594 - protein, 9 aa, Homo Sapiens
ERENLNQVL

SEQ ID NO: 910595 - protein, 9 aa, Homo Sapiens
SLSSRRRTE

SEQ ID NO: 910596 - protein, 9 aa, Homo Sapiens
RYNLVDKDH

SEQ ID NO: 910597 - protein, 9 aa, Homo Sapiens
KMMYGLENM

SEQ ID NO: 910598 - protein, 9 aa, Homo Sapiens
TPGNMSQRQ

SEQ ID NO: 910599 - protein, 9 aa, Homo Sapiens
STFTPQADT

SEQ ID NO: 910600 - protein, 9 aa, Homo Sapiens
PLPAPYKMM

SEQ ID NO: 910601 - protein, 9 aa, Homo Sapiens
PRISRCWER

SEQ ID NO: 910602 - protein, 9 aa, Homo Sapiens
LVAFRARYN

SEQ ID NO: 910603 - protein, 9 aa, Homo Sapiens
KKSLVEREN

SEQ ID NO: 910604 - protein, 9 aa, Homo Sapiens
EGDDLREEV

SEQ ID NO: 910605 - protein, 9 aa, Homo Sapiens
VSPSMGSTT

SEQ ID NO: 910606 - protein, 9 aa, Homo Sapiens
YASAQGTST

SEQ ID NO: 910607 - protein, 9 aa, Homo Sapiens
IWTSCLPHC

SEQ ID NO: 910608 - protein, 9 aa, Homo Sapiens
KKKNKEEER

SEQ ID NO: 910609 - protein, 9 aa, Homo Sapiens
PRTFFMWTS

SEQ ID NO: 910610 - protein, 9 aa, Homo Sapiens
AGDHGPDRV

SEQ ID NO: 910611 - protein, 9 aa, Homo Sapiens
PQVLQDHGG

SEQ ID NO: 910612 - protein, 9 aa, Homo Sapiens
TVSPSMGST

SEQ ID NO: 910613 - protein, 9 aa, Homo Sapiens
KWQRLASDG

SEQ ID NO: 910614 - protein, 9 aa, Homo Sapiens
SCLPHCVSE

SEQ ID NO: 910615 - protein, 9 aa, Homo Sapiens
VCFRISNSS

SEQ ID NO: 910616 - protein, 9 aa, Homo Sapiens
KPQNPLGDI

SEQ ID NO: 910617 - protein, 9 aa, Homo Sapiens
KIQEVECSV

SEQ ID NO: 910618 - protein, 9 aa, Homo Sapiens
VYDSQAEAV

SEQ ID NO: 910619 - protein, 9 aa, Homo Sapiens
ISACWPMSP

SEQ ID NO: 910620 - protein, 9 aa, Homo Sapiens
KVISFSTCA

SEQ ID NO: 910621 - protein, 9 aa, Homo Sapiens
LVLIKPQNP

SEQ ID NO: 910622 - protein, 9 aa, Homo Sapiens
PMSPWSSST

SEQ ID NO: 910623 - protein, 9 aa, Homo Sapiens
LMCRHNVGY

SEQ ID NO: 910624 - protein, 9 aa, Homo Sapiens
CLAIHVNTF

SEQ ID NO: 910625 - protein, 9 aa, Homo Sapiens
PGNMSQRQG

SEQ ID NO: 910626 - protein, 9 aa, Homo Sapiens
AIHVNTFLS

SEQ ID NO: 910627 - protein, 9 aa, Homo Sapiens
DSQAEAVKT

SEQ ID NO: 910628 - protein, 9 aa, Homo Sapiens
EAVKTSAFI

SEQ ID NO: 910629 - protein, 9 aa, Homo Sapiens
VFTRQTTAA

SEQ ID NO: 910630 - protein, 9 aa, Homo Sapiens
GMNNAPTKG

SEQ ID NO: 910631 - protein, 9 aa, Homo Sapiens
FGSGMPCAV

SEQ ID NO: 910632 - protein, 9 aa, Homo Sapiens
LYELEAALQ

SEQ ID NO: 910633 - protein, 9 aa, Homo Sapiens
MMYGLENMT

SEQ ID NO: 910634 - protein, 9 aa, Homo Sapiens
GAMCLRWCS

SEQ ID NO: 910635 - protein, 9 aa, Homo Sapiens
RSSCIWGMN

SEQ ID NO: 910636 - protein, 9 aa, Homo Sapiens
HLDPEKNTT

SEQ ID NO: 910637 - protein, 9 aa, Homo Sapiens
SFRQSFPST

SEQ ID NO: 910638 - protein, 9 aa, Homo Sapiens
NFINRAGCL

SEQ ID NO: 910639 - protein, 9 aa, Homo Sapiens
TEDQSSNFL

SEQ ID NO: 910640 - protein, 9 aa, Homo Sapiens
FADKKKFWL

SEQ ID NO: 910641 - protein, 9 aa, Homo Sapiens
PPDIRGRAC

SEQ ID NO: 910642 - protein, 9 aa, Homo Sapiens
SALKSSPRT

SEQ ID NO: 910643 - protein, 9 aa, Homo Sapiens
KVRGLVLIK

SEQ ID NO: 910644 - protein, 9 aa, Homo Sapiens
CSPLMISAC

SEQ ID NO: 910645 - protein, 9 aa, Homo Sapiens
SQAEAVKTS

SEQ ID NO: 910646 - protein, 9 aa, Homo Sapiens
ELIQEEKIQ

SEQ ID NO: 910647 - protein, 9 aa, Homo Sapiens
RSAIEQVCF

SEQ ID NO: 910648 - protein, 9 aa, Homo Sapiens
GPVTVFTRQ

SEQ ID NO: 910649 - protein, 9 aa, Homo Sapiens
SLGAMCLRW

SEQ ID NO: 910650 - protein, 9 aa, Homo Sapiens
ANSHNSSPY

SEQ ID NO: 910651 - protein, 9 aa, Homo Sapiens
FLERNNSSP

SEQ ID NO: 910652 - protein, 9 aa, Homo Sapiens
KRRASATGP

SEQ ID NO: 910653 - protein, 9 aa, Homo Sapiens
WQRLASDGS

SEQ ID NO: 910654 - protein, 9 aa, Homo Sapiens
PVTVFTRQT

SEQ ID NO: 910655 - protein, 9 aa, Homo Sapiens
GEIVVLEVE

SEQ ID NO: 910656 - protein, 9 aa, Homo Sapiens
PAIRAGDHG

SEQ ID NO: 910657 - protein, 9 aa, Homo Sapiens
MCRHNVGYH

SEQ ID NO: 910658 - protein, 9 aa, Homo Sapiens
TGTPIWTSC

SEQ ID NO: 910659 - protein, 9 aa, Homo Sapiens
LIPFLERNN

SEQ ID NO: 910660 - protein, 9 aa, Homo Sapiens
HKVISFSTC

SEQ ID NO: 910661 - protein, 9 aa, Homo Sapiens
WKKLHQNCI

SEQ ID NO: 910662 - protein, 9 aa, Homo Sapiens
WERTNLDLP

SEQ ID NO: 910663 - protein, 9 aa, Homo Sapiens
VCLAIHVNT

SEQ ID NO: 910664 - protein, 9 aa, Homo Sapiens
PIWTSCLPH

SEQ ID NO: 910665 - protein, 9 aa, Homo Sapiens
LAGPRETDL

SEQ ID NO: 910666 - protein, 9 aa, Homo Sapiens
ASDGSARLD

SEQ ID NO: 910667 - protein, 9 aa, Homo Sapiens
FMWTSPSSV

SEQ ID NO: 910668 - protein, 9 aa, Homo Sapiens
RENLNQVLL

SEQ ID NO: 910669 - protein, 9 aa, Homo Sapiens
LKNVGEIVV

SEQ ID NO: 910670 - protein, 9 aa, Homo Sapiens
AWAGGKAES

SEQ ID NO: 910671 - protein, 9 aa, Homo Sapiens
DKWQRLASD

SEQ ID NO: 910672 - protein, 9 aa, Homo Sapiens
RTFFMWTSP

SEQ ID NO: 910673 - protein, 9 aa, Homo Sapiens
EDCCFSFRQ

SEQ ID NO: 910674 - protein, 9 aa, Homo Sapiens
TSYLRRFGS

SEQ ID NO: 910675 - protein, 9 aa, Homo Sapiens
FFLHNFSFL

SEQ ID NO: 910676 - protein, 9 aa, Homo Sapiens
APYKMMYGL

SEQ ID NO: 910677 - protein, 9 aa, Homo Sapiens
VTVFTRQTT

SEQ ID NO: 910678 - protein, 9 aa, Homo Sapiens
QSSIKTAEI

SEQ ID NO: 910679 - protein, 9 aa, Homo Sapiens
SVANSHNSS

SEQ ID NO: 910680 - protein, 9 aa, Homo Sapiens
KNVGEIVVL

SEQ ID NO: 910681 - protein, 9 aa, Homo Sapiens
MCLRWCSPL

SEQ ID NO: 910682 - protein, 9 aa, Homo Sapiens
CIWGMNNAP

SEQ ID NO: 910683 - protein, 9 aa, Homo Sapiens
FSTCATQFA

SEQ ID NO: 910684 - protein, 9 aa, Homo Sapiens
RFGSGMPCA

SEQ ID NO: 910685 - protein, 9 aa, Homo Sapiens
IVLIPFLER

SEQ ID NO: 910686 - protein, 9 aa, Homo Sapiens
TERFSIALD

SEQ ID NO: 910687 - protein, 9 aa, Homo Sapiens
PTMEEGSGQ

SEQ ID NO: 910688 - protein, 9 aa, Homo Sapiens
PIFWKKLHQ

SEQ ID NO: 910689 - protein, 9 aa, Homo Sapiens
QQAVKSSPL

SEQ ID NO: 910690 - protein, 9 aa, Homo Sapiens
ESAVISEEG

SEQ ID NO: 910691 - protein, 9 aa, Homo Sapiens
CFSFRQSFP

SEQ ID NO: 910692 - protein, 9 aa, Homo Sapiens
SFSTCATQF

SEQ ID NO: 910693 - protein, 9 aa, Homo Sapiens
GPRETDLCR

SEQ ID NO: 910694 - protein, 9 aa, Homo Sapiens
YTCKRDSVK

SEQ ID NO: 910695 - protein, 9 aa, Homo Sapiens
AVKTSAFIA

SEQ ID NO: 910696 - protein, 9 aa, Homo Sapiens
VLIKPQNPL

SEQ ID NO: 910697 - protein, 9 aa, Homo Sapiens
DSLSSRRRT

SEQ ID NO: 910698 - protein, 9 aa, Homo Sapiens
LSSLGAMCL

SEQ ID NO: 910699 - protein, 9 aa, Homo Sapiens
GQTKPIFWK

SEQ ID NO: 910700 - protein, 9 aa, Homo Sapiens
LHNFSFLEV

SEQ ID NO: 910701 - protein, 9 aa, Homo Sapiens
IKTAEIPGS

SEQ ID NO: 910702 - protein, 9 aa, Homo Sapiens
VGEIVVLEV

SEQ ID NO: 910703 - protein, 9 aa, Homo Sapiens
KTEDQSSNF

SEQ ID NO: 910704 - protein, 9 aa, Homo Sapiens
QVLQDHGGW

SEQ ID NO: 910705 - protein, 9 aa, Homo Sapiens
AQPTMEEGS

SEQ ID NO: 910706 - protein, 9 aa, Homo Sapiens
RRACPAHPL

SEQ ID NO: 910707 - protein, 9 aa, Homo Sapiens
FGFTSTMVP

SEQ ID NO: 910708 - protein, 9 aa, Homo Sapiens
AVCLAIHVN

SEQ ID NO: 910709 - protein, 9 aa, Homo Sapiens
IRAGDHGPD

SEQ ID NO: 910710 - protein, 9 aa, Homo Sapiens
LSSRRRTER

SEQ ID NO: 910711 - protein, 9 aa, Homo Sapiens
IEQVCFRIS

SEQ ID NO: 910712 - protein, 9 aa, Homo Sapiens
LPAPYKMMY

SEQ ID NO: 910713 - protein, 9 aa, Homo Sapiens
DWERTNLDL

SEQ ID NO: 910714 - protein, 9 aa, Homo Sapiens
AEIPGSVLQ

SEQ ID NO: 910715 - protein, 9 aa, Homo Sapiens
SPYLDMATN

SEQ ID NO: 910716 - protein, 9 aa, Homo Sapiens
RTERFSIAL

SEQ ID NO: 910717 - protein, 9 aa, Homo Sapiens
SSSTITSYL

SEQ ID NO: 910718 - protein, 9 aa, Homo Sapiens
SCIWGMNNA

SEQ ID NO: 910719 - protein, 9 aa, Homo Sapiens
SPRISRCWE

SEQ ID NO: 910720 - protein, 9 aa, Homo Sapiens
GCLCLSSLG

SEQ ID NO: 910721 - protein, 9 aa, Homo Sapiens
PFLERNNSS

SEQ ID NO: 910722 - protein, 9 aa, Homo Sapiens
QAEAVKTSA

SEQ ID NO: 910723 - protein, 9 aa, Homo Sapiens
AMCLRWCSP

SEQ ID NO: 910724 - protein, 9 aa, Homo Sapiens
SMGSTTSAL

SEQ ID NO: 910725 - protein, 9 aa, Homo Sapiens
HNFSFLEVI

SEQ ID NO: 910726 - protein, 9 aa, Homo Sapiens
MWTSPSSVY

SEQ ID NO: 910727 - protein, 9 aa, Homo Sapiens
ISRCWERYA

SEQ ID NO: 910728 - protein, 9 aa, Homo Sapiens
FEDIWMHSG

SEQ ID NO: 910729 - protein, 9 aa, Homo Sapiens
QQVFADKKK

SEQ ID NO: 910730 - protein, 9 aa, Homo Sapiens
PYLDMATNI

SEQ ID NO: 910731 - protein, 9 aa, Homo Sapiens
QAVKSSPLL

SEQ ID NO: 910732 - protein, 9 aa, Homo Sapiens
FDSVRSEGD

SEQ ID NO: 910733 - protein, 9 aa, Homo Sapiens
STTSALKSS

SEQ ID NO: 910734 - protein, 9 aa, Homo Sapiens
ASAQGTSTF

SEQ ID NO: 910735 - protein, 9 aa, Homo Sapiens
KTAEIPGSV

SEQ ID NO: 910736 - protein, 9 aa, Homo Sapiens
SEVLMCRHN

SEQ ID NO: 910737 - protein, 9 aa, Homo Sapiens
KTGRVTKTK

SEQ ID NO: 910738 - protein, 9 aa, Homo Sapiens
TPIWTSCLP

SEQ ID NO: 910739 - protein, 9 aa, Homo Sapiens
NHKVISFST

SEQ ID NO: 910740 - protein, 9 aa, Homo Sapiens
SQLLTPGNM

SEQ ID NO: 910741 - protein, 9 aa, Homo Sapiens
IWMHSGSWK

SEQ ID NO: 910742 - protein, 9 aa, Homo Sapiens
AFEDIWMHS

SEQ ID NO: 910743 - protein, 9 aa, Homo Sapiens
LSNLSLPDF

SEQ ID NO: 910744 - protein, 9 aa, Homo Sapiens
RISRCWERY

SEQ ID NO: 910745 - protein, 9 aa, Homo Sapiens
AHPLYNMVA

SEQ ID NO: 910746 - protein, 9 aa, Homo Sapiens
SSVYASAQG

SEQ ID NO: 910747 - protein, 9 aa, Homo Sapiens
HWDLPQVLQ

SEQ ID NO: 910748 - protein, 9 aa, Homo Sapiens
SSLGAMCLR

SEQ ID NO: 910749 - protein, 9 aa, Homo Sapiens
SLLKNVGEI

SEQ ID NO: 910750 - protein, 9 aa, Homo Sapiens
SNLSLPDFG

SEQ ID NO: 910751 - protein, 9 aa, Homo Sapiens
VLIPFLERN

SEQ ID NO: 910752 - protein, 9 aa, Homo Sapiens
TPQADTGEQ

SEQ ID NO: 910753 - protein, 9 aa, Homo Sapiens
LNLIFIVLK

SEQ ID NO: 910754 - protein, 9 aa, Homo Sapiens
WCSPLMISA

SEQ ID NO: 910755 - protein, 9 aa, Homo Sapiens
RACFCALLN

SEQ ID NO: 910756 - protein, 9 aa, Homo Sapiens
FSFRQSFPS

SEQ ID NO: 910757 - protein, 9 aa, Homo Sapiens
WDLPQVLQD

SEQ ID NO: 910758 - protein, 9 aa, Homo Sapiens
VKTSLAGPR

SEQ ID NO: 910759 - protein, 9 aa, Homo Sapiens
EIVVLEVEY

SEQ ID NO: 910760 - protein, 9 aa, Homo Sapiens
GMPCAVSSP

SEQ ID NO: 910761 - protein, 9 aa, Homo Sapiens
EVKTSLAGP

SEQ ID NO: 910762 - protein, 9 aa, Homo Sapiens
NLSLPDFGF

SEQ ID NO: 910763 - protein, 9 aa, Homo Sapiens
MLQGVAQPT

SEQ ID NO: 910764 - protein, 9 aa, Homo Sapiens
QVFADKKKF

SEQ ID NO: 910765 - protein, 9 aa, Homo Sapiens
GTSTFSREL

SEQ ID NO: 910766 - protein, 9 aa, Homo Sapiens
KLQKKKNKE

SEQ ID NO: 910767 - protein, 9 aa, Homo Sapiens
AGPRETDLC

SEQ ID NO: 910768 - protein, 9 aa, Homo Sapiens
PDIRGRACF

SEQ ID NO: 910769 - protein, 9 aa, Homo Sapiens
DEAIQDGLE

SEQ ID NO: 910770 - protein, 9 aa, Homo Sapiens
CRHNVGYHI

SEQ ID NO: 910771 - protein, 9 aa, Homo Sapiens
AIRAGDHGP

SEQ ID NO: 910772 - protein, 9 aa, Homo Sapiens
EEKIQEVEC

SEQ ID NO: 910773 - protein, 9 aa, Homo Sapiens
DQSSNFLSL

SEQ ID NO: 910774 - protein, 9 aa, Homo Sapiens
WMHSGSWKR

SEQ ID NO: 910775 - protein, 9 aa, Homo Sapiens
EAIQDGLEV

SEQ ID NO: 910776 - protein, 9 aa, Homo Sapiens
MHSGSWKRR

SEQ ID NO: 910777 - protein, 9 aa, Homo Sapiens
IQQVFADKK

SEQ ID NO: 910778 - protein, 9 aa, Homo Sapiens
TVFTRQTTA

SEQ ID NO: 910779 - protein, 9 aa, Homo Sapiens
EIVKTEDQS

SEQ ID NO: 910780 - protein, 9 aa, Homo Sapiens
GTHLDPEKN

SEQ ID NO: 910781 - protein, 9 aa, Homo Sapiens
IQDGLEVWS

SEQ ID NO: 910782 - protein, 9 aa, Homo Sapiens
IFWKKLHQN

SEQ ID NO: 910783 - protein, 9 aa, Homo Sapiens
TAEIPGSVL

SEQ ID NO: 910784 - protein, 9 aa, Homo Sapiens
FFDSVRSEG

SEQ ID NO: 910785 - protein, 9 aa, Homo Sapiens
PRETDLCRW

SEQ ID NO: 910786 - protein, 9 aa, Homo Sapiens
YDSQAEAVK

SEQ ID NO: 910787 - protein, 9 aa, Homo Sapiens
WTSCLPHCV

SEQ ID NO: 910788 - protein, 9 aa, Homo Sapiens
CLRWCSPLM

SEQ ID NO: 910789 - protein, 9 aa, Homo Sapiens
PSMGSTTSA

SEQ ID NO: 910790 - protein, 9 aa, Homo Sapiens
AESAVISEE

SEQ ID NO: 910791 - protein, 9 aa, Homo Sapiens
SSTITSYLR

SEQ ID NO: 910792 - protein, 9 aa, Homo Sapiens
AQGTSTFSR

SEQ ID NO: 910793 - protein, 9 aa, Homo Sapiens
ACPAHPLYN

SEQ ID NO: 910794 - protein, 9 aa, Homo Sapiens
SLAGPRETD

SEQ ID NO: 910795 - protein, 9 aa, Homo Sapiens
LQGVAQPTM

SEQ ID NO: 910796 - protein, 9 aa, Homo Sapiens
LKSSPRTFF

SEQ ID NO: 910797 - protein, 9 aa, Homo Sapiens
ACKKLQKKK

SEQ ID NO: 910798 - protein, 9 aa, Homo Sapiens
RRFGSGMPC

SEQ ID NO: 910799 - protein, 9 aa, Homo Sapiens
RLASDGSAR

SEQ ID NO: 910800 - protein, 9 aa, Homo Sapiens
DGSARLDMF

SEQ ID NO: 910801 - protein, 9 aa, Homo Sapiens
LGAMCLRWC

SEQ ID NO: 910802 - protein, 9 aa, Homo Sapiens
FPDWERTNL

SEQ ID NO: 910803 - protein, 9 aa, Homo Sapiens
NLNQVLLEG

SEQ ID NO: 910804 - protein, 9 aa, Homo Sapiens
VKTSAFIAG

SEQ ID NO: 910805 - protein, 9 aa, Homo Sapiens
IVLKTGRVT

SEQ ID NO: 910806 - protein, 9 aa, Homo Sapiens
TNLDLPLQC

SEQ ID NO: 910807 - protein, 9 aa, Homo Sapiens
AGGKAESAV

SEQ ID NO: 910808 - protein, 9 aa, Homo Sapiens
NPAIRAGDH

SEQ ID NO: 910809 - protein, 9 aa, Homo Sapiens
MSGPVTVFT

SEQ ID NO: 910810 - protein, 9 aa, Homo Sapiens
NAKLYELEA

SEQ ID NO: 910811 - protein, 9 aa, Homo Sapiens
EQVCFRISN

SEQ ID NO: 910812 - protein, 9 aa, Homo Sapiens
KSSPLLESP

SEQ ID NO: 910813 - protein, 9 aa, Homo Sapiens
ERTNLDLPL

SEQ ID NO: 910814 - protein, 9 aa, Homo Sapiens
ISFSTCATQ

SEQ ID NO: 910815 - protein, 9 aa, Homo Sapiens
VRSEGDDLR

SEQ ID NO: 910816 - protein, 9 aa, Homo Sapiens
NMSQRQGKE

SEQ ID NO: 910817 - protein, 9 aa, Homo Sapiens
TSCLPHCVS

SEQ ID NO: 910818 - protein, 9 aa, Homo Sapiens
VRSAIEQVC

SEQ ID NO: 910819 - protein, 9 aa, Homo Sapiens
ESQLLTPGN

SEQ ID NO: 910820 - protein, 9 aa, Homo Sapiens
PLYNMVAGW

SEQ ID NO: 910821 - protein, 9 aa, Homo Sapiens
ADKKKFWLI

SEQ ID NO: 910822 - protein, 9 aa, Homo Sapiens
TSPSSVYAS

SEQ ID NO: 910823 - protein, 9 aa, Homo Sapiens
SGMPCAVSS

SEQ ID NO: 910824 - protein, 9 aa, Homo Sapiens
FTPQADTGE

SEQ ID NO: 910825 - protein, 9 aa, Homo Sapiens
WAGGKAESA

SEQ ID NO: 910826 - protein, 9 aa, Homo Sapiens
VKTEDQSSN

SEQ ID NO: 910827 - protein, 9 aa, Homo Sapiens
RYAFEDIWM

SEQ ID NO: 910828 - protein, 9 aa, Homo Sapiens
LIKPQNPLG

SEQ ID NO: 910829 - protein, 9 aa, Homo Sapiens
CKRDSVKWH

SEQ ID NO: 910830 - protein, 9 aa, Homo Sapiens
IKDANAKLY

SEQ ID NO: 910831 - protein, 9 aa, Homo Sapiens
FLHNFSFLE

SEQ ID NO: 910832 - protein, 9 aa, Homo Sapiens
IPFLERNNS

SEQ ID NO: 910833 - protein, 9 aa, Homo Sapiens
SVYASAQGT

SEQ ID NO: 910834 - protein, 9 aa, Homo Sapiens
LTPGNMSQR

SEQ ID NO: 910835 - protein, 9 aa, Homo Sapiens
TTITVSPSM

SEQ ID NO: 910836 - protein, 9 aa, Homo Sapiens
AVDEAIQDG

SEQ ID NO: 910837 - protein, 9 aa, Homo Sapiens
YFFLHNFSF

SEQ ID NO: 910838 - protein, 9 aa, Homo Sapiens
DFGFTSTMV

SEQ ID NO: 910839 - protein, 9 aa, Homo Sapiens
CFRISNSST

SEQ ID NO: 910840 - protein, 9 aa, Homo Sapiens
MYFFLHNFS

SEQ ID NO: 910841 - protein, 9 aa, Homo Sapiens
RAGDHGPDR

SEQ ID NO: 910842 - protein, 9 aa, Homo Sapiens
KLYELEAAL

SEQ ID NO: 910843 - protein, 9 aa, Homo Sapiens
ITSYLRRFG

SEQ ID NO: 910844 - protein, 9 aa, Homo Sapiens
NLDLPLQCY

SEQ ID NO: 910845 - protein, 9 aa, Homo Sapiens
DRSSCIWGM

SEQ ID NO: 910846 - protein, 9 aa, Homo Sapiens
FRARYNLVD

SEQ ID NO: 910847 - protein, 9 aa, Homo Sapiens
LASDGSARL

SEQ ID NO: 910848 - protein, 9 aa, Homo Sapiens
HVNTFLSCS

SEQ ID NO: 910849 - protein, 9 aa, Homo Sapiens
LPDFGFTST

SEQ ID NO: 910850 - protein, 9 aa, Homo Sapiens
VERENLNQV

SEQ ID NO: 910851 - protein, 9 aa, Homo Sapiens
DAWAGGKAE

SEQ ID NO: 910852 - protein, 9 aa, Homo Sapiens
CKKLQKKKN

SEQ ID NO: 910853 - protein, 9 aa, Homo Sapiens
LDMATNIFR

SEQ ID NO: 910854 - protein, 9 aa, Homo Sapiens
LPQVLQDHG

SEQ ID NO: 910855 - protein, 9 aa, Homo Sapiens
DANAKLYEL

SEQ ID NO: 910856 - protein, 9 aa, Homo Sapiens
IFIVLKTGR

SEQ ID NO: 910857 - protein, 9 aa, Homo Sapiens
QKKKNKEEE

SEQ ID NO: 910858 - protein, 9 aa, Homo Sapiens
IVVLEVEYE

SEQ ID NO: 910859 - protein, 9 aa, Homo Sapiens
WKRRASATG

SEQ ID NO: 910860 - protein, 9 aa, Homo Sapiens
AVKSSPLLE

SEQ ID NO: 910861 - protein, 9 aa, Homo Sapiens
INRAGCLCL

SEQ ID NO: 910862 - protein, 9 aa, Homo Sapiens
TITSYLRRF

SEQ ID NO: 910863 - protein, 9 aa, Homo Sapiens
QEEKIQEVE

SEQ ID NO: 910864 - protein, 9 aa, Homo Sapiens
NVGEIVVLE

SEQ ID NO: 910865 - protein, 9 aa, Homo Sapiens
GRACFCALL

SEQ ID NO: 910866 - protein, 9 aa, Homo Sapiens
DSVRSEGDD

SEQ ID NO: 910867 - protein, 9 aa, Homo Sapiens
RASATGPSQ

SEQ ID NO: 910868 - protein, 9 aa, Homo Sapiens
VSSPYLDMA

SEQ ID NO: 910869 - protein, 9 aa, Homo Sapiens
TFTPQADTG

SEQ ID NO: 910870 - protein, 9 aa, Homo Sapiens
DIRGRACFC

SEQ ID NO: 910871 - protein, 9 aa, Homo Sapiens
TPMYFFLHN

SEQ ID NO: 910872 - protein, 9 aa, Homo Sapiens
VAFRARYNL

SEQ ID NO: 910873 - protein, 9 aa, Homo Sapiens
FFMWTSPSS

SEQ ID NO: 910874 - protein, 9 aa, Homo Sapiens
SPLLESPDA

SEQ ID NO: 910875 - protein, 9 aa, Homo Sapiens
SAIEQVCFR

SEQ ID NO: 910876 - protein, 9 aa, Homo Sapiens
DLPQVLQDH

SEQ ID NO: 910877 - protein, 9 aa, Homo Sapiens
LQKKKNKEE

SEQ ID NO: 910878 - protein, 9 aa, Homo Sapiens
AGCLCLSSL

SEQ ID NO: 910879 - protein, 9 aa, Homo Sapiens
TITVSPSMG

SEQ ID NO: 910880 - protein, 9 aa, Homo Sapiens
GLVLIKPQN

SEQ ID NO: 910881 - protein, 9 aa, Homo Sapiens
TQSSIKTAE

SEQ ID NO: 910882 - protein, 9 aa, Homo Sapiens
YEIVKTEDQ

SEQ ID NO: 910883 - protein, 9 aa, Homo Sapiens
ITVSPSMGS

SEQ ID NO: 910884 - protein, 9 aa, Homo Sapiens
LLTPGNMSQ

SEQ ID NO: 910885 - protein, 9 aa, Homo Sapiens
VDEAIQDGL

SEQ ID NO: 910886 - protein, 9 aa, Homo Sapiens
EKNTTAAAA

SEQ ID NO: 910887 - protein, 9 aa, Homo Sapiens
ERYAFEDIW

SEQ ID NO: 910888 - protein, 9 aa, Homo Sapiens
FSRELLSPR

SEQ ID NO: 910889 - protein, 9 aa, Homo Sapiens
YKMMYGLEN

SEQ ID NO: 910890 - protein, 9 aa, Homo Sapiens
QTKPIFWKK

SEQ ID NO: 910891 - protein, 9 aa, Homo Sapiens
ALKSSPRTF

SEQ ID NO: 910892 - protein, 9 aa, Homo Sapiens
KTPMYFFLH

SEQ ID NO: 910893 - protein, 9 aa, Homo Sapiens
GNMSQRQGK

SEQ ID NO: 910894 - protein, 9 aa, Homo Sapiens
MGSTTSALK

SEQ ID NO: 910895 - protein, 9 aa, Homo Sapiens
FTRQTTAAE

SEQ ID NO: 910896 - protein, 9 aa, Homo Sapiens
DTELILYTC

SEQ ID NO: 910897 - protein, 9 aa, Homo Sapiens
FINRAGCLC

SEQ ID NO: 910898 - protein, 9 aa, Homo Sapiens
SGSWKRRAS

SEQ ID NO: 910899 - protein, 9 aa, Homo Sapiens
CCFSFRQSF

SEQ ID NO: 910900 - protein, 9 aa, Homo Sapiens
LSPRISRCW

SEQ ID NO: 910901 - protein, 9 aa, Homo Sapiens
SRCWERYAF

SEQ ID NO: 910902 - protein, 9 aa, Homo Sapiens
CLSSLGAMC

SEQ ID NO: 910903 - protein, 9 aa, Homo Sapiens
VISFSTCAT

SEQ ID NO: 910904 - protein, 9 aa, Homo Sapiens
ETQSSIKTA

SEQ ID NO: 910905 - protein, 9 aa, Homo Sapiens
STCATQFAF

SEQ ID NO: 910906 - protein, 9 aa, Homo Sapiens
RCWERYAFE

SEQ ID NO: 910907 - protein, 9 aa, Homo Sapiens
PEKNTTAAA

SEQ ID NO: 910908 - protein, 9 aa, Homo Sapiens
EVLMCRHNV

SEQ ID NO: 910909 - protein, 9 aa, Homo Sapiens
QLLTPGNMS

SEQ ID NO: 910910 - protein, 9 aa, Homo Sapiens
SACWPMSPW

SEQ ID NO: 910911 - protein, 9 aa, Homo Sapiens
TFFMWTSPS

SEQ ID NO: 910912 - protein, 9 aa, Homo Sapiens
KSSPRTFFM

SEQ ID NO: 910913 - protein, 9 aa, Homo Sapiens
RSEGDDLRE

SEQ ID NO: 910914 - protein, 9 aa, Homo Sapiens
PWSSSTITS

SEQ ID NO: 910915 - protein, 9 aa, Homo Sapiens
WPMSPWSSS

SEQ ID NO: 910916 - protein, 9 aa, Homo Sapiens
IVKTEDQSS

SEQ ID NO: 910917 - protein, 9 aa, Homo Sapiens
LKTGRVTKT

SEQ ID NO: 910918 - protein, 9 aa, Homo Sapiens
VANSHNSSP

SEQ ID NO: 910919 - protein, 9 aa, Homo Sapiens
IWGMNNAPT

SEQ ID NO: 910920 - protein, 9 aa, Homo Sapiens
KPIFWKKLH

SEQ ID NO: 910921 - protein, 9 aa, Homo Sapiens
LCLSSLGAM

SEQ ID NO: 910922 - protein, 9 aa, Homo Sapiens
IRGRACFCA

SEQ ID NO: 910923 - protein, 9 aa, Homo Sapiens
PCAVSSPYL

SEQ ID NO: 910924 - protein, 9 aa, Homo Sapiens
TMEEGSGQL

SEQ ID NO: 910925 - protein, 9 aa, Homo Sapiens
FRQSFPSTW

SEQ ID NO: 910926 - protein, 9 aa, Homo Sapiens
ELILYTCKR

SEQ ID NO: 910927 - protein, 9 aa, Homo Sapiens
RQSFPSTWC

SEQ ID NO: 910928 - protein, 9 aa, Homo Sapiens
TKPIFWKKL

SEQ ID NO: 910929 - protein, 9 aa, Homo Sapiens
SGPVTVFTR

SEQ ID NO: 910930 - protein, 9 aa, Homo Sapiens
LRWCSPLMI

SEQ ID NO: 910931 - protein, 9 aa, Homo Sapiens
QSSNFLSLQ

SEQ ID NO: 910932 - protein, 9 aa, Homo Sapiens
SSSSTFTPQ

SEQ ID NO: 910933 - protein, 9 aa, Homo Sapiens
MSPWSSSTI

SEQ ID NO: 910934 - protein, 9 aa, Homo Sapiens
EGTHLDPEK

SEQ ID NO: 910935 - protein, 9 aa, Homo Sapiens
EMSGPVTVF

SEQ ID NO: 910936 - protein, 9 aa, Homo Sapiens
RRRTERFSI

SEQ ID NO: 910937 - protein, 9 aa, Homo Sapiens
LIQEEKIQE

SEQ ID NO: 910938 - protein, 9 aa, Homo Sapiens
SPWSSSTIT

SEQ ID NO: 910939 - protein, 9 aa, Homo Sapiens
QRLASDGSA

SEQ ID NO: 910940 - protein, 9 aa, Homo Sapiens
DSQQAVKSS

SEQ ID NO: 910941 - protein, 9 aa, Homo Sapiens
YNLVDKDHD

SEQ ID NO: 910942 - protein, 9 aa, Homo Sapiens
TSTFSRELL

SEQ ID NO: 910943 - protein, 9 aa, Homo Sapiens
VSVANSHNS

SEQ ID NO: 910944 - protein, 9 aa, Homo Sapiens
GSWKRRASA

SEQ ID NO: 910945 - protein, 9 aa, Homo Sapiens
MPCAVSSPY

SEQ ID NO: 910946 - protein, 9 aa, Homo Sapiens
SSPLLESPD

SEQ ID NO: 910947 - protein, 9 aa, Homo Sapiens
GVAQPTMEE

SEQ ID NO: 910948 - protein, 9 aa, Homo Sapiens
CWPMSPWSS

SEQ ID NO: 910949 - protein, 9 aa, Homo Sapiens
DHGPDRVRP

SEQ ID NO: 910950 - protein, 9 aa, Homo Sapiens
LIFIVLKTG

SEQ ID NO: 910951 - protein, 9 aa, Homo Sapiens
WTSPSSVYA

SEQ ID NO: 910952 - protein, 9 aa, Homo Sapiens
SRELLSPRI

SEQ ID NO: 910953 - protein, 9 aa, Homo Sapiens
SSRRRTERF

SEQ ID NO: 910954 - protein, 9 aa, Homo Sapiens
GDHGPDRVR

SEQ ID NO: 910955 - protein, 9 aa, Homo Sapiens
CAVSSPYLD

SEQ ID NO: 910956 - protein, 9 aa, Homo Sapiens
DCCFSFRQS

SEQ ID NO: 910957 - protein, 9 aa, Homo Sapiens
SSIKTAEIP

SEQ ID NO: 910958 - protein, 9 aa, Homo Sapiens
SPSMGSTTS

SEQ ID NO: 910959 - protein, 9 aa, Homo Sapiens
TFSRELLSP

SEQ ID NO: 910960 - protein, 9 aa, Homo Sapiens
PYKMMYGLE

SEQ ID NO: 910961 - protein, 9 aa, Homo Sapiens
LYNMVAGWY

SEQ ID NO: 910962 - protein, 9 aa, Homo Sapiens
VLKTGRVTK

SEQ ID NO: 910963 - protein, 9 aa, Homo Sapiens
AKLYELEAA

SEQ ID NO: 910964 - protein, 9 aa, Homo Sapiens
AAVDEAIQD

SEQ ID NO: 910965 - protein, 9 aa, Homo Sapiens
LSLPDFGFT

SEQ ID NO: 910966 - protein, 9 aa, Homo Sapiens
NLIFIVLKT

SEQ ID NO: 910967 - protein, 9 aa, Homo Sapiens
VFADKKKFW

SEQ ID NO: 910968 - protein, 9 aa, Homo Sapiens
HRELIQEEK

SEQ ID NO: 910969 - protein, 9 aa, Homo Sapiens
SSCIWGMNN

SEQ ID NO: 910970 - protein, 9 aa, Homo Sapiens
PDFGFTSTM

SEQ ID NO: 910971 - protein, 9 aa, Homo Sapiens
TELILYTCK

SEQ ID NO: 910972 - protein, 9 aa, Homo Sapiens
LLKNVGEIV

SEQ ID NO: 910973 - protein, 9 aa, Homo Sapiens
KSLVERENL

SEQ ID NO: 910974 - protein, 9 aa, Homo Sapiens
SRRRTERFS

SEQ ID NO: 910975 - protein, 9 aa, Homo Sapiens
SSPYLDMAT

SEQ ID NO: 910976 - protein, 9 aa, Homo Sapiens
NLVDKDHDS

SEQ ID NO: 910977 - protein, 9 aa, Homo Sapiens
EKIQEVECS

SEQ ID NO: 910978 - protein, 9 aa, Homo Sapiens
RGRACFCAL

SEQ ID NO: 910979 - protein, 9 aa, Homo Sapiens
ANAKLYELE

SEQ ID NO: 910980 - protein, 9 aa, Homo Sapiens
WNPAIRAGD

SEQ ID NO: 910981 - protein, 9 aa, Homo Sapiens
IKNIQQVFA

SEQ ID NO: 910982 - protein, 9 aa, Homo Sapiens
MISACWPMS

SEQ ID NO: 910983 - protein, 9 aa, Homo Sapiens
CLCLSSLGA

SEQ ID NO: 910984 - protein, 9 aa, Homo Sapiens
LLSPRISRC

SEQ ID NO: 910985 - protein, 9 aa, Homo Sapiens
TTSALKSSP

SEQ ID NO: 910986 - protein, 9 aa, Homo Sapiens
RRTERFSIA

SEQ ID NO: 910987 - protein, 9 aa, Homo Sapiens
LERNNSSPN

SEQ ID NO: 910988 - protein, 9 aa, Homo Sapiens
NSHNSSPYL

SEQ ID NO: 910989 - protein, 9 aa, Homo Sapiens
YELEAALQR

SEQ ID NO: 910990 - protein, 9 aa, Homo Sapiens
KDANAKLYE

SEQ ID NO: 910991 - protein, 9 aa, Homo Sapiens
SLVERENLN

SEQ ID NO: 910992 - protein, 9 aa, Homo Sapiens
DIWMHSGSW

SEQ ID NO: 910993 - protein, 9 aa, Homo Sapiens
LDPEKNTTA

SEQ ID NO: 910994 - protein, 9 aa, Homo Sapiens
GGQTKPIFW

SEQ ID NO: 910995 - protein, 9 aa, Homo Sapiens
QVCFRISNS

SEQ ID NO: 910996 - protein, 9 aa, Homo Sapiens
WGMNNAPTK

SEQ ID NO: 910997 - protein, 9 aa, Homo Sapiens
ARYNLVDKD

SEQ ID NO: 910998 - protein, 9 aa, Homo Sapiens
VKSSPLLES

SEQ ID NO: 910999 - protein, 9 aa, Homo Sapiens
YAFEDIWMH

SEQ ID NO: 911000 - protein, 9 aa, Homo Sapiens
SYLRRFGSG

SEQ ID NO: 911001 - protein, 9 aa, Homo Sapiens
TSALKSSPR

SEQ ID NO: 911002 - protein, 9 aa, Homo Sapiens
CLPHCVSEE

SEQ ID NO: 911003 - protein, 9 aa, Homo Sapiens
VAQPTMEEG

SEQ ID NO: 911004 - protein, 9 aa, Homo Sapiens
FIVLKTGRV

SEQ ID NO: 911005 - protein, 9 aa, Homo Sapiens
CPAHPLYNM

SEQ ID NO: 911006 - protein, 9 aa, Homo Sapiens
SWKRRASAT

SEQ ID NO: 911007 - protein, 9 aa, Homo Sapiens
SAQGTSTFS

SEQ ID NO: 911008 - protein, 9 aa, Homo Sapiens
HSGSWKRRA

SEQ ID NO: 911009 - protein, 9 aa, Homo Sapiens
QPAVCLAIH

SEQ ID NO: 911010 - protein, 9 aa, Homo Sapiens
FWKKLHQNC

SEQ ID NO: 911011 - protein, 9 aa, Homo Sapiens
ERNNSSPNT

SEQ ID NO: 911012 - protein, 9 aa, Homo Sapiens
ELLSPRISR

SEQ ID NO: 911013 - protein, 9 aa, Homo Sapiens
KAESAVISE

SEQ ID NO: 911014 - protein, 9 aa, Homo Sapiens
IKPQNPLGD

SEQ ID NO: 911015 - protein, 9 aa, Homo Sapiens
HPLYNMVAG

SEQ ID NO: 911016 - protein, 9 aa, Homo Sapiens
STFSRELLS

SEQ ID NO: 911017 - protein, 9 aa, Homo Sapiens
DGLEVWSKV

SEQ ID NO: 911018 - protein, 9 aa, Homo Sapiens
SSSTFTPQA

SEQ ID NO: 911019 - protein, 9 aa, Homo Sapiens
AVSSPYLDM

SEQ ID NO: 911020 - protein, 9 aa, Homo Sapiens
QGTSTFSRE

SEQ ID NO: 911021 - protein, 9 aa, Homo Sapiens
LFHWDLPQV

SEQ ID NO: 911022 - protein, 9 aa, Homo Sapiens
SPSSVYASA

SEQ ID NO: 911023 - protein, 9 aa, Homo Sapiens
PLMISACWP

SEQ ID NO: 911024 - protein, 9 aa, Homo Sapiens
GGKAESAVI

SEQ ID NO: 911025 - protein, 9 aa, Homo Sapiens
TSLAGPRET

SEQ ID NO: 911026 - protein, 9 aa, Homo Sapiens
SDGSARLDM

SEQ ID NO: 911027 - protein, 9 aa, Homo Sapiens
QDGLEVWSK

SEQ ID NO: 911028 - protein, 9 aa, Homo Sapiens
SPLMISACW

SEQ ID NO: 911029 - protein, 9 aa, Homo Sapiens
GSTTSALKS

SEQ ID NO: 911030 - protein, 9 aa, Homo Sapiens
WSSSTITSY

SEQ ID NO: 911031 - protein, 9 aa, Homo Sapiens
IQEEKIQEV

SEQ ID NO: 911032 - protein, 9 aa, Homo Sapiens
RELLSPRIS

SEQ ID NO: 911033 - protein, 9 aa, Homo Sapiens
PPAVSVANS

SEQ ID NO: 911034 - protein, 9 aa, Homo Sapiens
RGLVLIKPQ

SEQ ID NO: 911035 - protein, 9 aa, Homo Sapiens
QPPAVSVAN

SEQ ID NO: 911036 - protein, 9 aa, Homo Sapiens
PAVSVANSH

SEQ ID NO: 911037 - protein, 9 aa, Homo Sapiens
AEAVKTSAF

SEQ ID NO: 911038 - protein, 9 aa, Homo Sapiens
RRASATGPS

SEQ ID NO: 911039 - protein, 9 aa, Homo Sapiens
RAGCLCLSS

SEQ ID NO: 911040 - protein, 9 aa, Homo Sapiens
SLPDFGFTS

SEQ ID NO: 911041 - protein, 9 aa, Homo Sapiens
SVRSEGDDL

SEQ ID NO: 911042 - protein, 9 aa, Homo Sapiens
GTPIWTSCL

SEQ ID NO: 911043 - protein, 9 aa, Homo Sapiens
VLQDHGGWQ

SEQ ID NO: 911044 - protein, 9 aa, Homo Sapiens
GNFINRAGC

SEQ ID NO: 911045 - protein, 9 aa, Homo Sapiens
PAHPLYNMV

SEQ ID NO: 911046 - protein, 9 aa, Homo Sapiens
CWERYAFED

SEQ ID NO: 911047 - protein, 9 aa, Homo Sapiens
KKLQKKKNK

SEQ ID NO: 911048 - protein, 9 aa, Homo Sapiens
YLDMATNIF

SEQ ID NO: 911049 - protein, 9 aa, Homo Sapiens
AVSVANSHN

SEQ ID NO: 911050 - protein, 9 aa, Homo Sapiens
EDQSSNFLS

SEQ ID NO: 911051 - protein, 9 aa, Homo Sapiens
ACWPMSPWS

SEQ ID NO: 911052 - protein, 9 aa, Homo Sapiens
WERYAFEDI

SEQ ID NO: 911053 - protein, 9 aa, Homo Sapiens
RTNLDLPLQ

SEQ ID NO: 911054 - protein, 9 aa, Homo Sapiens
NIQQVFADK

SEQ ID NO: 911055 - protein, 9 aa, Homo Sapiens
PAVCLAIHV

SEQ ID NO: 911056 - protein, 9 aa, Homo Sapiens
LAIHVNTFL

SEQ ID NO: 911057 - protein, 9 aa, Homo Sapiens
SSSSSSTFT

SEQ ID NO: 911058 - protein, 9 aa, Homo Sapiens
GSGMPCAVS

SEQ ID NO: 911059 - protein, 9 aa, Homo Sapiens
LILYTCKRD

SEQ ID NO: 911060 - protein, 9 aa, Homo Sapiens
GSEVLMCRH

SEQ ID NO: 911061 - protein, 9 aa, Homo Sapiens
KTTITVSPS

SEQ ID NO: 911062 - protein, 9 aa, Homo Sapiens
FHWDLPQVL

SEQ ID NO: 911063 - protein, 9 aa, Homo Sapiens
KNTTAAAAI

SEQ ID NO: 911064 - protein, 9 aa, Homo Sapiens
ILYTCKRDS

SEQ ID NO: 911065 - protein, 9 aa, Homo Sapiens
QGVAQPTME

SEQ ID NO: 911066 - protein, 9 aa, Homo Sapiens
RACPAHPLY

SEQ ID NO: 911067 - protein, 9 aa, Homo Sapiens
RARYNLVDK

SEQ ID NO: 911068 - protein, 9 aa, Homo Sapiens
THLDPEKNT

SEQ ID NO: 911069 - protein, 9 aa, Homo Sapiens
VRGLVLIKP

SEQ ID NO: 911070 - protein, 9 aa, Homo Sapiens
QGSEVLMCR

SEQ ID NO: 911071 - protein, 9 aa, Homo Sapiens
KTSLAGPRE

SEQ ID NO: 911072 - protein, 9 aa, Homo Sapiens
PDWERTNLD

SEQ ID NO: 911073 - protein, 9 aa, Homo Sapiens
DPEKNTTAA

SEQ ID NO: 911074 - protein, 9 aa, Homo Sapiens
IDRSSCIWG

SEQ ID NO: 911075 - protein, 9 aa, Homo Sapiens
QPTMEEGSG

SEQ ID NO: 911076 - protein, 9 aa, Homo Sapiens
EDIWMHSGS

SEQ ID NO: 911077 - protein, 9 aa, Homo Sapiens
AIQDGLEVW

SEQ ID NO: 911078 - protein, 9 aa, Homo Sapiens
LYTCKRDSV

SEQ ID NO: 911079 - protein, 9 aa, Homo Sapiens
NRAGCLCLS

SEQ ID NO: 911080 - protein, 9 aa, Homo Sapiens
MYGLENMTQ

SEQ ID NO: 911081 - protein, 9 aa, Homo Sapiens
TCATQFAFF

SEQ ID NO: 911082 - protein, 9 aa, Homo Sapiens
DIYKKLYYS

SEQ ID NO: 911083 - protein, 9 aa, Homo Sapiens
HAAFTGSQD

SEQ ID NO: 911084 - protein, 9 aa, Homo Sapiens
TIVFQKPGA

SEQ ID NO: 911085 - protein, 9 aa, Homo Sapiens
VQGVEVQPL

SEQ ID NO: 911086 - protein, 9 aa, Homo Sapiens
IRHGKTLRR

SEQ ID NO: 911087 - protein, 9 aa, Homo Sapiens
VRIHVSYLD

SEQ ID NO: 911088 - protein, 9 aa, Homo Sapiens
YYSDACSSK

SEQ ID NO: 911089 - protein, 9 aa, Homo Sapiens
SRLQEWGLR

SEQ ID NO: 911090 - protein, 9 aa, Homo Sapiens
KREPGELSG

SEQ ID NO: 911091 - protein, 9 aa, Homo Sapiens
EDEDGAPPA

SEQ ID NO: 911092 - protein, 9 aa, Homo Sapiens
EIMDEKTVV

SEQ ID NO: 911093 - protein, 9 aa, Homo Sapiens
LPEFDRDKS

SEQ ID NO: 911094 - protein, 9 aa, Homo Sapiens
IELLQQYRS

SEQ ID NO: 911095 - protein, 9 aa, Homo Sapiens
STKDYQQYK

SEQ ID NO: 911096 - protein, 9 aa, Homo Sapiens
WISKREPGE

SEQ ID NO: 911097 - protein, 9 aa, Homo Sapiens
LILGEQIEL

SEQ ID NO: 911098 - protein, 9 aa, Homo Sapiens
CSSWGPGSF

SEQ ID NO: 911099 - protein, 9 aa, Homo Sapiens
EDGAPPAEI

SEQ ID NO: 911100 - protein, 9 aa, Homo Sapiens
GSFTRSCGY

SEQ ID NO: 911101 - protein, 9 aa, Homo Sapiens
RIHVSYLDG

SEQ ID NO: 911102 - protein, 9 aa, Homo Sapiens
ETAVRIHVS

SEQ ID NO: 911103 - protein, 9 aa, Homo Sapiens
CLILGEQIE

SEQ ID NO: 911104 - protein, 9 aa, Homo Sapiens
FLISPSSCS

SEQ ID NO: 911105 - protein, 9 aa, Homo Sapiens
FSRSLPEFD

SEQ ID NO: 911106 - protein, 9 aa, Homo Sapiens
GCGLKKLED

SEQ ID NO: 911107 - protein, 9 aa, Homo Sapiens
PSSCSSWGP

SEQ ID NO: 911108 - protein, 9 aa, Homo Sapiens
CGYPTLCSS

SEQ ID NO: 911109 - protein, 9 aa, Homo Sapiens
SLPEFDRDK

SEQ ID NO: 911110 - protein, 9 aa, Homo Sapiens
WGPGSFTRS

SEQ ID NO: 911111 - protein, 9 aa, Homo Sapiens
CLYKGSLGL

SEQ ID NO: 911112 - protein, 9 aa, Homo Sapiens
CAETAVRIH

SEQ ID NO: 911113 - protein, 9 aa, Homo Sapiens
LSGVWTSAW

SEQ ID NO: 911114 - protein, 9 aa, Homo Sapiens
DLCLYKGSL

SEQ ID NO: 911115 - protein, 9 aa, Homo Sapiens
FDRDKSDSD

SEQ ID NO: 911116 - protein, 9 aa, Homo Sapiens
SPLQYPVQG

SEQ ID NO: 911117 - protein, 9 aa, Homo Sapiens
PTLCSSWIS

SEQ ID NO: 911118 - protein, 9 aa, Homo Sapiens
EQIELLQQY

SEQ ID NO: 911119 - protein, 9 aa, Homo Sapiens
VIRHGKTLR

SEQ ID NO: 911120 - protein, 9 aa, Homo Sapiens
RFKPSDGST

SEQ ID NO: 911121 - protein, 9 aa, Homo Sapiens
GELSGVWTS

SEQ ID NO: 911122 - protein, 9 aa, Homo Sapiens
AGLGFLISP

SEQ ID NO: 911123 - protein, 9 aa, Homo Sapiens
KTRSTKDYQ

SEQ ID NO: 911124 - protein, 9 aa, Homo Sapiens
IQKYKEAEK

SEQ ID NO: 911125 - protein, 9 aa, Homo Sapiens
KTLRRTKEE

SEQ ID NO: 911126 - protein, 9 aa, Homo Sapiens
QRPPQKFAG

SEQ ID NO: 911127 - protein, 9 aa, Homo Sapiens
WSRLQEWGL

SEQ ID NO: 911128 - protein, 9 aa, Homo Sapiens
KDYQQYKKD

SEQ ID NO: 911129 - protein, 9 aa, Homo Sapiens
REPGELSGV

SEQ ID NO: 911130 - protein, 9 aa, Homo Sapiens
QEWGLRSQC

SEQ ID NO: 911131 - protein, 9 aa, Homo Sapiens
YPVQGVEVQ

SEQ ID NO: 911132 - protein, 9 aa, Homo Sapiens
RPPQKFAGL

SEQ ID NO: 911133 - protein, 9 aa, Homo Sapiens
FTRSCGYPT

SEQ ID NO: 911134 - protein, 9 aa, Homo Sapiens
SCGYPTLCS

SEQ ID NO: 911135 - protein, 9 aa, Homo Sapiens
PLQYPVQGV

SEQ ID NO: 911136 - protein, 9 aa, Homo Sapiens
YKKLYYSDA

SEQ ID NO: 911137 - protein, 9 aa, Homo Sapiens
RLQEWGLRS

SEQ ID NO: 911138 - protein, 9 aa, Homo Sapiens
LYYSDACSS

SEQ ID NO: 911139 - protein, 9 aa, Homo Sapiens
RKGRFKPSD

SEQ ID NO: 911140 - protein, 9 aa, Homo Sapiens
KKGKERQEG

SEQ ID NO: 911141 - protein, 9 aa, Homo Sapiens
GSQDLCLYK

SEQ ID NO: 911142 - protein, 9 aa, Homo Sapiens
EWGLRSQCE

SEQ ID NO: 911143 - protein, 9 aa, Homo Sapiens
SQDLCLYKG

SEQ ID NO: 911144 - protein, 9 aa, Homo Sapiens
KGKERQEGQ

SEQ ID NO: 911145 - protein, 9 aa, Homo Sapiens
LCLYKGSLG

SEQ ID NO: 911146 - protein, 9 aa, Homo Sapiens
PVQGVEVQP

SEQ ID NO: 911147 - protein, 9 aa, Homo Sapiens
VTIVFQKPG

SEQ ID NO: 911148 - protein, 9 aa, Homo Sapiens
LSSGGGGGT

SEQ ID NO: 911149 - protein, 9 aa, Homo Sapiens
FQKPGALPF

SEQ ID NO: 911150 - protein, 9 aa, Homo Sapiens
GRFKPSDGS

SEQ ID NO: 911151 - protein, 9 aa, Homo Sapiens
APPAEIVIQ

SEQ ID NO: 911152 - protein, 9 aa, Homo Sapiens
IKKKKKKKG

SEQ ID NO: 911153 - protein, 9 aa, Homo Sapiens
PPAEIVIQP

SEQ ID NO: 911154 - protein, 9 aa, Homo Sapiens
GCAETAVRI

SEQ ID NO: 911155 - protein, 9 aa, Homo Sapiens
ATVIRHGKT

SEQ ID NO: 911156 - protein, 9 aa, Homo Sapiens
SWISKREPG

SEQ ID NO: 911157 - protein, 9 aa, Homo Sapiens
EFDRDKSDS

SEQ ID NO: 911158 - protein, 9 aa, Homo Sapiens
KLYYSDACS

SEQ ID NO: 911159 - protein, 9 aa, Homo Sapiens
RQEGQRPPQ

SEQ ID NO: 911160 - protein, 9 aa, Homo Sapiens
SSWISKREP

SEQ ID NO: 911161 - protein, 9 aa, Homo Sapiens
GPGSFTRSC

SEQ ID NO: 911162 - protein, 9 aa, Homo Sapiens
REDEDGAPP

SEQ ID NO: 911163 - protein, 9 aa, Homo Sapiens
SSWGPGSFT

SEQ ID NO: 911164 - protein, 9 aa, Homo Sapiens
KRKGRFKPS

SEQ ID NO: 911165 - protein, 9 aa, Homo Sapiens
TCEIMDEKT

SEQ ID NO: 911166 - protein, 9 aa, Homo Sapiens
LREDEDGAP

SEQ ID NO: 911167 - protein, 9 aa, Homo Sapiens
PEFDRDKSD

SEQ ID NO: 911168 - protein, 9 aa, Homo Sapiens
GYPTLCSSW

SEQ ID NO: 911169 - protein, 9 aa, Homo Sapiens
FTGSQDLCL

SEQ ID NO: 911170 - protein, 9 aa, Homo Sapiens
IYKKLYYSD

SEQ ID NO: 911171 - protein, 9 aa, Homo Sapiens
YKEAEKDCT

SEQ ID NO: 911172 - protein, 9 aa, Homo Sapiens
IVFQKPGAL

SEQ ID NO: 911173 - protein, 9 aa, Homo Sapiens
EPGELSGVW

SEQ ID NO: 911174 - protein, 9 aa, Homo Sapiens
LQYPVQGVE

SEQ ID NO: 911175 - protein, 9 aa, Homo Sapiens
KPSDGSTSS

SEQ ID NO: 911176 - protein, 9 aa, Homo Sapiens
ERQEGQRPP

SEQ ID NO: 911177 - protein, 9 aa, Homo Sapiens
QKPGALPFT

SEQ ID NO: 911178 - protein, 9 aa, Homo Sapiens
PGELSGVWT

SEQ ID NO: 911179 - protein, 9 aa, Homo Sapiens
TNPTCEIMD

SEQ ID NO: 911180 - protein, 9 aa, Homo Sapiens
LGEQIELLQ

SEQ ID NO: 911181 - protein, 9 aa, Homo Sapiens
SFTRSCGYP

SEQ ID NO: 911182 - protein, 9 aa, Homo Sapiens
QEGQRPPQK

SEQ ID NO: 911183 - protein, 9 aa, Homo Sapiens
KYKEAEKDC

SEQ ID NO: 911184 - protein, 9 aa, Homo Sapiens
ELLQQYRSA

SEQ ID NO: 911185 - protein, 9 aa, Homo Sapiens
AETAVRIHV

SEQ ID NO: 911186 - protein, 9 aa, Homo Sapiens
SRSLPEFDR

SEQ ID NO: 911187 - protein, 9 aa, Homo Sapiens
SKRKGRFKP

SEQ ID NO: 911188 - protein, 9 aa, Homo Sapiens
VWTSAWRTH

SEQ ID NO: 911189 - protein, 9 aa, Homo Sapiens
KFAGLGFLI

SEQ ID NO: 911190 - protein, 9 aa, Homo Sapiens
TAVRIHVSY

SEQ ID NO: 911191 - protein, 9 aa, Homo Sapiens
DGAPPAEIV

SEQ ID NO: 911192 - protein, 9 aa, Homo Sapiens
PGSFTRSCG

SEQ ID NO: 911193 - protein, 9 aa, Homo Sapiens
YSDACSSKA

SEQ ID NO: 911194 - protein, 9 aa, Homo Sapiens
PPQKFAGLG

SEQ ID NO: 911195 - protein, 9 aa, Homo Sapiens
ELSGVWTSA

SEQ ID NO: 911196 - protein, 9 aa, Homo Sapiens
KIQKYKEAE

SEQ ID NO: 911197 - protein, 9 aa, Homo Sapiens
MGCGLKKLE

SEQ ID NO: 911198 - protein, 9 aa, Homo Sapiens
TKDYQQYKK

SEQ ID NO: 911199 - protein, 9 aa, Homo Sapiens
ISPSSCSSW

SEQ ID NO: 911200 - protein, 9 aa, Homo Sapiens
LYKGSLGLH

SEQ ID NO: 911201 - protein, 9 aa, Homo Sapiens
IVTIVFQKP

SEQ ID NO: 911202 - protein, 9 aa, Homo Sapiens
KKLEDPDDS

SEQ ID NO: 911203 - protein, 9 aa, Homo Sapiens
GAPPAEIVI

SEQ ID NO: 911204 - protein, 9 aa, Homo Sapiens
TGSQDLCLY

SEQ ID NO: 911205 - protein, 9 aa, Homo Sapiens
AWRTHAAFT

SEQ ID NO: 911206 - protein, 9 aa, Homo Sapiens
SWGPGSFTR

SEQ ID NO: 911207 - protein, 9 aa, Homo Sapiens
SGGGGGTKY

SEQ ID NO: 911208 - protein, 9 aa, Homo Sapiens
KPGALPFTP

SEQ ID NO: 911209 - protein, 9 aa, Homo Sapiens
LISPSSCSS

SEQ ID NO: 911210 - protein, 9 aa, Homo Sapiens
QDLCLYKGS

SEQ ID NO: 911211 - protein, 9 aa, Homo Sapiens
RHGKTLRRT

SEQ ID NO: 911212 - protein, 9 aa, Homo Sapiens
WRTHAAFTG

SEQ ID NO: 911213 - protein, 9 aa, Homo Sapiens
ISKREPGEL

SEQ ID NO: 911214 - protein, 9 aa, Homo Sapiens
LKKLEDPDD

SEQ ID NO: 911215 - protein, 9 aa, Homo Sapiens
AFTGSQDLC

SEQ ID NO: 911216 - protein, 9 aa, Homo Sapiens
WTSAWRTHA

SEQ ID NO: 911217 - protein, 9 aa, Homo Sapiens
LCSSWISKR

SEQ ID NO: 911218 - protein, 9 aa, Homo Sapiens
SPSSCSSWG

SEQ ID NO: 911219 - protein, 9 aa, Homo Sapiens
VDIYKKLYY

SEQ ID NO: 911220 - protein, 9 aa, Homo Sapiens
SGVWTSAWR

SEQ ID NO: 911221 - protein, 9 aa, Homo Sapiens
PQKFAGLGF

SEQ ID NO: 911222 - protein, 9 aa, Homo Sapiens
TSAWRTHAA

SEQ ID NO: 911223 - protein, 9 aa, Homo Sapiens
AYLKIQKYK

SEQ ID NO: 911224 - protein, 9 aa, Homo Sapiens
LSARSKDPE

SEQ ID NO: 911225 - protein, 9 aa, Homo Sapiens
LKIQKYKEA

SEQ ID NO: 911226 - protein, 9 aa, Homo Sapiens
CGLKKLEDP

SEQ ID NO: 911227 - protein, 9 aa, Homo Sapiens
CSSWISKRE

SEQ ID NO: 911228 - protein, 9 aa, Homo Sapiens
DEDGAPPAE

SEQ ID NO: 911229 - protein, 9 aa, Homo Sapiens
KKKGKERQE

SEQ ID NO: 911230 - protein, 9 aa, Homo Sapiens
WGLRSQCEC

SEQ ID NO: 911231 - protein, 9 aa, Homo Sapiens
RSLPEFDRD

SEQ ID NO: 911232 - protein, 9 aa, Homo Sapiens
KKKKKGKER

SEQ ID NO: 911233 - protein, 9 aa, Homo Sapiens
FAGLGFLIS

SEQ ID NO: 911234 - protein, 9 aa, Homo Sapiens
TRSCGYPTL

SEQ ID NO: 911235 - protein, 9 aa, Homo Sapiens
KKKKGKERQ

SEQ ID NO: 911236 - protein, 9 aa, Homo Sapiens
KATVIRHGK

SEQ ID NO: 911237 - protein, 9 aa, Homo Sapiens
AAFTGSQDL

SEQ ID NO: 911238 - protein, 9 aa, Homo Sapiens
RSTKDYQQY

SEQ ID NO: 911239 - protein, 9 aa, Homo Sapiens
GKTLRRTKE

SEQ ID NO: 911240 - protein, 9 aa, Homo Sapiens
TLCSSWISK

SEQ ID NO: 911241 - protein, 9 aa, Homo Sapiens
FTNPTCEIM

SEQ ID NO: 911242 - protein, 9 aa, Homo Sapiens
AAKARLELI

SEQ ID NO: 911243 - protein, 9 aa, Homo Sapiens
IHVSYLDGK

SEQ ID NO: 911244 - protein, 9 aa, Homo Sapiens
EGQRPPQKF

SEQ ID NO: 911245 - protein, 9 aa, Homo Sapiens
QIELLQQYR

SEQ ID NO: 911246 - protein, 9 aa, Homo Sapiens
NSPLQYPVQ

SEQ ID NO: 911247 - protein, 9 aa, Homo Sapiens
GEQIELLQQ

SEQ ID NO: 911248 - protein, 9 aa, Homo Sapiens
RSCGYPTLC

SEQ ID NO: 911249 - protein, 9 aa, Homo Sapiens
SSGGGGGTK

SEQ ID NO: 911250 - protein, 9 aa, Homo Sapiens
ANSPLQYPV

SEQ ID NO: 911251 - protein, 9 aa, Homo Sapiens
PTCEIMDEK

SEQ ID NO: 911252 - protein, 9 aa, Homo Sapiens
QKFAGLGFL

SEQ ID NO: 911253 - protein, 9 aa, Homo Sapiens
AKTRSTKDY

SEQ ID NO: 911254 - protein, 9 aa, Homo Sapiens
QYPVQGVEV

SEQ ID NO: 911255 - protein, 9 aa, Homo Sapiens
AVRIHVSYL

SEQ ID NO: 911256 - protein, 9 aa, Homo Sapiens
SAWRTHAAF

SEQ ID NO: 911257 - protein, 9 aa, Homo Sapiens
GKERQEGQR

SEQ ID NO: 911258 - protein, 9 aa, Homo Sapiens
MDEKTVVVH

SEQ ID NO: 911259 - protein, 9 aa, Homo Sapiens
LQEWGLRSQ

SEQ ID NO: 911260 - protein, 9 aa, Homo Sapiens
SKREPGELS

SEQ ID NO: 911261 - protein, 9 aa, Homo Sapiens
THAAFTGSQ

SEQ ID NO: 911262 - protein, 9 aa, Homo Sapiens
KPEEEEEEL

SEQ ID NO: 911263 - protein, 9 aa, Homo Sapiens
GVWTSAWRT

SEQ ID NO: 911264 - protein, 9 aa, Homo Sapiens
DIVTIVFQK

SEQ ID NO: 911265 - protein, 9 aa, Homo Sapiens
VFQKPGALP

SEQ ID NO: 911266 - protein, 9 aa, Homo Sapiens
TRSTKDYQQ

SEQ ID NO: 911267 - protein, 9 aa, Homo Sapiens
DFSRSLPEF

SEQ ID NO: 911268 - protein, 9 aa, Homo Sapiens
AKARLELIG

SEQ ID NO: 911269 - protein, 9 aa, Homo Sapiens
ILGEQIELL

SEQ ID NO: 911270 - protein, 9 aa, Homo Sapiens
PSDGSTSSD

SEQ ID NO: 911271 - protein, 9 aa, Homo Sapiens
YKGSLGLHI

SEQ ID NO: 911272 - protein, 9 aa, Homo Sapiens
RTHAAFTGS

SEQ ID NO: 911273 - protein, 9 aa, Homo Sapiens
QKYKEAEKD

SEQ ID NO: 911274 - protein, 9 aa, Homo Sapiens
TVIRHGKTL

SEQ ID NO: 911275 - protein, 9 aa, Homo Sapiens
GLGFLISPS

SEQ ID NO: 911276 - protein, 9 aa, Homo Sapiens
SIWSRLQEW

SEQ ID NO: 911277 - protein, 9 aa, Homo Sapiens
NPTCEIMDE

SEQ ID NO: 911278 - protein, 9 aa, Homo Sapiens
GLKKLEDPD

SEQ ID NO: 911279 - protein, 9 aa, Homo Sapiens
KERQEGQRP

SEQ ID NO: 911280 - protein, 9 aa, Homo Sapiens
SSCSSWGPG

SEQ ID NO: 911281 - protein, 9 aa, Homo Sapiens
CEIMDEKTV

SEQ ID NO: 911282 - protein, 9 aa, Homo Sapiens
KKLYYSDAC

SEQ ID NO: 911283 - protein, 9 aa, Homo Sapiens
YQQYKKDQN

SEQ ID NO: 911284 - protein, 9 aa, Homo Sapiens
KEAEKDCTQ

SEQ ID NO: 911285 - protein, 9 aa, Homo Sapiens
KGRFKPSDG

SEQ ID NO: 911286 - protein, 9 aa, Homo Sapiens
IMDEKTVVV

SEQ ID NO: 911287 - protein, 9 aa, Homo Sapiens
YPTLCSSWI

SEQ ID NO: 911288 - protein, 9 aa, Homo Sapiens
HGKTLRRTK

SEQ ID NO: 911289 - protein, 9 aa, Homo Sapiens
YLKIQKYKE

SEQ ID NO: 911290 - protein, 9 aa, Homo Sapiens
DYQQYKKDQ

SEQ ID NO: 911291 - protein, 9 aa, Homo Sapiens
LLSARSKDP

SEQ ID NO: 911292 - protein, 9 aa, Homo Sapiens
GQRPPQKFA

SEQ ID NO: 911293 - protein, 9 aa, Homo Sapiens
FKPSDGSTS

SEQ ID NO: 911294 - protein, 9 aa, Homo Sapiens
SCSSWGPGS

SEQ ID NO: 911295 - protein, 9 aa, Homo Sapiens
LGFLISPSS

SEQ ID NO: 911296 - protein, 9 aa, Homo Sapiens
IWSRLQEWG

SEQ ID NO: 911297 - protein, 9 aa, Homo Sapiens
GFLISPSSC

SEQ ID NO: 911298 - protein, 9 aa, Homo Sapiens
ADFIRLDPR

SEQ ID NO: 911299 - protein, 9 aa, Homo Sapiens
ELGWMANPA

SEQ ID NO: 911300 - protein, 9 aa, Homo Sapiens
LTQHLKGGE

SEQ ID NO: 911301 - protein, 9 aa, Homo Sapiens
VFEQIIELL

SEQ ID NO: 911302 - protein, 9 aa, Homo Sapiens
LEPIKEYRW

SEQ ID NO: 911303 - protein, 9 aa, Homo Sapiens
MILYILLCG

SEQ ID NO: 911304 - protein, 9 aa, Homo Sapiens
ADMSEVHSV

SEQ ID NO: 911305 - protein, 9 aa, Homo Sapiens
CTTTNAFLH

SEQ ID NO: 911306 - protein, 9 aa, Homo Sapiens
ALHSLDGAA

SEQ ID NO: 911307 - protein, 9 aa, Homo Sapiens
EVHSVGSNG

SEQ ID NO: 911308 - protein, 9 aa, Homo Sapiens
HLKGGEAGG

SEQ ID NO: 911309 - protein, 9 aa, Homo Sapiens
TSKKLRRKE

SEQ ID NO: 911310 - protein, 9 aa, Homo Sapiens
GWRLRAASI

SEQ ID NO: 911311 - protein, 9 aa, Homo Sapiens
EEFADMSEV

SEQ ID NO: 911312 - protein, 9 aa, Homo Sapiens
VDMWAAGMI

SEQ ID NO: 911313 - protein, 9 aa, Homo Sapiens
RAMLTQHLK

SEQ ID NO: 911314 - protein, 9 aa, Homo Sapiens
GKMETKRHP

SEQ ID NO: 911315 - protein, 9 aa, Homo Sapiens
HEYLLESRD

SEQ ID NO: 911316 - protein, 9 aa, Homo Sapiens
FFFFSLFFF

SEQ ID NO: 911317 - protein, 9 aa, Homo Sapiens
ERLHQIEEQ

SEQ ID NO: 911318 - protein, 9 aa, Homo Sapiens
DEEIPVVIC

SEQ ID NO: 911319 - protein, 9 aa, Homo Sapiens
AASRADFVA

SEQ ID NO: 911320 - protein, 9 aa, Homo Sapiens
QFFFFFSLF

SEQ ID NO: 911321 - protein, 9 aa, Homo Sapiens
VMEVTPLPS

SEQ ID NO: 911322 - protein, 9 aa, Homo Sapiens
TAELGWMAN

SEQ ID NO: 911323 - protein, 9 aa, Homo Sapiens
HVADFIRLD

SEQ ID NO: 911324 - protein, 9 aa, Homo Sapiens
PTHSEPAME

SEQ ID NO: 911325 - protein, 9 aa, Homo Sapiens
KGGEAGGWR

SEQ ID NO: 911326 - protein, 9 aa, Homo Sapiens
LGWMANPAS

SEQ ID NO: 911327 - protein, 9 aa, Homo Sapiens
GWMANPASG

SEQ ID NO: 911328 - protein, 9 aa, Homo Sapiens
PQSLPTHSE

SEQ ID NO: 911329 - protein, 9 aa, Homo Sapiens
EKVMEVTPL

SEQ ID NO: 911330 - protein, 9 aa, Homo Sapiens
MLAALFVRE

SEQ ID NO: 911331 - protein, 9 aa, Homo Sapiens
MCIWRAMLT

SEQ ID NO: 911332 - protein, 9 aa, Homo Sapiens
KHRQARNWT

SEQ ID NO: 911333 - protein, 9 aa, Homo Sapiens
TPEELDEEI

SEQ ID NO: 911334 - protein, 9 aa, Homo Sapiens
FFSLFFFLR

SEQ ID NO: 911335 - protein, 9 aa, Homo Sapiens
RLDPRIAAW

SEQ ID NO: 911336 - protein, 9 aa, Homo Sapiens
ICTTTNAFL

SEQ ID NO: 911337 - protein, 9 aa, Homo Sapiens
SIVATIGPA

SEQ ID NO: 911338 - protein, 9 aa, Homo Sapiens
HVFEQIIEL

SEQ ID NO: 911339 - protein, 9 aa, Homo Sapiens
KKLRRKELL

SEQ ID NO: 911340 - protein, 9 aa, Homo Sapiens
ARSTSIVAT

SEQ ID NO: 911341 - protein, 9 aa, Homo Sapiens
ILKIQLQDA

SEQ ID NO: 911342 - protein, 9 aa, Homo Sapiens
HPTKQQKTS

SEQ ID NO: 911343 - protein, 9 aa, Homo Sapiens
ALLLSTCIK

SEQ ID NO: 911344 - protein, 9 aa, Homo Sapiens
IRSGVKPWK

SEQ ID NO: 911345 - protein, 9 aa, Homo Sapiens
LDGAASRAD

SEQ ID NO: 911346 - protein, 9 aa, Homo Sapiens
TSIVATIGP

SEQ ID NO: 911347 - protein, 9 aa, Homo Sapiens
PEELDEEIP

SEQ ID NO: 911348 - protein, 9 aa, Homo Sapiens
MLTQHLKGG

SEQ ID NO: 911349 - protein, 9 aa, Homo Sapiens
FPQSLPTHS

SEQ ID NO: 911350 - protein, 9 aa, Homo Sapiens
VNKLHEYLL

SEQ ID NO: 911351 - protein, 9 aa, Homo Sapiens
WKFIRDFLQ

SEQ ID NO: 911352 - protein, 9 aa, Homo Sapiens
IGGFAVVEY

SEQ ID NO: 911353 - protein, 9 aa, Homo Sapiens
QDEGSYIGG

SEQ ID NO: 911354 - protein, 9 aa, Homo Sapiens
AEKHRQARN

SEQ ID NO: 911355 - protein, 9 aa, Homo Sapiens
GGEAGGWRL

SEQ ID NO: 911356 - protein, 9 aa, Homo Sapiens
YRWEGPRGP

SEQ ID NO: 911357 - protein, 9 aa, Homo Sapiens
KSNKQLGKM

SEQ ID NO: 911358 - protein, 9 aa, Homo Sapiens
TAYWTNFAK

SEQ ID NO: 911359 - protein, 9 aa, Homo Sapiens
RHPTKQQKT

SEQ ID NO: 911360 - protein, 9 aa, Homo Sapiens
AMTAYWTNF

SEQ ID NO: 911361 - protein, 9 aa, Homo Sapiens
SICTTTNAF

SEQ ID NO: 911362 - protein, 9 aa, Homo Sapiens
FADMSEVHS

SEQ ID NO: 911363 - protein, 9 aa, Homo Sapiens
IRLDPRIAA

SEQ ID NO: 911364 - protein, 9 aa, Homo Sapiens
TQHLKGGEA

SEQ ID NO: 911365 - protein, 9 aa, Homo Sapiens
AEKVMEVTP

SEQ ID NO: 911366 - protein, 9 aa, Homo Sapiens
VADFIRLDP

SEQ ID NO: 911367 - protein, 9 aa, Homo Sapiens
AELGWMANP

SEQ ID NO: 911368 - protein, 9 aa, Homo Sapiens
FGFPQSLPT

SEQ ID NO: 911369 - protein, 9 aa, Homo Sapiens
RARAEKVME

SEQ ID NO: 911370 - protein, 9 aa, Homo Sapiens
TTTNAFLHF

SEQ ID NO: 911371 - protein, 9 aa, Homo Sapiens
AQDEGSYIG

SEQ ID NO: 911372 - protein, 9 aa, Homo Sapiens
TVSKAMTAY

SEQ ID NO: 911373 - protein, 9 aa, Homo Sapiens
FIRLDPRIA

SEQ ID NO: 911374 - protein, 9 aa, Homo Sapiens
FEPMLAALF

SEQ ID NO: 911375 - protein, 9 aa, Homo Sapiens
GVKPWKAVR

SEQ ID NO: 911376 - protein, 9 aa, Homo Sapiens
IKAHVFEQI

SEQ ID NO: 911377 - protein, 9 aa, Homo Sapiens
EGSYIGGFA

SEQ ID NO: 911378 - protein, 9 aa, Homo Sapiens
LHSLDGAAS

SEQ ID NO: 911379 - protein, 9 aa, Homo Sapiens
IVATIGPAS

SEQ ID NO: 911380 - protein, 9 aa, Homo Sapiens
LKGGEAGGW

SEQ ID NO: 911381 - protein, 9 aa, Homo Sapiens
HQIEEQKAL

SEQ ID NO: 911382 - protein, 9 aa, Homo Sapiens
STSIVATIG

SEQ ID NO: 911383 - protein, 9 aa, Homo Sapiens
APGPVDASI

SEQ ID NO: 911384 - protein, 9 aa, Homo Sapiens
MEILKIQLQ

SEQ ID NO: 911385 - protein, 9 aa, Homo Sapiens
WMANPASGW

SEQ ID NO: 911386 - protein, 9 aa, Homo Sapiens
YMCIWRAML

SEQ ID NO: 911387 - protein, 9 aa, Homo Sapiens
LSTCIKFVN

SEQ ID NO: 911388 - protein, 9 aa, Homo Sapiens
VKPWKAVRV

SEQ ID NO: 911389 - protein, 9 aa, Homo Sapiens
ATAELGWMA

SEQ ID NO: 911390 - protein, 9 aa, Homo Sapiens
TKRHPTKQQ

SEQ ID NO: 911391 - protein, 9 aa, Homo Sapiens
SNKQLGKME

SEQ ID NO: 911392 - protein, 9 aa, Homo Sapiens
GSYIGGFAV

SEQ ID NO: 911393 - protein, 9 aa, Homo Sapiens
SIICPSTSS

SEQ ID NO: 911394 - protein, 9 aa, Homo Sapiens
SKAMTAYWT

SEQ ID NO: 911395 - protein, 9 aa, Homo Sapiens
SPQAEKHRQ

SEQ ID NO: 911396 - protein, 9 aa, Homo Sapiens
EVDMWAAGM

SEQ ID NO: 911397 - protein, 9 aa, Homo Sapiens
LAFRRYMCI

SEQ ID NO: 911398 - protein, 9 aa, Homo Sapiens
LLLSTCIKF

SEQ ID NO: 911399 - protein, 9 aa, Homo Sapiens
KLHEYLLES

SEQ ID NO: 911400 - protein, 9 aa, Homo Sapiens
LLSTCIKFV

SEQ ID NO: 911401 - protein, 9 aa, Homo Sapiens
LAQDEGSYI

SEQ ID NO: 911402 - protein, 9 aa, Homo Sapiens
RSGVKPWKA

SEQ ID NO: 911403 - protein, 9 aa, Homo Sapiens
IICPSTSSL

SEQ ID NO: 911404 - protein, 9 aa, Homo Sapiens
KAMTAYWTN

SEQ ID NO: 911405 - protein, 9 aa, Homo Sapiens
NAFLHFFFL

SEQ ID NO: 911406 - protein, 9 aa, Homo Sapiens
MTAYWTNFA

SEQ ID NO: 911407 - protein, 9 aa, Homo Sapiens
RALLLSTCI

SEQ ID NO: 911408 - protein, 9 aa, Homo Sapiens
TGTFFEPML

SEQ ID NO: 911409 - protein, 9 aa, Homo Sapiens
TKQQKTSKK

SEQ ID NO: 911410 - protein, 9 aa, Homo Sapiens
QHLKGGEAG

SEQ ID NO: 911411 - protein, 9 aa, Homo Sapiens
RRYMCIWRA

SEQ ID NO: 911412 - protein, 9 aa, Homo Sapiens
KQLGKMETK

SEQ ID NO: 911413 - protein, 9 aa, Homo Sapiens
CIKFVNLFP

SEQ ID NO: 911414 - protein, 9 aa, Homo Sapiens
LHQIEEQKA

SEQ ID NO: 911415 - protein, 9 aa, Homo Sapiens
WKHVADFIR

SEQ ID NO: 911416 - protein, 9 aa, Homo Sapiens
FFFFFSLFF

SEQ ID NO: 911417 - protein, 9 aa, Homo Sapiens
KRARAEKVM

SEQ ID NO: 911418 - protein, 9 aa, Homo Sapiens
EPMLAALFV

SEQ ID NO: 911419 - protein, 9 aa, Homo Sapiens
SRARERLHQ

SEQ ID NO: 911420 - protein, 9 aa, Homo Sapiens
DFIRLDPRI

SEQ ID NO: 911421 - protein, 9 aa, Homo Sapiens
LLAFRRYMC

SEQ ID NO: 911422 - protein, 9 aa, Homo Sapiens
GGWRLRAAS

SEQ ID NO: 911423 - protein, 9 aa, Homo Sapiens
WAAGMILYI

SEQ ID NO: 911424 - protein, 9 aa, Homo Sapiens
DASIICPST

SEQ ID NO: 911425 - protein, 9 aa, Homo Sapiens
AGMILYILL

SEQ ID NO: 911426 - protein, 9 aa, Homo Sapiens
VVVTCPMEI

SEQ ID NO: 911427 - protein, 9 aa, Homo Sapiens
RARERLHQI

SEQ ID NO: 911428 - protein, 9 aa, Homo Sapiens
ESETPEELD

SEQ ID NO: 911429 - protein, 9 aa, Homo Sapiens
METKRHPTK

SEQ ID NO: 911430 - protein, 9 aa, Homo Sapiens
GFPQSLPTH

SEQ ID NO: 911431 - protein, 9 aa, Homo Sapiens
QAEKHRQAR

SEQ ID NO: 911432 - protein, 9 aa, Homo Sapiens
VATIGPASR

SEQ ID NO: 911433 - protein, 9 aa, Homo Sapiens
SYIGGFAVV

SEQ ID NO: 911434 - protein, 9 aa, Homo Sapiens
RERLHQIEE

SEQ ID NO: 911435 - protein, 9 aa, Homo Sapiens
PTKQQKTSK

SEQ ID NO: 911436 - protein, 9 aa, Homo Sapiens
RTVSKAMTA

SEQ ID NO: 911437 - protein, 9 aa, Homo Sapiens
KAHVFEQII

SEQ ID NO: 911438 - protein, 9 aa, Homo Sapiens
FFEPMLAAL

SEQ ID NO: 911439 - protein, 9 aa, Homo Sapiens
YIGGFAVVE

SEQ ID NO: 911440 - protein, 9 aa, Homo Sapiens
SETPEELDE

SEQ ID NO: 911441 - protein, 9 aa, Homo Sapiens
PMLAALFVR

SEQ ID NO: 911442 - protein, 9 aa, Homo Sapiens
MWAAGMILY

SEQ ID NO: 911443 - protein, 9 aa, Homo Sapiens
ELDEEIPVV

SEQ ID NO: 911444 - protein, 9 aa, Homo Sapiens
TRALLLSTC

SEQ ID NO: 911445 - protein, 9 aa, Homo Sapiens
KEYRWEGPR

SEQ ID NO: 911446 - protein, 9 aa, Homo Sapiens
QKTSKKLRR

SEQ ID NO: 911447 - protein, 9 aa, Homo Sapiens
SLFFFLRRS

SEQ ID NO: 911448 - protein, 9 aa, Homo Sapiens
EPIKEYRWE

SEQ ID NO: 911449 - protein, 9 aa, Homo Sapiens
FSLFFFLRR

SEQ ID NO: 911450 - protein, 9 aa, Homo Sapiens
EILKIQLQD

SEQ ID NO: 911451 - protein, 9 aa, Homo Sapiens
ETPEELDEE

SEQ ID NO: 911452 - protein, 9 aa, Homo Sapiens
KLRRKELLL

SEQ ID NO: 911453 - protein, 9 aa, Homo Sapiens
ETGTFFEPM

SEQ ID NO: 911454 - protein, 9 aa, Homo Sapiens
FFFSLFFFL

SEQ ID NO: 911455 - protein, 9 aa, Homo Sapiens
EYRWEGPRG

SEQ ID NO: 911456 - protein, 9 aa, Homo Sapiens
DSRARERLH

SEQ ID NO: 911457 - protein, 9 aa, Homo Sapiens
QQKTSKKLR

SEQ ID NO: 911458 - protein, 9 aa, Homo Sapiens
GPVDASIIC

SEQ ID NO: 911459 - protein, 9 aa, Homo Sapiens
FEQIIELLS

SEQ ID NO: 911460 - protein, 9 aa, Homo Sapiens
LGKMETKRH

SEQ ID NO: 911461 - protein, 9 aa, Homo Sapiens
PMEILKIQL

SEQ ID NO: 911462 - protein, 9 aa, Homo Sapiens
YLLESRDKN

SEQ ID NO: 911463 - protein, 9 aa, Homo Sapiens
AFRRYMCIW

SEQ ID NO: 911464 - protein, 9 aa, Homo Sapiens
NKLHEYLLE

SEQ ID NO: 911465 - protein, 9 aa, Homo Sapiens
VAARSTSIV

SEQ ID NO: 911466 - protein, 9 aa, Homo Sapiens
KTSKKLRRK

SEQ ID NO: 911467 - protein, 9 aa, Homo Sapiens
LHEYLLESR

SEQ ID NO: 911468 - protein, 9 aa, Homo Sapiens
RAEKVMEVT

SEQ ID NO: 911469 - protein, 9 aa, Homo Sapiens
SKKLRRKEL

SEQ ID NO: 911470 - protein, 9 aa, Homo Sapiens
IWRAMLTQH

SEQ ID NO: 911471 - protein, 9 aa, Homo Sapiens
LDEEIPVVI

SEQ ID NO: 911472 - protein, 9 aa, Homo Sapiens
HRQARNWTD

SEQ ID NO: 911473 - protein, 9 aa, Homo Sapiens
ASRADFVAL

SEQ ID NO: 911474 - protein, 9 aa, Homo Sapiens
LLSIKAHVF

SEQ ID NO: 911475 - protein, 9 aa, Homo Sapiens
CIWRAMLTQ

SEQ ID NO: 911476 - protein, 9 aa, Homo Sapiens
EFADMSEVH

SEQ ID NO: 911477 - protein, 9 aa, Homo Sapiens
IIRSGVKPW

SEQ ID NO: 911478 - protein, 9 aa, Homo Sapiens
DMSEVHSVG

SEQ ID NO: 911479 - protein, 9 aa, Homo Sapiens
WRAMLTQHL

SEQ ID NO: 911480 - protein, 9 aa, Homo Sapiens
GQQFFFFFS

SEQ ID NO: 911481 - protein, 9 aa, Homo Sapiens
SLPTHSEPA

SEQ ID NO: 911482 - protein, 9 aa, Homo Sapiens
LSIKAHVFE

SEQ ID NO: 911483 - protein, 9 aa, Homo Sapiens
QSLPTHSEP

SEQ ID NO: 911484 - protein, 9 aa, Homo Sapiens
MANPASGWE

SEQ ID NO: 911485 - protein, 9 aa, Homo Sapiens
ASIICPSTS

SEQ ID NO: 911486 - protein, 9 aa, Homo Sapiens
PQAEKHRQA

SEQ ID NO: 911487 - protein, 9 aa, Homo Sapiens
AAGMILYIL

SEQ ID NO: 911488 - protein, 9 aa, Homo Sapiens
EKHRQARNW

SEQ ID NO: 911489 - protein, 9 aa, Homo Sapiens
KEEFADMSE

SEQ ID NO: 911490 - protein, 9 aa, Homo Sapiens
NKQLGKMET

SEQ ID NO: 911491 - protein, 9 aa, Homo Sapiens
IKEYRWEGP

SEQ ID NO: 911492 - protein, 9 aa, Homo Sapiens
AHVFEQIIE

SEQ ID NO: 911493 - protein, 9 aa, Homo Sapiens
FRRYMCIWR

SEQ ID NO: 911494 - protein, 9 aa, Homo Sapiens
GTFFEPMLA

SEQ ID NO: 911495 - protein, 9 aa, Homo Sapiens
DEGSYIGGF

SEQ ID NO: 911496 - protein, 9 aa, Homo Sapiens
ARERLHQIE

SEQ ID NO: 911497 - protein, 9 aa, Homo Sapiens
SGVKPWKAV

SEQ ID NO: 911498 - protein, 9 aa, Homo Sapiens
KVMEVTPLP

SEQ ID NO: 911499 - protein, 9 aa, Homo Sapiens
HSLDGAASR

SEQ ID NO: 911500 - protein, 9 aa, Homo Sapiens
CPMEILKIQ

SEQ ID NO: 911501 - protein, 9 aa, Homo Sapiens
KMETKRHPT

SEQ ID NO: 911502 - protein, 9 aa, Homo Sapiens
PWKAVRVLL

SEQ ID NO: 911503 - protein, 9 aa, Homo Sapiens
LESRDKNAL

SEQ ID NO: 911504 - protein, 9 aa, Homo Sapiens
AMLTQHLKG

SEQ ID NO: 911505 - protein, 9 aa, Homo Sapiens
TNAFLHFFF

SEQ ID NO: 911506 - protein, 9 aa, Homo Sapiens
LPTHSEPAM

SEQ ID NO: 911507 - protein, 9 aa, Homo Sapiens
GMILYILLC

SEQ ID NO: 911508 - protein, 9 aa, Homo Sapiens
AARSTSIVA

SEQ ID NO: 911509 - protein, 9 aa, Homo Sapiens
KFIRDFLQW

SEQ ID NO: 911510 - protein, 9 aa, Homo Sapiens
ARAEKVMEV

SEQ ID NO: 911511 - protein, 9 aa, Homo Sapiens
QARNWTDAE

SEQ ID NO: 911512 - protein, 9 aa, Homo Sapiens
GEAGGWRLR

SEQ ID NO: 911513 - protein, 9 aa, Homo Sapiens
DMWAAGMIL

SEQ ID NO: 911514 - protein, 9 aa, Homo Sapiens
PIKEYRWEG

SEQ ID NO: 911515 - protein, 9 aa, Homo Sapiens
MSEVHSVGS

SEQ ID NO: 911516 - protein, 9 aa, Homo Sapiens
KSICTTTNA

SEQ ID NO: 911517 - protein, 9 aa, Homo Sapiens
KQQKTSKKL

SEQ ID NO: 911518 - protein, 9 aa, Homo Sapiens
STCIKFVNL

SEQ ID NO: 911519 - protein, 9 aa, Homo Sapiens
RYMCIWRAM

SEQ ID NO: 911520 - protein, 9 aa, Homo Sapiens
VDASIICPS

SEQ ID NO: 911521 - protein, 9 aa, Homo Sapiens
NKSICTTTN

SEQ ID NO: 911522 - protein, 9 aa, Homo Sapiens
DLLAFRRYM

SEQ ID NO: 911523 - protein, 9 aa, Homo Sapiens
VSKAMTAYW

SEQ ID NO: 911524 - protein, 9 aa, Homo Sapiens
TFFEPMLAA

SEQ ID NO: 911525 - protein, 9 aa, Homo Sapiens
GLDAPLFGV

SEQ ID NO: 911526 - protein, 9 aa, Homo Sapiens
SLDGAASRA

SEQ ID NO: 911527 - protein, 9 aa, Homo Sapiens
KHVADFIRL

SEQ ID NO: 911528 - protein, 9 aa, Homo Sapiens
EAGGWRLRA

SEQ ID NO: 911529 - protein, 9 aa, Homo Sapiens
PGPVDASII

SEQ ID NO: 911530 - protein, 9 aa, Homo Sapiens
TCPMEILKI

SEQ ID NO: 911531 - protein, 9 aa, Homo Sapiens
RQARNWTDA

SEQ ID NO: 911532 - protein, 9 aa, Homo Sapiens
RLHQIEEQK

SEQ ID NO: 911533 - protein, 9 aa, Homo Sapiens
VTCPMEILK

SEQ ID NO: 911534 - protein, 9 aa, Homo Sapiens
TTNAFLHFF

SEQ ID NO: 911535 - protein, 9 aa, Homo Sapiens
SIKAHVFEQ

SEQ ID NO: 911536 - protein, 9 aa, Homo Sapiens
LLESRDKNA

SEQ ID NO: 911537 - protein, 9 aa, Homo Sapiens
TCIKFVNLF

SEQ ID NO: 911538 - protein, 9 aa, Homo Sapiens
MKRARAEKV

SEQ ID NO: 911539 - protein, 9 aa, Homo Sapiens
QQFFFFFSL

SEQ ID NO: 911540 - protein, 9 aa, Homo Sapiens
ETKRHPTKQ

SEQ ID NO: 911541 - protein, 9 aa, Homo Sapiens
DRTVSKAMT

SEQ ID NO: 911542 - protein, 9 aa, Homo Sapiens
RSTSIVATI

SEQ ID NO: 911543 - protein, 9 aa, Homo Sapiens
SEVHSVGSN

SEQ ID NO: 911544 - protein, 9 aa, Homo Sapiens
QLGKMETKR

SEQ ID NO: 911545 - protein, 9 aa, Homo Sapiens
AGGWRLRAA

SEQ ID NO: 911546 - protein, 9 aa, Homo Sapiens
KPWKAVRVL

SEQ ID NO: 911547 - protein, 9 aa, Homo Sapiens
WKAVRVLLN

SEQ ID NO: 911548 - protein, 9 aa, Homo Sapiens
VVTCPMEIL

SEQ ID NO: 911549 - protein, 9 aa, Homo Sapiens
KRHPTKQQK

SEQ ID NO: 911550 - protein, 9 aa, Homo Sapiens
DGAASRADF

SEQ ID NO: 911551 - protein, 9 aa, Homo Sapiens
GAASRADFV

SEQ ID NO: 911552 - protein, 9 aa, Homo Sapiens
RWEGPRGPH

SEQ ID NO: 911553 - protein, 9 aa, Homo Sapiens
PVDASIICP

SEQ ID NO: 911554 - protein, 9 aa, Homo Sapiens
WEGPRGPHL

SEQ ID NO: 911555 - protein, 9 aa, Homo Sapiens
EYLLESRDK

SEQ ID NO: 911556 - protein, 9 aa, Homo Sapiens
THSEPAMES

SEQ ID NO: 911557 - protein, 9 aa, Homo Sapiens
CVKIQSIEG

SEQ ID NO: 911558 - protein, 9 aa, Homo Sapiens
NCTGICFNV

SEQ ID NO: 911559 - protein, 9 aa, Homo Sapiens
SHFKFYAKP

SEQ ID NO: 911560 - protein, 9 aa, Homo Sapiens
TEEPRINVP

SEQ ID NO: 911561 - protein, 9 aa, Homo Sapiens
TGVEDIDDI

SEQ ID NO: 911562 - protein, 9 aa, Homo Sapiens
FQGTQWNPK

SEQ ID NO: 911563 - protein, 9 aa, Homo Sapiens
VRNGGHILI

SEQ ID NO: 911564 - protein, 9 aa, Homo Sapiens
NSSWGPARS

SEQ ID NO: 911565 - protein, 9 aa, Homo Sapiens
CDLIIQAII

SEQ ID NO: 911566 - protein, 9 aa, Homo Sapiens
PARSLPLDP

SEQ ID NO: 911567 - protein, 9 aa, Homo Sapiens
YGSLDRPYY

SEQ ID NO: 911568 - protein, 9 aa, Homo Sapiens
TLPWGTLSC

SEQ ID NO: 911569 - protein, 9 aa, Homo Sapiens
SSSCRSTYQ

SEQ ID NO: 911570 - protein, 9 aa, Homo Sapiens
CFNVGFNFS

SEQ ID NO: 911571 - protein, 9 aa, Homo Sapiens
ITKLFLKDI

SEQ ID NO: 911572 - protein, 9 aa, Homo Sapiens
RESPRAPVG

SEQ ID NO: 911573 - protein, 9 aa, Homo Sapiens
LFEKGNSSW

SEQ ID NO: 911574 - protein, 9 aa, Homo Sapiens
INVPHLLEE

SEQ ID NO: 911575 - protein, 9 aa, Homo Sapiens
LAKLHEEME

SEQ ID NO: 911576 - protein, 9 aa, Homo Sapiens
KSLVDVGVD

SEQ ID NO: 911577 - protein, 9 aa, Homo Sapiens
KKSVYGVNE

SEQ ID NO: 911578 - protein, 9 aa, Homo Sapiens
TTLTGVEDI

SEQ ID NO: 911579 - protein, 9 aa, Homo Sapiens
PATFRSSSC

SEQ ID NO: 911580 - protein, 9 aa, Homo Sapiens
FRSSSCRST

SEQ ID NO: 911581 - protein, 9 aa, Homo Sapiens
MPSRSSCSR

SEQ ID NO: 911582 - protein, 9 aa, Homo Sapiens
GNSSWGPAR

SEQ ID NO: 911583 - protein, 9 aa, Homo Sapiens
AKLHEEMEH

SEQ ID NO: 911584 - protein, 9 aa, Homo Sapiens
ELFEKGNSS

SEQ ID NO: 911585 - protein, 9 aa, Homo Sapiens
SVKLFYGSL

SEQ ID NO: 911586 - protein, 9 aa, Homo Sapiens
AAQAKGLFQ

SEQ ID NO: 911587 - protein, 9 aa, Homo Sapiens
NGVSHLCPE

SEQ ID NO: 911588 - protein, 9 aa, Homo Sapiens
VSKRKSLQL

SEQ ID NO: 911589 - protein, 9 aa, Homo Sapiens
LTTLTGVED

SEQ ID NO: 911590 - protein, 9 aa, Homo Sapiens
SIPSTASLP

SEQ ID NO: 911591 - protein, 9 aa, Homo Sapiens
KLHEEMEHL

SEQ ID NO: 911592 - protein, 9 aa, Homo Sapiens
IFDVRNGGH

SEQ ID NO: 911593 - protein, 9 aa, Homo Sapiens
VDAFEERRK

SEQ ID NO: 911594 - protein, 9 aa, Homo Sapiens
WNPKKHVQE

SEQ ID NO: 911595 - protein, 9 aa, Homo Sapiens
AQSSVILGR

SEQ ID NO: 911596 - protein, 9 aa, Homo Sapiens
QTMEEFYVE

SEQ ID NO: 911597 - protein, 9 aa, Homo Sapiens
SGSGCVKIQ

SEQ ID NO: 911598 - protein, 9 aa, Homo Sapiens
KLFLKDIST

SEQ ID NO: 911599 - protein, 9 aa, Homo Sapiens
DPCSCMPSR

SEQ ID NO: 911600 - protein, 9 aa, Homo Sapiens
LGPATFRSS

SEQ ID NO: 911601 - protein, 9 aa, Homo Sapiens
GVEDIDDIA

SEQ ID NO: 911602 - protein, 9 aa, Homo Sapiens
AVMAAAGGS

SEQ ID NO: 911603 - protein, 9 aa, Homo Sapiens
AAVMAAAGG

SEQ ID NO: 911604 - protein, 9 aa, Homo Sapiens
VILGRAAHR

SEQ ID NO: 911605 - protein, 9 aa, Homo Sapiens
WTSPVALST

SEQ ID NO: 911606 - protein, 9 aa, Homo Sapiens
HAEQGEDRF

SEQ ID NO: 911607 - protein, 9 aa, Homo Sapiens
LIHAEQGED

SEQ ID NO: 911608 - protein, 9 aa, Homo Sapiens
SKSLVDVGV

SEQ ID NO: 911609 - protein, 9 aa, Homo Sapiens
SGGAGGRSS

SEQ ID NO: 911610 - protein, 9 aa, Homo Sapiens
EDLERNYGS

SEQ ID NO: 911611 - protein, 9 aa, Homo Sapiens
SSVILGRAA

SEQ ID NO: 911612 - protein, 9 aa, Homo Sapiens
PGKKKKKLG

SEQ ID NO: 911613 - protein, 9 aa, Homo Sapiens
TSGTSWTSP

SEQ ID NO: 911614 - protein, 9 aa, Homo Sapiens
PTSGTSWTS

SEQ ID NO: 911615 - protein, 9 aa, Homo Sapiens
ERRKSWGID

SEQ ID NO: 911616 - protein, 9 aa, Homo Sapiens
TFRSSSCRS

SEQ ID NO: 911617 - protein, 9 aa, Homo Sapiens
SCSRESPRA

SEQ ID NO: 911618 - protein, 9 aa, Homo Sapiens
KLSLPESLK

SEQ ID NO: 911619 - protein, 9 aa, Homo Sapiens
SDEQGCEVR

SEQ ID NO: 911620 - protein, 9 aa, Homo Sapiens
IHAEQGEDR

SEQ ID NO: 911621 - protein, 9 aa, Homo Sapiens
DTWAKARHP

SEQ ID NO: 911622 - protein, 9 aa, Homo Sapiens
SRSSCSRES

SEQ ID NO: 911623 - protein, 9 aa, Homo Sapiens
VKIQSIEGD

SEQ ID NO: 911624 - protein, 9 aa, Homo Sapiens
EPRINVPHL

SEQ ID NO: 911625 - protein, 9 aa, Homo Sapiens
CEVRTCHPV

SEQ ID NO: 911626 - protein, 9 aa, Homo Sapiens
LDPCSCMPS

SEQ ID NO: 911627 - protein, 9 aa, Homo Sapiens
FLAQKDLLG

SEQ ID NO: 911628 - protein, 9 aa, Homo Sapiens
EGSHFKFYA

SEQ ID NO: 911629 - protein, 9 aa, Homo Sapiens
GRSSDSRLE

SEQ ID NO: 911630 - protein, 9 aa, Homo Sapiens
ERPLENLEK

SEQ ID NO: 911631 - protein, 9 aa, Homo Sapiens
EPPENGVSH

SEQ ID NO: 911632 - protein, 9 aa, Homo Sapiens
YSSPCIRWR

SEQ ID NO: 911633 - protein, 9 aa, Homo Sapiens
SSWGPARSL

SEQ ID NO: 911634 - protein, 9 aa, Homo Sapiens
STEEPRINV

SEQ ID NO: 911635 - protein, 9 aa, Homo Sapiens
TFQGTQWNP

SEQ ID NO: 911636 - protein, 9 aa, Homo Sapiens
KVWKLERPL

SEQ ID NO: 911637 - protein, 9 aa, Homo Sapiens
SSDSRLELA

SEQ ID NO: 911638 - protein, 9 aa, Homo Sapiens
QPVQLTKEG

SEQ ID NO: 911639 - protein, 9 aa, Homo Sapiens
KLFYGSLLF

SEQ ID NO: 911640 - protein, 9 aa, Homo Sapiens
VGMPRPTSG

SEQ ID NO: 911641 - protein, 9 aa, Homo Sapiens
PERFYEALD

SEQ ID NO: 911642 - protein, 9 aa, Homo Sapiens
FEKGNSSWG

SEQ ID NO: 911643 - protein, 9 aa, Homo Sapiens
LPWGTLSCL

SEQ ID NO: 911644 - protein, 9 aa, Homo Sapiens
AAAGGSPLS

SEQ ID NO: 911645 - protein, 9 aa, Homo Sapiens
DLLGPATFR

SEQ ID NO: 911646 - protein, 9 aa, Homo Sapiens
SAIQSLFGA

SEQ ID NO: 911647 - protein, 9 aa, Homo Sapiens
ESIPSTASL

SEQ ID NO: 911648 - protein, 9 aa, Homo Sapiens
TEGRISAIQ

SEQ ID NO: 911649 - protein, 9 aa, Homo Sapiens
DLSLYPHLF

SEQ ID NO: 911650 - protein, 9 aa, Homo Sapiens
GSHFKFYAK

SEQ ID NO: 911651 - protein, 9 aa, Homo Sapiens
YAVVSKRKS

SEQ ID NO: 911652 - protein, 9 aa, Homo Sapiens
KSLQLVATG

SEQ ID NO: 911653 - protein, 9 aa, Homo Sapiens
AIQSLFGAS

SEQ ID NO: 911654 - protein, 9 aa, Homo Sapiens
LERNYGSLD

SEQ ID NO: 911655 - protein, 9 aa, Homo Sapiens
KPQSSALDN

SEQ ID NO: 911656 - protein, 9 aa, Homo Sapiens
QSSVILGRA

SEQ ID NO: 911657 - protein, 9 aa, Homo Sapiens
FEGSHFKFY

SEQ ID NO: 911658 - protein, 9 aa, Homo Sapiens
LPERFYEAL

SEQ ID NO: 911659 - protein, 9 aa, Homo Sapiens
LQNEHAQTM

SEQ ID NO: 911660 - protein, 9 aa, Homo Sapiens
LDTWAKARH

SEQ ID NO: 911661 - protein, 9 aa, Homo Sapiens
RKSLQLVAT

SEQ ID NO: 911662 - protein, 9 aa, Homo Sapiens
MAAAGGSPL

SEQ ID NO: 911663 - protein, 9 aa, Homo Sapiens
AVVSKRKSL

SEQ ID NO: 911664 - protein, 9 aa, Homo Sapiens
AQKDLLGPA

SEQ ID NO: 911665 - protein, 9 aa, Homo Sapiens
RSSSCRSTY

SEQ ID NO: 911666 - protein, 9 aa, Homo Sapiens
HLISVKLFY

SEQ ID NO: 911667 - protein, 9 aa, Homo Sapiens
TLKVWKLER

SEQ ID NO: 911668 - protein, 9 aa, Homo Sapiens
MLAKLHEEM

SEQ ID NO: 911669 - protein, 9 aa, Homo Sapiens
PVQLTKEGE

SEQ ID NO: 911670 - protein, 9 aa, Homo Sapiens
GTQWNPKKH

SEQ ID NO: 911671 - protein, 9 aa, Homo Sapiens
KRKSLQLVA

SEQ ID NO: 911672 - protein, 9 aa, Homo Sapiens
ERFYEALDS

SEQ ID NO: 911673 - protein, 9 aa, Homo Sapiens
VWKLERPLE

SEQ ID NO: 911674 - protein, 9 aa, Homo Sapiens
NYGSLDRPY

SEQ ID NO: 911675 - protein, 9 aa, Homo Sapiens
ERNYGSLDR

SEQ ID NO: 911676 - protein, 9 aa, Homo Sapiens
SEEGMYGQD

SEQ ID NO: 911677 - protein, 9 aa, Homo Sapiens
GAGGRSSDS

SEQ ID NO: 911678 - protein, 9 aa, Homo Sapiens
LLDTWAKAR

SEQ ID NO: 911679 - protein, 9 aa, Homo Sapiens
NDLIHAEQG

SEQ ID NO: 911680 - protein, 9 aa, Homo Sapiens
QSAQISKSL

SEQ ID NO: 911681 - protein, 9 aa, Homo Sapiens
VVSKRKSLQ

SEQ ID NO: 911682 - protein, 9 aa, Homo Sapiens
AKGLFQVGK

SEQ ID NO: 911683 - protein, 9 aa, Homo Sapiens
PRPTSGTSW

SEQ ID NO: 911684 - protein, 9 aa, Homo Sapiens
NEHAQTMEE

SEQ ID NO: 911685 - protein, 9 aa, Homo Sapiens
MPRPTSGTS

SEQ ID NO: 911686 - protein, 9 aa, Homo Sapiens
SSCRSTYQY

SEQ ID NO: 911687 - protein, 9 aa, Homo Sapiens
TPGKKKKKL

SEQ ID NO: 911688 - protein, 9 aa, Homo Sapiens
ASILADKYS

SEQ ID NO: 911689 - protein, 9 aa, Homo Sapiens
SRESPRAPV

SEQ ID NO: 911690 - protein, 9 aa, Homo Sapiens
RNYGSLDRP

SEQ ID NO: 911691 - protein, 9 aa, Homo Sapiens
KIMKLSLPE

SEQ ID NO: 911692 - protein, 9 aa, Homo Sapiens
KEGEPSART

SEQ ID NO: 911693 - protein, 9 aa, Homo Sapiens
LDTMKHQRQ

SEQ ID NO: 911694 - protein, 9 aa, Homo Sapiens
EERRKSWGI

SEQ ID NO: 911695 - protein, 9 aa, Homo Sapiens
AEQGEDRFA

SEQ ID NO: 911696 - protein, 9 aa, Homo Sapiens
EEPRINVPH

SEQ ID NO: 911697 - protein, 9 aa, Homo Sapiens
GCVKIQSIE

SEQ ID NO: 911698 - protein, 9 aa, Homo Sapiens
LEDLERNYG

SEQ ID NO: 911699 - protein, 9 aa, Homo Sapiens
SHLISVKLF

SEQ ID NO: 911700 - protein, 9 aa, Homo Sapiens
SWTSPVALS

SEQ ID NO: 911701 - protein, 9 aa, Homo Sapiens
PRINVPHLL

SEQ ID NO: 911702 - protein, 9 aa, Homo Sapiens
MKHQRQLRK

SEQ ID NO: 911703 - protein, 9 aa, Homo Sapiens
LFSRAYINF

SEQ ID NO: 911704 - protein, 9 aa, Homo Sapiens
IIQAIIKIQ

SEQ ID NO: 911705 - protein, 9 aa, Homo Sapiens
PVGMPRPTS

SEQ ID NO: 911706 - protein, 9 aa, Homo Sapiens
TLTGVEDID

SEQ ID NO: 911707 - protein, 9 aa, Homo Sapiens
SCMPSRSSC

SEQ ID NO: 911708 - protein, 9 aa, Homo Sapiens
SLYPHLFSR

SEQ ID NO: 911709 - protein, 9 aa, Homo Sapiens
SPRAPVGMP

SEQ ID NO: 911710 - protein, 9 aa, Homo Sapiens
QRQLRKKKY

SEQ ID NO: 911711 - protein, 9 aa, Homo Sapiens
FDVYFEGSH

SEQ ID NO: 911712 - protein, 9 aa, Homo Sapiens
CSCMPSRSS

SEQ ID NO: 911713 - protein, 9 aa, Homo Sapiens
HREKKESIP

SEQ ID NO: 911714 - protein, 9 aa, Homo Sapiens
VMAAAGGSP

SEQ ID NO: 911715 - protein, 9 aa, Homo Sapiens
RKSWGIDCL

SEQ ID NO: 911716 - protein, 9 aa, Homo Sapiens
PLPERFYEA

SEQ ID NO: 911717 - protein, 9 aa, Homo Sapiens
TMEEFYVEQ

SEQ ID NO: 911718 - protein, 9 aa, Homo Sapiens
DEQGCEVRT

SEQ ID NO: 911719 - protein, 9 aa, Homo Sapiens
FYEALDSKG

SEQ ID NO: 911720 - protein, 9 aa, Homo Sapiens
GGHILIADL

SEQ ID NO: 911721 - protein, 9 aa, Homo Sapiens
RRKSWGIDC

SEQ ID NO: 911722 - protein, 9 aa, Homo Sapiens
VEDIDDIAD

SEQ ID NO: 911723 - protein, 9 aa, Homo Sapiens
NESSTLTTH

SEQ ID NO: 911724 - protein, 9 aa, Homo Sapiens
EKKESIPST

SEQ ID NO: 911725 - protein, 9 aa, Homo Sapiens
SSCSRESPR

SEQ ID NO: 911726 - protein, 9 aa, Homo Sapiens
NVPHLLEEE

SEQ ID NO: 911727 - protein, 9 aa, Homo Sapiens
SSALDNAVM

SEQ ID NO: 911728 - protein, 9 aa, Homo Sapiens
AQISKSLVD

SEQ ID NO: 911729 - protein, 9 aa, Homo Sapiens
GKKKKKLGP

SEQ ID NO: 911730 - protein, 9 aa, Homo Sapiens
TGICFNVGF

SEQ ID NO: 911731 - protein, 9 aa, Homo Sapiens
GICFNVGFN

SEQ ID NO: 911732 - protein, 9 aa, Homo Sapiens
QISKSLVDV

SEQ ID NO: 911733 - protein, 9 aa, Homo Sapiens
QQPPKPQSS

SEQ ID NO: 911734 - protein, 9 aa, Homo Sapiens
AEELFEKGN

SEQ ID NO: 911735 - protein, 9 aa, Homo Sapiens
SASLASILA

SEQ ID NO: 911736 - protein, 9 aa, Homo Sapiens
VYFEGSHFK

SEQ ID NO: 911737 - protein, 9 aa, Homo Sapiens
AVKEQITKL

SEQ ID NO: 911738 - protein, 9 aa, Homo Sapiens
KIQSIEGDN

SEQ ID NO: 911739 - protein, 9 aa, Homo Sapiens
KESIPSTAS

SEQ ID NO: 911740 - protein, 9 aa, Homo Sapiens
ASLASILAD

SEQ ID NO: 911741 - protein, 9 aa, Homo Sapiens
RSSDSRLEL

SEQ ID NO: 911742 - protein, 9 aa, Homo Sapiens
VWELSEEGM

SEQ ID NO: 911743 - protein, 9 aa, Homo Sapiens
YEALDSKGI

SEQ ID NO: 911744 - protein, 9 aa, Homo Sapiens
LKVWKLERP

SEQ ID NO: 911745 - protein, 9 aa, Homo Sapiens
QGTQWNPKK

SEQ ID NO: 911746 - protein, 9 aa, Homo Sapiens
KEQITKLFL

SEQ ID NO: 911747 - protein, 9 aa, Homo Sapiens
CSRESPRAP

SEQ ID NO: 911748 - protein, 9 aa, Homo Sapiens
YPHLFSRAY

SEQ ID NO: 911749 - protein, 9 aa, Homo Sapiens
WELSEEGMY

SEQ ID NO: 911750 - protein, 9 aa, Homo Sapiens
IKIQKELQK

SEQ ID NO: 911751 - protein, 9 aa, Homo Sapiens
LYPHLFSRA

SEQ ID NO: 911752 - protein, 9 aa, Homo Sapiens
CLKLQSRKD

SEQ ID NO: 911753 - protein, 9 aa, Homo Sapiens
TSPVALSTL

SEQ ID NO: 911754 - protein, 9 aa, Homo Sapiens
DLIIQAIIK

SEQ ID NO: 911755 - protein, 9 aa, Homo Sapiens
YGVNEESQA

SEQ ID NO: 911756 - protein, 9 aa, Homo Sapiens
EMEHLKREN

SEQ ID NO: 911757 - protein, 9 aa, Homo Sapiens
THREKKESI

SEQ ID NO: 911758 - protein, 9 aa, Homo Sapiens
IFPLPERFY

SEQ ID NO: 911759 - protein, 9 aa, Homo Sapiens
AGGRSSDSR

SEQ ID NO: 911760 - protein, 9 aa, Homo Sapiens
PPENGVSHL

SEQ ID NO: 911761 - protein, 9 aa, Homo Sapiens
SSGSGCVKI

SEQ ID NO: 911762 - protein, 9 aa, Homo Sapiens
PRAPVGMPR

SEQ ID NO: 911763 - protein, 9 aa, Homo Sapiens
RSTYQYSSP

SEQ ID NO: 911764 - protein, 9 aa, Homo Sapiens
LHLEPPENG

SEQ ID NO: 911765 - protein, 9 aa, Homo Sapiens
SLHLEPPEN

SEQ ID NO: 911766 - protein, 9 aa, Homo Sapiens
QYSSPCIRW

SEQ ID NO: 911767 - protein, 9 aa, Homo Sapiens
IIKIQKELQ

SEQ ID NO: 911768 - protein, 9 aa, Homo Sapiens
LLGPATFRS

SEQ ID NO: 911769 - protein, 9 aa, Homo Sapiens
SLQNEHAQT

SEQ ID NO: 911770 - protein, 9 aa, Homo Sapiens
GCEVRTCHP

SEQ ID NO: 911771 - protein, 9 aa, Homo Sapiens
TLRFLAQKD

SEQ ID NO: 911772 - protein, 9 aa, Homo Sapiens
EQITKLFLK

SEQ ID NO: 911773 - protein, 9 aa, Homo Sapiens
FNESSTLTT

SEQ ID NO: 911774 - protein, 9 aa, Homo Sapiens
IQSLFGASM

SEQ ID NO: 911775 - protein, 9 aa, Homo Sapiens
IQAIIKIQK

SEQ ID NO: 911776 - protein, 9 aa, Homo Sapiens
IQSIEGDNC

SEQ ID NO: 911777 - protein, 9 aa, Homo Sapiens
QAKGLFQVG

SEQ ID NO: 911778 - protein, 9 aa, Homo Sapiens
YFEGSHFKF

SEQ ID NO: 911779 - protein, 9 aa, Homo Sapiens
GGRSSDSRL

SEQ ID NO: 911780 - protein, 9 aa, Homo Sapiens
RPTSGTSWT

SEQ ID NO: 911781 - protein, 9 aa, Homo Sapiens
LERPLENLE

SEQ ID NO: 911782 - protein, 9 aa, Homo Sapiens
LAQKDLLGP

SEQ ID NO: 911783 - protein, 9 aa, Homo Sapiens
LRFLAQKDL

SEQ ID NO: 911784 - protein, 9 aa, Homo Sapiens
GPATFRSSS

SEQ ID NO: 911785 - protein, 9 aa, Homo Sapiens
LFQVGKWNP

SEQ ID NO: 911786 - protein, 9 aa, Homo Sapiens
MYGQDSPLE

SEQ ID NO: 911787 - protein, 9 aa, Homo Sapiens
HLEPPENGV

SEQ ID NO: 911788 - protein, 9 aa, Homo Sapiens
QSLFGASMT

SEQ ID NO: 911789 - protein, 9 aa, Homo Sapiens
KLERPLENL

SEQ ID NO: 911790 - protein, 9 aa, Homo Sapiens
SVYGVNEES

SEQ ID NO: 911791 - protein, 9 aa, Homo Sapiens
NVGFNFSIR

SEQ ID NO: 911792 - protein, 9 aa, Homo Sapiens
QSSALDNAV

SEQ ID NO: 911793 - protein, 9 aa, Homo Sapiens
AGGSPLSLR

SEQ ID NO: 911794 - protein, 9 aa, Homo Sapiens
LGRAAHRPF

SEQ ID NO: 911795 - protein, 9 aa, Homo Sapiens
EGRISAIQS

SEQ ID NO: 911796 - protein, 9 aa, Homo Sapiens
LSTLRFLAQ

SEQ ID NO: 911797 - protein, 9 aa, Homo Sapiens
GTLSCLKLQ

SEQ ID NO: 911798 - protein, 9 aa, Homo Sapiens
VSASLASIL

SEQ ID NO: 911799 - protein, 9 aa, Homo Sapiens
LSCLKLQSR

SEQ ID NO: 911800 - protein, 9 aa, Homo Sapiens
VRTCHPVGD

SEQ ID NO: 911801 - protein, 9 aa, Homo Sapiens
TQWNPKKHV

SEQ ID NO: 911802 - protein, 9 aa, Homo Sapiens
GLFQVGKWN

SEQ ID NO: 911803 - protein, 9 aa, Homo Sapiens
SKRKSLQLV

SEQ ID NO: 911804 - protein, 9 aa, Homo Sapiens
TSWTSPVAL

SEQ ID NO: 911805 - protein, 9 aa, Homo Sapiens
GLILLLDTW

SEQ ID NO: 911806 - protein, 9 aa, Homo Sapiens
CRSTYQYSS

SEQ ID NO: 911807 - protein, 9 aa, Homo Sapiens
SAAQAKGLF

SEQ ID NO: 911808 - protein, 9 aa, Homo Sapiens
APVGMPRPT

SEQ ID NO: 911809 - protein, 9 aa, Homo Sapiens
PPKPQSSAL

SEQ ID NO: 911810 - protein, 9 aa, Homo Sapiens
ESPRAPVGM

SEQ ID NO: 911811 - protein, 9 aa, Homo Sapiens
GGAGGRSSD

SEQ ID NO: 911812 - protein, 9 aa, Homo Sapiens
SWGPARSLP

SEQ ID NO: 911813 - protein, 9 aa, Homo Sapiens
REKIMKLSL

SEQ ID NO: 911814 - protein, 9 aa, Homo Sapiens
ATFRSSSCR

SEQ ID NO: 911815 - protein, 9 aa, Homo Sapiens
EGMYGQDSP

SEQ ID NO: 911816 - protein, 9 aa, Homo Sapiens
FQVGKWNPV

SEQ ID NO: 911817 - protein, 9 aa, Homo Sapiens
EEGMYGQDS

SEQ ID NO: 911818 - protein, 9 aa, Homo Sapiens
QLTKEGEPS

SEQ ID NO: 911819 - protein, 9 aa, Homo Sapiens
LTGVEDIDD

SEQ ID NO: 911820 - protein, 9 aa, Homo Sapiens
QPPKPQSSA

SEQ ID NO: 911821 - protein, 9 aa, Homo Sapiens
LISVKLFYG

SEQ ID NO: 911822 - protein, 9 aa, Homo Sapiens
LHEEMEHLK

SEQ ID NO: 911823 - protein, 9 aa, Homo Sapiens
VKEQITKLF

SEQ ID NO: 911824 - protein, 9 aa, Homo Sapiens
LTKEGEPSA

SEQ ID NO: 911825 - protein, 9 aa, Homo Sapiens
RPLENLEKS

SEQ ID NO: 911826 - protein, 9 aa, Homo Sapiens
MKLSLPESL

SEQ ID NO: 911827 - protein, 9 aa, Homo Sapiens
PCSCMPSRS

SEQ ID NO: 911828 - protein, 9 aa, Homo Sapiens
GTSWTSPVA

SEQ ID NO: 911829 - protein, 9 aa, Homo Sapiens
VKKSVYGVN

SEQ ID NO: 911830 - protein, 9 aa, Homo Sapiens
SLPLDPCSC

SEQ ID NO: 911831 - protein, 9 aa, Homo Sapiens
DAFEERRKS

SEQ ID NO: 911832 - protein, 9 aa, Homo Sapiens
FPLPERFYE

SEQ ID NO: 911833 - protein, 9 aa, Homo Sapiens
GKAFNESST

SEQ ID NO: 911834 - protein, 9 aa, Homo Sapiens
ILGRAAHRP

SEQ ID NO: 911835 - protein, 9 aa, Homo Sapiens
SLPESLKAY

SEQ ID NO: 911836 - protein, 9 aa, Homo Sapiens
TYQYSSPCI

SEQ ID NO: 911837 - protein, 9 aa, Homo Sapiens
GPARSLPLD

SEQ ID NO: 911838 - protein, 9 aa, Homo Sapiens
HILIADLRG

SEQ ID NO: 911839 - protein, 9 aa, Homo Sapiens
LSLYPHLFS

SEQ ID NO: 911840 - protein, 9 aa, Homo Sapiens
KSVYGVNEE

SEQ ID NO: 911841 - protein, 9 aa, Homo Sapiens
GGSPLSLRP

SEQ ID NO: 911842 - protein, 9 aa, Homo Sapiens
HTFQGTQWN

SEQ ID NO: 911843 - protein, 9 aa, Homo Sapiens
GVNEESQAQ

SEQ ID NO: 911844 - protein, 9 aa, Homo Sapiens
QAIIKIQKE

SEQ ID NO: 911845 - protein, 9 aa, Homo Sapiens
RSSCSRESP

SEQ ID NO: 911846 - protein, 9 aa, Homo Sapiens
DTMKHQRQL

SEQ ID NO: 911847 - protein, 9 aa, Homo Sapiens
EVRTCHPVG

SEQ ID NO: 911848 - protein, 9 aa, Homo Sapiens
ILLLDTWAK

SEQ ID NO: 911849 - protein, 9 aa, Homo Sapiens
GRISAIQSL

SEQ ID NO: 911850 - protein, 9 aa, Homo Sapiens
WGPARSLPL

SEQ ID NO: 911851 - protein, 9 aa, Homo Sapiens
SLQLVATGA

SEQ ID NO: 911852 - protein, 9 aa, Homo Sapiens
KHQRQLRKK

SEQ ID NO: 911853 - protein, 9 aa, Homo Sapiens
TLTTLTGVE

SEQ ID NO: 911854 - protein, 9 aa, Homo Sapiens
NEESQAQSP

SEQ ID NO: 911855 - protein, 9 aa, Homo Sapiens
RSLPLDPCS

SEQ ID NO: 911856 - protein, 9 aa, Homo Sapiens
NTLTTLTGV

SEQ ID NO: 911857 - protein, 9 aa, Homo Sapiens
VAAVMAAAG

SEQ ID NO: 911858 - protein, 9 aa, Homo Sapiens
RQLRKKKYL

SEQ ID NO: 911859 - protein, 9 aa, Homo Sapiens
LFLKDISTT

SEQ ID NO: 911860 - protein, 9 aa, Homo Sapiens
NGGHILIAD

SEQ ID NO: 911861 - protein, 9 aa, Homo Sapiens
KVDAFEERR

SEQ ID NO: 911862 - protein, 9 aa, Homo Sapiens
VYGVNEESQ

SEQ ID NO: 911863 - protein, 9 aa, Homo Sapiens
KDLLGPATF

SEQ ID NO: 911864 - protein, 9 aa, Homo Sapiens
LASILADKY

SEQ ID NO: 911865 - protein, 9 aa, Homo Sapiens
YQYSSPCIR

SEQ ID NO: 911866 - protein, 9 aa, Homo Sapiens
AFEERRKSW

SEQ ID NO: 911867 - protein, 9 aa, Homo Sapiens
EKIMKLSLP

SEQ ID NO: 911868 - protein, 9 aa, Homo Sapiens
FNVGFNFSI

SEQ ID NO: 911869 - protein, 9 aa, Homo Sapiens
TMKHQRQLR

SEQ ID NO: 911870 - protein, 9 aa, Homo Sapiens
ISVKLFYGS

SEQ ID NO: 911871 - protein, 9 aa, Homo Sapiens
RNGGHILIA

SEQ ID NO: 911872 - protein, 9 aa, Homo Sapiens
EHAQTMEEF

SEQ ID NO: 911873 - protein, 9 aa, Homo Sapiens
PHLFSRAYI

SEQ ID NO: 911874 - protein, 9 aa, Homo Sapiens
EGEPSARTK

SEQ ID NO: 911875 - protein, 9 aa, Homo Sapiens
HEEMEHLKR

SEQ ID NO: 911876 - protein, 9 aa, Homo Sapiens
ALSTLRFLA

SEQ ID NO: 911877 - protein, 9 aa, Homo Sapiens
SLASILADK

SEQ ID NO: 911878 - protein, 9 aa, Homo Sapiens
IMKLSLPES

SEQ ID NO: 911879 - protein, 9 aa, Homo Sapiens
REKKESIPS

SEQ ID NO: 911880 - protein, 9 aa, Homo Sapiens
SGCVKIQSI

SEQ ID NO: 911881 - protein, 9 aa, Homo Sapiens
LIIQAIIKI

SEQ ID NO: 911882 - protein, 9 aa, Homo Sapiens
WKLERPLEN

SEQ ID NO: 911883 - protein, 9 aa, Homo Sapiens
NSDEQGCEV

SEQ ID NO: 911884 - protein, 9 aa, Homo Sapiens
DVYFEGSHF

SEQ ID NO: 911885 - protein, 9 aa, Homo Sapiens
KAFNESSTL

SEQ ID NO: 911886 - protein, 9 aa, Homo Sapiens
EELFEKGNS

SEQ ID NO: 911887 - protein, 9 aa, Homo Sapiens
VKLFYGSLL

SEQ ID NO: 911888 - protein, 9 aa, Homo Sapiens
DVRNGGHIL

SEQ ID NO: 911889 - protein, 9 aa, Homo Sapiens
GMPRPTSGT

SEQ ID NO: 911890 - protein, 9 aa, Homo Sapiens
VGFNFSIRF

SEQ ID NO: 911891 - protein, 9 aa, Homo Sapiens
LADKYSYTI

SEQ ID NO: 911892 - protein, 9 aa, Homo Sapiens
LREKIMKLS

SEQ ID NO: 911893 - protein, 9 aa, Homo Sapiens
VPHLLEEEV

SEQ ID NO: 911894 - protein, 9 aa, Homo Sapiens
GRAAHRPFV

SEQ ID NO: 911895 - protein, 9 aa, Homo Sapiens
STYQYSSPC

SEQ ID NO: 911896 - protein, 9 aa, Homo Sapiens
KGLFQVGKW

SEQ ID NO: 911897 - protein, 9 aa, Homo Sapiens
WGTLSCLKL

SEQ ID NO: 911898 - protein, 9 aa, Homo Sapiens
CASHLISVK

SEQ ID NO: 911899 - protein, 9 aa, Homo Sapiens
RFYEALDSK

SEQ ID NO: 911900 - protein, 9 aa, Homo Sapiens
GEPSARTKF

SEQ ID NO: 911901 - protein, 9 aa, Homo Sapiens
QQSAQISKS

SEQ ID NO: 911902 - protein, 9 aa, Homo Sapiens
PENGVSHLC

SEQ ID NO: 911903 - protein, 9 aa, Homo Sapiens
AQAKGLFQV

SEQ ID NO: 911904 - protein, 9 aa, Homo Sapiens
QITKLFLKD

SEQ ID NO: 911905 - protein, 9 aa, Homo Sapiens
CMPSRSSCS

SEQ ID NO: 911906 - protein, 9 aa, Homo Sapiens
LEPPENGVS

SEQ ID NO: 911907 - protein, 9 aa, Homo Sapiens
LSLPESLKA

SEQ ID NO: 911908 - protein, 9 aa, Homo Sapiens
SDSRLELAS

SEQ ID NO: 911909 - protein, 9 aa, Homo Sapiens
LSEEGMYGQ

SEQ ID NO: 911910 - protein, 9 aa, Homo Sapiens
GSGCVKIQS

SEQ ID NO: 911911 - protein, 9 aa, Homo Sapiens
MEHLKRENK

SEQ ID NO: 911912 - protein, 9 aa, Homo Sapiens
SVILGRAAH

SEQ ID NO: 911913 - protein, 9 aa, Homo Sapiens
HQRQLRKKK

SEQ ID NO: 911914 - protein, 9 aa, Homo Sapiens
GHILIADLR

SEQ ID NO: 911915 - protein, 9 aa, Homo Sapiens
HFKFYAKPY

SEQ ID NO: 911916 - protein, 9 aa, Homo Sapiens
DLERNYGSL

SEQ ID NO: 911917 - protein, 9 aa, Homo Sapiens
TWAKARHPP

SEQ ID NO: 911918 - protein, 9 aa, Homo Sapiens
RINVPHLLE

SEQ ID NO: 911919 - protein, 9 aa, Homo Sapiens
LPLDPCSCM

SEQ ID NO: 911920 - protein, 9 aa, Homo Sapiens
SGTSWTSPV

SEQ ID NO: 911921 - protein, 9 aa, Homo Sapiens
ESSTLTTHK

SEQ ID NO: 911922 - protein, 9 aa, Homo Sapiens
VNEESQAQS

SEQ ID NO: 911923 - protein, 9 aa, Homo Sapiens
RAAHRPFVA

SEQ ID NO: 911924 - protein, 9 aa, Homo Sapiens
AAGGSPLSL

SEQ ID NO: 911925 - protein, 9 aa, Homo Sapiens
VALSTLRFL

SEQ ID NO: 911926 - protein, 9 aa, Homo Sapiens
LILLLDTWA

SEQ ID NO: 911927 - protein, 9 aa, Homo Sapiens
AFNESSTLT

SEQ ID NO: 911928 - protein, 9 aa, Homo Sapiens
GMYGQDSPL

SEQ ID NO: 911929 - protein, 9 aa, Homo Sapiens
DLIHAEQGE

SEQ ID NO: 911930 - protein, 9 aa, Homo Sapiens
AIIKIQKEL

SEQ ID NO: 911931 - protein, 9 aa, Homo Sapiens
SAQISKSLV

SEQ ID NO: 911932 - protein, 9 aa, Homo Sapiens
NPKKHVQEM

SEQ ID NO: 911933 - protein, 9 aa, Homo Sapiens
KGNSSWGPA

SEQ ID NO: 911934 - protein, 9 aa, Homo Sapiens
TKEGEPSAR

SEQ ID NO: 911935 - protein, 9 aa, Homo Sapiens
QGCEVRTCH

SEQ ID NO: 911936 - protein, 9 aa, Homo Sapiens
SPVALSTLR

SEQ ID NO: 911937 - protein, 9 aa, Homo Sapiens
ELSEEGMYG

SEQ ID NO: 911938 - protein, 9 aa, Homo Sapiens
EQGCEVRTC

SEQ ID NO: 911939 - protein, 9 aa, Homo Sapiens
ISKSLVDVG

SEQ ID NO: 911940 - protein, 9 aa, Homo Sapiens
ASHLISVKL

SEQ ID NO: 911941 - protein, 9 aa, Homo Sapiens
FEERRKSWG

SEQ ID NO: 911942 - protein, 9 aa, Homo Sapiens
ENGVSHLCP

SEQ ID NO: 911943 - protein, 9 aa, Homo Sapiens
SLVDVGVDF

SEQ ID NO: 911944 - protein, 9 aa, Homo Sapiens
EQGEDRFAD

SEQ ID NO: 911945 - protein, 9 aa, Homo Sapiens
RISAIQSLF

SEQ ID NO: 911946 - protein, 9 aa, Homo Sapiens
STLRFLAQK

SEQ ID NO: 911947 - protein, 9 aa, Homo Sapiens
SALDNAVMA

SEQ ID NO: 911948 - protein, 9 aa, Homo Sapiens
ILADKYSYT

SEQ ID NO: 911949 - protein, 9 aa, Homo Sapiens
QNEHAQTME

SEQ ID NO: 911950 - protein, 9 aa, Homo Sapiens
QKDLLGPAT

SEQ ID NO: 911951 - protein, 9 aa, Homo Sapiens
HAQTMEEFY

SEQ ID NO: 911952 - protein, 9 aa, Homo Sapiens
VQLTKEGEP

SEQ ID NO: 911953 - protein, 9 aa, Homo Sapiens
PQSSALDNA

SEQ ID NO: 911954 - protein, 9 aa, Homo Sapiens
FSRAYINFR

SEQ ID NO: 911955 - protein, 9 aa, Homo Sapiens
PVALSTLRF

SEQ ID NO: 911956 - protein, 9 aa, Homo Sapiens
KKESIPSTA

SEQ ID NO: 911957 - protein, 9 aa, Homo Sapiens
QWNPKKHVQ

SEQ ID NO: 911958 - protein, 9 aa, Homo Sapiens
ARSLPLDPC

SEQ ID NO: 911959 - protein, 9 aa, Homo Sapiens
CTGICFNVG

SEQ ID NO: 911960 - protein, 9 aa, Homo Sapiens
SCLKLQSRK

SEQ ID NO: 911961 - protein, 9 aa, Homo Sapiens
PKPQSSALD

SEQ ID NO: 911962 - protein, 9 aa, Homo Sapiens
ELDTMKHQR

SEQ ID NO: 911963 - protein, 9 aa, Homo Sapiens
PWGTLSCLK

SEQ ID NO: 911964 - protein, 9 aa, Homo Sapiens
ICFNVGFNF

SEQ ID NO: 911965 - protein, 9 aa, Homo Sapiens
RNDLIHAEQ

SEQ ID NO: 911966 - protein, 9 aa, Homo Sapiens
FDVRNGGHI

SEQ ID NO: 911967 - protein, 9 aa, Homo Sapiens
EKGNSSWGP

SEQ ID NO: 911968 - protein, 9 aa, Homo Sapiens
LLLDTWAKA

SEQ ID NO: 911969 - protein, 9 aa, Homo Sapiens
SILADKYSY

SEQ ID NO: 911970 - protein, 9 aa, Homo Sapiens
SCRSTYQYS

SEQ ID NO: 911971 - protein, 9 aa, Homo Sapiens
EEMEHLKRE

SEQ ID NO: 911972 - protein, 9 aa, Homo Sapiens
TKLFLKDIS

SEQ ID NO: 911973 - protein, 9 aa, Homo Sapiens
IPSTASLPS

SEQ ID NO: 911974 - protein, 9 aa, Homo Sapiens
ISAIQSLFG

SEQ ID NO: 911975 - protein, 9 aa, Homo Sapiens
RAPVGMPRP

SEQ ID NO: 911976 - protein, 9 aa, Homo Sapiens
RFLAQKDLL

SEQ ID NO: 911977 - protein, 9 aa, Homo Sapiens
HLFSRAYIN

SEQ ID NO: 911978 - protein, 9 aa, Homo Sapiens
PSRSSCSRE

SEQ ID NO: 911979 - protein, 9 aa, Homo Sapiens
WAKARHPPS

SEQ ID NO: 911980 - protein, 9 aa, Homo Sapiens
PLDPCSCMP

SEQ ID NO: 911981 - protein, 9 aa, Homo Sapiens
FLEDLERNY

SEQ ID NO: 911982 - protein, 9 aa, Homo Sapiens
AQTMEEFYV

SEQ ID NO: 911983 - protein, 9 aa, Homo Sapiens
QGEDRFADL

SEQ ID NO: 911984 - protein, 9 aa, Homo Sapiens
TLSCLKLQS

SEQ ID NO: 911985 - protein, 9 aa, Homo Sapiens
MCCDYPDIY

SEQ ID NO: 911986 - protein, 9 aa, Homo Sapiens
RKLHPGLPE

SEQ ID NO: 911987 - protein, 9 aa, Homo Sapiens
SVPSHGQPG

SEQ ID NO: 911988 - protein, 9 aa, Homo Sapiens
FLLIPLSYA

SEQ ID NO: 911989 - protein, 9 aa, Homo Sapiens
FTIADSPDG

SEQ ID NO: 911990 - protein, 9 aa, Homo Sapiens
RAQALQESE

SEQ ID NO: 911991 - protein, 9 aa, Homo Sapiens
EDYNTPSEL

SEQ ID NO: 911992 - protein, 9 aa, Homo Sapiens
LVCQKRENS

SEQ ID NO: 911993 - protein, 9 aa, Homo Sapiens
RPSCCLTTC

SEQ ID NO: 911994 - protein, 9 aa, Homo Sapiens
EMCCDYPDI

SEQ ID NO: 911995 - protein, 9 aa, Homo Sapiens
LIIQHNTNS

SEQ ID NO: 911996 - protein, 9 aa, Homo Sapiens
THLRRHTGE

SEQ ID NO: 911997 - protein, 9 aa, Homo Sapiens
GAVRKLHPG

SEQ ID NO: 911998 - protein, 9 aa, Homo Sapiens
DGGGQRVKQ

SEQ ID NO: 911999 - protein, 9 aa, Homo Sapiens
QSMTALDLF

SEQ ID NO: 912000 - protein, 9 aa, Homo Sapiens
RTEGVEITA

SEQ ID NO: 912001 - protein, 9 aa, Homo Sapiens
PVVCNRTLY

SEQ ID NO: 912002 - protein, 9 aa, Homo Sapiens
NVVRKVCTG

SEQ ID NO: 912003 - protein, 9 aa, Homo Sapiens
LRGYDQYAY

SEQ ID NO: 912004 - protein, 9 aa, Homo Sapiens
RSPIALAIE

SEQ ID NO: 912005 - protein, 9 aa, Homo Sapiens
LRRHTGERP

SEQ ID NO: 912006 - protein, 9 aa, Homo Sapiens
LHEALDQSM

SEQ ID NO: 912007 - protein, 9 aa, Homo Sapiens
SESKILEDA

SEQ ID NO: 912008 - protein, 9 aa, Homo Sapiens
PNGPPELFD

SEQ ID NO: 912009 - protein, 9 aa, Homo Sapiens
LDQSMTALD

SEQ ID NO: 912010 - protein, 9 aa, Homo Sapiens
SYLTTHLRR

SEQ ID NO: 912011 - protein, 9 aa, Homo Sapiens
KPNWWFCAF

SEQ ID NO: 912012 - protein, 9 aa, Homo Sapiens
LSKLRVQIL

SEQ ID NO: 912013 - protein, 9 aa, Homo Sapiens
GNPKKQGST

SEQ ID NO: 912014 - protein, 9 aa, Homo Sapiens
KEISQAMEQ

SEQ ID NO: 912015 - protein, 9 aa, Homo Sapiens
ADGVITLTR

SEQ ID NO: 912016 - protein, 9 aa, Homo Sapiens
PGVEVTLMM

SEQ ID NO: 912017 - protein, 9 aa, Homo Sapiens
HEVPTVLGT

SEQ ID NO: 912018 - protein, 9 aa, Homo Sapiens
PEELNPPKE

SEQ ID NO: 912019 - protein, 9 aa, Homo Sapiens
LSHVFNGLN

SEQ ID NO: 912020 - protein, 9 aa, Homo Sapiens
YLIIQHNTN

SEQ ID NO: 912021 - protein, 9 aa, Homo Sapiens
CQKRENSKA

SEQ ID NO: 912022 - protein, 9 aa, Homo Sapiens
GVHRYPAQS

SEQ ID NO: 912023 - protein, 9 aa, Homo Sapiens
IADSPDGGG

SEQ ID NO: 912024 - protein, 9 aa, Homo Sapiens
ALDQSMTAL

SEQ ID NO: 912025 - protein, 9 aa, Homo Sapiens
TYLIIQHNT

SEQ ID NO: 912026 - protein, 9 aa, Homo Sapiens
QRDSLSHVF

SEQ ID NO: 912027 - protein, 9 aa, Homo Sapiens
YNTPSELAK

SEQ ID NO: 912028 - protein, 9 aa, Homo Sapiens
IWIPDTIFC

SEQ ID NO: 912029 - protein, 9 aa, Homo Sapiens
GSDMEIWVN

SEQ ID NO: 912030 - protein, 9 aa, Homo Sapiens
DSLSHVFNG

SEQ ID NO: 912031 - protein, 9 aa, Homo Sapiens
LTTHLRRHT

SEQ ID NO: 912032 - protein, 9 aa, Homo Sapiens
LRVQILNDN

SEQ ID NO: 912033 - protein, 9 aa, Homo Sapiens
RSNVVRKVC

SEQ ID NO: 912034 - protein, 9 aa, Homo Sapiens
KSTYEEYRK

SEQ ID NO: 912035 - protein, 9 aa, Homo Sapiens
SKLRVQILN

SEQ ID NO: 912036 - protein, 9 aa, Homo Sapiens
MEIWVNSSD

SEQ ID NO: 912037 - protein, 9 aa, Homo Sapiens
DGGGAVRKL

SEQ ID NO: 912038 - protein, 9 aa, Homo Sapiens
SNVVRKVCT

SEQ ID NO: 912039 - protein, 9 aa, Homo Sapiens
TLTRAFLAA

SEQ ID NO: 912040 - protein, 9 aa, Homo Sapiens
KEKDTEGKK

SEQ ID NO: 912041 - protein, 9 aa, Homo Sapiens
MYPLKPNWW

SEQ ID NO: 912042 - protein, 9 aa, Homo Sapiens
AVRKLHPGL

SEQ ID NO: 912043 - protein, 9 aa, Homo Sapiens
FIGWAGCAL

SEQ ID NO: 912044 - protein, 9 aa, Homo Sapiens
CCRPSCCLT

SEQ ID NO: 912045 - protein, 9 aa, Homo Sapiens
RDSLSHVFN

SEQ ID NO: 912046 - protein, 9 aa, Homo Sapiens
GVEVTLMMK

SEQ ID NO: 912047 - protein, 9 aa, Homo Sapiens
MVLVYLPGV

SEQ ID NO: 912048 - protein, 9 aa, Homo Sapiens
LALPVTALR

SEQ ID NO: 912049 - protein, 9 aa, Homo Sapiens
MHQIIHTGE

SEQ ID NO: 912050 - protein, 9 aa, Homo Sapiens
GQIRAQALQ

SEQ ID NO: 912051 - protein, 9 aa, Homo Sapiens
ERAKEEICA

SEQ ID NO: 912052 - protein, 9 aa, Homo Sapiens
DQSMTALDL

SEQ ID NO: 912053 - protein, 9 aa, Homo Sapiens
GDSGRAERA

SEQ ID NO: 912054 - protein, 9 aa, Homo Sapiens
DTIFCNSKT

SEQ ID NO: 912055 - protein, 9 aa, Homo Sapiens
LLIPLSYAF

SEQ ID NO: 912056 - protein, 9 aa, Homo Sapiens
HEYFALRHA

SEQ ID NO: 912057 - protein, 9 aa, Homo Sapiens
ENSKASSIP

SEQ ID NO: 912058 - protein, 9 aa, Homo Sapiens
WNLTQDQAQ

SEQ ID NO: 912059 - protein, 9 aa, Homo Sapiens
ERSNVVRKV

SEQ ID NO: 912060 - protein, 9 aa, Homo Sapiens
VEQPHEVPT

SEQ ID NO: 912061 - protein, 9 aa, Homo Sapiens
AGCALVILG

SEQ ID NO: 912062 - protein, 9 aa, Homo Sapiens
VVRKVCTGV

SEQ ID NO: 912063 - protein, 9 aa, Homo Sapiens
HGQPGSPSV

SEQ ID NO: 912064 - protein, 9 aa, Homo Sapiens
QQRERSNVV

SEQ ID NO: 912065 - protein, 9 aa, Homo Sapiens
KLKSEEYEK

SEQ ID NO: 912066 - protein, 9 aa, Homo Sapiens
EYFALRHAD

SEQ ID NO: 912067 - protein, 9 aa, Homo Sapiens
TPKEKDTEG

SEQ ID NO: 912068 - protein, 9 aa, Homo Sapiens
RHADSSNFY

SEQ ID NO: 912069 - protein, 9 aa, Homo Sapiens
KKKLEKKNK

SEQ ID NO: 912070 - protein, 9 aa, Homo Sapiens
KEMTLNVLG

SEQ ID NO: 912071 - protein, 9 aa, Homo Sapiens
VYLPGVINT

SEQ ID NO: 912072 - protein, 9 aa, Homo Sapiens
TRPEELNPP

SEQ ID NO: 912073 - protein, 9 aa, Homo Sapiens
EGKKSGDSG

SEQ ID NO: 912074 - protein, 9 aa, Homo Sapiens
LCTHARETL

SEQ ID NO: 912075 - protein, 9 aa, Homo Sapiens
RSFLPPNLE

SEQ ID NO: 912076 - protein, 9 aa, Homo Sapiens
PPGCHTFTV

SEQ ID NO: 912077 - protein, 9 aa, Homo Sapiens
LLTEEACRP

SEQ ID NO: 912078 - protein, 9 aa, Homo Sapiens
LEMCCDYPD

SEQ ID NO: 912079 - protein, 9 aa, Homo Sapiens
SPKGTPNFR

SEQ ID NO: 912080 - protein, 9 aa, Homo Sapiens
THGLADFSF

SEQ ID NO: 912081 - protein, 9 aa, Homo Sapiens
ACRPNTALI

SEQ ID NO: 912082 - protein, 9 aa, Homo Sapiens
YGNPKKQGS

SEQ ID NO: 912083 - protein, 9 aa, Homo Sapiens
EEEGACMIV

SEQ ID NO: 912084 - protein, 9 aa, Homo Sapiens
ALPVTALRL

SEQ ID NO: 912085 - protein, 9 aa, Homo Sapiens
CRPNTALIS

SEQ ID NO: 912086 - protein, 9 aa, Homo Sapiens
LMMKVASGS

SEQ ID NO: 912087 - protein, 9 aa, Homo Sapiens
NLTQDQAQV

SEQ ID NO: 912088 - protein, 9 aa, Homo Sapiens
LYPNGVHRY

SEQ ID NO: 912089 - protein, 9 aa, Homo Sapiens
ITLTRAFLA

SEQ ID NO: 912090 - protein, 9 aa, Homo Sapiens
ATYCNEPNG

SEQ ID NO: 912091 - protein, 9 aa, Homo Sapiens
LLRHLCTHA

SEQ ID NO: 912092 - protein, 9 aa, Homo Sapiens
LTEEACRPN

SEQ ID NO: 912093 - protein, 9 aa, Homo Sapiens
SHLLRHLCT

SEQ ID NO: 912094 - protein, 9 aa, Homo Sapiens
EEKEISQAM

SEQ ID NO: 912095 - protein, 9 aa, Homo Sapiens
WAGCALVIL

SEQ ID NO: 912096 - protein, 9 aa, Homo Sapiens
RMVLVYLPG

SEQ ID NO: 912097 - protein, 9 aa, Homo Sapiens
NQLVRLAHL

SEQ ID NO: 912098 - protein, 9 aa, Homo Sapiens
TYEEYRKDK

SEQ ID NO: 912099 - protein, 9 aa, Homo Sapiens
AAETEEKEI

SEQ ID NO: 912100 - protein, 9 aa, Homo Sapiens
RGYNSCAQT

SEQ ID NO: 912101 - protein, 9 aa, Homo Sapiens
TPSELAKYL

SEQ ID NO: 912102 - protein, 9 aa, Homo Sapiens
ALRHADSSN

SEQ ID NO: 912103 - protein, 9 aa, Homo Sapiens
SLHEALDQS

SEQ ID NO: 912104 - protein, 9 aa, Homo Sapiens
IPDTIFCNS

SEQ ID NO: 912105 - protein, 9 aa, Homo Sapiens
QRKRQQYGN

SEQ ID NO: 912106 - protein, 9 aa, Homo Sapiens
NSKASSIPT

SEQ ID NO: 912107 - protein, 9 aa, Homo Sapiens
SDLDYGDND

SEQ ID NO: 912108 - protein, 9 aa, Homo Sapiens
KGTPNFRGE

SEQ ID NO: 912109 - protein, 9 aa, Homo Sapiens
KTPKEKDTE

SEQ ID NO: 912110 - protein, 9 aa, Homo Sapiens
SWKLALPVT

SEQ ID NO: 912111 - protein, 9 aa, Homo Sapiens
TYCNEPNGP

SEQ ID NO: 912112 - protein, 9 aa, Homo Sapiens
TFTVSAWDA

SEQ ID NO: 912113 - protein, 9 aa, Homo Sapiens
AHLEQVALY

SEQ ID NO: 912114 - protein, 9 aa, Homo Sapiens
KLKTKVKAY

SEQ ID NO: 912115 - protein, 9 aa, Homo Sapiens
GCALVILGG

SEQ ID NO: 912116 - protein, 9 aa, Homo Sapiens
GGPVVCNRT

SEQ ID NO: 912117 - protein, 9 aa, Homo Sapiens
HLRRHTGER

SEQ ID NO: 912118 - protein, 9 aa, Homo Sapiens
IGWAGCALV

SEQ ID NO: 912119 - protein, 9 aa, Homo Sapiens
KLRVQILND

SEQ ID NO: 912120 - protein, 9 aa, Homo Sapiens
IHVEDYNTP

SEQ ID NO: 912121 - protein, 9 aa, Homo Sapiens
PIALAIEVF

SEQ ID NO: 912122 - protein, 9 aa, Homo Sapiens
FLPPNLEIR

SEQ ID NO: 912123 - protein, 9 aa, Homo Sapiens
QPHEVPTVL

SEQ ID NO: 912124 - protein, 9 aa, Homo Sapiens
NLSKLRVQI

SEQ ID NO: 912125 - protein, 9 aa, Homo Sapiens
VVVTHGLAD

SEQ ID NO: 912126 - protein, 9 aa, Homo Sapiens
TIADSPDGG

SEQ ID NO: 912127 - protein, 9 aa, Homo Sapiens
KKCMLVGIV

SEQ ID NO: 912128 - protein, 9 aa, Homo Sapiens
YLPGVINTV

SEQ ID NO: 912129 - protein, 9 aa, Homo Sapiens
LQDLVDKLK

SEQ ID NO: 912130 - protein, 9 aa, Homo Sapiens
KEEICAVSI

SEQ ID NO: 912131 - protein, 9 aa, Homo Sapiens
SGGPVVCNR

SEQ ID NO: 912132 - protein, 9 aa, Homo Sapiens
EELNPPKEE

SEQ ID NO: 912133 - protein, 9 aa, Homo Sapiens
KNKTPKEKD

SEQ ID NO: 912134 - protein, 9 aa, Homo Sapiens
RLAHLEQVA

SEQ ID NO: 912135 - protein, 9 aa, Homo Sapiens
YPNGVHRYP

SEQ ID NO: 912136 - protein, 9 aa, Homo Sapiens
PSHGQPGSP

SEQ ID NO: 912137 - protein, 9 aa, Homo Sapiens
KKLEKKNKT

SEQ ID NO: 912138 - protein, 9 aa, Homo Sapiens
IIQHNTNSI

SEQ ID NO: 912139 - protein, 9 aa, Homo Sapiens
QRAHSESKI

SEQ ID NO: 912140 - protein, 9 aa, Homo Sapiens
NGPPELFDA

SEQ ID NO: 912141 - protein, 9 aa, Homo Sapiens
RSYLTTHLR

SEQ ID NO: 912142 - protein, 9 aa, Homo Sapiens
ASALRNNML

SEQ ID NO: 912143 - protein, 9 aa, Homo Sapiens
ESKILEDAH

SEQ ID NO: 912144 - protein, 9 aa, Homo Sapiens
HSESKILED

SEQ ID NO: 912145 - protein, 9 aa, Homo Sapiens
GIWNLTQDQ

SEQ ID NO: 912146 - protein, 9 aa, Homo Sapiens
NSHLLRHLC

SEQ ID NO: 912147 - protein, 9 aa, Homo Sapiens
SPFAPRRSP

SEQ ID NO: 912148 - protein, 9 aa, Homo Sapiens
SKEMTLNVL

SEQ ID NO: 912149 - protein, 9 aa, Homo Sapiens
SSSVPSHGQ

SEQ ID NO: 912150 - protein, 9 aa, Homo Sapiens
GVEITATFP

SEQ ID NO: 912151 - protein, 9 aa, Homo Sapiens
CALVILGGA

SEQ ID NO: 912152 - protein, 9 aa, Homo Sapiens
CAQTDLYFM

SEQ ID NO: 912153 - protein, 9 aa, Homo Sapiens
NGVHRYPAQ

SEQ ID NO: 912154 - protein, 9 aa, Homo Sapiens
YPDIYFLPT

SEQ ID NO: 912155 - protein, 9 aa, Homo Sapiens
HLEVKKCML

SEQ ID NO: 912156 - protein, 9 aa, Homo Sapiens
YRKDKDIPV

SEQ ID NO: 912157 - protein, 9 aa, Homo Sapiens
SDMEIWVNS

SEQ ID NO: 912158 - protein, 9 aa, Homo Sapiens
CAVSIKKAV

SEQ ID NO: 912159 - protein, 9 aa, Homo Sapiens
TLMMKVASG

SEQ ID NO: 912160 - protein, 9 aa, Homo Sapiens
DYGDNDFGA

SEQ ID NO: 912161 - protein, 9 aa, Homo Sapiens
ALLKIQYCP

SEQ ID NO: 912162 - protein, 9 aa, Homo Sapiens
QRMVLVYLP

SEQ ID NO: 912163 - protein, 9 aa, Homo Sapiens
CEGDSGGPV

SEQ ID NO: 912164 - protein, 9 aa, Homo Sapiens
VEITATFPR

SEQ ID NO: 912165 - protein, 9 aa, Homo Sapiens
LSPKGTPNF

SEQ ID NO: 912166 - protein, 9 aa, Homo Sapiens
KKNKTPKEK

SEQ ID NO: 912167 - protein, 9 aa, Homo Sapiens
KLEKKNKTP

SEQ ID NO: 912168 - protein, 9 aa, Homo Sapiens
DDIQEEDKG

SEQ ID NO: 912169 - protein, 9 aa, Homo Sapiens
CCDYPDIYF

SEQ ID NO: 912170 - protein, 9 aa, Homo Sapiens
QAQVEMQGC

SEQ ID NO: 912171 - protein, 9 aa, Homo Sapiens
RYPAQSPAA

SEQ ID NO: 912172 - protein, 9 aa, Homo Sapiens
NQLSMHQII

SEQ ID NO: 912173 - protein, 9 aa, Homo Sapiens
RPEELNPPK

SEQ ID NO: 912174 - protein, 9 aa, Homo Sapiens
SHRFPSPFA

SEQ ID NO: 912175 - protein, 9 aa, Homo Sapiens
VTADGVITL

SEQ ID NO: 912176 - protein, 9 aa, Homo Sapiens
ATFPRDVSP

SEQ ID NO: 912177 - protein, 9 aa, Homo Sapiens
RERSNVVRK

SEQ ID NO: 912178 - protein, 9 aa, Homo Sapiens
TADGVITLT

SEQ ID NO: 912179 - protein, 9 aa, Homo Sapiens
QLSMHQIIH

SEQ ID NO: 912180 - protein, 9 aa, Homo Sapiens
RFPSPFAPR

SEQ ID NO: 912181 - protein, 9 aa, Homo Sapiens
GPVVCNRTL

SEQ ID NO: 912182 - protein, 9 aa, Homo Sapiens
NWWFCAFPY

SEQ ID NO: 912183 - protein, 9 aa, Homo Sapiens
PTYLIIQHN

SEQ ID NO: 912184 - protein, 9 aa, Homo Sapiens
YGDNDFGAG

SEQ ID NO: 912185 - protein, 9 aa, Homo Sapiens
IFCNSKTAE

SEQ ID NO: 912186 - protein, 9 aa, Homo Sapiens
YEKSTKLQE

SEQ ID NO: 912187 - protein, 9 aa, Homo Sapiens
DIQEEDKGN

SEQ ID NO: 912188 - protein, 9 aa, Homo Sapiens
EVTLMMKVA

SEQ ID NO: 912189 - protein, 9 aa, Homo Sapiens
DYPDIYFLP

SEQ ID NO: 912190 - protein, 9 aa, Homo Sapiens
STYEEYRKD

SEQ ID NO: 912191 - protein, 9 aa, Homo Sapiens
PYDRGSDME

SEQ ID NO: 912192 - protein, 9 aa, Homo Sapiens
LKSEEYEKS

SEQ ID NO: 912193 - protein, 9 aa, Homo Sapiens
QLVRLAHLE

SEQ ID NO: 912194 - protein, 9 aa, Homo Sapiens
RQQYGNPKK

SEQ ID NO: 912195 - protein, 9 aa, Homo Sapiens
DNDFGAGRG

SEQ ID NO: 912196 - protein, 9 aa, Homo Sapiens
GWAGCALVI

SEQ ID NO: 912197 - protein, 9 aa, Homo Sapiens
LDYGDNDFG

SEQ ID NO: 912198 - protein, 9 aa, Homo Sapiens
ECSRALLKI

SEQ ID NO: 912199 - protein, 9 aa, Homo Sapiens
AIFIGWAGC

SEQ ID NO: 912200 - protein, 9 aa, Homo Sapiens
CLTTCCRTT

SEQ ID NO: 912201 - protein, 9 aa, Homo Sapiens
ADSPDGGGQ

SEQ ID NO: 912202 - protein, 9 aa, Homo Sapiens
PLEMCCDYP

SEQ ID NO: 912203 - protein, 9 aa, Homo Sapiens
HWEGPEFIS

SEQ ID NO: 912204 - protein, 9 aa, Homo Sapiens
LLKIQYCPH

SEQ ID NO: 912205 - protein, 9 aa, Homo Sapiens
RVQILNDNL

SEQ ID NO: 912206 - protein, 9 aa, Homo Sapiens
RMYPLKPNW

SEQ ID NO: 912207 - protein, 9 aa, Homo Sapiens
HSRAASALR

SEQ ID NO: 912208 - protein, 9 aa, Homo Sapiens
VTHGLADFS

SEQ ID NO: 912209 - protein, 9 aa, Homo Sapiens
EICAVSIKK

SEQ ID NO: 912210 - protein, 9 aa, Homo Sapiens
WIPDTIFCN

SEQ ID NO: 912211 - protein, 9 aa, Homo Sapiens
CCLTTCCRT

SEQ ID NO: 912212 - protein, 9 aa, Homo Sapiens
SCCRPSCCL

SEQ ID NO: 912213 - protein, 9 aa, Homo Sapiens
EEEEEGACM

SEQ ID NO: 912214 - protein, 9 aa, Homo Sapiens
TEGKKSGDS

SEQ ID NO: 912215 - protein, 9 aa, Homo Sapiens
GDNDFGAGR

SEQ ID NO: 912216 - protein, 9 aa, Homo Sapiens
DPGVEVTLM

SEQ ID NO: 912217 - protein, 9 aa, Homo Sapiens
CSRALLKIQ

SEQ ID NO: 912218 - protein, 9 aa, Homo Sapiens
PDGGGQRVK

SEQ ID NO: 912219 - protein, 9 aa, Homo Sapiens
ACMIVDVPD

SEQ ID NO: 912220 - protein, 9 aa, Homo Sapiens
VVCNRTLYG

SEQ ID NO: 912221 - protein, 9 aa, Homo Sapiens
TERAKEEIC

SEQ ID NO: 912222 - protein, 9 aa, Homo Sapiens
FISLEAHQQ

SEQ ID NO: 912223 - protein, 9 aa, Homo Sapiens
MMKVASGST

SEQ ID NO: 912224 - protein, 9 aa, Homo Sapiens
HGLADFSFS

SEQ ID NO: 912225 - protein, 9 aa, Homo Sapiens
DQAQVEMQG

SEQ ID NO: 912226 - protein, 9 aa, Homo Sapiens
NFRGETSLE

SEQ ID NO: 912227 - protein, 9 aa, Homo Sapiens
LEQVALYVD

SEQ ID NO: 912228 - protein, 9 aa, Homo Sapiens
YEEYRKDKD

SEQ ID NO: 912229 - protein, 9 aa, Homo Sapiens
QDQAQVEMQ

SEQ ID NO: 912230 - protein, 9 aa, Homo Sapiens
FPSPFAPRR

SEQ ID NO: 912231 - protein, 9 aa, Homo Sapiens
VEVTLMMKV

SEQ ID NO: 912232 - protein, 9 aa, Homo Sapiens
TEEACRPNT

SEQ ID NO: 912233 - protein, 9 aa, Homo Sapiens
RKVVVTHGL

SEQ ID NO: 912234 - protein, 9 aa, Homo Sapiens
GTPNFRGET

SEQ ID NO: 912235 - protein, 9 aa, Homo Sapiens
RRSPIALAI

SEQ ID NO: 912236 - protein, 9 aa, Homo Sapiens
AGSSSVPSH

SEQ ID NO: 912237 - protein, 9 aa, Homo Sapiens
SCCLTTCCR

SEQ ID NO: 912238 - protein, 9 aa, Homo Sapiens
LQESERLAR

SEQ ID NO: 912239 - protein, 9 aa, Homo Sapiens
EYRKDKDIP

SEQ ID NO: 912240 - protein, 9 aa, Homo Sapiens
PDTIFCNSK

SEQ ID NO: 912241 - protein, 9 aa, Homo Sapiens
ARKVVVTHG

SEQ ID NO: 912242 - protein, 9 aa, Homo Sapiens
TAAETEEKE

SEQ ID NO: 912243 - protein, 9 aa, Homo Sapiens
LEVKKCMLV

SEQ ID NO: 912244 - protein, 9 aa, Homo Sapiens
LTQDQAQVE

SEQ ID NO: 912245 - protein, 9 aa, Homo Sapiens
CDYPDIYFL

SEQ ID NO: 912246 - protein, 9 aa, Homo Sapiens
QQYGNPKKQ

SEQ ID NO: 912247 - protein, 9 aa, Homo Sapiens
DFGAGRGQL

SEQ ID NO: 912248 - protein, 9 aa, Homo Sapiens
DGVITLTRA

SEQ ID NO: 912249 - protein, 9 aa, Homo Sapiens
QDLVDKLKT

SEQ ID NO: 912250 - protein, 9 aa, Homo Sapiens
PATYCNEPN

SEQ ID NO: 912251 - protein, 9 aa, Homo Sapiens
KLALPVTAL

SEQ ID NO: 912252 - protein, 9 aa, Homo Sapiens
DHKSTYEEY

SEQ ID NO: 912253 - protein, 9 aa, Homo Sapiens
AQALQESER

SEQ ID NO: 912254 - protein, 9 aa, Homo Sapiens
VTLMMKVAS

SEQ ID NO: 912255 - protein, 9 aa, Homo Sapiens
QYGNPKKQG

SEQ ID NO: 912256 - protein, 9 aa, Homo Sapiens
VFNGLNLSK

SEQ ID NO: 912257 - protein, 9 aa, Homo Sapiens
PNWWFCAFP

SEQ ID NO: 912258 - protein, 9 aa, Homo Sapiens
TIFCNSKTA

SEQ ID NO: 912259 - protein, 9 aa, Homo Sapiens
DYNTPSELA

SEQ ID NO: 912260 - protein, 9 aa, Homo Sapiens
LVYLPGVIN

SEQ ID NO: 912261 - protein, 9 aa, Homo Sapiens
GCFLLIPLS

SEQ ID NO: 912262 - protein, 9 aa, Homo Sapiens
LKPNWWFCA

SEQ ID NO: 912263 - protein, 9 aa, Homo Sapiens
EEGACMIVD

SEQ ID NO: 912264 - protein, 9 aa, Homo Sapiens
SEEYEKSTK

SEQ ID NO: 912265 - protein, 9 aa, Homo Sapiens
TEEKEISQA

SEQ ID NO: 912266 - protein, 9 aa, Homo Sapiens
VVTHGLADF

SEQ ID NO: 912267 - protein, 9 aa, Homo Sapiens
TEGVEITAT

SEQ ID NO: 912268 - protein, 9 aa, Homo Sapiens
FFETRPEEL

SEQ ID NO: 912269 - protein, 9 aa, Homo Sapiens
RQQRERSNV

SEQ ID NO: 912270 - protein, 9 aa, Homo Sapiens
KRQQYGNPK

SEQ ID NO: 912271 - protein, 9 aa, Homo Sapiens
HRYPAQSPA

SEQ ID NO: 912272 - protein, 9 aa, Homo Sapiens
DTEGKKSGD

SEQ ID NO: 912273 - protein, 9 aa, Homo Sapiens
ELNPPKEEH

SEQ ID NO: 912274 - protein, 9 aa, Homo Sapiens
VRLAHLEQV

SEQ ID NO: 912275 - protein, 9 aa, Homo Sapiens
SALRNNMLE

SEQ ID NO: 912276 - protein, 9 aa, Homo Sapiens
GRSFLPPNL

SEQ ID NO: 912277 - protein, 9 aa, Homo Sapiens
EGDSGGPVV

SEQ ID NO: 912278 - protein, 9 aa, Homo Sapiens
HLVAQGRSF

SEQ ID NO: 912279 - protein, 9 aa, Homo Sapiens
NTPSELAKY

SEQ ID NO: 912280 - protein, 9 aa, Homo Sapiens
IQEEDKGNV

SEQ ID NO: 912281 - protein, 9 aa, Homo Sapiens
HLLRHLCTH

SEQ ID NO: 912282 - protein, 9 aa, Homo Sapiens
SHGQPGSPS

SEQ ID NO: 912283 - protein, 9 aa, Homo Sapiens
KDTEGKKSG

SEQ ID NO: 912284 - protein, 9 aa, Homo Sapiens
GYNSCAQTD

SEQ ID NO: 912285 - protein, 9 aa, Homo Sapiens
KKSGDSGRA

SEQ ID NO: 912286 - protein, 9 aa, Homo Sapiens
LGTASKEMT

SEQ ID NO: 912287 - protein, 9 aa, Homo Sapiens
EEYRKDKDI

SEQ ID NO: 912288 - protein, 9 aa, Homo Sapiens
LRHADSSNF

SEQ ID NO: 912289 - protein, 9 aa, Homo Sapiens
NNPPGCHTF

SEQ ID NO: 912290 - protein, 9 aa, Homo Sapiens
RALLKIQYC

SEQ ID NO: 912291 - protein, 9 aa, Homo Sapiens
GAQRRRSPI

SEQ ID NO: 912292 - protein, 9 aa, Homo Sapiens
VRKLHPGLP

SEQ ID NO: 912293 - protein, 9 aa, Homo Sapiens
VLVYLPGVI

SEQ ID NO: 912294 - protein, 9 aa, Homo Sapiens
QEEDKGNVK

SEQ ID NO: 912295 - protein, 9 aa, Homo Sapiens
DLDYGDNDF

SEQ ID NO: 912296 - protein, 9 aa, Homo Sapiens
LKTKVKAYK

SEQ ID NO: 912297 - protein, 9 aa, Homo Sapiens
EITATFPRD

SEQ ID NO: 912298 - protein, 9 aa, Homo Sapiens
QLLTEEACR

SEQ ID NO: 912299 - protein, 9 aa, Homo Sapiens
YEKLKSEEY

SEQ ID NO: 912300 - protein, 9 aa, Homo Sapiens
QRERSNVVR

SEQ ID NO: 912301 - protein, 9 aa, Homo Sapiens
AKKKLEKKN

SEQ ID NO: 912302 - protein, 9 aa, Homo Sapiens
SFLPPNLEI

SEQ ID NO: 912303 - protein, 9 aa, Homo Sapiens
ALYPNGVHR

SEQ ID NO: 912304 - protein, 9 aa, Homo Sapiens
HLEQVALYV

SEQ ID NO: 912305 - protein, 9 aa, Homo Sapiens
SPIALAIEV

SEQ ID NO: 912306 - protein, 9 aa, Homo Sapiens
EGPEFISLE

SEQ ID NO: 912307 - protein, 9 aa, Homo Sapiens
RAKEEICAV

SEQ ID NO: 912308 - protein, 9 aa, Homo Sapiens
YCNEPNGPP

SEQ ID NO: 912309 - protein, 9 aa, Homo Sapiens
KCMLVGIVG

SEQ ID NO: 912310 - protein, 9 aa, Homo Sapiens
EGACMIVDV

SEQ ID NO: 912311 - protein, 9 aa, Homo Sapiens
LVRLAHLEQ

SEQ ID NO: 912312 - protein, 9 aa, Homo Sapiens
RLLRGYDQY

SEQ ID NO: 912313 - protein, 9 aa, Homo Sapiens
SPDGGGQRV

SEQ ID NO: 912314 - protein, 9 aa, Homo Sapiens
SRAASALRN

SEQ ID NO: 912315 - protein, 9 aa, Homo Sapiens
PGCHTFTVS

SEQ ID NO: 912316 - protein, 9 aa, Homo Sapiens
IQLLTEEAC

SEQ ID NO: 912317 - protein, 9 aa, Homo Sapiens
AWTRSTCIL

SEQ ID NO: 912318 - protein, 9 aa, Homo Sapiens
NKTPKEKDT

SEQ ID NO: 912319 - protein, 9 aa, Homo Sapiens
AETEEKEIS

SEQ ID NO: 912320 - protein, 9 aa, Homo Sapiens
LLGCFLLIP

SEQ ID NO: 912321 - protein, 9 aa, Homo Sapiens
GCHTFTVSA

SEQ ID NO: 912322 - protein, 9 aa, Homo Sapiens
LEKKNKTPK

SEQ ID NO: 912323 - protein, 9 aa, Homo Sapiens
DKLKTKVKA

SEQ ID NO: 912324 - protein, 9 aa, Homo Sapiens
FALRHADSS

SEQ ID NO: 912325 - protein, 9 aa, Homo Sapiens
NSCAQTDLY

SEQ ID NO: 912326 - protein, 9 aa, Homo Sapiens
MAWTRSTCI

SEQ ID NO: 912327 - protein, 9 aa, Homo Sapiens
ELQRAHSES

SEQ ID NO: 912328 - protein, 9 aa, Homo Sapiens
RENSKASSI

SEQ ID NO: 912329 - protein, 9 aa, Homo Sapiens
PNFRGETSL

SEQ ID NO: 912330 - protein, 9 aa, Homo Sapiens
TQDQAQVEM

SEQ ID NO: 912331 - protein, 9 aa, Homo Sapiens
NHEYFALRH

SEQ ID NO: 912332 - protein, 9 aa, Homo Sapiens
ISHLEVKKC

SEQ ID NO: 912333 - protein, 9 aa, Homo Sapiens
VAQGRSFLP

SEQ ID NO: 912334 - protein, 9 aa, Homo Sapiens
RAHSESKIL

SEQ ID NO: 912335 - protein, 9 aa, Homo Sapiens
CTHARETLY

SEQ ID NO: 912336 - protein, 9 aa, Homo Sapiens
KSGDSGRAE

SEQ ID NO: 912337 - protein, 9 aa, Homo Sapiens
SLEAHQQNK

SEQ ID NO: 912338 - protein, 9 aa, Homo Sapiens
HRFPSPFAP

SEQ ID NO: 912339 - protein, 9 aa, Homo Sapiens
VQILNDNLI

SEQ ID NO: 912340 - protein, 9 aa, Homo Sapiens
ATAAETEEK

SEQ ID NO: 912341 - protein, 9 aa, Homo Sapiens
EEEEEEGAC

SEQ ID NO: 912342 - protein, 9 aa, Homo Sapiens
HEALDQSMT

SEQ ID NO: 912343 - protein, 9 aa, Homo Sapiens
EVPTVLGTP

SEQ ID NO: 912344 - protein, 9 aa, Homo Sapiens
DRGSDMEIW

SEQ ID NO: 912345 - protein, 9 aa, Homo Sapiens
WKLALPVTA

SEQ ID NO: 912346 - protein, 9 aa, Homo Sapiens
QKRENSKAS

SEQ ID NO: 912347 - protein, 9 aa, Homo Sapiens
CHTFTVSAW

SEQ ID NO: 912348 - protein, 9 aa, Homo Sapiens
LQRMVLVYL

SEQ ID NO: 912349 - protein, 9 aa, Homo Sapiens
QQRDSLSHV

SEQ ID NO: 912350 - protein, 9 aa, Homo Sapiens
GYDQYAYDG

SEQ ID NO: 912351 - protein, 9 aa, Homo Sapiens
RSDGGGAVR

SEQ ID NO: 912352 - protein, 9 aa, Homo Sapiens
FAPRRSPTP

SEQ ID NO: 912353 - protein, 9 aa, Homo Sapiens
SHLEVKKCM

SEQ ID NO: 912354 - protein, 9 aa, Homo Sapiens
LPLEMCCDY

SEQ ID NO: 912355 - protein, 9 aa, Homo Sapiens
EYEKSTKLQ

SEQ ID NO: 912356 - protein, 9 aa, Homo Sapiens
YPLKPNWWF

SEQ ID NO: 912357 - protein, 9 aa, Homo Sapiens
HVEDYNTPS

SEQ ID NO: 912358 - protein, 9 aa, Homo Sapiens
SKILEDAHS

SEQ ID NO: 912359 - protein, 9 aa, Homo Sapiens
TASKEMTLN

SEQ ID NO: 912360 - protein, 9 aa, Homo Sapiens
VTALRLSWL

SEQ ID NO: 912361 - protein, 9 aa, Homo Sapiens
GPTYLIIQH

SEQ ID NO: 912362 - protein, 9 aa, Homo Sapiens
HLCTHARET

SEQ ID NO: 912363 - protein, 9 aa, Homo Sapiens
IWNLTQDQA

SEQ ID NO: 912364 - protein, 9 aa, Homo Sapiens
KDDIQEEDK

SEQ ID NO: 912365 - protein, 9 aa, Homo Sapiens
EFISLEAHQ

SEQ ID NO: 912366 - protein, 9 aa, Homo Sapiens
SGDSGRAER

SEQ ID NO: 912367 - protein, 9 aa, Homo Sapiens
ILVCQKREN

SEQ ID NO: 912368 - protein, 9 aa, Homo Sapiens
LPVTALRLS

SEQ ID NO: 912369 - protein, 9 aa, Homo Sapiens
IPLSYAFIV

SEQ ID NO: 912370 - protein, 9 aa, Homo Sapiens
EKDTEGKKS

SEQ ID NO: 912371 - protein, 9 aa, Homo Sapiens
CMLVGIVGK

SEQ ID NO: 912372 - protein, 9 aa, Homo Sapiens
ENNPPGCHT

SEQ ID NO: 912373 - protein, 9 aa, Homo Sapiens
KKDDIQEED

SEQ ID NO: 912374 - protein, 9 aa, Homo Sapiens
DRGYNSCAQ

SEQ ID NO: 912375 - protein, 9 aa, Homo Sapiens
CRPSCCLTT

SEQ ID NO: 912376 - protein, 9 aa, Homo Sapiens
DLVDKLKTK

SEQ ID NO: 912377 - protein, 9 aa, Homo Sapiens
LVAQGRSFL

SEQ ID NO: 912378 - protein, 9 aa, Homo Sapiens
CFLLIPLSY

SEQ ID NO: 912379 - protein, 9 aa, Homo Sapiens
YDRGSDMEI

SEQ ID NO: 912380 - protein, 9 aa, Homo Sapiens
SCAQTDLYF

SEQ ID NO: 912381 - protein, 9 aa, Homo Sapiens
VHRYPAQSP

SEQ ID NO: 912382 - protein, 9 aa, Homo Sapiens
EALDQSMTA

SEQ ID NO: 912383 - protein, 9 aa, Homo Sapiens
LKIQYCPHC

SEQ ID NO: 912384 - protein, 9 aa, Homo Sapiens
RNLSKLRVQ

SEQ ID NO: 912385 - protein, 9 aa, Homo Sapiens
SHVFNGLNL

SEQ ID NO: 912386 - protein, 9 aa, Homo Sapiens
AQRRRSPIA

SEQ ID NO: 912387 - protein, 9 aa, Homo Sapiens
PLSYAFIVA

SEQ ID NO: 912388 - protein, 9 aa, Homo Sapiens
VDKLKTKVK

SEQ ID NO: 912389 - protein, 9 aa, Homo Sapiens
FIHVEDYNT

SEQ ID NO: 912390 - protein, 9 aa, Homo Sapiens
EMTLNVLGR

SEQ ID NO: 912391 - protein, 9 aa, Homo Sapiens
ETRPEELNP

SEQ ID NO: 912392 - protein, 9 aa, Homo Sapiens
YFALRHADS

SEQ ID NO: 912393 - protein, 9 aa, Homo Sapiens
ITATFPRDV

SEQ ID NO: 912394 - protein, 9 aa, Homo Sapiens
HVFNGLNLS

SEQ ID NO: 912395 - protein, 9 aa, Homo Sapiens
EKEISQAME

SEQ ID NO: 912396 - protein, 9 aa, Homo Sapiens
GACMIVDVP

SEQ ID NO: 912397 - protein, 9 aa, Homo Sapiens
PLKPNWWFC

SEQ ID NO: 912398 - protein, 9 aa, Homo Sapiens
PNGVHRYPA

SEQ ID NO: 912399 - protein, 9 aa, Homo Sapiens
VEDYNTPSE

SEQ ID NO: 912400 - protein, 9 aa, Homo Sapiens
EVKKCMLVG

SEQ ID NO: 912401 - protein, 9 aa, Homo Sapiens
KRENSKASS

SEQ ID NO: 912402 - protein, 9 aa, Homo Sapiens
HTFTVSAWD

SEQ ID NO: 912403 - protein, 9 aa, Homo Sapiens
IQYCPHCQG

SEQ ID NO: 912404 - protein, 9 aa, Homo Sapiens
FCNSKTAEA

SEQ ID NO: 912405 - protein, 9 aa, Homo Sapiens
DMEIWVNSS

SEQ ID NO: 912406 - protein, 9 aa, Homo Sapiens
AHSESKILE

SEQ ID NO: 912407 - protein, 9 aa, Homo Sapiens
SSVPSHGQP

SEQ ID NO: 912408 - protein, 9 aa, Homo Sapiens
RNQLSMHQI

SEQ ID NO: 912409 - protein, 9 aa, Homo Sapiens
QRRRSPIAL

SEQ ID NO: 912410 - protein, 9 aa, Homo Sapiens
ASKEMTLNV

SEQ ID NO: 912411 - protein, 9 aa, Homo Sapiens
AGQIRAQAL

SEQ ID NO: 912412 - protein, 9 aa, Homo Sapiens
IQHNTNSII

SEQ ID NO: 912413 - protein, 9 aa, Homo Sapiens
TVLGTPLLQ

SEQ ID NO: 912414 - protein, 9 aa, Homo Sapiens
LIPLSYAFI

SEQ ID NO: 912415 - protein, 9 aa, Homo Sapiens
VPSHGQPGS

SEQ ID NO: 912416 - protein, 9 aa, Homo Sapiens
NDFGAGRGQ

SEQ ID NO: 912417 - protein, 9 aa, Homo Sapiens
NPKKQGSTT

SEQ ID NO: 912418 - protein, 9 aa, Homo Sapiens
GTASKEMTL

SEQ ID NO: 912419 - protein, 9 aa, Homo Sapiens
LLRGYDQYA

SEQ ID NO: 912420 - protein, 9 aa, Homo Sapiens
ICAVSIKKA

SEQ ID NO: 912421 - protein, 9 aa, Homo Sapiens
PKEKDTEGK

SEQ ID NO: 912422 - protein, 9 aa, Homo Sapiens
KVVVTHGLA

SEQ ID NO: 912423 - protein, 9 aa, Homo Sapiens
LVDKLKTKV

SEQ ID NO: 912424 - protein, 9 aa, Homo Sapiens
AQTDLYFMP

SEQ ID NO: 912425 - protein, 9 aa, Homo Sapiens
HNTNSIIGD

SEQ ID NO: 912426 - protein, 9 aa, Homo Sapiens
TKKKDDIQE

SEQ ID NO: 912427 - protein, 9 aa, Homo Sapiens
ALRNNMLEP

SEQ ID NO: 912428 - protein, 9 aa, Homo Sapiens
GVITLTRAF

SEQ ID NO: 912429 - protein, 9 aa, Homo Sapiens
RGYDQYAYD

SEQ ID NO: 912430 - protein, 9 aa, Homo Sapiens
EACRPNTAL

SEQ ID NO: 912431 - protein, 9 aa, Homo Sapiens
TATFPRDVS

SEQ ID NO: 912432 - protein, 9 aa, Homo Sapiens
YLTTHLRRH

SEQ ID NO: 912433 - protein, 9 aa, Homo Sapiens
KSEEYEKST

SEQ ID NO: 912434 - protein, 9 aa, Homo Sapiens
GLQRMVLVY

SEQ ID NO: 912435 - protein, 9 aa, Homo Sapiens
DSPDGGGQR

SEQ ID NO: 912436 - protein, 9 aa, Homo Sapiens
EKLKSEEYE

SEQ ID NO: 912437 - protein, 9 aa, Homo Sapiens
KIQYCPHCQ

SEQ ID NO: 912438 - protein, 9 aa, Homo Sapiens
PSPFAPRRS

SEQ ID NO: 912439 - protein, 9 aa, Homo Sapiens
EEYEKSTKL

SEQ ID NO: 912440 - protein, 9 aa, Homo Sapiens
CNEPNGPPE

SEQ ID NO: 912441 - protein, 9 aa, Homo Sapiens
KKKDDIQEE

SEQ ID NO: 912442 - protein, 9 aa, Homo Sapiens
ALQESERLA

SEQ ID NO: 912443 - protein, 9 aa, Homo Sapiens
KTKVKAYKR

SEQ ID NO: 912444 - protein, 9 aa, Homo Sapiens
ANHEYFALR

SEQ ID NO: 912445 - protein, 9 aa, Homo Sapiens
SLSHVFNGL

SEQ ID NO: 912446 - protein, 9 aa, Homo Sapiens
RAASALRNN

SEQ ID NO: 912447 - protein, 9 aa, Homo Sapiens
LRMYPLKPN

SEQ ID NO: 912448 - protein, 9 aa, Homo Sapiens
TTHLRRHTG

SEQ ID NO: 912449 - protein, 9 aa, Homo Sapiens
FSHRFPSPF

SEQ ID NO: 912450 - protein, 9 aa, Homo Sapiens
TPNFRGETS

SEQ ID NO: 912451 - protein, 9 aa, Homo Sapiens
SRALLKIQY

SEQ ID NO: 912452 - protein, 9 aa, Homo Sapiens
WEGPEFISL

SEQ ID NO: 912453 - protein, 9 aa, Homo Sapiens
GLADFSFSL

SEQ ID NO: 912454 - protein, 9 aa, Homo Sapiens
VKKCMLVGI

SEQ ID NO: 912455 - protein, 9 aa, Homo Sapiens
VPTVLGTPL

SEQ ID NO: 912456 - protein, 9 aa, Homo Sapiens
TRSTCILFF

SEQ ID NO: 912457 - protein, 9 aa, Homo Sapiens
FRGETSLEL

SEQ ID NO: 912458 - protein, 9 aa, Homo Sapiens
GSSSVPSHG

SEQ ID NO: 912459 - protein, 9 aa, Homo Sapiens
QILNDNLIP

SEQ ID NO: 912460 - protein, 9 aa, Homo Sapiens
LRHLCTHAR

SEQ ID NO: 912461 - protein, 9 aa, Homo Sapiens
KVTADGVIT

SEQ ID NO: 912462 - protein, 9 aa, Homo Sapiens
EEEEGACMI

SEQ ID NO: 912463 - protein, 9 aa, Homo Sapiens
TRNQLSMHQ

SEQ ID NO: 912464 - protein, 9 aa, Homo Sapiens
ISWKLALPV

SEQ ID NO: 912465 - protein, 9 aa, Homo Sapiens
RNNMLEPVG

SEQ ID NO: 912466 - protein, 9 aa, Homo Sapiens
AKEEICAVS

SEQ ID NO: 912467 - protein, 9 aa, Homo Sapiens
IRAQALQES

SEQ ID NO: 912468 - protein, 9 aa, Homo Sapiens
PFAPRRSPT

SEQ ID NO: 912469 - protein, 9 aa, Homo Sapiens
FETRPEELN

SEQ ID NO: 912470 - protein, 9 aa, Homo Sapiens
EEICAVSIK

SEQ ID NO: 912471 - protein, 9 aa, Homo Sapiens
PTVLGTPLL

SEQ ID NO: 912472 - protein, 9 aa, Homo Sapiens
LTTCCRTTC

SEQ ID NO: 912473 - protein, 9 aa, Homo Sapiens
QTDLYFMPL

SEQ ID NO: 912474 - protein, 9 aa, Homo Sapiens
GFTIADSPD

SEQ ID NO: 912475 - protein, 9 aa, Homo Sapiens
LRNNMLEPV

SEQ ID NO: 912476 - protein, 9 aa, Homo Sapiens
IALAIEVFE

SEQ ID NO: 912477 - protein, 9 aa, Homo Sapiens
GKKSGDSGR

SEQ ID NO: 912478 - protein, 9 aa, Homo Sapiens
AQGRSFLPP

SEQ ID NO: 912479 - protein, 9 aa, Homo Sapiens
YNSCAQTDL

SEQ ID NO: 912480 - protein, 9 aa, Homo Sapiens
NPPGCHTFT

SEQ ID NO: 912481 - protein, 9 aa, Homo Sapiens
QIRAQALQE

SEQ ID NO: 912482 - protein, 9 aa, Homo Sapiens
WTRSTCILF

SEQ ID NO: 912483 - protein, 9 aa, Homo Sapiens
RKRQQYGNP

SEQ ID NO: 912484 - protein, 9 aa, Homo Sapiens
MTLNVLGRP

SEQ ID NO: 912485 - protein, 9 aa, Homo Sapiens
SRSYLTTHL

SEQ ID NO: 912486 - protein, 9 aa, Homo Sapiens
EEACRPNTA

SEQ ID NO: 912487 - protein, 9 aa, Homo Sapiens
LAHLEQVAL

SEQ ID NO: 912488 - protein, 9 aa, Homo Sapiens
YDQYAYDGK

SEQ ID NO: 912489 - protein, 9 aa, Homo Sapiens
EKKNKTPKE

SEQ ID NO: 912490 - protein, 9 aa, Homo Sapiens
EQPHEVPTV

SEQ ID NO: 912491 - protein, 9 aa, Homo Sapiens
LQRAHSESK

SEQ ID NO: 912492 - protein, 9 aa, Homo Sapiens
QALQESERL

SEQ ID NO: 912493 - protein, 9 aa, Homo Sapiens
GGGAVRKLH

SEQ ID NO: 912494 - protein, 9 aa, Homo Sapiens
PHEVPTVLG

SEQ ID NO: 912495 - protein, 9 aa, Homo Sapiens
GPEFISLEA

SEQ ID NO: 912496 - protein, 9 aa, Homo Sapiens
RRRSPIALA

SEQ ID NO: 912497 - protein, 9 aa, Homo Sapiens
EGVEITATF

SEQ ID NO: 912498 - protein, 9 aa, Homo Sapiens
QHNTNSIIG

SEQ ID NO: 912499 - protein, 9 aa, Homo Sapiens
NEPNGPPEL

SEQ ID NO: 912500 - protein, 9 aa, Homo Sapiens
VITLTRAFL

SEQ ID NO: 912501 - protein, 9 aa, Homo Sapiens
HKSTYEEYR

SEQ ID NO: 912502 - protein, 9 aa, Homo Sapiens
VCQKRENSK

SEQ ID NO: 912503 - protein, 9 aa, Homo Sapiens
SMTALDLFL

SEQ ID NO: 912504 - protein, 9 aa, Homo Sapiens
AASALRNNM

SEQ ID NO: 912505 - protein, 9 aa, Homo Sapiens
PEFISLEAH

SEQ ID NO: 912506 - protein, 9 aa, Homo Sapiens
GGAVRKLHP

SEQ ID NO: 912507 - protein, 9 aa, Homo Sapiens
LGCFLLIPL

SEQ ID NO: 912508 - protein, 9 aa, Homo Sapiens
PVTALRLSW

SEQ ID NO: 912509 - protein, 9 aa, Homo Sapiens
RHLCTHARE

SEQ ID NO: 912510 - protein, 9 aa, Homo Sapiens
RGSDMEIWV

SEQ ID NO: 912511 - protein, 9 aa, Homo Sapiens
QGRSFLPPN

SEQ ID NO: 912512 - protein, 9 aa, Homo Sapiens
ETKKKDDIQ

SEQ ID NO: 912513 - protein, 9 aa, Homo Sapiens
SDGGGAVRK

SEQ ID NO: 912514 - protein, 9 aa, Homo Sapiens
CNSKTAEAH

SEQ ID NO: 912515 - protein, 9 aa, Homo Sapiens
TLNVLGRPG

SEQ ID NO: 912516 - protein, 9 aa, Homo Sapiens
PSCCLTTCC

SEQ ID NO: 912517 - protein, 9 aa, Homo Sapiens
ISLEAHQQN

SEQ ID NO: 912518 - protein, 9 aa, Homo Sapiens
IFIGWAGCA

SEQ ID NO: 912519 - protein, 9 aa, Homo Sapiens
PKGTPNFRG

SEQ ID NO: 912520 - protein, 9 aa, Homo Sapiens
EPNGPPELF

SEQ ID NO: 912521 - protein, 9 aa, Homo Sapiens
QFFETRPEE

SEQ ID NO: 912522 - protein, 9 aa, Homo Sapiens
ETEEKEISQ

SEQ ID NO: 912523 - protein, 9 aa, Homo Sapiens
EIWVNSSDG

SEQ ID NO: 912524 - protein, 9 aa, Homo Sapiens
RGRWQSNVH

SEQ ID NO: 912525 - protein, 9 aa, Homo Sapiens
RRKSSWQSW

SEQ ID NO: 912526 - protein, 9 aa, Homo Sapiens
GDVVSKFSV

SEQ ID NO: 912527 - protein, 9 aa, Homo Sapiens
QSWPFGELL

SEQ ID NO: 912528 - protein, 9 aa, Homo Sapiens
HTFTLSLPC

SEQ ID NO: 912529 - protein, 9 aa, Homo Sapiens
EKNGSRGSR

SEQ ID NO: 912530 - protein, 9 aa, Homo Sapiens
RHQKEGYGL

SEQ ID NO: 912531 - protein, 9 aa, Homo Sapiens
YKGLSVRCV

SEQ ID NO: 912532 - protein, 9 aa, Homo Sapiens
LCANANGSE

SEQ ID NO: 912533 - protein, 9 aa, Homo Sapiens
SYIFILLSV

SEQ ID NO: 912534 - protein, 9 aa, Homo Sapiens
VWAEKNGSR

SEQ ID NO: 912535 - protein, 9 aa, Homo Sapiens
YPPHLNSQD

SEQ ID NO: 912536 - protein, 9 aa, Homo Sapiens
CKEAINVLS

SEQ ID NO: 912537 - protein, 9 aa, Homo Sapiens
VARFCYFED

SEQ ID NO: 912538 - protein, 9 aa, Homo Sapiens
RDHKLIRKK

SEQ ID NO: 912539 - protein, 9 aa, Homo Sapiens
TDRRIEVNA

SEQ ID NO: 912540 - protein, 9 aa, Homo Sapiens
IIISYIFIL

SEQ ID NO: 912541 - protein, 9 aa, Homo Sapiens
LSPPRRLLL

SEQ ID NO: 912542 - protein, 9 aa, Homo Sapiens
DQLIQDSPE

SEQ ID NO: 912543 - protein, 9 aa, Homo Sapiens
SNARGRWQS

SEQ ID NO: 912544 - protein, 9 aa, Homo Sapiens
GGGLSVKGT

SEQ ID NO: 912545 - protein, 9 aa, Homo Sapiens
LNSQDTLKN

SEQ ID NO: 912546 - protein, 9 aa, Homo Sapiens
FMATHQNEP

SEQ ID NO: 912547 - protein, 9 aa, Homo Sapiens
KKSVKAICN

SEQ ID NO: 912548 - protein, 9 aa, Homo Sapiens
VEKHAQNVS

SEQ ID NO: 912549 - protein, 9 aa, Homo Sapiens
HGLLCWVLL

SEQ ID NO: 912550 - protein, 9 aa, Homo Sapiens
APEVSREDS

SEQ ID NO: 912551 - protein, 9 aa, Homo Sapiens
VKAICNSGQ

SEQ ID NO: 912552 - protein, 9 aa, Homo Sapiens
WGWGWSNAR

SEQ ID NO: 912553 - protein, 9 aa, Homo Sapiens
QEPNWGKGP

SEQ ID NO: 912554 - protein, 9 aa, Homo Sapiens
RRRKSSWQS

SEQ ID NO: 912555 - protein, 9 aa, Homo Sapiens
FCYFEDIYG

SEQ ID NO: 912556 - protein, 9 aa, Homo Sapiens
RKGARKAGK

SEQ ID NO: 912557 - protein, 9 aa, Homo Sapiens
RTSSLALNL

SEQ ID NO: 912558 - protein, 9 aa, Homo Sapiens
GHGLALYRT

SEQ ID NO: 912559 - protein, 9 aa, Homo Sapiens
RAERTAPRR

SEQ ID NO: 912560 - protein, 9 aa, Homo Sapiens
TRLDMMDED

SEQ ID NO: 912561 - protein, 9 aa, Homo Sapiens
PVNASRCSW

SEQ ID NO: 912562 - protein, 9 aa, Homo Sapiens
DYEVAERIW

SEQ ID NO: 912563 - protein, 9 aa, Homo Sapiens
ISVIPGPKT

SEQ ID NO: 912564 - protein, 9 aa, Homo Sapiens
QTGGGNTPR

SEQ ID NO: 912565 - protein, 9 aa, Homo Sapiens
KLGIGGTES

SEQ ID NO: 912566 - protein, 9 aa, Homo Sapiens
NVGQVNKHD

SEQ ID NO: 912567 - protein, 9 aa, Homo Sapiens
SNVHHSWRT

SEQ ID NO: 912568 - protein, 9 aa, Homo Sapiens
TEKIVAMTM

SEQ ID NO: 912569 - protein, 9 aa, Homo Sapiens
PAQTGGGNT

SEQ ID NO: 912570 - protein, 9 aa, Homo Sapiens
TSRLQEAQP

SEQ ID NO: 912571 - protein, 9 aa, Homo Sapiens
LLSLNEDPR

SEQ ID NO: 912572 - protein, 9 aa, Homo Sapiens
YLLLSLNED

SEQ ID NO: 912573 - protein, 9 aa, Homo Sapiens
EQEVISLQL

SEQ ID NO: 912574 - protein, 9 aa, Homo Sapiens
GSRGSRQNV

SEQ ID NO: 912575 - protein, 9 aa, Homo Sapiens
ARGRVARFC

SEQ ID NO: 912576 - protein, 9 aa, Homo Sapiens
NSTAKVSLL

SEQ ID NO: 912577 - protein, 9 aa, Homo Sapiens
QIPTFVEES

SEQ ID NO: 912578 - protein, 9 aa, Homo Sapiens
LALNLPTLP

SEQ ID NO: 912579 - protein, 9 aa, Homo Sapiens
LLTPKLFNS

SEQ ID NO: 912580 - protein, 9 aa, Homo Sapiens
IFILLSVLK

SEQ ID NO: 912581 - protein, 9 aa, Homo Sapiens
GAGSKLIFG

SEQ ID NO: 912582 - protein, 9 aa, Homo Sapiens
RGYVCTARW

SEQ ID NO: 912583 - protein, 9 aa, Homo Sapiens
TQDVISRLS

SEQ ID NO: 912584 - protein, 9 aa, Homo Sapiens
EKINLTVVR

SEQ ID NO: 912585 - protein, 9 aa, Homo Sapiens
PRRLLLLLL

SEQ ID NO: 912586 - protein, 9 aa, Homo Sapiens
VSKFSVVNP

SEQ ID NO: 912587 - protein, 9 aa, Homo Sapiens
DKKNWKGKI

SEQ ID NO: 912588 - protein, 9 aa, Homo Sapiens
SPHRAMAPL

SEQ ID NO: 912589 - protein, 9 aa, Homo Sapiens
YIVANKEGQ

SEQ ID NO: 912590 - protein, 9 aa, Homo Sapiens
AAPLVALVA

SEQ ID NO: 912591 - protein, 9 aa, Homo Sapiens
FDFMATHQN

SEQ ID NO: 912592 - protein, 9 aa, Homo Sapiens
NWKGKIIAV

SEQ ID NO: 912593 - protein, 9 aa, Homo Sapiens
QVISLFLLD

SEQ ID NO: 912594 - protein, 9 aa, Homo Sapiens
EPVLEGWMP

SEQ ID NO: 912595 - protein, 9 aa, Homo Sapiens
GGGNTPRPS

SEQ ID NO: 912596 - protein, 9 aa, Homo Sapiens
FTVSTQKNV

SEQ ID NO: 912597 - protein, 9 aa, Homo Sapiens
KSIHDSLCS

SEQ ID NO: 912598 - protein, 9 aa, Homo Sapiens
TISVIPGPK

SEQ ID NO: 912599 - protein, 9 aa, Homo Sapiens
SCGNGTEGF

SEQ ID NO: 912600 - protein, 9 aa, Homo Sapiens
MDEDEVEVS

SEQ ID NO: 912601 - protein, 9 aa, Homo Sapiens
LNRGLKKKK

SEQ ID NO: 912602 - protein, 9 aa, Homo Sapiens
RPGACEESN

SEQ ID NO: 912603 - protein, 9 aa, Homo Sapiens
QSHFVQQTL

SEQ ID NO: 912604 - protein, 9 aa, Homo Sapiens
FVRHWQDLG

SEQ ID NO: 912605 - protein, 9 aa, Homo Sapiens
RGAAPLVAL

SEQ ID NO: 912606 - protein, 9 aa, Homo Sapiens
HTLTEKIVA

SEQ ID NO: 912607 - protein, 9 aa, Homo Sapiens
EAKIELKRR

SEQ ID NO: 912608 - protein, 9 aa, Homo Sapiens
HLFTIQGLD

SEQ ID NO: 912609 - protein, 9 aa, Homo Sapiens
LALSPPRRL

SEQ ID NO: 912610 - protein, 9 aa, Homo Sapiens
KSSQTPPYL

SEQ ID NO: 912611 - protein, 9 aa, Homo Sapiens
HYEDENPVG

SEQ ID NO: 912612 - protein, 9 aa, Homo Sapiens
ITQKAGEFM

SEQ ID NO: 912613 - protein, 9 aa, Homo Sapiens
LIQDSPECY

SEQ ID NO: 912614 - protein, 9 aa, Homo Sapiens
GKLGIGGTE

SEQ ID NO: 912615 - protein, 9 aa, Homo Sapiens
GTLAPSESQ

SEQ ID NO: 912616 - protein, 9 aa, Homo Sapiens
TQNMVDSYM

SEQ ID NO: 912617 - protein, 9 aa, Homo Sapiens
KLRTSSLAL

SEQ ID NO: 912618 - protein, 9 aa, Homo Sapiens
GLSVKGTVV

SEQ ID NO: 912619 - protein, 9 aa, Homo Sapiens
GGNTPRPSL

SEQ ID NO: 912620 - protein, 9 aa, Homo Sapiens
GGAGSKLIF

SEQ ID NO: 912621 - protein, 9 aa, Homo Sapiens
YNCKEAINV

SEQ ID NO: 912622 - protein, 9 aa, Homo Sapiens
KHDGGAQPG

SEQ ID NO: 912623 - protein, 9 aa, Homo Sapiens
QESEEQQLR

SEQ ID NO: 912624 - protein, 9 aa, Homo Sapiens
DLPAMLRVL

SEQ ID NO: 912625 - protein, 9 aa, Homo Sapiens
KSSWQSWNR

SEQ ID NO: 912626 - protein, 9 aa, Homo Sapiens
AAAVFPVNA

SEQ ID NO: 912627 - protein, 9 aa, Homo Sapiens
LNSRSFHYE

SEQ ID NO: 912628 - protein, 9 aa, Homo Sapiens
QMETTQNMV

SEQ ID NO: 912629 - protein, 9 aa, Homo Sapiens
LSLPCLKPS

SEQ ID NO: 912630 - protein, 9 aa, Homo Sapiens
KDLPAMLRV

SEQ ID NO: 912631 - protein, 9 aa, Homo Sapiens
AELEGPAQP

SEQ ID NO: 912632 - protein, 9 aa, Homo Sapiens
LEPVLEGWM

SEQ ID NO: 912633 - protein, 9 aa, Homo Sapiens
VLLPMEGLP

SEQ ID NO: 912634 - protein, 9 aa, Homo Sapiens
GWGWSNARG

SEQ ID NO: 912635 - protein, 9 aa, Homo Sapiens
QDVISRLSG

SEQ ID NO: 912636 - protein, 9 aa, Homo Sapiens
LDGTLAPSE

SEQ ID NO: 912637 - protein, 9 aa, Homo Sapiens
GSFTVSTQK

SEQ ID NO: 912638 - protein, 9 aa, Homo Sapiens
APTAPLPYA

SEQ ID NO: 912639 - protein, 9 aa, Homo Sapiens
VQESKEQKL

SEQ ID NO: 912640 - protein, 9 aa, Homo Sapiens
PGAPSICRP

SEQ ID NO: 912641 - protein, 9 aa, Homo Sapiens
FSRITQKAG

SEQ ID NO: 912642 - protein, 9 aa, Homo Sapiens
EGWMPDQPY

SEQ ID NO: 912643 - protein, 9 aa, Homo Sapiens
HSEPNEQVT

SEQ ID NO: 912644 - protein, 9 aa, Homo Sapiens
KDDYFSMMD

SEQ ID NO: 912645 - protein, 9 aa, Homo Sapiens
KGARKAGKT

SEQ ID NO: 912646 - protein, 9 aa, Homo Sapiens
IEMSGLQSK

SEQ ID NO: 912647 - protein, 9 aa, Homo Sapiens
LIRKKKGTD

SEQ ID NO: 912648 - protein, 9 aa, Homo Sapiens
TVSTQKNVE

SEQ ID NO: 912649 - protein, 9 aa, Homo Sapiens
TKSSQTPPY

SEQ ID NO: 912650 - protein, 9 aa, Homo Sapiens
LPCLKPSEA

SEQ ID NO: 912651 - protein, 9 aa, Homo Sapiens
KINLTVVRE

SEQ ID NO: 912652 - protein, 9 aa, Homo Sapiens
WGWSNARGR

SEQ ID NO: 912653 - protein, 9 aa, Homo Sapiens
EVSREDSGS

SEQ ID NO: 912654 - protein, 9 aa, Homo Sapiens
VDQLIQDSP

SEQ ID NO: 912655 - protein, 9 aa, Homo Sapiens
SLCSLQQIQ

SEQ ID NO: 912656 - protein, 9 aa, Homo Sapiens
PCDHPYIQY

SEQ ID NO: 912657 - protein, 9 aa, Homo Sapiens
KKEKGKDNV

SEQ ID NO: 912658 - protein, 9 aa, Homo Sapiens
PEVSREDSG

SEQ ID NO: 912659 - protein, 9 aa, Homo Sapiens
CSSNCNGNG

SEQ ID NO: 912660 - protein, 9 aa, Homo Sapiens
RRLLLLLLS

SEQ ID NO: 912661 - protein, 9 aa, Homo Sapiens
AERIWFNES

SEQ ID NO: 912662 - protein, 9 aa, Homo Sapiens
IVQEFYDTM

SEQ ID NO: 912663 - protein, 9 aa, Homo Sapiens
WKGKIIAVY

SEQ ID NO: 912664 - protein, 9 aa, Homo Sapiens
KKNWKGKII

SEQ ID NO: 912665 - protein, 9 aa, Homo Sapiens
LQLQGAMYG

SEQ ID NO: 912666 - protein, 9 aa, Homo Sapiens
RRLSKEWGS

SEQ ID NO: 912667 - protein, 9 aa, Homo Sapiens
PMEGLPDTA

SEQ ID NO: 912668 - protein, 9 aa, Homo Sapiens
QPDKEALEL

SEQ ID NO: 912669 - protein, 9 aa, Homo Sapiens
LLAVLLPME

SEQ ID NO: 912670 - protein, 9 aa, Homo Sapiens
KVRPGAVDF

SEQ ID NO: 912671 - protein, 9 aa, Homo Sapiens
CLKPSEAGR

SEQ ID NO: 912672 - protein, 9 aa, Homo Sapiens
MPDQPYRTE

SEQ ID NO: 912673 - protein, 9 aa, Homo Sapiens
QGDLSPPAK

SEQ ID NO: 912674 - protein, 9 aa, Homo Sapiens
HFVQQTLYH

SEQ ID NO: 912675 - protein, 9 aa, Homo Sapiens
EDEVEVSLP

SEQ ID NO: 912676 - protein, 9 aa, Homo Sapiens
ERIWFNESN

SEQ ID NO: 912677 - protein, 9 aa, Homo Sapiens
FLNRQHSEP

SEQ ID NO: 912678 - protein, 9 aa, Homo Sapiens
TGLHNLSTF

SEQ ID NO: 912679 - protein, 9 aa, Homo Sapiens
SAAPEVSRE

SEQ ID NO: 912680 - protein, 9 aa, Homo Sapiens
KFSVVNPTA

SEQ ID NO: 912681 - protein, 9 aa, Homo Sapiens
SHEIAANHK

SEQ ID NO: 912682 - protein, 9 aa, Homo Sapiens
YAAPEASGP

SEQ ID NO: 912683 - protein, 9 aa, Homo Sapiens
DHKLIRKKK

SEQ ID NO: 912684 - protein, 9 aa, Homo Sapiens
PEGGAGSKL

SEQ ID NO: 912685 - protein, 9 aa, Homo Sapiens
SFHYEDENP

SEQ ID NO: 912686 - protein, 9 aa, Homo Sapiens
FHYEDENPV

SEQ ID NO: 912687 - protein, 9 aa, Homo Sapiens
FSFSRSQLD

SEQ ID NO: 912688 - protein, 9 aa, Homo Sapiens
CDHPYIQYN

SEQ ID NO: 912689 - protein, 9 aa, Homo Sapiens
GQVEVVGRG

SEQ ID NO: 912690 - protein, 9 aa, Homo Sapiens
QLENEELRR

SEQ ID NO: 912691 - protein, 9 aa, Homo Sapiens
SYTQQSHFV

SEQ ID NO: 912692 - protein, 9 aa, Homo Sapiens
QRISHYEVE

SEQ ID NO: 912693 - protein, 9 aa, Homo Sapiens
FIRIKKEKG

SEQ ID NO: 912694 - protein, 9 aa, Homo Sapiens
PPTPSASTP

SEQ ID NO: 912695 - protein, 9 aa, Homo Sapiens
SRRLSKEWG

SEQ ID NO: 912696 - protein, 9 aa, Homo Sapiens
AKIELKRRL

SEQ ID NO: 912697 - protein, 9 aa, Homo Sapiens
PPHLNSQDT

SEQ ID NO: 912698 - protein, 9 aa, Homo Sapiens
IETDGINCL

SEQ ID NO: 912699 - protein, 9 aa, Homo Sapiens
ASQIWNLNP

SEQ ID NO: 912700 - protein, 9 aa, Homo Sapiens
RRSKKAELE

SEQ ID NO: 912701 - protein, 9 aa, Homo Sapiens
EVDQLIQDS

SEQ ID NO: 912702 - protein, 9 aa, Homo Sapiens
NTRLQLQGA

SEQ ID NO: 912703 - protein, 9 aa, Homo Sapiens
YLTTVQESK

SEQ ID NO: 912704 - protein, 9 aa, Homo Sapiens
AGGKLGIGG

SEQ ID NO: 912705 - protein, 9 aa, Homo Sapiens
DTSTSSFDH

SEQ ID NO: 912706 - protein, 9 aa, Homo Sapiens
RPGAVDFVR

SEQ ID NO: 912707 - protein, 9 aa, Homo Sapiens
NAIFISNDM

SEQ ID NO: 912708 - protein, 9 aa, Homo Sapiens
TRKQGDLSP

SEQ ID NO: 912709 - protein, 9 aa, Homo Sapiens
GLEGKTPEE

SEQ ID NO: 912710 - protein, 9 aa, Homo Sapiens
HEIAANHKV

SEQ ID NO: 912711 - protein, 9 aa, Homo Sapiens
TFSRRLSKE

SEQ ID NO: 912712 - protein, 9 aa, Homo Sapiens
RTTWGQVEV

SEQ ID NO: 912713 - protein, 9 aa, Homo Sapiens
EEEQLRQES

SEQ ID NO: 912714 - protein, 9 aa, Homo Sapiens
EPNEQVTRK

SEQ ID NO: 912715 - protein, 9 aa, Homo Sapiens
QTACKPEFA

SEQ ID NO: 912716 - protein, 9 aa, Homo Sapiens
SRLSASQIW

SEQ ID NO: 912717 - protein, 9 aa, Homo Sapiens
EFLNRQHSE

SEQ ID NO: 912718 - protein, 9 aa, Homo Sapiens
KYRKCAWEA

SEQ ID NO: 912719 - protein, 9 aa, Homo Sapiens
FKSIHDSLC

SEQ ID NO: 912720 - protein, 9 aa, Homo Sapiens
QPAQTGGGN

SEQ ID NO: 912721 - protein, 9 aa, Homo Sapiens
GFFFCCRRR

SEQ ID NO: 912722 - protein, 9 aa, Homo Sapiens
LEVVIRGLK

SEQ ID NO: 912723 - protein, 9 aa, Homo Sapiens
GYVCTARWM

SEQ ID NO: 912724 - protein, 9 aa, Homo Sapiens
IEIMDDCSS

SEQ ID NO: 912725 - protein, 9 aa, Homo Sapiens
NKEGQQFAL

SEQ ID NO: 912726 - protein, 9 aa, Homo Sapiens
ATTSRAERT

SEQ ID NO: 912727 - protein, 9 aa, Homo Sapiens
KGLSVRCVC

SEQ ID NO: 912728 - protein, 9 aa, Homo Sapiens
FTIQGLDPS

SEQ ID NO: 912729 - protein, 9 aa, Homo Sapiens
TGWLRLRVS

SEQ ID NO: 912730 - protein, 9 aa, Homo Sapiens
SHFVQQTLY

SEQ ID NO: 912731 - protein, 9 aa, Homo Sapiens
ANKEGQQFA

SEQ ID NO: 912732 - protein, 9 aa, Homo Sapiens
ELREKVQKE

SEQ ID NO: 912733 - protein, 9 aa, Homo Sapiens
VKVYSYEIQ

SEQ ID NO: 912734 - protein, 9 aa, Homo Sapiens
SIHDSLCSL

SEQ ID NO: 912735 - protein, 9 aa, Homo Sapiens
METTQNMVD

SEQ ID NO: 912736 - protein, 9 aa, Homo Sapiens
EGFSVEHLV

SEQ ID NO: 912737 - protein, 9 aa, Homo Sapiens
MVDSYMAIV

SEQ ID NO: 912738 - protein, 9 aa, Homo Sapiens
TGHGLALYR

SEQ ID NO: 912739 - protein, 9 aa, Homo Sapiens
DDYFSMMDK

SEQ ID NO: 912740 - protein, 9 aa, Homo Sapiens
LKKKEIEMS

SEQ ID NO: 912741 - protein, 9 aa, Homo Sapiens
KLQKEIADI

SEQ ID NO: 912742 - protein, 9 aa, Homo Sapiens
FFFCCRRRR

SEQ ID NO: 912743 - protein, 9 aa, Homo Sapiens
DMMDEDEVE

SEQ ID NO: 912744 - protein, 9 aa, Homo Sapiens
RATTSRAER

SEQ ID NO: 912745 - protein, 9 aa, Homo Sapiens
CTFQEASDL

SEQ ID NO: 912746 - protein, 9 aa, Homo Sapiens
DAEVPGDAT

SEQ ID NO: 912747 - protein, 9 aa, Homo Sapiens
SEGEESEDE

SEQ ID NO: 912748 - protein, 9 aa, Homo Sapiens
SYIQPGTQE

SEQ ID NO: 912749 - protein, 9 aa, Homo Sapiens
TIQGLDPSL

SEQ ID NO: 912750 - protein, 9 aa, Homo Sapiens
SRGSRQNVS

SEQ ID NO: 912751 - protein, 9 aa, Homo Sapiens
GRGFFFCCR

SEQ ID NO: 912752 - protein, 9 aa, Homo Sapiens
GKTPEEYKG

SEQ ID NO: 912753 - protein, 9 aa, Homo Sapiens
DLSPPAKRE

SEQ ID NO: 912754 - protein, 9 aa, Homo Sapiens
SLDRIPCDH

SEQ ID NO: 912755 - protein, 9 aa, Homo Sapiens
KERKGARKA

SEQ ID NO: 912756 - protein, 9 aa, Homo Sapiens
PTPPPVGNR

SEQ ID NO: 912757 - protein, 9 aa, Homo Sapiens
ARKAGKTTY

SEQ ID NO: 912758 - protein, 9 aa, Homo Sapiens
AEHLLQSWP

SEQ ID NO: 912759 - protein, 9 aa, Homo Sapiens
PHLNSQDTL

SEQ ID NO: 912760 - protein, 9 aa, Homo Sapiens
EESRALCPV

SEQ ID NO: 912761 - protein, 9 aa, Homo Sapiens
QIETDGINC

SEQ ID NO: 912762 - protein, 9 aa, Homo Sapiens
RIPCDHPYI

SEQ ID NO: 912763 - protein, 9 aa, Homo Sapiens
GSKLIFGGY

SEQ ID NO: 912764 - protein, 9 aa, Homo Sapiens
QGAMYGSGI

SEQ ID NO: 912765 - protein, 9 aa, Homo Sapiens
CVCWRGDHI

SEQ ID NO: 912766 - protein, 9 aa, Homo Sapiens
NMVDSYMAI

SEQ ID NO: 912767 - protein, 9 aa, Homo Sapiens
RKCAWEAVE

SEQ ID NO: 912768 - protein, 9 aa, Homo Sapiens
GNTPRPSLP

SEQ ID NO: 912769 - protein, 9 aa, Homo Sapiens
KTISVIPGP

SEQ ID NO: 912770 - protein, 9 aa, Homo Sapiens
GTQETPSHL

SEQ ID NO: 912771 - protein, 9 aa, Homo Sapiens
TGGGNTPRP

SEQ ID NO: 912772 - protein, 9 aa, Homo Sapiens
EGKTPEEYK

SEQ ID NO: 912773 - protein, 9 aa, Homo Sapiens
VANKEGQQF

SEQ ID NO: 912774 - protein, 9 aa, Homo Sapiens
VHHSWRTTW

SEQ ID NO: 912775 - protein, 9 aa, Homo Sapiens
TPPPVGNRP

SEQ ID NO: 912776 - protein, 9 aa, Homo Sapiens
SWPFGELLC

SEQ ID NO: 912777 - protein, 9 aa, Homo Sapiens
ALYIPKDDY

SEQ ID NO: 912778 - protein, 9 aa, Homo Sapiens
CPGQEPNWG

SEQ ID NO: 912779 - protein, 9 aa, Homo Sapiens
TDGINCLVD

SEQ ID NO: 912780 - protein, 9 aa, Homo Sapiens
AICNSGQDH

SEQ ID NO: 912781 - protein, 9 aa, Homo Sapiens
TSQSPVPTT

SEQ ID NO: 912782 - protein, 9 aa, Homo Sapiens
INLTVVREF

SEQ ID NO: 912783 - protein, 9 aa, Homo Sapiens
GLKNTSHEI

SEQ ID NO: 912784 - protein, 9 aa, Homo Sapiens
SYEIQKPSL

SEQ ID NO: 912785 - protein, 9 aa, Homo Sapiens
DGGGLSVKG

SEQ ID NO: 912786 - protein, 9 aa, Homo Sapiens
VNASRCSWT

SEQ ID NO: 912787 - protein, 9 aa, Homo Sapiens
DCSSNCNGN

SEQ ID NO: 912788 - protein, 9 aa, Homo Sapiens
LSVKGTVVI

SEQ ID NO: 912789 - protein, 9 aa, Homo Sapiens
IRYPPHLNS

SEQ ID NO: 912790 - protein, 9 aa, Homo Sapiens
TTEEFVAPM

SEQ ID NO: 912791 - protein, 9 aa, Homo Sapiens
KEIADIVEA

SEQ ID NO: 912792 - protein, 9 aa, Homo Sapiens
APLGLMLTC

SEQ ID NO: 912793 - protein, 9 aa, Homo Sapiens
EQEEEEQAG

SEQ ID NO: 912794 - protein, 9 aa, Homo Sapiens
QIWNLNPVF

SEQ ID NO: 912795 - protein, 9 aa, Homo Sapiens
QGLDPSLQP

SEQ ID NO: 912796 - protein, 9 aa, Homo Sapiens
MATHQNEPK

SEQ ID NO: 912797 - protein, 9 aa, Homo Sapiens
TFTLSLPCL

SEQ ID NO: 912798 - protein, 9 aa, Homo Sapiens
LRTSSLALN

SEQ ID NO: 912799 - protein, 9 aa, Homo Sapiens
GAPSICRPT

SEQ ID NO: 912800 - protein, 9 aa, Homo Sapiens
PEFAYAYKV

SEQ ID NO: 912801 - protein, 9 aa, Homo Sapiens
ISYIFILLS

SEQ ID NO: 912802 - protein, 9 aa, Homo Sapiens
CANANGSEK

SEQ ID NO: 912803 - protein, 9 aa, Homo Sapiens
QRELREKVQ

SEQ ID NO: 912804 - protein, 9 aa, Homo Sapiens
HLLQSWPFG

SEQ ID NO: 912805 - protein, 9 aa, Homo Sapiens
HDPKYRKCA

SEQ ID NO: 912806 - protein, 9 aa, Homo Sapiens
DPDKKNWKG

SEQ ID NO: 912807 - protein, 9 aa, Homo Sapiens
QLQGAMYGS

SEQ ID NO: 912808 - protein, 9 aa, Homo Sapiens
VAERIWFNE

SEQ ID NO: 912809 - protein, 9 aa, Homo Sapiens
KRCTFQEAS

SEQ ID NO: 912810 - protein, 9 aa, Homo Sapiens
TDSVEVTDG

SEQ ID NO: 912811 - protein, 9 aa, Homo Sapiens
LPAMLRVLR

SEQ ID NO: 912812 - protein, 9 aa, Homo Sapiens
VTTEEFVAP

SEQ ID NO: 912813 - protein, 9 aa, Homo Sapiens
VSTQKNVEH

SEQ ID NO: 912814 - protein, 9 aa, Homo Sapiens
HTTIIDRRP

SEQ ID NO: 912815 - protein, 9 aa, Homo Sapiens
IIIIISYIF

SEQ ID NO: 912816 - protein, 9 aa, Homo Sapiens
NANGSEKLP

SEQ ID NO: 912817 - protein, 9 aa, Homo Sapiens
PLPYAAPEA

SEQ ID NO: 912818 - protein, 9 aa, Homo Sapiens
GRWQSNVHH

SEQ ID NO: 912819 - protein, 9 aa, Homo Sapiens
SVWAEKNGS

SEQ ID NO: 912820 - protein, 9 aa, Homo Sapiens
TTVQESKEQ

SEQ ID NO: 912821 - protein, 9 aa, Homo Sapiens
SLQLENEEL

SEQ ID NO: 912822 - protein, 9 aa, Homo Sapiens
AEVPGDATK

SEQ ID NO: 912823 - protein, 9 aa, Homo Sapiens
NTPRPSLPQ

SEQ ID NO: 912824 - protein, 9 aa, Homo Sapiens
SNTRLQLQG

SEQ ID NO: 912825 - protein, 9 aa, Homo Sapiens
AINVLSHLP

SEQ ID NO: 912826 - protein, 9 aa, Homo Sapiens
SEPNEQVTR

SEQ ID NO: 912827 - protein, 9 aa, Homo Sapiens
KSVKAICNS

SEQ ID NO: 912828 - protein, 9 aa, Homo Sapiens
RSFHYEDEN

SEQ ID NO: 912829 - protein, 9 aa, Homo Sapiens
DPKYRKCAW

SEQ ID NO: 912830 - protein, 9 aa, Homo Sapiens
VYSYEIQKP

SEQ ID NO: 912831 - protein, 9 aa, Homo Sapiens
KVYSYEIQK

SEQ ID NO: 912832 - protein, 9 aa, Homo Sapiens
QEEEEQAGK

SEQ ID NO: 912833 - protein, 9 aa, Homo Sapiens
AAPEASGPP

SEQ ID NO: 912834 - protein, 9 aa, Homo Sapiens
FKLSYIQPG

SEQ ID NO: 912835 - protein, 9 aa, Homo Sapiens
ELEVVIRGL

SEQ ID NO: 912836 - protein, 9 aa, Homo Sapiens
AEKNGSRGS

SEQ ID NO: 912837 - protein, 9 aa, Homo Sapiens
NYLTTVQES

SEQ ID NO: 912838 - protein, 9 aa, Homo Sapiens
AKVSLLTPK

SEQ ID NO: 912839 - protein, 9 aa, Homo Sapiens
PKDDYFSMM

SEQ ID NO: 912840 - protein, 9 aa, Homo Sapiens
SLALNLPTL

SEQ ID NO: 912841 - protein, 9 aa, Homo Sapiens
LRLRRHQKE

SEQ ID NO: 912842 - protein, 9 aa, Homo Sapiens
ANANGSEKL

SEQ ID NO: 912843 - protein, 9 aa, Homo Sapiens
ICNSGQDHV

SEQ ID NO: 912844 - protein, 9 aa, Homo Sapiens
NRGLKKKKQ

SEQ ID NO: 912845 - protein, 9 aa, Homo Sapiens
LDMQSTFDN

SEQ ID NO: 912846 - protein, 9 aa, Homo Sapiens
EVLKMAVKQ

SEQ ID NO: 912847 - protein, 9 aa, Homo Sapiens
YKVIHITGW

SEQ ID NO: 912848 - protein, 9 aa, Homo Sapiens
LLLSLNEDP

SEQ ID NO: 912849 - protein, 9 aa, Homo Sapiens
ALDDKPPPT

SEQ ID NO: 912850 - protein, 9 aa, Homo Sapiens
IVKVYSYEI

SEQ ID NO: 912851 - protein, 9 aa, Homo Sapiens
SRLQEAQPD

SEQ ID NO: 912852 - protein, 9 aa, Homo Sapiens
ESKEQKLRE

SEQ ID NO: 912853 - protein, 9 aa, Homo Sapiens
DFMATHQNE

SEQ ID NO: 912854 - protein, 9 aa, Homo Sapiens
SQSPVPTTL

SEQ ID NO: 912855 - protein, 9 aa, Homo Sapiens
SQKLTDEQV

SEQ ID NO: 912856 - protein, 9 aa, Homo Sapiens
TSSLALNLP

SEQ ID NO: 912857 - protein, 9 aa, Homo Sapiens
QLDMQSTFD

SEQ ID NO: 912858 - protein, 9 aa, Homo Sapiens
ASNTRLQLQ

SEQ ID NO: 912859 - protein, 9 aa, Homo Sapiens
NGTEGFSVE

SEQ ID NO: 912860 - protein, 9 aa, Homo Sapiens
RGRVARFCY

SEQ ID NO: 912861 - protein, 9 aa, Homo Sapiens
FSRRLSKEW

SEQ ID NO: 912862 - protein, 9 aa, Homo Sapiens
QESKEQKLR

SEQ ID NO: 912863 - protein, 9 aa, Homo Sapiens
QKEIADIVE

SEQ ID NO: 912864 - protein, 9 aa, Homo Sapiens
AITSQSPVP

SEQ ID NO: 912865 - protein, 9 aa, Homo Sapiens
TRLQLQGAM

SEQ ID NO: 912866 - protein, 9 aa, Homo Sapiens
SDYEVAERI

SEQ ID NO: 912867 - protein, 9 aa, Homo Sapiens
SVIPGPKTI

SEQ ID NO: 912868 - protein, 9 aa, Homo Sapiens
CLVDDFANA

SEQ ID NO: 912869 - protein, 9 aa, Homo Sapiens
LENEELRRK

SEQ ID NO: 912870 - protein, 9 aa, Homo Sapiens
VLEGWMPDQ

SEQ ID NO: 912871 - protein, 9 aa, Homo Sapiens
RAMAPLGLM

SEQ ID NO: 912872 - protein, 9 aa, Homo Sapiens
ATHQNEPKN

SEQ ID NO: 912873 - protein, 9 aa, Homo Sapiens
YLKRCTFQE

SEQ ID NO: 912874 - protein, 9 aa, Homo Sapiens
TEGFSVEHL

SEQ ID NO: 912875 - protein, 9 aa, Homo Sapiens
IPFSRITQK

SEQ ID NO: 912876 - protein, 9 aa, Homo Sapiens
SVSTGLHNL

SEQ ID NO: 912877 - protein, 9 aa, Homo Sapiens
PFDETKSSQ

SEQ ID NO: 912878 - protein, 9 aa, Homo Sapiens
DRRIEVNAI

SEQ ID NO: 912879 - protein, 9 aa, Homo Sapiens
FFSFSRSQL

SEQ ID NO: 912880 - protein, 9 aa, Homo Sapiens
ARFCYFEDI

SEQ ID NO: 912881 - protein, 9 aa, Homo Sapiens
EIAANHKVA

SEQ ID NO: 912882 - protein, 9 aa, Homo Sapiens
YVCTARWMF

SEQ ID NO: 912883 - protein, 9 aa, Homo Sapiens
TLTEKIVAM

SEQ ID NO: 912884 - protein, 9 aa, Homo Sapiens
TAPLPYAAP

SEQ ID NO: 912885 - protein, 9 aa, Homo Sapiens
KVQKEEEQL

SEQ ID NO: 912886 - protein, 9 aa, Homo Sapiens
QVEGSQPFE

SEQ ID NO: 912887 - protein, 9 aa, Homo Sapiens
RRRRKSSWQ

SEQ ID NO: 912888 - protein, 9 aa, Homo Sapiens
EKGKDNVES

SEQ ID NO: 912889 - protein, 9 aa, Homo Sapiens
MAPLGLMLT

SEQ ID NO: 912890 - protein, 9 aa, Homo Sapiens
LRQESEEQQ

SEQ ID NO: 912891 - protein, 9 aa, Homo Sapiens
RKKKGTDGV

SEQ ID NO: 912892 - protein, 9 aa, Homo Sapiens
GEMAHKDAN

SEQ ID NO: 912893 - protein, 9 aa, Homo Sapiens
ILVVDTLKI

SEQ ID NO: 912894 - protein, 9 aa, Homo Sapiens
YSYEIQKPS

SEQ ID NO: 912895 - protein, 9 aa, Homo Sapiens
PFSRITQKA

SEQ ID NO: 912896 - protein, 9 aa, Homo Sapiens
VHFNGLEGK

SEQ ID NO: 912897 - protein, 9 aa, Homo Sapiens
IHDSLCSLQ

SEQ ID NO: 912898 - protein, 9 aa, Homo Sapiens
QKAGEFMIT

SEQ ID NO: 912899 - protein, 9 aa, Homo Sapiens
HSSSTMSKS

SEQ ID NO: 912900 - protein, 9 aa, Homo Sapiens
KKGREKERK

SEQ ID NO: 912901 - protein, 9 aa, Homo Sapiens
KNWKGKIIA

SEQ ID NO: 912902 - protein, 9 aa, Homo Sapiens
HITGWLRLR

SEQ ID NO: 912903 - protein, 9 aa, Homo Sapiens
FVEESRALC

SEQ ID NO: 912904 - protein, 9 aa, Homo Sapiens
YEVAERIWF

SEQ ID NO: 912905 - protein, 9 aa, Homo Sapiens
KEGQQFALK

SEQ ID NO: 912906 - protein, 9 aa, Homo Sapiens
LSVRCVCWR

SEQ ID NO: 912907 - protein, 9 aa, Homo Sapiens
TWGWGWSNA

SEQ ID NO: 912908 - protein, 9 aa, Homo Sapiens
LDMMDEDEV

SEQ ID NO: 912909 - protein, 9 aa, Homo Sapiens
TFVEESRAL

SEQ ID NO: 912910 - protein, 9 aa, Homo Sapiens
EVNAIFISN

SEQ ID NO: 912911 - protein, 9 aa, Homo Sapiens
TDEQVEGSQ

SEQ ID NO: 912912 - protein, 9 aa, Homo Sapiens
LEGPAQPCP

SEQ ID NO: 912913 - protein, 9 aa, Homo Sapiens
ISLQLENEE

SEQ ID NO: 912914 - protein, 9 aa, Homo Sapiens
SASQIWNLN

SEQ ID NO: 912915 - protein, 9 aa, Homo Sapiens
RIKKEKGKD

SEQ ID NO: 912916 - protein, 9 aa, Homo Sapiens
SRSQLDMQS

SEQ ID NO: 912917 - protein, 9 aa, Homo Sapiens
DTMTPVNAR

SEQ ID NO: 912918 - protein, 9 aa, Homo Sapiens
LAVLLPMEG

SEQ ID NO: 912919 - protein, 9 aa, Homo Sapiens
QEAQPDKEA

SEQ ID NO: 912920 - protein, 9 aa, Homo Sapiens
FDETKSSQT

SEQ ID NO: 912921 - protein, 9 aa, Homo Sapiens
KGREKERKG

SEQ ID NO: 912922 - protein, 9 aa, Homo Sapiens
FSKELEVVI

SEQ ID NO: 912923 - protein, 9 aa, Homo Sapiens
LTRGQTQDV

SEQ ID NO: 912924 - protein, 9 aa, Homo Sapiens
LYIPKDDYF

SEQ ID NO: 912925 - protein, 9 aa, Homo Sapiens
CSLQQIQKT

SEQ ID NO: 912926 - protein, 9 aa, Homo Sapiens
GGRGAAPLV

SEQ ID NO: 912927 - protein, 9 aa, Homo Sapiens
TTWGQVEVV

SEQ ID NO: 912928 - protein, 9 aa, Homo Sapiens
VEGSQPFEG

SEQ ID NO: 912929 - protein, 9 aa, Homo Sapiens
LPLWATNYS

SEQ ID NO: 912930 - protein, 9 aa, Homo Sapiens
AMAPLGLML

SEQ ID NO: 912931 - protein, 9 aa, Homo Sapiens
NEPKNTVVV

SEQ ID NO: 912932 - protein, 9 aa, Homo Sapiens
INVLSHLPS

SEQ ID NO: 912933 - protein, 9 aa, Homo Sapiens
EAINVLSHL

SEQ ID NO: 912934 - protein, 9 aa, Homo Sapiens
DLSRHSSST

SEQ ID NO: 912935 - protein, 9 aa, Homo Sapiens
RQESEEQQL

SEQ ID NO: 912936 - protein, 9 aa, Homo Sapiens
MGHGLLCWV

SEQ ID NO: 912937 - protein, 9 aa, Homo Sapiens
QHSEPNEQV

SEQ ID NO: 912938 - protein, 9 aa, Homo Sapiens
NKHDGGAQP

SEQ ID NO: 912939 - protein, 9 aa, Homo Sapiens
IEKLQKEIA

SEQ ID NO: 912940 - protein, 9 aa, Homo Sapiens
AEQRGEMAH

SEQ ID NO: 912941 - protein, 9 aa, Homo Sapiens
SAAAVFPVN

SEQ ID NO: 912942 - protein, 9 aa, Homo Sapiens
SKKAELEGP

SEQ ID NO: 912943 - protein, 9 aa, Homo Sapiens
FNSTAKVSL

SEQ ID NO: 912944 - protein, 9 aa, Homo Sapiens
NGLEGKTPE

SEQ ID NO: 912945 - protein, 9 aa, Homo Sapiens
LTDEQVEGS

SEQ ID NO: 912946 - protein, 9 aa, Homo Sapiens
KLTDEQVEG

SEQ ID NO: 912947 - protein, 9 aa, Homo Sapiens
GWSNARGRW

SEQ ID NO: 912948 - protein, 9 aa, Homo Sapiens
NPDLRLRRH

SEQ ID NO: 912949 - protein, 9 aa, Homo Sapiens
THQNEPKNT

SEQ ID NO: 912950 - protein, 9 aa, Homo Sapiens
CHTLTEKIV

SEQ ID NO: 912951 - protein, 9 aa, Homo Sapiens
ANGSEKLPP

SEQ ID NO: 912952 - protein, 9 aa, Homo Sapiens
RYPPHLNSQ

SEQ ID NO: 912953 - protein, 9 aa, Homo Sapiens
LNEDPRRQP

SEQ ID NO: 912954 - protein, 9 aa, Homo Sapiens
RTTFSRRLS

SEQ ID NO: 912955 - protein, 9 aa, Homo Sapiens
ASTPAPPSS

SEQ ID NO: 912956 - protein, 9 aa, Homo Sapiens
SLPAITSQS

SEQ ID NO: 912957 - protein, 9 aa, Homo Sapiens
SHYLLFLQV

SEQ ID NO: 912958 - protein, 9 aa, Homo Sapiens
PDKKNWKGK

SEQ ID NO: 912959 - protein, 9 aa, Homo Sapiens
QEAKIELKR

SEQ ID NO: 912960 - protein, 9 aa, Homo Sapiens
ALSPPRRLL

SEQ ID NO: 912961 - protein, 9 aa, Homo Sapiens
GWLRLRVSL

SEQ ID NO: 912962 - protein, 9 aa, Homo Sapiens
SDSDLSRHS

SEQ ID NO: 912963 - protein, 9 aa, Homo Sapiens
EKVQKEEEQ

SEQ ID NO: 912964 - protein, 9 aa, Homo Sapiens
PPPTPPPVG

SEQ ID NO: 912965 - protein, 9 aa, Homo Sapiens
TDGGGLSVK

SEQ ID NO: 912966 - protein, 9 aa, Homo Sapiens
PAPPGAPSI

SEQ ID NO: 912967 - protein, 9 aa, Homo Sapiens
PAPCPGQEP

SEQ ID NO: 912968 - protein, 9 aa, Homo Sapiens
KEIEMSGLQ

SEQ ID NO: 912969 - protein, 9 aa, Homo Sapiens
VNAIFISND

SEQ ID NO: 912970 - protein, 9 aa, Homo Sapiens
AGSKLIFGG

SEQ ID NO: 912971 - protein, 9 aa, Homo Sapiens
SVEVTDGEN

SEQ ID NO: 912972 - protein, 9 aa, Homo Sapiens
ETKSSQTPP

SEQ ID NO: 912973 - protein, 9 aa, Homo Sapiens
SRAERTAPR

SEQ ID NO: 912974 - protein, 9 aa, Homo Sapiens
FYDTMTPVN

SEQ ID NO: 912975 - protein, 9 aa, Homo Sapiens
EFAYAYKVS

SEQ ID NO: 912976 - protein, 9 aa, Homo Sapiens
TQKAGEFMI

SEQ ID NO: 912977 - protein, 9 aa, Homo Sapiens
MEGLPDTAG

SEQ ID NO: 912978 - protein, 9 aa, Homo Sapiens
VLKMAVKQG

SEQ ID NO: 912979 - protein, 9 aa, Homo Sapiens
KIELKRRLS

SEQ ID NO: 912980 - protein, 9 aa, Homo Sapiens
VISLFLLDT

SEQ ID NO: 912981 - protein, 9 aa, Homo Sapiens
GGKLGIGGT

SEQ ID NO: 912982 - protein, 9 aa, Homo Sapiens
IAANHKVAK

SEQ ID NO: 912983 - protein, 9 aa, Homo Sapiens
NVHHSWRTT

SEQ ID NO: 912984 - protein, 9 aa, Homo Sapiens
KPLADAEVP

SEQ ID NO: 912985 - protein, 9 aa, Homo Sapiens
GQTQDVISR

SEQ ID NO: 912986 - protein, 9 aa, Homo Sapiens
CGNGTEGFS

SEQ ID NO: 912987 - protein, 9 aa, Homo Sapiens
RKAGKTTYS

SEQ ID NO: 912988 - protein, 9 aa, Homo Sapiens
RGLKKKKQY

SEQ ID NO: 912989 - protein, 9 aa, Homo Sapiens
EAQPDKEAL

SEQ ID NO: 912990 - protein, 9 aa, Homo Sapiens
EKKKGREKE

SEQ ID NO: 912991 - protein, 9 aa, Homo Sapiens
PKYRKCAWE

SEQ ID NO: 912992 - protein, 9 aa, Homo Sapiens
TSRAERTAP

SEQ ID NO: 912993 - protein, 9 aa, Homo Sapiens
NGSRGSRQN

SEQ ID NO: 912994 - protein, 9 aa, Homo Sapiens
IPCDHPYIQ

SEQ ID NO: 912995 - protein, 9 aa, Homo Sapiens
LSYIQPGTQ

SEQ ID NO: 912996 - protein, 9 aa, Homo Sapiens
KPPPTPPPV

SEQ ID NO: 912997 - protein, 9 aa, Homo Sapiens
LDDKPPPTP

SEQ ID NO: 912998 - protein, 9 aa, Homo Sapiens
EKLQKEIAD

SEQ ID NO: 912999 - protein, 9 aa, Homo Sapiens
IVANKEGQQ

SEQ ID NO: 913000 - protein, 9 aa, Homo Sapiens
VGQVNKHDG

SEQ ID NO: 913001 - protein, 9 aa, Homo Sapiens
EYEEVLKMA

SEQ ID NO: 913002 - protein, 9 aa, Homo Sapiens
YILDTSTSS

SEQ ID NO: 913003 - protein, 9 aa, Homo Sapiens
HQNEPKNTV

SEQ ID NO: 913004 - protein, 9 aa, Homo Sapiens
RITQKAGEF

SEQ ID NO: 913005 - protein, 9 aa, Homo Sapiens
IQDSPECYQ

SEQ ID NO: 913006 - protein, 9 aa, Homo Sapiens
QDSPECYQL

SEQ ID NO: 913007 - protein, 9 aa, Homo Sapiens
QTPPYLLSP

SEQ ID NO: 913008 - protein, 9 aa, Homo Sapiens
RCTFQEASD

SEQ ID NO: 913009 - protein, 9 aa, Homo Sapiens
WGQVEVVGR

SEQ ID NO: 913010 - protein, 9 aa, Homo Sapiens
LQLENEELR

SEQ ID NO: 913011 - protein, 9 aa, Homo Sapiens
LSPPAKREQ

SEQ ID NO: 913012 - protein, 9 aa, Homo Sapiens
SQTPPYLLS

SEQ ID NO: 913013 - protein, 9 aa, Homo Sapiens
ETTQNMVDS

SEQ ID NO: 913014 - protein, 9 aa, Homo Sapiens
EEEEQEAKI

SEQ ID NO: 913015 - protein, 9 aa, Homo Sapiens
IRIKKEKGK

SEQ ID NO: 913016 - protein, 9 aa, Homo Sapiens
AAPPTPSAS

SEQ ID NO: 913017 - protein, 9 aa, Homo Sapiens
VVFIRIKKE

SEQ ID NO: 913018 - protein, 9 aa, Homo Sapiens
DFVRHWQDL

SEQ ID NO: 913019 - protein, 9 aa, Homo Sapiens
KQTACKPEF

SEQ ID NO: 913020 - protein, 9 aa, Homo Sapiens
LLPMEGLPD

SEQ ID NO: 913021 - protein, 9 aa, Homo Sapiens
PPTPPPVGN

SEQ ID NO: 913022 - protein, 9 aa, Homo Sapiens
NVLSHLPSH

SEQ ID NO: 913023 - protein, 9 aa, Homo Sapiens
APSESQGNG

SEQ ID NO: 913024 - protein, 9 aa, Homo Sapiens
KGKIIAVYS

SEQ ID NO: 913025 - protein, 9 aa, Homo Sapiens
STAKVSLLT

SEQ ID NO: 913026 - protein, 9 aa, Homo Sapiens
LVALVARGG

SEQ ID NO: 913027 - protein, 9 aa, Homo Sapiens
LRVLRSLVF

SEQ ID NO: 913028 - protein, 9 aa, Homo Sapiens
PKTWGWGWS

SEQ ID NO: 913029 - protein, 9 aa, Homo Sapiens
SQIWNLNPV

SEQ ID NO: 913030 - protein, 9 aa, Homo Sapiens
LTTVQESKE

SEQ ID NO: 913031 - protein, 9 aa, Homo Sapiens
SSVSTGLHN

SEQ ID NO: 913032 - protein, 9 aa, Homo Sapiens
WNLNPVFGG

SEQ ID NO: 913033 - protein, 9 aa, Homo Sapiens
KAELEGPAQ

SEQ ID NO: 913034 - protein, 9 aa, Homo Sapiens
VLSHLPSHH

SEQ ID NO: 913035 - protein, 9 aa, Homo Sapiens
LVVDTLKIV

SEQ ID NO: 913036 - protein, 9 aa, Homo Sapiens
SQGEYEEVL

SEQ ID NO: 913037 - protein, 9 aa, Homo Sapiens
IISYIFILL

SEQ ID NO: 913038 - protein, 9 aa, Homo Sapiens
FCCRRRRKS

SEQ ID NO: 913039 - protein, 9 aa, Homo Sapiens
EESEDEERD

SEQ ID NO: 913040 - protein, 9 aa, Homo Sapiens
PGPKTIVGA

SEQ ID NO: 913041 - protein, 9 aa, Homo Sapiens
ASDSDLSRH

SEQ ID NO: 913042 - protein, 9 aa, Homo Sapiens
SSQTPPYLL

SEQ ID NO: 913043 - protein, 9 aa, Homo Sapiens
RIEVNAIFI

SEQ ID NO: 913044 - protein, 9 aa, Homo Sapiens
IRKKKGTDG

SEQ ID NO: 913045 - protein, 9 aa, Homo Sapiens
GNGTEGFSV

SEQ ID NO: 913046 - protein, 9 aa, Homo Sapiens
ESEDEERDG

SEQ ID NO: 913047 - protein, 9 aa, Homo Sapiens
GLDPSLQPY

SEQ ID NO: 913048 - protein, 9 aa, Homo Sapiens
DDCSSNCNG

SEQ ID NO: 913049 - protein, 9 aa, Homo Sapiens
MLRVLRSLV

SEQ ID NO: 913050 - protein, 9 aa, Homo Sapiens
PLVALVARG

SEQ ID NO: 913051 - protein, 9 aa, Homo Sapiens
DSLCSLQQI

SEQ ID NO: 913052 - protein, 9 aa, Homo Sapiens
SQLDMQSTF

SEQ ID NO: 913053 - protein, 9 aa, Homo Sapiens
LKRCTFQEA

SEQ ID NO: 913054 - protein, 9 aa, Homo Sapiens
SSNCNGNGE

SEQ ID NO: 913055 - protein, 9 aa, Homo Sapiens
ATGYGAGGK

SEQ ID NO: 913056 - protein, 9 aa, Homo Sapiens
IIIISYIFI

SEQ ID NO: 913057 - protein, 9 aa, Homo Sapiens
FQEASDLYC

SEQ ID NO: 913058 - protein, 9 aa, Homo Sapiens
AVLLPMEGL

SEQ ID NO: 913059 - protein, 9 aa, Homo Sapiens
PCPGQEPNW

SEQ ID NO: 913060 - protein, 9 aa, Homo Sapiens
EGEESEDEE

SEQ ID NO: 913061 - protein, 9 aa, Homo Sapiens
SSWQSWNRF

SEQ ID NO: 913062 - protein, 9 aa, Homo Sapiens
KEIFLYILD

SEQ ID NO: 913063 - protein, 9 aa, Homo Sapiens
VGRGFFFCC

SEQ ID NO: 913064 - protein, 9 aa, Homo Sapiens
GPKTIVGAL

SEQ ID NO: 913065 - protein, 9 aa, Homo Sapiens
LQSWPFGEL

SEQ ID NO: 913066 - protein, 9 aa, Homo Sapiens
NIAEHLLQS

SEQ ID NO: 913067 - protein, 9 aa, Homo Sapiens
VFPVNASRC

SEQ ID NO: 913068 - protein, 9 aa, Homo Sapiens
RHSSSTMSK

SEQ ID NO: 913069 - protein, 9 aa, Homo Sapiens
VRTTFSRRL

SEQ ID NO: 913070 - protein, 9 aa, Homo Sapiens
TEEFVAPMP

SEQ ID NO: 913071 - protein, 9 aa, Homo Sapiens
LLFLQVISL

SEQ ID NO: 913072 - protein, 9 aa, Homo Sapiens
YDTMTPVNA

SEQ ID NO: 913073 - protein, 9 aa, Homo Sapiens
KTDRRIEVN

SEQ ID NO: 913074 - protein, 9 aa, Homo Sapiens
KLIFGGYDH

SEQ ID NO: 913075 - protein, 9 aa, Homo Sapiens
SFTVSTQKN

SEQ ID NO: 913076 - protein, 9 aa, Homo Sapiens
ISHYEVEKH

SEQ ID NO: 913077 - protein, 9 aa, Homo Sapiens
EIMDDCSSN

SEQ ID NO: 913078 - protein, 9 aa, Homo Sapiens
LLLAVLLPM

SEQ ID NO: 913079 - protein, 9 aa, Homo Sapiens
RDGSFTVST

SEQ ID NO: 913080 - protein, 9 aa, Homo Sapiens
TVQESKEQK

SEQ ID NO: 913081 - protein, 9 aa, Homo Sapiens
LEGKTPEEY

SEQ ID NO: 913082 - protein, 9 aa, Homo Sapiens
PKTIVGALI

SEQ ID NO: 913083 - protein, 9 aa, Homo Sapiens
YKKLRTSSL

SEQ ID NO: 913084 - protein, 9 aa, Homo Sapiens
PCLKPSEAG

SEQ ID NO: 913085 - protein, 9 aa, Homo Sapiens
SASTPAPPS

SEQ ID NO: 913086 - protein, 9 aa, Homo Sapiens
SHLFTIQGL

SEQ ID NO: 913087 - protein, 9 aa, Homo Sapiens
RLQEAQPDK

SEQ ID NO: 913088 - protein, 9 aa, Homo Sapiens
QEASDLYCP

SEQ ID NO: 913089 - protein, 9 aa, Homo Sapiens
YRKCAWEAV

SEQ ID NO: 913090 - protein, 9 aa, Homo Sapiens
AAPEVSRED

SEQ ID NO: 913091 - protein, 9 aa, Homo Sapiens
KELEVVIRG

SEQ ID NO: 913092 - protein, 9 aa, Homo Sapiens
QLIQDSPEC

SEQ ID NO: 913093 - protein, 9 aa, Homo Sapiens
TAKVSLLTP

SEQ ID NO: 913094 - protein, 9 aa, Homo Sapiens
PGAVDFVRH

SEQ ID NO: 913095 - protein, 9 aa, Homo Sapiens
SLPCLKPSE

SEQ ID NO: 913096 - protein, 9 aa, Homo Sapiens
EEQEAKIEL

SEQ ID NO: 913097 - protein, 9 aa, Homo Sapiens
AHKDANAKL

SEQ ID NO: 913098 - protein, 9 aa, Homo Sapiens
RSKKAELEG

SEQ ID NO: 913099 - protein, 9 aa, Homo Sapiens
GGDKPLADA

SEQ ID NO: 913100 - protein, 9 aa, Homo Sapiens
LREKVQKEE

SEQ ID NO: 913101 - protein, 9 aa, Homo Sapiens
RGQTQDVIS

SEQ ID NO: 913102 - protein, 9 aa, Homo Sapiens
RIVQEFYDT

SEQ ID NO: 913103 - protein, 9 aa, Homo Sapiens
EHLLQSWPF

SEQ ID NO: 913104 - protein, 9 aa, Homo Sapiens
SQRISHYEV

SEQ ID NO: 913105 - protein, 9 aa, Homo Sapiens
KKKGTDGVE

SEQ ID NO: 913106 - protein, 9 aa, Homo Sapiens
STQKNVEHG

SEQ ID NO: 913107 - protein, 9 aa, Homo Sapiens
IELKRRLSR

SEQ ID NO: 913108 - protein, 9 aa, Homo Sapiens
GINCLVDDF

SEQ ID NO: 913109 - protein, 9 aa, Homo Sapiens
ILDTSTSSF

SEQ ID NO: 913110 - protein, 9 aa, Homo Sapiens
DFTGHGLAL

SEQ ID NO: 913111 - protein, 9 aa, Homo Sapiens
LSASQIWNL

SEQ ID NO: 913112 - protein, 9 aa, Homo Sapiens
GASAAPEVS

SEQ ID NO: 913113 - protein, 9 aa, Homo Sapiens
PLGLMLTCM

SEQ ID NO: 913114 - protein, 9 aa, Homo Sapiens
LEQEEEEQA

SEQ ID NO: 913115 - protein, 9 aa, Homo Sapiens
FPVNASRCS

SEQ ID NO: 913116 - protein, 9 aa, Homo Sapiens
IYIVANKEG

SEQ ID NO: 913117 - protein, 9 aa, Homo Sapiens
GRGAAPLVA

SEQ ID NO: 913118 - protein, 9 aa, Homo Sapiens
TQKNVEHGI

SEQ ID NO: 913119 - protein, 9 aa, Homo Sapiens
HRAMAPLGL

SEQ ID NO: 913120 - protein, 9 aa, Homo Sapiens
VVIRGLKHW

SEQ ID NO: 913121 - protein, 9 aa, Homo Sapiens
SLNEDPRRQ

SEQ ID NO: 913122 - protein, 9 aa, Homo Sapiens
LPYAAPEAS

SEQ ID NO: 913123 - protein, 9 aa, Homo Sapiens
WSNARGRWQ

SEQ ID NO: 913124 - protein, 9 aa, Homo Sapiens
FSAAAVFPV

SEQ ID NO: 913125 - protein, 9 aa, Homo Sapiens
EKERKGARK

SEQ ID NO: 913126 - protein, 9 aa, Homo Sapiens
GHGLLCWVL

SEQ ID NO: 913127 - protein, 9 aa, Homo Sapiens
SRHSSSTMS

SEQ ID NO: 913128 - protein, 9 aa, Homo Sapiens
EQLRQESEE

SEQ ID NO: 913129 - protein, 9 aa, Homo Sapiens
YIFILLSVL

SEQ ID NO: 913130 - protein, 9 aa, Homo Sapiens
TQQSHFVQQ

SEQ ID NO: 913131 - protein, 9 aa, Homo Sapiens
YEEVLKMAV

SEQ ID NO: 913132 - protein, 9 aa, Homo Sapiens
KQGDLSPPA

SEQ ID NO: 913133 - protein, 9 aa, Homo Sapiens
CCRRRRKSS

SEQ ID NO: 913134 - protein, 9 aa, Homo Sapiens
ENVGQVNKH

SEQ ID NO: 913135 - protein, 9 aa, Homo Sapiens
LRRHQKEGY

SEQ ID NO: 913136 - protein, 9 aa, Homo Sapiens
LDRIPCDHP

SEQ ID NO: 913137 - protein, 9 aa, Homo Sapiens
QNEPKNTVV

SEQ ID NO: 913138 - protein, 9 aa, Homo Sapiens
WLRLRVSLS

SEQ ID NO: 913139 - protein, 9 aa, Homo Sapiens
SKELEVVIR

SEQ ID NO: 913140 - protein, 9 aa, Homo Sapiens
NTSHEIAAN

SEQ ID NO: 913141 - protein, 9 aa, Homo Sapiens
IEVNAIFIS

SEQ ID NO: 913142 - protein, 9 aa, Homo Sapiens
QQIPTFVEE

SEQ ID NO: 913143 - protein, 9 aa, Homo Sapiens
VKGTVVIEV

SEQ ID NO: 913144 - protein, 9 aa, Homo Sapiens
FLQVISLFL

SEQ ID NO: 913145 - protein, 9 aa, Homo Sapiens
IIDRRPGAC

SEQ ID NO: 913146 - protein, 9 aa, Homo Sapiens
VRCVCWRGD

SEQ ID NO: 913147 - protein, 9 aa, Homo Sapiens
EGGAGSKLI

SEQ ID NO: 913148 - protein, 9 aa, Homo Sapiens
EKLKKKEIE

SEQ ID NO: 913149 - protein, 9 aa, Homo Sapiens
NSQGEYEEV

SEQ ID NO: 913150 - protein, 9 aa, Homo Sapiens
GYKGLSVRC

SEQ ID NO: 913151 - protein, 9 aa, Homo Sapiens
SVLLCANAN

SEQ ID NO: 913152 - protein, 9 aa, Homo Sapiens
NSRSFHYED

SEQ ID NO: 913153 - protein, 9 aa, Homo Sapiens
DSVEVTDGE

SEQ ID NO: 913154 - protein, 9 aa, Homo Sapiens
REKVQKEEE

SEQ ID NO: 913155 - protein, 9 aa, Homo Sapiens
TPPAPCPGQ

SEQ ID NO: 913156 - protein, 9 aa, Homo Sapiens
EVVIRGLKH

SEQ ID NO: 913157 - protein, 9 aa, Homo Sapiens
GYLKRCTFQ

SEQ ID NO: 913158 - protein, 9 aa, Homo Sapiens
QPGTQETPS

SEQ ID NO: 913159 - protein, 9 aa, Homo Sapiens
TFQEASDLY

SEQ ID NO: 913160 - protein, 9 aa, Homo Sapiens
AMLRVLRSL

SEQ ID NO: 913161 - protein, 9 aa, Homo Sapiens
HYLLFLQVI

SEQ ID NO: 913162 - protein, 9 aa, Homo Sapiens
IMDDCSSNC

SEQ ID NO: 913163 - protein, 9 aa, Homo Sapiens
EVAERIWFN

SEQ ID NO: 913164 - protein, 9 aa, Homo Sapiens
IQGLDPSLQ

SEQ ID NO: 913165 - protein, 9 aa, Homo Sapiens
GAAPLVALV

SEQ ID NO: 913166 - protein, 9 aa, Homo Sapiens
MMDEDEVEV

SEQ ID NO: 913167 - protein, 9 aa, Homo Sapiens
MEKINLTVV

SEQ ID NO: 913168 - protein, 9 aa, Homo Sapiens
TLSLPCLKP

SEQ ID NO: 913169 - protein, 9 aa, Homo Sapiens
GAGGKLGIG

SEQ ID NO: 913170 - protein, 9 aa, Homo Sapiens
PGQEPNWGK

SEQ ID NO: 913171 - protein, 9 aa, Homo Sapiens
DYFSMMDKD

SEQ ID NO: 913172 - protein, 9 aa, Homo Sapiens
LFSKELEVV

SEQ ID NO: 913173 - protein, 9 aa, Homo Sapiens
TRVTTEEFV

SEQ ID NO: 913174 - protein, 9 aa, Homo Sapiens
CYFEDIYGY

SEQ ID NO: 913175 - protein, 9 aa, Homo Sapiens
RCVCWRGDH

SEQ ID NO: 913176 - protein, 9 aa, Homo Sapiens
VFIRIKKEK

SEQ ID NO: 913177 - protein, 9 aa, Homo Sapiens
KTDSVEVTD

SEQ ID NO: 913178 - protein, 9 aa, Homo Sapiens
KVSLLTPKL

SEQ ID NO: 913179 - protein, 9 aa, Homo Sapiens
KKAELEGPA

SEQ ID NO: 913180 - protein, 9 aa, Homo Sapiens
PAITSQSPV

SEQ ID NO: 913181 - protein, 9 aa, Homo Sapiens
FTLSLPCLK

SEQ ID NO: 913182 - protein, 9 aa, Homo Sapiens
WMPDQPYRT

SEQ ID NO: 913183 - protein, 9 aa, Homo Sapiens
SVKAICNSG

SEQ ID NO: 913184 - protein, 9 aa, Homo Sapiens
VEVVGRGFF

SEQ ID NO: 913185 - protein, 9 aa, Homo Sapiens
IKKEKGKDN

SEQ ID NO: 913186 - protein, 9 aa, Homo Sapiens
MRQYNNITE

SEQ ID NO: 913187 - protein, 9 aa, Homo Sapiens
AGDVVSKFS

SEQ ID NO: 913188 - protein, 9 aa, Homo Sapiens
DVRTTFSRR

SEQ ID NO: 913189 - protein, 9 aa, Homo Sapiens
PLDGTLAPS

SEQ ID NO: 913190 - protein, 9 aa, Homo Sapiens
SDIYIVANK

SEQ ID NO: 913191 - protein, 9 aa, Homo Sapiens
DISLDRIPC

SEQ ID NO: 913192 - protein, 9 aa, Homo Sapiens
GLNSRSFHY

SEQ ID NO: 913193 - protein, 9 aa, Homo Sapiens
VISLQLENE

SEQ ID NO: 913194 - protein, 9 aa, Homo Sapiens
FSRSQLDMQ

SEQ ID NO: 913195 - protein, 9 aa, Homo Sapiens
EKIVAMTMG

SEQ ID NO: 913196 - protein, 9 aa, Homo Sapiens
KNGSRGSRQ

SEQ ID NO: 913197 - protein, 9 aa, Homo Sapiens
KTWGWGWSN

SEQ ID NO: 913198 - protein, 9 aa, Homo Sapiens
TIEKLQKEI

SEQ ID NO: 913199 - protein, 9 aa, Homo Sapiens
EIEMSGLQS

SEQ ID NO: 913200 - protein, 9 aa, Homo Sapiens
EIADIVEAS

SEQ ID NO: 913201 - protein, 9 aa, Homo Sapiens
RQMETTQNM

SEQ ID NO: 913202 - protein, 9 aa, Homo Sapiens
HYEVEKHAQ

SEQ ID NO: 913203 - protein, 9 aa, Homo Sapiens
GREKERKGA

SEQ ID NO: 913204 - protein, 9 aa, Homo Sapiens
LQKEIADIV

SEQ ID NO: 913205 - protein, 9 aa, Homo Sapiens
YNNITEFVL

SEQ ID NO: 913206 - protein, 9 aa, Homo Sapiens
SWRTTWGQV

SEQ ID NO: 913207 - protein, 9 aa, Homo Sapiens
IARRLGYIL

SEQ ID NO: 913208 - protein, 9 aa, Homo Sapiens
WATNYSYRY

SEQ ID NO: 913209 - protein, 9 aa, Homo Sapiens
PLADAEVPG

SEQ ID NO: 913210 - protein, 9 aa, Homo Sapiens
EVEKHAQNV

SEQ ID NO: 913211 - protein, 9 aa, Homo Sapiens
DGINCLVDD

SEQ ID NO: 913212 - protein, 9 aa, Homo Sapiens
PTAPLPYAA

SEQ ID NO: 913213 - protein, 9 aa, Homo Sapiens
EEFVAPMPS

SEQ ID NO: 913214 - protein, 9 aa, Homo Sapiens
FRDHKLIRK

SEQ ID NO: 913215 - protein, 9 aa, Homo Sapiens
VIPGPKTIV

SEQ ID NO: 913216 - protein, 9 aa, Homo Sapiens
LGYILVVDT

SEQ ID NO: 913217 - protein, 9 aa, Homo Sapiens
IADIVEASR

SEQ ID NO: 913218 - protein, 9 aa, Homo Sapiens
QQSHFVQQT

SEQ ID NO: 913219 - protein, 9 aa, Homo Sapiens
DEVEVSLPR

SEQ ID NO: 913220 - protein, 9 aa, Homo Sapiens
YGAGGKLGI

SEQ ID NO: 913221 - protein, 9 aa, Homo Sapiens
GPAPPGAPS

SEQ ID NO: 913222 - protein, 9 aa, Homo Sapiens
PSICRPTRA

SEQ ID NO: 913223 - protein, 9 aa, Homo Sapiens
VSTGLHNLS

SEQ ID NO: 913224 - protein, 9 aa, Homo Sapiens
SVKGTVVIE

SEQ ID NO: 913225 - protein, 9 aa, Homo Sapiens
HDSLCSLQQ

SEQ ID NO: 913226 - protein, 9 aa, Homo Sapiens
FVAPMPSAV

SEQ ID NO: 913227 - protein, 9 aa, Homo Sapiens
RKSSWQSWN

SEQ ID NO: 913228 - protein, 9 aa, Homo Sapiens
EDEERDGDV

SEQ ID NO: 913229 - protein, 9 aa, Homo Sapiens
SPPRRLLLL

SEQ ID NO: 913230 - protein, 9 aa, Homo Sapiens
CKPEFAYAY

SEQ ID NO: 913231 - protein, 9 aa, Homo Sapiens
ILEQEEEEQ

SEQ ID NO: 913232 - protein, 9 aa, Homo Sapiens
FAYAYKVSI

SEQ ID NO: 913233 - protein, 9 aa, Homo Sapiens
QGEYEEVLK

SEQ ID NO: 913234 - protein, 9 aa, Homo Sapiens
QVNKHDGGA

SEQ ID NO: 913235 - protein, 9 aa, Homo Sapiens
AQTGGGNTP

SEQ ID NO: 913236 - protein, 9 aa, Homo Sapiens
LSRHSSSTM

SEQ ID NO: 913237 - protein, 9 aa, Homo Sapiens
GKIIAVYSG

SEQ ID NO: 913238 - protein, 9 aa, Homo Sapiens
ICHTLTEKI

SEQ ID NO: 913239 - protein, 9 aa, Homo Sapiens
KNTSHEIAA

SEQ ID NO: 913240 - protein, 9 aa, Homo Sapiens
LSLNEDPRR

SEQ ID NO: 913241 - protein, 9 aa, Homo Sapiens
WAEKNGSRG

SEQ ID NO: 913242 - protein, 9 aa, Homo Sapiens
EIQKPSLCF

SEQ ID NO: 913243 - protein, 9 aa, Homo Sapiens
TPSASTPAP

SEQ ID NO: 913244 - protein, 9 aa, Homo Sapiens
TSHEIAANH

SEQ ID NO: 913245 - protein, 9 aa, Homo Sapiens
QYNNITEFV

SEQ ID NO: 913246 - protein, 9 aa, Homo Sapiens
IEKTDSVEV

SEQ ID NO: 913247 - protein, 9 aa, Homo Sapiens
SRSFHYEDE

SEQ ID NO: 913248 - protein, 9 aa, Homo Sapiens
SDLSRHSSS

SEQ ID NO: 913249 - protein, 9 aa, Homo Sapiens
APPTPSAST

SEQ ID NO: 913250 - protein, 9 aa, Homo Sapiens
RLDMMDEDE

SEQ ID NO: 913251 - protein, 9 aa, Homo Sapiens
ESEGEESED

SEQ ID NO: 913252 - protein, 9 aa, Homo Sapiens
SEDEERDGD

SEQ ID NO: 913253 - protein, 9 aa, Homo Sapiens
WRTTWGQVE

SEQ ID NO: 913254 - protein, 9 aa, Homo Sapiens
AVFPVNASR

SEQ ID NO: 913255 - protein, 9 aa, Homo Sapiens
RVLRSLVFP

SEQ ID NO: 913256 - protein, 9 aa, Homo Sapiens
QVEVVGRGF

SEQ ID NO: 913257 - protein, 9 aa, Homo Sapiens
IHITGWLRL

SEQ ID NO: 913258 - protein, 9 aa, Homo Sapiens
LLQSWPFGE

SEQ ID NO: 913259 - protein, 9 aa, Homo Sapiens
SVRCVCWRG

SEQ ID NO: 913260 - protein, 9 aa, Homo Sapiens
LENVGQVNK

SEQ ID NO: 913261 - protein, 9 aa, Homo Sapiens
LQQIPTFVE

SEQ ID NO: 913262 - protein, 9 aa, Homo Sapiens
TTFSRRLSK

SEQ ID NO: 913263 - protein, 9 aa, Homo Sapiens
VSLLTPKLF

SEQ ID NO: 913264 - protein, 9 aa, Homo Sapiens
EHTTIIDRR

SEQ ID NO: 913265 - protein, 9 aa, Homo Sapiens
KLIRKKKGT

SEQ ID NO: 913266 - protein, 9 aa, Homo Sapiens
KEAINVLSH

SEQ ID NO: 913267 - protein, 9 aa, Homo Sapiens
RIWFNESNR

SEQ ID NO: 913268 - protein, 9 aa, Homo Sapiens
RRHQKEGYG

SEQ ID NO: 913269 - protein, 9 aa, Homo Sapiens
EFYDTMTPV

SEQ ID NO: 913270 - protein, 9 aa, Homo Sapiens
RLRRHQKEG

SEQ ID NO: 913271 - protein, 9 aa, Homo Sapiens
YEIQKPSLC

SEQ ID NO: 913272 - protein, 9 aa, Homo Sapiens
QTQDVISRL

SEQ ID NO: 913273 - protein, 9 aa, Homo Sapiens
EFVAPMPSA

SEQ ID NO: 913274 - protein, 9 aa, Homo Sapiens
FGASAAPEV

SEQ ID NO: 913275 - protein, 9 aa, Homo Sapiens
KKKGREKER

SEQ ID NO: 913276 - protein, 9 aa, Homo Sapiens
GRVARFCYF

SEQ ID NO: 913277 - protein, 9 aa, Homo Sapiens
RLQLQGAMY

SEQ ID NO: 913278 - protein, 9 aa, Homo Sapiens
DEDEVEVSL

SEQ ID NO: 913279 - protein, 9 aa, Homo Sapiens
HFNGLEGKT

SEQ ID NO: 913280 - protein, 9 aa, Homo Sapiens
VISRLSGAA

SEQ ID NO: 913281 - protein, 9 aa, Homo Sapiens
DEKLKKKEI

SEQ ID NO: 913282 - protein, 9 aa, Homo Sapiens
AQPDKEALE

SEQ ID NO: 913283 - protein, 9 aa, Homo Sapiens
INCLVDDFA

SEQ ID NO: 913284 - protein, 9 aa, Homo Sapiens
TNYSYRYDW

SEQ ID NO: 913285 - protein, 9 aa, Homo Sapiens
ADAEVPGDA

SEQ ID NO: 913286 - protein, 9 aa, Homo Sapiens
GDLSPPAKR

SEQ ID NO: 913287 - protein, 9 aa, Homo Sapiens
KPEFAYAYK

SEQ ID NO: 913288 - protein, 9 aa, Homo Sapiens
VNKHDGGAQ

SEQ ID NO: 913289 - protein, 9 aa, Homo Sapiens
SNCNGNGEC

SEQ ID NO: 913290 - protein, 9 aa, Homo Sapiens
PLALSPPRR

SEQ ID NO: 913291 - protein, 9 aa, Homo Sapiens
NGSEKLPPL

SEQ ID NO: 913292 - protein, 9 aa, Homo Sapiens
TIIDRRPGA

SEQ ID NO: 913293 - protein, 9 aa, Homo Sapiens
PPAPCPGQE

SEQ ID NO: 913294 - protein, 9 aa, Homo Sapiens
THDPKYRKC

SEQ ID NO: 913295 - protein, 9 aa, Homo Sapiens
WSCGNGTEG

SEQ ID NO: 913296 - protein, 9 aa, Homo Sapiens
LADAEVPGD

SEQ ID NO: 913297 - protein, 9 aa, Homo Sapiens
FIIIIISYI

SEQ ID NO: 913298 - protein, 9 aa, Homo Sapiens
TRGQTQDVI

SEQ ID NO: 913299 - protein, 9 aa, Homo Sapiens
VSREDSGSP

SEQ ID NO: 913300 - protein, 9 aa, Homo Sapiens
LAPSESQGN

SEQ ID NO: 913301 - protein, 9 aa, Homo Sapiens
LGPAPPGAP

SEQ ID NO: 913302 - protein, 9 aa, Homo Sapiens
GERATTSRA

SEQ ID NO: 913303 - protein, 9 aa, Homo Sapiens
EVISLQLEN

SEQ ID NO: 913304 - protein, 9 aa, Homo Sapiens
RVTTEEFVA

SEQ ID NO: 913305 - protein, 9 aa, Homo Sapiens
EKTDSVEVT

SEQ ID NO: 913306 - protein, 9 aa, Homo Sapiens
GLSVRCVCW

SEQ ID NO: 913307 - protein, 9 aa, Homo Sapiens
DKPLADAEV

SEQ ID NO: 913308 - protein, 9 aa, Homo Sapiens
RISHYEVEK

SEQ ID NO: 913309 - protein, 9 aa, Homo Sapiens
RQHSEPNEQ

SEQ ID NO: 913310 - protein, 9 aa, Homo Sapiens
STPAPPSSS

SEQ ID NO: 913311 - protein, 9 aa, Homo Sapiens
PAMLRVLRS

SEQ ID NO: 913312 - protein, 9 aa, Homo Sapiens
SHYEVEKHA

SEQ ID NO: 913313 - protein, 9 aa, Homo Sapiens
IWNLNPVFG

SEQ ID NO: 913314 - protein, 9 aa, Homo Sapiens
GYGAGGKLG

SEQ ID NO: 913315 - protein, 9 aa, Homo Sapiens
LDTSTSSFD

SEQ ID NO: 913316 - protein, 9 aa, Homo Sapiens
RLSASQIWN

SEQ ID NO: 913317 - protein, 9 aa, Homo Sapiens
PVLEGWMPD

SEQ ID NO: 913318 - protein, 9 aa, Homo Sapiens
RFCYFEDIY

SEQ ID NO: 913319 - protein, 9 aa, Homo Sapiens
CRRRRKSSW

SEQ ID NO: 913320 - protein, 9 aa, Homo Sapiens
EEEQEAKIE

SEQ ID NO: 913321 - protein, 9 aa, Homo Sapiens
RQRELREKV

SEQ ID NO: 913322 - protein, 9 aa, Homo Sapiens
ISLDRIPCD

SEQ ID NO: 913323 - protein, 9 aa, Homo Sapiens
NGLNSRSFH

SEQ ID NO: 913324 - protein, 9 aa, Homo Sapiens
APLPYAAPE

SEQ ID NO: 913325 - protein, 9 aa, Homo Sapiens
LWATNYSYR

SEQ ID NO: 913326 - protein, 9 aa, Homo Sapiens
DVIDFTGHG

SEQ ID NO: 913327 - protein, 9 aa, Homo Sapiens
FTGHGLALY

SEQ ID NO: 913328 - protein, 9 aa, Homo Sapiens
YILVVDTLK

SEQ ID NO: 913329 - protein, 9 aa, Homo Sapiens
TTSRAERTA

SEQ ID NO: 913330 - protein, 9 aa, Homo Sapiens
KIVAMTMGS

SEQ ID NO: 913331 - protein, 9 aa, Homo Sapiens
DRRPGACEE

SEQ ID NO: 913332 - protein, 9 aa, Homo Sapiens
SQDTLKNYV

SEQ ID NO: 913333 - protein, 9 aa, Homo Sapiens
VLLCANANG

SEQ ID NO: 913334 - protein, 9 aa, Homo Sapiens
NARGRWQSN

SEQ ID NO: 913335 - protein, 9 aa, Homo Sapiens
PGTQETPSH

SEQ ID NO: 913336 - protein, 9 aa, Homo Sapiens
PPGAPSICR

SEQ ID NO: 913337 - protein, 9 aa, Homo Sapiens
APSICRPTR

SEQ ID NO: 913338 - protein, 9 aa, Homo Sapiens
APCPGQEPN

SEQ ID NO: 913339 - protein, 9 aa, Homo Sapiens
AAVFPVNAS

SEQ ID NO: 913340 - protein, 9 aa, Homo Sapiens
LYLLLSLNE

SEQ ID NO: 913341 - protein, 9 aa, Homo Sapiens
TLPLWATNY

SEQ ID NO: 913342 - protein, 9 aa, Homo Sapiens
EMAHKDANA

SEQ ID NO: 913343 - protein, 9 aa, Homo Sapiens
HKLIRKKKG

SEQ ID NO: 913344 - protein, 9 aa, Homo Sapiens
LSLPAITSQ

SEQ ID NO: 913345 - protein, 9 aa, Homo Sapiens
GGLSVKGTV

SEQ ID NO: 913346 - protein, 9 aa, Homo Sapiens
RGFFFCCRR

SEQ ID NO: 913347 - protein, 9 aa, Homo Sapiens
NCKEAINVL

SEQ ID NO: 913348 - protein, 9 aa, Homo Sapiens
VVGRGFFFC

SEQ ID NO: 913349 - protein, 9 aa, Homo Sapiens
PYAAPEASG

SEQ ID NO: 913350 - protein, 9 aa, Homo Sapiens
DVISRLSGA

SEQ ID NO: 913351 - protein, 9 aa, Homo Sapiens
NLSTFRGLM

SEQ ID NO: 913352 - protein, 9 aa, Homo Sapiens
APPGAPSIC

SEQ ID NO: 913353 - protein, 9 aa, Homo Sapiens
LTEKIVAMT

SEQ ID NO: 913354 - protein, 9 aa, Homo Sapiens
RLGYILVVD

SEQ ID NO: 913355 - protein, 9 aa, Homo Sapiens
DSPECYQLL

SEQ ID NO: 913356 - protein, 9 aa, Homo Sapiens
NRQHSEPNE

SEQ ID NO: 913357 - protein, 9 aa, Homo Sapiens
WQSNVHHSW

SEQ ID NO: 913358 - protein, 9 aa, Homo Sapiens
LQGAMYGSG

SEQ ID NO: 913359 - protein, 9 aa, Homo Sapiens
PPRRLLLLL

SEQ ID NO: 913360 - protein, 9 aa, Homo Sapiens
KEKGKDNVE

SEQ ID NO: 913361 - protein, 9 aa, Homo Sapiens
CAWEAVEAL

SEQ ID NO: 913362 - protein, 9 aa, Homo Sapiens
RELREKVQK

SEQ ID NO: 913363 - protein, 9 aa, Homo Sapiens
KKLRTSSLA

SEQ ID NO: 913364 - protein, 9 aa, Homo Sapiens
SPPAKREQG

SEQ ID NO: 913365 - protein, 9 aa, Homo Sapiens
VQQTLYHQQ

SEQ ID NO: 913366 - protein, 9 aa, Homo Sapiens
DIYIVANKE

SEQ ID NO: 913367 - protein, 9 aa, Homo Sapiens
LDPSLQPYL

SEQ ID NO: 913368 - protein, 9 aa, Homo Sapiens
TTIIDRRPG

SEQ ID NO: 913369 - protein, 9 aa, Homo Sapiens
RGEMAHKDA

SEQ ID NO: 913370 - protein, 9 aa, Homo Sapiens
VDFVRHWQD

SEQ ID NO: 913371 - protein, 9 aa, Homo Sapiens
ILYLLLSLN

SEQ ID NO: 913372 - protein, 9 aa, Homo Sapiens
IPKDDYFSM

SEQ ID NO: 913373 - protein, 9 aa, Homo Sapiens
QEFYDTMTP

SEQ ID NO: 913374 - protein, 9 aa, Homo Sapiens
VAPMPSAVS

SEQ ID NO: 913375 - protein, 9 aa, Homo Sapiens
ETDGINCLV

SEQ ID NO: 913376 - protein, 9 aa, Homo Sapiens
NSKIEKTDS

SEQ ID NO: 913377 - protein, 9 aa, Homo Sapiens
WPKTWGWGW

SEQ ID NO: 913378 - protein, 9 aa, Homo Sapiens
LHNLSTFRG

SEQ ID NO: 913379 - protein, 9 aa, Homo Sapiens
TTQNMVDSY

SEQ ID NO: 913380 - protein, 9 aa, Homo Sapiens
YEVEKHAQN

SEQ ID NO: 913381 - protein, 9 aa, Homo Sapiens
VLRSLVFPG

SEQ ID NO: 913382 - protein, 9 aa, Homo Sapiens
LFTIQGLDP

SEQ ID NO: 913383 - protein, 9 aa, Homo Sapiens
QRGEMAHKD

SEQ ID NO: 913384 - protein, 9 aa, Homo Sapiens
EVVGRGFFF

SEQ ID NO: 913385 - protein, 9 aa, Homo Sapiens
KAICNSGQD

SEQ ID NO: 913386 - protein, 9 aa, Homo Sapiens
GDKPLADAE

SEQ ID NO: 913387 - protein, 9 aa, Homo Sapiens
NYSYRYDWL

SEQ ID NO: 913388 - protein, 9 aa, Homo Sapiens
PSASTPAPP

SEQ ID NO: 913389 - protein, 9 aa, Homo Sapiens
VQKEEEQLQ

SEQ ID NO: 913390 - protein, 9 aa, Homo Sapiens
GEESEDEER

SEQ ID NO: 913391 - protein, 9 aa, Homo Sapiens
CNSGQDHVQ

SEQ ID NO: 913392 - protein, 9 aa, Homo Sapiens
GYILVVDTL

SEQ ID NO: 913393 - protein, 9 aa, Homo Sapiens
MDDCSSNCN

SEQ ID NO: 913394 - protein, 9 aa, Homo Sapiens
SKIEKTDSV

SEQ ID NO: 913395 - protein, 9 aa, Homo Sapiens
DRIPCDHPY

SEQ ID NO: 913396 - protein, 9 aa, Homo Sapiens
KKKEIEMSG

SEQ ID NO: 913397 - protein, 9 aa, Homo Sapiens
HNLSTFRGL

SEQ ID NO: 913398 - protein, 9 aa, Homo Sapiens
PHRAMAPLG

SEQ ID NO: 913399 - protein, 9 aa, Homo Sapiens
VEVDQLIQD

SEQ ID NO: 913400 - protein, 9 aa, Homo Sapiens
ESEEQQLRP

SEQ ID NO: 913401 - protein, 9 aa, Homo Sapiens
LLCANANGS

SEQ ID NO: 913402 - protein, 9 aa, Homo Sapiens
LQEAQPDKE

SEQ ID NO: 913403 - protein, 9 aa, Homo Sapiens
LFLQVISLF

SEQ ID NO: 913404 - protein, 9 aa, Homo Sapiens
ITGWLRLRV

SEQ ID NO: 913405 - protein, 9 aa, Homo Sapiens
SESQGNGST

SEQ ID NO: 913406 - protein, 9 aa, Homo Sapiens
IPGPKTIVG

SEQ ID NO: 913407 - protein, 9 aa, Homo Sapiens
CNPDLRLRR

SEQ ID NO: 913408 - protein, 9 aa, Homo Sapiens
YLLFLQVIS

SEQ ID NO: 913409 - protein, 9 aa, Homo Sapiens
LEGWMPDQP

SEQ ID NO: 913410 - protein, 9 aa, Homo Sapiens
HSPHRAMAP

SEQ ID NO: 913411 - protein, 9 aa, Homo Sapiens
REKERKGAR

SEQ ID NO: 913412 - protein, 9 aa, Homo Sapiens
FSVVNPTAQ

SEQ ID NO: 913413 - protein, 9 aa, Homo Sapiens
TWGQVEVVG

SEQ ID NO: 913414 - protein, 9 aa, Homo Sapiens
KLKKKEIEM

SEQ ID NO: 913415 - protein, 9 aa, Homo Sapiens
NPEGGAGSK

SEQ ID NO: 913416 - protein, 9 aa, Homo Sapiens
RRIEVNAIF

SEQ ID NO: 913417 - protein, 9 aa, Homo Sapiens
NCLVDDFAN

SEQ ID NO: 913418 - protein, 9 aa, Homo Sapiens
PRRSKKAEL

SEQ ID NO: 913419 - protein, 9 aa, Homo Sapiens
FNGLEGKTP

SEQ ID NO: 913420 - protein, 9 aa, Homo Sapiens
TGYGAGGKL

SEQ ID NO: 913421 - protein, 9 aa, Homo Sapiens
GFSVEHLVQ

SEQ ID NO: 913422 - protein, 9 aa, Homo Sapiens
TMTPVNARY

SEQ ID NO: 913423 - protein, 9 aa, Homo Sapiens
SFSRSQLDM

SEQ ID NO: 913424 - protein, 9 aa, Homo Sapiens
DLRLRRHQK

SEQ ID NO: 913425 - protein, 9 aa, Homo Sapiens
SKFSVVNPT

SEQ ID NO: 913426 - protein, 9 aa, Homo Sapiens
GQEPNWGKG

SEQ ID NO: 913427 - protein, 9 aa, Homo Sapiens
LSDYEVAER

SEQ ID NO: 913428 - protein, 9 aa, Homo Sapiens
PDKEALELT

SEQ ID NO: 913429 - protein, 9 aa, Homo Sapiens
KVIHITGWL

SEQ ID NO: 913430 - protein, 9 aa, Homo Sapiens
QNMVDSYMA

SEQ ID NO: 913431 - protein, 9 aa, Homo Sapiens
ERKGARKAG

SEQ ID NO: 913432 - protein, 9 aa, Homo Sapiens
SKLIFGGYD

SEQ ID NO: 913433 - protein, 9 aa, Homo Sapiens
QEVISLQLE

SEQ ID NO: 913434 - protein, 9 aa, Homo Sapiens
VIHITGWLR

SEQ ID NO: 913435 - protein, 9 aa, Homo Sapiens
GWMPDQPYR

SEQ ID NO: 913436 - protein, 9 aa, Homo Sapiens
QALYIPKDD

SEQ ID NO: 913437 - protein, 9 aa, Homo Sapiens
LPMEGLPDT

SEQ ID NO: 913438 - protein, 9 aa, Homo Sapiens
RSQLDMQST

SEQ ID NO: 913439 - protein, 9 aa, Homo Sapiens
DEERDGDVD

SEQ ID NO: 913440 - protein, 9 aa, Homo Sapiens
HSWRTTWGQ

SEQ ID NO: 913441 - protein, 9 aa, Homo Sapiens
KLSYIQPGT

SEQ ID NO: 913442 - protein, 9 aa, Homo Sapiens
HKDANAKLQ

SEQ ID NO: 913443 - protein, 9 aa, Homo Sapiens
RLSKEWGSF

SEQ ID NO: 913444 - protein, 9 aa, Homo Sapiens
NEDPRRQPS

SEQ ID NO: 913445 - protein, 9 aa, Homo Sapiens
SLLTPKLFN

SEQ ID NO: 913446 - protein, 9 aa, Homo Sapiens
ASAAPEVSR

SEQ ID NO: 913447 - protein, 9 aa, Homo Sapiens
IQPGTQETP

SEQ ID NO: 913448 - protein, 9 aa, Homo Sapiens
EIFLYILDT

SEQ ID NO: 913449 - protein, 9 aa, Homo Sapiens
EQRGEMAHK

SEQ ID NO: 913450 - protein, 9 aa, Homo Sapiens
PDLRLRRHQ

SEQ ID NO: 913451 - protein, 9 aa, Homo Sapiens
QLRQESEEQ

SEQ ID NO: 913452 - protein, 9 aa, Homo Sapiens
KAGEFMITF

SEQ ID NO: 913453 - protein, 9 aa, Homo Sapiens
LNRQHSEPN

SEQ ID NO: 913454 - protein, 9 aa, Homo Sapiens
VRPGAVDFV

SEQ ID NO: 913455 - protein, 9 aa, Homo Sapiens
IDFTGHGLA

SEQ ID NO: 913456 - protein, 9 aa, Homo Sapiens
VQEFYDTMT

SEQ ID NO: 913457 - protein, 9 aa, Homo Sapiens
ACKPEFAYA

SEQ ID NO: 913458 - protein, 9 aa, Homo Sapiens
ELARGYVCT

SEQ ID NO: 913459 - protein, 9 aa, Homo Sapiens
EEVLKMAVK

SEQ ID NO: 913460 - protein, 9 aa, Homo Sapiens
ATNYSYRYD

SEQ ID NO: 913461 - protein, 9 aa, Homo Sapiens
GARKAGKTT

SEQ ID NO: 913462 - protein, 9 aa, Homo Sapiens
LTRKQGDLS

SEQ ID NO: 913463 - protein, 9 aa, Homo Sapiens
HGLALYRTD

SEQ ID NO: 913464 - protein, 9 aa, Homo Sapiens
FFCCRRRRK

SEQ ID NO: 913465 - protein, 9 aa, Homo Sapiens
PLWATNYSY

SEQ ID NO: 913466 - protein, 9 aa, Homo Sapiens
KEKEKKKGR

SEQ ID NO: 913467 - protein, 9 aa, Homo Sapiens
SKEQKLREK

SEQ ID NO: 913468 - protein, 9 aa, Homo Sapiens
DDKPPPTPP

SEQ ID NO: 913469 - protein, 9 aa, Homo Sapiens
DGTLAPSES

SEQ ID NO: 913470 - protein, 9 aa, Homo Sapiens
IPTFVEESR

SEQ ID NO: 913471 - protein, 9 aa, Homo Sapiens
EKEKKKGRE

SEQ ID NO: 913472 - protein, 9 aa, Homo Sapiens
PGGRGAAPL

SEQ ID NO: 913473 - protein, 9 aa, Homo Sapiens
ATLPLWATN

SEQ ID NO: 913474 - protein, 9 aa, Homo Sapiens
KIPELARGY

SEQ ID NO: 913475 - protein, 9 aa, Homo Sapiens
GEYEEVLKM

SEQ ID NO: 913476 - protein, 9 aa, Homo Sapiens
SEEQQLRPQ

SEQ ID NO: 913477 - protein, 9 aa, Homo Sapiens
IAEHLLQSW

SEQ ID NO: 913478 - protein, 9 aa, Homo Sapiens
RRLGYILVV

SEQ ID NO: 913479 - protein, 9 aa, Homo Sapiens
DETKSSQTP

SEQ ID NO: 913480 - protein, 9 aa, Homo Sapiens
QSNVHHSWR

SEQ ID NO: 913481 - protein, 9 aa, Homo Sapiens
GLALYRTDD

SEQ ID NO: 913482 - protein, 9 aa, Homo Sapiens
TLAPSESQG

SEQ ID NO: 913483 - protein, 9 aa, Homo Sapiens
LARGYVCTA

SEQ ID NO: 913484 - protein, 9 aa, Homo Sapiens
YIQPGTQET

SEQ ID NO: 913485 - protein, 9 aa, Homo Sapiens
ATDGGGLSV

SEQ ID NO: 913486 - protein, 9 aa, Homo Sapiens
RQYNNITEF

SEQ ID NO: 913487 - protein, 9 aa, Homo Sapiens
ERATTSRAE

SEQ ID NO: 913488 - protein, 9 aa, Homo Sapiens
KEKKKGREK

SEQ ID NO: 913489 - protein, 9 aa, Homo Sapiens
HLNSQDTLK

SEQ ID NO: 913490 - protein, 9 aa, Homo Sapiens
DEQVEGSQP

SEQ ID NO: 913491 - protein, 9 aa, Homo Sapiens
STGLHNLST

SEQ ID NO: 913492 - protein, 9 aa, Homo Sapiens
EQVEGSQPF

SEQ ID NO: 913493 - protein, 9 aa, Homo Sapiens
PSESQGNGS

SEQ ID NO: 913494 - protein, 9 aa, Homo Sapiens
LKNTSHEIA

SEQ ID NO: 913495 - protein, 9 aa, Homo Sapiens
PTPSASTPA

SEQ ID NO: 913496 - protein, 9 aa, Homo Sapiens
AVDFVRHWQ

SEQ ID NO: 913497 - protein, 9 aa, Homo Sapiens
QGERATTSR

SEQ ID NO: 913498 - protein, 9 aa, Homo Sapiens
LYILDTSTS

SEQ ID NO: 913499 - protein, 9 aa, Homo Sapiens
RLLLLLLSL

SEQ ID NO: 913500 - protein, 9 aa, Homo Sapiens
IQKPSLCFC

SEQ ID NO: 913501 - protein, 9 aa, Homo Sapiens
DVVSKFSVV

SEQ ID NO: 913502 - protein, 9 aa, Homo Sapiens
IDRRPGACE

SEQ ID NO: 913503 - protein, 9 aa, Homo Sapiens
KIEKTDSVE

SEQ ID NO: 913504 - protein, 9 aa, Homo Sapiens
RVARFCYFE

SEQ ID NO: 913505 - protein, 9 aa, Homo Sapiens
MAHKDANAK

SEQ ID NO: 913506 - protein, 9 aa, Homo Sapiens
ARGRWQSNV

SEQ ID NO: 913507 - protein, 9 aa, Homo Sapiens
PELARGYVC

SEQ ID NO: 913508 - protein, 9 aa, Homo Sapiens
NSQDTLKNY

SEQ ID NO: 913509 - protein, 9 aa, Homo Sapiens
ELEGPAQPC

SEQ ID NO: 913510 - protein, 9 aa, Homo Sapiens
PTFVEESRA

SEQ ID NO: 913511 - protein, 9 aa, Homo Sapiens
IVAMTMGSG

SEQ ID NO: 913512 - protein, 9 aa, Homo Sapiens
FVQQTLYHQ

SEQ ID NO: 913513 - protein, 9 aa, Homo Sapiens
IFLYILDTS

SEQ ID NO: 913514 - protein, 9 aa, Homo Sapiens
YTQQSHFVQ

SEQ ID NO: 913515 - protein, 9 aa, Homo Sapiens
ITSQSPVPT

SEQ ID NO: 913516 - protein, 9 aa, Homo Sapiens
NVHFNGLEG

SEQ ID NO: 913517 - protein, 9 aa, Homo Sapiens
LCSLQQIQK

SEQ ID NO: 913518 - protein, 9 aa, Homo Sapiens
LPAITSQSP

SEQ ID NO: 913519 - protein, 9 aa, Homo Sapiens
RWQSNVHHS

SEQ ID NO: 913520 - protein, 9 aa, Homo Sapiens
IPELARGYV

SEQ ID NO: 913521 - protein, 9 aa, Homo Sapiens
DGSFTVSTQ

SEQ ID NO: 913522 - protein, 9 aa, Homo Sapiens
ARGYVCTAR

SEQ ID NO: 913523 - protein, 9 aa, Homo Sapiens
HHSWRTTWG

SEQ ID NO: 913524 - protein, 9 aa, Homo Sapiens
GTEGFSVEH

SEQ ID NO: 913525 - protein, 9 aa, Homo Sapiens
YIPKDDYFS

SEQ ID NO: 913526 - protein, 9 aa, Homo Sapiens
VIDFTGHGL

SEQ ID NO: 913527 - protein, 9 aa, Homo Sapiens
LQVISLFLL

SEQ ID NO: 913528 - protein, 9 aa, Homo Sapiens
APLVALVAR

SEQ ID NO: 913529 - protein, 9 aa, Homo Sapiens
EQEAKIELK

SEQ ID NO: 913530 - protein, 9 aa, Homo Sapiens
RKQGDLSPP

SEQ ID NO: 913531 - protein, 9 aa, Homo Sapiens
VVSKFSVVN

SEQ ID NO: 913532 - protein, 9 aa, Homo Sapiens
VAGDVVSKF

SEQ ID NO: 913533 - protein, 9 aa, Homo Sapiens
RRPGACEES

SEQ ID NO: 913534 - protein, 9 aa, Homo Sapiens
ARRLGYILV

SEQ ID NO: 913535 - protein, 9 aa, Homo Sapiens
GLHNLSTFR

SEQ ID NO: 913536 - protein, 9 aa, Homo Sapiens
SRITQKAGE

SEQ ID NO: 913537 - protein, 9 aa, Homo Sapiens
GAVDFVRHW

SEQ ID NO: 913538 - protein, 9 aa, Homo Sapiens
GQVNKHDGG

SEQ ID NO: 913539 - protein, 9 aa, Homo Sapiens
DSDLSRHSS

SEQ ID NO: 913540 - protein, 9 aa, Homo Sapiens
KKEIEMSGL

SEQ ID NO: 913541 - protein, 9 aa, Homo Sapiens
QSPVPTTLP

SEQ ID NO: 913542 - protein, 9 aa, Homo Sapiens
VKKSVKAIC

SEQ ID NO: 913543 - protein, 9 aa, Homo Sapiens
QKLTDEQVE

SEQ ID NO: 913544 - protein, 9 aa, Homo Sapiens
FLYILDTST

SEQ ID NO: 913545 - protein, 9 aa, Homo Sapiens
SSLALNLPT

SEQ ID NO: 913546 - protein, 9 aa, Homo Sapiens
DKPPPTPPP

SEQ ID NO: 913547 - protein, 9 aa, Homo Sapiens
KCAWEAVEA

SEQ ID NO: 913548 - protein, 9 aa, Homo Sapiens
EEQLRQESE

SEQ ID NO: 913549 - protein, 9 aa, Homo Sapiens
TACKPEFAY

SEQ ID NO: 913550 - protein, 9 aa, Homo Sapiens
VEESRALCP

SEQ ID NO: 913551 - protein, 9 aa, Homo Sapiens
RDTDSHVQS

SEQ ID NO: 913552 - protein, 9 aa, Homo Sapiens
GILAVLQGG

SEQ ID NO: 913553 - protein, 9 aa, Homo Sapiens
VELCSQGRH

SEQ ID NO: 913554 - protein, 9 aa, Homo Sapiens
PDSLSPPVR

SEQ ID NO: 913555 - protein, 9 aa, Homo Sapiens
MMTERSLHE

SEQ ID NO: 913556 - protein, 9 aa, Homo Sapiens
TFIMPVLII

SEQ ID NO: 913557 - protein, 9 aa, Homo Sapiens
LTAYLCIRQ

SEQ ID NO: 913558 - protein, 9 aa, Homo Sapiens
MDLRVYGPA

SEQ ID NO: 913559 - protein, 9 aa, Homo Sapiens
RVSILRKDI

SEQ ID NO: 913560 - protein, 9 aa, Homo Sapiens
SSCSGWFPR

SEQ ID NO: 913561 - protein, 9 aa, Homo Sapiens
TIQMGSLRI

SEQ ID NO: 913562 - protein, 9 aa, Homo Sapiens
VISPDSLSP

SEQ ID NO: 913563 - protein, 9 aa, Homo Sapiens
ESDCLSNDS

SEQ ID NO: 913564 - protein, 9 aa, Homo Sapiens
HHEIYRRNA

SEQ ID NO: 913565 - protein, 9 aa, Homo Sapiens
TDIGFGVFL

SEQ ID NO: 913566 - protein, 9 aa, Homo Sapiens
GTICRGCPS

SEQ ID NO: 913567 - protein, 9 aa, Homo Sapiens
LTLICPWLR

SEQ ID NO: 913568 - protein, 9 aa, Homo Sapiens
CETFRMVVK

SEQ ID NO: 913569 - protein, 9 aa, Homo Sapiens
PFERPFKNH

SEQ ID NO: 913570 - protein, 9 aa, Homo Sapiens
PKQLQHHQQ

SEQ ID NO: 913571 - protein, 9 aa, Homo Sapiens
LCSQGRHIL

SEQ ID NO: 913572 - protein, 9 aa, Homo Sapiens
NNNFYLDSV

SEQ ID NO: 913573 - protein, 9 aa, Homo Sapiens
FFPQKVSEL

SEQ ID NO: 913574 - protein, 9 aa, Homo Sapiens
CSKSVCEPG

SEQ ID NO: 913575 - protein, 9 aa, Homo Sapiens
QEYKGVYST

SEQ ID NO: 913576 - protein, 9 aa, Homo Sapiens
ERGITNNNN

SEQ ID NO: 913577 - protein, 9 aa, Homo Sapiens
LRKDISENL

SEQ ID NO: 913578 - protein, 9 aa, Homo Sapiens
NNFYLDSVE

SEQ ID NO: 913579 - protein, 9 aa, Homo Sapiens
RGITNNNNF

SEQ ID NO: 913580 - protein, 9 aa, Homo Sapiens
GITNNNNFY

SEQ ID NO: 913581 - protein, 9 aa, Homo Sapiens
PDDMDLRVY

SEQ ID NO: 913582 - protein, 9 aa, Homo Sapiens
ERPFKNHQV

SEQ ID NO: 913583 - protein, 9 aa, Homo Sapiens
ARLPPGPPM

SEQ ID NO: 913584 - protein, 9 aa, Homo Sapiens
SILRKDISE

SEQ ID NO: 913585 - protein, 9 aa, Homo Sapiens
PAHHPGCQL

SEQ ID NO: 913586 - protein, 9 aa, Homo Sapiens
SSHRDTDSH

SEQ ID NO: 913587 - protein, 9 aa, Homo Sapiens
SAARLVSSC

SEQ ID NO: 913588 - protein, 9 aa, Homo Sapiens
LMMTERSLH

SEQ ID NO: 913589 - protein, 9 aa, Homo Sapiens
DPCNLLVDV

SEQ ID NO: 913590 - protein, 9 aa, Homo Sapiens
GQMSLGKSY

SEQ ID NO: 913591 - protein, 9 aa, Homo Sapiens
AKSGLDKLV

SEQ ID NO: 913592 - protein, 9 aa, Homo Sapiens
PPPGTLRGS

SEQ ID NO: 913593 - protein, 9 aa, Homo Sapiens
DTDSHVQSS

SEQ ID NO: 913594 - protein, 9 aa, Homo Sapiens
GLDKLVSDL

SEQ ID NO: 913595 - protein, 9 aa, Homo Sapiens
EVELCSQGR

SEQ ID NO: 913596 - protein, 9 aa, Homo Sapiens
CNLLVDVDD

SEQ ID NO: 913597 - protein, 9 aa, Homo Sapiens
TDSHVQSSP

SEQ ID NO: 913598 - protein, 9 aa, Homo Sapiens
SILTLICPW

SEQ ID NO: 913599 - protein, 9 aa, Homo Sapiens
TGHAAESVD

SEQ ID NO: 913600 - protein, 9 aa, Homo Sapiens
QKVSELHRA

SEQ ID NO: 913601 - protein, 9 aa, Homo Sapiens
TLRGSRTAA

SEQ ID NO: 913602 - protein, 9 aa, Homo Sapiens
TNNNNFYLD

SEQ ID NO: 913603 - protein, 9 aa, Homo Sapiens
ELHRATESH

SEQ ID NO: 913604 - protein, 9 aa, Homo Sapiens
DCETFRMVV

SEQ ID NO: 913605 - protein, 9 aa, Homo Sapiens
PRWAVPVHV

SEQ ID NO: 913606 - protein, 9 aa, Homo Sapiens
SRTAAGPRW

SEQ ID NO: 913607 - protein, 9 aa, Homo Sapiens
SRHHEIYRR

SEQ ID NO: 913608 - protein, 9 aa, Homo Sapiens
TLICPWLRL

SEQ ID NO: 913609 - protein, 9 aa, Homo Sapiens
SPDSLSPPV

SEQ ID NO: 913610 - protein, 9 aa, Homo Sapiens
TGIVGILAV

SEQ ID NO: 913611 - protein, 9 aa, Homo Sapiens
RRVSILRKD

SEQ ID NO: 913612 - protein, 9 aa, Homo Sapiens
LAVLQGGDV

SEQ ID NO: 913613 - protein, 9 aa, Homo Sapiens
IPPPGTLRG

SEQ ID NO: 913614 - protein, 9 aa, Homo Sapiens
GFALWCLCN

SEQ ID NO: 913615 - protein, 9 aa, Homo Sapiens
WCLCNVYSG

SEQ ID NO: 913616 - protein, 9 aa, Homo Sapiens
YRQDCETFR

SEQ ID NO: 913617 - protein, 9 aa, Homo Sapiens
VDVDDIRDL

SEQ ID NO: 913618 - protein, 9 aa, Homo Sapiens
RKDISENLY

SEQ ID NO: 913619 - protein, 9 aa, Homo Sapiens
SHRDTDSHV

SEQ ID NO: 913620 - protein, 9 aa, Homo Sapiens
GESDCLSND

SEQ ID NO: 913621 - protein, 9 aa, Homo Sapiens
ERWQATGHA

SEQ ID NO: 913622 - protein, 9 aa, Homo Sapiens
DVDDIRDLS

SEQ ID NO: 913623 - protein, 9 aa, Homo Sapiens
LIFLMMTER

SEQ ID NO: 913624 - protein, 9 aa, Homo Sapiens
AYLCIRQIW

SEQ ID NO: 913625 - protein, 9 aa, Homo Sapiens
GLVISPDSL

SEQ ID NO: 913626 - protein, 9 aa, Homo Sapiens
RPFKNHQVC

SEQ ID NO: 913627 - protein, 9 aa, Homo Sapiens
IERWQATGH

SEQ ID NO: 913628 - protein, 9 aa, Homo Sapiens
QALGMPLTP

SEQ ID NO: 913629 - protein, 9 aa, Homo Sapiens
KNHQVCLEW

SEQ ID NO: 913630 - protein, 9 aa, Homo Sapiens
SCSGWFPRI

SEQ ID NO: 913631 - protein, 9 aa, Homo Sapiens
ENGSGESDC

SEQ ID NO: 913632 - protein, 9 aa, Homo Sapiens
EIYRRNAFR

SEQ ID NO: 913633 - protein, 9 aa, Homo Sapiens
EPAHHPGCQ

SEQ ID NO: 913634 - protein, 9 aa, Homo Sapiens
FLIFLMMTE

SEQ ID NO: 913635 - protein, 9 aa, Homo Sapiens
KERGITNNN

SEQ ID NO: 913636 - protein, 9 aa, Homo Sapiens
NLLVDVDDI

SEQ ID NO: 913637 - protein, 9 aa, Homo Sapiens
DEWQFWLRD

SEQ ID NO: 913638 - protein, 9 aa, Homo Sapiens
LAFPDDMDL

SEQ ID NO: 913639 - protein, 9 aa, Homo Sapiens
VTVQPGCYL

SEQ ID NO: 913640 - protein, 9 aa, Homo Sapiens
FPILFFFFP

SEQ ID NO: 913641 - protein, 9 aa, Homo Sapiens
HRATESHRC

SEQ ID NO: 913642 - protein, 9 aa, Homo Sapiens
IPPKQLQHH

SEQ ID NO: 913643 - protein, 9 aa, Homo Sapiens
CSQGRHILV

SEQ ID NO: 913644 - protein, 9 aa, Homo Sapiens
FFFPQKVSE

SEQ ID NO: 913645 - protein, 9 aa, Homo Sapiens
KKTIQMGSL

SEQ ID NO: 913646 - protein, 9 aa, Homo Sapiens
NGSGESDCL

SEQ ID NO: 913647 - protein, 9 aa, Homo Sapiens
FPQKVSELH

SEQ ID NO: 913648 - protein, 9 aa, Homo Sapiens
ELEDEWQFW

SEQ ID NO: 913649 - protein, 9 aa, Homo Sapiens
ENGTICRGC

SEQ ID NO: 913650 - protein, 9 aa, Homo Sapiens
GIVGILAVL

SEQ ID NO: 913651 - protein, 9 aa, Homo Sapiens
SFGQMSLGK

SEQ ID NO: 913652 - protein, 9 aa, Homo Sapiens
LFFFFPQKV

SEQ ID NO: 913653 - protein, 9 aa, Homo Sapiens
LSRHHEIYR

SEQ ID NO: 913654 - protein, 9 aa, Homo Sapiens
TESHRCLRI

SEQ ID NO: 913655 - protein, 9 aa, Homo Sapiens
ILFFFFPQK

SEQ ID NO: 913656 - protein, 9 aa, Homo Sapiens
LVISPDSLS

SEQ ID NO: 913657 - protein, 9 aa, Homo Sapiens
ALGMPLTPQ

SEQ ID NO: 913658 - protein, 9 aa, Homo Sapiens
QATGHAAES

SEQ ID NO: 913659 - protein, 9 aa, Homo Sapiens
LSILTLICP

SEQ ID NO: 913660 - protein, 9 aa, Homo Sapiens
SHRCLRIPP

SEQ ID NO: 913661 - protein, 9 aa, Homo Sapiens
DCLSNDSSS

SEQ ID NO: 913662 - protein, 9 aa, Homo Sapiens
GSLRINPDG

SEQ ID NO: 913663 - protein, 9 aa, Homo Sapiens
RQDCETFRM

SEQ ID NO: 913664 - protein, 9 aa, Homo Sapiens
PFKNHQVCL

SEQ ID NO: 913665 - protein, 9 aa, Homo Sapiens
FEAVENGTI

SEQ ID NO: 913666 - protein, 9 aa, Homo Sapiens
CIFSFGQMS

SEQ ID NO: 913667 - protein, 9 aa, Homo Sapiens
LWCLCNVYS

SEQ ID NO: 913668 - protein, 9 aa, Homo Sapiens
CLCNVYSGH

SEQ ID NO: 913669 - protein, 9 aa, Homo Sapiens
IVGILAVLQ

SEQ ID NO: 913670 - protein, 9 aa, Homo Sapiens
CNVYSGHQS

SEQ ID NO: 913671 - protein, 9 aa, Homo Sapiens
WAVPVHVPG

SEQ ID NO: 913672 - protein, 9 aa, Homo Sapiens
DGCIFSFGQ

SEQ ID NO: 913673 - protein, 9 aa, Homo Sapiens
ETFRMVVKM

SEQ ID NO: 913674 - protein, 9 aa, Homo Sapiens
PRRVSILRK

SEQ ID NO: 913675 - protein, 9 aa, Homo Sapiens
ATGHAAESV

SEQ ID NO: 913676 - protein, 9 aa, Homo Sapiens
FLMMTERSL

SEQ ID NO: 913677 - protein, 9 aa, Homo Sapiens
GMPLTPQQA

SEQ ID NO: 913678 - protein, 9 aa, Homo Sapiens
GVYSTLAGE

SEQ ID NO: 913679 - protein, 9 aa, Homo Sapiens
ICPWLRLKP

SEQ ID NO: 913680 - protein, 9 aa, Homo Sapiens
CLRIPPPGT

SEQ ID NO: 913681 - protein, 9 aa, Homo Sapiens
IFLIFLMMT

SEQ ID NO: 913682 - protein, 9 aa, Homo Sapiens
FGQMSLGKS

SEQ ID NO: 913683 - protein, 9 aa, Homo Sapiens
RGGLVISPD

SEQ ID NO: 913684 - protein, 9 aa, Homo Sapiens
AAGPRWAVP

SEQ ID NO: 913685 - protein, 9 aa, Homo Sapiens
TVQPGCYLP

SEQ ID NO: 913686 - protein, 9 aa, Homo Sapiens
LICPWLRLK

SEQ ID NO: 913687 - protein, 9 aa, Homo Sapiens
GNIFLIFLM

SEQ ID NO: 913688 - protein, 9 aa, Homo Sapiens
ESHRCLRIP

SEQ ID NO: 913689 - protein, 9 aa, Homo Sapiens
GDLCSKSVC

SEQ ID NO: 913690 - protein, 9 aa, Homo Sapiens
DDMDLRVYG

SEQ ID NO: 913691 - protein, 9 aa, Homo Sapiens
SLSRHHEIY

SEQ ID NO: 913692 - protein, 9 aa, Homo Sapiens
TFRMVVKML

SEQ ID NO: 913693 - protein, 9 aa, Homo Sapiens
LEDEWQFWL

SEQ ID NO: 913694 - protein, 9 aa, Homo Sapiens
VSELHRATE

SEQ ID NO: 913695 - protein, 9 aa, Homo Sapiens
VSILRKDIS

SEQ ID NO: 913696 - protein, 9 aa, Homo Sapiens
AFPDDMDLR

SEQ ID NO: 913697 - protein, 9 aa, Homo Sapiens
PPGPPMARL

SEQ ID NO: 913698 - protein, 9 aa, Homo Sapiens
FWLRDEFQT

SEQ ID NO: 913699 - protein, 9 aa, Homo Sapiens
YLCIRQIWH

SEQ ID NO: 913700 - protein, 9 aa, Homo Sapiens
NVYSGHQSV

SEQ ID NO: 913701 - protein, 9 aa, Homo Sapiens
TAYLCIRQI

SEQ ID NO: 913702 - protein, 9 aa, Homo Sapiens
VLAFPDDMD

SEQ ID NO: 913703 - protein, 9 aa, Homo Sapiens
PCNLLVDVD

SEQ ID NO: 913704 - protein, 9 aa, Homo Sapiens
DSLSPPVRE

SEQ ID NO: 913705 - protein, 9 aa, Homo Sapiens
WQATGHAAE

SEQ ID NO: 913706 - protein, 9 aa, Homo Sapiens
QMSLGKSYT

SEQ ID NO: 913707 - protein, 9 aa, Homo Sapiens
CSGWFPRIP

SEQ ID NO: 913708 - protein, 9 aa, Homo Sapiens
PQKVSELHR

SEQ ID NO: 913709 - protein, 9 aa, Homo Sapiens
WQFSSDGTD

SEQ ID NO: 913710 - protein, 9 aa, Homo Sapiens
KLVSDLLQE

SEQ ID NO: 913711 - protein, 9 aa, Homo Sapiens
MGSLRINPD

SEQ ID NO: 913712 - protein, 9 aa, Homo Sapiens
FERPFKNHQ

SEQ ID NO: 913713 - protein, 9 aa, Homo Sapiens
RATESHRCL

SEQ ID NO: 913714 - protein, 9 aa, Homo Sapiens
QFSSDGTDI

SEQ ID NO: 913715 - protein, 9 aa, Homo Sapiens
ATESHRCLR

SEQ ID NO: 913716 - protein, 9 aa, Homo Sapiens
VGILAVLQG

SEQ ID NO: 913717 - protein, 9 aa, Homo Sapiens
QDCETFRMV

SEQ ID NO: 913718 - protein, 9 aa, Homo Sapiens
PGPPMARLP

SEQ ID NO: 913719 - protein, 9 aa, Homo Sapiens
LDKLVSDLL

SEQ ID NO: 913720 - protein, 9 aa, Homo Sapiens
RLVSSCSGW

SEQ ID NO: 913721 - protein, 9 aa, Homo Sapiens
DKLVSDLLQ

SEQ ID NO: 913722 - protein, 9 aa, Homo Sapiens
QLQHHQQQQ

SEQ ID NO: 913723 - protein, 9 aa, Homo Sapiens
PPGTLRGSR

SEQ ID NO: 913724 - protein, 9 aa, Homo Sapiens
FKNHQVCLE

SEQ ID NO: 913725 - protein, 9 aa, Homo Sapiens
LVDVDDIRD

SEQ ID NO: 913726 - protein, 9 aa, Homo Sapiens
QFWLRDEFQ

SEQ ID NO: 913727 - protein, 9 aa, Homo Sapiens
GGLVISPDS

SEQ ID NO: 913728 - protein, 9 aa, Homo Sapiens
RWQFSSDGT

SEQ ID NO: 913729 - protein, 9 aa, Homo Sapiens
HEIYRRNAF

SEQ ID NO: 913730 - protein, 9 aa, Homo Sapiens
SDCLSNDSS

SEQ ID NO: 913731 - protein, 9 aa, Homo Sapiens
GHAAESVDE

SEQ ID NO: 913732 - protein, 9 aa, Homo Sapiens
SSDGTDIGF

SEQ ID NO: 913733 - protein, 9 aa, Homo Sapiens
SLRINPDGS

SEQ ID NO: 913734 - protein, 9 aa, Homo Sapiens
ICRGCPSGT

SEQ ID NO: 913735 - protein, 9 aa, Homo Sapiens
AEVQEYKGV

SEQ ID NO: 913736 - protein, 9 aa, Homo Sapiens
ITNNNNFYL

SEQ ID NO: 913737 - protein, 9 aa, Homo Sapiens
LKICVFIFT

SEQ ID NO: 913738 - protein, 9 aa, Homo Sapiens
QGRHILVAW

SEQ ID NO: 913739 - protein, 9 aa, Homo Sapiens
PILFFFFPQ

SEQ ID NO: 913740 - protein, 9 aa, Homo Sapiens
NGTICRGCP

SEQ ID NO: 913741 - protein, 9 aa, Homo Sapiens
PPFERPFKN

SEQ ID NO: 913742 - protein, 9 aa, Homo Sapiens
AVENGTICR

SEQ ID NO: 913743 - protein, 9 aa, Homo Sapiens
PPKQLQHHQ

SEQ ID NO: 913744 - protein, 9 aa, Homo Sapiens
VFIFTFIMP

SEQ ID NO: 913745 - protein, 9 aa, Homo Sapiens
TAAGPRWAV

SEQ ID NO: 913746 - protein, 9 aa, Homo Sapiens
RIPPPGTLR

SEQ ID NO: 913747 - protein, 9 aa, Homo Sapiens
VQEYKGVYS

SEQ ID NO: 913748 - protein, 9 aa, Homo Sapiens
DGTDIGFGV

SEQ ID NO: 913749 - protein, 9 aa, Homo Sapiens
SDGTDIGFG

SEQ ID NO: 913750 - protein, 9 aa, Homo Sapiens
PMARLPPGP

SEQ ID NO: 913751 - protein, 9 aa, Homo Sapiens
LRINPDGSQ

SEQ ID NO: 913752 - protein, 9 aa, Homo Sapiens
KTIQMGSLR

SEQ ID NO: 913753 - protein, 9 aa, Homo Sapiens
LRGSRTAAG

SEQ ID NO: 913754 - protein, 9 aa, Homo Sapiens
NIFLIFLMM

SEQ ID NO: 913755 - protein, 9 aa, Homo Sapiens
EYKGVYSTL

SEQ ID NO: 913756 - protein, 9 aa, Homo Sapiens
HRDTDSHVQ

SEQ ID NO: 913757 - protein, 9 aa, Homo Sapiens
ARLVSSCSG

SEQ ID NO: 913758 - protein, 9 aa, Homo Sapiens
YQGDLCSKS

SEQ ID NO: 913759 - protein, 9 aa, Homo Sapiens
VENGTICRG

SEQ ID NO: 913760 - protein, 9 aa, Homo Sapiens
DLCSKSVCE

SEQ ID NO: 913761 - protein, 9 aa, Homo Sapiens
ILAVLQGGD

SEQ ID NO: 913762 - protein, 9 aa, Homo Sapiens
ICVFIFTFI

SEQ ID NO: 913763 - protein, 9 aa, Homo Sapiens
ALWCLCNVY

SEQ ID NO: 913764 - protein, 9 aa, Homo Sapiens
MARLPPGPP

SEQ ID NO: 913765 - protein, 9 aa, Homo Sapiens
VDDIRDLSS

SEQ ID NO: 913766 - protein, 9 aa, Homo Sapiens
ILSILTLIC

SEQ ID NO: 913767 - protein, 9 aa, Homo Sapiens
QGDLCSKSV

SEQ ID NO: 913768 - protein, 9 aa, Homo Sapiens
ILTAYLCIR

SEQ ID NO: 913769 - protein, 9 aa, Homo Sapiens
ILRKDISEN

SEQ ID NO: 913770 - protein, 9 aa, Homo Sapiens
YRRNAFRNK

SEQ ID NO: 913771 - protein, 9 aa, Homo Sapiens
GTDIGFGVF

SEQ ID NO: 913772 - protein, 9 aa, Homo Sapiens
GEEVELCSQ

SEQ ID NO: 913773 - protein, 9 aa, Homo Sapiens
PPMARLPPG

SEQ ID NO: 913774 - protein, 9 aa, Homo Sapiens
GSSHRDTDS

SEQ ID NO: 913775 - protein, 9 aa, Homo Sapiens
KICVFIFTF

SEQ ID NO: 913776 - protein, 9 aa, Homo Sapiens
GPPMARLPP

SEQ ID NO: 913777 - protein, 9 aa, Homo Sapiens
KGVYSTLAG

SEQ ID NO: 913778 - protein, 9 aa, Homo Sapiens
AGPRWAVPV

SEQ ID NO: 913779 - protein, 9 aa, Homo Sapiens
NQILTAYLC

SEQ ID NO: 913780 - protein, 9 aa, Homo Sapiens
GSGESDCLS

SEQ ID NO: 913781 - protein, 9 aa, Homo Sapiens
GTLRGSRTA

SEQ ID NO: 913782 - protein, 9 aa, Homo Sapiens
GEPAHHPGC

SEQ ID NO: 913783 - protein, 9 aa, Homo Sapiens
HRCLRIPPP

SEQ ID NO: 913784 - protein, 9 aa, Homo Sapiens
VTAKSGLDK

SEQ ID NO: 913785 - protein, 9 aa, Homo Sapiens
EVQEYKGVY

SEQ ID NO: 913786 - protein, 9 aa, Homo Sapiens
KSVCEPGCG

SEQ ID NO: 913787 - protein, 9 aa, Homo Sapiens
EAEVQEYKG

SEQ ID NO: 913788 - protein, 9 aa, Homo Sapiens
RLPPGPPMA

SEQ ID NO: 913789 - protein, 9 aa, Homo Sapiens
AARLVSSCS

SEQ ID NO: 913790 - protein, 9 aa, Homo Sapiens
RIERWQATG

SEQ ID NO: 913791 - protein, 9 aa, Homo Sapiens
KQLQHHQQQ

SEQ ID NO: 913792 - protein, 9 aa, Homo Sapiens
LVSSCSGWF

SEQ ID NO: 913793 - protein, 9 aa, Homo Sapiens
SGESDCLSN

SEQ ID NO: 913794 - protein, 9 aa, Homo Sapiens
WQFWLRDEF

SEQ ID NO: 913795 - protein, 9 aa, Homo Sapiens
EWQFWLRDE

SEQ ID NO: 913796 - protein, 9 aa, Homo Sapiens
GPRWAVPVH

SEQ ID NO: 913797 - protein, 9 aa, Homo Sapiens
ISPDSLSPP

SEQ ID NO: 913798 - protein, 9 aa, Homo Sapiens
SVCEPGCGA

SEQ ID NO: 913799 - protein, 9 aa, Homo Sapiens
LCSKSVCEP

SEQ ID NO: 913800 - protein, 9 aa, Homo Sapiens
IYRRNAFRN

SEQ ID NO: 913801 - protein, 9 aa, Homo Sapiens
FPDDMDLRV

SEQ ID NO: 913802 - protein, 9 aa, Homo Sapiens
RCLRIPPPG

SEQ ID NO: 913803 - protein, 9 aa, Homo Sapiens
GCIFSFGQM

SEQ ID NO: 913804 - protein, 9 aa, Homo Sapiens
DSHVQSSPV

SEQ ID NO: 913805 - protein, 9 aa, Homo Sapiens
DMDLRVYGP

SEQ ID NO: 913806 - protein, 9 aa, Homo Sapiens
VSSCSGWFP

SEQ ID NO: 913807 - protein, 9 aa, Homo Sapiens
QMGSLRINP

SEQ ID NO: 913808 - protein, 9 aa, Homo Sapiens
QILTAYLCI

SEQ ID NO: 913809 - protein, 9 aa, Homo Sapiens
SGLDKLVSD

SEQ ID NO: 913810 - protein, 9 aa, Homo Sapiens
RMVVKMLIE

SEQ ID NO: 913811 - protein, 9 aa, Homo Sapiens
FIFTFIMPV

SEQ ID NO: 913812 - protein, 9 aa, Homo Sapiens
CVFIFTFIM

SEQ ID NO: 913813 - protein, 9 aa, Homo Sapiens
NPRRVSILR

SEQ ID NO: 913814 - protein, 9 aa, Homo Sapiens
KSGLDKLVS

SEQ ID NO: 913815 - protein, 9 aa, Homo Sapiens
FRMVVKMLI

SEQ ID NO: 913816 - protein, 9 aa, Homo Sapiens
LGMPLTPQQ

SEQ ID NO: 913817 - protein, 9 aa, Homo Sapiens
RGSRTAAGP

SEQ ID NO: 913818 - protein, 9 aa, Homo Sapiens
LCNVYSGHQ

SEQ ID NO: 913819 - protein, 9 aa, Homo Sapiens
TICRGCPSG

SEQ ID NO: 913820 - protein, 9 aa, Homo Sapiens
EEVELCSQG

SEQ ID NO: 913821 - protein, 9 aa, Homo Sapiens
LRIPPPGTL

SEQ ID NO: 913822 - protein, 9 aa, Homo Sapiens
SELHRATES

SEQ ID NO: 913823 - protein, 9 aa, Homo Sapiens
TAKSGLDKL

SEQ ID NO: 913824 - protein, 9 aa, Homo Sapiens
GSRTAAGPR

SEQ ID NO: 913825 - protein, 9 aa, Homo Sapiens
SKSVCEPGC

SEQ ID NO: 913826 - protein, 9 aa, Homo Sapiens
CIRQIWHDA

SEQ ID NO: 913827 - protein, 9 aa, Homo Sapiens
PGSSHRDTD

SEQ ID NO: 913828 - protein, 9 aa, Homo Sapiens
MPLTPQQAQ

SEQ ID NO: 913829 - protein, 9 aa, Homo Sapiens
RWAVPVHVP

SEQ ID NO: 913830 - protein, 9 aa, Homo Sapiens
IQMGSLRIN

SEQ ID NO: 913831 - protein, 9 aa, Homo Sapiens
LLVDVDDIR

SEQ ID NO: 913832 - protein, 9 aa, Homo Sapiens
AVLQGGDVT

SEQ ID NO: 913833 - protein, 9 aa, Homo Sapiens
FFFFPQKVS

SEQ ID NO: 913834 - protein, 9 aa, Homo Sapiens
FALWCLCNV

SEQ ID NO: 913835 - protein, 9 aa, Homo Sapiens
LCIRQIWHD

SEQ ID NO: 913836 - protein, 9 aa, Homo Sapiens
IFSFGQMSL

SEQ ID NO: 913837 - protein, 9 aa, Homo Sapiens
KVSELHRAT

SEQ ID NO: 913838 - protein, 9 aa, Homo Sapiens
ILTLICPWL

SEQ ID NO: 913839 - protein, 9 aa, Homo Sapiens
YKGVYSTLA

SEQ ID NO: 913840 - protein, 9 aa, Homo Sapiens
ELCSQGRHI

SEQ ID NO: 913841 - protein, 9 aa, Homo Sapiens
NNNNFYLDS

SEQ ID NO: 913842 - protein, 9 aa, Homo Sapiens
RHHEIYRRN

SEQ ID NO: 913843 - protein, 9 aa, Homo Sapiens
NHQVCLEWN

SEQ ID NO: 913844 - protein, 9 aa, Homo Sapiens
EAVENGTIC

SEQ ID NO: 913845 - protein, 9 aa, Homo Sapiens
FTFIMPVLI

SEQ ID NO: 913846 - protein, 9 aa, Homo Sapiens
PGTLRGSRT

SEQ ID NO: 913847 - protein, 9 aa, Homo Sapiens
RTAAGPRWA

SEQ ID NO: 913848 - protein, 9 aa, Homo Sapiens
CLSNDSSSA

SEQ ID NO: 913849 - protein, 9 aa, Homo Sapiens
WLRDEFQTA

SEQ ID NO: 913850 - protein, 9 aa, Homo Sapiens
IFTFIMPVL

SEQ ID NO: 913851 - protein, 9 aa, Homo Sapiens
SQGRHILVA

SEQ ID NO: 913852 - protein, 9 aa, Homo Sapiens
EVTVQPGCY

SEQ ID NO: 913853 - protein, 9 aa, Homo Sapiens
LHRATESHR

SEQ ID NO: 913854 - protein, 9 aa, Homo Sapiens
VLQGGDVTI

SEQ ID NO: 913855 - protein, 9 aa, Homo Sapiens
EDEWQFWLR

SEQ ID NO: 913856 - protein, 9 aa, Homo Sapiens
FSFGQMSLG

SEQ ID NO: 913857 - protein, 9 aa, Homo Sapiens
FSSDGTDIG

SEQ ID NO: 913858 - protein, 9 aa, Homo Sapiens
IFLMMTERS

SEQ ID NO: 913859 - protein, 9 aa, Homo Sapiens
AVLAFPDDM

SEQ ID NO: 913860 - protein, 9 aa, Homo Sapiens
RWQATGHAA

SEQ ID NO: 913861 - protein, 9 aa, Homo Sapiens
FVGSCLGDS

SEQ ID NO: 913862 - protein, 9 aa, Homo Sapiens
CLGDSQLVK

SEQ ID NO: 913863 - protein, 9 aa, Homo Sapiens
ARAFFPALP

SEQ ID NO: 913864 - protein, 9 aa, Homo Sapiens
AINPPPTSG

SEQ ID NO: 913865 - protein, 9 aa, Homo Sapiens
LHSIWPREE

SEQ ID NO: 913866 - protein, 9 aa, Homo Sapiens
GDVYFPEEL

SEQ ID NO: 913867 - protein, 9 aa, Homo Sapiens
KLYPLFQDV

SEQ ID NO: 913868 - protein, 9 aa, Homo Sapiens
KGGHMDRQK

SEQ ID NO: 913869 - protein, 9 aa, Homo Sapiens
ANFTKGSFD

SEQ ID NO: 913870 - protein, 9 aa, Homo Sapiens
PLGDVYFPE

SEQ ID NO: 913871 - protein, 9 aa, Homo Sapiens
VAFPFMDAM

SEQ ID NO: 913872 - protein, 9 aa, Homo Sapiens
LLSKLPMPY

SEQ ID NO: 913873 - protein, 9 aa, Homo Sapiens
GAKGLRGIS

SEQ ID NO: 913874 - protein, 9 aa, Homo Sapiens
HELNFHKAQ

SEQ ID NO: 913875 - protein, 9 aa, Homo Sapiens
MPANFTKGS

SEQ ID NO: 913876 - protein, 9 aa, Homo Sapiens
LRLIFLLVG

SEQ ID NO: 913877 - protein, 9 aa, Homo Sapiens
IHFTEGHKK

SEQ ID NO: 913878 - protein, 9 aa, Homo Sapiens
SSFLPPLEE

SEQ ID NO: 913879 - protein, 9 aa, Homo Sapiens
MSPLLKNQS

SEQ ID NO: 913880 - protein, 9 aa, Homo Sapiens
LNKDIQSGI

SEQ ID NO: 913881 - protein, 9 aa, Homo Sapiens
IFLLFNSSD

SEQ ID NO: 913882 - protein, 9 aa, Homo Sapiens
LYFLLDRFR

SEQ ID NO: 913883 - protein, 9 aa, Homo Sapiens
VLVRLARHS

SEQ ID NO: 913884 - protein, 9 aa, Homo Sapiens
DLSPDDSTG

SEQ ID NO: 913885 - protein, 9 aa, Homo Sapiens
YVIPEISQV

SEQ ID NO: 913886 - protein, 9 aa, Homo Sapiens
RFMAMNLEH

SEQ ID NO: 913887 - protein, 9 aa, Homo Sapiens
QLWLNDSHN

SEQ ID NO: 913888 - protein, 9 aa, Homo Sapiens
SSPLAACIP

SEQ ID NO: 913889 - protein, 9 aa, Homo Sapiens
QVTLHSIWP

SEQ ID NO: 913890 - protein, 9 aa, Homo Sapiens
AFFPALPSA

SEQ ID NO: 913891 - protein, 9 aa, Homo Sapiens
SIWPREEND

SEQ ID NO: 913892 - protein, 9 aa, Homo Sapiens
MQLWLNDSH

SEQ ID NO: 913893 - protein, 9 aa, Homo Sapiens
ASHLSAVIV

SEQ ID NO: 913894 - protein, 9 aa, Homo Sapiens
LFLNVPGYK

SEQ ID NO: 913895 - protein, 9 aa, Homo Sapiens
LKAKIITIL

SEQ ID NO: 913896 - protein, 9 aa, Homo Sapiens
MQRKQETSA

SEQ ID NO: 913897 - protein, 9 aa, Homo Sapiens
ILEDDEYET

SEQ ID NO: 913898 - protein, 9 aa, Homo Sapiens
PSLPPRSGS

SEQ ID NO: 913899 - protein, 9 aa, Homo Sapiens
YCQNLQTKQ

SEQ ID NO: 913900 - protein, 9 aa, Homo Sapiens
SETEETWKA

SEQ ID NO: 913901 - protein, 9 aa, Homo Sapiens
SEGAGPYVD

SEQ ID NO: 913902 - protein, 9 aa, Homo Sapiens
YKIERSFFL

SEQ ID NO: 913903 - protein, 9 aa, Homo Sapiens
AIWDLCQAR

SEQ ID NO: 913904 - protein, 9 aa, Homo Sapiens
LLAKKFGEN

SEQ ID NO: 913905 - protein, 9 aa, Homo Sapiens
QNPLEQIND

SEQ ID NO: 913906 - protein, 9 aa, Homo Sapiens
FGENVAKFI

SEQ ID NO: 913907 - protein, 9 aa, Homo Sapiens
QCPSPPPPA

SEQ ID NO: 913908 - protein, 9 aa, Homo Sapiens
MNLEHEDMV

SEQ ID NO: 913909 - protein, 9 aa, Homo Sapiens
PALPSAVPV

SEQ ID NO: 913910 - protein, 9 aa, Homo Sapiens
APQCPSPPP

SEQ ID NO: 913911 - protein, 9 aa, Homo Sapiens
SHRAAPCSG

SEQ ID NO: 913912 - protein, 9 aa, Homo Sapiens
VPGYKASFR

SEQ ID NO: 913913 - protein, 9 aa, Homo Sapiens
LRAKCHITG

SEQ ID NO: 913914 - protein, 9 aa, Homo Sapiens
LATEKSRWS

SEQ ID NO: 913915 - protein, 9 aa, Homo Sapiens
KKERPRQQD

SEQ ID NO: 913916 - protein, 9 aa, Homo Sapiens
LCPSGHNNS

SEQ ID NO: 913917 - protein, 9 aa, Homo Sapiens
LNYCKEGIA

SEQ ID NO: 913918 - protein, 9 aa, Homo Sapiens
SKNIMQTLS

SEQ ID NO: 913919 - protein, 9 aa, Homo Sapiens
QPAPFFSQP

SEQ ID NO: 913920 - protein, 9 aa, Homo Sapiens
LEKLNDVQL

SEQ ID NO: 913921 - protein, 9 aa, Homo Sapiens
NFNFRNGFG

SEQ ID NO: 913922 - protein, 9 aa, Homo Sapiens
WVLRKRKVV

SEQ ID NO: 913923 - protein, 9 aa, Homo Sapiens
SISIKHPQE

SEQ ID NO: 913924 - protein, 9 aa, Homo Sapiens
FFSQPVQTT

SEQ ID NO: 913925 - protein, 9 aa, Homo Sapiens
FLLDRFRLS

SEQ ID NO: 913926 - protein, 9 aa, Homo Sapiens
PYFQPKNSQ

SEQ ID NO: 913927 - protein, 9 aa, Homo Sapiens
WYMWSDASG

SEQ ID NO: 913928 - protein, 9 aa, Homo Sapiens
MVLSVFVAI

SEQ ID NO: 913929 - protein, 9 aa, Homo Sapiens
EQNFNFRNG

SEQ ID NO: 913930 - protein, 9 aa, Homo Sapiens
LEQINDGKY

SEQ ID NO: 913931 - protein, 9 aa, Homo Sapiens
SKLPMPYIT

SEQ ID NO: 913932 - protein, 9 aa, Homo Sapiens
KTPSKIPYK

SEQ ID NO: 913933 - protein, 9 aa, Homo Sapiens
LLFLNVPGY

SEQ ID NO: 913934 - protein, 9 aa, Homo Sapiens
TQPAPFFSQ

SEQ ID NO: 913935 - protein, 9 aa, Homo Sapiens
DIQSGIHGT

SEQ ID NO: 913936 - protein, 9 aa, Homo Sapiens
PGICHVHPN

SEQ ID NO: 913937 - protein, 9 aa, Homo Sapiens
MVGRGMHSA

SEQ ID NO: 913938 - protein, 9 aa, Homo Sapiens
EHELNFHKA

SEQ ID NO: 913939 - protein, 9 aa, Homo Sapiens
FSEGAGPYV

SEQ ID NO: 913940 - protein, 9 aa, Homo Sapiens
EIKDVQIPV

SEQ ID NO: 913941 - protein, 9 aa, Homo Sapiens
GWLLKSGRP

SEQ ID NO: 913942 - protein, 9 aa, Homo Sapiens
FQPKNSQDV

SEQ ID NO: 913943 - protein, 9 aa, Homo Sapiens
KESHESLGM

SEQ ID NO: 913944 - protein, 9 aa, Homo Sapiens
IISEEDVWE

SEQ ID NO: 913945 - protein, 9 aa, Homo Sapiens
EKPSLPPRS

SEQ ID NO: 913946 - protein, 9 aa, Homo Sapiens
VKREEGEVF

SEQ ID NO: 913947 - protein, 9 aa, Homo Sapiens
QPLQLSTET

SEQ ID NO: 913948 - protein, 9 aa, Homo Sapiens
KPSLPPRSG

SEQ ID NO: 913949 - protein, 9 aa, Homo Sapiens
TLTYQSVGI

SEQ ID NO: 913950 - protein, 9 aa, Homo Sapiens
EDEKPSLPP

SEQ ID NO: 913951 - protein, 9 aa, Homo Sapiens
RQSIFQLLK

SEQ ID NO: 913952 - protein, 9 aa, Homo Sapiens
VEDGGSSTG

SEQ ID NO: 913953 - protein, 9 aa, Homo Sapiens
RLIFLLVGI

SEQ ID NO: 913954 - protein, 9 aa, Homo Sapiens
LDILAVLVR

SEQ ID NO: 913955 - protein, 9 aa, Homo Sapiens
PFRILEDDE

SEQ ID NO: 913956 - protein, 9 aa, Homo Sapiens
SLVLKAKII

SEQ ID NO: 913957 - protein, 9 aa, Homo Sapiens
LFWGNRDGS

SEQ ID NO: 913958 - protein, 9 aa, Homo Sapiens
EMKLPGDKI

SEQ ID NO: 913959 - protein, 9 aa, Homo Sapiens
SLLLFLNVP

SEQ ID NO: 913960 - protein, 9 aa, Homo Sapiens
SQILEHELN

SEQ ID NO: 913961 - protein, 9 aa, Homo Sapiens
LLGGLTSPE

SEQ ID NO: 913962 - protein, 9 aa, Homo Sapiens
MKPSSPLGE

SEQ ID NO: 913963 - protein, 9 aa, Homo Sapiens
LGIRISVGH

SEQ ID NO: 913964 - protein, 9 aa, Homo Sapiens
RLREQEERQ

SEQ ID NO: 913965 - protein, 9 aa, Homo Sapiens
VEGTSGMEI

SEQ ID NO: 913966 - protein, 9 aa, Homo Sapiens
NFDLSPDDS

SEQ ID NO: 913967 - protein, 9 aa, Homo Sapiens
ITVKKESHE

SEQ ID NO: 913968 - protein, 9 aa, Homo Sapiens
LGDEQNELL

SEQ ID NO: 913969 - protein, 9 aa, Homo Sapiens
ARVEIKDVQ

SEQ ID NO: 913970 - protein, 9 aa, Homo Sapiens
MRAINPPPT

SEQ ID NO: 913971 - protein, 9 aa, Homo Sapiens
FPEELQEYL

SEQ ID NO: 913972 - protein, 9 aa, Homo Sapiens
TPKPYFQPK

SEQ ID NO: 913973 - protein, 9 aa, Homo Sapiens
YCKEGIAFF

SEQ ID NO: 913974 - protein, 9 aa, Homo Sapiens
PSGHNNSPQ

SEQ ID NO: 913975 - protein, 9 aa, Homo Sapiens
KNDRRRKSR

SEQ ID NO: 913976 - protein, 9 aa, Homo Sapiens
RLQNPLEQI

SEQ ID NO: 913977 - protein, 9 aa, Homo Sapiens
KQETSAFLR

SEQ ID NO: 913978 - protein, 9 aa, Homo Sapiens
TSGMEITTK

SEQ ID NO: 913979 - protein, 9 aa, Homo Sapiens
LFNSSDFIT

SEQ ID NO: 913980 - protein, 9 aa, Homo Sapiens
VLKAKIITI

SEQ ID NO: 913981 - protein, 9 aa, Homo Sapiens
NTLLGDEQN

SEQ ID NO: 913982 - protein, 9 aa, Homo Sapiens
HIVQQAQRQ

SEQ ID NO: 913983 - protein, 9 aa, Homo Sapiens
STDLERLRK

SEQ ID NO: 913984 - protein, 9 aa, Homo Sapiens
NDVQLALVI

SEQ ID NO: 913985 - protein, 9 aa, Homo Sapiens
VQLALVIAR

SEQ ID NO: 913986 - protein, 9 aa, Homo Sapiens
CVWPWQCPC

SEQ ID NO: 913987 - protein, 9 aa, Homo Sapiens
LNFDLSPDD

SEQ ID NO: 913988 - protein, 9 aa, Homo Sapiens
QSGIHGTVP

SEQ ID NO: 913989 - protein, 9 aa, Homo Sapiens
DVQLALVIA

SEQ ID NO: 913990 - protein, 9 aa, Homo Sapiens
FLLFNSSDF

SEQ ID NO: 913991 - protein, 9 aa, Homo Sapiens
TEETWKALP

SEQ ID NO: 913992 - protein, 9 aa, Homo Sapiens
LKSGRPKEM

SEQ ID NO: 913993 - protein, 9 aa, Homo Sapiens
IWDLCQARD

SEQ ID NO: 913994 - protein, 9 aa, Homo Sapiens
GMHSAGVTR

SEQ ID NO: 913995 - protein, 9 aa, Homo Sapiens
LLKFWEGDM

SEQ ID NO: 913996 - protein, 9 aa, Homo Sapiens
SDSETEETW

SEQ ID NO: 913997 - protein, 9 aa, Homo Sapiens
YTLRNRNMK

SEQ ID NO: 913998 - protein, 9 aa, Homo Sapiens
PTDMGIFFK

SEQ ID NO: 913999 - protein, 9 aa, Homo Sapiens
VCLEKLNDV

SEQ ID NO: 914000 - protein, 9 aa, Homo Sapiens
ITKKENSAF

SEQ ID NO: 914001 - protein, 9 aa, Homo Sapiens
ISVGHVDYF

SEQ ID NO: 914002 - protein, 9 aa, Homo Sapiens
HKKDLLEVS

SEQ ID NO: 914003 - protein, 9 aa, Homo Sapiens
RILEDDEYE

SEQ ID NO: 914004 - protein, 9 aa, Homo Sapiens
TTPGGWLLK

SEQ ID NO: 914005 - protein, 9 aa, Homo Sapiens
NPLEQINDG

SEQ ID NO: 914006 - protein, 9 aa, Homo Sapiens
EKSRWSGSH

SEQ ID NO: 914007 - protein, 9 aa, Homo Sapiens
EITTKLGAA

SEQ ID NO: 914008 - protein, 9 aa, Homo Sapiens
EDGEEEEEV

SEQ ID NO: 914009 - protein, 9 aa, Homo Sapiens
AFLLRLIFL

SEQ ID NO: 914010 - protein, 9 aa, Homo Sapiens
RLYFLLDRF

SEQ ID NO: 914011 - protein, 9 aa, Homo Sapiens
RQLFWGNRD

SEQ ID NO: 914012 - protein, 9 aa, Homo Sapiens
FNLEIYCQN

SEQ ID NO: 914013 - protein, 9 aa, Homo Sapiens
RSVVALLPP

SEQ ID NO: 914014 - protein, 9 aa, Homo Sapiens
VEDPRVVVI

SEQ ID NO: 914015 - protein, 9 aa, Homo Sapiens
DLSKLFKTL

SEQ ID NO: 914016 - protein, 9 aa, Homo Sapiens
SIKHPQEMK

SEQ ID NO: 914017 - protein, 9 aa, Homo Sapiens
YFQPKNSQD

SEQ ID NO: 914018 - protein, 9 aa, Homo Sapiens
TWKALPIQS

SEQ ID NO: 914019 - protein, 9 aa, Homo Sapiens
PMLTPKPYF

SEQ ID NO: 914020 - protein, 9 aa, Homo Sapiens
VRLARHSLE

SEQ ID NO: 914021 - protein, 9 aa, Homo Sapiens
NGQVEDGGS

SEQ ID NO: 914022 - protein, 9 aa, Homo Sapiens
HFNLEIYCQ

SEQ ID NO: 914023 - protein, 9 aa, Homo Sapiens
SMKPSSPLG

SEQ ID NO: 914024 - protein, 9 aa, Homo Sapiens
LIISEEDVW

SEQ ID NO: 914025 - protein, 9 aa, Homo Sapiens
NYCKEGIAF

SEQ ID NO: 914026 - protein, 9 aa, Homo Sapiens
SRGLPTDWY

SEQ ID NO: 914027 - protein, 9 aa, Homo Sapiens
TPEQASSTA

SEQ ID NO: 914028 - protein, 9 aa, Homo Sapiens
DPTAAASLV

SEQ ID NO: 914029 - protein, 9 aa, Homo Sapiens
MLQQQQAQQ

SEQ ID NO: 914030 - protein, 9 aa, Homo Sapiens
ERLNSRDVE

SEQ ID NO: 914031 - protein, 9 aa, Homo Sapiens
LARAFFPAL

SEQ ID NO: 914032 - protein, 9 aa, Homo Sapiens
VQEYKIERS

SEQ ID NO: 914033 - protein, 9 aa, Homo Sapiens
SHESLGMTV

SEQ ID NO: 914034 - protein, 9 aa, Homo Sapiens
AASLVLKAK

SEQ ID NO: 914035 - protein, 9 aa, Homo Sapiens
YAIWDLCQA

SEQ ID NO: 914036 - protein, 9 aa, Homo Sapiens
FLPPLEEAA

SEQ ID NO: 914037 - protein, 9 aa, Homo Sapiens
WDLCQARDC

SEQ ID NO: 914038 - protein, 9 aa, Homo Sapiens
ASPFRILED

SEQ ID NO: 914039 - protein, 9 aa, Homo Sapiens
VQMSPLLKN

SEQ ID NO: 914040 - protein, 9 aa, Homo Sapiens
NLGIRISVG

SEQ ID NO: 914041 - protein, 9 aa, Homo Sapiens
RRAASLVLK

SEQ ID NO: 914042 - protein, 9 aa, Homo Sapiens
SEEDVWENV

SEQ ID NO: 914043 - protein, 9 aa, Homo Sapiens
DGEDEKPSL

SEQ ID NO: 914044 - protein, 9 aa, Homo Sapiens
VVVIWTKNK

SEQ ID NO: 914045 - protein, 9 aa, Homo Sapiens
TARHFAGLP

SEQ ID NO: 914046 - protein, 9 aa, Homo Sapiens
GGHMDRQKR

SEQ ID NO: 914047 - protein, 9 aa, Homo Sapiens
GFRRFMAMN

SEQ ID NO: 914048 - protein, 9 aa, Homo Sapiens
SEGWCVWPW

SEQ ID NO: 914049 - protein, 9 aa, Homo Sapiens
VQQAQRQQD

SEQ ID NO: 914050 - protein, 9 aa, Homo Sapiens
SSLHDSSPP

SEQ ID NO: 914051 - protein, 9 aa, Homo Sapiens
LEIYCQNLQ

SEQ ID NO: 914052 - protein, 9 aa, Homo Sapiens
GHMDRQKRD

SEQ ID NO: 914053 - protein, 9 aa, Homo Sapiens
TKGSFDSSG

SEQ ID NO: 914054 - protein, 9 aa, Homo Sapiens
RESWVLRKR

SEQ ID NO: 914055 - protein, 9 aa, Homo Sapiens
WLNFDLSPD

SEQ ID NO: 914056 - protein, 9 aa, Homo Sapiens
NLGDMSPEG

SEQ ID NO: 914057 - protein, 9 aa, Homo Sapiens
MPKTFLRPK

SEQ ID NO: 914058 - protein, 9 aa, Homo Sapiens
SSSLHDSSP

SEQ ID NO: 914059 - protein, 9 aa, Homo Sapiens
PNLGDMSPE

SEQ ID NO: 914060 - protein, 9 aa, Homo Sapiens
RKRKVVVID

SEQ ID NO: 914061 - protein, 9 aa, Homo Sapiens
ANGQVEDGG

SEQ ID NO: 914062 - protein, 9 aa, Homo Sapiens
FAQKPQSPE

SEQ ID NO: 914063 - protein, 9 aa, Homo Sapiens
YALNYEQKE

SEQ ID NO: 914064 - protein, 9 aa, Homo Sapiens
IFIVLAAGM

SEQ ID NO: 914065 - protein, 9 aa, Homo Sapiens
EQINDGKYS

SEQ ID NO: 914066 - protein, 9 aa, Homo Sapiens
LTYQSVGIS

SEQ ID NO: 914067 - protein, 9 aa, Homo Sapiens
HFLQRVILR

SEQ ID NO: 914068 - protein, 9 aa, Homo Sapiens
DKIYSISIK

SEQ ID NO: 914069 - protein, 9 aa, Homo Sapiens
RVLNKDIQS

SEQ ID NO: 914070 - protein, 9 aa, Homo Sapiens
DGAVVSPNL

SEQ ID NO: 914071 - protein, 9 aa, Homo Sapiens
RAFLYLVAF

SEQ ID NO: 914072 - protein, 9 aa, Homo Sapiens
WLLKSGRPK

SEQ ID NO: 914073 - protein, 9 aa, Homo Sapiens
LDPGICANG

SEQ ID NO: 914074 - protein, 9 aa, Homo Sapiens
LGSANGQVE

SEQ ID NO: 914075 - protein, 9 aa, Homo Sapiens
LTSPEIRFS

SEQ ID NO: 914076 - protein, 9 aa, Homo Sapiens
LFYVIPEIS

SEQ ID NO: 914077 - protein, 9 aa, Homo Sapiens
SANGQVEDG

SEQ ID NO: 914078 - protein, 9 aa, Homo Sapiens
SLPPRMLPG

SEQ ID NO: 914079 - protein, 9 aa, Homo Sapiens
WENVVTYDD

SEQ ID NO: 914080 - protein, 9 aa, Homo Sapiens
LLRSKLFYA

SEQ ID NO: 914081 - protein, 9 aa, Homo Sapiens
PLLKNQSSK

SEQ ID NO: 914082 - protein, 9 aa, Homo Sapiens
SPLLKNQSS

SEQ ID NO: 914083 - protein, 9 aa, Homo Sapiens
QSQTPGASL

SEQ ID NO: 914084 - protein, 9 aa, Homo Sapiens
EETWKALPI

SEQ ID NO: 914085 - protein, 9 aa, Homo Sapiens
QLSTETVEQ

SEQ ID NO: 914086 - protein, 9 aa, Homo Sapiens
PRVVVIWTK

SEQ ID NO: 914087 - protein, 9 aa, Homo Sapiens
CASHLSAVI

SEQ ID NO: 914088 - protein, 9 aa, Homo Sapiens
VFAREHGLI

SEQ ID NO: 914089 - protein, 9 aa, Homo Sapiens
FLQRVILRD

SEQ ID NO: 914090 - protein, 9 aa, Homo Sapiens
NLEIYCQNL

SEQ ID NO: 914091 - protein, 9 aa, Homo Sapiens
SGKNMRAIN

SEQ ID NO: 914092 - protein, 9 aa, Homo Sapiens
EQEERQREQ

SEQ ID NO: 914093 - protein, 9 aa, Homo Sapiens
HSHFVQEYK

SEQ ID NO: 914094 - protein, 9 aa, Homo Sapiens
PKTFLRPKV

SEQ ID NO: 914095 - protein, 9 aa, Homo Sapiens
MHSAGVTRS

SEQ ID NO: 914096 - protein, 9 aa, Homo Sapiens
PTLTYQSVG

SEQ ID NO: 914097 - protein, 9 aa, Homo Sapiens
GLPTDWYMW

SEQ ID NO: 914098 - protein, 9 aa, Homo Sapiens
FRRFMAMNL

SEQ ID NO: 914099 - protein, 9 aa, Homo Sapiens
WTQHSKNIM

SEQ ID NO: 914100 - protein, 9 aa, Homo Sapiens
DWYMWSDAS

SEQ ID NO: 914101 - protein, 9 aa, Homo Sapiens
DYHKQSHRA

SEQ ID NO: 914102 - protein, 9 aa, Homo Sapiens
SRTPSTSSS

SEQ ID NO: 914103 - protein, 9 aa, Homo Sapiens
ERQREQEER

SEQ ID NO: 914104 - protein, 9 aa, Homo Sapiens
LGGLTSPEI

SEQ ID NO: 914105 - protein, 9 aa, Homo Sapiens
RTPSTSSSL

SEQ ID NO: 914106 - protein, 9 aa, Homo Sapiens
ESWVLRKRK

SEQ ID NO: 914107 - protein, 9 aa, Homo Sapiens
GMPGDWGDS

SEQ ID NO: 914108 - protein, 9 aa, Homo Sapiens
LSSPLAACI

SEQ ID NO: 914109 - protein, 9 aa, Homo Sapiens
AFLYLVAFP

SEQ ID NO: 914110 - protein, 9 aa, Homo Sapiens
KTLMDVPTV

SEQ ID NO: 914111 - protein, 9 aa, Homo Sapiens
LEVGSDRDF

SEQ ID NO: 914112 - protein, 9 aa, Homo Sapiens
AEVSVSSTR

SEQ ID NO: 914113 - protein, 9 aa, Homo Sapiens
LLRSVVALL

SEQ ID NO: 914114 - protein, 9 aa, Homo Sapiens
MSPLLTIAS

SEQ ID NO: 914115 - protein, 9 aa, Homo Sapiens
DLRAKCHIT

SEQ ID NO: 914116 - protein, 9 aa, Homo Sapiens
KLFKTLMDV

SEQ ID NO: 914117 - protein, 9 aa, Homo Sapiens
AVKILDLVS

SEQ ID NO: 914118 - protein, 9 aa, Homo Sapiens
RAINPPPTS

SEQ ID NO: 914119 - protein, 9 aa, Homo Sapiens
QSHRAAPCS

SEQ ID NO: 914120 - protein, 9 aa, Homo Sapiens
SHNVEKLRD

SEQ ID NO: 914121 - protein, 9 aa, Homo Sapiens
QKVEMKLPG

SEQ ID NO: 914122 - protein, 9 aa, Homo Sapiens
ICHVHPNGT

SEQ ID NO: 914123 - protein, 9 aa, Homo Sapiens
IYDVPGICH

SEQ ID NO: 914124 - protein, 9 aa, Homo Sapiens
VEWLNFDLS

SEQ ID NO: 914125 - protein, 9 aa, Homo Sapiens
RRFMAMNLE

SEQ ID NO: 914126 - protein, 9 aa, Homo Sapiens
FDLSPDDST

SEQ ID NO: 914127 - protein, 9 aa, Homo Sapiens
ALGYAIWDL

SEQ ID NO: 914128 - protein, 9 aa, Homo Sapiens
SQKLGQRPP

SEQ ID NO: 914129 - protein, 9 aa, Homo Sapiens
GGWLLKSGR

SEQ ID NO: 914130 - protein, 9 aa, Homo Sapiens
AVVSPNLGD

SEQ ID NO: 914131 - protein, 9 aa, Homo Sapiens
YLKVIHSAV

SEQ ID NO: 914132 - protein, 9 aa, Homo Sapiens
IVLAAGMVL

SEQ ID NO: 914133 - protein, 9 aa, Homo Sapiens
KKTPSKIPY

SEQ ID NO: 914134 - protein, 9 aa, Homo Sapiens
QKPQSPEWK

SEQ ID NO: 914135 - protein, 9 aa, Homo Sapiens
IVEDPRVVV

SEQ ID NO: 914136 - protein, 9 aa, Homo Sapiens
KKFGENVAK

SEQ ID NO: 914137 - protein, 9 aa, Homo Sapiens
KPAVDEMFS

SEQ ID NO: 914138 - protein, 9 aa, Homo Sapiens
LAVLVRLAR

SEQ ID NO: 914139 - protein, 9 aa, Homo Sapiens
AAGMVLSVF

SEQ ID NO: 914140 - protein, 9 aa, Homo Sapiens
ETEETWKAL

SEQ ID NO: 914141 - protein, 9 aa, Homo Sapiens
LRSKLFYAI

SEQ ID NO: 914142 - protein, 9 aa, Homo Sapiens
FIKIVISTD

SEQ ID NO: 914143 - protein, 9 aa, Homo Sapiens
DGEEEEEVL

SEQ ID NO: 914144 - protein, 9 aa, Homo Sapiens
QNELLKRVR

SEQ ID NO: 914145 - protein, 9 aa, Homo Sapiens
STCASHLSA

SEQ ID NO: 914146 - protein, 9 aa, Homo Sapiens
CQNLQTKQL

SEQ ID NO: 914147 - protein, 9 aa, Homo Sapiens
NECALDPGI

SEQ ID NO: 914148 - protein, 9 aa, Homo Sapiens
LGCGTARHF

SEQ ID NO: 914149 - protein, 9 aa, Homo Sapiens
TDNLGIRIS

SEQ ID NO: 914150 - protein, 9 aa, Homo Sapiens
DSETEETWK

SEQ ID NO: 914151 - protein, 9 aa, Homo Sapiens
VLDILAVLV

SEQ ID NO: 914152 - protein, 9 aa, Homo Sapiens
IFQLLKFWE

SEQ ID NO: 914153 - protein, 9 aa, Homo Sapiens
LQQQQAQQQ

SEQ ID NO: 914154 - protein, 9 aa, Homo Sapiens
RVILRDFQK

SEQ ID NO: 914155 - protein, 9 aa, Homo Sapiens
PSKIPYKAI

SEQ ID NO: 914156 - protein, 9 aa, Homo Sapiens
MKLPGDKIG

SEQ ID NO: 914157 - protein, 9 aa, Homo Sapiens
FLLRLIFLL

SEQ ID NO: 914158 - protein, 9 aa, Homo Sapiens
MEITTKLGA

SEQ ID NO: 914159 - protein, 9 aa, Homo Sapiens
VEMKLPGDK

SEQ ID NO: 914160 - protein, 9 aa, Homo Sapiens
APWTQHSKN

SEQ ID NO: 914161 - protein, 9 aa, Homo Sapiens
PWQCPCLVD

SEQ ID NO: 914162 - protein, 9 aa, Homo Sapiens
FPALPSAVP

SEQ ID NO: 914163 - protein, 9 aa, Homo Sapiens
LPPDLLPVL

SEQ ID NO: 914164 - protein, 9 aa, Homo Sapiens
KHKRTHWKD

SEQ ID NO: 914165 - protein, 9 aa, Homo Sapiens
GCGTARHFA

SEQ ID NO: 914166 - protein, 9 aa, Homo Sapiens
NMRAINPPP

SEQ ID NO: 914167 - protein, 9 aa, Homo Sapiens
TPGGWLLKS

SEQ ID NO: 914168 - protein, 9 aa, Homo Sapiens
ALPSAVPVI

SEQ ID NO: 914169 - protein, 9 aa, Homo Sapiens
RQSLPFAAW

SEQ ID NO: 914170 - protein, 9 aa, Homo Sapiens
VYEGAGGRG

SEQ ID NO: 914171 - protein, 9 aa, Homo Sapiens
EAHFLQRVI

SEQ ID NO: 914172 - protein, 9 aa, Homo Sapiens
QRLYFLLDR

SEQ ID NO: 914173 - protein, 9 aa, Homo Sapiens
FLPPLEEEQ

SEQ ID NO: 914174 - protein, 9 aa, Homo Sapiens
LVLKAKIIT

SEQ ID NO: 914175 - protein, 9 aa, Homo Sapiens
MGIFFKLYP

SEQ ID NO: 914176 - protein, 9 aa, Homo Sapiens
LNDSHNVEK

SEQ ID NO: 914177 - protein, 9 aa, Homo Sapiens
GAVVSPNLG

SEQ ID NO: 914178 - protein, 9 aa, Homo Sapiens
ESSFLPPLE

SEQ ID NO: 914179 - protein, 9 aa, Homo Sapiens
IKDVQIPVQ

SEQ ID NO: 914180 - protein, 9 aa, Homo Sapiens
SGFAGADGG

SEQ ID NO: 914181 - protein, 9 aa, Homo Sapiens
WLNDSHNVE

SEQ ID NO: 914182 - protein, 9 aa, Homo Sapiens
KGEKKERPR

SEQ ID NO: 914183 - protein, 9 aa, Homo Sapiens
HQHIDTYSQ

SEQ ID NO: 914184 - protein, 9 aa, Homo Sapiens
NPPTLTYQS

SEQ ID NO: 914185 - protein, 9 aa, Homo Sapiens
SPEPRAKND

SEQ ID NO: 914186 - protein, 9 aa, Homo Sapiens
ILDLVSDMD

SEQ ID NO: 914187 - protein, 9 aa, Homo Sapiens
YKCRTSSRS

SEQ ID NO: 914188 - protein, 9 aa, Homo Sapiens
TTPSVYEGA

SEQ ID NO: 914189 - protein, 9 aa, Homo Sapiens
FIVLAAGMV

SEQ ID NO: 914190 - protein, 9 aa, Homo Sapiens
SHLSAVIVH

SEQ ID NO: 914191 - protein, 9 aa, Homo Sapiens
EGAGGRGIR

SEQ ID NO: 914192 - protein, 9 aa, Homo Sapiens
WQCPCLVDG

SEQ ID NO: 914193 - protein, 9 aa, Homo Sapiens
QRVILRDFQ

SEQ ID NO: 914194 - protein, 9 aa, Homo Sapiens
SLRSLHKHK

SEQ ID NO: 914195 - protein, 9 aa, Homo Sapiens
LLEVSEIKT

SEQ ID NO: 914196 - protein, 9 aa, Homo Sapiens
LLEEACRQS

SEQ ID NO: 914197 - protein, 9 aa, Homo Sapiens
IYTLRNRNM

SEQ ID NO: 914198 - protein, 9 aa, Homo Sapiens
TETVEQVAH

SEQ ID NO: 914199 - protein, 9 aa, Homo Sapiens
QVEDGGSST

SEQ ID NO: 914200 - protein, 9 aa, Homo Sapiens
SCLGDSQLV

SEQ ID NO: 914201 - protein, 9 aa, Homo Sapiens
KPSSPLGEW

SEQ ID NO: 914202 - protein, 9 aa, Homo Sapiens
NGVVFVGSC

SEQ ID NO: 914203 - protein, 9 aa, Homo Sapiens
EMFSEGAGP

SEQ ID NO: 914204 - protein, 9 aa, Homo Sapiens
MLTPKPYFQ

SEQ ID NO: 914205 - protein, 9 aa, Homo Sapiens
REEGEVFAR

SEQ ID NO: 914206 - protein, 9 aa, Homo Sapiens
KIVISTDLE

SEQ ID NO: 914207 - protein, 9 aa, Homo Sapiens
GTARHFAGL

SEQ ID NO: 914208 - protein, 9 aa, Homo Sapiens
QHSKNIMQT

SEQ ID NO: 914209 - protein, 9 aa, Homo Sapiens
LRSLHKHKR

SEQ ID NO: 914210 - protein, 9 aa, Homo Sapiens
LLTIASSSA

SEQ ID NO: 914211 - protein, 9 aa, Homo Sapiens
LGDVYFPEE

SEQ ID NO: 914212 - protein, 9 aa, Homo Sapiens
PSVYEGAGG

SEQ ID NO: 914213 - protein, 9 aa, Homo Sapiens
EVGSDRDFL

SEQ ID NO: 914214 - protein, 9 aa, Homo Sapiens
LQNPLEQIN

SEQ ID NO: 914215 - protein, 9 aa, Homo Sapiens
VGSDRDFLA

SEQ ID NO: 914216 - protein, 9 aa, Homo Sapiens
SPFRILEDD

SEQ ID NO: 914217 - protein, 9 aa, Homo Sapiens
KLQMEKEHL

SEQ ID NO: 914218 - protein, 9 aa, Homo Sapiens
RAASLVLKA

SEQ ID NO: 914219 - protein, 9 aa, Homo Sapiens
HSIWPREEN

SEQ ID NO: 914220 - protein, 9 aa, Homo Sapiens
GGKQELSSP

SEQ ID NO: 914221 - protein, 9 aa, Homo Sapiens
KIYSISIKH

SEQ ID NO: 914222 - protein, 9 aa, Homo Sapiens
LTIASSSAS

SEQ ID NO: 914223 - protein, 9 aa, Homo Sapiens
AQRHQRLYF

SEQ ID NO: 914224 - protein, 9 aa, Homo Sapiens
LLLFLNVPG

SEQ ID NO: 914225 - protein, 9 aa, Homo Sapiens
VSSTRNTAP

SEQ ID NO: 914226 - protein, 9 aa, Homo Sapiens
PANFTKGSF

SEQ ID NO: 914227 - protein, 9 aa, Homo Sapiens
CPSGHNNSP

SEQ ID NO: 914228 - protein, 9 aa, Homo Sapiens
FTKGSFDSS

SEQ ID NO: 914229 - protein, 9 aa, Homo Sapiens
LQLSTETVE

SEQ ID NO: 914230 - protein, 9 aa, Homo Sapiens
HSKNIMQTL

SEQ ID NO: 914231 - protein, 9 aa, Homo Sapiens
QTPGASLPP

SEQ ID NO: 914232 - protein, 9 aa, Homo Sapiens
VYFPEELQE

SEQ ID NO: 914233 - protein, 9 aa, Homo Sapiens
GKQELSSPL

SEQ ID NO: 914234 - protein, 9 aa, Homo Sapiens
ASLVLKAKI

SEQ ID NO: 914235 - protein, 9 aa, Homo Sapiens
SPLGHPGHE

SEQ ID NO: 914236 - protein, 9 aa, Homo Sapiens
FNFRNGFGF

SEQ ID NO: 914237 - protein, 9 aa, Homo Sapiens
PAVDEMFSE

SEQ ID NO: 914238 - protein, 9 aa, Homo Sapiens
AVIVHYGCA

SEQ ID NO: 914239 - protein, 9 aa, Homo Sapiens
LRNRNMKAA

SEQ ID NO: 914240 - protein, 9 aa, Homo Sapiens
FQYLKVIHS

SEQ ID NO: 914241 - protein, 9 aa, Homo Sapiens
QLLKFWEGD

SEQ ID NO: 914242 - protein, 9 aa, Homo Sapiens
DFLALIEGL

SEQ ID NO: 914243 - protein, 9 aa, Homo Sapiens
SFLLAKKFG

SEQ ID NO: 914244 - protein, 9 aa, Homo Sapiens
QIPVQLQRS

SEQ ID NO: 914245 - protein, 9 aa, Homo Sapiens
ISQKLGQRP

SEQ ID NO: 914246 - protein, 9 aa, Homo Sapiens
ASPEPRAKN

SEQ ID NO: 914247 - protein, 9 aa, Homo Sapiens
YFPEELQEY

SEQ ID NO: 914248 - protein, 9 aa, Homo Sapiens
PGASLPPRM

SEQ ID NO: 914249 - protein, 9 aa, Homo Sapiens
GLATEKSRW

SEQ ID NO: 914250 - protein, 9 aa, Homo Sapiens
LTPKPYFQP

SEQ ID NO: 914251 - protein, 9 aa, Homo Sapiens
RHQRLYFLL

SEQ ID NO: 914252 - protein, 9 aa, Homo Sapiens
PPPPARAAP

SEQ ID NO: 914253 - protein, 9 aa, Homo Sapiens
QGMPGDWGD

SEQ ID NO: 914254 - protein, 9 aa, Homo Sapiens
IKIVISTDL

SEQ ID NO: 914255 - protein, 9 aa, Homo Sapiens
TPSKIPYKA

SEQ ID NO: 914256 - protein, 9 aa, Homo Sapiens
QYMQRKQET

SEQ ID NO: 914257 - protein, 9 aa, Homo Sapiens
AYKCRTSSR

SEQ ID NO: 914258 - protein, 9 aa, Homo Sapiens
TDMGIFFKL

SEQ ID NO: 914259 - protein, 9 aa, Homo Sapiens
LVAFPFMDA

SEQ ID NO: 914260 - protein, 9 aa, Homo Sapiens
RDFLALIEG

SEQ ID NO: 914261 - protein, 9 aa, Homo Sapiens
QEYKIERSF

SEQ ID NO: 914262 - protein, 9 aa, Homo Sapiens
TDWYMWSDA

SEQ ID NO: 914263 - protein, 9 aa, Homo Sapiens
KQSHRAAPC

SEQ ID NO: 914264 - protein, 9 aa, Homo Sapiens
ISIKHPQEM

SEQ ID NO: 914265 - protein, 9 aa, Homo Sapiens
SGHNNSPQL

SEQ ID NO: 914266 - protein, 9 aa, Homo Sapiens
LSDIFLLFN

SEQ ID NO: 914267 - protein, 9 aa, Homo Sapiens
RVEIKDVQI

SEQ ID NO: 914268 - protein, 9 aa, Homo Sapiens
LREQEERQR

SEQ ID NO: 914269 - protein, 9 aa, Homo Sapiens
AAVKILDLV

SEQ ID NO: 914270 - protein, 9 aa, Homo Sapiens
SPEWKNMSS

SEQ ID NO: 914271 - protein, 9 aa, Homo Sapiens
QYLKVIHSA

SEQ ID NO: 914272 - protein, 9 aa, Homo Sapiens
TKILIIDMV

SEQ ID NO: 914273 - protein, 9 aa, Homo Sapiens
IKHPQEMKT

SEQ ID NO: 914274 - protein, 9 aa, Homo Sapiens
ATEKSRWSG

SEQ ID NO: 914275 - protein, 9 aa, Homo Sapiens
TSGKNMRAI

SEQ ID NO: 914276 - protein, 9 aa, Homo Sapiens
KEHLLREQI

SEQ ID NO: 914277 - protein, 9 aa, Homo Sapiens
HMDRQKRDF

SEQ ID NO: 914278 - protein, 9 aa, Homo Sapiens
DIFLLFNSS

SEQ ID NO: 914279 - protein, 9 aa, Homo Sapiens
FALGYAIWD

SEQ ID NO: 914280 - protein, 9 aa, Homo Sapiens
STSSSLHDS

SEQ ID NO: 914281 - protein, 9 aa, Homo Sapiens
WCVWPWQCP

SEQ ID NO: 914282 - protein, 9 aa, Homo Sapiens
SFLPPLEEA

SEQ ID NO: 914283 - protein, 9 aa, Homo Sapiens
QRQQDHFVK

SEQ ID NO: 914284 - protein, 9 aa, Homo Sapiens
TLNLLSKLP

SEQ ID NO: 914285 - protein, 9 aa, Homo Sapiens
LSAVIVHYG

SEQ ID NO: 914286 - protein, 9 aa, Homo Sapiens
ALLPPDLLP

SEQ ID NO: 914287 - protein, 9 aa, Homo Sapiens
LGTTPSVYE

SEQ ID NO: 914288 - protein, 9 aa, Homo Sapiens
HKQSHRAAP

SEQ ID NO: 914289 - protein, 9 aa, Homo Sapiens
HQRLYFLLD

SEQ ID NO: 914290 - protein, 9 aa, Homo Sapiens
IVQMSPLLK

SEQ ID NO: 914291 - protein, 9 aa, Homo Sapiens
LAAVKILDL

SEQ ID NO: 914292 - protein, 9 aa, Homo Sapiens
YQSVGISDV

SEQ ID NO: 914293 - protein, 9 aa, Homo Sapiens
LAAGMVLSV

SEQ ID NO: 914294 - protein, 9 aa, Homo Sapiens
WPREENDLG

SEQ ID NO: 914295 - protein, 9 aa, Homo Sapiens
VKILDLVSD

SEQ ID NO: 914296 - protein, 9 aa, Homo Sapiens
SDRDFLALI

SEQ ID NO: 914297 - protein, 9 aa, Homo Sapiens
PGSDSPLGH

SEQ ID NO: 914298 - protein, 9 aa, Homo Sapiens
HFTEGHKKA

SEQ ID NO: 914299 - protein, 9 aa, Homo Sapiens
EYKIERSFF

SEQ ID NO: 914300 - protein, 9 aa, Homo Sapiens
LNSRDVEYG

SEQ ID NO: 914301 - protein, 9 aa, Homo Sapiens
RQREQEERL

SEQ ID NO: 914302 - protein, 9 aa, Homo Sapiens
VTSALVALL

SEQ ID NO: 914303 - protein, 9 aa, Homo Sapiens
AGMVLSVFV

SEQ ID NO: 914304 - protein, 9 aa, Homo Sapiens
PSPPPPARA

SEQ ID NO: 914305 - protein, 9 aa, Homo Sapiens
DLGDLRAKC

SEQ ID NO: 914306 - protein, 9 aa, Homo Sapiens
ILIIDMVIT

SEQ ID NO: 914307 - protein, 9 aa, Homo Sapiens
PEMEQNFNF

SEQ ID NO: 914308 - protein, 9 aa, Homo Sapiens
VSVSSTRNT

SEQ ID NO: 914309 - protein, 9 aa, Homo Sapiens
VISTDLERL

SEQ ID NO: 914310 - protein, 9 aa, Homo Sapiens
VLFYVIPEI

SEQ ID NO: 914311 - protein, 9 aa, Homo Sapiens
DFEYALNYE

SEQ ID NO: 914312 - protein, 9 aa, Homo Sapiens
LSTETVEQV

SEQ ID NO: 914313 - protein, 9 aa, Homo Sapiens
THMLQQQQA

SEQ ID NO: 914314 - protein, 9 aa, Homo Sapiens
DMGIFFKLY

SEQ ID NO: 914315 - protein, 9 aa, Homo Sapiens
LSKLFKTLM

SEQ ID NO: 914316 - protein, 9 aa, Homo Sapiens
KHITVKKES

SEQ ID NO: 914317 - protein, 9 aa, Homo Sapiens
KENSAFKNQ

SEQ ID NO: 914318 - protein, 9 aa, Homo Sapiens
LIIDMVITV

SEQ ID NO: 914319 - protein, 9 aa, Homo Sapiens
TSALVALLL

SEQ ID NO: 914320 - protein, 9 aa, Homo Sapiens
SAVIVHYGC

SEQ ID NO: 914321 - protein, 9 aa, Homo Sapiens
ILYIHQHID

SEQ ID NO: 914322 - protein, 9 aa, Homo Sapiens
EIDQKGVTV

SEQ ID NO: 914323 - protein, 9 aa, Homo Sapiens
AKNDRRRKS

SEQ ID NO: 914324 - protein, 9 aa, Homo Sapiens
EDVWENVVT

SEQ ID NO: 914325 - protein, 9 aa, Homo Sapiens
VGSCLGDSQ

SEQ ID NO: 914326 - protein, 9 aa, Homo Sapiens
FYAIECAAG

SEQ ID NO: 914327 - protein, 9 aa, Homo Sapiens
GEDEKPSLP

SEQ ID NO: 914328 - protein, 9 aa, Homo Sapiens
LGYAIWDLC

SEQ ID NO: 914329 - protein, 9 aa, Homo Sapiens
AMNLEHEDM

SEQ ID NO: 914330 - protein, 9 aa, Homo Sapiens
WGDSGSQGF

SEQ ID NO: 914331 - protein, 9 aa, Homo Sapiens
DQVTLHSIW

SEQ ID NO: 914332 - protein, 9 aa, Homo Sapiens
NPLGDVYFP

SEQ ID NO: 914333 - protein, 9 aa, Homo Sapiens
DFQYLKVIH

SEQ ID NO: 914334 - protein, 9 aa, Homo Sapiens
RGISGFAGA

SEQ ID NO: 914335 - protein, 9 aa, Homo Sapiens
WKALPIQSF

SEQ ID NO: 914336 - protein, 9 aa, Homo Sapiens
EKLNDVQLA

SEQ ID NO: 914337 - protein, 9 aa, Homo Sapiens
WGNRDGSGR

SEQ ID NO: 914338 - protein, 9 aa, Homo Sapiens
FYINITKKE

SEQ ID NO: 914339 - protein, 9 aa, Homo Sapiens
STVLKIHFT

SEQ ID NO: 914340 - protein, 9 aa, Homo Sapiens
ITQPAPFFS

SEQ ID NO: 914341 - protein, 9 aa, Homo Sapiens
KDLLEVSEI

SEQ ID NO: 914342 - protein, 9 aa, Homo Sapiens
ISTDLERLR

SEQ ID NO: 914343 - protein, 9 aa, Homo Sapiens
FKLYPLFQD

SEQ ID NO: 914344 - protein, 9 aa, Homo Sapiens
DRDFLALIE

SEQ ID NO: 914345 - protein, 9 aa, Homo Sapiens
QQAQRQQDH

SEQ ID NO: 914346 - protein, 9 aa, Homo Sapiens
QNPLGDVYF

SEQ ID NO: 914347 - protein, 9 aa, Homo Sapiens
SDGEDEKPS

SEQ ID NO: 914348 - protein, 9 aa, Homo Sapiens
PFFSQPVQT

SEQ ID NO: 914349 - protein, 9 aa, Homo Sapiens
GEKKERPRQ

SEQ ID NO: 914350 - protein, 9 aa, Homo Sapiens
LLKNQSSKA

SEQ ID NO: 914351 - protein, 9 aa, Homo Sapiens
GDLRAKCHI

SEQ ID NO: 914352 - protein, 9 aa, Homo Sapiens
QMSPLLKNQ

SEQ ID NO: 914353 - protein, 9 aa, Homo Sapiens
ADKIYSISI

SEQ ID NO: 914354 - protein, 9 aa, Homo Sapiens
DDGAVVSPN

SEQ ID NO: 914355 - protein, 9 aa, Homo Sapiens
SSLRSLHKH

SEQ ID NO: 914356 - protein, 9 aa, Homo Sapiens
RISVGHVDY

SEQ ID NO: 914357 - protein, 9 aa, Homo Sapiens
EVFAREHGL

SEQ ID NO: 914358 - protein, 9 aa, Homo Sapiens
PDLSKLFKT

SEQ ID NO: 914359 - protein, 9 aa, Homo Sapiens
TVKKESHES

SEQ ID NO: 914360 - protein, 9 aa, Homo Sapiens
SEIKTEGDK

SEQ ID NO: 914361 - protein, 9 aa, Homo Sapiens
RSLHKHKRT

SEQ ID NO: 914362 - protein, 9 aa, Homo Sapiens
PWTQHSKNI

SEQ ID NO: 914363 - protein, 9 aa, Homo Sapiens
SAKPLSMKP

SEQ ID NO: 914364 - protein, 9 aa, Homo Sapiens
HNNSPQLST

SEQ ID NO: 914365 - protein, 9 aa, Homo Sapiens
RMQLWLNDS

SEQ ID NO: 914366 - protein, 9 aa, Homo Sapiens
PLEQINDGK

SEQ ID NO: 914367 - protein, 9 aa, Homo Sapiens
SLPPRSGST

SEQ ID NO: 914368 - protein, 9 aa, Homo Sapiens
YINITKKEN

SEQ ID NO: 914369 - protein, 9 aa, Homo Sapiens
LNVPGYKAS

SEQ ID NO: 914370 - protein, 9 aa, Homo Sapiens
FRILEDDEY

SEQ ID NO: 914371 - protein, 9 aa, Homo Sapiens
IGDFGLATE

SEQ ID NO: 914372 - protein, 9 aa, Homo Sapiens
LTKILIIDM

SEQ ID NO: 914373 - protein, 9 aa, Homo Sapiens
STETVEQVA

SEQ ID NO: 914374 - protein, 9 aa, Homo Sapiens
QETSAFLRV

SEQ ID NO: 914375 - protein, 9 aa, Homo Sapiens
QFKKTPSKI

SEQ ID NO: 914376 - protein, 9 aa, Homo Sapiens
KRDFLREAS

SEQ ID NO: 914377 - protein, 9 aa, Homo Sapiens
RQKRDFLRE

SEQ ID NO: 914378 - protein, 9 aa, Homo Sapiens
QINDGKYSF

SEQ ID NO: 914379 - protein, 9 aa, Homo Sapiens
RAKNDRRRK

SEQ ID NO: 914380 - protein, 9 aa, Homo Sapiens
NIMQTLSRY

SEQ ID NO: 914381 - protein, 9 aa, Homo Sapiens
REQEERQRE

SEQ ID NO: 914382 - protein, 9 aa, Homo Sapiens
CALDPGICA

SEQ ID NO: 914383 - protein, 9 aa, Homo Sapiens
NLEHEDMVE

SEQ ID NO: 914384 - protein, 9 aa, Homo Sapiens
QDDVVYECQ

SEQ ID NO: 914385 - protein, 9 aa, Homo Sapiens
IFFKLYPLF

SEQ ID NO: 914386 - protein, 9 aa, Homo Sapiens
AVDEMFSEG

SEQ ID NO: 914387 - protein, 9 aa, Homo Sapiens
KSQILEHEL

SEQ ID NO: 914388 - protein, 9 aa, Homo Sapiens
KVEMKLPGD

SEQ ID NO: 914389 - protein, 9 aa, Homo Sapiens
MEKEHLLRE

SEQ ID NO: 914390 - protein, 9 aa, Homo Sapiens
SNPPTLTYQ

SEQ ID NO: 914391 - protein, 9 aa, Homo Sapiens
AQRQQDHFV

SEQ ID NO: 914392 - protein, 9 aa, Homo Sapiens
VSTVLKIHF

SEQ ID NO: 914393 - protein, 9 aa, Homo Sapiens
ALLLLFAMG

SEQ ID NO: 914394 - protein, 9 aa, Homo Sapiens
KKENSAFKN

SEQ ID NO: 914395 - protein, 9 aa, Homo Sapiens
FLLAKKFGE

SEQ ID NO: 914396 - protein, 9 aa, Homo Sapiens
KLFYAIECA

SEQ ID NO: 914397 - protein, 9 aa, Homo Sapiens
DPVTLNLLS

SEQ ID NO: 914398 - protein, 9 aa, Homo Sapiens
IYCQNLQTK

SEQ ID NO: 914399 - protein, 9 aa, Homo Sapiens
GSDSPLGHP

SEQ ID NO: 914400 - protein, 9 aa, Homo Sapiens
RIREIDQKG

SEQ ID NO: 914401 - protein, 9 aa, Homo Sapiens
KKRQLFWGN

SEQ ID NO: 914402 - protein, 9 aa, Homo Sapiens
EVSEIKTEG

SEQ ID NO: 914403 - protein, 9 aa, Homo Sapiens
VSEIKTEGD

SEQ ID NO: 914404 - protein, 9 aa, Homo Sapiens
GLTSPEIRF

SEQ ID NO: 914405 - protein, 9 aa, Homo Sapiens
EEDVWENVV

SEQ ID NO: 914406 - protein, 9 aa, Homo Sapiens
LQDDVVYEC

SEQ ID NO: 914407 - protein, 9 aa, Homo Sapiens
VLAAGMVLS

SEQ ID NO: 914408 - protein, 9 aa, Homo Sapiens
ALNYEQKEA

SEQ ID NO: 914409 - protein, 9 aa, Homo Sapiens
QNFNFRNGF

SEQ ID NO: 914410 - protein, 9 aa, Homo Sapiens
WRKQKVEMK

SEQ ID NO: 914411 - protein, 9 aa, Homo Sapiens
NSRDVEYGT

SEQ ID NO: 914412 - protein, 9 aa, Homo Sapiens
ASLVVPQSI

SEQ ID NO: 914413 - protein, 9 aa, Homo Sapiens
SSLLLFLNV

SEQ ID NO: 914414 - protein, 9 aa, Homo Sapiens
TRRAFLYLV

SEQ ID NO: 914415 - protein, 9 aa, Homo Sapiens
TPSVYEGAG

SEQ ID NO: 914416 - protein, 9 aa, Homo Sapiens
MFSEGAGPY

SEQ ID NO: 914417 - protein, 9 aa, Homo Sapiens
TISQKLGQR

SEQ ID NO: 914418 - protein, 9 aa, Homo Sapiens
TYKKRQLFW

SEQ ID NO: 914419 - protein, 9 aa, Homo Sapiens
GAEVSVSST

SEQ ID NO: 914420 - protein, 9 aa, Homo Sapiens
ASTTPEQAS

SEQ ID NO: 914421 - protein, 9 aa, Homo Sapiens
KNQSSKANL

SEQ ID NO: 914422 - protein, 9 aa, Homo Sapiens
NQERLNSRD

SEQ ID NO: 914423 - protein, 9 aa, Homo Sapiens
NSSDFITRD

SEQ ID NO: 914424 - protein, 9 aa, Homo Sapiens
YEGAGGRGI

SEQ ID NO: 914425 - protein, 9 aa, Homo Sapiens
FFKLYPLFQ

SEQ ID NO: 914426 - protein, 9 aa, Homo Sapiens
EGWCVWPWQ

SEQ ID NO: 914427 - protein, 9 aa, Homo Sapiens
LLKSGRPKE

SEQ ID NO: 914428 - protein, 9 aa, Homo Sapiens
GRGMHSAGV

SEQ ID NO: 914429 - protein, 9 aa, Homo Sapiens
KDKGEKKER

SEQ ID NO: 914430 - protein, 9 aa, Homo Sapiens
ISEEDVWEN

SEQ ID NO: 914431 - protein, 9 aa, Homo Sapiens
EEGEVFARE

SEQ ID NO: 914432 - protein, 9 aa, Homo Sapiens
IWPREENDL

SEQ ID NO: 914433 - protein, 9 aa, Homo Sapiens
TLEVGSDRD

SEQ ID NO: 914434 - protein, 9 aa, Homo Sapiens
GQVEDGGSS

SEQ ID NO: 914435 - protein, 9 aa, Homo Sapiens
VPGICHVHP

SEQ ID NO: 914436 - protein, 9 aa, Homo Sapiens
SDSPLGHPG

SEQ ID NO: 914437 - protein, 9 aa, Homo Sapiens
DKGEKKERP

SEQ ID NO: 914438 - protein, 9 aa, Homo Sapiens
MDRQKRDFL

SEQ ID NO: 914439 - protein, 9 aa, Homo Sapiens
GTSGMEITT

SEQ ID NO: 914440 - protein, 9 aa, Homo Sapiens
RRNQERLNS

SEQ ID NO: 914441 - protein, 9 aa, Homo Sapiens
QELSSPLAA

SEQ ID NO: 914442 - protein, 9 aa, Homo Sapiens
VFVGSCLGD

SEQ ID NO: 914443 - protein, 9 aa, Homo Sapiens
LKVIHSAVQ

SEQ ID NO: 914444 - protein, 9 aa, Homo Sapiens
EPRAKNDRR

SEQ ID NO: 914445 - protein, 9 aa, Homo Sapiens
YKKRQLFWG

SEQ ID NO: 914446 - protein, 9 aa, Homo Sapiens
LEHELNFHK

SEQ ID NO: 914447 - protein, 9 aa, Homo Sapiens
ETWKALPIQ

SEQ ID NO: 914448 - protein, 9 aa, Homo Sapiens
TQHSKNIMQ

SEQ ID NO: 914449 - protein, 9 aa, Homo Sapiens
GSCLGDSQL

SEQ ID NO: 914450 - protein, 9 aa, Homo Sapiens
LKFWEGDMV

SEQ ID NO: 914451 - protein, 9 aa, Homo Sapiens
NKDIQSGIH

SEQ ID NO: 914452 - protein, 9 aa, Homo Sapiens
KNMRAINPP

SEQ ID NO: 914453 - protein, 9 aa, Homo Sapiens
LKNQSSKAN

SEQ ID NO: 914454 - protein, 9 aa, Homo Sapiens
TLRNRNMKA

SEQ ID NO: 914455 - protein, 9 aa, Homo Sapiens
RKQETSAFL

SEQ ID NO: 914456 - protein, 9 aa, Homo Sapiens
QERLNSRDV

SEQ ID NO: 914457 - protein, 9 aa, Homo Sapiens
PGGWLLKSG

SEQ ID NO: 914458 - protein, 9 aa, Homo Sapiens
KILIIDMVI

SEQ ID NO: 914459 - protein, 9 aa, Homo Sapiens
TLHSIWPRE

SEQ ID NO: 914460 - protein, 9 aa, Homo Sapiens
LPDLSKLFK

SEQ ID NO: 914461 - protein, 9 aa, Homo Sapiens
TSRGLPTDW

SEQ ID NO: 914462 - protein, 9 aa, Homo Sapiens
SDIFLLFNS

SEQ ID NO: 914463 - protein, 9 aa, Homo Sapiens
TAAASLVVP

SEQ ID NO: 914464 - protein, 9 aa, Homo Sapiens
RNTLLGDEQ

SEQ ID NO: 914465 - protein, 9 aa, Homo Sapiens
YMQRKQETS

SEQ ID NO: 914466 - protein, 9 aa, Homo Sapiens
PRAKNDRRR

SEQ ID NO: 914467 - protein, 9 aa, Homo Sapiens
RHFAGLPHL

SEQ ID NO: 914468 - protein, 9 aa, Homo Sapiens
EKEHLLREQ

SEQ ID NO: 914469 - protein, 9 aa, Homo Sapiens
PEVRIREID

SEQ ID NO: 914470 - protein, 9 aa, Homo Sapiens
LESSFLPPL

SEQ ID NO: 914471 - protein, 9 aa, Homo Sapiens
IAAFLLRLI

SEQ ID NO: 914472 - protein, 9 aa, Homo Sapiens
YFLLDRFRL

SEQ ID NO: 914473 - protein, 9 aa, Homo Sapiens
ETSAFLRVF

SEQ ID NO: 914474 - protein, 9 aa, Homo Sapiens
VLNKDIQSG

SEQ ID NO: 914475 - protein, 9 aa, Homo Sapiens
EVSVSSTRN

SEQ ID NO: 914476 - protein, 9 aa, Homo Sapiens
LWLNDSHNV

SEQ ID NO: 914477 - protein, 9 aa, Homo Sapiens
LQRVILRDF

SEQ ID NO: 914478 - protein, 9 aa, Homo Sapiens
FLNVPGYKA

SEQ ID NO: 914479 - protein, 9 aa, Homo Sapiens
GIFFKLYPL

SEQ ID NO: 914480 - protein, 9 aa, Homo Sapiens
ILESSFLPP

SEQ ID NO: 914481 - protein, 9 aa, Homo Sapiens
EEEILESSF

SEQ ID NO: 914482 - protein, 9 aa, Homo Sapiens
LFYAIECAA

SEQ ID NO: 914483 - protein, 9 aa, Homo Sapiens
QSIFQLLKF

SEQ ID NO: 914484 - protein, 9 aa, Homo Sapiens
ISGFAGADG

SEQ ID NO: 914485 - protein, 9 aa, Homo Sapiens
PAPQCPSPP

SEQ ID NO: 914486 - protein, 9 aa, Homo Sapiens
LGAEVSVSS

SEQ ID NO: 914487 - protein, 9 aa, Homo Sapiens
LPTDWYMWS

SEQ ID NO: 914488 - protein, 9 aa, Homo Sapiens
VSPNLGDMS

SEQ ID NO: 914489 - protein, 9 aa, Homo Sapiens
TLLRSKLFY

SEQ ID NO: 914490 - protein, 9 aa, Homo Sapiens
KQLGCGTAR

SEQ ID NO: 914491 - protein, 9 aa, Homo Sapiens
SPLAACIPT

SEQ ID NO: 914492 - protein, 9 aa, Homo Sapiens
QSPEWKNMS

SEQ ID NO: 914493 - protein, 9 aa, Homo Sapiens
VVALLPPDL

SEQ ID NO: 914494 - protein, 9 aa, Homo Sapiens
TLLGDEQNE

SEQ ID NO: 914495 - protein, 9 aa, Homo Sapiens
AEAHFLQRV

SEQ ID NO: 914496 - protein, 9 aa, Homo Sapiens
VEIKDVQIP

SEQ ID NO: 914497 - protein, 9 aa, Homo Sapiens
LEEACRQSL

SEQ ID NO: 914498 - protein, 9 aa, Homo Sapiens
LPGSDSPLG

SEQ ID NO: 914499 - protein, 9 aa, Homo Sapiens
IIYTLRNRN

SEQ ID NO: 914500 - protein, 9 aa, Homo Sapiens
LHKHKRTHW

SEQ ID NO: 914501 - protein, 9 aa, Homo Sapiens
AAFLLRLIF

SEQ ID NO: 914502 - protein, 9 aa, Homo Sapiens
EILESSFLP

SEQ ID NO: 914503 - protein, 9 aa, Homo Sapiens
GDFGLATEK

SEQ ID NO: 914504 - protein, 9 aa, Homo Sapiens
QLGSANGQV

SEQ ID NO: 914505 - protein, 9 aa, Homo Sapiens
PKPYFQPKN

SEQ ID NO: 914506 - protein, 9 aa, Homo Sapiens
TCASHLSAV

SEQ ID NO: 914507 - protein, 9 aa, Homo Sapiens
QAQRQQDHF

SEQ ID NO: 914508 - protein, 9 aa, Homo Sapiens
EEILESSFL

SEQ ID NO: 914509 - protein, 9 aa, Homo Sapiens
SVGHVDYFV

SEQ ID NO: 914510 - protein, 9 aa, Homo Sapiens
QHIDTYSQS

SEQ ID NO: 914511 - protein, 9 aa, Homo Sapiens
KQKVEMKLP

SEQ ID NO: 914512 - protein, 9 aa, Homo Sapiens
MAMNLEHED

SEQ ID NO: 914513 - protein, 9 aa, Homo Sapiens
DFGLATEKS

SEQ ID NO: 914514 - protein, 9 aa, Homo Sapiens
GKNMRAINP

SEQ ID NO: 914515 - protein, 9 aa, Homo Sapiens
QQDHFVKEK

SEQ ID NO: 914516 - protein, 9 aa, Homo Sapiens
SKLFKTLMD

SEQ ID NO: 914517 - protein, 9 aa, Homo Sapiens
HRAAPCSGG

SEQ ID NO: 914518 - protein, 9 aa, Homo Sapiens
EASTTPEQA

SEQ ID NO: 914519 - protein, 9 aa, Homo Sapiens
WPWQCPCLV

SEQ ID NO: 914520 - protein, 9 aa, Homo Sapiens
GWCVWPWQC

SEQ ID NO: 914521 - protein, 9 aa, Homo Sapiens
QCLTKILII

SEQ ID NO: 914522 - protein, 9 aa, Homo Sapiens
TVLKIHFTE

SEQ ID NO: 914523 - protein, 9 aa, Homo Sapiens
SSSASDSSK

SEQ ID NO: 914524 - protein, 9 aa, Homo Sapiens
IAEAHFLQR

SEQ ID NO: 914525 - protein, 9 aa, Homo Sapiens
APFFSQPVQ

SEQ ID NO: 914526 - protein, 9 aa, Homo Sapiens
FFPALPSAV

SEQ ID NO: 914527 - protein, 9 aa, Homo Sapiens
IVISTDLER

SEQ ID NO: 914528 - protein, 9 aa, Homo Sapiens
NMKAAVRKI

SEQ ID NO: 914529 - protein, 9 aa, Homo Sapiens
SITQPAPFF

SEQ ID NO: 914530 - protein, 9 aa, Homo Sapiens
DVYFPEELQ

SEQ ID NO: 914531 - protein, 9 aa, Homo Sapiens
PGLPGSDSP

SEQ ID NO: 914532 - protein, 9 aa, Homo Sapiens
YIHQHIDTY

SEQ ID NO: 914533 - protein, 9 aa, Homo Sapiens
GLPGSDSPL

SEQ ID NO: 914534 - protein, 9 aa, Homo Sapiens
SGGKQELSS

SEQ ID NO: 914535 - protein, 9 aa, Homo Sapiens
DSPLGHPGH

SEQ ID NO: 914536 - protein, 9 aa, Homo Sapiens
RGLPTDWYM

SEQ ID NO: 914537 - protein, 9 aa, Homo Sapiens
DVPGICHVH

SEQ ID NO: 914538 - protein, 9 aa, Homo Sapiens
SVVALLPPD

SEQ ID NO: 914539 - protein, 9 aa, Homo Sapiens
INPPPTSGL

SEQ ID NO: 914540 - protein, 9 aa, Homo Sapiens
LSPDDSTGN

SEQ ID NO: 914541 - protein, 9 aa, Homo Sapiens
LAKKFGENV

SEQ ID NO: 914542 - protein, 9 aa, Homo Sapiens
GDWGDSGSQ

SEQ ID NO: 914543 - protein, 9 aa, Homo Sapiens
VDFQYLKVI

SEQ ID NO: 914544 - protein, 9 aa, Homo Sapiens
CPLILYIHQ

SEQ ID NO: 914545 - protein, 9 aa, Homo Sapiens
TKKENSAFK

SEQ ID NO: 914546 - protein, 9 aa, Homo Sapiens
ISQVTKSSP

SEQ ID NO: 914547 - protein, 9 aa, Homo Sapiens
SVSSTRNTA

SEQ ID NO: 914548 - protein, 9 aa, Homo Sapiens
FKKTPSKIP

SEQ ID NO: 914549 - protein, 9 aa, Homo Sapiens
SFLPPLEEE

SEQ ID NO: 914550 - protein, 9 aa, Homo Sapiens
VLRKRKVVV

SEQ ID NO: 914551 - protein, 9 aa, Homo Sapiens
PPTLTYQSV

SEQ ID NO: 914552 - protein, 9 aa, Homo Sapiens
SKIPYKAIA

SEQ ID NO: 914553 - protein, 9 aa, Homo Sapiens
NNSPQLSTC

SEQ ID NO: 914554 - protein, 9 aa, Homo Sapiens
KDIQSGIHG

SEQ ID NO: 914555 - protein, 9 aa, Homo Sapiens
TTPEQASST

SEQ ID NO: 914556 - protein, 9 aa, Homo Sapiens
IPEISQVTK

SEQ ID NO: 914557 - protein, 9 aa, Homo Sapiens
RLKSQILEH

SEQ ID NO: 914558 - protein, 9 aa, Homo Sapiens
LPASPFRIL

SEQ ID NO: 914559 - protein, 9 aa, Homo Sapiens
GIAAFLLRL

SEQ ID NO: 914560 - protein, 9 aa, Homo Sapiens
IIDMVITVK

SEQ ID NO: 914561 - protein, 9 aa, Homo Sapiens
HLSAVIVHY

SEQ ID NO: 914562 - protein, 9 aa, Homo Sapiens
DVVYECQAI

SEQ ID NO: 914563 - protein, 9 aa, Homo Sapiens
SSRTPSTSS

SEQ ID NO: 914564 - protein, 9 aa, Homo Sapiens
FLYLVAFPF

SEQ ID NO: 914565 - protein, 9 aa, Homo Sapiens
QEERQREQE

SEQ ID NO: 914566 - protein, 9 aa, Homo Sapiens
ASLPPRMLP

SEQ ID NO: 914567 - protein, 9 aa, Homo Sapiens
EIYDVPGIC

SEQ ID NO: 914568 - protein, 9 aa, Homo Sapiens
LRKRKVVVI

SEQ ID NO: 914569 - protein, 9 aa, Homo Sapiens
PEISQVTKS

SEQ ID NO: 914570 - protein, 9 aa, Homo Sapiens
RNMKAAVRK

SEQ ID NO: 914571 - protein, 9 aa, Homo Sapiens
VWPWQCPCL

SEQ ID NO: 914572 - protein, 9 aa, Homo Sapiens
AQKPQSPEW

SEQ ID NO: 914573 - protein, 9 aa, Homo Sapiens
RAELQDDVV

SEQ ID NO: 914574 - protein, 9 aa, Homo Sapiens
VTLNLLSKL

SEQ ID NO: 914575 - protein, 9 aa, Homo Sapiens
IPGLPGSDS

SEQ ID NO: 914576 - protein, 9 aa, Homo Sapiens
DLVSDMDEE

SEQ ID NO: 914577 - protein, 9 aa, Homo Sapiens
CLTKILIID

SEQ ID NO: 914578 - protein, 9 aa, Homo Sapiens
FKTLMDVPT

SEQ ID NO: 914579 - protein, 9 aa, Homo Sapiens
PEQASSTAQ

SEQ ID NO: 914580 - protein, 9 aa, Homo Sapiens
HFVQEYKIE

SEQ ID NO: 914581 - protein, 9 aa, Homo Sapiens
TEKSRWSGS

SEQ ID NO: 914582 - protein, 9 aa, Homo Sapiens
GPEMEQNFN

SEQ ID NO: 914583 - protein, 9 aa, Homo Sapiens
KKESHESLG

SEQ ID NO: 914584 - protein, 9 aa, Homo Sapiens
AVLVRLARH

SEQ ID NO: 914585 - protein, 9 aa, Homo Sapiens
NDRRRKSRP

SEQ ID NO: 914586 - protein, 9 aa, Homo Sapiens
AAASLVVPQ

SEQ ID NO: 914587 - protein, 9 aa, Homo Sapiens
GYAIWDLCQ

SEQ ID NO: 914588 - protein, 9 aa, Homo Sapiens
IQSGIHGTV

SEQ ID NO: 914589 - protein, 9 aa, Homo Sapiens
VLKIHFTEG

SEQ ID NO: 914590 - protein, 9 aa, Homo Sapiens
DNLGIRISV

SEQ ID NO: 914591 - protein, 9 aa, Homo Sapiens
VFALGYAIW

SEQ ID NO: 914592 - protein, 9 aa, Homo Sapiens
KPQSPEWKN

SEQ ID NO: 914593 - protein, 9 aa, Homo Sapiens
SLHKHKRTH

SEQ ID NO: 914594 - protein, 9 aa, Homo Sapiens
SSITQPAPF

SEQ ID NO: 914595 - protein, 9 aa, Homo Sapiens
LYIHQHIDT

SEQ ID NO: 914596 - protein, 9 aa, Homo Sapiens
DVWENVVTY

SEQ ID NO: 914597 - protein, 9 aa, Homo Sapiens
DEMFSEGAG

SEQ ID NO: 914598 - protein, 9 aa, Homo Sapiens
SWVLRKRKV

SEQ ID NO: 914599 - protein, 9 aa, Homo Sapiens
GEVFAREHG

SEQ ID NO: 914600 - protein, 9 aa, Homo Sapiens
IDQKGVTVQ

SEQ ID NO: 914601 - protein, 9 aa, Homo Sapiens
GGLTSPEIR

SEQ ID NO: 914602 - protein, 9 aa, Homo Sapiens
ELSSPLAAC

SEQ ID NO: 914603 - protein, 9 aa, Homo Sapiens
PASPFRILE

SEQ ID NO: 914604 - protein, 9 aa, Homo Sapiens
VVFVGSCLG

SEQ ID NO: 914605 - protein, 9 aa, Homo Sapiens
ALDPGICAN

SEQ ID NO: 914606 - protein, 9 aa, Homo Sapiens
SLLNYCKEG

SEQ ID NO: 914607 - protein, 9 aa, Homo Sapiens
KREEGEVFA

SEQ ID NO: 914608 - protein, 9 aa, Homo Sapiens
PLSMKPSSP

SEQ ID NO: 914609 - protein, 9 aa, Homo Sapiens
FGLATEKSR

SEQ ID NO: 914610 - protein, 9 aa, Homo Sapiens
FEYALNYEQ

SEQ ID NO: 914611 - protein, 9 aa, Homo Sapiens
PAPFFSQPV

SEQ ID NO: 914612 - protein, 9 aa, Homo Sapiens
KGLRGISGF

SEQ ID NO: 914613 - protein, 9 aa, Homo Sapiens
DVQIPVQLQ

SEQ ID NO: 914614 - protein, 9 aa, Homo Sapiens
VKKESHESL

SEQ ID NO: 914615 - protein, 9 aa, Homo Sapiens
PVTLNLLSK

SEQ ID NO: 914616 - protein, 9 aa, Homo Sapiens
EVRIREIDQ

SEQ ID NO: 914617 - protein, 9 aa, Homo Sapiens
EIYCQNLQT

SEQ ID NO: 914618 - protein, 9 aa, Homo Sapiens
CPSPPPPAR

SEQ ID NO: 914619 - protein, 9 aa, Homo Sapiens
EMEQNFNFR

SEQ ID NO: 914620 - protein, 9 aa, Homo Sapiens
PRRAASLVL

SEQ ID NO: 914621 - protein, 9 aa, Homo Sapiens
KRQLFWGNR

SEQ ID NO: 914622 - protein, 9 aa, Homo Sapiens
VWENVVTYD

SEQ ID NO: 914623 - protein, 9 aa, Homo Sapiens
GVVFVGSCL

SEQ ID NO: 914624 - protein, 9 aa, Homo Sapiens
IQGMPGDWG

SEQ ID NO: 914625 - protein, 9 aa, Homo Sapiens
ECALDPGIC

SEQ ID NO: 914626 - protein, 9 aa, Homo Sapiens
AASLVVPQS

SEQ ID NO: 914627 - protein, 9 aa, Homo Sapiens
SGIHGTVPL

SEQ ID NO: 914628 - protein, 9 aa, Homo Sapiens
IHQHIDTYS

SEQ ID NO: 914629 - protein, 9 aa, Homo Sapiens
DPRVVVIWT

SEQ ID NO: 914630 - protein, 9 aa, Homo Sapiens
INECALDPG

SEQ ID NO: 914631 - protein, 9 aa, Homo Sapiens
NRNMKAAVR

SEQ ID NO: 914632 - protein, 9 aa, Homo Sapiens
EGTSGMEIT

SEQ ID NO: 914633 - protein, 9 aa, Homo Sapiens
LLNYCKEGI

SEQ ID NO: 914634 - protein, 9 aa, Homo Sapiens
VIPEISQVT

SEQ ID NO: 914635 - protein, 9 aa, Homo Sapiens
ITTKLGAAT

SEQ ID NO: 914636 - protein, 9 aa, Homo Sapiens
KIERSFFLR

SEQ ID NO: 914637 - protein, 9 aa, Homo Sapiens
KPYFQPKNS

SEQ ID NO: 914638 - protein, 9 aa, Homo Sapiens
LVSDMDEEI

SEQ ID NO: 914639 - protein, 9 aa, Homo Sapiens
EWLNFDLSP

SEQ ID NO: 914640 - protein, 9 aa, Homo Sapiens
FVQEYKIER

SEQ ID NO: 914641 - protein, 9 aa, Homo Sapiens
IASSSASDS

SEQ ID NO: 914642 - protein, 9 aa, Homo Sapiens
SRDVEYGTI

SEQ ID NO: 914643 - protein, 9 aa, Homo Sapiens
FYVIPEISQ

SEQ ID NO: 914644 - protein, 9 aa, Homo Sapiens
KRKVVVIDT

SEQ ID NO: 914645 - protein, 9 aa, Homo Sapiens
PLDPTAAAS

SEQ ID NO: 914646 - protein, 9 aa, Homo Sapiens
EKLQMEKEH

SEQ ID NO: 914647 - protein, 9 aa, Homo Sapiens
AELQDDVVY

SEQ ID NO: 914648 - protein, 9 aa, Homo Sapiens
DPGICANGI

SEQ ID NO: 914649 - protein, 9 aa, Homo Sapiens
KSAKPLSMK

SEQ ID NO: 914650 - protein, 9 aa, Homo Sapiens
LLCPSGHNN

SEQ ID NO: 914651 - protein, 9 aa, Homo Sapiens
QASSTAQAQ

SEQ ID NO: 914652 - protein, 9 aa, Homo Sapiens
DRQKRDFLR

SEQ ID NO: 914653 - protein, 9 aa, Homo Sapiens
DVKREEGEV

SEQ ID NO: 914654 - protein, 9 aa, Homo Sapiens
CLEKLNDVQ

SEQ ID NO: 914655 - protein, 9 aa, Homo Sapiens
CGTARHFAG

SEQ ID NO: 914656 - protein, 9 aa, Homo Sapiens
PPPARAAPP

SEQ ID NO: 914657 - protein, 9 aa, Homo Sapiens
SGIAAFLLR

SEQ ID NO: 914658 - protein, 9 aa, Homo Sapiens
HKHKRTHWK

SEQ ID NO: 914659 - protein, 9 aa, Homo Sapiens
ESHESLGMT

SEQ ID NO: 914660 - protein, 9 aa, Homo Sapiens
KSGRPKEMV

SEQ ID NO: 914661 - protein, 9 aa, Homo Sapiens
QSLPFAAWD

SEQ ID NO: 914662 - protein, 9 aa, Homo Sapiens
TYQSVGISD

SEQ ID NO: 914663 - protein, 9 aa, Homo Sapiens
QAYKCRTSS

SEQ ID NO: 914664 - protein, 9 aa, Homo Sapiens
RLNSRDVEY

SEQ ID NO: 914665 - protein, 9 aa, Homo Sapiens
KPLSMKPSS

SEQ ID NO: 914666 - protein, 9 aa, Homo Sapiens
NSPQLSTCG

SEQ ID NO: 914667 - protein, 9 aa, Homo Sapiens
LSSLRSLHK

SEQ ID NO: 914668 - protein, 9 aa, Homo Sapiens
YSISIKHPQ

SEQ ID NO: 914669 - protein, 9 aa, Homo Sapiens
ILEHELNFH

SEQ ID NO: 914670 - protein, 9 aa, Homo Sapiens
RSFLLAKKF

SEQ ID NO: 914671 - protein, 9 aa, Homo Sapiens
TPGASLPPR

SEQ ID NO: 914672 - protein, 9 aa, Homo Sapiens
YHKQSHRAA

SEQ ID NO: 914673 - protein, 9 aa, Homo Sapiens
GICHVHPNG

SEQ ID NO: 914674 - protein, 9 aa, Homo Sapiens
RVVVIWTKN

SEQ ID NO: 914675 - protein, 9 aa, Homo Sapiens
DDVVYECQA

SEQ ID NO: 914676 - protein, 9 aa, Homo Sapiens
LLFNSSDFI

SEQ ID NO: 914677 - protein, 9 aa, Homo Sapiens
IREIDQKGV

SEQ ID NO: 914678 - protein, 9 aa, Homo Sapiens
GDEQNELLK

SEQ ID NO: 914679 - protein, 9 aa, Homo Sapiens
SQTPGASLP

SEQ ID NO: 914680 - protein, 9 aa, Homo Sapiens
MPGDWGDSG

SEQ ID NO: 914681 - protein, 9 aa, Homo Sapiens
REIDQKGVT

SEQ ID NO: 914682 - protein, 9 aa, Homo Sapiens
ELQDDVVYE

SEQ ID NO: 914683 - protein, 9 aa, Homo Sapiens
IVQQAQRQQ

SEQ ID NO: 914684 - protein, 9 aa, Homo Sapiens
INDGKYSFE

SEQ ID NO: 914685 - protein, 9 aa, Homo Sapiens
CRQSLPFAA

SEQ ID NO: 914686 - protein, 9 aa, Homo Sapiens
KEGIAFFRP

SEQ ID NO: 914687 - protein, 9 aa, Homo Sapiens
LNLLSKLPM

SEQ ID NO: 914688 - protein, 9 aa, Homo Sapiens
ALVALLLLF

SEQ ID NO: 914689 - protein, 9 aa, Homo Sapiens
LKEKLQMEK

SEQ ID NO: 914690 - protein, 9 aa, Homo Sapiens
DLQFKKTPS

SEQ ID NO: 914691 - protein, 9 aa, Homo Sapiens
VTLHSIWPR

SEQ ID NO: 914692 - protein, 9 aa, Homo Sapiens
SHFVQEYKI

SEQ ID NO: 914693 - protein, 9 aa, Homo Sapiens
RKQKVEMKL

SEQ ID NO: 914694 - protein, 9 aa, Homo Sapiens
PQCPSPPPP

SEQ ID NO: 914695 - protein, 9 aa, Homo Sapiens
SSNPPTLTY

SEQ ID NO: 914696 - protein, 9 aa, Homo Sapiens
KFIKIVIST

SEQ ID NO: 914697 - protein, 9 aa, Homo Sapiens
GICANGICE

SEQ ID NO: 914698 - protein, 9 aa, Homo Sapiens
RNQERLNSR

SEQ ID NO: 914699 - protein, 9 aa, Homo Sapiens
KFGENVAKF

SEQ ID NO: 914700 - protein, 9 aa, Homo Sapiens
SALVALLLL

SEQ ID NO: 914701 - protein, 9 aa, Homo Sapiens
VVYECQAIQ

SEQ ID NO: 914702 - protein, 9 aa, Homo Sapiens
QRHQRLYFL

SEQ ID NO: 914703 - protein, 9 aa, Homo Sapiens
NITKKENSA

SEQ ID NO: 914704 - protein, 9 aa, Homo Sapiens
QMEKEHLLR

SEQ ID NO: 914705 - protein, 9 aa, Homo Sapiens
NDSHNVEKL

SEQ ID NO: 914706 - protein, 9 aa, Homo Sapiens
SKLFYAIEC

SEQ ID NO: 914707 - protein, 9 aa, Homo Sapiens
HSAGVTRSN

SEQ ID NO: 914708 - protein, 9 aa, Homo Sapiens
EWKNMSSTK

SEQ ID NO: 914709 - protein, 9 aa, Homo Sapiens
DPEVRIREI

SEQ ID NO: 914710 - protein, 9 aa, Homo Sapiens
KIHFTEGHK

SEQ ID NO: 914711 - protein, 9 aa, Homo Sapiens
AKGLRGISG

SEQ ID NO: 914712 - protein, 9 aa, Homo Sapiens
LGDLRAKCH

SEQ ID NO: 914713 - protein, 9 aa, Homo Sapiens
KVIHSAVQI

SEQ ID NO: 914714 - protein, 9 aa, Homo Sapiens
IVDFQYLKV

SEQ ID NO: 914715 - protein, 9 aa, Homo Sapiens
KDVQIPVQL

SEQ ID NO: 914716 - protein, 9 aa, Homo Sapiens
FWGNRDGSG

SEQ ID NO: 914717 - protein, 9 aa, Homo Sapiens
AKPLSMKPS

SEQ ID NO: 914718 - protein, 9 aa, Homo Sapiens
LLRLIFLLV

SEQ ID NO: 914719 - protein, 9 aa, Homo Sapiens
GEEEEEVLA

SEQ ID NO: 914720 - protein, 9 aa, Homo Sapiens
SVEWLNFDL

SEQ ID NO: 914721 - protein, 9 aa, Homo Sapiens
RNRNMKAAV

SEQ ID NO: 914722 - protein, 9 aa, Homo Sapiens
TIQGMPGDW

SEQ ID NO: 914723 - protein, 9 aa, Homo Sapiens
NKDKGEKKE

SEQ ID NO: 914724 - protein, 9 aa, Homo Sapiens
GISGFAGAD

SEQ ID NO: 914725 - protein, 9 aa, Homo Sapiens
KNIMQTLSR

SEQ ID NO: 914726 - protein, 9 aa, Homo Sapiens
GLGAEVSVS

SEQ ID NO: 914727 - protein, 9 aa, Homo Sapiens
KEKLQMEKE

SEQ ID NO: 914728 - protein, 9 aa, Homo Sapiens
GASLPPRML

SEQ ID NO: 914729 - protein, 9 aa, Homo Sapiens
DWGDSGSQG

SEQ ID NO: 914730 - protein, 9 aa, Homo Sapiens
LLPPDLLPV

SEQ ID NO: 914731 - protein, 9 aa, Homo Sapiens
GLRGISGFA

SEQ ID NO: 914732 - protein, 9 aa, Homo Sapiens
VIWTKNKEL

SEQ ID NO: 914733 - protein, 9 aa, Homo Sapiens
LNDVQLALV

SEQ ID NO: 914734 - protein, 9 aa, Homo Sapiens
LNKDKGEKK

SEQ ID NO: 914735 - protein, 9 aa, Homo Sapiens
KERPRQQDP

SEQ ID NO: 914736 - protein, 9 aa, Homo Sapiens
TSSSLHDSS

SEQ ID NO: 914737 - protein, 9 aa, Homo Sapiens
SPPPPARAA

SEQ ID NO: 914738 - protein, 9 aa, Homo Sapiens
ILAVLVRLA

SEQ ID NO: 914739 - protein, 9 aa, Homo Sapiens
QSLLNYCKE

SEQ ID NO: 914740 - protein, 9 aa, Homo Sapiens
KKDLLEVSE

SEQ ID NO: 914741 - protein, 9 aa, Homo Sapiens
VALLLLFAM

SEQ ID NO: 914742 - protein, 9 aa, Homo Sapiens
YLVAFPFMD

SEQ ID NO: 914743 - protein, 9 aa, Homo Sapiens
KGSFDSSGT

SEQ ID NO: 914744 - protein, 9 aa, Homo Sapiens
EQASSTAQA

SEQ ID NO: 914745 - protein, 9 aa, Homo Sapiens
SPLLTIASS

SEQ ID NO: 914746 - protein, 9 aa, Homo Sapiens
EQNELLKRV

SEQ ID NO: 914747 - protein, 9 aa, Homo Sapiens
EHFNLEIYC

SEQ ID NO: 914748 - protein, 9 aa, Homo Sapiens
GHNNSPQLS

SEQ ID NO: 914749 - protein, 9 aa, Homo Sapiens
PEPRAKNDR

SEQ ID NO: 914750 - protein, 9 aa, Homo Sapiens
CFYINITKK

SEQ ID NO: 914751 - protein, 9 aa, Homo Sapiens
PTISQKLGQ

SEQ ID NO: 914752 - protein, 9 aa, Homo Sapiens
LYLVAFPFM

SEQ ID NO: 914753 - protein, 9 aa, Homo Sapiens
GIRISVGHV

SEQ ID NO: 914754 - protein, 9 aa, Homo Sapiens
VVSPNLGDM

SEQ ID NO: 914755 - protein, 9 aa, Homo Sapiens
GMEITTKLG

SEQ ID NO: 914756 - protein, 9 aa, Homo Sapiens
LRAELQDDV

SEQ ID NO: 914757 - protein, 9 aa, Homo Sapiens
NVPGYKASF

SEQ ID NO: 914758 - protein, 9 aa, Homo Sapiens
LEVSEIKTE

SEQ ID NO: 914759 - protein, 9 aa, Homo Sapiens
LFKTLMDVP

SEQ ID NO: 914760 - protein, 9 aa, Homo Sapiens
GSANGQVED

SEQ ID NO: 914761 - protein, 9 aa, Homo Sapiens
IRISVGHVD

SEQ ID NO: 914762 - protein, 9 aa, Homo Sapiens
EACRQSLPF

SEQ ID NO: 914763 - protein, 9 aa, Homo Sapiens
LSKLPMPYI

SEQ ID NO: 914764 - protein, 9 aa, Homo Sapiens
LKSQILEHE

SEQ ID NO: 914765 - protein, 9 aa, Homo Sapiens
VRIREIDQK

SEQ ID NO: 914766 - protein, 9 aa, Homo Sapiens
LRSVVALLP

SEQ ID NO: 914767 - protein, 9 aa, Homo Sapiens
STTPEQASS

SEQ ID NO: 914768 - protein, 9 aa, Homo Sapiens
LEDDEYETT

SEQ ID NO: 914769 - protein, 9 aa, Homo Sapiens
LILYIHQHI

SEQ ID NO: 914770 - protein, 9 aa, Homo Sapiens
VALLPPDLL

SEQ ID NO: 914771 - protein, 9 aa, Homo Sapiens
TEPTISQKL

SEQ ID NO: 914772 - protein, 9 aa, Homo Sapiens
LDLVSDMDE

SEQ ID NO: 914773 - protein, 9 aa, Homo Sapiens
VGRGMHSAG

SEQ ID NO: 914774 - protein, 9 aa, Homo Sapiens
FMAMNLEHE

SEQ ID NO: 914775 - protein, 9 aa, Homo Sapiens
SLVVPQSIP

SEQ ID NO: 914776 - protein, 9 aa, Homo Sapiens
QREQEERLC

SEQ ID NO: 914777 - protein, 9 aa, Homo Sapiens
HITVKKESH

SEQ ID NO: 914778 - protein, 9 aa, Homo Sapiens
DSHNVEKLR

SEQ ID NO: 914779 - protein, 9 aa, Homo Sapiens
VDEMFSEGA

SEQ ID NO: 914780 - protein, 9 aa, Homo Sapiens
KILDLVSDM

SEQ ID NO: 914781 - protein, 9 aa, Homo Sapiens
ACRQSLPFA

SEQ ID NO: 914782 - protein, 9 aa, Homo Sapiens
NFTKGSFDS

SEQ ID NO: 914783 - protein, 9 aa, Homo Sapiens
LKIHFTEGH

SEQ ID NO: 914784 - protein, 9 aa, Homo Sapiens
SGMEITTKL

SEQ ID NO: 914785 - protein, 9 aa, Homo Sapiens
SVYEGAGGR

SEQ ID NO: 914786 - protein, 9 aa, Homo Sapiens
RRAFLYLVA

SEQ ID NO: 914787 - protein, 9 aa, Homo Sapiens
DEKPSLPPR

SEQ ID NO: 914788 - protein, 9 aa, Homo Sapiens
VVIWTKNKE

SEQ ID NO: 914789 - protein, 9 aa, Homo Sapiens
TPSTSSSLH

SEQ ID NO: 914790 - protein, 9 aa, Homo Sapiens
IYSISIKHP

SEQ ID NO: 914791 - protein, 9 aa, Homo Sapiens
RAAPCSGGS

SEQ ID NO: 914792 - protein, 9 aa, Homo Sapiens
LQCLTKILI

SEQ ID NO: 914793 - protein, 9 aa, Homo Sapiens
QRKQETSAF

SEQ ID NO: 914794 - protein, 9 aa, Homo Sapiens
TIASSSASD

SEQ ID NO: 914795 - protein, 9 aa, Homo Sapiens
WDLGDLRAK

SEQ ID NO: 914796 - protein, 9 aa, Homo Sapiens
GTTPSVYEG

SEQ ID NO: 914797 - protein, 9 aa, Homo Sapiens
EEASTTPEQ

SEQ ID NO: 914798 - protein, 9 aa, Homo Sapiens
ARHFAGLPH

SEQ ID NO: 914799 - protein, 9 aa, Homo Sapiens
PLLTIASSS

SEQ ID NO: 914800 - protein, 9 aa, Homo Sapiens
EKKERPRQQ

SEQ ID NO: 914801 - protein, 9 aa, Homo Sapiens
ETLLRSKLF

SEQ ID NO: 914802 - protein, 9 aa, Homo Sapiens
PTAAASLVV

SEQ ID NO: 914803 - protein, 9 aa, Homo Sapiens
QRESWVLRK

SEQ ID NO: 914804 - protein, 9 aa, Homo Sapiens
PGDWGDSGS

SEQ ID NO: 914805 - protein, 9 aa, Homo Sapiens
TDYHKQSHR

SEQ ID NO: 914806 - protein, 9 aa, Homo Sapiens
SAGVTRSNS

SEQ ID NO: 914807 - protein, 9 aa, Homo Sapiens
DEQNELLKR

SEQ ID NO: 914808 - protein, 9 aa, Homo Sapiens
EYALNYEQK

SEQ ID NO: 914809 - protein, 9 aa, Homo Sapiens
QLGCGTARH

SEQ ID NO: 914810 - protein, 9 aa, Homo Sapiens
LLLFAMGTE

SEQ ID NO: 914811 - protein, 9 aa, Homo Sapiens
QKFIKIVIS

SEQ ID NO: 914812 - protein, 9 aa, Homo Sapiens
AHFLQRVIL

SEQ ID NO: 914813 - protein, 9 aa, Homo Sapiens
QKRDFLREA

SEQ ID NO: 914814 - protein, 9 aa, Homo Sapiens
TVEQVAHGS

SEQ ID NO: 914815 - protein, 9 aa, Homo Sapiens
ETVEQVAHG

SEQ ID NO: 914816 - protein, 9 aa, Homo Sapiens
AKKFGENVA

SEQ ID NO: 914817 - protein, 9 aa, Homo Sapiens
KLNDVQLAL

SEQ ID NO: 914818 - protein, 9 aa, Homo Sapiens
CIVDFQYLK

SEQ ID NO: 914819 - protein, 9 aa, Homo Sapiens
ASSSASDSS

SEQ ID NO: 914820 - protein, 9 aa, Homo Sapiens
MEQNFNFRN

SEQ ID NO: 914821 - protein, 9 aa, Homo Sapiens
FGPEMEQNF

SEQ ID NO: 914822 - protein, 9 aa, Homo Sapiens
EMVGRGMHS

SEQ ID NO: 914823 - protein, 9 aa, Homo Sapiens
KFWEGDMVL

SEQ ID NO: 914824 - protein, 9 aa, Homo Sapiens
FQLLKFWEG

SEQ ID NO: 914825 - protein, 9 aa, Homo Sapiens
LVRLARHSL

SEQ ID NO: 914826 - protein, 9 aa, Homo Sapiens
EPTISQKLG

SEQ ID NO: 914827 - protein, 9 aa, Homo Sapiens
VTEPTISQK

SEQ ID NO: 914828 - protein, 9 aa, Homo Sapiens
NLLSKLPMP

SEQ ID NO: 914829 - protein, 9 aa, Homo Sapiens
RSKLFYAIE

SEQ ID NO: 914830 - protein, 9 aa, Homo Sapiens
LPSAVPVIG

SEQ ID NO: 914831 - protein, 9 aa, Homo Sapiens
GMVLSVFVA

SEQ ID NO: 914832 - protein, 9 aa, Homo Sapiens
LVALLLLFA

SEQ ID NO: 914833 - protein, 9 aa, Homo Sapiens
PEWKNMSST

SEQ ID NO: 914834 - protein, 9 aa, Homo Sapiens
SIFQLLKFW

SEQ ID NO: 914835 - protein, 9 aa, Homo Sapiens
CKEGIAFFR

SEQ ID NO: 914836 - protein, 9 aa, Homo Sapiens
VQIPVQLQR

SEQ ID NO: 914837 - protein, 9 aa, Homo Sapiens
KQELSSPLA

SEQ ID NO: 914838 - protein, 9 aa, Homo Sapiens
RAFFPALPS

SEQ ID NO: 914839 - protein, 9 aa, Homo Sapiens
LLLLFAMGT

SEQ ID NO: 914840 - protein, 9 aa, Homo Sapiens
INITKKENS

SEQ ID NO: 914841 - protein, 9 aa, Homo Sapiens
LQMEKEHLL

SEQ ID NO: 914842 - protein, 9 aa, Homo Sapiens
YDVPGICHV

SEQ ID NO: 914843 - protein, 9 aa, Homo Sapiens
FNSSDFITR

SEQ ID NO: 914844 - protein, 9 aa, Homo Sapiens
PLILYIHQH

SEQ ID NO: 914845 - protein, 9 aa, Homo Sapiens
PSTSSSLHD

SEQ ID NO: 914846 - protein, 9 aa, Homo Sapiens
EGEVFAREH

SEQ ID NO: 914847 - protein, 9 aa, Homo Sapiens
EQSQTPGAS

SEQ ID NO: 914848 - protein, 9 aa, Homo Sapiens
QKLGQRPPV

SEQ ID NO: 914849 - protein, 9 aa, Homo Sapiens
LLGDEQNEL

SEQ ID NO: 914850 - protein, 9 aa, Homo Sapiens
EGIAFFRPG

SEQ ID NO: 914851 - protein, 9 aa, Homo Sapiens
PTDWYMWSD

SEQ ID NO: 914852 - protein, 9 aa, Homo Sapiens
MQYMQRKQE

SEQ ID NO: 914853 - protein, 9 aa, Homo Sapiens
RGMHSAGVT

SEQ ID NO: 914854 - protein, 9 aa, Homo Sapiens
LSMKPSSPL

SEQ ID NO: 914855 - protein, 9 aa, Homo Sapiens
EISQVTKSS

SEQ ID NO: 914856 - protein, 9 aa, Homo Sapiens
PGICANGIC

SEQ ID NO: 914857 - protein, 9 aa, Homo Sapiens
LDPTAAASL

SEQ ID NO: 914858 - protein, 9 aa, Homo Sapiens
HMLQQQQAQ

SEQ ID NO: 914859 - protein, 9 aa, Homo Sapiens
CHVHPNGTL

SEQ ID NO: 914860 - protein, 9 aa, Homo Sapiens
EEACRQSLP

SEQ ID NO: 914861 - protein, 9 aa, Homo Sapiens
PLQLSTETV

SEQ ID NO: 914862 - protein, 9 aa, Homo Sapiens
GSDRDFLAL

SEQ ID NO: 914863 - protein, 9 aa, Homo Sapiens
KLPGDKIGL

SEQ ID NO: 914864 - protein, 9 aa, Homo Sapiens
QLFWGNRDG

SEQ ID NO: 914865 - protein, 9 aa, Homo Sapiens
FTEGHKKAF

SEQ ID NO: 914866 - protein, 9 aa, Homo Sapiens
SLPFAAWDG

SEQ ID NO: 914867 - protein, 9 aa, Homo Sapiens
SPNLGDMSP

SEQ ID NO: 914868 - protein, 9 aa, Homo Sapiens
PQSPEWKNM

SEQ ID NO: 914869 - protein, 9 aa, Homo Sapiens
RQQDHFVKE

SEQ ID NO: 914870 - protein, 9 aa, Homo Sapiens
EERQREQEE

SEQ ID NO: 914871 - protein, 9 aa, Homo Sapiens
QILEHELNF

SEQ ID NO: 914872 - protein, 9 aa, Homo Sapiens
MQAYKCRTS

SEQ ID NO: 914873 - protein, 9 aa, Homo Sapiens
EDPRVVVIW

SEQ ID NO: 914874 - protein, 9 aa, Homo Sapiens
LQFKKTPSK

SEQ ID NO: 914875 - protein, 9 aa, Homo Sapiens
KLGQRPPVT

SEQ ID NO: 914876 - protein, 9 aa, Homo Sapiens
LRGISGFAG

SEQ ID NO: 914877 - protein, 9 aa, Homo Sapiens
DLLEVSEIK

SEQ ID NO: 914878 - protein, 9 aa, Homo Sapiens
SSTRNTAPP

SEQ ID NO: 914879 - protein, 9 aa, Homo Sapiens
DILAVLVRL

SEQ ID NO: 914880 - protein, 9 aa, Homo Sapiens
LWIKFVSDG

SEQ ID NO: 914881 - protein, 9 aa, Homo Sapiens
KINIIYDLC

SEQ ID NO: 914882 - protein, 9 aa, Homo Sapiens
AEPGDCYKE

SEQ ID NO: 914883 - protein, 9 aa, Homo Sapiens
SSMGMSDVF

SEQ ID NO: 914884 - protein, 9 aa, Homo Sapiens
LSSSRVMPM

SEQ ID NO: 914885 - protein, 9 aa, Homo Sapiens
PPGDKEDDG

SEQ ID NO: 914886 - protein, 9 aa, Homo Sapiens
SQSFIHTAA

SEQ ID NO: 914887 - protein, 9 aa, Homo Sapiens
SLTSQLKAE

SEQ ID NO: 914888 - protein, 9 aa, Homo Sapiens
LIHVNCSNF

SEQ ID NO: 914889 - protein, 9 aa, Homo Sapiens
PPKPPKLPR

SEQ ID NO: 914890 - protein, 9 aa, Homo Sapiens
IIVGSSKFQ

SEQ ID NO: 914891 - protein, 9 aa, Homo Sapiens
DVASPSQDM

SEQ ID NO: 914892 - protein, 9 aa, Homo Sapiens
KVTTSITFK

SEQ ID NO: 914893 - protein, 9 aa, Homo Sapiens
LAGVPGVEV

SEQ ID NO: 914894 - protein, 9 aa, Homo Sapiens
IPAGIYALI

SEQ ID NO: 914895 - protein, 9 aa, Homo Sapiens
RDIFLVGWC

SEQ ID NO: 914896 - protein, 9 aa, Homo Sapiens
DGIRDKIAL

SEQ ID NO: 914897 - protein, 9 aa, Homo Sapiens
RQSTSRVQN

SEQ ID NO: 914898 - protein, 9 aa, Homo Sapiens
SSREIRLID

SEQ ID NO: 914899 - protein, 9 aa, Homo Sapiens
VIQLSPDEE

SEQ ID NO: 914900 - protein, 9 aa, Homo Sapiens
IQSLLSSSR

SEQ ID NO: 914901 - protein, 9 aa, Homo Sapiens
CQPPDRNKF

SEQ ID NO: 914902 - protein, 9 aa, Homo Sapiens
HPSQENFFA

SEQ ID NO: 914903 - protein, 9 aa, Homo Sapiens
NLPFQFTRT

SEQ ID NO: 914904 - protein, 9 aa, Homo Sapiens
ITKYWTLLS

SEQ ID NO: 914905 - protein, 9 aa, Homo Sapiens
SNPNEDASK

SEQ ID NO: 914906 - protein, 9 aa, Homo Sapiens
REKDWEKDK

SEQ ID NO: 914907 - protein, 9 aa, Homo Sapiens
AEPCGHSIY

SEQ ID NO: 914908 - protein, 9 aa, Homo Sapiens
LPADNQKVD

SEQ ID NO: 914909 - protein, 9 aa, Homo Sapiens
RVGHCIIEI

SEQ ID NO: 914910 - protein, 9 aa, Homo Sapiens
VSELLDDPF

SEQ ID NO: 914911 - protein, 9 aa, Homo Sapiens
YRMCIMQIS

SEQ ID NO: 914912 - protein, 9 aa, Homo Sapiens
INLLQDNKF

SEQ ID NO: 914913 - protein, 9 aa, Homo Sapiens
ITQERANST

SEQ ID NO: 914914 - protein, 9 aa, Homo Sapiens
RDFSVQWNQ

SEQ ID NO: 914915 - protein, 9 aa, Homo Sapiens
LALNTGDDF

SEQ ID NO: 914916 - protein, 9 aa, Homo Sapiens
PPTKGDCGP

SEQ ID NO: 914917 - protein, 9 aa, Homo Sapiens
VRFWVFQSI

SEQ ID NO: 914918 - protein, 9 aa, Homo Sapiens
VGLRLAETL

SEQ ID NO: 914919 - protein, 9 aa, Homo Sapiens
YARNNSIFS

SEQ ID NO: 914920 - protein, 9 aa, Homo Sapiens
SSFGLLALG

SEQ ID NO: 914921 - protein, 9 aa, Homo Sapiens
RHHTLFQLR

SEQ ID NO: 914922 - protein, 9 aa, Homo Sapiens
KYSSDISYM

SEQ ID NO: 914923 - protein, 9 aa, Homo Sapiens
CIQLIFERA

SEQ ID NO: 914924 - protein, 9 aa, Homo Sapiens
AQEPDASPR

SEQ ID NO: 914925 - protein, 9 aa, Homo Sapiens
GSSLLATRS

SEQ ID NO: 914926 - protein, 9 aa, Homo Sapiens
TESCFMAGD

SEQ ID NO: 914927 - protein, 9 aa, Homo Sapiens
YQKAHRWQD

SEQ ID NO: 914928 - protein, 9 aa, Homo Sapiens
RGAQLHEFL

SEQ ID NO: 914929 - protein, 9 aa, Homo Sapiens
VARDTDETG

SEQ ID NO: 914930 - protein, 9 aa, Homo Sapiens
ALCPTFQID

SEQ ID NO: 914931 - protein, 9 aa, Homo Sapiens
VPEIMGAIC

SEQ ID NO: 914932 - protein, 9 aa, Homo Sapiens
ITMNKQRLL

SEQ ID NO: 914933 - protein, 9 aa, Homo Sapiens
IDFGKITPL

SEQ ID NO: 914934 - protein, 9 aa, Homo Sapiens
LNFLITKLG

SEQ ID NO: 914935 - protein, 9 aa, Homo Sapiens
AKVPSTPSP

SEQ ID NO: 914936 - protein, 9 aa, Homo Sapiens
AQRDICIAF

SEQ ID NO: 914937 - protein, 9 aa, Homo Sapiens
DVLFPNSSC

SEQ ID NO: 914938 - protein, 9 aa, Homo Sapiens
TRFTGVIIQ

SEQ ID NO: 914939 - protein, 9 aa, Homo Sapiens
VFESVSQSF

SEQ ID NO: 914940 - protein, 9 aa, Homo Sapiens
ADQRPPRSA

SEQ ID NO: 914941 - protein, 9 aa, Homo Sapiens
KKGSPEPWD

SEQ ID NO: 914942 - protein, 9 aa, Homo Sapiens
LCKLPSFIC

SEQ ID NO: 914943 - protein, 9 aa, Homo Sapiens
PYLVFLHTL

SEQ ID NO: 914944 - protein, 9 aa, Homo Sapiens
ANKANTSSD

SEQ ID NO: 914945 - protein, 9 aa, Homo Sapiens
HRGLTQPPP

SEQ ID NO: 914946 - protein, 9 aa, Homo Sapiens
IVLLNTLFF

SEQ ID NO: 914947 - protein, 9 aa, Homo Sapiens
TPRGNKNFE

SEQ ID NO: 914948 - protein, 9 aa, Homo Sapiens
EATEKTKVK

SEQ ID NO: 914949 - protein, 9 aa, Homo Sapiens
ELAIIMYMV

SEQ ID NO: 914950 - protein, 9 aa, Homo Sapiens
LSQTVVEVL

SEQ ID NO: 914951 - protein, 9 aa, Homo Sapiens
GAIVAMTRD

SEQ ID NO: 914952 - protein, 9 aa, Homo Sapiens
EDILGSAMQ

SEQ ID NO: 914953 - protein, 9 aa, Homo Sapiens
KGSTNDEAE

SEQ ID NO: 914954 - protein, 9 aa, Homo Sapiens
LETVQQHLD

SEQ ID NO: 914955 - protein, 9 aa, Homo Sapiens
SQDMLFPQD

SEQ ID NO: 914956 - protein, 9 aa, Homo Sapiens
SPGSIRFFS

SEQ ID NO: 914957 - protein, 9 aa, Homo Sapiens
LSQGSSKFR

SEQ ID NO: 914958 - protein, 9 aa, Homo Sapiens
YAEPGDCYK

SEQ ID NO: 914959 - protein, 9 aa, Homo Sapiens
KSDDSVNTE

SEQ ID NO: 914960 - protein, 9 aa, Homo Sapiens
SQPKATPLV

SEQ ID NO: 914961 - protein, 9 aa, Homo Sapiens
LSRELLDER

SEQ ID NO: 914962 - protein, 9 aa, Homo Sapiens
FPNSSCGSS

SEQ ID NO: 914963 - protein, 9 aa, Homo Sapiens
LDINFLESL

SEQ ID NO: 914964 - protein, 9 aa, Homo Sapiens
YLPGPCRTC

SEQ ID NO: 914965 - protein, 9 aa, Homo Sapiens
TFAFCDFCR

SEQ ID NO: 914966 - protein, 9 aa, Homo Sapiens
EVSEKEGYE

SEQ ID NO: 914967 - protein, 9 aa, Homo Sapiens
NRPCETLEL

SEQ ID NO: 914968 - protein, 9 aa, Homo Sapiens
SKFSLQSGK

SEQ ID NO: 914969 - protein, 9 aa, Homo Sapiens
GGRLEKVSF

SEQ ID NO: 914970 - protein, 9 aa, Homo Sapiens
PGYSPSQNP

SEQ ID NO: 914971 - protein, 9 aa, Homo Sapiens
ESLFWKLYE

SEQ ID NO: 914972 - protein, 9 aa, Homo Sapiens
ERWNHVITT

SEQ ID NO: 914973 - protein, 9 aa, Homo Sapiens
AGQPGEKES

SEQ ID NO: 914974 - protein, 9 aa, Homo Sapiens
LSYFHHQKE

SEQ ID NO: 914975 - protein, 9 aa, Homo Sapiens
FRSPACQCL

SEQ ID NO: 914976 - protein, 9 aa, Homo Sapiens
SSASILFDS

SEQ ID NO: 914977 - protein, 9 aa, Homo Sapiens
FLILGVLFL

SEQ ID NO: 914978 - protein, 9 aa, Homo Sapiens
EVAKDPQQV

SEQ ID NO: 914979 - protein, 9 aa, Homo Sapiens
LPTTSFATA

SEQ ID NO: 914980 - protein, 9 aa, Homo Sapiens
LHNCLVASK

SEQ ID NO: 914981 - protein, 9 aa, Homo Sapiens
KAITALRQT

SEQ ID NO: 914982 - protein, 9 aa, Homo Sapiens
VQENQMDKT

SEQ ID NO: 914983 - protein, 9 aa, Homo Sapiens
FPRRVSSMG

SEQ ID NO: 914984 - protein, 9 aa, Homo Sapiens
KKIDGKAGL

SEQ ID NO: 914985 - protein, 9 aa, Homo Sapiens
GTKSSTTEG

SEQ ID NO: 914986 - protein, 9 aa, Homo Sapiens
NFNLLRDID

SEQ ID NO: 914987 - protein, 9 aa, Homo Sapiens
KVEALQEGL

SEQ ID NO: 914988 - protein, 9 aa, Homo Sapiens
NSFFISHQR

SEQ ID NO: 914989 - protein, 9 aa, Homo Sapiens
GSGESSFSR

SEQ ID NO: 914990 - protein, 9 aa, Homo Sapiens
WKNLNKDGE

SEQ ID NO: 914991 - protein, 9 aa, Homo Sapiens
LNTGDDFVT

SEQ ID NO: 914992 - protein, 9 aa, Homo Sapiens
TTSGLVEKS

SEQ ID NO: 914993 - protein, 9 aa, Homo Sapiens
PLTHLDLCG

SEQ ID NO: 914994 - protein, 9 aa, Homo Sapiens
LTICNPLYH

SEQ ID NO: 914995 - protein, 9 aa, Homo Sapiens
GKNSVSVRI

SEQ ID NO: 914996 - protein, 9 aa, Homo Sapiens
FEVILKPPF

SEQ ID NO: 914997 - protein, 9 aa, Homo Sapiens
STSSQFLGY

SEQ ID NO: 914998 - protein, 9 aa, Homo Sapiens
TAQEPDASP

SEQ ID NO: 914999 - protein, 9 aa, Homo Sapiens
WQETKDGML

SEQ ID NO: 915000 - protein, 9 aa, Homo Sapiens
FTFVTEFLF

SEQ ID NO: 915001 - protein, 9 aa, Homo Sapiens
MDTVFPIQY

SEQ ID NO: 915002 - protein, 9 aa, Homo Sapiens
KEDDGEPGQ

SEQ ID NO: 915003 - protein, 9 aa, Homo Sapiens
KITKYWTLL

SEQ ID NO: 915004 - protein, 9 aa, Homo Sapiens
DSSRHPRSH

SEQ ID NO: 915005 - protein, 9 aa, Homo Sapiens
FVSVDGVRA

SEQ ID NO: 915006 - protein, 9 aa, Homo Sapiens
VAEAERLGV

SEQ ID NO: 915007 - protein, 9 aa, Homo Sapiens
VEVSAAGLE

SEQ ID NO: 915008 - protein, 9 aa, Homo Sapiens
LGQKKLASG

SEQ ID NO: 915009 - protein, 9 aa, Homo Sapiens
VWQETKDGM

SEQ ID NO: 915010 - protein, 9 aa, Homo Sapiens
NGFLHRGLT

SEQ ID NO: 915011 - protein, 9 aa, Homo Sapiens
SPAVPAHGY

SEQ ID NO: 915012 - protein, 9 aa, Homo Sapiens
KKREFAKNL

SEQ ID NO: 915013 - protein, 9 aa, Homo Sapiens
GQPDNWQGH

SEQ ID NO: 915014 - protein, 9 aa, Homo Sapiens
IDFLPFVLE

SEQ ID NO: 915015 - protein, 9 aa, Homo Sapiens
GSSKFRNAP

SEQ ID NO: 915016 - protein, 9 aa, Homo Sapiens
RCSAPPTKG

SEQ ID NO: 915017 - protein, 9 aa, Homo Sapiens
LPNIRESSK

SEQ ID NO: 915018 - protein, 9 aa, Homo Sapiens
APSLTFAFP

SEQ ID NO: 915019 - protein, 9 aa, Homo Sapiens
IRDKIALLF

SEQ ID NO: 915020 - protein, 9 aa, Homo Sapiens
SHGKAVDLG

SEQ ID NO: 915021 - protein, 9 aa, Homo Sapiens
SHLSSYELR

SEQ ID NO: 915022 - protein, 9 aa, Homo Sapiens
KDKSLEERG

SEQ ID NO: 915023 - protein, 9 aa, Homo Sapiens
EKEEDVSQA

SEQ ID NO: 915024 - protein, 9 aa, Homo Sapiens
SETNDFREF

SEQ ID NO: 915025 - protein, 9 aa, Homo Sapiens
EHHGKPFCH

SEQ ID NO: 915026 - protein, 9 aa, Homo Sapiens
TSASQNVIP

SEQ ID NO: 915027 - protein, 9 aa, Homo Sapiens
GTGTLTEKK

SEQ ID NO: 915028 - protein, 9 aa, Homo Sapiens
IRSAGIFLC

SEQ ID NO: 915029 - protein, 9 aa, Homo Sapiens
EKVSLEAFF

SEQ ID NO: 915030 - protein, 9 aa, Homo Sapiens
PSCLYAGVS

SEQ ID NO: 915031 - protein, 9 aa, Homo Sapiens
PPPTTPILV

SEQ ID NO: 915032 - protein, 9 aa, Homo Sapiens
AGGRLEKVS

SEQ ID NO: 915033 - protein, 9 aa, Homo Sapiens
RESENTRIL

SEQ ID NO: 915034 - protein, 9 aa, Homo Sapiens
TYEIITSRM

SEQ ID NO: 915035 - protein, 9 aa, Homo Sapiens
MLATIPPTV

SEQ ID NO: 915036 - protein, 9 aa, Homo Sapiens
NSGTKSKLP

SEQ ID NO: 915037 - protein, 9 aa, Homo Sapiens
IRLLQVILN

SEQ ID NO: 915038 - protein, 9 aa, Homo Sapiens
LSSTIILVL

SEQ ID NO: 915039 - protein, 9 aa, Homo Sapiens
TIPRQDKVP

SEQ ID NO: 915040 - protein, 9 aa, Homo Sapiens
WKRPLFLVI

SEQ ID NO: 915041 - protein, 9 aa, Homo Sapiens
EPSTVPSER

SEQ ID NO: 915042 - protein, 9 aa, Homo Sapiens
PFPNETNLV

SEQ ID NO: 915043 - protein, 9 aa, Homo Sapiens
VLLDAKTSA

SEQ ID NO: 915044 - protein, 9 aa, Homo Sapiens
LPLGFTIGA

SEQ ID NO: 915045 - protein, 9 aa, Homo Sapiens
ETLELSHVA

SEQ ID NO: 915046 - protein, 9 aa, Homo Sapiens
RAPESPRVL

SEQ ID NO: 915047 - protein, 9 aa, Homo Sapiens
CQIEAFGFS

SEQ ID NO: 915048 - protein, 9 aa, Homo Sapiens
VIAANMTEW

SEQ ID NO: 915049 - protein, 9 aa, Homo Sapiens
SQITYLVPW

SEQ ID NO: 915050 - protein, 9 aa, Homo Sapiens
QSKVTKKYH

SEQ ID NO: 915051 - protein, 9 aa, Homo Sapiens
QKEVRQGVE

SEQ ID NO: 915052 - protein, 9 aa, Homo Sapiens
GGIRVGHCI

SEQ ID NO: 915053 - protein, 9 aa, Homo Sapiens
RASVSVLED

SEQ ID NO: 915054 - protein, 9 aa, Homo Sapiens
ATEDWTVAK

SEQ ID NO: 915055 - protein, 9 aa, Homo Sapiens
PAKELSLPR

SEQ ID NO: 915056 - protein, 9 aa, Homo Sapiens
LFGSSAKSP

SEQ ID NO: 915057 - protein, 9 aa, Homo Sapiens
TEDWTVAKQ

SEQ ID NO: 915058 - protein, 9 aa, Homo Sapiens
NHVITTTKR

SEQ ID NO: 915059 - protein, 9 aa, Homo Sapiens
EQSRDSSRH

SEQ ID NO: 915060 - protein, 9 aa, Homo Sapiens
FLSLVTIIG

SEQ ID NO: 915061 - protein, 9 aa, Homo Sapiens
ASHLSSYEL

SEQ ID NO: 915062 - protein, 9 aa, Homo Sapiens
GAAQPALAE

SEQ ID NO: 915063 - protein, 9 aa, Homo Sapiens
MRLSFVGKL

SEQ ID NO: 915064 - protein, 9 aa, Homo Sapiens
TNGLCIWLL

SEQ ID NO: 915065 - protein, 9 aa, Homo Sapiens
GRFGDFQPL

SEQ ID NO: 915066 - protein, 9 aa, Homo Sapiens
MTNEPGLDN

SEQ ID NO: 915067 - protein, 9 aa, Homo Sapiens
LCVSTYEII

SEQ ID NO: 915068 - protein, 9 aa, Homo Sapiens
KNLPVEGLF

SEQ ID NO: 915069 - protein, 9 aa, Homo Sapiens
YHWKRWPLL

SEQ ID NO: 915070 - protein, 9 aa, Homo Sapiens
AAIRSAGIF

SEQ ID NO: 915071 - protein, 9 aa, Homo Sapiens
EEVNISNRR

SEQ ID NO: 915072 - protein, 9 aa, Homo Sapiens
HLSCLRRAL

SEQ ID NO: 915073 - protein, 9 aa, Homo Sapiens
STRSDASET

SEQ ID NO: 915074 - protein, 9 aa, Homo Sapiens
SSMYKYSSD

SEQ ID NO: 915075 - protein, 9 aa, Homo Sapiens
IDWIDEIKA

SEQ ID NO: 915076 - protein, 9 aa, Homo Sapiens
ACSHVPTRS

SEQ ID NO: 915077 - protein, 9 aa, Homo Sapiens
LGEKEDEDE

SEQ ID NO: 915078 - protein, 9 aa, Homo Sapiens
SDIAPLNFY

SEQ ID NO: 915079 - protein, 9 aa, Homo Sapiens
GFSLGSSES

SEQ ID NO: 915080 - protein, 9 aa, Homo Sapiens
LQYVKTHLA

SEQ ID NO: 915081 - protein, 9 aa, Homo Sapiens
LRDELVDSV

SEQ ID NO: 915082 - protein, 9 aa, Homo Sapiens
VDEDVFYNS

SEQ ID NO: 915083 - protein, 9 aa, Homo Sapiens
GKIDVLGEK

SEQ ID NO: 915084 - protein, 9 aa, Homo Sapiens
RAWVGVAAV

SEQ ID NO: 915085 - protein, 9 aa, Homo Sapiens
DRSGARPCL

SEQ ID NO: 915086 - protein, 9 aa, Homo Sapiens
HGYCSRISR

SEQ ID NO: 915087 - protein, 9 aa, Homo Sapiens
PKLNFTFVT

SEQ ID NO: 915088 - protein, 9 aa, Homo Sapiens
LCIWLLILS

SEQ ID NO: 915089 - protein, 9 aa, Homo Sapiens
SSLDYQYRQ

SEQ ID NO: 915090 - protein, 9 aa, Homo Sapiens
RKFGFYSKS

SEQ ID NO: 915091 - protein, 9 aa, Homo Sapiens
WLGCLLLVL

SEQ ID NO: 915092 - protein, 9 aa, Homo Sapiens
KMLILPPVS

SEQ ID NO: 915093 - protein, 9 aa, Homo Sapiens
EFGQWNMSG

SEQ ID NO: 915094 - protein, 9 aa, Homo Sapiens
IPRVLRLQH

SEQ ID NO: 915095 - protein, 9 aa, Homo Sapiens
LPKVIFTLE

SEQ ID NO: 915096 - protein, 9 aa, Homo Sapiens
DSNDSSTLK

SEQ ID NO: 915097 - protein, 9 aa, Homo Sapiens
AKILHFTLR

SEQ ID NO: 915098 - protein, 9 aa, Homo Sapiens
MPKLNFTFV

SEQ ID NO: 915099 - protein, 9 aa, Homo Sapiens
EQLRQRQNV

SEQ ID NO: 915100 - protein, 9 aa, Homo Sapiens
DNSEGLLFR

SEQ ID NO: 915101 - protein, 9 aa, Homo Sapiens
DPFGPAGSL

SEQ ID NO: 915102 - protein, 9 aa, Homo Sapiens
FLVITFFML

SEQ ID NO: 915103 - protein, 9 aa, Homo Sapiens
LGLVRGQFQ

SEQ ID NO: 915104 - protein, 9 aa, Homo Sapiens
LTRFTGVII

SEQ ID NO: 915105 - protein, 9 aa, Homo Sapiens
GYRMKNHHC

SEQ ID NO: 915106 - protein, 9 aa, Homo Sapiens
SQKTGLQYL

SEQ ID NO: 915107 - protein, 9 aa, Homo Sapiens
TGDSGALPV

SEQ ID NO: 915108 - protein, 9 aa, Homo Sapiens
LRPGWPQGL

SEQ ID NO: 915109 - protein, 9 aa, Homo Sapiens
PGVEVSAAG

SEQ ID NO: 915110 - protein, 9 aa, Homo Sapiens
EEEEEEKFG

SEQ ID NO: 915111 - protein, 9 aa, Homo Sapiens
GLCRRGGRC

SEQ ID NO: 915112 - protein, 9 aa, Homo Sapiens
YKFRSESKR

SEQ ID NO: 915113 - protein, 9 aa, Homo Sapiens
DFEILKSKK

SEQ ID NO: 915114 - protein, 9 aa, Homo Sapiens
KTSSGTKLS

SEQ ID NO: 915115 - protein, 9 aa, Homo Sapiens
RGGRCVNTH

SEQ ID NO: 915116 - protein, 9 aa, Homo Sapiens
LKRQSRTLY

SEQ ID NO: 915117 - protein, 9 aa, Homo Sapiens
LFDSNDSST

SEQ ID NO: 915118 - protein, 9 aa, Homo Sapiens
YTVLFSHGK

SEQ ID NO: 915119 - protein, 9 aa, Homo Sapiens
SASMLKQFS

SEQ ID NO: 915120 - protein, 9 aa, Homo Sapiens
CITMNKQRL

SEQ ID NO: 915121 - protein, 9 aa, Homo Sapiens
RVDTSLGTK

SEQ ID NO: 915122 - protein, 9 aa, Homo Sapiens
SGYRSFRRS

SEQ ID NO: 915123 - protein, 9 aa, Homo Sapiens
QPGEKESPG

SEQ ID NO: 915124 - protein, 9 aa, Homo Sapiens
RHHRSHRRR

SEQ ID NO: 915125 - protein, 9 aa, Homo Sapiens
REKDRELER

SEQ ID NO: 915126 - protein, 9 aa, Homo Sapiens
HLGSGVSDS

SEQ ID NO: 915127 - protein, 9 aa, Homo Sapiens
KRTPRGNKN

SEQ ID NO: 915128 - protein, 9 aa, Homo Sapiens
HHTLFQLRQ

SEQ ID NO: 915129 - protein, 9 aa, Homo Sapiens
EKKYCQPPD

SEQ ID NO: 915130 - protein, 9 aa, Homo Sapiens
EEEKFGPGM

SEQ ID NO: 915131 - protein, 9 aa, Homo Sapiens
TTSRTPCFS

SEQ ID NO: 915132 - protein, 9 aa, Homo Sapiens
EPCGHSIYH

SEQ ID NO: 915133 - protein, 9 aa, Homo Sapiens
GPPGPKGSM

SEQ ID NO: 915134 - protein, 9 aa, Homo Sapiens
GVSSSCQSV

SEQ ID NO: 915135 - protein, 9 aa, Homo Sapiens
GQFPRRVSS

SEQ ID NO: 915136 - protein, 9 aa, Homo Sapiens
EEEEEEEKF

SEQ ID NO: 915137 - protein, 9 aa, Homo Sapiens
FSTRSDASE

SEQ ID NO: 915138 - protein, 9 aa, Homo Sapiens
LWGHKRIHT

SEQ ID NO: 915139 - protein, 9 aa, Homo Sapiens
FLMAAGKSA

SEQ ID NO: 915140 - protein, 9 aa, Homo Sapiens
DKNYHNIKI

SEQ ID NO: 915141 - protein, 9 aa, Homo Sapiens
SLQLIQEGF

SEQ ID NO: 915142 - protein, 9 aa, Homo Sapiens
GPKATLCGD

SEQ ID NO: 915143 - protein, 9 aa, Homo Sapiens
SATIPRQDK

SEQ ID NO: 915144 - protein, 9 aa, Homo Sapiens
SEEQLRQRQ

SEQ ID NO: 915145 - protein, 9 aa, Homo Sapiens
GYIEGYPKF

SEQ ID NO: 915146 - protein, 9 aa, Homo Sapiens
TYRENVGGS

SEQ ID NO: 915147 - protein, 9 aa, Homo Sapiens
LFGQGDFYY

SEQ ID NO: 915148 - protein, 9 aa, Homo Sapiens
SAASNRSKN

SEQ ID NO: 915149 - protein, 9 aa, Homo Sapiens
YWKLALKYH

SEQ ID NO: 915150 - protein, 9 aa, Homo Sapiens
RFDSRDIFL

SEQ ID NO: 915151 - protein, 9 aa, Homo Sapiens
NIKILSSEE

SEQ ID NO: 915152 - protein, 9 aa, Homo Sapiens
LHEFLQYVK

SEQ ID NO: 915153 - protein, 9 aa, Homo Sapiens
PQGLFRLGK

SEQ ID NO: 915154 - protein, 9 aa, Homo Sapiens
SCQSVSSNQ

SEQ ID NO: 915155 - protein, 9 aa, Homo Sapiens
ETQYGTETF

SEQ ID NO: 915156 - protein, 9 aa, Homo Sapiens
RNSVDSGST

SEQ ID NO: 915157 - protein, 9 aa, Homo Sapiens
HNAVNKIFH

SEQ ID NO: 915158 - protein, 9 aa, Homo Sapiens
WEFALLFLI

SEQ ID NO: 915159 - protein, 9 aa, Homo Sapiens
GVTTVKPGN

SEQ ID NO: 915160 - protein, 9 aa, Homo Sapiens
ECEIIKRRR

SEQ ID NO: 915161 - protein, 9 aa, Homo Sapiens
KPGLSSVLS

SEQ ID NO: 915162 - protein, 9 aa, Homo Sapiens
FPYLVFLHT

SEQ ID NO: 915163 - protein, 9 aa, Homo Sapiens
FQSILVATP

SEQ ID NO: 915164 - protein, 9 aa, Homo Sapiens
QRTLFMIEE

SEQ ID NO: 915165 - protein, 9 aa, Homo Sapiens
WVGVAAVGN

SEQ ID NO: 915166 - protein, 9 aa, Homo Sapiens
LLDDPFGPA

SEQ ID NO: 915167 - protein, 9 aa, Homo Sapiens
LRQRLKEYF

SEQ ID NO: 915168 - protein, 9 aa, Homo Sapiens
FCSFENQFH

SEQ ID NO: 915169 - protein, 9 aa, Homo Sapiens
NEEVIQLSP

SEQ ID NO: 915170 - protein, 9 aa, Homo Sapiens
AKEIQGIPL

SEQ ID NO: 915171 - protein, 9 aa, Homo Sapiens
LVVLLSGGQ

SEQ ID NO: 915172 - protein, 9 aa, Homo Sapiens
LLTEVAKDP

SEQ ID NO: 915173 - protein, 9 aa, Homo Sapiens
SLKSCRTHW

SEQ ID NO: 915174 - protein, 9 aa, Homo Sapiens
LVASKNGIA

SEQ ID NO: 915175 - protein, 9 aa, Homo Sapiens
PIVQDGSHR

SEQ ID NO: 915176 - protein, 9 aa, Homo Sapiens
GAQLHEFLQ

SEQ ID NO: 915177 - protein, 9 aa, Homo Sapiens
PKSCYKLFQ

SEQ ID NO: 915178 - protein, 9 aa, Homo Sapiens
LFIDNIATL

SEQ ID NO: 915179 - protein, 9 aa, Homo Sapiens
SLSPGLAPL

SEQ ID NO: 915180 - protein, 9 aa, Homo Sapiens
AVILKNLSF

SEQ ID NO: 915181 - protein, 9 aa, Homo Sapiens
AATEDWTVA

SEQ ID NO: 915182 - protein, 9 aa, Homo Sapiens
SLGLVRGQF

SEQ ID NO: 915183 - protein, 9 aa, Homo Sapiens
SVSQSFIHT

SEQ ID NO: 915184 - protein, 9 aa, Homo Sapiens
RQMIGEFLE

SEQ ID NO: 915185 - protein, 9 aa, Homo Sapiens
IKFVSDGTV

SEQ ID NO: 915186 - protein, 9 aa, Homo Sapiens
AVGGDVPIL

SEQ ID NO: 915187 - protein, 9 aa, Homo Sapiens
PSLTFAFPA

SEQ ID NO: 915188 - protein, 9 aa, Homo Sapiens
QYYGMPAWK

SEQ ID NO: 915189 - protein, 9 aa, Homo Sapiens
NNLLQQVGG

SEQ ID NO: 915190 - protein, 9 aa, Homo Sapiens
FFSEHQLPS

SEQ ID NO: 915191 - protein, 9 aa, Homo Sapiens
DDEPIVQDG

SEQ ID NO: 915192 - protein, 9 aa, Homo Sapiens
RKTFFTFAF

SEQ ID NO: 915193 - protein, 9 aa, Homo Sapiens
LEDVTSGYS

SEQ ID NO: 915194 - protein, 9 aa, Homo Sapiens
PHPFPNETN

SEQ ID NO: 915195 - protein, 9 aa, Homo Sapiens
ISSHLGSGV

SEQ ID NO: 915196 - protein, 9 aa, Homo Sapiens
LERINVHHR

SEQ ID NO: 915197 - protein, 9 aa, Homo Sapiens
EKNQNKKID

SEQ ID NO: 915198 - protein, 9 aa, Homo Sapiens
TQYGTETFW

SEQ ID NO: 915199 - protein, 9 aa, Homo Sapiens
NEEKVSLEA

SEQ ID NO: 915200 - protein, 9 aa, Homo Sapiens
TSLPTTSFA

SEQ ID NO: 915201 - protein, 9 aa, Homo Sapiens
NECQCVQSK

SEQ ID NO: 915202 - protein, 9 aa, Homo Sapiens
LEVVRKKLE

SEQ ID NO: 915203 - protein, 9 aa, Homo Sapiens
YATYNQSEY

SEQ ID NO: 915204 - protein, 9 aa, Homo Sapiens
CYGNNVLRL

SEQ ID NO: 915205 - protein, 9 aa, Homo Sapiens
AEHHGKPFC

SEQ ID NO: 915206 - protein, 9 aa, Homo Sapiens
VEVLGSFSV

SEQ ID NO: 915207 - protein, 9 aa, Homo Sapiens
TPSPKAAPP

SEQ ID NO: 915208 - protein, 9 aa, Homo Sapiens
IQLSPDEET

SEQ ID NO: 915209 - protein, 9 aa, Homo Sapiens
VTPWLKGNI

SEQ ID NO: 915210 - protein, 9 aa, Homo Sapiens
GFFDPNTEK

SEQ ID NO: 915211 - protein, 9 aa, Homo Sapiens
LEKERSVLN

SEQ ID NO: 915212 - protein, 9 aa, Homo Sapiens
FVQGYGTFF

SEQ ID NO: 915213 - protein, 9 aa, Homo Sapiens
TKGDCGPGK

SEQ ID NO: 915214 - protein, 9 aa, Homo Sapiens
MRIEDPFLL

SEQ ID NO: 915215 - protein, 9 aa, Homo Sapiens
SKKNESLFW

SEQ ID NO: 915216 - protein, 9 aa, Homo Sapiens
SWQILAQPW

SEQ ID NO: 915217 - protein, 9 aa, Homo Sapiens
DMSLDDEDS

SEQ ID NO: 915218 - protein, 9 aa, Homo Sapiens
GNGWKPPEN

SEQ ID NO: 915219 - protein, 9 aa, Homo Sapiens
QWITSLLKS

SEQ ID NO: 915220 - protein, 9 aa, Homo Sapiens
SKGVVISFL

SEQ ID NO: 915221 - protein, 9 aa, Homo Sapiens
EMKSYRCRL

SEQ ID NO: 915222 - protein, 9 aa, Homo Sapiens
IVRELYARN

SEQ ID NO: 915223 - protein, 9 aa, Homo Sapiens
IDVLGEKED

SEQ ID NO: 915224 - protein, 9 aa, Homo Sapiens
NIKHVPRGG

SEQ ID NO: 915225 - protein, 9 aa, Homo Sapiens
MPLRNETLR

SEQ ID NO: 915226 - protein, 9 aa, Homo Sapiens
MISLLEQEK

SEQ ID NO: 915227 - protein, 9 aa, Homo Sapiens
AIIMYMVPA

SEQ ID NO: 915228 - protein, 9 aa, Homo Sapiens
SIPWDGKAP

SEQ ID NO: 915229 - protein, 9 aa, Homo Sapiens
SKTDSIITG

SEQ ID NO: 915230 - protein, 9 aa, Homo Sapiens
AFLYKPCGV

SEQ ID NO: 915231 - protein, 9 aa, Homo Sapiens
PMAPNQELP

SEQ ID NO: 915232 - protein, 9 aa, Homo Sapiens
VILKPPFFD

SEQ ID NO: 915233 - protein, 9 aa, Homo Sapiens
YGMPAWKVS

SEQ ID NO: 915234 - protein, 9 aa, Homo Sapiens
DAGVYSCIT

SEQ ID NO: 915235 - protein, 9 aa, Homo Sapiens
VFLEFFAWG

SEQ ID NO: 915236 - protein, 9 aa, Homo Sapiens
HGKKGKIDS

SEQ ID NO: 915237 - protein, 9 aa, Homo Sapiens
TNECEIIKR

SEQ ID NO: 915238 - protein, 9 aa, Homo Sapiens
LSDPVPTAF

SEQ ID NO: 915239 - protein, 9 aa, Homo Sapiens
QELEVVRKK

SEQ ID NO: 915240 - protein, 9 aa, Homo Sapiens
MKMRHPNSV

SEQ ID NO: 915241 - protein, 9 aa, Homo Sapiens
QPRHRSASL

SEQ ID NO: 915242 - protein, 9 aa, Homo Sapiens
KLGWELHIP

SEQ ID NO: 915243 - protein, 9 aa, Homo Sapiens
KFDKPLDMS

SEQ ID NO: 915244 - protein, 9 aa, Homo Sapiens
LSKTHGKSS

SEQ ID NO: 915245 - protein, 9 aa, Homo Sapiens
QEQSRDSSR

SEQ ID NO: 915246 - protein, 9 aa, Homo Sapiens
SSDISYMPS

SEQ ID NO: 915247 - protein, 9 aa, Homo Sapiens
VIFTLEEPT

SEQ ID NO: 915248 - protein, 9 aa, Homo Sapiens
ESVSQSFIH

SEQ ID NO: 915249 - protein, 9 aa, Homo Sapiens
SLLSSSRVM

SEQ ID NO: 915250 - protein, 9 aa, Homo Sapiens
TFNILFGSS

SEQ ID NO: 915251 - protein, 9 aa, Homo Sapiens
TKDGMLVVN

SEQ ID NO: 915252 - protein, 9 aa, Homo Sapiens
AKAGQSDSD

SEQ ID NO: 915253 - protein, 9 aa, Homo Sapiens
ASKDPALEK

SEQ ID NO: 915254 - protein, 9 aa, Homo Sapiens
GNKVIPLFT

SEQ ID NO: 915255 - protein, 9 aa, Homo Sapiens
PEEDGTFNL

SEQ ID NO: 915256 - protein, 9 aa, Homo Sapiens
YLVFLHTLI

SEQ ID NO: 915257 - protein, 9 aa, Homo Sapiens
SSHLGSGVS

SEQ ID NO: 915258 - protein, 9 aa, Homo Sapiens
DMDWEFALL

SEQ ID NO: 915259 - protein, 9 aa, Homo Sapiens
RKMEMLCAG

SEQ ID NO: 915260 - protein, 9 aa, Homo Sapiens
YSSDISYMP

SEQ ID NO: 915261 - protein, 9 aa, Homo Sapiens
NKIVNEKSS

SEQ ID NO: 915262 - protein, 9 aa, Homo Sapiens
KKGKIDSYS

SEQ ID NO: 915263 - protein, 9 aa, Homo Sapiens
VKKITFLKY

SEQ ID NO: 915264 - protein, 9 aa, Homo Sapiens
SAERQNLSV

SEQ ID NO: 915265 - protein, 9 aa, Homo Sapiens
LLPGSPNLE

SEQ ID NO: 915266 - protein, 9 aa, Homo Sapiens
ACILFGQGD

SEQ ID NO: 915267 - protein, 9 aa, Homo Sapiens
HMAHKKFLW

SEQ ID NO: 915268 - protein, 9 aa, Homo Sapiens
PGEKESPGA

SEQ ID NO: 915269 - protein, 9 aa, Homo Sapiens
FCYIRSQLE

SEQ ID NO: 915270 - protein, 9 aa, Homo Sapiens
DSLGYTALH

SEQ ID NO: 915271 - protein, 9 aa, Homo Sapiens
TRNMVHRLI

SEQ ID NO: 915272 - protein, 9 aa, Homo Sapiens
DPPGIPVFR

SEQ ID NO: 915273 - protein, 9 aa, Homo Sapiens
QTLCVSTYE

SEQ ID NO: 915274 - protein, 9 aa, Homo Sapiens
TGLQYLKNV

SEQ ID NO: 915275 - protein, 9 aa, Homo Sapiens
CPKCRGDKE

SEQ ID NO: 915276 - protein, 9 aa, Homo Sapiens
YMARTPYWA

SEQ ID NO: 915277 - protein, 9 aa, Homo Sapiens
RTGGMMVIT

SEQ ID NO: 915278 - protein, 9 aa, Homo Sapiens
IFRIYVSID

SEQ ID NO: 915279 - protein, 9 aa, Homo Sapiens
IEWLILPAD

SEQ ID NO: 915280 - protein, 9 aa, Homo Sapiens
FPQMGITNF

SEQ ID NO: 915281 - protein, 9 aa, Homo Sapiens
RHRSASLAA

SEQ ID NO: 915282 - protein, 9 aa, Homo Sapiens
QSVHHLVLT

SEQ ID NO: 915283 - protein, 9 aa, Homo Sapiens
GLDINFLES

SEQ ID NO: 915284 - protein, 9 aa, Homo Sapiens
EVIQLSPDE

SEQ ID NO: 915285 - protein, 9 aa, Homo Sapiens
HIINLLQDN

SEQ ID NO: 915286 - protein, 9 aa, Homo Sapiens
MIPAGIYAL

SEQ ID NO: 915287 - protein, 9 aa, Homo Sapiens
SLQSGKQKT

SEQ ID NO: 915288 - protein, 9 aa, Homo Sapiens
RSVRLQEAE

SEQ ID NO: 915289 - protein, 9 aa, Homo Sapiens
VSSMGPPSK

SEQ ID NO: 915290 - protein, 9 aa, Homo Sapiens
NSAPYAPAY

SEQ ID NO: 915291 - protein, 9 aa, Homo Sapiens
GVKAMGPLV

SEQ ID NO: 915292 - protein, 9 aa, Homo Sapiens
DDLEYLQAN

SEQ ID NO: 915293 - protein, 9 aa, Homo Sapiens
RSLDSPTFS

SEQ ID NO: 915294 - protein, 9 aa, Homo Sapiens
PKCRGDKEK

SEQ ID NO: 915295 - protein, 9 aa, Homo Sapiens
VLFSHGKAV

SEQ ID NO: 915296 - protein, 9 aa, Homo Sapiens
LLIFFLFIE

SEQ ID NO: 915297 - protein, 9 aa, Homo Sapiens
TSLGTKSST

SEQ ID NO: 915298 - protein, 9 aa, Homo Sapiens
KQQELEVVR

SEQ ID NO: 915299 - protein, 9 aa, Homo Sapiens
AQITQERAN

SEQ ID NO: 915300 - protein, 9 aa, Homo Sapiens
RYKVNTHML

SEQ ID NO: 915301 - protein, 9 aa, Homo Sapiens
GVLFLLLLV

SEQ ID NO: 915302 - protein, 9 aa, Homo Sapiens
NCNECQCVQ

SEQ ID NO: 915303 - protein, 9 aa, Homo Sapiens
QEAEGDLGR

SEQ ID NO: 915304 - protein, 9 aa, Homo Sapiens
SHFVSVDGV

SEQ ID NO: 915305 - protein, 9 aa, Homo Sapiens
VSVPKIKGI

SEQ ID NO: 915306 - protein, 9 aa, Homo Sapiens
FFIRYEIFK

SEQ ID NO: 915307 - protein, 9 aa, Homo Sapiens
PRGNKNFEC

SEQ ID NO: 915308 - protein, 9 aa, Homo Sapiens
SFFKPGFEE

SEQ ID NO: 915309 - protein, 9 aa, Homo Sapiens
EFGDLEKIE

SEQ ID NO: 915310 - protein, 9 aa, Homo Sapiens
TQLAEAQKV

SEQ ID NO: 915311 - protein, 9 aa, Homo Sapiens
HRLIEKREV

SEQ ID NO: 915312 - protein, 9 aa, Homo Sapiens
LAPEFIPRV

SEQ ID NO: 915313 - protein, 9 aa, Homo Sapiens
SSSSSSFPP

SEQ ID NO: 915314 - protein, 9 aa, Homo Sapiens
VPGVRNYEF

SEQ ID NO: 915315 - protein, 9 aa, Homo Sapiens
SIQKDKTYS

SEQ ID NO: 915316 - protein, 9 aa, Homo Sapiens
GTLGQKKLA

SEQ ID NO: 915317 - protein, 9 aa, Homo Sapiens
CVGYAVTKT

SEQ ID NO: 915318 - protein, 9 aa, Homo Sapiens
NETLREVWA

SEQ ID NO: 915319 - protein, 9 aa, Homo Sapiens
LTSQLKAEK

SEQ ID NO: 915320 - protein, 9 aa, Homo Sapiens
YLQANFNLL

SEQ ID NO: 915321 - protein, 9 aa, Homo Sapiens
SSDFEKDDD

SEQ ID NO: 915322 - protein, 9 aa, Homo Sapiens
ADNSEGLLF

SEQ ID NO: 915323 - protein, 9 aa, Homo Sapiens
NSSHEKAIT

SEQ ID NO: 915324 - protein, 9 aa, Homo Sapiens
RLKEYFQHA

SEQ ID NO: 915325 - protein, 9 aa, Homo Sapiens
LSTTIQEEL

SEQ ID NO: 915326 - protein, 9 aa, Homo Sapiens
HPMMLKESR

SEQ ID NO: 915327 - protein, 9 aa, Homo Sapiens
PFLQVNFHS

SEQ ID NO: 915328 - protein, 9 aa, Homo Sapiens
SKTQSDDSD

SEQ ID NO: 915329 - protein, 9 aa, Homo Sapiens
LLNDEGEDN

SEQ ID NO: 915330 - protein, 9 aa, Homo Sapiens
GEAEMAEAM

SEQ ID NO: 915331 - protein, 9 aa, Homo Sapiens
ALIEFCYKF

SEQ ID NO: 915332 - protein, 9 aa, Homo Sapiens
AICAQLSII

SEQ ID NO: 915333 - protein, 9 aa, Homo Sapiens
RENVGGSGA

SEQ ID NO: 915334 - protein, 9 aa, Homo Sapiens
PKQTPLAFD

SEQ ID NO: 915335 - protein, 9 aa, Homo Sapiens
IQQYKCLRF

SEQ ID NO: 915336 - protein, 9 aa, Homo Sapiens
KNKARYRTK

SEQ ID NO: 915337 - protein, 9 aa, Homo Sapiens
LLKSQPYRL

SEQ ID NO: 915338 - protein, 9 aa, Homo Sapiens
KDLDKLHRA

SEQ ID NO: 915339 - protein, 9 aa, Homo Sapiens
RGKNSVSVR

SEQ ID NO: 915340 - protein, 9 aa, Homo Sapiens
FRNSVDSGS

SEQ ID NO: 915341 - protein, 9 aa, Homo Sapiens
IDIILNQRN

SEQ ID NO: 915342 - protein, 9 aa, Homo Sapiens
LYFFSEHQL

SEQ ID NO: 915343 - protein, 9 aa, Homo Sapiens
SNSYSLTKN

SEQ ID NO: 915344 - protein, 9 aa, Homo Sapiens
QASRFCYGG

SEQ ID NO: 915345 - protein, 9 aa, Homo Sapiens
CKSGINCSI

SEQ ID NO: 915346 - protein, 9 aa, Homo Sapiens
GLVRGQFQD

SEQ ID NO: 915347 - protein, 9 aa, Homo Sapiens
VDFYMAIVN

SEQ ID NO: 915348 - protein, 9 aa, Homo Sapiens
QFQPGFISP

SEQ ID NO: 915349 - protein, 9 aa, Homo Sapiens
GLVEKSTTY

SEQ ID NO: 915350 - protein, 9 aa, Homo Sapiens
YNEAWPTLL

SEQ ID NO: 915351 - protein, 9 aa, Homo Sapiens
TGLNVPRNQ

SEQ ID NO: 915352 - protein, 9 aa, Homo Sapiens
FLPPSESFD

SEQ ID NO: 915353 - protein, 9 aa, Homo Sapiens
RFTGVIIQG

SEQ ID NO: 915354 - protein, 9 aa, Homo Sapiens
KSGINCSIQ

SEQ ID NO: 915355 - protein, 9 aa, Homo Sapiens
KFLVALLVE

SEQ ID NO: 915356 - protein, 9 aa, Homo Sapiens
INGDPEAVA

SEQ ID NO: 915357 - protein, 9 aa, Homo Sapiens
QENQMDKTR

SEQ ID NO: 915358 - protein, 9 aa, Homo Sapiens
DELVDSVSK

SEQ ID NO: 915359 - protein, 9 aa, Homo Sapiens
QIIKANYHS

SEQ ID NO: 915360 - protein, 9 aa, Homo Sapiens
ITDEMADQL

SEQ ID NO: 915361 - protein, 9 aa, Homo Sapiens
RLLKVEILR

SEQ ID NO: 915362 - protein, 9 aa, Homo Sapiens
KQTPLAFDN

SEQ ID NO: 915363 - protein, 9 aa, Homo Sapiens
PGSPNLEEP

SEQ ID NO: 915364 - protein, 9 aa, Homo Sapiens
TFWSKDMAP

SEQ ID NO: 915365 - protein, 9 aa, Homo Sapiens
EEDQESSEE

SEQ ID NO: 915366 - protein, 9 aa, Homo Sapiens
IPMWSQQVI

SEQ ID NO: 915367 - protein, 9 aa, Homo Sapiens
SISQVPCRL

SEQ ID NO: 915368 - protein, 9 aa, Homo Sapiens
RYHVRRKDL

SEQ ID NO: 915369 - protein, 9 aa, Homo Sapiens
LKNIARMTH

SEQ ID NO: 915370 - protein, 9 aa, Homo Sapiens
MTLTVSPGV

SEQ ID NO: 915371 - protein, 9 aa, Homo Sapiens
QEGFKSGFL

SEQ ID NO: 915372 - protein, 9 aa, Homo Sapiens
LEGQMFWKT

SEQ ID NO: 915373 - protein, 9 aa, Homo Sapiens
TNGFSLGSS

SEQ ID NO: 915374 - protein, 9 aa, Homo Sapiens
DKLNLKKSD

SEQ ID NO: 915375 - protein, 9 aa, Homo Sapiens
DYMARTPYW

SEQ ID NO: 915376 - protein, 9 aa, Homo Sapiens
LRLDQLGIT

SEQ ID NO: 915377 - protein, 9 aa, Homo Sapiens
LAETLNPSD

SEQ ID NO: 915378 - protein, 9 aa, Homo Sapiens
ALLAKKREF

SEQ ID NO: 915379 - protein, 9 aa, Homo Sapiens
KSYRCRLAA

SEQ ID NO: 915380 - protein, 9 aa, Homo Sapiens
FLLLEWYGW

SEQ ID NO: 915381 - protein, 9 aa, Homo Sapiens
RKSAKAGQS

SEQ ID NO: 915382 - protein, 9 aa, Homo Sapiens
ALKRQSRTL

SEQ ID NO: 915383 - protein, 9 aa, Homo Sapiens
PKSDSYLQL

SEQ ID NO: 915384 - protein, 9 aa, Homo Sapiens
PRHRSASLA

SEQ ID NO: 915385 - protein, 9 aa, Homo Sapiens
PTFSPGAGT

SEQ ID NO: 915386 - protein, 9 aa, Homo Sapiens
SRDIFLVGW

SEQ ID NO: 915387 - protein, 9 aa, Homo Sapiens
LVRGQFQDN

SEQ ID NO: 915388 - protein, 9 aa, Homo Sapiens
PRPAKELSL

SEQ ID NO: 915389 - protein, 9 aa, Homo Sapiens
EHKSQGSGQ

SEQ ID NO: 915390 - protein, 9 aa, Homo Sapiens
LVNRLILAY

SEQ ID NO: 915391 - protein, 9 aa, Homo Sapiens
IAPLNFYEV

SEQ ID NO: 915392 - protein, 9 aa, Homo Sapiens
LASPAVPAH

SEQ ID NO: 915393 - protein, 9 aa, Homo Sapiens
SIRFFSRSR

SEQ ID NO: 915394 - protein, 9 aa, Homo Sapiens
RSVGMHGEH

SEQ ID NO: 915395 - protein, 9 aa, Homo Sapiens
PLVKNLLKD

SEQ ID NO: 915396 - protein, 9 aa, Homo Sapiens
LGTKSSTTE

SEQ ID NO: 915397 - protein, 9 aa, Homo Sapiens
AQKVEPQEV

SEQ ID NO: 915398 - protein, 9 aa, Homo Sapiens
PRGFSFHSS

SEQ ID NO: 915399 - protein, 9 aa, Homo Sapiens
LHKNLPVEG

SEQ ID NO: 915400 - protein, 9 aa, Homo Sapiens
KPILPQQKS

SEQ ID NO: 915401 - protein, 9 aa, Homo Sapiens
FSPGAGTRQ

SEQ ID NO: 915402 - protein, 9 aa, Homo Sapiens
KEFAKILHF

SEQ ID NO: 915403 - protein, 9 aa, Homo Sapiens
IIEWKNLNK

SEQ ID NO: 915404 - protein, 9 aa, Homo Sapiens
RLQNGRRAG

SEQ ID NO: 915405 - protein, 9 aa, Homo Sapiens
SDDIKKSYW

SEQ ID NO: 915406 - protein, 9 aa, Homo Sapiens
KVIFTLEEP

SEQ ID NO: 915407 - protein, 9 aa, Homo Sapiens
AVGLRLAET

SEQ ID NO: 915408 - protein, 9 aa, Homo Sapiens
SSSFPPLPL

SEQ ID NO: 915409 - protein, 9 aa, Homo Sapiens
PPSPFRNSV

SEQ ID NO: 915410 - protein, 9 aa, Homo Sapiens
WPQGLFRLG

SEQ ID NO: 915411 - protein, 9 aa, Homo Sapiens
NETACQSSL

SEQ ID NO: 915412 - protein, 9 aa, Homo Sapiens
FLWTIEPNE

SEQ ID NO: 915413 - protein, 9 aa, Homo Sapiens
HLAELDLPR

SEQ ID NO: 915414 - protein, 9 aa, Homo Sapiens
FFFSALEGA

SEQ ID NO: 915415 - protein, 9 aa, Homo Sapiens
LTEVAKDPQ

SEQ ID NO: 915416 - protein, 9 aa, Homo Sapiens
DSEGHLYAV

SEQ ID NO: 915417 - protein, 9 aa, Homo Sapiens
GCSRRQRAL

SEQ ID NO: 915418 - protein, 9 aa, Homo Sapiens
GPGTLGQKK

SEQ ID NO: 915419 - protein, 9 aa, Homo Sapiens
EIISEKKYC

SEQ ID NO: 915420 - protein, 9 aa, Homo Sapiens
GQMFWKTGK

SEQ ID NO: 915421 - protein, 9 aa, Homo Sapiens
TRSVHGDPP

SEQ ID NO: 915422 - protein, 9 aa, Homo Sapiens
ESIFVRIHA

SEQ ID NO: 915423 - protein, 9 aa, Homo Sapiens
IDEIKAHLL

SEQ ID NO: 915424 - protein, 9 aa, Homo Sapiens
VTKTHPALV

SEQ ID NO: 915425 - protein, 9 aa, Homo Sapiens
IGDPACIQL

SEQ ID NO: 915426 - protein, 9 aa, Homo Sapiens
GSSGSKSST

SEQ ID NO: 915427 - protein, 9 aa, Homo Sapiens
DLLQDVLFP

SEQ ID NO: 915428 - protein, 9 aa, Homo Sapiens
CIIEINGQS

SEQ ID NO: 915429 - protein, 9 aa, Homo Sapiens
IITGTVSTV

SEQ ID NO: 915430 - protein, 9 aa, Homo Sapiens
LCGDSFPDD

SEQ ID NO: 915431 - protein, 9 aa, Homo Sapiens
FKPGDTQKK

SEQ ID NO: 915432 - protein, 9 aa, Homo Sapiens
GCALMKMRH

SEQ ID NO: 915433 - protein, 9 aa, Homo Sapiens
INSTVNLVC

SEQ ID NO: 915434 - protein, 9 aa, Homo Sapiens
PLNFYEVAG

SEQ ID NO: 915435 - protein, 9 aa, Homo Sapiens
EELNFLITK

SEQ ID NO: 915436 - protein, 9 aa, Homo Sapiens
LNPTGQFLV

SEQ ID NO: 915437 - protein, 9 aa, Homo Sapiens
DEDSKIQNQ

SEQ ID NO: 915438 - protein, 9 aa, Homo Sapiens
FDLNPTGQF

SEQ ID NO: 915439 - protein, 9 aa, Homo Sapiens
FSLKNIARM

SEQ ID NO: 915440 - protein, 9 aa, Homo Sapiens
VGKLGWELH

SEQ ID NO: 915441 - protein, 9 aa, Homo Sapiens
KPKTLSLTV

SEQ ID NO: 915442 - protein, 9 aa, Homo Sapiens
DVFSQSKAD

SEQ ID NO: 915443 - protein, 9 aa, Homo Sapiens
TLLTGAVGF

SEQ ID NO: 915444 - protein, 9 aa, Homo Sapiens
NILFGSSAK

SEQ ID NO: 915445 - protein, 9 aa, Homo Sapiens
ADGPKATLC

SEQ ID NO: 915446 - protein, 9 aa, Homo Sapiens
IIFRKAREF

SEQ ID NO: 915447 - protein, 9 aa, Homo Sapiens
GKITPLPDG

SEQ ID NO: 915448 - protein, 9 aa, Homo Sapiens
LDKKLMTES

SEQ ID NO: 915449 - protein, 9 aa, Homo Sapiens
PSPQVPPQG

SEQ ID NO: 915450 - protein, 9 aa, Homo Sapiens
KAVDLGQMS

SEQ ID NO: 915451 - protein, 9 aa, Homo Sapiens
FLHTLIFLA

SEQ ID NO: 915452 - protein, 9 aa, Homo Sapiens
PQGCYVAKE

SEQ ID NO: 915453 - protein, 9 aa, Homo Sapiens
KAEKGLTIV

SEQ ID NO: 915454 - protein, 9 aa, Homo Sapiens
SPQVPPQGC

SEQ ID NO: 915455 - protein, 9 aa, Homo Sapiens
LSIPWDGKA

SEQ ID NO: 915456 - protein, 9 aa, Homo Sapiens
VSQSFIHTA

SEQ ID NO: 915457 - protein, 9 aa, Homo Sapiens
EEYNNLDLF

SEQ ID NO: 915458 - protein, 9 aa, Homo Sapiens
QSEYIPSFL

SEQ ID NO: 915459 - protein, 9 aa, Homo Sapiens
DITDKLRQV

SEQ ID NO: 915460 - protein, 9 aa, Homo Sapiens
GPIAGQAPG

SEQ ID NO: 915461 - protein, 9 aa, Homo Sapiens
TSPGSIRFF

SEQ ID NO: 915462 - protein, 9 aa, Homo Sapiens
GQKKLASGD

SEQ ID NO: 915463 - protein, 9 aa, Homo Sapiens
EEEEEKFGP

SEQ ID NO: 915464 - protein, 9 aa, Homo Sapiens
AFLLIAIKP

SEQ ID NO: 915465 - protein, 9 aa, Homo Sapiens
LDMSLDDED

SEQ ID NO: 915466 - protein, 9 aa, Homo Sapiens
ALQEGLGGC

SEQ ID NO: 915467 - protein, 9 aa, Homo Sapiens
CYWSDMFTG

SEQ ID NO: 915468 - protein, 9 aa, Homo Sapiens
LQDNKFHHF

SEQ ID NO: 915469 - protein, 9 aa, Homo Sapiens
GLRLAETLN

SEQ ID NO: 915470 - protein, 9 aa, Homo Sapiens
AVPIREQGN

SEQ ID NO: 915471 - protein, 9 aa, Homo Sapiens
NSYSLTKNP

SEQ ID NO: 915472 - protein, 9 aa, Homo Sapiens
VPPQGCYVA

SEQ ID NO: 915473 - protein, 9 aa, Homo Sapiens
EKLARMLRE

SEQ ID NO: 915474 - protein, 9 aa, Homo Sapiens
PMMLKESRQ

SEQ ID NO: 915475 - protein, 9 aa, Homo Sapiens
VASSDHLSC

SEQ ID NO: 915476 - protein, 9 aa, Homo Sapiens
NNVLRLGDK

SEQ ID NO: 915477 - protein, 9 aa, Homo Sapiens
HVNCSNFPQ

SEQ ID NO: 915478 - protein, 9 aa, Homo Sapiens
AVVGFAIFL

SEQ ID NO: 915479 - protein, 9 aa, Homo Sapiens
LKVEILRNA

SEQ ID NO: 915480 - protein, 9 aa, Homo Sapiens
LQLIQEGFK

SEQ ID NO: 915481 - protein, 9 aa, Homo Sapiens
NVLRLGDKY

SEQ ID NO: 915482 - protein, 9 aa, Homo Sapiens
GWKPPENLA

SEQ ID NO: 915483 - protein, 9 aa, Homo Sapiens
KDIASVLDL

SEQ ID NO: 915484 - protein, 9 aa, Homo Sapiens
LTQPPPPHV

SEQ ID NO: 915485 - protein, 9 aa, Homo Sapiens
GMARTGGMM

SEQ ID NO: 915486 - protein, 9 aa, Homo Sapiens
TRLQNGRRA

SEQ ID NO: 915487 - protein, 9 aa, Homo Sapiens
LEPFSLLCT

SEQ ID NO: 915488 - protein, 9 aa, Homo Sapiens
LKKKKEDKA

SEQ ID NO: 915489 - protein, 9 aa, Homo Sapiens
YFLLLDFVP

SEQ ID NO: 915490 - protein, 9 aa, Homo Sapiens
TEKTKVKEE

SEQ ID NO: 915491 - protein, 9 aa, Homo Sapiens
SFLEIFFTN

SEQ ID NO: 915492 - protein, 9 aa, Homo Sapiens
SSGYYLQTM

SEQ ID NO: 915493 - protein, 9 aa, Homo Sapiens
QELLAIRLS

SEQ ID NO: 915494 - protein, 9 aa, Homo Sapiens
VTRSLVPEP

SEQ ID NO: 915495 - protein, 9 aa, Homo Sapiens
SCRTHWIDV

SEQ ID NO: 915496 - protein, 9 aa, Homo Sapiens
DSPKPAEVA

SEQ ID NO: 915497 - protein, 9 aa, Homo Sapiens
QEPDASPRL

SEQ ID NO: 915498 - protein, 9 aa, Homo Sapiens
SSSRVMPMT

SEQ ID NO: 915499 - protein, 9 aa, Homo Sapiens
PSQDMLFPQ

SEQ ID NO: 915500 - protein, 9 aa, Homo Sapiens
VHRLIEKRE

SEQ ID NO: 915501 - protein, 9 aa, Homo Sapiens
PPWTGEGDT

SEQ ID NO: 915502 - protein, 9 aa, Homo Sapiens
PGTGKPIQS

SEQ ID NO: 915503 - protein, 9 aa, Homo Sapiens
WIDEIKAHL

SEQ ID NO: 915504 - protein, 9 aa, Homo Sapiens
AALSDPVPT

SEQ ID NO: 915505 - protein, 9 aa, Homo Sapiens
KLTVNSGTK

SEQ ID NO: 915506 - protein, 9 aa, Homo Sapiens
LKAKGILVV

SEQ ID NO: 915507 - protein, 9 aa, Homo Sapiens
LLCTSLLSN

SEQ ID NO: 915508 - protein, 9 aa, Homo Sapiens
KIFSCAFNY

SEQ ID NO: 915509 - protein, 9 aa, Homo Sapiens
QEAAETEIP

SEQ ID NO: 915510 - protein, 9 aa, Homo Sapiens
EGFKSGFLY

SEQ ID NO: 915511 - protein, 9 aa, Homo Sapiens
EDCGKAFNR

SEQ ID NO: 915512 - protein, 9 aa, Homo Sapiens
TSSSQCLHG

SEQ ID NO: 915513 - protein, 9 aa, Homo Sapiens
TTQNLVDFY

SEQ ID NO: 915514 - protein, 9 aa, Homo Sapiens
LFGYLGNGW

SEQ ID NO: 915515 - protein, 9 aa, Homo Sapiens
ALSDPVPTA

SEQ ID NO: 915516 - protein, 9 aa, Homo Sapiens
TQARGQLEK

SEQ ID NO: 915517 - protein, 9 aa, Homo Sapiens
DLKKKKEDK

SEQ ID NO: 915518 - protein, 9 aa, Homo Sapiens
VRELYARNN

SEQ ID NO: 915519 - protein, 9 aa, Homo Sapiens
SPTSFVYGS

SEQ ID NO: 915520 - protein, 9 aa, Homo Sapiens
TVKPGNKVI

SEQ ID NO: 915521 - protein, 9 aa, Homo Sapiens
EWKNLNKDG

SEQ ID NO: 915522 - protein, 9 aa, Homo Sapiens
IVYELAIIM

SEQ ID NO: 915523 - protein, 9 aa, Homo Sapiens
SPPADGSKE

SEQ ID NO: 915524 - protein, 9 aa, Homo Sapiens
CTSLLSNVS

SEQ ID NO: 915525 - protein, 9 aa, Homo Sapiens
TGVIIQGRN

SEQ ID NO: 915526 - protein, 9 aa, Homo Sapiens
IGDDPFIFI

SEQ ID NO: 915527 - protein, 9 aa, Homo Sapiens
EVLGSFSVL

SEQ ID NO: 915528 - protein, 9 aa, Homo Sapiens
RLLQVILNC

SEQ ID NO: 915529 - protein, 9 aa, Homo Sapiens
SNDSPASAF

SEQ ID NO: 915530 - protein, 9 aa, Homo Sapiens
FWSKDMAPY

SEQ ID NO: 915531 - protein, 9 aa, Homo Sapiens
AQSNEEVIQ

SEQ ID NO: 915532 - protein, 9 aa, Homo Sapiens
FSLGSSESS

SEQ ID NO: 915533 - protein, 9 aa, Homo Sapiens
GFAIFLSSM

SEQ ID NO: 915534 - protein, 9 aa, Homo Sapiens
LVAKRHFVQ

SEQ ID NO: 915535 - protein, 9 aa, Homo Sapiens
LPVPPTGDA

SEQ ID NO: 915536 - protein, 9 aa, Homo Sapiens
VLKYLPGPC

SEQ ID NO: 915537 - protein, 9 aa, Homo Sapiens
GIVWQETKD

SEQ ID NO: 915538 - protein, 9 aa, Homo Sapiens
GSGAPEGTP

SEQ ID NO: 915539 - protein, 9 aa, Homo Sapiens
QKEWALLDP

SEQ ID NO: 915540 - protein, 9 aa, Homo Sapiens
SSDSEVANS

SEQ ID NO: 915541 - protein, 9 aa, Homo Sapiens
VGFAIFLSS

SEQ ID NO: 915542 - protein, 9 aa, Homo Sapiens
SQVPCRLPR

SEQ ID NO: 915543 - protein, 9 aa, Homo Sapiens
ERSISTLKF

SEQ ID NO: 915544 - protein, 9 aa, Homo Sapiens
TGETPNKCE

SEQ ID NO: 915545 - protein, 9 aa, Homo Sapiens
TAIQSLLSS

SEQ ID NO: 915546 - protein, 9 aa, Homo Sapiens
PILNPLDSW

SEQ ID NO: 915547 - protein, 9 aa, Homo Sapiens
RQRQNVIGL

SEQ ID NO: 915548 - protein, 9 aa, Homo Sapiens
PKPILPQQK

SEQ ID NO: 915549 - protein, 9 aa, Homo Sapiens
IPPTPFFLS

SEQ ID NO: 915550 - protein, 9 aa, Homo Sapiens
MYMVPAGFS

SEQ ID NO: 915551 - protein, 9 aa, Homo Sapiens
GEGKGSTND

SEQ ID NO: 915552 - protein, 9 aa, Homo Sapiens
VAMTRDGVN

SEQ ID NO: 915553 - protein, 9 aa, Homo Sapiens
NSPSSDERR

SEQ ID NO: 915554 - protein, 9 aa, Homo Sapiens
NASVPRGFS

SEQ ID NO: 915555 - protein, 9 aa, Homo Sapiens
VRGQFQDNP

SEQ ID NO: 915556 - protein, 9 aa, Homo Sapiens
GNNVLRLGD

SEQ ID NO: 915557 - protein, 9 aa, Homo Sapiens
ASSKTANLV

SEQ ID NO: 915558 - protein, 9 aa, Homo Sapiens
REDLKKKKE

SEQ ID NO: 915559 - protein, 9 aa, Homo Sapiens
IKRKFGFYS

SEQ ID NO: 915560 - protein, 9 aa, Homo Sapiens
PGQPDNWQG

SEQ ID NO: 915561 - protein, 9 aa, Homo Sapiens
SPSTKSNGH

SEQ ID NO: 915562 - protein, 9 aa, Homo Sapiens
NPNEDKAIS

SEQ ID NO: 915563 - protein, 9 aa, Homo Sapiens
QSDSDSGAE

SEQ ID NO: 915564 - protein, 9 aa, Homo Sapiens
IGMGIVKKI

SEQ ID NO: 915565 - protein, 9 aa, Homo Sapiens
KGDCGPGKP

SEQ ID NO: 915566 - protein, 9 aa, Homo Sapiens
QVDPETKQE

SEQ ID NO: 915567 - protein, 9 aa, Homo Sapiens
IEFCYKFRS

SEQ ID NO: 915568 - protein, 9 aa, Homo Sapiens
SRELLDERK

SEQ ID NO: 915569 - protein, 9 aa, Homo Sapiens
SSDHLSCLR

SEQ ID NO: 915570 - protein, 9 aa, Homo Sapiens
GFLLLEWYG

SEQ ID NO: 915571 - protein, 9 aa, Homo Sapiens
FRPLMNFSH

SEQ ID NO: 915572 - protein, 9 aa, Homo Sapiens
FRRSDPVNP

SEQ ID NO: 915573 - protein, 9 aa, Homo Sapiens
PMLSRDGGL

SEQ ID NO: 915574 - protein, 9 aa, Homo Sapiens
ASPAVPAHG

SEQ ID NO: 915575 - protein, 9 aa, Homo Sapiens
SLNEELNFL

SEQ ID NO: 915576 - protein, 9 aa, Homo Sapiens
KNIARMTHA

SEQ ID NO: 915577 - protein, 9 aa, Homo Sapiens
AVLKPSHCK

SEQ ID NO: 915578 - protein, 9 aa, Homo Sapiens
SKFQSRRRF

SEQ ID NO: 915579 - protein, 9 aa, Homo Sapiens
SPGTGTLTE

SEQ ID NO: 915580 - protein, 9 aa, Homo Sapiens
EWLILPADN

SEQ ID NO: 915581 - protein, 9 aa, Homo Sapiens
LVTLFPPSS

SEQ ID NO: 915582 - protein, 9 aa, Homo Sapiens
ALMKMRHPN

SEQ ID NO: 915583 - protein, 9 aa, Homo Sapiens
TETDKDIAS

SEQ ID NO: 915584 - protein, 9 aa, Homo Sapiens
TDRSGARPC

SEQ ID NO: 915585 - protein, 9 aa, Homo Sapiens
ITPLPDGQI

SEQ ID NO: 915586 - protein, 9 aa, Homo Sapiens
LQIAVILKN

SEQ ID NO: 915587 - protein, 9 aa, Homo Sapiens
QTFGVSSSC

SEQ ID NO: 915588 - protein, 9 aa, Homo Sapiens
RNSHLAELD

SEQ ID NO: 915589 - protein, 9 aa, Homo Sapiens
RQRALPAVW

SEQ ID NO: 915590 - protein, 9 aa, Homo Sapiens
LKPPFFDGV

SEQ ID NO: 915591 - protein, 9 aa, Homo Sapiens
MNRPCETLE

SEQ ID NO: 915592 - protein, 9 aa, Homo Sapiens
DETGNYLLL

SEQ ID NO: 915593 - protein, 9 aa, Homo Sapiens
LGCLLLVLM

SEQ ID NO: 915594 - protein, 9 aa, Homo Sapiens
YDLGGRFGD

SEQ ID NO: 915595 - protein, 9 aa, Homo Sapiens
TKSSTTEGR

SEQ ID NO: 915596 - protein, 9 aa, Homo Sapiens
NLKSLLFLV

SEQ ID NO: 915597 - protein, 9 aa, Homo Sapiens
SYPRGIVVD

SEQ ID NO: 915598 - protein, 9 aa, Homo Sapiens
TLLSNLVAS

SEQ ID NO: 915599 - protein, 9 aa, Homo Sapiens
IKILSSEEF

SEQ ID NO: 915600 - protein, 9 aa, Homo Sapiens
PMIGLVSIL

SEQ ID NO: 915601 - protein, 9 aa, Homo Sapiens
SKSSTPENV

SEQ ID NO: 915602 - protein, 9 aa, Homo Sapiens
PFQAANVWP

SEQ ID NO: 915603 - protein, 9 aa, Homo Sapiens
FLENRQKQF

SEQ ID NO: 915604 - protein, 9 aa, Homo Sapiens
HPFPNETNL

SEQ ID NO: 915605 - protein, 9 aa, Homo Sapiens
NYENEEKVS

SEQ ID NO: 915606 - protein, 9 aa, Homo Sapiens
YPENEIGGQ

SEQ ID NO: 915607 - protein, 9 aa, Homo Sapiens
SLPFQAANV

SEQ ID NO: 915608 - protein, 9 aa, Homo Sapiens
ETHGAGFFI

SEQ ID NO: 915609 - protein, 9 aa, Homo Sapiens
SPRGSSSAT

SEQ ID NO: 915610 - protein, 9 aa, Homo Sapiens
MEQLRNCDD

SEQ ID NO: 915611 - protein, 9 aa, Homo Sapiens
RPGFSEPLL

SEQ ID NO: 915612 - protein, 9 aa, Homo Sapiens
EDVFYNSRV

SEQ ID NO: 915613 - protein, 9 aa, Homo Sapiens
AVDFSQKEW

SEQ ID NO: 915614 - protein, 9 aa, Homo Sapiens
QEKEPWMVE

SEQ ID NO: 915615 - protein, 9 aa, Homo Sapiens
TDKIIHATQ

SEQ ID NO: 915616 - protein, 9 aa, Homo Sapiens
STDLKFDRV

SEQ ID NO: 915617 - protein, 9 aa, Homo Sapiens
GSSKFQSRR

SEQ ID NO: 915618 - protein, 9 aa, Homo Sapiens
RLETEMKSY

SEQ ID NO: 915619 - protein, 9 aa, Homo Sapiens
FQDNPAYLL

SEQ ID NO: 915620 - protein, 9 aa, Homo Sapiens
KKPKTLSLT

SEQ ID NO: 915621 - protein, 9 aa, Homo Sapiens
EQELKGSFI

SEQ ID NO: 915622 - protein, 9 aa, Homo Sapiens
GKAVDLGQM

SEQ ID NO: 915623 - protein, 9 aa, Homo Sapiens
KKLMTESSL

SEQ ID NO: 915624 - protein, 9 aa, Homo Sapiens
ACMTLTVSP

SEQ ID NO: 915625 - protein, 9 aa, Homo Sapiens
TEKNLTYLQ

SEQ ID NO: 915626 - protein, 9 aa, Homo Sapiens
KQTESCFMA

SEQ ID NO: 915627 - protein, 9 aa, Homo Sapiens
QILIASHLS

SEQ ID NO: 915628 - protein, 9 aa, Homo Sapiens
GAFSEFGDL

SEQ ID NO: 915629 - protein, 9 aa, Homo Sapiens
RNQLQGMLY

SEQ ID NO: 915630 - protein, 9 aa, Homo Sapiens
YHDYHQYFS

SEQ ID NO: 915631 - protein, 9 aa, Homo Sapiens
KAQSNEEVI

SEQ ID NO: 915632 - protein, 9 aa, Homo Sapiens
PASFLPPSE

SEQ ID NO: 915633 - protein, 9 aa, Homo Sapiens
FLSSTIILV

SEQ ID NO: 915634 - protein, 9 aa, Homo Sapiens
SFVGKLGWE

SEQ ID NO: 915635 - protein, 9 aa, Homo Sapiens
YTGEKPYEC

SEQ ID NO: 915636 - protein, 9 aa, Homo Sapiens
SYQPAVTAQ

SEQ ID NO: 915637 - protein, 9 aa, Homo Sapiens
QALAKEFAK

SEQ ID NO: 915638 - protein, 9 aa, Homo Sapiens
VQSKVTKKY

SEQ ID NO: 915639 - protein, 9 aa, Homo Sapiens
ETGLNVPRN

SEQ ID NO: 915640 - protein, 9 aa, Homo Sapiens
EGQMFWKTG

SEQ ID NO: 915641 - protein, 9 aa, Homo Sapiens
KNLSFEEGN

SEQ ID NO: 915642 - protein, 9 aa, Homo Sapiens
CSECGKSFY

SEQ ID NO: 915643 - protein, 9 aa, Homo Sapiens
TNEPGLDNP

SEQ ID NO: 915644 - protein, 9 aa, Homo Sapiens
STTIQEELY

SEQ ID NO: 915645 - protein, 9 aa, Homo Sapiens
NFLESLGQG

SEQ ID NO: 915646 - protein, 9 aa, Homo Sapiens
QNGRRAGVK

SEQ ID NO: 915647 - protein, 9 aa, Homo Sapiens
TNDEAEDGR

SEQ ID NO: 915648 - protein, 9 aa, Homo Sapiens
LIKRKFGFY

SEQ ID NO: 915649 - protein, 9 aa, Homo Sapiens
EQMLRDELV

SEQ ID NO: 915650 - protein, 9 aa, Homo Sapiens
PGIPVFRSP

SEQ ID NO: 915651 - protein, 9 aa, Homo Sapiens
RSERSISTL

SEQ ID NO: 915652 - protein, 9 aa, Homo Sapiens
REREKDREL

SEQ ID NO: 915653 - protein, 9 aa, Homo Sapiens
TSQLKAEKG

SEQ ID NO: 915654 - protein, 9 aa, Homo Sapiens
EGAEALLLA

SEQ ID NO: 915655 - protein, 9 aa, Homo Sapiens
ESPGAQGPP

SEQ ID NO: 915656 - protein, 9 aa, Homo Sapiens
NFSHIYFKK

SEQ ID NO: 915657 - protein, 9 aa, Homo Sapiens
CRGDKEKTM

SEQ ID NO: 915658 - protein, 9 aa, Homo Sapiens
SVGMHGEHF

SEQ ID NO: 915659 - protein, 9 aa, Homo Sapiens
FLLPGDYSH

SEQ ID NO: 915660 - protein, 9 aa, Homo Sapiens
SALEGAEAL

SEQ ID NO: 915661 - protein, 9 aa, Homo Sapiens
GPCRTCSRS

SEQ ID NO: 915662 - protein, 9 aa, Homo Sapiens
RFSAQRSER

SEQ ID NO: 915663 - protein, 9 aa, Homo Sapiens
DDPFGPAGS

SEQ ID NO: 915664 - protein, 9 aa, Homo Sapiens
LDDEDSKIQ

SEQ ID NO: 915665 - protein, 9 aa, Homo Sapiens
LDLCGNQLQ

SEQ ID NO: 915666 - protein, 9 aa, Homo Sapiens
ALAKEFAKI

SEQ ID NO: 915667 - protein, 9 aa, Homo Sapiens
IKKSYWKLA

SEQ ID NO: 915668 - protein, 9 aa, Homo Sapiens
RLEKVSFLQ

SEQ ID NO: 915669 - protein, 9 aa, Homo Sapiens
AERPFLEED

SEQ ID NO: 915670 - protein, 9 aa, Homo Sapiens
IIKRRRKSC

SEQ ID NO: 915671 - protein, 9 aa, Homo Sapiens
RIEDPFLLN

SEQ ID NO: 915672 - protein, 9 aa, Homo Sapiens
LTSMAYDCY

SEQ ID NO: 915673 - protein, 9 aa, Homo Sapiens
GTSISQVPC

SEQ ID NO: 915674 - protein, 9 aa, Homo Sapiens
ITDKLRQVT

SEQ ID NO: 915675 - protein, 9 aa, Homo Sapiens
GIPVFRSPA

SEQ ID NO: 915676 - protein, 9 aa, Homo Sapiens
FAFPASPVC

SEQ ID NO: 915677 - protein, 9 aa, Homo Sapiens
VSWKRPLFL

SEQ ID NO: 915678 - protein, 9 aa, Homo Sapiens
RSLVPEPAI

SEQ ID NO: 915679 - protein, 9 aa, Homo Sapiens
FQFSLKNIA

SEQ ID NO: 915680 - protein, 9 aa, Homo Sapiens
LNVFELKRL

SEQ ID NO: 915681 - protein, 9 aa, Homo Sapiens
ELQKVVRKA

SEQ ID NO: 915682 - protein, 9 aa, Homo Sapiens
QSNEEVIQL

SEQ ID NO: 915683 - protein, 9 aa, Homo Sapiens
GPPDLRGDP

SEQ ID NO: 915684 - protein, 9 aa, Homo Sapiens
SNGHHQYKD

SEQ ID NO: 915685 - protein, 9 aa, Homo Sapiens
CEVSGLCRR

SEQ ID NO: 915686 - protein, 9 aa, Homo Sapiens
NVFELKRLL

SEQ ID NO: 915687 - protein, 9 aa, Homo Sapiens
IQGRNSLWL

SEQ ID NO: 915688 - protein, 9 aa, Homo Sapiens
MLKESRQNK

SEQ ID NO: 915689 - protein, 9 aa, Homo Sapiens
VILVSLQKH

SEQ ID NO: 915690 - protein, 9 aa, Homo Sapiens
ALTNYRFYG

SEQ ID NO: 915691 - protein, 9 aa, Homo Sapiens
IFSPPACRS

SEQ ID NO: 915692 - protein, 9 aa, Homo Sapiens
KPCLGNSAP

SEQ ID NO: 915693 - protein, 9 aa, Homo Sapiens
DSHLPLERI

SEQ ID NO: 915694 - protein, 9 aa, Homo Sapiens
GILVVGSGV

SEQ ID NO: 915695 - protein, 9 aa, Homo Sapiens
MQTRASLKL

SEQ ID NO: 915696 - protein, 9 aa, Homo Sapiens
DFVTSLFAA

SEQ ID NO: 915697 - protein, 9 aa, Homo Sapiens
HVRRKDLDK

SEQ ID NO: 915698 - protein, 9 aa, Homo Sapiens
HTLFQLRQL

SEQ ID NO: 915699 - protein, 9 aa, Homo Sapiens
RKKMLPEAF

SEQ ID NO: 915700 - protein, 9 aa, Homo Sapiens
PPFLQVNFH

SEQ ID NO: 915701 - protein, 9 aa, Homo Sapiens
EAERLGVKA

SEQ ID NO: 915702 - protein, 9 aa, Homo Sapiens
LLDMSLDDE

SEQ ID NO: 915703 - protein, 9 aa, Homo Sapiens
ASSDHLSCL

SEQ ID NO: 915704 - protein, 9 aa, Homo Sapiens
RDAALSDPV

SEQ ID NO: 915705 - protein, 9 aa, Homo Sapiens
SLKNIARMT

SEQ ID NO: 915706 - protein, 9 aa, Homo Sapiens
RKIKFLVAL

SEQ ID NO: 915707 - protein, 9 aa, Homo Sapiens
GLSSVLSPG

SEQ ID NO: 915708 - protein, 9 aa, Homo Sapiens
RSDASETND

SEQ ID NO: 915709 - protein, 9 aa, Homo Sapiens
TKEMTMEQL

SEQ ID NO: 915710 - protein, 9 aa, Homo Sapiens
ETTTSSSKI

SEQ ID NO: 915711 - protein, 9 aa, Homo Sapiens
EAAETEIPV

SEQ ID NO: 915712 - protein, 9 aa, Homo Sapiens
ETACQSSLD

SEQ ID NO: 915713 - protein, 9 aa, Homo Sapiens
VVISFLVLA

SEQ ID NO: 915714 - protein, 9 aa, Homo Sapiens
PYWALFGAS

SEQ ID NO: 915715 - protein, 9 aa, Homo Sapiens
RGLTQPPPP

SEQ ID NO: 915716 - protein, 9 aa, Homo Sapiens
SGLVEKSTT

SEQ ID NO: 915717 - protein, 9 aa, Homo Sapiens
YEVAGSAAD

SEQ ID NO: 915718 - protein, 9 aa, Homo Sapiens
ASQNVIPSS

SEQ ID NO: 915719 - protein, 9 aa, Homo Sapiens
FHGKKGKID

SEQ ID NO: 915720 - protein, 9 aa, Homo Sapiens
IYTGEKPYE

SEQ ID NO: 915721 - protein, 9 aa, Homo Sapiens
LAAATEDWT

SEQ ID NO: 915722 - protein, 9 aa, Homo Sapiens
LGFTIGAIC

SEQ ID NO: 915723 - protein, 9 aa, Homo Sapiens
GTDDGVRSD

SEQ ID NO: 915724 - protein, 9 aa, Homo Sapiens
LEKVSFLQP

SEQ ID NO: 915725 - protein, 9 aa, Homo Sapiens
YNSRVILFN

SEQ ID NO: 915726 - protein, 9 aa, Homo Sapiens
KPAEVAVKT

SEQ ID NO: 915727 - protein, 9 aa, Homo Sapiens
SISALKFSK

SEQ ID NO: 915728 - protein, 9 aa, Homo Sapiens
DLRNSSHEK

SEQ ID NO: 915729 - protein, 9 aa, Homo Sapiens
SYFHHQKEV

SEQ ID NO: 915730 - protein, 9 aa, Homo Sapiens
FKYNSFFIS

SEQ ID NO: 915731 - protein, 9 aa, Homo Sapiens
SSCLSPRGS

SEQ ID NO: 915732 - protein, 9 aa, Homo Sapiens
GKSFYRSSS

SEQ ID NO: 915733 - protein, 9 aa, Homo Sapiens
DIKKSYWKL

SEQ ID NO: 915734 - protein, 9 aa, Homo Sapiens
EEQLRQRQN

SEQ ID NO: 915735 - protein, 9 aa, Homo Sapiens
NGVSDLSQS

SEQ ID NO: 915736 - protein, 9 aa, Homo Sapiens
INVHHREAS

SEQ ID NO: 915737 - protein, 9 aa, Homo Sapiens
GTHNAVNKI

SEQ ID NO: 915738 - protein, 9 aa, Homo Sapiens
FGQWNMSGN

SEQ ID NO: 915739 - protein, 9 aa, Homo Sapiens
FIRYEIFKR

SEQ ID NO: 915740 - protein, 9 aa, Homo Sapiens
FLQYVKTHL

SEQ ID NO: 915741 - protein, 9 aa, Homo Sapiens
PQEAAETEI

SEQ ID NO: 915742 - protein, 9 aa, Homo Sapiens
PKFVVMVST

SEQ ID NO: 915743 - protein, 9 aa, Homo Sapiens
YALICVTVW

SEQ ID NO: 915744 - protein, 9 aa, Homo Sapiens
LFQLRQLQD

SEQ ID NO: 915745 - protein, 9 aa, Homo Sapiens
VSRDSCYVK

SEQ ID NO: 915746 - protein, 9 aa, Homo Sapiens
DEKSQDDII

SEQ ID NO: 915747 - protein, 9 aa, Homo Sapiens
YILRTLEGI

SEQ ID NO: 915748 - protein, 9 aa, Homo Sapiens
KNESLFWKL

SEQ ID NO: 915749 - protein, 9 aa, Homo Sapiens
PTTSFATAP

SEQ ID NO: 915750 - protein, 9 aa, Homo Sapiens
GCKSGINCS

SEQ ID NO: 915751 - protein, 9 aa, Homo Sapiens
IRIVGTHNA

SEQ ID NO: 915752 - protein, 9 aa, Homo Sapiens
PAVPAHGYC

SEQ ID NO: 915753 - protein, 9 aa, Homo Sapiens
FQLRQLQDM

SEQ ID NO: 915754 - protein, 9 aa, Homo Sapiens
GGMMVITVL

SEQ ID NO: 915755 - protein, 9 aa, Homo Sapiens
IHVNCSNFP

SEQ ID NO: 915756 - protein, 9 aa, Homo Sapiens
TGNKIVNEK

SEQ ID NO: 915757 - protein, 9 aa, Homo Sapiens
PATSPGSIR

SEQ ID NO: 915758 - protein, 9 aa, Homo Sapiens
PAFASLFPS

SEQ ID NO: 915759 - protein, 9 aa, Homo Sapiens
LNVPRNQLQ

SEQ ID NO: 915760 - protein, 9 aa, Homo Sapiens
QLARPGFSE

SEQ ID NO: 915761 - protein, 9 aa, Homo Sapiens
LRVTRSLVP

SEQ ID NO: 915762 - protein, 9 aa, Homo Sapiens
NKKIDGKAG

SEQ ID NO: 915763 - protein, 9 aa, Homo Sapiens
QERANSTIT

SEQ ID NO: 915764 - protein, 9 aa, Homo Sapiens
LFMIEEEIR

SEQ ID NO: 915765 - protein, 9 aa, Homo Sapiens
SSPVIQLPK

SEQ ID NO: 915766 - protein, 9 aa, Homo Sapiens
KGILVVGSG

SEQ ID NO: 915767 - protein, 9 aa, Homo Sapiens
THMLQSFIN

SEQ ID NO: 915768 - protein, 9 aa, Homo Sapiens
DGSISALKF

SEQ ID NO: 915769 - protein, 9 aa, Homo Sapiens
EKAITALRQ

SEQ ID NO: 915770 - protein, 9 aa, Homo Sapiens
LILPADNQK

SEQ ID NO: 915771 - protein, 9 aa, Homo Sapiens
YKYSSDISY

SEQ ID NO: 915772 - protein, 9 aa, Homo Sapiens
LQVPKLDEH

SEQ ID NO: 915773 - protein, 9 aa, Homo Sapiens
AETEIPVAP

SEQ ID NO: 915774 - protein, 9 aa, Homo Sapiens
SMLKQFSNS

SEQ ID NO: 915775 - protein, 9 aa, Homo Sapiens
YYGMPAWKV

SEQ ID NO: 915776 - protein, 9 aa, Homo Sapiens
RGFSFHSSE

SEQ ID NO: 915777 - protein, 9 aa, Homo Sapiens
NRSKNKARY

SEQ ID NO: 915778 - protein, 9 aa, Homo Sapiens
AWPTLLRTV

SEQ ID NO: 915779 - protein, 9 aa, Homo Sapiens
GALHQAKEK

SEQ ID NO: 915780 - protein, 9 aa, Homo Sapiens
TPILVSSSG

SEQ ID NO: 915781 - protein, 9 aa, Homo Sapiens
ERIAKEIQG

SEQ ID NO: 915782 - protein, 9 aa, Homo Sapiens
TVPGVRNYE

SEQ ID NO: 915783 - protein, 9 aa, Homo Sapiens
IGLRGMAFC

SEQ ID NO: 915784 - protein, 9 aa, Homo Sapiens
PLCEPNLWM

SEQ ID NO: 915785 - protein, 9 aa, Homo Sapiens
PEAVASLHW

SEQ ID NO: 915786 - protein, 9 aa, Homo Sapiens
DDNFYAYDE

SEQ ID NO: 915787 - protein, 9 aa, Homo Sapiens
FQPGFISPR

SEQ ID NO: 915788 - protein, 9 aa, Homo Sapiens
SELDPEGSK

SEQ ID NO: 915789 - protein, 9 aa, Homo Sapiens
EALRHHTLF

SEQ ID NO: 915790 - protein, 9 aa, Homo Sapiens
VTTVKPGNK

SEQ ID NO: 915791 - protein, 9 aa, Homo Sapiens
QIAVILKNL

SEQ ID NO: 915792 - protein, 9 aa, Homo Sapiens
ARPGFSEPL

SEQ ID NO: 915793 - protein, 9 aa, Homo Sapiens
VLSPSCLYA

SEQ ID NO: 915794 - protein, 9 aa, Homo Sapiens
PLHLISVRR

SEQ ID NO: 915795 - protein, 9 aa, Homo Sapiens
DIESDAKSK

SEQ ID NO: 915796 - protein, 9 aa, Homo Sapiens
YNMERIRLQ

SEQ ID NO: 915797 - protein, 9 aa, Homo Sapiens
NFYDVQRLL

SEQ ID NO: 915798 - protein, 9 aa, Homo Sapiens
PVFRSPACQ

SEQ ID NO: 915799 - protein, 9 aa, Homo Sapiens
PWLKGNILG

SEQ ID NO: 915800 - protein, 9 aa, Homo Sapiens
VYSCITMNK

SEQ ID NO: 915801 - protein, 9 aa, Homo Sapiens
THNAVNKIF

SEQ ID NO: 915802 - protein, 9 aa, Homo Sapiens
KIGILITDE

SEQ ID NO: 915803 - protein, 9 aa, Homo Sapiens
QELPRLLAR

SEQ ID NO: 915804 - protein, 9 aa, Homo Sapiens
GPEEDGTFN

SEQ ID NO: 915805 - protein, 9 aa, Homo Sapiens
LGERVAQRD

SEQ ID NO: 915806 - protein, 9 aa, Homo Sapiens
DAAPYQGWE

SEQ ID NO: 915807 - protein, 9 aa, Homo Sapiens
LLEALVLFL

SEQ ID NO: 915808 - protein, 9 aa, Homo Sapiens
TSSSKIFVK

SEQ ID NO: 915809 - protein, 9 aa, Homo Sapiens
SFGLLALGA

SEQ ID NO: 915810 - protein, 9 aa, Homo Sapiens
VPCRLPRGL

SEQ ID NO: 915811 - protein, 9 aa, Homo Sapiens
APSVTDKII

SEQ ID NO: 915812 - protein, 9 aa, Homo Sapiens
SWKRPLFLV

SEQ ID NO: 915813 - protein, 9 aa, Homo Sapiens
SGAIVAMTR

SEQ ID NO: 915814 - protein, 9 aa, Homo Sapiens
LDSPTFSPG

SEQ ID NO: 915815 - protein, 9 aa, Homo Sapiens
FYLWIKIHP

SEQ ID NO: 915816 - protein, 9 aa, Homo Sapiens
YIASLPFQA

SEQ ID NO: 915817 - protein, 9 aa, Homo Sapiens
KEEDVSQAI

SEQ ID NO: 915818 - protein, 9 aa, Homo Sapiens
GDDPFIFIT

SEQ ID NO: 915819 - protein, 9 aa, Homo Sapiens
SILKGGRFY

SEQ ID NO: 915820 - protein, 9 aa, Homo Sapiens
EEVIQLSPD

SEQ ID NO: 915821 - protein, 9 aa, Homo Sapiens
GTFNLPFQF

SEQ ID NO: 915822 - protein, 9 aa, Homo Sapiens
LSPSCLYAG

SEQ ID NO: 915823 - protein, 9 aa, Homo Sapiens
LSSYELRHN

SEQ ID NO: 915824 - protein, 9 aa, Homo Sapiens
RPLMNFSHI

SEQ ID NO: 915825 - protein, 9 aa, Homo Sapiens
FGLLALGAL

SEQ ID NO: 915826 - protein, 9 aa, Homo Sapiens
RSKNKARYR

SEQ ID NO: 915827 - protein, 9 aa, Homo Sapiens
KSAKAGQSD

SEQ ID NO: 915828 - protein, 9 aa, Homo Sapiens
VGGSGAPEG

SEQ ID NO: 915829 - protein, 9 aa, Homo Sapiens
KQEITRLKA

SEQ ID NO: 915830 - protein, 9 aa, Homo Sapiens
KSDSYLQLH

SEQ ID NO: 915831 - protein, 9 aa, Homo Sapiens
NIRESSKSQ

SEQ ID NO: 915832 - protein, 9 aa, Homo Sapiens
HPPPTTPIL

SEQ ID NO: 915833 - protein, 9 aa, Homo Sapiens
PFRNSVDSG

SEQ ID NO: 915834 - protein, 9 aa, Homo Sapiens
GRERWNHVI

SEQ ID NO: 915835 - protein, 9 aa, Homo Sapiens
GVSDLSQSQ

SEQ ID NO: 915836 - protein, 9 aa, Homo Sapiens
FYHPSAVRL

SEQ ID NO: 915837 - protein, 9 aa, Homo Sapiens
KNSVSVRIV

SEQ ID NO: 915838 - protein, 9 aa, Homo Sapiens
RLQEAEGDL

SEQ ID NO: 915839 - protein, 9 aa, Homo Sapiens
QLEKIMANT

SEQ ID NO: 915840 - protein, 9 aa, Homo Sapiens
SFLPPSESF

SEQ ID NO: 915841 - protein, 9 aa, Homo Sapiens
SHSKGVVIS

SEQ ID NO: 915842 - protein, 9 aa, Homo Sapiens
SKIFVKIFF

SEQ ID NO: 915843 - protein, 9 aa, Homo Sapiens
FRIYVSIDV

SEQ ID NO: 915844 - protein, 9 aa, Homo Sapiens
VYHAAIVVF

SEQ ID NO: 915845 - protein, 9 aa, Homo Sapiens
CGKSFYRSS

SEQ ID NO: 915846 - protein, 9 aa, Homo Sapiens
VNGVSDLSQ

SEQ ID NO: 915847 - protein, 9 aa, Homo Sapiens
NQRLLKVEI

SEQ ID NO: 915848 - protein, 9 aa, Homo Sapiens
LQIIKANYH

SEQ ID NO: 915849 - protein, 9 aa, Homo Sapiens
NLLQDNKFH

SEQ ID NO: 915850 - protein, 9 aa, Homo Sapiens
DHFCSFENQ

SEQ ID NO: 915851 - protein, 9 aa, Homo Sapiens
PLPKVIFTL

SEQ ID NO: 915852 - protein, 9 aa, Homo Sapiens
DNKFHHFKP

SEQ ID NO: 915853 - protein, 9 aa, Homo Sapiens
VSSELDPEG

SEQ ID NO: 915854 - protein, 9 aa, Homo Sapiens
DRETQSVHH

SEQ ID NO: 915855 - protein, 9 aa, Homo Sapiens
SNPATSPGS

SEQ ID NO: 915856 - protein, 9 aa, Homo Sapiens
GGRSDMDWE

SEQ ID NO: 915857 - protein, 9 aa, Homo Sapiens
LSLPRKGGA

SEQ ID NO: 915858 - protein, 9 aa, Homo Sapiens
TNFYDVQRL

SEQ ID NO: 915859 - protein, 9 aa, Homo Sapiens
LATIPPTVV

SEQ ID NO: 915860 - protein, 9 aa, Homo Sapiens
FWVFQSILV

SEQ ID NO: 915861 - protein, 9 aa, Homo Sapiens
DPKPILPQQ

SEQ ID NO: 915862 - protein, 9 aa, Homo Sapiens
RDDNFYAYD

SEQ ID NO: 915863 - protein, 9 aa, Homo Sapiens
PSCSGGGGE

SEQ ID NO: 915864 - protein, 9 aa, Homo Sapiens
DHLSCLRRA

SEQ ID NO: 915865 - protein, 9 aa, Homo Sapiens
IEAFGFSDI

SEQ ID NO: 915866 - protein, 9 aa, Homo Sapiens
LIFFLFIEV

SEQ ID NO: 915867 - protein, 9 aa, Homo Sapiens
QPKATPLVT

SEQ ID NO: 915868 - protein, 9 aa, Homo Sapiens
TSTPTFNIL

SEQ ID NO: 915869 - protein, 9 aa, Homo Sapiens
PRLRVTRSL

SEQ ID NO: 915870 - protein, 9 aa, Homo Sapiens
VEERKIKFL

SEQ ID NO: 915871 - protein, 9 aa, Homo Sapiens
TVFPIQYLF

SEQ ID NO: 915872 - protein, 9 aa, Homo Sapiens
DPETKQEIT

SEQ ID NO: 915873 - protein, 9 aa, Homo Sapiens
FIPRVLRLQ

SEQ ID NO: 915874 - protein, 9 aa, Homo Sapiens
VLQIAVILK

SEQ ID NO: 915875 - protein, 9 aa, Homo Sapiens
HVNGSRPPW

SEQ ID NO: 915876 - protein, 9 aa, Homo Sapiens
KAVKILAQE

SEQ ID NO: 915877 - protein, 9 aa, Homo Sapiens
SVSVLEDIL

SEQ ID NO: 915878 - protein, 9 aa, Homo Sapiens
ELLAIRLSR

SEQ ID NO: 915879 - protein, 9 aa, Homo Sapiens
LAEPHLLPC

SEQ ID NO: 915880 - protein, 9 aa, Homo Sapiens
STVNLVCYA

SEQ ID NO: 915881 - protein, 9 aa, Homo Sapiens
EQIDFLPFV

SEQ ID NO: 915882 - protein, 9 aa, Homo Sapiens
TSLLSNVSQ

SEQ ID NO: 915883 - protein, 9 aa, Homo Sapiens
LFLDFSDKE

SEQ ID NO: 915884 - protein, 9 aa, Homo Sapiens
LVKNLLKDG

SEQ ID NO: 915885 - protein, 9 aa, Homo Sapiens
MNSNFVPVN

SEQ ID NO: 915886 - protein, 9 aa, Homo Sapiens
QSFIHTAAS

SEQ ID NO: 915887 - protein, 9 aa, Homo Sapiens
IDHHVFSAN

SEQ ID NO: 915888 - protein, 9 aa, Homo Sapiens
PCFSSPNVI

SEQ ID NO: 915889 - protein, 9 aa, Homo Sapiens
LTFAFPASP

SEQ ID NO: 915890 - protein, 9 aa, Homo Sapiens
RNNSIFSAR

SEQ ID NO: 915891 - protein, 9 aa, Homo Sapiens
SSKFQSRRR

SEQ ID NO: 915892 - protein, 9 aa, Homo Sapiens
TGTLTEKKS

SEQ ID NO: 915893 - protein, 9 aa, Homo Sapiens
MLNQEHKSQ

SEQ ID NO: 915894 - protein, 9 aa, Homo Sapiens
QFLGYDQHG

SEQ ID NO: 915895 - protein, 9 aa, Homo Sapiens
SVEDFQRGN

SEQ ID NO: 915896 - protein, 9 aa, Homo Sapiens
LPPFLQVNF

SEQ ID NO: 915897 - protein, 9 aa, Homo Sapiens
NTILSKFSL

SEQ ID NO: 915898 - protein, 9 aa, Homo Sapiens
ALNTGDDFV

SEQ ID NO: 915899 - protein, 9 aa, Homo Sapiens
QMLATIPPT

SEQ ID NO: 915900 - protein, 9 aa, Homo Sapiens
DIILNQRNC

SEQ ID NO: 915901 - protein, 9 aa, Homo Sapiens
FSQKEWALL

SEQ ID NO: 915902 - protein, 9 aa, Homo Sapiens
IPGSEQWKF

SEQ ID NO: 915903 - protein, 9 aa, Homo Sapiens
KRWPLLNDE

SEQ ID NO: 915904 - protein, 9 aa, Homo Sapiens
KSYWKLALK

SEQ ID NO: 915905 - protein, 9 aa, Homo Sapiens
TQSVHHLVL

SEQ ID NO: 915906 - protein, 9 aa, Homo Sapiens
MYFLLLDFV

SEQ ID NO: 915907 - protein, 9 aa, Homo Sapiens
RGTTASSKG

SEQ ID NO: 915908 - protein, 9 aa, Homo Sapiens
ALWFLICKQ

SEQ ID NO: 915909 - protein, 9 aa, Homo Sapiens
KVSLEAFFV

SEQ ID NO: 915910 - protein, 9 aa, Homo Sapiens
LLNTLFFFN

SEQ ID NO: 915911 - protein, 9 aa, Homo Sapiens
CQSSLDYQY

SEQ ID NO: 915912 - protein, 9 aa, Homo Sapiens
PDHPLHLIS

SEQ ID NO: 915913 - protein, 9 aa, Homo Sapiens
DKVPQQTVA

SEQ ID NO: 915914 - protein, 9 aa, Homo Sapiens
KIFVKIFFQ

SEQ ID NO: 915915 - protein, 9 aa, Homo Sapiens
DLITSSSQC

SEQ ID NO: 915916 - protein, 9 aa, Homo Sapiens
RAERPFLEE

SEQ ID NO: 915917 - protein, 9 aa, Homo Sapiens
GMMVITVLL

SEQ ID NO: 915918 - protein, 9 aa, Homo Sapiens
PPSSASPSI

SEQ ID NO: 915919 - protein, 9 aa, Homo Sapiens
LRCSAPPTK

SEQ ID NO: 915920 - protein, 9 aa, Homo Sapiens
IRDGELQYY

SEQ ID NO: 915921 - protein, 9 aa, Homo Sapiens
EGDLGRRGT

SEQ ID NO: 915922 - protein, 9 aa, Homo Sapiens
PASPDSLKG

SEQ ID NO: 915923 - protein, 9 aa, Homo Sapiens
SGGFIFSPS

SEQ ID NO: 915924 - protein, 9 aa, Homo Sapiens
KRPHELVNR

SEQ ID NO: 915925 - protein, 9 aa, Homo Sapiens
GLDPNAMYF

SEQ ID NO: 915926 - protein, 9 aa, Homo Sapiens
LEGAEALLL

SEQ ID NO: 915927 - protein, 9 aa, Homo Sapiens
CLGKFDKPL

SEQ ID NO: 915928 - protein, 9 aa, Homo Sapiens
SVDGVRAFL

SEQ ID NO: 915929 - protein, 9 aa, Homo Sapiens
FFTNIFIPR

SEQ ID NO: 915930 - protein, 9 aa, Homo Sapiens
HLWGHKRIH

SEQ ID NO: 915931 - protein, 9 aa, Homo Sapiens
SSKIFVKIF

SEQ ID NO: 915932 - protein, 9 aa, Homo Sapiens
DIDIILNQR

SEQ ID NO: 915933 - protein, 9 aa, Homo Sapiens
PKPAEVAVK

SEQ ID NO: 915934 - protein, 9 aa, Homo Sapiens
FFAPADIPV

SEQ ID NO: 915935 - protein, 9 aa, Homo Sapiens
PDNWQGHGL

SEQ ID NO: 915936 - protein, 9 aa, Homo Sapiens
PESPRVLSP

SEQ ID NO: 915937 - protein, 9 aa, Homo Sapiens
NEIGGQVAP

SEQ ID NO: 915938 - protein, 9 aa, Homo Sapiens
YWSDMFTGR

SEQ ID NO: 915939 - protein, 9 aa, Homo Sapiens
LELSHVAGM

SEQ ID NO: 915940 - protein, 9 aa, Homo Sapiens
TRGPPPTPL

SEQ ID NO: 915941 - protein, 9 aa, Homo Sapiens
EDGTFNLPF

SEQ ID NO: 915942 - protein, 9 aa, Homo Sapiens
DIASVLDLK

SEQ ID NO: 915943 - protein, 9 aa, Homo Sapiens
AIVVFLEFF

SEQ ID NO: 915944 - protein, 9 aa, Homo Sapiens
IESDAKSKT

SEQ ID NO: 915945 - protein, 9 aa, Homo Sapiens
LKGSSETET

SEQ ID NO: 915946 - protein, 9 aa, Homo Sapiens
MLREDLKKK

SEQ ID NO: 915947 - protein, 9 aa, Homo Sapiens
IMGAICAQL

SEQ ID NO: 915948 - protein, 9 aa, Homo Sapiens
FKVDSSSRE

SEQ ID NO: 915949 - protein, 9 aa, Homo Sapiens
KPGQPDNWQ

SEQ ID NO: 915950 - protein, 9 aa, Homo Sapiens
TDSIITGTV

SEQ ID NO: 915951 - protein, 9 aa, Homo Sapiens
AMYFLLLDF

SEQ ID NO: 915952 - protein, 9 aa, Homo Sapiens
NLLQQVGGV

SEQ ID NO: 915953 - protein, 9 aa, Homo Sapiens
TMNKQRLLN

SEQ ID NO: 915954 - protein, 9 aa, Homo Sapiens
PSSASPSIQ

SEQ ID NO: 915955 - protein, 9 aa, Homo Sapiens
LHRGLTQPP

SEQ ID NO: 915956 - protein, 9 aa, Homo Sapiens
AKSKTQSDD

SEQ ID NO: 915957 - protein, 9 aa, Homo Sapiens
ARTGGMMVI

SEQ ID NO: 915958 - protein, 9 aa, Homo Sapiens
PGTLGQKKL

SEQ ID NO: 915959 - protein, 9 aa, Homo Sapiens
SRLETEMKS

SEQ ID NO: 915960 - protein, 9 aa, Homo Sapiens
KAKIVTLKQ

SEQ ID NO: 915961 - protein, 9 aa, Homo Sapiens
TDKDIASVL

SEQ ID NO: 915962 - protein, 9 aa, Homo Sapiens
LEYLQANFN

SEQ ID NO: 915963 - protein, 9 aa, Homo Sapiens
LWLLIKRKF

SEQ ID NO: 915964 - protein, 9 aa, Homo Sapiens
ALEGAEALL

SEQ ID NO: 915965 - protein, 9 aa, Homo Sapiens
NTEKNLTYL

SEQ ID NO: 915966 - protein, 9 aa, Homo Sapiens
SSFSRSVTS

SEQ ID NO: 915967 - protein, 9 aa, Homo Sapiens
IPPVTGSSF

SEQ ID NO: 915968 - protein, 9 aa, Homo Sapiens
FFLFIEVIL

SEQ ID NO: 915969 - protein, 9 aa, Homo Sapiens
IKINIIYDL

SEQ ID NO: 915970 - protein, 9 aa, Homo Sapiens
GMGIVKKIT

SEQ ID NO: 915971 - protein, 9 aa, Homo Sapiens
KDLENKSQE

SEQ ID NO: 915972 - protein, 9 aa, Homo Sapiens
QADPKPILP

SEQ ID NO: 915973 - protein, 9 aa, Homo Sapiens
QRLLKVEIL

SEQ ID NO: 915974 - protein, 9 aa, Homo Sapiens
SGEGKGSTN

SEQ ID NO: 915975 - protein, 9 aa, Homo Sapiens
KRYIIQLTT

SEQ ID NO: 915976 - protein, 9 aa, Homo Sapiens
VPQEAAETE

SEQ ID NO: 915977 - protein, 9 aa, Homo Sapiens
SNLPNIFRI

SEQ ID NO: 915978 - protein, 9 aa, Homo Sapiens
PVPTAFWCG

SEQ ID NO: 915979 - protein, 9 aa, Homo Sapiens
LFLMAAGKS

SEQ ID NO: 915980 - protein, 9 aa, Homo Sapiens
KQQAALSAF

SEQ ID NO: 915981 - protein, 9 aa, Homo Sapiens
FFFCRLLSG

SEQ ID NO: 915982 - protein, 9 aa, Homo Sapiens
NSTVNLVCY

SEQ ID NO: 915983 - protein, 9 aa, Homo Sapiens
ENTRILFID

SEQ ID NO: 915984 - protein, 9 aa, Homo Sapiens
FKPGFEEYN

SEQ ID NO: 915985 - protein, 9 aa, Homo Sapiens
SYWKLALKY

SEQ ID NO: 915986 - protein, 9 aa, Homo Sapiens
ENLQARERM

SEQ ID NO: 915987 - protein, 9 aa, Homo Sapiens
WTLLSNLVA

SEQ ID NO: 915988 - protein, 9 aa, Homo Sapiens
KDGEIKWLR

SEQ ID NO: 915989 - protein, 9 aa, Homo Sapiens
RWPLLNDEG

SEQ ID NO: 915990 - protein, 9 aa, Homo Sapiens
GKFDKPLDM

SEQ ID NO: 915991 - protein, 9 aa, Homo Sapiens
ILSQTVVEV

SEQ ID NO: 915992 - protein, 9 aa, Homo Sapiens
VVEVLGSFS

SEQ ID NO: 915993 - protein, 9 aa, Homo Sapiens
TPWLKGNIL

SEQ ID NO: 915994 - protein, 9 aa, Homo Sapiens
FAFCDFCRK

SEQ ID NO: 915995 - protein, 9 aa, Homo Sapiens
RGSEPEKEE

SEQ ID NO: 915996 - protein, 9 aa, Homo Sapiens
YFPYLVFLH

SEQ ID NO: 915997 - protein, 9 aa, Homo Sapiens
ASVLDLKCK

SEQ ID NO: 915998 - protein, 9 aa, Homo Sapiens
IVAEAERLG

SEQ ID NO: 915999 - protein, 9 aa, Homo Sapiens
SIDWIDEIK

SEQ ID NO: 916000 - protein, 9 aa, Homo Sapiens
VAHSDFEIL

SEQ ID NO: 916001 - protein, 9 aa, Homo Sapiens
ISEESFKAH

SEQ ID NO: 916002 - protein, 9 aa, Homo Sapiens
FLICKQREI

SEQ ID NO: 916003 - protein, 9 aa, Homo Sapiens
KMITSLFCK

SEQ ID NO: 916004 - protein, 9 aa, Homo Sapiens
LLAIRLSRE

SEQ ID NO: 916005 - protein, 9 aa, Homo Sapiens
LILGVLFLL

SEQ ID NO: 916006 - protein, 9 aa, Homo Sapiens
GEKESPGAQ

SEQ ID NO: 916007 - protein, 9 aa, Homo Sapiens
TAQWITSLL

SEQ ID NO: 916008 - protein, 9 aa, Homo Sapiens
GFYLWIKIH

SEQ ID NO: 916009 - protein, 9 aa, Homo Sapiens
STKSNGHHQ

SEQ ID NO: 916010 - protein, 9 aa, Homo Sapiens
PKPPKPPKL

SEQ ID NO: 916011 - protein, 9 aa, Homo Sapiens
QGYRMEQLR

SEQ ID NO: 916012 - protein, 9 aa, Homo Sapiens
LEEEIKAER

SEQ ID NO: 916013 - protein, 9 aa, Homo Sapiens
SDIWKNLHA

SEQ ID NO: 916014 - protein, 9 aa, Homo Sapiens
LVDLITSSS

SEQ ID NO: 916015 - protein, 9 aa, Homo Sapiens
NGDPEAVAS

SEQ ID NO: 916016 - protein, 9 aa, Homo Sapiens
VQASRFCYG

SEQ ID NO: 916017 - protein, 9 aa, Homo Sapiens
SQQVIYLQG

SEQ ID NO: 916018 - protein, 9 aa, Homo Sapiens
RSISTLKFQ

SEQ ID NO: 916019 - protein, 9 aa, Homo Sapiens
LASPKSCYK

SEQ ID NO: 916020 - protein, 9 aa, Homo Sapiens
RPFLEEDPG

SEQ ID NO: 916021 - protein, 9 aa, Homo Sapiens
NLPVEGLFR

SEQ ID NO: 916022 - protein, 9 aa, Homo Sapiens
SSSKIFVKI

SEQ ID NO: 916023 - protein, 9 aa, Homo Sapiens
MGIVKKITF

SEQ ID NO: 916024 - protein, 9 aa, Homo Sapiens
ILVSLQKHS

SEQ ID NO: 916025 - protein, 9 aa, Homo Sapiens
TVKVLLIPV

SEQ ID NO: 916026 - protein, 9 aa, Homo Sapiens
MGSCRSVGM

SEQ ID NO: 916027 - protein, 9 aa, Homo Sapiens
SELKRCYWS

SEQ ID NO: 916028 - protein, 9 aa, Homo Sapiens
DINFLESLG

SEQ ID NO: 916029 - protein, 9 aa, Homo Sapiens
VIQKGAFSE

SEQ ID NO: 916030 - protein, 9 aa, Homo Sapiens
KITPLPDGQ

SEQ ID NO: 916031 - protein, 9 aa, Homo Sapiens
EVANSPSSD

SEQ ID NO: 916032 - protein, 9 aa, Homo Sapiens
EPFSLLCTS

SEQ ID NO: 916033 - protein, 9 aa, Homo Sapiens
WKTGKLVSL

SEQ ID NO: 916034 - protein, 9 aa, Homo Sapiens
TSITFKKWG

SEQ ID NO: 916035 - protein, 9 aa, Homo Sapiens
KMLPEAFLL

SEQ ID NO: 916036 - protein, 9 aa, Homo Sapiens
PALAEPHLL

SEQ ID NO: 916037 - protein, 9 aa, Homo Sapiens
HTGETPNKC

SEQ ID NO: 916038 - protein, 9 aa, Homo Sapiens
YKPCGVSTP

SEQ ID NO: 916039 - protein, 9 aa, Homo Sapiens
LMTNEPGLD

SEQ ID NO: 916040 - protein, 9 aa, Homo Sapiens
SIITGTVST

SEQ ID NO: 916041 - protein, 9 aa, Homo Sapiens
LGDKYSLRQ

SEQ ID NO: 916042 - protein, 9 aa, Homo Sapiens
IFFTNIFIP

SEQ ID NO: 916043 - protein, 9 aa, Homo Sapiens
FCPRLASAP

SEQ ID NO: 916044 - protein, 9 aa, Homo Sapiens
YRMEQLRNC

SEQ ID NO: 916045 - protein, 9 aa, Homo Sapiens
YHNIKILSS

SEQ ID NO: 916046 - protein, 9 aa, Homo Sapiens
QPDNWQGHG

SEQ ID NO: 916047 - protein, 9 aa, Homo Sapiens
FRLLLASPK

SEQ ID NO: 916048 - protein, 9 aa, Homo Sapiens
VSILKGGRF

SEQ ID NO: 916049 - protein, 9 aa, Homo Sapiens
EFLQYVKTH

SEQ ID NO: 916050 - protein, 9 aa, Homo Sapiens
EREKDWEKD

SEQ ID NO: 916051 - protein, 9 aa, Homo Sapiens
PDHPCFLLP

SEQ ID NO: 916052 - protein, 9 aa, Homo Sapiens
SEPEKEEDV

SEQ ID NO: 916053 - protein, 9 aa, Homo Sapiens
EWDAKSRGF

SEQ ID NO: 916054 - protein, 9 aa, Homo Sapiens
LLYFFSEHQ

SEQ ID NO: 916055 - protein, 9 aa, Homo Sapiens
ILVLPFTGI

SEQ ID NO: 916056 - protein, 9 aa, Homo Sapiens
KIMANTTIG

SEQ ID NO: 916057 - protein, 9 aa, Homo Sapiens
NTGDDFVTS

SEQ ID NO: 916058 - protein, 9 aa, Homo Sapiens
VGYAVTKTH

SEQ ID NO: 916059 - protein, 9 aa, Homo Sapiens
VGHCIIEIN

SEQ ID NO: 916060 - protein, 9 aa, Homo Sapiens
RDSCYVKEL

SEQ ID NO: 916061 - protein, 9 aa, Homo Sapiens
EKGERGKNS

SEQ ID NO: 916062 - protein, 9 aa, Homo Sapiens
KFRNAPRSS

SEQ ID NO: 916063 - protein, 9 aa, Homo Sapiens
LIDKQESQI

SEQ ID NO: 916064 - protein, 9 aa, Homo Sapiens
ASNRSKNKA

SEQ ID NO: 916065 - protein, 9 aa, Homo Sapiens
IGEFLENRQ

SEQ ID NO: 916066 - protein, 9 aa, Homo Sapiens
QAALSAFCY

SEQ ID NO: 916067 - protein, 9 aa, Homo Sapiens
LGSGVSDSE

SEQ ID NO: 916068 - protein, 9 aa, Homo Sapiens
KEEVKTRKP

SEQ ID NO: 916069 - protein, 9 aa, Homo Sapiens
LCRRGGRCV

SEQ ID NO: 916070 - protein, 9 aa, Homo Sapiens
QAKEKLARM

SEQ ID NO: 916071 - protein, 9 aa, Homo Sapiens
AVPAHGYCS

SEQ ID NO: 916072 - protein, 9 aa, Homo Sapiens
HRAERPFLE

SEQ ID NO: 916073 - protein, 9 aa, Homo Sapiens
QRNCMAATL

SEQ ID NO: 916074 - protein, 9 aa, Homo Sapiens
AHSDFEILK

SEQ ID NO: 916075 - protein, 9 aa, Homo Sapiens
KKEDKAHLQ

SEQ ID NO: 916076 - protein, 9 aa, Homo Sapiens
LVAHSDFEI

SEQ ID NO: 916077 - protein, 9 aa, Homo Sapiens
VLLNTLFFF

SEQ ID NO: 916078 - protein, 9 aa, Homo Sapiens
STPSPKAAP

SEQ ID NO: 916079 - protein, 9 aa, Homo Sapiens
EELNRENAY

SEQ ID NO: 916080 - protein, 9 aa, Homo Sapiens
LKRCYWSDM

SEQ ID NO: 916081 - protein, 9 aa, Homo Sapiens
HHVFSANYD

SEQ ID NO: 916082 - protein, 9 aa, Homo Sapiens
SSKGAFLYK

SEQ ID NO: 916083 - protein, 9 aa, Homo Sapiens
KRPLFLVIT

SEQ ID NO: 916084 - protein, 9 aa, Homo Sapiens
KKSELKRCY

SEQ ID NO: 916085 - protein, 9 aa, Homo Sapiens
KVSGTDDGV

SEQ ID NO: 916086 - protein, 9 aa, Homo Sapiens
AGRKMEMLC

SEQ ID NO: 916087 - protein, 9 aa, Homo Sapiens
IPLVKNLLK

SEQ ID NO: 916088 - protein, 9 aa, Homo Sapiens
ATIPRQDKV

SEQ ID NO: 916089 - protein, 9 aa, Homo Sapiens
KSNGHHQYK

SEQ ID NO: 916090 - protein, 9 aa, Homo Sapiens
GAFLYKPCG

SEQ ID NO: 916091 - protein, 9 aa, Homo Sapiens
CLGNSAPYA

SEQ ID NO: 916092 - protein, 9 aa, Homo Sapiens
SNKEKKMIT

SEQ ID NO: 916093 - protein, 9 aa, Homo Sapiens
KPGNKVIPL

SEQ ID NO: 916094 - protein, 9 aa, Homo Sapiens
KSYISEESF

SEQ ID NO: 916095 - protein, 9 aa, Homo Sapiens
TLTDHKKIH

SEQ ID NO: 916096 - protein, 9 aa, Homo Sapiens
MPGSHFVSV

SEQ ID NO: 916097 - protein, 9 aa, Homo Sapiens
PYLSIPWDG

SEQ ID NO: 916098 - protein, 9 aa, Homo Sapiens
INYDDESEK

SEQ ID NO: 916099 - protein, 9 aa, Homo Sapiens
LPGSPNLEE

SEQ ID NO: 916100 - protein, 9 aa, Homo Sapiens
QITYLVPWC

SEQ ID NO: 916101 - protein, 9 aa, Homo Sapiens
PRVLSPPPS

SEQ ID NO: 916102 - protein, 9 aa, Homo Sapiens
DCYKEIFQY

SEQ ID NO: 916103 - protein, 9 aa, Homo Sapiens
DFYMAIVNK

SEQ ID NO: 916104 - protein, 9 aa, Homo Sapiens
LGNSAPYAP

SEQ ID NO: 916105 - protein, 9 aa, Homo Sapiens
AGLRLDQLG

SEQ ID NO: 916106 - protein, 9 aa, Homo Sapiens
KDWEKDKEK

SEQ ID NO: 916107 - protein, 9 aa, Homo Sapiens
EEREQQLRR

SEQ ID NO: 916108 - protein, 9 aa, Homo Sapiens
PHPMMLKES

SEQ ID NO: 916109 - protein, 9 aa, Homo Sapiens
NPLRQRLKE

SEQ ID NO: 916110 - protein, 9 aa, Homo Sapiens
PLMNFSHIY

SEQ ID NO: 916111 - protein, 9 aa, Homo Sapiens
EEDGTFNLP

SEQ ID NO: 916112 - protein, 9 aa, Homo Sapiens
NFCPRLASA

SEQ ID NO: 916113 - protein, 9 aa, Homo Sapiens
CEPMIGLVS

SEQ ID NO: 916114 - protein, 9 aa, Homo Sapiens
LNTLFFFNT

SEQ ID NO: 916115 - protein, 9 aa, Homo Sapiens
EETTTSSSK

SEQ ID NO: 916116 - protein, 9 aa, Homo Sapiens
KKLTVNSGT

SEQ ID NO: 916117 - protein, 9 aa, Homo Sapiens
GFIFSPSYV

SEQ ID NO: 916118 - protein, 9 aa, Homo Sapiens
PFGPAGSLT

SEQ ID NO: 916119 - protein, 9 aa, Homo Sapiens
PQNLWHIDF

SEQ ID NO: 916120 - protein, 9 aa, Homo Sapiens
SSLVVLLSG

SEQ ID NO: 916121 - protein, 9 aa, Homo Sapiens
QDGSHRTNQ

SEQ ID NO: 916122 - protein, 9 aa, Homo Sapiens
RPLFLVITF

SEQ ID NO: 916123 - protein, 9 aa, Homo Sapiens
DNFFLKEGR

SEQ ID NO: 916124 - protein, 9 aa, Homo Sapiens
VTMNSNFVP

SEQ ID NO: 916125 - protein, 9 aa, Homo Sapiens
PKLDEHLVE

SEQ ID NO: 916126 - protein, 9 aa, Homo Sapiens
SGTKSKLPK

SEQ ID NO: 916127 - protein, 9 aa, Homo Sapiens
EVNISNRRV

SEQ ID NO: 916128 - protein, 9 aa, Homo Sapiens
GDVPILNPL

SEQ ID NO: 916129 - protein, 9 aa, Homo Sapiens
FKKWGTRDL

SEQ ID NO: 916130 - protein, 9 aa, Homo Sapiens
MLTSMAYDC

SEQ ID NO: 916131 - protein, 9 aa, Homo Sapiens
NFLGFYLWI

SEQ ID NO: 916132 - protein, 9 aa, Homo Sapiens
DLGGRFGDF

SEQ ID NO: 916133 - protein, 9 aa, Homo Sapiens
SAQRSERSI

SEQ ID NO: 916134 - protein, 9 aa, Homo Sapiens
KLDEHLVER

SEQ ID NO: 916135 - protein, 9 aa, Homo Sapiens
EEEVNISNR

SEQ ID NO: 916136 - protein, 9 aa, Homo Sapiens
AETRLQNGR

SEQ ID NO: 916137 - protein, 9 aa, Homo Sapiens
GKKGKIDSY

SEQ ID NO: 916138 - protein, 9 aa, Homo Sapiens
AALSAFCYI

SEQ ID NO: 916139 - protein, 9 aa, Homo Sapiens
PSPFRNSVD

SEQ ID NO: 916140 - protein, 9 aa, Homo Sapiens
DIWKNLHAA

SEQ ID NO: 916141 - protein, 9 aa, Homo Sapiens
LPKQTPLAF

SEQ ID NO: 916142 - protein, 9 aa, Homo Sapiens
GVPGVEVSA

SEQ ID NO: 916143 - protein, 9 aa, Homo Sapiens
QTRASLKLV

SEQ ID NO: 916144 - protein, 9 aa, Homo Sapiens
LGNGWKPPE

SEQ ID NO: 916145 - protein, 9 aa, Homo Sapiens
SNPRNLSPI

SEQ ID NO: 916146 - protein, 9 aa, Homo Sapiens
LGGSAPGPT

SEQ ID NO: 916147 - protein, 9 aa, Homo Sapiens
PIIFRKARE

SEQ ID NO: 916148 - protein, 9 aa, Homo Sapiens
CKLPSFICL

SEQ ID NO: 916149 - protein, 9 aa, Homo Sapiens
QSQRLFAAV

SEQ ID NO: 916150 - protein, 9 aa, Homo Sapiens
FLLLLVTGA

SEQ ID NO: 916151 - protein, 9 aa, Homo Sapiens
ACQSSLDYQ

SEQ ID NO: 916152 - protein, 9 aa, Homo Sapiens
PCETLELSH

SEQ ID NO: 916153 - protein, 9 aa, Homo Sapiens
KTKDKSLEE

SEQ ID NO: 916154 - protein, 9 aa, Homo Sapiens
NCTDSLGYT

SEQ ID NO: 916155 - protein, 9 aa, Homo Sapiens
FLPFVLEYD

SEQ ID NO: 916156 - protein, 9 aa, Homo Sapiens
GEKPFQCED

SEQ ID NO: 916157 - protein, 9 aa, Homo Sapiens
RTLFMIEEE

SEQ ID NO: 916158 - protein, 9 aa, Homo Sapiens
QKVVRKAEE

SEQ ID NO: 916159 - protein, 9 aa, Homo Sapiens
RDELVDSVS

SEQ ID NO: 916160 - protein, 9 aa, Homo Sapiens
KHVPRGGSV

SEQ ID NO: 916161 - protein, 9 aa, Homo Sapiens
TETFWSKDM

SEQ ID NO: 916162 - protein, 9 aa, Homo Sapiens
KPPKLPRPP

SEQ ID NO: 916163 - protein, 9 aa, Homo Sapiens
SKFRNAPRS

SEQ ID NO: 916164 - protein, 9 aa, Homo Sapiens
AAENYQKAH

SEQ ID NO: 916165 - protein, 9 aa, Homo Sapiens
TDKLRQVTV

SEQ ID NO: 916166 - protein, 9 aa, Homo Sapiens
PFIFITKII

SEQ ID NO: 916167 - protein, 9 aa, Homo Sapiens
CQSVSSNQR

SEQ ID NO: 916168 - protein, 9 aa, Homo Sapiens
SLDNFFLKE

SEQ ID NO: 916169 - protein, 9 aa, Homo Sapiens
GGEIPGSEQ

SEQ ID NO: 916170 - protein, 9 aa, Homo Sapiens
LRQRQNVIG

SEQ ID NO: 916171 - protein, 9 aa, Homo Sapiens
PWAGLRLDQ

SEQ ID NO: 916172 - protein, 9 aa, Homo Sapiens
VGGDVPILN

SEQ ID NO: 916173 - protein, 9 aa, Homo Sapiens
IINLLQDNK

SEQ ID NO: 916174 - protein, 9 aa, Homo Sapiens
MAFNNLLQQ

SEQ ID NO: 916175 - protein, 9 aa, Homo Sapiens
EKGLTIVGS

SEQ ID NO: 916176 - protein, 9 aa, Homo Sapiens
RRAWVGVAA

SEQ ID NO: 916177 - protein, 9 aa, Homo Sapiens
EEEIKAERA

SEQ ID NO: 916178 - protein, 9 aa, Homo Sapiens
LAIRLSREE

SEQ ID NO: 916179 - protein, 9 aa, Homo Sapiens
NAVNKIFHI

SEQ ID NO: 916180 - protein, 9 aa, Homo Sapiens
SSGTKLSVK

SEQ ID NO: 916181 - protein, 9 aa, Homo Sapiens
YPRGIVVDP

SEQ ID NO: 916182 - protein, 9 aa, Homo Sapiens
PPTVVDDDL

SEQ ID NO: 916183 - protein, 9 aa, Homo Sapiens
GEKEDEDEV

SEQ ID NO: 916184 - protein, 9 aa, Homo Sapiens
VVLLSGGQR

SEQ ID NO: 916185 - protein, 9 aa, Homo Sapiens
GEKAWPTHV

SEQ ID NO: 916186 - protein, 9 aa, Homo Sapiens
NKEKKMITS

SEQ ID NO: 916187 - protein, 9 aa, Homo Sapiens
SLEAFFVFP

SEQ ID NO: 916188 - protein, 9 aa, Homo Sapiens
IKDHFCSFE

SEQ ID NO: 916189 - protein, 9 aa, Homo Sapiens
GRLEKVSFL

SEQ ID NO: 916190 - protein, 9 aa, Homo Sapiens
RLGDKYSLR

SEQ ID NO: 916191 - protein, 9 aa, Homo Sapiens
KVPQQTVAP

SEQ ID NO: 916192 - protein, 9 aa, Homo Sapiens
EAPAAAAFE

SEQ ID NO: 916193 - protein, 9 aa, Homo Sapiens
ESQITYLVP

SEQ ID NO: 916194 - protein, 9 aa, Homo Sapiens
EKEPWMVER

SEQ ID NO: 916195 - protein, 9 aa, Homo Sapiens
WLKDSMQCT

SEQ ID NO: 916196 - protein, 9 aa, Homo Sapiens
KEQELKGSF

SEQ ID NO: 916197 - protein, 9 aa, Homo Sapiens
SSGSKSSTP

SEQ ID NO: 916198 - protein, 9 aa, Homo Sapiens
PTRSARLLT

SEQ ID NO: 916199 - protein, 9 aa, Homo Sapiens
SESFDAVAD

SEQ ID NO: 916200 - protein, 9 aa, Homo Sapiens
GCLLLVLMA

SEQ ID NO: 916201 - protein, 9 aa, Homo Sapiens
TASSKGRVR

SEQ ID NO: 916202 - protein, 9 aa, Homo Sapiens
RPRPAKELS

SEQ ID NO: 916203 - protein, 9 aa, Homo Sapiens
DGTFNLPFQ

SEQ ID NO: 916204 - protein, 9 aa, Homo Sapiens
AEEKQELLA

SEQ ID NO: 916205 - protein, 9 aa, Homo Sapiens
ALVLFLDFS

SEQ ID NO: 916206 - protein, 9 aa, Homo Sapiens
AVTAQEPDA

SEQ ID NO: 916207 - protein, 9 aa, Homo Sapiens
TTQLAEAQK

SEQ ID NO: 916208 - protein, 9 aa, Homo Sapiens
TSNTLWIKF

SEQ ID NO: 916209 - protein, 9 aa, Homo Sapiens
EFWDKDKSR

SEQ ID NO: 916210 - protein, 9 aa, Homo Sapiens
PDSLKGSSE

SEQ ID NO: 916211 - protein, 9 aa, Homo Sapiens
GFKSGFLYP

SEQ ID NO: 916212 - protein, 9 aa, Homo Sapiens
NSVDSGSTT

SEQ ID NO: 916213 - protein, 9 aa, Homo Sapiens
LPNIFRIYV

SEQ ID NO: 916214 - protein, 9 aa, Homo Sapiens
GLSHPPNLK

SEQ ID NO: 916215 - protein, 9 aa, Homo Sapiens
LTKLYYARV

SEQ ID NO: 916216 - protein, 9 aa, Homo Sapiens
IYHDYHQYF

SEQ ID NO: 916217 - protein, 9 aa, Homo Sapiens
GLQSKAVKI

SEQ ID NO: 916218 - protein, 9 aa, Homo Sapiens
YSALLAKKR

SEQ ID NO: 916219 - protein, 9 aa, Homo Sapiens
FQSRRRFPV

SEQ ID NO: 916220 - protein, 9 aa, Homo Sapiens
GYPKFVVMV

SEQ ID NO: 916221 - protein, 9 aa, Homo Sapiens
NYHNIKILS

SEQ ID NO: 916222 - protein, 9 aa, Homo Sapiens
LAELDLPRA

SEQ ID NO: 916223 - protein, 9 aa, Homo Sapiens
SLDDEDSKI

SEQ ID NO: 916224 - protein, 9 aa, Homo Sapiens
EVVRKKLEE

SEQ ID NO: 916225 - protein, 9 aa, Homo Sapiens
DTSLGTKSS

SEQ ID NO: 916226 - protein, 9 aa, Homo Sapiens
PETKQEITR

SEQ ID NO: 916227 - protein, 9 aa, Homo Sapiens
LSKFSLQSG

SEQ ID NO: 916228 - protein, 9 aa, Homo Sapiens
EVQASRFCY

SEQ ID NO: 916229 - protein, 9 aa, Homo Sapiens
PGDYSHETA

SEQ ID NO: 916230 - protein, 9 aa, Homo Sapiens
IADNSEGLL

SEQ ID NO: 916231 - protein, 9 aa, Homo Sapiens
VVFLEFFAW

SEQ ID NO: 916232 - protein, 9 aa, Homo Sapiens
CIPLVKNLL

SEQ ID NO: 916233 - protein, 9 aa, Homo Sapiens
RLGQITEFG

SEQ ID NO: 916234 - protein, 9 aa, Homo Sapiens
AKEFAKILH

SEQ ID NO: 916235 - protein, 9 aa, Homo Sapiens
FLYTCLVEI

SEQ ID NO: 916236 - protein, 9 aa, Homo Sapiens
SDPVPTAFW

SEQ ID NO: 916237 - protein, 9 aa, Homo Sapiens
IEYLHKNLP

SEQ ID NO: 916238 - protein, 9 aa, Homo Sapiens
SSEDHLLYV

SEQ ID NO: 916239 - protein, 9 aa, Homo Sapiens
SSSCQSVSS

SEQ ID NO: 916240 - protein, 9 aa, Homo Sapiens
LHQAKEKLA

SEQ ID NO: 916241 - protein, 9 aa, Homo Sapiens
KERSVLNNQ

SEQ ID NO: 916242 - protein, 9 aa, Homo Sapiens
EGQFPRRVS

SEQ ID NO: 916243 - protein, 9 aa, Homo Sapiens
LQDVTVLSP

SEQ ID NO: 916244 - protein, 9 aa, Homo Sapiens
LICVTVWYP

SEQ ID NO: 916245 - protein, 9 aa, Homo Sapiens
SCITMNKQR

SEQ ID NO: 916246 - protein, 9 aa, Homo Sapiens
SVLEDILGS

SEQ ID NO: 916247 - protein, 9 aa, Homo Sapiens
NTSSDFEKD

SEQ ID NO: 916248 - protein, 9 aa, Homo Sapiens
FLGFYLWIK

SEQ ID NO: 916249 - protein, 9 aa, Homo Sapiens
GVYSCITMN

SEQ ID NO: 916250 - protein, 9 aa, Homo Sapiens
KLSVKPTSA

SEQ ID NO: 916251 - protein, 9 aa, Homo Sapiens
PDLRGDPGS

SEQ ID NO: 916252 - protein, 9 aa, Homo Sapiens
MIGLRGMAF

SEQ ID NO: 916253 - protein, 9 aa, Homo Sapiens
KYFPYLVFL

SEQ ID NO: 916254 - protein, 9 aa, Homo Sapiens
KYWTLLSNL

SEQ ID NO: 916255 - protein, 9 aa, Homo Sapiens
ERQSTSRVQ

SEQ ID NO: 916256 - protein, 9 aa, Homo Sapiens
KVCIVTKCS

SEQ ID NO: 916257 - protein, 9 aa, Homo Sapiens
TAGRKMEML

SEQ ID NO: 916258 - protein, 9 aa, Homo Sapiens
IFFLFIEVI

SEQ ID NO: 916259 - protein, 9 aa, Homo Sapiens
QFSLKNIAR

SEQ ID NO: 916260 - protein, 9 aa, Homo Sapiens
NEDKAISCK

SEQ ID NO: 916261 - protein, 9 aa, Homo Sapiens
VMDTVFPIQ

SEQ ID NO: 916262 - protein, 9 aa, Homo Sapiens
IQSPTQTPQ

SEQ ID NO: 916263 - protein, 9 aa, Homo Sapiens
LPPHPMMLK

SEQ ID NO: 916264 - protein, 9 aa, Homo Sapiens
HTDKIFSCA

SEQ ID NO: 916265 - protein, 9 aa, Homo Sapiens
EDAAPYQGW

SEQ ID NO: 916266 - protein, 9 aa, Homo Sapiens
EGKGSTNDE

SEQ ID NO: 916267 - protein, 9 aa, Homo Sapiens
YELAIIMYM

SEQ ID NO: 916268 - protein, 9 aa, Homo Sapiens
HFCSFENQF

SEQ ID NO: 916269 - protein, 9 aa, Homo Sapiens
RGNKIEVNK

SEQ ID NO: 916270 - protein, 9 aa, Homo Sapiens
VASPSQDML

SEQ ID NO: 916271 - protein, 9 aa, Homo Sapiens
STYEIITSR

SEQ ID NO: 916272 - protein, 9 aa, Homo Sapiens
KKKEDKAHL

SEQ ID NO: 916273 - protein, 9 aa, Homo Sapiens
GNAFYHPSA

SEQ ID NO: 916274 - protein, 9 aa, Homo Sapiens
LLPGDYSHE

SEQ ID NO: 916275 - protein, 9 aa, Homo Sapiens
GIVKKITFL

SEQ ID NO: 916276 - protein, 9 aa, Homo Sapiens
SVPKIKGID

SEQ ID NO: 916277 - protein, 9 aa, Homo Sapiens
QIFVKTLTE

SEQ ID NO: 916278 - protein, 9 aa, Homo Sapiens
WPTLLRTVY

SEQ ID NO: 916279 - protein, 9 aa, Homo Sapiens
TPKSDSYLQ

SEQ ID NO: 916280 - protein, 9 aa, Homo Sapiens
RDREREKDR

SEQ ID NO: 916281 - protein, 9 aa, Homo Sapiens
ELYRVYPYL

SEQ ID NO: 916282 - protein, 9 aa, Homo Sapiens
TGYFPIIFR

SEQ ID NO: 916283 - protein, 9 aa, Homo Sapiens
KSFYRSSSL

SEQ ID NO: 916284 - protein, 9 aa, Homo Sapiens
GDSNSYSLT

SEQ ID NO: 916285 - protein, 9 aa, Homo Sapiens
QSRDSSRHP

SEQ ID NO: 916286 - protein, 9 aa, Homo Sapiens
CGDSFPDDG

SEQ ID NO: 916287 - protein, 9 aa, Homo Sapiens
NLGRDFSVQ

SEQ ID NO: 916288 - protein, 9 aa, Homo Sapiens
VLRLQHSGS

SEQ ID NO: 916289 - protein, 9 aa, Homo Sapiens
QPSTDLKFD

SEQ ID NO: 916290 - protein, 9 aa, Homo Sapiens
SGCSRRQRA

SEQ ID NO: 916291 - protein, 9 aa, Homo Sapiens
KDLPTVLPL

SEQ ID NO: 916292 - protein, 9 aa, Homo Sapiens
LHLISVRRL

SEQ ID NO: 916293 - protein, 9 aa, Homo Sapiens
ALICVTVWY

SEQ ID NO: 916294 - protein, 9 aa, Homo Sapiens
ARDTDETGN

SEQ ID NO: 916295 - protein, 9 aa, Homo Sapiens
DDFVTSLFA

SEQ ID NO: 916296 - protein, 9 aa, Homo Sapiens
LISHQRIYT

SEQ ID NO: 916297 - protein, 9 aa, Homo Sapiens
SQENFFAPA

SEQ ID NO: 916298 - protein, 9 aa, Homo Sapiens
LVTPWLKGN

SEQ ID NO: 916299 - protein, 9 aa, Homo Sapiens
RPPWTGEGD

SEQ ID NO: 916300 - protein, 9 aa, Homo Sapiens
NISNRRVLV

SEQ ID NO: 916301 - protein, 9 aa, Homo Sapiens
KSSTPENVG

SEQ ID NO: 916302 - protein, 9 aa, Homo Sapiens
WKNLHAATV

SEQ ID NO: 916303 - protein, 9 aa, Homo Sapiens
KKLASGDEG

SEQ ID NO: 916304 - protein, 9 aa, Homo Sapiens
RHQAIFIIS

SEQ ID NO: 916305 - protein, 9 aa, Homo Sapiens
THLDLCGNQ

SEQ ID NO: 916306 - protein, 9 aa, Homo Sapiens
CSFQFSLKN

SEQ ID NO: 916307 - protein, 9 aa, Homo Sapiens
HLDLCGNQL

SEQ ID NO: 916308 - protein, 9 aa, Homo Sapiens
VVGSGVSGG

SEQ ID NO: 916309 - protein, 9 aa, Homo Sapiens
PGKRYIIQL

SEQ ID NO: 916310 - protein, 9 aa, Homo Sapiens
GGGEKAWPT

SEQ ID NO: 916311 - protein, 9 aa, Homo Sapiens
FFTFAFCDF

SEQ ID NO: 916312 - protein, 9 aa, Homo Sapiens
IRVGHCIIE

SEQ ID NO: 916313 - protein, 9 aa, Homo Sapiens
DEPIVQDGS

SEQ ID NO: 916314 - protein, 9 aa, Homo Sapiens
IQKGAFSEF

SEQ ID NO: 916315 - protein, 9 aa, Homo Sapiens
LSPPPSPRL

SEQ ID NO: 916316 - protein, 9 aa, Homo Sapiens
SFRRSDPVN

SEQ ID NO: 916317 - protein, 9 aa, Homo Sapiens
LDERKSLKS

SEQ ID NO: 916318 - protein, 9 aa, Homo Sapiens
YFPIIFRKA

SEQ ID NO: 916319 - protein, 9 aa, Homo Sapiens
GNKNFECHE

SEQ ID NO: 916320 - protein, 9 aa, Homo Sapiens
GLRLDQLGI

SEQ ID NO: 916321 - protein, 9 aa, Homo Sapiens
YSCITMNKQ

SEQ ID NO: 916322 - protein, 9 aa, Homo Sapiens
LYLHKQWLL

SEQ ID NO: 916323 - protein, 9 aa, Homo Sapiens
EDDGEPGQT

SEQ ID NO: 916324 - protein, 9 aa, Homo Sapiens
EKAKIVTLK

SEQ ID NO: 916325 - protein, 9 aa, Homo Sapiens
ILVSSSGAS

SEQ ID NO: 916326 - protein, 9 aa, Homo Sapiens
SSELDPEGS

SEQ ID NO: 916327 - protein, 9 aa, Homo Sapiens
VLIYFVEKD

SEQ ID NO: 916328 - protein, 9 aa, Homo Sapiens
QDVLFPNSS

SEQ ID NO: 916329 - protein, 9 aa, Homo Sapiens
EEKVSLEAF

SEQ ID NO: 916330 - protein, 9 aa, Homo Sapiens
VQNTVQDPA

SEQ ID NO: 916331 - protein, 9 aa, Homo Sapiens
GSHFVSVDG

SEQ ID NO: 916332 - protein, 9 aa, Homo Sapiens
PNIRESSKS

SEQ ID NO: 916333 - protein, 9 aa, Homo Sapiens
TPYWALFGA

SEQ ID NO: 916334 - protein, 9 aa, Homo Sapiens
VSPTSFVYG

SEQ ID NO: 916335 - protein, 9 aa, Homo Sapiens
DKEKTMDKS

SEQ ID NO: 916336 - protein, 9 aa, Homo Sapiens
DVGLNLDYE

SEQ ID NO: 916337 - protein, 9 aa, Homo Sapiens
GSKEGSPLT

SEQ ID NO: 916338 - protein, 9 aa, Homo Sapiens
RDKEREKDW

SEQ ID NO: 916339 - protein, 9 aa, Homo Sapiens
ATLCGDSFP

SEQ ID NO: 916340 - protein, 9 aa, Homo Sapiens
DPFLLNSRV

SEQ ID NO: 916341 - protein, 9 aa, Homo Sapiens
CSHVPTRSA

SEQ ID NO: 916342 - protein, 9 aa, Homo Sapiens
SEGHLYAVP

SEQ ID NO: 916343 - protein, 9 aa, Homo Sapiens
AAPYQGWEG

SEQ ID NO: 916344 - protein, 9 aa, Homo Sapiens
GDKENLQAR

SEQ ID NO: 916345 - protein, 9 aa, Homo Sapiens
DSGALPVPP

SEQ ID NO: 916346 - protein, 9 aa, Homo Sapiens
LISVRRLKE

SEQ ID NO: 916347 - protein, 9 aa, Homo Sapiens
ERIRLQWSR

SEQ ID NO: 916348 - protein, 9 aa, Homo Sapiens
SDVFSQSKA

SEQ ID NO: 916349 - protein, 9 aa, Homo Sapiens
WKPPENLAD

SEQ ID NO: 916350 - protein, 9 aa, Homo Sapiens
SRSLDSPTF

SEQ ID NO: 916351 - protein, 9 aa, Homo Sapiens
PLERINVHH

SEQ ID NO: 916352 - protein, 9 aa, Homo Sapiens
GDTQKKIRV

SEQ ID NO: 916353 - protein, 9 aa, Homo Sapiens
VRLQEAEGD

SEQ ID NO: 916354 - protein, 9 aa, Homo Sapiens
PVIQLPKQT

SEQ ID NO: 916355 - protein, 9 aa, Homo Sapiens
YAVTKTHPA

SEQ ID NO: 916356 - protein, 9 aa, Homo Sapiens
RPTSAACIL

SEQ ID NO: 916357 - protein, 9 aa, Homo Sapiens
LAEAQKVEP

SEQ ID NO: 916358 - protein, 9 aa, Homo Sapiens
VPRGFSFHS

SEQ ID NO: 916359 - protein, 9 aa, Homo Sapiens
ESSKSQDLG

SEQ ID NO: 916360 - protein, 9 aa, Homo Sapiens
KEIQGIPLQ

SEQ ID NO: 916361 - protein, 9 aa, Homo Sapiens
FSAQRSERS

SEQ ID NO: 916362 - protein, 9 aa, Homo Sapiens
EKIMANTTI

SEQ ID NO: 916363 - protein, 9 aa, Homo Sapiens
GVEVSAAGL

SEQ ID NO: 916364 - protein, 9 aa, Homo Sapiens
IFLSSMACC

SEQ ID NO: 916365 - protein, 9 aa, Homo Sapiens
VIKLTHDVG

SEQ ID NO: 916366 - protein, 9 aa, Homo Sapiens
GFSEPLLIL

SEQ ID NO: 916367 - protein, 9 aa, Homo Sapiens
HHRSHRRRP

SEQ ID NO: 916368 - protein, 9 aa, Homo Sapiens
EDFQRGNKI

SEQ ID NO: 916369 - protein, 9 aa, Homo Sapiens
QTESCFMAG

SEQ ID NO: 916370 - protein, 9 aa, Homo Sapiens
SREIRLIDK

SEQ ID NO: 916371 - protein, 9 aa, Homo Sapiens
GEIPGSEQW

SEQ ID NO: 916372 - protein, 9 aa, Homo Sapiens
TLGSSGSKS

SEQ ID NO: 916373 - protein, 9 aa, Homo Sapiens
NMVHRLIEK

SEQ ID NO: 916374 - protein, 9 aa, Homo Sapiens
IPSRTVTRK

SEQ ID NO: 916375 - protein, 9 aa, Homo Sapiens
KRCYWSDMF

SEQ ID NO: 916376 - protein, 9 aa, Homo Sapiens
SITFKKWGT

SEQ ID NO: 916377 - protein, 9 aa, Homo Sapiens
VFELKRLLY

SEQ ID NO: 916378 - protein, 9 aa, Homo Sapiens
IGDSNSYSL

SEQ ID NO: 916379 - protein, 9 aa, Homo Sapiens
DSEVANSPS

SEQ ID NO: 916380 - protein, 9 aa, Homo Sapiens
SLPRKGGAW

SEQ ID NO: 916381 - protein, 9 aa, Homo Sapiens
DNSKKNESL

SEQ ID NO: 916382 - protein, 9 aa, Homo Sapiens
SGLHAIYGE

SEQ ID NO: 916383 - protein, 9 aa, Homo Sapiens
EIIKRRRKS

SEQ ID NO: 916384 - protein, 9 aa, Homo Sapiens
SGGGGEKAW

SEQ ID NO: 916385 - protein, 9 aa, Homo Sapiens
KGNILGEKL

SEQ ID NO: 916386 - protein, 9 aa, Homo Sapiens
PNIFRIYVS

SEQ ID NO: 916387 - protein, 9 aa, Homo Sapiens
IDVIRLLQV

SEQ ID NO: 916388 - protein, 9 aa, Homo Sapiens
SHEKAITAL

SEQ ID NO: 916389 - protein, 9 aa, Homo Sapiens
AFNNLLQQV

SEQ ID NO: 916390 - protein, 9 aa, Homo Sapiens
PAGIYALIC

SEQ ID NO: 916391 - protein, 9 aa, Homo Sapiens
DADEERADS

SEQ ID NO: 916392 - protein, 9 aa, Homo Sapiens
PQDLGPLGG

SEQ ID NO: 916393 - protein, 9 aa, Homo Sapiens
SSSSSFPPL

SEQ ID NO: 916394 - protein, 9 aa, Homo Sapiens
SGTDDGVRS

SEQ ID NO: 916395 - protein, 9 aa, Homo Sapiens
DKKLMTESS

SEQ ID NO: 916396 - protein, 9 aa, Homo Sapiens
RETQSVHHL

SEQ ID NO: 916397 - protein, 9 aa, Homo Sapiens
KEWALLDPA

SEQ ID NO: 916398 - protein, 9 aa, Homo Sapiens
PWTGEGDTP

SEQ ID NO: 916399 - protein, 9 aa, Homo Sapiens
DSAERQNLS

SEQ ID NO: 916400 - protein, 9 aa, Homo Sapiens
TVHGFVSPT

SEQ ID NO: 916401 - protein, 9 aa, Homo Sapiens
KMRHPNSVQ

SEQ ID NO: 916402 - protein, 9 aa, Homo Sapiens
KNALTNYRF

SEQ ID NO: 916403 - protein, 9 aa, Homo Sapiens
VFSQSKADF

SEQ ID NO: 916404 - protein, 9 aa, Homo Sapiens
DPNAMYFLL

SEQ ID NO: 916405 - protein, 9 aa, Homo Sapiens
NGHHQYKDI

SEQ ID NO: 916406 - protein, 9 aa, Homo Sapiens
SDFEILKSK

SEQ ID NO: 916407 - protein, 9 aa, Homo Sapiens
WQILAQPWR

SEQ ID NO: 916408 - protein, 9 aa, Homo Sapiens
SEVQASRFC

SEQ ID NO: 916409 - protein, 9 aa, Homo Sapiens
DKPLDMSLF

SEQ ID NO: 916410 - protein, 9 aa, Homo Sapiens
EPGDCYKEI

SEQ ID NO: 916411 - protein, 9 aa, Homo Sapiens
DPEAVASLH

SEQ ID NO: 916412 - protein, 9 aa, Homo Sapiens
NFTFVTEFL

SEQ ID NO: 916413 - protein, 9 aa, Homo Sapiens
ELVDSVSKA

SEQ ID NO: 916414 - protein, 9 aa, Homo Sapiens
AAETEIPVA

SEQ ID NO: 916415 - protein, 9 aa, Homo Sapiens
ARERMNTVT

SEQ ID NO: 916416 - protein, 9 aa, Homo Sapiens
QSSLDYQYR

SEQ ID NO: 916417 - protein, 9 aa, Homo Sapiens
LGAETRLQN

SEQ ID NO: 916418 - protein, 9 aa, Homo Sapiens
ATPLVTLFP

SEQ ID NO: 916419 - protein, 9 aa, Homo Sapiens
QVLEGHTDK

SEQ ID NO: 916420 - protein, 9 aa, Homo Sapiens
ISNPNEDAS

SEQ ID NO: 916421 - protein, 9 aa, Homo Sapiens
ILPQQKSAH

SEQ ID NO: 916422 - protein, 9 aa, Homo Sapiens
QATVSHKVG

SEQ ID NO: 916423 - protein, 9 aa, Homo Sapiens
ETNDFREFV

SEQ ID NO: 916424 - protein, 9 aa, Homo Sapiens
HSKGVVISF

SEQ ID NO: 916425 - protein, 9 aa, Homo Sapiens
FSFHSSEIQ

SEQ ID NO: 916426 - protein, 9 aa, Homo Sapiens
LNFYEVAGS

SEQ ID NO: 916427 - protein, 9 aa, Homo Sapiens
LIYFVEKDD

SEQ ID NO: 916428 - protein, 9 aa, Homo Sapiens
LVGWCSLTG

SEQ ID NO: 916429 - protein, 9 aa, Homo Sapiens
AKYFPYLVF

SEQ ID NO: 916430 - protein, 9 aa, Homo Sapiens
GQAPGGSRA

SEQ ID NO: 916431 - protein, 9 aa, Homo Sapiens
RGDKEKTMD

SEQ ID NO: 916432 - protein, 9 aa, Homo Sapiens
GKPIQSPTQ

SEQ ID NO: 916433 - protein, 9 aa, Homo Sapiens
EIITSRMLC

SEQ ID NO: 916434 - protein, 9 aa, Homo Sapiens
ETFWSKDMA

SEQ ID NO: 916435 - protein, 9 aa, Homo Sapiens
LGGCGATAQ

SEQ ID NO: 916436 - protein, 9 aa, Homo Sapiens
IKTIVRGNK

SEQ ID NO: 916437 - protein, 9 aa, Homo Sapiens
GIPLQRDDE

SEQ ID NO: 916438 - protein, 9 aa, Homo Sapiens
TRNSHLAEL

SEQ ID NO: 916439 - protein, 9 aa, Homo Sapiens
KLNFTFVTE

SEQ ID NO: 916440 - protein, 9 aa, Homo Sapiens
FSLLCTSLL

SEQ ID NO: 916441 - protein, 9 aa, Homo Sapiens
YAVPIREQG

SEQ ID NO: 916442 - protein, 9 aa, Homo Sapiens
TSISQVPCR

SEQ ID NO: 916443 - protein, 9 aa, Homo Sapiens
KSRGFLKCK

SEQ ID NO: 916444 - protein, 9 aa, Homo Sapiens
AQFQPGFIS

SEQ ID NO: 916445 - protein, 9 aa, Homo Sapiens
FELKRLLYT

SEQ ID NO: 916446 - protein, 9 aa, Homo Sapiens
SSASPSIQY

SEQ ID NO: 916447 - protein, 9 aa, Homo Sapiens
VQDGSHRTN

SEQ ID NO: 916448 - protein, 9 aa, Homo Sapiens
GQLARPGFS

SEQ ID NO: 916449 - protein, 9 aa, Homo Sapiens
KSQGSGQSL

SEQ ID NO: 916450 - protein, 9 aa, Homo Sapiens
RVLSPPPSP

SEQ ID NO: 916451 - protein, 9 aa, Homo Sapiens
VEKSTTYHS

SEQ ID NO: 916452 - protein, 9 aa, Homo Sapiens
QPGFISPRH

SEQ ID NO: 916453 - protein, 9 aa, Homo Sapiens
TDSLGYTAL

SEQ ID NO: 916454 - protein, 9 aa, Homo Sapiens
TSMAYDCYV

SEQ ID NO: 916455 - protein, 9 aa, Homo Sapiens
PRNQLQGML

SEQ ID NO: 916456 - protein, 9 aa, Homo Sapiens
QLQATVSHK

SEQ ID NO: 916457 - protein, 9 aa, Homo Sapiens
TYNQSEYIP

SEQ ID NO: 916458 - protein, 9 aa, Homo Sapiens
GKPCLGNSA

SEQ ID NO: 916459 - protein, 9 aa, Homo Sapiens
TLLEGEMSY

SEQ ID NO: 916460 - protein, 9 aa, Homo Sapiens
FLQVNFHSP

SEQ ID NO: 916461 - protein, 9 aa, Homo Sapiens
FAKILHFTL

SEQ ID NO: 916462 - protein, 9 aa, Homo Sapiens
QDPLDKKLM

SEQ ID NO: 916463 - protein, 9 aa, Homo Sapiens
TEVAKDPQQ

SEQ ID NO: 916464 - protein, 9 aa, Homo Sapiens
GFSDITLLQ

SEQ ID NO: 916465 - protein, 9 aa, Homo Sapiens
EKPFQCEDC

SEQ ID NO: 916466 - protein, 9 aa, Homo Sapiens
RMCIMQISS

SEQ ID NO: 916467 - protein, 9 aa, Homo Sapiens
MILSQTVVE

SEQ ID NO: 916468 - protein, 9 aa, Homo Sapiens
PCRLPRGLH

SEQ ID NO: 916469 - protein, 9 aa, Homo Sapiens
AVTKTHPAL

SEQ ID NO: 916470 - protein, 9 aa, Homo Sapiens
GSRPPWTGE

SEQ ID NO: 916471 - protein, 9 aa, Homo Sapiens
AGFFIRYEI

SEQ ID NO: 916472 - protein, 9 aa, Homo Sapiens
QRSHLWGHK

SEQ ID NO: 916473 - protein, 9 aa, Homo Sapiens
AQLHEFLQY

SEQ ID NO: 916474 - protein, 9 aa, Homo Sapiens
SHQKLEKER

SEQ ID NO: 916475 - protein, 9 aa, Homo Sapiens
VPTAFWCGP

SEQ ID NO: 916476 - protein, 9 aa, Homo Sapiens
NVNCTDSLG

SEQ ID NO: 916477 - protein, 9 aa, Homo Sapiens
SEKEGYEPH

SEQ ID NO: 916478 - protein, 9 aa, Homo Sapiens
QMIGEFLEN

SEQ ID NO: 916479 - protein, 9 aa, Homo Sapiens
QNLVDFYMA

SEQ ID NO: 916480 - protein, 9 aa, Homo Sapiens
PRGTTASSK

SEQ ID NO: 916481 - protein, 9 aa, Homo Sapiens
LQQPSTDLK

SEQ ID NO: 916482 - protein, 9 aa, Homo Sapiens
IEKREVILY

SEQ ID NO: 916483 - protein, 9 aa, Homo Sapiens
TVRKQTESC

SEQ ID NO: 916484 - protein, 9 aa, Homo Sapiens
IFVKTLTEK

SEQ ID NO: 916485 - protein, 9 aa, Homo Sapiens
LKLNLGRDF

SEQ ID NO: 916486 - protein, 9 aa, Homo Sapiens
QVPKLDEHL

SEQ ID NO: 916487 - protein, 9 aa, Homo Sapiens
LHSIDWIDE

SEQ ID NO: 916488 - protein, 9 aa, Homo Sapiens
HNIKILSSE

SEQ ID NO: 916489 - protein, 9 aa, Homo Sapiens
ISALKFSKC

SEQ ID NO: 916490 - protein, 9 aa, Homo Sapiens
VYELAIIMY

SEQ ID NO: 916491 - protein, 9 aa, Homo Sapiens
KEGSPLTSQ

SEQ ID NO: 916492 - protein, 9 aa, Homo Sapiens
GINCSIQKD

SEQ ID NO: 916493 - protein, 9 aa, Homo Sapiens
EALQEGLGG

SEQ ID NO: 916494 - protein, 9 aa, Homo Sapiens
QAQITQERA

SEQ ID NO: 916495 - protein, 9 aa, Homo Sapiens
RPCETLELS

SEQ ID NO: 916496 - protein, 9 aa, Homo Sapiens
NYQKAHRWQ

SEQ ID NO: 916497 - protein, 9 aa, Homo Sapiens
FRVAGITDL

SEQ ID NO: 916498 - protein, 9 aa, Homo Sapiens
NSSLVVLLS

SEQ ID NO: 916499 - protein, 9 aa, Homo Sapiens
ELNFLITKL

SEQ ID NO: 916500 - protein, 9 aa, Homo Sapiens
LSYQATASP

SEQ ID NO: 916501 - protein, 9 aa, Homo Sapiens
MGAICAQLS

SEQ ID NO: 916502 - protein, 9 aa, Homo Sapiens
GYAVTKTHP

SEQ ID NO: 916503 - protein, 9 aa, Homo Sapiens
FNNLLQQVG

SEQ ID NO: 916504 - protein, 9 aa, Homo Sapiens
LQNGRRAGV

SEQ ID NO: 916505 - protein, 9 aa, Homo Sapiens
AGIYALICV

SEQ ID NO: 916506 - protein, 9 aa, Homo Sapiens
SALKFSKCS

SEQ ID NO: 916507 - protein, 9 aa, Homo Sapiens
CSAPPTKGD

SEQ ID NO: 916508 - protein, 9 aa, Homo Sapiens
ATAQWITSL

SEQ ID NO: 916509 - protein, 9 aa, Homo Sapiens
KVDSSSREI

SEQ ID NO: 916510 - protein, 9 aa, Homo Sapiens
ECWKSFSEK

SEQ ID NO: 916511 - protein, 9 aa, Homo Sapiens
FSEFGDLEK

SEQ ID NO: 916512 - protein, 9 aa, Homo Sapiens
HSLNEELNF

SEQ ID NO: 916513 - protein, 9 aa, Homo Sapiens
SWLQIIKAN

SEQ ID NO: 916514 - protein, 9 aa, Homo Sapiens
AKGILVVGS

SEQ ID NO: 916515 - protein, 9 aa, Homo Sapiens
GSEPEKEED

SEQ ID NO: 916516 - protein, 9 aa, Homo Sapiens
FFSALEGAE

SEQ ID NO: 916517 - protein, 9 aa, Homo Sapiens
YRLVKKGSP

SEQ ID NO: 916518 - protein, 9 aa, Homo Sapiens
EPMIGLVSI

SEQ ID NO: 916519 - protein, 9 aa, Homo Sapiens
PRRVSSMGP

SEQ ID NO: 916520 - protein, 9 aa, Homo Sapiens
VLWLKDSMQ

SEQ ID NO: 916521 - protein, 9 aa, Homo Sapiens
TKLSVKPTS

SEQ ID NO: 916522 - protein, 9 aa, Homo Sapiens
NVNQSVASD

SEQ ID NO: 916523 - protein, 9 aa, Homo Sapiens
ATSPGSIRF

SEQ ID NO: 916524 - protein, 9 aa, Homo Sapiens
LPLERINVH

SEQ ID NO: 916525 - protein, 9 aa, Homo Sapiens
TTNPNQRLL

SEQ ID NO: 916526 - protein, 9 aa, Homo Sapiens
IVVFLEFFA

SEQ ID NO: 916527 - protein, 9 aa, Homo Sapiens
FCYGGLDLS

SEQ ID NO: 916528 - protein, 9 aa, Homo Sapiens
QELKGSFIR

SEQ ID NO: 916529 - protein, 9 aa, Homo Sapiens
WLKSLKQEK

SEQ ID NO: 916530 - protein, 9 aa, Homo Sapiens
VTDKIIHAT

SEQ ID NO: 916531 - protein, 9 aa, Homo Sapiens
IEGYPKFVV

SEQ ID NO: 916532 - protein, 9 aa, Homo Sapiens
ANTSSDFEK

SEQ ID NO: 916533 - protein, 9 aa, Homo Sapiens
IISEKKYCQ

SEQ ID NO: 916534 - protein, 9 aa, Homo Sapiens
PPTGDSGAL

SEQ ID NO: 916535 - protein, 9 aa, Homo Sapiens
LKESRQNKL

SEQ ID NO: 916536 - protein, 9 aa, Homo Sapiens
YDDESEKTC

SEQ ID NO: 916537 - protein, 9 aa, Homo Sapiens
SSPPLLPPF

SEQ ID NO: 916538 - protein, 9 aa, Homo Sapiens
VLGEKEDED

SEQ ID NO: 916539 - protein, 9 aa, Homo Sapiens
GYSPSQNPG

SEQ ID NO: 916540 - protein, 9 aa, Homo Sapiens
TVVEVLGSF

SEQ ID NO: 916541 - protein, 9 aa, Homo Sapiens
VSPGVFPVT

SEQ ID NO: 916542 - protein, 9 aa, Homo Sapiens
YRFYGCYCG

SEQ ID NO: 916543 - protein, 9 aa, Homo Sapiens
GGEKAWPTH

SEQ ID NO: 916544 - protein, 9 aa, Homo Sapiens
WLQIIKANY

SEQ ID NO: 916545 - protein, 9 aa, Homo Sapiens
IASSKTANL

SEQ ID NO: 916546 - protein, 9 aa, Homo Sapiens
FGDFQPLGF

SEQ ID NO: 916547 - protein, 9 aa, Homo Sapiens
EPEKEEDVS

SEQ ID NO: 916548 - protein, 9 aa, Homo Sapiens
DSIITGTVS

SEQ ID NO: 916549 - protein, 9 aa, Homo Sapiens
LTPPSPFRN

SEQ ID NO: 916550 - protein, 9 aa, Homo Sapiens
NAFYHPSAV

SEQ ID NO: 916551 - protein, 9 aa, Homo Sapiens
VTAQEPDAS

SEQ ID NO: 916552 - protein, 9 aa, Homo Sapiens
REIRLIDKL

SEQ ID NO: 916553 - protein, 9 aa, Homo Sapiens
GHCIIEING

SEQ ID NO: 916554 - protein, 9 aa, Homo Sapiens
CIMQISSGY

SEQ ID NO: 916555 - protein, 9 aa, Homo Sapiens
KVVRKAEEE

SEQ ID NO: 916556 - protein, 9 aa, Homo Sapiens
VPKLDEHLV

SEQ ID NO: 916557 - protein, 9 aa, Homo Sapiens
NLVGPPASC

SEQ ID NO: 916558 - protein, 9 aa, Homo Sapiens
YLTICNPLY

SEQ ID NO: 916559 - protein, 9 aa, Homo Sapiens
LSSVLSPGD

SEQ ID NO: 916560 - protein, 9 aa, Homo Sapiens
PLDIEWLIL

SEQ ID NO: 916561 - protein, 9 aa, Homo Sapiens
IGSSLLATR

SEQ ID NO: 916562 - protein, 9 aa, Homo Sapiens
LCGNQLQTL

SEQ ID NO: 916563 - protein, 9 aa, Homo Sapiens
VNSGTKSKL

SEQ ID NO: 916564 - protein, 9 aa, Homo Sapiens
QSPTQTPQT

SEQ ID NO: 916565 - protein, 9 aa, Homo Sapiens
RRHQAIFII

SEQ ID NO: 916566 - protein, 9 aa, Homo Sapiens
SEKTCVHIA

SEQ ID NO: 916567 - protein, 9 aa, Homo Sapiens
PNVNCTDSL

SEQ ID NO: 916568 - protein, 9 aa, Homo Sapiens
YGNAFYHPS

SEQ ID NO: 916569 - protein, 9 aa, Homo Sapiens
SGAPEGTPA

SEQ ID NO: 916570 - protein, 9 aa, Homo Sapiens
ISQVPCRLP

SEQ ID NO: 916571 - protein, 9 aa, Homo Sapiens
LTVSPGVFP

SEQ ID NO: 916572 - protein, 9 aa, Homo Sapiens
NFFAPADIP

SEQ ID NO: 916573 - protein, 9 aa, Homo Sapiens
LEGHTDKIF

SEQ ID NO: 916574 - protein, 9 aa, Homo Sapiens
IHTGETPNK

SEQ ID NO: 916575 - protein, 9 aa, Homo Sapiens
AENYQKAHR

SEQ ID NO: 916576 - protein, 9 aa, Homo Sapiens
KNAVLKPSH

SEQ ID NO: 916577 - protein, 9 aa, Homo Sapiens
FSVLIYFVE

SEQ ID NO: 916578 - protein, 9 aa, Homo Sapiens
PGFSEPLLI

SEQ ID NO: 916579 - protein, 9 aa, Homo Sapiens
GKNALTNYR

SEQ ID NO: 916580 - protein, 9 aa, Homo Sapiens
GVVISFLVL

SEQ ID NO: 916581 - protein, 9 aa, Homo Sapiens
WEQLEQKEQ

SEQ ID NO: 916582 - protein, 9 aa, Homo Sapiens
EGHLYAVPI

SEQ ID NO: 916583 - protein, 9 aa, Homo Sapiens
AGQSDSDSG

SEQ ID NO: 916584 - protein, 9 aa, Homo Sapiens
VKTLTEKTI

SEQ ID NO: 916585 - protein, 9 aa, Homo Sapiens
PHIGDDPFI

SEQ ID NO: 916586 - protein, 9 aa, Homo Sapiens
PEIMGAICA

SEQ ID NO: 916587 - protein, 9 aa, Homo Sapiens
KDGMLVVNV

SEQ ID NO: 916588 - protein, 9 aa, Homo Sapiens
PIGDSNSYS

SEQ ID NO: 916589 - protein, 9 aa, Homo Sapiens
VIITRNSHL

SEQ ID NO: 916590 - protein, 9 aa, Homo Sapiens
RSGARPCLA

SEQ ID NO: 916591 - protein, 9 aa, Homo Sapiens
EDQESSEEG

SEQ ID NO: 916592 - protein, 9 aa, Homo Sapiens
ILKPPFFDG

SEQ ID NO: 916593 - protein, 9 aa, Homo Sapiens
WKLALKYHP

SEQ ID NO: 916594 - protein, 9 aa, Homo Sapiens
VDKTKDKSL

SEQ ID NO: 916595 - protein, 9 aa, Homo Sapiens
SSHEKAITA

SEQ ID NO: 916596 - protein, 9 aa, Homo Sapiens
ERVAQRDIC

SEQ ID NO: 916597 - protein, 9 aa, Homo Sapiens
LKAEKGLTI

SEQ ID NO: 916598 - protein, 9 aa, Homo Sapiens
CAQWSLDNF

SEQ ID NO: 916599 - protein, 9 aa, Homo Sapiens
MDSDGSISA

SEQ ID NO: 916600 - protein, 9 aa, Homo Sapiens
SSLLATRSV

SEQ ID NO: 916601 - protein, 9 aa, Homo Sapiens
LSPRGSSSA

SEQ ID NO: 916602 - protein, 9 aa, Homo Sapiens
KQLPVDKTK

SEQ ID NO: 916603 - protein, 9 aa, Homo Sapiens
KKSDDSVNT

SEQ ID NO: 916604 - protein, 9 aa, Homo Sapiens
VGGPPPSSA

SEQ ID NO: 916605 - protein, 9 aa, Homo Sapiens
LGKFDKPLD

SEQ ID NO: 916606 - protein, 9 aa, Homo Sapiens
PTKGDCGPG

SEQ ID NO: 916607 - protein, 9 aa, Homo Sapiens
ICDITDKLR

SEQ ID NO: 916608 - protein, 9 aa, Homo Sapiens
SRPPWTGEG

SEQ ID NO: 916609 - protein, 9 aa, Homo Sapiens
PEAFLLIAI

SEQ ID NO: 916610 - protein, 9 aa, Homo Sapiens
LQATVSHKV

SEQ ID NO: 916611 - protein, 9 aa, Homo Sapiens
KTGLQYLKN

SEQ ID NO: 916612 - protein, 9 aa, Homo Sapiens
QPWRAFFKL

SEQ ID NO: 916613 - protein, 9 aa, Homo Sapiens
EAQKVEPQE

SEQ ID NO: 916614 - protein, 9 aa, Homo Sapiens
RMFRPLMNF

SEQ ID NO: 916615 - protein, 9 aa, Homo Sapiens
LSVKPTSAT

SEQ ID NO: 916616 - protein, 9 aa, Homo Sapiens
FLGYDQHGS

SEQ ID NO: 916617 - protein, 9 aa, Homo Sapiens
PESVGEAEM

SEQ ID NO: 916618 - protein, 9 aa, Homo Sapiens
LSCLRRALQ

SEQ ID NO: 916619 - protein, 9 aa, Homo Sapiens
LDAKTSASQ

SEQ ID NO: 916620 - protein, 9 aa, Homo Sapiens
TSRTPCFSS

SEQ ID NO: 916621 - protein, 9 aa, Homo Sapiens
PSRTVTRKS

SEQ ID NO: 916622 - protein, 9 aa, Homo Sapiens
KEKTMDKST

SEQ ID NO: 916623 - protein, 9 aa, Homo Sapiens
SSSSFPPLP

SEQ ID NO: 916624 - protein, 9 aa, Homo Sapiens
HPPNLKSLL

SEQ ID NO: 916625 - protein, 9 aa, Homo Sapiens
RREQEEREQ

SEQ ID NO: 916626 - protein, 9 aa, Homo Sapiens
DFSQKEWAL

SEQ ID NO: 916627 - protein, 9 aa, Homo Sapiens
PFSLLCTSL

SEQ ID NO: 916628 - protein, 9 aa, Homo Sapiens
KKKKVCKYW

SEQ ID NO: 916629 - protein, 9 aa, Homo Sapiens
EGLGGCGAT

SEQ ID NO: 916630 - protein, 9 aa, Homo Sapiens
ICLQSSPSP

SEQ ID NO: 916631 - protein, 9 aa, Homo Sapiens
PAEVAVKTP

SEQ ID NO: 916632 - protein, 9 aa, Homo Sapiens
KLRQVTVKL

SEQ ID NO: 916633 - protein, 9 aa, Homo Sapiens
RDIDIILNQ

SEQ ID NO: 916634 - protein, 9 aa, Homo Sapiens
VETNFYDVQ

SEQ ID NO: 916635 - protein, 9 aa, Homo Sapiens
SNEEVIQLS

SEQ ID NO: 916636 - protein, 9 aa, Homo Sapiens
NCSIQKDKT

SEQ ID NO: 916637 - protein, 9 aa, Homo Sapiens
GLHAITIKP

SEQ ID NO: 916638 - protein, 9 aa, Homo Sapiens
IKLTHDVGL

SEQ ID NO: 916639 - protein, 9 aa, Homo Sapiens
WITSLLKSQ

SEQ ID NO: 916640 - protein, 9 aa, Homo Sapiens
TILSKFSLQ

SEQ ID NO: 916641 - protein, 9 aa, Homo Sapiens
ESCFMAGDI

SEQ ID NO: 916642 - protein, 9 aa, Homo Sapiens
NPRNLSPIK

SEQ ID NO: 916643 - protein, 9 aa, Homo Sapiens
DNFYAYDED

SEQ ID NO: 916644 - protein, 9 aa, Homo Sapiens
NTLFFFNTK

SEQ ID NO: 916645 - protein, 9 aa, Homo Sapiens
EGYPKFVVM

SEQ ID NO: 916646 - protein, 9 aa, Homo Sapiens
SSKFRNAPR

SEQ ID NO: 916647 - protein, 9 aa, Homo Sapiens
GAVGGDVPI

SEQ ID NO: 916648 - protein, 9 aa, Homo Sapiens
LGVKAMGPL

SEQ ID NO: 916649 - protein, 9 aa, Homo Sapiens
RMEQLRNCD

SEQ ID NO: 916650 - protein, 9 aa, Homo Sapiens
VFQSILVAT

SEQ ID NO: 916651 - protein, 9 aa, Homo Sapiens
RADQRPPRS

SEQ ID NO: 916652 - protein, 9 aa, Homo Sapiens
ELEEEIKAE

SEQ ID NO: 916653 - protein, 9 aa, Homo Sapiens
FDKPLDMSL

SEQ ID NO: 916654 - protein, 9 aa, Homo Sapiens
IVDEGYRMK

SEQ ID NO: 916655 - protein, 9 aa, Homo Sapiens
ILKNLSFEE

SEQ ID NO: 916656 - protein, 9 aa, Homo Sapiens
DIFLVGWCS

SEQ ID NO: 916657 - protein, 9 aa, Homo Sapiens
MDWEFALLF

SEQ ID NO: 916658 - protein, 9 aa, Homo Sapiens
SLGLVAASF

SEQ ID NO: 916659 - protein, 9 aa, Homo Sapiens
FLVALLVET

SEQ ID NO: 916660 - protein, 9 aa, Homo Sapiens
WGLWLGCLL

SEQ ID NO: 916661 - protein, 9 aa, Homo Sapiens
GKRYIIQLT

SEQ ID NO: 916662 - protein, 9 aa, Homo Sapiens
RTLGSSGSK

SEQ ID NO: 916663 - protein, 9 aa, Homo Sapiens
LKFDRVVIY

SEQ ID NO: 916664 - protein, 9 aa, Homo Sapiens
LYHPTIMTS

SEQ ID NO: 916665 - protein, 9 aa, Homo Sapiens
YFVEKDDHT

SEQ ID NO: 916666 - protein, 9 aa, Homo Sapiens
LEQKEQELK

SEQ ID NO: 916667 - protein, 9 aa, Homo Sapiens
YPWAGLRLD

SEQ ID NO: 916668 - protein, 9 aa, Homo Sapiens
ANLVAKRHF

SEQ ID NO: 916669 - protein, 9 aa, Homo Sapiens
GTINGDPEA

SEQ ID NO: 916670 - protein, 9 aa, Homo Sapiens
THRGSEPEK

SEQ ID NO: 916671 - protein, 9 aa, Homo Sapiens
LGSGESSFS

SEQ ID NO: 916672 - protein, 9 aa, Homo Sapiens
IFGVSDHIR

SEQ ID NO: 916673 - protein, 9 aa, Homo Sapiens
GLCIWLLIL

SEQ ID NO: 916674 - protein, 9 aa, Homo Sapiens
VPYPENEIG

SEQ ID NO: 916675 - protein, 9 aa, Homo Sapiens
REQEEREQQ

SEQ ID NO: 916676 - protein, 9 aa, Homo Sapiens
KITFLKYIP

SEQ ID NO: 916677 - protein, 9 aa, Homo Sapiens
TRKSTDSPV

SEQ ID NO: 916678 - protein, 9 aa, Homo Sapiens
DLNPTGQFL

SEQ ID NO: 916679 - protein, 9 aa, Homo Sapiens
LDRETQSVH

SEQ ID NO: 916680 - protein, 9 aa, Homo Sapiens
SKQQELEVV

SEQ ID NO: 916681 - protein, 9 aa, Homo Sapiens
SFFFSALEG

SEQ ID NO: 916682 - protein, 9 aa, Homo Sapiens
CEIIKRRRK

SEQ ID NO: 916683 - protein, 9 aa, Homo Sapiens
PIKTIVRGN

SEQ ID NO: 916684 - protein, 9 aa, Homo Sapiens
DQRPPRSAS

SEQ ID NO: 916685 - protein, 9 aa, Homo Sapiens
SAVTNGFSL

SEQ ID NO: 916686 - protein, 9 aa, Homo Sapiens
SNFPQMGIT

SEQ ID NO: 916687 - protein, 9 aa, Homo Sapiens
STRRAWVGV

SEQ ID NO: 916688 - protein, 9 aa, Homo Sapiens
QSRRRFPVL

SEQ ID NO: 916689 - protein, 9 aa, Homo Sapiens
CGHSIYHDY

SEQ ID NO: 916690 - protein, 9 aa, Homo Sapiens
QFPRRVSSM

SEQ ID NO: 916691 - protein, 9 aa, Homo Sapiens
IPPTVVDDD

SEQ ID NO: 916692 - protein, 9 aa, Homo Sapiens
QEKEDADEE

SEQ ID NO: 916693 - protein, 9 aa, Homo Sapiens
QYKCLRFRR

SEQ ID NO: 916694 - protein, 9 aa, Homo Sapiens
AFSNLPNIF

SEQ ID NO: 916695 - protein, 9 aa, Homo Sapiens
GHASNKEKK

SEQ ID NO: 916696 - protein, 9 aa, Homo Sapiens
QEGLGGCGA

SEQ ID NO: 916697 - protein, 9 aa, Homo Sapiens
TPIQLAPIK

SEQ ID NO: 916698 - protein, 9 aa, Homo Sapiens
PKTSSGTKL

SEQ ID NO: 916699 - protein, 9 aa, Homo Sapiens
ALLPGKRYI

SEQ ID NO: 916700 - protein, 9 aa, Homo Sapiens
EEEEDQESS

SEQ ID NO: 916701 - protein, 9 aa, Homo Sapiens
GQFQDNPAY

SEQ ID NO: 916702 - protein, 9 aa, Homo Sapiens
CFLLPGDYS

SEQ ID NO: 916703 - protein, 9 aa, Homo Sapiens
APESPRVLS

SEQ ID NO: 916704 - protein, 9 aa, Homo Sapiens
AASPYLSIP

SEQ ID NO: 916705 - protein, 9 aa, Homo Sapiens
LRLGDKYSL

SEQ ID NO: 916706 - protein, 9 aa, Homo Sapiens
PIKPGGSED

SEQ ID NO: 916707 - protein, 9 aa, Homo Sapiens
PGPCRTCSR

SEQ ID NO: 916708 - protein, 9 aa, Homo Sapiens
QESQITYLV

SEQ ID NO: 916709 - protein, 9 aa, Homo Sapiens
DKTRRHPQG

SEQ ID NO: 916710 - protein, 9 aa, Homo Sapiens
SDHMGSCRS

SEQ ID NO: 916711 - protein, 9 aa, Homo Sapiens
CILFGQGDF

SEQ ID NO: 916712 - protein, 9 aa, Homo Sapiens
PYQGWEGAS

SEQ ID NO: 916713 - protein, 9 aa, Homo Sapiens
TGAVGFLLL

SEQ ID NO: 916714 - protein, 9 aa, Homo Sapiens
LVSLQKHSA

SEQ ID NO: 916715 - protein, 9 aa, Homo Sapiens
LGYTALHHA

SEQ ID NO: 916716 - protein, 9 aa, Homo Sapiens
LRNCDDEVY

SEQ ID NO: 916717 - protein, 9 aa, Homo Sapiens
RASLKLVKT

SEQ ID NO: 916718 - protein, 9 aa, Homo Sapiens
KPCGVSTPV

SEQ ID NO: 916719 - protein, 9 aa, Homo Sapiens
KSCYKLFQE

SEQ ID NO: 916720 - protein, 9 aa, Homo Sapiens
RKIKDHFCS

SEQ ID NO: 916721 - protein, 9 aa, Homo Sapiens
KNLLKDGTD

SEQ ID NO: 916722 - protein, 9 aa, Homo Sapiens
AGIFLCETP

SEQ ID NO: 916723 - protein, 9 aa, Homo Sapiens
FVGKLGWEL

SEQ ID NO: 916724 - protein, 9 aa, Homo Sapiens
RLLLASPKS

SEQ ID NO: 916725 - protein, 9 aa, Homo Sapiens
CYINSTVNL

SEQ ID NO: 916726 - protein, 9 aa, Homo Sapiens
RGGREAAGS

SEQ ID NO: 916727 - protein, 9 aa, Homo Sapiens
LPPSESFDA

SEQ ID NO: 916728 - protein, 9 aa, Homo Sapiens
VKPGNKVIP

SEQ ID NO: 916729 - protein, 9 aa, Homo Sapiens
EREKDRELE

SEQ ID NO: 916730 - protein, 9 aa, Homo Sapiens
EVILFSSAV

SEQ ID NO: 916731 - protein, 9 aa, Homo Sapiens
FICLQSSPS

SEQ ID NO: 916732 - protein, 9 aa, Homo Sapiens
SILFDSNDS

SEQ ID NO: 916733 - protein, 9 aa, Homo Sapiens
YQGWEGAST

SEQ ID NO: 916734 - protein, 9 aa, Homo Sapiens
GERGKNSVS

SEQ ID NO: 916735 - protein, 9 aa, Homo Sapiens
SVPRGFSFH

SEQ ID NO: 916736 - protein, 9 aa, Homo Sapiens
RINVHHREA

SEQ ID NO: 916737 - protein, 9 aa, Homo Sapiens
HGKSSEDHL

SEQ ID NO: 916738 - protein, 9 aa, Homo Sapiens
HVPTRSARL

SEQ ID NO: 916739 - protein, 9 aa, Homo Sapiens
LQYLKNVVL

SEQ ID NO: 916740 - protein, 9 aa, Homo Sapiens
EKTCVHIAA

SEQ ID NO: 916741 - protein, 9 aa, Homo Sapiens
KEIFQYVCH

SEQ ID NO: 916742 - protein, 9 aa, Homo Sapiens
IEWKNLNKD

SEQ ID NO: 916743 - protein, 9 aa, Homo Sapiens
GLTQPPPPH

SEQ ID NO: 916744 - protein, 9 aa, Homo Sapiens
MARTPYWAL

SEQ ID NO: 916745 - protein, 9 aa, Homo Sapiens
QSTSRVQNT

SEQ ID NO: 916746 - protein, 9 aa, Homo Sapiens
QVIADNSEG

SEQ ID NO: 916747 - protein, 9 aa, Homo Sapiens
NLQARERMN

SEQ ID NO: 916748 - protein, 9 aa, Homo Sapiens
ENYQKAHRW

SEQ ID NO: 916749 - protein, 9 aa, Homo Sapiens
ISPEQIDFL

SEQ ID NO: 916750 - protein, 9 aa, Homo Sapiens
LPSFICLQS

SEQ ID NO: 916751 - protein, 9 aa, Homo Sapiens
ESEKTCVHI

SEQ ID NO: 916752 - protein, 9 aa, Homo Sapiens
FVKTLTEKT

SEQ ID NO: 916753 - protein, 9 aa, Homo Sapiens
ASMSTRRAW

SEQ ID NO: 916754 - protein, 9 aa, Homo Sapiens
KREFAKNLK

SEQ ID NO: 916755 - protein, 9 aa, Homo Sapiens
DSMQCTCEE

SEQ ID NO: 916756 - protein, 9 aa, Homo Sapiens
ELLDERKSL

SEQ ID NO: 916757 - protein, 9 aa, Homo Sapiens
EDKNYHNIK

SEQ ID NO: 916758 - protein, 9 aa, Homo Sapiens
FVTSLFAAK

SEQ ID NO: 916759 - protein, 9 aa, Homo Sapiens
VAVDFSQKE

SEQ ID NO: 916760 - protein, 9 aa, Homo Sapiens
AVNKIFHIV

SEQ ID NO: 916761 - protein, 9 aa, Homo Sapiens
ILFGQGDFY

SEQ ID NO: 916762 - protein, 9 aa, Homo Sapiens
PIAGQAPGG

SEQ ID NO: 916763 - protein, 9 aa, Homo Sapiens
NCLVASKNG

SEQ ID NO: 916764 - protein, 9 aa, Homo Sapiens
VGSSKFQSR

SEQ ID NO: 916765 - protein, 9 aa, Homo Sapiens
MTRDGVNDA

SEQ ID NO: 916766 - protein, 9 aa, Homo Sapiens
QITQERANS

SEQ ID NO: 916767 - protein, 9 aa, Homo Sapiens
NKNFECHEC

SEQ ID NO: 916768 - protein, 9 aa, Homo Sapiens
RVQNTVQDP

SEQ ID NO: 916769 - protein, 9 aa, Homo Sapiens
RAVVGFAIF

SEQ ID NO: 916770 - protein, 9 aa, Homo Sapiens
YFPDHPLHL

SEQ ID NO: 916771 - protein, 9 aa, Homo Sapiens
FLLNSRVLL

SEQ ID NO: 916772 - protein, 9 aa, Homo Sapiens
PIQSPTQTP

SEQ ID NO: 916773 - protein, 9 aa, Homo Sapiens
SVFPCGDIV

SEQ ID NO: 916774 - protein, 9 aa, Homo Sapiens
LNFTFVTEF

SEQ ID NO: 916775 - protein, 9 aa, Homo Sapiens
RTVTRKSTD

SEQ ID NO: 916776 - protein, 9 aa, Homo Sapiens
APYQGWEGA

SEQ ID NO: 916777 - protein, 9 aa, Homo Sapiens
LRQVTVKLK

SEQ ID NO: 916778 - protein, 9 aa, Homo Sapiens
TRRAWVGVA

SEQ ID NO: 916779 - protein, 9 aa, Homo Sapiens
AERLGVKAM

SEQ ID NO: 916780 - protein, 9 aa, Homo Sapiens
FEEYNNLDL

SEQ ID NO: 916781 - protein, 9 aa, Homo Sapiens
NSKKNESLF

SEQ ID NO: 916782 - protein, 9 aa, Homo Sapiens
SAGIFLCET

SEQ ID NO: 916783 - protein, 9 aa, Homo Sapiens
DGSKEGSPL

SEQ ID NO: 916784 - protein, 9 aa, Homo Sapiens
VTRKSTDSP

SEQ ID NO: 916785 - protein, 9 aa, Homo Sapiens
ALRHHTLFQ

SEQ ID NO: 916786 - protein, 9 aa, Homo Sapiens
EDVTSGYST

SEQ ID NO: 916787 - protein, 9 aa, Homo Sapiens
SYSLTKNPV

SEQ ID NO: 916788 - protein, 9 aa, Homo Sapiens
QLAPIKTIV

SEQ ID NO: 916789 - protein, 9 aa, Homo Sapiens
EREQQLRRE

SEQ ID NO: 916790 - protein, 9 aa, Homo Sapiens
VSGTDDGVR

SEQ ID NO: 916791 - protein, 9 aa, Homo Sapiens
LQANFNLLR

SEQ ID NO: 916792 - protein, 9 aa, Homo Sapiens
KAERASRAK

SEQ ID NO: 916793 - protein, 9 aa, Homo Sapiens
QMFWKTGKL

SEQ ID NO: 916794 - protein, 9 aa, Homo Sapiens
YFHHQKEVR

SEQ ID NO: 916795 - protein, 9 aa, Homo Sapiens
TPGGHAEHH

SEQ ID NO: 916796 - protein, 9 aa, Homo Sapiens
EFAKILHFT

SEQ ID NO: 916797 - protein, 9 aa, Homo Sapiens
DAQKGGEIP

SEQ ID NO: 916798 - protein, 9 aa, Homo Sapiens
PSPKAAPPP

SEQ ID NO: 916799 - protein, 9 aa, Homo Sapiens
APNQELPRL

SEQ ID NO: 916800 - protein, 9 aa, Homo Sapiens
GDDFVTSLF

SEQ ID NO: 916801 - protein, 9 aa, Homo Sapiens
PNQELPRLL

SEQ ID NO: 916802 - protein, 9 aa, Homo Sapiens
SGSKSSTPE

SEQ ID NO: 916803 - protein, 9 aa, Homo Sapiens
KFEVLVSDS

SEQ ID NO: 916804 - protein, 9 aa, Homo Sapiens
ILPADNQKV

SEQ ID NO: 916805 - protein, 9 aa, Homo Sapiens
PIGMGIVKK

SEQ ID NO: 916806 - protein, 9 aa, Homo Sapiens
VEALQEGLG

SEQ ID NO: 916807 - protein, 9 aa, Homo Sapiens
FSEHQLPSE

SEQ ID NO: 916808 - protein, 9 aa, Homo Sapiens
GIRVGHCII

SEQ ID NO: 916809 - protein, 9 aa, Homo Sapiens
KKNESLFWK

SEQ ID NO: 916810 - protein, 9 aa, Homo Sapiens
ATRSVHGDP

SEQ ID NO: 916811 - protein, 9 aa, Homo Sapiens
IVAMTRDGV

SEQ ID NO: 916812 - protein, 9 aa, Homo Sapiens
PCFLLPGDY

SEQ ID NO: 916813 - protein, 9 aa, Homo Sapiens
QPALAEPHL

SEQ ID NO: 916814 - protein, 9 aa, Homo Sapiens
PACIQLIFE

SEQ ID NO: 916815 - protein, 9 aa, Homo Sapiens
SKTHGKSSE

SEQ ID NO: 916816 - protein, 9 aa, Homo Sapiens
DHRAERPFL

SEQ ID NO: 916817 - protein, 9 aa, Homo Sapiens
QGSRGGREA

SEQ ID NO: 916818 - protein, 9 aa, Homo Sapiens
LICKQREIF

SEQ ID NO: 916819 - protein, 9 aa, Homo Sapiens
IKIHPYLLQ

SEQ ID NO: 916820 - protein, 9 aa, Homo Sapiens
SDAKSKTQS

SEQ ID NO: 916821 - protein, 9 aa, Homo Sapiens
EMKIGDPAC

SEQ ID NO: 916822 - protein, 9 aa, Homo Sapiens
FHIPPTPFF

SEQ ID NO: 916823 - protein, 9 aa, Homo Sapiens
FKSGFLYPL

SEQ ID NO: 916824 - protein, 9 aa, Homo Sapiens
ESKQQELEV

SEQ ID NO: 916825 - protein, 9 aa, Homo Sapiens
GLPTPKSDS

SEQ ID NO: 916826 - protein, 9 aa, Homo Sapiens
ASILFDSND

SEQ ID NO: 916827 - protein, 9 aa, Homo Sapiens
GHSIYHDYH

SEQ ID NO: 916828 - protein, 9 aa, Homo Sapiens
KFLWTIEPN

SEQ ID NO: 916829 - protein, 9 aa, Homo Sapiens
MCIMQISSG

SEQ ID NO: 916830 - protein, 9 aa, Homo Sapiens
KESPGAQGP

SEQ ID NO: 916831 - protein, 9 aa, Homo Sapiens
GDPEAVASL

SEQ ID NO: 916832 - protein, 9 aa, Homo Sapiens
NLHAATVNP

SEQ ID NO: 916833 - protein, 9 aa, Homo Sapiens
RVAQRDICI

SEQ ID NO: 916834 - protein, 9 aa, Homo Sapiens
AERYKVNTH

SEQ ID NO: 916835 - protein, 9 aa, Homo Sapiens
QSWQILAQP

SEQ ID NO: 916836 - protein, 9 aa, Homo Sapiens
VDFSQKEWA

SEQ ID NO: 916837 - protein, 9 aa, Homo Sapiens
SSKGRVRRK

SEQ ID NO: 916838 - protein, 9 aa, Homo Sapiens
KIKFLVALL

SEQ ID NO: 916839 - protein, 9 aa, Homo Sapiens
SVLIYFVEK

SEQ ID NO: 916840 - protein, 9 aa, Homo Sapiens
VLFLLLLVT

SEQ ID NO: 916841 - protein, 9 aa, Homo Sapiens
SPGLAPLTL

SEQ ID NO: 916842 - protein, 9 aa, Homo Sapiens
FWKTGKLVS

SEQ ID NO: 916843 - protein, 9 aa, Homo Sapiens
QCVQSKVTK

SEQ ID NO: 916844 - protein, 9 aa, Homo Sapiens
PRVLRLQHS

SEQ ID NO: 916845 - protein, 9 aa, Homo Sapiens
QMLRDELVD

SEQ ID NO: 916846 - protein, 9 aa, Homo Sapiens
TLFFFNTKY

SEQ ID NO: 916847 - protein, 9 aa, Homo Sapiens
VCIVTKCSD

SEQ ID NO: 916848 - protein, 9 aa, Homo Sapiens
ASLPFQAAN

SEQ ID NO: 916849 - protein, 9 aa, Homo Sapiens
RDGKPCLGN

SEQ ID NO: 916850 - protein, 9 aa, Homo Sapiens
RLRVTRSLV

SEQ ID NO: 916851 - protein, 9 aa, Homo Sapiens
LILPPVSVP

SEQ ID NO: 916852 - protein, 9 aa, Homo Sapiens
QDVTVLSPS

SEQ ID NO: 916853 - protein, 9 aa, Homo Sapiens
VLSPPPSPR

SEQ ID NO: 916854 - protein, 9 aa, Homo Sapiens
NLSVNPPSS

SEQ ID NO: 916855 - protein, 9 aa, Homo Sapiens
LAPIKTIVR

SEQ ID NO: 916856 - protein, 9 aa, Homo Sapiens
CTDSLGYTA

SEQ ID NO: 916857 - protein, 9 aa, Homo Sapiens
MLPQNLWHI

SEQ ID NO: 916858 - protein, 9 aa, Homo Sapiens
LVKPEELNR

SEQ ID NO: 916859 - protein, 9 aa, Homo Sapiens
HNCLVASKN

SEQ ID NO: 916860 - protein, 9 aa, Homo Sapiens
MERIRLQWS

SEQ ID NO: 916861 - protein, 9 aa, Homo Sapiens
DEMADQLMT

SEQ ID NO: 916862 - protein, 9 aa, Homo Sapiens
IEELEEEIK

SEQ ID NO: 916863 - protein, 9 aa, Homo Sapiens
SSPEKPLSD

SEQ ID NO: 916864 - protein, 9 aa, Homo Sapiens
LKFLTSKIF

SEQ ID NO: 916865 - protein, 9 aa, Homo Sapiens
NQELPRLLA

SEQ ID NO: 916866 - protein, 9 aa, Homo Sapiens
KFVVMVSTC

SEQ ID NO: 916867 - protein, 9 aa, Homo Sapiens
KIIHTGETP

SEQ ID NO: 916868 - protein, 9 aa, Homo Sapiens
TLTEKKSTL

SEQ ID NO: 916869 - protein, 9 aa, Homo Sapiens
QRGNKIEVN

SEQ ID NO: 916870 - protein, 9 aa, Homo Sapiens
EDADEERAD

SEQ ID NO: 916871 - protein, 9 aa, Homo Sapiens
PLYHPTIMT

SEQ ID NO: 916872 - protein, 9 aa, Homo Sapiens
SSVKSKVFQ

SEQ ID NO: 916873 - protein, 9 aa, Homo Sapiens
PKVIFTLEE

SEQ ID NO: 916874 - protein, 9 aa, Homo Sapiens
SEGLLFRYK

SEQ ID NO: 916875 - protein, 9 aa, Homo Sapiens
PTFQIDNTT

SEQ ID NO: 916876 - protein, 9 aa, Homo Sapiens
TANLVAKRH

SEQ ID NO: 916877 - protein, 9 aa, Homo Sapiens
CGNQLQTLP

SEQ ID NO: 916878 - protein, 9 aa, Homo Sapiens
TKYWTLLSN

SEQ ID NO: 916879 - protein, 9 aa, Homo Sapiens
ELSLPRKGG

SEQ ID NO: 916880 - protein, 9 aa, Homo Sapiens
ISEKKYCQP

SEQ ID NO: 916881 - protein, 9 aa, Homo Sapiens
ITGNKIVNE

SEQ ID NO: 916882 - protein, 9 aa, Homo Sapiens
ITIKPTSKF

SEQ ID NO: 916883 - protein, 9 aa, Homo Sapiens
SNSGLSPGL

SEQ ID NO: 916884 - protein, 9 aa, Homo Sapiens
SFFISHQRN

SEQ ID NO: 916885 - protein, 9 aa, Homo Sapiens
GLGGCGATA

SEQ ID NO: 916886 - protein, 9 aa, Homo Sapiens
DPNTEKNLT

SEQ ID NO: 916887 - protein, 9 aa, Homo Sapiens
CKYWDVPPP

SEQ ID NO: 916888 - protein, 9 aa, Homo Sapiens
PGLHAITIK

SEQ ID NO: 916889 - protein, 9 aa, Homo Sapiens
AIRSAGIFL

SEQ ID NO: 916890 - protein, 9 aa, Homo Sapiens
SKGAFLYKP

SEQ ID NO: 916891 - protein, 9 aa, Homo Sapiens
GFLKCKKDK

SEQ ID NO: 916892 - protein, 9 aa, Homo Sapiens
FALFLMAAG

SEQ ID NO: 916893 - protein, 9 aa, Homo Sapiens
KEKAKIVTL

SEQ ID NO: 916894 - protein, 9 aa, Homo Sapiens
DKLRQVTVK

SEQ ID NO: 916895 - protein, 9 aa, Homo Sapiens
VSHKVGRDG

SEQ ID NO: 916896 - protein, 9 aa, Homo Sapiens
LRNSSHEKA

SEQ ID NO: 916897 - protein, 9 aa, Homo Sapiens
RQGSRGGRE

SEQ ID NO: 916898 - protein, 9 aa, Homo Sapiens
IPRQDKVPQ

SEQ ID NO: 916899 - protein, 9 aa, Homo Sapiens
PKTLSLTVF

SEQ ID NO: 916900 - protein, 9 aa, Homo Sapiens
KVFQESSKK

SEQ ID NO: 916901 - protein, 9 aa, Homo Sapiens
VITTTKRPV

SEQ ID NO: 916902 - protein, 9 aa, Homo Sapiens
SQLKAEKGL

SEQ ID NO: 916903 - protein, 9 aa, Homo Sapiens
WAGLRLDQL

SEQ ID NO: 916904 - protein, 9 aa, Homo Sapiens
LPGDYSHET

SEQ ID NO: 916905 - protein, 9 aa, Homo Sapiens
SYISEESFK

SEQ ID NO: 916906 - protein, 9 aa, Homo Sapiens
GKNAVLKPS

SEQ ID NO: 916907 - protein, 9 aa, Homo Sapiens
RTLEGIYRY

SEQ ID NO: 916908 - protein, 9 aa, Homo Sapiens
DIAPLNFYE

SEQ ID NO: 916909 - protein, 9 aa, Homo Sapiens
KPIQSPTQT

SEQ ID NO: 916910 - protein, 9 aa, Homo Sapiens
RTPYWALFG

SEQ ID NO: 916911 - protein, 9 aa, Homo Sapiens
WLILPADNQ

SEQ ID NO: 916912 - protein, 9 aa, Homo Sapiens
KTLTEKTIT

SEQ ID NO: 916913 - protein, 9 aa, Homo Sapiens
LRREQEERE

SEQ ID NO: 916914 - protein, 9 aa, Homo Sapiens
HAEHHGKPF

SEQ ID NO: 916915 - protein, 9 aa, Homo Sapiens
SGTKLSVKP

SEQ ID NO: 916916 - protein, 9 aa, Homo Sapiens
VDSGYRSFR

SEQ ID NO: 916917 - protein, 9 aa, Homo Sapiens
ECGKSFYRS

SEQ ID NO: 916918 - protein, 9 aa, Homo Sapiens
FLKCKKDKA

SEQ ID NO: 916919 - protein, 9 aa, Homo Sapiens
TGSSFGLLA

SEQ ID NO: 916920 - protein, 9 aa, Homo Sapiens
VPAHGYCSR

SEQ ID NO: 916921 - protein, 9 aa, Homo Sapiens
SQESIFVRI

SEQ ID NO: 916922 - protein, 9 aa, Homo Sapiens
TVLFSHGKA

SEQ ID NO: 916923 - protein, 9 aa, Homo Sapiens
DHRYYAGRC

SEQ ID NO: 916924 - protein, 9 aa, Homo Sapiens
LKSLKQEKE

SEQ ID NO: 916925 - protein, 9 aa, Homo Sapiens
KEDEDEVED

SEQ ID NO: 916926 - protein, 9 aa, Homo Sapiens
NWQGHGLGG

SEQ ID NO: 916927 - protein, 9 aa, Homo Sapiens
VLLIPVGQE

SEQ ID NO: 916928 - protein, 9 aa, Homo Sapiens
PYSEEEEDQ

SEQ ID NO: 916929 - protein, 9 aa, Homo Sapiens
PDRQNFCPR

SEQ ID NO: 916930 - protein, 9 aa, Homo Sapiens
ISSGYYLQT

SEQ ID NO: 916931 - protein, 9 aa, Homo Sapiens
VLFPNSSCG

SEQ ID NO: 916932 - protein, 9 aa, Homo Sapiens
KYPWAGLRL

SEQ ID NO: 916933 - protein, 9 aa, Homo Sapiens
QMDKTRRHP

SEQ ID NO: 916934 - protein, 9 aa, Homo Sapiens
QLPCIPLVK

SEQ ID NO: 916935 - protein, 9 aa, Homo Sapiens
SHVPTRSAR

SEQ ID NO: 916936 - protein, 9 aa, Homo Sapiens
VLFLDFSDK

SEQ ID NO: 916937 - protein, 9 aa, Homo Sapiens
ETQSVHHLV

SEQ ID NO: 916938 - protein, 9 aa, Homo Sapiens
LTSKIFGVS

SEQ ID NO: 916939 - protein, 9 aa, Homo Sapiens
PGVRNYEFW

SEQ ID NO: 916940 - protein, 9 aa, Homo Sapiens
LFPNSSCGS

SEQ ID NO: 916941 - protein, 9 aa, Homo Sapiens
LIDFGKITP

SEQ ID NO: 916942 - protein, 9 aa, Homo Sapiens
IEITKEMTM

SEQ ID NO: 916943 - protein, 9 aa, Homo Sapiens
TNTILSKFS

SEQ ID NO: 916944 - protein, 9 aa, Homo Sapiens
IKRRRKSCQ

SEQ ID NO: 916945 - protein, 9 aa, Homo Sapiens
PGKEGPPDL

SEQ ID NO: 916946 - protein, 9 aa, Homo Sapiens
LVAGFLSLV

SEQ ID NO: 916947 - protein, 9 aa, Homo Sapiens
LKKSDDSVN

SEQ ID NO: 916948 - protein, 9 aa, Homo Sapiens
FLVGWCSLT

SEQ ID NO: 916949 - protein, 9 aa, Homo Sapiens
VFSANYDLV

SEQ ID NO: 916950 - protein, 9 aa, Homo Sapiens
HEKKKKVCK

SEQ ID NO: 916951 - protein, 9 aa, Homo Sapiens
DQLMTLAYD

SEQ ID NO: 916952 - protein, 9 aa, Homo Sapiens
TKLYYARVT

SEQ ID NO: 916953 - protein, 9 aa, Homo Sapiens
LQVILNCLT

SEQ ID NO: 916954 - protein, 9 aa, Homo Sapiens
MLPNIRESS

SEQ ID NO: 916955 - protein, 9 aa, Homo Sapiens
QKGGEIPGS

SEQ ID NO: 916956 - protein, 9 aa, Homo Sapiens
RSASLAALA

SEQ ID NO: 916957 - protein, 9 aa, Homo Sapiens
TKVKEEVKT

SEQ ID NO: 916958 - protein, 9 aa, Homo Sapiens
PHELVNRLI

SEQ ID NO: 916959 - protein, 9 aa, Homo Sapiens
ELPRLLARQ

SEQ ID NO: 916960 - protein, 9 aa, Homo Sapiens
CVDEDVFYN

SEQ ID NO: 916961 - protein, 9 aa, Homo Sapiens
GIRDKIALL

SEQ ID NO: 916962 - protein, 9 aa, Homo Sapiens
LEEDPGPDG

SEQ ID NO: 916963 - protein, 9 aa, Homo Sapiens
RDSSRHPRS

SEQ ID NO: 916964 - protein, 9 aa, Homo Sapiens
QNTVQDPAY

SEQ ID NO: 916965 - protein, 9 aa, Homo Sapiens
YLGNGWKPP

SEQ ID NO: 916966 - protein, 9 aa, Homo Sapiens
AKKREFAKN

SEQ ID NO: 916967 - protein, 9 aa, Homo Sapiens
SMGMSDVFS

SEQ ID NO: 916968 - protein, 9 aa, Homo Sapiens
ERQNLSVNP

SEQ ID NO: 916969 - protein, 9 aa, Homo Sapiens
ILPPVSVPK

SEQ ID NO: 916970 - protein, 9 aa, Homo Sapiens
SLLKSQPYR

SEQ ID NO: 916971 - protein, 9 aa, Homo Sapiens
IVTMNSNFV

SEQ ID NO: 916972 - protein, 9 aa, Homo Sapiens
LNRENAYHC

SEQ ID NO: 916973 - protein, 9 aa, Homo Sapiens
QGSSKFRNA

SEQ ID NO: 916974 - protein, 9 aa, Homo Sapiens
LSRDGGLHP

SEQ ID NO: 916975 - protein, 9 aa, Homo Sapiens
YCPKCRGDK

SEQ ID NO: 916976 - protein, 9 aa, Homo Sapiens
YISEESFKA

SEQ ID NO: 916977 - protein, 9 aa, Homo Sapiens
GYFPIIFRK

SEQ ID NO: 916978 - protein, 9 aa, Homo Sapiens
VTTSITFKK

SEQ ID NO: 916979 - protein, 9 aa, Homo Sapiens
IFTLEEPTP

SEQ ID NO: 916980 - protein, 9 aa, Homo Sapiens
LTVNSGTKS

SEQ ID NO: 916981 - protein, 9 aa, Homo Sapiens
LSGGQRTAL

SEQ ID NO: 916982 - protein, 9 aa, Homo Sapiens
SKSQDLGPK

SEQ ID NO: 916983 - protein, 9 aa, Homo Sapiens
SKNGIAPVP

SEQ ID NO: 916984 - protein, 9 aa, Homo Sapiens
ESENTRILF

SEQ ID NO: 916985 - protein, 9 aa, Homo Sapiens
SMSTRRAWV

SEQ ID NO: 916986 - protein, 9 aa, Homo Sapiens
SDFEKDDDA

SEQ ID NO: 916987 - protein, 9 aa, Homo Sapiens
RVLRLQHSG

SEQ ID NO: 916988 - protein, 9 aa, Homo Sapiens
LSSVKSKVF

SEQ ID NO: 916989 - protein, 9 aa, Homo Sapiens
STPTFNILF

SEQ ID NO: 916990 - protein, 9 aa, Homo Sapiens
SAACILFGQ

SEQ ID NO: 916991 - protein, 9 aa, Homo Sapiens
EKVPEIMGA

SEQ ID NO: 916992 - protein, 9 aa, Homo Sapiens
QEEREQQLR

SEQ ID NO: 916993 - protein, 9 aa, Homo Sapiens
VHGFVSPTS

SEQ ID NO: 916994 - protein, 9 aa, Homo Sapiens
SSKSQDLGP

SEQ ID NO: 916995 - protein, 9 aa, Homo Sapiens
NWTSLPTTS

SEQ ID NO: 916996 - protein, 9 aa, Homo Sapiens
RKRTPRGNK

SEQ ID NO: 916997 - protein, 9 aa, Homo Sapiens
QQVIYLQGS

SEQ ID NO: 916998 - protein, 9 aa, Homo Sapiens
RCSPHYILN

SEQ ID NO: 916999 - protein, 9 aa, Homo Sapiens
RERMNTVTS

SEQ ID NO: 917000 - protein, 9 aa, Homo Sapiens
ETPNKCEEC

SEQ ID NO: 917001 - protein, 9 aa, Homo Sapiens
FLHRGLTQP

SEQ ID NO: 917002 - protein, 9 aa, Homo Sapiens
GYRMEQLRN

SEQ ID NO: 917003 - protein, 9 aa, Homo Sapiens
DREREKDRE

SEQ ID NO: 917004 - protein, 9 aa, Homo Sapiens
QRIYFDLNP

SEQ ID NO: 917005 - protein, 9 aa, Homo Sapiens
LLSQGSSKF

SEQ ID NO: 917006 - protein, 9 aa, Homo Sapiens
PGPKGSMGP

SEQ ID NO: 917007 - protein, 9 aa, Homo Sapiens
ISCKEAGLS

SEQ ID NO: 917008 - protein, 9 aa, Homo Sapiens
RNETLREVW

SEQ ID NO: 917009 - protein, 9 aa, Homo Sapiens
MLHSIDWID

SEQ ID NO: 917010 - protein, 9 aa, Homo Sapiens
GSSSATTGC

SEQ ID NO: 917011 - protein, 9 aa, Homo Sapiens
KGEKGERGK

SEQ ID NO: 917012 - protein, 9 aa, Homo Sapiens
KAVQLYLHK

SEQ ID NO: 917013 - protein, 9 aa, Homo Sapiens
DPACIQLIF

SEQ ID NO: 917014 - protein, 9 aa, Homo Sapiens
LENRQKQFN

SEQ ID NO: 917015 - protein, 9 aa, Homo Sapiens
MSRLETEMK

SEQ ID NO: 917016 - protein, 9 aa, Homo Sapiens
LLSGGQRTA

SEQ ID NO: 917017 - protein, 9 aa, Homo Sapiens
KDKLNLKKS

SEQ ID NO: 917018 - protein, 9 aa, Homo Sapiens
QGLFRLGKA

SEQ ID NO: 917019 - protein, 9 aa, Homo Sapiens
AAIVVFLEF

SEQ ID NO: 917020 - protein, 9 aa, Homo Sapiens
TTASSKGRV

SEQ ID NO: 917021 - protein, 9 aa, Homo Sapiens
LIEKREVIL

SEQ ID NO: 917022 - protein, 9 aa, Homo Sapiens
VNCTDSLGY

SEQ ID NO: 917023 - protein, 9 aa, Homo Sapiens
GQPGEKESP

SEQ ID NO: 917024 - protein, 9 aa, Homo Sapiens
MQISSGYYL

SEQ ID NO: 917025 - protein, 9 aa, Homo Sapiens
TTTSSSKIF

SEQ ID NO: 917026 - protein, 9 aa, Homo Sapiens
FSNLPNIFR

SEQ ID NO: 917027 - protein, 9 aa, Homo Sapiens
KWLEDVTSG

SEQ ID NO: 917028 - protein, 9 aa, Homo Sapiens
IAANMTEWK

SEQ ID NO: 917029 - protein, 9 aa, Homo Sapiens
SEEEEDQES

SEQ ID NO: 917030 - protein, 9 aa, Homo Sapiens
PRGGSVQIV

SEQ ID NO: 917031 - protein, 9 aa, Homo Sapiens
FSEEQLRQR

SEQ ID NO: 917032 - protein, 9 aa, Homo Sapiens
RSDMDWEFA

SEQ ID NO: 917033 - protein, 9 aa, Homo Sapiens
HMLQSFINY

SEQ ID NO: 917034 - protein, 9 aa, Homo Sapiens
NSEIFSPPA

SEQ ID NO: 917035 - protein, 9 aa, Homo Sapiens
LSQPKATPL

SEQ ID NO: 917036 - protein, 9 aa, Homo Sapiens
PEFIPRVLR

SEQ ID NO: 917037 - protein, 9 aa, Homo Sapiens
LLQDNKFHH

SEQ ID NO: 917038 - protein, 9 aa, Homo Sapiens
DKISDGIRD

SEQ ID NO: 917039 - protein, 9 aa, Homo Sapiens
EEGTNSEIF

SEQ ID NO: 917040 - protein, 9 aa, Homo Sapiens
PNQRLLKVE

SEQ ID NO: 917041 - protein, 9 aa, Homo Sapiens
SGARPCLAS

SEQ ID NO: 917042 - protein, 9 aa, Homo Sapiens
ASPKSCYKL

SEQ ID NO: 917043 - protein, 9 aa, Homo Sapiens
VNEKSSLEG

SEQ ID NO: 917044 - protein, 9 aa, Homo Sapiens
HQAKEKLAR

SEQ ID NO: 917045 - protein, 9 aa, Homo Sapiens
RNLSPIKPG

SEQ ID NO: 917046 - protein, 9 aa, Homo Sapiens
SDLSQSQRL

SEQ ID NO: 917047 - protein, 9 aa, Homo Sapiens
QILAQPWRA

SEQ ID NO: 917048 - protein, 9 aa, Homo Sapiens
PTTPILVSS

SEQ ID NO: 917049 - protein, 9 aa, Homo Sapiens
INCSIQKDK

SEQ ID NO: 917050 - protein, 9 aa, Homo Sapiens
TRASLKLVK

SEQ ID NO: 917051 - protein, 9 aa, Homo Sapiens
WYQFALFLM

SEQ ID NO: 917052 - protein, 9 aa, Homo Sapiens
NLKKSDDSV

SEQ ID NO: 917053 - protein, 9 aa, Homo Sapiens
LRGQVPGYS

SEQ ID NO: 917054 - protein, 9 aa, Homo Sapiens
YENEEKVSL

SEQ ID NO: 917055 - protein, 9 aa, Homo Sapiens
CSGGGGEKA

SEQ ID NO: 917056 - protein, 9 aa, Homo Sapiens
EKSQDDIIP

SEQ ID NO: 917057 - protein, 9 aa, Homo Sapiens
ITSSSQCLH

SEQ ID NO: 917058 - protein, 9 aa, Homo Sapiens
IIKANYHSS

SEQ ID NO: 917059 - protein, 9 aa, Homo Sapiens
IAVILKNLS

SEQ ID NO: 917060 - protein, 9 aa, Homo Sapiens
ETGNLTKLY

SEQ ID NO: 917061 - protein, 9 aa, Homo Sapiens
SPTFSPGAG

SEQ ID NO: 917062 - protein, 9 aa, Homo Sapiens
DKQESQITY

SEQ ID NO: 917063 - protein, 9 aa, Homo Sapiens
NLVAKRHFV

SEQ ID NO: 917064 - protein, 9 aa, Homo Sapiens
TGDDFVTSL

SEQ ID NO: 917065 - protein, 9 aa, Homo Sapiens
SDSYLQLHN

SEQ ID NO: 917066 - protein, 9 aa, Homo Sapiens
LDPEGSKDK

SEQ ID NO: 917067 - protein, 9 aa, Homo Sapiens
MLRDELVDS

SEQ ID NO: 917068 - protein, 9 aa, Homo Sapiens
SNRRVLVTG

SEQ ID NO: 917069 - protein, 9 aa, Homo Sapiens
KVPSTPSPK

SEQ ID NO: 917070 - protein, 9 aa, Homo Sapiens
GFLHRGLTQ

SEQ ID NO: 917071 - protein, 9 aa, Homo Sapiens
GERVAQRDI

SEQ ID NO: 917072 - protein, 9 aa, Homo Sapiens
NKFHHFKPV

SEQ ID NO: 917073 - protein, 9 aa, Homo Sapiens
WSQQVIYLQ

SEQ ID NO: 917074 - protein, 9 aa, Homo Sapiens
EQELRDDNF

SEQ ID NO: 917075 - protein, 9 aa, Homo Sapiens
AVAGGRLEK

SEQ ID NO: 917076 - protein, 9 aa, Homo Sapiens
PPADGSKEG

SEQ ID NO: 917077 - protein, 9 aa, Homo Sapiens
SEKKYCQPP

SEQ ID NO: 917078 - protein, 9 aa, Homo Sapiens
EKTKVKEEV

SEQ ID NO: 917079 - protein, 9 aa, Homo Sapiens
VPGYSPSQN

SEQ ID NO: 917080 - protein, 9 aa, Homo Sapiens
LQSKAVKIL

SEQ ID NO: 917081 - protein, 9 aa, Homo Sapiens
EKEDADEER

SEQ ID NO: 917082 - protein, 9 aa, Homo Sapiens
TVTRKSTDS

SEQ ID NO: 917083 - protein, 9 aa, Homo Sapiens
LVIAEKKAR

SEQ ID NO: 917084 - protein, 9 aa, Homo Sapiens
QENFFAPAD

SEQ ID NO: 917085 - protein, 9 aa, Homo Sapiens
ANFNLLRDI

SEQ ID NO: 917086 - protein, 9 aa, Homo Sapiens
CVPYPENEI

SEQ ID NO: 917087 - protein, 9 aa, Homo Sapiens
QVPCRLPRG

SEQ ID NO: 917088 - protein, 9 aa, Homo Sapiens
CRTHWIDVI

SEQ ID NO: 917089 - protein, 9 aa, Homo Sapiens
NTEDVSSEL

SEQ ID NO: 917090 - protein, 9 aa, Homo Sapiens
ALAGVPGVE

SEQ ID NO: 917091 - protein, 9 aa, Homo Sapiens
VSSPGTGTL

SEQ ID NO: 917092 - protein, 9 aa, Homo Sapiens
GREAAGSQA

SEQ ID NO: 917093 - protein, 9 aa, Homo Sapiens
EIMGAICAQ

SEQ ID NO: 917094 - protein, 9 aa, Homo Sapiens
PGDCYKEIF

SEQ ID NO: 917095 - protein, 9 aa, Homo Sapiens
IQLPKQTPL

SEQ ID NO: 917096 - protein, 9 aa, Homo Sapiens
EKDRELERE

SEQ ID NO: 917097 - protein, 9 aa, Homo Sapiens
TSLLKSQPY

SEQ ID NO: 917098 - protein, 9 aa, Homo Sapiens
AGIEITKEM

SEQ ID NO: 917099 - protein, 9 aa, Homo Sapiens
SPSQNPGMT

SEQ ID NO: 917100 - protein, 9 aa, Homo Sapiens
VDEGYRMKN

SEQ ID NO: 917101 - protein, 9 aa, Homo Sapiens
FNLPFQFTR

SEQ ID NO: 917102 - protein, 9 aa, Homo Sapiens
GLNVPRNQL

SEQ ID NO: 917103 - protein, 9 aa, Homo Sapiens
IFQVDPETK

SEQ ID NO: 917104 - protein, 9 aa, Homo Sapiens
RLAETLNPS

SEQ ID NO: 917105 - protein, 9 aa, Homo Sapiens
KQREIFQNS

SEQ ID NO: 917106 - protein, 9 aa, Homo Sapiens
PKATLCGDS

SEQ ID NO: 917107 - protein, 9 aa, Homo Sapiens
AVASLHWDG

SEQ ID NO: 917108 - protein, 9 aa, Homo Sapiens
GGHAEHHGK

SEQ ID NO: 917109 - protein, 9 aa, Homo Sapiens
TLCGDSFPD

SEQ ID NO: 917110 - protein, 9 aa, Homo Sapiens
EAVASLHWD

SEQ ID NO: 917111 - protein, 9 aa, Homo Sapiens
TEFGQWNMS

SEQ ID NO: 917112 - protein, 9 aa, Homo Sapiens
EVLVSDSVF

SEQ ID NO: 917113 - protein, 9 aa, Homo Sapiens
CYKEIFQYV

SEQ ID NO: 917114 - protein, 9 aa, Homo Sapiens
CLQVPKLDE

SEQ ID NO: 917115 - protein, 9 aa, Homo Sapiens
VKKGSPEPW

SEQ ID NO: 917116 - protein, 9 aa, Homo Sapiens
GYGTFFFCR

SEQ ID NO: 917117 - protein, 9 aa, Homo Sapiens
WTGEGDTPK

SEQ ID NO: 917118 - protein, 9 aa, Homo Sapiens
IILNQRNCM

SEQ ID NO: 917119 - protein, 9 aa, Homo Sapiens
KLYYARVTA

SEQ ID NO: 917120 - protein, 9 aa, Homo Sapiens
SALLAKKRE

SEQ ID NO: 917121 - protein, 9 aa, Homo Sapiens
KTKVCIVTK

SEQ ID NO: 917122 - protein, 9 aa, Homo Sapiens
PSTVPSERS

SEQ ID NO: 917123 - protein, 9 aa, Homo Sapiens
QCEDCGKAF

SEQ ID NO: 917124 - protein, 9 aa, Homo Sapiens
SSQFLGYDQ

SEQ ID NO: 917125 - protein, 9 aa, Homo Sapiens
YFDLNPTGQ

SEQ ID NO: 917126 - protein, 9 aa, Homo Sapiens
QTVVEVLGS

SEQ ID NO: 917127 - protein, 9 aa, Homo Sapiens
DAKSKTQSD

SEQ ID NO: 917128 - protein, 9 aa, Homo Sapiens
LDDEPIVQD

SEQ ID NO: 917129 - protein, 9 aa, Homo Sapiens
PPSESFDAV

SEQ ID NO: 917130 - protein, 9 aa, Homo Sapiens
KLTVHGFVS

SEQ ID NO: 917131 - protein, 9 aa, Homo Sapiens
PPGPKGSMG

SEQ ID NO: 917132 - protein, 9 aa, Homo Sapiens
TKSNGHHQY

SEQ ID NO: 917133 - protein, 9 aa, Homo Sapiens
GNILGEKLV

SEQ ID NO: 917134 - protein, 9 aa, Homo Sapiens
GYDLGGRFG

SEQ ID NO: 917135 - protein, 9 aa, Homo Sapiens
VKVLLIPVG

SEQ ID NO: 917136 - protein, 9 aa, Homo Sapiens
LEGEMSYPR

SEQ ID NO: 917137 - protein, 9 aa, Homo Sapiens
LWYQFALFL

SEQ ID NO: 917138 - protein, 9 aa, Homo Sapiens
VPRGGSVQI

SEQ ID NO: 917139 - protein, 9 aa, Homo Sapiens
SPKSCYKLF

SEQ ID NO: 917140 - protein, 9 aa, Homo Sapiens
KKSYWKLAL

SEQ ID NO: 917141 - protein, 9 aa, Homo Sapiens
LKRLLYTGK

SEQ ID NO: 917142 - protein, 9 aa, Homo Sapiens
WNHVITTTK

SEQ ID NO: 917143 - protein, 9 aa, Homo Sapiens
ELLPGSPNL

SEQ ID NO: 917144 - protein, 9 aa, Homo Sapiens
SVNPPSSLE

SEQ ID NO: 917145 - protein, 9 aa, Homo Sapiens
HCIIEINGQ

SEQ ID NO: 917146 - protein, 9 aa, Homo Sapiens
EISYYNMER

SEQ ID NO: 917147 - protein, 9 aa, Homo Sapiens
NYEFWDKDK

SEQ ID NO: 917148 - protein, 9 aa, Homo Sapiens
ADPKPILPQ

SEQ ID NO: 917149 - protein, 9 aa, Homo Sapiens
MKSYRCRLA

SEQ ID NO: 917150 - protein, 9 aa, Homo Sapiens
PGNKVIPLF

SEQ ID NO: 917151 - protein, 9 aa, Homo Sapiens
LLIKRKFGF

SEQ ID NO: 917152 - protein, 9 aa, Homo Sapiens
LLGERVAQR

SEQ ID NO: 917153 - protein, 9 aa, Homo Sapiens
GAETRLQNG

SEQ ID NO: 917154 - protein, 9 aa, Homo Sapiens
LPTPKSDSY

SEQ ID NO: 917155 - protein, 9 aa, Homo Sapiens
FSPSYVPVV

SEQ ID NO: 917156 - protein, 9 aa, Homo Sapiens
ENEEKVSLE

SEQ ID NO: 917157 - protein, 9 aa, Homo Sapiens
FGVSDHIRL

SEQ ID NO: 917158 - protein, 9 aa, Homo Sapiens
AKRPHELVN

SEQ ID NO: 917159 - protein, 9 aa, Homo Sapiens
FFLKEGRQL

SEQ ID NO: 917160 - protein, 9 aa, Homo Sapiens
NFPQMGITN

SEQ ID NO: 917161 - protein, 9 aa, Homo Sapiens
DFSVQWNQI

SEQ ID NO: 917162 - protein, 9 aa, Homo Sapiens
KKYCQPPDR

SEQ ID NO: 917163 - protein, 9 aa, Homo Sapiens
LLAKKREFA

SEQ ID NO: 917164 - protein, 9 aa, Homo Sapiens
LPRPPKTLK

SEQ ID NO: 917165 - protein, 9 aa, Homo Sapiens
LVDFYMAIV

SEQ ID NO: 917166 - protein, 9 aa, Homo Sapiens
FCYKFRSES

SEQ ID NO: 917167 - protein, 9 aa, Homo Sapiens
NQLQGMLYS

SEQ ID NO: 917168 - protein, 9 aa, Homo Sapiens
GTGKPIQSP

SEQ ID NO: 917169 - protein, 9 aa, Homo Sapiens
GGGGEKAWP

SEQ ID NO: 917170 - protein, 9 aa, Homo Sapiens
HHGKPFCHK

SEQ ID NO: 917171 - protein, 9 aa, Homo Sapiens
FVSPTSFVY

SEQ ID NO: 917172 - protein, 9 aa, Homo Sapiens
HAAIVVFLE

SEQ ID NO: 917173 - protein, 9 aa, Homo Sapiens
DRELERERA

SEQ ID NO: 917174 - protein, 9 aa, Homo Sapiens
TIILVLPFT

SEQ ID NO: 917175 - protein, 9 aa, Homo Sapiens
KSELKRCYW

SEQ ID NO: 917176 - protein, 9 aa, Homo Sapiens
CSIQKDKTY

SEQ ID NO: 917177 - protein, 9 aa, Homo Sapiens
EGYRMKNHH

SEQ ID NO: 917178 - protein, 9 aa, Homo Sapiens
FSPPACRSP

SEQ ID NO: 917179 - protein, 9 aa, Homo Sapiens
LLSNLVASL

SEQ ID NO: 917180 - protein, 9 aa, Homo Sapiens
TDDGVRSDS

SEQ ID NO: 917181 - protein, 9 aa, Homo Sapiens
EGLDINFLE

SEQ ID NO: 917182 - protein, 9 aa, Homo Sapiens
IITRNSHLA

SEQ ID NO: 917183 - protein, 9 aa, Homo Sapiens
FVEKDDHTS

SEQ ID NO: 917184 - protein, 9 aa, Homo Sapiens
QKKLASGDE

SEQ ID NO: 917185 - protein, 9 aa, Homo Sapiens
HRYYAGRCS

SEQ ID NO: 917186 - protein, 9 aa, Homo Sapiens
REILLYFFS

SEQ ID NO: 917187 - protein, 9 aa, Homo Sapiens
PTGDSGALP

SEQ ID NO: 917188 - protein, 9 aa, Homo Sapiens
LDDPFGPAG

SEQ ID NO: 917189 - protein, 9 aa, Homo Sapiens
TSSGTKLSV

SEQ ID NO: 917190 - protein, 9 aa, Homo Sapiens
QRSERSIST

SEQ ID NO: 917191 - protein, 9 aa, Homo Sapiens
EVAVKTPTE

SEQ ID NO: 917192 - protein, 9 aa, Homo Sapiens
PGDKEDDGE

SEQ ID NO: 917193 - protein, 9 aa, Homo Sapiens
GVSRDSCYV

SEQ ID NO: 917194 - protein, 9 aa, Homo Sapiens
PADGSKEGS

SEQ ID NO: 917195 - protein, 9 aa, Homo Sapiens
SLKLVKTCQ

SEQ ID NO: 917196 - protein, 9 aa, Homo Sapiens
FRNAPRSSC

SEQ ID NO: 917197 - protein, 9 aa, Homo Sapiens
FISPRHGGA

SEQ ID NO: 917198 - protein, 9 aa, Homo Sapiens
SEVANSPSS

SEQ ID NO: 917199 - protein, 9 aa, Homo Sapiens
PNPLRQRLK

SEQ ID NO: 917200 - protein, 9 aa, Homo Sapiens
LKLVKTCQE

SEQ ID NO: 917201 - protein, 9 aa, Homo Sapiens
KSSTTEGRL

SEQ ID NO: 917202 - protein, 9 aa, Homo Sapiens
THWIDVIRL

SEQ ID NO: 917203 - protein, 9 aa, Homo Sapiens
FSANYDLVL

SEQ ID NO: 917204 - protein, 9 aa, Homo Sapiens
TLCVSTYEI

SEQ ID NO: 917205 - protein, 9 aa, Homo Sapiens
LNLGRDFSV

SEQ ID NO: 917206 - protein, 9 aa, Homo Sapiens
FDPNTEKNL

SEQ ID NO: 917207 - protein, 9 aa, Homo Sapiens
ICQIEAFGF

SEQ ID NO: 917208 - protein, 9 aa, Homo Sapiens
CLLLVLMAK

SEQ ID NO: 917209 - protein, 9 aa, Homo Sapiens
RFCYGGLDL

SEQ ID NO: 917210 - protein, 9 aa, Homo Sapiens
NMISLLEQE

SEQ ID NO: 917211 - protein, 9 aa, Homo Sapiens
GLWLGCLLL

SEQ ID NO: 917212 - protein, 9 aa, Homo Sapiens
YTGYFPIIF

SEQ ID NO: 917213 - protein, 9 aa, Homo Sapiens
TDEKSQDDI

SEQ ID NO: 917214 - protein, 9 aa, Homo Sapiens
RTPCFSSPN

SEQ ID NO: 917215 - protein, 9 aa, Homo Sapiens
VSSSCQSVS

SEQ ID NO: 917216 - protein, 9 aa, Homo Sapiens
TLTVSPGVF

SEQ ID NO: 917217 - protein, 9 aa, Homo Sapiens
SRGGREAAG

SEQ ID NO: 917218 - protein, 9 aa, Homo Sapiens
ALISHQRIY

SEQ ID NO: 917219 - protein, 9 aa, Homo Sapiens
IIHATQDAL

SEQ ID NO: 917220 - protein, 9 aa, Homo Sapiens
SCYVKELGV

SEQ ID NO: 917221 - protein, 9 aa, Homo Sapiens
SSQCLHGLV

SEQ ID NO: 917222 - protein, 9 aa, Homo Sapiens
SSSQCLHGL

SEQ ID NO: 917223 - protein, 9 aa, Homo Sapiens
VKILAQEMM

SEQ ID NO: 917224 - protein, 9 aa, Homo Sapiens
KPSHCKCGV

SEQ ID NO: 917225 - protein, 9 aa, Homo Sapiens
VSLEAFFVF

SEQ ID NO: 917226 - protein, 9 aa, Homo Sapiens
PVDKTKDKS

SEQ ID NO: 917227 - protein, 9 aa, Homo Sapiens
EVSGLCRRG

SEQ ID NO: 917228 - protein, 9 aa, Homo Sapiens
LVEKSTTYH

SEQ ID NO: 917229 - protein, 9 aa, Homo Sapiens
LLTGAVGFL

SEQ ID NO: 917230 - protein, 9 aa, Homo Sapiens
TLEGIYRYG

SEQ ID NO: 917231 - protein, 9 aa, Homo Sapiens
WTSLPTTSF

SEQ ID NO: 917232 - protein, 9 aa, Homo Sapiens
LEALVLFLD

SEQ ID NO: 917233 - protein, 9 aa, Homo Sapiens
ELSHVAGMC

SEQ ID NO: 917234 - protein, 9 aa, Homo Sapiens
ADEERADST

SEQ ID NO: 917235 - protein, 9 aa, Homo Sapiens
CGKSYISEE

SEQ ID NO: 917236 - protein, 9 aa, Homo Sapiens
SFPPLPLPS

SEQ ID NO: 917237 - protein, 9 aa, Homo Sapiens
ILFDSNDSS

SEQ ID NO: 917238 - protein, 9 aa, Homo Sapiens
AQEQSRDSS

SEQ ID NO: 917239 - protein, 9 aa, Homo Sapiens
THGAGFFIR

SEQ ID NO: 917240 - protein, 9 aa, Homo Sapiens
SSYELRHNQ

SEQ ID NO: 917241 - protein, 9 aa, Homo Sapiens
SAKAGQSDS

SEQ ID NO: 917242 - protein, 9 aa, Homo Sapiens
RTLHMIGLR

SEQ ID NO: 917243 - protein, 9 aa, Homo Sapiens
GKLGWELHI

SEQ ID NO: 917244 - protein, 9 aa, Homo Sapiens
KFKVDSSSR

SEQ ID NO: 917245 - protein, 9 aa, Homo Sapiens
VSVDGVRAF

SEQ ID NO: 917246 - protein, 9 aa, Homo Sapiens
HSGGFIFSP

SEQ ID NO: 917247 - protein, 9 aa, Homo Sapiens
NLSPIKPGG

SEQ ID NO: 917248 - protein, 9 aa, Homo Sapiens
IVWQETKDG

SEQ ID NO: 917249 - protein, 9 aa, Homo Sapiens
PGTGTLTEK

SEQ ID NO: 917250 - protein, 9 aa, Homo Sapiens
QIEAFGFSD

SEQ ID NO: 917251 - protein, 9 aa, Homo Sapiens
SPTQTPQTD

SEQ ID NO: 917252 - protein, 9 aa, Homo Sapiens
KTLSLTVFL

SEQ ID NO: 917253 - protein, 9 aa, Homo Sapiens
SSTHRMPGS

SEQ ID NO: 917254 - protein, 9 aa, Homo Sapiens
GQSDSDSGA

SEQ ID NO: 917255 - protein, 9 aa, Homo Sapiens
GMKHVETNF

SEQ ID NO: 917256 - protein, 9 aa, Homo Sapiens
LHVMDTVFP

SEQ ID NO: 917257 - protein, 9 aa, Homo Sapiens
IAKEIQGIP

SEQ ID NO: 917258 - protein, 9 aa, Homo Sapiens
ERYKVNTHM

SEQ ID NO: 917259 - protein, 9 aa, Homo Sapiens
RRKRTPRGN

SEQ ID NO: 917260 - protein, 9 aa, Homo Sapiens
RQDKVPQQT

SEQ ID NO: 917261 - protein, 9 aa, Homo Sapiens
QLLGERVAQ

SEQ ID NO: 917262 - protein, 9 aa, Homo Sapiens
ISLLEQEKE

SEQ ID NO: 917263 - protein, 9 aa, Homo Sapiens
IVTLKQALL

SEQ ID NO: 917264 - protein, 9 aa, Homo Sapiens
LKQFSNSGL

SEQ ID NO: 917265 - protein, 9 aa, Homo Sapiens
IYALICVTV

SEQ ID NO: 917266 - protein, 9 aa, Homo Sapiens
SRFCYGGLD

SEQ ID NO: 917267 - protein, 9 aa, Homo Sapiens
CTECGKSYI

SEQ ID NO: 917268 - protein, 9 aa, Homo Sapiens
RPGWPQGLF

SEQ ID NO: 917269 - protein, 9 aa, Homo Sapiens
CRSVGMHGE

SEQ ID NO: 917270 - protein, 9 aa, Homo Sapiens
LSAFCYIRS

SEQ ID NO: 917271 - protein, 9 aa, Homo Sapiens
EFIPRVLRL

SEQ ID NO: 917272 - protein, 9 aa, Homo Sapiens
LPFVLEYDA

SEQ ID NO: 917273 - protein, 9 aa, Homo Sapiens
KVCKYWDVP

SEQ ID NO: 917274 - protein, 9 aa, Homo Sapiens
APPTKGDCG

SEQ ID NO: 917275 - protein, 9 aa, Homo Sapiens
ALIDKQESQ

SEQ ID NO: 917276 - protein, 9 aa, Homo Sapiens
DRQNFCPRL

SEQ ID NO: 917277 - protein, 9 aa, Homo Sapiens
AHMAHKKFL

SEQ ID NO: 917278 - protein, 9 aa, Homo Sapiens
LMRIEDPFL

SEQ ID NO: 917279 - protein, 9 aa, Homo Sapiens
TPPSPFRNS

SEQ ID NO: 917280 - protein, 9 aa, Homo Sapiens
IVQDGSHRT

SEQ ID NO: 917281 - protein, 9 aa, Homo Sapiens
SKVFQESSK

SEQ ID NO: 917282 - protein, 9 aa, Homo Sapiens
ICKQREIFQ

SEQ ID NO: 917283 - protein, 9 aa, Homo Sapiens
PPVSVPKIK

SEQ ID NO: 917284 - protein, 9 aa, Homo Sapiens
LKDSMQCTC

SEQ ID NO: 917285 - protein, 9 aa, Homo Sapiens
QLYLHKQWL

SEQ ID NO: 917286 - protein, 9 aa, Homo Sapiens
KNQNKKIDG

SEQ ID NO: 917287 - protein, 9 aa, Homo Sapiens
PFLLNSRVL

SEQ ID NO: 917288 - protein, 9 aa, Homo Sapiens
NQRIYFDLN

SEQ ID NO: 917289 - protein, 9 aa, Homo Sapiens
GPPGDKEDD

SEQ ID NO: 917290 - protein, 9 aa, Homo Sapiens
CLRRALQMS

SEQ ID NO: 917291 - protein, 9 aa, Homo Sapiens
SRRQRALPA

SEQ ID NO: 917292 - protein, 9 aa, Homo Sapiens
SVLSPGDIN

SEQ ID NO: 917293 - protein, 9 aa, Homo Sapiens
EKFGPGMQE

SEQ ID NO: 917294 - protein, 9 aa, Homo Sapiens
KLEKERSVL

SEQ ID NO: 917295 - protein, 9 aa, Homo Sapiens
VRRKDLDKL

SEQ ID NO: 917296 - protein, 9 aa, Homo Sapiens
LKYLPGPCR

SEQ ID NO: 917297 - protein, 9 aa, Homo Sapiens
RNYHKWLKS

SEQ ID NO: 917298 - protein, 9 aa, Homo Sapiens
AQWITSLLK

SEQ ID NO: 917299 - protein, 9 aa, Homo Sapiens
YEFWDKDKS

SEQ ID NO: 917300 - protein, 9 aa, Homo Sapiens
CFMAGDINS

SEQ ID NO: 917301 - protein, 9 aa, Homo Sapiens
KVARDTDET

SEQ ID NO: 917302 - protein, 9 aa, Homo Sapiens
HDVGLNLDY

SEQ ID NO: 917303 - protein, 9 aa, Homo Sapiens
DDEDFVEVS

SEQ ID NO: 917304 - protein, 9 aa, Homo Sapiens
WSLDNFFLK

SEQ ID NO: 917305 - protein, 9 aa, Homo Sapiens
VILKNLSFE

SEQ ID NO: 917306 - protein, 9 aa, Homo Sapiens
AQPALAEPH

SEQ ID NO: 917307 - protein, 9 aa, Homo Sapiens
NLTKLYYAR

SEQ ID NO: 917308 - protein, 9 aa, Homo Sapiens
TSSQFLGYD

SEQ ID NO: 917309 - protein, 9 aa, Homo Sapiens
KGSMGPQGE

SEQ ID NO: 917310 - protein, 9 aa, Homo Sapiens
FIVLVAGFL

SEQ ID NO: 917311 - protein, 9 aa, Homo Sapiens
CLRFRRSLL

SEQ ID NO: 917312 - protein, 9 aa, Homo Sapiens
VTSHQKLEK

SEQ ID NO: 917313 - protein, 9 aa, Homo Sapiens
CIVTKCSDS

SEQ ID NO: 917314 - protein, 9 aa, Homo Sapiens
VCKYWDVPP

SEQ ID NO: 917315 - protein, 9 aa, Homo Sapiens
AVQLYLHKQ

SEQ ID NO: 917316 - protein, 9 aa, Homo Sapiens
RVTRSLVPE

SEQ ID NO: 917317 - protein, 9 aa, Homo Sapiens
SHLAELDLP

SEQ ID NO: 917318 - protein, 9 aa, Homo Sapiens
QQPSTDLKF

SEQ ID NO: 917319 - protein, 9 aa, Homo Sapiens
GPKGSMGPQ

SEQ ID NO: 917320 - protein, 9 aa, Homo Sapiens
SSPGTGTLT

SEQ ID NO: 917321 - protein, 9 aa, Homo Sapiens
QNLWHIDFG

SEQ ID NO: 917322 - protein, 9 aa, Homo Sapiens
RSFRRSDPV

SEQ ID NO: 917323 - protein, 9 aa, Homo Sapiens
AMRLSFVGK

SEQ ID NO: 917324 - protein, 9 aa, Homo Sapiens
NPATSPGSI

SEQ ID NO: 917325 - protein, 9 aa, Homo Sapiens
LQEAEGDLG

SEQ ID NO: 917326 - protein, 9 aa, Homo Sapiens
PGSIRFFSR

SEQ ID NO: 917327 - protein, 9 aa, Homo Sapiens
GGREAAGSQ

SEQ ID NO: 917328 - protein, 9 aa, Homo Sapiens
RGMAFCSTL

SEQ ID NO: 917329 - protein, 9 aa, Homo Sapiens
LNQEHKSQG

SEQ ID NO: 917330 - protein, 9 aa, Homo Sapiens
ECQCVQSKV

SEQ ID NO: 917331 - protein, 9 aa, Homo Sapiens
KFLTSKIFG

SEQ ID NO: 917332 - protein, 9 aa, Homo Sapiens
LHAITIKPT

SEQ ID NO: 917333 - protein, 9 aa, Homo Sapiens
DAAENYQKA

SEQ ID NO: 917334 - protein, 9 aa, Homo Sapiens
DSDGSISAL

SEQ ID NO: 917335 - protein, 9 aa, Homo Sapiens
SPIKPGGSE

SEQ ID NO: 917336 - protein, 9 aa, Homo Sapiens
PNEDKAISC

SEQ ID NO: 917337 - protein, 9 aa, Homo Sapiens
EGIVWQETK

SEQ ID NO: 917338 - protein, 9 aa, Homo Sapiens
TKTHPALVC

SEQ ID NO: 917339 - protein, 9 aa, Homo Sapiens
KILHFTLRF

SEQ ID NO: 917340 - protein, 9 aa, Homo Sapiens
HGKAVDLGQ

SEQ ID NO: 917341 - protein, 9 aa, Homo Sapiens
ELKRLLYTG

SEQ ID NO: 917342 - protein, 9 aa, Homo Sapiens
KRQSRTLYG

SEQ ID NO: 917343 - protein, 9 aa, Homo Sapiens
SPSQDMLFP

SEQ ID NO: 917344 - protein, 9 aa, Homo Sapiens
IIYDLCAIC

SEQ ID NO: 917345 - protein, 9 aa, Homo Sapiens
SEDAAPYQG

SEQ ID NO: 917346 - protein, 9 aa, Homo Sapiens
MSDVFSQSK

SEQ ID NO: 917347 - protein, 9 aa, Homo Sapiens
KIKDHFCSF

SEQ ID NO: 917348 - protein, 9 aa, Homo Sapiens
NDSPASAFR

SEQ ID NO: 917349 - protein, 9 aa, Homo Sapiens
LKSLLFLVF

SEQ ID NO: 917350 - protein, 9 aa, Homo Sapiens
KTKVKEEVK

SEQ ID NO: 917351 - protein, 9 aa, Homo Sapiens
TFSKTDSII

SEQ ID NO: 917352 - protein, 9 aa, Homo Sapiens
CLECWKSFS

SEQ ID NO: 917353 - protein, 9 aa, Homo Sapiens
KSKTQSDDS

SEQ ID NO: 917354 - protein, 9 aa, Homo Sapiens
PPGIPVFRS

SEQ ID NO: 917355 - protein, 9 aa, Homo Sapiens
MNFSHIYFK

SEQ ID NO: 917356 - protein, 9 aa, Homo Sapiens
FYRSSSLLR

SEQ ID NO: 917357 - protein, 9 aa, Homo Sapiens
SSSAVTNGF

SEQ ID NO: 917358 - protein, 9 aa, Homo Sapiens
KWLKSLKQE

SEQ ID NO: 917359 - protein, 9 aa, Homo Sapiens
FMIEEEIRA

SEQ ID NO: 917360 - protein, 9 aa, Homo Sapiens
SWGLWLGCL

SEQ ID NO: 917361 - protein, 9 aa, Homo Sapiens
RFGDFQPLG

SEQ ID NO: 917362 - protein, 9 aa, Homo Sapiens
FGFSDITLL

SEQ ID NO: 917363 - protein, 9 aa, Homo Sapiens
TECGKSYIS

SEQ ID NO: 917364 - protein, 9 aa, Homo Sapiens
YIEGYPKFV

SEQ ID NO: 917365 - protein, 9 aa, Homo Sapiens
TVQQHLDML

SEQ ID NO: 917366 - protein, 9 aa, Homo Sapiens
TSGLVEKST

SEQ ID NO: 917367 - protein, 9 aa, Homo Sapiens
ILGVLFLLL

SEQ ID NO: 917368 - protein, 9 aa, Homo Sapiens
LVEEEVNIS

SEQ ID NO: 917369 - protein, 9 aa, Homo Sapiens
QLHEFLQYV

SEQ ID NO: 917370 - protein, 9 aa, Homo Sapiens
CLSPRGSSS

SEQ ID NO: 917371 - protein, 9 aa, Homo Sapiens
SDSEVANSP

SEQ ID NO: 917372 - protein, 9 aa, Homo Sapiens
NPLYHPTIM

SEQ ID NO: 917373 - protein, 9 aa, Homo Sapiens
KATPLVTLF

SEQ ID NO: 917374 - protein, 9 aa, Homo Sapiens
RIVGTHNAV

SEQ ID NO: 917375 - protein, 9 aa, Homo Sapiens
DSKGKELSY

SEQ ID NO: 917376 - protein, 9 aa, Homo Sapiens
EPIVQDGSH

SEQ ID NO: 917377 - protein, 9 aa, Homo Sapiens
CNECQCVQS

SEQ ID NO: 917378 - protein, 9 aa, Homo Sapiens
DMLAKSLEE

SEQ ID NO: 917379 - protein, 9 aa, Homo Sapiens
NDEAEDGRA

SEQ ID NO: 917380 - protein, 9 aa, Homo Sapiens
LLDAKTSAS

SEQ ID NO: 917381 - protein, 9 aa, Homo Sapiens
PIQYLFLTF

SEQ ID NO: 917382 - protein, 9 aa, Homo Sapiens
YAAATRGPP

SEQ ID NO: 917383 - protein, 9 aa, Homo Sapiens
YRENVGGSG

SEQ ID NO: 917384 - protein, 9 aa, Homo Sapiens
EPYSEEEED

SEQ ID NO: 917385 - protein, 9 aa, Homo Sapiens
DTDETGNYL

SEQ ID NO: 917386 - protein, 9 aa, Homo Sapiens
EIFSPPACR

SEQ ID NO: 917387 - protein, 9 aa, Homo Sapiens
AQPWRAFFK

SEQ ID NO: 917388 - protein, 9 aa, Homo Sapiens
ATRGPPPTP

SEQ ID NO: 917389 - protein, 9 aa, Homo Sapiens
SSAASNRSK

SEQ ID NO: 917390 - protein, 9 aa, Homo Sapiens
CMQTRASLK

SEQ ID NO: 917391 - protein, 9 aa, Homo Sapiens
PCIPLVKNL

SEQ ID NO: 917392 - protein, 9 aa, Homo Sapiens
ASPYLSIPW

SEQ ID NO: 917393 - protein, 9 aa, Homo Sapiens
DDEDSKIQN

SEQ ID NO: 917394 - protein, 9 aa, Homo Sapiens
QVIYLQGSA

SEQ ID NO: 917395 - protein, 9 aa, Homo Sapiens
QAHMAHKKF

SEQ ID NO: 917396 - protein, 9 aa, Homo Sapiens
RWNHVITTT

SEQ ID NO: 917397 - protein, 9 aa, Homo Sapiens
YRMKNHHCK

SEQ ID NO: 917398 - protein, 9 aa, Homo Sapiens
ASRFCYGGL

SEQ ID NO: 917399 - protein, 9 aa, Homo Sapiens
NLVDFYMAI

SEQ ID NO: 917400 - protein, 9 aa, Homo Sapiens
PRNLSPIKP

SEQ ID NO: 917401 - protein, 9 aa, Homo Sapiens
KEGPPDLRG

SEQ ID NO: 917402 - protein, 9 aa, Homo Sapiens
AEMAEAMGS

SEQ ID NO: 917403 - protein, 9 aa, Homo Sapiens
KAISCKEAG

SEQ ID NO: 917404 - protein, 9 aa, Homo Sapiens
FQAANVWPT

SEQ ID NO: 917405 - protein, 9 aa, Homo Sapiens
IVNEKSSLE

SEQ ID NO: 917406 - protein, 9 aa, Homo Sapiens
GDCYKEIFQ

SEQ ID NO: 917407 - protein, 9 aa, Homo Sapiens
FIHTAASVQ

SEQ ID NO: 917408 - protein, 9 aa, Homo Sapiens
GHAEHHGKP

SEQ ID NO: 917409 - protein, 9 aa, Homo Sapiens
LQKHSAEGR

SEQ ID NO: 917410 - protein, 9 aa, Homo Sapiens
TTVKPGNKV

SEQ ID NO: 917411 - protein, 9 aa, Homo Sapiens
LLEGEMSYP

SEQ ID NO: 917412 - protein, 9 aa, Homo Sapiens
IFLCETPVL

SEQ ID NO: 917413 - protein, 9 aa, Homo Sapiens
QKTGLQYLK

SEQ ID NO: 917414 - protein, 9 aa, Homo Sapiens
KNLHAATVN

SEQ ID NO: 917415 - protein, 9 aa, Homo Sapiens
KTSASQNVI

SEQ ID NO: 917416 - protein, 9 aa, Homo Sapiens
YLHKNLPVE

SEQ ID NO: 917417 - protein, 9 aa, Homo Sapiens
RLLEALVLF

SEQ ID NO: 917418 - protein, 9 aa, Homo Sapiens
VPGVEVSAA

SEQ ID NO: 917419 - protein, 9 aa, Homo Sapiens
TRQLQATVS

SEQ ID NO: 917420 - protein, 9 aa, Homo Sapiens
LGQITEFGQ

SEQ ID NO: 917421 - protein, 9 aa, Homo Sapiens
FYDVQRLLH

SEQ ID NO: 917422 - protein, 9 aa, Homo Sapiens
VEVSEKEGY

SEQ ID NO: 917423 - protein, 9 aa, Homo Sapiens
DTQKKIRVG

SEQ ID NO: 917424 - protein, 9 aa, Homo Sapiens
PNEDASKDP

SEQ ID NO: 917425 - protein, 9 aa, Homo Sapiens
TLWIKFVSD

SEQ ID NO: 917426 - protein, 9 aa, Homo Sapiens
TKVTTSITF

SEQ ID NO: 917427 - protein, 9 aa, Homo Sapiens
NECEIIKRR

SEQ ID NO: 917428 - protein, 9 aa, Homo Sapiens
TFQIDNTTY

SEQ ID NO: 917429 - protein, 9 aa, Homo Sapiens
PSSPSTKSN

SEQ ID NO: 917430 - protein, 9 aa, Homo Sapiens
PRQDKVPQQ

SEQ ID NO: 917431 - protein, 9 aa, Homo Sapiens
APLTLKPDG

SEQ ID NO: 917432 - protein, 9 aa, Homo Sapiens
HKSQGSGQS

SEQ ID NO: 917433 - protein, 9 aa, Homo Sapiens
SLDYQYRQE

SEQ ID NO: 917434 - protein, 9 aa, Homo Sapiens
ASSKGRVRR

SEQ ID NO: 917435 - protein, 9 aa, Homo Sapiens
TEIPVAPPK

SEQ ID NO: 917436 - protein, 9 aa, Homo Sapiens
GLVSILKGG

SEQ ID NO: 917437 - protein, 9 aa, Homo Sapiens
IYFVEKDDH

SEQ ID NO: 917438 - protein, 9 aa, Homo Sapiens
PATNECEII

SEQ ID NO: 917439 - protein, 9 aa, Homo Sapiens
VSGLCRRGG

SEQ ID NO: 917440 - protein, 9 aa, Homo Sapiens
QFKTKVCIV

SEQ ID NO: 917441 - protein, 9 aa, Homo Sapiens
THDVGLNLD

SEQ ID NO: 917442 - protein, 9 aa, Homo Sapiens
PPFFDGVPE

SEQ ID NO: 917443 - protein, 9 aa, Homo Sapiens
GLNLDYERY

SEQ ID NO: 917444 - protein, 9 aa, Homo Sapiens
WQPMAPNQE

SEQ ID NO: 917445 - protein, 9 aa, Homo Sapiens
FPIIFRKAR

SEQ ID NO: 917446 - protein, 9 aa, Homo Sapiens
FSLQSGKQK

SEQ ID NO: 917447 - protein, 9 aa, Homo Sapiens
FQESSKKDQ

SEQ ID NO: 917448 - protein, 9 aa, Homo Sapiens
VLVAGFLSL

SEQ ID NO: 917449 - protein, 9 aa, Homo Sapiens
PSGLHAIYG

SEQ ID NO: 917450 - protein, 9 aa, Homo Sapiens
RLELQKVVR

SEQ ID NO: 917451 - protein, 9 aa, Homo Sapiens
SVGEAEMAE

SEQ ID NO: 917452 - protein, 9 aa, Homo Sapiens
MANKANTSS

SEQ ID NO: 917453 - protein, 9 aa, Homo Sapiens
TTSFATAPW

SEQ ID NO: 917454 - protein, 9 aa, Homo Sapiens
IDKQESQIT

SEQ ID NO: 917455 - protein, 9 aa, Homo Sapiens
PPRSASHPQ

SEQ ID NO: 917456 - protein, 9 aa, Homo Sapiens
KPPFFDGVP

SEQ ID NO: 917457 - protein, 9 aa, Homo Sapiens
SVRLQEAEG

SEQ ID NO: 917458 - protein, 9 aa, Homo Sapiens
YSPSQNPGM

SEQ ID NO: 917459 - protein, 9 aa, Homo Sapiens
EVILKPPFF

SEQ ID NO: 917460 - protein, 9 aa, Homo Sapiens
HLISVRRLK

SEQ ID NO: 917461 - protein, 9 aa, Homo Sapiens
SLKGSSETE

SEQ ID NO: 917462 - protein, 9 aa, Homo Sapiens
FGCALMKMR

SEQ ID NO: 917463 - protein, 9 aa, Homo Sapiens
GIEITKEMT

SEQ ID NO: 917464 - protein, 9 aa, Homo Sapiens
NVGGSGAPE

SEQ ID NO: 917465 - protein, 9 aa, Homo Sapiens
EQKEQELKG

SEQ ID NO: 917466 - protein, 9 aa, Homo Sapiens
SKNKARYRT

SEQ ID NO: 917467 - protein, 9 aa, Homo Sapiens
LQADPKPIL

SEQ ID NO: 917468 - protein, 9 aa, Homo Sapiens
KVKEEVKTR

SEQ ID NO: 917469 - protein, 9 aa, Homo Sapiens
KKKVCKYWD

SEQ ID NO: 917470 - protein, 9 aa, Homo Sapiens
KKITFLKYI

SEQ ID NO: 917471 - protein, 9 aa, Homo Sapiens
DVIRLLQVI

SEQ ID NO: 917472 - protein, 9 aa, Homo Sapiens
YLSIPWDGK

SEQ ID NO: 917473 - protein, 9 aa, Homo Sapiens
VSLQKHSAE

SEQ ID NO: 917474 - protein, 9 aa, Homo Sapiens
WLIDFGKIT

SEQ ID NO: 917475 - protein, 9 aa, Homo Sapiens
SSKTANLVA

SEQ ID NO: 917476 - protein, 9 aa, Homo Sapiens
SCRSVGMHG

SEQ ID NO: 917477 - protein, 9 aa, Homo Sapiens
TPTFNILFG

SEQ ID NO: 917478 - protein, 9 aa, Homo Sapiens
DEERADSTY

SEQ ID NO: 917479 - protein, 9 aa, Homo Sapiens
GLQYLKNVV

SEQ ID NO: 917480 - protein, 9 aa, Homo Sapiens
EFCYKFRSE

SEQ ID NO: 917481 - protein, 9 aa, Homo Sapiens
YRGKNAVLK

SEQ ID NO: 917482 - protein, 9 aa, Homo Sapiens
ELSYQATAS

SEQ ID NO: 917483 - protein, 9 aa, Homo Sapiens
KLTHDVGLN

SEQ ID NO: 917484 - protein, 9 aa, Homo Sapiens
WRSVEDFQR

SEQ ID NO: 917485 - protein, 9 aa, Homo Sapiens
CQCVQSKVT

SEQ ID NO: 917486 - protein, 9 aa, Homo Sapiens
PLRNETLRE

SEQ ID NO: 917487 - protein, 9 aa, Homo Sapiens
KGAFLYKPC

SEQ ID NO: 917488 - protein, 9 aa, Homo Sapiens
VRKQTESCF

SEQ ID NO: 917489 - protein, 9 aa, Homo Sapiens
FTACMTLTV

SEQ ID NO: 917490 - protein, 9 aa, Homo Sapiens
ELEVVRKKL

SEQ ID NO: 917491 - protein, 9 aa, Homo Sapiens
SKGKELSYQ

SEQ ID NO: 917492 - protein, 9 aa, Homo Sapiens
RSASHPQAS

SEQ ID NO: 917493 - protein, 9 aa, Homo Sapiens
QGYGTFFFC

SEQ ID NO: 917494 - protein, 9 aa, Homo Sapiens
LVSILKGGR

SEQ ID NO: 917495 - protein, 9 aa, Homo Sapiens
FQCEDCGKA

SEQ ID NO: 917496 - protein, 9 aa, Homo Sapiens
VKPEELNRE

SEQ ID NO: 917497 - protein, 9 aa, Homo Sapiens
EPRYHVRRK

SEQ ID NO: 917498 - protein, 9 aa, Homo Sapiens
SLGTKSSTT

SEQ ID NO: 917499 - protein, 9 aa, Homo Sapiens
NTHMLQSFI

SEQ ID NO: 917500 - protein, 9 aa, Homo Sapiens
KAPSLTFAF

SEQ ID NO: 917501 - protein, 9 aa, Homo Sapiens
VDTSLGTKS

SEQ ID NO: 917502 - protein, 9 aa, Homo Sapiens
NYDDESEKT

SEQ ID NO: 917503 - protein, 9 aa, Homo Sapiens
LEIFFTNIF

SEQ ID NO: 917504 - protein, 9 aa, Homo Sapiens
LQQAQITQE

SEQ ID NO: 917505 - protein, 9 aa, Homo Sapiens
VTSGYSTQE

SEQ ID NO: 917506 - protein, 9 aa, Homo Sapiens
DLEYLQANF

SEQ ID NO: 917507 - protein, 9 aa, Homo Sapiens
QIDNTTYGC

SEQ ID NO: 917508 - protein, 9 aa, Homo Sapiens
QVPGYSPSQ

SEQ ID NO: 917509 - protein, 9 aa, Homo Sapiens
FFISHQRNH

SEQ ID NO: 917510 - protein, 9 aa, Homo Sapiens
LGVLFLLLL

SEQ ID NO: 917511 - protein, 9 aa, Homo Sapiens
VDPETKQEI

SEQ ID NO: 917512 - protein, 9 aa, Homo Sapiens
NYRFYGCYC

SEQ ID NO: 917513 - protein, 9 aa, Homo Sapiens
AQRSERSIS

SEQ ID NO: 917514 - protein, 9 aa, Homo Sapiens
SCKEAGLSF

SEQ ID NO: 917515 - protein, 9 aa, Homo Sapiens
IKANYHSSN

SEQ ID NO: 917516 - protein, 9 aa, Homo Sapiens
VYFRIVTMN

SEQ ID NO: 917517 - protein, 9 aa, Homo Sapiens
LAVGLRLAE

SEQ ID NO: 917518 - protein, 9 aa, Homo Sapiens
RKQTESCFM

SEQ ID NO: 917519 - protein, 9 aa, Homo Sapiens
ELQYYGMPA

SEQ ID NO: 917520 - protein, 9 aa, Homo Sapiens
VPTRSARLL

SEQ ID NO: 917521 - protein, 9 aa, Homo Sapiens
VLEDILGSA

SEQ ID NO: 917522 - protein, 9 aa, Homo Sapiens
SHPPNLKSL

SEQ ID NO: 917523 - protein, 9 aa, Homo Sapiens
LRSWLQIIK

SEQ ID NO: 917524 - protein, 9 aa, Homo Sapiens
RQNFCPRLA

SEQ ID NO: 917525 - protein, 9 aa, Homo Sapiens
YMIVDEGYR

SEQ ID NO: 917526 - protein, 9 aa, Homo Sapiens
QRQNVIGLQ

SEQ ID NO: 917527 - protein, 9 aa, Homo Sapiens
HLSSYELRH

SEQ ID NO: 917528 - protein, 9 aa, Homo Sapiens
DGPLCEPNL

SEQ ID NO: 917529 - protein, 9 aa, Homo Sapiens
SSSATTGCL

SEQ ID NO: 917530 - protein, 9 aa, Homo Sapiens
TGGMMVITV

SEQ ID NO: 917531 - protein, 9 aa, Homo Sapiens
ITKEMTMEQ

SEQ ID NO: 917532 - protein, 9 aa, Homo Sapiens
NETNLVGPP

SEQ ID NO: 917533 - protein, 9 aa, Homo Sapiens
LWLKDSMQC

SEQ ID NO: 917534 - protein, 9 aa, Homo Sapiens
KFGFYSKSQ

SEQ ID NO: 917535 - protein, 9 aa, Homo Sapiens
LIQEGFKSG

SEQ ID NO: 917536 - protein, 9 aa, Homo Sapiens
LLATRSVHG

SEQ ID NO: 917537 - protein, 9 aa, Homo Sapiens
HKWLKSLKQ

SEQ ID NO: 917538 - protein, 9 aa, Homo Sapiens
QEYRLVKKG

SEQ ID NO: 917539 - protein, 9 aa, Homo Sapiens
SCSGGGGEK

SEQ ID NO: 917540 - protein, 9 aa, Homo Sapiens
LHKQWLLKA

SEQ ID NO: 917541 - protein, 9 aa, Homo Sapiens
QKGAFSEFG

SEQ ID NO: 917542 - protein, 9 aa, Homo Sapiens
EMSYPRGIV

SEQ ID NO: 917543 - protein, 9 aa, Homo Sapiens
HVETNFYDV

SEQ ID NO: 917544 - protein, 9 aa, Homo Sapiens
TLSLTVFLL

SEQ ID NO: 917545 - protein, 9 aa, Homo Sapiens
QHESTSSQF

SEQ ID NO: 917546 - protein, 9 aa, Homo Sapiens
LARPGFSEP

SEQ ID NO: 917547 - protein, 9 aa, Homo Sapiens
RKQRTLFMI

SEQ ID NO: 917548 - protein, 9 aa, Homo Sapiens
CYKFRSESK

SEQ ID NO: 917549 - protein, 9 aa, Homo Sapiens
GIFLCETPV

SEQ ID NO: 917550 - protein, 9 aa, Homo Sapiens
QISSGYYLQ

SEQ ID NO: 917551 - protein, 9 aa, Homo Sapiens
VLPLGFTIG

SEQ ID NO: 917552 - protein, 9 aa, Homo Sapiens
GGDVPILNP

SEQ ID NO: 917553 - protein, 9 aa, Homo Sapiens
KVFKYNSFF

SEQ ID NO: 917554 - protein, 9 aa, Homo Sapiens
TDKIFSCAF

SEQ ID NO: 917555 - protein, 9 aa, Homo Sapiens
GFEEYNNLD

SEQ ID NO: 917556 - protein, 9 aa, Homo Sapiens
VWLIDFGKI

SEQ ID NO: 917557 - protein, 9 aa, Homo Sapiens
MVPDRQNFC

SEQ ID NO: 917558 - protein, 9 aa, Homo Sapiens
VEISYYNME

SEQ ID NO: 917559 - protein, 9 aa, Homo Sapiens
GCVPYPENE

SEQ ID NO: 917560 - protein, 9 aa, Homo Sapiens
FLSSMACCI

SEQ ID NO: 917561 - protein, 9 aa, Homo Sapiens
LDPNAMYFL

SEQ ID NO: 917562 - protein, 9 aa, Homo Sapiens
EIKAERASR

SEQ ID NO: 917563 - protein, 9 aa, Homo Sapiens
YQATASPIV

SEQ ID NO: 917564 - protein, 9 aa, Homo Sapiens
HIPPTPFFL

SEQ ID NO: 917565 - protein, 9 aa, Homo Sapiens
DHMGSCRSV

SEQ ID NO: 917566 - protein, 9 aa, Homo Sapiens
GQITDEMAD

SEQ ID NO: 917567 - protein, 9 aa, Homo Sapiens
LTGAVGFLL

SEQ ID NO: 917568 - protein, 9 aa, Homo Sapiens
ASETNDFRE

SEQ ID NO: 917569 - protein, 9 aa, Homo Sapiens
DWEFALLFL

SEQ ID NO: 917570 - protein, 9 aa, Homo Sapiens
ISPPADGSK

SEQ ID NO: 917571 - protein, 9 aa, Homo Sapiens
MSYPRGIVV

SEQ ID NO: 917572 - protein, 9 aa, Homo Sapiens
GESSFSRSV

SEQ ID NO: 917573 - protein, 9 aa, Homo Sapiens
RQNLSVNPP

SEQ ID NO: 917574 - protein, 9 aa, Homo Sapiens
SNDSSTLKL

SEQ ID NO: 917575 - protein, 9 aa, Homo Sapiens
EIGGQVAPS

SEQ ID NO: 917576 - protein, 9 aa, Homo Sapiens
SEDHLLYVS

SEQ ID NO: 917577 - protein, 9 aa, Homo Sapiens
AAKVPSTPS

SEQ ID NO: 917578 - protein, 9 aa, Homo Sapiens
KTANLVAKR

SEQ ID NO: 917579 - protein, 9 aa, Homo Sapiens
HGKPFCHKP

SEQ ID NO: 917580 - protein, 9 aa, Homo Sapiens
SEFGDLEKI

SEQ ID NO: 917581 - protein, 9 aa, Homo Sapiens
QLRQRQNVI

SEQ ID NO: 917582 - protein, 9 aa, Homo Sapiens
CLQDPLDKK

SEQ ID NO: 917583 - protein, 9 aa, Homo Sapiens
GWPQGLFRL

SEQ ID NO: 917584 - protein, 9 aa, Homo Sapiens
GHTDKIFSC

SEQ ID NO: 917585 - protein, 9 aa, Homo Sapiens
TSAACILFG

SEQ ID NO: 917586 - protein, 9 aa, Homo Sapiens
MTAGRKMEM

SEQ ID NO: 917587 - protein, 9 aa, Homo Sapiens
PTSAACILF

SEQ ID NO: 917588 - protein, 9 aa, Homo Sapiens
PTFNILFGS

SEQ ID NO: 917589 - protein, 9 aa, Homo Sapiens
VDSSSREIR

SEQ ID NO: 917590 - protein, 9 aa, Homo Sapiens
GSMGPQGEP

SEQ ID NO: 917591 - protein, 9 aa, Homo Sapiens
ESPRVLSPP

SEQ ID NO: 917592 - protein, 9 aa, Homo Sapiens
LTEKTITLE

SEQ ID NO: 917593 - protein, 9 aa, Homo Sapiens
NQEHKSQGS

SEQ ID NO: 917594 - protein, 9 aa, Homo Sapiens
TLFMIEEEI

SEQ ID NO: 917595 - protein, 9 aa, Homo Sapiens
PIIQQYKCL

SEQ ID NO: 917596 - protein, 9 aa, Homo Sapiens
DSPTFSPGA

SEQ ID NO: 917597 - protein, 9 aa, Homo Sapiens
HEKAITALR

SEQ ID NO: 917598 - protein, 9 aa, Homo Sapiens
VFYNSRVIL

SEQ ID NO: 917599 - protein, 9 aa, Homo Sapiens
VLSPGDINL

SEQ ID NO: 917600 - protein, 9 aa, Homo Sapiens
QNGFLHRGL

SEQ ID NO: 917601 - protein, 9 aa, Homo Sapiens
QNKKIDGKA

SEQ ID NO: 917602 - protein, 9 aa, Homo Sapiens
SNRSKNKAR

SEQ ID NO: 917603 - protein, 9 aa, Homo Sapiens
SSMLNQEHK

SEQ ID NO: 917604 - protein, 9 aa, Homo Sapiens
DPFIFITKI

SEQ ID NO: 917605 - protein, 9 aa, Homo Sapiens
IKPTSKFFG

SEQ ID NO: 917606 - protein, 9 aa, Homo Sapiens
IRESSKSQD

SEQ ID NO: 917607 - protein, 9 aa, Homo Sapiens
TVNSGTKSK

SEQ ID NO: 917608 - protein, 9 aa, Homo Sapiens
LNKDGEIKW

SEQ ID NO: 917609 - protein, 9 aa, Homo Sapiens
LSPIKPGGS

SEQ ID NO: 917610 - protein, 9 aa, Homo Sapiens
TSSDFEKDD

SEQ ID NO: 917611 - protein, 9 aa, Homo Sapiens
AVGFLLLEW

SEQ ID NO: 917612 - protein, 9 aa, Homo Sapiens
GVIAANMTE

SEQ ID NO: 917613 - protein, 9 aa, Homo Sapiens
SKAVKILAQ

SEQ ID NO: 917614 - protein, 9 aa, Homo Sapiens
YHPTIMTSK

SEQ ID NO: 917615 - protein, 9 aa, Homo Sapiens
FDSRDIFLV

SEQ ID NO: 917616 - protein, 9 aa, Homo Sapiens
AKSRGFLKC

SEQ ID NO: 917617 - protein, 9 aa, Homo Sapiens
HPCLQVPKL

SEQ ID NO: 917618 - protein, 9 aa, Homo Sapiens
ILFIDNIAT

SEQ ID NO: 917619 - protein, 9 aa, Homo Sapiens
TIKPTSKFF

SEQ ID NO: 917620 - protein, 9 aa, Homo Sapiens
DVTSGYSTQ

SEQ ID NO: 917621 - protein, 9 aa, Homo Sapiens
RDKIALLFQ

SEQ ID NO: 917622 - protein, 9 aa, Homo Sapiens
FECLECWKS

SEQ ID NO: 917623 - protein, 9 aa, Homo Sapiens
DLRGDPGSH

SEQ ID NO: 917624 - protein, 9 aa, Homo Sapiens
HLYAVPIRE

SEQ ID NO: 917625 - protein, 9 aa, Homo Sapiens
SIFSVLIYF

SEQ ID NO: 917626 - protein, 9 aa, Homo Sapiens
NPNQRLLKV

SEQ ID NO: 917627 - protein, 9 aa, Homo Sapiens
TSRVQNTVQ

SEQ ID NO: 917628 - protein, 9 aa, Homo Sapiens
SLQKHSAEG

SEQ ID NO: 917629 - protein, 9 aa, Homo Sapiens
MFLYTCLVE

SEQ ID NO: 917630 - protein, 9 aa, Homo Sapiens
KNLNKDGEI

SEQ ID NO: 917631 - protein, 9 aa, Homo Sapiens
GARPCLASA

SEQ ID NO: 917632 - protein, 9 aa, Homo Sapiens
CFSSPNVIS

SEQ ID NO: 917633 - protein, 9 aa, Homo Sapiens
FQIDNTTYG

SEQ ID NO: 917634 - protein, 9 aa, Homo Sapiens
DKDIASVLD

SEQ ID NO: 917635 - protein, 9 aa, Homo Sapiens
KSQESIFVR

SEQ ID NO: 917636 - protein, 9 aa, Homo Sapiens
FGDVASPSQ

SEQ ID NO: 917637 - protein, 9 aa, Homo Sapiens
SVYHAAIVV

SEQ ID NO: 917638 - protein, 9 aa, Homo Sapiens
SEYIPSFLK

SEQ ID NO: 917639 - protein, 9 aa, Homo Sapiens
LSQSQRLFA

SEQ ID NO: 917640 - protein, 9 aa, Homo Sapiens
ISLMTNEPG

SEQ ID NO: 917641 - protein, 9 aa, Homo Sapiens
DKENLQARE

SEQ ID NO: 917642 - protein, 9 aa, Homo Sapiens
SYATYNQSE

SEQ ID NO: 917643 - protein, 9 aa, Homo Sapiens
IILVLPFTG

SEQ ID NO: 917644 - protein, 9 aa, Homo Sapiens
INSDIWKNL

SEQ ID NO: 917645 - protein, 9 aa, Homo Sapiens
HVMDTVFPI

SEQ ID NO: 917646 - protein, 9 aa, Homo Sapiens
VANSPSSDE

SEQ ID NO: 917647 - protein, 9 aa, Homo Sapiens
ASLKLVKTC

SEQ ID NO: 917648 - protein, 9 aa, Homo Sapiens
SRLELQKVV

SEQ ID NO: 917649 - protein, 9 aa, Homo Sapiens
TNPNQRLLK

SEQ ID NO: 917650 - protein, 9 aa, Homo Sapiens
ETEIPVAPP

SEQ ID NO: 917651 - protein, 9 aa, Homo Sapiens
NLNKDGEIK

SEQ ID NO: 917652 - protein, 9 aa, Homo Sapiens
LKPSHCKCG

SEQ ID NO: 917653 - protein, 9 aa, Homo Sapiens
LWIKIHPYL

SEQ ID NO: 917654 - protein, 9 aa, Homo Sapiens
SFYRSSSLL

SEQ ID NO: 917655 - protein, 9 aa, Homo Sapiens
FGYLGNGWK

SEQ ID NO: 917656 - protein, 9 aa, Homo Sapiens
RRGGRCVNT

SEQ ID NO: 917657 - protein, 9 aa, Homo Sapiens
PNAMYFLLL

SEQ ID NO: 917658 - protein, 9 aa, Homo Sapiens
GVRSDSKQD

SEQ ID NO: 917659 - protein, 9 aa, Homo Sapiens
SLFPSGLHA

SEQ ID NO: 917660 - protein, 9 aa, Homo Sapiens
ERLGVKAMG

SEQ ID NO: 917661 - protein, 9 aa, Homo Sapiens
FFFNTKYFQ

SEQ ID NO: 917662 - protein, 9 aa, Homo Sapiens
SVTDKIIHA

SEQ ID NO: 917663 - protein, 9 aa, Homo Sapiens
LGGRFGDFQ

SEQ ID NO: 917664 - protein, 9 aa, Homo Sapiens
FIEVILFSS

SEQ ID NO: 917665 - protein, 9 aa, Homo Sapiens
AGFLSLVTI

SEQ ID NO: 917666 - protein, 9 aa, Homo Sapiens
KANYHSSNP

SEQ ID NO: 917667 - protein, 9 aa, Homo Sapiens
PIVLLNTLF

SEQ ID NO: 917668 - protein, 9 aa, Homo Sapiens
STTSGLVEK

SEQ ID NO: 917669 - protein, 9 aa, Homo Sapiens
DSLKGSSET

SEQ ID NO: 917670 - protein, 9 aa, Homo Sapiens
QRPPRSASH

SEQ ID NO: 917671 - protein, 9 aa, Homo Sapiens
SGLCRRGGR

SEQ ID NO: 917672 - protein, 9 aa, Homo Sapiens
GSGVSDSET

SEQ ID NO: 917673 - protein, 9 aa, Homo Sapiens
KELSYQATA

SEQ ID NO: 917674 - protein, 9 aa, Homo Sapiens
KEYFQHAWS

SEQ ID NO: 917675 - protein, 9 aa, Homo Sapiens
LPFQAANVW

SEQ ID NO: 917676 - protein, 9 aa, Homo Sapiens
RELYARNNS

SEQ ID NO: 917677 - protein, 9 aa, Homo Sapiens
SHLGSGVSD

SEQ ID NO: 917678 - protein, 9 aa, Homo Sapiens
QDNKFHHFK

SEQ ID NO: 917679 - protein, 9 aa, Homo Sapiens
DHHVFSANY

SEQ ID NO: 917680 - protein, 9 aa, Homo Sapiens
NGLCIWLLI

SEQ ID NO: 917681 - protein, 9 aa, Homo Sapiens
STLTDHKKI

SEQ ID NO: 917682 - protein, 9 aa, Homo Sapiens
TKQEITRLK

SEQ ID NO: 917683 - protein, 9 aa, Homo Sapiens
IPVFRSPAC

SEQ ID NO: 917684 - protein, 9 aa, Homo Sapiens
EQEEREQQL

SEQ ID NO: 917685 - protein, 9 aa, Homo Sapiens
FAIFLSSMA

SEQ ID NO: 917686 - protein, 9 aa, Homo Sapiens
QGLAAATED

SEQ ID NO: 917687 - protein, 9 aa, Homo Sapiens
GPGLHAITI

SEQ ID NO: 917688 - protein, 9 aa, Homo Sapiens
SSTIILVLP

SEQ ID NO: 917689 - protein, 9 aa, Homo Sapiens
QGCYVAKEA

SEQ ID NO: 917690 - protein, 9 aa, Homo Sapiens
FRSESKRMK

SEQ ID NO: 917691 - protein, 9 aa, Homo Sapiens
SSFPPLPLP

SEQ ID NO: 917692 - protein, 9 aa, Homo Sapiens
PGVIAANMT

SEQ ID NO: 917693 - protein, 9 aa, Homo Sapiens
MSTRRAWVG

SEQ ID NO: 917694 - protein, 9 aa, Homo Sapiens
YKCLRFRRS

SEQ ID NO: 917695 - protein, 9 aa, Homo Sapiens
FSEPLLILE

SEQ ID NO: 917696 - protein, 9 aa, Homo Sapiens
KTFFTFAFC

SEQ ID NO: 917697 - protein, 9 aa, Homo Sapiens
SFICLQSSP

SEQ ID NO: 917698 - protein, 9 aa, Homo Sapiens
GKVFKYNSF

SEQ ID NO: 917699 - protein, 9 aa, Homo Sapiens
KIGDPACIQ

SEQ ID NO: 917700 - protein, 9 aa, Homo Sapiens
LPRLRVTRS

SEQ ID NO: 917701 - protein, 9 aa, Homo Sapiens
VLEGHTDKI

SEQ ID NO: 917702 - protein, 9 aa, Homo Sapiens
FNILFGSSA

SEQ ID NO: 917703 - protein, 9 aa, Homo Sapiens
HKNLPVEGL

SEQ ID NO: 917704 - protein, 9 aa, Homo Sapiens
IFSVLIYFV

SEQ ID NO: 917705 - protein, 9 aa, Homo Sapiens
SAFCYIRSQ

SEQ ID NO: 917706 - protein, 9 aa, Homo Sapiens
PEELNRENA

SEQ ID NO: 917707 - protein, 9 aa, Homo Sapiens
RDGELQYYG

SEQ ID NO: 917708 - protein, 9 aa, Homo Sapiens
AGVYSCITM

SEQ ID NO: 917709 - protein, 9 aa, Homo Sapiens
LFPSGLHAI

SEQ ID NO: 917710 - protein, 9 aa, Homo Sapiens
FDSNDSSTL

SEQ ID NO: 917711 - protein, 9 aa, Homo Sapiens
ITFKKWGTR

SEQ ID NO: 917712 - protein, 9 aa, Homo Sapiens
PSYILRTLE

SEQ ID NO: 917713 - protein, 9 aa, Homo Sapiens
PGGHAEHHG

SEQ ID NO: 917714 - protein, 9 aa, Homo Sapiens
KGVVISFLV

SEQ ID NO: 917715 - protein, 9 aa, Homo Sapiens
IEDPFLLNS

SEQ ID NO: 917716 - protein, 9 aa, Homo Sapiens
APLNFYEVA

SEQ ID NO: 917717 - protein, 9 aa, Homo Sapiens
VASKNGIAP

SEQ ID NO: 917718 - protein, 9 aa, Homo Sapiens
SRTLYGFGG

SEQ ID NO: 917719 - protein, 9 aa, Homo Sapiens
ASMLKQFSN

SEQ ID NO: 917720 - protein, 9 aa, Homo Sapiens
FPIQYLFLT

SEQ ID NO: 917721 - protein, 9 aa, Homo Sapiens
CMTLTVSPG

SEQ ID NO: 917722 - protein, 9 aa, Homo Sapiens
SFATAPWEA

SEQ ID NO: 917723 - protein, 9 aa, Homo Sapiens
IAEKKARAV

SEQ ID NO: 917724 - protein, 9 aa, Homo Sapiens
RKSLKSCRT

SEQ ID NO: 917725 - protein, 9 aa, Homo Sapiens
YGTETFWSK

SEQ ID NO: 917726 - protein, 9 aa, Homo Sapiens
GTSKEKAKI

SEQ ID NO: 917727 - protein, 9 aa, Homo Sapiens
EEEEKFGPG

SEQ ID NO: 917728 - protein, 9 aa, Homo Sapiens
ALEGQMFWK

SEQ ID NO: 917729 - protein, 9 aa, Homo Sapiens
SKEGSPLTS

SEQ ID NO: 917730 - protein, 9 aa, Homo Sapiens
HEFLQYVKT

SEQ ID NO: 917731 - protein, 9 aa, Homo Sapiens
YHAAIVVFL

SEQ ID NO: 917732 - protein, 9 aa, Homo Sapiens
SLVPEPAIL

SEQ ID NO: 917733 - protein, 9 aa, Homo Sapiens
QLAEAQKVE

SEQ ID NO: 917734 - protein, 9 aa, Homo Sapiens
VSVLEDILG

SEQ ID NO: 917735 - protein, 9 aa, Homo Sapiens
LQYYGMPAW

SEQ ID NO: 917736 - protein, 9 aa, Homo Sapiens
FLEEDPGPD

SEQ ID NO: 917737 - protein, 9 aa, Homo Sapiens
MAGIEITKE

SEQ ID NO: 917738 - protein, 9 aa, Homo Sapiens
KPFECLECW

SEQ ID NO: 917739 - protein, 9 aa, Homo Sapiens
IDKISDGIR

SEQ ID NO: 917740 - protein, 9 aa, Homo Sapiens
PLLPPFLQV

SEQ ID NO: 917741 - protein, 9 aa, Homo Sapiens
AISCKEAGL

SEQ ID NO: 917742 - protein, 9 aa, Homo Sapiens
AALCPTFQI

SEQ ID NO: 917743 - protein, 9 aa, Homo Sapiens
SFENQFHTE

SEQ ID NO: 917744 - protein, 9 aa, Homo Sapiens
MAHKKFLWT

SEQ ID NO: 917745 - protein, 9 aa, Homo Sapiens
SASPSIQYS

SEQ ID NO: 917746 - protein, 9 aa, Homo Sapiens
KLPSFICLQ

SEQ ID NO: 917747 - protein, 9 aa, Homo Sapiens
VTVLSPSCL

SEQ ID NO: 917748 - protein, 9 aa, Homo Sapiens
LSPGLAPLT

SEQ ID NO: 917749 - protein, 9 aa, Homo Sapiens
DAEEKQELL

SEQ ID NO: 917750 - protein, 9 aa, Homo Sapiens
TSGYSTQEG

SEQ ID NO: 917751 - protein, 9 aa, Homo Sapiens
ENEIGGQVA

SEQ ID NO: 917752 - protein, 9 aa, Homo Sapiens
EVQGLAAAT

SEQ ID NO: 917753 - protein, 9 aa, Homo Sapiens
IRLGQITEF

SEQ ID NO: 917754 - protein, 9 aa, Homo Sapiens
LFLILGVLF

SEQ ID NO: 917755 - protein, 9 aa, Homo Sapiens
SYYNMERIR

SEQ ID NO: 917756 - protein, 9 aa, Homo Sapiens
LTHDVGLNL

SEQ ID NO: 917757 - protein, 9 aa, Homo Sapiens
GDPACIQLI

SEQ ID NO: 917758 - protein, 9 aa, Homo Sapiens
GSIRFFSRS

SEQ ID NO: 917759 - protein, 9 aa, Homo Sapiens
ASNKEKKMI

SEQ ID NO: 917760 - protein, 9 aa, Homo Sapiens
DWEKDKEKD

SEQ ID NO: 917761 - protein, 9 aa, Homo Sapiens
LATVKVLLI

SEQ ID NO: 917762 - protein, 9 aa, Homo Sapiens
RPHELVNRL

SEQ ID NO: 917763 - protein, 9 aa, Homo Sapiens
PADSGCSRR

SEQ ID NO: 917764 - protein, 9 aa, Homo Sapiens
LGRDFSVQW

SEQ ID NO: 917765 - protein, 9 aa, Homo Sapiens
KESRQNKLA

SEQ ID NO: 917766 - protein, 9 aa, Homo Sapiens
PLVTLFPPS

SEQ ID NO: 917767 - protein, 9 aa, Homo Sapiens
QRDICIAFQ

SEQ ID NO: 917768 - protein, 9 aa, Homo Sapiens
LRDDNFYAY

SEQ ID NO: 917769 - protein, 9 aa, Homo Sapiens
PCLQVPKLD

SEQ ID NO: 917770 - protein, 9 aa, Homo Sapiens
QSLLSSSRV

SEQ ID NO: 917771 - protein, 9 aa, Homo Sapiens
GLAPLTLKP

SEQ ID NO: 917772 - protein, 9 aa, Homo Sapiens
LVSDSVFPC

SEQ ID NO: 917773 - protein, 9 aa, Homo Sapiens
MPSYILRTL

SEQ ID NO: 917774 - protein, 9 aa, Homo Sapiens
PPDLRGDPG

SEQ ID NO: 917775 - protein, 9 aa, Homo Sapiens
WFLICKQRE

SEQ ID NO: 917776 - protein, 9 aa, Homo Sapiens
MMVITVLLS

SEQ ID NO: 917777 - protein, 9 aa, Homo Sapiens
GTFFFCRLL

SEQ ID NO: 917778 - protein, 9 aa, Homo Sapiens
CETLELSHV

SEQ ID NO: 917779 - protein, 9 aa, Homo Sapiens
RTHWIDVIR

SEQ ID NO: 917780 - protein, 9 aa, Homo Sapiens
SERSISTLK

SEQ ID NO: 917781 - protein, 9 aa, Homo Sapiens
KDNIKHVPR

SEQ ID NO: 917782 - protein, 9 aa, Homo Sapiens
SPVIQLPKQ

SEQ ID NO: 917783 - protein, 9 aa, Homo Sapiens
FYEVAGSAA

SEQ ID NO: 917784 - protein, 9 aa, Homo Sapiens
HGGRSDMDW

SEQ ID NO: 917785 - protein, 9 aa, Homo Sapiens
SYQATASPI

SEQ ID NO: 917786 - protein, 9 aa, Homo Sapiens
KRSYGNAFY

SEQ ID NO: 917787 - protein, 9 aa, Homo Sapiens
TMNSNFVPV

SEQ ID NO: 917788 - protein, 9 aa, Homo Sapiens
ALAEPHLLP

SEQ ID NO: 917789 - protein, 9 aa, Homo Sapiens
MLSRDGGLH

SEQ ID NO: 917790 - protein, 9 aa, Homo Sapiens
RRVSSMGPP

SEQ ID NO: 917791 - protein, 9 aa, Homo Sapiens
YHSLNEELN

SEQ ID NO: 917792 - protein, 9 aa, Homo Sapiens
LYKPCGVST

SEQ ID NO: 917793 - protein, 9 aa, Homo Sapiens
DKIIHATQD

SEQ ID NO: 917794 - protein, 9 aa, Homo Sapiens
KGKELSYQA

SEQ ID NO: 917795 - protein, 9 aa, Homo Sapiens
KYMIVDEGY

SEQ ID NO: 917796 - protein, 9 aa, Homo Sapiens
VFLSSTIIL

SEQ ID NO: 917797 - protein, 9 aa, Homo Sapiens
HKIIHTGET

SEQ ID NO: 917798 - protein, 9 aa, Homo Sapiens
RGSSSATTG

SEQ ID NO: 917799 - protein, 9 aa, Homo Sapiens
SKTANLVAK

SEQ ID NO: 917800 - protein, 9 aa, Homo Sapiens
VGEAEMAEA

SEQ ID NO: 917801 - protein, 9 aa, Homo Sapiens
EFCLGKFDK

SEQ ID NO: 917802 - protein, 9 aa, Homo Sapiens
TGNLTKLYY

SEQ ID NO: 917803 - protein, 9 aa, Homo Sapiens
LAKKREFAK

SEQ ID NO: 917804 - protein, 9 aa, Homo Sapiens
TRSDASETN

SEQ ID NO: 917805 - protein, 9 aa, Homo Sapiens
ERDREREKD

SEQ ID NO: 917806 - protein, 9 aa, Homo Sapiens
RKDLDKLHR

SEQ ID NO: 917807 - protein, 9 aa, Homo Sapiens
ATEKTKVKE

SEQ ID NO: 917808 - protein, 9 aa, Homo Sapiens
DSSSREIRL

SEQ ID NO: 917809 - protein, 9 aa, Homo Sapiens
KSKVFQESS

SEQ ID NO: 917810 - protein, 9 aa, Homo Sapiens
LLASPKSCY

SEQ ID NO: 917811 - protein, 9 aa, Homo Sapiens
RNSSHEKAI

SEQ ID NO: 917812 - protein, 9 aa, Homo Sapiens
TQNLVDFYM

SEQ ID NO: 917813 - protein, 9 aa, Homo Sapiens
SRTPCFSSP

SEQ ID NO: 917814 - protein, 9 aa, Homo Sapiens
AATISLMTN

SEQ ID NO: 917815 - protein, 9 aa, Homo Sapiens
AETLNPSDP

SEQ ID NO: 917816 - protein, 9 aa, Homo Sapiens
SLLATRSVH

SEQ ID NO: 917817 - protein, 9 aa, Homo Sapiens
AAATRGPPP

SEQ ID NO: 917818 - protein, 9 aa, Homo Sapiens
DGVRSDSKQ

SEQ ID NO: 917819 - protein, 9 aa, Homo Sapiens
VSSPEKPLS

SEQ ID NO: 917820 - protein, 9 aa, Homo Sapiens
TFFTFAFCD

SEQ ID NO: 917821 - protein, 9 aa, Homo Sapiens
QQHLDMLAK

SEQ ID NO: 917822 - protein, 9 aa, Homo Sapiens
LKSCRTHWI

SEQ ID NO: 917823 - protein, 9 aa, Homo Sapiens
VVRKAEEEL

SEQ ID NO: 917824 - protein, 9 aa, Homo Sapiens
FFCRLLSGV

SEQ ID NO: 917825 - protein, 9 aa, Homo Sapiens
LPVDKTKDK

SEQ ID NO: 917826 - protein, 9 aa, Homo Sapiens
KIVNEKSSL

SEQ ID NO: 917827 - protein, 9 aa, Homo Sapiens
VIRLLQVIL

SEQ ID NO: 917828 - protein, 9 aa, Homo Sapiens
MGMSDVFSQ

SEQ ID NO: 917829 - protein, 9 aa, Homo Sapiens
QNLSVNPPS

SEQ ID NO: 917830 - protein, 9 aa, Homo Sapiens
DLSQSQRLF

SEQ ID NO: 917831 - protein, 9 aa, Homo Sapiens
AFSEFGDLE

SEQ ID NO: 917832 - protein, 9 aa, Homo Sapiens
GGFIFSPSY

SEQ ID NO: 917833 - protein, 9 aa, Homo Sapiens
APAAAAFES

SEQ ID NO: 917834 - protein, 9 aa, Homo Sapiens
GTTASSKGR

SEQ ID NO: 917835 - protein, 9 aa, Homo Sapiens
NTYTGYFPI

SEQ ID NO: 917836 - protein, 9 aa, Homo Sapiens
SDHLSCLRR

SEQ ID NO: 917837 - protein, 9 aa, Homo Sapiens
GKPGLSSVL

SEQ ID NO: 917838 - protein, 9 aa, Homo Sapiens
SSVLSPGDI

SEQ ID NO: 917839 - protein, 9 aa, Homo Sapiens
RSAGIFLCE

SEQ ID NO: 917840 - protein, 9 aa, Homo Sapiens
VVGFAIFLS

SEQ ID NO: 917841 - protein, 9 aa, Homo Sapiens
TDEMADQLM

SEQ ID NO: 917842 - protein, 9 aa, Homo Sapiens
REAPAAAAF

SEQ ID NO: 917843 - protein, 9 aa, Homo Sapiens
PDAQKGGEI

SEQ ID NO: 917844 - protein, 9 aa, Homo Sapiens
LFSHGKAVD

SEQ ID NO: 917845 - protein, 9 aa, Homo Sapiens
QDLGPLGGS

SEQ ID NO: 917846 - protein, 9 aa, Homo Sapiens
QQYKCLRFR

SEQ ID NO: 917847 - protein, 9 aa, Homo Sapiens
EPASPDSLK

SEQ ID NO: 917848 - protein, 9 aa, Homo Sapiens
LQEGLGGCG

SEQ ID NO: 917849 - protein, 9 aa, Homo Sapiens
FYNEAWPTL

SEQ ID NO: 917850 - protein, 9 aa, Homo Sapiens
LPGKRYIIQ

SEQ ID NO: 917851 - protein, 9 aa, Homo Sapiens
RIVTMNSNF

SEQ ID NO: 917852 - protein, 9 aa, Homo Sapiens
FTLEEPTPQ

SEQ ID NO: 917853 - protein, 9 aa, Homo Sapiens
AIFLSSMAC

SEQ ID NO: 917854 - protein, 9 aa, Homo Sapiens
KNLTYLQLK

SEQ ID NO: 917855 - protein, 9 aa, Homo Sapiens
IVTKCSDSA

SEQ ID NO: 917856 - protein, 9 aa, Homo Sapiens
ISNRRVLVT

SEQ ID NO: 917857 - protein, 9 aa, Homo Sapiens
IFLVGWCSL

SEQ ID NO: 917858 - protein, 9 aa, Homo Sapiens
GYLGNGWKP

SEQ ID NO: 917859 - protein, 9 aa, Homo Sapiens
QAPGGSRAS

SEQ ID NO: 917860 - protein, 9 aa, Homo Sapiens
AQWSLDNFF

SEQ ID NO: 917861 - protein, 9 aa, Homo Sapiens
ESSFSRSVT

SEQ ID NO: 917862 - protein, 9 aa, Homo Sapiens
ENQMDKTRR

SEQ ID NO: 917863 - protein, 9 aa, Homo Sapiens
NNSIFSARQ

SEQ ID NO: 917864 - protein, 9 aa, Homo Sapiens
IWKNLHAAT

SEQ ID NO: 917865 - protein, 9 aa, Homo Sapiens
AQEYRLVKK

SEQ ID NO: 917866 - protein, 9 aa, Homo Sapiens
SHLWGHKRI

SEQ ID NO: 917867 - protein, 9 aa, Homo Sapiens
PEKEEDVSQ

SEQ ID NO: 917868 - protein, 9 aa, Homo Sapiens
GRCSPHYIL

SEQ ID NO: 917869 - protein, 9 aa, Homo Sapiens
NQRNCMAAT

SEQ ID NO: 917870 - protein, 9 aa, Homo Sapiens
SHQRIYTGE

SEQ ID NO: 917871 - protein, 9 aa, Homo Sapiens
NPTGQFLVS

SEQ ID NO: 917872 - protein, 9 aa, Homo Sapiens
LPGPCRTCS

SEQ ID NO: 917873 - protein, 9 aa, Homo Sapiens
LAQPWRAFF

SEQ ID NO: 917874 - protein, 9 aa, Homo Sapiens
VVYALKRQS

SEQ ID NO: 917875 - protein, 9 aa, Homo Sapiens
FPSGLHAIY

SEQ ID NO: 917876 - protein, 9 aa, Homo Sapiens
DLKFDRVVI

SEQ ID NO: 917877 - protein, 9 aa, Homo Sapiens
GALPVPPTG

SEQ ID NO: 917878 - protein, 9 aa, Homo Sapiens
LYARNNSIF

SEQ ID NO: 917879 - protein, 9 aa, Homo Sapiens
EVPQEAAET

SEQ ID NO: 917880 - protein, 9 aa, Homo Sapiens
LLDERKSLK

SEQ ID NO: 917881 - protein, 9 aa, Homo Sapiens
IIQGRNSLW

SEQ ID NO: 917882 - protein, 9 aa, Homo Sapiens
IIQQYKCLR

SEQ ID NO: 917883 - protein, 9 aa, Homo Sapiens
TACMTLTVS

SEQ ID NO: 917884 - protein, 9 aa, Homo Sapiens
CLVASKNGI

SEQ ID NO: 917885 - protein, 9 aa, Homo Sapiens
GRSDMDWEF

SEQ ID NO: 917886 - protein, 9 aa, Homo Sapiens
KYNSFFISH

SEQ ID NO: 917887 - protein, 9 aa, Homo Sapiens
KTDSIITGT

SEQ ID NO: 917888 - protein, 9 aa, Homo Sapiens
LNQRNCMAA

SEQ ID NO: 917889 - protein, 9 aa, Homo Sapiens
PTPKSDSYL

SEQ ID NO: 917890 - protein, 9 aa, Homo Sapiens
KPGFEEYNN

SEQ ID NO: 917891 - protein, 9 aa, Homo Sapiens
NKSQESIFV

SEQ ID NO: 917892 - protein, 9 aa, Homo Sapiens
RFYGCYCGW

SEQ ID NO: 917893 - protein, 9 aa, Homo Sapiens
PSVTDKIIH

SEQ ID NO: 917894 - protein, 9 aa, Homo Sapiens
PPLLPPFLQ

SEQ ID NO: 917895 - protein, 9 aa, Homo Sapiens
SPKAAPPPP

SEQ ID NO: 917896 - protein, 9 aa, Homo Sapiens
HAITIKPTS

SEQ ID NO: 917897 - protein, 9 aa, Homo Sapiens
NFHGKKGKI

SEQ ID NO: 917898 - protein, 9 aa, Homo Sapiens
NRENAYHCG

SEQ ID NO: 917899 - protein, 9 aa, Homo Sapiens
TSKIFGVSD

SEQ ID NO: 917900 - protein, 9 aa, Homo Sapiens
EKKMITSLF

SEQ ID NO: 917901 - protein, 9 aa, Homo Sapiens
DAKSRGFLK

SEQ ID NO: 917902 - protein, 9 aa, Homo Sapiens
PNLKSLLFL

SEQ ID NO: 917903 - protein, 9 aa, Homo Sapiens
SSRHPRSHH

SEQ ID NO: 917904 - protein, 9 aa, Homo Sapiens
LGLPTPKSD

SEQ ID NO: 917905 - protein, 9 aa, Homo Sapiens
SVHHLVLTA

SEQ ID NO: 917906 - protein, 9 aa, Homo Sapiens
KEKKMITSL

SEQ ID NO: 917907 - protein, 9 aa, Homo Sapiens
EAWPTLLRT

SEQ ID NO: 917908 - protein, 9 aa, Homo Sapiens
EQLEQKEQE

SEQ ID NO: 917909 - protein, 9 aa, Homo Sapiens
AKYAAATRG

SEQ ID NO: 917910 - protein, 9 aa, Homo Sapiens
SPSYVPVVM

SEQ ID NO: 917911 - protein, 9 aa, Homo Sapiens
AWVGVAAVG

SEQ ID NO: 917912 - protein, 9 aa, Homo Sapiens
RSVHGDPPG

SEQ ID NO: 917913 - protein, 9 aa, Homo Sapiens
AATRGPPPT

SEQ ID NO: 917914 - protein, 9 aa, Homo Sapiens
LFLVITFFM

SEQ ID NO: 917915 - protein, 9 aa, Homo Sapiens
LKGNILGEK

SEQ ID NO: 917916 - protein, 9 aa, Homo Sapiens
SPDSLKGSS

SEQ ID NO: 917917 - protein, 9 aa, Homo Sapiens
DLPTVLPLG

SEQ ID NO: 917918 - protein, 9 aa, Homo Sapiens
LYAVPIREQ

SEQ ID NO: 917919 - protein, 9 aa, Homo Sapiens
KDYMARTPY

SEQ ID NO: 917920 - protein, 9 aa, Homo Sapiens
LFFFNTKYF

SEQ ID NO: 917921 - protein, 9 aa, Homo Sapiens
TRILFIDNI

SEQ ID NO: 917922 - protein, 9 aa, Homo Sapiens
NQSEYIPSF

SEQ ID NO: 917923 - protein, 9 aa, Homo Sapiens
LDLVIAEKK

SEQ ID NO: 917924 - protein, 9 aa, Homo Sapiens
HESTSSQFL

SEQ ID NO: 917925 - protein, 9 aa, Homo Sapiens
MAPNQELPR

SEQ ID NO: 917926 - protein, 9 aa, Homo Sapiens
DLTTSRTPC

SEQ ID NO: 917927 - protein, 9 aa, Homo Sapiens
CDITDKLRQ

SEQ ID NO: 917928 - protein, 9 aa, Homo Sapiens
KATLCGDSF

SEQ ID NO: 917929 - protein, 9 aa, Homo Sapiens
TVFLSSTII

SEQ ID NO: 917930 - protein, 9 aa, Homo Sapiens
EDLDLVIAE

SEQ ID NO: 917931 - protein, 9 aa, Homo Sapiens
TSKEKAKIV

SEQ ID NO: 917932 - protein, 9 aa, Homo Sapiens
FLLIAIKPV

SEQ ID NO: 917933 - protein, 9 aa, Homo Sapiens
IYDLCAICN

SEQ ID NO: 917934 - protein, 9 aa, Homo Sapiens
YRKEKNQNK

SEQ ID NO: 917935 - protein, 9 aa, Homo Sapiens
PQGYRMEQL

SEQ ID NO: 917936 - protein, 9 aa, Homo Sapiens
AVKKLTVNS

SEQ ID NO: 917937 - protein, 9 aa, Homo Sapiens
LVFLHTLIF

SEQ ID NO: 917938 - protein, 9 aa, Homo Sapiens
KQESQITYL

SEQ ID NO: 917939 - protein, 9 aa, Homo Sapiens
KLESTVSSP

SEQ ID NO: 917940 - protein, 9 aa, Homo Sapiens
VTGSSFGLL

SEQ ID NO: 917941 - protein, 9 aa, Homo Sapiens
EKVSFLQPY

SEQ ID NO: 917942 - protein, 9 aa, Homo Sapiens
AIQSLLSSS

SEQ ID NO: 917943 - protein, 9 aa, Homo Sapiens
DFVEVSEKE

SEQ ID NO: 917944 - protein, 9 aa, Homo Sapiens
PAAAAFESG

SEQ ID NO: 917945 - protein, 9 aa, Homo Sapiens
RLVKKGSPE

SEQ ID NO: 917946 - protein, 9 aa, Homo Sapiens
EKERSVLNN

SEQ ID NO: 917947 - protein, 9 aa, Homo Sapiens
LVKKGSPEP

SEQ ID NO: 917948 - protein, 9 aa, Homo Sapiens
QGIPLQRDD

SEQ ID NO: 917949 - protein, 9 aa, Homo Sapiens
SRRHQAIFI

SEQ ID NO: 917950 - protein, 9 aa, Homo Sapiens
LWLGCLLLV

SEQ ID NO: 917951 - protein, 9 aa, Homo Sapiens
WLEDVTSGY

SEQ ID NO: 917952 - protein, 9 aa, Homo Sapiens
MARTGGMMV

SEQ ID NO: 917953 - protein, 9 aa, Homo Sapiens
AKDPQQVST

SEQ ID NO: 917954 - protein, 9 aa, Homo Sapiens
TRSARLLTR

SEQ ID NO: 917955 - protein, 9 aa, Homo Sapiens
AFASLFPSG

SEQ ID NO: 917956 - protein, 9 aa, Homo Sapiens
VSDSVFPCG

SEQ ID NO: 917957 - protein, 9 aa, Homo Sapiens
YINSTVNLV

SEQ ID NO: 917958 - protein, 9 aa, Homo Sapiens
PGLAPLTLK

SEQ ID NO: 917959 - protein, 9 aa, Homo Sapiens
PGPIAGQAP

SEQ ID NO: 917960 - protein, 9 aa, Homo Sapiens
TRDGVNDAV

SEQ ID NO: 917961 - protein, 9 aa, Homo Sapiens
NCSFQFSLK

SEQ ID NO: 917962 - protein, 9 aa, Homo Sapiens
QDKVPQQTV

SEQ ID NO: 917963 - protein, 9 aa, Homo Sapiens
GRKMEMLCA

SEQ ID NO: 917964 - protein, 9 aa, Homo Sapiens
NQNKKIDGK

SEQ ID NO: 917965 - protein, 9 aa, Homo Sapiens
LLSSSRVMP

SEQ ID NO: 917966 - protein, 9 aa, Homo Sapiens
CALMKMRHP

SEQ ID NO: 917967 - protein, 9 aa, Homo Sapiens
PMWSQQVIY

SEQ ID NO: 917968 - protein, 9 aa, Homo Sapiens
PYPENEIGG

SEQ ID NO: 917969 - protein, 9 aa, Homo Sapiens
KKFLWTIEP

SEQ ID NO: 917970 - protein, 9 aa, Homo Sapiens
SPRVLSPPP

SEQ ID NO: 917971 - protein, 9 aa, Homo Sapiens
IKFLVALLV

SEQ ID NO: 917972 - protein, 9 aa, Homo Sapiens
RKEKNQNKK

SEQ ID NO: 917973 - protein, 9 aa, Homo Sapiens
DPVPTAFWC

SEQ ID NO: 917974 - protein, 9 aa, Homo Sapiens
FLNVFELKR

SEQ ID NO: 917975 - protein, 9 aa, Homo Sapiens
MIVDEGYRM

SEQ ID NO: 917976 - protein, 9 aa, Homo Sapiens
TLGLPTPKS

SEQ ID NO: 917977 - protein, 9 aa, Homo Sapiens
RDTDETGNY

SEQ ID NO: 917978 - protein, 9 aa, Homo Sapiens
RYIIQLTTL

SEQ ID NO: 917979 - protein, 9 aa, Homo Sapiens
VGTHNAVNK

SEQ ID NO: 917980 - protein, 9 aa, Homo Sapiens
GAVGFLLLE

SEQ ID NO: 917981 - protein, 9 aa, Homo Sapiens
EDVSSELDP

SEQ ID NO: 917982 - protein, 9 aa, Homo Sapiens
IVLVAGFLS

SEQ ID NO: 917983 - protein, 9 aa, Homo Sapiens
RLADAAENY

SEQ ID NO: 917984 - protein, 9 aa, Homo Sapiens
RIAKEIQGI

SEQ ID NO: 917985 - protein, 9 aa, Homo Sapiens
TVLPLGFTI

SEQ ID NO: 917986 - protein, 9 aa, Homo Sapiens
VPILNPLDS

SEQ ID NO: 917987 - protein, 9 aa, Homo Sapiens
PEQIDFLPF

SEQ ID NO: 917988 - protein, 9 aa, Homo Sapiens
DLKAKGILV

SEQ ID NO: 917989 - protein, 9 aa, Homo Sapiens
ANSPSSDER

SEQ ID NO: 917990 - protein, 9 aa, Homo Sapiens
MLKQFSNSG

SEQ ID NO: 917991 - protein, 9 aa, Homo Sapiens
FQRGNKIEV

SEQ ID NO: 917992 - protein, 9 aa, Homo Sapiens
KIWEQEEKM

SEQ ID NO: 917993 - protein, 9 aa, Homo Sapiens
ICNPLYHPT

SEQ ID NO: 917994 - protein, 9 aa, Homo Sapiens
RQLQATVSH

SEQ ID NO: 917995 - protein, 9 aa, Homo Sapiens
LQIPMWSQQ

SEQ ID NO: 917996 - protein, 9 aa, Homo Sapiens
IINYDDESE

SEQ ID NO: 917997 - protein, 9 aa, Homo Sapiens
KILSSEEFS

SEQ ID NO: 917998 - protein, 9 aa, Homo Sapiens
YKVNTHMLQ

SEQ ID NO: 917999 - protein, 9 aa, Homo Sapiens
EKEDEDEVE

SEQ ID NO: 918000 - protein, 9 aa, Homo Sapiens
APIKTIVRG

SEQ ID NO: 918001 - protein, 9 aa, Homo Sapiens
LNEELNFLI

SEQ ID NO: 918002 - protein, 9 aa, Homo Sapiens
QSILVATPS

SEQ ID NO: 918003 - protein, 9 aa, Homo Sapiens
GFLSLVTII

SEQ ID NO: 918004 - protein, 9 aa, Homo Sapiens
LRHHTLFQL

SEQ ID NO: 918005 - protein, 9 aa, Homo Sapiens
FLLLDFVPT

SEQ ID NO: 918006 - protein, 9 aa, Homo Sapiens
LTLRPGWPQ

SEQ ID NO: 918007 - protein, 9 aa, Homo Sapiens
TFKKWGTRD

SEQ ID NO: 918008 - protein, 9 aa, Homo Sapiens
VIADNSEGL

SEQ ID NO: 918009 - protein, 9 aa, Homo Sapiens
RHEKKKKVC

SEQ ID NO: 918010 - protein, 9 aa, Homo Sapiens
GYRSFRRSD

SEQ ID NO: 918011 - protein, 9 aa, Homo Sapiens
KDSMQCTCE

SEQ ID NO: 918012 - protein, 9 aa, Homo Sapiens
HSIDWIDEI

SEQ ID NO: 918013 - protein, 9 aa, Homo Sapiens
ELDPEGSKD

SEQ ID NO: 918014 - protein, 9 aa, Homo Sapiens
SCLRRALQM

SEQ ID NO: 918015 - protein, 9 aa, Homo Sapiens
LVDSVSKAV

SEQ ID NO: 918016 - protein, 9 aa, Homo Sapiens
MLILPPVSV

SEQ ID NO: 918017 - protein, 9 aa, Homo Sapiens
LPASFLPPS

SEQ ID NO: 918018 - protein, 9 aa, Homo Sapiens
AEGDLGRRG

SEQ ID NO: 918019 - protein, 9 aa, Homo Sapiens
EYRLVKKGS

SEQ ID NO: 918020 - protein, 9 aa, Homo Sapiens
CNPLYHPTI

SEQ ID NO: 918021 - protein, 9 aa, Homo Sapiens
DVSSELDPE

SEQ ID NO: 918022 - protein, 9 aa, Homo Sapiens
YHVRRKDLD

SEQ ID NO: 918023 - protein, 9 aa, Homo Sapiens
GDKEKTMDK

SEQ ID NO: 918024 - protein, 9 aa, Homo Sapiens
SASQNVIPS

SEQ ID NO: 918025 - protein, 9 aa, Homo Sapiens
IVGTHNAVN

SEQ ID NO: 918026 - protein, 9 aa, Homo Sapiens
APGGSRASP

SEQ ID NO: 918027 - protein, 9 aa, Homo Sapiens
GRDFSVQWN

SEQ ID NO: 918028 - protein, 9 aa, Homo Sapiens
NIIYDLCAI

SEQ ID NO: 918029 - protein, 9 aa, Homo Sapiens
QDGPPGDKE

SEQ ID NO: 918030 - protein, 9 aa, Homo Sapiens
KGERGKNSV

SEQ ID NO: 918031 - protein, 9 aa, Homo Sapiens
ESTSSQFLG

SEQ ID NO: 918032 - protein, 9 aa, Homo Sapiens
IWLLILSYV

SEQ ID NO: 918033 - protein, 9 aa, Homo Sapiens
EVRQGVEEM

SEQ ID NO: 918034 - protein, 9 aa, Homo Sapiens
VAKDPQQVS

SEQ ID NO: 918035 - protein, 9 aa, Homo Sapiens
FPIIQQYKC

SEQ ID NO: 918036 - protein, 9 aa, Homo Sapiens
TTPILVSSS

SEQ ID NO: 918037 - protein, 9 aa, Homo Sapiens
WKRWPLLND

SEQ ID NO: 918038 - protein, 9 aa, Homo Sapiens
LMKMRHPNS

SEQ ID NO: 918039 - protein, 9 aa, Homo Sapiens
YGLQSKAVK

SEQ ID NO: 918040 - protein, 9 aa, Homo Sapiens
LTTSRTPCF

SEQ ID NO: 918041 - protein, 9 aa, Homo Sapiens
DDPFIFITK

SEQ ID NO: 918042 - protein, 9 aa, Homo Sapiens
TLHMIGLRG

SEQ ID NO: 918043 - protein, 9 aa, Homo Sapiens
ISYYNMERI

SEQ ID NO: 918044 - protein, 9 aa, Homo Sapiens
FLYKPCGVS

SEQ ID NO: 918045 - protein, 9 aa, Homo Sapiens
QEHKSQGSG

SEQ ID NO: 918046 - protein, 9 aa, Homo Sapiens
FYNSRVILF

SEQ ID NO: 918047 - protein, 9 aa, Homo Sapiens
KFDRVVIYT

SEQ ID NO: 918048 - protein, 9 aa, Homo Sapiens
TIQEELYRV

SEQ ID NO: 918049 - protein, 9 aa, Homo Sapiens
PSPDGDGPL

SEQ ID NO: 918050 - protein, 9 aa, Homo Sapiens
NCSNFPQMG

SEQ ID NO: 918051 - protein, 9 aa, Homo Sapiens
YFFSEHQLP

SEQ ID NO: 918052 - protein, 9 aa, Homo Sapiens
YPKFVVMVS

SEQ ID NO: 918053 - protein, 9 aa, Homo Sapiens
LRTLEGIYR

SEQ ID NO: 918054 - protein, 9 aa, Homo Sapiens
DSGCSRRQR

SEQ ID NO: 918055 - protein, 9 aa, Homo Sapiens
KPEELNREN

SEQ ID NO: 918056 - protein, 9 aa, Homo Sapiens
SFGDVASPS

SEQ ID NO: 918057 - protein, 9 aa, Homo Sapiens
RQRLKEYFQ

SEQ ID NO: 918058 - protein, 9 aa, Homo Sapiens
LVVGSGVSG

SEQ ID NO: 918059 - protein, 9 aa, Homo Sapiens
DWIDEIKAH

SEQ ID NO: 918060 - protein, 9 aa, Homo Sapiens
PLGAETRLQ

SEQ ID NO: 918061 - protein, 9 aa, Homo Sapiens
NVPRNQLQG

SEQ ID NO: 918062 - protein, 9 aa, Homo Sapiens
GIDHHVFSA

SEQ ID NO: 918063 - protein, 9 aa, Homo Sapiens
SVLWLKDSM

SEQ ID NO: 918064 - protein, 9 aa, Homo Sapiens
YLHKQWLLK

SEQ ID NO: 918065 - protein, 9 aa, Homo Sapiens
PQEKEDADE

SEQ ID NO: 918066 - protein, 9 aa, Homo Sapiens
PSTDLKFDR

SEQ ID NO: 918067 - protein, 9 aa, Homo Sapiens
GSISALKFS

SEQ ID NO: 918068 - protein, 9 aa, Homo Sapiens
GGRFGDFQP

SEQ ID NO: 918069 - protein, 9 aa, Homo Sapiens
ATTGVSRDS

SEQ ID NO: 918070 - protein, 9 aa, Homo Sapiens
SFNPGVIAA

SEQ ID NO: 918071 - protein, 9 aa, Homo Sapiens
KLMRIEDPF

SEQ ID NO: 918072 - protein, 9 aa, Homo Sapiens
VNCSNFPQM

SEQ ID NO: 918073 - protein, 9 aa, Homo Sapiens
KVEPQEVSG

SEQ ID NO: 918074 - protein, 9 aa, Homo Sapiens
FVRKTFFTF

SEQ ID NO: 918075 - protein, 9 aa, Homo Sapiens
KLMTESSLF

SEQ ID NO: 918076 - protein, 9 aa, Homo Sapiens
VIPSRTVTR

SEQ ID NO: 918077 - protein, 9 aa, Homo Sapiens
DPLDKKLMT

SEQ ID NO: 918078 - protein, 9 aa, Homo Sapiens
FPNETNLVG

SEQ ID NO: 918079 - protein, 9 aa, Homo Sapiens
HIGDDPFIF

SEQ ID NO: 918080 - protein, 9 aa, Homo Sapiens
ENRQKQFNR

SEQ ID NO: 918081 - protein, 9 aa, Homo Sapiens
HPCFLLPGD

SEQ ID NO: 918082 - protein, 9 aa, Homo Sapiens
GDGPLCEPN

SEQ ID NO: 918083 - protein, 9 aa, Homo Sapiens
AMTRDGVND

SEQ ID NO: 918084 - protein, 9 aa, Homo Sapiens
SFHSSEIQR

SEQ ID NO: 918085 - protein, 9 aa, Homo Sapiens
SFQFSLKNI

SEQ ID NO: 918086 - protein, 9 aa, Homo Sapiens
YFRIVTMNS

SEQ ID NO: 918087 - protein, 9 aa, Homo Sapiens
VDSEGHLYA

SEQ ID NO: 918088 - protein, 9 aa, Homo Sapiens
QVPPQGCYV

SEQ ID NO: 918089 - protein, 9 aa, Homo Sapiens
VNGSRPPWT

SEQ ID NO: 918090 - protein, 9 aa, Homo Sapiens
EIPGSEQWK

SEQ ID NO: 918091 - protein, 9 aa, Homo Sapiens
KEMTMEQLE

SEQ ID NO: 918092 - protein, 9 aa, Homo Sapiens
SEIFSPPAC

SEQ ID NO: 918093 - protein, 9 aa, Homo Sapiens
KEDADEERA

SEQ ID NO: 918094 - protein, 9 aa, Homo Sapiens
WLLILSYVG

SEQ ID NO: 918095 - protein, 9 aa, Homo Sapiens
RSHLWGHKR

SEQ ID NO: 918096 - protein, 9 aa, Homo Sapiens
VDPPGIPVF

SEQ ID NO: 918097 - protein, 9 aa, Homo Sapiens
MGNVNQSVA

SEQ ID NO: 918098 - protein, 9 aa, Homo Sapiens
SANYDLVLG

SEQ ID NO: 918099 - protein, 9 aa, Homo Sapiens
VLVSDSVFP

SEQ ID NO: 918100 - protein, 9 aa, Homo Sapiens
TISLMTNEP

SEQ ID NO: 918101 - protein, 9 aa, Homo Sapiens
EKSSLEGAW

SEQ ID NO: 918102 - protein, 9 aa, Homo Sapiens
GGLFASLGL

SEQ ID NO: 918103 - protein, 9 aa, Homo Sapiens
AKTSASQNV

SEQ ID NO: 918104 - protein, 9 aa, Homo Sapiens
FASLGLVAA

SEQ ID NO: 918105 - protein, 9 aa, Homo Sapiens
PGSHFVSVD

SEQ ID NO: 918106 - protein, 9 aa, Homo Sapiens
GALEGQMFW

SEQ ID NO: 918107 - protein, 9 aa, Homo Sapiens
SRDSSRHPR

SEQ ID NO: 918108 - protein, 9 aa, Homo Sapiens
GHLYAVPIR

SEQ ID NO: 918109 - protein, 9 aa, Homo Sapiens
LDQLGITKE

SEQ ID NO: 918110 - protein, 9 aa, Homo Sapiens
RLIEKREVI

SEQ ID NO: 918111 - protein, 9 aa, Homo Sapiens
EYIPSFLKK

SEQ ID NO: 918112 - protein, 9 aa, Homo Sapiens
LQDVLFPNS

SEQ ID NO: 918113 - protein, 9 aa, Homo Sapiens
LHPSQENFF

SEQ ID NO: 918114 - protein, 9 aa, Homo Sapiens
GQITEFGQW

SEQ ID NO: 918115 - protein, 9 aa, Homo Sapiens
GAGFFIRYE

SEQ ID NO: 918116 - protein, 9 aa, Homo Sapiens
NFSFLEIFF

SEQ ID NO: 918117 - protein, 9 aa, Homo Sapiens
SYILRTLEG

SEQ ID NO: 918118 - protein, 9 aa, Homo Sapiens
TLDRETQSV

SEQ ID NO: 918119 - protein, 9 aa, Homo Sapiens
TQKKIRVGI

SEQ ID NO: 918120 - protein, 9 aa, Homo Sapiens
TNYRFYGCY

SEQ ID NO: 918121 - protein, 9 aa, Homo Sapiens
SSMGPPSKP

SEQ ID NO: 918122 - protein, 9 aa, Homo Sapiens
VLVAHSDFE

SEQ ID NO: 918123 - protein, 9 aa, Homo Sapiens
ETRLQNGRR

SEQ ID NO: 918124 - protein, 9 aa, Homo Sapiens
STSNTLWIK

SEQ ID NO: 918125 - protein, 9 aa, Homo Sapiens
KKMITSLFC

SEQ ID NO: 918126 - protein, 9 aa, Homo Sapiens
LVAASFCRS

SEQ ID NO: 918127 - protein, 9 aa, Homo Sapiens
NYQVIADNS

SEQ ID NO: 918128 - protein, 9 aa, Homo Sapiens
ETKDGMLVV

SEQ ID NO: 918129 - protein, 9 aa, Homo Sapiens
EDASKDPAL

SEQ ID NO: 918130 - protein, 9 aa, Homo Sapiens
GLVAASFCR

SEQ ID NO: 918131 - protein, 9 aa, Homo Sapiens
RILFIDNIA

SEQ ID NO: 918132 - protein, 9 aa, Homo Sapiens
VAGGRLEKV

SEQ ID NO: 918133 - protein, 9 aa, Homo Sapiens
NLWHIDFGR

SEQ ID NO: 918134 - protein, 9 aa, Homo Sapiens
WIKIHPYLL

SEQ ID NO: 918135 - protein, 9 aa, Homo Sapiens
VNISNRRVL

SEQ ID NO: 918136 - protein, 9 aa, Homo Sapiens
VRSDSKQDK

SEQ ID NO: 918137 - protein, 9 aa, Homo Sapiens
ETTQNLVDF

SEQ ID NO: 918138 - protein, 9 aa, Homo Sapiens
QKHSAEGRQ

SEQ ID NO: 918139 - protein, 9 aa, Homo Sapiens
QARERMNTV

SEQ ID NO: 918140 - protein, 9 aa, Homo Sapiens
DGDGPLCEP

SEQ ID NO: 918141 - protein, 9 aa, Homo Sapiens
LPQNLWHID

SEQ ID NO: 918142 - protein, 9 aa, Homo Sapiens
DNWQGHGLG

SEQ ID NO: 918143 - protein, 9 aa, Homo Sapiens
NEPGLDNPA

SEQ ID NO: 918144 - protein, 9 aa, Homo Sapiens
VAQRDICIA

SEQ ID NO: 918145 - protein, 9 aa, Homo Sapiens
PPTTPILVS

SEQ ID NO: 918146 - protein, 9 aa, Homo Sapiens
WGHKRIHTG

SEQ ID NO: 918147 - protein, 9 aa, Homo Sapiens
FLEIFFTNI

SEQ ID NO: 918148 - protein, 9 aa, Homo Sapiens
TSHQKLEKE

SEQ ID NO: 918149 - protein, 9 aa, Homo Sapiens
LFIEVILFS

SEQ ID NO: 918150 - protein, 9 aa, Homo Sapiens
KSLKQEKEE

SEQ ID NO: 918151 - protein, 9 aa, Homo Sapiens
QKLEKERSV

SEQ ID NO: 918152 - protein, 9 aa, Homo Sapiens
DSRDIFLVG

SEQ ID NO: 918153 - protein, 9 aa, Homo Sapiens
KVSFLQPYP

SEQ ID NO: 918154 - protein, 9 aa, Homo Sapiens
LELQKVVRK

SEQ ID NO: 918155 - protein, 9 aa, Homo Sapiens
SRVQNTVQD

SEQ ID NO: 918156 - protein, 9 aa, Homo Sapiens
REAAGSQAA

SEQ ID NO: 918157 - protein, 9 aa, Homo Sapiens
PACSHVPTR

SEQ ID NO: 918158 - protein, 9 aa, Homo Sapiens
YGNNVLRLG

SEQ ID NO: 918159 - protein, 9 aa, Homo Sapiens
PLLNDEGED

SEQ ID NO: 918160 - protein, 9 aa, Homo Sapiens
SIKINIIYD

SEQ ID NO: 918161 - protein, 9 aa, Homo Sapiens
VQQHLDMLA

SEQ ID NO: 918162 - protein, 9 aa, Homo Sapiens
VPSPQVPPQ

SEQ ID NO: 918163 - protein, 9 aa, Homo Sapiens
LDNFFLKEG

SEQ ID NO: 918164 - protein, 9 aa, Homo Sapiens
LAIIMYMVP

SEQ ID NO: 918165 - protein, 9 aa, Homo Sapiens
HVITTTKRP

SEQ ID NO: 918166 - protein, 9 aa, Homo Sapiens
HHQKEVRQG

SEQ ID NO: 918167 - protein, 9 aa, Homo Sapiens
EKFGCALMK

SEQ ID NO: 918168 - protein, 9 aa, Homo Sapiens
LSLTVFLLG

SEQ ID NO: 918169 - protein, 9 aa, Homo Sapiens
MADQLMTLA

SEQ ID NO: 918170 - protein, 9 aa, Homo Sapiens
TYTGYFPII

SEQ ID NO: 918171 - protein, 9 aa, Homo Sapiens
KCLRFRRSL

SEQ ID NO: 918172 - protein, 9 aa, Homo Sapiens
SPKPAEVAV

SEQ ID NO: 918173 - protein, 9 aa, Homo Sapiens
GFSFHSSEI

SEQ ID NO: 918174 - protein, 9 aa, Homo Sapiens
AVKILAQEM

SEQ ID NO: 918175 - protein, 9 aa, Homo Sapiens
EGPPDLRGD

SEQ ID NO: 918176 - protein, 9 aa, Homo Sapiens
PTVVDDDLP

SEQ ID NO: 918177 - protein, 9 aa, Homo Sapiens
TVSSPEKPL

SEQ ID NO: 918178 - protein, 9 aa, Homo Sapiens
LQARERMNT

SEQ ID NO: 918179 - protein, 9 aa, Homo Sapiens
STIILVLPF

SEQ ID NO: 918180 - protein, 9 aa, Homo Sapiens
NFYAYDEDG

SEQ ID NO: 918181 - protein, 9 aa, Homo Sapiens
ESVGEAEMA

SEQ ID NO: 918182 - protein, 9 aa, Homo Sapiens
IMYMVPAGF

SEQ ID NO: 918183 - protein, 9 aa, Homo Sapiens
LTEKKSTLE

SEQ ID NO: 918184 - protein, 9 aa, Homo Sapiens
KAKGILVVG

SEQ ID NO: 918185 - protein, 9 aa, Homo Sapiens
AANVWPTKY

SEQ ID NO: 918186 - protein, 9 aa, Homo Sapiens
AKELSLPRK

SEQ ID NO: 918187 - protein, 9 aa, Homo Sapiens
IEVILFSSA

SEQ ID NO: 918188 - protein, 9 aa, Homo Sapiens
FSALEGAEA

SEQ ID NO: 918189 - protein, 9 aa, Homo Sapiens
CWKSFSEKS

SEQ ID NO: 918190 - protein, 9 aa, Homo Sapiens
QHLDMLAKS

SEQ ID NO: 918191 - protein, 9 aa, Homo Sapiens
KRLLYTGKT

SEQ ID NO: 918192 - protein, 9 aa, Homo Sapiens
SLLCTSLLS

SEQ ID NO: 918193 - protein, 9 aa, Homo Sapiens
QRIYTGEKP

SEQ ID NO: 918194 - protein, 9 aa, Homo Sapiens
ITGTVSTVK

SEQ ID NO: 918195 - protein, 9 aa, Homo Sapiens
ITSLLKSQP

SEQ ID NO: 918196 - protein, 9 aa, Homo Sapiens
PCLASAEMQ

SEQ ID NO: 918197 - protein, 9 aa, Homo Sapiens
VPIGDSNSY

SEQ ID NO: 918198 - protein, 9 aa, Homo Sapiens
LEQELRDDN

SEQ ID NO: 918199 - protein, 9 aa, Homo Sapiens
GCVDEDVFY

SEQ ID NO: 918200 - protein, 9 aa, Homo Sapiens
SLDSPTFSP

SEQ ID NO: 918201 - protein, 9 aa, Homo Sapiens
RNMVHRLIE

SEQ ID NO: 918202 - protein, 9 aa, Homo Sapiens
AKEKLARML

SEQ ID NO: 918203 - protein, 9 aa, Homo Sapiens
SPPLLPPFL

SEQ ID NO: 918204 - protein, 9 aa, Homo Sapiens
AGRCSPHYI

SEQ ID NO: 918205 - protein, 9 aa, Homo Sapiens
WEQEEKMWR

SEQ ID NO: 918206 - protein, 9 aa, Homo Sapiens
ARTPYWALF

SEQ ID NO: 918207 - protein, 9 aa, Homo Sapiens
TLFQLRQLQ

SEQ ID NO: 918208 - protein, 9 aa, Homo Sapiens
PPHPMMLKE

SEQ ID NO: 918209 - protein, 9 aa, Homo Sapiens
NQMDKTRRH

SEQ ID NO: 918210 - protein, 9 aa, Homo Sapiens
IMQISSGYY

SEQ ID NO: 918211 - protein, 9 aa, Homo Sapiens
PSESFDAVA

SEQ ID NO: 918212 - protein, 9 aa, Homo Sapiens
SMLNQEHKS

SEQ ID NO: 918213 - protein, 9 aa, Homo Sapiens
AAQPALAEP

SEQ ID NO: 918214 - protein, 9 aa, Homo Sapiens
SQCLHGLVG

SEQ ID NO: 918215 - protein, 9 aa, Homo Sapiens
GTNSEIFSP

SEQ ID NO: 918216 - protein, 9 aa, Homo Sapiens
LVLFLDFSD

SEQ ID NO: 918217 - protein, 9 aa, Homo Sapiens
RLSFVGKLG

SEQ ID NO: 918218 - protein, 9 aa, Homo Sapiens
NSNFVPVND

SEQ ID NO: 918219 - protein, 9 aa, Homo Sapiens
STVSSPEKP

SEQ ID NO: 918220 - protein, 9 aa, Homo Sapiens
VDSVSKAVS

SEQ ID NO: 918221 - protein, 9 aa, Homo Sapiens
RGNKNFECH

SEQ ID NO: 918222 - protein, 9 aa, Homo Sapiens
NIFRIYVSI

SEQ ID NO: 918223 - protein, 9 aa, Homo Sapiens
IMTNGLCIW

SEQ ID NO: 918224 - protein, 9 aa, Homo Sapiens
VSEKEGYEP

SEQ ID NO: 918225 - protein, 9 aa, Homo Sapiens
HMGSCRSVG

SEQ ID NO: 918226 - protein, 9 aa, Homo Sapiens
LCEPNLWMW

SEQ ID NO: 918227 - protein, 9 aa, Homo Sapiens
INIIYDLCA

SEQ ID NO: 918228 - protein, 9 aa, Homo Sapiens
KFRSESKRM

SEQ ID NO: 918229 - protein, 9 aa, Homo Sapiens
YWTLLSNLV

SEQ ID NO: 918230 - protein, 9 aa, Homo Sapiens
FLFIEVILF

SEQ ID NO: 918231 - protein, 9 aa, Homo Sapiens
KELSLPRKG

SEQ ID NO: 918232 - protein, 9 aa, Homo Sapiens
EERKIKFLV

SEQ ID NO: 918233 - protein, 9 aa, Homo Sapiens
RGQLEKIMA

SEQ ID NO: 918234 - protein, 9 aa, Homo Sapiens
EYLHKNLPV

SEQ ID NO: 918235 - protein, 9 aa, Homo Sapiens
GNSAPYAPA

SEQ ID NO: 918236 - protein, 9 aa, Homo Sapiens
QIDFLPFVL

SEQ ID NO: 918237 - protein, 9 aa, Homo Sapiens
VFPIQYLFL

SEQ ID NO: 918238 - protein, 9 aa, Homo Sapiens
GCMQTRASL

SEQ ID NO: 918239 - protein, 9 aa, Homo Sapiens
ETNLVGPPA

SEQ ID NO: 918240 - protein, 9 aa, Homo Sapiens
RCYWSDMFT

SEQ ID NO: 918241 - protein, 9 aa, Homo Sapiens
SPSCLYAGV

SEQ ID NO: 918242 - protein, 9 aa, Homo Sapiens
VGLNLDYER

SEQ ID NO: 918243 - protein, 9 aa, Homo Sapiens
LSHPPNLKS

SEQ ID NO: 918244 - protein, 9 aa, Homo Sapiens
TICNPLYHP

SEQ ID NO: 918245 - protein, 9 aa, Homo Sapiens
HVGGPPPSS

SEQ ID NO: 918246 - protein, 9 aa, Homo Sapiens
PSFICLQSS

SEQ ID NO: 918247 - protein, 9 aa, Homo Sapiens
HELVNRLIL

SEQ ID NO: 918248 - protein, 9 aa, Homo Sapiens
PAHGYCSRI

SEQ ID NO: 918249 - protein, 9 aa, Homo Sapiens
VHHLVLTAL

SEQ ID NO: 918250 - protein, 9 aa, Homo Sapiens
AQKGGEIPG

SEQ ID NO: 918251 - protein, 9 aa, Homo Sapiens
KCRGDKEKT

SEQ ID NO: 918252 - protein, 9 aa, Homo Sapiens
VPDRQNFCP

SEQ ID NO: 918253 - protein, 9 aa, Homo Sapiens
VRKTFFTFA

SEQ ID NO: 918254 - protein, 9 aa, Homo Sapiens
CKEGLDINF

SEQ ID NO: 918255 - protein, 9 aa, Homo Sapiens
ALFLMAAGK

SEQ ID NO: 918256 - protein, 9 aa, Homo Sapiens
QSFFFSALE

SEQ ID NO: 918257 - protein, 9 aa, Homo Sapiens
TFFFCRLLS

SEQ ID NO: 918258 - protein, 9 aa, Homo Sapiens
LFWKLYESV

SEQ ID NO: 918259 - protein, 9 aa, Homo Sapiens
VPSTPSPKA

SEQ ID NO: 918260 - protein, 9 aa, Homo Sapiens
DGPPGDKED

SEQ ID NO: 918261 - protein, 9 aa, Homo Sapiens
FSHIYFKKF

SEQ ID NO: 918262 - protein, 9 aa, Homo Sapiens
IGILITDEK

SEQ ID NO: 918263 - protein, 9 aa, Homo Sapiens
DFGKITPLP

SEQ ID NO: 918264 - protein, 9 aa, Homo Sapiens
TLTEKTITL

SEQ ID NO: 918265 - protein, 9 aa, Homo Sapiens
PRGSSSATT

SEQ ID NO: 918266 - protein, 9 aa, Homo Sapiens
ILVVGSGVS

SEQ ID NO: 918267 - protein, 9 aa, Homo Sapiens
ASKNGIAPV

SEQ ID NO: 918268 - protein, 9 aa, Homo Sapiens
KEREKDWEK

SEQ ID NO: 918269 - protein, 9 aa, Homo Sapiens
PTVLPLGFT

SEQ ID NO: 918270 - protein, 9 aa, Homo Sapiens
ERKSLKSCR

SEQ ID NO: 918271 - protein, 9 aa, Homo Sapiens
SGALPVPPT

SEQ ID NO: 918272 - protein, 9 aa, Homo Sapiens
EAFGFSDIT

SEQ ID NO: 918273 - protein, 9 aa, Homo Sapiens
PIQLAPIKT

SEQ ID NO: 918274 - protein, 9 aa, Homo Sapiens
LEKIMANTT

SEQ ID NO: 918275 - protein, 9 aa, Homo Sapiens
FLESLGQGI

SEQ ID NO: 918276 - protein, 9 aa, Homo Sapiens
ECLECWKSF

SEQ ID NO: 918277 - protein, 9 aa, Homo Sapiens
VEDFQRGNK

SEQ ID NO: 918278 - protein, 9 aa, Homo Sapiens
SLGSGESSF

SEQ ID NO: 918279 - protein, 9 aa, Homo Sapiens
KIIHATQDA

SEQ ID NO: 918280 - protein, 9 aa, Homo Sapiens
HQKEVRQGV

SEQ ID NO: 918281 - protein, 9 aa, Homo Sapiens
VGFLLLEWY

SEQ ID NO: 918282 - protein, 9 aa, Homo Sapiens
AGVPGVEVS

SEQ ID NO: 918283 - protein, 9 aa, Homo Sapiens
MMLPQNLWH

SEQ ID NO: 918284 - protein, 9 aa, Homo Sapiens
AANMTEWKH

SEQ ID NO: 918285 - protein, 9 aa, Homo Sapiens
PKPPKLPRP

SEQ ID NO: 918286 - protein, 9 aa, Homo Sapiens
GELQYYGMP

SEQ ID NO: 918287 - protein, 9 aa, Homo Sapiens
CIWLLILSY

SEQ ID NO: 918288 - protein, 9 aa, Homo Sapiens
ELKRCYWSD

SEQ ID NO: 918289 - protein, 9 aa, Homo Sapiens
KEVRQGVEE

SEQ ID NO: 918290 - protein, 9 aa, Homo Sapiens
SCLSPRGSS

SEQ ID NO: 918291 - protein, 9 aa, Homo Sapiens
LETEMKSYR

SEQ ID NO: 918292 - protein, 9 aa, Homo Sapiens
IQEGFKSGF

SEQ ID NO: 918293 - protein, 9 aa, Homo Sapiens
HVFSANYDL

SEQ ID NO: 918294 - protein, 9 aa, Homo Sapiens
GTETFWSKD

SEQ ID NO: 918295 - protein, 9 aa, Homo Sapiens
GDKEDDGEP

SEQ ID NO: 918296 - protein, 9 aa, Homo Sapiens
DERKSLKSC

SEQ ID NO: 918297 - protein, 9 aa, Homo Sapiens
LATRSVHGD

SEQ ID NO: 918298 - protein, 9 aa, Homo Sapiens
GDSGALPVP

SEQ ID NO: 918299 - protein, 9 aa, Homo Sapiens
ARNNSIFSA

SEQ ID NO: 918300 - protein, 9 aa, Homo Sapiens
SPDGDGPLC

SEQ ID NO: 918301 - protein, 9 aa, Homo Sapiens
DKTKDKSLE

SEQ ID NO: 918302 - protein, 9 aa, Homo Sapiens
ATIPPTVVD

SEQ ID NO: 918303 - protein, 9 aa, Homo Sapiens
EITKEMTME

SEQ ID NO: 918304 - protein, 9 aa, Homo Sapiens
DSNSYSLTK

SEQ ID NO: 918305 - protein, 9 aa, Homo Sapiens
SQSQRLFAA

SEQ ID NO: 918306 - protein, 9 aa, Homo Sapiens
ILFGSSAKS

SEQ ID NO: 918307 - protein, 9 aa, Homo Sapiens
AERQNLSVN

SEQ ID NO: 918308 - protein, 9 aa, Homo Sapiens
QITEFGQWN

SEQ ID NO: 918309 - protein, 9 aa, Homo Sapiens
VIQLPKQTP

SEQ ID NO: 918310 - protein, 9 aa, Homo Sapiens
GAASPYLSI

SEQ ID NO: 918311 - protein, 9 aa, Homo Sapiens
YQVIADNSE

SEQ ID NO: 918312 - protein, 9 aa, Homo Sapiens
PFLEEDPGP

SEQ ID NO: 918313 - protein, 9 aa, Homo Sapiens
AEKKARAVS

SEQ ID NO: 918314 - protein, 9 aa, Homo Sapiens
PPKLPRPPK

SEQ ID NO: 918315 - protein, 9 aa, Homo Sapiens
APEFIPRVL

SEQ ID NO: 918316 - protein, 9 aa, Homo Sapiens
FTGVIIQGR

SEQ ID NO: 918317 - protein, 9 aa, Homo Sapiens
PNSSLVVLL

SEQ ID NO: 918318 - protein, 9 aa, Homo Sapiens
VFRSPACQC

SEQ ID NO: 918319 - protein, 9 aa, Homo Sapiens
ALHQAKEKL

SEQ ID NO: 918320 - protein, 9 aa, Homo Sapiens
GAALCPTFQ

SEQ ID NO: 918321 - protein, 9 aa, Homo Sapiens
LSKLESTVS

SEQ ID NO: 918322 - protein, 9 aa, Homo Sapiens
NLVCYALCN

SEQ ID NO: 918323 - protein, 9 aa, Homo Sapiens
DKIFSCAFN

SEQ ID NO: 918324 - protein, 9 aa, Homo Sapiens
KLASGDEGS

SEQ ID NO: 918325 - protein, 9 aa, Homo Sapiens
TFNLPFQFT

SEQ ID NO: 918326 - protein, 9 aa, Homo Sapiens
KENLQARER

SEQ ID NO: 918327 - protein, 9 aa, Homo Sapiens
TVSHKVGRD

SEQ ID NO: 918328 - protein, 9 aa, Homo Sapiens
NFYEVAGSA

SEQ ID NO: 918329 - protein, 9 aa, Homo Sapiens
FESVSQSFI

SEQ ID NO: 918330 - protein, 9 aa, Homo Sapiens
FCLGKFDKP

SEQ ID NO: 918331 - protein, 9 aa, Homo Sapiens
KQFSNSGLS

SEQ ID NO: 918332 - protein, 9 aa, Homo Sapiens
AEAQKVEPQ

SEQ ID NO: 918333 - protein, 9 aa, Homo Sapiens
KPGDTQKKI

SEQ ID NO: 918334 - protein, 9 aa, Homo Sapiens
RSRKQRTLF

SEQ ID NO: 918335 - protein, 9 aa, Homo Sapiens
TIPPTVVDD

SEQ ID NO: 918336 - protein, 9 aa, Homo Sapiens
EKNLTYLQL

SEQ ID NO: 918337 - protein, 9 aa, Homo Sapiens
QLIQEGFKS

SEQ ID NO: 918338 - protein, 9 aa, Homo Sapiens
SILVATPSV

SEQ ID NO: 918339 - protein, 9 aa, Homo Sapiens
YQPAVTAQE

SEQ ID NO: 918340 - protein, 9 aa, Homo Sapiens
NMERIRLQW

SEQ ID NO: 918341 - protein, 9 aa, Homo Sapiens
TKDKSLEER

SEQ ID NO: 918342 - protein, 9 aa, Homo Sapiens
HRGSEPEKE

SEQ ID NO: 918343 - protein, 9 aa, Homo Sapiens
VFIVLVAGF

SEQ ID NO: 918344 - protein, 9 aa, Homo Sapiens
PENEIGGQV

SEQ ID NO: 918345 - protein, 9 aa, Homo Sapiens
SFHIPPTPF

SEQ ID NO: 918346 - protein, 9 aa, Homo Sapiens
ENVGGSGAP

SEQ ID NO: 918347 - protein, 9 aa, Homo Sapiens
ATISLMTNE

SEQ ID NO: 918348 - protein, 9 aa, Homo Sapiens
VLLSGGQRT

SEQ ID NO: 918349 - protein, 9 aa, Homo Sapiens
LPTVLPLGF

SEQ ID NO: 918350 - protein, 9 aa, Homo Sapiens
SKKPKTLSL

SEQ ID NO: 918351 - protein, 9 aa, Homo Sapiens
EDLKKKKED

SEQ ID NO: 918352 - protein, 9 aa, Homo Sapiens
GFVSPTSFV

SEQ ID NO: 918353 - protein, 9 aa, Homo Sapiens
LVSSSGASG

SEQ ID NO: 918354 - protein, 9 aa, Homo Sapiens
TINGDPEAV

SEQ ID NO: 918355 - protein, 9 aa, Homo Sapiens
EKQELLAIR

SEQ ID NO: 918356 - protein, 9 aa, Homo Sapiens
NSHLAELDL

SEQ ID NO: 918357 - protein, 9 aa, Homo Sapiens
PCLGNSAPY

SEQ ID NO: 918358 - protein, 9 aa, Homo Sapiens
LTNYRFYGC

SEQ ID NO: 918359 - protein, 9 aa, Homo Sapiens
IVGSSKFQS

SEQ ID NO: 918360 - protein, 9 aa, Homo Sapiens
SNFHGKKGK

SEQ ID NO: 918361 - protein, 9 aa, Homo Sapiens
QPLPKVIFT

SEQ ID NO: 918362 - protein, 9 aa, Homo Sapiens
STNDEAEDG

SEQ ID NO: 918363 - protein, 9 aa, Homo Sapiens
SPRHGGAPA

SEQ ID NO: 918364 - protein, 9 aa, Homo Sapiens
YSEEEEDQE

SEQ ID NO: 918365 - protein, 9 aa, Homo Sapiens
LTLKPDGTR

SEQ ID NO: 918366 - protein, 9 aa, Homo Sapiens
SEHQLPSEL

SEQ ID NO: 918367 - protein, 9 aa, Homo Sapiens
MFWKTGKLV

SEQ ID NO: 918368 - protein, 9 aa, Homo Sapiens
KSTTYHSSP

SEQ ID NO: 918369 - protein, 9 aa, Homo Sapiens
STHRMPGSV

SEQ ID NO: 918370 - protein, 9 aa, Homo Sapiens
QLRNCDDEV

SEQ ID NO: 918371 - protein, 9 aa, Homo Sapiens
GYSHSKGVV

SEQ ID NO: 918372 - protein, 9 aa, Homo Sapiens
KFSLQSGKQ

SEQ ID NO: 918373 - protein, 9 aa, Homo Sapiens
ISPRHGGAP

SEQ ID NO: 918374 - protein, 9 aa, Homo Sapiens
TFGVSSSCQ

SEQ ID NO: 918375 - protein, 9 aa, Homo Sapiens
IIHTGETPN

SEQ ID NO: 918376 - protein, 9 aa, Homo Sapiens
DSSDSEVAN

SEQ ID NO: 918377 - protein, 9 aa, Homo Sapiens
YYNMERIRL

SEQ ID NO: 918378 - protein, 9 aa, Homo Sapiens
SDSVFPCGD

SEQ ID NO: 918379 - protein, 9 aa, Homo Sapiens
MKHVETNFY

SEQ ID NO: 918380 - protein, 9 aa, Homo Sapiens
LGFYLWIKI

SEQ ID NO: 918381 - protein, 9 aa, Homo Sapiens
KAGQSDSDS

SEQ ID NO: 918382 - protein, 9 aa, Homo Sapiens
DKEREKDWE

SEQ ID NO: 918383 - protein, 9 aa, Homo Sapiens
SKEKAKIVT

SEQ ID NO: 918384 - protein, 9 aa, Homo Sapiens
GQMLATIPP

SEQ ID NO: 918385 - protein, 9 aa, Homo Sapiens
VRNYEFWDK

SEQ ID NO: 918386 - protein, 9 aa, Homo Sapiens
HRSASLAAL

SEQ ID NO: 918387 - protein, 9 aa, Homo Sapiens
NWKPGQPDN

SEQ ID NO: 918388 - protein, 9 aa, Homo Sapiens
TPLVTLFPP

SEQ ID NO: 918389 - protein, 9 aa, Homo Sapiens
SQKEWALLD

SEQ ID NO: 918390 - protein, 9 aa, Homo Sapiens
IKHVPRGGS

SEQ ID NO: 918391 - protein, 9 aa, Homo Sapiens
DGELQYYGM

SEQ ID NO: 918392 - protein, 9 aa, Homo Sapiens
SFSRSVTSN

SEQ ID NO: 918393 - protein, 9 aa, Homo Sapiens
RRSDPVNPY

SEQ ID NO: 918394 - protein, 9 aa, Homo Sapiens
KIRVGIIDD

SEQ ID NO: 918395 - protein, 9 aa, Homo Sapiens
PGLSSVLSP

SEQ ID NO: 918396 - protein, 9 aa, Homo Sapiens
PFQCEDCGK

SEQ ID NO: 918397 - protein, 9 aa, Homo Sapiens
MEPSTVPSE

SEQ ID NO: 918398 - protein, 9 aa, Homo Sapiens
DHPCFLLPG

SEQ ID NO: 918399 - protein, 9 aa, Homo Sapiens
WIDVIRLLQ

SEQ ID NO: 918400 - protein, 9 aa, Homo Sapiens
DFLPFVLEY

SEQ ID NO: 918401 - protein, 9 aa, Homo Sapiens
RNYEFWDKD

SEQ ID NO: 918402 - protein, 9 aa, Homo Sapiens
RGGSVQIVY

SEQ ID NO: 918403 - protein, 9 aa, Homo Sapiens
TDETGNYLL

SEQ ID NO: 918404 - protein, 9 aa, Homo Sapiens
EMADQLMTL

SEQ ID NO: 918405 - protein, 9 aa, Homo Sapiens
KDRELERER

SEQ ID NO: 918406 - protein, 9 aa, Homo Sapiens
VLKPSHCKC

SEQ ID NO: 918407 - protein, 9 aa, Homo Sapiens
LESTVSSPE

SEQ ID NO: 918408 - protein, 9 aa, Homo Sapiens
RGQVPGYSP

SEQ ID NO: 918409 - protein, 9 aa, Homo Sapiens
TTSITFKKW

SEQ ID NO: 918410 - protein, 9 aa, Homo Sapiens
NSDIWKNLH

SEQ ID NO: 918411 - protein, 9 aa, Homo Sapiens
DASKDPALE

SEQ ID NO: 918412 - protein, 9 aa, Homo Sapiens
ETVQQHLDM

SEQ ID NO: 918413 - protein, 9 aa, Homo Sapiens
SLATVKVLL

SEQ ID NO: 918414 - protein, 9 aa, Homo Sapiens
SPYLSIPWD

SEQ ID NO: 918415 - protein, 9 aa, Homo Sapiens
AKIVTLKQA

SEQ ID NO: 918416 - protein, 9 aa, Homo Sapiens
KPPKPPKLP

SEQ ID NO: 918417 - protein, 9 aa, Homo Sapiens
ILSKFSLQS

SEQ ID NO: 918418 - protein, 9 aa, Homo Sapiens
SKDPALEKL

SEQ ID NO: 918419 - protein, 9 aa, Homo Sapiens
MLPEAFLLI

SEQ ID NO: 918420 - protein, 9 aa, Homo Sapiens
PLLTEVAKD

SEQ ID NO: 918421 - protein, 9 aa, Homo Sapiens
PKATPLVTL

SEQ ID NO: 918422 - protein, 9 aa, Homo Sapiens
DIEWLILPA

SEQ ID NO: 918423 - protein, 9 aa, Homo Sapiens
RGFLKCKKD

SEQ ID NO: 918424 - protein, 9 aa, Homo Sapiens
SVKSKVFQE

SEQ ID NO: 918425 - protein, 9 aa, Homo Sapiens
RPPRSASHP

SEQ ID NO: 918426 - protein, 9 aa, Homo Sapiens
ITAIQSLLS

SEQ ID NO: 918427 - protein, 9 aa, Homo Sapiens
LLLVLMAKL

SEQ ID NO: 918428 - protein, 9 aa, Homo Sapiens
RLGVKAMGP

SEQ ID NO: 918429 - protein, 9 aa, Homo Sapiens
LADAAENYQ

SEQ ID NO: 918430 - protein, 9 aa, Homo Sapiens
WLKGNILGE

SEQ ID NO: 918431 - protein, 9 aa, Homo Sapiens
LIEFCYKFR

SEQ ID NO: 918432 - protein, 9 aa, Homo Sapiens
IAFYNEAWP

SEQ ID NO: 918433 - protein, 9 aa, Homo Sapiens
IASVLDLKC

SEQ ID NO: 918434 - protein, 9 aa, Homo Sapiens
EILLYFFSE

SEQ ID NO: 918435 - protein, 9 aa, Homo Sapiens
NSEGLLFRY

SEQ ID NO: 918436 - protein, 9 aa, Homo Sapiens
KVPEIMGAI

SEQ ID NO: 918437 - protein, 9 aa, Homo Sapiens
YLKNVVLVA

SEQ ID NO: 918438 - protein, 9 aa, Homo Sapiens
PGWPQGLFR

SEQ ID NO: 918439 - protein, 9 aa, Homo Sapiens
MFRPLMNFS

SEQ ID NO: 918440 - protein, 9 aa, Homo Sapiens
PGAASPYLS

SEQ ID NO: 918441 - protein, 9 aa, Homo Sapiens
AIVAMTRDG

SEQ ID NO: 918442 - protein, 9 aa, Homo Sapiens
PSQENFFAP

SEQ ID NO: 918443 - protein, 9 aa, Homo Sapiens
KFGPGMQEV

SEQ ID NO: 918444 - protein, 9 aa, Homo Sapiens
YDLCAICNL

SEQ ID NO: 918445 - protein, 9 aa, Homo Sapiens
EAEGDLGRR

SEQ ID NO: 918446 - protein, 9 aa, Homo Sapiens
KFGCALMKM

SEQ ID NO: 918447 - protein, 9 aa, Homo Sapiens
NGSRPPWTG

SEQ ID NO: 918448 - protein, 9 aa, Homo Sapiens
GFFIRYEIF

SEQ ID NO: 918449 - protein, 9 aa, Homo Sapiens
GGPPPSSAS

SEQ ID NO: 918450 - protein, 9 aa, Homo Sapiens
ELVNRLILA

SEQ ID NO: 918451 - protein, 9 aa, Homo Sapiens
LIASHLSSY

SEQ ID NO: 918452 - protein, 9 aa, Homo Sapiens
QFSEDAAPY

SEQ ID NO: 918453 - protein, 9 aa, Homo Sapiens
IGLVSILKG

SEQ ID NO: 918454 - protein, 9 aa, Homo Sapiens
EAAGSQAAG

SEQ ID NO: 918455 - protein, 9 aa, Homo Sapiens
ITDEKSQDD

SEQ ID NO: 918456 - protein, 9 aa, Homo Sapiens
PGKPGLSSV

SEQ ID NO: 918457 - protein, 9 aa, Homo Sapiens
PFFDGVPEF

SEQ ID NO: 918458 - protein, 9 aa, Homo Sapiens
PGFEEYNNL

SEQ ID NO: 918459 - protein, 9 aa, Homo Sapiens
SELLDDPFG

SEQ ID NO: 918460 - protein, 9 aa, Homo Sapiens
RFWVFQSIL

SEQ ID NO: 918461 - protein, 9 aa, Homo Sapiens
FKDKLNLKK

SEQ ID NO: 918462 - protein, 9 aa, Homo Sapiens
RGGIRVGHC

SEQ ID NO: 918463 - protein, 9 aa, Homo Sapiens
PGGSRASPA

SEQ ID NO: 918464 - protein, 9 aa, Homo Sapiens
DLVIAEKKA

SEQ ID NO: 918465 - protein, 9 aa, Homo Sapiens
RRQRALPAV

SEQ ID NO: 918466 - protein, 9 aa, Homo Sapiens
RRKSAKAGQ

SEQ ID NO: 918467 - protein, 9 aa, Homo Sapiens
FIFSPSYVP

SEQ ID NO: 918468 - protein, 9 aa, Homo Sapiens
RPAKELSLP

SEQ ID NO: 918469 - protein, 9 aa, Homo Sapiens
FKTKVCIVT

SEQ ID NO: 918470 - protein, 9 aa, Homo Sapiens
KNYHNIKIL

SEQ ID NO: 918471 - protein, 9 aa, Homo Sapiens
FGKITPLPD

SEQ ID NO: 918472 - protein, 9 aa, Homo Sapiens
FKITKYWTL

SEQ ID NO: 918473 - protein, 9 aa, Homo Sapiens
GEFLENRQK

SEQ ID NO: 918474 - protein, 9 aa, Homo Sapiens
EPGKEGPPD

SEQ ID NO: 918475 - protein, 9 aa, Homo Sapiens
ILAQPWRAF

SEQ ID NO: 918476 - protein, 9 aa, Homo Sapiens
GQLEKIMAN

SEQ ID NO: 918477 - protein, 9 aa, Homo Sapiens
LPEAFLLIA

SEQ ID NO: 918478 - protein, 9 aa, Homo Sapiens
DFQRGNKIE

SEQ ID NO: 918479 - protein, 9 aa, Homo Sapiens
ILRTLEGIY

SEQ ID NO: 918480 - protein, 9 aa, Homo Sapiens
FKWLEDVTS

SEQ ID NO: 918481 - protein, 9 aa, Homo Sapiens
AEKGLTIVG

SEQ ID NO: 918482 - protein, 9 aa, Homo Sapiens
LLLASPKSC

SEQ ID NO: 918483 - protein, 9 aa, Homo Sapiens
TTGVSRDSC

SEQ ID NO: 918484 - protein, 9 aa, Homo Sapiens
EYNNLDLFR

SEQ ID NO: 918485 - protein, 9 aa, Homo Sapiens
LPCIPLVKN

SEQ ID NO: 918486 - protein, 9 aa, Homo Sapiens
DLENKSQES

SEQ ID NO: 918487 - protein, 9 aa, Homo Sapiens
AEVAVKTPT

SEQ ID NO: 918488 - protein, 9 aa, Homo Sapiens
PAVTAQEPD

SEQ ID NO: 918489 - protein, 9 aa, Homo Sapiens
NALTNYRFY

SEQ ID NO: 918490 - protein, 9 aa, Homo Sapiens
QREIFQNSK

SEQ ID NO: 918491 - protein, 9 aa, Homo Sapiens
GEMSYPRGI

SEQ ID NO: 918492 - protein, 9 aa, Homo Sapiens
AEAERLGVK

SEQ ID NO: 918493 - protein, 9 aa, Homo Sapiens
GVSDSETEE

SEQ ID NO: 918494 - protein, 9 aa, Homo Sapiens
GSSFGLLAL

SEQ ID NO: 918495 - protein, 9 aa, Homo Sapiens
TLELSHVAG

SEQ ID NO: 918496 - protein, 9 aa, Homo Sapiens
SQTVVEVLG

SEQ ID NO: 918497 - protein, 9 aa, Homo Sapiens
GTLTEKKST

SEQ ID NO: 918498 - protein, 9 aa, Homo Sapiens
LNDEGEDNS

SEQ ID NO: 918499 - protein, 9 aa, Homo Sapiens
DQESSEEGS

SEQ ID NO: 918500 - protein, 9 aa, Homo Sapiens
ESDAKSKTQ

SEQ ID NO: 918501 - protein, 9 aa, Homo Sapiens
HQKLEKERS

SEQ ID NO: 918502 - protein, 9 aa, Homo Sapiens
ASLFPSGLH

SEQ ID NO: 918503 - protein, 9 aa, Homo Sapiens
LRGMAFCST

SEQ ID NO: 918504 - protein, 9 aa, Homo Sapiens
SLTFAFPAS

SEQ ID NO: 918505 - protein, 9 aa, Homo Sapiens
GVRNYEFWD

SEQ ID NO: 918506 - protein, 9 aa, Homo Sapiens
PLGGSAPGP

SEQ ID NO: 918507 - protein, 9 aa, Homo Sapiens
RESSKSQDL

SEQ ID NO: 918508 - protein, 9 aa, Homo Sapiens
ILLYFFSEH

SEQ ID NO: 918509 - protein, 9 aa, Homo Sapiens
NYHKWLKSL

SEQ ID NO: 918510 - protein, 9 aa, Homo Sapiens
KTHPALVCA

SEQ ID NO: 918511 - protein, 9 aa, Homo Sapiens
SCFMAGDIN

SEQ ID NO: 918512 - protein, 9 aa, Homo Sapiens
EKDWEKDKE

SEQ ID NO: 918513 - protein, 9 aa, Homo Sapiens
FPPLPLPSC

SEQ ID NO: 918514 - protein, 9 aa, Homo Sapiens
SMQCTCEEM

SEQ ID NO: 918515 - protein, 9 aa, Homo Sapiens
VPRNQLQGM

SEQ ID NO: 918516 - protein, 9 aa, Homo Sapiens
ILNQRNCMA

SEQ ID NO: 918517 - protein, 9 aa, Homo Sapiens
DVPILNPLD

SEQ ID NO: 918518 - protein, 9 aa, Homo Sapiens
EGTNSEIFS

SEQ ID NO: 918519 - protein, 9 aa, Homo Sapiens
DSGYRSFRR

SEQ ID NO: 918520 - protein, 9 aa, Homo Sapiens
GSRGGREAA

SEQ ID NO: 918521 - protein, 9 aa, Homo Sapiens
FSHGKAVDL

SEQ ID NO: 918522 - protein, 9 aa, Homo Sapiens
NEDASKDPA

SEQ ID NO: 918523 - protein, 9 aa, Homo Sapiens
ISKKPKTLS

SEQ ID NO: 918524 - protein, 9 aa, Homo Sapiens
DAALSDPVP

SEQ ID NO: 918525 - protein, 9 aa, Homo Sapiens
CSFENQFHT

SEQ ID NO: 918526 - protein, 9 aa, Homo Sapiens
KKIRVGIID

SEQ ID NO: 918527 - protein, 9 aa, Homo Sapiens
ALPVPPTGD

SEQ ID NO: 918528 - protein, 9 aa, Homo Sapiens
NEKSSLEGA

SEQ ID NO: 918529 - protein, 9 aa, Homo Sapiens
DKAISCKEA

SEQ ID NO: 918530 - protein, 9 aa, Homo Sapiens
DKEDDGEPG

SEQ ID NO: 918531 - protein, 9 aa, Homo Sapiens
GNVNQSVAS

SEQ ID NO: 918532 - protein, 9 aa, Homo Sapiens
SECGKSFYR

SEQ ID NO: 918533 - protein, 9 aa, Homo Sapiens
KINSDIWKN

SEQ ID NO: 918534 - protein, 9 aa, Homo Sapiens
LCTSLLSNV

SEQ ID NO: 918535 - protein, 9 aa, Homo Sapiens
PQVPPQGCY

SEQ ID NO: 918536 - protein, 9 aa, Homo Sapiens
KPFQCEDCG

SEQ ID NO: 918537 - protein, 9 aa, Homo Sapiens
PLFLVITFF

SEQ ID NO: 918538 - protein, 9 aa, Homo Sapiens
ELWLLIKRK

SEQ ID NO: 918539 - protein, 9 aa, Homo Sapiens
FLTSKIFGV

SEQ ID NO: 918540 - protein, 9 aa, Homo Sapiens
SYGNAFYHP

SEQ ID NO: 918541 - protein, 9 aa, Homo Sapiens
YHPSAVRLQ

SEQ ID NO: 918542 - protein, 9 aa, Homo Sapiens
NESLFWKLY

SEQ ID NO: 918543 - protein, 9 aa, Homo Sapiens
EKSTTYHSS

SEQ ID NO: 918544 - protein, 9 aa, Homo Sapiens
TVETGNLTK

SEQ ID NO: 918545 - protein, 9 aa, Homo Sapiens
VGAVGGDVP

SEQ ID NO: 918546 - protein, 9 aa, Homo Sapiens
SDMDWEFAL

SEQ ID NO: 918547 - protein, 9 aa, Homo Sapiens
GSKSSTPEN

SEQ ID NO: 918548 - protein, 9 aa, Homo Sapiens
TKVCIVTKC

SEQ ID NO: 918549 - protein, 9 aa, Homo Sapiens
TRLLEALVL

SEQ ID NO: 918550 - protein, 9 aa, Homo Sapiens
LLQVILNCL

SEQ ID NO: 918551 - protein, 9 aa, Homo Sapiens
TDDSPKPAE

SEQ ID NO: 918552 - protein, 9 aa, Homo Sapiens
YCQPPDRNK

SEQ ID NO: 918553 - protein, 9 aa, Homo Sapiens
VKSKVFQES

SEQ ID NO: 918554 - protein, 9 aa, Homo Sapiens
LKNVVLVAS

SEQ ID NO: 918555 - protein, 9 aa, Homo Sapiens
EDSKIQNQL

SEQ ID NO: 918556 - protein, 9 aa, Homo Sapiens
VSTYEIITS

SEQ ID NO: 918557 - protein, 9 aa, Homo Sapiens
ETGNYLLLT

SEQ ID NO: 918558 - protein, 9 aa, Homo Sapiens
YRSSSLLRH

SEQ ID NO: 918559 - protein, 9 aa, Homo Sapiens
KYAAATRGP

SEQ ID NO: 918560 - protein, 9 aa, Homo Sapiens
AHGYCSRIS

SEQ ID NO: 918561 - protein, 9 aa, Homo Sapiens
KGAFSEFGD

SEQ ID NO: 918562 - protein, 9 aa, Homo Sapiens
RLDQLGITK

SEQ ID NO: 918563 - protein, 9 aa, Homo Sapiens
PRSASHPQA

SEQ ID NO: 918564 - protein, 9 aa, Homo Sapiens
IQEELYRVY

SEQ ID NO: 918565 - protein, 9 aa, Homo Sapiens
CRLPRGLHC

SEQ ID NO: 918566 - protein, 9 aa, Homo Sapiens
ELNRENAYH

SEQ ID NO: 918567 - protein, 9 aa, Homo Sapiens
TGVSRDSCY

SEQ ID NO: 918568 - protein, 9 aa, Homo Sapiens
NEAWPTLLR

SEQ ID NO: 918569 - protein, 9 aa, Homo Sapiens
KSLLFLVFF

SEQ ID NO: 918570 - protein, 9 aa, Homo Sapiens
ASFLPPSES

SEQ ID NO: 918571 - protein, 9 aa, Homo Sapiens
FVEVSEKEG

SEQ ID NO: 918572 - protein, 9 aa, Homo Sapiens
QPAVTAQEP

SEQ ID NO: 918573 - protein, 9 aa, Homo Sapiens
FQVDPETKQ

SEQ ID NO: 918574 - protein, 9 aa, Homo Sapiens
FEVLVSDSV

SEQ ID NO: 918575 - protein, 9 aa, Homo Sapiens
QQAQITQER

SEQ ID NO: 918576 - protein, 9 aa, Homo Sapiens
FPASPVCAS

SEQ ID NO: 918577 - protein, 9 aa, Homo Sapiens
SLMTNEPGL

SEQ ID NO: 918578 - protein, 9 aa, Homo Sapiens
PFECLECWK

SEQ ID NO: 918579 - protein, 9 aa, Homo Sapiens
PCGHSIYHD

SEQ ID NO: 918580 - protein, 9 aa, Homo Sapiens
SIYHDYHQY

SEQ ID NO: 918581 - protein, 9 aa, Homo Sapiens
HWKRWPLLN

SEQ ID NO: 918582 - protein, 9 aa, Homo Sapiens
MYKYSSDIS

SEQ ID NO: 918583 - protein, 9 aa, Homo Sapiens
DAGQPGEKE

SEQ ID NO: 918584 - protein, 9 aa, Homo Sapiens
FASLFPSGL

SEQ ID NO: 918585 - protein, 9 aa, Homo Sapiens
VSDLSQSQR

SEQ ID NO: 918586 - protein, 9 aa, Homo Sapiens
ELRDDNFYA

SEQ ID NO: 918587 - protein, 9 aa, Homo Sapiens
KILAQEMMT

SEQ ID NO: 918588 - protein, 9 aa, Homo Sapiens
NFFLKEGRQ

SEQ ID NO: 918589 - protein, 9 aa, Homo Sapiens
KLARMLREY

SEQ ID NO: 918590 - protein, 9 aa, Homo Sapiens
ITPIQLAPI

SEQ ID NO: 918591 - protein, 9 aa, Homo Sapiens
QWSLDNFFL

SEQ ID NO: 918592 - protein, 9 aa, Homo Sapiens
KRKFGFYSK

SEQ ID NO: 918593 - protein, 9 aa, Homo Sapiens
GNLTKLYYA

SEQ ID NO: 918594 - protein, 9 aa, Homo Sapiens
DLKLNLGRD

SEQ ID NO: 918595 - protein, 9 aa, Homo Sapiens
SKLESTVSS

SEQ ID NO: 918596 - protein, 9 aa, Homo Sapiens
AFCYIRSQL

SEQ ID NO: 918597 - protein, 9 aa, Homo Sapiens
AHKKFLWTI

SEQ ID NO: 918598 - protein, 9 aa, Homo Sapiens
ASPDSLKGS

SEQ ID NO: 918599 - protein, 9 aa, Homo Sapiens
DVFYNSRVI

SEQ ID NO: 918600 - protein, 9 aa, Homo Sapiens
LKVARDTDE

SEQ ID NO: 918601 - protein, 9 aa, Homo Sapiens
GPLGGSAPG

SEQ ID NO: 918602 - protein, 9 aa, Homo Sapiens
YQFALFLMA

SEQ ID NO: 918603 - protein, 9 aa, Homo Sapiens
QLPVDKTKD

SEQ ID NO: 918604 - protein, 9 aa, Homo Sapiens
PSTKSNGHH

SEQ ID NO: 918605 - protein, 9 aa, Homo Sapiens
LDHRYYAGR

SEQ ID NO: 918606 - protein, 9 aa, Homo Sapiens
DDSPKPAEV

SEQ ID NO: 918607 - protein, 9 aa, Homo Sapiens
DVLGEKEDE

SEQ ID NO: 918608 - protein, 9 aa, Homo Sapiens
VKKLTVNSG

SEQ ID NO: 918609 - protein, 9 aa, Homo Sapiens
QITDEMADQ

SEQ ID NO: 918610 - protein, 9 aa, Homo Sapiens
HLPLERINV

SEQ ID NO: 918611 - protein, 9 aa, Homo Sapiens
GGSGAPEGT

SEQ ID NO: 918612 - protein, 9 aa, Homo Sapiens
SSCQSVSSN

SEQ ID NO: 918613 - protein, 9 aa, Homo Sapiens
TGKPIQSPT

SEQ ID NO: 918614 - protein, 9 aa, Homo Sapiens
GSTNDEAED

SEQ ID NO: 918615 - protein, 9 aa, Homo Sapiens
KYLPGPCRT

SEQ ID NO: 918616 - protein, 9 aa, Homo Sapiens
ETKQEITRL

SEQ ID NO: 918617 - protein, 9 aa, Homo Sapiens
KFQSRRRFP

SEQ ID NO: 918618 - protein, 9 aa, Homo Sapiens
NTLWIKFVS

SEQ ID NO: 918619 - protein, 9 aa, Homo Sapiens
DHPCLQVPK

SEQ ID NO: 918620 - protein, 9 aa, Homo Sapiens
QANFNLLRD

SEQ ID NO: 918621 - protein, 9 aa, Homo Sapiens
LGPLGGSAP

SEQ ID NO: 918622 - protein, 9 aa, Homo Sapiens
YLWIKIHPY

SEQ ID NO: 918623 - protein, 9 aa, Homo Sapiens
RSTSNTLWI

SEQ ID NO: 918624 - protein, 9 aa, Homo Sapiens
QNETACQSS

SEQ ID NO: 918625 - protein, 9 aa, Homo Sapiens
RIYFDLNPT

SEQ ID NO: 918626 - protein, 9 aa, Homo Sapiens
TRSLVPEPA

SEQ ID NO: 918627 - protein, 9 aa, Homo Sapiens
WEKDKEKDR

SEQ ID NO: 918628 - protein, 9 aa, Homo Sapiens
ITEFGQWNM

SEQ ID NO: 918629 - protein, 9 aa, Homo Sapiens
LTHLDLCGN

SEQ ID NO: 918630 - protein, 9 aa, Homo Sapiens
LECWKSFSE

SEQ ID NO: 918631 - protein, 9 aa, Homo Sapiens
DLCGNQLQT

SEQ ID NO: 918632 - protein, 9 aa, Homo Sapiens
SKIFGVSDH

SEQ ID NO: 918633 - protein, 9 aa, Homo Sapiens
QARGQLEKI

SEQ ID NO: 918634 - protein, 9 aa, Homo Sapiens
QYLKNVVLV

SEQ ID NO: 918635 - protein, 9 aa, Homo Sapiens
DLGPLGGSA

SEQ ID NO: 918636 - protein, 9 aa, Homo Sapiens
PTLLRTVYS

SEQ ID NO: 918637 - protein, 9 aa, Homo Sapiens
HKKFLWTIE

SEQ ID NO: 918638 - protein, 9 aa, Homo Sapiens
EVAVDFSQK

SEQ ID NO: 918639 - protein, 9 aa, Homo Sapiens
QFALFLMAA

SEQ ID NO: 918640 - protein, 9 aa, Homo Sapiens
MIGEFLENR

SEQ ID NO: 918641 - protein, 9 aa, Homo Sapiens
SHLPLERIN

SEQ ID NO: 918642 - protein, 9 aa, Homo Sapiens
HVRFWVFQS

SEQ ID NO: 918643 - protein, 9 aa, Homo Sapiens
WLLIKRKFG

SEQ ID NO: 918644 - protein, 9 aa, Homo Sapiens
LENKSQESI

SEQ ID NO: 918645 - protein, 9 aa, Homo Sapiens
IIQLTTLSG

SEQ ID NO: 918646 - protein, 9 aa, Homo Sapiens
SSSREIRLI

SEQ ID NO: 918647 - protein, 9 aa, Homo Sapiens
MWSQQVIYL

SEQ ID NO: 918648 - protein, 9 aa, Homo Sapiens
GMSDVFSQS

SEQ ID NO: 918649 - protein, 9 aa, Homo Sapiens
QAANVWPTK

SEQ ID NO: 918650 - protein, 9 aa, Homo Sapiens
YNSFFISHQ

SEQ ID NO: 918651 - protein, 9 aa, Homo Sapiens
YSLTKNPVV

SEQ ID NO: 918652 - protein, 9 aa, Homo Sapiens
DDGVRSDSK

SEQ ID NO: 918653 - protein, 9 aa, Homo Sapiens
GSCRSVGMH

SEQ ID NO: 918654 - protein, 9 aa, Homo Sapiens
TEMKSYRCR

SEQ ID NO: 918655 - protein, 9 aa, Homo Sapiens
DESEKTCVH

SEQ ID NO: 918656 - protein, 9 aa, Homo Sapiens
NKANTSSDF

SEQ ID NO: 918657 - protein, 9 aa, Homo Sapiens
HGFVSPTSF

SEQ ID NO: 918658 - protein, 9 aa, Homo Sapiens
QETKDGMLV

SEQ ID NO: 918659 - protein, 9 aa, Homo Sapiens
VISFLVLAV

SEQ ID NO: 918660 - protein, 9 aa, Homo Sapiens
KPLDMSLFS

SEQ ID NO: 918661 - protein, 9 aa, Homo Sapiens
TTSSSKIFV

SEQ ID NO: 918662 - protein, 9 aa, Homo Sapiens
VKEEVKTRK

SEQ ID NO: 918663 - protein, 9 aa, Homo Sapiens
CSFNPGVIA

SEQ ID NO: 918664 - protein, 9 aa, Homo Sapiens
DSVFPCGDI

SEQ ID NO: 918665 - protein, 9 aa, Homo Sapiens
LTVHGFVSP

SEQ ID NO: 918666 - protein, 9 aa, Homo Sapiens
NGWKPPENL

SEQ ID NO: 918667 - protein, 9 aa, Homo Sapiens
SRKQRTLFM

SEQ ID NO: 918668 - protein, 9 aa, Homo Sapiens
SDGSISALK

SEQ ID NO: 918669 - protein, 9 aa, Homo Sapiens
FRIVTMNSN

SEQ ID NO: 918670 - protein, 9 aa, Homo Sapiens
KHVETNFYD

SEQ ID NO: 918671 - protein, 9 aa, Homo Sapiens
SRGFLKCKK

SEQ ID NO: 918672 - protein, 9 aa, Homo Sapiens
VSDSETEET

SEQ ID NO: 918673 - protein, 9 aa, Homo Sapiens
EDFVEVSEK

SEQ ID NO: 918674 - protein, 9 aa, Homo Sapiens
AITIKPTSK

SEQ ID NO: 918675 - protein, 9 aa, Homo Sapiens
EKESPGAQG

SEQ ID NO: 918676 - protein, 9 aa, Homo Sapiens
EYLQANFNL

SEQ ID NO: 918677 - protein, 9 aa, Homo Sapiens
VMDSDGSIS

SEQ ID NO: 918678 - protein, 9 aa, Homo Sapiens
ALDDEPIVQ

SEQ ID NO: 918679 - protein, 9 aa, Homo Sapiens
LSPQDLGPL

SEQ ID NO: 918680 - protein, 9 aa, Homo Sapiens
ATVKVLLIP

SEQ ID NO: 918681 - protein, 9 aa, Homo Sapiens
ASVPRGFSF

SEQ ID NO: 918682 - protein, 9 aa, Homo Sapiens
KQRTLFMIE

SEQ ID NO: 918683 - protein, 9 aa, Homo Sapiens
IVKKITFLK

SEQ ID NO: 918684 - protein, 9 aa, Homo Sapiens
THPALVCAV

SEQ ID NO: 918685 - protein, 9 aa, Homo Sapiens
AFYNEAWPT

SEQ ID NO: 918686 - protein, 9 aa, Homo Sapiens
DVTVLSPSC

SEQ ID NO: 918687 - protein, 9 aa, Homo Sapiens
CVSTYEIIT

SEQ ID NO: 918688 - protein, 9 aa, Homo Sapiens
SFIHTAASV

SEQ ID NO: 918689 - protein, 9 aa, Homo Sapiens
KNGIAPVPW

SEQ ID NO: 918690 - protein, 9 aa, Homo Sapiens
LPVEGLFRV

SEQ ID NO: 918691 - protein, 9 aa, Homo Sapiens
YHKWLKSLK

SEQ ID NO: 918692 - protein, 9 aa, Homo Sapiens
LMNFSHIYF

SEQ ID NO: 918693 - protein, 9 aa, Homo Sapiens
REFAKNLKT

SEQ ID NO: 918694 - protein, 9 aa, Homo Sapiens
DGPPGPKGS

SEQ ID NO: 918695 - protein, 9 aa, Homo Sapiens
STVPSERSL

SEQ ID NO: 918696 - protein, 9 aa, Homo Sapiens
KHSGGFIFS

SEQ ID NO: 918697 - protein, 9 aa, Homo Sapiens
ISDGIRDKI

SEQ ID NO: 918698 - protein, 9 aa, Homo Sapiens
HASNKEKKM

SEQ ID NO: 918699 - protein, 9 aa, Homo Sapiens
YSHSKGVVI

SEQ ID NO: 918700 - protein, 9 aa, Homo Sapiens
VQLYLHKQW

SEQ ID NO: 918701 - protein, 9 aa, Homo Sapiens
SRTVTRKST

SEQ ID NO: 918702 - protein, 9 aa, Homo Sapiens
MAEAMGSAR

SEQ ID NO: 918703 - protein, 9 aa, Homo Sapiens
ESSMYKYSS

SEQ ID NO: 918704 - protein, 9 aa, Homo Sapiens
LQPLPKVIF

SEQ ID NO: 918705 - protein, 9 aa, Homo Sapiens
ERPFLEEDP

SEQ ID NO: 918706 - protein, 9 aa, Homo Sapiens
KKVCKYWDV

SEQ ID NO: 918707 - protein, 9 aa, Homo Sapiens
EGHTDKIFS

SEQ ID NO: 918708 - protein, 9 aa, Homo Sapiens
EKKARAVSP

SEQ ID NO: 918709 - protein, 9 aa, Homo Sapiens
FSDITLLQN

SEQ ID NO: 918710 - protein, 9 aa, Homo Sapiens
INFLESLGQ

SEQ ID NO: 918711 - protein, 9 aa, Homo Sapiens
GLRGMAFCS

SEQ ID NO: 918712 - protein, 9 aa, Homo Sapiens
ARPCLASAE

SEQ ID NO: 918713 - protein, 9 aa, Homo Sapiens
HSIYHDYHQ

SEQ ID NO: 918714 - protein, 9 aa, Homo Sapiens
GTKLSVKPT

SEQ ID NO: 918715 - protein, 9 aa, Homo Sapiens
DSLATVKVL

SEQ ID NO: 918716 - protein, 9 aa, Homo Sapiens
ECGKSYISE

SEQ ID NO: 918717 - protein, 9 aa, Homo Sapiens
PPVTGSSFG

SEQ ID NO: 918718 - protein, 9 aa, Homo Sapiens
KGGEIPGSE

SEQ ID NO: 918719 - protein, 9 aa, Homo Sapiens
PFLNVFELK

SEQ ID NO: 918720 - protein, 9 aa, Homo Sapiens
VAGFLSLVT

SEQ ID NO: 918721 - protein, 9 aa, Homo Sapiens
KEKNQNKKI

SEQ ID NO: 918722 - protein, 9 aa, Homo Sapiens
PILPQQKSA

SEQ ID NO: 918723 - protein, 9 aa, Homo Sapiens
HKQWLLKAL

SEQ ID NO: 918724 - protein, 9 aa, Homo Sapiens
FIFITKIIP

SEQ ID NO: 918725 - protein, 9 aa, Homo Sapiens
FEILKSKKK

SEQ ID NO: 918726 - protein, 9 aa, Homo Sapiens
ERKIKFLVA

SEQ ID NO: 918727 - protein, 9 aa, Homo Sapiens
KEGLDINFL

SEQ ID NO: 918728 - protein, 9 aa, Homo Sapiens
KGSPEPWDT

SEQ ID NO: 918729 - protein, 9 aa, Homo Sapiens
ATVSHKVGR

SEQ ID NO: 918730 - protein, 9 aa, Homo Sapiens
EEEDQESSE

SEQ ID NO: 918731 - protein, 9 aa, Homo Sapiens
ASEVQASRF

SEQ ID NO: 918732 - protein, 9 aa, Homo Sapiens
QNFCPRLAS

SEQ ID NO: 918733 - protein, 9 aa, Homo Sapiens
MSLDDEDSK

SEQ ID NO: 918734 - protein, 9 aa, Homo Sapiens
YALKRQSRT

SEQ ID NO: 918735 - protein, 9 aa, Homo Sapiens
YKEIFQYVC

SEQ ID NO: 918736 - protein, 9 aa, Homo Sapiens
SASILFDSN

SEQ ID NO: 918737 - protein, 9 aa, Homo Sapiens
LLIPVGQEI

SEQ ID NO: 918738 - protein, 9 aa, Homo Sapiens
SLKQEKEET

SEQ ID NO: 918739 - protein, 9 aa, Homo Sapiens
YWALFGASE

SEQ ID NO: 918740 - protein, 9 aa, Homo Sapiens
QFQDNPAYL

SEQ ID NO: 918741 - protein, 9 aa, Homo Sapiens
FYMAIVNKT

SEQ ID NO: 918742 - protein, 9 aa, Homo Sapiens
DEDVFYNSR

SEQ ID NO: 918743 - protein, 9 aa, Homo Sapiens
TVLSPSCLY

SEQ ID NO: 918744 - protein, 9 aa, Homo Sapiens
VNLVCYALC

SEQ ID NO: 918745 - protein, 9 aa, Homo Sapiens
IASHLSSYE

SEQ ID NO: 918746 - protein, 9 aa, Homo Sapiens
TNSEIFSPP

SEQ ID NO: 918747 - protein, 9 aa, Homo Sapiens
EMAEAMGSA

SEQ ID NO: 918748 - protein, 9 aa, Homo Sapiens
TLRPGWPQG

SEQ ID NO: 918749 - protein, 9 aa, Homo Sapiens
PNETNLVGP

SEQ ID NO: 918750 - protein, 9 aa, Homo Sapiens
ERINVHHRE

SEQ ID NO: 918751 - protein, 9 aa, Homo Sapiens
PILVSSSGA

SEQ ID NO: 918752 - protein, 9 aa, Homo Sapiens
RYYAGRCSP

SEQ ID NO: 918753 - protein, 9 aa, Homo Sapiens
LPPVSVPKI

SEQ ID NO: 918754 - protein, 9 aa, Homo Sapiens
TTIQEELYR

SEQ ID NO: 918755 - protein, 9 aa, Homo Sapiens
GEKGERGKN

SEQ ID NO: 918756 - protein, 9 aa, Homo Sapiens
FSFLEIFFT

SEQ ID NO: 918757 - protein, 9 aa, Homo Sapiens
LSFVGKLGW

SEQ ID NO: 918758 - protein, 9 aa, Homo Sapiens
CKQREIFQN

SEQ ID NO: 918759 - protein, 9 aa, Homo Sapiens
LQKVVRKAE

SEQ ID NO: 918760 - protein, 9 aa, Homo Sapiens
KQELLAIRL

SEQ ID NO: 918761 - protein, 9 aa, Homo Sapiens
QKEQELKGS

SEQ ID NO: 918762 - protein, 9 aa, Homo Sapiens
AAATEDWTV

SEQ ID NO: 918763 - protein, 9 aa, Homo Sapiens
TFAFPASPV

SEQ ID NO: 918764 - protein, 9 aa, Homo Sapiens
TLGQKKLAS

SEQ ID NO: 918765 - protein, 9 aa, Homo Sapiens
PNTEKNLTY

SEQ ID NO: 918766 - protein, 9 aa, Homo Sapiens
MVITVLLSV

SEQ ID NO: 918767 - protein, 9 aa, Homo Sapiens
EELEEEIKA

SEQ ID NO: 918768 - protein, 9 aa, Homo Sapiens
RGPPPTPLP

SEQ ID NO: 918769 - protein, 9 aa, Homo Sapiens
NGFSLGSSE

SEQ ID NO: 918770 - protein, 9 aa, Homo Sapiens
EKKKKVCKY

SEQ ID NO: 918771 - protein, 9 aa, Homo Sapiens
VIIQGRNSL

SEQ ID NO: 918772 - protein, 9 aa, Homo Sapiens
EPHLLPCSP

SEQ ID NO: 918773 - protein, 9 aa, Homo Sapiens
FFDGVPEFN

SEQ ID NO: 918774 - protein, 9 aa, Homo Sapiens
TPCFSSPNV

SEQ ID NO: 918775 - protein, 9 aa, Homo Sapiens
AACILFGQG

SEQ ID NO: 918776 - protein, 9 aa, Homo Sapiens
SGINCSIQK

SEQ ID NO: 918777 - protein, 9 aa, Homo Sapiens
KDPQQVSTV

SEQ ID NO: 918778 - protein, 9 aa, Homo Sapiens
EAFLLIAIK

SEQ ID NO: 918779 - protein, 9 aa, Homo Sapiens
IQFKTKVCI

SEQ ID NO: 918780 - protein, 9 aa, Homo Sapiens
DEGYRMKNH

SEQ ID NO: 918781 - protein, 9 aa, Homo Sapiens
MTNGLCIWL

SEQ ID NO: 918782 - protein, 9 aa, Homo Sapiens
LLKVEILRN

SEQ ID NO: 918783 - protein, 9 aa, Homo Sapiens
ERGKNSVSV

SEQ ID NO: 918784 - protein, 9 aa, Homo Sapiens
EEIKAERAS

SEQ ID NO: 918785 - protein, 9 aa, Homo Sapiens
PPQGCYVAK

SEQ ID NO: 918786 - protein, 9 aa, Homo Sapiens
VQGYGTFFF

SEQ ID NO: 918787 - protein, 9 aa, Homo Sapiens
PLDKKLMTE

SEQ ID NO: 918788 - protein, 9 aa, Homo Sapiens
HRHHRSHRR

SEQ ID NO: 918789 - protein, 9 aa, Homo Sapiens
TRRHPQGAW

SEQ ID NO: 918790 - protein, 9 aa, Homo Sapiens
QYGTETFWS

SEQ ID NO: 918791 - protein, 9 aa, Homo Sapiens
YYAGRCSPH

SEQ ID NO: 918792 - protein, 9 aa, Homo Sapiens
QPMAPNQEL

SEQ ID NO: 918793 - protein, 9 aa, Homo Sapiens
RENAYHCGL

SEQ ID NO: 918794 - protein, 9 aa, Homo Sapiens
ITTTKRPVT

SEQ ID NO: 918795 - protein, 9 aa, Homo Sapiens
ETDKDIASV

SEQ ID NO: 918796 - protein, 9 aa, Homo Sapiens
HPLHLISVR

SEQ ID NO: 918797 - protein, 9 aa, Homo Sapiens
GLAAATEDW

SEQ ID NO: 918798 - protein, 9 aa, Homo Sapiens
FQSWQILAQ

SEQ ID NO: 918799 - protein, 9 aa, Homo Sapiens
HGAGFFIRY

SEQ ID NO: 918800 - protein, 9 aa, Homo Sapiens
IAGQAPGGS

SEQ ID NO: 918801 - protein, 9 aa, Homo Sapiens
KIFGVSDHI

SEQ ID NO: 918802 - protein, 9 aa, Homo Sapiens
KSLKSCRTH

SEQ ID NO: 918803 - protein, 9 aa, Homo Sapiens
QSRTLYGFG

SEQ ID NO: 918804 - protein, 9 aa, Homo Sapiens
DDESEKTCV

SEQ ID NO: 918805 - protein, 9 aa, Homo Sapiens
SPEQIDFLP

SEQ ID NO: 918806 - protein, 9 aa, Homo Sapiens
EELYRVYPY

SEQ ID NO: 918807 - protein, 9 aa, Homo Sapiens
SSAVTNGFS

SEQ ID NO: 918808 - protein, 9 aa, Homo Sapiens
RGQFQDNPA

SEQ ID NO: 918809 - protein, 9 aa, Homo Sapiens
AAPSVTDKI

SEQ ID NO: 918810 - protein, 9 aa, Homo Sapiens
KMAGIEITK

SEQ ID NO: 918811 - protein, 9 aa, Homo Sapiens
QIPMWSQQV

SEQ ID NO: 918812 - protein, 9 aa, Homo Sapiens
DICDITDKL

SEQ ID NO: 918813 - protein, 9 aa, Homo Sapiens
DDLLQDVLF

SEQ ID NO: 918814 - protein, 9 aa, Homo Sapiens
QLKAEKGLT

SEQ ID NO: 918815 - protein, 9 aa, Homo Sapiens
SMPGSHFVS

SEQ ID NO: 918816 - protein, 9 aa, Homo Sapiens
DSCYVKELG

SEQ ID NO: 918817 - protein, 9 aa, Homo Sapiens
WDAKSRGFL

SEQ ID NO: 918818 - protein, 9 aa, Homo Sapiens
CRRGGRCVN

SEQ ID NO: 918819 - protein, 9 aa, Homo Sapiens
DASETNDFR

SEQ ID NO: 918820 - protein, 9 aa, Homo Sapiens
DTVFPIQYL

SEQ ID NO: 918821 - protein, 9 aa, Homo Sapiens
VTNGFSLGS

SEQ ID NO: 918822 - protein, 9 aa, Homo Sapiens
QESIFVRIH

SEQ ID NO: 918823 - protein, 9 aa, Homo Sapiens
ARASVSVLE

SEQ ID NO: 918824 - protein, 9 aa, Homo Sapiens
VFKYNSFFI

SEQ ID NO: 918825 - protein, 9 aa, Homo Sapiens
EAEMAEAMG

SEQ ID NO: 918826 - protein, 9 aa, Homo Sapiens
LAKEFAKIL

SEQ ID NO: 918827 - protein, 9 aa, Homo Sapiens
QKKIRVGII

SEQ ID NO: 918828 - protein, 9 aa, Homo Sapiens
ERANSTITQ

SEQ ID NO: 918829 - protein, 9 aa, Homo Sapiens
AALAGVPGV

SEQ ID NO: 918830 - protein, 9 aa, Homo Sapiens
AVIPSRTVT

SEQ ID NO: 918831 - protein, 9 aa, Homo Sapiens
NLPNIFRIY

SEQ ID NO: 918832 - protein, 9 aa, Homo Sapiens
ETNFYDVQR

SEQ ID NO: 918833 - protein, 9 aa, Homo Sapiens
NKVIPLFTP

SEQ ID NO: 918834 - protein, 9 aa, Homo Sapiens
DHPLHLISV

SEQ ID NO: 918835 - protein, 9 aa, Homo Sapiens
VIAEKKARA

SEQ ID NO: 918836 - protein, 9 aa, Homo Sapiens
CVQSKVTKK

SEQ ID NO: 918837 - protein, 9 aa, Homo Sapiens
ADAAENYQK

SEQ ID NO: 918838 - protein, 9 aa, Homo Sapiens
KDHFCSFEN

SEQ ID NO: 918839 - protein, 9 aa, Homo Sapiens
GPLCEPNLW

SEQ ID NO: 918840 - protein, 9 aa, Homo Sapiens
HFVSVDGVR

SEQ ID NO: 918841 - protein, 9 aa, Homo Sapiens
GNKIVNEKS

SEQ ID NO: 918842 - protein, 9 aa, Homo Sapiens
TESSMYKYS

SEQ ID NO: 918843 - protein, 9 aa, Homo Sapiens
RELLDERKS

SEQ ID NO: 918844 - protein, 9 aa, Homo Sapiens
SGYSTQEGA

SEQ ID NO: 918845 - protein, 9 aa, Homo Sapiens
EIQGIPLQR

SEQ ID NO: 918846 - protein, 9 aa, Homo Sapiens
SMGPQGEPG

SEQ ID NO: 918847 - protein, 9 aa, Homo Sapiens
EGEMSYPRG

SEQ ID NO: 918848 - protein, 9 aa, Homo Sapiens
YNQSEYIPS

SEQ ID NO: 918849 - protein, 9 aa, Homo Sapiens
SSPSTKSNG

SEQ ID NO: 918850 - protein, 9 aa, Homo Sapiens
LRLAETLNP

SEQ ID NO: 918851 - protein, 9 aa, Homo Sapiens
RNFSFLEIF

SEQ ID NO: 918852 - protein, 9 aa, Homo Sapiens
PDGDGPLCE

SEQ ID NO: 918853 - protein, 9 aa, Homo Sapiens
DGKPCLGNS

SEQ ID NO: 918854 - protein, 9 aa, Homo Sapiens
RGKNAVLKP

SEQ ID NO: 918855 - protein, 9 aa, Homo Sapiens
SVLDLKCKD

SEQ ID NO: 918856 - protein, 9 aa, Homo Sapiens
IWEQEEKMW

SEQ ID NO: 918857 - protein, 9 aa, Homo Sapiens
ADSGCSRRQ

SEQ ID NO: 918858 - protein, 9 aa, Homo Sapiens
KLNLGRDFS

SEQ ID NO: 918859 - protein, 9 aa, Homo Sapiens
VAKRPHELV

SEQ ID NO: 918860 - protein, 9 aa, Homo Sapiens
GAAIRSAGI

SEQ ID NO: 918861 - protein, 9 aa, Homo Sapiens
KSRLELQKV

SEQ ID NO: 918862 - protein, 9 aa, Homo Sapiens
NPHIGDDPF

SEQ ID NO: 918863 - protein, 9 aa, Homo Sapiens
NPNEDASKD

SEQ ID NO: 918864 - protein, 9 aa, Homo Sapiens
HMIGLRGMA

SEQ ID NO: 918865 - protein, 9 aa, Homo Sapiens
GAICAQLSI

SEQ ID NO: 918866 - protein, 9 aa, Homo Sapiens
HQRIYTGEK

SEQ ID NO: 918867 - protein, 9 aa, Homo Sapiens
FSEDAAPYQ

SEQ ID NO: 918868 - protein, 9 aa, Homo Sapiens
TACQSSLDY

SEQ ID NO: 918869 - protein, 9 aa, Homo Sapiens
KLNLKKSDD

SEQ ID NO: 918870 - protein, 9 aa, Homo Sapiens
ADQLMTLAY

SEQ ID NO: 918871 - protein, 9 aa, Homo Sapiens
ATNECEIIK

SEQ ID NO: 918872 - protein, 9 aa, Homo Sapiens
DLCAICNLV

SEQ ID NO: 918873 - protein, 9 aa, Homo Sapiens
SGESSFSRS

SEQ ID NO: 918874 - protein, 9 aa, Homo Sapiens
SPQDLGPLG

SEQ ID NO: 918875 - protein, 9 aa, Homo Sapiens
QELRDDNFY

SEQ ID NO: 918876 - protein, 9 aa, Homo Sapiens
KTHGKSSED

SEQ ID NO: 918877 - protein, 9 aa, Homo Sapiens
PLRQRLKEY

SEQ ID NO: 918878 - protein, 9 aa, Homo Sapiens
QLEQKEQEL

SEQ ID NO: 918879 - protein, 9 aa, Homo Sapiens
QRLKEYFQH

SEQ ID NO: 918880 - protein, 9 aa, Homo Sapiens
KANTSSDFE

SEQ ID NO: 918881 - protein, 9 aa, Homo Sapiens
AFGFSDITL

SEQ ID NO: 918882 - protein, 9 aa, Homo Sapiens
ENKSQESIF

SEQ ID NO: 918883 - protein, 9 aa, Homo Sapiens
RERWNHVIT

SEQ ID NO: 918884 - protein, 9 aa, Homo Sapiens
KSCRTHWID

SEQ ID NO: 918885 - protein, 9 aa, Homo Sapiens
ALSAFCYIR

SEQ ID NO: 918886 - protein, 9 aa, Homo Sapiens
LWFLICKQR

SEQ ID NO: 918887 - protein, 9 aa, Homo Sapiens
TNLVGPPAS

SEQ ID NO: 918888 - protein, 9 aa, Homo Sapiens
ISHQRIYTG

SEQ ID NO: 918889 - protein, 9 aa, Homo Sapiens
GDVASPSQD

SEQ ID NO: 918890 - protein, 9 aa, Homo Sapiens
KTQSDDSDT

SEQ ID NO: 918891 - protein, 9 aa, Homo Sapiens
KISDGIRDK

SEQ ID NO: 918892 - protein, 9 aa, Homo Sapiens
FFDPNTEKN

SEQ ID NO: 918893 - protein, 9 aa, Homo Sapiens
ARGQLEKIM

SEQ ID NO: 918894 - protein, 9 aa, Homo Sapiens
DDIKKSYWK

SEQ ID NO: 918895 - protein, 9 aa, Homo Sapiens
ETEMKSYRC

SEQ ID NO: 918896 - protein, 9 aa, Homo Sapiens
LWHIDFGRC

SEQ ID NO: 918897 - protein, 9 aa, Homo Sapiens
CSNFPQMGI

SEQ ID NO: 918898 - protein, 9 aa, Homo Sapiens
VTRQLQATV

SEQ ID NO: 918899 - protein, 9 aa, Homo Sapiens
SGVSDSETE

SEQ ID NO: 918900 - protein, 9 aa, Homo Sapiens
DNIKHVPRG

SEQ ID NO: 918901 - protein, 9 aa, Homo Sapiens
YMVILVSLQ

SEQ ID NO: 918902 - protein, 9 aa, Homo Sapiens
GILITDEKS

SEQ ID NO: 918903 - protein, 9 aa, Homo Sapiens
LQDPLDKKL

SEQ ID NO: 918904 - protein, 9 aa, Homo Sapiens
ILIASHLSS

SEQ ID NO: 918905 - protein, 9 aa, Homo Sapiens
CSRRQRALP

SEQ ID NO: 918906 - protein, 9 aa, Homo Sapiens
LAPLTLKPD

SEQ ID NO: 918907 - protein, 9 aa, Homo Sapiens
WKPGQPDNW

SEQ ID NO: 918908 - protein, 9 aa, Homo Sapiens
RQSRTLYGF

SEQ ID NO: 918909 - protein, 9 aa, Homo Sapiens
SEPLLILED

SEQ ID NO: 918910 - protein, 9 aa, Homo Sapiens
HLWYQFALF

SEQ ID NO: 918911 - protein, 9 aa, Homo Sapiens
LLPGKRYII

SEQ ID NO: 918912 - protein, 9 aa, Homo Sapiens
EFLENRQKQ

SEQ ID NO: 918913 - protein, 9 aa, Homo Sapiens
TEKTITLEV

SEQ ID NO: 918914 - protein, 9 aa, Homo Sapiens
LITDEKSQD

SEQ ID NO: 918915 - protein, 9 aa, Homo Sapiens
PKLPRPPKT

SEQ ID NO: 918916 - protein, 9 aa, Homo Sapiens
ESTVSSPEK

SEQ ID NO: 918917 - protein, 9 aa, Homo Sapiens
AASNRSKNK

SEQ ID NO: 918918 - protein, 9 aa, Homo Sapiens
VVRKKLEEA

SEQ ID NO: 918919 - protein, 9 aa, Homo Sapiens
FTFAFCDFC

SEQ ID NO: 918920 - protein, 9 aa, Homo Sapiens
LCPTFQIDN

SEQ ID NO: 918921 - protein, 9 aa, Homo Sapiens
HSDFEILKS

SEQ ID NO: 918922 - protein, 9 aa, Homo Sapiens
SQGSSKFRN

SEQ ID NO: 918923 - protein, 9 aa, Homo Sapiens
LITSSSQCL

SEQ ID NO: 918924 - protein, 9 aa, Homo Sapiens
KYCQPPDRN

SEQ ID NO: 918925 - protein, 9 aa, Homo Sapiens
GSPNLEEPI

SEQ ID NO: 918926 - protein, 9 aa, Homo Sapiens
FNPGVIAAN

SEQ ID NO: 918927 - protein, 9 aa, Homo Sapiens
YETHGAGFF

SEQ ID NO: 918928 - protein, 9 aa, Homo Sapiens
SPFRNSVDS

SEQ ID NO: 918929 - protein, 9 aa, Homo Sapiens
KSSEDHLLY

SEQ ID NO: 918930 - protein, 9 aa, Homo Sapiens
SSLGSGESS

SEQ ID NO: 918931 - protein, 9 aa, Homo Sapiens
NPGVIAANM

SEQ ID NO: 918932 - protein, 9 aa, Homo Sapiens
NKDGEIKWL

SEQ ID NO: 918933 - protein, 9 aa, Homo Sapiens
ASPSQDMLF

SEQ ID NO: 918934 - protein, 9 aa, Homo Sapiens
VFQESSKKD

SEQ ID NO: 918935 - protein, 9 aa, Homo Sapiens
GKGSTNDEA

SEQ ID NO: 918936 - protein, 9 aa, Homo Sapiens
WKSFSEKSN

SEQ ID NO: 918937 - protein, 9 aa, Homo Sapiens
RTPRGNKNF

SEQ ID NO: 918938 - protein, 9 aa, Homo Sapiens
PVSVPKIKG

SEQ ID NO: 918939 - protein, 9 aa, Homo Sapiens
SSTLTDHKK

SEQ ID NO: 918940 - protein, 9 aa, Homo Sapiens
KEKLARMLR

SEQ ID NO: 918941 - protein, 9 aa, Homo Sapiens
NTRILFIDN

SEQ ID NO: 918942 - protein, 9 aa, Homo Sapiens
MKIGDPACI

SEQ ID NO: 918943 - protein, 9 aa, Homo Sapiens
LGSSGSKSS

SEQ ID NO: 918944 - protein, 9 aa, Homo Sapiens
SQFLGYDQH

SEQ ID NO: 918945 - protein, 9 aa, Homo Sapiens
VKNLLKDGT

SEQ ID NO: 918946 - protein, 9 aa, Homo Sapiens
PLTLKPDGT

SEQ ID NO: 918947 - protein, 9 aa, Homo Sapiens
IIMYMVPAG

SEQ ID NO: 918948 - protein, 9 aa, Homo Sapiens
RPCLASAEM

SEQ ID NO: 918949 - protein, 9 aa, Homo Sapiens
NAMYFLLLD

SEQ ID NO: 918950 - protein, 9 aa, Homo Sapiens
LREDLKKKK

SEQ ID NO: 918951 - protein, 9 aa, Homo Sapiens
EIFFTNIFI

SEQ ID NO: 918952 - protein, 9 aa, Homo Sapiens
EDKAISCKE

SEQ ID NO: 918953 - protein, 9 aa, Homo Sapiens
SASHPQASF

SEQ ID NO: 918954 - protein, 9 aa, Homo Sapiens
LNLKKSDDS

SEQ ID NO: 918955 - protein, 9 aa, Homo Sapiens
MQCTCEEMN

SEQ ID NO: 918956 - protein, 9 aa, Homo Sapiens
ILITDEKSQ

SEQ ID NO: 918957 - protein, 9 aa, Homo Sapiens
VDLITSSSQ

SEQ ID NO: 918958 - protein, 9 aa, Homo Sapiens
ENFFAPADI

SEQ ID NO: 918959 - protein, 9 aa, Homo Sapiens
ETLNPSDPN

SEQ ID NO: 918960 - protein, 9 aa, Homo Sapiens
YGTFFFCRL

SEQ ID NO: 918961 - protein, 9 aa, Homo Sapiens
TPNKCEECG

SEQ ID NO: 918962 - protein, 9 aa, Homo Sapiens
VEEEVNISN

SEQ ID NO: 918963 - protein, 9 aa, Homo Sapiens
LEDILGSAM

SEQ ID NO: 918964 - protein, 9 aa, Homo Sapiens
AGQAPGGSR

SEQ ID NO: 918965 - protein, 9 aa, Homo Sapiens
ASLGLVAAS

SEQ ID NO: 918966 - protein, 9 aa, Homo Sapiens
LKNLSFEEG

SEQ ID NO: 918967 - protein, 9 aa, Homo Sapiens
PVTGSSFGL

SEQ ID NO: 918968 - protein, 9 aa, Homo Sapiens
VYALKRQSR

SEQ ID NO: 918969 - protein, 9 aa, Homo Sapiens
WVFQSILVA

SEQ ID NO: 918970 - protein, 9 aa, Homo Sapiens
ASVSVLEDI

SEQ ID NO: 918971 - protein, 9 aa, Homo Sapiens
AFYHPSAVR

SEQ ID NO: 918972 - protein, 9 aa, Homo Sapiens
GFISPRHGG

SEQ ID NO: 918973 - protein, 9 aa, Homo Sapiens
PLHPSQENF

SEQ ID NO: 918974 - protein, 9 aa, Homo Sapiens
SLGYTALHH

SEQ ID NO: 918975 - protein, 9 aa, Homo Sapiens
DMLHSIDWI

SEQ ID NO: 918976 - protein, 9 aa, Homo Sapiens
TEDVSSELD

SEQ ID NO: 918977 - protein, 9 aa, Homo Sapiens
EEKFGPGMQ

SEQ ID NO: 918978 - protein, 9 aa, Homo Sapiens
HWIDVIRLL

SEQ ID NO: 918979 - protein, 9 aa, Homo Sapiens
DGPKATLCG

SEQ ID NO: 918980 - protein, 9 aa, Homo Sapiens
KTRRHPQGA

SEQ ID NO: 918981 - protein, 9 aa, Homo Sapiens
KAKYAAATR

SEQ ID NO: 918982 - protein, 9 aa, Homo Sapiens
PVEGLFRVP

SEQ ID NO: 918983 - protein, 9 aa, Homo Sapiens
EERADSTYG

SEQ ID NO: 918984 - protein, 9 aa, Homo Sapiens
YRSFRRSDP

SEQ ID NO: 918985 - protein, 9 aa, Homo Sapiens
ELYARNNSI

SEQ ID NO: 918986 - protein, 9 aa, Homo Sapiens
SRDSCYVKE

SEQ ID NO: 918987 - protein, 9 aa, Homo Sapiens
NISKKPKTL

SEQ ID NO: 918988 - protein, 9 aa, Homo Sapiens
HVPRGGSVQ

SEQ ID NO: 918989 - protein, 9 aa, Homo Sapiens
SASLAALAC

SEQ ID NO: 918990 - protein, 9 aa, Homo Sapiens
WIKFVSDGT

SEQ ID NO: 918991 - protein, 9 aa, Homo Sapiens
KMEMLCAGR

SEQ ID NO: 918992 - protein, 9 aa, Homo Sapiens
QQELEVVRK

SEQ ID NO: 918993 - protein, 9 aa, Homo Sapiens
KLPRPPKTL

SEQ ID NO: 918994 - protein, 9 aa, Homo Sapiens
FFKPGFEEY

SEQ ID NO: 918995 - protein, 9 aa, Homo Sapiens
PPNLKSLLF

SEQ ID NO: 918996 - protein, 9 aa, Homo Sapiens
GETPNKCEE

SEQ ID NO: 918997 - protein, 9 aa, Homo Sapiens
FPDHPLHLI

SEQ ID NO: 918998 - protein, 9 aa, Homo Sapiens
LEGIYRYGN

SEQ ID NO: 918999 - protein, 9 aa, Homo Sapiens
TDLKFDRVV

SEQ ID NO: 919000 - protein, 9 aa, Homo Sapiens
LGLVAASFC

SEQ ID NO: 919001 - protein, 9 aa, Homo Sapiens
GKSSEDHLL

SEQ ID NO: 919002 - protein, 9 aa, Homo Sapiens
IASLPFQAA

SEQ ID NO: 919003 - protein, 9 aa, Homo Sapiens
FSNSGLSPG

SEQ ID NO: 919004 - protein, 9 aa, Homo Sapiens
QEELYRVYP

SEQ ID NO: 919005 - protein, 9 aa, Homo Sapiens
GKEGPPDLR

SEQ ID NO: 919006 - protein, 9 aa, Homo Sapiens
LLQDVLFPN

SEQ ID NO: 919007 - protein, 9 aa, Homo Sapiens
QQAALSAFC

SEQ ID NO: 919008 - protein, 9 aa, Homo Sapiens
DLDLVIAEK

SEQ ID NO: 919009 - protein, 9 aa, Homo Sapiens
EKTITLEVE

SEQ ID NO: 919010 - protein, 9 aa, Homo Sapiens
GKSYISEES

SEQ ID NO: 919011 - protein, 9 aa, Homo Sapiens
SPRGTTASS

SEQ ID NO: 919012 - protein, 9 aa, Homo Sapiens
DEDFVEVSE

SEQ ID NO: 919013 - protein, 9 aa, Homo Sapiens
SLPTTSFAT

SEQ ID NO: 919014 - protein, 9 aa, Homo Sapiens
KVLLIPVGQ

SEQ ID NO: 919015 - protein, 9 aa, Homo Sapiens
SAPPTKGDC

SEQ ID NO: 919016 - protein, 9 aa, Homo Sapiens
EALVLFLDF

SEQ ID NO: 919017 - protein, 9 aa, Homo Sapiens
FVVMVSTCT

SEQ ID NO: 919018 - protein, 9 aa, Homo Sapiens
MVILVSLQK

SEQ ID NO: 919019 - protein, 9 aa, Homo Sapiens
SDGIRDKIA

SEQ ID NO: 919020 - protein, 9 aa, Homo Sapiens
AEPASPDSL

SEQ ID NO: 919021 - protein, 9 aa, Homo Sapiens
SLVVLLSGG

SEQ ID NO: 919022 - protein, 9 aa, Homo Sapiens
QFSNSGLSP

SEQ ID NO: 919023 - protein, 9 aa, Homo Sapiens
YAGRCSPHY

SEQ ID NO: 919024 - protein, 9 aa, Homo Sapiens
PKGSMGPQG

SEQ ID NO: 919025 - protein, 9 aa, Homo Sapiens
RVSSMGPPS

SEQ ID NO: 919026 - protein, 9 aa, Homo Sapiens
LDIEWLILP

SEQ ID NO: 919027 - protein, 9 aa, Homo Sapiens
ACIQLIFER

SEQ ID NO: 919028 - protein, 9 aa, Homo Sapiens
FGPAGSLTS

SEQ ID NO: 919029 - protein, 9 aa, Homo Sapiens
DAKTSASQN

SEQ ID NO: 919030 - protein, 9 aa, Homo Sapiens
LYRVYPYLC

SEQ ID NO: 919031 - protein, 9 aa, Homo Sapiens
NFLITKLGH

SEQ ID NO: 919032 - protein, 9 aa, Homo Sapiens
APLLTEVAK

SEQ ID NO: 919033 - protein, 9 aa, Homo Sapiens
PSTPSPKAA

SEQ ID NO: 919034 - protein, 9 aa, Homo Sapiens
GVIIQGRNS

SEQ ID NO: 919035 - protein, 9 aa, Homo Sapiens
AVTNGFSLG

SEQ ID NO: 919036 - protein, 9 aa, Homo Sapiens
THGKSSEDH

SEQ ID NO: 919037 - protein, 9 aa, Homo Sapiens
CLQSSPSPG

SEQ ID NO: 919038 - protein, 9 aa, Homo Sapiens
LSVNPPSSL

SEQ ID NO: 919039 - protein, 9 aa, Homo Sapiens
AFPASPVCA

SEQ ID NO: 919040 - protein, 9 aa, Homo Sapiens
LFLLLLVTG

SEQ ID NO: 919041 - protein, 9 aa, Homo Sapiens
EEKQELLAI

SEQ ID NO: 919042 - protein, 9 aa, Homo Sapiens
RRKDLDKLH

SEQ ID NO: 919043 - protein, 9 aa, Homo Sapiens
NEELNFLIT

SEQ ID NO: 919044 - protein, 9 aa, Homo Sapiens
SLFWKLYES

SEQ ID NO: 919045 - protein, 9 aa, Homo Sapiens
LVCYALCNK

SEQ ID NO: 919046 - protein, 9 aa, Homo Sapiens
KVNTHMLQS

SEQ ID NO: 919047 - protein, 9 aa, Homo Sapiens
RSVEDFQRG

SEQ ID NO: 919048 - protein, 9 aa, Homo Sapiens
PGDTQKKIR

SEQ ID NO: 919049 - protein, 9 aa, Homo Sapiens
FVLVAHSDF

SEQ ID NO: 919050 - protein, 9 aa, Homo Sapiens
RSWLQIIKA

SEQ ID NO: 919051 - protein, 9 aa, Homo Sapiens
FSKTDSIIT

SEQ ID NO: 919052 - protein, 9 aa, Homo Sapiens
PGFISPRHG

SEQ ID NO: 919053 - protein, 9 aa, Homo Sapiens
KKKKEDKAH

SEQ ID NO: 919054 - protein, 9 aa, Homo Sapiens
VFLHTLIFL

SEQ ID NO: 919055 - protein, 9 aa, Homo Sapiens
GKELSYQAT

SEQ ID NO: 919056 - protein, 9 aa, Homo Sapiens
NILGEKLVN

SEQ ID NO: 919057 - protein, 9 aa, Homo Sapiens
GIYALICVT

SEQ ID NO: 919058 - protein, 9 aa, Homo Sapiens
VVSWKRPLF

SEQ ID NO: 919059 - protein, 9 aa, Homo Sapiens
ASLAALACP

SEQ ID NO: 919060 - protein, 9 aa, Homo Sapiens
PRYHVRRKD

SEQ ID NO: 919061 - protein, 9 aa, Homo Sapiens
TVNLVCYAL

SEQ ID NO: 919062 - protein, 9 aa, Homo Sapiens
AVEERKIKF

SEQ ID NO: 919063 - protein, 9 aa, Homo Sapiens
RQNVIGLQM

SEQ ID NO: 919064 - protein, 9 aa, Homo Sapiens
IQLAPIKTI

SEQ ID NO: 919065 - protein, 9 aa, Homo Sapiens
YEIITSRML

SEQ ID NO: 919066 - protein, 9 aa, Homo Sapiens
RDGVNDAVA

SEQ ID NO: 919067 - protein, 9 aa, Homo Sapiens
KIVTLKQAL

SEQ ID NO: 919068 - protein, 9 aa, Homo Sapiens
WPLLNDEGE

SEQ ID NO: 919069 - protein, 9 aa, Homo Sapiens
STSRVQNTV

SEQ ID NO: 919070 - protein, 9 aa, Homo Sapiens
SNTLWIKFV

SEQ ID NO: 919071 - protein, 9 aa, Homo Sapiens
ITRNSHLAE

SEQ ID NO: 919072 - protein, 9 aa, Homo Sapiens
LRNETLREV

SEQ ID NO: 919073 - protein, 9 aa, Homo Sapiens
IYFDLNPTG

SEQ ID NO: 919074 - protein, 9 aa, Homo Sapiens
WGIDHHVFS

SEQ ID NO: 919075 - protein, 9 aa, Homo Sapiens
LDMLAKSLE

SEQ ID NO: 919076 - protein, 9 aa, Homo Sapiens
EDPFLLNSR

SEQ ID NO: 919077 - protein, 9 aa, Homo Sapiens
IQGIPLQRD

SEQ ID NO: 919078 - protein, 9 aa, Homo Sapiens
VLRLGDKYS

SEQ ID NO: 919079 - protein, 9 aa, Homo Sapiens
QSKAVKILA

SEQ ID NO: 919080 - protein, 9 aa, Homo Sapiens
MVHRLIEKR

SEQ ID NO: 919081 - protein, 9 aa, Homo Sapiens
LLPPFLQVN

SEQ ID NO: 919082 - protein, 9 aa, Homo Sapiens
GQVPGYSPS

SEQ ID NO: 919083 - protein, 9 aa, Homo Sapiens
ADGSKEGSP

SEQ ID NO: 919084 - protein, 9 aa, Homo Sapiens
TFSPGAGTR

SEQ ID NO: 919085 - protein, 9 aa, Homo Sapiens
LPQQKSAHH

SEQ ID NO: 919086 - protein, 9 aa, Homo Sapiens
SKGRVRRKE

SEQ ID NO: 919087 - protein, 9 aa, Homo Sapiens
VQGLAAATE

SEQ ID NO: 919088 - protein, 9 aa, Homo Sapiens
TQERANSTI

SEQ ID NO: 919089 - protein, 9 aa, Homo Sapiens
VNTHMLQSF

SEQ ID NO: 919090 - protein, 9 aa, Homo Sapiens
PLGFTIGAI

SEQ ID NO: 919091 - protein, 9 aa, Homo Sapiens
TVSPGVFPV

SEQ ID NO: 919092 - protein, 9 aa, Homo Sapiens
NAVLKPSHC

SEQ ID NO: 919093 - protein, 9 aa, Homo Sapiens
HLDMLAKSL

SEQ ID NO: 919094 - protein, 9 aa, Homo Sapiens
MPMLSRDGG

SEQ ID NO: 919095 - protein, 9 aa, Homo Sapiens
MMLKESRQN

SEQ ID NO: 919096 - protein, 9 aa, Homo Sapiens
EKAWPTHVV

SEQ ID NO: 919097 - protein, 9 aa, Homo Sapiens
VNRLILAYS

SEQ ID NO: 919098 - protein, 9 aa, Homo Sapiens
MIGLVSILK

SEQ ID NO: 919099 - protein, 9 aa, Homo Sapiens
CLASAEMQG

SEQ ID NO: 919100 - protein, 9 aa, Homo Sapiens
VPLTHLDLC

SEQ ID NO: 919101 - protein, 9 aa, Homo Sapiens
TSFATAPWE

SEQ ID NO: 919102 - protein, 9 aa, Homo Sapiens
IFSPSYVPV

SEQ ID NO: 919103 - protein, 9 aa, Homo Sapiens
MEEEEEEEK

SEQ ID NO: 919104 - protein, 9 aa, Homo Sapiens
KIDVLGEKE

SEQ ID NO: 919105 - protein, 9 aa, Homo Sapiens
SMYKYSSDI

SEQ ID NO: 919106 - protein, 9 aa, Homo Sapiens
QKVEPQEVS

SEQ ID NO: 919107 - protein, 9 aa, Homo Sapiens
IKPGGSEDR

SEQ ID NO: 919108 - protein, 9 aa, Homo Sapiens
EQLRNCDDE

SEQ ID NO: 919109 - protein, 9 aa, Homo Sapiens
CPTFQIDNT

SEQ ID NO: 919110 - protein, 9 aa, Homo Sapiens
KQWLLKALQ

SEQ ID NO: 919111 - protein, 9 aa, Homo Sapiens
GPPPSSASP

SEQ ID NO: 919112 - protein, 9 aa, Homo Sapiens
GDFQPLGFG

SEQ ID NO: 919113 - protein, 9 aa, Homo Sapiens
KKMLPEAFL

SEQ ID NO: 919114 - protein, 9 aa, Homo Sapiens
LHMIGLRGM

SEQ ID NO: 919115 - protein, 9 aa, Homo Sapiens
SENTRILFI

SEQ ID NO: 919116 - protein, 9 aa, Homo Sapiens
YIIQLTTLS

SEQ ID NO: 919117 - protein, 9 aa, Homo Sapiens
IKAERASRA

SEQ ID NO: 919118 - protein, 9 aa, Homo Sapiens
MDKTRRHPQ

SEQ ID NO: 919119 - protein, 9 aa, Homo Sapiens
LKEYFQHAW

SEQ ID NO: 919120 - protein, 9 aa, Homo Sapiens
AEPHLLPCS

SEQ ID NO: 919121 - protein, 9 aa, Homo Sapiens
SDASETNDF

SEQ ID NO: 919122 - protein, 9 aa, Homo Sapiens
FGVSSSCQS

SEQ ID NO: 919123 - protein, 9 aa, Homo Sapiens
LSSMGMSDV

SEQ ID NO: 919124 - protein, 9 aa, Homo Sapiens
SAQEQSRDS

SEQ ID NO: 919125 - protein, 9 aa, Homo Sapiens
FHHQKEVRQ

SEQ ID NO: 919126 - protein, 9 aa, Homo Sapiens
VETGNLTKL

SEQ ID NO: 919127 - protein, 9 aa, Homo Sapiens
ELLDDPFGP

SEQ ID NO: 919128 - protein, 9 aa, Homo Sapiens
ATYNQSEYI

SEQ ID NO: 919129 - protein, 9 aa, Homo Sapiens
RSYGNAFYH

SEQ ID NO: 919130 - protein, 9 aa, Homo Sapiens
QLPKQTPLA

SEQ ID NO: 919131 - protein, 9 aa, Homo Sapiens
SPCTLIVAV

SEQ ID NO: 919132 - protein, 9 aa, Homo Sapiens
KVMKNFIYE

SEQ ID NO: 919133 - protein, 9 aa, Homo Sapiens
LGTELPPGK

SEQ ID NO: 919134 - protein, 9 aa, Homo Sapiens
VSKGAPFRW

SEQ ID NO: 919135 - protein, 9 aa, Homo Sapiens
LWEEDQLAK

SEQ ID NO: 919136 - protein, 9 aa, Homo Sapiens
KLKVMKNFI

SEQ ID NO: 919137 - protein, 9 aa, Homo Sapiens
PSKNLLFSI

SEQ ID NO: 919138 - protein, 9 aa, Homo Sapiens
SSKEKPQTL

SEQ ID NO: 919139 - protein, 9 aa, Homo Sapiens
KTQIFLPIN

SEQ ID NO: 919140 - protein, 9 aa, Homo Sapiens
KNSFKVLFR

SEQ ID NO: 919141 - protein, 9 aa, Homo Sapiens
ADFDFFPMS

SEQ ID NO: 919142 - protein, 9 aa, Homo Sapiens
PFPTEEKSV

SEQ ID NO: 919143 - protein, 9 aa, Homo Sapiens
EIEITCALD

SEQ ID NO: 919144 - protein, 9 aa, Homo Sapiens
FAELLKPGS

SEQ ID NO: 919145 - protein, 9 aa, Homo Sapiens
FYGTDSGEF

SEQ ID NO: 919146 - protein, 9 aa, Homo Sapiens
FDPQLHDSS

SEQ ID NO: 919147 - protein, 9 aa, Homo Sapiens
EDSEWQAFL

SEQ ID NO: 919148 - protein, 9 aa, Homo Sapiens
ASMPEDSAE

SEQ ID NO: 919149 - protein, 9 aa, Homo Sapiens
RKKGSHGLG

SEQ ID NO: 919150 - protein, 9 aa, Homo Sapiens
YRNQFSEIL

SEQ ID NO: 919151 - protein, 9 aa, Homo Sapiens
PWGRLHSHC

SEQ ID NO: 919152 - protein, 9 aa, Homo Sapiens
LLNKETEKI

SEQ ID NO: 919153 - protein, 9 aa, Homo Sapiens
EEDQLAKEK

SEQ ID NO: 919154 - protein, 9 aa, Homo Sapiens
REGNPGSAR

SEQ ID NO: 919155 - protein, 9 aa, Homo Sapiens
DAFCHHSSN

SEQ ID NO: 919156 - protein, 9 aa, Homo Sapiens
LNERPPRAH

SEQ ID NO: 919157 - protein, 9 aa, Homo Sapiens
KGEKLEMET

SEQ ID NO: 919158 - protein, 9 aa, Homo Sapiens
PAASTSYFF

SEQ ID NO: 919159 - protein, 9 aa, Homo Sapiens
ALELIICCV

SEQ ID NO: 919160 - protein, 9 aa, Homo Sapiens
LAKIESTMP

SEQ ID NO: 919161 - protein, 9 aa, Homo Sapiens
KEKPQTLPE

SEQ ID NO: 919162 - protein, 9 aa, Homo Sapiens
RGNNSNGRE

SEQ ID NO: 919163 - protein, 9 aa, Homo Sapiens
AKIESTMPL

SEQ ID NO: 919164 - protein, 9 aa, Homo Sapiens
ELMQIARKA

SEQ ID NO: 919165 - protein, 9 aa, Homo Sapiens
LAVREGNPG

SEQ ID NO: 919166 - protein, 9 aa, Homo Sapiens
VVYTAMLDN

SEQ ID NO: 919167 - protein, 9 aa, Homo Sapiens
RINGIYGFF

SEQ ID NO: 919168 - protein, 9 aa, Homo Sapiens
GGQQGAAAW

SEQ ID NO: 919169 - protein, 9 aa, Homo Sapiens
SEKELAQIL

SEQ ID NO: 919170 - protein, 9 aa, Homo Sapiens
WQAFLRKSK

SEQ ID NO: 919171 - protein, 9 aa, Homo Sapiens
VEHVKEETK

SEQ ID NO: 919172 - protein, 9 aa, Homo Sapiens
AQKAAVPSP

SEQ ID NO: 919173 - protein, 9 aa, Homo Sapiens
YAGKKFYKC

SEQ ID NO: 919174 - protein, 9 aa, Homo Sapiens
KFRSLLEKT

SEQ ID NO: 919175 - protein, 9 aa, Homo Sapiens
SFPESPLQS

SEQ ID NO: 919176 - protein, 9 aa, Homo Sapiens
STNAVCQSR

SEQ ID NO: 919177 - protein, 9 aa, Homo Sapiens
GGCIILISS

SEQ ID NO: 919178 - protein, 9 aa, Homo Sapiens
YCRKKKGLD

SEQ ID NO: 919179 - protein, 9 aa, Homo Sapiens
KIFLQHALY

SEQ ID NO: 919180 - protein, 9 aa, Homo Sapiens
SSFQRLVND

SEQ ID NO: 919181 - protein, 9 aa, Homo Sapiens
SGPFCTDLG

SEQ ID NO: 919182 - protein, 9 aa, Homo Sapiens
GDSGGLLVC

SEQ ID NO: 919183 - protein, 9 aa, Homo Sapiens
FPMSDKNPE

SEQ ID NO: 919184 - protein, 9 aa, Homo Sapiens
AGKVAAMAN

SEQ ID NO: 919185 - protein, 9 aa, Homo Sapiens
RDADLLNVE

SEQ ID NO: 919186 - protein, 9 aa, Homo Sapiens
TKNSFKVLF

SEQ ID NO: 919187 - protein, 9 aa, Homo Sapiens
CLYGTVLKL

SEQ ID NO: 919188 - protein, 9 aa, Homo Sapiens
TGVWKKLIS

SEQ ID NO: 919189 - protein, 9 aa, Homo Sapiens
EDIVILLNK

SEQ ID NO: 919190 - protein, 9 aa, Homo Sapiens
RRPRHSHLT

SEQ ID NO: 919191 - protein, 9 aa, Homo Sapiens
ADRLDPYSS

SEQ ID NO: 919192 - protein, 9 aa, Homo Sapiens
FLFYGVMTP

SEQ ID NO: 919193 - protein, 9 aa, Homo Sapiens
EDVEWKSCD

SEQ ID NO: 919194 - protein, 9 aa, Homo Sapiens
QKVSMEEMI

SEQ ID NO: 919195 - protein, 9 aa, Homo Sapiens
SPAQRLVSW

SEQ ID NO: 919196 - protein, 9 aa, Homo Sapiens
NTINPACYA

SEQ ID NO: 919197 - protein, 9 aa, Homo Sapiens
KHPRKAFIL

SEQ ID NO: 919198 - protein, 9 aa, Homo Sapiens
SLKLARKGT

SEQ ID NO: 919199 - protein, 9 aa, Homo Sapiens
SESRSIDRL

SEQ ID NO: 919200 - protein, 9 aa, Homo Sapiens
KPQTLPETQ

SEQ ID NO: 919201 - protein, 9 aa, Homo Sapiens
PVVASLLKR

SEQ ID NO: 919202 - protein, 9 aa, Homo Sapiens
CTDLGYHLV

SEQ ID NO: 919203 - protein, 9 aa, Homo Sapiens
SEWQAFLRK

SEQ ID NO: 919204 - protein, 9 aa, Homo Sapiens
PIMPEPGQD

SEQ ID NO: 919205 - protein, 9 aa, Homo Sapiens
GWAVLTGPL

SEQ ID NO: 919206 - protein, 9 aa, Homo Sapiens
KYMPHTVLK

SEQ ID NO: 919207 - protein, 9 aa, Homo Sapiens
SSSIYHQNN

SEQ ID NO: 919208 - protein, 9 aa, Homo Sapiens
ENPAPKITW

SEQ ID NO: 919209 - protein, 9 aa, Homo Sapiens
QPGPLELVE

SEQ ID NO: 919210 - protein, 9 aa, Homo Sapiens
VLSLALTAF

SEQ ID NO: 919211 - protein, 9 aa, Homo Sapiens
ACIRGYNPE

SEQ ID NO: 919212 - protein, 9 aa, Homo Sapiens
PWGSKMLFG

SEQ ID NO: 919213 - protein, 9 aa, Homo Sapiens
LSFFFFFFF

SEQ ID NO: 919214 - protein, 9 aa, Homo Sapiens
YSKIIALMK

SEQ ID NO: 919215 - protein, 9 aa, Homo Sapiens
KGLESNKSL

SEQ ID NO: 919216 - protein, 9 aa, Homo Sapiens
EDQLAKEKR

SEQ ID NO: 919217 - protein, 9 aa, Homo Sapiens
LSPAQRLVS

SEQ ID NO: 919218 - protein, 9 aa, Homo Sapiens
FCTDLGYHL

SEQ ID NO: 919219 - protein, 9 aa, Homo Sapiens
EVQKRELQQ

SEQ ID NO: 919220 - protein, 9 aa, Homo Sapiens
INFKDNHGI

SEQ ID NO: 919221 - protein, 9 aa, Homo Sapiens
VALHAAREG

SEQ ID NO: 919222 - protein, 9 aa, Homo Sapiens
GIEKFTNYS

SEQ ID NO: 919223 - protein, 9 aa, Homo Sapiens
VFEFIGKFG

SEQ ID NO: 919224 - protein, 9 aa, Homo Sapiens
EGRPFGCNE

SEQ ID NO: 919225 - protein, 9 aa, Homo Sapiens
EPGLAKMIS

SEQ ID NO: 919226 - protein, 9 aa, Homo Sapiens
SFVLSLALT

SEQ ID NO: 919227 - protein, 9 aa, Homo Sapiens
GTHFWRDQF

SEQ ID NO: 919228 - protein, 9 aa, Homo Sapiens
DRQKRKKSL

SEQ ID NO: 919229 - protein, 9 aa, Homo Sapiens
DQLAKEKRE

SEQ ID NO: 919230 - protein, 9 aa, Homo Sapiens
TEEFKIVLA

SEQ ID NO: 919231 - protein, 9 aa, Homo Sapiens
VRSFSIEDA

SEQ ID NO: 919232 - protein, 9 aa, Homo Sapiens
TKKIGSTVK

SEQ ID NO: 919233 - protein, 9 aa, Homo Sapiens
SEHQTQLYK

SEQ ID NO: 919234 - protein, 9 aa, Homo Sapiens
ENTYLEACL

SEQ ID NO: 919235 - protein, 9 aa, Homo Sapiens
DDSDFSLSE

SEQ ID NO: 919236 - protein, 9 aa, Homo Sapiens
LIAPRGRVP

SEQ ID NO: 919237 - protein, 9 aa, Homo Sapiens
NLDKEDLGT

SEQ ID NO: 919238 - protein, 9 aa, Homo Sapiens
VDHVDCMTS

SEQ ID NO: 919239 - protein, 9 aa, Homo Sapiens
NLGTPRLKT

SEQ ID NO: 919240 - protein, 9 aa, Homo Sapiens
MNATGNSYL

SEQ ID NO: 919241 - protein, 9 aa, Homo Sapiens
GGFDLVRTA

SEQ ID NO: 919242 - protein, 9 aa, Homo Sapiens
YLVTVVRNL

SEQ ID NO: 919243 - protein, 9 aa, Homo Sapiens
VDQSALSCF

SEQ ID NO: 919244 - protein, 9 aa, Homo Sapiens
HAPKLDFLT

SEQ ID NO: 919245 - protein, 9 aa, Homo Sapiens
ATKMSGRGS

SEQ ID NO: 919246 - protein, 9 aa, Homo Sapiens
LWSEMLGVG

SEQ ID NO: 919247 - protein, 9 aa, Homo Sapiens
IEPDPTQDT

SEQ ID NO: 919248 - protein, 9 aa, Homo Sapiens
KEMGLVLSE

SEQ ID NO: 919249 - protein, 9 aa, Homo Sapiens
GASCQNLEA

SEQ ID NO: 919250 - protein, 9 aa, Homo Sapiens
NKSFVLGLY

SEQ ID NO: 919251 - protein, 9 aa, Homo Sapiens
CTLIVAVLL

SEQ ID NO: 919252 - protein, 9 aa, Homo Sapiens
IKKLHNDHY

SEQ ID NO: 919253 - protein, 9 aa, Homo Sapiens
LDYILRRGW

SEQ ID NO: 919254 - protein, 9 aa, Homo Sapiens
FTSSVLYGW

SEQ ID NO: 919255 - protein, 9 aa, Homo Sapiens
KKNRETWYL

SEQ ID NO: 919256 - protein, 9 aa, Homo Sapiens
FCCFPFGFV

SEQ ID NO: 919257 - protein, 9 aa, Homo Sapiens
RVPSKNLLF

SEQ ID NO: 919258 - protein, 9 aa, Homo Sapiens
DSVIARGHI

SEQ ID NO: 919259 - protein, 9 aa, Homo Sapiens
KENLEKMCR

SEQ ID NO: 919260 - protein, 9 aa, Homo Sapiens
VTNIVQKKK

SEQ ID NO: 919261 - protein, 9 aa, Homo Sapiens
AGKVSANRT

SEQ ID NO: 919262 - protein, 9 aa, Homo Sapiens
NITITVTNL

SEQ ID NO: 919263 - protein, 9 aa, Homo Sapiens
FSFFEISFT

SEQ ID NO: 919264 - protein, 9 aa, Homo Sapiens
MENYNQTLT

SEQ ID NO: 919265 - protein, 9 aa, Homo Sapiens
GRTPHCEPC

SEQ ID NO: 919266 - protein, 9 aa, Homo Sapiens
SLSIEDQTA

SEQ ID NO: 919267 - protein, 9 aa, Homo Sapiens
ARLSPESGG

SEQ ID NO: 919268 - protein, 9 aa, Homo Sapiens
VILLNKETE

SEQ ID NO: 919269 - protein, 9 aa, Homo Sapiens
EVHEVVVKA

SEQ ID NO: 919270 - protein, 9 aa, Homo Sapiens
TSLSGGPQS

SEQ ID NO: 919271 - protein, 9 aa, Homo Sapiens
KEDIVILLN

SEQ ID NO: 919272 - protein, 9 aa, Homo Sapiens
DFFEISMDL

SEQ ID NO: 919273 - protein, 9 aa, Homo Sapiens
WARRIASTS

SEQ ID NO: 919274 - protein, 9 aa, Homo Sapiens
KNLLFSIVE

SEQ ID NO: 919275 - protein, 9 aa, Homo Sapiens
GWGSYGSDK

SEQ ID NO: 919276 - protein, 9 aa, Homo Sapiens
KDAVERQRR

SEQ ID NO: 919277 - protein, 9 aa, Homo Sapiens
GINICHPDT

SEQ ID NO: 919278 - protein, 9 aa, Homo Sapiens
NMADNEDLD

SEQ ID NO: 919279 - protein, 9 aa, Homo Sapiens
NPGSARCAC

SEQ ID NO: 919280 - protein, 9 aa, Homo Sapiens
IYHQNNPWH

SEQ ID NO: 919281 - protein, 9 aa, Homo Sapiens
PCHGGASCQ

SEQ ID NO: 919282 - protein, 9 aa, Homo Sapiens
ASLLKRQAC

SEQ ID NO: 919283 - protein, 9 aa, Homo Sapiens
MYIKPSAND

SEQ ID NO: 919284 - protein, 9 aa, Homo Sapiens
VSWIDHILQ

SEQ ID NO: 919285 - protein, 9 aa, Homo Sapiens
VFFNIEALP

SEQ ID NO: 919286 - protein, 9 aa, Homo Sapiens
ATQAIQIFS

SEQ ID NO: 919287 - protein, 9 aa, Homo Sapiens
FFVVSFFVL

SEQ ID NO: 919288 - protein, 9 aa, Homo Sapiens
NSKYTLSAA

SEQ ID NO: 919289 - protein, 9 aa, Homo Sapiens
HITATQAIQ

SEQ ID NO: 919290 - protein, 9 aa, Homo Sapiens
RERVELRGI

SEQ ID NO: 919291 - protein, 9 aa, Homo Sapiens
MEVAGQVMC

SEQ ID NO: 919292 - protein, 9 aa, Homo Sapiens
PPGSKIPLP

SEQ ID NO: 919293 - protein, 9 aa, Homo Sapiens
FDDSTLVQR

SEQ ID NO: 919294 - protein, 9 aa, Homo Sapiens
ISKGLKDVS

SEQ ID NO: 919295 - protein, 9 aa, Homo Sapiens
EKIALQPGP

SEQ ID NO: 919296 - protein, 9 aa, Homo Sapiens
LKFSHKEKP

SEQ ID NO: 919297 - protein, 9 aa, Homo Sapiens
PPGKGGAQG

SEQ ID NO: 919298 - protein, 9 aa, Homo Sapiens
ADLLNVESK

SEQ ID NO: 919299 - protein, 9 aa, Homo Sapiens
PECRTPVFF

SEQ ID NO: 919300 - protein, 9 aa, Homo Sapiens
SYLPTQQDV

SEQ ID NO: 919301 - protein, 9 aa, Homo Sapiens
GICTKCQSS

SEQ ID NO: 919302 - protein, 9 aa, Homo Sapiens
SVDSSKEKP

SEQ ID NO: 919303 - protein, 9 aa, Homo Sapiens
ELLAKIEST

SEQ ID NO: 919304 - protein, 9 aa, Homo Sapiens
AGNEAAPAE

SEQ ID NO: 919305 - protein, 9 aa, Homo Sapiens
FLPINFKDN

SEQ ID NO: 919306 - protein, 9 aa, Homo Sapiens
HGTRCAGKV

SEQ ID NO: 919307 - protein, 9 aa, Homo Sapiens
FSKLWEEDQ

SEQ ID NO: 919308 - protein, 9 aa, Homo Sapiens
IMPFPTEEK

SEQ ID NO: 919309 - protein, 9 aa, Homo Sapiens
FIKFENTYL

SEQ ID NO: 919310 - protein, 9 aa, Homo Sapiens
FLELKFSHK

SEQ ID NO: 919311 - protein, 9 aa, Homo Sapiens
APKLDFLTL

SEQ ID NO: 919312 - protein, 9 aa, Homo Sapiens
LKQSGKFSG

SEQ ID NO: 919313 - protein, 9 aa, Homo Sapiens
SQGRLEVQK

SEQ ID NO: 919314 - protein, 9 aa, Homo Sapiens
RPPKPRLGK

SEQ ID NO: 919315 - protein, 9 aa, Homo Sapiens
LTGPLQQSH

SEQ ID NO: 919316 - protein, 9 aa, Homo Sapiens
SARKYKTLP

SEQ ID NO: 919317 - protein, 9 aa, Homo Sapiens
RLIIVLTLD

SEQ ID NO: 919318 - protein, 9 aa, Homo Sapiens
HKLIKLLHH

SEQ ID NO: 919319 - protein, 9 aa, Homo Sapiens
MTEEFKIVL

SEQ ID NO: 919320 - protein, 9 aa, Homo Sapiens
SSPAAAHCP

SEQ ID NO: 919321 - protein, 9 aa, Homo Sapiens
SSHQGAAPH

SEQ ID NO: 919322 - protein, 9 aa, Homo Sapiens
YGKELMQIA

SEQ ID NO: 919323 - protein, 9 aa, Homo Sapiens
ENEEKVSLE

SEQ ID NO: 919324 - protein, 9 aa, Homo Sapiens
FATEVCSRE

SEQ ID NO: 919325 - protein, 9 aa, Homo Sapiens
SGNPLSALD

SEQ ID NO: 919326 - protein, 9 aa, Homo Sapiens
RKIATRNVS

SEQ ID NO: 919327 - protein, 9 aa, Homo Sapiens
TDVKKKIPW

SEQ ID NO: 919328 - protein, 9 aa, Homo Sapiens
RKHPRKAFI

SEQ ID NO: 919329 - protein, 9 aa, Homo Sapiens
SYGAWAERI

SEQ ID NO: 919330 - protein, 9 aa, Homo Sapiens
EMDALINSW

SEQ ID NO: 919331 - protein, 9 aa, Homo Sapiens
YKIENVTRM

SEQ ID NO: 919332 - protein, 9 aa, Homo Sapiens
LFDASFYTY

SEQ ID NO: 919333 - protein, 9 aa, Homo Sapiens
ALNWVVGPC

SEQ ID NO: 919334 - protein, 9 aa, Homo Sapiens
VKKKIPWIQ

SEQ ID NO: 919335 - protein, 9 aa, Homo Sapiens
LKKFHDNEK

SEQ ID NO: 919336 - protein, 9 aa, Homo Sapiens
TPVKQADTI

SEQ ID NO: 919337 - protein, 9 aa, Homo Sapiens
QDMESDIIL

SEQ ID NO: 919338 - protein, 9 aa, Homo Sapiens
INGIYGFFV

SEQ ID NO: 919339 - protein, 9 aa, Homo Sapiens
WEEDQLAKE

SEQ ID NO: 919340 - protein, 9 aa, Homo Sapiens
GGESLSEKE

SEQ ID NO: 919341 - protein, 9 aa, Homo Sapiens
CLDFTSSVL

SEQ ID NO: 919342 - protein, 9 aa, Homo Sapiens
MPEPGQDET

SEQ ID NO: 919343 - protein, 9 aa, Homo Sapiens
SCEYKIENV

SEQ ID NO: 919344 - protein, 9 aa, Homo Sapiens
NEEKVSLEA

SEQ ID NO: 919345 - protein, 9 aa, Homo Sapiens
QNNPWHPPV

SEQ ID NO: 919346 - protein, 9 aa, Homo Sapiens
LVEKKEMGL

SEQ ID NO: 919347 - protein, 9 aa, Homo Sapiens
QKESSEDEG

SEQ ID NO: 919348 - protein, 9 aa, Homo Sapiens
CFSKRKRKI

SEQ ID NO: 919349 - protein, 9 aa, Homo Sapiens
QKLKVMKNF

SEQ ID NO: 919350 - protein, 9 aa, Homo Sapiens
QVAKLGKHL

SEQ ID NO: 919351 - protein, 9 aa, Homo Sapiens
EFKIVLAIG

SEQ ID NO: 919352 - protein, 9 aa, Homo Sapiens
IENMVLSPC

SEQ ID NO: 919353 - protein, 9 aa, Homo Sapiens
IEVETGKPR

SEQ ID NO: 919354 - protein, 9 aa, Homo Sapiens
EIPHQESWG

SEQ ID NO: 919355 - protein, 9 aa, Homo Sapiens
LGSCCSEAI

SEQ ID NO: 919356 - protein, 9 aa, Homo Sapiens
VTNFNDNLI

SEQ ID NO: 919357 - protein, 9 aa, Homo Sapiens
MRGGRSAPF

SEQ ID NO: 919358 - protein, 9 aa, Homo Sapiens
DLEEYDDGE

SEQ ID NO: 919359 - protein, 9 aa, Homo Sapiens
ELLVHPDLA

SEQ ID NO: 919360 - protein, 9 aa, Homo Sapiens
EKMIGQFLY

SEQ ID NO: 919361 - protein, 9 aa, Homo Sapiens
LHKLIKLLH

SEQ ID NO: 919362 - protein, 9 aa, Homo Sapiens
FVPFRHVIS

SEQ ID NO: 919363 - protein, 9 aa, Homo Sapiens
VILCRIQAS

SEQ ID NO: 919364 - protein, 9 aa, Homo Sapiens
NDRVSLSKG

SEQ ID NO: 919365 - protein, 9 aa, Homo Sapiens
DYGGFQEHV

SEQ ID NO: 919366 - protein, 9 aa, Homo Sapiens
MVLSPCTLI

SEQ ID NO: 919367 - protein, 9 aa, Homo Sapiens
DDGLVALNW

SEQ ID NO: 919368 - protein, 9 aa, Homo Sapiens
WDNQVELYR

SEQ ID NO: 919369 - protein, 9 aa, Homo Sapiens
CPGGAGTLL

SEQ ID NO: 919370 - protein, 9 aa, Homo Sapiens
VHSGSGVIE

SEQ ID NO: 919371 - protein, 9 aa, Homo Sapiens
GNIFIVRII

SEQ ID NO: 919372 - protein, 9 aa, Homo Sapiens
NLAPTFINF

SEQ ID NO: 919373 - protein, 9 aa, Homo Sapiens
ALAAIFAYW

SEQ ID NO: 919374 - protein, 9 aa, Homo Sapiens
VFQMLNMNL

SEQ ID NO: 919375 - protein, 9 aa, Homo Sapiens
RAAASAPGC

SEQ ID NO: 919376 - protein, 9 aa, Homo Sapiens
EVRLAVRKA

SEQ ID NO: 919377 - protein, 9 aa, Homo Sapiens
KFENTYLEA

SEQ ID NO: 919378 - protein, 9 aa, Homo Sapiens
VPSKNLLFS

SEQ ID NO: 919379 - protein, 9 aa, Homo Sapiens
GNSYLDDIG

SEQ ID NO: 919380 - protein, 9 aa, Homo Sapiens
NWVVGPCVR

SEQ ID NO: 919381 - protein, 9 aa, Homo Sapiens
GCGRFSQAI

SEQ ID NO: 919382 - protein, 9 aa, Homo Sapiens
TEILRRLKR

SEQ ID NO: 919383 - protein, 9 aa, Homo Sapiens
KELAQILEQ

SEQ ID NO: 919384 - protein, 9 aa, Homo Sapiens
VECKEKLWK

SEQ ID NO: 919385 - protein, 9 aa, Homo Sapiens
LVVGTHFWR

SEQ ID NO: 919386 - protein, 9 aa, Homo Sapiens
PKPIYRKLT

SEQ ID NO: 919387 - protein, 9 aa, Homo Sapiens
NNSNGREAK

SEQ ID NO: 919388 - protein, 9 aa, Homo Sapiens
KKDEADHDS

SEQ ID NO: 919389 - protein, 9 aa, Homo Sapiens
IRGYNPELL

SEQ ID NO: 919390 - protein, 9 aa, Homo Sapiens
CYINNTINP

SEQ ID NO: 919391 - protein, 9 aa, Homo Sapiens
SLSEKELAQ

SEQ ID NO: 919392 - protein, 9 aa, Homo Sapiens
AASTSYFFP

SEQ ID NO: 919393 - protein, 9 aa, Homo Sapiens
IRSARGNNS

SEQ ID NO: 919394 - protein, 9 aa, Homo Sapiens
ARCACSCDL

SEQ ID NO: 919395 - protein, 9 aa, Homo Sapiens
GRPSGEPGG

SEQ ID NO: 919396 - protein, 9 aa, Homo Sapiens
GRSKGEKLE

SEQ ID NO: 919397 - protein, 9 aa, Homo Sapiens
QMLNMNLAP

SEQ ID NO: 919398 - protein, 9 aa, Homo Sapiens
EKLTRTDEG

SEQ ID NO: 919399 - protein, 9 aa, Homo Sapiens
KKGSHGLGI

SEQ ID NO: 919400 - protein, 9 aa, Homo Sapiens
GQQGAAAWE

SEQ ID NO: 919401 - protein, 9 aa, Homo Sapiens
ICNEVALHA

SEQ ID NO: 919402 - protein, 9 aa, Homo Sapiens
QVEVNLFGE

SEQ ID NO: 919403 - protein, 9 aa, Homo Sapiens
FHFRSPGQD

SEQ ID NO: 919404 - protein, 9 aa, Homo Sapiens
KKVEKIQIS

SEQ ID NO: 919405 - protein, 9 aa, Homo Sapiens
RSKGEKLEM

SEQ ID NO: 919406 - protein, 9 aa, Homo Sapiens
LGKSKERKY

SEQ ID NO: 919407 - protein, 9 aa, Homo Sapiens
KGLWSEMLG

SEQ ID NO: 919408 - protein, 9 aa, Homo Sapiens
NNTINPACY

SEQ ID NO: 919409 - protein, 9 aa, Homo Sapiens
LDKEDLGTY

SEQ ID NO: 919410 - protein, 9 aa, Homo Sapiens
AKKKNRETW

SEQ ID NO: 919411 - protein, 9 aa, Homo Sapiens
TIPKDRQKR

SEQ ID NO: 919412 - protein, 9 aa, Homo Sapiens
FAVVRQCTS

SEQ ID NO: 919413 - protein, 9 aa, Homo Sapiens
LYECAICQR

SEQ ID NO: 919414 - protein, 9 aa, Homo Sapiens
ITVTNLGTP

SEQ ID NO: 919415 - protein, 9 aa, Homo Sapiens
DIILEDYDE

SEQ ID NO: 919416 - protein, 9 aa, Homo Sapiens
HQGAAPHRV

SEQ ID NO: 919417 - protein, 9 aa, Homo Sapiens
NIVRSFSIE

SEQ ID NO: 919418 - protein, 9 aa, Homo Sapiens
PPELLAKIE

SEQ ID NO: 919419 - protein, 9 aa, Homo Sapiens
LTRRRSSPR

SEQ ID NO: 919420 - protein, 9 aa, Homo Sapiens
RLHTGQKLY

SEQ ID NO: 919421 - protein, 9 aa, Homo Sapiens
KIIALMKAY

SEQ ID NO: 919422 - protein, 9 aa, Homo Sapiens
QSPDFETED

SEQ ID NO: 919423 - protein, 9 aa, Homo Sapiens
LHLFHVVTN

SEQ ID NO: 919424 - protein, 9 aa, Homo Sapiens
FEISFTNIF

SEQ ID NO: 919425 - protein, 9 aa, Homo Sapiens
KVVFCLAEG

SEQ ID NO: 919426 - protein, 9 aa, Homo Sapiens
TKKLATSAS

SEQ ID NO: 919427 - protein, 9 aa, Homo Sapiens
TLSNVEEIG

SEQ ID NO: 919428 - protein, 9 aa, Homo Sapiens
KHKKIYAGK

SEQ ID NO: 919429 - protein, 9 aa, Homo Sapiens
ARMAASIRK

SEQ ID NO: 919430 - protein, 9 aa, Homo Sapiens
PTEPLPFLP

SEQ ID NO: 919431 - protein, 9 aa, Homo Sapiens
SFFPGLPCI

SEQ ID NO: 919432 - protein, 9 aa, Homo Sapiens
LPFLPPAGS

SEQ ID NO: 919433 - protein, 9 aa, Homo Sapiens
FCQLVVVAK

SEQ ID NO: 919434 - protein, 9 aa, Homo Sapiens
LFEGLFFLQ

SEQ ID NO: 919435 - protein, 9 aa, Homo Sapiens
KLYLKNLDK

SEQ ID NO: 919436 - protein, 9 aa, Homo Sapiens
SKSFPESPL

SEQ ID NO: 919437 - protein, 9 aa, Homo Sapiens
SNFAQLLVE

SEQ ID NO: 919438 - protein, 9 aa, Homo Sapiens
TRSSNMETR

SEQ ID NO: 919439 - protein, 9 aa, Homo Sapiens
PLASGKGLW

SEQ ID NO: 919440 - protein, 9 aa, Homo Sapiens
ERERDRHSL

SEQ ID NO: 919441 - protein, 9 aa, Homo Sapiens
NIAKYFSKK

SEQ ID NO: 919442 - protein, 9 aa, Homo Sapiens
RQNVCAENK

SEQ ID NO: 919443 - protein, 9 aa, Homo Sapiens
LVSWIDHIL

SEQ ID NO: 919444 - protein, 9 aa, Homo Sapiens
LISTLIDDY

SEQ ID NO: 919445 - protein, 9 aa, Homo Sapiens
GMTSLSGGP

SEQ ID NO: 919446 - protein, 9 aa, Homo Sapiens
MAAYKEKRR

SEQ ID NO: 919447 - protein, 9 aa, Homo Sapiens
TLDYILRRG

SEQ ID NO: 919448 - protein, 9 aa, Homo Sapiens
DLETAIADV

SEQ ID NO: 919449 - protein, 9 aa, Homo Sapiens
EIGNIFIVR

SEQ ID NO: 919450 - protein, 9 aa, Homo Sapiens
KFDGWYCDS

SEQ ID NO: 919451 - protein, 9 aa, Homo Sapiens
NFNFTRSSN

SEQ ID NO: 919452 - protein, 9 aa, Homo Sapiens
YMPHTVLKL

SEQ ID NO: 919453 - protein, 9 aa, Homo Sapiens
SDAVPQPGI

SEQ ID NO: 919454 - protein, 9 aa, Homo Sapiens
ICFSFRVVL

SEQ ID NO: 919455 - protein, 9 aa, Homo Sapiens
HLDTSVELR

SEQ ID NO: 919456 - protein, 9 aa, Homo Sapiens
IVQKKKHTP

SEQ ID NO: 919457 - protein, 9 aa, Homo Sapiens
VCSCLSFFF

SEQ ID NO: 919458 - protein, 9 aa, Homo Sapiens
HRVTAGEGM

SEQ ID NO: 919459 - protein, 9 aa, Homo Sapiens
LGQKVIAPE

SEQ ID NO: 919460 - protein, 9 aa, Homo Sapiens
TVSKAKENL

SEQ ID NO: 919461 - protein, 9 aa, Homo Sapiens
EKIQKAFDN

SEQ ID NO: 919462 - protein, 9 aa, Homo Sapiens
GFGARLSPE

SEQ ID NO: 919463 - protein, 9 aa, Homo Sapiens
PVLSALSLS

SEQ ID NO: 919464 - protein, 9 aa, Homo Sapiens
AAIFAYWFT

SEQ ID NO: 919465 - protein, 9 aa, Homo Sapiens
WGSKMLFGE

SEQ ID NO: 919466 - protein, 9 aa, Homo Sapiens
IKSLMDFEW

SEQ ID NO: 919467 - protein, 9 aa, Homo Sapiens
VEVNLFGET

SEQ ID NO: 919468 - protein, 9 aa, Homo Sapiens
SHGLGIFQR

SEQ ID NO: 919469 - protein, 9 aa, Homo Sapiens
YQSGINYAV

SEQ ID NO: 919470 - protein, 9 aa, Homo Sapiens
TAIADVEQR

SEQ ID NO: 919471 - protein, 9 aa, Homo Sapiens
SKKKVKGSP

SEQ ID NO: 919472 - protein, 9 aa, Homo Sapiens
HLTRARRCP

SEQ ID NO: 919473 - protein, 9 aa, Homo Sapiens
PPPLVPQRL

SEQ ID NO: 919474 - protein, 9 aa, Homo Sapiens
FLQLLLLNA

SEQ ID NO: 919475 - protein, 9 aa, Homo Sapiens
LNATVESTN

SEQ ID NO: 919476 - protein, 9 aa, Homo Sapiens
KESSCHSSF

SEQ ID NO: 919477 - protein, 9 aa, Homo Sapiens
LSLALTAFL

SEQ ID NO: 919478 - protein, 9 aa, Homo Sapiens
ESDIILEDY

SEQ ID NO: 919479 - protein, 9 aa, Homo Sapiens
DWEVTAEFQ

SEQ ID NO: 919480 - protein, 9 aa, Homo Sapiens
QAIEVETGK

SEQ ID NO: 919481 - protein, 9 aa, Homo Sapiens
KSLFEGLFF

SEQ ID NO: 919482 - protein, 9 aa, Homo Sapiens
CKLLTCDVP

SEQ ID NO: 919483 - protein, 9 aa, Homo Sapiens
PKPRLGKEL

SEQ ID NO: 919484 - protein, 9 aa, Homo Sapiens
LNMNLAPTF

SEQ ID NO: 919485 - protein, 9 aa, Homo Sapiens
VLTLDYILR

SEQ ID NO: 919486 - protein, 9 aa, Homo Sapiens
FTKKIGSTV

SEQ ID NO: 919487 - protein, 9 aa, Homo Sapiens
EDQTANQGR

SEQ ID NO: 919488 - protein, 9 aa, Homo Sapiens
KDEADHDSD

SEQ ID NO: 919489 - protein, 9 aa, Homo Sapiens
DNEDLDLGP

SEQ ID NO: 919490 - protein, 9 aa, Homo Sapiens
LIFLFYGVM

SEQ ID NO: 919491 - protein, 9 aa, Homo Sapiens
SVELRYSVG

SEQ ID NO: 919492 - protein, 9 aa, Homo Sapiens
RGKNFNFTR

SEQ ID NO: 919493 - protein, 9 aa, Homo Sapiens
SQAIEVETG

SEQ ID NO: 919494 - protein, 9 aa, Homo Sapiens
HRYTLRTLP

SEQ ID NO: 919495 - protein, 9 aa, Homo Sapiens
VMKNFIYES

SEQ ID NO: 919496 - protein, 9 aa, Homo Sapiens
EYRNQFSEI

SEQ ID NO: 919497 - protein, 9 aa, Homo Sapiens
AYKEKRRSE

SEQ ID NO: 919498 - protein, 9 aa, Homo Sapiens
SKFRSLLEK

SEQ ID NO: 919499 - protein, 9 aa, Homo Sapiens
CDLDSLGSY

SEQ ID NO: 919500 - protein, 9 aa, Homo Sapiens
RGLCSVSCG

SEQ ID NO: 919501 - protein, 9 aa, Homo Sapiens
LSPVLSALS

SEQ ID NO: 919502 - protein, 9 aa, Homo Sapiens
GRFSQAIEV

SEQ ID NO: 919503 - protein, 9 aa, Homo Sapiens
QRQEKLEMQ

SEQ ID NO: 919504 - protein, 9 aa, Homo Sapiens
SRSIDRLFM

SEQ ID NO: 919505 - protein, 9 aa, Homo Sapiens
ELKFSHKEK

SEQ ID NO: 919506 - protein, 9 aa, Homo Sapiens
FDFFPMSDK

SEQ ID NO: 919507 - protein, 9 aa, Homo Sapiens
EPRKRLLLT

SEQ ID NO: 919508 - protein, 9 aa, Homo Sapiens
CRIQASSSE

SEQ ID NO: 919509 - protein, 9 aa, Homo Sapiens
VSNTGLYWC

SEQ ID NO: 919510 - protein, 9 aa, Homo Sapiens
ITIPKDRQK

SEQ ID NO: 919511 - protein, 9 aa, Homo Sapiens
MGFLILGLV

SEQ ID NO: 919512 - protein, 9 aa, Homo Sapiens
PEPGQDETV

SEQ ID NO: 919513 - protein, 9 aa, Homo Sapiens
DWDNQVELY

SEQ ID NO: 919514 - protein, 9 aa, Homo Sapiens
QGTSSYSAD

SEQ ID NO: 919515 - protein, 9 aa, Homo Sapiens
LEACLDFIK

SEQ ID NO: 919516 - protein, 9 aa, Homo Sapiens
STNSLALSQ

SEQ ID NO: 919517 - protein, 9 aa, Homo Sapiens
IECKPKVAP

SEQ ID NO: 919518 - protein, 9 aa, Homo Sapiens
FDGWYCDSL

SEQ ID NO: 919519 - protein, 9 aa, Homo Sapiens
HQTQLYKVY

SEQ ID NO: 919520 - protein, 9 aa, Homo Sapiens
PKVALKGSQ

SEQ ID NO: 919521 - protein, 9 aa, Homo Sapiens
RGPQSLPPI

SEQ ID NO: 919522 - protein, 9 aa, Homo Sapiens
SGPTEPLPF

SEQ ID NO: 919523 - protein, 9 aa, Homo Sapiens
VSFRGAPCS

SEQ ID NO: 919524 - protein, 9 aa, Homo Sapiens
LTVKRPTMW

SEQ ID NO: 919525 - protein, 9 aa, Homo Sapiens
LDGLKYEGE

SEQ ID NO: 919526 - protein, 9 aa, Homo Sapiens
VVLELFDRY

SEQ ID NO: 919527 - protein, 9 aa, Homo Sapiens
SQTKFCQSQ

SEQ ID NO: 919528 - protein, 9 aa, Homo Sapiens
KQSGKFSGN

SEQ ID NO: 919529 - protein, 9 aa, Homo Sapiens
FKYPNTACK

SEQ ID NO: 919530 - protein, 9 aa, Homo Sapiens
VKRKRRKPR

SEQ ID NO: 919531 - protein, 9 aa, Homo Sapiens
DGSDAVPQP

SEQ ID NO: 919532 - protein, 9 aa, Homo Sapiens
VFLCEGEKP

SEQ ID NO: 919533 - protein, 9 aa, Homo Sapiens
FKEQKPLEK

SEQ ID NO: 919534 - protein, 9 aa, Homo Sapiens
CEGEKPKSD

SEQ ID NO: 919535 - protein, 9 aa, Homo Sapiens
KRDADLLNV

SEQ ID NO: 919536 - protein, 9 aa, Homo Sapiens
VAINPYPLM

SEQ ID NO: 919537 - protein, 9 aa, Homo Sapiens
HELEDLKIR

SEQ ID NO: 919538 - protein, 9 aa, Homo Sapiens
YGFKSTVPH

SEQ ID NO: 919539 - protein, 9 aa, Homo Sapiens
TSGPFCTDL

SEQ ID NO: 919540 - protein, 9 aa, Homo Sapiens
VSKAKENLE

SEQ ID NO: 919541 - protein, 9 aa, Homo Sapiens
WAAVRGLCS

SEQ ID NO: 919542 - protein, 9 aa, Homo Sapiens
AWPGASSLS

SEQ ID NO: 919543 - protein, 9 aa, Homo Sapiens
KGRGKNFNF

SEQ ID NO: 919544 - protein, 9 aa, Homo Sapiens
LFFLQLLLL

SEQ ID NO: 919545 - protein, 9 aa, Homo Sapiens
SKIPLPGGG

SEQ ID NO: 919546 - protein, 9 aa, Homo Sapiens
VSSGISTAT

SEQ ID NO: 919547 - protein, 9 aa, Homo Sapiens
TCALDEDFT

SEQ ID NO: 919548 - protein, 9 aa, Homo Sapiens
LIFWLPIPA

SEQ ID NO: 919549 - protein, 9 aa, Homo Sapiens
GGPDKDAVE

SEQ ID NO: 919550 - protein, 9 aa, Homo Sapiens
TNSYGAWAE

SEQ ID NO: 919551 - protein, 9 aa, Homo Sapiens
RTNDVLLFI

SEQ ID NO: 919552 - protein, 9 aa, Homo Sapiens
AVQTVASMP

SEQ ID NO: 919553 - protein, 9 aa, Homo Sapiens
VKQADTIDR

SEQ ID NO: 919554 - protein, 9 aa, Homo Sapiens
ELADRSATK

SEQ ID NO: 919555 - protein, 9 aa, Homo Sapiens
SMGALAAIF

SEQ ID NO: 919556 - protein, 9 aa, Homo Sapiens
SFVLGLYGP

SEQ ID NO: 919557 - protein, 9 aa, Homo Sapiens
GVIRSGCGQ

SEQ ID NO: 919558 - protein, 9 aa, Homo Sapiens
SGGPQSRGR

SEQ ID NO: 919559 - protein, 9 aa, Homo Sapiens
SSCHSSFKE

SEQ ID NO: 919560 - protein, 9 aa, Homo Sapiens
PSFFPGLPC

SEQ ID NO: 919561 - protein, 9 aa, Homo Sapiens
SKGEKLEME

SEQ ID NO: 919562 - protein, 9 aa, Homo Sapiens
EEKSVGDED

SEQ ID NO: 919563 - protein, 9 aa, Homo Sapiens
RKKKGLDSD

SEQ ID NO: 919564 - protein, 9 aa, Homo Sapiens
LNLLGNKFS

SEQ ID NO: 919565 - protein, 9 aa, Homo Sapiens
VKTQALSGL

SEQ ID NO: 919566 - protein, 9 aa, Homo Sapiens
VLGLYGPKK

SEQ ID NO: 919567 - protein, 9 aa, Homo Sapiens
LIQKESSED

SEQ ID NO: 919568 - protein, 9 aa, Homo Sapiens
GDKFEKASK

SEQ ID NO: 919569 - protein, 9 aa, Homo Sapiens
LQQKPRKTS

SEQ ID NO: 919570 - protein, 9 aa, Homo Sapiens
GAAPHRVTA

SEQ ID NO: 919571 - protein, 9 aa, Homo Sapiens
PLVPQRLRP

SEQ ID NO: 919572 - protein, 9 aa, Homo Sapiens
IQKESSEDE

SEQ ID NO: 919573 - protein, 9 aa, Homo Sapiens
ELPGLNERP

SEQ ID NO: 919574 - protein, 9 aa, Homo Sapiens
HLFHVVTNF

SEQ ID NO: 919575 - protein, 9 aa, Homo Sapiens
QENDITLFV

SEQ ID NO: 919576 - protein, 9 aa, Homo Sapiens
LRTLPRRAA

SEQ ID NO: 919577 - protein, 9 aa, Homo Sapiens
FCGGPSGLG

SEQ ID NO: 919578 - protein, 9 aa, Homo Sapiens
FAQLLVEAR

SEQ ID NO: 919579 - protein, 9 aa, Homo Sapiens
TSSSFQRLV

SEQ ID NO: 919580 - protein, 9 aa, Homo Sapiens
RSIDRLFMD

SEQ ID NO: 919581 - protein, 9 aa, Homo Sapiens
FSICFSFRV

SEQ ID NO: 919582 - protein, 9 aa, Homo Sapiens
APPSPKDIS

SEQ ID NO: 919583 - protein, 9 aa, Homo Sapiens
TSYFFPWML

SEQ ID NO: 919584 - protein, 9 aa, Homo Sapiens
VTDTNSYGA

SEQ ID NO: 919585 - protein, 9 aa, Homo Sapiens
RKRRKPRKQ

SEQ ID NO: 919586 - protein, 9 aa, Homo Sapiens
KGLDSDVAD

SEQ ID NO: 919587 - protein, 9 aa, Homo Sapiens
HSSNMNKAL

SEQ ID NO: 919588 - protein, 9 aa, Homo Sapiens
SVIARGHIE

SEQ ID NO: 919589 - protein, 9 aa, Homo Sapiens
QLEEQPRGP

SEQ ID NO: 919590 - protein, 9 aa, Homo Sapiens
KIRPRVSYV

SEQ ID NO: 919591 - protein, 9 aa, Homo Sapiens
SALDTEGLS

SEQ ID NO: 919592 - protein, 9 aa, Homo Sapiens
SKLWEEDQL

SEQ ID NO: 919593 - protein, 9 aa, Homo Sapiens
PEIGNIFIV

SEQ ID NO: 919594 - protein, 9 aa, Homo Sapiens
VLTGPLQQS

SEQ ID NO: 919595 - protein, 9 aa, Homo Sapiens
LEIEITCAL

SEQ ID NO: 919596 - protein, 9 aa, Homo Sapiens
GLNERPPRA

SEQ ID NO: 919597 - protein, 9 aa, Homo Sapiens
KVAAMANNG

SEQ ID NO: 919598 - protein, 9 aa, Homo Sapiens
PPLVPQRLR

SEQ ID NO: 919599 - protein, 9 aa, Homo Sapiens
VIYSIRTND

SEQ ID NO: 919600 - protein, 9 aa, Homo Sapiens
KTTLISKGL

SEQ ID NO: 919601 - protein, 9 aa, Homo Sapiens
DCLDFTSSV

SEQ ID NO: 919602 - protein, 9 aa, Homo Sapiens
AEASVCYSS

SEQ ID NO: 919603 - protein, 9 aa, Homo Sapiens
LQRSRLLEN

SEQ ID NO: 919604 - protein, 9 aa, Homo Sapiens
LIKGHQVKT

SEQ ID NO: 919605 - protein, 9 aa, Homo Sapiens
LVAINPYPL

SEQ ID NO: 919606 - protein, 9 aa, Homo Sapiens
SAPFWLWPL

SEQ ID NO: 919607 - protein, 9 aa, Homo Sapiens
IAKVSFRGA

SEQ ID NO: 919608 - protein, 9 aa, Homo Sapiens
GKVSANRTV

SEQ ID NO: 919609 - protein, 9 aa, Homo Sapiens
FKIVLAIGN

SEQ ID NO: 919610 - protein, 9 aa, Homo Sapiens
FRKHPRKAF

SEQ ID NO: 919611 - protein, 9 aa, Homo Sapiens
VNGSLDWDN

SEQ ID NO: 919612 - protein, 9 aa, Homo Sapiens
DHVDCMTSP

SEQ ID NO: 919613 - protein, 9 aa, Homo Sapiens
PGLNERPPR

SEQ ID NO: 919614 - protein, 9 aa, Homo Sapiens
STFIGTEPS

SEQ ID NO: 919615 - protein, 9 aa, Homo Sapiens
PRAWGPDLL

SEQ ID NO: 919616 - protein, 9 aa, Homo Sapiens
KIGSTVKIP

SEQ ID NO: 919617 - protein, 9 aa, Homo Sapiens
RPKILIVGE

SEQ ID NO: 919618 - protein, 9 aa, Homo Sapiens
VLVVHSGSG

SEQ ID NO: 919619 - protein, 9 aa, Homo Sapiens
CCTACESAR

SEQ ID NO: 919620 - protein, 9 aa, Homo Sapiens
PKVAPKPKF

SEQ ID NO: 919621 - protein, 9 aa, Homo Sapiens
GKQSTLSRH

SEQ ID NO: 919622 - protein, 9 aa, Homo Sapiens
ILRRLKREC

SEQ ID NO: 919623 - protein, 9 aa, Homo Sapiens
TEKSRWSGS

SEQ ID NO: 919624 - protein, 9 aa, Homo Sapiens
VVRNLLIVV

SEQ ID NO: 919625 - protein, 9 aa, Homo Sapiens
LCHMHIKSL

SEQ ID NO: 919626 - protein, 9 aa, Homo Sapiens
NYENEEKVS

SEQ ID NO: 919627 - protein, 9 aa, Homo Sapiens
EQSSRWDCN

SEQ ID NO: 919628 - protein, 9 aa, Homo Sapiens
SKGLESNKS

SEQ ID NO: 919629 - protein, 9 aa, Homo Sapiens
SQGYTVEKR

SEQ ID NO: 919630 - protein, 9 aa, Homo Sapiens
AEKQRQEKL

SEQ ID NO: 919631 - protein, 9 aa, Homo Sapiens
AEGHYTVFY

SEQ ID NO: 919632 - protein, 9 aa, Homo Sapiens
SGINYAVDI

SEQ ID NO: 919633 - protein, 9 aa, Homo Sapiens
NGIYGFFVV

SEQ ID NO: 919634 - protein, 9 aa, Homo Sapiens
FFPWMLAYV

SEQ ID NO: 919635 - protein, 9 aa, Homo Sapiens
VLSALSLSE

SEQ ID NO: 919636 - protein, 9 aa, Homo Sapiens
PRKAFILNM

SEQ ID NO: 919637 - protein, 9 aa, Homo Sapiens
DYQAEDTYV

SEQ ID NO: 919638 - protein, 9 aa, Homo Sapiens
NELDTEILR

SEQ ID NO: 919639 - protein, 9 aa, Homo Sapiens
GRGKNFNFT

SEQ ID NO: 919640 - protein, 9 aa, Homo Sapiens
GVTDTNSYG

SEQ ID NO: 919641 - protein, 9 aa, Homo Sapiens
LLGNKFSIG

SEQ ID NO: 919642 - protein, 9 aa, Homo Sapiens
NNPWHPPVV

SEQ ID NO: 919643 - protein, 9 aa, Homo Sapiens
ELDTEILRR

SEQ ID NO: 919644 - protein, 9 aa, Homo Sapiens
DCLYGTVLK

SEQ ID NO: 919645 - protein, 9 aa, Homo Sapiens
ANDRVSLSK

SEQ ID NO: 919646 - protein, 9 aa, Homo Sapiens
SMTVRRGPQ

SEQ ID NO: 919647 - protein, 9 aa, Homo Sapiens
GIFQRCDCA

SEQ ID NO: 919648 - protein, 9 aa, Homo Sapiens
DCNNGKRPH

SEQ ID NO: 919649 - protein, 9 aa, Homo Sapiens
DVKKKIPWI

SEQ ID NO: 919650 - protein, 9 aa, Homo Sapiens
LKAHPKFLK

SEQ ID NO: 919651 - protein, 9 aa, Homo Sapiens
GVSQRLDGL

SEQ ID NO: 919652 - protein, 9 aa, Homo Sapiens
TLRTLPRRA

SEQ ID NO: 919653 - protein, 9 aa, Homo Sapiens
IFIVRIIIM

SEQ ID NO: 919654 - protein, 9 aa, Homo Sapiens
HYFIKKAHS

SEQ ID NO: 919655 - protein, 9 aa, Homo Sapiens
KFLKKFHDN

SEQ ID NO: 919656 - protein, 9 aa, Homo Sapiens
VSPQVVYTA

SEQ ID NO: 919657 - protein, 9 aa, Homo Sapiens
ETPSHGDRP

SEQ ID NO: 919658 - protein, 9 aa, Homo Sapiens
KPQWSLKLA

SEQ ID NO: 919659 - protein, 9 aa, Homo Sapiens
FDQFFATEV

SEQ ID NO: 919660 - protein, 9 aa, Homo Sapiens
DNQVELYRA

SEQ ID NO: 919661 - protein, 9 aa, Homo Sapiens
GGASCQNLE

SEQ ID NO: 919662 - protein, 9 aa, Homo Sapiens
VVAKLREGI

SEQ ID NO: 919663 - protein, 9 aa, Homo Sapiens
SVHRLDLSA

SEQ ID NO: 919664 - protein, 9 aa, Homo Sapiens
SFRPKILIV

SEQ ID NO: 919665 - protein, 9 aa, Homo Sapiens
DATQVEVNL

SEQ ID NO: 919666 - protein, 9 aa, Homo Sapiens
DSSAGKVSA

SEQ ID NO: 919667 - protein, 9 aa, Homo Sapiens
FIGKFGLAL

SEQ ID NO: 919668 - protein, 9 aa, Homo Sapiens
INNTINPAC

SEQ ID NO: 919669 - protein, 9 aa, Homo Sapiens
QLINFTKKI

SEQ ID NO: 919670 - protein, 9 aa, Homo Sapiens
GFCQLVVVA

SEQ ID NO: 919671 - protein, 9 aa, Homo Sapiens
DRYKSNFAQ

SEQ ID NO: 919672 - protein, 9 aa, Homo Sapiens
NPWHPPVVF

SEQ ID NO: 919673 - protein, 9 aa, Homo Sapiens
PQGQQGLAI

SEQ ID NO: 919674 - protein, 9 aa, Homo Sapiens
YVEHVKEET

SEQ ID NO: 919675 - protein, 9 aa, Homo Sapiens
QILKWRYKE

SEQ ID NO: 919676 - protein, 9 aa, Homo Sapiens
DIQKLKVMK

SEQ ID NO: 919677 - protein, 9 aa, Homo Sapiens
KMDVQVRRV

SEQ ID NO: 919678 - protein, 9 aa, Homo Sapiens
DGWGSYGSD

SEQ ID NO: 919679 - protein, 9 aa, Homo Sapiens
PSSSSGSSS

SEQ ID NO: 919680 - protein, 9 aa, Homo Sapiens
TSGWGSSAG

SEQ ID NO: 919681 - protein, 9 aa, Homo Sapiens
QKLYECAIC

SEQ ID NO: 919682 - protein, 9 aa, Homo Sapiens
KLLTCDVPQ

SEQ ID NO: 919683 - protein, 9 aa, Homo Sapiens
LTDVKKKIP

SEQ ID NO: 919684 - protein, 9 aa, Homo Sapiens
KQSTLSRHW

SEQ ID NO: 919685 - protein, 9 aa, Homo Sapiens
VPLTRRRSS

SEQ ID NO: 919686 - protein, 9 aa, Homo Sapiens
LINFTKKIG

SEQ ID NO: 919687 - protein, 9 aa, Homo Sapiens
LKDIFDEFK

SEQ ID NO: 919688 - protein, 9 aa, Homo Sapiens
MHIKSLMDF

SEQ ID NO: 919689 - protein, 9 aa, Homo Sapiens
FDNIAKYFS

SEQ ID NO: 919690 - protein, 9 aa, Homo Sapiens
FGARLSPES

SEQ ID NO: 919691 - protein, 9 aa, Homo Sapiens
LAAIFAYWF

SEQ ID NO: 919692 - protein, 9 aa, Homo Sapiens
KDALNLIKA

SEQ ID NO: 919693 - protein, 9 aa, Homo Sapiens
SCFLSADGM

SEQ ID NO: 919694 - protein, 9 aa, Homo Sapiens
GHYTVFYGT

SEQ ID NO: 919695 - protein, 9 aa, Homo Sapiens
GCNECALGA

SEQ ID NO: 919696 - protein, 9 aa, Homo Sapiens
YNITITVTN

SEQ ID NO: 919697 - protein, 9 aa, Homo Sapiens
PAPFDSSWV

SEQ ID NO: 919698 - protein, 9 aa, Homo Sapiens
EEQPRGPPQ

SEQ ID NO: 919699 - protein, 9 aa, Homo Sapiens
QPVYTTLSQ

SEQ ID NO: 919700 - protein, 9 aa, Homo Sapiens
AIKSAMSTI

SEQ ID NO: 919701 - protein, 9 aa, Homo Sapiens
DHYFIKKAH

SEQ ID NO: 919702 - protein, 9 aa, Homo Sapiens
SFFEISFTN

SEQ ID NO: 919703 - protein, 9 aa, Homo Sapiens
FSQLTSVFR

SEQ ID NO: 919704 - protein, 9 aa, Homo Sapiens
VRGLCSVSC

SEQ ID NO: 919705 - protein, 9 aa, Homo Sapiens
LMDFEWLKQ

SEQ ID NO: 919706 - protein, 9 aa, Homo Sapiens
RKRLLLTAA

SEQ ID NO: 919707 - protein, 9 aa, Homo Sapiens
FDNMGPYTV

SEQ ID NO: 919708 - protein, 9 aa, Homo Sapiens
VHRLDLSAL

SEQ ID NO: 919709 - protein, 9 aa, Homo Sapiens
KSLEIEITC

SEQ ID NO: 919710 - protein, 9 aa, Homo Sapiens
GLAIFTSES

SEQ ID NO: 919711 - protein, 9 aa, Homo Sapiens
KRLLLTAAH

SEQ ID NO: 919712 - protein, 9 aa, Homo Sapiens
LDGSYRVTF

SEQ ID NO: 919713 - protein, 9 aa, Homo Sapiens
SVECKEKLW

SEQ ID NO: 919714 - protein, 9 aa, Homo Sapiens
FRHVISAKV

SEQ ID NO: 919715 - protein, 9 aa, Homo Sapiens
KELASKKKV

SEQ ID NO: 919716 - protein, 9 aa, Homo Sapiens
KHGGFSKLP

SEQ ID NO: 919717 - protein, 9 aa, Homo Sapiens
VLVSFVLSL

SEQ ID NO: 919718 - protein, 9 aa, Homo Sapiens
EPVEKIEIP

SEQ ID NO: 919719 - protein, 9 aa, Homo Sapiens
NVESKHFED

SEQ ID NO: 919720 - protein, 9 aa, Homo Sapiens
NEVALHAAR

SEQ ID NO: 919721 - protein, 9 aa, Homo Sapiens
KPRLGKELQ

SEQ ID NO: 919722 - protein, 9 aa, Homo Sapiens
QGRLEVQKR

SEQ ID NO: 919723 - protein, 9 aa, Homo Sapiens
LLENTGQTV

SEQ ID NO: 919724 - protein, 9 aa, Homo Sapiens
VVGTHFWRD

SEQ ID NO: 919725 - protein, 9 aa, Homo Sapiens
MLNMNLAPT

SEQ ID NO: 919726 - protein, 9 aa, Homo Sapiens
LSALELIIC

SEQ ID NO: 919727 - protein, 9 aa, Homo Sapiens
INFTKKIGS

SEQ ID NO: 919728 - protein, 9 aa, Homo Sapiens
LLSGTFRVE

SEQ ID NO: 919729 - protein, 9 aa, Homo Sapiens
RQKRKKSLR

SEQ ID NO: 919730 - protein, 9 aa, Homo Sapiens
TIDRYYYEN

SEQ ID NO: 919731 - protein, 9 aa, Homo Sapiens
EKRPAPFDS

SEQ ID NO: 919732 - protein, 9 aa, Homo Sapiens
ENLYSATKI

SEQ ID NO: 919733 - protein, 9 aa, Homo Sapiens
IEPVEKIEI

SEQ ID NO: 919734 - protein, 9 aa, Homo Sapiens
FLKQSGKFS

SEQ ID NO: 919735 - protein, 9 aa, Homo Sapiens
HSSFIEDLA

SEQ ID NO: 919736 - protein, 9 aa, Homo Sapiens
MEEGDKFEK

SEQ ID NO: 919737 - protein, 9 aa, Homo Sapiens
LGQENDITL

SEQ ID NO: 919738 - protein, 9 aa, Homo Sapiens
EKPKSDLKA

SEQ ID NO: 919739 - protein, 9 aa, Homo Sapiens
SMDLLPNVF

SEQ ID NO: 919740 - protein, 9 aa, Homo Sapiens
NMVLSPCTL

SEQ ID NO: 919741 - protein, 9 aa, Homo Sapiens
SPSAESVAD

SEQ ID NO: 919742 - protein, 9 aa, Homo Sapiens
NFTRSSNME

SEQ ID NO: 919743 - protein, 9 aa, Homo Sapiens
KIESTMPLC

SEQ ID NO: 919744 - protein, 9 aa, Homo Sapiens
DTSVELRYS

SEQ ID NO: 919745 - protein, 9 aa, Homo Sapiens
YINNTINPA

SEQ ID NO: 919746 - protein, 9 aa, Homo Sapiens
QPMSFRPKI

SEQ ID NO: 919747 - protein, 9 aa, Homo Sapiens
DEFKADLSG

SEQ ID NO: 919748 - protein, 9 aa, Homo Sapiens
MLTAGKGVA

SEQ ID NO: 919749 - protein, 9 aa, Homo Sapiens
LELRKQVAK

SEQ ID NO: 919750 - protein, 9 aa, Homo Sapiens
LHDSSCICE

SEQ ID NO: 919751 - protein, 9 aa, Homo Sapiens
KVAPKPKFS

SEQ ID NO: 919752 - protein, 9 aa, Homo Sapiens
NEVHEVVVK

SEQ ID NO: 919753 - protein, 9 aa, Homo Sapiens
SLEIEITCA

SEQ ID NO: 919754 - protein, 9 aa, Homo Sapiens
QTLTDFILL

SEQ ID NO: 919755 - protein, 9 aa, Homo Sapiens
GNPGSARCA

SEQ ID NO: 919756 - protein, 9 aa, Homo Sapiens
LLEKTNLGH

SEQ ID NO: 919757 - protein, 9 aa, Homo Sapiens
NSNGREAKM

SEQ ID NO: 919758 - protein, 9 aa, Homo Sapiens
CTSSPPRHL

SEQ ID NO: 919759 - protein, 9 aa, Homo Sapiens
DTNSYGAWA

SEQ ID NO: 919760 - protein, 9 aa, Homo Sapiens
CIMNATGNS

SEQ ID NO: 919761 - protein, 9 aa, Homo Sapiens
PLTRRRSSP

SEQ ID NO: 919762 - protein, 9 aa, Homo Sapiens
FSEILRRAA

SEQ ID NO: 919763 - protein, 9 aa, Homo Sapiens
KEDSEWQAF

SEQ ID NO: 919764 - protein, 9 aa, Homo Sapiens
WGSSQHILS

SEQ ID NO: 919765 - protein, 9 aa, Homo Sapiens
IQASSSEAK

SEQ ID NO: 919766 - protein, 9 aa, Homo Sapiens
AQLSSPAAA

SEQ ID NO: 919767 - protein, 9 aa, Homo Sapiens
FGKQSTLSR

SEQ ID NO: 919768 - protein, 9 aa, Homo Sapiens
TSSSLSKSF

SEQ ID NO: 919769 - protein, 9 aa, Homo Sapiens
QLYKVYKLD

SEQ ID NO: 919770 - protein, 9 aa, Homo Sapiens
QARILYSEQ

SEQ ID NO: 919771 - protein, 9 aa, Homo Sapiens
LQGTSSYSA

SEQ ID NO: 919772 - protein, 9 aa, Homo Sapiens
EDLDLGPVE

SEQ ID NO: 919773 - protein, 9 aa, Homo Sapiens
PELLAKIES

SEQ ID NO: 919774 - protein, 9 aa, Homo Sapiens
EPFSQLTSV

SEQ ID NO: 919775 - protein, 9 aa, Homo Sapiens
LPPELLAKI

SEQ ID NO: 919776 - protein, 9 aa, Homo Sapiens
NEELIQKES

SEQ ID NO: 919777 - protein, 9 aa, Homo Sapiens
RMYSKIIAL

SEQ ID NO: 919778 - protein, 9 aa, Homo Sapiens
DDENGCPIP

SEQ ID NO: 919779 - protein, 9 aa, Homo Sapiens
KLLMGVLTP

SEQ ID NO: 919780 - protein, 9 aa, Homo Sapiens
IFLFYGVMT

SEQ ID NO: 919781 - protein, 9 aa, Homo Sapiens
ASAPGCCPP

SEQ ID NO: 919782 - protein, 9 aa, Homo Sapiens
LEVQKRELQ

SEQ ID NO: 919783 - protein, 9 aa, Homo Sapiens
CHSSFKEQK

SEQ ID NO: 919784 - protein, 9 aa, Homo Sapiens
PFRHVISAK

SEQ ID NO: 919785 - protein, 9 aa, Homo Sapiens
ADMEAEAST

SEQ ID NO: 919786 - protein, 9 aa, Homo Sapiens
VLQKLLMGV

SEQ ID NO: 919787 - protein, 9 aa, Homo Sapiens
GDWEVTAEF

SEQ ID NO: 919788 - protein, 9 aa, Homo Sapiens
LHTGQKLYE

SEQ ID NO: 919789 - protein, 9 aa, Homo Sapiens
IFKREPSEG

SEQ ID NO: 919790 - protein, 9 aa, Homo Sapiens
WKPTRWGWN

SEQ ID NO: 919791 - protein, 9 aa, Homo Sapiens
LPINFKDNH

SEQ ID NO: 919792 - protein, 9 aa, Homo Sapiens
TSSYSADTP

SEQ ID NO: 919793 - protein, 9 aa, Homo Sapiens
LSQSSIALP

SEQ ID NO: 919794 - protein, 9 aa, Homo Sapiens
EGMDGFADW

SEQ ID NO: 919795 - protein, 9 aa, Homo Sapiens
LSLSEARFP

SEQ ID NO: 919796 - protein, 9 aa, Homo Sapiens
NDDYFFAAG

SEQ ID NO: 919797 - protein, 9 aa, Homo Sapiens
PGQDISLPE

SEQ ID NO: 919798 - protein, 9 aa, Homo Sapiens
PQLHDSSCI

SEQ ID NO: 919799 - protein, 9 aa, Homo Sapiens
FTRSSNMET

SEQ ID NO: 919800 - protein, 9 aa, Homo Sapiens
SPAQPDDCI

SEQ ID NO: 919801 - protein, 9 aa, Homo Sapiens
LQTKNSFKV

SEQ ID NO: 919802 - protein, 9 aa, Homo Sapiens
SAESVADRL

SEQ ID NO: 919803 - protein, 9 aa, Homo Sapiens
LTYLVTVVR

SEQ ID NO: 919804 - protein, 9 aa, Homo Sapiens
KCCKGGPDK

SEQ ID NO: 919805 - protein, 9 aa, Homo Sapiens
AINSKYTLS

SEQ ID NO: 919806 - protein, 9 aa, Homo Sapiens
QVKTQALSG

SEQ ID NO: 919807 - protein, 9 aa, Homo Sapiens
RASVAQAEV

SEQ ID NO: 919808 - protein, 9 aa, Homo Sapiens
PSVHVCALK

SEQ ID NO: 919809 - protein, 9 aa, Homo Sapiens
DTEILRRLK

SEQ ID NO: 919810 - protein, 9 aa, Homo Sapiens
HSVKRKRRK

SEQ ID NO: 919811 - protein, 9 aa, Homo Sapiens
IVLLLFDAS

SEQ ID NO: 919812 - protein, 9 aa, Homo Sapiens
PCPGGAGTL

SEQ ID NO: 919813 - protein, 9 aa, Homo Sapiens
KVFEFIGKF

SEQ ID NO: 919814 - protein, 9 aa, Homo Sapiens
SKMLFGELM

SEQ ID NO: 919815 - protein, 9 aa, Homo Sapiens
WYCDSLENL

SEQ ID NO: 919816 - protein, 9 aa, Homo Sapiens
CHHSSNMNK

SEQ ID NO: 919817 - protein, 9 aa, Homo Sapiens
IENLYSATK

SEQ ID NO: 919818 - protein, 9 aa, Homo Sapiens
ILCPTKMDV

SEQ ID NO: 919819 - protein, 9 aa, Homo Sapiens
CPAIIFSSE

SEQ ID NO: 919820 - protein, 9 aa, Homo Sapiens
AAIYRISLE

SEQ ID NO: 919821 - protein, 9 aa, Homo Sapiens
RRVSLGINI

SEQ ID NO: 919822 - protein, 9 aa, Homo Sapiens
PRKRLLLTA

SEQ ID NO: 919823 - protein, 9 aa, Homo Sapiens
KFCQSQPSQ

SEQ ID NO: 919824 - protein, 9 aa, Homo Sapiens
GTVLKLKEL

SEQ ID NO: 919825 - protein, 9 aa, Homo Sapiens
SGFGVSQRL

SEQ ID NO: 919826 - protein, 9 aa, Homo Sapiens
GLLIMGFLI

SEQ ID NO: 919827 - protein, 9 aa, Homo Sapiens
PRPPPPRLG

SEQ ID NO: 919828 - protein, 9 aa, Homo Sapiens
CFLSADGML

SEQ ID NO: 919829 - protein, 9 aa, Homo Sapiens
SHCPRHCPP

SEQ ID NO: 919830 - protein, 9 aa, Homo Sapiens
EASVCYSSP

SEQ ID NO: 919831 - protein, 9 aa, Homo Sapiens
KKKVEKIQI

SEQ ID NO: 919832 - protein, 9 aa, Homo Sapiens
RTSIKDALN

SEQ ID NO: 919833 - protein, 9 aa, Homo Sapiens
DALINSWAS

SEQ ID NO: 919834 - protein, 9 aa, Homo Sapiens
FENTYLEAC

SEQ ID NO: 919835 - protein, 9 aa, Homo Sapiens
SCLSFFFFF

SEQ ID NO: 919836 - protein, 9 aa, Homo Sapiens
DDCIDEAEA

SEQ ID NO: 919837 - protein, 9 aa, Homo Sapiens
CFPFGFVPD

SEQ ID NO: 919838 - protein, 9 aa, Homo Sapiens
VQKKKHTPR

SEQ ID NO: 919839 - protein, 9 aa, Homo Sapiens
EGDKFEKAS

SEQ ID NO: 919840 - protein, 9 aa, Homo Sapiens
ISTATNSES

SEQ ID NO: 919841 - protein, 9 aa, Homo Sapiens
FIILCRTLS

SEQ ID NO: 919842 - protein, 9 aa, Homo Sapiens
AKSEIFNED

SEQ ID NO: 919843 - protein, 9 aa, Homo Sapiens
KKGLDSDVA

SEQ ID NO: 919844 - protein, 9 aa, Homo Sapiens
KGIPDGACS

SEQ ID NO: 919845 - protein, 9 aa, Homo Sapiens
IEDQTANQG

SEQ ID NO: 919846 - protein, 9 aa, Homo Sapiens
LLLVFLRAR

SEQ ID NO: 919847 - protein, 9 aa, Homo Sapiens
KKKVKGSPS

SEQ ID NO: 919848 - protein, 9 aa, Homo Sapiens
TVASMPEDS

SEQ ID NO: 919849 - protein, 9 aa, Homo Sapiens
FLQHALYLL

SEQ ID NO: 919850 - protein, 9 aa, Homo Sapiens
ENGCPIPPT

SEQ ID NO: 919851 - protein, 9 aa, Homo Sapiens
GSHGLGIFQ

SEQ ID NO: 919852 - protein, 9 aa, Homo Sapiens
GRSAPFWLW

SEQ ID NO: 919853 - protein, 9 aa, Homo Sapiens
GAAAWEKEL

SEQ ID NO: 919854 - protein, 9 aa, Homo Sapiens
EKRRSEAPP

SEQ ID NO: 919855 - protein, 9 aa, Homo Sapiens
KSVGDEDIY

SEQ ID NO: 919856 - protein, 9 aa, Homo Sapiens
VPFRHVISA

SEQ ID NO: 919857 - protein, 9 aa, Homo Sapiens
TYVLVVHSG

SEQ ID NO: 919858 - protein, 9 aa, Homo Sapiens
AINPYPLML

SEQ ID NO: 919859 - protein, 9 aa, Homo Sapiens
YGTVLKLKE

SEQ ID NO: 919860 - protein, 9 aa, Homo Sapiens
KKKGLDSDV

SEQ ID NO: 919861 - protein, 9 aa, Homo Sapiens
KRKRKIATR

SEQ ID NO: 919862 - protein, 9 aa, Homo Sapiens
LSPCTLIVA

SEQ ID NO: 919863 - protein, 9 aa, Homo Sapiens
GFDLVRTAS

SEQ ID NO: 919864 - protein, 9 aa, Homo Sapiens
MGPYTVGMG

SEQ ID NO: 919865 - protein, 9 aa, Homo Sapiens
EGLFFLQLL

SEQ ID NO: 919866 - protein, 9 aa, Homo Sapiens
PMTEEFKIV

SEQ ID NO: 919867 - protein, 9 aa, Homo Sapiens
REVLQKLLM

SEQ ID NO: 919868 - protein, 9 aa, Homo Sapiens
PINFKDNHG

SEQ ID NO: 919869 - protein, 9 aa, Homo Sapiens
LEMETDAVQ

SEQ ID NO: 919870 - protein, 9 aa, Homo Sapiens
PLSALDTEG

SEQ ID NO: 919871 - protein, 9 aa, Homo Sapiens
YLRFWARRI

SEQ ID NO: 919872 - protein, 9 aa, Homo Sapiens
GLVALNWVV

SEQ ID NO: 919873 - protein, 9 aa, Homo Sapiens
TNLGTPRLK

SEQ ID NO: 919874 - protein, 9 aa, Homo Sapiens
LATEKSRWS

SEQ ID NO: 919875 - protein, 9 aa, Homo Sapiens
KKVGEEVIS

SEQ ID NO: 919876 - protein, 9 aa, Homo Sapiens
WSLKLARKG

SEQ ID NO: 919877 - protein, 9 aa, Homo Sapiens
FKREPSEGC

SEQ ID NO: 919878 - protein, 9 aa, Homo Sapiens
VDCLYGTVL

SEQ ID NO: 919879 - protein, 9 aa, Homo Sapiens
TTTIDASFI

SEQ ID NO: 919880 - protein, 9 aa, Homo Sapiens
HVKEETKKA

SEQ ID NO: 919881 - protein, 9 aa, Homo Sapiens
CTSKSTGQE

SEQ ID NO: 919882 - protein, 9 aa, Homo Sapiens
EIFNEDVEW

SEQ ID NO: 919883 - protein, 9 aa, Homo Sapiens
QGAAPHRVT

SEQ ID NO: 919884 - protein, 9 aa, Homo Sapiens
TNKMAPALL

SEQ ID NO: 919885 - protein, 9 aa, Homo Sapiens
AAAWEKELV

SEQ ID NO: 919886 - protein, 9 aa, Homo Sapiens
IMNATGNSY

SEQ ID NO: 919887 - protein, 9 aa, Homo Sapiens
KASIILGQE

SEQ ID NO: 919888 - protein, 9 aa, Homo Sapiens
TATQAIQIF

SEQ ID NO: 919889 - protein, 9 aa, Homo Sapiens
LSGNPLSAL

SEQ ID NO: 919890 - protein, 9 aa, Homo Sapiens
SIEDAISIT

SEQ ID NO: 919891 - protein, 9 aa, Homo Sapiens
IRINGIYGF

SEQ ID NO: 919892 - protein, 9 aa, Homo Sapiens
ASLYIRSTF

SEQ ID NO: 919893 - protein, 9 aa, Homo Sapiens
NKMAPALLK

SEQ ID NO: 919894 - protein, 9 aa, Homo Sapiens
RNQFSEILR

SEQ ID NO: 919895 - protein, 9 aa, Homo Sapiens
GRPFGCNEC

SEQ ID NO: 919896 - protein, 9 aa, Homo Sapiens
LKPGSLGGS

SEQ ID NO: 919897 - protein, 9 aa, Homo Sapiens
GVWKKLIST

SEQ ID NO: 919898 - protein, 9 aa, Homo Sapiens
RLLENTGQT

SEQ ID NO: 919899 - protein, 9 aa, Homo Sapiens
KFCCFPFGF

SEQ ID NO: 919900 - protein, 9 aa, Homo Sapiens
AHPKFLKKF

SEQ ID NO: 919901 - protein, 9 aa, Homo Sapiens
ERVELRGIE

SEQ ID NO: 919902 - protein, 9 aa, Homo Sapiens
KKIKEKLEG

SEQ ID NO: 919903 - protein, 9 aa, Homo Sapiens
ATQVEVNLF

SEQ ID NO: 919904 - protein, 9 aa, Homo Sapiens
VLKLKELHV

SEQ ID NO: 919905 - protein, 9 aa, Homo Sapiens
IVILLNKET

SEQ ID NO: 919906 - protein, 9 aa, Homo Sapiens
ESVADRLDP

SEQ ID NO: 919907 - protein, 9 aa, Homo Sapiens
GLKDIFDEF

SEQ ID NO: 919908 - protein, 9 aa, Homo Sapiens
GEKPKSDLK

SEQ ID NO: 919909 - protein, 9 aa, Homo Sapiens
TNSLALSQS

SEQ ID NO: 919910 - protein, 9 aa, Homo Sapiens
KIPWIQQKS

SEQ ID NO: 919911 - protein, 9 aa, Homo Sapiens
GQFLYSEER

SEQ ID NO: 919912 - protein, 9 aa, Homo Sapiens
PPPRLGMHS

SEQ ID NO: 919913 - protein, 9 aa, Homo Sapiens
KAAVPSPQS

SEQ ID NO: 919914 - protein, 9 aa, Homo Sapiens
ISMDLLPNV

SEQ ID NO: 919915 - protein, 9 aa, Homo Sapiens
KIALQPGPL

SEQ ID NO: 919916 - protein, 9 aa, Homo Sapiens
LTAGKGVAE

SEQ ID NO: 919917 - protein, 9 aa, Homo Sapiens
YWCMAANTA

SEQ ID NO: 919918 - protein, 9 aa, Homo Sapiens
QITIPKDRQ

SEQ ID NO: 919919 - protein, 9 aa, Homo Sapiens
SVKRKRRKP

SEQ ID NO: 919920 - protein, 9 aa, Homo Sapiens
VWNFSQVLE

SEQ ID NO: 919921 - protein, 9 aa, Homo Sapiens
VAGQVMCLI

SEQ ID NO: 919922 - protein, 9 aa, Homo Sapiens
AVDIPELGV

SEQ ID NO: 919923 - protein, 9 aa, Homo Sapiens
HIPGPGSTE

SEQ ID NO: 919924 - protein, 9 aa, Homo Sapiens
PAEASVCYS

SEQ ID NO: 919925 - protein, 9 aa, Homo Sapiens
SANDRVSLS

SEQ ID NO: 919926 - protein, 9 aa, Homo Sapiens
IMGFLILGL

SEQ ID NO: 919927 - protein, 9 aa, Homo Sapiens
MLVAINPYP

SEQ ID NO: 919928 - protein, 9 aa, Homo Sapiens
KKEMGLVLS

SEQ ID NO: 919929 - protein, 9 aa, Homo Sapiens
SNMQIYGFK

SEQ ID NO: 919930 - protein, 9 aa, Homo Sapiens
AFPRLWDIK

SEQ ID NO: 919931 - protein, 9 aa, Homo Sapiens
SICFSFRVV

SEQ ID NO: 919932 - protein, 9 aa, Homo Sapiens
GAGTLLSGT

SEQ ID NO: 919933 - protein, 9 aa, Homo Sapiens
LSALDTEGL

SEQ ID NO: 919934 - protein, 9 aa, Homo Sapiens
TTIDASFIG

SEQ ID NO: 919935 - protein, 9 aa, Homo Sapiens
DLSALYSVS

SEQ ID NO: 919936 - protein, 9 aa, Homo Sapiens
ECKPKVAPK

SEQ ID NO: 919937 - protein, 9 aa, Homo Sapiens
EHQTQLYKV

SEQ ID NO: 919938 - protein, 9 aa, Homo Sapiens
KLEMQLEEE

SEQ ID NO: 919939 - protein, 9 aa, Homo Sapiens
GAWAERISD

SEQ ID NO: 919940 - protein, 9 aa, Homo Sapiens
GPYLRFWAR

SEQ ID NO: 919941 - protein, 9 aa, Homo Sapiens
ERYGKELMQ

SEQ ID NO: 919942 - protein, 9 aa, Homo Sapiens
WGSYGSDKR

SEQ ID NO: 919943 - protein, 9 aa, Homo Sapiens
NSFKVLFRK

SEQ ID NO: 919944 - protein, 9 aa, Homo Sapiens
ENKGIPDGA

SEQ ID NO: 919945 - protein, 9 aa, Homo Sapiens
LDAFCHHSS

SEQ ID NO: 919946 - protein, 9 aa, Homo Sapiens
NALPAPPVF

SEQ ID NO: 919947 - protein, 9 aa, Homo Sapiens
ILEDYDERG

SEQ ID NO: 919948 - protein, 9 aa, Homo Sapiens
KGGPDKDAV

SEQ ID NO: 919949 - protein, 9 aa, Homo Sapiens
KLWEEDQLA

SEQ ID NO: 919950 - protein, 9 aa, Homo Sapiens
EAAPAEASV

SEQ ID NO: 919951 - protein, 9 aa, Homo Sapiens
KDIFDEFKA

SEQ ID NO: 919952 - protein, 9 aa, Homo Sapiens
PKLDFLTLS

SEQ ID NO: 919953 - protein, 9 aa, Homo Sapiens
GRLEVQKRE

SEQ ID NO: 919954 - protein, 9 aa, Homo Sapiens
SDIILEDYD

SEQ ID NO: 919955 - protein, 9 aa, Homo Sapiens
RAEFCGGPS

SEQ ID NO: 919956 - protein, 9 aa, Homo Sapiens
WDCNNGKRP

SEQ ID NO: 919957 - protein, 9 aa, Homo Sapiens
CSCDLDSLG

SEQ ID NO: 919958 - protein, 9 aa, Homo Sapiens
KSNFAQLLV

SEQ ID NO: 919959 - protein, 9 aa, Homo Sapiens
LPAASTSYF

SEQ ID NO: 919960 - protein, 9 aa, Homo Sapiens
FAYWFTHRP

SEQ ID NO: 919961 - protein, 9 aa, Homo Sapiens
RLAVRKAIH

SEQ ID NO: 919962 - protein, 9 aa, Homo Sapiens
LPGGGCVTW

SEQ ID NO: 919963 - protein, 9 aa, Homo Sapiens
KEVMAAYKE

SEQ ID NO: 919964 - protein, 9 aa, Homo Sapiens
RRAEFCGGP

SEQ ID NO: 919965 - protein, 9 aa, Homo Sapiens
PAGLRTLLL

SEQ ID NO: 919966 - protein, 9 aa, Homo Sapiens
DHSVKRKRR

SEQ ID NO: 919967 - protein, 9 aa, Homo Sapiens
VSEGMDGFA

SEQ ID NO: 919968 - protein, 9 aa, Homo Sapiens
STLVQRQLV

SEQ ID NO: 919969 - protein, 9 aa, Homo Sapiens
HVVTNFNDN

SEQ ID NO: 919970 - protein, 9 aa, Homo Sapiens
SNTEAPGDN

SEQ ID NO: 919971 - protein, 9 aa, Homo Sapiens
NVCAENKGI

SEQ ID NO: 919972 - protein, 9 aa, Homo Sapiens
QMAHKKIKE

SEQ ID NO: 919973 - protein, 9 aa, Homo Sapiens
LGMHSPPPR

SEQ ID NO: 919974 - protein, 9 aa, Homo Sapiens
ASTFQALED

SEQ ID NO: 919975 - protein, 9 aa, Homo Sapiens
NFNDNLISN

SEQ ID NO: 919976 - protein, 9 aa, Homo Sapiens
ALQMAQEMK

SEQ ID NO: 919977 - protein, 9 aa, Homo Sapiens
SCHSSFKEQ

SEQ ID NO: 919978 - protein, 9 aa, Homo Sapiens
RGHIEPDPT

SEQ ID NO: 919979 - protein, 9 aa, Homo Sapiens
HFRSPGQDI

SEQ ID NO: 919980 - protein, 9 aa, Homo Sapiens
EQKGRVAIA

SEQ ID NO: 919981 - protein, 9 aa, Homo Sapiens
ALGQENDIT

SEQ ID NO: 919982 - protein, 9 aa, Homo Sapiens
DESTYVLVV

SEQ ID NO: 919983 - protein, 9 aa, Homo Sapiens
ITATQAIQI

SEQ ID NO: 919984 - protein, 9 aa, Homo Sapiens
ILLEETPSH

SEQ ID NO: 919985 - protein, 9 aa, Homo Sapiens
HCPRHCPPW

SEQ ID NO: 919986 - protein, 9 aa, Homo Sapiens
RSPGQDISL

SEQ ID NO: 919987 - protein, 9 aa, Homo Sapiens
IMLHKLIKL

SEQ ID NO: 919988 - protein, 9 aa, Homo Sapiens
LSAAVDPDV

SEQ ID NO: 919989 - protein, 9 aa, Homo Sapiens
SSFKEQKPL

SEQ ID NO: 919990 - protein, 9 aa, Homo Sapiens
DSGGLLVCG

SEQ ID NO: 919991 - protein, 9 aa, Homo Sapiens
VADFDFFPM

SEQ ID NO: 919992 - protein, 9 aa, Homo Sapiens
GKFSGNPWP

SEQ ID NO: 919993 - protein, 9 aa, Homo Sapiens
ADVEQRGDC

SEQ ID NO: 919994 - protein, 9 aa, Homo Sapiens
RKAFILNMP

SEQ ID NO: 919995 - protein, 9 aa, Homo Sapiens
KSLMDFEWL

SEQ ID NO: 919996 - protein, 9 aa, Homo Sapiens
TSVELRYSV

SEQ ID NO: 919997 - protein, 9 aa, Homo Sapiens
DSAPEKPGK

SEQ ID NO: 919998 - protein, 9 aa, Homo Sapiens
RSVECKEKL

SEQ ID NO: 919999 - protein, 9 aa, Homo Sapiens
ESVDSSKEK

SEQ ID NO: 920000 - protein, 9 aa, Homo Sapiens
DYVEHVKEE

SEQ ID NO: 920001 - protein, 9 aa, Homo Sapiens
ECLEKFSVI

SEQ ID NO: 920002 - protein, 9 aa, Homo Sapiens
VSFVLSLAL

SEQ ID NO: 920003 - protein, 9 aa, Homo Sapiens
MQIARKAGG

SEQ ID NO: 920004 - protein, 9 aa, Homo Sapiens
ESTYVLVVH

SEQ ID NO: 920005 - protein, 9 aa, Homo Sapiens
SANRTVDYE

SEQ ID NO: 920006 - protein, 9 aa, Homo Sapiens
LFHVVTNFN

SEQ ID NO: 920007 - protein, 9 aa, Homo Sapiens
TPVFFNIEA

SEQ ID NO: 920008 - protein, 9 aa, Homo Sapiens
SSCICERVA

SEQ ID NO: 920009 - protein, 9 aa, Homo Sapiens
AKTKKLATS

SEQ ID NO: 920010 - protein, 9 aa, Homo Sapiens
GSDAVPQPG

SEQ ID NO: 920011 - protein, 9 aa, Homo Sapiens
RPAPFDSSW

SEQ ID NO: 920012 - protein, 9 aa, Homo Sapiens
KVSFRGAPC

SEQ ID NO: 920013 - protein, 9 aa, Homo Sapiens
PSCPAIIFS

SEQ ID NO: 920014 - protein, 9 aa, Homo Sapiens
PGQDETVRV

SEQ ID NO: 920015 - protein, 9 aa, Homo Sapiens
VVRQCTSKS

SEQ ID NO: 920016 - protein, 9 aa, Homo Sapiens
PRKTSEKQS

SEQ ID NO: 920017 - protein, 9 aa, Homo Sapiens
CHMHIKSLM

SEQ ID NO: 920018 - protein, 9 aa, Homo Sapiens
LAVRKAIHA

SEQ ID NO: 920019 - protein, 9 aa, Homo Sapiens
RYGKELMQI

SEQ ID NO: 920020 - protein, 9 aa, Homo Sapiens
AIIFSSEKL

SEQ ID NO: 920021 - protein, 9 aa, Homo Sapiens
LSALYSVSA

SEQ ID NO: 920022 - protein, 9 aa, Homo Sapiens
KCTHSSFIE

SEQ ID NO: 920023 - protein, 9 aa, Homo Sapiens
EVNLFGETP

SEQ ID NO: 920024 - protein, 9 aa, Homo Sapiens
ALNLIKAVH

SEQ ID NO: 920025 - protein, 9 aa, Homo Sapiens
KQVADFQGN

SEQ ID NO: 920026 - protein, 9 aa, Homo Sapiens
QTVASMPED

SEQ ID NO: 920027 - protein, 9 aa, Homo Sapiens
PYADYGGFQ

SEQ ID NO: 920028 - protein, 9 aa, Homo Sapiens
ERKYPPMDS

SEQ ID NO: 920029 - protein, 9 aa, Homo Sapiens
LKLARKGTG

SEQ ID NO: 920030 - protein, 9 aa, Homo Sapiens
LSPESGGPE

SEQ ID NO: 920031 - protein, 9 aa, Homo Sapiens
EREAKKKNR

SEQ ID NO: 920032 - protein, 9 aa, Homo Sapiens
MNYLKIFLQ

SEQ ID NO: 920033 - protein, 9 aa, Homo Sapiens
KDRQKRKKS

SEQ ID NO: 920034 - protein, 9 aa, Homo Sapiens
RYKSNFAQL

SEQ ID NO: 920035 - protein, 9 aa, Homo Sapiens
NATDYVEHV

SEQ ID NO: 920036 - protein, 9 aa, Homo Sapiens
VALNWVVGP

SEQ ID NO: 920037 - protein, 9 aa, Homo Sapiens
FIGIVQPEL

SEQ ID NO: 920038 - protein, 9 aa, Homo Sapiens
ETVSKAKEN

SEQ ID NO: 920039 - protein, 9 aa, Homo Sapiens
PVPLTRRRS

SEQ ID NO: 920040 - protein, 9 aa, Homo Sapiens
SKLYLKNLD

SEQ ID NO: 920041 - protein, 9 aa, Homo Sapiens
DRHSLFGQR

SEQ ID NO: 920042 - protein, 9 aa, Homo Sapiens
EGNPGSARC

SEQ ID NO: 920043 - protein, 9 aa, Homo Sapiens
EQPRGPPQR

SEQ ID NO: 920044 - protein, 9 aa, Homo Sapiens
IIEALIFLF

SEQ ID NO: 920045 - protein, 9 aa, Homo Sapiens
NATVESTNA

SEQ ID NO: 920046 - protein, 9 aa, Homo Sapiens
GPYTVGMGS

SEQ ID NO: 920047 - protein, 9 aa, Homo Sapiens
VQTVASMPE

SEQ ID NO: 920048 - protein, 9 aa, Homo Sapiens
LATVQRLPL

SEQ ID NO: 920049 - protein, 9 aa, Homo Sapiens
SIEDQTANQ

SEQ ID NO: 920050 - protein, 9 aa, Homo Sapiens
LFAVHSIHT

SEQ ID NO: 920051 - protein, 9 aa, Homo Sapiens
LKLKELHVH

SEQ ID NO: 920052 - protein, 9 aa, Homo Sapiens
KLVFRNESD

SEQ ID NO: 920053 - protein, 9 aa, Homo Sapiens
NIFIVRIII

SEQ ID NO: 920054 - protein, 9 aa, Homo Sapiens
TDILIFWLP

SEQ ID NO: 920055 - protein, 9 aa, Homo Sapiens
EHLLQRSRL

SEQ ID NO: 920056 - protein, 9 aa, Homo Sapiens
GQDISLPEG

SEQ ID NO: 920057 - protein, 9 aa, Homo Sapiens
AFSLAFPAS

SEQ ID NO: 920058 - protein, 9 aa, Homo Sapiens
FLYSEERES

SEQ ID NO: 920059 - protein, 9 aa, Homo Sapiens
QEKRPAPFD

SEQ ID NO: 920060 - protein, 9 aa, Homo Sapiens
RGYNPELLV

SEQ ID NO: 920061 - protein, 9 aa, Homo Sapiens
GSKMLFGEL

SEQ ID NO: 920062 - protein, 9 aa, Homo Sapiens
LAIFTSESG

SEQ ID NO: 920063 - protein, 9 aa, Homo Sapiens
FPFGFVPDE

SEQ ID NO: 920064 - protein, 9 aa, Homo Sapiens
KSDDENGCP

SEQ ID NO: 920065 - protein, 9 aa, Homo Sapiens
TLSPGACQA

SEQ ID NO: 920066 - protein, 9 aa, Homo Sapiens
DFSLSEVLR

SEQ ID NO: 920067 - protein, 9 aa, Homo Sapiens
MPHTVLKLL

SEQ ID NO: 920068 - protein, 9 aa, Homo Sapiens
PLGQKVIAP

SEQ ID NO: 920069 - protein, 9 aa, Homo Sapiens
AVSRAAASA

SEQ ID NO: 920070 - protein, 9 aa, Homo Sapiens
VTFITENLG

SEQ ID NO: 920071 - protein, 9 aa, Homo Sapiens
ISTLIDDYE

SEQ ID NO: 920072 - protein, 9 aa, Homo Sapiens
TIQGGVIRS

SEQ ID NO: 920073 - protein, 9 aa, Homo Sapiens
FNIEALPAN

SEQ ID NO: 920074 - protein, 9 aa, Homo Sapiens
MKNFIYESM

SEQ ID NO: 920075 - protein, 9 aa, Homo Sapiens
SRDGWGSYG

SEQ ID NO: 920076 - protein, 9 aa, Homo Sapiens
KTLAVREGN

SEQ ID NO: 920077 - protein, 9 aa, Homo Sapiens
EISMDLLPN

SEQ ID NO: 920078 - protein, 9 aa, Homo Sapiens
DSDFSLSEV

SEQ ID NO: 920079 - protein, 9 aa, Homo Sapiens
LRRPRHSHL

SEQ ID NO: 920080 - protein, 9 aa, Homo Sapiens
EDIIEALIF

SEQ ID NO: 920081 - protein, 9 aa, Homo Sapiens
VYQSGINYA

SEQ ID NO: 920082 - protein, 9 aa, Homo Sapiens
PLQQSHQLV

SEQ ID NO: 920083 - protein, 9 aa, Homo Sapiens
TYLVTVVRN

SEQ ID NO: 920084 - protein, 9 aa, Homo Sapiens
SWASAPSPS

SEQ ID NO: 920085 - protein, 9 aa, Homo Sapiens
FHVVTNFND

SEQ ID NO: 920086 - protein, 9 aa, Homo Sapiens
LQPGPLELV

SEQ ID NO: 920087 - protein, 9 aa, Homo Sapiens
SEAIKSAMS

SEQ ID NO: 920088 - protein, 9 aa, Homo Sapiens
LQQSHQLVS

SEQ ID NO: 920089 - protein, 9 aa, Homo Sapiens
RAWGPDLLP

SEQ ID NO: 920090 - protein, 9 aa, Homo Sapiens
IIVLLLFDA

SEQ ID NO: 920091 - protein, 9 aa, Homo Sapiens
GFLAGGRPS

SEQ ID NO: 920092 - protein, 9 aa, Homo Sapiens
FFDQFFATE

SEQ ID NO: 920093 - protein, 9 aa, Homo Sapiens
CFILALSQS

SEQ ID NO: 920094 - protein, 9 aa, Homo Sapiens
ANQPPHGVS

SEQ ID NO: 920095 - protein, 9 aa, Homo Sapiens
EIEPVEKIE

SEQ ID NO: 920096 - protein, 9 aa, Homo Sapiens
NTACKLLTC

SEQ ID NO: 920097 - protein, 9 aa, Homo Sapiens
GCIILISSE

SEQ ID NO: 920098 - protein, 9 aa, Homo Sapiens
LTSGWGSSA

SEQ ID NO: 920099 - protein, 9 aa, Homo Sapiens
ASPSSSSGS

SEQ ID NO: 920100 - protein, 9 aa, Homo Sapiens
VLNKHKKIY

SEQ ID NO: 920101 - protein, 9 aa, Homo Sapiens
QEPGLAKMI

SEQ ID NO: 920102 - protein, 9 aa, Homo Sapiens
QFFATEVCS

SEQ ID NO: 920103 - protein, 9 aa, Homo Sapiens
ANALPAPPV

SEQ ID NO: 920104 - protein, 9 aa, Homo Sapiens
GINYAVDIP

SEQ ID NO: 920105 - protein, 9 aa, Homo Sapiens
PHGVSQLSL

SEQ ID NO: 920106 - protein, 9 aa, Homo Sapiens
CTIAKVSFR

SEQ ID NO: 920107 - protein, 9 aa, Homo Sapiens
EVMAAYKEK

SEQ ID NO: 920108 - protein, 9 aa, Homo Sapiens
LPGERGTSG

SEQ ID NO: 920109 - protein, 9 aa, Homo Sapiens
GESLSEKEL

SEQ ID NO: 920110 - protein, 9 aa, Homo Sapiens
EKELAQILE

SEQ ID NO: 920111 - protein, 9 aa, Homo Sapiens
HGGASCQNL

SEQ ID NO: 920112 - protein, 9 aa, Homo Sapiens
NGICTKCQS

SEQ ID NO: 920113 - protein, 9 aa, Homo Sapiens
ASCQNLEAG

SEQ ID NO: 920114 - protein, 9 aa, Homo Sapiens
KIENVTRMV

SEQ ID NO: 920115 - protein, 9 aa, Homo Sapiens
RSSPRVFNF

SEQ ID NO: 920116 - protein, 9 aa, Homo Sapiens
AAASAPGCC

SEQ ID NO: 920117 - protein, 9 aa, Homo Sapiens
LTRARRCPG

SEQ ID NO: 920118 - protein, 9 aa, Homo Sapiens
SFQRLVNDM

SEQ ID NO: 920119 - protein, 9 aa, Homo Sapiens
TTKPQWSLK

SEQ ID NO: 920120 - protein, 9 aa, Homo Sapiens
ELIQKESSE

SEQ ID NO: 920121 - protein, 9 aa, Homo Sapiens
VSQLSLYEH

SEQ ID NO: 920122 - protein, 9 aa, Homo Sapiens
RQCTSKSTG

SEQ ID NO: 920123 - protein, 9 aa, Homo Sapiens
DSTLVQRQL

SEQ ID NO: 920124 - protein, 9 aa, Homo Sapiens
NQVELYRAY

SEQ ID NO: 920125 - protein, 9 aa, Homo Sapiens
LDRYKSNFA

SEQ ID NO: 920126 - protein, 9 aa, Homo Sapiens
MVLIAPRGR

SEQ ID NO: 920127 - protein, 9 aa, Homo Sapiens
GLATEKSRW

SEQ ID NO: 920128 - protein, 9 aa, Homo Sapiens
TNAVCQSRT

SEQ ID NO: 920129 - protein, 9 aa, Homo Sapiens
SLDWDNQVE

SEQ ID NO: 920130 - protein, 9 aa, Homo Sapiens
VLSPCTLIV

SEQ ID NO: 920131 - protein, 9 aa, Homo Sapiens
LSIEDQTAN

SEQ ID NO: 920132 - protein, 9 aa, Homo Sapiens
VGTHFWRDQ

SEQ ID NO: 920133 - protein, 9 aa, Homo Sapiens
EAIKSAMST

SEQ ID NO: 920134 - protein, 9 aa, Homo Sapiens
RWDCNNGKR

SEQ ID NO: 920135 - protein, 9 aa, Homo Sapiens
SLALSQSSI

SEQ ID NO: 920136 - protein, 9 aa, Homo Sapiens
IAEIEPVEK

SEQ ID NO: 920137 - protein, 9 aa, Homo Sapiens
VTSSSFQRL

SEQ ID NO: 920138 - protein, 9 aa, Homo Sapiens
GHLQILKWR

SEQ ID NO: 920139 - protein, 9 aa, Homo Sapiens
HPRKAFILN

SEQ ID NO: 920140 - protein, 9 aa, Homo Sapiens
EPIMPEPGQ

SEQ ID NO: 920141 - protein, 9 aa, Homo Sapiens
GARLSPESG

SEQ ID NO: 920142 - protein, 9 aa, Homo Sapiens
SQARILYSE

SEQ ID NO: 920143 - protein, 9 aa, Homo Sapiens
KEVPTKRSV

SEQ ID NO: 920144 - protein, 9 aa, Homo Sapiens
HMHIKSLMD

SEQ ID NO: 920145 - protein, 9 aa, Homo Sapiens
CGRFSQAIE

SEQ ID NO: 920146 - protein, 9 aa, Homo Sapiens
RHGTRCAGK

SEQ ID NO: 920147 - protein, 9 aa, Homo Sapiens
CRRNFIPHT

SEQ ID NO: 920148 - protein, 9 aa, Homo Sapiens
YARVPSKNL

SEQ ID NO: 920149 - protein, 9 aa, Homo Sapiens
RHVISAKVF

SEQ ID NO: 920150 - protein, 9 aa, Homo Sapiens
VFRNESDGL

SEQ ID NO: 920151 - protein, 9 aa, Homo Sapiens
NPCHGGASC

SEQ ID NO: 920152 - protein, 9 aa, Homo Sapiens
ESTNAVCQS

SEQ ID NO: 920153 - protein, 9 aa, Homo Sapiens
TTLISKGLK

SEQ ID NO: 920154 - protein, 9 aa, Homo Sapiens
RRLIIVLTL

SEQ ID NO: 920155 - protein, 9 aa, Homo Sapiens
GAFPIENLY

SEQ ID NO: 920156 - protein, 9 aa, Homo Sapiens
SKYTLSAAV

SEQ ID NO: 920157 - protein, 9 aa, Homo Sapiens
FSLYSYYRG

SEQ ID NO: 920158 - protein, 9 aa, Homo Sapiens
SASLYIRST

SEQ ID NO: 920159 - protein, 9 aa, Homo Sapiens
EFKADLSGI

SEQ ID NO: 920160 - protein, 9 aa, Homo Sapiens
PTSGPFCTD

SEQ ID NO: 920161 - protein, 9 aa, Homo Sapiens
VKEETKKAI

SEQ ID NO: 920162 - protein, 9 aa, Homo Sapiens
KPVVASLLK

SEQ ID NO: 920163 - protein, 9 aa, Homo Sapiens
QGLAIFTSE

SEQ ID NO: 920164 - protein, 9 aa, Homo Sapiens
ELPPGKGGA

SEQ ID NO: 920165 - protein, 9 aa, Homo Sapiens
SKIIALMKA

SEQ ID NO: 920166 - protein, 9 aa, Homo Sapiens
MAAKVFEFI

SEQ ID NO: 920167 - protein, 9 aa, Homo Sapiens
GLYWCMAAN

SEQ ID NO: 920168 - protein, 9 aa, Homo Sapiens
SGKGLWSEM

SEQ ID NO: 920169 - protein, 9 aa, Homo Sapiens
PFDSSWVKH

SEQ ID NO: 920170 - protein, 9 aa, Homo Sapiens
RLVNDMNIA

SEQ ID NO: 920171 - protein, 9 aa, Homo Sapiens
HGGFSKLPR

SEQ ID NO: 920172 - protein, 9 aa, Homo Sapiens
DPLASGKGL

SEQ ID NO: 920173 - protein, 9 aa, Homo Sapiens
SRLLENTGQ

SEQ ID NO: 920174 - protein, 9 aa, Homo Sapiens
EEKVSLEAF

SEQ ID NO: 920175 - protein, 9 aa, Homo Sapiens
KKHGGFSKL

SEQ ID NO: 920176 - protein, 9 aa, Homo Sapiens
IADVEQRGD

SEQ ID NO: 920177 - protein, 9 aa, Homo Sapiens
RLSPESGGP

SEQ ID NO: 920178 - protein, 9 aa, Homo Sapiens
INSKYTLSA

SEQ ID NO: 920179 - protein, 9 aa, Homo Sapiens
NDVLLFIPR

SEQ ID NO: 920180 - protein, 9 aa, Homo Sapiens
CLGKSKERK

SEQ ID NO: 920181 - protein, 9 aa, Homo Sapiens
TCCTACESA

SEQ ID NO: 920182 - protein, 9 aa, Homo Sapiens
AWGPDLLPA

SEQ ID NO: 920183 - protein, 9 aa, Homo Sapiens
FWRDQFMEA

SEQ ID NO: 920184 - protein, 9 aa, Homo Sapiens
PSPLPSFFP

SEQ ID NO: 920185 - protein, 9 aa, Homo Sapiens
TVLKLLENM

SEQ ID NO: 920186 - protein, 9 aa, Homo Sapiens
TGVWTVWNF

SEQ ID NO: 920187 - protein, 9 aa, Homo Sapiens
AFMIGMFSL

SEQ ID NO: 920188 - protein, 9 aa, Homo Sapiens
KLIKLLHHA

SEQ ID NO: 920189 - protein, 9 aa, Homo Sapiens
RSARGNNSN

SEQ ID NO: 920190 - protein, 9 aa, Homo Sapiens
RLKANALPA

SEQ ID NO: 920191 - protein, 9 aa, Homo Sapiens
LLEETPSHG

SEQ ID NO: 920192 - protein, 9 aa, Homo Sapiens
ELRGIEKFT

SEQ ID NO: 920193 - protein, 9 aa, Homo Sapiens
GPLQQSHQL

SEQ ID NO: 920194 - protein, 9 aa, Homo Sapiens
YGFFVVSFF

SEQ ID NO: 920195 - protein, 9 aa, Homo Sapiens
TLSRHWRIH

SEQ ID NO: 920196 - protein, 9 aa, Homo Sapiens
AGLRTLLLV

SEQ ID NO: 920197 - protein, 9 aa, Homo Sapiens
FLILGLVPF

SEQ ID NO: 920198 - protein, 9 aa, Homo Sapiens
ASLLFAVHS

SEQ ID NO: 920199 - protein, 9 aa, Homo Sapiens
PPPPRTLSP

SEQ ID NO: 920200 - protein, 9 aa, Homo Sapiens
GSQVDVKGP

SEQ ID NO: 920201 - protein, 9 aa, Homo Sapiens
VGSEEEPFS

SEQ ID NO: 920202 - protein, 9 aa, Homo Sapiens
LKLVFRNES

SEQ ID NO: 920203 - protein, 9 aa, Homo Sapiens
KMLFGELMF

SEQ ID NO: 920204 - protein, 9 aa, Homo Sapiens
CLSFFFFFF

SEQ ID NO: 920205 - protein, 9 aa, Homo Sapiens
SALYSVSAK

SEQ ID NO: 920206 - protein, 9 aa, Homo Sapiens
GTELPPGKG

SEQ ID NO: 920207 - protein, 9 aa, Homo Sapiens
RLPYCRRNF

SEQ ID NO: 920208 - protein, 9 aa, Homo Sapiens
AAPAEASVC

SEQ ID NO: 920209 - protein, 9 aa, Homo Sapiens
PPRTLSPGA

SEQ ID NO: 920210 - protein, 9 aa, Homo Sapiens
RRNFIPHTY

SEQ ID NO: 920211 - protein, 9 aa, Homo Sapiens
LSEKELAQI

SEQ ID NO: 920212 - protein, 9 aa, Homo Sapiens
YAVDIPELG

SEQ ID NO: 920213 - protein, 9 aa, Homo Sapiens
VTNLGTPRL

SEQ ID NO: 920214 - protein, 9 aa, Homo Sapiens
GRRSLKALR

SEQ ID NO: 920215 - protein, 9 aa, Homo Sapiens
WGRLHSHCP

SEQ ID NO: 920216 - protein, 9 aa, Homo Sapiens
LCPTKMDVQ

SEQ ID NO: 920217 - protein, 9 aa, Homo Sapiens
VADMLVAIN

SEQ ID NO: 920218 - protein, 9 aa, Homo Sapiens
ERLHTGQKL

SEQ ID NO: 920219 - protein, 9 aa, Homo Sapiens
LLKFDGWYC

SEQ ID NO: 920220 - protein, 9 aa, Homo Sapiens
MEPTSGPFC

SEQ ID NO: 920221 - protein, 9 aa, Homo Sapiens
LKALDELDL

SEQ ID NO: 920222 - protein, 9 aa, Homo Sapiens
HSLFGQRHL

SEQ ID NO: 920223 - protein, 9 aa, Homo Sapiens
VRLAVRKAI

SEQ ID NO: 920224 - protein, 9 aa, Homo Sapiens
NVLLLVHNL

SEQ ID NO: 920225 - protein, 9 aa, Homo Sapiens
SPGACQAAR

SEQ ID NO: 920226 - protein, 9 aa, Homo Sapiens
KPGSLGGSD

SEQ ID NO: 920227 - protein, 9 aa, Homo Sapiens
KQQAQKAAV

SEQ ID NO: 920228 - protein, 9 aa, Homo Sapiens
FFPMSDKNP

SEQ ID NO: 920229 - protein, 9 aa, Homo Sapiens
RQEKLEMQL

SEQ ID NO: 920230 - protein, 9 aa, Homo Sapiens
KFEKASKLT

SEQ ID NO: 920231 - protein, 9 aa, Homo Sapiens
GGIDYQAED

SEQ ID NO: 920232 - protein, 9 aa, Homo Sapiens
SHELEDLKI

SEQ ID NO: 920233 - protein, 9 aa, Homo Sapiens
ILISSEGYV

SEQ ID NO: 920234 - protein, 9 aa, Homo Sapiens
CMEVAGQVM

SEQ ID NO: 920235 - protein, 9 aa, Homo Sapiens
IYRIQEPGL

SEQ ID NO: 920236 - protein, 9 aa, Homo Sapiens
DNMGPYTVG

SEQ ID NO: 920237 - protein, 9 aa, Homo Sapiens
LSCFLSADG

SEQ ID NO: 920238 - protein, 9 aa, Homo Sapiens
EILSPVDLE

SEQ ID NO: 920239 - protein, 9 aa, Homo Sapiens
FFLQLLLLN

SEQ ID NO: 920240 - protein, 9 aa, Homo Sapiens
PGLAKMIST

SEQ ID NO: 920241 - protein, 9 aa, Homo Sapiens
MPKVALKGS

SEQ ID NO: 920242 - protein, 9 aa, Homo Sapiens
LDFTSSVLY

SEQ ID NO: 920243 - protein, 9 aa, Homo Sapiens
LEETPSHGD

SEQ ID NO: 920244 - protein, 9 aa, Homo Sapiens
FYNISQGYT

SEQ ID NO: 920245 - protein, 9 aa, Homo Sapiens
CMTSPEQVA

SEQ ID NO: 920246 - protein, 9 aa, Homo Sapiens
FQEHVYEEI

SEQ ID NO: 920247 - protein, 9 aa, Homo Sapiens
FFLRNFSFF

SEQ ID NO: 920248 - protein, 9 aa, Homo Sapiens
IEDAISITA

SEQ ID NO: 920249 - protein, 9 aa, Homo Sapiens
GLAKMISTV

SEQ ID NO: 920250 - protein, 9 aa, Homo Sapiens
CIILISSEG

SEQ ID NO: 920251 - protein, 9 aa, Homo Sapiens
TLISKGLKD

SEQ ID NO: 920252 - protein, 9 aa, Homo Sapiens
NTYLEACLD

SEQ ID NO: 920253 - protein, 9 aa, Homo Sapiens
HAFLELKFS

SEQ ID NO: 920254 - protein, 9 aa, Homo Sapiens
KVSANRTVD

SEQ ID NO: 920255 - protein, 9 aa, Homo Sapiens
LNEKIALQP

SEQ ID NO: 920256 - protein, 9 aa, Homo Sapiens
ELPPELLAK

SEQ ID NO: 920257 - protein, 9 aa, Homo Sapiens
HVCALKAQA

SEQ ID NO: 920258 - protein, 9 aa, Homo Sapiens
FMRNKQVAD

SEQ ID NO: 920259 - protein, 9 aa, Homo Sapiens
AWEKELVNV

SEQ ID NO: 920260 - protein, 9 aa, Homo Sapiens
VILCPTKMD

SEQ ID NO: 920261 - protein, 9 aa, Homo Sapiens
CKGGPDKDA

SEQ ID NO: 920262 - protein, 9 aa, Homo Sapiens
PQRLRPPGP

SEQ ID NO: 920263 - protein, 9 aa, Homo Sapiens
DALQMAQEM

SEQ ID NO: 920264 - protein, 9 aa, Homo Sapiens
VWTVWNFSQ

SEQ ID NO: 920265 - protein, 9 aa, Homo Sapiens
IFNEDVEWK

SEQ ID NO: 920266 - protein, 9 aa, Homo Sapiens
AVLTGPLQQ

SEQ ID NO: 920267 - protein, 9 aa, Homo Sapiens
ALSQSSIAL

SEQ ID NO: 920268 - protein, 9 aa, Homo Sapiens
RRIASTSFS

SEQ ID NO: 920269 - protein, 9 aa, Homo Sapiens
KEILSPVDL

SEQ ID NO: 920270 - protein, 9 aa, Homo Sapiens
KDSGHLQIL

SEQ ID NO: 920271 - protein, 9 aa, Homo Sapiens
PPPPRLGMH

SEQ ID NO: 920272 - protein, 9 aa, Homo Sapiens
VFYGTDSGE

SEQ ID NO: 920273 - protein, 9 aa, Homo Sapiens
CIRGYNPEL

SEQ ID NO: 920274 - protein, 9 aa, Homo Sapiens
GFADWPPPQ

SEQ ID NO: 920275 - protein, 9 aa, Homo Sapiens
TDTNSYGAW

SEQ ID NO: 920276 - protein, 9 aa, Homo Sapiens
VTVVRNLLI

SEQ ID NO: 920277 - protein, 9 aa, Homo Sapiens
HSSFKEQKP

SEQ ID NO: 920278 - protein, 9 aa, Homo Sapiens
VDGPQRGAF

SEQ ID NO: 920279 - protein, 9 aa, Homo Sapiens
FDEFKADLS

SEQ ID NO: 920280 - protein, 9 aa, Homo Sapiens
PALLKVYDQ

SEQ ID NO: 920281 - protein, 9 aa, Homo Sapiens
RSSNMETRR

SEQ ID NO: 920282 - protein, 9 aa, Homo Sapiens
SDGPPYDTL

SEQ ID NO: 920283 - protein, 9 aa, Homo Sapiens
NYAVDIPEL

SEQ ID NO: 920284 - protein, 9 aa, Homo Sapiens
EASTFQALE

SEQ ID NO: 920285 - protein, 9 aa, Homo Sapiens
DVLRNSMLT

SEQ ID NO: 920286 - protein, 9 aa, Homo Sapiens
RSAPFWLWP

SEQ ID NO: 920287 - protein, 9 aa, Homo Sapiens
VIETREPRK

SEQ ID NO: 920288 - protein, 9 aa, Homo Sapiens
RLDGLKYEG

SEQ ID NO: 920289 - protein, 9 aa, Homo Sapiens
NDHYFIKKA

SEQ ID NO: 920290 - protein, 9 aa, Homo Sapiens
FSFRVVLEL

SEQ ID NO: 920291 - protein, 9 aa, Homo Sapiens
MGALAAIFA

SEQ ID NO: 920292 - protein, 9 aa, Homo Sapiens
STYVLVVHS

SEQ ID NO: 920293 - protein, 9 aa, Homo Sapiens
ELLKPGSLG

SEQ ID NO: 920294 - protein, 9 aa, Homo Sapiens
LPEFYNISQ

SEQ ID NO: 920295 - protein, 9 aa, Homo Sapiens
KLARKGTGK

SEQ ID NO: 920296 - protein, 9 aa, Homo Sapiens
LNVESKHFE

SEQ ID NO: 920297 - protein, 9 aa, Homo Sapiens
QPPEIGNIF

SEQ ID NO: 920298 - protein, 9 aa, Homo Sapiens
EPRALGQEN

SEQ ID NO: 920299 - protein, 9 aa, Homo Sapiens
LVSFVLSLA

SEQ ID NO: 920300 - protein, 9 aa, Homo Sapiens
GMAKAALKA

SEQ ID NO: 920301 - protein, 9 aa, Homo Sapiens
LASKKKVKG

SEQ ID NO: 920302 - protein, 9 aa, Homo Sapiens
MTVRRGPQS

SEQ ID NO: 920303 - protein, 9 aa, Homo Sapiens
ETIQGGVIR

SEQ ID NO: 920304 - protein, 9 aa, Homo Sapiens
GGVIRSGCG

SEQ ID NO: 920305 - protein, 9 aa, Homo Sapiens
MNLAPTFIN

SEQ ID NO: 920306 - protein, 9 aa, Homo Sapiens
MAASIRKLL

SEQ ID NO: 920307 - protein, 9 aa, Homo Sapiens
LCYINNTIN

SEQ ID NO: 920308 - protein, 9 aa, Homo Sapiens
SSAGKVSAN

SEQ ID NO: 920309 - protein, 9 aa, Homo Sapiens
RKQVAKLGK

SEQ ID NO: 920310 - protein, 9 aa, Homo Sapiens
GFFVVSFFV

SEQ ID NO: 920311 - protein, 9 aa, Homo Sapiens
GRPDSAPEK

SEQ ID NO: 920312 - protein, 9 aa, Homo Sapiens
LLSALELII

SEQ ID NO: 920313 - protein, 9 aa, Homo Sapiens
TNIVQKKKH

SEQ ID NO: 920314 - protein, 9 aa, Homo Sapiens
VSQRLDGLK

SEQ ID NO: 920315 - protein, 9 aa, Homo Sapiens
MEKDALQMA

SEQ ID NO: 920316 - protein, 9 aa, Homo Sapiens
SAAVMVLIA

SEQ ID NO: 920317 - protein, 9 aa, Homo Sapiens
NTEAPGDNR

SEQ ID NO: 920318 - protein, 9 aa, Homo Sapiens
VSQGTYGQK

SEQ ID NO: 920319 - protein, 9 aa, Homo Sapiens
TVQLEEQPR

SEQ ID NO: 920320 - protein, 9 aa, Homo Sapiens
NLLGNKFSI

SEQ ID NO: 920321 - protein, 9 aa, Homo Sapiens
SKAKENLEK

SEQ ID NO: 920322 - protein, 9 aa, Homo Sapiens
DFGLATEKS

SEQ ID NO: 920323 - protein, 9 aa, Homo Sapiens
FWKPTRWGW

SEQ ID NO: 920324 - protein, 9 aa, Homo Sapiens
PPKPRLGKE

SEQ ID NO: 920325 - protein, 9 aa, Homo Sapiens
FEISMDLLP

SEQ ID NO: 920326 - protein, 9 aa, Homo Sapiens
QQKPRKTSE

SEQ ID NO: 920327 - protein, 9 aa, Homo Sapiens
LLQTKNSFK

SEQ ID NO: 920328 - protein, 9 aa, Homo Sapiens
GMDGFADWP

SEQ ID NO: 920329 - protein, 9 aa, Homo Sapiens
SFRVVLELF

SEQ ID NO: 920330 - protein, 9 aa, Homo Sapiens
MPFPTEEKS

SEQ ID NO: 920331 - protein, 9 aa, Homo Sapiens
APGDNRVCS

SEQ ID NO: 920332 - protein, 9 aa, Homo Sapiens
YTVQLEEQP

SEQ ID NO: 920333 - protein, 9 aa, Homo Sapiens
SLFGQRHLH

SEQ ID NO: 920334 - protein, 9 aa, Homo Sapiens
NISQGYTVE

SEQ ID NO: 920335 - protein, 9 aa, Homo Sapiens
CAGKVAAMA

SEQ ID NO: 920336 - protein, 9 aa, Homo Sapiens
DAPQRMYSK

SEQ ID NO: 920337 - protein, 9 aa, Homo Sapiens
GNEAAPAEA

SEQ ID NO: 920338 - protein, 9 aa, Homo Sapiens
FYPENDDYF

SEQ ID NO: 920339 - protein, 9 aa, Homo Sapiens
LLLFDASFY

SEQ ID NO: 920340 - protein, 9 aa, Homo Sapiens
SSPRVFNFD

SEQ ID NO: 920341 - protein, 9 aa, Homo Sapiens
CQSSAITLN

SEQ ID NO: 920342 - protein, 9 aa, Homo Sapiens
QNTLELNKQ

SEQ ID NO: 920343 - protein, 9 aa, Homo Sapiens
RTLSNVEEI

SEQ ID NO: 920344 - protein, 9 aa, Homo Sapiens
KAHPKFLKK

SEQ ID NO: 920345 - protein, 9 aa, Homo Sapiens
GFQEHVYEE

SEQ ID NO: 920346 - protein, 9 aa, Homo Sapiens
PTDILIFWL

SEQ ID NO: 920347 - protein, 9 aa, Homo Sapiens
LDTSVELRY

SEQ ID NO: 920348 - protein, 9 aa, Homo Sapiens
AKLGKHLRI

SEQ ID NO: 920349 - protein, 9 aa, Homo Sapiens
LIIVLTLDY

SEQ ID NO: 920350 - protein, 9 aa, Homo Sapiens
HAQLSSPAA

SEQ ID NO: 920351 - protein, 9 aa, Homo Sapiens
SGNPWPPYK

SEQ ID NO: 920352 - protein, 9 aa, Homo Sapiens
ILQQKPRKT

SEQ ID NO: 920353 - protein, 9 aa, Homo Sapiens
GAFPRLWDI

SEQ ID NO: 920354 - protein, 9 aa, Homo Sapiens
RYTLRTLPR

SEQ ID NO: 920355 - protein, 9 aa, Homo Sapiens
FVLGLYGPK

SEQ ID NO: 920356 - protein, 9 aa, Homo Sapiens
KGAPFRWPL

SEQ ID NO: 920357 - protein, 9 aa, Homo Sapiens
SCQGDSGGL

SEQ ID NO: 920358 - protein, 9 aa, Homo Sapiens
SSAITLNRQ

SEQ ID NO: 920359 - protein, 9 aa, Homo Sapiens
LQILKWRYK

SEQ ID NO: 920360 - protein, 9 aa, Homo Sapiens
PDFETEDQK

SEQ ID NO: 920361 - protein, 9 aa, Homo Sapiens
LFGELMFES

SEQ ID NO: 920362 - protein, 9 aa, Homo Sapiens
EGKNVLLLV

SEQ ID NO: 920363 - protein, 9 aa, Homo Sapiens
GKTFNRSSI

SEQ ID NO: 920364 - protein, 9 aa, Homo Sapiens
NYNQTLTDF

SEQ ID NO: 920365 - protein, 9 aa, Homo Sapiens
VFDNMGPYT

SEQ ID NO: 920366 - protein, 9 aa, Homo Sapiens
KSEIFNEDV

SEQ ID NO: 920367 - protein, 9 aa, Homo Sapiens
LGKELQVTT

SEQ ID NO: 920368 - protein, 9 aa, Homo Sapiens
PFRWPLYTN

SEQ ID NO: 920369 - protein, 9 aa, Homo Sapiens
LEKFSVIQH

SEQ ID NO: 920370 - protein, 9 aa, Homo Sapiens
QIKKLHNDH

SEQ ID NO: 920371 - protein, 9 aa, Homo Sapiens
AVRGLCSVS

SEQ ID NO: 920372 - protein, 9 aa, Homo Sapiens
FRWPLYTNV

SEQ ID NO: 920373 - protein, 9 aa, Homo Sapiens
KVLDALELQ

SEQ ID NO: 920374 - protein, 9 aa, Homo Sapiens
YIRSTFIGT

SEQ ID NO: 920375 - protein, 9 aa, Homo Sapiens
GGLLVCGDH

SEQ ID NO: 920376 - protein, 9 aa, Homo Sapiens
LNKSFVLGL

SEQ ID NO: 920377 - protein, 9 aa, Homo Sapiens
KVYKLDFLM

SEQ ID NO: 920378 - protein, 9 aa, Homo Sapiens
EGEKPKSDL

SEQ ID NO: 920379 - protein, 9 aa, Homo Sapiens
QISEMKVSR

SEQ ID NO: 920380 - protein, 9 aa, Homo Sapiens
ESSCHSSFK

SEQ ID NO: 920381 - protein, 9 aa, Homo Sapiens
RSTFIGTEP

SEQ ID NO: 920382 - protein, 9 aa, Homo Sapiens
SSLSKSFPE

SEQ ID NO: 920383 - protein, 9 aa, Homo Sapiens
QGDSGGLLV

SEQ ID NO: 920384 - protein, 9 aa, Homo Sapiens
PFAELLKPG

SEQ ID NO: 920385 - protein, 9 aa, Homo Sapiens
YRKLTVKRP

SEQ ID NO: 920386 - protein, 9 aa, Homo Sapiens
RPDSAPEKP

SEQ ID NO: 920387 - protein, 9 aa, Homo Sapiens
ARRIASTSF

SEQ ID NO: 920388 - protein, 9 aa, Homo Sapiens
PNMADNEDL

SEQ ID NO: 920389 - protein, 9 aa, Homo Sapiens
VANELDTEI

SEQ ID NO: 920390 - protein, 9 aa, Homo Sapiens
IARGHIEPD

SEQ ID NO: 920391 - protein, 9 aa, Homo Sapiens
IATLSYLPT

SEQ ID NO: 920392 - protein, 9 aa, Homo Sapiens
YEREAKKKN

SEQ ID NO: 920393 - protein, 9 aa, Homo Sapiens
KPKSDLKAA

SEQ ID NO: 920394 - protein, 9 aa, Homo Sapiens
EHVKEETKK

SEQ ID NO: 920395 - protein, 9 aa, Homo Sapiens
LLVCGDHLR

SEQ ID NO: 920396 - protein, 9 aa, Homo Sapiens
IPFKVLDAL

SEQ ID NO: 920397 - protein, 9 aa, Homo Sapiens
PPPRTLSPG

SEQ ID NO: 920398 - protein, 9 aa, Homo Sapiens
RALGQENDI

SEQ ID NO: 920399 - protein, 9 aa, Homo Sapiens
ICTMKNDNF

SEQ ID NO: 920400 - protein, 9 aa, Homo Sapiens
IGSTVKIPM

SEQ ID NO: 920401 - protein, 9 aa, Homo Sapiens
APFRWPLYT

SEQ ID NO: 920402 - protein, 9 aa, Homo Sapiens
QVGSEEEPF

SEQ ID NO: 920403 - protein, 9 aa, Homo Sapiens
LPYCRRNFI

SEQ ID NO: 920404 - protein, 9 aa, Homo Sapiens
GQILHPLGW

SEQ ID NO: 920405 - protein, 9 aa, Homo Sapiens
FLRKSKAAD

SEQ ID NO: 920406 - protein, 9 aa, Homo Sapiens
QWSLKLARK

SEQ ID NO: 920407 - protein, 9 aa, Homo Sapiens
SPLPSFFPG

SEQ ID NO: 920408 - protein, 9 aa, Homo Sapiens
QPLQGRTPH

SEQ ID NO: 920409 - protein, 9 aa, Homo Sapiens
TCNSRNENP

SEQ ID NO: 920410 - protein, 9 aa, Homo Sapiens
SFKEQKPLE

SEQ ID NO: 920411 - protein, 9 aa, Homo Sapiens
LDTEILRRL

SEQ ID NO: 920412 - protein, 9 aa, Homo Sapiens
ESWGSSQHI

SEQ ID NO: 920413 - protein, 9 aa, Homo Sapiens
TSSVLYGWS

SEQ ID NO: 920414 - protein, 9 aa, Homo Sapiens
LDWDNQVEL

SEQ ID NO: 920415 - protein, 9 aa, Homo Sapiens
TNFNDNLIS

SEQ ID NO: 920416 - protein, 9 aa, Homo Sapiens
FSVIQHFKF

SEQ ID NO: 920417 - protein, 9 aa, Homo Sapiens
SQSSIGSIK

SEQ ID NO: 920418 - protein, 9 aa, Homo Sapiens
CPTGVWTVW

SEQ ID NO: 920419 - protein, 9 aa, Homo Sapiens
PGSTEGMKG

SEQ ID NO: 920420 - protein, 9 aa, Homo Sapiens
EPPGSKIPL

SEQ ID NO: 920421 - protein, 9 aa, Homo Sapiens
TSASLYIRS

SEQ ID NO: 920422 - protein, 9 aa, Homo Sapiens
SQGTYGQKV

SEQ ID NO: 920423 - protein, 9 aa, Homo Sapiens
FLRNFSFFE

SEQ ID NO: 920424 - protein, 9 aa, Homo Sapiens
TGPLQQSHQ

SEQ ID NO: 920425 - protein, 9 aa, Homo Sapiens
IILISSEGY

SEQ ID NO: 920426 - protein, 9 aa, Homo Sapiens
KLATSASQS

SEQ ID NO: 920427 - protein, 9 aa, Homo Sapiens
ADNEDLDLG

SEQ ID NO: 920428 - protein, 9 aa, Homo Sapiens
GPQSLPPIP

SEQ ID NO: 920429 - protein, 9 aa, Homo Sapiens
PSANDRVSL

SEQ ID NO: 920430 - protein, 9 aa, Homo Sapiens
FLAGGRPSG

SEQ ID NO: 920431 - protein, 9 aa, Homo Sapiens
VAFMIGMFS

SEQ ID NO: 920432 - protein, 9 aa, Homo Sapiens
VAQRKPESF

SEQ ID NO: 920433 - protein, 9 aa, Homo Sapiens
HQVKTQALS

SEQ ID NO: 920434 - protein, 9 aa, Homo Sapiens
YGGFQEHVY

SEQ ID NO: 920435 - protein, 9 aa, Homo Sapiens
TVSSGISTA

SEQ ID NO: 920436 - protein, 9 aa, Homo Sapiens
TDYVEHVKE

SEQ ID NO: 920437 - protein, 9 aa, Homo Sapiens
LELIICCVK

SEQ ID NO: 920438 - protein, 9 aa, Homo Sapiens
SAPGCCPPT

SEQ ID NO: 920439 - protein, 9 aa, Homo Sapiens
GGFSKLPRN

SEQ ID NO: 920440 - protein, 9 aa, Homo Sapiens
LPGLNERPP

SEQ ID NO: 920441 - protein, 9 aa, Homo Sapiens
DLLNVESKH

SEQ ID NO: 920442 - protein, 9 aa, Homo Sapiens
AEIEPVEKI

SEQ ID NO: 920443 - protein, 9 aa, Homo Sapiens
RCAGKVAAM

SEQ ID NO: 920444 - protein, 9 aa, Homo Sapiens
FFEISFTNI

SEQ ID NO: 920445 - protein, 9 aa, Homo Sapiens
GCPIPPTSS

SEQ ID NO: 920446 - protein, 9 aa, Homo Sapiens
LVFLRARKL

SEQ ID NO: 920447 - protein, 9 aa, Homo Sapiens
IPGPGSTEG

SEQ ID NO: 920448 - protein, 9 aa, Homo Sapiens
GIYGFFVVS

SEQ ID NO: 920449 - protein, 9 aa, Homo Sapiens
QADTIDRYY

SEQ ID NO: 920450 - protein, 9 aa, Homo Sapiens
GLESNKSLR

SEQ ID NO: 920451 - protein, 9 aa, Homo Sapiens
LYWCMAANT

SEQ ID NO: 920452 - protein, 9 aa, Homo Sapiens
HSHCPRHCP

SEQ ID NO: 920453 - protein, 9 aa, Homo Sapiens
DSLGSYCKG

SEQ ID NO: 920454 - protein, 9 aa, Homo Sapiens
NDNFEKENK

SEQ ID NO: 920455 - protein, 9 aa, Homo Sapiens
IIFSSEKLL

SEQ ID NO: 920456 - protein, 9 aa, Homo Sapiens
TASWQETAL

SEQ ID NO: 920457 - protein, 9 aa, Homo Sapiens
SHGDRPLLG

SEQ ID NO: 920458 - protein, 9 aa, Homo Sapiens
RSRLLENTG

SEQ ID NO: 920459 - protein, 9 aa, Homo Sapiens
RFSQAIEVE

SEQ ID NO: 920460 - protein, 9 aa, Homo Sapiens
EPSEGCEKV

SEQ ID NO: 920461 - protein, 9 aa, Homo Sapiens
GPQRGAFPR

SEQ ID NO: 920462 - protein, 9 aa, Homo Sapiens
SWIDHILQT

SEQ ID NO: 920463 - protein, 9 aa, Homo Sapiens
SALSLSEAR

SEQ ID NO: 920464 - protein, 9 aa, Homo Sapiens
HEVVVKAVQ

SEQ ID NO: 920465 - protein, 9 aa, Homo Sapiens
LFDPQLHDS

SEQ ID NO: 920466 - protein, 9 aa, Homo Sapiens
EFQEALGPG

SEQ ID NO: 920467 - protein, 9 aa, Homo Sapiens
CPPPPRTLS

SEQ ID NO: 920468 - protein, 9 aa, Homo Sapiens
GNPLSALDT

SEQ ID NO: 920469 - protein, 9 aa, Homo Sapiens
RRSSPRVFN

SEQ ID NO: 920470 - protein, 9 aa, Homo Sapiens
LLAKIESTM

SEQ ID NO: 920471 - protein, 9 aa, Homo Sapiens
ILLNKETEK

SEQ ID NO: 920472 - protein, 9 aa, Homo Sapiens
SFKVLFRKS

SEQ ID NO: 920473 - protein, 9 aa, Homo Sapiens
EALMEEGDK

SEQ ID NO: 920474 - protein, 9 aa, Homo Sapiens
NFSFFEISF

SEQ ID NO: 920475 - protein, 9 aa, Homo Sapiens
RNENPAPKI

SEQ ID NO: 920476 - protein, 9 aa, Homo Sapiens
LFGETPEGQ

SEQ ID NO: 920477 - protein, 9 aa, Homo Sapiens
CRKKKGLDS

SEQ ID NO: 920478 - protein, 9 aa, Homo Sapiens
LADRSATKM

SEQ ID NO: 920479 - protein, 9 aa, Homo Sapiens
KFAVVRQCT

SEQ ID NO: 920480 - protein, 9 aa, Homo Sapiens
CIDEAEASN

SEQ ID NO: 920481 - protein, 9 aa, Homo Sapiens
VDSSKEKPQ

SEQ ID NO: 920482 - protein, 9 aa, Homo Sapiens
EVAGQVMCL

SEQ ID NO: 920483 - protein, 9 aa, Homo Sapiens
HNDHYFIKK

SEQ ID NO: 920484 - protein, 9 aa, Homo Sapiens
RRRSSPRVF

SEQ ID NO: 920485 - protein, 9 aa, Homo Sapiens
GLLVCGDHL

SEQ ID NO: 920486 - protein, 9 aa, Homo Sapiens
GALKYMPHT

SEQ ID NO: 920487 - protein, 9 aa, Homo Sapiens
IQGGVIRSG

SEQ ID NO: 920488 - protein, 9 aa, Homo Sapiens
GLITARLLR

SEQ ID NO: 920489 - protein, 9 aa, Homo Sapiens
MKDCLDFTS

SEQ ID NO: 920490 - protein, 9 aa, Homo Sapiens
PDDCIDEAE

SEQ ID NO: 920491 - protein, 9 aa, Homo Sapiens
QKAAVPSPQ

SEQ ID NO: 920492 - protein, 9 aa, Homo Sapiens
GNNSNGREA

SEQ ID NO: 920493 - protein, 9 aa, Homo Sapiens
LLKPGSLGG

SEQ ID NO: 920494 - protein, 9 aa, Homo Sapiens
KTKKLATSA

SEQ ID NO: 920495 - protein, 9 aa, Homo Sapiens
DLKIRPRVS

SEQ ID NO: 920496 - protein, 9 aa, Homo Sapiens
EEFKIVLAI

SEQ ID NO: 920497 - protein, 9 aa, Homo Sapiens
AVRKAIHAL

SEQ ID NO: 920498 - protein, 9 aa, Homo Sapiens
SLLKRQACG

SEQ ID NO: 920499 - protein, 9 aa, Homo Sapiens
YCRRNFIPH

SEQ ID NO: 920500 - protein, 9 aa, Homo Sapiens
EHAQLSSPA

SEQ ID NO: 920501 - protein, 9 aa, Homo Sapiens
IILCRTLSN

SEQ ID NO: 920502 - protein, 9 aa, Homo Sapiens
KSSQTKFCQ

SEQ ID NO: 920503 - protein, 9 aa, Homo Sapiens
EAKKKNRET

SEQ ID NO: 920504 - protein, 9 aa, Homo Sapiens
TSSPPRHLS

SEQ ID NO: 920505 - protein, 9 aa, Homo Sapiens
NPYPLMLHA

SEQ ID NO: 920506 - protein, 9 aa, Homo Sapiens
CESARKYKT

SEQ ID NO: 920507 - protein, 9 aa, Homo Sapiens
QSSAITLNR

SEQ ID NO: 920508 - protein, 9 aa, Homo Sapiens
KKIPWIQQK

SEQ ID NO: 920509 - protein, 9 aa, Homo Sapiens
RLHSHCPRH

SEQ ID NO: 920510 - protein, 9 aa, Homo Sapiens
SSSFQRLVN

SEQ ID NO: 920511 - protein, 9 aa, Homo Sapiens
SYLDDIGLL

SEQ ID NO: 920512 - protein, 9 aa, Homo Sapiens
TKRSVECKE

SEQ ID NO: 920513 - protein, 9 aa, Homo Sapiens
FSVHRLDLS

SEQ ID NO: 920514 - protein, 9 aa, Homo Sapiens
FFEISMDLL

SEQ ID NO: 920515 - protein, 9 aa, Homo Sapiens
EAEKQRQEK

SEQ ID NO: 920516 - protein, 9 aa, Homo Sapiens
IYGFFVVSF

SEQ ID NO: 920517 - protein, 9 aa, Homo Sapiens
QSSRWDCNN

SEQ ID NO: 920518 - protein, 9 aa, Homo Sapiens
LVNDMNIAS

SEQ ID NO: 920519 - protein, 9 aa, Homo Sapiens
QIFLPINFK

SEQ ID NO: 920520 - protein, 9 aa, Homo Sapiens
YADYGGFQE

SEQ ID NO: 920521 - protein, 9 aa, Homo Sapiens
YSEQKGRVA

SEQ ID NO: 920522 - protein, 9 aa, Homo Sapiens
NGLKSKEIL

SEQ ID NO: 920523 - protein, 9 aa, Homo Sapiens
HVDCMTSPE

SEQ ID NO: 920524 - protein, 9 aa, Homo Sapiens
YKSNFAQLL

SEQ ID NO: 920525 - protein, 9 aa, Homo Sapiens
NLLFSIVEE

SEQ ID NO: 920526 - protein, 9 aa, Homo Sapiens
HSKLYLKNL

SEQ ID NO: 920527 - protein, 9 aa, Homo Sapiens
VNDHAPKLD

SEQ ID NO: 920528 - protein, 9 aa, Homo Sapiens
RSATKMSGR

SEQ ID NO: 920529 - protein, 9 aa, Homo Sapiens
SFFFFFFFL

SEQ ID NO: 920530 - protein, 9 aa, Homo Sapiens
WPLYTNVPF

SEQ ID NO: 920531 - protein, 9 aa, Homo Sapiens
PTLKLVFRN

SEQ ID NO: 920532 - protein, 9 aa, Homo Sapiens
KCLGKSKER

SEQ ID NO: 920533 - protein, 9 aa, Homo Sapiens
DTIDRYYYE

SEQ ID NO: 920534 - protein, 9 aa, Homo Sapiens
ALSCFLSAD

SEQ ID NO: 920535 - protein, 9 aa, Homo Sapiens
ATVESTNAV

SEQ ID NO: 920536 - protein, 9 aa, Homo Sapiens
DQSALSCFL

SEQ ID NO: 920537 - protein, 9 aa, Homo Sapiens
TVESTNAVC

SEQ ID NO: 920538 - protein, 9 aa, Homo Sapiens
LRRAEFCGG

SEQ ID NO: 920539 - protein, 9 aa, Homo Sapiens
DSSWVKHYC

SEQ ID NO: 920540 - protein, 9 aa, Homo Sapiens
TVWNFSQVL

SEQ ID NO: 920541 - protein, 9 aa, Homo Sapiens
VVCSCLSFF

SEQ ID NO: 920542 - protein, 9 aa, Homo Sapiens
FSLAFPASS

SEQ ID NO: 920543 - protein, 9 aa, Homo Sapiens
VGQILHPLG

SEQ ID NO: 920544 - protein, 9 aa, Homo Sapiens
FQEALGPGK

SEQ ID NO: 920545 - protein, 9 aa, Homo Sapiens
AVPQPGISS

SEQ ID NO: 920546 - protein, 9 aa, Homo Sapiens
PPFMRNKQV

SEQ ID NO: 920547 - protein, 9 aa, Homo Sapiens
PYTVGMGSP

SEQ ID NO: 920548 - protein, 9 aa, Homo Sapiens
GSCCSEAIK

SEQ ID NO: 920549 - protein, 9 aa, Homo Sapiens
QDKLARLQN

SEQ ID NO: 920550 - protein, 9 aa, Homo Sapiens
QGRTPHCEP

SEQ ID NO: 920551 - protein, 9 aa, Homo Sapiens
SDDENGCPI

SEQ ID NO: 920552 - protein, 9 aa, Homo Sapiens
GRLHSHCPR

SEQ ID NO: 920553 - protein, 9 aa, Homo Sapiens
WEKELVNVK

SEQ ID NO: 920554 - protein, 9 aa, Homo Sapiens
SGGLLVCGD

SEQ ID NO: 920555 - protein, 9 aa, Homo Sapiens
SIDRLFMDF

SEQ ID NO: 920556 - protein, 9 aa, Homo Sapiens
EKYEREAKK

SEQ ID NO: 920557 - protein, 9 aa, Homo Sapiens
ARGHIEPDP

SEQ ID NO: 920558 - protein, 9 aa, Homo Sapiens
GMFSLYSYY

SEQ ID NO: 920559 - protein, 9 aa, Homo Sapiens
TLSAAVDPD

SEQ ID NO: 920560 - protein, 9 aa, Homo Sapiens
IQMAHKKIK

SEQ ID NO: 920561 - protein, 9 aa, Homo Sapiens
TFITENLGH

SEQ ID NO: 920562 - protein, 9 aa, Homo Sapiens
HNFFDQFFA

SEQ ID NO: 920563 - protein, 9 aa, Homo Sapiens
PFGFVPDEH

SEQ ID NO: 920564 - protein, 9 aa, Homo Sapiens
PQRGAFPRL

SEQ ID NO: 920565 - protein, 9 aa, Homo Sapiens
MAHKKIKEK

SEQ ID NO: 920566 - protein, 9 aa, Homo Sapiens
VIQMAHKKI

SEQ ID NO: 920567 - protein, 9 aa, Homo Sapiens
LLKRQACGQ

SEQ ID NO: 920568 - protein, 9 aa, Homo Sapiens
ERDRHSLFG

SEQ ID NO: 920569 - protein, 9 aa, Homo Sapiens
SIYHQNNPW

SEQ ID NO: 920570 - protein, 9 aa, Homo Sapiens
RLEVQKREL

SEQ ID NO: 920571 - protein, 9 aa, Homo Sapiens
IPHQESWGS

SEQ ID NO: 920572 - protein, 9 aa, Homo Sapiens
AASAPGCCP

SEQ ID NO: 920573 - protein, 9 aa, Homo Sapiens
ERGTSGLPG

SEQ ID NO: 920574 - protein, 9 aa, Homo Sapiens
YLKNLDKED

SEQ ID NO: 920575 - protein, 9 aa, Homo Sapiens
TQLYKVYKL

SEQ ID NO: 920576 - protein, 9 aa, Homo Sapiens
SPPRHLSCD

SEQ ID NO: 920577 - protein, 9 aa, Homo Sapiens
RLGKELQVT

SEQ ID NO: 920578 - protein, 9 aa, Homo Sapiens
SKEKPQTLP

SEQ ID NO: 920579 - protein, 9 aa, Homo Sapiens
RSFSIEDAI

SEQ ID NO: 920580 - protein, 9 aa, Homo Sapiens
LLLQTKNSF

SEQ ID NO: 920581 - protein, 9 aa, Homo Sapiens
VSLGINICH

SEQ ID NO: 920582 - protein, 9 aa, Homo Sapiens
AALKALDEL

SEQ ID NO: 920583 - protein, 9 aa, Homo Sapiens
GKVAAMANN

SEQ ID NO: 920584 - protein, 9 aa, Homo Sapiens
DLNEKIALQ

SEQ ID NO: 920585 - protein, 9 aa, Homo Sapiens
GASSLSSQP

SEQ ID NO: 920586 - protein, 9 aa, Homo Sapiens
KANALPAPP

SEQ ID NO: 920587 - protein, 9 aa, Homo Sapiens
LTDFILLGF

SEQ ID NO: 920588 - protein, 9 aa, Homo Sapiens
KPTRWGWND

SEQ ID NO: 920589 - protein, 9 aa, Homo Sapiens
KAALKALDE

SEQ ID NO: 920590 - protein, 9 aa, Homo Sapiens
CKPKVAPKP

SEQ ID NO: 920591 - protein, 9 aa, Homo Sapiens
KVEKIQISE

SEQ ID NO: 920592 - protein, 9 aa, Homo Sapiens
LHSHCPRHC

SEQ ID NO: 920593 - protein, 9 aa, Homo Sapiens
TREPRKRLL

SEQ ID NO: 920594 - protein, 9 aa, Homo Sapiens
IDRLFMDFA

SEQ ID NO: 920595 - protein, 9 aa, Homo Sapiens
YNQTLTDFI

SEQ ID NO: 920596 - protein, 9 aa, Homo Sapiens
SCARMAASI

SEQ ID NO: 920597 - protein, 9 aa, Homo Sapiens
TLSYLPTQQ

SEQ ID NO: 920598 - protein, 9 aa, Homo Sapiens
ISIMLHKLI

SEQ ID NO: 920599 - protein, 9 aa, Homo Sapiens
HFPTLKLVF

SEQ ID NO: 920600 - protein, 9 aa, Homo Sapiens
VKEYRNQFS

SEQ ID NO: 920601 - protein, 9 aa, Homo Sapiens
PDKDAVERQ

SEQ ID NO: 920602 - protein, 9 aa, Homo Sapiens
PMSFRPKIL

SEQ ID NO: 920603 - protein, 9 aa, Homo Sapiens
VCAENKGIP

SEQ ID NO: 920604 - protein, 9 aa, Homo Sapiens
AAYKEKRRS

SEQ ID NO: 920605 - protein, 9 aa, Homo Sapiens
WKKLISTLI

SEQ ID NO: 920606 - protein, 9 aa, Homo Sapiens
GFSKLPRNP

SEQ ID NO: 920607 - protein, 9 aa, Homo Sapiens
TLLSGTFRV

SEQ ID NO: 920608 - protein, 9 aa, Homo Sapiens
SCDLDSLGS

SEQ ID NO: 920609 - protein, 9 aa, Homo Sapiens
KVSEGKNVL

SEQ ID NO: 920610 - protein, 9 aa, Homo Sapiens
QKDLENVTS

SEQ ID NO: 920611 - protein, 9 aa, Homo Sapiens
DLVRTASWQ

SEQ ID NO: 920612 - protein, 9 aa, Homo Sapiens
QQAQKAAVP

SEQ ID NO: 920613 - protein, 9 aa, Homo Sapiens
EYKIENVTR

SEQ ID NO: 920614 - protein, 9 aa, Homo Sapiens
QDISLPEGV

SEQ ID NO: 920615 - protein, 9 aa, Homo Sapiens
VDCMTSPEQ

SEQ ID NO: 920616 - protein, 9 aa, Homo Sapiens
KSKERKYPP

SEQ ID NO: 920617 - protein, 9 aa, Homo Sapiens
AELLKPGSL

SEQ ID NO: 920618 - protein, 9 aa, Homo Sapiens
FLCEGEKPK

SEQ ID NO: 920619 - protein, 9 aa, Homo Sapiens
QAQKAAVPS

SEQ ID NO: 920620 - protein, 9 aa, Homo Sapiens
FKADLSGIA

SEQ ID NO: 920621 - protein, 9 aa, Homo Sapiens
YQAEDTYVS

SEQ ID NO: 920622 - protein, 9 aa, Homo Sapiens
DHDSDGPPY

SEQ ID NO: 920623 - protein, 9 aa, Homo Sapiens
VHEVVVKAV

SEQ ID NO: 920624 - protein, 9 aa, Homo Sapiens
RHSHLTRAR

SEQ ID NO: 920625 - protein, 9 aa, Homo Sapiens
QLVVVAKLR

SEQ ID NO: 920626 - protein, 9 aa, Homo Sapiens
IENVTRMVV

SEQ ID NO: 920627 - protein, 9 aa, Homo Sapiens
MQIYGFKST

SEQ ID NO: 920628 - protein, 9 aa, Homo Sapiens
IDASFIGIV

SEQ ID NO: 920629 - protein, 9 aa, Homo Sapiens
DGFADWPPP

SEQ ID NO: 920630 - protein, 9 aa, Homo Sapiens
SAFYPENDD

SEQ ID NO: 920631 - protein, 9 aa, Homo Sapiens
QVSEGMDGF

SEQ ID NO: 920632 - protein, 9 aa, Homo Sapiens
FCHHSSNMN

SEQ ID NO: 920633 - protein, 9 aa, Homo Sapiens
RVELRGIEK

SEQ ID NO: 920634 - protein, 9 aa, Homo Sapiens
IEKFTNYSV

SEQ ID NO: 920635 - protein, 9 aa, Homo Sapiens
TLAVREGNP

SEQ ID NO: 920636 - protein, 9 aa, Homo Sapiens
ETREPRKRL

SEQ ID NO: 920637 - protein, 9 aa, Homo Sapiens
IVRSFSIED

SEQ ID NO: 920638 - protein, 9 aa, Homo Sapiens
MFSLYSYYR

SEQ ID NO: 920639 - protein, 9 aa, Homo Sapiens
RTLSPGACQ

SEQ ID NO: 920640 - protein, 9 aa, Homo Sapiens
LEKTNLGHA

SEQ ID NO: 920641 - protein, 9 aa, Homo Sapiens
SHKEKPDLE

SEQ ID NO: 920642 - protein, 9 aa, Homo Sapiens
DSRDGWGSY

SEQ ID NO: 920643 - protein, 9 aa, Homo Sapiens
KGGAQGAWG

SEQ ID NO: 920644 - protein, 9 aa, Homo Sapiens
TEAPGDNRV

SEQ ID NO: 920645 - protein, 9 aa, Homo Sapiens
PTKMDVQVR

SEQ ID NO: 920646 - protein, 9 aa, Homo Sapiens
KEKRRSEAP

SEQ ID NO: 920647 - protein, 9 aa, Homo Sapiens
LSYLPTQQD

SEQ ID NO: 920648 - protein, 9 aa, Homo Sapiens
KESSEDEGE

SEQ ID NO: 920649 - protein, 9 aa, Homo Sapiens
FQMLNMNLA

SEQ ID NO: 920650 - protein, 9 aa, Homo Sapiens
PFMRNKQVA

SEQ ID NO: 920651 - protein, 9 aa, Homo Sapiens
YKVYKLDFL

SEQ ID NO: 920652 - protein, 9 aa, Homo Sapiens
TLKLVFRNE

SEQ ID NO: 920653 - protein, 9 aa, Homo Sapiens
TKFCQSQPS

SEQ ID NO: 920654 - protein, 9 aa, Homo Sapiens
KLHNDHYFI

SEQ ID NO: 920655 - protein, 9 aa, Homo Sapiens
IEYTLLNLL

SEQ ID NO: 920656 - protein, 9 aa, Homo Sapiens
PRHLSCDSF

SEQ ID NO: 920657 - protein, 9 aa, Homo Sapiens
TRTDEGRPS

SEQ ID NO: 920658 - protein, 9 aa, Homo Sapiens
SIKDALNLI

SEQ ID NO: 920659 - protein, 9 aa, Homo Sapiens
KPESFANVS

SEQ ID NO: 920660 - protein, 9 aa, Homo Sapiens
DKKKVEKIQ

SEQ ID NO: 920661 - protein, 9 aa, Homo Sapiens
VSTKKVGEE

SEQ ID NO: 920662 - protein, 9 aa, Homo Sapiens
LESNKSLRV

SEQ ID NO: 920663 - protein, 9 aa, Homo Sapiens
KGHQVKTQA

SEQ ID NO: 920664 - protein, 9 aa, Homo Sapiens
ESNKSLRVL

SEQ ID NO: 920665 - protein, 9 aa, Homo Sapiens
ASFIGIVQP

SEQ ID NO: 920666 - protein, 9 aa, Homo Sapiens
TYGQKVSME

SEQ ID NO: 920667 - protein, 9 aa, Homo Sapiens
AVVRQCTSK

SEQ ID NO: 920668 - protein, 9 aa, Homo Sapiens
LYLKNLDKE

SEQ ID NO: 920669 - protein, 9 aa, Homo Sapiens
PRTLSPGAC

SEQ ID NO: 920670 - protein, 9 aa, Homo Sapiens
RDKGAKTKK

SEQ ID NO: 920671 - protein, 9 aa, Homo Sapiens
DRSATKMSG

SEQ ID NO: 920672 - protein, 9 aa, Homo Sapiens
SWGSSQHIL

SEQ ID NO: 920673 - protein, 9 aa, Homo Sapiens
VCTIAKVSF

SEQ ID NO: 920674 - protein, 9 aa, Homo Sapiens
SALSCFLSA

SEQ ID NO: 920675 - protein, 9 aa, Homo Sapiens
IGQFLYSEE

SEQ ID NO: 920676 - protein, 9 aa, Homo Sapiens
ENMVLSPCT

SEQ ID NO: 920677 - protein, 9 aa, Homo Sapiens
FSHKEKPDL

SEQ ID NO: 920678 - protein, 9 aa, Homo Sapiens
VVHSGSGVI

SEQ ID NO: 920679 - protein, 9 aa, Homo Sapiens
RILYSEQKG

SEQ ID NO: 920680 - protein, 9 aa, Homo Sapiens
ALSQSSIGS

SEQ ID NO: 920681 - protein, 9 aa, Homo Sapiens
YWLCYINNT

SEQ ID NO: 920682 - protein, 9 aa, Homo Sapiens
LYSATKIGK

SEQ ID NO: 920683 - protein, 9 aa, Homo Sapiens
LARLQNTLE

SEQ ID NO: 920684 - protein, 9 aa, Homo Sapiens
SLSSQPLSG

SEQ ID NO: 920685 - protein, 9 aa, Homo Sapiens
DNIAKYFSK

SEQ ID NO: 920686 - protein, 9 aa, Homo Sapiens
IIVLTLDYI

SEQ ID NO: 920687 - protein, 9 aa, Homo Sapiens
NKSDDENGC

SEQ ID NO: 920688 - protein, 9 aa, Homo Sapiens
GERGTSGLP

SEQ ID NO: 920689 - protein, 9 aa, Homo Sapiens
ELEDLKIRP

SEQ ID NO: 920690 - protein, 9 aa, Homo Sapiens
WTVWNFSQV

SEQ ID NO: 920691 - protein, 9 aa, Homo Sapiens
TVFYGTDSG

SEQ ID NO: 920692 - protein, 9 aa, Homo Sapiens
KQADTIDRY

SEQ ID NO: 920693 - protein, 9 aa, Homo Sapiens
PKSSQTKFC

SEQ ID NO: 920694 - protein, 9 aa, Homo Sapiens
FFNIEALPA

SEQ ID NO: 920695 - protein, 9 aa, Homo Sapiens
ECRTPVFFN

SEQ ID NO: 920696 - protein, 9 aa, Homo Sapiens
SPESGGPEA

SEQ ID NO: 920697 - protein, 9 aa, Homo Sapiens
PPSPKDISM

SEQ ID NO: 920698 - protein, 9 aa, Homo Sapiens
CQLVVVAKL

SEQ ID NO: 920699 - protein, 9 aa, Homo Sapiens
EDSSAGKVS

SEQ ID NO: 920700 - protein, 9 aa, Homo Sapiens
GLKSKEILS

SEQ ID NO: 920701 - protein, 9 aa, Homo Sapiens
AFILNMPLV

SEQ ID NO: 920702 - protein, 9 aa, Homo Sapiens
IYRKLTVKR

SEQ ID NO: 920703 - protein, 9 aa, Homo Sapiens
VHSIHTEAV

SEQ ID NO: 920704 - protein, 9 aa, Homo Sapiens
NSRNENPAP

SEQ ID NO: 920705 - protein, 9 aa, Homo Sapiens
QGQQGLAIF

SEQ ID NO: 920706 - protein, 9 aa, Homo Sapiens
IEALIFLFY

SEQ ID NO: 920707 - protein, 9 aa, Homo Sapiens
GALAAIFAY

SEQ ID NO: 920708 - protein, 9 aa, Homo Sapiens
RRGPQSLPP

SEQ ID NO: 920709 - protein, 9 aa, Homo Sapiens
TANQGRNLS

SEQ ID NO: 920710 - protein, 9 aa, Homo Sapiens
ASIRKLLLQ

SEQ ID NO: 920711 - protein, 9 aa, Homo Sapiens
KNVLLLVHN

SEQ ID NO: 920712 - protein, 9 aa, Homo Sapiens
FEGLFFLQL

SEQ ID NO: 920713 - protein, 9 aa, Homo Sapiens
DFDFFPMSD

SEQ ID NO: 920714 - protein, 9 aa, Homo Sapiens
ACESARKYK

SEQ ID NO: 920715 - protein, 9 aa, Homo Sapiens
PKQQAQKAA

SEQ ID NO: 920716 - protein, 9 aa, Homo Sapiens
ADYGGFQEH

SEQ ID NO: 920717 - protein, 9 aa, Homo Sapiens
TPSHGDRPL

SEQ ID NO: 920718 - protein, 9 aa, Homo Sapiens
FSVSPQVVY

SEQ ID NO: 920719 - protein, 9 aa, Homo Sapiens
IEITCALDE

SEQ ID NO: 920720 - protein, 9 aa, Homo Sapiens
LALSQSSIG

SEQ ID NO: 920721 - protein, 9 aa, Homo Sapiens
ESFANVSID

SEQ ID NO: 920722 - protein, 9 aa, Homo Sapiens
LALSQSSIA

SEQ ID NO: 920723 - protein, 9 aa, Homo Sapiens
PHRVTAGEG

SEQ ID NO: 920724 - protein, 9 aa, Homo Sapiens
LVQRQLVDI

SEQ ID NO: 920725 - protein, 9 aa, Homo Sapiens
YFFPWMLAY

SEQ ID NO: 920726 - protein, 9 aa, Homo Sapiens
LEDLKIRPR

SEQ ID NO: 920727 - protein, 9 aa, Homo Sapiens
TRWGWNDVI

SEQ ID NO: 920728 - protein, 9 aa, Homo Sapiens
TPWGSKMLF

SEQ ID NO: 920729 - protein, 9 aa, Homo Sapiens
LKIRPRVSY

SEQ ID NO: 920730 - protein, 9 aa, Homo Sapiens
ADRSATKMS

SEQ ID NO: 920731 - protein, 9 aa, Homo Sapiens
SEQKGRVAI

SEQ ID NO: 920732 - protein, 9 aa, Homo Sapiens
VRKAIHALS

SEQ ID NO: 920733 - protein, 9 aa, Homo Sapiens
WEVTAEFQE

SEQ ID NO: 920734 - protein, 9 aa, Homo Sapiens
FKVLDALEL

SEQ ID NO: 920735 - protein, 9 aa, Homo Sapiens
GGRPSGEPG

SEQ ID NO: 920736 - protein, 9 aa, Homo Sapiens
LVRTASWQE

SEQ ID NO: 920737 - protein, 9 aa, Homo Sapiens
EKIEIPDLE

SEQ ID NO: 920738 - protein, 9 aa, Homo Sapiens
MLFGELMFE

SEQ ID NO: 920739 - protein, 9 aa, Homo Sapiens
IKFENTYLE

SEQ ID NO: 920740 - protein, 9 aa, Homo Sapiens
AEDTYVSTS

SEQ ID NO: 920741 - protein, 9 aa, Homo Sapiens
PLPSFFPGL

SEQ ID NO: 920742 - protein, 9 aa, Homo Sapiens
RKLTVKRPT

SEQ ID NO: 920743 - protein, 9 aa, Homo Sapiens
HRLDLSALY

SEQ ID NO: 920744 - protein, 9 aa, Homo Sapiens
SGHLQILKW

SEQ ID NO: 920745 - protein, 9 aa, Homo Sapiens
LNLIKAVHV

SEQ ID NO: 920746 - protein, 9 aa, Homo Sapiens
GKELMQIAR

SEQ ID NO: 920747 - protein, 9 aa, Homo Sapiens
DENGCPIPP

SEQ ID NO: 920748 - protein, 9 aa, Homo Sapiens
VVASLLKRQ

SEQ ID NO: 920749 - protein, 9 aa, Homo Sapiens
RPSGEPGGP

SEQ ID NO: 920750 - protein, 9 aa, Homo Sapiens
LPRRAAPTR

SEQ ID NO: 920751 - protein, 9 aa, Homo Sapiens
LVYCRKKKG

SEQ ID NO: 920752 - protein, 9 aa, Homo Sapiens
DALELQDDF

SEQ ID NO: 920753 - protein, 9 aa, Homo Sapiens
VPQRLRPPG

SEQ ID NO: 920754 - protein, 9 aa, Homo Sapiens
IYAGKKFYK

SEQ ID NO: 920755 - protein, 9 aa, Homo Sapiens
TAEFQEALG

SEQ ID NO: 920756 - protein, 9 aa, Homo Sapiens
FSQAIEVET

SEQ ID NO: 920757 - protein, 9 aa, Homo Sapiens
ALLKVYDQM

SEQ ID NO: 920758 - protein, 9 aa, Homo Sapiens
SLLEKTNLG

SEQ ID NO: 920759 - protein, 9 aa, Homo Sapiens
IPKDRQKRK

SEQ ID NO: 920760 - protein, 9 aa, Homo Sapiens
KLYECAICQ

SEQ ID NO: 920761 - protein, 9 aa, Homo Sapiens
PAQRLVSWI

SEQ ID NO: 920762 - protein, 9 aa, Homo Sapiens
PKFLKKFHD

SEQ ID NO: 920763 - protein, 9 aa, Homo Sapiens
SLSEARFPR

SEQ ID NO: 920764 - protein, 9 aa, Homo Sapiens
QTANQGRNL

SEQ ID NO: 920765 - protein, 9 aa, Homo Sapiens
GLFFLQLLL

SEQ ID NO: 920766 - protein, 9 aa, Homo Sapiens
LCDFFEISM

SEQ ID NO: 920767 - protein, 9 aa, Homo Sapiens
PLQGRTPHC

SEQ ID NO: 920768 - protein, 9 aa, Homo Sapiens
DKCTHSSFI

SEQ ID NO: 920769 - protein, 9 aa, Homo Sapiens
GSYCKGRGK

SEQ ID NO: 920770 - protein, 9 aa, Homo Sapiens
IIYTGKKPY

SEQ ID NO: 920771 - protein, 9 aa, Homo Sapiens
IVLAIGNLV

SEQ ID NO: 920772 - protein, 9 aa, Homo Sapiens
ADHDSDGPP

SEQ ID NO: 920773 - protein, 9 aa, Homo Sapiens
MDGFADWPP

SEQ ID NO: 920774 - protein, 9 aa, Homo Sapiens
RTLPRRAAP

SEQ ID NO: 920775 - protein, 9 aa, Homo Sapiens
DKSDDSDFS

SEQ ID NO: 920776 - protein, 9 aa, Homo Sapiens
QSSIALPQG

SEQ ID NO: 920777 - protein, 9 aa, Homo Sapiens
SMLTAGKGV

SEQ ID NO: 920778 - protein, 9 aa, Homo Sapiens
RSQGRLEVQ

SEQ ID NO: 920779 - protein, 9 aa, Homo Sapiens
QNVCAENKG

SEQ ID NO: 920780 - protein, 9 aa, Homo Sapiens
SIRKLLLQL

SEQ ID NO: 920781 - protein, 9 aa, Homo Sapiens
ETTTIDASF

SEQ ID NO: 920782 - protein, 9 aa, Homo Sapiens
KCQSSAITL

SEQ ID NO: 920783 - protein, 9 aa, Homo Sapiens
GGFQEHVYE

SEQ ID NO: 920784 - protein, 9 aa, Homo Sapiens
VSLEAFFVF

SEQ ID NO: 920785 - protein, 9 aa, Homo Sapiens
VWAAVRGLC

SEQ ID NO: 920786 - protein, 9 aa, Homo Sapiens
ARLQGTSSY

SEQ ID NO: 920787 - protein, 9 aa, Homo Sapiens
SHQGAAPHR

SEQ ID NO: 920788 - protein, 9 aa, Homo Sapiens
EKSVGDEDI

SEQ ID NO: 920789 - protein, 9 aa, Homo Sapiens
FLKKFHDNE

SEQ ID NO: 920790 - protein, 9 aa, Homo Sapiens
LKRDADLLN

SEQ ID NO: 920791 - protein, 9 aa, Homo Sapiens
GLELRRAEF

SEQ ID NO: 920792 - protein, 9 aa, Homo Sapiens
EKPGKPGSP

SEQ ID NO: 920793 - protein, 9 aa, Homo Sapiens
SSIYHQNNP

SEQ ID NO: 920794 - protein, 9 aa, Homo Sapiens
LRTLLLVFL

SEQ ID NO: 920795 - protein, 9 aa, Homo Sapiens
VDRIATLSY

SEQ ID NO: 920796 - protein, 9 aa, Homo Sapiens
IDYQAEDTY

SEQ ID NO: 920797 - protein, 9 aa, Homo Sapiens
KDLENVTSK

SEQ ID NO: 920798 - protein, 9 aa, Homo Sapiens
ENDDYFFAA

SEQ ID NO: 920799 - protein, 9 aa, Homo Sapiens
LCSVSCGAG

SEQ ID NO: 920800 - protein, 9 aa, Homo Sapiens
TVGQILHPL

SEQ ID NO: 920801 - protein, 9 aa, Homo Sapiens
VELRGIEKF

SEQ ID NO: 920802 - protein, 9 aa, Homo Sapiens
IREHAQLSS

SEQ ID NO: 920803 - protein, 9 aa, Homo Sapiens
KSFPESPLQ

SEQ ID NO: 920804 - protein, 9 aa, Homo Sapiens
PGDNRVCSA

SEQ ID NO: 920805 - protein, 9 aa, Homo Sapiens
PLPGGGCVT

SEQ ID NO: 920806 - protein, 9 aa, Homo Sapiens
NQPPHGVSQ

SEQ ID NO: 920807 - protein, 9 aa, Homo Sapiens
GPGSTEGMK

SEQ ID NO: 920808 - protein, 9 aa, Homo Sapiens
SKNLLFSIV

SEQ ID NO: 920809 - protein, 9 aa, Homo Sapiens
SPSCPAIIF

SEQ ID NO: 920810 - protein, 9 aa, Homo Sapiens
SYSADTPEA

SEQ ID NO: 920811 - protein, 9 aa, Homo Sapiens
AAEGHYTVF

SEQ ID NO: 920812 - protein, 9 aa, Homo Sapiens
SLLFAVHSI

SEQ ID NO: 920813 - protein, 9 aa, Homo Sapiens
KIYAGKKFY

SEQ ID NO: 920814 - protein, 9 aa, Homo Sapiens
NFEKENKYL

SEQ ID NO: 920815 - protein, 9 aa, Homo Sapiens
PHTVLKLLE

SEQ ID NO: 920816 - protein, 9 aa, Homo Sapiens
ATVQRLPLG

SEQ ID NO: 920817 - protein, 9 aa, Homo Sapiens
GAWPGASSL

SEQ ID NO: 920818 - protein, 9 aa, Homo Sapiens
EGHYTVFYG

SEQ ID NO: 920819 - protein, 9 aa, Homo Sapiens
ACKLLTCDV

SEQ ID NO: 920820 - protein, 9 aa, Homo Sapiens
RSLKALREY

SEQ ID NO: 920821 - protein, 9 aa, Homo Sapiens
HVFLCEGEK

SEQ ID NO: 920822 - protein, 9 aa, Homo Sapiens
GPTEPLPFL

SEQ ID NO: 920823 - protein, 9 aa, Homo Sapiens
SYCKGRGKN

SEQ ID NO: 920824 - protein, 9 aa, Homo Sapiens
LNEELIQKE

SEQ ID NO: 920825 - protein, 9 aa, Homo Sapiens
KFSGNPWPP

SEQ ID NO: 920826 - protein, 9 aa, Homo Sapiens
DTRDLEEYD

SEQ ID NO: 920827 - protein, 9 aa, Homo Sapiens
KIEIPDLEL

SEQ ID NO: 920828 - protein, 9 aa, Homo Sapiens
NYLKIFLQH

SEQ ID NO: 920829 - protein, 9 aa, Homo Sapiens
ILHPLGWLV

SEQ ID NO: 920830 - protein, 9 aa, Homo Sapiens
EPLPFLPPA

SEQ ID NO: 920831 - protein, 9 aa, Homo Sapiens
DRLFMDFAT

SEQ ID NO: 920832 - protein, 9 aa, Homo Sapiens
SQVDVKGPK

SEQ ID NO: 920833 - protein, 9 aa, Homo Sapiens
LGLYGPKKK

SEQ ID NO: 920834 - protein, 9 aa, Homo Sapiens
GFLILGLVP

SEQ ID NO: 920835 - protein, 9 aa, Homo Sapiens
LKDVSWTSP

SEQ ID NO: 920836 - protein, 9 aa, Homo Sapiens
QVVYTAMLD

SEQ ID NO: 920837 - protein, 9 aa, Homo Sapiens
VASMPEDSA

SEQ ID NO: 920838 - protein, 9 aa, Homo Sapiens
AYARVPSKN

SEQ ID NO: 920839 - protein, 9 aa, Homo Sapiens
RLQNTLELN

SEQ ID NO: 920840 - protein, 9 aa, Homo Sapiens
STLSRHWRI

SEQ ID NO: 920841 - protein, 9 aa, Homo Sapiens
AGMTSLSGG

SEQ ID NO: 920842 - protein, 9 aa, Homo Sapiens
AKASIILGQ

SEQ ID NO: 920843 - protein, 9 aa, Homo Sapiens
PEFYNISQG

SEQ ID NO: 920844 - protein, 9 aa, Homo Sapiens
MDALINSWA

SEQ ID NO: 920845 - protein, 9 aa, Homo Sapiens
YENEEKVSL

SEQ ID NO: 920846 - protein, 9 aa, Homo Sapiens
HPPFAELLK

SEQ ID NO: 920847 - protein, 9 aa, Homo Sapiens
FEKENKYLK

SEQ ID NO: 920848 - protein, 9 aa, Homo Sapiens
SPGQDISLP

SEQ ID NO: 920849 - protein, 9 aa, Homo Sapiens
SFIGIVQPE

SEQ ID NO: 920850 - protein, 9 aa, Homo Sapiens
RGAFPRLWD

SEQ ID NO: 920851 - protein, 9 aa, Homo Sapiens
FIEDLALGR

SEQ ID NO: 920852 - protein, 9 aa, Homo Sapiens
GKELQVTTV

SEQ ID NO: 920853 - protein, 9 aa, Homo Sapiens
NEKIALQPG

SEQ ID NO: 920854 - protein, 9 aa, Homo Sapiens
VRQCTSKST

SEQ ID NO: 920855 - protein, 9 aa, Homo Sapiens
LHNDHYFIK

SEQ ID NO: 920856 - protein, 9 aa, Homo Sapiens
PRLGKELQV

SEQ ID NO: 920857 - protein, 9 aa, Homo Sapiens
PESGGPEAQ

SEQ ID NO: 920858 - protein, 9 aa, Homo Sapiens
GLVEKKEMG

SEQ ID NO: 920859 - protein, 9 aa, Homo Sapiens
NTGLYWCMA

SEQ ID NO: 920860 - protein, 9 aa, Homo Sapiens
LKSKEILSP

SEQ ID NO: 920861 - protein, 9 aa, Homo Sapiens
LRPPGPDLD

SEQ ID NO: 920862 - protein, 9 aa, Homo Sapiens
VEKIQISEM

SEQ ID NO: 920863 - protein, 9 aa, Homo Sapiens
LTLDYILRR

SEQ ID NO: 920864 - protein, 9 aa, Homo Sapiens
IPRPPPPRL

SEQ ID NO: 920865 - protein, 9 aa, Homo Sapiens
EGGIDYQAE

SEQ ID NO: 920866 - protein, 9 aa, Homo Sapiens
PLPFLPPAG

SEQ ID NO: 920867 - protein, 9 aa, Homo Sapiens
PFSQLTSVF

SEQ ID NO: 920868 - protein, 9 aa, Homo Sapiens
KVSLEAFFV

SEQ ID NO: 920869 - protein, 9 aa, Homo Sapiens
SEGCEKVRV

SEQ ID NO: 920870 - protein, 9 aa, Homo Sapiens
NENPAPKIT

SEQ ID NO: 920871 - protein, 9 aa, Homo Sapiens
KKLHNDHYF

SEQ ID NO: 920872 - protein, 9 aa, Homo Sapiens
IKSAMSTID

SEQ ID NO: 920873 - protein, 9 aa, Homo Sapiens
VLLLSALEL

SEQ ID NO: 920874 - protein, 9 aa, Homo Sapiens
YRISLETNN

SEQ ID NO: 920875 - protein, 9 aa, Homo Sapiens
FADWPPPQE

SEQ ID NO: 920876 - protein, 9 aa, Homo Sapiens
VCSDTRDLE

SEQ ID NO: 920877 - protein, 9 aa, Homo Sapiens
DAVPQPGIS

SEQ ID NO: 920878 - protein, 9 aa, Homo Sapiens
SAPPSPKDI

SEQ ID NO: 920879 - protein, 9 aa, Homo Sapiens
TSGLPGPKG

SEQ ID NO: 920880 - protein, 9 aa, Homo Sapiens
LNKHKKIYA

SEQ ID NO: 920881 - protein, 9 aa, Homo Sapiens
HGLGIFQRC

SEQ ID NO: 920882 - protein, 9 aa, Homo Sapiens
SAAVDPDVG

SEQ ID NO: 920883 - protein, 9 aa, Homo Sapiens
DSDGPPYDT

SEQ ID NO: 920884 - protein, 9 aa, Homo Sapiens
SARCACSCD

SEQ ID NO: 920885 - protein, 9 aa, Homo Sapiens
SPTDILIFW

SEQ ID NO: 920886 - protein, 9 aa, Homo Sapiens
RLPLGQKVI

SEQ ID NO: 920887 - protein, 9 aa, Homo Sapiens
EPPKQQAQK

SEQ ID NO: 920888 - protein, 9 aa, Homo Sapiens
SHLTRARRC

SEQ ID NO: 920889 - protein, 9 aa, Homo Sapiens
HLSCDSFSL

SEQ ID NO: 920890 - protein, 9 aa, Homo Sapiens
NAVCQSRTS

SEQ ID NO: 920891 - protein, 9 aa, Homo Sapiens
RLDLSALYS

SEQ ID NO: 920892 - protein, 9 aa, Homo Sapiens
EPGQDETVR

SEQ ID NO: 920893 - protein, 9 aa, Homo Sapiens
AIFAYWFTH

SEQ ID NO: 920894 - protein, 9 aa, Homo Sapiens
ELCDFFEIS

SEQ ID NO: 920895 - protein, 9 aa, Homo Sapiens
WCMAANTAG

SEQ ID NO: 920896 - protein, 9 aa, Homo Sapiens
ARGNNSNGR

SEQ ID NO: 920897 - protein, 9 aa, Homo Sapiens
GSARCACSC

SEQ ID NO: 920898 - protein, 9 aa, Homo Sapiens
TKMDVQVRR

SEQ ID NO: 920899 - protein, 9 aa, Homo Sapiens
KMSGRGSVL

SEQ ID NO: 920900 - protein, 9 aa, Homo Sapiens
LSKSFPESP

SEQ ID NO: 920901 - protein, 9 aa, Homo Sapiens
VRTASWQET

SEQ ID NO: 920902 - protein, 9 aa, Homo Sapiens
AGTLLSGTF

SEQ ID NO: 920903 - protein, 9 aa, Homo Sapiens
LMEEGDKFE

SEQ ID NO: 920904 - protein, 9 aa, Homo Sapiens
DPNMADNED

SEQ ID NO: 920905 - protein, 9 aa, Homo Sapiens
KKIGSTVKI

SEQ ID NO: 920906 - protein, 9 aa, Homo Sapiens
KIPLPGGGC

SEQ ID NO: 920907 - protein, 9 aa, Homo Sapiens
RVTFITENL

SEQ ID NO: 920908 - protein, 9 aa, Homo Sapiens
GVWTVWNFS

SEQ ID NO: 920909 - protein, 9 aa, Homo Sapiens
PFCTDLGYH

SEQ ID NO: 920910 - protein, 9 aa, Homo Sapiens
VLNEVHEVV

SEQ ID NO: 920911 - protein, 9 aa, Homo Sapiens
VGMAKAALK

SEQ ID NO: 920912 - protein, 9 aa, Homo Sapiens
EELIQKESS

SEQ ID NO: 920913 - protein, 9 aa, Homo Sapiens
SLFEGLFFL

SEQ ID NO: 920914 - protein, 9 aa, Homo Sapiens
RDSRDGWGS

SEQ ID NO: 920915 - protein, 9 aa, Homo Sapiens
SFIEDLALG

SEQ ID NO: 920916 - protein, 9 aa, Homo Sapiens
AAPHRVTAG

SEQ ID NO: 920917 - protein, 9 aa, Homo Sapiens
CNEVALHAA

SEQ ID NO: 920918 - protein, 9 aa, Homo Sapiens
DIVILLNKE

SEQ ID NO: 920919 - protein, 9 aa, Homo Sapiens
RLGMHSPPP

SEQ ID NO: 920920 - protein, 9 aa, Homo Sapiens
LNWVVGPCV

SEQ ID NO: 920921 - protein, 9 aa, Homo Sapiens
GYTVGAKAS

SEQ ID NO: 920922 - protein, 9 aa, Homo Sapiens
GQKLYECAI

SEQ ID NO: 920923 - protein, 9 aa, Homo Sapiens
DCMEVAGQV

SEQ ID NO: 920924 - protein, 9 aa, Homo Sapiens
ARLLRASVA

SEQ ID NO: 920925 - protein, 9 aa, Homo Sapiens
DFFPMSDKN

SEQ ID NO: 920926 - protein, 9 aa, Homo Sapiens
QVADFQGND

SEQ ID NO: 920927 - protein, 9 aa, Homo Sapiens
CTHSSFIED

SEQ ID NO: 920928 - protein, 9 aa, Homo Sapiens
HDSDGPPYD

SEQ ID NO: 920929 - protein, 9 aa, Homo Sapiens
CNSRNENPA

SEQ ID NO: 920930 - protein, 9 aa, Homo Sapiens
LELRRAEFC

SEQ ID NO: 920931 - protein, 9 aa, Homo Sapiens
KSDDSDFSL

SEQ ID NO: 920932 - protein, 9 aa, Homo Sapiens
PPFAELLKP

SEQ ID NO: 920933 - protein, 9 aa, Homo Sapiens
DIIEALIFL

SEQ ID NO: 920934 - protein, 9 aa, Homo Sapiens
KKKIPWIQQ

SEQ ID NO: 920935 - protein, 9 aa, Homo Sapiens
EKLEMQLEE

SEQ ID NO: 920936 - protein, 9 aa, Homo Sapiens
KMIGQFLYS

SEQ ID NO: 920937 - protein, 9 aa, Homo Sapiens
STSYFFPWM

SEQ ID NO: 920938 - protein, 9 aa, Homo Sapiens
GTVGQILHP

SEQ ID NO: 920939 - protein, 9 aa, Homo Sapiens
PTGVWTVWN

SEQ ID NO: 920940 - protein, 9 aa, Homo Sapiens
MRNKQVADF

SEQ ID NO: 920941 - protein, 9 aa, Homo Sapiens
RNKQVADFQ

SEQ ID NO: 920942 - protein, 9 aa, Homo Sapiens
FPIENLYSA

SEQ ID NO: 920943 - protein, 9 aa, Homo Sapiens
VTSKEIRTE

SEQ ID NO: 920944 - protein, 9 aa, Homo Sapiens
SPKDISMEI

SEQ ID NO: 920945 - protein, 9 aa, Homo Sapiens
PVYTTLSQP

SEQ ID NO: 920946 - protein, 9 aa, Homo Sapiens
KKKNRETWY

SEQ ID NO: 920947 - protein, 9 aa, Homo Sapiens
IFSSEKLLA

SEQ ID NO: 920948 - protein, 9 aa, Homo Sapiens
GVMNYLKIF

SEQ ID NO: 920949 - protein, 9 aa, Homo Sapiens
DVEQRGDCA

SEQ ID NO: 920950 - protein, 9 aa, Homo Sapiens
TFNRSSILT

SEQ ID NO: 920951 - protein, 9 aa, Homo Sapiens
SEEEPFSQL

SEQ ID NO: 920952 - protein, 9 aa, Homo Sapiens
ITITVTNLG

SEQ ID NO: 920953 - protein, 9 aa, Homo Sapiens
FDASFYTYM

SEQ ID NO: 920954 - protein, 9 aa, Homo Sapiens
VSEGKNVLL

SEQ ID NO: 920955 - protein, 9 aa, Homo Sapiens
SQRLDGLKY

SEQ ID NO: 920956 - protein, 9 aa, Homo Sapiens
DNRVCSANG

SEQ ID NO: 920957 - protein, 9 aa, Homo Sapiens
LLIMGFLIL

SEQ ID NO: 920958 - protein, 9 aa, Homo Sapiens
KPSANDRVS

SEQ ID NO: 920959 - protein, 9 aa, Homo Sapiens
QQGLAIFTS

SEQ ID NO: 920960 - protein, 9 aa, Homo Sapiens
PFGCNECAL

SEQ ID NO: 920961 - protein, 9 aa, Homo Sapiens
QAFLRKSKA

SEQ ID NO: 920962 - protein, 9 aa, Homo Sapiens
LEEQPRGPP

SEQ ID NO: 920963 - protein, 9 aa, Homo Sapiens
SDFSLSEVL

SEQ ID NO: 920964 - protein, 9 aa, Homo Sapiens
FGVSQRLDG

SEQ ID NO: 920965 - protein, 9 aa, Homo Sapiens
LVLNEVHEV

SEQ ID NO: 920966 - protein, 9 aa, Homo Sapiens
HVCTIAKVS

SEQ ID NO: 920967 - protein, 9 aa, Homo Sapiens
QKKKHTPRR

SEQ ID NO: 920968 - protein, 9 aa, Homo Sapiens
LLQRSRLLE

SEQ ID NO: 920969 - protein, 9 aa, Homo Sapiens
FSGNPWPPY

SEQ ID NO: 920970 - protein, 9 aa, Homo Sapiens
KKIYAGKKF

SEQ ID NO: 920971 - protein, 9 aa, Homo Sapiens
KYPNTACKL

SEQ ID NO: 920972 - protein, 9 aa, Homo Sapiens
LKVYDQMPE

SEQ ID NO: 920973 - protein, 9 aa, Homo Sapiens
FPAFSLAFP

SEQ ID NO: 920974 - protein, 9 aa, Homo Sapiens
EEEPFSQLT

SEQ ID NO: 920975 - protein, 9 aa, Homo Sapiens
EDTYVSTSD

SEQ ID NO: 920976 - protein, 9 aa, Homo Sapiens
LVTVVRNLL

SEQ ID NO: 920977 - protein, 9 aa, Homo Sapiens
NFFDQFFAT

SEQ ID NO: 920978 - protein, 9 aa, Homo Sapiens
TLPRRAAPT

SEQ ID NO: 920979 - protein, 9 aa, Homo Sapiens
DLLKFDGWY

SEQ ID NO: 920980 - protein, 9 aa, Homo Sapiens
PFKVLDALE

SEQ ID NO: 920981 - protein, 9 aa, Homo Sapiens
KIVLAIGNL

SEQ ID NO: 920982 - protein, 9 aa, Homo Sapiens
CCFPFGFVP

SEQ ID NO: 920983 - protein, 9 aa, Homo Sapiens
TMKNDNFEK

SEQ ID NO: 920984 - protein, 9 aa, Homo Sapiens
SYRVTFITE

SEQ ID NO: 920985 - protein, 9 aa, Homo Sapiens
AAVRGLCSV

SEQ ID NO: 920986 - protein, 9 aa, Homo Sapiens
FPTEEKSVG

SEQ ID NO: 920987 - protein, 9 aa, Homo Sapiens
GSYGSDKRM

SEQ ID NO: 920988 - protein, 9 aa, Homo Sapiens
PTSRLKANA

SEQ ID NO: 920989 - protein, 9 aa, Homo Sapiens
TEGMKGAAG

SEQ ID NO: 920990 - protein, 9 aa, Homo Sapiens
AVMVLIAPR

SEQ ID NO: 920991 - protein, 9 aa, Homo Sapiens
TVTNLGTPR

SEQ ID NO: 920992 - protein, 9 aa, Homo Sapiens
SLGINICHP

SEQ ID NO: 920993 - protein, 9 aa, Homo Sapiens
FPRLWDIKV

SEQ ID NO: 920994 - protein, 9 aa, Homo Sapiens
ILYSEQKGR

SEQ ID NO: 920995 - protein, 9 aa, Homo Sapiens
GQKVSMEEM

SEQ ID NO: 920996 - protein, 9 aa, Homo Sapiens
IVLTLDYIL

SEQ ID NO: 920997 - protein, 9 aa, Homo Sapiens
MSFRPKILI

SEQ ID NO: 920998 - protein, 9 aa, Homo Sapiens
SSVLYGWSF

SEQ ID NO: 920999 - protein, 9 aa, Homo Sapiens
QKLLMGVLT

SEQ ID NO: 921000 - protein, 9 aa, Homo Sapiens
AEFCGGPSG

SEQ ID NO: 921001 - protein, 9 aa, Homo Sapiens
QRKPESFAN

SEQ ID NO: 921002 - protein, 9 aa, Homo Sapiens
DMEAEASTF

SEQ ID NO: 921003 - protein, 9 aa, Homo Sapiens
SSSLSKSFP

SEQ ID NO: 921004 - protein, 9 aa, Homo Sapiens
YPENDDYFF

SEQ ID NO: 921005 - protein, 9 aa, Homo Sapiens
THFWRDQFM

SEQ ID NO: 921006 - protein, 9 aa, Homo Sapiens
ALELQDDFY

SEQ ID NO: 921007 - protein, 9 aa, Homo Sapiens
HPMTEEFKI

SEQ ID NO: 921008 - protein, 9 aa, Homo Sapiens
KELQVTTVT

SEQ ID NO: 921009 - protein, 9 aa, Homo Sapiens
GKGGAQGAW

SEQ ID NO: 921010 - protein, 9 aa, Homo Sapiens
HTVLKLLEN

SEQ ID NO: 921011 - protein, 9 aa, Homo Sapiens
DMESDIILE

SEQ ID NO: 921012 - protein, 9 aa, Homo Sapiens
VADRLDPYS

SEQ ID NO: 921013 - protein, 9 aa, Homo Sapiens
RHSLFGQRH

SEQ ID NO: 921014 - protein, 9 aa, Homo Sapiens
VEQSSRWDC

SEQ ID NO: 921015 - protein, 9 aa, Homo Sapiens
YTLRTLPRR

SEQ ID NO: 921016 - protein, 9 aa, Homo Sapiens
EVAQRKPES

SEQ ID NO: 921017 - protein, 9 aa, Homo Sapiens
MKNDNFEKE

SEQ ID NO: 921018 - protein, 9 aa, Homo Sapiens
SGEPGGPFC

SEQ ID NO: 921019 - protein, 9 aa, Homo Sapiens
LVVVAKLRE

SEQ ID NO: 921020 - protein, 9 aa, Homo Sapiens
FRSLLEKTN

SEQ ID NO: 921021 - protein, 9 aa, Homo Sapiens
ADTIDRYYY

SEQ ID NO: 921022 - protein, 9 aa, Homo Sapiens
RTPHCEPCQ

SEQ ID NO: 921023 - protein, 9 aa, Homo Sapiens
EKPQTLPET

SEQ ID NO: 921024 - protein, 9 aa, Homo Sapiens
PAVSRAAAS

SEQ ID NO: 921025 - protein, 9 aa, Homo Sapiens
LPAVQTVAS

SEQ ID NO: 921026 - protein, 9 aa, Homo Sapiens
DQTANQGRN

SEQ ID NO: 921027 - protein, 9 aa, Homo Sapiens
CNECALGAT

SEQ ID NO: 921028 - protein, 9 aa, Homo Sapiens
WGPDLLPAS

SEQ ID NO: 921029 - protein, 9 aa, Homo Sapiens
PASGPTEPL

SEQ ID NO: 921030 - protein, 9 aa, Homo Sapiens
YLEACLDFI

SEQ ID NO: 921031 - protein, 9 aa, Homo Sapiens
LFGQRHLHT

SEQ ID NO: 921032 - protein, 9 aa, Homo Sapiens
ILCRTLSNV

SEQ ID NO: 921033 - protein, 9 aa, Homo Sapiens
TARLLRASV

SEQ ID NO: 921034 - protein, 9 aa, Homo Sapiens
KTSEKQSIW

SEQ ID NO: 921035 - protein, 9 aa, Homo Sapiens
MIGMFSLYS

SEQ ID NO: 921036 - protein, 9 aa, Homo Sapiens
GDFGLATEK

SEQ ID NO: 921037 - protein, 9 aa, Homo Sapiens
LSCDSFSLE

SEQ ID NO: 921038 - protein, 9 aa, Homo Sapiens
KPKVAPKPK

SEQ ID NO: 921039 - protein, 9 aa, Homo Sapiens
HLTTHKIIY

SEQ ID NO: 921040 - protein, 9 aa, Homo Sapiens
YTLSAAVDP

SEQ ID NO: 921041 - protein, 9 aa, Homo Sapiens
MADNEDLDL

SEQ ID NO: 921042 - protein, 9 aa, Homo Sapiens
IQISEMKVS

SEQ ID NO: 921043 - protein, 9 aa, Homo Sapiens
KSKEILSPV

SEQ ID NO: 921044 - protein, 9 aa, Homo Sapiens
IANICNEVA

SEQ ID NO: 921045 - protein, 9 aa, Homo Sapiens
LCRTLSNVE

SEQ ID NO: 921046 - protein, 9 aa, Homo Sapiens
IIECKPKVA

SEQ ID NO: 921047 - protein, 9 aa, Homo Sapiens
NPLSALDTE

SEQ ID NO: 921048 - protein, 9 aa, Homo Sapiens
VSAAVMVLI

SEQ ID NO: 921049 - protein, 9 aa, Homo Sapiens
NMNLAPTFI

SEQ ID NO: 921050 - protein, 9 aa, Homo Sapiens
RVSLGINIC

SEQ ID NO: 921051 - protein, 9 aa, Homo Sapiens
VALKGSQVD

SEQ ID NO: 921052 - protein, 9 aa, Homo Sapiens
DALNLIKAV

SEQ ID NO: 921053 - protein, 9 aa, Homo Sapiens
AKAALKALD

SEQ ID NO: 921054 - protein, 9 aa, Homo Sapiens
GPFCTDLGY

SEQ ID NO: 921055 - protein, 9 aa, Homo Sapiens
AASIRKLLL

SEQ ID NO: 921056 - protein, 9 aa, Homo Sapiens
SEGKNVLLL

SEQ ID NO: 921057 - protein, 9 aa, Homo Sapiens
QTKNSFKVL

SEQ ID NO: 921058 - protein, 9 aa, Homo Sapiens
LYSEQKGRV

SEQ ID NO: 921059 - protein, 9 aa, Homo Sapiens
LQKLLMGVL

SEQ ID NO: 921060 - protein, 9 aa, Homo Sapiens
CCKGGPDKD

SEQ ID NO: 921061 - protein, 9 aa, Homo Sapiens
SDDSDFSLS

SEQ ID NO: 921062 - protein, 9 aa, Homo Sapiens
CQGDSGGLL

SEQ ID NO: 921063 - protein, 9 aa, Homo Sapiens
VGAKASIIL

SEQ ID NO: 921064 - protein, 9 aa, Homo Sapiens
LKIFLQHAL

SEQ ID NO: 921065 - protein, 9 aa, Homo Sapiens
LYIRSTFIG

SEQ ID NO: 921066 - protein, 9 aa, Homo Sapiens
QRMYSKIIA

SEQ ID NO: 921067 - protein, 9 aa, Homo Sapiens
GQENDITLF

SEQ ID NO: 921068 - protein, 9 aa, Homo Sapiens
IYRISLETN

SEQ ID NO: 921069 - protein, 9 aa, Homo Sapiens
PGTVGQILH

SEQ ID NO: 921070 - protein, 9 aa, Homo Sapiens
SNTGLYWCM

SEQ ID NO: 921071 - protein, 9 aa, Homo Sapiens
LDSLGSYCK

SEQ ID NO: 921072 - protein, 9 aa, Homo Sapiens
VSANRTVDY

SEQ ID NO: 921073 - protein, 9 aa, Homo Sapiens
GLTQPLQGR

SEQ ID NO: 921074 - protein, 9 aa, Homo Sapiens
VREGNPGSA

SEQ ID NO: 921075 - protein, 9 aa, Homo Sapiens
LELKFSHKE

SEQ ID NO: 921076 - protein, 9 aa, Homo Sapiens
LALVVGTHF

SEQ ID NO: 921077 - protein, 9 aa, Homo Sapiens
WVWAAVRGL

SEQ ID NO: 921078 - protein, 9 aa, Homo Sapiens
PQSPDFETE

SEQ ID NO: 921079 - protein, 9 aa, Homo Sapiens
EALIFLFYG

SEQ ID NO: 921080 - protein, 9 aa, Homo Sapiens
LSPGACQAA

SEQ ID NO: 921081 - protein, 9 aa, Homo Sapiens
FFIILCRTL

SEQ ID NO: 921082 - protein, 9 aa, Homo Sapiens
RAAIYRISL

SEQ ID NO: 921083 - protein, 9 aa, Homo Sapiens
PRALGQEND

SEQ ID NO: 921084 - protein, 9 aa, Homo Sapiens
SVIQHFKFG

SEQ ID NO: 921085 - protein, 9 aa, Homo Sapiens
PKVSEGKNV

SEQ ID NO: 921086 - protein, 9 aa, Homo Sapiens
ALSLSEARF

SEQ ID NO: 921087 - protein, 9 aa, Homo Sapiens
PIYRKLTVK

SEQ ID NO: 921088 - protein, 9 aa, Homo Sapiens
KAGMTSLSG

SEQ ID NO: 921089 - protein, 9 aa, Homo Sapiens
NPELLVHPD

SEQ ID NO: 921090 - protein, 9 aa, Homo Sapiens
NKSLRVLKL

SEQ ID NO: 921091 - protein, 9 aa, Homo Sapiens
EVTAEFQEA

SEQ ID NO: 921092 - protein, 9 aa, Homo Sapiens
KPIYRKLTV

SEQ ID NO: 921093 - protein, 9 aa, Homo Sapiens
RSLLEKTNL

SEQ ID NO: 921094 - protein, 9 aa, Homo Sapiens
YRIQEPGLA

SEQ ID NO: 921095 - protein, 9 aa, Homo Sapiens
ISKGLESNK

SEQ ID NO: 921096 - protein, 9 aa, Homo Sapiens
KYEREAKKK

SEQ ID NO: 921097 - protein, 9 aa, Homo Sapiens
EIREHAQLS

SEQ ID NO: 921098 - protein, 9 aa, Homo Sapiens
GHQVKTQAL

SEQ ID NO: 921099 - protein, 9 aa, Homo Sapiens
EKKEMGLVL

SEQ ID NO: 921100 - protein, 9 aa, Homo Sapiens
AFYPENDDY

SEQ ID NO: 921101 - protein, 9 aa, Homo Sapiens
ESRSIDRLF

SEQ ID NO: 921102 - protein, 9 aa, Homo Sapiens
PVEKIEIPD

SEQ ID NO: 921103 - protein, 9 aa, Homo Sapiens
PYCRRNFIP

SEQ ID NO: 921104 - protein, 9 aa, Homo Sapiens
KALREYQGL

SEQ ID NO: 921105 - protein, 9 aa, Homo Sapiens
SGKFSGNPW

SEQ ID NO: 921106 - protein, 9 aa, Homo Sapiens
TSSNMQIYG

SEQ ID NO: 921107 - protein, 9 aa, Homo Sapiens
NDITLFVKA

SEQ ID NO: 921108 - protein, 9 aa, Homo Sapiens
FRPKILIVG

SEQ ID NO: 921109 - protein, 9 aa, Homo Sapiens
KAFILNMPL

SEQ ID NO: 921110 - protein, 9 aa, Homo Sapiens
LRNSMLTAG

SEQ ID NO: 921111 - protein, 9 aa, Homo Sapiens
VPQPGISSW

SEQ ID NO: 921112 - protein, 9 aa, Homo Sapiens
FGLATEKSR

SEQ ID NO: 921113 - protein, 9 aa, Homo Sapiens
RKTQIFLPI

SEQ ID NO: 921114 - protein, 9 aa, Homo Sapiens
ASKKKVKGS

SEQ ID NO: 921115 - protein, 9 aa, Homo Sapiens
TDEGRPSFV

SEQ ID NO: 921116 - protein, 9 aa, Homo Sapiens
ASSLSSQPL

SEQ ID NO: 921117 - protein, 9 aa, Homo Sapiens
KRPAPFDSS

SEQ ID NO: 921118 - protein, 9 aa, Homo Sapiens
STFQALEDF

SEQ ID NO: 921119 - protein, 9 aa, Homo Sapiens
LMEKDALQM

SEQ ID NO: 921120 - protein, 9 aa, Homo Sapiens
VREVLQKLL

SEQ ID NO: 921121 - protein, 9 aa, Homo Sapiens
CAENKGIPD

SEQ ID NO: 921122 - protein, 9 aa, Homo Sapiens
EEGDKFEKA

SEQ ID NO: 921123 - protein, 9 aa, Homo Sapiens
EFYNISQGY

SEQ ID NO: 921124 - protein, 9 aa, Homo Sapiens
TLLNLLGNK

SEQ ID NO: 921125 - protein, 9 aa, Homo Sapiens
DVLLFIPRF

SEQ ID NO: 921126 - protein, 9 aa, Homo Sapiens
ENDITLFVK

SEQ ID NO: 921127 - protein, 9 aa, Homo Sapiens
RLRPPGPDL

SEQ ID NO: 921128 - protein, 9 aa, Homo Sapiens
KKVKGSPSF

SEQ ID NO: 921129 - protein, 9 aa, Homo Sapiens
HSHLTRARR

SEQ ID NO: 921130 - protein, 9 aa, Homo Sapiens
TASPSSSSG

SEQ ID NO: 921131 - protein, 9 aa, Homo Sapiens
SLDHSVKRK

SEQ ID NO: 921132 - protein, 9 aa, Homo Sapiens
YTVFYGTDS

SEQ ID NO: 921133 - protein, 9 aa, Homo Sapiens
RNLLIVVDI

SEQ ID NO: 921134 - protein, 9 aa, Homo Sapiens
RTLLLVFLR

SEQ ID NO: 921135 - protein, 9 aa, Homo Sapiens
FITENLGHP

SEQ ID NO: 921136 - protein, 9 aa, Homo Sapiens
RIQEPGLAK

SEQ ID NO: 921137 - protein, 9 aa, Homo Sapiens
ILSPVDLEK

SEQ ID NO: 921138 - protein, 9 aa, Homo Sapiens
QQGAAAWEK

SEQ ID NO: 921139 - protein, 9 aa, Homo Sapiens
SRAAASAPG

SEQ ID NO: 921140 - protein, 9 aa, Homo Sapiens
PYLRFWARR

SEQ ID NO: 921141 - protein, 9 aa, Homo Sapiens
IRKLLLQLK

SEQ ID NO: 921142 - protein, 9 aa, Homo Sapiens
TELPPGKGG

SEQ ID NO: 921143 - protein, 9 aa, Homo Sapiens
HHSSNMNKA

SEQ ID NO: 921144 - protein, 9 aa, Homo Sapiens
HPSPLPSFF

SEQ ID NO: 921145 - protein, 9 aa, Homo Sapiens
SPDGSDAVP

SEQ ID NO: 921146 - protein, 9 aa, Homo Sapiens
PAIIFSSEK

SEQ ID NO: 921147 - protein, 9 aa, Homo Sapiens
ILSGNPLSA

SEQ ID NO: 921148 - protein, 9 aa, Homo Sapiens
PGSARCACS

SEQ ID NO: 921149 - protein, 9 aa, Homo Sapiens
LRKQVAKLG

SEQ ID NO: 921150 - protein, 9 aa, Homo Sapiens
DILIFWLPI

SEQ ID NO: 921151 - protein, 9 aa, Homo Sapiens
LITARLLRA

SEQ ID NO: 921152 - protein, 9 aa, Homo Sapiens
CSDTRDLEE

SEQ ID NO: 921153 - protein, 9 aa, Homo Sapiens
DLDSLGSYC

SEQ ID NO: 921154 - protein, 9 aa, Homo Sapiens
GAKASIILG

SEQ ID NO: 921155 - protein, 9 aa, Homo Sapiens
KTFNRSSIL

SEQ ID NO: 921156 - protein, 9 aa, Homo Sapiens
QVSNTGLYW

SEQ ID NO: 921157 - protein, 9 aa, Homo Sapiens
DKGAKTKKL

SEQ ID NO: 921158 - protein, 9 aa, Homo Sapiens
LLFAVHSIH

SEQ ID NO: 921159 - protein, 9 aa, Homo Sapiens
QSTLSRHWR

SEQ ID NO: 921160 - protein, 9 aa, Homo Sapiens
SQSSIALPQ

SEQ ID NO: 921161 - protein, 9 aa, Homo Sapiens
RYLVSTKKV

SEQ ID NO: 921162 - protein, 9 aa, Homo Sapiens
MIIVLLLFD

SEQ ID NO: 921163 - protein, 9 aa, Homo Sapiens
THSSFIEDL

SEQ ID NO: 921164 - protein, 9 aa, Homo Sapiens
KAFGKQSTL

SEQ ID NO: 921165 - protein, 9 aa, Homo Sapiens
PIENLYSAT

SEQ ID NO: 921166 - protein, 9 aa, Homo Sapiens
LSSPAAAHC

SEQ ID NO: 921167 - protein, 9 aa, Homo Sapiens
DHAPKLDFL

SEQ ID NO: 921168 - protein, 9 aa, Homo Sapiens
IFDEFKADL

SEQ ID NO: 921169 - protein, 9 aa, Homo Sapiens
KVSMEEMIP

SEQ ID NO: 921170 - protein, 9 aa, Homo Sapiens
CCSEAIKSA

SEQ ID NO: 921171 - protein, 9 aa, Homo Sapiens
GAPFRWPLY

SEQ ID NO: 921172 - protein, 9 aa, Homo Sapiens
RDRHSLFGQ

SEQ ID NO: 921173 - protein, 9 aa, Homo Sapiens
CSCLSFFFF

SEQ ID NO: 921174 - protein, 9 aa, Homo Sapiens
ITCALDEDF

SEQ ID NO: 921175 - protein, 9 aa, Homo Sapiens
NKHKKIYAG

SEQ ID NO: 921176 - protein, 9 aa, Homo Sapiens
SIMLHKLIK

SEQ ID NO: 921177 - protein, 9 aa, Homo Sapiens
VIRSGCGQL

SEQ ID NO: 921178 - protein, 9 aa, Homo Sapiens
SATKMSGRG

SEQ ID NO: 921179 - protein, 9 aa, Homo Sapiens
LVSTKKVGE

SEQ ID NO: 921180 - protein, 9 aa, Homo Sapiens
KNCFSKRKR

SEQ ID NO: 921181 - protein, 9 aa, Homo Sapiens
FGCNECALG

SEQ ID NO: 921182 - protein, 9 aa, Homo Sapiens
QPRGPPQRE

SEQ ID NO: 921183 - protein, 9 aa, Homo Sapiens
ARGGCIILI

SEQ ID NO: 921184 - protein, 9 aa, Homo Sapiens
QHIPGPGST

SEQ ID NO: 921185 - protein, 9 aa, Homo Sapiens
ISQGYTVEK

SEQ ID NO: 921186 - protein, 9 aa, Homo Sapiens
AIADVEQRG

SEQ ID NO: 921187 - protein, 9 aa, Homo Sapiens
LKYMPHTVL

SEQ ID NO: 921188 - protein, 9 aa, Homo Sapiens
FLSADGMLT

SEQ ID NO: 921189 - protein, 9 aa, Homo Sapiens
EKSRWSGSH

SEQ ID NO: 921190 - protein, 9 aa, Homo Sapiens
QPPHGVSQL

SEQ ID NO: 921191 - protein, 9 aa, Homo Sapiens
EVALHAARE

SEQ ID NO: 921192 - protein, 9 aa, Homo Sapiens
SNKSLRVLK

SEQ ID NO: 921193 - protein, 9 aa, Homo Sapiens
HNKKHGGFS

SEQ ID NO: 921194 - protein, 9 aa, Homo Sapiens
KLISTLIDD

SEQ ID NO: 921195 - protein, 9 aa, Homo Sapiens
TEPLPFLPP

SEQ ID NO: 921196 - protein, 9 aa, Homo Sapiens
RSPTDILIF

SEQ ID NO: 921197 - protein, 9 aa, Homo Sapiens
KRLPYCRRN

SEQ ID NO: 921198 - protein, 9 aa, Homo Sapiens
NFAQLLVEA

SEQ ID NO: 921199 - protein, 9 aa, Homo Sapiens
VAFDDSTLV

SEQ ID NO: 921200 - protein, 9 aa, Homo Sapiens
ETAIADVEQ

SEQ ID NO: 921201 - protein, 9 aa, Homo Sapiens
TVRRGPQSL

SEQ ID NO: 921202 - protein, 9 aa, Homo Sapiens
IFLQHALYL

SEQ ID NO: 921203 - protein, 9 aa, Homo Sapiens
PGASSLSSQ

SEQ ID NO: 921204 - protein, 9 aa, Homo Sapiens
NFTKKIGST

SEQ ID NO: 921205 - protein, 9 aa, Homo Sapiens
EKLEMETDA

SEQ ID NO: 921206 - protein, 9 aa, Homo Sapiens
TPPLFPAFS

SEQ ID NO: 921207 - protein, 9 aa, Homo Sapiens
EPYADYGGF

SEQ ID NO: 921208 - protein, 9 aa, Homo Sapiens
RFHGAKVVF

SEQ ID NO: 921209 - protein, 9 aa, Homo Sapiens
FVPDEHGTD

SEQ ID NO: 921210 - protein, 9 aa, Homo Sapiens
KNDNFEKEN

SEQ ID NO: 921211 - protein, 9 aa, Homo Sapiens
QKPRKTSEK

SEQ ID NO: 921212 - protein, 9 aa, Homo Sapiens
LQNTLELNK

SEQ ID NO: 921213 - protein, 9 aa, Homo Sapiens
LFPAFSLAF

SEQ ID NO: 921214 - protein, 9 aa, Homo Sapiens
QDETVRVVA

SEQ ID NO: 921215 - protein, 9 aa, Homo Sapiens
KLGKHLRIA

SEQ ID NO: 921216 - protein, 9 aa, Homo Sapiens
RKIVDHVDC

SEQ ID NO: 921217 - protein, 9 aa, Homo Sapiens
DVNDHAPKL

SEQ ID NO: 921218 - protein, 9 aa, Homo Sapiens
FGFVPDEHG

SEQ ID NO: 921219 - protein, 9 aa, Homo Sapiens
PQRMYSKII

SEQ ID NO: 921220 - protein, 9 aa, Homo Sapiens
RGGRSAPFW

SEQ ID NO: 921221 - protein, 9 aa, Homo Sapiens
TACKLLTCD

SEQ ID NO: 921222 - protein, 9 aa, Homo Sapiens
DADLLNVES

SEQ ID NO: 921223 - protein, 9 aa, Homo Sapiens
KERKYPPMD

SEQ ID NO: 921224 - protein, 9 aa, Homo Sapiens
EWQAFLRKS

SEQ ID NO: 921225 - protein, 9 aa, Homo Sapiens
ACSCDLDSL

SEQ ID NO: 921226 - protein, 9 aa, Homo Sapiens
SIRTNDVLL

SEQ ID NO: 921227 - protein, 9 aa, Homo Sapiens
QKAFDNIAK

SEQ ID NO: 921228 - protein, 9 aa, Homo Sapiens
PTRWGWNDV

SEQ ID NO: 921229 - protein, 9 aa, Homo Sapiens
NQTLTDFIL

SEQ ID NO: 921230 - protein, 9 aa, Homo Sapiens
RNSMLTAGK

SEQ ID NO: 921231 - protein, 9 aa, Homo Sapiens
ALTSGWGSS

SEQ ID NO: 921232 - protein, 9 aa, Homo Sapiens
RLVSWIDHI

SEQ ID NO: 921233 - protein, 9 aa, Homo Sapiens
SRWDCNNGK

SEQ ID NO: 921234 - protein, 9 aa, Homo Sapiens
YAVILCRIQ

SEQ ID NO: 921235 - protein, 9 aa, Homo Sapiens
YTGKKPYKC

SEQ ID NO: 921236 - protein, 9 aa, Homo Sapiens
FSLSEVLRG

SEQ ID NO: 921237 - protein, 9 aa, Homo Sapiens
IRSTFIGTE

SEQ ID NO: 921238 - protein, 9 aa, Homo Sapiens
CNNGKRPHQ

SEQ ID NO: 921239 - protein, 9 aa, Homo Sapiens
EERYGKELM

SEQ ID NO: 921240 - protein, 9 aa, Homo Sapiens
GVLLLSALE

SEQ ID NO: 921241 - protein, 9 aa, Homo Sapiens
VEKIEIPDL

SEQ ID NO: 921242 - protein, 9 aa, Homo Sapiens
VLRNSMLTA

SEQ ID NO: 921243 - protein, 9 aa, Homo Sapiens
VSRAAASAP

SEQ ID NO: 921244 - protein, 9 aa, Homo Sapiens
YSIRTNDVL

SEQ ID NO: 921245 - protein, 9 aa, Homo Sapiens
VSAPPSPKD

SEQ ID NO: 921246 - protein, 9 aa, Homo Sapiens
RNFIPHTYC

SEQ ID NO: 921247 - protein, 9 aa, Homo Sapiens
DGWYCDSLE

SEQ ID NO: 921248 - protein, 9 aa, Homo Sapiens
SSLSSQPLS

SEQ ID NO: 921249 - protein, 9 aa, Homo Sapiens
MAQEMKAEY

SEQ ID NO: 921250 - protein, 9 aa, Homo Sapiens
AFDDSTLVQ

SEQ ID NO: 921251 - protein, 9 aa, Homo Sapiens
ENYNQTLTD

SEQ ID NO: 921252 - protein, 9 aa, Homo Sapiens
LRASVAQAE

SEQ ID NO: 921253 - protein, 9 aa, Homo Sapiens
ILKWRYKEA

SEQ ID NO: 921254 - protein, 9 aa, Homo Sapiens
LMQIARKAG

SEQ ID NO: 921255 - protein, 9 aa, Homo Sapiens
NVTSKEIRT

SEQ ID NO: 921256 - protein, 9 aa, Homo Sapiens
GLRTLLLVF

SEQ ID NO: 921257 - protein, 9 aa, Homo Sapiens
EAEASTFQA

SEQ ID NO: 921258 - protein, 9 aa, Homo Sapiens
AFGKQSTLS

SEQ ID NO: 921259 - protein, 9 aa, Homo Sapiens
SCQNLEAGR

SEQ ID NO: 921260 - protein, 9 aa, Homo Sapiens
YCKGRGKNF

SEQ ID NO: 921261 - protein, 9 aa, Homo Sapiens
ALQPGPLEL

SEQ ID NO: 921262 - protein, 9 aa, Homo Sapiens
LVVHSGSGV

SEQ ID NO: 921263 - protein, 9 aa, Homo Sapiens
PKDRQKRKK

SEQ ID NO: 921264 - protein, 9 aa, Homo Sapiens
DNELPGLNE

SEQ ID NO: 921265 - protein, 9 aa, Homo Sapiens
HLREKLTRT

SEQ ID NO: 921266 - protein, 9 aa, Homo Sapiens
SKERKYPPM

SEQ ID NO: 921267 - protein, 9 aa, Homo Sapiens
SPSSSSGSS

SEQ ID NO: 921268 - protein, 9 aa, Homo Sapiens
SYIFKREPS

SEQ ID NO: 921269 - protein, 9 aa, Homo Sapiens
EETPSHGDR

SEQ ID NO: 921270 - protein, 9 aa, Homo Sapiens
VEKKEMGLV

SEQ ID NO: 921271 - protein, 9 aa, Homo Sapiens
FDSSWVKHY

SEQ ID NO: 921272 - protein, 9 aa, Homo Sapiens
IKPSANDRV

SEQ ID NO: 921273 - protein, 9 aa, Homo Sapiens
ATLSYLPTQ

SEQ ID NO: 921274 - protein, 9 aa, Homo Sapiens
QLSSPAAAH

SEQ ID NO: 921275 - protein, 9 aa, Homo Sapiens
FEFIGKFGL

SEQ ID NO: 921276 - protein, 9 aa, Homo Sapiens
PPRLGMHSP

SEQ ID NO: 921277 - protein, 9 aa, Homo Sapiens
EDLKIRPRV

SEQ ID NO: 921278 - protein, 9 aa, Homo Sapiens
LLKVYDQMP

SEQ ID NO: 921279 - protein, 9 aa, Homo Sapiens
TQPLQGRTP

SEQ ID NO: 921280 - protein, 9 aa, Homo Sapiens
KIQISEMKV

SEQ ID NO: 921281 - protein, 9 aa, Homo Sapiens
RGTSGLPGP

SEQ ID NO: 921282 - protein, 9 aa, Homo Sapiens
DIANICNEV

SEQ ID NO: 921283 - protein, 9 aa, Homo Sapiens
KIIYTGKKP

SEQ ID NO: 921284 - protein, 9 aa, Homo Sapiens
QFSEILRRA

SEQ ID NO: 921285 - protein, 9 aa, Homo Sapiens
ILIFWLPIP

SEQ ID NO: 921286 - protein, 9 aa, Homo Sapiens
SAGKVSANR

SEQ ID NO: 921287 - protein, 9 aa, Homo Sapiens
AFDNIAKYF

SEQ ID NO: 921288 - protein, 9 aa, Homo Sapiens
KVGEEVIST

SEQ ID NO: 921289 - protein, 9 aa, Homo Sapiens
NELPGLNER

SEQ ID NO: 921290 - protein, 9 aa, Homo Sapiens
FCQSQPSQT

SEQ ID NO: 921291 - protein, 9 aa, Homo Sapiens
INSWASAPS

SEQ ID NO: 921292 - protein, 9 aa, Homo Sapiens
LSHELEDLK

SEQ ID NO: 921293 - protein, 9 aa, Homo Sapiens
ALMEEGDKF

SEQ ID NO: 921294 - protein, 9 aa, Homo Sapiens
ESGGPEAQT

SEQ ID NO: 921295 - protein, 9 aa, Homo Sapiens
TACESARKY

SEQ ID NO: 921296 - protein, 9 aa, Homo Sapiens
SIVFWKPTR

SEQ ID NO: 921297 - protein, 9 aa, Homo Sapiens
GLCSVSCGA

SEQ ID NO: 921298 - protein, 9 aa, Homo Sapiens
PPRHLSCDS

SEQ ID NO: 921299 - protein, 9 aa, Homo Sapiens
FPTLKLVFR

SEQ ID NO: 921300 - protein, 9 aa, Homo Sapiens
LAGGRPSGE

SEQ ID NO: 921301 - protein, 9 aa, Homo Sapiens
VLLLFDASF

SEQ ID NO: 921302 - protein, 9 aa, Homo Sapiens
ILCRIQASS

SEQ ID NO: 921303 - protein, 9 aa, Homo Sapiens
NIVQKKKHT

SEQ ID NO: 921304 - protein, 9 aa, Homo Sapiens
GEKLEMETD

SEQ ID NO: 921305 - protein, 9 aa, Homo Sapiens
TQALSGLGR

SEQ ID NO: 921306 - protein, 9 aa, Homo Sapiens
TLTDFILLG

SEQ ID NO: 921307 - protein, 9 aa, Homo Sapiens
APQRMYSKI

SEQ ID NO: 921308 - protein, 9 aa, Homo Sapiens
QGARGGCII

SEQ ID NO: 921309 - protein, 9 aa, Homo Sapiens
SVADRLDPY

SEQ ID NO: 921310 - protein, 9 aa, Homo Sapiens
VAPKPKFSW

SEQ ID NO: 921311 - protein, 9 aa, Homo Sapiens
DSEWQAFLR

SEQ ID NO: 921312 - protein, 9 aa, Homo Sapiens
DKDAVERQR

SEQ ID NO: 921313 - protein, 9 aa, Homo Sapiens
TRRRSSPRV

SEQ ID NO: 921314 - protein, 9 aa, Homo Sapiens
GKSKERKYP

SEQ ID NO: 921315 - protein, 9 aa, Homo Sapiens
HFWRDQFME

SEQ ID NO: 921316 - protein, 9 aa, Homo Sapiens
YHQNNPWHP

SEQ ID NO: 921317 - protein, 9 aa, Homo Sapiens
ATPVKQADT

SEQ ID NO: 921318 - protein, 9 aa, Homo Sapiens
RADMEAEAS

SEQ ID NO: 921319 - protein, 9 aa, Homo Sapiens
REKLTRTDE

SEQ ID NO: 921320 - protein, 9 aa, Homo Sapiens
KDISMEIDS

SEQ ID NO: 921321 - protein, 9 aa, Homo Sapiens
HIEPDPTQD

SEQ ID NO: 921322 - protein, 9 aa, Homo Sapiens
RKAIHALSS

SEQ ID NO: 921323 - protein, 9 aa, Homo Sapiens
ARYLVSTKK

SEQ ID NO: 921324 - protein, 9 aa, Homo Sapiens
QSPDGSDAV

SEQ ID NO: 921325 - protein, 9 aa, Homo Sapiens
KDALQMAQE

SEQ ID NO: 921326 - protein, 9 aa, Homo Sapiens
IILEDYDER

SEQ ID NO: 921327 - protein, 9 aa, Homo Sapiens
NDHAPKLDF

SEQ ID NO: 921328 - protein, 9 aa, Homo Sapiens
FILNMPLVT

SEQ ID NO: 921329 - protein, 9 aa, Homo Sapiens
QASSSEAKN

SEQ ID NO: 921330 - protein, 9 aa, Homo Sapiens
CTKCQSSAI

SEQ ID NO: 921331 - protein, 9 aa, Homo Sapiens
PAQPDDCID

SEQ ID NO: 921332 - protein, 9 aa, Homo Sapiens
PVFFNIEAL

SEQ ID NO: 921333 - protein, 9 aa, Homo Sapiens
NLIKAVHVL

SEQ ID NO: 921334 - protein, 9 aa, Homo Sapiens
WAVLTGPLQ

SEQ ID NO: 921335 - protein, 9 aa, Homo Sapiens
FNEDVEWKS

SEQ ID NO: 921336 - protein, 9 aa, Homo Sapiens
HKIIYTGKK

SEQ ID NO: 921337 - protein, 9 aa, Homo Sapiens
RTHLDTSVE

SEQ ID NO: 921338 - protein, 9 aa, Homo Sapiens
PSPKDISME

SEQ ID NO: 921339 - protein, 9 aa, Homo Sapiens
QSAFYPEND

SEQ ID NO: 921340 - protein, 9 aa, Homo Sapiens
SVHVCALKA

SEQ ID NO: 921341 - protein, 9 aa, Homo Sapiens
PENDDYFFA

SEQ ID NO: 921342 - protein, 9 aa, Homo Sapiens
HTGQKLYEC

SEQ ID NO: 921343 - protein, 9 aa, Homo Sapiens
SLEAFFVFP

SEQ ID NO: 921344 - protein, 9 aa, Homo Sapiens
MPKPIYRKL

SEQ ID NO: 921345 - protein, 9 aa, Homo Sapiens
FFATEVCSR

SEQ ID NO: 921346 - protein, 9 aa, Homo Sapiens
KNFNFTRSS

SEQ ID NO: 921347 - protein, 9 aa, Homo Sapiens
KILIVGEPG

SEQ ID NO: 921348 - protein, 9 aa, Homo Sapiens
CTMKNDNFE

SEQ ID NO: 921349 - protein, 9 aa, Homo Sapiens
MFVPFRHVI

SEQ ID NO: 921350 - protein, 9 aa, Homo Sapiens
HSIHTEAVT

SEQ ID NO: 921351 - protein, 9 aa, Homo Sapiens
VFTSRAAIY

SEQ ID NO: 921352 - protein, 9 aa, Homo Sapiens
LDALELQDD

SEQ ID NO: 921353 - protein, 9 aa, Homo Sapiens
RVVLELFDR

SEQ ID NO: 921354 - protein, 9 aa, Homo Sapiens
YIEYTLLNL

SEQ ID NO: 921355 - protein, 9 aa, Homo Sapiens
QGTYGQKVS

SEQ ID NO: 921356 - protein, 9 aa, Homo Sapiens
KGRSKGEKL

SEQ ID NO: 921357 - protein, 9 aa, Homo Sapiens
KKPVVASLL

SEQ ID NO: 921358 - protein, 9 aa, Homo Sapiens
TNDVLLFIP

SEQ ID NO: 921359 - protein, 9 aa, Homo Sapiens
KSFVLGLYG

SEQ ID NO: 921360 - protein, 9 aa, Homo Sapiens
FKVLFRKSE

SEQ ID NO: 921361 - protein, 9 aa, Homo Sapiens
EVPTKRSVE

SEQ ID NO: 921362 - protein, 9 aa, Homo Sapiens
TVVREVLQK

SEQ ID NO: 921363 - protein, 9 aa, Homo Sapiens
GTRCAGKVA

SEQ ID NO: 921364 - protein, 9 aa, Homo Sapiens
MESDIILED

SEQ ID NO: 921365 - protein, 9 aa, Homo Sapiens
RKRKIATRN

SEQ ID NO: 921366 - protein, 9 aa, Homo Sapiens
SRNENPAPK

SEQ ID NO: 921367 - protein, 9 aa, Homo Sapiens
NQFSEILRR

SEQ ID NO: 921368 - protein, 9 aa, Homo Sapiens
SARGNNSNG

SEQ ID NO: 921369 - protein, 9 aa, Homo Sapiens
SEGRPFGCN

SEQ ID NO: 921370 - protein, 9 aa, Homo Sapiens
KKLATSASQ

SEQ ID NO: 921371 - protein, 9 aa, Homo Sapiens
GKAFGKQST

SEQ ID NO: 921372 - protein, 9 aa, Homo Sapiens
NVLVSFVLS

SEQ ID NO: 921373 - protein, 9 aa, Homo Sapiens
LNEVHEVVV

SEQ ID NO: 921374 - protein, 9 aa, Homo Sapiens
TEEKSVGDE

SEQ ID NO: 921375 - protein, 9 aa, Homo Sapiens
VLDALELQD

SEQ ID NO: 921376 - protein, 9 aa, Homo Sapiens
VETVSKAKE

SEQ ID NO: 921377 - protein, 9 aa, Homo Sapiens
PHQESWGSS

SEQ ID NO: 921378 - protein, 9 aa, Homo Sapiens
SSRWDCNNG

SEQ ID NO: 921379 - protein, 9 aa, Homo Sapiens
LLLSALELI

SEQ ID NO: 921380 - protein, 9 aa, Homo Sapiens
FQRLVNDMN

SEQ ID NO: 921381 - protein, 9 aa, Homo Sapiens
GQDETVRVV

SEQ ID NO: 921382 - protein, 9 aa, Homo Sapiens
VVTNFNDNL

SEQ ID NO: 921383 - protein, 9 aa, Homo Sapiens
PPWGRLHSH

SEQ ID NO: 921384 - protein, 9 aa, Homo Sapiens
QPKSSQTKF

SEQ ID NO: 921385 - protein, 9 aa, Homo Sapiens
VFWKPTRWG

SEQ ID NO: 921386 - protein, 9 aa, Homo Sapiens
ALREYQGLP

SEQ ID NO: 921387 - protein, 9 aa, Homo Sapiens
EPTSGPFCT

SEQ ID NO: 921388 - protein, 9 aa, Homo Sapiens
ELASKKKVK

SEQ ID NO: 921389 - protein, 9 aa, Homo Sapiens
AFCHHSSNM

SEQ ID NO: 921390 - protein, 9 aa, Homo Sapiens
GTLLSGTFR

SEQ ID NO: 921391 - protein, 9 aa, Homo Sapiens
LRNFSFFEI

SEQ ID NO: 921392 - protein, 9 aa, Homo Sapiens
CEYKIENVT

SEQ ID NO: 921393 - protein, 9 aa, Homo Sapiens
ESLSEKELA

SEQ ID NO: 921394 - protein, 9 aa, Homo Sapiens
HYTVFYGTD

SEQ ID NO: 921395 - protein, 9 aa, Homo Sapiens
PSHGDRPLL

SEQ ID NO: 921396 - protein, 9 aa, Homo Sapiens
DASFIGIVQ

SEQ ID NO: 921397 - protein, 9 aa, Homo Sapiens
EITCALDED

SEQ ID NO: 921398 - protein, 9 aa, Homo Sapiens
IQKLKVMKN

SEQ ID NO: 921399 - protein, 9 aa, Homo Sapiens
SLALTAFLN

SEQ ID NO: 921400 - protein, 9 aa, Homo Sapiens
NSMLTAGKG

SEQ ID NO: 921401 - protein, 9 aa, Homo Sapiens
ALKYMPHTV

SEQ ID NO: 921402 - protein, 9 aa, Homo Sapiens
VVVAKLREG

SEQ ID NO: 921403 - protein, 9 aa, Homo Sapiens
NEAAPAEAS

SEQ ID NO: 921404 - protein, 9 aa, Homo Sapiens
PSGEPGGPF

SEQ ID NO: 921405 - protein, 9 aa, Homo Sapiens
GSEEEPFSQ

SEQ ID NO: 921406 - protein, 9 aa, Homo Sapiens
IYGFKSTVP

SEQ ID NO: 921407 - protein, 9 aa, Homo Sapiens
ALINSWASA

SEQ ID NO: 921408 - protein, 9 aa, Homo Sapiens
SLDAFCHHS

SEQ ID NO: 921409 - protein, 9 aa, Homo Sapiens
ALKGSQVDV

SEQ ID NO: 921410 - protein, 9 aa, Homo Sapiens
LVFRNESDG

SEQ ID NO: 921411 - protein, 9 aa, Homo Sapiens
QGGVIRSGC

SEQ ID NO: 921412 - protein, 9 aa, Homo Sapiens
ANICNEVAL

SEQ ID NO: 921413 - protein, 9 aa, Homo Sapiens
NGCPIPPTS

SEQ ID NO: 921414 - protein, 9 aa, Homo Sapiens
VFCLAEGVS

SEQ ID NO: 921415 - protein, 9 aa, Homo Sapiens
SNGREAKMI

SEQ ID NO: 921416 - protein, 9 aa, Homo Sapiens
KTQALSGLG

SEQ ID NO: 921417 - protein, 9 aa, Homo Sapiens
NCFSKRKRK

SEQ ID NO: 921418 - protein, 9 aa, Homo Sapiens
TSRLKANAL

SEQ ID NO: 921419 - protein, 9 aa, Homo Sapiens
SNIVRSFSI

SEQ ID NO: 921420 - protein, 9 aa, Homo Sapiens
YVVILCPTK

SEQ ID NO: 921421 - protein, 9 aa, Homo Sapiens
KIQKAFDNI

SEQ ID NO: 921422 - protein, 9 aa, Homo Sapiens
DGSYRVTFI

SEQ ID NO: 921423 - protein, 9 aa, Homo Sapiens
RTPVFFNIE

SEQ ID NO: 921424 - protein, 9 aa, Homo Sapiens
YVLVVHSGS

SEQ ID NO: 921425 - protein, 9 aa, Homo Sapiens
KQVAKLGKH

SEQ ID NO: 921426 - protein, 9 aa, Homo Sapiens
GAKTKKLAT

SEQ ID NO: 921427 - protein, 9 aa, Homo Sapiens
QRLVNDMNI

SEQ ID NO: 921428 - protein, 9 aa, Homo Sapiens
AVILCRIQA

SEQ ID NO: 921429 - protein, 9 aa, Homo Sapiens
TIAKVSFRG

SEQ ID NO: 921430 - protein, 9 aa, Homo Sapiens
VIIECKPKV

SEQ ID NO: 921431 - protein, 9 aa, Homo Sapiens
RTCCTACES

SEQ ID NO: 921432 - protein, 9 aa, Homo Sapiens
PRHSHLTRA

SEQ ID NO: 921433 - protein, 9 aa, Homo Sapiens
ESARKYKTL

SEQ ID NO: 921434 - protein, 9 aa, Homo Sapiens
DNFEKENKY

SEQ ID NO: 921435 - protein, 9 aa, Homo Sapiens
RPPPPRLGM

SEQ ID NO: 921436 - protein, 9 aa, Homo Sapiens
PSEGCEKVR

SEQ ID NO: 921437 - protein, 9 aa, Homo Sapiens
EEPFSQLTS

SEQ ID NO: 921438 - protein, 9 aa, Homo Sapiens
APTSRLKAN

SEQ ID NO: 921439 - protein, 9 aa, Homo Sapiens
PNTACKLLT

SEQ ID NO: 921440 - protein, 9 aa, Homo Sapiens
LKKPVVASL

SEQ ID NO: 921441 - protein, 9 aa, Homo Sapiens
IQEPGLAKM

SEQ ID NO: 921442 - protein, 9 aa, Homo Sapiens
EKDALQMAQ

SEQ ID NO: 921443 - protein, 9 aa, Homo Sapiens
IAPRGRVPK

SEQ ID NO: 921444 - protein, 9 aa, Homo Sapiens
TLVQRQLVD

SEQ ID NO: 921445 - protein, 9 aa, Homo Sapiens
DPQLHDSSC

SEQ ID NO: 921446 - protein, 9 aa, Homo Sapiens
KLTVKRPTM

SEQ ID NO: 921447 - protein, 9 aa, Homo Sapiens
DSSCICERV

SEQ ID NO: 921448 - protein, 9 aa, Homo Sapiens
SEGMDGFAD

SEQ ID NO: 921449 - protein, 9 aa, Homo Sapiens
KKGYTVGAK

SEQ ID NO: 921450 - protein, 9 aa, Homo Sapiens
RSGCGQLAP

SEQ ID NO: 921451 - protein, 9 aa, Homo Sapiens
AVHSIHTEA

SEQ ID NO: 921452 - protein, 9 aa, Homo Sapiens
GKKEDIVIL

SEQ ID NO: 921453 - protein, 9 aa, Homo Sapiens
KTNLGHALD

SEQ ID NO: 921454 - protein, 9 aa, Homo Sapiens
NTLELNKQK

SEQ ID NO: 921455 - protein, 9 aa, Homo Sapiens
AIYRISLET

SEQ ID NO: 921456 - protein, 9 aa, Homo Sapiens
PCTLIVAVL

SEQ ID NO: 921457 - protein, 9 aa, Homo Sapiens
WASAPSPST

SEQ ID NO: 921458 - protein, 9 aa, Homo Sapiens
CRTPVFFNI

SEQ ID NO: 921459 - protein, 9 aa, Homo Sapiens
REHAQLSSP

SEQ ID NO: 921460 - protein, 9 aa, Homo Sapiens
YGAWAERIS

SEQ ID NO: 921461 - protein, 9 aa, Homo Sapiens
KALDELDLF

SEQ ID NO: 921462 - protein, 9 aa, Homo Sapiens
PRTHLDTSV

SEQ ID NO: 921463 - protein, 9 aa, Homo Sapiens
QIYGFKSTV

SEQ ID NO: 921464 - protein, 9 aa, Homo Sapiens
QRSRLLENT

SEQ ID NO: 921465 - protein, 9 aa, Homo Sapiens
DGLVALNWV

SEQ ID NO: 921466 - protein, 9 aa, Homo Sapiens
QSALSCFLS

SEQ ID NO: 921467 - protein, 9 aa, Homo Sapiens
YSADTPEAS

SEQ ID NO: 921468 - protein, 9 aa, Homo Sapiens
PGPGSTEGM

SEQ ID NO: 921469 - protein, 9 aa, Homo Sapiens
EKQRQEKLE

SEQ ID NO: 921470 - protein, 9 aa, Homo Sapiens
GPDLLPASL

SEQ ID NO: 921471 - protein, 9 aa, Homo Sapiens
ALIFLFYGV

SEQ ID NO: 921472 - protein, 9 aa, Homo Sapiens
PGGAGTLLS

SEQ ID NO: 921473 - protein, 9 aa, Homo Sapiens
AFLELKFSH

SEQ ID NO: 921474 - protein, 9 aa, Homo Sapiens
ILALSQSSI

SEQ ID NO: 921475 - protein, 9 aa, Homo Sapiens
KAFDNIAKY

SEQ ID NO: 921476 - protein, 9 aa, Homo Sapiens
ASGKGLWSE

SEQ ID NO: 921477 - protein, 9 aa, Homo Sapiens
LELQDDFYL

SEQ ID NO: 921478 - protein, 9 aa, Homo Sapiens
DVDRIATLS

SEQ ID NO: 921479 - protein, 9 aa, Homo Sapiens
VAKLGKHLR

SEQ ID NO: 921480 - protein, 9 aa, Homo Sapiens
TRCAGKVAA

SEQ ID NO: 921481 - protein, 9 aa, Homo Sapiens
THKIIYTGK

SEQ ID NO: 921482 - protein, 9 aa, Homo Sapiens
ILGLVPFLM

SEQ ID NO: 921483 - protein, 9 aa, Homo Sapiens
YNISQGYTV

SEQ ID NO: 921484 - protein, 9 aa, Homo Sapiens
RRRVSLGIN

SEQ ID NO: 921485 - protein, 9 aa, Homo Sapiens
KELMQIARK

SEQ ID NO: 921486 - protein, 9 aa, Homo Sapiens
RMAASIRKL

SEQ ID NO: 921487 - protein, 9 aa, Homo Sapiens
GIDYQAEDT

SEQ ID NO: 921488 - protein, 9 aa, Homo Sapiens
FSIEDAISI

SEQ ID NO: 921489 - protein, 9 aa, Homo Sapiens
CDFFEISMD

SEQ ID NO: 921490 - protein, 9 aa, Homo Sapiens
TSEKQSIWI

SEQ ID NO: 921491 - protein, 9 aa, Homo Sapiens
LKFDGWYCD

SEQ ID NO: 921492 - protein, 9 aa, Homo Sapiens
GGAGTLLSG

SEQ ID NO: 921493 - protein, 9 aa, Homo Sapiens
KGFCQLVVV

SEQ ID NO: 921494 - protein, 9 aa, Homo Sapiens
TDVNDHAPK

SEQ ID NO: 921495 - protein, 9 aa, Homo Sapiens
GGRSAPFWL

SEQ ID NO: 921496 - protein, 9 aa, Homo Sapiens
LVPQRLRPP

SEQ ID NO: 921497 - protein, 9 aa, Homo Sapiens
TSIKDALNL

SEQ ID NO: 921498 - protein, 9 aa, Homo Sapiens
MYSKIIALM

SEQ ID NO: 921499 - protein, 9 aa, Homo Sapiens
FHGAKVVFC

SEQ ID NO: 921500 - protein, 9 aa, Homo Sapiens
PKILIVGEP

SEQ ID NO: 921501 - protein, 9 aa, Homo Sapiens
INICHPDTF

SEQ ID NO: 921502 - protein, 9 aa, Homo Sapiens
SPDFETEDQ

SEQ ID NO: 921503 - protein, 9 aa, Homo Sapiens
AKVSFRGAP

SEQ ID NO: 921504 - protein, 9 aa, Homo Sapiens
GSTEGMKGA

SEQ ID NO: 921505 - protein, 9 aa, Homo Sapiens
RCACSCDLD

SEQ ID NO: 921506 - protein, 9 aa, Homo Sapiens
IGMFSLYSY

SEQ ID NO: 921507 - protein, 9 aa, Homo Sapiens
IVDHVDCMT

SEQ ID NO: 921508 - protein, 9 aa, Homo Sapiens
HQESWGSSQ

SEQ ID NO: 921509 - protein, 9 aa, Homo Sapiens
KAIHALSSS

SEQ ID NO: 921510 - protein, 9 aa, Homo Sapiens
ILVYCRKKK

SEQ ID NO: 921511 - protein, 9 aa, Homo Sapiens
EKIQISEMK

SEQ ID NO: 921512 - protein, 9 aa, Homo Sapiens
QILHPLGWL

SEQ ID NO: 921513 - protein, 9 aa, Homo Sapiens
HGAKVVFCL

SEQ ID NO: 921514 - protein, 9 aa, Homo Sapiens
AAVMVLIAP

SEQ ID NO: 921515 - protein, 9 aa, Homo Sapiens
KLDFLTLSN

SEQ ID NO: 921516 - protein, 9 aa, Homo Sapiens
SLSKSFPES

SEQ ID NO: 921517 - protein, 9 aa, Homo Sapiens
YIKPSANDR

SEQ ID NO: 921518 - protein, 9 aa, Homo Sapiens
KFFIILCRT

SEQ ID NO: 921519 - protein, 9 aa, Homo Sapiens
KNLDKEDLG

SEQ ID NO: 921520 - protein, 9 aa, Homo Sapiens
TDKCTHSSF

SEQ ID NO: 921521 - protein, 9 aa, Homo Sapiens
ENLEKMCRT

SEQ ID NO: 921522 - protein, 9 aa, Homo Sapiens
LVLTDVKKK

SEQ ID NO: 921523 - protein, 9 aa, Homo Sapiens
FNFTRSSNM

SEQ ID NO: 921524 - protein, 9 aa, Homo Sapiens
RDGWGSYGS

SEQ ID NO: 921525 - protein, 9 aa, Homo Sapiens
LSQSSIGSI

SEQ ID NO: 921526 - protein, 9 aa, Homo Sapiens
RFWARRIAS

SEQ ID NO: 921527 - protein, 9 aa, Homo Sapiens
YPNTACKLL

SEQ ID NO: 921528 - protein, 9 aa, Homo Sapiens
TITVTNLGT

SEQ ID NO: 921529 - protein, 9 aa, Homo Sapiens
LTQPLQGRT

SEQ ID NO: 921530 - protein, 9 aa, Homo Sapiens
QFLYSEERE

SEQ ID NO: 921531 - protein, 9 aa, Homo Sapiens
ASGPTEPLP

SEQ ID NO: 921532 - protein, 9 aa, Homo Sapiens
APEKPGKPG

SEQ ID NO: 921533 - protein, 9 aa, Homo Sapiens
FMYIKPSAN

SEQ ID NO: 921534 - protein, 9 aa, Homo Sapiens
DKFEKASKL

SEQ ID NO: 921535 - protein, 9 aa, Homo Sapiens
KGSQVDVKG

SEQ ID NO: 921536 - protein, 9 aa, Homo Sapiens
ARVPSKNLL

SEQ ID NO: 921537 - protein, 9 aa, Homo Sapiens
NKGIPDGAC

SEQ ID NO: 921538 - protein, 9 aa, Homo Sapiens
DCIDEAEAS

SEQ ID NO: 921539 - protein, 9 aa, Homo Sapiens
FIVRIIIMK

SEQ ID NO: 921540 - protein, 9 aa, Homo Sapiens
CARMAASIR

SEQ ID NO: 921541 - protein, 9 aa, Homo Sapiens
IKGHQVKTQ

SEQ ID NO: 921542 - protein, 9 aa, Homo Sapiens
TKMSGRGSV

SEQ ID NO: 921543 - protein, 9 aa, Homo Sapiens
PGSKIPLPG

SEQ ID NO: 921544 - protein, 9 aa, Homo Sapiens
RIATLSYLP

SEQ ID NO: 921545 - protein, 9 aa, Homo Sapiens
LKGSQVDVK

SEQ ID NO: 921546 - protein, 9 aa, Homo Sapiens
NGSLDWDNQ

SEQ ID NO: 921547 - protein, 9 aa, Homo Sapiens
EKVSLEAFF

SEQ ID NO: 921548 - protein, 9 aa, Homo Sapiens
SPVLSALSL

SEQ ID NO: 921549 - protein, 9 aa, Homo Sapiens
QAEDTYVST

SEQ ID NO: 921550 - protein, 9 aa, Homo Sapiens
FEIPHQESW

SEQ ID NO: 921551 - protein, 9 aa, Homo Sapiens
QEKMIGQFL

SEQ ID NO: 921552 - protein, 9 aa, Homo Sapiens
IVFWKPTRW

SEQ ID NO: 921553 - protein, 9 aa, Homo Sapiens
MLHKLIKLL

SEQ ID NO: 921554 - protein, 9 aa, Homo Sapiens
SIHTEAVTG

SEQ ID NO: 921555 - protein, 9 aa, Homo Sapiens
NSYLDDIGL

SEQ ID NO: 921556 - protein, 9 aa, Homo Sapiens
DFETEDQKP

SEQ ID NO: 921557 - protein, 9 aa, Homo Sapiens
EMGLVLSEL

SEQ ID NO: 921558 - protein, 9 aa, Homo Sapiens
FFPGLPCII

SEQ ID NO: 921559 - protein, 9 aa, Homo Sapiens
GARGGCIIL

SEQ ID NO: 921560 - protein, 9 aa, Homo Sapiens
SCPAIIFSS

SEQ ID NO: 921561 - protein, 9 aa, Homo Sapiens
SEIFNEDVE

SEQ ID NO: 921562 - protein, 9 aa, Homo Sapiens
ILQMFVPFR

SEQ ID NO: 921563 - protein, 9 aa, Homo Sapiens
CQITIPKDR

SEQ ID NO: 921564 - protein, 9 aa, Homo Sapiens
VPTKRSVEC

SEQ ID NO: 921565 - protein, 9 aa, Homo Sapiens
QSSIGSIKC

SEQ ID NO: 921566 - protein, 9 aa, Homo Sapiens
GLVLSELEA

SEQ ID NO: 921567 - protein, 9 aa, Homo Sapiens
LAPTFINFP

SEQ ID NO: 921568 - protein, 9 aa, Homo Sapiens
GVSQLSLYE

SEQ ID NO: 921569 - protein, 9 aa, Homo Sapiens
SPGTVGQIL

SEQ ID NO: 921570 - protein, 9 aa, Homo Sapiens
PDSAPEKPG

SEQ ID NO: 921571 - protein, 9 aa, Homo Sapiens
NKAGMTSLS

SEQ ID NO: 921572 - protein, 9 aa, Homo Sapiens
EKFSVIQHF

SEQ ID NO: 921573 - protein, 9 aa, Homo Sapiens
YLKIFLQHA

SEQ ID NO: 921574 - protein, 9 aa, Homo Sapiens
EILRRLKRE

SEQ ID NO: 921575 - protein, 9 aa, Homo Sapiens
THLDTSVEL

SEQ ID NO: 921576 - protein, 9 aa, Homo Sapiens
IFWLPIPAK

SEQ ID NO: 921577 - protein, 9 aa, Homo Sapiens
PPHGVSQLS

SEQ ID NO: 921578 - protein, 9 aa, Homo Sapiens
CFSFRVVLE

SEQ ID NO: 921579 - protein, 9 aa, Homo Sapiens
VMNYLKIFL

SEQ ID NO: 921580 - protein, 9 aa, Homo Sapiens
VRNLLIVVD

SEQ ID NO: 921581 - protein, 9 aa, Homo Sapiens
KGYTVGAKA

SEQ ID NO: 921582 - protein, 9 aa, Homo Sapiens
SISIMLHKL

SEQ ID NO: 921583 - protein, 9 aa, Homo Sapiens
TQVEVNLFG

SEQ ID NO: 921584 - protein, 9 aa, Homo Sapiens
LSPSAESVA

SEQ ID NO: 921585 - protein, 9 aa, Homo Sapiens
DFTSSVLYG

SEQ ID NO: 921586 - protein, 9 aa, Homo Sapiens
LLNLLGNKF

SEQ ID NO: 921587 - protein, 9 aa, Homo Sapiens
ATEKSRWSG

SEQ ID NO: 921588 - protein, 9 aa, Homo Sapiens
NMGPYTVGM

SEQ ID NO: 921589 - protein, 9 aa, Homo Sapiens
NSYGAWAER

SEQ ID NO: 921590 - protein, 9 aa, Homo Sapiens
QLAKEKREA

SEQ ID NO: 921591 - protein, 9 aa, Homo Sapiens
VYCRKKKGL

SEQ ID NO: 921592 - protein, 9 aa, Homo Sapiens
KPRKTSEKQ

SEQ ID NO: 921593 - protein, 9 aa, Homo Sapiens
NEDVEWKSC

SEQ ID NO: 921594 - protein, 9 aa, Homo Sapiens
TVVRNLLIV

SEQ ID NO: 921595 - protein, 9 aa, Homo Sapiens
LPSFFPGLP

SEQ ID NO: 921596 - protein, 9 aa, Homo Sapiens
NERPPRAHA

SEQ ID NO: 921597 - protein, 9 aa, Homo Sapiens
TYTVQLEEQ

SEQ ID NO: 921598 - protein, 9 aa, Homo Sapiens
TSRAAIYRI

SEQ ID NO: 921599 - protein, 9 aa, Homo Sapiens
PAFSLAFPA

SEQ ID NO: 921600 - protein, 9 aa, Homo Sapiens
VWKKLISTL

SEQ ID NO: 921601 - protein, 9 aa, Homo Sapiens
NKQVADFQG

SEQ ID NO: 921602 - protein, 9 aa, Homo Sapiens
QCTSKSTGQ

SEQ ID NO: 921603 - protein, 9 aa, Homo Sapiens
PELLVHPDL

SEQ ID NO: 921604 - protein, 9 aa, Homo Sapiens
ATCNSRNEN

SEQ ID NO: 921605 - protein, 9 aa, Homo Sapiens
CTACESARK

SEQ ID NO: 921606 - protein, 9 aa, Homo Sapiens
PSAESVADR

SEQ ID NO: 921607 - protein, 9 aa, Homo Sapiens
AKENLEKMC

SEQ ID NO: 921608 - protein, 9 aa, Homo Sapiens
SSYSADTPE

SEQ ID NO: 921609 - protein, 9 aa, Homo Sapiens
NMQIYGFKS

SEQ ID NO: 921610 - protein, 9 aa, Homo Sapiens
KKLISTLID

SEQ ID NO: 921611 - protein, 9 aa, Homo Sapiens
QGAAAWEKE

SEQ ID NO: 921612 - protein, 9 aa, Homo Sapiens
TKKVGEEVI

SEQ ID NO: 921613 - protein, 9 aa, Homo Sapiens
SCCSEAIKS

SEQ ID NO: 921614 - protein, 9 aa, Homo Sapiens
LAKMISTVV

SEQ ID NO: 921615 - protein, 9 aa, Homo Sapiens
SQLSLYEHF

SEQ ID NO: 921616 - protein, 9 aa, Homo Sapiens
HGVSQLSLY

SEQ ID NO: 921617 - protein, 9 aa, Homo Sapiens
LSGGPQSRG

SEQ ID NO: 921618 - protein, 9 aa, Homo Sapiens
VGGRRSLKA

SEQ ID NO: 921619 - protein, 9 aa, Homo Sapiens
RGGCIILIS

SEQ ID NO: 921620 - protein, 9 aa, Homo Sapiens
IRTNDVLLF

SEQ ID NO: 921621 - protein, 9 aa, Homo Sapiens
LPPGKGGAQ

SEQ ID NO: 921622 - protein, 9 aa, Homo Sapiens
KLARLQNTL

SEQ ID NO: 921623 - protein, 9 aa, Homo Sapiens
SFSIEDAIS

SEQ ID NO: 921624 - protein, 9 aa, Homo Sapiens
ANQGRNLSR

SEQ ID NO: 921625 - protein, 9 aa, Homo Sapiens
LILGLVPFL

SEQ ID NO: 921626 - protein, 9 aa, Homo Sapiens
KAECLEKFS

SEQ ID NO: 921627 - protein, 9 aa, Homo Sapiens
FILALSQSS

SEQ ID NO: 921628 - protein, 9 aa, Homo Sapiens
LDVLRNSML

SEQ ID NO: 921629 - protein, 9 aa, Homo Sapiens
SKRKRKIAT

SEQ ID NO: 921630 - protein, 9 aa, Homo Sapiens
PPEIGNIFI

SEQ ID NO: 921631 - protein, 9 aa, Homo Sapiens
ITARLLRAS

SEQ ID NO: 921632 - protein, 9 aa, Homo Sapiens
VFHFRSPGQ

SEQ ID NO: 921633 - protein, 9 aa, Homo Sapiens
ASLDHSVKR

SEQ ID NO: 921634 - protein, 9 aa, Homo Sapiens
LQMAQEMKA

SEQ ID NO: 921635 - protein, 9 aa, Homo Sapiens
RPFGCNECA

SEQ ID NO: 921636 - protein, 9 aa, Homo Sapiens
PSISIMLHK

SEQ ID NO: 921637 - protein, 9 aa, Homo Sapiens
TVLKLKELH

SEQ ID NO: 921638 - protein, 9 aa, Homo Sapiens
VVILCPTKM

SEQ ID NO: 921639 - protein, 9 aa, Homo Sapiens
SHHNKKHGG

SEQ ID NO: 921640 - protein, 9 aa, Homo Sapiens
QRLPLGQKV

SEQ ID NO: 921641 - protein, 9 aa, Homo Sapiens
DMLVAINPY

SEQ ID NO: 921642 - protein, 9 aa, Homo Sapiens
SSNMQIYGF

SEQ ID NO: 921643 - protein, 9 aa, Homo Sapiens
SMPEDSAEN

SEQ ID NO: 921644 - protein, 9 aa, Homo Sapiens
INPYPLMLH

SEQ ID NO: 921645 - protein, 9 aa, Homo Sapiens
CRTLSNVEE

SEQ ID NO: 921646 - protein, 9 aa, Homo Sapiens
PLFPAFSLA

SEQ ID NO: 921647 - protein, 9 aa, Homo Sapiens
AAWEKELVN

SEQ ID NO: 921648 - protein, 9 aa, Homo Sapiens
DSGHLQILK

SEQ ID NO: 921649 - protein, 9 aa, Homo Sapiens
IALQPGPLE

SEQ ID NO: 921650 - protein, 9 aa, Homo Sapiens
SALELIICC

SEQ ID NO: 921651 - protein, 9 aa, Homo Sapiens
YEVAQRKPE

SEQ ID NO: 921652 - protein, 9 aa, Homo Sapiens
RPRHSHLTR

SEQ ID NO: 921653 - protein, 9 aa, Homo Sapiens
QSGINYAVD

SEQ ID NO: 921654 - protein, 9 aa, Homo Sapiens
TVGAKASII

SEQ ID NO: 921655 - protein, 9 aa, Homo Sapiens
AFLRKSKAA

SEQ ID NO: 921656 - protein, 9 aa, Homo Sapiens
LETAIADVE

SEQ ID NO: 921657 - protein, 9 aa, Homo Sapiens
PGKGGAQGA

SEQ ID NO: 921658 - protein, 9 aa, Homo Sapiens
DRIATLSYL

SEQ ID NO: 921659 - protein, 9 aa, Homo Sapiens
IGNIFIVRI

SEQ ID NO: 921660 - protein, 9 aa, Homo Sapiens
GLPEFYNIS

SEQ ID NO: 921661 - protein, 9 aa, Homo Sapiens
DPTPQSPDF

SEQ ID NO: 921662 - protein, 9 aa, Homo Sapiens
LVFDNMGPY

SEQ ID NO: 921663 - protein, 9 aa, Homo Sapiens
IGDFGLATE

SEQ ID NO: 921664 - protein, 9 aa, Homo Sapiens
LRGIEKFTN

SEQ ID NO: 921665 - protein, 9 aa, Homo Sapiens
KVKGSPSFL

SEQ ID NO: 921666 - protein, 9 aa, Homo Sapiens
FRVVLELFD

SEQ ID NO: 921667 - protein, 9 aa, Homo Sapiens
AGGRPSGEP

SEQ ID NO: 921668 - protein, 9 aa, Homo Sapiens
NSWASAPSP

SEQ ID NO: 921669 - protein, 9 aa, Homo Sapiens
KGSHGLGIF

SEQ ID NO: 921670 - protein, 9 aa, Homo Sapiens
KRKIATRNV

SEQ ID NO: 921671 - protein, 9 aa, Homo Sapiens
SVSPQVVYT

SEQ ID NO: 921672 - protein, 9 aa, Homo Sapiens
QESWGSSQH

SEQ ID NO: 921673 - protein, 9 aa, Homo Sapiens
EFCGGPSGL

SEQ ID NO: 921674 - protein, 9 aa, Homo Sapiens
APAEASVCY

SEQ ID NO: 921675 - protein, 9 aa, Homo Sapiens
PGAWPGASS

SEQ ID NO: 921676 - protein, 9 aa, Homo Sapiens
NICNEVALH

SEQ ID NO: 921677 - protein, 9 aa, Homo Sapiens
STLIDDYEG

SEQ ID NO: 921678 - protein, 9 aa, Homo Sapiens
QTKFCQSQP

SEQ ID NO: 921679 - protein, 9 aa, Homo Sapiens
APFDSSWVK

SEQ ID NO: 921680 - protein, 9 aa, Homo Sapiens
EAPGDNRVC

SEQ ID NO: 921681 - protein, 9 aa, Homo Sapiens
PNPCHGGAS

SEQ ID NO: 921682 - protein, 9 aa, Homo Sapiens
ASTSYFFPW

SEQ ID NO: 921683 - protein, 9 aa, Homo Sapiens
HHNKKHGGF

SEQ ID NO: 921684 - protein, 9 aa, Homo Sapiens
VVVKAVQQY

SEQ ID NO: 921685 - protein, 9 aa, Homo Sapiens
GLPGERGTS

SEQ ID NO: 921686 - protein, 9 aa, Homo Sapiens
SLMDFEWLK

SEQ ID NO: 921687 - protein, 9 aa, Homo Sapiens
VAKLREGIS

SEQ ID NO: 921688 - protein, 9 aa, Homo Sapiens
MALTSGWGS

SEQ ID NO: 921689 - protein, 9 aa, Homo Sapiens
TVQRLPLGQ

SEQ ID NO: 921690 - protein, 9 aa, Homo Sapiens
SDTRDLEEY

SEQ ID NO: 921691 - protein, 9 aa, Homo Sapiens
TLLLVFLRA

SEQ ID NO: 921692 - protein, 9 aa, Homo Sapiens
ICTKCQSSA

SEQ ID NO: 921693 - protein, 9 aa, Homo Sapiens
GLYGPKKKE

SEQ ID NO: 921694 - protein, 9 aa, Homo Sapiens
TGNSYLDDI

SEQ ID NO: 921695 - protein, 9 aa, Homo Sapiens
LGSYCKGRG

SEQ ID NO: 921696 - protein, 9 aa, Homo Sapiens
FFSVSPQVV

SEQ ID NO: 921697 - protein, 9 aa, Homo Sapiens
NSLALSQSS

SEQ ID NO: 921698 - protein, 9 aa, Homo Sapiens
IYSIRTNDV

SEQ ID NO: 921699 - protein, 9 aa, Homo Sapiens
PRLGMHSPP

SEQ ID NO: 921700 - protein, 9 aa, Homo Sapiens
HDSSCICER

SEQ ID NO: 921701 - protein, 9 aa, Homo Sapiens
SEILRRAAA

SEQ ID NO: 921702 - protein, 9 aa, Homo Sapiens
HIKSLMDFE

SEQ ID NO: 921703 - protein, 9 aa, Homo Sapiens
GILSGNPLS

SEQ ID NO: 921704 - protein, 9 aa, Homo Sapiens
AENKGIPDG

SEQ ID NO: 921705 - protein, 9 aa, Homo Sapiens
FWARRIAST

SEQ ID NO: 921706 - protein, 9 aa, Homo Sapiens
LHPLGWLVP

SEQ ID NO: 921707 - protein, 9 aa, Homo Sapiens
YNPELLVHP

SEQ ID NO: 921708 - protein, 9 aa, Homo Sapiens
ATGNSYLDD

SEQ ID NO: 921709 - protein, 9 aa, Homo Sapiens
AHKKIKEKL

SEQ ID NO: 921710 - protein, 9 aa, Homo Sapiens
LVIQMAHKK

SEQ ID NO: 921711 - protein, 9 aa, Homo Sapiens
LSPVDLEKH

SEQ ID NO: 921712 - protein, 9 aa, Homo Sapiens
QDNELPGLN

SEQ ID NO: 921713 - protein, 9 aa, Homo Sapiens
PQVVYTAML

SEQ ID NO: 921714 - protein, 9 aa, Homo Sapiens
VEVADFDFF

SEQ ID NO: 921715 - protein, 9 aa, Homo Sapiens
LKANALPAP

SEQ ID NO: 921716 - protein, 9 aa, Homo Sapiens
LLRASVAQA

SEQ ID NO: 921717 - protein, 9 aa, Homo Sapiens
GFVPDEHGT

SEQ ID NO: 921718 - protein, 9 aa, Homo Sapiens
EVADFDFFP

SEQ ID NO: 921719 - protein, 9 aa, Homo Sapiens
STEGMKGAA

SEQ ID NO: 921720 - protein, 9 aa, Homo Sapiens
YIFKREPSE

SEQ ID NO: 921721 - protein, 9 aa, Homo Sapiens
KRKRRKPRK

SEQ ID NO: 921722 - protein, 9 aa, Homo Sapiens
FAVHSIHTE

SEQ ID NO: 921723 - protein, 9 aa, Homo Sapiens
CSEAIKSAM

SEQ ID NO: 921724 - protein, 9 aa, Homo Sapiens
YGQKVSMEE

SEQ ID NO: 921725 - protein, 9 aa, Homo Sapiens
MTSLSGGPQ

SEQ ID NO: 921726 - protein, 9 aa, Homo Sapiens
QEKLEMQLE

SEQ ID NO: 921727 - protein, 9 aa, Homo Sapiens
IPLPGGGCV

SEQ ID NO: 921728 - protein, 9 aa, Homo Sapiens
GSLDWDNQV

SEQ ID NO: 921729 - protein, 9 aa, Homo Sapiens
LGIFQRCDC

SEQ ID NO: 921730 - protein, 9 aa, Homo Sapiens
GLWSEMLGV

SEQ ID NO: 921731 - protein, 9 aa, Homo Sapiens
FDLVRTASW

SEQ ID NO: 921732 - protein, 9 aa, Homo Sapiens
TKRLPYCRR

SEQ ID NO: 921733 - protein, 9 aa, Homo Sapiens
KDCLDFTSS

SEQ ID NO: 921734 - protein, 9 aa, Homo Sapiens
KAKENLEKM

SEQ ID NO: 921735 - protein, 9 aa, Homo Sapiens
LLNVESKHF

SEQ ID NO: 921736 - protein, 9 aa, Homo Sapiens
NLYSATKIG

SEQ ID NO: 921737 - protein, 9 aa, Homo Sapiens
GYNPELLVH

SEQ ID NO: 921738 - protein, 9 aa, Homo Sapiens
MMQKDLENV

SEQ ID NO: 921739 - protein, 9 aa, Homo Sapiens
QPDDCIDEA

SEQ ID NO: 921740 - protein, 9 aa, Homo Sapiens
ELRRAEFCG

SEQ ID NO: 921741 - protein, 9 aa, Homo Sapiens
PAVQTVASM

SEQ ID NO: 921742 - protein, 9 aa, Homo Sapiens
YTVGAKASI

SEQ ID NO: 921743 - protein, 9 aa, Homo Sapiens
SGGESLSEK

SEQ ID NO: 921744 - protein, 9 aa, Homo Sapiens
GGRRSLKAL

SEQ ID NO: 921745 - protein, 9 aa, Homo Sapiens
VHVCALKAQ

SEQ ID NO: 921746 - protein, 9 aa, Homo Sapiens
IAKSEIFNE

SEQ ID NO: 921747 - protein, 9 aa, Homo Sapiens
GGAFPIENL

SEQ ID NO: 921748 - protein, 9 aa, Homo Sapiens
ILDRYKSNF

SEQ ID NO: 921749 - protein, 9 aa, Homo Sapiens
PESFANVSI

SEQ ID NO: 921750 - protein, 9 aa, Homo Sapiens
ADDGLVALN

SEQ ID NO: 921751 - protein, 9 aa, Homo Sapiens
KIVDHVDCM

SEQ ID NO: 921752 - protein, 9 aa, Homo Sapiens
AEASTFQAL

SEQ ID NO: 921753 - protein, 9 aa, Homo Sapiens
ALKALDELD

SEQ ID NO: 921754 - protein, 9 aa, Homo Sapiens
PPLFPAFSL

SEQ ID NO: 921755 - protein, 9 aa, Homo Sapiens
SLGSYCKGR

SEQ ID NO: 921756 - protein, 9 aa, Homo Sapiens
TRDLEEYDD

SEQ ID NO: 921757 - protein, 9 aa, Homo Sapiens
CLEKFSVIQ

SEQ ID NO: 921758 - protein, 9 aa, Homo Sapiens
QMFVPFRHV

SEQ ID NO: 921759 - protein, 9 aa, Homo Sapiens
DDSTLVQRQ

SEQ ID NO: 921760 - protein, 9 aa, Homo Sapiens
IFAYWFTHR

SEQ ID NO: 921761 - protein, 9 aa, Homo Sapiens
LYGPKKKEK

SEQ ID NO: 921762 - protein, 9 aa, Homo Sapiens
AQRLVSWID

SEQ ID NO: 921763 - protein, 9 aa, Homo Sapiens
LISKGLKDV

SEQ ID NO: 921764 - protein, 9 aa, Homo Sapiens
LPLGQKVIA

SEQ ID NO: 921765 - protein, 9 aa, Homo Sapiens
FRNESDGLN

SEQ ID NO: 921766 - protein, 9 aa, Homo Sapiens
ITSSNMQIY

SEQ ID NO: 921767 - protein, 9 aa, Homo Sapiens
HGDRPLLGT

SEQ ID NO: 921768 - protein, 9 aa, Homo Sapiens
LLKAHPKFL

SEQ ID NO: 921769 - protein, 9 aa, Homo Sapiens
DGPQRGAFP

SEQ ID NO: 921770 - protein, 9 aa, Homo Sapiens
FCLAEGVSH

SEQ ID NO: 921771 - protein, 9 aa, Homo Sapiens
VVFCLAEGV

SEQ ID NO: 921772 - protein, 9 aa, Homo Sapiens
PTKRSVECK

SEQ ID NO: 921773 - protein, 9 aa, Homo Sapiens
RNFSFFEIS

SEQ ID NO: 921774 - protein, 9 aa, Homo Sapiens
FTSRAAIYR

SEQ ID NO: 921775 - protein, 9 aa, Homo Sapiens
LIMGFLILG

SEQ ID NO: 921776 - protein, 9 aa, Homo Sapiens
RDLEEYDDG

SEQ ID NO: 921777 - protein, 9 aa, Homo Sapiens
TGQKLYECA

SEQ ID NO: 921778 - protein, 9 aa, Homo Sapiens
TKCLGKSKE

SEQ ID NO: 921779 - protein, 9 aa, Homo Sapiens
LKALREYQG

SEQ ID NO: 921780 - protein, 9 aa, Homo Sapiens
LQMFVPFRH

SEQ ID NO: 921781 - protein, 9 aa, Homo Sapiens
KKEDIVILL

SEQ ID NO: 921782 - protein, 9 aa, Homo Sapiens
FETEDQKPT

SEQ ID NO: 921783 - protein, 9 aa, Homo Sapiens
LYGTVLKLK

SEQ ID NO: 921784 - protein, 9 aa, Homo Sapiens
ARILYSEQK

SEQ ID NO: 921785 - protein, 9 aa, Homo Sapiens
AIEVETGKP

SEQ ID NO: 921786 - protein, 9 aa, Homo Sapiens
VASLLKRQA

SEQ ID NO: 921787 - protein, 9 aa, Homo Sapiens
LSALSLSEA

SEQ ID NO: 921788 - protein, 9 aa, Homo Sapiens
LSCEYKIEN

SEQ ID NO: 921789 - protein, 9 aa, Homo Sapiens
RIQASSSEA

SEQ ID NO: 921790 - protein, 9 aa, Homo Sapiens
SLYSYYRGA

SEQ ID NO: 921791 - protein, 9 aa, Homo Sapiens
SLKALREYQ

SEQ ID NO: 921792 - protein, 9 aa, Homo Sapiens
HKKIKEKLE

SEQ ID NO: 921793 - protein, 9 aa, Homo Sapiens
REPSEGCEK

SEQ ID NO: 921794 - protein, 9 aa, Homo Sapiens
APALLKVYD

SEQ ID NO: 921795 - protein, 9 aa, Homo Sapiens
PEKPGKPGS

SEQ ID NO: 921796 - protein, 9 aa, Homo Sapiens
VMVLIAPRG

SEQ ID NO: 921797 - protein, 9 aa, Homo Sapiens
KLEMETDAV

SEQ ID NO: 921798 - protein, 9 aa, Homo Sapiens
SEVRLAVRK

SEQ ID NO: 921799 - protein, 9 aa, Homo Sapiens
YKEKRRSEA

SEQ ID NO: 921800 - protein, 9 aa, Homo Sapiens
VTAEFQEAL

SEQ ID NO: 921801 - protein, 9 aa, Homo Sapiens
QSGKFSGNP

SEQ ID NO: 921802 - protein, 9 aa, Homo Sapiens
RFFSVSPQV

SEQ ID NO: 921803 - protein, 9 aa, Homo Sapiens
GKNVLLLVH

SEQ ID NO: 921804 - protein, 9 aa, Homo Sapiens
EFIGKFGLA

SEQ ID NO: 921805 - protein, 9 aa, Homo Sapiens
TYLEACLDF

SEQ ID NO: 921806 - protein, 9 aa, Homo Sapiens
CPIPPTSSP

SEQ ID NO: 921807 - protein, 9 aa, Homo Sapiens
TTHKIIYTG

SEQ ID NO: 921808 - protein, 9 aa, Homo Sapiens
LKWRYKEAK

SEQ ID NO: 921809 - protein, 9 aa, Homo Sapiens
TDPNMADNE

SEQ ID NO: 921810 - protein, 9 aa, Homo Sapiens
VEQRGDCAL

SEQ ID NO: 921811 - protein, 9 aa, Homo Sapiens
AFPIENLYS

SEQ ID NO: 921812 - protein, 9 aa, Homo Sapiens
RLFMDFATQ

SEQ ID NO: 921813 - protein, 9 aa, Homo Sapiens
NEDLDLGPV

SEQ ID NO: 921814 - protein, 9 aa, Homo Sapiens
KSLRVLKLF

SEQ ID NO: 921815 - protein, 9 aa, Homo Sapiens
SLYIRSTFI

SEQ ID NO: 921816 - protein, 9 aa, Homo Sapiens
DASFYTYML

SEQ ID NO: 921817 - protein, 9 aa, Homo Sapiens
INYAVDIPE

SEQ ID NO: 921818 - protein, 9 aa, Homo Sapiens
RHLSCDSFS

SEQ ID NO: 921819 - protein, 9 aa, Homo Sapiens
MIGQFLYSE

SEQ ID NO: 921820 - protein, 9 aa, Homo Sapiens
LYKVYKLDF

SEQ ID NO: 921821 - protein, 9 aa, Homo Sapiens
GYWLCYINN

SEQ ID NO: 921822 - protein, 9 aa, Homo Sapiens
IMPEPGQDE

SEQ ID NO: 921823 - protein, 9 aa, Homo Sapiens
STKKVGEEV

SEQ ID NO: 921824 - protein, 9 aa, Homo Sapiens
KFSVIQHFK

SEQ ID NO: 921825 - protein, 9 aa, Homo Sapiens
VELRYSVGS

SEQ ID NO: 921826 - protein, 9 aa, Homo Sapiens
RKTSEKQSI

SEQ ID NO: 921827 - protein, 9 aa, Homo Sapiens
LGINICHPD

SEQ ID NO: 921828 - protein, 9 aa, Homo Sapiens
LEDYDERGE

SEQ ID NO: 921829 - protein, 9 aa, Homo Sapiens
AEFQEALGP

SEQ ID NO: 921830 - protein, 9 aa, Homo Sapiens
LREKLTRTD

SEQ ID NO: 921831 - protein, 9 aa, Homo Sapiens
MGLVLSELE

SEQ ID NO: 921832 - protein, 9 aa, Homo Sapiens
HKKIYAGKK

SEQ ID NO: 921833 - protein, 9 aa, Homo Sapiens
AKVVFCLAE

SEQ ID NO: 921834 - protein, 9 aa, Homo Sapiens
REAKKKNRE

SEQ ID NO: 921835 - protein, 9 aa, Homo Sapiens
PQWSLKLAR

SEQ ID NO: 921836 - protein, 9 aa, Homo Sapiens
SKGAPFRWP

SEQ ID NO: 921837 - protein, 9 aa, Homo Sapiens
AESVADRLD

SEQ ID NO: 921838 - protein, 9 aa, Homo Sapiens
SSPPRHLSC

SEQ ID NO: 921839 - protein, 9 aa, Homo Sapiens
IATCNSRNE

SEQ ID NO: 921840 - protein, 9 aa, Homo Sapiens
AAKVFEFIG

SEQ ID NO: 921841 - protein, 9 aa, Homo Sapiens
RTDEGRPSF

SEQ ID NO: 921842 - protein, 9 aa, Homo Sapiens
SSFIEDLAL

SEQ ID NO: 921843 - protein, 9 aa, Homo Sapiens
NATGNSYLD

SEQ ID NO: 921844 - protein, 9 aa, Homo Sapiens
SSNMNKALL

SEQ ID NO: 921845 - protein, 9 aa, Homo Sapiens
DIFDEFKAD

SEQ ID NO: 921846 - protein, 9 aa, Homo Sapiens
HPKFLKKFH

SEQ ID NO: 921847 - protein, 9 aa, Homo Sapiens
LLFDASFYT

SEQ ID NO: 921848 - protein, 9 aa, Homo Sapiens
IFLPINFKD

SEQ ID NO: 921849 - protein, 9 aa, Homo Sapiens
DVTNIVQKK

SEQ ID NO: 921850 - protein, 9 aa, Homo Sapiens
KEYRNQFSE

SEQ ID NO: 921851 - protein, 9 aa, Homo Sapiens
QVAFDDSTL

SEQ ID NO: 921852 - protein, 9 aa, Homo Sapiens
KQRQEKLEM

SEQ ID NO: 921853 - protein, 9 aa, Homo Sapiens
SKEILSPVD

SEQ ID NO: 921854 - protein, 9 aa, Homo Sapiens
AGQVMCLIV

SEQ ID NO: 921855 - protein, 9 aa, Homo Sapiens
RRSLKALRE

SEQ ID NO: 921856 - protein, 9 aa, Homo Sapiens
DKLARLQNT

SEQ ID NO: 921857 - protein, 9 aa, Homo Sapiens
LDKSDDSDF

SEQ ID NO: 921858 - protein, 9 aa, Homo Sapiens
KNFIYESMR

SEQ ID NO: 921859 - protein, 9 aa, Homo Sapiens
PGERGTSGL

SEQ ID NO: 921860 - protein, 9 aa, Homo Sapiens
CACSCDLDS

SEQ ID NO: 921861 - protein, 9 aa, Homo Sapiens
LRFWARRIA

SEQ ID NO: 921862 - protein, 9 aa, Homo Sapiens
FMIGMFSLY

SEQ ID NO: 921863 - protein, 9 aa, Homo Sapiens
ALVVGTHFW

SEQ ID NO: 921864 - protein, 9 aa, Homo Sapiens
QRLRPPGPD

SEQ ID NO: 921865 - protein, 9 aa, Homo Sapiens
LVALNWVVG

SEQ ID NO: 921866 - protein, 9 aa, Homo Sapiens
AECLEKFSV

SEQ ID NO: 921867 - protein, 9 aa, Homo Sapiens
KYTLSAAVD

SEQ ID NO: 921868 - protein, 9 aa, Homo Sapiens
TKCQSSAIT

SEQ ID NO: 921869 - protein, 9 aa, Homo Sapiens
ATDYVEHVK

SEQ ID NO: 921870 - protein, 9 aa, Homo Sapiens
NGGFDLVRT

SEQ ID NO: 921871 - protein, 9 aa, Homo Sapiens
FRSPGQDIS

SEQ ID NO: 921872 - protein, 9 aa, Homo Sapiens
SYGSDKRMS

SEQ ID NO: 921873 - protein, 9 aa, Homo Sapiens
ADMLVAINP

SEQ ID NO: 921874 - protein, 9 aa, Homo Sapiens
PPKQQAQKA

SEQ ID NO: 921875 - protein, 9 aa, Homo Sapiens
LASGKGLWS

SEQ ID NO: 921876 - protein, 9 aa, Homo Sapiens
MCFILALSQ

SEQ ID NO: 921877 - protein, 9 aa, Homo Sapiens
HLLQRSRLL

SEQ ID NO: 921878 - protein, 9 aa, Homo Sapiens
SRAAIYRIS

SEQ ID NO: 921879 - protein, 9 aa, Homo Sapiens
EKTNLGHAL

SEQ ID NO: 921880 - protein, 9 aa, Homo Sapiens
EHRYTLRTL

SEQ ID NO: 921881 - protein, 9 aa, Homo Sapiens
QMAQEMKAE

SEQ ID NO: 921882 - protein, 9 aa, Homo Sapiens
DQFFATEVC

SEQ ID NO: 921883 - protein, 9 aa, Homo Sapiens
NECALGATV

SEQ ID NO: 921884 - protein, 9 aa, Homo Sapiens
GFGVSQRLD

SEQ ID NO: 921885 - protein, 9 aa, Homo Sapiens
HLQILKWRY

SEQ ID NO: 921886 - protein, 9 aa, Homo Sapiens
SKGLKDVSW

SEQ ID NO: 921887 - protein, 9 aa, Homo Sapiens
GRSQGRLEV

SEQ ID NO: 921888 - protein, 9 aa, Homo Sapiens
GLKDVSWTS

SEQ ID NO: 921889 - protein, 9 aa, Homo Sapiens
QVMCLIVFM

SEQ ID NO: 921890 - protein, 9 aa, Homo Sapiens
HQNNPWHPP

SEQ ID NO: 921891 - protein, 9 aa, Homo Sapiens
IKDALNLIK

SEQ ID NO: 921892 - protein, 9 aa, Homo Sapiens
CTPPLFPAF

SEQ ID NO: 921893 - protein, 9 aa, Homo Sapiens
QLHDSSCIC

SEQ ID NO: 921894 - protein, 9 aa, Homo Sapiens
VESTNAVCQ

SEQ ID NO: 921895 - protein, 9 aa, Homo Sapiens
IQKAFDNIA

SEQ ID NO: 921896 - protein, 9 aa, Homo Sapiens
GTSGLPGPK

SEQ ID NO: 921897 - protein, 9 aa, Homo Sapiens
GKNFNFTRS

SEQ ID NO: 921898 - protein, 9 aa, Homo Sapiens
NKKHGGFSK

SEQ ID NO: 921899 - protein, 9 aa, Homo Sapiens
QRLDGLKYE

SEQ ID NO: 921900 - protein, 9 aa, Homo Sapiens
LINSWASAP

SEQ ID NO: 921901 - protein, 9 aa, Homo Sapiens
PGRPDSAPE

SEQ ID NO: 921902 - protein, 9 aa, Homo Sapiens
NRVCSANGF

SEQ ID NO: 921903 - protein, 9 aa, Homo Sapiens
ISESRSIDR

SEQ ID NO: 921904 - protein, 9 aa, Homo Sapiens
PQSLPPIPS

SEQ ID NO: 921905 - protein, 9 aa, Homo Sapiens
GQQGLAIFT

SEQ ID NO: 921906 - protein, 9 aa, Homo Sapiens
LCRIQASSS

SEQ ID NO: 921907 - protein, 9 aa, Homo Sapiens
REPRKRLLL

SEQ ID NO: 921908 - protein, 9 aa, Homo Sapiens
GAKVVFCLA

SEQ ID NO: 921909 - protein, 9 aa, Homo Sapiens
GKGLWSEML

SEQ ID NO: 921910 - protein, 9 aa, Homo Sapiens
APHRVTAGE

SEQ ID NO: 921911 - protein, 9 aa, Homo Sapiens
KLTRTDEGR

SEQ ID NO: 921912 - protein, 9 aa, Homo Sapiens
VRRGPQSLP

SEQ ID NO: 921913 - protein, 9 aa, Homo Sapiens
RLQGTSSYS

SEQ ID NO: 921914 - protein, 9 aa, Homo Sapiens
TIDASFIGI

SEQ ID NO: 921915 - protein, 9 aa, Homo Sapiens
LYSEERESG

SEQ ID NO: 921916 - protein, 9 aa, Homo Sapiens
KGLKDVSWT

SEQ ID NO: 921917 - protein, 9 aa, Homo Sapiens
RSPAQPDDC

SEQ ID NO: 921918 - protein, 9 aa, Homo Sapiens
VQRLPLGQK

SEQ ID NO: 921919 - protein, 9 aa, Homo Sapiens
LDHSVKRKR

SEQ ID NO: 921920 - protein, 9 aa, Homo Sapiens
RLLRASVAQ

SEQ ID NO: 921921 - protein, 9 aa, Homo Sapiens
SGWGSSAGP

SEQ ID NO: 921922 - protein, 9 aa, Homo Sapiens
TQIFLPINF

SEQ ID NO: 921923 - protein, 9 aa, Homo Sapiens
QRGAFPRLW

SEQ ID NO: 921924 - protein, 9 aa, Homo Sapiens
NICHPDTFS

SEQ ID NO: 921925 - protein, 9 aa, Homo Sapiens
EADHDSDGP

SEQ ID NO: 921926 - protein, 9 aa, Homo Sapiens
AVREGNPGS

SEQ ID NO: 921927 - protein, 9 aa, Homo Sapiens
TGLYWCMAA

SEQ ID NO: 921928 - protein, 9 aa, Homo Sapiens
WLVFDNMGP

SEQ ID NO: 921929 - protein, 9 aa, Homo Sapiens
ELNEELIQK

SEQ ID NO: 921930 - protein, 9 aa, Homo Sapiens
ELRKQVAKL

SEQ ID NO: 921931 - protein, 9 aa, Homo Sapiens
PDVTNIVQK

SEQ ID NO: 921932 - protein, 9 aa, Homo Sapiens
VQKRELQQA

SEQ ID NO: 921933 - protein, 9 aa, Homo Sapiens
LPPFMRNKQ

SEQ ID NO: 921934 - protein, 9 aa, Homo Sapiens
PDGSDAVPQ

SEQ ID NO: 921935 - protein, 9 aa, Homo Sapiens
FWLPIPAKY

SEQ ID NO: 921936 - protein, 9 aa, Homo Sapiens
NLFGETPEG

SEQ ID NO: 921937 - protein, 9 aa, Homo Sapiens
ARLQNTLEL

SEQ ID NO: 921938 - protein, 9 aa, Homo Sapiens
MAKAALKAL

SEQ ID NO: 921939 - protein, 9 aa, Homo Sapiens
LTRTDEGRP

SEQ ID NO: 921940 - protein, 9 aa, Homo Sapiens
NKELASKKK

SEQ ID NO: 921941 - protein, 9 aa, Homo Sapiens
LEEYDDGEK

SEQ ID NO: 921942 - protein, 9 aa, Homo Sapiens
GPDKDAVER

SEQ ID NO: 921943 - protein, 9 aa, Homo Sapiens
TPQSPDFET

SEQ ID NO: 921944 - protein, 9 aa, Homo Sapiens
CKGRGKNFN

SEQ ID NO: 921945 - protein, 9 aa, Homo Sapiens
IYTGKKPYK

SEQ ID NO: 921946 - protein, 9 aa, Homo Sapiens
MAPALLKVY

SEQ ID NO: 921947 - protein, 9 aa, Homo Sapiens
QRLVSWIDH

SEQ ID NO: 921948 - protein, 9 aa, Homo Sapiens
FSSEKLLAK

SEQ ID NO: 921949 - protein, 9 aa, Homo Sapiens
LHPSPLPSF

SEQ ID NO: 921950 - protein, 9 aa, Homo Sapiens
RKPESFANV

SEQ ID NO: 921951 - protein, 9 aa, Homo Sapiens
EVLQKLLMG

SEQ ID NO: 921952 - protein, 9 aa, Homo Sapiens
KMAPALLKV

SEQ ID NO: 921953 - protein, 9 aa, Homo Sapiens
LDLSALYSV

SEQ ID NO: 921954 - protein, 9 aa, Homo Sapiens
GQVMCLIVF

SEQ ID NO: 921955 - protein, 9 aa, Homo Sapiens
LCEGEKPKS

SEQ ID NO: 921956 - protein, 9 aa, Homo Sapiens
WNFSQVLEN

SEQ ID NO: 921957 - protein, 9 aa, Homo Sapiens
SAPEKPGKP

SEQ ID NO: 921958 - protein, 9 aa, Homo Sapiens
WLCYINNTI

SEQ ID NO: 921959 - protein, 9 aa, Homo Sapiens
CPTKMDVQV

SEQ ID NO: 921960 - protein, 9 aa, Homo Sapiens
PVSAPPSPK

SEQ ID NO: 921961 - protein, 9 aa, Homo Sapiens
PPKVSEGKN

SEQ ID NO: 921962 - protein, 9 aa, Homo Sapiens
VDLLKFDGW

SEQ ID NO: 921963 - protein, 9 aa, Homo Sapiens
VVCSDTRDL

SEQ ID NO: 921964 - protein, 9 aa, Homo Sapiens
VMAAYKEKR

SEQ ID NO: 921965 - protein, 9 aa, Homo Sapiens
SRLKANALP

SEQ ID NO: 921966 - protein, 9 aa, Homo Sapiens
KKKHTPRRR

SEQ ID NO: 921967 - protein, 9 aa, Homo Sapiens
LQGRTPHCE

SEQ ID NO: 921968 - protein, 9 aa, Homo Sapiens
RERDRHSLF

SEQ ID NO: 921969 - protein, 9 aa, Homo Sapiens
RWGWNDVIC

SEQ ID NO: 921970 - protein, 9 aa, Homo Sapiens
SLSGGPQSR

SEQ ID NO: 921971 - protein, 9 aa, Homo Sapiens
RTASWQETA

SEQ ID NO: 921972 - protein, 9 aa, Homo Sapiens
PTPQSPDFE

SEQ ID NO: 921973 - protein, 9 aa, Homo Sapiens
RWPLYTNVP

SEQ ID NO: 921974 - protein, 9 aa, Homo Sapiens
YLVSTKKVG

SEQ ID NO: 921975 - protein, 9 aa, Homo Sapiens
TKPQWSLKL

SEQ ID NO: 921976 - protein, 9 aa, Homo Sapiens
WPGASSLSS

SEQ ID NO: 921977 - protein, 9 aa, Homo Sapiens
ELIICCVKK

SEQ ID NO: 921978 - protein, 9 aa, Homo Sapiens
GTSSYSADT

SEQ ID NO: 921979 - protein, 9 aa, Homo Sapiens
FSKRKRKIA

SEQ ID NO: 921980 - protein, 9 aa, Homo Sapiens
LKVMKNFIY

SEQ ID NO: 921981 - protein, 9 aa, Homo Sapiens
PTPWGSKML

SEQ ID NO: 921982 - protein, 9 aa, Homo Sapiens
VNLFGETPE

SEQ ID NO: 921983 - protein, 9 aa, Homo Sapiens
FVLSLALTA

SEQ ID NO: 921984 - protein, 9 aa, Homo Sapiens
VMCLIVFMM

SEQ ID NO: 921985 - protein, 9 aa, Homo Sapiens
LLVFLRARK

SEQ ID NO: 921986 - protein, 9 aa, Homo Sapiens
YTLLNLLGN

SEQ ID NO: 921987 - protein, 9 aa, Homo Sapiens
PLSCEYKIE

SEQ ID NO: 921988 - protein, 9 aa, Homo Sapiens
PVKQADTID

SEQ ID NO: 921989 - protein, 9 aa, Homo Sapiens
KRSVECKEK

SEQ ID NO: 921990 - protein, 9 aa, Homo Sapiens
SSQTKFCQS

SEQ ID NO: 921991 - protein, 9 aa, Homo Sapiens
VLTDVKKKI

SEQ ID NO: 921992 - protein, 9 aa, Homo Sapiens
AQPDDCIDE

SEQ ID NO: 921993 - protein, 9 aa, Homo Sapiens
SFRGAPCSD

SEQ ID NO: 921994 - protein, 9 aa, Homo Sapiens
RPLSCEYKI

SEQ ID NO: 921995 - protein, 9 aa, Homo Sapiens
VLIAPRGRV

SEQ ID NO: 921996 - protein, 9 aa, Homo Sapiens
RGIEKFTNY

SEQ ID NO: 921997 - protein, 9 aa, Homo Sapiens
GTYGQKVSM

SEQ ID NO: 921998 - protein, 9 aa, Homo Sapiens
DSSKEKPQT

SEQ ID NO: 921999 - protein, 9 aa, Homo Sapiens
GLGIFQRCD

SEQ ID NO: 922000 - protein, 9 aa, Homo Sapiens
YRVTFITEN

SEQ ID NO: 922001 - protein, 9 aa, Homo Sapiens
KREPSEGCE

SEQ ID NO: 922002 - protein, 9 aa, Homo Sapiens
DCMTSPEQV

SEQ ID NO: 922003 - protein, 9 aa, Homo Sapiens
AQRKPESFA

SEQ ID NO: 922004 - protein, 9 aa, Homo Sapiens
SPQVVYTAM

SEQ ID NO: 922005 - protein, 9 aa, Homo Sapiens
PKDISMEID

SEQ ID NO: 922006 - protein, 9 aa, Homo Sapiens
MEAEASTFQ

SEQ ID NO: 922007 - protein, 9 aa, Homo Sapiens
AKVFEFIGK

SEQ ID NO: 922008 - protein, 9 aa, Homo Sapiens
LKNLDKEDL

SEQ ID NO: 922009 - protein, 9 aa, Homo Sapiens
DEADHDSDG

SEQ ID NO: 922010 - protein, 9 aa, Homo Sapiens
VVREVLQKL

SEQ ID NO: 922011 - protein, 9 aa, Homo Sapiens
KFSHKEKPD

SEQ ID NO: 922012 - protein, 9 aa, Homo Sapiens
EYTLLNLLG

SEQ ID NO: 922013 - protein, 9 aa, Homo Sapiens
GHIEPDPTQ

SEQ ID NO: 922014 - protein, 9 aa, Homo Sapiens
CALDEDFTD

SEQ ID NO: 922015 - protein, 9 aa, Homo Sapiens
GDNRVCSAN

SEQ ID NO: 922016 - protein, 9 aa, Homo Sapiens
KIKEKLEGK

SEQ ID NO: 922017 - protein, 9 aa, Homo Sapiens
ANELDTEIL

SEQ ID NO: 922018 - protein, 9 aa, Homo Sapiens
IETREPRKR

SEQ ID NO: 922019 - protein, 9 aa, Homo Sapiens
VQLEEQPRG

SEQ ID NO: 922020 - protein, 9 aa, Homo Sapiens
MQKDLENVT

SEQ ID NO: 922021 - protein, 9 aa, Homo Sapiens
PTEEKSVGD

SEQ ID NO: 922022 - protein, 9 aa, Homo Sapiens
SQSAFYPEN

SEQ ID NO: 922023 - protein, 9 aa, Homo Sapiens
GWYCDSLEN

SEQ ID NO: 922024 - protein, 9 aa, Homo Sapiens
EVVVKAVQQ

SEQ ID NO: 922025 - protein, 9 aa, Homo Sapiens
GSYRVTFIT

SEQ ID NO: 922026 - protein, 9 aa, Homo Sapiens
TSKSTGQEY

SEQ ID NO: 922027 - protein, 9 aa, Homo Sapiens
IRSGCGQLA

SEQ ID NO: 922028 - protein, 9 aa, Homo Sapiens
PHNFFDQFF

SEQ ID NO: 922029 - protein, 9 aa, Homo Sapiens
SYFFPWMLA

SEQ ID NO: 922030 - protein, 9 aa, Homo Sapiens
CHGGASCQN

SEQ ID NO: 922031 - protein, 9 aa, Homo Sapiens
YQPMSFRPK

SEQ ID NO: 922032 - protein, 9 aa, Homo Sapiens
VIARGHIEP

SEQ ID NO: 922033 - protein, 9 aa, Homo Sapiens
KVALKGSQV

SEQ ID NO: 922034 - protein, 9 aa, Homo Sapiens
KGAKTKKLA

SEQ ID NO: 922035 - protein, 9 aa, Homo Sapiens
QTQLYKVYK

SEQ ID NO: 922036 - protein, 9 aa, Homo Sapiens
GSKIPLPGG

SEQ ID NO: 922037 - protein, 9 aa, Homo Sapiens
QSLPPIPST

SEQ ID NO: 922038 - protein, 9 aa, Homo Sapiens
FLIPIVFIS

SEQ ID NO: 922039 - protein, 9 aa, Homo Sapiens
KCDLTLFLV

SEQ ID NO: 922040 - protein, 9 aa, Homo Sapiens
PLTAEKLYI

SEQ ID NO: 922041 - protein, 9 aa, Homo Sapiens
ELKNLLKKN

SEQ ID NO: 922042 - protein, 9 aa, Homo Sapiens
VLVQIYELE

SEQ ID NO: 922043 - protein, 9 aa, Homo Sapiens
CWRTAPEFR

SEQ ID NO: 922044 - protein, 9 aa, Homo Sapiens
SFSSDDGDK

SEQ ID NO: 922045 - protein, 9 aa, Homo Sapiens
KHFFLYEEF

SEQ ID NO: 922046 - protein, 9 aa, Homo Sapiens
QLLSETLPK

SEQ ID NO: 922047 - protein, 9 aa, Homo Sapiens
YPSRAKIFG

SEQ ID NO: 922048 - protein, 9 aa, Homo Sapiens
HAARNYFPL

SEQ ID NO: 922049 - protein, 9 aa, Homo Sapiens
WELTQEASV

SEQ ID NO: 922050 - protein, 9 aa, Homo Sapiens
CSYTSGPGS

SEQ ID NO: 922051 - protein, 9 aa, Homo Sapiens
LHSHCPRHC

SEQ ID NO: 922052 - protein, 9 aa, Homo Sapiens
SSYATLVDL

SEQ ID NO: 922053 - protein, 9 aa, Homo Sapiens
PWGRLHSHC

SEQ ID NO: 922054 - protein, 9 aa, Homo Sapiens
EVVTMHKEK

SEQ ID NO: 922055 - protein, 9 aa, Homo Sapiens
LKNLLKKNA

SEQ ID NO: 922056 - protein, 9 aa, Homo Sapiens
LTPKQQRIS

SEQ ID NO: 922057 - protein, 9 aa, Homo Sapiens
GFKANKLTQ

SEQ ID NO: 922058 - protein, 9 aa, Homo Sapiens
RSRLLPALA

SEQ ID NO: 922059 - protein, 9 aa, Homo Sapiens
CTIHGFLML

SEQ ID NO: 922060 - protein, 9 aa, Homo Sapiens
IAPDPTIHT

SEQ ID NO: 922061 - protein, 9 aa, Homo Sapiens
YSVWLHGEF

SEQ ID NO: 922062 - protein, 9 aa, Homo Sapiens
SDWLRTIAW

SEQ ID NO: 922063 - protein, 9 aa, Homo Sapiens
ISAYASTYG

SEQ ID NO: 922064 - protein, 9 aa, Homo Sapiens
PPPPPPEFR

SEQ ID NO: 922065 - protein, 9 aa, Homo Sapiens
QLKREIRFM

SEQ ID NO: 922066 - protein, 9 aa, Homo Sapiens
SKWLFKSRN

SEQ ID NO: 922067 - protein, 9 aa, Homo Sapiens
GAAGPGKRH

SEQ ID NO: 922068 - protein, 9 aa, Homo Sapiens
AATMRSQPT

SEQ ID NO: 922069 - protein, 9 aa, Homo Sapiens
TTYRSSPSS

SEQ ID NO: 922070 - protein, 9 aa, Homo Sapiens
LATEKSRWS

SEQ ID NO: 922071 - protein, 9 aa, Homo Sapiens
WIIQNGTLI

SEQ ID NO: 922072 - protein, 9 aa, Homo Sapiens
FVFGQNGAG

SEQ ID NO: 922073 - protein, 9 aa, Homo Sapiens
HCPFFLETK

SEQ ID NO: 922074 - protein, 9 aa, Homo Sapiens
WELVQSFGA

SEQ ID NO: 922075 - protein, 9 aa, Homo Sapiens
VHAARNYFP

SEQ ID NO: 922076 - protein, 9 aa, Homo Sapiens
RRWDYSVWL

SEQ ID NO: 922077 - protein, 9 aa, Homo Sapiens
SKADAKTPV

SEQ ID NO: 922078 - protein, 9 aa, Homo Sapiens
DCYAAICSP

SEQ ID NO: 922079 - protein, 9 aa, Homo Sapiens
KADAKTPVL

SEQ ID NO: 922080 - protein, 9 aa, Homo Sapiens
PWHCPFFLE

SEQ ID NO: 922081 - protein, 9 aa, Homo Sapiens
FVKLSTTYR

SEQ ID NO: 922082 - protein, 9 aa, Homo Sapiens
SHSSFLPQV

SEQ ID NO: 922083 - protein, 9 aa, Homo Sapiens
REQEERLPE

SEQ ID NO: 922084 - protein, 9 aa, Homo Sapiens
PEQEERLRE

SEQ ID NO: 922085 - protein, 9 aa, Homo Sapiens
TLAKESAPY

SEQ ID NO: 922086 - protein, 9 aa, Homo Sapiens
LTAEKLYIY

SEQ ID NO: 922087 - protein, 9 aa, Homo Sapiens
KCVFSRIKQ

SEQ ID NO: 922088 - protein, 9 aa, Homo Sapiens
CYQLRMSKA

SEQ ID NO: 922089 - protein, 9 aa, Homo Sapiens
SFISAYAST

SEQ ID NO: 922090 - protein, 9 aa, Homo Sapiens
AKMIFSDSP

SEQ ID NO: 922091 - protein, 9 aa, Homo Sapiens
WISFISAYA

SEQ ID NO: 922092 - protein, 9 aa, Homo Sapiens
QCLRETVHA

SEQ ID NO: 922093 - protein, 9 aa, Homo Sapiens
LQPLSGASP

SEQ ID NO: 922094 - protein, 9 aa, Homo Sapiens
DDLDATNKI

SEQ ID NO: 922095 - protein, 9 aa, Homo Sapiens
PQLTAKKIC

SEQ ID NO: 922096 - protein, 9 aa, Homo Sapiens
DALNSSLIC

SEQ ID NO: 922097 - protein, 9 aa, Homo Sapiens
ESKADAKTP

SEQ ID NO: 922098 - protein, 9 aa, Homo Sapiens
LDFKAYSAA

SEQ ID NO: 922099 - protein, 9 aa, Homo Sapiens
SMAHDCYAA

SEQ ID NO: 922100 - protein, 9 aa, Homo Sapiens
KNLLKKNAT

SEQ ID NO: 922101 - protein, 9 aa, Homo Sapiens
TPKQQRISV

SEQ ID NO: 922102 - protein, 9 aa, Homo Sapiens
RSIRVGVTQ

SEQ ID NO: 922103 - protein, 9 aa, Homo Sapiens
HRYYKSVLV

SEQ ID NO: 922104 - protein, 9 aa, Homo Sapiens
FRPWHCPFF

SEQ ID NO: 922105 - protein, 9 aa, Homo Sapiens
PPWGRLHSH

SEQ ID NO: 922106 - protein, 9 aa, Homo Sapiens
LNSSLICLA

SEQ ID NO: 922107 - protein, 9 aa, Homo Sapiens
VNYYSAVTS

SEQ ID NO: 922108 - protein, 9 aa, Homo Sapiens
IIQNGTLIE

SEQ ID NO: 922109 - protein, 9 aa, Homo Sapiens
FMKNREAAR

SEQ ID NO: 922110 - protein, 9 aa, Homo Sapiens
REVYSGRAH

SEQ ID NO: 922111 - protein, 9 aa, Homo Sapiens
RTAPEFRAV

SEQ ID NO: 922112 - protein, 9 aa, Homo Sapiens
CLRETVHAA

SEQ ID NO: 922113 - protein, 9 aa, Homo Sapiens
SKAATMRSQ

SEQ ID NO: 922114 - protein, 9 aa, Homo Sapiens
FSSDDGDKL

SEQ ID NO: 922115 - protein, 9 aa, Homo Sapiens
LDATNKIIS

SEQ ID NO: 922116 - protein, 9 aa, Homo Sapiens
IIHMRNIYS

SEQ ID NO: 922117 - protein, 9 aa, Homo Sapiens
LLPALAALG

SEQ ID NO: 922118 - protein, 9 aa, Homo Sapiens
TLVDLWSVG

SEQ ID NO: 922119 - protein, 9 aa, Homo Sapiens
CDVWIIQNG

SEQ ID NO: 922120 - protein, 9 aa, Homo Sapiens
AAKMIFSDS

SEQ ID NO: 922121 - protein, 9 aa, Homo Sapiens
REIRFMKNR

SEQ ID NO: 922122 - protein, 9 aa, Homo Sapiens
VWISFISAY

SEQ ID NO: 922123 - protein, 9 aa, Homo Sapiens
SKTRSPGRG

SEQ ID NO: 922124 - protein, 9 aa, Homo Sapiens
VVTFKEDCS

SEQ ID NO: 922125 - protein, 9 aa, Homo Sapiens
ELTQEASVD

SEQ ID NO: 922126 - protein, 9 aa, Homo Sapiens
PRAFSSCSY

SEQ ID NO: 922127 - protein, 9 aa, Homo Sapiens
SSFLPQVIA

SEQ ID NO: 922128 - protein, 9 aa, Homo Sapiens
DATNKIISM

SEQ ID NO: 922129 - protein, 9 aa, Homo Sapiens
ISEEGEIIA

SEQ ID NO: 922130 - protein, 9 aa, Homo Sapiens
HMRNIYSTV

SEQ ID NO: 922131 - protein, 9 aa, Homo Sapiens
KWLFKSRNN

SEQ ID NO: 922132 - protein, 9 aa, Homo Sapiens
SLICLAAEY

SEQ ID NO: 922133 - protein, 9 aa, Homo Sapiens
RAKIFGQNS

SEQ ID NO: 922134 - protein, 9 aa, Homo Sapiens
IMICVPTLA

SEQ ID NO: 922135 - protein, 9 aa, Homo Sapiens
RFMKNREAA

SEQ ID NO: 922136 - protein, 9 aa, Homo Sapiens
TIHGFLMLL

SEQ ID NO: 922137 - protein, 9 aa, Homo Sapiens
TYRSSPSST

SEQ ID NO: 922138 - protein, 9 aa, Homo Sapiens
KPRKCDLTL

SEQ ID NO: 922139 - protein, 9 aa, Homo Sapiens
IRFMKNREA

SEQ ID NO: 922140 - protein, 9 aa, Homo Sapiens
RSQTQTLEC

SEQ ID NO: 922141 - protein, 9 aa, Homo Sapiens
AAISHSSFL

SEQ ID NO: 922142 - protein, 9 aa, Homo Sapiens
FNLLIKCVF

SEQ ID NO: 922143 - protein, 9 aa, Homo Sapiens
KANKLTQLP

SEQ ID NO: 922144 - protein, 9 aa, Homo Sapiens
LSETLPKDE

SEQ ID NO: 922145 - protein, 9 aa, Homo Sapiens
GASPIPGTP

SEQ ID NO: 922146 - protein, 9 aa, Homo Sapiens
AKKICYQLR

SEQ ID NO: 922147 - protein, 9 aa, Homo Sapiens
RAARVPSRD

SEQ ID NO: 922148 - protein, 9 aa, Homo Sapiens
HCPRHCPPW

SEQ ID NO: 922149 - protein, 9 aa, Homo Sapiens
KAATMRSQP

SEQ ID NO: 922150 - protein, 9 aa, Homo Sapiens
HAVLLGFIT

SEQ ID NO: 922151 - protein, 9 aa, Homo Sapiens
GKGFTCGCP

SEQ ID NO: 922152 - protein, 9 aa, Homo Sapiens
SFTGFKANK

SEQ ID NO: 922153 - protein, 9 aa, Homo Sapiens
YRSSPSSTP

SEQ ID NO: 922154 - protein, 9 aa, Homo Sapiens
AARNYFPLL

SEQ ID NO: 922155 - protein, 9 aa, Homo Sapiens
PPPEFRRWD

SEQ ID NO: 922156 - protein, 9 aa, Homo Sapiens
ECGEKMTLC

SEQ ID NO: 922157 - protein, 9 aa, Homo Sapiens
LPSECGEKM

SEQ ID NO: 922158 - protein, 9 aa, Homo Sapiens
ALSPALQPA

SEQ ID NO: 922159 - protein, 9 aa, Homo Sapiens
IFSDSPLGL

SEQ ID NO: 922160 - protein, 9 aa, Homo Sapiens
EQEERLPEQ

SEQ ID NO: 922161 - protein, 9 aa, Homo Sapiens
SIDETRVHL

SEQ ID NO: 922162 - protein, 9 aa, Homo Sapiens
SVWLHGEFS

SEQ ID NO: 922163 - protein, 9 aa, Homo Sapiens
GVTQFSRCC

SEQ ID NO: 922164 - protein, 9 aa, Homo Sapiens
IAWELVQSF

SEQ ID NO: 922165 - protein, 9 aa, Homo Sapiens
RIAPDPTIH

SEQ ID NO: 922166 - protein, 9 aa, Homo Sapiens
LLQSSYATL

SEQ ID NO: 922167 - protein, 9 aa, Homo Sapiens
FGQNSSVRG

SEQ ID NO: 922168 - protein, 9 aa, Homo Sapiens
AWELVQSFG

SEQ ID NO: 922169 - protein, 9 aa, Homo Sapiens
FSRIKQFHM

SEQ ID NO: 922170 - protein, 9 aa, Homo Sapiens
LQPALFICS

SEQ ID NO: 922171 - protein, 9 aa, Homo Sapiens
FYRIAPDPT

SEQ ID NO: 922172 - protein, 9 aa, Homo Sapiens
VLLGFITVS

SEQ ID NO: 922173 - protein, 9 aa, Homo Sapiens
EDCSSGRQV

SEQ ID NO: 922174 - protein, 9 aa, Homo Sapiens
FKAYSAAAL

SEQ ID NO: 922175 - protein, 9 aa, Homo Sapiens
RAFSSCSYT

SEQ ID NO: 922176 - protein, 9 aa, Homo Sapiens
ALNSSLICL

SEQ ID NO: 922177 - protein, 9 aa, Homo Sapiens
QELKNLLKK

SEQ ID NO: 922178 - protein, 9 aa, Homo Sapiens
FFLYEEFPG

SEQ ID NO: 922179 - protein, 9 aa, Homo Sapiens
MRSQPTASA

SEQ ID NO: 922180 - protein, 9 aa, Homo Sapiens
QTLECLEFI

SEQ ID NO: 922181 - protein, 9 aa, Homo Sapiens
SSLICLAAE

SEQ ID NO: 922182 - protein, 9 aa, Homo Sapiens
EFYRIAPDP

SEQ ID NO: 922183 - protein, 9 aa, Homo Sapiens
NLLKKNATV

SEQ ID NO: 922184 - protein, 9 aa, Homo Sapiens
TYCDVWIIQ

SEQ ID NO: 922185 - protein, 9 aa, Homo Sapiens
EKLYIYTDN

SEQ ID NO: 922186 - protein, 9 aa, Homo Sapiens
FISQMPFCG

SEQ ID NO: 922187 - protein, 9 aa, Homo Sapiens
LREVYSGRA

SEQ ID NO: 922188 - protein, 9 aa, Homo Sapiens
KICYQLRMS

SEQ ID NO: 922189 - protein, 9 aa, Homo Sapiens
FLYEEFPGD

SEQ ID NO: 922190 - protein, 9 aa, Homo Sapiens
NKLTQLPRH

SEQ ID NO: 922191 - protein, 9 aa, Homo Sapiens
ISKTRSPGR

SEQ ID NO: 922192 - protein, 9 aa, Homo Sapiens
LALSPALQP

SEQ ID NO: 922193 - protein, 9 aa, Homo Sapiens
KIFGQNSSV

SEQ ID NO: 922194 - protein, 9 aa, Homo Sapiens
NISEEGEII

SEQ ID NO: 922195 - protein, 9 aa, Homo Sapiens
AISHSSFLP

SEQ ID NO: 922196 - protein, 9 aa, Homo Sapiens
KGFTCGCPD

SEQ ID NO: 922197 - protein, 9 aa, Homo Sapiens
IVFISQMPF

SEQ ID NO: 922198 - protein, 9 aa, Homo Sapiens
TSGCKIGPS

SEQ ID NO: 922199 - protein, 9 aa, Homo Sapiens
TIMICVPTL

SEQ ID NO: 922200 - protein, 9 aa, Homo Sapiens
TQFSRCCVA

SEQ ID NO: 922201 - protein, 9 aa, Homo Sapiens
PIVFISQMP

SEQ ID NO: 922202 - protein, 9 aa, Homo Sapiens
MDEFSKWLF

SEQ ID NO: 922203 - protein, 9 aa, Homo Sapiens
RHGVATPVI

SEQ ID NO: 922204 - protein, 9 aa, Homo Sapiens
TNKIISMFY

SEQ ID NO: 922205 - protein, 9 aa, Homo Sapiens
ATMRSQPTA

SEQ ID NO: 922206 - protein, 9 aa, Homo Sapiens
QGKHFFLYE

SEQ ID NO: 922207 - protein, 9 aa, Homo Sapiens
GTPPPPPPE

SEQ ID NO: 922208 - protein, 9 aa, Homo Sapiens
FKSRNNLPG

SEQ ID NO: 922209 - protein, 9 aa, Homo Sapiens
SQTQTLECL

SEQ ID NO: 922210 - protein, 9 aa, Homo Sapiens
TCWRTAPEF

SEQ ID NO: 922211 - protein, 9 aa, Homo Sapiens
SIRVGVTQF

SEQ ID NO: 922212 - protein, 9 aa, Homo Sapiens
LLSSMAHDC

SEQ ID NO: 922213 - protein, 9 aa, Homo Sapiens
AAGPGKRHG

SEQ ID NO: 922214 - protein, 9 aa, Homo Sapiens
NSDDLDATN

SEQ ID NO: 922215 - protein, 9 aa, Homo Sapiens
QNGAGNNWA

SEQ ID NO: 922216 - protein, 9 aa, Homo Sapiens
DLDATNKII

SEQ ID NO: 922217 - protein, 9 aa, Homo Sapiens
RSPGRGSLD

SEQ ID NO: 922218 - protein, 9 aa, Homo Sapiens
SPLTAEKLY

SEQ ID NO: 922219 - protein, 9 aa, Homo Sapiens
HFFLYEEFP

SEQ ID NO: 922220 - protein, 9 aa, Homo Sapiens
ETKIIHMRN

SEQ ID NO: 922221 - protein, 9 aa, Homo Sapiens
PPEFRRWDY

SEQ ID NO: 922222 - protein, 9 aa, Homo Sapiens
YKSVLVQIY

SEQ ID NO: 922223 - protein, 9 aa, Homo Sapiens
LSIDETRVH

SEQ ID NO: 922224 - protein, 9 aa, Homo Sapiens
GFITVSCFF

SEQ ID NO: 922225 - protein, 9 aa, Homo Sapiens
HSSFLPQVI

SEQ ID NO: 922226 - protein, 9 aa, Homo Sapiens
RVHLLLKEK

SEQ ID NO: 922227 - protein, 9 aa, Homo Sapiens
YSAVTSHLR

SEQ ID NO: 922228 - protein, 9 aa, Homo Sapiens
CSSGRQVIL

SEQ ID NO: 922229 - protein, 9 aa, Homo Sapiens
FKTCWRTAP

SEQ ID NO: 922230 - protein, 9 aa, Homo Sapiens
VFSRIKQFH

SEQ ID NO: 922231 - protein, 9 aa, Homo Sapiens
NSSLICLAA

SEQ ID NO: 922232 - protein, 9 aa, Homo Sapiens
LREQEERLP

SEQ ID NO: 922233 - protein, 9 aa, Homo Sapiens
LFKSRNNLP

SEQ ID NO: 922234 - protein, 9 aa, Homo Sapiens
IEPNISEEG

SEQ ID NO: 922235 - protein, 9 aa, Homo Sapiens
ETVHAARNY

SEQ ID NO: 922236 - protein, 9 aa, Homo Sapiens
IIEPNISEE

SEQ ID NO: 922237 - protein, 9 aa, Homo Sapiens
HGVATPVIF

SEQ ID NO: 922238 - protein, 9 aa, Homo Sapiens
EEFPGDERR

SEQ ID NO: 922239 - protein, 9 aa, Homo Sapiens
STTYRSSPS

SEQ ID NO: 922240 - protein, 9 aa, Homo Sapiens
ILHRYYKSV

SEQ ID NO: 922241 - protein, 9 aa, Homo Sapiens
LSTTYRSSP

SEQ ID NO: 922242 - protein, 9 aa, Homo Sapiens
ICYQLRMSK

SEQ ID NO: 922243 - protein, 9 aa, Homo Sapiens
DDLREVYSG

SEQ ID NO: 922244 - protein, 9 aa, Homo Sapiens
SECGEKMTL

SEQ ID NO: 922245 - protein, 9 aa, Homo Sapiens
NTCTIHGFL

SEQ ID NO: 922246 - protein, 9 aa, Homo Sapiens
GQNGAGNNW

SEQ ID NO: 922247 - protein, 9 aa, Homo Sapiens
RLKNTCTIH

SEQ ID NO: 922248 - protein, 9 aa, Homo Sapiens
RVGVTQFSR

SEQ ID NO: 922249 - protein, 9 aa, Homo Sapiens
PHLALSPAL

SEQ ID NO: 922250 - protein, 9 aa, Homo Sapiens
APDPTIHTV

SEQ ID NO: 922251 - protein, 9 aa, Homo Sapiens
EWRSQLLSE

SEQ ID NO: 922252 - protein, 9 aa, Homo Sapiens
VFGQNGAGN

SEQ ID NO: 922253 - protein, 9 aa, Homo Sapiens
RNYFPLLCI

SEQ ID NO: 922254 - protein, 9 aa, Homo Sapiens
VTMHKEKQE

SEQ ID NO: 922255 - protein, 9 aa, Homo Sapiens
GLATEKSRW

SEQ ID NO: 922256 - protein, 9 aa, Homo Sapiens
PRKCDLTLF

SEQ ID NO: 922257 - protein, 9 aa, Homo Sapiens
QLTAKKICY

SEQ ID NO: 922258 - protein, 9 aa, Homo Sapiens
MTSGCKIGP

SEQ ID NO: 922259 - protein, 9 aa, Homo Sapiens
PSRAKIFGQ

SEQ ID NO: 922260 - protein, 9 aa, Homo Sapiens
TAEKLYIYT

SEQ ID NO: 922261 - protein, 9 aa, Homo Sapiens
TPPPPPPEF

SEQ ID NO: 922262 - protein, 9 aa, Homo Sapiens
MRNIYSTVI

SEQ ID NO: 922263 - protein, 9 aa, Homo Sapiens
LWELTQEAS

SEQ ID NO: 922264 - protein, 9 aa, Homo Sapiens
VTFKEDCSS

SEQ ID NO: 922265 - protein, 9 aa, Homo Sapiens
LLWELTQEA

SEQ ID NO: 922266 - protein, 9 aa, Homo Sapiens
ALQPALFIC

SEQ ID NO: 922267 - protein, 9 aa, Homo Sapiens
SAYASTYGK

SEQ ID NO: 922268 - protein, 9 aa, Homo Sapiens
PGKRHGVAT

SEQ ID NO: 922269 - protein, 9 aa, Homo Sapiens
ATEKSRWSG

SEQ ID NO: 922270 - protein, 9 aa, Homo Sapiens
VVTMHKEKQ

SEQ ID NO: 922271 - protein, 9 aa, Homo Sapiens
RNIYSTVID

SEQ ID NO: 922272 - protein, 9 aa, Homo Sapiens
DYPSRAKIF

SEQ ID NO: 922273 - protein, 9 aa, Homo Sapiens
LFLVLKARK

SEQ ID NO: 922274 - protein, 9 aa, Homo Sapiens
FSKWLFKSR

SEQ ID NO: 922275 - protein, 9 aa, Homo Sapiens
NYYSAVTSH

SEQ ID NO: 922276 - protein, 9 aa, Homo Sapiens
QSSYATLVD

SEQ ID NO: 922277 - protein, 9 aa, Homo Sapiens
DFKAYSAAA

SEQ ID NO: 922278 - protein, 9 aa, Homo Sapiens
SQLLSETLP

SEQ ID NO: 922279 - protein, 9 aa, Homo Sapiens
FISAYASTY

SEQ ID NO: 922280 - protein, 9 aa, Homo Sapiens
CGCPDDFRT

SEQ ID NO: 922281 - protein, 9 aa, Homo Sapiens
EFRRWDYSV

SEQ ID NO: 922282 - protein, 9 aa, Homo Sapiens
KTRSPGRGS

SEQ ID NO: 922283 - protein, 9 aa, Homo Sapiens
IGDFGLATE

SEQ ID NO: 922284 - protein, 9 aa, Homo Sapiens
RSQLLSETL

SEQ ID NO: 922285 - protein, 9 aa, Homo Sapiens
RETVHAARN

SEQ ID NO: 922286 - protein, 9 aa, Homo Sapiens
PALQPALFI

SEQ ID NO: 922287 - protein, 9 aa, Homo Sapiens
FTCGCPDDF

SEQ ID NO: 922288 - protein, 9 aa, Homo Sapiens
RNISKTRSP

SEQ ID NO: 922289 - protein, 9 aa, Homo Sapiens
YYSAVTSHL

SEQ ID NO: 922290 - protein, 9 aa, Homo Sapiens
LIKCVFSRI

SEQ ID NO: 922291 - protein, 9 aa, Homo Sapiens
LSSMAHDCY

SEQ ID NO: 922292 - protein, 9 aa, Homo Sapiens
RKCDLTLFL

SEQ ID NO: 922293 - protein, 9 aa, Homo Sapiens
ECLEFIPQH

SEQ ID NO: 922294 - protein, 9 aa, Homo Sapiens
PRAARVPSR

SEQ ID NO: 922295 - protein, 9 aa, Homo Sapiens
KREIRFMKN

SEQ ID NO: 922296 - protein, 9 aa, Homo Sapiens
SGPRAFSSC

SEQ ID NO: 922297 - protein, 9 aa, Homo Sapiens
KLTPKQQRI

SEQ ID NO: 922298 - protein, 9 aa, Homo Sapiens
GCPDDFRTL

SEQ ID NO: 922299 - protein, 9 aa, Homo Sapiens
SPSKAATMR

SEQ ID NO: 922300 - protein, 9 aa, Homo Sapiens
LYIYTDNSI

SEQ ID NO: 922301 - protein, 9 aa, Homo Sapiens
AGATLLWEL

SEQ ID NO: 922302 - protein, 9 aa, Homo Sapiens
PPPPPEFRR

SEQ ID NO: 922303 - protein, 9 aa, Homo Sapiens
TAKKICYQL

SEQ ID NO: 922304 - protein, 9 aa, Homo Sapiens
SPLGLTCGM

SEQ ID NO: 922305 - protein, 9 aa, Homo Sapiens
KEDCSSGRQ

SEQ ID NO: 922306 - protein, 9 aa, Homo Sapiens
SVLVQIYEL

SEQ ID NO: 922307 - protein, 9 aa, Homo Sapiens
WFLIPIVFI

SEQ ID NO: 922308 - protein, 9 aa, Homo Sapiens
EKPGPLDFK

SEQ ID NO: 922309 - protein, 9 aa, Homo Sapiens
WGRLHSHCP

SEQ ID NO: 922310 - protein, 9 aa, Homo Sapiens
PALQPLSGA

SEQ ID NO: 922311 - protein, 9 aa, Homo Sapiens
EVYSGRAHP

SEQ ID NO: 922312 - protein, 9 aa, Homo Sapiens
SGASPIPGT

SEQ ID NO: 922313 - protein, 9 aa, Homo Sapiens
AVLLGFITV

SEQ ID NO: 922314 - protein, 9 aa, Homo Sapiens
MRSRLLPAL

SEQ ID NO: 922315 - protein, 9 aa, Homo Sapiens
TFKEDCSSG

SEQ ID NO: 922316 - protein, 9 aa, Homo Sapiens
YRIAPDPTI

SEQ ID NO: 922317 - protein, 9 aa, Homo Sapiens
YPEFYRIAP

SEQ ID NO: 922318 - protein, 9 aa, Homo Sapiens
SLGAESKAD

SEQ ID NO: 922319 - protein, 9 aa, Homo Sapiens
QWEVVTMHK

SEQ ID NO: 922320 - protein, 9 aa, Homo Sapiens
FKEDCSSGR

SEQ ID NO: 922321 - protein, 9 aa, Homo Sapiens
RYYKSVLVQ

SEQ ID NO: 922322 - protein, 9 aa, Homo Sapiens
VGVTQFSRC

SEQ ID NO: 922323 - protein, 9 aa, Homo Sapiens
KNTCTIHGF

SEQ ID NO: 922324 - protein, 9 aa, Homo Sapiens
KLTQLPRHL

SEQ ID NO: 922325 - protein, 9 aa, Homo Sapiens
TGFKANKLT

SEQ ID NO: 922326 - protein, 9 aa, Homo Sapiens
TAPEFRAVG

SEQ ID NO: 922327 - protein, 9 aa, Homo Sapiens
GKRHGVATP

SEQ ID NO: 922328 - protein, 9 aa, Homo Sapiens
GRNISKTRS

SEQ ID NO: 922329 - protein, 9 aa, Homo Sapiens
LLSETLPKD

SEQ ID NO: 922330 - protein, 9 aa, Homo Sapiens
TPALQPLSG

SEQ ID NO: 922331 - protein, 9 aa, Homo Sapiens
WRTAPEFRA

SEQ ID NO: 922332 - protein, 9 aa, Homo Sapiens
VQCLRETVH

SEQ ID NO: 922333 - protein, 9 aa, Homo Sapiens
TIAWELVQS

SEQ ID NO: 922334 - protein, 9 aa, Homo Sapiens
TLFLVLKAR

SEQ ID NO: 922335 - protein, 9 aa, Homo Sapiens
FLPQVIALH

SEQ ID NO: 922336 - protein, 9 aa, Homo Sapiens
KEKQESAIF

SEQ ID NO: 922337 - protein, 9 aa, Homo Sapiens
TVDDLREVY

SEQ ID NO: 922338 - protein, 9 aa, Homo Sapiens
LHRYYKSVL

SEQ ID NO: 922339 - protein, 9 aa, Homo Sapiens
SDDLDATNK

SEQ ID NO: 922340 - protein, 9 aa, Homo Sapiens
PPPPEFRRW

SEQ ID NO: 922341 - protein, 9 aa, Homo Sapiens
VFISQMPFC

SEQ ID NO: 922342 - protein, 9 aa, Homo Sapiens
IRVGVTQFS

SEQ ID NO: 922343 - protein, 9 aa, Homo Sapiens
GATLLWELT

SEQ ID NO: 922344 - protein, 9 aa, Homo Sapiens
FLETKILER

SEQ ID NO: 922345 - protein, 9 aa, Homo Sapiens
NIYSTVIDI

SEQ ID NO: 922346 - protein, 9 aa, Homo Sapiens
LQSSYATLV

SEQ ID NO: 922347 - protein, 9 aa, Homo Sapiens
CYAAICSPL

SEQ ID NO: 922348 - protein, 9 aa, Homo Sapiens
TSHLRNQPI

SEQ ID NO: 922349 - protein, 9 aa, Homo Sapiens
LECLEFIPQ

SEQ ID NO: 922350 - protein, 9 aa, Homo Sapiens
GPRAFSSCS

SEQ ID NO: 922351 - protein, 9 aa, Homo Sapiens
TCGCPDDFR

SEQ ID NO: 922352 - protein, 9 aa, Homo Sapiens
SRLLPALAA

SEQ ID NO: 922353 - protein, 9 aa, Homo Sapiens
RPWHCPFFL

SEQ ID NO: 922354 - protein, 9 aa, Homo Sapiens
AARVPSRDL

SEQ ID NO: 922355 - protein, 9 aa, Homo Sapiens
DLTLFLVLK

SEQ ID NO: 922356 - protein, 9 aa, Homo Sapiens
FIVWISFIS

SEQ ID NO: 922357 - protein, 9 aa, Homo Sapiens
VPTLAKESA

SEQ ID NO: 922358 - protein, 9 aa, Homo Sapiens
ARNYFPLLC

SEQ ID NO: 922359 - protein, 9 aa, Homo Sapiens
ICVPTLAKE

SEQ ID NO: 922360 - protein, 9 aa, Homo Sapiens
ALQPLSGAS

SEQ ID NO: 922361 - protein, 9 aa, Homo Sapiens
YEEFPGDER

SEQ ID NO: 922362 - protein, 9 aa, Homo Sapiens
ANKLTQLPR

SEQ ID NO: 922363 - protein, 9 aa, Homo Sapiens
NKIISMFYG

SEQ ID NO: 922364 - protein, 9 aa, Homo Sapiens
TRSPGRGSL

SEQ ID NO: 922365 - protein, 9 aa, Homo Sapiens
WRSQLLSET

SEQ ID NO: 922366 - protein, 9 aa, Homo Sapiens
EIRFMKNRE

SEQ ID NO: 922367 - protein, 9 aa, Homo Sapiens
GFTCGCPDD

SEQ ID NO: 922368 - protein, 9 aa, Homo Sapiens
AGPGKRHGV

SEQ ID NO: 922369 - protein, 9 aa, Homo Sapiens
EFSKWLFKS

SEQ ID NO: 922370 - protein, 9 aa, Homo Sapiens
IPIVFISQM

SEQ ID NO: 922371 - protein, 9 aa, Homo Sapiens
TLECLEFIP

SEQ ID NO: 922372 - protein, 9 aa, Homo Sapiens
FSDSPLGLT

SEQ ID NO: 922373 - protein, 9 aa, Homo Sapiens
RTYCDVWII

SEQ ID NO: 922374 - protein, 9 aa, Homo Sapiens
DNFVFGQNG

SEQ ID NO: 922375 - protein, 9 aa, Homo Sapiens
GDFGLATEK

SEQ ID NO: 922376 - protein, 9 aa, Homo Sapiens
FFLETKILE

SEQ ID NO: 922377 - protein, 9 aa, Homo Sapiens
DAKTPVLVE

SEQ ID NO: 922378 - protein, 9 aa, Homo Sapiens
TKIIHMRNI

SEQ ID NO: 922379 - protein, 9 aa, Homo Sapiens
DFGLATEKS

SEQ ID NO: 922380 - protein, 9 aa, Homo Sapiens
PFFLETKIL

SEQ ID NO: 922381 - protein, 9 aa, Homo Sapiens
NISKTRSPG

SEQ ID NO: 922382 - protein, 9 aa, Homo Sapiens
NFVFGQNGA

SEQ ID NO: 922383 - protein, 9 aa, Homo Sapiens
LGAESKADA

SEQ ID NO: 922384 - protein, 9 aa, Homo Sapiens
RTIAWELVQ

SEQ ID NO: 922385 - protein, 9 aa, Homo Sapiens
GSPSKAATM

SEQ ID NO: 922386 - protein, 9 aa, Homo Sapiens
KLYIYTDNS

SEQ ID NO: 922387 - protein, 9 aa, Homo Sapiens
CPFFLETKI

SEQ ID NO: 922388 - protein, 9 aa, Homo Sapiens
AKIFGQNSS

SEQ ID NO: 922389 - protein, 9 aa, Homo Sapiens
CLEFIPQHV

SEQ ID NO: 922390 - protein, 9 aa, Homo Sapiens
HKEKQESAI

SEQ ID NO: 922391 - protein, 9 aa, Homo Sapiens
WLFKSRNNL

SEQ ID NO: 922392 - protein, 9 aa, Homo Sapiens
GAESKADAK

SEQ ID NO: 922393 - protein, 9 aa, Homo Sapiens
DETRVHLLL

SEQ ID NO: 922394 - protein, 9 aa, Homo Sapiens
QTQTLECLE

SEQ ID NO: 922395 - protein, 9 aa, Homo Sapiens
AEKLYIYTD

SEQ ID NO: 922396 - protein, 9 aa, Homo Sapiens
VWIIQNGTL

SEQ ID NO: 922397 - protein, 9 aa, Homo Sapiens
LIPIVFISQ

SEQ ID NO: 922398 - protein, 9 aa, Homo Sapiens
DPRAARVPS

SEQ ID NO: 922399 - protein, 9 aa, Homo Sapiens
SEEGEIIAS

SEQ ID NO: 922400 - protein, 9 aa, Homo Sapiens
SETLPKDEL

SEQ ID NO: 922401 - protein, 9 aa, Homo Sapiens
LTLFLVLKA

SEQ ID NO: 922402 - protein, 9 aa, Homo Sapiens
IDETRVHLL

SEQ ID NO: 922403 - protein, 9 aa, Homo Sapiens
LGFITVSCF

SEQ ID NO: 922404 - protein, 9 aa, Homo Sapiens
IFGQNSSVR

SEQ ID NO: 922405 - protein, 9 aa, Homo Sapiens
SAVTSHLRN

SEQ ID NO: 922406 - protein, 9 aa, Homo Sapiens
GKHFFLYEE

SEQ ID NO: 922407 - protein, 9 aa, Homo Sapiens
KMIFSDSPL

SEQ ID NO: 922408 - protein, 9 aa, Homo Sapiens
YYKSVLVQI

SEQ ID NO: 922409 - protein, 9 aa, Homo Sapiens
SSMAHDCYA

SEQ ID NO: 922410 - protein, 9 aa, Homo Sapiens
RVPSRDLAV

SEQ ID NO: 922411 - protein, 9 aa, Homo Sapiens
VHAVLLGFI

SEQ ID NO: 922412 - protein, 9 aa, Homo Sapiens
VDDLREVYS

SEQ ID NO: 922413 - protein, 9 aa, Homo Sapiens
TEKSRWSGS

SEQ ID NO: 922414 - protein, 9 aa, Homo Sapiens
FRRWDYSVW

SEQ ID NO: 922415 - protein, 9 aa, Homo Sapiens
SSCSYTSGP

SEQ ID NO: 922416 - protein, 9 aa, Homo Sapiens
PSECGEKMT

SEQ ID NO: 922417 - protein, 9 aa, Homo Sapiens
ETLPKDELK

SEQ ID NO: 922418 - protein, 9 aa, Homo Sapiens
KQQRISVVW

SEQ ID NO: 922419 - protein, 9 aa, Homo Sapiens
DSPLGLTCG

SEQ ID NO: 922420 - protein, 9 aa, Homo Sapiens
QPLSGASPI

SEQ ID NO: 922421 - protein, 9 aa, Homo Sapiens
VVTVDDLRE

SEQ ID NO: 922422 - protein, 9 aa, Homo Sapiens
SPALQPALF

SEQ ID NO: 922423 - protein, 9 aa, Homo Sapiens
TVHAARNYF

SEQ ID NO: 922424 - protein, 9 aa, Homo Sapiens
VTVDDLREV

SEQ ID NO: 922425 - protein, 9 aa, Homo Sapiens
CVPTLAKES

SEQ ID NO: 922426 - protein, 9 aa, Homo Sapiens
PNISEEGEI

SEQ ID NO: 922427 - protein, 9 aa, Homo Sapiens
EPNISEEGE

SEQ ID NO: 922428 - protein, 9 aa, Homo Sapiens
DCSSGRQVI

SEQ ID NO: 922429 - protein, 9 aa, Homo Sapiens
LWFLIPIVF

SEQ ID NO: 922430 - protein, 9 aa, Homo Sapiens
DLREVYSGR

SEQ ID NO: 922431 - protein, 9 aa, Homo Sapiens
YIYTDNSIK

SEQ ID NO: 922432 - protein, 9 aa, Homo Sapiens
FGLATEKSR

SEQ ID NO: 922433 - protein, 9 aa, Homo Sapiens
TLLWELTQE

SEQ ID NO: 922434 - protein, 9 aa, Homo Sapiens
KKICYQLRM

SEQ ID NO: 922435 - protein, 9 aa, Homo Sapiens
LRETVHAAR

SEQ ID NO: 922436 - protein, 9 aa, Homo Sapiens
LVDLWSVGC

SEQ ID NO: 922437 - protein, 9 aa, Homo Sapiens
YATLVDLWS

SEQ ID NO: 922438 - protein, 9 aa, Homo Sapiens
PEFYRIAPD

SEQ ID NO: 922439 - protein, 9 aa, Homo Sapiens
VWLHGEFSY

SEQ ID NO: 922440 - protein, 9 aa, Homo Sapiens
RSSPSSTPT

SEQ ID NO: 922441 - protein, 9 aa, Homo Sapiens
DYSVWLHGE

SEQ ID NO: 922442 - protein, 9 aa, Homo Sapiens
LLGFITVSC

SEQ ID NO: 922443 - protein, 9 aa, Homo Sapiens
LSGASPIPG

SEQ ID NO: 922444 - protein, 9 aa, Homo Sapiens
KIIHMRNIY

SEQ ID NO: 922445 - protein, 9 aa, Homo Sapiens
ISFISAYAS

SEQ ID NO: 922446 - protein, 9 aa, Homo Sapiens
PLDFKAYSA

SEQ ID NO: 922447 - protein, 9 aa, Homo Sapiens
QFSRCCVAI

SEQ ID NO: 922448 - protein, 9 aa, Homo Sapiens
NYFPLLCIL

SEQ ID NO: 922449 - protein, 9 aa, Homo Sapiens
SHLRNQPIY

SEQ ID NO: 922450 - protein, 9 aa, Homo Sapiens
LKREIRFMK

SEQ ID NO: 922451 - protein, 9 aa, Homo Sapiens
LLIKCVFSR

SEQ ID NO: 922452 - protein, 9 aa, Homo Sapiens
HLALSPALQ

SEQ ID NO: 922453 - protein, 9 aa, Homo Sapiens
VTQFSRCCV

SEQ ID NO: 922454 - protein, 9 aa, Homo Sapiens
AVTSHLRNQ

SEQ ID NO: 922455 - protein, 9 aa, Homo Sapiens
ALSIDETRV

SEQ ID NO: 922456 - protein, 9 aa, Homo Sapiens
WDYSVWLHG

SEQ ID NO: 922457 - protein, 9 aa, Homo Sapiens
FQELKNLLK

SEQ ID NO: 922458 - protein, 9 aa, Homo Sapiens
LTAKKICYQ

SEQ ID NO: 922459 - protein, 9 aa, Homo Sapiens
NLLIKCVFS

SEQ ID NO: 922460 - protein, 9 aa, Homo Sapiens
SRTYCDVWI

SEQ ID NO: 922461 - protein, 9 aa, Homo Sapiens
GEKLTPKQQ

SEQ ID NO: 922462 - protein, 9 aa, Homo Sapiens
GPLDFKAYS

SEQ ID NO: 922463 - protein, 9 aa, Homo Sapiens
ITVSCFFFI

SEQ ID NO: 922464 - protein, 9 aa, Homo Sapiens
ATNKIISMF

SEQ ID NO: 922465 - protein, 9 aa, Homo Sapiens
WLHGEFSYV

SEQ ID NO: 922466 - protein, 9 aa, Homo Sapiens
MIFSDSPLG

SEQ ID NO: 922467 - protein, 9 aa, Homo Sapiens
ICLAAEYPI

SEQ ID NO: 922468 - protein, 9 aa, Homo Sapiens
FKANKLTQL

SEQ ID NO: 922469 - protein, 9 aa, Homo Sapiens
AESKADAKT

SEQ ID NO: 922470 - protein, 9 aa, Homo Sapiens
EGEIIASIP

SEQ ID NO: 922471 - protein, 9 aa, Homo Sapiens
PGGKGFTCG

SEQ ID NO: 922472 - protein, 9 aa, Homo Sapiens
GGKGFTCGC

SEQ ID NO: 922473 - protein, 9 aa, Homo Sapiens
HSHCPRHCP

SEQ ID NO: 922474 - protein, 9 aa, Homo Sapiens
KLSTTYRSS

SEQ ID NO: 922475 - protein, 9 aa, Homo Sapiens
VTSHLRNQP

SEQ ID NO: 922476 - protein, 9 aa, Homo Sapiens
HDCYAAICS

SEQ ID NO: 922477 - protein, 9 aa, Homo Sapiens
WFVQCLRET

SEQ ID NO: 922478 - protein, 9 aa, Homo Sapiens
KAYSAAALQ

SEQ ID NO: 922479 - protein, 9 aa, Homo Sapiens
KTCWRTAPE

SEQ ID NO: 922480 - protein, 9 aa, Homo Sapiens
WEVVTMHKE

SEQ ID NO: 922481 - protein, 9 aa, Homo Sapiens
LSPALQPAL

SEQ ID NO: 922482 - protein, 9 aa, Homo Sapiens
SCSYTSGPG

SEQ ID NO: 922483 - protein, 9 aa, Homo Sapiens
LAKESAPYM

SEQ ID NO: 922484 - protein, 9 aa, Homo Sapiens
IVVTFKEDC

SEQ ID NO: 922485 - protein, 9 aa, Homo Sapiens
KRHGVATPV

SEQ ID NO: 922486 - protein, 9 aa, Homo Sapiens
LYEEFPGDE

SEQ ID NO: 922487 - protein, 9 aa, Homo Sapiens
NGAGNNWAK

SEQ ID NO: 922488 - protein, 9 aa, Homo Sapiens
LPALAALGA

SEQ ID NO: 922489 - protein, 9 aa, Homo Sapiens
EKSRWSGSH

SEQ ID NO: 922490 - protein, 9 aa, Homo Sapiens
AHDCYAAIC

SEQ ID NO: 922491 - protein, 9 aa, Homo Sapiens
GPGKRHGVA

SEQ ID NO: 922492 - protein, 9 aa, Homo Sapiens
WLRTIAWEL

SEQ ID NO: 922493 - protein, 9 aa, Homo Sapiens
ETRVHLLLK

SEQ ID NO: 922494 - protein, 9 aa, Homo Sapiens
ITVFQELKN

SEQ ID NO: 922495 - protein, 9 aa, Homo Sapiens
LKNTCTIHG

SEQ ID NO: 922496 - protein, 9 aa, Homo Sapiens
RLLPALAAL

SEQ ID NO: 922497 - protein, 9 aa, Homo Sapiens
MHKEKQESA

SEQ ID NO: 922498 - protein, 9 aa, Homo Sapiens
DVWIIQNGT

SEQ ID NO: 922499 - protein, 9 aa, Homo Sapiens
EERLPEQEE

SEQ ID NO: 922500 - protein, 9 aa, Homo Sapiens
NGEKLTPKQ

SEQ ID NO: 922501 - protein, 9 aa, Homo Sapiens
QEERLPEQE

SEQ ID NO: 922502 - protein, 9 aa, Homo Sapiens
ADAKTPVLV

SEQ ID NO: 922503 - protein, 9 aa, Homo Sapiens
TRVHLLLKE

SEQ ID NO: 922504 - protein, 9 aa, Homo Sapiens
ATLVDLWSV

SEQ ID NO: 922505 - protein, 9 aa, Homo Sapiens
DWLRTIAWE

SEQ ID NO: 922506 - protein, 9 aa, Homo Sapiens
QFKTCWRTA

SEQ ID NO: 922507 - protein, 9 aa, Homo Sapiens
PDNFVFGQN

SEQ ID NO: 922508 - protein, 9 aa, Homo Sapiens
TMHKEKQES

SEQ ID NO: 922509 - protein, 9 aa, Homo Sapiens
MICVPTLAK

SEQ ID NO: 922510 - protein, 9 aa, Homo Sapiens
FVQCLRETV

SEQ ID NO: 922511 - protein, 9 aa, Homo Sapiens
TVFQELKNL

SEQ ID NO: 922512 - protein, 9 aa, Homo Sapiens
IKCVFSRIK

SEQ ID NO: 922513 - protein, 9 aa, Homo Sapiens
ATLLWELTQ

SEQ ID NO: 922514 - protein, 9 aa, Homo Sapiens
PSKAATMRS

SEQ ID NO: 922515 - protein, 9 aa, Homo Sapiens
PSRDLAVLL

SEQ ID NO: 922516 - protein, 9 aa, Homo Sapiens
LICLAAEYP

SEQ ID NO: 922517 - protein, 9 aa, Homo Sapiens
YCDVWIIQN

SEQ ID NO: 922518 - protein, 9 aa, Homo Sapiens
SFLPQVIAL

SEQ ID NO: 922519 - protein, 9 aa, Homo Sapiens
ARVPSRDLA

SEQ ID NO: 922520 - protein, 9 aa, Homo Sapiens
RLHSHCPRH

SEQ ID NO: 922521 - protein, 9 aa, Homo Sapiens
LRTIAWELV

SEQ ID NO: 922522 - protein, 9 aa, Homo Sapiens
DEFSKWLFK

SEQ ID NO: 922523 - protein, 9 aa, Homo Sapiens
VFQELKNLL

SEQ ID NO: 922524 - protein, 9 aa, Homo Sapiens
HGFLMLLYV

SEQ ID NO: 922525 - protein, 9 aa, Homo Sapiens
PKQQRISVV

SEQ ID NO: 922526 - protein, 9 aa, Homo Sapiens
WHCPFFLET

SEQ ID NO: 922527 - protein, 9 aa, Homo Sapiens
PDPTIHTVP

SEQ ID NO: 922528 - protein, 9 aa, Homo Sapiens
MAHDCYAAI

SEQ ID NO: 922529 - protein, 9 aa, Homo Sapiens
PEFRRWDYS

SEQ ID NO: 922530 - protein, 9 aa, Homo Sapiens
VHLLLKEKM

SEQ ID NO: 922531 - protein, 9 aa, Homo Sapiens
PLSGASPIP

SEQ ID NO: 922532 - protein, 9 aa, Homo Sapiens
CDLTLFLVL

SEQ ID NO: 922533 - protein, 9 aa, Homo Sapiens
EKLTPKQQR

SEQ ID NO: 922534 - protein, 9 aa, Homo Sapiens
SRAKIFGQN

SEQ ID NO: 922535 - protein, 9 aa, Homo Sapiens
FGQNGAGNN

SEQ ID NO: 922536 - protein, 9 aa, Homo Sapiens
KPGPLDFKA

SEQ ID NO: 922537 - protein, 9 aa, Homo Sapiens
PTLAKESAP

SEQ ID NO: 922538 - protein, 9 aa, Homo Sapiens
PGPLDFKAY

SEQ ID NO: 922539 - protein, 9 aa, Homo Sapiens
SDSPLGLTC

SEQ ID NO: 922540 - protein, 9 aa, Homo Sapiens
RWDYSVWLH

SEQ ID NO: 922541 - protein, 9 aa, Homo Sapiens
IVWISFISA

SEQ ID NO: 922542 - protein, 9 aa, Homo Sapiens
TMRSQPTAS

SEQ ID NO: 922543 - protein, 9 aa, Homo Sapiens
CQFKTCWRT

SEQ ID NO: 922544 - protein, 9 aa, Homo Sapiens
SRDLAVLLC

SEQ ID NO: 922545 - protein, 9 aa, Homo Sapiens
GRLHSHCPR

SEQ ID NO: 922546 - protein, 9 aa, Homo Sapiens
VPSRDLAVL

SEQ ID NO: 922547 - protein, 9 aa, Homo Sapiens
TQTLECLEF

SEQ ID NO: 922548 - protein, 9 aa, Homo Sapiens
SHCPRHCPP

SEQ ID NO: 922549 - protein, 9 aa, Homo Sapiens
EEGEIIASI

SEQ ID NO: 922550 - protein, 9 aa, Homo Sapiens
SYATLVDLW

SEQ ID NO: 922551 - protein, 9 aa, Homo Sapiens
AAAISHSSF

SEQ ID NO: 922552 - protein, 9 aa, Homo Sapiens
IHMRNIYST

SEQ ID NO: 922553 - protein, 9 aa, Homo Sapiens
FITVSCFFF

SEQ ID NO: 922554 - protein, 9 aa, Homo Sapiens
PQLKREIRF

SEQ ID NO: 922555 - protein, 9 aa, Homo Sapiens
PNGEKLTPK

SEQ ID NO: 922556 - protein, 9 aa, Homo Sapiens
FTGFKANKL

SEQ ID NO: 922557 - protein, 9 aa, Homo Sapiens
CDALNSSLI

SEQ ID NO: 922558 - protein, 9 aa, Homo Sapiens
AFSSCSYTS

SEQ ID NO: 922559 - protein, 9 aa, Homo Sapiens
WAGATLLWE

SEQ ID NO: 922560 - protein, 9 aa, Homo Sapiens
KSVLVQIYE

SEQ ID NO: 922561 - protein, 9 aa, Homo Sapiens
CVFSRIKQF

SEQ ID NO: 922562 - protein, 9 aa, Homo Sapiens
VKLSTTYRS

SEQ ID NO: 922563 - protein, 9 aa, Homo Sapiens
TCTIHGFLM

SEQ ID NO: 922564 - protein, 9 aa, Homo Sapiens
ISHSSFLPQ

SEQ ID NO: 922565 - protein, 9 aa, Homo Sapiens
FSSCSYTSG

SEQ ID NO: 922566 - protein, 9 aa, Homo Sapiens
IHGFLMLLY

SEQ ID NO: 922567 - protein, 9 aa, Homo Sapiens
GYCFSFLST

SEQ ID NO: 922568 - protein, 9 aa, Homo Sapiens
GIGLTLKQT

SEQ ID NO: 922569 - protein, 9 aa, Homo Sapiens
HHITAHDSD

SEQ ID NO: 922570 - protein, 9 aa, Homo Sapiens
APMAVFFDY

SEQ ID NO: 922571 - protein, 9 aa, Homo Sapiens
AHLKEPPSA

SEQ ID NO: 922572 - protein, 9 aa, Homo Sapiens
LVAIGVWQV

SEQ ID NO: 922573 - protein, 9 aa, Homo Sapiens
MKVLLDPPL

SEQ ID NO: 922574 - protein, 9 aa, Homo Sapiens
KLCEAKHIH

SEQ ID NO: 922575 - protein, 9 aa, Homo Sapiens
AVLGLSWRQ

SEQ ID NO: 922576 - protein, 9 aa, Homo Sapiens
ISMKVLLDP

SEQ ID NO: 922577 - protein, 9 aa, Homo Sapiens
IIFFLRTTA

SEQ ID NO: 922578 - protein, 9 aa, Homo Sapiens
QVCCSADQQ

SEQ ID NO: 922579 - protein, 9 aa, Homo Sapiens
AKAEKCETH

SEQ ID NO: 922580 - protein, 9 aa, Homo Sapiens
PRQTPNGNS

SEQ ID NO: 922581 - protein, 9 aa, Homo Sapiens
AQLECEINT

SEQ ID NO: 922582 - protein, 9 aa, Homo Sapiens
LQDSKFFEK

SEQ ID NO: 922583 - protein, 9 aa, Homo Sapiens
GPYFTSEPL

SEQ ID NO: 922584 - protein, 9 aa, Homo Sapiens
FLFYARRSE

SEQ ID NO: 922585 - protein, 9 aa, Homo Sapiens
AEGNSSRSI

SEQ ID NO: 922586 - protein, 9 aa, Homo Sapiens
RRINARYQT

SEQ ID NO: 922587 - protein, 9 aa, Homo Sapiens
GGIRETRST

SEQ ID NO: 922588 - protein, 9 aa, Homo Sapiens
IPLHQARSF

SEQ ID NO: 922589 - protein, 9 aa, Homo Sapiens
SLASAGESI

SEQ ID NO: 922590 - protein, 9 aa, Homo Sapiens
SELCALLPT

SEQ ID NO: 922591 - protein, 9 aa, Homo Sapiens
KAICTLRKA

SEQ ID NO: 922592 - protein, 9 aa, Homo Sapiens
FCLIQGLVS

SEQ ID NO: 922593 - protein, 9 aa, Homo Sapiens
QRSRTFPKE

SEQ ID NO: 922594 - protein, 9 aa, Homo Sapiens
HGVRDVSKK

SEQ ID NO: 922595 - protein, 9 aa, Homo Sapiens
TLEKNLKEN

SEQ ID NO: 922596 - protein, 9 aa, Homo Sapiens
GNLFCEQQR

SEQ ID NO: 922597 - protein, 9 aa, Homo Sapiens
FLRHLMQEC

SEQ ID NO: 922598 - protein, 9 aa, Homo Sapiens
DQQEEGQRQ

SEQ ID NO: 922599 - protein, 9 aa, Homo Sapiens
YDIRAALDT

SEQ ID NO: 922600 - protein, 9 aa, Homo Sapiens
LKTVKVVED

SEQ ID NO: 922601 - protein, 9 aa, Homo Sapiens
RPIRKRLNS

SEQ ID NO: 922602 - protein, 9 aa, Homo Sapiens
TENSVRVKW

SEQ ID NO: 922603 - protein, 9 aa, Homo Sapiens
TWSLEENKL

SEQ ID NO: 922604 - protein, 9 aa, Homo Sapiens
AHDSDEGRN

SEQ ID NO: 922605 - protein, 9 aa, Homo Sapiens
GENRLVSQD

SEQ ID NO: 922606 - protein, 9 aa, Homo Sapiens
MLIFCLIQG

SEQ ID NO: 922607 - protein, 9 aa, Homo Sapiens
TVRLPVGGK

SEQ ID NO: 922608 - protein, 9 aa, Homo Sapiens
GTSGRIKEL

SEQ ID NO: 922609 - protein, 9 aa, Homo Sapiens
NKIIHIREK

SEQ ID NO: 922610 - protein, 9 aa, Homo Sapiens
FFNDGRWHR

SEQ ID NO: 922611 - protein, 9 aa, Homo Sapiens
LLLLGHCKP

SEQ ID NO: 922612 - protein, 9 aa, Homo Sapiens
VRRALTELG

SEQ ID NO: 922613 - protein, 9 aa, Homo Sapiens
ASFLPLQCI

SEQ ID NO: 922614 - protein, 9 aa, Homo Sapiens
TFSQGASGN

SEQ ID NO: 922615 - protein, 9 aa, Homo Sapiens
PQLNQVAYD

SEQ ID NO: 922616 - protein, 9 aa, Homo Sapiens
PGWNMKKQR

SEQ ID NO: 922617 - protein, 9 aa, Homo Sapiens
EQDSEHGDV

SEQ ID NO: 922618 - protein, 9 aa, Homo Sapiens
NGIPGKKGP

SEQ ID NO: 922619 - protein, 9 aa, Homo Sapiens
LKKEISRVL

SEQ ID NO: 922620 - protein, 9 aa, Homo Sapiens
QCRFYFNKD

SEQ ID NO: 922621 - protein, 9 aa, Homo Sapiens
EEAIFGADV

SEQ ID NO: 922622 - protein, 9 aa, Homo Sapiens
FVYSKGSSP

SEQ ID NO: 922623 - protein, 9 aa, Homo Sapiens
NGVDLLSLR

SEQ ID NO: 922624 - protein, 9 aa, Homo Sapiens
SGTPMIPVP

SEQ ID NO: 922625 - protein, 9 aa, Homo Sapiens
IHLLLLVFE

SEQ ID NO: 922626 - protein, 9 aa, Homo Sapiens
ENKLIGKFK

SEQ ID NO: 922627 - protein, 9 aa, Homo Sapiens
GAPVLLLCL

SEQ ID NO: 922628 - protein, 9 aa, Homo Sapiens
CFSFLSTVT

SEQ ID NO: 922629 - protein, 9 aa, Homo Sapiens
AEKCPNIIH

SEQ ID NO: 922630 - protein, 9 aa, Homo Sapiens
KREGKSFIC

SEQ ID NO: 922631 - protein, 9 aa, Homo Sapiens
VLLCLLIAG

SEQ ID NO: 922632 - protein, 9 aa, Homo Sapiens
VTCLGLSYN

SEQ ID NO: 922633 - protein, 9 aa, Homo Sapiens
ASNTCPKSD

SEQ ID NO: 922634 - protein, 9 aa, Homo Sapiens
SQGPSTPKA

SEQ ID NO: 922635 - protein, 9 aa, Homo Sapiens
MKKFLFYAR

SEQ ID NO: 922636 - protein, 9 aa, Homo Sapiens
KLIQPSELH

SEQ ID NO: 922637 - protein, 9 aa, Homo Sapiens
GKSFICQSE

SEQ ID NO: 922638 - protein, 9 aa, Homo Sapiens
YECDDCGLG

SEQ ID NO: 922639 - protein, 9 aa, Homo Sapiens
DVRAQLECE

SEQ ID NO: 922640 - protein, 9 aa, Homo Sapiens
LPASAFAIA

SEQ ID NO: 922641 - protein, 9 aa, Homo Sapiens
PQGENQSQG

SEQ ID NO: 922642 - protein, 9 aa, Homo Sapiens
HPNLEMTER

SEQ ID NO: 922643 - protein, 9 aa, Homo Sapiens
EAFDLEKAG

SEQ ID NO: 922644 - protein, 9 aa, Homo Sapiens
LNETIQCET

SEQ ID NO: 922645 - protein, 9 aa, Homo Sapiens
FPVILLLLL

SEQ ID NO: 922646 - protein, 9 aa, Homo Sapiens
LCFRKIGGE

SEQ ID NO: 922647 - protein, 9 aa, Homo Sapiens
IRETRSTVR

SEQ ID NO: 922648 - protein, 9 aa, Homo Sapiens
LKKKVTELK

SEQ ID NO: 922649 - protein, 9 aa, Homo Sapiens
IVTVLRISS

SEQ ID NO: 922650 - protein, 9 aa, Homo Sapiens
SVNKNSVLL

SEQ ID NO: 922651 - protein, 9 aa, Homo Sapiens
LANLSEGVF

SEQ ID NO: 922652 - protein, 9 aa, Homo Sapiens
LGAGSCRLE

SEQ ID NO: 922653 - protein, 9 aa, Homo Sapiens
LKELTMDGA

SEQ ID NO: 922654 - protein, 9 aa, Homo Sapiens
FFLQEKNRR

SEQ ID NO: 922655 - protein, 9 aa, Homo Sapiens
IIFSALSDF

SEQ ID NO: 922656 - protein, 9 aa, Homo Sapiens
HDQTEQCVP

SEQ ID NO: 922657 - protein, 9 aa, Homo Sapiens
CLDMQPYMC

SEQ ID NO: 922658 - protein, 9 aa, Homo Sapiens
RITLLRENH

SEQ ID NO: 922659 - protein, 9 aa, Homo Sapiens
GGQKAKMSN

SEQ ID NO: 922660 - protein, 9 aa, Homo Sapiens
FPGDSYSYN

SEQ ID NO: 922661 - protein, 9 aa, Homo Sapiens
LFQLLIIDG

SEQ ID NO: 922662 - protein, 9 aa, Homo Sapiens
QKRNAYWKE

SEQ ID NO: 922663 - protein, 9 aa, Homo Sapiens
QQISMKVLL

SEQ ID NO: 922664 - protein, 9 aa, Homo Sapiens
RKIGGEDGD

SEQ ID NO: 922665 - protein, 9 aa, Homo Sapiens
QCLSPLKSF

SEQ ID NO: 922666 - protein, 9 aa, Homo Sapiens
EEKKLFGFA

SEQ ID NO: 922667 - protein, 9 aa, Homo Sapiens
LSSLEYRTE

SEQ ID NO: 922668 - protein, 9 aa, Homo Sapiens
EILKTTYFI

SEQ ID NO: 922669 - protein, 9 aa, Homo Sapiens
TSVDSNSPV

SEQ ID NO: 922670 - protein, 9 aa, Homo Sapiens
QRGHYRVAC

SEQ ID NO: 922671 - protein, 9 aa, Homo Sapiens
QEQPYFSVD

SEQ ID NO: 922672 - protein, 9 aa, Homo Sapiens
QAVLSDTKK

SEQ ID NO: 922673 - protein, 9 aa, Homo Sapiens
AWYEGSLGA

SEQ ID NO: 922674 - protein, 9 aa, Homo Sapiens
RDRSSRDRA

SEQ ID NO: 922675 - protein, 9 aa, Homo Sapiens
HTGERSYRC

SEQ ID NO: 922676 - protein, 9 aa, Homo Sapiens
RISSAAGKW

SEQ ID NO: 922677 - protein, 9 aa, Homo Sapiens
PKQTLEKNL

SEQ ID NO: 922678 - protein, 9 aa, Homo Sapiens
PGPPFVSYM

SEQ ID NO: 922679 - protein, 9 aa, Homo Sapiens
VYSKVVFSG

SEQ ID NO: 922680 - protein, 9 aa, Homo Sapiens
HKFILFRFS

SEQ ID NO: 922681 - protein, 9 aa, Homo Sapiens
DRSSAGQYA

SEQ ID NO: 922682 - protein, 9 aa, Homo Sapiens
NNIFKPLTE

SEQ ID NO: 922683 - protein, 9 aa, Homo Sapiens
NSKPRENKN

SEQ ID NO: 922684 - protein, 9 aa, Homo Sapiens
GAAAHGPRE

SEQ ID NO: 922685 - protein, 9 aa, Homo Sapiens
PETCAFPWK

SEQ ID NO: 922686 - protein, 9 aa, Homo Sapiens
IRGPPLPGM

SEQ ID NO: 922687 - protein, 9 aa, Homo Sapiens
MCQQNTGPL

SEQ ID NO: 922688 - protein, 9 aa, Homo Sapiens
RKFGPLEWN

SEQ ID NO: 922689 - protein, 9 aa, Homo Sapiens
NVRRALTEL

SEQ ID NO: 922690 - protein, 9 aa, Homo Sapiens
RARHGFQKK

SEQ ID NO: 922691 - protein, 9 aa, Homo Sapiens
DGEYHQPAC

SEQ ID NO: 922692 - protein, 9 aa, Homo Sapiens
LLRENHESR

SEQ ID NO: 922693 - protein, 9 aa, Homo Sapiens
SQQGYPPQQ

SEQ ID NO: 922694 - protein, 9 aa, Homo Sapiens
YVYYLVIES

SEQ ID NO: 922695 - protein, 9 aa, Homo Sapiens
YMFWNCNHP

SEQ ID NO: 922696 - protein, 9 aa, Homo Sapiens
APVGINLQQ

SEQ ID NO: 922697 - protein, 9 aa, Homo Sapiens
SLINKEESY

SEQ ID NO: 922698 - protein, 9 aa, Homo Sapiens
SSWPDAAFA

SEQ ID NO: 922699 - protein, 9 aa, Homo Sapiens
SITERKKKG

SEQ ID NO: 922700 - protein, 9 aa, Homo Sapiens
GERSYRCGD

SEQ ID NO: 922701 - protein, 9 aa, Homo Sapiens
FCAQSFFKN

SEQ ID NO: 922702 - protein, 9 aa, Homo Sapiens
PPSQQGYPP

SEQ ID NO: 922703 - protein, 9 aa, Homo Sapiens
FDCLCPSGS

SEQ ID NO: 922704 - protein, 9 aa, Homo Sapiens
TNQFGDRES

SEQ ID NO: 922705 - protein, 9 aa, Homo Sapiens
TQFIIFSAL

SEQ ID NO: 922706 - protein, 9 aa, Homo Sapiens
RDDFLWGVF

SEQ ID NO: 922707 - protein, 9 aa, Homo Sapiens
LTQPKLVVS

SEQ ID NO: 922708 - protein, 9 aa, Homo Sapiens
TLELQKLEE

SEQ ID NO: 922709 - protein, 9 aa, Homo Sapiens
ELVRPALKN

SEQ ID NO: 922710 - protein, 9 aa, Homo Sapiens
SQLKILIRL

SEQ ID NO: 922711 - protein, 9 aa, Homo Sapiens
LCLMCQKLI

SEQ ID NO: 922712 - protein, 9 aa, Homo Sapiens
AEKCETHCA

SEQ ID NO: 922713 - protein, 9 aa, Homo Sapiens
VKVVEDEAT

SEQ ID NO: 922714 - protein, 9 aa, Homo Sapiens
YLAVHSPQR

SEQ ID NO: 922715 - protein, 9 aa, Homo Sapiens
YDTIKQVLL

SEQ ID NO: 922716 - protein, 9 aa, Homo Sapiens
EKNLKENRE

SEQ ID NO: 922717 - protein, 9 aa, Homo Sapiens
RLPFYNQDY

SEQ ID NO: 922718 - protein, 9 aa, Homo Sapiens
ILLLLLGHC

SEQ ID NO: 922719 - protein, 9 aa, Homo Sapiens
SLLYGEDEA

SEQ ID NO: 922720 - protein, 9 aa, Homo Sapiens
DVNIFFDEL

SEQ ID NO: 922721 - protein, 9 aa, Homo Sapiens
VFIMLMARL

SEQ ID NO: 922722 - protein, 9 aa, Homo Sapiens
ITTFSENHS

SEQ ID NO: 922723 - protein, 9 aa, Homo Sapiens
GLNQLNEHA

SEQ ID NO: 922724 - protein, 9 aa, Homo Sapiens
ILLRLTDDP

SEQ ID NO: 922725 - protein, 9 aa, Homo Sapiens
YLYPGWNMK

SEQ ID NO: 922726 - protein, 9 aa, Homo Sapiens
QRYLAVHSP

SEQ ID NO: 922727 - protein, 9 aa, Homo Sapiens
FPGSRKLQS

SEQ ID NO: 922728 - protein, 9 aa, Homo Sapiens
DLKGLQIDV

SEQ ID NO: 922729 - protein, 9 aa, Homo Sapiens
SLEYRTEPS

SEQ ID NO: 922730 - protein, 9 aa, Homo Sapiens
LLLLVFEVL

SEQ ID NO: 922731 - protein, 9 aa, Homo Sapiens
APRDRDRKD

SEQ ID NO: 922732 - protein, 9 aa, Homo Sapiens
QYSGGLSTI

SEQ ID NO: 922733 - protein, 9 aa, Homo Sapiens
TPASLLPVS

SEQ ID NO: 922734 - protein, 9 aa, Homo Sapiens
YRVRISRRP

SEQ ID NO: 922735 - protein, 9 aa, Homo Sapiens
SVDSNSPVV

SEQ ID NO: 922736 - protein, 9 aa, Homo Sapiens
APAPLASYE

SEQ ID NO: 922737 - protein, 9 aa, Homo Sapiens
EFCASVLEI

SEQ ID NO: 922738 - protein, 9 aa, Homo Sapiens
GLATEKSRW

SEQ ID NO: 922739 - protein, 9 aa, Homo Sapiens
QSEAFDCAY

SEQ ID NO: 922740 - protein, 9 aa, Homo Sapiens
DRITLLREN

SEQ ID NO: 922741 - protein, 9 aa, Homo Sapiens
HSAPPVLSA

SEQ ID NO: 922742 - protein, 9 aa, Homo Sapiens
QVTCFLMPH

SEQ ID NO: 922743 - protein, 9 aa, Homo Sapiens
EDCSVLCGG

SEQ ID NO: 922744 - protein, 9 aa, Homo Sapiens
DRLENGMED

SEQ ID NO: 922745 - protein, 9 aa, Homo Sapiens
GGLENMGRF

SEQ ID NO: 922746 - protein, 9 aa, Homo Sapiens
QDSEHGDVL

SEQ ID NO: 922747 - protein, 9 aa, Homo Sapiens
AVLPEHGAA

SEQ ID NO: 922748 - protein, 9 aa, Homo Sapiens
SPLKSFPVE

SEQ ID NO: 922749 - protein, 9 aa, Homo Sapiens
MPSENWSPS

SEQ ID NO: 922750 - protein, 9 aa, Homo Sapiens
KYISNKAIP

SEQ ID NO: 922751 - protein, 9 aa, Homo Sapiens
KRNKREEQG

SEQ ID NO: 922752 - protein, 9 aa, Homo Sapiens
PLKSFPVET

SEQ ID NO: 922753 - protein, 9 aa, Homo Sapiens
VRHLKSFFE

SEQ ID NO: 922754 - protein, 9 aa, Homo Sapiens
WQVRHLKSF

SEQ ID NO: 922755 - protein, 9 aa, Homo Sapiens
DDPKDPLIE

SEQ ID NO: 922756 - protein, 9 aa, Homo Sapiens
ILKTTYFIC

SEQ ID NO: 922757 - protein, 9 aa, Homo Sapiens
GNDWGLQGN

SEQ ID NO: 922758 - protein, 9 aa, Homo Sapiens
CDDCGLGFV

SEQ ID NO: 922759 - protein, 9 aa, Homo Sapiens
ITKFYFQED

SEQ ID NO: 922760 - protein, 9 aa, Homo Sapiens
TNIIFGERQ

SEQ ID NO: 922761 - protein, 9 aa, Homo Sapiens
HFGRMMFVG

SEQ ID NO: 922762 - protein, 9 aa, Homo Sapiens
SSALSSLRC

SEQ ID NO: 922763 - protein, 9 aa, Homo Sapiens
NAVGKPEYL

SEQ ID NO: 922764 - protein, 9 aa, Homo Sapiens
KFILFRFSM

SEQ ID NO: 922765 - protein, 9 aa, Homo Sapiens
RSVFLDRSS

SEQ ID NO: 922766 - protein, 9 aa, Homo Sapiens
IFGADVLDQ

SEQ ID NO: 922767 - protein, 9 aa, Homo Sapiens
VRLPVGGKL

SEQ ID NO: 922768 - protein, 9 aa, Homo Sapiens
PPAPAPLAS

SEQ ID NO: 922769 - protein, 9 aa, Homo Sapiens
EKSVRHPKP

SEQ ID NO: 922770 - protein, 9 aa, Homo Sapiens
DLEKAGTDA

SEQ ID NO: 922771 - protein, 9 aa, Homo Sapiens
LLLVFEVLV

SEQ ID NO: 922772 - protein, 9 aa, Homo Sapiens
ETRSTVRDS

SEQ ID NO: 922773 - protein, 9 aa, Homo Sapiens
SKLTSSWPD

SEQ ID NO: 922774 - protein, 9 aa, Homo Sapiens
RGASYLKTC

SEQ ID NO: 922775 - protein, 9 aa, Homo Sapiens
YFHLATWLV

SEQ ID NO: 922776 - protein, 9 aa, Homo Sapiens
VKYPLGKVI

SEQ ID NO: 922777 - protein, 9 aa, Homo Sapiens
PRELKGEKG

SEQ ID NO: 922778 - protein, 9 aa, Homo Sapiens
NLSASTMDV

SEQ ID NO: 922779 - protein, 9 aa, Homo Sapiens
SCELGMKQF

SEQ ID NO: 922780 - protein, 9 aa, Homo Sapiens
GRSQDFIGG

SEQ ID NO: 922781 - protein, 9 aa, Homo Sapiens
NIQQNNAPM

SEQ ID NO: 922782 - protein, 9 aa, Homo Sapiens
YKQSEILGY

SEQ ID NO: 922783 - protein, 9 aa, Homo Sapiens
KELGLPPGM

SEQ ID NO: 922784 - protein, 9 aa, Homo Sapiens
SWPDAAFAE

SEQ ID NO: 922785 - protein, 9 aa, Homo Sapiens
AVLDFLGND

SEQ ID NO: 922786 - protein, 9 aa, Homo Sapiens
LGLSWRQGL

SEQ ID NO: 922787 - protein, 9 aa, Homo Sapiens
KFMNVLGAF

SEQ ID NO: 922788 - protein, 9 aa, Homo Sapiens
FSSAYQIEG

SEQ ID NO: 922789 - protein, 9 aa, Homo Sapiens
NETIQCETL

SEQ ID NO: 922790 - protein, 9 aa, Homo Sapiens
SVFLDRSSA

SEQ ID NO: 922791 - protein, 9 aa, Homo Sapiens
REMLKIEEW

SEQ ID NO: 922792 - protein, 9 aa, Homo Sapiens
GLACVFIGI

SEQ ID NO: 922793 - protein, 9 aa, Homo Sapiens
IAWLGTRPP

SEQ ID NO: 922794 - protein, 9 aa, Homo Sapiens
TFQEQLTPS

SEQ ID NO: 922795 - protein, 9 aa, Homo Sapiens
KNLEDVPGD

SEQ ID NO: 922796 - protein, 9 aa, Homo Sapiens
VAQSEAFDC

SEQ ID NO: 922797 - protein, 9 aa, Homo Sapiens
ATVRLPVGG

SEQ ID NO: 922798 - protein, 9 aa, Homo Sapiens
CAFPWKAES

SEQ ID NO: 922799 - protein, 9 aa, Homo Sapiens
SARLSNESF

SEQ ID NO: 922800 - protein, 9 aa, Homo Sapiens
LAEVQCHPD

SEQ ID NO: 922801 - protein, 9 aa, Homo Sapiens
DKGSVLEET

SEQ ID NO: 922802 - protein, 9 aa, Homo Sapiens
LQEQPYFSV

SEQ ID NO: 922803 - protein, 9 aa, Homo Sapiens
RKSHIRYGA

SEQ ID NO: 922804 - protein, 9 aa, Homo Sapiens
LPVGGKLNV

SEQ ID NO: 922805 - protein, 9 aa, Homo Sapiens
FFFNNLKYK

SEQ ID NO: 922806 - protein, 9 aa, Homo Sapiens
YSQYFHLAT

SEQ ID NO: 922807 - protein, 9 aa, Homo Sapiens
ERGRLPSGP

SEQ ID NO: 922808 - protein, 9 aa, Homo Sapiens
PFGGGLENM

SEQ ID NO: 922809 - protein, 9 aa, Homo Sapiens
CLCPSGSSC

SEQ ID NO: 922810 - protein, 9 aa, Homo Sapiens
QAAHGPREL

SEQ ID NO: 922811 - protein, 9 aa, Homo Sapiens
PAQISLVAQ

SEQ ID NO: 922812 - protein, 9 aa, Homo Sapiens
GSSHPFLLN

SEQ ID NO: 922813 - protein, 9 aa, Homo Sapiens
GSRVLFSCH

SEQ ID NO: 922814 - protein, 9 aa, Homo Sapiens
VSGGLLVPR

SEQ ID NO: 922815 - protein, 9 aa, Homo Sapiens
YEAGKTAKA

SEQ ID NO: 922816 - protein, 9 aa, Homo Sapiens
PEFSEAKTP

SEQ ID NO: 922817 - protein, 9 aa, Homo Sapiens
PGMKGEKEA

SEQ ID NO: 922818 - protein, 9 aa, Homo Sapiens
KQLSFEVFI

SEQ ID NO: 922819 - protein, 9 aa, Homo Sapiens
KWRGSEKVL

SEQ ID NO: 922820 - protein, 9 aa, Homo Sapiens
TYYHDQTEQ

SEQ ID NO: 922821 - protein, 9 aa, Homo Sapiens
CVFIGINDL

SEQ ID NO: 922822 - protein, 9 aa, Homo Sapiens
LLCLLIAGP

SEQ ID NO: 922823 - protein, 9 aa, Homo Sapiens
CAYRKQMRG

SEQ ID NO: 922824 - protein, 9 aa, Homo Sapiens
KFTPSYMFW

SEQ ID NO: 922825 - protein, 9 aa, Homo Sapiens
VRVKWDAVP

SEQ ID NO: 922826 - protein, 9 aa, Homo Sapiens
QYPGAGMVS

SEQ ID NO: 922827 - protein, 9 aa, Homo Sapiens
NGQVTCFLM

SEQ ID NO: 922828 - protein, 9 aa, Homo Sapiens
KGFPGKTGP

SEQ ID NO: 922829 - protein, 9 aa, Homo Sapiens
ACAGSCNCK

SEQ ID NO: 922830 - protein, 9 aa, Homo Sapiens
ITLLRENHE

SEQ ID NO: 922831 - protein, 9 aa, Homo Sapiens
QTNVRRALT

SEQ ID NO: 922832 - protein, 9 aa, Homo Sapiens
IFFLRTTAL

SEQ ID NO: 922833 - protein, 9 aa, Homo Sapiens
LMAYTLELQ

SEQ ID NO: 922834 - protein, 9 aa, Homo Sapiens
GSLGAMLRC

SEQ ID NO: 922835 - protein, 9 aa, Homo Sapiens
EKCETHCAK

SEQ ID NO: 922836 - protein, 9 aa, Homo Sapiens
NEIVTAAIN

SEQ ID NO: 922837 - protein, 9 aa, Homo Sapiens
LRRLAVSFV

SEQ ID NO: 922838 - protein, 9 aa, Homo Sapiens
VHSGGLHRP

SEQ ID NO: 922839 - protein, 9 aa, Homo Sapiens
LQASITERK

SEQ ID NO: 922840 - protein, 9 aa, Homo Sapiens
FGFEAKAEK

SEQ ID NO: 922841 - protein, 9 aa, Homo Sapiens
SYNGLLGDN

SEQ ID NO: 922842 - protein, 9 aa, Homo Sapiens
DDFLWGVFS

SEQ ID NO: 922843 - protein, 9 aa, Homo Sapiens
LRISSAAGK

SEQ ID NO: 922844 - protein, 9 aa, Homo Sapiens
SISCGNGLF

SEQ ID NO: 922845 - protein, 9 aa, Homo Sapiens
ETLLGVFLV

SEQ ID NO: 922846 - protein, 9 aa, Homo Sapiens
DIALLMANT

SEQ ID NO: 922847 - protein, 9 aa, Homo Sapiens
IFVIFDFLI

SEQ ID NO: 922848 - protein, 9 aa, Homo Sapiens
ASTLSTTSV

SEQ ID NO: 922849 - protein, 9 aa, Homo Sapiens
KDKEEKKLF

SEQ ID NO: 922850 - protein, 9 aa, Homo Sapiens
YNQDYERLF

SEQ ID NO: 922851 - protein, 9 aa, Homo Sapiens
IQQEGDDVQ

SEQ ID NO: 922852 - protein, 9 aa, Homo Sapiens
GENQSQGPP

SEQ ID NO: 922853 - protein, 9 aa, Homo Sapiens
FATFNEMCA

SEQ ID NO: 922854 - protein, 9 aa, Homo Sapiens
LFCEQQRTL

SEQ ID NO: 922855 - protein, 9 aa, Homo Sapiens
VQTGTPQST

SEQ ID NO: 922856 - protein, 9 aa, Homo Sapiens
SFVLKSRES

SEQ ID NO: 922857 - protein, 9 aa, Homo Sapiens
KPFKLQRYL

SEQ ID NO: 922858 - protein, 9 aa, Homo Sapiens
GGSRVLFSC

SEQ ID NO: 922859 - protein, 9 aa, Homo Sapiens
FLGNDWGLQ

SEQ ID NO: 922860 - protein, 9 aa, Homo Sapiens
QVVDVDEPP

SEQ ID NO: 922861 - protein, 9 aa, Homo Sapiens
PGKKGPAGE

SEQ ID NO: 922862 - protein, 9 aa, Homo Sapiens
AEEESLINK

SEQ ID NO: 922863 - protein, 9 aa, Homo Sapiens
GRKLIFGGR

SEQ ID NO: 922864 - protein, 9 aa, Homo Sapiens
ILMFAGRKL

SEQ ID NO: 922865 - protein, 9 aa, Homo Sapiens
DKYDTIKQV

SEQ ID NO: 922866 - protein, 9 aa, Homo Sapiens
AERASSPCH

SEQ ID NO: 922867 - protein, 9 aa, Homo Sapiens
GNGQSQGSR

SEQ ID NO: 922868 - protein, 9 aa, Homo Sapiens
LIKSQIDTY

SEQ ID NO: 922869 - protein, 9 aa, Homo Sapiens
CASVLEIAA

SEQ ID NO: 922870 - protein, 9 aa, Homo Sapiens
TLTMNRVRQ

SEQ ID NO: 922871 - protein, 9 aa, Homo Sapiens
LKQTLQFWK

SEQ ID NO: 922872 - protein, 9 aa, Homo Sapiens
GMVSQGEAN

SEQ ID NO: 922873 - protein, 9 aa, Homo Sapiens
FGNVLKFIP

SEQ ID NO: 922874 - protein, 9 aa, Homo Sapiens
HCMPSENWS

SEQ ID NO: 922875 - protein, 9 aa, Homo Sapiens
GIHLLLLVF

SEQ ID NO: 922876 - protein, 9 aa, Homo Sapiens
QKAKMSNFP

SEQ ID NO: 922877 - protein, 9 aa, Homo Sapiens
NFCDSNVID

SEQ ID NO: 922878 - protein, 9 aa, Homo Sapiens
MNVLGAFDG

SEQ ID NO: 922879 - protein, 9 aa, Homo Sapiens
QKKLCEAKH

SEQ ID NO: 922880 - protein, 9 aa, Homo Sapiens
AGSCNCKKC

SEQ ID NO: 922881 - protein, 9 aa, Homo Sapiens
QIIFFLRTT

SEQ ID NO: 922882 - protein, 9 aa, Homo Sapiens
RLEEEAIFG

SEQ ID NO: 922883 - protein, 9 aa, Homo Sapiens
DRAPRDRDR

SEQ ID NO: 922884 - protein, 9 aa, Homo Sapiens
TFIKIQVVD

SEQ ID NO: 922885 - protein, 9 aa, Homo Sapiens
ALCFRKIGG

SEQ ID NO: 922886 - protein, 9 aa, Homo Sapiens
FEPVVQMPA

SEQ ID NO: 922887 - protein, 9 aa, Homo Sapiens
ETILTETPQ

SEQ ID NO: 922888 - protein, 9 aa, Homo Sapiens
LEKVPCTQE

SEQ ID NO: 922889 - protein, 9 aa, Homo Sapiens
SFLPLQCIY

SEQ ID NO: 922890 - protein, 9 aa, Homo Sapiens
LWRQSSERG

SEQ ID NO: 922891 - protein, 9 aa, Homo Sapiens
DIRAALDTI

SEQ ID NO: 922892 - protein, 9 aa, Homo Sapiens
PSTPKAERA

SEQ ID NO: 922893 - protein, 9 aa, Homo Sapiens
FCASVLEIA

SEQ ID NO: 922894 - protein, 9 aa, Homo Sapiens
NNGFCELFG

SEQ ID NO: 922895 - protein, 9 aa, Homo Sapiens
NETSAEMKI

SEQ ID NO: 922896 - protein, 9 aa, Homo Sapiens
MPKVDLKGL

SEQ ID NO: 922897 - protein, 9 aa, Homo Sapiens
METLLGVFL

SEQ ID NO: 922898 - protein, 9 aa, Homo Sapiens
IAKNRIKKT

SEQ ID NO: 922899 - protein, 9 aa, Homo Sapiens
RDLGPNMRG

SEQ ID NO: 922900 - protein, 9 aa, Homo Sapiens
IYFVYSKGS

SEQ ID NO: 922901 - protein, 9 aa, Homo Sapiens
LHKFILFRF

SEQ ID NO: 922902 - protein, 9 aa, Homo Sapiens
SQDFIGGEP

SEQ ID NO: 922903 - protein, 9 aa, Homo Sapiens
SLVDGRSVL

SEQ ID NO: 922904 - protein, 9 aa, Homo Sapiens
PSALLFVAS

SEQ ID NO: 922905 - protein, 9 aa, Homo Sapiens
PPPVPSGTP

SEQ ID NO: 922906 - protein, 9 aa, Homo Sapiens
IGENRLVSQ

SEQ ID NO: 922907 - protein, 9 aa, Homo Sapiens
TCFLMPHVP

SEQ ID NO: 922908 - protein, 9 aa, Homo Sapiens
MLLFVSNRT

SEQ ID NO: 922909 - protein, 9 aa, Homo Sapiens
SNFPWQVFT

SEQ ID NO: 922910 - protein, 9 aa, Homo Sapiens
NIFKPLTEC

SEQ ID NO: 922911 - protein, 9 aa, Homo Sapiens
NTLKAGEIL

SEQ ID NO: 922912 - protein, 9 aa, Homo Sapiens
GCRLRDLRD

SEQ ID NO: 922913 - protein, 9 aa, Homo Sapiens
LEQDSEHGD

SEQ ID NO: 922914 - protein, 9 aa, Homo Sapiens
RGPPLPGMR

SEQ ID NO: 922915 - protein, 9 aa, Homo Sapiens
PFYNQDYER

SEQ ID NO: 922916 - protein, 9 aa, Homo Sapiens
LAEAEAGIT

SEQ ID NO: 922917 - protein, 9 aa, Homo Sapiens
SKMADTSVG

SEQ ID NO: 922918 - protein, 9 aa, Homo Sapiens
YMCQQNTGP

SEQ ID NO: 922919 - protein, 9 aa, Homo Sapiens
GVRDVSKKL

SEQ ID NO: 922920 - protein, 9 aa, Homo Sapiens
HISRWGPGF

SEQ ID NO: 922921 - protein, 9 aa, Homo Sapiens
NIIHLNLSG

SEQ ID NO: 922922 - protein, 9 aa, Homo Sapiens
HIRYGAFCC

SEQ ID NO: 922923 - protein, 9 aa, Homo Sapiens
EYRTEPSPG

SEQ ID NO: 922924 - protein, 9 aa, Homo Sapiens
GEYHQPACS

SEQ ID NO: 922925 - protein, 9 aa, Homo Sapiens
EMKIREDEN

SEQ ID NO: 922926 - protein, 9 aa, Homo Sapiens
AKMSNFPWQ

SEQ ID NO: 922927 - protein, 9 aa, Homo Sapiens
ATQFIIFSA

SEQ ID NO: 922928 - protein, 9 aa, Homo Sapiens
SALSSLRCL

SEQ ID NO: 922929 - protein, 9 aa, Homo Sapiens
SVLPASAFA

SEQ ID NO: 922930 - protein, 9 aa, Homo Sapiens
KRLRKAICT

SEQ ID NO: 922931 - protein, 9 aa, Homo Sapiens
ADRASTSPR

SEQ ID NO: 922932 - protein, 9 aa, Homo Sapiens
HNSCSDSVC

SEQ ID NO: 922933 - protein, 9 aa, Homo Sapiens
TFNEMCALL

SEQ ID NO: 922934 - protein, 9 aa, Homo Sapiens
LYDSNAVGK

SEQ ID NO: 922935 - protein, 9 aa, Homo Sapiens
LCGGGEQLR

SEQ ID NO: 922936 - protein, 9 aa, Homo Sapiens
IRNMVIFCN

SEQ ID NO: 922937 - protein, 9 aa, Homo Sapiens
RNYKSSTNG

SEQ ID NO: 922938 - protein, 9 aa, Homo Sapiens
RHCSTKDKE

SEQ ID NO: 922939 - protein, 9 aa, Homo Sapiens
MTLPGGSCF

SEQ ID NO: 922940 - protein, 9 aa, Homo Sapiens
GKHEALSSP

SEQ ID NO: 922941 - protein, 9 aa, Homo Sapiens
EGPPPQGEN

SEQ ID NO: 922942 - protein, 9 aa, Homo Sapiens
MKQFSYDQN

SEQ ID NO: 922943 - protein, 9 aa, Homo Sapiens
LPEHGAALS

SEQ ID NO: 922944 - protein, 9 aa, Homo Sapiens
RRLAVSFVL

SEQ ID NO: 922945 - protein, 9 aa, Homo Sapiens
QLSFEVFIM

SEQ ID NO: 922946 - protein, 9 aa, Homo Sapiens
NGLLGDNQI

SEQ ID NO: 922947 - protein, 9 aa, Homo Sapiens
NEHAGWQWS

SEQ ID NO: 922948 - protein, 9 aa, Homo Sapiens
HPFLLNGFP

SEQ ID NO: 922949 - protein, 9 aa, Homo Sapiens
LQITTFSEN

SEQ ID NO: 922950 - protein, 9 aa, Homo Sapiens
NSLNNIFKP

SEQ ID NO: 922951 - protein, 9 aa, Homo Sapiens
VLLDPPLEL

SEQ ID NO: 922952 - protein, 9 aa, Homo Sapiens
PLFQLLIID

SEQ ID NO: 922953 - protein, 9 aa, Homo Sapiens
HGFQKKPEA

SEQ ID NO: 922954 - protein, 9 aa, Homo Sapiens
NASNTCPKS

SEQ ID NO: 922955 - protein, 9 aa, Homo Sapiens
MVIFCNVVD

SEQ ID NO: 922956 - protein, 9 aa, Homo Sapiens
DGTSLAEAE

SEQ ID NO: 922957 - protein, 9 aa, Homo Sapiens
GPITKSDGN

SEQ ID NO: 922958 - protein, 9 aa, Homo Sapiens
QLKILIRLM

SEQ ID NO: 922959 - protein, 9 aa, Homo Sapiens
KEATNIICP

SEQ ID NO: 922960 - protein, 9 aa, Homo Sapiens
KAIFLRHLM

SEQ ID NO: 922961 - protein, 9 aa, Homo Sapiens
TLPKHKTNE

SEQ ID NO: 922962 - protein, 9 aa, Homo Sapiens
LHSQIHHST

SEQ ID NO: 922963 - protein, 9 aa, Homo Sapiens
SSVSSDLGP

SEQ ID NO: 922964 - protein, 9 aa, Homo Sapiens
YEGSLGAML

SEQ ID NO: 922965 - protein, 9 aa, Homo Sapiens
ESLINKEES

SEQ ID NO: 922966 - protein, 9 aa, Homo Sapiens
FRPIRKRLN

SEQ ID NO: 922967 - protein, 9 aa, Homo Sapiens
QGQVCCSAD

SEQ ID NO: 922968 - protein, 9 aa, Homo Sapiens
LEKAGTDAL

SEQ ID NO: 922969 - protein, 9 aa, Homo Sapiens
QSFFKNFGL

SEQ ID NO: 922970 - protein, 9 aa, Homo Sapiens
IMMEGCKYA

SEQ ID NO: 922971 - protein, 9 aa, Homo Sapiens
HYPWAYEPV

SEQ ID NO: 922972 - protein, 9 aa, Homo Sapiens
EPLVPAQDS

SEQ ID NO: 922973 - protein, 9 aa, Homo Sapiens
ALVFLESAE

SEQ ID NO: 922974 - protein, 9 aa, Homo Sapiens
ELCALLPTS

SEQ ID NO: 922975 - protein, 9 aa, Homo Sapiens
FSCHLSKAL

SEQ ID NO: 922976 - protein, 9 aa, Homo Sapiens
QKFTPSYMF

SEQ ID NO: 922977 - protein, 9 aa, Homo Sapiens
HEDLNWVKK

SEQ ID NO: 922978 - protein, 9 aa, Homo Sapiens
SCKRQTNVR

SEQ ID NO: 922979 - protein, 9 aa, Homo Sapiens
SPNNSLNNI

SEQ ID NO: 922980 - protein, 9 aa, Homo Sapiens
VMNEVQKFL

SEQ ID NO: 922981 - protein, 9 aa, Homo Sapiens
HQPPFFHAL

SEQ ID NO: 922982 - protein, 9 aa, Homo Sapiens
PPLPGMRPP

SEQ ID NO: 922983 - protein, 9 aa, Homo Sapiens
EYHQPACSL

SEQ ID NO: 922984 - protein, 9 aa, Homo Sapiens
HYVYSTLTM

SEQ ID NO: 922985 - protein, 9 aa, Homo Sapiens
LFVSNRTTF

SEQ ID NO: 922986 - protein, 9 aa, Homo Sapiens
FHLATWLVP

SEQ ID NO: 922987 - protein, 9 aa, Homo Sapiens
QGDINSFSQ

SEQ ID NO: 922988 - protein, 9 aa, Homo Sapiens
PALKNSLKK

SEQ ID NO: 922989 - protein, 9 aa, Homo Sapiens
KARRLDSTE

SEQ ID NO: 922990 - protein, 9 aa, Homo Sapiens
VNKNSVLLQ

SEQ ID NO: 922991 - protein, 9 aa, Homo Sapiens
KAQKELIKS

SEQ ID NO: 922992 - protein, 9 aa, Homo Sapiens
TEKSRWSGS

SEQ ID NO: 922993 - protein, 9 aa, Homo Sapiens
TLNTLKAGE

SEQ ID NO: 922994 - protein, 9 aa, Homo Sapiens
GSSCSGDCP

SEQ ID NO: 922995 - protein, 9 aa, Homo Sapiens
LQRSRTFPK

SEQ ID NO: 922996 - protein, 9 aa, Homo Sapiens
LVRPALKNS

SEQ ID NO: 922997 - protein, 9 aa, Homo Sapiens
VTVLRISSA

SEQ ID NO: 922998 - protein, 9 aa, Homo Sapiens
FHALTLPPN

SEQ ID NO: 922999 - protein, 9 aa, Homo Sapiens
FFEKKVVQD

SEQ ID NO: 923000 - protein, 9 aa, Homo Sapiens
QDSSSQVKR

SEQ ID NO: 923001 - protein, 9 aa, Homo Sapiens
YGEDEAADE

SEQ ID NO: 923002 - protein, 9 aa, Homo Sapiens
PKDPLIETF

SEQ ID NO: 923003 - protein, 9 aa, Homo Sapiens
ELGMKQFSY

SEQ ID NO: 923004 - protein, 9 aa, Homo Sapiens
CQKLIQPSE

SEQ ID NO: 923005 - protein, 9 aa, Homo Sapiens
IGRSPTDKI

SEQ ID NO: 923006 - protein, 9 aa, Homo Sapiens
PFLLNGFPG

SEQ ID NO: 923007 - protein, 9 aa, Homo Sapiens
TREKPYHCP

SEQ ID NO: 923008 - protein, 9 aa, Homo Sapiens
TSEEKSVRH

SEQ ID NO: 923009 - protein, 9 aa, Homo Sapiens
FKNQLSPYK

SEQ ID NO: 923010 - protein, 9 aa, Homo Sapiens
FIKRLPMNY

SEQ ID NO: 923011 - protein, 9 aa, Homo Sapiens
AHGPRELKG

SEQ ID NO: 923012 - protein, 9 aa, Homo Sapiens
NCTCLNETI

SEQ ID NO: 923013 - protein, 9 aa, Homo Sapiens
GVSISLSFI

SEQ ID NO: 923014 - protein, 9 aa, Homo Sapiens
TVMNEVQKF

SEQ ID NO: 923015 - protein, 9 aa, Homo Sapiens
CCSADQQEE

SEQ ID NO: 923016 - protein, 9 aa, Homo Sapiens
QSTPGLMKR

SEQ ID NO: 923017 - protein, 9 aa, Homo Sapiens
SVSKKKKKP

SEQ ID NO: 923018 - protein, 9 aa, Homo Sapiens
FFKNFGLYN

SEQ ID NO: 923019 - protein, 9 aa, Homo Sapiens
SDHTTNQFG

SEQ ID NO: 923020 - protein, 9 aa, Homo Sapiens
SDTKKIFPS

SEQ ID NO: 923021 - protein, 9 aa, Homo Sapiens
SQGSRLRQE

SEQ ID NO: 923022 - protein, 9 aa, Homo Sapiens
KTDTIRCPV

SEQ ID NO: 923023 - protein, 9 aa, Homo Sapiens
RLDTEASYC

SEQ ID NO: 923024 - protein, 9 aa, Homo Sapiens
INKEESYGG

SEQ ID NO: 923025 - protein, 9 aa, Homo Sapiens
SKKLVGLAE

SEQ ID NO: 923026 - protein, 9 aa, Homo Sapiens
NNSLNNIFK

SEQ ID NO: 923027 - protein, 9 aa, Homo Sapiens
SILQEQPYF

SEQ ID NO: 923028 - protein, 9 aa, Homo Sapiens
QVRHLKSFF

SEQ ID NO: 923029 - protein, 9 aa, Homo Sapiens
CLLIAGPVD

SEQ ID NO: 923030 - protein, 9 aa, Homo Sapiens
VHNSCSDSV

SEQ ID NO: 923031 - protein, 9 aa, Homo Sapiens
CTLRKAVHR

SEQ ID NO: 923032 - protein, 9 aa, Homo Sapiens
NKNSVLLQA

SEQ ID NO: 923033 - protein, 9 aa, Homo Sapiens
NEVAIEKAV

SEQ ID NO: 923034 - protein, 9 aa, Homo Sapiens
RQIVVKYPL

SEQ ID NO: 923035 - protein, 9 aa, Homo Sapiens
CLRRLAVSF

SEQ ID NO: 923036 - protein, 9 aa, Homo Sapiens
HQGNGQSQG

SEQ ID NO: 923037 - protein, 9 aa, Homo Sapiens
VSENTMLLF

SEQ ID NO: 923038 - protein, 9 aa, Homo Sapiens
QPYMCQQNT

SEQ ID NO: 923039 - protein, 9 aa, Homo Sapiens
PGEQQKLQE

SEQ ID NO: 923040 - protein, 9 aa, Homo Sapiens
DVTENSVRV

SEQ ID NO: 923041 - protein, 9 aa, Homo Sapiens
ICEFENKHV

SEQ ID NO: 923042 - protein, 9 aa, Homo Sapiens
VCKKRVVVL

SEQ ID NO: 923043 - protein, 9 aa, Homo Sapiens
TFEDQYFIG

SEQ ID NO: 923044 - protein, 9 aa, Homo Sapiens
RSTVRDSDS

SEQ ID NO: 923045 - protein, 9 aa, Homo Sapiens
VPSGTPMIP

SEQ ID NO: 923046 - protein, 9 aa, Homo Sapiens
EREMLKIEE

SEQ ID NO: 923047 - protein, 9 aa, Homo Sapiens
PQSTVPGAT

SEQ ID NO: 923048 - protein, 9 aa, Homo Sapiens
EFFCAQSFF

SEQ ID NO: 923049 - protein, 9 aa, Homo Sapiens
PQPFPGDSY

SEQ ID NO: 923050 - protein, 9 aa, Homo Sapiens
FVIVRVHNS

SEQ ID NO: 923051 - protein, 9 aa, Homo Sapiens
VLAEKCPNI

SEQ ID NO: 923052 - protein, 9 aa, Homo Sapiens
PTPSSTFQE

SEQ ID NO: 923053 - protein, 9 aa, Homo Sapiens
VINQRSLLY

SEQ ID NO: 923054 - protein, 9 aa, Homo Sapiens
HIREKPHAC

SEQ ID NO: 923055 - protein, 9 aa, Homo Sapiens
YPGAGMVSQ

SEQ ID NO: 923056 - protein, 9 aa, Homo Sapiens
LLEKVPCTQ

SEQ ID NO: 923057 - protein, 9 aa, Homo Sapiens
RRIWGTVCK

SEQ ID NO: 923058 - protein, 9 aa, Homo Sapiens
VQKFTPSYM

SEQ ID NO: 923059 - protein, 9 aa, Homo Sapiens
HPDKEGASN

SEQ ID NO: 923060 - protein, 9 aa, Homo Sapiens
EQGQVCCSA

SEQ ID NO: 923061 - protein, 9 aa, Homo Sapiens
IQVVDVDEP

SEQ ID NO: 923062 - protein, 9 aa, Homo Sapiens
RVSENTMLL

SEQ ID NO: 923063 - protein, 9 aa, Homo Sapiens
EKNRRRGAA

SEQ ID NO: 923064 - protein, 9 aa, Homo Sapiens
PNGIPGKKG

SEQ ID NO: 923065 - protein, 9 aa, Homo Sapiens
GEILNRFSK

SEQ ID NO: 923066 - protein, 9 aa, Homo Sapiens
YLGRSQDFI

SEQ ID NO: 923067 - protein, 9 aa, Homo Sapiens
CPNIIHLNL

SEQ ID NO: 923068 - protein, 9 aa, Homo Sapiens
ESGFDPNIC

SEQ ID NO: 923069 - protein, 9 aa, Homo Sapiens
EAEAGITVL

SEQ ID NO: 923070 - protein, 9 aa, Homo Sapiens
VFLAERGSF

SEQ ID NO: 923071 - protein, 9 aa, Homo Sapiens
FLSTVTILS

SEQ ID NO: 923072 - protein, 9 aa, Homo Sapiens
NWSLKGFKM

SEQ ID NO: 923073 - protein, 9 aa, Homo Sapiens
LKSFPVETP

SEQ ID NO: 923074 - protein, 9 aa, Homo Sapiens
KEPPSAASK

SEQ ID NO: 923075 - protein, 9 aa, Homo Sapiens
IFCNVVDGQ

SEQ ID NO: 923076 - protein, 9 aa, Homo Sapiens
KMADTSVGW

SEQ ID NO: 923077 - protein, 9 aa, Homo Sapiens
FVSYMTLPG

SEQ ID NO: 923078 - protein, 9 aa, Homo Sapiens
RLNSTSSEE

SEQ ID NO: 923079 - protein, 9 aa, Homo Sapiens
CSTKDKEEK

SEQ ID NO: 923080 - protein, 9 aa, Homo Sapiens
KGNLFCEQQ

SEQ ID NO: 923081 - protein, 9 aa, Homo Sapiens
LDVRAQLEC

SEQ ID NO: 923082 - protein, 9 aa, Homo Sapiens
SSHPFLLNG

SEQ ID NO: 923083 - protein, 9 aa, Homo Sapiens
SLAEVQCHP

SEQ ID NO: 923084 - protein, 9 aa, Homo Sapiens
EKRLRKAIC

SEQ ID NO: 923085 - protein, 9 aa, Homo Sapiens
NLFCEQQRT

SEQ ID NO: 923086 - protein, 9 aa, Homo Sapiens
LPCQVYMNH

SEQ ID NO: 923087 - protein, 9 aa, Homo Sapiens
NKDSDKMMI

SEQ ID NO: 923088 - protein, 9 aa, Homo Sapiens
GTVCKKRVV

SEQ ID NO: 923089 - protein, 9 aa, Homo Sapiens
AHLYLGRSQ

SEQ ID NO: 923090 - protein, 9 aa, Homo Sapiens
NTCPKSDFI

SEQ ID NO: 923091 - protein, 9 aa, Homo Sapiens
AKVELVIGE

SEQ ID NO: 923092 - protein, 9 aa, Homo Sapiens
QQQTLPKHK

SEQ ID NO: 923093 - protein, 9 aa, Homo Sapiens
EPPSAASKG

SEQ ID NO: 923094 - protein, 9 aa, Homo Sapiens
SDIDASSEV

SEQ ID NO: 923095 - protein, 9 aa, Homo Sapiens
GRPAQISLV

SEQ ID NO: 923096 - protein, 9 aa, Homo Sapiens
AATVRLPVG

SEQ ID NO: 923097 - protein, 9 aa, Homo Sapiens
IPSPQASFL

SEQ ID NO: 923098 - protein, 9 aa, Homo Sapiens
RGTWSLEEN

SEQ ID NO: 923099 - protein, 9 aa, Homo Sapiens
NYDIRAALD

SEQ ID NO: 923100 - protein, 9 aa, Homo Sapiens
DEFKLFIKR

SEQ ID NO: 923101 - protein, 9 aa, Homo Sapiens
QCQVYDMGP

SEQ ID NO: 923102 - protein, 9 aa, Homo Sapiens
ENHESRQIT

SEQ ID NO: 923103 - protein, 9 aa, Homo Sapiens
SHRQPETIL

SEQ ID NO: 923104 - protein, 9 aa, Homo Sapiens
IDSSALSSL

SEQ ID NO: 923105 - protein, 9 aa, Homo Sapiens
LPQTKEATN

SEQ ID NO: 923106 - protein, 9 aa, Homo Sapiens
SPTDKIANL

SEQ ID NO: 923107 - protein, 9 aa, Homo Sapiens
YVFFFNNLK

SEQ ID NO: 923108 - protein, 9 aa, Homo Sapiens
NVSFNSESF

SEQ ID NO: 923109 - protein, 9 aa, Homo Sapiens
ALSSLRCLS

SEQ ID NO: 923110 - protein, 9 aa, Homo Sapiens
PDRITLLRE

SEQ ID NO: 923111 - protein, 9 aa, Homo Sapiens
NVLKFIPAS

SEQ ID NO: 923112 - protein, 9 aa, Homo Sapiens
TQAVLSDTK

SEQ ID NO: 923113 - protein, 9 aa, Homo Sapiens
SDESSDESE

SEQ ID NO: 923114 - protein, 9 aa, Homo Sapiens
SVRVKWDAV

SEQ ID NO: 923115 - protein, 9 aa, Homo Sapiens
CKNCTCLNE

SEQ ID NO: 923116 - protein, 9 aa, Homo Sapiens
LLCLSREAR

SEQ ID NO: 923117 - protein, 9 aa, Homo Sapiens
GSCRGSKRG

SEQ ID NO: 923118 - protein, 9 aa, Homo Sapiens
LCPSGSSCS

SEQ ID NO: 923119 - protein, 9 aa, Homo Sapiens
LIRLMYSNP

SEQ ID NO: 923120 - protein, 9 aa, Homo Sapiens
LEEEAIFGA

SEQ ID NO: 923121 - protein, 9 aa, Homo Sapiens
KYAISNAEA

SEQ ID NO: 923122 - protein, 9 aa, Homo Sapiens
SIPSPQASF

SEQ ID NO: 923123 - protein, 9 aa, Homo Sapiens
VRISRRPGA

SEQ ID NO: 923124 - protein, 9 aa, Homo Sapiens
RLPVGGKLN

SEQ ID NO: 923125 - protein, 9 aa, Homo Sapiens
TSLAEAEAG

SEQ ID NO: 923126 - protein, 9 aa, Homo Sapiens
YFPLFQLLI

SEQ ID NO: 923127 - protein, 9 aa, Homo Sapiens
DTQEEIITV

SEQ ID NO: 923128 - protein, 9 aa, Homo Sapiens
RGRPAQISL

SEQ ID NO: 923129 - protein, 9 aa, Homo Sapiens
SFLSTVTIL

SEQ ID NO: 923130 - protein, 9 aa, Homo Sapiens
LSSLRCLSS

SEQ ID NO: 923131 - protein, 9 aa, Homo Sapiens
SNESFSAPS

SEQ ID NO: 923132 - protein, 9 aa, Homo Sapiens
SYMTLPGGS

SEQ ID NO: 923133 - protein, 9 aa, Homo Sapiens
ERLEEEAIF

SEQ ID NO: 923134 - protein, 9 aa, Homo Sapiens
DKEEKKLFG

SEQ ID NO: 923135 - protein, 9 aa, Homo Sapiens
SPETCAFPW

SEQ ID NO: 923136 - protein, 9 aa, Homo Sapiens
LIFCLIQGL

SEQ ID NO: 923137 - protein, 9 aa, Homo Sapiens
STPGLMKRN

SEQ ID NO: 923138 - protein, 9 aa, Homo Sapiens
FIQQEGDDV

SEQ ID NO: 923139 - protein, 9 aa, Homo Sapiens
TNGASRVEH

SEQ ID NO: 923140 - protein, 9 aa, Homo Sapiens
TFIQQEGDD

SEQ ID NO: 923141 - protein, 9 aa, Homo Sapiens
LPTPSSTFQ

SEQ ID NO: 923142 - protein, 9 aa, Homo Sapiens
LLIIYRGDP

SEQ ID NO: 923143 - protein, 9 aa, Homo Sapiens
ITNIIFGER

SEQ ID NO: 923144 - protein, 9 aa, Homo Sapiens
GLSYNGLLG

SEQ ID NO: 923145 - protein, 9 aa, Homo Sapiens
KKFLFYARR

SEQ ID NO: 923146 - protein, 9 aa, Homo Sapiens
MANTSQLKA

SEQ ID NO: 923147 - protein, 9 aa, Homo Sapiens
NYKSSTNGA

SEQ ID NO: 923148 - protein, 9 aa, Homo Sapiens
LGPYFTSEP

SEQ ID NO: 923149 - protein, 9 aa, Homo Sapiens
PPGIRGPPL

SEQ ID NO: 923150 - protein, 9 aa, Homo Sapiens
LKGIGLTLK

SEQ ID NO: 923151 - protein, 9 aa, Homo Sapiens
EPVVQMPAK

SEQ ID NO: 923152 - protein, 9 aa, Homo Sapiens
VWMGLNQLN

SEQ ID NO: 923153 - protein, 9 aa, Homo Sapiens
YETFIQQEG

SEQ ID NO: 923154 - protein, 9 aa, Homo Sapiens
RKKKGSFFI

SEQ ID NO: 923155 - protein, 9 aa, Homo Sapiens
TTDKCINLS

SEQ ID NO: 923156 - protein, 9 aa, Homo Sapiens
SYSYNVQDK

SEQ ID NO: 923157 - protein, 9 aa, Homo Sapiens
VACILIDLC

SEQ ID NO: 923158 - protein, 9 aa, Homo Sapiens
ASYEVLGGA

SEQ ID NO: 923159 - protein, 9 aa, Homo Sapiens
VIAKNRIKK

SEQ ID NO: 923160 - protein, 9 aa, Homo Sapiens
DKIANLVPS

SEQ ID NO: 923161 - protein, 9 aa, Homo Sapiens
CSGQEQGQV

SEQ ID NO: 923162 - protein, 9 aa, Homo Sapiens
GCKYAISNA

SEQ ID NO: 923163 - protein, 9 aa, Homo Sapiens
SRSPETCAF

SEQ ID NO: 923164 - protein, 9 aa, Homo Sapiens
DINSFSQAA

SEQ ID NO: 923165 - protein, 9 aa, Homo Sapiens
RDRAPRDRD

SEQ ID NO: 923166 - protein, 9 aa, Homo Sapiens
KTNEQSLHS

SEQ ID NO: 923167 - protein, 9 aa, Homo Sapiens
KFRDHVGVE

SEQ ID NO: 923168 - protein, 9 aa, Homo Sapiens
HTTNQFGDR

SEQ ID NO: 923169 - protein, 9 aa, Homo Sapiens
LTHTGERSY

SEQ ID NO: 923170 - protein, 9 aa, Homo Sapiens
VLLDVRAQL

SEQ ID NO: 923171 - protein, 9 aa, Homo Sapiens
EEAAHGPRE

SEQ ID NO: 923172 - protein, 9 aa, Homo Sapiens
QVLLDVRAQ

SEQ ID NO: 923173 - protein, 9 aa, Homo Sapiens
TSLLNQTTV

SEQ ID NO: 923174 - protein, 9 aa, Homo Sapiens
GIPGKKGPA

SEQ ID NO: 923175 - protein, 9 aa, Homo Sapiens
LCEAKHIHQ

SEQ ID NO: 923176 - protein, 9 aa, Homo Sapiens
IYRGDPARL

SEQ ID NO: 923177 - protein, 9 aa, Homo Sapiens
KKLQVNISQ

SEQ ID NO: 923178 - protein, 9 aa, Homo Sapiens
IGVENICEF

SEQ ID NO: 923179 - protein, 9 aa, Homo Sapiens
SYLKTCKAP

SEQ ID NO: 923180 - protein, 9 aa, Homo Sapiens
QLECEINTY

SEQ ID NO: 923181 - protein, 9 aa, Homo Sapiens
VDLLSLRSD

SEQ ID NO: 923182 - protein, 9 aa, Homo Sapiens
LSSPISGQP

SEQ ID NO: 923183 - protein, 9 aa, Homo Sapiens
EAEEESLIN

SEQ ID NO: 923184 - protein, 9 aa, Homo Sapiens
CRLESAGGL

SEQ ID NO: 923185 - protein, 9 aa, Homo Sapiens
CILIDLCSD

SEQ ID NO: 923186 - protein, 9 aa, Homo Sapiens
MPAKVELVI

SEQ ID NO: 923187 - protein, 9 aa, Homo Sapiens
TPQSTVPGA

SEQ ID NO: 923188 - protein, 9 aa, Homo Sapiens
DIGCETGKY

SEQ ID NO: 923189 - protein, 9 aa, Homo Sapiens
PKSLPEFSE

SEQ ID NO: 923190 - protein, 9 aa, Homo Sapiens
SRTFPKELQ

SEQ ID NO: 923191 - protein, 9 aa, Homo Sapiens
NESFSAPSL

SEQ ID NO: 923192 - protein, 9 aa, Homo Sapiens
KFLFYARRS

SEQ ID NO: 923193 - protein, 9 aa, Homo Sapiens
EAPVGINLQ

SEQ ID NO: 923194 - protein, 9 aa, Homo Sapiens
NFILLRLTD

SEQ ID NO: 923195 - protein, 9 aa, Homo Sapiens
STTPQGDIN

SEQ ID NO: 923196 - protein, 9 aa, Homo Sapiens
AIIYCNNGF

SEQ ID NO: 923197 - protein, 9 aa, Homo Sapiens
LAVSFVLKS

SEQ ID NO: 923198 - protein, 9 aa, Homo Sapiens
KSFPVETPE

SEQ ID NO: 923199 - protein, 9 aa, Homo Sapiens
FFTNIFIPR

SEQ ID NO: 923200 - protein, 9 aa, Homo Sapiens
TSISCGNGL

SEQ ID NO: 923201 - protein, 9 aa, Homo Sapiens
RAPRDRDRK

SEQ ID NO: 923202 - protein, 9 aa, Homo Sapiens
SDFQCRVPY

SEQ ID NO: 923203 - protein, 9 aa, Homo Sapiens
VFLESAERP

SEQ ID NO: 923204 - protein, 9 aa, Homo Sapiens
LATEKSRWS

SEQ ID NO: 923205 - protein, 9 aa, Homo Sapiens
EAFDCAYRK

SEQ ID NO: 923206 - protein, 9 aa, Homo Sapiens
VVTPALNLL

SEQ ID NO: 923207 - protein, 9 aa, Homo Sapiens
NSTSSEETQ

SEQ ID NO: 923208 - protein, 9 aa, Homo Sapiens
DMQPYMCQQ

SEQ ID NO: 923209 - protein, 9 aa, Homo Sapiens
LKAGEILNR

SEQ ID NO: 923210 - protein, 9 aa, Homo Sapiens
ICLPQTKEA

SEQ ID NO: 923211 - protein, 9 aa, Homo Sapiens
KESGADRAS

SEQ ID NO: 923212 - protein, 9 aa, Homo Sapiens
YIFVIFDFL

SEQ ID NO: 923213 - protein, 9 aa, Homo Sapiens
LENGMEDAG

SEQ ID NO: 923214 - protein, 9 aa, Homo Sapiens
KLVEHLHKF

SEQ ID NO: 923215 - protein, 9 aa, Homo Sapiens
DSSSQVKRE

SEQ ID NO: 923216 - protein, 9 aa, Homo Sapiens
LWGVFSSAY

SEQ ID NO: 923217 - protein, 9 aa, Homo Sapiens
VKDEEYIFV

SEQ ID NO: 923218 - protein, 9 aa, Homo Sapiens
MNEVQKFLG

SEQ ID NO: 923219 - protein, 9 aa, Homo Sapiens
NLKKEISRV

SEQ ID NO: 923220 - protein, 9 aa, Homo Sapiens
QEEGQRQGE

SEQ ID NO: 923221 - protein, 9 aa, Homo Sapiens
KKLVGLAEH

SEQ ID NO: 923222 - protein, 9 aa, Homo Sapiens
GRSPTDKIA

SEQ ID NO: 923223 - protein, 9 aa, Homo Sapiens
EATNIICPC

SEQ ID NO: 923224 - protein, 9 aa, Homo Sapiens
ADTSISCGN

SEQ ID NO: 923225 - protein, 9 aa, Homo Sapiens
ILQEQPYFS

SEQ ID NO: 923226 - protein, 9 aa, Homo Sapiens
SGCRLRDLR

SEQ ID NO: 923227 - protein, 9 aa, Homo Sapiens
KCPNIIHLN

SEQ ID NO: 923228 - protein, 9 aa, Homo Sapiens
TAAINEVAI

SEQ ID NO: 923229 - protein, 9 aa, Homo Sapiens
MILMFAGRK

SEQ ID NO: 923230 - protein, 9 aa, Homo Sapiens
KSIHCMPSE

SEQ ID NO: 923231 - protein, 9 aa, Homo Sapiens
ELGLPPGMA

SEQ ID NO: 923232 - protein, 9 aa, Homo Sapiens
ITFGNVLKF

SEQ ID NO: 923233 - protein, 9 aa, Homo Sapiens
GPFGGGLEN

SEQ ID NO: 923234 - protein, 9 aa, Homo Sapiens
KVAPRVPSI

SEQ ID NO: 923235 - protein, 9 aa, Homo Sapiens
PVILLLLLG

SEQ ID NO: 923236 - protein, 9 aa, Homo Sapiens
IHLANVLHR

SEQ ID NO: 923237 - protein, 9 aa, Homo Sapiens
LYDVTENSV

SEQ ID NO: 923238 - protein, 9 aa, Homo Sapiens
LTMNRVRQP

SEQ ID NO: 923239 - protein, 9 aa, Homo Sapiens
RKAICTLRK

SEQ ID NO: 923240 - protein, 9 aa, Homo Sapiens
LYGDKYDTI

SEQ ID NO: 923241 - protein, 9 aa, Homo Sapiens
LCLLIAGPV

SEQ ID NO: 923242 - protein, 9 aa, Homo Sapiens
LSHRQPETI

SEQ ID NO: 923243 - protein, 9 aa, Homo Sapiens
KQTLQFWKQ

SEQ ID NO: 923244 - protein, 9 aa, Homo Sapiens
SHIRYGAFC

SEQ ID NO: 923245 - protein, 9 aa, Homo Sapiens
GVDLLSLRS

SEQ ID NO: 923246 - protein, 9 aa, Homo Sapiens
NGASRVEHF

SEQ ID NO: 923247 - protein, 9 aa, Homo Sapiens
KEREMLKIE

SEQ ID NO: 923248 - protein, 9 aa, Homo Sapiens
SLAEAEAGI

SEQ ID NO: 923249 - protein, 9 aa, Homo Sapiens
DSEVHSGGL

SEQ ID NO: 923250 - protein, 9 aa, Homo Sapiens
QTLPKHKTN

SEQ ID NO: 923251 - protein, 9 aa, Homo Sapiens
EMKKFLFYA

SEQ ID NO: 923252 - protein, 9 aa, Homo Sapiens
IYKNGFFIH

SEQ ID NO: 923253 - protein, 9 aa, Homo Sapiens
KEMVDWARN

SEQ ID NO: 923254 - protein, 9 aa, Homo Sapiens
QQIIFFLRT

SEQ ID NO: 923255 - protein, 9 aa, Homo Sapiens
YSTLTMNRV

SEQ ID NO: 923256 - protein, 9 aa, Homo Sapiens
SKLPEDGVS

SEQ ID NO: 923257 - protein, 9 aa, Homo Sapiens
SCGNGLFVA

SEQ ID NO: 923258 - protein, 9 aa, Homo Sapiens
PGIRGPPLP

SEQ ID NO: 923259 - protein, 9 aa, Homo Sapiens
KDTQEEIIT

SEQ ID NO: 923260 - protein, 9 aa, Homo Sapiens
VWRATFSQG

SEQ ID NO: 923261 - protein, 9 aa, Homo Sapiens
ASIMVNGFF

SEQ ID NO: 923262 - protein, 9 aa, Homo Sapiens
DFLGNDWGL

SEQ ID NO: 923263 - protein, 9 aa, Homo Sapiens
EGVFLAERG

SEQ ID NO: 923264 - protein, 9 aa, Homo Sapiens
VTKNLEDVP

SEQ ID NO: 923265 - protein, 9 aa, Homo Sapiens
LNEHAGWQW

SEQ ID NO: 923266 - protein, 9 aa, Homo Sapiens
PGFPPPVPS

SEQ ID NO: 923267 - protein, 9 aa, Homo Sapiens
PSAASKGAP

SEQ ID NO: 923268 - protein, 9 aa, Homo Sapiens
ERKKKGSFF

SEQ ID NO: 923269 - protein, 9 aa, Homo Sapiens
QVAYDSLVV

SEQ ID NO: 923270 - protein, 9 aa, Homo Sapiens
HALTLPPNG

SEQ ID NO: 923271 - protein, 9 aa, Homo Sapiens
CEFENKHVK

SEQ ID NO: 923272 - protein, 9 aa, Homo Sapiens
VQMPAKVEL

SEQ ID NO: 923273 - protein, 9 aa, Homo Sapiens
RRKFGPLEW

SEQ ID NO: 923274 - protein, 9 aa, Homo Sapiens
LVFLESAER

SEQ ID NO: 923275 - protein, 9 aa, Homo Sapiens
LGKTNEQSL

SEQ ID NO: 923276 - protein, 9 aa, Homo Sapiens
NLKENREEN

SEQ ID NO: 923277 - protein, 9 aa, Homo Sapiens
IFFTNIFIP

SEQ ID NO: 923278 - protein, 9 aa, Homo Sapiens
EKEARGPNG

SEQ ID NO: 923279 - protein, 9 aa, Homo Sapiens
QWQKKLCEA

SEQ ID NO: 923280 - protein, 9 aa, Homo Sapiens
VDVDMKFRD

SEQ ID NO: 923281 - protein, 9 aa, Homo Sapiens
ASGQTCEPV

SEQ ID NO: 923282 - protein, 9 aa, Homo Sapiens
EEILKTTYF

SEQ ID NO: 923283 - protein, 9 aa, Homo Sapiens
QEEIITVKQ

SEQ ID NO: 923284 - protein, 9 aa, Homo Sapiens
RIWGTVCKK

SEQ ID NO: 923285 - protein, 9 aa, Homo Sapiens
IADIGCETG

SEQ ID NO: 923286 - protein, 9 aa, Homo Sapiens
FCEQQRTLY

SEQ ID NO: 923287 - protein, 9 aa, Homo Sapiens
LSTTSVDSN

SEQ ID NO: 923288 - protein, 9 aa, Homo Sapiens
DVDMKFRDH

SEQ ID NO: 923289 - protein, 9 aa, Homo Sapiens
TRAKKHLIM

SEQ ID NO: 923290 - protein, 9 aa, Homo Sapiens
KGSSPPLLW

SEQ ID NO: 923291 - protein, 9 aa, Homo Sapiens
PQTKEATNI

SEQ ID NO: 923292 - protein, 9 aa, Homo Sapiens
PSGPQASQP

SEQ ID NO: 923293 - protein, 9 aa, Homo Sapiens
FLAERGSFG

SEQ ID NO: 923294 - protein, 9 aa, Homo Sapiens
WYEGSLGAM

SEQ ID NO: 923295 - protein, 9 aa, Homo Sapiens
TPALNLLIY

SEQ ID NO: 923296 - protein, 9 aa, Homo Sapiens
IHCMPSENW

SEQ ID NO: 923297 - protein, 9 aa, Homo Sapiens
QITTFSENH

SEQ ID NO: 923298 - protein, 9 aa, Homo Sapiens
TKKLQVNIS

SEQ ID NO: 923299 - protein, 9 aa, Homo Sapiens
AQAGLACVF

SEQ ID NO: 923300 - protein, 9 aa, Homo Sapiens
EDKLEKLKE

SEQ ID NO: 923301 - protein, 9 aa, Homo Sapiens
LGADGEYHQ

SEQ ID NO: 923302 - protein, 9 aa, Homo Sapiens
SSDADRARK

SEQ ID NO: 923303 - protein, 9 aa, Homo Sapiens
AEAEAGITV

SEQ ID NO: 923304 - protein, 9 aa, Homo Sapiens
QVYMNHGEN

SEQ ID NO: 923305 - protein, 9 aa, Homo Sapiens
INEVAIEKA

SEQ ID NO: 923306 - protein, 9 aa, Homo Sapiens
WSLEENKLI

SEQ ID NO: 923307 - protein, 9 aa, Homo Sapiens
KIANLVPSV

SEQ ID NO: 923308 - protein, 9 aa, Homo Sapiens
PAPLASYEV

SEQ ID NO: 923309 - protein, 9 aa, Homo Sapiens
NVLAFTCEP

SEQ ID NO: 923310 - protein, 9 aa, Homo Sapiens
CTQEQDHFK

SEQ ID NO: 923311 - protein, 9 aa, Homo Sapiens
AIGVWQVRH

SEQ ID NO: 923312 - protein, 9 aa, Homo Sapiens
MIAWLGTRP

SEQ ID NO: 923313 - protein, 9 aa, Homo Sapiens
YPLGKVIEP

SEQ ID NO: 923314 - protein, 9 aa, Homo Sapiens
PLAMGLQLN

SEQ ID NO: 923315 - protein, 9 aa, Homo Sapiens
FVYSKVVFS

SEQ ID NO: 923316 - protein, 9 aa, Homo Sapiens
SPYKQSEIL

SEQ ID NO: 923317 - protein, 9 aa, Homo Sapiens
YDVTENSVR

SEQ ID NO: 923318 - protein, 9 aa, Homo Sapiens
AVLSDTKKI

SEQ ID NO: 923319 - protein, 9 aa, Homo Sapiens
CPKSDFIPE

SEQ ID NO: 923320 - protein, 9 aa, Homo Sapiens
TTFSENHSS

SEQ ID NO: 923321 - protein, 9 aa, Homo Sapiens
FSYDQNEMK

SEQ ID NO: 923322 - protein, 9 aa, Homo Sapiens
LQEKNRRRG

SEQ ID NO: 923323 - protein, 9 aa, Homo Sapiens
AHCSVLPAS

SEQ ID NO: 923324 - protein, 9 aa, Homo Sapiens
DYERLFELI

SEQ ID NO: 923325 - protein, 9 aa, Homo Sapiens
PVLSADSSS

SEQ ID NO: 923326 - protein, 9 aa, Homo Sapiens
RKRLNSTSS

SEQ ID NO: 923327 - protein, 9 aa, Homo Sapiens
QFYQLMNLY

SEQ ID NO: 923328 - protein, 9 aa, Homo Sapiens
SRGASYLKT

SEQ ID NO: 923329 - protein, 9 aa, Homo Sapiens
WRATFSQGA

SEQ ID NO: 923330 - protein, 9 aa, Homo Sapiens
EEKSVRHPK

SEQ ID NO: 923331 - protein, 9 aa, Homo Sapiens
QIKGNLFCE

SEQ ID NO: 923332 - protein, 9 aa, Homo Sapiens
LLIYTLRNT

SEQ ID NO: 923333 - protein, 9 aa, Homo Sapiens
QGNGQSQGS

SEQ ID NO: 923334 - protein, 9 aa, Homo Sapiens
GSRKLQSLK

SEQ ID NO: 923335 - protein, 9 aa, Homo Sapiens
PWEDCSVLC

SEQ ID NO: 923336 - protein, 9 aa, Homo Sapiens
MKGEKEARG

SEQ ID NO: 923337 - protein, 9 aa, Homo Sapiens
RSPTDKIAN

SEQ ID NO: 923338 - protein, 9 aa, Homo Sapiens
DPATVMNEV

SEQ ID NO: 923339 - protein, 9 aa, Homo Sapiens
GNVLKFIPA

SEQ ID NO: 923340 - protein, 9 aa, Homo Sapiens
KAKMSNFPW

SEQ ID NO: 923341 - protein, 9 aa, Homo Sapiens
LHSGACRAL

SEQ ID NO: 923342 - protein, 9 aa, Homo Sapiens
LQSLKTSDV

SEQ ID NO: 923343 - protein, 9 aa, Homo Sapiens
IFFDELEAV

SEQ ID NO: 923344 - protein, 9 aa, Homo Sapiens
ENPTKKTKS

SEQ ID NO: 923345 - protein, 9 aa, Homo Sapiens
SEKVLPPLT

SEQ ID NO: 923346 - protein, 9 aa, Homo Sapiens
FEAKAEKCE

SEQ ID NO: 923347 - protein, 9 aa, Homo Sapiens
PEGPPPQGE

SEQ ID NO: 923348 - protein, 9 aa, Homo Sapiens
TERKKKGSF

SEQ ID NO: 923349 - protein, 9 aa, Homo Sapiens
VVVSPILEQ

SEQ ID NO: 923350 - protein, 9 aa, Homo Sapiens
TAKAGYPPS

SEQ ID NO: 923351 - protein, 9 aa, Homo Sapiens
SVSSDLGPY

SEQ ID NO: 923352 - protein, 9 aa, Homo Sapiens
TGTPQSTVP

SEQ ID NO: 923353 - protein, 9 aa, Homo Sapiens
NDWGLQGNR

SEQ ID NO: 923354 - protein, 9 aa, Homo Sapiens
LRQWQKKLC

SEQ ID NO: 923355 - protein, 9 aa, Homo Sapiens
PRARQPGPS

SEQ ID NO: 923356 - protein, 9 aa, Homo Sapiens
LNETSAEMK

SEQ ID NO: 923357 - protein, 9 aa, Homo Sapiens
MNLYQLKSP

SEQ ID NO: 923358 - protein, 9 aa, Homo Sapiens
TFGFEAKAE

SEQ ID NO: 923359 - protein, 9 aa, Homo Sapiens
DGASEYVYY

SEQ ID NO: 923360 - protein, 9 aa, Homo Sapiens
VGINLQQMP

SEQ ID NO: 923361 - protein, 9 aa, Homo Sapiens
LRENHESRQ

SEQ ID NO: 923362 - protein, 9 aa, Homo Sapiens
LASYEVLGG

SEQ ID NO: 923363 - protein, 9 aa, Homo Sapiens
NLSEGVFLA

SEQ ID NO: 923364 - protein, 9 aa, Homo Sapiens
NMVIFCNVV

SEQ ID NO: 923365 - protein, 9 aa, Homo Sapiens
ADKQLSFEV

SEQ ID NO: 923366 - protein, 9 aa, Homo Sapiens
LSWRQGLMG

SEQ ID NO: 923367 - protein, 9 aa, Homo Sapiens
PQASFLPLQ

SEQ ID NO: 923368 - protein, 9 aa, Homo Sapiens
VDMKFRDHV

SEQ ID NO: 923369 - protein, 9 aa, Homo Sapiens
LRHLMQECF

SEQ ID NO: 923370 - protein, 9 aa, Homo Sapiens
NGLYRVRIS

SEQ ID NO: 923371 - protein, 9 aa, Homo Sapiens
NTAAPQVLQ

SEQ ID NO: 923372 - protein, 9 aa, Homo Sapiens
LRPSALLFV

SEQ ID NO: 923373 - protein, 9 aa, Homo Sapiens
APQVLQSYH

SEQ ID NO: 923374 - protein, 9 aa, Homo Sapiens
MCQKLIQPS

SEQ ID NO: 923375 - protein, 9 aa, Homo Sapiens
EQSLHSQIH

SEQ ID NO: 923376 - protein, 9 aa, Homo Sapiens
ETFIQQEGD

SEQ ID NO: 923377 - protein, 9 aa, Homo Sapiens
FLMPHVPFK

SEQ ID NO: 923378 - protein, 9 aa, Homo Sapiens
DVRSDFQCR

SEQ ID NO: 923379 - protein, 9 aa, Homo Sapiens
KFGPLEWNI

SEQ ID NO: 923380 - protein, 9 aa, Homo Sapiens
VRGRPAQIS

SEQ ID NO: 923381 - protein, 9 aa, Homo Sapiens
LQENPTKKT

SEQ ID NO: 923382 - protein, 9 aa, Homo Sapiens
AGEILNRFS

SEQ ID NO: 923383 - protein, 9 aa, Homo Sapiens
TCAFPWKAE

SEQ ID NO: 923384 - protein, 9 aa, Homo Sapiens
HGPRELKGE

SEQ ID NO: 923385 - protein, 9 aa, Homo Sapiens
VEGPSRGAS

SEQ ID NO: 923386 - protein, 9 aa, Homo Sapiens
RSDPATVMN

SEQ ID NO: 923387 - protein, 9 aa, Homo Sapiens
GPWEDCSVL

SEQ ID NO: 923388 - protein, 9 aa, Homo Sapiens
LMCQKLIQP

SEQ ID NO: 923389 - protein, 9 aa, Homo Sapiens
VPRQTPNGN

SEQ ID NO: 923390 - protein, 9 aa, Homo Sapiens
TNEQSLHSQ

SEQ ID NO: 923391 - protein, 9 aa, Homo Sapiens
DKCINLSAS

SEQ ID NO: 923392 - protein, 9 aa, Homo Sapiens
IYFVYSKVV

SEQ ID NO: 923393 - protein, 9 aa, Homo Sapiens
LYGEDEAAD

SEQ ID NO: 923394 - protein, 9 aa, Homo Sapiens
KKIFPSAMS

SEQ ID NO: 923395 - protein, 9 aa, Homo Sapiens
KRNAYWKEK

SEQ ID NO: 923396 - protein, 9 aa, Homo Sapiens
EEAEEESLI

SEQ ID NO: 923397 - protein, 9 aa, Homo Sapiens
SLGAMLRCV

SEQ ID NO: 923398 - protein, 9 aa, Homo Sapiens
SIHCMPSEN

SEQ ID NO: 923399 - protein, 9 aa, Homo Sapiens
PPFVSYMTL

SEQ ID NO: 923400 - protein, 9 aa, Homo Sapiens
ISCGNGLFV

SEQ ID NO: 923401 - protein, 9 aa, Homo Sapiens
VIVRVHNSC

SEQ ID NO: 923402 - protein, 9 aa, Homo Sapiens
WQKKLCEAK

SEQ ID NO: 923403 - protein, 9 aa, Homo Sapiens
SGGLSTISL

SEQ ID NO: 923404 - protein, 9 aa, Homo Sapiens
SSVDDPKDP

SEQ ID NO: 923405 - protein, 9 aa, Homo Sapiens
CKRQTNVRR

SEQ ID NO: 923406 - protein, 9 aa, Homo Sapiens
NMKKQRFLT

SEQ ID NO: 923407 - protein, 9 aa, Homo Sapiens
STVPGATTT

SEQ ID NO: 923408 - protein, 9 aa, Homo Sapiens
QEGDDVQQL

SEQ ID NO: 923409 - protein, 9 aa, Homo Sapiens
TFTPSETPA

SEQ ID NO: 923410 - protein, 9 aa, Homo Sapiens
YQCLSPLKS

SEQ ID NO: 923411 - protein, 9 aa, Homo Sapiens
LDMQPYMCQ

SEQ ID NO: 923412 - protein, 9 aa, Homo Sapiens
YRGDPARLV

SEQ ID NO: 923413 - protein, 9 aa, Homo Sapiens
IGHKVAPRV

SEQ ID NO: 923414 - protein, 9 aa, Homo Sapiens
IFCLIQGLV

SEQ ID NO: 923415 - protein, 9 aa, Homo Sapiens
KLTQPKLVV

SEQ ID NO: 923416 - protein, 9 aa, Homo Sapiens
QFIIFSALS

SEQ ID NO: 923417 - protein, 9 aa, Homo Sapiens
INSFSQAAA

SEQ ID NO: 923418 - protein, 9 aa, Homo Sapiens
EATQFIIFS

SEQ ID NO: 923419 - protein, 9 aa, Homo Sapiens
SRSITCLQN

SEQ ID NO: 923420 - protein, 9 aa, Homo Sapiens
ASYLKTCKA

SEQ ID NO: 923421 - protein, 9 aa, Homo Sapiens
FFCAQSFFK

SEQ ID NO: 923422 - protein, 9 aa, Homo Sapiens
GRSVLMLPN

SEQ ID NO: 923423 - protein, 9 aa, Homo Sapiens
LSADSSSPA

SEQ ID NO: 923424 - protein, 9 aa, Homo Sapiens
CAQSFFKNF

SEQ ID NO: 923425 - protein, 9 aa, Homo Sapiens
FPPPVPSGT

SEQ ID NO: 923426 - protein, 9 aa, Homo Sapiens
KGGSRVLFS

SEQ ID NO: 923427 - protein, 9 aa, Homo Sapiens
LAQAGLACV

SEQ ID NO: 923428 - protein, 9 aa, Homo Sapiens
ITERKKKGS

SEQ ID NO: 923429 - protein, 9 aa, Homo Sapiens
CWVLLCLLI

SEQ ID NO: 923430 - protein, 9 aa, Homo Sapiens
YISNKAIPE

SEQ ID NO: 923431 - protein, 9 aa, Homo Sapiens
VLPEHGAAL

SEQ ID NO: 923432 - protein, 9 aa, Homo Sapiens
RAHLKEPPS

SEQ ID NO: 923433 - protein, 9 aa, Homo Sapiens
ITDKDTQEE

SEQ ID NO: 923434 - protein, 9 aa, Homo Sapiens
TVANFILLR

SEQ ID NO: 923435 - protein, 9 aa, Homo Sapiens
AFPWKAESR

SEQ ID NO: 923436 - protein, 9 aa, Homo Sapiens
TNVRRALTE

SEQ ID NO: 923437 - protein, 9 aa, Homo Sapiens
NLQITTFSE

SEQ ID NO: 923438 - protein, 9 aa, Homo Sapiens
KKASTAFEQ

SEQ ID NO: 923439 - protein, 9 aa, Homo Sapiens
FVYSKLPED

SEQ ID NO: 923440 - protein, 9 aa, Homo Sapiens
FFIMIYILC

SEQ ID NO: 923441 - protein, 9 aa, Homo Sapiens
KSSTNGASR

SEQ ID NO: 923442 - protein, 9 aa, Homo Sapiens
VIFCNVVDG

SEQ ID NO: 923443 - protein, 9 aa, Homo Sapiens
CRVPYNYLQ

SEQ ID NO: 923444 - protein, 9 aa, Homo Sapiens
LEDVPGDQV

SEQ ID NO: 923445 - protein, 9 aa, Homo Sapiens
VVELYDSNA

SEQ ID NO: 923446 - protein, 9 aa, Homo Sapiens
KTVKVVEDE

SEQ ID NO: 923447 - protein, 9 aa, Homo Sapiens
YDMGPETDP

SEQ ID NO: 923448 - protein, 9 aa, Homo Sapiens
ITKSDGNRE

SEQ ID NO: 923449 - protein, 9 aa, Homo Sapiens
FNKDSDKMM

SEQ ID NO: 923450 - protein, 9 aa, Homo Sapiens
EQKARRLDS

SEQ ID NO: 923451 - protein, 9 aa, Homo Sapiens
QQQQTLPKH

SEQ ID NO: 923452 - protein, 9 aa, Homo Sapiens
QDLHSGACR

SEQ ID NO: 923453 - protein, 9 aa, Homo Sapiens
WVLLCLLIA

SEQ ID NO: 923454 - protein, 9 aa, Homo Sapiens
KEEKKLFGF

SEQ ID NO: 923455 - protein, 9 aa, Homo Sapiens
YFVYSKGSS

SEQ ID NO: 923456 - protein, 9 aa, Homo Sapiens
MLAVLPEHG

SEQ ID NO: 923457 - protein, 9 aa, Homo Sapiens
WGVFSSAYQ

SEQ ID NO: 923458 - protein, 9 aa, Homo Sapiens
CKYAISNAE

SEQ ID NO: 923459 - protein, 9 aa, Homo Sapiens
LEQGKKAST

SEQ ID NO: 923460 - protein, 9 aa, Homo Sapiens
WNMKKQRFL

SEQ ID NO: 923461 - protein, 9 aa, Homo Sapiens
SHFGRMMFV

SEQ ID NO: 923462 - protein, 9 aa, Homo Sapiens
YSKGSSPPL

SEQ ID NO: 923463 - protein, 9 aa, Homo Sapiens
AQSFFKNFG

SEQ ID NO: 923464 - protein, 9 aa, Homo Sapiens
AEAPVGINL

SEQ ID NO: 923465 - protein, 9 aa, Homo Sapiens
VYSKLPEDG

SEQ ID NO: 923466 - protein, 9 aa, Homo Sapiens
KLEKLKELT

SEQ ID NO: 923467 - protein, 9 aa, Homo Sapiens
LSTVTILSQ

SEQ ID NO: 923468 - protein, 9 aa, Homo Sapiens
ELKIQNSCS

SEQ ID NO: 923469 - protein, 9 aa, Homo Sapiens
LLVFEVLVC

SEQ ID NO: 923470 - protein, 9 aa, Homo Sapiens
LSSVDDPKD

SEQ ID NO: 923471 - protein, 9 aa, Homo Sapiens
GADGEYHQP

SEQ ID NO: 923472 - protein, 9 aa, Homo Sapiens
MEGPFGGGL

SEQ ID NO: 923473 - protein, 9 aa, Homo Sapiens
GMKGEKEAR

SEQ ID NO: 923474 - protein, 9 aa, Homo Sapiens
QSLHSQIHH

SEQ ID NO: 923475 - protein, 9 aa, Homo Sapiens
SDRLENGME

SEQ ID NO: 923476 - protein, 9 aa, Homo Sapiens
VLQSYHLAA

SEQ ID NO: 923477 - protein, 9 aa, Homo Sapiens
WLGTRPPHS

SEQ ID NO: 923478 - protein, 9 aa, Homo Sapiens
LLIDQVVQT

SEQ ID NO: 923479 - protein, 9 aa, Homo Sapiens
YTWMLIFCL

SEQ ID NO: 923480 - protein, 9 aa, Homo Sapiens
LPGMRPPRP

SEQ ID NO: 923481 - protein, 9 aa, Homo Sapiens
VAVDLEQGK

SEQ ID NO: 923482 - protein, 9 aa, Homo Sapiens
NIFFDELEA

SEQ ID NO: 923483 - protein, 9 aa, Homo Sapiens
VSISLSFIA

SEQ ID NO: 923484 - protein, 9 aa, Homo Sapiens
GDKYDTIKQ

SEQ ID NO: 923485 - protein, 9 aa, Homo Sapiens
PAPAPLASY

SEQ ID NO: 923486 - protein, 9 aa, Homo Sapiens
VLKFIPASF

SEQ ID NO: 923487 - protein, 9 aa, Homo Sapiens
NALAQKRNA

SEQ ID NO: 923488 - protein, 9 aa, Homo Sapiens
KVVFSGKAY

SEQ ID NO: 923489 - protein, 9 aa, Homo Sapiens
ESAGGLGST

SEQ ID NO: 923490 - protein, 9 aa, Homo Sapiens
PGGIRETRS

SEQ ID NO: 923491 - protein, 9 aa, Homo Sapiens
GLTLKQTLQ

SEQ ID NO: 923492 - protein, 9 aa, Homo Sapiens
LATWLVPSV

SEQ ID NO: 923493 - protein, 9 aa, Homo Sapiens
MGLQLNFCD

SEQ ID NO: 923494 - protein, 9 aa, Homo Sapiens
RLSNESFSA

SEQ ID NO: 923495 - protein, 9 aa, Homo Sapiens
VAYDSLVVG

SEQ ID NO: 923496 - protein, 9 aa, Homo Sapiens
GLMKRNKRE

SEQ ID NO: 923497 - protein, 9 aa, Homo Sapiens
KNQLSPYKQ

SEQ ID NO: 923498 - protein, 9 aa, Homo Sapiens
RGHYRVACI

SEQ ID NO: 923499 - protein, 9 aa, Homo Sapiens
DTSISCGNG

SEQ ID NO: 923500 - protein, 9 aa, Homo Sapiens
LNGFPGLEE

SEQ ID NO: 923501 - protein, 9 aa, Homo Sapiens
CAGSCNCKK

SEQ ID NO: 923502 - protein, 9 aa, Homo Sapiens
IKSQIDTYC

SEQ ID NO: 923503 - protein, 9 aa, Homo Sapiens
RNMVIFCNV

SEQ ID NO: 923504 - protein, 9 aa, Homo Sapiens
FSQGASGNE

SEQ ID NO: 923505 - protein, 9 aa, Homo Sapiens
YPGWNMKKQ

SEQ ID NO: 923506 - protein, 9 aa, Homo Sapiens
FSKLTSSWP

SEQ ID NO: 923507 - protein, 9 aa, Homo Sapiens
FIIFSALSD

SEQ ID NO: 923508 - protein, 9 aa, Homo Sapiens
KGFKMDRQG

SEQ ID NO: 923509 - protein, 9 aa, Homo Sapiens
KPRENKNVL

SEQ ID NO: 923510 - protein, 9 aa, Homo Sapiens
LSREARKKK

SEQ ID NO: 923511 - protein, 9 aa, Homo Sapiens
SGESAPSDI

SEQ ID NO: 923512 - protein, 9 aa, Homo Sapiens
VAVTRAKKH

SEQ ID NO: 923513 - protein, 9 aa, Homo Sapiens
AGKTAKAGY

SEQ ID NO: 923514 - protein, 9 aa, Homo Sapiens
NSVLLQAFD

SEQ ID NO: 923515 - protein, 9 aa, Homo Sapiens
PPVPSGTPM

SEQ ID NO: 923516 - protein, 9 aa, Homo Sapiens
RLRKAICTL

SEQ ID NO: 923517 - protein, 9 aa, Homo Sapiens
NIPLHQARS

SEQ ID NO: 923518 - protein, 9 aa, Homo Sapiens
GHQGNGQSQ

SEQ ID NO: 923519 - protein, 9 aa, Homo Sapiens
PPFFHALTL

SEQ ID NO: 923520 - protein, 9 aa, Homo Sapiens
QKAIFLRHL

SEQ ID NO: 923521 - protein, 9 aa, Homo Sapiens
LNQLNEHAG

SEQ ID NO: 923522 - protein, 9 aa, Homo Sapiens
VVHLGVGTS

SEQ ID NO: 923523 - protein, 9 aa, Homo Sapiens
LMYSNPPLN

SEQ ID NO: 923524 - protein, 9 aa, Homo Sapiens
ISLSFIATC

SEQ ID NO: 923525 - protein, 9 aa, Homo Sapiens
TTVQIRKLT

SEQ ID NO: 923526 - protein, 9 aa, Homo Sapiens
ADTSVGWSR

SEQ ID NO: 923527 - protein, 9 aa, Homo Sapiens
SGQEQGQVC

SEQ ID NO: 923528 - protein, 9 aa, Homo Sapiens
TCPKSDFIP

SEQ ID NO: 923529 - protein, 9 aa, Homo Sapiens
LLVPRQTPN

SEQ ID NO: 923530 - protein, 9 aa, Homo Sapiens
RVACILIDL

SEQ ID NO: 923531 - protein, 9 aa, Homo Sapiens
QPFPGDSYS

SEQ ID NO: 923532 - protein, 9 aa, Homo Sapiens
MITKFYFQE

SEQ ID NO: 923533 - protein, 9 aa, Homo Sapiens
GPETDPQSM

SEQ ID NO: 923534 - protein, 9 aa, Homo Sapiens
LEKLKELTM

SEQ ID NO: 923535 - protein, 9 aa, Homo Sapiens
KLVGLAEHA

SEQ ID NO: 923536 - protein, 9 aa, Homo Sapiens
EAAHGPREL

SEQ ID NO: 923537 - protein, 9 aa, Homo Sapiens
KKKGSFFIS

SEQ ID NO: 923538 - protein, 9 aa, Homo Sapiens
KPHYPWAYE

SEQ ID NO: 923539 - protein, 9 aa, Homo Sapiens
LPQDLFQKL

SEQ ID NO: 923540 - protein, 9 aa, Homo Sapiens
TGERSYRCG

SEQ ID NO: 923541 - protein, 9 aa, Homo Sapiens
EEIGVENIC

SEQ ID NO: 923542 - protein, 9 aa, Homo Sapiens
VYMNHGENL

SEQ ID NO: 923543 - protein, 9 aa, Homo Sapiens
LASAGESIG

SEQ ID NO: 923544 - protein, 9 aa, Homo Sapiens
PSYMFWNCN

SEQ ID NO: 923545 - protein, 9 aa, Homo Sapiens
STSEEKSVR

SEQ ID NO: 923546 - protein, 9 aa, Homo Sapiens
RARQPGPSP

SEQ ID NO: 923547 - protein, 9 aa, Homo Sapiens
EAGKTAKAG

SEQ ID NO: 923548 - protein, 9 aa, Homo Sapiens
LKEPPSAAS

SEQ ID NO: 923549 - protein, 9 aa, Homo Sapiens
PVGINLQQM

SEQ ID NO: 923550 - protein, 9 aa, Homo Sapiens
MPDEGVMIT

SEQ ID NO: 923551 - protein, 9 aa, Homo Sapiens
MKIREDENQ

SEQ ID NO: 923552 - protein, 9 aa, Homo Sapiens
SDEFKLFIK

SEQ ID NO: 923553 - protein, 9 aa, Homo Sapiens
RWLVYFPLF

SEQ ID NO: 923554 - protein, 9 aa, Homo Sapiens
VGYVFFFNN

SEQ ID NO: 923555 - protein, 9 aa, Homo Sapiens
AWNVLPQDL

SEQ ID NO: 923556 - protein, 9 aa, Homo Sapiens
RVHNSCSDS

SEQ ID NO: 923557 - protein, 9 aa, Homo Sapiens
AEVQCHPDK

SEQ ID NO: 923558 - protein, 9 aa, Homo Sapiens
PLPGMRPPR

SEQ ID NO: 923559 - protein, 9 aa, Homo Sapiens
RVLFSCHLS

SEQ ID NO: 923560 - protein, 9 aa, Homo Sapiens
VLLQAFDRF

SEQ ID NO: 923561 - protein, 9 aa, Homo Sapiens
EENKLIGKF

SEQ ID NO: 923562 - protein, 9 aa, Homo Sapiens
DVSKKLVGL

SEQ ID NO: 923563 - protein, 9 aa, Homo Sapiens
GPPLPGMRP

SEQ ID NO: 923564 - protein, 9 aa, Homo Sapiens
LEIFFTNIF

SEQ ID NO: 923565 - protein, 9 aa, Homo Sapiens
DSKMADTSV

SEQ ID NO: 923566 - protein, 9 aa, Homo Sapiens
QQKLQENPT

SEQ ID NO: 923567 - protein, 9 aa, Homo Sapiens
VRAQLECEI

SEQ ID NO: 923568 - protein, 9 aa, Homo Sapiens
RSFRLYTQE

SEQ ID NO: 923569 - protein, 9 aa, Homo Sapiens
SAGESIGKK

SEQ ID NO: 923570 - protein, 9 aa, Homo Sapiens
DEGVMITKF

SEQ ID NO: 923571 - protein, 9 aa, Homo Sapiens
CFRKIGGED

SEQ ID NO: 923572 - protein, 9 aa, Homo Sapiens
AQYSGGLST

SEQ ID NO: 923573 - protein, 9 aa, Homo Sapiens
IAENEAFDL

SEQ ID NO: 923574 - protein, 9 aa, Homo Sapiens
VSSDLGPYF

SEQ ID NO: 923575 - protein, 9 aa, Homo Sapiens
FAFESITNI

SEQ ID NO: 923576 - protein, 9 aa, Homo Sapiens
KGRKEMVDW

SEQ ID NO: 923577 - protein, 9 aa, Homo Sapiens
TPGLMKRNK

SEQ ID NO: 923578 - protein, 9 aa, Homo Sapiens
MCALLIILT

SEQ ID NO: 923579 - protein, 9 aa, Homo Sapiens
KIREDENQN

SEQ ID NO: 923580 - protein, 9 aa, Homo Sapiens
ALNLLIYTL

SEQ ID NO: 923581 - protein, 9 aa, Homo Sapiens
GHQPPFFHA

SEQ ID NO: 923582 - protein, 9 aa, Homo Sapiens
LIQPSELHP

SEQ ID NO: 923583 - protein, 9 aa, Homo Sapiens
FGGGLENMG

SEQ ID NO: 923584 - protein, 9 aa, Homo Sapiens
KAGEILNRF

SEQ ID NO: 923585 - protein, 9 aa, Homo Sapiens
CSVLCGGGE

SEQ ID NO: 923586 - protein, 9 aa, Homo Sapiens
VVEDEATKG

SEQ ID NO: 923587 - protein, 9 aa, Homo Sapiens
QCHPDKEGA

SEQ ID NO: 923588 - protein, 9 aa, Homo Sapiens
CKKRVVVLL

SEQ ID NO: 923589 - protein, 9 aa, Homo Sapiens
GPPFVSYMT

SEQ ID NO: 923590 - protein, 9 aa, Homo Sapiens
QVLQSYHLA

SEQ ID NO: 923591 - protein, 9 aa, Homo Sapiens
TILTETPQD

SEQ ID NO: 923592 - protein, 9 aa, Homo Sapiens
TSLLKTVKV

SEQ ID NO: 923593 - protein, 9 aa, Homo Sapiens
FTPSETPAS

SEQ ID NO: 923594 - protein, 9 aa, Homo Sapiens
MQPYMCQQN

SEQ ID NO: 923595 - protein, 9 aa, Homo Sapiens
VNGVDLLSL

SEQ ID NO: 923596 - protein, 9 aa, Homo Sapiens
IIHIREKPH

SEQ ID NO: 923597 - protein, 9 aa, Homo Sapiens
RSITCLQNG

SEQ ID NO: 923598 - protein, 9 aa, Homo Sapiens
SAEMKIRED

SEQ ID NO: 923599 - protein, 9 aa, Homo Sapiens
TVLRISSAA

SEQ ID NO: 923600 - protein, 9 aa, Homo Sapiens
ENWSPSAPR

SEQ ID NO: 923601 - protein, 9 aa, Homo Sapiens
FNIQQNNAP

SEQ ID NO: 923602 - protein, 9 aa, Homo Sapiens
LKTKKLQVN

SEQ ID NO: 923603 - protein, 9 aa, Homo Sapiens
GEAWYEGSL

SEQ ID NO: 923604 - protein, 9 aa, Homo Sapiens
LSPLKSFPV

SEQ ID NO: 923605 - protein, 9 aa, Homo Sapiens
RKLQSLKTS

SEQ ID NO: 923606 - protein, 9 aa, Homo Sapiens
FYFNKDSDK

SEQ ID NO: 923607 - protein, 9 aa, Homo Sapiens
RTFPKELQD

SEQ ID NO: 923608 - protein, 9 aa, Homo Sapiens
AVSFVLKSR

SEQ ID NO: 923609 - protein, 9 aa, Homo Sapiens
VSSLALVFL

SEQ ID NO: 923610 - protein, 9 aa, Homo Sapiens
LLNGFPGLE

SEQ ID NO: 923611 - protein, 9 aa, Homo Sapiens
PVLLLCLSR

SEQ ID NO: 923612 - protein, 9 aa, Homo Sapiens
LYPGWNMKK

SEQ ID NO: 923613 - protein, 9 aa, Homo Sapiens
WEDCSVLCG

SEQ ID NO: 923614 - protein, 9 aa, Homo Sapiens
QASQPPPPR

SEQ ID NO: 923615 - protein, 9 aa, Homo Sapiens
FPGKTGPRG

SEQ ID NO: 923616 - protein, 9 aa, Homo Sapiens
QYRNIGTAK

SEQ ID NO: 923617 - protein, 9 aa, Homo Sapiens
IKLYGDKYD

SEQ ID NO: 923618 - protein, 9 aa, Homo Sapiens
NGFFNDGRW

SEQ ID NO: 923619 - protein, 9 aa, Homo Sapiens
HYRVACILI

SEQ ID NO: 923620 - protein, 9 aa, Homo Sapiens
PPSAASKGA

SEQ ID NO: 923621 - protein, 9 aa, Homo Sapiens
RNLKKEISR

SEQ ID NO: 923622 - protein, 9 aa, Homo Sapiens
QSSERGRLP

SEQ ID NO: 923623 - protein, 9 aa, Homo Sapiens
RKLIFGGRV

SEQ ID NO: 923624 - protein, 9 aa, Homo Sapiens
VLFSCHLSK

SEQ ID NO: 923625 - protein, 9 aa, Homo Sapiens
VAIGVWQVR

SEQ ID NO: 923626 - protein, 9 aa, Homo Sapiens
ITVRGRPAQ

SEQ ID NO: 923627 - protein, 9 aa, Homo Sapiens
QRSLLYGED

SEQ ID NO: 923628 - protein, 9 aa, Homo Sapiens
SVLESDRLE

SEQ ID NO: 923629 - protein, 9 aa, Homo Sapiens
RSQDLHSGA

SEQ ID NO: 923630 - protein, 9 aa, Homo Sapiens
QTKEATNII

SEQ ID NO: 923631 - protein, 9 aa, Homo Sapiens
KLKELTMDG

SEQ ID NO: 923632 - protein, 9 aa, Homo Sapiens
TLKQTLQFW

SEQ ID NO: 923633 - protein, 9 aa, Homo Sapiens
ISLPQLNQV

SEQ ID NO: 923634 - protein, 9 aa, Homo Sapiens
EKELGLPPG

SEQ ID NO: 923635 - protein, 9 aa, Homo Sapiens
SDLGPYFTS

SEQ ID NO: 923636 - protein, 9 aa, Homo Sapiens
QFSYDQNEM

SEQ ID NO: 923637 - protein, 9 aa, Homo Sapiens
QASITERKK

SEQ ID NO: 923638 - protein, 9 aa, Homo Sapiens
MEGCKYAIS

SEQ ID NO: 923639 - protein, 9 aa, Homo Sapiens
EMVDWARNS

SEQ ID NO: 923640 - protein, 9 aa, Homo Sapiens
KDLRPSALL

SEQ ID NO: 923641 - protein, 9 aa, Homo Sapiens
CLIQGLVSK

SEQ ID NO: 923642 - protein, 9 aa, Homo Sapiens
KNRIKKTDT

SEQ ID NO: 923643 - protein, 9 aa, Homo Sapiens
EMLKIEEWT

SEQ ID NO: 923644 - protein, 9 aa, Homo Sapiens
AQDSSSQVK

SEQ ID NO: 923645 - protein, 9 aa, Homo Sapiens
ENKNVLAFT

SEQ ID NO: 923646 - protein, 9 aa, Homo Sapiens
CVDVDMKFR

SEQ ID NO: 923647 - protein, 9 aa, Homo Sapiens
EDLNWVKKK

SEQ ID NO: 923648 - protein, 9 aa, Homo Sapiens
EGDDVQQLC

SEQ ID NO: 923649 - protein, 9 aa, Homo Sapiens
KLQRYLAVH

SEQ ID NO: 923650 - protein, 9 aa, Homo Sapiens
HLIMTKSLE

SEQ ID NO: 923651 - protein, 9 aa, Homo Sapiens
CRFYFNKDS

SEQ ID NO: 923652 - protein, 9 aa, Homo Sapiens
TCLNETIQC

SEQ ID NO: 923653 - protein, 9 aa, Homo Sapiens
LLGVFLVIL

SEQ ID NO: 923654 - protein, 9 aa, Homo Sapiens
GFQKKPEAE

SEQ ID NO: 923655 - protein, 9 aa, Homo Sapiens
KLQENPTKK

SEQ ID NO: 923656 - protein, 9 aa, Homo Sapiens
AQSEAFDCA

SEQ ID NO: 923657 - protein, 9 aa, Homo Sapiens
TKNYDIRAA

SEQ ID NO: 923658 - protein, 9 aa, Homo Sapiens
SSCSGDCPH

SEQ ID NO: 923659 - protein, 9 aa, Homo Sapiens
SSKLTQPKL

SEQ ID NO: 923660 - protein, 9 aa, Homo Sapiens
APRVPSIFR

SEQ ID NO: 923661 - protein, 9 aa, Homo Sapiens
CQSEVSFSC

SEQ ID NO: 923662 - protein, 9 aa, Homo Sapiens
SDPATVMNE

SEQ ID NO: 923663 - protein, 9 aa, Homo Sapiens
VASIMVNGF

SEQ ID NO: 923664 - protein, 9 aa, Homo Sapiens
MVSQGEANF

SEQ ID NO: 923665 - protein, 9 aa, Homo Sapiens
SPILEQDSE

SEQ ID NO: 923666 - protein, 9 aa, Homo Sapiens
IWGTVCKKR

SEQ ID NO: 923667 - protein, 9 aa, Homo Sapiens
ESIGKKEVA

SEQ ID NO: 923668 - protein, 9 aa, Homo Sapiens
DLEQGKKAS

SEQ ID NO: 923669 - protein, 9 aa, Homo Sapiens
REQLNQNLI

SEQ ID NO: 923670 - protein, 9 aa, Homo Sapiens
KKLNGTIVE

SEQ ID NO: 923671 - protein, 9 aa, Homo Sapiens
SNKAIPEKY

SEQ ID NO: 923672 - protein, 9 aa, Homo Sapiens
VVKYPLGKV

SEQ ID NO: 923673 - protein, 9 aa, Homo Sapiens
EYSAKGPIT

SEQ ID NO: 923674 - protein, 9 aa, Homo Sapiens
VLQRSRTFP

SEQ ID NO: 923675 - protein, 9 aa, Homo Sapiens
LEWNIPYEF

SEQ ID NO: 923676 - protein, 9 aa, Homo Sapiens
ASITERKKK

SEQ ID NO: 923677 - protein, 9 aa, Homo Sapiens
YMTLPGGSC

SEQ ID NO: 923678 - protein, 9 aa, Homo Sapiens
SDFIPESHF

SEQ ID NO: 923679 - protein, 9 aa, Homo Sapiens
QPACSLQSP

SEQ ID NO: 923680 - protein, 9 aa, Homo Sapiens
NQTTVQIRK

SEQ ID NO: 923681 - protein, 9 aa, Homo Sapiens
PDDKIYECD

SEQ ID NO: 923682 - protein, 9 aa, Homo Sapiens
SYCGPSSYN

SEQ ID NO: 923683 - protein, 9 aa, Homo Sapiens
VLGAFDGEE

SEQ ID NO: 923684 - protein, 9 aa, Homo Sapiens
MVTVLRISS

SEQ ID NO: 923685 - protein, 9 aa, Homo Sapiens
GQVCCSADQ

SEQ ID NO: 923686 - protein, 9 aa, Homo Sapiens
FLPLQCIYP

SEQ ID NO: 923687 - protein, 9 aa, Homo Sapiens
NQFGDRESS

SEQ ID NO: 923688 - protein, 9 aa, Homo Sapiens
LLQAFDRFF

SEQ ID NO: 923689 - protein, 9 aa, Homo Sapiens
FLVILWLQL

SEQ ID NO: 923690 - protein, 9 aa, Homo Sapiens
IGKKEVAEK

SEQ ID NO: 923691 - protein, 9 aa, Homo Sapiens
NGFPGLEEA

SEQ ID NO: 923692 - protein, 9 aa, Homo Sapiens
SQDLHSGAC

SEQ ID NO: 923693 - protein, 9 aa, Homo Sapiens
GEKEARGPN

SEQ ID NO: 923694 - protein, 9 aa, Homo Sapiens
WGRVWRATF

SEQ ID NO: 923695 - protein, 9 aa, Homo Sapiens
EPVHCPALK

SEQ ID NO: 923696 - protein, 9 aa, Homo Sapiens
FIPASFGTR

SEQ ID NO: 923697 - protein, 9 aa, Homo Sapiens
VLLLCLSRE

SEQ ID NO: 923698 - protein, 9 aa, Homo Sapiens
GTVSVSCHY

SEQ ID NO: 923699 - protein, 9 aa, Homo Sapiens
WFNIQQNNA

SEQ ID NO: 923700 - protein, 9 aa, Homo Sapiens
RIKKTDTIR

SEQ ID NO: 923701 - protein, 9 aa, Homo Sapiens
VIGENRLVS

SEQ ID NO: 923702 - protein, 9 aa, Homo Sapiens
CNCKKCKCT

SEQ ID NO: 923703 - protein, 9 aa, Homo Sapiens
GPPPQGENQ

SEQ ID NO: 923704 - protein, 9 aa, Homo Sapiens
EEIITVKQN

SEQ ID NO: 923705 - protein, 9 aa, Homo Sapiens
QMPAKVELV

SEQ ID NO: 923706 - protein, 9 aa, Homo Sapiens
SIGKKEVAE

SEQ ID NO: 923707 - protein, 9 aa, Homo Sapiens
TGRNLKKEI

SEQ ID NO: 923708 - protein, 9 aa, Homo Sapiens
ETPASLLPV

SEQ ID NO: 923709 - protein, 9 aa, Homo Sapiens
DRARKKLNG

SEQ ID NO: 923710 - protein, 9 aa, Homo Sapiens
KGEKEARGP

SEQ ID NO: 923711 - protein, 9 aa, Homo Sapiens
PCTQEQDHF

SEQ ID NO: 923712 - protein, 9 aa, Homo Sapiens
ALLFVASLI

SEQ ID NO: 923713 - protein, 9 aa, Homo Sapiens
ANLSEGVFL

SEQ ID NO: 923714 - protein, 9 aa, Homo Sapiens
AGESIGKKE

SEQ ID NO: 923715 - protein, 9 aa, Homo Sapiens
AAHGPRELK

SEQ ID NO: 923716 - protein, 9 aa, Homo Sapiens
FLQEKNRRR

SEQ ID NO: 923717 - protein, 9 aa, Homo Sapiens
VKTTDKCIN

SEQ ID NO: 923718 - protein, 9 aa, Homo Sapiens
TVSVSCHYL

SEQ ID NO: 923719 - protein, 9 aa, Homo Sapiens
KLVVSAMQL

SEQ ID NO: 923720 - protein, 9 aa, Homo Sapiens
TFSENHSSA

SEQ ID NO: 923721 - protein, 9 aa, Homo Sapiens
IFKPLTECG

SEQ ID NO: 923722 - protein, 9 aa, Homo Sapiens
VGMIAWLGT

SEQ ID NO: 923723 - protein, 9 aa, Homo Sapiens
VTAAINEVA

SEQ ID NO: 923724 - protein, 9 aa, Homo Sapiens
GIRGPPLPG

SEQ ID NO: 923725 - protein, 9 aa, Homo Sapiens
SQALCFRKI

SEQ ID NO: 923726 - protein, 9 aa, Homo Sapiens
GASYLKTCK

SEQ ID NO: 923727 - protein, 9 aa, Homo Sapiens
DFGLATEKS

SEQ ID NO: 923728 - protein, 9 aa, Homo Sapiens
EISRVLCKR

SEQ ID NO: 923729 - protein, 9 aa, Homo Sapiens
SSDHTTNQF

SEQ ID NO: 923730 - protein, 9 aa, Homo Sapiens
SLPCQVYMN

SEQ ID NO: 923731 - protein, 9 aa, Homo Sapiens
ESSDHTTNQ

SEQ ID NO: 923732 - protein, 9 aa, Homo Sapiens
PEATQFIIF

SEQ ID NO: 923733 - protein, 9 aa, Homo Sapiens
RPALKNSLK

SEQ ID NO: 923734 - protein, 9 aa, Homo Sapiens
EKEREMLKI

SEQ ID NO: 923735 - protein, 9 aa, Homo Sapiens
WAYEPVFTN

SEQ ID NO: 923736 - protein, 9 aa, Homo Sapiens
EWNIPYEFN

SEQ ID NO: 923737 - protein, 9 aa, Homo Sapiens
GGLSTISLN

SEQ ID NO: 923738 - protein, 9 aa, Homo Sapiens
LENMGRFGS

SEQ ID NO: 923739 - protein, 9 aa, Homo Sapiens
DKIYECDDC

SEQ ID NO: 923740 - protein, 9 aa, Homo Sapiens
KQSEILGYA

SEQ ID NO: 923741 - protein, 9 aa, Homo Sapiens
YFIGGPQEQ

SEQ ID NO: 923742 - protein, 9 aa, Homo Sapiens
DHTTNQFGD

SEQ ID NO: 923743 - protein, 9 aa, Homo Sapiens
IGLTLKQTL

SEQ ID NO: 923744 - protein, 9 aa, Homo Sapiens
FGRMMFVGT

SEQ ID NO: 923745 - protein, 9 aa, Homo Sapiens
GKTAKAGYP

SEQ ID NO: 923746 - protein, 9 aa, Homo Sapiens
LKYIHLANV

SEQ ID NO: 923747 - protein, 9 aa, Homo Sapiens
SFEVFIMLM

SEQ ID NO: 923748 - protein, 9 aa, Homo Sapiens
YMNHGENLK

SEQ ID NO: 923749 - protein, 9 aa, Homo Sapiens
LPQLNQVAY

SEQ ID NO: 923750 - protein, 9 aa, Homo Sapiens
QRRINARYQ

SEQ ID NO: 923751 - protein, 9 aa, Homo Sapiens
EDQYFIGGP

SEQ ID NO: 923752 - protein, 9 aa, Homo Sapiens
GAFDGEEHL

SEQ ID NO: 923753 - protein, 9 aa, Homo Sapiens
EIITVKQNL

SEQ ID NO: 923754 - protein, 9 aa, Homo Sapiens
VDLKGLQID

SEQ ID NO: 923755 - protein, 9 aa, Homo Sapiens
AVDLEQGKK

SEQ ID NO: 923756 - protein, 9 aa, Homo Sapiens
LSLRSDQNR

SEQ ID NO: 923757 - protein, 9 aa, Homo Sapiens
FESITNIIF

SEQ ID NO: 923758 - protein, 9 aa, Homo Sapiens
FKNFGLYNE

SEQ ID NO: 923759 - protein, 9 aa, Homo Sapiens
SGADRASTS

SEQ ID NO: 923760 - protein, 9 aa, Homo Sapiens
GQQQQTLPK

SEQ ID NO: 923761 - protein, 9 aa, Homo Sapiens
TVRGRPAQI

SEQ ID NO: 923762 - protein, 9 aa, Homo Sapiens
KIYECDDCG

SEQ ID NO: 923763 - protein, 9 aa, Homo Sapiens
EGNSSRSIT

SEQ ID NO: 923764 - protein, 9 aa, Homo Sapiens
GNKIIHIRE

SEQ ID NO: 923765 - protein, 9 aa, Homo Sapiens
LGMKQFSYD

SEQ ID NO: 923766 - protein, 9 aa, Homo Sapiens
YYETFIQQE

SEQ ID NO: 923767 - protein, 9 aa, Homo Sapiens
AICTLRKAV

SEQ ID NO: 923768 - protein, 9 aa, Homo Sapiens
KTAKAGYPP

SEQ ID NO: 923769 - protein, 9 aa, Homo Sapiens
PPQGENQSQ

SEQ ID NO: 923770 - protein, 9 aa, Homo Sapiens
NARLMAYTL

SEQ ID NO: 923771 - protein, 9 aa, Homo Sapiens
CLPQTKEAT

SEQ ID NO: 923772 - protein, 9 aa, Homo Sapiens
QTTVQIRKL

SEQ ID NO: 923773 - protein, 9 aa, Homo Sapiens
FQKKPEAET

SEQ ID NO: 923774 - protein, 9 aa, Homo Sapiens
LTSSWPDAA

SEQ ID NO: 923775 - protein, 9 aa, Homo Sapiens
TLLGVFLVI

SEQ ID NO: 923776 - protein, 9 aa, Homo Sapiens
QNLIKEVNV

SEQ ID NO: 923777 - protein, 9 aa, Homo Sapiens
VLMLPNGQL

SEQ ID NO: 923778 - protein, 9 aa, Homo Sapiens
TSSWPDAAF

SEQ ID NO: 923779 - protein, 9 aa, Homo Sapiens
MSGREQLNQ

SEQ ID NO: 923780 - protein, 9 aa, Homo Sapiens
HRQPETILT

SEQ ID NO: 923781 - protein, 9 aa, Homo Sapiens
AQCQVYDMG

SEQ ID NO: 923782 - protein, 9 aa, Homo Sapiens
KKKVTELKI

SEQ ID NO: 923783 - protein, 9 aa, Homo Sapiens
GEQQKLQEN

SEQ ID NO: 923784 - protein, 9 aa, Homo Sapiens
NPYRRLLID

SEQ ID NO: 923785 - protein, 9 aa, Homo Sapiens
EHLHKFILF

SEQ ID NO: 923786 - protein, 9 aa, Homo Sapiens
KELTMDGAK

SEQ ID NO: 923787 - protein, 9 aa, Homo Sapiens
VSPILEQDS

SEQ ID NO: 923788 - protein, 9 aa, Homo Sapiens
TLKAGEILN

SEQ ID NO: 923789 - protein, 9 aa, Homo Sapiens
VDLEQGKKA

SEQ ID NO: 923790 - protein, 9 aa, Homo Sapiens
KAEKCETHC

SEQ ID NO: 923791 - protein, 9 aa, Homo Sapiens
TAEGNSSRS

SEQ ID NO: 923792 - protein, 9 aa, Homo Sapiens
IVTAAINEV

SEQ ID NO: 923793 - protein, 9 aa, Homo Sapiens
IIYRGDPAR

SEQ ID NO: 923794 - protein, 9 aa, Homo Sapiens
EVHSGGLHR

SEQ ID NO: 923795 - protein, 9 aa, Homo Sapiens
WSLKGFKMD

SEQ ID NO: 923796 - protein, 9 aa, Homo Sapiens
QISMKVLLD

SEQ ID NO: 923797 - protein, 9 aa, Homo Sapiens
QTCEPVHCP

SEQ ID NO: 923798 - protein, 9 aa, Homo Sapiens
ERWLVYFPL

SEQ ID NO: 923799 - protein, 9 aa, Homo Sapiens
ITAHDSDEG

SEQ ID NO: 923800 - protein, 9 aa, Homo Sapiens
KYPLGKVIE

SEQ ID NO: 923801 - protein, 9 aa, Homo Sapiens
ETGKYLKVN

SEQ ID NO: 923802 - protein, 9 aa, Homo Sapiens
RQPGPSPRW

SEQ ID NO: 923803 - protein, 9 aa, Homo Sapiens
GASIDSSAL

SEQ ID NO: 923804 - protein, 9 aa, Homo Sapiens
VILLLLLGH

SEQ ID NO: 923805 - protein, 9 aa, Homo Sapiens
MAYTLELQK

SEQ ID NO: 923806 - protein, 9 aa, Homo Sapiens
QSTVPGATT

SEQ ID NO: 923807 - protein, 9 aa, Homo Sapiens
LLLLLGHCK

SEQ ID NO: 923808 - protein, 9 aa, Homo Sapiens
GPQASQPPP

SEQ ID NO: 923809 - protein, 9 aa, Homo Sapiens
PSQQGYPPQ

SEQ ID NO: 923810 - protein, 9 aa, Homo Sapiens
SLHSQIHHS

SEQ ID NO: 923811 - protein, 9 aa, Homo Sapiens
LAVLDFLGN

SEQ ID NO: 923812 - protein, 9 aa, Homo Sapiens
VLCGGGEQL

SEQ ID NO: 923813 - protein, 9 aa, Homo Sapiens
ISSAAGKWK

SEQ ID NO: 923814 - protein, 9 aa, Homo Sapiens
ENTMLLFVS

SEQ ID NO: 923815 - protein, 9 aa, Homo Sapiens
PQASQPPPP

SEQ ID NO: 923816 - protein, 9 aa, Homo Sapiens
ASIDSSALS

SEQ ID NO: 923817 - protein, 9 aa, Homo Sapiens
GKKGPAGER

SEQ ID NO: 923818 - protein, 9 aa, Homo Sapiens
AKGPITKSD

SEQ ID NO: 923819 - protein, 9 aa, Homo Sapiens
LESDRLENG

SEQ ID NO: 923820 - protein, 9 aa, Homo Sapiens
PRVPSIFRI

SEQ ID NO: 923821 - protein, 9 aa, Homo Sapiens
ISTTPQGDI

SEQ ID NO: 923822 - protein, 9 aa, Homo Sapiens
CFHPNLEMT

SEQ ID NO: 923823 - protein, 9 aa, Homo Sapiens
IIHLNLSGN

SEQ ID NO: 923824 - protein, 9 aa, Homo Sapiens
ENQSQGPPP

SEQ ID NO: 923825 - protein, 9 aa, Homo Sapiens
KFAATVRLP

SEQ ID NO: 923826 - protein, 9 aa, Homo Sapiens
MGPETDPQS

SEQ ID NO: 923827 - protein, 9 aa, Homo Sapiens
DKLEKLKEL

SEQ ID NO: 923828 - protein, 9 aa, Homo Sapiens
SFIATCVYI

SEQ ID NO: 923829 - protein, 9 aa, Homo Sapiens
VLRISSAAG

SEQ ID NO: 923830 - protein, 9 aa, Homo Sapiens
SKVVFSGKA

SEQ ID NO: 923831 - protein, 9 aa, Homo Sapiens
SGACRALVD

SEQ ID NO: 923832 - protein, 9 aa, Homo Sapiens
EEEAIFGAD

SEQ ID NO: 923833 - protein, 9 aa, Homo Sapiens
TFPKELQDE

SEQ ID NO: 923834 - protein, 9 aa, Homo Sapiens
IKRLPMNYF

SEQ ID NO: 923835 - protein, 9 aa, Homo Sapiens
GPRELKGEK

SEQ ID NO: 923836 - protein, 9 aa, Homo Sapiens
LHSAPPVLS

SEQ ID NO: 923837 - protein, 9 aa, Homo Sapiens
LIIYRGDPA

SEQ ID NO: 923838 - protein, 9 aa, Homo Sapiens
DTKKIFPSA

SEQ ID NO: 923839 - protein, 9 aa, Homo Sapiens
ADARLVFLV

SEQ ID NO: 923840 - protein, 9 aa, Homo Sapiens
PLASYEVLG

SEQ ID NO: 923841 - protein, 9 aa, Homo Sapiens
YACAGSCNC

SEQ ID NO: 923842 - protein, 9 aa, Homo Sapiens
EEIYSELCA

SEQ ID NO: 923843 - protein, 9 aa, Homo Sapiens
DSYSYNVQD

SEQ ID NO: 923844 - protein, 9 aa, Homo Sapiens
YFVYSKVVF

SEQ ID NO: 923845 - protein, 9 aa, Homo Sapiens
GSGCRLRDL

SEQ ID NO: 923846 - protein, 9 aa, Homo Sapiens
FQCRVPYNY

SEQ ID NO: 923847 - protein, 9 aa, Homo Sapiens
SEYVYYLVI

SEQ ID NO: 923848 - protein, 9 aa, Homo Sapiens
HLHKFILFR

SEQ ID NO: 923849 - protein, 9 aa, Homo Sapiens
DIGHKVAPR

SEQ ID NO: 923850 - protein, 9 aa, Homo Sapiens
LSLWRQSSE

SEQ ID NO: 923851 - protein, 9 aa, Homo Sapiens
VVSPILEQD

SEQ ID NO: 923852 - protein, 9 aa, Homo Sapiens
QIRNMVIFC

SEQ ID NO: 923853 - protein, 9 aa, Homo Sapiens
CEQQRTLYS

SEQ ID NO: 923854 - protein, 9 aa, Homo Sapiens
IYSELCALL

SEQ ID NO: 923855 - protein, 9 aa, Homo Sapiens
KKLCEAKHI

SEQ ID NO: 923856 - protein, 9 aa, Homo Sapiens
PASLLPVSS

SEQ ID NO: 923857 - protein, 9 aa, Homo Sapiens
PKSDFIPES

SEQ ID NO: 923858 - protein, 9 aa, Homo Sapiens
EVQCHPDKE

SEQ ID NO: 923859 - protein, 9 aa, Homo Sapiens
KKRVVVLLD

SEQ ID NO: 923860 - protein, 9 aa, Homo Sapiens
RENHESRQI

SEQ ID NO: 923861 - protein, 9 aa, Homo Sapiens
KIIHIREKP

SEQ ID NO: 923862 - protein, 9 aa, Homo Sapiens
EIMMEGCKY

SEQ ID NO: 923863 - protein, 9 aa, Homo Sapiens
LGKVIEPGC

SEQ ID NO: 923864 - protein, 9 aa, Homo Sapiens
RLLIDQVVQ

SEQ ID NO: 923865 - protein, 9 aa, Homo Sapiens
ALLIILTSY

SEQ ID NO: 923866 - protein, 9 aa, Homo Sapiens
VSVSCHYLK

SEQ ID NO: 923867 - protein, 9 aa, Homo Sapiens
GMILMFAGR

SEQ ID NO: 923868 - protein, 9 aa, Homo Sapiens
LLIAGPVDA

SEQ ID NO: 923869 - protein, 9 aa, Homo Sapiens
SSRSITCLQ

SEQ ID NO: 923870 - protein, 9 aa, Homo Sapiens
YPWAYEPVF

SEQ ID NO: 923871 - protein, 9 aa, Homo Sapiens
YHDQTEQCV

SEQ ID NO: 923872 - protein, 9 aa, Homo Sapiens
KNLNVSFNS

SEQ ID NO: 923873 - protein, 9 aa, Homo Sapiens
SLIADIGCE

SEQ ID NO: 923874 - protein, 9 aa, Homo Sapiens
SVLMLPNGQ

SEQ ID NO: 923875 - protein, 9 aa, Homo Sapiens
TWMLIFCLI

SEQ ID NO: 923876 - protein, 9 aa, Homo Sapiens
GFFNDGRWH

SEQ ID NO: 923877 - protein, 9 aa, Homo Sapiens
SEVHSGGLH

SEQ ID NO: 923878 - protein, 9 aa, Homo Sapiens
MSQALCFRK

SEQ ID NO: 923879 - protein, 9 aa, Homo Sapiens
DDCGLGFVD

SEQ ID NO: 923880 - protein, 9 aa, Homo Sapiens
TLLQDSKFF

SEQ ID NO: 923881 - protein, 9 aa, Homo Sapiens
HTREKPYHC

SEQ ID NO: 923882 - protein, 9 aa, Homo Sapiens
LLLGHCKPL

SEQ ID NO: 923883 - protein, 9 aa, Homo Sapiens
SGSSCSGDC

SEQ ID NO: 923884 - protein, 9 aa, Homo Sapiens
FFIHSVPRH

SEQ ID NO: 923885 - protein, 9 aa, Homo Sapiens
EILNRFSKD

SEQ ID NO: 923886 - protein, 9 aa, Homo Sapiens
TVCKKRVVV

SEQ ID NO: 923887 - protein, 9 aa, Homo Sapiens
QEQDHFKKQ

SEQ ID NO: 923888 - protein, 9 aa, Homo Sapiens
AVQTGTPQS

SEQ ID NO: 923889 - protein, 9 aa, Homo Sapiens
NFFLQEKNR

SEQ ID NO: 923890 - protein, 9 aa, Homo Sapiens
AFESITNII

SEQ ID NO: 923891 - protein, 9 aa, Homo Sapiens
LSHILKTKK

SEQ ID NO: 923892 - protein, 9 aa, Homo Sapiens
VPQMLAVLP

SEQ ID NO: 923893 - protein, 9 aa, Homo Sapiens
CINLSASTM

SEQ ID NO: 923894 - protein, 9 aa, Homo Sapiens
SLSFIATCV

SEQ ID NO: 923895 - protein, 9 aa, Homo Sapiens
LLMANTSQL

SEQ ID NO: 923896 - protein, 9 aa, Homo Sapiens
QGKKASTAF

SEQ ID NO: 923897 - protein, 9 aa, Homo Sapiens
CLMCQKLIQ

SEQ ID NO: 923898 - protein, 9 aa, Homo Sapiens
IEIMMEGCK

SEQ ID NO: 923899 - protein, 9 aa, Homo Sapiens
VDGRSVLML

SEQ ID NO: 923900 - protein, 9 aa, Homo Sapiens
QKLQENPTK

SEQ ID NO: 923901 - protein, 9 aa, Homo Sapiens
PPVKDEEYI

SEQ ID NO: 923902 - protein, 9 aa, Homo Sapiens
DTSVGWSRT

SEQ ID NO: 923903 - protein, 9 aa, Homo Sapiens
KQTLEKNLK

SEQ ID NO: 923904 - protein, 9 aa, Homo Sapiens
LIADIGCET

SEQ ID NO: 923905 - protein, 9 aa, Homo Sapiens
MKKQRFLTD

SEQ ID NO: 923906 - protein, 9 aa, Homo Sapiens
ICTLRKAVH

SEQ ID NO: 923907 - protein, 9 aa, Homo Sapiens
VLSADSSSP

SEQ ID NO: 923908 - protein, 9 aa, Homo Sapiens
KVVEDEATK

SEQ ID NO: 923909 - protein, 9 aa, Homo Sapiens
LCALLPTSS

SEQ ID NO: 923910 - protein, 9 aa, Homo Sapiens
DLLSLRSDQ

SEQ ID NO: 923911 - protein, 9 aa, Homo Sapiens
TPSSTFQEQ

SEQ ID NO: 923912 - protein, 9 aa, Homo Sapiens
MSNFPWQVF

SEQ ID NO: 923913 - protein, 9 aa, Homo Sapiens
AKNRIKKTD

SEQ ID NO: 923914 - protein, 9 aa, Homo Sapiens
STLTMNRVR

SEQ ID NO: 923915 - protein, 9 aa, Homo Sapiens
LCLSREARK

SEQ ID NO: 923916 - protein, 9 aa, Homo Sapiens
TTPQGDINS

SEQ ID NO: 923917 - protein, 9 aa, Homo Sapiens
RIDTRQRRI

SEQ ID NO: 923918 - protein, 9 aa, Homo Sapiens
NCAIIYCNN

SEQ ID NO: 923919 - protein, 9 aa, Homo Sapiens
YLAQAGLAC

SEQ ID NO: 923920 - protein, 9 aa, Homo Sapiens
SDGGPHKID

SEQ ID NO: 923921 - protein, 9 aa, Homo Sapiens
AVIYKNGFF

SEQ ID NO: 923922 - protein, 9 aa, Homo Sapiens
PALNLLIYT

SEQ ID NO: 923923 - protein, 9 aa, Homo Sapiens
RISRRPGAL

SEQ ID NO: 923924 - protein, 9 aa, Homo Sapiens
KIDHQEHPR

SEQ ID NO: 923925 - protein, 9 aa, Homo Sapiens
KNGFFIHSV

SEQ ID NO: 923926 - protein, 9 aa, Homo Sapiens
LHQARSFRL

SEQ ID NO: 923927 - protein, 9 aa, Homo Sapiens
PPCHLLIIY

SEQ ID NO: 923928 - protein, 9 aa, Homo Sapiens
ICDSRGRTG

SEQ ID NO: 923929 - protein, 9 aa, Homo Sapiens
VQQIIFFLR

SEQ ID NO: 923930 - protein, 9 aa, Homo Sapiens
LMNLYQLKS

SEQ ID NO: 923931 - protein, 9 aa, Homo Sapiens
TMLLFVSNR

SEQ ID NO: 923932 - protein, 9 aa, Homo Sapiens
MMEGCKYAI

SEQ ID NO: 923933 - protein, 9 aa, Homo Sapiens
MVNGFFNDG

SEQ ID NO: 923934 - protein, 9 aa, Homo Sapiens
KGSGCRLRD

SEQ ID NO: 923935 - protein, 9 aa, Homo Sapiens
CGSCRGSKR

SEQ ID NO: 923936 - protein, 9 aa, Homo Sapiens
PGDKGSGCR

SEQ ID NO: 923937 - protein, 9 aa, Homo Sapiens
ELKGEKGEP

SEQ ID NO: 923938 - protein, 9 aa, Homo Sapiens
KGDKGFPGK

SEQ ID NO: 923939 - protein, 9 aa, Homo Sapiens
KNCTCLNET

SEQ ID NO: 923940 - protein, 9 aa, Homo Sapiens
LPSRKYISN

SEQ ID NO: 923941 - protein, 9 aa, Homo Sapiens
WMLIFCLIQ

SEQ ID NO: 923942 - protein, 9 aa, Homo Sapiens
ANFILLRLT

SEQ ID NO: 923943 - protein, 9 aa, Homo Sapiens
NVSGGLLVP

SEQ ID NO: 923944 - protein, 9 aa, Homo Sapiens
IKKTDTIRC

SEQ ID NO: 923945 - protein, 9 aa, Homo Sapiens
LDTEASYCG

SEQ ID NO: 923946 - protein, 9 aa, Homo Sapiens
VNIFFDELE

SEQ ID NO: 923947 - protein, 9 aa, Homo Sapiens
GGLLVPRQT

SEQ ID NO: 923948 - protein, 9 aa, Homo Sapiens
QSLKTSDVS

SEQ ID NO: 923949 - protein, 9 aa, Homo Sapiens
FPDKGSVLE

SEQ ID NO: 923950 - protein, 9 aa, Homo Sapiens
VQIRKLTDM

SEQ ID NO: 923951 - protein, 9 aa, Homo Sapiens
VVYSILQEQ

SEQ ID NO: 923952 - protein, 9 aa, Homo Sapiens
SGGLLVPRQ

SEQ ID NO: 923953 - protein, 9 aa, Homo Sapiens
FNLQITTFS

SEQ ID NO: 923954 - protein, 9 aa, Homo Sapiens
FGLATEKSR

SEQ ID NO: 923955 - protein, 9 aa, Homo Sapiens
QEQGQVCCS

SEQ ID NO: 923956 - protein, 9 aa, Homo Sapiens
AMGLQLNFC

SEQ ID NO: 923957 - protein, 9 aa, Homo Sapiens
LRGTWSLEE

SEQ ID NO: 923958 - protein, 9 aa, Homo Sapiens
CDSRGRTGL

SEQ ID NO: 923959 - protein, 9 aa, Homo Sapiens
KSDFIPESH

SEQ ID NO: 923960 - protein, 8 aa, Homo Sapiens
KRQSERDS

SEQ ID NO: 923961 - protein, 9 aa, Homo Sapiens
AFGGKHEAL

SEQ ID NO: 923962 - protein, 9 aa, Homo Sapiens
NRDLGPNMR

SEQ ID NO: 923963 - protein, 9 aa, Homo Sapiens
SEGVFLAER

SEQ ID NO: 923964 - protein, 9 aa, Homo Sapiens
DPKDPLIET

SEQ ID NO: 923965 - protein, 9 aa, Homo Sapiens
KSLPEFSEA

SEQ ID NO: 923966 - protein, 9 aa, Homo Sapiens
HKVAPRVPS

SEQ ID NO: 923967 - protein, 9 aa, Homo Sapiens
KKQRFLTDV

SEQ ID NO: 923968 - protein, 9 aa, Homo Sapiens
LEYRTEPSP

SEQ ID NO: 923969 - protein, 9 aa, Homo Sapiens
CPQGTYYHD

SEQ ID NO: 923970 - protein, 9 aa, Homo Sapiens
ISNKAIPEK

SEQ ID NO: 923971 - protein, 9 aa, Homo Sapiens
SENHSSALQ

SEQ ID NO: 923972 - protein, 9 aa, Homo Sapiens
KKENKNKID

SEQ ID NO: 923973 - protein, 9 aa, Homo Sapiens
KLPEDGVSR

SEQ ID NO: 923974 - protein, 9 aa, Homo Sapiens
STLSTTSVD

SEQ ID NO: 923975 - protein, 9 aa, Homo Sapiens
LAVLPEHGA

SEQ ID NO: 923976 - protein, 9 aa, Homo Sapiens
QIVVKYPLG

SEQ ID NO: 923977 - protein, 9 aa, Homo Sapiens
CRLRDLRDS

SEQ ID NO: 923978 - protein, 9 aa, Homo Sapiens
STNGASRVE

SEQ ID NO: 923979 - protein, 9 aa, Homo Sapiens
EPVFTNISW

SEQ ID NO: 923980 - protein, 9 aa, Homo Sapiens
ATVMNEVQK

SEQ ID NO: 923981 - protein, 9 aa, Homo Sapiens
PSENWSPSA

SEQ ID NO: 923982 - protein, 9 aa, Homo Sapiens
GDKGFPGKT

SEQ ID NO: 923983 - protein, 9 aa, Homo Sapiens
LGRSQDFIG

SEQ ID NO: 923984 - protein, 9 aa, Homo Sapiens
FQIKGNLFC

SEQ ID NO: 923985 - protein, 9 aa, Homo Sapiens
DNDKKENKN

SEQ ID NO: 923986 - protein, 9 aa, Homo Sapiens
FGPLEWNIP

SEQ ID NO: 923987 - protein, 9 aa, Homo Sapiens
DGGPHKIDH

SEQ ID NO: 923988 - protein, 9 aa, Homo Sapiens
LKGLQIDVK

SEQ ID NO: 923989 - protein, 9 aa, Homo Sapiens
FICQSEVSF

SEQ ID NO: 923990 - protein, 9 aa, Homo Sapiens
PKPFKLQRY

SEQ ID NO: 923991 - protein, 9 aa, Homo Sapiens
KKPEAETLE

SEQ ID NO: 923992 - protein, 9 aa, Homo Sapiens
SGREQLNQN

SEQ ID NO: 923993 - protein, 9 aa, Homo Sapiens
KGGCGSCRG

SEQ ID NO: 923994 - protein, 9 aa, Homo Sapiens
KTKKLQVNI

SEQ ID NO: 923995 - protein, 9 aa, Homo Sapiens
KYIHLANVL

SEQ ID NO: 923996 - protein, 9 aa, Homo Sapiens
DKGFPGKTG

SEQ ID NO: 923997 - protein, 9 aa, Homo Sapiens
KNLKENREE

SEQ ID NO: 923998 - protein, 9 aa, Homo Sapiens
EAGITVLDA

SEQ ID NO: 923999 - protein, 9 aa, Homo Sapiens
KNRRRGAAG

SEQ ID NO: 924000 - protein, 9 aa, Homo Sapiens
KEISRVLCK

SEQ ID NO: 924001 - protein, 9 aa, Homo Sapiens
SSTNGASRV

SEQ ID NO: 924002 - protein, 9 aa, Homo Sapiens
VYSTLTMNR

SEQ ID NO: 924003 - protein, 9 aa, Homo Sapiens
AINEVAIEK

SEQ ID NO: 924004 - protein, 9 aa, Homo Sapiens
HLLIIYRGD

SEQ ID NO: 924005 - protein, 9 aa, Homo Sapiens
HSGGLHRPH

SEQ ID NO: 924006 - protein, 9 aa, Homo Sapiens
DSDEGRNGK

SEQ ID NO: 924007 - protein, 9 aa, Homo Sapiens
LDFLGNDWG

SEQ ID NO: 924008 - protein, 9 aa, Homo Sapiens
VLSSLEYRT

SEQ ID NO: 924009 - protein, 9 aa, Homo Sapiens
STPKAERAS

SEQ ID NO: 924010 - protein, 9 aa, Homo Sapiens
FDGEEHLIY

SEQ ID NO: 924011 - protein, 9 aa, Homo Sapiens
PATVMNEVQ

SEQ ID NO: 924012 - protein, 9 aa, Homo Sapiens
QALYEAGKT

SEQ ID NO: 924013 - protein, 9 aa, Homo Sapiens
SDADRARKK

SEQ ID NO: 924014 - protein, 9 aa, Homo Sapiens
NRIKKTDTI

SEQ ID NO: 924015 - protein, 9 aa, Homo Sapiens
GDKGSGCRL

SEQ ID NO: 924016 - protein, 9 aa, Homo Sapiens
MDFFIMIYI

SEQ ID NO: 924017 - protein, 9 aa, Homo Sapiens
LLSLRSDQN

SEQ ID NO: 924018 - protein, 9 aa, Homo Sapiens
EESLINKEE

SEQ ID NO: 924019 - protein, 9 aa, Homo Sapiens
GPNMRGFLY

SEQ ID NO: 924020 - protein, 9 aa, Homo Sapiens
GDSYSYNVQ

SEQ ID NO: 924021 - protein, 9 aa, Homo Sapiens
LRTTALAFL

SEQ ID NO: 924022 - protein, 9 aa, Homo Sapiens
FYQLMNLYQ

SEQ ID NO: 924023 - protein, 9 aa, Homo Sapiens
CLSPLKSFP

SEQ ID NO: 924024 - protein, 9 aa, Homo Sapiens
HLGVGTSGR

SEQ ID NO: 924025 - protein, 9 aa, Homo Sapiens
IEKWRGSEK

SEQ ID NO: 924026 - protein, 9 aa, Homo Sapiens
GYVFFFNNL

SEQ ID NO: 924027 - protein, 9 aa, Homo Sapiens
SLSEDNDKK

SEQ ID NO: 924028 - protein, 9 aa, Homo Sapiens
NKNVLAFTC

SEQ ID NO: 924029 - protein, 9 aa, Homo Sapiens
TQQISMKVL

SEQ ID NO: 924030 - protein, 9 aa, Homo Sapiens
RFYFNKDSD

SEQ ID NO: 924031 - protein, 9 aa, Homo Sapiens
VSFNSESFL

SEQ ID NO: 924032 - protein, 9 aa, Homo Sapiens
DCAYRKQMR

SEQ ID NO: 924033 - protein, 9 aa, Homo Sapiens
SIDSSALSS

SEQ ID NO: 924034 - protein, 9 aa, Homo Sapiens
YQLMNLYQL

SEQ ID NO: 924035 - protein, 9 aa, Homo Sapiens
KCINLSAST

SEQ ID NO: 924036 - protein, 9 aa, Homo Sapiens
DFLWGVFSS

SEQ ID NO: 924037 - protein, 9 aa, Homo Sapiens
TTYFICGLE

SEQ ID NO: 924038 - protein, 9 aa, Homo Sapiens
LFVASLIRH

SEQ ID NO: 924039 - protein, 9 aa, Homo Sapiens
PLVPAQDSS

SEQ ID NO: 924040 - protein, 9 aa, Homo Sapiens
MNRVRQPEK

SEQ ID NO: 924041 - protein, 9 aa, Homo Sapiens
NEAFDLEKA

SEQ ID NO: 924042 - protein, 9 aa, Homo Sapiens
RGLKYIHLA

SEQ ID NO: 924043 - protein, 9 aa, Homo Sapiens
EYIFVIFDF

SEQ ID NO: 924044 - protein, 9 aa, Homo Sapiens
CLSREARKK

SEQ ID NO: 924045 - protein, 9 aa, Homo Sapiens
TCLGLSYNG

SEQ ID NO: 924046 - protein, 9 aa, Homo Sapiens
NLEDVPGDQ

SEQ ID NO: 924047 - protein, 9 aa, Homo Sapiens
PFKLQRYLA

SEQ ID NO: 924048 - protein, 9 aa, Homo Sapiens
EKRSVFLDR

SEQ ID NO: 924049 - protein, 9 aa, Homo Sapiens
PYMCQQNTG

SEQ ID NO: 924050 - protein, 9 aa, Homo Sapiens
AKDVNIFFD

SEQ ID NO: 924051 - protein, 9 aa, Homo Sapiens
VYSILQEQP

SEQ ID NO: 924052 - protein, 9 aa, Homo Sapiens
VQCHPDKEG

SEQ ID NO: 924053 - protein, 9 aa, Homo Sapiens
HQARSFRLY

SEQ ID NO: 924054 - protein, 9 aa, Homo Sapiens
ETIQCETLI

SEQ ID NO: 924055 - protein, 9 aa, Homo Sapiens
LSDTKKIFP

SEQ ID NO: 924056 - protein, 9 aa, Homo Sapiens
EAIFGADVL

SEQ ID NO: 924057 - protein, 9 aa, Homo Sapiens
SERGRLPSG

SEQ ID NO: 924058 - protein, 9 aa, Homo Sapiens
YKNGFFIHS

SEQ ID NO: 924059 - protein, 9 aa, Homo Sapiens
GFDPNICDS

SEQ ID NO: 924060 - protein, 9 aa, Homo Sapiens
EGPSRGASY

SEQ ID NO: 924061 - protein, 9 aa, Homo Sapiens
KLQSLKTSD

SEQ ID NO: 924062 - protein, 9 aa, Homo Sapiens
LPFYNQDYE

SEQ ID NO: 924063 - protein, 9 aa, Homo Sapiens
CMPSENWSP

SEQ ID NO: 924064 - protein, 9 aa, Homo Sapiens
RGNKIIHIR

SEQ ID NO: 924065 - protein, 9 aa, Homo Sapiens
VPAQDSSSQ

SEQ ID NO: 924066 - protein, 9 aa, Homo Sapiens
LSEDNDKKE

SEQ ID NO: 924067 - protein, 9 aa, Homo Sapiens
EERLEEEAI

SEQ ID NO: 924068 - protein, 9 aa, Homo Sapiens
LEKRSVFLD

SEQ ID NO: 924069 - protein, 9 aa, Homo Sapiens
GCETGKYLK

SEQ ID NO: 924070 - protein, 9 aa, Homo Sapiens
NWVKKKPYL

SEQ ID NO: 924071 - protein, 9 aa, Homo Sapiens
VFPVILLLL

SEQ ID NO: 924072 - protein, 9 aa, Homo Sapiens
HILKTKKLQ

SEQ ID NO: 924073 - protein, 9 aa, Homo Sapiens
SEEKSVRHP

SEQ ID NO: 924074 - protein, 9 aa, Homo Sapiens
WMGLNQLNE

SEQ ID NO: 924075 - protein, 9 aa, Homo Sapiens
PNICDSRGR

SEQ ID NO: 924076 - protein, 9 aa, Homo Sapiens
LLQDSKFFE

SEQ ID NO: 924077 - protein, 9 aa, Homo Sapiens
IYVIGENRL

SEQ ID NO: 924078 - protein, 9 aa, Homo Sapiens
EGVMITKFY

SEQ ID NO: 924079 - protein, 9 aa, Homo Sapiens
SLWRQSSER

SEQ ID NO: 924080 - protein, 9 aa, Homo Sapiens
ILIRLMYSN

SEQ ID NO: 924081 - protein, 9 aa, Homo Sapiens
TEASYCGPS

SEQ ID NO: 924082 - protein, 9 aa, Homo Sapiens
SGQTCEPVH

SEQ ID NO: 924083 - protein, 9 aa, Homo Sapiens
AIVISHFGR

SEQ ID NO: 924084 - protein, 9 aa, Homo Sapiens
GSCRLESAG

SEQ ID NO: 924085 - protein, 9 aa, Homo Sapiens
DLNWVKKKP

SEQ ID NO: 924086 - protein, 9 aa, Homo Sapiens
DKGSGCRLR

SEQ ID NO: 924087 - protein, 9 aa, Homo Sapiens
DFQCRVPYN

SEQ ID NO: 924088 - protein, 9 aa, Homo Sapiens
RYLAVHSPQ

SEQ ID NO: 924089 - protein, 9 aa, Homo Sapiens
VYDMGPETD

SEQ ID NO: 924090 - protein, 9 aa, Homo Sapiens
RLTDDPQLQ

SEQ ID NO: 924091 - protein, 9 aa, Homo Sapiens
LSNESFSAP

SEQ ID NO: 924092 - protein, 9 aa, Homo Sapiens
TKKIFPSAM

SEQ ID NO: 924093 - protein, 9 aa, Homo Sapiens
TDKCINLSA

SEQ ID NO: 924094 - protein, 9 aa, Homo Sapiens
QLAEKELGL

SEQ ID NO: 924095 - protein, 9 aa, Homo Sapiens
CLNETIQCE

SEQ ID NO: 924096 - protein, 9 aa, Homo Sapiens
VISHFGRMM

SEQ ID NO: 924097 - protein, 9 aa, Homo Sapiens
TVKVVEDEA

SEQ ID NO: 924098 - protein, 9 aa, Homo Sapiens
VGTSGRIKE

SEQ ID NO: 924099 - protein, 9 aa, Homo Sapiens
SIGRSPTDK

SEQ ID NO: 924100 - protein, 9 aa, Homo Sapiens
VTELKIQNS

SEQ ID NO: 924101 - protein, 9 aa, Homo Sapiens
EMTERPANS

SEQ ID NO: 924102 - protein, 9 aa, Homo Sapiens
EGCKYAISN

SEQ ID NO: 924103 - protein, 9 aa, Homo Sapiens
VMITKFYFQ

SEQ ID NO: 924104 - protein, 9 aa, Homo Sapiens
LYRVRISRR

SEQ ID NO: 924105 - protein, 9 aa, Homo Sapiens
GGGLENMGR

SEQ ID NO: 924106 - protein, 9 aa, Homo Sapiens
IMVNGFFND

SEQ ID NO: 924107 - protein, 9 aa, Homo Sapiens
ICQSEVSFS

SEQ ID NO: 924108 - protein, 9 aa, Homo Sapiens
KVLLDPPLE

SEQ ID NO: 924109 - protein, 9 aa, Homo Sapiens
PDKEGASNL

SEQ ID NO: 924110 - protein, 9 aa, Homo Sapiens
LNQTTVQIR

SEQ ID NO: 924111 - protein, 9 aa, Homo Sapiens
VVQMPAKVE

SEQ ID NO: 924112 - protein, 9 aa, Homo Sapiens
GREQLNQNL

SEQ ID NO: 924113 - protein, 9 aa, Homo Sapiens
KVDLKGLQI

SEQ ID NO: 924114 - protein, 9 aa, Homo Sapiens
VRVHNSCSD

SEQ ID NO: 924115 - protein, 9 aa, Homo Sapiens
SIMVNGFFN

SEQ ID NO: 924116 - protein, 9 aa, Homo Sapiens
QTGTPQSTV

SEQ ID NO: 924117 - protein, 9 aa, Homo Sapiens
RTTALAFLV

SEQ ID NO: 924118 - protein, 9 aa, Homo Sapiens
TINALAQKR

SEQ ID NO: 924119 - protein, 9 aa, Homo Sapiens
VCADTSISC

SEQ ID NO: 924120 - protein, 9 aa, Homo Sapiens
GQEQGQVCC

SEQ ID NO: 924121 - protein, 9 aa, Homo Sapiens
LELQKLEEQ

SEQ ID NO: 924122 - protein, 9 aa, Homo Sapiens
LQLNFCDSN

SEQ ID NO: 924123 - protein, 9 aa, Homo Sapiens
ISRRPGALD

SEQ ID NO: 924124 - protein, 9 aa, Homo Sapiens
PAKVELVIG

SEQ ID NO: 924125 - protein, 9 aa, Homo Sapiens
SDEGRNGKV

SEQ ID NO: 924126 - protein, 9 aa, Homo Sapiens
YNGLLGDNQ

SEQ ID NO: 924127 - protein, 9 aa, Homo Sapiens
YSAKGPITK

SEQ ID NO: 924128 - protein, 9 aa, Homo Sapiens
LFSCHLSKA

SEQ ID NO: 924129 - protein, 9 aa, Homo Sapiens
GPNGIPGKK

SEQ ID NO: 924130 - protein, 9 aa, Homo Sapiens
SSDLGPYFT

SEQ ID NO: 924131 - protein, 9 aa, Homo Sapiens
NQVAYDSLV

SEQ ID NO: 924132 - protein, 9 aa, Homo Sapiens
ATFNEMCAL

SEQ ID NO: 924133 - protein, 9 aa, Homo Sapiens
KQFSYDQNE

SEQ ID NO: 924134 - protein, 9 aa, Homo Sapiens
TDKDTQEEI

SEQ ID NO: 924135 - protein, 9 aa, Homo Sapiens
PHKIDHQEH

SEQ ID NO: 924136 - protein, 9 aa, Homo Sapiens
LTLLQDSKF

SEQ ID NO: 924137 - protein, 9 aa, Homo Sapiens
AGPNGIPGK

SEQ ID NO: 924138 - protein, 9 aa, Homo Sapiens
SNAVGKPEY

SEQ ID NO: 924139 - protein, 9 aa, Homo Sapiens
TAIVISHFG

SEQ ID NO: 924140 - protein, 9 aa, Homo Sapiens
SQHQVIHTR

SEQ ID NO: 924141 - protein, 9 aa, Homo Sapiens
PVAKDVNIF

SEQ ID NO: 924142 - protein, 9 aa, Homo Sapiens
AIFGADVLD

SEQ ID NO: 924143 - protein, 9 aa, Homo Sapiens
QYFIGGPQE

SEQ ID NO: 924144 - protein, 9 aa, Homo Sapiens
LQTKNYDIR

SEQ ID NO: 924145 - protein, 9 aa, Homo Sapiens
PSLSEDNDK

SEQ ID NO: 924146 - protein, 9 aa, Homo Sapiens
EAWYEGSLG

SEQ ID NO: 924147 - protein, 9 aa, Homo Sapiens
SSDESEDGS

SEQ ID NO: 924148 - protein, 9 aa, Homo Sapiens
ARRSQDLHS

SEQ ID NO: 924149 - protein, 9 aa, Homo Sapiens
GLQLNFCDS

SEQ ID NO: 924150 - protein, 9 aa, Homo Sapiens
HEALSSPIS

SEQ ID NO: 924151 - protein, 9 aa, Homo Sapiens
PCHLLIIYR

SEQ ID NO: 924152 - protein, 9 aa, Homo Sapiens
GIYFVYSKV

SEQ ID NO: 924153 - protein, 9 aa, Homo Sapiens
YSILQEQPY

SEQ ID NO: 924154 - protein, 9 aa, Homo Sapiens
KKHLIMTKS

SEQ ID NO: 924155 - protein, 9 aa, Homo Sapiens
PGAGMVSQG

SEQ ID NO: 924156 - protein, 9 aa, Homo Sapiens
NGFCELFGY

SEQ ID NO: 924157 - protein, 9 aa, Homo Sapiens
GIYFVYSKG

SEQ ID NO: 924158 - protein, 9 aa, Homo Sapiens
NEVQKFLGV

SEQ ID NO: 924159 - protein, 9 aa, Homo Sapiens
GIYFVYSKL

SEQ ID NO: 924160 - protein, 9 aa, Homo Sapiens
RSLLYGEDE

SEQ ID NO: 924161 - protein, 9 aa, Homo Sapiens
EQQKLQENP

SEQ ID NO: 924162 - protein, 9 aa, Homo Sapiens
QLNEHAGWQ

SEQ ID NO: 924163 - protein, 9 aa, Homo Sapiens
PPQPFPGDS

SEQ ID NO: 924164 - protein, 9 aa, Homo Sapiens
RKKLNGTIV

SEQ ID NO: 924165 - protein, 9 aa, Homo Sapiens
DSTEPIRTP

SEQ ID NO: 924166 - protein, 9 aa, Homo Sapiens
FPMKGRKEM

SEQ ID NO: 924167 - protein, 9 aa, Homo Sapiens
QAGLACVFI

SEQ ID NO: 924168 - protein, 9 aa, Homo Sapiens
FLDRSSAGQ

SEQ ID NO: 924169 - protein, 9 aa, Homo Sapiens
AYTLELQKL

SEQ ID NO: 924170 - protein, 9 aa, Homo Sapiens
RLENGMEDA

SEQ ID NO: 924171 - protein, 9 aa, Homo Sapiens
RLDSTEPIR

SEQ ID NO: 924172 - protein, 9 aa, Homo Sapiens
WNVLPQDLF

SEQ ID NO: 924173 - protein, 9 aa, Homo Sapiens
NLLIYTLRN

SEQ ID NO: 924174 - protein, 9 aa, Homo Sapiens
LNWVKKKPY

SEQ ID NO: 924175 - protein, 9 aa, Homo Sapiens
SHILKTKKL

SEQ ID NO: 924176 - protein, 9 aa, Homo Sapiens
RAALDTIQY

SEQ ID NO: 924177 - protein, 9 aa, Homo Sapiens
NEDKLEKLK

SEQ ID NO: 924178 - protein, 9 aa, Homo Sapiens
DTEASYCGP

SEQ ID NO: 924179 - protein, 9 aa, Homo Sapiens
ACILIDLCS

SEQ ID NO: 924180 - protein, 9 aa, Homo Sapiens
PNMRGFLYA

SEQ ID NO: 924181 - protein, 9 aa, Homo Sapiens
RATFSQGAS

SEQ ID NO: 924182 - protein, 9 aa, Homo Sapiens
HLLLLVFEV

SEQ ID NO: 924183 - protein, 9 aa, Homo Sapiens
QEKNRRRGA

SEQ ID NO: 924184 - protein, 9 aa, Homo Sapiens
WRGSEKVLP

SEQ ID NO: 924185 - protein, 9 aa, Homo Sapiens
LAEKCPNII

SEQ ID NO: 924186 - protein, 9 aa, Homo Sapiens
GKKASTAFE

SEQ ID NO: 924187 - protein, 9 aa, Homo Sapiens
LNQNLIKEV

SEQ ID NO: 924188 - protein, 9 aa, Homo Sapiens
NMPDEGVMI

SEQ ID NO: 924189 - protein, 9 aa, Homo Sapiens
FYNQDYERL

SEQ ID NO: 924190 - protein, 9 aa, Homo Sapiens
FRKIGGEDG

SEQ ID NO: 924191 - protein, 9 aa, Homo Sapiens
PITKSDGNR

SEQ ID NO: 924192 - protein, 9 aa, Homo Sapiens
PLEWNIPYE

SEQ ID NO: 924193 - protein, 9 aa, Homo Sapiens
ESNPYRRLL

SEQ ID NO: 924194 - protein, 9 aa, Homo Sapiens
AAHLYLGRS

SEQ ID NO: 924195 - protein, 9 aa, Homo Sapiens
PHYPWAYEP

SEQ ID NO: 924196 - protein, 9 aa, Homo Sapiens
VSKKLVGLA

SEQ ID NO: 924197 - protein, 9 aa, Homo Sapiens
WGHQGNGQS

SEQ ID NO: 924198 - protein, 9 aa, Homo Sapiens
GDFGLATEK

SEQ ID NO: 924199 - protein, 9 aa, Homo Sapiens
LHEDLNWVK

SEQ ID NO: 924200 - protein, 9 aa, Homo Sapiens
GRNLKKEIS

SEQ ID NO: 924201 - protein, 9 aa, Homo Sapiens
RKEMVDWAR

SEQ ID NO: 924202 - protein, 9 aa, Homo Sapiens
YSKVVFSGK

SEQ ID NO: 924203 - protein, 9 aa, Homo Sapiens
STFQEQLTP

SEQ ID NO: 924204 - protein, 9 aa, Homo Sapiens
FAGRKLIFG

SEQ ID NO: 924205 - protein, 9 aa, Homo Sapiens
AQISLVAQN

SEQ ID NO: 924206 - protein, 9 aa, Homo Sapiens
ELIKSQIDT

SEQ ID NO: 924207 - protein, 9 aa, Homo Sapiens
GMKQFSYDQ

SEQ ID NO: 924208 - protein, 9 aa, Homo Sapiens
QPETILTET

SEQ ID NO: 924209 - protein, 9 aa, Homo Sapiens
ETQQISMKV

SEQ ID NO: 924210 - protein, 9 aa, Homo Sapiens
LSDESSDES

SEQ ID NO: 924211 - protein, 9 aa, Homo Sapiens
DSTSEEKSV

SEQ ID NO: 924212 - protein, 9 aa, Homo Sapiens
LFIKRLPMN

SEQ ID NO: 924213 - protein, 9 aa, Homo Sapiens
YYHDQTEQC

SEQ ID NO: 924214 - protein, 9 aa, Homo Sapiens
TQEQDHFKK

SEQ ID NO: 924215 - protein, 9 aa, Homo Sapiens
VKGDKGFPG

SEQ ID NO: 924216 - protein, 9 aa, Homo Sapiens
LDRSSAGQY

SEQ ID NO: 924217 - protein, 9 aa, Homo Sapiens
LVDGRSVLM

SEQ ID NO: 924218 - protein, 9 aa, Homo Sapiens
SQAAHGPRE

SEQ ID NO: 924219 - protein, 9 aa, Homo Sapiens
QKLIQPSEL

SEQ ID NO: 924220 - protein, 9 aa, Homo Sapiens
LNNIFKPLT

SEQ ID NO: 924221 - protein, 9 aa, Homo Sapiens
MRGFLYAGL

SEQ ID NO: 924222 - protein, 9 aa, Homo Sapiens
VRSDFQCRV

SEQ ID NO: 924223 - protein, 9 aa, Homo Sapiens
GKGGCGSCR

SEQ ID NO: 924224 - protein, 9 aa, Homo Sapiens
KVPCTQEQD

SEQ ID NO: 924225 - protein, 9 aa, Homo Sapiens
LGTRPPHSV

SEQ ID NO: 924226 - protein, 9 aa, Homo Sapiens
ADQQEEGQR

SEQ ID NO: 924227 - protein, 9 aa, Homo Sapiens
KNYDIRAAL

SEQ ID NO: 924228 - protein, 9 aa, Homo Sapiens
QENPTKKTK

SEQ ID NO: 924229 - protein, 9 aa, Homo Sapiens
GVENICEFE

SEQ ID NO: 924230 - protein, 9 aa, Homo Sapiens
HLANVLHRD

SEQ ID NO: 924231 - protein, 9 aa, Homo Sapiens
GTRPPHSVI

SEQ ID NO: 924232 - protein, 9 aa, Homo Sapiens
LMANTSQLK

SEQ ID NO: 924233 - protein, 9 aa, Homo Sapiens
IQQNNAPMA

SEQ ID NO: 924234 - protein, 9 aa, Homo Sapiens
PQMLAVLPE

SEQ ID NO: 924235 - protein, 9 aa, Homo Sapiens
KNSVLLQAF

SEQ ID NO: 924236 - protein, 9 aa, Homo Sapiens
RPAQISLVA

SEQ ID NO: 924237 - protein, 9 aa, Homo Sapiens
HRLDTEASY

SEQ ID NO: 924238 - protein, 9 aa, Homo Sapiens
PWAYEPVFT

SEQ ID NO: 924239 - protein, 9 aa, Homo Sapiens
RQKAIFLRH

SEQ ID NO: 924240 - protein, 9 aa, Homo Sapiens
AFDLEKAGT

SEQ ID NO: 924241 - protein, 9 aa, Homo Sapiens
EKAQKELIK

SEQ ID NO: 924242 - protein, 9 aa, Homo Sapiens
KTNVGYVFF

SEQ ID NO: 924243 - protein, 9 aa, Homo Sapiens
PQVLQSYHL

SEQ ID NO: 924244 - protein, 9 aa, Homo Sapiens
GNWSLKGFK

SEQ ID NO: 924245 - protein, 9 aa, Homo Sapiens
NTMLLFVSN

SEQ ID NO: 924246 - protein, 9 aa, Homo Sapiens
LNQVAYDSL

SEQ ID NO: 924247 - protein, 9 aa, Homo Sapiens
AKKHLIMTK

SEQ ID NO: 924248 - protein, 9 aa, Homo Sapiens
PVPSGTPMI

SEQ ID NO: 924249 - protein, 9 aa, Homo Sapiens
NEQSLHSQI

SEQ ID NO: 924250 - protein, 9 aa, Homo Sapiens
WRQGLMGVP

SEQ ID NO: 924251 - protein, 9 aa, Homo Sapiens
GESAPSDID

SEQ ID NO: 924252 - protein, 9 aa, Homo Sapiens
CNVVDGQPF

SEQ ID NO: 924253 - protein, 9 aa, Homo Sapiens
FLVTTDPLV

SEQ ID NO: 924254 - protein, 9 aa, Homo Sapiens
QGPPSQQGY

SEQ ID NO: 924255 - protein, 9 aa, Homo Sapiens
SMKVLLDPP

SEQ ID NO: 924256 - protein, 9 aa, Homo Sapiens
DARLVFLVT

SEQ ID NO: 924257 - protein, 9 aa, Homo Sapiens
SLPQLNQVA

SEQ ID NO: 924258 - protein, 9 aa, Homo Sapiens
TVVTPALNL

SEQ ID NO: 924259 - protein, 9 aa, Homo Sapiens
GDINSFSQA

SEQ ID NO: 924260 - protein, 9 aa, Homo Sapiens
AQKRNAYWK

SEQ ID NO: 924261 - protein, 9 aa, Homo Sapiens
TDSTSEEKS

SEQ ID NO: 924262 - protein, 9 aa, Homo Sapiens
QQNNAPMAV

SEQ ID NO: 924263 - protein, 9 aa, Homo Sapiens
LGVFLVILW

SEQ ID NO: 924264 - protein, 9 aa, Homo Sapiens
VVLQRSRTF

SEQ ID NO: 924265 - protein, 9 aa, Homo Sapiens
TIAWNVLPQ

SEQ ID NO: 924266 - protein, 9 aa, Homo Sapiens
PPVLSADSS

SEQ ID NO: 924267 - protein, 9 aa, Homo Sapiens
TSQLKAVVE

SEQ ID NO: 924268 - protein, 9 aa, Homo Sapiens
PTDKIANLV

SEQ ID NO: 924269 - protein, 9 aa, Homo Sapiens
LEIAAQEEA

SEQ ID NO: 924270 - protein, 9 aa, Homo Sapiens
QPKLVVSAM

SEQ ID NO: 924271 - protein, 9 aa, Homo Sapiens
RTEPSPGQA

SEQ ID NO: 924272 - protein, 9 aa, Homo Sapiens
SADQQEEGQ

SEQ ID NO: 924273 - protein, 9 aa, Homo Sapiens
PFFHALTLP

SEQ ID NO: 924274 - protein, 9 aa, Homo Sapiens
EAKAEKCET

SEQ ID NO: 924275 - protein, 9 aa, Homo Sapiens
YQGPPSQQG

SEQ ID NO: 924276 - protein, 9 aa, Homo Sapiens
RAQLECEIN

SEQ ID NO: 924277 - protein, 9 aa, Homo Sapiens
ADIGCETGK

SEQ ID NO: 924278 - protein, 9 aa, Homo Sapiens
QKELIKSQI

SEQ ID NO: 924279 - protein, 9 aa, Homo Sapiens
ATWLVPSVK

SEQ ID NO: 924280 - protein, 9 aa, Homo Sapiens
ADRARKKLN

SEQ ID NO: 924281 - protein, 9 aa, Homo Sapiens
ESAPSDIDA

SEQ ID NO: 924282 - protein, 9 aa, Homo Sapiens
SEEIYSELC

SEQ ID NO: 924283 - protein, 9 aa, Homo Sapiens
QKKPEAETL

SEQ ID NO: 924284 - protein, 9 aa, Homo Sapiens
AGMVSQGEA

SEQ ID NO: 924285 - protein, 9 aa, Homo Sapiens
YFVYSKLPE

SEQ ID NO: 924286 - protein, 9 aa, Homo Sapiens
VFFFNNLKY

SEQ ID NO: 924287 - protein, 9 aa, Homo Sapiens
ECDDCGLGF

SEQ ID NO: 924288 - protein, 9 aa, Homo Sapiens
SCRLESAGG

SEQ ID NO: 924289 - protein, 9 aa, Homo Sapiens
SFLEIFFTN

SEQ ID NO: 924290 - protein, 9 aa, Homo Sapiens
LCSGQEQGQ

SEQ ID NO: 924291 - protein, 9 aa, Homo Sapiens
PIRKRLNST

SEQ ID NO: 924292 - protein, 9 aa, Homo Sapiens
AYEPVFTNI

SEQ ID NO: 924293 - protein, 9 aa, Homo Sapiens
PDKGSVLEE

SEQ ID NO: 924294 - protein, 9 aa, Homo Sapiens
GSEKVLPPL

SEQ ID NO: 924295 - protein, 9 aa, Homo Sapiens
SVLEETSAE

SEQ ID NO: 924296 - protein, 9 aa, Homo Sapiens
YRVACILID

SEQ ID NO: 924297 - protein, 9 aa, Homo Sapiens
EIGVENICE

SEQ ID NO: 924298 - protein, 9 aa, Homo Sapiens
SVSCHYLKN

SEQ ID NO: 924299 - protein, 9 aa, Homo Sapiens
AEMKIREDE

SEQ ID NO: 924300 - protein, 9 aa, Homo Sapiens
PRENKNVLA

SEQ ID NO: 924301 - protein, 9 aa, Homo Sapiens
YTAIVISHF

SEQ ID NO: 924302 - protein, 9 aa, Homo Sapiens
KELIKSQID

SEQ ID NO: 924303 - protein, 9 aa, Homo Sapiens
SGRIKELVK

SEQ ID NO: 924304 - protein, 9 aa, Homo Sapiens
VLPASAFAI

SEQ ID NO: 924305 - protein, 9 aa, Homo Sapiens
SSSKLTQPK

SEQ ID NO: 924306 - protein, 9 aa, Homo Sapiens
VEHLHKFIL

SEQ ID NO: 924307 - protein, 9 aa, Homo Sapiens
WRQSSERGR

SEQ ID NO: 924308 - protein, 9 aa, Homo Sapiens
AEKELGLPP

SEQ ID NO: 924309 - protein, 9 aa, Homo Sapiens
IRLMYSNPP

SEQ ID NO: 924310 - protein, 9 aa, Homo Sapiens
TRPPHSVID

SEQ ID NO: 924311 - protein, 9 aa, Homo Sapiens
LIAGPVDAG

SEQ ID NO: 924312 - protein, 9 aa, Homo Sapiens
APSDIDASS

SEQ ID NO: 924313 - protein, 9 aa, Homo Sapiens
CALLIILTS

SEQ ID NO: 924314 - protein, 9 aa, Homo Sapiens
NQLSPYKQS

SEQ ID NO: 924315 - protein, 9 aa, Homo Sapiens
RSQDFIGGE

SEQ ID NO: 924316 - protein, 9 aa, Homo Sapiens
RETRSTVRD

SEQ ID NO: 924317 - protein, 9 aa, Homo Sapiens
TKNLEDVPG

SEQ ID NO: 924318 - protein, 9 aa, Homo Sapiens
LEKNLKENR

SEQ ID NO: 924319 - protein, 9 aa, Homo Sapiens
NLNVSFNSE

SEQ ID NO: 924320 - protein, 9 aa, Homo Sapiens
ENEAFDLEK

SEQ ID NO: 924321 - protein, 9 aa, Homo Sapiens
INQRSLLYG

SEQ ID NO: 924322 - protein, 9 aa, Homo Sapiens
GLLVPRQTP

SEQ ID NO: 924323 - protein, 9 aa, Homo Sapiens
LLFVASLIR

SEQ ID NO: 924324 - protein, 9 aa, Homo Sapiens
GQVTCFLMP

SEQ ID NO: 924325 - protein, 9 aa, Homo Sapiens
LKTTYFICG

SEQ ID NO: 924326 - protein, 9 aa, Homo Sapiens
FNSESFLDC

SEQ ID NO: 924327 - protein, 9 aa, Homo Sapiens
LEMTERPAN

SEQ ID NO: 924328 - protein, 9 aa, Homo Sapiens
ENGMEDAGD

SEQ ID NO: 924329 - protein, 9 aa, Homo Sapiens
LVPAQDSSS

SEQ ID NO: 924330 - protein, 9 aa, Homo Sapiens
QQQLAEKEL

SEQ ID NO: 924331 - protein, 9 aa, Homo Sapiens
LSTISLNSN

SEQ ID NO: 924332 - protein, 9 aa, Homo Sapiens
PLGKVIEPG

SEQ ID NO: 924333 - protein, 9 aa, Homo Sapiens
EEESLINKE

SEQ ID NO: 924334 - protein, 9 aa, Homo Sapiens
SLPEFSEAK

SEQ ID NO: 924335 - protein, 9 aa, Homo Sapiens
RVRISRRPG

SEQ ID NO: 924336 - protein, 9 aa, Homo Sapiens
TVQIRKLTD

SEQ ID NO: 924337 - protein, 9 aa, Homo Sapiens
IKGNLFCEQ

SEQ ID NO: 924338 - protein, 9 aa, Homo Sapiens
PELVRPALK

SEQ ID NO: 924339 - protein, 9 aa, Homo Sapiens
HCSVLPASA

SEQ ID NO: 924340 - protein, 9 aa, Homo Sapiens
NNAPMAVFF

SEQ ID NO: 924341 - protein, 9 aa, Homo Sapiens
SSTFQEQLT

SEQ ID NO: 924342 - protein, 9 aa, Homo Sapiens
EMCALLIIL

SEQ ID NO: 924343 - protein, 9 aa, Homo Sapiens
HQPACSLQS

SEQ ID NO: 924344 - protein, 9 aa, Homo Sapiens
AQKELIKSQ

SEQ ID NO: 924345 - protein, 9 aa, Homo Sapiens
EKSRWSGSH

SEQ ID NO: 924346 - protein, 9 aa, Homo Sapiens
NEMCALLII

SEQ ID NO: 924347 - protein, 9 aa, Homo Sapiens
LGLSYNGLL

SEQ ID NO: 924348 - protein, 9 aa, Homo Sapiens
DNAHCSVLP

SEQ ID NO: 924349 - protein, 9 aa, Homo Sapiens
VNGFFNDGR

SEQ ID NO: 924350 - protein, 9 aa, Homo Sapiens
VSKKKKKPG

SEQ ID NO: 924351 - protein, 9 aa, Homo Sapiens
CGNGLFVAF

SEQ ID NO: 924352 - protein, 9 aa, Homo Sapiens
LLFVSNRTT

SEQ ID NO: 924353 - protein, 9 aa, Homo Sapiens
YIHLANVLH

SEQ ID NO: 924354 - protein, 9 aa, Homo Sapiens
RSPETCAFP

SEQ ID NO: 924355 - protein, 9 aa, Homo Sapiens
LMFAGRKLI

SEQ ID NO: 924356 - protein, 9 aa, Homo Sapiens
FMNVLGAFD

SEQ ID NO: 924357 - protein, 9 aa, Homo Sapiens
REKPHACLL

SEQ ID NO: 924358 - protein, 9 aa, Homo Sapiens
VSLVDGRSV

SEQ ID NO: 924359 - protein, 9 aa, Homo Sapiens
KAERASSPC

SEQ ID NO: 924360 - protein, 9 aa, Homo Sapiens
NSESFLDCQ

SEQ ID NO: 924361 - protein, 9 aa, Homo Sapiens
DPNICDSRG

SEQ ID NO: 924362 - protein, 9 aa, Homo Sapiens
TLSTTSVDS

SEQ ID NO: 924363 - protein, 9 aa, Homo Sapiens
DKKENKNKI

SEQ ID NO: 924364 - protein, 9 aa, Homo Sapiens
FHPNLEMTE

SEQ ID NO: 924365 - protein, 9 aa, Homo Sapiens
DMGPETDPQ

SEQ ID NO: 924366 - protein, 9 aa, Homo Sapiens
YSGGLSTIS

SEQ ID NO: 924367 - protein, 9 aa, Homo Sapiens
LNVSFNSES

SEQ ID NO: 924368 - protein, 9 aa, Homo Sapiens
ANGQVTCFL

SEQ ID NO: 924369 - protein, 9 aa, Homo Sapiens
EALSSPISG

SEQ ID NO: 924370 - protein, 9 aa, Homo Sapiens
LKNSLKKAQ

SEQ ID NO: 924371 - protein, 9 aa, Homo Sapiens
GINLQQMPY

SEQ ID NO: 924372 - protein, 9 aa, Homo Sapiens
INARYQTQP

SEQ ID NO: 924373 - protein, 9 aa, Homo Sapiens
GLKYIHLAN

SEQ ID NO: 924374 - protein, 9 aa, Homo Sapiens
NQNLIKEVN

SEQ ID NO: 924375 - protein, 9 aa, Homo Sapiens
RGSEKVLPP

SEQ ID NO: 924376 - protein, 9 aa, Homo Sapiens
IRAALDTIQ

SEQ ID NO: 924377 - protein, 9 aa, Homo Sapiens
LSARLSNES

SEQ ID NO: 924378 - protein, 9 aa, Homo Sapiens
CRGSKRGCV

SEQ ID NO: 924379 - protein, 9 aa, Homo Sapiens
SFPGSRKLQ

SEQ ID NO: 924380 - protein, 9 aa, Homo Sapiens
GSVLEETSA

SEQ ID NO: 924381 - protein, 9 aa, Homo Sapiens
PHRLDTEAS

SEQ ID NO: 924382 - protein, 9 aa, Homo Sapiens
DKQLSFEVF

SEQ ID NO: 924383 - protein, 9 aa, Homo Sapiens
QTKNYDIRA

SEQ ID NO: 924384 - protein, 9 aa, Homo Sapiens
EEYIFVIFD

SEQ ID NO: 924385 - protein, 9 aa, Homo Sapiens
QAEAPVGIN

SEQ ID NO: 924386 - protein, 9 aa, Homo Sapiens
RLESAGGLG

SEQ ID NO: 924387 - protein, 9 aa, Homo Sapiens
GLHEDLNWV

SEQ ID NO: 924388 - protein, 9 aa, Homo Sapiens
LQRYLAVHS

SEQ ID NO: 924389 - protein, 9 aa, Homo Sapiens
KDSDKMMIH

SEQ ID NO: 924390 - protein, 9 aa, Homo Sapiens
ALKNSLKKA

SEQ ID NO: 924391 - protein, 9 aa, Homo Sapiens
KVTELKIQN

SEQ ID NO: 924392 - protein, 9 aa, Homo Sapiens
MADTSVGWS

SEQ ID NO: 924393 - protein, 9 aa, Homo Sapiens
LWSDGGPHK

SEQ ID NO: 924394 - protein, 9 aa, Homo Sapiens
GFKMDRQGV

SEQ ID NO: 924395 - protein, 9 aa, Homo Sapiens
GVWQVRHLK

SEQ ID NO: 924396 - protein, 9 aa, Homo Sapiens
RSVLMLPNG

SEQ ID NO: 924397 - protein, 9 aa, Homo Sapiens
FGGKHEALS

SEQ ID NO: 924398 - protein, 9 aa, Homo Sapiens
SNPYRRLLI

SEQ ID NO: 924399 - protein, 9 aa, Homo Sapiens
ESDRLENGM

SEQ ID NO: 924400 - protein, 9 aa, Homo Sapiens
VPCTQEQDH

SEQ ID NO: 924401 - protein, 9 aa, Homo Sapiens
WSNFFLQEK

SEQ ID NO: 924402 - protein, 9 aa, Homo Sapiens
PVLSSLEYR

SEQ ID NO: 924403 - protein, 9 aa, Homo Sapiens
NFPMKGRKE

SEQ ID NO: 924404 - protein, 9 aa, Homo Sapiens
SPQASFLPL

SEQ ID NO: 924405 - protein, 9 aa, Homo Sapiens
LLKTVKVVE

SEQ ID NO: 924406 - protein, 9 aa, Homo Sapiens
GVFLVILWL

SEQ ID NO: 924407 - protein, 9 aa, Homo Sapiens
RSRTFPKEL

SEQ ID NO: 924408 - protein, 9 aa, Homo Sapiens
KGPITKSDG

SEQ ID NO: 924409 - protein, 9 aa, Homo Sapiens
RPSALLFVA

SEQ ID NO: 924410 - protein, 9 aa, Homo Sapiens
FIKIQVVDV

SEQ ID NO: 924411 - protein, 9 aa, Homo Sapiens
DTRQRRINA

SEQ ID NO: 924412 - protein, 9 aa, Homo Sapiens
YERLFELIL

SEQ ID NO: 924413 - protein, 9 aa, Homo Sapiens
PQGDINSFS

SEQ ID NO: 924414 - protein, 9 aa, Homo Sapiens
VANFILLRL

SEQ ID NO: 924415 - protein, 9 aa, Homo Sapiens
YDSNAVGKP

SEQ ID NO: 924416 - protein, 9 aa, Homo Sapiens
YVYSTLTMN

SEQ ID NO: 924417 - protein, 9 aa, Homo Sapiens
YKSSTNGAS

SEQ ID NO: 924418 - protein, 9 aa, Homo Sapiens
MNHGENLKT

SEQ ID NO: 924419 - protein, 9 aa, Homo Sapiens
PSRKYISNK

SEQ ID NO: 924420 - protein, 9 aa, Homo Sapiens
GKTNEQSLH

SEQ ID NO: 924421 - protein, 9 aa, Homo Sapiens
FFDELEAVS

SEQ ID NO: 924422 - protein, 9 aa, Homo Sapiens
RINARYQTQ

SEQ ID NO: 924423 - protein, 9 aa, Homo Sapiens
GVGTSGRIK

SEQ ID NO: 924424 - protein, 9 aa, Homo Sapiens
TLLRENHES

SEQ ID NO: 924425 - protein, 9 aa, Homo Sapiens
SLEENKLIG

SEQ ID NO: 924426 - protein, 9 aa, Homo Sapiens
TKEATNIIC

SEQ ID NO: 924427 - protein, 9 aa, Homo Sapiens
GLENMGRFG

SEQ ID NO: 924428 - protein, 9 aa, Homo Sapiens
QSQGSRLRQ

SEQ ID NO: 924429 - protein, 9 aa, Homo Sapiens
LGPNMRGFL

SEQ ID NO: 924430 - protein, 9 aa, Homo Sapiens
TFGNVLKFI

SEQ ID NO: 924431 - protein, 9 aa, Homo Sapiens
PFPGDSYSY

SEQ ID NO: 924432 - protein, 9 aa, Homo Sapiens
RQWQKKLCE

SEQ ID NO: 924433 - protein, 9 aa, Homo Sapiens
DQTEQCVPC

SEQ ID NO: 924434 - protein, 9 aa, Homo Sapiens
EQGKKASTA

SEQ ID NO: 924435 - protein, 9 aa, Homo Sapiens
PETILTETP

SEQ ID NO: 924436 - protein, 9 aa, Homo Sapiens
KVSSLALVF

SEQ ID NO: 924437 - protein, 9 aa, Homo Sapiens
QQLAEKELG

SEQ ID NO: 924438 - protein, 9 aa, Homo Sapiens
RDVSKKLVG

SEQ ID NO: 924439 - protein, 9 aa, Homo Sapiens
QGLMGVPLG

SEQ ID NO: 924440 - protein, 9 aa, Homo Sapiens
GGPHKIDHQ

SEQ ID NO: 924441 - protein, 9 aa, Homo Sapiens
SADSSSPAV

SEQ ID NO: 924442 - protein, 9 aa, Homo Sapiens
YCFSFLSTV

SEQ ID NO: 924443 - protein, 9 aa, Homo Sapiens
FDCAYRKQM

SEQ ID NO: 924444 - protein, 9 aa, Homo Sapiens
IDASSEVER

SEQ ID NO: 924445 - protein, 9 aa, Homo Sapiens
YSKLPEDGV

SEQ ID NO: 924446 - protein, 9 aa, Homo Sapiens
DQYFIGGPQ

SEQ ID NO: 924447 - protein, 9 aa, Homo Sapiens
NSTFEDQYF

SEQ ID NO: 924448 - protein, 9 aa, Homo Sapiens
ARRLDSTEP

SEQ ID NO: 924449 - protein, 9 aa, Homo Sapiens
PQGSPSGPQ

SEQ ID NO: 924450 - protein, 9 aa, Homo Sapiens
ALSSPISGQ

SEQ ID NO: 924451 - protein, 9 aa, Homo Sapiens
SEDNDKKEN

SEQ ID NO: 924452 - protein, 9 aa, Homo Sapiens
DGRSVLMLP

SEQ ID NO: 924453 - protein, 9 aa, Homo Sapiens
NFSFLEIFF

SEQ ID NO: 924454 - protein, 9 aa, Homo Sapiens
SVFPVILLL

SEQ ID NO: 924455 - protein, 9 aa, Homo Sapiens
GPHKIDHQE

SEQ ID NO: 924456 - protein, 9 aa, Homo Sapiens
QLNQNLIKE

SEQ ID NO: 924457 - protein, 9 aa, Homo Sapiens
ESFSAPSLT

SEQ ID NO: 924458 - protein, 9 aa, Homo Sapiens
NICEFENKH

SEQ ID NO: 924459 - protein, 9 aa, Homo Sapiens
HITAHDSDE

SEQ ID NO: 924460 - protein, 9 aa, Homo Sapiens
YRTEPSPGQ

SEQ ID NO: 924461 - protein, 9 aa, Homo Sapiens
NQRSLLYGE

SEQ ID NO: 924462 - protein, 9 aa, Homo Sapiens
VYYLVIESK

SEQ ID NO: 924463 - protein, 9 aa, Homo Sapiens
CHYLKNSLH

SEQ ID NO: 924464 - protein, 9 aa, Homo Sapiens
ARHGFQKKP

SEQ ID NO: 924465 - protein, 9 aa, Homo Sapiens
KIQVVDVDE

SEQ ID NO: 924466 - protein, 9 aa, Homo Sapiens
RRLLIDQVV

SEQ ID NO: 924467 - protein, 9 aa, Homo Sapiens
SGGLHRPHS

SEQ ID NO: 924468 - protein, 9 aa, Homo Sapiens
ADGEYHQPA

SEQ ID NO: 924469 - protein, 9 aa, Homo Sapiens
SNFFLQEKN

SEQ ID NO: 924470 - protein, 9 aa, Homo Sapiens
EFKLFIKRL

SEQ ID NO: 924471 - protein, 9 aa, Homo Sapiens
EKVPCTQEQ

SEQ ID NO: 924472 - protein, 9 aa, Homo Sapiens
LGQQQQTLP

SEQ ID NO: 924473 - protein, 9 aa, Homo Sapiens
GASEYVYYL

SEQ ID NO: 924474 - protein, 9 aa, Homo Sapiens
REKPYHCPD

SEQ ID NO: 924475 - protein, 9 aa, Homo Sapiens
FPLFQLLII

SEQ ID NO: 924476 - protein, 9 aa, Homo Sapiens
LALVFLESA

SEQ ID NO: 924477 - protein, 9 aa, Homo Sapiens
SLRSDQNRR

SEQ ID NO: 924478 - protein, 9 aa, Homo Sapiens
LYEAGKTAK

SEQ ID NO: 924479 - protein, 9 aa, Homo Sapiens
GRVWRATFS

SEQ ID NO: 924480 - protein, 9 aa, Homo Sapiens
CADTSISCG

SEQ ID NO: 924481 - protein, 9 aa, Homo Sapiens
ENICEFENK

SEQ ID NO: 924482 - protein, 9 aa, Homo Sapiens
LEFCASVLE

SEQ ID NO: 924483 - protein, 9 aa, Homo Sapiens
FIGGPQEQI

SEQ ID NO: 924484 - protein, 9 aa, Homo Sapiens
KKEISRVLC

SEQ ID NO: 924485 - protein, 9 aa, Homo Sapiens
LAMGLQLNF

SEQ ID NO: 924486 - protein, 9 aa, Homo Sapiens
APVLLLCLS

SEQ ID NO: 924487 - protein, 9 aa, Homo Sapiens
SSLEYRTEP

SEQ ID NO: 924488 - protein, 9 aa, Homo Sapiens
ISHFGRMMF

SEQ ID NO: 924489 - protein, 9 aa, Homo Sapiens
RAKKHLIMT

SEQ ID NO: 924490 - protein, 9 aa, Homo Sapiens
MKFRDHVGV

SEQ ID NO: 924491 - protein, 9 aa, Homo Sapiens
ETCAFPWKA

SEQ ID NO: 924492 - protein, 9 aa, Homo Sapiens
GLYRVRISR

SEQ ID NO: 924493 - protein, 9 aa, Homo Sapiens
LRGLKYIHL

SEQ ID NO: 924494 - protein, 9 aa, Homo Sapiens
HRKSHIRYG

SEQ ID NO: 924495 - protein, 9 aa, Homo Sapiens
WSDGGPHKI

SEQ ID NO: 924496 - protein, 9 aa, Homo Sapiens
RHLMQECFI

SEQ ID NO: 924497 - protein, 9 aa, Homo Sapiens
QTLEKNLKE

SEQ ID NO: 924498 - protein, 9 aa, Homo Sapiens
PCQVYMNHG

SEQ ID NO: 924499 - protein, 9 aa, Homo Sapiens
AFDGEEHLI

SEQ ID NO: 924500 - protein, 9 aa, Homo Sapiens
YRRLLIDQV

SEQ ID NO: 924501 - protein, 9 aa, Homo Sapiens
LAQKRNAYW

SEQ ID NO: 924502 - protein, 9 aa, Homo Sapiens
FQQQLAEKE

SEQ ID NO: 924503 - protein, 9 aa, Homo Sapiens
DSSALSSLR

SEQ ID NO: 924504 - protein, 9 aa, Homo Sapiens
KVLPPLTRI

SEQ ID NO: 924505 - protein, 9 aa, Homo Sapiens
DEEYIFVIF

SEQ ID NO: 924506 - protein, 9 aa, Homo Sapiens
CYEMKKFLF

SEQ ID NO: 924507 - protein, 9 aa, Homo Sapiens
VDVDEPPLF

SEQ ID NO: 924508 - protein, 9 aa, Homo Sapiens
SKLTQPKLV

SEQ ID NO: 924509 - protein, 9 aa, Homo Sapiens
QLNFCDSNV

SEQ ID NO: 924510 - protein, 9 aa, Homo Sapiens
SENTMLLFV

SEQ ID NO: 924511 - protein, 9 aa, Homo Sapiens
TPKAERASS

SEQ ID NO: 924512 - protein, 9 aa, Homo Sapiens
QISLVAQNK

SEQ ID NO: 924513 - protein, 9 aa, Homo Sapiens
RVWRATFSQ

SEQ ID NO: 924514 - protein, 9 aa, Homo Sapiens
FLEIFFTNI

SEQ ID NO: 924515 - protein, 9 aa, Homo Sapiens
TYFICGLER

SEQ ID NO: 924516 - protein, 9 aa, Homo Sapiens
FFLRTTALA

SEQ ID NO: 924517 - protein, 9 aa, Homo Sapiens
EDVRSDFQC

SEQ ID NO: 924518 - protein, 9 aa, Homo Sapiens
QNNAPMAVF

SEQ ID NO: 924519 - protein, 9 aa, Homo Sapiens
GFPGKTGPR

SEQ ID NO: 924520 - protein, 9 aa, Homo Sapiens
SRRPGALDG

SEQ ID NO: 924521 - protein, 9 aa, Homo Sapiens
TQPKLVVSA

SEQ ID NO: 924522 - protein, 9 aa, Homo Sapiens
VVDVDEPPL

SEQ ID NO: 924523 - protein, 9 aa, Homo Sapiens
PSDIDASSE

SEQ ID NO: 924524 - protein, 9 aa, Homo Sapiens
STTSVDSNS

SEQ ID NO: 924525 - protein, 9 aa, Homo Sapiens
EGKSFICQS

SEQ ID NO: 924526 - protein, 9 aa, Homo Sapiens
AVTRAKKHL

SEQ ID NO: 924527 - protein, 9 aa, Homo Sapiens
DSKFFEKKV

SEQ ID NO: 924528 - protein, 9 aa, Homo Sapiens
SESFLDCQI

SEQ ID NO: 924529 - protein, 9 aa, Homo Sapiens
ALAQKRNAY

SEQ ID NO: 924530 - protein, 9 aa, Homo Sapiens
PILEQDSEH

SEQ ID NO: 924531 - protein, 9 aa, Homo Sapiens
TERPANSSK

SEQ ID NO: 924532 - protein, 9 aa, Homo Sapiens
EIVTAAINE

SEQ ID NO: 924533 - protein, 9 aa, Homo Sapiens
KEEILKTTY

SEQ ID NO: 924534 - protein, 9 aa, Homo Sapiens
LRLTDDPQL

SEQ ID NO: 924535 - protein, 9 aa, Homo Sapiens
QGTYYHDQT

SEQ ID NO: 924536 - protein, 9 aa, Homo Sapiens
TTFIKIQVV

SEQ ID NO: 924537 - protein, 9 aa, Homo Sapiens
QLSPYKQSE

SEQ ID NO: 924538 - protein, 9 aa, Homo Sapiens
DGLHEDLNW

SEQ ID NO: 924539 - protein, 9 aa, Homo Sapiens
SSSQVKRED

SEQ ID NO: 924540 - protein, 9 aa, Homo Sapiens
FILLRLTDD

SEQ ID NO: 924541 - protein, 9 aa, Homo Sapiens
QARSFRLYT

SEQ ID NO: 924542 - protein, 9 aa, Homo Sapiens
LSFIATCVY

SEQ ID NO: 924543 - protein, 9 aa, Homo Sapiens
QLNQVAYDS

SEQ ID NO: 924544 - protein, 9 aa, Homo Sapiens
QDLFQKLFR

SEQ ID NO: 924545 - protein, 9 aa, Homo Sapiens
SAASKGAPA

SEQ ID NO: 924546 - protein, 9 aa, Homo Sapiens
ENSVRVKWD

SEQ ID NO: 924547 - protein, 9 aa, Homo Sapiens
KHEALSSPI

SEQ ID NO: 924548 - protein, 9 aa, Homo Sapiens
LSEGVFLAE

SEQ ID NO: 924549 - protein, 9 aa, Homo Sapiens
SYEVLGGAL

SEQ ID NO: 924550 - protein, 9 aa, Homo Sapiens
INLQQMPYP

SEQ ID NO: 924551 - protein, 9 aa, Homo Sapiens
DAVIYKNGF

SEQ ID NO: 924552 - protein, 9 aa, Homo Sapiens
ENRLVSQDL

SEQ ID NO: 924553 - protein, 9 aa, Homo Sapiens
GESIGKKEV

SEQ ID NO: 924554 - protein, 9 aa, Homo Sapiens
APKSLPEFS

SEQ ID NO: 924555 - protein, 9 aa, Homo Sapiens
KLKGVTKNL

SEQ ID NO: 924556 - protein, 9 aa, Homo Sapiens
ASLLPVSSP

SEQ ID NO: 924557 - protein, 9 aa, Homo Sapiens
SRDRAPRDR

SEQ ID NO: 924558 - protein, 9 aa, Homo Sapiens
ESDEFKLFI

SEQ ID NO: 924559 - protein, 9 aa, Homo Sapiens
LVTTDPLVP

SEQ ID NO: 924560 - protein, 9 aa, Homo Sapiens
SVLLQAFDR

SEQ ID NO: 924561 - protein, 9 aa, Homo Sapiens
GVTKNLEDV

SEQ ID NO: 924562 - protein, 9 aa, Homo Sapiens
QFGDRESSS

SEQ ID NO: 924563 - protein, 9 aa, Homo Sapiens
HCSTKDKEE

SEQ ID NO: 924564 - protein, 9 aa, Homo Sapiens
MFAGRKLIF

SEQ ID NO: 924565 - protein, 9 aa, Homo Sapiens
SCSDSVCYS

SEQ ID NO: 924566 - protein, 9 aa, Homo Sapiens
EASYCGPSS

SEQ ID NO: 924567 - protein, 9 aa, Homo Sapiens
IPGKKGPAG

SEQ ID NO: 924568 - protein, 9 aa, Homo Sapiens
CQVYMNHGE

SEQ ID NO: 924569 - protein, 9 aa, Homo Sapiens
NRLVSQDLM

SEQ ID NO: 924570 - protein, 9 aa, Homo Sapiens
NVGYVFFFN

SEQ ID NO: 924571 - protein, 9 aa, Homo Sapiens
GGCGSCRGS

SEQ ID NO: 924572 - protein, 9 aa, Homo Sapiens
RLVSQDLMQ

SEQ ID NO: 924573 - protein, 9 aa, Homo Sapiens
DSNAVGKPE

SEQ ID NO: 924574 - protein, 9 aa, Homo Sapiens
STEPIRTPI

SEQ ID NO: 924575 - protein, 9 aa, Homo Sapiens
KHLIMTKSL

SEQ ID NO: 924576 - protein, 9 aa, Homo Sapiens
KSFICQSEV

SEQ ID NO: 924577 - protein, 9 aa, Homo Sapiens
EGSLGAMLR

SEQ ID NO: 924578 - protein, 9 aa, Homo Sapiens
WLVYFPLFQ

SEQ ID NO: 924579 - protein, 9 aa, Homo Sapiens
TNVGYVFFF

SEQ ID NO: 924580 - protein, 9 aa, Homo Sapiens
CTCLNETIQ

SEQ ID NO: 924581 - protein, 9 aa, Homo Sapiens
RQSSERGRL

SEQ ID NO: 924582 - protein, 9 aa, Homo Sapiens
LLYGEDEAA

SEQ ID NO: 924583 - protein, 9 aa, Homo Sapiens
GMIAWLGTR

SEQ ID NO: 924584 - protein, 9 aa, Homo Sapiens
LVSQDLMQK

SEQ ID NO: 924585 - protein, 9 aa, Homo Sapiens
FLRTTALAF

SEQ ID NO: 924586 - protein, 9 aa, Homo Sapiens
EKLKELTMD

SEQ ID NO: 924587 - protein, 9 aa, Homo Sapiens
GWNMKKQRF

SEQ ID NO: 924588 - protein, 9 aa, Homo Sapiens
SQGEANFAP

SEQ ID NO: 924589 - protein, 9 aa, Homo Sapiens
QDYERLFEL

SEQ ID NO: 924590 - protein, 9 aa, Homo Sapiens
SCRGSKRGC

SEQ ID NO: 924591 - protein, 9 aa, Homo Sapiens
NAPMAVFFD

SEQ ID NO: 924592 - protein, 9 aa, Homo Sapiens
WVKKKPYLE

SEQ ID NO: 924593 - protein, 9 aa, Homo Sapiens
GLQIDVKGP

SEQ ID NO: 924594 - protein, 9 aa, Homo Sapiens
RRALTELGS

SEQ ID NO: 924595 - protein, 9 aa, Homo Sapiens
ASVLEIAAQ

SEQ ID NO: 924596 - protein, 9 aa, Homo Sapiens
IQPSELHPM

SEQ ID NO: 924597 - protein, 9 aa, Homo Sapiens
WGTVCKKRV

SEQ ID NO: 924598 - protein, 9 aa, Homo Sapiens
SLKGFKMDR

SEQ ID NO: 924599 - protein, 9 aa, Homo Sapiens
KPEAETLES

SEQ ID NO: 924600 - protein, 9 aa, Homo Sapiens
RELKGEKGE

SEQ ID NO: 924601 - protein, 9 aa, Homo Sapiens
GKESGADRA

SEQ ID NO: 924602 - protein, 9 aa, Homo Sapiens
LNSTSSEET

SEQ ID NO: 924603 - protein, 9 aa, Homo Sapiens
YVIGENRLV

SEQ ID NO: 924604 - protein, 9 aa, Homo Sapiens
ARLSNESFS

SEQ ID NO: 924605 - protein, 9 aa, Homo Sapiens
RASTSPRNQ

SEQ ID NO: 924606 - protein, 9 aa, Homo Sapiens
LKGFKMDRQ

SEQ ID NO: 924607 - protein, 9 aa, Homo Sapiens
RARKKLNGT

SEQ ID NO: 924608 - protein, 9 aa, Homo Sapiens
MLKIEEWTQ

SEQ ID NO: 924609 - protein, 9 aa, Homo Sapiens
RQRRINARY

SEQ ID NO: 924610 - protein, 9 aa, Homo Sapiens
KNVLAFTCE

SEQ ID NO: 924611 - protein, 9 aa, Homo Sapiens
IIFGERQGM

SEQ ID NO: 924612 - protein, 9 aa, Homo Sapiens
KLFIKRLPM

SEQ ID NO: 924613 - protein, 9 aa, Homo Sapiens
GDSKMADTS

SEQ ID NO: 924614 - protein, 9 aa, Homo Sapiens
GLSARLSNE

SEQ ID NO: 924615 - protein, 9 aa, Homo Sapiens
SFFKNFGLY

SEQ ID NO: 924616 - protein, 9 aa, Homo Sapiens
LAEKELGLP

SEQ ID NO: 924617 - protein, 9 aa, Homo Sapiens
IYECDDCGL

SEQ ID NO: 924618 - protein, 9 aa, Homo Sapiens
GSCNCKKCK

SEQ ID NO: 924619 - protein, 9 aa, Homo Sapiens
HLATWLVPS

SEQ ID NO: 924620 - protein, 9 aa, Homo Sapiens
FTPSYMFWN

SEQ ID NO: 924621 - protein, 9 aa, Homo Sapiens
HLMQECFIK

SEQ ID NO: 924622 - protein, 9 aa, Homo Sapiens
PSSTFQEQL

SEQ ID NO: 924623 - protein, 9 aa, Homo Sapiens
RLAVSFVLK

SEQ ID NO: 924624 - protein, 9 aa, Homo Sapiens
VLEIAAQEE

SEQ ID NO: 924625 - protein, 9 aa, Homo Sapiens
KTTYFICGL

SEQ ID NO: 924626 - protein, 9 aa, Homo Sapiens
KGSVLEETS

SEQ ID NO: 924627 - protein, 9 aa, Homo Sapiens
IHIREKPHA

SEQ ID NO: 924628 - protein, 9 aa, Homo Sapiens
QPGPSPRWT

SEQ ID NO: 924629 - protein, 9 aa, Homo Sapiens
GVFSSAYQI

SEQ ID NO: 924630 - protein, 9 aa, Homo Sapiens
ADNAHCSVL

SEQ ID NO: 924631 - protein, 9 aa, Homo Sapiens
FQEQLTPST

SEQ ID NO: 924632 - protein, 9 aa, Homo Sapiens
LVYFPLFQL

SEQ ID NO: 924633 - protein, 9 aa, Homo Sapiens
QLMNLYQLK

SEQ ID NO: 924634 - protein, 9 aa, Homo Sapiens
GVKGDKGFP

SEQ ID NO: 924635 - protein, 9 aa, Homo Sapiens
IGVWQVRHL

SEQ ID NO: 924636 - protein, 9 aa, Homo Sapiens
LQIDVKGPK

SEQ ID NO: 924637 - protein, 9 aa, Homo Sapiens
LLLCLSREA

SEQ ID NO: 924638 - protein, 9 aa, Homo Sapiens
SEAFDCAYR

SEQ ID NO: 924639 - protein, 9 aa, Homo Sapiens
SYRCGDCGK

SEQ ID NO: 924640 - protein, 9 aa, Homo Sapiens
VPLCSGQEQ

SEQ ID NO: 924641 - protein, 9 aa, Homo Sapiens
PSRGASYLK

SEQ ID NO: 924642 - protein, 9 aa, Homo Sapiens
DPEATQFII

SEQ ID NO: 924643 - protein, 9 aa, Homo Sapiens
VDDPKDPLI

SEQ ID NO: 924644 - protein, 9 aa, Homo Sapiens
VCCSADQQE

SEQ ID NO: 924645 - protein, 9 aa, Homo Sapiens
KILIRLMYS

SEQ ID NO: 924646 - protein, 9 aa, Homo Sapiens
SSERGRLPS

SEQ ID NO: 924647 - protein, 9 aa, Homo Sapiens
PKVDLKGLQ

SEQ ID NO: 924648 - protein, 9 aa, Homo Sapiens
STGNWSLKG

SEQ ID NO: 924649 - protein, 9 aa, Homo Sapiens
QGENQSQGP

SEQ ID NO: 924650 - protein, 9 aa, Homo Sapiens
QGPSTPKAE

SEQ ID NO: 924651 - protein, 9 aa, Homo Sapiens
LEENKLIGK

SEQ ID NO: 924652 - protein, 9 aa, Homo Sapiens
VSCHYLKNS

SEQ ID NO: 924653 - protein, 9 aa, Homo Sapiens
YEPVFTNIS

SEQ ID NO: 924654 - protein, 9 aa, Homo Sapiens
NLEMTERPA

SEQ ID NO: 924655 - protein, 9 aa, Homo Sapiens
KKVTELKIQ

SEQ ID NO: 924656 - protein, 9 aa, Homo Sapiens
STFEDQYFI

SEQ ID NO: 924657 - protein, 9 aa, Homo Sapiens
VGIHLLLLV

SEQ ID NO: 924658 - protein, 9 aa, Homo Sapiens
EGPFGGGLE

SEQ ID NO: 924659 - protein, 9 aa, Homo Sapiens
ACVFIGIND

SEQ ID NO: 924660 - protein, 9 aa, Homo Sapiens
LMKRNKREE

SEQ ID NO: 924661 - protein, 9 aa, Homo Sapiens
EFSEAKTPF

SEQ ID NO: 924662 - protein, 9 aa, Homo Sapiens
IRYGAFCCA

SEQ ID NO: 924663 - protein, 9 aa, Homo Sapiens
QQEGDDVQQ

SEQ ID NO: 924664 - protein, 9 aa, Homo Sapiens
VELYDSNAV

SEQ ID NO: 924665 - protein, 9 aa, Homo Sapiens
MTERPANSS

SEQ ID NO: 924666 - protein, 9 aa, Homo Sapiens
GFEAKAEKC

SEQ ID NO: 924667 - protein, 9 aa, Homo Sapiens
LNTLKAGEI

SEQ ID NO: 924668 - protein, 9 aa, Homo Sapiens
GANGQVTCF

SEQ ID NO: 924669 - protein, 9 aa, Homo Sapiens
ERSYRCGDC

SEQ ID NO: 924670 - protein, 9 aa, Homo Sapiens
FDPNICDSR

SEQ ID NO: 924671 - protein, 9 aa, Homo Sapiens
MEQFYQLMN

SEQ ID NO: 924672 - protein, 9 aa, Homo Sapiens
INLSASTMD

SEQ ID NO: 924673 - protein, 9 aa, Homo Sapiens
KLQVNISQQ

SEQ ID NO: 924674 - protein, 9 aa, Homo Sapiens
DAYQGPPSQ

SEQ ID NO: 924675 - protein, 9 aa, Homo Sapiens
NKAIPEKYG

SEQ ID NO: 924676 - protein, 9 aa, Homo Sapiens
FLLNGFPGL

SEQ ID NO: 924677 - protein, 9 aa, Homo Sapiens
MKGRKEMVD

SEQ ID NO: 924678 - protein, 9 aa, Homo Sapiens
DCSVLCGGG

SEQ ID NO: 924679 - protein, 9 aa, Homo Sapiens
KTTDKCINL

SEQ ID NO: 924680 - protein, 9 aa, Homo Sapiens
LRSDQNRRE

SEQ ID NO: 924681 - protein, 9 aa, Homo Sapiens
KYDTIKQVL

SEQ ID NO: 924682 - protein, 9 aa, Homo Sapiens
ATAEGNSSR

SEQ ID NO: 924683 - protein, 9 aa, Homo Sapiens
GVMITKFYF

SEQ ID NO: 924684 - protein, 9 aa, Homo Sapiens
FNEMCALLI

SEQ ID NO: 924685 - protein, 9 aa, Homo Sapiens
VRPALKNSL

SEQ ID NO: 924686 - protein, 9 aa, Homo Sapiens
FSEAKTPFP

SEQ ID NO: 924687 - protein, 9 aa, Homo Sapiens
PEHGAALSY

SEQ ID NO: 924688 - protein, 9 aa, Homo Sapiens
VAPRVPSIF

SEQ ID NO: 924689 - protein, 9 aa, Homo Sapiens
LVFLVTTDP

SEQ ID NO: 924690 - protein, 9 aa, Homo Sapiens
GTWSLEENK

SEQ ID NO: 924691 - protein, 9 aa, Homo Sapiens
PYKQSEILG

SEQ ID NO: 924692 - protein, 9 aa, Homo Sapiens
LESAGGLGS

SEQ ID NO: 924693 - protein, 9 aa, Homo Sapiens
VTRAKKHLI

SEQ ID NO: 924694 - protein, 9 aa, Homo Sapiens
EARGPNGSV

SEQ ID NO: 924695 - protein, 9 aa, Homo Sapiens
VCVDVDMKF

SEQ ID NO: 924696 - protein, 9 aa, Homo Sapiens
AFPDKGSVL

SEQ ID NO: 924697 - protein, 9 aa, Homo Sapiens
IGCETGKYL

SEQ ID NO: 924698 - protein, 9 aa, Homo Sapiens
LACVFIGIN

SEQ ID NO: 924699 - protein, 9 aa, Homo Sapiens
LGVGTSGRI

SEQ ID NO: 924700 - protein, 9 aa, Homo Sapiens
ATEKSRWSG

SEQ ID NO: 924701 - protein, 9 aa, Homo Sapiens
PLCSGQEQG

SEQ ID NO: 924702 - protein, 9 aa, Homo Sapiens
GPLEWNIPY

SEQ ID NO: 924703 - protein, 9 aa, Homo Sapiens
RGSKRGCVS

SEQ ID NO: 924704 - protein, 9 aa, Homo Sapiens
REGKSFICQ

SEQ ID NO: 924705 - protein, 9 aa, Homo Sapiens
LGHQPPFFH

SEQ ID NO: 924706 - protein, 9 aa, Homo Sapiens
ARLVFLVTT

SEQ ID NO: 924707 - protein, 9 aa, Homo Sapiens
FKLFIKRLP

SEQ ID NO: 924708 - protein, 9 aa, Homo Sapiens
QDSKFFEKK

SEQ ID NO: 924709 - protein, 9 aa, Homo Sapiens
ISRVLCKRC

SEQ ID NO: 924710 - protein, 9 aa, Homo Sapiens
ERRKFGPLE

SEQ ID NO: 924711 - protein, 9 aa, Homo Sapiens
GENTAAPQV

SEQ ID NO: 924712 - protein, 9 aa, Homo Sapiens
RSLPCQVYM

SEQ ID NO: 924713 - protein, 9 aa, Homo Sapiens
VTPALNLLI

SEQ ID NO: 924714 - protein, 9 aa, Homo Sapiens
LPEFSEAKT

SEQ ID NO: 924715 - protein, 9 aa, Homo Sapiens
ASEYVYYLV

SEQ ID NO: 924716 - protein, 9 aa, Homo Sapiens
NQLNEHAGW

SEQ ID NO: 924717 - protein, 9 aa, Homo Sapiens
ETSAEMKIR

SEQ ID NO: 924718 - protein, 9 aa, Homo Sapiens
CHPDKEGAS

SEQ ID NO: 924719 - protein, 9 aa, Homo Sapiens
PVVQMPAKV

SEQ ID NO: 924720 - protein, 9 aa, Homo Sapiens
HKIDHQEHP

SEQ ID NO: 924721 - protein, 9 aa, Homo Sapiens
HYLKNSLHV

SEQ ID NO: 924722 - protein, 9 aa, Homo Sapiens
YYLVIESKH

SEQ ID NO: 924723 - protein, 9 aa, Homo Sapiens
SAPPVLSAD

SEQ ID NO: 924724 - protein, 9 aa, Homo Sapiens
TDKIANLVP

SEQ ID NO: 924725 - protein, 9 aa, Homo Sapiens
CQVYDMGPE

SEQ ID NO: 924726 - protein, 9 aa, Homo Sapiens
AEAGITVLD

SEQ ID NO: 924727 - protein, 9 aa, Homo Sapiens
TCEPVHCPA

SEQ ID NO: 924728 - protein, 9 aa, Homo Sapiens
SGIYFVYSK

SEQ ID NO: 924729 - protein, 9 aa, Homo Sapiens
CELGMKQFS

SEQ ID NO: 924730 - protein, 9 aa, Homo Sapiens
YGDKYDTIK

SEQ ID NO: 924731 - protein, 9 aa, Homo Sapiens
VFSSAYQIE

SEQ ID NO: 924732 - protein, 9 aa, Homo Sapiens
LEETSAEEC

SEQ ID NO: 924733 - protein, 9 aa, Homo Sapiens
VAKDVNIFF

SEQ ID NO: 924734 - protein, 9 aa, Homo Sapiens
LLDVRAQLE

SEQ ID NO: 924735 - protein, 9 aa, Homo Sapiens
APPVLSADS

SEQ ID NO: 924736 - protein, 9 aa, Homo Sapiens
ELYDSNAVG

SEQ ID NO: 924737 - protein, 9 aa, Homo Sapiens
NGFFIHSVP

SEQ ID NO: 924738 - protein, 9 aa, Homo Sapiens
EYVYYLVIE

SEQ ID NO: 924739 - protein, 9 aa, Homo Sapiens
NQDYERLFE

SEQ ID NO: 924740 - protein, 9 aa, Homo Sapiens
DRSSRDRAP

SEQ ID NO: 924741 - protein, 9 aa, Homo Sapiens
PGPSPRWTG

SEQ ID NO: 924742 - protein, 9 aa, Homo Sapiens
TTNQFGDRE

SEQ ID NO: 924743 - protein, 9 aa, Homo Sapiens
IREKPHACL

SEQ ID NO: 924744 - protein, 9 aa, Homo Sapiens
STVTILSQY

SEQ ID NO: 924745 - protein, 9 aa, Homo Sapiens
PGVKGDKGF

SEQ ID NO: 924746 - protein, 9 aa, Homo Sapiens
RVVYSILQE

SEQ ID NO: 924747 - protein, 9 aa, Homo Sapiens
LHRPHSREH

SEQ ID NO: 924748 - protein, 9 aa, Homo Sapiens
MKRNKREEQ

SEQ ID NO: 924749 - protein, 9 aa, Homo Sapiens
SETPASLLP

SEQ ID NO: 924750 - protein, 9 aa, Homo Sapiens
DLGPNMRGF

SEQ ID NO: 924751 - protein, 9 aa, Homo Sapiens
KNSLKKAQL

SEQ ID NO: 924752 - protein, 9 aa, Homo Sapiens
KGVTKNLED

SEQ ID NO: 924753 - protein, 9 aa, Homo Sapiens
IKIQVVDVD

SEQ ID NO: 924754 - protein, 9 aa, Homo Sapiens
YTLELQKLE

SEQ ID NO: 924755 - protein, 9 aa, Homo Sapiens
SGKESGADR

SEQ ID NO: 924756 - protein, 9 aa, Homo Sapiens
TAAPQVLQS

SEQ ID NO: 924757 - protein, 9 aa, Homo Sapiens
PPPQGENQS

SEQ ID NO: 924758 - protein, 9 aa, Homo Sapiens
LRKAICTLR

SEQ ID NO: 924759 - protein, 9 aa, Homo Sapiens
LVFEVLVCD

SEQ ID NO: 924760 - protein, 9 aa, Homo Sapiens
AGRKLIFGG

SEQ ID NO: 924761 - protein, 9 aa, Homo Sapiens
PDEGVMITK

SEQ ID NO: 924762 - protein, 9 aa, Homo Sapiens
NAHCSVLPA

SEQ ID NO: 924763 - protein, 9 aa, Homo Sapiens
PSGTPMIPV

SEQ ID NO: 924764 - protein, 9 aa, Homo Sapiens
GQKAKMSNF

SEQ ID NO: 924765 - protein, 9 aa, Homo Sapiens
LDSTEPIRT

SEQ ID NO: 924766 - protein, 9 aa, Homo Sapiens
YGAFCCAIC

SEQ ID NO: 924767 - protein, 9 aa, Homo Sapiens
TSAEMKIRE

SEQ ID NO: 924768 - protein, 9 aa, Homo Sapiens
GVFLAERGS

SEQ ID NO: 924769 - protein, 9 aa, Homo Sapiens
THTGERSYR

SEQ ID NO: 924770 - protein, 9 aa, Homo Sapiens
SGFDPNICD

SEQ ID NO: 924771 - protein, 9 aa, Homo Sapiens
ALYEAGKTA

SEQ ID NO: 924772 - protein, 9 aa, Homo Sapiens
LSYNGLLGD

SEQ ID NO: 924773 - protein, 9 aa, Homo Sapiens
QASFLPLQC

SEQ ID NO: 924774 - protein, 9 aa, Homo Sapiens
DADRARKKL

SEQ ID NO: 924775 - protein, 9 aa, Homo Sapiens
RASGQTCEP

SEQ ID NO: 924776 - protein, 9 aa, Homo Sapiens
IGDFGLATE

SEQ ID NO: 924777 - protein, 9 aa, Homo Sapiens
SENWSPSAP

SEQ ID NO: 924778 - protein, 9 aa, Homo Sapiens
VTCFLMPHV

SEQ ID NO: 924779 - protein, 9 aa, Homo Sapiens
IRKRLNSTS

SEQ ID NO: 924780 - protein, 9 aa, Homo Sapiens
RKLVEHLHK

SEQ ID NO: 924781 - protein, 9 aa, Homo Sapiens
LANVLHRDL

SEQ ID NO: 924782 - protein, 9 aa, Homo Sapiens
FYARRSEIR

SEQ ID NO: 924783 - protein, 9 aa, Homo Sapiens
SPSGPQASQ

SEQ ID NO: 924784 - protein, 9 aa, Homo Sapiens
DKDTQEEII

SEQ ID NO: 924785 - protein, 9 aa, Homo Sapiens
DLRPSALLF

SEQ ID NO: 924786 - protein, 9 aa, Homo Sapiens
RYGAFCCAI

SEQ ID NO: 924787 - protein, 9 aa, Homo Sapiens
WPDAAFAEI

SEQ ID NO: 924788 - protein, 9 aa, Homo Sapiens
FPWKAESRS

SEQ ID NO: 924789 - protein, 9 aa, Homo Sapiens
TRQRRINAR

SEQ ID NO: 924790 - protein, 9 aa, Homo Sapiens
SAPSDIDAS

SEQ ID NO: 924791 - protein, 9 aa, Homo Sapiens
HSGACRALV

SEQ ID NO: 924792 - protein, 9 aa, Homo Sapiens
KLYGDKYDT

SEQ ID NO: 924793 - protein, 9 aa, Homo Sapiens
KGLQIDVKG

SEQ ID NO: 924794 - protein, 9 aa, Homo Sapiens
SSAAGKWKA

SEQ ID NO: 924795 - protein, 9 aa, Homo Sapiens
TQEEIITVK

SEQ ID NO: 924796 - protein, 9 aa, Homo Sapiens
RENKNVLAF

SEQ ID NO: 924797 - protein, 9 aa, Homo Sapiens
AENEAFDLE

SEQ ID NO: 924798 - protein, 9 aa, Homo Sapiens
SYACAGSCN

SEQ ID NO: 924799 - protein, 9 aa, Homo Sapiens
AAPQVLQSY

SEQ ID NO: 924800 - protein, 9 aa, Homo Sapiens
YIKLYGDKY

SEQ ID NO: 924801 - protein, 9 aa, Homo Sapiens
FPKELQDEQ

SEQ ID NO: 924802 - protein, 9 aa, Homo Sapiens
LKIQNSCST

SEQ ID NO: 924803 - protein, 9 aa, Homo Sapiens
INALAQKRN

SEQ ID NO: 924804 - protein, 9 aa, Homo Sapiens
PQDLFQKLF

SEQ ID NO: 924805 - protein, 9 aa, Homo Sapiens
QKARRLDST

SEQ ID NO: 924806 - protein, 9 aa, Homo Sapiens
LNLLIYTLR

SEQ ID NO: 924807 - protein, 9 aa, Homo Sapiens
PSETPASLL

SEQ ID NO: 924808 - protein, 9 aa, Homo Sapiens
YFICGLERD

SEQ ID NO: 924809 - protein, 9 aa, Homo Sapiens
ESGADRAST

SEQ ID NO: 924810 - protein, 9 aa, Homo Sapiens
APGDKGSGC

SEQ ID NO: 924811 - protein, 9 aa, Homo Sapiens
TMNRVRQPE

SEQ ID NO: 924812 - protein, 9 aa, Homo Sapiens
ESITNIIFG

SEQ ID NO: 924813 - protein, 9 aa, Homo Sapiens
GHYRVACIL

SEQ ID NO: 924814 - protein, 9 aa, Homo Sapiens
RNAYWKEKT

SEQ ID NO: 924815 - protein, 9 aa, Homo Sapiens
ESSDESEDG

SEQ ID NO: 924816 - protein, 9 aa, Homo Sapiens
DLGPYFTSE

SEQ ID NO: 924817 - protein, 9 aa, Homo Sapiens
IGVSISLSF

SEQ ID NO: 924818 - protein, 9 aa, Homo Sapiens
VIYKNGFFI

SEQ ID NO: 924819 - protein, 9 aa, Homo Sapiens
EQPYFSVDP

SEQ ID NO: 924820 - protein, 9 aa, Homo Sapiens
FKLQRYLAV

SEQ ID NO: 924821 - protein, 9 aa, Homo Sapiens
CLGLSYNGL

SEQ ID NO: 924822 - protein, 9 aa, Homo Sapiens
KKGPAGERG

SEQ ID NO: 924823 - protein, 9 aa, Homo Sapiens
QMSQALCFR

SEQ ID NO: 924824 - protein, 9 aa, Homo Sapiens
SGPQASQPP

SEQ ID NO: 924825 - protein, 9 aa, Homo Sapiens
LKFIPASFG

SEQ ID NO: 924826 - protein, 9 aa, Homo Sapiens
ATDSTSEEK

SEQ ID NO: 924827 - protein, 9 aa, Homo Sapiens
KDPLIETFC

SEQ ID NO: 924828 - protein, 9 aa, Homo Sapiens
LKILIRLMY

SEQ ID NO: 924829 - protein, 9 aa, Homo Sapiens
PQGTYYHDQ

SEQ ID NO: 924830 - protein, 9 aa, Homo Sapiens
TPSYMFWNC

SEQ ID NO: 924831 - protein, 9 aa, Homo Sapiens
ELEFCASVL

SEQ ID NO: 924832 - protein, 9 aa, Homo Sapiens
QQEEGQRQG

SEQ ID NO: 924833 - protein, 9 aa, Homo Sapiens
EQFYQLMNL

SEQ ID NO: 924834 - protein, 9 aa, Homo Sapiens
CSADQQEEG

SEQ ID NO: 924835 - protein, 9 aa, Homo Sapiens
DLHSGACRA

SEQ ID NO: 924836 - protein, 9 aa, Homo Sapiens
RQGLMGVPL

SEQ ID NO: 924837 - protein, 9 aa, Homo Sapiens
SCNCKKCKC

SEQ ID NO: 924838 - protein, 9 aa, Homo Sapiens
SCHYLKNSL

SEQ ID NO: 924839 - protein, 9 aa, Homo Sapiens
GPSTPKAER

SEQ ID NO: 924840 - protein, 9 aa, Homo Sapiens
PVKDEEYIF

SEQ ID NO: 924841 - protein, 9 aa, Homo Sapiens
SFNSESFLD

SEQ ID NO: 924842 - protein, 9 aa, Homo Sapiens
MGLNQLNEH

SEQ ID NO: 924843 - protein, 9 aa, Homo Sapiens
RSSRDRAPR

SEQ ID NO: 924844 - protein, 9 aa, Homo Sapiens
PFVSYMTLP

SEQ ID NO: 924845 - protein, 9 aa, Homo Sapiens
RQTNVRRAL

SEQ ID NO: 924846 - protein, 9 aa, Homo Sapiens
PSLGQQQQT

SEQ ID NO: 924847 - protein, 9 aa, Homo Sapiens
GLSWRQGLM

SEQ ID NO: 924848 - protein, 9 aa, Homo Sapiens
FSEEIYSEL

SEQ ID NO: 924849 - protein, 9 aa, Homo Sapiens
RQPETILTE

SEQ ID NO: 924850 - protein, 9 aa, Homo Sapiens
NGQSQGSRL

SEQ ID NO: 924851 - protein, 9 aa, Homo Sapiens
SRKYISNKA

SEQ ID NO: 924852 - protein, 9 aa, Homo Sapiens
SVLEIAAQE

SEQ ID NO: 924853 - protein, 9 aa, Homo Sapiens
KSHIRYGAF

SEQ ID NO: 924854 - protein, 9 aa, Homo Sapiens
IVISHFGRM

SEQ ID NO: 924855 - protein, 9 aa, Homo Sapiens
KRLNSTSSE

SEQ ID NO: 924856 - protein, 9 aa, Homo Sapiens
IAWNVLPQD

SEQ ID NO: 924857 - protein, 9 aa, Homo Sapiens
ARLMAYTLE

SEQ ID NO: 924858 - protein, 9 aa, Homo Sapiens
ENTAAPQVL

SEQ ID NO: 924859 - protein, 9 aa, Homo Sapiens
FVLKSRESL

SEQ ID NO: 924860 - protein, 9 aa, Homo Sapiens
HDSDEGRNG

SEQ ID NO: 924861 - protein, 9 aa, Homo Sapiens
LINKEESYG

SEQ ID NO: 924862 - protein, 9 aa, Homo Sapiens
SLLKTVKVV

SEQ ID NO: 924863 - protein, 9 aa, Homo Sapiens
IHTREKPYH

SEQ ID NO: 924864 - protein, 9 aa, Homo Sapiens
NDKKENKNK

SEQ ID NO: 924865 - protein, 9 aa, Homo Sapiens
PATDSTSEE

SEQ ID NO: 924866 - protein, 9 aa, Homo Sapiens
PVQKFTPSY

SEQ ID NO: 924867 - protein, 9 aa, Homo Sapiens
GTYYHDQTE

SEQ ID NO: 924868 - protein, 9 aa, Homo Sapiens
VYFPLFQLL

SEQ ID NO: 924869 - protein, 9 aa, Homo Sapiens
NCKKCKCTS

SEQ ID NO: 924870 - protein, 9 aa, Homo Sapiens
CETGKYLKV

SEQ ID NO: 924871 - protein, 9 aa, Homo Sapiens
VFLDRSSAG

SEQ ID NO: 924872 - protein, 9 aa, Homo Sapiens
NVLPQDLFQ

SEQ ID NO: 924873 - protein, 9 aa, Homo Sapiens
VSYMTLPGG

SEQ ID NO: 924874 - protein, 9 aa, Homo Sapiens
GIRETRSTV

SEQ ID NO: 924875 - protein, 9 aa, Homo Sapiens
EEGQRQGEG

SEQ ID NO: 924876 - protein, 9 aa, Homo Sapiens
RSDFQCRVP

SEQ ID NO: 924877 - protein, 9 aa, Homo Sapiens
FLESAERPN

SEQ ID NO: 924878 - protein, 9 aa, Homo Sapiens
GHKVAPRVP

SEQ ID NO: 924879 - protein, 9 aa, Homo Sapiens
VLPQDLFQK

SEQ ID NO: 924880 - protein, 9 aa, Homo Sapiens
RNKREEQGL

SEQ ID NO: 924881 - protein, 9 aa, Homo Sapiens
HLKEPPSAA

SEQ ID NO: 924882 - protein, 9 aa, Homo Sapiens
EASTLSTTS

SEQ ID NO: 924883 - protein, 9 aa, Homo Sapiens
TGNWSLKGF

SEQ ID NO: 924884 - protein, 9 aa, Homo Sapiens
KFIPASFGT

SEQ ID NO: 924885 - protein, 9 aa, Homo Sapiens
ARKKLNGTI

SEQ ID NO: 924886 - protein, 9 aa, Homo Sapiens
SISLSFIAT

SEQ ID NO: 924887 - protein, 9 aa, Homo Sapiens
SSRDRAPRD

SEQ ID NO: 924888 - protein, 9 aa, Homo Sapiens
NSVRVKWDA

SEQ ID NO: 924889 - protein, 9 aa, Homo Sapiens
QGSPSGPQA

SEQ ID NO: 924890 - protein, 9 aa, Homo Sapiens
RHGFQKKPE

SEQ ID NO: 924891 - protein, 9 aa, Homo Sapiens
GQSQGSRLR

SEQ ID NO: 924892 - protein, 9 aa, Homo Sapiens
KMSNFPWQV

SEQ ID NO: 924893 - protein, 9 aa, Homo Sapiens
LLNQTTVQI

SEQ ID NO: 924894 - protein, 9 aa, Homo Sapiens
VWQVRHLKS

SEQ ID NO: 924895 - protein, 9 aa, Homo Sapiens
ACESGISSE

SEQ ID NO: 924896 - protein, 9 aa, Homo Sapiens
KGIGLTLKQ

SEQ ID NO: 924897 - protein, 9 aa, Homo Sapiens
PGSRKLQSL

SEQ ID NO: 924898 - protein, 9 aa, Homo Sapiens
RRSQDLHSG

SEQ ID NO: 924899 - protein, 9 aa, Homo Sapiens
SRKLQSLKT

SEQ ID NO: 924900 - protein, 9 aa, Homo Sapiens
FSFLEIFFT

SEQ ID NO: 924901 - protein, 9 aa, Homo Sapiens
RLTHTGERS

SEQ ID NO: 924902 - protein, 9 aa, Homo Sapiens
TAHDSDEGR

SEQ ID NO: 924903 - protein, 9 aa, Homo Sapiens
IYFVYSKLP

SEQ ID NO: 924904 - protein, 9 aa, Homo Sapiens
SRVLFSCHL

SEQ ID NO: 924905 - protein, 9 aa, Homo Sapiens
LADARLVFL

SEQ ID NO: 924906 - protein, 9 aa, Homo Sapiens
SKPRENKNV

SEQ ID NO: 924907 - protein, 9 aa, Homo Sapiens
NTSQLKAVV

SEQ ID NO: 924908 - protein, 9 aa, Homo Sapiens
VSFVLKSRE

SEQ ID NO: 924909 - protein, 9 aa, Homo Sapiens
IMVTVLRIS

SEQ ID NO: 924910 - protein, 9 aa, Homo Sapiens
VHLGVGTSG

SEQ ID NO: 924911 - protein, 9 aa, Homo Sapiens
VYSKGSSPP

SEQ ID NO: 924912 - protein, 9 aa, Homo Sapiens
ANTSQLKAV

SEQ ID NO: 924913 - protein, 9 aa, Homo Sapiens
TELKIQNSC

SEQ ID NO: 924914 - protein, 9 aa, Homo Sapiens
CHLLIIYRG

SEQ ID NO: 924915 - protein, 9 aa, Homo Sapiens
RLMAYTLEL

SEQ ID NO: 924916 - protein, 9 aa, Homo Sapiens
LTLKQTLQF

SEQ ID NO: 924917 - protein, 9 aa, Homo Sapiens
GPSPRWTGR

SEQ ID NO: 924918 - protein, 9 aa, Homo Sapiens
VSQGEANFA

SEQ ID NO: 924919 - protein, 9 aa, Homo Sapiens
VFLVILWLQ

SEQ ID NO: 924920 - protein, 9 aa, Homo Sapiens
GAGSCRLES

SEQ ID NO: 924921 - protein, 9 aa, Homo Sapiens
LSFEVFIML

SEQ ID NO: 924922 - protein, 9 aa, Homo Sapiens
VHHITAHDS

SEQ ID NO: 924923 - protein, 9 aa, Homo Sapiens
AFDCAYRKQ

SEQ ID NO: 924924 - protein, 9 aa, Homo Sapiens
ASAGESIGK

SEQ ID NO: 924925 - protein, 9 aa, Homo Sapiens
SFRLYTQEV

SEQ ID NO: 924926 - protein, 9 aa, Homo Sapiens
RLMYSNPPL

SEQ ID NO: 924927 - protein, 9 aa, Homo Sapiens
VFEVLVCDR

SEQ ID NO: 924928 - protein, 9 aa, Homo Sapiens
KEARGPNGS

SEQ ID NO: 924929 - protein, 9 aa, Homo Sapiens
SITNIIFGE

SEQ ID NO: 924930 - protein, 9 aa, Homo Sapiens
PYRRLLIDQ

SEQ ID NO: 924931 - protein, 9 aa, Homo Sapiens
NVLGAFDGE

SEQ ID NO: 924932 - protein, 9 aa, Homo Sapiens
PKAERASSP

SEQ ID NO: 924933 - protein, 9 aa, Homo Sapiens
YFNKDSDKM

SEQ ID NO: 924934 - protein, 9 aa, Homo Sapiens
PLHQARSFR

SEQ ID NO: 924935 - protein, 9 aa, Homo Sapiens
VLSDTKKIF

SEQ ID NO: 924936 - protein, 9 aa, Homo Sapiens
AYQGPPSQQ

SEQ ID NO: 924937 - protein, 9 aa, Homo Sapiens
VRDVSKKLV

SEQ ID NO: 924938 - protein, 9 aa, Homo Sapiens
FAATVRLPV

SEQ ID NO: 924939 - protein, 9 aa, Homo Sapiens
GLHRPHSRE

SEQ ID NO: 924940 - protein, 9 aa, Homo Sapiens
DESSDESED

SEQ ID NO: 924941 - protein, 9 aa, Homo Sapiens
ASYCGPSSY

SEQ ID NO: 924942 - protein, 9 aa, Homo Sapiens
QVIHTREKP

SEQ ID NO: 924943 - protein, 9 aa, Homo Sapiens
KDVNIFFDE

SEQ ID NO: 924944 - protein, 9 aa, Homo Sapiens
ILEQDSEHG

SEQ ID NO: 924945 - protein, 9 aa, Homo Sapiens
APLASYEVL

SEQ ID NO: 924946 - protein, 9 aa, Homo Sapiens
QDAYQGPPS

SEQ ID NO: 924947 - protein, 9 aa, Homo Sapiens
RPKQTLEKN

SEQ ID NO: 924948 - protein, 9 aa, Homo Sapiens
PAQDSSSQV

SEQ ID NO: 924949 - protein, 9 aa, Homo Sapiens
SHPFLLNGF

SEQ ID NO: 924950 - protein, 9 aa, Homo Sapiens
LYLGRSQDF

SEQ ID NO: 924951 - protein, 9 aa, Homo Sapiens
TEKAQKELI

SEQ ID NO: 924952 - protein, 9 aa, Homo Sapiens
QQTLPKHKT

SEQ ID NO: 924953 - protein, 9 aa, Homo Sapiens
QEYSAKGPI

SEQ ID NO: 924954 - protein, 9 aa, Homo Sapiens
SALLFVASL

SEQ ID NO: 924955 - protein, 9 aa, Homo Sapiens
LQAFDRFFD

SEQ ID NO: 924956 - protein, 9 aa, Homo Sapiens
RNFSFLEIF

SEQ ID NO: 924957 - protein, 9 aa, Homo Sapiens
PMKGRKEMV

SEQ ID NO: 924958 - protein, 9 aa, Homo Sapiens
VLESDRLEN

SEQ ID NO: 924959 - protein, 9 aa, Homo Sapiens
EKCPNIIHL

SEQ ID NO: 924960 - protein, 9 aa, Homo Sapiens
YHQPACSLQ

SEQ ID NO: 924961 - protein, 9 aa, Homo Sapiens
SKFFEKKVV

SEQ ID NO: 924962 - protein, 9 aa, Homo Sapiens
TSGRIKELV

SEQ ID NO: 924963 - protein, 9 aa, Homo Sapiens
CNNGFCELF

SEQ ID NO: 924964 - protein, 9 aa, Homo Sapiens
ARQPGPSPR

SEQ ID NO: 924965 - protein, 9 aa, Homo Sapiens
GRKEMVDWA

SEQ ID NO: 924966 - protein, 9 aa, Homo Sapiens
NMRGFLYAG

SEQ ID NO: 924967 - protein, 9 aa, Homo Sapiens
STVRDSDSG

SEQ ID NO: 924968 - protein, 9 aa, Homo Sapiens
FCNVVDGQP

SEQ ID NO: 924969 - protein, 9 aa, Homo Sapiens
TTSVDSNSP

SEQ ID NO: 924970 - protein, 9 aa, Homo Sapiens
GLSTISLNS

SEQ ID NO: 924971 - protein, 9 aa, Homo Sapiens
STKDKEEKK

SEQ ID NO: 924972 - protein, 9 aa, Homo Sapiens
YLVIESKHG

SEQ ID NO: 924973 - protein, 9 aa, Homo Sapiens
KIQNSCSTI

SEQ ID NO: 924974 - protein, 9 aa, Homo Sapiens
EKVLPPLTR

SEQ ID NO: 924975 - protein, 9 aa, Homo Sapiens
IFSALSDFA

SEQ ID NO: 924976 - protein, 9 aa, Homo Sapiens
NSCSDSVCY

SEQ ID NO: 924977 - protein, 9 aa, Homo Sapiens
GCGSCRGSK

SEQ ID NO: 924978 - protein, 9 aa, Homo Sapiens
NLQQMPYPC

SEQ ID NO: 924979 - protein, 9 aa, Homo Sapiens
IDTRQRRIN

SEQ ID NO: 924980 - protein, 9 aa, Homo Sapiens
LNFCDSNVI

SEQ ID NO: 924981 - protein, 9 aa, Homo Sapiens
LGNDWGLQG

SEQ ID NO: 924982 - protein, 9 aa, Homo Sapiens
LVEHLHKFI

SEQ ID NO: 924983 - protein, 9 aa, Homo Sapiens
ARSFRLYTQ

SEQ ID NO: 924984 - protein, 9 aa, Homo Sapiens
VTENSVRVK

SEQ ID NO: 924985 - protein, 9 aa, Homo Sapiens
SLGQQQQTL

SEQ ID NO: 924986 - protein, 9 aa, Homo Sapiens
RLVFLVTTD

SEQ ID NO: 924987 - protein, 9 aa, Homo Sapiens
KRSVFLDRS

SEQ ID NO: 924988 - protein, 9 aa, Homo Sapiens
CFLMPHVPF

SEQ ID NO: 924989 - protein, 9 aa, Homo Sapiens
EVFIMLMAR

SEQ ID NO: 924990 - protein, 9 aa, Homo Sapiens
RSYRCGDCG

SEQ ID NO: 924991 - protein, 9 aa, Homo Sapiens
VLGLSWRQG

SEQ ID NO: 924992 - protein, 9 aa, Homo Sapiens
ILTETPQDT

SEQ ID NO: 924993 - protein, 9 aa, Homo Sapiens
DCLCPSGSS

SEQ ID NO: 924994 - protein, 9 aa, Homo Sapiens
GADRASTSP

SEQ ID NO: 924995 - protein, 9 aa, Homo Sapiens
PSGSSCSGD

SEQ ID NO: 924996 - protein, 9 aa, Homo Sapiens
GGKHEALSS

SEQ ID NO: 924997 - protein, 9 aa, Homo Sapiens
IVVKYPLGK

SEQ ID NO: 924998 - protein, 9 aa, Homo Sapiens
TYTWMLIFC

SEQ ID NO: 924999 - protein, 9 aa, Homo Sapiens
CPSGSSCSG

SEQ ID NO: 925000 - protein, 9 aa, Homo Sapiens
SKGSSPPLL

SEQ ID NO: 925001 - protein, 9 aa, Homo Sapiens
GFPPPVPSG

SEQ ID NO: 925002 - protein, 9 aa, Homo Sapiens
IGGQKAKMS

SEQ ID NO: 925003 - protein, 9 aa, Homo Sapiens
AAINEVAIE

SEQ ID NO: 925004 - protein, 9 aa, Homo Sapiens
GAGMVSQGE

SEQ ID NO: 925005 - protein, 9 aa, Homo Sapiens
YEMKKFLFY

SEQ ID NO: 925006 - protein, 9 aa, Homo Sapiens
GTPQSTVPG

SEQ ID NO: 925007 - protein, 9 aa, Homo Sapiens
ALLMANTSQ

SEQ ID NO: 925008 - protein, 9 aa, Homo Sapiens
FFNNLKYKR

SEQ ID NO: 925009 - protein, 9 aa, Homo Sapiens
DIDASSEVE

SEQ ID NO: 925010 - protein, 9 aa, Homo Sapiens
SQYFHLATW

SEQ ID NO: 925011 - protein, 9 aa, Homo Sapiens
GPSRGASYL

SEQ ID NO: 925012 - protein, 9 aa, Homo Sapiens
KLTSSWPDA

SEQ ID NO: 925013 - protein, 9 aa, Homo Sapiens
PKLVVSAMQ

SEQ ID NO: 925014 - protein, 9 aa, Homo Sapiens
SEAKTPFPF

SEQ ID NO: 925015 - protein, 9 aa, Homo Sapiens
ATFSQGASG

SEQ ID NO: 925016 - protein, 9 aa, Homo Sapiens
IIVTVLRIS

SEQ ID NO: 925017 - protein, 9 aa, Homo Sapiens
VENICEFEN

SEQ ID NO: 925018 - protein, 9 aa, Homo Sapiens
EIFFTNIFI

SEQ ID NO: 925019 - protein, 9 aa, Homo Sapiens
LGAFDGEEH

SEQ ID NO: 925020 - protein, 9 aa, Homo Sapiens
AGDSKMADT

SEQ ID NO: 925021 - protein, 9 aa, Homo Sapiens
KKTDTIRCP

SEQ ID NO: 925022 - protein, 9 aa, Homo Sapiens
FSENHSSAL

SEQ ID NO: 925023 - protein, 9 aa, Homo Sapiens
TAQYSGGLS

SEQ ID NO: 925024 - protein, 9 aa, Homo Sapiens
RRLDSTEPI

SEQ ID NO: 925025 - protein, 9 aa, Homo Sapiens
HFSKLTSSW

SEQ ID NO: 925026 - protein, 9 aa, Homo Sapiens
NIIFGERQG

SEQ ID NO: 925027 - protein, 9 aa, Homo Sapiens
SAKGPITKS

SEQ ID NO: 925028 - protein, 9 aa, Homo Sapiens
PRNYKSSTN

SEQ ID NO: 925029 - protein, 9 aa, Homo Sapiens
VLDFLGNDW

SEQ ID NO: 925030 - protein, 9 aa, Homo Sapiens
VFLVTTDPL

SEQ ID NO: 925031 - protein, 9 aa, Homo Sapiens
SLLNQTTVQ

SEQ ID NO: 925032 - protein, 9 aa, Homo Sapiens
TKDKEEKKL

SEQ ID NO: 925033 - protein, 9 aa, Homo Sapiens
QVYDMGPET

SEQ ID NO: 925034 - protein, 9 aa, Homo Sapiens
NICDSRGRT

SEQ ID NO: 925035 - protein, 9 aa, Homo Sapiens
KFFEKKVVQ

SEQ ID NO: 925036 - protein, 9 aa, Homo Sapiens
CEPVHCPAL

SEQ ID NO: 925037 - protein, 9 aa, Homo Sapiens
IALLMANTS

SEQ ID NO: 925038 - protein, 9 aa, Homo Sapiens
AAGDSKMAD

SEQ ID NO: 925039 - protein, 9 aa, Homo Sapiens
VLEETSAEE

SEQ ID NO: 925040 - protein, 9 aa, Homo Sapiens
SFICQSEVS

SEQ ID NO: 925041 - protein, 9 aa, Homo Sapiens
IVRVHNSCS

SEQ ID NO: 925042 - protein, 9 aa, Homo Sapiens
SSLALVFLE

SEQ ID NO: 925043 - protein, 9 aa, Homo Sapiens
FLWGVFSSA

SEQ ID NO: 925044 - protein, 9 aa, Homo Sapiens
FDLEKAGTD

SEQ ID NO: 925045 - protein, 9 aa, Homo Sapiens
YSELCALLP

SEQ ID NO: 925046 - protein, 9 aa, Homo Sapiens
SCHLSKALP

SEQ ID NO: 925047 - protein, 9 aa, Homo Sapiens
SWRQGLMGV

SEQ ID NO: 925048 - protein, 9 aa, Homo Sapiens
GFFIHSVPR

SEQ ID NO: 925049 - protein, 9 aa, Homo Sapiens
SNTCPKSDF

SEQ ID NO: 925050 - protein, 9 aa, Homo Sapiens
LLRLTDDPQ

SEQ ID NO: 925051 - protein, 9 aa, Homo Sapiens
SVLCGGGEQ

SEQ ID NO: 925052 - protein, 9 aa, Homo Sapiens
QCRVPYNYL

SEQ ID NO: 925053 - protein, 9 aa, Homo Sapiens
GNSSRSITC

SEQ ID NO: 925054 - protein, 9 aa, Homo Sapiens
TPQGDINSF

SEQ ID NO: 925055 - protein, 9 aa, Homo Sapiens
CSSVSSDLG

SEQ ID NO: 925056 - protein, 9 aa, Homo Sapiens
ILKTKKLQV

SEQ ID NO: 925057 - protein, 9 aa, Homo Sapiens
SGEAWYEGS

SEQ ID NO: 925058 - protein, 9 aa, Homo Sapiens
SLALVFLES

SEQ ID NO: 925059 - protein, 9 aa, Homo Sapiens
EDNDKKENK

SEQ ID NO: 925060 - protein, 9 aa, Homo Sapiens
RGTVSVSCH

SEQ ID NO: 925061 - protein, 9 aa, Homo Sapiens
PVHCPALKP

SEQ ID NO: 925062 - protein, 9 aa, Homo Sapiens
PNNSLNNIF

SEQ ID NO: 925063 - protein, 9 aa, Homo Sapiens
FIATCVYIA

SEQ ID NO: 925064 - protein, 9 aa, Homo Sapiens
PVGGKLNVH

SEQ ID NO: 925065 - protein, 9 aa, Homo Sapiens
MICLPQTKE

SEQ ID NO: 925066 - protein, 9 aa, Homo Sapiens
TRSTVRDSD

SEQ ID NO: 925067 - protein, 9 aa, Homo Sapiens
LKGVTKNLE

SEQ ID NO: 925068 - protein, 9 aa, Homo Sapiens
LVCVDVDMK

SEQ ID NO: 925069 - protein, 9 aa, Homo Sapiens
IAGPVDAGV

SEQ ID NO: 925070 - protein, 9 aa, Homo Sapiens
DMKFRDHVG

SEQ ID NO: 925071 - protein, 9 aa, Homo Sapiens
EIYSELCAL

SEQ ID NO: 925072 - protein, 9 aa, Homo Sapiens
HLYLGRSQD

SEQ ID NO: 925073 - protein, 9 aa, Homo Sapiens
HLPTPSSTF

SEQ ID NO: 925074 - protein, 9 aa, Homo Sapiens
FFHALTLPP

SEQ ID NO: 925075 - protein, 9 aa, Homo Sapiens
LFYARRSEI

SEQ ID NO: 925076 - protein, 9 aa, Homo Sapiens
NLYQLKSPR

SEQ ID NO: 925077 - protein, 9 aa, Homo Sapiens
FEVFIMLMA

SEQ ID NO: 925078 - protein, 9 aa, Homo Sapiens
QPPFFHALT

SEQ ID NO: 925079 - protein, 9 aa, Homo Sapiens
PNLEMTERP

SEQ ID NO: 925080 - protein, 9 aa, Homo Sapiens
EKWRGSEKV

SEQ ID NO: 925081 - protein, 9 aa, Homo Sapiens
GPPSQQGYP

SEQ ID NO: 925082 - protein, 9 aa, Homo Sapiens
EQLNQNLIK

SEQ ID NO: 925083 - protein, 9 aa, Homo Sapiens
IFLRHLMQE

SEQ ID NO: 925084 - protein, 9 aa, Homo Sapiens
CAIIYCNNG

SEQ ID NO: 925085 - protein, 9 aa, Homo Sapiens
LVPRQTPNG

SEQ ID NO: 925086 - protein, 9 aa, Homo Sapiens
GSPSGPQAS

SEQ ID NO: 925087 - protein, 9 aa, Homo Sapiens
IIYCNNGFC

SEQ ID NO: 925088 - protein, 9 aa, Homo Sapiens
LPGMKGEKE

SEQ ID NO: 925089 - protein, 9 aa, Homo Sapiens
CEAKHIHQQ

SEQ ID NO: 925090 - protein, 9 aa, Homo Sapiens
PGDSYSYNV

SEQ ID NO: 925091 - protein, 9 aa, Homo Sapiens
LLSSVDDPK

SEQ ID NO: 925092 - protein, 9 aa, Homo Sapiens
GQTCEPVHC

SEQ ID NO: 925093 - protein, 9 aa, Homo Sapiens
AGLACVFIG

SEQ ID NO: 925094 - protein, 9 aa, Homo Sapiens
YCNNGFCEL

SEQ ID NO: 925095 - protein, 9 aa, Homo Sapiens
DRASTSPRN

SEQ ID NO: 925096 - protein, 9 aa, Homo Sapiens
KRQTNVRRA

SEQ ID NO: 925097 - protein, 9 aa, Homo Sapiens
TWLVPSVKS

SEQ ID NO: 925098 - protein, 9 aa, Homo Sapiens
FSFLSTVTI

SEQ ID NO: 925099 - protein, 9 aa, Homo Sapiens
RVPSIFRIL

SEQ ID NO: 925100 - protein, 9 aa, Homo Sapiens
RKYISNKAI

SEQ ID NO: 925101 - protein, 9 aa, Homo Sapiens
LGYCFSFLS

SEQ ID NO: 925102 - protein, 9 aa, Homo Sapiens
THRKSHIRY

SEQ ID NO: 925103 - protein, 9 aa, Homo Sapiens
VVVELYDSN

SEQ ID NO: 925104 - protein, 9 aa, Homo Sapiens
AIFLRHLMQ

SEQ ID NO: 925105 - protein, 9 aa, Homo Sapiens
FEDQYFIGG

SEQ ID NO: 925106 - protein, 9 aa, Homo Sapiens
NSSRSITCL

SEQ ID NO: 925107 - protein, 9 aa, Homo Sapiens
LSPYKQSEI

SEQ ID NO: 925108 - protein, 9 aa, Homo Sapiens
IYCNNGFCE

SEQ ID NO: 925109 - protein, 9 aa, Homo Sapiens
CSVLPASAF

SEQ ID NO: 925110 - protein, 9 aa, Homo Sapiens
AGSCRLESA

SEQ ID NO: 925111 - protein, 9 aa, Homo Sapiens
SLNNIFKPL

SEQ ID NO: 925112 - protein, 9 aa, Homo Sapiens
PTAQYSGGL

SEQ ID NO: 925113 - protein, 9 aa, Homo Sapiens
GGLHRPHSR

SEQ ID NO: 925114 - protein, 9 aa, Homo Sapiens
QALCFRKIG

SEQ ID NO: 925115 - protein, 9 aa, Homo Sapiens
DFFIMIYIL

SEQ ID NO: 925116 - protein, 9 aa, Homo Sapiens
LESNPYRRL

SEQ ID NO: 925117 - protein, 9 aa, Homo Sapiens
TPSETPASL

SEQ ID NO: 925118 - protein, 9 aa, Homo Sapiens
SYMFWNCNH

SEQ ID NO: 925119 - protein, 9 aa, Homo Sapiens
QYFHLATWL

SEQ ID NO: 925120 - protein, 9 aa, Homo Sapiens
AWLGTRPPH

SEQ ID NO: 925121 - protein, 9 aa, Homo Sapiens
DDKIYECDD

SEQ ID NO: 925122 - protein, 9 aa, Homo Sapiens
PNIIHLNLS

SEQ ID NO: 925123 - protein, 9 aa, Homo Sapiens
QMLAVLPEH

SEQ ID NO: 925124 - protein, 9 aa, Homo Sapiens
PGLMKRNKR

SEQ ID NO: 925125 - protein, 9 aa, Homo Sapiens
LNRDLGPNM

SEQ ID NO: 925126 - protein, 9 aa, Homo Sapiens
GYQCLSPLK

SEQ ID NO: 925127 - protein, 9 aa, Homo Sapiens
GTSLAEAEA

SEQ ID NO: 925128 - protein, 9 aa, Homo Sapiens
CQQNTGPLV

SEQ ID NO: 925129 - protein, 9 aa, Homo Sapiens
SVDDPKDPL

SEQ ID NO: 925130 - protein, 9 aa, Homo Sapiens
KQCRFYFNK

SEQ ID NO: 925131 - protein, 9 aa, Homo Sapiens
KDEEYIFVI

SEQ ID NO: 925132 - protein, 9 aa, Homo Sapiens
AAAHGPREL

SEQ ID NO: 925133 - protein, 9 aa, Homo Sapiens
DNTTASRLL

SEQ ID NO: 925134 - protein, 9 aa, Homo Sapiens
ALNGSKIIT

SEQ ID NO: 925135 - protein, 9 aa, Homo Sapiens
SVLPPTEGP

SEQ ID NO: 925136 - protein, 9 aa, Homo Sapiens
IKWTSALLL

SEQ ID NO: 925137 - protein, 9 aa, Homo Sapiens
FLEMYGERL

SEQ ID NO: 925138 - protein, 9 aa, Homo Sapiens
FDKIDKEYL

SEQ ID NO: 925139 - protein, 9 aa, Homo Sapiens
RNLRALSLE

SEQ ID NO: 925140 - protein, 9 aa, Homo Sapiens
FFKTPRKVK

SEQ ID NO: 925141 - protein, 9 aa, Homo Sapiens
DSLFVSLNR

SEQ ID NO: 925142 - protein, 9 aa, Homo Sapiens
YYWLNGAKF

SEQ ID NO: 925143 - protein, 9 aa, Homo Sapiens
NASCITWKG

SEQ ID NO: 925144 - protein, 9 aa, Homo Sapiens
FGKKDCSWP

SEQ ID NO: 925145 - protein, 9 aa, Homo Sapiens
ASKDTICEE

SEQ ID NO: 925146 - protein, 9 aa, Homo Sapiens
KSAEERKKA

SEQ ID NO: 925147 - protein, 9 aa, Homo Sapiens
QEEDPPNPQ

SEQ ID NO: 925148 - protein, 9 aa, Homo Sapiens
KFFLSIKES

SEQ ID NO: 925149 - protein, 9 aa, Homo Sapiens
NPQLMRLDN

SEQ ID NO: 925150 - protein, 9 aa, Homo Sapiens
SSNKGDLLV

SEQ ID NO: 925151 - protein, 9 aa, Homo Sapiens
CDIYLVMKL

SEQ ID NO: 925152 - protein, 9 aa, Homo Sapiens
SSEIQQLEF

SEQ ID NO: 925153 - protein, 9 aa, Homo Sapiens
RSNLVKHGQ

SEQ ID NO: 925154 - protein, 9 aa, Homo Sapiens
DGTPRKGTR

SEQ ID NO: 925155 - protein, 9 aa, Homo Sapiens
PPTGPAEEA

SEQ ID NO: 925156 - protein, 9 aa, Homo Sapiens
AAGSESPNQ

SEQ ID NO: 925157 - protein, 9 aa, Homo Sapiens
SGEKLYPCP

SEQ ID NO: 925158 - protein, 9 aa, Homo Sapiens
GERGFPGPA

SEQ ID NO: 925159 - protein, 9 aa, Homo Sapiens
EEQDSLSIS

SEQ ID NO: 925160 - protein, 9 aa, Homo Sapiens
QRLRTPQLT

SEQ ID NO: 925161 - protein, 9 aa, Homo Sapiens
WSFPKGSEG

SEQ ID NO: 925162 - protein, 9 aa, Homo Sapiens
ESPNQKLSS

SEQ ID NO: 925163 - protein, 9 aa, Homo Sapiens
SNGRSVSLM

SEQ ID NO: 925164 - protein, 9 aa, Homo Sapiens
AQLRAARTQ

SEQ ID NO: 925165 - protein, 9 aa, Homo Sapiens
TLIGQTSQV

SEQ ID NO: 925166 - protein, 9 aa, Homo Sapiens
QGLFKNKVI

SEQ ID NO: 925167 - protein, 9 aa, Homo Sapiens
GDQALNGSK

SEQ ID NO: 925168 - protein, 9 aa, Homo Sapiens
NVDYGLKVS

SEQ ID NO: 925169 - protein, 9 aa, Homo Sapiens
TLKPAQPSE

SEQ ID NO: 925170 - protein, 9 aa, Homo Sapiens
RYVAICHSL

SEQ ID NO: 925171 - protein, 9 aa, Homo Sapiens
GNNMSGQRN

SEQ ID NO: 925172 - protein, 9 aa, Homo Sapiens
CCKKDIAIK

SEQ ID NO: 925173 - protein, 9 aa, Homo Sapiens
LVSPEARSE

SEQ ID NO: 925174 - protein, 9 aa, Homo Sapiens
GVYHRTQVP

SEQ ID NO: 925175 - protein, 9 aa, Homo Sapiens
FLSGKDVVS

SEQ ID NO: 925176 - protein, 9 aa, Homo Sapiens
TEQEKSHRN

SEQ ID NO: 925177 - protein, 9 aa, Homo Sapiens
GPPGLPEKH

SEQ ID NO: 925178 - protein, 9 aa, Homo Sapiens
DSVNFFANE

SEQ ID NO: 925179 - protein, 9 aa, Homo Sapiens
KKENRVSPT

SEQ ID NO: 925180 - protein, 9 aa, Homo Sapiens
KLYLNDNHL

SEQ ID NO: 925181 - protein, 9 aa, Homo Sapiens
KALQQVLEL

SEQ ID NO: 925182 - protein, 9 aa, Homo Sapiens
DLGSWNLLI

SEQ ID NO: 925183 - protein, 9 aa, Homo Sapiens
LKIPAVKES

SEQ ID NO: 925184 - protein, 9 aa, Homo Sapiens
LRAGKLSLL

SEQ ID NO: 925185 - protein, 9 aa, Homo Sapiens
FYCLWDSGR

SEQ ID NO: 925186 - protein, 9 aa, Homo Sapiens
NNFGSVARM

SEQ ID NO: 925187 - protein, 9 aa, Homo Sapiens
KNPFLDNPD

SEQ ID NO: 925188 - protein, 9 aa, Homo Sapiens
LYSQPPKTR

SEQ ID NO: 925189 - protein, 9 aa, Homo Sapiens
LILAVCCES

SEQ ID NO: 925190 - protein, 9 aa, Homo Sapiens
LIRLPLPDN

SEQ ID NO: 925191 - protein, 9 aa, Homo Sapiens
YCPIAMQSL

SEQ ID NO: 925192 - protein, 9 aa, Homo Sapiens
IQELQVFSS

SEQ ID NO: 925193 - protein, 9 aa, Homo Sapiens
ESRQEVLMC

SEQ ID NO: 925194 - protein, 9 aa, Homo Sapiens
DVYQLQELW

SEQ ID NO: 925195 - protein, 9 aa, Homo Sapiens
KIEQMFQNE

SEQ ID NO: 925196 - protein, 9 aa, Homo Sapiens
FSESIRKGP

SEQ ID NO: 925197 - protein, 9 aa, Homo Sapiens
SNSCDSPIL

SEQ ID NO: 925198 - protein, 9 aa, Homo Sapiens
IILTQSLHL

SEQ ID NO: 925199 - protein, 9 aa, Homo Sapiens
KLWDVFNMD

SEQ ID NO: 925200 - protein, 9 aa, Homo Sapiens
IFSAKVIIS

SEQ ID NO: 925201 - protein, 9 aa, Homo Sapiens
TKLTYNHEG

SEQ ID NO: 925202 - protein, 9 aa, Homo Sapiens
MYEELNKMC

SEQ ID NO: 925203 - protein, 9 aa, Homo Sapiens
SLSISTRPT

SEQ ID NO: 925204 - protein, 9 aa, Homo Sapiens
EIQELQVFS

SEQ ID NO: 925205 - protein, 9 aa, Homo Sapiens
WVLSRNSLI

SEQ ID NO: 925206 - protein, 9 aa, Homo Sapiens
ETLSVKVPD

SEQ ID NO: 925207 - protein, 9 aa, Homo Sapiens
FSVAMFWVS

SEQ ID NO: 925208 - protein, 9 aa, Homo Sapiens
SNLQCFTCT

SEQ ID NO: 925209 - protein, 9 aa, Homo Sapiens
CALAGLTLL

SEQ ID NO: 925210 - protein, 9 aa, Homo Sapiens
DITVSSNEK

SEQ ID NO: 925211 - protein, 9 aa, Homo Sapiens
PPFLTLSRK

SEQ ID NO: 925212 - protein, 9 aa, Homo Sapiens
NSTEAENSN

SEQ ID NO: 925213 - protein, 9 aa, Homo Sapiens
RALSLEDQP

SEQ ID NO: 925214 - protein, 9 aa, Homo Sapiens
CSLSLKPSE

SEQ ID NO: 925215 - protein, 9 aa, Homo Sapiens
ILAVCCESA

SEQ ID NO: 925216 - protein, 9 aa, Homo Sapiens
ALWKVATFR

SEQ ID NO: 925217 - protein, 9 aa, Homo Sapiens
CLFSHHVSK

SEQ ID NO: 925218 - protein, 9 aa, Homo Sapiens
EETLSVKVP

SEQ ID NO: 925219 - protein, 9 aa, Homo Sapiens
KGTRTKRHQ

SEQ ID NO: 925220 - protein, 9 aa, Homo Sapiens
HGRPLAQTN

SEQ ID NO: 925221 - protein, 9 aa, Homo Sapiens
SKSDQSFFK

SEQ ID NO: 925222 - protein, 9 aa, Homo Sapiens
RIVSKAMIA

SEQ ID NO: 925223 - protein, 9 aa, Homo Sapiens
LEVEFLPDL

SEQ ID NO: 925224 - protein, 9 aa, Homo Sapiens
AVDGTAKNP

SEQ ID NO: 925225 - protein, 9 aa, Homo Sapiens
KGANGKREK

SEQ ID NO: 925226 - protein, 9 aa, Homo Sapiens
GAVLINSLP

SEQ ID NO: 925227 - protein, 9 aa, Homo Sapiens
PMMSGSTKL

SEQ ID NO: 925228 - protein, 9 aa, Homo Sapiens
LLSHRSCHP

SEQ ID NO: 925229 - protein, 9 aa, Homo Sapiens
VLFFYGSLM

SEQ ID NO: 925230 - protein, 9 aa, Homo Sapiens
EENEAVEAV

SEQ ID NO: 925231 - protein, 9 aa, Homo Sapiens
SKDTICEEI

SEQ ID NO: 925232 - protein, 9 aa, Homo Sapiens
EHQVKLKAF

SEQ ID NO: 925233 - protein, 9 aa, Homo Sapiens
SNSPSRFLG

SEQ ID NO: 925234 - protein, 9 aa, Homo Sapiens
HKREHILGA

SEQ ID NO: 925235 - protein, 9 aa, Homo Sapiens
YFDYDETWT

SEQ ID NO: 925236 - protein, 9 aa, Homo Sapiens
SRRSNLVKH

SEQ ID NO: 925237 - protein, 9 aa, Homo Sapiens
LTFSVAMFW

SEQ ID NO: 925238 - protein, 9 aa, Homo Sapiens
SLGQVYNPT

SEQ ID NO: 925239 - protein, 9 aa, Homo Sapiens
APSRGRDGF

SEQ ID NO: 925240 - protein, 9 aa, Homo Sapiens
KFCCDSGRC

SEQ ID NO: 925241 - protein, 9 aa, Homo Sapiens
KKDGAHSAA

SEQ ID NO: 925242 - protein, 9 aa, Homo Sapiens
CNFGFKFLQ

SEQ ID NO: 925243 - protein, 9 aa, Homo Sapiens
SIVFTTSKS

SEQ ID NO: 925244 - protein, 9 aa, Homo Sapiens
FCIIRRRLS

SEQ ID NO: 925245 - protein, 9 aa, Homo Sapiens
KWPVKLFQL

SEQ ID NO: 925246 - protein, 9 aa, Homo Sapiens
GKTKKENRV

SEQ ID NO: 925247 - protein, 9 aa, Homo Sapiens
WDSGRDRCL

SEQ ID NO: 925248 - protein, 9 aa, Homo Sapiens
VCCESASIV

SEQ ID NO: 925249 - protein, 9 aa, Homo Sapiens
SPVSREENQ

SEQ ID NO: 925250 - protein, 9 aa, Homo Sapiens
FGCPEDRAV

SEQ ID NO: 925251 - protein, 9 aa, Homo Sapiens
QQLSVLFSS

SEQ ID NO: 925252 - protein, 9 aa, Homo Sapiens
SPSASASRH

SEQ ID NO: 925253 - protein, 9 aa, Homo Sapiens
FRPHPGSLP

SEQ ID NO: 925254 - protein, 9 aa, Homo Sapiens
LDAQLRQFS

SEQ ID NO: 925255 - protein, 9 aa, Homo Sapiens
RTQVPQFLI

SEQ ID NO: 925256 - protein, 9 aa, Homo Sapiens
AAQTSSDAH

SEQ ID NO: 925257 - protein, 9 aa, Homo Sapiens
EKHGASGPP

SEQ ID NO: 925258 - protein, 9 aa, Homo Sapiens
MHSAEERQK

SEQ ID NO: 925259 - protein, 9 aa, Homo Sapiens
IPCHCCVLA

SEQ ID NO: 925260 - protein, 9 aa, Homo Sapiens
DMAAQTSSD

SEQ ID NO: 925261 - protein, 9 aa, Homo Sapiens
LQYQDQHSL

SEQ ID NO: 925262 - protein, 9 aa, Homo Sapiens
ISYSKSHVS

SEQ ID NO: 925263 - protein, 9 aa, Homo Sapiens
WAVRLGAEE

SEQ ID NO: 925264 - protein, 9 aa, Homo Sapiens
PERQESPWK

SEQ ID NO: 925265 - protein, 9 aa, Homo Sapiens
TAKNPFLDN

SEQ ID NO: 925266 - protein, 9 aa, Homo Sapiens
CVVNVTYFP

SEQ ID NO: 925267 - protein, 9 aa, Homo Sapiens
AKNHGSQCG

SEQ ID NO: 925268 - protein, 9 aa, Homo Sapiens
SSNEKHLFR

SEQ ID NO: 925269 - protein, 9 aa, Homo Sapiens
SGKEEDFIR

SEQ ID NO: 925270 - protein, 9 aa, Homo Sapiens
SDMLLPLNG

SEQ ID NO: 925271 - protein, 9 aa, Homo Sapiens
QLLILVCQL

SEQ ID NO: 925272 - protein, 9 aa, Homo Sapiens
NLSWPDRSC

SEQ ID NO: 925273 - protein, 9 aa, Homo Sapiens
TEEQDSLSI

SEQ ID NO: 925274 - protein, 9 aa, Homo Sapiens
EMYGERLAV

SEQ ID NO: 925275 - protein, 9 aa, Homo Sapiens
AWSHLSHFS

SEQ ID NO: 925276 - protein, 9 aa, Homo Sapiens
WPVKLFQLK

SEQ ID NO: 925277 - protein, 9 aa, Homo Sapiens
VDVQFNNRH

SEQ ID NO: 925278 - protein, 9 aa, Homo Sapiens
DPELEMDLE

SEQ ID NO: 925279 - protein, 9 aa, Homo Sapiens
VFMGHQLTA

SEQ ID NO: 925280 - protein, 9 aa, Homo Sapiens
TFRDVSLKI

SEQ ID NO: 925281 - protein, 9 aa, Homo Sapiens
GKKDCSWPC

SEQ ID NO: 925282 - protein, 9 aa, Homo Sapiens
LNTNLETST

SEQ ID NO: 925283 - protein, 9 aa, Homo Sapiens
LWGVPLHSH

SEQ ID NO: 925284 - protein, 9 aa, Homo Sapiens
AFCIIRRRL

SEQ ID NO: 925285 - protein, 9 aa, Homo Sapiens
NQTLIGQTS

SEQ ID NO: 925286 - protein, 9 aa, Homo Sapiens
AEVAPGFER

SEQ ID NO: 925287 - protein, 9 aa, Homo Sapiens
SLASLNTLE

SEQ ID NO: 925288 - protein, 9 aa, Homo Sapiens
GCSFPEYEL

SEQ ID NO: 925289 - protein, 9 aa, Homo Sapiens
KKNYPDSVS

SEQ ID NO: 925290 - protein, 9 aa, Homo Sapiens
PARGSPSGR

SEQ ID NO: 925291 - protein, 9 aa, Homo Sapiens
GVRASRLLF

SEQ ID NO: 925292 - protein, 9 aa, Homo Sapiens
EKNGTAHQR

SEQ ID NO: 925293 - protein, 9 aa, Homo Sapiens
EGGALRAQK

SEQ ID NO: 925294 - protein, 9 aa, Homo Sapiens
RRKKIEQMF

SEQ ID NO: 925295 - protein, 9 aa, Homo Sapiens
PRKVKPPED

SEQ ID NO: 925296 - protein, 9 aa, Homo Sapiens
PAGERGFPG

SEQ ID NO: 925297 - protein, 9 aa, Homo Sapiens
RDQFGEQEE

SEQ ID NO: 925298 - protein, 9 aa, Homo Sapiens
DYLVGMRVT

SEQ ID NO: 925299 - protein, 9 aa, Homo Sapiens
ADAALHKPM

SEQ ID NO: 925300 - protein, 9 aa, Homo Sapiens
NNFSPKVEL

SEQ ID NO: 925301 - protein, 9 aa, Homo Sapiens
IDHHKIMHR

SEQ ID NO: 925302 - protein, 9 aa, Homo Sapiens
KRLTSWPGK

SEQ ID NO: 925303 - protein, 9 aa, Homo Sapiens
GFWVTGLVD

SEQ ID NO: 925304 - protein, 9 aa, Homo Sapiens
RPLAQTNDP

SEQ ID NO: 925305 - protein, 9 aa, Homo Sapiens
VFGSVFLFA

SEQ ID NO: 925306 - protein, 9 aa, Homo Sapiens
RKILMDLKY

SEQ ID NO: 925307 - protein, 9 aa, Homo Sapiens
TVSSNEKHL

SEQ ID NO: 925308 - protein, 9 aa, Homo Sapiens
NQPLKENEE

SEQ ID NO: 925309 - protein, 9 aa, Homo Sapiens
ITAQYHGRP

SEQ ID NO: 925310 - protein, 9 aa, Homo Sapiens
ASPRRSKSY

SEQ ID NO: 925311 - protein, 9 aa, Homo Sapiens
GNADSSVPP

SEQ ID NO: 925312 - protein, 9 aa, Homo Sapiens
ICEEIQNAL

SEQ ID NO: 925313 - protein, 9 aa, Homo Sapiens
CNTKQLNCF

SEQ ID NO: 925314 - protein, 9 aa, Homo Sapiens
MSIKWTSAL

SEQ ID NO: 925315 - protein, 9 aa, Homo Sapiens
TFSFICKTR

SEQ ID NO: 925316 - protein, 9 aa, Homo Sapiens
ECATYRRPY

SEQ ID NO: 925317 - protein, 9 aa, Homo Sapiens
LLVTKSEHM

SEQ ID NO: 925318 - protein, 9 aa, Homo Sapiens
IAEQEHIQE

SEQ ID NO: 925319 - protein, 9 aa, Homo Sapiens
SGTQNEFIT

SEQ ID NO: 925320 - protein, 9 aa, Homo Sapiens
CLSQYPNLS

SEQ ID NO: 925321 - protein, 9 aa, Homo Sapiens
TKVFLSGKD

SEQ ID NO: 925322 - protein, 9 aa, Homo Sapiens
KDGAHSAAT

SEQ ID NO: 925323 - protein, 9 aa, Homo Sapiens
QEHIQEDLQ

SEQ ID NO: 925324 - protein, 9 aa, Homo Sapiens
QSQCRRKKI

SEQ ID NO: 925325 - protein, 9 aa, Homo Sapiens
IESQVQCEQ

SEQ ID NO: 925326 - protein, 9 aa, Homo Sapiens
KFDLFLKTL

SEQ ID NO: 925327 - protein, 9 aa, Homo Sapiens
NGPDPGVLV

SEQ ID NO: 925328 - protein, 9 aa, Homo Sapiens
GGCSFPEYE

SEQ ID NO: 925329 - protein, 9 aa, Homo Sapiens
EPFHENLLD

SEQ ID NO: 925330 - protein, 9 aa, Homo Sapiens
GTETALAED

SEQ ID NO: 925331 - protein, 9 aa, Homo Sapiens
SPSPPYSRL

SEQ ID NO: 925332 - protein, 9 aa, Homo Sapiens
HEACFLNLV

SEQ ID NO: 925333 - protein, 9 aa, Homo Sapiens
REGDVYFDY

SEQ ID NO: 925334 - protein, 9 aa, Homo Sapiens
KNKVIWVGI

SEQ ID NO: 925335 - protein, 9 aa, Homo Sapiens
KNGLTFSFI

SEQ ID NO: 925336 - protein, 9 aa, Homo Sapiens
RPPPSLSGT

SEQ ID NO: 925337 - protein, 9 aa, Homo Sapiens
SLLKSKFKT

SEQ ID NO: 925338 - protein, 9 aa, Homo Sapiens
LNMAMFCCK

SEQ ID NO: 925339 - protein, 9 aa, Homo Sapiens
KLTWFLLQK

SEQ ID NO: 925340 - protein, 9 aa, Homo Sapiens
LQKGESVKV

SEQ ID NO: 925341 - protein, 9 aa, Homo Sapiens
ENQPLKENE

SEQ ID NO: 925342 - protein, 9 aa, Homo Sapiens
IDWAQLNYR

SEQ ID NO: 925343 - protein, 9 aa, Homo Sapiens
DTIENGKAK

SEQ ID NO: 925344 - protein, 9 aa, Homo Sapiens
INLDFCIDH

SEQ ID NO: 925345 - protein, 9 aa, Homo Sapiens
RGSPSGRSG

SEQ ID NO: 925346 - protein, 9 aa, Homo Sapiens
ENLLDVRNE

SEQ ID NO: 925347 - protein, 9 aa, Homo Sapiens
ENGKAKIQD

SEQ ID NO: 925348 - protein, 9 aa, Homo Sapiens
GFFIKRQFR

SEQ ID NO: 925349 - protein, 9 aa, Homo Sapiens
LLGASLGGI

SEQ ID NO: 925350 - protein, 9 aa, Homo Sapiens
QVFSSYLAV

SEQ ID NO: 925351 - protein, 9 aa, Homo Sapiens
ATEKKFFFV

SEQ ID NO: 925352 - protein, 9 aa, Homo Sapiens
GDAWSHLSH

SEQ ID NO: 925353 - protein, 9 aa, Homo Sapiens
NVCLGFHIN

SEQ ID NO: 925354 - protein, 9 aa, Homo Sapiens
QEVLMCTGP

SEQ ID NO: 925355 - protein, 9 aa, Homo Sapiens
NVLQDHNAI

SEQ ID NO: 925356 - protein, 9 aa, Homo Sapiens
KVAAANVAV

SEQ ID NO: 925357 - protein, 9 aa, Homo Sapiens
GVLSGYGGT

SEQ ID NO: 925358 - protein, 9 aa, Homo Sapiens
QGPPEPPGI

SEQ ID NO: 925359 - protein, 9 aa, Homo Sapiens
VNSVWEEEP

SEQ ID NO: 925360 - protein, 9 aa, Homo Sapiens
LNPRQSMIK

SEQ ID NO: 925361 - protein, 9 aa, Homo Sapiens
IHSEFDVFS

SEQ ID NO: 925362 - protein, 9 aa, Homo Sapiens
TVSPLSSSM

SEQ ID NO: 925363 - protein, 9 aa, Homo Sapiens
LGEVLFSIE

SEQ ID NO: 925364 - protein, 9 aa, Homo Sapiens
HSIPLKEGE

SEQ ID NO: 925365 - protein, 9 aa, Homo Sapiens
TSEEEVKFG

SEQ ID NO: 925366 - protein, 9 aa, Homo Sapiens
DDEAEDSRA

SEQ ID NO: 925367 - protein, 9 aa, Homo Sapiens
EEVPPCQTP

SEQ ID NO: 925368 - protein, 9 aa, Homo Sapiens
FHEPRYIAV

SEQ ID NO: 925369 - protein, 9 aa, Homo Sapiens
EQLQPCLDW

SEQ ID NO: 925370 - protein, 9 aa, Homo Sapiens
IGVYHRTQV

SEQ ID NO: 925371 - protein, 9 aa, Homo Sapiens
WSRAASLLL

SEQ ID NO: 925372 - protein, 9 aa, Homo Sapiens
SRTSSSSSD

SEQ ID NO: 925373 - protein, 9 aa, Homo Sapiens
ILRQRYQEP

SEQ ID NO: 925374 - protein, 9 aa, Homo Sapiens
YTLQRVPTA

SEQ ID NO: 925375 - protein, 9 aa, Homo Sapiens
RVTTALGSS

SEQ ID NO: 925376 - protein, 9 aa, Homo Sapiens
PSVRRPGIE

SEQ ID NO: 925377 - protein, 9 aa, Homo Sapiens
PPNPQLMRL

SEQ ID NO: 925378 - protein, 9 aa, Homo Sapiens
GAFNSLASL

SEQ ID NO: 925379 - protein, 9 aa, Homo Sapiens
DEENEAVEA

SEQ ID NO: 925380 - protein, 9 aa, Homo Sapiens
TSSRSVKKK

SEQ ID NO: 925381 - protein, 9 aa, Homo Sapiens
GSLAITIAI

SEQ ID NO: 925382 - protein, 9 aa, Homo Sapiens
RTCDFSMYF

SEQ ID NO: 925383 - protein, 9 aa, Homo Sapiens
LSVSSGSSS

SEQ ID NO: 925384 - protein, 9 aa, Homo Sapiens
LFWGPYLRF

SEQ ID NO: 925385 - protein, 9 aa, Homo Sapiens
GKHGPAGTS

SEQ ID NO: 925386 - protein, 9 aa, Homo Sapiens
SFEVHYCSL

SEQ ID NO: 925387 - protein, 9 aa, Homo Sapiens
VGINQPPFG

SEQ ID NO: 925388 - protein, 9 aa, Homo Sapiens
LKASKDTIC

SEQ ID NO: 925389 - protein, 9 aa, Homo Sapiens
SRRPYCHFH

SEQ ID NO: 925390 - protein, 9 aa, Homo Sapiens
EQEKSHRNS

SEQ ID NO: 925391 - protein, 9 aa, Homo Sapiens
KMCSQNTSI

SEQ ID NO: 925392 - protein, 9 aa, Homo Sapiens
ASRHPHKGI

SEQ ID NO: 925393 - protein, 9 aa, Homo Sapiens
PGNFYVFSE

SEQ ID NO: 925394 - protein, 9 aa, Homo Sapiens
GRLHCKPAK

SEQ ID NO: 925395 - protein, 9 aa, Homo Sapiens
SVARAWSSV

SEQ ID NO: 925396 - protein, 9 aa, Homo Sapiens
DGTCLFSHH

SEQ ID NO: 925397 - protein, 9 aa, Homo Sapiens
PTTMCTSLL

SEQ ID NO: 925398 - protein, 9 aa, Homo Sapiens
LLILVCQLY

SEQ ID NO: 925399 - protein, 9 aa, Homo Sapiens
ASEKNYNLT

SEQ ID NO: 925400 - protein, 9 aa, Homo Sapiens
PSRWAVRLG

SEQ ID NO: 925401 - protein, 9 aa, Homo Sapiens
NENSEGFHE

SEQ ID NO: 925402 - protein, 9 aa, Homo Sapiens
LEKNALIMF

SEQ ID NO: 925403 - protein, 9 aa, Homo Sapiens
IDYSLSGVS

SEQ ID NO: 925404 - protein, 9 aa, Homo Sapiens
RLYPPLNTF

SEQ ID NO: 925405 - protein, 9 aa, Homo Sapiens
SLSLQKQLS

SEQ ID NO: 925406 - protein, 9 aa, Homo Sapiens
KMKQSKEKS

SEQ ID NO: 925407 - protein, 9 aa, Homo Sapiens
GIEIAEIMI

SEQ ID NO: 925408 - protein, 9 aa, Homo Sapiens
WKSPGQRAR

SEQ ID NO: 925409 - protein, 9 aa, Homo Sapiens
QCEQVHCRL

SEQ ID NO: 925410 - protein, 9 aa, Homo Sapiens
LEVAKRSSA

SEQ ID NO: 925411 - protein, 9 aa, Homo Sapiens
NLQCFTCTY

SEQ ID NO: 925412 - protein, 9 aa, Homo Sapiens
PRHEGRAPS

SEQ ID NO: 925413 - protein, 9 aa, Homo Sapiens
GSSVLTGRT

SEQ ID NO: 925414 - protein, 9 aa, Homo Sapiens
CAFSNSCIP

SEQ ID NO: 925415 - protein, 9 aa, Homo Sapiens
LRALSLEDQ

SEQ ID NO: 925416 - protein, 9 aa, Homo Sapiens
KSDESGDER

SEQ ID NO: 925417 - protein, 9 aa, Homo Sapiens
SWVQDGSPD

SEQ ID NO: 925418 - protein, 9 aa, Homo Sapiens
IPNKKDEKE

SEQ ID NO: 925419 - protein, 9 aa, Homo Sapiens
RAPSRGRDG

SEQ ID NO: 925420 - protein, 9 aa, Homo Sapiens
VIDYSLSGV

SEQ ID NO: 925421 - protein, 9 aa, Homo Sapiens
SCVVNVTYF

SEQ ID NO: 925422 - protein, 9 aa, Homo Sapiens
SIKWTSALL

SEQ ID NO: 925423 - protein, 9 aa, Homo Sapiens
GKREKMGIP

SEQ ID NO: 925424 - protein, 9 aa, Homo Sapiens
IESEFIGIG

SEQ ID NO: 925425 - protein, 9 aa, Homo Sapiens
NVAVTQPES

SEQ ID NO: 925426 - protein, 9 aa, Homo Sapiens
IAHMKAREA

SEQ ID NO: 925427 - protein, 9 aa, Homo Sapiens
ILQTLNVYF

SEQ ID NO: 925428 - protein, 9 aa, Homo Sapiens
EKMANGHHI

SEQ ID NO: 925429 - protein, 9 aa, Homo Sapiens
LSLQKQLSL

SEQ ID NO: 925430 - protein, 9 aa, Homo Sapiens
CYCHMGTHC

SEQ ID NO: 925431 - protein, 9 aa, Homo Sapiens
RGSSGTQAS

SEQ ID NO: 925432 - protein, 9 aa, Homo Sapiens
DAESRQEVL

SEQ ID NO: 925433 - protein, 9 aa, Homo Sapiens
GRAPSRGRD

SEQ ID NO: 925434 - protein, 9 aa, Homo Sapiens
FFAGGCGGT

SEQ ID NO: 925435 - protein, 9 aa, Homo Sapiens
EDTSDGLAA

SEQ ID NO: 925436 - protein, 9 aa, Homo Sapiens
SGFPSKFPG

SEQ ID NO: 925437 - protein, 9 aa, Homo Sapiens
WAAEECRIQ

SEQ ID NO: 925438 - protein, 9 aa, Homo Sapiens
SALQAEDKA

SEQ ID NO: 925439 - protein, 9 aa, Homo Sapiens
TEFDVWAYG

SEQ ID NO: 925440 - protein, 9 aa, Homo Sapiens
ETEYEYIGS

SEQ ID NO: 925441 - protein, 9 aa, Homo Sapiens
LGFHINKKA

SEQ ID NO: 925442 - protein, 9 aa, Homo Sapiens
QQGGHQQGS

SEQ ID NO: 925443 - protein, 9 aa, Homo Sapiens
DKIDKEYLG

SEQ ID NO: 925444 - protein, 9 aa, Homo Sapiens
EKEKQLKTS

SEQ ID NO: 925445 - protein, 9 aa, Homo Sapiens
KFSLVLRFV

SEQ ID NO: 925446 - protein, 9 aa, Homo Sapiens
PCHCCVLAA

SEQ ID NO: 925447 - protein, 9 aa, Homo Sapiens
YFSVPLSVY

SEQ ID NO: 925448 - protein, 9 aa, Homo Sapiens
GRGHGGGKH

SEQ ID NO: 925449 - protein, 9 aa, Homo Sapiens
LKSCSFDKI

SEQ ID NO: 925450 - protein, 9 aa, Homo Sapiens
LSGYGGTNV

SEQ ID NO: 925451 - protein, 9 aa, Homo Sapiens
LNGELVLAS

SEQ ID NO: 925452 - protein, 9 aa, Homo Sapiens
RGMHQKESY

SEQ ID NO: 925453 - protein, 9 aa, Homo Sapiens
QFCQALGAH

SEQ ID NO: 925454 - protein, 9 aa, Homo Sapiens
DLVWGQIKR

SEQ ID NO: 925455 - protein, 9 aa, Homo Sapiens
RGHGGGKHG

SEQ ID NO: 925456 - protein, 9 aa, Homo Sapiens
LSNGRSVSL

SEQ ID NO: 925457 - protein, 9 aa, Homo Sapiens
VSPLSSSMD

SEQ ID NO: 925458 - protein, 9 aa, Homo Sapiens
SMYFGCPED

SEQ ID NO: 925459 - protein, 9 aa, Homo Sapiens
IPSSVQQVL

SEQ ID NO: 925460 - protein, 9 aa, Homo Sapiens
SKKSSFANV

SEQ ID NO: 925461 - protein, 9 aa, Homo Sapiens
VLNPRQSMI

SEQ ID NO: 925462 - protein, 9 aa, Homo Sapiens
EQFCQALGA

SEQ ID NO: 925463 - protein, 9 aa, Homo Sapiens
QREHFSNLA

SEQ ID NO: 925464 - protein, 9 aa, Homo Sapiens
RGKSYQCGV

SEQ ID NO: 925465 - protein, 9 aa, Homo Sapiens
DRGQHLDSE

SEQ ID NO: 925466 - protein, 9 aa, Homo Sapiens
IENGKAKIQ

SEQ ID NO: 925467 - protein, 9 aa, Homo Sapiens
DAAGFKRHV

SEQ ID NO: 925468 - protein, 9 aa, Homo Sapiens
LLAALIRRN

SEQ ID NO: 925469 - protein, 9 aa, Homo Sapiens
PFSCTQCGQ

SEQ ID NO: 925470 - protein, 9 aa, Homo Sapiens
DSISLVFPE

SEQ ID NO: 925471 - protein, 9 aa, Homo Sapiens
LSLLLLLTF

SEQ ID NO: 925472 - protein, 9 aa, Homo Sapiens
EAIIGTNVL

SEQ ID NO: 925473 - protein, 9 aa, Homo Sapiens
RISVLCIWM

SEQ ID NO: 925474 - protein, 9 aa, Homo Sapiens
LRISVLCIW

SEQ ID NO: 925475 - protein, 9 aa, Homo Sapiens
DWQPNEQGL

SEQ ID NO: 925476 - protein, 9 aa, Homo Sapiens
DLDYCPIAM

SEQ ID NO: 925477 - protein, 9 aa, Homo Sapiens
DYLYATNSN

SEQ ID NO: 925478 - protein, 9 aa, Homo Sapiens
GERPFSCTQ

SEQ ID NO: 925479 - protein, 9 aa, Homo Sapiens
KKLLKISYS

SEQ ID NO: 925480 - protein, 9 aa, Homo Sapiens
SPEARSEHG

SEQ ID NO: 925481 - protein, 9 aa, Homo Sapiens
LNPKANQEK

SEQ ID NO: 925482 - protein, 9 aa, Homo Sapiens
RRRLSAYQA

SEQ ID NO: 925483 - protein, 9 aa, Homo Sapiens
ANGKREKMG

SEQ ID NO: 925484 - protein, 9 aa, Homo Sapiens
DPQKIHLEC

SEQ ID NO: 925485 - protein, 9 aa, Homo Sapiens
SILNMAMFC

SEQ ID NO: 925486 - protein, 9 aa, Homo Sapiens
RKKVFSTCG

SEQ ID NO: 925487 - protein, 9 aa, Homo Sapiens
WRELDRANK

SEQ ID NO: 925488 - protein, 9 aa, Homo Sapiens
AEERQKAFS

SEQ ID NO: 925489 - protein, 9 aa, Homo Sapiens
NYLKPRTEY

SEQ ID NO: 925490 - protein, 9 aa, Homo Sapiens
MLEYEPARG

SEQ ID NO: 925491 - protein, 9 aa, Homo Sapiens
HEGRAPSRG

SEQ ID NO: 925492 - protein, 9 aa, Homo Sapiens
EQPSEVQHE

SEQ ID NO: 925493 - protein, 9 aa, Homo Sapiens
RPRQQGMMR

SEQ ID NO: 925494 - protein, 9 aa, Homo Sapiens
LEVQREWQE

SEQ ID NO: 925495 - protein, 9 aa, Homo Sapiens
QSAEGRKKV

SEQ ID NO: 925496 - protein, 9 aa, Homo Sapiens
PKSRYTFKI

SEQ ID NO: 925497 - protein, 9 aa, Homo Sapiens
RSGFPSKFP

SEQ ID NO: 925498 - protein, 9 aa, Homo Sapiens
HRLCAVSQV

SEQ ID NO: 925499 - protein, 9 aa, Homo Sapiens
YVFMGHQLT

SEQ ID NO: 925500 - protein, 9 aa, Homo Sapiens
EEPEASHNT

SEQ ID NO: 925501 - protein, 9 aa, Homo Sapiens
VYHRTQVPQ

SEQ ID NO: 925502 - protein, 9 aa, Homo Sapiens
KMSEYPLPK

SEQ ID NO: 925503 - protein, 9 aa, Homo Sapiens
KIDKEYLGK

SEQ ID NO: 925504 - protein, 9 aa, Homo Sapiens
REWQEIRQI

SEQ ID NO: 925505 - protein, 9 aa, Homo Sapiens
DLFLKTLLQ

SEQ ID NO: 925506 - protein, 9 aa, Homo Sapiens
NHLDYSSKS

SEQ ID NO: 925507 - protein, 9 aa, Homo Sapiens
GNISLRCPV

SEQ ID NO: 925508 - protein, 9 aa, Homo Sapiens
PQPQPQPQL

SEQ ID NO: 925509 - protein, 9 aa, Homo Sapiens
AREAAVRVD

SEQ ID NO: 925510 - protein, 9 aa, Homo Sapiens
DAQLRQFSQ

SEQ ID NO: 925511 - protein, 9 aa, Homo Sapiens
TSPSTAFQA

SEQ ID NO: 925512 - protein, 9 aa, Homo Sapiens
QMVWVLSRN

SEQ ID NO: 925513 - protein, 9 aa, Homo Sapiens
KLYPCPQCG

SEQ ID NO: 925514 - protein, 9 aa, Homo Sapiens
GMMRGMHQK

SEQ ID NO: 925515 - protein, 9 aa, Homo Sapiens
LLVIIEVFG

SEQ ID NO: 925516 - protein, 9 aa, Homo Sapiens
NKFCCDSGR

SEQ ID NO: 925517 - protein, 9 aa, Homo Sapiens
EFFKGDPKD

SEQ ID NO: 925518 - protein, 9 aa, Homo Sapiens
GTCLFSHHV

SEQ ID NO: 925519 - protein, 9 aa, Homo Sapiens
LQCFTCTYK

SEQ ID NO: 925520 - protein, 9 aa, Homo Sapiens
SGSTKLEQV

SEQ ID NO: 925521 - protein, 9 aa, Homo Sapiens
GFHFEGCLY

SEQ ID NO: 925522 - protein, 9 aa, Homo Sapiens
KLFQLKEEE

SEQ ID NO: 925523 - protein, 9 aa, Homo Sapiens
FLCDTSSNK

SEQ ID NO: 925524 - protein, 9 aa, Homo Sapiens
MSGQRNIPP

SEQ ID NO: 925525 - protein, 9 aa, Homo Sapiens
TDYIVYIDE

SEQ ID NO: 925526 - protein, 9 aa, Homo Sapiens
AEDKAISDC

SEQ ID NO: 925527 - protein, 9 aa, Homo Sapiens
RRSSLYSQP

SEQ ID NO: 925528 - protein, 9 aa, Homo Sapiens
YATIVIGFP

SEQ ID NO: 925529 - protein, 9 aa, Homo Sapiens
EKGIPSFQT

SEQ ID NO: 925530 - protein, 9 aa, Homo Sapiens
QCVDGKWTT

SEQ ID NO: 925531 - protein, 9 aa, Homo Sapiens
KNKGMFLGF

SEQ ID NO: 925532 - protein, 9 aa, Homo Sapiens
VYGAEKERL

SEQ ID NO: 925533 - protein, 9 aa, Homo Sapiens
ALSGEGATS

SEQ ID NO: 925534 - protein, 9 aa, Homo Sapiens
YFIILPENF

SEQ ID NO: 925535 - protein, 9 aa, Homo Sapiens
TIVIGFPDL

SEQ ID NO: 925536 - protein, 9 aa, Homo Sapiens
VLDDITVSS

SEQ ID NO: 925537 - protein, 9 aa, Homo Sapiens
SASASRHPH

SEQ ID NO: 925538 - protein, 9 aa, Homo Sapiens
KDDFGIYLK

SEQ ID NO: 925539 - protein, 9 aa, Homo Sapiens
GIPSFQTYE

SEQ ID NO: 925540 - protein, 9 aa, Homo Sapiens
ASCITWKGT

SEQ ID NO: 925541 - protein, 9 aa, Homo Sapiens
NIEQILDKV

SEQ ID NO: 925542 - protein, 9 aa, Homo Sapiens
FINMSQKNV

SEQ ID NO: 925543 - protein, 9 aa, Homo Sapiens
QESPRCKIC

SEQ ID NO: 925544 - protein, 9 aa, Homo Sapiens
LLKSKFKTG

SEQ ID NO: 925545 - protein, 9 aa, Homo Sapiens
ITNNFGSVA

SEQ ID NO: 925546 - protein, 9 aa, Homo Sapiens
CRRKKIEQM

SEQ ID NO: 925547 - protein, 9 aa, Homo Sapiens
LEQVKLMPP

SEQ ID NO: 925548 - protein, 9 aa, Homo Sapiens
VAQACVRHC

SEQ ID NO: 925549 - protein, 9 aa, Homo Sapiens
AGKLSLLKS

SEQ ID NO: 925550 - protein, 9 aa, Homo Sapiens
AARTQRARA

SEQ ID NO: 925551 - protein, 9 aa, Homo Sapiens
ERGPYGPKR

SEQ ID NO: 925552 - protein, 9 aa, Homo Sapiens
RVAPCSGGS

SEQ ID NO: 925553 - protein, 9 aa, Homo Sapiens
VDKFGNYSC

SEQ ID NO: 925554 - protein, 9 aa, Homo Sapiens
FLTLSRKKG

SEQ ID NO: 925555 - protein, 9 aa, Homo Sapiens
TPWLRDFHN

SEQ ID NO: 925556 - protein, 9 aa, Homo Sapiens
VQQLSVLFS

SEQ ID NO: 925557 - protein, 9 aa, Homo Sapiens
SSFSSSSTS

SEQ ID NO: 925558 - protein, 9 aa, Homo Sapiens
LNQEPLEET

SEQ ID NO: 925559 - protein, 9 aa, Homo Sapiens
TLDADKFQD

SEQ ID NO: 925560 - protein, 9 aa, Homo Sapiens
RRNRKNCAQ

SEQ ID NO: 925561 - protein, 9 aa, Homo Sapiens
TLHNWKVWV

SEQ ID NO: 925562 - protein, 9 aa, Homo Sapiens
MAAGFWVTG

SEQ ID NO: 925563 - protein, 9 aa, Homo Sapiens
KNNFSPKVE

SEQ ID NO: 925564 - protein, 9 aa, Homo Sapiens
TQGPSPRGW

SEQ ID NO: 925565 - protein, 9 aa, Homo Sapiens
GELGNISLR

SEQ ID NO: 925566 - protein, 9 aa, Homo Sapiens
LRLKHQCPS

SEQ ID NO: 925567 - protein, 9 aa, Homo Sapiens
LTTDYLVGM

SEQ ID NO: 925568 - protein, 9 aa, Homo Sapiens
SISCSSPCT

SEQ ID NO: 925569 - protein, 9 aa, Homo Sapiens
DQSFFKISY

SEQ ID NO: 925570 - protein, 9 aa, Homo Sapiens
QNTSINMQL

SEQ ID NO: 925571 - protein, 9 aa, Homo Sapiens
TLILVKDLP

SEQ ID NO: 925572 - protein, 9 aa, Homo Sapiens
NMSQKNVDM

SEQ ID NO: 925573 - protein, 9 aa, Homo Sapiens
PYWHCRLLL

SEQ ID NO: 925574 - protein, 9 aa, Homo Sapiens
PRYIAVAVH

SEQ ID NO: 925575 - protein, 9 aa, Homo Sapiens
HGLAVCLAP

SEQ ID NO: 925576 - protein, 9 aa, Homo Sapiens
AITAQYHGR

SEQ ID NO: 925577 - protein, 9 aa, Homo Sapiens
VMLLAYLTP

SEQ ID NO: 925578 - protein, 9 aa, Homo Sapiens
LASLLVDIT

SEQ ID NO: 925579 - protein, 9 aa, Homo Sapiens
QFLEMYGER

SEQ ID NO: 925580 - protein, 9 aa, Homo Sapiens
LDLANITLE

SEQ ID NO: 925581 - protein, 9 aa, Homo Sapiens
DSSVPPRVY

SEQ ID NO: 925582 - protein, 9 aa, Homo Sapiens
HGMEMPFIK

SEQ ID NO: 925583 - protein, 9 aa, Homo Sapiens
KTKKENRVS

SEQ ID NO: 925584 - protein, 9 aa, Homo Sapiens
ITVSSNEKH

SEQ ID NO: 925585 - protein, 9 aa, Homo Sapiens
PLPLWGVPL

SEQ ID NO: 925586 - protein, 9 aa, Homo Sapiens
KDKGVVYSV

SEQ ID NO: 925587 - protein, 9 aa, Homo Sapiens
KKIEQMFQN

SEQ ID NO: 925588 - protein, 9 aa, Homo Sapiens
GVTSRRPYC

SEQ ID NO: 925589 - protein, 9 aa, Homo Sapiens
IGFPDLMSP

SEQ ID NO: 925590 - protein, 9 aa, Homo Sapiens
FGRGRQRET

SEQ ID NO: 925591 - protein, 9 aa, Homo Sapiens
LQLVANLMV

SEQ ID NO: 925592 - protein, 9 aa, Homo Sapiens
VNSIANFFC

SEQ ID NO: 925593 - protein, 9 aa, Homo Sapiens
REAAVRVDF

SEQ ID NO: 925594 - protein, 9 aa, Homo Sapiens
VNVCLGFHI

SEQ ID NO: 925595 - protein, 9 aa, Homo Sapiens
AATRVDAIC

SEQ ID NO: 925596 - protein, 9 aa, Homo Sapiens
FIIGFYTLV

SEQ ID NO: 925597 - protein, 9 aa, Homo Sapiens
KLLKISYSK

SEQ ID NO: 925598 - protein, 9 aa, Homo Sapiens
APRNLVSKK

SEQ ID NO: 925599 - protein, 9 aa, Homo Sapiens
MFQRLRTPQ

SEQ ID NO: 925600 - protein, 9 aa, Homo Sapiens
DASVAKNPK

SEQ ID NO: 925601 - protein, 9 aa, Homo Sapiens
KGVVYSVVH

SEQ ID NO: 925602 - protein, 9 aa, Homo Sapiens
LVTITNNFG

SEQ ID NO: 925603 - protein, 9 aa, Homo Sapiens
STLDPSKLF

SEQ ID NO: 925604 - protein, 9 aa, Homo Sapiens
PAAHLNSVS

SEQ ID NO: 925605 - protein, 9 aa, Homo Sapiens
DKALSFYIS

SEQ ID NO: 925606 - protein, 9 aa, Homo Sapiens
PRKGTRTKR

SEQ ID NO: 925607 - protein, 9 aa, Homo Sapiens
LQSFNDVGC

SEQ ID NO: 925608 - protein, 9 aa, Homo Sapiens
SKFFLSIKE

SEQ ID NO: 925609 - protein, 9 aa, Homo Sapiens
NLVAILPYY

SEQ ID NO: 925610 - protein, 9 aa, Homo Sapiens
VTKKFIRDP

SEQ ID NO: 925611 - protein, 9 aa, Homo Sapiens
SRHPHKGIP

SEQ ID NO: 925612 - protein, 9 aa, Homo Sapiens
RQQGMMRGM

SEQ ID NO: 925613 - protein, 9 aa, Homo Sapiens
IKSALQAED

SEQ ID NO: 925614 - protein, 9 aa, Homo Sapiens
GLPGARGPK

SEQ ID NO: 925615 - protein, 9 aa, Homo Sapiens
EEMFQRLRT

SEQ ID NO: 925616 - protein, 9 aa, Homo Sapiens
QPDLNLLSE

SEQ ID NO: 925617 - protein, 9 aa, Homo Sapiens
QKASSNVFS

SEQ ID NO: 925618 - protein, 9 aa, Homo Sapiens
GGRGHGGGK

SEQ ID NO: 925619 - protein, 9 aa, Homo Sapiens
LATWTSKYS

SEQ ID NO: 925620 - protein, 9 aa, Homo Sapiens
GVAGKSDES

SEQ ID NO: 925621 - protein, 9 aa, Homo Sapiens
DLNTNLETS

SEQ ID NO: 925622 - protein, 9 aa, Homo Sapiens
AWSSVFDNL

SEQ ID NO: 925623 - protein, 9 aa, Homo Sapiens
LRIAEQEHI

SEQ ID NO: 925624 - protein, 9 aa, Homo Sapiens
VPSLFFNDR

SEQ ID NO: 925625 - protein, 9 aa, Homo Sapiens
VTLQAFDSH

SEQ ID NO: 925626 - protein, 9 aa, Homo Sapiens
TEKKFFFVK

SEQ ID NO: 925627 - protein, 9 aa, Homo Sapiens
DIDDAVRRL

SEQ ID NO: 925628 - protein, 9 aa, Homo Sapiens
ATVATEKKF

SEQ ID NO: 925629 - protein, 9 aa, Homo Sapiens
EFIPCPTES

SEQ ID NO: 925630 - protein, 9 aa, Homo Sapiens
DLNVDYGLK

SEQ ID NO: 925631 - protein, 9 aa, Homo Sapiens
CKMSEYPLP

SEQ ID NO: 925632 - protein, 9 aa, Homo Sapiens
KNALIMFSR

SEQ ID NO: 925633 - protein, 9 aa, Homo Sapiens
ECRIQKLIK

SEQ ID NO: 925634 - protein, 9 aa, Homo Sapiens
SQIDSLEKI

SEQ ID NO: 925635 - protein, 9 aa, Homo Sapiens
EPARGSPSG

SEQ ID NO: 925636 - protein, 9 aa, Homo Sapiens
PDMAENESE

SEQ ID NO: 925637 - protein, 9 aa, Homo Sapiens
AVSAPKGIL

SEQ ID NO: 925638 - protein, 9 aa, Homo Sapiens
HEEPEASHN

SEQ ID NO: 925639 - protein, 9 aa, Homo Sapiens
CINLDAASF

SEQ ID NO: 925640 - protein, 9 aa, Homo Sapiens
TAEITCKDN

SEQ ID NO: 925641 - protein, 9 aa, Homo Sapiens
EKNYNLTKV

SEQ ID NO: 925642 - protein, 9 aa, Homo Sapiens
PGKMKQSKE

SEQ ID NO: 925643 - protein, 9 aa, Homo Sapiens
GTSSANFDT

SEQ ID NO: 925644 - protein, 9 aa, Homo Sapiens
AAANVAVTQ

SEQ ID NO: 925645 - protein, 9 aa, Homo Sapiens
VPDSVNFFA

SEQ ID NO: 925646 - protein, 9 aa, Homo Sapiens
FFCLLSQGG

SEQ ID NO: 925647 - protein, 9 aa, Homo Sapiens
KFIRDPIRI

SEQ ID NO: 925648 - protein, 9 aa, Homo Sapiens
IKEPHWLFG

SEQ ID NO: 925649 - protein, 9 aa, Homo Sapiens
QKFYMNSVS

SEQ ID NO: 925650 - protein, 9 aa, Homo Sapiens
KPLIMLLSS

SEQ ID NO: 925651 - protein, 9 aa, Homo Sapiens
LIIPETQVL

SEQ ID NO: 925652 - protein, 9 aa, Homo Sapiens
GFERTMSPY

SEQ ID NO: 925653 - protein, 9 aa, Homo Sapiens
CITWKGTNG

SEQ ID NO: 925654 - protein, 9 aa, Homo Sapiens
IVSMMSEDK

SEQ ID NO: 925655 - protein, 9 aa, Homo Sapiens
QGNYIYGTD

SEQ ID NO: 925656 - protein, 9 aa, Homo Sapiens
SCVRSLELD

SEQ ID NO: 925657 - protein, 9 aa, Homo Sapiens
ENPMVEALC

SEQ ID NO: 925658 - protein, 9 aa, Homo Sapiens
QEDKATIKC

SEQ ID NO: 925659 - protein, 9 aa, Homo Sapiens
SLFFNDRLL

SEQ ID NO: 925660 - protein, 9 aa, Homo Sapiens
VVYGAEKER

SEQ ID NO: 925661 - protein, 9 aa, Homo Sapiens
QIEEEGILR

SEQ ID NO: 925662 - protein, 9 aa, Homo Sapiens
KKKEKASVI

SEQ ID NO: 925663 - protein, 9 aa, Homo Sapiens
VANLMVWVP

SEQ ID NO: 925664 - protein, 9 aa, Homo Sapiens
YTIPTPPFF

SEQ ID NO: 925665 - protein, 9 aa, Homo Sapiens
VVNVTYFPF

SEQ ID NO: 925666 - protein, 9 aa, Homo Sapiens
TLNYLKPRT

SEQ ID NO: 925667 - protein, 9 aa, Homo Sapiens
SWPCPKCRF

SEQ ID NO: 925668 - protein, 9 aa, Homo Sapiens
EAEVAPGFE

SEQ ID NO: 925669 - protein, 9 aa, Homo Sapiens
DDFNKTGLV

SEQ ID NO: 925670 - protein, 9 aa, Homo Sapiens
QYPNLSQLK

SEQ ID NO: 925671 - protein, 9 aa, Homo Sapiens
ASLLLPAPA

SEQ ID NO: 925672 - protein, 9 aa, Homo Sapiens
TLSRKKGPA

SEQ ID NO: 925673 - protein, 9 aa, Homo Sapiens
IVEVQESPR

SEQ ID NO: 925674 - protein, 9 aa, Homo Sapiens
ILNLQGKGL

SEQ ID NO: 925675 - protein, 9 aa, Homo Sapiens
YIVYIDELS

SEQ ID NO: 925676 - protein, 9 aa, Homo Sapiens
PLNPKANQE

SEQ ID NO: 925677 - protein, 9 aa, Homo Sapiens
KLVFGSVFL

SEQ ID NO: 925678 - protein, 9 aa, Homo Sapiens
VEKTRCQHK

SEQ ID NO: 925679 - protein, 9 aa, Homo Sapiens
LAEVQEDLE

SEQ ID NO: 925680 - protein, 9 aa, Homo Sapiens
GSPKVRSLR

SEQ ID NO: 925681 - protein, 9 aa, Homo Sapiens
DNHLTKLSK

SEQ ID NO: 925682 - protein, 9 aa, Homo Sapiens
IEVGAFNSL

SEQ ID NO: 925683 - protein, 9 aa, Homo Sapiens
RQESPWKSP

SEQ ID NO: 925684 - protein, 9 aa, Homo Sapiens
SAKVIISKQ

SEQ ID NO: 925685 - protein, 9 aa, Homo Sapiens
HSLCYSTVM

SEQ ID NO: 925686 - protein, 9 aa, Homo Sapiens
KAILHASRS

SEQ ID NO: 925687 - protein, 9 aa, Homo Sapiens
KIFKDEMNK

SEQ ID NO: 925688 - protein, 9 aa, Homo Sapiens
VQFNNRHMM

SEQ ID NO: 925689 - protein, 9 aa, Homo Sapiens
QCIKSALQA

SEQ ID NO: 925690 - protein, 9 aa, Homo Sapiens
PMKKLYGIN

SEQ ID NO: 925691 - protein, 9 aa, Homo Sapiens
VYYQGKCYC

SEQ ID NO: 925692 - protein, 9 aa, Homo Sapiens
LSKSDQSFF

SEQ ID NO: 925693 - protein, 9 aa, Homo Sapiens
PWLRDFHNP

SEQ ID NO: 925694 - protein, 9 aa, Homo Sapiens
ERIAKNHGS

SEQ ID NO: 925695 - protein, 9 aa, Homo Sapiens
VQLCVLGQN

SEQ ID NO: 925696 - protein, 9 aa, Homo Sapiens
RFGDIIPLG

SEQ ID NO: 925697 - protein, 9 aa, Homo Sapiens
PSKNKGMFL

SEQ ID NO: 925698 - protein, 9 aa, Homo Sapiens
LQGQLQPLL

SEQ ID NO: 925699 - protein, 9 aa, Homo Sapiens
KNYATIVIG

SEQ ID NO: 925700 - protein, 9 aa, Homo Sapiens
FERTMSPYP

SEQ ID NO: 925701 - protein, 9 aa, Homo Sapiens
DVFSQINQP

SEQ ID NO: 925702 - protein, 9 aa, Homo Sapiens
KQSKEKSPQ

SEQ ID NO: 925703 - protein, 9 aa, Homo Sapiens
FIILPENFL

SEQ ID NO: 925704 - protein, 9 aa, Homo Sapiens
SRNSLIAAP

SEQ ID NO: 925705 - protein, 9 aa, Homo Sapiens
KASVIIQNN

SEQ ID NO: 925706 - protein, 9 aa, Homo Sapiens
EGATSRKEP

SEQ ID NO: 925707 - protein, 9 aa, Homo Sapiens
FIRDPIRIL

SEQ ID NO: 925708 - protein, 9 aa, Homo Sapiens
NQPPFGIFV

SEQ ID NO: 925709 - protein, 9 aa, Homo Sapiens
YLVGMRVTY

SEQ ID NO: 925710 - protein, 9 aa, Homo Sapiens
VQCEQVHCR

SEQ ID NO: 925711 - protein, 9 aa, Homo Sapiens
EVHYCSLSL

SEQ ID NO: 925712 - protein, 9 aa, Homo Sapiens
ISSEIQQLE

SEQ ID NO: 925713 - protein, 9 aa, Homo Sapiens
KLSLLKSKF

SEQ ID NO: 925714 - protein, 9 aa, Homo Sapiens
KMPKSQKLW

SEQ ID NO: 925715 - protein, 9 aa, Homo Sapiens
SKHPMANII

SEQ ID NO: 925716 - protein, 9 aa, Homo Sapiens
LKTSCKEKT

SEQ ID NO: 925717 - protein, 9 aa, Homo Sapiens
PESPSPPYS

SEQ ID NO: 925718 - protein, 9 aa, Homo Sapiens
FAVRLGLLK

SEQ ID NO: 925719 - protein, 9 aa, Homo Sapiens
KSYQCGVCG

SEQ ID NO: 925720 - protein, 9 aa, Homo Sapiens
RFHRFNEDC

SEQ ID NO: 925721 - protein, 9 aa, Homo Sapiens
QCRRKKIEQ

SEQ ID NO: 925722 - protein, 9 aa, Homo Sapiens
NYRQIEPPF

SEQ ID NO: 925723 - protein, 9 aa, Homo Sapiens
REAVLFKTK

SEQ ID NO: 925724 - protein, 9 aa, Homo Sapiens
LESLRQKDD

SEQ ID NO: 925725 - protein, 9 aa, Homo Sapiens
EYEYIGSEE

SEQ ID NO: 925726 - protein, 9 aa, Homo Sapiens
LQVFSSYLA

SEQ ID NO: 925727 - protein, 9 aa, Homo Sapiens
FITYVFMGH

SEQ ID NO: 925728 - protein, 9 aa, Homo Sapiens
NGHHIHDRA

SEQ ID NO: 925729 - protein, 9 aa, Homo Sapiens
LNLQGKGLS

SEQ ID NO: 925730 - protein, 9 aa, Homo Sapiens
KHGPAGTSV

SEQ ID NO: 925731 - protein, 9 aa, Homo Sapiens
KENSQPGEQ

SEQ ID NO: 925732 - protein, 9 aa, Homo Sapiens
STPKKEHCY

SEQ ID NO: 925733 - protein, 9 aa, Homo Sapiens
IRGRTSTES

SEQ ID NO: 925734 - protein, 9 aa, Homo Sapiens
FHENLLDVR

SEQ ID NO: 925735 - protein, 9 aa, Homo Sapiens
TSQGNAVNS

SEQ ID NO: 925736 - protein, 9 aa, Homo Sapiens
AYLTPGAQK

SEQ ID NO: 925737 - protein, 9 aa, Homo Sapiens
GDVIDYSLS

SEQ ID NO: 925738 - protein, 9 aa, Homo Sapiens
SASRHPHKG

SEQ ID NO: 925739 - protein, 9 aa, Homo Sapiens
LTLLCAVGA

SEQ ID NO: 925740 - protein, 9 aa, Homo Sapiens
NNKKKLSCY

SEQ ID NO: 925741 - protein, 9 aa, Homo Sapiens
LFKNKVIWV

SEQ ID NO: 925742 - protein, 9 aa, Homo Sapiens
WPTLSIYKL

SEQ ID NO: 925743 - protein, 9 aa, Homo Sapiens
SFLEDLQYQ

SEQ ID NO: 925744 - protein, 9 aa, Homo Sapiens
NHEGITGSR

SEQ ID NO: 925745 - protein, 9 aa, Homo Sapiens
ERKKAYLTC

SEQ ID NO: 925746 - protein, 9 aa, Homo Sapiens
ITLKPAQPS

SEQ ID NO: 925747 - protein, 9 aa, Homo Sapiens
NNILNLQGK

SEQ ID NO: 925748 - protein, 9 aa, Homo Sapiens
SGRNILRLK

SEQ ID NO: 925749 - protein, 9 aa, Homo Sapiens
LNKSLGASC

SEQ ID NO: 925750 - protein, 9 aa, Homo Sapiens
ALHKPMYLF

SEQ ID NO: 925751 - protein, 9 aa, Homo Sapiens
FCSWFFSRS

SEQ ID NO: 925752 - protein, 9 aa, Homo Sapiens
VWGQIKRLT

SEQ ID NO: 925753 - protein, 9 aa, Homo Sapiens
PQKIHLECS

SEQ ID NO: 925754 - protein, 9 aa, Homo Sapiens
GTAKNPFLD

SEQ ID NO: 925755 - protein, 9 aa, Homo Sapiens
YQGKCYCHM

SEQ ID NO: 925756 - protein, 9 aa, Homo Sapiens
PAEEANSHT

SEQ ID NO: 925757 - protein, 9 aa, Homo Sapiens
HKIMHRVAP

SEQ ID NO: 925758 - protein, 9 aa, Homo Sapiens
LPSSPIYDS

SEQ ID NO: 925759 - protein, 9 aa, Homo Sapiens
RLLGQIEEE

SEQ ID NO: 925760 - protein, 9 aa, Homo Sapiens
NLMVWVPEG

SEQ ID NO: 925761 - protein, 9 aa, Homo Sapiens
VLYGASNEN

SEQ ID NO: 925762 - protein, 9 aa, Homo Sapiens
LNYRQIEPP

SEQ ID NO: 925763 - protein, 9 aa, Homo Sapiens
DYCPIAMQS

SEQ ID NO: 925764 - protein, 9 aa, Homo Sapiens
LMVWVPEGG

SEQ ID NO: 925765 - protein, 9 aa, Homo Sapiens
SSRDSPSSS

SEQ ID NO: 925766 - protein, 9 aa, Homo Sapiens
KGAKGEKEN

SEQ ID NO: 925767 - protein, 9 aa, Homo Sapiens
LDYSSKSFD

SEQ ID NO: 925768 - protein, 9 aa, Homo Sapiens
RQKDDFGIY

SEQ ID NO: 925769 - protein, 9 aa, Homo Sapiens
SEKNYNLTK

SEQ ID NO: 925770 - protein, 9 aa, Homo Sapiens
INLVAILPY

SEQ ID NO: 925771 - protein, 9 aa, Homo Sapiens
QYHGRPLAQ

SEQ ID NO: 925772 - protein, 9 aa, Homo Sapiens
LTCHGSGPD

SEQ ID NO: 925773 - protein, 9 aa, Homo Sapiens
LLLPAPAPL

SEQ ID NO: 925774 - protein, 9 aa, Homo Sapiens
DIKTSQKFS

SEQ ID NO: 925775 - protein, 9 aa, Homo Sapiens
EETETLAVS

SEQ ID NO: 925776 - protein, 9 aa, Homo Sapiens
GGVRASRLL

SEQ ID NO: 925777 - protein, 9 aa, Homo Sapiens
RCQHKREHI

SEQ ID NO: 925778 - protein, 9 aa, Homo Sapiens
EEEVKFGAR

SEQ ID NO: 925779 - protein, 9 aa, Homo Sapiens
LLPLNGELV

SEQ ID NO: 925780 - protein, 9 aa, Homo Sapiens
TKLEQVKLM

SEQ ID NO: 925781 - protein, 9 aa, Homo Sapiens
NPVFKSFEK

SEQ ID NO: 925782 - protein, 9 aa, Homo Sapiens
LGLLKLTWF

SEQ ID NO: 925783 - protein, 9 aa, Homo Sapiens
QFSQGSEEY

SEQ ID NO: 925784 - protein, 9 aa, Homo Sapiens
CVRSLELDD

SEQ ID NO: 925785 - protein, 9 aa, Homo Sapiens
AGPASGLNK

SEQ ID NO: 925786 - protein, 9 aa, Homo Sapiens
CFTLSESQR

SEQ ID NO: 925787 - protein, 9 aa, Homo Sapiens
AAVLLGGVR

SEQ ID NO: 925788 - protein, 9 aa, Homo Sapiens
DHFFCDIYL

SEQ ID NO: 925789 - protein, 9 aa, Homo Sapiens
VHHQKGKDK

SEQ ID NO: 925790 - protein, 9 aa, Homo Sapiens
IACNTKQLN

SEQ ID NO: 925791 - protein, 9 aa, Homo Sapiens
LRQRYQEPN

SEQ ID NO: 925792 - protein, 9 aa, Homo Sapiens
EVQESPRCK

SEQ ID NO: 925793 - protein, 9 aa, Homo Sapiens
RLKHQCPSH

SEQ ID NO: 925794 - protein, 9 aa, Homo Sapiens
SLEKIEANA

SEQ ID NO: 925795 - protein, 9 aa, Homo Sapiens
VLELSEALD

SEQ ID NO: 925796 - protein, 9 aa, Homo Sapiens
AGTAYIQTQ

SEQ ID NO: 925797 - protein, 9 aa, Homo Sapiens
TFHCKMSEY

SEQ ID NO: 925798 - protein, 9 aa, Homo Sapiens
SAVGKFSLV

SEQ ID NO: 925799 - protein, 9 aa, Homo Sapiens
VYAVVYGAE

SEQ ID NO: 925800 - protein, 9 aa, Homo Sapiens
CCFGTPLGE

SEQ ID NO: 925801 - protein, 9 aa, Homo Sapiens
SVQQVLTII

SEQ ID NO: 925802 - protein, 9 aa, Homo Sapiens
AEDSRAAPG

SEQ ID NO: 925803 - protein, 9 aa, Homo Sapiens
NMSGQRNIP

SEQ ID NO: 925804 - protein, 9 aa, Homo Sapiens
PPGLPEKHG

SEQ ID NO: 925805 - protein, 9 aa, Homo Sapiens
ELEMDLESQ

SEQ ID NO: 925806 - protein, 9 aa, Homo Sapiens
ESPSPPYSR

SEQ ID NO: 925807 - protein, 9 aa, Homo Sapiens
DTPPEDSIS

SEQ ID NO: 925808 - protein, 9 aa, Homo Sapiens
EKEKFLMDK

SEQ ID NO: 925809 - protein, 9 aa, Homo Sapiens
ARAPIIRVR

SEQ ID NO: 925810 - protein, 9 aa, Homo Sapiens
LPLWGVPLH

SEQ ID NO: 925811 - protein, 9 aa, Homo Sapiens
ANVAVTQPE

SEQ ID NO: 925812 - protein, 9 aa, Homo Sapiens
PSPRGWHAG

SEQ ID NO: 925813 - protein, 9 aa, Homo Sapiens
WDVFNMDFP

SEQ ID NO: 925814 - protein, 9 aa, Homo Sapiens
NDGTSSANF

SEQ ID NO: 925815 - protein, 9 aa, Homo Sapiens
DAEGNFNPR

SEQ ID NO: 925816 - protein, 9 aa, Homo Sapiens
GTNVLQDHN

SEQ ID NO: 925817 - protein, 9 aa, Homo Sapiens
PNVMLLAYL

SEQ ID NO: 925818 - protein, 9 aa, Homo Sapiens
VIGFPDLMS

SEQ ID NO: 925819 - protein, 9 aa, Homo Sapiens
TLDPSKLFW

SEQ ID NO: 925820 - protein, 9 aa, Homo Sapiens
LKLRCLQKF

SEQ ID NO: 925821 - protein, 9 aa, Homo Sapiens
LRQKDDFGI

SEQ ID NO: 925822 - protein, 9 aa, Homo Sapiens
YGFHFEGCL

SEQ ID NO: 925823 - protein, 9 aa, Homo Sapiens
RIQKLIKEM

SEQ ID NO: 925824 - protein, 9 aa, Homo Sapiens
CDSSDPDTS

SEQ ID NO: 925825 - protein, 9 aa, Homo Sapiens
DRCKAICKP

SEQ ID NO: 925826 - protein, 9 aa, Homo Sapiens
DPSKLFWGP

SEQ ID NO: 925827 - protein, 9 aa, Homo Sapiens
NSERRSKSL

SEQ ID NO: 925828 - protein, 9 aa, Homo Sapiens
SISTRPTCS

SEQ ID NO: 925829 - protein, 9 aa, Homo Sapiens
EAAVRVDFN

SEQ ID NO: 925830 - protein, 9 aa, Homo Sapiens
TGEKSYICF

SEQ ID NO: 925831 - protein, 9 aa, Homo Sapiens
QLQELWREL

SEQ ID NO: 925832 - protein, 9 aa, Homo Sapiens
LAGLTLLCA

SEQ ID NO: 925833 - protein, 9 aa, Homo Sapiens
DRELVYTIP

SEQ ID NO: 925834 - protein, 9 aa, Homo Sapiens
SDEDESESV

SEQ ID NO: 925835 - protein, 9 aa, Homo Sapiens
KNYPDSVSI

SEQ ID NO: 925836 - protein, 9 aa, Homo Sapiens
GWAAEECRI

SEQ ID NO: 925837 - protein, 9 aa, Homo Sapiens
LFSSLQIKA

SEQ ID NO: 925838 - protein, 9 aa, Homo Sapiens
LPDNTTASR

SEQ ID NO: 925839 - protein, 9 aa, Homo Sapiens
RGEPGLRGP

SEQ ID NO: 925840 - protein, 9 aa, Homo Sapiens
VLRAAILVT

SEQ ID NO: 925841 - protein, 9 aa, Homo Sapiens
QWKDSSLAT

SEQ ID NO: 925842 - protein, 9 aa, Homo Sapiens
SLPRDLRCF

SEQ ID NO: 925843 - protein, 9 aa, Homo Sapiens
LHKDEENEA

SEQ ID NO: 925844 - protein, 9 aa, Homo Sapiens
ITIAIYVGG

SEQ ID NO: 925845 - protein, 9 aa, Homo Sapiens
EDVPDSVNF

SEQ ID NO: 925846 - protein, 9 aa, Homo Sapiens
PVSGSGGCS

SEQ ID NO: 925847 - protein, 9 aa, Homo Sapiens
QQIQADPEL

SEQ ID NO: 925848 - protein, 9 aa, Homo Sapiens
LENQPLKEN

SEQ ID NO: 925849 - protein, 9 aa, Homo Sapiens
RRSKSYLSH

SEQ ID NO: 925850 - protein, 9 aa, Homo Sapiens
VQQVLTIIK

SEQ ID NO: 925851 - protein, 9 aa, Homo Sapiens
QHKREHILG

SEQ ID NO: 925852 - protein, 9 aa, Homo Sapiens
REKMGIPGA

SEQ ID NO: 925853 - protein, 9 aa, Homo Sapiens
EKAAKENSQ

SEQ ID NO: 925854 - protein, 9 aa, Homo Sapiens
TDISEYYWL

SEQ ID NO: 925855 - protein, 9 aa, Homo Sapiens
VQREWQEIR

SEQ ID NO: 925856 - protein, 9 aa, Homo Sapiens
LLGQIEEEG

SEQ ID NO: 925857 - protein, 9 aa, Homo Sapiens
GESVKVQLC

SEQ ID NO: 925858 - protein, 9 aa, Homo Sapiens
KIPAVKESD

SEQ ID NO: 925859 - protein, 9 aa, Homo Sapiens
APQAVFPSI

SEQ ID NO: 925860 - protein, 9 aa, Homo Sapiens
TVKTPKDKK

SEQ ID NO: 925861 - protein, 9 aa, Homo Sapiens
FYVFSESIR

SEQ ID NO: 925862 - protein, 9 aa, Homo Sapiens
DDQVFSMNP

SEQ ID NO: 925863 - protein, 9 aa, Homo Sapiens
VYHMKSAEE

SEQ ID NO: 925864 - protein, 9 aa, Homo Sapiens
KENRVSPTM

SEQ ID NO: 925865 - protein, 9 aa, Homo Sapiens
TGPAEEANS

SEQ ID NO: 925866 - protein, 9 aa, Homo Sapiens
RVDAICIHH

SEQ ID NO: 925867 - protein, 9 aa, Homo Sapiens
SPSTAFQAH

SEQ ID NO: 925868 - protein, 9 aa, Homo Sapiens
VSAPKGILR

SEQ ID NO: 925869 - protein, 9 aa, Homo Sapiens
KDDFNKTGL

SEQ ID NO: 925870 - protein, 9 aa, Homo Sapiens
MSEYPLPKI

SEQ ID NO: 925871 - protein, 9 aa, Homo Sapiens
VTKSEHMTE

SEQ ID NO: 925872 - protein, 9 aa, Homo Sapiens
HVAQACVRH

SEQ ID NO: 925873 - protein, 9 aa, Homo Sapiens
KCKLLEKFN

SEQ ID NO: 925874 - protein, 9 aa, Homo Sapiens
DEIIPCHCC

SEQ ID NO: 925875 - protein, 9 aa, Homo Sapiens
QLQPLLDGF

SEQ ID NO: 925876 - protein, 9 aa, Homo Sapiens
KSIDDEALW

SEQ ID NO: 925877 - protein, 9 aa, Homo Sapiens
TKGFYCLWD

SEQ ID NO: 925878 - protein, 9 aa, Homo Sapiens
EGTETALAE

SEQ ID NO: 925879 - protein, 9 aa, Homo Sapiens
KREKMGIPG

SEQ ID NO: 925880 - protein, 9 aa, Homo Sapiens
SPWKSPGQR

SEQ ID NO: 925881 - protein, 9 aa, Homo Sapiens
PYRGMKESE

SEQ ID NO: 925882 - protein, 9 aa, Homo Sapiens
SQKFSRVPL

SEQ ID NO: 925883 - protein, 9 aa, Homo Sapiens
NSLASLNTL

SEQ ID NO: 925884 - protein, 9 aa, Homo Sapiens
KTHREGDVY

SEQ ID NO: 925885 - protein, 9 aa, Homo Sapiens
IIGFYTLVL

SEQ ID NO: 925886 - protein, 9 aa, Homo Sapiens
LRLLVTKSE

SEQ ID NO: 925887 - protein, 9 aa, Homo Sapiens
REENQEDKA

SEQ ID NO: 925888 - protein, 9 aa, Homo Sapiens
NFFCLLSQG

SEQ ID NO: 925889 - protein, 9 aa, Homo Sapiens
QGSPPPPPG

SEQ ID NO: 925890 - protein, 9 aa, Homo Sapiens
MENKTVSEL

SEQ ID NO: 925891 - protein, 9 aa, Homo Sapiens
CCESASIVS

SEQ ID NO: 925892 - protein, 9 aa, Homo Sapiens
MAAVLLGGV

SEQ ID NO: 925893 - protein, 9 aa, Homo Sapiens
KDEIIPCHC

SEQ ID NO: 925894 - protein, 9 aa, Homo Sapiens
KTEQEKSHR

SEQ ID NO: 925895 - protein, 9 aa, Homo Sapiens
AASLLLPAP

SEQ ID NO: 925896 - protein, 9 aa, Homo Sapiens
LKAFREAHS

SEQ ID NO: 925897 - protein, 9 aa, Homo Sapiens
PPEPPGIPG

SEQ ID NO: 925898 - protein, 9 aa, Homo Sapiens
LLKISYSKS

SEQ ID NO: 925899 - protein, 9 aa, Homo Sapiens
QVQCEQVHC

SEQ ID NO: 925900 - protein, 9 aa, Homo Sapiens
SCDSPILSV

SEQ ID NO: 925901 - protein, 9 aa, Homo Sapiens
NDSLFVSLN

SEQ ID NO: 925902 - protein, 9 aa, Homo Sapiens
KEVQQLSVL

SEQ ID NO: 925903 - protein, 9 aa, Homo Sapiens
SPSSSTFIS

SEQ ID NO: 925904 - protein, 9 aa, Homo Sapiens
PTPPFFSFS

SEQ ID NO: 925905 - protein, 9 aa, Homo Sapiens
ADCKNKFCC

SEQ ID NO: 925906 - protein, 9 aa, Homo Sapiens
GTPRKGTRT

SEQ ID NO: 925907 - protein, 9 aa, Homo Sapiens
LATWSFPAL

SEQ ID NO: 925908 - protein, 9 aa, Homo Sapiens
SMRSGAGVQ

SEQ ID NO: 925909 - protein, 9 aa, Homo Sapiens
GPKSDPGLP

SEQ ID NO: 925910 - protein, 9 aa, Homo Sapiens
MRSGAGVQA

SEQ ID NO: 925911 - protein, 9 aa, Homo Sapiens
SKDELVMKI

SEQ ID NO: 925912 - protein, 9 aa, Homo Sapiens
KKLYGINLS

SEQ ID NO: 925913 - protein, 9 aa, Homo Sapiens
DSVSPANPS

SEQ ID NO: 925914 - protein, 9 aa, Homo Sapiens
PGIEIAEIM

SEQ ID NO: 925915 - protein, 9 aa, Homo Sapiens
AQAALAEVQ

SEQ ID NO: 925916 - protein, 9 aa, Homo Sapiens
IGFYTLVLK

SEQ ID NO: 925917 - protein, 9 aa, Homo Sapiens
KQLLKSSAD

SEQ ID NO: 925918 - protein, 9 aa, Homo Sapiens
KRNSERRSK

SEQ ID NO: 925919 - protein, 9 aa, Homo Sapiens
LLTCHGSGP

SEQ ID NO: 925920 - protein, 9 aa, Homo Sapiens
SGVGINQPP

SEQ ID NO: 925921 - protein, 9 aa, Homo Sapiens
KTRAEVLHM

SEQ ID NO: 925922 - protein, 9 aa, Homo Sapiens
FHRFNEDCV

SEQ ID NO: 925923 - protein, 9 aa, Homo Sapiens
NIASLCVGH

SEQ ID NO: 925924 - protein, 9 aa, Homo Sapiens
SRLLEASMP

SEQ ID NO: 925925 - protein, 9 aa, Homo Sapiens
AEENPMVEA

SEQ ID NO: 925926 - protein, 9 aa, Homo Sapiens
IDSLEKIEA

SEQ ID NO: 925927 - protein, 9 aa, Homo Sapiens
GQIKRLTSW

SEQ ID NO: 925928 - protein, 9 aa, Homo Sapiens
SGTQASDSE

SEQ ID NO: 925929 - protein, 9 aa, Homo Sapiens
SFKEDLAGP

SEQ ID NO: 925930 - protein, 9 aa, Homo Sapiens
PSASASRHP

SEQ ID NO: 925931 - protein, 9 aa, Homo Sapiens
GPYGPKRDV

SEQ ID NO: 925932 - protein, 9 aa, Homo Sapiens
KEFIPCPTE

SEQ ID NO: 925933 - protein, 9 aa, Homo Sapiens
LLKLTWFLL

SEQ ID NO: 925934 - protein, 9 aa, Homo Sapiens
RRSNLVKHG

SEQ ID NO: 925935 - protein, 9 aa, Homo Sapiens
GFWNPHTEA

SEQ ID NO: 925936 - protein, 9 aa, Homo Sapiens
PWVLLVTKQ

SEQ ID NO: 925937 - protein, 9 aa, Homo Sapiens
AAHLNSVSK

SEQ ID NO: 925938 - protein, 9 aa, Homo Sapiens
GFYCLWDSG

SEQ ID NO: 925939 - protein, 9 aa, Homo Sapiens
EHSPRNWGH

SEQ ID NO: 925940 - protein, 9 aa, Homo Sapiens
YPPLNTFRD

SEQ ID NO: 925941 - protein, 9 aa, Homo Sapiens
LSISTRPTC

SEQ ID NO: 925942 - protein, 9 aa, Homo Sapiens
SSVQQVLTI

SEQ ID NO: 925943 - protein, 9 aa, Homo Sapiens
GFNEYFPFR

SEQ ID NO: 925944 - protein, 9 aa, Homo Sapiens
MEMPFIKEP

SEQ ID NO: 925945 - protein, 9 aa, Homo Sapiens
VNYTVIECE

SEQ ID NO: 925946 - protein, 9 aa, Homo Sapiens
VILACLITG

SEQ ID NO: 925947 - protein, 9 aa, Homo Sapiens
SRVPLPRRE

SEQ ID NO: 925948 - protein, 9 aa, Homo Sapiens
NWKVWVFSI

SEQ ID NO: 925949 - protein, 9 aa, Homo Sapiens
ALHKDEENE

SEQ ID NO: 925950 - protein, 9 aa, Homo Sapiens
GSTKLEQVK

SEQ ID NO: 925951 - protein, 9 aa, Homo Sapiens
EKHEEMFQR

SEQ ID NO: 925952 - protein, 9 aa, Homo Sapiens
NFFRGQLQV

SEQ ID NO: 925953 - protein, 9 aa, Homo Sapiens
CDKENKIFK

SEQ ID NO: 925954 - protein, 9 aa, Homo Sapiens
IKKLLKISY

SEQ ID NO: 925955 - protein, 9 aa, Homo Sapiens
ILVCQLYQG

SEQ ID NO: 925956 - protein, 9 aa, Homo Sapiens
HIRAVIESE

SEQ ID NO: 925957 - protein, 9 aa, Homo Sapiens
PKDKKDFSV

SEQ ID NO: 925958 - protein, 9 aa, Homo Sapiens
SGAARNFHS

SEQ ID NO: 925959 - protein, 9 aa, Homo Sapiens
LWDVFNMDF

SEQ ID NO: 925960 - protein, 9 aa, Homo Sapiens
VQPVVPRPE

SEQ ID NO: 925961 - protein, 9 aa, Homo Sapiens
DSEPFHENL

SEQ ID NO: 925962 - protein, 9 aa, Homo Sapiens
LAPTSQKEG

SEQ ID NO: 925963 - protein, 9 aa, Homo Sapiens
LLASLLVDI

SEQ ID NO: 925964 - protein, 9 aa, Homo Sapiens
KDERESSLS

SEQ ID NO: 925965 - protein, 9 aa, Homo Sapiens
KTVSELNQT

SEQ ID NO: 925966 - protein, 9 aa, Homo Sapiens
EDSRAAPGP

SEQ ID NO: 925967 - protein, 9 aa, Homo Sapiens
SQGSGKEED

SEQ ID NO: 925968 - protein, 9 aa, Homo Sapiens
ARAWSSVFD

SEQ ID NO: 925969 - protein, 9 aa, Homo Sapiens
KLFWGPYLR

SEQ ID NO: 925970 - protein, 9 aa, Homo Sapiens
RYIAVAVHN

SEQ ID NO: 925971 - protein, 9 aa, Homo Sapiens
LSIYKLIAL

SEQ ID NO: 925972 - protein, 9 aa, Homo Sapiens
FLGSSDSLA

SEQ ID NO: 925973 - protein, 9 aa, Homo Sapiens
FKTPRKVKP

SEQ ID NO: 925974 - protein, 9 aa, Homo Sapiens
NDNHLTKLS

SEQ ID NO: 925975 - protein, 9 aa, Homo Sapiens
RRRSSLYSQ

SEQ ID NO: 925976 - protein, 9 aa, Homo Sapiens
IFYFIILPE

SEQ ID NO: 925977 - protein, 9 aa, Homo Sapiens
QELWRELDR

SEQ ID NO: 925978 - protein, 9 aa, Homo Sapiens
RTDISEYYW

SEQ ID NO: 925979 - protein, 9 aa, Homo Sapiens
TCHGSGPDN

SEQ ID NO: 925980 - protein, 9 aa, Homo Sapiens
CQHKREHIL

SEQ ID NO: 925981 - protein, 9 aa, Homo Sapiens
TREEVLQLS

SEQ ID NO: 925982 - protein, 9 aa, Homo Sapiens
DAALHKPMY

SEQ ID NO: 925983 - protein, 9 aa, Homo Sapiens
TYSLGQVYN

SEQ ID NO: 925984 - protein, 9 aa, Homo Sapiens
ITKSSCVVN

SEQ ID NO: 925985 - protein, 9 aa, Homo Sapiens
HCCVLAACS

SEQ ID NO: 925986 - protein, 9 aa, Homo Sapiens
YTTEFDVWA

SEQ ID NO: 925987 - protein, 9 aa, Homo Sapiens
YLGNIASLC

SEQ ID NO: 925988 - protein, 9 aa, Homo Sapiens
LGASLGGII

SEQ ID NO: 925989 - protein, 9 aa, Homo Sapiens
HRTQVPQFL

SEQ ID NO: 925990 - protein, 9 aa, Homo Sapiens
FYISTDFSS

SEQ ID NO: 925991 - protein, 9 aa, Homo Sapiens
IIRRRLSAY

SEQ ID NO: 925992 - protein, 9 aa, Homo Sapiens
GLTLLCAVG

SEQ ID NO: 925993 - protein, 9 aa, Homo Sapiens
PFLDGILDV

SEQ ID NO: 925994 - protein, 9 aa, Homo Sapiens
QLDLANITL

SEQ ID NO: 925995 - protein, 9 aa, Homo Sapiens
HLDYSSKSF

SEQ ID NO: 925996 - protein, 9 aa, Homo Sapiens
PWSFPKGSE

SEQ ID NO: 925997 - protein, 9 aa, Homo Sapiens
AVCLAPTTM

SEQ ID NO: 925998 - protein, 9 aa, Homo Sapiens
QQGSPPPPP

SEQ ID NO: 925999 - protein, 9 aa, Homo Sapiens
SYQIKMCSQ

SEQ ID NO: 926000 - protein, 9 aa, Homo Sapiens
VAVSAPKGI

SEQ ID NO: 926001 - protein, 9 aa, Homo Sapiens
LTEHTLILV

SEQ ID NO: 926002 - protein, 9 aa, Homo Sapiens
FLRLLVTKS

SEQ ID NO: 926003 - protein, 9 aa, Homo Sapiens
KCYCHMGTH

SEQ ID NO: 926004 - protein, 9 aa, Homo Sapiens
NPVVEVEVS

SEQ ID NO: 926005 - protein, 9 aa, Homo Sapiens
ERDRAERKK

SEQ ID NO: 926006 - protein, 9 aa, Homo Sapiens
YRPQDRIVS

SEQ ID NO: 926007 - protein, 9 aa, Homo Sapiens
QLSEFTIES

SEQ ID NO: 926008 - protein, 9 aa, Homo Sapiens
MEKEKHNQL

SEQ ID NO: 926009 - protein, 9 aa, Homo Sapiens
LEMDLESQN

SEQ ID NO: 926010 - protein, 9 aa, Homo Sapiens
EDQPLVLLP

SEQ ID NO: 926011 - protein, 9 aa, Homo Sapiens
YFGCPEDRA

SEQ ID NO: 926012 - protein, 9 aa, Homo Sapiens
LSWPDRSCT

SEQ ID NO: 926013 - protein, 9 aa, Homo Sapiens
DRYVAICHS

SEQ ID NO: 926014 - protein, 9 aa, Homo Sapiens
VLVTAICLL

SEQ ID NO: 926015 - protein, 9 aa, Homo Sapiens
HRAQTPRTG

SEQ ID NO: 926016 - protein, 9 aa, Homo Sapiens
LLKSSADFL

SEQ ID NO: 926017 - protein, 9 aa, Homo Sapiens
AEQFCQALG

SEQ ID NO: 926018 - protein, 9 aa, Homo Sapiens
LTSPSTAFQ

SEQ ID NO: 926019 - protein, 9 aa, Homo Sapiens
WPQMHLLDG

SEQ ID NO: 926020 - protein, 9 aa, Homo Sapiens
SREENQEDK

SEQ ID NO: 926021 - protein, 9 aa, Homo Sapiens
SFICKTRVA

SEQ ID NO: 926022 - protein, 9 aa, Homo Sapiens
GAATRVDAI

SEQ ID NO: 926023 - protein, 9 aa, Homo Sapiens
PVVPRPEAL

SEQ ID NO: 926024 - protein, 9 aa, Homo Sapiens
FKGDPKDDF

SEQ ID NO: 926025 - protein, 9 aa, Homo Sapiens
TTDAAGFKR

SEQ ID NO: 926026 - protein, 9 aa, Homo Sapiens
INLDAASFS

SEQ ID NO: 926027 - protein, 9 aa, Homo Sapiens
ELEAEPPKM

SEQ ID NO: 926028 - protein, 9 aa, Homo Sapiens
ANVVVLVAV

SEQ ID NO: 926029 - protein, 9 aa, Homo Sapiens
SDAHIPVLF

SEQ ID NO: 926030 - protein, 9 aa, Homo Sapiens
NMAMFCCKK

SEQ ID NO: 926031 - protein, 9 aa, Homo Sapiens
DESESVDEV

SEQ ID NO: 926032 - protein, 9 aa, Homo Sapiens
CFLNLVDHG

SEQ ID NO: 926033 - protein, 9 aa, Homo Sapiens
CDTSSNKDV

SEQ ID NO: 926034 - protein, 9 aa, Homo Sapiens
QKPYRGMKE

SEQ ID NO: 926035 - protein, 9 aa, Homo Sapiens
FKEDLAGPS

SEQ ID NO: 926036 - protein, 9 aa, Homo Sapiens
SHRSCHPPG

SEQ ID NO: 926037 - protein, 9 aa, Homo Sapiens
GIVDNEDSV

SEQ ID NO: 926038 - protein, 9 aa, Homo Sapiens
DLGLEKNGT

SEQ ID NO: 926039 - protein, 9 aa, Homo Sapiens
SAVDGTAKN

SEQ ID NO: 926040 - protein, 9 aa, Homo Sapiens
GRLLGQIEE

SEQ ID NO: 926041 - protein, 9 aa, Homo Sapiens
DMASTPKKE

SEQ ID NO: 926042 - protein, 9 aa, Homo Sapiens
LNVDYGLKV

SEQ ID NO: 926043 - protein, 9 aa, Homo Sapiens
CHSLCYSTV

SEQ ID NO: 926044 - protein, 9 aa, Homo Sapiens
CGFEQPSEV

SEQ ID NO: 926045 - protein, 9 aa, Homo Sapiens
IKRLTSWPG

SEQ ID NO: 926046 - protein, 9 aa, Homo Sapiens
SESVDEVFD

SEQ ID NO: 926047 - protein, 9 aa, Homo Sapiens
MHRVAPCSG

SEQ ID NO: 926048 - protein, 9 aa, Homo Sapiens
KAAKENSQP

SEQ ID NO: 926049 - protein, 9 aa, Homo Sapiens
LKTQKKGKI

SEQ ID NO: 926050 - protein, 9 aa, Homo Sapiens
AHEQLTSPS

SEQ ID NO: 926051 - protein, 9 aa, Homo Sapiens
GDVYFDYDE

SEQ ID NO: 926052 - protein, 9 aa, Homo Sapiens
KSQKLWDVF

SEQ ID NO: 926053 - protein, 9 aa, Homo Sapiens
NLANVIYKE

SEQ ID NO: 926054 - protein, 9 aa, Homo Sapiens
REKEKQLKT

SEQ ID NO: 926055 - protein, 9 aa, Homo Sapiens
KRQFRSLRH

SEQ ID NO: 926056 - protein, 9 aa, Homo Sapiens
AANVAVTQP

SEQ ID NO: 926057 - protein, 9 aa, Homo Sapiens
SLASASPVA

SEQ ID NO: 926058 - protein, 9 aa, Homo Sapiens
LQAEDKAIS

SEQ ID NO: 926059 - protein, 9 aa, Homo Sapiens
GPSTAEITC

SEQ ID NO: 926060 - protein, 9 aa, Homo Sapiens
NISLRCPVS

SEQ ID NO: 926061 - protein, 9 aa, Homo Sapiens
ASFLEDLQY

SEQ ID NO: 926062 - protein, 9 aa, Homo Sapiens
YEPARGSPS

SEQ ID NO: 926063 - protein, 9 aa, Homo Sapiens
QGMMRGMHQ

SEQ ID NO: 926064 - protein, 9 aa, Homo Sapiens
SNGALVCAF

SEQ ID NO: 926065 - protein, 9 aa, Homo Sapiens
SPIYDSVSP

SEQ ID NO: 926066 - protein, 9 aa, Homo Sapiens
ESPRCKICR

SEQ ID NO: 926067 - protein, 9 aa, Homo Sapiens
SVAMFWVSN

SEQ ID NO: 926068 - protein, 9 aa, Homo Sapiens
DETEYEYIG

SEQ ID NO: 926069 - protein, 9 aa, Homo Sapiens
QKGKDKGVV

SEQ ID NO: 926070 - protein, 9 aa, Homo Sapiens
LVLYGASNE

SEQ ID NO: 926071 - protein, 9 aa, Homo Sapiens
KTDGTCLFS

SEQ ID NO: 926072 - protein, 9 aa, Homo Sapiens
RNYFSVPLS

SEQ ID NO: 926073 - protein, 9 aa, Homo Sapiens
DRAERKKKQ

SEQ ID NO: 926074 - protein, 9 aa, Homo Sapiens
STAEITCKD

SEQ ID NO: 926075 - protein, 9 aa, Homo Sapiens
VTITNNFGS

SEQ ID NO: 926076 - protein, 9 aa, Homo Sapiens
DDITVSSNE

SEQ ID NO: 926077 - protein, 9 aa, Homo Sapiens
VRGALKAPS

SEQ ID NO: 926078 - protein, 9 aa, Homo Sapiens
GYTVADLSD

SEQ ID NO: 926079 - protein, 9 aa, Homo Sapiens
RAVIESEFI

SEQ ID NO: 926080 - protein, 9 aa, Homo Sapiens
VEFLPDLRA

SEQ ID NO: 926081 - protein, 9 aa, Homo Sapiens
LVANLMVWV

SEQ ID NO: 926082 - protein, 9 aa, Homo Sapiens
GGITKLVVL

SEQ ID NO: 926083 - protein, 9 aa, Homo Sapiens
LATQSNENT

SEQ ID NO: 926084 - protein, 9 aa, Homo Sapiens
TIRPPPSLS

SEQ ID NO: 926085 - protein, 9 aa, Homo Sapiens
KMLSSVSED

SEQ ID NO: 926086 - protein, 9 aa, Homo Sapiens
EDIVEVQES

SEQ ID NO: 926087 - protein, 9 aa, Homo Sapiens
KFYMNSVSF

SEQ ID NO: 926088 - protein, 9 aa, Homo Sapiens
GLLSHRSCH

SEQ ID NO: 926089 - protein, 9 aa, Homo Sapiens
DGSPDMAEN

SEQ ID NO: 926090 - protein, 9 aa, Homo Sapiens
KLGSNSPPQ

SEQ ID NO: 926091 - protein, 9 aa, Homo Sapiens
FGLATMKSR

SEQ ID NO: 926092 - protein, 9 aa, Homo Sapiens
VPRPEALAK

SEQ ID NO: 926093 - protein, 9 aa, Homo Sapiens
LVTKSEHMT

SEQ ID NO: 926094 - protein, 9 aa, Homo Sapiens
CLWDSGRDR

SEQ ID NO: 926095 - protein, 9 aa, Homo Sapiens
RSGAGVQAA

SEQ ID NO: 926096 - protein, 9 aa, Homo Sapiens
SPDMAENES

SEQ ID NO: 926097 - protein, 9 aa, Homo Sapiens
PSGTQNEFI

SEQ ID NO: 926098 - protein, 9 aa, Homo Sapiens
VQERIAKNH

SEQ ID NO: 926099 - protein, 9 aa, Homo Sapiens
REHFSNLAQ

SEQ ID NO: 926100 - protein, 9 aa, Homo Sapiens
VLHMCVEHS

SEQ ID NO: 926101 - protein, 9 aa, Homo Sapiens
GSGPDNCTK

SEQ ID NO: 926102 - protein, 9 aa, Homo Sapiens
FNLSWPDRS

SEQ ID NO: 926103 - protein, 9 aa, Homo Sapiens
VSSNEKHLF

SEQ ID NO: 926104 - protein, 9 aa, Homo Sapiens
VKKKLVIES

SEQ ID NO: 926105 - protein, 9 aa, Homo Sapiens
YRISGVGIN

SEQ ID NO: 926106 - protein, 9 aa, Homo Sapiens
AVLVHRKAW

SEQ ID NO: 926107 - protein, 9 aa, Homo Sapiens
SQASPNGPP

SEQ ID NO: 926108 - protein, 9 aa, Homo Sapiens
QRSLSAELK

SEQ ID NO: 926109 - protein, 9 aa, Homo Sapiens
ILPWVLLVT

SEQ ID NO: 926110 - protein, 9 aa, Homo Sapiens
KHQCPSHRA

SEQ ID NO: 926111 - protein, 9 aa, Homo Sapiens
SHCPREAVL

SEQ ID NO: 926112 - protein, 9 aa, Homo Sapiens
HRSCHPPGI

SEQ ID NO: 926113 - protein, 9 aa, Homo Sapiens
RNWGHLDQL

SEQ ID NO: 926114 - protein, 9 aa, Homo Sapiens
HIQEDLQQL

SEQ ID NO: 926115 - protein, 9 aa, Homo Sapiens
RQEDRLIRG

SEQ ID NO: 926116 - protein, 9 aa, Homo Sapiens
LPENFLIIF

SEQ ID NO: 926117 - protein, 9 aa, Homo Sapiens
VIECETSPA

SEQ ID NO: 926118 - protein, 9 aa, Homo Sapiens
EFDVWAYGV

SEQ ID NO: 926119 - protein, 9 aa, Homo Sapiens
INSLPRDLR

SEQ ID NO: 926120 - protein, 9 aa, Homo Sapiens
FSAEYLYST

SEQ ID NO: 926121 - protein, 9 aa, Homo Sapiens
NGELVLASG

SEQ ID NO: 926122 - protein, 9 aa, Homo Sapiens
THSGEKLYP

SEQ ID NO: 926123 - protein, 9 aa, Homo Sapiens
FQVKIEREQ

SEQ ID NO: 926124 - protein, 9 aa, Homo Sapiens
AVRTQYKLI

SEQ ID NO: 926125 - protein, 8 aa, Homo Sapiens
EGERRASQ

SEQ ID NO: 926126 - protein, 9 aa, Homo Sapiens
VPPCQTPKR

SEQ ID NO: 926127 - protein, 9 aa, Homo Sapiens
EHRGCDSSD

SEQ ID NO: 926128 - protein, 9 aa, Homo Sapiens
NPKANQEKM

SEQ ID NO: 926129 - protein, 9 aa, Homo Sapiens
RIAKNHGSQ

SEQ ID NO: 926130 - protein, 9 aa, Homo Sapiens
QLNCFPVLL

SEQ ID NO: 926131 - protein, 9 aa, Homo Sapiens
DVQFNNRHM

SEQ ID NO: 926132 - protein, 9 aa, Homo Sapiens
QIKEVDKFG

SEQ ID NO: 926133 - protein, 9 aa, Homo Sapiens
PRGWHAGGD

SEQ ID NO: 926134 - protein, 9 aa, Homo Sapiens
WFHAWSQEA

SEQ ID NO: 926135 - protein, 9 aa, Homo Sapiens
EQDSLSIST

SEQ ID NO: 926136 - protein, 9 aa, Homo Sapiens
QGNAVNSVW

SEQ ID NO: 926137 - protein, 9 aa, Homo Sapiens
LSLLKSKFK

SEQ ID NO: 926138 - protein, 9 aa, Homo Sapiens
KEGLDRFQA

SEQ ID NO: 926139 - protein, 9 aa, Homo Sapiens
YAEAAKVAV

SEQ ID NO: 926140 - protein, 9 aa, Homo Sapiens
MDLKYVSAT

SEQ ID NO: 926141 - protein, 9 aa, Homo Sapiens
PGVAGKSDE

SEQ ID NO: 926142 - protein, 9 aa, Homo Sapiens
PWKSPGQRA

SEQ ID NO: 926143 - protein, 9 aa, Homo Sapiens
DYIFSSYTA

SEQ ID NO: 926144 - protein, 9 aa, Homo Sapiens
IAKNHGSQC

SEQ ID NO: 926145 - protein, 9 aa, Homo Sapiens
TVATEKKFF

SEQ ID NO: 926146 - protein, 9 aa, Homo Sapiens
PRQSMIKYL

SEQ ID NO: 926147 - protein, 9 aa, Homo Sapiens
LGHLPLQEE

SEQ ID NO: 926148 - protein, 9 aa, Homo Sapiens
RPYCHFHGG

SEQ ID NO: 926149 - protein, 9 aa, Homo Sapiens
VKLFQLKEE

SEQ ID NO: 926150 - protein, 9 aa, Homo Sapiens
NGRLLGQIE

SEQ ID NO: 926151 - protein, 9 aa, Homo Sapiens
KAICKPLHY

SEQ ID NO: 926152 - protein, 9 aa, Homo Sapiens
FNDGTSSAN

SEQ ID NO: 926153 - protein, 9 aa, Homo Sapiens
QSFFKISYL

SEQ ID NO: 926154 - protein, 9 aa, Homo Sapiens
RAEENPMVE

SEQ ID NO: 926155 - protein, 9 aa, Homo Sapiens
EEQDLNVDY

SEQ ID NO: 926156 - protein, 9 aa, Homo Sapiens
FFLSIKESA

SEQ ID NO: 926157 - protein, 9 aa, Homo Sapiens
EPLEETETL

SEQ ID NO: 926158 - protein, 9 aa, Homo Sapiens
ESQLKTQKK

SEQ ID NO: 926159 - protein, 9 aa, Homo Sapiens
SDSLASASP

SEQ ID NO: 926160 - protein, 9 aa, Homo Sapiens
CEYSTTDAA

SEQ ID NO: 926161 - protein, 9 aa, Homo Sapiens
LELSEALDS

SEQ ID NO: 926162 - protein, 9 aa, Homo Sapiens
LLHFFAGGC

SEQ ID NO: 926163 - protein, 9 aa, Homo Sapiens
HMKSAEERK

SEQ ID NO: 926164 - protein, 9 aa, Homo Sapiens
ISCFTLSES

SEQ ID NO: 926165 - protein, 9 aa, Homo Sapiens
IFSAEYLYS
